United States Patent 10,058,623 (COMPOSITIONS AND METHODS FOR MODULATING UTRN EXPRESSION) - sequence listing, part 4

SEQ ID NO: 69558 - DNA, 15 bp, Homo sapiens
gaaatagctcaaagc

SEQ ID NO: 69559 - DNA, 15 bp, Homo sapiens
agaaatagctcaaag

SEQ ID NO: 69560 - DNA, 15 bp, Homo sapiens
gagaaatagctcaaa

SEQ ID NO: 69561 - DNA, 15 bp, Homo sapiens
agagaaatagctcaa

SEQ ID NO: 69562 - DNA, 15 bp, Homo sapiens
aagagaaatagctca

SEQ ID NO: 69563 - DNA, 15 bp, Homo sapiens
aaagagaaatagctc

SEQ ID NO: 69564 - DNA, 15 bp, Homo sapiens
aaaagagaaatagct

SEQ ID NO: 69565 - DNA, 15 bp, Homo sapiens
taaaagagaaatagc

SEQ ID NO: 69566 - DNA, 15 bp, Homo sapiens
ttaaaagagaaatag

SEQ ID NO: 69567 - DNA, 15 bp, Homo sapiens
gttaaaagagaaata

SEQ ID NO: 69568 - DNA, 15 bp, Homo sapiens
agttaaaagagaaat

SEQ ID NO: 69569 - DNA, 15 bp, Homo sapiens
aagttaaaagagaaa

SEQ ID NO: 69570 - DNA, 15 bp, Homo sapiens
taagttaaaagagaa

SEQ ID NO: 69571 - DNA, 15 bp, Homo sapiens
ataagttaaaagaga

SEQ ID NO: 69572 - DNA, 15 bp, Homo sapiens
cataagttaaaagag

SEQ ID NO: 69573 - DNA, 15 bp, Homo sapiens
ccataagttaaaaga

SEQ ID NO: 69574 - DNA, 15 bp, Homo sapiens
gccataagttaaaag

SEQ ID NO: 69575 - DNA, 15 bp, Homo sapiens
tgccataagttaaaa

SEQ ID NO: 69576 - DNA, 15 bp, Homo sapiens
ctgccataagttaaa

SEQ ID NO: 69577 - DNA, 15 bp, Homo sapiens
cctgccataagttaa

SEQ ID NO: 69578 - DNA, 15 bp, Homo sapiens
acctgccataagtta

SEQ ID NO: 69579 - DNA, 15 bp, Homo sapiens
cacctgccataagtt

SEQ ID NO: 69580 - DNA, 15 bp, Homo sapiens
acacctgccataagt

SEQ ID NO: 69581 - DNA, 15 bp, Homo sapiens
aacacctgccataag

SEQ ID NO: 69582 - DNA, 15 bp, Homo sapiens
aaacacctgccataa

SEQ ID NO: 69583 - DNA, 15 bp, Homo sapiens
taaacacctgccata

SEQ ID NO: 69584 - DNA, 15 bp, Homo sapiens
ataaacacctgccat

SEQ ID NO: 69585 - DNA, 15 bp, Homo sapiens
aataaacacctgcca

SEQ ID NO: 69586 - DNA, 15 bp, Homo sapiens
gaataaacacctgcc

SEQ ID NO: 69587 - DNA, 15 bp, Homo sapiens
ggaataaacacctgc

SEQ ID NO: 69588 - DNA, 15 bp, Homo sapiens
aggaataaacacctg

SEQ ID NO: 69589 - DNA, 15 bp, Homo sapiens
taggaataaacacct

SEQ ID NO: 69590 - DNA, 15 bp, Homo sapiens
ataggaataaacacc

SEQ ID NO: 69591 - DNA, 15 bp, Homo sapiens
aataggaataaacac

SEQ ID NO: 69592 - DNA, 15 bp, Homo sapiens
aaataggaataaaca

SEQ ID NO: 69593 - DNA, 15 bp, Homo sapiens
aaaataggaataaac

SEQ ID NO: 69594 - DNA, 15 bp, Homo sapiens
gaaaataggaataaa

SEQ ID NO: 69595 - DNA, 15 bp, Homo sapiens
tgaaaataggaataa

SEQ ID NO: 69596 - DNA, 15 bp, Homo sapiens
ctgaaaataggaata

SEQ ID NO: 69597 - DNA, 15 bp, Homo sapiens
tctgaaaataggaat

SEQ ID NO: 69598 - DNA, 15 bp, Homo sapiens
ctctgaaaataggaa

SEQ ID NO: 69599 - DNA, 15 bp, Homo sapiens
tctctgaaaatagga

SEQ ID NO: 69600 - DNA, 15 bp, Homo sapiens
atctctgaaaatagg

SEQ ID NO: 69601 - DNA, 15 bp, Homo sapiens
aatctctgaaaatag

SEQ ID NO: 69602 - DNA, 15 bp, Homo sapiens
taatctctgaaaata

SEQ ID NO: 69603 - DNA, 15 bp, Homo sapiens
ttaatctctgaaaat

SEQ ID NO: 69604 - DNA, 15 bp, Homo sapiens
tttaatctctgaaaa

SEQ ID NO: 69605 - DNA, 15 bp, Homo sapiens
ttttaatctctgaaa

SEQ ID NO: 69606 - DNA, 15 bp, Homo sapiens
tttttaatctctgaa

SEQ ID NO: 69607 - DNA, 15 bp, Homo sapiens
ttttttaatctctga

SEQ ID NO: 69608 - DNA, 15 bp, Homo sapiens
attttttaatctctg

SEQ ID NO: 69609 - DNA, 15 bp, Homo sapiens
cattttttaatctct

SEQ ID NO: 69610 - DNA, 15 bp, Homo sapiens
acattttttaatctc

SEQ ID NO: 69611 - DNA, 15 bp, Homo sapiens
cacattttttaatct

SEQ ID NO: 69612 - DNA, 15 bp, Homo sapiens
ccacattttttaatc

SEQ ID NO: 69613 - DNA, 15 bp, Homo sapiens
accacattttttaat

SEQ ID NO: 69614 - DNA, 15 bp, Homo sapiens
gaccacattttttaa

SEQ ID NO: 69615 - DNA, 15 bp, Homo sapiens
tgaccacatttttta

SEQ ID NO: 69616 - DNA, 15 bp, Homo sapiens
ttgaccacatttttt

SEQ ID NO: 69617 - DNA, 15 bp, Homo sapiens
attgaccacattttt

SEQ ID NO: 69618 - DNA, 15 bp, Homo sapiens
cattgaccacatttt

SEQ ID NO: 69619 - DNA, 15 bp, Homo sapiens
acattgaccacattt

SEQ ID NO: 69620 - DNA, 15 bp, Homo sapiens
gacattgaccacatt

SEQ ID NO: 69621 - DNA, 15 bp, Homo sapiens
agacattgaccacat

SEQ ID NO: 69622 - DNA, 15 bp, Homo sapiens
tagacattgaccaca

SEQ ID NO: 69623 - DNA, 15 bp, Homo sapiens
atagacattgaccac

SEQ ID NO: 69624 - DNA, 15 bp, Homo sapiens
aatagacattgacca

SEQ ID NO: 69625 - DNA, 15 bp, Homo sapiens
aaatagacattgacc

SEQ ID NO: 69626 - DNA, 15 bp, Homo sapiens
aaaatagacattgac

SEQ ID NO: 69627 - DNA, 15 bp, Homo sapiens
taaaatagacattga

SEQ ID NO: 69628 - DNA, 15 bp, Homo sapiens
ataaaatagacattg

SEQ ID NO: 69629 - DNA, 15 bp, Homo sapiens
aataaaatagacatt

SEQ ID NO: 69630 - DNA, 15 bp, Homo sapiens
aaataaaatagacat

SEQ ID NO: 69631 - DNA, 15 bp, Homo sapiens
caaataaaatagaca

SEQ ID NO: 69632 - DNA, 15 bp, Homo sapiens
gcaaataaaatagac

SEQ ID NO: 69633 - DNA, 15 bp, Homo sapiens
cgcaaataaaataga

SEQ ID NO: 69634 - DNA, 15 bp, Homo sapiens
gcgcaaataaaatag

SEQ ID NO: 69635 - DNA, 15 bp, Homo sapiens
agcgcaaataaaata

SEQ ID NO: 69636 - DNA, 15 bp, Homo sapiens
gagcgcaaataaaat

SEQ ID NO: 69637 - DNA, 15 bp, Homo sapiens
agagcgcaaataaaa

SEQ ID NO: 69638 - DNA, 15 bp, Homo sapiens
tagagcgcaaataaa

SEQ ID NO: 69639 - DNA, 15 bp, Homo sapiens
gtagagcgcaaataa

SEQ ID NO: 69640 - DNA, 15 bp, Homo sapiens
agtagagcgcaaata

SEQ ID NO: 69641 - DNA, 15 bp, Homo sapiens
tagtagagcgcaaat

SEQ ID NO: 69642 - DNA, 15 bp, Homo sapiens
ctagtagagcgcaaa

SEQ ID NO: 69643 - DNA, 15 bp, Homo sapiens
cctagtagagcgcaa

SEQ ID NO: 69644 - DNA, 15 bp, Homo sapiens
gcctagtagagcgca

SEQ ID NO: 69645 - DNA, 15 bp, Homo sapiens
agcctagtagagcgc

SEQ ID NO: 69646 - DNA, 15 bp, Homo sapiens
tagcctagtagagcg

SEQ ID NO: 69647 - DNA, 15 bp, Homo sapiens
gtagcctagtagagc

SEQ ID NO: 69648 - DNA, 15 bp, Homo sapiens
ggtagcctagtagag

SEQ ID NO: 69649 - DNA, 15 bp, Homo sapiens
aggtagcctagtaga

SEQ ID NO: 69650 - DNA, 15 bp, Homo sapiens
aaggtagcctagtag

SEQ ID NO: 69651 - DNA, 15 bp, Homo sapiens
aaaggtagcctagta

SEQ ID NO: 69652 - DNA, 15 bp, Homo sapiens
aaaaggtagcctagt

SEQ ID NO: 69653 - DNA, 15 bp, Homo sapiens
aaaaaggtagcctag

SEQ ID NO: 69654 - DNA, 15 bp, Homo sapiens
gaaaaaggtagccta

SEQ ID NO: 69655 - DNA, 15 bp, Homo sapiens
agaaaaaggtagcct

SEQ ID NO: 69656 - DNA, 15 bp, Homo sapiens
cagaaaaaggtagcc

SEQ ID NO: 69657 - DNA, 15 bp, Homo sapiens
gcagaaaaaggtagc

SEQ ID NO: 69658 - DNA, 15 bp, Homo sapiens
tgcagaaaaaggtag

SEQ ID NO: 69659 - DNA, 15 bp, Homo sapiens
atgcagaaaaaggta

SEQ ID NO: 69660 - DNA, 15 bp, Homo sapiens
gatgcagaaaaaggt

SEQ ID NO: 69661 - DNA, 15 bp, Homo sapiens
tgatgcagaaaaagg

SEQ ID NO: 69662 - DNA, 15 bp, Homo sapiens
gtgatgcagaaaaag

SEQ ID NO: 69663 - DNA, 15 bp, Homo sapiens
agtgatgcagaaaaa

SEQ ID NO: 69664 - DNA, 15 bp, Homo sapiens
cagtgatgcagaaaa

SEQ ID NO: 69665 - DNA, 15 bp, Homo sapiens
tcagtgatgcagaaa

SEQ ID NO: 69666 - DNA, 15 bp, Homo sapiens
gtcagtgatgcagaa

SEQ ID NO: 69667 - DNA, 15 bp, Homo sapiens
tgtcagtgatgcaga

SEQ ID NO: 69668 - DNA, 15 bp, Homo sapiens
atgtcagtgatgcag

SEQ ID NO: 69669 - DNA, 15 bp, Homo sapiens
aatgtcagtgatgca

SEQ ID NO: 69670 - DNA, 15 bp, Homo sapiens
aaatgtcagtgatgc

SEQ ID NO: 69671 - DNA, 15 bp, Homo sapiens
taaatgtcagtgatg

SEQ ID NO: 69672 - DNA, 15 bp, Homo sapiens
ctaaatgtcagtgat

SEQ ID NO: 69673 - DNA, 15 bp, Homo sapiens
cctaaatgtcagtga

SEQ ID NO: 69674 - DNA, 15 bp, Homo sapiens
acctaaatgtcagtg

SEQ ID NO: 69675 - DNA, 15 bp, Homo sapiens
aacctaaatgtcagt

SEQ ID NO: 69676 - DNA, 15 bp, Homo sapiens
taacctaaatgtcag

SEQ ID NO: 69677 - DNA, 15 bp, Homo sapiens
ctaacctaaatgtca

SEQ ID NO: 69678 - DNA, 15 bp, Homo sapiens
cctaacctaaatgtc

SEQ ID NO: 69679 - DNA, 15 bp, Homo sapiens
gcctaacctaaatgt

SEQ ID NO: 69680 - DNA, 15 bp, Homo sapiens
tgcctaacctaaatg

SEQ ID NO: 69681 - DNA, 15 bp, Homo sapiens
atgcctaacctaaat

SEQ ID NO: 69682 - DNA, 15 bp, Homo sapiens
aatgcctaacctaaa

SEQ ID NO: 69683 - DNA, 15 bp, Homo sapiens
taatgcctaacctaa

SEQ ID NO: 69684 - DNA, 15 bp, Homo sapiens
ctaatgcctaaccta

SEQ ID NO: 69685 - DNA, 15 bp, Homo sapiens
gctaatgcctaacct

SEQ ID NO: 69686 - DNA, 15 bp, Homo sapiens
tgctaatgcctaacc

SEQ ID NO: 69687 - DNA, 15 bp, Homo sapiens
ttgctaatgcctaac

SEQ ID NO: 69688 - DNA, 15 bp, Homo sapiens
attgctaatgcctaa

SEQ ID NO: 69689 - DNA, 15 bp, Homo sapiens
aattgctaatgccta

SEQ ID NO: 69690 - DNA, 15 bp, Homo sapiens
aaattgctaatgcct

SEQ ID NO: 69691 - DNA, 15 bp, Homo sapiens
caaattgctaatgcc

SEQ ID NO: 69692 - DNA, 15 bp, Homo sapiens
acaaattgctaatgc

SEQ ID NO: 69693 - DNA, 15 bp, Homo sapiens
aacaaattgctaatg

SEQ ID NO: 69694 - DNA, 15 bp, Homo sapiens
gaacaaattgctaat

SEQ ID NO: 69695 - DNA, 15 bp, Homo sapiens
tgaacaaattgctaa

SEQ ID NO: 69696 - DNA, 15 bp, Homo sapiens
ctgaacaaattgcta

SEQ ID NO: 69697 - DNA, 15 bp, Homo sapiens
actgaacaaattgct

SEQ ID NO: 69698 - DNA, 15 bp, Homo sapiens
gactgaacaaattgc

SEQ ID NO: 69699 - DNA, 15 bp, Homo sapiens
agactgaacaaattg

SEQ ID NO: 69700 - DNA, 15 bp, Homo sapiens
aagactgaacaaatt

SEQ ID NO: 69701 - DNA, 15 bp, Homo sapiens
gaagactgaacaaat

SEQ ID NO: 69702 - DNA, 15 bp, Homo sapiens
ggaagactgaacaaa

SEQ ID NO: 69703 - DNA, 15 bp, Homo sapiens
aggaagactgaacaa

SEQ ID NO: 69704 - DNA, 15 bp, Homo sapiens
aaggaagactgaaca

SEQ ID NO: 69705 - DNA, 15 bp, Homo sapiens
aaaggaagactgaac

SEQ ID NO: 69706 - DNA, 15 bp, Homo sapiens
aaaaggaagactgaa

SEQ ID NO: 69707 - DNA, 15 bp, Homo sapiens
aaaaaggaagactga

SEQ ID NO: 69708 - DNA, 15 bp, Homo sapiens
aaaaaaggaagactg

SEQ ID NO: 69709 - DNA, 15 bp, Homo sapiens
aaaaaaaggaagact

SEQ ID NO: 69710 - DNA, 15 bp, Homo sapiens
aaaaaaaaggaagac

SEQ ID NO: 69711 - DNA, 15 bp, Homo sapiens
aaaaaaaaaggaaga

SEQ ID NO: 69712 - DNA, 15 bp, Homo sapiens
aaaaaaaaaaggaag

SEQ ID NO: 69713 - DNA, 15 bp, Homo sapiens
caaaaaaaaaaaagg

SEQ ID NO: 69714 - DNA, 15 bp, Homo sapiens
gcaaaaaaaaaaaag

SEQ ID NO: 69715 - DNA, 15 bp, Homo sapiens
gtgcaaaaaaaaaaa

SEQ ID NO: 69716 - DNA, 15 bp, Homo sapiens
agtgcaaaaaaaaaa

SEQ ID NO: 69717 - DNA, 15 bp, Homo sapiens
cagtgcaaaaaaaaa

SEQ ID NO: 69718 - DNA, 15 bp, Homo sapiens
tcagtgcaaaaaaaa

SEQ ID NO: 69719 - DNA, 15 bp, Homo sapiens
ctcagtgcaaaaaaa

SEQ ID NO: 69720 - DNA, 15 bp, Homo sapiens
actcagtgcaaaaaa

SEQ ID NO: 69721 - DNA, 15 bp, Homo sapiens
tactcagtgcaaaaa

SEQ ID NO: 69722 - DNA, 15 bp, Homo sapiens
ctactcagtgcaaaa

SEQ ID NO: 69723 - DNA, 15 bp, Homo sapiens
gctactcagtgcaaa

SEQ ID NO: 69724 - DNA, 15 bp, Homo sapiens
agctactcagtgcaa

SEQ ID NO: 69725 - DNA, 15 bp, Homo sapiens
gagctactcagtgca

SEQ ID NO: 69726 - DNA, 15 bp, Homo sapiens
tgagctactcagtgc

SEQ ID NO: 69727 - DNA, 15 bp, Homo sapiens
gtgagctactcagtg

SEQ ID NO: 69728 - DNA, 15 bp, Homo sapiens
tgtgagctactcagt

SEQ ID NO: 69729 - DNA, 15 bp, Homo sapiens
ttgtgagctactcag

SEQ ID NO: 69730 - DNA, 15 bp, Homo sapiens
tttgtgagctactca

SEQ ID NO: 69731 - DNA, 15 bp, Homo sapiens
atttgtgagctactc

SEQ ID NO: 69732 - DNA, 15 bp, Homo sapiens
aatttgtgagctact

SEQ ID NO: 69733 - DNA, 15 bp, Homo sapiens
taatttgtgagctac

SEQ ID NO: 69734 - DNA, 15 bp, Homo sapiens
ataatttgtgagcta

SEQ ID NO: 69735 - DNA, 15 bp, Homo sapiens
tataatttgtgagct

SEQ ID NO: 69736 - DNA, 15 bp, Homo sapiens
ttataatttgtgagc

SEQ ID NO: 69737 - DNA, 15 bp, Homo sapiens
gttataatttgtgag

SEQ ID NO: 69738 - DNA, 15 bp, Homo sapiens
tgttataatttgtga

SEQ ID NO: 69739 - DNA, 15 bp, Homo sapiens
ttgttataatttgtg

SEQ ID NO: 69740 - DNA, 15 bp, Homo sapiens
attgttataatttgt

SEQ ID NO: 69741 - DNA, 15 bp, Homo sapiens
cattgttataatttg

SEQ ID NO: 69742 - DNA, 15 bp, Homo sapiens
acattgttataattt

SEQ ID NO: 69743 - DNA, 15 bp, Homo sapiens
gacattgttataatt

SEQ ID NO: 69744 - DNA, 15 bp, Homo sapiens
ggacattgttataat

SEQ ID NO: 69745 - DNA, 15 bp, Homo sapiens
gggacattgttataa

SEQ ID NO: 69746 - DNA, 15 bp, Homo sapiens
agggacattgttata

SEQ ID NO: 69747 - DNA, 15 bp, Homo sapiens
aagggacattgttat

SEQ ID NO: 69748 - DNA, 15 bp, Homo sapiens
aaagggacattgtta

SEQ ID NO: 69749 - DNA, 15 bp, Homo sapiens
gaaagggacattgtt

SEQ ID NO: 69750 - DNA, 15 bp, Homo sapiens
agaaagggacattgt

SEQ ID NO: 69751 - DNA, 15 bp, Homo sapiens
tagaaagggacattg

SEQ ID NO: 69752 - DNA, 15 bp, Homo sapiens
ctagaaagggacatt

SEQ ID NO: 69753 - DNA, 15 bp, Homo sapiens
cctagaaagggacat

SEQ ID NO: 69754 - DNA, 15 bp, Homo sapiens
gcctagaaagggaca

SEQ ID NO: 69755 - DNA, 15 bp, Homo sapiens
agcctagaaagggac

SEQ ID NO: 69756 - DNA, 15 bp, Homo sapiens
aagcctagaaaggga

SEQ ID NO: 69757 - DNA, 15 bp, Homo sapiens
aaagcctagaaaggg

SEQ ID NO: 69758 - DNA, 15 bp, Homo sapiens
aaaagcctagaaagg

SEQ ID NO: 69759 - DNA, 15 bp, Homo sapiens
taaaagcctagaaag

SEQ ID NO: 69760 - DNA, 15 bp, Homo sapiens
ataaaagcctagaaa

SEQ ID NO: 69761 - DNA, 15 bp, Homo sapiens
cataaaagcctagaa

SEQ ID NO: 69762 - DNA, 15 bp, Homo sapiens
tcataaaagcctaga

SEQ ID NO: 69763 - DNA, 15 bp, Homo sapiens
atcataaaagcctag

SEQ ID NO: 69764 - DNA, 15 bp, Homo sapiens
catcataaaagccta

SEQ ID NO: 69765 - DNA, 15 bp, Homo sapiens
ccatcataaaagcct

SEQ ID NO: 69766 - DNA, 15 bp, Homo sapiens
tccatcataaaagcc

SEQ ID NO: 69767 - DNA, 15 bp, Homo sapiens
ttccatcataaaagc

SEQ ID NO: 69768 - DNA, 15 bp, Homo sapiens
gttccatcataaaag

SEQ ID NO: 69769 - DNA, 15 bp, Homo sapiens
agttccatcataaaa

SEQ ID NO: 69770 - DNA, 15 bp, Homo sapiens
cagttccatcataaa

SEQ ID NO: 69771 - DNA, 15 bp, Homo sapiens
tcagttccatcataa

SEQ ID NO: 69772 - DNA, 15 bp, Homo sapiens
gtcagttccatcata

SEQ ID NO: 69773 - DNA, 15 bp, Homo sapiens
agtcagttccatcat

SEQ ID NO: 69774 - DNA, 15 bp, Homo sapiens
cagtcagttccatca

SEQ ID NO: 69775 - DNA, 15 bp, Homo sapiens
gcagtcagttccatc

SEQ ID NO: 69776 - DNA, 15 bp, Homo sapiens
tgcagtcagttccat

SEQ ID NO: 69777 - DNA, 15 bp, Homo sapiens
gtgcagtcagttcca

SEQ ID NO: 69778 - DNA, 15 bp, Homo sapiens
tgtgcagtcagttcc

SEQ ID NO: 69779 - DNA, 15 bp, Homo sapiens
gtgtgcagtcagttc

SEQ ID NO: 69780 - DNA, 15 bp, Homo sapiens
ggtgtgcagtcagtt

SEQ ID NO: 69781 - DNA, 15 bp, Homo sapiens
tggtgtgcagtcagt

SEQ ID NO: 69782 - DNA, 15 bp, Homo sapiens
ctggtgtgcagtcag

SEQ ID NO: 69783 - DNA, 15 bp, Homo sapiens
tctggtgtgcagtca

SEQ ID NO: 69784 - DNA, 15 bp, Homo sapiens
ctctggtgtgcagtc

SEQ ID NO: 69785 - DNA, 15 bp, Homo sapiens
gctctggtgtgcagt

SEQ ID NO: 69786 - DNA, 15 bp, Homo sapiens
tgctctggtgtgcag

SEQ ID NO: 69787 - DNA, 15 bp, Homo sapiens
ctgctctggtgtgca

SEQ ID NO: 69788 - DNA, 15 bp, Homo sapiens
actgctctggtgtgc

SEQ ID NO: 69789 - DNA, 15 bp, Homo sapiens
cactgctctggtgtg

SEQ ID NO: 69790 - DNA, 15 bp, Homo sapiens
acactgctctggtgt

SEQ ID NO: 69791 - DNA, 15 bp, Homo sapiens
cacactgctctggtg

SEQ ID NO: 69792 - DNA, 15 bp, Homo sapiens
ccacactgctctggt

SEQ ID NO: 69793 - DNA, 15 bp, Homo sapiens
cccacactgctctgg

SEQ ID NO: 69794 - DNA, 15 bp, Homo sapiens
gcccacactgctctg

SEQ ID NO: 69795 - DNA, 15 bp, Homo sapiens
tgcccacactgctct

SEQ ID NO: 69796 - DNA, 15 bp, Homo sapiens
ctgcccacactgctc

SEQ ID NO: 69797 - DNA, 15 bp, Homo sapiens
gctgcccacactgct

SEQ ID NO: 69798 - DNA, 15 bp, Homo sapiens
cgctgcccacactgc

SEQ ID NO: 69799 - DNA, 15 bp, Homo sapiens
acgctgcccacactg

SEQ ID NO: 69800 - DNA, 15 bp, Homo sapiens
gacgctgcccacact

SEQ ID NO: 69801 - DNA, 15 bp, Homo sapiens
ggacgctgcccacac

SEQ ID NO: 69802 - DNA, 15 bp, Homo sapiens
aggacgctgcccaca

SEQ ID NO: 69803 - DNA, 15 bp, Homo sapiens
caggacgctgcccac

SEQ ID NO: 69804 - DNA, 15 bp, Homo sapiens
gcaggacgctgccca

SEQ ID NO: 69805 - DNA, 15 bp, Homo sapiens
tgcaggacgctgccc

SEQ ID NO: 69806 - DNA, 15 bp, Homo sapiens
ctgcaggacgctgcc

SEQ ID NO: 69807 - DNA, 15 bp, Homo sapiens
cctgcaggacgctgc

SEQ ID NO: 69808 - DNA, 15 bp, Homo sapiens
gcctgcaggacgctg

SEQ ID NO: 69809 - DNA, 15 bp, Homo sapiens
tgcctgcaggacgct

SEQ ID NO: 69810 - DNA, 15 bp, Homo sapiens
ctgcctgcaggacgc

SEQ ID NO: 69811 - DNA, 15 bp, Homo sapiens
cctgcctgcaggacg

SEQ ID NO: 69812 - DNA, 15 bp, Homo sapiens
gcctgcctgcaggac

SEQ ID NO: 69813 - DNA, 15 bp, Homo sapiens
tgcctgcctgcagga

SEQ ID NO: 69814 - DNA, 15 bp, Homo sapiens
ttgcctgcctgcagg

SEQ ID NO: 69815 - DNA, 15 bp, Homo sapiens
gttgcctgcctgcag

SEQ ID NO: 69816 - DNA, 15 bp, Homo sapiens
ggttgcctgcctgca

SEQ ID NO: 69817 - DNA, 15 bp, Homo sapiens
tggttgcctgcctgc

SEQ ID NO: 69818 - DNA, 15 bp, Homo sapiens
ttggttgcctgcctg

SEQ ID NO: 69819 - DNA, 15 bp, Homo sapiens
gttggttgcctgcct

SEQ ID NO: 69820 - DNA, 15 bp, Homo sapiens
agttggttgcctgcc

SEQ ID NO: 69821 - DNA, 15 bp, Homo sapiens
cagttggttgcctgc

SEQ ID NO: 69822 - DNA, 15 bp, Homo sapiens
tcagttggttgcctg

SEQ ID NO: 69823 - DNA, 15 bp, Homo sapiens
atcagttggttgcct

SEQ ID NO: 69824 - DNA, 15 bp, Homo sapiens
tatcagttggttgcc

SEQ ID NO: 69825 - DNA, 15 bp, Homo sapiens
ttatcagttggttgc

SEQ ID NO: 69826 - DNA, 15 bp, Homo sapiens
gttatcagttggttg

SEQ ID NO: 69827 - DNA, 15 bp, Homo sapiens
tgttatcagttggtt

SEQ ID NO: 69828 - DNA, 15 bp, Homo sapiens
gtgttatcagttggt

SEQ ID NO: 69829 - DNA, 15 bp, Homo sapiens
tgtgttatcagttgg

SEQ ID NO: 69830 - DNA, 15 bp, Homo sapiens
ttgtgttatcagttg

SEQ ID NO: 69831 - DNA, 15 bp, Homo sapiens
cttgtgttatcagtt

SEQ ID NO: 69832 - DNA, 15 bp, Homo sapiens
ccttgtgttatcagt

SEQ ID NO: 69833 - DNA, 15 bp, Homo sapiens
tccttgtgttatcag

SEQ ID NO: 69834 - DNA, 15 bp, Homo sapiens
ttccttgtgttatca

SEQ ID NO: 69835 - DNA, 15 bp, Homo sapiens
gttccttgtgttatc

SEQ ID NO: 69836 - DNA, 15 bp, Homo sapiens
agttccttgtgttat

SEQ ID NO: 69837 - DNA, 15 bp, Homo sapiens
gagttccttgtgtta

SEQ ID NO: 69838 - DNA, 15 bp, Homo sapiens
agagttccttgtgtt

SEQ ID NO: 69839 - DNA, 15 bp, Homo sapiens
cagagttccttgtgt

SEQ ID NO: 69840 - DNA, 15 bp, Homo sapiens
acagagttccttgtg

SEQ ID NO: 69841 - DNA, 15 bp, Homo sapiens
gacagagttccttgt

SEQ ID NO: 69842 - DNA, 15 bp, Homo sapiens
tgacagagttccttg

SEQ ID NO: 69843 - DNA, 15 bp, Homo sapiens
ctgacagagttcctt

SEQ ID NO: 69844 - DNA, 15 bp, Homo sapiens
tctgacagagttcct

SEQ ID NO: 69845 - DNA, 15 bp, Homo sapiens
gtctgacagagttcc

SEQ ID NO: 69846 - DNA, 15 bp, Homo sapiens
cgtctgacagagttc

SEQ ID NO: 69847 - DNA, 15 bp, Homo sapiens
tcgtctgacagagtt

SEQ ID NO: 69848 - DNA, 15 bp, Homo sapiens
ttcgtctgacagagt

SEQ ID NO: 69849 - DNA, 15 bp, Homo sapiens
cttcgtctgacagag

SEQ ID NO: 69850 - DNA, 15 bp, Homo sapiens
tcttcgtctgacaga

SEQ ID NO: 69851 - DNA, 15 bp, Homo sapiens
ttcttcgtctgacag

SEQ ID NO: 69852 - DNA, 15 bp, Homo sapiens
cttcttcgtctgaca

SEQ ID NO: 69853 - DNA, 15 bp, Homo sapiens
tcttcttcgtctgac

SEQ ID NO: 69854 - DNA, 15 bp, Homo sapiens
ttcttcttcgtctga

SEQ ID NO: 69855 - DNA, 15 bp, Homo sapiens
attcttcttcgtctg

SEQ ID NO: 69856 - DNA, 15 bp, Homo sapiens
aattcttcttcgtct

SEQ ID NO: 69857 - DNA, 15 bp, Homo sapiens
aaattcttcttcgtc

SEQ ID NO: 69858 - DNA, 15 bp, Homo sapiens
caaattcttcttcgt

SEQ ID NO: 69859 - DNA, 15 bp, Homo sapiens
tcaaattcttcttcg

SEQ ID NO: 69860 - DNA, 15 bp, Homo sapiens
ctcaaattcttcttc

SEQ ID NO: 69861 - DNA, 15 bp, Homo sapiens
tctcaaattcttctt

SEQ ID NO: 69862 - DNA, 15 bp, Homo sapiens
atctcaaattcttct

SEQ ID NO: 69863 - DNA, 15 bp, Homo sapiens
aatctcaaattcttc

SEQ ID NO: 69864 - DNA, 15 bp, Homo sapiens
gaatctcaaattctt

SEQ ID NO: 69865 - DNA, 15 bp, Homo sapiens
tgaatctcaaattct

SEQ ID NO: 69866 - DNA, 15 bp, Homo sapiens
ctgaatctcaaattc

SEQ ID NO: 69867 - DNA, 15 bp, Homo sapiens
cctgaatctcaaatt

SEQ ID NO: 69868 - DNA, 15 bp, Homo sapiens
tcctgaatctcaaat

SEQ ID NO: 69869 - DNA, 15 bp, Homo sapiens
ttcctgaatctcaaa

SEQ ID NO: 69870 - DNA, 15 bp, Homo sapiens
gttcctgaatctcaa

SEQ ID NO: 69871 - DNA, 15 bp, Homo sapiens
tgttcctgaatctca

SEQ ID NO: 69872 - DNA, 15 bp, Homo sapiens
ctgttcctgaatctc

SEQ ID NO: 69873 - DNA, 15 bp, Homo sapiens
tctgttcctgaatct

SEQ ID NO: 69874 - DNA, 15 bp, Homo sapiens
atctgttcctgaatc

SEQ ID NO: 69875 - DNA, 15 bp, Homo sapiens
catctgttcctgaat

SEQ ID NO: 69876 - DNA, 15 bp, Homo sapiens
tcatctgttcctgaa

SEQ ID NO: 69877 - DNA, 15 bp, Homo sapiens
gtcatctgttcctga

SEQ ID NO: 69878 - DNA, 15 bp, Homo sapiens
ggtcatctgttcctg

SEQ ID NO: 69879 - DNA, 15 bp, Homo sapiens
gggtcatctgttcct

SEQ ID NO: 69880 - DNA, 15 bp, Homo sapiens
agggtcatctgttcc

SEQ ID NO: 69881 - DNA, 15 bp, Homo sapiens
cagggtcatctgttc

SEQ ID NO: 69882 - DNA, 15 bp, Homo sapiens
gcagggtcatctgtt

SEQ ID NO: 69883 - DNA, 15 bp, Homo sapiens
agcagggtcatctgt

SEQ ID NO: 69884 - DNA, 15 bp, Homo sapiens
cagcagggtcatctg

SEQ ID NO: 69885 - DNA, 15 bp, Homo sapiens
tcagcagggtcatct

SEQ ID NO: 69886 - DNA, 15 bp, Homo sapiens
ttcagcagggtcatc

SEQ ID NO: 69887 - DNA, 15 bp, Homo sapiens
attcagcagggtcat

SEQ ID NO: 69888 - DNA, 15 bp, Homo sapiens
cattcagcagggtca

SEQ ID NO: 69889 - DNA, 15 bp, Homo sapiens
gcattcagcagggtc

SEQ ID NO: 69890 - DNA, 15 bp, Homo sapiens
agcattcagcagggt

SEQ ID NO: 69891 - DNA, 15 bp, Homo sapiens
tagcattcagcaggg

SEQ ID NO: 69892 - DNA, 15 bp, Homo sapiens
ctagcattcagcagg

SEQ ID NO: 69893 - DNA, 15 bp, Homo sapiens
tctagcattcagcag

SEQ ID NO: 69894 - DNA, 15 bp, Homo sapiens
atctagcattcagca

SEQ ID NO: 69895 - DNA, 15 bp, Homo sapiens
catctagcattcagc

SEQ ID NO: 69896 - DNA, 15 bp, Homo sapiens
ccatctagcattcag

SEQ ID NO: 69897 - DNA, 15 bp, Homo sapiens
cccatctagcattca

SEQ ID NO: 69898 - DNA, 15 bp, Homo sapiens
tcccatctagcattc

SEQ ID NO: 69899 - DNA, 15 bp, Homo sapiens
ctcccatctagcatt

SEQ ID NO: 69900 - DNA, 15 bp, Homo sapiens
cctcccatctagcat

SEQ ID NO: 69901 - DNA, 15 bp, Homo sapiens
gcctcccatctagca

SEQ ID NO: 69902 - DNA, 15 bp, Homo sapiens
agcctcccatctagc

SEQ ID NO: 69903 - DNA, 15 bp, Homo sapiens
gagcctcccatctag

SEQ ID NO: 69904 - DNA, 15 bp, Homo sapiens
agagcctcccatcta

SEQ ID NO: 69905 - DNA, 15 bp, Homo sapiens
aagagcctcccatct

SEQ ID NO: 69906 - DNA, 15 bp, Homo sapiens
taagagcctcccatc

SEQ ID NO: 69907 - DNA, 15 bp, Homo sapiens
ctaagagcctcccat

SEQ ID NO: 69908 - DNA, 15 bp, Homo sapiens
cctaagagcctccca

SEQ ID NO: 69909 - DNA, 15 bp, Homo sapiens
ccctaagagcctccc

SEQ ID NO: 69910 - DNA, 15 bp, Homo sapiens
accctaagagcctcc

SEQ ID NO: 69911 - DNA, 15 bp, Homo sapiens
caccctaagagcctc

SEQ ID NO: 69912 - DNA, 15 bp, Homo sapiens
ccaccctaagagcct

SEQ ID NO: 69913 - DNA, 15 bp, Homo sapiens
tccaccctaagagcc

SEQ ID NO: 69914 - DNA, 15 bp, Homo sapiens
ctccaccctaagagc

SEQ ID NO: 69915 - DNA, 15 bp, Homo sapiens
tctccaccctaagag

SEQ ID NO: 69916 - DNA, 15 bp, Homo sapiens
ctctccaccctaaga

SEQ ID NO: 69917 - DNA, 15 bp, Homo sapiens
actctccaccctaag

SEQ ID NO: 69918 - DNA, 15 bp, Homo sapiens
tactctccaccctaa

SEQ ID NO: 69919 - DNA, 15 bp, Homo sapiens
atactctccacccta

SEQ ID NO: 69920 - DNA, 15 bp, Homo sapiens
catactctccaccct

SEQ ID NO: 69921 - DNA, 15 bp, Homo sapiens
ccatactctccaccc

SEQ ID NO: 69922 - DNA, 15 bp, Homo sapiens
tccatactctccacc

SEQ ID NO: 69923 - DNA, 15 bp, Homo sapiens
gtccatactctccac

SEQ ID NO: 69924 - DNA, 15 bp, Homo sapiens
tgtccatactctcca

SEQ ID NO: 69925 - DNA, 15 bp, Homo sapiens
ctgtccatactctcc

SEQ ID NO: 69926 - DNA, 15 bp, Homo sapiens
tctgtccatactctc

SEQ ID NO: 69927 - DNA, 15 bp, Homo sapiens
gtctgtccatactct

SEQ ID NO: 69928 - DNA, 15 bp, Homo sapiens
tgtctgtccatactc

SEQ ID NO: 69929 - DNA, 15 bp, Homo sapiens
ctgtctgtccatact

SEQ ID NO: 69930 - DNA, 15 bp, Homo sapiens
actgtctgtccatac

SEQ ID NO: 69931 - DNA, 15 bp, Homo sapiens
gactgtctgtccata

SEQ ID NO: 69932 - DNA, 15 bp, Homo sapiens
ggactgtctgtccat

SEQ ID NO: 69933 - DNA, 15 bp, Homo sapiens
gggactgtctgtcca

SEQ ID NO: 69934 - DNA, 15 bp, Homo sapiens
cgggactgtctgtcc

SEQ ID NO: 69935 - DNA, 15 bp, Homo sapiens
ccgggactgtctgtc

SEQ ID NO: 69936 - DNA, 15 bp, Homo sapiens
accgggactgtctgt

SEQ ID NO: 69937 - DNA, 15 bp, Homo sapiens
caccgggactgtctg

SEQ ID NO: 69938 - DNA, 15 bp, Homo sapiens
tcaccgggactgtct

SEQ ID NO: 69939 - DNA, 15 bp, Homo sapiens
ctcaccgggactgtc

SEQ ID NO: 69940 - DNA, 15 bp, Homo sapiens
actcaccgggactgt

SEQ ID NO: 69941 - DNA, 15 bp, Homo sapiens
cactcaccgggactg

SEQ ID NO: 69942 - DNA, 15 bp, Homo sapiens
ccactcaccgggact

SEQ ID NO: 69943 - DNA, 15 bp, Homo sapiens
tccactcaccgggac

SEQ ID NO: 69944 - DNA, 15 bp, Homo sapiens
ttccactcaccggga

SEQ ID NO: 69945 - DNA, 15 bp, Homo sapiens
tttccactcaccggg

SEQ ID NO: 69946 - DNA, 15 bp, Homo sapiens
ctttccactcaccgg

SEQ ID NO: 69947 - DNA, 15 bp, Homo sapiens
gctttccactcaccg

SEQ ID NO: 69948 - DNA, 15 bp, Homo sapiens
ggctttccactcacc

SEQ ID NO: 69949 - DNA, 15 bp, Homo sapiens
tggctttccactcac

SEQ ID NO: 69950 - DNA, 15 bp, Homo sapiens
ttggctttccactca

SEQ ID NO: 69951 - DNA, 15 bp, Homo sapiens
cttggctttccactc

SEQ ID NO: 69952 - DNA, 15 bp, Homo sapiens
tcttggctttccact

SEQ ID NO: 69953 - DNA, 15 bp, Homo sapiens
ttcttggctttccac

SEQ ID NO: 69954 - DNA, 15 bp, Homo sapiens
tttcttggctttcca

SEQ ID NO: 69955 - DNA, 15 bp, Homo sapiens
atttcttggctttcc

SEQ ID NO: 69956 - DNA, 15 bp, Homo sapiens
catttcttggctttc

SEQ ID NO: 69957 - DNA, 15 bp, Homo sapiens
gcatttcttggcttt

SEQ ID NO: 69958 - DNA, 15 bp, Homo sapiens
tgcatttcttggctt

SEQ ID NO: 69959 - DNA, 15 bp, Homo sapiens
gtgcatttcttggct

SEQ ID NO: 69960 - DNA, 15 bp, Homo sapiens
agtgcatttcttggc

SEQ ID NO: 69961 - DNA, 15 bp, Homo sapiens
aagtgcatttcttgg

SEQ ID NO: 69962 - DNA, 15 bp, Homo sapiens
taagtgcatttcttg

SEQ ID NO: 69963 - DNA, 15 bp, Homo sapiens
ttaagtgcatttctt

SEQ ID NO: 69964 - DNA, 15 bp, Homo sapiens
attaagtgcatttct

SEQ ID NO: 69965 - DNA, 15 bp, Homo sapiens
aattaagtgcatttc

SEQ ID NO: 69966 - DNA, 15 bp, Homo sapiens
gaattaagtgcattt

SEQ ID NO: 69967 - DNA, 15 bp, Homo sapiens
ggaattaagtgcatt

SEQ ID NO: 69968 - DNA, 15 bp, Homo sapiens
tggaattaagtgcat

SEQ ID NO: 69969 - DNA, 15 bp, Homo sapiens
gtggaattaagtgca

SEQ ID NO: 69970 - DNA, 15 bp, Homo sapiens
tgtggaattaagtgc

SEQ ID NO: 69971 - DNA, 15 bp, Homo sapiens
ctgtggaattaagtg

SEQ ID NO: 69972 - DNA, 15 bp, Homo sapiens
cctgtggaattaagt

SEQ ID NO: 69973 - DNA, 15 bp, Homo sapiens
gcctgtggaattaag

SEQ ID NO: 69974 - DNA, 15 bp, Homo sapiens
agcctgtggaattaa

SEQ ID NO: 69975 - DNA, 15 bp, Homo sapiens
cagcctgtggaatta

SEQ ID NO: 69976 - DNA, 15 bp, Homo sapiens
gcagcctgtggaatt

SEQ ID NO: 69977 - DNA, 15 bp, Homo sapiens
agcagcctgtggaat

SEQ ID NO: 69978 - DNA, 15 bp, Homo sapiens
aagcagcctgtggaa

SEQ ID NO: 69979 - DNA, 15 bp, Homo sapiens
aaagcagcctgtgga

SEQ ID NO: 69980 - DNA, 15 bp, Homo sapiens
caaagcagcctgtgg

SEQ ID NO: 69981 - DNA, 15 bp, Homo sapiens
gcaaagcagcctgtg

SEQ ID NO: 69982 - DNA, 15 bp, Homo sapiens
tgcaaagcagcctgt

SEQ ID NO: 69983 - DNA, 15 bp, Homo sapiens
gtgcaaagcagcctg

SEQ ID NO: 69984 - DNA, 15 bp, Homo sapiens
tgtgcaaagcagcct

SEQ ID NO: 69985 - DNA, 15 bp, Homo sapiens
ctgtgcaaagcagcc

SEQ ID NO: 69986 - DNA, 15 bp, Homo sapiens
actgtgcaaagcagc

SEQ ID NO: 69987 - DNA, 15 bp, Homo sapiens
aactgtgcaaagcag

SEQ ID NO: 69988 - DNA, 15 bp, Homo sapiens
caactgtgcaaagca

SEQ ID NO: 69989 - DNA, 15 bp, Homo sapiens
tcaactgtgcaaagc

SEQ ID NO: 69990 - DNA, 15 bp, Homo sapiens
ctcaactgtgcaaag

SEQ ID NO: 69991 - DNA, 15 bp, Homo sapiens
gctcaactgtgcaaa

SEQ ID NO: 69992 - DNA, 15 bp, Homo sapiens
agctcaactgtgcaa

SEQ ID NO: 69993 - DNA, 15 bp, Homo sapiens
gagctcaactgtgca

SEQ ID NO: 69994 - DNA, 15 bp, Homo sapiens
agagctcaactgtgc

SEQ ID NO: 69995 - DNA, 15 bp, Homo sapiens
tagagctcaactgtg

SEQ ID NO: 69996 - DNA, 15 bp, Homo sapiens
ctagagctcaactgt

SEQ ID NO: 69997 - DNA, 15 bp, Homo sapiens
actagagctcaactg

SEQ ID NO: 69998 - DNA, 15 bp, Homo sapiens
tactagagctcaact

SEQ ID NO: 69999 - DNA, 15 bp, Homo sapiens
ctactagagctcaac

SEQ ID NO: 70000 - DNA, 15 bp, Homo sapiens
tctactagagctcaa

SEQ ID NO: 70001 - DNA, 15 bp, Homo sapiens
atctactagagctca

SEQ ID NO: 70002 - DNA, 15 bp, Homo sapiens
catctactagagctc

SEQ ID NO: 70003 - DNA, 15 bp, Homo sapiens
acatctactagagct

SEQ ID NO: 70004 - DNA, 15 bp, Homo sapiens
gacatctactagagc

SEQ ID NO: 70005 - DNA, 15 bp, Homo sapiens
agacatctactagag

SEQ ID NO: 70006 - DNA, 15 bp, Homo sapiens
cagacatctactaga

SEQ ID NO: 70007 - DNA, 15 bp, Homo sapiens
gcagacatctactag

SEQ ID NO: 70008 - DNA, 15 bp, Homo sapiens
tgcagacatctacta

SEQ ID NO: 70009 - DNA, 15 bp, Homo sapiens
atgcagacatctact

SEQ ID NO: 70010 - DNA, 15 bp, Homo sapiens
catgcagacatctac

SEQ ID NO: 70011 - DNA, 15 bp, Homo sapiens
acatgcagacatcta

SEQ ID NO: 70012 - DNA, 15 bp, Homo sapiens
gacatgcagacatct

SEQ ID NO: 70013 - DNA, 15 bp, Homo sapiens
agacatgcagacatc

SEQ ID NO: 70014 - DNA, 15 bp, Homo sapiens
cagacatgcagacat

SEQ ID NO: 70015 - DNA, 15 bp, Homo sapiens
acagacatgcagaca

SEQ ID NO: 70016 - DNA, 15 bp, Homo sapiens
cacagacatgcagac

SEQ ID NO: 70017 - DNA, 15 bp, Homo sapiens
tcacagacatgcaga

SEQ ID NO: 70018 - DNA, 15 bp, Homo sapiens
ttcacagacatgcag

SEQ ID NO: 70019 - DNA, 15 bp, Homo sapiens
tttcacagacatgca

SEQ ID NO: 70020 - DNA, 15 bp, Homo sapiens
ctttcacagacatgc

SEQ ID NO: 70021 - DNA, 15 bp, Homo sapiens
gctttcacagacatg

SEQ ID NO: 70022 - DNA, 15 bp, Homo sapiens
cgctttcacagacat

SEQ ID NO: 70023 - DNA, 15 bp, Homo sapiens
tcgctttcacagaca

SEQ ID NO: 70024 - DNA, 15 bp, Homo sapiens
ctcgctttcacagac

SEQ ID NO: 70025 - DNA, 15 bp, Homo sapiens
tctcgctttcacaga

SEQ ID NO: 70026 - DNA, 15 bp, Homo sapiens
atctcgctttcacag

SEQ ID NO: 70027 - DNA, 15 bp, Homo sapiens
catctcgctttcaca

SEQ ID NO: 70028 - DNA, 15 bp, Homo sapiens
tcatctcgctttcac

SEQ ID NO: 70029 - DNA, 15 bp, Homo sapiens
atcatctcgctttca

SEQ ID NO: 70030 - DNA, 15 bp, Homo sapiens
aatcatctcgctttc

SEQ ID NO: 70031 - DNA, 15 bp, Homo sapiens
taatcatctcgcttt

SEQ ID NO: 70032 - DNA, 15 bp, Homo sapiens
gtaatcatctcgctt

SEQ ID NO: 70033 - DNA, 15 bp, Homo sapiens
tgtaatcatctcgct

SEQ ID NO: 70034 - DNA, 15 bp, Homo sapiens
ctgtaatcatctcgc

SEQ ID NO: 70035 - DNA, 15 bp, Homo sapiens
tctgtaatcatctcg

SEQ ID NO: 70036 - DNA, 15 bp, Homo sapiens
ttctgtaatcatctc

SEQ ID NO: 70037 - DNA, 15 bp, Homo sapiens
gttctgtaatcatct

SEQ ID NO: 70038 - DNA, 15 bp, Homo sapiens
agttctgtaatcatc

SEQ ID NO: 70039 - DNA, 15 bp, Homo sapiens
aagttctgtaatcat

SEQ ID NO: 70040 - DNA, 15 bp, Homo sapiens
caagttctgtaatca

SEQ ID NO: 70041 - DNA, 15 bp, Homo sapiens
gcaagttctgtaatc

SEQ ID NO: 70042 - DNA, 15 bp, Homo sapiens
ggcaagttctgtaat

SEQ ID NO: 70043 - DNA, 15 bp, Homo sapiens
aggcaagttctgtaa

SEQ ID NO: 70044 - DNA, 15 bp, Homo sapiens
aaggcaagttctgta

SEQ ID NO: 70045 - DNA, 15 bp, Homo sapiens
caaggcaagttctgt

SEQ ID NO: 70046 - DNA, 15 bp, Homo sapiens
ccaaggcaagttctg

SEQ ID NO: 70047 - DNA, 15 bp, Homo sapiens
tccaaggcaagttct

SEQ ID NO: 70048 - DNA, 15 bp, Homo sapiens
ttccaaggcaagttc

SEQ ID NO: 70049 - DNA, 15 bp, Homo sapiens
tttccaaggcaagtt

SEQ ID NO: 70050 - DNA, 15 bp, Homo sapiens
ttttccaaggcaagt

SEQ ID NO: 70051 - DNA, 15 bp, Homo sapiens
cttttccaaggcaag

SEQ ID NO: 70052 - DNA, 15 bp, Homo sapiens
acttttccaaggcaa

SEQ ID NO: 70053 - DNA, 15 bp, Homo sapiens
tacttttccaaggca

SEQ ID NO: 70054 - DNA, 15 bp, Homo sapiens
ttacttttccaaggc

SEQ ID NO: 70055 - DNA, 15 bp, Homo sapiens
cttacttttccaagg

SEQ ID NO: 70056 - DNA, 15 bp, Homo sapiens
tcttacttttccaag

SEQ ID NO: 70057 - DNA, 15 bp, Homo sapiens
gtcttacttttccaa

SEQ ID NO: 70058 - DNA, 15 bp, Homo sapiens
agtcttacttttcca

SEQ ID NO: 70059 - DNA, 15 bp, Homo sapiens
gagtcttacttttcc

SEQ ID NO: 70060 - DNA, 15 bp, Homo sapiens
agagtcttacttttc

SEQ ID NO: 70061 - DNA, 15 bp, Homo sapiens
aagagtcttactttt

SEQ ID NO: 70062 - DNA, 15 bp, Homo sapiens
aaagagtcttacttt

SEQ ID NO: 70063 - DNA, 15 bp, Homo sapiens
aaaagagtcttactt

SEQ ID NO: 70064 - DNA, 15 bp, Homo sapiens
gaaaagagtcttact

SEQ ID NO: 70065 - DNA, 15 bp, Homo sapiens
agaaaagagtcttac

SEQ ID NO: 70066 - DNA, 15 bp, Homo sapiens
tagaaaagagtctta

SEQ ID NO: 70067 - DNA, 15 bp, Homo sapiens
gtagaaaagagtctt

SEQ ID NO: 70068 - DNA, 15 bp, Homo sapiens
cgtagaaaagagtct

SEQ ID NO: 70069 - DNA, 15 bp, Homo sapiens
ccgtagaaaagagtc

SEQ ID NO: 70070 - DNA, 15 bp, Homo sapiens
cccgtagaaaagagt

SEQ ID NO: 70071 - DNA, 15 bp, Homo sapiens
acccgtagaaaagag

SEQ ID NO: 70072 - DNA, 15 bp, Homo sapiens
tacccgtagaaaaga

SEQ ID NO: 70073 - DNA, 15 bp, Homo sapiens
ttacccgtagaaaag

SEQ ID NO: 70074 - DNA, 15 bp, Homo sapiens
attacccgtagaaaa

SEQ ID NO: 70075 - DNA, 15 bp, Homo sapiens
tattacccgtagaaa

SEQ ID NO: 70076 - DNA, 15 bp, Homo sapiens
atattacccgtagaa

SEQ ID NO: 70077 - DNA, 15 bp, Homo sapiens
aatattacccgtaga

SEQ ID NO: 70078 - DNA, 15 bp, Homo sapiens
caatattacccgtag

SEQ ID NO: 70079 - DNA, 15 bp, Homo sapiens
gcaatattacccgta

SEQ ID NO: 70080 - DNA, 15 bp, Homo sapiens
agcaatattacccgt

SEQ ID NO: 70081 - DNA, 15 bp, Homo sapiens
cagcaatattacccg

SEQ ID NO: 70082 - DNA, 15 bp, Homo sapiens
ccagcaatattaccc

SEQ ID NO: 70083 - DNA, 15 bp, Homo sapiens
tccagcaatattacc

SEQ ID NO: 70084 - DNA, 15 bp, Homo sapiens
ttccagcaatattac

SEQ ID NO: 70085 - DNA, 15 bp, Homo sapiens
attccagcaatatta

SEQ ID NO: 70086 - DNA, 15 bp, Homo sapiens
aattccagcaatatt

SEQ ID NO: 70087 - DNA, 15 bp, Homo sapiens
gaattccagcaatat

SEQ ID NO: 70088 - DNA, 15 bp, Homo sapiens
agaattccagcaata

SEQ ID NO: 70089 - DNA, 15 bp, Homo sapiens
cagaattccagcaat

SEQ ID NO: 70090 - DNA, 15 bp, Homo sapiens
gcagaattccagcaa

SEQ ID NO: 70091 - DNA, 15 bp, Homo sapiens
tgcagaattccagca

SEQ ID NO: 70092 - DNA, 15 bp, Homo sapiens
atgcagaattccagc

SEQ ID NO: 70093 - DNA, 15 bp, Homo sapiens
catgcagaattccag

SEQ ID NO: 70094 - DNA, 15 bp, Homo sapiens
tcatgcagaattcca

SEQ ID NO: 70095 - DNA, 15 bp, Homo sapiens
atcatgcagaattcc

SEQ ID NO: 70096 - DNA, 15 bp, Homo sapiens
gatcatgcagaattc

SEQ ID NO: 70097 - DNA, 15 bp, Homo sapiens
agatcatgcagaatt

SEQ ID NO: 70098 - DNA, 15 bp, Homo sapiens
aagatcatgcagaat

SEQ ID NO: 70099 - DNA, 15 bp, Homo sapiens
aaagatcatgcagaa

SEQ ID NO: 70100 - DNA, 15 bp, Homo sapiens
caaagatcatgcaga

SEQ ID NO: 70101 - DNA, 15 bp, Homo sapiens
acaaagatcatgcag

SEQ ID NO: 70102 - DNA, 15 bp, Homo sapiens
aacaaagatcatgca

SEQ ID NO: 70103 - DNA, 15 bp, Homo sapiens
aaacaaagatcatgc

SEQ ID NO: 70104 - DNA, 15 bp, Homo sapiens
gaaacaaagatcatg

SEQ ID NO: 70105 - DNA, 15 bp, Homo sapiens
ggaaacaaagatcat

SEQ ID NO: 70106 - DNA, 15 bp, Homo sapiens
gggaaacaaagatca

SEQ ID NO: 70107 - DNA, 15 bp, Homo sapiens
ggggaaacaaagatc

SEQ ID NO: 70108 - DNA, 15 bp, Homo sapiens
aggggaaacaaagat

SEQ ID NO: 70109 - DNA, 15 bp, Homo sapiens
aaggggaaacaaaga

SEQ ID NO: 70110 - DNA, 15 bp, Homo sapiens
aaaggggaaacaaag

SEQ ID NO: 70111 - DNA, 15 bp, Homo sapiens
caaaggggaaacaaa

SEQ ID NO: 70112 - DNA, 15 bp, Homo sapiens
tcaaaggggaaacaa

SEQ ID NO: 70113 - DNA, 15 bp, Homo sapiens
atcaaaggggaaaca

SEQ ID NO: 70114 - DNA, 15 bp, Homo sapiens
catcaaaggggaaac

SEQ ID NO: 70115 - DNA, 15 bp, Homo sapiens
acatcaaaggggaaa

SEQ ID NO: 70116 - DNA, 15 bp, Homo sapiens
cacatcaaaggggaa

SEQ ID NO: 70117 - DNA, 15 bp, Homo sapiens
acacatcaaagggga

SEQ ID NO: 70118 - DNA, 15 bp, Homo sapiens
aacacatcaaagggg

SEQ ID NO: 70119 - DNA, 15 bp, Homo sapiens
taacacatcaaaggg

SEQ ID NO: 70120 - DNA, 15 bp, Homo sapiens
ctaacacatcaaagg

SEQ ID NO: 70121 - DNA, 15 bp, Homo sapiens
gctaacacatcaaag

SEQ ID NO: 70122 - DNA, 15 bp, Homo sapiens
ggctaacacatcaaa

SEQ ID NO: 70123 - DNA, 15 bp, Homo sapiens
tggctaacacatcaa

SEQ ID NO: 70124 - DNA, 15 bp, Homo sapiens
gtggctaacacatca

SEQ ID NO: 70125 - DNA, 15 bp, Homo sapiens
tgtggctaacacatc

SEQ ID NO: 70126 - DNA, 15 bp, Homo sapiens
gtgtggctaacacat

SEQ ID NO: 70127 - DNA, 15 bp, Homo sapiens
ggtgtggctaacaca

SEQ ID NO: 70128 - DNA, 15 bp, Homo sapiens
tggtgtggctaacac

SEQ ID NO: 70129 - DNA, 15 bp, Homo sapiens
ttggtgtggctaaca

SEQ ID NO: 70130 - DNA, 15 bp, Homo sapiens
tttggtgtggctaac

SEQ ID NO: 70131 - DNA, 15 bp, Homo sapiens
ttttggtgtggctaa

SEQ ID NO: 70132 - DNA, 15 bp, Homo sapiens
cttttggtgtggcta

SEQ ID NO: 70133 - DNA, 15 bp, Homo sapiens
tcttttggtgtggct

SEQ ID NO: 70134 - DNA, 15 bp, Homo sapiens
atcttttggtgtggc

SEQ ID NO: 70135 - DNA, 15 bp, Homo sapiens
tatcttttggtgtgg

SEQ ID NO: 70136 - DNA, 15 bp, Homo sapiens
ttatcttttggtgtg

SEQ ID NO: 70137 - DNA, 15 bp, Homo sapiens
tttatcttttggtgt

SEQ ID NO: 70138 - DNA, 15 bp, Homo sapiens
ttttatcttttggtg

SEQ ID NO: 70139 - DNA, 15 bp, Homo sapiens
cttttatcttttggt

SEQ ID NO: 70140 - DNA, 15 bp, Homo sapiens
acttttatcttttgg

SEQ ID NO: 70141 - DNA, 15 bp, Homo sapiens
aacttttatcttttg

SEQ ID NO: 70142 - DNA, 15 bp, Homo sapiens
caacttttatctttt

SEQ ID NO: 70143 - DNA, 15 bp, Homo sapiens
ccaacttttatcttt

SEQ ID NO: 70144 - DNA, 15 bp, Homo sapiens
tccaacttttatctt

SEQ ID NO: 70145 - DNA, 15 bp, Homo sapiens
ttccaacttttatct

SEQ ID NO: 70146 - DNA, 15 bp, Homo sapiens
attccaacttttatc

SEQ ID NO: 70147 - DNA, 15 bp, Homo sapiens
tattccaacttttat

SEQ ID NO: 70148 - DNA, 15 bp, Homo sapiens
gtattccaactttta

SEQ ID NO: 70149 - DNA, 15 bp, Homo sapiens
tgtattccaactttt

SEQ ID NO: 70150 - DNA, 15 bp, Homo sapiens
ctgtattccaacttt

SEQ ID NO: 70151 - DNA, 15 bp, Homo sapiens
tctgtattccaactt

SEQ ID NO: 70152 - DNA, 15 bp, Homo sapiens
ttctgtattccaact

SEQ ID NO: 70153 - DNA, 15 bp, Homo sapiens
attctgtattccaac

SEQ ID NO: 70154 - DNA, 15 bp, Homo sapiens
aattctgtattccaa

SEQ ID NO: 70155 - DNA, 15 bp, Homo sapiens
aaattctgtattcca

SEQ ID NO: 70156 - DNA, 15 bp, Homo sapiens
taaattctgtattcc

SEQ ID NO: 70157 - DNA, 15 bp, Homo sapiens
ttaaattctgtattc

SEQ ID NO: 70158 - DNA, 15 bp, Homo sapiens
gttaaattctgtatt

SEQ ID NO: 70159 - DNA, 15 bp, Homo sapiens
tgttaaattctgtat

SEQ ID NO: 70160 - DNA, 15 bp, Homo sapiens
ttgttaaattctgta

SEQ ID NO: 70161 - DNA, 15 bp, Homo sapiens
tttgttaaattctgt

SEQ ID NO: 70162 - DNA, 15 bp, Homo sapiens
ttttgttaaattctg

SEQ ID NO: 70163 - DNA, 15 bp, Homo sapiens
tttttgttaaattct

SEQ ID NO: 70164 - DNA, 15 bp, Homo sapiens
ctttttgttaaattc

SEQ ID NO: 70165 - DNA, 15 bp, Homo sapiens
cctttttgttaaatt

SEQ ID NO: 70166 - DNA, 15 bp, Homo sapiens
tcctttttgttaaat

SEQ ID NO: 70167 - DNA, 15 bp, Homo sapiens
ttcctttttgttaaa

SEQ ID NO: 70168 - DNA, 15 bp, Homo sapiens
tttcctttttgttaa

SEQ ID NO: 70169 - DNA, 15 bp, Homo sapiens
ttttcctttttgtta

SEQ ID NO: 70170 - DNA, 15 bp, Homo sapiens
tttttcctttttgtt

SEQ ID NO: 70171 - DNA, 15 bp, Homo sapiens
ctttttcctttttgt

SEQ ID NO: 70172 - DNA, 15 bp, Homo sapiens
tctttttcctttttg

SEQ ID NO: 70173 - DNA, 15 bp, Homo sapiens
ctctttttccttttt

SEQ ID NO: 70174 - DNA, 15 bp, Homo sapiens
cctctttttcctttt

SEQ ID NO: 70175 - DNA, 15 bp, Homo sapiens
tcctctttttccttt

SEQ ID NO: 70176 - DNA, 15 bp, Homo sapiens
atcctctttttcctt

SEQ ID NO: 70177 - DNA, 15 bp, Homo sapiens
tatcctctttttcct

SEQ ID NO: 70178 - DNA, 15 bp, Homo sapiens
ctatcctctttttcc

SEQ ID NO: 70179 - DNA, 15 bp, Homo sapiens
cctatcctctttttc

SEQ ID NO: 70180 - DNA, 15 bp, Homo sapiens
gcctatcctcttttt

SEQ ID NO: 70181 - DNA, 15 bp, Homo sapiens
tgcctatcctctttt

SEQ ID NO: 70182 - DNA, 15 bp, Homo sapiens
atgcctatcctcttt

SEQ ID NO: 70183 - DNA, 15 bp, Homo sapiens
catgcctatcctctt

SEQ ID NO: 70184 - DNA, 15 bp, Homo sapiens
ccatgcctatcctct

SEQ ID NO: 70185 - DNA, 15 bp, Homo sapiens
accatgcctatcctc

SEQ ID NO: 70186 - DNA, 15 bp, Homo sapiens
caccatgcctatcct

SEQ ID NO: 70187 - DNA, 15 bp, Homo sapiens
ccaccatgcctatcc

SEQ ID NO: 70188 - DNA, 15 bp, Homo sapiens
gccaccatgcctatc

SEQ ID NO: 70189 - DNA, 15 bp, Homo sapiens
agccaccatgcctat

SEQ ID NO: 70190 - DNA, 15 bp, Homo sapiens
gagccaccatgccta

SEQ ID NO: 70191 - DNA, 15 bp, Homo sapiens
caagtgctgggatta

SEQ ID NO: 70192 - DNA, 15 bp, Homo sapiens
ccaagtgctgggatt

SEQ ID NO: 70193 - DNA, 15 bp, Homo sapiens
cccaagtgctgggat

SEQ ID NO: 70194 - DNA, 15 bp, Homo sapiens
tcccaagtgctggga

SEQ ID NO: 70195 - DNA, 15 bp, Homo sapiens
ctcccaagtgctggg

SEQ ID NO: 70196 - DNA, 15 bp, Homo sapiens
cctcccaagtgctgg

SEQ ID NO: 70197 - DNA, 15 bp, Homo sapiens
gcctcccaagtgctg

SEQ ID NO: 70198 - DNA, 15 bp, Homo sapiens
ggcctcccaagtgct

SEQ ID NO: 70199 - DNA, 15 bp, Homo sapiens
tggcctcccaagtgc

SEQ ID NO: 70200 - DNA, 15 bp, Homo sapiens
gttggcctcccaagt

SEQ ID NO: 70201 - DNA, 15 bp, Homo sapiens
cgttggcctcccaag

SEQ ID NO: 70202 - DNA, 15 bp, Homo sapiens
gcgttggcctcccaa

SEQ ID NO: 70203 - DNA, 15 bp, Homo sapiens
cgcgttggcctccca

SEQ ID NO: 70204 - DNA, 15 bp, Homo sapiens
ccgcgttggcctccc

SEQ ID NO: 70205 - DNA, 15 bp, Homo sapiens
tccgcgttggcctcc

SEQ ID NO: 70206 - DNA, 15 bp, Homo sapiens
atccgcgttggcctc

SEQ ID NO: 70207 - DNA, 15 bp, Homo sapiens
catccgcgttggcct

SEQ ID NO: 70208 - DNA, 15 bp, Homo sapiens
ccatccgcgttggcc

SEQ ID NO: 70209 - DNA, 15 bp, Homo sapiens
tccatccgcgttggc

SEQ ID NO: 70210 - DNA, 15 bp, Homo sapiens
atccatccgcgttgg

SEQ ID NO: 70211 - DNA, 15 bp, Homo sapiens
gatccatccgcgttg

SEQ ID NO: 70212 - DNA, 15 bp, Homo sapiens
tgatccatccgcgtt

SEQ ID NO: 70213 - DNA, 15 bp, Homo sapiens
gtgatccatccgcgt

SEQ ID NO: 70214 - DNA, 15 bp, Homo sapiens
agtgatccatccgcg

SEQ ID NO: 70215 - DNA, 15 bp, Homo sapiens
aagtgatccatccgc

SEQ ID NO: 70216 - DNA, 15 bp, Homo sapiens
caagtgatccatccg

SEQ ID NO: 70217 - DNA, 15 bp, Homo sapiens
tcaagtgatccatcc

SEQ ID NO: 70218 - DNA, 15 bp, Homo sapiens
ctcaagtgatccatc

SEQ ID NO: 70219 - DNA, 15 bp, Homo sapiens
cctcaagtgatccat

SEQ ID NO: 70220 - DNA, 15 bp, Homo sapiens
gcctcaagtgatcca

SEQ ID NO: 70221 - DNA, 15 bp, Homo sapiens
tctcaaactcctggc

SEQ ID NO: 70222 - DNA, 15 bp, Homo sapiens
cgcccaggctggtct

SEQ ID NO: 70223 - DNA, 15 bp, Homo sapiens
tcgcccaggctggtc

SEQ ID NO: 70224 - DNA, 15 bp, Homo sapiens
gtcgcccaggctggt

SEQ ID NO: 70225 - DNA, 15 bp, Homo sapiens
catgtcgcccaggct

SEQ ID NO: 70226 - DNA, 15 bp, Homo sapiens
ccatgtcgcccaggc

SEQ ID NO: 70227 - DNA, 15 bp, Homo sapiens
gccatgtcgcccagg

SEQ ID NO: 70228 - DNA, 15 bp, Homo sapiens
cgccatgtcgcccag

SEQ ID NO: 70229 - DNA, 15 bp, Homo sapiens
tcgccatgtcgccca

SEQ ID NO: 70230 - DNA, 15 bp, Homo sapiens
ttcgccatgtcgccc

SEQ ID NO: 70231 - DNA, 15 bp, Homo sapiens
tttcgccatgtcgcc

SEQ ID NO: 70232 - DNA, 15 bp, Homo sapiens
gtttcgccatgtcgc

SEQ ID NO: 70233 - DNA, 15 bp, Homo sapiens
agtttcgccatgtcg

SEQ ID NO: 70234 - DNA, 15 bp, Homo sapiens
gagtttcgccatgtc

SEQ ID NO: 70235 - DNA, 15 bp, Homo sapiens
ggagtttcgccatgt

SEQ ID NO: 70236 - DNA, 15 bp, Homo sapiens
cggagtttcgccatg

SEQ ID NO: 70237 - DNA, 15 bp, Homo sapiens
acggagtttcgccat

SEQ ID NO: 70238 - DNA, 15 bp, Homo sapiens
gacggagtttcgcca

SEQ ID NO: 70239 - DNA, 15 bp, Homo sapiens
agagacggagtttcg

SEQ ID NO: 70240 - DNA, 15 bp, Homo sapiens
cccaccatgcccagc

SEQ ID NO: 70241 - DNA, 15 bp, Homo sapiens
gcccaccatgcccag

SEQ ID NO: 70242 - DNA, 15 bp, Homo sapiens
ggcccaccatgccca

SEQ ID NO: 70243 - DNA, 15 bp, Homo sapiens
tggcccaccatgccc

SEQ ID NO: 70244 - DNA, 15 bp, Homo sapiens
atggcccaccatgcc

SEQ ID NO: 70245 - DNA, 15 bp, Homo sapiens
catggcccaccatgc

SEQ ID NO: 70246 - DNA, 15 bp, Homo sapiens
gcatggcccaccatg

SEQ ID NO: 70247 - DNA, 15 bp, Homo sapiens
ggcatggcccaccat

SEQ ID NO: 70248 - DNA, 15 bp, Homo sapiens
aggcatggcccacca

SEQ ID NO: 70249 - DNA, 15 bp, Homo sapiens
caggcatggcccacc

SEQ ID NO: 70250 - DNA, 15 bp, Homo sapiens
acaggcatggcccac

SEQ ID NO: 70251 - DNA, 15 bp, Homo sapiens
tacaggcatggccca

SEQ ID NO: 70252 - DNA, 15 bp, Homo sapiens
ttacaggcatggccc

SEQ ID NO: 70253 - DNA, 15 bp, Homo sapiens
attacaggcatggcc

SEQ ID NO: 70254 - DNA, 15 bp, Homo sapiens
gattacaggcatggc

SEQ ID NO: 70255 - DNA, 15 bp, Homo sapiens
ggattacaggcatgg

SEQ ID NO: 70256 - DNA, 15 bp, Homo sapiens
aggattacaggcatg

SEQ ID NO: 70257 - DNA, 15 bp, Homo sapiens
taggattacaggcat

SEQ ID NO: 70258 - DNA, 15 bp, Homo sapiens
ctaggattacaggca

SEQ ID NO: 70259 - DNA, 15 bp, Homo sapiens
agctaggattacagg

SEQ ID NO: 70260 - DNA, 15 bp, Homo sapiens
tagctaggattacag

SEQ ID NO: 70261 - DNA, 15 bp, Homo sapiens
gtagctaggattaca

SEQ ID NO: 70262 - DNA, 15 bp, Homo sapiens
agtagctaggattac

SEQ ID NO: 70263 - DNA, 15 bp, Homo sapiens
acctcccaagtagct

SEQ ID NO: 70264 - DNA, 15 bp, Homo sapiens
aacctcccaagtagc

SEQ ID NO: 70265 - DNA, 15 bp, Homo sapiens
caacctcccaagtag

SEQ ID NO: 70266 - DNA, 15 bp, Homo sapiens
tcaacctcccaagta

SEQ ID NO: 70267 - DNA, 15 bp, Homo sapiens
ctcaacctcccaagt

SEQ ID NO: 70268 - DNA, 15 bp, Homo sapiens
cctcaacctcccaag

SEQ ID NO: 70269 - DNA, 15 bp, Homo sapiens
acctcaacctcccaa

SEQ ID NO: 70270 - DNA, 15 bp, Homo sapiens
tacctcaacctccca

SEQ ID NO: 70271 - DNA, 15 bp, Homo sapiens
atacctcaacctccc

SEQ ID NO: 70272 - DNA, 15 bp, Homo sapiens
catacctcaacctcc

SEQ ID NO: 70273 - DNA, 15 bp, Homo sapiens
tcatacctcaacctc

SEQ ID NO: 70274 - DNA, 15 bp, Homo sapiens
ctcatacctcaacct

SEQ ID NO: 70275 - DNA, 15 bp, Homo sapiens
cctcatacctcaacc

SEQ ID NO: 70276 - DNA, 15 bp, Homo sapiens
tcctcatacctcaac

SEQ ID NO: 70277 - DNA, 15 bp, Homo sapiens
atcctcatacctcaa

SEQ ID NO: 70278 - DNA, 15 bp, Homo sapiens
gatcctcatacctca

SEQ ID NO: 70279 - DNA, 15 bp, Homo sapiens
cgatcctcatacctc

SEQ ID NO: 70280 - DNA, 15 bp, Homo sapiens
gcgatcctcatacct

SEQ ID NO: 70281 - DNA, 15 bp, Homo sapiens
agcgatcctcatacc

SEQ ID NO: 70282 - DNA, 15 bp, Homo sapiens
aagcgatcctcatac

SEQ ID NO: 70283 - DNA, 15 bp, Homo sapiens
caagcgatcctcata

SEQ ID NO: 70284 - DNA, 15 bp, Homo sapiens
tcaagcgatcctcat

SEQ ID NO: 70285 - DNA, 15 bp, Homo sapiens
ttcaagcgatcctca

SEQ ID NO: 70286 - DNA, 15 bp, Homo sapiens
gttcaagcgatcctc

SEQ ID NO: 70287 - DNA, 15 bp, Homo sapiens
agttcaagcgatcct

SEQ ID NO: 70288 - DNA, 15 bp, Homo sapiens
gagttcaagcgatcc

SEQ ID NO: 70289 - DNA, 15 bp, Homo sapiens
tgagttcaagcgatc

SEQ ID NO: 70290 - DNA, 15 bp, Homo sapiens
ctgagttcaagcgat

SEQ ID NO: 70291 - DNA, 15 bp, Homo sapiens
cctgagttcaagcga

SEQ ID NO: 70292 - DNA, 15 bp, Homo sapiens
tcctgagttcaagcg

SEQ ID NO: 70293 - DNA, 15 bp, Homo sapiens
tctcctgagttcaag

SEQ ID NO: 70294 - DNA, 15 bp, Homo sapiens
gtctcctgagttcaa

SEQ ID NO: 70295 - DNA, 15 bp, Homo sapiens
tgtctcctgagttca

SEQ ID NO: 70296 - DNA, 15 bp, Homo sapiens
ctgtctcctgagttc

SEQ ID NO: 70297 - DNA, 15 bp, Homo sapiens
tctgtctcctgagtt

SEQ ID NO: 70298 - DNA, 15 bp, Homo sapiens
ctctgtctcctgagt

SEQ ID NO: 70299 - DNA, 15 bp, Homo sapiens
tctctgtctcctgag

SEQ ID NO: 70300 - DNA, 15 bp, Homo sapiens
atctctgtctcctga

SEQ ID NO: 70301 - DNA, 15 bp, Homo sapiens
aatctctgtctcctg

SEQ ID NO: 70302 - DNA, 15 bp, Homo sapiens
caatctctgtctcct

SEQ ID NO: 70303 - DNA, 15 bp, Homo sapiens
gcaatctctgtctcc

SEQ ID NO: 70304 - DNA, 15 bp, Homo sapiens
tgcaatctctgtctc

SEQ ID NO: 70305 - DNA, 15 bp, Homo sapiens
ctgcaatctctgtct

SEQ ID NO: 70306 - DNA, 15 bp, Homo sapiens
actgcaatctctgtc

SEQ ID NO: 70307 - DNA, 15 bp, Homo sapiens
cactgcaatctctgt

SEQ ID NO: 70308 - DNA, 15 bp, Homo sapiens
tcactgcaatctctg

SEQ ID NO: 70309 - DNA, 15 bp, Homo sapiens
ctcactgcaatctct

SEQ ID NO: 70310 - DNA, 15 bp, Homo sapiens
gctcactgcaatctc

SEQ ID NO: 70311 - DNA, 15 bp, Homo sapiens
agctcactgcaatct

SEQ ID NO: 70312 - DNA, 15 bp, Homo sapiens
cagctcactgcaatc

SEQ ID NO: 70313 - DNA, 15 bp, Homo sapiens
tcagctcactgcaat

SEQ ID NO: 70314 - DNA, 15 bp, Homo sapiens
gaatctcagctcact

SEQ ID NO: 70315 - DNA, 15 bp, Homo sapiens
tgaatctcagctcac

SEQ ID NO: 70316 - DNA, 15 bp, Homo sapiens
ctgaatctcagctca

SEQ ID NO: 70317 - DNA, 15 bp, Homo sapiens
gctgaatctcagctc

SEQ ID NO: 70318 - DNA, 15 bp, Homo sapiens
ggctgaatctcagct

SEQ ID NO: 70319 - DNA, 15 bp, Homo sapiens
tggctgaatctcagc

SEQ ID NO: 70320 - DNA, 15 bp, Homo sapiens
gtggctgaatctcag

SEQ ID NO: 70321 - DNA, 15 bp, Homo sapiens
agtggctgaatctca

SEQ ID NO: 70322 - DNA, 15 bp, Homo sapiens
cagtggctgaatctc

SEQ ID NO: 70323 - DNA, 15 bp, Homo sapiens
gcagtggctgaatct

SEQ ID NO: 70324 - DNA, 15 bp, Homo sapiens
tgcagtggctgaatc

SEQ ID NO: 70325 - DNA, 15 bp, Homo sapiens
gtgcagtggctgaat

SEQ ID NO: 70326 - DNA, 15 bp, Homo sapiens
agtgcagtggctgaa

SEQ ID NO: 70327 - DNA, 15 bp, Homo sapiens
gagtgcagtggctga

SEQ ID NO: 70328 - DNA, 15 bp, Homo sapiens
ggagtgcagtggctg

SEQ ID NO: 70329 - DNA, 15 bp, Homo sapiens
tggagtgcagtggct

SEQ ID NO: 70330 - DNA, 15 bp, Homo sapiens
cactttgttacccag

SEQ ID NO: 70331 - DNA, 15 bp, Homo sapiens
tcactttgttaccca

SEQ ID NO: 70332 - DNA, 15 bp, Homo sapiens
ctcactttgttaccc

SEQ ID NO: 70333 - DNA, 15 bp, Homo sapiens
tctcactttgttacc

SEQ ID NO: 70334 - DNA, 15 bp, Homo sapiens
gtctcactttgttac

SEQ ID NO: 70335 - DNA, 15 bp, Homo sapiens
agtctcactttgtta

SEQ ID NO: 70336 - DNA, 15 bp, Homo sapiens
cagtctcactttgtt

SEQ ID NO: 70337 - DNA, 15 bp, Homo sapiens
acagtctcactttgt

SEQ ID NO: 70338 - DNA, 15 bp, Homo sapiens
gacagtctcactttg

SEQ ID NO: 70339 - DNA, 15 bp, Homo sapiens
agacagtctcacttt

SEQ ID NO: 70340 - DNA, 15 bp, Homo sapiens
gagacagtctcactt

SEQ ID NO: 70341 - DNA, 15 bp, Homo sapiens
ggagacagtctcact

SEQ ID NO: 70342 - DNA, 15 bp, Homo sapiens
tggagacagtctcac

SEQ ID NO: 70343 - DNA, 15 bp, Homo sapiens
ttggagacagtctca

SEQ ID NO: 70344 - DNA, 15 bp, Homo sapiens
tttggagacagtctc

SEQ ID NO: 70345 - DNA, 15 bp, Homo sapiens
ttttggagacagtct

SEQ ID NO: 70346 - DNA, 15 bp, Homo sapiens
tttttggagacagtc

SEQ ID NO: 70347 - DNA, 15 bp, Homo sapiens
ttttttggagacagt

SEQ ID NO: 70348 - DNA, 15 bp, Homo sapiens
tttttttggagacag

SEQ ID NO: 70349 - DNA, 15 bp, Homo sapiens
ctttttttggagaca

SEQ ID NO: 70350 - DNA, 15 bp, Homo sapiens
cctttttttggagac

SEQ ID NO: 70351 - DNA, 15 bp, Homo sapiens
tcctttttttggaga

SEQ ID NO: 70352 - DNA, 15 bp, Homo sapiens
ttcctttttttggag

SEQ ID NO: 70353 - DNA, 15 bp, Homo sapiens
tttcctttttttgga

SEQ ID NO: 70354 - DNA, 15 bp, Homo sapiens
ttttcctttttttgg

SEQ ID NO: 70355 - DNA, 15 bp, Homo sapiens
cttttcctttttttg

SEQ ID NO: 70356 - DNA, 15 bp, Homo sapiens
tcttttccttttttt

SEQ ID NO: 70357 - DNA, 15 bp, Homo sapiens
gtcttttcctttttt

SEQ ID NO: 70358 - DNA, 15 bp, Homo sapiens
tgtcttttccttttt

SEQ ID NO: 70359 - DNA, 15 bp, Homo sapiens
atgtcttttcctttt

SEQ ID NO: 70360 - DNA, 15 bp, Homo sapiens
aatgtcttttccttt

SEQ ID NO: 70361 - DNA, 15 bp, Homo sapiens
aaatgtcttttcctt

SEQ ID NO: 70362 - DNA, 15 bp, Homo sapiens
gaaatgtcttttcct

SEQ ID NO: 70363 - DNA, 15 bp, Homo sapiens
tgaaatgtcttttcc

SEQ ID NO: 70364 - DNA, 15 bp, Homo sapiens
atgaaatgtcttttc

SEQ ID NO: 70365 - DNA, 15 bp, Homo sapiens
tatgaaatgtctttt

SEQ ID NO: 70366 - DNA, 15 bp, Homo sapiens
ctatgaaatgtcttt

SEQ ID NO: 70367 - DNA, 15 bp, Homo sapiens
cctatgaaatgtctt

SEQ ID NO: 70368 - DNA, 15 bp, Homo sapiens
ccctatgaaatgtct

SEQ ID NO: 70369 - DNA, 15 bp, Homo sapiens
cccctatgaaatgtc

SEQ ID NO: 70370 - DNA, 15 bp, Homo sapiens
gcccctatgaaatgt

SEQ ID NO: 70371 - DNA, 15 bp, Homo sapiens
tgcccctatgaaatg

SEQ ID NO: 70372 - DNA, 15 bp, Homo sapiens
ctgcccctatgaaat

SEQ ID NO: 70373 - DNA, 15 bp, Homo sapiens
actgcccctatgaaa

SEQ ID NO: 70374 - DNA, 15 bp, Homo sapiens
aactgcccctatgaa

SEQ ID NO: 70375 - DNA, 15 bp, Homo sapiens
taactgcccctatga

SEQ ID NO: 70376 - DNA, 15 bp, Homo sapiens
gtaactgcccctatg

SEQ ID NO: 70377 - DNA, 15 bp, Homo sapiens
agtaactgcccctat

SEQ ID NO: 70378 - DNA, 15 bp, Homo sapiens
aagtaactgccccta

SEQ ID NO: 70379 - DNA, 15 bp, Homo sapiens
taagtaactgcccct

SEQ ID NO: 70380 - DNA, 15 bp, Homo sapiens
ataagtaactgcccc

SEQ ID NO: 70381 - DNA, 15 bp, Homo sapiens
aataagtaactgccc

SEQ ID NO: 70382 - DNA, 15 bp, Homo sapiens
aaataagtaactgcc

SEQ ID NO: 70383 - DNA, 15 bp, Homo sapiens
caaataagtaactgc

SEQ ID NO: 70384 - DNA, 15 bp, Homo sapiens
gcaaataagtaactg

SEQ ID NO: 70385 - DNA, 15 bp, Homo sapiens
tgcaaataagtaact

SEQ ID NO: 70386 - DNA, 15 bp, Homo sapiens
ttgcaaataagtaac

SEQ ID NO: 70387 - DNA, 15 bp, Homo sapiens
attgcaaataagtaa

SEQ ID NO: 70388 - DNA, 15 bp, Homo sapiens
cattgcaaataagta

SEQ ID NO: 70389 - DNA, 15 bp, Homo sapiens
acattgcaaataagt

SEQ ID NO: 70390 - DNA, 15 bp, Homo sapiens
aacattgcaaataag

SEQ ID NO: 70391 - DNA, 15 bp, Homo sapiens
taacattgcaaataa

SEQ ID NO: 70392 - DNA, 15 bp, Homo sapiens
ttaacattgcaaata

SEQ ID NO: 70393 - DNA, 15 bp, Homo sapiens
cttaacattgcaaat

SEQ ID NO: 70394 - DNA, 15 bp, Homo sapiens
tcttaacattgcaaa

SEQ ID NO: 70395 - DNA, 15 bp, Homo sapiens
atcttaacattgcaa

SEQ ID NO: 70396 - DNA, 15 bp, Homo sapiens
aatcttaacattgca

SEQ ID NO: 70397 - DNA, 15 bp, Homo sapiens
taatcttaacattgc

SEQ ID NO: 70398 - DNA, 15 bp, Homo sapiens
ctaatcttaacattg

SEQ ID NO: 70399 - DNA, 15 bp, Homo sapiens
gctaatcttaacatt

SEQ ID NO: 70400 - DNA, 15 bp, Homo sapiens
agctaatcttaacat

SEQ ID NO: 70401 - DNA, 15 bp, Homo sapiens
tagctaatcttaaca

SEQ ID NO: 70402 - DNA, 15 bp, Homo sapiens
ttagctaatcttaac

SEQ ID NO: 70403 - DNA, 15 bp, Homo sapiens
tttagctaatcttaa

SEQ ID NO: 70404 - DNA, 15 bp, Homo sapiens
gtttagctaatctta

SEQ ID NO: 70405 - DNA, 15 bp, Homo sapiens
tgtttagctaatctt

SEQ ID NO: 70406 - DNA, 15 bp, Homo sapiens
atgtttagctaatct

SEQ ID NO: 70407 - DNA, 15 bp, Homo sapiens
aatgtttagctaatc

SEQ ID NO: 70408 - DNA, 15 bp, Homo sapiens
taatgtttagctaat

SEQ ID NO: 70409 - DNA, 15 bp, Homo sapiens
ttaatgtttagctaa

SEQ ID NO: 70410 - DNA, 15 bp, Homo sapiens
gttaatgtttagcta

SEQ ID NO: 70411 - DNA, 15 bp, Homo sapiens
agttaatgtttagct

SEQ ID NO: 70412 - DNA, 15 bp, Homo sapiens
aagttaatgtttagc

SEQ ID NO: 70413 - DNA, 15 bp, Homo sapiens
caagttaatgtttag

SEQ ID NO: 70414 - DNA, 15 bp, Homo sapiens
ccaagttaatgttta

SEQ ID NO: 70415 - DNA, 15 bp, Homo sapiens
accaagttaatgttt

SEQ ID NO: 70416 - DNA, 15 bp, Homo sapiens
caccaagttaatgtt

SEQ ID NO: 70417 - DNA, 15 bp, Homo sapiens
acaccaagttaatgt

SEQ ID NO: 70418 - DNA, 15 bp, Homo sapiens
cacaccaagttaatg

SEQ ID NO: 70419 - DNA, 15 bp, Homo sapiens
tcacaccaagttaat

SEQ ID NO: 70420 - DNA, 15 bp, Homo sapiens
ttcacaccaagttaa

SEQ ID NO: 70421 - DNA, 15 bp, Homo sapiens
cttcacaccaagtta

SEQ ID NO: 70422 - DNA, 15 bp, Homo sapiens
tcttcacaccaagtt

SEQ ID NO: 70423 - DNA, 15 bp, Homo sapiens
gtcttcacaccaagt

SEQ ID NO: 70424 - DNA, 15 bp, Homo sapiens
tgtcttcacaccaag

SEQ ID NO: 70425 - DNA, 15 bp, Homo sapiens
ctgtcttcacaccaa

SEQ ID NO: 70426 - DNA, 15 bp, Homo sapiens
cctgtcttcacacca

SEQ ID NO: 70427 - DNA, 15 bp, Homo sapiens
tcctgtcttcacacc

SEQ ID NO: 70428 - DNA, 15 bp, Homo sapiens
gtcctgtcttcacac

SEQ ID NO: 70429 - DNA, 15 bp, Homo sapiens
agtcctgtcttcaca

SEQ ID NO: 70430 - DNA, 15 bp, Homo sapiens
tagtcctgtcttcac

SEQ ID NO: 70431 - DNA, 15 bp, Homo sapiens
atagtcctgtcttca

SEQ ID NO: 70432 - DNA, 15 bp, Homo sapiens
catagtcctgtcttc

SEQ ID NO: 70433 - DNA, 15 bp, Homo sapiens
ccatagtcctgtctt

SEQ ID NO: 70434 - DNA, 15 bp, Homo sapiens
tccatagtcctgtct

SEQ ID NO: 70435 - DNA, 15 bp, Homo sapiens
ctccatagtcctgtc

SEQ ID NO: 70436 - DNA, 15 bp, Homo sapiens
actccatagtcctgt

SEQ ID NO: 70437 - DNA, 15 bp, Homo sapiens
tactccatagtcctg

SEQ ID NO: 70438 - DNA, 15 bp, Homo sapiens
atactccatagtcct

SEQ ID NO: 70439 - DNA, 15 bp, Homo sapiens
aatactccatagtcc

SEQ ID NO: 70440 - DNA, 15 bp, Homo sapiens
caatactccatagtc

SEQ ID NO: 70441 - DNA, 15 bp, Homo sapiens
tcaatactccatagt

SEQ ID NO: 70442 - DNA, 15 bp, Homo sapiens
atcaatactccatag

SEQ ID NO: 70443 - DNA, 15 bp, Homo sapiens
gatcaatactccata

SEQ ID NO: 70444 - DNA, 15 bp, Homo sapiens
agatcaatactccat

SEQ ID NO: 70445 - DNA, 15 bp, Homo sapiens
tagatcaatactcca

SEQ ID NO: 70446 - DNA, 15 bp, Homo sapiens
gtagatcaatactcc

SEQ ID NO: 70447 - DNA, 15 bp, Homo sapiens
agtagatcaatactc

SEQ ID NO: 70448 - DNA, 15 bp, Homo sapiens
aagtagatcaatact

SEQ ID NO: 70449 - DNA, 15 bp, Homo sapiens
aaagtagatcaatac

SEQ ID NO: 70450 - DNA, 15 bp, Homo sapiens
aaaagtagatcaata

SEQ ID NO: 70451 - DNA, 15 bp, Homo sapiens
gaaaagtagatcaat

SEQ ID NO: 70452 - DNA, 15 bp, Homo sapiens
ggaaaagtagatcaa

SEQ ID NO: 70453 - DNA, 15 bp, Homo sapiens
tggaaaagtagatca

SEQ ID NO: 70454 - DNA, 15 bp, Homo sapiens
atggaaaagtagatc

SEQ ID NO: 70455 - DNA, 15 bp, Homo sapiens
aatggaaaagtagat

SEQ ID NO: 70456 - DNA, 15 bp, Homo sapiens
aaatggaaaagtaga

SEQ ID NO: 70457 - DNA, 15 bp, Homo sapiens
aaaatggaaaagtag

SEQ ID NO: 70458 - DNA, 15 bp, Homo sapiens
caaaatggaaaagta

SEQ ID NO: 70459 - DNA, 15 bp, Homo sapiens
acaaaatggaaaagt

SEQ ID NO: 70460 - DNA, 15 bp, Homo sapiens
cacaaaatggaaaag

SEQ ID NO: 70461 - DNA, 15 bp, Homo sapiens
tcacaaaatggaaaa

SEQ ID NO: 70462 - DNA, 15 bp, Homo sapiens
gtcacaaaatggaaa

SEQ ID NO: 70463 - DNA, 15 bp, Homo sapiens
agtcacaaaatggaa

SEQ ID NO: 70464 - DNA, 15 bp, Homo sapiens
aagtcacaaaatgga

SEQ ID NO: 70465 - DNA, 15 bp, Homo sapiens
aaagtcacaaaatgg

SEQ ID NO: 70466 - DNA, 15 bp, Homo sapiens
aaaagtcacaaaatg

SEQ ID NO: 70467 - DNA, 15 bp, Homo sapiens
taaaagtcacaaaat

SEQ ID NO: 70468 - DNA, 15 bp, Homo sapiens
ataaaagtcacaaaa

SEQ ID NO: 70469 - DNA, 15 bp, Homo sapiens
aataaaagtcacaaa

SEQ ID NO: 70470 - DNA, 15 bp, Homo sapiens
aaataaaagtcacaa

SEQ ID NO: 70471 - DNA, 15 bp, Homo sapiens
aaaataaaagtcaca

SEQ ID NO: 70472 - DNA, 15 bp, Homo sapiens
taaaataaaagtcac

SEQ ID NO: 70473 - DNA, 15 bp, Homo sapiens
ttaaaataaaagtca

SEQ ID NO: 70474 - DNA, 15 bp, Homo sapiens
tttaaaataaaagtc

SEQ ID NO: 70475 - DNA, 15 bp, Homo sapiens
ctttaaaataaaagt

SEQ ID NO: 70476 - DNA, 15 bp, Homo sapiens
gctttaaaataaaag

SEQ ID NO: 70477 - DNA, 15 bp, Homo sapiens
agctttaaaataaaa

SEQ ID NO: 70478 - DNA, 15 bp, Homo sapiens
aagctttaaaataaa

SEQ ID NO: 70479 - DNA, 15 bp, Homo sapiens
aaagctttaaaataa

SEQ ID NO: 70480 - DNA, 15 bp, Homo sapiens
gaaagctttaaaata

SEQ ID NO: 70481 - DNA, 15 bp, Homo sapiens
agaaagctttaaaat

SEQ ID NO: 70482 - DNA, 15 bp, Homo sapiens
gagaaagctttaaaa

SEQ ID NO: 70483 - DNA, 15 bp, Homo sapiens
tgagaaagctttaaa

SEQ ID NO: 70484 - DNA, 15 bp, Homo sapiens
atgagaaagctttaa

SEQ ID NO: 70485 - DNA, 15 bp, Homo sapiens
catgagaaagcttta

SEQ ID NO: 70486 - DNA, 15 bp, Homo sapiens
ccatgagaaagcttt

SEQ ID NO: 70487 - DNA, 15 bp, Homo sapiens
accatgagaaagctt

SEQ ID NO: 70488 - DNA, 15 bp, Homo sapiens
aaccatgagaaagct

SEQ ID NO: 70489 - DNA, 15 bp, Homo sapiens
aaaccatgagaaagc

SEQ ID NO: 70490 - DNA, 15 bp, Homo sapiens
taaaccatgagaaag

SEQ ID NO: 70491 - DNA, 15 bp, Homo sapiens
ataaaccatgagaaa

SEQ ID NO: 70492 - DNA, 15 bp, Homo sapiens
aataaaccatgagaa

SEQ ID NO: 70493 - DNA, 15 bp, Homo sapiens
aaataaaccatgaga

SEQ ID NO: 70494 - DNA, 15 bp, Homo sapiens
aaaataaaccatgag

SEQ ID NO: 70495 - DNA, 15 bp, Homo sapiens
taaaataaaccatga

SEQ ID NO: 70496 - DNA, 15 bp, Homo sapiens
ataaaataaaccatg

SEQ ID NO: 70497 - DNA, 15 bp, Homo sapiens
aataaaataaaccat

SEQ ID NO: 70498 - DNA, 15 bp, Homo sapiens
aaataaaataaacca

SEQ ID NO: 70499 - DNA, 15 bp, Homo sapiens
gaaataaaataaacc

SEQ ID NO: 70500 - DNA, 15 bp, Homo sapiens
tgaaataaaataaac

SEQ ID NO: 70501 - DNA, 15 bp, Homo sapiens
atgaaataaaataaa

SEQ ID NO: 70502 - DNA, 15 bp, Homo sapiens
catgaaataaaataa

SEQ ID NO: 70503 - DNA, 15 bp, Homo sapiens
acatgaaataaaata

SEQ ID NO: 70504 - DNA, 15 bp, Homo sapiens
tacatgaaataaaat

SEQ ID NO: 70505 - DNA, 15 bp, Homo sapiens
atacatgaaataaaa

SEQ ID NO: 70506 - DNA, 15 bp, Homo sapiens
aatacatgaaataaa

SEQ ID NO: 70507 - DNA, 15 bp, Homo sapiens
caatacatgaaataa

SEQ ID NO: 70508 - DNA, 15 bp, Homo sapiens
acaatacatgaaata

SEQ ID NO: 70509 - DNA, 15 bp, Homo sapiens
cacaatacatgaaat

SEQ ID NO: 70510 - DNA, 15 bp, Homo sapiens
acacaatacatgaaa

SEQ ID NO: 70511 - DNA, 15 bp, Homo sapiens
gacacaatacatgaa

SEQ ID NO: 70512 - DNA, 15 bp, Homo sapiens
agacacaatacatga

SEQ ID NO: 70513 - DNA, 15 bp, Homo sapiens
aagacacaatacatg

SEQ ID NO: 70514 - DNA, 15 bp, Homo sapiens
taagacacaatacat

SEQ ID NO: 70515 - DNA, 15 bp, Homo sapiens
ttaagacacaataca

SEQ ID NO: 70516 - DNA, 15 bp, Homo sapiens
cttaagacacaatac

SEQ ID NO: 70517 - DNA, 15 bp, Homo sapiens
ccttaagacacaata

SEQ ID NO: 70518 - DNA, 15 bp, Homo sapiens
tccttaagacacaat

SEQ ID NO: 70519 - DNA, 15 bp, Homo sapiens
ctccttaagacacaa

SEQ ID NO: 70520 - DNA, 15 bp, Homo sapiens
gctccttaagacaca

SEQ ID NO: 70521 - DNA, 15 bp, Homo sapiens
tgctccttaagacac

SEQ ID NO: 70522 - DNA, 15 bp, Homo sapiens
ttgctccttaagaca

SEQ ID NO: 70523 - DNA, 15 bp, Homo sapiens
tttgctccttaagac

SEQ ID NO: 70524 - DNA, 15 bp, Homo sapiens
gtttgctccttaaga

SEQ ID NO: 70525 - DNA, 15 bp, Homo sapiens
agtttgctccttaag

SEQ ID NO: 70526 - DNA, 15 bp, Homo sapiens
cagtttgctccttaa

SEQ ID NO: 70527 - DNA, 15 bp, Homo sapiens
gcagtttgctcctta

SEQ ID NO: 70528 - DNA, 15 bp, Homo sapiens
tgcagtttgctcctt

SEQ ID NO: 70529 - DNA, 15 bp, Homo sapiens
atgcagtttgctcct

SEQ ID NO: 70530 - DNA, 15 bp, Homo sapiens
aatgcagtttgctcc

SEQ ID NO: 70531 - DNA, 15 bp, Homo sapiens
gaatgcagtttgctc

SEQ ID NO: 70532 - DNA, 15 bp, Homo sapiens
tgaatgcagtttgct

SEQ ID NO: 70533 - DNA, 15 bp, Homo sapiens
atgaatgcagtttgc

SEQ ID NO: 70534 - DNA, 15 bp, Homo sapiens
aatgaatgcagtttg

SEQ ID NO: 70535 - DNA, 15 bp, Homo sapiens
caatgaatgcagttt

SEQ ID NO: 70536 - DNA, 15 bp, Homo sapiens
gcaatgaatgcagtt

SEQ ID NO: 70537 - DNA, 15 bp, Homo sapiens
ggcaatgaatgcagt

SEQ ID NO: 70538 - DNA, 15 bp, Homo sapiens
tggcaatgaatgcag

SEQ ID NO: 70539 - DNA, 15 bp, Homo sapiens
gtggcaatgaatgca

SEQ ID NO: 70540 - DNA, 15 bp, Homo sapiens
agtggcaatgaatgc

SEQ ID NO: 70541 - DNA, 15 bp, Homo sapiens
aagtggcaatgaatg

SEQ ID NO: 70542 - DNA, 15 bp, Homo sapiens
gaagtggcaatgaat

SEQ ID NO: 70543 - DNA, 15 bp, Homo sapiens
ggaagtggcaatgaa

SEQ ID NO: 70544 - DNA, 15 bp, Homo sapiens
tggaagtggcaatga

SEQ ID NO: 70545 - DNA, 15 bp, Homo sapiens
gtggaagtggcaatg

SEQ ID NO: 70546 - DNA, 15 bp, Homo sapiens
ggtggaagtggcaat

SEQ ID NO: 70547 - DNA, 15 bp, Homo sapiens
aggtggaagtggcaa

SEQ ID NO: 70548 - DNA, 15 bp, Homo sapiens
taggtggaagtggca

SEQ ID NO: 70549 - DNA, 15 bp, Homo sapiens
ataggtggaagtggc

SEQ ID NO: 70550 - DNA, 15 bp, Homo sapiens
aataggtggaagtgg

SEQ ID NO: 70551 - DNA, 15 bp, Homo sapiens
aaataggtggaagtg

SEQ ID NO: 70552 - DNA, 15 bp, Homo sapiens
taaataggtggaagt

SEQ ID NO: 70553 - DNA, 15 bp, Homo sapiens
ttaaataggtggaag

SEQ ID NO: 70554 - DNA, 15 bp, Homo sapiens
attaaataggtggaa

SEQ ID NO: 70555 - DNA, 15 bp, Homo sapiens
tattaaataggtgga

SEQ ID NO: 70556 - DNA, 15 bp, Homo sapiens
ttattaaataggtgg

SEQ ID NO: 70557 - DNA, 15 bp, Homo sapiens
cttattaaataggtg

SEQ ID NO: 70558 - DNA, 15 bp, Homo sapiens
gcttattaaataggt

SEQ ID NO: 70559 - DNA, 15 bp, Homo sapiens
tgcttattaaatagg

SEQ ID NO: 70560 - DNA, 15 bp, Homo sapiens
ctgcttattaaatag

SEQ ID NO: 70561 - DNA, 15 bp, Homo sapiens
cctgcttattaaata

SEQ ID NO: 70562 - DNA, 15 bp, Homo sapiens
tcctgcttattaaat

SEQ ID NO: 70563 - DNA, 15 bp, Homo sapiens
ttcctgcttattaaa

SEQ ID NO: 70564 - DNA, 15 bp, Homo sapiens
attcctgcttattaa

SEQ ID NO: 70565 - DNA, 15 bp, Homo sapiens
aattcctgcttatta

SEQ ID NO: 70566 - DNA, 15 bp, Homo sapiens
gaattcctgcttatt

SEQ ID NO: 70567 - DNA, 15 bp, Homo sapiens
ggaattcctgcttat

SEQ ID NO: 70568 - DNA, 15 bp, Homo sapiens
aggaattcctgctta

SEQ ID NO: 70569 - DNA, 15 bp, Homo sapiens
caggaattcctgctt

SEQ ID NO: 70570 - DNA, 15 bp, Homo sapiens
tcaggaattcctgct

SEQ ID NO: 70571 - DNA, 15 bp, Homo sapiens
atcaggaattcctgc

SEQ ID NO: 70572 - DNA, 15 bp, Homo sapiens
aatcaggaattcctg

SEQ ID NO: 70573 - DNA, 15 bp, Homo sapiens
caatcaggaattcct

SEQ ID NO: 70574 - DNA, 15 bp, Homo sapiens
tcaatcaggaattcc

SEQ ID NO: 70575 - DNA, 15 bp, Homo sapiens
ttcaatcaggaattc

SEQ ID NO: 70576 - DNA, 15 bp, Homo sapiens
cttcaatcaggaatt

SEQ ID NO: 70577 - DNA, 15 bp, Homo sapiens
tcttcaatcaggaat

SEQ ID NO: 70578 - DNA, 15 bp, Homo sapiens
ttcttcaatcaggaa

SEQ ID NO: 70579 - DNA, 15 bp, Homo sapiens
tttcttcaatcagga

SEQ ID NO: 70580 - DNA, 15 bp, Homo sapiens
gtttcttcaatcagg

SEQ ID NO: 70581 - DNA, 15 bp, Homo sapiens
tgtttcttcaatcag

SEQ ID NO: 70582 - DNA, 15 bp, Homo sapiens
ttgtttcttcaatca

SEQ ID NO: 70583 - DNA, 15 bp, Homo sapiens
attgtttcttcaatc

SEQ ID NO: 70584 - DNA, 15 bp, Homo sapiens
cattgtttcttcaat

SEQ ID NO: 70585 - DNA, 15 bp, Homo sapiens
tcattgtttcttcaa

SEQ ID NO: 70586 - DNA, 15 bp, Homo sapiens
atcattgtttcttca

SEQ ID NO: 70587 - DNA, 15 bp, Homo sapiens
aatcattgtttcttc

SEQ ID NO: 70588 - DNA, 15 bp, Homo sapiens
gaatcattgtttctt

SEQ ID NO: 70589 - DNA, 15 bp, Homo sapiens
agaatcattgtttct

SEQ ID NO: 70590 - DNA, 15 bp, Homo sapiens
cagaatcattgtttc

SEQ ID NO: 70591 - DNA, 15 bp, Homo sapiens
tcagaatcattgttt

SEQ ID NO: 70592 - DNA, 15 bp, Homo sapiens
atcagaatcattgtt

SEQ ID NO: 70593 - DNA, 15 bp, Homo sapiens
tatcagaatcattgt

SEQ ID NO: 70594 - DNA, 15 bp, Homo sapiens
atatcagaatcattg

SEQ ID NO: 70595 - DNA, 15 bp, Homo sapiens
catatcagaatcatt

SEQ ID NO: 70596 - DNA, 15 bp, Homo sapiens
tcatatcagaatcat

SEQ ID NO: 70597 - DNA, 15 bp, Homo sapiens
ttcatatcagaatca

SEQ ID NO: 70598 - DNA, 15 bp, Homo sapiens
attcatatcagaatc

SEQ ID NO: 70599 - DNA, 15 bp, Homo sapiens
tattcatatcagaat

SEQ ID NO: 70600 - DNA, 15 bp, Homo sapiens
gtattcatatcagaa

SEQ ID NO: 70601 - DNA, 15 bp, Homo sapiens
tgtattcatatcaga

SEQ ID NO: 70602 - DNA, 15 bp, Homo sapiens
ctgtattcatatcag

SEQ ID NO: 70603 - DNA, 15 bp, Homo sapiens
cctgtattcatatca

SEQ ID NO: 70604 - DNA, 15 bp, Homo sapiens
ccctgtattcatatc

SEQ ID NO: 70605 - DNA, 15 bp, Homo sapiens
accctgtattcatat

SEQ ID NO: 70606 - DNA, 15 bp, Homo sapiens
caccctgtattcata

SEQ ID NO: 70607 - DNA, 15 bp, Homo sapiens
gcaccctgtattcat

SEQ ID NO: 70608 - DNA, 15 bp, Homo sapiens
agcaccctgtattca

SEQ ID NO: 70609 - DNA, 15 bp, Homo sapiens
cagcaccctgtattc

SEQ ID NO: 70610 - DNA, 15 bp, Homo sapiens
gcagcaccctgtatt

SEQ ID NO: 70611 - DNA, 15 bp, Homo sapiens
agcagcaccctgtat

SEQ ID NO: 70612 - DNA, 15 bp, Homo sapiens
aagcagcaccctgta

SEQ ID NO: 70613 - DNA, 15 bp, Homo sapiens
aaagcagcaccctgt

SEQ ID NO: 70614 - DNA, 15 bp, Homo sapiens
aaaagcagcaccctg

SEQ ID NO: 70615 - DNA, 15 bp, Homo sapiens
aaaaagcagcaccct

SEQ ID NO: 70616 - DNA, 15 bp, Homo sapiens
caaaaagcagcaccc

SEQ ID NO: 70617 - DNA, 15 bp, Homo sapiens
gcaaaaagcagcacc

SEQ ID NO: 70618 - DNA, 15 bp, Homo sapiens
tgcaaaaagcagcac

SEQ ID NO: 70619 - DNA, 15 bp, Homo sapiens
atgcaaaaagcagca

SEQ ID NO: 70620 - DNA, 15 bp, Homo sapiens
aatgcaaaaagcagc

SEQ ID NO: 70621 - DNA, 15 bp, Homo sapiens
gaatgcaaaaagcag

SEQ ID NO: 70622 - DNA, 15 bp, Homo sapiens
agaatgcaaaaagca

SEQ ID NO: 70623 - DNA, 15 bp, Homo sapiens
aagaatgcaaaaagc

SEQ ID NO: 70624 - DNA, 15 bp, Homo sapiens
aaagaatgcaaaaag

SEQ ID NO: 70625 - DNA, 15 bp, Homo sapiens
caaagaatgcaaaaa

SEQ ID NO: 70626 - DNA, 15 bp, Homo sapiens
acaaagaatgcaaaa

SEQ ID NO: 70627 - DNA, 15 bp, Homo sapiens
gacaaagaatgcaaa

SEQ ID NO: 70628 - DNA, 15 bp, Homo sapiens
agacaaagaatgcaa

SEQ ID NO: 70629 - DNA, 15 bp, Homo sapiens
cagacaaagaatgca

SEQ ID NO: 70630 - DNA, 15 bp, Homo sapiens
gcagacaaagaatgc

SEQ ID NO: 70631 - DNA, 15 bp, Homo sapiens
tgcagacaaagaatg

SEQ ID NO: 70632 - DNA, 15 bp, Homo sapiens
atgcagacaaagaat

SEQ ID NO: 70633 - DNA, 15 bp, Homo sapiens
aatgcagacaaagaa

SEQ ID NO: 70634 - DNA, 15 bp, Homo sapiens
aaatgcagacaaaga

SEQ ID NO: 70635 - DNA, 15 bp, Homo sapiens
taaatgcagacaaag

SEQ ID NO: 70636 - DNA, 15 bp, Homo sapiens
ttaaatgcagacaaa

SEQ ID NO: 70637 - DNA, 15 bp, Homo sapiens
attaaatgcagacaa

SEQ ID NO: 70638 - DNA, 15 bp, Homo sapiens
cattaaatgcagaca

SEQ ID NO: 70639 - DNA, 15 bp, Homo sapiens
tcattaaatgcagac

SEQ ID NO: 70640 - DNA, 15 bp, Homo sapiens
ttcattaaatgcaga

SEQ ID NO: 70641 - DNA, 15 bp, Homo sapiens
gttcattaaatgcag

SEQ ID NO: 70642 - DNA, 15 bp, Homo sapiens
agttcattaaatgca

SEQ ID NO: 70643 - DNA, 15 bp, Homo sapiens
gagttcattaaatgc

SEQ ID NO: 70644 - DNA, 15 bp, Homo sapiens
ggagttcattaaatg

SEQ ID NO: 70645 - DNA, 15 bp, Homo sapiens
tggagttcattaaat

SEQ ID NO: 70646 - DNA, 15 bp, Homo sapiens
atggagttcattaaa

SEQ ID NO: 70647 - DNA, 15 bp, Homo sapiens
aatggagttcattaa

SEQ ID NO: 70648 - DNA, 15 bp, Homo sapiens
aaatggagttcatta

SEQ ID NO: 70649 - DNA, 15 bp, Homo sapiens
taaatggagttcatt

SEQ ID NO: 70650 - DNA, 15 bp, Homo sapiens
ctaaatggagttcat

SEQ ID NO: 70651 - DNA, 15 bp, Homo sapiens
cctaaatggagttca

SEQ ID NO: 70652 - DNA, 15 bp, Homo sapiens
tcctaaatggagttc

SEQ ID NO: 70653 - DNA, 15 bp, Homo sapiens
gtcctaaatggagtt

SEQ ID NO: 70654 - DNA, 15 bp, Homo sapiens
tgtcctaaatggagt

SEQ ID NO: 70655 - DNA, 15 bp, Homo sapiens
ttgtcctaaatggag

SEQ ID NO: 70656 - DNA, 15 bp, Homo sapiens
tttgtcctaaatgga

SEQ ID NO: 70657 - DNA, 15 bp, Homo sapiens
ttttgtcctaaatgg

SEQ ID NO: 70658 - DNA, 15 bp, Homo sapiens
attttgtcctaaatg

SEQ ID NO: 70659 - DNA, 15 bp, Homo sapiens
tattttgtcctaaat

SEQ ID NO: 70660 - DNA, 15 bp, Homo sapiens
ttattttgtcctaaa

SEQ ID NO: 70661 - DNA, 15 bp, Homo sapiens
tttattttgtcctaa

SEQ ID NO: 70662 - DNA, 15 bp, Homo sapiens
ttttattttgtccta

SEQ ID NO: 70663 - DNA, 15 bp, Homo sapiens
cttttattttgtcct

SEQ ID NO: 70664 - DNA, 15 bp, Homo sapiens
acttttattttgtcc

SEQ ID NO: 70665 - DNA, 15 bp, Homo sapiens
aacttttattttgtc

SEQ ID NO: 70666 - DNA, 15 bp, Homo sapiens
aaacttttattttgt

SEQ ID NO: 70667 - DNA, 15 bp, Homo sapiens
taaacttttattttg

SEQ ID NO: 70668 - DNA, 15 bp, Homo sapiens
gtaaacttttatttt

SEQ ID NO: 70669 - DNA, 15 bp, Homo sapiens
agtaaacttttattt

SEQ ID NO: 70670 - DNA, 15 bp, Homo sapiens
aagtaaacttttatt

SEQ ID NO: 70671 - DNA, 15 bp, Homo sapiens
aaagtaaacttttat

SEQ ID NO: 70672 - DNA, 15 bp, Homo sapiens
gaaagtaaactttta

SEQ ID NO: 70673 - DNA, 15 bp, Homo sapiens
ggaaagtaaactttt

SEQ ID NO: 70674 - DNA, 15 bp, Homo sapiens
aggaaagtaaacttt

SEQ ID NO: 70675 - DNA, 15 bp, Homo sapiens
caggaaagtaaactt

SEQ ID NO: 70676 - DNA, 15 bp, Homo sapiens
ccaggaaagtaaact

SEQ ID NO: 70677 - DNA, 15 bp, Homo sapiens
gccaggaaagtaaac

SEQ ID NO: 70678 - DNA, 15 bp, Homo sapiens
agccaggaaagtaaa

SEQ ID NO: 70679 - DNA, 15 bp, Homo sapiens
aagccaggaaagtaa

SEQ ID NO: 70680 - DNA, 15 bp, Homo sapiens
gaagccaggaaagta

SEQ ID NO: 70681 - DNA, 15 bp, Homo sapiens
agaagccaggaaagt

SEQ ID NO: 70682 - DNA, 15 bp, Homo sapiens
tagaagccaggaaag

SEQ ID NO: 70683 - DNA, 15 bp, Homo sapiens
atagaagccaggaaa

SEQ ID NO: 70684 - DNA, 15 bp, Homo sapiens
tatagaagccaggaa

SEQ ID NO: 70685 - DNA, 15 bp, Homo sapiens
atatagaagccagga

SEQ ID NO: 70686 - DNA, 15 bp, Homo sapiens
aatatagaagccagg

SEQ ID NO: 70687 - DNA, 15 bp, Homo sapiens
aaatatagaagccag

SEQ ID NO: 70688 - DNA, 15 bp, Homo sapiens
taaatatagaagcca

SEQ ID NO: 70689 - DNA, 15 bp, Homo sapiens
ttaaatatagaagcc

SEQ ID NO: 70690 - DNA, 15 bp, Homo sapiens
tttaaatatagaagc

SEQ ID NO: 70691 - DNA, 15 bp, Homo sapiens
ctttaaatatagaag

SEQ ID NO: 70692 - DNA, 15 bp, Homo sapiens
tctttaaatatagaa

SEQ ID NO: 70693 - DNA, 15 bp, Homo sapiens
gtctttaaatataga

SEQ ID NO: 70694 - DNA, 15 bp, Homo sapiens
agtctttaaatatag

SEQ ID NO: 70695 - DNA, 15 bp, Homo sapiens
tagtctttaaatata

SEQ ID NO: 70696 - DNA, 15 bp, Homo sapiens
ttagtctttaaatat

SEQ ID NO: 70697 - DNA, 15 bp, Homo sapiens
tttagtctttaaata

SEQ ID NO: 70698 - DNA, 15 bp, Homo sapiens
atttagtctttaaat

SEQ ID NO: 70699 - DNA, 15 bp, Homo sapiens
catttagtctttaaa

SEQ ID NO: 70700 - DNA, 15 bp, Homo sapiens
gcatttagtctttaa

SEQ ID NO: 70701 - DNA, 15 bp, Homo sapiens
agcatttagtcttta

SEQ ID NO: 70702 - DNA, 15 bp, Homo sapiens
tagcatttagtcttt

SEQ ID NO: 70703 - DNA, 15 bp, Homo sapiens
gtagcatttagtctt

SEQ ID NO: 70704 - DNA, 15 bp, Homo sapiens
ggtagcatttagtct

SEQ ID NO: 70705 - DNA, 15 bp, Homo sapiens
aggtagcatttagtc

SEQ ID NO: 70706 - DNA, 15 bp, Homo sapiens
aaggtagcatttagt

SEQ ID NO: 70707 - DNA, 15 bp, Homo sapiens
caaggtagcatttag

SEQ ID NO: 70708 - DNA, 15 bp, Homo sapiens
tcaaggtagcattta

SEQ ID NO: 70709 - DNA, 15 bp, Homo sapiens
ttcaaggtagcattt

SEQ ID NO: 70710 - DNA, 15 bp, Homo sapiens
attcaaggtagcatt

SEQ ID NO: 70711 - DNA, 15 bp, Homo sapiens
cattcaaggtagcat

SEQ ID NO: 70712 - DNA, 15 bp, Homo sapiens
acattcaaggtagca

SEQ ID NO: 70713 - DNA, 15 bp, Homo sapiens
aacattcaaggtagc

SEQ ID NO: 70714 - DNA, 15 bp, Homo sapiens
aaacattcaaggtag

SEQ ID NO: 70715 - DNA, 15 bp, Homo sapiens
taaacattcaaggta

SEQ ID NO: 70716 - DNA, 15 bp, Homo sapiens
ctaaacattcaaggt

SEQ ID NO: 70717 - DNA, 15 bp, Homo sapiens
tctaaacattcaagg

SEQ ID NO: 70718 - DNA, 15 bp, Homo sapiens
gtctaaacattcaag

SEQ ID NO: 70719 - DNA, 15 bp, Homo sapiens
tgtctaaacattcaa

SEQ ID NO: 70720 - DNA, 15 bp, Homo sapiens
ttgtctaaacattca

SEQ ID NO: 70721 - DNA, 15 bp, Homo sapiens
cttgtctaaacattc

SEQ ID NO: 70722 - DNA, 15 bp, Homo sapiens
ccttgtctaaacatt

SEQ ID NO: 70723 - DNA, 15 bp, Homo sapiens
cccttgtctaaacat

SEQ ID NO: 70724 - DNA, 15 bp, Homo sapiens
acccttgtctaaaca

SEQ ID NO: 70725 - DNA, 15 bp, Homo sapiens
cacccttgtctaaac

SEQ ID NO: 70726 - DNA, 15 bp, Homo sapiens
acacccttgtctaaa

SEQ ID NO: 70727 - DNA, 15 bp, Homo sapiens
gacacccttgtctaa

SEQ ID NO: 70728 - DNA, 15 bp, Homo sapiens
agacacccttgtcta

SEQ ID NO: 70729 - DNA, 15 bp, Homo sapiens
aagacacccttgtct

SEQ ID NO: 70730 - DNA, 15 bp, Homo sapiens
gaagacacccttgtc

SEQ ID NO: 70731 - DNA, 15 bp, Homo sapiens
ggaagacacccttgt

SEQ ID NO: 70732 - DNA, 15 bp, Homo sapiens
gggaagacacccttg

SEQ ID NO: 70733 - DNA, 15 bp, Homo sapiens
agggaagacaccctt

SEQ ID NO: 70734 - DNA, 15 bp, Homo sapiens
aagggaagacaccct

SEQ ID NO: 70735 - DNA, 15 bp, Homo sapiens
caagggaagacaccc

SEQ ID NO: 70736 - DNA, 15 bp, Homo sapiens
gcaagggaagacacc

SEQ ID NO: 70737 - DNA, 15 bp, Homo sapiens
ggcaagggaagacac

SEQ ID NO: 70738 - DNA, 15 bp, Homo sapiens
gggcaagggaagaca

SEQ ID NO: 70739 - DNA, 15 bp, Homo sapiens
agggcaagggaagac

SEQ ID NO: 70740 - DNA, 15 bp, Homo sapiens
cagggcaagggaaga

SEQ ID NO: 70741 - DNA, 15 bp, Homo sapiens
acagggcaagggaag

SEQ ID NO: 70742 - DNA, 15 bp, Homo sapiens
tacagggcaagggaa

SEQ ID NO: 70743 - DNA, 15 bp, Homo sapiens
atacagggcaaggga

SEQ ID NO: 70744 - DNA, 15 bp, Homo sapiens
gatacagggcaaggg

SEQ ID NO: 70745 - DNA, 15 bp, Homo sapiens
agatacagggcaagg

SEQ ID NO: 70746 - DNA, 15 bp, Homo sapiens
gagatacagggcaag

SEQ ID NO: 70747 - DNA, 15 bp, Homo sapiens
ggagatacagggcaa

SEQ ID NO: 70748 - DNA, 15 bp, Homo sapiens
cggagatacagggca

SEQ ID NO: 70749 - DNA, 15 bp, Homo sapiens
ccggagatacagggc

SEQ ID NO: 70750 - DNA, 15 bp, Homo sapiens
accggagatacaggg

SEQ ID NO: 70751 - DNA, 15 bp, Homo sapiens
caccggagatacagg

SEQ ID NO: 70752 - DNA, 15 bp, Homo sapiens
gcaccggagatacag

SEQ ID NO: 70753 - DNA, 15 bp, Homo sapiens
ggcaccggagataca

SEQ ID NO: 70754 - DNA, 15 bp, Homo sapiens
gggcaccggagatac

SEQ ID NO: 70755 - DNA, 15 bp, Homo sapiens
tgggcaccggagata

SEQ ID NO: 70756 - DNA, 15 bp, Homo sapiens
ctgggcaccggagat

SEQ ID NO: 70757 - DNA, 15 bp, Homo sapiens
tctgggcaccggaga

SEQ ID NO: 70758 - DNA, 15 bp, Homo sapiens
ttctgggcaccggag

SEQ ID NO: 70759 - DNA, 15 bp, Homo sapiens
attctgggcaccgga

SEQ ID NO: 70760 - DNA, 15 bp, Homo sapiens
cattctgggcaccgg

SEQ ID NO: 70761 - DNA, 15 bp, Homo sapiens
acattctgggcaccg

SEQ ID NO: 70762 - DNA, 15 bp, Homo sapiens
tacattctgggcacc

SEQ ID NO: 70763 - DNA, 15 bp, Homo sapiens
atacattctgggcac

SEQ ID NO: 70764 - DNA, 15 bp, Homo sapiens
tatacattctgggca

SEQ ID NO: 70765 - DNA, 15 bp, Homo sapiens
atatacattctgggc

SEQ ID NO: 70766 - DNA, 15 bp, Homo sapiens
aatatacattctggg

SEQ ID NO: 70767 - DNA, 15 bp, Homo sapiens
aaatatacattctgg

SEQ ID NO: 70768 - DNA, 15 bp, Homo sapiens
caaatatacattctg

SEQ ID NO: 70769 - DNA, 15 bp, Homo sapiens
tcaaatatacattct

SEQ ID NO: 70770 - DNA, 15 bp, Homo sapiens
gtcaaatatacattc

SEQ ID NO: 70771 - DNA, 15 bp, Homo sapiens
agtcaaatatacatt

SEQ ID NO: 70772 - DNA, 15 bp, Homo sapiens
aagtcaaatatacat

SEQ ID NO: 70773 - DNA, 15 bp, Homo sapiens
aaagtcaaatataca

SEQ ID NO: 70774 - DNA, 15 bp, Homo sapiens
caaagtcaaatatac

SEQ ID NO: 70775 - DNA, 15 bp, Homo sapiens
gcaaagtcaaatata

SEQ ID NO: 70776 - DNA, 15 bp, Homo sapiens
tgcaaagtcaaatat

SEQ ID NO: 70777 - DNA, 15 bp, Homo sapiens
ttgcaaagtcaaata

SEQ ID NO: 70778 - DNA, 15 bp, Homo sapiens
tttgcaaagtcaaat

SEQ ID NO: 70779 - DNA, 15 bp, Homo sapiens
ctttgcaaagtcaaa

SEQ ID NO: 70780 - DNA, 15 bp, Homo sapiens
cctttgcaaagtcaa

SEQ ID NO: 70781 - DNA, 15 bp, Homo sapiens
ccctttgcaaagtca

SEQ ID NO: 70782 - DNA, 15 bp, Homo sapiens
tccctttgcaaagtc

SEQ ID NO: 70783 - DNA, 15 bp, Homo sapiens
ttccctttgcaaagt

SEQ ID NO: 70784 - DNA, 15 bp, Homo sapiens
tttccctttgcaaag

SEQ ID NO: 70785 - DNA, 15 bp, Homo sapiens
ttttccctttgcaaa

SEQ ID NO: 70786 - DNA, 15 bp, Homo sapiens
cttttccctttgcaa

SEQ ID NO: 70787 - DNA, 15 bp, Homo sapiens
ccttttccctttgca

SEQ ID NO: 70788 - DNA, 15 bp, Homo sapiens
gccttttccctttgc

SEQ ID NO: 70789 - DNA, 15 bp, Homo sapiens
agccttttccctttg

SEQ ID NO: 70790 - DNA, 15 bp, Homo sapiens
aagccttttcccttt

SEQ ID NO: 70791 - DNA, 15 bp, Homo sapiens
caagccttttccctt

SEQ ID NO: 70792 - DNA, 15 bp, Homo sapiens
acaagccttttccct

SEQ ID NO: 70793 - DNA, 15 bp, Homo sapiens
tacaagccttttccc

SEQ ID NO: 70794 - DNA, 15 bp, Homo sapiens
ctacaagccttttcc

SEQ ID NO: 70795 - DNA, 15 bp, Homo sapiens
cctacaagccttttc

SEQ ID NO: 70796 - DNA, 15 bp, Homo sapiens
tcctacaagcctttt

SEQ ID NO: 70797 - DNA, 15 bp, Homo sapiens
ttcctacaagccttt

SEQ ID NO: 70798 - DNA, 15 bp, Homo sapiens
attcctacaagcctt

SEQ ID NO: 70799 - DNA, 15 bp, Homo sapiens
tattcctacaagcct

SEQ ID NO: 70800 - DNA, 15 bp, Homo sapiens
ttattcctacaagcc

SEQ ID NO: 70801 - DNA, 15 bp, Homo sapiens
attattcctacaagc

SEQ ID NO: 70802 - DNA, 15 bp, Homo sapiens
cattattcctacaag

SEQ ID NO: 70803 - DNA, 15 bp, Homo sapiens
gcattattcctacaa

SEQ ID NO: 70804 - DNA, 15 bp, Homo sapiens
agcattattcctaca

SEQ ID NO: 70805 - DNA, 15 bp, Homo sapiens
cagcattattcctac

SEQ ID NO: 70806 - DNA, 15 bp, Homo sapiens
acagcattattccta

SEQ ID NO: 70807 - DNA, 15 bp, Homo sapiens
cacagcattattcct

SEQ ID NO: 70808 - DNA, 15 bp, Homo sapiens
acacagcattattcc

SEQ ID NO: 70809 - DNA, 15 bp, Homo sapiens
aacacagcattattc

SEQ ID NO: 70810 - DNA, 15 bp, Homo sapiens
gaacacagcattatt

SEQ ID NO: 70811 - DNA, 15 bp, Homo sapiens
ggaacacagcattat

SEQ ID NO: 70812 - DNA, 15 bp, Homo sapiens
gggaacacagcatta

SEQ ID NO: 70813 - DNA, 15 bp, Homo sapiens
ggggaacacagcatt

SEQ ID NO: 70814 - DNA, 15 bp, Homo sapiens
tggggaacacagcat

SEQ ID NO: 70815 - DNA, 15 bp, Homo sapiens
gtggggaacacagca

SEQ ID NO: 70816 - DNA, 15 bp, Homo sapiens
cgtggggaacacagc

SEQ ID NO: 70817 - DNA, 15 bp, Homo sapiens
ccgtggggaacacag

SEQ ID NO: 70818 - DNA, 15 bp, Homo sapiens
tccgtggggaacaca

SEQ ID NO: 70819 - DNA, 15 bp, Homo sapiens
gtccgtggggaacac

SEQ ID NO: 70820 - DNA, 15 bp, Homo sapiens
tgtccgtggggaaca

SEQ ID NO: 70821 - DNA, 15 bp, Homo sapiens
ctgtccgtggggaac

SEQ ID NO: 70822 - DNA, 15 bp, Homo sapiens
cctgtccgtggggaa

SEQ ID NO: 70823 - DNA, 15 bp, Homo sapiens
gcctgtccgtgggga

SEQ ID NO: 70824 - DNA, 15 bp, Homo sapiens
agcctgtccgtgggg

SEQ ID NO: 70825 - DNA, 15 bp, Homo sapiens
cagcctgtccgtggg

SEQ ID NO: 70826 - DNA, 15 bp, Homo sapiens
gcagcctgtccgtgg

SEQ ID NO: 70827 - DNA, 15 bp, Homo sapiens
tgcagcctgtccgtg

SEQ ID NO: 70828 - DNA, 15 bp, Homo sapiens
gtgcagcctgtccgt

SEQ ID NO: 70829 - DNA, 15 bp, Homo sapiens
cgtgcagcctgtccg

SEQ ID NO: 70830 - DNA, 15 bp, Homo sapiens
tcgtgcagcctgtcc

SEQ ID NO: 70831 - DNA, 15 bp, Homo sapiens
atcgtgcagcctgtc

SEQ ID NO: 70832 - DNA, 15 bp, Homo sapiens
catcgtgcagcctgt

SEQ ID NO: 70833 - DNA, 15 bp, Homo sapiens
acatcgtgcagcctg

SEQ ID NO: 70834 - DNA, 15 bp, Homo sapiens
cacatcgtgcagcct

SEQ ID NO: 70835 - DNA, 15 bp, Homo sapiens
gcacatcgtgcagcc

SEQ ID NO: 70836 - DNA, 15 bp, Homo sapiens
agcacatcgtgcagc

SEQ ID NO: 70837 - DNA, 15 bp, Homo sapiens
cagcacatcgtgcag

SEQ ID NO: 70838 - DNA, 15 bp, Homo sapiens
tcagcacatcgtgca

SEQ ID NO: 70839 - DNA, 15 bp, Homo sapiens
atcagcacatcgtgc

SEQ ID NO: 70840 - DNA, 15 bp, Homo sapiens
catcagcacatcgtg

SEQ ID NO: 70841 - DNA, 15 bp, Homo sapiens
ccatcagcacatcgt

SEQ ID NO: 70842 - DNA, 15 bp, Homo sapiens
tccatcagcacatcg

SEQ ID NO: 70843 - DNA, 15 bp, Homo sapiens
ttccatcagcacatc

SEQ ID NO: 70844 - DNA, 15 bp, Homo sapiens
gttccatcagcacat

SEQ ID NO: 70845 - DNA, 15 bp, Homo sapiens
agttccatcagcaca

SEQ ID NO: 70846 - DNA, 15 bp, Homo sapiens
cagttccatcagcac

SEQ ID NO: 70847 - DNA, 15 bp, Homo sapiens
gcagttccatcagca

SEQ ID NO: 70848 - DNA, 15 bp, Homo sapiens
tgcagttccatcagc

SEQ ID NO: 70849 - DNA, 15 bp, Homo sapiens
ctgcagttccatcag

SEQ ID NO: 70850 - DNA, 15 bp, Homo sapiens
tctgcagttccatca

SEQ ID NO: 70851 - DNA, 15 bp, Homo sapiens
ttctgcagttccatc

SEQ ID NO: 70852 - DNA, 15 bp, Homo sapiens
cttctgcagttccat

SEQ ID NO: 70853 - DNA, 15 bp, Homo sapiens
tcttctgcagttcca

SEQ ID NO: 70854 - DNA, 15 bp, Homo sapiens
ttcttctgcagttcc

SEQ ID NO: 70855 - DNA, 15 bp, Homo sapiens
cttcttctgcagttc

SEQ ID NO: 70856 - DNA, 15 bp, Homo sapiens
gcttcttctgcagtt

SEQ ID NO: 70857 - DNA, 15 bp, Homo sapiens
tgcttcttctgcagt

SEQ ID NO: 70858 - DNA, 15 bp, Homo sapiens
ttgcttcttctgcag

SEQ ID NO: 70859 - DNA, 15 bp, Homo sapiens
gttgcttcttctgca

SEQ ID NO: 70860 - DNA, 15 bp, Homo sapiens
agttgcttcttctgc

SEQ ID NO: 70861 - DNA, 15 bp, Homo sapiens
cagttgcttcttctg

SEQ ID NO: 70862 - DNA, 15 bp, Homo sapiens
gcagttgcttcttct

SEQ ID NO: 70863 - DNA, 15 bp, Homo sapiens
tgcagttgcttcttc

SEQ ID NO: 70864 - DNA, 15 bp, Homo sapiens
ctgcagttgcttctt

SEQ ID NO: 70865 - DNA, 15 bp, Homo sapiens
tgctgcagttgcttc

SEQ ID NO: 70866 - DNA, 15 bp, Homo sapiens
ctgctgcagttgctt

SEQ ID NO: 70867 - DNA, 15 bp, Homo sapiens
gctgctgcagttgct

SEQ ID NO: 70868 - DNA, 15 bp, Homo sapiens
agctgctgcagttgc

SEQ ID NO: 70869 - DNA, 15 bp, Homo sapiens
gagctgctgcagttg

SEQ ID NO: 70870 - DNA, 15 bp, Homo sapiens
agagctgctgcagtt

SEQ ID NO: 70871 - DNA, 15 bp, Homo sapiens
gagagctgctgcagt

SEQ ID NO: 70872 - DNA, 15 bp, Homo sapiens
ggagagctgctgcag

SEQ ID NO: 70873 - DNA, 15 bp, Homo sapiens
cggagagctgctgca

SEQ ID NO: 70874 - DNA, 15 bp, Homo sapiens
gcggagagctgctgc

SEQ ID NO: 70875 - DNA, 15 bp, Homo sapiens
ggcggagagctgctg

SEQ ID NO: 70876 - DNA, 15 bp, Homo sapiens
aggcggagagctgct

SEQ ID NO: 70877 - DNA, 15 bp, Homo sapiens
caggcggagagctgc

SEQ ID NO: 70878 - DNA, 15 bp, Homo sapiens
ccaggcggagagctg

SEQ ID NO: 70879 - DNA, 15 bp, Homo sapiens
accaggcggagagct

SEQ ID NO: 70880 - DNA, 15 bp, Homo sapiens
aaccaggcggagagc

SEQ ID NO: 70881 - DNA, 15 bp, Homo sapiens
taaccaggcggagag

SEQ ID NO: 70882 - DNA, 15 bp, Homo sapiens
ttaaccaggcggaga

SEQ ID NO: 70883 - DNA, 15 bp, Homo sapiens
gttaaccaggcggag

SEQ ID NO: 70884 - DNA, 15 bp, Homo sapiens
tgttaaccaggcgga

SEQ ID NO: 70885 - DNA, 15 bp, Homo sapiens
gtgttaaccaggcgg

SEQ ID NO: 70886 - DNA, 15 bp, Homo sapiens
agtgttaaccaggcg

SEQ ID NO: 70887 - DNA, 15 bp, Homo sapiens
gagtgttaaccaggc

SEQ ID NO: 70888 - DNA, 15 bp, Homo sapiens
tgagtgttaaccagg

SEQ ID NO: 70889 - DNA, 15 bp, Homo sapiens
gtgagtgttaaccag

SEQ ID NO: 70890 - DNA, 15 bp, Homo sapiens
tgtgagtgttaacca

SEQ ID NO: 70891 - DNA, 15 bp, Homo sapiens
ctgtgagtgttaacc

SEQ ID NO: 70892 - DNA, 15 bp, Homo sapiens
tctgtgagtgttaac

SEQ ID NO: 70893 - DNA, 15 bp, Homo sapiens
ctctgtgagtgttaa

SEQ ID NO: 70894 - DNA, 15 bp, Homo sapiens
cctctgtgagtgtta

SEQ ID NO: 70895 - DNA, 15 bp, Homo sapiens
tcctctgtgagtgtt

SEQ ID NO: 70896 - DNA, 15 bp, Homo sapiens
ctcctctgtgagtgt

SEQ ID NO: 70897 - DNA, 15 bp, Homo sapiens
gctcctctgtgagtg

SEQ ID NO: 70898 - DNA, 15 bp, Homo sapiens
cgctcctctgtgagt

SEQ ID NO: 70899 - DNA, 15 bp, Homo sapiens
gcgctcctctgtgag

SEQ ID NO: 70900 - DNA, 15 bp, Homo sapiens
tgcgctcctctgtga

SEQ ID NO: 70901 - DNA, 15 bp, Homo sapiens
atgcgctcctctgtg

SEQ ID NO: 70902 - DNA, 15 bp, Homo sapiens
aatgcgctcctctgt

SEQ ID NO: 70903 - DNA, 15 bp, Homo sapiens
gaatgcgctcctctg

SEQ ID NO: 70904 - DNA, 15 bp, Homo sapiens
tgaatgcgctcctct

SEQ ID NO: 70905 - DNA, 15 bp, Homo sapiens
ctgaatgcgctcctc

SEQ ID NO: 70906 - DNA, 15 bp, Homo sapiens
tctgaatgcgctcct

SEQ ID NO: 70907 - DNA, 15 bp, Homo sapiens
ttctgaatgcgctcc

SEQ ID NO: 70908 - DNA, 15 bp, Homo sapiens
cttctgaatgcgctc

SEQ ID NO: 70909 - DNA, 15 bp, Homo sapiens
tcttctgaatgcgct

SEQ ID NO: 70910 - DNA, 15 bp, Homo sapiens
atcttctgaatgcgc

SEQ ID NO: 70911 - DNA, 15 bp, Homo sapiens
catcttctgaatgcg

SEQ ID NO: 70912 - DNA, 15 bp, Homo sapiens
ccatcttctgaatgc

SEQ ID NO: 70913 - DNA, 15 bp, Homo sapiens
tccatcttctgaatg

SEQ ID NO: 70914 - DNA, 15 bp, Homo sapiens
ttccatcttctgaat

SEQ ID NO: 70915 - DNA, 15 bp, Homo sapiens
tttccatcttctgaa

SEQ ID NO: 70916 - DNA, 15 bp, Homo sapiens
gtttccatcttctga

SEQ ID NO: 70917 - DNA, 15 bp, Homo sapiens
agtttccatcttctg

SEQ ID NO: 70918 - DNA, 15 bp, Homo sapiens
aagtttccatcttct

SEQ ID NO: 70919 - DNA, 15 bp, Homo sapiens
caagtttccatcttc

SEQ ID NO: 70920 - DNA, 15 bp, Homo sapiens
gcaagtttccatctt

SEQ ID NO: 70921 - DNA, 15 bp, Homo sapiens
ggcaagtttccatct

SEQ ID NO: 70922 - DNA, 15 bp, Homo sapiens
gggcaagtttccatc

SEQ ID NO: 70923 - DNA, 15 bp, Homo sapiens
ggggcaagtttccat

SEQ ID NO: 70924 - DNA, 15 bp, Homo sapiens
gggggcaagtttcca

SEQ ID NO: 70925 - DNA, 15 bp, Homo sapiens
agggggcaagtttcc

SEQ ID NO: 70926 - DNA, 15 bp, Homo sapiens
cagggggcaagtttc

SEQ ID NO: 70927 - DNA, 15 bp, Homo sapiens
ccagggggcaagttt

SEQ ID NO: 70928 - DNA, 15 bp, Homo sapiens
tccagggggcaagtt

SEQ ID NO: 70929 - DNA, 15 bp, Homo sapiens
atccagggggcaagt

SEQ ID NO: 70930 - DNA, 15 bp, Homo sapiens
catccagggggcaag

SEQ ID NO: 70931 - DNA, 15 bp, Homo sapiens
tcatccagggggcaa

SEQ ID NO: 70932 - DNA, 15 bp, Homo sapiens
atcatccagggggca

SEQ ID NO: 70933 - DNA, 15 bp, Homo sapiens
catcatccagggggc

SEQ ID NO: 70934 - DNA, 15 bp, Homo sapiens
tcatcatccaggggg

SEQ ID NO: 70935 - DNA, 15 bp, Homo sapiens
atcatcatccagggg

SEQ ID NO: 70936 - DNA, 15 bp, Homo sapiens
catcatcatccaggg

SEQ ID NO: 70937 - DNA, 15 bp, Homo sapiens
acatcatcatccagg

SEQ ID NO: 70938 - DNA, 15 bp, Homo sapiens
tacatcatcatccag

SEQ ID NO: 70939 - DNA, 15 bp, Homo sapiens
ttacatcatcatcca

SEQ ID NO: 70940 - DNA, 15 bp, Homo sapiens
tttacatcatcatcc

SEQ ID NO: 70941 - DNA, 15 bp, Homo sapiens
ttttacatcatcatc

SEQ ID NO: 70942 - DNA, 15 bp, Homo sapiens
attttacatcatcat

SEQ ID NO: 70943 - DNA, 15 bp, Homo sapiens
gattttacatcatca

SEQ ID NO: 70944 - DNA, 15 bp, Homo sapiens
agattttacatcatc

SEQ ID NO: 70945 - DNA, 15 bp, Homo sapiens
gagattttacatcat

SEQ ID NO: 70946 - DNA, 15 bp, Homo sapiens
agagattttacatca

SEQ ID NO: 70947 - DNA, 15 bp, Homo sapiens
tagagattttacatc

SEQ ID NO: 70948 - DNA, 15 bp, Homo sapiens
gtagagattttacat

SEQ ID NO: 70949 - DNA, 15 bp, Homo sapiens
tgtagagattttaca

SEQ ID NO: 70950 - DNA, 15 bp, Homo sapiens
ttgtagagattttac

SEQ ID NO: 70951 - DNA, 15 bp, Homo sapiens
tttgtagagatttta

SEQ ID NO: 70952 - DNA, 15 bp, Homo sapiens
ttttgtagagatttt

SEQ ID NO: 70953 - DNA, 15 bp, Homo sapiens
cttttgtagagattt

SEQ ID NO: 70954 - DNA, 15 bp, Homo sapiens
gcttttgtagagatt

SEQ ID NO: 70955 - DNA, 15 bp, Homo sapiens
agcttttgtagagat

SEQ ID NO: 70956 - DNA, 15 bp, Homo sapiens
cagcttttgtagaga

SEQ ID NO: 70957 - DNA, 15 bp, Homo sapiens
gcagcttttgtagag

SEQ ID NO: 70958 - DNA, 15 bp, Homo sapiens
agcagcttttgtaga

SEQ ID NO: 70959 - DNA, 15 bp, Homo sapiens
tagcagcttttgtag

SEQ ID NO: 70960 - DNA, 15 bp, Homo sapiens
ctagcagcttttgta

SEQ ID NO: 70961 - DNA, 15 bp, Homo sapiens
tctagcagcttttgt

SEQ ID NO: 70962 - DNA, 15 bp, Homo sapiens
ttctagcagcttttg

SEQ ID NO: 70963 - DNA, 15 bp, Homo sapiens
cttctagcagctttt

SEQ ID NO: 70964 - DNA, 15 bp, Homo sapiens
tcttctagcagcttt

SEQ ID NO: 70965 - DNA, 15 bp, Homo sapiens
ttcttctagcagctt

SEQ ID NO: 70966 - DNA, 15 bp, Homo sapiens
gttcttctagcagct

SEQ ID NO: 70967 - DNA, 15 bp, Homo sapiens
tgttcttctagcagc

SEQ ID NO: 70968 - DNA, 15 bp, Homo sapiens
atgttcttctagcag

SEQ ID NO: 70969 - DNA, 15 bp, Homo sapiens
tatgttcttctagca

SEQ ID NO: 70970 - DNA, 15 bp, Homo sapiens
ttatgttcttctagc

SEQ ID NO: 70971 - DNA, 15 bp, Homo sapiens
tttatgttcttctag

SEQ ID NO: 70972 - DNA, 15 bp, Homo sapiens
ctttatgttcttcta

SEQ ID NO: 70973 - DNA, 15 bp, Homo sapiens
actttatgttcttct

SEQ ID NO: 70974 - DNA, 15 bp, Homo sapiens
tactttatgttcttc

SEQ ID NO: 70975 - DNA, 15 bp, Homo sapiens
ttactttatgttctt

SEQ ID NO: 70976 - DNA, 15 bp, Homo sapiens
tttactttatgttct

SEQ ID NO: 70977 - DNA, 15 bp, Homo sapiens
atttactttatgttc

SEQ ID NO: 70978 - DNA, 15 bp, Homo sapiens
gatttactttatgtt

SEQ ID NO: 70979 - DNA, 15 bp, Homo sapiens
agatttactttatgt

SEQ ID NO: 70980 - DNA, 15 bp, Homo sapiens
cagatttactttatg

SEQ ID NO: 70981 - DNA, 15 bp, Homo sapiens
acagatttactttat

SEQ ID NO: 70982 - DNA, 15 bp, Homo sapiens
gacagatttacttta

SEQ ID NO: 70983 - DNA, 15 bp, Homo sapiens
agacagatttacttt

SEQ ID NO: 70984 - DNA, 15 bp, Homo sapiens
gagacagatttactt

SEQ ID NO: 70985 - DNA, 15 bp, Homo sapiens
tgagacagatttact

SEQ ID NO: 70986 - DNA, 15 bp, Homo sapiens
atgagacagatttac

SEQ ID NO: 70987 - DNA, 15 bp, Homo sapiens
tatgagacagattta

SEQ ID NO: 70988 - DNA, 15 bp, Homo sapiens
atatgagacagattt

SEQ ID NO: 70989 - DNA, 15 bp, Homo sapiens
aatatgagacagatt

SEQ ID NO: 70990 - DNA, 15 bp, Homo sapiens
aaatatgagacagat

SEQ ID NO: 70991 - DNA, 15 bp, Homo sapiens
gaaatatgagacaga

SEQ ID NO: 70992 - DNA, 15 bp, Homo sapiens
agaaatatgagacag

SEQ ID NO: 70993 - DNA, 15 bp, Homo sapiens
aagaaatatgagaca

SEQ ID NO: 70994 - DNA, 15 bp, Homo sapiens
gaagaaatatgagac

SEQ ID NO: 70995 - DNA, 15 bp, Homo sapiens
cgaagaaatatgaga

SEQ ID NO: 70996 - DNA, 15 bp, Homo sapiens
tcgaagaaatatgag

SEQ ID NO: 70997 - DNA, 15 bp, Homo sapiens
atcgaagaaatatga

SEQ ID NO: 70998 - DNA, 15 bp, Homo sapiens
tatcgaagaaatatg

SEQ ID NO: 70999 - DNA, 15 bp, Homo sapiens
gtatcgaagaaatat

SEQ ID NO: 71000 - DNA, 15 bp, Homo sapiens
ggtatcgaagaaata

SEQ ID NO: 71001 - DNA, 15 bp, Homo sapiens
aggtatcgaagaaat

SEQ ID NO: 71002 - DNA, 15 bp, Homo sapiens
aaggtatcgaagaaa

SEQ ID NO: 71003 - DNA, 15 bp, Homo sapiens
taaggtatcgaagaa

SEQ ID NO: 71004 - DNA, 15 bp, Homo sapiens
ataaggtatcgaaga

SEQ ID NO: 71005 - DNA, 15 bp, Homo sapiens
gataaggtatcgaag

SEQ ID NO: 71006 - DNA, 15 bp, Homo sapiens
tgataaggtatcgaa

SEQ ID NO: 71007 - DNA, 15 bp, Homo sapiens
ttgataaggtatcga

SEQ ID NO: 71008 - DNA, 15 bp, Homo sapiens
tttgataaggtatcg

SEQ ID NO: 71009 - DNA, 15 bp, Homo sapiens
atttgataaggtatc

SEQ ID NO: 71010 - DNA, 15 bp, Homo sapiens
tatttgataaggtat

SEQ ID NO: 71011 - DNA, 15 bp, Homo sapiens
atatttgataaggta

SEQ ID NO: 71012 - DNA, 15 bp, Homo sapiens
catatttgataaggt

SEQ ID NO: 71013 - DNA, 15 bp, Homo sapiens
tcatatttgataagg

SEQ ID NO: 71014 - DNA, 15 bp, Homo sapiens
ttcatatttgataag

SEQ ID NO: 71015 - DNA, 15 bp, Homo sapiens
tttcatatttgataa

SEQ ID NO: 71016 - DNA, 15 bp, Homo sapiens
ctttcatatttgata

SEQ ID NO: 71017 - DNA, 15 bp, Homo sapiens
tctttcatatttgat

SEQ ID NO: 71018 - DNA, 15 bp, Homo sapiens
ctctttcatatttga

SEQ ID NO: 71019 - DNA, 15 bp, Homo sapiens
gctctttcatatttg

SEQ ID NO: 71020 - DNA, 15 bp, Homo sapiens
tgctctttcatattt

SEQ ID NO: 71021 - DNA, 15 bp, Homo sapiens
ctgctctttcatatt

SEQ ID NO: 71022 - DNA, 15 bp, Homo sapiens
gctgctctttcatat

SEQ ID NO: 71023 - DNA, 15 bp, Homo sapiens
tgctgctctttcata

SEQ ID NO: 71024 - DNA, 15 bp, Homo sapiens
gtgctgctctttcat

SEQ ID NO: 71025 - DNA, 15 bp, Homo sapiens
agtgctgctctttca

SEQ ID NO: 71026 - DNA, 15 bp, Homo sapiens
aagtgctgctctttc

SEQ ID NO: 71027 - DNA, 15 bp, Homo sapiens
taagtgctgctcttt

SEQ ID NO: 71028 - DNA, 15 bp, Homo sapiens
ctaagtgctgctctt

SEQ ID NO: 71029 - DNA, 15 bp, Homo sapiens
gctaagtgctgctct

SEQ ID NO: 71030 - DNA, 15 bp, Homo sapiens
tgctaagtgctgctc

SEQ ID NO: 71031 - DNA, 15 bp, Homo sapiens
atgctaagtgctgct

SEQ ID NO: 71032 - DNA, 15 bp, Homo sapiens
gatgctaagtgctgc

SEQ ID NO: 71033 - DNA, 15 bp, Homo sapiens
agatgctaagtgctg

SEQ ID NO: 71034 - DNA, 15 bp, Homo sapiens
gagatgctaagtgct

SEQ ID NO: 71035 - DNA, 15 bp, Homo sapiens
tgagatgctaagtgc

SEQ ID NO: 71036 - DNA, 15 bp, Homo sapiens
ctgagatgctaagtg

SEQ ID NO: 71037 - DNA, 15 bp, Homo sapiens
tctgagatgctaagt

SEQ ID NO: 71038 - DNA, 15 bp, Homo sapiens
ctctgagatgctaag

SEQ ID NO: 71039 - DNA, 15 bp, Homo sapiens
cctctgagatgctaa

SEQ ID NO: 71040 - DNA, 15 bp, Homo sapiens
gcctctgagatgcta

SEQ ID NO: 71041 - DNA, 15 bp, Homo sapiens
agcctctgagatgct

SEQ ID NO: 71042 - DNA, 15 bp, Homo sapiens
cagcctctgagatgc

SEQ ID NO: 71043 - DNA, 15 bp, Homo sapiens
tcagcctctgagatg

SEQ ID NO: 71044 - DNA, 15 bp, Homo sapiens
atcagcctctgagat

SEQ ID NO: 71045 - DNA, 15 bp, Homo sapiens
catcagcctctgaga

SEQ ID NO: 71046 - DNA, 15 bp, Homo sapiens
tcatcagcctctgag

SEQ ID NO: 71047 - DNA, 15 bp, Homo sapiens
gtcatcagcctctga

SEQ ID NO: 71048 - DNA, 15 bp, Homo sapiens
tgtcatcagcctctg

SEQ ID NO: 71049 - DNA, 15 bp, Homo sapiens
atgtcatcagcctct

SEQ ID NO: 71050 - DNA, 15 bp, Homo sapiens
gatgtcatcagcctc

SEQ ID NO: 71051 - DNA, 15 bp, Homo sapiens
agatgtcatcagcct

SEQ ID NO: 71052 - DNA, 15 bp, Homo sapiens
tagatgtcatcagcc

SEQ ID NO: 71053 - DNA, 15 bp, Homo sapiens
atagatgtcatcagc

SEQ ID NO: 71054 - DNA, 15 bp, Homo sapiens
gatagatgtcatcag

SEQ ID NO: 71055 - DNA, 15 bp, Homo sapiens
cgatagatgtcatca

SEQ ID NO: 71056 - DNA, 15 bp, Homo sapiens
acgatagatgtcatc

SEQ ID NO: 71057 - DNA, 15 bp, Homo sapiens
aacgatagatgtcat

SEQ ID NO: 71058 - DNA, 15 bp, Homo sapiens
taacgatagatgtca

SEQ ID NO: 71059 - DNA, 15 bp, Homo sapiens
ttaacgatagatgtc

SEQ ID NO: 71060 - DNA, 15 bp, Homo sapiens
gttaacgatagatgt

SEQ ID NO: 71061 - DNA, 15 bp, Homo sapiens
tgttaacgatagatg

SEQ ID NO: 71062 - DNA, 15 bp, Homo sapiens
atgttaacgatagat

SEQ ID NO: 71063 - DNA, 15 bp, Homo sapiens
catgttaacgataga

SEQ ID NO: 71064 - DNA, 15 bp, Homo sapiens
tcatgttaacgatag

SEQ ID NO: 71065 - DNA, 15 bp, Homo sapiens
ttcatgttaacgata

SEQ ID NO: 71066 - DNA, 15 bp, Homo sapiens
cttcatgttaacgat

SEQ ID NO: 71067 - DNA, 15 bp, Homo sapiens
acttcatgttaacga

SEQ ID NO: 71068 - DNA, 15 bp, Homo sapiens
aacttcatgttaacg

SEQ ID NO: 71069 - DNA, 15 bp, Homo sapiens
caacttcatgttaac

SEQ ID NO: 71070 - DNA, 15 bp, Homo sapiens
ccaacttcatgttaa

SEQ ID NO: 71071 - DNA, 15 bp, Homo sapiens
cccaacttcatgtta

SEQ ID NO: 71072 - DNA, 15 bp, Homo sapiens
tcccaacttcatgtt

SEQ ID NO: 71073 - DNA, 15 bp, Homo sapiens
gtcccaacttcatgt

SEQ ID NO: 71074 - DNA, 15 bp, Homo sapiens
tgtcccaacttcatg

SEQ ID NO: 71075 - DNA, 15 bp, Homo sapiens
gtgtcccaacttcat

SEQ ID NO: 71076 - DNA, 15 bp, Homo sapiens
agtgtcccaacttca

SEQ ID NO: 71077 - DNA, 15 bp, Homo sapiens
aagtgtcccaacttc

SEQ ID NO: 71078 - DNA, 15 bp, Homo sapiens
gaagtgtcccaactt

SEQ ID NO: 71079 - DNA, 15 bp, Homo sapiens
agaagtgtcccaact

SEQ ID NO: 71080 - DNA, 15 bp, Homo sapiens
aagaagtgtcccaac

SEQ ID NO: 71081 - DNA, 15 bp, Homo sapiens
gaagaagtgtcccaa

SEQ ID NO: 71082 - DNA, 15 bp, Homo sapiens
tgaagaagtgtccca

SEQ ID NO: 71083 - DNA, 15 bp, Homo sapiens
ctgaagaagtgtccc

SEQ ID NO: 71084 - DNA, 15 bp, Homo sapiens
cctgaagaagtgtcc

SEQ ID NO: 71085 - DNA, 15 bp, Homo sapiens
ccctgaagaagtgtc

SEQ ID NO: 71086 - DNA, 15 bp, Homo sapiens
accctgaagaagtgt

SEQ ID NO: 71087 - DNA, 15 bp, Homo sapiens
aaccctgaagaagtg

SEQ ID NO: 71088 - DNA, 15 bp, Homo sapiens
caaccctgaagaagt

SEQ ID NO: 71089 - DNA, 15 bp, Homo sapiens
acaaccctgaagaag

SEQ ID NO: 71090 - DNA, 15 bp, Homo sapiens
gacaaccctgaagaa

SEQ ID NO: 71091 - DNA, 15 bp, Homo sapiens
agacaaccctgaaga

SEQ ID NO: 71092 - DNA, 15 bp, Homo sapiens
aagacaaccctgaag

SEQ ID NO: 71093 - DNA, 15 bp, Homo sapiens
gaagacaaccctgaa

SEQ ID NO: 71094 - DNA, 15 bp, Homo sapiens
tgaagacaaccctga

SEQ ID NO: 71095 - DNA, 15 bp, Homo sapiens
atgaagacaaccctg

SEQ ID NO: 71096 - DNA, 15 bp, Homo sapiens
aatgaagacaaccct

SEQ ID NO: 71097 - DNA, 15 bp, Homo sapiens
aaatgaagacaaccc

SEQ ID NO: 71098 - DNA, 15 bp, Homo sapiens
taaatgaagacaacc

SEQ ID NO: 71099 - DNA, 15 bp, Homo sapiens
ctaaatgaagacaac

SEQ ID NO: 71100 - DNA, 15 bp, Homo sapiens
gctaaatgaagacaa

SEQ ID NO: 71101 - DNA, 15 bp, Homo sapiens
tgctaaatgaagaca

SEQ ID NO: 71102 - DNA, 15 bp, Homo sapiens
ctgctaaatgaagac

SEQ ID NO: 71103 - DNA, 15 bp, Homo sapiens
gctgctaaatgaaga

SEQ ID NO: 71104 - DNA, 15 bp, Homo sapiens
agctgctaaatgaag

SEQ ID NO: 71105 - DNA, 15 bp, Homo sapiens
gagctgctaaatgaa

SEQ ID NO: 71106 - DNA, 15 bp, Homo sapiens
tgagctgctaaatga

SEQ ID NO: 71107 - DNA, 15 bp, Homo sapiens
gtgagctgctaaatg

SEQ ID NO: 71108 - DNA, 15 bp, Homo sapiens
tgtgagctgctaaat

SEQ ID NO: 71109 - DNA, 15 bp, Homo sapiens
ctgtgagctgctaaa

SEQ ID NO: 71110 - DNA, 15 bp, Homo sapiens
cctgtgagctgctaa

SEQ ID NO: 71111 - DNA, 15 bp, Homo sapiens
ccctgtgagctgcta

SEQ ID NO: 71112 - DNA, 15 bp, Homo sapiens
accctgtgagctgct

SEQ ID NO: 71113 - DNA, 15 bp, Homo sapiens
caccctgtgagctgc

SEQ ID NO: 71114 - DNA, 15 bp, Homo sapiens
ccaccctgtgagctg

SEQ ID NO: 71115 - DNA, 15 bp, Homo sapiens
tccaccctgtgagct

SEQ ID NO: 71116 - DNA, 15 bp, Homo sapiens
ttccaccctgtgagc

SEQ ID NO: 71117 - DNA, 15 bp, Homo sapiens
attccaccctgtgag

SEQ ID NO: 71118 - DNA, 15 bp, Homo sapiens
aattccaccctgtga

SEQ ID NO: 71119 - DNA, 15 bp, Homo sapiens
caattccaccctgtg

SEQ ID NO: 71120 - DNA, 15 bp, Homo sapiens
tcaattccaccctgt

SEQ ID NO: 71121 - DNA, 15 bp, Homo sapiens
atcaattccaccctg

SEQ ID NO: 71122 - DNA, 15 bp, Homo sapiens
tatcaattccaccct

SEQ ID NO: 71123 - DNA, 15 bp, Homo sapiens
ctatcaattccaccc

SEQ ID NO: 71124 - DNA, 15 bp, Homo sapiens
tctatcaattccacc

SEQ ID NO: 71125 - DNA, 15 bp, Homo sapiens
ctctatcaattccac

SEQ ID NO: 71126 - DNA, 15 bp, Homo sapiens
tctctatcaattcca

SEQ ID NO: 71127 - DNA, 15 bp, Homo sapiens
atctctatcaattcc

SEQ ID NO: 71128 - DNA, 15 bp, Homo sapiens
catctctatcaattc

SEQ ID NO: 71129 - DNA, 15 bp, Homo sapiens
tcatctctatcaatt

SEQ ID NO: 71130 - DNA, 15 bp, Homo sapiens
ctcatctctatcaat

SEQ ID NO: 71131 - DNA, 15 bp, Homo sapiens
tctcatctctatcaa

SEQ ID NO: 71132 - DNA, 15 bp, Homo sapiens
gtctcatctctatca

SEQ ID NO: 71133 - DNA, 15 bp, Homo sapiens
agtctcatctctatc

SEQ ID NO: 71134 - DNA, 15 bp, Homo sapiens
aagtctcatctctat

SEQ ID NO: 71135 - DNA, 15 bp, Homo sapiens
aaagtctcatctcta

SEQ ID NO: 71136 - DNA, 15 bp, Homo sapiens
aaaagtctcatctct

SEQ ID NO: 71137 - DNA, 15 bp, Homo sapiens
gaaaagtctcatctc

SEQ ID NO: 71138 - DNA, 15 bp, Homo sapiens
agaaaagtctcatct

SEQ ID NO: 71139 - DNA, 15 bp, Homo sapiens
cagaaaagtctcatc

SEQ ID NO: 71140 - DNA, 15 bp, Homo sapiens
tcagaaaagtctcat

SEQ ID NO: 71141 - DNA, 15 bp, Homo sapiens
ctcagaaaagtctca

SEQ ID NO: 71142 - DNA, 15 bp, Homo sapiens
gctcagaaaagtctc

SEQ ID NO: 71143 - DNA, 15 bp, Homo sapiens
ggctcagaaaagtct

SEQ ID NO: 71144 - DNA, 15 bp, Homo sapiens
tggctcagaaaagtc

SEQ ID NO: 71145 - DNA, 15 bp, Homo sapiens
ctggctcagaaaagt

SEQ ID NO: 71146 - DNA, 15 bp, Homo sapiens
cctggctcagaaaag

SEQ ID NO: 71147 - DNA, 15 bp, Homo sapiens
ccctggctcagaaaa

SEQ ID NO: 71148 - DNA, 15 bp, Homo sapiens
tccctggctcagaaa

SEQ ID NO: 71149 - DNA, 15 bp, Homo sapiens
atccctggctcagaa

SEQ ID NO: 71150 - DNA, 15 bp, Homo sapiens
tatccctggctcaga

SEQ ID NO: 71151 - DNA, 15 bp, Homo sapiens
ttatccctggctcag

SEQ ID NO: 71152 - DNA, 15 bp, Homo sapiens
tttatccctggctca

SEQ ID NO: 71153 - DNA, 15 bp, Homo sapiens
ttttatccctggctc

SEQ ID NO: 71154 - DNA, 15 bp, Homo sapiens
cttttatccctggct

SEQ ID NO: 71155 - DNA, 15 bp, Homo sapiens
ccttttatccctggc

SEQ ID NO: 71156 - DNA, 15 bp, Homo sapiens
cccttttatccctgg

SEQ ID NO: 71157 - DNA, 15 bp, Homo sapiens
gcccttttatccctg

SEQ ID NO: 71158 - DNA, 15 bp, Homo sapiens
tgcccttttatccct

SEQ ID NO: 71159 - DNA, 15 bp, Homo sapiens
gtgcccttttatccc

SEQ ID NO: 71160 - DNA, 15 bp, Homo sapiens
cgtgcccttttatcc

SEQ ID NO: 71161 - DNA, 15 bp, Homo sapiens
ccgtgcccttttatc

SEQ ID NO: 71162 - DNA, 15 bp, Homo sapiens
accgtgcccttttat

SEQ ID NO: 71163 - DNA, 15 bp, Homo sapiens
taccgtgccctttta

SEQ ID NO: 71164 - DNA, 15 bp, Homo sapiens
ttaccgtgccctttt

SEQ ID NO: 71165 - DNA, 15 bp, Homo sapiens
tttaccgtgcccttt

SEQ ID NO: 71166 - DNA, 15 bp, Homo sapiens
ttttaccgtgccctt

SEQ ID NO: 71167 - DNA, 15 bp, Homo sapiens
attttaccgtgccct

SEQ ID NO: 71168 - DNA, 15 bp, Homo sapiens
aattttaccgtgccc

SEQ ID NO: 71169 - DNA, 15 bp, Homo sapiens
aaattttaccgtgcc

SEQ ID NO: 71170 - DNA, 15 bp, Homo sapiens
aaaattttaccgtgc

SEQ ID NO: 71171 - DNA, 15 bp, Homo sapiens
taaaattttaccgtg

SEQ ID NO: 71172 - DNA, 15 bp, Homo sapiens
ataaaattttaccgt

SEQ ID NO: 71173 - DNA, 15 bp, Homo sapiens
tataaaattttaccg

SEQ ID NO: 71174 - DNA, 15 bp, Homo sapiens
atataaaattttacc

SEQ ID NO: 71175 - DNA, 15 bp, Homo sapiens
catataaaattttac

SEQ ID NO: 71176 - DNA, 15 bp, Homo sapiens
acatataaaatttta

SEQ ID NO: 71177 - DNA, 15 bp, Homo sapiens
cacatataaaatttt

SEQ ID NO: 71178 - DNA, 15 bp, Homo sapiens
tcacatataaaattt

SEQ ID NO: 71179 - DNA, 15 bp, Homo sapiens
atcacatataaaatt

SEQ ID NO: 71180 - DNA, 15 bp, Homo sapiens
catcacatataaaat

SEQ ID NO: 71181 - DNA, 15 bp, Homo sapiens
acatcacatataaaa

SEQ ID NO: 71182 - DNA, 15 bp, Homo sapiens
cacatcacatataaa

SEQ ID NO: 71183 - DNA, 15 bp, Homo sapiens
gcacatcacatataa

SEQ ID NO: 71184 - DNA, 15 bp, Homo sapiens
tgcacatcacatata

SEQ ID NO: 71185 - DNA, 15 bp, Homo sapiens
ctgcacatcacatat

SEQ ID NO: 71186 - DNA, 15 bp, Homo sapiens
actgcacatcacata

SEQ ID NO: 71187 - DNA, 15 bp, Homo sapiens
aactgcacatcacat

SEQ ID NO: 71188 - DNA, 15 bp, Homo sapiens
aaactgcacatcaca

SEQ ID NO: 71189 - DNA, 15 bp, Homo sapiens
aaaactgcacatcac

SEQ ID NO: 71190 - DNA, 15 bp, Homo sapiens
gaaaactgcacatca

SEQ ID NO: 71191 - DNA, 15 bp, Homo sapiens
agaaaactgcacatc

SEQ ID NO: 71192 - DNA, 15 bp, Homo sapiens
aagaaaactgcacat

SEQ ID NO: 71193 - DNA, 15 bp, Homo sapiens
aaagaaaactgcaca

SEQ ID NO: 71194 - DNA, 15 bp, Homo sapiens
aaaagaaaactgcac

SEQ ID NO: 71195 - DNA, 15 bp, Homo sapiens
caaaagaaaactgca

SEQ ID NO: 71196 - DNA, 15 bp, Homo sapiens
tcaaaagaaaactgc

SEQ ID NO: 71197 - DNA, 15 bp, Homo sapiens
ttcaaaagaaaactg

SEQ ID NO: 71198 - DNA, 15 bp, Homo sapiens
tttcaaaagaaaact

SEQ ID NO: 71199 - DNA, 15 bp, Homo sapiens
ctttcaaaagaaaac

SEQ ID NO: 71200 - DNA, 15 bp, Homo sapiens
actttcaaaagaaaa

SEQ ID NO: 71201 - DNA, 15 bp, Homo sapiens
tactttcaaaagaaa

SEQ ID NO: 71202 - DNA, 15 bp, Homo sapiens
gtactttcaaaagaa

SEQ ID NO: 71203 - DNA, 15 bp, Homo sapiens
tgtactttcaaaaga

SEQ ID NO: 71204 - DNA, 15 bp, Homo sapiens
atgtactttcaaaag

SEQ ID NO: 71205 - DNA, 15 bp, Homo sapiens
tatgtactttcaaaa

SEQ ID NO: 71206 - DNA, 15 bp, Homo sapiens
ctatgtactttcaaa

SEQ ID NO: 71207 - DNA, 15 bp, Homo sapiens
gctatgtactttcaa

SEQ ID NO: 71208 - DNA, 15 bp, Homo sapiens
agctatgtactttca

SEQ ID NO: 71209 - DNA, 15 bp, Homo sapiens
aagctatgtactttc

SEQ ID NO: 71210 - DNA, 15 bp, Homo sapiens
aaagctatgtacttt

SEQ ID NO: 71211 - DNA, 15 bp, Homo sapiens
gaaagctatgtactt

SEQ ID NO: 71212 - DNA, 15 bp, Homo sapiens
tgaaagctatgtact

SEQ ID NO: 71213 - DNA, 15 bp, Homo sapiens
atgaaagctatgtac

SEQ ID NO: 71214 - DNA, 15 bp, Homo sapiens
tatgaaagctatgta

SEQ ID NO: 71215 - DNA, 15 bp, Homo sapiens
gtatgaaagctatgt

SEQ ID NO: 71216 - DNA, 15 bp, Homo sapiens
tgtatgaaagctatg

SEQ ID NO: 71217 - DNA, 15 bp, Homo sapiens
ttgtatgaaagctat

SEQ ID NO: 71218 - DNA, 15 bp, Homo sapiens
gttgtatgaaagcta

SEQ ID NO: 71219 - DNA, 15 bp, Homo sapiens
agttgtatgaaagct

SEQ ID NO: 71220 - DNA, 15 bp, Homo sapiens
cagttgtatgaaagc

SEQ ID NO: 71221 - DNA, 15 bp, Homo sapiens
ccagttgtatgaaag

SEQ ID NO: 71222 - DNA, 15 bp, Homo sapiens
tccagttgtatgaaa

SEQ ID NO: 71223 - DNA, 15 bp, Homo sapiens
ctccagttgtatgaa

SEQ ID NO: 71224 - DNA, 15 bp, Homo sapiens
tctccagttgtatga

SEQ ID NO: 71225 - DNA, 15 bp, Homo sapiens
ttctccagttgtatg

SEQ ID NO: 71226 - DNA, 15 bp, Homo sapiens
cttctccagttgtat

SEQ ID NO: 71227 - DNA, 15 bp, Homo sapiens
ccttctccagttgta

SEQ ID NO: 71228 - DNA, 15 bp, Homo sapiens
cccttctccagttgt

SEQ ID NO: 71229 - DNA, 15 bp, Homo sapiens
acccttctccagttg

SEQ ID NO: 71230 - DNA, 15 bp, Homo sapiens
aacccttctccagtt

SEQ ID NO: 71231 - DNA, 15 bp, Homo sapiens
gaacccttctccagt

SEQ ID NO: 71232 - DNA, 15 bp, Homo sapiens
agaacccttctccag

SEQ ID NO: 71233 - DNA, 15 bp, Homo sapiens
aagaacccttctcca

SEQ ID NO: 71234 - DNA, 15 bp, Homo sapiens
aaagaacccttctcc

SEQ ID NO: 71235 - DNA, 15 bp, Homo sapiens
aaaagaacccttctc

SEQ ID NO: 71236 - DNA, 15 bp, Homo sapiens
caaaagaacccttct

SEQ ID NO: 71237 - DNA, 15 bp, Homo sapiens
ccaaaagaacccttc

SEQ ID NO: 71238 - DNA, 15 bp, Homo sapiens
gccaaaagaaccctt

SEQ ID NO: 71239 - DNA, 15 bp, Homo sapiens
ggccaaaagaaccct

SEQ ID NO: 71240 - DNA, 15 bp, Homo sapiens
gggccaaaagaaccc

SEQ ID NO: 71241 - DNA, 15 bp, Homo sapiens
agggccaaaagaacc

SEQ ID NO: 71242 - DNA, 15 bp, Homo sapiens
gagggccaaaagaac

SEQ ID NO: 71243 - DNA, 15 bp, Homo sapiens
agagggccaaaagaa

SEQ ID NO: 71244 - DNA, 15 bp, Homo sapiens
tagagggccaaaaga

SEQ ID NO: 71245 - DNA, 15 bp, Homo sapiens
ttagagggccaaaag

SEQ ID NO: 71246 - DNA, 15 bp, Homo sapiens
cttagagggccaaaa

SEQ ID NO: 71247 - DNA, 15 bp, Homo sapiens
acttagagggccaaa

SEQ ID NO: 71248 - DNA, 15 bp, Homo sapiens
cacttagagggccaa

SEQ ID NO: 71249 - DNA, 15 bp, Homo sapiens
ccacttagagggcca

SEQ ID NO: 71250 - DNA, 15 bp, Homo sapiens
gccacttagagggcc

SEQ ID NO: 71251 - DNA, 15 bp, Homo sapiens
agccacttagagggc

SEQ ID NO: 71252 - DNA, 15 bp, Homo sapiens
tagccacttagaggg

SEQ ID NO: 71253 - DNA, 15 bp, Homo sapiens
ttagccacttagagg

SEQ ID NO: 71254 - DNA, 15 bp, Homo sapiens
cttagccacttagag

SEQ ID NO: 71255 - DNA, 15 bp, Homo sapiens
tcttagccacttaga

SEQ ID NO: 71256 - DNA, 15 bp, Homo sapiens
ttcttagccacttag

SEQ ID NO: 71257 - DNA, 15 bp, Homo sapiens
gttcttagccactta

SEQ ID NO: 71258 - DNA, 15 bp, Homo sapiens
ggttcttagccactt

SEQ ID NO: 71259 - DNA, 15 bp, Homo sapiens
gggttcttagccact

SEQ ID NO: 71260 - DNA, 15 bp, Homo sapiens
tgggttcttagccac

SEQ ID NO: 71261 - DNA, 15 bp, Homo sapiens
ttgggttcttagcca

SEQ ID NO: 71262 - DNA, 15 bp, Homo sapiens
cttgggttcttagcc

SEQ ID NO: 71263 - DNA, 15 bp, Homo sapiens
gcttgggttcttagc

SEQ ID NO: 71264 - DNA, 15 bp, Homo sapiens
tgcttgggttcttag

SEQ ID NO: 71265 - DNA, 15 bp, Homo sapiens
atgcttgggttctta

SEQ ID NO: 71266 - DNA, 15 bp, Homo sapiens
catgcttgggttctt

SEQ ID NO: 71267 - DNA, 15 bp, Homo sapiens
acatgcttgggttct

SEQ ID NO: 71268 - DNA, 15 bp, Homo sapiens
aacatgcttgggttc

SEQ ID NO: 71269 - DNA, 15 bp, Homo sapiens
caacatgcttgggtt

SEQ ID NO: 71270 - DNA, 15 bp, Homo sapiens
ccaacatgcttgggt

SEQ ID NO: 71271 - DNA, 15 bp, Homo sapiens
gccaacatgcttggg

SEQ ID NO: 71272 - DNA, 15 bp, Homo sapiens
cgccaacatgcttgg

SEQ ID NO: 71273 - DNA, 15 bp, Homo sapiens
acgccaacatgcttg

SEQ ID NO: 71274 - DNA, 15 bp, Homo sapiens
aacgccaacatgctt

SEQ ID NO: 71275 - DNA, 15 bp, Homo sapiens
gaacgccaacatgct

SEQ ID NO: 71276 - DNA, 15 bp, Homo sapiens
tgaacgccaacatgc

SEQ ID NO: 71277 - DNA, 15 bp, Homo sapiens
gtgaacgccaacatg

SEQ ID NO: 71278 - DNA, 15 bp, Homo sapiens
tgtgaacgccaacat

SEQ ID NO: 71279 - DNA, 15 bp, Homo sapiens
atgtgaacgccaaca

SEQ ID NO: 71280 - DNA, 15 bp, Homo sapiens
catgtgaacgccaac

SEQ ID NO: 71281 - DNA, 15 bp, Homo sapiens
ccatgtgaacgccaa

SEQ ID NO: 71282 - DNA, 15 bp, Homo sapiens
accatgtgaacgcca

SEQ ID NO: 71283 - DNA, 15 bp, Homo sapiens
caccatgtgaacgcc

SEQ ID NO: 71284 - DNA, 15 bp, Homo sapiens
acaccatgtgaacgc

SEQ ID NO: 71285 - DNA, 15 bp, Homo sapiens
cacaccatgtgaacg

SEQ ID NO: 71286 - DNA, 15 bp, Homo sapiens
acacaccatgtgaac

SEQ ID NO: 71287 - DNA, 15 bp, Homo sapiens
cacacaccatgtgaa

SEQ ID NO: 71288 - DNA, 15 bp, Homo sapiens
ccacacaccatgtga

SEQ ID NO: 71289 - DNA, 15 bp, Homo sapiens
cccacacaccatgtg

SEQ ID NO: 71290 - DNA, 15 bp, Homo sapiens
acccacacaccatgt

SEQ ID NO: 71291 - DNA, 15 bp, Homo sapiens
cacccacacaccatg

SEQ ID NO: 71292 - DNA, 15 bp, Homo sapiens
tcacccacacaccat

SEQ ID NO: 71293 - DNA, 15 bp, Homo sapiens
ttcacccacacacca

SEQ ID NO: 71294 - DNA, 15 bp, Homo sapiens
cttcacccacacacc

SEQ ID NO: 71295 - DNA, 15 bp, Homo sapiens
tcttcacccacacac

SEQ ID NO: 71296 - DNA, 15 bp, Homo sapiens
ctcttcacccacaca

SEQ ID NO: 71297 - DNA, 15 bp, Homo sapiens
gctcttcacccacac

SEQ ID NO: 71298 - DNA, 15 bp, Homo sapiens
tgctcttcacccaca

SEQ ID NO: 71299 - DNA, 15 bp, Homo sapiens
ttgctcttcacccac

SEQ ID NO: 71300 - DNA, 15 bp, Homo sapiens
tttgctcttcaccca

SEQ ID NO: 71301 - DNA, 15 bp, Homo sapiens
atttgctcttcaccc

SEQ ID NO: 71302 - DNA, 15 bp, Homo sapiens
aatttgctcttcacc

SEQ ID NO: 71303 - DNA, 15 bp, Homo sapiens
gaatttgctcttcac

SEQ ID NO: 71304 - DNA, 15 bp, Homo sapiens
agaatttgctcttca

SEQ ID NO: 71305 - DNA, 15 bp, Homo sapiens
aagaatttgctcttc

SEQ ID NO: 71306 - DNA, 15 bp, Homo sapiens
gaagaatttgctctt

SEQ ID NO: 71307 - DNA, 15 bp, Homo sapiens
cgaagaatttgctct

SEQ ID NO: 71308 - DNA, 15 bp, Homo sapiens
acgaagaatttgctc

SEQ ID NO: 71309 - DNA, 15 bp, Homo sapiens
gacgaagaatttgct

SEQ ID NO: 71310 - DNA, 15 bp, Homo sapiens
agacgaagaatttgc

SEQ ID NO: 71311 - DNA, 15 bp, Homo sapiens
tagacgaagaatttg

SEQ ID NO: 71312 - DNA, 15 bp, Homo sapiens
atagacgaagaattt

SEQ ID NO: 71313 - DNA, 15 bp, Homo sapiens
catagacgaagaatt

SEQ ID NO: 71314 - DNA, 15 bp, Homo sapiens
tcatagacgaagaat

SEQ ID NO: 71315 - DNA, 15 bp, Homo sapiens
atcatagacgaagaa

SEQ ID NO: 71316 - DNA, 15 bp, Homo sapiens
aatcatagacgaaga

SEQ ID NO: 71317 - DNA, 15 bp, Homo sapiens
gaatcatagacgaag

SEQ ID NO: 71318 - DNA, 15 bp, Homo sapiens
tgaatcatagacgaa

SEQ ID NO: 71319 - DNA, 15 bp, Homo sapiens
ctgaatcatagacga

SEQ ID NO: 71320 - DNA, 15 bp, Homo sapiens
cctgaatcatagacg

SEQ ID NO: 71321 - DNA, 15 bp, Homo sapiens
tcctgaatcatagac

SEQ ID NO: 71322 - DNA, 15 bp, Homo sapiens
ttcctgaatcataga

SEQ ID NO: 71323 - DNA, 15 bp, Homo sapiens
tttcctgaatcatag

SEQ ID NO: 71324 - DNA, 15 bp, Homo sapiens
ctttcctgaatcata

SEQ ID NO: 71325 - DNA, 15 bp, Homo sapiens
gctttcctgaatcat

SEQ ID NO: 71326 - DNA, 15 bp, Homo sapiens
cgctttcctgaatca

SEQ ID NO: 71327 - DNA, 15 bp, Homo sapiens
acgctttcctgaatc

SEQ ID NO: 71328 - DNA, 15 bp, Homo sapiens
gacgctttcctgaat

SEQ ID NO: 71329 - DNA, 15 bp, Homo sapiens
tgacgctttcctgaa

SEQ ID NO: 71330 - DNA, 15 bp, Homo sapiens
ctgacgctttcctga

SEQ ID NO: 71331 - DNA, 15 bp, Homo sapiens
cctgacgctttcctg

SEQ ID NO: 71332 - DNA, 15 bp, Homo sapiens
gcctgacgctttcct

SEQ ID NO: 71333 - DNA, 15 bp, Homo sapiens
tgcctgacgctttcc

SEQ ID NO: 71334 - DNA, 15 bp, Homo sapiens
atgcctgacgctttc

SEQ ID NO: 71335 - DNA, 15 bp, Homo sapiens
aatgcctgacgcttt

SEQ ID NO: 71336 - DNA, 15 bp, Homo sapiens
taatgcctgacgctt

SEQ ID NO: 71337 - DNA, 15 bp, Homo sapiens
ttaatgcctgacgct

SEQ ID NO: 71338 - DNA, 15 bp, Homo sapiens
cttaatgcctgacgc

SEQ ID NO: 71339 - DNA, 15 bp, Homo sapiens
acttaatgcctgacg

SEQ ID NO: 71340 - DNA, 15 bp, Homo sapiens
aacttaatgcctgac

SEQ ID NO: 71341 - DNA, 15 bp, Homo sapiens
taacttaatgcctga

SEQ ID NO: 71342 - DNA, 15 bp, Homo sapiens
ctaacttaatgcctg

SEQ ID NO: 71343 - DNA, 15 bp, Homo sapiens
cctaacttaatgcct

SEQ ID NO: 71344 - DNA, 15 bp, Homo sapiens
tcctaacttaatgcc

SEQ ID NO: 71345 - DNA, 15 bp, Homo sapiens
ttcctaacttaatgc

SEQ ID NO: 71346 - DNA, 15 bp, Homo sapiens
gttcctaacttaatg

SEQ ID NO: 71347 - DNA, 15 bp, Homo sapiens
ggttcctaacttaat

SEQ ID NO: 71348 - DNA, 15 bp, Homo sapiens
tggttcctaacttaa

SEQ ID NO: 71349 - DNA, 15 bp, Homo sapiens
ttggttcctaactta

SEQ ID NO: 71350 - DNA, 15 bp, Homo sapiens
tttggttcctaactt

SEQ ID NO: 71351 - DNA, 15 bp, Homo sapiens
ttttggttcctaact

SEQ ID NO: 71352 - DNA, 15 bp, Homo sapiens
attttggttcctaac

SEQ ID NO: 71353 - DNA, 15 bp, Homo sapiens
aattttggttcctaa

SEQ ID NO: 71354 - DNA, 15 bp, Homo sapiens
caattttggttccta

SEQ ID NO: 71355 - DNA, 15 bp, Homo sapiens
ccaattttggttcct

SEQ ID NO: 71356 - DNA, 15 bp, Homo sapiens
cccaattttggttcc

SEQ ID NO: 71357 - DNA, 15 bp, Homo sapiens
acccaattttggttc

SEQ ID NO: 71358 - DNA, 15 bp, Homo sapiens
cacccaattttggtt

SEQ ID NO: 71359 - DNA, 15 bp, Homo sapiens
ccacccaattttggt

SEQ ID NO: 71360 - DNA, 15 bp, Homo sapiens
cccacccaattttgg

SEQ ID NO: 71361 - DNA, 15 bp, Homo sapiens
gcccacccaattttg

SEQ ID NO: 71362 - DNA, 15 bp, Homo sapiens
tgcccacccaatttt

SEQ ID NO: 71363 - DNA, 15 bp, Homo sapiens
ttgcccacccaattt

SEQ ID NO: 71364 - DNA, 15 bp, Homo sapiens
attgcccacccaatt

SEQ ID NO: 71365 - DNA, 15 bp, Homo sapiens
aattgcccacccaat

SEQ ID NO: 71366 - DNA, 15 bp, Homo sapiens
aaattgcccacccaa

SEQ ID NO: 71367 - DNA, 15 bp, Homo sapiens
taaattgcccaccca

SEQ ID NO: 71368 - DNA, 15 bp, Homo sapiens
ttaaattgcccaccc

SEQ ID NO: 71369 - DNA, 15 bp, Homo sapiens
attaaattgcccacc

SEQ ID NO: 71370 - DNA, 15 bp, Homo sapiens
aattaaattgcccac

SEQ ID NO: 71371 - DNA, 15 bp, Homo sapiens
aaattaaattgccca

SEQ ID NO: 71372 - DNA, 15 bp, Homo sapiens
caaattaaattgccc

SEQ ID NO: 71373 - DNA, 15 bp, Homo sapiens
ccaaattaaattgcc

SEQ ID NO: 71374 - DNA, 15 bp, Homo sapiens
accaaattaaattgc

SEQ ID NO: 71375 - DNA, 15 bp, Homo sapiens
gaccaaattaaattg

SEQ ID NO: 71376 - DNA, 15 bp, Homo sapiens
tgaccaaattaaatt

SEQ ID NO: 71377 - DNA, 15 bp, Homo sapiens
gtgaccaaattaaat

SEQ ID NO: 71378 - DNA, 15 bp, Homo sapiens
tgtgaccaaattaaa

SEQ ID NO: 71379 - DNA, 15 bp, Homo sapiens
ttgtgaccaaattaa

SEQ ID NO: 71380 - DNA, 15 bp, Homo sapiens
cttgtgaccaaatta

SEQ ID NO: 71381 - DNA, 15 bp, Homo sapiens
acttgtgaccaaatt

SEQ ID NO: 71382 - DNA, 15 bp, Homo sapiens
gacttgtgaccaaat

SEQ ID NO: 71383 - DNA, 15 bp, Homo sapiens
agacttgtgaccaaa

SEQ ID NO: 71384 - DNA, 15 bp, Homo sapiens
tagacttgtgaccaa

SEQ ID NO: 71385 - DNA, 15 bp, Homo sapiens
ctagacttgtgacca

SEQ ID NO: 71386 - DNA, 15 bp, Homo sapiens
cctagacttgtgacc

SEQ ID NO: 71387 - DNA, 15 bp, Homo sapiens
tcctagacttgtgac

SEQ ID NO: 71388 - DNA, 15 bp, Homo sapiens
ctcctagacttgtga

SEQ ID NO: 71389 - DNA, 15 bp, Homo sapiens
tctcctagacttgtg

SEQ ID NO: 71390 - DNA, 15 bp, Homo sapiens
atctcctagacttgt

SEQ ID NO: 71391 - DNA, 15 bp, Homo sapiens
tatctcctagacttg

SEQ ID NO: 71392 - DNA, 15 bp, Homo sapiens
ttatctcctagactt

SEQ ID NO: 71393 - DNA, 15 bp, Homo sapiens
tttatctcctagact

SEQ ID NO: 71394 - DNA, 15 bp, Homo sapiens
gtttatctcctagac

SEQ ID NO: 71395 - DNA, 15 bp, Homo sapiens
agtttatctcctaga

SEQ ID NO: 71396 - DNA, 15 bp, Homo sapiens
aagtttatctcctag

SEQ ID NO: 71397 - DNA, 15 bp, Homo sapiens
aaagtttatctccta

SEQ ID NO: 71398 - DNA, 15 bp, Homo sapiens
aaaagtttatctcct

SEQ ID NO: 71399 - DNA, 15 bp, Homo sapiens
gaaaagtttatctcc

SEQ ID NO: 71400 - DNA, 15 bp, Homo sapiens
tgaaaagtttatctc

SEQ ID NO: 71401 - DNA, 15 bp, Homo sapiens
atgaaaagtttatct

SEQ ID NO: 71402 - DNA, 15 bp, Homo sapiens
tatgaaaagtttatc

SEQ ID NO: 71403 - DNA, 15 bp, Homo sapiens
ctatgaaaagtttat

SEQ ID NO: 71404 - DNA, 15 bp, Homo sapiens
actatgaaaagttta

SEQ ID NO: 71405 - DNA, 15 bp, Homo sapiens
gactatgaaaagttt

SEQ ID NO: 71406 - DNA, 15 bp, Homo sapiens
tgactatgaaaagtt

SEQ ID NO: 71407 - DNA, 15 bp, Homo sapiens
ttgactatgaaaagt

SEQ ID NO: 71408 - DNA, 15 bp, Homo sapiens
cttgactatgaaaag

SEQ ID NO: 71409 - DNA, 15 bp, Homo sapiens
tcttgactatgaaaa

SEQ ID NO: 71410 - DNA, 15 bp, Homo sapiens
atcttgactatgaaa

SEQ ID NO: 71411 - DNA, 15 bp, Homo sapiens
tatcttgactatgaa

SEQ ID NO: 71412 - DNA, 15 bp, Homo sapiens
ttatcttgactatga

SEQ ID NO: 71413 - DNA, 15 bp, Homo sapiens
cttatcttgactatg

SEQ ID NO: 71414 - DNA, 15 bp, Homo sapiens
ccttatcttgactat

SEQ ID NO: 71415 - DNA, 15 bp, Homo sapiens
tccttatcttgacta

SEQ ID NO: 71416 - DNA, 15 bp, Homo sapiens
ttccttatcttgact

SEQ ID NO: 71417 - DNA, 15 bp, Homo sapiens
tttccttatcttgac

SEQ ID NO: 71418 - DNA, 15 bp, Homo sapiens
ctttccttatcttga

SEQ ID NO: 71419 - DNA, 15 bp, Homo sapiens
tctttccttatcttg

SEQ ID NO: 71420 - DNA, 15 bp, Homo sapiens
atctttccttatctt

SEQ ID NO: 71421 - DNA, 15 bp, Homo sapiens
tatctttccttatct

SEQ ID NO: 71422 - DNA, 15 bp, Homo sapiens
ctatctttccttatc

SEQ ID NO: 71423 - DNA, 15 bp, Homo sapiens
tctatctttccttat

SEQ ID NO: 71424 - DNA, 15 bp, Homo sapiens
ttctatctttcctta

SEQ ID NO: 71425 - DNA, 15 bp, Homo sapiens
attctatctttcctt

SEQ ID NO: 71426 - DNA, 15 bp, Homo sapiens
tattctatctttcct

SEQ ID NO: 71427 - DNA, 15 bp, Homo sapiens
ttattctatctttcc

SEQ ID NO: 71428 - DNA, 15 bp, Homo sapiens
tttattctatctttc

SEQ ID NO: 71429 - DNA, 15 bp, Homo sapiens
ttttattctatcttt

SEQ ID NO: 71430 - DNA, 15 bp, Homo sapiens
attttattctatctt

SEQ ID NO: 71431 - DNA, 15 bp, Homo sapiens
tattttattctatct

SEQ ID NO: 71432 - DNA, 15 bp, Homo sapiens
atattttattctatc

SEQ ID NO: 71433 - DNA, 15 bp, Homo sapiens
catattttattctat

SEQ ID NO: 71434 - DNA, 15 bp, Homo sapiens
gcatattttattcta

SEQ ID NO: 71435 - DNA, 15 bp, Homo sapiens
agcatattttattct

SEQ ID NO: 71436 - DNA, 15 bp, Homo sapiens
gagcatattttattc

SEQ ID NO: 71437 - DNA, 15 bp, Homo sapiens
agagcatattttatt

SEQ ID NO: 71438 - DNA, 15 bp, Homo sapiens
gagagcatattttat

SEQ ID NO: 71439 - DNA, 15 bp, Homo sapiens
agagagcatatttta

SEQ ID NO: 71440 - DNA, 15 bp, Homo sapiens
cagagagcatatttt

SEQ ID NO: 71441 - DNA, 15 bp, Homo sapiens
acagagagcatattt

SEQ ID NO: 71442 - DNA, 15 bp, Homo sapiens
tacagagagcatatt

SEQ ID NO: 71443 - DNA, 15 bp, Homo sapiens
ttacagagagcatat

SEQ ID NO: 71444 - DNA, 15 bp, Homo sapiens
tttacagagagcata

SEQ ID NO: 71445 - DNA, 15 bp, Homo sapiens
atttacagagagcat

SEQ ID NO: 71446 - DNA, 15 bp, Homo sapiens
aatttacagagagca

SEQ ID NO: 71447 - DNA, 15 bp, Homo sapiens
caatttacagagagc

SEQ ID NO: 71448 - DNA, 15 bp, Homo sapiens
tcaatttacagagag

SEQ ID NO: 71449 - DNA, 15 bp, Homo sapiens
ttcaatttacagaga

SEQ ID NO: 71450 - DNA, 15 bp, Homo sapiens
cttcaatttacagag

SEQ ID NO: 71451 - DNA, 15 bp, Homo sapiens
tcttcaatttacaga

SEQ ID NO: 71452 - DNA, 15 bp, Homo sapiens
gtcttcaatttacag

SEQ ID NO: 71453 - DNA, 15 bp, Homo sapiens
agtcttcaatttaca

SEQ ID NO: 71454 - DNA, 15 bp, Homo sapiens
aagtcttcaatttac

SEQ ID NO: 71455 - DNA, 15 bp, Homo sapiens
aaagtcttcaattta

SEQ ID NO: 71456 - DNA, 15 bp, Homo sapiens
aaaagtcttcaattt

SEQ ID NO: 71457 - DNA, 15 bp, Homo sapiens
taaaagtcttcaatt

SEQ ID NO: 71458 - DNA, 15 bp, Homo sapiens
ataaaagtcttcaat

SEQ ID NO: 71459 - DNA, 15 bp, Homo sapiens
aataaaagtcttcaa

SEQ ID NO: 71460 - DNA, 15 bp, Homo sapiens
caataaaagtcttca

SEQ ID NO: 71461 - DNA, 15 bp, Homo sapiens
tcaataaaagtcttc

SEQ ID NO: 71462 - DNA, 15 bp, Homo sapiens
atcaataaaagtctt

SEQ ID NO: 71463 - DNA, 15 bp, Homo sapiens
gatcaataaaagtct

SEQ ID NO: 71464 - DNA, 15 bp, Homo sapiens
tgatcaataaaagtc

SEQ ID NO: 71465 - DNA, 15 bp, Homo sapiens
ctgatcaataaaagt

SEQ ID NO: 71466 - DNA, 15 bp, Homo sapiens
actgatcaataaaag

SEQ ID NO: 71467 - DNA, 15 bp, Homo sapiens
cactgatcaataaaa

SEQ ID NO: 71468 - DNA, 15 bp, Homo sapiens
tcactgatcaataaa

SEQ ID NO: 71469 - DNA, 15 bp, Homo sapiens
ttcactgatcaataa

SEQ ID NO: 71470 - DNA, 15 bp, Homo sapiens
tttcactgatcaata

SEQ ID NO: 71471 - DNA, 15 bp, Homo sapiens
gtttcactgatcaat

SEQ ID NO: 71472 - DNA, 15 bp, Homo sapiens
tgtttcactgatcaa

SEQ ID NO: 71473 - DNA, 15 bp, Homo sapiens
atgtttcactgatca

SEQ ID NO: 71474 - DNA, 15 bp, Homo sapiens
aatgtttcactgatc

SEQ ID NO: 71475 - DNA, 15 bp, Homo sapiens
caatgtttcactgat

SEQ ID NO: 71476 - DNA, 15 bp, Homo sapiens
tcaatgtttcactga

SEQ ID NO: 71477 - DNA, 15 bp, Homo sapiens
ctcaatgtttcactg

SEQ ID NO: 71478 - DNA, 15 bp, Homo sapiens
cctcaatgtttcact

SEQ ID NO: 71479 - DNA, 15 bp, Homo sapiens
acctcaatgtttcac

SEQ ID NO: 71480 - DNA, 15 bp, Homo sapiens
tacctcaatgtttca

SEQ ID NO: 71481 - DNA, 15 bp, Homo sapiens
ttacctcaatgtttc

SEQ ID NO: 71482 - DNA, 15 bp, Homo sapiens
gttacctcaatgttt

SEQ ID NO: 71483 - DNA, 15 bp, Homo sapiens
agttacctcaatgtt

SEQ ID NO: 71484 - DNA, 15 bp, Homo sapiens
tagttacctcaatgt

SEQ ID NO: 71485 - DNA, 15 bp, Homo sapiens
ttagttacctcaatg

SEQ ID NO: 71486 - DNA, 15 bp, Homo sapiens
attagttacctcaat

SEQ ID NO: 71487 - DNA, 15 bp, Homo sapiens
tattagttacctcaa

SEQ ID NO: 71488 - DNA, 15 bp, Homo sapiens
atattagttacctca

SEQ ID NO: 71489 - DNA, 15 bp, Homo sapiens
catattagttacctc

SEQ ID NO: 71490 - DNA, 15 bp, Homo sapiens
acatattagttacct

SEQ ID NO: 71491 - DNA, 15 bp, Homo sapiens
tacatattagttacc

SEQ ID NO: 71492 - DNA, 15 bp, Homo sapiens
ttacatattagttac

SEQ ID NO: 71493 - DNA, 15 bp, Homo sapiens
tttacatattagtta

SEQ ID NO: 71494 - DNA, 15 bp, Homo sapiens
ttttacatattagtt

SEQ ID NO: 71495 - DNA, 15 bp, Homo sapiens
gttttacatattagt

SEQ ID NO: 71496 - DNA, 15 bp, Homo sapiens
agttttacatattag

SEQ ID NO: 71497 - DNA, 15 bp, Homo sapiens
aagttttacatatta

SEQ ID NO: 71498 - DNA, 15 bp, Homo sapiens
aaagttttacatatt

SEQ ID NO: 71499 - DNA, 15 bp, Homo sapiens
taaagttttacatat

SEQ ID NO: 71500 - DNA, 15 bp, Homo sapiens
ctaaagttttacata

SEQ ID NO: 71501 - DNA, 15 bp, Homo sapiens
cctaaagttttacat

SEQ ID NO: 71502 - DNA, 15 bp, Homo sapiens
tcctaaagttttaca

SEQ ID NO: 71503 - DNA, 15 bp, Homo sapiens
ttcctaaagttttac

SEQ ID NO: 71504 - DNA, 15 bp, Homo sapiens
attcctaaagtttta

SEQ ID NO: 71505 - DNA, 15 bp, Homo sapiens
tattcctaaagtttt

SEQ ID NO: 71506 - DNA, 15 bp, Homo sapiens
gtattcctaaagttt

SEQ ID NO: 71507 - DNA, 15 bp, Homo sapiens
tgtattcctaaagtt

SEQ ID NO: 71508 - DNA, 15 bp, Homo sapiens
atgtattcctaaagt

SEQ ID NO: 71509 - DNA, 15 bp, Homo sapiens
aatgtattcctaaag

SEQ ID NO: 71510 - DNA, 15 bp, Homo sapiens
taatgtattcctaaa

SEQ ID NO: 71511 - DNA, 15 bp, Homo sapiens
ttaatgtattcctaa

SEQ ID NO: 71512 - DNA, 15 bp, Homo sapiens
tttaatgtattccta

SEQ ID NO: 71513 - DNA, 15 bp, Homo sapiens
gtttaatgtattcct

SEQ ID NO: 71514 - DNA, 15 bp, Homo sapiens
tgtttaatgtattcc

SEQ ID NO: 71515 - DNA, 15 bp, Homo sapiens
gtgtttaatgtattc

SEQ ID NO: 71516 - DNA, 15 bp, Homo sapiens
tgtgtttaatgtatt

SEQ ID NO: 71517 - DNA, 15 bp, Homo sapiens
ttgtgtttaatgtat

SEQ ID NO: 71518 - DNA, 15 bp, Homo sapiens
gttgtgtttaatgta

SEQ ID NO: 71519 - DNA, 15 bp, Homo sapiens
agttgtgtttaatgt

SEQ ID NO: 71520 - DNA, 15 bp, Homo sapiens
gagttgtgtttaatg

SEQ ID NO: 71521 - DNA, 15 bp, Homo sapiens
agagttgtgtttaat

SEQ ID NO: 71522 - DNA, 15 bp, Homo sapiens
cagagttgtgtttaa

SEQ ID NO: 71523 - DNA, 15 bp, Homo sapiens
tcagagttgtgttta

SEQ ID NO: 71524 - DNA, 15 bp, Homo sapiens
ctcagagttgtgttt

SEQ ID NO: 71525 - DNA, 15 bp, Homo sapiens
tctcagagttgtgtt

SEQ ID NO: 71526 - DNA, 15 bp, Homo sapiens
ttctcagagttgtgt

SEQ ID NO: 71527 - DNA, 15 bp, Homo sapiens
cttctcagagttgtg

SEQ ID NO: 71528 - DNA, 15 bp, Homo sapiens
gcttctcagagttgt

SEQ ID NO: 71529 - DNA, 15 bp, Homo sapiens
tgcttctcagagttg

SEQ ID NO: 71530 - DNA, 15 bp, Homo sapiens
atgcttctcagagtt

SEQ ID NO: 71531 - DNA, 15 bp, Homo sapiens
aatgcttctcagagt

SEQ ID NO: 71532 - DNA, 15 bp, Homo sapiens
aaatgcttctcagag

SEQ ID NO: 71533 - DNA, 15 bp, Homo sapiens
caaatgcttctcaga

SEQ ID NO: 71534 - DNA, 15 bp, Homo sapiens
tcaaatgcttctcag

SEQ ID NO: 71535 - DNA, 15 bp, Homo sapiens
ctcaaatgcttctca

SEQ ID NO: 71536 - DNA, 15 bp, Homo sapiens
tctcaaatgcttctc

SEQ ID NO: 71537 - DNA, 15 bp, Homo sapiens
ttctcaaatgcttct

SEQ ID NO: 71538 - DNA, 15 bp, Homo sapiens
gttctcaaatgcttc

SEQ ID NO: 71539 - DNA, 15 bp, Homo sapiens
tgttctcaaatgctt

SEQ ID NO: 71540 - DNA, 15 bp, Homo sapiens
gtgttctcaaatgct

SEQ ID NO: 71541 - DNA, 15 bp, Homo sapiens
agtgttctcaaatgc

SEQ ID NO: 71542 - DNA, 15 bp, Homo sapiens
tagtgttctcaaatg

SEQ ID NO: 71543 - DNA, 15 bp, Homo sapiens
atagtgttctcaaat

SEQ ID NO: 71544 - DNA, 15 bp, Homo sapiens
aatagtgttctcaaa

SEQ ID NO: 71545 - DNA, 15 bp, Homo sapiens
caatagtgttctcaa

SEQ ID NO: 71546 - DNA, 15 bp, Homo sapiens
tcaatagtgttctca

SEQ ID NO: 71547 - DNA, 15 bp, Homo sapiens
atcaatagtgttctc

SEQ ID NO: 71548 - DNA, 15 bp, Homo sapiens
tatcaatagtgttct

SEQ ID NO: 71549 - DNA, 15 bp, Homo sapiens
ctatcaatagtgttc

SEQ ID NO: 71550 - DNA, 15 bp, Homo sapiens
actatcaatagtgtt

SEQ ID NO: 71551 - DNA, 15 bp, Homo sapiens
tactatcaatagtgt

SEQ ID NO: 71552 - DNA, 15 bp, Homo sapiens
atactatcaatagtg

SEQ ID NO: 71553 - DNA, 15 bp, Homo sapiens
aatactatcaatagt

SEQ ID NO: 71554 - DNA, 15 bp, Homo sapiens
aaatactatcaatag

SEQ ID NO: 71555 - DNA, 15 bp, Homo sapiens
taaatactatcaata

SEQ ID NO: 71556 - DNA, 15 bp, Homo sapiens
ttaaatactatcaat

SEQ ID NO: 71557 - DNA, 15 bp, Homo sapiens
tttaaatactatcaa

SEQ ID NO: 71558 - DNA, 15 bp, Homo sapiens
atttaaatactatca

SEQ ID NO: 71559 - DNA, 15 bp, Homo sapiens
tatttaaatactatc

SEQ ID NO: 71560 - DNA, 15 bp, Homo sapiens
ttatttaaatactat

SEQ ID NO: 71561 - DNA, 15 bp, Homo sapiens
tttatttaaatacta

SEQ ID NO: 71562 - DNA, 15 bp, Homo sapiens
atttatttaaatact

SEQ ID NO: 71563 - DNA, 15 bp, Homo sapiens
aatttatttaaatac

SEQ ID NO: 71564 - DNA, 15 bp, Homo sapiens
aaatttatttaaata

SEQ ID NO: 71565 - DNA, 15 bp, Homo sapiens
aaaatttatttaaat

SEQ ID NO: 71566 - DNA, 15 bp, Homo sapiens
gaaaatttatttaaa

SEQ ID NO: 71567 - DNA, 15 bp, Homo sapiens
agaaaatttatttaa

SEQ ID NO: 71568 - DNA, 15 bp, Homo sapiens
aagaaaatttattta

SEQ ID NO: 71569 - DNA, 15 bp, Homo sapiens
aaagaaaatttattt

SEQ ID NO: 71570 - DNA, 15 bp, Homo sapiens
gaaagaaaatttatt

SEQ ID NO: 71571 - DNA, 15 bp, Homo sapiens
agaaagaaaatttat

SEQ ID NO: 71572 - DNA, 15 bp, Homo sapiens
aagaaagaaaattta

SEQ ID NO: 71573 - DNA, 15 bp, Homo sapiens
aaagaaagaaaattt

SEQ ID NO: 71574 - DNA, 15 bp, Homo sapiens
atctcaaaaaaaaga

SEQ ID NO: 71575 - DNA, 15 bp, Homo sapiens
catctcaaaaaaaag

SEQ ID NO: 71576 - DNA, 15 bp, Homo sapiens
cctccagcctgggtg

SEQ ID NO: 71577 - DNA, 15 bp, Homo sapiens
ccctccagcctgggt

SEQ ID NO: 71578 - DNA, 15 bp, Homo sapiens
gccctccagcctggg

SEQ ID NO: 71579 - DNA, 15 bp, Homo sapiens
tgccctccagcctgg

SEQ ID NO: 71580 - DNA, 15 bp, Homo sapiens
ttgccctccagcctg

SEQ ID NO: 71581 - DNA, 15 bp, Homo sapiens
attgccctccagcct

SEQ ID NO: 71582 - DNA, 15 bp, Homo sapiens
cattgccctccagcc

SEQ ID NO: 71583 - DNA, 15 bp, Homo sapiens
ccattgccctccagc

SEQ ID NO: 71584 - DNA, 15 bp, Homo sapiens
gccattgccctccag

SEQ ID NO: 71585 - DNA, 15 bp, Homo sapiens
tgccattgccctcca

SEQ ID NO: 71586 - DNA, 15 bp, Homo sapiens
ttgccattgccctcc

SEQ ID NO: 71587 - DNA, 15 bp, Homo sapiens
tttgccattgccctc

SEQ ID NO: 71588 - DNA, 15 bp, Homo sapiens
ttttgccattgccct

SEQ ID NO: 71589 - DNA, 15 bp, Homo sapiens
attttgccattgccc

SEQ ID NO: 71590 - DNA, 15 bp, Homo sapiens
gattttgccattgcc

SEQ ID NO: 71591 - DNA, 15 bp, Homo sapiens
agattttgccattgc

SEQ ID NO: 71592 - DNA, 15 bp, Homo sapiens
gagattttgccattg

SEQ ID NO: 71593 - DNA, 15 bp, Homo sapiens
tgagattttgccatt

SEQ ID NO: 71594 - DNA, 15 bp, Homo sapiens
ctgagattttgccat

SEQ ID NO: 71595 - DNA, 15 bp, Homo sapiens
gctgagattttgcca

SEQ ID NO: 71596 - DNA, 15 bp, Homo sapiens
agctgagattttgcc

SEQ ID NO: 71597 - DNA, 15 bp, Homo sapiens
gagctgagattttgc

SEQ ID NO: 71598 - DNA, 15 bp, Homo sapiens
tgagctgagattttg

SEQ ID NO: 71599 - DNA, 15 bp, Homo sapiens
gtgagctgagatttt

SEQ ID NO: 71600 - DNA, 15 bp, Homo sapiens
agtgagctgagattt

SEQ ID NO: 71601 - DNA, 15 bp, Homo sapiens
cagtgagctgagatt

SEQ ID NO: 71602 - DNA, 15 bp, Homo sapiens
gtgcagtgagctgag

SEQ ID NO: 71603 - DNA, 15 bp, Homo sapiens
ggtgcagtgagctga

SEQ ID NO: 71604 - DNA, 15 bp, Homo sapiens
gggtgcagtgagctg

SEQ ID NO: 71605 - DNA, 15 bp, Homo sapiens
agggtgcagtgagct

SEQ ID NO: 71606 - DNA, 15 bp, Homo sapiens
gagggtgcagtgagc

SEQ ID NO: 71607 - DNA, 15 bp, Homo sapiens
agagggtgcagtgag

SEQ ID NO: 71608 - DNA, 15 bp, Homo sapiens
cagagggtgcagtga

SEQ ID NO: 71609 - DNA, 15 bp, Homo sapiens
gcagagggtgcagtg

SEQ ID NO: 71610 - DNA, 15 bp, Homo sapiens
ggcagagggtgcagt

SEQ ID NO: 71611 - DNA, 15 bp, Homo sapiens
aggcagagggtgcag

SEQ ID NO: 71612 - DNA, 15 bp, Homo sapiens
gaggcagagggtgca

SEQ ID NO: 71613 - DNA, 15 bp, Homo sapiens
ggaggcagagggtgc

SEQ ID NO: 71614 - DNA, 15 bp, Homo sapiens
aggaggcagagggtg

SEQ ID NO: 71615 - DNA, 15 bp, Homo sapiens
caggaggcagagggt

SEQ ID NO: 71616 - DNA, 15 bp, Homo sapiens
ccaggaggcagaggg

SEQ ID NO: 71617 - DNA, 15 bp, Homo sapiens
cccaggaggcagagg

SEQ ID NO: 71618 - DNA, 15 bp, Homo sapiens
acccaggaggcagag

SEQ ID NO: 71619 - DNA, 15 bp, Homo sapiens
aacccaggaggcaga

SEQ ID NO: 71620 - DNA, 15 bp, Homo sapiens
gaacccaggaggcag

SEQ ID NO: 71621 - DNA, 15 bp, Homo sapiens
tgaacccaggaggca

SEQ ID NO: 71622 - DNA, 15 bp, Homo sapiens
actgaggtgggagaa

SEQ ID NO: 71623 - DNA, 15 bp, Homo sapiens
gactgaggtgggaga

SEQ ID NO: 71624 - DNA, 15 bp, Homo sapiens
acgcctgtagtccca

SEQ ID NO: 71625 - DNA, 15 bp, Homo sapiens
cacgcctgtagtccc

SEQ ID NO: 71626 - DNA, 15 bp, Homo sapiens
acacgcctgtagtcc

SEQ ID NO: 71627 - DNA, 15 bp, Homo sapiens
cacacgcctgtagtc

SEQ ID NO: 71628 - DNA, 15 bp, Homo sapiens
gcacacgcctgtagt

SEQ ID NO: 71629 - DNA, 15 bp, Homo sapiens
ggcacacgcctgtag

SEQ ID NO: 71630 - DNA, 15 bp, Homo sapiens
ggtggcacacgcctg

SEQ ID NO: 71631 - DNA, 15 bp, Homo sapiens
tggtggcacacgcct

SEQ ID NO: 71632 - DNA, 15 bp, Homo sapiens
gtggtggcacacgcc

SEQ ID NO: 71633 - DNA, 15 bp, Homo sapiens
tgtggtggcacacgc

SEQ ID NO: 71634 - DNA, 15 bp, Homo sapiens
gtgtggtggcacacg

SEQ ID NO: 71635 - DNA, 15 bp, Homo sapiens
aaaaaatacaaaaaa

SEQ ID NO: 71636 - DNA, 15 bp, Homo sapiens
caaaaaatacaaaaa

SEQ ID NO: 71637 - DNA, 15 bp, Homo sapiens
acaaaaaatacaaaa

SEQ ID NO: 71638 - DNA, 15 bp, Homo sapiens
tacaaaaaatacaaa

SEQ ID NO: 71639 - DNA, 15 bp, Homo sapiens
atacaaaaaatacaa

SEQ ID NO: 71640 - DNA, 15 bp, Homo sapiens
aatacaaaaaataca

SEQ ID NO: 71641 - DNA, 15 bp, Homo sapiens
aaatacaaaaaatac

SEQ ID NO: 71642 - DNA, 15 bp, Homo sapiens
aaaatacaaaaaata

SEQ ID NO: 71643 - DNA, 15 bp, Homo sapiens
actttactaaaaata

SEQ ID NO: 71644 - DNA, 15 bp, Homo sapiens
gactttactaaaaat

SEQ ID NO: 71645 - DNA, 15 bp, Homo sapiens
tgactttactaaaaa

SEQ ID NO: 71646 - DNA, 15 bp, Homo sapiens
ctgactttactaaaa

SEQ ID NO: 71647 - DNA, 15 bp, Homo sapiens
cctgactttactaaa

SEQ ID NO: 71648 - DNA, 15 bp, Homo sapiens
ccctgactttactaa

SEQ ID NO: 71649 - DNA, 15 bp, Homo sapiens
accctgactttacta

SEQ ID NO: 71650 - DNA, 15 bp, Homo sapiens
aaccctgactttact

SEQ ID NO: 71651 - DNA, 15 bp, Homo sapiens
aaaccctgactttac

SEQ ID NO: 71652 - DNA, 15 bp, Homo sapiens
gaaaccctgacttta

SEQ ID NO: 71653 - DNA, 15 bp, Homo sapiens
tgaaaccctgacttt

SEQ ID NO: 71654 - DNA, 15 bp, Homo sapiens
gtgaaaccctgactt

SEQ ID NO: 71655 - DNA, 15 bp, Homo sapiens
ggtgaaaccctgact

SEQ ID NO: 71656 - DNA, 15 bp, Homo sapiens
tggtgaaaccctgac

SEQ ID NO: 71657 - DNA, 15 bp, Homo sapiens
atggtgaaaccctga

SEQ ID NO: 71658 - DNA, 15 bp, Homo sapiens
catggtgaaaccctg

SEQ ID NO: 71659 - DNA, 15 bp, Homo sapiens
acatggtgaaaccct

SEQ ID NO: 71660 - DNA, 15 bp, Homo sapiens
aaggcaggcggatca

SEQ ID NO: 71661 - DNA, 15 bp, Homo sapiens
caaggcaggcggatc

SEQ ID NO: 71662 - DNA, 15 bp, Homo sapiens
ccaaggcaggcggat

SEQ ID NO: 71663 - DNA, 15 bp, Homo sapiens
cccaaggcaggcgga

SEQ ID NO: 71664 - DNA, 15 bp, Homo sapiens
acccaaggcaggcgg

SEQ ID NO: 71665 - DNA, 15 bp, Homo sapiens
aacccaaggcaggcg

SEQ ID NO: 71666 - DNA, 15 bp, Homo sapiens
gaacccaaggcaggc

SEQ ID NO: 71667 - DNA, 15 bp, Homo sapiens
ggaacccaaggcagg

SEQ ID NO: 71668 - DNA, 15 bp, Homo sapiens
gggaacccaaggcag

SEQ ID NO: 71669 - DNA, 15 bp, Homo sapiens
tgggaacccaaggca

SEQ ID NO: 71670 - DNA, 15 bp, Homo sapiens
ttgggaacccaaggc

SEQ ID NO: 71671 - DNA, 15 bp, Homo sapiens
tttgggaacccaagg

SEQ ID NO: 71672 - DNA, 15 bp, Homo sapiens
ctttgggaacccaag

SEQ ID NO: 71673 - DNA, 15 bp, Homo sapiens
actttgggaacccaa

SEQ ID NO: 71674 - DNA, 15 bp, Homo sapiens
cactttgggaaccca

SEQ ID NO: 71675 - DNA, 15 bp, Homo sapiens
gcactttgggaaccc

SEQ ID NO: 71676 - DNA, 15 bp, Homo sapiens
agcactttgggaacc

SEQ ID NO: 71677 - DNA, 15 bp, Homo sapiens
cagcactttgggaac

SEQ ID NO: 71678 - DNA, 15 bp, Homo sapiens
aggctgggcatggtg

SEQ ID NO: 71679 - DNA, 15 bp, Homo sapiens
taggctgggcatggt

SEQ ID NO: 71680 - DNA, 15 bp, Homo sapiens
ataggctgggcatgg

SEQ ID NO: 71681 - DNA, 15 bp, Homo sapiens
tataggctgggcatg

SEQ ID NO: 71682 - DNA, 15 bp, Homo sapiens
ttataggctgggcat

SEQ ID NO: 71683 - DNA, 15 bp, Homo sapiens
tttataggctgggca

SEQ ID NO: 71684 - DNA, 15 bp, Homo sapiens
atttataggctgggc

SEQ ID NO: 71685 - DNA, 15 bp, Homo sapiens
aatttataggctggg

SEQ ID NO: 71686 - DNA, 15 bp, Homo sapiens
aaatttataggctgg

SEQ ID NO: 71687 - DNA, 15 bp, Homo sapiens
aaaatttataggctg

SEQ ID NO: 71688 - DNA, 15 bp, Homo sapiens
gaaaatttataggct

SEQ ID NO: 71689 - DNA, 15 bp, Homo sapiens
agaaaatttataggc

SEQ ID NO: 71690 - DNA, 15 bp, Homo sapiens
tagaaaatttatagg

SEQ ID NO: 71691 - DNA, 15 bp, Homo sapiens
atagaaaatttatag

SEQ ID NO: 71692 - DNA, 15 bp, Homo sapiens
tatagaaaatttata

SEQ ID NO: 71693 - DNA, 15 bp, Homo sapiens
gtatagaaaatttat

SEQ ID NO: 71694 - DNA, 15 bp, Homo sapiens
tgtatagaaaattta

SEQ ID NO: 71695 - DNA, 15 bp, Homo sapiens
gtgtatagaaaattt

SEQ ID NO: 71696 - DNA, 15 bp, Homo sapiens
tgtgtatagaaaatt

SEQ ID NO: 71697 - DNA, 15 bp, Homo sapiens
atgtgtatagaaaat

SEQ ID NO: 71698 - DNA, 15 bp, Homo sapiens
catgtgtatagaaaa

SEQ ID NO: 71699 - DNA, 15 bp, Homo sapiens
acatgtgtatagaaa

SEQ ID NO: 71700 - DNA, 15 bp, Homo sapiens
tacatgtgtatagaa

SEQ ID NO: 71701 - DNA, 15 bp, Homo sapiens
atacatgtgtataga

SEQ ID NO: 71702 - DNA, 15 bp, Homo sapiens
gatacatgtgtatag

SEQ ID NO: 71703 - DNA, 15 bp, Homo sapiens
ggatacatgtgtata

SEQ ID NO: 71704 - DNA, 15 bp, Homo sapiens
tggatacatgtgtat

SEQ ID NO: 71705 - DNA, 15 bp, Homo sapiens
ttggatacatgtgta

SEQ ID NO: 71706 - DNA, 15 bp, Homo sapiens
attggatacatgtgt

SEQ ID NO: 71707 - DNA, 15 bp, Homo sapiens
cattggatacatgtg

SEQ ID NO: 71708 - DNA, 15 bp, Homo sapiens
tcattggatacatgt

SEQ ID NO: 71709 - DNA, 15 bp, Homo sapiens
gtcattggatacatg

SEQ ID NO: 71710 - DNA, 15 bp, Homo sapiens
agtcattggatacat

SEQ ID NO: 71711 - DNA, 15 bp, Homo sapiens
tagtcattggataca

SEQ ID NO: 71712 - DNA, 15 bp, Homo sapiens
atagtcattggatac

SEQ ID NO: 71713 - DNA, 15 bp, Homo sapiens
catagtcattggata

SEQ ID NO: 71714 - DNA, 15 bp, Homo sapiens
gcatagtcattggat

SEQ ID NO: 71715 - DNA, 15 bp, Homo sapiens
agcatagtcattgga

SEQ ID NO: 71716 - DNA, 15 bp, Homo sapiens
gagcatagtcattgg

SEQ ID NO: 71717 - DNA, 15 bp, Homo sapiens
agagcatagtcattg

SEQ ID NO: 71718 - DNA, 15 bp, Homo sapiens
aagagcatagtcatt

SEQ ID NO: 71719 - DNA, 15 bp, Homo sapiens
gaagagcatagtcat

SEQ ID NO: 71720 - DNA, 15 bp, Homo sapiens
ggaagagcatagtca

SEQ ID NO: 71721 - DNA, 15 bp, Homo sapiens
gggaagagcatagtc

SEQ ID NO: 71722 - DNA, 15 bp, Homo sapiens
tgggaagagcatagt

SEQ ID NO: 71723 - DNA, 15 bp, Homo sapiens
atgggaagagcatag

SEQ ID NO: 71724 - DNA, 15 bp, Homo sapiens
catgggaagagcata

SEQ ID NO: 71725 - DNA, 15 bp, Homo sapiens
ccatgggaagagcat

SEQ ID NO: 71726 - DNA, 15 bp, Homo sapiens
tccatgggaagagca

SEQ ID NO: 71727 - DNA, 15 bp, Homo sapiens
ttccatgggaagagc

SEQ ID NO: 71728 - DNA, 15 bp, Homo sapiens
tttccatgggaagag

SEQ ID NO: 71729 - DNA, 15 bp, Homo sapiens
ttttccatgggaaga

SEQ ID NO: 71730 - DNA, 15 bp, Homo sapiens
cttttccatgggaag

SEQ ID NO: 71731 - DNA, 15 bp, Homo sapiens
ccttttccatgggaa

SEQ ID NO: 71732 - DNA, 15 bp, Homo sapiens
gccttttccatggga

SEQ ID NO: 71733 - DNA, 15 bp, Homo sapiens
cgccttttccatggg

SEQ ID NO: 71734 - DNA, 15 bp, Homo sapiens
tcgccttttccatgg

SEQ ID NO: 71735 - DNA, 15 bp, Homo sapiens
ctcgccttttccatg

SEQ ID NO: 71736 - DNA, 15 bp, Homo sapiens
tctcgccttttccat

SEQ ID NO: 71737 - DNA, 15 bp, Homo sapiens
ctctcgccttttcca

SEQ ID NO: 71738 - DNA, 15 bp, Homo sapiens
tctctcgccttttcc

SEQ ID NO: 71739 - DNA, 15 bp, Homo sapiens
ttctctcgccttttc

SEQ ID NO: 71740 - DNA, 15 bp, Homo sapiens
attctctcgcctttt

SEQ ID NO: 71741 - DNA, 15 bp, Homo sapiens
gattctctcgccttt

SEQ ID NO: 71742 - DNA, 15 bp, Homo sapiens
agattctctcgcctt

SEQ ID NO: 71743 - DNA, 15 bp, Homo sapiens
tagattctctcgcct

SEQ ID NO: 71744 - DNA, 15 bp, Homo sapiens
ttagattctctcgcc

SEQ ID NO: 71745 - DNA, 15 bp, Homo sapiens
cttagattctctcgc

SEQ ID NO: 71746 - DNA, 15 bp, Homo sapiens
ccttagattctctcg

SEQ ID NO: 71747 - DNA, 15 bp, Homo sapiens
accttagattctctc

SEQ ID NO: 71748 - DNA, 15 bp, Homo sapiens
caccttagattctct

SEQ ID NO: 71749 - DNA, 15 bp, Homo sapiens
acaccttagattctc

SEQ ID NO: 71750 - DNA, 15 bp, Homo sapiens
gacaccttagattct

SEQ ID NO: 71751 - DNA, 15 bp, Homo sapiens
ggacaccttagattc

SEQ ID NO: 71752 - DNA, 15 bp, Homo sapiens
tggacaccttagatt

SEQ ID NO: 71753 - DNA, 15 bp, Homo sapiens
atggacaccttagat

SEQ ID NO: 71754 - DNA, 15 bp, Homo sapiens
tatggacaccttaga

SEQ ID NO: 71755 - DNA, 15 bp, Homo sapiens
gtatggacaccttag

SEQ ID NO: 71756 - DNA, 15 bp, Homo sapiens
agtatggacacctta

SEQ ID NO: 71757 - DNA, 15 bp, Homo sapiens
aagtatggacacctt

SEQ ID NO: 71758 - DNA, 15 bp, Homo sapiens
gaagtatggacacct

SEQ ID NO: 71759 - DNA, 15 bp, Homo sapiens
agaagtatggacacc

SEQ ID NO: 71760 - DNA, 15 bp, Homo sapiens
aagaagtatggacac

SEQ ID NO: 71761 - DNA, 15 bp, Homo sapiens
aaagaagtatggaca

SEQ ID NO: 71762 - DNA, 15 bp, Homo sapiens
taaagaagtatggac

SEQ ID NO: 71763 - DNA, 15 bp, Homo sapiens
ttaaagaagtatgga

SEQ ID NO: 71764 - DNA, 15 bp, Homo sapiens
gttaaagaagtatgg

SEQ ID NO: 71765 - DNA, 15 bp, Homo sapiens
agttaaagaagtatg

SEQ ID NO: 71766 - DNA, 15 bp, Homo sapiens
cagttaaagaagtat

SEQ ID NO: 71767 - DNA, 15 bp, Homo sapiens
gcagttaaagaagta

SEQ ID NO: 71768 - DNA, 15 bp, Homo sapiens
agcagttaaagaagt

SEQ ID NO: 71769 - DNA, 15 bp, Homo sapiens
aagcagttaaagaag

SEQ ID NO: 71770 - DNA, 15 bp, Homo sapiens
aaagcagttaaagaa

SEQ ID NO: 71771 - DNA, 15 bp, Homo sapiens
taaagcagttaaaga

SEQ ID NO: 71772 - DNA, 15 bp, Homo sapiens
ataaagcagttaaag

SEQ ID NO: 71773 - DNA, 15 bp, Homo sapiens
aataaagcagttaaa

SEQ ID NO: 71774 - DNA, 15 bp, Homo sapiens
caataaagcagttaa

SEQ ID NO: 71775 - DNA, 15 bp, Homo sapiens
ccaataaagcagtta

SEQ ID NO: 71776 - DNA, 15 bp, Homo sapiens
cccaataaagcagtt

SEQ ID NO: 71777 - DNA, 15 bp, Homo sapiens
acccaataaagcagt

SEQ ID NO: 71778 - DNA, 15 bp, Homo sapiens
tacccaataaagcag

SEQ ID NO: 71779 - DNA, 15 bp, Homo sapiens
ctacccaataaagca

SEQ ID NO: 71780 - DNA, 15 bp, Homo sapiens
gctacccaataaagc

SEQ ID NO: 71781 - DNA, 15 bp, Homo sapiens
agctacccaataaag

SEQ ID NO: 71782 - DNA, 15 bp, Homo sapiens
tagctacccaataaa

SEQ ID NO: 71783 - DNA, 15 bp, Homo sapiens
ttagctacccaataa

SEQ ID NO: 71784 - DNA, 15 bp, Homo sapiens
attagctacccaata

SEQ ID NO: 71785 - DNA, 15 bp, Homo sapiens
gattagctacccaat

SEQ ID NO: 71786 - DNA, 15 bp, Homo sapiens
tgattagctacccaa

SEQ ID NO: 71787 - DNA, 15 bp, Homo sapiens
ctgattagctaccca

SEQ ID NO: 71788 - DNA, 15 bp, Homo sapiens
tctgattagctaccc

SEQ ID NO: 71789 - DNA, 15 bp, Homo sapiens
ctctgattagctacc

SEQ ID NO: 71790 - DNA, 15 bp, Homo sapiens
actctgattagctac

SEQ ID NO: 71791 - DNA, 15 bp, Homo sapiens
tactctgattagcta

SEQ ID NO: 71792 - DNA, 15 bp, Homo sapiens
ttactctgattagct

SEQ ID NO: 71793 - DNA, 15 bp, Homo sapiens
gttactctgattagc

SEQ ID NO: 71794 - DNA, 15 bp, Homo sapiens
agttactctgattag

SEQ ID NO: 71795 - DNA, 15 bp, Homo sapiens
aagttactctgatta

SEQ ID NO: 71796 - DNA, 15 bp, Homo sapiens
aaagttactctgatt

SEQ ID NO: 71797 - DNA, 15 bp, Homo sapiens
aaaagttactctgat

SEQ ID NO: 71798 - DNA, 15 bp, Homo sapiens
caaaagttactctga

SEQ ID NO: 71799 - DNA, 15 bp, Homo sapiens
tcaaaagttactctg

SEQ ID NO: 71800 - DNA, 15 bp, Homo sapiens
gtcaaaagttactct

SEQ ID NO: 71801 - DNA, 15 bp, Homo sapiens
agtcaaaagttactc

SEQ ID NO: 71802 - DNA, 15 bp, Homo sapiens
tagtcaaaagttact

SEQ ID NO: 71803 - DNA, 15 bp, Homo sapiens
atagtcaaaagttac

SEQ ID NO: 71804 - DNA, 15 bp, Homo sapiens
gatagtcaaaagtta

SEQ ID NO: 71805 - DNA, 15 bp, Homo sapiens
cgatagtcaaaagtt

SEQ ID NO: 71806 - DNA, 15 bp, Homo sapiens
acgatagtcaaaagt

SEQ ID NO: 71807 - DNA, 15 bp, Homo sapiens
cacgatagtcaaaag

SEQ ID NO: 71808 - DNA, 15 bp, Homo sapiens
acacgatagtcaaaa

SEQ ID NO: 71809 - DNA, 15 bp, Homo sapiens
tacacgatagtcaaa

SEQ ID NO: 71810 - DNA, 15 bp, Homo sapiens
ctacacgatagtcaa

SEQ ID NO: 71811 - DNA, 15 bp, Homo sapiens
gctacacgatagtca

SEQ ID NO: 71812 - DNA, 15 bp, Homo sapiens
tgctacacgatagtc

SEQ ID NO: 71813 - DNA, 15 bp, Homo sapiens
atgctacacgatagt

SEQ ID NO: 71814 - DNA, 15 bp, Homo sapiens
aatgctacacgatag

SEQ ID NO: 71815 - DNA, 15 bp, Homo sapiens
gaatgctacacgata

SEQ ID NO: 71816 - DNA, 15 bp, Homo sapiens
agaatgctacacgat

SEQ ID NO: 71817 - DNA, 15 bp, Homo sapiens
tagaatgctacacga

SEQ ID NO: 71818 - DNA, 15 bp, Homo sapiens
gtagaatgctacacg

SEQ ID NO: 71819 - DNA, 15 bp, Homo sapiens
agtagaatgctacac

SEQ ID NO: 71820 - DNA, 15 bp, Homo sapiens
aagtagaatgctaca

SEQ ID NO: 71821 - DNA, 15 bp, Homo sapiens
taagtagaatgctac

SEQ ID NO: 71822 - DNA, 15 bp, Homo sapiens
ataagtagaatgcta

SEQ ID NO: 71823 - DNA, 15 bp, Homo sapiens
gataagtagaatgct

SEQ ID NO: 71824 - DNA, 15 bp, Homo sapiens
agataagtagaatgc

SEQ ID NO: 71825 - DNA, 15 bp, Homo sapiens
gagataagtagaatg

SEQ ID NO: 71826 - DNA, 15 bp, Homo sapiens
agagataagtagaat

SEQ ID NO: 71827 - DNA, 15 bp, Homo sapiens
aagagataagtagaa

SEQ ID NO: 71828 - DNA, 15 bp, Homo sapiens
aaagagataagtaga

SEQ ID NO: 71829 - DNA, 15 bp, Homo sapiens
taaagagataagtag

SEQ ID NO: 71830 - DNA, 15 bp, Homo sapiens
ataaagagataagta

SEQ ID NO: 71831 - DNA, 15 bp, Homo sapiens
tataaagagataagt

SEQ ID NO: 71832 - DNA, 15 bp, Homo sapiens
gtataaagagataag

SEQ ID NO: 71833 - DNA, 15 bp, Homo sapiens
agtataaagagataa

SEQ ID NO: 71834 - DNA, 15 bp, Homo sapiens
cagtataaagagata

SEQ ID NO: 71835 - DNA, 15 bp, Homo sapiens
acagtataaagagat

SEQ ID NO: 71836 - DNA, 15 bp, Homo sapiens
gacagtataaagaga

SEQ ID NO: 71837 - DNA, 15 bp, Homo sapiens
ggacagtataaagag

SEQ ID NO: 71838 - DNA, 15 bp, Homo sapiens
aggacagtataaaga

SEQ ID NO: 71839 - DNA, 15 bp, Homo sapiens
taggacagtataaag

SEQ ID NO: 71840 - DNA, 15 bp, Homo sapiens
gtaggacagtataaa

SEQ ID NO: 71841 - DNA, 15 bp, Homo sapiens
tgtaggacagtataa

SEQ ID NO: 71842 - DNA, 15 bp, Homo sapiens
gtgtaggacagtata

SEQ ID NO: 71843 - DNA, 15 bp, Homo sapiens
agtgtaggacagtat

SEQ ID NO: 71844 - DNA, 15 bp, Homo sapiens
tagtgtaggacagta

SEQ ID NO: 71845 - DNA, 15 bp, Homo sapiens
ctagtgtaggacagt

SEQ ID NO: 71846 - DNA, 15 bp, Homo sapiens
tctagtgtaggacag

SEQ ID NO: 71847 - DNA, 15 bp, Homo sapiens
atctagtgtaggaca

SEQ ID NO: 71848 - DNA, 15 bp, Homo sapiens
tatctagtgtaggac

SEQ ID NO: 71849 - DNA, 15 bp, Homo sapiens
ttatctagtgtagga

SEQ ID NO: 71850 - DNA, 15 bp, Homo sapiens
tttatctagtgtagg

SEQ ID NO: 71851 - DNA, 15 bp, Homo sapiens
ttttatctagtgtag

SEQ ID NO: 71852 - DNA, 15 bp, Homo sapiens
attttatctagtgta

SEQ ID NO: 71853 - DNA, 15 bp, Homo sapiens
cattttatctagtgt

SEQ ID NO: 71854 - DNA, 15 bp, Homo sapiens
tcattttatctagtg

SEQ ID NO: 71855 - DNA, 15 bp, Homo sapiens
atcattttatctagt

SEQ ID NO: 71856 - DNA, 15 bp, Homo sapiens
gatcattttatctag

SEQ ID NO: 71857 - DNA, 15 bp, Homo sapiens
agatcattttatcta

SEQ ID NO: 71858 - DNA, 15 bp, Homo sapiens
gagatcattttatct

SEQ ID NO: 71859 - DNA, 15 bp, Homo sapiens
agagatcattttatc

SEQ ID NO: 71860 - DNA, 15 bp, Homo sapiens
cagagatcattttat

SEQ ID NO: 71861 - DNA, 15 bp, Homo sapiens
tcagagatcatttta

SEQ ID NO: 71862 - DNA, 15 bp, Homo sapiens
gtcagagatcatttt

SEQ ID NO: 71863 - DNA, 15 bp, Homo sapiens
agtcagagatcattt

SEQ ID NO: 71864 - DNA, 15 bp, Homo sapiens
aagtcagagatcatt

SEQ ID NO: 71865 - DNA, 15 bp, Homo sapiens
caagtcagagatcat

SEQ ID NO: 71866 - DNA, 15 bp, Homo sapiens
ccaagtcagagatca

SEQ ID NO: 71867 - DNA, 15 bp, Homo sapiens
accaagtcagagatc

SEQ ID NO: 71868 - DNA, 15 bp, Homo sapiens
aaccaagtcagagat

SEQ ID NO: 71869 - DNA, 15 bp, Homo sapiens
aaaccaagtcagaga

SEQ ID NO: 71870 - DNA, 15 bp, Homo sapiens
taaaccaagtcagag

SEQ ID NO: 71871 - DNA, 15 bp, Homo sapiens
ataaaccaagtcaga

SEQ ID NO: 71872 - DNA, 15 bp, Homo sapiens
aataaaccaagtcag

SEQ ID NO: 71873 - DNA, 15 bp, Homo sapiens
aaataaaccaagtca

SEQ ID NO: 71874 - DNA, 15 bp, Homo sapiens
taaataaaccaagtc

SEQ ID NO: 71875 - DNA, 15 bp, Homo sapiens
ttaaataaaccaagt

SEQ ID NO: 71876 - DNA, 15 bp, Homo sapiens
cttaaataaaccaag

SEQ ID NO: 71877 - DNA, 15 bp, Homo sapiens
gcttaaataaaccaa

SEQ ID NO: 71878 - DNA, 15 bp, Homo sapiens
agcttaaataaacca

SEQ ID NO: 71879 - DNA, 15 bp, Homo sapiens
gagcttaaataaacc

SEQ ID NO: 71880 - DNA, 15 bp, Homo sapiens
agagcttaaataaac

SEQ ID NO: 71881 - DNA, 15 bp, Homo sapiens
cagagcttaaataaa

SEQ ID NO: 71882 - DNA, 15 bp, Homo sapiens
ccagagcttaaataa

SEQ ID NO: 71883 - DNA, 15 bp, Homo sapiens
tccagagcttaaata

SEQ ID NO: 71884 - DNA, 15 bp, Homo sapiens
gtccagagcttaaat

SEQ ID NO: 71885 - DNA, 15 bp, Homo sapiens
agtccagagcttaaa

SEQ ID NO: 71886 - DNA, 15 bp, Homo sapiens
aagtccagagcttaa

SEQ ID NO: 71887 - DNA, 15 bp, Homo sapiens
aaagtccagagctta

SEQ ID NO: 71888 - DNA, 15 bp, Homo sapiens
aaaagtccagagctt

SEQ ID NO: 71889 - DNA, 15 bp, Homo sapiens
aaaaagtccagagct

SEQ ID NO: 71890 - DNA, 15 bp, Homo sapiens
aaaaaagtccagagc

SEQ ID NO: 71891 - DNA, 15 bp, Homo sapiens
caaaaaagtccagag

SEQ ID NO: 71892 - DNA, 15 bp, Homo sapiens
gcaaaaaagtccaga

SEQ ID NO: 71893 - DNA, 15 bp, Homo sapiens
agcaaaaaagtccag

SEQ ID NO: 71894 - DNA, 15 bp, Homo sapiens
aagcaaaaaagtcca

SEQ ID NO: 71895 - DNA, 15 bp, Homo sapiens
aaagcaaaaaagtcc

SEQ ID NO: 71896 - DNA, 15 bp, Homo sapiens
taaagcaaaaaagtc

SEQ ID NO: 71897 - DNA, 15 bp, Homo sapiens
gtaaagcaaaaaagt

SEQ ID NO: 71898 - DNA, 15 bp, Homo sapiens
ggtaaagcaaaaaag

SEQ ID NO: 71899 - DNA, 15 bp, Homo sapiens
tggtaaagcaaaaaa

SEQ ID NO: 71900 - DNA, 15 bp, Homo sapiens
gtggtaaagcaaaaa

SEQ ID NO: 71901 - DNA, 15 bp, Homo sapiens
agtggtaaagcaaaa

SEQ ID NO: 71902 - DNA, 15 bp, Homo sapiens
aagtggtaaagcaaa

SEQ ID NO: 71903 - DNA, 15 bp, Homo sapiens
gaagtggtaaagcaa

SEQ ID NO: 71904 - DNA, 15 bp, Homo sapiens
agaagtggtaaagca

SEQ ID NO: 71905 - DNA, 15 bp, Homo sapiens
tagaagtggtaaagc

SEQ ID NO: 71906 - DNA, 15 bp, Homo sapiens
gtagaagtggtaaag

SEQ ID NO: 71907 - DNA, 15 bp, Homo sapiens
tgtagaagtggtaaa

SEQ ID NO: 71908 - DNA, 15 bp, Homo sapiens
atgtagaagtggtaa

SEQ ID NO: 71909 - DNA, 15 bp, Homo sapiens
aatgtagaagtggta

SEQ ID NO: 71910 - DNA, 15 bp, Homo sapiens
aaatgtagaagtggt

SEQ ID NO: 71911 - DNA, 15 bp, Homo sapiens
aaaatgtagaagtgg

SEQ ID NO: 71912 - DNA, 15 bp, Homo sapiens
aaaaatgtagaagtg

SEQ ID NO: 71913 - DNA, 15 bp, Homo sapiens
caaaaatgtagaagt

SEQ ID NO: 71914 - DNA, 15 bp, Homo sapiens
acaaaaatgtagaag

SEQ ID NO: 71915 - DNA, 15 bp, Homo sapiens
tacaaaaatgtagaa

SEQ ID NO: 71916 - DNA, 15 bp, Homo sapiens
atacaaaaatgtaga

SEQ ID NO: 71917 - DNA, 15 bp, Homo sapiens
aatacaaaaatgtag

SEQ ID NO: 71918 - DNA, 15 bp, Homo sapiens
taatacaaaaatgta

SEQ ID NO: 71919 - DNA, 15 bp, Homo sapiens
ttaatacaaaaatgt

SEQ ID NO: 71920 - DNA, 15 bp, Homo sapiens
attaatacaaaaatg

SEQ ID NO: 71921 - DNA, 15 bp, Homo sapiens
aattaatacaaaaat

SEQ ID NO: 71922 - DNA, 15 bp, Homo sapiens
gaattaatacaaaaa

SEQ ID NO: 71923 - DNA, 15 bp, Homo sapiens
ggaattaatacaaaa

SEQ ID NO: 71924 - DNA, 15 bp, Homo sapiens
aggaattaatacaaa

SEQ ID NO: 71925 - DNA, 15 bp, Homo sapiens
taggaattaatacaa

SEQ ID NO: 71926 - DNA, 15 bp, Homo sapiens
ctaggaattaataca

SEQ ID NO: 71927 - DNA, 15 bp, Homo sapiens
actaggaattaatac

SEQ ID NO: 71928 - DNA, 15 bp, Homo sapiens
tactaggaattaata

SEQ ID NO: 71929 - DNA, 15 bp, Homo sapiens
atactaggaattaat

SEQ ID NO: 71930 - DNA, 15 bp, Homo sapiens
catactaggaattaa

SEQ ID NO: 71931 - DNA, 15 bp, Homo sapiens
ccatactaggaatta

SEQ ID NO: 71932 - DNA, 15 bp, Homo sapiens
tccatactaggaatt

SEQ ID NO: 71933 - DNA, 15 bp, Homo sapiens
gtccatactaggaat

SEQ ID NO: 71934 - DNA, 15 bp, Homo sapiens
tgtccatactaggaa

SEQ ID NO: 71935 - DNA, 15 bp, Homo sapiens
gtgtccatactagga

SEQ ID NO: 71936 - DNA, 15 bp, Homo sapiens
agtgtccatactagg

SEQ ID NO: 71937 - DNA, 15 bp, Homo sapiens
gagtgtccatactag

SEQ ID NO: 71938 - DNA, 15 bp, Homo sapiens
tgagtgtccatacta

SEQ ID NO: 71939 - DNA, 15 bp, Homo sapiens
ttgagtgtccatact

SEQ ID NO: 71940 - DNA, 15 bp, Homo sapiens
gttgagtgtccatac

SEQ ID NO: 71941 - DNA, 15 bp, Homo sapiens
agttgagtgtccata

SEQ ID NO: 71942 - DNA, 15 bp, Homo sapiens
gagttgagtgtccat

SEQ ID NO: 71943 - DNA, 15 bp, Homo sapiens
ggagttgagtgtcca

SEQ ID NO: 71944 - DNA, 15 bp, Homo sapiens
aggagttgagtgtcc

SEQ ID NO: 71945 - DNA, 15 bp, Homo sapiens
aaggagttgagtgtc

SEQ ID NO: 71946 - DNA, 15 bp, Homo sapiens
aaaggagttgagtgt

SEQ ID NO: 71947 - DNA, 15 bp, Homo sapiens
taaaggagttgagtg

SEQ ID NO: 71948 - DNA, 15 bp, Homo sapiens
ataaaggagttgagt

SEQ ID NO: 71949 - DNA, 15 bp, Homo sapiens
cataaaggagttgag

SEQ ID NO: 71950 - DNA, 15 bp, Homo sapiens
gcataaaggagttga

SEQ ID NO: 71951 - DNA, 15 bp, Homo sapiens
agcataaaggagttg

SEQ ID NO: 71952 - DNA, 15 bp, Homo sapiens
tagcataaaggagtt

SEQ ID NO: 71953 - DNA, 15 bp, Homo sapiens
atagcataaaggagt

SEQ ID NO: 71954 - DNA, 15 bp, Homo sapiens
tatagcataaaggag

SEQ ID NO: 71955 - DNA, 15 bp, Homo sapiens
ttatagcataaagga

SEQ ID NO: 71956 - DNA, 15 bp, Homo sapiens
tttatagcataaagg

SEQ ID NO: 71957 - DNA, 15 bp, Homo sapiens
atttatagcataaag

SEQ ID NO: 71958 - DNA, 15 bp, Homo sapiens
aatttatagcataaa

SEQ ID NO: 71959 - DNA, 15 bp, Homo sapiens
gaatttatagcataa

SEQ ID NO: 71960 - DNA, 15 bp, Homo sapiens
agaatttatagcata

SEQ ID NO: 71961 - DNA, 15 bp, Homo sapiens
cagaatttatagcat

SEQ ID NO: 71962 - DNA, 15 bp, Homo sapiens
tcagaatttatagca

SEQ ID NO: 71963 - DNA, 15 bp, Homo sapiens
ctcagaatttatagc

SEQ ID NO: 71964 - DNA, 15 bp, Homo sapiens
cctcagaatttatag

SEQ ID NO: 71965 - DNA, 15 bp, Homo sapiens
ccctcagaatttata

SEQ ID NO: 71966 - DNA, 15 bp, Homo sapiens
tccctcagaatttat

SEQ ID NO: 71967 - DNA, 15 bp, Homo sapiens
ctccctcagaattta

SEQ ID NO: 71968 - DNA, 15 bp, Homo sapiens
cctccctcagaattt

SEQ ID NO: 71969 - DNA, 15 bp, Homo sapiens
ccctccctcagaatt

SEQ ID NO: 71970 - DNA, 15 bp, Homo sapiens
gccctccctcagaat

SEQ ID NO: 71971 - DNA, 15 bp, Homo sapiens
ggccctccctcagaa

SEQ ID NO: 71972 - DNA, 15 bp, Homo sapiens
tggccctccctcaga

SEQ ID NO: 71973 - DNA, 15 bp, Homo sapiens
ctggccctccctcag

SEQ ID NO: 71974 - DNA, 15 bp, Homo sapiens
tctggccctccctca

SEQ ID NO: 71975 - DNA, 15 bp, Homo sapiens
ttctggccctccctc

SEQ ID NO: 71976 - DNA, 15 bp, Homo sapiens
gttctggccctccct

SEQ ID NO: 71977 - DNA, 15 bp, Homo sapiens
agttctggccctccc

SEQ ID NO: 71978 - DNA, 15 bp, Homo sapiens
aagttctggccctcc

SEQ ID NO: 71979 - DNA, 15 bp, Homo sapiens
caagttctggccctc

SEQ ID NO: 71980 - DNA, 15 bp, Homo sapiens
tcaagttctggccct

SEQ ID NO: 71981 - DNA, 15 bp, Homo sapiens
ttcaagttctggccc

SEQ ID NO: 71982 - DNA, 15 bp, Homo sapiens
attcaagttctggcc

SEQ ID NO: 71983 - DNA, 15 bp, Homo sapiens
tattcaagttctggc

SEQ ID NO: 71984 - DNA, 15 bp, Homo sapiens
ttattcaagttctgg

SEQ ID NO: 71985 - DNA, 15 bp, Homo sapiens
tttattcaagttctg

SEQ ID NO: 71986 - DNA, 15 bp, Homo sapiens
ttttattcaagttct

SEQ ID NO: 71987 - DNA, 15 bp, Homo sapiens
cttttattcaagttc

SEQ ID NO: 71988 - DNA, 15 bp, Homo sapiens
acttttattcaagtt

SEQ ID NO: 71989 - DNA, 15 bp, Homo sapiens
cacttttattcaagt

SEQ ID NO: 71990 - DNA, 15 bp, Homo sapiens
ccacttttattcaag

SEQ ID NO: 71991 - DNA, 15 bp, Homo sapiens
accacttttattcaa

SEQ ID NO: 71992 - DNA, 15 bp, Homo sapiens
caccacttttattca

SEQ ID NO: 71993 - DNA, 15 bp, Homo sapiens
tcaccacttttattc

SEQ ID NO: 71994 - DNA, 15 bp, Homo sapiens
atcaccacttttatt

SEQ ID NO: 71995 - DNA, 15 bp, Homo sapiens
tatcaccacttttat

SEQ ID NO: 71996 - DNA, 15 bp, Homo sapiens
atatcaccactttta

SEQ ID NO: 71997 - DNA, 15 bp, Homo sapiens
gatatcaccactttt

SEQ ID NO: 71998 - DNA, 15 bp, Homo sapiens
agatatcaccacttt

SEQ ID NO: 71999 - DNA, 15 bp, Homo sapiens
gagatatcaccactt

SEQ ID NO: 72000 - DNA, 15 bp, Homo sapiens
ggagatatcaccact

SEQ ID NO: 72001 - DNA, 15 bp, Homo sapiens
tggagatatcaccac

SEQ ID NO: 72002 - DNA, 15 bp, Homo sapiens
atggagatatcacca

SEQ ID NO: 72003 - DNA, 15 bp, Homo sapiens
aatggagatatcacc

SEQ ID NO: 72004 - DNA, 15 bp, Homo sapiens
aaatggagatatcac

SEQ ID NO: 72005 - DNA, 15 bp, Homo sapiens
caaatggagatatca

SEQ ID NO: 72006 - DNA, 15 bp, Homo sapiens
gcaaatggagatatc

SEQ ID NO: 72007 - DNA, 15 bp, Homo sapiens
tgcaaatggagatat

SEQ ID NO: 72008 - DNA, 15 bp, Homo sapiens
ctgcaaatggagata

SEQ ID NO: 72009 - DNA, 15 bp, Homo sapiens
actgcaaatggagat

SEQ ID NO: 72010 - DNA, 15 bp, Homo sapiens
gactgcaaatggaga

SEQ ID NO: 72011 - DNA, 15 bp, Homo sapiens
agactgcaaatggag

SEQ ID NO: 72012 - DNA, 15 bp, Homo sapiens
cagactgcaaatgga

SEQ ID NO: 72013 - DNA, 15 bp, Homo sapiens
acagactgcaaatgg

SEQ ID NO: 72014 - DNA, 15 bp, Homo sapiens
aacagactgcaaatg

SEQ ID NO: 72015 - DNA, 15 bp, Homo sapiens
taacagactgcaaat

SEQ ID NO: 72016 - DNA, 15 bp, Homo sapiens
ataacagactgcaaa

SEQ ID NO: 72017 - DNA, 15 bp, Homo sapiens
tataacagactgcaa

SEQ ID NO: 72018 - DNA, 15 bp, Homo sapiens
ttataacagactgca

SEQ ID NO: 72019 - DNA, 15 bp, Homo sapiens
gttataacagactgc

SEQ ID NO: 72020 - DNA, 15 bp, Homo sapiens
tgttataacagactg

SEQ ID NO: 72021 - DNA, 15 bp, Homo sapiens
gtgttataacagact

SEQ ID NO: 72022 - DNA, 15 bp, Homo sapiens
agtgttataacagac

SEQ ID NO: 72023 - DNA, 15 bp, Homo sapiens
cagtgttataacaga

SEQ ID NO: 72024 - DNA, 15 bp, Homo sapiens
gcagtgttataacag

SEQ ID NO: 72025 - DNA, 15 bp, Homo sapiens
tgcagtgttataaca

SEQ ID NO: 72026 - DNA, 15 bp, Homo sapiens
atgcagtgttataac

SEQ ID NO: 72027 - DNA, 15 bp, Homo sapiens
gatgcagtgttataa

SEQ ID NO: 72028 - DNA, 15 bp, Homo sapiens
ggatgcagtgttata

SEQ ID NO: 72029 - DNA, 15 bp, Homo sapiens
aggatgcagtgttat

SEQ ID NO: 72030 - DNA, 15 bp, Homo sapiens
gaggatgcagtgtta

SEQ ID NO: 72031 - DNA, 15 bp, Homo sapiens
tgaggatgcagtgtt

SEQ ID NO: 72032 - DNA, 15 bp, Homo sapiens
ttgaggatgcagtgt

SEQ ID NO: 72033 - DNA, 15 bp, Homo sapiens
tttgaggatgcagtg

SEQ ID NO: 72034 - DNA, 15 bp, Homo sapiens
gtttgaggatgcagt

SEQ ID NO: 72035 - DNA, 15 bp, Homo sapiens
agtttgaggatgcag

SEQ ID NO: 72036 - DNA, 15 bp, Homo sapiens
cagtttgaggatgca

SEQ ID NO: 72037 - DNA, 15 bp, Homo sapiens
gcagtttgaggatgc

SEQ ID NO: 72038 - DNA, 15 bp, Homo sapiens
ggcagtttgaggatg

SEQ ID NO: 72039 - DNA, 15 bp, Homo sapiens
aggcagtttgaggat

SEQ ID NO: 72040 - DNA, 15 bp, Homo sapiens
aaggcagtttgagga

SEQ ID NO: 72041 - DNA, 15 bp, Homo sapiens
aaaggcagtttgagg

SEQ ID NO: 72042 - DNA, 15 bp, Homo sapiens
caaaggcagtttgag

SEQ ID NO: 72043 - DNA, 15 bp, Homo sapiens
acaaaggcagtttga

SEQ ID NO: 72044 - DNA, 15 bp, Homo sapiens
aacaaaggcagtttg

SEQ ID NO: 72045 - DNA, 15 bp, Homo sapiens
caacaaaggcagttt

SEQ ID NO: 72046 - DNA, 15 bp, Homo sapiens
tcaacaaaggcagtt

SEQ ID NO: 72047 - DNA, 15 bp, Homo sapiens
atcaacaaaggcagt

SEQ ID NO: 72048 - DNA, 15 bp, Homo sapiens
tatcaacaaaggcag

SEQ ID NO: 72049 - DNA, 15 bp, Homo sapiens
ttatcaacaaaggca

SEQ ID NO: 72050 - DNA, 15 bp, Homo sapiens
attatcaacaaaggc

SEQ ID NO: 72051 - DNA, 15 bp, Homo sapiens
cattatcaacaaagg

SEQ ID NO: 72052 - DNA, 15 bp, Homo sapiens
ccattatcaacaaag

SEQ ID NO: 72053 - DNA, 15 bp, Homo sapiens
tccattatcaacaaa

SEQ ID NO: 72054 - DNA, 15 bp, Homo sapiens
ttccattatcaacaa

SEQ ID NO: 72055 - DNA, 15 bp, Homo sapiens
attccattatcaaca

SEQ ID NO: 72056 - DNA, 15 bp, Homo sapiens
cattccattatcaac

SEQ ID NO: 72057 - DNA, 15 bp, Homo sapiens
acattccattatcaa

SEQ ID NO: 72058 - DNA, 15 bp, Homo sapiens
tacattccattatca

SEQ ID NO: 72059 - DNA, 15 bp, Homo sapiens
ttacattccattatc

SEQ ID NO: 72060 - DNA, 15 bp, Homo sapiens
tttacattccattat

SEQ ID NO: 72061 - DNA, 15 bp, Homo sapiens
ctttacattccatta

SEQ ID NO: 72062 - DNA, 15 bp, Homo sapiens
tctttacattccatt

SEQ ID NO: 72063 - DNA, 15 bp, Homo sapiens
atctttacattccat

SEQ ID NO: 72064 - DNA, 15 bp, Homo sapiens
catctttacattcca

SEQ ID NO: 72065 - DNA, 15 bp, Homo sapiens
acatctttacattcc

SEQ ID NO: 72066 - DNA, 15 bp, Homo sapiens
tacatctttacattc

SEQ ID NO: 72067 - DNA, 15 bp, Homo sapiens
atacatctttacatt

SEQ ID NO: 72068 - DNA, 15 bp, Homo sapiens
tatacatctttacat

SEQ ID NO: 72069 - DNA, 15 bp, Homo sapiens
ttatacatctttaca

SEQ ID NO: 72070 - DNA, 15 bp, Homo sapiens
attatacatctttac

SEQ ID NO: 72071 - DNA, 15 bp, Homo sapiens
tattatacatcttta

SEQ ID NO: 72072 - DNA, 15 bp, Homo sapiens
ctattatacatcttt

SEQ ID NO: 72073 - DNA, 15 bp, Homo sapiens
cctattatacatctt

SEQ ID NO: 72074 - DNA, 15 bp, Homo sapiens
tcctattatacatct

SEQ ID NO: 72075 - DNA, 15 bp, Homo sapiens
atcctattatacatc

SEQ ID NO: 72076 - DNA, 15 bp, Homo sapiens
aatcctattatacat

SEQ ID NO: 72077 - DNA, 15 bp, Homo sapiens
taatcctattataca

SEQ ID NO: 72078 - DNA, 15 bp, Homo sapiens
ctaatcctattatac

SEQ ID NO: 72079 - DNA, 15 bp, Homo sapiens
actaatcctattata

SEQ ID NO: 72080 - DNA, 15 bp, Homo sapiens
aactaatcctattat

SEQ ID NO: 72081 - DNA, 15 bp, Homo sapiens
aaactaatcctatta

SEQ ID NO: 72082 - DNA, 15 bp, Homo sapiens
gaaactaatcctatt

SEQ ID NO: 72083 - DNA, 15 bp, Homo sapiens
tgaaactaatcctat

SEQ ID NO: 72084 - DNA, 15 bp, Homo sapiens
atgaaactaatccta

SEQ ID NO: 72085 - DNA, 15 bp, Homo sapiens
aatgaaactaatcct

SEQ ID NO: 72086 - DNA, 15 bp, Homo sapiens
taatgaaactaatcc

SEQ ID NO: 72087 - DNA, 15 bp, Homo sapiens
ctaatgaaactaatc

SEQ ID NO: 72088 - DNA, 15 bp, Homo sapiens
actaatgaaactaat

SEQ ID NO: 72089 - DNA, 15 bp, Homo sapiens
tactaatgaaactaa

SEQ ID NO: 72090 - DNA, 15 bp, Homo sapiens
ctactaatgaaacta

SEQ ID NO: 72091 - DNA, 15 bp, Homo sapiens
tctactaatgaaact

SEQ ID NO: 72092 - DNA, 15 bp, Homo sapiens
ttctactaatgaaac

SEQ ID NO: 72093 - DNA, 15 bp, Homo sapiens
gttctactaatgaaa

SEQ ID NO: 72094 - DNA, 15 bp, Homo sapiens
tgttctactaatgaa

SEQ ID NO: 72095 - DNA, 15 bp, Homo sapiens
ctgttctactaatga

SEQ ID NO: 72096 - DNA, 15 bp, Homo sapiens
actgttctactaatg

SEQ ID NO: 72097 - DNA, 15 bp, Homo sapiens
aactgttctactaat

SEQ ID NO: 72098 - DNA, 15 bp, Homo sapiens
taactgttctactaa

SEQ ID NO: 72099 - DNA, 15 bp, Homo sapiens
ctaactgttctacta

SEQ ID NO: 72100 - DNA, 15 bp, Homo sapiens
cctaactgttctact

SEQ ID NO: 72101 - DNA, 15 bp, Homo sapiens
ccctaactgttctac

SEQ ID NO: 72102 - DNA, 15 bp, Homo sapiens
accctaactgttcta

SEQ ID NO: 72103 - DNA, 15 bp, Homo sapiens
taccctaactgttct

SEQ ID NO: 72104 - DNA, 15 bp, Homo sapiens
ttaccctaactgttc

SEQ ID NO: 72105 - DNA, 15 bp, Homo sapiens
attaccctaactgtt

SEQ ID NO: 72106 - DNA, 15 bp, Homo sapiens
cattaccctaactgt

SEQ ID NO: 72107 - DNA, 15 bp, Homo sapiens
tcattaccctaactg

SEQ ID NO: 72108 - DNA, 15 bp, Homo sapiens
atcattaccctaact

SEQ ID NO: 72109 - DNA, 15 bp, Homo sapiens
aatcattaccctaac

SEQ ID NO: 72110 - DNA, 15 bp, Homo sapiens
caatcattaccctaa

SEQ ID NO: 72111 - DNA, 15 bp, Homo sapiens
ccaatcattacccta

SEQ ID NO: 72112 - DNA, 15 bp, Homo sapiens
tccaatcattaccct

SEQ ID NO: 72113 - DNA, 15 bp, Homo sapiens
ttccaatcattaccc

SEQ ID NO: 72114 - DNA, 15 bp, Homo sapiens
tttccaatcattacc

SEQ ID NO: 72115 - DNA, 15 bp, Homo sapiens
atttccaatcattac

SEQ ID NO: 72116 - DNA, 15 bp, Homo sapiens
aatttccaatcatta

SEQ ID NO: 72117 - DNA, 15 bp, Homo sapiens
aaatttccaatcatt

SEQ ID NO: 72118 - DNA, 15 bp, Homo sapiens
taaatttccaatcat

SEQ ID NO: 72119 - DNA, 15 bp, Homo sapiens
ttaaatttccaatca

SEQ ID NO: 72120 - DNA, 15 bp, Homo sapiens
tttaaatttccaatc

SEQ ID NO: 72121 - DNA, 15 bp, Homo sapiens
atttaaatttccaat

SEQ ID NO: 72122 - DNA, 15 bp, Homo sapiens
tatttaaatttccaa

SEQ ID NO: 72123 - DNA, 15 bp, Homo sapiens
atatttaaatttcca

SEQ ID NO: 72124 - DNA, 15 bp, Homo sapiens
catatttaaatttcc

SEQ ID NO: 72125 - DNA, 15 bp, Homo sapiens
tcatatttaaatttc

SEQ ID NO: 72126 - DNA, 15 bp, Homo sapiens
atcatatttaaattt

SEQ ID NO: 72127 - DNA, 15 bp, Homo sapiens
catcatatttaaatt

SEQ ID NO: 72128 - DNA, 15 bp, Homo sapiens
gcatcatatttaaat

SEQ ID NO: 72129 - DNA, 15 bp, Homo sapiens
ggcatcatatttaaa

SEQ ID NO: 72130 - DNA, 15 bp, Homo sapiens
aggcatcatatttaa

SEQ ID NO: 72131 - DNA, 15 bp, Homo sapiens
gaggcatcatattta

SEQ ID NO: 72132 - DNA, 15 bp, Homo sapiens
tgaggcatcatattt

SEQ ID NO: 72133 - DNA, 15 bp, Homo sapiens
atgaggcatcatatt

SEQ ID NO: 72134 - DNA, 15 bp, Homo sapiens
aatgaggcatcatat

SEQ ID NO: 72135 - DNA, 15 bp, Homo sapiens
taatgaggcatcata

SEQ ID NO: 72136 - DNA, 15 bp, Homo sapiens
ttaatgaggcatcat

SEQ ID NO: 72137 - DNA, 15 bp, Homo sapiens
gttaatgaggcatca

SEQ ID NO: 72138 - DNA, 15 bp, Homo sapiens
agttaatgaggcatc

SEQ ID NO: 72139 - DNA, 15 bp, Homo sapiens
cagttaatgaggcat

SEQ ID NO: 72140 - DNA, 15 bp, Homo sapiens
acagttaatgaggca

SEQ ID NO: 72141 - DNA, 15 bp, Homo sapiens
gacagttaatgaggc

SEQ ID NO: 72142 - DNA, 15 bp, Homo sapiens
ggacagttaatgagg

SEQ ID NO: 72143 - DNA, 15 bp, Homo sapiens
aggacagttaatgag

SEQ ID NO: 72144 - DNA, 15 bp, Homo sapiens
aaggacagttaatga

SEQ ID NO: 72145 - DNA, 15 bp, Homo sapiens
taaggacagttaatg

SEQ ID NO: 72146 - DNA, 15 bp, Homo sapiens
ttaaggacagttaat

SEQ ID NO: 72147 - DNA, 15 bp, Homo sapiens
attaaggacagttaa

SEQ ID NO: 72148 - DNA, 15 bp, Homo sapiens
aattaaggacagtta

SEQ ID NO: 72149 - DNA, 15 bp, Homo sapiens
taattaaggacagtt

SEQ ID NO: 72150 - DNA, 15 bp, Homo sapiens
gtaattaaggacagt

SEQ ID NO: 72151 - DNA, 15 bp, Homo sapiens
agtaattaaggacag

SEQ ID NO: 72152 - DNA, 15 bp, Homo sapiens
tagtaattaaggaca

SEQ ID NO: 72153 - DNA, 15 bp, Homo sapiens
atagtaattaaggac

SEQ ID NO: 72154 - DNA, 15 bp, Homo sapiens
aatagtaattaagga

SEQ ID NO: 72155 - DNA, 15 bp, Homo sapiens
caatagtaattaagg

SEQ ID NO: 72156 - DNA, 15 bp, Homo sapiens
tcaatagtaattaag

SEQ ID NO: 72157 - DNA, 15 bp, Homo sapiens
gtcaatagtaattaa

SEQ ID NO: 72158 - DNA, 15 bp, Homo sapiens
tgtcaatagtaatta

SEQ ID NO: 72159 - DNA, 15 bp, Homo sapiens
ttgtcaatagtaatt

SEQ ID NO: 72160 - DNA, 15 bp, Homo sapiens
gttgtcaatagtaat

SEQ ID NO: 72161 - DNA, 15 bp, Homo sapiens
agttgtcaatagtaa

SEQ ID NO: 72162 - DNA, 15 bp, Homo sapiens
cagttgtcaatagta

SEQ ID NO: 72163 - DNA, 15 bp, Homo sapiens
tcagttgtcaatagt

SEQ ID NO: 72164 - DNA, 15 bp, Homo sapiens
ctcagttgtcaatag

SEQ ID NO: 72165 - DNA, 15 bp, Homo sapiens
actcagttgtcaata

SEQ ID NO: 72166 - DNA, 15 bp, Homo sapiens
cactcagttgtcaat

SEQ ID NO: 72167 - DNA, 15 bp, Homo sapiens
gcactcagttgtcaa

SEQ ID NO: 72168 - DNA, 15 bp, Homo sapiens
cgcactcagttgtca

SEQ ID NO: 72169 - DNA, 15 bp, Homo sapiens
acgcactcagttgtc

SEQ ID NO: 72170 - DNA, 15 bp, Homo sapiens
aacgcactcagttgt

SEQ ID NO: 72171 - DNA, 15 bp, Homo sapiens
aaacgcactcagttg

SEQ ID NO: 72172 - DNA, 15 bp, Homo sapiens
aaaacgcactcagtt

SEQ ID NO: 72173 - DNA, 15 bp, Homo sapiens
taaaacgcactcagt

SEQ ID NO: 72174 - DNA, 15 bp, Homo sapiens
ttaaaacgcactcag

SEQ ID NO: 72175 - DNA, 15 bp, Homo sapiens
tttaaaacgcactca

SEQ ID NO: 72176 - DNA, 15 bp, Homo sapiens
atttaaaacgcactc

SEQ ID NO: 72177 - DNA, 15 bp, Homo sapiens
tatttaaaacgcact

SEQ ID NO: 72178 - DNA, 15 bp, Homo sapiens
ctatttaaaacgcac

SEQ ID NO: 72179 - DNA, 15 bp, Homo sapiens
cctatttaaaacgca

SEQ ID NO: 72180 - DNA, 15 bp, Homo sapiens
acctatttaaaacgc

SEQ ID NO: 72181 - DNA, 15 bp, Homo sapiens
tacctatttaaaacg

SEQ ID NO: 72182 - DNA, 15 bp, Homo sapiens
ttacctatttaaaac

SEQ ID NO: 72183 - DNA, 15 bp, Homo sapiens
tttacctatttaaaa

SEQ ID NO: 72184 - DNA, 15 bp, Homo sapiens
atttacctatttaaa

SEQ ID NO: 72185 - DNA, 15 bp, Homo sapiens
catttacctatttaa

SEQ ID NO: 72186 - DNA, 15 bp, Homo sapiens
acatttacctattta

SEQ ID NO: 72187 - DNA, 15 bp, Homo sapiens
cacatttacctattt

SEQ ID NO: 72188 - DNA, 15 bp, Homo sapiens
tcacatttacctatt

SEQ ID NO: 72189 - DNA, 15 bp, Homo sapiens
ttcacatttacctat

SEQ ID NO: 72190 - DNA, 15 bp, Homo sapiens
tttcacatttaccta

SEQ ID NO: 72191 - DNA, 15 bp, Homo sapiens
ctttcacatttacct

SEQ ID NO: 72192 - DNA, 15 bp, Homo sapiens
actttcacatttacc

SEQ ID NO: 72193 - DNA, 15 bp, Homo sapiens
tactttcacatttac

SEQ ID NO: 72194 - DNA, 15 bp, Homo sapiens
ctactttcacattta

SEQ ID NO: 72195 - DNA, 15 bp, Homo sapiens
tctactttcacattt

SEQ ID NO: 72196 - DNA, 15 bp, Homo sapiens
ttctactttcacatt

SEQ ID NO: 72197 - DNA, 15 bp, Homo sapiens
tttctactttcacat

SEQ ID NO: 72198 - DNA, 15 bp, Homo sapiens
atttctactttcaca

SEQ ID NO: 72199 - DNA, 15 bp, Homo sapiens
tatttctactttcac

SEQ ID NO: 72200 - DNA, 15 bp, Homo sapiens
ttatttctactttca

SEQ ID NO: 72201 - DNA, 15 bp, Homo sapiens
attatttctactttc

SEQ ID NO: 72202 - DNA, 15 bp, Homo sapiens
cattatttctacttt

SEQ ID NO: 72203 - DNA, 15 bp, Homo sapiens
ccattatttctactt

SEQ ID NO: 72204 - DNA, 15 bp, Homo sapiens
accattatttctact

SEQ ID NO: 72205 - DNA, 15 bp, Homo sapiens
aaccattatttctac

SEQ ID NO: 72206 - DNA, 15 bp, Homo sapiens
aaaccattatttcta

SEQ ID NO: 72207 - DNA, 15 bp, Homo sapiens
taaaccattatttct

SEQ ID NO: 72208 - DNA, 15 bp, Homo sapiens
ataaaccattatttc

SEQ ID NO: 72209 - DNA, 15 bp, Homo sapiens
gataaaccattattt

SEQ ID NO: 72210 - DNA, 15 bp, Homo sapiens
agataaaccattatt

SEQ ID NO: 72211 - DNA, 15 bp, Homo sapiens
aagataaaccattat

SEQ ID NO: 72212 - DNA, 15 bp, Homo sapiens
taagataaaccatta

SEQ ID NO: 72213 - DNA, 15 bp, Homo sapiens
ttaagataaaccatt

SEQ ID NO: 72214 - DNA, 15 bp, Homo sapiens
attaagataaaccat

SEQ ID NO: 72215 - DNA, 15 bp, Homo sapiens
aattaagataaacca

SEQ ID NO: 72216 - DNA, 15 bp, Homo sapiens
aaattaagataaacc

SEQ ID NO: 72217 - DNA, 15 bp, Homo sapiens
aaaattaagataaac

SEQ ID NO: 72218 - DNA, 15 bp, Homo sapiens
aaaaattaagataaa

SEQ ID NO: 72219 - DNA, 15 bp, Homo sapiens
aaaaaattaagataa

SEQ ID NO: 72220 - DNA, 15 bp, Homo sapiens
aaaaaaattaagata

SEQ ID NO: 72221 - DNA, 15 bp, Homo sapiens
gaaaaaaattaagat

SEQ ID NO: 72222 - DNA, 15 bp, Homo sapiens
agaaaaaaattaaga

SEQ ID NO: 72223 - DNA, 15 bp, Homo sapiens
gagaaaaaaattaag

SEQ ID NO: 72224 - DNA, 15 bp, Homo sapiens
agagaaaaaaattaa

SEQ ID NO: 72225 - DNA, 15 bp, Homo sapiens
tagagaaaaaaatta

SEQ ID NO: 72226 - DNA, 15 bp, Homo sapiens
ctagagaaaaaaatt

SEQ ID NO: 72227 - DNA, 15 bp, Homo sapiens
tctagagaaaaaaat

SEQ ID NO: 72228 - DNA, 15 bp, Homo sapiens
ctctagagaaaaaaa

SEQ ID NO: 72229 - DNA, 15 bp, Homo sapiens
actctagagaaaaaa

SEQ ID NO: 72230 - DNA, 15 bp, Homo sapiens
aactctagagaaaaa

SEQ ID NO: 72231 - DNA, 15 bp, Homo sapiens
aaactctagagaaaa

SEQ ID NO: 72232 - DNA, 15 bp, Homo sapiens
caaactctagagaaa

SEQ ID NO: 72233 - DNA, 15 bp, Homo sapiens
gcaaactctagagaa

SEQ ID NO: 72234 - DNA, 15 bp, Homo sapiens
tgcaaactctagaga

SEQ ID NO: 72235 - DNA, 15 bp, Homo sapiens
ttgcaaactctagag

SEQ ID NO: 72236 - DNA, 15 bp, Homo sapiens
tttgcaaactctaga

SEQ ID NO: 72237 - DNA, 15 bp, Homo sapiens
ctttgcaaactctag

SEQ ID NO: 72238 - DNA, 15 bp, Homo sapiens
actttgcaaactcta

SEQ ID NO: 72239 - DNA, 15 bp, Homo sapiens
cactttgcaaactct

SEQ ID NO: 72240 - DNA, 15 bp, Homo sapiens
tcactttgcaaactc

SEQ ID NO: 72241 - DNA, 15 bp, Homo sapiens
atcactttgcaaact

SEQ ID NO: 72242 - DNA, 15 bp, Homo sapiens
gatcactttgcaaac

SEQ ID NO: 72243 - DNA, 15 bp, Homo sapiens
agatcactttgcaaa

SEQ ID NO: 72244 - DNA, 15 bp, Homo sapiens
aagatcactttgcaa

SEQ ID NO: 72245 - DNA, 15 bp, Homo sapiens
caagatcactttgca

SEQ ID NO: 72246 - DNA, 15 bp, Homo sapiens
tcaagatcactttgc

SEQ ID NO: 72247 - DNA, 15 bp, Homo sapiens
ctcaagatcactttg

SEQ ID NO: 72248 - DNA, 15 bp, Homo sapiens
cctcaagatcacttt

SEQ ID NO: 72249 - DNA, 15 bp, Homo sapiens
gcctcaagatcactt

SEQ ID NO: 72250 - DNA, 15 bp, Homo sapiens
agcctcaagatcact

SEQ ID NO: 72251 - DNA, 15 bp, Homo sapiens
cagcctcaagatcac

SEQ ID NO: 72252 - DNA, 15 bp, Homo sapiens
tcagcctcaagatca

SEQ ID NO: 72253 - DNA, 15 bp, Homo sapiens
ttcagcctcaagatc

SEQ ID NO: 72254 - DNA, 15 bp, Homo sapiens
gttcagcctcaagat

SEQ ID NO: 72255 - DNA, 15 bp, Homo sapiens
tgttcagcctcaaga

SEQ ID NO: 72256 - DNA, 15 bp, Homo sapiens
ctgttcagcctcaag

SEQ ID NO: 72257 - DNA, 15 bp, Homo sapiens
cctgttcagcctcaa

SEQ ID NO: 72258 - DNA, 15 bp, Homo sapiens
acctgttcagcctca

SEQ ID NO: 72259 - DNA, 15 bp, Homo sapiens
cacctgttcagcctc

SEQ ID NO: 72260 - DNA, 15 bp, Homo sapiens
tcacctgttcagcct

SEQ ID NO: 72261 - DNA, 15 bp, Homo sapiens
ttcacctgttcagcc

SEQ ID NO: 72262 - DNA, 15 bp, Homo sapiens
tttcacctgttcagc

SEQ ID NO: 72263 - DNA, 15 bp, Homo sapiens
ctttcacctgttcag

SEQ ID NO: 72264 - DNA, 15 bp, Homo sapiens
actttcacctgttca

SEQ ID NO: 72265 - DNA, 15 bp, Homo sapiens
tactttcacctgttc

SEQ ID NO: 72266 - DNA, 15 bp, Homo sapiens
ttactttcacctgtt

SEQ ID NO: 72267 - DNA, 15 bp, Homo sapiens
tttactttcacctgt

SEQ ID NO: 72268 - DNA, 15 bp, Homo sapiens
atttactttcacctg

SEQ ID NO: 72269 - DNA, 15 bp, Homo sapiens
aatttactttcacct

SEQ ID NO: 72270 - DNA, 15 bp, Homo sapiens
gaatttactttcacc

SEQ ID NO: 72271 - DNA, 15 bp, Homo sapiens
tgaatttactttcac

SEQ ID NO: 72272 - DNA, 15 bp, Homo sapiens
gtgaatttactttca

SEQ ID NO: 72273 - DNA, 15 bp, Homo sapiens
agtgaatttactttc

SEQ ID NO: 72274 - DNA, 15 bp, Homo sapiens
tagtgaatttacttt

SEQ ID NO: 72275 - DNA, 15 bp, Homo sapiens
ttagtgaatttactt

SEQ ID NO: 72276 - DNA, 15 bp, Homo sapiens
gttagtgaatttact

SEQ ID NO: 72277 - DNA, 15 bp, Homo sapiens
agttagtgaatttac

SEQ ID NO: 72278 - DNA, 15 bp, Homo sapiens
gagttagtgaattta

SEQ ID NO: 72279 - DNA, 15 bp, Homo sapiens
tgagttagtgaattt

SEQ ID NO: 72280 - DNA, 15 bp, Homo sapiens
gtgagttagtgaatt

SEQ ID NO: 72281 - DNA, 15 bp, Homo sapiens
tgtgagttagtgaat

SEQ ID NO: 72282 - DNA, 15 bp, Homo sapiens
atgtgagttagtgaa

SEQ ID NO: 72283 - DNA, 15 bp, Homo sapiens
catgtgagttagtga

SEQ ID NO: 72284 - DNA, 15 bp, Homo sapiens
ccatgtgagttagtg

SEQ ID NO: 72285 - DNA, 15 bp, Homo sapiens
accatgtgagttagt

SEQ ID NO: 72286 - DNA, 15 bp, Homo sapiens
caccatgtgagttag

SEQ ID NO: 72287 - DNA, 15 bp, Homo sapiens
ccaccatgtgagtta

SEQ ID NO: 72288 - DNA, 15 bp, Homo sapiens
accaccatgtgagtt

SEQ ID NO: 72289 - DNA, 15 bp, Homo sapiens
gaccaccatgtgagt

SEQ ID NO: 72290 - DNA, 15 bp, Homo sapiens
tgaccaccatgtgag

SEQ ID NO: 72291 - DNA, 15 bp, Homo sapiens
atgaccaccatgtga

SEQ ID NO: 72292 - DNA, 15 bp, Homo sapiens
aatgaccaccatgtg

SEQ ID NO: 72293 - DNA, 15 bp, Homo sapiens
caatgaccaccatgt

SEQ ID NO: 72294 - DNA, 15 bp, Homo sapiens
acaatgaccaccatg

SEQ ID NO: 72295 - DNA, 15 bp, Homo sapiens
aacaatgaccaccat

SEQ ID NO: 72296 - DNA, 15 bp, Homo sapiens
caacaatgaccacca

SEQ ID NO: 72297 - DNA, 15 bp, Homo sapiens
tcaacaatgaccacc

SEQ ID NO: 72298 - DNA, 15 bp, Homo sapiens
atcaacaatgaccac

SEQ ID NO: 72299 - DNA, 15 bp, Homo sapiens
catcaacaatgacca

SEQ ID NO: 72300 - DNA, 15 bp, Homo sapiens
tcatcaacaatgacc

SEQ ID NO: 72301 - DNA, 15 bp, Homo sapiens
ttcatcaacaatgac

SEQ ID NO: 72302 - DNA, 15 bp, Homo sapiens
tttcatcaacaatga

SEQ ID NO: 72303 - DNA, 15 bp, Homo sapiens
ttttcatcaacaatg

SEQ ID NO: 72304 - DNA, 15 bp, Homo sapiens
gttttcatcaacaat

SEQ ID NO: 72305 - DNA, 15 bp, Homo sapiens
tgttttcatcaacaa

SEQ ID NO: 72306 - DNA, 15 bp, Homo sapiens
ctgttttcatcaaca

SEQ ID NO: 72307 - DNA, 15 bp, Homo sapiens
actgttttcatcaac

SEQ ID NO: 72308 - DNA, 15 bp, Homo sapiens
cactgttttcatcaa

SEQ ID NO: 72309 - DNA, 15 bp, Homo sapiens
ccactgttttcatca

SEQ ID NO: 72310 - DNA, 15 bp, Homo sapiens
accactgttttcatc

SEQ ID NO: 72311 - DNA, 15 bp, Homo sapiens
caccactgttttcat

SEQ ID NO: 72312 - DNA, 15 bp, Homo sapiens
tcaccactgttttca

SEQ ID NO: 72313 - DNA, 15 bp, Homo sapiens
ctcaccactgttttc

SEQ ID NO: 72314 - DNA, 15 bp, Homo sapiens
tctcaccactgtttt

SEQ ID NO: 72315 - DNA, 15 bp, Homo sapiens
ctctcaccactgttt

SEQ ID NO: 72316 - DNA, 15 bp, Homo sapiens
actctcaccactgtt

SEQ ID NO: 72317 - DNA, 15 bp, Homo sapiens
cactctcaccactgt

SEQ ID NO: 72318 - DNA, 15 bp, Homo sapiens
gcactctcaccactg

SEQ ID NO: 72319 - DNA, 15 bp, Homo sapiens
agcactctcaccact

SEQ ID NO: 72320 - DNA, 15 bp, Homo sapiens
tagcactctcaccac

SEQ ID NO: 72321 - DNA, 15 bp, Homo sapiens
gtagcactctcacca

SEQ ID NO: 72322 - DNA, 15 bp, Homo sapiens
tgtagcactctcacc

SEQ ID NO: 72323 - DNA, 15 bp, Homo sapiens
ctgtagcactctcac

SEQ ID NO: 72324 - DNA, 15 bp, Homo sapiens
gctgtagcactctca

SEQ ID NO: 72325 - DNA, 15 bp, Homo sapiens
agctgtagcactctc

SEQ ID NO: 72326 - DNA, 15 bp, Homo sapiens
tagctgtagcactct

SEQ ID NO: 72327 - DNA, 15 bp, Homo sapiens
atagctgtagcactc

SEQ ID NO: 72328 - DNA, 15 bp, Homo sapiens
gatagctgtagcact

SEQ ID NO: 72329 - DNA, 15 bp, Homo sapiens
ggatagctgtagcac

SEQ ID NO: 72330 - DNA, 15 bp, Homo sapiens
aggatagctgtagca

SEQ ID NO: 72331 - DNA, 15 bp, Homo sapiens
taggatagctgtagc

SEQ ID NO: 72332 - DNA, 15 bp, Homo sapiens
ctaggatagctgtag

SEQ ID NO: 72333 - DNA, 15 bp, Homo sapiens
tctaggatagctgta

SEQ ID NO: 72334 - DNA, 15 bp, Homo sapiens
ttctaggatagctgt

SEQ ID NO: 72335 - DNA, 15 bp, Homo sapiens
cttctaggatagctg

SEQ ID NO: 72336 - DNA, 15 bp, Homo sapiens
tcttctaggatagct

SEQ ID NO: 72337 - DNA, 15 bp, Homo sapiens
gtcttctaggatagc

SEQ ID NO: 72338 - DNA, 15 bp, Homo sapiens
ggtcttctaggatag

SEQ ID NO: 72339 - DNA, 15 bp, Homo sapiens
tggtcttctaggata

SEQ ID NO: 72340 - DNA, 15 bp, Homo sapiens
ctggtcttctaggat

SEQ ID NO: 72341 - DNA, 15 bp, Homo sapiens
actggtcttctagga

SEQ ID NO: 72342 - DNA, 15 bp, Homo sapiens
aactggtcttctagg

SEQ ID NO: 72343 - DNA, 15 bp, Homo sapiens
taactggtcttctag

SEQ ID NO: 72344 - DNA, 15 bp, Homo sapiens
gtaactggtcttcta

SEQ ID NO: 72345 - DNA, 15 bp, Homo sapiens
tgtaactggtcttct

SEQ ID NO: 72346 - DNA, 15 bp, Homo sapiens
ctgtaactggtcttc

SEQ ID NO: 72347 - DNA, 15 bp, Homo sapiens
cctgtaactggtctt

SEQ ID NO: 72348 - DNA, 15 bp, Homo sapiens
acctgtaactggtct

SEQ ID NO: 72349 - DNA, 15 bp, Homo sapiens
tacctgtaactggtc

SEQ ID NO: 72350 - DNA, 15 bp, Homo sapiens
ttacctgtaactggt

SEQ ID NO: 72351 - DNA, 15 bp, Homo sapiens
cttacctgtaactgg

SEQ ID NO: 72352 - DNA, 15 bp, Homo sapiens
tcttacctgtaactg

SEQ ID NO: 72353 - DNA, 15 bp, Homo sapiens
ctcttacctgtaact

SEQ ID NO: 72354 - DNA, 15 bp, Homo sapiens
actcttacctgtaac

SEQ ID NO: 72355 - DNA, 15 bp, Homo sapiens
cactcttacctgtaa

SEQ ID NO: 72356 - DNA, 15 bp, Homo sapiens
gcactcttacctgta

SEQ ID NO: 72357 - DNA, 15 bp, Homo sapiens
agcactcttacctgt

SEQ ID NO: 72358 - DNA, 15 bp, Homo sapiens
cagcactcttacctg

SEQ ID NO: 72359 - DNA, 15 bp, Homo sapiens
acagcactcttacct

SEQ ID NO: 72360 - DNA, 15 bp, Homo sapiens
tacagcactcttacc

SEQ ID NO: 72361 - DNA, 15 bp, Homo sapiens
ttacagcactcttac

SEQ ID NO: 72362 - DNA, 15 bp, Homo sapiens
tttacagcactctta

SEQ ID NO: 72363 - DNA, 15 bp, Homo sapiens
ctttacagcactctt

SEQ ID NO: 72364 - DNA, 15 bp, Homo sapiens
actttacagcactct

SEQ ID NO: 72365 - DNA, 15 bp, Homo sapiens
aactttacagcactc

SEQ ID NO: 72366 - DNA, 15 bp, Homo sapiens
caactttacagcact

SEQ ID NO: 72367 - DNA, 15 bp, Homo sapiens
ccaactttacagcac

SEQ ID NO: 72368 - DNA, 15 bp, Homo sapiens
tccaactttacagca

SEQ ID NO: 72369 - DNA, 15 bp, Homo sapiens
atccaactttacagc

SEQ ID NO: 72370 - DNA, 15 bp, Homo sapiens
tatccaactttacag

SEQ ID NO: 72371 - DNA, 15 bp, Homo sapiens
ttatccaactttaca

SEQ ID NO: 72372 - DNA, 15 bp, Homo sapiens
attatccaactttac

SEQ ID NO: 72373 - DNA, 15 bp, Homo sapiens
gattatccaacttta

SEQ ID NO: 72374 - DNA, 15 bp, Homo sapiens
ggattatccaacttt

SEQ ID NO: 72375 - DNA, 15 bp, Homo sapiens
aggattatccaactt

SEQ ID NO: 72376 - DNA, 15 bp, Homo sapiens
caggattatccaact

SEQ ID NO: 72377 - DNA, 15 bp, Homo sapiens
tcaggattatccaac

SEQ ID NO: 72378 - DNA, 15 bp, Homo sapiens
ctcaggattatccaa

SEQ ID NO: 72379 - DNA, 15 bp, Homo sapiens
cctcaggattatcca

SEQ ID NO: 72380 - DNA, 15 bp, Homo sapiens
ccctcaggattatcc

SEQ ID NO: 72381 - DNA, 15 bp, Homo sapiens
tccctcaggattatc

SEQ ID NO: 72382 - DNA, 15 bp, Homo sapiens
gtccctcaggattat

SEQ ID NO: 72383 - DNA, 15 bp, Homo sapiens
ggtccctcaggatta

SEQ ID NO: 72384 - DNA, 15 bp, Homo sapiens
aggtccctcaggatt

SEQ ID NO: 72385 - DNA, 15 bp, Homo sapiens
caggtccctcaggat

SEQ ID NO: 72386 - DNA, 15 bp, Homo sapiens
acaggtccctcagga

SEQ ID NO: 72387 - DNA, 15 bp, Homo sapiens
cacaggtccctcagg

SEQ ID NO: 72388 - DNA, 15 bp, Homo sapiens
ccacaggtccctcag

SEQ ID NO: 72389 - DNA, 15 bp, Homo sapiens
accacaggtccctca

SEQ ID NO: 72390 - DNA, 15 bp, Homo sapiens
gaccacaggtccctc

SEQ ID NO: 72391 - DNA, 15 bp, Homo sapiens
agaccacaggtccct

SEQ ID NO: 72392 - DNA, 15 bp, Homo sapiens
cagaccacaggtccc

SEQ ID NO: 72393 - DNA, 15 bp, Homo sapiens
tcagaccacaggtcc

SEQ ID NO: 72394 - DNA, 15 bp, Homo sapiens
ctcagaccacaggtc

SEQ ID NO: 72395 - DNA, 15 bp, Homo sapiens
tctcagaccacaggt

SEQ ID NO: 72396 - DNA, 15 bp, Homo sapiens
gtctcagaccacagg

SEQ ID NO: 72397 - DNA, 15 bp, Homo sapiens
ggtctcagaccacag

SEQ ID NO: 72398 - DNA, 15 bp, Homo sapiens
gggtctcagaccaca

SEQ ID NO: 72399 - DNA, 15 bp, Homo sapiens
tgggtctcagaccac

SEQ ID NO: 72400 - DNA, 15 bp, Homo sapiens
ttgggtctcagacca

SEQ ID NO: 72401 - DNA, 15 bp, Homo sapiens
attgggtctcagacc

SEQ ID NO: 72402 - DNA, 15 bp, Homo sapiens
aattgggtctcagac

SEQ ID NO: 72403 - DNA, 15 bp, Homo sapiens
taattgggtctcaga

SEQ ID NO: 72404 - DNA, 15 bp, Homo sapiens
gtaattgggtctcag

SEQ ID NO: 72405 - DNA, 15 bp, Homo sapiens
tgtaattgggtctca

SEQ ID NO: 72406 - DNA, 15 bp, Homo sapiens
atgtaattgggtctc

SEQ ID NO: 72407 - DNA, 15 bp, Homo sapiens
tatgtaattgggtct

SEQ ID NO: 72408 - DNA, 15 bp, Homo sapiens
atatgtaattgggtc

SEQ ID NO: 72409 - DNA, 15 bp, Homo sapiens
aatatgtaattgggt

SEQ ID NO: 72410 - DNA, 15 bp, Homo sapiens
caatatgtaattggg

SEQ ID NO: 72411 - DNA, 15 bp, Homo sapiens
gcaatatgtaattgg

SEQ ID NO: 72412 - DNA, 15 bp, Homo sapiens
ggcaatatgtaattg

SEQ ID NO: 72413 - DNA, 15 bp, Homo sapiens
gggcaatatgtaatt

SEQ ID NO: 72414 - DNA, 15 bp, Homo sapiens
agggcaatatgtaat

SEQ ID NO: 72415 - DNA, 15 bp, Homo sapiens
aagggcaatatgtaa

SEQ ID NO: 72416 - DNA, 15 bp, Homo sapiens
caagggcaatatgta

SEQ ID NO: 72417 - DNA, 15 bp, Homo sapiens
acaagggcaatatgt

SEQ ID NO: 72418 - DNA, 15 bp, Homo sapiens
aacaagggcaatatg

SEQ ID NO: 72419 - DNA, 15 bp, Homo sapiens
gaacaagggcaatat

SEQ ID NO: 72420 - DNA, 15 bp, Homo sapiens
agaacaagggcaata

SEQ ID NO: 72421 - DNA, 15 bp, Homo sapiens
aagaacaagggcaat

SEQ ID NO: 72422 - DNA, 15 bp, Homo sapiens
gaagaacaagggcaa

SEQ ID NO: 72423 - DNA, 15 bp, Homo sapiens
tgaagaacaagggca

SEQ ID NO: 72424 - DNA, 15 bp, Homo sapiens
atgaagaacaagggc

SEQ ID NO: 72425 - DNA, 15 bp, Homo sapiens
catgaagaacaaggg

SEQ ID NO: 72426 - DNA, 15 bp, Homo sapiens
acatgaagaacaagg

SEQ ID NO: 72427 - DNA, 15 bp, Homo sapiens
gacatgaagaacaag

SEQ ID NO: 72428 - DNA, 15 bp, Homo sapiens
ggacatgaagaacaa

SEQ ID NO: 72429 - DNA, 15 bp, Homo sapiens
aggacatgaagaaca

SEQ ID NO: 72430 - DNA, 15 bp, Homo sapiens
aaggacatgaagaac

SEQ ID NO: 72431 - DNA, 15 bp, Homo sapiens
aaaggacatgaagaa

SEQ ID NO: 72432 - DNA, 15 bp, Homo sapiens
gaaaggacatgaaga

SEQ ID NO: 72433 - DNA, 15 bp, Homo sapiens
agaaaggacatgaag

SEQ ID NO: 72434 - DNA, 15 bp, Homo sapiens
gagaaaggacatgaa

SEQ ID NO: 72435 - DNA, 15 bp, Homo sapiens
tgagaaaggacatga

SEQ ID NO: 72436 - DNA, 15 bp, Homo sapiens
atgagaaaggacatg

SEQ ID NO: 72437 - DNA, 15 bp, Homo sapiens
aatgagaaaggacat

SEQ ID NO: 72438 - DNA, 15 bp, Homo sapiens
gaatgagaaaggaca

SEQ ID NO: 72439 - DNA, 15 bp, Homo sapiens
agaatgagaaaggac

SEQ ID NO: 72440 - DNA, 15 bp, Homo sapiens
aagaatgagaaagga

SEQ ID NO: 72441 - DNA, 15 bp, Homo sapiens
aaagaatgagaaagg

SEQ ID NO: 72442 - DNA, 15 bp, Homo sapiens
taaagaatgagaaag

SEQ ID NO: 72443 - DNA, 15 bp, Homo sapiens
ataaagaatgagaaa

SEQ ID NO: 72444 - DNA, 15 bp, Homo sapiens
gataaagaatgagaa

SEQ ID NO: 72445 - DNA, 15 bp, Homo sapiens
ggataaagaatgaga

SEQ ID NO: 72446 - DNA, 15 bp, Homo sapiens
tggataaagaatgag

SEQ ID NO: 72447 - DNA, 15 bp, Homo sapiens
ctggataaagaatga

SEQ ID NO: 72448 - DNA, 15 bp, Homo sapiens
tctggataaagaatg

SEQ ID NO: 72449 - DNA, 15 bp, Homo sapiens
ttctggataaagaat

SEQ ID NO: 72450 - DNA, 15 bp, Homo sapiens
cttctggataaagaa

SEQ ID NO: 72451 - DNA, 15 bp, Homo sapiens
ccttctggataaaga

SEQ ID NO: 72452 - DNA, 15 bp, Homo sapiens
cccttctggataaag

SEQ ID NO: 72453 - DNA, 15 bp, Homo sapiens
acccttctggataaa

SEQ ID NO: 72454 - DNA, 15 bp, Homo sapiens
tacccttctggataa

SEQ ID NO: 72455 - DNA, 15 bp, Homo sapiens
ctacccttctggata

SEQ ID NO: 72456 - DNA, 15 bp, Homo sapiens
tctacccttctggat

SEQ ID NO: 72457 - DNA, 15 bp, Homo sapiens
ttctacccttctgga

SEQ ID NO: 72458 - DNA, 15 bp, Homo sapiens
tttctacccttctgg

SEQ ID NO: 72459 - DNA, 15 bp, Homo sapiens
ttttctacccttctg

SEQ ID NO: 72460 - DNA, 15 bp, Homo sapiens
tttttctacccttct

SEQ ID NO: 72461 - DNA, 15 bp, Homo sapiens
gtttttctacccttc

SEQ ID NO: 72462 - DNA, 15 bp, Homo sapiens
ggtttttctaccctt

SEQ ID NO: 72463 - DNA, 15 bp, Homo sapiens
aggtttttctaccct

SEQ ID NO: 72464 - DNA, 15 bp, Homo sapiens
taggtttttctaccc

SEQ ID NO: 72465 - DNA, 15 bp, Homo sapiens
gtaggtttttctacc

SEQ ID NO: 72466 - DNA, 15 bp, Homo sapiens
ggtaggtttttctac

SEQ ID NO: 72467 - DNA, 15 bp, Homo sapiens
aggtaggtttttcta

SEQ ID NO: 72468 - DNA, 15 bp, Homo sapiens
aaggtaggtttttct

SEQ ID NO: 72469 - DNA, 15 bp, Homo sapiens
aaaggtaggtttttc

SEQ ID NO: 72470 - DNA, 15 bp, Homo sapiens
caaaggtaggttttt

SEQ ID NO: 72471 - DNA, 15 bp, Homo sapiens
tcaaaggtaggtttt

SEQ ID NO: 72472 - DNA, 15 bp, Homo sapiens
atcaaaggtaggttt

SEQ ID NO: 72473 - DNA, 15 bp, Homo sapiens
aatcaaaggtaggtt

SEQ ID NO: 72474 - DNA, 15 bp, Homo sapiens
caatcaaaggtaggt

SEQ ID NO: 72475 - DNA, 15 bp, Homo sapiens
acaatcaaaggtagg

SEQ ID NO: 72476 - DNA, 15 bp, Homo sapiens
tacaatcaaaggtag

SEQ ID NO: 72477 - DNA, 15 bp, Homo sapiens
gtacaatcaaaggta

SEQ ID NO: 72478 - DNA, 15 bp, Homo sapiens
agtacaatcaaaggt

SEQ ID NO: 72479 - DNA, 15 bp, Homo sapiens
aagtacaatcaaagg

SEQ ID NO: 72480 - DNA, 15 bp, Homo sapiens
gaagtacaatcaaag

SEQ ID NO: 72481 - DNA, 15 bp, Homo sapiens
agaagtacaatcaaa

SEQ ID NO: 72482 - DNA, 15 bp, Homo sapiens
gagaagtacaatcaa

SEQ ID NO: 72483 - DNA, 15 bp, Homo sapiens
tgagaagtacaatca

SEQ ID NO: 72484 - DNA, 15 bp, Homo sapiens
ctgagaagtacaatc

SEQ ID NO: 72485 - DNA, 15 bp, Homo sapiens
actgagaagtacaat

SEQ ID NO: 72486 - DNA, 15 bp, Homo sapiens
aactgagaagtacaa

SEQ ID NO: 72487 - DNA, 15 bp, Homo sapiens
caactgagaagtaca

SEQ ID NO: 72488 - DNA, 15 bp, Homo sapiens
ccaactgagaagtac

SEQ ID NO: 72489 - DNA, 15 bp, Homo sapiens
cccaactgagaagta

SEQ ID NO: 72490 - DNA, 15 bp, Homo sapiens
ccccaactgagaagt

SEQ ID NO: 72491 - DNA, 15 bp, Homo sapiens
accccaactgagaag

SEQ ID NO: 72492 - DNA, 15 bp, Homo sapiens
aaccccaactgagaa

SEQ ID NO: 72493 - DNA, 15 bp, Homo sapiens
gaaccccaactgaga

SEQ ID NO: 72494 - DNA, 15 bp, Homo sapiens
agaaccccaactgag

SEQ ID NO: 72495 - DNA, 15 bp, Homo sapiens
tagaaccccaactga

SEQ ID NO: 72496 - DNA, 15 bp, Homo sapiens
gtagaaccccaactg

SEQ ID NO: 72497 - DNA, 15 bp, Homo sapiens
tgtagaaccccaact

SEQ ID NO: 72498 - DNA, 15 bp, Homo sapiens
ctgtagaaccccaac

SEQ ID NO: 72499 - DNA, 15 bp, Homo sapiens
actgtagaaccccaa

SEQ ID NO: 72500 - DNA, 15 bp, Homo sapiens
cactgtagaacccca

SEQ ID NO: 72501 - DNA, 15 bp, Homo sapiens
acactgtagaacccc

SEQ ID NO: 72502 - DNA, 15 bp, Homo sapiens
cacactgtagaaccc

SEQ ID NO: 72503 - DNA, 15 bp, Homo sapiens
acacactgtagaacc

SEQ ID NO: 72504 - DNA, 15 bp, Homo sapiens
cacacactgtagaac

SEQ ID NO: 72505 - DNA, 15 bp, Homo sapiens
ccacacactgtagaa

SEQ ID NO: 72506 - DNA, 15 bp, Homo sapiens
cccacacactgtaga

SEQ ID NO: 72507 - DNA, 15 bp, Homo sapiens
gcccacacactgtag

SEQ ID NO: 72508 - DNA, 15 bp, Homo sapiens
agcccacacactgta

SEQ ID NO: 72509 - DNA, 15 bp, Homo sapiens
tagcccacacactgt

SEQ ID NO: 72510 - DNA, 15 bp, Homo sapiens
gtagcccacacactg

SEQ ID NO: 72511 - DNA, 15 bp, Homo sapiens
tgtagcccacacact

SEQ ID NO: 72512 - DNA, 15 bp, Homo sapiens
ctgtagcccacacac

SEQ ID NO: 72513 - DNA, 15 bp, Homo sapiens
cctgtagcccacaca

SEQ ID NO: 72514 - DNA, 15 bp, Homo sapiens
tcctgtagcccacac

SEQ ID NO: 72515 - DNA, 15 bp, Homo sapiens
ctcctgtagcccaca

SEQ ID NO: 72516 - DNA, 15 bp, Homo sapiens
actcctgtagcccac

SEQ ID NO: 72517 - DNA, 15 bp, Homo sapiens
tactcctgtagccca

SEQ ID NO: 72518 - DNA, 15 bp, Homo sapiens
gtactcctgtagccc

SEQ ID NO: 72519 - DNA, 15 bp, Homo sapiens
ggtactcctgtagcc

SEQ ID NO: 72520 - DNA, 15 bp, Homo sapiens
gggtactcctgtagc

SEQ ID NO: 72521 - DNA, 15 bp, Homo sapiens
tgggtactcctgtag

SEQ ID NO: 72522 - DNA, 15 bp, Homo sapiens
ctgggtactcctgta

SEQ ID NO: 72523 - DNA, 15 bp, Homo sapiens
cctgggtactcctgt

SEQ ID NO: 72524 - DNA, 15 bp, Homo sapiens
acctgggtactcctg

SEQ ID NO: 72525 - DNA, 15 bp, Homo sapiens
tacctgggtactcct

SEQ ID NO: 72526 - DNA, 15 bp, Homo sapiens
atacctgggtactcc

SEQ ID NO: 72527 - DNA, 15 bp, Homo sapiens
aatacctgggtactc

SEQ ID NO: 72528 - DNA, 15 bp, Homo sapiens
caatacctgggtact

SEQ ID NO: 72529 - DNA, 15 bp, Homo sapiens
tcaatacctgggtac

SEQ ID NO: 72530 - DNA, 15 bp, Homo sapiens
atcaatacctgggta

SEQ ID NO: 72531 - DNA, 15 bp, Homo sapiens
aatcaatacctgggt

SEQ ID NO: 72532 - DNA, 15 bp, Homo sapiens
gaatcaatacctggg

SEQ ID NO: 72533 - DNA, 15 bp, Homo sapiens
ggaatcaatacctgg

SEQ ID NO: 72534 - DNA, 15 bp, Homo sapiens
aggaatcaatacctg

SEQ ID NO: 72535 - DNA, 15 bp, Homo sapiens
aaggaatcaatacct

SEQ ID NO: 72536 - DNA, 15 bp, Homo sapiens
aaaggaatcaatacc

SEQ ID NO: 72537 - DNA, 15 bp, Homo sapiens
taaaggaatcaatac

SEQ ID NO: 72538 - DNA, 15 bp, Homo sapiens
gtaaaggaatcaata

SEQ ID NO: 72539 - DNA, 15 bp, Homo sapiens
agtaaaggaatcaat

SEQ ID NO: 72540 - DNA, 15 bp, Homo sapiens
aagtaaaggaatcaa

SEQ ID NO: 72541 - DNA, 15 bp, Homo sapiens
gaagtaaaggaatca

SEQ ID NO: 72542 - DNA, 15 bp, Homo sapiens
tgaagtaaaggaatc

SEQ ID NO: 72543 - DNA, 15 bp, Homo sapiens
ctgaagtaaaggaat

SEQ ID NO: 72544 - DNA, 15 bp, Homo sapiens
gctgaagtaaaggaa

SEQ ID NO: 72545 - DNA, 15 bp, Homo sapiens
agctgaagtaaagga

SEQ ID NO: 72546 - DNA, 15 bp, Homo sapiens
gagctgaagtaaagg

SEQ ID NO: 72547 - DNA, 15 bp, Homo sapiens
agagctgaagtaaag

SEQ ID NO: 72548 - DNA, 15 bp, Homo sapiens
aagagctgaagtaaa

SEQ ID NO: 72549 - DNA, 15 bp, Homo sapiens
caagagctgaagtaa

SEQ ID NO: 72550 - DNA, 15 bp, Homo sapiens
ccaagagctgaagta

SEQ ID NO: 72551 - DNA, 15 bp, Homo sapiens
cccaagagctgaagt

SEQ ID NO: 72552 - DNA, 15 bp, Homo sapiens
ccccaagagctgaag

SEQ ID NO: 72553 - DNA, 15 bp, Homo sapiens
accccaagagctgaa

SEQ ID NO: 72554 - DNA, 15 bp, Homo sapiens
caccccaagagctga

SEQ ID NO: 72555 - DNA, 15 bp, Homo sapiens
tcaccccaagagctg

SEQ ID NO: 72556 - DNA, 15 bp, Homo sapiens
ttcaccccaagagct

SEQ ID NO: 72557 - DNA, 15 bp, Homo sapiens
attcaccccaagagc

SEQ ID NO: 72558 - DNA, 15 bp, Homo sapiens
cattcaccccaagag

SEQ ID NO: 72559 - DNA, 15 bp, Homo sapiens
ccattcaccccaaga

SEQ ID NO: 72560 - DNA, 15 bp, Homo sapiens
tccattcaccccaag

SEQ ID NO: 72561 - DNA, 15 bp, Homo sapiens
atccattcaccccaa

SEQ ID NO: 72562 - DNA, 15 bp, Homo sapiens
catccattcacccca

SEQ ID NO: 72563 - DNA, 15 bp, Homo sapiens
ccatccattcacccc

SEQ ID NO: 72564 - DNA, 15 bp, Homo sapiens
cccatccattcaccc

SEQ ID NO: 72565 - DNA, 15 bp, Homo sapiens
ccccatccattcacc

SEQ ID NO: 72566 - DNA, 15 bp, Homo sapiens
gccccatccattcac

SEQ ID NO: 72567 - DNA, 15 bp, Homo sapiens
agccccatccattca

SEQ ID NO: 72568 - DNA, 15 bp, Homo sapiens
cagccccatccattc

SEQ ID NO: 72569 - DNA, 15 bp, Homo sapiens
ccagccccatccatt

SEQ ID NO: 72570 - DNA, 15 bp, Homo sapiens
accagccccatccat

SEQ ID NO: 72571 - DNA, 15 bp, Homo sapiens
aaccagccccatcca

SEQ ID NO: 72572 - DNA, 15 bp, Homo sapiens
caaccagccccatcc

SEQ ID NO: 72573 - DNA, 15 bp, Homo sapiens
gcaaccagccccatc

SEQ ID NO: 72574 - DNA, 15 bp, Homo sapiens
tgcaaccagccccat

SEQ ID NO: 72575 - DNA, 15 bp, Homo sapiens
ctgcaaccagcccca

SEQ ID NO: 72576 - DNA, 15 bp, Homo sapiens
actgcaaccagcccc

SEQ ID NO: 72577 - DNA, 15 bp, Homo sapiens
gactgcaaccagccc

SEQ ID NO: 72578 - DNA, 15 bp, Homo sapiens
ggactgcaaccagcc

SEQ ID NO: 72579 - DNA, 15 bp, Homo sapiens
gggactgcaaccagc

SEQ ID NO: 72580 - DNA, 15 bp, Homo sapiens
ggggactgcaaccag

SEQ ID NO: 72581 - DNA, 15 bp, Homo sapiens
tggggactgcaacca

SEQ ID NO: 72582 - DNA, 15 bp, Homo sapiens
ctggggactgcaacc

SEQ ID NO: 72583 - DNA, 15 bp, Homo sapiens
gctggggactgcaac

SEQ ID NO: 72584 - DNA, 15 bp, Homo sapiens
agctggggactgcaa

SEQ ID NO: 72585 - DNA, 15 bp, Homo sapiens
aagctggggactgca

SEQ ID NO: 72586 - DNA, 15 bp, Homo sapiens
gaagctggggactgc

SEQ ID NO: 72587 - DNA, 15 bp, Homo sapiens
ggaagctggggactg

SEQ ID NO: 72588 - DNA, 15 bp, Homo sapiens
aggaagctggggact

SEQ ID NO: 72589 - DNA, 15 bp, Homo sapiens
aaggaagctggggac

SEQ ID NO: 72590 - DNA, 15 bp, Homo sapiens
caaggaagctgggga

SEQ ID NO: 72591 - DNA, 15 bp, Homo sapiens
acaaggaagctgggg

SEQ ID NO: 72592 - DNA, 15 bp, Homo sapiens
cacaaggaagctggg

SEQ ID NO: 72593 - DNA, 15 bp, Homo sapiens
gcacaaggaagctgg

SEQ ID NO: 72594 - DNA, 15 bp, Homo sapiens
tgcacaaggaagctg

SEQ ID NO: 72595 - DNA, 15 bp, Homo sapiens
atgcacaaggaagct

SEQ ID NO: 72596 - DNA, 15 bp, Homo sapiens
tatgcacaaggaagc

SEQ ID NO: 72597 - DNA, 15 bp, Homo sapiens
ttatgcacaaggaag

SEQ ID NO: 72598 - DNA, 15 bp, Homo sapiens
attatgcacaaggaa

SEQ ID NO: 72599 - DNA, 15 bp, Homo sapiens
cattatgcacaagga

SEQ ID NO: 72600 - DNA, 15 bp, Homo sapiens
tcattatgcacaagg

SEQ ID NO: 72601 - DNA, 15 bp, Homo sapiens
gtcattatgcacaag

SEQ ID NO: 72602 - DNA, 15 bp, Homo sapiens
tgtcattatgcacaa

SEQ ID NO: 72603 - DNA, 15 bp, Homo sapiens
ttgtcattatgcaca

SEQ ID NO: 72604 - DNA, 15 bp, Homo sapiens
cttgtcattatgcac

SEQ ID NO: 72605 - DNA, 15 bp, Homo sapiens
tcttgtcattatgca

SEQ ID NO: 72606 - DNA, 15 bp, Homo sapiens
atcttgtcattatgc

SEQ ID NO: 72607 - DNA, 15 bp, Homo sapiens
aatcttgtcattatg

SEQ ID NO: 72608 - DNA, 15 bp, Homo sapiens
aaatcttgtcattat

SEQ ID NO: 72609 - DNA, 15 bp, Homo sapiens
caaatcttgtcatta

SEQ ID NO: 72610 - DNA, 15 bp, Homo sapiens
ccaaatcttgtcatt

SEQ ID NO: 72611 - DNA, 15 bp, Homo sapiens
tccaaatcttgtcat

SEQ ID NO: 72612 - DNA, 15 bp, Homo sapiens
ttccaaatcttgtca

SEQ ID NO: 72613 - DNA, 15 bp, Homo sapiens
cttccaaatcttgtc

SEQ ID NO: 72614 - DNA, 15 bp, Homo sapiens
gcttccaaatcttgt

SEQ ID NO: 72615 - DNA, 15 bp, Homo sapiens
gtgcttccaaatctt

SEQ ID NO: 72616 - DNA, 15 bp, Homo sapiens
tgtgcttccaaatct

SEQ ID NO: 72617 - DNA, 15 bp, Homo sapiens
ctgtgcttccaaatc

SEQ ID NO: 72618 - DNA, 15 bp, Homo sapiens
actgtgcttccaaat

SEQ ID NO: 72619 - DNA, 15 bp, Homo sapiens
cactgtgcttccaaa

SEQ ID NO: 72620 - DNA, 15 bp, Homo sapiens
acactgtgcttccaa

SEQ ID NO: 72621 - DNA, 15 bp, Homo sapiens
tacactgtgcttcca

SEQ ID NO: 72622 - DNA, 15 bp, Homo sapiens
atacactgtgcttcc

SEQ ID NO: 72623 - DNA, 15 bp, Homo sapiens
aatacactgtgcttc

SEQ ID NO: 72624 - DNA, 15 bp, Homo sapiens
taatacactgtgctt

SEQ ID NO: 72625 - DNA, 15 bp, Homo sapiens
ctaatacactgtgct

SEQ ID NO: 72626 - DNA, 15 bp, Homo sapiens
actaatacactgtgc

SEQ ID NO: 72627 - DNA, 15 bp, Homo sapiens
gactaatacactgtg

SEQ ID NO: 72628 - DNA, 15 bp, Homo sapiens
ggactaatacactgt

SEQ ID NO: 72629 - DNA, 15 bp, Homo sapiens
cggactaatacactg

SEQ ID NO: 72630 - DNA, 15 bp, Homo sapiens
acggactaatacact

SEQ ID NO: 72631 - DNA, 15 bp, Homo sapiens
aacggactaatacac

SEQ ID NO: 72632 - DNA, 15 bp, Homo sapiens
aaacggactaataca

SEQ ID NO: 72633 - DNA, 15 bp, Homo sapiens
aaaacggactaatac

SEQ ID NO: 72634 - DNA, 15 bp, Homo sapiens
gaaaacggactaata

SEQ ID NO: 72635 - DNA, 15 bp, Homo sapiens
tgaaaacggactaat

SEQ ID NO: 72636 - DNA, 15 bp, Homo sapiens
gtgaaaacggactaa

SEQ ID NO: 72637 - DNA, 15 bp, Homo sapiens
tgtgaaaacggacta

SEQ ID NO: 72638 - DNA, 15 bp, Homo sapiens
gtgtgaaaacggact

SEQ ID NO: 72639 - DNA, 15 bp, Homo sapiens
agtgtgaaaacggac

SEQ ID NO: 72640 - DNA, 15 bp, Homo sapiens
cagtgtgaaaacgga

SEQ ID NO: 72641 - DNA, 15 bp, Homo sapiens
gcagtgtgaaaacgg

SEQ ID NO: 72642 - DNA, 15 bp, Homo sapiens
agcagtgtgaaaacg

SEQ ID NO: 72643 - DNA, 15 bp, Homo sapiens
cagcagtgtgaaaac

SEQ ID NO: 72644 - DNA, 15 bp, Homo sapiens
tcagcagtgtgaaaa

SEQ ID NO: 72645 - DNA, 15 bp, Homo sapiens
atcagcagtgtgaaa

SEQ ID NO: 72646 - DNA, 15 bp, Homo sapiens
tatcagcagtgtgaa

SEQ ID NO: 72647 - DNA, 15 bp, Homo sapiens
ttatcagcagtgtga

SEQ ID NO: 72648 - DNA, 15 bp, Homo sapiens
tttatcagcagtgtg

SEQ ID NO: 72649 - DNA, 15 bp, Homo sapiens
ctttatcagcagtgt

SEQ ID NO: 72650 - DNA, 15 bp, Homo sapiens
tctttatcagcagtg

SEQ ID NO: 72651 - DNA, 15 bp, Homo sapiens
gtctttatcagcagt

SEQ ID NO: 72652 - DNA, 15 bp, Homo sapiens
tgtctttatcagcag

SEQ ID NO: 72653 - DNA, 15 bp, Homo sapiens
atgtctttatcagca

SEQ ID NO: 72654 - DNA, 15 bp, Homo sapiens
tatgtctttatcagc

SEQ ID NO: 72655 - DNA, 15 bp, Homo sapiens
gtatgtctttatcag

SEQ ID NO: 72656 - DNA, 15 bp, Homo sapiens
ggtatgtctttatca

SEQ ID NO: 72657 - DNA, 15 bp, Homo sapiens
aggtatgtctttatc

SEQ ID NO: 72658 - DNA, 15 bp, Homo sapiens
caggtatgtctttat

SEQ ID NO: 72659 - DNA, 15 bp, Homo sapiens
tcaggtatgtcttta

SEQ ID NO: 72660 - DNA, 15 bp, Homo sapiens
ctcaggtatgtcttt

SEQ ID NO: 72661 - DNA, 15 bp, Homo sapiens
tctcaggtatgtctt

SEQ ID NO: 72662 - DNA, 15 bp, Homo sapiens
gtctcaggtatgtct

SEQ ID NO: 72663 - DNA, 15 bp, Homo sapiens
agtctcaggtatgtc

SEQ ID NO: 72664 - DNA, 15 bp, Homo sapiens
cagtctcaggtatgt

SEQ ID NO: 72665 - DNA, 15 bp, Homo sapiens
ccagtctcaggtatg

SEQ ID NO: 72666 - DNA, 15 bp, Homo sapiens
cccagtctcaggtat

SEQ ID NO: 72667 - DNA, 15 bp, Homo sapiens
tcccagtctcaggta

SEQ ID NO: 72668 - DNA, 15 bp, Homo sapiens
ttcccagtctcaggt

SEQ ID NO: 72669 - DNA, 15 bp, Homo sapiens
cttcccagtctcagg

SEQ ID NO: 72670 - DNA, 15 bp, Homo sapiens
tcttcccagtctcag

SEQ ID NO: 72671 - DNA, 15 bp, Homo sapiens
ttcttcccagtctca

SEQ ID NO: 72672 - DNA, 15 bp, Homo sapiens
tttcttcccagtctc

SEQ ID NO: 72673 - DNA, 15 bp, Homo sapiens
ttttcttcccagtct

SEQ ID NO: 72674 - DNA, 15 bp, Homo sapiens
tttttcttcccagtc

SEQ ID NO: 72675 - DNA, 15 bp, Homo sapiens
ctttttcttcccagt

SEQ ID NO: 72676 - DNA, 15 bp, Homo sapiens
tctttttcttcccag

SEQ ID NO: 72677 - DNA, 15 bp, Homo sapiens
ctctttttcttccca

SEQ ID NO: 72678 - DNA, 15 bp, Homo sapiens
cctctttttcttccc

SEQ ID NO: 72679 - DNA, 15 bp, Homo sapiens
acctctttttcttcc

SEQ ID NO: 72680 - DNA, 15 bp, Homo sapiens
aacctctttttcttc

SEQ ID NO: 72681 - DNA, 15 bp, Homo sapiens
aaacctctttttctt

SEQ ID NO: 72682 - DNA, 15 bp, Homo sapiens
taaacctctttttct

SEQ ID NO: 72683 - DNA, 15 bp, Homo sapiens
ttaaacctctttttc

SEQ ID NO: 72684 - DNA, 15 bp, Homo sapiens
cttaaacctcttttt

SEQ ID NO: 72685 - DNA, 15 bp, Homo sapiens
ccttaaacctctttt

SEQ ID NO: 72686 - DNA, 15 bp, Homo sapiens
cccttaaacctcttt

SEQ ID NO: 72687 - DNA, 15 bp, Homo sapiens
tcccttaaacctctt

SEQ ID NO: 72688 - DNA, 15 bp, Homo sapiens
gtcccttaaacctct

SEQ ID NO: 72689 - DNA, 15 bp, Homo sapiens
agtcccttaaacctc

SEQ ID NO: 72690 - DNA, 15 bp, Homo sapiens
aagtcccttaaacct

SEQ ID NO: 72691 - DNA, 15 bp, Homo sapiens
taagtcccttaaacc

SEQ ID NO: 72692 - DNA, 15 bp, Homo sapiens
gtaagtcccttaaac

SEQ ID NO: 72693 - DNA, 15 bp, Homo sapiens
tgtaagtcccttaaa

SEQ ID NO: 72694 - DNA, 15 bp, Homo sapiens
ctgtaagtcccttaa

SEQ ID NO: 72695 - DNA, 15 bp, Homo sapiens
actgtaagtccctta

SEQ ID NO: 72696 - DNA, 15 bp, Homo sapiens
aactgtaagtccctt

SEQ ID NO: 72697 - DNA, 15 bp, Homo sapiens
gaactgtaagtccct

SEQ ID NO: 72698 - DNA, 15 bp, Homo sapiens
ggaactgtaagtccc

SEQ ID NO: 72699 - DNA, 15 bp, Homo sapiens
tggaactgtaagtcc

SEQ ID NO: 72700 - DNA, 15 bp, Homo sapiens
atggaactgtaagtc

SEQ ID NO: 72701 - DNA, 15 bp, Homo sapiens
catggaactgtaagt

SEQ ID NO: 72702 - DNA, 15 bp, Homo sapiens
acatggaactgtaag

SEQ ID NO: 72703 - DNA, 15 bp, Homo sapiens
cacatggaactgtaa

SEQ ID NO: 72704 - DNA, 15 bp, Homo sapiens
ccacatggaactgta

SEQ ID NO: 72705 - DNA, 15 bp, Homo sapiens
gccacatggaactgt

SEQ ID NO: 72706 - DNA, 15 bp, Homo sapiens
agccacatggaactg

SEQ ID NO: 72707 - DNA, 15 bp, Homo sapiens
cagccacatggaact

SEQ ID NO: 72708 - DNA, 15 bp, Homo sapiens
ccagccacatggaac

SEQ ID NO: 72709 - DNA, 15 bp, Homo sapiens
cccagccacatggaa

SEQ ID NO: 72710 - DNA, 15 bp, Homo sapiens
ccccagccacatgga

SEQ ID NO: 72711 - DNA, 15 bp, Homo sapiens
tccccagccacatgg

SEQ ID NO: 72712 - DNA, 15 bp, Homo sapiens
ctccccagccacatg

SEQ ID NO: 72713 - DNA, 15 bp, Homo sapiens
tctccccagccacat

SEQ ID NO: 72714 - DNA, 15 bp, Homo sapiens
gtctccccagccaca

SEQ ID NO: 72715 - DNA, 15 bp, Homo sapiens
ggtctccccagccac

SEQ ID NO: 72716 - DNA, 15 bp, Homo sapiens
aggtctccccagcca

SEQ ID NO: 72717 - DNA, 15 bp, Homo sapiens
gaggtctccccagcc

SEQ ID NO: 72718 - DNA, 15 bp, Homo sapiens
tgaggtctccccagc

SEQ ID NO: 72719 - DNA, 15 bp, Homo sapiens
gtgaggtctccccag

SEQ ID NO: 72720 - DNA, 15 bp, Homo sapiens
tgtgaggtctcccca

SEQ ID NO: 72721 - DNA, 15 bp, Homo sapiens
ttgtgaggtctcccc

SEQ ID NO: 72722 - DNA, 15 bp, Homo sapiens
attgtgaggtctccc

SEQ ID NO: 72723 - DNA, 15 bp, Homo sapiens
gattgtgaggtctcc

SEQ ID NO: 72724 - DNA, 15 bp, Homo sapiens
tgattgtgaggtctc

SEQ ID NO: 72725 - DNA, 15 bp, Homo sapiens
atgattgtgaggtct

SEQ ID NO: 72726 - DNA, 15 bp, Homo sapiens
catgattgtgaggtc

SEQ ID NO: 72727 - DNA, 15 bp, Homo sapiens
ccatgattgtgaggt

SEQ ID NO: 72728 - DNA, 15 bp, Homo sapiens
accatgattgtgagg

SEQ ID NO: 72729 - DNA, 15 bp, Homo sapiens
caccatgattgtgag

SEQ ID NO: 72730 - DNA, 15 bp, Homo sapiens
ccaccatgattgtga

SEQ ID NO: 72731 - DNA, 15 bp, Homo sapiens
tccaccatgattgtg

SEQ ID NO: 72732 - DNA, 15 bp, Homo sapiens
ttccaccatgattgt

SEQ ID NO: 72733 - DNA, 15 bp, Homo sapiens
cttccaccatgattg

SEQ ID NO: 72734 - DNA, 15 bp, Homo sapiens
ccttccaccatgatt

SEQ ID NO: 72735 - DNA, 15 bp, Homo sapiens
cccttccaccatgat

SEQ ID NO: 72736 - DNA, 15 bp, Homo sapiens
tcccttccaccatga

SEQ ID NO: 72737 - DNA, 15 bp, Homo sapiens
ttcccttccaccatg

SEQ ID NO: 72738 - DNA, 15 bp, Homo sapiens
cttcccttccaccat

SEQ ID NO: 72739 - DNA, 15 bp, Homo sapiens
ccttcccttccacca

SEQ ID NO: 72740 - DNA, 15 bp, Homo sapiens
tccttcccttccacc

SEQ ID NO: 72741 - DNA, 15 bp, Homo sapiens
ctccttcccttccac

SEQ ID NO: 72742 - DNA, 15 bp, Homo sapiens
cctccttcccttcca

SEQ ID NO: 72743 - DNA, 15 bp, Homo sapiens
tcctccttcccttcc

SEQ ID NO: 72744 - DNA, 15 bp, Homo sapiens
ctcctccttcccttc

SEQ ID NO: 72745 - DNA, 15 bp, Homo sapiens
gctcctccttccctt

SEQ ID NO: 72746 - DNA, 15 bp, Homo sapiens
tgctcctccttccct

SEQ ID NO: 72747 - DNA, 15 bp, Homo sapiens
ttgctcctccttccc

SEQ ID NO: 72748 - DNA, 15 bp, Homo sapiens
cttgctcctccttcc

SEQ ID NO: 72749 - DNA, 15 bp, Homo sapiens
gcttgctcctccttc

SEQ ID NO: 72750 - DNA, 15 bp, Homo sapiens
ggcttgctcctcctt

SEQ ID NO: 72751 - DNA, 15 bp, Homo sapiens
tggcttgctcctcct

SEQ ID NO: 72752 - DNA, 15 bp, Homo sapiens
gtggcttgctcctcc

SEQ ID NO: 72753 - DNA, 15 bp, Homo sapiens
tgtggcttgctcctc

SEQ ID NO: 72754 - DNA, 15 bp, Homo sapiens
atgtggcttgctcct

SEQ ID NO: 72755 - DNA, 15 bp, Homo sapiens
aatgtggcttgctcc

SEQ ID NO: 72756 - DNA, 15 bp, Homo sapiens
aaatgtggcttgctc

SEQ ID NO: 72757 - DNA, 15 bp, Homo sapiens
aaaatgtggcttgct

SEQ ID NO: 72758 - DNA, 15 bp, Homo sapiens
taaaatgtggcttgc

SEQ ID NO: 72759 - DNA, 15 bp, Homo sapiens
ataaaatgtggcttg

SEQ ID NO: 72760 - DNA, 15 bp, Homo sapiens
tataaaatgtggctt

SEQ ID NO: 72761 - DNA, 15 bp, Homo sapiens
atataaaatgtggct

SEQ ID NO: 72762 - DNA, 15 bp, Homo sapiens
catataaaatgtggc

SEQ ID NO: 72763 - DNA, 15 bp, Homo sapiens
ccatataaaatgtgg

SEQ ID NO: 72764 - DNA, 15 bp, Homo sapiens
tccatataaaatgtg

SEQ ID NO: 72765 - DNA, 15 bp, Homo sapiens
atccatataaaatgt

SEQ ID NO: 72766 - DNA, 15 bp, Homo sapiens
catccatataaaatg

SEQ ID NO: 72767 - DNA, 15 bp, Homo sapiens
ccatccatataaaat

SEQ ID NO: 72768 - DNA, 15 bp, Homo sapiens
accatccatataaaa

SEQ ID NO: 72769 - DNA, 15 bp, Homo sapiens
caccatccatataaa

SEQ ID NO: 72770 - DNA, 15 bp, Homo sapiens
ccaccatccatataa

SEQ ID NO: 72771 - DNA, 15 bp, Homo sapiens
gccaccatccatata

SEQ ID NO: 72772 - DNA, 15 bp, Homo sapiens
tgccaccatccatat

SEQ ID NO: 72773 - DNA, 15 bp, Homo sapiens
ctgccaccatccata

SEQ ID NO: 72774 - DNA, 15 bp, Homo sapiens
cctgccaccatccat

SEQ ID NO: 72775 - DNA, 15 bp, Homo sapiens
gcctgccaccatcca

SEQ ID NO: 72776 - DNA, 15 bp, Homo sapiens
tgcctgccaccatcc

SEQ ID NO: 72777 - DNA, 15 bp, Homo sapiens
ttgcctgccaccatc

SEQ ID NO: 72778 - DNA, 15 bp, Homo sapiens
tttgcctgccaccat

SEQ ID NO: 72779 - DNA, 15 bp, Homo sapiens
ctttgcctgccacca

SEQ ID NO: 72780 - DNA, 15 bp, Homo sapiens
tctttgcctgccacc

SEQ ID NO: 72781 - DNA, 15 bp, Homo sapiens
ctctttgcctgccac

SEQ ID NO: 72782 - DNA, 15 bp, Homo sapiens
tctctttgcctgcca

SEQ ID NO: 72783 - DNA, 15 bp, Homo sapiens
ctctctttgcctgcc

SEQ ID NO: 72784 - DNA, 15 bp, Homo sapiens
cctctctttgcctgc

SEQ ID NO: 72785 - DNA, 15 bp, Homo sapiens
ccctctctttgcctg

SEQ ID NO: 72786 - DNA, 15 bp, Homo sapiens
tccctctctttgcct

SEQ ID NO: 72787 - DNA, 15 bp, Homo sapiens
ctccctctctttgcc

SEQ ID NO: 72788 - DNA, 15 bp, Homo sapiens
gctccctctctttgc

SEQ ID NO: 72789 - DNA, 15 bp, Homo sapiens
agctccctctctttg

SEQ ID NO: 72790 - DNA, 15 bp, Homo sapiens
aagctccctctcttt

SEQ ID NO: 72791 - DNA, 15 bp, Homo sapiens
caagctccctctctt

SEQ ID NO: 72792 - DNA, 15 bp, Homo sapiens
acaagctccctctct

SEQ ID NO: 72793 - DNA, 15 bp, Homo sapiens
cacaagctccctctc

SEQ ID NO: 72794 - DNA, 15 bp, Homo sapiens
gcacaagctccctct

SEQ ID NO: 72795 - DNA, 15 bp, Homo sapiens
tgcacaagctccctc

SEQ ID NO: 72796 - DNA, 15 bp, Homo sapiens
ctgcacaagctccct

SEQ ID NO: 72797 - DNA, 15 bp, Homo sapiens
cctgcacaagctccc

SEQ ID NO: 72798 - DNA, 15 bp, Homo sapiens
ccctgcacaagctcc

SEQ ID NO: 72799 - DNA, 15 bp, Homo sapiens
tccctgcacaagctc

SEQ ID NO: 72800 - DNA, 15 bp, Homo sapiens
ttccctgcacaagct

SEQ ID NO: 72801 - DNA, 15 bp, Homo sapiens
tttccctgcacaagc

SEQ ID NO: 72802 - DNA, 15 bp, Homo sapiens
gtttccctgcacaag

SEQ ID NO: 72803 - DNA, 15 bp, Homo sapiens
agtttccctgcacaa

SEQ ID NO: 72804 - DNA, 15 bp, Homo sapiens
gagtttccctgcaca

SEQ ID NO: 72805 - DNA, 15 bp, Homo sapiens
ggagtttccctgcac

SEQ ID NO: 72806 - DNA, 15 bp, Homo sapiens
aggagtttccctgca

SEQ ID NO: 72807 - DNA, 15 bp, Homo sapiens
aaggagtttccctgc

SEQ ID NO: 72808 - DNA, 15 bp, Homo sapiens
aaaggagtttccctg

SEQ ID NO: 72809 - DNA, 15 bp, Homo sapiens
aaaaggagtttccct

SEQ ID NO: 72810 - DNA, 15 bp, Homo sapiens
aaaaaggagtttccc

SEQ ID NO: 72811 - DNA, 15 bp, Homo sapiens
aaaaaaggagtttcc

SEQ ID NO: 72812 - DNA, 15 bp, Homo sapiens
aaaaaaaggagtttc

SEQ ID NO: 72813 - DNA, 15 bp, Homo sapiens
taaaaaaaggagttt

SEQ ID NO: 72814 - DNA, 15 bp, Homo sapiens
ttaaaaaaaggagtt

SEQ ID NO: 72815 - DNA, 15 bp, Homo sapiens
tttaaaaaaaggagt

SEQ ID NO: 72816 - DNA, 15 bp, Homo sapiens
ttttaaaaaaaggag

SEQ ID NO: 72817 - DNA, 15 bp, Homo sapiens
gttttaaaaaaagga

SEQ ID NO: 72818 - DNA, 15 bp, Homo sapiens
ggttttaaaaaaagg

SEQ ID NO: 72819 - DNA, 15 bp, Homo sapiens
tggttttaaaaaaag

SEQ ID NO: 72820 - DNA, 15 bp, Homo sapiens
atggttttaaaaaaa

SEQ ID NO: 72821 - DNA, 15 bp, Homo sapiens
gatggttttaaaaaa

SEQ ID NO: 72822 - DNA, 15 bp, Homo sapiens
tgatggttttaaaaa

SEQ ID NO: 72823 - DNA, 15 bp, Homo sapiens
ctgatggttttaaaa

SEQ ID NO: 72824 - DNA, 15 bp, Homo sapiens
tctgatggttttaaa

SEQ ID NO: 72825 - DNA, 15 bp, Homo sapiens
gtctgatggttttaa

SEQ ID NO: 72826 - DNA, 15 bp, Homo sapiens
ggtctgatggtttta

SEQ ID NO: 72827 - DNA, 15 bp, Homo sapiens
aggtctgatggtttt

SEQ ID NO: 72828 - DNA, 15 bp, Homo sapiens
gaggtctgatggttt

SEQ ID NO: 72829 - DNA, 15 bp, Homo sapiens
cgaggtctgatggtt

SEQ ID NO: 72830 - DNA, 15 bp, Homo sapiens
acgaggtctgatggt

SEQ ID NO: 72831 - DNA, 15 bp, Homo sapiens
cacgaggtctgatgg

SEQ ID NO: 72832 - DNA, 15 bp, Homo sapiens
tcacgaggtctgatg

SEQ ID NO: 72833 - DNA, 15 bp, Homo sapiens
ctcacgaggtctgat

SEQ ID NO: 72834 - DNA, 15 bp, Homo sapiens
tctcacgaggtctga

SEQ ID NO: 72835 - DNA, 15 bp, Homo sapiens
gtctcacgaggtctg

SEQ ID NO: 72836 - DNA, 15 bp, Homo sapiens
agtctcacgaggtct

SEQ ID NO: 72837 - DNA, 15 bp, Homo sapiens
aagtctcacgaggtc

SEQ ID NO: 72838 - DNA, 15 bp, Homo sapiens
taagtctcacgaggt

SEQ ID NO: 72839 - DNA, 15 bp, Homo sapiens
gtaagtctcacgagg

SEQ ID NO: 72840 - DNA, 15 bp, Homo sapiens
agtaagtctcacgag

SEQ ID NO: 72841 - DNA, 15 bp, Homo sapiens
gagtaagtctcacga

SEQ ID NO: 72842 - DNA, 15 bp, Homo sapiens
tgagtaagtctcacg

SEQ ID NO: 72843 - DNA, 15 bp, Homo sapiens
gtgagtaagtctcac

SEQ ID NO: 72844 - DNA, 15 bp, Homo sapiens
agtgagtaagtctca

SEQ ID NO: 72845 - DNA, 15 bp, Homo sapiens
tagtgagtaagtctc

SEQ ID NO: 72846 - DNA, 15 bp, Homo sapiens
atagtgagtaagtct

SEQ ID NO: 72847 - DNA, 15 bp, Homo sapiens
gatagtgagtaagtc

SEQ ID NO: 72848 - DNA, 15 bp, Homo sapiens
tgatagtgagtaagt

SEQ ID NO: 72849 - DNA, 15 bp, Homo sapiens
gtgatagtgagtaag

SEQ ID NO: 72850 - DNA, 15 bp, Homo sapiens
tgtgatagtgagtaa

SEQ ID NO: 72851 - DNA, 15 bp, Homo sapiens
ttgtgatagtgagta

SEQ ID NO: 72852 - DNA, 15 bp, Homo sapiens
cttgtgatagtgagt

SEQ ID NO: 72853 - DNA, 15 bp, Homo sapiens
tcttgtgatagtgag

SEQ ID NO: 72854 - DNA, 15 bp, Homo sapiens
ttcttgtgatagtga

SEQ ID NO: 72855 - DNA, 15 bp, Homo sapiens
gttcttgtgatagtg

SEQ ID NO: 72856 - DNA, 15 bp, Homo sapiens
tgttcttgtgatagt

SEQ ID NO: 72857 - DNA, 15 bp, Homo sapiens
ctgttcttgtgatag

SEQ ID NO: 72858 - DNA, 15 bp, Homo sapiens
gctgttcttgtgata

SEQ ID NO: 72859 - DNA, 15 bp, Homo sapiens
tgctgttcttgtgat

SEQ ID NO: 72860 - DNA, 15 bp, Homo sapiens
ttgctgttcttgtga

SEQ ID NO: 72861 - DNA, 15 bp, Homo sapiens
cttgctgttcttgtg

SEQ ID NO: 72862 - DNA, 15 bp, Homo sapiens
tcttgctgttcttgt

SEQ ID NO: 72863 - DNA, 15 bp, Homo sapiens
ctcttgctgttcttg

SEQ ID NO: 72864 - DNA, 15 bp, Homo sapiens
tctcttgctgttctt

SEQ ID NO: 72865 - DNA, 15 bp, Homo sapiens
ctctcttgctgttct

SEQ ID NO: 72866 - DNA, 15 bp, Homo sapiens
tctctcttgctgttc

SEQ ID NO: 72867 - DNA, 15 bp, Homo sapiens
ctctctcttgctgtt

SEQ ID NO: 72868 - DNA, 15 bp, Homo sapiens
tctctctcttgctgt

SEQ ID NO: 72869 - DNA, 15 bp, Homo sapiens
gtctctctcttgctg

SEQ ID NO: 72870 - DNA, 15 bp, Homo sapiens
ggtctctctcttgct

SEQ ID NO: 72871 - DNA, 15 bp, Homo sapiens
aggtctctctcttgc

SEQ ID NO: 72872 - DNA, 15 bp, Homo sapiens
caggtctctctcttg

SEQ ID NO: 72873 - DNA, 15 bp, Homo sapiens
gcaggtctctctctt

SEQ ID NO: 72874 - DNA, 15 bp, Homo sapiens
cgcaggtctctctct

SEQ ID NO: 72875 - DNA, 15 bp, Homo sapiens
gcgcaggtctctctc

SEQ ID NO: 72876 - DNA, 15 bp, Homo sapiens
ggcgcaggtctctct

SEQ ID NO: 72877 - DNA, 15 bp, Homo sapiens
gggcgcaggtctctc

SEQ ID NO: 72878 - DNA, 15 bp, Homo sapiens
tgggcgcaggtctct

SEQ ID NO: 72879 - DNA, 15 bp, Homo sapiens
atgggcgcaggtctc

SEQ ID NO: 72880 - DNA, 15 bp, Homo sapiens
catgggcgcaggtct

SEQ ID NO: 72881 - DNA, 15 bp, Homo sapiens
tcatgggcgcaggtc

SEQ ID NO: 72882 - DNA, 15 bp, Homo sapiens
ttcatgggcgcaggt

SEQ ID NO: 72883 - DNA, 15 bp, Homo sapiens
attcatgggcgcagg

SEQ ID NO: 72884 - DNA, 15 bp, Homo sapiens
gattcatgggcgcag

SEQ ID NO: 72885 - DNA, 15 bp, Homo sapiens
tgattcatgggcgca

SEQ ID NO: 72886 - DNA, 15 bp, Homo sapiens
ttgattcatgggcgc

SEQ ID NO: 72887 - DNA, 15 bp, Homo sapiens
attgattcatgggcg

SEQ ID NO: 72888 - DNA, 15 bp, Homo sapiens
aattgattcatgggc

SEQ ID NO: 72889 - DNA, 15 bp, Homo sapiens
taattgattcatggg

SEQ ID NO: 72890 - DNA, 15 bp, Homo sapiens
gtaattgattcatgg

SEQ ID NO: 72891 - DNA, 15 bp, Homo sapiens
ggtaattgattcatg

SEQ ID NO: 72892 - DNA, 15 bp, Homo sapiens
aggtaattgattcat

SEQ ID NO: 72893 - DNA, 15 bp, Homo sapiens
gaggtaattgattca

SEQ ID NO: 72894 - DNA, 15 bp, Homo sapiens
ggaggtaattgattc

SEQ ID NO: 72895 - DNA, 15 bp, Homo sapiens
gggaggtaattgatt

SEQ ID NO: 72896 - DNA, 15 bp, Homo sapiens
tgggaggtaattgat

SEQ ID NO: 72897 - DNA, 15 bp, Homo sapiens
gtgggaggtaattga

SEQ ID NO: 72898 - DNA, 15 bp, Homo sapiens
agtgggaggtaattg

SEQ ID NO: 72899 - DNA, 15 bp, Homo sapiens
cagtgggaggtaatt

SEQ ID NO: 72900 - DNA, 15 bp, Homo sapiens
ccagtgggaggtaat

SEQ ID NO: 72901 - DNA, 15 bp, Homo sapiens
cccagtgggaggtaa

SEQ ID NO: 72902 - DNA, 15 bp, Homo sapiens
acccagtgggaggta

SEQ ID NO: 72903 - DNA, 15 bp, Homo sapiens
aacccagtgggaggt

SEQ ID NO: 72904 - DNA, 15 bp, Homo sapiens
gaacccagtgggagg

SEQ ID NO: 72905 - DNA, 15 bp, Homo sapiens
ggaacccagtgggag

SEQ ID NO: 72906 - DNA, 15 bp, Homo sapiens
aggaacccagtggga

SEQ ID NO: 72907 - DNA, 15 bp, Homo sapiens
gaggaacccagtggg

SEQ ID NO: 72908 - DNA, 15 bp, Homo sapiens
tgaggaacccagtgg

SEQ ID NO: 72909 - DNA, 15 bp, Homo sapiens
gtgaggaacccagtg

SEQ ID NO: 72910 - DNA, 15 bp, Homo sapiens
agtgaggaacccagt

SEQ ID NO: 72911 - DNA, 15 bp, Homo sapiens
aagtgaggaacccag

SEQ ID NO: 72912 - DNA, 15 bp, Homo sapiens
taagtgaggaaccca

SEQ ID NO: 72913 - DNA, 15 bp, Homo sapiens
ttaagtgaggaaccc

SEQ ID NO: 72914 - DNA, 15 bp, Homo sapiens
tttaagtgaggaacc

SEQ ID NO: 72915 - DNA, 15 bp, Homo sapiens
ttttaagtgaggaac

SEQ ID NO: 72916 - DNA, 15 bp, Homo sapiens
attttaagtgaggaa

SEQ ID NO: 72917 - DNA, 15 bp, Homo sapiens
cattttaagtgagga

SEQ ID NO: 72918 - DNA, 15 bp, Homo sapiens
acattttaagtgagg

SEQ ID NO: 72919 - DNA, 15 bp, Homo sapiens
cacattttaagtgag

SEQ ID NO: 72920 - DNA, 15 bp, Homo sapiens
ccacattttaagtga

SEQ ID NO: 72921 - DNA, 15 bp, Homo sapiens
cccacattttaagtg

SEQ ID NO: 72922 - DNA, 15 bp, Homo sapiens
tcccacattttaagt

SEQ ID NO: 72923 - DNA, 15 bp, Homo sapiens
ttcccacattttaag

SEQ ID NO: 72924 - DNA, 15 bp, Homo sapiens
attcccacattttaa

SEQ ID NO: 72925 - DNA, 15 bp, Homo sapiens
aattcccacatttta

SEQ ID NO: 72926 - DNA, 15 bp, Homo sapiens
caattcccacatttt

SEQ ID NO: 72927 - DNA, 15 bp, Homo sapiens
acaattcccacattt

SEQ ID NO: 72928 - DNA, 15 bp, Homo sapiens
cacaattcccacatt

SEQ ID NO: 72929 - DNA, 15 bp, Homo sapiens
ccacaattcccacat

SEQ ID NO: 72930 - DNA, 15 bp, Homo sapiens
cccacaattcccaca

SEQ ID NO: 72931 - DNA, 15 bp, Homo sapiens
tcccacaattcccac

SEQ ID NO: 72932 - DNA, 15 bp, Homo sapiens
ctcccacaattccca

SEQ ID NO: 72933 - DNA, 15 bp, Homo sapiens
actcccacaattccc

SEQ ID NO: 72934 - DNA, 15 bp, Homo sapiens
aactcccacaattcc

SEQ ID NO: 72935 - DNA, 15 bp, Homo sapiens
taactcccacaattc

SEQ ID NO: 72936 - DNA, 15 bp, Homo sapiens
gtaactcccacaatt

SEQ ID NO: 72937 - DNA, 15 bp, Homo sapiens
tgtaactcccacaat

SEQ ID NO: 72938 - DNA, 15 bp, Homo sapiens
ttgtaactcccacaa

SEQ ID NO: 72939 - DNA, 15 bp, Homo sapiens
attgtaactcccaca

SEQ ID NO: 72940 - DNA, 15 bp, Homo sapiens
aattgtaactcccac

SEQ ID NO: 72941 - DNA, 15 bp, Homo sapiens
gaattgtaactccca

SEQ ID NO: 72942 - DNA, 15 bp, Homo sapiens
tgaattgtaactccc

SEQ ID NO: 72943 - DNA, 15 bp, Homo sapiens
ttgaattgtaactcc

SEQ ID NO: 72944 - DNA, 15 bp, Homo sapiens
cttgaattgtaactc

SEQ ID NO: 72945 - DNA, 15 bp, Homo sapiens
tcttgaattgtaact

SEQ ID NO: 72946 - DNA, 15 bp, Homo sapiens
atcttgaattgtaac

SEQ ID NO: 72947 - DNA, 15 bp, Homo sapiens
catcttgaattgtaa

SEQ ID NO: 72948 - DNA, 15 bp, Homo sapiens
tcatcttgaattgta

SEQ ID NO: 72949 - DNA, 15 bp, Homo sapiens
ctcatcttgaattgt

SEQ ID NO: 72950 - DNA, 15 bp, Homo sapiens
tctcatcttgaattg

SEQ ID NO: 72951 - DNA, 15 bp, Homo sapiens
gtctcatcttgaatt

SEQ ID NO: 72952 - DNA, 15 bp, Homo sapiens
agtctcatcttgaat

SEQ ID NO: 72953 - DNA, 15 bp, Homo sapiens
aagtctcatcttgaa

SEQ ID NO: 72954 - DNA, 15 bp, Homo sapiens
caagtctcatcttga

SEQ ID NO: 72955 - DNA, 15 bp, Homo sapiens
ccaagtctcatcttg

SEQ ID NO: 72956 - DNA, 15 bp, Homo sapiens
tccaagtctcatctt

SEQ ID NO: 72957 - DNA, 15 bp, Homo sapiens
atccaagtctcatct

SEQ ID NO: 72958 - DNA, 15 bp, Homo sapiens
catccaagtctcatc

SEQ ID NO: 72959 - DNA, 15 bp, Homo sapiens
ccatccaagtctcat

SEQ ID NO: 72960 - DNA, 15 bp, Homo sapiens
cccatccaagtctca

SEQ ID NO: 72961 - DNA, 15 bp, Homo sapiens
ccccatccaagtctc

SEQ ID NO: 72962 - DNA, 15 bp, Homo sapiens
tccccatccaagtct

SEQ ID NO: 72963 - DNA, 15 bp, Homo sapiens
gtccccatccaagtc

SEQ ID NO: 72964 - DNA, 15 bp, Homo sapiens
tgtccccatccaagt

SEQ ID NO: 72965 - DNA, 15 bp, Homo sapiens
gtgtccccatccaag

SEQ ID NO: 72966 - DNA, 15 bp, Homo sapiens
tgtgtccccatccaa

SEQ ID NO: 72967 - DNA, 15 bp, Homo sapiens
ttgtgtccccatcca

SEQ ID NO: 72968 - DNA, 15 bp, Homo sapiens
cttgtgtccccatcc

SEQ ID NO: 72969 - DNA, 15 bp, Homo sapiens
gcttgtgtccccatc

SEQ ID NO: 72970 - DNA, 15 bp, Homo sapiens
tgcttgtgtccccat

SEQ ID NO: 72971 - DNA, 15 bp, Homo sapiens
ttgcttgtgtcccca

SEQ ID NO: 72972 - DNA, 15 bp, Homo sapiens
tttgcttgtgtcccc

SEQ ID NO: 72973 - DNA, 15 bp, Homo sapiens
gtttgcttgtgtccc

SEQ ID NO: 72974 - DNA, 15 bp, Homo sapiens
ggtttgcttgtgtcc

SEQ ID NO: 72975 - DNA, 15 bp, Homo sapiens
tggtttgcttgtgtc

SEQ ID NO: 72976 - DNA, 15 bp, Homo sapiens
atggtttgcttgtgt

SEQ ID NO: 72977 - DNA, 15 bp, Homo sapiens
tatggtttgcttgtg

SEQ ID NO: 72978 - DNA, 15 bp, Homo sapiens
atatggtttgcttgt

SEQ ID NO: 72979 - DNA, 15 bp, Homo sapiens
gatatggtttgcttg

SEQ ID NO: 72980 - DNA, 15 bp, Homo sapiens
tgatatggtttgctt

SEQ ID NO: 72981 - DNA, 15 bp, Homo sapiens
atgatatggtttgct

SEQ ID NO: 72982 - DNA, 15 bp, Homo sapiens
aatgatatggtttgc

SEQ ID NO: 72983 - DNA, 15 bp, Homo sapiens
gaatgatatggtttg

SEQ ID NO: 72984 - DNA, 15 bp, Homo sapiens
ggaatgatatggttt

SEQ ID NO: 72985 - DNA, 15 bp, Homo sapiens
tggaatgatatggtt

SEQ ID NO: 72986 - DNA, 15 bp, Homo sapiens
gtggaatgatatggt

SEQ ID NO: 72987 - DNA, 15 bp, Homo sapiens
ggtggaatgatatgg

SEQ ID NO: 72988 - DNA, 15 bp, Homo sapiens
gggtggaatgatatg

SEQ ID NO: 72989 - DNA, 15 bp, Homo sapiens
ggggtggaatgatat

SEQ ID NO: 72990 - DNA, 15 bp, Homo sapiens
aggggtggaatgata

SEQ ID NO: 72991 - DNA, 15 bp, Homo sapiens
caggggtggaatgat

SEQ ID NO: 72992 - DNA, 15 bp, Homo sapiens
ccaggggtggaatga

SEQ ID NO: 72993 - DNA, 15 bp, Homo sapiens
gccaggggtggaatg

SEQ ID NO: 72994 - DNA, 15 bp, Homo sapiens
ggccaggggtggaat

SEQ ID NO: 72995 - DNA, 15 bp, Homo sapiens
aggccaggggtggaa

SEQ ID NO: 72996 - DNA, 15 bp, Homo sapiens
gaggccaggggtgga

SEQ ID NO: 72997 - DNA, 15 bp, Homo sapiens
agaggccaggggtgg

SEQ ID NO: 72998 - DNA, 15 bp, Homo sapiens
gagaggccaggggtg

SEQ ID NO: 72999 - DNA, 15 bp, Homo sapiens
ggagaggccaggggt

SEQ ID NO: 73000 - DNA, 15 bp, Homo sapiens
gggagaggccagggg

SEQ ID NO: 73001 - DNA, 15 bp, Homo sapiens
tgggagaggccaggg

SEQ ID NO: 73002 - DNA, 15 bp, Homo sapiens
ttgggagaggccagg

SEQ ID NO: 73003 - DNA, 15 bp, Homo sapiens
tttgggagaggccag

SEQ ID NO: 73004 - DNA, 15 bp, Homo sapiens
atttgggagaggcca

SEQ ID NO: 73005 - DNA, 15 bp, Homo sapiens
gatttgggagaggcc

SEQ ID NO: 73006 - DNA, 15 bp, Homo sapiens
agatttgggagaggc

SEQ ID NO: 73007 - DNA, 15 bp, Homo sapiens
aagatttgggagagg

SEQ ID NO: 73008 - DNA, 15 bp, Homo sapiens
taagatttgggagag

SEQ ID NO: 73009 - DNA, 15 bp, Homo sapiens
ataagatttgggaga

SEQ ID NO: 73010 - DNA, 15 bp, Homo sapiens
cataagatttgggag

SEQ ID NO: 73011 - DNA, 15 bp, Homo sapiens
acataagatttggga

SEQ ID NO: 73012 - DNA, 15 bp, Homo sapiens
gacataagatttggg

SEQ ID NO: 73013 - DNA, 15 bp, Homo sapiens
ggacataagatttgg

SEQ ID NO: 73014 - DNA, 15 bp, Homo sapiens
aggacataagatttg

SEQ ID NO: 73015 - DNA, 15 bp, Homo sapiens
gaggacataagattt

SEQ ID NO: 73016 - DNA, 15 bp, Homo sapiens
tgaggacataagatt

SEQ ID NO: 73017 - DNA, 15 bp, Homo sapiens
gtgaggacataagat

SEQ ID NO: 73018 - DNA, 15 bp, Homo sapiens
tgtgaggacataaga

SEQ ID NO: 73019 - DNA, 15 bp, Homo sapiens
atgtgaggacataag

SEQ ID NO: 73020 - DNA, 15 bp, Homo sapiens
aatgtgaggacataa

SEQ ID NO: 73021 - DNA, 15 bp, Homo sapiens
aaatgtgaggacata

SEQ ID NO: 73022 - DNA, 15 bp, Homo sapiens
gaaatgtgaggacat

SEQ ID NO: 73023 - DNA, 15 bp, Homo sapiens
tgaaatgtgaggaca

SEQ ID NO: 73024 - DNA, 15 bp, Homo sapiens
gtgaaatgtgaggac

SEQ ID NO: 73025 - DNA, 15 bp, Homo sapiens
tgtgaaatgtgagga

SEQ ID NO: 73026 - DNA, 15 bp, Homo sapiens
ttgtgaaatgtgagg

SEQ ID NO: 73027 - DNA, 15 bp, Homo sapiens
gttgtgaaatgtgag

SEQ ID NO: 73028 - DNA, 15 bp, Homo sapiens
ggttgtgaaatgtga

SEQ ID NO: 73029 - DNA, 15 bp, Homo sapiens
tggttgtgaaatgtg

SEQ ID NO: 73030 - DNA, 15 bp, Homo sapiens
ttggttgtgaaatgt

SEQ ID NO: 73031 - DNA, 15 bp, Homo sapiens
attggttgtgaaatg

SEQ ID NO: 73032 - DNA, 15 bp, Homo sapiens
gattggttgtgaaat

SEQ ID NO: 73033 - DNA, 15 bp, Homo sapiens
tgattggttgtgaaa

SEQ ID NO: 73034 - DNA, 15 bp, Homo sapiens
atgattggttgtgaa

SEQ ID NO: 73035 - DNA, 15 bp, Homo sapiens
catgattggttgtga

SEQ ID NO: 73036 - DNA, 15 bp, Homo sapiens
gcatgattggttgtg

SEQ ID NO: 73037 - DNA, 15 bp, Homo sapiens
agcatgattggttgt

SEQ ID NO: 73038 - DNA, 15 bp, Homo sapiens
aagcatgattggttg

SEQ ID NO: 73039 - DNA, 15 bp, Homo sapiens
aaagcatgattggtt

SEQ ID NO: 73040 - DNA, 15 bp, Homo sapiens
gaaagcatgattggt

SEQ ID NO: 73041 - DNA, 15 bp, Homo sapiens
ggaaagcatgattgg

SEQ ID NO: 73042 - DNA, 15 bp, Homo sapiens
gggaaagcatgattg

SEQ ID NO: 73043 - DNA, 15 bp, Homo sapiens
tgggaaagcatgatt

SEQ ID NO: 73044 - DNA, 15 bp, Homo sapiens
ttgggaaagcatgat

SEQ ID NO: 73045 - DNA, 15 bp, Homo sapiens
gttgggaaagcatga

SEQ ID NO: 73046 - DNA, 15 bp, Homo sapiens
tgttgggaaagcatg

SEQ ID NO: 73047 - DNA, 15 bp, Homo sapiens
ctgttgggaaagcat

SEQ ID NO: 73048 - DNA, 15 bp, Homo sapiens
actgttgggaaagca

SEQ ID NO: 73049 - DNA, 15 bp, Homo sapiens
tactgttgggaaagc

SEQ ID NO: 73050 - DNA, 15 bp, Homo sapiens
gtactgttgggaaag

SEQ ID NO: 73051 - DNA, 15 bp, Homo sapiens
ggtactgttgggaaa

SEQ ID NO: 73052 - DNA, 15 bp, Homo sapiens
gggtactgttgggaa

SEQ ID NO: 73053 - DNA, 15 bp, Homo sapiens
ggggtactgttggga

SEQ ID NO: 73054 - DNA, 15 bp, Homo sapiens
gggggtactgttggg

SEQ ID NO: 73055 - DNA, 15 bp, Homo sapiens
tgggggtactgttgg

SEQ ID NO: 73056 - DNA, 15 bp, Homo sapiens
ttgggggtactgttg

SEQ ID NO: 73057 - DNA, 15 bp, Homo sapiens
tttgggggtactgtt

SEQ ID NO: 73058 - DNA, 15 bp, Homo sapiens
ctttgggggtactgt

SEQ ID NO: 73059 - DNA, 15 bp, Homo sapiens
actttgggggtactg

SEQ ID NO: 73060 - DNA, 15 bp, Homo sapiens
gactttgggggtact

SEQ ID NO: 73061 - DNA, 15 bp, Homo sapiens
agactttgggggtac

SEQ ID NO: 73062 - DNA, 15 bp, Homo sapiens
aagactttgggggta

SEQ ID NO: 73063 - DNA, 15 bp, Homo sapiens
taagactttgggggt

SEQ ID NO: 73064 - DNA, 15 bp, Homo sapiens
ttaagactttggggg

SEQ ID NO: 73065 - DNA, 15 bp, Homo sapiens
gttaagactttgggg

SEQ ID NO: 73066 - DNA, 15 bp, Homo sapiens
agttaagactttggg

SEQ ID NO: 73067 - DNA, 15 bp, Homo sapiens
gagttaagactttgg

SEQ ID NO: 73068 - DNA, 15 bp, Homo sapiens
tgagttaagactttg

SEQ ID NO: 73069 - DNA, 15 bp, Homo sapiens
atgagttaagacttt

SEQ ID NO: 73070 - DNA, 15 bp, Homo sapiens
aatgagttaagactt

SEQ ID NO: 73071 - DNA, 15 bp, Homo sapiens
aaatgagttaagact

SEQ ID NO: 73072 - DNA, 15 bp, Homo sapiens
gaaatgagttaagac

SEQ ID NO: 73073 - DNA, 15 bp, Homo sapiens
tgaaatgagttaaga

SEQ ID NO: 73074 - DNA, 15 bp, Homo sapiens
ctgaaatgagttaag

SEQ ID NO: 73075 - DNA, 15 bp, Homo sapiens
gctgaaatgagttaa

SEQ ID NO: 73076 - DNA, 15 bp, Homo sapiens
tgctgaaatgagtta

SEQ ID NO: 73077 - DNA, 15 bp, Homo sapiens
atgctgaaatgagtt

SEQ ID NO: 73078 - DNA, 15 bp, Homo sapiens
aatgctgaaatgagt

SEQ ID NO: 73079 - DNA, 15 bp, Homo sapiens
taatgctgaaatgag

SEQ ID NO: 73080 - DNA, 15 bp, Homo sapiens
ttaatgctgaaatga

SEQ ID NO: 73081 - DNA, 15 bp, Homo sapiens
gttaatgctgaaatg

SEQ ID NO: 73082 - DNA, 15 bp, Homo sapiens
agttaatgctgaaat

SEQ ID NO: 73083 - DNA, 15 bp, Homo sapiens
gagttaatgctgaaa

SEQ ID NO: 73084 - DNA, 15 bp, Homo sapiens
tgagttaatgctgaa

SEQ ID NO: 73085 - DNA, 15 bp, Homo sapiens
ttgagttaatgctga

SEQ ID NO: 73086 - DNA, 15 bp, Homo sapiens
tttgagttaatgctg

SEQ ID NO: 73087 - DNA, 15 bp, Homo sapiens
ttttgagttaatgct

SEQ ID NO: 73088 - DNA, 15 bp, Homo sapiens
cttttgagttaatgc

SEQ ID NO: 73089 - DNA, 15 bp, Homo sapiens
acttttgagttaatg

SEQ ID NO: 73090 - DNA, 15 bp, Homo sapiens
gacttttgagttaat

SEQ ID NO: 73091 - DNA, 15 bp, Homo sapiens
ggacttttgagttaa

SEQ ID NO: 73092 - DNA, 15 bp, Homo sapiens
tggacttttgagtta

SEQ ID NO: 73093 - DNA, 15 bp, Homo sapiens
gtggacttttgagtt

SEQ ID NO: 73094 - DNA, 15 bp, Homo sapiens
tgtggacttttgagt

SEQ ID NO: 73095 - DNA, 15 bp, Homo sapiens
ctgtggacttttgag

SEQ ID NO: 73096 - DNA, 15 bp, Homo sapiens
actgtggacttttga

SEQ ID NO: 73097 - DNA, 15 bp, Homo sapiens
gactgtggacttttg

SEQ ID NO: 73098 - DNA, 15 bp, Homo sapiens
ggactgtggactttt

SEQ ID NO: 73099 - DNA, 15 bp, Homo sapiens
tggactgtggacttt

SEQ ID NO: 73100 - DNA, 15 bp, Homo sapiens
ttggactgtggactt

SEQ ID NO: 73101 - DNA, 15 bp, Homo sapiens
tttggactgtggact

SEQ ID NO: 73102 - DNA, 15 bp, Homo sapiens
ctttggactgtggac

SEQ ID NO: 73103 - DNA, 15 bp, Homo sapiens
actttggactgtgga

SEQ ID NO: 73104 - DNA, 15 bp, Homo sapiens
gactttggactgtgg

SEQ ID NO: 73105 - DNA, 15 bp, Homo sapiens
agactttggactgtg

SEQ ID NO: 73106 - DNA, 15 bp, Homo sapiens
gagactttggactgt

SEQ ID NO: 73107 - DNA, 15 bp, Homo sapiens
tgagactttggactg

SEQ ID NO: 73108 - DNA, 15 bp, Homo sapiens
atgagactttggact

SEQ ID NO: 73109 - DNA, 15 bp, Homo sapiens
gatgagactttggac

SEQ ID NO: 73110 - DNA, 15 bp, Homo sapiens
agatgagactttgga

SEQ ID NO: 73111 - DNA, 15 bp, Homo sapiens
cagatgagactttgg

SEQ ID NO: 73112 - DNA, 15 bp, Homo sapiens
tcagatgagactttg

SEQ ID NO: 73113 - DNA, 15 bp, Homo sapiens
ctcagatgagacttt

SEQ ID NO: 73114 - DNA, 15 bp, Homo sapiens
tctcagatgagactt

SEQ ID NO: 73115 - DNA, 15 bp, Homo sapiens
gtctcagatgagact

SEQ ID NO: 73116 - DNA, 15 bp, Homo sapiens
tgtctcagatgagac

SEQ ID NO: 73117 - DNA, 15 bp, Homo sapiens
ttgtctcagatgaga

SEQ ID NO: 73118 - DNA, 15 bp, Homo sapiens
cttgtctcagatgag

SEQ ID NO: 73119 - DNA, 15 bp, Homo sapiens
ccttgtctcagatga

SEQ ID NO: 73120 - DNA, 15 bp, Homo sapiens
gccttgtctcagatg

SEQ ID NO: 73121 - DNA, 15 bp, Homo sapiens
tgccttgtctcagat

SEQ ID NO: 73122 - DNA, 15 bp, Homo sapiens
ttgccttgtctcaga

SEQ ID NO: 73123 - DNA, 15 bp, Homo sapiens
cttgccttgtctcag

SEQ ID NO: 73124 - DNA, 15 bp, Homo sapiens
acttgccttgtctca

SEQ ID NO: 73125 - DNA, 15 bp, Homo sapiens
gacttgccttgtctc

SEQ ID NO: 73126 - DNA, 15 bp, Homo sapiens
ggacttgccttgtct

SEQ ID NO: 73127 - DNA, 15 bp, Homo sapiens
gggacttgccttgtc

SEQ ID NO: 73128 - DNA, 15 bp, Homo sapiens
agggacttgccttgt

SEQ ID NO: 73129 - DNA, 15 bp, Homo sapiens
aagggacttgccttg

SEQ ID NO: 73130 - DNA, 15 bp, Homo sapiens
gaagggacttgcctt

SEQ ID NO: 73131 - DNA, 15 bp, Homo sapiens
ggaagggacttgcct

SEQ ID NO: 73132 - DNA, 15 bp, Homo sapiens
cggaagggacttgcc

SEQ ID NO: 73133 - DNA, 15 bp, Homo sapiens
gcggaagggacttgc

SEQ ID NO: 73134 - DNA, 15 bp, Homo sapiens
ggcggaagggacttg

SEQ ID NO: 73135 - DNA, 15 bp, Homo sapiens
aggcggaagggactt

SEQ ID NO: 73136 - DNA, 15 bp, Homo sapiens
taggcggaagggact

SEQ ID NO: 73137 - DNA, 15 bp, Homo sapiens
ataggcggaagggac

SEQ ID NO: 73138 - DNA, 15 bp, Homo sapiens
cataggcggaaggga

SEQ ID NO: 73139 - DNA, 15 bp, Homo sapiens
tcataggcggaaggg

SEQ ID NO: 73140 - DNA, 15 bp, Homo sapiens
ctcataggcggaagg

SEQ ID NO: 73141 - DNA, 15 bp, Homo sapiens
gctcataggcggaag

SEQ ID NO: 73142 - DNA, 15 bp, Homo sapiens
ggctcataggcggaa

SEQ ID NO: 73143 - DNA, 15 bp, Homo sapiens
aggctcataggcgga

SEQ ID NO: 73144 - DNA, 15 bp, Homo sapiens
caggctcataggcgg

SEQ ID NO: 73145 - DNA, 15 bp, Homo sapiens
gcaggctcataggcg

SEQ ID NO: 73146 - DNA, 15 bp, Homo sapiens
tgcaggctcataggc

SEQ ID NO: 73147 - DNA, 15 bp, Homo sapiens
ttgcaggctcatagg

SEQ ID NO: 73148 - DNA, 15 bp, Homo sapiens
tttgcaggctcatag

SEQ ID NO: 73149 - DNA, 15 bp, Homo sapiens
ctttgcaggctcata

SEQ ID NO: 73150 - DNA, 15 bp, Homo sapiens
actttgcaggctcat

SEQ ID NO: 73151 - DNA, 15 bp, Homo sapiens
gactttgcaggctca

SEQ ID NO: 73152 - DNA, 15 bp, Homo sapiens
tgactttgcaggctc

SEQ ID NO: 73153 - DNA, 15 bp, Homo sapiens
ttgactttgcaggct

SEQ ID NO: 73154 - DNA, 15 bp, Homo sapiens
tttgactttgcaggc

SEQ ID NO: 73155 - DNA, 15 bp, Homo sapiens
ttttgactttgcagg

SEQ ID NO: 73156 - DNA, 15 bp, Homo sapiens
cttttgactttgcag

SEQ ID NO: 73157 - DNA, 15 bp, Homo sapiens
gcttttgactttgca

SEQ ID NO: 73158 - DNA, 15 bp, Homo sapiens
tgcttttgactttgc

SEQ ID NO: 73159 - DNA, 15 bp, Homo sapiens
ttgcttttgactttg

SEQ ID NO: 73160 - DNA, 15 bp, Homo sapiens
cttgcttttgacttt

SEQ ID NO: 73161 - DNA, 15 bp, Homo sapiens
acttgcttttgactt

SEQ ID NO: 73162 - DNA, 15 bp, Homo sapiens
aacttgcttttgact

SEQ ID NO: 73163 - DNA, 15 bp, Homo sapiens
taacttgcttttgac

SEQ ID NO: 73164 - DNA, 15 bp, Homo sapiens
ctaacttgcttttga

SEQ ID NO: 73165 - DNA, 15 bp, Homo sapiens
actaacttgcttttg

SEQ ID NO: 73166 - DNA, 15 bp, Homo sapiens
aactaacttgctttt

SEQ ID NO: 73167 - DNA, 15 bp, Homo sapiens
taactaacttgcttt

SEQ ID NO: 73168 - DNA, 15 bp, Homo sapiens
gtaactaacttgctt

SEQ ID NO: 73169 - DNA, 15 bp, Homo sapiens
agtaactaacttgct

SEQ ID NO: 73170 - DNA, 15 bp, Homo sapiens
aagtaactaacttgc

SEQ ID NO: 73171 - DNA, 15 bp, Homo sapiens
gaagtaactaacttg

SEQ ID NO: 73172 - DNA, 15 bp, Homo sapiens
ggaagtaactaactt

SEQ ID NO: 73173 - DNA, 15 bp, Homo sapiens
aggaagtaactaact

SEQ ID NO: 73174 - DNA, 15 bp, Homo sapiens
taggaagtaactaac

SEQ ID NO: 73175 - DNA, 15 bp, Homo sapiens
ctaggaagtaactaa

SEQ ID NO: 73176 - DNA, 15 bp, Homo sapiens
gctaggaagtaacta

SEQ ID NO: 73177 - DNA, 15 bp, Homo sapiens
agctaggaagtaact

SEQ ID NO: 73178 - DNA, 15 bp, Homo sapiens
tagctaggaagtaac

SEQ ID NO: 73179 - DNA, 15 bp, Homo sapiens
gtagctaggaagtaa

SEQ ID NO: 73180 - DNA, 15 bp, Homo sapiens
tgtagctaggaagta

SEQ ID NO: 73181 - DNA, 15 bp, Homo sapiens
ttgtagctaggaagt

SEQ ID NO: 73182 - DNA, 15 bp, Homo sapiens
attgtagctaggaag

SEQ ID NO: 73183 - DNA, 15 bp, Homo sapiens
cattgtagctaggaa

SEQ ID NO: 73184 - DNA, 15 bp, Homo sapiens
ccattgtagctagga

SEQ ID NO: 73185 - DNA, 15 bp, Homo sapiens
cccattgtagctagg

SEQ ID NO: 73186 - DNA, 15 bp, Homo sapiens
ccccattgtagctag

SEQ ID NO: 73187 - DNA, 15 bp, Homo sapiens
cccccattgtagcta

SEQ ID NO: 73188 - DNA, 15 bp, Homo sapiens
gcccccattgtagct

SEQ ID NO: 73189 - DNA, 15 bp, Homo sapiens
tgcccccattgtagc

SEQ ID NO: 73190 - DNA, 15 bp, Homo sapiens
gtgcccccattgtag

SEQ ID NO: 73191 - DNA, 15 bp, Homo sapiens
tgtgcccccattgta

SEQ ID NO: 73192 - DNA, 15 bp, Homo sapiens
ctgtgcccccattgt

SEQ ID NO: 73193 - DNA, 15 bp, Homo sapiens
cctgtgcccccattg

SEQ ID NO: 73194 - DNA, 15 bp, Homo sapiens
gcctgtgcccccatt

SEQ ID NO: 73195 - DNA, 15 bp, Homo sapiens
tgcctgtgcccccat

SEQ ID NO: 73196 - DNA, 15 bp, Homo sapiens
ttgcctgtgccccca

SEQ ID NO: 73197 - DNA, 15 bp, Homo sapiens
tttgcctgtgccccc

SEQ ID NO: 73198 - DNA, 15 bp, Homo sapiens
ctttgcctgtgcccc

SEQ ID NO: 73199 - DNA, 15 bp, Homo sapiens
tctttgcctgtgccc

SEQ ID NO: 73200 - DNA, 15 bp, Homo sapiens
ctctttgcctgtgcc

SEQ ID NO: 73201 - DNA, 15 bp, Homo sapiens
actctttgcctgtgc

SEQ ID NO: 73202 - DNA, 15 bp, Homo sapiens
tactctttgcctgtg

SEQ ID NO: 73203 - DNA, 15 bp, Homo sapiens
ttactctttgcctgt

SEQ ID NO: 73204 - DNA, 15 bp, Homo sapiens
tttactctttgcctg

SEQ ID NO: 73205 - DNA, 15 bp, Homo sapiens
atttactctttgcct

SEQ ID NO: 73206 - DNA, 15 bp, Homo sapiens
tatttactctttgcc

SEQ ID NO: 73207 - DNA, 15 bp, Homo sapiens
gtatttactctttgc

SEQ ID NO: 73208 - DNA, 15 bp, Homo sapiens
tgtatttactctttg

SEQ ID NO: 73209 - DNA, 15 bp, Homo sapiens
atgtatttactcttt

SEQ ID NO: 73210 - DNA, 15 bp, Homo sapiens
gatgtatttactctt

SEQ ID NO: 73211 - DNA, 15 bp, Homo sapiens
agatgtatttactct

SEQ ID NO: 73212 - DNA, 15 bp, Homo sapiens
cagatgtatttactc

SEQ ID NO: 73213 - DNA, 15 bp, Homo sapiens
acagatgtatttact

SEQ ID NO: 73214 - DNA, 15 bp, Homo sapiens
aacagatgtatttac

SEQ ID NO: 73215 - DNA, 15 bp, Homo sapiens
gaacagatgtattta

SEQ ID NO: 73216 - DNA, 15 bp, Homo sapiens
ggaacagatgtattt

SEQ ID NO: 73217 - DNA, 15 bp, Homo sapiens
tggaacagatgtatt

SEQ ID NO: 73218 - DNA, 15 bp, Homo sapiens
ttggaacagatgtat

SEQ ID NO: 73219 - DNA, 15 bp, Homo sapiens
tttggaacagatgta

SEQ ID NO: 73220 - DNA, 15 bp, Homo sapiens
atttggaacagatgt

SEQ ID NO: 73221 - DNA, 15 bp, Homo sapiens
catttggaacagatg

SEQ ID NO: 73222 - DNA, 15 bp, Homo sapiens
ccatttggaacagat

SEQ ID NO: 73223 - DNA, 15 bp, Homo sapiens
cccatttggaacaga

SEQ ID NO: 73224 - DNA, 15 bp, Homo sapiens
tcccatttggaacag

SEQ ID NO: 73225 - DNA, 15 bp, Homo sapiens
ctcccatttggaaca

SEQ ID NO: 73226 - DNA, 15 bp, Homo sapiens
tctcccatttggaac

SEQ ID NO: 73227 - DNA, 15 bp, Homo sapiens
ttctcccatttggaa

SEQ ID NO: 73228 - DNA, 15 bp, Homo sapiens
tttctcccatttgga

SEQ ID NO: 73229 - DNA, 15 bp, Homo sapiens
gtttctcccatttgg

SEQ ID NO: 73230 - DNA, 15 bp, Homo sapiens
agtttctcccatttg

SEQ ID NO: 73231 - DNA, 15 bp, Homo sapiens
cagtttctcccattt

SEQ ID NO: 73232 - DNA, 15 bp, Homo sapiens
ccagtttctcccatt

SEQ ID NO: 73233 - DNA, 15 bp, Homo sapiens
gccagtttctcccat

SEQ ID NO: 73234 - DNA, 15 bp, Homo sapiens
ggccagtttctccca

SEQ ID NO: 73235 - DNA, 15 bp, Homo sapiens
tggccagtttctccc

SEQ ID NO: 73236 - DNA, 15 bp, Homo sapiens
ttggccagtttctcc

SEQ ID NO: 73237 - DNA, 15 bp, Homo sapiens
tttggccagtttctc

SEQ ID NO: 73238 - DNA, 15 bp, Homo sapiens
ttttggccagtttct

SEQ ID NO: 73239 - DNA, 15 bp, Homo sapiens
gttttggccagtttc

SEQ ID NO: 73240 - DNA, 15 bp, Homo sapiens
tgttttggccagttt

SEQ ID NO: 73241 - DNA, 15 bp, Homo sapiens
ttgttttggccagtt

SEQ ID NO: 73242 - DNA, 15 bp, Homo sapiens
tttgttttggccagt

SEQ ID NO: 73243 - DNA, 15 bp, Homo sapiens
ttttgttttggccag

SEQ ID NO: 73244 - DNA, 15 bp, Homo sapiens
cttttgttttggcca

SEQ ID NO: 73245 - DNA, 15 bp, Homo sapiens
ccttttgttttggcc

SEQ ID NO: 73246 - DNA, 15 bp, Homo sapiens
cccttttgttttggc

SEQ ID NO: 73247 - DNA, 15 bp, Homo sapiens
gcccttttgttttgg

SEQ ID NO: 73248 - DNA, 15 bp, Homo sapiens
agcccttttgttttg

SEQ ID NO: 73249 - DNA, 15 bp, Homo sapiens
tagcccttttgtttt

SEQ ID NO: 73250 - DNA, 15 bp, Homo sapiens
gtagcccttttgttt

SEQ ID NO: 73251 - DNA, 15 bp, Homo sapiens
tgtagcccttttgtt

SEQ ID NO: 73252 - DNA, 15 bp, Homo sapiens
ctgtagcccttttgt

SEQ ID NO: 73253 - DNA, 15 bp, Homo sapiens
actgtagcccttttg

SEQ ID NO: 73254 - DNA, 15 bp, Homo sapiens
gactgtagccctttt

SEQ ID NO: 73255 - DNA, 15 bp, Homo sapiens
ggactgtagcccttt

SEQ ID NO: 73256 - DNA, 15 bp, Homo sapiens
gggactgtagccctt

SEQ ID NO: 73257 - DNA, 15 bp, Homo sapiens
ggggactgtagccct

SEQ ID NO: 73258 - DNA, 15 bp, Homo sapiens
tggggactgtagccc

SEQ ID NO: 73259 - DNA, 15 bp, Homo sapiens
atggggactgtagcc

SEQ ID NO: 73260 - DNA, 15 bp, Homo sapiens
aatggggactgtagc

SEQ ID NO: 73261 - DNA, 15 bp, Homo sapiens
gaatggggactgtag

SEQ ID NO: 73262 - DNA, 15 bp, Homo sapiens
tgaatggggactgta

SEQ ID NO: 73263 - DNA, 15 bp, Homo sapiens
ttgaatggggactgt

SEQ ID NO: 73264 - DNA, 15 bp, Homo sapiens
cttgaatggggactg

SEQ ID NO: 73265 - DNA, 15 bp, Homo sapiens
acttgaatggggact

SEQ ID NO: 73266 - DNA, 15 bp, Homo sapiens
tacttgaatggggac

SEQ ID NO: 73267 - DNA, 15 bp, Homo sapiens
atacttgaatgggga

SEQ ID NO: 73268 - DNA, 15 bp, Homo sapiens
catacttgaatgggg

SEQ ID NO: 73269 - DNA, 15 bp, Homo sapiens
ccatacttgaatggg

SEQ ID NO: 73270 - DNA, 15 bp, Homo sapiens
tccatacttgaatgg

SEQ ID NO: 73271 - DNA, 15 bp, Homo sapiens
ttccatacttgaatg

SEQ ID NO: 73272 - DNA, 15 bp, Homo sapiens
attccatacttgaat

SEQ ID NO: 73273 - DNA, 15 bp, Homo sapiens
tattccatacttgaa

SEQ ID NO: 73274 - DNA, 15 bp, Homo sapiens
gtattccatacttga

SEQ ID NO: 73275 - DNA, 15 bp, Homo sapiens
cgtattccatacttg

SEQ ID NO: 73276 - DNA, 15 bp, Homo sapiens
ccgtattccatactt

SEQ ID NO: 73277 - DNA, 15 bp, Homo sapiens
accgtattccatact

SEQ ID NO: 73278 - DNA, 15 bp, Homo sapiens
caccgtattccatac

SEQ ID NO: 73279 - DNA, 15 bp, Homo sapiens
ccaccgtattccata

SEQ ID NO: 73280 - DNA, 15 bp, Homo sapiens
cccaccgtattccat

SEQ ID NO: 73281 - DNA, 15 bp, Homo sapiens
ccccaccgtattcca

SEQ ID NO: 73282 - DNA, 15 bp, Homo sapiens
accccaccgtattcc

SEQ ID NO: 73283 - DNA, 15 bp, Homo sapiens
taccccaccgtattc

SEQ ID NO: 73284 - DNA, 15 bp, Homo sapiens
ctaccccaccgtatt

SEQ ID NO: 73285 - DNA, 15 bp, Homo sapiens
actaccccaccgtat

SEQ ID NO: 73286 - DNA, 15 bp, Homo sapiens
gactaccccaccgta

SEQ ID NO: 73287 - DNA, 15 bp, Homo sapiens
tgactaccccaccgt

SEQ ID NO: 73288 - DNA, 15 bp, Homo sapiens
ttgactaccccaccg

SEQ ID NO: 73289 - DNA, 15 bp, Homo sapiens
tttgactaccccacc

SEQ ID NO: 73290 - DNA, 15 bp, Homo sapiens
atttgactaccccac

SEQ ID NO: 73291 - DNA, 15 bp, Homo sapiens
gatttgactacccca

SEQ ID NO: 73292 - DNA, 15 bp, Homo sapiens
agatttgactacccc

SEQ ID NO: 73293 - DNA, 15 bp, Homo sapiens
aagatttgactaccc

SEQ ID NO: 73294 - DNA, 15 bp, Homo sapiens
taagatttgactacc

SEQ ID NO: 73295 - DNA, 15 bp, Homo sapiens
ttaagatttgactac

SEQ ID NO: 73296 - DNA, 15 bp, Homo sapiens
tttaagatttgacta

SEQ ID NO: 73297 - DNA, 15 bp, Homo sapiens
ctttaagatttgact

SEQ ID NO: 73298 - DNA, 15 bp, Homo sapiens
gctttaagatttgac

SEQ ID NO: 73299 - DNA, 15 bp, Homo sapiens
agctttaagatttga

SEQ ID NO: 73300 - DNA, 15 bp, Homo sapiens
aagctttaagatttg

SEQ ID NO: 73301 - DNA, 15 bp, Homo sapiens
gaagctttaagattt

SEQ ID NO: 73302 - DNA, 15 bp, Homo sapiens
tgaagctttaagatt

SEQ ID NO: 73303 - DNA, 15 bp, Homo sapiens
ttgaagctttaagat

SEQ ID NO: 73304 - DNA, 15 bp, Homo sapiens
tttgaagctttaaga

SEQ ID NO: 73305 - DNA, 15 bp, Homo sapiens
ttttgaagctttaag

SEQ ID NO: 73306 - DNA, 15 bp, Homo sapiens
attttgaagctttaa

SEQ ID NO: 73307 - DNA, 15 bp, Homo sapiens
cattttgaagcttta

SEQ ID NO: 73308 - DNA, 15 bp, Homo sapiens
tcattttgaagcttt

SEQ ID NO: 73309 - DNA, 15 bp, Homo sapiens
atcattttgaagctt

SEQ ID NO: 73310 - DNA, 15 bp, Homo sapiens
gatcattttgaagct

SEQ ID NO: 73311 - DNA, 15 bp, Homo sapiens
agatcattttgaagc

SEQ ID NO: 73312 - DNA, 15 bp, Homo sapiens
gagatcattttgaag

SEQ ID NO: 73313 - DNA, 15 bp, Homo sapiens
ggagatcattttgaa

SEQ ID NO: 73314 - DNA, 15 bp, Homo sapiens
aggagatcattttga

SEQ ID NO: 73315 - DNA, 15 bp, Homo sapiens
aaggagatcattttg

SEQ ID NO: 73316 - DNA, 15 bp, Homo sapiens
aaaggagatcatttt

SEQ ID NO: 73317 - DNA, 15 bp, Homo sapiens
caaaggagatcattt

SEQ ID NO: 73318 - DNA, 15 bp, Homo sapiens
tcaaaggagatcatt

SEQ ID NO: 73319 - DNA, 15 bp, Homo sapiens
gtcaaaggagatcat

SEQ ID NO: 73320 - DNA, 15 bp, Homo sapiens
agtcaaaggagatca

SEQ ID NO: 73321 - DNA, 15 bp, Homo sapiens
aagtcaaaggagatc

SEQ ID NO: 73322 - DNA, 15 bp, Homo sapiens
gaagtcaaaggagat

SEQ ID NO: 73323 - DNA, 15 bp, Homo sapiens
tgaagtcaaaggaga

SEQ ID NO: 73324 - DNA, 15 bp, Homo sapiens
atgaagtcaaaggag

SEQ ID NO: 73325 - DNA, 15 bp, Homo sapiens
catgaagtcaaagga

SEQ ID NO: 73326 - DNA, 15 bp, Homo sapiens
acatgaagtcaaagg

SEQ ID NO: 73327 - DNA, 15 bp, Homo sapiens
aacatgaagtcaaag

SEQ ID NO: 73328 - DNA, 15 bp, Homo sapiens
aaacatgaagtcaaa

SEQ ID NO: 73329 - DNA, 15 bp, Homo sapiens
gaaacatgaagtcaa

SEQ ID NO: 73330 - DNA, 15 bp, Homo sapiens
tgaaacatgaagtca

SEQ ID NO: 73331 - DNA, 15 bp, Homo sapiens
gtgaaacatgaagtc

SEQ ID NO: 73332 - DNA, 15 bp, Homo sapiens
tgtgaaacatgaagt

SEQ ID NO: 73333 - DNA, 15 bp, Homo sapiens
atgtgaaacatgaag

SEQ ID NO: 73334 - DNA, 15 bp, Homo sapiens
gatgtgaaacatgaa

SEQ ID NO: 73335 - DNA, 15 bp, Homo sapiens
ggatgtgaaacatga

SEQ ID NO: 73336 - DNA, 15 bp, Homo sapiens
tggatgtgaaacatg

SEQ ID NO: 73337 - DNA, 15 bp, Homo sapiens
ctggatgtgaaacat

SEQ ID NO: 73338 - DNA, 15 bp, Homo sapiens
cctggatgtgaaaca

SEQ ID NO: 73339 - DNA, 15 bp, Homo sapiens
acctggatgtgaaac

SEQ ID NO: 73340 - DNA, 15 bp, Homo sapiens
gacctggatgtgaaa

SEQ ID NO: 73341 - DNA, 15 bp, Homo sapiens
tgacctggatgtgaa

SEQ ID NO: 73342 - DNA, 15 bp, Homo sapiens
gtgacctggatgtga

SEQ ID NO: 73343 - DNA, 15 bp, Homo sapiens
cgtgacctggatgtg

SEQ ID NO: 73344 - DNA, 15 bp, Homo sapiens
gcgtgacctggatgt

SEQ ID NO: 73345 - DNA, 15 bp, Homo sapiens
ggcgtgacctggatg

SEQ ID NO: 73346 - DNA, 15 bp, Homo sapiens
aggcgtgacctggat

SEQ ID NO: 73347 - DNA, 15 bp, Homo sapiens
taggcgtgacctgga

SEQ ID NO: 73348 - DNA, 15 bp, Homo sapiens
ataggcgtgacctgg

SEQ ID NO: 73349 - DNA, 15 bp, Homo sapiens
cataggcgtgacctg

SEQ ID NO: 73350 - DNA, 15 bp, Homo sapiens
gcataggcgtgacct

SEQ ID NO: 73351 - DNA, 15 bp, Homo sapiens
tgcataggcgtgacc

SEQ ID NO: 73352 - DNA, 15 bp, Homo sapiens
ttgcataggcgtgac

SEQ ID NO: 73353 - DNA, 15 bp, Homo sapiens
cttgcataggcgtga

SEQ ID NO: 73354 - DNA, 15 bp, Homo sapiens
tcttgcataggcgtg

SEQ ID NO: 73355 - DNA, 15 bp, Homo sapiens
ctcttgcataggcgt

SEQ ID NO: 73356 - DNA, 15 bp, Homo sapiens
cctcttgcataggcg

SEQ ID NO: 73357 - DNA, 15 bp, Homo sapiens
acctcttgcataggc

SEQ ID NO: 73358 - DNA, 15 bp, Homo sapiens
tacctcttgcatagg

SEQ ID NO: 73359 - DNA, 15 bp, Homo sapiens
ctacctcttgcatag

SEQ ID NO: 73360 - DNA, 15 bp, Homo sapiens
cctacctcttgcata

SEQ ID NO: 73361 - DNA, 15 bp, Homo sapiens
acctacctcttgcat

SEQ ID NO: 73362 - DNA, 15 bp, Homo sapiens
aacctacctcttgca

SEQ ID NO: 73363 - DNA, 15 bp, Homo sapiens
gaacctacctcttgc

SEQ ID NO: 73364 - DNA, 15 bp, Homo sapiens
ggaacctacctcttg

SEQ ID NO: 73365 - DNA, 15 bp, Homo sapiens
gggaacctacctctt

SEQ ID NO: 73366 - DNA, 15 bp, Homo sapiens
tgggaacctacctct

SEQ ID NO: 73367 - DNA, 15 bp, Homo sapiens
atgggaacctacctc

SEQ ID NO: 73368 - DNA, 15 bp, Homo sapiens
catgggaacctacct

SEQ ID NO: 73369 - DNA, 15 bp, Homo sapiens
ccatgggaacctacc

SEQ ID NO: 73370 - DNA, 15 bp, Homo sapiens
accatgggaacctac

SEQ ID NO: 73371 - DNA, 15 bp, Homo sapiens
gaccatgggaaccta

SEQ ID NO: 73372 - DNA, 15 bp, Homo sapiens
agaccatgggaacct

SEQ ID NO: 73373 - DNA, 15 bp, Homo sapiens
aagaccatgggaacc

SEQ ID NO: 73374 - DNA, 15 bp, Homo sapiens
caagaccatgggaac

SEQ ID NO: 73375 - DNA, 15 bp, Homo sapiens
ccaagaccatgggaa

SEQ ID NO: 73376 - DNA, 15 bp, Homo sapiens
cccaagaccatggga

SEQ ID NO: 73377 - DNA, 15 bp, Homo sapiens
gcccaagaccatggg

SEQ ID NO: 73378 - DNA, 15 bp, Homo sapiens
tgcccaagaccatgg

SEQ ID NO: 73379 - DNA, 15 bp, Homo sapiens
ctgcccaagaccatg

SEQ ID NO: 73380 - DNA, 15 bp, Homo sapiens
actgcccaagaccat

SEQ ID NO: 73381 - DNA, 15 bp, Homo sapiens
cactgcccaagacca

SEQ ID NO: 73382 - DNA, 15 bp, Homo sapiens
gcactgcccaagacc

SEQ ID NO: 73383 - DNA, 15 bp, Homo sapiens
agcactgcccaagac

SEQ ID NO: 73384 - DNA, 15 bp, Homo sapiens
cagcactgcccaaga

SEQ ID NO: 73385 - DNA, 15 bp, Homo sapiens
gcagcactgcccaag

SEQ ID NO: 73386 - DNA, 15 bp, Homo sapiens
ggcagcactgcccaa

SEQ ID NO: 73387 - DNA, 15 bp, Homo sapiens
aggcagcactgccca

SEQ ID NO: 73388 - DNA, 15 bp, Homo sapiens
gaggcagcactgccc

SEQ ID NO: 73389 - DNA, 15 bp, Homo sapiens
agaggcagcactgcc

SEQ ID NO: 73390 - DNA, 15 bp, Homo sapiens
cagaggcagcactgc

SEQ ID NO: 73391 - DNA, 15 bp, Homo sapiens
acagaggcagcactg

SEQ ID NO: 73392 - DNA, 15 bp, Homo sapiens
cacagaggcagcact

SEQ ID NO: 73393 - DNA, 15 bp, Homo sapiens
ccacagaggcagcac

SEQ ID NO: 73394 - DNA, 15 bp, Homo sapiens
gccacagaggcagca

SEQ ID NO: 73395 - DNA, 15 bp, Homo sapiens
agccacagaggcagc

SEQ ID NO: 73396 - DNA, 15 bp, Homo sapiens
aagccacagaggcag

SEQ ID NO: 73397 - DNA, 15 bp, Homo sapiens
aaagccacagaggca

SEQ ID NO: 73398 - DNA, 15 bp, Homo sapiens
caaagccacagaggc

SEQ ID NO: 73399 - DNA, 15 bp, Homo sapiens
gcaaagccacagagg

SEQ ID NO: 73400 - DNA, 15 bp, Homo sapiens
cgcaaagccacagag

SEQ ID NO: 73401 - DNA, 15 bp, Homo sapiens
ccgcaaagccacaga

SEQ ID NO: 73402 - DNA, 15 bp, Homo sapiens
cccgcaaagccacag

SEQ ID NO: 73403 - DNA, 15 bp, Homo sapiens
tcccgcaaagccaca

SEQ ID NO: 73404 - DNA, 15 bp, Homo sapiens
ttcccgcaaagccac

SEQ ID NO: 73405 - DNA, 15 bp, Homo sapiens
tttcccgcaaagcca

SEQ ID NO: 73406 - DNA, 15 bp, Homo sapiens
atttcccgcaaagcc

SEQ ID NO: 73407 - DNA, 15 bp, Homo sapiens
tatttcccgcaaagc

SEQ ID NO: 73408 - DNA, 15 bp, Homo sapiens
ctatttcccgcaaag

SEQ ID NO: 73409 - DNA, 15 bp, Homo sapiens
gctatttcccgcaaa

SEQ ID NO: 73410 - DNA, 15 bp, Homo sapiens
ggctatttcccgcaa

SEQ ID NO: 73411 - DNA, 15 bp, Homo sapiens
gggctatttcccgca

SEQ ID NO: 73412 - DNA, 15 bp, Homo sapiens
ggggctatttcccgc

SEQ ID NO: 73413 - DNA, 15 bp, Homo sapiens
gggggctatttcccg

SEQ ID NO: 73414 - DNA, 15 bp, Homo sapiens
agggggctatttccc

SEQ ID NO: 73415 - DNA, 15 bp, Homo sapiens
gagggggctatttcc

SEQ ID NO: 73416 - DNA, 15 bp, Homo sapiens
ggagggggctatttc

SEQ ID NO: 73417 - DNA, 15 bp, Homo sapiens
aggagggggctattt

SEQ ID NO: 73418 - DNA, 15 bp, Homo sapiens
caggagggggctatt

SEQ ID NO: 73419 - DNA, 15 bp, Homo sapiens
ccaggagggggctat

SEQ ID NO: 73420 - DNA, 15 bp, Homo sapiens
gccaggagggggcta

SEQ ID NO: 73421 - DNA, 15 bp, Homo sapiens
agccaggagggggct

SEQ ID NO: 73422 - DNA, 15 bp, Homo sapiens
cagccaggagggggc

SEQ ID NO: 73423 - DNA, 15 bp, Homo sapiens
gcagccaggaggggg

SEQ ID NO: 73424 - DNA, 15 bp, Homo sapiens
agcagccaggagggg

SEQ ID NO: 73425 - DNA, 15 bp, Homo sapiens
aagcagccaggaggg

SEQ ID NO: 73426 - DNA, 15 bp, Homo sapiens
aaagcagccaggagg

SEQ ID NO: 73427 - DNA, 15 bp, Homo sapiens
gaaagcagccaggag

SEQ ID NO: 73428 - DNA, 15 bp, Homo sapiens
tgaaagcagccagga

SEQ ID NO: 73429 - DNA, 15 bp, Homo sapiens
atgaaagcagccagg

SEQ ID NO: 73430 - DNA, 15 bp, Homo sapiens
catgaaagcagccag

SEQ ID NO: 73431 - DNA, 15 bp, Homo sapiens
ccatgaaagcagcca

SEQ ID NO: 73432 - DNA, 15 bp, Homo sapiens
cccatgaaagcagcc

SEQ ID NO: 73433 - DNA, 15 bp, Homo sapiens
acccatgaaagcagc

SEQ ID NO: 73434 - DNA, 15 bp, Homo sapiens
gacccatgaaagcag

SEQ ID NO: 73435 - DNA, 15 bp, Homo sapiens
tgacccatgaaagca

SEQ ID NO: 73436 - DNA, 15 bp, Homo sapiens
ctgacccatgaaagc

SEQ ID NO: 73437 - DNA, 15 bp, Homo sapiens
actgacccatgaaag

SEQ ID NO: 73438 - DNA, 15 bp, Homo sapiens
cactgacccatgaaa

SEQ ID NO: 73439 - DNA, 15 bp, Homo sapiens
acactgacccatgaa

SEQ ID NO: 73440 - DNA, 15 bp, Homo sapiens
aacactgacccatga

SEQ ID NO: 73441 - DNA, 15 bp, Homo sapiens
caacactgacccatg

SEQ ID NO: 73442 - DNA, 15 bp, Homo sapiens
tcaacactgacccat

SEQ ID NO: 73443 - DNA, 15 bp, Homo sapiens
ctcaacactgaccca

SEQ ID NO: 73444 - DNA, 15 bp, Homo sapiens
actcaacactgaccc

SEQ ID NO: 73445 - DNA, 15 bp, Homo sapiens
cactcaacactgacc

SEQ ID NO: 73446 - DNA, 15 bp, Homo sapiens
acactcaacactgac

SEQ ID NO: 73447 - DNA, 15 bp, Homo sapiens
gacactcaacactga

SEQ ID NO: 73448 - DNA, 15 bp, Homo sapiens
agacactcaacactg

SEQ ID NO: 73449 - DNA, 15 bp, Homo sapiens
cagacactcaacact

SEQ ID NO: 73450 - DNA, 15 bp, Homo sapiens
gcagacactcaacac

SEQ ID NO: 73451 - DNA, 15 bp, Homo sapiens
cgcagacactcaaca

SEQ ID NO: 73452 - DNA, 15 bp, Homo sapiens
ccgcagacactcaac

SEQ ID NO: 73453 - DNA, 15 bp, Homo sapiens
gccgcagacactcaa

SEQ ID NO: 73454 - DNA, 15 bp, Homo sapiens
agccgcagacactca

SEQ ID NO: 73455 - DNA, 15 bp, Homo sapiens
aagccgcagacactc

SEQ ID NO: 73456 - DNA, 15 bp, Homo sapiens
aaagccgcagacact

SEQ ID NO: 73457 - DNA, 15 bp, Homo sapiens
aaaagccgcagacac

SEQ ID NO: 73458 - DNA, 15 bp, Homo sapiens
gaaaagccgcagaca

SEQ ID NO: 73459 - DNA, 15 bp, Homo sapiens
ggaaaagccgcagac

SEQ ID NO: 73460 - DNA, 15 bp, Homo sapiens
tggaaaagccgcaga

SEQ ID NO: 73461 - DNA, 15 bp, Homo sapiens
ctggaaaagccgcag

SEQ ID NO: 73462 - DNA, 15 bp, Homo sapiens
cctggaaaagccgca

SEQ ID NO: 73463 - DNA, 15 bp, Homo sapiens
acctggaaaagccgc

SEQ ID NO: 73464 - DNA, 15 bp, Homo sapiens
cacctggaaaagccg

SEQ ID NO: 73465 - DNA, 15 bp, Homo sapiens
gcacctggaaaagcc

SEQ ID NO: 73466 - DNA, 15 bp, Homo sapiens
tgcacctggaaaagc

SEQ ID NO: 73467 - DNA, 15 bp, Homo sapiens
atgcacctggaaaag

SEQ ID NO: 73468 - DNA, 15 bp, Homo sapiens
tatgcacctggaaaa

SEQ ID NO: 73469 - DNA, 15 bp, Homo sapiens
ctatgcacctggaaa

SEQ ID NO: 73470 - DNA, 15 bp, Homo sapiens
actatgcacctggaa

SEQ ID NO: 73471 - DNA, 15 bp, Homo sapiens
cactatgcacctgga

SEQ ID NO: 73472 - DNA, 15 bp, Homo sapiens
gcactatgcacctgg

SEQ ID NO: 73473 - DNA, 15 bp, Homo sapiens
tgcactatgcacctg

SEQ ID NO: 73474 - DNA, 15 bp, Homo sapiens
ttgcactatgcacct

SEQ ID NO: 73475 - DNA, 15 bp, Homo sapiens
cttgcactatgcacc

SEQ ID NO: 73476 - DNA, 15 bp, Homo sapiens
gcttgcactatgcac

SEQ ID NO: 73477 - DNA, 15 bp, Homo sapiens
agcttgcactatgca

SEQ ID NO: 73478 - DNA, 15 bp, Homo sapiens
cagcttgcactatgc

SEQ ID NO: 73479 - DNA, 15 bp, Homo sapiens
acagcttgcactatg

SEQ ID NO: 73480 - DNA, 15 bp, Homo sapiens
gacagcttgcactat

SEQ ID NO: 73481 - DNA, 15 bp, Homo sapiens
tgacagcttgcacta

SEQ ID NO: 73482 - DNA, 15 bp, Homo sapiens
ctgacagcttgcact

SEQ ID NO: 73483 - DNA, 15 bp, Homo sapiens
actgacagcttgcac

SEQ ID NO: 73484 - DNA, 15 bp, Homo sapiens
cactgacagcttgca

SEQ ID NO: 73485 - DNA, 15 bp, Homo sapiens
ccactgacagcttgc

SEQ ID NO: 73486 - DNA, 15 bp, Homo sapiens
tccactgacagcttg

SEQ ID NO: 73487 - DNA, 15 bp, Homo sapiens
atccactgacagctt

SEQ ID NO: 73488 - DNA, 15 bp, Homo sapiens
gatccactgacagct

SEQ ID NO: 73489 - DNA, 15 bp, Homo sapiens
agatccactgacagc

SEQ ID NO: 73490 - DNA, 15 bp, Homo sapiens
tagatccactgacag

SEQ ID NO: 73491 - DNA, 15 bp, Homo sapiens
gtagatccactgaca

SEQ ID NO: 73492 - DNA, 15 bp, Homo sapiens
ggtagatccactgac

SEQ ID NO: 73493 - DNA, 15 bp, Homo sapiens
tggtagatccactga

SEQ ID NO: 73494 - DNA, 15 bp, Homo sapiens
gtggtagatccactg

SEQ ID NO: 73495 - DNA, 15 bp, Homo sapiens
ggtggtagatccact

SEQ ID NO: 73496 - DNA, 15 bp, Homo sapiens
gggtggtagatccac

SEQ ID NO: 73497 - DNA, 15 bp, Homo sapiens
agggtggtagatcca

SEQ ID NO: 73498 - DNA, 15 bp, Homo sapiens
cagggtggtagatcc

SEQ ID NO: 73499 - DNA, 15 bp, Homo sapiens
ccagggtggtagatc

SEQ ID NO: 73500 - DNA, 15 bp, Homo sapiens
cccagggtggtagat

SEQ ID NO: 73501 - DNA, 15 bp, Homo sapiens
ccccagggtggtaga

SEQ ID NO: 73502 - DNA, 15 bp, Homo sapiens
accccagggtggtag

SEQ ID NO: 73503 - DNA, 15 bp, Homo sapiens
gaccccagggtggta

SEQ ID NO: 73504 - DNA, 15 bp, Homo sapiens
agaccccagggtggt

SEQ ID NO: 73505 - DNA, 15 bp, Homo sapiens
cagaccccagggtgg

SEQ ID NO: 73506 - DNA, 15 bp, Homo sapiens
ccagaccccagggtg

SEQ ID NO: 73507 - DNA, 15 bp, Homo sapiens
tccagaccccagggt

SEQ ID NO: 73508 - DNA, 15 bp, Homo sapiens
ctccagaccccaggg

SEQ ID NO: 73509 - DNA, 15 bp, Homo sapiens
cctccagaccccagg

SEQ ID NO: 73510 - DNA, 15 bp, Homo sapiens
tcctccagaccccag

SEQ ID NO: 73511 - DNA, 15 bp, Homo sapiens
gtcctccagacccca

SEQ ID NO: 73512 - DNA, 15 bp, Homo sapiens
tgtcctccagacccc

SEQ ID NO: 73513 - DNA, 15 bp, Homo sapiens
ctgtcctccagaccc

SEQ ID NO: 73514 - DNA, 15 bp, Homo sapiens
actgtcctccagacc

SEQ ID NO: 73515 - DNA, 15 bp, Homo sapiens
cactgtcctccagac

SEQ ID NO: 73516 - DNA, 15 bp, Homo sapiens
ccactgtcctccaga

SEQ ID NO: 73517 - DNA, 15 bp, Homo sapiens
gccactgtcctccag

SEQ ID NO: 73518 - DNA, 15 bp, Homo sapiens
ggccactgtcctcca

SEQ ID NO: 73519 - DNA, 15 bp, Homo sapiens
cggccactgtcctcc

SEQ ID NO: 73520 - DNA, 15 bp, Homo sapiens
acggccactgtcctc

SEQ ID NO: 73521 - DNA, 15 bp, Homo sapiens
gacggccactgtcct

SEQ ID NO: 73522 - DNA, 15 bp, Homo sapiens
agacggccactgtcc

SEQ ID NO: 73523 - DNA, 15 bp, Homo sapiens
aagacggccactgtc

SEQ ID NO: 73524 - DNA, 15 bp, Homo sapiens
gaagacggccactgt

SEQ ID NO: 73525 - DNA, 15 bp, Homo sapiens
agaagacggccactg

SEQ ID NO: 73526 - DNA, 15 bp, Homo sapiens
gagaagacggccact

SEQ ID NO: 73527 - DNA, 15 bp, Homo sapiens
tgagaagacggccac

SEQ ID NO: 73528 - DNA, 15 bp, Homo sapiens
gtgagaagacggcca

SEQ ID NO: 73529 - DNA, 15 bp, Homo sapiens
tgtgagaagacggcc

SEQ ID NO: 73530 - DNA, 15 bp, Homo sapiens
ctgtgagaagacggc

SEQ ID NO: 73531 - DNA, 15 bp, Homo sapiens
gctgtgagaagacgg

SEQ ID NO: 73532 - DNA, 15 bp, Homo sapiens
agctgtgagaagacg

SEQ ID NO: 73533 - DNA, 15 bp, Homo sapiens
gagctgtgagaagac

SEQ ID NO: 73534 - DNA, 15 bp, Homo sapiens
ggagctgtgagaaga

SEQ ID NO: 73535 - DNA, 15 bp, Homo sapiens
tggagctgtgagaag

SEQ ID NO: 73536 - DNA, 15 bp, Homo sapiens
gtggagctgtgagaa

SEQ ID NO: 73537 - DNA, 15 bp, Homo sapiens
agtggagctgtgaga

SEQ ID NO: 73538 - DNA, 15 bp, Homo sapiens
tagtggagctgtgag

SEQ ID NO: 73539 - DNA, 15 bp, Homo sapiens
ctagtggagctgtga

SEQ ID NO: 73540 - DNA, 15 bp, Homo sapiens
cctagtggagctgtg

SEQ ID NO: 73541 - DNA, 15 bp, Homo sapiens
acctagtggagctgt

SEQ ID NO: 73542 - DNA, 15 bp, Homo sapiens
cacctagtggagctg

SEQ ID NO: 73543 - DNA, 15 bp, Homo sapiens
ccacctagtggagct

SEQ ID NO: 73544 - DNA, 15 bp, Homo sapiens
accacctagtggagc

SEQ ID NO: 73545 - DNA, 15 bp, Homo sapiens
caccacctagtggag

SEQ ID NO: 73546 - DNA, 15 bp, Homo sapiens
gcaccacctagtgga

SEQ ID NO: 73547 - DNA, 15 bp, Homo sapiens
ggcaccacctagtgg

SEQ ID NO: 73548 - DNA, 15 bp, Homo sapiens
tggcaccacctagtg

SEQ ID NO: 73549 - DNA, 15 bp, Homo sapiens
gtggcaccacctagt

SEQ ID NO: 73550 - DNA, 15 bp, Homo sapiens
tgtggcaccacctag

SEQ ID NO: 73551 - DNA, 15 bp, Homo sapiens
ctgtggcaccaccta

SEQ ID NO: 73552 - DNA, 15 bp, Homo sapiens
actgtggcaccacct

SEQ ID NO: 73553 - DNA, 15 bp, Homo sapiens
tactgtggcaccacc

SEQ ID NO: 73554 - DNA, 15 bp, Homo sapiens
ctactgtggcaccac

SEQ ID NO: 73555 - DNA, 15 bp, Homo sapiens
cctactgtggcacca

SEQ ID NO: 73556 - DNA, 15 bp, Homo sapiens
ccctactgtggcacc

SEQ ID NO: 73557 - DNA, 15 bp, Homo sapiens
tccctactgtggcac

SEQ ID NO: 73558 - DNA, 15 bp, Homo sapiens
gtccctactgtggca

SEQ ID NO: 73559 - DNA, 15 bp, Homo sapiens
agtccctactgtggc

SEQ ID NO: 73560 - DNA, 15 bp, Homo sapiens
gagtccctactgtgg

SEQ ID NO: 73561 - DNA, 15 bp, Homo sapiens
agagtccctactgtg

SEQ ID NO: 73562 - DNA, 15 bp, Homo sapiens
cagagtccctactgt

SEQ ID NO: 73563 - DNA, 15 bp, Homo sapiens
acagagtccctactg

SEQ ID NO: 73564 - DNA, 15 bp, Homo sapiens
aacagagtccctact

SEQ ID NO: 73565 - DNA, 15 bp, Homo sapiens
aaacagagtccctac

SEQ ID NO: 73566 - DNA, 15 bp, Homo sapiens
caaacagagtcccta

SEQ ID NO: 73567 - DNA, 15 bp, Homo sapiens
ccaaacagagtccct

SEQ ID NO: 73568 - DNA, 15 bp, Homo sapiens
cccaaacagagtccc

SEQ ID NO: 73569 - DNA, 15 bp, Homo sapiens
gcccaaacagagtcc

SEQ ID NO: 73570 - DNA, 15 bp, Homo sapiens
ggcccaaacagagtc

SEQ ID NO: 73571 - DNA, 15 bp, Homo sapiens
tggcccaaacagagt

SEQ ID NO: 73572 - DNA, 15 bp, Homo sapiens
gtggcccaaacagag

SEQ ID NO: 73573 - DNA, 15 bp, Homo sapiens
tgtggcccaaacaga

SEQ ID NO: 73574 - DNA, 15 bp, Homo sapiens
atgtggcccaaacag

SEQ ID NO: 73575 - DNA, 15 bp, Homo sapiens
aatgtggcccaaaca

SEQ ID NO: 73576 - DNA, 15 bp, Homo sapiens
aaatgtggcccaaac

SEQ ID NO: 73577 - DNA, 15 bp, Homo sapiens
gaaatgtggcccaaa

SEQ ID NO: 73578 - DNA, 15 bp, Homo sapiens
ggaaatgtggcccaa

SEQ ID NO: 73579 - DNA, 15 bp, Homo sapiens
gggaaatgtggccca

SEQ ID NO: 73580 - DNA, 15 bp, Homo sapiens
agggaaatgtggccc

SEQ ID NO: 73581 - DNA, 15 bp, Homo sapiens
aagggaaatgtggcc

SEQ ID NO: 73582 - DNA, 15 bp, Homo sapiens
gaagggaaatgtggc

SEQ ID NO: 73583 - DNA, 15 bp, Homo sapiens
agaagggaaatgtgg

SEQ ID NO: 73584 - DNA, 15 bp, Homo sapiens
cagaagggaaatgtg

SEQ ID NO: 73585 - DNA, 15 bp, Homo sapiens
gcagaagggaaatgt

SEQ ID NO: 73586 - DNA, 15 bp, Homo sapiens
tgcagaagggaaatg

SEQ ID NO: 73587 - DNA, 15 bp, Homo sapiens
gtgcagaagggaaat

SEQ ID NO: 73588 - DNA, 15 bp, Homo sapiens
agtgcagaagggaaa

SEQ ID NO: 73589 - DNA, 15 bp, Homo sapiens
cagtgcagaagggaa

SEQ ID NO: 73590 - DNA, 15 bp, Homo sapiens
gcagtgcagaaggga

SEQ ID NO: 73591 - DNA, 15 bp, Homo sapiens
ggcagtgcagaaggg

SEQ ID NO: 73592 - DNA, 15 bp, Homo sapiens
gggcagtgcagaagg

SEQ ID NO: 73593 - DNA, 15 bp, Homo sapiens
agggcagtgcagaag

SEQ ID NO: 73594 - DNA, 15 bp, Homo sapiens
tagggcagtgcagaa

SEQ ID NO: 73595 - DNA, 15 bp, Homo sapiens
ctagggcagtgcaga

SEQ ID NO: 73596 - DNA, 15 bp, Homo sapiens
gctagggcagtgcag

SEQ ID NO: 73597 - DNA, 15 bp, Homo sapiens
tgctagggcagtgca

SEQ ID NO: 73598 - DNA, 15 bp, Homo sapiens
ctgctagggcagtgc

SEQ ID NO: 73599 - DNA, 15 bp, Homo sapiens
tctgctagggcagtg

SEQ ID NO: 73600 - DNA, 15 bp, Homo sapiens
ctctgctagggcagt

SEQ ID NO: 73601 - DNA, 15 bp, Homo sapiens
cctctgctagggcag

SEQ ID NO: 73602 - DNA, 15 bp, Homo sapiens
acctctgctagggca

SEQ ID NO: 73603 - DNA, 15 bp, Homo sapiens
aacctctgctagggc

SEQ ID NO: 73604 - DNA, 15 bp, Homo sapiens
gaacctctgctaggg

SEQ ID NO: 73605 - DNA, 15 bp, Homo sapiens
agaacctctgctagg

SEQ ID NO: 73606 - DNA, 15 bp, Homo sapiens
gagaacctctgctag

SEQ ID NO: 73607 - DNA, 15 bp, Homo sapiens
ggagaacctctgcta

SEQ ID NO: 73608 - DNA, 15 bp, Homo sapiens
tggagaacctctgct

SEQ ID NO: 73609 - DNA, 15 bp, Homo sapiens
atggagaacctctgc

SEQ ID NO: 73610 - DNA, 15 bp, Homo sapiens
catggagaacctctg

SEQ ID NO: 73611 - DNA, 15 bp, Homo sapiens
tcatggagaacctct

SEQ ID NO: 73612 - DNA, 15 bp, Homo sapiens
ctcatggagaacctc

SEQ ID NO: 73613 - DNA, 15 bp, Homo sapiens
tctcatggagaacct

SEQ ID NO: 73614 - DNA, 15 bp, Homo sapiens
ctctcatggagaacc

SEQ ID NO: 73615 - DNA, 15 bp, Homo sapiens
gctctcatggagaac

SEQ ID NO: 73616 - DNA, 15 bp, Homo sapiens
ggctctcatggagaa

SEQ ID NO: 73617 - DNA, 15 bp, Homo sapiens
gggctctcatggaga

SEQ ID NO: 73618 - DNA, 15 bp, Homo sapiens
ggggctctcatggag

SEQ ID NO: 73619 - DNA, 15 bp, Homo sapiens
tggggctctcatgga

SEQ ID NO: 73620 - DNA, 15 bp, Homo sapiens
gtggggctctcatgg

SEQ ID NO: 73621 - DNA, 15 bp, Homo sapiens
ggtggggctctcatg

SEQ ID NO: 73622 - DNA, 15 bp, Homo sapiens
aggtggggctctcat

SEQ ID NO: 73623 - DNA, 15 bp, Homo sapiens
gaggtggggctctca

SEQ ID NO: 73624 - DNA, 15 bp, Homo sapiens
agaggtggggctctc

SEQ ID NO: 73625 - DNA, 15 bp, Homo sapiens
cagaggtggggctct

SEQ ID NO: 73626 - DNA, 15 bp, Homo sapiens
gcagaggtggggctc

SEQ ID NO: 73627 - DNA, 15 bp, Homo sapiens
tgcagaggtggggct

SEQ ID NO: 73628 - DNA, 15 bp, Homo sapiens
ctgcagaggtggggc

SEQ ID NO: 73629 - DNA, 15 bp, Homo sapiens
gctgcagaggtgggg

SEQ ID NO: 73630 - DNA, 15 bp, Homo sapiens
tgctgcagaggtggg

SEQ ID NO: 73631 - DNA, 15 bp, Homo sapiens
ttgctgcagaggtgg

SEQ ID NO: 73632 - DNA, 15 bp, Homo sapiens
tttgctgcagaggtg

SEQ ID NO: 73633 - DNA, 15 bp, Homo sapiens
gtttgctgcagaggt

SEQ ID NO: 73634 - DNA, 15 bp, Homo sapiens
agtttgctgcagagg

SEQ ID NO: 73635 - DNA, 15 bp, Homo sapiens
aagtttgctgcagag

SEQ ID NO: 73636 - DNA, 15 bp, Homo sapiens
gaagtttgctgcaga

SEQ ID NO: 73637 - DNA, 15 bp, Homo sapiens
agaagtttgctgcag

SEQ ID NO: 73638 - DNA, 15 bp, Homo sapiens
cagaagtttgctgca

SEQ ID NO: 73639 - DNA, 15 bp, Homo sapiens
gcagaagtttgctgc

SEQ ID NO: 73640 - DNA, 15 bp, Homo sapiens
ggcagaagtttgctg

SEQ ID NO: 73641 - DNA, 15 bp, Homo sapiens
aggcagaagtttgct

SEQ ID NO: 73642 - DNA, 15 bp, Homo sapiens
caggcagaagtttgc

SEQ ID NO: 73643 - DNA, 15 bp, Homo sapiens
ccaggcagaagtttg

SEQ ID NO: 73644 - DNA, 15 bp, Homo sapiens
tccaggcagaagttt

SEQ ID NO: 73645 - DNA, 15 bp, Homo sapiens
gtccaggcagaagtt

SEQ ID NO: 73646 - DNA, 15 bp, Homo sapiens
tgtccaggcagaagt

SEQ ID NO: 73647 - DNA, 15 bp, Homo sapiens
atgtccaggcagaag

SEQ ID NO: 73648 - DNA, 15 bp, Homo sapiens
gatgtccaggcagaa

SEQ ID NO: 73649 - DNA, 15 bp, Homo sapiens
ggatgtccaggcaga

SEQ ID NO: 73650 - DNA, 15 bp, Homo sapiens
tggatgtccaggcag

SEQ ID NO: 73651 - DNA, 15 bp, Homo sapiens
gtggatgtccaggca

SEQ ID NO: 73652 - DNA, 15 bp, Homo sapiens
cgtggatgtccaggc

SEQ ID NO: 73653 - DNA, 15 bp, Homo sapiens
acgtggatgtccagg

SEQ ID NO: 73654 - DNA, 15 bp, Homo sapiens
cacgtggatgtccag

SEQ ID NO: 73655 - DNA, 15 bp, Homo sapiens
acacgtggatgtcca

SEQ ID NO: 73656 - DNA, 15 bp, Homo sapiens
aacacgtggatgtcc

SEQ ID NO: 73657 - DNA, 15 bp, Homo sapiens
aaacacgtggatgtc

SEQ ID NO: 73658 - DNA, 15 bp, Homo sapiens
gaaacacgtggatgt

SEQ ID NO: 73659 - DNA, 15 bp, Homo sapiens
ggaaacacgtggatg

SEQ ID NO: 73660 - DNA, 15 bp, Homo sapiens
tggaaacacgtggat

SEQ ID NO: 73661 - DNA, 15 bp, Homo sapiens
atggaaacacgtgga

SEQ ID NO: 73662 - DNA, 15 bp, Homo sapiens
tatggaaacacgtgg

SEQ ID NO: 73663 - DNA, 15 bp, Homo sapiens
gtatggaaacacgtg

SEQ ID NO: 73664 - DNA, 15 bp, Homo sapiens
tgtatggaaacacgt

SEQ ID NO: 73665 - DNA, 15 bp, Homo sapiens
atgtatggaaacacg

SEQ ID NO: 73666 - DNA, 15 bp, Homo sapiens
gatgtatggaaacac

SEQ ID NO: 73667 - DNA, 15 bp, Homo sapiens
ggatgtatggaaaca

SEQ ID NO: 73668 - DNA, 15 bp, Homo sapiens
aggatgtatggaaac

SEQ ID NO: 73669 - DNA, 15 bp, Homo sapiens
gaggatgtatggaaa

SEQ ID NO: 73670 - DNA, 15 bp, Homo sapiens
agaggatgtatggaa

SEQ ID NO: 73671 - DNA, 15 bp, Homo sapiens
cagaggatgtatgga

SEQ ID NO: 73672 - DNA, 15 bp, Homo sapiens
tcagaggatgtatgg

SEQ ID NO: 73673 - DNA, 15 bp, Homo sapiens
ttcagaggatgtatg

SEQ ID NO: 73674 - DNA, 15 bp, Homo sapiens
tttcagaggatgtat

SEQ ID NO: 73675 - DNA, 15 bp, Homo sapiens
atttcagaggatgta

SEQ ID NO: 73676 - DNA, 15 bp, Homo sapiens
gatttcagaggatgt

SEQ ID NO: 73677 - DNA, 15 bp, Homo sapiens
agatttcagaggatg

SEQ ID NO: 73678 - DNA, 15 bp, Homo sapiens
tagatttcagaggat

SEQ ID NO: 73679 - DNA, 15 bp, Homo sapiens
ctagatttcagagga

SEQ ID NO: 73680 - DNA, 15 bp, Homo sapiens
cctagatttcagagg

SEQ ID NO: 73681 - DNA, 15 bp, Homo sapiens
acctagatttcagag

SEQ ID NO: 73682 - DNA, 15 bp, Homo sapiens
cacctagatttcaga

SEQ ID NO: 73683 - DNA, 15 bp, Homo sapiens
ccacctagatttcag

SEQ ID NO: 73684 - DNA, 15 bp, Homo sapiens
tccacctagatttca

SEQ ID NO: 73685 - DNA, 15 bp, Homo sapiens
atccacctagatttc

SEQ ID NO: 73686 - DNA, 15 bp, Homo sapiens
catccacctagattt

SEQ ID NO: 73687 - DNA, 15 bp, Homo sapiens
acatccacctagatt

SEQ ID NO: 73688 - DNA, 15 bp, Homo sapiens
aacatccacctagat

SEQ ID NO: 73689 - DNA, 15 bp, Homo sapiens
gaacatccacctaga

SEQ ID NO: 73690 - DNA, 15 bp, Homo sapiens
ggaacatccacctag

SEQ ID NO: 73691 - DNA, 15 bp, Homo sapiens
gggaacatccaccta

SEQ ID NO: 73692 - DNA, 15 bp, Homo sapiens
tgggaacatccacct

SEQ ID NO: 73693 - DNA, 15 bp, Homo sapiens
ttgggaacatccacc

SEQ ID NO: 73694 - DNA, 15 bp, Homo sapiens
tttgggaacatccac

SEQ ID NO: 73695 - DNA, 15 bp, Homo sapiens
gtttgggaacatcca

SEQ ID NO: 73696 - DNA, 15 bp, Homo sapiens
ggtttgggaacatcc

SEQ ID NO: 73697 - DNA, 15 bp, Homo sapiens
aggtttgggaacatc

SEQ ID NO: 73698 - DNA, 15 bp, Homo sapiens
gaggtttgggaacat

SEQ ID NO: 73699 - DNA, 15 bp, Homo sapiens
tgaggtttgggaaca

SEQ ID NO: 73700 - DNA, 15 bp, Homo sapiens
ttgaggtttgggaac

SEQ ID NO: 73701 - DNA, 15 bp, Homo sapiens
attgaggtttgggaa

SEQ ID NO: 73702 - DNA, 15 bp, Homo sapiens
aattgaggtttggga

SEQ ID NO: 73703 - DNA, 15 bp, Homo sapiens
gaattgaggtttggg

SEQ ID NO: 73704 - DNA, 15 bp, Homo sapiens
agaattgaggtttgg

SEQ ID NO: 73705 - DNA, 15 bp, Homo sapiens
aagaattgaggtttg

SEQ ID NO: 73706 - DNA, 15 bp, Homo sapiens
caagaattgaggttt

SEQ ID NO: 73707 - DNA, 15 bp, Homo sapiens
tcaagaattgaggtt

SEQ ID NO: 73708 - DNA, 15 bp, Homo sapiens
gtcaagaattgaggt

SEQ ID NO: 73709 - DNA, 15 bp, Homo sapiens
agtcaagaattgagg

SEQ ID NO: 73710 - DNA, 15 bp, Homo sapiens
aagtcaagaattgag

SEQ ID NO: 73711 - DNA, 15 bp, Homo sapiens
gaagtcaagaattga

SEQ ID NO: 73712 - DNA, 15 bp, Homo sapiens
agaagtcaagaattg

SEQ ID NO: 73713 - DNA, 15 bp, Homo sapiens
cagaagtcaagaatt

SEQ ID NO: 73714 - DNA, 15 bp, Homo sapiens
acagaagtcaagaat

SEQ ID NO: 73715 - DNA, 15 bp, Homo sapiens
cacagaagtcaagaa

SEQ ID NO: 73716 - DNA, 15 bp, Homo sapiens
acacagaagtcaaga

SEQ ID NO: 73717 - DNA, 15 bp, Homo sapiens
tacacagaagtcaag

SEQ ID NO: 73718 - DNA, 15 bp, Homo sapiens
gtacacagaagtcaa

SEQ ID NO: 73719 - DNA, 15 bp, Homo sapiens
ggtacacagaagtca

SEQ ID NO: 73720 - DNA, 15 bp, Homo sapiens
gggtacacagaagtc

SEQ ID NO: 73721 - DNA, 15 bp, Homo sapiens
cgggtacacagaagt

SEQ ID NO: 73722 - DNA, 15 bp, Homo sapiens
gcgggtacacagaag

SEQ ID NO: 73723 - DNA, 15 bp, Homo sapiens
tgcgggtacacagaa

SEQ ID NO: 73724 - DNA, 15 bp, Homo sapiens
ctgcgggtacacaga

SEQ ID NO: 73725 - DNA, 15 bp, Homo sapiens
cctgcgggtacacag

SEQ ID NO: 73726 - DNA, 15 bp, Homo sapiens
gcctgcgggtacaca

SEQ ID NO: 73727 - DNA, 15 bp, Homo sapiens
agcctgcgggtacac

SEQ ID NO: 73728 - DNA, 15 bp, Homo sapiens
gagcctgcgggtaca

SEQ ID NO: 73729 - DNA, 15 bp, Homo sapiens
tgagcctgcgggtac

SEQ ID NO: 73730 - DNA, 15 bp, Homo sapiens
ttgagcctgcgggta

SEQ ID NO: 73731 - DNA, 15 bp, Homo sapiens
gttgagcctgcgggt

SEQ ID NO: 73732 - DNA, 15 bp, Homo sapiens
tgttgagcctgcggg

SEQ ID NO: 73733 - DNA, 15 bp, Homo sapiens
gtgttgagcctgcgg

SEQ ID NO: 73734 - DNA, 15 bp, Homo sapiens
ggtgttgagcctgcg

SEQ ID NO: 73735 - DNA, 15 bp, Homo sapiens
tggtgttgagcctgc

SEQ ID NO: 73736 - DNA, 15 bp, Homo sapiens
gtggtgttgagcctg

SEQ ID NO: 73737 - DNA, 15 bp, Homo sapiens
tgtggtgttgagcct

SEQ ID NO: 73738 - DNA, 15 bp, Homo sapiens
atgtggtgttgagcc

SEQ ID NO: 73739 - DNA, 15 bp, Homo sapiens
catgtggtgttgagc

SEQ ID NO: 73740 - DNA, 15 bp, Homo sapiens
ccatgtggtgttgag

SEQ ID NO: 73741 - DNA, 15 bp, Homo sapiens
tccatgtggtgttga

SEQ ID NO: 73742 - DNA, 15 bp, Homo sapiens
ttccatgtggtgttg

SEQ ID NO: 73743 - DNA, 15 bp, Homo sapiens
cttccatgtggtgtt

SEQ ID NO: 73744 - DNA, 15 bp, Homo sapiens
gcttccatgtggtgt

SEQ ID NO: 73745 - DNA, 15 bp, Homo sapiens
agcttccatgtggtg

SEQ ID NO: 73746 - DNA, 15 bp, Homo sapiens
cagcttccatgtggt

SEQ ID NO: 73747 - DNA, 15 bp, Homo sapiens
gcagcttccatgtgg

SEQ ID NO: 73748 - DNA, 15 bp, Homo sapiens
ggcagcttccatgtg

SEQ ID NO: 73749 - DNA, 15 bp, Homo sapiens
tggcagcttccatgt

SEQ ID NO: 73750 - DNA, 15 bp, Homo sapiens
ttggcagcttccatg

SEQ ID NO: 73751 - DNA, 15 bp, Homo sapiens
cttggcagcttccat

SEQ ID NO: 73752 - DNA, 15 bp, Homo sapiens
ccttggcagcttcca

SEQ ID NO: 73753 - DNA, 15 bp, Homo sapiens
gccttggcagcttcc

SEQ ID NO: 73754 - DNA, 15 bp, Homo sapiens
agccttggcagcttc

SEQ ID NO: 73755 - DNA, 15 bp, Homo sapiens
aagccttggcagctt

SEQ ID NO: 73756 - DNA, 15 bp, Homo sapiens
caagccttggcagct

SEQ ID NO: 73757 - DNA, 15 bp, Homo sapiens
acaagccttggcagc

SEQ ID NO: 73758 - DNA, 15 bp, Homo sapiens
cacaagccttggcag

SEQ ID NO: 73759 - DNA, 15 bp, Homo sapiens
ccacaagccttggca

SEQ ID NO: 73760 - DNA, 15 bp, Homo sapiens
gccacaagccttggc

SEQ ID NO: 73761 - DNA, 15 bp, Homo sapiens
agccacaagccttgg

SEQ ID NO: 73762 - DNA, 15 bp, Homo sapiens
aagccacaagccttg

SEQ ID NO: 73763 - DNA, 15 bp, Homo sapiens
caagccacaagcctt

SEQ ID NO: 73764 - DNA, 15 bp, Homo sapiens
gcaagccacaagcct

SEQ ID NO: 73765 - DNA, 15 bp, Homo sapiens
tgcaagccacaagcc

SEQ ID NO: 73766 - DNA, 15 bp, Homo sapiens
gtgcaagccacaagc

SEQ ID NO: 73767 - DNA, 15 bp, Homo sapiens
ggtgcaagccacaag

SEQ ID NO: 73768 - DNA, 15 bp, Homo sapiens
aggtgcaagccacaa

SEQ ID NO: 73769 - DNA, 15 bp, Homo sapiens
aaggtgcaagccaca

SEQ ID NO: 73770 - DNA, 15 bp, Homo sapiens
aaaggtgcaagccac

SEQ ID NO: 73771 - DNA, 15 bp, Homo sapiens
caaaggtgcaagcca

SEQ ID NO: 73772 - DNA, 15 bp, Homo sapiens
gcaaaggtgcaagcc

SEQ ID NO: 73773 - DNA, 15 bp, Homo sapiens
ggcaaaggtgcaagc

SEQ ID NO: 73774 - DNA, 15 bp, Homo sapiens
tggcaaaggtgcaag

SEQ ID NO: 73775 - DNA, 15 bp, Homo sapiens
atggcaaaggtgcaa

SEQ ID NO: 73776 - DNA, 15 bp, Homo sapiens
catggcaaaggtgca

SEQ ID NO: 73777 - DNA, 15 bp, Homo sapiens
ccatggcaaaggtgc

SEQ ID NO: 73778 - DNA, 15 bp, Homo sapiens
gccatggcaaaggtg

SEQ ID NO: 73779 - DNA, 15 bp, Homo sapiens
ggccatggcaaaggt

SEQ ID NO: 73780 - DNA, 15 bp, Homo sapiens
aggccatggcaaagg

SEQ ID NO: 73781 - DNA, 15 bp, Homo sapiens
caggccatggcaaag

SEQ ID NO: 73782 - DNA, 15 bp, Homo sapiens
tcaggccatggcaaa

SEQ ID NO: 73783 - DNA, 15 bp, Homo sapiens
ctcaggccatggcaa

SEQ ID NO: 73784 - DNA, 15 bp, Homo sapiens
gctcaggccatggca

SEQ ID NO: 73785 - DNA, 15 bp, Homo sapiens
agctcaggccatggc

SEQ ID NO: 73786 - DNA, 15 bp, Homo sapiens
cagctcaggccatgg

SEQ ID NO: 73787 - DNA, 15 bp, Homo sapiens
acagctcaggccatg

SEQ ID NO: 73788 - DNA, 15 bp, Homo sapiens
tacagctcaggccat

SEQ ID NO: 73789 - DNA, 15 bp, Homo sapiens
gtacagctcaggcca

SEQ ID NO: 73790 - DNA, 15 bp, Homo sapiens
ggtacagctcaggcc

SEQ ID NO: 73791 - DNA, 15 bp, Homo sapiens
aggtacagctcaggc

SEQ ID NO: 73792 - DNA, 15 bp, Homo sapiens
aaggtacagctcagg

SEQ ID NO: 73793 - DNA, 15 bp, Homo sapiens
aaaggtacagctcag

SEQ ID NO: 73794 - DNA, 15 bp, Homo sapiens
caaaggtacagctca

SEQ ID NO: 73795 - DNA, 15 bp, Homo sapiens
gcaaaggtacagctc

SEQ ID NO: 73796 - DNA, 15 bp, Homo sapiens
ggcaaaggtacagct

SEQ ID NO: 73797 - DNA, 15 bp, Homo sapiens
gggcaaaggtacagc

SEQ ID NO: 73798 - DNA, 15 bp, Homo sapiens
ggggcaaaggtacag

SEQ ID NO: 73799 - DNA, 15 bp, Homo sapiens
aggggcaaaggtaca

SEQ ID NO: 73800 - DNA, 15 bp, Homo sapiens
aaggggcaaaggtac

SEQ ID NO: 73801 - DNA, 15 bp, Homo sapiens
aaaggggcaaaggta

SEQ ID NO: 73802 - DNA, 15 bp, Homo sapiens
aaaaggggcaaaggt

SEQ ID NO: 73803 - DNA, 15 bp, Homo sapiens
taaaaggggcaaagg

SEQ ID NO: 73804 - DNA, 15 bp, Homo sapiens
ctaaaaggggcaaag

SEQ ID NO: 73805 - DNA, 15 bp, Homo sapiens
actaaaaggggcaaa

SEQ ID NO: 73806 - DNA, 15 bp, Homo sapiens
gactaaaaggggcaa

SEQ ID NO: 73807 - DNA, 15 bp, Homo sapiens
tgactaaaaggggca

SEQ ID NO: 73808 - DNA, 15 bp, Homo sapiens
atgactaaaaggggc

SEQ ID NO: 73809 - DNA, 15 bp, Homo sapiens
catgactaaaagggg

SEQ ID NO: 73810 - DNA, 15 bp, Homo sapiens
ccatgactaaaaggg

SEQ ID NO: 73811 - DNA, 15 bp, Homo sapiens
gccatgactaaaagg

SEQ ID NO: 73812 - DNA, 15 bp, Homo sapiens
agccatgactaaaag

SEQ ID NO: 73813 - DNA, 15 bp, Homo sapiens
cagccatgactaaaa

SEQ ID NO: 73814 - DNA, 15 bp, Homo sapiens
ccagccatgactaaa

SEQ ID NO: 73815 - DNA, 15 bp, Homo sapiens
tccagccatgactaa

SEQ ID NO: 73816 - DNA, 15 bp, Homo sapiens
ctccagccatgacta

SEQ ID NO: 73817 - DNA, 15 bp, Homo sapiens
gctccagccatgact

SEQ ID NO: 73818 - DNA, 15 bp, Homo sapiens
tgctccagccatgac

SEQ ID NO: 73819 - DNA, 15 bp, Homo sapiens
ctgctccagccatga

SEQ ID NO: 73820 - DNA, 15 bp, Homo sapiens
gctgctccagccatg

SEQ ID NO: 73821 - DNA, 15 bp, Homo sapiens
agctgctccagccat

SEQ ID NO: 73822 - DNA, 15 bp, Homo sapiens
cagctgctccagcca

SEQ ID NO: 73823 - DNA, 15 bp, Homo sapiens
ccagctgctccagcc

SEQ ID NO: 73824 - DNA, 15 bp, Homo sapiens
cccagctgctccagc

SEQ ID NO: 73825 - DNA, 15 bp, Homo sapiens
tcccagctgctccag

SEQ ID NO: 73826 - DNA, 15 bp, Homo sapiens
atcccagctgctcca

SEQ ID NO: 73827 - DNA, 15 bp, Homo sapiens
catcccagctgctcc

SEQ ID NO: 73828 - DNA, 15 bp, Homo sapiens
gcatcccagctgctc

SEQ ID NO: 73829 - DNA, 15 bp, Homo sapiens
tgcatcccagctgct

SEQ ID NO: 73830 - DNA, 15 bp, Homo sapiens
ctgcatcccagctgc

SEQ ID NO: 73831 - DNA, 15 bp, Homo sapiens
cctgcatcccagctg

SEQ ID NO: 73832 - DNA, 15 bp, Homo sapiens
ccctgcatcccagct

SEQ ID NO: 73833 - DNA, 15 bp, Homo sapiens
gccctgcatcccagc

SEQ ID NO: 73834 - DNA, 15 bp, Homo sapiens
tgccctgcatcccag

SEQ ID NO: 73835 - DNA, 15 bp, Homo sapiens
gtgccctgcatccca

SEQ ID NO: 73836 - DNA, 15 bp, Homo sapiens
ggtgccctgcatccc

SEQ ID NO: 73837 - DNA, 15 bp, Homo sapiens
tggtgccctgcatcc

SEQ ID NO: 73838 - DNA, 15 bp, Homo sapiens
ttggtgccctgcatc

SEQ ID NO: 73839 - DNA, 15 bp, Homo sapiens
cttggtgccctgcat

SEQ ID NO: 73840 - DNA, 15 bp, Homo sapiens
acttggtgccctgca

SEQ ID NO: 73841 - DNA, 15 bp, Homo sapiens
tacttggtgccctgc

SEQ ID NO: 73842 - DNA, 15 bp, Homo sapiens
gtacttggtgccctg

SEQ ID NO: 73843 - DNA, 15 bp, Homo sapiens
ggtacttggtgccct

SEQ ID NO: 73844 - DNA, 15 bp, Homo sapiens
aggtacttggtgccc

SEQ ID NO: 73845 - DNA, 15 bp, Homo sapiens
taggtacttggtgcc

SEQ ID NO: 73846 - DNA, 15 bp, Homo sapiens
ctaggtacttggtgc

SEQ ID NO: 73847 - DNA, 15 bp, Homo sapiens
gctaggtacttggtg

SEQ ID NO: 73848 - DNA, 15 bp, Homo sapiens
ggctaggtacttggt

SEQ ID NO: 73849 - DNA, 15 bp, Homo sapiens
tggctaggtacttgg

SEQ ID NO: 73850 - DNA, 15 bp, Homo sapiens
gtggctaggtacttg

SEQ ID NO: 73851 - DNA, 15 bp, Homo sapiens
tgtggctaggtactt

SEQ ID NO: 73852 - DNA, 15 bp, Homo sapiens
ttgtggctaggtact

SEQ ID NO: 73853 - DNA, 15 bp, Homo sapiens
cttgtggctaggtac

SEQ ID NO: 73854 - DNA, 15 bp, Homo sapiens
ccttgtggctaggta

SEQ ID NO: 73855 - DNA, 15 bp, Homo sapiens
gccttgtggctaggt

SEQ ID NO: 73856 - DNA, 15 bp, Homo sapiens
tgccttgtggctagg

SEQ ID NO: 73857 - DNA, 15 bp, Homo sapiens
gtgccttgtggctag

SEQ ID NO: 73858 - DNA, 15 bp, Homo sapiens
cgtgccttgtggcta

SEQ ID NO: 73859 - DNA, 15 bp, Homo sapiens
ccgtgccttgtggct

SEQ ID NO: 73860 - DNA, 15 bp, Homo sapiens
cccgtgccttgtggc

SEQ ID NO: 73861 - DNA, 15 bp, Homo sapiens
ccccgtgccttgtgg

SEQ ID NO: 73862 - DNA, 15 bp, Homo sapiens
tccccgtgccttgtg

SEQ ID NO: 73863 - DNA, 15 bp, Homo sapiens
gtccccgtgccttgt

SEQ ID NO: 73864 - DNA, 15 bp, Homo sapiens
ggtccccgtgccttg

SEQ ID NO: 73865 - DNA, 15 bp, Homo sapiens
gggtccccgtgcctt

SEQ ID NO: 73866 - DNA, 15 bp, Homo sapiens
agggtccccgtgcct

SEQ ID NO: 73867 - DNA, 15 bp, Homo sapiens
cagggtccccgtgcc

SEQ ID NO: 73868 - DNA, 15 bp, Homo sapiens
tcagggtccccgtgc

SEQ ID NO: 73869 - DNA, 15 bp, Homo sapiens
ctcagggtccccgtg

SEQ ID NO: 73870 - DNA, 15 bp, Homo sapiens
gctcagggtccccgt

SEQ ID NO: 73871 - DNA, 15 bp, Homo sapiens
ggctcagggtccccg

SEQ ID NO: 73872 - DNA, 15 bp, Homo sapiens
gggctcagggtcccc

SEQ ID NO: 73873 - DNA, 15 bp, Homo sapiens
tgggctcagggtccc

SEQ ID NO: 73874 - DNA, 15 bp, Homo sapiens
ctgggctcagggtcc

SEQ ID NO: 73875 - DNA, 15 bp, Homo sapiens
gctgggctcagggtc

SEQ ID NO: 73876 - DNA, 15 bp, Homo sapiens
ggctgggctcagggt

SEQ ID NO: 73877 - DNA, 15 bp, Homo sapiens
gggctgggctcaggg

SEQ ID NO: 73878 - DNA, 15 bp, Homo sapiens
tgggctgggctcagg

SEQ ID NO: 73879 - DNA, 15 bp, Homo sapiens
gtgggctgggctcag

SEQ ID NO: 73880 - DNA, 15 bp, Homo sapiens
tgtgggctgggctca

SEQ ID NO: 73881 - DNA, 15 bp, Homo sapiens
ttgtgggctgggctc

SEQ ID NO: 73882 - DNA, 15 bp, Homo sapiens
tttgtgggctgggct

SEQ ID NO: 73883 - DNA, 15 bp, Homo sapiens
ttttgtgggctgggc

SEQ ID NO: 73884 - DNA, 15 bp, Homo sapiens
gttttgtgggctggg

SEQ ID NO: 73885 - DNA, 15 bp, Homo sapiens
ggttttgtgggctgg

SEQ ID NO: 73886 - DNA, 15 bp, Homo sapiens
tggttttgtgggctg

SEQ ID NO: 73887 - DNA, 15 bp, Homo sapiens
atggttttgtgggct

SEQ ID NO: 73888 - DNA, 15 bp, Homo sapiens
aatggttttgtgggc

SEQ ID NO: 73889 - DNA, 15 bp, Homo sapiens
aaatggttttgtggg

SEQ ID NO: 73890 - DNA, 15 bp, Homo sapiens
aaaatggttttgtgg

SEQ ID NO: 73891 - DNA, 15 bp, Homo sapiens
aaaaatggttttgtg

SEQ ID NO: 73892 - DNA, 15 bp, Homo sapiens
aaaaaatggttttgt

SEQ ID NO: 73893 - DNA, 15 bp, Homo sapiens
gaaaaaatggttttg

SEQ ID NO: 73894 - DNA, 15 bp, Homo sapiens
ggaaaaaatggtttt

SEQ ID NO: 73895 - DNA, 15 bp, Homo sapiens
aggaaaaaatggttt

SEQ ID NO: 73896 - DNA, 15 bp, Homo sapiens
gaggaaaaaatggtt

SEQ ID NO: 73897 - DNA, 15 bp, Homo sapiens
ggaggaaaaaatggt

SEQ ID NO: 73898 - DNA, 15 bp, Homo sapiens
aggaggaaaaaatgg

SEQ ID NO: 73899 - DNA, 15 bp, Homo sapiens
taggaggaaaaaatg

SEQ ID NO: 73900 - DNA, 15 bp, Homo sapiens
ctaggaggaaaaaat

SEQ ID NO: 73901 - DNA, 15 bp, Homo sapiens
cctaggaggaaaaaa

SEQ ID NO: 73902 - DNA, 15 bp, Homo sapiens
gcctaggaggaaaaa

SEQ ID NO: 73903 - DNA, 15 bp, Homo sapiens
ggcctaggaggaaaa

SEQ ID NO: 73904 - DNA, 15 bp, Homo sapiens
aggcctaggaggaaa

SEQ ID NO: 73905 - DNA, 15 bp, Homo sapiens
gaggcctaggaggaa

SEQ ID NO: 73906 - DNA, 15 bp, Homo sapiens
agaggcctaggagga

SEQ ID NO: 73907 - DNA, 15 bp, Homo sapiens
cagaggcctaggagg

SEQ ID NO: 73908 - DNA, 15 bp, Homo sapiens
ccagaggcctaggag

SEQ ID NO: 73909 - DNA, 15 bp, Homo sapiens
cccagaggcctagga

SEQ ID NO: 73910 - DNA, 15 bp, Homo sapiens
gcccagaggcctagg

SEQ ID NO: 73911 - DNA, 15 bp, Homo sapiens
agcccagaggcctag

SEQ ID NO: 73912 - DNA, 15 bp, Homo sapiens
aagcccagaggccta

SEQ ID NO: 73913 - DNA, 15 bp, Homo sapiens
caagcccagaggcct

SEQ ID NO: 73914 - DNA, 15 bp, Homo sapiens
acaagcccagaggcc

SEQ ID NO: 73915 - DNA, 15 bp, Homo sapiens
cacaagcccagaggc

SEQ ID NO: 73916 - DNA, 15 bp, Homo sapiens
tcacaagcccagagg

SEQ ID NO: 73917 - DNA, 15 bp, Homo sapiens
atcacaagcccagag

SEQ ID NO: 73918 - DNA, 15 bp, Homo sapiens
catcacaagcccaga

SEQ ID NO: 73919 - DNA, 15 bp, Homo sapiens
ccatcacaagcccag

SEQ ID NO: 73920 - DNA, 15 bp, Homo sapiens
cccatcacaagccca

SEQ ID NO: 73921 - DNA, 15 bp, Homo sapiens
tcccatcacaagccc

SEQ ID NO: 73922 - DNA, 15 bp, Homo sapiens
ctcccatcacaagcc

SEQ ID NO: 73923 - DNA, 15 bp, Homo sapiens
cctcccatcacaagc

SEQ ID NO: 73924 - DNA, 15 bp, Homo sapiens
ccctcccatcacaag

SEQ ID NO: 73925 - DNA, 15 bp, Homo sapiens
cccctcccatcacaa

SEQ ID NO: 73926 - DNA, 15 bp, Homo sapiens
gcccctcccatcaca

SEQ ID NO: 73927 - DNA, 15 bp, Homo sapiens
agcccctcccatcac

SEQ ID NO: 73928 - DNA, 15 bp, Homo sapiens
cagcccctcccatca

SEQ ID NO: 73929 - DNA, 15 bp, Homo sapiens
tcagcccctcccatc

SEQ ID NO: 73930 - DNA, 15 bp, Homo sapiens
atcagcccctcccat

SEQ ID NO: 73931 - DNA, 15 bp, Homo sapiens
catcagcccctccca

SEQ ID NO: 73932 - DNA, 15 bp, Homo sapiens
acatcagcccctccc

SEQ ID NO: 73933 - DNA, 15 bp, Homo sapiens
cacatcagcccctcc

SEQ ID NO: 73934 - DNA, 15 bp, Homo sapiens
tcacatcagcccctc

SEQ ID NO: 73935 - DNA, 15 bp, Homo sapiens
ttcacatcagcccct

SEQ ID NO: 73936 - DNA, 15 bp, Homo sapiens
cttcacatcagcccc

SEQ ID NO: 73937 - DNA, 15 bp, Homo sapiens
tcttcacatcagccc

SEQ ID NO: 73938 - DNA, 15 bp, Homo sapiens
gtcttcacatcagcc

SEQ ID NO: 73939 - DNA, 15 bp, Homo sapiens
ggtcttcacatcagc

SEQ ID NO: 73940 - DNA, 15 bp, Homo sapiens
aggtcttcacatcag

SEQ ID NO: 73941 - DNA, 15 bp, Homo sapiens
gaggtcttcacatca

SEQ ID NO: 73942 - DNA, 15 bp, Homo sapiens
agaggtcttcacatc

SEQ ID NO: 73943 - DNA, 15 bp, Homo sapiens
cagaggtcttcacat

SEQ ID NO: 73944 - DNA, 15 bp, Homo sapiens
tcagaggtcttcaca

SEQ ID NO: 73945 - DNA, 15 bp, Homo sapiens
gtcagaggtcttcac

SEQ ID NO: 73946 - DNA, 15 bp, Homo sapiens
tgtcagaggtcttca

SEQ ID NO: 73947 - DNA, 15 bp, Homo sapiens
atgtcagaggtcttc

SEQ ID NO: 73948 - DNA, 15 bp, Homo sapiens
catgtcagaggtctt

SEQ ID NO: 73949 - DNA, 15 bp, Homo sapiens
gcatgtcagaggtct

SEQ ID NO: 73950 - DNA, 15 bp, Homo sapiens
ggcatgtcagaggtc

SEQ ID NO: 73951 - DNA, 15 bp, Homo sapiens
aggcatgtcagaggt

SEQ ID NO: 73952 - DNA, 15 bp, Homo sapiens
caggcatgtcagagg

SEQ ID NO: 73953 - DNA, 15 bp, Homo sapiens
ccaggcatgtcagag

SEQ ID NO: 73954 - DNA, 15 bp, Homo sapiens
tccaggcatgtcaga

SEQ ID NO: 73955 - DNA, 15 bp, Homo sapiens
ctccaggcatgtcag

SEQ ID NO: 73956 - DNA, 15 bp, Homo sapiens
tctccaggcatgtca

SEQ ID NO: 73957 - DNA, 15 bp, Homo sapiens
atctccaggcatgtc

SEQ ID NO: 73958 - DNA, 15 bp, Homo sapiens
catctccaggcatgt

SEQ ID NO: 73959 - DNA, 15 bp, Homo sapiens
acatctccaggcatg

SEQ ID NO: 73960 - DNA, 15 bp, Homo sapiens
aacatctccaggcat

SEQ ID NO: 73961 - DNA, 15 bp, Homo sapiens
aaacatctccaggca

SEQ ID NO: 73962 - DNA, 15 bp, Homo sapiens
aaaacatctccaggc

SEQ ID NO: 73963 - DNA, 15 bp, Homo sapiens
gaaaacatctccagg

SEQ ID NO: 73964 - DNA, 15 bp, Homo sapiens
ggaaaacatctccag

SEQ ID NO: 73965 - DNA, 15 bp, Homo sapiens
cggaaaacatctcca

SEQ ID NO: 73966 - DNA, 15 bp, Homo sapiens
gcggaaaacatctcc

SEQ ID NO: 73967 - DNA, 15 bp, Homo sapiens
tgcggaaaacatctc

SEQ ID NO: 73968 - DNA, 15 bp, Homo sapiens
atgcggaaaacatct

SEQ ID NO: 73969 - DNA, 15 bp, Homo sapiens
aatgcggaaaacatc

SEQ ID NO: 73970 - DNA, 15 bp, Homo sapiens
caatgcggaaaacat

SEQ ID NO: 73971 - DNA, 15 bp, Homo sapiens
acaatgcggaaaaca

SEQ ID NO: 73972 - DNA, 15 bp, Homo sapiens
gacaatgcggaaaac

SEQ ID NO: 73973 - DNA, 15 bp, Homo sapiens
agacaatgcggaaaa

SEQ ID NO: 73974 - DNA, 15 bp, Homo sapiens
aagacaatgcggaaa

SEQ ID NO: 73975 - DNA, 15 bp, Homo sapiens
caagacaatgcggaa

SEQ ID NO: 73976 - DNA, 15 bp, Homo sapiens
ccaagacaatgcgga

SEQ ID NO: 73977 - DNA, 15 bp, Homo sapiens
accaagacaatgcgg

SEQ ID NO: 73978 - DNA, 15 bp, Homo sapiens
caccaagacaatgcg

SEQ ID NO: 73979 - DNA, 15 bp, Homo sapiens
tcaccaagacaatgc

SEQ ID NO: 73980 - DNA, 15 bp, Homo sapiens
atcaccaagacaatg

SEQ ID NO: 73981 - DNA, 15 bp, Homo sapiens
aatcaccaagacaat

SEQ ID NO: 73982 - DNA, 15 bp, Homo sapiens
taatcaccaagacaa

SEQ ID NO: 73983 - DNA, 15 bp, Homo sapiens
ttaatcaccaagaca

SEQ ID NO: 73984 - DNA, 15 bp, Homo sapiens
gttaatcaccaagac

SEQ ID NO: 73985 - DNA, 15 bp, Homo sapiens
agttaatcaccaaga

SEQ ID NO: 73986 - DNA, 15 bp, Homo sapiens
aagttaatcaccaag

SEQ ID NO: 73987 - DNA, 15 bp, Homo sapiens
aaagttaatcaccaa

SEQ ID NO: 73988 - DNA, 15 bp, Homo sapiens
aaaagttaatcacca

SEQ ID NO: 73989 - DNA, 15 bp, Homo sapiens
caaaagttaatcacc

SEQ ID NO: 73990 - DNA, 15 bp, Homo sapiens
gcaaaagttaatcac

SEQ ID NO: 73991 - DNA, 15 bp, Homo sapiens
ggcaaaagttaatca

SEQ ID NO: 73992 - DNA, 15 bp, Homo sapiens
aggcaaaagttaatc

SEQ ID NO: 73993 - DNA, 15 bp, Homo sapiens
gaggcaaaagttaat

SEQ ID NO: 73994 - DNA, 15 bp, Homo sapiens
agaggcaaaagttaa

SEQ ID NO: 73995 - DNA, 15 bp, Homo sapiens
aagaggcaaaagtta

SEQ ID NO: 73996 - DNA, 15 bp, Homo sapiens
aaagaggcaaaagtt

SEQ ID NO: 73997 - DNA, 15 bp, Homo sapiens
caaagaggcaaaagt

SEQ ID NO: 73998 - DNA, 15 bp, Homo sapiens
acaaagaggcaaaag

SEQ ID NO: 73999 - DNA, 15 bp, Homo sapiens
aacaaagaggcaaaa

SEQ ID NO: 74000 - DNA, 15 bp, Homo sapiens
taacaaagaggcaaa

SEQ ID NO: 74001 - DNA, 15 bp, Homo sapiens
gtaacaaagaggcaa

SEQ ID NO: 74002 - DNA, 15 bp, Homo sapiens
agtaacaaagaggca

SEQ ID NO: 74003 - DNA, 15 bp, Homo sapiens
aagtaacaaagaggc

SEQ ID NO: 74004 - DNA, 15 bp, Homo sapiens
taagtaacaaagagg

SEQ ID NO: 74005 - DNA, 15 bp, Homo sapiens
ataagtaacaaagag

SEQ ID NO: 74006 - DNA, 15 bp, Homo sapiens
cataagtaacaaaga

SEQ ID NO: 74007 - DNA, 15 bp, Homo sapiens
gcataagtaacaaag

SEQ ID NO: 74008 - DNA, 15 bp, Homo sapiens
tgcataagtaacaaa

SEQ ID NO: 74009 - DNA, 15 bp, Homo sapiens
ttgcataagtaacaa

SEQ ID NO: 74010 - DNA, 15 bp, Homo sapiens
tttgcataagtaaca

SEQ ID NO: 74011 - DNA, 15 bp, Homo sapiens
atttgcataagtaac

SEQ ID NO: 74012 - DNA, 15 bp, Homo sapiens
aatttgcataagtaa

SEQ ID NO: 74013 - DNA, 15 bp, Homo sapiens
aaatttgcataagta

SEQ ID NO: 74014 - DNA, 15 bp, Homo sapiens
gaaatttgcataagt

SEQ ID NO: 74015 - DNA, 15 bp, Homo sapiens
agaaatttgcataag

SEQ ID NO: 74016 - DNA, 15 bp, Homo sapiens
cagaaatttgcataa

SEQ ID NO: 74017 - DNA, 15 bp, Homo sapiens
gcagaaatttgcata

SEQ ID NO: 74018 - DNA, 15 bp, Homo sapiens
tgcagaaatttgcat

SEQ ID NO: 74019 - DNA, 15 bp, Homo sapiens
ctgcagaaatttgca

SEQ ID NO: 74020 - DNA, 15 bp, Homo sapiens
gctgcagaaatttgc

SEQ ID NO: 74021 - DNA, 15 bp, Homo sapiens
ggctgcagaaatttg

SEQ ID NO: 74022 - DNA, 15 bp, Homo sapiens
tggctgcagaaattt

SEQ ID NO: 74023 - DNA, 15 bp, Homo sapiens
ctggctgcagaaatt

SEQ ID NO: 74024 - DNA, 15 bp, Homo sapiens
gctggctgcagaaat

SEQ ID NO: 74025 - DNA, 15 bp, Homo sapiens
agctggctgcagaaa

SEQ ID NO: 74026 - DNA, 15 bp, Homo sapiens
aagctggctgcagaa

SEQ ID NO: 74027 - DNA, 15 bp, Homo sapiens
caagctggctgcaga

SEQ ID NO: 74028 - DNA, 15 bp, Homo sapiens
tcaagctggctgcag

SEQ ID NO: 74029 - DNA, 15 bp, Homo sapiens
ttcaagctggctgca

SEQ ID NO: 74030 - DNA, 15 bp, Homo sapiens
attcaagctggctgc

SEQ ID NO: 74031 - DNA, 15 bp, Homo sapiens
aattcaagctggctg

SEQ ID NO: 74032 - DNA, 15 bp, Homo sapiens
aaattcaagctggct

SEQ ID NO: 74033 - DNA, 15 bp, Homo sapiens
gaaattcaagctggc

SEQ ID NO: 74034 - DNA, 15 bp, Homo sapiens
agaaattcaagctgg

SEQ ID NO: 74035 - DNA, 15 bp, Homo sapiens
gagaaattcaagctg

SEQ ID NO: 74036 - DNA, 15 bp, Homo sapiens
ggagaaattcaagct

SEQ ID NO: 74037 - DNA, 15 bp, Homo sapiens
aggagaaattcaagc

SEQ ID NO: 74038 - DNA, 15 bp, Homo sapiens
gaggagaaattcaag

SEQ ID NO: 74039 - DNA, 15 bp, Homo sapiens
tgaggagaaattcaa

SEQ ID NO: 74040 - DNA, 15 bp, Homo sapiens
ctgaggagaaattca

SEQ ID NO: 74041 - DNA, 15 bp, Homo sapiens
tctgaggagaaattc

SEQ ID NO: 74042 - DNA, 15 bp, Homo sapiens
ttctgaggagaaatt

SEQ ID NO: 74043 - DNA, 15 bp, Homo sapiens
tttctgaggagaaat

SEQ ID NO: 74044 - DNA, 15 bp, Homo sapiens
ttttctgaggagaaa

SEQ ID NO: 74045 - DNA, 15 bp, Homo sapiens
attttctgaggagaa

SEQ ID NO: 74046 - DNA, 15 bp, Homo sapiens
cattttctgaggaga

SEQ ID NO: 74047 - DNA, 15 bp, Homo sapiens
tcattttctgaggag

SEQ ID NO: 74048 - DNA, 15 bp, Homo sapiens
ctcattttctgagga

SEQ ID NO: 74049 - DNA, 15 bp, Homo sapiens
tctcattttctgagg

SEQ ID NO: 74050 - DNA, 15 bp, Homo sapiens
atctcattttctgag

SEQ ID NO: 74051 - DNA, 15 bp, Homo sapiens
aatctcattttctga

SEQ ID NO: 74052 - DNA, 15 bp, Homo sapiens
aaatctcattttctg

SEQ ID NO: 74053 - DNA, 15 bp, Homo sapiens
aaaatctcattttct

SEQ ID NO: 74054 - DNA, 15 bp, Homo sapiens
gaaaatctcattttc

SEQ ID NO: 74055 - DNA, 15 bp, Homo sapiens
agaaaatctcatttt

SEQ ID NO: 74056 - DNA, 15 bp, Homo sapiens
aagaaaatctcattt

SEQ ID NO: 74057 - DNA, 15 bp, Homo sapiens
aaagaaaatctcatt

SEQ ID NO: 74058 - DNA, 15 bp, Homo sapiens
aaaagaaaatctcat

SEQ ID NO: 74059 - DNA, 15 bp, Homo sapiens
gaaaagaaaatctca

SEQ ID NO: 74060 - DNA, 15 bp, Homo sapiens
agaaaagaaaatctc

SEQ ID NO: 74061 - DNA, 15 bp, Homo sapiens
tagaaaagaaaatct

SEQ ID NO: 74062 - DNA, 15 bp, Homo sapiens
atagaaaagaaaatc

SEQ ID NO: 74063 - DNA, 15 bp, Homo sapiens
aatagaaaagaaaat

SEQ ID NO: 74064 - DNA, 15 bp, Homo sapiens
caatagaaaagaaaa

SEQ ID NO: 74065 - DNA, 15 bp, Homo sapiens
gcaatagaaaagaaa

SEQ ID NO: 74066 - DNA, 15 bp, Homo sapiens
tgcaatagaaaagaa

SEQ ID NO: 74067 - DNA, 15 bp, Homo sapiens
atgcaatagaaaaga

SEQ ID NO: 74068 - DNA, 15 bp, Homo sapiens
aatgcaatagaaaag

SEQ ID NO: 74069 - DNA, 15 bp, Homo sapiens
caatgcaatagaaaa

SEQ ID NO: 74070 - DNA, 15 bp, Homo sapiens
acaatgcaatagaaa

SEQ ID NO: 74071 - DNA, 15 bp, Homo sapiens
gacaatgcaatagaa

SEQ ID NO: 74072 - DNA, 15 bp, Homo sapiens
tgacaatgcaataga

SEQ ID NO: 74073 - DNA, 15 bp, Homo sapiens
ctgacaatgcaatag

SEQ ID NO: 74074 - DNA, 15 bp, Homo sapiens
cctgacaatgcaata

SEQ ID NO: 74075 - DNA, 15 bp, Homo sapiens
gcctgacaatgcaat

SEQ ID NO: 74076 - DNA, 15 bp, Homo sapiens
agcctgacaatgcaa

SEQ ID NO: 74077 - DNA, 15 bp, Homo sapiens
cagcctgacaatgca

SEQ ID NO: 74078 - DNA, 15 bp, Homo sapiens
gcagcctgacaatgc

SEQ ID NO: 74079 - DNA, 15 bp, Homo sapiens
tgcagcctgacaatg

SEQ ID NO: 74080 - DNA, 15 bp, Homo sapiens
ttgcagcctgacaat

SEQ ID NO: 74081 - DNA, 15 bp, Homo sapiens
tttgcagcctgacaa

SEQ ID NO: 74082 - DNA, 15 bp, Homo sapiens
atttgcagcctgaca

SEQ ID NO: 74083 - DNA, 15 bp, Homo sapiens
aatttgcagcctgac

SEQ ID NO: 74084 - DNA, 15 bp, Homo sapiens
aaatttgcagcctga

SEQ ID NO: 74085 - DNA, 15 bp, Homo sapiens
gaaatttgcagcctg

SEQ ID NO: 74086 - DNA, 15 bp, Homo sapiens
agaaatttgcagcct

SEQ ID NO: 74087 - DNA, 15 bp, Homo sapiens
gagaaatttgcagcc

SEQ ID NO: 74088 - DNA, 15 bp, Homo sapiens
tgagaaatttgcagc

SEQ ID NO: 74089 - DNA, 15 bp, Homo sapiens
ttgagaaatttgcag

SEQ ID NO: 74090 - DNA, 15 bp, Homo sapiens
tttgagaaatttgca

SEQ ID NO: 74091 - DNA, 15 bp, Homo sapiens
gtttgagaaatttgc

SEQ ID NO: 74092 - DNA, 15 bp, Homo sapiens
agtttgagaaatttg

SEQ ID NO: 74093 - DNA, 15 bp, Homo sapiens
aagtttgagaaattt

SEQ ID NO: 74094 - DNA, 15 bp, Homo sapiens
aaagtttgagaaatt

SEQ ID NO: 74095 - DNA, 15 bp, Homo sapiens
aaaagtttgagaaat

SEQ ID NO: 74096 - DNA, 15 bp, Homo sapiens
taaaagtttgagaaa

SEQ ID NO: 74097 - DNA, 15 bp, Homo sapiens
ataaaagtttgagaa

SEQ ID NO: 74098 - DNA, 15 bp, Homo sapiens
cataaaagtttgaga

SEQ ID NO: 74099 - DNA, 15 bp, Homo sapiens
tcataaaagtttgag

SEQ ID NO: 74100 - DNA, 15 bp, Homo sapiens
atcataaaagtttga

SEQ ID NO: 74101 - DNA, 15 bp, Homo sapiens
gatcataaaagtttg

SEQ ID NO: 74102 - DNA, 15 bp, Homo sapiens
agatcataaaagttt

SEQ ID NO: 74103 - DNA, 15 bp, Homo sapiens
cagatcataaaagtt

SEQ ID NO: 74104 - DNA, 15 bp, Homo sapiens
acagatcataaaagt

SEQ ID NO: 74105 - DNA, 15 bp, Homo sapiens
aacagatcataaaag

SEQ ID NO: 74106 - DNA, 15 bp, Homo sapiens
aaacagatcataaaa

SEQ ID NO: 74107 - DNA, 15 bp, Homo sapiens
gaaacagatcataaa

SEQ ID NO: 74108 - DNA, 15 bp, Homo sapiens
ggaaacagatcataa

SEQ ID NO: 74109 - DNA, 15 bp, Homo sapiens
aggaaacagatcata

SEQ ID NO: 74110 - DNA, 15 bp, Homo sapiens
aaggaaacagatcat

SEQ ID NO: 74111 - DNA, 15 bp, Homo sapiens
aaaggaaacagatca

SEQ ID NO: 74112 - DNA, 15 bp, Homo sapiens
taaaggaaacagatc

SEQ ID NO: 74113 - DNA, 15 bp, Homo sapiens
ataaaggaaacagat

SEQ ID NO: 74114 - DNA, 15 bp, Homo sapiens
tataaaggaaacaga

SEQ ID NO: 74115 - DNA, 15 bp, Homo sapiens
ttataaaggaaacag

SEQ ID NO: 74116 - DNA, 15 bp, Homo sapiens
tttataaaggaaaca

SEQ ID NO: 74117 - DNA, 15 bp, Homo sapiens
ttttataaaggaaac

SEQ ID NO: 74118 - DNA, 15 bp, Homo sapiens
gttttataaaggaaa

SEQ ID NO: 74119 - DNA, 15 bp, Homo sapiens
agttttataaaggaa

SEQ ID NO: 74120 - DNA, 15 bp, Homo sapiens
cagttttataaagga

SEQ ID NO: 74121 - DNA, 15 bp, Homo sapiens
tcagttttataaagg

SEQ ID NO: 74122 - DNA, 15 bp, Homo sapiens
ttcagttttataaag

SEQ ID NO: 74123 - DNA, 15 bp, Homo sapiens
attcagttttataaa

SEQ ID NO: 74124 - DNA, 15 bp, Homo sapiens
cattcagttttataa

SEQ ID NO: 74125 - DNA, 15 bp, Homo sapiens
gcattcagttttata

SEQ ID NO: 74126 - DNA, 15 bp, Homo sapiens
ggcattcagttttat

SEQ ID NO: 74127 - DNA, 15 bp, Homo sapiens
aggcattcagtttta

SEQ ID NO: 74128 - DNA, 15 bp, Homo sapiens
aaggcattcagtttt

SEQ ID NO: 74129 - DNA, 15 bp, Homo sapiens
aaaggcattcagttt

SEQ ID NO: 74130 - DNA, 15 bp, Homo sapiens
taaaggcattcagtt

SEQ ID NO: 74131 - DNA, 15 bp, Homo sapiens
ttaaaggcattcagt

SEQ ID NO: 74132 - DNA, 15 bp, Homo sapiens
gttaaaggcattcag

SEQ ID NO: 74133 - DNA, 15 bp, Homo sapiens
tgttaaaggcattca

SEQ ID NO: 74134 - DNA, 15 bp, Homo sapiens
ctgttaaaggcattc

SEQ ID NO: 74135 - DNA, 15 bp, Homo sapiens
gctgttaaaggcatt

SEQ ID NO: 74136 - DNA, 15 bp, Homo sapiens
tgctgttaaaggcat

SEQ ID NO: 74137 - DNA, 15 bp, Homo sapiens
gtgctgttaaaggca

SEQ ID NO: 74138 - DNA, 15 bp, Homo sapiens
ggtgctgttaaaggc

SEQ ID NO: 74139 - DNA, 15 bp, Homo sapiens
gggtgctgttaaagg

SEQ ID NO: 74140 - DNA, 15 bp, Homo sapiens
tgggtgctgttaaag

SEQ ID NO: 74141 - DNA, 15 bp, Homo sapiens
ttgggtgctgttaaa

SEQ ID NO: 74142 - DNA, 15 bp, Homo sapiens
cttgggtgctgttaa

SEQ ID NO: 74143 - DNA, 15 bp, Homo sapiens
acttgggtgctgtta

SEQ ID NO: 74144 - DNA, 15 bp, Homo sapiens
gacttgggtgctgtt

SEQ ID NO: 74145 - DNA, 15 bp, Homo sapiens
tgacttgggtgctgt

SEQ ID NO: 74146 - DNA, 15 bp, Homo sapiens
atgacttgggtgctg

SEQ ID NO: 74147 - DNA, 15 bp, Homo sapiens
gatgacttgggtgct

SEQ ID NO: 74148 - DNA, 15 bp, Homo sapiens
agatgacttgggtgc

SEQ ID NO: 74149 - DNA, 15 bp, Homo sapiens
gagatgacttgggtg

SEQ ID NO: 74150 - DNA, 15 bp, Homo sapiens
ggagatgacttgggt

SEQ ID NO: 74151 - DNA, 15 bp, Homo sapiens
aggagatgacttggg

SEQ ID NO: 74152 - DNA, 15 bp, Homo sapiens
caggagatgacttgg

SEQ ID NO: 74153 - DNA, 15 bp, Homo sapiens
tcaggagatgacttg

SEQ ID NO: 74154 - DNA, 15 bp, Homo sapiens
ttcaggagatgactt

SEQ ID NO: 74155 - DNA, 15 bp, Homo sapiens
attcaggagatgact

SEQ ID NO: 74156 - DNA, 15 bp, Homo sapiens
cattcaggagatgac

SEQ ID NO: 74157 - DNA, 15 bp, Homo sapiens
gcattcaggagatga

SEQ ID NO: 74158 - DNA, 15 bp, Homo sapiens
agcattcaggagatg

SEQ ID NO: 74159 - DNA, 15 bp, Homo sapiens
aagcattcaggagat

SEQ ID NO: 74160 - DNA, 15 bp, Homo sapiens
aaagcattcaggaga

SEQ ID NO: 74161 - DNA, 15 bp, Homo sapiens
caaagcattcaggag

SEQ ID NO: 74162 - DNA, 15 bp, Homo sapiens
gcaaagcattcagga

SEQ ID NO: 74163 - DNA, 15 bp, Homo sapiens
agcaaagcattcagg

SEQ ID NO: 74164 - DNA, 15 bp, Homo sapiens
cagcaaagcattcag

SEQ ID NO: 74165 - DNA, 15 bp, Homo sapiens
gcagcaaagcattca

SEQ ID NO: 74166 - DNA, 15 bp, Homo sapiens
agcagcaaagcattc

SEQ ID NO: 74167 - DNA, 15 bp, Homo sapiens
aagcagcaaagcatt

SEQ ID NO: 74168 - DNA, 15 bp, Homo sapiens
taagcagcaaagcat

SEQ ID NO: 74169 - DNA, 15 bp, Homo sapiens
ctaagcagcaaagca

SEQ ID NO: 74170 - DNA, 15 bp, Homo sapiens
tctaagcagcaaagc

SEQ ID NO: 74171 - DNA, 15 bp, Homo sapiens
ttctaagcagcaaag

SEQ ID NO: 74172 - DNA, 15 bp, Homo sapiens
tttctaagcagcaaa

SEQ ID NO: 74173 - DNA, 15 bp, Homo sapiens
atttctaagcagcaa

SEQ ID NO: 74174 - DNA, 15 bp, Homo sapiens
aatttctaagcagca

SEQ ID NO: 74175 - DNA, 15 bp, Homo sapiens
aaatttctaagcagc

SEQ ID NO: 74176 - DNA, 15 bp, Homo sapiens
gaaatttctaagcag

SEQ ID NO: 74177 - DNA, 15 bp, Homo sapiens
agaaatttctaagca

SEQ ID NO: 74178 - DNA, 15 bp, Homo sapiens
aagaaatttctaagc

SEQ ID NO: 74179 - DNA, 15 bp, Homo sapiens
gaagaaatttctaag

SEQ ID NO: 74180 - DNA, 15 bp, Homo sapiens
ggaagaaatttctaa

SEQ ID NO: 74181 - DNA, 15 bp, Homo sapiens
tggaagaaatttcta

SEQ ID NO: 74182 - DNA, 15 bp, Homo sapiens
gtggaagaaatttct

SEQ ID NO: 74183 - DNA, 15 bp, Homo sapiens
tgtggaagaaatttc

SEQ ID NO: 74184 - DNA, 15 bp, Homo sapiens
ctgtggaagaaattt

SEQ ID NO: 74185 - DNA, 15 bp, Homo sapiens
cctgtggaagaaatt

SEQ ID NO: 74186 - DNA, 15 bp, Homo sapiens
acctgtggaagaaat

SEQ ID NO: 74187 - DNA, 15 bp, Homo sapiens
tacctgtggaagaaa

SEQ ID NO: 74188 - DNA, 15 bp, Homo sapiens
gtacctgtggaagaa

SEQ ID NO: 74189 - DNA, 15 bp, Homo sapiens
ggtacctgtggaaga

SEQ ID NO: 74190 - DNA, 15 bp, Homo sapiens
gggtacctgtggaag

SEQ ID NO: 74191 - DNA, 15 bp, Homo sapiens
agggtacctgtggaa

SEQ ID NO: 74192 - DNA, 15 bp, Homo sapiens
tagggtacctgtgga

SEQ ID NO: 74193 - DNA, 15 bp, Homo sapiens
ttagggtacctgtgg

SEQ ID NO: 74194 - DNA, 15 bp, Homo sapiens
tttagggtacctgtg

SEQ ID NO: 74195 - DNA, 15 bp, Homo sapiens
atttagggtacctgt

SEQ ID NO: 74196 - DNA, 15 bp, Homo sapiens
aatttagggtacctg

SEQ ID NO: 74197 - DNA, 15 bp, Homo sapiens
aaatttagggtacct

SEQ ID NO: 74198 - DNA, 15 bp, Homo sapiens
aaaatttagggtacc

SEQ ID NO: 74199 - DNA, 15 bp, Homo sapiens
gaaaatttagggtac

SEQ ID NO: 74200 - DNA, 15 bp, Homo sapiens
ggaaaatttagggta

SEQ ID NO: 74201 - DNA, 15 bp, Homo sapiens
gggaaaatttagggt

SEQ ID NO: 74202 - DNA, 15 bp, Homo sapiens
tgggaaaatttaggg

SEQ ID NO: 74203 - DNA, 15 bp, Homo sapiens
gtgggaaaatttagg

SEQ ID NO: 74204 - DNA, 15 bp, Homo sapiens
tgtgggaaaatttag

SEQ ID NO: 74205 - DNA, 15 bp, Homo sapiens
atgtgggaaaattta

SEQ ID NO: 74206 - DNA, 15 bp, Homo sapiens
aatgtgggaaaattt

SEQ ID NO: 74207 - DNA, 15 bp, Homo sapiens
aaatgtgggaaaatt

SEQ ID NO: 74208 - DNA, 15 bp, Homo sapiens
aaaatgtgggaaaat

SEQ ID NO: 74209 - DNA, 15 bp, Homo sapiens
aaaaatgtgggaaaa

SEQ ID NO: 74210 - DNA, 15 bp, Homo sapiens
gaaaaatgtgggaaa

SEQ ID NO: 74211 - DNA, 15 bp, Homo sapiens
agaaaaatgtgggaa

SEQ ID NO: 74212 - DNA, 15 bp, Homo sapiens
cagaaaaatgtggga

SEQ ID NO: 74213 - DNA, 15 bp, Homo sapiens
acagaaaaatgtggg

SEQ ID NO: 74214 - DNA, 15 bp, Homo sapiens
gacagaaaaatgtgg

SEQ ID NO: 74215 - DNA, 15 bp, Homo sapiens
agacagaaaaatgtg

SEQ ID NO: 74216 - DNA, 15 bp, Homo sapiens
aagacagaaaaatgt

SEQ ID NO: 74217 - DNA, 15 bp, Homo sapiens
gaagacagaaaaatg

SEQ ID NO: 74218 - DNA, 15 bp, Homo sapiens
agaagacagaaaaat

SEQ ID NO: 74219 - DNA, 15 bp, Homo sapiens
aagaagacagaaaaa

SEQ ID NO: 74220 - DNA, 15 bp, Homo sapiens
gaagaagacagaaaa

SEQ ID NO: 74221 - DNA, 15 bp, Homo sapiens
agaagaagacagaaa

SEQ ID NO: 74222 - DNA, 15 bp, Homo sapiens
cagaagaagacagaa

SEQ ID NO: 74223 - DNA, 15 bp, Homo sapiens
tcagaagaagacaga

SEQ ID NO: 74224 - DNA, 15 bp, Homo sapiens
ctcagaagaagacag

SEQ ID NO: 74225 - DNA, 15 bp, Homo sapiens
gctcagaagaagaca

SEQ ID NO: 74226 - DNA, 15 bp, Homo sapiens
agctcagaagaagac

SEQ ID NO: 74227 - DNA, 15 bp, Homo sapiens
gagctcagaagaaga

SEQ ID NO: 74228 - DNA, 15 bp, Homo sapiens
agagctcagaagaag

SEQ ID NO: 74229 - DNA, 15 bp, Homo sapiens
gagagctcagaagaa

SEQ ID NO: 74230 - DNA, 15 bp, Homo sapiens
ggagagctcagaaga

SEQ ID NO: 74231 - DNA, 15 bp, Homo sapiens
tggagagctcagaag

SEQ ID NO: 74232 - DNA, 15 bp, Homo sapiens
ttggagagctcagaa

SEQ ID NO: 74233 - DNA, 15 bp, Homo sapiens
tttggagagctcaga

SEQ ID NO: 74234 - DNA, 15 bp, Homo sapiens
atttggagagctcag

SEQ ID NO: 74235 - DNA, 15 bp, Homo sapiens
catttggagagctca

SEQ ID NO: 74236 - DNA, 15 bp, Homo sapiens
acatttggagagctc

SEQ ID NO: 74237 - DNA, 15 bp, Homo sapiens
aacatttggagagct

SEQ ID NO: 74238 - DNA, 15 bp, Homo sapiens
aaacatttggagagc

SEQ ID NO: 74239 - DNA, 15 bp, Homo sapiens
gaaacatttggagag

SEQ ID NO: 74240 - DNA, 15 bp, Homo sapiens
ggaaacatttggaga

SEQ ID NO: 74241 - DNA, 15 bp, Homo sapiens
tggaaacatttggag

SEQ ID NO: 74242 - DNA, 15 bp, Homo sapiens
ttggaaacatttgga

SEQ ID NO: 74243 - DNA, 15 bp, Homo sapiens
gttggaaacatttgg

SEQ ID NO: 74244 - DNA, 15 bp, Homo sapiens
ggttggaaacatttg

SEQ ID NO: 74245 - DNA, 15 bp, Homo sapiens
aggttggaaacattt

SEQ ID NO: 74246 - DNA, 15 bp, Homo sapiens
gaggttggaaacatt

SEQ ID NO: 74247 - DNA, 15 bp, Homo sapiens
agaggttggaaacat

SEQ ID NO: 74248 - DNA, 15 bp, Homo sapiens
cagaggttggaaaca

SEQ ID NO: 74249 - DNA, 15 bp, Homo sapiens
gcagaggttggaaac

SEQ ID NO: 74250 - DNA, 15 bp, Homo sapiens
ggcagaggttggaaa

SEQ ID NO: 74251 - DNA, 15 bp, Homo sapiens
aggcagaggttggaa

SEQ ID NO: 74252 - DNA, 15 bp, Homo sapiens
caggcagaggttgga

SEQ ID NO: 74253 - DNA, 15 bp, Homo sapiens
acaggcagaggttgg

SEQ ID NO: 74254 - DNA, 15 bp, Homo sapiens
aacaggcagaggttg

SEQ ID NO: 74255 - DNA, 15 bp, Homo sapiens
taacaggcagaggtt

SEQ ID NO: 74256 - DNA, 15 bp, Homo sapiens
gtaacaggcagaggt

SEQ ID NO: 74257 - DNA, 15 bp, Homo sapiens
ggtaacaggcagagg

SEQ ID NO: 74258 - DNA, 15 bp, Homo sapiens
cggtaacaggcagag

SEQ ID NO: 74259 - DNA, 15 bp, Homo sapiens
tcggtaacaggcaga

SEQ ID NO: 74260 - DNA, 15 bp, Homo sapiens
ctcggtaacaggcag

SEQ ID NO: 74261 - DNA, 15 bp, Homo sapiens
actcggtaacaggca

SEQ ID NO: 74262 - DNA, 15 bp, Homo sapiens
aactcggtaacaggc

SEQ ID NO: 74263 - DNA, 15 bp, Homo sapiens
gaactcggtaacagg

SEQ ID NO: 74264 - DNA, 15 bp, Homo sapiens
ggaactcggtaacag

SEQ ID NO: 74265 - DNA, 15 bp, Homo sapiens
tggaactcggtaaca

SEQ ID NO: 74266 - DNA, 15 bp, Homo sapiens
ttggaactcggtaac

SEQ ID NO: 74267 - DNA, 15 bp, Homo sapiens
tttggaactcggtaa

SEQ ID NO: 74268 - DNA, 15 bp, Homo sapiens
ctttggaactcggta

SEQ ID NO: 74269 - DNA, 15 bp, Homo sapiens
actttggaactcggt

SEQ ID NO: 74270 - DNA, 15 bp, Homo sapiens
gactttggaactcgg

SEQ ID NO: 74271 - DNA, 15 bp, Homo sapiens
tgactttggaactcg

SEQ ID NO: 74272 - DNA, 15 bp, Homo sapiens
gtgactttggaactc

SEQ ID NO: 74273 - DNA, 15 bp, Homo sapiens
agtgactttggaact

SEQ ID NO: 74274 - DNA, 15 bp, Homo sapiens
aagtgactttggaac

SEQ ID NO: 74275 - DNA, 15 bp, Homo sapiens
gaagtgactttggaa

SEQ ID NO: 74276 - DNA, 15 bp, Homo sapiens
agaagtgactttgga

SEQ ID NO: 74277 - DNA, 15 bp, Homo sapiens
tagaagtgactttgg

SEQ ID NO: 74278 - DNA, 15 bp, Homo sapiens
gtagaagtgactttg

SEQ ID NO: 74279 - DNA, 15 bp, Homo sapiens
tgtagaagtgacttt

SEQ ID NO: 74280 - DNA, 15 bp, Homo sapiens
atgtagaagtgactt

SEQ ID NO: 74281 - DNA, 15 bp, Homo sapiens
aatgtagaagtgact

SEQ ID NO: 74282 - DNA, 15 bp, Homo sapiens
aaatgtagaagtgac

SEQ ID NO: 74283 - DNA, 15 bp, Homo sapiens
aaaatgtagaagtga

SEQ ID NO: 74284 - DNA, 15 bp, Homo sapiens
taaaatgtagaagtg

SEQ ID NO: 74285 - DNA, 15 bp, Homo sapiens
ctaaaatgtagaagt

SEQ ID NO: 74286 - DNA, 15 bp, Homo sapiens
cctaaaatgtagaag

SEQ ID NO: 74287 - DNA, 15 bp, Homo sapiens
ccctaaaatgtagaa

SEQ ID NO: 74288 - DNA, 15 bp, Homo sapiens
accctaaaatgtaga

SEQ ID NO: 74289 - DNA, 15 bp, Homo sapiens
taccctaaaatgtag

SEQ ID NO: 74290 - DNA, 15 bp, Homo sapiens
ataccctaaaatgta

SEQ ID NO: 74291 - DNA, 15 bp, Homo sapiens
gataccctaaaatgt

SEQ ID NO: 74292 - DNA, 15 bp, Homo sapiens
agataccctaaaatg

SEQ ID NO: 74293 - DNA, 15 bp, Homo sapiens
aagataccctaaaat

SEQ ID NO: 74294 - DNA, 15 bp, Homo sapiens
aaagataccctaaaa

SEQ ID NO: 74295 - DNA, 15 bp, Homo sapiens
aaaagataccctaaa

SEQ ID NO: 74296 - DNA, 15 bp, Homo sapiens
gaaaagataccctaa

SEQ ID NO: 74297 - DNA, 15 bp, Homo sapiens
tgaaaagatacccta

SEQ ID NO: 74298 - DNA, 15 bp, Homo sapiens
ttgaaaagataccct

SEQ ID NO: 74299 - DNA, 15 bp, Homo sapiens
gttgaaaagataccc

SEQ ID NO: 74300 - DNA, 15 bp, Homo sapiens
tgttgaaaagatacc

SEQ ID NO: 74301 - DNA, 15 bp, Homo sapiens
ctgttgaaaagatac

SEQ ID NO: 74302 - DNA, 15 bp, Homo sapiens
gctgttgaaaagata

SEQ ID NO: 74303 - DNA, 15 bp, Homo sapiens
tgctgttgaaaagat

SEQ ID NO: 74304 - DNA, 15 bp, Homo sapiens
gtgctgttgaaaaga

SEQ ID NO: 74305 - DNA, 15 bp, Homo sapiens
ggtgctgttgaaaag

SEQ ID NO: 74306 - DNA, 15 bp, Homo sapiens
gggtgctgttgaaaa

SEQ ID NO: 74307 - DNA, 15 bp, Homo sapiens
ggggtgctgttgaaa

SEQ ID NO: 74308 - DNA, 15 bp, Homo sapiens
tggggtgctgttgaa

SEQ ID NO: 74309 - DNA, 15 bp, Homo sapiens
gtggggtgctgttga

SEQ ID NO: 74310 - DNA, 15 bp, Homo sapiens
agtggggtgctgttg

SEQ ID NO: 74311 - DNA, 15 bp, Homo sapiens
gagtggggtgctgtt

SEQ ID NO: 74312 - DNA, 15 bp, Homo sapiens
agagtggggtgctgt

SEQ ID NO: 74313 - DNA, 15 bp, Homo sapiens
tagagtggggtgctg

SEQ ID NO: 74314 - DNA, 15 bp, Homo sapiens
gtagagtggggtgct

SEQ ID NO: 74315 - DNA, 15 bp, Homo sapiens
agtagagtggggtgc

SEQ ID NO: 74316 - DNA, 15 bp, Homo sapiens
cagtagagtggggtg

SEQ ID NO: 74317 - DNA, 15 bp, Homo sapiens
ccagtagagtggggt

SEQ ID NO: 74318 - DNA, 15 bp, Homo sapiens
accagtagagtgggg

SEQ ID NO: 74319 - DNA, 15 bp, Homo sapiens
taccagtagagtggg

SEQ ID NO: 74320 - DNA, 15 bp, Homo sapiens
gtaccagtagagtgg

SEQ ID NO: 74321 - DNA, 15 bp, Homo sapiens
ggtaccagtagagtg

SEQ ID NO: 74322 - DNA, 15 bp, Homo sapiens
cggtaccagtagagt

SEQ ID NO: 74323 - DNA, 15 bp, Homo sapiens
tcggtaccagtagag

SEQ ID NO: 74324 - DNA, 15 bp, Homo sapiens
atcggtaccagtaga

SEQ ID NO: 74325 - DNA, 15 bp, Homo sapiens
aatcggtaccagtag

SEQ ID NO: 74326 - DNA, 15 bp, Homo sapiens
aaatcggtaccagta

SEQ ID NO: 74327 - DNA, 15 bp, Homo sapiens
taaatcggtaccagt

SEQ ID NO: 74328 - DNA, 15 bp, Homo sapiens
gtaaatcggtaccag

SEQ ID NO: 74329 - DNA, 15 bp, Homo sapiens
agtaaatcggtacca

SEQ ID NO: 74330 - DNA, 15 bp, Homo sapiens
tagtaaatcggtacc

SEQ ID NO: 74331 - DNA, 15 bp, Homo sapiens
atagtaaatcggtac

SEQ ID NO: 74332 - DNA, 15 bp, Homo sapiens
tatagtaaatcggta

SEQ ID NO: 74333 - DNA, 15 bp, Homo sapiens
atatagtaaatcggt

SEQ ID NO: 74334 - DNA, 15 bp, Homo sapiens
aatatagtaaatcgg

SEQ ID NO: 74335 - DNA, 15 bp, Homo sapiens
taatatagtaaatcg

SEQ ID NO: 74336 - DNA, 15 bp, Homo sapiens
ctaatatagtaaatc

SEQ ID NO: 74337 - DNA, 15 bp, Homo sapiens
actaatatagtaaat

SEQ ID NO: 74338 - DNA, 15 bp, Homo sapiens
gactaatatagtaaa

SEQ ID NO: 74339 - DNA, 15 bp, Homo sapiens
ggactaatatagtaa

SEQ ID NO: 74340 - DNA, 15 bp, Homo sapiens
tggactaatatagta

SEQ ID NO: 74341 - DNA, 15 bp, Homo sapiens
atggactaatatagt

SEQ ID NO: 74342 - DNA, 15 bp, Homo sapiens
aatggactaatatag

SEQ ID NO: 74343 - DNA, 15 bp, Homo sapiens
aaatggactaatata

SEQ ID NO: 74344 - DNA, 15 bp, Homo sapiens
aaaatggactaatat

SEQ ID NO: 74345 - DNA, 15 bp, Homo sapiens
gaaaatggactaata

SEQ ID NO: 74346 - DNA, 15 bp, Homo sapiens
tgaaaatggactaat

SEQ ID NO: 74347 - DNA, 15 bp, Homo sapiens
atgaaaatggactaa

SEQ ID NO: 74348 - DNA, 15 bp, Homo sapiens
catgaaaatggacta

SEQ ID NO: 74349 - DNA, 15 bp, Homo sapiens
gcatgaaaatggact

SEQ ID NO: 74350 - DNA, 15 bp, Homo sapiens
agcatgaaaatggac

SEQ ID NO: 74351 - DNA, 15 bp, Homo sapiens
cagcatgaaaatgga

SEQ ID NO: 74352 - DNA, 15 bp, Homo sapiens
gcagcatgaaaatgg

SEQ ID NO: 74353 - DNA, 15 bp, Homo sapiens
agcagcatgaaaatg

SEQ ID NO: 74354 - DNA, 15 bp, Homo sapiens
cagcagcatgaaaat

SEQ ID NO: 74355 - DNA, 15 bp, Homo sapiens
tcagcagcatgaaaa

SEQ ID NO: 74356 - DNA, 15 bp, Homo sapiens
atcagcagcatgaaa

SEQ ID NO: 74357 - DNA, 15 bp, Homo sapiens
tatcagcagcatgaa

SEQ ID NO: 74358 - DNA, 15 bp, Homo sapiens
ttatcagcagcatga

SEQ ID NO: 74359 - DNA, 15 bp, Homo sapiens
tttatcagcagcatg

SEQ ID NO: 74360 - DNA, 15 bp, Homo sapiens
ttttatcagcagcat

SEQ ID NO: 74361 - DNA, 15 bp, Homo sapiens
tttttatcagcagca

SEQ ID NO: 74362 - DNA, 15 bp, Homo sapiens
gtttttatcagcagc

SEQ ID NO: 74363 - DNA, 15 bp, Homo sapiens
tgtttttatcagcag

SEQ ID NO: 74364 - DNA, 15 bp, Homo sapiens
atgtttttatcagca

SEQ ID NO: 74365 - DNA, 15 bp, Homo sapiens
tatgtttttatcagc

SEQ ID NO: 74366 - DNA, 15 bp, Homo sapiens
gtatgtttttatcag

SEQ ID NO: 74367 - DNA, 15 bp, Homo sapiens
ggtatgtttttatca

SEQ ID NO: 74368 - DNA, 15 bp, Homo sapiens
aggtatgtttttatc

SEQ ID NO: 74369 - DNA, 15 bp, Homo sapiens
caggtatgtttttat

SEQ ID NO: 74370 - DNA, 15 bp, Homo sapiens
tcaggtatgttttta

SEQ ID NO: 74371 - DNA, 15 bp, Homo sapiens
ctcaggtatgttttt

SEQ ID NO: 74372 - DNA, 15 bp, Homo sapiens
tctcaggtatgtttt

SEQ ID NO: 74373 - DNA, 15 bp, Homo sapiens
gtctcaggtatgttt

SEQ ID NO: 74374 - DNA, 15 bp, Homo sapiens
agtctcaggtatgtt

SEQ ID NO: 74375 - DNA, 15 bp, Homo sapiens
attaaacctcttttt

SEQ ID NO: 74376 - DNA, 15 bp, Homo sapiens
cattaaacctctttt

SEQ ID NO: 74377 - DNA, 15 bp, Homo sapiens
ccattaaacctcttt

SEQ ID NO: 74378 - DNA, 15 bp, Homo sapiens
tccattaaacctctt

SEQ ID NO: 74379 - DNA, 15 bp, Homo sapiens
gtccattaaacctct

SEQ ID NO: 74380 - DNA, 15 bp, Homo sapiens
agtccattaaacctc

SEQ ID NO: 74381 - DNA, 15 bp, Homo sapiens
aagtccattaaacct

SEQ ID NO: 74382 - DNA, 15 bp, Homo sapiens
taagtccattaaacc

SEQ ID NO: 74383 - DNA, 15 bp, Homo sapiens
gtaagtccattaaac

SEQ ID NO: 74384 - DNA, 15 bp, Homo sapiens
tgtaagtccattaaa

SEQ ID NO: 74385 - DNA, 15 bp, Homo sapiens
ctgtaagtccattaa

SEQ ID NO: 74386 - DNA, 15 bp, Homo sapiens
actgtaagtccatta

SEQ ID NO: 74387 - DNA, 15 bp, Homo sapiens
aactgtaagtccatt

SEQ ID NO: 74388 - DNA, 15 bp, Homo sapiens
gaactgtaagtccat

SEQ ID NO: 74389 - DNA, 15 bp, Homo sapiens
ggaactgtaagtcca

SEQ ID NO: 74390 - DNA, 15 bp, Homo sapiens
gtggaactgtaagtc

SEQ ID NO: 74391 - DNA, 15 bp, Homo sapiens
tgtggaactgtaagt

SEQ ID NO: 74392 - DNA, 15 bp, Homo sapiens
atgtggaactgtaag

SEQ ID NO: 74393 - DNA, 15 bp, Homo sapiens
gatgtggaactgtaa

SEQ ID NO: 74394 - DNA, 15 bp, Homo sapiens
cgatgtggaactgta

SEQ ID NO: 74395 - DNA, 15 bp, Homo sapiens
acgatgtggaactgt

SEQ ID NO: 74396 - DNA, 15 bp, Homo sapiens
aacgatgtggaactg

SEQ ID NO: 74397 - DNA, 15 bp, Homo sapiens
caacgatgtggaact

SEQ ID NO: 74398 - DNA, 15 bp, Homo sapiens
ccaacgatgtggaac

SEQ ID NO: 74399 - DNA, 15 bp, Homo sapiens
cccaacgatgtggaa

SEQ ID NO: 74400 - DNA, 15 bp, Homo sapiens
ccccaacgatgtgga

SEQ ID NO: 74401 - DNA, 15 bp, Homo sapiens
tccccaacgatgtgg

SEQ ID NO: 74402 - DNA, 15 bp, Homo sapiens
ctccccaacgatgtg

SEQ ID NO: 74403 - DNA, 15 bp, Homo sapiens
cctccccaacgatgt

SEQ ID NO: 74404 - DNA, 15 bp, Homo sapiens
gcctccccaacgatg

SEQ ID NO: 74405 - DNA, 15 bp, Homo sapiens
ggcctccccaacgat

SEQ ID NO: 74406 - DNA, 15 bp, Homo sapiens
aggcctccccaacga

SEQ ID NO: 74407 - DNA, 15 bp, Homo sapiens
gaggcctccccaacg

SEQ ID NO: 74408 - DNA, 15 bp, Homo sapiens
tgaggcctccccaac

SEQ ID NO: 74409 - DNA, 15 bp, Homo sapiens
gtgaggcctccccaa

SEQ ID NO: 74410 - DNA, 15 bp, Homo sapiens
tgtgaggcctcccca

SEQ ID NO: 74411 - DNA, 15 bp, Homo sapiens
ttgtgaggcctcccc

SEQ ID NO: 74412 - DNA, 15 bp, Homo sapiens
attgtgaggcctccc

SEQ ID NO: 74413 - DNA, 15 bp, Homo sapiens
gattgtgaggcctcc

SEQ ID NO: 74414 - DNA, 15 bp, Homo sapiens
tgattgtgaggcctc

SEQ ID NO: 74415 - DNA, 15 bp, Homo sapiens
atgattgtgaggcct

SEQ ID NO: 74416 - DNA, 15 bp, Homo sapiens
catgattgtgaggcc

SEQ ID NO: 74417 - DNA, 15 bp, Homo sapiens
ccatgattgtgaggc

SEQ ID NO: 74418 - DNA, 15 bp, Homo sapiens
gccatgattgtgagg

SEQ ID NO: 74419 - DNA, 15 bp, Homo sapiens
tgccatgattgtgag

SEQ ID NO: 74420 - DNA, 15 bp, Homo sapiens
ctgccatgattgtga

SEQ ID NO: 74421 - DNA, 15 bp, Homo sapiens
tctgccatgattgtg

SEQ ID NO: 74422 - DNA, 15 bp, Homo sapiens
ttctgccatgattgt

SEQ ID NO: 74423 - DNA, 15 bp, Homo sapiens
cttctgccatgattg

SEQ ID NO: 74424 - DNA, 15 bp, Homo sapiens
ccttctgccatgatt

SEQ ID NO: 74425 - DNA, 15 bp, Homo sapiens
cccttctgccatgat

SEQ ID NO: 74426 - DNA, 15 bp, Homo sapiens
tcccttctgccatga

SEQ ID NO: 74427 - DNA, 15 bp, Homo sapiens
ttcccttctgccatg

SEQ ID NO: 74428 - DNA, 15 bp, Homo sapiens
cttcccttctgccat

SEQ ID NO: 74429 - DNA, 15 bp, Homo sapiens
ccttcccttctgcca

SEQ ID NO: 74430 - DNA, 15 bp, Homo sapiens
tccttcccttctgcc

SEQ ID NO: 74431 - DNA, 15 bp, Homo sapiens
ctccttcccttctgc

SEQ ID NO: 74432 - DNA, 15 bp, Homo sapiens
cctccttcccttctg

SEQ ID NO: 74433 - DNA, 15 bp, Homo sapiens
tcctccttcccttct

SEQ ID NO: 74434 - DNA, 15 bp, Homo sapiens
acttgctcctccttc

SEQ ID NO: 74435 - DNA, 15 bp, Homo sapiens
gacttgctcctcctt

SEQ ID NO: 74436 - DNA, 15 bp, Homo sapiens
tgacttgctcctcct

SEQ ID NO: 74437 - DNA, 15 bp, Homo sapiens
gtgacttgctcctcc

SEQ ID NO: 74438 - DNA, 15 bp, Homo sapiens
cgtgacttgctcctc

SEQ ID NO: 74439 - DNA, 15 bp, Homo sapiens
tcgtgacttgctcct

SEQ ID NO: 74440 - DNA, 15 bp, Homo sapiens
atcgtgacttgctcc

SEQ ID NO: 74441 - DNA, 15 bp, Homo sapiens
aatcgtgacttgctc

SEQ ID NO: 74442 - DNA, 15 bp, Homo sapiens
aaatcgtgacttgct

SEQ ID NO: 74443 - DNA, 15 bp, Homo sapiens
taaatcgtgacttgc

SEQ ID NO: 74444 - DNA, 15 bp, Homo sapiens
gtaaatcgtgacttg

SEQ ID NO: 74445 - DNA, 15 bp, Homo sapiens
tgtaaatcgtgactt

SEQ ID NO: 74446 - DNA, 15 bp, Homo sapiens
atgtaaatcgtgact

SEQ ID NO: 74447 - DNA, 15 bp, Homo sapiens
catgtaaatcgtgac

SEQ ID NO: 74448 - DNA, 15 bp, Homo sapiens
gcatgtaaatcgtga

SEQ ID NO: 74449 - DNA, 15 bp, Homo sapiens
tgcatgtaaatcgtg

SEQ ID NO: 74450 - DNA, 15 bp, Homo sapiens
atgcatgtaaatcgt

SEQ ID NO: 74451 - DNA, 15 bp, Homo sapiens
catgcatgtaaatcg

SEQ ID NO: 74452 - DNA, 15 bp, Homo sapiens
ccatgcatgtaaatc

SEQ ID NO: 74453 - DNA, 15 bp, Homo sapiens
accatgcatgtaaat

SEQ ID NO: 74454 - DNA, 15 bp, Homo sapiens
caccatgcatgtaaa

SEQ ID NO: 74455 - DNA, 15 bp, Homo sapiens
ccaccatgcatgtaa

SEQ ID NO: 74456 - DNA, 15 bp, Homo sapiens
gccaccatgcatgta

SEQ ID NO: 74457 - DNA, 15 bp, Homo sapiens
tgccaccatgcatgt

SEQ ID NO: 74458 - DNA, 15 bp, Homo sapiens
ctgccaccatgcatg

SEQ ID NO: 74459 - DNA, 15 bp, Homo sapiens
cctgccaccatgcat

SEQ ID NO: 74460 - DNA, 15 bp, Homo sapiens
gcctgccaccatgca

SEQ ID NO: 74461 - DNA, 15 bp, Homo sapiens
tgcctgccaccatgc

SEQ ID NO: 74462 - DNA, 15 bp, Homo sapiens
ttgcctgccaccatg

SEQ ID NO: 74463 - DNA, 15 bp, Homo sapiens
tctctctttgcctgc

SEQ ID NO: 74464 - DNA, 15 bp, Homo sapiens
ctctctctttgcctg

SEQ ID NO: 74465 - DNA, 15 bp, Homo sapiens
tctctctctttgcct

SEQ ID NO: 74466 - DNA, 15 bp, Homo sapiens
ctctctctctttgcc

SEQ ID NO: 74467 - DNA, 15 bp, Homo sapiens
gctctctctctttgc

SEQ ID NO: 74468 - DNA, 15 bp, Homo sapiens
agctctctctctttg

SEQ ID NO: 74469 - DNA, 15 bp, Homo sapiens
aagctctctctcttt

SEQ ID NO: 74470 - DNA, 15 bp, Homo sapiens
caagctctctctctt

SEQ ID NO: 74471 - DNA, 15 bp, Homo sapiens
acaagctctctctct

SEQ ID NO: 74472 - DNA, 15 bp, Homo sapiens
cacaagctctctctc

SEQ ID NO: 74473 - DNA, 15 bp, Homo sapiens
gcacaagctctctct

SEQ ID NO: 74474 - DNA, 15 bp, Homo sapiens
tgcacaagctctctc

SEQ ID NO: 74475 - DNA, 15 bp, Homo sapiens
ctgcacaagctctct

SEQ ID NO: 74476 - DNA, 15 bp, Homo sapiens
cctgcacaagctctc

SEQ ID NO: 74477 - DNA, 15 bp, Homo sapiens
ccctgcacaagctct

SEQ ID NO: 74478 - DNA, 15 bp, Homo sapiens
gggagtttccctgca

SEQ ID NO: 74479 - DNA, 15 bp, Homo sapiens
agggagtttccctgc

SEQ ID NO: 74480 - DNA, 15 bp, Homo sapiens
aagggagtttccctg

SEQ ID NO: 74481 - DNA, 15 bp, Homo sapiens
aaagggagtttccct

SEQ ID NO: 74482 - DNA, 15 bp, Homo sapiens
aaaagggagtttccc

SEQ ID NO: 74483 - DNA, 15 bp, Homo sapiens
caaaagggagtttcc

SEQ ID NO: 74484 - DNA, 15 bp, Homo sapiens
acaaaagggagtttc

SEQ ID NO: 74485 - DNA, 15 bp, Homo sapiens
tacaaaagggagttt

SEQ ID NO: 74486 - DNA, 15 bp, Homo sapiens
ttacaaaagggagtt

SEQ ID NO: 74487 - DNA, 15 bp, Homo sapiens
tttacaaaagggagt

SEQ ID NO: 74488 - DNA, 15 bp, Homo sapiens
ttttacaaaagggag

SEQ ID NO: 74489 - DNA, 15 bp, Homo sapiens
gttttacaaaaggga

SEQ ID NO: 74490 - DNA, 15 bp, Homo sapiens
ggttttacaaaaggg

SEQ ID NO: 74491 - DNA, 15 bp, Homo sapiens
tggttttacaaaagg

SEQ ID NO: 74492 - DNA, 15 bp, Homo sapiens
atggttttacaaaag

SEQ ID NO: 74493 - DNA, 15 bp, Homo sapiens
gatggttttacaaaa

SEQ ID NO: 74494 - DNA, 15 bp, Homo sapiens
tgatggttttacaaa

SEQ ID NO: 74495 - DNA, 15 bp, Homo sapiens
ctgatggttttacaa

SEQ ID NO: 74496 - DNA, 15 bp, Homo sapiens
tctgatggttttaca

SEQ ID NO: 74497 - DNA, 15 bp, Homo sapiens
atctgatggttttac

SEQ ID NO: 74498 - DNA, 15 bp, Homo sapiens
gatctgatggtttta

SEQ ID NO: 74499 - DNA, 15 bp, Homo sapiens
agatctgatggtttt

SEQ ID NO: 74500 - DNA, 15 bp, Homo sapiens
gagatctgatggttt

SEQ ID NO: 74501 - DNA, 15 bp, Homo sapiens
cgagatctgatggtt

SEQ ID NO: 74502 - DNA, 15 bp, Homo sapiens
acgagatctgatggt

SEQ ID NO: 74503 - DNA, 15 bp, Homo sapiens
cacgagatctgatgg

SEQ ID NO: 74504 - DNA, 15 bp, Homo sapiens
tcacgagatctgatg

SEQ ID NO: 74505 - DNA, 15 bp, Homo sapiens
ctcacgagatctgat

SEQ ID NO: 74506 - DNA, 15 bp, Homo sapiens
tctcacgagatctga

SEQ ID NO: 74507 - DNA, 15 bp, Homo sapiens
gtctcacgagatctg

SEQ ID NO: 74508 - DNA, 15 bp, Homo sapiens
agtctcacgagatct

SEQ ID NO: 74509 - DNA, 15 bp, Homo sapiens
aagtctcacgagatc

SEQ ID NO: 74510 - DNA, 15 bp, Homo sapiens
taagtctcacgagat

SEQ ID NO: 74511 - DNA, 15 bp, Homo sapiens
ataagtctcacgaga

SEQ ID NO: 74512 - DNA, 15 bp, Homo sapiens
aataagtctcacgag

SEQ ID NO: 74513 - DNA, 15 bp, Homo sapiens
gaataagtctcacga

SEQ ID NO: 74514 - DNA, 15 bp, Homo sapiens
tgaataagtctcacg

SEQ ID NO: 74515 - DNA, 15 bp, Homo sapiens
gtgaataagtctcac

SEQ ID NO: 74516 - DNA, 15 bp, Homo sapiens
agtgaataagtctca

SEQ ID NO: 74517 - DNA, 15 bp, Homo sapiens
tagtgaataagtctc

SEQ ID NO: 74518 - DNA, 15 bp, Homo sapiens
atagtgaataagtct

SEQ ID NO: 74519 - DNA, 15 bp, Homo sapiens
tatagtgaataagtc

SEQ ID NO: 74520 - DNA, 15 bp, Homo sapiens
ttatagtgaataagt

SEQ ID NO: 74521 - DNA, 15 bp, Homo sapiens
attatagtgaataag

SEQ ID NO: 74522 - DNA, 15 bp, Homo sapiens
cattatagtgaataa

SEQ ID NO: 74523 - DNA, 15 bp, Homo sapiens
tcattatagtgaata

SEQ ID NO: 74524 - DNA, 15 bp, Homo sapiens
ctcattatagtgaat

SEQ ID NO: 74525 - DNA, 15 bp, Homo sapiens
tctcattatagtgaa

SEQ ID NO: 74526 - DNA, 15 bp, Homo sapiens
ttctcattatagtga

SEQ ID NO: 74527 - DNA, 15 bp, Homo sapiens
gttctcattatagtg

SEQ ID NO: 74528 - DNA, 15 bp, Homo sapiens
tgttctcattatagt

SEQ ID NO: 74529 - DNA, 15 bp, Homo sapiens
ctgttctcattatag

SEQ ID NO: 74530 - DNA, 15 bp, Homo sapiens
gctgttctcattata

SEQ ID NO: 74531 - DNA, 15 bp, Homo sapiens
tgctgttctcattat

SEQ ID NO: 74532 - DNA, 15 bp, Homo sapiens
atgctgttctcatta

SEQ ID NO: 74533 - DNA, 15 bp, Homo sapiens
catgctgttctcatt

SEQ ID NO: 74534 - DNA, 15 bp, Homo sapiens
ccatgctgttctcat

SEQ ID NO: 74535 - DNA, 15 bp, Homo sapiens
cccatgctgttctca

SEQ ID NO: 74536 - DNA, 15 bp, Homo sapiens
tcccatgctgttctc

SEQ ID NO: 74537 - DNA, 15 bp, Homo sapiens
ttcccatgctgttct

SEQ ID NO: 74538 - DNA, 15 bp, Homo sapiens
tttcccatgctgttc

SEQ ID NO: 74539 - DNA, 15 bp, Homo sapiens
ctttcccatgctgtt

SEQ ID NO: 74540 - DNA, 15 bp, Homo sapiens
tctttcccatgctgt

SEQ ID NO: 74541 - DNA, 15 bp, Homo sapiens
atctttcccatgctg

SEQ ID NO: 74542 - DNA, 15 bp, Homo sapiens
gatctttcccatgct

SEQ ID NO: 74543 - DNA, 15 bp, Homo sapiens
agatctttcccatgc

SEQ ID NO: 74544 - DNA, 15 bp, Homo sapiens
cagatctttcccatg

SEQ ID NO: 74545 - DNA, 15 bp, Homo sapiens
gcagatctttcccat

SEQ ID NO: 74546 - DNA, 15 bp, Homo sapiens
ggcagatctttccca

SEQ ID NO: 74547 - DNA, 15 bp, Homo sapiens
gggcagatctttccc

SEQ ID NO: 74548 - DNA, 15 bp, Homo sapiens
ggggcagatctttcc

SEQ ID NO: 74549 - DNA, 15 bp, Homo sapiens
gggggcagatctttc

SEQ ID NO: 74550 - DNA, 15 bp, Homo sapiens
tgggggcagatcttt

SEQ ID NO: 74551 - DNA, 15 bp, Homo sapiens
atgggggcagatctt

SEQ ID NO: 74552 - DNA, 15 bp, Homo sapiens
catgggggcagatct

SEQ ID NO: 74553 - DNA, 15 bp, Homo sapiens
gcatgggggcagatc

SEQ ID NO: 74554 - DNA, 15 bp, Homo sapiens
agcatgggggcagat

SEQ ID NO: 74555 - DNA, 15 bp, Homo sapiens
aagcatgggggcaga

SEQ ID NO: 74556 - DNA, 15 bp, Homo sapiens
gaagcatgggggcag

SEQ ID NO: 74557 - DNA, 15 bp, Homo sapiens
tgaagcatgggggca

SEQ ID NO: 74558 - DNA, 15 bp, Homo sapiens
ttgaagcatgggggc

SEQ ID NO: 74559 - DNA, 15 bp, Homo sapiens
attgaagcatggggg

SEQ ID NO: 74560 - DNA, 15 bp, Homo sapiens
aattgaagcatgggg

SEQ ID NO: 74561 - DNA, 15 bp, Homo sapiens
taattgaagcatggg

SEQ ID NO: 74562 - DNA, 15 bp, Homo sapiens
gtaattgaagcatgg

SEQ ID NO: 74563 - DNA, 15 bp, Homo sapiens
ggtaattgaagcatg

SEQ ID NO: 74564 - DNA, 15 bp, Homo sapiens
aggtaattgaagcat

SEQ ID NO: 74565 - DNA, 15 bp, Homo sapiens
gaggtaattgaagca

SEQ ID NO: 74566 - DNA, 15 bp, Homo sapiens
ggaggtaattgaagc

SEQ ID NO: 74567 - DNA, 15 bp, Homo sapiens
gggaggtaattgaag

SEQ ID NO: 74568 - DNA, 15 bp, Homo sapiens
tgggaggtaattgaa

SEQ ID NO: 74569 - DNA, 15 bp, Homo sapiens
ggtgggaggtaattg

SEQ ID NO: 74570 - DNA, 15 bp, Homo sapiens
tggtgggaggtaatt

SEQ ID NO: 74571 - DNA, 15 bp, Homo sapiens
ttggtgggaggtaat

SEQ ID NO: 74572 - DNA, 15 bp, Homo sapiens
cttggtgggaggtaa

SEQ ID NO: 74573 - DNA, 15 bp, Homo sapiens
acttggtgggaggta

SEQ ID NO: 74574 - DNA, 15 bp, Homo sapiens
aacttggtgggaggt

SEQ ID NO: 74575 - DNA, 15 bp, Homo sapiens
gaacttggtgggagg

SEQ ID NO: 74576 - DNA, 15 bp, Homo sapiens
ggaacttggtgggag

SEQ ID NO: 74577 - DNA, 15 bp, Homo sapiens
aggaacttggtggga

SEQ ID NO: 74578 - DNA, 15 bp, Homo sapiens
gaggaacttggtggg

SEQ ID NO: 74579 - DNA, 15 bp, Homo sapiens
agaggaacttggtgg

SEQ ID NO: 74580 - DNA, 15 bp, Homo sapiens
gagaggaacttggtg

SEQ ID NO: 74581 - DNA, 15 bp, Homo sapiens
tgagaggaacttggt

SEQ ID NO: 74582 - DNA, 15 bp, Homo sapiens
ttgagaggaacttgg

SEQ ID NO: 74583 - DNA, 15 bp, Homo sapiens
tttgagaggaacttg

SEQ ID NO: 74584 - DNA, 15 bp, Homo sapiens
ttttgagaggaactt

SEQ ID NO: 74585 - DNA, 15 bp, Homo sapiens
tttttgagaggaact

SEQ ID NO: 74586 - DNA, 15 bp, Homo sapiens
ttttttgagaggaac

SEQ ID NO: 74587 - DNA, 15 bp, Homo sapiens
attttttgagaggaa

SEQ ID NO: 74588 - DNA, 15 bp, Homo sapiens
cattttttgagagga

SEQ ID NO: 74589 - DNA, 15 bp, Homo sapiens
acattttttgagagg

SEQ ID NO: 74590 - DNA, 15 bp, Homo sapiens
cacattttttgagag

SEQ ID NO: 74591 - DNA, 15 bp, Homo sapiens
tcacattttttgaga

SEQ ID NO: 74592 - DNA, 15 bp, Homo sapiens
ctcacattttttgag

SEQ ID NO: 74593 - DNA, 15 bp, Homo sapiens
tctcacattttttga

SEQ ID NO: 74594 - DNA, 15 bp, Homo sapiens
ttctcacattttttg

SEQ ID NO: 74595 - DNA, 15 bp, Homo sapiens
gttctcacatttttt

SEQ ID NO: 74596 - DNA, 15 bp, Homo sapiens
agttctcacattttt

SEQ ID NO: 74597 - DNA, 15 bp, Homo sapiens
cagttctcacatttt

SEQ ID NO: 74598 - DNA, 15 bp, Homo sapiens
acagttctcacattt

SEQ ID NO: 74599 - DNA, 15 bp, Homo sapiens
cacagttctcacatt

SEQ ID NO: 74600 - DNA, 15 bp, Homo sapiens
ccacagttctcacat

SEQ ID NO: 74601 - DNA, 15 bp, Homo sapiens
accacagttctcaca

SEQ ID NO: 74602 - DNA, 15 bp, Homo sapiens
taccacagttctcac

SEQ ID NO: 74603 - DNA, 15 bp, Homo sapiens
ctaccacagttctca

SEQ ID NO: 74604 - DNA, 15 bp, Homo sapiens
actaccacagttctc

SEQ ID NO: 74605 - DNA, 15 bp, Homo sapiens
aactaccacagttct

SEQ ID NO: 74606 - DNA, 15 bp, Homo sapiens
taactaccacagttc

SEQ ID NO: 74607 - DNA, 15 bp, Homo sapiens
ataactaccacagtt

SEQ ID NO: 74608 - DNA, 15 bp, Homo sapiens
tataactaccacagt

SEQ ID NO: 74609 - DNA, 15 bp, Homo sapiens
ttataactaccacag

SEQ ID NO: 74610 - DNA, 15 bp, Homo sapiens
attataactaccaca

SEQ ID NO: 74611 - DNA, 15 bp, Homo sapiens
cattataactaccac

SEQ ID NO: 74612 - DNA, 15 bp, Homo sapiens
gcattataactacca

SEQ ID NO: 74613 - DNA, 15 bp, Homo sapiens
tgcattataactacc

SEQ ID NO: 74614 - DNA, 15 bp, Homo sapiens
ttgcattataactac

SEQ ID NO: 74615 - DNA, 15 bp, Homo sapiens
cttgcattataacta

SEQ ID NO: 74616 - DNA, 15 bp, Homo sapiens
tcttgcattataact

SEQ ID NO: 74617 - DNA, 15 bp, Homo sapiens
atcttgcattataac

SEQ ID NO: 74618 - DNA, 15 bp, Homo sapiens
catcttgcattataa

SEQ ID NO: 74619 - DNA, 15 bp, Homo sapiens
tcatcttgcattata

SEQ ID NO: 74620 - DNA, 15 bp, Homo sapiens
ctcatcttgcattat

SEQ ID NO: 74621 - DNA, 15 bp, Homo sapiens
tctcatcttgcatta

SEQ ID NO: 74622 - DNA, 15 bp, Homo sapiens
atctcatcttgcatt

SEQ ID NO: 74623 - DNA, 15 bp, Homo sapiens
aatctcatcttgcat

SEQ ID NO: 74624 - DNA, 15 bp, Homo sapiens
aaatctcatcttgca

SEQ ID NO: 74625 - DNA, 15 bp, Homo sapiens
caaatctcatcttgc

SEQ ID NO: 74626 - DNA, 15 bp, Homo sapiens
ccaaatctcatcttg

SEQ ID NO: 74627 - DNA, 15 bp, Homo sapiens
tccaaatctcatctt

SEQ ID NO: 74628 - DNA, 15 bp, Homo sapiens
atccaaatctcatct

SEQ ID NO: 74629 - DNA, 15 bp, Homo sapiens
catccaaatctcatc

SEQ ID NO: 74630 - DNA, 15 bp, Homo sapiens
ccatccaaatctcat

SEQ ID NO: 74631 - DNA, 15 bp, Homo sapiens
tccatccaaatctca

SEQ ID NO: 74632 - DNA, 15 bp, Homo sapiens
ctccatccaaatctc

SEQ ID NO: 74633 - DNA, 15 bp, Homo sapiens
tctccatccaaatct

SEQ ID NO: 74634 - DNA, 15 bp, Homo sapiens
gtctccatccaaatc

SEQ ID NO: 74635 - DNA, 15 bp, Homo sapiens
tgtctccatccaaat

SEQ ID NO: 74636 - DNA, 15 bp, Homo sapiens
gtgtctccatccaaa

SEQ ID NO: 74637 - DNA, 15 bp, Homo sapiens
tgtgtctccatccaa

SEQ ID NO: 74638 - DNA, 15 bp, Homo sapiens
ctgtgtctccatcca

SEQ ID NO: 74639 - DNA, 15 bp, Homo sapiens
cctgtgtctccatcc

SEQ ID NO: 74640 - DNA, 15 bp, Homo sapiens
gcctgtgtctccatc

SEQ ID NO: 74641 - DNA, 15 bp, Homo sapiens
tgcctgtgtctccat

SEQ ID NO: 74642 - DNA, 15 bp, Homo sapiens
ttgcctgtgtctcca

SEQ ID NO: 74643 - DNA, 15 bp, Homo sapiens
tttgcctgtgtctcc

SEQ ID NO: 74644 - DNA, 15 bp, Homo sapiens
gtttgcctgtgtctc

SEQ ID NO: 74645 - DNA, 15 bp, Homo sapiens
ggtttgcctgtgtct

SEQ ID NO: 74646 - DNA, 15 bp, Homo sapiens
tggtttgcctgtgtc

SEQ ID NO: 74647 - DNA, 15 bp, Homo sapiens
atggtttgcctgtgt

SEQ ID NO: 74648 - DNA, 15 bp, Homo sapiens
tatggtttgcctgtg

SEQ ID NO: 74649 - DNA, 15 bp, Homo sapiens
atatggtttgcctgt

SEQ ID NO: 74650 - DNA, 15 bp, Homo sapiens
gatatggtttgcctg

SEQ ID NO: 74651 - DNA, 15 bp, Homo sapiens
tgatatggtttgcct

SEQ ID NO: 74652 - DNA, 15 bp, Homo sapiens
gtgatatggtttgcc

SEQ ID NO: 74653 - DNA, 15 bp, Homo sapiens
tgtgatatggtttgc

SEQ ID NO: 74654 - DNA, 15 bp, Homo sapiens
gtgtgatatggtttg

SEQ ID NO: 74655 - DNA, 15 bp, Homo sapiens
tgtgtgatatggttt

SEQ ID NO: 74656 - DNA, 15 bp, Homo sapiens
ctgtgtgatatggtt

SEQ ID NO: 74657 - DNA, 15 bp, Homo sapiens
cctgtgtgatatggt

SEQ ID NO: 74658 - DNA, 15 bp, Homo sapiens
tcctgtgtgatatgg

SEQ ID NO: 74659 - DNA, 15 bp, Homo sapiens
ctcctgtgtgatatg

SEQ ID NO: 74660 - DNA, 15 bp, Homo sapiens
gctcctgtgtgatat

SEQ ID NO: 74661 - DNA, 15 bp, Homo sapiens
agctcctgtgtgata

SEQ ID NO: 74662 - DNA, 15 bp, Homo sapiens
cagctcctgtgtgat

SEQ ID NO: 74663 - DNA, 15 bp, Homo sapiens
tcagctcctgtgtga

SEQ ID NO: 74664 - DNA, 15 bp, Homo sapiens
atcagctcctgtgtg

SEQ ID NO: 74665 - DNA, 15 bp, Homo sapiens
gatcagctcctgtgt

SEQ ID NO: 74666 - DNA, 15 bp, Homo sapiens
agatcagctcctgtg

SEQ ID NO: 74667 - DNA, 15 bp, Homo sapiens
aagatcagctcctgt

SEQ ID NO: 74668 - DNA, 15 bp, Homo sapiens
taagatcagctcctg

SEQ ID NO: 74669 - DNA, 15 bp, Homo sapiens
ataagatcagctcct

SEQ ID NO: 74670 - DNA, 15 bp, Homo sapiens
aataagatcagctcc

SEQ ID NO: 74671 - DNA, 15 bp, Homo sapiens
taataagatcagctc

SEQ ID NO: 74672 - DNA, 15 bp, Homo sapiens
ttaataagatcagct

SEQ ID NO: 74673 - DNA, 15 bp, Homo sapiens
cttaataagatcagc

SEQ ID NO: 74674 - DNA, 15 bp, Homo sapiens
acttaataagatcag

SEQ ID NO: 74675 - DNA, 15 bp, Homo sapiens
cacttaataagatca

SEQ ID NO: 74676 - DNA, 15 bp, Homo sapiens
tcacttaataagatc

SEQ ID NO: 74677 - DNA, 15 bp, Homo sapiens
atcacttaataagat

SEQ ID NO: 74678 - DNA, 15 bp, Homo sapiens
gatcacttaataaga

SEQ ID NO: 74679 - DNA, 15 bp, Homo sapiens
ggatcacttaataag

SEQ ID NO: 74680 - DNA, 15 bp, Homo sapiens
tggatcacttaataa

SEQ ID NO: 74681 - DNA, 15 bp, Homo sapiens
gtggatcacttaata

SEQ ID NO: 74682 - DNA, 15 bp, Homo sapiens
agtggatcacttaat

SEQ ID NO: 74683 - DNA, 15 bp, Homo sapiens
cagtggatcacttaa

SEQ ID NO: 74684 - DNA, 15 bp, Homo sapiens
tcagtggatcactta

SEQ ID NO: 74685 - DNA, 15 bp, Homo sapiens
gtcagtggatcactt

SEQ ID NO: 74686 - DNA, 15 bp, Homo sapiens
agtcagtggatcact

SEQ ID NO: 74687 - DNA, 15 bp, Homo sapiens
aagtcagtggatcac

SEQ ID NO: 74688 - DNA, 15 bp, Homo sapiens
gaagtcagtggatca

SEQ ID NO: 74689 - DNA, 15 bp, Homo sapiens
agaagtcagtggatc

SEQ ID NO: 74690 - DNA, 15 bp, Homo sapiens
aagaagtcagtggat

SEQ ID NO: 74691 - DNA, 15 bp, Homo sapiens
gaagaagtcagtgga

SEQ ID NO: 74692 - DNA, 15 bp, Homo sapiens
agaagaagtcagtgg

SEQ ID NO: 74693 - DNA, 15 bp, Homo sapiens
gagaagaagtcagtg

SEQ ID NO: 74694 - DNA, 15 bp, Homo sapiens
tgagaagaagtcagt

SEQ ID NO: 74695 - DNA, 15 bp, Homo sapiens
ctgagaagaagtcag

SEQ ID NO: 74696 - DNA, 15 bp, Homo sapiens
tctgagaagaagtca

SEQ ID NO: 74697 - DNA, 15 bp, Homo sapiens
ttctgagaagaagtc

SEQ ID NO: 74698 - DNA, 15 bp, Homo sapiens
cttctgagaagaagt

SEQ ID NO: 74699 - DNA, 15 bp, Homo sapiens
gcttctgagaagaag

SEQ ID NO: 74700 - DNA, 15 bp, Homo sapiens
tgcttctgagaagaa

SEQ ID NO: 74701 - DNA, 15 bp, Homo sapiens
gtgcttctgagaaga

SEQ ID NO: 74702 - DNA, 15 bp, Homo sapiens
agtgcttctgagaag

SEQ ID NO: 74703 - DNA, 15 bp, Homo sapiens
aagtgcttctgagaa

SEQ ID NO: 74704 - DNA, 15 bp, Homo sapiens
caagtgcttctgaga

SEQ ID NO: 74705 - DNA, 15 bp, Homo sapiens
tcaagtgcttctgag

SEQ ID NO: 74706 - DNA, 15 bp, Homo sapiens
ctcaagtgcttctga

SEQ ID NO: 74707 - DNA, 15 bp, Homo sapiens
cctcaagtgcttctg

SEQ ID NO: 74708 - DNA, 15 bp, Homo sapiens
tcctcaagtgcttct

SEQ ID NO: 74709 - DNA, 15 bp, Homo sapiens
ctcctcaagtgcttc

SEQ ID NO: 74710 - DNA, 15 bp, Homo sapiens
gctcctcaagtgctt

SEQ ID NO: 74711 - DNA, 15 bp, Homo sapiens
agctcctcaagtgct

SEQ ID NO: 74712 - DNA, 15 bp, Homo sapiens
aagctcctcaagtgc

SEQ ID NO: 74713 - DNA, 15 bp, Homo sapiens
caagctcctcaagtg

SEQ ID NO: 74714 - DNA, 15 bp, Homo sapiens
acaagctcctcaagt

SEQ ID NO: 74715 - DNA, 15 bp, Homo sapiens
aacaagctcctcaag

SEQ ID NO: 74716 - DNA, 15 bp, Homo sapiens
taacaagctcctcaa

SEQ ID NO: 74717 - DNA, 15 bp, Homo sapiens
ttaacaagctcctca

SEQ ID NO: 74718 - DNA, 15 bp, Homo sapiens
tttaacaagctcctc

SEQ ID NO: 74719 - DNA, 15 bp, Homo sapiens
ttttaacaagctcct

SEQ ID NO: 74720 - DNA, 15 bp, Homo sapiens
attttaacaagctcc

SEQ ID NO: 74721 - DNA, 15 bp, Homo sapiens
cattttaacaagctc

SEQ ID NO: 74722 - DNA, 15 bp, Homo sapiens
acattttaacaagct

SEQ ID NO: 74723 - DNA, 15 bp, Homo sapiens
tacattttaacaagc

SEQ ID NO: 74724 - DNA, 15 bp, Homo sapiens
ctacattttaacaag

SEQ ID NO: 74725 - DNA, 15 bp, Homo sapiens
tctacattttaacaa

SEQ ID NO: 74726 - DNA, 15 bp, Homo sapiens
atctacattttaaca

SEQ ID NO: 74727 - DNA, 15 bp, Homo sapiens
aatctacattttaac

SEQ ID NO: 74728 - DNA, 15 bp, Homo sapiens
gaatctacattttaa

SEQ ID NO: 74729 - DNA, 15 bp, Homo sapiens
ggaatctacatttta

SEQ ID NO: 74730 - DNA, 15 bp, Homo sapiens
aggaatctacatttt

SEQ ID NO: 74731 - DNA, 15 bp, Homo sapiens
taggaatctacattt

SEQ ID NO: 74732 - DNA, 15 bp, Homo sapiens
ctaggaatctacatt

SEQ ID NO: 74733 - DNA, 15 bp, Homo sapiens
cctaggaatctacat

SEQ ID NO: 74734 - DNA, 15 bp, Homo sapiens
gcctaggaatctaca

SEQ ID NO: 74735 - DNA, 15 bp, Homo sapiens
agcctaggaatctac

SEQ ID NO: 74736 - DNA, 15 bp, Homo sapiens
gagcctaggaatcta

SEQ ID NO: 74737 - DNA, 15 bp, Homo sapiens
agagcctaggaatct

SEQ ID NO: 74738 - DNA, 15 bp, Homo sapiens
tagagcctaggaatc

SEQ ID NO: 74739 - DNA, 15 bp, Homo sapiens
gtagagcctaggaat

SEQ ID NO: 74740 - DNA, 15 bp, Homo sapiens
ggtagagcctaggaa

SEQ ID NO: 74741 - DNA, 15 bp, Homo sapiens
gggtagagcctagga

SEQ ID NO: 74742 - DNA, 15 bp, Homo sapiens
tgggtagagcctagg

SEQ ID NO: 74743 - DNA, 15 bp, Homo sapiens
gtgggtagagcctag

SEQ ID NO: 74744 - DNA, 15 bp, Homo sapiens
agtgggtagagccta

SEQ ID NO: 74745 - DNA, 15 bp, Homo sapiens
tagtgggtagagcct

SEQ ID NO: 74746 - DNA, 15 bp, Homo sapiens
gtagtgggtagagcc

SEQ ID NO: 74747 - DNA, 15 bp, Homo sapiens
ggtagtgggtagagc

SEQ ID NO: 74748 - DNA, 15 bp, Homo sapiens
aggtagtgggtagag

SEQ ID NO: 74749 - DNA, 15 bp, Homo sapiens
taggtagtgggtaga

SEQ ID NO: 74750 - DNA, 15 bp, Homo sapiens
ttaggtagtgggtag

SEQ ID NO: 74751 - DNA, 15 bp, Homo sapiens
tttaggtagtgggta

SEQ ID NO: 74752 - DNA, 15 bp, Homo sapiens
atttaggtagtgggt

SEQ ID NO: 74753 - DNA, 15 bp, Homo sapiens
gatttaggtagtggg

SEQ ID NO: 74754 - DNA, 15 bp, Homo sapiens
agatttaggtagtgg

SEQ ID NO: 74755 - DNA, 15 bp, Homo sapiens
tagatttaggtagtg

SEQ ID NO: 74756 - DNA, 15 bp, Homo sapiens
ctagatttaggtagt

SEQ ID NO: 74757 - DNA, 15 bp, Homo sapiens
cctagatttaggtag

SEQ ID NO: 74758 - DNA, 15 bp, Homo sapiens
acctagatttaggta

SEQ ID NO: 74759 - DNA, 15 bp, Homo sapiens
cacctagatttaggt

SEQ ID NO: 74760 - DNA, 15 bp, Homo sapiens
tcacctagatttagg

SEQ ID NO: 74761 - DNA, 15 bp, Homo sapiens
ctcacctagatttag

SEQ ID NO: 74762 - DNA, 15 bp, Homo sapiens
cctcacctagattta

SEQ ID NO: 74763 - DNA, 15 bp, Homo sapiens
ccctcacctagattt

SEQ ID NO: 74764 - DNA, 15 bp, Homo sapiens
tccctcacctagatt

SEQ ID NO: 74765 - DNA, 15 bp, Homo sapiens
ctccctcacctagat

SEQ ID NO: 74766 - DNA, 15 bp, Homo sapiens
cctccctcacctaga

SEQ ID NO: 74767 - DNA, 15 bp, Homo sapiens
ccctccctcacctag

SEQ ID NO: 74768 - DNA, 15 bp, Homo sapiens
tccctccctcaccta

SEQ ID NO: 74769 - DNA, 15 bp, Homo sapiens
atccctccctcacct

SEQ ID NO: 74770 - DNA, 15 bp, Homo sapiens
catccctccctcacc

SEQ ID NO: 74771 - DNA, 15 bp, Homo sapiens
gcatccctccctcac

SEQ ID NO: 74772 - DNA, 15 bp, Homo sapiens
tgcatccctccctca

SEQ ID NO: 74773 - DNA, 15 bp, Homo sapiens
ctgcatccctccctc

SEQ ID NO: 74774 - DNA, 15 bp, Homo sapiens
actgcatccctccct

SEQ ID NO: 74775 - DNA, 15 bp, Homo sapiens
cactgcatccctccc

SEQ ID NO: 74776 - DNA, 15 bp, Homo sapiens
tcactgcatccctcc

SEQ ID NO: 74777 - DNA, 15 bp, Homo sapiens
ttcactgcatccctc

SEQ ID NO: 74778 - DNA, 15 bp, Homo sapiens
attcactgcatccct

SEQ ID NO: 74779 - DNA, 15 bp, Homo sapiens
aattcactgcatccc

SEQ ID NO: 74780 - DNA, 15 bp, Homo sapiens
aaattcactgcatcc

SEQ ID NO: 74781 - DNA, 15 bp, Homo sapiens
caaattcactgcatc

SEQ ID NO: 74782 - DNA, 15 bp, Homo sapiens
gcaaattcactgcat

SEQ ID NO: 74783 - DNA, 15 bp, Homo sapiens
tgcaaattcactgca

SEQ ID NO: 74784 - DNA, 15 bp, Homo sapiens
ttgcaaattcactgc

SEQ ID NO: 74785 - DNA, 15 bp, Homo sapiens
attgcaaattcactg

SEQ ID NO: 74786 - DNA, 15 bp, Homo sapiens
cattgcaaattcact

SEQ ID NO: 74787 - DNA, 15 bp, Homo sapiens
acattgcaaattcac

SEQ ID NO: 74788 - DNA, 15 bp, Homo sapiens
tacattgcaaattca

SEQ ID NO: 74789 - DNA, 15 bp, Homo sapiens
ttacattgcaaattc

SEQ ID NO: 74790 - DNA, 15 bp, Homo sapiens
cttacattgcaaatt

SEQ ID NO: 74791 - DNA, 15 bp, Homo sapiens
tcttacattgcaaat

SEQ ID NO: 74792 - DNA, 15 bp, Homo sapiens
ttcttacattgcaaa

SEQ ID NO: 74793 - DNA, 15 bp, Homo sapiens
tttcttacattgcaa

SEQ ID NO: 74794 - DNA, 15 bp, Homo sapiens
ttttcttacattgca

SEQ ID NO: 74795 - DNA, 15 bp, Homo sapiens
tttttcttacattgc

SEQ ID NO: 74796 - DNA, 15 bp, Homo sapiens
atttttcttacattg

SEQ ID NO: 74797 - DNA, 15 bp, Homo sapiens
gatttttcttacatt

SEQ ID NO: 74798 - DNA, 15 bp, Homo sapiens
tgatttttcttacat

SEQ ID NO: 74799 - DNA, 15 bp, Homo sapiens
atgatttttcttaca

SEQ ID NO: 74800 - DNA, 15 bp, Homo sapiens
catgatttttcttac

SEQ ID NO: 74801 - DNA, 15 bp, Homo sapiens
acatgatttttctta

SEQ ID NO: 74802 - DNA, 15 bp, Homo sapiens
cacatgatttttctt

SEQ ID NO: 74803 - DNA, 15 bp, Homo sapiens
gcacatgatttttct

SEQ ID NO: 74804 - DNA, 15 bp, Homo sapiens
tgcacatgatttttc

SEQ ID NO: 74805 - DNA, 15 bp, Homo sapiens
atgcacatgattttt

SEQ ID NO: 74806 - DNA, 15 bp, Homo sapiens
tatgcacatgatttt

SEQ ID NO: 74807 - DNA, 15 bp, Homo sapiens
ctatgcacatgattt

SEQ ID NO: 74808 - DNA, 15 bp, Homo sapiens
actatgcacatgatt

SEQ ID NO: 74809 - DNA, 15 bp, Homo sapiens
tactatgcacatgat

SEQ ID NO: 74810 - DNA, 15 bp, Homo sapiens
ttactatgcacatga

SEQ ID NO: 74811 - DNA, 15 bp, Homo sapiens
tttactatgcacatg

SEQ ID NO: 74812 - DNA, 15 bp, Homo sapiens
ctttactatgcacat

SEQ ID NO: 74813 - DNA, 15 bp, Homo sapiens
actttactatgcaca

SEQ ID NO: 74814 - DNA, 15 bp, Homo sapiens
aactttactatgcac

SEQ ID NO: 74815 - DNA, 15 bp, Homo sapiens
aaactttactatgca

SEQ ID NO: 74816 - DNA, 15 bp, Homo sapiens
caaactttactatgc

SEQ ID NO: 74817 - DNA, 15 bp, Homo sapiens
tcaaactttactatg

SEQ ID NO: 74818 - DNA, 15 bp, Homo sapiens
ctcaaactttactat

SEQ ID NO: 74819 - DNA, 15 bp, Homo sapiens
tctcaaactttacta

SEQ ID NO: 74820 - DNA, 15 bp, Homo sapiens
ttctcaaactttact

SEQ ID NO: 74821 - DNA, 15 bp, Homo sapiens
attctcaaactttac

SEQ ID NO: 74822 - DNA, 15 bp, Homo sapiens
aattctcaaacttta

SEQ ID NO: 74823 - DNA, 15 bp, Homo sapiens
aaattctcaaacttt

SEQ ID NO: 74824 - DNA, 15 bp, Homo sapiens
gaaattctcaaactt

SEQ ID NO: 74825 - DNA, 15 bp, Homo sapiens
tgaaattctcaaact

SEQ ID NO: 74826 - DNA, 15 bp, Homo sapiens
gtgaaattctcaaac

SEQ ID NO: 74827 - DNA, 15 bp, Homo sapiens
ggtgaaattctcaaa

SEQ ID NO: 74828 - DNA, 15 bp, Homo sapiens
aggtgaaattctcaa

SEQ ID NO: 74829 - DNA, 15 bp, Homo sapiens
taggtgaaattctca

SEQ ID NO: 74830 - DNA, 15 bp, Homo sapiens
ctaggtgaaattctc

SEQ ID NO: 74831 - DNA, 15 bp, Homo sapiens
actaggtgaaattct

SEQ ID NO: 74832 - DNA, 15 bp, Homo sapiens
tactaggtgaaattc

SEQ ID NO: 74833 - DNA, 15 bp, Homo sapiens
ctactaggtgaaatt

SEQ ID NO: 74834 - DNA, 15 bp, Homo sapiens
cctactaggtgaaat

SEQ ID NO: 74835 - DNA, 15 bp, Homo sapiens
tcctactaggtgaaa

SEQ ID NO: 74836 - DNA, 15 bp, Homo sapiens
atcctactaggtgaa

SEQ ID NO: 74837 - DNA, 15 bp, Homo sapiens
aatcctactaggtga

SEQ ID NO: 74838 - DNA, 15 bp, Homo sapiens
gaatcctactaggtg

SEQ ID NO: 74839 - DNA, 15 bp, Homo sapiens
tgaatcctactaggt

SEQ ID NO: 74840 - DNA, 15 bp, Homo sapiens
ttgaatcctactagg

SEQ ID NO: 74841 - DNA, 15 bp, Homo sapiens
attgaatcctactag

SEQ ID NO: 74842 - DNA, 15 bp, Homo sapiens
tattgaatcctacta

SEQ ID NO: 74843 - DNA, 15 bp, Homo sapiens
atattgaatcctact

SEQ ID NO: 74844 - DNA, 15 bp, Homo sapiens
gatattgaatcctac

SEQ ID NO: 74845 - DNA, 15 bp, Homo sapiens
agatattgaatccta

SEQ ID NO: 74846 - DNA, 15 bp, Homo sapiens
gagatattgaatcct

SEQ ID NO: 74847 - DNA, 15 bp, Homo sapiens
tgagatattgaatcc

SEQ ID NO: 74848 - DNA, 15 bp, Homo sapiens
ctgagatattgaatc

SEQ ID NO: 74849 - DNA, 15 bp, Homo sapiens
actgagatattgaat

SEQ ID NO: 74850 - DNA, 15 bp, Homo sapiens
cactgagatattgaa

SEQ ID NO: 74851 - DNA, 15 bp, Homo sapiens
acactgagatattga

SEQ ID NO: 74852 - DNA, 15 bp, Homo sapiens
aacactgagatattg

SEQ ID NO: 74853 - DNA, 15 bp, Homo sapiens
aaacactgagatatt

SEQ ID NO: 74854 - DNA, 15 bp, Homo sapiens
aaaacactgagatat

SEQ ID NO: 74855 - DNA, 15 bp, Homo sapiens
gaaaacactgagata

SEQ ID NO: 74856 - DNA, 15 bp, Homo sapiens
cgaaaacactgagat

SEQ ID NO: 74857 - DNA, 15 bp, Homo sapiens
ccgaaaacactgaga

SEQ ID NO: 74858 - DNA, 15 bp, Homo sapiens
accgaaaacactgag

SEQ ID NO: 74859 - DNA, 15 bp, Homo sapiens
taccgaaaacactga

SEQ ID NO: 74860 - DNA, 15 bp, Homo sapiens
ctaccgaaaacactg

SEQ ID NO: 74861 - DNA, 15 bp, Homo sapiens
tctaccgaaaacact

SEQ ID NO: 74862 - DNA, 15 bp, Homo sapiens
atctaccgaaaacac

SEQ ID NO: 74863 - DNA, 15 bp, Homo sapiens
aatctaccgaaaaca

SEQ ID NO: 74864 - DNA, 15 bp, Homo sapiens
taatctaccgaaaac

SEQ ID NO: 74865 - DNA, 15 bp, Homo sapiens
ttaatctaccgaaaa

SEQ ID NO: 74866 - DNA, 15 bp, Homo sapiens
attaatctaccgaaa

SEQ ID NO: 74867 - DNA, 15 bp, Homo sapiens
tattaatctaccgaa

SEQ ID NO: 74868 - DNA, 15 bp, Homo sapiens
atattaatctaccga

SEQ ID NO: 74869 - DNA, 15 bp, Homo sapiens
catattaatctaccg

SEQ ID NO: 74870 - DNA, 15 bp, Homo sapiens
acatattaatctacc

SEQ ID NO: 74871 - DNA, 15 bp, Homo sapiens
cacatattaatctac

SEQ ID NO: 74872 - DNA, 15 bp, Homo sapiens
tcacatattaatcta

SEQ ID NO: 74873 - DNA, 15 bp, Homo sapiens
ttcacatattaatct

SEQ ID NO: 74874 - DNA, 15 bp, Homo sapiens
attcacatattaatc

SEQ ID NO: 74875 - DNA, 15 bp, Homo sapiens
aattcacatattaat

SEQ ID NO: 74876 - DNA, 15 bp, Homo sapiens
aaattcacatattaa

SEQ ID NO: 74877 - DNA, 15 bp, Homo sapiens
gaaattcacatatta

SEQ ID NO: 74878 - DNA, 15 bp, Homo sapiens
tgaaattcacatatt

SEQ ID NO: 74879 - DNA, 15 bp, Homo sapiens
ttgaaattcacatat

SEQ ID NO: 74880 - DNA, 15 bp, Homo sapiens
gttgaaattcacata

SEQ ID NO: 74881 - DNA, 15 bp, Homo sapiens
tgttgaaattcacat

SEQ ID NO: 74882 - DNA, 15 bp, Homo sapiens
ttgttgaaattcaca

SEQ ID NO: 74883 - DNA, 15 bp, Homo sapiens
gttgttgaaattcac

SEQ ID NO: 74884 - DNA, 15 bp, Homo sapiens
tgttgttgaaattca

SEQ ID NO: 74885 - DNA, 15 bp, Homo sapiens
ctgttgttgaaattc

SEQ ID NO: 74886 - DNA, 15 bp, Homo sapiens
actgttgttgaaatt

SEQ ID NO: 74887 - DNA, 15 bp, Homo sapiens
aactgttgttgaaat

SEQ ID NO: 74888 - DNA, 15 bp, Homo sapiens
aaactgttgttgaaa

SEQ ID NO: 74889 - DNA, 15 bp, Homo sapiens
aaaactgttgttgaa

SEQ ID NO: 74890 - DNA, 15 bp, Homo sapiens
caaaactgttgttga

SEQ ID NO: 74891 - DNA, 15 bp, Homo sapiens
ccaaaactgttgttg

SEQ ID NO: 74892 - DNA, 15 bp, Homo sapiens
tccaaaactgttgtt

SEQ ID NO: 74893 - DNA, 15 bp, Homo sapiens
ttccaaaactgttgt

SEQ ID NO: 74894 - DNA, 15 bp, Homo sapiens
tttccaaaactgttg

SEQ ID NO: 74895 - DNA, 15 bp, Homo sapiens
gtttccaaaactgtt

SEQ ID NO: 74896 - DNA, 15 bp, Homo sapiens
ggtttccaaaactgt

SEQ ID NO: 74897 - DNA, 15 bp, Homo sapiens
aggtttccaaaactg

SEQ ID NO: 74898 - DNA, 15 bp, Homo sapiens
gaggtttccaaaact

SEQ ID NO: 74899 - DNA, 15 bp, Homo sapiens
ggaggtttccaaaac

SEQ ID NO: 74900 - DNA, 15 bp, Homo sapiens
gggaggtttccaaaa

SEQ ID NO: 74901 - DNA, 15 bp, Homo sapiens
tgggaggtttccaaa

SEQ ID NO: 74902 - DNA, 15 bp, Homo sapiens
ttgggaggtttccaa

SEQ ID NO: 74903 - DNA, 15 bp, Homo sapiens
tttgggaggtttcca

SEQ ID NO: 74904 - DNA, 15 bp, Homo sapiens
ttttgggaggtttcc

SEQ ID NO: 74905 - DNA, 15 bp, Homo sapiens
attttgggaggtttc

SEQ ID NO: 74906 - DNA, 15 bp, Homo sapiens
aattttgggaggttt

SEQ ID NO: 74907 - DNA, 15 bp, Homo sapiens
caattttgggaggtt

SEQ ID NO: 74908 - DNA, 15 bp, Homo sapiens
gcaattttgggaggt

SEQ ID NO: 74909 - DNA, 15 bp, Homo sapiens
agcaattttgggagg

SEQ ID NO: 74910 - DNA, 15 bp, Homo sapiens
aagcaattttgggag

SEQ ID NO: 74911 - DNA, 15 bp, Homo sapiens
gaagcaattttggga

SEQ ID NO: 74912 - DNA, 15 bp, Homo sapiens
agaagcaattttggg

SEQ ID NO: 74913 - DNA, 15 bp, Homo sapiens
aagaagcaattttgg

SEQ ID NO: 74914 - DNA, 15 bp, Homo sapiens
aaagaagcaattttg

SEQ ID NO: 74915 - DNA, 15 bp, Homo sapiens
aaaagaagcaatttt

SEQ ID NO: 74916 - DNA, 15 bp, Homo sapiens
aaaaagaagcaattt

SEQ ID NO: 74917 - DNA, 15 bp, Homo sapiens
caaaaagaagcaatt

SEQ ID NO: 74918 - DNA, 15 bp, Homo sapiens
gcaaaaagaagcaat

SEQ ID NO: 74919 - DNA, 15 bp, Homo sapiens
tgcaaaaagaagcaa

SEQ ID NO: 74920 - DNA, 15 bp, Homo sapiens
gtgcaaaaagaagca

SEQ ID NO: 74921 - DNA, 15 bp, Homo sapiens
tgtgcaaaaagaagc

SEQ ID NO: 74922 - DNA, 15 bp, Homo sapiens
ttgtgcaaaaagaag

SEQ ID NO: 74923 - DNA, 15 bp, Homo sapiens
tttgtgcaaaaagaa

SEQ ID NO: 74924 - DNA, 15 bp, Homo sapiens
ctttgtgcaaaaaga

SEQ ID NO: 74925 - DNA, 15 bp, Homo sapiens
cctttgtgcaaaaag

SEQ ID NO: 74926 - DNA, 15 bp, Homo sapiens
gcctttgtgcaaaaa

SEQ ID NO: 74927 - DNA, 15 bp, Homo sapiens
tgcctttgtgcaaaa

SEQ ID NO: 74928 - DNA, 15 bp, Homo sapiens
ttgcctttgtgcaaa

SEQ ID NO: 74929 - DNA, 15 bp, Homo sapiens
attgcctttgtgcaa

SEQ ID NO: 74930 - DNA, 15 bp, Homo sapiens
tattgcctttgtgca

SEQ ID NO: 74931 - DNA, 15 bp, Homo sapiens
ctattgcctttgtgc

SEQ ID NO: 74932 - DNA, 15 bp, Homo sapiens
actattgcctttgtg

SEQ ID NO: 74933 - DNA, 15 bp, Homo sapiens
cactattgcctttgt

SEQ ID NO: 74934 - DNA, 15 bp, Homo sapiens
acactattgcctttg

SEQ ID NO: 74935 - DNA, 15 bp, Homo sapiens
tacactattgccttt

SEQ ID NO: 74936 - DNA, 15 bp, Homo sapiens
atacactattgcctt

SEQ ID NO: 74937 - DNA, 15 bp, Homo sapiens
gatacactattgcct

SEQ ID NO: 74938 - DNA, 15 bp, Homo sapiens
agatacactattgcc

SEQ ID NO: 74939 - DNA, 15 bp, Homo sapiens
aagatacactattgc

SEQ ID NO: 74940 - DNA, 15 bp, Homo sapiens
aaagatacactattg

SEQ ID NO: 74941 - DNA, 15 bp, Homo sapiens
taaagatacactatt

SEQ ID NO: 74942 - DNA, 15 bp, Homo sapiens
gtaaagatacactat

SEQ ID NO: 74943 - DNA, 15 bp, Homo sapiens
tgtaaagatacacta

SEQ ID NO: 74944 - DNA, 15 bp, Homo sapiens
ttgtaaagatacact

SEQ ID NO: 74945 - DNA, 15 bp, Homo sapiens
cttgtaaagatacac

SEQ ID NO: 74946 - DNA, 15 bp, Homo sapiens
acttgtaaagataca

SEQ ID NO: 74947 - DNA, 15 bp, Homo sapiens
gacttgtaaagatac

SEQ ID NO: 74948 - DNA, 15 bp, Homo sapiens
agacttgtaaagata

SEQ ID NO: 74949 - DNA, 15 bp, Homo sapiens
aagacttgtaaagat

SEQ ID NO: 74950 - DNA, 15 bp, Homo sapiens
aaagacttgtaaaga

SEQ ID NO: 74951 - DNA, 15 bp, Homo sapiens
taaagacttgtaaag

SEQ ID NO: 74952 - DNA, 15 bp, Homo sapiens
ttaaagacttgtaaa

SEQ ID NO: 74953 - DNA, 15 bp, Homo sapiens
gttaaagacttgtaa

SEQ ID NO: 74954 - DNA, 15 bp, Homo sapiens
tgttaaagacttgta

SEQ ID NO: 74955 - DNA, 15 bp, Homo sapiens
ctgttaaagacttgt

SEQ ID NO: 74956 - DNA, 15 bp, Homo sapiens
tctgttaaagacttg

SEQ ID NO: 74957 - DNA, 15 bp, Homo sapiens
atctgttaaagactt

SEQ ID NO: 74958 - DNA, 15 bp, Homo sapiens
tatctgttaaagact

SEQ ID NO: 74959 - DNA, 15 bp, Homo sapiens
ttatctgttaaagac

SEQ ID NO: 74960 - DNA, 15 bp, Homo sapiens
tttatctgttaaaga

SEQ ID NO: 74961 - DNA, 15 bp, Homo sapiens
atttatctgttaaag

SEQ ID NO: 74962 - DNA, 15 bp, Homo sapiens
aatttatctgttaaa

SEQ ID NO: 74963 - DNA, 15 bp, Homo sapiens
aaatttatctgttaa

SEQ ID NO: 74964 - DNA, 15 bp, Homo sapiens
taaatttatctgtta

SEQ ID NO: 74965 - DNA, 15 bp, Homo sapiens
ataaatttatctgtt

SEQ ID NO: 74966 - DNA, 15 bp, Homo sapiens
aataaatttatctgt

SEQ ID NO: 74967 - DNA, 15 bp, Homo sapiens
caataaatttatctg

SEQ ID NO: 74968 - DNA, 15 bp, Homo sapiens
ccaataaatttatct

SEQ ID NO: 74969 - DNA, 15 bp, Homo sapiens
accaataaatttatc

SEQ ID NO: 74970 - DNA, 15 bp, Homo sapiens
taccaataaatttat

SEQ ID NO: 74971 - DNA, 15 bp, Homo sapiens
ataccaataaattta

SEQ ID NO: 74972 - DNA, 15 bp, Homo sapiens
aataccaataaattt

SEQ ID NO: 74973 - DNA, 15 bp, Homo sapiens
aaataccaataaatt

SEQ ID NO: 74974 - DNA, 15 bp, Homo sapiens
gaaataccaataaat

SEQ ID NO: 74975 - DNA, 15 bp, Homo sapiens
tgaaataccaataaa

SEQ ID NO: 74976 - DNA, 15 bp, Homo sapiens
atgaaataccaataa

SEQ ID NO: 74977 - DNA, 15 bp, Homo sapiens
aatgaaataccaata

SEQ ID NO: 74978 - DNA, 15 bp, Homo sapiens
aaatgaaataccaat

SEQ ID NO: 74979 - DNA, 15 bp, Homo sapiens
caaatgaaataccaa

SEQ ID NO: 74980 - DNA, 15 bp, Homo sapiens
tcaaatgaaatacca

SEQ ID NO: 74981 - DNA, 15 bp, Homo sapiens
ttcaaatgaaatacc

SEQ ID NO: 74982 - DNA, 15 bp, Homo sapiens
gttcaaatgaaatac

SEQ ID NO: 74983 - DNA, 15 bp, Homo sapiens
tgttcaaatgaaata

SEQ ID NO: 74984 - DNA, 15 bp, Homo sapiens
ttgttcaaatgaaat

SEQ ID NO: 74985 - DNA, 15 bp, Homo sapiens
attgttcaaatgaaa

SEQ ID NO: 74986 - DNA, 15 bp, Homo sapiens
tattgttcaaatgaa

SEQ ID NO: 74987 - DNA, 15 bp, Homo sapiens
gtattgttcaaatga

SEQ ID NO: 74988 - DNA, 15 bp, Homo sapiens
agtattgttcaaatg

SEQ ID NO: 74989 - DNA, 15 bp, Homo sapiens
aagtattgttcaaat

SEQ ID NO: 74990 - DNA, 15 bp, Homo sapiens
caagtattgttcaaa

SEQ ID NO: 74991 - DNA, 15 bp, Homo sapiens
ccaagtattgttcaa

SEQ ID NO: 74992 - DNA, 15 bp, Homo sapiens
tccaagtattgttca

SEQ ID NO: 74993 - DNA, 15 bp, Homo sapiens
atccaagtattgttc

SEQ ID NO: 74994 - DNA, 15 bp, Homo sapiens
aatccaagtattgtt

SEQ ID NO: 74995 - DNA, 15 bp, Homo sapiens
aaatccaagtattgt

SEQ ID NO: 74996 - DNA, 15 bp, Homo sapiens
aaaatccaagtattg

SEQ ID NO: 74997 - DNA, 15 bp, Homo sapiens
gaaaatccaagtatt

SEQ ID NO: 74998 - DNA, 15 bp, Homo sapiens
agaaaatccaagtat

SEQ ID NO: 74999 - DNA, 15 bp, Homo sapiens
cagaaaatccaagta

SEQ ID NO: 75000 - DNA, 15 bp, Homo sapiens
ccagaaaatccaagt

SEQ ID NO: 75001 - DNA, 15 bp, Homo sapiens
accagaaaatccaag

SEQ ID NO: 75002 - DNA, 15 bp, Homo sapiens
taccagaaaatccaa

SEQ ID NO: 75003 - DNA, 15 bp, Homo sapiens
ttaccagaaaatcca

SEQ ID NO: 75004 - DNA, 15 bp, Homo sapiens
cttaccagaaaatcc

SEQ ID NO: 75005 - DNA, 15 bp, Homo sapiens
tcttaccagaaaatc

SEQ ID NO: 75006 - DNA, 15 bp, Homo sapiens
gtcttaccagaaaat

SEQ ID NO: 75007 - DNA, 15 bp, Homo sapiens
cgtcttaccagaaaa

SEQ ID NO: 75008 - DNA, 15 bp, Homo sapiens
acgtcttaccagaaa

SEQ ID NO: 75009 - DNA, 15 bp, Homo sapiens
aacgtcttaccagaa

SEQ ID NO: 75010 - DNA, 15 bp, Homo sapiens
caacgtcttaccaga

SEQ ID NO: 75011 - DNA, 15 bp, Homo sapiens
gcaacgtcttaccag

SEQ ID NO: 75012 - DNA, 15 bp, Homo sapiens
ggcaacgtcttacca

SEQ ID NO: 75013 - DNA, 15 bp, Homo sapiens
tggcaacgtcttacc

SEQ ID NO: 75014 - DNA, 15 bp, Homo sapiens
ttggcaacgtcttac

SEQ ID NO: 75015 - DNA, 15 bp, Homo sapiens
attggcaacgtctta

SEQ ID NO: 75016 - DNA, 15 bp, Homo sapiens
aattggcaacgtctt

SEQ ID NO: 75017 - DNA, 15 bp, Homo sapiens
aaattggcaacgtct

SEQ ID NO: 75018 - DNA, 15 bp, Homo sapiens
taaattggcaacgtc

SEQ ID NO: 75019 - DNA, 15 bp, Homo sapiens
ataaattggcaacgt

SEQ ID NO: 75020 - DNA, 15 bp, Homo sapiens
aataaattggcaacg

SEQ ID NO: 75021 - DNA, 15 bp, Homo sapiens
aaataaattggcaac

SEQ ID NO: 75022 - DNA, 15 bp, Homo sapiens
taaataaattggcaa

SEQ ID NO: 75023 - DNA, 15 bp, Homo sapiens
ttaaataaattggca

SEQ ID NO: 75024 - DNA, 15 bp, Homo sapiens
tttaaataaattggc

SEQ ID NO: 75025 - DNA, 15 bp, Homo sapiens
atttaaataaattgg

SEQ ID NO: 75026 - DNA, 15 bp, Homo sapiens
tatttaaataaattg

SEQ ID NO: 75027 - DNA, 15 bp, Homo sapiens
atatttaaataaatt

SEQ ID NO: 75028 - DNA, 15 bp, Homo sapiens
catatttaaataaat

SEQ ID NO: 75029 - DNA, 15 bp, Homo sapiens
tcatatttaaataaa

SEQ ID NO: 75030 - DNA, 15 bp, Homo sapiens
atcatatttaaataa

SEQ ID NO: 75031 - DNA, 15 bp, Homo sapiens
catcatatttaaata

SEQ ID NO: 75032 - DNA, 15 bp, Homo sapiens
cttaatgaggcatca

SEQ ID NO: 75033 - DNA, 15 bp, Homo sapiens
acttaatgaggcatc

SEQ ID NO: 75034 - DNA, 15 bp, Homo sapiens
cacttaatgaggcat

SEQ ID NO: 75035 - DNA, 15 bp, Homo sapiens
tcacttaatgaggca

SEQ ID NO: 75036 - DNA, 15 bp, Homo sapiens
ctcacttaatgaggc

SEQ ID NO: 75037 - DNA, 15 bp, Homo sapiens
cctcacttaatgagg

SEQ ID NO: 75038 - DNA, 15 bp, Homo sapiens
gcctcacttaatgag

SEQ ID NO: 75039 - DNA, 15 bp, Homo sapiens
tgcctcacttaatga

SEQ ID NO: 75040 - DNA, 15 bp, Homo sapiens
ttgcctcacttaatg

SEQ ID NO: 75041 - DNA, 15 bp, Homo sapiens
attgcctcacttaat

SEQ ID NO: 75042 - DNA, 15 bp, Homo sapiens
gattgcctcacttaa

SEQ ID NO: 75043 - DNA, 15 bp, Homo sapiens
ggattgcctcactta

SEQ ID NO: 75044 - DNA, 15 bp, Homo sapiens
tggattgcctcactt

SEQ ID NO: 75045 - DNA, 15 bp, Homo sapiens
ttggattgcctcact

SEQ ID NO: 75046 - DNA, 15 bp, Homo sapiens
tttggattgcctcac

SEQ ID NO: 75047 - DNA, 15 bp, Homo sapiens
gtttggattgcctca

SEQ ID NO: 75048 - DNA, 15 bp, Homo sapiens
agtttggattgcctc

SEQ ID NO: 75049 - DNA, 15 bp, Homo sapiens
cagtttggattgcct

SEQ ID NO: 75050 - DNA, 15 bp, Homo sapiens
acagtttggattgcc

SEQ ID NO: 75051 - DNA, 15 bp, Homo sapiens
tacagtttggattgc

SEQ ID NO: 75052 - DNA, 15 bp, Homo sapiens
ttacagtttggattg

SEQ ID NO: 75053 - DNA, 15 bp, Homo sapiens
attacagtttggatt

SEQ ID NO: 75054 - DNA, 15 bp, Homo sapiens
aattacagtttggat

SEQ ID NO: 75055 - DNA, 15 bp, Homo sapiens
aaattacagtttgga

SEQ ID NO: 75056 - DNA, 15 bp, Homo sapiens
gaaattacagtttgg

SEQ ID NO: 75057 - DNA, 15 bp, Homo sapiens
tgaaattacagtttg

SEQ ID NO: 75058 - DNA, 15 bp, Homo sapiens
atgaaattacagttt

SEQ ID NO: 75059 - DNA, 15 bp, Homo sapiens
gatgaaattacagtt

SEQ ID NO: 75060 - DNA, 15 bp, Homo sapiens
tgatgaaattacagt

SEQ ID NO: 75061 - DNA, 15 bp, Homo sapiens
gtgatgaaattacag

SEQ ID NO: 75062 - DNA, 15 bp, Homo sapiens
cgtgatgaaattaca

SEQ ID NO: 75063 - DNA, 15 bp, Homo sapiens
acgtgatgaaattac

SEQ ID NO: 75064 - DNA, 15 bp, Homo sapiens
cacgtgatgaaatta

SEQ ID NO: 75065 - DNA, 15 bp, Homo sapiens
tcacgtgatgaaatt

SEQ ID NO: 75066 - DNA, 15 bp, Homo sapiens
ctcacgtgatgaaat

SEQ ID NO: 75067 - DNA, 15 bp, Homo sapiens
cctcacgtgatgaaa

SEQ ID NO: 75068 - DNA, 15 bp, Homo sapiens
acctcacgtgatgaa

SEQ ID NO: 75069 - DNA, 15 bp, Homo sapiens
gacctcacgtgatga

SEQ ID NO: 75070 - DNA, 15 bp, Homo sapiens
ggacctcacgtgatg

SEQ ID NO: 75071 - DNA, 15 bp, Homo sapiens
aggacctcacgtgat

SEQ ID NO: 75072 - DNA, 15 bp, Homo sapiens
aaggacctcacgtga

SEQ ID NO: 75073 - DNA, 15 bp, Homo sapiens
aaaggacctcacgtg

SEQ ID NO: 75074 - DNA, 15 bp, Homo sapiens
aaaaggacctcacgt

SEQ ID NO: 75075 - DNA, 15 bp, Homo sapiens
caaaaggacctcacg

SEQ ID NO: 75076 - DNA, 15 bp, Homo sapiens
gcaaaaggacctcac

SEQ ID NO: 75077 - DNA, 15 bp, Homo sapiens
agcaaaaggacctca

SEQ ID NO: 75078 - DNA, 15 bp, Homo sapiens
aagcaaaaggacctc

SEQ ID NO: 75079 - DNA, 15 bp, Homo sapiens
aaagcaaaaggacct

SEQ ID NO: 75080 - DNA, 15 bp, Homo sapiens
aaaagcaaaaggacc

SEQ ID NO: 75081 - DNA, 15 bp, Homo sapiens
caaaagcaaaaggac

SEQ ID NO: 75082 - DNA, 15 bp, Homo sapiens
acaaaagcaaaagga

SEQ ID NO: 75083 - DNA, 15 bp, Homo sapiens
cacaaaagcaaaagg

SEQ ID NO: 75084 - DNA, 15 bp, Homo sapiens
tcacaaaagcaaaag

SEQ ID NO: 75085 - DNA, 15 bp, Homo sapiens
atcacaaaagcaaaa

SEQ ID NO: 75086 - DNA, 15 bp, Homo sapiens
tatcacaaaagcaaa

SEQ ID NO: 75087 - DNA, 15 bp, Homo sapiens
atatcacaaaagcaa

SEQ ID NO: 75088 - DNA, 15 bp, Homo sapiens
aatatcacaaaagca

SEQ ID NO: 75089 - DNA, 15 bp, Homo sapiens
aaatatcacaaaagc

SEQ ID NO: 75090 - DNA, 15 bp, Homo sapiens
taaatatcacaaaag

SEQ ID NO: 75091 - DNA, 15 bp, Homo sapiens
ttaaatatcacaaaa

SEQ ID NO: 75092 - DNA, 15 bp, Homo sapiens
tttaaatatcacaaa

SEQ ID NO: 75093 - DNA, 15 bp, Homo sapiens
ctttaaatatcacaa

SEQ ID NO: 75094 - DNA, 15 bp, Homo sapiens
actttaaatatcaca

SEQ ID NO: 75095 - DNA, 15 bp, Homo sapiens
gactttaaatatcac

SEQ ID NO: 75096 - DNA, 15 bp, Homo sapiens
tgactttaaatatca

SEQ ID NO: 75097 - DNA, 15 bp, Homo sapiens
ctgactttaaatatc

SEQ ID NO: 75098 - DNA, 15 bp, Homo sapiens
gctgactttaaatat

SEQ ID NO: 75099 - DNA, 15 bp, Homo sapiens
ggctgactttaaata

SEQ ID NO: 75100 - DNA, 15 bp, Homo sapiens
tggctgactttaaat

SEQ ID NO: 75101 - DNA, 15 bp, Homo sapiens
ctggctgactttaaa

SEQ ID NO: 75102 - DNA, 15 bp, Homo sapiens
tctggctgactttaa

SEQ ID NO: 75103 - DNA, 15 bp, Homo sapiens
ctctggctgacttta

SEQ ID NO: 75104 - DNA, 15 bp, Homo sapiens
cctctggctgacttt

SEQ ID NO: 75105 - DNA, 15 bp, Homo sapiens
acctctggctgactt

SEQ ID NO: 75106 - DNA, 15 bp, Homo sapiens
aacctctggctgact

SEQ ID NO: 75107 - DNA, 15 bp, Homo sapiens
gaacctctggctgac

SEQ ID NO: 75108 - DNA, 15 bp, Homo sapiens
agaacctctggctga

SEQ ID NO: 75109 - DNA, 15 bp, Homo sapiens
tagaacctctggctg

SEQ ID NO: 75110 - DNA, 15 bp, Homo sapiens
ttagaacctctggct

SEQ ID NO: 75111 - DNA, 15 bp, Homo sapiens
cttagaacctctggc

SEQ ID NO: 75112 - DNA, 15 bp, Homo sapiens
tcttagaacctctgg

SEQ ID NO: 75113 - DNA, 15 bp, Homo sapiens
gtcttagaacctctg

SEQ ID NO: 75114 - DNA, 15 bp, Homo sapiens
agtcttagaacctct

SEQ ID NO: 75115 - DNA, 15 bp, Homo sapiens
aagtcttagaacctc

SEQ ID NO: 75116 - DNA, 15 bp, Homo sapiens
caagtcttagaacct

SEQ ID NO: 75117 - DNA, 15 bp, Homo sapiens
acaagtcttagaacc

SEQ ID NO: 75118 - DNA, 15 bp, Homo sapiens
tacaagtcttagaac

SEQ ID NO: 75119 - DNA, 15 bp, Homo sapiens
atacaagtcttagaa

SEQ ID NO: 75120 - DNA, 15 bp, Homo sapiens
catacaagtcttaga

SEQ ID NO: 75121 - DNA, 15 bp, Homo sapiens
gcatacaagtcttag

SEQ ID NO: 75122 - DNA, 15 bp, Homo sapiens
tgcatacaagtctta

SEQ ID NO: 75123 - DNA, 15 bp, Homo sapiens
ctgcatacaagtctt

SEQ ID NO: 75124 - DNA, 15 bp, Homo sapiens
actgcatacaagtct

SEQ ID NO: 75125 - DNA, 15 bp, Homo sapiens
tactgcatacaagtc

SEQ ID NO: 75126 - DNA, 15 bp, Homo sapiens
ctactgcatacaagt

SEQ ID NO: 75127 - DNA, 15 bp, Homo sapiens
actactgcatacaag

SEQ ID NO: 75128 - DNA, 15 bp, Homo sapiens
aactactgcatacaa

SEQ ID NO: 75129 - DNA, 15 bp, Homo sapiens
taactactgcataca

SEQ ID NO: 75130 - DNA, 15 bp, Homo sapiens
ctaactactgcatac

SEQ ID NO: 75131 - DNA, 15 bp, Homo sapiens
actaactactgcata

SEQ ID NO: 75132 - DNA, 15 bp, Homo sapiens
aactaactactgcat

SEQ ID NO: 75133 - DNA, 15 bp, Homo sapiens
taactaactactgca

SEQ ID NO: 75134 - DNA, 15 bp, Homo sapiens
ataactaactactgc

SEQ ID NO: 75135 - DNA, 15 bp, Homo sapiens
aataactaactactg

SEQ ID NO: 75136 - DNA, 15 bp, Homo sapiens
taataactaactact

SEQ ID NO: 75137 - DNA, 15 bp, Homo sapiens
ataataactaactac

SEQ ID NO: 75138 - DNA, 15 bp, Homo sapiens
tataataactaacta

SEQ ID NO: 75139 - DNA, 15 bp, Homo sapiens
ttataataactaact

SEQ ID NO: 75140 - DNA, 15 bp, Homo sapiens
gttataataactaac

SEQ ID NO: 75141 - DNA, 15 bp, Homo sapiens
ggttataataactaa

SEQ ID NO: 75142 - DNA, 15 bp, Homo sapiens
aggttataataacta

SEQ ID NO: 75143 - DNA, 15 bp, Homo sapiens
caggttataataact

SEQ ID NO: 75144 - DNA, 15 bp, Homo sapiens
tcaggttataataac

SEQ ID NO: 75145 - DNA, 15 bp, Homo sapiens
ctcaggttataataa

SEQ ID NO: 75146 - DNA, 15 bp, Homo sapiens
tctcaggttataata

SEQ ID NO: 75147 - DNA, 15 bp, Homo sapiens
ctctcaggttataat

SEQ ID NO: 75148 - DNA, 15 bp, Homo sapiens
gctctcaggttataa

SEQ ID NO: 75149 - DNA, 15 bp, Homo sapiens
agctctcaggttata

SEQ ID NO: 75150 - DNA, 15 bp, Homo sapiens
tagctctcaggttat

SEQ ID NO: 75151 - DNA, 15 bp, Homo sapiens
ttagctctcaggtta

SEQ ID NO: 75152 - DNA, 15 bp, Homo sapiens
cttagctctcaggtt

SEQ ID NO: 75153 - DNA, 15 bp, Homo sapiens
acttagctctcaggt

SEQ ID NO: 75154 - DNA, 15 bp, Homo sapiens
tacttagctctcagg

SEQ ID NO: 75155 - DNA, 15 bp, Homo sapiens
atacttagctctcag

SEQ ID NO: 75156 - DNA, 15 bp, Homo sapiens
aatacttagctctca

SEQ ID NO: 75157 - DNA, 15 bp, Homo sapiens
gaatacttagctctc

SEQ ID NO: 75158 - DNA, 15 bp, Homo sapiens
tgaatacttagctct

SEQ ID NO: 75159 - DNA, 15 bp, Homo sapiens
atgaatacttagctc

SEQ ID NO: 75160 - DNA, 15 bp, Homo sapiens
catgaatacttagct

SEQ ID NO: 75161 - DNA, 15 bp, Homo sapiens
gcatgaatacttagc

SEQ ID NO: 75162 - DNA, 15 bp, Homo sapiens
ggcatgaatacttag

SEQ ID NO: 75163 - DNA, 15 bp, Homo sapiens
aggcatgaatactta

SEQ ID NO: 75164 - DNA, 15 bp, Homo sapiens
aaggcatgaatactt

SEQ ID NO: 75165 - DNA, 15 bp, Homo sapiens
caaggcatgaatact

SEQ ID NO: 75166 - DNA, 15 bp, Homo sapiens
tcaaggcatgaatac

SEQ ID NO: 75167 - DNA, 15 bp, Homo sapiens
gtcaaggcatgaata

SEQ ID NO: 75168 - DNA, 15 bp, Homo sapiens
agtcaaggcatgaat

SEQ ID NO: 75169 - DNA, 15 bp, Homo sapiens
tagtcaaggcatgaa

SEQ ID NO: 75170 - DNA, 15 bp, Homo sapiens
atagtcaaggcatga

SEQ ID NO: 75171 - DNA, 15 bp, Homo sapiens
aatagtcaaggcatg

SEQ ID NO: 75172 - DNA, 15 bp, Homo sapiens
aaatagtcaaggcat

SEQ ID NO: 75173 - DNA, 15 bp, Homo sapiens
taaatagtcaaggca

SEQ ID NO: 75174 - DNA, 15 bp, Homo sapiens
ctaaatagtcaaggc

SEQ ID NO: 75175 - DNA, 15 bp, Homo sapiens
gctaaatagtcaagg

SEQ ID NO: 75176 - DNA, 15 bp, Homo sapiens
tgctaaatagtcaag

SEQ ID NO: 75177 - DNA, 15 bp, Homo sapiens
ctgctaaatagtcaa

SEQ ID NO: 75178 - DNA, 15 bp, Homo sapiens
actgctaaatagtca

SEQ ID NO: 75179 - DNA, 15 bp, Homo sapiens
tactgctaaatagtc

SEQ ID NO: 75180 - DNA, 15 bp, Homo sapiens
ttactgctaaatagt

SEQ ID NO: 75181 - DNA, 15 bp, Homo sapiens
cttactgctaaatag

SEQ ID NO: 75182 - DNA, 15 bp, Homo sapiens
ccttactgctaaata

SEQ ID NO: 75183 - DNA, 15 bp, Homo sapiens
tccttactgctaaat

SEQ ID NO: 75184 - DNA, 15 bp, Homo sapiens
ttccttactgctaaa

SEQ ID NO: 75185 - DNA, 15 bp, Homo sapiens
attccttactgctaa

SEQ ID NO: 75186 - DNA, 15 bp, Homo sapiens
gattccttactgcta

SEQ ID NO: 75187 - DNA, 15 bp, Homo sapiens
agattccttactgct

SEQ ID NO: 75188 - DNA, 15 bp, Homo sapiens
cagattccttactgc

SEQ ID NO: 75189 - DNA, 15 bp, Homo sapiens
tcagattccttactg

SEQ ID NO: 75190 - DNA, 15 bp, Homo sapiens
ctcagattccttact

SEQ ID NO: 75191 - DNA, 15 bp, Homo sapiens
tctcagattccttac

SEQ ID NO: 75192 - DNA, 15 bp, Homo sapiens
atctcagattcctta

SEQ ID NO: 75193 - DNA, 15 bp, Homo sapiens
aatctcagattcctt

SEQ ID NO: 75194 - DNA, 15 bp, Homo sapiens
gaatctcagattcct

SEQ ID NO: 75195 - DNA, 15 bp, Homo sapiens
tgaatctcagattcc

SEQ ID NO: 75196 - DNA, 15 bp, Homo sapiens
ctgaatctcagattc

SEQ ID NO: 75197 - DNA, 15 bp, Homo sapiens
tctgaatctcagatt

SEQ ID NO: 75198 - DNA, 15 bp, Homo sapiens
ctctgaatctcagat

SEQ ID NO: 75199 - DNA, 15 bp, Homo sapiens
ctctctgaatctcag

SEQ ID NO: 75200 - DNA, 15 bp, Homo sapiens
cctctctgaatctca

SEQ ID NO: 75201 - DNA, 15 bp, Homo sapiens
acctctctgaatctc

SEQ ID NO: 75202 - DNA, 15 bp, Homo sapiens
aacctctctgaatct

SEQ ID NO: 75203 - DNA, 15 bp, Homo sapiens
taacctctctgaatc

SEQ ID NO: 75204 - DNA, 15 bp, Homo sapiens
ttaacctctctgaat

SEQ ID NO: 75205 - DNA, 15 bp, Homo sapiens
cttaacctctctgaa

SEQ ID NO: 75206 - DNA, 15 bp, Homo sapiens
acttaacctctctga

SEQ ID NO: 75207 - DNA, 15 bp, Homo sapiens
tacttaacctctctg

SEQ ID NO: 75208 - DNA, 15 bp, Homo sapiens
ctacttaacctctct

SEQ ID NO: 75209 - DNA, 15 bp, Homo sapiens
actacttaacctctc

SEQ ID NO: 75210 - DNA, 15 bp, Homo sapiens
gactacttaacctct

SEQ ID NO: 75211 - DNA, 15 bp, Homo sapiens
ggactacttaacctc

SEQ ID NO: 75212 - DNA, 15 bp, Homo sapiens
aggactacttaacct

SEQ ID NO: 75213 - DNA, 15 bp, Homo sapiens
gaggactacttaacc

SEQ ID NO: 75214 - DNA, 15 bp, Homo sapiens
ggaggactacttaac

SEQ ID NO: 75215 - DNA, 15 bp, Homo sapiens
aggaggactacttaa

SEQ ID NO: 75216 - DNA, 15 bp, Homo sapiens
caggaggactactta

SEQ ID NO: 75217 - DNA, 15 bp, Homo sapiens
tcaggaggactactt

SEQ ID NO: 75218 - DNA, 15 bp, Homo sapiens
ctcaggaggactact

SEQ ID NO: 75219 - DNA, 15 bp, Homo sapiens
tctcaggaggactac

SEQ ID NO: 75220 - DNA, 15 bp, Homo sapiens
atctcaggaggacta

SEQ ID NO: 75221 - DNA, 15 bp, Homo sapiens
aatctcaggaggact

SEQ ID NO: 75222 - DNA, 15 bp, Homo sapiens
aaatctcaggaggac

SEQ ID NO: 75223 - DNA, 15 bp, Homo sapiens
taaatctcaggagga

SEQ ID NO: 75224 - DNA, 15 bp, Homo sapiens
ttaaatctcaggagg

SEQ ID NO: 75225 - DNA, 15 bp, Homo sapiens
tttaaatctcaggag

SEQ ID NO: 75226 - DNA, 15 bp, Homo sapiens
atttaaatctcagga

SEQ ID NO: 75227 - DNA, 15 bp, Homo sapiens
tatttaaatctcagg

SEQ ID NO: 75228 - DNA, 15 bp, Homo sapiens
ctatttaaatctcag

SEQ ID NO: 75229 - DNA, 15 bp, Homo sapiens
tctatttaaatctca

SEQ ID NO: 75230 - DNA, 15 bp, Homo sapiens
gtctatttaaatctc

SEQ ID NO: 75231 - DNA, 15 bp, Homo sapiens
tgtctatttaaatct

SEQ ID NO: 75232 - DNA, 15 bp, Homo sapiens
ttgtctatttaaatc

SEQ ID NO: 75233 - DNA, 15 bp, Homo sapiens
attgtctatttaaat

SEQ ID NO: 75234 - DNA, 15 bp, Homo sapiens
cattgtctatttaaa

SEQ ID NO: 75235 - DNA, 15 bp, Homo sapiens
tcattgtctatttaa

SEQ ID NO: 75236 - DNA, 15 bp, Homo sapiens
ctcattgtctattta

SEQ ID NO: 75237 - DNA, 15 bp, Homo sapiens
actcattgtctattt

SEQ ID NO: 75238 - DNA, 15 bp, Homo sapiens
aactcattgtctatt

SEQ ID NO: 75239 - DNA, 15 bp, Homo sapiens
taactcattgtctat

SEQ ID NO: 75240 - DNA, 15 bp, Homo sapiens
ataactcattgtcta

SEQ ID NO: 75241 - DNA, 15 bp, Homo sapiens
gataactcattgtct

SEQ ID NO: 75242 - DNA, 15 bp, Homo sapiens
tgataactcattgtc

SEQ ID NO: 75243 - DNA, 15 bp, Homo sapiens
atgataactcattgt

SEQ ID NO: 75244 - DNA, 15 bp, Homo sapiens
catgataactcattg

SEQ ID NO: 75245 - DNA, 15 bp, Homo sapiens
gcatgataactcatt

SEQ ID NO: 75246 - DNA, 15 bp, Homo sapiens
agcatgataactcat

SEQ ID NO: 75247 - DNA, 15 bp, Homo sapiens
cagcatgataactca

SEQ ID NO: 75248 - DNA, 15 bp, Homo sapiens
tcagcatgataactc

SEQ ID NO: 75249 - DNA, 15 bp, Homo sapiens
ctcagcatgataact

SEQ ID NO: 75250 - DNA, 15 bp, Homo sapiens
tctcagcatgataac

SEQ ID NO: 75251 - DNA, 15 bp, Homo sapiens
gtctcagcatgataa

SEQ ID NO: 75252 - DNA, 15 bp, Homo sapiens
agtctcagcatgata

SEQ ID NO: 75253 - DNA, 15 bp, Homo sapiens
cagtctcagcatgat

SEQ ID NO: 75254 - DNA, 15 bp, Homo sapiens
ccagtctcagcatga

SEQ ID NO: 75255 - DNA, 15 bp, Homo sapiens
tccagtctcagcatg

SEQ ID NO: 75256 - DNA, 15 bp, Homo sapiens
ttccagtctcagcat

SEQ ID NO: 75257 - DNA, 15 bp, Homo sapiens
tttccagtctcagca

SEQ ID NO: 75258 - DNA, 15 bp, Homo sapiens
atttccagtctcagc

SEQ ID NO: 75259 - DNA, 15 bp, Homo sapiens
gatttccagtctcag

SEQ ID NO: 75260 - DNA, 15 bp, Homo sapiens
agatttccagtctca

SEQ ID NO: 75261 - DNA, 15 bp, Homo sapiens
tagatttccagtctc

SEQ ID NO: 75262 - DNA, 15 bp, Homo sapiens
atagatttccagtct

SEQ ID NO: 75263 - DNA, 15 bp, Homo sapiens
gatagatttccagtc

SEQ ID NO: 75264 - DNA, 15 bp, Homo sapiens
agatagatttccagt

SEQ ID NO: 75265 - DNA, 15 bp, Homo sapiens
aagatagatttccag

SEQ ID NO: 75266 - DNA, 15 bp, Homo sapiens
gaagatagatttcca

SEQ ID NO: 75267 - DNA, 15 bp, Homo sapiens
agaagatagatttcc

SEQ ID NO: 75268 - DNA, 15 bp, Homo sapiens
cagaagatagatttc

SEQ ID NO: 75269 - DNA, 15 bp, Homo sapiens
ccagaagatagattt

SEQ ID NO: 75270 - DNA, 15 bp, Homo sapiens
gccagaagatagatt

SEQ ID NO: 75271 - DNA, 15 bp, Homo sapiens
agccagaagatagat

SEQ ID NO: 75272 - DNA, 15 bp, Homo sapiens
gagccagaagataga

SEQ ID NO: 75273 - DNA, 15 bp, Homo sapiens
agagccagaagatag

SEQ ID NO: 75274 - DNA, 15 bp, Homo sapiens
aagagccagaagata

SEQ ID NO: 75275 - DNA, 15 bp, Homo sapiens
taagagccagaagat

SEQ ID NO: 75276 - DNA, 15 bp, Homo sapiens
ttaagagccagaaga

SEQ ID NO: 75277 - DNA, 15 bp, Homo sapiens
cttaagagccagaag

SEQ ID NO: 75278 - DNA, 15 bp, Homo sapiens
acttaagagccagaa

SEQ ID NO: 75279 - DNA, 15 bp, Homo sapiens
aacttaagagccaga

SEQ ID NO: 75280 - DNA, 15 bp, Homo sapiens
aaacttaagagccag

SEQ ID NO: 75281 - DNA, 15 bp, Homo sapiens
aaaacttaagagcca

SEQ ID NO: 75282 - DNA, 15 bp, Homo sapiens
gaaaacttaagagcc

SEQ ID NO: 75283 - DNA, 15 bp, Homo sapiens
agaaaacttaagagc

SEQ ID NO: 75284 - DNA, 15 bp, Homo sapiens
gagaaaacttaagag

SEQ ID NO: 75285 - DNA, 15 bp, Homo sapiens
ggagaaaacttaaga

SEQ ID NO: 75286 - DNA, 15 bp, Homo sapiens
gggagaaaacttaag

SEQ ID NO: 75287 - DNA, 15 bp, Homo sapiens
ggggagaaaacttaa

SEQ ID NO: 75288 - DNA, 15 bp, Homo sapiens
gggggagaaaactta

SEQ ID NO: 75289 - DNA, 15 bp, Homo sapiens
agggggagaaaactt

SEQ ID NO: 75290 - DNA, 15 bp, Homo sapiens
aagggggagaaaact

SEQ ID NO: 75291 - DNA, 15 bp, Homo sapiens
aaagggggagaaaac

SEQ ID NO: 75292 - DNA, 15 bp, Homo sapiens
caaagggggagaaaa

SEQ ID NO: 75293 - DNA, 15 bp, Homo sapiens
acaaagggggagaaa

SEQ ID NO: 75294 - DNA, 15 bp, Homo sapiens
tacaaagggggagaa

SEQ ID NO: 75295 - DNA, 15 bp, Homo sapiens
gtacaaagggggaga

SEQ ID NO: 75296 - DNA, 15 bp, Homo sapiens
agtacaaagggggag

SEQ ID NO: 75297 - DNA, 15 bp, Homo sapiens
tagtacaaaggggga

SEQ ID NO: 75298 - DNA, 15 bp, Homo sapiens
atagtacaaaggggg

SEQ ID NO: 75299 - DNA, 15 bp, Homo sapiens
catagtacaaagggg

SEQ ID NO: 75300 - DNA, 15 bp, Homo sapiens
tcatagtacaaaggg

SEQ ID NO: 75301 - DNA, 15 bp, Homo sapiens
ttcatagtacaaagg

SEQ ID NO: 75302 - DNA, 15 bp, Homo sapiens
tttcatagtacaaag

SEQ ID NO: 75303 - DNA, 15 bp, Homo sapiens
ttttcatagtacaaa

SEQ ID NO: 75304 - DNA, 15 bp, Homo sapiens
cttttcatagtacaa

SEQ ID NO: 75305 - DNA, 15 bp, Homo sapiens
gcttttcatagtaca

SEQ ID NO: 75306 - DNA, 15 bp, Homo sapiens
agcttttcatagtac

SEQ ID NO: 75307 - DNA, 15 bp, Homo sapiens
aagcttttcatagta

SEQ ID NO: 75308 - DNA, 15 bp, Homo sapiens
taagcttttcatagt

SEQ ID NO: 75309 - DNA, 15 bp, Homo sapiens
ataagcttttcatag

SEQ ID NO: 75310 - DNA, 15 bp, Homo sapiens
aataagcttttcata

SEQ ID NO: 75311 - DNA, 15 bp, Homo sapiens
gaataagcttttcat

SEQ ID NO: 75312 - DNA, 15 bp, Homo sapiens
agaataagcttttca

SEQ ID NO: 75313 - DNA, 15 bp, Homo sapiens
gagaataagcttttc

SEQ ID NO: 75314 - DNA, 15 bp, Homo sapiens
tgagaataagctttt

SEQ ID NO: 75315 - DNA, 15 bp, Homo sapiens
atgagaataagcttt

SEQ ID NO: 75316 - DNA, 15 bp, Homo sapiens
tatgagaataagctt

SEQ ID NO: 75317 - DNA, 15 bp, Homo sapiens
atatgagaataagct

SEQ ID NO: 75318 - DNA, 15 bp, Homo sapiens
aatatgagaataagc

SEQ ID NO: 75319 - DNA, 15 bp, Homo sapiens
taatatgagaataag

SEQ ID NO: 75320 - DNA, 15 bp, Homo sapiens
ttaatatgagaataa

SEQ ID NO: 75321 - DNA, 15 bp, Homo sapiens
cttaatatgagaata

SEQ ID NO: 75322 - DNA, 15 bp, Homo sapiens
acttaatatgagaat

SEQ ID NO: 75323 - DNA, 15 bp, Homo sapiens
tacttaatatgagaa

SEQ ID NO: 75324 - DNA, 15 bp, Homo sapiens
atacttaatatgaga

SEQ ID NO: 75325 - DNA, 15 bp, Homo sapiens
gatacttaatatgag

SEQ ID NO: 75326 - DNA, 15 bp, Homo sapiens
tgatacttaatatga

SEQ ID NO: 75327 - DNA, 15 bp, Homo sapiens
ttgatacttaatatg

SEQ ID NO: 75328 - DNA, 15 bp, Homo sapiens
tttgatacttaatat

SEQ ID NO: 75329 - DNA, 15 bp, Homo sapiens
ttttgatacttaata

SEQ ID NO: 75330 - DNA, 15 bp, Homo sapiens
attttgatacttaat

SEQ ID NO: 75331 - DNA, 15 bp, Homo sapiens
tattttgatacttaa

SEQ ID NO: 75332 - DNA, 15 bp, Homo sapiens
ctattttgatactta

SEQ ID NO: 75333 - DNA, 15 bp, Homo sapiens
actattttgatactt

SEQ ID NO: 75334 - DNA, 15 bp, Homo sapiens
tactattttgatact

SEQ ID NO: 75335 - DNA, 15 bp, Homo sapiens
atactattttgatac

SEQ ID NO: 75336 - DNA, 15 bp, Homo sapiens
tatactattttgata

SEQ ID NO: 75337 - DNA, 15 bp, Homo sapiens
ttatactattttgat

SEQ ID NO: 75338 - DNA, 15 bp, Homo sapiens
attatactattttga

SEQ ID NO: 75339 - DNA, 15 bp, Homo sapiens
tattatactattttg

SEQ ID NO: 75340 - DNA, 15 bp, Homo sapiens
atattatactatttt

SEQ ID NO: 75341 - DNA, 15 bp, Homo sapiens
catattatactattt

SEQ ID NO: 75342 - DNA, 15 bp, Homo sapiens
tcatattatactatt

SEQ ID NO: 75343 - DNA, 15 bp, Homo sapiens
ttcatattatactat

SEQ ID NO: 75344 - DNA, 15 bp, Homo sapiens
attcatattatacta

SEQ ID NO: 75345 - DNA, 15 bp, Homo sapiens
aattcatattatact

SEQ ID NO: 75346 - DNA, 15 bp, Homo sapiens
taattcatattatac

SEQ ID NO: 75347 - DNA, 15 bp, Homo sapiens
ttaattcatattata

SEQ ID NO: 75348 - DNA, 15 bp, Homo sapiens
tttaattcatattat

SEQ ID NO: 75349 - DNA, 15 bp, Homo sapiens
atttaattcatatta

SEQ ID NO: 75350 - DNA, 15 bp, Homo sapiens
tatttaattcatatt

SEQ ID NO: 75351 - DNA, 15 bp, Homo sapiens
ttatttaattcatat

SEQ ID NO: 75352 - DNA, 15 bp, Homo sapiens
attatttaattcata

SEQ ID NO: 75353 - DNA, 15 bp, Homo sapiens
aattatttaattcat

SEQ ID NO: 75354 - DNA, 15 bp, Homo sapiens
gaattatttaattca

SEQ ID NO: 75355 - DNA, 15 bp, Homo sapiens
agaattatttaattc

SEQ ID NO: 75356 - DNA, 15 bp, Homo sapiens
aagaattatttaatt

SEQ ID NO: 75357 - DNA, 15 bp, Homo sapiens
caagaattatttaat

SEQ ID NO: 75358 - DNA, 15 bp, Homo sapiens
acaagaattatttaa

SEQ ID NO: 75359 - DNA, 15 bp, Homo sapiens
aacaagaattattta

SEQ ID NO: 75360 - DNA, 15 bp, Homo sapiens
gaacaagaattattt

SEQ ID NO: 75361 - DNA, 15 bp, Homo sapiens
tgaacaagaattatt

SEQ ID NO: 75362 - DNA, 15 bp, Homo sapiens
gtgaacaagaattat

SEQ ID NO: 75363 - DNA, 15 bp, Homo sapiens
tgtgaacaagaatta

SEQ ID NO: 75364 - DNA, 15 bp, Homo sapiens
atgtgaacaagaatt

SEQ ID NO: 75365 - DNA, 15 bp, Homo sapiens
catgtgaacaagaat

SEQ ID NO: 75366 - DNA, 15 bp, Homo sapiens
acatgtgaacaagaa

SEQ ID NO: 75367 - DNA, 15 bp, Homo sapiens
tacatgtgaacaaga

SEQ ID NO: 75368 - DNA, 15 bp, Homo sapiens
atacatgtgaacaag

SEQ ID NO: 75369 - DNA, 15 bp, Homo sapiens
tatacatgtgaacaa

SEQ ID NO: 75370 - DNA, 15 bp, Homo sapiens
atatacatgtgaaca

SEQ ID NO: 75371 - DNA, 15 bp, Homo sapiens
tatatacatgtgaac

SEQ ID NO: 75372 - DNA, 15 bp, Homo sapiens
ctatatacatgtgaa

SEQ ID NO: 75373 - DNA, 15 bp, Homo sapiens
actatatacatgtga

SEQ ID NO: 75374 - DNA, 15 bp, Homo sapiens
tactatatacatgtg

SEQ ID NO: 75375 - DNA, 15 bp, Homo sapiens
gtactatatacatgt

SEQ ID NO: 75376 - DNA, 15 bp, Homo sapiens
tgtactatatacatg

SEQ ID NO: 75377 - DNA, 15 bp, Homo sapiens
ttgtactatatacat

SEQ ID NO: 75378 - DNA, 15 bp, Homo sapiens
tttgtactatataca

SEQ ID NO: 75379 - DNA, 15 bp, Homo sapiens
ttttgtactatatac

SEQ ID NO: 75380 - DNA, 15 bp, Homo sapiens
tttttgtactatata

SEQ ID NO: 75381 - DNA, 15 bp, Homo sapiens
atttttgtactatat

SEQ ID NO: 75382 - DNA, 15 bp, Homo sapiens
tatttttgtactata

SEQ ID NO: 75383 - DNA, 15 bp, Homo sapiens
ttatttttgtactat

SEQ ID NO: 75384 - DNA, 15 bp, Homo sapiens
tttatttttgtacta

SEQ ID NO: 75385 - DNA, 15 bp, Homo sapiens
atttatttttgtact

SEQ ID NO: 75386 - DNA, 15 bp, Homo sapiens
aatttatttttgtac

SEQ ID NO: 75387 - DNA, 15 bp, Homo sapiens
aaatttatttttgta

SEQ ID NO: 75388 - DNA, 15 bp, Homo sapiens
aaaatttatttttgt

SEQ ID NO: 75389 - DNA, 15 bp, Homo sapiens
taaaatttatttttg

SEQ ID NO: 75390 - DNA, 15 bp, Homo sapiens
ttaaaatttattttt

SEQ ID NO: 75391 - DNA, 15 bp, Homo sapiens
gttaaaatttatttt

SEQ ID NO: 75392 - DNA, 15 bp, Homo sapiens
tgttaaaatttattt

SEQ ID NO: 75393 - DNA, 15 bp, Homo sapiens
atgttaaaatttatt

SEQ ID NO: 75394 - DNA, 15 bp, Homo sapiens
aatgttaaaatttat

SEQ ID NO: 75395 - DNA, 15 bp, Homo sapiens
aaatgttaaaattta

SEQ ID NO: 75396 - DNA, 15 bp, Homo sapiens
caaatgttaaaattt

SEQ ID NO: 75397 - DNA, 15 bp, Homo sapiens
acaaatgttaaaatt

SEQ ID NO: 75398 - DNA, 15 bp, Homo sapiens
aacaaatgttaaaat

SEQ ID NO: 75399 - DNA, 15 bp, Homo sapiens
taacaaatgttaaaa

SEQ ID NO: 75400 - DNA, 15 bp, Homo sapiens
ttaacaaatgttaaa

SEQ ID NO: 75401 - DNA, 15 bp, Homo sapiens
attaacaaatgttaa

SEQ ID NO: 75402 - DNA, 15 bp, Homo sapiens
gattaacaaatgtta

SEQ ID NO: 75403 - DNA, 15 bp, Homo sapiens
tgattaacaaatgtt

SEQ ID NO: 75404 - DNA, 15 bp, Homo sapiens
atgattaacaaatgt

SEQ ID NO: 75405 - DNA, 15 bp, Homo sapiens
aatgattaacaaatg

SEQ ID NO: 75406 - DNA, 15 bp, Homo sapiens
taatgattaacaaat

SEQ ID NO: 75407 - DNA, 15 bp, Homo sapiens
ataatgattaacaaa

SEQ ID NO: 75408 - DNA, 15 bp, Homo sapiens
aataatgattaacaa

SEQ ID NO: 75409 - DNA, 15 bp, Homo sapiens
aaataatgattaaca

SEQ ID NO: 75410 - DNA, 15 bp, Homo sapiens
caaataatgattaac

SEQ ID NO: 75411 - DNA, 15 bp, Homo sapiens
acaaataatgattaa

SEQ ID NO: 75412 - DNA, 15 bp, Homo sapiens
tacaaataatgatta

SEQ ID NO: 75413 - DNA, 15 bp, Homo sapiens
ttacaaataatgatt

SEQ ID NO: 75414 - DNA, 15 bp, Homo sapiens
tttacaaataatgat

SEQ ID NO: 75415 - DNA, 15 bp, Homo sapiens
ttttacaaataatga

SEQ ID NO: 75416 - DNA, 15 bp, Homo sapiens
attttacaaataatg

SEQ ID NO: 75417 - DNA, 15 bp, Homo sapiens
aattttacaaataat

SEQ ID NO: 75418 - DNA, 15 bp, Homo sapiens
caattttacaaataa

SEQ ID NO: 75419 - DNA, 15 bp, Homo sapiens
acaattttacaaata

SEQ ID NO: 75420 - DNA, 15 bp, Homo sapiens
tacaattttacaaat

SEQ ID NO: 75421 - DNA, 15 bp, Homo sapiens
ttacaattttacaaa

SEQ ID NO: 75422 - DNA, 15 bp, Homo sapiens
attacaattttacaa

SEQ ID NO: 75423 - DNA, 15 bp, Homo sapiens
tattacaattttaca

SEQ ID NO: 75424 - DNA, 15 bp, Homo sapiens
ttattacaattttac

SEQ ID NO: 75425 - DNA, 15 bp, Homo sapiens
tttattacaatttta

SEQ ID NO: 75426 - DNA, 15 bp, Homo sapiens
ttttattacaatttt

SEQ ID NO: 75427 - DNA, 15 bp, Homo sapiens
attttattacaattt

SEQ ID NO: 75428 - DNA, 15 bp, Homo sapiens
cattttattacaatt

SEQ ID NO: 75429 - DNA, 15 bp, Homo sapiens
tcattttattacaat

SEQ ID NO: 75430 - DNA, 15 bp, Homo sapiens
atcattttattacaa

SEQ ID NO: 75431 - DNA, 15 bp, Homo sapiens
aatcattttattaca

SEQ ID NO: 75432 - DNA, 15 bp, Homo sapiens
aaatcattttattac

SEQ ID NO: 75433 - DNA, 15 bp, Homo sapiens
aaaatcattttatta

SEQ ID NO: 75434 - DNA, 15 bp, Homo sapiens
caaaatcattttatt

SEQ ID NO: 75435 - DNA, 15 bp, Homo sapiens
ccaaaatcattttat

SEQ ID NO: 75436 - DNA, 15 bp, Homo sapiens
cccaaaatcatttta

SEQ ID NO: 75437 - DNA, 15 bp, Homo sapiens
tcccaaaatcatttt

SEQ ID NO: 75438 - DNA, 15 bp, Homo sapiens
ctcccaaaatcattt

SEQ ID NO: 75439 - DNA, 15 bp, Homo sapiens
tctcccaaaatcatt

SEQ ID NO: 75440 - DNA, 15 bp, Homo sapiens
ttctcccaaaatcat

SEQ ID NO: 75441 - DNA, 15 bp, Homo sapiens
tttctcccaaaatca

SEQ ID NO: 75442 - DNA, 15 bp, Homo sapiens
ttttctcccaaaatc

SEQ ID NO: 75443 - DNA, 15 bp, Homo sapiens
attttctcccaaaat

SEQ ID NO: 75444 - DNA, 15 bp, Homo sapiens
tattttctcccaaaa

SEQ ID NO: 75445 - DNA, 15 bp, Homo sapiens
ttattttctcccaaa

SEQ ID NO: 75446 - DNA, 15 bp, Homo sapiens
attattttctcccaa

SEQ ID NO: 75447 - DNA, 15 bp, Homo sapiens
gattattttctccca

SEQ ID NO: 75448 - DNA, 15 bp, Homo sapiens
tgattattttctccc

SEQ ID NO: 75449 - DNA, 15 bp, Homo sapiens
atgattattttctcc

SEQ ID NO: 75450 - DNA, 15 bp, Homo sapiens
catgattattttctc

SEQ ID NO: 75451 - DNA, 15 bp, Homo sapiens
tcatgattattttct

SEQ ID NO: 75452 - DNA, 15 bp, Homo sapiens
ttcatgattattttc

SEQ ID NO: 75453 - DNA, 15 bp, Homo sapiens
cttcatgattatttt

SEQ ID NO: 75454 - DNA, 15 bp, Homo sapiens
tcttcatgattattt

SEQ ID NO: 75455 - DNA, 15 bp, Homo sapiens
ctcttcatgattatt

SEQ ID NO: 75456 - DNA, 15 bp, Homo sapiens
actcttcatgattat

SEQ ID NO: 75457 - DNA, 15 bp, Homo sapiens
cactcttcatgatta

SEQ ID NO: 75458 - DNA, 15 bp, Homo sapiens
tcactcttcatgatt

SEQ ID NO: 75459 - DNA, 15 bp, Homo sapiens
atcactcttcatgat

SEQ ID NO: 75460 - DNA, 15 bp, Homo sapiens
aatcactcttcatga

SEQ ID NO: 75461 - DNA, 15 bp, Homo sapiens
aaatcactcttcatg

SEQ ID NO: 75462 - DNA, 15 bp, Homo sapiens
aaaatcactcttcat

SEQ ID NO: 75463 - DNA, 15 bp, Homo sapiens
aaaaatcactcttca

SEQ ID NO: 75464 - DNA, 15 bp, Homo sapiens
aaaaaatcactcttc

SEQ ID NO: 75465 - DNA, 15 bp, Homo sapiens
taaaaaatcactctt

SEQ ID NO: 75466 - DNA, 15 bp, Homo sapiens
ataaaaaatcactct

SEQ ID NO: 75467 - DNA, 15 bp, Homo sapiens
tataaaaaatcactc

SEQ ID NO: 75468 - DNA, 15 bp, Homo sapiens
ttataaaaaatcact

SEQ ID NO: 75469 - DNA, 15 bp, Homo sapiens
attataaaaaatcac

SEQ ID NO: 75470 - DNA, 15 bp, Homo sapiens
aattataaaaaatca

SEQ ID NO: 75471 - DNA, 15 bp, Homo sapiens
taattataaaaaatc

SEQ ID NO: 75472 - DNA, 15 bp, Homo sapiens
ttaattataaaaaat

SEQ ID NO: 75473 - DNA, 15 bp, Homo sapiens
attaattataaaaaa

SEQ ID NO: 75474 - DNA, 15 bp, Homo sapiens
tattaattataaaaa

SEQ ID NO: 75475 - DNA, 15 bp, Homo sapiens
ttattaattataaaa

SEQ ID NO: 75476 - DNA, 15 bp, Homo sapiens
tttattaattataaa

SEQ ID NO: 75477 - DNA, 15 bp, Homo sapiens
ttttattaattataa

SEQ ID NO: 75478 - DNA, 15 bp, Homo sapiens
attttattaattata

SEQ ID NO: 75479 - DNA, 15 bp, Homo sapiens
aattttattaattat

SEQ ID NO: 75480 - DNA, 15 bp, Homo sapiens
aaattttattaatta

SEQ ID NO: 75481 - DNA, 15 bp, Homo sapiens
taaattttattaatt

SEQ ID NO: 75482 - DNA, 15 bp, Homo sapiens
ataaattttattaat

SEQ ID NO: 75483 - DNA, 15 bp, Homo sapiens
aataaattttattaa

SEQ ID NO: 75484 - DNA, 15 bp, Homo sapiens
aaataaattttatta

SEQ ID NO: 75485 - DNA, 15 bp, Homo sapiens
taaataaattttatt

SEQ ID NO: 75486 - DNA, 15 bp, Homo sapiens
ctaaataaattttat

SEQ ID NO: 75487 - DNA, 15 bp, Homo sapiens
actaaataaatttta

SEQ ID NO: 75488 - DNA, 15 bp, Homo sapiens
tactaaataaatttt

SEQ ID NO: 75489 - DNA, 15 bp, Homo sapiens
atactaaataaattt

SEQ ID NO: 75490 - DNA, 15 bp, Homo sapiens
aatactaaataaatt

SEQ ID NO: 75491 - DNA, 15 bp, Homo sapiens
caatactaaataaat

SEQ ID NO: 75492 - DNA, 15 bp, Homo sapiens
gcaatactaaataaa

SEQ ID NO: 75493 - DNA, 15 bp, Homo sapiens
agcaatactaaataa

SEQ ID NO: 75494 - DNA, 15 bp, Homo sapiens
cagcaatactaaata

SEQ ID NO: 75495 - DNA, 15 bp, Homo sapiens
tcagcaatactaaat

SEQ ID NO: 75496 - DNA, 15 bp, Homo sapiens
atcagcaatactaaa

SEQ ID NO: 75497 - DNA, 15 bp, Homo sapiens
tatcagcaatactaa

SEQ ID NO: 75498 - DNA, 15 bp, Homo sapiens
gtatcagcaatacta

SEQ ID NO: 75499 - DNA, 15 bp, Homo sapiens
agtatcagcaatact

SEQ ID NO: 75500 - DNA, 15 bp, Homo sapiens
tagtatcagcaatac

SEQ ID NO: 75501 - DNA, 15 bp, Homo sapiens
ctagtatcagcaata

SEQ ID NO: 75502 - DNA, 15 bp, Homo sapiens
actagtatcagcaat

SEQ ID NO: 75503 - DNA, 15 bp, Homo sapiens
tactagtatcagcaa

SEQ ID NO: 75504 - DNA, 15 bp, Homo sapiens
ttactagtatcagca

SEQ ID NO: 75505 - DNA, 15 bp, Homo sapiens
cttactagtatcagc

SEQ ID NO: 75506 - DNA, 15 bp, Homo sapiens
tcttactagtatcag

SEQ ID NO: 75507 - DNA, 15 bp, Homo sapiens
atcttactagtatca

SEQ ID NO: 75508 - DNA, 15 bp, Homo sapiens
aatcttactagtatc

SEQ ID NO: 75509 - DNA, 15 bp, Homo sapiens
gaatcttactagtat

SEQ ID NO: 75510 - DNA, 15 bp, Homo sapiens
agaatcttactagta

SEQ ID NO: 75511 - DNA, 15 bp, Homo sapiens
tagaatcttactagt

SEQ ID NO: 75512 - DNA, 15 bp, Homo sapiens
atagaatcttactag

SEQ ID NO: 75513 - DNA, 15 bp, Homo sapiens
aatagaatcttacta

SEQ ID NO: 75514 - DNA, 15 bp, Homo sapiens
caatagaatcttact

SEQ ID NO: 75515 - DNA, 15 bp, Homo sapiens
gcaatagaatcttac

SEQ ID NO: 75516 - DNA, 15 bp, Homo sapiens
agcaatagaatctta

SEQ ID NO: 75517 - DNA, 15 bp, Homo sapiens
tagcaatagaatctt

SEQ ID NO: 75518 - DNA, 15 bp, Homo sapiens
ttagcaatagaatct

SEQ ID NO: 75519 - DNA, 15 bp, Homo sapiens
attagcaatagaatc

SEQ ID NO: 75520 - DNA, 15 bp, Homo sapiens
aattagcaatagaat

SEQ ID NO: 75521 - DNA, 15 bp, Homo sapiens
aaattagcaatagaa

SEQ ID NO: 75522 - DNA, 15 bp, Homo sapiens
taaattagcaataga

SEQ ID NO: 75523 - DNA, 15 bp, Homo sapiens
ataaattagcaatag

SEQ ID NO: 75524 - DNA, 15 bp, Homo sapiens
cataaattagcaata

SEQ ID NO: 75525 - DNA, 15 bp, Homo sapiens
acataaattagcaat

SEQ ID NO: 75526 - DNA, 15 bp, Homo sapiens
tacataaattagcaa

SEQ ID NO: 75527 - DNA, 15 bp, Homo sapiens
ttacataaattagca

SEQ ID NO: 75528 - DNA, 15 bp, Homo sapiens
gttacataaattagc

SEQ ID NO: 75529 - DNA, 15 bp, Homo sapiens
agttacataaattag

SEQ ID NO: 75530 - DNA, 15 bp, Homo sapiens
aagttacataaatta

SEQ ID NO: 75531 - DNA, 15 bp, Homo sapiens
taagttacataaatt

SEQ ID NO: 75532 - DNA, 15 bp, Homo sapiens
ataagttacataaat

SEQ ID NO: 75533 - DNA, 15 bp, Homo sapiens
cataagttacataaa

SEQ ID NO: 75534 - DNA, 15 bp, Homo sapiens
ccataagttacataa

SEQ ID NO: 75535 - DNA, 15 bp, Homo sapiens
cccataagttacata

SEQ ID NO: 75536 - DNA, 15 bp, Homo sapiens
ccccataagttacat

SEQ ID NO: 75537 - DNA, 15 bp, Homo sapiens
tccccataagttaca

SEQ ID NO: 75538 - DNA, 15 bp, Homo sapiens
ttccccataagttac

SEQ ID NO: 75539 - DNA, 15 bp, Homo sapiens
attccccataagtta

SEQ ID NO: 75540 - DNA, 15 bp, Homo sapiens
aattccccataagtt

SEQ ID NO: 75541 - DNA, 15 bp, Homo sapiens
aaattccccataagt

SEQ ID NO: 75542 - DNA, 15 bp, Homo sapiens
aaaattccccataag

SEQ ID NO: 75543 - DNA, 15 bp, Homo sapiens
aaaaattccccataa

SEQ ID NO: 75544 - DNA, 15 bp, Homo sapiens
aaaaaattccccata

SEQ ID NO: 75545 - DNA, 15 bp, Homo sapiens
aaaaaaattccccat

SEQ ID NO: 75546 - DNA, 15 bp, Homo sapiens
taaaaaaattcccca

SEQ ID NO: 75547 - DNA, 15 bp, Homo sapiens
ataaaaaaattcccc

SEQ ID NO: 75548 - DNA, 15 bp, Homo sapiens
cataaaaaaattccc

SEQ ID NO: 75549 - DNA, 15 bp, Homo sapiens
ccataaaaaaattcc

SEQ ID NO: 75550 - DNA, 15 bp, Homo sapiens
tccataaaaaaattc

SEQ ID NO: 75551 - DNA, 15 bp, Homo sapiens
atccataaaaaaatt

SEQ ID NO: 75552 - DNA, 15 bp, Homo sapiens
gatccataaaaaaat

SEQ ID NO: 75553 - DNA, 15 bp, Homo sapiens
tgatccataaaaaaa

SEQ ID NO: 75554 - DNA, 15 bp, Homo sapiens
gtgatccataaaaaa

SEQ ID NO: 75555 - DNA, 15 bp, Homo sapiens
tgtgatccataaaaa

SEQ ID NO: 75556 - DNA, 15 bp, Homo sapiens
atgtgatccataaaa

SEQ ID NO: 75557 - DNA, 15 bp, Homo sapiens
tatgtgatccataaa

SEQ ID NO: 75558 - DNA, 15 bp, Homo sapiens
ttatgtgatccataa

SEQ ID NO: 75559 - DNA, 15 bp, Homo sapiens
attatgtgatccata

SEQ ID NO: 75560 - DNA, 15 bp, Homo sapiens
cattatgtgatccat

SEQ ID NO: 75561 - DNA, 15 bp, Homo sapiens
acattatgtgatcca

SEQ ID NO: 75562 - DNA, 15 bp, Homo sapiens
tacattatgtgatcc

SEQ ID NO: 75563 - DNA, 15 bp, Homo sapiens
ttacattatgtgatc

SEQ ID NO: 75564 - DNA, 15 bp, Homo sapiens
tttacattatgtgat

SEQ ID NO: 75565 - DNA, 15 bp, Homo sapiens
gtttacattatgtga

SEQ ID NO: 75566 - DNA, 15 bp, Homo sapiens
tgtttacattatgtg

SEQ ID NO: 75567 - DNA, 15 bp, Homo sapiens
ctgtttacattatgt

SEQ ID NO: 75568 - DNA, 15 bp, Homo sapiens
tctgtttacattatg

SEQ ID NO: 75569 - DNA, 15 bp, Homo sapiens
ttctgtttacattat

SEQ ID NO: 75570 - DNA, 15 bp, Homo sapiens
gttctgtttacatta

SEQ ID NO: 75571 - DNA, 15 bp, Homo sapiens
tgttctgtttacatt

SEQ ID NO: 75572 - DNA, 15 bp, Homo sapiens
ttgttctgtttacat

SEQ ID NO: 75573 - DNA, 15 bp, Homo sapiens
tttgttctgtttaca

SEQ ID NO: 75574 - DNA, 15 bp, Homo sapiens
atttgttctgtttac

SEQ ID NO: 75575 - DNA, 15 bp, Homo sapiens
gatttgttctgttta

SEQ ID NO: 75576 - DNA, 15 bp, Homo sapiens
tgatttgttctgttt

SEQ ID NO: 75577 - DNA, 15 bp, Homo sapiens
atgatttgttctgtt

SEQ ID NO: 75578 - DNA, 15 bp, Homo sapiens
aatgatttgttctgt

SEQ ID NO: 75579 - DNA, 15 bp, Homo sapiens
aaatgatttgttctg

SEQ ID NO: 75580 - DNA, 15 bp, Homo sapiens
caaatgatttgttct

SEQ ID NO: 75581 - DNA, 15 bp, Homo sapiens
tcaaatgatttgttc

SEQ ID NO: 75582 - DNA, 15 bp, Homo sapiens
atcaaatgatttgtt

SEQ ID NO: 75583 - DNA, 15 bp, Homo sapiens
aatcaaatgatttgt

SEQ ID NO: 75584 - DNA, 15 bp, Homo sapiens
aaatcaaatgatttg

SEQ ID NO: 75585 - DNA, 15 bp, Homo sapiens
aaaatcaaatgattt

SEQ ID NO: 75586 - DNA, 15 bp, Homo sapiens
aaaaatcaaatgatt

SEQ ID NO: 75587 - DNA, 15 bp, Homo sapiens
aaaaaatcaaatgat

SEQ ID NO: 75588 - DNA, 15 bp, Homo sapiens
aaaaaaatcaaatga

SEQ ID NO: 75589 - DNA, 15 bp, Homo sapiens
taaaaaaatcaaatg

SEQ ID NO: 75590 - DNA, 15 bp, Homo sapiens
ataaaaaaatcaaat

SEQ ID NO: 75591 - DNA, 15 bp, Homo sapiens
aataaaaaaatcaaa

SEQ ID NO: 75592 - DNA, 15 bp, Homo sapiens
caataaaaaaatcaa

SEQ ID NO: 75593 - DNA, 15 bp, Homo sapiens
acaataaaaaaatca

SEQ ID NO: 75594 - DNA, 15 bp, Homo sapiens
gacaataaaaaaatc

SEQ ID NO: 75595 - DNA, 15 bp, Homo sapiens
agacaataaaaaaat

SEQ ID NO: 75596 - DNA, 15 bp, Homo sapiens
gagacaataaaaaaa

SEQ ID NO: 75597 - DNA, 15 bp, Homo sapiens
tgagacaataaaaaa

SEQ ID NO: 75598 - DNA, 15 bp, Homo sapiens
atgagacaataaaaa

SEQ ID NO: 75599 - DNA, 15 bp, Homo sapiens
tatgagacaataaaa

SEQ ID NO: 75600 - DNA, 15 bp, Homo sapiens
ttatgagacaataaa

SEQ ID NO: 75601 - DNA, 15 bp, Homo sapiens
tttatgagacaataa

SEQ ID NO: 75602 - DNA, 15 bp, Homo sapiens
ttttatgagacaata

SEQ ID NO: 75603 - DNA, 15 bp, Homo sapiens
tttttatgagacaat

SEQ ID NO: 75604 - DNA, 15 bp, Homo sapiens
atttttatgagacaa

SEQ ID NO: 75605 - DNA, 15 bp, Homo sapiens
aatttttatgagaca

SEQ ID NO: 75606 - DNA, 15 bp, Homo sapiens
gaatttttatgagac

SEQ ID NO: 75607 - DNA, 15 bp, Homo sapiens
agaatttttatgaga

SEQ ID NO: 75608 - DNA, 15 bp, Homo sapiens
gagaatttttatgag

SEQ ID NO: 75609 - DNA, 15 bp, Homo sapiens
agagaatttttatga

SEQ ID NO: 75610 - DNA, 15 bp, Homo sapiens
aagagaatttttatg

SEQ ID NO: 75611 - DNA, 15 bp, Homo sapiens
taagagaatttttat

SEQ ID NO: 75612 - DNA, 15 bp, Homo sapiens
ataagagaattttta

SEQ ID NO: 75613 - DNA, 15 bp, Homo sapiens
aataagagaattttt

SEQ ID NO: 75614 - DNA, 15 bp, Homo sapiens
gaataagagaatttt

SEQ ID NO: 75615 - DNA, 15 bp, Homo sapiens
tgaataagagaattt

SEQ ID NO: 75616 - DNA, 15 bp, Homo sapiens
ttgaataagagaatt

SEQ ID NO: 75617 - DNA, 15 bp, Homo sapiens
tttgaataagagaat

SEQ ID NO: 75618 - DNA, 15 bp, Homo sapiens
ttttgaataagagaa

SEQ ID NO: 75619 - DNA, 15 bp, Homo sapiens
gttttgaataagaga

SEQ ID NO: 75620 - DNA, 15 bp, Homo sapiens
tgttttgaataagag

SEQ ID NO: 75621 - DNA, 15 bp, Homo sapiens
ctgttttgaataaga

SEQ ID NO: 75622 - DNA, 15 bp, Homo sapiens
cctgttttgaataag

SEQ ID NO: 75623 - DNA, 15 bp, Homo sapiens
acctgttttgaataa

SEQ ID NO: 75624 - DNA, 15 bp, Homo sapiens
aacctgttttgaata

SEQ ID NO: 75625 - DNA, 15 bp, Homo sapiens
aaacctgttttgaat

SEQ ID NO: 75626 - DNA, 15 bp, Homo sapiens
aaaacctgttttgaa

SEQ ID NO: 75627 - DNA, 15 bp, Homo sapiens
taaaacctgttttga

SEQ ID NO: 75628 - DNA, 15 bp, Homo sapiens
ataaaacctgttttg

SEQ ID NO: 75629 - DNA, 15 bp, Homo sapiens
tataaaacctgtttt

SEQ ID NO: 75630 - DNA, 15 bp, Homo sapiens
ttataaaacctgttt

SEQ ID NO: 75631 - DNA, 15 bp, Homo sapiens
cttataaaacctgtt

SEQ ID NO: 75632 - DNA, 15 bp, Homo sapiens
acttataaaacctgt

SEQ ID NO: 75633 - DNA, 15 bp, Homo sapiens
aacttataaaacctg

SEQ ID NO: 75634 - DNA, 15 bp, Homo sapiens
taacttataaaacct

SEQ ID NO: 75635 - DNA, 15 bp, Homo sapiens
ttaacttataaaacc

SEQ ID NO: 75636 - DNA, 15 bp, Homo sapiens
tttaacttataaaac

SEQ ID NO: 75637 - DNA, 15 bp, Homo sapiens
gtttaacttataaaa

SEQ ID NO: 75638 - DNA, 15 bp, Homo sapiens
tgtttaacttataaa

SEQ ID NO: 75639 - DNA, 15 bp, Homo sapiens
atgtttaacttataa

SEQ ID NO: 75640 - DNA, 15 bp, Homo sapiens
aatgtttaacttata

SEQ ID NO: 75641 - DNA, 15 bp, Homo sapiens
aaatgtttaacttat

SEQ ID NO: 75642 - DNA, 15 bp, Homo sapiens
aaaatgtttaactta

SEQ ID NO: 75643 - DNA, 15 bp, Homo sapiens
aaaaatgtttaactt

SEQ ID NO: 75644 - DNA, 15 bp, Homo sapiens
gaaaaatgtttaact

SEQ ID NO: 75645 - DNA, 15 bp, Homo sapiens
tgaaaaatgtttaac

SEQ ID NO: 75646 - DNA, 15 bp, Homo sapiens
atgaaaaatgtttaa

SEQ ID NO: 75647 - DNA, 15 bp, Homo sapiens
tatgaaaaatgttta

SEQ ID NO: 75648 - DNA, 15 bp, Homo sapiens
ttatgaaaaatgttt

SEQ ID NO: 75649 - DNA, 15 bp, Homo sapiens
attatgaaaaatgtt

SEQ ID NO: 75650 - DNA, 15 bp, Homo sapiens
aattatgaaaaatgt

SEQ ID NO: 75651 - DNA, 15 bp, Homo sapiens
aaattatgaaaaatg

SEQ ID NO: 75652 - DNA, 15 bp, Homo sapiens
aaaattatgaaaaat

SEQ ID NO: 75653 - DNA, 15 bp, Homo sapiens
caaaattatgaaaaa

SEQ ID NO: 75654 - DNA, 15 bp, Homo sapiens
ccaaaattatgaaaa

SEQ ID NO: 75655 - DNA, 15 bp, Homo sapiens
accaaaattatgaaa

SEQ ID NO: 75656 - DNA, 15 bp, Homo sapiens
taccaaaattatgaa

SEQ ID NO: 75657 - DNA, 15 bp, Homo sapiens
gtaccaaaattatga

SEQ ID NO: 75658 - DNA, 15 bp, Homo sapiens
ggtaccaaaattatg

SEQ ID NO: 75659 - DNA, 15 bp, Homo sapiens
tggtaccaaaattat

SEQ ID NO: 75660 - DNA, 15 bp, Homo sapiens
gtggtaccaaaatta

SEQ ID NO: 75661 - DNA, 15 bp, Homo sapiens
tgtggtaccaaaatt

SEQ ID NO: 75662 - DNA, 15 bp, Homo sapiens
ctgtggtaccaaaat

SEQ ID NO: 75663 - DNA, 15 bp, Homo sapiens
tctgtggtaccaaaa

SEQ ID NO: 75664 - DNA, 15 bp, Homo sapiens
atctgtggtaccaaa

SEQ ID NO: 75665 - DNA, 15 bp, Homo sapiens
catctgtggtaccaa

SEQ ID NO: 75666 - DNA, 15 bp, Homo sapiens
tcatctgtggtacca

SEQ ID NO: 75667 - DNA, 15 bp, Homo sapiens
ttcatctgtggtacc

SEQ ID NO: 75668 - DNA, 15 bp, Homo sapiens
tttcatctgtggtac

SEQ ID NO: 75669 - DNA, 15 bp, Homo sapiens
ttttcatctgtggta

SEQ ID NO: 75670 - DNA, 15 bp, Homo sapiens
attttcatctgtggt

SEQ ID NO: 75671 - DNA, 15 bp, Homo sapiens
aattttcatctgtgg

SEQ ID NO: 75672 - DNA, 15 bp, Homo sapiens
aaattttcatctgtg

SEQ ID NO: 75673 - DNA, 15 bp, Homo sapiens
aaaattttcatctgt

SEQ ID NO: 75674 - DNA, 15 bp, Homo sapiens
gaaaattttcatctg

SEQ ID NO: 75675 - DNA, 15 bp, Homo sapiens
agaaaattttcatct

SEQ ID NO: 75676 - DNA, 15 bp, Homo sapiens
aagaaaattttcatc

SEQ ID NO: 75677 - DNA, 15 bp, Homo sapiens
caagaaaattttcat

SEQ ID NO: 75678 - DNA, 15 bp, Homo sapiens
ccaagaaaattttca

SEQ ID NO: 75679 - DNA, 15 bp, Homo sapiens
gccaagaaaattttc

SEQ ID NO: 75680 - DNA, 15 bp, Homo sapiens
tgccaagaaaatttt

SEQ ID NO: 75681 - DNA, 15 bp, Homo sapiens
atgccaagaaaattt

SEQ ID NO: 75682 - DNA, 15 bp, Homo sapiens
catgccaagaaaatt

SEQ ID NO: 75683 - DNA, 15 bp, Homo sapiens
acatgccaagaaaat

SEQ ID NO: 75684 - DNA, 15 bp, Homo sapiens
tacatgccaagaaaa

SEQ ID NO: 75685 - DNA, 15 bp, Homo sapiens
ttacatgccaagaaa

SEQ ID NO: 75686 - DNA, 15 bp, Homo sapiens
tttacatgccaagaa

SEQ ID NO: 75687 - DNA, 15 bp, Homo sapiens
ttttacatgccaaga

SEQ ID NO: 75688 - DNA, 15 bp, Homo sapiens
cttttacatgccaag

SEQ ID NO: 75689 - DNA, 15 bp, Homo sapiens
tcttttacatgccaa

SEQ ID NO: 75690 - DNA, 15 bp, Homo sapiens
ctcttttacatgcca

SEQ ID NO: 75691 - DNA, 15 bp, Homo sapiens
tctcttttacatgcc

SEQ ID NO: 75692 - DNA, 15 bp, Homo sapiens
ctctcttttacatgc

SEQ ID NO: 75693 - DNA, 15 bp, Homo sapiens
actctcttttacatg

SEQ ID NO: 75694 - DNA, 15 bp, Homo sapiens
aactctcttttacat

SEQ ID NO: 75695 - DNA, 15 bp, Homo sapiens
taactctcttttaca

SEQ ID NO: 75696 - DNA, 15 bp, Homo sapiens
ttaactctcttttac

SEQ ID NO: 75697 - DNA, 15 bp, Homo sapiens
cttaactctctttta

SEQ ID NO: 75698 - DNA, 15 bp, Homo sapiens
ccttaactctctttt

SEQ ID NO: 75699 - DNA, 15 bp, Homo sapiens
tccttaactctcttt

SEQ ID NO: 75700 - DNA, 15 bp, Homo sapiens
ttccttaactctctt

SEQ ID NO: 75701 - DNA, 15 bp, Homo sapiens
attccttaactctct

SEQ ID NO: 75702 - DNA, 15 bp, Homo sapiens
tattccttaactctc

SEQ ID NO: 75703 - DNA, 15 bp, Homo sapiens
atattccttaactct

SEQ ID NO: 75704 - DNA, 15 bp, Homo sapiens
tatattccttaactc

SEQ ID NO: 75705 - DNA, 15 bp, Homo sapiens
ttatattccttaact

SEQ ID NO: 75706 - DNA, 15 bp, Homo sapiens
gttatattccttaac

SEQ ID NO: 75707 - DNA, 15 bp, Homo sapiens
tgttatattccttaa

SEQ ID NO: 75708 - DNA, 15 bp, Homo sapiens
ctgttatattcctta

SEQ ID NO: 75709 - DNA, 15 bp, Homo sapiens
tctgttatattcctt

SEQ ID NO: 75710 - DNA, 15 bp, Homo sapiens
gtctgttatattcct

SEQ ID NO: 75711 - DNA, 15 bp, Homo sapiens
tgtctgttatattcc

SEQ ID NO: 75712 - DNA, 15 bp, Homo sapiens
atgtctgttatattc

SEQ ID NO: 75713 - DNA, 15 bp, Homo sapiens
catgtctgttatatt

SEQ ID NO: 75714 - DNA, 15 bp, Homo sapiens
gcatgtctgttatat

SEQ ID NO: 75715 - DNA, 15 bp, Homo sapiens
agcatgtctgttata

SEQ ID NO: 75716 - DNA, 15 bp, Homo sapiens
cagcatgtctgttat

SEQ ID NO: 75717 - DNA, 15 bp, Homo sapiens
ccagcatgtctgtta

SEQ ID NO: 75718 - DNA, 15 bp, Homo sapiens
accagcatgtctgtt

SEQ ID NO: 75719 - DNA, 15 bp, Homo sapiens
aaccagcatgtctgt

SEQ ID NO: 75720 - DNA, 15 bp, Homo sapiens
aaaccagcatgtctg

SEQ ID NO: 75721 - DNA, 15 bp, Homo sapiens
aaaaccagcatgtct

SEQ ID NO: 75722 - DNA, 15 bp, Homo sapiens
aaaaaccagcatgtc

SEQ ID NO: 75723 - DNA, 15 bp, Homo sapiens
aaaaaaccagcatgt

SEQ ID NO: 75724 - DNA, 15 bp, Homo sapiens
aaaaaaaccagcatg

SEQ ID NO: 75725 - DNA, 15 bp, Homo sapiens
taaaaaaaccagcat

SEQ ID NO: 75726 - DNA, 15 bp, Homo sapiens
ctaaaaaaaccagca

SEQ ID NO: 75727 - DNA, 15 bp, Homo sapiens
gctaaaaaaaccagc

SEQ ID NO: 75728 - DNA, 15 bp, Homo sapiens
agctaaaaaaaccag

SEQ ID NO: 75729 - DNA, 15 bp, Homo sapiens
tagctaaaaaaacca

SEQ ID NO: 75730 - DNA, 15 bp, Homo sapiens
ttagctaaaaaaacc

SEQ ID NO: 75731 - DNA, 15 bp, Homo sapiens
tttagctaaaaaaac

SEQ ID NO: 75732 - DNA, 15 bp, Homo sapiens
ttttagctaaaaaaa

SEQ ID NO: 75733 - DNA, 15 bp, Homo sapiens
tttttagctaaaaaa

SEQ ID NO: 75734 - DNA, 15 bp, Homo sapiens
atttttagctaaaaa

SEQ ID NO: 75735 - DNA, 15 bp, Homo sapiens
aatttttagctaaaa

SEQ ID NO: 75736 - DNA, 15 bp, Homo sapiens
aaatttttagctaaa

SEQ ID NO: 75737 - DNA, 15 bp, Homo sapiens
caaatttttagctaa

SEQ ID NO: 75738 - DNA, 15 bp, Homo sapiens
tcaaatttttagcta

SEQ ID NO: 75739 - DNA, 15 bp, Homo sapiens
ttcaaatttttagct

SEQ ID NO: 75740 - DNA, 15 bp, Homo sapiens
tttcaaatttttagc

SEQ ID NO: 75741 - DNA, 15 bp, Homo sapiens
ttttcaaatttttag

SEQ ID NO: 75742 - DNA, 15 bp, Homo sapiens
tttttcaaattttta

SEQ ID NO: 75743 - DNA, 15 bp, Homo sapiens
aatttttcaaatttt

SEQ ID NO: 75744 - DNA, 15 bp, Homo sapiens
aaatttttcaaattt

SEQ ID NO: 75745 - DNA, 15 bp, Homo sapiens
caaatttttcaaatt

SEQ ID NO: 75746 - DNA, 15 bp, Homo sapiens
tcaaatttttcaaat

SEQ ID NO: 75747 - DNA, 15 bp, Homo sapiens
ttcaaatttttcaaa

SEQ ID NO: 75748 - DNA, 15 bp, Homo sapiens
cttcaaatttttcaa

SEQ ID NO: 75749 - DNA, 15 bp, Homo sapiens
gcttcaaatttttca

SEQ ID NO: 75750 - DNA, 15 bp, Homo sapiens
tgcttcaaatttttc

SEQ ID NO: 75751 - DNA, 15 bp, Homo sapiens
gtgcttcaaattttt

SEQ ID NO: 75752 - DNA, 15 bp, Homo sapiens
tgtgcttcaaatttt

SEQ ID NO: 75753 - DNA, 15 bp, Homo sapiens
ttgtgcttcaaattt

SEQ ID NO: 75754 - DNA, 15 bp, Homo sapiens
tttgtgcttcaaatt

SEQ ID NO: 75755 - DNA, 15 bp, Homo sapiens
ttttgtgcttcaaat

SEQ ID NO: 75756 - DNA, 15 bp, Homo sapiens
tttttgtgcttcaaa

SEQ ID NO: 75757 - DNA, 15 bp, Homo sapiens
ctttttgtgcttcaa

SEQ ID NO: 75758 - DNA, 15 bp, Homo sapiens
actttttgtgcttca

SEQ ID NO: 75759 - DNA, 15 bp, Homo sapiens
tactttttgtgcttc

SEQ ID NO: 75760 - DNA, 15 bp, Homo sapiens
ctactttttgtgctt

SEQ ID NO: 75761 - DNA, 15 bp, Homo sapiens
tctactttttgtgct

SEQ ID NO: 75762 - DNA, 15 bp, Homo sapiens
atctactttttgtgc

SEQ ID NO: 75763 - DNA, 15 bp, Homo sapiens
tatctactttttgtg

SEQ ID NO: 75764 - DNA, 15 bp, Homo sapiens
atatctactttttgt

SEQ ID NO: 75765 - DNA, 15 bp, Homo sapiens
catatctactttttg

SEQ ID NO: 75766 - DNA, 15 bp, Homo sapiens
acatatctacttttt

SEQ ID NO: 75767 - DNA, 15 bp, Homo sapiens
aacatatctactttt

SEQ ID NO: 75768 - DNA, 15 bp, Homo sapiens
aaacatatctacttt

SEQ ID NO: 75769 - DNA, 15 bp, Homo sapiens
caaacatatctactt

SEQ ID NO: 75770 - DNA, 15 bp, Homo sapiens
acaaacatatctact

SEQ ID NO: 75771 - DNA, 15 bp, Homo sapiens
aacaaacatatctac

SEQ ID NO: 75772 - DNA, 15 bp, Homo sapiens
aaacaaacatatcta

SEQ ID NO: 75773 - DNA, 15 bp, Homo sapiens
aaaacaaacatatct

SEQ ID NO: 75774 - DNA, 15 bp, Homo sapiens
taaaacaaacatatc

SEQ ID NO: 75775 - DNA, 15 bp, Homo sapiens
ataaaacaaacatat

SEQ ID NO: 75776 - DNA, 15 bp, Homo sapiens
aataaaacaaacata

SEQ ID NO: 75777 - DNA, 15 bp, Homo sapiens
aaataaaacaaacat

SEQ ID NO: 75778 - DNA, 15 bp, Homo sapiens
aaaataaaacaaaca

SEQ ID NO: 75779 - DNA, 15 bp, Homo sapiens
aaaaataaaacaaac

SEQ ID NO: 75780 - DNA, 15 bp, Homo sapiens
aaaaaataaaacaaa

SEQ ID NO: 75781 - DNA, 15 bp, Homo sapiens
taaaaaataaaacaa

SEQ ID NO: 75782 - DNA, 15 bp, Homo sapiens
ttaaaaaataaaaca

SEQ ID NO: 75783 - DNA, 15 bp, Homo sapiens
attaaaaaataaaac

SEQ ID NO: 75784 - DNA, 15 bp, Homo sapiens
tattaaaaaataaaa

SEQ ID NO: 75785 - DNA, 15 bp, Homo sapiens
ttattaaaaaataaa

SEQ ID NO: 75786 - DNA, 15 bp, Homo sapiens
attattaaaaaataa

SEQ ID NO: 75787 - DNA, 15 bp, Homo sapiens
tattattaaaaaata

SEQ ID NO: 75788 - DNA, 15 bp, Homo sapiens
atattattaaaaaat

SEQ ID NO: 75789 - DNA, 15 bp, Homo sapiens
catattattaaaaaa

SEQ ID NO: 75790 - DNA, 15 bp, Homo sapiens
acatattattaaaaa

SEQ ID NO: 75791 - DNA, 15 bp, Homo sapiens
tacatattattaaaa

SEQ ID NO: 75792 - DNA, 15 bp, Homo sapiens
ttacatattattaaa

SEQ ID NO: 75793 - DNA, 15 bp, Homo sapiens
tttacatattattaa

SEQ ID NO: 75794 - DNA, 15 bp, Homo sapiens
ttttacatattatta

SEQ ID NO: 75795 - DNA, 15 bp, Homo sapiens
tttttacatattatt

SEQ ID NO: 75796 - DNA, 15 bp, Homo sapiens
atttttacatattat

SEQ ID NO: 75797 - DNA, 15 bp, Homo sapiens
catttttacatatta

SEQ ID NO: 75798 - DNA, 15 bp, Homo sapiens
acatttttacatatt

SEQ ID NO: 75799 - DNA, 15 bp, Homo sapiens
gacatttttacatat

SEQ ID NO: 75800 - DNA, 15 bp, Homo sapiens
tgacatttttacata

SEQ ID NO: 75801 - DNA, 15 bp, Homo sapiens
atgacatttttacat

SEQ ID NO: 75802 - DNA, 15 bp, Homo sapiens
tatgacatttttaca

SEQ ID NO: 75803 - DNA, 15 bp, Homo sapiens
atatgacatttttac

SEQ ID NO: 75804 - DNA, 15 bp, Homo sapiens
aatatgacattttta

SEQ ID NO: 75805 - DNA, 15 bp, Homo sapiens
gaatatgacattttt

SEQ ID NO: 75806 - DNA, 15 bp, Homo sapiens
agaatatgacatttt

SEQ ID NO: 75807 - DNA, 15 bp, Homo sapiens
gagaatatgacattt

SEQ ID NO: 75808 - DNA, 15 bp, Homo sapiens
tgagaatatgacatt

SEQ ID NO: 75809 - DNA, 15 bp, Homo sapiens
atgagaatatgacat

SEQ ID NO: 75810 - DNA, 15 bp, Homo sapiens
tatgagaatatgaca

SEQ ID NO: 75811 - DNA, 15 bp, Homo sapiens
ttatgagaatatgac

SEQ ID NO: 75812 - DNA, 15 bp, Homo sapiens
tttatgagaatatga

SEQ ID NO: 75813 - DNA, 15 bp, Homo sapiens
ttttatgagaatatg

SEQ ID NO: 75814 - DNA, 15 bp, Homo sapiens
tttttatgagaatat

SEQ ID NO: 75815 - DNA, 15 bp, Homo sapiens
gtttttatgagaata

SEQ ID NO: 75816 - DNA, 15 bp, Homo sapiens
ggtttttatgagaat

SEQ ID NO: 75817 - DNA, 15 bp, Homo sapiens
tggtttttatgagaa

SEQ ID NO: 75818 - DNA, 15 bp, Homo sapiens
gtggtttttatgaga

SEQ ID NO: 75819 - DNA, 15 bp, Homo sapiens
tgtggtttttatgag

SEQ ID NO: 75820 - DNA, 15 bp, Homo sapiens
ttgtggtttttatga

SEQ ID NO: 75821 - DNA, 15 bp, Homo sapiens
attgtggtttttatg

SEQ ID NO: 75822 - DNA, 15 bp, Homo sapiens
cattgtggtttttat

SEQ ID NO: 75823 - DNA, 15 bp, Homo sapiens
tcattgtggttttta

SEQ ID NO: 75824 - DNA, 15 bp, Homo sapiens
ttcattgtggttttt

SEQ ID NO: 75825 - DNA, 15 bp, Homo sapiens
tttcattgtggtttt

SEQ ID NO: 75826 - DNA, 15 bp, Homo sapiens
atttcattgtggttt

SEQ ID NO: 75827 - DNA, 15 bp, Homo sapiens
tatttcattgtggtt

SEQ ID NO: 75828 - DNA, 15 bp, Homo sapiens
ctatttcattgtggt

SEQ ID NO: 75829 - DNA, 15 bp, Homo sapiens
tctatttcattgtgg

SEQ ID NO: 75830 - DNA, 15 bp, Homo sapiens
ttctatttcattgtg

SEQ ID NO: 75831 - DNA, 15 bp, Homo sapiens
tttctatttcattgt

SEQ ID NO: 75832 - DNA, 15 bp, Homo sapiens
ctttctatttcattg

SEQ ID NO: 75833 - DNA, 15 bp, Homo sapiens
tctttctatttcatt

SEQ ID NO: 75834 - DNA, 15 bp, Homo sapiens
ctctttctatttcat

SEQ ID NO: 75835 - DNA, 15 bp, Homo sapiens
gctctttctatttca

SEQ ID NO: 75836 - DNA, 15 bp, Homo sapiens
tgctctttctatttc

SEQ ID NO: 75837 - DNA, 15 bp, Homo sapiens
ctgctctttctattt

SEQ ID NO: 75838 - DNA, 15 bp, Homo sapiens
cctgctctttctatt

SEQ ID NO: 75839 - DNA, 15 bp, Homo sapiens
acctgctctttctat

SEQ ID NO: 75840 - DNA, 15 bp, Homo sapiens
aacctgctctttcta

SEQ ID NO: 75841 - DNA, 15 bp, Homo sapiens
aaacctgctctttct

SEQ ID NO: 75842 - DNA, 15 bp, Homo sapiens
caaacctgctctttc

SEQ ID NO: 75843 - DNA, 15 bp, Homo sapiens
ccaaacctgctcttt

SEQ ID NO: 75844 - DNA, 15 bp, Homo sapiens
tccaaacctgctctt

SEQ ID NO: 75845 - DNA, 15 bp, Homo sapiens
ctccaaacctgctct

SEQ ID NO: 75846 - DNA, 15 bp, Homo sapiens
actccaaacctgctc

SEQ ID NO: 75847 - DNA, 15 bp, Homo sapiens
gactccaaacctgct

SEQ ID NO: 75848 - DNA, 15 bp, Homo sapiens
tgactccaaacctgc

SEQ ID NO: 75849 - DNA, 15 bp, Homo sapiens
ttgactccaaacctg

SEQ ID NO: 75850 - DNA, 15 bp, Homo sapiens
tttgactccaaacct

SEQ ID NO: 75851 - DNA, 15 bp, Homo sapiens
ctttgactccaaacc

SEQ ID NO: 75852 - DNA, 15 bp, Homo sapiens
tctttgactccaaac

SEQ ID NO: 75853 - DNA, 15 bp, Homo sapiens
atctttgactccaaa

SEQ ID NO: 75854 - DNA, 15 bp, Homo sapiens
aatctttgactccaa

SEQ ID NO: 75855 - DNA, 15 bp, Homo sapiens
gaatctttgactcca

SEQ ID NO: 75856 - DNA, 15 bp, Homo sapiens
tgaatctttgactcc

SEQ ID NO: 75857 - DNA, 15 bp, Homo sapiens
ctgaatctttgactc

SEQ ID NO: 75858 - DNA, 15 bp, Homo sapiens
tctgaatctttgact

SEQ ID NO: 75859 - DNA, 15 bp, Homo sapiens
ctctgaatctttgac

SEQ ID NO: 75860 - DNA, 15 bp, Homo sapiens
cctctgaatctttga

SEQ ID NO: 75861 - DNA, 15 bp, Homo sapiens
tcctctgaatctttg

SEQ ID NO: 75862 - DNA, 15 bp, Homo sapiens
atcctctgaatcttt

SEQ ID NO: 75863 - DNA, 15 bp, Homo sapiens
tatcctctgaatctt

SEQ ID NO: 75864 - DNA, 15 bp, Homo sapiens
gtatcctctgaatct

SEQ ID NO: 75865 - DNA, 15 bp, Homo sapiens
tgtatcctctgaatc

SEQ ID NO: 75866 - DNA, 15 bp, Homo sapiens
ctgtatcctctgaat

SEQ ID NO: 75867 - DNA, 15 bp, Homo sapiens
actgtatcctctgaa

SEQ ID NO: 75868 - DNA, 15 bp, Homo sapiens
aactgtatcctctga

SEQ ID NO: 75869 - DNA, 15 bp, Homo sapiens
gaactgtatcctctg

SEQ ID NO: 75870 - DNA, 15 bp, Homo sapiens
agaactgtatcctct

SEQ ID NO: 75871 - DNA, 15 bp, Homo sapiens
tagaactgtatcctc

SEQ ID NO: 75872 - DNA, 15 bp, Homo sapiens
atagaactgtatcct

SEQ ID NO: 75873 - DNA, 15 bp, Homo sapiens
aatagaactgtatcc

SEQ ID NO: 75874 - DNA, 15 bp, Homo sapiens
taatagaactgtatc

SEQ ID NO: 75875 - DNA, 15 bp, Homo sapiens
ataatagaactgtat

SEQ ID NO: 75876 - DNA, 15 bp, Homo sapiens
cataatagaactgta

SEQ ID NO: 75877 - DNA, 15 bp, Homo sapiens
acataatagaactgt

SEQ ID NO: 75878 - DNA, 15 bp, Homo sapiens
aacataatagaactg

SEQ ID NO: 75879 - DNA, 15 bp, Homo sapiens
taacataatagaact

SEQ ID NO: 75880 - DNA, 15 bp, Homo sapiens
ctaacataatagaac

SEQ ID NO: 75881 - DNA, 15 bp, Homo sapiens
actaacataatagaa

SEQ ID NO: 75882 - DNA, 15 bp, Homo sapiens
aactaacataataga

SEQ ID NO: 75883 - DNA, 15 bp, Homo sapiens
aaactaacataatag

SEQ ID NO: 75884 - DNA, 15 bp, Homo sapiens
gaaactaacataata

SEQ ID NO: 75885 - DNA, 15 bp, Homo sapiens
agaaactaacataat

SEQ ID NO: 75886 - DNA, 15 bp, Homo sapiens
tagaaactaacataa

SEQ ID NO: 75887 - DNA, 15 bp, Homo sapiens
ctagaaactaacata

SEQ ID NO: 75888 - DNA, 15 bp, Homo sapiens
gctagaaactaacat

SEQ ID NO: 75889 - DNA, 15 bp, Homo sapiens
agctagaaactaaca

SEQ ID NO: 75890 - DNA, 15 bp, Homo sapiens
tagctagaaactaac

SEQ ID NO: 75891 - DNA, 15 bp, Homo sapiens
atagctagaaactaa

SEQ ID NO: 75892 - DNA, 15 bp, Homo sapiens
catagctagaaacta

SEQ ID NO: 75893 - DNA, 15 bp, Homo sapiens
acatagctagaaact

SEQ ID NO: 75894 - DNA, 15 bp, Homo sapiens
cacatagctagaaac

SEQ ID NO: 75895 - DNA, 15 bp, Homo sapiens
tcacatagctagaaa

SEQ ID NO: 75896 - DNA, 15 bp, Homo sapiens
ttcacatagctagaa

SEQ ID NO: 75897 - DNA, 15 bp, Homo sapiens
tttcacatagctaga

SEQ ID NO: 75898 - DNA, 15 bp, Homo sapiens
atttcacatagctag

SEQ ID NO: 75899 - DNA, 15 bp, Homo sapiens
gatttcacatagcta

SEQ ID NO: 75900 - DNA, 15 bp, Homo sapiens
tgatttcacatagct

SEQ ID NO: 75901 - DNA, 15 bp, Homo sapiens
atgatttcacatagc

SEQ ID NO: 75902 - DNA, 15 bp, Homo sapiens
aatgatttcacatag

SEQ ID NO: 75903 - DNA, 15 bp, Homo sapiens
aaatgatttcacata

SEQ ID NO: 75904 - DNA, 15 bp, Homo sapiens
caaatgatttcacat

SEQ ID NO: 75905 - DNA, 15 bp, Homo sapiens
acaaatgatttcaca

SEQ ID NO: 75906 - DNA, 15 bp, Homo sapiens
aacaaatgatttcac

SEQ ID NO: 75907 - DNA, 15 bp, Homo sapiens
gaacaaatgatttca

SEQ ID NO: 75908 - DNA, 15 bp, Homo sapiens
tgaacaaatgatttc

SEQ ID NO: 75909 - DNA, 15 bp, Homo sapiens
ttgaacaaatgattt

SEQ ID NO: 75910 - DNA, 15 bp, Homo sapiens
attgaacaaatgatt

SEQ ID NO: 75911 - DNA, 15 bp, Homo sapiens
aattgaacaaatgat

SEQ ID NO: 75912 - DNA, 15 bp, Homo sapiens
gaattgaacaaatga

SEQ ID NO: 75913 - DNA, 15 bp, Homo sapiens
agaattgaacaaatg

SEQ ID NO: 75914 - DNA, 15 bp, Homo sapiens
tagaattgaacaaat

SEQ ID NO: 75915 - DNA, 15 bp, Homo sapiens
atagaattgaacaaa

SEQ ID NO: 75916 - DNA, 15 bp, Homo sapiens
catagaattgaacaa

SEQ ID NO: 75917 - DNA, 15 bp, Homo sapiens
ccatagaattgaaca

SEQ ID NO: 75918 - DNA, 15 bp, Homo sapiens
tccatagaattgaac

SEQ ID NO: 75919 - DNA, 15 bp, Homo sapiens
ttccatagaattgaa

SEQ ID NO: 75920 - DNA, 15 bp, Homo sapiens
tttccatagaattga

SEQ ID NO: 75921 - DNA, 15 bp, Homo sapiens
atttccatagaattg

SEQ ID NO: 75922 - DNA, 15 bp, Homo sapiens
aatttccatagaatt

SEQ ID NO: 75923 - DNA, 15 bp, Homo sapiens
taatttccatagaat

SEQ ID NO: 75924 - DNA, 15 bp, Homo sapiens
ctaatttccatagaa

SEQ ID NO: 75925 - DNA, 15 bp, Homo sapiens
actaatttccataga

SEQ ID NO: 75926 - DNA, 15 bp, Homo sapiens
aactaatttccatag

SEQ ID NO: 75927 - DNA, 15 bp, Homo sapiens
aaactaatttccata

SEQ ID NO: 75928 - DNA, 15 bp, Homo sapiens
aaaactaatttccat

SEQ ID NO: 75929 - DNA, 15 bp, Homo sapiens
aaaaactaatttcca

SEQ ID NO: 75930 - DNA, 15 bp, Homo sapiens
gaaaaactaatttcc

SEQ ID NO: 75931 - DNA, 15 bp, Homo sapiens
agaaaaactaatttc

SEQ ID NO: 75932 - DNA, 15 bp, Homo sapiens
cagaaaaactaattt

SEQ ID NO: 75933 - DNA, 15 bp, Homo sapiens
tcagaaaaactaatt

SEQ ID NO: 75934 - DNA, 15 bp, Homo sapiens
atcagaaaaactaat

SEQ ID NO: 75935 - DNA, 15 bp, Homo sapiens
aatcagaaaaactaa

SEQ ID NO: 75936 - DNA, 15 bp, Homo sapiens
gaatcagaaaaacta

SEQ ID NO: 75937 - DNA, 15 bp, Homo sapiens
tgaatcagaaaaact

SEQ ID NO: 75938 - DNA, 15 bp, Homo sapiens
atgaatcagaaaaac

SEQ ID NO: 75939 - DNA, 15 bp, Homo sapiens
tatgaatcagaaaaa

SEQ ID NO: 75940 - DNA, 15 bp, Homo sapiens
gtatgaatcagaaaa

SEQ ID NO: 75941 - DNA, 15 bp, Homo sapiens
tgtatgaatcagaaa

SEQ ID NO: 75942 - DNA, 15 bp, Homo sapiens
atgtatgaatcagaa

SEQ ID NO: 75943 - DNA, 15 bp, Homo sapiens
aatgtatgaatcaga

SEQ ID NO: 75944 - DNA, 15 bp, Homo sapiens
aaatgtatgaatcag

SEQ ID NO: 75945 - DNA, 15 bp, Homo sapiens
gaaatgtatgaatca

SEQ ID NO: 75946 - DNA, 15 bp, Homo sapiens
agaaatgtatgaatc

SEQ ID NO: 75947 - DNA, 15 bp, Homo sapiens
tagaaatgtatgaat

SEQ ID NO: 75948 - DNA, 15 bp, Homo sapiens
ctagaaatgtatgaa

SEQ ID NO: 75949 - DNA, 15 bp, Homo sapiens
cctagaaatgtatga

SEQ ID NO: 75950 - DNA, 15 bp, Homo sapiens
gcctagaaatgtatg

SEQ ID NO: 75951 - DNA, 15 bp, Homo sapiens
ggcctagaaatgtat

SEQ ID NO: 75952 - DNA, 15 bp, Homo sapiens
aggcctagaaatgta

SEQ ID NO: 75953 - DNA, 15 bp, Homo sapiens
taggcctagaaatgt

SEQ ID NO: 75954 - DNA, 15 bp, Homo sapiens
ctaggcctagaaatg

SEQ ID NO: 75955 - DNA, 15 bp, Homo sapiens
actaggcctagaaat

SEQ ID NO: 75956 - DNA, 15 bp, Homo sapiens
gactaggcctagaaa

SEQ ID NO: 75957 - DNA, 15 bp, Homo sapiens
agactaggcctagaa

SEQ ID NO: 75958 - DNA, 15 bp, Homo sapiens
cagactaggcctaga

SEQ ID NO: 75959 - DNA, 15 bp, Homo sapiens
acagactaggcctag

SEQ ID NO: 75960 - DNA, 15 bp, Homo sapiens
aacagactaggccta

SEQ ID NO: 75961 - DNA, 15 bp, Homo sapiens
taacagactaggcct

SEQ ID NO: 75962 - DNA, 15 bp, Homo sapiens
ataacagactaggcc

SEQ ID NO: 75963 - DNA, 15 bp, Homo sapiens
aataacagactaggc

SEQ ID NO: 75964 - DNA, 15 bp, Homo sapiens
aaataacagactagg

SEQ ID NO: 75965 - DNA, 15 bp, Homo sapiens
aaaataacagactag

SEQ ID NO: 75966 - DNA, 15 bp, Homo sapiens
taaaataacagacta

SEQ ID NO: 75967 - DNA, 15 bp, Homo sapiens
ttaaaataacagact

SEQ ID NO: 75968 - DNA, 15 bp, Homo sapiens
tttaaaataacagac

SEQ ID NO: 75969 - DNA, 15 bp, Homo sapiens
ctttaaaataacaga

SEQ ID NO: 75970 - DNA, 15 bp, Homo sapiens
gctttaaaataacag

SEQ ID NO: 75971 - DNA, 15 bp, Homo sapiens
tgctttaaaataaca

SEQ ID NO: 75972 - DNA, 15 bp, Homo sapiens
ttgctttaaaataac

SEQ ID NO: 75973 - DNA, 15 bp, Homo sapiens
attgctttaaaataa

SEQ ID NO: 75974 - DNA, 15 bp, Homo sapiens
aattgctttaaaata

SEQ ID NO: 75975 - DNA, 15 bp, Homo sapiens
aaattgctttaaaat

SEQ ID NO: 75976 - DNA, 15 bp, Homo sapiens
aaaattgctttaaaa

SEQ ID NO: 75977 - DNA, 15 bp, Homo sapiens
aaaaattgctttaaa

SEQ ID NO: 75978 - DNA, 15 bp, Homo sapiens
taaaaattgctttaa

SEQ ID NO: 75979 - DNA, 15 bp, Homo sapiens
ataaaaattgcttta

SEQ ID NO: 75980 - DNA, 15 bp, Homo sapiens
tataaaaattgcttt

SEQ ID NO: 75981 - DNA, 15 bp, Homo sapiens
ttataaaaattgctt

SEQ ID NO: 75982 - DNA, 15 bp, Homo sapiens
tttataaaaattgct

SEQ ID NO: 75983 - DNA, 15 bp, Homo sapiens
ttttataaaaattgc

SEQ ID NO: 75984 - DNA, 15 bp, Homo sapiens
tttttataaaaattg

SEQ ID NO: 75985 - DNA, 15 bp, Homo sapiens
atttttataaaaatt

SEQ ID NO: 75986 - DNA, 15 bp, Homo sapiens
tatttttataaaaat

SEQ ID NO: 75987 - DNA, 15 bp, Homo sapiens
gtatttttataaaaa

SEQ ID NO: 75988 - DNA, 15 bp, Homo sapiens
agtatttttataaaa

SEQ ID NO: 75989 - DNA, 15 bp, Homo sapiens
aagtatttttataaa

SEQ ID NO: 75990 - DNA, 15 bp, Homo sapiens
aaagtatttttataa

SEQ ID NO: 75991 - DNA, 15 bp, Homo sapiens
aaaagtatttttata

SEQ ID NO: 75992 - DNA, 15 bp, Homo sapiens
aaaaagtatttttat

SEQ ID NO: 75993 - DNA, 15 bp, Homo sapiens
taaaaagtattttta

SEQ ID NO: 75994 - DNA, 15 bp, Homo sapiens
ataaaaagtattttt

SEQ ID NO: 75995 - DNA, 15 bp, Homo sapiens
tataaaaagtatttt

SEQ ID NO: 75996 - DNA, 15 bp, Homo sapiens
ttataaaaagtattt

SEQ ID NO: 75997 - DNA, 15 bp, Homo sapiens
cttataaaaagtatt

SEQ ID NO: 75998 - DNA, 15 bp, Homo sapiens
acttataaaaagtat

SEQ ID NO: 75999 - DNA, 15 bp, Homo sapiens
aacttataaaaagta

SEQ ID NO: 76000 - DNA, 15 bp, Homo sapiens
caacttataaaaagt

SEQ ID NO: 76001 - DNA, 15 bp, Homo sapiens
aacaacttataaaaa

SEQ ID NO: 76002 - DNA, 15 bp, Homo sapiens
taacaacttataaaa

SEQ ID NO: 76003 - DNA, 15 bp, Homo sapiens
ataacaacttataaa

SEQ ID NO: 76004 - DNA, 15 bp, Homo sapiens
aataacaacttataa

SEQ ID NO: 76005 - DNA, 15 bp, Homo sapiens
gaataacaacttata

SEQ ID NO: 76006 - DNA, 15 bp, Homo sapiens
agaataacaacttat

SEQ ID NO: 76007 - DNA, 15 bp, Homo sapiens
tagaataacaactta

SEQ ID NO: 76008 - DNA, 15 bp, Homo sapiens
atagaataacaactt

SEQ ID NO: 76009 - DNA, 15 bp, Homo sapiens
tatagaataacaact

SEQ ID NO: 76010 - DNA, 15 bp, Homo sapiens
ttatagaataacaac

SEQ ID NO: 76011 - DNA, 15 bp, Homo sapiens
attatagaataacaa

SEQ ID NO: 76012 - DNA, 15 bp, Homo sapiens
tattatagaataaca

SEQ ID NO: 76013 - DNA, 15 bp, Homo sapiens
ttattatagaataac

SEQ ID NO: 76014 - DNA, 15 bp, Homo sapiens
tttattatagaataa

SEQ ID NO: 76015 - DNA, 15 bp, Homo sapiens
ctttattatagaata

SEQ ID NO: 76016 - DNA, 15 bp, Homo sapiens
tctttattatagaat

SEQ ID NO: 76017 - DNA, 15 bp, Homo sapiens
ttctttattatagaa

SEQ ID NO: 76018 - DNA, 15 bp, Homo sapiens
gttctttattataga

SEQ ID NO: 76019 - DNA, 15 bp, Homo sapiens
tgttctttattatag

SEQ ID NO: 76020 - DNA, 15 bp, Homo sapiens
ttgttctttattata

SEQ ID NO: 76021 - DNA, 15 bp, Homo sapiens
attgttctttattat

SEQ ID NO: 76022 - DNA, 15 bp, Homo sapiens
cattgttctttatta

SEQ ID NO: 76023 - DNA, 15 bp, Homo sapiens
ccattgttctttatt

SEQ ID NO: 76024 - DNA, 15 bp, Homo sapiens
tccattgttctttat

SEQ ID NO: 76025 - DNA, 15 bp, Homo sapiens
ttccattgttcttta

SEQ ID NO: 76026 - DNA, 15 bp, Homo sapiens
tttccattgttcttt

SEQ ID NO: 76027 - DNA, 15 bp, Homo sapiens
atttccattgttctt

SEQ ID NO: 76028 - DNA, 15 bp, Homo sapiens
gatttccattgttct

SEQ ID NO: 76029 - DNA, 15 bp, Homo sapiens
tgatttccattgttc

SEQ ID NO: 76030 - DNA, 15 bp, Homo sapiens
atgatttccattgtt

SEQ ID NO: 76031 - DNA, 15 bp, Homo sapiens
catgatttccattgt

SEQ ID NO: 76032 - DNA, 15 bp, Homo sapiens
tcatgatttccattg

SEQ ID NO: 76033 - DNA, 15 bp, Homo sapiens
ttcatgatttccatt

SEQ ID NO: 76034 - DNA, 15 bp, Homo sapiens
attcatgatttccat

SEQ ID NO: 76035 - DNA, 15 bp, Homo sapiens
aattcatgatttcca

SEQ ID NO: 76036 - DNA, 15 bp, Homo sapiens
aaattcatgatttcc

SEQ ID NO: 76037 - DNA, 15 bp, Homo sapiens
gaaattcatgatttc

SEQ ID NO: 76038 - DNA, 15 bp, Homo sapiens
agaaattcatgattt

SEQ ID NO: 76039 - DNA, 15 bp, Homo sapiens
aagaaattcatgatt

SEQ ID NO: 76040 - DNA, 15 bp, Homo sapiens
gaagaaattcatgat

SEQ ID NO: 76041 - DNA, 15 bp, Homo sapiens
tgaagaaattcatga

SEQ ID NO: 76042 - DNA, 15 bp, Homo sapiens
ttgaagaaattcatg

SEQ ID NO: 76043 - DNA, 15 bp, Homo sapiens
cttgaagaaattcat

SEQ ID NO: 76044 - DNA, 15 bp, Homo sapiens
ccttgaagaaattca

SEQ ID NO: 76045 - DNA, 15 bp, Homo sapiens
tccttgaagaaattc

SEQ ID NO: 76046 - DNA, 15 bp, Homo sapiens
atccttgaagaaatt

SEQ ID NO: 76047 - DNA, 15 bp, Homo sapiens
aatccttgaagaaat

SEQ ID NO: 76048 - DNA, 15 bp, Homo sapiens
caatccttgaagaaa

SEQ ID NO: 76049 - DNA, 15 bp, Homo sapiens
acaatccttgaagaa

SEQ ID NO: 76050 - DNA, 15 bp, Homo sapiens
cacaatccttgaaga

SEQ ID NO: 76051 - DNA, 15 bp, Homo sapiens
tcacaatccttgaag

SEQ ID NO: 76052 - DNA, 15 bp, Homo sapiens
atcacaatccttgaa

SEQ ID NO: 76053 - DNA, 15 bp, Homo sapiens
tatcacaatccttga

SEQ ID NO: 76054 - DNA, 15 bp, Homo sapiens
ttatcacaatccttg

SEQ ID NO: 76055 - DNA, 15 bp, Homo sapiens
gttatcacaatcctt

SEQ ID NO: 76056 - DNA, 15 bp, Homo sapiens
agttatcacaatcct

SEQ ID NO: 76057 - DNA, 15 bp, Homo sapiens
gagttatcacaatcc

SEQ ID NO: 76058 - DNA, 15 bp, Homo sapiens
agagttatcacaatc

SEQ ID NO: 76059 - DNA, 15 bp, Homo sapiens
gagagttatcacaat

SEQ ID NO: 76060 - DNA, 15 bp, Homo sapiens
agagagttatcacaa

SEQ ID NO: 76061 - DNA, 15 bp, Homo sapiens
gagagagttatcaca

SEQ ID NO: 76062 - DNA, 15 bp, Homo sapiens
agagagagttatcac

SEQ ID NO: 76063 - DNA, 15 bp, Homo sapiens
aagagagagttatca

SEQ ID NO: 76064 - DNA, 15 bp, Homo sapiens
taagagagagttatc

SEQ ID NO: 76065 - DNA, 15 bp, Homo sapiens
ttaagagagagttat

SEQ ID NO: 76066 - DNA, 15 bp, Homo sapiens
cttaagagagagtta

SEQ ID NO: 76067 - DNA, 15 bp, Homo sapiens
ccttaagagagagtt

SEQ ID NO: 76068 - DNA, 15 bp, Homo sapiens
gccttaagagagagt

SEQ ID NO: 76069 - DNA, 15 bp, Homo sapiens
agccttaagagagag

SEQ ID NO: 76070 - DNA, 15 bp, Homo sapiens
cagccttaagagaga

SEQ ID NO: 76071 - DNA, 15 bp, Homo sapiens
acagccttaagagag

SEQ ID NO: 76072 - DNA, 15 bp, Homo sapiens
cacagccttaagaga

SEQ ID NO: 76073 - DNA, 15 bp, Homo sapiens
acacagccttaagag

SEQ ID NO: 76074 - DNA, 15 bp, Homo sapiens
aacacagccttaaga

SEQ ID NO: 76075 - DNA, 15 bp, Homo sapiens
caacacagccttaag

SEQ ID NO: 76076 - DNA, 15 bp, Homo sapiens
tcaacacagccttaa

SEQ ID NO: 76077 - DNA, 15 bp, Homo sapiens
gtcaacacagcctta

SEQ ID NO: 76078 - DNA, 15 bp, Homo sapiens
tgtcaacacagcctt

SEQ ID NO: 76079 - DNA, 15 bp, Homo sapiens
ttgtcaacacagcct

SEQ ID NO: 76080 - DNA, 15 bp, Homo sapiens
tttgtcaacacagcc

SEQ ID NO: 76081 - DNA, 15 bp, Homo sapiens
ctttgtcaacacagc

SEQ ID NO: 76082 - DNA, 15 bp, Homo sapiens
cctttgtcaacacag

SEQ ID NO: 76083 - DNA, 15 bp, Homo sapiens
tcctttgtcaacaca

SEQ ID NO: 76084 - DNA, 15 bp, Homo sapiens
atcctttgtcaacac

SEQ ID NO: 76085 - DNA, 15 bp, Homo sapiens
catcctttgtcaaca

SEQ ID NO: 76086 - DNA, 15 bp, Homo sapiens
ccatcctttgtcaac

SEQ ID NO: 76087 - DNA, 15 bp, Homo sapiens
accatcctttgtcaa

SEQ ID NO: 76088 - DNA, 15 bp, Homo sapiens
aaccatcctttgtca

SEQ ID NO: 76089 - DNA, 15 bp, Homo sapiens
aaaccatcctttgtc

SEQ ID NO: 76090 - DNA, 15 bp, Homo sapiens
gaaaccatcctttgt

SEQ ID NO: 76091 - DNA, 15 bp, Homo sapiens
agaaaccatcctttg

SEQ ID NO: 76092 - DNA, 15 bp, Homo sapiens
gagaaaccatccttt

SEQ ID NO: 76093 - DNA, 15 bp, Homo sapiens
ggagaaaccatcctt

SEQ ID NO: 76094 - DNA, 15 bp, Homo sapiens
aggagaaaccatcct

SEQ ID NO: 76095 - DNA, 15 bp, Homo sapiens
aaggagaaaccatcc

SEQ ID NO: 76096 - DNA, 15 bp, Homo sapiens
aaaggagaaaccatc

SEQ ID NO: 76097 - DNA, 15 bp, Homo sapiens
aaaaggagaaaccat

SEQ ID NO: 76098 - DNA, 15 bp, Homo sapiens
aaaaaggagaaacca

SEQ ID NO: 76099 - DNA, 15 bp, Homo sapiens
gaaaaaggagaaacc

SEQ ID NO: 76100 - DNA, 15 bp, Homo sapiens
agaaaaaggagaaac

SEQ ID NO: 76101 - DNA, 15 bp, Homo sapiens
tagaaaaaggagaaa

SEQ ID NO: 76102 - DNA, 15 bp, Homo sapiens
ctagaaaaaggagaa

SEQ ID NO: 76103 - DNA, 15 bp, Homo sapiens
tctagaaaaaggaga

SEQ ID NO: 76104 - DNA, 15 bp, Homo sapiens
ttctagaaaaaggag

SEQ ID NO: 76105 - DNA, 15 bp, Homo sapiens
tttctagaaaaagga

SEQ ID NO: 76106 - DNA, 15 bp, Homo sapiens
gtttctagaaaaagg

SEQ ID NO: 76107 - DNA, 15 bp, Homo sapiens
agtttctagaaaaag

SEQ ID NO: 76108 - DNA, 15 bp, Homo sapiens
aagtttctagaaaaa

SEQ ID NO: 76109 - DNA, 15 bp, Homo sapiens
caagtttctagaaaa

SEQ ID NO: 76110 - DNA, 15 bp, Homo sapiens
ccaagtttctagaaa

SEQ ID NO: 76111 - DNA, 15 bp, Homo sapiens
accaagtttctagaa

SEQ ID NO: 76112 - DNA, 15 bp, Homo sapiens
caccaagtttctaga

SEQ ID NO: 76113 - DNA, 15 bp, Homo sapiens
tcaccaagtttctag

SEQ ID NO: 76114 - DNA, 15 bp, Homo sapiens
ctcaccaagtttcta

SEQ ID NO: 76115 - DNA, 15 bp, Homo sapiens
gctcaccaagtttct

SEQ ID NO: 76116 - DNA, 15 bp, Homo sapiens
cgctcaccaagtttc

SEQ ID NO: 76117 - DNA, 15 bp, Homo sapiens
gcgctcaccaagttt

SEQ ID NO: 76118 - DNA, 15 bp, Homo sapiens
agcgctcaccaagtt

SEQ ID NO: 76119 - DNA, 15 bp, Homo sapiens
cagcgctcaccaagt

SEQ ID NO: 76120 - DNA, 15 bp, Homo sapiens
ccagcgctcaccaag

SEQ ID NO: 76121 - DNA, 15 bp, Homo sapiens
tccagcgctcaccaa

SEQ ID NO: 76122 - DNA, 15 bp, Homo sapiens
gtccagcgctcacca

SEQ ID NO: 76123 - DNA, 15 bp, Homo sapiens
tgtccagcgctcacc

SEQ ID NO: 76124 - DNA, 15 bp, Homo sapiens
ctgtccagcgctcac

SEQ ID NO: 76125 - DNA, 15 bp, Homo sapiens
gctgtccagcgctca

SEQ ID NO: 76126 - DNA, 15 bp, Homo sapiens
tgctgtccagcgctc

SEQ ID NO: 76127 - DNA, 15 bp, Homo sapiens
ctgctgtccagcgct

SEQ ID NO: 76128 - DNA, 15 bp, Homo sapiens
actgctgtccagcgc

SEQ ID NO: 76129 - DNA, 15 bp, Homo sapiens
tactgctgtccagcg

SEQ ID NO: 76130 - DNA, 15 bp, Homo sapiens
atactgctgtccagc

SEQ ID NO: 76131 - DNA, 15 bp, Homo sapiens
catactgctgtccag

SEQ ID NO: 76132 - DNA, 15 bp, Homo sapiens
gcatactgctgtcca

SEQ ID NO: 76133 - DNA, 15 bp, Homo sapiens
ggcatactgctgtcc

SEQ ID NO: 76134 - DNA, 15 bp, Homo sapiens
cggcatactgctgtc

SEQ ID NO: 76135 - DNA, 15 bp, Homo sapiens
acggcatactgctgt

SEQ ID NO: 76136 - DNA, 15 bp, Homo sapiens
aacggcatactgctg

SEQ ID NO: 76137 - DNA, 15 bp, Homo sapiens
caacggcatactgct

SEQ ID NO: 76138 - DNA, 15 bp, Homo sapiens
ccaacggcatactgc

SEQ ID NO: 76139 - DNA, 15 bp, Homo sapiens
tccaacggcatactg

SEQ ID NO: 76140 - DNA, 15 bp, Homo sapiens
gtccaacggcatact

SEQ ID NO: 76141 - DNA, 15 bp, Homo sapiens
agtccaacggcatac

SEQ ID NO: 76142 - DNA, 15 bp, Homo sapiens
cagtccaacggcata

SEQ ID NO: 76143 - DNA, 15 bp, Homo sapiens
tcagtccaacggcat

SEQ ID NO: 76144 - DNA, 15 bp, Homo sapiens
ttcagtccaacggca

SEQ ID NO: 76145 - DNA, 15 bp, Homo sapiens
cttcagtccaacggc

SEQ ID NO: 76146 - DNA, 15 bp, Homo sapiens
tcttcagtccaacgg

SEQ ID NO: 76147 - DNA, 15 bp, Homo sapiens
ttcttcagtccaacg

SEQ ID NO: 76148 - DNA, 15 bp, Homo sapiens
gttcttcagtccaac

SEQ ID NO: 76149 - DNA, 15 bp, Homo sapiens
cgttcttcagtccaa

SEQ ID NO: 76150 - DNA, 15 bp, Homo sapiens
gcgttcttcagtcca

SEQ ID NO: 76151 - DNA, 15 bp, Homo sapiens
agcgttcttcagtcc

SEQ ID NO: 76152 - DNA, 15 bp, Homo sapiens
cagcgttcttcagtc

SEQ ID NO: 76153 - DNA, 15 bp, Homo sapiens
ccagcgttcttcagt

SEQ ID NO: 76154 - DNA, 15 bp, Homo sapiens
tccagcgttcttcag

SEQ ID NO: 76155 - DNA, 15 bp, Homo sapiens
ttccagcgttcttca

SEQ ID NO: 76156 - DNA, 15 bp, Homo sapiens
attccagcgttcttc

SEQ ID NO: 76157 - DNA, 15 bp, Homo sapiens
tattccagcgttctt

SEQ ID NO: 76158 - DNA, 15 bp, Homo sapiens
ctattccagcgttct

SEQ ID NO: 76159 - DNA, 15 bp, Homo sapiens
cctattccagcgttc

SEQ ID NO: 76160 - DNA, 15 bp, Homo sapiens
acctattccagcgtt

SEQ ID NO: 76161 - DNA, 15 bp, Homo sapiens
aacctattccagcgt

SEQ ID NO: 76162 - DNA, 15 bp, Homo sapiens
taacctattccagcg

SEQ ID NO: 76163 - DNA, 15 bp, Homo sapiens
gtaacctattccagc

SEQ ID NO: 76164 - DNA, 15 bp, Homo sapiens
tgtaacctattccag

SEQ ID NO: 76165 - DNA, 15 bp, Homo sapiens
ttgtaacctattcca

SEQ ID NO: 76166 - DNA, 15 bp, Homo sapiens
cttgtaacctattcc

SEQ ID NO: 76167 - DNA, 15 bp, Homo sapiens
tcttgtaacctattc

SEQ ID NO: 76168 - DNA, 15 bp, Homo sapiens
ttcttgtaacctatt

SEQ ID NO: 76169 - DNA, 15 bp, Homo sapiens
tttcttgtaacctat

SEQ ID NO: 76170 - DNA, 15 bp, Homo sapiens
atttcttgtaaccta

SEQ ID NO: 76171 - DNA, 15 bp, Homo sapiens
gatttcttgtaacct

SEQ ID NO: 76172 - DNA, 15 bp, Homo sapiens
tgatttcttgtaacc

SEQ ID NO: 76173 - DNA, 15 bp, Homo sapiens
ttgatttcttgtaac

SEQ ID NO: 76174 - DNA, 15 bp, Homo sapiens
attgatttcttgtaa

SEQ ID NO: 76175 - DNA, 15 bp, Homo sapiens
tattgatttcttgta

SEQ ID NO: 76176 - DNA, 15 bp, Homo sapiens
atattgatttcttgt

SEQ ID NO: 76177 - DNA, 15 bp, Homo sapiens
tatattgatttcttg

SEQ ID NO: 76178 - DNA, 15 bp, Homo sapiens
atatattgatttctt

SEQ ID NO: 76179 - DNA, 15 bp, Homo sapiens
aatatattgatttct

SEQ ID NO: 76180 - DNA, 15 bp, Homo sapiens
caatatattgatttc

SEQ ID NO: 76181 - DNA, 15 bp, Homo sapiens
acaatatattgattt

SEQ ID NO: 76182 - DNA, 15 bp, Homo sapiens
cacaatatattgatt

SEQ ID NO: 76183 - DNA, 15 bp, Homo sapiens
ccacaatatattgat

SEQ ID NO: 76184 - DNA, 15 bp, Homo sapiens
gccacaatatattga

SEQ ID NO: 76185 - DNA, 15 bp, Homo sapiens
tgccacaatatattg

SEQ ID NO: 76186 - DNA, 15 bp, Homo sapiens
ctgccacaatatatt

SEQ ID NO: 76187 - DNA, 15 bp, Homo sapiens
cctgccacaatatat

SEQ ID NO: 76188 - DNA, 15 bp, Homo sapiens
tcctgccacaatata

SEQ ID NO: 76189 - DNA, 15 bp, Homo sapiens
ttcctgccacaatat

SEQ ID NO: 76190 - DNA, 15 bp, Homo sapiens
attcctgccacaata

SEQ ID NO: 76191 - DNA, 15 bp, Homo sapiens
aattcctgccacaat

SEQ ID NO: 76192 - DNA, 15 bp, Homo sapiens
taattcctgccacaa

SEQ ID NO: 76193 - DNA, 15 bp, Homo sapiens
ataattcctgccaca

SEQ ID NO: 76194 - DNA, 15 bp, Homo sapiens
aataattcctgccac

SEQ ID NO: 76195 - DNA, 15 bp, Homo sapiens
caataattcctgcca

SEQ ID NO: 76196 - DNA, 15 bp, Homo sapiens
ccaataattcctgcc

SEQ ID NO: 76197 - DNA, 15 bp, Homo sapiens
tccaataattcctgc

SEQ ID NO: 76198 - DNA, 15 bp, Homo sapiens
ttccaataattcctg

SEQ ID NO: 76199 - DNA, 15 bp, Homo sapiens
cttccaataattcct

SEQ ID NO: 76200 - DNA, 15 bp, Homo sapiens
tcttccaataattcc

SEQ ID NO: 76201 - DNA, 15 bp, Homo sapiens
ttcttccaataattc

SEQ ID NO: 76202 - DNA, 15 bp, Homo sapiens
gttcttccaataatt

SEQ ID NO: 76203 - DNA, 15 bp, Homo sapiens
tgttcttccaataat

SEQ ID NO: 76204 - DNA, 15 bp, Homo sapiens
ctgttcttccaataa

SEQ ID NO: 76205 - DNA, 15 bp, Homo sapiens
cctgttcttccaata

SEQ ID NO: 76206 - DNA, 15 bp, Homo sapiens
acctgttcttccaat

SEQ ID NO: 76207 - DNA, 15 bp, Homo sapiens
tacctgttcttccaa

SEQ ID NO: 76208 - DNA, 15 bp, Homo sapiens
atacctgttcttcca

SEQ ID NO: 76209 - DNA, 15 bp, Homo sapiens
catacctgttcttcc

SEQ ID NO: 76210 - DNA, 15 bp, Homo sapiens
tcatacctgttcttc

SEQ ID NO: 76211 - DNA, 15 bp, Homo sapiens
ttcatacctgttctt

SEQ ID NO: 76212 - DNA, 15 bp, Homo sapiens
tttcatacctgttct

SEQ ID NO: 76213 - DNA, 15 bp, Homo sapiens
gtttcatacctgttc

SEQ ID NO: 76214 - DNA, 15 bp, Homo sapiens
agtttcatacctgtt

SEQ ID NO: 76215 - DNA, 15 bp, Homo sapiens
cagtttcatacctgt

SEQ ID NO: 76216 - DNA, 15 bp, Homo sapiens
acagtttcatacctg

SEQ ID NO: 76217 - DNA, 15 bp, Homo sapiens
aacagtttcatacct

SEQ ID NO: 76218 - DNA, 15 bp, Homo sapiens
aaacagtttcatacc

SEQ ID NO: 76219 - DNA, 15 bp, Homo sapiens
aaaacagtttcatac

SEQ ID NO: 76220 - DNA, 15 bp, Homo sapiens
gaaaacagtttcata

SEQ ID NO: 76221 - DNA, 15 bp, Homo sapiens
ggaaaacagtttcat

SEQ ID NO: 76222 - DNA, 15 bp, Homo sapiens
tggaaaacagtttca

SEQ ID NO: 76223 - DNA, 15 bp, Homo sapiens
atggaaaacagtttc

SEQ ID NO: 76224 - DNA, 15 bp, Homo sapiens
tatggaaaacagttt

SEQ ID NO: 76225 - DNA, 15 bp, Homo sapiens
ttatggaaaacagtt

SEQ ID NO: 76226 - DNA, 15 bp, Homo sapiens
cttatggaaaacagt

SEQ ID NO: 76227 - DNA, 15 bp, Homo sapiens
ccttatggaaaacag

SEQ ID NO: 76228 - DNA, 15 bp, Homo sapiens
cccttatggaaaaca

SEQ ID NO: 76229 - DNA, 15 bp, Homo sapiens
ccccttatggaaaac

SEQ ID NO: 76230 - DNA, 15 bp, Homo sapiens
gccccttatggaaaa

SEQ ID NO: 76231 - DNA, 15 bp, Homo sapiens
tgccccttatggaaa

SEQ ID NO: 76232 - DNA, 15 bp, Homo sapiens
ttgccccttatggaa

SEQ ID NO: 76233 - DNA, 15 bp, Homo sapiens
tttgccccttatgga

SEQ ID NO: 76234 - DNA, 15 bp, Homo sapiens
ttttgccccttatgg

SEQ ID NO: 76235 - DNA, 15 bp, Homo sapiens
attttgccccttatg

SEQ ID NO: 76236 - DNA, 15 bp, Homo sapiens
tattttgccccttat

SEQ ID NO: 76237 - DNA, 15 bp, Homo sapiens
ttattttgcccctta

SEQ ID NO: 76238 - DNA, 15 bp, Homo sapiens
tttattttgcccctt

SEQ ID NO: 76239 - DNA, 15 bp, Homo sapiens
atttattttgcccct

SEQ ID NO: 76240 - DNA, 15 bp, Homo sapiens
catttattttgcccc

SEQ ID NO: 76241 - DNA, 15 bp, Homo sapiens
ccatttattttgccc

SEQ ID NO: 76242 - DNA, 15 bp, Homo sapiens
accatttattttgcc

SEQ ID NO: 76243 - DNA, 15 bp, Homo sapiens
caccatttattttgc

SEQ ID NO: 76244 - DNA, 15 bp, Homo sapiens
tcaccatttattttg

SEQ ID NO: 76245 - DNA, 15 bp, Homo sapiens
ttcaccatttatttt

SEQ ID NO: 76246 - DNA, 15 bp, Homo sapiens
tttcaccatttattt

SEQ ID NO: 76247 - DNA, 15 bp, Homo sapiens
ttttcaccatttatt

SEQ ID NO: 76248 - DNA, 15 bp, Homo sapiens
cttttcaccatttat

SEQ ID NO: 76249 - DNA, 15 bp, Homo sapiens
acttttcaccattta

SEQ ID NO: 76250 - DNA, 15 bp, Homo sapiens
tacttttcaccattt

SEQ ID NO: 76251 - DNA, 15 bp, Homo sapiens
ttacttttcaccatt

SEQ ID NO: 76252 - DNA, 15 bp, Homo sapiens
gttacttttcaccat

SEQ ID NO: 76253 - DNA, 15 bp, Homo sapiens
ggttacttttcacca

SEQ ID NO: 76254 - DNA, 15 bp, Homo sapiens
gggttacttttcacc

SEQ ID NO: 76255 - DNA, 15 bp, Homo sapiens
tgggttacttttcac

SEQ ID NO: 76256 - DNA, 15 bp, Homo sapiens
atgggttacttttca

SEQ ID NO: 76257 - DNA, 15 bp, Homo sapiens
gatgggttacttttc

SEQ ID NO: 76258 - DNA, 15 bp, Homo sapiens
agatgggttactttt

SEQ ID NO: 76259 - DNA, 15 bp, Homo sapiens
aagatgggttacttt

SEQ ID NO: 76260 - DNA, 15 bp, Homo sapiens
aaagatgggttactt

SEQ ID NO: 76261 - DNA, 15 bp, Homo sapiens
aaaagatgggttact

SEQ ID NO: 76262 - DNA, 15 bp, Homo sapiens
taaaagatgggttac

SEQ ID NO: 76263 - DNA, 15 bp, Homo sapiens
ataaaagatgggtta

SEQ ID NO: 76264 - DNA, 15 bp, Homo sapiens
aataaaagatgggtt

SEQ ID NO: 76265 - DNA, 15 bp, Homo sapiens
caataaaagatgggt

SEQ ID NO: 76266 - DNA, 15 bp, Homo sapiens
acaataaaagatggg

SEQ ID NO: 76267 - DNA, 15 bp, Homo sapiens
cacaataaaagatgg

SEQ ID NO: 76268 - DNA, 15 bp, Homo sapiens
tcacaataaaagatg

SEQ ID NO: 76269 - DNA, 15 bp, Homo sapiens
gtcacaataaaagat

SEQ ID NO: 76270 - DNA, 15 bp, Homo sapiens
agtcacaataaaaga

SEQ ID NO: 76271 - DNA, 15 bp, Homo sapiens
aagtcacaataaaag

SEQ ID NO: 76272 - DNA, 15 bp, Homo sapiens
aaagtcacaataaaa

SEQ ID NO: 76273 - DNA, 15 bp, Homo sapiens
taaagtcacaataaa

SEQ ID NO: 76274 - DNA, 15 bp, Homo sapiens
ctaaagtcacaataa

SEQ ID NO: 76275 - DNA, 15 bp, Homo sapiens
tctaaagtcacaata

SEQ ID NO: 76276 - DNA, 15 bp, Homo sapiens
ttctaaagtcacaat

SEQ ID NO: 76277 - DNA, 15 bp, Homo sapiens
attctaaagtcacaa

SEQ ID NO: 76278 - DNA, 15 bp, Homo sapiens
tattctaaagtcaca

SEQ ID NO: 76279 - DNA, 15 bp, Homo sapiens
ttattctaaagtcac

SEQ ID NO: 76280 - DNA, 15 bp, Homo sapiens
tttattctaaagtca

SEQ ID NO: 76281 - DNA, 15 bp, Homo sapiens
ctttattctaaagtc

SEQ ID NO: 76282 - DNA, 15 bp, Homo sapiens
actttattctaaagt

SEQ ID NO: 76283 - DNA, 15 bp, Homo sapiens
aactttattctaaag

SEQ ID NO: 76284 - DNA, 15 bp, Homo sapiens
caactttattctaaa

SEQ ID NO: 76285 - DNA, 15 bp, Homo sapiens
gcaactttattctaa

SEQ ID NO: 76286 - DNA, 15 bp, Homo sapiens
ggcaactttattcta

SEQ ID NO: 76287 - DNA, 15 bp, Homo sapiens
aggcaactttattct

SEQ ID NO: 76288 - DNA, 15 bp, Homo sapiens
aaggcaactttattc

SEQ ID NO: 76289 - DNA, 15 bp, Homo sapiens
caaggcaactttatt

SEQ ID NO: 76290 - DNA, 15 bp, Homo sapiens
acaaggcaactttat

SEQ ID NO: 76291 - DNA, 15 bp, Homo sapiens
aacaaggcaacttta

SEQ ID NO: 76292 - DNA, 15 bp, Homo sapiens
aaacaaggcaacttt

SEQ ID NO: 76293 - DNA, 15 bp, Homo sapiens
taaacaaggcaactt

SEQ ID NO: 76294 - DNA, 15 bp, Homo sapiens
gtaaacaaggcaact

SEQ ID NO: 76295 - DNA, 15 bp, Homo sapiens
agtaaacaaggcaac

SEQ ID NO: 76296 - DNA, 15 bp, Homo sapiens
aagtaaacaaggcaa

SEQ ID NO: 76297 - DNA, 15 bp, Homo sapiens
aaagtaaacaaggca

SEQ ID NO: 76298 - DNA, 15 bp, Homo sapiens
aaaagtaaacaaggc

SEQ ID NO: 76299 - DNA, 15 bp, Homo sapiens
gaaaagtaaacaagg

SEQ ID NO: 76300 - DNA, 15 bp, Homo sapiens
agaaaagtaaacaag

SEQ ID NO: 76301 - DNA, 15 bp, Homo sapiens
aagaaaagtaaacaa

SEQ ID NO: 76302 - DNA, 15 bp, Homo sapiens
aaagaaaagtaaaca

SEQ ID NO: 76303 - DNA, 15 bp, Homo sapiens
caaagaaaagtaaac

SEQ ID NO: 76304 - DNA, 15 bp, Homo sapiens
tcaaagaaaagtaaa

SEQ ID NO: 76305 - DNA, 15 bp, Homo sapiens
ttcaaagaaaagtaa

SEQ ID NO: 76306 - DNA, 15 bp, Homo sapiens
tttcaaagaaaagta

SEQ ID NO: 76307 - DNA, 15 bp, Homo sapiens
ctttcaaagaaaagt

SEQ ID NO: 76308 - DNA, 15 bp, Homo sapiens
cctttcaaagaaaag

SEQ ID NO: 76309 - DNA, 15 bp, Homo sapiens
tcctttcaaagaaaa

SEQ ID NO: 76310 - DNA, 15 bp, Homo sapiens
ttcctttcaaagaaa

SEQ ID NO: 76311 - DNA, 15 bp, Homo sapiens
tttcctttcaaagaa

SEQ ID NO: 76312 - DNA, 15 bp, Homo sapiens
ttttcctttcaaaga

SEQ ID NO: 76313 - DNA, 15 bp, Homo sapiens
attttcctttcaaag

SEQ ID NO: 76314 - DNA, 15 bp, Homo sapiens
tattttcctttcaaa

SEQ ID NO: 76315 - DNA, 15 bp, Homo sapiens
atattttcctttcaa

SEQ ID NO: 76316 - DNA, 15 bp, Homo sapiens
tatattttcctttca

SEQ ID NO: 76317 - DNA, 15 bp, Homo sapiens
atatattttcctttc

SEQ ID NO: 76318 - DNA, 15 bp, Homo sapiens
tatatattttccttt

SEQ ID NO: 76319 - DNA, 15 bp, Homo sapiens
ttatatattttcctt

SEQ ID NO: 76320 - DNA, 15 bp, Homo sapiens
tttatatattttcct

SEQ ID NO: 76321 - DNA, 15 bp, Homo sapiens
atttatatattttcc

SEQ ID NO: 76322 - DNA, 15 bp, Homo sapiens
tatttatatattttc

SEQ ID NO: 76323 - DNA, 15 bp, Homo sapiens
aattatttatatatt

SEQ ID NO: 76324 - DNA, 15 bp, Homo sapiens
taattatttatatat

SEQ ID NO: 76325 - DNA, 15 bp, Homo sapiens
ataattatttatata

SEQ ID NO: 76326 - DNA, 15 bp, Homo sapiens
aataattatttatat

SEQ ID NO: 76327 - DNA, 15 bp, Homo sapiens
aaataattatttata

SEQ ID NO: 76328 - DNA, 15 bp, Homo sapiens
aaaataattatttat

SEQ ID NO: 76329 - DNA, 15 bp, Homo sapiens
taaaataattattta

SEQ ID NO: 76330 - DNA, 15 bp, Homo sapiens
ttaaaataattattt

SEQ ID NO: 76331 - DNA, 15 bp, Homo sapiens
tttaaaataattatt

SEQ ID NO: 76332 - DNA, 15 bp, Homo sapiens
ctttaaaataattat

SEQ ID NO: 76333 - DNA, 15 bp, Homo sapiens
tctttaaaataatta

SEQ ID NO: 76334 - DNA, 15 bp, Homo sapiens
atctttaaaataatt

SEQ ID NO: 76335 - DNA, 15 bp, Homo sapiens
gatctttaaaataat

SEQ ID NO: 76336 - DNA, 15 bp, Homo sapiens
tgatctttaaaataa

SEQ ID NO: 76337 - DNA, 15 bp, Homo sapiens
ttgatctttaaaata

SEQ ID NO: 76338 - DNA, 15 bp, Homo sapiens
tttgatctttaaaat

SEQ ID NO: 76339 - DNA, 15 bp, Homo sapiens
atttgatctttaaaa

SEQ ID NO: 76340 - DNA, 15 bp, Homo sapiens
aatttgatctttaaa

SEQ ID NO: 76341 - DNA, 15 bp, Homo sapiens
aaatttgatctttaa

SEQ ID NO: 76342 - DNA, 15 bp, Homo sapiens
gaaatttgatcttta

SEQ ID NO: 76343 - DNA, 15 bp, Homo sapiens
agaaatttgatcttt

SEQ ID NO: 76344 - DNA, 15 bp, Homo sapiens
tagaaatttgatctt

SEQ ID NO: 76345 - DNA, 15 bp, Homo sapiens
atagaaatttgatct

SEQ ID NO: 76346 - DNA, 15 bp, Homo sapiens
gatagaaatttgatc

SEQ ID NO: 76347 - DNA, 15 bp, Homo sapiens
ggatagaaatttgat

SEQ ID NO: 76348 - DNA, 15 bp, Homo sapiens
tggatagaaatttga

SEQ ID NO: 76349 - DNA, 15 bp, Homo sapiens
ctggatagaaatttg

SEQ ID NO: 76350 - DNA, 15 bp, Homo sapiens
actggatagaaattt

SEQ ID NO: 76351 - DNA, 15 bp, Homo sapiens
aactggatagaaatt

SEQ ID NO: 76352 - DNA, 15 bp, Homo sapiens
aaactggatagaaat

SEQ ID NO: 76353 - DNA, 15 bp, Homo sapiens
taaactggatagaaa

SEQ ID NO: 76354 - DNA, 15 bp, Homo sapiens
ataaactggatagaa

SEQ ID NO: 76355 - DNA, 15 bp, Homo sapiens
tataaactggataga

SEQ ID NO: 76356 - DNA, 15 bp, Homo sapiens
ttataaactggatag

SEQ ID NO: 76357 - DNA, 15 bp, Homo sapiens
gttataaactggata

SEQ ID NO: 76358 - DNA, 15 bp, Homo sapiens
agttataaactggat

SEQ ID NO: 76359 - DNA, 15 bp, Homo sapiens
cagttataaactgga

SEQ ID NO: 76360 - DNA, 15 bp, Homo sapiens
tcagttataaactgg

SEQ ID NO: 76361 - DNA, 15 bp, Homo sapiens
atcagttataaactg

SEQ ID NO: 76362 - DNA, 15 bp, Homo sapiens
gatcagttataaact

SEQ ID NO: 76363 - DNA, 15 bp, Homo sapiens
tgatcagttataaac

SEQ ID NO: 76364 - DNA, 15 bp, Homo sapiens
atgatcagttataaa

SEQ ID NO: 76365 - DNA, 15 bp, Homo sapiens
catgatcagttataa

SEQ ID NO: 76366 - DNA, 15 bp, Homo sapiens
tcatgatcagttata

SEQ ID NO: 76367 - DNA, 15 bp, Homo sapiens
ttcatgatcagttat

SEQ ID NO: 76368 - DNA, 15 bp, Homo sapiens
cttcatgatcagtta

SEQ ID NO: 76369 - DNA, 15 bp, Homo sapiens
gcttcatgatcagtt

SEQ ID NO: 76370 - DNA, 15 bp, Homo sapiens
agcttcatgatcagt

SEQ ID NO: 76371 - DNA, 15 bp, Homo sapiens
aagcttcatgatcag

SEQ ID NO: 76372 - DNA, 15 bp, Homo sapiens
taagcttcatgatca

SEQ ID NO: 76373 - DNA, 15 bp, Homo sapiens
ataagcttcatgatc

SEQ ID NO: 76374 - DNA, 15 bp, Homo sapiens
aataagcttcatgat

SEQ ID NO: 76375 - DNA, 15 bp, Homo sapiens
gaataagcttcatga

SEQ ID NO: 76376 - DNA, 15 bp, Homo sapiens
tgaataagcttcatg

SEQ ID NO: 76377 - DNA, 15 bp, Homo sapiens
gtgaataagcttcat

SEQ ID NO: 76378 - DNA, 15 bp, Homo sapiens
tgtgaataagcttca

SEQ ID NO: 76379 - DNA, 15 bp, Homo sapiens
ctgtgaataagcttc

SEQ ID NO: 76380 - DNA, 15 bp, Homo sapiens
tctgtgaataagctt

SEQ ID NO: 76381 - DNA, 15 bp, Homo sapiens
ctctgtgaataagct

SEQ ID NO: 76382 - DNA, 15 bp, Homo sapiens
tctctgtgaataagc

SEQ ID NO: 76383 - DNA, 15 bp, Homo sapiens
atctctgtgaataag

SEQ ID NO: 76384 - DNA, 15 bp, Homo sapiens
aatctctgtgaataa

SEQ ID NO: 76385 - DNA, 15 bp, Homo sapiens
caatctctgtgaata

SEQ ID NO: 76386 - DNA, 15 bp, Homo sapiens
acaatctctgtgaat

SEQ ID NO: 76387 - DNA, 15 bp, Homo sapiens
cacaatctctgtgaa

SEQ ID NO: 76388 - DNA, 15 bp, Homo sapiens
acacaatctctgtga

SEQ ID NO: 76389 - DNA, 15 bp, Homo sapiens
gacacaatctctgtg

SEQ ID NO: 76390 - DNA, 15 bp, Homo sapiens
tgacacaatctctgt

SEQ ID NO: 76391 - DNA, 15 bp, Homo sapiens
atgacacaatctctg

SEQ ID NO: 76392 - DNA, 15 bp, Homo sapiens
aatgacacaatctct

SEQ ID NO: 76393 - DNA, 15 bp, Homo sapiens
aaatgacacaatctc

SEQ ID NO: 76394 - DNA, 15 bp, Homo sapiens
caaatgacacaatct

SEQ ID NO: 76395 - DNA, 15 bp, Homo sapiens
ccaaatgacacaatc

SEQ ID NO: 76396 - DNA, 15 bp, Homo sapiens
gccaaatgacacaat

SEQ ID NO: 76397 - DNA, 15 bp, Homo sapiens
agccaaatgacacaa

SEQ ID NO: 76398 - DNA, 15 bp, Homo sapiens
gagccaaatgacaca

SEQ ID NO: 76399 - DNA, 15 bp, Homo sapiens
ggagccaaatgacac

SEQ ID NO: 76400 - DNA, 15 bp, Homo sapiens
tggagccaaatgaca

SEQ ID NO: 76401 - DNA, 15 bp, Homo sapiens
atggagccaaatgac

SEQ ID NO: 76402 - DNA, 15 bp, Homo sapiens
aatggagccaaatga

SEQ ID NO: 76403 - DNA, 15 bp, Homo sapiens
taatggagccaaatg

SEQ ID NO: 76404 - DNA, 15 bp, Homo sapiens
ttaatggagccaaat

SEQ ID NO: 76405 - DNA, 15 bp, Homo sapiens
attaatggagccaaa

SEQ ID NO: 76406 - DNA, 15 bp, Homo sapiens
aattaatggagccaa

SEQ ID NO: 76407 - DNA, 15 bp, Homo sapiens
aaattaatggagcca

SEQ ID NO: 76408 - DNA, 15 bp, Homo sapiens
caaattaatggagcc

SEQ ID NO: 76409 - DNA, 15 bp, Homo sapiens
tcaaattaatggagc

SEQ ID NO: 76410 - DNA, 15 bp, Homo sapiens
gtcaaattaatggag

SEQ ID NO: 76411 - DNA, 15 bp, Homo sapiens
ggtcaaattaatgga

SEQ ID NO: 76412 - DNA, 15 bp, Homo sapiens
aggtcaaattaatgg

SEQ ID NO: 76413 - DNA, 15 bp, Homo sapiens
caggtcaaattaatg

SEQ ID NO: 76414 - DNA, 15 bp, Homo sapiens
acaggtcaaattaat

SEQ ID NO: 76415 - DNA, 15 bp, Homo sapiens
aacaggtcaaattaa

SEQ ID NO: 76416 - DNA, 15 bp, Homo sapiens
aaacaggtcaaatta

SEQ ID NO: 76417 - DNA, 15 bp, Homo sapiens
aaaacaggtcaaatt

SEQ ID NO: 76418 - DNA, 15 bp, Homo sapiens
gaaaacaggtcaaat

SEQ ID NO: 76419 - DNA, 15 bp, Homo sapiens
tgaaaacaggtcaaa

SEQ ID NO: 76420 - DNA, 15 bp, Homo sapiens
atgaaaacaggtcaa

SEQ ID NO: 76421 - DNA, 15 bp, Homo sapiens
aatgaaaacaggtca

SEQ ID NO: 76422 - DNA, 15 bp, Homo sapiens
taatgaaaacaggtc

SEQ ID NO: 76423 - DNA, 15 bp, Homo sapiens
gtaatgaaaacaggt

SEQ ID NO: 76424 - DNA, 15 bp, Homo sapiens
agtaatgaaaacagg

SEQ ID NO: 76425 - DNA, 15 bp, Homo sapiens
aagtaatgaaaacag

SEQ ID NO: 76426 - DNA, 15 bp, Homo sapiens
caagtaatgaaaaca

SEQ ID NO: 76427 - DNA, 15 bp, Homo sapiens
ccaagtaatgaaaac

SEQ ID NO: 76428 - DNA, 15 bp, Homo sapiens
tccaagtaatgaaaa

SEQ ID NO: 76429 - DNA, 15 bp, Homo sapiens
ttccaagtaatgaaa

SEQ ID NO: 76430 - DNA, 15 bp, Homo sapiens
attccaagtaatgaa

SEQ ID NO: 76431 - DNA, 15 bp, Homo sapiens
cattccaagtaatga

SEQ ID NO: 76432 - DNA, 15 bp, Homo sapiens
acattccaagtaatg

SEQ ID NO: 76433 - DNA, 15 bp, Homo sapiens
aacattccaagtaat

SEQ ID NO: 76434 - DNA, 15 bp, Homo sapiens
taacattccaagtaa

SEQ ID NO: 76435 - DNA, 15 bp, Homo sapiens
ctaacattccaagta

SEQ ID NO: 76436 - DNA, 15 bp, Homo sapiens
actaacattccaagt

SEQ ID NO: 76437 - DNA, 15 bp, Homo sapiens
tactaacattccaag

SEQ ID NO: 76438 - DNA, 15 bp, Homo sapiens
gtactaacattccaa

SEQ ID NO: 76439 - DNA, 15 bp, Homo sapiens
agtactaacattcca

SEQ ID NO: 76440 - DNA, 15 bp, Homo sapiens
aagtactaacattcc

SEQ ID NO: 76441 - DNA, 15 bp, Homo sapiens
taagtactaacattc

SEQ ID NO: 76442 - DNA, 15 bp, Homo sapiens
ctaagtactaacatt

SEQ ID NO: 76443 - DNA, 15 bp, Homo sapiens
tctaagtactaacat

SEQ ID NO: 76444 - DNA, 15 bp, Homo sapiens
ttctaagtactaaca

SEQ ID NO: 76445 - DNA, 15 bp, Homo sapiens
cttctaagtactaac

SEQ ID NO: 76446 - DNA, 15 bp, Homo sapiens
tcttctaagtactaa

SEQ ID NO: 76447 - DNA, 15 bp, Homo sapiens
atcttctaagtacta

SEQ ID NO: 76448 - DNA, 15 bp, Homo sapiens
tatcttctaagtact

SEQ ID NO: 76449 - DNA, 15 bp, Homo sapiens
atatcttctaagtac

SEQ ID NO: 76450 - DNA, 15 bp, Homo sapiens
catatcttctaagta

SEQ ID NO: 76451 - DNA, 15 bp, Homo sapiens
gcatatcttctaagt

SEQ ID NO: 76452 - DNA, 15 bp, Homo sapiens
agcatatcttctaag

SEQ ID NO: 76453 - DNA, 15 bp, Homo sapiens
tagcatatcttctaa

SEQ ID NO: 76454 - DNA, 15 bp, Homo sapiens
atagcatatcttcta

SEQ ID NO: 76455 - DNA, 15 bp, Homo sapiens
aatagcatatcttct

SEQ ID NO: 76456 - DNA, 15 bp, Homo sapiens
aaatagcatatcttc

SEQ ID NO: 76457 - DNA, 15 bp, Homo sapiens
aaaatagcatatctt

SEQ ID NO: 76458 - DNA, 15 bp, Homo sapiens
gaaaatagcatatct

SEQ ID NO: 76459 - DNA, 15 bp, Homo sapiens
tgaaaatagcatatc

SEQ ID NO: 76460 - DNA, 15 bp, Homo sapiens
atgaaaatagcatat

SEQ ID NO: 76461 - DNA, 15 bp, Homo sapiens
catgaaaatagcata

SEQ ID NO: 76462 - DNA, 15 bp, Homo sapiens
tcatgaaaatagcat

SEQ ID NO: 76463 - DNA, 15 bp, Homo sapiens
atcatgaaaatagca

SEQ ID NO: 76464 - DNA, 15 bp, Homo sapiens
aatcatgaaaatagc

SEQ ID NO: 76465 - DNA, 15 bp, Homo sapiens
aaatcatgaaaatag

SEQ ID NO: 76466 - DNA, 15 bp, Homo sapiens
caaatcatgaaaata

SEQ ID NO: 76467 - DNA, 15 bp, Homo sapiens
acaaatcatgaaaat

SEQ ID NO: 76468 - DNA, 15 bp, Homo sapiens
aacaaatcatgaaaa

SEQ ID NO: 76469 - DNA, 15 bp, Homo sapiens
aaacaaatcatgaaa

SEQ ID NO: 76470 - DNA, 15 bp, Homo sapiens
caaacaaatcatgaa

SEQ ID NO: 76471 - DNA, 15 bp, Homo sapiens
tcaaacaaatcatga

SEQ ID NO: 76472 - DNA, 15 bp, Homo sapiens
gtcaaacaaatcatg

SEQ ID NO: 76473 - DNA, 15 bp, Homo sapiens
tgtcaaacaaatcat

SEQ ID NO: 76474 - DNA, 15 bp, Homo sapiens
atgtcaaacaaatca

SEQ ID NO: 76475 - DNA, 15 bp, Homo sapiens
gatgtcaaacaaatc

SEQ ID NO: 76476 - DNA, 15 bp, Homo sapiens
tgatgtcaaacaaat

SEQ ID NO: 76477 - DNA, 15 bp, Homo sapiens
atgatgtcaaacaaa

SEQ ID NO: 76478 - DNA, 15 bp, Homo sapiens
tatgatgtcaaacaa

SEQ ID NO: 76479 - DNA, 15 bp, Homo sapiens
ctatgatgtcaaaca

SEQ ID NO: 76480 - DNA, 15 bp, Homo sapiens
actatgatgtcaaac

SEQ ID NO: 76481 - DNA, 15 bp, Homo sapiens
aactatgatgtcaaa

SEQ ID NO: 76482 - DNA, 15 bp, Homo sapiens
taactatgatgtcaa

SEQ ID NO: 76483 - DNA, 15 bp, Homo sapiens
ataactatgatgtca

SEQ ID NO: 76484 - DNA, 15 bp, Homo sapiens
aataactatgatgtc

SEQ ID NO: 76485 - DNA, 15 bp, Homo sapiens
taataactatgatgt

SEQ ID NO: 76486 - DNA, 15 bp, Homo sapiens
ctaataactatgatg

SEQ ID NO: 76487 - DNA, 15 bp, Homo sapiens
actaataactatgat

SEQ ID NO: 76488 - DNA, 15 bp, Homo sapiens
cactaataactatga

SEQ ID NO: 76489 - DNA, 15 bp, Homo sapiens
ccactaataactatg

SEQ ID NO: 76490 - DNA, 15 bp, Homo sapiens
tccactaataactat

SEQ ID NO: 76491 - DNA, 15 bp, Homo sapiens
atccactaataacta

SEQ ID NO: 76492 - DNA, 15 bp, Homo sapiens
aatccactaataact

SEQ ID NO: 76493 - DNA, 15 bp, Homo sapiens
aaatccactaataac

SEQ ID NO: 76494 - DNA, 15 bp, Homo sapiens
caaatccactaataa

SEQ ID NO: 76495 - DNA, 15 bp, Homo sapiens
acaaatccactaata

SEQ ID NO: 76496 - DNA, 15 bp, Homo sapiens
cacaaatccactaat

SEQ ID NO: 76497 - DNA, 15 bp, Homo sapiens
acacaaatccactaa

SEQ ID NO: 76498 - DNA, 15 bp, Homo sapiens
aacacaaatccacta

SEQ ID NO: 76499 - DNA, 15 bp, Homo sapiens
caacacaaatccact

SEQ ID NO: 76500 - DNA, 15 bp, Homo sapiens
ccaacacaaatccac

SEQ ID NO: 76501 - DNA, 15 bp, Homo sapiens
cccaacacaaatcca

SEQ ID NO: 76502 - DNA, 15 bp, Homo sapiens
acccaacacaaatcc

SEQ ID NO: 76503 - DNA, 15 bp, Homo sapiens
cacccaacacaaatc

SEQ ID NO: 76504 - DNA, 15 bp, Homo sapiens
tcacccaacacaaat

SEQ ID NO: 76505 - DNA, 15 bp, Homo sapiens
atcacccaacacaaa

SEQ ID NO: 76506 - DNA, 15 bp, Homo sapiens
catcacccaacacaa

SEQ ID NO: 76507 - DNA, 15 bp, Homo sapiens
acatcacccaacaca

SEQ ID NO: 76508 - DNA, 15 bp, Homo sapiens
tacatcacccaacac

SEQ ID NO: 76509 - DNA, 15 bp, Homo sapiens
atacatcacccaaca

SEQ ID NO: 76510 - DNA, 15 bp, Homo sapiens
aatacatcacccaac

SEQ ID NO: 76511 - DNA, 15 bp, Homo sapiens
aaatacatcacccaa

SEQ ID NO: 76512 - DNA, 15 bp, Homo sapiens
caaatacatcaccca

SEQ ID NO: 76513 - DNA, 15 bp, Homo sapiens
tcaaatacatcaccc

SEQ ID NO: 76514 - DNA, 15 bp, Homo sapiens
ttcaaatacatcacc

SEQ ID NO: 76515 - DNA, 15 bp, Homo sapiens
attcaaatacatcac

SEQ ID NO: 76516 - DNA, 15 bp, Homo sapiens
aattcaaatacatca

SEQ ID NO: 76517 - DNA, 15 bp, Homo sapiens
aaattcaaatacatc

SEQ ID NO: 76518 - DNA, 15 bp, Homo sapiens
caaattcaaatacat

SEQ ID NO: 76519 - DNA, 15 bp, Homo sapiens
acaaattcaaataca

SEQ ID NO: 76520 - DNA, 15 bp, Homo sapiens
tacaaattcaaatac

SEQ ID NO: 76521 - DNA, 15 bp, Homo sapiens
atacaaattcaaata

SEQ ID NO: 76522 - DNA, 15 bp, Homo sapiens
gatacaaattcaaat

SEQ ID NO: 76523 - DNA, 15 bp, Homo sapiens
tgatacaaattcaaa

SEQ ID NO: 76524 - DNA, 15 bp, Homo sapiens
ttgatacaaattcaa

SEQ ID NO: 76525 - DNA, 15 bp, Homo sapiens
gttgatacaaattca

SEQ ID NO: 76526 - DNA, 15 bp, Homo sapiens
tgttgatacaaattc

SEQ ID NO: 76527 - DNA, 15 bp, Homo sapiens
gtgttgatacaaatt

SEQ ID NO: 76528 - DNA, 15 bp, Homo sapiens
tgtgttgatacaaat

SEQ ID NO: 76529 - DNA, 15 bp, Homo sapiens
ttgtgttgatacaaa

SEQ ID NO: 76530 - DNA, 15 bp, Homo sapiens
attgtgttgatacaa

SEQ ID NO: 76531 - DNA, 15 bp, Homo sapiens
cattgtgttgataca

SEQ ID NO: 76532 - DNA, 15 bp, Homo sapiens
gcattgtgttgatac

SEQ ID NO: 76533 - DNA, 15 bp, Homo sapiens
ggcattgtgttgata

SEQ ID NO: 76534 - DNA, 15 bp, Homo sapiens
aggcattgtgttgat

SEQ ID NO: 76535 - DNA, 15 bp, Homo sapiens
taggcattgtgttga

SEQ ID NO: 76536 - DNA, 15 bp, Homo sapiens
ctaggcattgtgttg

SEQ ID NO: 76537 - DNA, 15 bp, Homo sapiens
gctaggcattgtgtt

SEQ ID NO: 76538 - DNA, 15 bp, Homo sapiens
tgctaggcattgtgt

SEQ ID NO: 76539 - DNA, 15 bp, Homo sapiens
atgctaggcattgtg

SEQ ID NO: 76540 - DNA, 15 bp, Homo sapiens
tatgctaggcattgt

SEQ ID NO: 76541 - DNA, 15 bp, Homo sapiens
atatgctaggcattg

SEQ ID NO: 76542 - DNA, 15 bp, Homo sapiens
tatatgctaggcatt

SEQ ID NO: 76543 - DNA, 15 bp, Homo sapiens
ttatatgctaggcat

SEQ ID NO: 76544 - DNA, 15 bp, Homo sapiens
attatatgctaggca

SEQ ID NO: 76545 - DNA, 15 bp, Homo sapiens
aattatatgctaggc

SEQ ID NO: 76546 - DNA, 15 bp, Homo sapiens
aaattatatgctagg

SEQ ID NO: 76547 - DNA, 15 bp, Homo sapiens
caaattatatgctag

SEQ ID NO: 76548 - DNA, 15 bp, Homo sapiens
acaaattatatgcta

SEQ ID NO: 76549 - DNA, 15 bp, Homo sapiens
cacaaattatatgct

SEQ ID NO: 76550 - DNA, 15 bp, Homo sapiens
gcacaaattatatgc

SEQ ID NO: 76551 - DNA, 15 bp, Homo sapiens
agcacaaattatatg

SEQ ID NO: 76552 - DNA, 15 bp, Homo sapiens
gagcacaaattatat

SEQ ID NO: 76553 - DNA, 15 bp, Homo sapiens
tgagcacaaattata

SEQ ID NO: 76554 - DNA, 15 bp, Homo sapiens
ctgagcacaaattat

SEQ ID NO: 76555 - DNA, 15 bp, Homo sapiens
actgagcacaaatta

SEQ ID NO: 76556 - DNA, 15 bp, Homo sapiens
tactgagcacaaatt

SEQ ID NO: 76557 - DNA, 15 bp, Homo sapiens
ttactgagcacaaat

SEQ ID NO: 76558 - DNA, 15 bp, Homo sapiens
tttactgagcacaaa

SEQ ID NO: 76559 - DNA, 15 bp, Homo sapiens
atttactgagcacaa

SEQ ID NO: 76560 - DNA, 15 bp, Homo sapiens
tatttactgagcaca

SEQ ID NO: 76561 - DNA, 15 bp, Homo sapiens
ttatttactgagcac

SEQ ID NO: 76562 - DNA, 15 bp, Homo sapiens
attatttactgagca

SEQ ID NO: 76563 - DNA, 15 bp, Homo sapiens
cattatttactgagc

SEQ ID NO: 76564 - DNA, 15 bp, Homo sapiens
tcattatttactgag

SEQ ID NO: 76565 - DNA, 15 bp, Homo sapiens
ctcattatttactga

SEQ ID NO: 76566 - DNA, 15 bp, Homo sapiens
actcattatttactg

SEQ ID NO: 76567 - DNA, 15 bp, Homo sapiens
tactcattatttact

SEQ ID NO: 76568 - DNA, 15 bp, Homo sapiens
ttactcattatttac

SEQ ID NO: 76569 - DNA, 15 bp, Homo sapiens
attactcattattta

SEQ ID NO: 76570 - DNA, 15 bp, Homo sapiens
cattactcattattt

SEQ ID NO: 76571 - DNA, 15 bp, Homo sapiens
tcattactcattatt

SEQ ID NO: 76572 - DNA, 15 bp, Homo sapiens
ttcattactcattat

SEQ ID NO: 76573 - DNA, 15 bp, Homo sapiens
attcattactcatta

SEQ ID NO: 76574 - DNA, 15 bp, Homo sapiens
gattcattactcatt

SEQ ID NO: 76575 - DNA, 15 bp, Homo sapiens
ggattcattactcat

SEQ ID NO: 76576 - DNA, 15 bp, Homo sapiens
tggattcattactca

SEQ ID NO: 76577 - DNA, 15 bp, Homo sapiens
gtggattcattactc

SEQ ID NO: 76578 - DNA, 15 bp, Homo sapiens
agtggattcattact

SEQ ID NO: 76579 - DNA, 15 bp, Homo sapiens
gagtggattcattac

SEQ ID NO: 76580 - DNA, 15 bp, Homo sapiens
tgagtggattcatta

SEQ ID NO: 76581 - DNA, 15 bp, Homo sapiens
ttgagtggattcatt

SEQ ID NO: 76582 - DNA, 15 bp, Homo sapiens
gttgagtggattcat

SEQ ID NO: 76583 - DNA, 15 bp, Homo sapiens
tgttgagtggattca

SEQ ID NO: 76584 - DNA, 15 bp, Homo sapiens
gtgttgagtggattc

SEQ ID NO: 76585 - DNA, 15 bp, Homo sapiens
tgtgttgagtggatt

SEQ ID NO: 76586 - DNA, 15 bp, Homo sapiens
gtgtgttgagtggat

SEQ ID NO: 76587 - DNA, 15 bp, Homo sapiens
agtgtgttgagtgga

SEQ ID NO: 76588 - DNA, 15 bp, Homo sapiens
cagtgtgttgagtgg

SEQ ID NO: 76589 - DNA, 15 bp, Homo sapiens
acagtgtgttgagtg

SEQ ID NO: 76590 - DNA, 15 bp, Homo sapiens
cacagtgtgttgagt

SEQ ID NO: 76591 - DNA, 15 bp, Homo sapiens
tcacagtgtgttgag

SEQ ID NO: 76592 - DNA, 15 bp, Homo sapiens
ttcacagtgtgttga

SEQ ID NO: 76593 - DNA, 15 bp, Homo sapiens
gttcacagtgtgttg

SEQ ID NO: 76594 - DNA, 15 bp, Homo sapiens
agttcacagtgtgtt

SEQ ID NO: 76595 - DNA, 15 bp, Homo sapiens
aagttcacagtgtgt

SEQ ID NO: 76596 - DNA, 15 bp, Homo sapiens
aaagttcacagtgtg

SEQ ID NO: 76597 - DNA, 15 bp, Homo sapiens
taaagttcacagtgt

SEQ ID NO: 76598 - DNA, 15 bp, Homo sapiens
ttaaagttcacagtg

SEQ ID NO: 76599 - DNA, 15 bp, Homo sapiens
attaaagttcacagt

SEQ ID NO: 76600 - DNA, 15 bp, Homo sapiens
aattaaagttcacag

SEQ ID NO: 76601 - DNA, 15 bp, Homo sapiens
gaattaaagttcaca

SEQ ID NO: 76602 - DNA, 15 bp, Homo sapiens
ggaattaaagttcac

SEQ ID NO: 76603 - DNA, 15 bp, Homo sapiens
gggaattaaagttca

SEQ ID NO: 76604 - DNA, 15 bp, Homo sapiens
agggaattaaagttc

SEQ ID NO: 76605 - DNA, 15 bp, Homo sapiens
tagggaattaaagtt

SEQ ID NO: 76606 - DNA, 15 bp, Homo sapiens
ctagggaattaaagt

SEQ ID NO: 76607 - DNA, 15 bp, Homo sapiens
tctagggaattaaag

SEQ ID NO: 76608 - DNA, 15 bp, Homo sapiens
atctagggaattaaa

SEQ ID NO: 76609 - DNA, 15 bp, Homo sapiens
aatctagggaattaa

SEQ ID NO: 76610 - DNA, 15 bp, Homo sapiens
aaatctagggaatta

SEQ ID NO: 76611 - DNA, 15 bp, Homo sapiens
aaaatctagggaatt

SEQ ID NO: 76612 - DNA, 15 bp, Homo sapiens
aaaaatctagggaat

SEQ ID NO: 76613 - DNA, 15 bp, Homo sapiens
aaaaaatctagggaa

SEQ ID NO: 76614 - DNA, 15 bp, Homo sapiens
gaaaaaatctaggga

SEQ ID NO: 76615 - DNA, 15 bp, Homo sapiens
agaaaaaatctaggg

SEQ ID NO: 76616 - DNA, 15 bp, Homo sapiens
aagaaaaaatctagg

SEQ ID NO: 76617 - DNA, 15 bp, Homo sapiens
caagaaaaaatctag

SEQ ID NO: 76618 - DNA, 15 bp, Homo sapiens
tcaagaaaaaatcta

SEQ ID NO: 76619 - DNA, 15 bp, Homo sapiens
atcaagaaaaaatct

SEQ ID NO: 76620 - DNA, 15 bp, Homo sapiens
aatcaagaaaaaatc

SEQ ID NO: 76621 - DNA, 15 bp, Homo sapiens
aaatcaagaaaaaat

SEQ ID NO: 76622 - DNA, 15 bp, Homo sapiens
aaaatcaagaaaaaa

SEQ ID NO: 76623 - DNA, 15 bp, Homo sapiens
aaaaatcaagaaaaa

SEQ ID NO: 76624 - DNA, 15 bp, Homo sapiens
taaaaatcaagaaaa

SEQ ID NO: 76625 - DNA, 15 bp, Homo sapiens
ttaaaaatcaagaaa

SEQ ID NO: 76626 - DNA, 15 bp, Homo sapiens
gttaaaaatcaagaa

SEQ ID NO: 76627 - DNA, 15 bp, Homo sapiens
tgttaaaaatcaaga

SEQ ID NO: 76628 - DNA, 15 bp, Homo sapiens
ttgttaaaaatcaag

SEQ ID NO: 76629 - DNA, 15 bp, Homo sapiens
cttgttaaaaatcaa

SEQ ID NO: 76630 - DNA, 15 bp, Homo sapiens
acttgttaaaaatca

SEQ ID NO: 76631 - DNA, 15 bp, Homo sapiens
tacttgttaaaaatc

SEQ ID NO: 76632 - DNA, 15 bp, Homo sapiens
atacttgttaaaaat

SEQ ID NO: 76633 - DNA, 15 bp, Homo sapiens
aatacttgttaaaaa

SEQ ID NO: 76634 - DNA, 15 bp, Homo sapiens
caatacttgttaaaa

SEQ ID NO: 76635 - DNA, 15 bp, Homo sapiens
tcaatacttgttaaa

SEQ ID NO: 76636 - DNA, 15 bp, Homo sapiens
ttcaatacttgttaa

SEQ ID NO: 76637 - DNA, 15 bp, Homo sapiens
tttcaatacttgtta

SEQ ID NO: 76638 - DNA, 15 bp, Homo sapiens
atttcaatacttgtt

SEQ ID NO: 76639 - DNA, 15 bp, Homo sapiens
aatttcaatacttgt

SEQ ID NO: 76640 - DNA, 15 bp, Homo sapiens
taatttcaatacttg

SEQ ID NO: 76641 - DNA, 15 bp, Homo sapiens
ttaatttcaatactt

SEQ ID NO: 76642 - DNA, 15 bp, Homo sapiens
attaatttcaatact

SEQ ID NO: 76643 - DNA, 15 bp, Homo sapiens
cattaatttcaatac

SEQ ID NO: 76644 - DNA, 15 bp, Homo sapiens
tcattaatttcaata

SEQ ID NO: 76645 - DNA, 15 bp, Homo sapiens
ctcattaatttcaat

SEQ ID NO: 76646 - DNA, 15 bp, Homo sapiens
tctcattaatttcaa

SEQ ID NO: 76647 - DNA, 15 bp, Homo sapiens
ttctcattaatttca

SEQ ID NO: 76648 - DNA, 15 bp, Homo sapiens
tttctcattaatttc

SEQ ID NO: 76649 - DNA, 15 bp, Homo sapiens
ttttctcattaattt

SEQ ID NO: 76650 - DNA, 15 bp, Homo sapiens
attttctcattaatt

SEQ ID NO: 76651 - DNA, 15 bp, Homo sapiens
tattttctcattaat

SEQ ID NO: 76652 - DNA, 15 bp, Homo sapiens
atattttctcattaa

SEQ ID NO: 76653 - DNA, 15 bp, Homo sapiens
aatattttctcatta

SEQ ID NO: 76654 - DNA, 15 bp, Homo sapiens
taatattttctcatt

SEQ ID NO: 76655 - DNA, 15 bp, Homo sapiens
ataatattttctcat

SEQ ID NO: 76656 - DNA, 15 bp, Homo sapiens
aataatattttctca

SEQ ID NO: 76657 - DNA, 15 bp, Homo sapiens
aaataatattttctc

SEQ ID NO: 76658 - DNA, 15 bp, Homo sapiens
taaataatattttct

SEQ ID NO: 76659 - DNA, 15 bp, Homo sapiens
ctaaataatattttc

SEQ ID NO: 76660 - DNA, 15 bp, Homo sapiens
actaaataatatttt

SEQ ID NO: 76661 - DNA, 15 bp, Homo sapiens
gactaaataatattt

SEQ ID NO: 76662 - DNA, 15 bp, Homo sapiens
tgactaaataatatt

SEQ ID NO: 76663 - DNA, 15 bp, Homo sapiens
gtgactaaataatat

SEQ ID NO: 76664 - DNA, 15 bp, Homo sapiens
tgtgactaaataata

SEQ ID NO: 76665 - DNA, 15 bp, Homo sapiens
gtgtgactaaataat

SEQ ID NO: 76666 - DNA, 15 bp, Homo sapiens
ggtgtgactaaataa

SEQ ID NO: 76667 - DNA, 15 bp, Homo sapiens
aggtgtgactaaata

SEQ ID NO: 76668 - DNA, 15 bp, Homo sapiens
aaggtgtgactaaat

SEQ ID NO: 76669 - DNA, 15 bp, Homo sapiens
aaaggtgtgactaaa

SEQ ID NO: 76670 - DNA, 15 bp, Homo sapiens
caaaggtgtgactaa

SEQ ID NO: 76671 - DNA, 15 bp, Homo sapiens
tcaaaggtgtgacta

SEQ ID NO: 76672 - DNA, 15 bp, Homo sapiens
atcaaaggtgtgact

SEQ ID NO: 76673 - DNA, 15 bp, Homo sapiens
aatcaaaggtgtgac

SEQ ID NO: 76674 - DNA, 15 bp, Homo sapiens
aaatcaaaggtgtga

SEQ ID NO: 76675 - DNA, 15 bp, Homo sapiens
taaatcaaaggtgtg

SEQ ID NO: 76676 - DNA, 15 bp, Homo sapiens
ttaaatcaaaggtgt

SEQ ID NO: 76677 - DNA, 15 bp, Homo sapiens
gttaaatcaaaggtg

SEQ ID NO: 76678 - DNA, 15 bp, Homo sapiens
tgttaaatcaaaggt

SEQ ID NO: 76679 - DNA, 15 bp, Homo sapiens
gtgttaaatcaaagg

SEQ ID NO: 76680 - DNA, 15 bp, Homo sapiens
agtgttaaatcaaag

SEQ ID NO: 76681 - DNA, 15 bp, Homo sapiens
cagtgttaaatcaaa

SEQ ID NO: 76682 - DNA, 15 bp, Homo sapiens
ccagtgttaaatcaa

SEQ ID NO: 76683 - DNA, 15 bp, Homo sapiens
tccagtgttaaatca

SEQ ID NO: 76684 - DNA, 15 bp, Homo sapiens
atccagtgttaaatc

SEQ ID NO: 76685 - DNA, 15 bp, Homo sapiens
aatccagtgttaaat

SEQ ID NO: 76686 - DNA, 15 bp, Homo sapiens
taatccagtgttaaa

SEQ ID NO: 76687 - DNA, 15 bp, Homo sapiens
ttaatccagtgttaa

SEQ ID NO: 76688 - DNA, 15 bp, Homo sapiens
attaatccagtgtta

SEQ ID NO: 76689 - DNA, 15 bp, Homo sapiens
aattaatccagtgtt

SEQ ID NO: 76690 - DNA, 15 bp, Homo sapiens
caattaatccagtgt

SEQ ID NO: 76691 - DNA, 15 bp, Homo sapiens
gcaattaatccagtg

SEQ ID NO: 76692 - DNA, 15 bp, Homo sapiens
tgcaattaatccagt

SEQ ID NO: 76693 - DNA, 15 bp, Homo sapiens
atgcaattaatccag

SEQ ID NO: 76694 - DNA, 15 bp, Homo sapiens
tatgcaattaatcca

SEQ ID NO: 76695 - DNA, 15 bp, Homo sapiens
atatgcaattaatcc

SEQ ID NO: 76696 - DNA, 15 bp, Homo sapiens
aatatgcaattaatc

SEQ ID NO: 76697 - DNA, 15 bp, Homo sapiens
aaatatgcaattaat

SEQ ID NO: 76698 - DNA, 15 bp, Homo sapiens
aaaatatgcaattaa

SEQ ID NO: 76699 - DNA, 15 bp, Homo sapiens
aaaaatatgcaatta

SEQ ID NO: 76700 - DNA, 15 bp, Homo sapiens
aaaaaatatgcaatt

SEQ ID NO: 76701 - DNA, 15 bp, Homo sapiens
gaaaaaatatgcaat

SEQ ID NO: 76702 - DNA, 15 bp, Homo sapiens
ggaaaaaatatgcaa

SEQ ID NO: 76703 - DNA, 15 bp, Homo sapiens
tggaaaaaatatgca

SEQ ID NO: 76704 - DNA, 15 bp, Homo sapiens
gtggaaaaaatatgc

SEQ ID NO: 76705 - DNA, 15 bp, Homo sapiens
agtggaaaaaatatg

SEQ ID NO: 76706 - DNA, 15 bp, Homo sapiens
tagtggaaaaaatat

SEQ ID NO: 76707 - DNA, 15 bp, Homo sapiens
ttagtggaaaaaata

SEQ ID NO: 76708 - DNA, 15 bp, Homo sapiens
cttagtggaaaaaat

SEQ ID NO: 76709 - DNA, 15 bp, Homo sapiens
acttagtggaaaaaa

SEQ ID NO: 76710 - DNA, 15 bp, Homo sapiens
cacttagtggaaaaa

SEQ ID NO: 76711 - DNA, 15 bp, Homo sapiens
acacttagtggaaaa

SEQ ID NO: 76712 - DNA, 15 bp, Homo sapiens
aacacttagtggaaa

SEQ ID NO: 76713 - DNA, 15 bp, Homo sapiens
taacacttagtggaa

SEQ ID NO: 76714 - DNA, 15 bp, Homo sapiens
ataacacttagtgga

SEQ ID NO: 76715 - DNA, 15 bp, Homo sapiens
gataacacttagtgg

SEQ ID NO: 76716 - DNA, 15 bp, Homo sapiens
tgataacacttagtg

SEQ ID NO: 76717 - DNA, 15 bp, Homo sapiens
gtgataacacttagt

SEQ ID NO: 76718 - DNA, 15 bp, Homo sapiens
tgtgataacacttag

SEQ ID NO: 76719 - DNA, 15 bp, Homo sapiens
ctgtgataacactta

SEQ ID NO: 76720 - DNA, 15 bp, Homo sapiens
gctgtgataacactt

SEQ ID NO: 76721 - DNA, 15 bp, Homo sapiens
tgctgtgataacact

SEQ ID NO: 76722 - DNA, 15 bp, Homo sapiens
ttgctgtgataacac

SEQ ID NO: 76723 - DNA, 15 bp, Homo sapiens
tttgctgtgataaca

SEQ ID NO: 76724 - DNA, 15 bp, Homo sapiens
atttgctgtgataac

SEQ ID NO: 76725 - DNA, 15 bp, Homo sapiens
catttgctgtgataa

SEQ ID NO: 76726 - DNA, 15 bp, Homo sapiens
tcatttgctgtgata

SEQ ID NO: 76727 - DNA, 15 bp, Homo sapiens
ttcatttgctgtgat

SEQ ID NO: 76728 - DNA, 15 bp, Homo sapiens
attcatttgctgtga

SEQ ID NO: 76729 - DNA, 15 bp, Homo sapiens
gattcatttgctgtg

SEQ ID NO: 76730 - DNA, 15 bp, Homo sapiens
agattcatttgctgt

SEQ ID NO: 76731 - DNA, 15 bp, Homo sapiens
cagattcatttgctg

SEQ ID NO: 76732 - DNA, 15 bp, Homo sapiens
acagattcatttgct

SEQ ID NO: 76733 - DNA, 15 bp, Homo sapiens
aacagattcatttgc

SEQ ID NO: 76734 - DNA, 15 bp, Homo sapiens
caacagattcatttg

SEQ ID NO: 76735 - DNA, 15 bp, Homo sapiens
acaacagattcattt

SEQ ID NO: 76736 - DNA, 15 bp, Homo sapiens
tacaacagattcatt

SEQ ID NO: 76737 - DNA, 15 bp, Homo sapiens
gtacaacagattcat

SEQ ID NO: 76738 - DNA, 15 bp, Homo sapiens
tgtacaacagattca

SEQ ID NO: 76739 - DNA, 15 bp, Homo sapiens
ttgtacaacagattc

SEQ ID NO: 76740 - DNA, 15 bp, Homo sapiens
tttgtacaacagatt

SEQ ID NO: 76741 - DNA, 15 bp, Homo sapiens
ctttgtacaacagat

SEQ ID NO: 76742 - DNA, 15 bp, Homo sapiens
gctttgtacaacaga

SEQ ID NO: 76743 - DNA, 15 bp, Homo sapiens
agctttgtacaacag

SEQ ID NO: 76744 - DNA, 15 bp, Homo sapiens
cagctttgtacaaca

SEQ ID NO: 76745 - DNA, 15 bp, Homo sapiens
gcagctttgtacaac

SEQ ID NO: 76746 - DNA, 15 bp, Homo sapiens
ggcagctttgtacaa

SEQ ID NO: 76747 - DNA, 15 bp, Homo sapiens
tggcagctttgtaca

SEQ ID NO: 76748 - DNA, 15 bp, Homo sapiens
gtggcagctttgtac

SEQ ID NO: 76749 - DNA, 15 bp, Homo sapiens
ggtggcagctttgta

SEQ ID NO: 76750 - DNA, 15 bp, Homo sapiens
aggtggcagctttgt

SEQ ID NO: 76751 - DNA, 15 bp, Homo sapiens
aaggtggcagctttg

SEQ ID NO: 76752 - DNA, 15 bp, Homo sapiens
taaggtggcagcttt

SEQ ID NO: 76753 - DNA, 15 bp, Homo sapiens
ttaaggtggcagctt

SEQ ID NO: 76754 - DNA, 15 bp, Homo sapiens
attaaggtggcagct

SEQ ID NO: 76755 - DNA, 15 bp, Homo sapiens
aattaaggtggcagc

SEQ ID NO: 76756 - DNA, 15 bp, Homo sapiens
aaattaaggtggcag

SEQ ID NO: 76757 - DNA, 15 bp, Homo sapiens
aaaattaaggtggca

SEQ ID NO: 76758 - DNA, 15 bp, Homo sapiens
aaaaattaaggtggc

SEQ ID NO: 76759 - DNA, 15 bp, Homo sapiens
gaaaaattaaggtgg

SEQ ID NO: 76760 - DNA, 15 bp, Homo sapiens
tgaaaaattaaggtg

SEQ ID NO: 76761 - DNA, 15 bp, Homo sapiens
ttgaaaaattaaggt

SEQ ID NO: 76762 - DNA, 15 bp, Homo sapiens
attgaaaaattaagg

SEQ ID NO: 76763 - DNA, 15 bp, Homo sapiens
tattgaaaaattaag

SEQ ID NO: 76764 - DNA, 15 bp, Homo sapiens
ctattgaaaaattaa

SEQ ID NO: 76765 - DNA, 15 bp, Homo sapiens
cctattgaaaaatta

SEQ ID NO: 76766 - DNA, 15 bp, Homo sapiens
tcctattgaaaaatt

SEQ ID NO: 76767 - DNA, 15 bp, Homo sapiens
gtcctattgaaaaat

SEQ ID NO: 76768 - DNA, 15 bp, Homo sapiens
agtcctattgaaaaa

SEQ ID NO: 76769 - DNA, 15 bp, Homo sapiens
cagtcctattgaaaa

SEQ ID NO: 76770 - DNA, 15 bp, Homo sapiens
ccagtcctattgaaa

SEQ ID NO: 76771 - DNA, 15 bp, Homo sapiens
accagtcctattgaa

SEQ ID NO: 76772 - DNA, 15 bp, Homo sapiens
caccagtcctattga

SEQ ID NO: 76773 - DNA, 15 bp, Homo sapiens
ccaccagtcctattg

SEQ ID NO: 76774 - DNA, 15 bp, Homo sapiens
gccaccagtcctatt

SEQ ID NO: 76775 - DNA, 15 bp, Homo sapiens
agccaccagtcctat

SEQ ID NO: 76776 - DNA, 15 bp, Homo sapiens
gagccaccagtccta

SEQ ID NO: 76777 - DNA, 15 bp, Homo sapiens
agagccaccagtcct

SEQ ID NO: 76778 - DNA, 15 bp, Homo sapiens
aagagccaccagtcc

SEQ ID NO: 76779 - DNA, 15 bp, Homo sapiens
aaagagccaccagtc

SEQ ID NO: 76780 - DNA, 15 bp, Homo sapiens
caaagagccaccagt

SEQ ID NO: 76781 - DNA, 15 bp, Homo sapiens
gcaaagagccaccag

SEQ ID NO: 76782 - DNA, 15 bp, Homo sapiens
ggcaaagagccacca

SEQ ID NO: 76783 - DNA, 15 bp, Homo sapiens
aggcaaagagccacc

SEQ ID NO: 76784 - DNA, 15 bp, Homo sapiens
caggcaaagagccac

SEQ ID NO: 76785 - DNA, 15 bp, Homo sapiens
acaggcaaagagcca

SEQ ID NO: 76786 - DNA, 15 bp, Homo sapiens
aacaggcaaagagcc

SEQ ID NO: 76787 - DNA, 15 bp, Homo sapiens
gaacaggcaaagagc

SEQ ID NO: 76788 - DNA, 15 bp, Homo sapiens
agaacaggcaaagag

SEQ ID NO: 76789 - DNA, 15 bp, Homo sapiens
gagaacaggcaaaga

SEQ ID NO: 76790 - DNA, 15 bp, Homo sapiens
agagaacaggcaaag

SEQ ID NO: 76791 - DNA, 15 bp, Homo sapiens
cagagaacaggcaaa

SEQ ID NO: 76792 - DNA, 15 bp, Homo sapiens
acagagaacaggcaa

SEQ ID NO: 76793 - DNA, 15 bp, Homo sapiens
gacagagaacaggca

SEQ ID NO: 76794 - DNA, 15 bp, Homo sapiens
agacagagaacaggc

SEQ ID NO: 76795 - DNA, 15 bp, Homo sapiens
aagacagagaacagg

SEQ ID NO: 76796 - DNA, 15 bp, Homo sapiens
aaagacagagaacag

SEQ ID NO: 76797 - DNA, 15 bp, Homo sapiens
gaaagacagagaaca

SEQ ID NO: 76798 - DNA, 15 bp, Homo sapiens
ggaaagacagagaac

SEQ ID NO: 76799 - DNA, 15 bp, Homo sapiens
tggaaagacagagaa

SEQ ID NO: 76800 - DNA, 15 bp, Homo sapiens
ctggaaagacagaga

SEQ ID NO: 76801 - DNA, 15 bp, Homo sapiens
tctggaaagacagag

SEQ ID NO: 76802 - DNA, 15 bp, Homo sapiens
ttctggaaagacaga

SEQ ID NO: 76803 - DNA, 15 bp, Homo sapiens
tttctggaaagacag

SEQ ID NO: 76804 - DNA, 15 bp, Homo sapiens
ttttctggaaagaca

SEQ ID NO: 76805 - DNA, 15 bp, Homo sapiens
cttttctggaaagac

SEQ ID NO: 76806 - DNA, 15 bp, Homo sapiens
gcttttctggaaaga

SEQ ID NO: 76807 - DNA, 15 bp, Homo sapiens
tgcttttctggaaag

SEQ ID NO: 76808 - DNA, 15 bp, Homo sapiens
ttgcttttctggaaa

SEQ ID NO: 76809 - DNA, 15 bp, Homo sapiens
gttgcttttctggaa

SEQ ID NO: 76810 - DNA, 15 bp, Homo sapiens
ggttgcttttctgga

SEQ ID NO: 76811 - DNA, 15 bp, Homo sapiens
tggttgcttttctgg

SEQ ID NO: 76812 - DNA, 15 bp, Homo sapiens
atggttgcttttctg

SEQ ID NO: 76813 - DNA, 15 bp, Homo sapiens
aatggttgcttttct

SEQ ID NO: 76814 - DNA, 15 bp, Homo sapiens
caatggttgcttttc

SEQ ID NO: 76815 - DNA, 15 bp, Homo sapiens
tcaatggttgctttt

SEQ ID NO: 76816 - DNA, 15 bp, Homo sapiens
ttcaatggttgcttt

SEQ ID NO: 76817 - DNA, 15 bp, Homo sapiens
tttcaatggttgctt

SEQ ID NO: 76818 - DNA, 15 bp, Homo sapiens
gtttcaatggttgct

SEQ ID NO: 76819 - DNA, 15 bp, Homo sapiens
tgtttcaatggttgc

SEQ ID NO: 76820 - DNA, 15 bp, Homo sapiens
ttgtttcaatggttg

SEQ ID NO: 76821 - DNA, 15 bp, Homo sapiens
tttgtttcaatggtt

SEQ ID NO: 76822 - DNA, 15 bp, Homo sapiens
ttttgtttcaatggt

SEQ ID NO: 76823 - DNA, 15 bp, Homo sapiens
attttgtttcaatgg

SEQ ID NO: 76824 - DNA, 15 bp, Homo sapiens
tattttgtttcaatg

SEQ ID NO: 76825 - DNA, 15 bp, Homo sapiens
gtattttgtttcaat

SEQ ID NO: 76826 - DNA, 15 bp, Homo sapiens
tgtattttgtttcaa

SEQ ID NO: 76827 - DNA, 15 bp, Homo sapiens
ttgtattttgtttca

SEQ ID NO: 76828 - DNA, 15 bp, Homo sapiens
tttgtattttgtttc

SEQ ID NO: 76829 - DNA, 15 bp, Homo sapiens
atttgtattttgttt

SEQ ID NO: 76830 - DNA, 15 bp, Homo sapiens
tatttgtattttgtt

SEQ ID NO: 76831 - DNA, 15 bp, Homo sapiens
ttatttgtattttgt

SEQ ID NO: 76832 - DNA, 15 bp, Homo sapiens
tttatttgtattttg

SEQ ID NO: 76833 - DNA, 15 bp, Homo sapiens
gtttatttgtatttt

SEQ ID NO: 76834 - DNA, 15 bp, Homo sapiens
tgtttatttgtattt

SEQ ID NO: 76835 - DNA, 15 bp, Homo sapiens
ttgtttatttgtatt

SEQ ID NO: 76836 - DNA, 15 bp, Homo sapiens
tttgtttatttgtat

SEQ ID NO: 76837 - DNA, 15 bp, Homo sapiens
ttttgtttatttgta

SEQ ID NO: 76838 - DNA, 15 bp, Homo sapiens
gttttgtttatttgt

SEQ ID NO: 76839 - DNA, 15 bp, Homo sapiens
agttttgtttatttg

SEQ ID NO: 76840 - DNA, 15 bp, Homo sapiens
aagttttgtttattt

SEQ ID NO: 76841 - DNA, 15 bp, Homo sapiens
aaagttttgtttatt

SEQ ID NO: 76842 - DNA, 15 bp, Homo sapiens
aaaagttttgtttat

SEQ ID NO: 76843 - DNA, 15 bp, Homo sapiens
gaaaagttttgttta

SEQ ID NO: 76844 - DNA, 15 bp, Homo sapiens
agaaaagttttgttt

SEQ ID NO: 76845 - DNA, 15 bp, Homo sapiens
gagaaaagttttgtt

SEQ ID NO: 76846 - DNA, 15 bp, Homo sapiens
ggagaaaagttttgt

SEQ ID NO: 76847 - DNA, 15 bp, Homo sapiens
gggagaaaagttttg

SEQ ID NO: 76848 - DNA, 15 bp, Homo sapiens
ggggagaaaagtttt

SEQ ID NO: 76849 - DNA, 15 bp, Homo sapiens
tggggagaaaagttt

SEQ ID NO: 76850 - DNA, 15 bp, Homo sapiens
ttggggagaaaagtt

SEQ ID NO: 76851 - DNA, 15 bp, Homo sapiens
tttggggagaaaagt

SEQ ID NO: 76852 - DNA, 15 bp, Homo sapiens
atttggggagaaaag

SEQ ID NO: 76853 - DNA, 15 bp, Homo sapiens
catttggggagaaaa

SEQ ID NO: 76854 - DNA, 15 bp, Homo sapiens
gcatttggggagaaa

SEQ ID NO: 76855 - DNA, 15 bp, Homo sapiens
ggcatttggggagaa

SEQ ID NO: 76856 - DNA, 15 bp, Homo sapiens
tggcatttggggaga

SEQ ID NO: 76857 - DNA, 15 bp, Homo sapiens
ttggcatttggggag

SEQ ID NO: 76858 - DNA, 15 bp, Homo sapiens
tttggcatttgggga

SEQ ID NO: 76859 - DNA, 15 bp, Homo sapiens
gtttggcatttgggg

SEQ ID NO: 76860 - DNA, 15 bp, Homo sapiens
tgtttggcatttggg

SEQ ID NO: 76861 - DNA, 15 bp, Homo sapiens
ctgtttggcatttgg

SEQ ID NO: 76862 - DNA, 15 bp, Homo sapiens
actgtttggcatttg

SEQ ID NO: 76863 - DNA, 15 bp, Homo sapiens
aactgtttggcattt

SEQ ID NO: 76864 - DNA, 15 bp, Homo sapiens
caactgtttggcatt

SEQ ID NO: 76865 - DNA, 15 bp, Homo sapiens
acaactgtttggcat

SEQ ID NO: 76866 - DNA, 15 bp, Homo sapiens
cacaactgtttggca

SEQ ID NO: 76867 - DNA, 15 bp, Homo sapiens
ccacaactgtttggc

SEQ ID NO: 76868 - DNA, 15 bp, Homo sapiens
accacaactgtttgg

SEQ ID NO: 76869 - DNA, 15 bp, Homo sapiens
aaccacaactgtttg

SEQ ID NO: 76870 - DNA, 15 bp, Homo sapiens
aaaccacaactgttt

SEQ ID NO: 76871 - DNA, 15 bp, Homo sapiens
taaaccacaactgtt

SEQ ID NO: 76872 - DNA, 15 bp, Homo sapiens
ttaaaccacaactgt

SEQ ID NO: 76873 - DNA, 15 bp, Homo sapiens
tttaaaccacaactg

SEQ ID NO: 76874 - DNA, 15 bp, Homo sapiens
ttttaaaccacaact

SEQ ID NO: 76875 - DNA, 15 bp, Homo sapiens
tttttaaaccacaac

SEQ ID NO: 76876 - DNA, 15 bp, Homo sapiens
ttttttaaaccacaa

SEQ ID NO: 76877 - DNA, 15 bp, Homo sapiens
attttttaaaccaca

SEQ ID NO: 76878 - DNA, 15 bp, Homo sapiens
tattttttaaaccac

SEQ ID NO: 76879 - DNA, 15 bp, Homo sapiens
ttattttttaaacca

SEQ ID NO: 76880 - DNA, 15 bp, Homo sapiens
cttattttttaaacc

SEQ ID NO: 76881 - DNA, 15 bp, Homo sapiens
acttattttttaaac

SEQ ID NO: 76882 - DNA, 15 bp, Homo sapiens
tacttattttttaaa

SEQ ID NO: 76883 - DNA, 15 bp, Homo sapiens
ctacttattttttaa

SEQ ID NO: 76884 - DNA, 15 bp, Homo sapiens
tctacttatttttta

SEQ ID NO: 76885 - DNA, 15 bp, Homo sapiens
atctacttatttttt

SEQ ID NO: 76886 - DNA, 15 bp, Homo sapiens
tatctacttattttt

SEQ ID NO: 76887 - DNA, 15 bp, Homo sapiens
gtatctacttatttt

SEQ ID NO: 76888 - DNA, 15 bp, Homo sapiens
agtatctacttattt

SEQ ID NO: 76889 - DNA, 15 bp, Homo sapiens
cagtatctacttatt

SEQ ID NO: 76890 - DNA, 15 bp, Homo sapiens
ccagtatctacttat

SEQ ID NO: 76891 - DNA, 15 bp, Homo sapiens
gccagtatctactta

SEQ ID NO: 76892 - DNA, 15 bp, Homo sapiens
ggccagtatctactt

SEQ ID NO: 76893 - DNA, 15 bp, Homo sapiens
cggccagtatctact

SEQ ID NO: 76894 - DNA, 15 bp, Homo sapiens
ccggccagtatctac

SEQ ID NO: 76895 - DNA, 15 bp, Homo sapiens
cccggccagtatcta

SEQ ID NO: 76896 - DNA, 15 bp, Homo sapiens
gcccggccagtatct

SEQ ID NO: 76897 - DNA, 15 bp, Homo sapiens
tgcccggccagtatc

SEQ ID NO: 76898 - DNA, 15 bp, Homo sapiens
ctgcccggccagtat

SEQ ID NO: 76899 - DNA, 15 bp, Homo sapiens
cctgcccggccagta

SEQ ID NO: 76900 - DNA, 15 bp, Homo sapiens
ccctgcccggccagt

SEQ ID NO: 76901 - DNA, 15 bp, Homo sapiens
accctgcccggccag

SEQ ID NO: 76902 - DNA, 15 bp, Homo sapiens
caccctgcccggcca

SEQ ID NO: 76903 - DNA, 15 bp, Homo sapiens
ccaccctgcccggcc

SEQ ID NO: 76904 - DNA, 15 bp, Homo sapiens
gccaccctgcccggc

SEQ ID NO: 76905 - DNA, 15 bp, Homo sapiens
agccaccctgcccgg

SEQ ID NO: 76906 - DNA, 15 bp, Homo sapiens
gagccaccctgcccg

SEQ ID NO: 76907 - DNA, 15 bp, Homo sapiens
tgagccaccctgccc

SEQ ID NO: 76908 - DNA, 15 bp, Homo sapiens
gtgagccaccctgcc

SEQ ID NO: 76909 - DNA, 15 bp, Homo sapiens
cgtgagccaccctgc

SEQ ID NO: 76910 - DNA, 15 bp, Homo sapiens
gcgtgagccaccctg

SEQ ID NO: 76911 - DNA, 15 bp, Homo sapiens
ggcgtgagccaccct

SEQ ID NO: 76912 - DNA, 15 bp, Homo sapiens
cacctgcctcagcct

SEQ ID NO: 76913 - DNA, 15 bp, Homo sapiens
ccacctgcctcagcc

SEQ ID NO: 76914 - DNA, 15 bp, Homo sapiens
tccacctgcctcagc

SEQ ID NO: 76915 - DNA, 15 bp, Homo sapiens
atccacctgcctcag

SEQ ID NO: 76916 - DNA, 15 bp, Homo sapiens
gatccacctgcctca

SEQ ID NO: 76917 - DNA, 15 bp, Homo sapiens
agtgatccacctgcc

SEQ ID NO: 76918 - DNA, 15 bp, Homo sapiens
aagtgatccacctgc

SEQ ID NO: 76919 - DNA, 15 bp, Homo sapiens
caagtgatccacctg

SEQ ID NO: 76920 - DNA, 15 bp, Homo sapiens
tcaagtgatccacct

SEQ ID NO: 76921 - DNA, 15 bp, Homo sapiens
ttcaagtgatccacc

SEQ ID NO: 76922 - DNA, 15 bp, Homo sapiens
cttcaagtgatccac

SEQ ID NO: 76923 - DNA, 15 bp, Homo sapiens
acttcaagtgatcca

SEQ ID NO: 76924 - DNA, 15 bp, Homo sapiens
gacttcaagtgatcc

SEQ ID NO: 76925 - DNA, 15 bp, Homo sapiens
tgacttcaagtgatc

SEQ ID NO: 76926 - DNA, 15 bp, Homo sapiens
ctgacttcaagtgat

SEQ ID NO: 76927 - DNA, 15 bp, Homo sapiens
cctgacttcaagtga

SEQ ID NO: 76928 - DNA, 15 bp, Homo sapiens
tcctgacttcaagtg

SEQ ID NO: 76929 - DNA, 15 bp, Homo sapiens
ctcctgacttcaagt

SEQ ID NO: 76930 - DNA, 15 bp, Homo sapiens
actcctgacttcaag

SEQ ID NO: 76931 - DNA, 15 bp, Homo sapiens
aactcctgacttcaa

SEQ ID NO: 76932 - DNA, 15 bp, Homo sapiens
gaactcctgacttca

SEQ ID NO: 76933 - DNA, 15 bp, Homo sapiens
tgaactcctgacttc

SEQ ID NO: 76934 - DNA, 15 bp, Homo sapiens
ttgaactcctgactt

SEQ ID NO: 76935 - DNA, 15 bp, Homo sapiens
cttgaactcctgact

SEQ ID NO: 76936 - DNA, 15 bp, Homo sapiens
agtcttgaactcctg

SEQ ID NO: 76937 - DNA, 15 bp, Homo sapiens
tagtcttgaactcct

SEQ ID NO: 76938 - DNA, 15 bp, Homo sapiens
ctagtcttgaactcc

SEQ ID NO: 76939 - DNA, 15 bp, Homo sapiens
gctagtcttgaactc

SEQ ID NO: 76940 - DNA, 15 bp, Homo sapiens
ggctagtcttgaact

SEQ ID NO: 76941 - DNA, 15 bp, Homo sapiens
gggctagtcttgaac

SEQ ID NO: 76942 - DNA, 15 bp, Homo sapiens
cgggctagtcttgaa

SEQ ID NO: 76943 - DNA, 15 bp, Homo sapiens
ccgggctagtcttga

SEQ ID NO: 76944 - DNA, 15 bp, Homo sapiens
gccgggctagtcttg

SEQ ID NO: 76945 - DNA, 15 bp, Homo sapiens
ggccgggctagtctt

SEQ ID NO: 76946 - DNA, 15 bp, Homo sapiens
tggccgggctagtct

SEQ ID NO: 76947 - DNA, 15 bp, Homo sapiens
ttggccgggctagtc

SEQ ID NO: 76948 - DNA, 15 bp, Homo sapiens
gttggccgggctagt

SEQ ID NO: 76949 - DNA, 15 bp, Homo sapiens
tgttggccgggctag

SEQ ID NO: 76950 - DNA, 15 bp, Homo sapiens
atgttggccgggcta

SEQ ID NO: 76951 - DNA, 15 bp, Homo sapiens
tatgttggccgggct

SEQ ID NO: 76952 - DNA, 15 bp, Homo sapiens
ctatgttggccgggc

SEQ ID NO: 76953 - DNA, 15 bp, Homo sapiens
actatgttggccggg

SEQ ID NO: 76954 - DNA, 15 bp, Homo sapiens
cactatgttggccgg

SEQ ID NO: 76955 - DNA, 15 bp, Homo sapiens
tcactatgttggccg

SEQ ID NO: 76956 - DNA, 15 bp, Homo sapiens
cggggtttcactatg

SEQ ID NO: 76957 - DNA, 15 bp, Homo sapiens
acggggtttcactat

SEQ ID NO: 76958 - DNA, 15 bp, Homo sapiens
gacggggtttcacta

SEQ ID NO: 76959 - DNA, 15 bp, Homo sapiens
agacggggtttcact

SEQ ID NO: 76960 - DNA, 15 bp, Homo sapiens
ggagacggggtttca

SEQ ID NO: 76961 - DNA, 15 bp, Homo sapiens
agtggagacggggtt

SEQ ID NO: 76962 - DNA, 15 bp, Homo sapiens
tagtggagacggggt

SEQ ID NO: 76963 - DNA, 15 bp, Homo sapiens
ttagtggagacgggg

SEQ ID NO: 76964 - DNA, 15 bp, Homo sapiens
tttagtggagacggg

SEQ ID NO: 76965 - DNA, 15 bp, Homo sapiens
ttttagtggagacgg

SEQ ID NO: 76966 - DNA, 15 bp, Homo sapiens
tttttagtggagacg

SEQ ID NO: 76967 - DNA, 15 bp, Homo sapiens
atttttagtggagac

SEQ ID NO: 76968 - DNA, 15 bp, Homo sapiens
tatttttagtggaga

SEQ ID NO: 76969 - DNA, 15 bp, Homo sapiens
atatttttagtggag

SEQ ID NO: 76970 - DNA, 15 bp, Homo sapiens
tatatttttagtgga

SEQ ID NO: 76971 - DNA, 15 bp, Homo sapiens
ttatatttttagtgg

SEQ ID NO: 76972 - DNA, 15 bp, Homo sapiens
tttatatttttagtg

SEQ ID NO: 76973 - DNA, 15 bp, Homo sapiens
tatttttatattttt

SEQ ID NO: 76974 - DNA, 15 bp, Homo sapiens
ttatttttatatttt

SEQ ID NO: 76975 - DNA, 15 bp, Homo sapiens
cttatttttatattt

SEQ ID NO: 76976 - DNA, 15 bp, Homo sapiens
gcttatttttatatt

SEQ ID NO: 76977 - DNA, 15 bp, Homo sapiens
ggcttatttttatat

SEQ ID NO: 76978 - DNA, 15 bp, Homo sapiens
tggcttatttttata

SEQ ID NO: 76979 - DNA, 15 bp, Homo sapiens
ctggcttatttttat

SEQ ID NO: 76980 - DNA, 15 bp, Homo sapiens
cctggcttattttta

SEQ ID NO: 76981 - DNA, 15 bp, Homo sapiens
acctggcttattttt

SEQ ID NO: 76982 - DNA, 15 bp, Homo sapiens
cacctggcttatttt

SEQ ID NO: 76983 - DNA, 15 bp, Homo sapiens
acacctggcttattt

SEQ ID NO: 76984 - DNA, 15 bp, Homo sapiens
cacacctggcttatt

SEQ ID NO: 76985 - DNA, 15 bp, Homo sapiens
ccacacctggcttat

SEQ ID NO: 76986 - DNA, 15 bp, Homo sapiens
gccacacctggctta

SEQ ID NO: 76987 - DNA, 15 bp, Homo sapiens
cgccacacctggctt

SEQ ID NO: 76988 - DNA, 15 bp, Homo sapiens
ccgccacacctggct

SEQ ID NO: 76989 - DNA, 15 bp, Homo sapiens
accgccacacctggc

SEQ ID NO: 76990 - DNA, 15 bp, Homo sapiens
caccgccacacctgg

SEQ ID NO: 76991 - DNA, 15 bp, Homo sapiens
ccaccgccacacctg

SEQ ID NO: 76992 - DNA, 15 bp, Homo sapiens
cccaccgccacacct

SEQ ID NO: 76993 - DNA, 15 bp, Homo sapiens
acccaccgccacacc

SEQ ID NO: 76994 - DNA, 15 bp, Homo sapiens
cacccaccgccacac

SEQ ID NO: 76995 - DNA, 15 bp, Homo sapiens
gcacccaccgccaca

SEQ ID NO: 76996 - DNA, 15 bp, Homo sapiens
ggcacccaccgccac

SEQ ID NO: 76997 - DNA, 15 bp, Homo sapiens
aggcacccaccgcca

SEQ ID NO: 76998 - DNA, 15 bp, Homo sapiens
caggcacccaccgcc

SEQ ID NO: 76999 - DNA, 15 bp, Homo sapiens
acaggcacccaccgc

SEQ ID NO: 77000 - DNA, 15 bp, Homo sapiens
tacaggcacccaccg

SEQ ID NO: 77001 - DNA, 15 bp, Homo sapiens
ttacaggcacccacc

SEQ ID NO: 77002 - DNA, 15 bp, Homo sapiens
attacaggcacccac

SEQ ID NO: 77003 - DNA, 15 bp, Homo sapiens
gattacaggcaccca

SEQ ID NO: 77004 - DNA, 15 bp, Homo sapiens
ggattacaggcaccc

SEQ ID NO: 77005 - DNA, 15 bp, Homo sapiens
cagcaattctcctgc

SEQ ID NO: 77006 - DNA, 15 bp, Homo sapiens
ccagcaattctcctg

SEQ ID NO: 77007 - DNA, 15 bp, Homo sapiens
tccagcaattctcct

SEQ ID NO: 77008 - DNA, 15 bp, Homo sapiens
ttccagcaattctcc

SEQ ID NO: 77009 - DNA, 15 bp, Homo sapiens
gttccagcaattctc

SEQ ID NO: 77010 - DNA, 15 bp, Homo sapiens
ggttccagcaattct

SEQ ID NO: 77011 - DNA, 15 bp, Homo sapiens
gggttccagcaattc

SEQ ID NO: 77012 - DNA, 15 bp, Homo sapiens
tgggttccagcaatt

SEQ ID NO: 77013 - DNA, 15 bp, Homo sapiens
ctgggttccagcaat

SEQ ID NO: 77014 - DNA, 15 bp, Homo sapiens
cctgggttccagcaa

SEQ ID NO: 77015 - DNA, 15 bp, Homo sapiens
tcctgggttccagca

SEQ ID NO: 77016 - DNA, 15 bp, Homo sapiens
ctcctgggttccagc

SEQ ID NO: 77017 - DNA, 15 bp, Homo sapiens
cctcctgggttccag

SEQ ID NO: 77018 - DNA, 15 bp, Homo sapiens
gcctcctgggttcca

SEQ ID NO: 77019 - DNA, 15 bp, Homo sapiens
tgcctcctgggttcc

SEQ ID NO: 77020 - DNA, 15 bp, Homo sapiens
gtctcggctcactgc

SEQ ID NO: 77021 - DNA, 15 bp, Homo sapiens
agtctcggctcactg

SEQ ID NO: 77022 - DNA, 15 bp, Homo sapiens
cagtctcggctcact

SEQ ID NO: 77023 - DNA, 15 bp, Homo sapiens
acagtctcggctcac

SEQ ID NO: 77024 - DNA, 15 bp, Homo sapiens
cacagtctcggctca

SEQ ID NO: 77025 - DNA, 15 bp, Homo sapiens
gcacagtctcggctc

SEQ ID NO: 77026 - DNA, 15 bp, Homo sapiens
ggcacagtctcggct

SEQ ID NO: 77027 - DNA, 15 bp, Homo sapiens
tggcacagtctcggc

SEQ ID NO: 77028 - DNA, 15 bp, Homo sapiens
gtggcacagtctcgg

SEQ ID NO: 77029 - DNA, 15 bp, Homo sapiens
agtggcacagtctcg

SEQ ID NO: 77030 - DNA, 15 bp, Homo sapiens
cagtggcacagtctc

SEQ ID NO: 77031 - DNA, 15 bp, Homo sapiens
gcagtggcacagtct

SEQ ID NO: 77032 - DNA, 15 bp, Homo sapiens
tgcagtggcacagtc

SEQ ID NO: 77033 - DNA, 15 bp, Homo sapiens
gtgcagtggcacagt

SEQ ID NO: 77034 - DNA, 15 bp, Homo sapiens
agtgcagtggcacag

SEQ ID NO: 77035 - DNA, 15 bp, Homo sapiens
ttgtctcccaggctg

SEQ ID NO: 77036 - DNA, 15 bp, Homo sapiens
cttgtctcccaggct

SEQ ID NO: 77037 - DNA, 15 bp, Homo sapiens
tcttgtctcccaggc

SEQ ID NO: 77038 - DNA, 15 bp, Homo sapiens
ctcttgtctcccagg

SEQ ID NO: 77039 - DNA, 15 bp, Homo sapiens
gctcttgtctcccag

SEQ ID NO: 77040 - DNA, 15 bp, Homo sapiens
cgctcttgtctccca

SEQ ID NO: 77041 - DNA, 15 bp, Homo sapiens
tcgctcttgtctccc

SEQ ID NO: 77042 - DNA, 15 bp, Homo sapiens
ctcgctcttgtctcc

SEQ ID NO: 77043 - DNA, 15 bp, Homo sapiens
tctcgctcttgtctc

SEQ ID NO: 77044 - DNA, 15 bp, Homo sapiens
gtctcgctcttgtct

SEQ ID NO: 77045 - DNA, 15 bp, Homo sapiens
agtctcgctcttgtc

SEQ ID NO: 77046 - DNA, 15 bp, Homo sapiens
gagtctcgctcttgt

SEQ ID NO: 77047 - DNA, 15 bp, Homo sapiens
ggagtctcgctcttg

SEQ ID NO: 77048 - DNA, 15 bp, Homo sapiens
gggagtctcgctctt

SEQ ID NO: 77049 - DNA, 15 bp, Homo sapiens
agggagtctcgctct

SEQ ID NO: 77050 - DNA, 15 bp, Homo sapiens
gagggagtctcgctc

SEQ ID NO: 77051 - DNA, 15 bp, Homo sapiens
agagggagtctcgct

SEQ ID NO: 77052 - DNA, 15 bp, Homo sapiens
gagagggagtctcgc

SEQ ID NO: 77053 - DNA, 15 bp, Homo sapiens
tgagagggagtctcg

SEQ ID NO: 77054 - DNA, 15 bp, Homo sapiens
ttgagagggagtctc

SEQ ID NO: 77055 - DNA, 15 bp, Homo sapiens
tttgctttttttttt

SEQ ID NO: 77056 - DNA, 15 bp, Homo sapiens
atttgcttttttttt

SEQ ID NO: 77057 - DNA, 15 bp, Homo sapiens
tatttgctttttttt

SEQ ID NO: 77058 - DNA, 15 bp, Homo sapiens
gtatttgcttttttt

SEQ ID NO: 77059 - DNA, 15 bp, Homo sapiens
agtatttgctttttt

SEQ ID NO: 77060 - DNA, 15 bp, Homo sapiens
gagtatttgcttttt

SEQ ID NO: 77061 - DNA, 15 bp, Homo sapiens
agagtatttgctttt

SEQ ID NO: 77062 - DNA, 15 bp, Homo sapiens
tagagtatttgcttt

SEQ ID NO: 77063 - DNA, 15 bp, Homo sapiens
atagagtatttgctt

SEQ ID NO: 77064 - DNA, 15 bp, Homo sapiens
aatagagtatttgct

SEQ ID NO: 77065 - DNA, 15 bp, Homo sapiens
gaatagagtatttgc

SEQ ID NO: 77066 - DNA, 15 bp, Homo sapiens
ggaatagagtatttg

SEQ ID NO: 77067 - DNA, 15 bp, Homo sapiens
gggaatagagtattt

SEQ ID NO: 77068 - DNA, 15 bp, Homo sapiens
tgggaatagagtatt

SEQ ID NO: 77069 - DNA, 15 bp, Homo sapiens
gtgggaatagagtat

SEQ ID NO: 77070 - DNA, 15 bp, Homo sapiens
tgtgggaatagagta

SEQ ID NO: 77071 - DNA, 15 bp, Homo sapiens
atgtgggaatagagt

SEQ ID NO: 77072 - DNA, 15 bp, Homo sapiens
gatgtgggaatagag

SEQ ID NO: 77073 - DNA, 15 bp, Homo sapiens
agatgtgggaataga

SEQ ID NO: 77074 - DNA, 15 bp, Homo sapiens
gagatgtgggaatag

SEQ ID NO: 77075 - DNA, 15 bp, Homo sapiens
agagatgtgggaata

SEQ ID NO: 77076 - DNA, 15 bp, Homo sapiens
gagagatgtgggaat

SEQ ID NO: 77077 - DNA, 15 bp, Homo sapiens
tgagagatgtgggaa

SEQ ID NO: 77078 - DNA, 15 bp, Homo sapiens
ctgagagatgtggga

SEQ ID NO: 77079 - DNA, 15 bp, Homo sapiens
actgagagatgtggg

SEQ ID NO: 77080 - DNA, 15 bp, Homo sapiens
cactgagagatgtgg

SEQ ID NO: 77081 - DNA, 15 bp, Homo sapiens
acactgagagatgtg

SEQ ID NO: 77082 - DNA, 15 bp, Homo sapiens
gacactgagagatgt

SEQ ID NO: 77083 - DNA, 15 bp, Homo sapiens
ggacactgagagatg

SEQ ID NO: 77084 - DNA, 15 bp, Homo sapiens
tggacactgagagat

SEQ ID NO: 77085 - DNA, 15 bp, Homo sapiens
atggacactgagaga

SEQ ID NO: 77086 - DNA, 15 bp, Homo sapiens
aatggacactgagag

SEQ ID NO: 77087 - DNA, 15 bp, Homo sapiens
aaaatggacactgag

SEQ ID NO: 77088 - DNA, 15 bp, Homo sapiens
caaaatggacactga

SEQ ID NO: 77089 - DNA, 15 bp, Homo sapiens
tcaaaatggacactg

SEQ ID NO: 77090 - DNA, 15 bp, Homo sapiens
atcaaaatggacact

SEQ ID NO: 77091 - DNA, 15 bp, Homo sapiens
aatcaaaatggacac

SEQ ID NO: 77092 - DNA, 15 bp, Homo sapiens
gaatcaaaatggaca

SEQ ID NO: 77093 - DNA, 15 bp, Homo sapiens
agaatcaaaatggac

SEQ ID NO: 77094 - DNA, 15 bp, Homo sapiens
aagaatcaaaatgga

SEQ ID NO: 77095 - DNA, 15 bp, Homo sapiens
aaagaatcaaaatgg

SEQ ID NO: 77096 - DNA, 15 bp, Homo sapiens
aaaagaatcaaaatg

SEQ ID NO: 77097 - DNA, 15 bp, Homo sapiens
taaaagaatcaaaat

SEQ ID NO: 77098 - DNA, 15 bp, Homo sapiens
tttaaaagaatcaaa

SEQ ID NO: 77099 - DNA, 15 bp, Homo sapiens
atttaaaagaatcaa

SEQ ID NO: 77100 - DNA, 15 bp, Homo sapiens
catttaaaagaatca

SEQ ID NO: 77101 - DNA, 15 bp, Homo sapiens
gcatttaaaagaatc

SEQ ID NO: 77102 - DNA, 15 bp, Homo sapiens
tgcatttaaaagaat

SEQ ID NO: 77103 - DNA, 15 bp, Homo sapiens
atgcatttaaaagaa

SEQ ID NO: 77104 - DNA, 15 bp, Homo sapiens
aatgcatttaaaaga

SEQ ID NO: 77105 - DNA, 15 bp, Homo sapiens
aaatgcatttaaaag

SEQ ID NO: 77106 - DNA, 15 bp, Homo sapiens
gaaatgcatttaaaa

SEQ ID NO: 77107 - DNA, 15 bp, Homo sapiens
tgaaatgcatttaaa

SEQ ID NO: 77108 - DNA, 15 bp, Homo sapiens
atgaaatgcatttaa

SEQ ID NO: 77109 - DNA, 15 bp, Homo sapiens
aatgaaatgcattta

SEQ ID NO: 77110 - DNA, 15 bp, Homo sapiens
aaatgaaatgcattt

SEQ ID NO: 77111 - DNA, 15 bp, Homo sapiens
gaaatgaaatgcatt

SEQ ID NO: 77112 - DNA, 15 bp, Homo sapiens
ggaaatgaaatgcat

SEQ ID NO: 77113 - DNA, 15 bp, Homo sapiens
tggaaatgaaatgca

SEQ ID NO: 77114 - DNA, 15 bp, Homo sapiens
atggaaatgaaatgc

SEQ ID NO: 77115 - DNA, 15 bp, Homo sapiens
gatggaaatgaaatg

SEQ ID NO: 77116 - DNA, 15 bp, Homo sapiens
agatggaaatgaaat

SEQ ID NO: 77117 - DNA, 15 bp, Homo sapiens
tagatggaaatgaaa

SEQ ID NO: 77118 - DNA, 15 bp, Homo sapiens
atagatggaaatgaa

SEQ ID NO: 77119 - DNA, 15 bp, Homo sapiens
tatagatggaaatga

SEQ ID NO: 77120 - DNA, 15 bp, Homo sapiens
ttatagatggaaatg

SEQ ID NO: 77121 - DNA, 15 bp, Homo sapiens
cttatagatggaaat

SEQ ID NO: 77122 - DNA, 15 bp, Homo sapiens
tcttatagatggaaa

SEQ ID NO: 77123 - DNA, 15 bp, Homo sapiens
ttcttatagatggaa

SEQ ID NO: 77124 - DNA, 15 bp, Homo sapiens
cttcttatagatgga

SEQ ID NO: 77125 - DNA, 15 bp, Homo sapiens
gcttcttatagatgg

SEQ ID NO: 77126 - DNA, 15 bp, Homo sapiens
tgcttcttatagatg

SEQ ID NO: 77127 - DNA, 15 bp, Homo sapiens
ttgcttcttatagat

SEQ ID NO: 77128 - DNA, 15 bp, Homo sapiens
gttgcttcttataga

SEQ ID NO: 77129 - DNA, 15 bp, Homo sapiens
agttgcttcttatag

SEQ ID NO: 77130 - DNA, 15 bp, Homo sapiens
tagttgcttcttata

SEQ ID NO: 77131 - DNA, 15 bp, Homo sapiens
atagttgcttcttat

SEQ ID NO: 77132 - DNA, 15 bp, Homo sapiens
tatagttgcttctta

SEQ ID NO: 77133 - DNA, 15 bp, Homo sapiens
atatagttgcttctt

SEQ ID NO: 77134 - DNA, 15 bp, Homo sapiens
aatatagttgcttct

SEQ ID NO: 77135 - DNA, 15 bp, Homo sapiens
gaatatagttgcttc

SEQ ID NO: 77136 - DNA, 15 bp, Homo sapiens
agaatatagttgctt

SEQ ID NO: 77137 - DNA, 15 bp, Homo sapiens
gagaatatagttgct

SEQ ID NO: 77138 - DNA, 15 bp, Homo sapiens
agagaatatagttgc

SEQ ID NO: 77139 - DNA, 15 bp, Homo sapiens
aagagaatatagttg

SEQ ID NO: 77140 - DNA, 15 bp, Homo sapiens
gaagagaatatagtt

SEQ ID NO: 77141 - DNA, 15 bp, Homo sapiens
tgaagagaatatagt

SEQ ID NO: 77142 - DNA, 15 bp, Homo sapiens
ctgaagagaatatag

SEQ ID NO: 77143 - DNA, 15 bp, Homo sapiens
cctgaagagaatata

SEQ ID NO: 77144 - DNA, 15 bp, Homo sapiens
ccctgaagagaatat

SEQ ID NO: 77145 - DNA, 15 bp, Homo sapiens
cccctgaagagaata

SEQ ID NO: 77146 - DNA, 15 bp, Homo sapiens
tcccctgaagagaat

SEQ ID NO: 77147 - DNA, 15 bp, Homo sapiens
ttcccctgaagagaa

SEQ ID NO: 77148 - DNA, 15 bp, Homo sapiens
tttcccctgaagaga

SEQ ID NO: 77149 - DNA, 15 bp, Homo sapiens
ttttcccctgaagag

SEQ ID NO: 77150 - DNA, 15 bp, Homo sapiens
tttttcccctgaaga

SEQ ID NO: 77151 - DNA, 15 bp, Homo sapiens
ttttttcccctgaag

SEQ ID NO: 77152 - DNA, 15 bp, Homo sapiens
gttttttcccctgaa

SEQ ID NO: 77153 - DNA, 15 bp, Homo sapiens
agttttttcccctga

SEQ ID NO: 77154 - DNA, 15 bp, Homo sapiens
gagttttttcccctg

SEQ ID NO: 77155 - DNA, 15 bp, Homo sapiens
tgagttttttcccct

SEQ ID NO: 77156 - DNA, 15 bp, Homo sapiens
ttgagttttttcccc

SEQ ID NO: 77157 - DNA, 15 bp, Homo sapiens
cttgagttttttccc

SEQ ID NO: 77158 - DNA, 15 bp, Homo sapiens
acttgagttttttcc

SEQ ID NO: 77159 - DNA, 15 bp, Homo sapiens
cacttgagttttttc

SEQ ID NO: 77160 - DNA, 15 bp, Homo sapiens
acacttgagtttttt

SEQ ID NO: 77161 - DNA, 15 bp, Homo sapiens
cacacttgagttttt

SEQ ID NO: 77162 - DNA, 15 bp, Homo sapiens
acacacttgagtttt

SEQ ID NO: 77163 - DNA, 15 bp, Homo sapiens
cacacacttgagttt

SEQ ID NO: 77164 - DNA, 15 bp, Homo sapiens
tcacacacttgagtt

SEQ ID NO: 77165 - DNA, 15 bp, Homo sapiens
atcacacacttgagt

SEQ ID NO: 77166 - DNA, 15 bp, Homo sapiens
catcacacacttgag

SEQ ID NO: 77167 - DNA, 15 bp, Homo sapiens
acatcacacacttga

SEQ ID NO: 77168 - DNA, 15 bp, Homo sapiens
aacatcacacacttg

SEQ ID NO: 77169 - DNA, 15 bp, Homo sapiens
aaacatcacacactt

SEQ ID NO: 77170 - DNA, 15 bp, Homo sapiens
aaaacatcacacact

SEQ ID NO: 77171 - DNA, 15 bp, Homo sapiens
caaaacatcacacac

SEQ ID NO: 77172 - DNA, 15 bp, Homo sapiens
acaaaacatcacaca

SEQ ID NO: 77173 - DNA, 15 bp, Homo sapiens
cacaaaacatcacac

SEQ ID NO: 77174 - DNA, 15 bp, Homo sapiens
ccacaaaacatcaca

SEQ ID NO: 77175 - DNA, 15 bp, Homo sapiens
gccacaaaacatcac

SEQ ID NO: 77176 - DNA, 15 bp, Homo sapiens
agccacaaaacatca

SEQ ID NO: 77177 - DNA, 15 bp, Homo sapiens
aagccacaaaacatc

SEQ ID NO: 77178 - DNA, 15 bp, Homo sapiens
taagccacaaaacat

SEQ ID NO: 77179 - DNA, 15 bp, Homo sapiens
gtaagccacaaaaca

SEQ ID NO: 77180 - DNA, 15 bp, Homo sapiens
agtaagccacaaaac

SEQ ID NO: 77181 - DNA, 15 bp, Homo sapiens
tagtaagccacaaaa

SEQ ID NO: 77182 - DNA, 15 bp, Homo sapiens
ttagtaagccacaaa

SEQ ID NO: 77183 - DNA, 15 bp, Homo sapiens
tttagtaagccacaa

SEQ ID NO: 77184 - DNA, 15 bp, Homo sapiens
atttagtaagccaca

SEQ ID NO: 77185 - DNA, 15 bp, Homo sapiens
tatttagtaagccac

SEQ ID NO: 77186 - DNA, 15 bp, Homo sapiens
atatttagtaagcca

SEQ ID NO: 77187 - DNA, 15 bp, Homo sapiens
catatttagtaagcc

SEQ ID NO: 77188 - DNA, 15 bp, Homo sapiens
ccatatttagtaagc

SEQ ID NO: 77189 - DNA, 15 bp, Homo sapiens
accatatttagtaag

SEQ ID NO: 77190 - DNA, 15 bp, Homo sapiens
caccatatttagtaa

SEQ ID NO: 77191 - DNA, 15 bp, Homo sapiens
ccaccatatttagta

SEQ ID NO: 77192 - DNA, 15 bp, Homo sapiens
gccaccatatttagt

SEQ ID NO: 77193 - DNA, 15 bp, Homo sapiens
tgccaccatatttag

SEQ ID NO: 77194 - DNA, 15 bp, Homo sapiens
ctgccaccatattta

SEQ ID NO: 77195 - DNA, 15 bp, Homo sapiens
tctgccaccatattt

SEQ ID NO: 77196 - DNA, 15 bp, Homo sapiens
atctgccaccatatt

SEQ ID NO: 77197 - DNA, 15 bp, Homo sapiens
tatctgccaccatat

SEQ ID NO: 77198 - DNA, 15 bp, Homo sapiens
ctatctgccaccata

SEQ ID NO: 77199 - DNA, 15 bp, Homo sapiens
actatctgccaccat

SEQ ID NO: 77200 - DNA, 15 bp, Homo sapiens
aactatctgccacca

SEQ ID NO: 77201 - DNA, 15 bp, Homo sapiens
caactatctgccacc

SEQ ID NO: 77202 - DNA, 15 bp, Homo sapiens
gcaactatctgccac

SEQ ID NO: 77203 - DNA, 15 bp, Homo sapiens
tgcaactatctgcca

SEQ ID NO: 77204 - DNA, 15 bp, Homo sapiens
ctgcaactatctgcc

SEQ ID NO: 77205 - DNA, 15 bp, Homo sapiens
tctgcaactatctgc

SEQ ID NO: 77206 - DNA, 15 bp, Homo sapiens
ttctgcaactatctg

SEQ ID NO: 77207 - DNA, 15 bp, Homo sapiens
attctgcaactatct

SEQ ID NO: 77208 - DNA, 15 bp, Homo sapiens
aattctgcaactatc

SEQ ID NO: 77209 - DNA, 15 bp, Homo sapiens
aaattctgcaactat

SEQ ID NO: 77210 - DNA, 15 bp, Homo sapiens
caaattctgcaacta

SEQ ID NO: 77211 - DNA, 15 bp, Homo sapiens
acaaattctgcaact

SEQ ID NO: 77212 - DNA, 15 bp, Homo sapiens
gacaaattctgcaac

SEQ ID NO: 77213 - DNA, 15 bp, Homo sapiens
ggacaaattctgcaa

SEQ ID NO: 77214 - DNA, 15 bp, Homo sapiens
tggacaaattctgca

SEQ ID NO: 77215 - DNA, 15 bp, Homo sapiens
ttggacaaattctgc

SEQ ID NO: 77216 - DNA, 15 bp, Homo sapiens
tttggacaaattctg

SEQ ID NO: 77217 - DNA, 15 bp, Homo sapiens
atttggacaaattct

SEQ ID NO: 77218 - DNA, 15 bp, Homo sapiens
tatttggacaaattc

SEQ ID NO: 77219 - DNA, 15 bp, Homo sapiens
atatttggacaaatt

SEQ ID NO: 77220 - DNA, 15 bp, Homo sapiens
tatatttggacaaat

SEQ ID NO: 77221 - DNA, 15 bp, Homo sapiens
ttatatttggacaaa

SEQ ID NO: 77222 - DNA, 15 bp, Homo sapiens
tttatatttggacaa

SEQ ID NO: 77223 - DNA, 15 bp, Homo sapiens
atttatatttggaca

SEQ ID NO: 77224 - DNA, 15 bp, Homo sapiens
aatttatatttggac

SEQ ID NO: 77225 - DNA, 15 bp, Homo sapiens
caatttatatttgga

SEQ ID NO: 77226 - DNA, 15 bp, Homo sapiens
acaatttatatttgg

SEQ ID NO: 77227 - DNA, 15 bp, Homo sapiens
aacaatttatatttg

SEQ ID NO: 77228 - DNA, 15 bp, Homo sapiens
taacaatttatattt

SEQ ID NO: 77229 - DNA, 15 bp, Homo sapiens
ttaacaatttatatt

SEQ ID NO: 77230 - DNA, 15 bp, Homo sapiens
attaacaatttatat

SEQ ID NO: 77231 - DNA, 15 bp, Homo sapiens
cattaacaatttata

SEQ ID NO: 77232 - DNA, 15 bp, Homo sapiens
tcattaacaatttat

SEQ ID NO: 77233 - DNA, 15 bp, Homo sapiens
gtcattaacaattta

SEQ ID NO: 77234 - DNA, 15 bp, Homo sapiens
agtcattaacaattt

SEQ ID NO: 77235 - DNA, 15 bp, Homo sapiens
tagtcattaacaatt

SEQ ID NO: 77236 - DNA, 15 bp, Homo sapiens
gtagtcattaacaat

SEQ ID NO: 77237 - DNA, 15 bp, Homo sapiens
agtagtcattaacaa

SEQ ID NO: 77238 - DNA, 15 bp, Homo sapiens
aagtagtcattaaca

SEQ ID NO: 77239 - DNA, 15 bp, Homo sapiens
gaagtagtcattaac

SEQ ID NO: 77240 - DNA, 15 bp, Homo sapiens
ggaagtagtcattaa

SEQ ID NO: 77241 - DNA, 15 bp, Homo sapiens
gggaagtagtcatta

SEQ ID NO: 77242 - DNA, 15 bp, Homo sapiens
ggggaagtagtcatt

SEQ ID NO: 77243 - DNA, 15 bp, Homo sapiens
gggggaagtagtcat

SEQ ID NO: 77244 - DNA, 15 bp, Homo sapiens
ggggggaagtagtca

SEQ ID NO: 77245 - DNA, 15 bp, Homo sapiens
gggggggaagtagtc

SEQ ID NO: 77246 - DNA, 15 bp, Homo sapiens
ggggggggaagtagt

SEQ ID NO: 77247 - DNA, 15 bp, Homo sapiens
cggggggggaagtag

SEQ ID NO: 77248 - DNA, 15 bp, Homo sapiens
gcggggggggaagta

SEQ ID NO: 77249 - DNA, 15 bp, Homo sapiens
ggcggggggggaagt

SEQ ID NO: 77250 - DNA, 15 bp, Homo sapiens
gggcggggggggaag

SEQ ID NO: 77251 - DNA, 15 bp, Homo sapiens
agggcggggggggaa

SEQ ID NO: 77252 - DNA, 15 bp, Homo sapiens
gagggcgggggggga

SEQ ID NO: 77253 - DNA, 15 bp, Homo sapiens
tgagggcgggggggg

SEQ ID NO: 77254 - DNA, 15 bp, Homo sapiens
ttgagggcggggggg

SEQ ID NO: 77255 - DNA, 15 bp, Homo sapiens
attgagggcgggggg

SEQ ID NO: 77256 - DNA, 15 bp, Homo sapiens
gattgagggcggggg

SEQ ID NO: 77257 - DNA, 15 bp, Homo sapiens
agattgagggcgggg

SEQ ID NO: 77258 - DNA, 15 bp, Homo sapiens
cagattgagggcggg

SEQ ID NO: 77259 - DNA, 15 bp, Homo sapiens
acagattgagggcgg

SEQ ID NO: 77260 - DNA, 15 bp, Homo sapiens
cacagattgagggcg

SEQ ID NO: 77261 - DNA, 15 bp, Homo sapiens
ccacagattgagggc

SEQ ID NO: 77262 - DNA, 15 bp, Homo sapiens
accacagattgaggg

SEQ ID NO: 77263 - DNA, 15 bp, Homo sapiens
gaccacagattgagg

SEQ ID NO: 77264 - DNA, 15 bp, Homo sapiens
tgaccacagattgag

SEQ ID NO: 77265 - DNA, 15 bp, Homo sapiens
ctgaccacagattga

SEQ ID NO: 77266 - DNA, 15 bp, Homo sapiens
tctgaccacagattg

SEQ ID NO: 77267 - DNA, 15 bp, Homo sapiens
atctgaccacagatt

SEQ ID NO: 77268 - DNA, 15 bp, Homo sapiens
aatctgaccacagat

SEQ ID NO: 77269 - DNA, 15 bp, Homo sapiens
aaatctgaccacaga

SEQ ID NO: 77270 - DNA, 15 bp, Homo sapiens
aaaatctgaccacag

SEQ ID NO: 77271 - DNA, 15 bp, Homo sapiens
aaaaatctgaccaca

SEQ ID NO: 77272 - DNA, 15 bp, Homo sapiens
gaaaaatctgaccac

SEQ ID NO: 77273 - DNA, 15 bp, Homo sapiens
agaaaaatctgacca

SEQ ID NO: 77274 - DNA, 15 bp, Homo sapiens
aagaaaaatctgacc

SEQ ID NO: 77275 - DNA, 15 bp, Homo sapiens
taagaaaaatctgac

SEQ ID NO: 77276 - DNA, 15 bp, Homo sapiens
ataagaaaaatctga

SEQ ID NO: 77277 - DNA, 15 bp, Homo sapiens
aataagaaaaatctg

SEQ ID NO: 77278 - DNA, 15 bp, Homo sapiens
taataagaaaaatct

SEQ ID NO: 77279 - DNA, 15 bp, Homo sapiens
ctaataagaaaaatc

SEQ ID NO: 77280 - DNA, 15 bp, Homo sapiens
cctaataagaaaaat

SEQ ID NO: 77281 - DNA, 15 bp, Homo sapiens
tcctaataagaaaaa

SEQ ID NO: 77282 - DNA, 15 bp, Homo sapiens
ttcctaataagaaaa

SEQ ID NO: 77283 - DNA, 15 bp, Homo sapiens
attcctaataagaaa

SEQ ID NO: 77284 - DNA, 15 bp, Homo sapiens
gattcctaataagaa

SEQ ID NO: 77285 - DNA, 15 bp, Homo sapiens
tgattcctaataaga

SEQ ID NO: 77286 - DNA, 15 bp, Homo sapiens
gtgattcctaataag

SEQ ID NO: 77287 - DNA, 15 bp, Homo sapiens
tgtgattcctaataa

SEQ ID NO: 77288 - DNA, 15 bp, Homo sapiens
ttgtgattcctaata

SEQ ID NO: 77289 - DNA, 15 bp, Homo sapiens
tttgtgattcctaat

SEQ ID NO: 77290 - DNA, 15 bp, Homo sapiens
ttttgtgattcctaa

SEQ ID NO: 77291 - DNA, 15 bp, Homo sapiens
cttttgtgattccta

SEQ ID NO: 77292 - DNA, 15 bp, Homo sapiens
ccttttgtgattcct

SEQ ID NO: 77293 - DNA, 15 bp, Homo sapiens
cccttttgtgattcc

SEQ ID NO: 77294 - DNA, 15 bp, Homo sapiens
tcccttttgtgattc

SEQ ID NO: 77295 - DNA, 15 bp, Homo sapiens
gtcccttttgtgatt

SEQ ID NO: 77296 - DNA, 15 bp, Homo sapiens
ggtcccttttgtgat

SEQ ID NO: 77297 - DNA, 15 bp, Homo sapiens
aggtcccttttgtga

SEQ ID NO: 77298 - DNA, 15 bp, Homo sapiens
caggtcccttttgtg

SEQ ID NO: 77299 - DNA, 15 bp, Homo sapiens
tcaggtcccttttgt

SEQ ID NO: 77300 - DNA, 15 bp, Homo sapiens
atcaggtcccttttg

SEQ ID NO: 77301 - DNA, 15 bp, Homo sapiens
aatcaggtccctttt

SEQ ID NO: 77302 - DNA, 15 bp, Homo sapiens
gaatcaggtcccttt

SEQ ID NO: 77303 - DNA, 15 bp, Homo sapiens
agaatcaggtccctt

SEQ ID NO: 77304 - DNA, 15 bp, Homo sapiens
cagaatcaggtccct

SEQ ID NO: 77305 - DNA, 15 bp, Homo sapiens
tcagaatcaggtccc

SEQ ID NO: 77306 - DNA, 15 bp, Homo sapiens
atcagaatcaggtcc

SEQ ID NO: 77307 - DNA, 15 bp, Homo sapiens
aatcagaatcaggtc

SEQ ID NO: 77308 - DNA, 15 bp, Homo sapiens
aaatcagaatcaggt

SEQ ID NO: 77309 - DNA, 15 bp, Homo sapiens
taaatcagaatcagg

SEQ ID NO: 77310 - DNA, 15 bp, Homo sapiens
ataaatcagaatcag

SEQ ID NO: 77311 - DNA, 15 bp, Homo sapiens
cataaatcagaatca

SEQ ID NO: 77312 - DNA, 15 bp, Homo sapiens
tcataaatcagaatc

SEQ ID NO: 77313 - DNA, 15 bp, Homo sapiens
ttcataaatcagaat

SEQ ID NO: 77314 - DNA, 15 bp, Homo sapiens
tttcataaatcagaa

SEQ ID NO: 77315 - DNA, 15 bp, Homo sapiens
atttcataaatcaga

SEQ ID NO: 77316 - DNA, 15 bp, Homo sapiens
catttcataaatcag

SEQ ID NO: 77317 - DNA, 15 bp, Homo sapiens
acatttcataaatca

SEQ ID NO: 77318 - DNA, 15 bp, Homo sapiens
aacatttcataaatc

SEQ ID NO: 77319 - DNA, 15 bp, Homo sapiens
aaacatttcataaat

SEQ ID NO: 77320 - DNA, 15 bp, Homo sapiens
taaacatttcataaa

SEQ ID NO: 77321 - DNA, 15 bp, Homo sapiens
gtaaacatttcataa

SEQ ID NO: 77322 - DNA, 15 bp, Homo sapiens
tgtaaacatttcata

SEQ ID NO: 77323 - DNA, 15 bp, Homo sapiens
atgtaaacatttcat

SEQ ID NO: 77324 - DNA, 15 bp, Homo sapiens
aatgtaaacatttca

SEQ ID NO: 77325 - DNA, 15 bp, Homo sapiens
aaatgtaaacatttc

SEQ ID NO: 77326 - DNA, 15 bp, Homo sapiens
gaaatgtaaacattt

SEQ ID NO: 77327 - DNA, 15 bp, Homo sapiens
tgaaatgtaaacatt

SEQ ID NO: 77328 - DNA, 15 bp, Homo sapiens
atgaaatgtaaacat

SEQ ID NO: 77329 - DNA, 15 bp, Homo sapiens
catgaaatgtaaaca

SEQ ID NO: 77330 - DNA, 15 bp, Homo sapiens
acatgaaatgtaaac

SEQ ID NO: 77331 - DNA, 15 bp, Homo sapiens
aacatgaaatgtaaa

SEQ ID NO: 77332 - DNA, 15 bp, Homo sapiens
taacatgaaatgtaa

SEQ ID NO: 77333 - DNA, 15 bp, Homo sapiens
gtaacatgaaatgta

SEQ ID NO: 77334 - DNA, 15 bp, Homo sapiens
tgtaacatgaaatgt

SEQ ID NO: 77335 - DNA, 15 bp, Homo sapiens
ttgtaacatgaaatg

SEQ ID NO: 77336 - DNA, 15 bp, Homo sapiens
tttgtaacatgaaat

SEQ ID NO: 77337 - DNA, 15 bp, Homo sapiens
atttgtaacatgaaa

SEQ ID NO: 77338 - DNA, 15 bp, Homo sapiens
tatttgtaacatgaa

SEQ ID NO: 77339 - DNA, 15 bp, Homo sapiens
atatttgtaacatga

SEQ ID NO: 77340 - DNA, 15 bp, Homo sapiens
aatatttgtaacatg

SEQ ID NO: 77341 - DNA, 15 bp, Homo sapiens
aaatatttgtaacat

SEQ ID NO: 77342 - DNA, 15 bp, Homo sapiens
taaatatttgtaaca

SEQ ID NO: 77343 - DNA, 15 bp, Homo sapiens
gtaaatatttgtaac

SEQ ID NO: 77344 - DNA, 15 bp, Homo sapiens
tgtaaatatttgtaa

SEQ ID NO: 77345 - DNA, 15 bp, Homo sapiens
atgtaaatatttgta

SEQ ID NO: 77346 - DNA, 15 bp, Homo sapiens
aatgtaaatatttgt

SEQ ID NO: 77347 - DNA, 15 bp, Homo sapiens
aaatgtaaatatttg

SEQ ID NO: 77348 - DNA, 15 bp, Homo sapiens
gaaatgtaaatattt

SEQ ID NO: 77349 - DNA, 15 bp, Homo sapiens
tgaaatgtaaatatt

SEQ ID NO: 77350 - DNA, 15 bp, Homo sapiens
gtgaaatgtaaatat

SEQ ID NO: 77351 - DNA, 15 bp, Homo sapiens
agtgaaatgtaaata

SEQ ID NO: 77352 - DNA, 15 bp, Homo sapiens
aagtgaaatgtaaat

SEQ ID NO: 77353 - DNA, 15 bp, Homo sapiens
aaagtgaaatgtaaa

SEQ ID NO: 77354 - DNA, 15 bp, Homo sapiens
taaagtgaaatgtaa

SEQ ID NO: 77355 - DNA, 15 bp, Homo sapiens
ataaagtgaaatgta

SEQ ID NO: 77356 - DNA, 15 bp, Homo sapiens
tataaagtgaaatgt

SEQ ID NO: 77357 - DNA, 15 bp, Homo sapiens
ttataaagtgaaatg

SEQ ID NO: 77358 - DNA, 15 bp, Homo sapiens
tttataaagtgaaat

SEQ ID NO: 77359 - DNA, 15 bp, Homo sapiens
atttataaagtgaaa

SEQ ID NO: 77360 - DNA, 15 bp, Homo sapiens
tatttataaagtgaa

SEQ ID NO: 77361 - DNA, 15 bp, Homo sapiens
atatttataaagtga

SEQ ID NO: 77362 - DNA, 15 bp, Homo sapiens
aatatttataaagtg

SEQ ID NO: 77363 - DNA, 15 bp, Homo sapiens
aaatatttataaagt

SEQ ID NO: 77364 - DNA, 15 bp, Homo sapiens
taaatatttataaag

SEQ ID NO: 77365 - DNA, 15 bp, Homo sapiens
ataaatatttataaa

SEQ ID NO: 77366 - DNA, 15 bp, Homo sapiens
cataaatatttataa

SEQ ID NO: 77367 - DNA, 15 bp, Homo sapiens
acataaatatttata

SEQ ID NO: 77368 - DNA, 15 bp, Homo sapiens
aacataaatatttat

SEQ ID NO: 77369 - DNA, 15 bp, Homo sapiens
aaacataaatattta

SEQ ID NO: 77370 - DNA, 15 bp, Homo sapiens
taaacataaatattt

SEQ ID NO: 77371 - DNA, 15 bp, Homo sapiens
ataaacataaatatt

SEQ ID NO: 77372 - DNA, 15 bp, Homo sapiens
aataaacataaatat

SEQ ID NO: 77373 - DNA, 15 bp, Homo sapiens
caataaacataaata

SEQ ID NO: 77374 - DNA, 15 bp, Homo sapiens
acaataaacataaat

SEQ ID NO: 77375 - DNA, 15 bp, Homo sapiens
cacaataaacataaa

SEQ ID NO: 77376 - DNA, 15 bp, Homo sapiens
tcacaataaacataa

SEQ ID NO: 77377 - DNA, 15 bp, Homo sapiens
ttcacaataaacata

SEQ ID NO: 77378 - DNA, 15 bp, Homo sapiens
gttcacaataaacat

SEQ ID NO: 77379 - DNA, 15 bp, Homo sapiens
ggttcacaataaaca

SEQ ID NO: 77380 - DNA, 15 bp, Homo sapiens
aggttcacaataaac

SEQ ID NO: 77381 - DNA, 15 bp, Homo sapiens
aaggttcacaataaa

SEQ ID NO: 77382 - DNA, 15 bp, Homo sapiens
caaggttcacaataa

SEQ ID NO: 77383 - DNA, 15 bp, Homo sapiens
acaaggttcacaata

SEQ ID NO: 77384 - DNA, 15 bp, Homo sapiens
tacaaggttcacaat

SEQ ID NO: 77385 - DNA, 15 bp, Homo sapiens
atacaaggttcacaa

SEQ ID NO: 77386 - DNA, 15 bp, Homo sapiens
aatacaaggttcaca

SEQ ID NO: 77387 - DNA, 15 bp, Homo sapiens
aaatacaaggttcac

SEQ ID NO: 77388 - DNA, 15 bp, Homo sapiens
taaatacaaggttca

SEQ ID NO: 77389 - DNA, 15 bp, Homo sapiens
ctaaatacaaggttc

SEQ ID NO: 77390 - DNA, 15 bp, Homo sapiens
cctaaatacaaggtt

SEQ ID NO: 77391 - DNA, 15 bp, Homo sapiens
gcctaaatacaaggt

SEQ ID NO: 77392 - DNA, 15 bp, Homo sapiens
ggcctaaatacaagg

SEQ ID NO: 77393 - DNA, 15 bp, Homo sapiens
tggcctaaatacaag

SEQ ID NO: 77394 - DNA, 15 bp, Homo sapiens
ttggcctaaatacaa

SEQ ID NO: 77395 - DNA, 15 bp, Homo sapiens
tttggcctaaataca

SEQ ID NO: 77396 - DNA, 15 bp, Homo sapiens
ttttggcctaaatac

SEQ ID NO: 77397 - DNA, 15 bp, Homo sapiens
tttttggcctaaata

SEQ ID NO: 77398 - DNA, 15 bp, Homo sapiens
ctttttggcctaaat

SEQ ID NO: 77399 - DNA, 15 bp, Homo sapiens
actttttggcctaaa

SEQ ID NO: 77400 - DNA, 15 bp, Homo sapiens
gactttttggcctaa

SEQ ID NO: 77401 - DNA, 15 bp, Homo sapiens
agactttttggccta

SEQ ID NO: 77402 - DNA, 15 bp, Homo sapiens
gagactttttggcct

SEQ ID NO: 77403 - DNA, 15 bp, Homo sapiens
tgagactttttggcc

SEQ ID NO: 77404 - DNA, 15 bp, Homo sapiens
ctgagactttttggc

SEQ ID NO: 77405 - DNA, 15 bp, Homo sapiens
tctgagactttttgg

SEQ ID NO: 77406 - DNA, 15 bp, Homo sapiens
ttctgagactttttg

SEQ ID NO: 77407 - DNA, 15 bp, Homo sapiens
attctgagacttttt

SEQ ID NO: 77408 - DNA, 15 bp, Homo sapiens
tattctgagactttt

SEQ ID NO: 77409 - DNA, 15 bp, Homo sapiens
ctattctgagacttt

SEQ ID NO: 77410 - DNA, 15 bp, Homo sapiens
actattctgagactt

SEQ ID NO: 77411 - DNA, 15 bp, Homo sapiens
aactattctgagact

SEQ ID NO: 77412 - DNA, 15 bp, Homo sapiens
taactattctgagac

SEQ ID NO: 77413 - DNA, 15 bp, Homo sapiens
ttaactattctgaga

SEQ ID NO: 77414 - DNA, 15 bp, Homo sapiens
tttaactattctgag

SEQ ID NO: 77415 - DNA, 15 bp, Homo sapiens
ttttaactattctga

SEQ ID NO: 77416 - DNA, 15 bp, Homo sapiens
attttaactattctg

SEQ ID NO: 77417 - DNA, 15 bp, Homo sapiens
aattttaactattct

SEQ ID NO: 77418 - DNA, 15 bp, Homo sapiens
aaattttaactattc

SEQ ID NO: 77419 - DNA, 15 bp, Homo sapiens
aaaattttaactatt

SEQ ID NO: 77420 - DNA, 15 bp, Homo sapiens
taaaattttaactat

SEQ ID NO: 77421 - DNA, 15 bp, Homo sapiens
gtaaaattttaacta

SEQ ID NO: 77422 - DNA, 15 bp, Homo sapiens
agtaaaattttaact

SEQ ID NO: 77423 - DNA, 15 bp, Homo sapiens
aagtaaaattttaac

SEQ ID NO: 77424 - DNA, 15 bp, Homo sapiens
gaagtaaaattttaa

SEQ ID NO: 77425 - DNA, 15 bp, Homo sapiens
tgaagtaaaatttta

SEQ ID NO: 77426 - DNA, 15 bp, Homo sapiens
ttgaagtaaaatttt

SEQ ID NO: 77427 - DNA, 15 bp, Homo sapiens
attgaagtaaaattt

SEQ ID NO: 77428 - DNA, 15 bp, Homo sapiens
tattgaagtaaaatt

SEQ ID NO: 77429 - DNA, 15 bp, Homo sapiens
ttattgaagtaaaat

SEQ ID NO: 77430 - DNA, 15 bp, Homo sapiens
attattgaagtaaaa

SEQ ID NO: 77431 - DNA, 15 bp, Homo sapiens
cattattgaagtaaa

SEQ ID NO: 77432 - DNA, 15 bp, Homo sapiens
tcattattgaagtaa

SEQ ID NO: 77433 - DNA, 15 bp, Homo sapiens
gtcattattgaagta

SEQ ID NO: 77434 - DNA, 15 bp, Homo sapiens
tgtcattattgaagt

SEQ ID NO: 77435 - DNA, 15 bp, Homo sapiens
ctgtcattattgaag

SEQ ID NO: 77436 - DNA, 15 bp, Homo sapiens
actgtcattattgaa

SEQ ID NO: 77437 - DNA, 15 bp, Homo sapiens
tactgtcattattga

SEQ ID NO: 77438 - DNA, 15 bp, Homo sapiens
ctactgtcattattg

SEQ ID NO: 77439 - DNA, 15 bp, Homo sapiens
tctactgtcattatt

SEQ ID NO: 77440 - DNA, 15 bp, Homo sapiens
ttctactgtcattat

SEQ ID NO: 77441 - DNA, 15 bp, Homo sapiens
tttctactgtcatta

SEQ ID NO: 77442 - DNA, 15 bp, Homo sapiens
ctttctactgtcatt

SEQ ID NO: 77443 - DNA, 15 bp, Homo sapiens
cctttctactgtcat

SEQ ID NO: 77444 - DNA, 15 bp, Homo sapiens
gcctttctactgtca

SEQ ID NO: 77445 - DNA, 15 bp, Homo sapiens
agcctttctactgtc

SEQ ID NO: 77446 - DNA, 15 bp, Homo sapiens
cagcctttctactgt

SEQ ID NO: 77447 - DNA, 15 bp, Homo sapiens
ccagcctttctactg

SEQ ID NO: 77448 - DNA, 15 bp, Homo sapiens
cccagcctttctact

SEQ ID NO: 77449 - DNA, 15 bp, Homo sapiens
gcccagcctttctac

SEQ ID NO: 77450 - DNA, 15 bp, Homo sapiens
cgcccagcctttcta

SEQ ID NO: 77451 - DNA, 15 bp, Homo sapiens
gcgcccagcctttct

SEQ ID NO: 77452 - DNA, 15 bp, Homo sapiens
cgcgcccagcctttc

SEQ ID NO: 77453 - DNA, 15 bp, Homo sapiens
ccgcgcccagccttt

SEQ ID NO: 77454 - DNA, 15 bp, Homo sapiens
caccgcgcccagcct

SEQ ID NO: 77455 - DNA, 15 bp, Homo sapiens
ccaccgcgcccagcc

SEQ ID NO: 77456 - DNA, 15 bp, Homo sapiens
tccaccgcgcccagc

SEQ ID NO: 77457 - DNA, 15 bp, Homo sapiens
atccaccgcgcccag

SEQ ID NO: 77458 - DNA, 15 bp, Homo sapiens
gatccaccgcgccca

SEQ ID NO: 77459 - DNA, 15 bp, Homo sapiens
tgatccaccgcgccc

SEQ ID NO: 77460 - DNA, 15 bp, Homo sapiens
gtgatccaccgcgcc

SEQ ID NO: 77461 - DNA, 15 bp, Homo sapiens
cgtgatccaccgcgc

SEQ ID NO: 77462 - DNA, 15 bp, Homo sapiens
gcgtgatccaccgcg

SEQ ID NO: 77463 - DNA, 15 bp, Homo sapiens
agcgtgatccaccgc

SEQ ID NO: 77464 - DNA, 15 bp, Homo sapiens
aagcgtgatccaccg

SEQ ID NO: 77465 - DNA, 15 bp, Homo sapiens
caagcgtgatccacc

SEQ ID NO: 77466 - DNA, 15 bp, Homo sapiens
acaagcgtgatccac

SEQ ID NO: 77467 - DNA, 15 bp, Homo sapiens
tacaagcgtgatcca

SEQ ID NO: 77468 - DNA, 15 bp, Homo sapiens
ttacaagcgtgatcc

SEQ ID NO: 77469 - DNA, 15 bp, Homo sapiens
attacaagcgtgatc

SEQ ID NO: 77470 - DNA, 15 bp, Homo sapiens
gattacaagcgtgat

SEQ ID NO: 77471 - DNA, 15 bp, Homo sapiens
ctgggattacaagcg

SEQ ID NO: 77472 - DNA, 15 bp, Homo sapiens
agtgatctgcccgcc

SEQ ID NO: 77473 - DNA, 15 bp, Homo sapiens
aagtgatctgcccgc

SEQ ID NO: 77474 - DNA, 15 bp, Homo sapiens
caagtgatctgcccg

SEQ ID NO: 77475 - DNA, 15 bp, Homo sapiens
tcaagtgatctgccc

SEQ ID NO: 77476 - DNA, 15 bp, Homo sapiens
ctcaagtgatctgcc

SEQ ID NO: 77477 - DNA, 15 bp, Homo sapiens
cctcaagtgatctgc

SEQ ID NO: 77478 - DNA, 15 bp, Homo sapiens
acctcaagtgatctg

SEQ ID NO: 77479 - DNA, 15 bp, Homo sapiens
gacctcaagtgatct

SEQ ID NO: 77480 - DNA, 15 bp, Homo sapiens
tctgacctcaagtga

SEQ ID NO: 77481 - DNA, 15 bp, Homo sapiens
gtctgacctcaagtg

SEQ ID NO: 77482 - DNA, 15 bp, Homo sapiens
ggtctgacctcaagt

SEQ ID NO: 77483 - DNA, 15 bp, Homo sapiens
tggtctgacctcaag

SEQ ID NO: 77484 - DNA, 15 bp, Homo sapiens
ttggtctgacctcaa

SEQ ID NO: 77485 - DNA, 15 bp, Homo sapiens
gttggtctgacctca

SEQ ID NO: 77486 - DNA, 15 bp, Homo sapiens
tgttggtctgacctc

SEQ ID NO: 77487 - DNA, 15 bp, Homo sapiens
atgttggtctgacct

SEQ ID NO: 77488 - DNA, 15 bp, Homo sapiens
catgttggtctgacc

SEQ ID NO: 77489 - DNA, 15 bp, Homo sapiens
acatgttggtctgac

SEQ ID NO: 77490 - DNA, 15 bp, Homo sapiens
aacatgttggtctga

SEQ ID NO: 77491 - DNA, 15 bp, Homo sapiens
caacatgttggtctg

SEQ ID NO: 77492 - DNA, 15 bp, Homo sapiens
tcaacatgttggtct

SEQ ID NO: 77493 - DNA, 15 bp, Homo sapiens
ttcaacatgttggtc

SEQ ID NO: 77494 - DNA, 15 bp, Homo sapiens
tttcaacatgttggt

SEQ ID NO: 77495 - DNA, 15 bp, Homo sapiens
gtttcaacatgttgg

SEQ ID NO: 77496 - DNA, 15 bp, Homo sapiens
ggtttcaacatgttg

SEQ ID NO: 77497 - DNA, 15 bp, Homo sapiens
aggtttcaacatgtt

SEQ ID NO: 77498 - DNA, 15 bp, Homo sapiens
caggtttcaacatgt

SEQ ID NO: 77499 - DNA, 15 bp, Homo sapiens
acaggtttcaacatg

SEQ ID NO: 77500 - DNA, 15 bp, Homo sapiens
gacaggtttcaacat

SEQ ID NO: 77501 - DNA, 15 bp, Homo sapiens
agacaggtttcaaca

SEQ ID NO: 77502 - DNA, 15 bp, Homo sapiens
gagacaggtttcaac

SEQ ID NO: 77503 - DNA, 15 bp, Homo sapiens
agagacaggtttcaa

SEQ ID NO: 77504 - DNA, 15 bp, Homo sapiens
tagagacaggtttca

SEQ ID NO: 77505 - DNA, 15 bp, Homo sapiens
gtagagacaggtttc

SEQ ID NO: 77506 - DNA, 15 bp, Homo sapiens
agtagagacaggttt

SEQ ID NO: 77507 - DNA, 15 bp, Homo sapiens
tagtagagacaggtt

SEQ ID NO: 77508 - DNA, 15 bp, Homo sapiens
ttagtagagacaggt

SEQ ID NO: 77509 - DNA, 15 bp, Homo sapiens
catttttagtagaga

SEQ ID NO: 77510 - DNA, 15 bp, Homo sapiens
gcatttttagtagag

SEQ ID NO: 77511 - DNA, 15 bp, Homo sapiens
tgcatttttagtaga

SEQ ID NO: 77512 - DNA, 15 bp, Homo sapiens
ttgcatttttagtag

SEQ ID NO: 77513 - DNA, 15 bp, Homo sapiens
tttgcatttttagta

SEQ ID NO: 77514 - DNA, 15 bp, Homo sapiens
ttttgcatttttagt

SEQ ID NO: 77515 - DNA, 15 bp, Homo sapiens
tttttgcatttttag

SEQ ID NO: 77516 - DNA, 15 bp, Homo sapiens
ttttttgcattttta

SEQ ID NO: 77517 - DNA, 15 bp, Homo sapiens
attttttgcattttt

SEQ ID NO: 77518 - DNA, 15 bp, Homo sapiens
aattttttgcatttt

SEQ ID NO: 77519 - DNA, 15 bp, Homo sapiens
taattttttgcattt

SEQ ID NO: 77520 - DNA, 15 bp, Homo sapiens
ctaattttttgcatt

SEQ ID NO: 77521 - DNA, 15 bp, Homo sapiens
gctaattttttgcat

SEQ ID NO: 77522 - DNA, 15 bp, Homo sapiens
ggctaattttttgca

SEQ ID NO: 77523 - DNA, 15 bp, Homo sapiens
tggctaattttttgc

SEQ ID NO: 77524 - DNA, 15 bp, Homo sapiens
ctggctaattttttg

SEQ ID NO: 77525 - DNA, 15 bp, Homo sapiens
ggcctggctaatttt

SEQ ID NO: 77526 - DNA, 15 bp, Homo sapiens
aggcctggctaattt

SEQ ID NO: 77527 - DNA, 15 bp, Homo sapiens
caggcctggctaatt

SEQ ID NO: 77528 - DNA, 15 bp, Homo sapiens
gcaggcctggctaat

SEQ ID NO: 77529 - DNA, 15 bp, Homo sapiens
tgcaggcctggctaa

SEQ ID NO: 77530 - DNA, 15 bp, Homo sapiens
ctgcaggcctggcta

SEQ ID NO: 77531 - DNA, 15 bp, Homo sapiens
actgcaggcctggct

SEQ ID NO: 77532 - DNA, 15 bp, Homo sapiens
cactgcaggcctggc

SEQ ID NO: 77533 - DNA, 15 bp, Homo sapiens
ccactgcaggcctgg

SEQ ID NO: 77534 - DNA, 15 bp, Homo sapiens
cccactgcaggcctg

SEQ ID NO: 77535 - DNA, 15 bp, Homo sapiens
gcccactgcaggcct

SEQ ID NO: 77536 - DNA, 15 bp, Homo sapiens
tgcccactgcaggcc

SEQ ID NO: 77537 - DNA, 15 bp, Homo sapiens
gtgcccactgcaggc

SEQ ID NO: 77538 - DNA, 15 bp, Homo sapiens
ggtgcccactgcagg

SEQ ID NO: 77539 - DNA, 15 bp, Homo sapiens
aggtgcccactgcag

SEQ ID NO: 77540 - DNA, 15 bp, Homo sapiens
caggtgcccactgca

SEQ ID NO: 77541 - DNA, 15 bp, Homo sapiens
acaggtgcccactgc

SEQ ID NO: 77542 - DNA, 15 bp, Homo sapiens
tacaggtgcccactg

SEQ ID NO: 77543 - DNA, 15 bp, Homo sapiens
ttacaggtgcccact

SEQ ID NO: 77544 - DNA, 15 bp, Homo sapiens
ggctgggattacagg

SEQ ID NO: 77545 - DNA, 15 bp, Homo sapiens
tggctgggattacag

SEQ ID NO: 77546 - DNA, 15 bp, Homo sapiens
gtggctgggattaca

SEQ ID NO: 77547 - DNA, 15 bp, Homo sapiens
agtggctgggattac

SEQ ID NO: 77548 - DNA, 15 bp, Homo sapiens
gagtggctgggatta

SEQ ID NO: 77549 - DNA, 15 bp, Homo sapiens
tgagtggctgggatt

SEQ ID NO: 77550 - DNA, 15 bp, Homo sapiens
ctgagtggctgggat

SEQ ID NO: 77551 - DNA, 15 bp, Homo sapiens
cctgagtggctggga

SEQ ID NO: 77552 - DNA, 15 bp, Homo sapiens
tcctgagtggctggg

SEQ ID NO: 77553 - DNA, 15 bp, Homo sapiens
ctcctgagtggctgg

SEQ ID NO: 77554 - DNA, 15 bp, Homo sapiens
cctcctgagtggctg

SEQ ID NO: 77555 - DNA, 15 bp, Homo sapiens
gcctcctgagtggct

SEQ ID NO: 77556 - DNA, 15 bp, Homo sapiens
agcctcctgagtggc

SEQ ID NO: 77557 - DNA, 15 bp, Homo sapiens
tagcctcctgagtgg

SEQ ID NO: 77558 - DNA, 15 bp, Homo sapiens
atagcctcctgagtg

SEQ ID NO: 77559 - DNA, 15 bp, Homo sapiens
catagcctcctgagt

SEQ ID NO: 77560 - DNA, 15 bp, Homo sapiens
ccatagcctcctgag

SEQ ID NO: 77561 - DNA, 15 bp, Homo sapiens
tccatagcctcctga

SEQ ID NO: 77562 - DNA, 15 bp, Homo sapiens
ctccatagcctcctg

SEQ ID NO: 77563 - DNA, 15 bp, Homo sapiens
cctccatagcctcct

SEQ ID NO: 77564 - DNA, 15 bp, Homo sapiens
gcctccatagcctcc

SEQ ID NO: 77565 - DNA, 15 bp, Homo sapiens
tgcctccatagcctc

SEQ ID NO: 77566 - DNA, 15 bp, Homo sapiens
ctgcctccatagcct

SEQ ID NO: 77567 - DNA, 15 bp, Homo sapiens
cctgcctccatagcc

SEQ ID NO: 77568 - DNA, 15 bp, Homo sapiens
tcctgcctccatagc

SEQ ID NO: 77569 - DNA, 15 bp, Homo sapiens
ctcctgcctccatag

SEQ ID NO: 77570 - DNA, 15 bp, Homo sapiens
tctcctgcctccata

SEQ ID NO: 77571 - DNA, 15 bp, Homo sapiens
ttctcctgcctccat

SEQ ID NO: 77572 - DNA, 15 bp, Homo sapiens
attctcctgcctcca

SEQ ID NO: 77573 - DNA, 15 bp, Homo sapiens
aattctcctgcctcc

SEQ ID NO: 77574 - DNA, 15 bp, Homo sapiens
gggttcaagcaattc

SEQ ID NO: 77575 - DNA, 15 bp, Homo sapiens
tgggttcaagcaatt

SEQ ID NO: 77576 - DNA, 15 bp, Homo sapiens
ctgggttcaagcaat

SEQ ID NO: 77577 - DNA, 15 bp, Homo sapiens
cctgggttcaagcaa

SEQ ID NO: 77578 - DNA, 15 bp, Homo sapiens
tcctgggttcaagca

SEQ ID NO: 77579 - DNA, 15 bp, Homo sapiens
acctctgcttcctgg

SEQ ID NO: 77580 - DNA, 15 bp, Homo sapiens
aacctctgcttcctg

SEQ ID NO: 77581 - DNA, 15 bp, Homo sapiens
caacctctgcttcct

SEQ ID NO: 77582 - DNA, 15 bp, Homo sapiens
atcactgcaacctct

SEQ ID NO: 77583 - DNA, 15 bp, Homo sapiens
gatcactgcaacctc

SEQ ID NO: 77584 - DNA, 15 bp, Homo sapiens
ggatcactgcaacct

SEQ ID NO: 77585 - DNA, 15 bp, Homo sapiens
cggatcactgcaacc

SEQ ID NO: 77586 - DNA, 15 bp, Homo sapiens
tcggatcactgcaac

SEQ ID NO: 77587 - DNA, 15 bp, Homo sapiens
ctcggatcactgcaa

SEQ ID NO: 77588 - DNA, 15 bp, Homo sapiens
tctcggatcactgca

SEQ ID NO: 77589 - DNA, 15 bp, Homo sapiens
atctcggatcactgc

SEQ ID NO: 77590 - DNA, 15 bp, Homo sapiens
catctcggatcactg

SEQ ID NO: 77591 - DNA, 15 bp, Homo sapiens
ccatctcggatcact

SEQ ID NO: 77592 - DNA, 15 bp, Homo sapiens
gccatctcggatcac

SEQ ID NO: 77593 - DNA, 15 bp, Homo sapiens
tgccatctcggatca

SEQ ID NO: 77594 - DNA, 15 bp, Homo sapiens
gtgccatctcggatc

SEQ ID NO: 77595 - DNA, 15 bp, Homo sapiens
ggtgccatctcggat

SEQ ID NO: 77596 - DNA, 15 bp, Homo sapiens
tggtgccatctcgga

SEQ ID NO: 77597 - DNA, 15 bp, Homo sapiens
gtggtgccatctcgg

SEQ ID NO: 77598 - DNA, 15 bp, Homo sapiens
agtggtgccatctcg

SEQ ID NO: 77599 - DNA, 15 bp, Homo sapiens
cagtggtgccatctc

SEQ ID NO: 77600 - DNA, 15 bp, Homo sapiens
gcagtggtgccatct

SEQ ID NO: 77601 - DNA, 15 bp, Homo sapiens
tgcagtggtgccatc

SEQ ID NO: 77602 - DNA, 15 bp, Homo sapiens
gtgcagtggtgccat

SEQ ID NO: 77603 - DNA, 15 bp, Homo sapiens
agtgcagtggtgcca

SEQ ID NO: 77604 - DNA, 15 bp, Homo sapiens
gagtgcagtggtgcc

SEQ ID NO: 77605 - DNA, 15 bp, Homo sapiens
ggagtgcagtggtgc

SEQ ID NO: 77606 - DNA, 15 bp, Homo sapiens
actggagtgcagtgg

SEQ ID NO: 77607 - DNA, 15 bp, Homo sapiens
gactggagtgcagtg

SEQ ID NO: 77608 - DNA, 15 bp, Homo sapiens
agactggagtgcagt

SEQ ID NO: 77609 - DNA, 15 bp, Homo sapiens
cagactggagtgcag

SEQ ID NO: 77610 - DNA, 15 bp, Homo sapiens
ccagactggagtgca

SEQ ID NO: 77611 - DNA, 15 bp, Homo sapiens
cccagactggagtgc

SEQ ID NO: 77612 - DNA, 15 bp, Homo sapiens
acccagactggagtg

SEQ ID NO: 77613 - DNA, 15 bp, Homo sapiens
cacccagactggagt

SEQ ID NO: 77614 - DNA, 15 bp, Homo sapiens
tcacccagactggag

SEQ ID NO: 77615 - DNA, 15 bp, Homo sapiens
gtcacccagactgga

SEQ ID NO: 77616 - DNA, 15 bp, Homo sapiens
tgtcacccagactgg

SEQ ID NO: 77617 - DNA, 15 bp, Homo sapiens
ctgtcacccagactg

SEQ ID NO: 77618 - DNA, 15 bp, Homo sapiens
tctgtcacccagact

SEQ ID NO: 77619 - DNA, 15 bp, Homo sapiens
ctctgtcacccagac

SEQ ID NO: 77620 - DNA, 15 bp, Homo sapiens
actctgtcacccaga

SEQ ID NO: 77621 - DNA, 15 bp, Homo sapiens
attttttgagacaga

SEQ ID NO: 77622 - DNA, 15 bp, Homo sapiens
tattttttgagacag

SEQ ID NO: 77623 - DNA, 15 bp, Homo sapiens
ttattttttgagaca

SEQ ID NO: 77624 - DNA, 15 bp, Homo sapiens
tttattttttgagac

SEQ ID NO: 77625 - DNA, 15 bp, Homo sapiens
ttttattttttgaga

SEQ ID NO: 77626 - DNA, 15 bp, Homo sapiens
tttttattttttgag

SEQ ID NO: 77627 - DNA, 15 bp, Homo sapiens
atttttattttttga

SEQ ID NO: 77628 - DNA, 15 bp, Homo sapiens
ttatttttatttttt

SEQ ID NO: 77629 - DNA, 15 bp, Homo sapiens
attatttttattttt

SEQ ID NO: 77630 - DNA, 15 bp, Homo sapiens
tattatttttatttt

SEQ ID NO: 77631 - DNA, 15 bp, Homo sapiens
ctattatttttattt

SEQ ID NO: 77632 - DNA, 15 bp, Homo sapiens
actattatttttatt

SEQ ID NO: 77633 - DNA, 15 bp, Homo sapiens
tactattatttttat

SEQ ID NO: 77634 - DNA, 15 bp, Homo sapiens
ttactattattttta

SEQ ID NO: 77635 - DNA, 15 bp, Homo sapiens
attactattattttt

SEQ ID NO: 77636 - DNA, 15 bp, Homo sapiens
tattactattatttt

SEQ ID NO: 77637 - DNA, 15 bp, Homo sapiens
ctattactattattt

SEQ ID NO: 77638 - DNA, 15 bp, Homo sapiens
actattactattatt

SEQ ID NO: 77639 - DNA, 15 bp, Homo sapiens
tactattactattat

SEQ ID NO: 77640 - DNA, 15 bp, Homo sapiens
ttactattactatta

SEQ ID NO: 77641 - DNA, 15 bp, Homo sapiens
attactattactatt

SEQ ID NO: 77642 - DNA, 15 bp, Homo sapiens
tattactattactat

SEQ ID NO: 77643 - DNA, 15 bp, Homo sapiens
ttattactattacta

SEQ ID NO: 77644 - DNA, 15 bp, Homo sapiens
attattactattact

SEQ ID NO: 77645 - DNA, 15 bp, Homo sapiens
aattattactattac

SEQ ID NO: 77646 - DNA, 15 bp, Homo sapiens
caattattactatta

SEQ ID NO: 77647 - DNA, 15 bp, Homo sapiens
gcaattattactatt

SEQ ID NO: 77648 - DNA, 15 bp, Homo sapiens
tgcaattattactat

SEQ ID NO: 77649 - DNA, 15 bp, Homo sapiens
ctgcaattattacta

SEQ ID NO: 77650 - DNA, 15 bp, Homo sapiens
actgcaattattact

SEQ ID NO: 77651 - DNA, 15 bp, Homo sapiens
tactgcaattattac

SEQ ID NO: 77652 - DNA, 15 bp, Homo sapiens
ctactgcaattatta

SEQ ID NO: 77653 - DNA, 15 bp, Homo sapiens
tctactgcaattatt

SEQ ID NO: 77654 - DNA, 15 bp, Homo sapiens
ttctactgcaattat

SEQ ID NO: 77655 - DNA, 15 bp, Homo sapiens
cttctactgcaatta

SEQ ID NO: 77656 - DNA, 15 bp, Homo sapiens
tcttctactgcaatt

SEQ ID NO: 77657 - DNA, 15 bp, Homo sapiens
gtcttctactgcaat

SEQ ID NO: 77658 - DNA, 15 bp, Homo sapiens
tgtcttctactgcaa

SEQ ID NO: 77659 - DNA, 15 bp, Homo sapiens
atgtcttctactgca

SEQ ID NO: 77660 - DNA, 15 bp, Homo sapiens
gatgtcttctactgc

SEQ ID NO: 77661 - DNA, 15 bp, Homo sapiens
cgatgtcttctactg

SEQ ID NO: 77662 - DNA, 15 bp, Homo sapiens
tcgatgtcttctact

SEQ ID NO: 77663 - DNA, 15 bp, Homo sapiens
atcgatgtcttctac

SEQ ID NO: 77664 - DNA, 15 bp, Homo sapiens
aatcgatgtcttcta

SEQ ID NO: 77665 - DNA, 15 bp, Homo sapiens
caatcgatgtcttct

SEQ ID NO: 77666 - DNA, 15 bp, Homo sapiens
gcaatcgatgtcttc

SEQ ID NO: 77667 - DNA, 15 bp, Homo sapiens
agcaatcgatgtctt

SEQ ID NO: 77668 - DNA, 15 bp, Homo sapiens
tagcaatcgatgtct

SEQ ID NO: 77669 - DNA, 15 bp, Homo sapiens
ctagcaatcgatgtc

SEQ ID NO: 77670 - DNA, 15 bp, Homo sapiens
tctagcaatcgatgt

SEQ ID NO: 77671 - DNA, 15 bp, Homo sapiens
ctctagcaatcgatg

SEQ ID NO: 77672 - DNA, 15 bp, Homo sapiens
tctctagcaatcgat

SEQ ID NO: 77673 - DNA, 15 bp, Homo sapiens
ttctctagcaatcga

SEQ ID NO: 77674 - DNA, 15 bp, Homo sapiens
tttctctagcaatcg

SEQ ID NO: 77675 - DNA, 15 bp, Homo sapiens
ttttctctagcaatc

SEQ ID NO: 77676 - DNA, 15 bp, Homo sapiens
gttttctctagcaat

SEQ ID NO: 77677 - DNA, 15 bp, Homo sapiens
ggttttctctagcaa

SEQ ID NO: 77678 - DNA, 15 bp, Homo sapiens
tggttttctctagca

SEQ ID NO: 77679 - DNA, 15 bp, Homo sapiens
atggttttctctagc

SEQ ID NO: 77680 - DNA, 15 bp, Homo sapiens
aatggttttctctag

SEQ ID NO: 77681 - DNA, 15 bp, Homo sapiens
caatggttttctcta

SEQ ID NO: 77682 - DNA, 15 bp, Homo sapiens
acaatggttttctct

SEQ ID NO: 77683 - DNA, 15 bp, Homo sapiens
cacaatggttttctc

SEQ ID NO: 77684 - DNA, 15 bp, Homo sapiens
acacaatggttttct

SEQ ID NO: 77685 - DNA, 15 bp, Homo sapiens
aacacaatggttttc

SEQ ID NO: 77686 - DNA, 15 bp, Homo sapiens
taacacaatggtttt

SEQ ID NO: 77687 - DNA, 15 bp, Homo sapiens
gtaacacaatggttt

SEQ ID NO: 77688 - DNA, 15 bp, Homo sapiens
agtaacacaatggtt

SEQ ID NO: 77689 - DNA, 15 bp, Homo sapiens
gagtaacacaatggt

SEQ ID NO: 77690 - DNA, 15 bp, Homo sapiens
agagtaacacaatgg

SEQ ID NO: 77691 - DNA, 15 bp, Homo sapiens
aagagtaacacaatg

SEQ ID NO: 77692 - DNA, 15 bp, Homo sapiens
gaagagtaacacaat

SEQ ID NO: 77693 - DNA, 15 bp, Homo sapiens
agaagagtaacacaa

SEQ ID NO: 77694 - DNA, 15 bp, Homo sapiens
tagaagagtaacaca

SEQ ID NO: 77695 - DNA, 15 bp, Homo sapiens
atagaagagtaacac

SEQ ID NO: 77696 - DNA, 15 bp, Homo sapiens
gatagaagagtaaca

SEQ ID NO: 77697 - DNA, 15 bp, Homo sapiens
ggatagaagagtaac

SEQ ID NO: 77698 - DNA, 15 bp, Homo sapiens
tggatagaagagtaa

SEQ ID NO: 77699 - DNA, 15 bp, Homo sapiens
ctggatagaagagta

SEQ ID NO: 77700 - DNA, 15 bp, Homo sapiens
actggatagaagagt

SEQ ID NO: 77701 - DNA, 15 bp, Homo sapiens
tactggatagaagag

SEQ ID NO: 77702 - DNA, 15 bp, Homo sapiens
ttactggatagaaga

SEQ ID NO: 77703 - DNA, 15 bp, Homo sapiens
tttactggatagaag

SEQ ID NO: 77704 - DNA, 15 bp, Homo sapiens
ctttactggatagaa

SEQ ID NO: 77705 - DNA, 15 bp, Homo sapiens
actttactggataga

SEQ ID NO: 77706 - DNA, 15 bp, Homo sapiens
tactttactggatag

SEQ ID NO: 77707 - DNA, 15 bp, Homo sapiens
ttactttactggata

SEQ ID NO: 77708 - DNA, 15 bp, Homo sapiens
attactttactggat

SEQ ID NO: 77709 - DNA, 15 bp, Homo sapiens
aattactttactgga

SEQ ID NO: 77710 - DNA, 15 bp, Homo sapiens
caattactttactgg

SEQ ID NO: 77711 - DNA, 15 bp, Homo sapiens
gcaattactttactg

SEQ ID NO: 77712 - DNA, 15 bp, Homo sapiens
tgcaattactttact

SEQ ID NO: 77713 - DNA, 15 bp, Homo sapiens
ttgcaattactttac

SEQ ID NO: 77714 - DNA, 15 bp, Homo sapiens
tttgcaattacttta

SEQ ID NO: 77715 - DNA, 15 bp, Homo sapiens
atttgcaattacttt

SEQ ID NO: 77716 - DNA, 15 bp, Homo sapiens
aatttgcaattactt

SEQ ID NO: 77717 - DNA, 15 bp, Homo sapiens
aaatttgcaattact

SEQ ID NO: 77718 - DNA, 15 bp, Homo sapiens
caaatttgcaattac

SEQ ID NO: 77719 - DNA, 15 bp, Homo sapiens
ccaaatttgcaatta

SEQ ID NO: 77720 - DNA, 15 bp, Homo sapiens
tccaaatttgcaatt

SEQ ID NO: 77721 - DNA, 15 bp, Homo sapiens
ttccaaatttgcaat

SEQ ID NO: 77722 - DNA, 15 bp, Homo sapiens
tttccaaatttgcaa

SEQ ID NO: 77723 - DNA, 15 bp, Homo sapiens
atttccaaatttgca

SEQ ID NO: 77724 - DNA, 15 bp, Homo sapiens
tatttccaaatttgc

SEQ ID NO: 77725 - DNA, 15 bp, Homo sapiens
ttatttccaaatttg

SEQ ID NO: 77726 - DNA, 15 bp, Homo sapiens
attatttccaaattt

SEQ ID NO: 77727 - DNA, 15 bp, Homo sapiens
aattatttccaaatt

SEQ ID NO: 77728 - DNA, 15 bp, Homo sapiens
aaattatttccaaat

SEQ ID NO: 77729 - DNA, 15 bp, Homo sapiens
aaaattatttccaaa

SEQ ID NO: 77730 - DNA, 15 bp, Homo sapiens
taaaattatttccaa

SEQ ID NO: 77731 - DNA, 15 bp, Homo sapiens
ttaaaattatttcca

SEQ ID NO: 77732 - DNA, 15 bp, Homo sapiens
attaaaattatttcc

SEQ ID NO: 77733 - DNA, 15 bp, Homo sapiens
aattaaaattatttc

SEQ ID NO: 77734 - DNA, 15 bp, Homo sapiens
aaattaaaattattt

SEQ ID NO: 77735 - DNA, 15 bp, Homo sapiens
caaattaaaattatt

SEQ ID NO: 77736 - DNA, 15 bp, Homo sapiens
tcaaattaaaattat

SEQ ID NO: 77737 - DNA, 15 bp, Homo sapiens
atcaaattaaaatta

SEQ ID NO: 77738 - DNA, 15 bp, Homo sapiens
catcaaattaaaatt

SEQ ID NO: 77739 - DNA, 15 bp, Homo sapiens
tcatcaaattaaaat

SEQ ID NO: 77740 - DNA, 15 bp, Homo sapiens
atcatcaaattaaaa

SEQ ID NO: 77741 - DNA, 15 bp, Homo sapiens
tatcatcaaattaaa

SEQ ID NO: 77742 - DNA, 15 bp, Homo sapiens
ttatcatcaaattaa

SEQ ID NO: 77743 - DNA, 15 bp, Homo sapiens
tttatcatcaaatta

SEQ ID NO: 77744 - DNA, 15 bp, Homo sapiens
ttttatcatcaaatt

SEQ ID NO: 77745 - DNA, 15 bp, Homo sapiens
tttttatcatcaaat

SEQ ID NO: 77746 - DNA, 15 bp, Homo sapiens
ttttttatcatcaaa

SEQ ID NO: 77747 - DNA, 15 bp, Homo sapiens
gttttttatcatcaa

SEQ ID NO: 77748 - DNA, 15 bp, Homo sapiens
tgttttttatcatca

SEQ ID NO: 77749 - DNA, 15 bp, Homo sapiens
ctgttttttatcatc

SEQ ID NO: 77750 - DNA, 15 bp, Homo sapiens
actgttttttatcat

SEQ ID NO: 77751 - DNA, 15 bp, Homo sapiens
aactgttttttatca

SEQ ID NO: 77752 - DNA, 15 bp, Homo sapiens
aaactgttttttatc

SEQ ID NO: 77753 - DNA, 15 bp, Homo sapiens
taaactgttttttat

SEQ ID NO: 77754 - DNA, 15 bp, Homo sapiens
ttaaactgtttttta

SEQ ID NO: 77755 - DNA, 15 bp, Homo sapiens
tttaaactgtttttt

SEQ ID NO: 77756 - DNA, 15 bp, Homo sapiens
ttttaaactgttttt

SEQ ID NO: 77757 - DNA, 15 bp, Homo sapiens
tttttaaactgtttt

SEQ ID NO: 77758 - DNA, 15 bp, Homo sapiens
atttttaaactgttt

SEQ ID NO: 77759 - DNA, 15 bp, Homo sapiens
tatttttaaactgtt

SEQ ID NO: 77760 - DNA, 15 bp, Homo sapiens
ctatttttaaactgt

SEQ ID NO: 77761 - DNA, 15 bp, Homo sapiens
tctatttttaaactg

SEQ ID NO: 77762 - DNA, 15 bp, Homo sapiens
ctctatttttaaact

SEQ ID NO: 77763 - DNA, 15 bp, Homo sapiens
actctatttttaaac

SEQ ID NO: 77764 - DNA, 15 bp, Homo sapiens
cactctatttttaaa

SEQ ID NO: 77765 - DNA, 15 bp, Homo sapiens
gcactctatttttaa

SEQ ID NO: 77766 - DNA, 15 bp, Homo sapiens
agcactctattttta

SEQ ID NO: 77767 - DNA, 15 bp, Homo sapiens
tagcactctattttt

SEQ ID NO: 77768 - DNA, 15 bp, Homo sapiens
ctagcactctatttt

SEQ ID NO: 77769 - DNA, 15 bp, Homo sapiens
actagcactctattt

SEQ ID NO: 77770 - DNA, 15 bp, Homo sapiens
tactagcactctatt

SEQ ID NO: 77771 - DNA, 15 bp, Homo sapiens
atactagcactctat

SEQ ID NO: 77772 - DNA, 15 bp, Homo sapiens
aatactagcactcta

SEQ ID NO: 77773 - DNA, 15 bp, Homo sapiens
aaatactagcactct

SEQ ID NO: 77774 - DNA, 15 bp, Homo sapiens
gaaatactagcactc

SEQ ID NO: 77775 - DNA, 15 bp, Homo sapiens
tgaaatactagcact

SEQ ID NO: 77776 - DNA, 15 bp, Homo sapiens
ctgaaatactagcac

SEQ ID NO: 77777 - DNA, 15 bp, Homo sapiens
actgaaatactagca

SEQ ID NO: 77778 - DNA, 15 bp, Homo sapiens
gactgaaatactagc

SEQ ID NO: 77779 - DNA, 15 bp, Homo sapiens
tgactgaaatactag

SEQ ID NO: 77780 - DNA, 15 bp, Homo sapiens
gtgactgaaatacta

SEQ ID NO: 77781 - DNA, 15 bp, Homo sapiens
agtgactgaaatact

SEQ ID NO: 77782 - DNA, 15 bp, Homo sapiens
aagtgactgaaatac

SEQ ID NO: 77783 - DNA, 15 bp, Homo sapiens
caagtgactgaaata

SEQ ID NO: 77784 - DNA, 15 bp, Homo sapiens
acaagtgactgaaat

SEQ ID NO: 77785 - DNA, 15 bp, Homo sapiens
tacaagtgactgaaa

SEQ ID NO: 77786 - DNA, 15 bp, Homo sapiens
gtacaagtgactgaa

SEQ ID NO: 77787 - DNA, 15 bp, Homo sapiens
ggtacaagtgactga

SEQ ID NO: 77788 - DNA, 15 bp, Homo sapiens
tggtacaagtgactg

SEQ ID NO: 77789 - DNA, 15 bp, Homo sapiens
gtggtacaagtgact

SEQ ID NO: 77790 - DNA, 15 bp, Homo sapiens
agtggtacaagtgac

SEQ ID NO: 77791 - DNA, 15 bp, Homo sapiens
aagtggtacaagtga

SEQ ID NO: 77792 - DNA, 15 bp, Homo sapiens
aaagtggtacaagtg

SEQ ID NO: 77793 - DNA, 15 bp, Homo sapiens
taaagtggtacaagt

SEQ ID NO: 77794 - DNA, 15 bp, Homo sapiens
ctaaagtggtacaag

SEQ ID NO: 77795 - DNA, 15 bp, Homo sapiens
cctaaagtggtacaa

SEQ ID NO: 77796 - DNA, 15 bp, Homo sapiens
acctaaagtggtaca

SEQ ID NO: 77797 - DNA, 15 bp, Homo sapiens
aacctaaagtggtac

SEQ ID NO: 77798 - DNA, 15 bp, Homo sapiens
aaacctaaagtggta

SEQ ID NO: 77799 - DNA, 15 bp, Homo sapiens
aaaacctaaagtggt

SEQ ID NO: 77800 - DNA, 15 bp, Homo sapiens
taaaacctaaagtgg

SEQ ID NO: 77801 - DNA, 15 bp, Homo sapiens
ttaaaacctaaagtg

SEQ ID NO: 77802 - DNA, 15 bp, Homo sapiens
tttaaaacctaaagt

SEQ ID NO: 77803 - DNA, 15 bp, Homo sapiens
gtttaaaacctaaag

SEQ ID NO: 77804 - DNA, 15 bp, Homo sapiens
agtttaaaacctaaa

SEQ ID NO: 77805 - DNA, 15 bp, Homo sapiens
cagtttaaaacctaa

SEQ ID NO: 77806 - DNA, 15 bp, Homo sapiens
tcagtttaaaaccta

SEQ ID NO: 77807 - DNA, 15 bp, Homo sapiens
gtcagtttaaaacct

SEQ ID NO: 77808 - DNA, 15 bp, Homo sapiens
ggtcagtttaaaacc

SEQ ID NO: 77809 - DNA, 15 bp, Homo sapiens
aggtcagtttaaaac

SEQ ID NO: 77810 - DNA, 15 bp, Homo sapiens
aaggtcagtttaaaa

SEQ ID NO: 77811 - DNA, 15 bp, Homo sapiens
aaaggtcagtttaaa

SEQ ID NO: 77812 - DNA, 15 bp, Homo sapiens
gaaaggtcagtttaa

SEQ ID NO: 77813 - DNA, 15 bp, Homo sapiens
tgaaaggtcagttta

SEQ ID NO: 77814 - DNA, 15 bp, Homo sapiens
atgaaaggtcagttt

SEQ ID NO: 77815 - DNA, 15 bp, Homo sapiens
gatgaaaggtcagtt

SEQ ID NO: 77816 - DNA, 15 bp, Homo sapiens
cgatgaaaggtcagt

SEQ ID NO: 77817 - DNA, 15 bp, Homo sapiens
acgatgaaaggtcag

SEQ ID NO: 77818 - DNA, 15 bp, Homo sapiens
cacgatgaaaggtca

SEQ ID NO: 77819 - DNA, 15 bp, Homo sapiens
acacgatgaaaggtc

SEQ ID NO: 77820 - DNA, 15 bp, Homo sapiens
aacacgatgaaaggt

SEQ ID NO: 77821 - DNA, 15 bp, Homo sapiens
gaacacgatgaaagg

SEQ ID NO: 77822 - DNA, 15 bp, Homo sapiens
agaacacgatgaaag

SEQ ID NO: 77823 - DNA, 15 bp, Homo sapiens
tagaacacgatgaaa

SEQ ID NO: 77824 - DNA, 15 bp, Homo sapiens
atagaacacgatgaa

SEQ ID NO: 77825 - DNA, 15 bp, Homo sapiens
tatagaacacgatga

SEQ ID NO: 77826 - DNA, 15 bp, Homo sapiens
ttatagaacacgatg

SEQ ID NO: 77827 - DNA, 15 bp, Homo sapiens
attatagaacacgat

SEQ ID NO: 77828 - DNA, 15 bp, Homo sapiens
cattatagaacacga

SEQ ID NO: 77829 - DNA, 15 bp, Homo sapiens
tcattatagaacacg

SEQ ID NO: 77830 - DNA, 15 bp, Homo sapiens
atcattatagaacac

SEQ ID NO: 77831 - DNA, 15 bp, Homo sapiens
gatcattatagaaca

SEQ ID NO: 77832 - DNA, 15 bp, Homo sapiens
agatcattatagaac

SEQ ID NO: 77833 - DNA, 15 bp, Homo sapiens
cagatcattatagaa

SEQ ID NO: 77834 - DNA, 15 bp, Homo sapiens
tcagatcattataga

SEQ ID NO: 77835 - DNA, 15 bp, Homo sapiens
gtcagatcattatag

SEQ ID NO: 77836 - DNA, 15 bp, Homo sapiens
tgtcagatcattata

SEQ ID NO: 77837 - DNA, 15 bp, Homo sapiens
atgtcagatcattat

SEQ ID NO: 77838 - DNA, 15 bp, Homo sapiens
aatgtcagatcatta

SEQ ID NO: 77839 - DNA, 15 bp, Homo sapiens
aaatgtcagatcatt

SEQ ID NO: 77840 - DNA, 15 bp, Homo sapiens
aaaatgtcagatcat

SEQ ID NO: 77841 - DNA, 15 bp, Homo sapiens
taaaatgtcagatca

SEQ ID NO: 77842 - DNA, 15 bp, Homo sapiens
ttaaaatgtcagatc

SEQ ID NO: 77843 - DNA, 15 bp, Homo sapiens
gttaaaatgtcagat

SEQ ID NO: 77844 - DNA, 15 bp, Homo sapiens
agttaaaatgtcaga

SEQ ID NO: 77845 - DNA, 15 bp, Homo sapiens
tagttaaaatgtcag

SEQ ID NO: 77846 - DNA, 15 bp, Homo sapiens
atagttaaaatgtca

SEQ ID NO: 77847 - DNA, 15 bp, Homo sapiens
tatagttaaaatgtc

SEQ ID NO: 77848 - DNA, 15 bp, Homo sapiens
gtatagttaaaatgt

SEQ ID NO: 77849 - DNA, 15 bp, Homo sapiens
ggtatagttaaaatg

SEQ ID NO: 77850 - DNA, 15 bp, Homo sapiens
aggtatagttaaaat

SEQ ID NO: 77851 - DNA, 15 bp, Homo sapiens
aaggtatagttaaaa

SEQ ID NO: 77852 - DNA, 15 bp, Homo sapiens
aaaggtatagttaaa

SEQ ID NO: 77853 - DNA, 15 bp, Homo sapiens
aaaaggtatagttaa

SEQ ID NO: 77854 - DNA, 15 bp, Homo sapiens
caaaaggtatagtta

SEQ ID NO: 77855 - DNA, 15 bp, Homo sapiens
acaaaaggtatagtt

SEQ ID NO: 77856 - DNA, 15 bp, Homo sapiens
cacaaaaggtatagt

SEQ ID NO: 77857 - DNA, 15 bp, Homo sapiens
acacaaaaggtatag

SEQ ID NO: 77858 - DNA, 15 bp, Homo sapiens
cacacaaaaggtata

SEQ ID NO: 77859 - DNA, 15 bp, Homo sapiens
acacacaaaaggtat

SEQ ID NO: 77860 - DNA, 15 bp, Homo sapiens
cacacacaaaaggta

SEQ ID NO: 77861 - DNA, 15 bp, Homo sapiens
acacacacaaaaggt

SEQ ID NO: 77862 - DNA, 15 bp, Homo sapiens
cacacacacaaaagg

SEQ ID NO: 77863 - DNA, 15 bp, Homo sapiens
acacacacacaaaag

SEQ ID NO: 77864 - DNA, 15 bp, Homo sapiens
cacacacacacaaaa

SEQ ID NO: 77865 - DNA, 15 bp, Homo sapiens
gtacacacacacaca

SEQ ID NO: 77866 - DNA, 15 bp, Homo sapiens
agtacacacacacac

SEQ ID NO: 77867 - DNA, 15 bp, Homo sapiens
cagtacacacacaca

SEQ ID NO: 77868 - DNA, 15 bp, Homo sapiens
acagtacacacacac

SEQ ID NO: 77869 - DNA, 15 bp, Homo sapiens
gacagtacacacaca

SEQ ID NO: 77870 - DNA, 15 bp, Homo sapiens
agacagtacacacac

SEQ ID NO: 77871 - DNA, 15 bp, Homo sapiens
tagacagtacacaca

SEQ ID NO: 77872 - DNA, 15 bp, Homo sapiens
gtagacagtacacac

SEQ ID NO: 77873 - DNA, 15 bp, Homo sapiens
tgtagacagtacaca

SEQ ID NO: 77874 - DNA, 15 bp, Homo sapiens
atgtagacagtacac

SEQ ID NO: 77875 - DNA, 15 bp, Homo sapiens
catgtagacagtaca

SEQ ID NO: 77876 - DNA, 15 bp, Homo sapiens
acatgtagacagtac

SEQ ID NO: 77877 - DNA, 15 bp, Homo sapiens
aacatgtagacagta

SEQ ID NO: 77878 - DNA, 15 bp, Homo sapiens
gaacatgtagacagt

SEQ ID NO: 77879 - DNA, 15 bp, Homo sapiens
agaacatgtagacag

SEQ ID NO: 77880 - DNA, 15 bp, Homo sapiens
cagaacatgtagaca

SEQ ID NO: 77881 - DNA, 15 bp, Homo sapiens
acagaacatgtagac

SEQ ID NO: 77882 - DNA, 15 bp, Homo sapiens
gacagaacatgtaga

SEQ ID NO: 77883 - DNA, 15 bp, Homo sapiens
agacagaacatgtag

SEQ ID NO: 77884 - DNA, 15 bp, Homo sapiens
cagacagaacatgta

SEQ ID NO: 77885 - DNA, 15 bp, Homo sapiens
tcagacagaacatgt

SEQ ID NO: 77886 - DNA, 15 bp, Homo sapiens
atcagacagaacatg

SEQ ID NO: 77887 - DNA, 15 bp, Homo sapiens
catcagacagaacat

SEQ ID NO: 77888 - DNA, 15 bp, Homo sapiens
ccatcagacagaaca

SEQ ID NO: 77889 - DNA, 15 bp, Homo sapiens
gccatcagacagaac

SEQ ID NO: 77890 - DNA, 15 bp, Homo sapiens
tgccatcagacagaa

SEQ ID NO: 77891 - DNA, 15 bp, Homo sapiens
atgccatcagacaga

SEQ ID NO: 77892 - DNA, 15 bp, Homo sapiens
gatgccatcagacag

SEQ ID NO: 77893 - DNA, 15 bp, Homo sapiens
tgatgccatcagaca

SEQ ID NO: 77894 - DNA, 15 bp, Homo sapiens
atgatgccatcagac

SEQ ID NO: 77895 - DNA, 15 bp, Homo sapiens
aatgatgccatcaga

SEQ ID NO: 77896 - DNA, 15 bp, Homo sapiens
taatgatgccatcag

SEQ ID NO: 77897 - DNA, 15 bp, Homo sapiens
ataatgatgccatca

SEQ ID NO: 77898 - DNA, 15 bp, Homo sapiens
aataatgatgccatc

SEQ ID NO: 77899 - DNA, 15 bp, Homo sapiens
aaataatgatgccat

SEQ ID NO: 77900 - DNA, 15 bp, Homo sapiens
taaataatgatgcca

SEQ ID NO: 77901 - DNA, 15 bp, Homo sapiens
ataaataatgatgcc

SEQ ID NO: 77902 - DNA, 15 bp, Homo sapiens
cataaataatgatgc

SEQ ID NO: 77903 - DNA, 15 bp, Homo sapiens
acataaataatgatg

SEQ ID NO: 77904 - DNA, 15 bp, Homo sapiens
cacataaataatgat

SEQ ID NO: 77905 - DNA, 15 bp, Homo sapiens
gcacataaataatga

SEQ ID NO: 77906 - DNA, 15 bp, Homo sapiens
tgcacataaataatg

SEQ ID NO: 77907 - DNA, 15 bp, Homo sapiens
atgcacataaataat

SEQ ID NO: 77908 - DNA, 15 bp, Homo sapiens
tatgcacataaataa

SEQ ID NO: 77909 - DNA, 15 bp, Homo sapiens
atatgcacataaata

SEQ ID NO: 77910 - DNA, 15 bp, Homo sapiens
gatatgcacataaat

SEQ ID NO: 77911 - DNA, 15 bp, Homo sapiens
agatatgcacataaa

SEQ ID NO: 77912 - DNA, 15 bp, Homo sapiens
aagatatgcacataa

SEQ ID NO: 77913 - DNA, 15 bp, Homo sapiens
taagatatgcacata

SEQ ID NO: 77914 - DNA, 15 bp, Homo sapiens
gtaagatatgcacat

SEQ ID NO: 77915 - DNA, 15 bp, Homo sapiens
ggtaagatatgcaca

SEQ ID NO: 77916 - DNA, 15 bp, Homo sapiens
tggtaagatatgcac

SEQ ID NO: 77917 - DNA, 15 bp, Homo sapiens
ctggtaagatatgca

SEQ ID NO: 77918 - DNA, 15 bp, Homo sapiens
gctggtaagatatgc

SEQ ID NO: 77919 - DNA, 15 bp, Homo sapiens
ggctggtaagatatg

SEQ ID NO: 77920 - DNA, 15 bp, Homo sapiens
aggctggtaagatat

SEQ ID NO: 77921 - DNA, 15 bp, Homo sapiens
gaggctggtaagata

SEQ ID NO: 77922 - DNA, 15 bp, Homo sapiens
tgaggctggtaagat

SEQ ID NO: 77923 - DNA, 15 bp, Homo sapiens
gtgaggctggtaaga

SEQ ID NO: 77924 - DNA, 15 bp, Homo sapiens
agtgaggctggtaag

SEQ ID NO: 77925 - DNA, 15 bp, Homo sapiens
tagtgaggctggtaa

SEQ ID NO: 77926 - DNA, 15 bp, Homo sapiens
ctagtgaggctggta

SEQ ID NO: 77927 - DNA, 15 bp, Homo sapiens
tctagtgaggctggt

SEQ ID NO: 77928 - DNA, 15 bp, Homo sapiens
gtctagtgaggctgg

SEQ ID NO: 77929 - DNA, 15 bp, Homo sapiens
agtctagtgaggctg

SEQ ID NO: 77930 - DNA, 15 bp, Homo sapiens
cagtctagtgaggct

SEQ ID NO: 77931 - DNA, 15 bp, Homo sapiens
tcagtctagtgaggc

SEQ ID NO: 77932 - DNA, 15 bp, Homo sapiens
ctcagtctagtgagg

SEQ ID NO: 77933 - DNA, 15 bp, Homo sapiens
cctcagtctagtgag

SEQ ID NO: 77934 - DNA, 15 bp, Homo sapiens
tcctcagtctagtga

SEQ ID NO: 77935 - DNA, 15 bp, Homo sapiens
gtcctcagtctagtg

SEQ ID NO: 77936 - DNA, 15 bp, Homo sapiens
tgtcctcagtctagt

SEQ ID NO: 77937 - DNA, 15 bp, Homo sapiens
ctgtcctcagtctag

SEQ ID NO: 77938 - DNA, 15 bp, Homo sapiens
actgtcctcagtcta

SEQ ID NO: 77939 - DNA, 15 bp, Homo sapiens
tactgtcctcagtct

SEQ ID NO: 77940 - DNA, 15 bp, Homo sapiens
atactgtcctcagtc

SEQ ID NO: 77941 - DNA, 15 bp, Homo sapiens
gatactgtcctcagt

SEQ ID NO: 77942 - DNA, 15 bp, Homo sapiens
ggatactgtcctcag

SEQ ID NO: 77943 - DNA, 15 bp, Homo sapiens
tggatactgtcctca

SEQ ID NO: 77944 - DNA, 15 bp, Homo sapiens
atggatactgtcctc

SEQ ID NO: 77945 - DNA, 15 bp, Homo sapiens
aatggatactgtcct

SEQ ID NO: 77946 - DNA, 15 bp, Homo sapiens
caatggatactgtcc

SEQ ID NO: 77947 - DNA, 15 bp, Homo sapiens
ccaatggatactgtc

SEQ ID NO: 77948 - DNA, 15 bp, Homo sapiens
cccaatggatactgt

SEQ ID NO: 77949 - DNA, 15 bp, Homo sapiens
ccccaatggatactg

SEQ ID NO: 77950 - DNA, 15 bp, Homo sapiens
cccccaatggatact

SEQ ID NO: 77951 - DNA, 15 bp, Homo sapiens
ccccccaatggatac

SEQ ID NO: 77952 - DNA, 15 bp, Homo sapiens
accccccaatggata

SEQ ID NO: 77953 - DNA, 15 bp, Homo sapiens
caccccccaatggat

SEQ ID NO: 77954 - DNA, 15 bp, Homo sapiens
tcaccccccaatgga

SEQ ID NO: 77955 - DNA, 15 bp, Homo sapiens
ttcaccccccaatgg

SEQ ID NO: 77956 - DNA, 15 bp, Homo sapiens
tttcaccccccaatg

SEQ ID NO: 77957 - DNA, 15 bp, Homo sapiens
atttcaccccccaat

SEQ ID NO: 77958 - DNA, 15 bp, Homo sapiens
tatttcaccccccaa

SEQ ID NO: 77959 - DNA, 15 bp, Homo sapiens
atatttcacccccca

SEQ ID NO: 77960 - DNA, 15 bp, Homo sapiens
tatatttcacccccc

SEQ ID NO: 77961 - DNA, 15 bp, Homo sapiens
ctatatttcaccccc

SEQ ID NO: 77962 - DNA, 15 bp, Homo sapiens
tctatatttcacccc

SEQ ID NO: 77963 - DNA, 15 bp, Homo sapiens
ctctatatttcaccc

SEQ ID NO: 77964 - DNA, 15 bp, Homo sapiens
cctctatatttcacc

SEQ ID NO: 77965 - DNA, 15 bp, Homo sapiens
gcctctatatttcac

SEQ ID NO: 77966 - DNA, 15 bp, Homo sapiens
tgcctctatatttca

SEQ ID NO: 77967 - DNA, 15 bp, Homo sapiens
ttgcctctatatttc

SEQ ID NO: 77968 - DNA, 15 bp, Homo sapiens
cttgcctctatattt

SEQ ID NO: 77969 - DNA, 15 bp, Homo sapiens
ccttgcctctatatt

SEQ ID NO: 77970 - DNA, 15 bp, Homo sapiens
tccttgcctctatat

SEQ ID NO: 77971 - DNA, 15 bp, Homo sapiens
ttccttgcctctata

SEQ ID NO: 77972 - DNA, 15 bp, Homo sapiens
attccttgcctctat

SEQ ID NO: 77973 - DNA, 15 bp, Homo sapiens
tattccttgcctcta

SEQ ID NO: 77974 - DNA, 15 bp, Homo sapiens
ctattccttgcctct

SEQ ID NO: 77975 - DNA, 15 bp, Homo sapiens
actattccttgcctc

SEQ ID NO: 77976 - DNA, 15 bp, Homo sapiens
aactattccttgcct

SEQ ID NO: 77977 - DNA, 15 bp, Homo sapiens
caactattccttgcc

SEQ ID NO: 77978 - DNA, 15 bp, Homo sapiens
acaactattccttgc

SEQ ID NO: 77979 - DNA, 15 bp, Homo sapiens
aacaactattccttg

SEQ ID NO: 77980 - DNA, 15 bp, Homo sapiens
taacaactattcctt

SEQ ID NO: 77981 - DNA, 15 bp, Homo sapiens
ttaacaactattcct

SEQ ID NO: 77982 - DNA, 15 bp, Homo sapiens
tttaacaactattcc

SEQ ID NO: 77983 - DNA, 15 bp, Homo sapiens
atttaacaactattc

SEQ ID NO: 77984 - DNA, 15 bp, Homo sapiens
tatttaacaactatt

SEQ ID NO: 77985 - DNA, 15 bp, Homo sapiens
atatttaacaactat

SEQ ID NO: 77986 - DNA, 15 bp, Homo sapiens
aatatttaacaacta

SEQ ID NO: 77987 - DNA, 15 bp, Homo sapiens
aaatatttaacaact

SEQ ID NO: 77988 - DNA, 15 bp, Homo sapiens
taaatatttaacaac

SEQ ID NO: 77989 - DNA, 15 bp, Homo sapiens
ttaaatatttaacaa

SEQ ID NO: 77990 - DNA, 15 bp, Homo sapiens
attaaatatttaaca

SEQ ID NO: 77991 - DNA, 15 bp, Homo sapiens
aattaaatatttaac

SEQ ID NO: 77992 - DNA, 15 bp, Homo sapiens
gaattaaatatttaa

SEQ ID NO: 77993 - DNA, 15 bp, Homo sapiens
tgaattaaatattta

SEQ ID NO: 77994 - DNA, 15 bp, Homo sapiens
atgaattaaatattt

SEQ ID NO: 77995 - DNA, 15 bp, Homo sapiens
tatgaattaaatatt

SEQ ID NO: 77996 - DNA, 15 bp, Homo sapiens
ttatgaattaaatat

SEQ ID NO: 77997 - DNA, 15 bp, Homo sapiens
tttatgaattaaata

SEQ ID NO: 77998 - DNA, 15 bp, Homo sapiens
atttatgaattaaat

SEQ ID NO: 77999 - DNA, 15 bp, Homo sapiens
tatttatgaattaaa

SEQ ID NO: 78000 - DNA, 15 bp, Homo sapiens
ttatttatgaattaa

SEQ ID NO: 78001 - DNA, 15 bp, Homo sapiens
tttatttatgaatta

SEQ ID NO: 78002 - DNA, 15 bp, Homo sapiens
ttttatttatgaatt

SEQ ID NO: 78003 - DNA, 15 bp, Homo sapiens
attttatttatgaat

SEQ ID NO: 78004 - DNA, 15 bp, Homo sapiens
aattttatttatgaa

SEQ ID NO: 78005 - DNA, 15 bp, Homo sapiens
caattttatttatga

SEQ ID NO: 78006 - DNA, 15 bp, Homo sapiens
gcaattttatttatg

SEQ ID NO: 78007 - DNA, 15 bp, Homo sapiens
agcaattttatttat

SEQ ID NO: 78008 - DNA, 15 bp, Homo sapiens
cagcaattttattta

SEQ ID NO: 78009 - DNA, 15 bp, Homo sapiens
tcagcaattttattt

SEQ ID NO: 78010 - DNA, 15 bp, Homo sapiens
ctcagcaattttatt

SEQ ID NO: 78011 - DNA, 15 bp, Homo sapiens
tctcagcaattttat

SEQ ID NO: 78012 - DNA, 15 bp, Homo sapiens
ttctcagcaatttta

SEQ ID NO: 78013 - DNA, 15 bp, Homo sapiens
tttctcagcaatttt

SEQ ID NO: 78014 - DNA, 15 bp, Homo sapiens
ctttctcagcaattt

SEQ ID NO: 78015 - DNA, 15 bp, Homo sapiens
tctttctcagcaatt

SEQ ID NO: 78016 - DNA, 15 bp, Homo sapiens
ttctttctcagcaat

SEQ ID NO: 78017 - DNA, 15 bp, Homo sapiens
attctttctcagcaa

SEQ ID NO: 78018 - DNA, 15 bp, Homo sapiens
aattctttctcagca

SEQ ID NO: 78019 - DNA, 15 bp, Homo sapiens
caattctttctcagc

SEQ ID NO: 78020 - DNA, 15 bp, Homo sapiens
tcaattctttctcag

SEQ ID NO: 78021 - DNA, 15 bp, Homo sapiens
atcaattctttctca

SEQ ID NO: 78022 - DNA, 15 bp, Homo sapiens
aatcaattctttctc

SEQ ID NO: 78023 - DNA, 15 bp, Homo sapiens
gaatcaattctttct

SEQ ID NO: 78024 - DNA, 15 bp, Homo sapiens
ggaatcaattctttc

SEQ ID NO: 78025 - DNA, 15 bp, Homo sapiens
cggaatcaattcttt

SEQ ID NO: 78026 - DNA, 15 bp, Homo sapiens
acggaatcaattctt

SEQ ID NO: 78027 - DNA, 15 bp, Homo sapiens
aacggaatcaattct

SEQ ID NO: 78028 - DNA, 15 bp, Homo sapiens
caacggaatcaattc

SEQ ID NO: 78029 - DNA, 15 bp, Homo sapiens
gcaacggaatcaatt

SEQ ID NO: 78030 - DNA, 15 bp, Homo sapiens
tgcaacggaatcaat

SEQ ID NO: 78031 - DNA, 15 bp, Homo sapiens
ttgcaacggaatcaa

SEQ ID NO: 78032 - DNA, 15 bp, Homo sapiens
tttgcaacggaatca

SEQ ID NO: 78033 - DNA, 15 bp, Homo sapiens
atttgcaacggaatc

SEQ ID NO: 78034 - DNA, 15 bp, Homo sapiens
tatttgcaacggaat

SEQ ID NO: 78035 - DNA, 15 bp, Homo sapiens
gtatttgcaacggaa

SEQ ID NO: 78036 - DNA, 15 bp, Homo sapiens
tgtatttgcaacgga

SEQ ID NO: 78037 - DNA, 15 bp, Homo sapiens
ctgtatttgcaacgg

SEQ ID NO: 78038 - DNA, 15 bp, Homo sapiens
tctgtatttgcaacg

SEQ ID NO: 78039 - DNA, 15 bp, Homo sapiens
ttctgtatttgcaac

SEQ ID NO: 78040 - DNA, 15 bp, Homo sapiens
gttctgtatttgcaa

SEQ ID NO: 78041 - DNA, 15 bp, Homo sapiens
ggttctgtatttgca

SEQ ID NO: 78042 - DNA, 15 bp, Homo sapiens
tggttctgtatttgc

SEQ ID NO: 78043 - DNA, 15 bp, Homo sapiens
ttggttctgtatttg

SEQ ID NO: 78044 - DNA, 15 bp, Homo sapiens
cttggttctgtattt

SEQ ID NO: 78045 - DNA, 15 bp, Homo sapiens
acttggttctgtatt

SEQ ID NO: 78046 - DNA, 15 bp, Homo sapiens
aacttggttctgtat

SEQ ID NO: 78047 - DNA, 15 bp, Homo sapiens
caacttggttctgta

SEQ ID NO: 78048 - DNA, 15 bp, Homo sapiens
acaacttggttctgt

SEQ ID NO: 78049 - DNA, 15 bp, Homo sapiens
aacaacttggttctg

SEQ ID NO: 78050 - DNA, 15 bp, Homo sapiens
aaacaacttggttct

SEQ ID NO: 78051 - DNA, 15 bp, Homo sapiens
aaaacaacttggttc

SEQ ID NO: 78052 - DNA, 15 bp, Homo sapiens
gaaaacaacttggtt

SEQ ID NO: 78053 - DNA, 15 bp, Homo sapiens
ggaaaacaacttggt

SEQ ID NO: 78054 - DNA, 15 bp, Homo sapiens
aggaaaacaacttgg

SEQ ID NO: 78055 - DNA, 15 bp, Homo sapiens
gaggaaaacaacttg

SEQ ID NO: 78056 - DNA, 15 bp, Homo sapiens
ggaggaaaacaactt

SEQ ID NO: 78057 - DNA, 15 bp, Homo sapiens
gggaggaaaacaact

SEQ ID NO: 78058 - DNA, 15 bp, Homo sapiens
agggaggaaaacaac

SEQ ID NO: 78059 - DNA, 15 bp, Homo sapiens
tagggaggaaaacaa

SEQ ID NO: 78060 - DNA, 15 bp, Homo sapiens
gtagggaggaaaaca

SEQ ID NO: 78061 - DNA, 15 bp, Homo sapiens
agtagggaggaaaac

SEQ ID NO: 78062 - DNA, 15 bp, Homo sapiens
tagtagggaggaaaa

SEQ ID NO: 78063 - DNA, 15 bp, Homo sapiens
ttagtagggaggaaa

SEQ ID NO: 78064 - DNA, 15 bp, Homo sapiens
tttagtagggaggaa

SEQ ID NO: 78065 - DNA, 15 bp, Homo sapiens
atttagtagggagga

SEQ ID NO: 78066 - DNA, 15 bp, Homo sapiens
tatttagtagggagg

SEQ ID NO: 78067 - DNA, 15 bp, Homo sapiens
ctatttagtagggag

SEQ ID NO: 78068 - DNA, 15 bp, Homo sapiens
tctatttagtaggga

SEQ ID NO: 78069 - DNA, 15 bp, Homo sapiens
ttctatttagtaggg

SEQ ID NO: 78070 - DNA, 15 bp, Homo sapiens
tttctatttagtagg

SEQ ID NO: 78071 - DNA, 15 bp, Homo sapiens
ttttctatttagtag

SEQ ID NO: 78072 - DNA, 15 bp, Homo sapiens
cttttctatttagta

SEQ ID NO: 78073 - DNA, 15 bp, Homo sapiens
ccttttctatttagt

SEQ ID NO: 78074 - DNA, 15 bp, Homo sapiens
cccttttctatttag

SEQ ID NO: 78075 - DNA, 15 bp, Homo sapiens
acccttttctattta

SEQ ID NO: 78076 - DNA, 15 bp, Homo sapiens
aacccttttctattt

SEQ ID NO: 78077 - DNA, 15 bp, Homo sapiens
aaacccttttctatt

SEQ ID NO: 78078 - DNA, 15 bp, Homo sapiens
gaaacccttttctat

SEQ ID NO: 78079 - DNA, 15 bp, Homo sapiens
ggaaacccttttcta

SEQ ID NO: 78080 - DNA, 15 bp, Homo sapiens
tggaaacccttttct

SEQ ID NO: 78081 - DNA, 15 bp, Homo sapiens
gtggaaacccttttc

SEQ ID NO: 78082 - DNA, 15 bp, Homo sapiens
ggtggaaaccctttt

SEQ ID NO: 78083 - DNA, 15 bp, Homo sapiens
gggtggaaacccttt

SEQ ID NO: 78084 - DNA, 15 bp, Homo sapiens
agggtggaaaccctt

SEQ ID NO: 78085 - DNA, 15 bp, Homo sapiens
tagggtggaaaccct

SEQ ID NO: 78086 - DNA, 15 bp, Homo sapiens
ttagggtggaaaccc

SEQ ID NO: 78087 - DNA, 15 bp, Homo sapiens
tttagggtggaaacc

SEQ ID NO: 78088 - DNA, 15 bp, Homo sapiens
atttagggtggaaac

SEQ ID NO: 78089 - DNA, 15 bp, Homo sapiens
catttagggtggaaa

SEQ ID NO: 78090 - DNA, 15 bp, Homo sapiens
gcatttagggtggaa

SEQ ID NO: 78091 - DNA, 15 bp, Homo sapiens
agcatttagggtgga

SEQ ID NO: 78092 - DNA, 15 bp, Homo sapiens
tagcatttagggtgg

SEQ ID NO: 78093 - DNA, 15 bp, Homo sapiens
gtagcatttagggtg

SEQ ID NO: 78094 - DNA, 15 bp, Homo sapiens
tgtagcatttagggt

SEQ ID NO: 78095 - DNA, 15 bp, Homo sapiens
atgtagcatttaggg

SEQ ID NO: 78096 - DNA, 15 bp, Homo sapiens
aatgtagcatttagg

SEQ ID NO: 78097 - DNA, 15 bp, Homo sapiens
aaatgtagcatttag

SEQ ID NO: 78098 - DNA, 15 bp, Homo sapiens
aaaatgtagcattta

SEQ ID NO: 78099 - DNA, 15 bp, Homo sapiens
caaaatgtagcattt

SEQ ID NO: 78100 - DNA, 15 bp, Homo sapiens
ccaaaatgtagcatt

SEQ ID NO: 78101 - DNA, 15 bp, Homo sapiens
cccaaaatgtagcat

SEQ ID NO: 78102 - DNA, 15 bp, Homo sapiens
tcccaaaatgtagca

SEQ ID NO: 78103 - DNA, 15 bp, Homo sapiens
ctcccaaaatgtagc

SEQ ID NO: 78104 - DNA, 15 bp, Homo sapiens
tctcccaaaatgtag

SEQ ID NO: 78105 - DNA, 15 bp, Homo sapiens
ttctcccaaaatgta

SEQ ID NO: 78106 - DNA, 15 bp, Homo sapiens
tttctcccaaaatgt

SEQ ID NO: 78107 - DNA, 15 bp, Homo sapiens
atttctcccaaaatg

SEQ ID NO: 78108 - DNA, 15 bp, Homo sapiens
aatttctcccaaaat

SEQ ID NO: 78109 - DNA, 15 bp, Homo sapiens
taatttctcccaaaa

SEQ ID NO: 78110 - DNA, 15 bp, Homo sapiens
ataatttctcccaaa

SEQ ID NO: 78111 - DNA, 15 bp, Homo sapiens
gataatttctcccaa

SEQ ID NO: 78112 - DNA, 15 bp, Homo sapiens
tgataatttctccca

SEQ ID NO: 78113 - DNA, 15 bp, Homo sapiens
gtgataatttctccc

SEQ ID NO: 78114 - DNA, 15 bp, Homo sapiens
tgtgataatttctcc

SEQ ID NO: 78115 - DNA, 15 bp, Homo sapiens
ttgtgataatttctc

SEQ ID NO: 78116 - DNA, 15 bp, Homo sapiens
attgtgataatttct

SEQ ID NO: 78117 - DNA, 15 bp, Homo sapiens
cattgtgataatttc

SEQ ID NO: 78118 - DNA, 15 bp, Homo sapiens
acattgtgataattt

SEQ ID NO: 78119 - DNA, 15 bp, Homo sapiens
tacattgtgataatt

SEQ ID NO: 78120 - DNA, 15 bp, Homo sapiens
ctacattgtgataat

SEQ ID NO: 78121 - DNA, 15 bp, Homo sapiens
gctacattgtgataa

SEQ ID NO: 78122 - DNA, 15 bp, Homo sapiens
agctacattgtgata

SEQ ID NO: 78123 - DNA, 15 bp, Homo sapiens
tagctacattgtgat

SEQ ID NO: 78124 - DNA, 15 bp, Homo sapiens
gtagctacattgtga

SEQ ID NO: 78125 - DNA, 15 bp, Homo sapiens
cgtagctacattgtg

SEQ ID NO: 78126 - DNA, 15 bp, Homo sapiens
ccgtagctacattgt

SEQ ID NO: 78127 - DNA, 15 bp, Homo sapiens
accgtagctacattg

SEQ ID NO: 78128 - DNA, 15 bp, Homo sapiens
aaccgtagctacatt

SEQ ID NO: 78129 - DNA, 15 bp, Homo sapiens
caaccgtagctacat

SEQ ID NO: 78130 - DNA, 15 bp, Homo sapiens
acaaccgtagctaca

SEQ ID NO: 78131 - DNA, 15 bp, Homo sapiens
aacaaccgtagctac

SEQ ID NO: 78132 - DNA, 15 bp, Homo sapiens
aaacaaccgtagcta

SEQ ID NO: 78133 - DNA, 15 bp, Homo sapiens
aaaacaaccgtagct

SEQ ID NO: 78134 - DNA, 15 bp, Homo sapiens
gaaaacaaccgtagc

SEQ ID NO: 78135 - DNA, 15 bp, Homo sapiens
ggaaaacaaccgtag

SEQ ID NO: 78136 - DNA, 15 bp, Homo sapiens
tggaaaacaaccgta

SEQ ID NO: 78137 - DNA, 15 bp, Homo sapiens
atggaaaacaaccgt

SEQ ID NO: 78138 - DNA, 15 bp, Homo sapiens
gatggaaaacaaccg

SEQ ID NO: 78139 - DNA, 15 bp, Homo sapiens
ggatggaaaacaacc

SEQ ID NO: 78140 - DNA, 15 bp, Homo sapiens
gggatggaaaacaac

SEQ ID NO: 78141 - DNA, 15 bp, Homo sapiens
agggatggaaaacaa

SEQ ID NO: 78142 - DNA, 15 bp, Homo sapiens
aagggatggaaaaca

SEQ ID NO: 78143 - DNA, 15 bp, Homo sapiens
gaagggatggaaaac

SEQ ID NO: 78144 - DNA, 15 bp, Homo sapiens
agaagggatggaaaa

SEQ ID NO: 78145 - DNA, 15 bp, Homo sapiens
aagaagggatggaaa

SEQ ID NO: 78146 - DNA, 15 bp, Homo sapiens
gaagaagggatggaa

SEQ ID NO: 78147 - DNA, 15 bp, Homo sapiens
tgaagaagggatgga

SEQ ID NO: 78148 - DNA, 15 bp, Homo sapiens
ctgaagaagggatgg

SEQ ID NO: 78149 - DNA, 15 bp, Homo sapiens
cctgaagaagggatg

SEQ ID NO: 78150 - DNA, 15 bp, Homo sapiens
tcctgaagaagggat

SEQ ID NO: 78151 - DNA, 15 bp, Homo sapiens
atcctgaagaaggga

SEQ ID NO: 78152 - DNA, 15 bp, Homo sapiens
aatcctgaagaaggg

SEQ ID NO: 78153 - DNA, 15 bp, Homo sapiens
taatcctgaagaagg

SEQ ID NO: 78154 - DNA, 15 bp, Homo sapiens
ataatcctgaagaag

SEQ ID NO: 78155 - DNA, 15 bp, Homo sapiens
gataatcctgaagaa

SEQ ID NO: 78156 - DNA, 15 bp, Homo sapiens
agataatcctgaaga

SEQ ID NO: 78157 - DNA, 15 bp, Homo sapiens
gagataatcctgaag

SEQ ID NO: 78158 - DNA, 15 bp, Homo sapiens
agagataatcctgaa

SEQ ID NO: 78159 - DNA, 15 bp, Homo sapiens
gagagataatcctga

SEQ ID NO: 78160 - DNA, 15 bp, Homo sapiens
agagagataatcctg

SEQ ID NO: 78161 - DNA, 15 bp, Homo sapiens
tagagagataatcct

SEQ ID NO: 78162 - DNA, 15 bp, Homo sapiens
gtagagagataatcc

SEQ ID NO: 78163 - DNA, 15 bp, Homo sapiens
tgtagagagataatc

SEQ ID NO: 78164 - DNA, 15 bp, Homo sapiens
atgtagagagataat

SEQ ID NO: 78165 - DNA, 15 bp, Homo sapiens
catgtagagagataa

SEQ ID NO: 78166 - DNA, 15 bp, Homo sapiens
tcatgtagagagata

SEQ ID NO: 78167 - DNA, 15 bp, Homo sapiens
gtcatgtagagagat

SEQ ID NO: 78168 - DNA, 15 bp, Homo sapiens
agtcatgtagagaga

SEQ ID NO: 78169 - DNA, 15 bp, Homo sapiens
cagtcatgtagagag

SEQ ID NO: 78170 - DNA, 15 bp, Homo sapiens
tcagtcatgtagaga

SEQ ID NO: 78171 - DNA, 15 bp, Homo sapiens
ttcagtcatgtagag

SEQ ID NO: 78172 - DNA, 15 bp, Homo sapiens
attcagtcatgtaga

SEQ ID NO: 78173 - DNA, 15 bp, Homo sapiens
tattcagtcatgtag

SEQ ID NO: 78174 - DNA, 15 bp, Homo sapiens
atattcagtcatgta

SEQ ID NO: 78175 - DNA, 15 bp, Homo sapiens
gatattcagtcatgt

SEQ ID NO: 78176 - DNA, 15 bp, Homo sapiens
ggatattcagtcatg

SEQ ID NO: 78177 - DNA, 15 bp, Homo sapiens
aggatattcagtcat

SEQ ID NO: 78178 - DNA, 15 bp, Homo sapiens
gaggatattcagtca

SEQ ID NO: 78179 - DNA, 15 bp, Homo sapiens
agaggatattcagtc

SEQ ID NO: 78180 - DNA, 15 bp, Homo sapiens
cagaggatattcagt

SEQ ID NO: 78181 - DNA, 15 bp, Homo sapiens
gcagaggatattcag

SEQ ID NO: 78182 - DNA, 15 bp, Homo sapiens
agcagaggatattca

SEQ ID NO: 78183 - DNA, 15 bp, Homo sapiens
aagcagaggatattc

SEQ ID NO: 78184 - DNA, 15 bp, Homo sapiens
taagcagaggatatt

SEQ ID NO: 78185 - DNA, 15 bp, Homo sapiens
ctaagcagaggatat

SEQ ID NO: 78186 - DNA, 15 bp, Homo sapiens
tctaagcagaggata

SEQ ID NO: 78187 - DNA, 15 bp, Homo sapiens
ttctaagcagaggat

SEQ ID NO: 78188 - DNA, 15 bp, Homo sapiens
tttctaagcagagga

SEQ ID NO: 78189 - DNA, 15 bp, Homo sapiens
ttttctaagcagagg

SEQ ID NO: 78190 - DNA, 15 bp, Homo sapiens
gttttctaagcagag

SEQ ID NO: 78191 - DNA, 15 bp, Homo sapiens
tgttttctaagcaga

SEQ ID NO: 78192 - DNA, 15 bp, Homo sapiens
gtgttttctaagcag

SEQ ID NO: 78193 - DNA, 15 bp, Homo sapiens
tgtgttttctaagca

SEQ ID NO: 78194 - DNA, 15 bp, Homo sapiens
gtgtgttttctaagc

SEQ ID NO: 78195 - DNA, 15 bp, Homo sapiens
tgtgtgttttctaag

SEQ ID NO: 78196 - DNA, 15 bp, Homo sapiens
atgtgtgttttctaa

SEQ ID NO: 78197 - DNA, 15 bp, Homo sapiens
aatgtgtgttttcta

SEQ ID NO: 78198 - DNA, 15 bp, Homo sapiens
caatgtgtgttttct

SEQ ID NO: 78199 - DNA, 15 bp, Homo sapiens
acaatgtgtgttttc

SEQ ID NO: 78200 - DNA, 15 bp, Homo sapiens
aacaatgtgtgtttt

SEQ ID NO: 78201 - DNA, 15 bp, Homo sapiens
caacaatgtgtgttt

SEQ ID NO: 78202 - DNA, 15 bp, Homo sapiens
acaacaatgtgtgtt

SEQ ID NO: 78203 - DNA, 15 bp, Homo sapiens
gacaacaatgtgtgt

SEQ ID NO: 78204 - DNA, 15 bp, Homo sapiens
ggacaacaatgtgtg

SEQ ID NO: 78205 - DNA, 15 bp, Homo sapiens
tggacaacaatgtgt

SEQ ID NO: 78206 - DNA, 15 bp, Homo sapiens
ttggacaacaatgtg

SEQ ID NO: 78207 - DNA, 15 bp, Homo sapiens
attggacaacaatgt

SEQ ID NO: 78208 - DNA, 15 bp, Homo sapiens
cattggacaacaatg

SEQ ID NO: 78209 - DNA, 15 bp, Homo sapiens
tcattggacaacaat

SEQ ID NO: 78210 - DNA, 15 bp, Homo sapiens
ttcattggacaacaa

SEQ ID NO: 78211 - DNA, 15 bp, Homo sapiens
cttcattggacaaca

SEQ ID NO: 78212 - DNA, 15 bp, Homo sapiens
acttcattggacaac

SEQ ID NO: 78213 - DNA, 15 bp, Homo sapiens
aacttcattggacaa

SEQ ID NO: 78214 - DNA, 15 bp, Homo sapiens
caacttcattggaca

SEQ ID NO: 78215 - DNA, 15 bp, Homo sapiens
tcaacttcattggac

SEQ ID NO: 78216 - DNA, 15 bp, Homo sapiens
ttcaacttcattgga

SEQ ID NO: 78217 - DNA, 15 bp, Homo sapiens
tttcaacttcattgg

SEQ ID NO: 78218 - DNA, 15 bp, Homo sapiens
ttttcaacttcattg

SEQ ID NO: 78219 - DNA, 15 bp, Homo sapiens
tttttcaacttcatt

SEQ ID NO: 78220 - DNA, 15 bp, Homo sapiens
atttttcaacttcat

SEQ ID NO: 78221 - DNA, 15 bp, Homo sapiens
gatttttcaacttca

SEQ ID NO: 78222 - DNA, 15 bp, Homo sapiens
agatttttcaacttc

SEQ ID NO: 78223 - DNA, 15 bp, Homo sapiens
aagatttttcaactt

SEQ ID NO: 78224 - DNA, 15 bp, Homo sapiens
aaagatttttcaact

SEQ ID NO: 78225 - DNA, 15 bp, Homo sapiens
taaagatttttcaac

SEQ ID NO: 78226 - DNA, 15 bp, Homo sapiens
ataaagatttttcaa

SEQ ID NO: 78227 - DNA, 15 bp, Homo sapiens
tataaagatttttca

SEQ ID NO: 78228 - DNA, 15 bp, Homo sapiens
atataaagatttttc

SEQ ID NO: 78229 - DNA, 15 bp, Homo sapiens
catataaagattttt

SEQ ID NO: 78230 - DNA, 15 bp, Homo sapiens
ccatataaagatttt

SEQ ID NO: 78231 - DNA, 15 bp, Homo sapiens
cccatataaagattt

SEQ ID NO: 78232 - DNA, 15 bp, Homo sapiens
gcccatataaagatt

SEQ ID NO: 78233 - DNA, 15 bp, Homo sapiens
agcccatataaagat

SEQ ID NO: 78234 - DNA, 15 bp, Homo sapiens
aagcccatataaaga

SEQ ID NO: 78235 - DNA, 15 bp, Homo sapiens
aaagcccatataaag

SEQ ID NO: 78236 - DNA, 15 bp, Homo sapiens
caaagcccatataaa

SEQ ID NO: 78237 - DNA, 15 bp, Homo sapiens
ccaaagcccatataa

SEQ ID NO: 78238 - DNA, 15 bp, Homo sapiens
cccaaagcccatata

SEQ ID NO: 78239 - DNA, 15 bp, Homo sapiens
acccaaagcccatat

SEQ ID NO: 78240 - DNA, 15 bp, Homo sapiens
cacccaaagcccata

SEQ ID NO: 78241 - DNA, 15 bp, Homo sapiens
gcacccaaagcccat

SEQ ID NO: 78242 - DNA, 15 bp, Homo sapiens
agcacccaaagccca

SEQ ID NO: 78243 - DNA, 15 bp, Homo sapiens
gagcacccaaagccc

SEQ ID NO: 78244 - DNA, 15 bp, Homo sapiens
agagcacccaaagcc

SEQ ID NO: 78245 - DNA, 15 bp, Homo sapiens
aagagcacccaaagc

SEQ ID NO: 78246 - DNA, 15 bp, Homo sapiens
gaagagcacccaaag

SEQ ID NO: 78247 - DNA, 15 bp, Homo sapiens
tgaagagcacccaaa

SEQ ID NO: 78248 - DNA, 15 bp, Homo sapiens
ctgaagagcacccaa

SEQ ID NO: 78249 - DNA, 15 bp, Homo sapiens
tctgaagagcaccca

SEQ ID NO: 78250 - DNA, 15 bp, Homo sapiens
gtctgaagagcaccc

SEQ ID NO: 78251 - DNA, 15 bp, Homo sapiens
agtctgaagagcacc

SEQ ID NO: 78252 - DNA, 15 bp, Homo sapiens
gagtctgaagagcac

SEQ ID NO: 78253 - DNA, 15 bp, Homo sapiens
ggagtctgaagagca

SEQ ID NO: 78254 - DNA, 15 bp, Homo sapiens
gggagtctgaagagc

SEQ ID NO: 78255 - DNA, 15 bp, Homo sapiens
agggagtctgaagag

SEQ ID NO: 78256 - DNA, 15 bp, Homo sapiens
gagggagtctgaaga

SEQ ID NO: 78257 - DNA, 15 bp, Homo sapiens
ggagggagtctgaag

SEQ ID NO: 78258 - DNA, 15 bp, Homo sapiens
aggagggagtctgaa

SEQ ID NO: 78259 - DNA, 15 bp, Homo sapiens
aaggagggagtctga

SEQ ID NO: 78260 - DNA, 15 bp, Homo sapiens
aaaggagggagtctg

SEQ ID NO: 78261 - DNA, 15 bp, Homo sapiens
taaaggagggagtct

SEQ ID NO: 78262 - DNA, 15 bp, Homo sapiens
ttaaaggagggagtc

SEQ ID NO: 78263 - DNA, 15 bp, Homo sapiens
attaaaggagggagt

SEQ ID NO: 78264 - DNA, 15 bp, Homo sapiens
gattaaaggagggag

SEQ ID NO: 78265 - DNA, 15 bp, Homo sapiens
tgattaaaggaggga

SEQ ID NO: 78266 - DNA, 15 bp, Homo sapiens
atgattaaaggaggg

SEQ ID NO: 78267 - DNA, 15 bp, Homo sapiens
tatgattaaaggagg

SEQ ID NO: 78268 - DNA, 15 bp, Homo sapiens
ttatgattaaaggag

SEQ ID NO: 78269 - DNA, 15 bp, Homo sapiens
attatgattaaagga

SEQ ID NO: 78270 - DNA, 15 bp, Homo sapiens
aattatgattaaagg

SEQ ID NO: 78271 - DNA, 15 bp, Homo sapiens
caattatgattaaag

SEQ ID NO: 78272 - DNA, 15 bp, Homo sapiens
gcaattatgattaaa

SEQ ID NO: 78273 - DNA, 15 bp, Homo sapiens
agcaattatgattaa

SEQ ID NO: 78274 - DNA, 15 bp, Homo sapiens
cagcaattatgatta

SEQ ID NO: 78275 - DNA, 15 bp, Homo sapiens
acagcaattatgatt

SEQ ID NO: 78276 - DNA, 15 bp, Homo sapiens
aacagcaattatgat

SEQ ID NO: 78277 - DNA, 15 bp, Homo sapiens
caacagcaattatga

SEQ ID NO: 78278 - DNA, 15 bp, Homo sapiens
tcaacagcaattatg

SEQ ID NO: 78279 - DNA, 15 bp, Homo sapiens
ttcaacagcaattat

SEQ ID NO: 78280 - DNA, 15 bp, Homo sapiens
gttcaacagcaatta

SEQ ID NO: 78281 - DNA, 15 bp, Homo sapiens
ggttcaacagcaatt

SEQ ID NO: 78282 - DNA, 15 bp, Homo sapiens
aggttcaacagcaat

SEQ ID NO: 78283 - DNA, 15 bp, Homo sapiens
aaggttcaacagcaa

SEQ ID NO: 78284 - DNA, 15 bp, Homo sapiens
caaggttcaacagca

SEQ ID NO: 78285 - DNA, 15 bp, Homo sapiens
tcaaggttcaacagc

SEQ ID NO: 78286 - DNA, 15 bp, Homo sapiens
ttcaaggttcaacag

SEQ ID NO: 78287 - DNA, 15 bp, Homo sapiens
attcaaggttcaaca

SEQ ID NO: 78288 - DNA, 15 bp, Homo sapiens
cattcaaggttcaac

SEQ ID NO: 78289 - DNA, 15 bp, Homo sapiens
gcattcaaggttcaa

SEQ ID NO: 78290 - DNA, 15 bp, Homo sapiens
agcattcaaggttca

SEQ ID NO: 78291 - DNA, 15 bp, Homo sapiens
tagcattcaaggttc

SEQ ID NO: 78292 - DNA, 15 bp, Homo sapiens
ctagcattcaaggtt

SEQ ID NO: 78293 - DNA, 15 bp, Homo sapiens
actagcattcaaggt

SEQ ID NO: 78294 - DNA, 15 bp, Homo sapiens
cactagcattcaagg

SEQ ID NO: 78295 - DNA, 15 bp, Homo sapiens
acactagcattcaag

SEQ ID NO: 78296 - DNA, 15 bp, Homo sapiens
cacactagcattcaa

SEQ ID NO: 78297 - DNA, 15 bp, Homo sapiens
ccacactagcattca

SEQ ID NO: 78298 - DNA, 15 bp, Homo sapiens
tccacactagcattc

SEQ ID NO: 78299 - DNA, 15 bp, Homo sapiens
atccacactagcatt

SEQ ID NO: 78300 - DNA, 15 bp, Homo sapiens
aatccacactagcat

SEQ ID NO: 78301 - DNA, 15 bp, Homo sapiens
aaatccacactagca

SEQ ID NO: 78302 - DNA, 15 bp, Homo sapiens
gaaatccacactagc

SEQ ID NO: 78303 - DNA, 15 bp, Homo sapiens
ggaaatccacactag

SEQ ID NO: 78304 - DNA, 15 bp, Homo sapiens
aggaaatccacacta

SEQ ID NO: 78305 - DNA, 15 bp, Homo sapiens
taggaaatccacact

SEQ ID NO: 78306 - DNA, 15 bp, Homo sapiens
gtaggaaatccacac

SEQ ID NO: 78307 - DNA, 15 bp, Homo sapiens
tgtaggaaatccaca

SEQ ID NO: 78308 - DNA, 15 bp, Homo sapiens
atgtaggaaatccac

SEQ ID NO: 78309 - DNA, 15 bp, Homo sapiens
catgtaggaaatcca

SEQ ID NO: 78310 - DNA, 15 bp, Homo sapiens
tcatgtaggaaatcc

SEQ ID NO: 78311 - DNA, 15 bp, Homo sapiens
atcatgtaggaaatc

SEQ ID NO: 78312 - DNA, 15 bp, Homo sapiens
catcatgtaggaaat

SEQ ID NO: 78313 - DNA, 15 bp, Homo sapiens
gcatcatgtaggaaa

SEQ ID NO: 78314 - DNA, 15 bp, Homo sapiens
ggcatcatgtaggaa

SEQ ID NO: 78315 - DNA, 15 bp, Homo sapiens
tggcatcatgtagga

SEQ ID NO: 78316 - DNA, 15 bp, Homo sapiens
atggcatcatgtagg

SEQ ID NO: 78317 - DNA, 15 bp, Homo sapiens
catggcatcatgtag

SEQ ID NO: 78318 - DNA, 15 bp, Homo sapiens
ccatggcatcatgta

SEQ ID NO: 78319 - DNA, 15 bp, Homo sapiens
tccatggcatcatgt

SEQ ID NO: 78320 - DNA, 15 bp, Homo sapiens
ttccatggcatcatg

SEQ ID NO: 78321 - DNA, 15 bp, Homo sapiens
tttccatggcatcat

SEQ ID NO: 78322 - DNA, 15 bp, Homo sapiens
ttttccatggcatca

SEQ ID NO: 78323 - DNA, 15 bp, Homo sapiens
gttttccatggcatc

SEQ ID NO: 78324 - DNA, 15 bp, Homo sapiens
tgttttccatggcat

SEQ ID NO: 78325 - DNA, 15 bp, Homo sapiens
gtgttttccatggca

SEQ ID NO: 78326 - DNA, 15 bp, Homo sapiens
agtgttttccatggc

SEQ ID NO: 78327 - DNA, 15 bp, Homo sapiens
cagtgttttccatgg

SEQ ID NO: 78328 - DNA, 15 bp, Homo sapiens
ccagtgttttccatg

SEQ ID NO: 78329 - DNA, 15 bp, Homo sapiens
accagtgttttccat

SEQ ID NO: 78330 - DNA, 15 bp, Homo sapiens
aaccagtgttttcca

SEQ ID NO: 78331 - DNA, 15 bp, Homo sapiens
aaaccagtgttttcc

SEQ ID NO: 78332 - DNA, 15 bp, Homo sapiens
aaaaccagtgttttc

SEQ ID NO: 78333 - DNA, 15 bp, Homo sapiens
caaaaccagtgtttt

SEQ ID NO: 78334 - DNA, 15 bp, Homo sapiens
ccaaaaccagtgttt

SEQ ID NO: 78335 - DNA, 15 bp, Homo sapiens
cccaaaaccagtgtt

SEQ ID NO: 78336 - DNA, 15 bp, Homo sapiens
ccccaaaaccagtgt

SEQ ID NO: 78337 - DNA, 15 bp, Homo sapiens
accccaaaaccagtg

SEQ ID NO: 78338 - DNA, 15 bp, Homo sapiens
caccccaaaaccagt

SEQ ID NO: 78339 - DNA, 15 bp, Homo sapiens
acaccccaaaaccag

SEQ ID NO: 78340 - DNA, 15 bp, Homo sapiens
cacaccccaaaacca

SEQ ID NO: 78341 - DNA, 15 bp, Homo sapiens
ccacaccccaaaacc

SEQ ID NO: 78342 - DNA, 15 bp, Homo sapiens
tccacaccccaaaac

SEQ ID NO: 78343 - DNA, 15 bp, Homo sapiens
gtccacaccccaaaa

SEQ ID NO: 78344 - DNA, 15 bp, Homo sapiens
ggtccacaccccaaa

SEQ ID NO: 78345 - DNA, 15 bp, Homo sapiens
gggtccacaccccaa

SEQ ID NO: 78346 - DNA, 15 bp, Homo sapiens
agggtccacacccca

SEQ ID NO: 78347 - DNA, 15 bp, Homo sapiens
cagggtccacacccc

SEQ ID NO: 78348 - DNA, 15 bp, Homo sapiens
ccagggtccacaccc

SEQ ID NO: 78349 - DNA, 15 bp, Homo sapiens
tccagggtccacacc

SEQ ID NO: 78350 - DNA, 15 bp, Homo sapiens
gtccagggtccacac

SEQ ID NO: 78351 - DNA, 15 bp, Homo sapiens
ggtccagggtccaca

SEQ ID NO: 78352 - DNA, 15 bp, Homo sapiens
gggtccagggtccac

SEQ ID NO: 78353 - DNA, 15 bp, Homo sapiens
tgggtccagggtcca

SEQ ID NO: 78354 - DNA, 15 bp, Homo sapiens
ctgggtccagggtcc

SEQ ID NO: 78355 - DNA, 15 bp, Homo sapiens
gctgggtccagggtc

SEQ ID NO: 78356 - DNA, 15 bp, Homo sapiens
agctgggtccagggt

SEQ ID NO: 78357 - DNA, 15 bp, Homo sapiens
gagctgggtccaggg

SEQ ID NO: 78358 - DNA, 15 bp, Homo sapiens
agagctgggtccagg

SEQ ID NO: 78359 - DNA, 15 bp, Homo sapiens
cagagctgggtccag

SEQ ID NO: 78360 - DNA, 15 bp, Homo sapiens
gcagagctgggtcca

SEQ ID NO: 78361 - DNA, 15 bp, Homo sapiens
ggcagagctgggtcc

SEQ ID NO: 78362 - DNA, 15 bp, Homo sapiens
tggcagagctgggtc

SEQ ID NO: 78363 - DNA, 15 bp, Homo sapiens
atggcagagctgggt

SEQ ID NO: 78364 - DNA, 15 bp, Homo sapiens
aatggcagagctggg

SEQ ID NO: 78365 - DNA, 15 bp, Homo sapiens
taatggcagagctgg

SEQ ID NO: 78366 - DNA, 15 bp, Homo sapiens
ttaatggcagagctg

SEQ ID NO: 78367 - DNA, 15 bp, Homo sapiens
gttaatggcagagct

SEQ ID NO: 78368 - DNA, 15 bp, Homo sapiens
agttaatggcagagc

SEQ ID NO: 78369 - DNA, 15 bp, Homo sapiens
tagttaatggcagag

SEQ ID NO: 78370 - DNA, 15 bp, Homo sapiens
atagttaatggcaga

SEQ ID NO: 78371 - DNA, 15 bp, Homo sapiens
gatagttaatggcag

SEQ ID NO: 78372 - DNA, 15 bp, Homo sapiens
ggatagttaatggca

SEQ ID NO: 78373 - DNA, 15 bp, Homo sapiens
tggatagttaatggc

SEQ ID NO: 78374 - DNA, 15 bp, Homo sapiens
ttggatagttaatgg

SEQ ID NO: 78375 - DNA, 15 bp, Homo sapiens
cttggatagttaatg

SEQ ID NO: 78376 - DNA, 15 bp, Homo sapiens
acttggatagttaat

SEQ ID NO: 78377 - DNA, 15 bp, Homo sapiens
cacttggatagttaa

SEQ ID NO: 78378 - DNA, 15 bp, Homo sapiens
tcacttggatagtta

SEQ ID NO: 78379 - DNA, 15 bp, Homo sapiens
atcacttggatagtt

SEQ ID NO: 78380 - DNA, 15 bp, Homo sapiens
gatcacttggatagt

SEQ ID NO: 78381 - DNA, 15 bp, Homo sapiens
agatcacttggatag

SEQ ID NO: 78382 - DNA, 15 bp, Homo sapiens
cagatcacttggata

SEQ ID NO: 78383 - DNA, 15 bp, Homo sapiens
ccagatcacttggat

SEQ ID NO: 78384 - DNA, 15 bp, Homo sapiens
cccagatcacttgga

SEQ ID NO: 78385 - DNA, 15 bp, Homo sapiens
tcccagatcacttgg

SEQ ID NO: 78386 - DNA, 15 bp, Homo sapiens
gtcccagatcacttg

SEQ ID NO: 78387 - DNA, 15 bp, Homo sapiens
tgtcccagatcactt

SEQ ID NO: 78388 - DNA, 15 bp, Homo sapiens
atgtcccagatcact

SEQ ID NO: 78389 - DNA, 15 bp, Homo sapiens
catgtcccagatcac

SEQ ID NO: 78390 - DNA, 15 bp, Homo sapiens
acatgtcccagatca

SEQ ID NO: 78391 - DNA, 15 bp, Homo sapiens
tacatgtcccagatc

SEQ ID NO: 78392 - DNA, 15 bp, Homo sapiens
ttacatgtcccagat

SEQ ID NO: 78393 - DNA, 15 bp, Homo sapiens
gttacatgtcccaga

SEQ ID NO: 78394 - DNA, 15 bp, Homo sapiens
agttacatgtcccag

SEQ ID NO: 78395 - DNA, 15 bp, Homo sapiens
aagttacatgtccca

SEQ ID NO: 78396 - DNA, 15 bp, Homo sapiens
caagttacatgtccc

SEQ ID NO: 78397 - DNA, 15 bp, Homo sapiens
tcaagttacatgtcc

SEQ ID NO: 78398 - DNA, 15 bp, Homo sapiens
gtcaagttacatgtc

SEQ ID NO: 78399 - DNA, 15 bp, Homo sapiens
agtcaagttacatgt

SEQ ID NO: 78400 - DNA, 15 bp, Homo sapiens
aagtcaagttacatg

SEQ ID NO: 78401 - DNA, 15 bp, Homo sapiens
gaagtcaagttacat

SEQ ID NO: 78402 - DNA, 15 bp, Homo sapiens
agaagtcaagttaca

SEQ ID NO: 78403 - DNA, 15 bp, Homo sapiens
gagaagtcaagttac

SEQ ID NO: 78404 - DNA, 15 bp, Homo sapiens
agagaagtcaagtta

SEQ ID NO: 78405 - DNA, 15 bp, Homo sapiens
aagagaagtcaagtt

SEQ ID NO: 78406 - DNA, 15 bp, Homo sapiens
aaagagaagtcaagt

SEQ ID NO: 78407 - DNA, 15 bp, Homo sapiens
gaaagagaagtcaag

SEQ ID NO: 78408 - DNA, 15 bp, Homo sapiens
ggaaagagaagtcaa

SEQ ID NO: 78409 - DNA, 15 bp, Homo sapiens
aggaaagagaagtca

SEQ ID NO: 78410 - DNA, 15 bp, Homo sapiens
aaggaaagagaagtc

SEQ ID NO: 78411 - DNA, 15 bp, Homo sapiens
gaaggaaagagaagt

SEQ ID NO: 78412 - DNA, 15 bp, Homo sapiens
ggaaggaaagagaag

SEQ ID NO: 78413 - DNA, 15 bp, Homo sapiens
aggaaggaaagagaa

SEQ ID NO: 78414 - DNA, 15 bp, Homo sapiens
aaggaaggaaagaga

SEQ ID NO: 78415 - DNA, 15 bp, Homo sapiens
aaaggaaggaaagag

SEQ ID NO: 78416 - DNA, 15 bp, Homo sapiens
gaaaggaaggaaaga

SEQ ID NO: 78417 - DNA, 15 bp, Homo sapiens
agaaaggaaggaaag

SEQ ID NO: 78418 - DNA, 15 bp, Homo sapiens
tagaaaggaaggaaa

SEQ ID NO: 78419 - DNA, 15 bp, Homo sapiens
ttagaaaggaaggaa

SEQ ID NO: 78420 - DNA, 15 bp, Homo sapiens
tttagaaaggaagga

SEQ ID NO: 78421 - DNA, 15 bp, Homo sapiens
ttttagaaaggaagg

SEQ ID NO: 78422 - DNA, 15 bp, Homo sapiens
attttagaaaggaag

SEQ ID NO: 78423 - DNA, 15 bp, Homo sapiens
cattttagaaaggaa

SEQ ID NO: 78424 - DNA, 15 bp, Homo sapiens
tcattttagaaagga

SEQ ID NO: 78425 - DNA, 15 bp, Homo sapiens
ctcattttagaaagg

SEQ ID NO: 78426 - DNA, 15 bp, Homo sapiens
cctcattttagaaag

SEQ ID NO: 78427 - DNA, 15 bp, Homo sapiens
ccctcattttagaaa

SEQ ID NO: 78428 - DNA, 15 bp, Homo sapiens
cccctcattttagaa

SEQ ID NO: 78429 - DNA, 15 bp, Homo sapiens
gcccctcattttaga

SEQ ID NO: 78430 - DNA, 15 bp, Homo sapiens
agcccctcattttag

SEQ ID NO: 78431 - DNA, 15 bp, Homo sapiens
cagcccctcatttta

SEQ ID NO: 78432 - DNA, 15 bp, Homo sapiens
ccagcccctcatttt

SEQ ID NO: 78433 - DNA, 15 bp, Homo sapiens
cccagcccctcattt

SEQ ID NO: 78434 - DNA, 15 bp, Homo sapiens
tcccagcccctcatt

SEQ ID NO: 78435 - DNA, 15 bp, Homo sapiens
gtcccagcccctcat

SEQ ID NO: 78436 - DNA, 15 bp, Homo sapiens
tgtcccagcccctca

SEQ ID NO: 78437 - DNA, 15 bp, Homo sapiens
ttgtcccagcccctc

SEQ ID NO: 78438 - DNA, 15 bp, Homo sapiens
cttgtcccagcccct

SEQ ID NO: 78439 - DNA, 15 bp, Homo sapiens
tcttgtcccagcccc

SEQ ID NO: 78440 - DNA, 15 bp, Homo sapiens
gtcttgtcccagccc

SEQ ID NO: 78441 - DNA, 15 bp, Homo sapiens
tgtcttgtcccagcc

SEQ ID NO: 78442 - DNA, 15 bp, Homo sapiens
ttgtcttgtcccagc

SEQ ID NO: 78443 - DNA, 15 bp, Homo sapiens
attgtcttgtcccag

SEQ ID NO: 78444 - DNA, 15 bp, Homo sapiens
gattgtcttgtccca

SEQ ID NO: 78445 - DNA, 15 bp, Homo sapiens
agattgtcttgtccc

SEQ ID NO: 78446 - DNA, 15 bp, Homo sapiens
gagattgtcttgtcc

SEQ ID NO: 78447 - DNA, 15 bp, Homo sapiens
ggagattgtcttgtc

SEQ ID NO: 78448 - DNA, 15 bp, Homo sapiens
cggagattgtcttgt

SEQ ID NO: 78449 - DNA, 15 bp, Homo sapiens
tcggagattgtcttg

SEQ ID NO: 78450 - DNA, 15 bp, Homo sapiens
ctcggagattgtctt

SEQ ID NO: 78451 - DNA, 15 bp, Homo sapiens
gctcggagattgtct

SEQ ID NO: 78452 - DNA, 15 bp, Homo sapiens
agctcggagattgtc

SEQ ID NO: 78453 - DNA, 15 bp, Homo sapiens
aagctcggagattgt

SEQ ID NO: 78454 - DNA, 15 bp, Homo sapiens
taagctcggagattg

SEQ ID NO: 78455 - DNA, 15 bp, Homo sapiens
gtaagctcggagatt

SEQ ID NO: 78456 - DNA, 15 bp, Homo sapiens
agtaagctcggagat

SEQ ID NO: 78457 - DNA, 15 bp, Homo sapiens
aagtaagctcggaga

SEQ ID NO: 78458 - DNA, 15 bp, Homo sapiens
gaagtaagctcggag

SEQ ID NO: 78459 - DNA, 15 bp, Homo sapiens
agaagtaagctcgga

SEQ ID NO: 78460 - DNA, 15 bp, Homo sapiens
cagaagtaagctcgg

SEQ ID NO: 78461 - DNA, 15 bp, Homo sapiens
gcagaagtaagctcg

SEQ ID NO: 78462 - DNA, 15 bp, Homo sapiens
ggcagaagtaagctc

SEQ ID NO: 78463 - DNA, 15 bp, Homo sapiens
aggcagaagtaagct

SEQ ID NO: 78464 - DNA, 15 bp, Homo sapiens
gaggcagaagtaagc

SEQ ID NO: 78465 - DNA, 15 bp, Homo sapiens
agaggcagaagtaag

SEQ ID NO: 78466 - DNA, 15 bp, Homo sapiens
tagaggcagaagtaa

SEQ ID NO: 78467 - DNA, 15 bp, Homo sapiens
ctagaggcagaagta

SEQ ID NO: 78468 - DNA, 15 bp, Homo sapiens
cctagaggcagaagt

SEQ ID NO: 78469 - DNA, 15 bp, Homo sapiens
tcctagaggcagaag

SEQ ID NO: 78470 - DNA, 15 bp, Homo sapiens
ttcctagaggcagaa

SEQ ID NO: 78471 - DNA, 15 bp, Homo sapiens
cttcctagaggcaga

SEQ ID NO: 78472 - DNA, 15 bp, Homo sapiens
acttcctagaggcag

SEQ ID NO: 78473 - DNA, 15 bp, Homo sapiens
aacttcctagaggca

SEQ ID NO: 78474 - DNA, 15 bp, Homo sapiens
caacttcctagaggc

SEQ ID NO: 78475 - DNA, 15 bp, Homo sapiens
acaacttcctagagg

SEQ ID NO: 78476 - DNA, 15 bp, Homo sapiens
tacaacttcctagag

SEQ ID NO: 78477 - DNA, 15 bp, Homo sapiens
ttacaacttcctaga

SEQ ID NO: 78478 - DNA, 15 bp, Homo sapiens
attacaacttcctag

SEQ ID NO: 78479 - DNA, 15 bp, Homo sapiens
cattacaacttccta

SEQ ID NO: 78480 - DNA, 15 bp, Homo sapiens
acattacaacttcct

SEQ ID NO: 78481 - DNA, 15 bp, Homo sapiens
tacattacaacttcc

SEQ ID NO: 78482 - DNA, 15 bp, Homo sapiens
ttacattacaacttc

SEQ ID NO: 78483 - DNA, 15 bp, Homo sapiens
attacattacaactt

SEQ ID NO: 78484 - DNA, 15 bp, Homo sapiens
aattacattacaact

SEQ ID NO: 78485 - DNA, 15 bp, Homo sapiens
gaattacattacaac

SEQ ID NO: 78486 - DNA, 15 bp, Homo sapiens
ggaattacattacaa

SEQ ID NO: 78487 - DNA, 15 bp, Homo sapiens
aggaattacattaca

SEQ ID NO: 78488 - DNA, 15 bp, Homo sapiens
aaggaattacattac

SEQ ID NO: 78489 - DNA, 15 bp, Homo sapiens
aaaggaattacatta

SEQ ID NO: 78490 - DNA, 15 bp, Homo sapiens
caaaggaattacatt

SEQ ID NO: 78491 - DNA, 15 bp, Homo sapiens
ccaaaggaattacat

SEQ ID NO: 78492 - DNA, 15 bp, Homo sapiens
tccaaaggaattaca

SEQ ID NO: 78493 - DNA, 15 bp, Homo sapiens
ctccaaaggaattac

SEQ ID NO: 78494 - DNA, 15 bp, Homo sapiens
tctccaaaggaatta

SEQ ID NO: 78495 - DNA, 15 bp, Homo sapiens
gtctccaaaggaatt

SEQ ID NO: 78496 - DNA, 15 bp, Homo sapiens
agtctccaaaggaat

SEQ ID NO: 78497 - DNA, 15 bp, Homo sapiens
aagtctccaaaggaa

SEQ ID NO: 78498 - DNA, 15 bp, Homo sapiens
caagtctccaaagga

SEQ ID NO: 78499 - DNA, 15 bp, Homo sapiens
gcaagtctccaaagg

SEQ ID NO: 78500 - DNA, 15 bp, Homo sapiens
tgcaagtctccaaag

SEQ ID NO: 78501 - DNA, 15 bp, Homo sapiens
atgcaagtctccaaa

SEQ ID NO: 78502 - DNA, 15 bp, Homo sapiens
tatgcaagtctccaa

SEQ ID NO: 78503 - DNA, 15 bp, Homo sapiens
ctatgcaagtctcca

SEQ ID NO: 78504 - DNA, 15 bp, Homo sapiens
actatgcaagtctcc

SEQ ID NO: 78505 - DNA, 15 bp, Homo sapiens
aactatgcaagtctc

SEQ ID NO: 78506 - DNA, 15 bp, Homo sapiens
caactatgcaagtct

SEQ ID NO: 78507 - DNA, 15 bp, Homo sapiens
ccaactatgcaagtc

SEQ ID NO: 78508 - DNA, 15 bp, Homo sapiens
tccaactatgcaagt

SEQ ID NO: 78509 - DNA, 15 bp, Homo sapiens
atccaactatgcaag

SEQ ID NO: 78510 - DNA, 15 bp, Homo sapiens
aatccaactatgcaa

SEQ ID NO: 78511 - DNA, 15 bp, Homo sapiens
aaatccaactatgca

SEQ ID NO: 78512 - DNA, 15 bp, Homo sapiens
aaaatccaactatgc

SEQ ID NO: 78513 - DNA, 15 bp, Homo sapiens
gaaaatccaactatg

SEQ ID NO: 78514 - DNA, 15 bp, Homo sapiens
ggaaaatccaactat

SEQ ID NO: 78515 - DNA, 15 bp, Homo sapiens
gggaaaatccaacta

SEQ ID NO: 78516 - DNA, 15 bp, Homo sapiens
agggaaaatccaact

SEQ ID NO: 78517 - DNA, 15 bp, Homo sapiens
aagggaaaatccaac

SEQ ID NO: 78518 - DNA, 15 bp, Homo sapiens
aaagggaaaatccaa

SEQ ID NO: 78519 - DNA, 15 bp, Homo sapiens
aaaagggaaaatcca

SEQ ID NO: 78520 - DNA, 15 bp, Homo sapiens
gaaaagggaaaatcc

SEQ ID NO: 78521 - DNA, 15 bp, Homo sapiens
ggaaaagggaaaatc

SEQ ID NO: 78522 - DNA, 15 bp, Homo sapiens
gggaaaagggaaaat

SEQ ID NO: 78523 - DNA, 15 bp, Homo sapiens
agggaaaagggaaaa

SEQ ID NO: 78524 - DNA, 15 bp, Homo sapiens
gagggaaaagggaaa

SEQ ID NO: 78525 - DNA, 15 bp, Homo sapiens
ggagggaaaagggaa

SEQ ID NO: 78526 - DNA, 15 bp, Homo sapiens
tggagggaaaaggga

SEQ ID NO: 78527 - DNA, 15 bp, Homo sapiens
gtggagggaaaaggg

SEQ ID NO: 78528 - DNA, 15 bp, Homo sapiens
ggtggagggaaaagg

SEQ ID NO: 78529 - DNA, 15 bp, Homo sapiens
aggtggagggaaaag

SEQ ID NO: 78530 - DNA, 15 bp, Homo sapiens
taggtggagggaaaa

SEQ ID NO: 78531 - DNA, 15 bp, Homo sapiens
ataggtggagggaaa

SEQ ID NO: 78532 - DNA, 15 bp, Homo sapiens
gataggtggagggaa

SEQ ID NO: 78533 - DNA, 15 bp, Homo sapiens
agataggtggaggga

SEQ ID NO: 78534 - DNA, 15 bp, Homo sapiens
gagataggtggaggg

SEQ ID NO: 78535 - DNA, 15 bp, Homo sapiens
ggagataggtggagg

SEQ ID NO: 78536 - DNA, 15 bp, Homo sapiens
aggagataggtggag

SEQ ID NO: 78537 - DNA, 15 bp, Homo sapiens
aaggagataggtgga

SEQ ID NO: 78538 - DNA, 15 bp, Homo sapiens
caaggagataggtgg

SEQ ID NO: 78539 - DNA, 15 bp, Homo sapiens
tcaaggagataggtg

SEQ ID NO: 78540 - DNA, 15 bp, Homo sapiens
ctcaaggagataggt

SEQ ID NO: 78541 - DNA, 15 bp, Homo sapiens
tctcaaggagatagg

SEQ ID NO: 78542 - DNA, 15 bp, Homo sapiens
ttctcaaggagatag

SEQ ID NO: 78543 - DNA, 15 bp, Homo sapiens
attctcaaggagata

SEQ ID NO: 78544 - DNA, 15 bp, Homo sapiens
aattctcaaggagat

SEQ ID NO: 78545 - DNA, 15 bp, Homo sapiens
taattctcaaggaga

SEQ ID NO: 78546 - DNA, 15 bp, Homo sapiens
ctaattctcaaggag

SEQ ID NO: 78547 - DNA, 15 bp, Homo sapiens
cctaattctcaagga

SEQ ID NO: 78548 - DNA, 15 bp, Homo sapiens
acctaattctcaagg

SEQ ID NO: 78549 - DNA, 15 bp, Homo sapiens
aacctaattctcaag

SEQ ID NO: 78550 - DNA, 15 bp, Homo sapiens
aaacctaattctcaa

SEQ ID NO: 78551 - DNA, 15 bp, Homo sapiens
taaacctaattctca

SEQ ID NO: 78552 - DNA, 15 bp, Homo sapiens
ctaaacctaattctc

SEQ ID NO: 78553 - DNA, 15 bp, Homo sapiens
actaaacctaattct

SEQ ID NO: 78554 - DNA, 15 bp, Homo sapiens
aactaaacctaattc

SEQ ID NO: 78555 - DNA, 15 bp, Homo sapiens
gaactaaacctaatt

SEQ ID NO: 78556 - DNA, 15 bp, Homo sapiens
ggaactaaacctaat

SEQ ID NO: 78557 - DNA, 15 bp, Homo sapiens
gggaactaaacctaa

SEQ ID NO: 78558 - DNA, 15 bp, Homo sapiens
agggaactaaaccta

SEQ ID NO: 78559 - DNA, 15 bp, Homo sapiens
tagggaactaaacct

SEQ ID NO: 78560 - DNA, 15 bp, Homo sapiens
ctagggaactaaacc

SEQ ID NO: 78561 - DNA, 15 bp, Homo sapiens
cctagggaactaaac

SEQ ID NO: 78562 - DNA, 15 bp, Homo sapiens
acctagggaactaaa

SEQ ID NO: 78563 - DNA, 15 bp, Homo sapiens
tacctagggaactaa

SEQ ID NO: 78564 - DNA, 15 bp, Homo sapiens
atacctagggaacta

SEQ ID NO: 78565 - DNA, 15 bp, Homo sapiens
catacctagggaact

SEQ ID NO: 78566 - DNA, 15 bp, Homo sapiens
tcatacctagggaac

SEQ ID NO: 78567 - DNA, 15 bp, Homo sapiens
ctcatacctagggaa

SEQ ID NO: 78568 - DNA, 15 bp, Homo sapiens
cctcatacctaggga

SEQ ID NO: 78569 - DNA, 15 bp, Homo sapiens
gcctcatacctaggg

SEQ ID NO: 78570 - DNA, 15 bp, Homo sapiens
agcctcatacctagg

SEQ ID NO: 78571 - DNA, 15 bp, Homo sapiens
tagcctcatacctag

SEQ ID NO: 78572 - DNA, 15 bp, Homo sapiens
ttagcctcataccta

SEQ ID NO: 78573 - DNA, 15 bp, Homo sapiens
attagcctcatacct

SEQ ID NO: 78574 - DNA, 15 bp, Homo sapiens
cattagcctcatacc

SEQ ID NO: 78575 - DNA, 15 bp, Homo sapiens
acattagcctcatac

SEQ ID NO: 78576 - DNA, 15 bp, Homo sapiens
gacattagcctcata

SEQ ID NO: 78577 - DNA, 15 bp, Homo sapiens
agacattagcctcat

SEQ ID NO: 78578 - DNA, 15 bp, Homo sapiens
cagacattagcctca

SEQ ID NO: 78579 - DNA, 15 bp, Homo sapiens
tcagacattagcctc

SEQ ID NO: 78580 - DNA, 15 bp, Homo sapiens
atcagacattagcct

SEQ ID NO: 78581 - DNA, 15 bp, Homo sapiens
aatcagacattagcc

SEQ ID NO: 78582 - DNA, 15 bp, Homo sapiens
caatcagacattagc

SEQ ID NO: 78583 - DNA, 15 bp, Homo sapiens
acaatcagacattag

SEQ ID NO: 78584 - DNA, 15 bp, Homo sapiens
aacaatcagacatta

SEQ ID NO: 78585 - DNA, 15 bp, Homo sapiens
gaacaatcagacatt

SEQ ID NO: 78586 - DNA, 15 bp, Homo sapiens
agaacaatcagacat

SEQ ID NO: 78587 - DNA, 15 bp, Homo sapiens
cagaacaatcagaca

SEQ ID NO: 78588 - DNA, 15 bp, Homo sapiens
acagaacaatcagac

SEQ ID NO: 78589 - DNA, 15 bp, Homo sapiens
aacagaacaatcaga

SEQ ID NO: 78590 - DNA, 15 bp, Homo sapiens
taacagaacaatcag

SEQ ID NO: 78591 - DNA, 15 bp, Homo sapiens
gtaacagaacaatca

SEQ ID NO: 78592 - DNA, 15 bp, Homo sapiens
tgtaacagaacaatc

SEQ ID NO: 78593 - DNA, 15 bp, Homo sapiens
ttgtaacagaacaat

SEQ ID NO: 78594 - DNA, 15 bp, Homo sapiens
tttgtaacagaacaa

SEQ ID NO: 78595 - DNA, 15 bp, Homo sapiens
atttgtaacagaaca

SEQ ID NO: 78596 - DNA, 15 bp, Homo sapiens
gatttgtaacagaac

SEQ ID NO: 78597 - DNA, 15 bp, Homo sapiens
agatttgtaacagaa

SEQ ID NO: 78598 - DNA, 15 bp, Homo sapiens
cagatttgtaacaga

SEQ ID NO: 78599 - DNA, 15 bp, Homo sapiens
tcagatttgtaacag

SEQ ID NO: 78600 - DNA, 15 bp, Homo sapiens
ctcagatttgtaaca

SEQ ID NO: 78601 - DNA, 15 bp, Homo sapiens
tctcagatttgtaac

SEQ ID NO: 78602 - DNA, 15 bp, Homo sapiens
ttctcagatttgtaa

SEQ ID NO: 78603 - DNA, 15 bp, Homo sapiens
cttctcagatttgta

SEQ ID NO: 78604 - DNA, 15 bp, Homo sapiens
ccttctcagatttgt

SEQ ID NO: 78605 - DNA, 15 bp, Homo sapiens
tccttctcagatttg

SEQ ID NO: 78606 - DNA, 15 bp, Homo sapiens
atccttctcagattt

SEQ ID NO: 78607 - DNA, 15 bp, Homo sapiens
tatccttctcagatt

SEQ ID NO: 78608 - DNA, 15 bp, Homo sapiens
ttatccttctcagat

SEQ ID NO: 78609 - DNA, 15 bp, Homo sapiens
attatccttctcaga

SEQ ID NO: 78610 - DNA, 15 bp, Homo sapiens
tattatccttctcag

SEQ ID NO: 78611 - DNA, 15 bp, Homo sapiens
atattatccttctca

SEQ ID NO: 78612 - DNA, 15 bp, Homo sapiens
aatattatccttctc

SEQ ID NO: 78613 - DNA, 15 bp, Homo sapiens
aaatattatccttct

SEQ ID NO: 78614 - DNA, 15 bp, Homo sapiens
aaaatattatccttc

SEQ ID NO: 78615 - DNA, 15 bp, Homo sapiens
taaaatattatcctt

SEQ ID NO: 78616 - DNA, 15 bp, Homo sapiens
ttaaaatattatcct

SEQ ID NO: 78617 - DNA, 15 bp, Homo sapiens
tttaaaatattatcc

SEQ ID NO: 78618 - DNA, 15 bp, Homo sapiens
ctttaaaatattatc

SEQ ID NO: 78619 - DNA, 15 bp, Homo sapiens
tctttaaaatattat

SEQ ID NO: 78620 - DNA, 15 bp, Homo sapiens
ttctttaaaatatta

SEQ ID NO: 78621 - DNA, 15 bp, Homo sapiens
tttctttaaaatatt

SEQ ID NO: 78622 - DNA, 15 bp, Homo sapiens
ctttctttaaaatat

SEQ ID NO: 78623 - DNA, 15 bp, Homo sapiens
cctttctttaaaata

SEQ ID NO: 78624 - DNA, 15 bp, Homo sapiens
acctttctttaaaat

SEQ ID NO: 78625 - DNA, 15 bp, Homo sapiens
tacctttctttaaaa

SEQ ID NO: 78626 - DNA, 15 bp, Homo sapiens
atacctttctttaaa

SEQ ID NO: 78627 - DNA, 15 bp, Homo sapiens
gatacctttctttaa

SEQ ID NO: 78628 - DNA, 15 bp, Homo sapiens
agatacctttcttta

SEQ ID NO: 78629 - DNA, 15 bp, Homo sapiens
aagatacctttcttt

SEQ ID NO: 78630 - DNA, 15 bp, Homo sapiens
aaagatacctttctt

SEQ ID NO: 78631 - DNA, 15 bp, Homo sapiens
gaaagatacctttct

SEQ ID NO: 78632 - DNA, 15 bp, Homo sapiens
agaaagatacctttc

SEQ ID NO: 78633 - DNA, 15 bp, Homo sapiens
cagaaagataccttt

SEQ ID NO: 78634 - DNA, 15 bp, Homo sapiens
ccagaaagatacctt

SEQ ID NO: 78635 - DNA, 15 bp, Homo sapiens
cccagaaagatacct

SEQ ID NO: 78636 - DNA, 15 bp, Homo sapiens
acccagaaagatacc

SEQ ID NO: 78637 - DNA, 15 bp, Homo sapiens
gacccagaaagatac

SEQ ID NO: 78638 - DNA, 15 bp, Homo sapiens
tgacccagaaagata

SEQ ID NO: 78639 - DNA, 15 bp, Homo sapiens
atgacccagaaagat

SEQ ID NO: 78640 - DNA, 15 bp, Homo sapiens
aatgacccagaaaga

SEQ ID NO: 78641 - DNA, 15 bp, Homo sapiens
aaatgacccagaaag

SEQ ID NO: 78642 - DNA, 15 bp, Homo sapiens
caaatgacccagaaa

SEQ ID NO: 78643 - DNA, 15 bp, Homo sapiens
acaaatgacccagaa

SEQ ID NO: 78644 - DNA, 15 bp, Homo sapiens
cacaaatgacccaga

SEQ ID NO: 78645 - DNA, 15 bp, Homo sapiens
gcacaaatgacccag

SEQ ID NO: 78646 - DNA, 15 bp, Homo sapiens
ggcacaaatgaccca

SEQ ID NO: 78647 - DNA, 15 bp, Homo sapiens
aggcacaaatgaccc

SEQ ID NO: 78648 - DNA, 15 bp, Homo sapiens
gaggcacaaatgacc

SEQ ID NO: 78649 - DNA, 15 bp, Homo sapiens
tgaggcacaaatgac

SEQ ID NO: 78650 - DNA, 15 bp, Homo sapiens
ctgaggcacaaatga

SEQ ID NO: 78651 - DNA, 15 bp, Homo sapiens
tctgaggcacaaatg

SEQ ID NO: 78652 - DNA, 15 bp, Homo sapiens
gtctgaggcacaaat

SEQ ID NO: 78653 - DNA, 15 bp, Homo sapiens
agtctgaggcacaaa

SEQ ID NO: 78654 - DNA, 15 bp, Homo sapiens
aagtctgaggcacaa

SEQ ID NO: 78655 - DNA, 15 bp, Homo sapiens
taagtctgaggcaca

SEQ ID NO: 78656 - DNA, 15 bp, Homo sapiens
ctaagtctgaggcac

SEQ ID NO: 78657 - DNA, 15 bp, Homo sapiens
cctaagtctgaggca

SEQ ID NO: 78658 - DNA, 15 bp, Homo sapiens
acctaagtctgaggc

SEQ ID NO: 78659 - DNA, 15 bp, Homo sapiens
cacctaagtctgagg

SEQ ID NO: 78660 - DNA, 15 bp, Homo sapiens
acacctaagtctgag

SEQ ID NO: 78661 - DNA, 15 bp, Homo sapiens
aacacctaagtctga

SEQ ID NO: 78662 - DNA, 15 bp, Homo sapiens
aaacacctaagtctg

SEQ ID NO: 78663 - DNA, 15 bp, Homo sapiens
caaacacctaagtct

SEQ ID NO: 78664 - DNA, 15 bp, Homo sapiens
tcaaacacctaagtc

SEQ ID NO: 78665 - DNA, 15 bp, Homo sapiens
ttcaaacacctaagt

SEQ ID NO: 78666 - DNA, 15 bp, Homo sapiens
cttcaaacacctaag

SEQ ID NO: 78667 - DNA, 15 bp, Homo sapiens
ccttcaaacacctaa

SEQ ID NO: 78668 - DNA, 15 bp, Homo sapiens
gccttcaaacaccta

SEQ ID NO: 78669 - DNA, 15 bp, Homo sapiens
ggccttcaaacacct

SEQ ID NO: 78670 - DNA, 15 bp, Homo sapiens
aggccttcaaacacc

SEQ ID NO: 78671 - DNA, 15 bp, Homo sapiens
aaggccttcaaacac

SEQ ID NO: 78672 - DNA, 15 bp, Homo sapiens
gaaggccttcaaaca

SEQ ID NO: 78673 - DNA, 15 bp, Homo sapiens
agaaggccttcaaac

SEQ ID NO: 78674 - DNA, 15 bp, Homo sapiens
aagaaggccttcaaa

SEQ ID NO: 78675 - DNA, 15 bp, Homo sapiens
taagaaggccttcaa

SEQ ID NO: 78676 - DNA, 15 bp, Homo sapiens
ataagaaggccttca

SEQ ID NO: 78677 - DNA, 15 bp, Homo sapiens
gataagaaggccttc

SEQ ID NO: 78678 - DNA, 15 bp, Homo sapiens
ggataagaaggcctt

SEQ ID NO: 78679 - DNA, 15 bp, Homo sapiens
gggataagaaggcct

SEQ ID NO: 78680 - DNA, 15 bp, Homo sapiens
ggggataagaaggcc

SEQ ID NO: 78681 - DNA, 15 bp, Homo sapiens
tggggataagaaggc

SEQ ID NO: 78682 - DNA, 15 bp, Homo sapiens
atggggataagaagg

SEQ ID NO: 78683 - DNA, 15 bp, Homo sapiens
catggggataagaag

SEQ ID NO: 78684 - DNA, 15 bp, Homo sapiens
acatggggataagaa

SEQ ID NO: 78685 - DNA, 15 bp, Homo sapiens
tacatggggataaga

SEQ ID NO: 78686 - DNA, 15 bp, Homo sapiens
ttacatggggataag

SEQ ID NO: 78687 - DNA, 15 bp, Homo sapiens
cttacatggggataa

SEQ ID NO: 78688 - DNA, 15 bp, Homo sapiens
ccttacatggggata

SEQ ID NO: 78689 - DNA, 15 bp, Homo sapiens
cccttacatggggat

SEQ ID NO: 78690 - DNA, 15 bp, Homo sapiens
acccttacatgggga

SEQ ID NO: 78691 - DNA, 15 bp, Homo sapiens
cacccttacatgggg

SEQ ID NO: 78692 - DNA, 15 bp, Homo sapiens
tcacccttacatggg

SEQ ID NO: 78693 - DNA, 15 bp, Homo sapiens
ttcacccttacatgg

SEQ ID NO: 78694 - DNA, 15 bp, Homo sapiens
cttcacccttacatg

SEQ ID NO: 78695 - DNA, 15 bp, Homo sapiens
gcttcacccttacat

SEQ ID NO: 78696 - DNA, 15 bp, Homo sapiens
ggcttcacccttaca

SEQ ID NO: 78697 - DNA, 15 bp, Homo sapiens
aggcttcacccttac

SEQ ID NO: 78698 - DNA, 15 bp, Homo sapiens
gaggcttcaccctta

SEQ ID NO: 78699 - DNA, 15 bp, Homo sapiens
agaggcttcaccctt

SEQ ID NO: 78700 - DNA, 15 bp, Homo sapiens
tagaggcttcaccct

SEQ ID NO: 78701 - DNA, 15 bp, Homo sapiens
ttagaggcttcaccc

SEQ ID NO: 78702 - DNA, 15 bp, Homo sapiens
attagaggcttcacc

SEQ ID NO: 78703 - DNA, 15 bp, Homo sapiens
tattagaggcttcac

SEQ ID NO: 78704 - DNA, 15 bp, Homo sapiens
ttattagaggcttca

SEQ ID NO: 78705 - DNA, 15 bp, Homo sapiens
tttattagaggcttc

SEQ ID NO: 78706 - DNA, 15 bp, Homo sapiens
ttttattagaggctt

SEQ ID NO: 78707 - DNA, 15 bp, Homo sapiens
attttattagaggct

SEQ ID NO: 78708 - DNA, 15 bp, Homo sapiens
tattttattagaggc

SEQ ID NO: 78709 - DNA, 15 bp, Homo sapiens
ttattttattagagg

SEQ ID NO: 78710 - DNA, 15 bp, Homo sapiens
tttattttattagag

SEQ ID NO: 78711 - DNA, 15 bp, Homo sapiens
ttttattttattaga

SEQ ID NO: 78712 - DNA, 15 bp, Homo sapiens
cttttattttattag

SEQ ID NO: 78713 - DNA, 15 bp, Homo sapiens
acttttattttatta

SEQ ID NO: 78714 - DNA, 15 bp, Homo sapiens
aacttttattttatt

SEQ ID NO: 78715 - DNA, 15 bp, Homo sapiens
taacttttattttat

SEQ ID NO: 78716 - DNA, 15 bp, Homo sapiens
ctaacttttatttta

SEQ ID NO: 78717 - DNA, 15 bp, Homo sapiens
tctaacttttatttt

SEQ ID NO: 78718 - DNA, 15 bp, Homo sapiens
ttctaacttttattt

SEQ ID NO: 78719 - DNA, 15 bp, Homo sapiens
tttctaacttttatt

SEQ ID NO: 78720 - DNA, 15 bp, Homo sapiens
atttctaacttttat

SEQ ID NO: 78721 - DNA, 15 bp, Homo sapiens
aatttctaactttta

SEQ ID NO: 78722 - DNA, 15 bp, Homo sapiens
aaatttctaactttt

SEQ ID NO: 78723 - DNA, 15 bp, Homo sapiens
caaatttctaacttt

SEQ ID NO: 78724 - DNA, 15 bp, Homo sapiens
ccaaatttctaactt

SEQ ID NO: 78725 - DNA, 15 bp, Homo sapiens
tccaaatttctaact

SEQ ID NO: 78726 - DNA, 15 bp, Homo sapiens
atccaaatttctaac

SEQ ID NO: 78727 - DNA, 15 bp, Homo sapiens
catccaaatttctaa

SEQ ID NO: 78728 - DNA, 15 bp, Homo sapiens
gcatccaaatttcta

SEQ ID NO: 78729 - DNA, 15 bp, Homo sapiens
tgcatccaaatttct

SEQ ID NO: 78730 - DNA, 15 bp, Homo sapiens
atgcatccaaatttc

SEQ ID NO: 78731 - DNA, 15 bp, Homo sapiens
catgcatccaaattt

SEQ ID NO: 78732 - DNA, 15 bp, Homo sapiens
tcatgcatccaaatt

SEQ ID NO: 78733 - DNA, 15 bp, Homo sapiens
atcatgcatccaaat

SEQ ID NO: 78734 - DNA, 15 bp, Homo sapiens
aatcatgcatccaaa

SEQ ID NO: 78735 - DNA, 15 bp, Homo sapiens
aaatcatgcatccaa

SEQ ID NO: 78736 - DNA, 15 bp, Homo sapiens
taaatcatgcatcca

SEQ ID NO: 78737 - DNA, 15 bp, Homo sapiens
ttaaatcatgcatcc

SEQ ID NO: 78738 - DNA, 15 bp, Homo sapiens
attaaatcatgcatc

SEQ ID NO: 78739 - DNA, 15 bp, Homo sapiens
aattaaatcatgcat

SEQ ID NO: 78740 - DNA, 15 bp, Homo sapiens
caattaaatcatgca

SEQ ID NO: 78741 - DNA, 15 bp, Homo sapiens
tcaattaaatcatgc

SEQ ID NO: 78742 - DNA, 15 bp, Homo sapiens
ttcaattaaatcatg

SEQ ID NO: 78743 - DNA, 15 bp, Homo sapiens
attcaattaaatcat

SEQ ID NO: 78744 - DNA, 15 bp, Homo sapiens
aattcaattaaatca

SEQ ID NO: 78745 - DNA, 15 bp, Homo sapiens
taattcaattaaatc

SEQ ID NO: 78746 - DNA, 15 bp, Homo sapiens
gtaattcaattaaat

SEQ ID NO: 78747 - DNA, 15 bp, Homo sapiens
ggtaattcaattaaa

SEQ ID NO: 78748 - DNA, 15 bp, Homo sapiens
tggtaattcaattaa

SEQ ID NO: 78749 - DNA, 15 bp, Homo sapiens
ttggtaattcaatta

SEQ ID NO: 78750 - DNA, 15 bp, Homo sapiens
tttggtaattcaatt

SEQ ID NO: 78751 - DNA, 15 bp, Homo sapiens
atttggtaattcaat

SEQ ID NO: 78752 - DNA, 15 bp, Homo sapiens
catttggtaattcaa

SEQ ID NO: 78753 - DNA, 15 bp, Homo sapiens
tcatttggtaattca

SEQ ID NO: 78754 - DNA, 15 bp, Homo sapiens
atcatttggtaattc

SEQ ID NO: 78755 - DNA, 15 bp, Homo sapiens
aatcatttggtaatt

SEQ ID NO: 78756 - DNA, 15 bp, Homo sapiens
aaatcatttggtaat

SEQ ID NO: 78757 - DNA, 15 bp, Homo sapiens
aaaatcatttggtaa

SEQ ID NO: 78758 - DNA, 15 bp, Homo sapiens
caaaatcatttggta

SEQ ID NO: 78759 - DNA, 15 bp, Homo sapiens
gcaaaatcatttggt

SEQ ID NO: 78760 - DNA, 15 bp, Homo sapiens
tgcaaaatcatttgg

SEQ ID NO: 78761 - DNA, 15 bp, Homo sapiens
ctgcaaaatcatttg

SEQ ID NO: 78762 - DNA, 15 bp, Homo sapiens
tctgcaaaatcattt

SEQ ID NO: 78763 - DNA, 15 bp, Homo sapiens
atctgcaaaatcatt

SEQ ID NO: 78764 - DNA, 15 bp, Homo sapiens
tatctgcaaaatcat

SEQ ID NO: 78765 - DNA, 15 bp, Homo sapiens
ttatctgcaaaatca

SEQ ID NO: 78766 - DNA, 15 bp, Homo sapiens
tttatctgcaaaatc

SEQ ID NO: 78767 - DNA, 15 bp, Homo sapiens
ctttatctgcaaaat

SEQ ID NO: 78768 - DNA, 15 bp, Homo sapiens
actttatctgcaaaa

SEQ ID NO: 78769 - DNA, 15 bp, Homo sapiens
aactttatctgcaaa

SEQ ID NO: 78770 - DNA, 15 bp, Homo sapiens
gaactttatctgcaa

SEQ ID NO: 78771 - DNA, 15 bp, Homo sapiens
tgaactttatctgca

SEQ ID NO: 78772 - DNA, 15 bp, Homo sapiens
ttgaactttatctgc

SEQ ID NO: 78773 - DNA, 15 bp, Homo sapiens
gttgaactttatctg

SEQ ID NO: 78774 - DNA, 15 bp, Homo sapiens
agttgaactttatct

SEQ ID NO: 78775 - DNA, 15 bp, Homo sapiens
aagttgaactttatc

SEQ ID NO: 78776 - DNA, 15 bp, Homo sapiens
aaagttgaactttat

SEQ ID NO: 78777 - DNA, 15 bp, Homo sapiens
aaaagttgaacttta

SEQ ID NO: 78778 - DNA, 15 bp, Homo sapiens
caaaagttgaacttt

SEQ ID NO: 78779 - DNA, 15 bp, Homo sapiens
acaaaagttgaactt

SEQ ID NO: 78780 - DNA, 15 bp, Homo sapiens
aacaaaagttgaact

SEQ ID NO: 78781 - DNA, 15 bp, Homo sapiens
taacaaaagttgaac

SEQ ID NO: 78782 - DNA, 15 bp, Homo sapiens
ataacaaaagttgaa

SEQ ID NO: 78783 - DNA, 15 bp, Homo sapiens
aataacaaaagttga

SEQ ID NO: 78784 - DNA, 15 bp, Homo sapiens
taataacaaaagttg

SEQ ID NO: 78785 - DNA, 15 bp, Homo sapiens
gtaataacaaaagtt

SEQ ID NO: 78786 - DNA, 15 bp, Homo sapiens
agtaataacaaaagt

SEQ ID NO: 78787 - DNA, 15 bp, Homo sapiens
aagtaataacaaaag

SEQ ID NO: 78788 - DNA, 15 bp, Homo sapiens
caagtaataacaaaa

SEQ ID NO: 78789 - DNA, 15 bp, Homo sapiens
acaagtaataacaaa

SEQ ID NO: 78790 - DNA, 15 bp, Homo sapiens
tacaagtaataacaa

SEQ ID NO: 78791 - DNA, 15 bp, Homo sapiens
ctacaagtaataaca

SEQ ID NO: 78792 - DNA, 15 bp, Homo sapiens
actacaagtaataac

SEQ ID NO: 78793 - DNA, 15 bp, Homo sapiens
cactacaagtaataa

SEQ ID NO: 78794 - DNA, 15 bp, Homo sapiens
gcactacaagtaata

SEQ ID NO: 78795 - DNA, 15 bp, Homo sapiens
agcactacaagtaat

SEQ ID NO: 78796 - DNA, 15 bp, Homo sapiens
aagcactacaagtaa

SEQ ID NO: 78797 - DNA, 15 bp, Homo sapiens
caagcactacaagta

SEQ ID NO: 78798 - DNA, 15 bp, Homo sapiens
acaagcactacaagt

SEQ ID NO: 78799 - DNA, 15 bp, Homo sapiens
aacaagcactacaag

SEQ ID NO: 78800 - DNA, 15 bp, Homo sapiens
caacaagcactacaa

SEQ ID NO: 78801 - DNA, 15 bp, Homo sapiens
tcaacaagcactaca

SEQ ID NO: 78802 - DNA, 15 bp, Homo sapiens
ttcaacaagcactac

SEQ ID NO: 78803 - DNA, 15 bp, Homo sapiens
tttcaacaagcacta

SEQ ID NO: 78804 - DNA, 15 bp, Homo sapiens
ctttcaacaagcact

SEQ ID NO: 78805 - DNA, 15 bp, Homo sapiens
gctttcaacaagcac

SEQ ID NO: 78806 - DNA, 15 bp, Homo sapiens
agctttcaacaagca

SEQ ID NO: 78807 - DNA, 15 bp, Homo sapiens
aagctttcaacaagc

SEQ ID NO: 78808 - DNA, 15 bp, Homo sapiens
caagctttcaacaag

SEQ ID NO: 78809 - DNA, 15 bp, Homo sapiens
ccaagctttcaacaa

SEQ ID NO: 78810 - DNA, 15 bp, Homo sapiens
accaagctttcaaca

SEQ ID NO: 78811 - DNA, 15 bp, Homo sapiens
aaccaagctttcaac

SEQ ID NO: 78812 - DNA, 15 bp, Homo sapiens
taaccaagctttcaa

SEQ ID NO: 78813 - DNA, 15 bp, Homo sapiens
ttaaccaagctttca

SEQ ID NO: 78814 - DNA, 15 bp, Homo sapiens
gttaaccaagctttc

SEQ ID NO: 78815 - DNA, 15 bp, Homo sapiens
ggttaaccaagcttt

SEQ ID NO: 78816 - DNA, 15 bp, Homo sapiens
cggttaaccaagctt

SEQ ID NO: 78817 - DNA, 15 bp, Homo sapiens
tcggttaaccaagct

SEQ ID NO: 78818 - DNA, 15 bp, Homo sapiens
ttcggttaaccaagc

SEQ ID NO: 78819 - DNA, 15 bp, Homo sapiens
tttcggttaaccaag

SEQ ID NO: 78820 - DNA, 15 bp, Homo sapiens
ttttcggttaaccaa

SEQ ID NO: 78821 - DNA, 15 bp, Homo sapiens
tttttcggttaacca

SEQ ID NO: 78822 - DNA, 15 bp, Homo sapiens
ctttttcggttaacc

SEQ ID NO: 78823 - DNA, 15 bp, Homo sapiens
tctttttcggttaac

SEQ ID NO: 78824 - DNA, 15 bp, Homo sapiens
ttctttttcggttaa

SEQ ID NO: 78825 - DNA, 15 bp, Homo sapiens
cttctttttcggtta

SEQ ID NO: 78826 - DNA, 15 bp, Homo sapiens
tcttctttttcggtt

SEQ ID NO: 78827 - DNA, 15 bp, Homo sapiens
ctcttctttttcggt

SEQ ID NO: 78828 - DNA, 15 bp, Homo sapiens
cctcttctttttcgg

SEQ ID NO: 78829 - DNA, 15 bp, Homo sapiens
gcctcttctttttcg

SEQ ID NO: 78830 - DNA, 15 bp, Homo sapiens
agcctcttctttttc

SEQ ID NO: 78831 - DNA, 15 bp, Homo sapiens
aagcctcttcttttt

SEQ ID NO: 78832 - DNA, 15 bp, Homo sapiens
aaagcctcttctttt

SEQ ID NO: 78833 - DNA, 15 bp, Homo sapiens
taaagcctcttcttt

SEQ ID NO: 78834 - DNA, 15 bp, Homo sapiens
ttaaagcctcttctt

SEQ ID NO: 78835 - DNA, 15 bp, Homo sapiens
tttaaagcctcttct

SEQ ID NO: 78836 - DNA, 15 bp, Homo sapiens
atttaaagcctcttc

SEQ ID NO: 78837 - DNA, 15 bp, Homo sapiens
tatttaaagcctctt

SEQ ID NO: 78838 - DNA, 15 bp, Homo sapiens
ttatttaaagcctct

SEQ ID NO: 78839 - DNA, 15 bp, Homo sapiens
tttatttaaagcctc

SEQ ID NO: 78840 - DNA, 15 bp, Homo sapiens
ctttatttaaagcct

SEQ ID NO: 78841 - DNA, 15 bp, Homo sapiens
actttatttaaagcc

SEQ ID NO: 78842 - DNA, 15 bp, Homo sapiens
gactttatttaaagc

SEQ ID NO: 78843 - DNA, 15 bp, Homo sapiens
ggactttatttaaag

SEQ ID NO: 78844 - DNA, 15 bp, Homo sapiens
tggactttatttaaa

SEQ ID NO: 78845 - DNA, 15 bp, Homo sapiens
ctggactttatttaa

SEQ ID NO: 78846 - DNA, 15 bp, Homo sapiens
tctggactttattta

SEQ ID NO: 78847 - DNA, 15 bp, Homo sapiens
gtctggactttattt

SEQ ID NO: 78848 - DNA, 15 bp, Homo sapiens
tgtctggactttatt

SEQ ID NO: 78849 - DNA, 15 bp, Homo sapiens
ttgtctggactttat

SEQ ID NO: 78850 - DNA, 15 bp, Homo sapiens
cttgtctggacttta

SEQ ID NO: 78851 - DNA, 15 bp, Homo sapiens
gcttgtctggacttt

SEQ ID NO: 78852 - DNA, 15 bp, Homo sapiens
tgcttgtctggactt

SEQ ID NO: 78853 - DNA, 15 bp, Homo sapiens
ttgcttgtctggact

SEQ ID NO: 78854 - DNA, 15 bp, Homo sapiens
gttgcttgtctggac

SEQ ID NO: 78855 - DNA, 15 bp, Homo sapiens
agttgcttgtctgga

SEQ ID NO: 78856 - DNA, 15 bp, Homo sapiens
aagttgcttgtctgg

SEQ ID NO: 78857 - DNA, 15 bp, Homo sapiens
gaagttgcttgtctg

SEQ ID NO: 78858 - DNA, 15 bp, Homo sapiens
tgaagttgcttgtct

SEQ ID NO: 78859 - DNA, 15 bp, Homo sapiens
ttgaagttgcttgtc

SEQ ID NO: 78860 - DNA, 15 bp, Homo sapiens
tttgaagttgcttgt

SEQ ID NO: 78861 - DNA, 15 bp, Homo sapiens
ctttgaagttgcttg

SEQ ID NO: 78862 - DNA, 15 bp, Homo sapiens
tctttgaagttgctt

SEQ ID NO: 78863 - DNA, 15 bp, Homo sapiens
gtctttgaagttgct

SEQ ID NO: 78864 - DNA, 15 bp, Homo sapiens
ggtctttgaagttgc

SEQ ID NO: 78865 - DNA, 15 bp, Homo sapiens
tggtctttgaagttg

SEQ ID NO: 78866 - DNA, 15 bp, Homo sapiens
ttggtctttgaagtt

SEQ ID NO: 78867 - DNA, 15 bp, Homo sapiens
tttggtctttgaagt

SEQ ID NO: 78868 - DNA, 15 bp, Homo sapiens
ttttggtctttgaag

SEQ ID NO: 78869 - DNA, 15 bp, Homo sapiens
cttttggtctttgaa

SEQ ID NO: 78870 - DNA, 15 bp, Homo sapiens
ccttttggtctttga

SEQ ID NO: 78871 - DNA, 15 bp, Homo sapiens
tccttttggtctttg

SEQ ID NO: 78872 - DNA, 15 bp, Homo sapiens
ttccttttggtcttt

SEQ ID NO: 78873 - DNA, 15 bp, Homo sapiens
gttccttttggtctt

SEQ ID NO: 78874 - DNA, 15 bp, Homo sapiens
agttccttttggtct

SEQ ID NO: 78875 - DNA, 15 bp, Homo sapiens
tagttccttttggtc

SEQ ID NO: 78876 - DNA, 15 bp, Homo sapiens
ttagttccttttggt

SEQ ID NO: 78877 - DNA, 15 bp, Homo sapiens
cttagttccttttgg

SEQ ID NO: 78878 - DNA, 15 bp, Homo sapiens
acttagttccttttg

SEQ ID NO: 78879 - DNA, 15 bp, Homo sapiens
cacttagttcctttt

SEQ ID NO: 78880 - DNA, 15 bp, Homo sapiens
acacttagttccttt

SEQ ID NO: 78881 - DNA, 15 bp, Homo sapiens
gacacttagttcctt

SEQ ID NO: 78882 - DNA, 15 bp, Homo sapiens
tgacacttagttcct

SEQ ID NO: 78883 - DNA, 15 bp, Homo sapiens
ctgacacttagttcc

SEQ ID NO: 78884 - DNA, 15 bp, Homo sapiens
actgacacttagttc

SEQ ID NO: 78885 - DNA, 15 bp, Homo sapiens
cactgacacttagtt

SEQ ID NO: 78886 - DNA, 15 bp, Homo sapiens
acactgacacttagt

SEQ ID NO: 78887 - DNA, 15 bp, Homo sapiens
aacactgacacttag

SEQ ID NO: 78888 - DNA, 15 bp, Homo sapiens
gaacactgacactta

SEQ ID NO: 78889 - DNA, 15 bp, Homo sapiens
cgaacactgacactt

SEQ ID NO: 78890 - DNA, 15 bp, Homo sapiens
tcgaacactgacact

SEQ ID NO: 78891 - DNA, 15 bp, Homo sapiens
gtcgaacactgacac

SEQ ID NO: 78892 - DNA, 15 bp, Homo sapiens
cgtcgaacactgaca

SEQ ID NO: 78893 - DNA, 15 bp, Homo sapiens
acgtcgaacactgac

SEQ ID NO: 78894 - DNA, 15 bp, Homo sapiens
gacgtcgaacactga

SEQ ID NO: 78895 - DNA, 15 bp, Homo sapiens
agacgtcgaacactg

SEQ ID NO: 78896 - DNA, 15 bp, Homo sapiens
cagacgtcgaacact

SEQ ID NO: 78897 - DNA, 15 bp, Homo sapiens
ccagacgtcgaacac

SEQ ID NO: 78898 - DNA, 15 bp, Homo sapiens
gccagacgtcgaaca

SEQ ID NO: 78899 - DNA, 15 bp, Homo sapiens
agccagacgtcgaac

SEQ ID NO: 78900 - DNA, 15 bp, Homo sapiens
cagccagacgtcgaa

SEQ ID NO: 78901 - DNA, 15 bp, Homo sapiens
acagccagacgtcga

SEQ ID NO: 78902 - DNA, 15 bp, Homo sapiens
tacagccagacgtcg

SEQ ID NO: 78903 - DNA, 15 bp, Homo sapiens
ttacagccagacgtc

SEQ ID NO: 78904 - DNA, 15 bp, Homo sapiens
cttacagccagacgt

SEQ ID NO: 78905 - DNA, 15 bp, Homo sapiens
acttacagccagacg

SEQ ID NO: 78906 - DNA, 15 bp, Homo sapiens
cacttacagccagac

SEQ ID NO: 78907 - DNA, 15 bp, Homo sapiens
tcacttacagccaga

SEQ ID NO: 78908 - DNA, 15 bp, Homo sapiens
atcacttacagccag

SEQ ID NO: 78909 - DNA, 15 bp, Homo sapiens
catcacttacagcca

SEQ ID NO: 78910 - DNA, 15 bp, Homo sapiens
ccatcacttacagcc

SEQ ID NO: 78911 - DNA, 15 bp, Homo sapiens
cccatcacttacagc

SEQ ID NO: 78912 - DNA, 15 bp, Homo sapiens
ccccatcacttacag

SEQ ID NO: 78913 - DNA, 15 bp, Homo sapiens
accccatcacttaca

SEQ ID NO: 78914 - DNA, 15 bp, Homo sapiens
aaccccatcacttac

SEQ ID NO: 78915 - DNA, 15 bp, Homo sapiens
caaccccatcactta

SEQ ID NO: 78916 - DNA, 15 bp, Homo sapiens
acaaccccatcactt

SEQ ID NO: 78917 - DNA, 15 bp, Homo sapiens
gacaaccccatcact

SEQ ID NO: 78918 - DNA, 15 bp, Homo sapiens
tgacaaccccatcac

SEQ ID NO: 78919 - DNA, 15 bp, Homo sapiens
ctgacaaccccatca

SEQ ID NO: 78920 - DNA, 15 bp, Homo sapiens
gctgacaaccccatc

SEQ ID NO: 78921 - DNA, 15 bp, Homo sapiens
tgctgacaaccccat

SEQ ID NO: 78922 - DNA, 15 bp, Homo sapiens
atgctgacaacccca

SEQ ID NO: 78923 - DNA, 15 bp, Homo sapiens
gatgctgacaacccc

SEQ ID NO: 78924 - DNA, 15 bp, Homo sapiens
agatgctgacaaccc

SEQ ID NO: 78925 - DNA, 15 bp, Homo sapiens
cagatgctgacaacc

SEQ ID NO: 78926 - DNA, 15 bp, Homo sapiens
acagatgctgacaac

SEQ ID NO: 78927 - DNA, 15 bp, Homo sapiens
cacagatgctgacaa

SEQ ID NO: 78928 - DNA, 15 bp, Homo sapiens
acacagatgctgaca

SEQ ID NO: 78929 - DNA, 15 bp, Homo sapiens
aacacagatgctgac

SEQ ID NO: 78930 - DNA, 15 bp, Homo sapiens
caacacagatgctga

SEQ ID NO: 78931 - DNA, 15 bp, Homo sapiens
acaacacagatgctg

SEQ ID NO: 78932 - DNA, 15 bp, Homo sapiens
tacaacacagatgct

SEQ ID NO: 78933 - DNA, 15 bp, Homo sapiens
ttacaacacagatgc

SEQ ID NO: 78934 - DNA, 15 bp, Homo sapiens
cttacaacacagatg

SEQ ID NO: 78935 - DNA, 15 bp, Homo sapiens
gcttacaacacagat

SEQ ID NO: 78936 - DNA, 15 bp, Homo sapiens
ggcttacaacacaga

SEQ ID NO: 78937 - DNA, 15 bp, Homo sapiens
aggcttacaacacag

SEQ ID NO: 78938 - DNA, 15 bp, Homo sapiens
taggcttacaacaca

SEQ ID NO: 78939 - DNA, 15 bp, Homo sapiens
ataggcttacaacac

SEQ ID NO: 78940 - DNA, 15 bp, Homo sapiens
cataggcttacaaca

SEQ ID NO: 78941 - DNA, 15 bp, Homo sapiens
tcataggcttacaac

SEQ ID NO: 78942 - DNA, 15 bp, Homo sapiens
atcataggcttacaa

SEQ ID NO: 78943 - DNA, 15 bp, Homo sapiens
tatcataggcttaca

SEQ ID NO: 78944 - DNA, 15 bp, Homo sapiens
atatcataggcttac

SEQ ID NO: 78945 - DNA, 15 bp, Homo sapiens
gatatcataggctta

SEQ ID NO: 78946 - DNA, 15 bp, Homo sapiens
agatatcataggctt

SEQ ID NO: 78947 - DNA, 15 bp, Homo sapiens
aagatatcataggct

SEQ ID NO: 78948 - DNA, 15 bp, Homo sapiens
taagatatcataggc

SEQ ID NO: 78949 - DNA, 15 bp, Homo sapiens
ttaagatatcatagg

SEQ ID NO: 78950 - DNA, 15 bp, Homo sapiens
attaagatatcatag

SEQ ID NO: 78951 - DNA, 15 bp, Homo sapiens
cattaagatatcata

SEQ ID NO: 78952 - DNA, 15 bp, Homo sapiens
acattaagatatcat

SEQ ID NO: 78953 - DNA, 15 bp, Homo sapiens
aacattaagatatca

SEQ ID NO: 78954 - DNA, 15 bp, Homo sapiens
aaacattaagatatc

SEQ ID NO: 78955 - DNA, 15 bp, Homo sapiens
aaaacattaagatat

SEQ ID NO: 78956 - DNA, 15 bp, Homo sapiens
taaaacattaagata

SEQ ID NO: 78957 - DNA, 15 bp, Homo sapiens
ataaaacattaagat

SEQ ID NO: 78958 - DNA, 15 bp, Homo sapiens
tataaaacattaaga

SEQ ID NO: 78959 - DNA, 15 bp, Homo sapiens
ctataaaacattaag

SEQ ID NO: 78960 - DNA, 15 bp, Homo sapiens
gctataaaacattaa

SEQ ID NO: 78961 - DNA, 15 bp, Homo sapiens
agctataaaacatta

SEQ ID NO: 78962 - DNA, 15 bp, Homo sapiens
tagctataaaacatt

SEQ ID NO: 78963 - DNA, 15 bp, Homo sapiens
ttagctataaaacat

SEQ ID NO: 78964 - DNA, 15 bp, Homo sapiens
attagctataaaaca

SEQ ID NO: 78965 - DNA, 15 bp, Homo sapiens
cattagctataaaac

SEQ ID NO: 78966 - DNA, 15 bp, Homo sapiens
ccattagctataaaa

SEQ ID NO: 78967 - DNA, 15 bp, Homo sapiens
accattagctataaa

SEQ ID NO: 78968 - DNA, 15 bp, Homo sapiens
aaccattagctataa

SEQ ID NO: 78969 - DNA, 15 bp, Homo sapiens
taaccattagctata

SEQ ID NO: 78970 - DNA, 15 bp, Homo sapiens
ctaaccattagctat

SEQ ID NO: 78971 - DNA, 15 bp, Homo sapiens
actaaccattagcta

SEQ ID NO: 78972 - DNA, 15 bp, Homo sapiens
tactaaccattagct

SEQ ID NO: 78973 - DNA, 15 bp, Homo sapiens
ctactaaccattagc

SEQ ID NO: 78974 - DNA, 15 bp, Homo sapiens
tctactaaccattag

SEQ ID NO: 78975 - DNA, 15 bp, Homo sapiens
ttctactaaccatta

SEQ ID NO: 78976 - DNA, 15 bp, Homo sapiens
attctactaaccatt

SEQ ID NO: 78977 - DNA, 15 bp, Homo sapiens
aattctactaaccat

SEQ ID NO: 78978 - DNA, 15 bp, Homo sapiens
aaattctactaacca

SEQ ID NO: 78979 - DNA, 15 bp, Homo sapiens
taaattctactaacc

SEQ ID NO: 78980 - DNA, 15 bp, Homo sapiens
ctaaattctactaac

SEQ ID NO: 78981 - DNA, 15 bp, Homo sapiens
actaaattctactaa

SEQ ID NO: 78982 - DNA, 15 bp, Homo sapiens
cactaaattctacta

SEQ ID NO: 78983 - DNA, 15 bp, Homo sapiens
tcactaaattctact

SEQ ID NO: 78984 - DNA, 15 bp, Homo sapiens
ttcactaaattctac

SEQ ID NO: 78985 - DNA, 15 bp, Homo sapiens
attcactaaattcta

SEQ ID NO: 78986 - DNA, 15 bp, Homo sapiens
cattcactaaattct

SEQ ID NO: 78987 - DNA, 15 bp, Homo sapiens
gcattcactaaattc

SEQ ID NO: 78988 - DNA, 15 bp, Homo sapiens
tgcattcactaaatt

SEQ ID NO: 78989 - DNA, 15 bp, Homo sapiens
ctgcattcactaaat

SEQ ID NO: 78990 - DNA, 15 bp, Homo sapiens
tctgcattcactaaa

SEQ ID NO: 78991 - DNA, 15 bp, Homo sapiens
atctgcattcactaa

SEQ ID NO: 78992 - DNA, 15 bp, Homo sapiens
aatctgcattcacta

SEQ ID NO: 78993 - DNA, 15 bp, Homo sapiens
taatctgcattcact

SEQ ID NO: 78994 - DNA, 15 bp, Homo sapiens
gtaatctgcattcac

SEQ ID NO: 78995 - DNA, 15 bp, Homo sapiens
tgtaatctgcattca

SEQ ID NO: 78996 - DNA, 15 bp, Homo sapiens
ctgtaatctgcattc

SEQ ID NO: 78997 - DNA, 15 bp, Homo sapiens
gctgtaatctgcatt

SEQ ID NO: 78998 - DNA, 15 bp, Homo sapiens
agctgtaatctgcat

SEQ ID NO: 78999 - DNA, 15 bp, Homo sapiens
gagctgtaatctgca

SEQ ID NO: 79000 - DNA, 15 bp, Homo sapiens
tgagctgtaatctgc

SEQ ID NO: 79001 - DNA, 15 bp, Homo sapiens
atgagctgtaatctg

SEQ ID NO: 79002 - DNA, 15 bp, Homo sapiens
aatgagctgtaatct

SEQ ID NO: 79003 - DNA, 15 bp, Homo sapiens
taatgagctgtaatc

SEQ ID NO: 79004 - DNA, 15 bp, Homo sapiens
gtaatgagctgtaat

SEQ ID NO: 79005 - DNA, 15 bp, Homo sapiens
ggtaatgagctgtaa

SEQ ID NO: 79006 - DNA, 15 bp, Homo sapiens
aggtaatgagctgta

SEQ ID NO: 79007 - DNA, 15 bp, Homo sapiens
taggtaatgagctgt

SEQ ID NO: 79008 - DNA, 15 bp, Homo sapiens
ctaggtaatgagctg

SEQ ID NO: 79009 - DNA, 15 bp, Homo sapiens
gctaggtaatgagct

SEQ ID NO: 79010 - DNA, 15 bp, Homo sapiens
tgctaggtaatgagc

SEQ ID NO: 79011 - DNA, 15 bp, Homo sapiens
atgctaggtaatgag

SEQ ID NO: 79012 - DNA, 15 bp, Homo sapiens
aatgctaggtaatga

SEQ ID NO: 79013 - DNA, 15 bp, Homo sapiens
taatgctaggtaatg

SEQ ID NO: 79014 - DNA, 15 bp, Homo sapiens
ctaatgctaggtaat

SEQ ID NO: 79015 - DNA, 15 bp, Homo sapiens
tctaatgctaggtaa

SEQ ID NO: 79016 - DNA, 15 bp, Homo sapiens
gtctaatgctaggta

SEQ ID NO: 79017 - DNA, 15 bp, Homo sapiens
agtctaatgctaggt

SEQ ID NO: 79018 - DNA, 15 bp, Homo sapiens
cagtctaatgctagg

SEQ ID NO: 79019 - DNA, 15 bp, Homo sapiens
gcagtctaatgctag

SEQ ID NO: 79020 - DNA, 15 bp, Homo sapiens
agcagtctaatgcta

SEQ ID NO: 79021 - DNA, 15 bp, Homo sapiens
cagcagtctaatgct

SEQ ID NO: 79022 - DNA, 15 bp, Homo sapiens
gcagcagtctaatgc

SEQ ID NO: 79023 - DNA, 15 bp, Homo sapiens
ggcagcagtctaatg

SEQ ID NO: 79024 - DNA, 15 bp, Homo sapiens
gggcagcagtctaat

SEQ ID NO: 79025 - DNA, 15 bp, Homo sapiens
agggcagcagtctaa

SEQ ID NO: 79026 - DNA, 15 bp, Homo sapiens
cagggcagcagtcta

SEQ ID NO: 79027 - DNA, 15 bp, Homo sapiens
acagggcagcagtct

SEQ ID NO: 79028 - DNA, 15 bp, Homo sapiens
tacagggcagcagtc

SEQ ID NO: 79029 - DNA, 15 bp, Homo sapiens
ttacagggcagcagt

SEQ ID NO: 79030 - DNA, 15 bp, Homo sapiens
gttacagggcagcag

SEQ ID NO: 79031 - DNA, 15 bp, Homo sapiens
tgttacagggcagca

SEQ ID NO: 79032 - DNA, 15 bp, Homo sapiens
ttgttacagggcagc

SEQ ID NO: 79033 - DNA, 15 bp, Homo sapiens
attgttacagggcag

SEQ ID NO: 79034 - DNA, 15 bp, Homo sapiens
gattgttacagggca

SEQ ID NO: 79035 - DNA, 15 bp, Homo sapiens
agattgttacagggc

SEQ ID NO: 79036 - DNA, 15 bp, Homo sapiens
cagattgttacaggg

SEQ ID NO: 79037 - DNA, 15 bp, Homo sapiens
ccagattgttacagg

SEQ ID NO: 79038 - DNA, 15 bp, Homo sapiens
tccagattgttacag

SEQ ID NO: 79039 - DNA, 15 bp, Homo sapiens
ttccagattgttaca

SEQ ID NO: 79040 - DNA, 15 bp, Homo sapiens
gttccagattgttac

SEQ ID NO: 79041 - DNA, 15 bp, Homo sapiens
ggttccagattgtta

SEQ ID NO: 79042 - DNA, 15 bp, Homo sapiens
tggttccagattgtt

SEQ ID NO: 79043 - DNA, 15 bp, Homo sapiens
gtggttccagattgt

SEQ ID NO: 79044 - DNA, 15 bp, Homo sapiens
cgtggttccagattg

SEQ ID NO: 79045 - DNA, 15 bp, Homo sapiens
tcgtggttccagatt

SEQ ID NO: 79046 - DNA, 15 bp, Homo sapiens
ctcgtggttccagat

SEQ ID NO: 79047 - DNA, 15 bp, Homo sapiens
actcgtggttccaga

SEQ ID NO: 79048 - DNA, 15 bp, Homo sapiens
gactcgtggttccag

SEQ ID NO: 79049 - DNA, 15 bp, Homo sapiens
agactcgtggttcca

SEQ ID NO: 79050 - DNA, 15 bp, Homo sapiens
aagactcgtggttcc

SEQ ID NO: 79051 - DNA, 15 bp, Homo sapiens
taagactcgtggttc

SEQ ID NO: 79052 - DNA, 15 bp, Homo sapiens
gtaagactcgtggtt

SEQ ID NO: 79053 - DNA, 15 bp, Homo sapiens
ggtaagactcgtggt

SEQ ID NO: 79054 - DNA, 15 bp, Homo sapiens
aggtaagactcgtgg

SEQ ID NO: 79055 - DNA, 15 bp, Homo sapiens
aaggtaagactcgtg

SEQ ID NO: 79056 - DNA, 15 bp, Homo sapiens
aaaggtaagactcgt

SEQ ID NO: 79057 - DNA, 15 bp, Homo sapiens
aaaaggtaagactcg

SEQ ID NO: 79058 - DNA, 15 bp, Homo sapiens
taaaaggtaagactc

SEQ ID NO: 79059 - DNA, 15 bp, Homo sapiens
ctaaaaggtaagact

SEQ ID NO: 79060 - DNA, 15 bp, Homo sapiens
gctaaaaggtaagac

SEQ ID NO: 79061 - DNA, 15 bp, Homo sapiens
tgctaaaaggtaaga

SEQ ID NO: 79062 - DNA, 15 bp, Homo sapiens
atgctaaaaggtaag

SEQ ID NO: 79063 - DNA, 15 bp, Homo sapiens
tatgctaaaaggtaa

SEQ ID NO: 79064 - DNA, 15 bp, Homo sapiens
ctatgctaaaaggta

SEQ ID NO: 79065 - DNA, 15 bp, Homo sapiens
actatgctaaaaggt

SEQ ID NO: 79066 - DNA, 15 bp, Homo sapiens
cactatgctaaaagg

SEQ ID NO: 79067 - DNA, 15 bp, Homo sapiens
tcactatgctaaaag

SEQ ID NO: 79068 - DNA, 15 bp, Homo sapiens
ttcactatgctaaaa

SEQ ID NO: 79069 - DNA, 15 bp, Homo sapiens
gttcactatgctaaa

SEQ ID NO: 79070 - DNA, 15 bp, Homo sapiens
agttcactatgctaa

SEQ ID NO: 79071 - DNA, 15 bp, Homo sapiens
cagttcactatgcta

SEQ ID NO: 79072 - DNA, 15 bp, Homo sapiens
gcagttcactatgct

SEQ ID NO: 79073 - DNA, 15 bp, Homo sapiens
tgcagttcactatgc

SEQ ID NO: 79074 - DNA, 15 bp, Homo sapiens
ttgcagttcactatg

SEQ ID NO: 79075 - DNA, 15 bp, Homo sapiens
tttgcagttcactat

SEQ ID NO: 79076 - DNA, 15 bp, Homo sapiens
ctttgcagttcacta

SEQ ID NO: 79077 - DNA, 15 bp, Homo sapiens
gctttgcagttcact

SEQ ID NO: 79078 - DNA, 15 bp, Homo sapiens
tgctttgcagttcac

SEQ ID NO: 79079 - DNA, 15 bp, Homo sapiens
atgctttgcagttca

SEQ ID NO: 79080 - DNA, 15 bp, Homo sapiens
catgctttgcagttc

SEQ ID NO: 79081 - DNA, 15 bp, Homo sapiens
acatgctttgcagtt

SEQ ID NO: 79082 - DNA, 15 bp, Homo sapiens
tacatgctttgcagt

SEQ ID NO: 79083 - DNA, 15 bp, Homo sapiens
gtacatgctttgcag

SEQ ID NO: 79084 - DNA, 15 bp, Homo sapiens
tgtacatgctttgca

SEQ ID NO: 79085 - DNA, 15 bp, Homo sapiens
atgtacatgctttgc

SEQ ID NO: 79086 - DNA, 15 bp, Homo sapiens
aatgtacatgctttg

SEQ ID NO: 79087 - DNA, 15 bp, Homo sapiens
aaatgtacatgcttt

SEQ ID NO: 79088 - DNA, 15 bp, Homo sapiens
aaaatgtacatgctt

SEQ ID NO: 79089 - DNA, 15 bp, Homo sapiens
taaaatgtacatgct

SEQ ID NO: 79090 - DNA, 15 bp, Homo sapiens
gtaaaatgtacatgc

SEQ ID NO: 79091 - DNA, 15 bp, Homo sapiens
agtaaaatgtacatg

SEQ ID NO: 79092 - DNA, 15 bp, Homo sapiens
tagtaaaatgtacat

SEQ ID NO: 79093 - DNA, 15 bp, Homo sapiens
atagtaaaatgtaca

SEQ ID NO: 79094 - DNA, 15 bp, Homo sapiens
tatagtaaaatgtac

SEQ ID NO: 79095 - DNA, 15 bp, Homo sapiens
ttatagtaaaatgta

SEQ ID NO: 79096 - DNA, 15 bp, Homo sapiens
tttatagtaaaatgt

SEQ ID NO: 79097 - DNA, 15 bp, Homo sapiens
ttttatagtaaaatg

SEQ ID NO: 79098 - DNA, 15 bp, Homo sapiens
cttttatagtaaaat

SEQ ID NO: 79099 - DNA, 15 bp, Homo sapiens
tcttttatagtaaaa

SEQ ID NO: 79100 - DNA, 15 bp, Homo sapiens
atcttttatagtaaa

SEQ ID NO: 79101 - DNA, 15 bp, Homo sapiens
tatcttttatagtaa

SEQ ID NO: 79102 - DNA, 15 bp, Homo sapiens
gtatcttttatagta

SEQ ID NO: 79103 - DNA, 15 bp, Homo sapiens
tgtatcttttatagt

SEQ ID NO: 79104 - DNA, 15 bp, Homo sapiens
atgtatcttttatag

SEQ ID NO: 79105 - DNA, 15 bp, Homo sapiens
catgtatcttttata

SEQ ID NO: 79106 - DNA, 15 bp, Homo sapiens
acatgtatcttttat

SEQ ID NO: 79107 - DNA, 15 bp, Homo sapiens
aacatgtatctttta

SEQ ID NO: 79108 - DNA, 15 bp, Homo sapiens
aaacatgtatctttt

SEQ ID NO: 79109 - DNA, 15 bp, Homo sapiens
taaacatgtatcttt

SEQ ID NO: 79110 - DNA, 15 bp, Homo sapiens
ttaaacatgtatctt

SEQ ID NO: 79111 - DNA, 15 bp, Homo sapiens
tttaaacatgtatct

SEQ ID NO: 79112 - DNA, 15 bp, Homo sapiens
ttttaaacatgtatc

SEQ ID NO: 79113 - DNA, 15 bp, Homo sapiens
attttaaacatgtat

SEQ ID NO: 79114 - DNA, 15 bp, Homo sapiens
aattttaaacatgta

SEQ ID NO: 79115 - DNA, 15 bp, Homo sapiens
aaattttaaacatgt

SEQ ID NO: 79116 - DNA, 15 bp, Homo sapiens
aaaattttaaacatg

SEQ ID NO: 79117 - DNA, 15 bp, Homo sapiens
aaaaattttaaacat

SEQ ID NO: 79118 - DNA, 15 bp, Homo sapiens
caaaaattttaaaca

SEQ ID NO: 79119 - DNA, 15 bp, Homo sapiens
ccaaaaattttaaac

SEQ ID NO: 79120 - DNA, 15 bp, Homo sapiens
gccaaaaattttaaa

SEQ ID NO: 79121 - DNA, 15 bp, Homo sapiens
agccaaaaattttaa

SEQ ID NO: 79122 - DNA, 15 bp, Homo sapiens
cagccaaaaatttta

SEQ ID NO: 79123 - DNA, 15 bp, Homo sapiens
ccagccaaaaatttt

SEQ ID NO: 79124 - DNA, 15 bp, Homo sapiens
cccagccaaaaattt

SEQ ID NO: 79125 - DNA, 15 bp, Homo sapiens
ccccagccaaaaatt

SEQ ID NO: 79126 - DNA, 15 bp, Homo sapiens
tccccagccaaaaat

SEQ ID NO: 79127 - DNA, 15 bp, Homo sapiens
ttccccagccaaaaa

SEQ ID NO: 79128 - DNA, 15 bp, Homo sapiens
gttccccagccaaaa

SEQ ID NO: 79129 - DNA, 15 bp, Homo sapiens
tgttccccagccaaa

SEQ ID NO: 79130 - DNA, 15 bp, Homo sapiens
ctgttccccagccaa

SEQ ID NO: 79131 - DNA, 15 bp, Homo sapiens
tctgttccccagcca

SEQ ID NO: 79132 - DNA, 15 bp, Homo sapiens
ttctgttccccagcc

SEQ ID NO: 79133 - DNA, 15 bp, Homo sapiens
tttctgttccccagc

SEQ ID NO: 79134 - DNA, 15 bp, Homo sapiens
ctttctgttccccag

SEQ ID NO: 79135 - DNA, 15 bp, Homo sapiens
tctttctgttcccca

SEQ ID NO: 79136 - DNA, 15 bp, Homo sapiens
gtctttctgttcccc

SEQ ID NO: 79137 - DNA, 15 bp, Homo sapiens
tgtctttctgttccc

SEQ ID NO: 79138 - DNA, 15 bp, Homo sapiens
ttgtctttctgttcc

SEQ ID NO: 79139 - DNA, 15 bp, Homo sapiens
tttgtctttctgttc

SEQ ID NO: 79140 - DNA, 15 bp, Homo sapiens
ctttgtctttctgtt

SEQ ID NO: 79141 - DNA, 15 bp, Homo sapiens
actttgtctttctgt

SEQ ID NO: 79142 - DNA, 15 bp, Homo sapiens
gactttgtctttctg

SEQ ID NO: 79143 - DNA, 15 bp, Homo sapiens
ggactttgtctttct

SEQ ID NO: 79144 - DNA, 15 bp, Homo sapiens
aggactttgtctttc

SEQ ID NO: 79145 - DNA, 15 bp, Homo sapiens
caggactttgtcttt

SEQ ID NO: 79146 - DNA, 15 bp, Homo sapiens
acaggactttgtctt

SEQ ID NO: 79147 - DNA, 15 bp, Homo sapiens
aacaggactttgtct

SEQ ID NO: 79148 - DNA, 15 bp, Homo sapiens
taacaggactttgtc

SEQ ID NO: 79149 - DNA, 15 bp, Homo sapiens
ttaacaggactttgt

SEQ ID NO: 79150 - DNA, 15 bp, Homo sapiens
tttaacaggactttg

SEQ ID NO: 79151 - DNA, 15 bp, Homo sapiens
ttttaacaggacttt

SEQ ID NO: 79152 - DNA, 15 bp, Homo sapiens
tttttaacaggactt

SEQ ID NO: 79153 - DNA, 15 bp, Homo sapiens
ctttttaacaggact

SEQ ID NO: 79154 - DNA, 15 bp, Homo sapiens
tctttttaacaggac

SEQ ID NO: 79155 - DNA, 15 bp, Homo sapiens
ctctttttaacagga

SEQ ID NO: 79156 - DNA, 15 bp, Homo sapiens
actctttttaacagg

SEQ ID NO: 79157 - DNA, 15 bp, Homo sapiens
gactctttttaacag

SEQ ID NO: 79158 - DNA, 15 bp, Homo sapiens
tgactctttttaaca

SEQ ID NO: 79159 - DNA, 15 bp, Homo sapiens
atgactctttttaac

SEQ ID NO: 79160 - DNA, 15 bp, Homo sapiens
gatgactctttttaa

SEQ ID NO: 79161 - DNA, 15 bp, Homo sapiens
agatgactcttttta

SEQ ID NO: 79162 - DNA, 15 bp, Homo sapiens
tagatgactcttttt

SEQ ID NO: 79163 - DNA, 15 bp, Homo sapiens
ttagatgactctttt

SEQ ID NO: 79164 - DNA, 15 bp, Homo sapiens
attagatgactcttt

SEQ ID NO: 79165 - DNA, 15 bp, Homo sapiens
tattagatgactctt

SEQ ID NO: 79166 - DNA, 15 bp, Homo sapiens
ttattagatgactct

SEQ ID NO: 79167 - DNA, 15 bp, Homo sapiens
tttattagatgactc

SEQ ID NO: 79168 - DNA, 15 bp, Homo sapiens
atttattagatgact

SEQ ID NO: 79169 - DNA, 15 bp, Homo sapiens
tatttattagatgac

SEQ ID NO: 79170 - DNA, 15 bp, Homo sapiens
atatttattagatga

SEQ ID NO: 79171 - DNA, 15 bp, Homo sapiens
gatatttattagatg

SEQ ID NO: 79172 - DNA, 15 bp, Homo sapiens
agatatttattagat

SEQ ID NO: 79173 - DNA, 15 bp, Homo sapiens
cagatatttattaga

SEQ ID NO: 79174 - DNA, 15 bp, Homo sapiens
tcagatatttattag

SEQ ID NO: 79175 - DNA, 15 bp, Homo sapiens
ttcagatatttatta

SEQ ID NO: 79176 - DNA, 15 bp, Homo sapiens
tttcagatatttatt

SEQ ID NO: 79177 - DNA, 15 bp, Homo sapiens
atttcagatatttat

SEQ ID NO: 79178 - DNA, 15 bp, Homo sapiens
tatttcagatattta

SEQ ID NO: 79179 - DNA, 15 bp, Homo sapiens
gtatttcagatattt

SEQ ID NO: 79180 - DNA, 15 bp, Homo sapiens
agtatttcagatatt

SEQ ID NO: 79181 - DNA, 15 bp, Homo sapiens
tagtatttcagatat

SEQ ID NO: 79182 - DNA, 15 bp, Homo sapiens
ctagtatttcagata

SEQ ID NO: 79183 - DNA, 15 bp, Homo sapiens
tctagtatttcagat

SEQ ID NO: 79184 - DNA, 15 bp, Homo sapiens
atctagtatttcaga

SEQ ID NO: 79185 - DNA, 15 bp, Homo sapiens
aatctagtatttcag

SEQ ID NO: 79186 - DNA, 15 bp, Homo sapiens
aaatctagtatttca

SEQ ID NO: 79187 - DNA, 15 bp, Homo sapiens
aaaatctagtatttc

SEQ ID NO: 79188 - DNA, 15 bp, Homo sapiens
caaaatctagtattt

SEQ ID NO: 79189 - DNA, 15 bp, Homo sapiens
tcaaaatctagtatt

SEQ ID NO: 79190 - DNA, 15 bp, Homo sapiens
ttcaaaatctagtat

SEQ ID NO: 79191 - DNA, 15 bp, Homo sapiens
cttcaaaatctagta

SEQ ID NO: 79192 - DNA, 15 bp, Homo sapiens
ccttcaaaatctagt

SEQ ID NO: 79193 - DNA, 15 bp, Homo sapiens
tccttcaaaatctag

SEQ ID NO: 79194 - DNA, 15 bp, Homo sapiens
ttccttcaaaatcta

SEQ ID NO: 79195 - DNA, 15 bp, Homo sapiens
cttccttcaaaatct

SEQ ID NO: 79196 - DNA, 15 bp, Homo sapiens
tcttccttcaaaatc

SEQ ID NO: 79197 - DNA, 15 bp, Homo sapiens
gtcttccttcaaaat

SEQ ID NO: 79198 - DNA, 15 bp, Homo sapiens
tgtcttccttcaaaa

SEQ ID NO: 79199 - DNA, 15 bp, Homo sapiens
atgtcttccttcaaa

SEQ ID NO: 79200 - DNA, 15 bp, Homo sapiens
catgtcttccttcaa

SEQ ID NO: 79201 - DNA, 15 bp, Homo sapiens
ccatgtcttccttca

SEQ ID NO: 79202 - DNA, 15 bp, Homo sapiens
tccatgtcttccttc

SEQ ID NO: 79203 - DNA, 15 bp, Homo sapiens
ttccatgtcttcctt

SEQ ID NO: 79204 - DNA, 15 bp, Homo sapiens
tttccatgtcttcct

SEQ ID NO: 79205 - DNA, 15 bp, Homo sapiens
atttccatgtcttcc

SEQ ID NO: 79206 - DNA, 15 bp, Homo sapiens
catttccatgtcttc

SEQ ID NO: 79207 - DNA, 15 bp, Homo sapiens
tcatttccatgtctt

SEQ ID NO: 79208 - DNA, 15 bp, Homo sapiens
ttcatttccatgtct

SEQ ID NO: 79209 - DNA, 15 bp, Homo sapiens
cttcatttccatgtc

SEQ ID NO: 79210 - DNA, 15 bp, Homo sapiens
gcttcatttccatgt

SEQ ID NO: 79211 - DNA, 15 bp, Homo sapiens
cgcttcatttccatg

SEQ ID NO: 79212 - DNA, 15 bp, Homo sapiens
acgcttcatttccat

SEQ ID NO: 79213 - DNA, 15 bp, Homo sapiens
gacgcttcatttcca

SEQ ID NO: 79214 - DNA, 15 bp, Homo sapiens
tgacgcttcatttcc

SEQ ID NO: 79215 - DNA, 15 bp, Homo sapiens
ttgacgcttcatttc

SEQ ID NO: 79216 - DNA, 15 bp, Homo sapiens
tttgacgcttcattt

SEQ ID NO: 79217 - DNA, 15 bp, Homo sapiens
gtttgacgcttcatt

SEQ ID NO: 79218 - DNA, 15 bp, Homo sapiens
tgtttgacgcttcat

SEQ ID NO: 79219 - DNA, 15 bp, Homo sapiens
atgtttgacgcttca

SEQ ID NO: 79220 - DNA, 15 bp, Homo sapiens
aatgtttgacgcttc

SEQ ID NO: 79221 - DNA, 15 bp, Homo sapiens
caatgtttgacgctt

SEQ ID NO: 79222 - DNA, 15 bp, Homo sapiens
ccaatgtttgacgct

SEQ ID NO: 79223 - DNA, 15 bp, Homo sapiens
tccaatgtttgacgc

SEQ ID NO: 79224 - DNA, 15 bp, Homo sapiens
atccaatgtttgacg

SEQ ID NO: 79225 - DNA, 15 bp, Homo sapiens
gatccaatgtttgac

SEQ ID NO: 79226 - DNA, 15 bp, Homo sapiens
tgatccaatgtttga

SEQ ID NO: 79227 - DNA, 15 bp, Homo sapiens
ctgatccaatgtttg

SEQ ID NO: 79228 - DNA, 15 bp, Homo sapiens
gctgatccaatgttt

SEQ ID NO: 79229 - DNA, 15 bp, Homo sapiens
agctgatccaatgtt

SEQ ID NO: 79230 - DNA, 15 bp, Homo sapiens
cagctgatccaatgt

SEQ ID NO: 79231 - DNA, 15 bp, Homo sapiens
tcagctgatccaatg

SEQ ID NO: 79232 - DNA, 15 bp, Homo sapiens
ctcagctgatccaat

SEQ ID NO: 79233 - DNA, 15 bp, Homo sapiens
actcagctgatccaa

SEQ ID NO: 79234 - DNA, 15 bp, Homo sapiens
cactcagctgatcca

SEQ ID NO: 79235 - DNA, 15 bp, Homo sapiens
tcactcagctgatcc

SEQ ID NO: 79236 - DNA, 15 bp, Homo sapiens
ctcactcagctgatc

SEQ ID NO: 79237 - DNA, 15 bp, Homo sapiens
tctcactcagctgat

SEQ ID NO: 79238 - DNA, 15 bp, Homo sapiens
atctcactcagctga

SEQ ID NO: 79239 - DNA, 15 bp, Homo sapiens
aatctcactcagctg

SEQ ID NO: 79240 - DNA, 15 bp, Homo sapiens
caatctcactcagct

SEQ ID NO: 79241 - DNA, 15 bp, Homo sapiens
ccaatctcactcagc

SEQ ID NO: 79242 - DNA, 15 bp, Homo sapiens
gccaatctcactcag

SEQ ID NO: 79243 - DNA, 15 bp, Homo sapiens
ggccaatctcactca

SEQ ID NO: 79244 - DNA, 15 bp, Homo sapiens
tggccaatctcactc

SEQ ID NO: 79245 - DNA, 15 bp, Homo sapiens
ctggccaatctcact

SEQ ID NO: 79246 - DNA, 15 bp, Homo sapiens
cctggccaatctcac

SEQ ID NO: 79247 - DNA, 15 bp, Homo sapiens
tcctggccaatctca

SEQ ID NO: 79248 - DNA, 15 bp, Homo sapiens
atcctggccaatctc

SEQ ID NO: 79249 - DNA, 15 bp, Homo sapiens
catcctggccaatct

SEQ ID NO: 79250 - DNA, 15 bp, Homo sapiens
acatcctggccaatc

SEQ ID NO: 79251 - DNA, 15 bp, Homo sapiens
cacatcctggccaat

SEQ ID NO: 79252 - DNA, 15 bp, Homo sapiens
ccacatcctggccaa

SEQ ID NO: 79253 - DNA, 15 bp, Homo sapiens
cccacatcctggcca

SEQ ID NO: 79254 - DNA, 15 bp, Homo sapiens
tcccacatcctggcc

SEQ ID NO: 79255 - DNA, 15 bp, Homo sapiens
gtcccacatcctggc

SEQ ID NO: 79256 - DNA, 15 bp, Homo sapiens
tgtcccacatcctgg

SEQ ID NO: 79257 - DNA, 15 bp, Homo sapiens
ttgtcccacatcctg

SEQ ID NO: 79258 - DNA, 15 bp, Homo sapiens
attgtcccacatcct

SEQ ID NO: 79259 - DNA, 15 bp, Homo sapiens
aattgtcccacatcc

SEQ ID NO: 79260 - DNA, 15 bp, Homo sapiens
taattgtcccacatc

SEQ ID NO: 79261 - DNA, 15 bp, Homo sapiens
gtaattgtcccacat

SEQ ID NO: 79262 - DNA, 15 bp, Homo sapiens
agtaattgtcccaca

SEQ ID NO: 79263 - DNA, 15 bp, Homo sapiens
aagtaattgtcccac

SEQ ID NO: 79264 - DNA, 15 bp, Homo sapiens
caagtaattgtccca

SEQ ID NO: 79265 - DNA, 15 bp, Homo sapiens
tcaagtaattgtccc

SEQ ID NO: 79266 - DNA, 15 bp, Homo sapiens
atcaagtaattgtcc

SEQ ID NO: 79267 - DNA, 15 bp, Homo sapiens
tatcaagtaattgtc

SEQ ID NO: 79268 - DNA, 15 bp, Homo sapiens
ttatcaagtaattgt

SEQ ID NO: 79269 - DNA, 15 bp, Homo sapiens
attatcaagtaattg

SEQ ID NO: 79270 - DNA, 15 bp, Homo sapiens
aattatcaagtaatt

SEQ ID NO: 79271 - DNA, 15 bp, Homo sapiens
gaattatcaagtaat

SEQ ID NO: 79272 - DNA, 15 bp, Homo sapiens
ggaattatcaagtaa

SEQ ID NO: 79273 - DNA, 15 bp, Homo sapiens
tggaattatcaagta

SEQ ID NO: 79274 - DNA, 15 bp, Homo sapiens
ttggaattatcaagt

SEQ ID NO: 79275 - DNA, 15 bp, Homo sapiens
cttggaattatcaag

SEQ ID NO: 79276 - DNA, 15 bp, Homo sapiens
ccttggaattatcaa

SEQ ID NO: 79277 - DNA, 15 bp, Homo sapiens
gccttggaattatca

SEQ ID NO: 79278 - DNA, 15 bp, Homo sapiens
tgccttggaattatc

SEQ ID NO: 79279 - DNA, 15 bp, Homo sapiens
atgccttggaattat

SEQ ID NO: 79280 - DNA, 15 bp, Homo sapiens
gatgccttggaatta

SEQ ID NO: 79281 - DNA, 15 bp, Homo sapiens
agatgccttggaatt

SEQ ID NO: 79282 - DNA, 15 bp, Homo sapiens
tagatgccttggaat

SEQ ID NO: 79283 - DNA, 15 bp, Homo sapiens
ttagatgccttggaa

SEQ ID NO: 79284 - DNA, 15 bp, Homo sapiens
cttagatgccttgga

SEQ ID NO: 79285 - DNA, 15 bp, Homo sapiens
tcttagatgccttgg

SEQ ID NO: 79286 - DNA, 15 bp, Homo sapiens
ttcttagatgccttg

SEQ ID NO: 79287 - DNA, 15 bp, Homo sapiens
cttcttagatgcctt

SEQ ID NO: 79288 - DNA, 15 bp, Homo sapiens
tcttcttagatgcct

SEQ ID NO: 79289 - DNA, 15 bp, Homo sapiens
atcttcttagatgcc

SEQ ID NO: 79290 - DNA, 15 bp, Homo sapiens
gatcttcttagatgc

SEQ ID NO: 79291 - DNA, 15 bp, Homo sapiens
tgatcttcttagatg

SEQ ID NO: 79292 - DNA, 15 bp, Homo sapiens
ttgatcttcttagat

SEQ ID NO: 79293 - DNA, 15 bp, Homo sapiens
gttgatcttcttaga

SEQ ID NO: 79294 - DNA, 15 bp, Homo sapiens
tgttgatcttcttag

SEQ ID NO: 79295 - DNA, 15 bp, Homo sapiens
ctgttgatcttctta

SEQ ID NO: 79296 - DNA, 15 bp, Homo sapiens
actgttgatcttctt

SEQ ID NO: 79297 - DNA, 15 bp, Homo sapiens
cactgttgatcttct

SEQ ID NO: 79298 - DNA, 15 bp, Homo sapiens
tcactgttgatcttc

SEQ ID NO: 79299 - DNA, 15 bp, Homo sapiens
gtcactgttgatctt

SEQ ID NO: 79300 - DNA, 15 bp, Homo sapiens
agtcactgttgatct

SEQ ID NO: 79301 - DNA, 15 bp, Homo sapiens
gagtcactgttgatc

SEQ ID NO: 79302 - DNA, 15 bp, Homo sapiens
tgagtcactgttgat

SEQ ID NO: 79303 - DNA, 15 bp, Homo sapiens
ctgagtcactgttga

SEQ ID NO: 79304 - DNA, 15 bp, Homo sapiens
tctgagtcactgttg

SEQ ID NO: 79305 - DNA, 15 bp, Homo sapiens
ctctgagtcactgtt

SEQ ID NO: 79306 - DNA, 15 bp, Homo sapiens
cctctgagtcactgt

SEQ ID NO: 79307 - DNA, 15 bp, Homo sapiens
tcctctgagtcactg

SEQ ID NO: 79308 - DNA, 15 bp, Homo sapiens
ttcctctgagtcact

SEQ ID NO: 79309 - DNA, 15 bp, Homo sapiens
gttcctctgagtcac

SEQ ID NO: 79310 - DNA, 15 bp, Homo sapiens
agttcctctgagtca

SEQ ID NO: 79311 - DNA, 15 bp, Homo sapiens
cagttcctctgagtc

SEQ ID NO: 79312 - DNA, 15 bp, Homo sapiens
tcagttcctctgagt

SEQ ID NO: 79313 - DNA, 15 bp, Homo sapiens
gtcagttcctctgag

SEQ ID NO: 79314 - DNA, 15 bp, Homo sapiens
agtcagttcctctga

SEQ ID NO: 79315 - DNA, 15 bp, Homo sapiens
gagtcagttcctctg

SEQ ID NO: 79316 - DNA, 15 bp, Homo sapiens
tgagtcagttcctct

SEQ ID NO: 79317 - DNA, 15 bp, Homo sapiens
ttgagtcagttcctc

SEQ ID NO: 79318 - DNA, 15 bp, Homo sapiens
tttgagtcagttcct

SEQ ID NO: 79319 - DNA, 15 bp, Homo sapiens
ctttgagtcagttcc

SEQ ID NO: 79320 - DNA, 15 bp, Homo sapiens
tctttgagtcagttc

SEQ ID NO: 79321 - DNA, 15 bp, Homo sapiens
atctttgagtcagtt

SEQ ID NO: 79322 - DNA, 15 bp, Homo sapiens
catctttgagtcagt

SEQ ID NO: 79323 - DNA, 15 bp, Homo sapiens
ccatctttgagtcag

SEQ ID NO: 79324 - DNA, 15 bp, Homo sapiens
cccatctttgagtca

SEQ ID NO: 79325 - DNA, 15 bp, Homo sapiens
tcccatctttgagtc

SEQ ID NO: 79326 - DNA, 15 bp, Homo sapiens
atcccatctttgagt

SEQ ID NO: 79327 - DNA, 15 bp, Homo sapiens
aatcccatctttgag

SEQ ID NO: 79328 - DNA, 15 bp, Homo sapiens
gaatcccatctttga

SEQ ID NO: 79329 - DNA, 15 bp, Homo sapiens
agaatcccatctttg

SEQ ID NO: 79330 - DNA, 15 bp, Homo sapiens
aagaatcccatcttt

SEQ ID NO: 79331 - DNA, 15 bp, Homo sapiens
aaagaatcccatctt

SEQ ID NO: 79332 - DNA, 15 bp, Homo sapiens
caaagaatcccatct

SEQ ID NO: 79333 - DNA, 15 bp, Homo sapiens
ccaaagaatcccatc

SEQ ID NO: 79334 - DNA, 15 bp, Homo sapiens
accaaagaatcccat

SEQ ID NO: 79335 - DNA, 15 bp, Homo sapiens
aaccaaagaatccca

SEQ ID NO: 79336 - DNA, 15 bp, Homo sapiens
gaaccaaagaatccc

SEQ ID NO: 79337 - DNA, 15 bp, Homo sapiens
tgaaccaaagaatcc

SEQ ID NO: 79338 - DNA, 15 bp, Homo sapiens
ctgaaccaaagaatc

SEQ ID NO: 79339 - DNA, 15 bp, Homo sapiens
tctgaaccaaagaat

SEQ ID NO: 79340 - DNA, 15 bp, Homo sapiens
ctctgaaccaaagaa

SEQ ID NO: 79341 - DNA, 15 bp, Homo sapiens
tctctgaaccaaaga

SEQ ID NO: 79342 - DNA, 15 bp, Homo sapiens
gtctctgaaccaaag

SEQ ID NO: 79343 - DNA, 15 bp, Homo sapiens
agtctctgaaccaaa

SEQ ID NO: 79344 - DNA, 15 bp, Homo sapiens
tagtctctgaaccaa

SEQ ID NO: 79345 - DNA, 15 bp, Homo sapiens
ctagtctctgaacca

SEQ ID NO: 79346 - DNA, 15 bp, Homo sapiens
tctagtctctgaacc

SEQ ID NO: 79347 - DNA, 15 bp, Homo sapiens
ttctagtctctgaac

SEQ ID NO: 79348 - DNA, 15 bp, Homo sapiens
cttctagtctctgaa

SEQ ID NO: 79349 - DNA, 15 bp, Homo sapiens
tcttctagtctctga

SEQ ID NO: 79350 - DNA, 15 bp, Homo sapiens
atcttctagtctctg

SEQ ID NO: 79351 - DNA, 15 bp, Homo sapiens
aatcttctagtctct

SEQ ID NO: 79352 - DNA, 15 bp, Homo sapiens
gaatcttctagtctc

SEQ ID NO: 79353 - DNA, 15 bp, Homo sapiens
ggaatcttctagtct

SEQ ID NO: 79354 - DNA, 15 bp, Homo sapiens
aggaatcttctagtc

SEQ ID NO: 79355 - DNA, 15 bp, Homo sapiens
gaggaatcttctagt

SEQ ID NO: 79356 - DNA, 15 bp, Homo sapiens
ggaggaatcttctag

SEQ ID NO: 79357 - DNA, 15 bp, Homo sapiens
tggaggaatcttcta

SEQ ID NO: 79358 - DNA, 15 bp, Homo sapiens
ttggaggaatcttct

SEQ ID NO: 79359 - DNA, 15 bp, Homo sapiens
gttggaggaatcttc

SEQ ID NO: 79360 - DNA, 15 bp, Homo sapiens
ggttggaggaatctt

SEQ ID NO: 79361 - DNA, 15 bp, Homo sapiens
tggttggaggaatct

SEQ ID NO: 79362 - DNA, 15 bp, Homo sapiens
ctggttggaggaatc

SEQ ID NO: 79363 - DNA, 15 bp, Homo sapiens
cctggttggaggaat

SEQ ID NO: 79364 - DNA, 15 bp, Homo sapiens
acctggttggaggaa

SEQ ID NO: 79365 - DNA, 15 bp, Homo sapiens
tacctggttggagga

SEQ ID NO: 79366 - DNA, 15 bp, Homo sapiens
gtacctggttggagg

SEQ ID NO: 79367 - DNA, 15 bp, Homo sapiens
agtacctggttggag

SEQ ID NO: 79368 - DNA, 15 bp, Homo sapiens
aagtacctggttgga

SEQ ID NO: 79369 - DNA, 15 bp, Homo sapiens
aaagtacctggttgg

SEQ ID NO: 79370 - DNA, 15 bp, Homo sapiens
aaaagtacctggttg

SEQ ID NO: 79371 - DNA, 15 bp, Homo sapiens
aaaaagtacctggtt

SEQ ID NO: 79372 - DNA, 15 bp, Homo sapiens
caaaaagtacctggt

SEQ ID NO: 79373 - DNA, 15 bp, Homo sapiens
tcaaaaagtacctgg

SEQ ID NO: 79374 - DNA, 15 bp, Homo sapiens
atcaaaaagtacctg

SEQ ID NO: 79375 - DNA, 15 bp, Homo sapiens
aatcaaaaagtacct

SEQ ID NO: 79376 - DNA, 15 bp, Homo sapiens
aaatcaaaaagtacc

SEQ ID NO: 79377 - DNA, 15 bp, Homo sapiens
caaatcaaaaagtac

SEQ ID NO: 79378 - DNA, 15 bp, Homo sapiens
ccaaatcaaaaagta

SEQ ID NO: 79379 - DNA, 15 bp, Homo sapiens
tccaaatcaaaaagt

SEQ ID NO: 79380 - DNA, 15 bp, Homo sapiens
atccaaatcaaaaag

SEQ ID NO: 79381 - DNA, 15 bp, Homo sapiens
gatccaaatcaaaaa

SEQ ID NO: 79382 - DNA, 15 bp, Homo sapiens
tgatccaaatcaaaa

SEQ ID NO: 79383 - DNA, 15 bp, Homo sapiens
atgatccaaatcaaa

SEQ ID NO: 79384 - DNA, 15 bp, Homo sapiens
tatgatccaaatcaa

SEQ ID NO: 79385 - DNA, 15 bp, Homo sapiens
atatgatccaaatca

SEQ ID NO: 79386 - DNA, 15 bp, Homo sapiens
catatgatccaaatc

SEQ ID NO: 79387 - DNA, 15 bp, Homo sapiens
acatatgatccaaat

SEQ ID NO: 79388 - DNA, 15 bp, Homo sapiens
aacatatgatccaaa

SEQ ID NO: 79389 - DNA, 15 bp, Homo sapiens
caacatatgatccaa

SEQ ID NO: 79390 - DNA, 15 bp, Homo sapiens
acaacatatgatcca

SEQ ID NO: 79391 - DNA, 15 bp, Homo sapiens
cacaacatatgatcc

SEQ ID NO: 79392 - DNA, 15 bp, Homo sapiens
gcacaacatatgatc

SEQ ID NO: 79393 - DNA, 15 bp, Homo sapiens
ggcacaacatatgat

SEQ ID NO: 79394 - DNA, 15 bp, Homo sapiens
tggcacaacatatga

SEQ ID NO: 79395 - DNA, 15 bp, Homo sapiens
atggcacaacatatg

SEQ ID NO: 79396 - DNA, 15 bp, Homo sapiens
catggcacaacatat

SEQ ID NO: 79397 - DNA, 15 bp, Homo sapiens
tcatggcacaacata

SEQ ID NO: 79398 - DNA, 15 bp, Homo sapiens
ttcatggcacaacat

SEQ ID NO: 79399 - DNA, 15 bp, Homo sapiens
cttcatggcacaaca

SEQ ID NO: 79400 - DNA, 15 bp, Homo sapiens
acttcatggcacaac

SEQ ID NO: 79401 - DNA, 15 bp, Homo sapiens
tacttcatggcacaa

SEQ ID NO: 79402 - DNA, 15 bp, Homo sapiens
ttacttcatggcaca

SEQ ID NO: 79403 - DNA, 15 bp, Homo sapiens
tttacttcatggcac

SEQ ID NO: 79404 - DNA, 15 bp, Homo sapiens
gtttacttcatggca

SEQ ID NO: 79405 - DNA, 15 bp, Homo sapiens
tgtttacttcatggc

SEQ ID NO: 79406 - DNA, 15 bp, Homo sapiens
atgtttacttcatgg

SEQ ID NO: 79407 - DNA, 15 bp, Homo sapiens
aatgtttacttcatg

SEQ ID NO: 79408 - DNA, 15 bp, Homo sapiens
aaatgtttacttcat

SEQ ID NO: 79409 - DNA, 15 bp, Homo sapiens
taaatgtttacttca

SEQ ID NO: 79410 - DNA, 15 bp, Homo sapiens
ttaaatgtttacttc

SEQ ID NO: 79411 - DNA, 15 bp, Homo sapiens
tttaaatgtttactt

SEQ ID NO: 79412 - DNA, 15 bp, Homo sapiens
ttttaaatgtttact

SEQ ID NO: 79413 - DNA, 15 bp, Homo sapiens
attttaaatgtttac

SEQ ID NO: 79414 - DNA, 15 bp, Homo sapiens
aattttaaatgttta

SEQ ID NO: 79415 - DNA, 15 bp, Homo sapiens
aaattttaaatgttt

SEQ ID NO: 79416 - DNA, 15 bp, Homo sapiens
taaattttaaatgtt

SEQ ID NO: 79417 - DNA, 15 bp, Homo sapiens
ttaaattttaaatgt

SEQ ID NO: 79418 - DNA, 15 bp, Homo sapiens
tttaaattttaaatg

SEQ ID NO: 79419 - DNA, 15 bp, Homo sapiens
atttaaattttaaat

SEQ ID NO: 79420 - DNA, 15 bp, Homo sapiens
catttaaattttaaa

SEQ ID NO: 79421 - DNA, 15 bp, Homo sapiens
acatttaaattttaa

SEQ ID NO: 79422 - DNA, 15 bp, Homo sapiens
aacatttaaatttta

SEQ ID NO: 79423 - DNA, 15 bp, Homo sapiens
gaacatttaaatttt

SEQ ID NO: 79424 - DNA, 15 bp, Homo sapiens
tgaacatttaaattt

SEQ ID NO: 79425 - DNA, 15 bp, Homo sapiens
ctgaacatttaaatt

SEQ ID NO: 79426 - DNA, 15 bp, Homo sapiens
cctgaacatttaaat

SEQ ID NO: 79427 - DNA, 15 bp, Homo sapiens
acctgaacatttaaa

SEQ ID NO: 79428 - DNA, 15 bp, Homo sapiens
aacctgaacatttaa

SEQ ID NO: 79429 - DNA, 15 bp, Homo sapiens
taacctgaacattta

SEQ ID NO: 79430 - DNA, 15 bp, Homo sapiens
ctaacctgaacattt

SEQ ID NO: 79431 - DNA, 15 bp, Homo sapiens
actaacctgaacatt

SEQ ID NO: 79432 - DNA, 15 bp, Homo sapiens
aactaacctgaacat

SEQ ID NO: 79433 - DNA, 15 bp, Homo sapiens
aaactaacctgaaca

SEQ ID NO: 79434 - DNA, 15 bp, Homo sapiens
aaaactaacctgaac

SEQ ID NO: 79435 - DNA, 15 bp, Homo sapiens
taaaactaacctgaa

SEQ ID NO: 79436 - DNA, 15 bp, Homo sapiens
ttaaaactaacctga

SEQ ID NO: 79437 - DNA, 15 bp, Homo sapiens
attaaaactaacctg

SEQ ID NO: 79438 - DNA, 15 bp, Homo sapiens
aattaaaactaacct

SEQ ID NO: 79439 - DNA, 15 bp, Homo sapiens
aaattaaaactaacc

SEQ ID NO: 79440 - DNA, 15 bp, Homo sapiens
caaattaaaactaac

SEQ ID NO: 79441 - DNA, 15 bp, Homo sapiens
acaaattaaaactaa

SEQ ID NO: 79442 - DNA, 15 bp, Homo sapiens
tacaaattaaaacta

SEQ ID NO: 79443 - DNA, 15 bp, Homo sapiens
atacaaattaaaact

SEQ ID NO: 79444 - DNA, 15 bp, Homo sapiens
catacaaattaaaac

SEQ ID NO: 79445 - DNA, 15 bp, Homo sapiens
tcatacaaattaaaa

SEQ ID NO: 79446 - DNA, 15 bp, Homo sapiens
ttcatacaaattaaa

SEQ ID NO: 79447 - DNA, 15 bp, Homo sapiens
tttcatacaaattaa

SEQ ID NO: 79448 - DNA, 15 bp, Homo sapiens
atttcatacaaatta

SEQ ID NO: 79449 - DNA, 15 bp, Homo sapiens
tatttcatacaaatt

SEQ ID NO: 79450 - DNA, 15 bp, Homo sapiens
ttatttcatacaaat

SEQ ID NO: 79451 - DNA, 15 bp, Homo sapiens
tttatttcatacaaa

SEQ ID NO: 79452 - DNA, 15 bp, Homo sapiens
gtttatttcatacaa

SEQ ID NO: 79453 - DNA, 15 bp, Homo sapiens
agtttatttcataca

SEQ ID NO: 79454 - DNA, 15 bp, Homo sapiens
tagtttatttcatac

SEQ ID NO: 79455 - DNA, 15 bp, Homo sapiens
ttagtttatttcata

SEQ ID NO: 79456 - DNA, 15 bp, Homo sapiens
tttagtttatttcat

SEQ ID NO: 79457 - DNA, 15 bp, Homo sapiens
ttttagtttatttca

SEQ ID NO: 79458 - DNA, 15 bp, Homo sapiens
tttttagtttatttc

SEQ ID NO: 79459 - DNA, 15 bp, Homo sapiens
ctttttagtttattt

SEQ ID NO: 79460 - DNA, 15 bp, Homo sapiens
actttttagtttatt

SEQ ID NO: 79461 - DNA, 15 bp, Homo sapiens
aactttttagtttat

SEQ ID NO: 79462 - DNA, 15 bp, Homo sapiens
caactttttagttta

SEQ ID NO: 79463 - DNA, 15 bp, Homo sapiens
acaactttttagttt

SEQ ID NO: 79464 - DNA, 15 bp, Homo sapiens
aacaactttttagtt

SEQ ID NO: 79465 - DNA, 15 bp, Homo sapiens
aaacaactttttagt

SEQ ID NO: 79466 - DNA, 15 bp, Homo sapiens
gaaacaactttttag

SEQ ID NO: 79467 - DNA, 15 bp, Homo sapiens
ggaaacaacttttta

SEQ ID NO: 79468 - DNA, 15 bp, Homo sapiens
aggaaacaacttttt

SEQ ID NO: 79469 - DNA, 15 bp, Homo sapiens
aaggaaacaactttt

SEQ ID NO: 79470 - DNA, 15 bp, Homo sapiens
taaggaaacaacttt

SEQ ID NO: 79471 - DNA, 15 bp, Homo sapiens
gtaaggaaacaactt

SEQ ID NO: 79472 - DNA, 15 bp, Homo sapiens
tgtaaggaaacaact

SEQ ID NO: 79473 - DNA, 15 bp, Homo sapiens
gtgtaaggaaacaac

SEQ ID NO: 79474 - DNA, 15 bp, Homo sapiens
ggtgtaaggaaacaa

SEQ ID NO: 79475 - DNA, 15 bp, Homo sapiens
aggtgtaaggaaaca

SEQ ID NO: 79476 - DNA, 15 bp, Homo sapiens
caggtgtaaggaaac

SEQ ID NO: 79477 - DNA, 15 bp, Homo sapiens
tcaggtgtaaggaaa

SEQ ID NO: 79478 - DNA, 15 bp, Homo sapiens
atcaggtgtaaggaa

SEQ ID NO: 79479 - DNA, 15 bp, Homo sapiens
catcaggtgtaagga

SEQ ID NO: 79480 - DNA, 15 bp, Homo sapiens
tcatcaggtgtaagg

SEQ ID NO: 79481 - DNA, 15 bp, Homo sapiens
ttcatcaggtgtaag

SEQ ID NO: 79482 - DNA, 15 bp, Homo sapiens
tttcatcaggtgtaa

SEQ ID NO: 79483 - DNA, 15 bp, Homo sapiens
ttttcatcaggtgta

SEQ ID NO: 79484 - DNA, 15 bp, Homo sapiens
tttttcatcaggtgt

SEQ ID NO: 79485 - DNA, 15 bp, Homo sapiens
atttttcatcaggtg

SEQ ID NO: 79486 - DNA, 15 bp, Homo sapiens
aatttttcatcaggt

SEQ ID NO: 79487 - DNA, 15 bp, Homo sapiens
caatttttcatcagg

SEQ ID NO: 79488 - DNA, 15 bp, Homo sapiens
tcaatttttcatcag

SEQ ID NO: 79489 - DNA, 15 bp, Homo sapiens
gtcaatttttcatca

SEQ ID NO: 79490 - DNA, 15 bp, Homo sapiens
tgtcaatttttcatc

SEQ ID NO: 79491 - DNA, 15 bp, Homo sapiens
atgtcaatttttcat

SEQ ID NO: 79492 - DNA, 15 bp, Homo sapiens
catgtcaatttttca

SEQ ID NO: 79493 - DNA, 15 bp, Homo sapiens
acatgtcaatttttc

SEQ ID NO: 79494 - DNA, 15 bp, Homo sapiens
cacatgtcaattttt

SEQ ID NO: 79495 - DNA, 15 bp, Homo sapiens
tcacatgtcaatttt

SEQ ID NO: 79496 - DNA, 15 bp, Homo sapiens
ttcacatgtcaattt

SEQ ID NO: 79497 - DNA, 15 bp, Homo sapiens
tttcacatgtcaatt

SEQ ID NO: 79498 - DNA, 15 bp, Homo sapiens
ttttcacatgtcaat

SEQ ID NO: 79499 - DNA, 15 bp, Homo sapiens
attttcacatgtcaa

SEQ ID NO: 79500 - DNA, 15 bp, Homo sapiens
gattttcacatgtca

SEQ ID NO: 79501 - DNA, 15 bp, Homo sapiens
tgattttcacatgtc

SEQ ID NO: 79502 - DNA, 15 bp, Homo sapiens
gtgattttcacatgt

SEQ ID NO: 79503 - DNA, 15 bp, Homo sapiens
ggtgattttcacatg

SEQ ID NO: 79504 - DNA, 15 bp, Homo sapiens
aggtgattttcacat

SEQ ID NO: 79505 - DNA, 15 bp, Homo sapiens
aaggtgattttcaca

SEQ ID NO: 79506 - DNA, 15 bp, Homo sapiens
gaaggtgattttcac

SEQ ID NO: 79507 - DNA, 15 bp, Homo sapiens
tgaaggtgattttca

SEQ ID NO: 79508 - DNA, 15 bp, Homo sapiens
ctgaaggtgattttc

SEQ ID NO: 79509 - DNA, 15 bp, Homo sapiens
actgaaggtgatttt

SEQ ID NO: 79510 - DNA, 15 bp, Homo sapiens
aactgaaggtgattt

SEQ ID NO: 79511 - DNA, 15 bp, Homo sapiens
aaactgaaggtgatt

SEQ ID NO: 79512 - DNA, 15 bp, Homo sapiens
aaaactgaaggtgat

SEQ ID NO: 79513 - DNA, 15 bp, Homo sapiens
gaaaactgaaggtga

SEQ ID NO: 79514 - DNA, 15 bp, Homo sapiens
agaaaactgaaggtg

SEQ ID NO: 79515 - DNA, 15 bp, Homo sapiens
tagaaaactgaaggt

SEQ ID NO: 79516 - DNA, 15 bp, Homo sapiens
ttagaaaactgaagg

SEQ ID NO: 79517 - DNA, 15 bp, Homo sapiens
tttagaaaactgaag

SEQ ID NO: 79518 - DNA, 15 bp, Homo sapiens
ctttagaaaactgaa

SEQ ID NO: 79519 - DNA, 15 bp, Homo sapiens
actttagaaaactga

SEQ ID NO: 79520 - DNA, 15 bp, Homo sapiens
tactttagaaaactg

SEQ ID NO: 79521 - DNA, 15 bp, Homo sapiens
ttactttagaaaact

SEQ ID NO: 79522 - DNA, 15 bp, Homo sapiens
cttactttagaaaac

SEQ ID NO: 79523 - DNA, 15 bp, Homo sapiens
acttactttagaaaa

SEQ ID NO: 79524 - DNA, 15 bp, Homo sapiens
aacttactttagaaa

SEQ ID NO: 79525 - DNA, 15 bp, Homo sapiens
aaacttactttagaa

SEQ ID NO: 79526 - DNA, 15 bp, Homo sapiens
aaaacttactttaga

SEQ ID NO: 79527 - DNA, 15 bp, Homo sapiens
taaaacttactttag

SEQ ID NO: 79528 - DNA, 15 bp, Homo sapiens
ttaaaacttacttta

SEQ ID NO: 79529 - DNA, 15 bp, Homo sapiens
attaaaacttacttt

SEQ ID NO: 79530 - DNA, 15 bp, Homo sapiens
tattaaaacttactt

SEQ ID NO: 79531 - DNA, 15 bp, Homo sapiens
ctattaaaacttact

SEQ ID NO: 79532 - DNA, 15 bp, Homo sapiens
tctattaaaacttac

SEQ ID NO: 79533 - DNA, 15 bp, Homo sapiens
atctattaaaactta

SEQ ID NO: 79534 - DNA, 15 bp, Homo sapiens
aatctattaaaactt

SEQ ID NO: 79535 - DNA, 15 bp, Homo sapiens
taatctattaaaact

SEQ ID NO: 79536 - DNA, 15 bp, Homo sapiens
ataatctattaaaac

SEQ ID NO: 79537 - DNA, 15 bp, Homo sapiens
gataatctattaaaa

SEQ ID NO: 79538 - DNA, 15 bp, Homo sapiens
agataatctattaaa

SEQ ID NO: 79539 - DNA, 15 bp, Homo sapiens
aagataatctattaa

SEQ ID NO: 79540 - DNA, 15 bp, Homo sapiens
taagataatctatta

SEQ ID NO: 79541 - DNA, 15 bp, Homo sapiens
ttaagataatctatt

SEQ ID NO: 79542 - DNA, 15 bp, Homo sapiens
attaagataatctat

SEQ ID NO: 79543 - DNA, 15 bp, Homo sapiens
tattaagataatcta

SEQ ID NO: 79544 - DNA, 15 bp, Homo sapiens
atattaagataatct

SEQ ID NO: 79545 - DNA, 15 bp, Homo sapiens
gatattaagataatc

SEQ ID NO: 79546 - DNA, 15 bp, Homo sapiens
ggatattaagataat

SEQ ID NO: 79547 - DNA, 15 bp, Homo sapiens
aggatattaagataa

SEQ ID NO: 79548 - DNA, 15 bp, Homo sapiens
taggatattaagata

SEQ ID NO: 79549 - DNA, 15 bp, Homo sapiens
ataggatattaagat

SEQ ID NO: 79550 - DNA, 15 bp, Homo sapiens
tataggatattaaga

SEQ ID NO: 79551 - DNA, 15 bp, Homo sapiens
ttataggatattaag

SEQ ID NO: 79552 - DNA, 15 bp, Homo sapiens
attataggatattaa

SEQ ID NO: 79553 - DNA, 15 bp, Homo sapiens
aattataggatatta

SEQ ID NO: 79554 - DNA, 15 bp, Homo sapiens
aaattataggatatt

SEQ ID NO: 79555 - DNA, 15 bp, Homo sapiens
taaattataggatat

SEQ ID NO: 79556 - DNA, 15 bp, Homo sapiens
ttaaattataggata

SEQ ID NO: 79557 - DNA, 15 bp, Homo sapiens
attaaattataggat

SEQ ID NO: 79558 - DNA, 15 bp, Homo sapiens
aattaaattatagga

SEQ ID NO: 79559 - DNA, 15 bp, Homo sapiens
aaattaaattatagg

SEQ ID NO: 79560 - DNA, 15 bp, Homo sapiens
taaattaaattatag

SEQ ID NO: 79561 - DNA, 15 bp, Homo sapiens
ataaattaaattata

SEQ ID NO: 79562 - DNA, 15 bp, Homo sapiens
tataaattaaattat

SEQ ID NO: 79563 - DNA, 15 bp, Homo sapiens
ctataaattaaatta

SEQ ID NO: 79564 - DNA, 15 bp, Homo sapiens
actataaattaaatt

SEQ ID NO: 79565 - DNA, 15 bp, Homo sapiens
tactataaattaaat

SEQ ID NO: 79566 - DNA, 15 bp, Homo sapiens
ttactataaattaaa

SEQ ID NO: 79567 - DNA, 15 bp, Homo sapiens
gttactataaattaa

SEQ ID NO: 79568 - DNA, 15 bp, Homo sapiens
agttactataaatta

SEQ ID NO: 79569 - DNA, 15 bp, Homo sapiens
cagttactataaatt

SEQ ID NO: 79570 - DNA, 15 bp, Homo sapiens
tcagttactataaat

SEQ ID NO: 79571 - DNA, 15 bp, Homo sapiens
atcagttactataaa

SEQ ID NO: 79572 - DNA, 15 bp, Homo sapiens
aatcagttactataa

SEQ ID NO: 79573 - DNA, 15 bp, Homo sapiens
taatcagttactata

SEQ ID NO: 79574 - DNA, 15 bp, Homo sapiens
ataatcagttactat

SEQ ID NO: 79575 - DNA, 15 bp, Homo sapiens
tataatcagttacta

SEQ ID NO: 79576 - DNA, 15 bp, Homo sapiens
gtataatcagttact

SEQ ID NO: 79577 - DNA, 15 bp, Homo sapiens
agtataatcagttac

SEQ ID NO: 79578 - DNA, 15 bp, Homo sapiens
aagtataatcagtta

SEQ ID NO: 79579 - DNA, 15 bp, Homo sapiens
taagtataatcagtt

SEQ ID NO: 79580 - DNA, 15 bp, Homo sapiens
ctaagtataatcagt

SEQ ID NO: 79581 - DNA, 15 bp, Homo sapiens
gctaagtataatcag

SEQ ID NO: 79582 - DNA, 15 bp, Homo sapiens
ggctaagtataatca

SEQ ID NO: 79583 - DNA, 15 bp, Homo sapiens
tggctaagtataatc

SEQ ID NO: 79584 - DNA, 15 bp, Homo sapiens
ttggctaagtataat

SEQ ID NO: 79585 - DNA, 15 bp, Homo sapiens
attggctaagtataa

SEQ ID NO: 79586 - DNA, 15 bp, Homo sapiens
tattggctaagtata

SEQ ID NO: 79587 - DNA, 15 bp, Homo sapiens
ttattggctaagtat

SEQ ID NO: 79588 - DNA, 15 bp, Homo sapiens
tttattggctaagta

SEQ ID NO: 79589 - DNA, 15 bp, Homo sapiens
atttattggctaagt

SEQ ID NO: 79590 - DNA, 15 bp, Homo sapiens
tatttattggctaag

SEQ ID NO: 79591 - DNA, 15 bp, Homo sapiens
ttatttattggctaa

SEQ ID NO: 79592 - DNA, 15 bp, Homo sapiens
attatttattggcta

SEQ ID NO: 79593 - DNA, 15 bp, Homo sapiens
gattatttattggct

SEQ ID NO: 79594 - DNA, 15 bp, Homo sapiens
agattatttattggc

SEQ ID NO: 79595 - DNA, 15 bp, Homo sapiens
aagattatttattgg

SEQ ID NO: 79596 - DNA, 15 bp, Homo sapiens
taagattatttattg

SEQ ID NO: 79597 - DNA, 15 bp, Homo sapiens
ttaagattatttatt

SEQ ID NO: 79598 - DNA, 15 bp, Homo sapiens
gttaagattatttat

SEQ ID NO: 79599 - DNA, 15 bp, Homo sapiens
tgttaagattattta

SEQ ID NO: 79600 - DNA, 15 bp, Homo sapiens
atgttaagattattt

SEQ ID NO: 79601 - DNA, 15 bp, Homo sapiens
gatgttaagattatt

SEQ ID NO: 79602 - DNA, 15 bp, Homo sapiens
agatgttaagattat

SEQ ID NO: 79603 - DNA, 15 bp, Homo sapiens
aagatgttaagatta

SEQ ID NO: 79604 - DNA, 15 bp, Homo sapiens
taagatgttaagatt

SEQ ID NO: 79605 - DNA, 15 bp, Homo sapiens
ttaagatgttaagat

SEQ ID NO: 79606 - DNA, 15 bp, Homo sapiens
tttaagatgttaaga

SEQ ID NO: 79607 - DNA, 15 bp, Homo sapiens
atttaagatgttaag

SEQ ID NO: 79608 - DNA, 15 bp, Homo sapiens
gatttaagatgttaa

SEQ ID NO: 79609 - DNA, 15 bp, Homo sapiens
agatttaagatgtta

SEQ ID NO: 79610 - DNA, 15 bp, Homo sapiens
aagatttaagatgtt

SEQ ID NO: 79611 - DNA, 15 bp, Homo sapiens
taagatttaagatgt

SEQ ID NO: 79612 - DNA, 15 bp, Homo sapiens
ttaagatttaagatg

SEQ ID NO: 79613 - DNA, 15 bp, Homo sapiens
cttaagatttaagat

SEQ ID NO: 79614 - DNA, 15 bp, Homo sapiens
acttaagatttaaga

SEQ ID NO: 79615 - DNA, 15 bp, Homo sapiens
tacttaagatttaag

SEQ ID NO: 79616 - DNA, 15 bp, Homo sapiens
ttacttaagatttaa

SEQ ID NO: 79617 - DNA, 15 bp, Homo sapiens
attacttaagattta

SEQ ID NO: 79618 - DNA, 15 bp, Homo sapiens
gattacttaagattt

SEQ ID NO: 79619 - DNA, 15 bp, Homo sapiens
agattacttaagatt

SEQ ID NO: 79620 - DNA, 15 bp, Homo sapiens
aagattacttaagat

SEQ ID NO: 79621 - DNA, 15 bp, Homo sapiens
taagattacttaaga

SEQ ID NO: 79622 - DNA, 15 bp, Homo sapiens
ataagattacttaag

SEQ ID NO: 79623 - DNA, 15 bp, Homo sapiens
aataagattacttaa

SEQ ID NO: 79624 - DNA, 15 bp, Homo sapiens
taataagattactta

SEQ ID NO: 79625 - DNA, 15 bp, Homo sapiens
ttaataagattactt

SEQ ID NO: 79626 - DNA, 15 bp, Homo sapiens
attaataagattact

SEQ ID NO: 79627 - DNA, 15 bp, Homo sapiens
gattaataagattac

SEQ ID NO: 79628 - DNA, 15 bp, Homo sapiens
agattaataagatta

SEQ ID NO: 79629 - DNA, 15 bp, Homo sapiens
aagattaataagatt

SEQ ID NO: 79630 - DNA, 15 bp, Homo sapiens
taagattaataagat

SEQ ID NO: 79631 - DNA, 15 bp, Homo sapiens
ttaagattaataaga

SEQ ID NO: 79632 - DNA, 15 bp, Homo sapiens
tttaagattaataag

SEQ ID NO: 79633 - DNA, 15 bp, Homo sapiens
ttttaagattaataa

SEQ ID NO: 79634 - DNA, 15 bp, Homo sapiens
tttttaagattaata

SEQ ID NO: 79635 - DNA, 15 bp, Homo sapiens
atttttaagattaat

SEQ ID NO: 79636 - DNA, 15 bp, Homo sapiens
tatttttaagattaa

SEQ ID NO: 79637 - DNA, 15 bp, Homo sapiens
atatttttaagatta

SEQ ID NO: 79638 - DNA, 15 bp, Homo sapiens
aatatttttaagatt

SEQ ID NO: 79639 - DNA, 15 bp, Homo sapiens
aaatatttttaagat

SEQ ID NO: 79640 - DNA, 15 bp, Homo sapiens
aaaatatttttaaga

SEQ ID NO: 79641 - DNA, 15 bp, Homo sapiens
taaaatatttttaag

SEQ ID NO: 79642 - DNA, 15 bp, Homo sapiens
ttaaaatatttttaa

SEQ ID NO: 79643 - DNA, 15 bp, Homo sapiens
attaaaatattttta

SEQ ID NO: 79644 - DNA, 15 bp, Homo sapiens
cattaaaatattttt

SEQ ID NO: 79645 - DNA, 15 bp, Homo sapiens
tcattaaaatatttt

SEQ ID NO: 79646 - DNA, 15 bp, Homo sapiens
ttcattaaaatattt

SEQ ID NO: 79647 - DNA, 15 bp, Homo sapiens
attcattaaaatatt

SEQ ID NO: 79648 - DNA, 15 bp, Homo sapiens
aattcattaaaatat

SEQ ID NO: 79649 - DNA, 15 bp, Homo sapiens
taattcattaaaata

SEQ ID NO: 79650 - DNA, 15 bp, Homo sapiens
ctaattcattaaaat

SEQ ID NO: 79651 - DNA, 15 bp, Homo sapiens
actaattcattaaaa

SEQ ID NO: 79652 - DNA, 15 bp, Homo sapiens
gactaattcattaaa

SEQ ID NO: 79653 - DNA, 15 bp, Homo sapiens
tgactaattcattaa

SEQ ID NO: 79654 - DNA, 15 bp, Homo sapiens
ttgactaattcatta

SEQ ID NO: 79655 - DNA, 15 bp, Homo sapiens
tttgactaattcatt

SEQ ID NO: 79656 - DNA, 15 bp, Homo sapiens
gtttgactaattcat

SEQ ID NO: 79657 - DNA, 15 bp, Homo sapiens
tgtttgactaattca

SEQ ID NO: 79658 - DNA, 15 bp, Homo sapiens
atgtttgactaattc

SEQ ID NO: 79659 - DNA, 15 bp, Homo sapiens
tatgtttgactaatt

SEQ ID NO: 79660 - DNA, 15 bp, Homo sapiens
ttatgtttgactaat

SEQ ID NO: 79661 - DNA, 15 bp, Homo sapiens
tttatgtttgactaa

SEQ ID NO: 79662 - DNA, 15 bp, Homo sapiens
ttttatgtttgacta

SEQ ID NO: 79663 - DNA, 15 bp, Homo sapiens
gttttatgtttgact

SEQ ID NO: 79664 - DNA, 15 bp, Homo sapiens
tgttttatgtttgac

SEQ ID NO: 79665 - DNA, 15 bp, Homo sapiens
atgttttatgtttga

SEQ ID NO: 79666 - DNA, 15 bp, Homo sapiens
aatgttttatgtttg

SEQ ID NO: 79667 - DNA, 15 bp, Homo sapiens
caatgttttatgttt

SEQ ID NO: 79668 - DNA, 15 bp, Homo sapiens
ccaatgttttatgtt

SEQ ID NO: 79669 - DNA, 15 bp, Homo sapiens
accaatgttttatgt

SEQ ID NO: 79670 - DNA, 15 bp, Homo sapiens
aaccaatgttttatg

SEQ ID NO: 79671 - DNA, 15 bp, Homo sapiens
aaaccaatgttttat

SEQ ID NO: 79672 - DNA, 15 bp, Homo sapiens
caaaccaatgtttta

SEQ ID NO: 79673 - DNA, 15 bp, Homo sapiens
acaaaccaatgtttt

SEQ ID NO: 79674 - DNA, 15 bp, Homo sapiens
tacaaaccaatgttt

SEQ ID NO: 79675 - DNA, 15 bp, Homo sapiens
ctacaaaccaatgtt

SEQ ID NO: 79676 - DNA, 15 bp, Homo sapiens
tctacaaaccaatgt

SEQ ID NO: 79677 - DNA, 15 bp, Homo sapiens
gtctacaaaccaatg

SEQ ID NO: 79678 - DNA, 15 bp, Homo sapiens
tgtctacaaaccaat

SEQ ID NO: 79679 - DNA, 15 bp, Homo sapiens
ctgtctacaaaccaa

SEQ ID NO: 79680 - DNA, 15 bp, Homo sapiens
tctgtctacaaacca

SEQ ID NO: 79681 - DNA, 15 bp, Homo sapiens
atctgtctacaaacc

SEQ ID NO: 79682 - DNA, 15 bp, Homo sapiens
tatctgtctacaaac

SEQ ID NO: 79683 - DNA, 15 bp, Homo sapiens
atatctgtctacaaa

SEQ ID NO: 79684 - DNA, 15 bp, Homo sapiens
aatatctgtctacaa

SEQ ID NO: 79685 - DNA, 15 bp, Homo sapiens
gaatatctgtctaca

SEQ ID NO: 79686 - DNA, 15 bp, Homo sapiens
agaatatctgtctac

SEQ ID NO: 79687 - DNA, 15 bp, Homo sapiens
aagaatatctgtcta

SEQ ID NO: 79688 - DNA, 15 bp, Homo sapiens
taagaatatctgtct

SEQ ID NO: 79689 - DNA, 15 bp, Homo sapiens
ctaagaatatctgtc

SEQ ID NO: 79690 - DNA, 15 bp, Homo sapiens
gctaagaatatctgt

SEQ ID NO: 79691 - DNA, 15 bp, Homo sapiens
tgctaagaatatctg

SEQ ID NO: 79692 - DNA, 15 bp, Homo sapiens
ctgctaagaatatct

SEQ ID NO: 79693 - DNA, 15 bp, Homo sapiens
gctgctaagaatatc

SEQ ID NO: 79694 - DNA, 15 bp, Homo sapiens
tgctgctaagaatat

SEQ ID NO: 79695 - DNA, 15 bp, Homo sapiens
atgctgctaagaata

SEQ ID NO: 79696 - DNA, 15 bp, Homo sapiens
aatgctgctaagaat

SEQ ID NO: 79697 - DNA, 15 bp, Homo sapiens
taatgctgctaagaa

SEQ ID NO: 79698 - DNA, 15 bp, Homo sapiens
ataatgctgctaaga

SEQ ID NO: 79699 - DNA, 15 bp, Homo sapiens
aataatgctgctaag

SEQ ID NO: 79700 - DNA, 15 bp, Homo sapiens
aaataatgctgctaa

SEQ ID NO: 79701 - DNA, 15 bp, Homo sapiens
taaataatgctgcta

SEQ ID NO: 79702 - DNA, 15 bp, Homo sapiens
ataaataatgctgct

SEQ ID NO: 79703 - DNA, 15 bp, Homo sapiens
tataaataatgctgc

SEQ ID NO: 79704 - DNA, 15 bp, Homo sapiens
ttataaataatgctg

SEQ ID NO: 79705 - DNA, 15 bp, Homo sapiens
attataaataatgct

SEQ ID NO: 79706 - DNA, 15 bp, Homo sapiens
tattataaataatgc

SEQ ID NO: 79707 - DNA, 15 bp, Homo sapiens
ctattataaataatg

SEQ ID NO: 79708 - DNA, 15 bp, Homo sapiens
gctattataaataat

SEQ ID NO: 79709 - DNA, 15 bp, Homo sapiens
ggctattataaataa

SEQ ID NO: 79710 - DNA, 15 bp, Homo sapiens
tggctattataaata

SEQ ID NO: 79711 - DNA, 15 bp, Homo sapiens
ttggctattataaat

SEQ ID NO: 79712 - DNA, 15 bp, Homo sapiens
tttggctattataaa

SEQ ID NO: 79713 - DNA, 15 bp, Homo sapiens
ttttggctattataa

SEQ ID NO: 79714 - DNA, 15 bp, Homo sapiens
tttttggctattata

SEQ ID NO: 79715 - DNA, 15 bp, Homo sapiens
tccactttttggcta

SEQ ID NO: 79716 - DNA, 15 bp, Homo sapiens
ttccactttttggct

SEQ ID NO: 79717 - DNA, 15 bp, Homo sapiens
gttccactttttggc

SEQ ID NO: 79718 - DNA, 15 bp, Homo sapiens
tgttccactttttgg

SEQ ID NO: 79719 - DNA, 15 bp, Homo sapiens
ttgttccactttttg

SEQ ID NO: 79720 - DNA, 15 bp, Homo sapiens
gttgttccacttttt

SEQ ID NO: 79721 - DNA, 15 bp, Homo sapiens
agttgttccactttt

SEQ ID NO: 79722 - DNA, 15 bp, Homo sapiens
gagttgttccacttt

SEQ ID NO: 79723 - DNA, 15 bp, Homo sapiens
tgagttgttccactt

SEQ ID NO: 79724 - DNA, 15 bp, Homo sapiens
ttgagttgttccact

SEQ ID NO: 79725 - DNA, 15 bp, Homo sapiens
tttgagttgttccac

SEQ ID NO: 79726 - DNA, 15 bp, Homo sapiens
atttgagttgttcca

SEQ ID NO: 79727 - DNA, 15 bp, Homo sapiens
tatttgagttgttcc

SEQ ID NO: 79728 - DNA, 15 bp, Homo sapiens
atatttgagttgttc

SEQ ID NO: 79729 - DNA, 15 bp, Homo sapiens
gatatttgagttgtt

SEQ ID NO: 79730 - DNA, 15 bp, Homo sapiens
ggatatttgagttgt

SEQ ID NO: 79731 - DNA, 15 bp, Homo sapiens
tggatatttgagttg

SEQ ID NO: 79732 - DNA, 15 bp, Homo sapiens
atggatatttgagtt

SEQ ID NO: 79733 - DNA, 15 bp, Homo sapiens
tatggatatttgagt

SEQ ID NO: 79734 - DNA, 15 bp, Homo sapiens
gtatggatatttgag

SEQ ID NO: 79735 - DNA, 15 bp, Homo sapiens
tgtatggatatttga

SEQ ID NO: 79736 - DNA, 15 bp, Homo sapiens
gtgtatggatatttg

SEQ ID NO: 79737 - DNA, 15 bp, Homo sapiens
tgtgtatggatattt

SEQ ID NO: 79738 - DNA, 15 bp, Homo sapiens
ctgtgtatggatatt

SEQ ID NO: 79739 - DNA, 15 bp, Homo sapiens
tctgtgtatggatat

SEQ ID NO: 79740 - DNA, 15 bp, Homo sapiens
atctgtgtatggata

SEQ ID NO: 79741 - DNA, 15 bp, Homo sapiens
catctgtgtatggat

SEQ ID NO: 79742 - DNA, 15 bp, Homo sapiens
tcatctgtgtatgga

SEQ ID NO: 79743 - DNA, 15 bp, Homo sapiens
ttcatctgtgtatgg

SEQ ID NO: 79744 - DNA, 15 bp, Homo sapiens
attcatctgtgtatg

SEQ ID NO: 79745 - DNA, 15 bp, Homo sapiens
cattcatctgtgtat

SEQ ID NO: 79746 - DNA, 15 bp, Homo sapiens
ccattcatctgtgta

SEQ ID NO: 79747 - DNA, 15 bp, Homo sapiens
tccattcatctgtgt

SEQ ID NO: 79748 - DNA, 15 bp, Homo sapiens
atccattcatctgtg

SEQ ID NO: 79749 - DNA, 15 bp, Homo sapiens
tatccattcatctgt

SEQ ID NO: 79750 - DNA, 15 bp, Homo sapiens
ttatccattcatctg

SEQ ID NO: 79751 - DNA, 15 bp, Homo sapiens
tttatccattcatct

SEQ ID NO: 79752 - DNA, 15 bp, Homo sapiens
gtttatccattcatc

SEQ ID NO: 79753 - DNA, 15 bp, Homo sapiens
tgtttatccattcat

SEQ ID NO: 79754 - DNA, 15 bp, Homo sapiens
ttgtttatccattca

SEQ ID NO: 79755 - DNA, 15 bp, Homo sapiens
tttgtttatccattc

SEQ ID NO: 79756 - DNA, 15 bp, Homo sapiens
ttttgtttatccatt

SEQ ID NO: 79757 - DNA, 15 bp, Homo sapiens
attttgtttatccat

SEQ ID NO: 79758 - DNA, 15 bp, Homo sapiens
cattttgtttatcca

SEQ ID NO: 79759 - DNA, 15 bp, Homo sapiens
acattttgtttatcc

SEQ ID NO: 79760 - DNA, 15 bp, Homo sapiens
cacattttgtttatc

SEQ ID NO: 79761 - DNA, 15 bp, Homo sapiens
ccacattttgtttat

SEQ ID NO: 79762 - DNA, 15 bp, Homo sapiens
accacattttgttta

SEQ ID NO: 79763 - DNA, 15 bp, Homo sapiens
caccacattttgttt

SEQ ID NO: 79764 - DNA, 15 bp, Homo sapiens
acaccacattttgtt

SEQ ID NO: 79765 - DNA, 15 bp, Homo sapiens
tacaccacattttgt

SEQ ID NO: 79766 - DNA, 15 bp, Homo sapiens
atacaccacattttg

SEQ ID NO: 79767 - DNA, 15 bp, Homo sapiens
catacaccacatttt

SEQ ID NO: 79768 - DNA, 15 bp, Homo sapiens
gcatacaccacattt

SEQ ID NO: 79769 - DNA, 15 bp, Homo sapiens
tgcatacaccacatt

SEQ ID NO: 79770 - DNA, 15 bp, Homo sapiens
atgcatacaccacat

SEQ ID NO: 79771 - DNA, 15 bp, Homo sapiens
tatgcatacaccaca

SEQ ID NO: 79772 - DNA, 15 bp, Homo sapiens
gtatgcatacaccac

SEQ ID NO: 79773 - DNA, 15 bp, Homo sapiens
tgtatgcatacacca

SEQ ID NO: 79774 - DNA, 15 bp, Homo sapiens
ttgtatgcatacacc

SEQ ID NO: 79775 - DNA, 15 bp, Homo sapiens
attgtatgcatacac

SEQ ID NO: 79776 - DNA, 15 bp, Homo sapiens
tattgtatgcataca

SEQ ID NO: 79777 - DNA, 15 bp, Homo sapiens
atattgtatgcatac

SEQ ID NO: 79778 - DNA, 15 bp, Homo sapiens
aatattgtatgcata

SEQ ID NO: 79779 - DNA, 15 bp, Homo sapiens
taatattgtatgcat

SEQ ID NO: 79780 - DNA, 15 bp, Homo sapiens
ataatattgtatgca

SEQ ID NO: 79781 - DNA, 15 bp, Homo sapiens
gataatattgtatgc

SEQ ID NO: 79782 - DNA, 15 bp, Homo sapiens
agataatattgtatg

SEQ ID NO: 79783 - DNA, 15 bp, Homo sapiens
cagataatattgtat

SEQ ID NO: 79784 - DNA, 15 bp, Homo sapiens
tcagataatattgta

SEQ ID NO: 79785 - DNA, 15 bp, Homo sapiens
atcagataatattgt

SEQ ID NO: 79786 - DNA, 15 bp, Homo sapiens
tatcagataatattg

SEQ ID NO: 79787 - DNA, 15 bp, Homo sapiens
ttatcagataatatt

SEQ ID NO: 79788 - DNA, 15 bp, Homo sapiens
attatcagataatat

SEQ ID NO: 79789 - DNA, 15 bp, Homo sapiens
tattatcagataata

SEQ ID NO: 79790 - DNA, 15 bp, Homo sapiens
gtattatcagataat

SEQ ID NO: 79791 - DNA, 15 bp, Homo sapiens
tgtattatcagataa

SEQ ID NO: 79792 - DNA, 15 bp, Homo sapiens
ttgtattatcagata

SEQ ID NO: 79793 - DNA, 15 bp, Homo sapiens
tttgtattatcagat

SEQ ID NO: 79794 - DNA, 15 bp, Homo sapiens
ttttgtattatcaga

SEQ ID NO: 79795 - DNA, 15 bp, Homo sapiens
cttttgtattatcag

SEQ ID NO: 79796 - DNA, 15 bp, Homo sapiens
tcttttgtattatca

SEQ ID NO: 79797 - DNA, 15 bp, Homo sapiens
ttcttttgtattatc

SEQ ID NO: 79798 - DNA, 15 bp, Homo sapiens
gttcttttgtattat

SEQ ID NO: 79799 - DNA, 15 bp, Homo sapiens
cgttcttttgtatta

SEQ ID NO: 79800 - DNA, 15 bp, Homo sapiens
tcgttcttttgtatt

SEQ ID NO: 79801 - DNA, 15 bp, Homo sapiens
ttcgttcttttgtat

SEQ ID NO: 79802 - DNA, 15 bp, Homo sapiens
cttcgttcttttgta

SEQ ID NO: 79803 - DNA, 15 bp, Homo sapiens
acttcgttcttttgt

SEQ ID NO: 79804 - DNA, 15 bp, Homo sapiens
tacttcgttcttttg

SEQ ID NO: 79805 - DNA, 15 bp, Homo sapiens
atacttcgttctttt

SEQ ID NO: 79806 - DNA, 15 bp, Homo sapiens
aatacttcgttcttt

SEQ ID NO: 79807 - DNA, 15 bp, Homo sapiens
caatacttcgttctt

SEQ ID NO: 79808 - DNA, 15 bp, Homo sapiens
tcaatacttcgttct

SEQ ID NO: 79809 - DNA, 15 bp, Homo sapiens
gtcaatacttcgttc

SEQ ID NO: 79810 - DNA, 15 bp, Homo sapiens
tgtcaatacttcgtt

SEQ ID NO: 79811 - DNA, 15 bp, Homo sapiens
gtgtcaatacttcgt

SEQ ID NO: 79812 - DNA, 15 bp, Homo sapiens
tgtgtcaatacttcg

SEQ ID NO: 79813 - DNA, 15 bp, Homo sapiens
atgtgtcaatacttc

SEQ ID NO: 79814 - DNA, 15 bp, Homo sapiens
catgtgtcaatactt

SEQ ID NO: 79815 - DNA, 15 bp, Homo sapiens
gcatgtgtcaatact

SEQ ID NO: 79816 - DNA, 15 bp, Homo sapiens
agcatgtgtcaatac

SEQ ID NO: 79817 - DNA, 15 bp, Homo sapiens
tagcatgtgtcaata

SEQ ID NO: 79818 - DNA, 15 bp, Homo sapiens
gtagcatgtgtcaat

SEQ ID NO: 79819 - DNA, 15 bp, Homo sapiens
tgtagcatgtgtcaa

SEQ ID NO: 79820 - DNA, 15 bp, Homo sapiens
ttgtagcatgtgtca

SEQ ID NO: 79821 - DNA, 15 bp, Homo sapiens
gttgtagcatgtgtc

SEQ ID NO: 79822 - DNA, 15 bp, Homo sapiens
tgttgtagcatgtgt

SEQ ID NO: 79823 - DNA, 15 bp, Homo sapiens
atgttgtagcatgtg

SEQ ID NO: 79824 - DNA, 15 bp, Homo sapiens
tatgttgtagcatgt

SEQ ID NO: 79825 - DNA, 15 bp, Homo sapiens
ctatgttgtagcatg

SEQ ID NO: 79826 - DNA, 15 bp, Homo sapiens
tctatgttgtagcat

SEQ ID NO: 79827 - DNA, 15 bp, Homo sapiens
atctatgttgtagca

SEQ ID NO: 79828 - DNA, 15 bp, Homo sapiens
catctatgttgtagc

SEQ ID NO: 79829 - DNA, 15 bp, Homo sapiens
tcatctatgttgtag

SEQ ID NO: 79830 - DNA, 15 bp, Homo sapiens
ttcatctatgttgta

SEQ ID NO: 79831 - DNA, 15 bp, Homo sapiens
gttcatctatgttgt

SEQ ID NO: 79832 - DNA, 15 bp, Homo sapiens
ggttcatctatgttg

SEQ ID NO: 79833 - DNA, 15 bp, Homo sapiens
aggttcatctatgtt

SEQ ID NO: 79834 - DNA, 15 bp, Homo sapiens
aaggttcatctatgt

SEQ ID NO: 79835 - DNA, 15 bp, Homo sapiens
caaggttcatctatg

SEQ ID NO: 79836 - DNA, 15 bp, Homo sapiens
tcaaggttcatctat

SEQ ID NO: 79837 - DNA, 15 bp, Homo sapiens
ttcaaggttcatcta

SEQ ID NO: 79838 - DNA, 15 bp, Homo sapiens
tttcaaggttcatct

SEQ ID NO: 79839 - DNA, 15 bp, Homo sapiens
ttttcaaggttcatc

SEQ ID NO: 79840 - DNA, 15 bp, Homo sapiens
gttttcaaggttcat

SEQ ID NO: 79841 - DNA, 15 bp, Homo sapiens
tgttttcaaggttca

SEQ ID NO: 79842 - DNA, 15 bp, Homo sapiens
gtgttttcaaggttc

SEQ ID NO: 79843 - DNA, 15 bp, Homo sapiens
agtgttttcaaggtt

SEQ ID NO: 79844 - DNA, 15 bp, Homo sapiens
tagtgttttcaaggt

SEQ ID NO: 79845 - DNA, 15 bp, Homo sapiens
atagtgttttcaagg

SEQ ID NO: 79846 - DNA, 15 bp, Homo sapiens
catagtgttttcaag

SEQ ID NO: 79847 - DNA, 15 bp, Homo sapiens
gcatagtgttttcaa

SEQ ID NO: 79848 - DNA, 15 bp, Homo sapiens
agcatagtgttttca

SEQ ID NO: 79849 - DNA, 15 bp, Homo sapiens
tagcatagtgttttc

SEQ ID NO: 79850 - DNA, 15 bp, Homo sapiens
ttagcatagtgtttt

SEQ ID NO: 79851 - DNA, 15 bp, Homo sapiens
cttagcatagtgttt

SEQ ID NO: 79852 - DNA, 15 bp, Homo sapiens
acttagcatagtgtt

SEQ ID NO: 79853 - DNA, 15 bp, Homo sapiens
tacttagcatagtgt

SEQ ID NO: 79854 - DNA, 15 bp, Homo sapiens
atacttagcatagtg

SEQ ID NO: 79855 - DNA, 15 bp, Homo sapiens
tatacttagcatagt

SEQ ID NO: 79856 - DNA, 15 bp, Homo sapiens
ttatacttagcatag

SEQ ID NO: 79857 - DNA, 15 bp, Homo sapiens
cttatacttagcata

SEQ ID NO: 79858 - DNA, 15 bp, Homo sapiens
tcttatacttagcat

SEQ ID NO: 79859 - DNA, 15 bp, Homo sapiens
ttcttatacttagca

SEQ ID NO: 79860 - DNA, 15 bp, Homo sapiens
cttcttatacttagc

SEQ ID NO: 79861 - DNA, 15 bp, Homo sapiens
gcttcttatacttag

SEQ ID NO: 79862 - DNA, 15 bp, Homo sapiens
ggcttcttatactta

SEQ ID NO: 79863 - DNA, 15 bp, Homo sapiens
tggcttcttatactt

SEQ ID NO: 79864 - DNA, 15 bp, Homo sapiens
ttggcttcttatact

SEQ ID NO: 79865 - DNA, 15 bp, Homo sapiens
attggcttcttatac

SEQ ID NO: 79866 - DNA, 15 bp, Homo sapiens
gattggcttcttata

SEQ ID NO: 79867 - DNA, 15 bp, Homo sapiens
cgattggcttcttat

SEQ ID NO: 79868 - DNA, 15 bp, Homo sapiens
gcgattggcttctta

SEQ ID NO: 79869 - DNA, 15 bp, Homo sapiens
tgcgattggcttctt

SEQ ID NO: 79870 - DNA, 15 bp, Homo sapiens
ttgcgattggcttct

SEQ ID NO: 79871 - DNA, 15 bp, Homo sapiens
cttgcgattggcttc

SEQ ID NO: 79872 - DNA, 15 bp, Homo sapiens
tcttgcgattggctt

SEQ ID NO: 79873 - DNA, 15 bp, Homo sapiens
atcttgcgattggct

SEQ ID NO: 79874 - DNA, 15 bp, Homo sapiens
aatcttgcgattggc

SEQ ID NO: 79875 - DNA, 15 bp, Homo sapiens
taatcttgcgattgg

SEQ ID NO: 79876 - DNA, 15 bp, Homo sapiens
ataatcttgcgattg

SEQ ID NO: 79877 - DNA, 15 bp, Homo sapiens
tataatcttgcgatt

SEQ ID NO: 79878 - DNA, 15 bp, Homo sapiens
atataatcttgcgat

SEQ ID NO: 79879 - DNA, 15 bp, Homo sapiens
tatataatcttgcga

SEQ ID NO: 79880 - DNA, 15 bp, Homo sapiens
gtatataatcttgcg

SEQ ID NO: 79881 - DNA, 15 bp, Homo sapiens
cgtatataatcttgc

SEQ ID NO: 79882 - DNA, 15 bp, Homo sapiens
gcgtatataatcttg

SEQ ID NO: 79883 - DNA, 15 bp, Homo sapiens
agcgtatataatctt

SEQ ID NO: 79884 - DNA, 15 bp, Homo sapiens
tagcgtatataatct

SEQ ID NO: 79885 - DNA, 15 bp, Homo sapiens
atagcgtatataatc

SEQ ID NO: 79886 - DNA, 15 bp, Homo sapiens
catagcgtatataat

SEQ ID NO: 79887 - DNA, 15 bp, Homo sapiens
tcatagcgtatataa

SEQ ID NO: 79888 - DNA, 15 bp, Homo sapiens
atcatagcgtatata

SEQ ID NO: 79889 - DNA, 15 bp, Homo sapiens
aatcatagcgtatat

SEQ ID NO: 79890 - DNA, 15 bp, Homo sapiens
gaatcatagcgtata

SEQ ID NO: 79891 - DNA, 15 bp, Homo sapiens
ggaatcatagcgtat

SEQ ID NO: 79892 - DNA, 15 bp, Homo sapiens
tggaatcatagcgta

SEQ ID NO: 79893 - DNA, 15 bp, Homo sapiens
atggaatcatagcgt

SEQ ID NO: 79894 - DNA, 15 bp, Homo sapiens
aatggaatcatagcg

SEQ ID NO: 79895 - DNA, 15 bp, Homo sapiens
gaatggaatcatagc

SEQ ID NO: 79896 - DNA, 15 bp, Homo sapiens
tgaatggaatcatag

SEQ ID NO: 79897 - DNA, 15 bp, Homo sapiens
atgaatggaatcata

SEQ ID NO: 79898 - DNA, 15 bp, Homo sapiens
tatgaatggaatcat

SEQ ID NO: 79899 - DNA, 15 bp, Homo sapiens
ctatgaatggaatca

SEQ ID NO: 79900 - DNA, 15 bp, Homo sapiens
cctatgaatggaatc

SEQ ID NO: 79901 - DNA, 15 bp, Homo sapiens
tcctatgaatggaat

SEQ ID NO: 79902 - DNA, 15 bp, Homo sapiens
ttcctatgaatggaa

SEQ ID NO: 79903 - DNA, 15 bp, Homo sapiens
tttcctatgaatgga

SEQ ID NO: 79904 - DNA, 15 bp, Homo sapiens
atttcctatgaatgg

SEQ ID NO: 79905 - DNA, 15 bp, Homo sapiens
catttcctatgaatg

SEQ ID NO: 79906 - DNA, 15 bp, Homo sapiens
acatttcctatgaat

SEQ ID NO: 79907 - DNA, 15 bp, Homo sapiens
gacatttcctatgaa

SEQ ID NO: 79908 - DNA, 15 bp, Homo sapiens
ggacatttcctatga

SEQ ID NO: 79909 - DNA, 15 bp, Homo sapiens
tggacatttcctatg

SEQ ID NO: 79910 - DNA, 15 bp, Homo sapiens
gtggacatttcctat

SEQ ID NO: 79911 - DNA, 15 bp, Homo sapiens
tgtggacatttccta

SEQ ID NO: 79912 - DNA, 15 bp, Homo sapiens
ttgtggacatttcct

SEQ ID NO: 79913 - DNA, 15 bp, Homo sapiens
cttgtggacatttcc

SEQ ID NO: 79914 - DNA, 15 bp, Homo sapiens
ccttgtggacatttc

SEQ ID NO: 79915 - DNA, 15 bp, Homo sapiens
cccttgtggacattt

SEQ ID NO: 79916 - DNA, 15 bp, Homo sapiens
ccccttgtggacatt

SEQ ID NO: 79917 - DNA, 15 bp, Homo sapiens
tccccttgtggacat

SEQ ID NO: 79918 - DNA, 15 bp, Homo sapiens
ttccccttgtggaca

SEQ ID NO: 79919 - DNA, 15 bp, Homo sapiens
tttccccttgtggac

SEQ ID NO: 79920 - DNA, 15 bp, Homo sapiens
ttttccccttgtgga

SEQ ID NO: 79921 - DNA, 15 bp, Homo sapiens
attttccccttgtgg

SEQ ID NO: 79922 - DNA, 15 bp, Homo sapiens
gattttccccttgtg

SEQ ID NO: 79923 - DNA, 15 bp, Homo sapiens
ggattttccccttgt

SEQ ID NO: 79924 - DNA, 15 bp, Homo sapiens
tggattttccccttg

SEQ ID NO: 79925 - DNA, 15 bp, Homo sapiens
gtggattttcccctt

SEQ ID NO: 79926 - DNA, 15 bp, Homo sapiens
tgtggattttcccct

SEQ ID NO: 79927 - DNA, 15 bp, Homo sapiens
ctgtggattttcccc

SEQ ID NO: 79928 - DNA, 15 bp, Homo sapiens
tctgtggattttccc

SEQ ID NO: 79929 - DNA, 15 bp, Homo sapiens
ctctgtggattttcc

SEQ ID NO: 79930 - DNA, 15 bp, Homo sapiens
tctctgtggattttc

SEQ ID NO: 79931 - DNA, 15 bp, Homo sapiens
atctctgtggatttt

SEQ ID NO: 79932 - DNA, 15 bp, Homo sapiens
tatctctgtggattt

SEQ ID NO: 79933 - DNA, 15 bp, Homo sapiens
ctatctctgtggatt

SEQ ID NO: 79934 - DNA, 15 bp, Homo sapiens
tctatctctgtggat

SEQ ID NO: 79935 - DNA, 15 bp, Homo sapiens
ttctatctctgtgga

SEQ ID NO: 79936 - DNA, 15 bp, Homo sapiens
tttctatctctgtgg

SEQ ID NO: 79937 - DNA, 15 bp, Homo sapiens
ctttctatctctgtg

SEQ ID NO: 79938 - DNA, 15 bp, Homo sapiens
actttctatctctgt

SEQ ID NO: 79939 - DNA, 15 bp, Homo sapiens
tactttctatctctg

SEQ ID NO: 79940 - DNA, 15 bp, Homo sapiens
ttactttctatctct

SEQ ID NO: 79941 - DNA, 15 bp, Homo sapiens
tttactttctatctc

SEQ ID NO: 79942 - DNA, 15 bp, Homo sapiens
atttactttctatct

SEQ ID NO: 79943 - DNA, 15 bp, Homo sapiens
catttactttctatc

SEQ ID NO: 79944 - DNA, 15 bp, Homo sapiens
gcatttactttctat

SEQ ID NO: 79945 - DNA, 15 bp, Homo sapiens
tgcatttactttcta

SEQ ID NO: 79946 - DNA, 15 bp, Homo sapiens
atgcatttactttct

SEQ ID NO: 79947 - DNA, 15 bp, Homo sapiens
catgcatttactttc

SEQ ID NO: 79948 - DNA, 15 bp, Homo sapiens
ccatgcatttacttt

SEQ ID NO: 79949 - DNA, 15 bp, Homo sapiens
accatgcatttactt

SEQ ID NO: 79950 - DNA, 15 bp, Homo sapiens
aaccatgcatttact

SEQ ID NO: 79951 - DNA, 15 bp, Homo sapiens
caaccatgcatttac

SEQ ID NO: 79952 - DNA, 15 bp, Homo sapiens
gcaaccatgcattta

SEQ ID NO: 79953 - DNA, 15 bp, Homo sapiens
ggcaaccatgcattt

SEQ ID NO: 79954 - DNA, 15 bp, Homo sapiens
tggcaaccatgcatt

SEQ ID NO: 79955 - DNA, 15 bp, Homo sapiens
gtggcaaccatgcat

SEQ ID NO: 79956 - DNA, 15 bp, Homo sapiens
agtggcaaccatgca

SEQ ID NO: 79957 - DNA, 15 bp, Homo sapiens
cagtggcaaccatgc

SEQ ID NO: 79958 - DNA, 15 bp, Homo sapiens
ccagtggcaaccatg

SEQ ID NO: 79959 - DNA, 15 bp, Homo sapiens
accagtggcaaccat

SEQ ID NO: 79960 - DNA, 15 bp, Homo sapiens
caccagtggcaacca

SEQ ID NO: 79961 - DNA, 15 bp, Homo sapiens
ccaccagtggcaacc

SEQ ID NO: 79962 - DNA, 15 bp, Homo sapiens
cccaccagtggcaac

SEQ ID NO: 79963 - DNA, 15 bp, Homo sapiens
tcccaccagtggcaa

SEQ ID NO: 79964 - DNA, 15 bp, Homo sapiens
ctcccaccagtggca

SEQ ID NO: 79965 - DNA, 15 bp, Homo sapiens
actcccaccagtggc

SEQ ID NO: 79966 - DNA, 15 bp, Homo sapiens
cactcccaccagtgg

SEQ ID NO: 79967 - DNA, 15 bp, Homo sapiens
ccactcccaccagtg

SEQ ID NO: 79968 - DNA, 15 bp, Homo sapiens
cccactcccaccagt

SEQ ID NO: 79969 - DNA, 15 bp, Homo sapiens
ccccactcccaccag

SEQ ID NO: 79970 - DNA, 15 bp, Homo sapiens
tccccactcccacca

SEQ ID NO: 79971 - DNA, 15 bp, Homo sapiens
ttccccactcccacc

SEQ ID NO: 79972 - DNA, 15 bp, Homo sapiens
attccccactcccac

SEQ ID NO: 79973 - DNA, 15 bp, Homo sapiens
cattccccactccca

SEQ ID NO: 79974 - DNA, 15 bp, Homo sapiens
ccattccccactccc

SEQ ID NO: 79975 - DNA, 15 bp, Homo sapiens
cccattccccactcc

SEQ ID NO: 79976 - DNA, 15 bp, Homo sapiens
ccccattccccactc

SEQ ID NO: 79977 - DNA, 15 bp, Homo sapiens
tccccattccccact

SEQ ID NO: 79978 - DNA, 15 bp, Homo sapiens
ctccccattccccac

SEQ ID NO: 79979 - DNA, 15 bp, Homo sapiens
actccccattcccca

SEQ ID NO: 79980 - DNA, 15 bp, Homo sapiens
cactccccattcccc

SEQ ID NO: 79981 - DNA, 15 bp, Homo sapiens
acactccccattccc

SEQ ID NO: 79982 - DNA, 15 bp, Homo sapiens
aacactccccattcc

SEQ ID NO: 79983 - DNA, 15 bp, Homo sapiens
caacactccccattc

SEQ ID NO: 79984 - DNA, 15 bp, Homo sapiens
ccaacactccccatt

SEQ ID NO: 79985 - DNA, 15 bp, Homo sapiens
accaacactccccat

SEQ ID NO: 79986 - DNA, 15 bp, Homo sapiens
aaccaacactcccca

SEQ ID NO: 79987 - DNA, 15 bp, Homo sapiens
aaaccaacactcccc

SEQ ID NO: 79988 - DNA, 15 bp, Homo sapiens
taaaccaacactccc

SEQ ID NO: 79989 - DNA, 15 bp, Homo sapiens
ataaaccaacactcc

SEQ ID NO: 79990 - DNA, 15 bp, Homo sapiens
cataaaccaacactc

SEQ ID NO: 79991 - DNA, 15 bp, Homo sapiens
ccataaaccaacact

SEQ ID NO: 79992 - DNA, 15 bp, Homo sapiens
gccataaaccaacac

SEQ ID NO: 79993 - DNA, 15 bp, Homo sapiens
agccataaaccaaca

SEQ ID NO: 79994 - DNA, 15 bp, Homo sapiens
tagccataaaccaac

SEQ ID NO: 79995 - DNA, 15 bp, Homo sapiens
atagccataaaccaa

SEQ ID NO: 79996 - DNA, 15 bp, Homo sapiens
catagccataaacca

SEQ ID NO: 79997 - DNA, 15 bp, Homo sapiens
ccatagccataaacc

SEQ ID NO: 79998 - DNA, 15 bp, Homo sapiens
cccatagccataaac

SEQ ID NO: 79999 - DNA, 15 bp, Homo sapiens
tcccatagccataaa

SEQ ID NO: 80000 - DNA, 15 bp, Homo sapiens
atcccatagccataa

SEQ ID NO: 80001 - DNA, 15 bp, Homo sapiens
aatcccatagccata

SEQ ID NO: 80002 - DNA, 15 bp, Homo sapiens
aaatcccatagccat

SEQ ID NO: 80003 - DNA, 15 bp, Homo sapiens
gaaatcccatagcca

SEQ ID NO: 80004 - DNA, 15 bp, Homo sapiens
agaaatcccatagcc

SEQ ID NO: 80005 - DNA, 15 bp, Homo sapiens
aagaaatcccatagc

SEQ ID NO: 80006 - DNA, 15 bp, Homo sapiens
aaagaaatcccatag

SEQ ID NO: 80007 - DNA, 15 bp, Homo sapiens
aaaagaaatcccata

SEQ ID NO: 80008 - DNA, 15 bp, Homo sapiens
aaaaagaaatcccat

SEQ ID NO: 80009 - DNA, 15 bp, Homo sapiens
caaaaagaaatccca

SEQ ID NO: 80010 - DNA, 15 bp, Homo sapiens
ccaaaaagaaatccc

SEQ ID NO: 80011 - DNA, 15 bp, Homo sapiens
cccaaaaagaaatcc

SEQ ID NO: 80012 - DNA, 15 bp, Homo sapiens
ccccaaaaagaaatc

SEQ ID NO: 80013 - DNA, 15 bp, Homo sapiens
accccaaaaagaaat

SEQ ID NO: 80014 - DNA, 15 bp, Homo sapiens
caccccaaaaagaaa

SEQ ID NO: 80015 - DNA, 15 bp, Homo sapiens
tcaccccaaaaagaa

SEQ ID NO: 80016 - DNA, 15 bp, Homo sapiens
atcaccccaaaaaga

SEQ ID NO: 80017 - DNA, 15 bp, Homo sapiens
tatcaccccaaaaag

SEQ ID NO: 80018 - DNA, 15 bp, Homo sapiens
ttatcaccccaaaaa

SEQ ID NO: 80019 - DNA, 15 bp, Homo sapiens
tttatcaccccaaaa

SEQ ID NO: 80020 - DNA, 15 bp, Homo sapiens
ttttatcaccccaaa

SEQ ID NO: 80021 - DNA, 15 bp, Homo sapiens
attttatcaccccaa

SEQ ID NO: 80022 - DNA, 15 bp, Homo sapiens
cattttatcacccca

SEQ ID NO: 80023 - DNA, 15 bp, Homo sapiens
acattttatcacccc

SEQ ID NO: 80024 - DNA, 15 bp, Homo sapiens
aacattttatcaccc

SEQ ID NO: 80025 - DNA, 15 bp, Homo sapiens
gaacattttatcacc

SEQ ID NO: 80026 - DNA, 15 bp, Homo sapiens
agaacattttatcac

SEQ ID NO: 80027 - DNA, 15 bp, Homo sapiens
cagaacattttatca

SEQ ID NO: 80028 - DNA, 15 bp, Homo sapiens
ccagaacattttatc

SEQ ID NO: 80029 - DNA, 15 bp, Homo sapiens
tccagaacattttat

SEQ ID NO: 80030 - DNA, 15 bp, Homo sapiens
ctccagaacatttta

SEQ ID NO: 80031 - DNA, 15 bp, Homo sapiens
tctccagaacatttt

SEQ ID NO: 80032 - DNA, 15 bp, Homo sapiens
gtctccagaacattt

SEQ ID NO: 80033 - DNA, 15 bp, Homo sapiens
tgtctccagaacatt

SEQ ID NO: 80034 - DNA, 15 bp, Homo sapiens
ctgtctccagaacat

SEQ ID NO: 80035 - DNA, 15 bp, Homo sapiens
tctgtctccagaaca

SEQ ID NO: 80036 - DNA, 15 bp, Homo sapiens
gtctgtctccagaac

SEQ ID NO: 80037 - DNA, 15 bp, Homo sapiens
agtctgtctccagaa

SEQ ID NO: 80038 - DNA, 15 bp, Homo sapiens
cagtctgtctccaga

SEQ ID NO: 80039 - DNA, 15 bp, Homo sapiens
acagtctgtctccag

SEQ ID NO: 80040 - DNA, 15 bp, Homo sapiens
cacagtctgtctcca

SEQ ID NO: 80041 - DNA, 15 bp, Homo sapiens
tcacagtctgtctcc

SEQ ID NO: 80042 - DNA, 15 bp, Homo sapiens
ctcacagtctgtctc

SEQ ID NO: 80043 - DNA, 15 bp, Homo sapiens
cctcacagtctgtct

SEQ ID NO: 80044 - DNA, 15 bp, Homo sapiens
tcctcacagtctgtc

SEQ ID NO: 80045 - DNA, 15 bp, Homo sapiens
atcctcacagtctgt

SEQ ID NO: 80046 - DNA, 15 bp, Homo sapiens
catcctcacagtctg

SEQ ID NO: 80047 - DNA, 15 bp, Homo sapiens
tcatcctcacagtct

SEQ ID NO: 80048 - DNA, 15 bp, Homo sapiens
atcatcctcacagtc

SEQ ID NO: 80049 - DNA, 15 bp, Homo sapiens
aatcatcctcacagt

SEQ ID NO: 80050 - DNA, 15 bp, Homo sapiens
taatcatcctcacag

SEQ ID NO: 80051 - DNA, 15 bp, Homo sapiens
ataatcatcctcaca

SEQ ID NO: 80052 - DNA, 15 bp, Homo sapiens
tataatcatcctcac

SEQ ID NO: 80053 - DNA, 15 bp, Homo sapiens
gtataatcatcctca

SEQ ID NO: 80054 - DNA, 15 bp, Homo sapiens
tgtataatcatcctc

SEQ ID NO: 80055 - DNA, 15 bp, Homo sapiens
ttgtataatcatcct

SEQ ID NO: 80056 - DNA, 15 bp, Homo sapiens
gttgtataatcatcc

SEQ ID NO: 80057 - DNA, 15 bp, Homo sapiens
agttgtataatcatc

SEQ ID NO: 80058 - DNA, 15 bp, Homo sapiens
cagttgtataatcat

SEQ ID NO: 80059 - DNA, 15 bp, Homo sapiens
acagttgtataatca

SEQ ID NO: 80060 - DNA, 15 bp, Homo sapiens
tacagttgtataatc

SEQ ID NO: 80061 - DNA, 15 bp, Homo sapiens
atacagttgtataat

SEQ ID NO: 80062 - DNA, 15 bp, Homo sapiens
tatacagttgtataa

SEQ ID NO: 80063 - DNA, 15 bp, Homo sapiens
ttatacagttgtata

SEQ ID NO: 80064 - DNA, 15 bp, Homo sapiens
tttatacagttgtat

SEQ ID NO: 80065 - DNA, 15 bp, Homo sapiens
atttatacagttgta

SEQ ID NO: 80066 - DNA, 15 bp, Homo sapiens
catttatacagttgt

SEQ ID NO: 80067 - DNA, 15 bp, Homo sapiens
acatttatacagttg

SEQ ID NO: 80068 - DNA, 15 bp, Homo sapiens
cacatttatacagtt

SEQ ID NO: 80069 - DNA, 15 bp, Homo sapiens
gcacatttatacagt

SEQ ID NO: 80070 - DNA, 15 bp, Homo sapiens
agcacatttatacag

SEQ ID NO: 80071 - DNA, 15 bp, Homo sapiens
tagcacatttataca

SEQ ID NO: 80072 - DNA, 15 bp, Homo sapiens
ttagcacatttatac

SEQ ID NO: 80073 - DNA, 15 bp, Homo sapiens
attagcacatttata

SEQ ID NO: 80074 - DNA, 15 bp, Homo sapiens
tattagcacatttat

SEQ ID NO: 80075 - DNA, 15 bp, Homo sapiens
ttattagcacattta

SEQ ID NO: 80076 - DNA, 15 bp, Homo sapiens
gttattagcacattt

SEQ ID NO: 80077 - DNA, 15 bp, Homo sapiens
ggttattagcacatt

SEQ ID NO: 80078 - DNA, 15 bp, Homo sapiens
tggttattagcacat

SEQ ID NO: 80079 - DNA, 15 bp, Homo sapiens
atggttattagcaca

SEQ ID NO: 80080 - DNA, 15 bp, Homo sapiens
aatggttattagcac

SEQ ID NO: 80081 - DNA, 15 bp, Homo sapiens
taatggttattagca

SEQ ID NO: 80082 - DNA, 15 bp, Homo sapiens
ttaatggttattagc

SEQ ID NO: 80083 - DNA, 15 bp, Homo sapiens
tttaatggttattag

SEQ ID NO: 80084 - DNA, 15 bp, Homo sapiens
atttaatggttatta

SEQ ID NO: 80085 - DNA, 15 bp, Homo sapiens
aatttaatggttatt

SEQ ID NO: 80086 - DNA, 15 bp, Homo sapiens
caatttaatggttat

SEQ ID NO: 80087 - DNA, 15 bp, Homo sapiens
acaatttaatggtta

SEQ ID NO: 80088 - DNA, 15 bp, Homo sapiens
cacaatttaatggtt

SEQ ID NO: 80089 - DNA, 15 bp, Homo sapiens
acacaatttaatggt

SEQ ID NO: 80090 - DNA, 15 bp, Homo sapiens
tacacaatttaatgg

SEQ ID NO: 80091 - DNA, 15 bp, Homo sapiens
atacacaatttaatg

SEQ ID NO: 80092 - DNA, 15 bp, Homo sapiens
aatacacaatttaat

SEQ ID NO: 80093 - DNA, 15 bp, Homo sapiens
aaatacacaatttaa

SEQ ID NO: 80094 - DNA, 15 bp, Homo sapiens
gaaatacacaattta

SEQ ID NO: 80095 - DNA, 15 bp, Homo sapiens
tgaaatacacaattt

SEQ ID NO: 80096 - DNA, 15 bp, Homo sapiens
ttgaaatacacaatt

SEQ ID NO: 80097 - DNA, 15 bp, Homo sapiens
tttgaaatacacaat

SEQ ID NO: 80098 - DNA, 15 bp, Homo sapiens
ctttgaaatacacaa

SEQ ID NO: 80099 - DNA, 15 bp, Homo sapiens
tctttgaaatacaca

SEQ ID NO: 80100 - DNA, 15 bp, Homo sapiens
ttctttgaaatacac

SEQ ID NO: 80101 - DNA, 15 bp, Homo sapiens
tttctttgaaataca

SEQ ID NO: 80102 - DNA, 15 bp, Homo sapiens
ctttctttgaaatac

SEQ ID NO: 80103 - DNA, 15 bp, Homo sapiens
tctttctttgaaata

SEQ ID NO: 80104 - DNA, 15 bp, Homo sapiens
ttctttctttgaaat

SEQ ID NO: 80105 - DNA, 15 bp, Homo sapiens
attctttctttgaaa

SEQ ID NO: 80106 - DNA, 15 bp, Homo sapiens
aattctttctttgaa

SEQ ID NO: 80107 - DNA, 15 bp, Homo sapiens
aaattctttctttga

SEQ ID NO: 80108 - DNA, 15 bp, Homo sapiens
aaaattctttctttg

SEQ ID NO: 80109 - DNA, 15 bp, Homo sapiens
taaaattctttcttt

SEQ ID NO: 80110 - DNA, 15 bp, Homo sapiens
ataaaattctttctt

SEQ ID NO: 80111 - DNA, 15 bp, Homo sapiens
tataaaattctttct

SEQ ID NO: 80112 - DNA, 15 bp, Homo sapiens
ctataaaattctttc

SEQ ID NO: 80113 - DNA, 15 bp, Homo sapiens
gctataaaattcttt

SEQ ID NO: 80114 - DNA, 15 bp, Homo sapiens
tgctataaaattctt

SEQ ID NO: 80115 - DNA, 15 bp, Homo sapiens
atgctataaaattct

SEQ ID NO: 80116 - DNA, 15 bp, Homo sapiens
catgctataaaattc

SEQ ID NO: 80117 - DNA, 15 bp, Homo sapiens
acatgctataaaatt

SEQ ID NO: 80118 - DNA, 15 bp, Homo sapiens
cacatgctataaaat

SEQ ID NO: 80119 - DNA, 15 bp, Homo sapiens
tcacatgctataaaa

SEQ ID NO: 80120 - DNA, 15 bp, Homo sapiens
ttcacatgctataaa

SEQ ID NO: 80121 - DNA, 15 bp, Homo sapiens
attcacatgctataa

SEQ ID NO: 80122 - DNA, 15 bp, Homo sapiens
aattcacatgctata

SEQ ID NO: 80123 - DNA, 15 bp, Homo sapiens
taattcacatgctat

SEQ ID NO: 80124 - DNA, 15 bp, Homo sapiens
gtaattcacatgcta

SEQ ID NO: 80125 - DNA, 15 bp, Homo sapiens
tgtaattcacatgct

SEQ ID NO: 80126 - DNA, 15 bp, Homo sapiens
atgtaattcacatgc

SEQ ID NO: 80127 - DNA, 15 bp, Homo sapiens
gatgtaattcacatg

SEQ ID NO: 80128 - DNA, 15 bp, Homo sapiens
agatgtaattcacat

SEQ ID NO: 80129 - DNA, 15 bp, Homo sapiens
gagatgtaattcaca

SEQ ID NO: 80130 - DNA, 15 bp, Homo sapiens
tgagatgtaattcac

SEQ ID NO: 80131 - DNA, 15 bp, Homo sapiens
ttgagatgtaattca

SEQ ID NO: 80132 - DNA, 15 bp, Homo sapiens
attgagatgtaattc

SEQ ID NO: 80133 - DNA, 15 bp, Homo sapiens
cattgagatgtaatt

SEQ ID NO: 80134 - DNA, 15 bp, Homo sapiens
tcattgagatgtaat

SEQ ID NO: 80135 - DNA, 15 bp, Homo sapiens
ttcattgagatgtaa

SEQ ID NO: 80136 - DNA, 15 bp, Homo sapiens
cttcattgagatgta

SEQ ID NO: 80137 - DNA, 15 bp, Homo sapiens
gcttcattgagatgt

SEQ ID NO: 80138 - DNA, 15 bp, Homo sapiens
agcttcattgagatg

SEQ ID NO: 80139 - DNA, 15 bp, Homo sapiens
cagcttcattgagat

SEQ ID NO: 80140 - DNA, 15 bp, Homo sapiens
acagcttcattgaga

SEQ ID NO: 80141 - DNA, 15 bp, Homo sapiens
aacagcttcattgag

SEQ ID NO: 80142 - DNA, 15 bp, Homo sapiens
taacagcttcattga

SEQ ID NO: 80143 - DNA, 15 bp, Homo sapiens
ataacagcttcattg

SEQ ID NO: 80144 - DNA, 15 bp, Homo sapiens
tataacagcttcatt

SEQ ID NO: 80145 - DNA, 15 bp, Homo sapiens
ttataacagcttcat

SEQ ID NO: 80146 - DNA, 15 bp, Homo sapiens
tttataacagcttca

SEQ ID NO: 80147 - DNA, 15 bp, Homo sapiens
gtttataacagcttc

SEQ ID NO: 80148 - DNA, 15 bp, Homo sapiens
tgtttataacagctt

SEQ ID NO: 80149 - DNA, 15 bp, Homo sapiens
atgtttataacagct

SEQ ID NO: 80150 - DNA, 15 bp, Homo sapiens
aatgtttataacagc

SEQ ID NO: 80151 - DNA, 15 bp, Homo sapiens
caatgtttataacag

SEQ ID NO: 80152 - DNA, 15 bp, Homo sapiens
tcaatgtttataaca

SEQ ID NO: 80153 - DNA, 15 bp, Homo sapiens
ttcaatgtttataac

SEQ ID NO: 80154 - DNA, 15 bp, Homo sapiens
tttcaatgtttataa

SEQ ID NO: 80155 - DNA, 15 bp, Homo sapiens
atttcaatgtttata

SEQ ID NO: 80156 - DNA, 15 bp, Homo sapiens
aatttcaatgtttat

SEQ ID NO: 80157 - DNA, 15 bp, Homo sapiens
aaatttcaatgttta

SEQ ID NO: 80158 - DNA, 15 bp, Homo sapiens
aaaatttcaatgttt

SEQ ID NO: 80159 - DNA, 15 bp, Homo sapiens
caaaatttcaatgtt

SEQ ID NO: 80160 - DNA, 15 bp, Homo sapiens
ccaaaatttcaatgt

SEQ ID NO: 80161 - DNA, 15 bp, Homo sapiens
tccaaaatttcaatg

SEQ ID NO: 80162 - DNA, 15 bp, Homo sapiens
atccaaaatttcaat

SEQ ID NO: 80163 - DNA, 15 bp, Homo sapiens
catccaaaatttcaa

SEQ ID NO: 80164 - DNA, 15 bp, Homo sapiens
ccatccaaaatttca

SEQ ID NO: 80165 - DNA, 15 bp, Homo sapiens
gccatccaaaatttc

SEQ ID NO: 80166 - DNA, 15 bp, Homo sapiens
agccatccaaaattt

SEQ ID NO: 80167 - DNA, 15 bp, Homo sapiens
aagccatccaaaatt

SEQ ID NO: 80168 - DNA, 15 bp, Homo sapiens
aaagccatccaaaat

SEQ ID NO: 80169 - DNA, 15 bp, Homo sapiens
aaaagccatccaaaa

SEQ ID NO: 80170 - DNA, 15 bp, Homo sapiens
taaaagccatccaaa

SEQ ID NO: 80171 - DNA, 15 bp, Homo sapiens
ataaaagccatccaa

SEQ ID NO: 80172 - DNA, 15 bp, Homo sapiens
aataaaagccatcca

SEQ ID NO: 80173 - DNA, 15 bp, Homo sapiens
aaataaaagccatcc

SEQ ID NO: 80174 - DNA, 15 bp, Homo sapiens
gaaataaaagccatc

SEQ ID NO: 80175 - DNA, 15 bp, Homo sapiens
tgaaataaaagccat

SEQ ID NO: 80176 - DNA, 15 bp, Homo sapiens
ctgaaataaaagcca

SEQ ID NO: 80177 - DNA, 15 bp, Homo sapiens
cctgaaataaaagcc

SEQ ID NO: 80178 - DNA, 15 bp, Homo sapiens
acctgaaataaaagc

SEQ ID NO: 80179 - DNA, 15 bp, Homo sapiens
cacctgaaataaaag

SEQ ID NO: 80180 - DNA, 15 bp, Homo sapiens
tcacctgaaataaaa

SEQ ID NO: 80181 - DNA, 15 bp, Homo sapiens
gtcacctgaaataaa

SEQ ID NO: 80182 - DNA, 15 bp, Homo sapiens
agtcacctgaaataa

SEQ ID NO: 80183 - DNA, 15 bp, Homo sapiens
gagtcacctgaaata

SEQ ID NO: 80184 - DNA, 15 bp, Homo sapiens
tgagtcacctgaaat

SEQ ID NO: 80185 - DNA, 15 bp, Homo sapiens
ctgagtcacctgaaa

SEQ ID NO: 80186 - DNA, 15 bp, Homo sapiens
cctgagtcacctgaa

SEQ ID NO: 80187 - DNA, 15 bp, Homo sapiens
gcctgagtcacctga

SEQ ID NO: 80188 - DNA, 15 bp, Homo sapiens
agcctgagtcacctg

SEQ ID NO: 80189 - DNA, 15 bp, Homo sapiens
cagcctgagtcacct

SEQ ID NO: 80190 - DNA, 15 bp, Homo sapiens
acagcctgagtcacc

SEQ ID NO: 80191 - DNA, 15 bp, Homo sapiens
tacagcctgagtcac

SEQ ID NO: 80192 - DNA, 15 bp, Homo sapiens
ctacagcctgagtca

SEQ ID NO: 80193 - DNA, 15 bp, Homo sapiens
gctacagcctgagtc

SEQ ID NO: 80194 - DNA, 15 bp, Homo sapiens
tgctacagcctgagt

SEQ ID NO: 80195 - DNA, 15 bp, Homo sapiens
ttgctacagcctgag

SEQ ID NO: 80196 - DNA, 15 bp, Homo sapiens
tttgctacagcctga

SEQ ID NO: 80197 - DNA, 15 bp, Homo sapiens
ctttgctacagcctg

SEQ ID NO: 80198 - DNA, 15 bp, Homo sapiens
gctttgctacagcct

SEQ ID NO: 80199 - DNA, 15 bp, Homo sapiens
agctttgctacagcc

SEQ ID NO: 80200 - DNA, 15 bp, Homo sapiens
cagctttgctacagc

SEQ ID NO: 80201 - DNA, 15 bp, Homo sapiens
ccagctttgctacag

SEQ ID NO: 80202 - DNA, 15 bp, Homo sapiens
cccagctttgctaca

SEQ ID NO: 80203 - DNA, 15 bp, Homo sapiens
ccccagctttgctac

SEQ ID NO: 80204 - DNA, 15 bp, Homo sapiens
tccccagctttgcta

SEQ ID NO: 80205 - DNA, 15 bp, Homo sapiens
atccccagctttgct

SEQ ID NO: 80206 - DNA, 15 bp, Homo sapiens
catccccagctttgc

SEQ ID NO: 80207 - DNA, 15 bp, Homo sapiens
acatccccagctttg

SEQ ID NO: 80208 - DNA, 15 bp, Homo sapiens
gacatccccagcttt

SEQ ID NO: 80209 - DNA, 15 bp, Homo sapiens
agacatccccagctt

SEQ ID NO: 80210 - DNA, 15 bp, Homo sapiens
gagacatccccagct

SEQ ID NO: 80211 - DNA, 15 bp, Homo sapiens
tgagacatccccagc

SEQ ID NO: 80212 - DNA, 15 bp, Homo sapiens
ctgagacatccccag

SEQ ID NO: 80213 - DNA, 15 bp, Homo sapiens
tctgagacatcccca

SEQ ID NO: 80214 - DNA, 15 bp, Homo sapiens
atctgagacatcccc

SEQ ID NO: 80215 - DNA, 15 bp, Homo sapiens
aatctgagacatccc

SEQ ID NO: 80216 - DNA, 15 bp, Homo sapiens
gaatctgagacatcc

SEQ ID NO: 80217 - DNA, 15 bp, Homo sapiens
ggaatctgagacatc

SEQ ID NO: 80218 - DNA, 15 bp, Homo sapiens
aggaatctgagacat

SEQ ID NO: 80219 - DNA, 15 bp, Homo sapiens
gaggaatctgagaca

SEQ ID NO: 80220 - DNA, 15 bp, Homo sapiens
tgaggaatctgagac

SEQ ID NO: 80221 - DNA, 15 bp, Homo sapiens
ctgaggaatctgaga

SEQ ID NO: 80222 - DNA, 15 bp, Homo sapiens
tctgaggaatctgag

SEQ ID NO: 80223 - DNA, 15 bp, Homo sapiens
ttctgaggaatctga

SEQ ID NO: 80224 - DNA, 15 bp, Homo sapiens
cttctgaggaatctg

SEQ ID NO: 80225 - DNA, 15 bp, Homo sapiens
ccttctgaggaatct

SEQ ID NO: 80226 - DNA, 15 bp, Homo sapiens
tccttctgaggaatc

SEQ ID NO: 80227 - DNA, 15 bp, Homo sapiens
gtccttctgaggaat

SEQ ID NO: 80228 - DNA, 15 bp, Homo sapiens
ggtccttctgaggaa

SEQ ID NO: 80229 - DNA, 15 bp, Homo sapiens
aggtccttctgagga

SEQ ID NO: 80230 - DNA, 15 bp, Homo sapiens
aaggtccttctgagg

SEQ ID NO: 80231 - DNA, 15 bp, Homo sapiens
aaaggtccttctgag

SEQ ID NO: 80232 - DNA, 15 bp, Homo sapiens
aaaaggtccttctga

SEQ ID NO: 80233 - DNA, 15 bp, Homo sapiens
caaaaggtccttctg

SEQ ID NO: 80234 - DNA, 15 bp, Homo sapiens
ccaaaaggtccttct

SEQ ID NO: 80235 - DNA, 15 bp, Homo sapiens
tccaaaaggtccttc

SEQ ID NO: 80236 - DNA, 15 bp, Homo sapiens
ctccaaaaggtcctt

SEQ ID NO: 80237 - DNA, 15 bp, Homo sapiens
tctccaaaaggtcct

SEQ ID NO: 80238 - DNA, 15 bp, Homo sapiens
gtctccaaaaggtcc

SEQ ID NO: 80239 - DNA, 15 bp, Homo sapiens
agtctccaaaaggtc

SEQ ID NO: 80240 - DNA, 15 bp, Homo sapiens
cagtctccaaaaggt

SEQ ID NO: 80241 - DNA, 15 bp, Homo sapiens
acagtctccaaaagg

SEQ ID NO: 80242 - DNA, 15 bp, Homo sapiens
aacagtctccaaaag

SEQ ID NO: 80243 - DNA, 15 bp, Homo sapiens
gaacagtctccaaaa

SEQ ID NO: 80244 - DNA, 15 bp, Homo sapiens
cgaacagtctccaaa

SEQ ID NO: 80245 - DNA, 15 bp, Homo sapiens
acgaacagtctccaa

SEQ ID NO: 80246 - DNA, 15 bp, Homo sapiens
cacgaacagtctcca

SEQ ID NO: 80247 - DNA, 15 bp, Homo sapiens
acacgaacagtctcc

SEQ ID NO: 80248 - DNA, 15 bp, Homo sapiens
tacacgaacagtctc

SEQ ID NO: 80249 - DNA, 15 bp, Homo sapiens
ttacacgaacagtct

SEQ ID NO: 80250 - DNA, 15 bp, Homo sapiens
cttacacgaacagtc

SEQ ID NO: 80251 - DNA, 15 bp, Homo sapiens
tcttacacgaacagt

SEQ ID NO: 80252 - DNA, 15 bp, Homo sapiens
ctcttacacgaacag

SEQ ID NO: 80253 - DNA, 15 bp, Homo sapiens
tctcttacacgaaca

SEQ ID NO: 80254 - DNA, 15 bp, Homo sapiens
ttctcttacacgaac

SEQ ID NO: 80255 - DNA, 15 bp, Homo sapiens
gttctcttacacgaa

SEQ ID NO: 80256 - DNA, 15 bp, Homo sapiens
tgttctcttacacga

SEQ ID NO: 80257 - DNA, 15 bp, Homo sapiens
ttgttctcttacacg

SEQ ID NO: 80258 - DNA, 15 bp, Homo sapiens
cttgttctcttacac

SEQ ID NO: 80259 - DNA, 15 bp, Homo sapiens
gcttgttctcttaca

SEQ ID NO: 80260 - DNA, 15 bp, Homo sapiens
tgcttgttctcttac

SEQ ID NO: 80261 - DNA, 15 bp, Homo sapiens
ttgcttgttctctta

SEQ ID NO: 80262 - DNA, 15 bp, Homo sapiens
attgcttgttctctt

SEQ ID NO: 80263 - DNA, 15 bp, Homo sapiens
aattgcttgttctct

SEQ ID NO: 80264 - DNA, 15 bp, Homo sapiens
taattgcttgttctc

SEQ ID NO: 80265 - DNA, 15 bp, Homo sapiens
gtaattgcttgttct

SEQ ID NO: 80266 - DNA, 15 bp, Homo sapiens
tgtaattgcttgttc

SEQ ID NO: 80267 - DNA, 15 bp, Homo sapiens
ttgtaattgcttgtt

SEQ ID NO: 80268 - DNA, 15 bp, Homo sapiens
tttgtaattgcttgt

SEQ ID NO: 80269 - DNA, 15 bp, Homo sapiens
ttttgtaattgcttg

SEQ ID NO: 80270 - DNA, 15 bp, Homo sapiens
tttttgtaattgctt

SEQ ID NO: 80271 - DNA, 15 bp, Homo sapiens
ttttttgtaattgct

SEQ ID NO: 80272 - DNA, 15 bp, Homo sapiens
tttttttgtaattgc

SEQ ID NO: 80273 - DNA, 15 bp, Homo sapiens
atttttttgtaattg

SEQ ID NO: 80274 - DNA, 15 bp, Homo sapiens
gatttttttgtaatt

SEQ ID NO: 80275 - DNA, 15 bp, Homo sapiens
agatttttttgtaat

SEQ ID NO: 80276 - DNA, 15 bp, Homo sapiens
tagatttttttgtaa

SEQ ID NO: 80277 - DNA, 15 bp, Homo sapiens
ttagatttttttgta

SEQ ID NO: 80278 - DNA, 15 bp, Homo sapiens
cttagatttttttgt

SEQ ID NO: 80279 - DNA, 15 bp, Homo sapiens
gcttagatttttttg

SEQ ID NO: 80280 - DNA, 15 bp, Homo sapiens
tgcttagattttttt

SEQ ID NO: 80281 - DNA, 15 bp, Homo sapiens
ctgcttagatttttt

SEQ ID NO: 80282 - DNA, 15 bp, Homo sapiens
cctgcttagattttt

SEQ ID NO: 80283 - DNA, 15 bp, Homo sapiens
tcctgcttagatttt

SEQ ID NO: 80284 - DNA, 15 bp, Homo sapiens
ttcctgcttagattt

SEQ ID NO: 80285 - DNA, 15 bp, Homo sapiens
gttcctgcttagatt

SEQ ID NO: 80286 - DNA, 15 bp, Homo sapiens
agttcctgcttagat

SEQ ID NO: 80287 - DNA, 15 bp, Homo sapiens
cagttcctgcttaga

SEQ ID NO: 80288 - DNA, 15 bp, Homo sapiens
gcagttcctgcttag

SEQ ID NO: 80289 - DNA, 15 bp, Homo sapiens
ggcagttcctgctta

SEQ ID NO: 80290 - DNA, 15 bp, Homo sapiens
aggcagttcctgctt

SEQ ID NO: 80291 - DNA, 15 bp, Homo sapiens
gaggcagttcctgct

SEQ ID NO: 80292 - DNA, 15 bp, Homo sapiens
ggaggcagttcctgc

SEQ ID NO: 80293 - DNA, 15 bp, Homo sapiens
aggaggcagttcctg

SEQ ID NO: 80294 - DNA, 15 bp, Homo sapiens
gaggaggcagttcct

SEQ ID NO: 80295 - DNA, 15 bp, Homo sapiens
ggaggaggcagttcc

SEQ ID NO: 80296 - DNA, 15 bp, Homo sapiens
aggaggaggcagttc

SEQ ID NO: 80297 - DNA, 15 bp, Homo sapiens
gaggaggaggcagtt

SEQ ID NO: 80298 - DNA, 15 bp, Homo sapiens
ggaggaggaggcagt

SEQ ID NO: 80299 - DNA, 15 bp, Homo sapiens
aggaggaggaggcag

SEQ ID NO: 80300 - DNA, 15 bp, Homo sapiens
gaggaggaggaggca

SEQ ID NO: 80301 - DNA, 15 bp, Homo sapiens
ggaggaggaggaggc

SEQ ID NO: 80302 - DNA, 15 bp, Homo sapiens
gggggaggaggagga

SEQ ID NO: 80303 - DNA, 15 bp, Homo sapiens
tgggggaggaggagg

SEQ ID NO: 80304 - DNA, 15 bp, Homo sapiens
ttgggggaggaggag

SEQ ID NO: 80305 - DNA, 15 bp, Homo sapiens
tttgggggaggagga

SEQ ID NO: 80306 - DNA, 15 bp, Homo sapiens
ctttgggggaggagg

SEQ ID NO: 80307 - DNA, 15 bp, Homo sapiens
tctttgggggaggag

SEQ ID NO: 80308 - DNA, 15 bp, Homo sapiens
ttctttgggggagga

SEQ ID NO: 80309 - DNA, 15 bp, Homo sapiens
cttctttgggggagg

SEQ ID NO: 80310 - DNA, 15 bp, Homo sapiens
tcttctttgggggag

SEQ ID NO: 80311 - DNA, 15 bp, Homo sapiens
ctcttctttggggga

SEQ ID NO: 80312 - DNA, 15 bp, Homo sapiens
tctcttctttggggg

SEQ ID NO: 80313 - DNA, 15 bp, Homo sapiens
gtctcttctttgggg

SEQ ID NO: 80314 - DNA, 15 bp, Homo sapiens
tgtctcttctttggg

SEQ ID NO: 80315 - DNA, 15 bp, Homo sapiens
ctgtctcttctttgg

SEQ ID NO: 80316 - DNA, 15 bp, Homo sapiens
tctgtctcttctttg

SEQ ID NO: 80317 - DNA, 15 bp, Homo sapiens
atctgtctcttcttt

SEQ ID NO: 80318 - DNA, 15 bp, Homo sapiens
gatctgtctcttctt

SEQ ID NO: 80319 - DNA, 15 bp, Homo sapiens
ggatctgtctcttct

SEQ ID NO: 80320 - DNA, 15 bp, Homo sapiens
tggatctgtctcttc

SEQ ID NO: 80321 - DNA, 15 bp, Homo sapiens
atggatctgtctctt

SEQ ID NO: 80322 - DNA, 15 bp, Homo sapiens
catggatctgtctct

SEQ ID NO: 80323 - DNA, 15 bp, Homo sapiens
acatggatctgtctc

SEQ ID NO: 80324 - DNA, 15 bp, Homo sapiens
cacatggatctgtct

SEQ ID NO: 80325 - DNA, 15 bp, Homo sapiens
ccacatggatctgtc

SEQ ID NO: 80326 - DNA, 15 bp, Homo sapiens
tccacatggatctgt

SEQ ID NO: 80327 - DNA, 15 bp, Homo sapiens
atccacatggatctg

SEQ ID NO: 80328 - DNA, 15 bp, Homo sapiens
tatccacatggatct

SEQ ID NO: 80329 - DNA, 15 bp, Homo sapiens
atatccacatggatc

SEQ ID NO: 80330 - DNA, 15 bp, Homo sapiens
aatatccacatggat

SEQ ID NO: 80331 - DNA, 15 bp, Homo sapiens
caatatccacatgga

SEQ ID NO: 80332 - DNA, 15 bp, Homo sapiens
tcaatatccacatgg

SEQ ID NO: 80333 - DNA, 15 bp, Homo sapiens
ttcaatatccacatg

SEQ ID NO: 80334 - DNA, 15 bp, Homo sapiens
cttcaatatccacat

SEQ ID NO: 80335 - DNA, 15 bp, Homo sapiens
gcttcaatatccaca

SEQ ID NO: 80336 - DNA, 15 bp, Homo sapiens
agcttcaatatccac

SEQ ID NO: 80337 - DNA, 15 bp, Homo sapiens
tagcttcaatatcca

SEQ ID NO: 80338 - DNA, 15 bp, Homo sapiens
ttagcttcaatatcc

SEQ ID NO: 80339 - DNA, 15 bp, Homo sapiens
cttagcttcaatatc

SEQ ID NO: 80340 - DNA, 15 bp, Homo sapiens
tcttagcttcaatat

SEQ ID NO: 80341 - DNA, 15 bp, Homo sapiens
ttcttagcttcaata

SEQ ID NO: 80342 - DNA, 15 bp, Homo sapiens
tttcttagcttcaat

SEQ ID NO: 80343 - DNA, 15 bp, Homo sapiens
ttttcttagcttcaa

SEQ ID NO: 80344 - DNA, 15 bp, Homo sapiens
tttttcttagcttca

SEQ ID NO: 80345 - DNA, 15 bp, Homo sapiens
ctttttcttagcttc

SEQ ID NO: 80346 - DNA, 15 bp, Homo sapiens
actttttcttagctt

SEQ ID NO: 80347 - DNA, 15 bp, Homo sapiens
cactttttcttagct

SEQ ID NO: 80348 - DNA, 15 bp, Homo sapiens
tcactttttcttagc

SEQ ID NO: 80349 - DNA, 15 bp, Homo sapiens
ctcactttttcttag

SEQ ID NO: 80350 - DNA, 15 bp, Homo sapiens
tctcactttttctta

SEQ ID NO: 80351 - DNA, 15 bp, Homo sapiens
ttctcactttttctt

SEQ ID NO: 80352 - DNA, 15 bp, Homo sapiens
cttctcactttttct

SEQ ID NO: 80353 - DNA, 15 bp, Homo sapiens
tcttctcactttttc

SEQ ID NO: 80354 - DNA, 15 bp, Homo sapiens
ctcttctcacttttt

SEQ ID NO: 80355 - DNA, 15 bp, Homo sapiens
tctcttctcactttt

SEQ ID NO: 80356 - DNA, 15 bp, Homo sapiens
atctcttctcacttt

SEQ ID NO: 80357 - DNA, 15 bp, Homo sapiens
tatctcttctcactt

SEQ ID NO: 80358 - DNA, 15 bp, Homo sapiens
ctatctcttctcact

SEQ ID NO: 80359 - DNA, 15 bp, Homo sapiens
tctatctcttctcac

SEQ ID NO: 80360 - DNA, 15 bp, Homo sapiens
ctctatctcttctca

SEQ ID NO: 80361 - DNA, 15 bp, Homo sapiens
tctctatctcttctc

SEQ ID NO: 80362 - DNA, 15 bp, Homo sapiens
ttctctatctcttct

SEQ ID NO: 80363 - DNA, 15 bp, Homo sapiens
tttctctatctcttc

SEQ ID NO: 80364 - DNA, 15 bp, Homo sapiens
atttctctatctctt

SEQ ID NO: 80365 - DNA, 15 bp, Homo sapiens
aatttctctatctct

SEQ ID NO: 80366 - DNA, 15 bp, Homo sapiens
caatttctctatctc

SEQ ID NO: 80367 - DNA, 15 bp, Homo sapiens
acaatttctctatct

SEQ ID NO: 80368 - DNA, 15 bp, Homo sapiens
aacaatttctctatc

SEQ ID NO: 80369 - DNA, 15 bp, Homo sapiens
gaacaatttctctat

SEQ ID NO: 80370 - DNA, 15 bp, Homo sapiens
tgaacaatttctcta

SEQ ID NO: 80371 - DNA, 15 bp, Homo sapiens
ttgaacaatttctct

SEQ ID NO: 80372 - DNA, 15 bp, Homo sapiens
tttgaacaatttctc

SEQ ID NO: 80373 - DNA, 15 bp, Homo sapiens
atttgaacaatttct

SEQ ID NO: 80374 - DNA, 15 bp, Homo sapiens
gatttgaacaatttc

SEQ ID NO: 80375 - DNA, 15 bp, Homo sapiens
ggatttgaacaattt

SEQ ID NO: 80376 - DNA, 15 bp, Homo sapiens
tggatttgaacaatt

SEQ ID NO: 80377 - DNA, 15 bp, Homo sapiens
ttggatttgaacaat

SEQ ID NO: 80378 - DNA, 15 bp, Homo sapiens
attggatttgaacaa

SEQ ID NO: 80379 - DNA, 15 bp, Homo sapiens
tattggatttgaaca

SEQ ID NO: 80380 - DNA, 15 bp, Homo sapiens
atattggatttgaac

SEQ ID NO: 80381 - DNA, 15 bp, Homo sapiens
aatattggatttgaa

SEQ ID NO: 80382 - DNA, 15 bp, Homo sapiens
caatattggatttga

SEQ ID NO: 80383 - DNA, 15 bp, Homo sapiens
gcaatattggatttg

SEQ ID NO: 80384 - DNA, 15 bp, Homo sapiens
tgcaatattggattt

SEQ ID NO: 80385 - DNA, 15 bp, Homo sapiens
gtgcaatattggatt

SEQ ID NO: 80386 - DNA, 15 bp, Homo sapiens
tgtgcaatattggat

SEQ ID NO: 80387 - DNA, 15 bp, Homo sapiens
atgtgcaatattgga

SEQ ID NO: 80388 - DNA, 15 bp, Homo sapiens
tatgtgcaatattgg

SEQ ID NO: 80389 - DNA, 15 bp, Homo sapiens
gtatgtgcaatattg

SEQ ID NO: 80390 - DNA, 15 bp, Homo sapiens
agtatgtgcaatatt

SEQ ID NO: 80391 - DNA, 15 bp, Homo sapiens
tagtatgtgcaatat

SEQ ID NO: 80392 - DNA, 15 bp, Homo sapiens
atagtatgtgcaata

SEQ ID NO: 80393 - DNA, 15 bp, Homo sapiens
tatagtatgtgcaat

SEQ ID NO: 80394 - DNA, 15 bp, Homo sapiens
atatagtatgtgcaa

SEQ ID NO: 80395 - DNA, 15 bp, Homo sapiens
aatatagtatgtgca

SEQ ID NO: 80396 - DNA, 15 bp, Homo sapiens
aaatatagtatgtgc

SEQ ID NO: 80397 - DNA, 15 bp, Homo sapiens
aaaatatagtatgtg

SEQ ID NO: 80398 - DNA, 15 bp, Homo sapiens
gaaaatatagtatgt

SEQ ID NO: 80399 - DNA, 15 bp, Homo sapiens
agaaaatatagtatg

SEQ ID NO: 80400 - DNA, 15 bp, Homo sapiens
tagaaaatatagtat

SEQ ID NO: 80401 - DNA, 15 bp, Homo sapiens
gtagaaaatatagta

SEQ ID NO: 80402 - DNA, 15 bp, Homo sapiens
agtagaaaatatagt

SEQ ID NO: 80403 - DNA, 15 bp, Homo sapiens
aagtagaaaatatag

SEQ ID NO: 80404 - DNA, 15 bp, Homo sapiens
caagtagaaaatata

SEQ ID NO: 80405 - DNA, 15 bp, Homo sapiens
ccaagtagaaaatat

SEQ ID NO: 80406 - DNA, 15 bp, Homo sapiens
accaagtagaaaata

SEQ ID NO: 80407 - DNA, 15 bp, Homo sapiens
caccaagtagaaaat

SEQ ID NO: 80408 - DNA, 15 bp, Homo sapiens
gcaccaagtagaaaa

SEQ ID NO: 80409 - DNA, 15 bp, Homo sapiens
ggcaccaagtagaaa

SEQ ID NO: 80410 - DNA, 15 bp, Homo sapiens
aggcaccaagtagaa

SEQ ID NO: 80411 - DNA, 15 bp, Homo sapiens
taggcaccaagtaga

SEQ ID NO: 80412 - DNA, 15 bp, Homo sapiens
ataggcaccaagtag

SEQ ID NO: 80413 - DNA, 15 bp, Homo sapiens
aataggcaccaagta

SEQ ID NO: 80414 - DNA, 15 bp, Homo sapiens
aaataggcaccaagt

SEQ ID NO: 80415 - DNA, 15 bp, Homo sapiens
aaaataggcaccaag

SEQ ID NO: 80416 - DNA, 15 bp, Homo sapiens
caaaataggcaccaa

SEQ ID NO: 80417 - DNA, 15 bp, Homo sapiens
acaaaataggcacca

SEQ ID NO: 80418 - DNA, 15 bp, Homo sapiens
tacaaaataggcacc

SEQ ID NO: 80419 - DNA, 15 bp, Homo sapiens
gtacaaaataggcac

SEQ ID NO: 80420 - DNA, 15 bp, Homo sapiens
agtacaaaataggca

SEQ ID NO: 80421 - DNA, 15 bp, Homo sapiens
tagtacaaaataggc

SEQ ID NO: 80422 - DNA, 15 bp, Homo sapiens
ttagtacaaaatagg

SEQ ID NO: 80423 - DNA, 15 bp, Homo sapiens
attagtacaaaatag

SEQ ID NO: 80424 - DNA, 15 bp, Homo sapiens
gattagtacaaaata

SEQ ID NO: 80425 - DNA, 15 bp, Homo sapiens
tgattagtacaaaat

SEQ ID NO: 80426 - DNA, 15 bp, Homo sapiens
atgattagtacaaaa

SEQ ID NO: 80427 - DNA, 15 bp, Homo sapiens
aatgattagtacaaa

SEQ ID NO: 80428 - DNA, 15 bp, Homo sapiens
taatgattagtacaa

SEQ ID NO: 80429 - DNA, 15 bp, Homo sapiens
ttaatgattagtaca

SEQ ID NO: 80430 - DNA, 15 bp, Homo sapiens
attaatgattagtac

SEQ ID NO: 80431 - DNA, 15 bp, Homo sapiens
gattaatgattagta

SEQ ID NO: 80432 - DNA, 15 bp, Homo sapiens
tgattaatgattagt

SEQ ID NO: 80433 - DNA, 15 bp, Homo sapiens
atgattaatgattag

SEQ ID NO: 80434 - DNA, 15 bp, Homo sapiens
tatgattaatgatta

SEQ ID NO: 80435 - DNA, 15 bp, Homo sapiens
ctatgattaatgatt

SEQ ID NO: 80436 - DNA, 15 bp, Homo sapiens
cctatgattaatgat

SEQ ID NO: 80437 - DNA, 15 bp, Homo sapiens
gcctatgattaatga

SEQ ID NO: 80438 - DNA, 15 bp, Homo sapiens
tgcctatgattaatg

SEQ ID NO: 80439 - DNA, 15 bp, Homo sapiens
ttgcctatgattaat

SEQ ID NO: 80440 - DNA, 15 bp, Homo sapiens
tttgcctatgattaa

SEQ ID NO: 80441 - DNA, 15 bp, Homo sapiens
atttgcctatgatta

SEQ ID NO: 80442 - DNA, 15 bp, Homo sapiens
gatttgcctatgatt

SEQ ID NO: 80443 - DNA, 15 bp, Homo sapiens
agatttgcctatgat

SEQ ID NO: 80444 - DNA, 15 bp, Homo sapiens
tagatttgcctatga

SEQ ID NO: 80445 - DNA, 15 bp, Homo sapiens
ctagatttgcctatg

SEQ ID NO: 80446 - DNA, 15 bp, Homo sapiens
tctagatttgcctat

SEQ ID NO: 80447 - DNA, 15 bp, Homo sapiens
gtctagatttgccta

SEQ ID NO: 80448 - DNA, 15 bp, Homo sapiens
tgtctagatttgcct

SEQ ID NO: 80449 - DNA, 15 bp, Homo sapiens
atgtctagatttgcc

SEQ ID NO: 80450 - DNA, 15 bp, Homo sapiens
tatgtctagatttgc

SEQ ID NO: 80451 - DNA, 15 bp, Homo sapiens
ttatgtctagatttg

SEQ ID NO: 80452 - DNA, 15 bp, Homo sapiens
attatgtctagattt

SEQ ID NO: 80453 - DNA, 15 bp, Homo sapiens
tattatgtctagatt

SEQ ID NO: 80454 - DNA, 15 bp, Homo sapiens
ttattatgtctagat

SEQ ID NO: 80455 - DNA, 15 bp, Homo sapiens
cttattatgtctaga

SEQ ID NO: 80456 - DNA, 15 bp, Homo sapiens
acttattatgtctag

SEQ ID NO: 80457 - DNA, 15 bp, Homo sapiens
tacttattatgtcta

SEQ ID NO: 80458 - DNA, 15 bp, Homo sapiens
atacttattatgtct

SEQ ID NO: 80459 - DNA, 15 bp, Homo sapiens
aatacttattatgtc

SEQ ID NO: 80460 - DNA, 15 bp, Homo sapiens
taatacttattatgt

SEQ ID NO: 80461 - DNA, 15 bp, Homo sapiens
ataatacttattatg

SEQ ID NO: 80462 - DNA, 15 bp, Homo sapiens
aataatacttattat

SEQ ID NO: 80463 - DNA, 15 bp, Homo sapiens
taataatacttatta

SEQ ID NO: 80464 - DNA, 15 bp, Homo sapiens
ataataatacttatt

SEQ ID NO: 80465 - DNA, 15 bp, Homo sapiens
aataataatacttat

SEQ ID NO: 80466 - DNA, 15 bp, Homo sapiens
taataataatactta

SEQ ID NO: 80467 - DNA, 15 bp, Homo sapiens
ataataataatactt

SEQ ID NO: 80468 - DNA, 15 bp, Homo sapiens
cataataataatact

SEQ ID NO: 80469 - DNA, 15 bp, Homo sapiens
tcataataataatac

SEQ ID NO: 80470 - DNA, 15 bp, Homo sapiens
ttcataataataata

SEQ ID NO: 80471 - DNA, 15 bp, Homo sapiens
tttcataataataat

SEQ ID NO: 80472 - DNA, 15 bp, Homo sapiens
ttttcataataataa

SEQ ID NO: 80473 - DNA, 15 bp, Homo sapiens
cttttcataataata

SEQ ID NO: 80474 - DNA, 15 bp, Homo sapiens
acttttcataataat

SEQ ID NO: 80475 - DNA, 15 bp, Homo sapiens
gacttttcataataa

SEQ ID NO: 80476 - DNA, 15 bp, Homo sapiens
tgacttttcataata

SEQ ID NO: 80477 - DNA, 15 bp, Homo sapiens
ttgacttttcataat

SEQ ID NO: 80478 - DNA, 15 bp, Homo sapiens
gttgacttttcataa

SEQ ID NO: 80479 - DNA, 15 bp, Homo sapiens
agttgacttttcata

SEQ ID NO: 80480 - DNA, 15 bp, Homo sapiens
tagttgacttttcat

SEQ ID NO: 80481 - DNA, 15 bp, Homo sapiens
gtagttgacttttca

SEQ ID NO: 80482 - DNA, 15 bp, Homo sapiens
agtagttgacttttc

SEQ ID NO: 80483 - DNA, 15 bp, Homo sapiens
cagtagttgactttt

SEQ ID NO: 80484 - DNA, 15 bp, Homo sapiens
tcagtagttgacttt

SEQ ID NO: 80485 - DNA, 15 bp, Homo sapiens
ttcagtagttgactt

SEQ ID NO: 80486 - DNA, 15 bp, Homo sapiens
gttcagtagttgact

SEQ ID NO: 80487 - DNA, 15 bp, Homo sapiens
ggttcagtagttgac

SEQ ID NO: 80488 - DNA, 15 bp, Homo sapiens
tggttcagtagttga

SEQ ID NO: 80489 - DNA, 15 bp, Homo sapiens
gtggttcagtagttg

SEQ ID NO: 80490 - DNA, 15 bp, Homo sapiens
agtggttcagtagtt

SEQ ID NO: 80491 - DNA, 15 bp, Homo sapiens
gagtggttcagtagt

SEQ ID NO: 80492 - DNA, 15 bp, Homo sapiens
tgagtggttcagtag

SEQ ID NO: 80493 - DNA, 15 bp, Homo sapiens
gtgagtggttcagta

SEQ ID NO: 80494 - DNA, 15 bp, Homo sapiens
agtgagtggttcagt

SEQ ID NO: 80495 - DNA, 15 bp, Homo sapiens
cagtgagtggttcag

SEQ ID NO: 80496 - DNA, 15 bp, Homo sapiens
gcagtgagtggttca

SEQ ID NO: 80497 - DNA, 15 bp, Homo sapiens
ggcagtgagtggttc

SEQ ID NO: 80498 - DNA, 15 bp, Homo sapiens
gggcagtgagtggtt

SEQ ID NO: 80499 - DNA, 15 bp, Homo sapiens
ggggcagtgagtggt

SEQ ID NO: 80500 - DNA, 15 bp, Homo sapiens
aggggcagtgagtgg

SEQ ID NO: 80501 - DNA, 15 bp, Homo sapiens
caggggcagtgagtg

SEQ ID NO: 80502 - DNA, 15 bp, Homo sapiens
acaggggcagtgagt

SEQ ID NO: 80503 - DNA, 15 bp, Homo sapiens
gacaggggcagtgag

SEQ ID NO: 80504 - DNA, 15 bp, Homo sapiens
agacaggggcagtga

SEQ ID NO: 80505 - DNA, 15 bp, Homo sapiens
aagacaggggcagtg

SEQ ID NO: 80506 - DNA, 15 bp, Homo sapiens
gaagacaggggcagt

SEQ ID NO: 80507 - DNA, 15 bp, Homo sapiens
agaagacaggggcag

SEQ ID NO: 80508 - DNA, 15 bp, Homo sapiens
cagaagacaggggca

SEQ ID NO: 80509 - DNA, 15 bp, Homo sapiens
tcagaagacaggggc

SEQ ID NO: 80510 - DNA, 15 bp, Homo sapiens
ttcagaagacagggg

SEQ ID NO: 80511 - DNA, 15 bp, Homo sapiens
attcagaagacaggg

SEQ ID NO: 80512 - DNA, 15 bp, Homo sapiens
tattcagaagacagg

SEQ ID NO: 80513 - DNA, 15 bp, Homo sapiens
atattcagaagacag

SEQ ID NO: 80514 - DNA, 15 bp, Homo sapiens
aatattcagaagaca

SEQ ID NO: 80515 - DNA, 15 bp, Homo sapiens
gaatattcagaagac

SEQ ID NO: 80516 - DNA, 15 bp, Homo sapiens
agaatattcagaaga

SEQ ID NO: 80517 - DNA, 15 bp, Homo sapiens
tagaatattcagaag

SEQ ID NO: 80518 - DNA, 15 bp, Homo sapiens
gtagaatattcagaa

SEQ ID NO: 80519 - DNA, 15 bp, Homo sapiens
agtagaatattcaga

SEQ ID NO: 80520 - DNA, 15 bp, Homo sapiens
aagtagaatattcag

SEQ ID NO: 80521 - DNA, 15 bp, Homo sapiens
caagtagaatattca

SEQ ID NO: 80522 - DNA, 15 bp, Homo sapiens
ccaagtagaatattc

SEQ ID NO: 80523 - DNA, 15 bp, Homo sapiens
gccaagtagaatatt

SEQ ID NO: 80524 - DNA, 15 bp, Homo sapiens
tgccaagtagaatat

SEQ ID NO: 80525 - DNA, 15 bp, Homo sapiens
gtgccaagtagaata

SEQ ID NO: 80526 - DNA, 15 bp, Homo sapiens
agtgccaagtagaat

SEQ ID NO: 80527 - DNA, 15 bp, Homo sapiens
tagtgccaagtagaa

SEQ ID NO: 80528 - DNA, 15 bp, Homo sapiens
ctagtgccaagtaga

SEQ ID NO: 80529 - DNA, 15 bp, Homo sapiens
gctagtgccaagtag

SEQ ID NO: 80530 - DNA, 15 bp, Homo sapiens
agctagtgccaagta

SEQ ID NO: 80531 - DNA, 15 bp, Homo sapiens
tagctagtgccaagt

SEQ ID NO: 80532 - DNA, 15 bp, Homo sapiens
ttagctagtgccaag

SEQ ID NO: 80533 - DNA, 15 bp, Homo sapiens
cttagctagtgccaa

SEQ ID NO: 80534 - DNA, 15 bp, Homo sapiens
gcttagctagtgcca

SEQ ID NO: 80535 - DNA, 15 bp, Homo sapiens
tgcttagctagtgcc

SEQ ID NO: 80536 - DNA, 15 bp, Homo sapiens
atgcttagctagtgc

SEQ ID NO: 80537 - DNA, 15 bp, Homo sapiens
gatgcttagctagtg

SEQ ID NO: 80538 - DNA, 15 bp, Homo sapiens
ggatgcttagctagt

SEQ ID NO: 80539 - DNA, 15 bp, Homo sapiens
tggatgcttagctag

SEQ ID NO: 80540 - DNA, 15 bp, Homo sapiens
ttggatgcttagcta

SEQ ID NO: 80541 - DNA, 15 bp, Homo sapiens
tttggatgcttagct

SEQ ID NO: 80542 - DNA, 15 bp, Homo sapiens
atttggatgcttagc

SEQ ID NO: 80543 - DNA, 15 bp, Homo sapiens
aatttggatgcttag

SEQ ID NO: 80544 - DNA, 15 bp, Homo sapiens
aaatttggatgctta

SEQ ID NO: 80545 - DNA, 15 bp, Homo sapiens
aaaatttggatgctt

SEQ ID NO: 80546 - DNA, 15 bp, Homo sapiens
gaaaatttggatgct

SEQ ID NO: 80547 - DNA, 15 bp, Homo sapiens
agaaaatttggatgc

SEQ ID NO: 80548 - DNA, 15 bp, Homo sapiens
aagaaaatttggatg

SEQ ID NO: 80549 - DNA, 15 bp, Homo sapiens
caagaaaatttggat

SEQ ID NO: 80550 - DNA, 15 bp, Homo sapiens
ccaagaaaatttgga

SEQ ID NO: 80551 - DNA, 15 bp, Homo sapiens
tccaagaaaatttgg

SEQ ID NO: 80552 - DNA, 15 bp, Homo sapiens
atccaagaaaatttg

SEQ ID NO: 80553 - DNA, 15 bp, Homo sapiens
catccaagaaaattt

SEQ ID NO: 80554 - DNA, 15 bp, Homo sapiens
tcatccaagaaaatt

SEQ ID NO: 80555 - DNA, 15 bp, Homo sapiens
atcatccaagaaaat

SEQ ID NO: 80556 - DNA, 15 bp, Homo sapiens
aatcatccaagaaaa

SEQ ID NO: 80557 - DNA, 15 bp, Homo sapiens
aaatcatccaagaaa

SEQ ID NO: 80558 - DNA, 15 bp, Homo sapiens
aaaatcatccaagaa

SEQ ID NO: 80559 - DNA, 15 bp, Homo sapiens
taaaatcatccaaga

SEQ ID NO: 80560 - DNA, 15 bp, Homo sapiens
ataaaatcatccaag

SEQ ID NO: 80561 - DNA, 15 bp, Homo sapiens
aataaaatcatccaa

SEQ ID NO: 80562 - DNA, 15 bp, Homo sapiens
aaataaaatcatcca

SEQ ID NO: 80563 - DNA, 15 bp, Homo sapiens
taaataaaatcatcc

SEQ ID NO: 80564 - DNA, 15 bp, Homo sapiens
ataaataaaatcatc

SEQ ID NO: 80565 - DNA, 15 bp, Homo sapiens
gataaataaaatcat

SEQ ID NO: 80566 - DNA, 15 bp, Homo sapiens
ggataaataaaatca

SEQ ID NO: 80567 - DNA, 15 bp, Homo sapiens
aggataaataaaatc

SEQ ID NO: 80568 - DNA, 15 bp, Homo sapiens
caggataaataaaat

SEQ ID NO: 80569 - DNA, 15 bp, Homo sapiens
acaggataaataaaa

SEQ ID NO: 80570 - DNA, 15 bp, Homo sapiens
cacaggataaataaa

SEQ ID NO: 80571 - DNA, 15 bp, Homo sapiens
acacaggataaataa

SEQ ID NO: 80572 - DNA, 15 bp, Homo sapiens
aacacaggataaata

SEQ ID NO: 80573 - DNA, 15 bp, Homo sapiens
gaacacaggataaat

SEQ ID NO: 80574 - DNA, 15 bp, Homo sapiens
tgaacacaggataaa

SEQ ID NO: 80575 - DNA, 15 bp, Homo sapiens
ttgaacacaggataa

SEQ ID NO: 80576 - DNA, 15 bp, Homo sapiens
attgaacacaggata

SEQ ID NO: 80577 - DNA, 15 bp, Homo sapiens
aattgaacacaggat

SEQ ID NO: 80578 - DNA, 15 bp, Homo sapiens
caattgaacacagga

SEQ ID NO: 80579 - DNA, 15 bp, Homo sapiens
ccaattgaacacagg

SEQ ID NO: 80580 - DNA, 15 bp, Homo sapiens
cccaattgaacacag

SEQ ID NO: 80581 - DNA, 15 bp, Homo sapiens
tcccaattgaacaca

SEQ ID NO: 80582 - DNA, 15 bp, Homo sapiens
ctcccaattgaacac

SEQ ID NO: 80583 - DNA, 15 bp, Homo sapiens
tctcccaattgaaca

SEQ ID NO: 80584 - DNA, 15 bp, Homo sapiens
ttctcccaattgaac

SEQ ID NO: 80585 - DNA, 15 bp, Homo sapiens
gttctcccaattgaa

SEQ ID NO: 80586 - DNA, 15 bp, Homo sapiens
agttctcccaattga

SEQ ID NO: 80587 - DNA, 15 bp, Homo sapiens
aagttctcccaattg

SEQ ID NO: 80588 - DNA, 15 bp, Homo sapiens
aaagttctcccaatt

SEQ ID NO: 80589 - DNA, 15 bp, Homo sapiens
caaagttctcccaat

SEQ ID NO: 80590 - DNA, 15 bp, Homo sapiens
acaaagttctcccaa

SEQ ID NO: 80591 - DNA, 15 bp, Homo sapiens
cacaaagttctccca

SEQ ID NO: 80592 - DNA, 15 bp, Homo sapiens
tcacaaagttctccc

SEQ ID NO: 80593 - DNA, 15 bp, Homo sapiens
atcacaaagttctcc

SEQ ID NO: 80594 - DNA, 15 bp, Homo sapiens
gatcacaaagttctc

SEQ ID NO: 80595 - DNA, 15 bp, Homo sapiens
cgatcacaaagttct

SEQ ID NO: 80596 - DNA, 15 bp, Homo sapiens
tcgatcacaaagttc

SEQ ID NO: 80597 - DNA, 15 bp, Homo sapiens
ttcgatcacaaagtt

SEQ ID NO: 80598 - DNA, 15 bp, Homo sapiens
cttcgatcacaaagt

SEQ ID NO: 80599 - DNA, 15 bp, Homo sapiens
gcttcgatcacaaag

SEQ ID NO: 80600 - DNA, 15 bp, Homo sapiens
agcttcgatcacaaa

SEQ ID NO: 80601 - DNA, 15 bp, Homo sapiens
aagcttcgatcacaa

SEQ ID NO: 80602 - DNA, 15 bp, Homo sapiens
aaagcttcgatcaca

SEQ ID NO: 80603 - DNA, 15 bp, Homo sapiens
gaaagcttcgatcac

SEQ ID NO: 80604 - DNA, 15 bp, Homo sapiens
agaaagcttcgatca

SEQ ID NO: 80605 - DNA, 15 bp, Homo sapiens
aagaaagcttcgatc

SEQ ID NO: 80606 - DNA, 15 bp, Homo sapiens
aaagaaagcttcgat

SEQ ID NO: 80607 - DNA, 15 bp, Homo sapiens
gaaagaaagcttcga

SEQ ID NO: 80608 - DNA, 15 bp, Homo sapiens
agaaagaaagcttcg

SEQ ID NO: 80609 - DNA, 15 bp, Homo sapiens
aagaaagaaagcttc

SEQ ID NO: 80610 - DNA, 15 bp, Homo sapiens
gaagaaagaaagctt

SEQ ID NO: 80611 - DNA, 15 bp, Homo sapiens
ggaagaaagaaagct

SEQ ID NO: 80612 - DNA, 15 bp, Homo sapiens
aggaagaaagaaagc

SEQ ID NO: 80613 - DNA, 15 bp, Homo sapiens
aaggaagaaagaaag

SEQ ID NO: 80614 - DNA, 15 bp, Homo sapiens
aaaggaagaaagaaa

SEQ ID NO: 80615 - DNA, 15 bp, Homo sapiens
gaaaggaagaaagaa

SEQ ID NO: 80616 - DNA, 15 bp, Homo sapiens
ggaaaggaagaaaga

SEQ ID NO: 80617 - DNA, 15 bp, Homo sapiens
gggaaaggaagaaag

SEQ ID NO: 80618 - DNA, 15 bp, Homo sapiens
tgggaaaggaagaaa

SEQ ID NO: 80619 - DNA, 15 bp, Homo sapiens
atgggaaaggaagaa

SEQ ID NO: 80620 - DNA, 15 bp, Homo sapiens
aatgggaaaggaaga

SEQ ID NO: 80621 - DNA, 15 bp, Homo sapiens
taatgggaaaggaag

SEQ ID NO: 80622 - DNA, 15 bp, Homo sapiens
ataatgggaaaggaa

SEQ ID NO: 80623 - DNA, 15 bp, Homo sapiens
aataatgggaaagga

SEQ ID NO: 80624 - DNA, 15 bp, Homo sapiens
gaataatgggaaagg

SEQ ID NO: 80625 - DNA, 15 bp, Homo sapiens
agaataatgggaaag

SEQ ID NO: 80626 - DNA, 15 bp, Homo sapiens
gagaataatgggaaa

SEQ ID NO: 80627 - DNA, 15 bp, Homo sapiens
ggagaataatgggaa

SEQ ID NO: 80628 - DNA, 15 bp, Homo sapiens
aggagaataatggga

SEQ ID NO: 80629 - DNA, 15 bp, Homo sapiens
aaggagaataatggg

SEQ ID NO: 80630 - DNA, 15 bp, Homo sapiens
caaggagaataatgg

SEQ ID NO: 80631 - DNA, 15 bp, Homo sapiens
ccaaggagaataatg

SEQ ID NO: 80632 - DNA, 15 bp, Homo sapiens
tccaaggagaataat

SEQ ID NO: 80633 - DNA, 15 bp, Homo sapiens
ttccaaggagaataa

SEQ ID NO: 80634 - DNA, 15 bp, Homo sapiens
cttccaaggagaata

SEQ ID NO: 80635 - DNA, 15 bp, Homo sapiens
ccttccaaggagaat

SEQ ID NO: 80636 - DNA, 15 bp, Homo sapiens
tccttccaaggagaa

SEQ ID NO: 80637 - DNA, 15 bp, Homo sapiens
atccttccaaggaga

SEQ ID NO: 80638 - DNA, 15 bp, Homo sapiens
tatccttccaaggag

SEQ ID NO: 80639 - DNA, 15 bp, Homo sapiens
atatccttccaagga

SEQ ID NO: 80640 - DNA, 15 bp, Homo sapiens
catatccttccaagg

SEQ ID NO: 80641 - DNA, 15 bp, Homo sapiens
tcatatccttccaag

SEQ ID NO: 80642 - DNA, 15 bp, Homo sapiens
atcatatccttccaa

SEQ ID NO: 80643 - DNA, 15 bp, Homo sapiens
aatcatatccttcca

SEQ ID NO: 80644 - DNA, 15 bp, Homo sapiens
caatcatatccttcc

SEQ ID NO: 80645 - DNA, 15 bp, Homo sapiens
acaatcatatccttc

SEQ ID NO: 80646 - DNA, 15 bp, Homo sapiens
gacaatcatatcctt

SEQ ID NO: 80647 - DNA, 15 bp, Homo sapiens
ggacaatcatatcct

SEQ ID NO: 80648 - DNA, 15 bp, Homo sapiens
tggacaatcatatcc

SEQ ID NO: 80649 - DNA, 15 bp, Homo sapiens
atggacaatcatatc

SEQ ID NO: 80650 - DNA, 15 bp, Homo sapiens
catggacaatcatat

SEQ ID NO: 80651 - DNA, 15 bp, Homo sapiens
tcatggacaatcata

SEQ ID NO: 80652 - DNA, 15 bp, Homo sapiens
gtcatggacaatcat

SEQ ID NO: 80653 - DNA, 15 bp, Homo sapiens
agtcatggacaatca

SEQ ID NO: 80654 - DNA, 15 bp, Homo sapiens
cagtcatggacaatc

SEQ ID NO: 80655 - DNA, 15 bp, Homo sapiens
acagtcatggacaat

SEQ ID NO: 80656 - DNA, 15 bp, Homo sapiens
gacagtcatggacaa

SEQ ID NO: 80657 - DNA, 15 bp, Homo sapiens
agacagtcatggaca

SEQ ID NO: 80658 - DNA, 15 bp, Homo sapiens
aagacagtcatggac

SEQ ID NO: 80659 - DNA, 15 bp, Homo sapiens
aaagacagtcatgga

SEQ ID NO: 80660 - DNA, 15 bp, Homo sapiens
aaaagacagtcatgg

SEQ ID NO: 80661 - DNA, 15 bp, Homo sapiens
aaaaagacagtcatg

SEQ ID NO: 80662 - DNA, 15 bp, Homo sapiens
taaaaagacagtcat

SEQ ID NO: 80663 - DNA, 15 bp, Homo sapiens
ataaaaagacagtca

SEQ ID NO: 80664 - DNA, 15 bp, Homo sapiens
aataaaaagacagtc

SEQ ID NO: 80665 - DNA, 15 bp, Homo sapiens
gaataaaaagacagt

SEQ ID NO: 80666 - DNA, 15 bp, Homo sapiens
agaataaaaagacag

SEQ ID NO: 80667 - DNA, 15 bp, Homo sapiens
aagaataaaaagaca

SEQ ID NO: 80668 - DNA, 15 bp, Homo sapiens
aaagaataaaaagac

SEQ ID NO: 80669 - DNA, 15 bp, Homo sapiens
gaaagaataaaaaga

SEQ ID NO: 80670 - DNA, 15 bp, Homo sapiens
agaaagaataaaaag

SEQ ID NO: 80671 - DNA, 15 bp, Homo sapiens
aagaaagaataaaaa

SEQ ID NO: 80672 - DNA, 15 bp, Homo sapiens
aaagaaagaataaaa

SEQ ID NO: 80673 - DNA, 15 bp, Homo sapiens
gaaagaaagaataaa

SEQ ID NO: 80674 - DNA, 15 bp, Homo sapiens
tgaaagaaagaataa

SEQ ID NO: 80675 - DNA, 15 bp, Homo sapiens
gtgaaagaaagaata

SEQ ID NO: 80676 - DNA, 15 bp, Homo sapiens
agtgaaagaaagaat

SEQ ID NO: 80677 - DNA, 15 bp, Homo sapiens
cagtgaaagaaagaa

SEQ ID NO: 80678 - DNA, 15 bp, Homo sapiens
acagtgaaagaaaga

SEQ ID NO: 80679 - DNA, 15 bp, Homo sapiens
gacagtgaaagaaag

SEQ ID NO: 80680 - DNA, 15 bp, Homo sapiens
tgacagtgaaagaaa

SEQ ID NO: 80681 - DNA, 15 bp, Homo sapiens
gtgacagtgaaagaa

SEQ ID NO: 80682 - DNA, 15 bp, Homo sapiens
tgtgacagtgaaaga

SEQ ID NO: 80683 - DNA, 15 bp, Homo sapiens
ttgtgacagtgaaag

SEQ ID NO: 80684 - DNA, 15 bp, Homo sapiens
gttgtgacagtgaaa

SEQ ID NO: 80685 - DNA, 15 bp, Homo sapiens
agttgtgacagtgaa

SEQ ID NO: 80686 - DNA, 15 bp, Homo sapiens
gagttgtgacagtga

SEQ ID NO: 80687 - DNA, 15 bp, Homo sapiens
cgagttgtgacagtg

SEQ ID NO: 80688 - DNA, 15 bp, Homo sapiens
tcgagttgtgacagt

SEQ ID NO: 80689 - DNA, 15 bp, Homo sapiens
gtcgagttgtgacag

SEQ ID NO: 80690 - DNA, 15 bp, Homo sapiens
tgtcgagttgtgaca

SEQ ID NO: 80691 - DNA, 15 bp, Homo sapiens
ctgtcgagttgtgac

SEQ ID NO: 80692 - DNA, 15 bp, Homo sapiens
actgtcgagttgtga

SEQ ID NO: 80693 - DNA, 15 bp, Homo sapiens
cactgtcgagttgtg

SEQ ID NO: 80694 - DNA, 15 bp, Homo sapiens
tcactgtcgagttgt

SEQ ID NO: 80695 - DNA, 15 bp, Homo sapiens
gtcactgtcgagttg

SEQ ID NO: 80696 - DNA, 15 bp, Homo sapiens
ggtcactgtcgagtt

SEQ ID NO: 80697 - DNA, 15 bp, Homo sapiens
aggtcactgtcgagt

SEQ ID NO: 80698 - DNA, 15 bp, Homo sapiens
gaggtcactgtcgag

SEQ ID NO: 80699 - DNA, 15 bp, Homo sapiens
ggaggtcactgtcga

SEQ ID NO: 80700 - DNA, 15 bp, Homo sapiens
aggaggtcactgtcg

SEQ ID NO: 80701 - DNA, 15 bp, Homo sapiens
gaggaggtcactgtc

SEQ ID NO: 80702 - DNA, 15 bp, Homo sapiens
tgaggaggtcactgt

SEQ ID NO: 80703 - DNA, 15 bp, Homo sapiens
ctgaggaggtcactg

SEQ ID NO: 80704 - DNA, 15 bp, Homo sapiens
actgaggaggtcact

SEQ ID NO: 80705 - DNA, 15 bp, Homo sapiens
gactgaggaggtcac

SEQ ID NO: 80706 - DNA, 15 bp, Homo sapiens
agactgaggaggtca

SEQ ID NO: 80707 - DNA, 15 bp, Homo sapiens
aagactgaggaggtc

SEQ ID NO: 80708 - DNA, 15 bp, Homo sapiens
aaagactgaggaggt

SEQ ID NO: 80709 - DNA, 15 bp, Homo sapiens
caaagactgaggagg

SEQ ID NO: 80710 - DNA, 15 bp, Homo sapiens
tcaaagactgaggag

SEQ ID NO: 80711 - DNA, 15 bp, Homo sapiens
ttcaaagactgagga

SEQ ID NO: 80712 - DNA, 15 bp, Homo sapiens
attcaaagactgagg

SEQ ID NO: 80713 - DNA, 15 bp, Homo sapiens
tattcaaagactgag

SEQ ID NO: 80714 - DNA, 15 bp, Homo sapiens
atattcaaagactga

SEQ ID NO: 80715 - DNA, 15 bp, Homo sapiens
tatattcaaagactg

SEQ ID NO: 80716 - DNA, 15 bp, Homo sapiens
ctatattcaaagact

SEQ ID NO: 80717 - DNA, 15 bp, Homo sapiens
gctatattcaaagac

SEQ ID NO: 80718 - DNA, 15 bp, Homo sapiens
agctatattcaaaga

SEQ ID NO: 80719 - DNA, 15 bp, Homo sapiens
aagctatattcaaag

SEQ ID NO: 80720 - DNA, 15 bp, Homo sapiens
gaagctatattcaaa

SEQ ID NO: 80721 - DNA, 15 bp, Homo sapiens
ggaagctatattcaa

SEQ ID NO: 80722 - DNA, 15 bp, Homo sapiens
gggaagctatattca

SEQ ID NO: 80723 - DNA, 15 bp, Homo sapiens
ggggaagctatattc

SEQ ID NO: 80724 - DNA, 15 bp, Homo sapiens
tggggaagctatatt

SEQ ID NO: 80725 - DNA, 15 bp, Homo sapiens
ctggggaagctatat

SEQ ID NO: 80726 - DNA, 15 bp, Homo sapiens
actggggaagctata

SEQ ID NO: 80727 - DNA, 15 bp, Homo sapiens
aactggggaagctat

SEQ ID NO: 80728 - DNA, 15 bp, Homo sapiens
aaactggggaagcta

SEQ ID NO: 80729 - DNA, 15 bp, Homo sapiens
aaaactggggaagct

SEQ ID NO: 80730 - DNA, 15 bp, Homo sapiens
aaaaactggggaagc

SEQ ID NO: 80731 - DNA, 15 bp, Homo sapiens
taaaaactggggaag

SEQ ID NO: 80732 - DNA, 15 bp, Homo sapiens
ataaaaactggggaa

SEQ ID NO: 80733 - DNA, 15 bp, Homo sapiens
aataaaaactgggga

SEQ ID NO: 80734 - DNA, 15 bp, Homo sapiens
caataaaaactgggg

SEQ ID NO: 80735 - DNA, 15 bp, Homo sapiens
acaataaaaactggg

SEQ ID NO: 80736 - DNA, 15 bp, Homo sapiens
gacaataaaaactgg

SEQ ID NO: 80737 - DNA, 15 bp, Homo sapiens
tgacaataaaaactg

SEQ ID NO: 80738 - DNA, 15 bp, Homo sapiens
ctgacaataaaaact

SEQ ID NO: 80739 - DNA, 15 bp, Homo sapiens
tctgacaataaaaac

SEQ ID NO: 80740 - DNA, 15 bp, Homo sapiens
ttctgacaataaaaa

SEQ ID NO: 80741 - DNA, 15 bp, Homo sapiens
tttctgacaataaaa

SEQ ID NO: 80742 - DNA, 15 bp, Homo sapiens
ctttctgacaataaa

SEQ ID NO: 80743 - DNA, 15 bp, Homo sapiens
actttctgacaataa

SEQ ID NO: 80744 - DNA, 15 bp, Homo sapiens
cactttctgacaata

SEQ ID NO: 80745 - DNA, 15 bp, Homo sapiens
gcactttctgacaat

SEQ ID NO: 80746 - DNA, 15 bp, Homo sapiens
tgcactttctgacaa

SEQ ID NO: 80747 - DNA, 15 bp, Homo sapiens
ctgcactttctgaca

SEQ ID NO: 80748 - DNA, 15 bp, Homo sapiens
cctgcactttctgac

SEQ ID NO: 80749 - DNA, 15 bp, Homo sapiens
ccctgcactttctga

SEQ ID NO: 80750 - DNA, 15 bp, Homo sapiens
cccctgcactttctg

SEQ ID NO: 80751 - DNA, 15 bp, Homo sapiens
tcccctgcactttct

SEQ ID NO: 80752 - DNA, 15 bp, Homo sapiens
atcccctgcactttc

SEQ ID NO: 80753 - DNA, 15 bp, Homo sapiens
gatcccctgcacttt

SEQ ID NO: 80754 - DNA, 15 bp, Homo sapiens
ggatcccctgcactt

SEQ ID NO: 80755 - DNA, 15 bp, Homo sapiens
aggatcccctgcact

SEQ ID NO: 80756 - DNA, 15 bp, Homo sapiens
aaggatcccctgcac

SEQ ID NO: 80757 - DNA, 15 bp, Homo sapiens
taaggatcccctgca

SEQ ID NO: 80758 - DNA, 15 bp, Homo sapiens
ttaaggatcccctgc

SEQ ID NO: 80759 - DNA, 15 bp, Homo sapiens
gttaaggatcccctg

SEQ ID NO: 80760 - DNA, 15 bp, Homo sapiens
ggttaaggatcccct

SEQ ID NO: 80761 - DNA, 15 bp, Homo sapiens
tggttaaggatcccc

SEQ ID NO: 80762 - DNA, 15 bp, Homo sapiens
atggttaaggatccc

SEQ ID NO: 80763 - DNA, 15 bp, Homo sapiens
aatggttaaggatcc

SEQ ID NO: 80764 - DNA, 15 bp, Homo sapiens
gaatggttaaggatc

SEQ ID NO: 80765 - DNA, 15 bp, Homo sapiens
ggaatggttaaggat

SEQ ID NO: 80766 - DNA, 15 bp, Homo sapiens
aggaatggttaagga

SEQ ID NO: 80767 - DNA, 15 bp, Homo sapiens
taggaatggttaagg

SEQ ID NO: 80768 - DNA, 15 bp, Homo sapiens
ataggaatggttaag

SEQ ID NO: 80769 - DNA, 15 bp, Homo sapiens
aataggaatggttaa

SEQ ID NO: 80770 - DNA, 15 bp, Homo sapiens
taataggaatggtta

SEQ ID NO: 80771 - DNA, 15 bp, Homo sapiens
ttaataggaatggtt

SEQ ID NO: 80772 - DNA, 15 bp, Homo sapiens
gttaataggaatggt

SEQ ID NO: 80773 - DNA, 15 bp, Homo sapiens
tgttaataggaatgg

SEQ ID NO: 80774 - DNA, 15 bp, Homo sapiens
atgttaataggaatg

SEQ ID NO: 80775 - DNA, 15 bp, Homo sapiens
catgttaataggaat

SEQ ID NO: 80776 - DNA, 15 bp, Homo sapiens
accatgttaatagga

SEQ ID NO: 80777 - DNA, 15 bp, Homo sapiens
aaccatgttaatagg

SEQ ID NO: 80778 - DNA, 15 bp, Homo sapiens
aaaccatgttaatag

SEQ ID NO: 80779 - DNA, 15 bp, Homo sapiens
gaaaccatgttaata

SEQ ID NO: 80780 - DNA, 15 bp, Homo sapiens
ggaaaccatgttaat

SEQ ID NO: 80781 - DNA, 15 bp, Homo sapiens
tggaaaccatgttaa

SEQ ID NO: 80782 - DNA, 15 bp, Homo sapiens
ctggaaaccatgtta

SEQ ID NO: 80783 - DNA, 15 bp, Homo sapiens
tctggaaaccatgtt

SEQ ID NO: 80784 - DNA, 15 bp, Homo sapiens
gtctggaaaccatgt

SEQ ID NO: 80785 - DNA, 15 bp, Homo sapiens
ggtctggaaaccatg

SEQ ID NO: 80786 - DNA, 15 bp, Homo sapiens
gggtctggaaaccat

SEQ ID NO: 80787 - DNA, 15 bp, Homo sapiens
agggtctggaaacca

SEQ ID NO: 80788 - DNA, 15 bp, Homo sapiens
aagggtctggaaacc

SEQ ID NO: 80789 - DNA, 15 bp, Homo sapiens
aaagggtctggaaac

SEQ ID NO: 80790 - DNA, 15 bp, Homo sapiens
aaaagggtctggaaa

SEQ ID NO: 80791 - DNA, 15 bp, Homo sapiens
taaaagggtctggaa

SEQ ID NO: 80792 - DNA, 15 bp, Homo sapiens
ataaaagggtctgga

SEQ ID NO: 80793 - DNA, 15 bp, Homo sapiens
tataaaagggtctgg

SEQ ID NO: 80794 - DNA, 15 bp, Homo sapiens
atataaaagggtctg

SEQ ID NO: 80795 - DNA, 15 bp, Homo sapiens
gatataaaagggtct

SEQ ID NO: 80796 - DNA, 15 bp, Homo sapiens
agatataaaagggtc

SEQ ID NO: 80797 - DNA, 15 bp, Homo sapiens
aagatataaaagggt

SEQ ID NO: 80798 - DNA, 15 bp, Homo sapiens
gaagatataaaaggg

SEQ ID NO: 80799 - DNA, 15 bp, Homo sapiens
agaagatataaaagg

SEQ ID NO: 80800 - DNA, 15 bp, Homo sapiens
cagaagatataaaag

SEQ ID NO: 80801 - DNA, 15 bp, Homo sapiens
acagaagatataaaa

SEQ ID NO: 80802 - DNA, 15 bp, Homo sapiens
gacagaagatataaa

SEQ ID NO: 80803 - DNA, 15 bp, Homo sapiens
agacagaagatataa

SEQ ID NO: 80804 - DNA, 15 bp, Homo sapiens
cagacagaagatata

SEQ ID NO: 80805 - DNA, 15 bp, Homo sapiens
gcagacagaagatat

SEQ ID NO: 80806 - DNA, 15 bp, Homo sapiens
agcagacagaagata

SEQ ID NO: 80807 - DNA, 15 bp, Homo sapiens
gagcagacagaagat

SEQ ID NO: 80808 - DNA, 15 bp, Homo sapiens
agagcagacagaaga

SEQ ID NO: 80809 - DNA, 15 bp, Homo sapiens
tagagcagacagaag

SEQ ID NO: 80810 - DNA, 15 bp, Homo sapiens
ctagagcagacagaa

SEQ ID NO: 80811 - DNA, 15 bp, Homo sapiens
tctagagcagacaga

SEQ ID NO: 80812 - DNA, 15 bp, Homo sapiens
ttctagagcagacag

SEQ ID NO: 80813 - DNA, 15 bp, Homo sapiens
tttctagagcagaca

SEQ ID NO: 80814 - DNA, 15 bp, Homo sapiens
gtttctagagcagac

SEQ ID NO: 80815 - DNA, 15 bp, Homo sapiens
ggtttctagagcaga

SEQ ID NO: 80816 - DNA, 15 bp, Homo sapiens
tggtttctagagcag

SEQ ID NO: 80817 - DNA, 15 bp, Homo sapiens
gtggtttctagagca

SEQ ID NO: 80818 - DNA, 15 bp, Homo sapiens
agtggtttctagagc

SEQ ID NO: 80819 - DNA, 15 bp, Homo sapiens
tagtggtttctagag

SEQ ID NO: 80820 - DNA, 15 bp, Homo sapiens
atagtggtttctaga

SEQ ID NO: 80821 - DNA, 15 bp, Homo sapiens
aatagtggtttctag

SEQ ID NO: 80822 - DNA, 15 bp, Homo sapiens
caatagtggtttcta

SEQ ID NO: 80823 - DNA, 15 bp, Homo sapiens
ccaatagtggtttct

SEQ ID NO: 80824 - DNA, 15 bp, Homo sapiens
accaatagtggtttc

SEQ ID NO: 80825 - DNA, 15 bp, Homo sapiens
aaccaatagtggttt

SEQ ID NO: 80826 - DNA, 15 bp, Homo sapiens
aaaccaatagtggtt

SEQ ID NO: 80827 - DNA, 15 bp, Homo sapiens
caaaccaatagtggt

SEQ ID NO: 80828 - DNA, 15 bp, Homo sapiens
gcaaaccaatagtgg

SEQ ID NO: 80829 - DNA, 15 bp, Homo sapiens
ggcaaaccaatagtg

SEQ ID NO: 80830 - DNA, 15 bp, Homo sapiens
aggcaaaccaatagt

SEQ ID NO: 80831 - DNA, 15 bp, Homo sapiens
aaggcaaaccaatag

SEQ ID NO: 80832 - DNA, 15 bp, Homo sapiens
taaggcaaaccaata

SEQ ID NO: 80833 - DNA, 15 bp, Homo sapiens
ttaaggcaaaccaat

SEQ ID NO: 80834 - DNA, 15 bp, Homo sapiens
tttaaggcaaaccaa

SEQ ID NO: 80835 - DNA, 15 bp, Homo sapiens
ttttaaggcaaacca

SEQ ID NO: 80836 - DNA, 15 bp, Homo sapiens
attttaaggcaaacc

SEQ ID NO: 80837 - DNA, 15 bp, Homo sapiens
cattttaaggcaaac

SEQ ID NO: 80838 - DNA, 15 bp, Homo sapiens
ccattttaaggcaaa

SEQ ID NO: 80839 - DNA, 15 bp, Homo sapiens
tccattttaaggcaa

SEQ ID NO: 80840 - DNA, 15 bp, Homo sapiens
gtccattttaaggca

SEQ ID NO: 80841 - DNA, 15 bp, Homo sapiens
agtccattttaaggc

SEQ ID NO: 80842 - DNA, 15 bp, Homo sapiens
tagtccattttaagg

SEQ ID NO: 80843 - DNA, 15 bp, Homo sapiens
gtagtccattttaag

SEQ ID NO: 80844 - DNA, 15 bp, Homo sapiens
ggtagtccattttaa

SEQ ID NO: 80845 - DNA, 15 bp, Homo sapiens
gggtagtccatttta

SEQ ID NO: 80846 - DNA, 15 bp, Homo sapiens
ggggtagtccatttt

SEQ ID NO: 80847 - DNA, 15 bp, Homo sapiens
tggggtagtccattt

SEQ ID NO: 80848 - DNA, 15 bp, Homo sapiens
ttggggtagtccatt

SEQ ID NO: 80849 - DNA, 15 bp, Homo sapiens
attggggtagtccat

SEQ ID NO: 80850 - DNA, 15 bp, Homo sapiens
tattggggtagtcca

SEQ ID NO: 80851 - DNA, 15 bp, Homo sapiens
ttattggggtagtcc

SEQ ID NO: 80852 - DNA, 15 bp, Homo sapiens
attattggggtagtc

SEQ ID NO: 80853 - DNA, 15 bp, Homo sapiens
gattattggggtagt

SEQ ID NO: 80854 - DNA, 15 bp, Homo sapiens
cgattattggggtag

SEQ ID NO: 80855 - DNA, 15 bp, Homo sapiens
tcgattattggggta

SEQ ID NO: 80856 - DNA, 15 bp, Homo sapiens
ctcgattattggggt

SEQ ID NO: 80857 - DNA, 15 bp, Homo sapiens
cctcgattattgggg

SEQ ID NO: 80858 - DNA, 15 bp, Homo sapiens
ccctcgattattggg

SEQ ID NO: 80859 - DNA, 15 bp, Homo sapiens
gccctcgattattgg

SEQ ID NO: 80860 - DNA, 15 bp, Homo sapiens
ggccctcgattattg

SEQ ID NO: 80861 - DNA, 15 bp, Homo sapiens
aggccctcgattatt

SEQ ID NO: 80862 - DNA, 15 bp, Homo sapiens
aaggccctcgattat

SEQ ID NO: 80863 - DNA, 15 bp, Homo sapiens
taaggccctcgatta

SEQ ID NO: 80864 - DNA, 15 bp, Homo sapiens
ttaaggccctcgatt

SEQ ID NO: 80865 - DNA, 15 bp, Homo sapiens
tttaaggccctcgat

SEQ ID NO: 80866 - DNA, 15 bp, Homo sapiens
atttaaggccctcga

SEQ ID NO: 80867 - DNA, 15 bp, Homo sapiens
catttaaggccctcg

SEQ ID NO: 80868 - DNA, 15 bp, Homo sapiens
tcatttaaggccctc

SEQ ID NO: 80869 - DNA, 15 bp, Homo sapiens
gtcatttaaggccct

SEQ ID NO: 80870 - DNA, 15 bp, Homo sapiens
agtcatttaaggccc

SEQ ID NO: 80871 - DNA, 15 bp, Homo sapiens
cagtcatttaaggcc

SEQ ID NO: 80872 - DNA, 15 bp, Homo sapiens
gcagtcatttaaggc

SEQ ID NO: 80873 - DNA, 15 bp, Homo sapiens
agcagtcatttaagg

SEQ ID NO: 80874 - DNA, 15 bp, Homo sapiens
aagcagtcatttaag

SEQ ID NO: 80875 - DNA, 15 bp, Homo sapiens
taagcagtcatttaa

SEQ ID NO: 80876 - DNA, 15 bp, Homo sapiens
ttaagcagtcattta

SEQ ID NO: 80877 - DNA, 15 bp, Homo sapiens
attaagcagtcattt

SEQ ID NO: 80878 - DNA, 15 bp, Homo sapiens
cattaagcagtcatt

SEQ ID NO: 80879 - DNA, 15 bp, Homo sapiens
gcattaagcagtcat

SEQ ID NO: 80880 - DNA, 15 bp, Homo sapiens
tgcattaagcagtca

SEQ ID NO: 80881 - DNA, 15 bp, Homo sapiens
ctgcattaagcagtc

SEQ ID NO: 80882 - DNA, 15 bp, Homo sapiens
actgcattaagcagt

SEQ ID NO: 80883 - DNA, 15 bp, Homo sapiens
cactgcattaagcag

SEQ ID NO: 80884 - DNA, 15 bp, Homo sapiens
gcactgcattaagca

SEQ ID NO: 80885 - DNA, 15 bp, Homo sapiens
ggcactgcattaagc

SEQ ID NO: 80886 - DNA, 15 bp, Homo sapiens
aggcactgcattaag

SEQ ID NO: 80887 - DNA, 15 bp, Homo sapiens
taggcactgcattaa

SEQ ID NO: 80888 - DNA, 15 bp, Homo sapiens
ctaggcactgcatta

SEQ ID NO: 80889 - DNA, 15 bp, Homo sapiens
actaggcactgcatt

SEQ ID NO: 80890 - DNA, 15 bp, Homo sapiens
aactaggcactgcat

SEQ ID NO: 80891 - DNA, 15 bp, Homo sapiens
aaactaggcactgca

SEQ ID NO: 80892 - DNA, 15 bp, Homo sapiens
taaactaggcactgc

SEQ ID NO: 80893 - DNA, 15 bp, Homo sapiens
ttaaactaggcactg

SEQ ID NO: 80894 - DNA, 15 bp, Homo sapiens
tttaaactaggcact

SEQ ID NO: 80895 - DNA, 15 bp, Homo sapiens
ttttaaactaggcac

SEQ ID NO: 80896 - DNA, 15 bp, Homo sapiens
attttaaactaggca

SEQ ID NO: 80897 - DNA, 15 bp, Homo sapiens
tattttaaactaggc

SEQ ID NO: 80898 - DNA, 15 bp, Homo sapiens
atattttaaactagg

SEQ ID NO: 80899 - DNA, 15 bp, Homo sapiens
tatattttaaactag

SEQ ID NO: 80900 - DNA, 15 bp, Homo sapiens
atatattttaaacta

SEQ ID NO: 80901 - DNA, 15 bp, Homo sapiens
catatattttaaact

SEQ ID NO: 80902 - DNA, 15 bp, Homo sapiens
gcatatattttaaac

SEQ ID NO: 80903 - DNA, 15 bp, Homo sapiens
agcatatattttaaa

SEQ ID NO: 80904 - DNA, 15 bp, Homo sapiens
aagcatatattttaa

SEQ ID NO: 80905 - DNA, 15 bp, Homo sapiens
taagcatatatttta

SEQ ID NO: 80906 - DNA, 15 bp, Homo sapiens
ttaagcatatatttt

SEQ ID NO: 80907 - DNA, 15 bp, Homo sapiens
tttaagcatatattt

SEQ ID NO: 80908 - DNA, 15 bp, Homo sapiens
ttttaagcatatatt

SEQ ID NO: 80909 - DNA, 15 bp, Homo sapiens
tttttaagcatatat

SEQ ID NO: 80910 - DNA, 15 bp, Homo sapiens
ttttttaagcatata

SEQ ID NO: 80911 - DNA, 15 bp, Homo sapiens
attttttaagcatat

SEQ ID NO: 80912 - DNA, 15 bp, Homo sapiens
cattttttaagcata

SEQ ID NO: 80913 - DNA, 15 bp, Homo sapiens
ccattttttaagcat

SEQ ID NO: 80914 - DNA, 15 bp, Homo sapiens
gccattttttaagca

SEQ ID NO: 80915 - DNA, 15 bp, Homo sapiens
tgccattttttaagc

SEQ ID NO: 80916 - DNA, 15 bp, Homo sapiens
ctgccattttttaag

SEQ ID NO: 80917 - DNA, 15 bp, Homo sapiens
gctgccattttttaa

SEQ ID NO: 80918 - DNA, 15 bp, Homo sapiens
agctgccatttttta

SEQ ID NO: 80919 - DNA, 15 bp, Homo sapiens
gagctgccatttttt

SEQ ID NO: 80920 - DNA, 15 bp, Homo sapiens
tgagctgccattttt

SEQ ID NO: 80921 - DNA, 15 bp, Homo sapiens
atgagctgccatttt

SEQ ID NO: 80922 - DNA, 15 bp, Homo sapiens
aatgagctgccattt

SEQ ID NO: 80923 - DNA, 15 bp, Homo sapiens
aaatgagctgccatt

SEQ ID NO: 80924 - DNA, 15 bp, Homo sapiens
gaaatgagctgccat

SEQ ID NO: 80925 - DNA, 15 bp, Homo sapiens
ggaaatgagctgcca

SEQ ID NO: 80926 - DNA, 15 bp, Homo sapiens
tggaaatgagctgcc

SEQ ID NO: 80927 - DNA, 15 bp, Homo sapiens
gtggaaatgagctgc

SEQ ID NO: 80928 - DNA, 15 bp, Homo sapiens
agtggaaatgagctg

SEQ ID NO: 80929 - DNA, 15 bp, Homo sapiens
aagtggaaatgagct

SEQ ID NO: 80930 - DNA, 15 bp, Homo sapiens
gaagtggaaatgagc

SEQ ID NO: 80931 - DNA, 15 bp, Homo sapiens
agaagtggaaatgag

SEQ ID NO: 80932 - DNA, 15 bp, Homo sapiens
gagaagtggaaatga

SEQ ID NO: 80933 - DNA, 15 bp, Homo sapiens
agagaagtggaaatg

SEQ ID NO: 80934 - DNA, 15 bp, Homo sapiens
aagagaagtggaaat

SEQ ID NO: 80935 - DNA, 15 bp, Homo sapiens
gaagagaagtggaaa

SEQ ID NO: 80936 - DNA, 15 bp, Homo sapiens
ggaagagaagtggaa

SEQ ID NO: 80937 - DNA, 15 bp, Homo sapiens
gggaagagaagtgga

SEQ ID NO: 80938 - DNA, 15 bp, Homo sapiens
ggggaagagaagtgg

SEQ ID NO: 80939 - DNA, 15 bp, Homo sapiens
aggggaagagaagtg

SEQ ID NO: 80940 - DNA, 15 bp, Homo sapiens
caggggaagagaagt

SEQ ID NO: 80941 - DNA, 15 bp, Homo sapiens
ccaggggaagagaag

SEQ ID NO: 80942 - DNA, 15 bp, Homo sapiens
accaggggaagagaa

SEQ ID NO: 80943 - DNA, 15 bp, Homo sapiens
caccaggggaagaga

SEQ ID NO: 80944 - DNA, 15 bp, Homo sapiens
gcaccaggggaagag

SEQ ID NO: 80945 - DNA, 15 bp, Homo sapiens
agcaccaggggaaga

SEQ ID NO: 80946 - DNA, 15 bp, Homo sapiens
cagcaccaggggaag

SEQ ID NO: 80947 - DNA, 15 bp, Homo sapiens
gcagcaccaggggaa

SEQ ID NO: 80948 - DNA, 15 bp, Homo sapiens
agcagcaccagggga

SEQ ID NO: 80949 - DNA, 15 bp, Homo sapiens
cagcagcaccagggg

SEQ ID NO: 80950 - DNA, 15 bp, Homo sapiens
acagcagcaccaggg

SEQ ID NO: 80951 - DNA, 15 bp, Homo sapiens
cacagcagcaccagg

SEQ ID NO: 80952 - DNA, 15 bp, Homo sapiens
ccacagcagcaccag

SEQ ID NO: 80953 - DNA, 15 bp, Homo sapiens
accacagcagcacca

SEQ ID NO: 80954 - DNA, 15 bp, Homo sapiens
caccacagcagcacc

SEQ ID NO: 80955 - DNA, 15 bp, Homo sapiens
ccaccacagcagcac

SEQ ID NO: 80956 - DNA, 15 bp, Homo sapiens
accaccacagcagca

SEQ ID NO: 80957 - DNA, 15 bp, Homo sapiens
caccaccacagcagc

SEQ ID NO: 80958 - DNA, 15 bp, Homo sapiens
ccaccaccacagcag

SEQ ID NO: 80959 - DNA, 15 bp, Homo sapiens
accaccaccacagca

SEQ ID NO: 80960 - DNA, 15 bp, Homo sapiens
aaccaccaccacagc

SEQ ID NO: 80961 - DNA, 15 bp, Homo sapiens
aaaccaccaccacag

SEQ ID NO: 80962 - DNA, 15 bp, Homo sapiens
aaaaccaccaccaca

SEQ ID NO: 80963 - DNA, 15 bp, Homo sapiens
aaaaaccaccaccac

SEQ ID NO: 80964 - DNA, 15 bp, Homo sapiens
taaaaaccaccacca

SEQ ID NO: 80965 - DNA, 15 bp, Homo sapiens
gtaaaaaccaccacc

SEQ ID NO: 80966 - DNA, 15 bp, Homo sapiens
ggtaaaaaccaccac

SEQ ID NO: 80967 - DNA, 15 bp, Homo sapiens
tggtaaaaaccacca

SEQ ID NO: 80968 - DNA, 15 bp, Homo sapiens
ctggtaaaaaccacc

SEQ ID NO: 80969 - DNA, 15 bp, Homo sapiens
gctggtaaaaaccac

SEQ ID NO: 80970 - DNA, 15 bp, Homo sapiens
agctggtaaaaacca

SEQ ID NO: 80971 - DNA, 15 bp, Homo sapiens
gagctggtaaaaacc

SEQ ID NO: 80972 - DNA, 15 bp, Homo sapiens
cgagctggtaaaaac

SEQ ID NO: 80973 - DNA, 15 bp, Homo sapiens
gcgagctggtaaaaa

SEQ ID NO: 80974 - DNA, 15 bp, Homo sapiens
cgcgagctggtaaaa

SEQ ID NO: 80975 - DNA, 15 bp, Homo sapiens
ccgcgagctggtaaa

SEQ ID NO: 80976 - DNA, 15 bp, Homo sapiens
accgcgagctggtaa

SEQ ID NO: 80977 - DNA, 15 bp, Homo sapiens
taccgcgagctggta

SEQ ID NO: 80978 - DNA, 15 bp, Homo sapiens
gtaccgcgagctggt

SEQ ID NO: 80979 - DNA, 15 bp, Homo sapiens
tgtaccgcgagctgg

SEQ ID NO: 80980 - DNA, 15 bp, Homo sapiens
ctgtaccgcgagctg

SEQ ID NO: 80981 - DNA, 15 bp, Homo sapiens
actgtaccgcgagct

SEQ ID NO: 80982 - DNA, 15 bp, Homo sapiens
cactgtaccgcgagc

SEQ ID NO: 80983 - DNA, 15 bp, Homo sapiens
ccactgtaccgcgag

SEQ ID NO: 80984 - DNA, 15 bp, Homo sapiens
tccactgtaccgcga

SEQ ID NO: 80985 - DNA, 15 bp, Homo sapiens
gtccactgtaccgcg

SEQ ID NO: 80986 - DNA, 15 bp, Homo sapiens
tgtccactgtaccgc

SEQ ID NO: 80987 - DNA, 15 bp, Homo sapiens
ctgtccactgtaccg

SEQ ID NO: 80988 - DNA, 15 bp, Homo sapiens
actgtccactgtacc

SEQ ID NO: 80989 - DNA, 15 bp, Homo sapiens
gactgtccactgtac

SEQ ID NO: 80990 - DNA, 15 bp, Homo sapiens
tgactgtccactgta

SEQ ID NO: 80991 - DNA, 15 bp, Homo sapiens
atgactgtccactgt

SEQ ID NO: 80992 - DNA, 15 bp, Homo sapiens
aatgactgtccactg

SEQ ID NO: 80993 - DNA, 15 bp, Homo sapiens
aaatgactgtccact

SEQ ID NO: 80994 - DNA, 15 bp, Homo sapiens
gaaatgactgtccac

SEQ ID NO: 80995 - DNA, 15 bp, Homo sapiens
ggaaatgactgtcca

SEQ ID NO: 80996 - DNA, 15 bp, Homo sapiens
aggaaatgactgtcc

SEQ ID NO: 80997 - DNA, 15 bp, Homo sapiens
taggaaatgactgtc

SEQ ID NO: 80998 - DNA, 15 bp, Homo sapiens
ctaggaaatgactgt

SEQ ID NO: 80999 - DNA, 15 bp, Homo sapiens
tctaggaaatgactg

SEQ ID NO: 81000 - DNA, 15 bp, Homo sapiens
ttctaggaaatgact

SEQ ID NO: 81001 - DNA, 15 bp, Homo sapiens
attctaggaaatgac

SEQ ID NO: 81002 - DNA, 15 bp, Homo sapiens
cattctaggaaatga

SEQ ID NO: 81003 - DNA, 15 bp, Homo sapiens
acattctaggaaatg

SEQ ID NO: 81004 - DNA, 15 bp, Homo sapiens
tacattctaggaaat

SEQ ID NO: 81005 - DNA, 15 bp, Homo sapiens
ctacattctaggaaa

SEQ ID NO: 81006 - DNA, 15 bp, Homo sapiens
tctacattctaggaa

SEQ ID NO: 81007 - DNA, 15 bp, Homo sapiens
gtctacattctagga

SEQ ID NO: 81008 - DNA, 15 bp, Homo sapiens
tgtctacattctagg

SEQ ID NO: 81009 - DNA, 15 bp, Homo sapiens
gtgtctacattctag

SEQ ID NO: 81010 - DNA, 15 bp, Homo sapiens
ggtgtctacattcta

SEQ ID NO: 81011 - DNA, 15 bp, Homo sapiens
aggtgtctacattct

SEQ ID NO: 81012 - DNA, 15 bp, Homo sapiens
caggtgtctacattc

SEQ ID NO: 81013 - DNA, 15 bp, Homo sapiens
acaggtgtctacatt

SEQ ID NO: 81014 - DNA, 15 bp, Homo sapiens
aacaggtgtctacat

SEQ ID NO: 81015 - DNA, 15 bp, Homo sapiens
gaacaggtgtctaca

SEQ ID NO: 81016 - DNA, 15 bp, Homo sapiens
ggaacaggtgtctac

SEQ ID NO: 81017 - DNA, 15 bp, Homo sapiens
aggaacaggtgtcta

SEQ ID NO: 81018 - DNA, 15 bp, Homo sapiens
caggaacaggtgtct

SEQ ID NO: 81019 - DNA, 15 bp, Homo sapiens
acaggaacaggtgtc

SEQ ID NO: 81020 - DNA, 15 bp, Homo sapiens
cacaggaacaggtgt

SEQ ID NO: 81021 - DNA, 15 bp, Homo sapiens
tcacaggaacaggtg

SEQ ID NO: 81022 - DNA, 15 bp, Homo sapiens
gtcacaggaacaggt

SEQ ID NO: 81023 - DNA, 15 bp, Homo sapiens
ggtcacaggaacagg

SEQ ID NO: 81024 - DNA, 15 bp, Homo sapiens
aggtcacaggaacag

SEQ ID NO: 81025 - DNA, 15 bp, Homo sapiens
caggtcacaggaaca

SEQ ID NO: 81026 - DNA, 15 bp, Homo sapiens
gcaggtcacaggaac

SEQ ID NO: 81027 - DNA, 15 bp, Homo sapiens
cgcaggtcacaggaa

SEQ ID NO: 81028 - DNA, 15 bp, Homo sapiens
tcgcaggtcacagga

SEQ ID NO: 81029 - DNA, 15 bp, Homo sapiens
atcgcaggtcacagg

SEQ ID NO: 81030 - DNA, 15 bp, Homo sapiens
gatcgcaggtcacag

SEQ ID NO: 81031 - DNA, 15 bp, Homo sapiens
tgatcgcaggtcaca

SEQ ID NO: 81032 - DNA, 15 bp, Homo sapiens
atgatcgcaggtcac

SEQ ID NO: 81033 - DNA, 15 bp, Homo sapiens
aatgatcgcaggtca

SEQ ID NO: 81034 - DNA, 15 bp, Homo sapiens
caatgatcgcaggtc

SEQ ID NO: 81035 - DNA, 15 bp, Homo sapiens
gcaatgatcgcaggt

SEQ ID NO: 81036 - DNA, 15 bp, Homo sapiens
tgcaatgatcgcagg

SEQ ID NO: 81037 - DNA, 15 bp, Homo sapiens
atgcaatgatcgcag

SEQ ID NO: 81038 - DNA, 15 bp, Homo sapiens
gatgcaatgatcgca

SEQ ID NO: 81039 - DNA, 15 bp, Homo sapiens
tgatgcaatgatcgc

SEQ ID NO: 81040 - DNA, 15 bp, Homo sapiens
gtgatgcaatgatcg

SEQ ID NO: 81041 - DNA, 15 bp, Homo sapiens
agtgatgcaatgatc

SEQ ID NO: 81042 - DNA, 15 bp, Homo sapiens
gagtgatgcaatgat

SEQ ID NO: 81043 - DNA, 15 bp, Homo sapiens
agagtgatgcaatga

SEQ ID NO: 81044 - DNA, 15 bp, Homo sapiens
gcaagagtgatgcaa

SEQ ID NO: 81045 - DNA, 15 bp, Homo sapiens
ggcaagagtgatgca

SEQ ID NO: 81046 - DNA, 15 bp, Homo sapiens
gggcaagagtgatgc

SEQ ID NO: 81047 - DNA, 15 bp, Homo sapiens
tgggcaagagtgatg

SEQ ID NO: 81048 - DNA, 15 bp, Homo sapiens
atgggcaagagtgat

SEQ ID NO: 81049 - DNA, 15 bp, Homo sapiens
tatgggcaagagtga

SEQ ID NO: 81050 - DNA, 15 bp, Homo sapiens
atatgggcaagagtg

SEQ ID NO: 81051 - DNA, 15 bp, Homo sapiens
aatatgggcaagagt

SEQ ID NO: 81052 - DNA, 15 bp, Homo sapiens
caatatgggcaagag

SEQ ID NO: 81053 - DNA, 15 bp, Homo sapiens
tcaatatgggcaaga

SEQ ID NO: 81054 - DNA, 15 bp, Homo sapiens
ctcaatatgggcaag

SEQ ID NO: 81055 - DNA, 15 bp, Homo sapiens
tctcaatatgggcaa

SEQ ID NO: 81056 - DNA, 15 bp, Homo sapiens
ctctcaatatgggca

SEQ ID NO: 81057 - DNA, 15 bp, Homo sapiens
gctctcaatatgggc

SEQ ID NO: 81058 - DNA, 15 bp, Homo sapiens
tgctctcaatatggg

SEQ ID NO: 81059 - DNA, 15 bp, Homo sapiens
ctgctctcaatatgg

SEQ ID NO: 81060 - DNA, 15 bp, Homo sapiens
tctgctctcaatatg

SEQ ID NO: 81061 - DNA, 15 bp, Homo sapiens
atctgctctcaatat

SEQ ID NO: 81062 - DNA, 15 bp, Homo sapiens
catctgctctcaata

SEQ ID NO: 81063 - DNA, 15 bp, Homo sapiens
gcatctgctctcaat

SEQ ID NO: 81064 - DNA, 15 bp, Homo sapiens
agcatctgctctcaa

SEQ ID NO: 81065 - DNA, 15 bp, Homo sapiens
cagcatctgctctca

SEQ ID NO: 81066 - DNA, 15 bp, Homo sapiens
tcagcatctgctctc

SEQ ID NO: 81067 - DNA, 15 bp, Homo sapiens
gtcagcatctgctct

SEQ ID NO: 81068 - DNA, 15 bp, Homo sapiens
agtcagcatctgctc

SEQ ID NO: 81069 - DNA, 15 bp, Homo sapiens
cagtcagcatctgct

SEQ ID NO: 81070 - DNA, 15 bp, Homo sapiens
tcagtcagcatctgc

SEQ ID NO: 81071 - DNA, 15 bp, Homo sapiens
ctcagtcagcatctg

SEQ ID NO: 81072 - DNA, 15 bp, Homo sapiens
actcagtcagcatct

SEQ ID NO: 81073 - DNA, 15 bp, Homo sapiens
gactcagtcagcatc

SEQ ID NO: 81074 - DNA, 15 bp, Homo sapiens
agactcagtcagcat

SEQ ID NO: 81075 - DNA, 15 bp, Homo sapiens
gagactcagtcagca

SEQ ID NO: 81076 - DNA, 15 bp, Homo sapiens
ggagactcagtcagc

SEQ ID NO: 81077 - DNA, 15 bp, Homo sapiens
tggagactcagtcag

SEQ ID NO: 81078 - DNA, 15 bp, Homo sapiens
ttggagactcagtca

SEQ ID NO: 81079 - DNA, 15 bp, Homo sapiens
cttggagactcagtc

SEQ ID NO: 81080 - DNA, 15 bp, Homo sapiens
ccttggagactcagt

SEQ ID NO: 81081 - DNA, 15 bp, Homo sapiens
accttggagactcag

SEQ ID NO: 81082 - DNA, 15 bp, Homo sapiens
gaccttggagactca

SEQ ID NO: 81083 - DNA, 15 bp, Homo sapiens
tgaccttggagactc

SEQ ID NO: 81084 - DNA, 15 bp, Homo sapiens
atgaccttggagact

SEQ ID NO: 81085 - DNA, 15 bp, Homo sapiens
aatgaccttggagac

SEQ ID NO: 81086 - DNA, 15 bp, Homo sapiens
caatgaccttggaga

SEQ ID NO: 81087 - DNA, 15 bp, Homo sapiens
ccaatgaccttggag

SEQ ID NO: 81088 - DNA, 15 bp, Homo sapiens
tccaatgaccttgga

SEQ ID NO: 81089 - DNA, 15 bp, Homo sapiens
ttccaatgaccttgg

SEQ ID NO: 81090 - DNA, 15 bp, Homo sapiens
tttccaatgaccttg

SEQ ID NO: 81091 - DNA, 15 bp, Homo sapiens
gtttccaatgacctt

SEQ ID NO: 81092 - DNA, 15 bp, Homo sapiens
cgtttccaatgacct

SEQ ID NO: 81093 - DNA, 15 bp, Homo sapiens
acgtttccaatgacc

SEQ ID NO: 81094 - DNA, 15 bp, Homo sapiens
cacgtttccaatgac

SEQ ID NO: 81095 - DNA, 15 bp, Homo sapiens
gcacgtttccaatga

SEQ ID NO: 81096 - DNA, 15 bp, Homo sapiens
cgcacgtttccaatg

SEQ ID NO: 81097 - DNA, 15 bp, Homo sapiens
tcgcacgtttccaat

SEQ ID NO: 81098 - DNA, 15 bp, Homo sapiens
atcgcacgtttccaa

SEQ ID NO: 81099 - DNA, 15 bp, Homo sapiens
aatcgcacgtttcca

SEQ ID NO: 81100 - DNA, 15 bp, Homo sapiens
aaatcgcacgtttcc

SEQ ID NO: 81101 - DNA, 15 bp, Homo sapiens
aaaatcgcacgtttc

SEQ ID NO: 81102 - DNA, 15 bp, Homo sapiens
aaaaatcgcacgttt

SEQ ID NO: 81103 - DNA, 15 bp, Homo sapiens
taaaaatcgcacgtt

SEQ ID NO: 81104 - DNA, 15 bp, Homo sapiens
ctaaaaatcgcacgt

SEQ ID NO: 81105 - DNA, 15 bp, Homo sapiens
tctaaaaatcgcacg

SEQ ID NO: 81106 - DNA, 15 bp, Homo sapiens
atctaaaaatcgcac

SEQ ID NO: 81107 - DNA, 15 bp, Homo sapiens
catctaaaaatcgca

SEQ ID NO: 81108 - DNA, 15 bp, Homo sapiens
ccatctaaaaatcgc

SEQ ID NO: 81109 - DNA, 15 bp, Homo sapiens
gccatctaaaaatcg

SEQ ID NO: 81110 - DNA, 15 bp, Homo sapiens
ggccatctaaaaatc

SEQ ID NO: 81111 - DNA, 15 bp, Homo sapiens
cggccatctaaaaat

SEQ ID NO: 81112 - DNA, 15 bp, Homo sapiens
acggccatctaaaaa

SEQ ID NO: 81113 - DNA, 15 bp, Homo sapiens
gacggccatctaaaa

SEQ ID NO: 81114 - DNA, 15 bp, Homo sapiens
agacggccatctaaa

SEQ ID NO: 81115 - DNA, 15 bp, Homo sapiens
gagacggccatctaa

SEQ ID NO: 81116 - DNA, 15 bp, Homo sapiens
agagacggccatcta

SEQ ID NO: 81117 - DNA, 15 bp, Homo sapiens
aagagacggccatct

SEQ ID NO: 81118 - DNA, 15 bp, Homo sapiens
gaagagacggccatc

SEQ ID NO: 81119 - DNA, 15 bp, Homo sapiens
agaagagacggccat

SEQ ID NO: 81120 - DNA, 15 bp, Homo sapiens
gagaagagacggcca

SEQ ID NO: 81121 - DNA, 15 bp, Homo sapiens
agagaagagacggcc

SEQ ID NO: 81122 - DNA, 15 bp, Homo sapiens
cagagaagagacggc

SEQ ID NO: 81123 - DNA, 15 bp, Homo sapiens
tcagagaagagacgg

SEQ ID NO: 81124 - DNA, 15 bp, Homo sapiens
ttcagagaagagacg

SEQ ID NO: 81125 - DNA, 15 bp, Homo sapiens
tttcagagaagagac

SEQ ID NO: 81126 - DNA, 15 bp, Homo sapiens
atttcagagaagaga

SEQ ID NO: 81127 - DNA, 15 bp, Homo sapiens
tatttcagagaagag

SEQ ID NO: 81128 - DNA, 15 bp, Homo sapiens
atatttcagagaaga

SEQ ID NO: 81129 - DNA, 15 bp, Homo sapiens
aatatttcagagaag

SEQ ID NO: 81130 - DNA, 15 bp, Homo sapiens
taatatttcagagaa

SEQ ID NO: 81131 - DNA, 15 bp, Homo sapiens
ttaatatttcagaga

SEQ ID NO: 81132 - DNA, 15 bp, Homo sapiens
tttaatatttcagag

SEQ ID NO: 81133 - DNA, 15 bp, Homo sapiens
atttaatatttcaga

SEQ ID NO: 81134 - DNA, 15 bp, Homo sapiens
tatttaatatttcag

SEQ ID NO: 81135 - DNA, 15 bp, Homo sapiens
ctatttaatatttca

SEQ ID NO: 81136 - DNA, 15 bp, Homo sapiens
tctatttaatatttc

SEQ ID NO: 81137 - DNA, 15 bp, Homo sapiens
ttctatttaatattt

SEQ ID NO: 81138 - DNA, 15 bp, Homo sapiens
tttctatttaatatt

SEQ ID NO: 81139 - DNA, 15 bp, Homo sapiens
ctttctatttaatat

SEQ ID NO: 81140 - DNA, 15 bp, Homo sapiens
gctttctatttaata

SEQ ID NO: 81141 - DNA, 15 bp, Homo sapiens
agctttctatttaat

SEQ ID NO: 81142 - DNA, 15 bp, Homo sapiens
cagctttctatttaa

SEQ ID NO: 81143 - DNA, 15 bp, Homo sapiens
gcagctttctattta

SEQ ID NO: 81144 - DNA, 15 bp, Homo sapiens
agcagctttctattt

SEQ ID NO: 81145 - DNA, 15 bp, Homo sapiens
cagcagctttctatt

SEQ ID NO: 81146 - DNA, 15 bp, Homo sapiens
acagcagctttctat

SEQ ID NO: 81147 - DNA, 15 bp, Homo sapiens
aacagcagctttcta

SEQ ID NO: 81148 - DNA, 15 bp, Homo sapiens
taacagcagctttct

SEQ ID NO: 81149 - DNA, 15 bp, Homo sapiens
ttaacagcagctttc

SEQ ID NO: 81150 - DNA, 15 bp, Homo sapiens
cttaacagcagcttt

SEQ ID NO: 81151 - DNA, 15 bp, Homo sapiens
tcttaacagcagctt

SEQ ID NO: 81152 - DNA, 15 bp, Homo sapiens
atcttaacagcagct

SEQ ID NO: 81153 - DNA, 15 bp, Homo sapiens
catcttaacagcagc

SEQ ID NO: 81154 - DNA, 15 bp, Homo sapiens
tcatcttaacagcag

SEQ ID NO: 81155 - DNA, 15 bp, Homo sapiens
gtcatcttaacagca

SEQ ID NO: 81156 - DNA, 15 bp, Homo sapiens
tgtcatcttaacagc

SEQ ID NO: 81157 - DNA, 15 bp, Homo sapiens
ctgtcatcttaacag

SEQ ID NO: 81158 - DNA, 15 bp, Homo sapiens
cctgtcatcttaaca

SEQ ID NO: 81159 - DNA, 15 bp, Homo sapiens
tcctgtcatcttaac

SEQ ID NO: 81160 - DNA, 15 bp, Homo sapiens
ctcctgtcatcttaa

SEQ ID NO: 81161 - DNA, 15 bp, Homo sapiens
cctcctgtcatctta

SEQ ID NO: 81162 - DNA, 15 bp, Homo sapiens
tcctcctgtcatctt

SEQ ID NO: 81163 - DNA, 15 bp, Homo sapiens
ttcctcctgtcatct

SEQ ID NO: 81164 - DNA, 15 bp, Homo sapiens
gttcctcctgtcatc

SEQ ID NO: 81165 - DNA, 15 bp, Homo sapiens
tgttcctcctgtcat

SEQ ID NO: 81166 - DNA, 15 bp, Homo sapiens
atgttcctcctgtca

SEQ ID NO: 81167 - DNA, 15 bp, Homo sapiens
tatgttcctcctgtc

SEQ ID NO: 81168 - DNA, 15 bp, Homo sapiens
atatgttcctcctgt

SEQ ID NO: 81169 - DNA, 15 bp, Homo sapiens
gatatgttcctcctg

SEQ ID NO: 81170 - DNA, 15 bp, Homo sapiens
ggatatgttcctcct

SEQ ID NO: 81171 - DNA, 15 bp, Homo sapiens
gggatatgttcctcc

SEQ ID NO: 81172 - DNA, 15 bp, Homo sapiens
agggatatgttcctc

SEQ ID NO: 81173 - DNA, 15 bp, Homo sapiens
cagggatatgttcct

SEQ ID NO: 81174 - DNA, 15 bp, Homo sapiens
acagggatatgttcc

SEQ ID NO: 81175 - DNA, 15 bp, Homo sapiens
aacagggatatgttc

SEQ ID NO: 81176 - DNA, 15 bp, Homo sapiens
aaacagggatatgtt

SEQ ID NO: 81177 - DNA, 15 bp, Homo sapiens
caaacagggatatgt

SEQ ID NO: 81178 - DNA, 15 bp, Homo sapiens
tcaaacagggatatg

SEQ ID NO: 81179 - DNA, 15 bp, Homo sapiens
ctcaaacagggatat

SEQ ID NO: 81180 - DNA, 15 bp, Homo sapiens
gctcaaacagggata

SEQ ID NO: 81181 - DNA, 15 bp, Homo sapiens
tgctcaaacagggat

SEQ ID NO: 81182 - DNA, 15 bp, Homo sapiens
ttgctcaaacaggga

SEQ ID NO: 81183 - DNA, 15 bp, Homo sapiens
attgctcaaacaggg

SEQ ID NO: 81184 - DNA, 15 bp, Homo sapiens
tattgctcaaacagg

SEQ ID NO: 81185 - DNA, 15 bp, Homo sapiens
gtattgctcaaacag

SEQ ID NO: 81186 - DNA, 15 bp, Homo sapiens
ggtattgctcaaaca

SEQ ID NO: 81187 - DNA, 15 bp, Homo sapiens
aggtattgctcaaac

SEQ ID NO: 81188 - DNA, 15 bp, Homo sapiens
aaggtattgctcaaa

SEQ ID NO: 81189 - DNA, 15 bp, Homo sapiens
caaggtattgctcaa

SEQ ID NO: 81190 - DNA, 15 bp, Homo sapiens
tcaaggtattgctca

SEQ ID NO: 81191 - DNA, 15 bp, Homo sapiens
gtcaaggtattgctc

SEQ ID NO: 81192 - DNA, 15 bp, Homo sapiens
ggtcaaggtattgct

SEQ ID NO: 81193 - DNA, 15 bp, Homo sapiens
gggtcaaggtattgc

SEQ ID NO: 81194 - DNA, 15 bp, Homo sapiens
ggggtcaaggtattg

SEQ ID NO: 81195 - DNA, 15 bp, Homo sapiens
tggggtcaaggtatt

SEQ ID NO: 81196 - DNA, 15 bp, Homo sapiens
ctggggtcaaggtat

SEQ ID NO: 81197 - DNA, 15 bp, Homo sapiens
tctggggtcaaggta

SEQ ID NO: 81198 - DNA, 15 bp, Homo sapiens
atctggggtcaaggt

SEQ ID NO: 81199 - DNA, 15 bp, Homo sapiens
tatctggggtcaagg

SEQ ID NO: 81200 - DNA, 15 bp, Homo sapiens
atatctggggtcaag

SEQ ID NO: 81201 - DNA, 15 bp, Homo sapiens
aatatctggggtcaa

SEQ ID NO: 81202 - DNA, 15 bp, Homo sapiens
aaatatctggggtca

SEQ ID NO: 81203 - DNA, 15 bp, Homo sapiens
taaatatctggggtc

SEQ ID NO: 81204 - DNA, 15 bp, Homo sapiens
ataaatatctggggt

SEQ ID NO: 81205 - DNA, 15 bp, Homo sapiens
gataaatatctgggg

SEQ ID NO: 81206 - DNA, 15 bp, Homo sapiens
agataaatatctggg

SEQ ID NO: 81207 - DNA, 15 bp, Homo sapiens
tagataaatatctgg

SEQ ID NO: 81208 - DNA, 15 bp, Homo sapiens
ctagataaatatctg

SEQ ID NO: 81209 - DNA, 15 bp, Homo sapiens
tctagataaatatct

SEQ ID NO: 81210 - DNA, 15 bp, Homo sapiens
ctctagataaatatc

SEQ ID NO: 81211 - DNA, 15 bp, Homo sapiens
gctctagataaatat

SEQ ID NO: 81212 - DNA, 15 bp, Homo sapiens
tgctctagataaata

SEQ ID NO: 81213 - DNA, 15 bp, Homo sapiens
atgctctagataaat

SEQ ID NO: 81214 - DNA, 15 bp, Homo sapiens
gatgctctagataaa

SEQ ID NO: 81215 - DNA, 15 bp, Homo sapiens
tgatgctctagataa

SEQ ID NO: 81216 - DNA, 15 bp, Homo sapiens
gtgatgctctagata

SEQ ID NO: 81217 - DNA, 15 bp, Homo sapiens
tgtgatgctctagat

SEQ ID NO: 81218 - DNA, 15 bp, Homo sapiens
ttgtgatgctctaga

SEQ ID NO: 81219 - DNA, 15 bp, Homo sapiens
tttgtgatgctctag

SEQ ID NO: 81220 - DNA, 15 bp, Homo sapiens
ttttgtgatgctcta

SEQ ID NO: 81221 - DNA, 15 bp, Homo sapiens
attttgtgatgctct

SEQ ID NO: 81222 - DNA, 15 bp, Homo sapiens
gattttgtgatgctc

SEQ ID NO: 81223 - DNA, 15 bp, Homo sapiens
ggattttgtgatgct

SEQ ID NO: 81224 - DNA, 15 bp, Homo sapiens
gggattttgtgatgc

SEQ ID NO: 81225 - DNA, 15 bp, Homo sapiens
agggattttgtgatg

SEQ ID NO: 81226 - DNA, 15 bp, Homo sapiens
gagggattttgtgat

SEQ ID NO: 81227 - DNA, 15 bp, Homo sapiens
tgagggattttgtga

SEQ ID NO: 81228 - DNA, 15 bp, Homo sapiens
gtgagggattttgtg

SEQ ID NO: 81229 - DNA, 15 bp, Homo sapiens
tgtgagggattttgt

SEQ ID NO: 81230 - DNA, 15 bp, Homo sapiens
atgtgagggattttg

SEQ ID NO: 81231 - DNA, 15 bp, Homo sapiens
aatgtgagggatttt

SEQ ID NO: 81232 - DNA, 15 bp, Homo sapiens
aaatgtgagggattt

SEQ ID NO: 81233 - DNA, 15 bp, Homo sapiens
aaaatgtgagggatt

SEQ ID NO: 81234 - DNA, 15 bp, Homo sapiens
taaaatgtgagggat

SEQ ID NO: 81235 - DNA, 15 bp, Homo sapiens
gtaaaatgtgaggga

SEQ ID NO: 81236 - DNA, 15 bp, Homo sapiens
tgtaaaatgtgaggg

SEQ ID NO: 81237 - DNA, 15 bp, Homo sapiens
ctgtaaaatgtgagg

SEQ ID NO: 81238 - DNA, 15 bp, Homo sapiens
cctgtaaaatgtgag

SEQ ID NO: 81239 - DNA, 15 bp, Homo sapiens
ccctgtaaaatgtga

SEQ ID NO: 81240 - DNA, 15 bp, Homo sapiens
tccctgtaaaatgtg

SEQ ID NO: 81241 - DNA, 15 bp, Homo sapiens
ttccctgtaaaatgt

SEQ ID NO: 81242 - DNA, 15 bp, Homo sapiens
tttccctgtaaaatg

SEQ ID NO: 81243 - DNA, 15 bp, Homo sapiens
ttttccctgtaaaat

SEQ ID NO: 81244 - DNA, 15 bp, Homo sapiens
attttccctgtaaaa

SEQ ID NO: 81245 - DNA, 15 bp, Homo sapiens
gattttccctgtaaa

SEQ ID NO: 81246 - DNA, 15 bp, Homo sapiens
agattttccctgtaa

SEQ ID NO: 81247 - DNA, 15 bp, Homo sapiens
tagattttccctgta

SEQ ID NO: 81248 - DNA, 15 bp, Homo sapiens
gtagattttccctgt

SEQ ID NO: 81249 - DNA, 15 bp, Homo sapiens
ggtagattttccctg

SEQ ID NO: 81250 - DNA, 15 bp, Homo sapiens
aggtagattttccct

SEQ ID NO: 81251 - DNA, 15 bp, Homo sapiens
aaggtagattttccc

SEQ ID NO: 81252 - DNA, 15 bp, Homo sapiens
caaggtagattttcc

SEQ ID NO: 81253 - DNA, 15 bp, Homo sapiens
tcaaggtagattttc

SEQ ID NO: 81254 - DNA, 15 bp, Homo sapiens
atcaaggtagatttt

SEQ ID NO: 81255 - DNA, 15 bp, Homo sapiens
catcaaggtagattt

SEQ ID NO: 81256 - DNA, 15 bp, Homo sapiens
tcatcaaggtagatt

SEQ ID NO: 81257 - DNA, 15 bp, Homo sapiens
ttcatcaaggtagat

SEQ ID NO: 81258 - DNA, 15 bp, Homo sapiens
tttcatcaaggtaga

SEQ ID NO: 81259 - DNA, 15 bp, Homo sapiens
ttttcatcaaggtag

SEQ ID NO: 81260 - DNA, 15 bp, Homo sapiens
cttttcatcaaggta

SEQ ID NO: 81261 - DNA, 15 bp, Homo sapiens
tcttttcatcaaggt

SEQ ID NO: 81262 - DNA, 15 bp, Homo sapiens
atcttttcatcaagg

SEQ ID NO: 81263 - DNA, 15 bp, Homo sapiens
tatcttttcatcaag

SEQ ID NO: 81264 - DNA, 15 bp, Homo sapiens
ttatcttttcatcaa

SEQ ID NO: 81265 - DNA, 15 bp, Homo sapiens
tttatcttttcatca

SEQ ID NO: 81266 - DNA, 15 bp, Homo sapiens
ttttatcttttcatc

SEQ ID NO: 81267 - DNA, 15 bp, Homo sapiens
attttatcttttcat

SEQ ID NO: 81268 - DNA, 15 bp, Homo sapiens
tattttatcttttca

SEQ ID NO: 81269 - DNA, 15 bp, Homo sapiens
atattttatcttttc

SEQ ID NO: 81270 - DNA, 15 bp, Homo sapiens
aatattttatctttt

SEQ ID NO: 81271 - DNA, 15 bp, Homo sapiens
gaatattttatcttt

SEQ ID NO: 81272 - DNA, 15 bp, Homo sapiens
tgaatattttatctt

SEQ ID NO: 81273 - DNA, 15 bp, Homo sapiens
atgaatattttatct

SEQ ID NO: 81274 - DNA, 15 bp, Homo sapiens
tatgaatattttatc

SEQ ID NO: 81275 - DNA, 15 bp, Homo sapiens
ctatgaatattttat

SEQ ID NO: 81276 - DNA, 15 bp, Homo sapiens
actatgaatatttta

SEQ ID NO: 81277 - DNA, 15 bp, Homo sapiens
aactatgaatatttt

SEQ ID NO: 81278 - DNA, 15 bp, Homo sapiens
gaactatgaatattt

SEQ ID NO: 81279 - DNA, 15 bp, Homo sapiens
tgaactatgaatatt

SEQ ID NO: 81280 - DNA, 15 bp, Homo sapiens
gtgaactatgaatat

SEQ ID NO: 81281 - DNA, 15 bp, Homo sapiens
ggtgaactatgaata

SEQ ID NO: 81282 - DNA, 15 bp, Homo sapiens
tggtgaactatgaat

SEQ ID NO: 81283 - DNA, 15 bp, Homo sapiens
ctggtgaactatgaa

SEQ ID NO: 81284 - DNA, 15 bp, Homo sapiens
tctggtgaactatga

SEQ ID NO: 81285 - DNA, 15 bp, Homo sapiens
ttctggtgaactatg

SEQ ID NO: 81286 - DNA, 15 bp, Homo sapiens
tttctggtgaactat

SEQ ID NO: 81287 - DNA, 15 bp, Homo sapiens
gtttctggtgaacta

SEQ ID NO: 81288 - DNA, 15 bp, Homo sapiens
tgtttctggtgaact

SEQ ID NO: 81289 - DNA, 15 bp, Homo sapiens
gtgtttctggtgaac

SEQ ID NO: 81290 - DNA, 15 bp, Homo sapiens
agtgtttctggtgaa

SEQ ID NO: 81291 - DNA, 15 bp, Homo sapiens
aagtgtttctggtga

SEQ ID NO: 81292 - DNA, 15 bp, Homo sapiens
aaagtgtttctggtg

SEQ ID NO: 81293 - DNA, 15 bp, Homo sapiens
taaagtgtttctggt

SEQ ID NO: 81294 - DNA, 15 bp, Homo sapiens
ttaaagtgtttctgg

SEQ ID NO: 81295 - DNA, 15 bp, Homo sapiens
cttaaagtgtttctg

SEQ ID NO: 81296 - DNA, 15 bp, Homo sapiens
gcttaaagtgtttct

SEQ ID NO: 81297 - DNA, 15 bp, Homo sapiens
tgcttaaagtgtttc

SEQ ID NO: 81298 - DNA, 15 bp, Homo sapiens
ttgcttaaagtgttt

SEQ ID NO: 81299 - DNA, 15 bp, Homo sapiens
tttgcttaaagtgtt

SEQ ID NO: 81300 - DNA, 15 bp, Homo sapiens
ctttgcttaaagtgt

SEQ ID NO: 81301 - DNA, 15 bp, Homo sapiens
actttgcttaaagtg

SEQ ID NO: 81302 - DNA, 15 bp, Homo sapiens
aactttgcttaaagt

SEQ ID NO: 81303 - DNA, 15 bp, Homo sapiens
aaactttgcttaaag

SEQ ID NO: 81304 - DNA, 15 bp, Homo sapiens
gaaactttgcttaaa

SEQ ID NO: 81305 - DNA, 15 bp, Homo sapiens
agaaactttgcttaa

SEQ ID NO: 81306 - DNA, 15 bp, Homo sapiens
gagaaactttgctta

SEQ ID NO: 81307 - DNA, 15 bp, Homo sapiens
tgagaaactttgctt

SEQ ID NO: 81308 - DNA, 15 bp, Homo sapiens
gtgagaaactttgct

SEQ ID NO: 81309 - DNA, 15 bp, Homo sapiens
tgtgagaaactttgc

SEQ ID NO: 81310 - DNA, 15 bp, Homo sapiens
ttgtgagaaactttg

SEQ ID NO: 81311 - DNA, 15 bp, Homo sapiens
cttgtgagaaacttt

SEQ ID NO: 81312 - DNA, 15 bp, Homo sapiens
tcttgtgagaaactt

SEQ ID NO: 81313 - DNA, 15 bp, Homo sapiens
ttcttgtgagaaact

SEQ ID NO: 81314 - DNA, 15 bp, Homo sapiens
attcttgtgagaaac

SEQ ID NO: 81315 - DNA, 15 bp, Homo sapiens
gattcttgtgagaaa

SEQ ID NO: 81316 - DNA, 15 bp, Homo sapiens
tgattcttgtgagaa

SEQ ID NO: 81317 - DNA, 15 bp, Homo sapiens
ctgattcttgtgaga

SEQ ID NO: 81318 - DNA, 15 bp, Homo sapiens
gctgattcttgtgag

SEQ ID NO: 81319 - DNA, 15 bp, Homo sapiens
tgctgattcttgtga

SEQ ID NO: 81320 - DNA, 15 bp, Homo sapiens
ttgctgattcttgtg

SEQ ID NO: 81321 - DNA, 15 bp, Homo sapiens
attgctgattcttgt

SEQ ID NO: 81322 - DNA, 15 bp, Homo sapiens
tattgctgattcttg

SEQ ID NO: 81323 - DNA, 15 bp, Homo sapiens
ttattgctgattctt

SEQ ID NO: 81324 - DNA, 15 bp, Homo sapiens
gttattgctgattct

SEQ ID NO: 81325 - DNA, 15 bp, Homo sapiens
cgttattgctgattc

SEQ ID NO: 81326 - DNA, 15 bp, Homo sapiens
tcgttattgctgatt

SEQ ID NO: 81327 - DNA, 15 bp, Homo sapiens
gtcgttattgctgat

SEQ ID NO: 81328 - DNA, 15 bp, Homo sapiens
agtcgttattgctga

SEQ ID NO: 81329 - DNA, 15 bp, Homo sapiens
aagtcgttattgctg

SEQ ID NO: 81330 - DNA, 15 bp, Homo sapiens
caagtcgttattgct

SEQ ID NO: 81331 - DNA, 15 bp, Homo sapiens
acaagtcgttattgc

SEQ ID NO: 81332 - DNA, 15 bp, Homo sapiens
cacaagtcgttattg

SEQ ID NO: 81333 - DNA, 15 bp, Homo sapiens
gcacaagtcgttatt

SEQ ID NO: 81334 - DNA, 15 bp, Homo sapiens
ggcacaagtcgttat

SEQ ID NO: 81335 - DNA, 15 bp, Homo sapiens
tggcacaagtcgtta

SEQ ID NO: 81336 - DNA, 15 bp, Homo sapiens
gtggcacaagtcgtt

SEQ ID NO: 81337 - DNA, 15 bp, Homo sapiens
agtggcacaagtcgt

SEQ ID NO: 81338 - DNA, 15 bp, Homo sapiens
cagtggcacaagtcg

SEQ ID NO: 81339 - DNA, 15 bp, Homo sapiens
gcagtggcacaagtc

SEQ ID NO: 81340 - DNA, 15 bp, Homo sapiens
agcagtggcacaagt

SEQ ID NO: 81341 - DNA, 15 bp, Homo sapiens
aagcagtggcacaag

SEQ ID NO: 81342 - DNA, 15 bp, Homo sapiens
taagcagtggcacaa

SEQ ID NO: 81343 - DNA, 15 bp, Homo sapiens
ttaagcagtggcaca

SEQ ID NO: 81344 - DNA, 15 bp, Homo sapiens
attaagcagtggcac

SEQ ID NO: 81345 - DNA, 15 bp, Homo sapiens
cattaagcagtggca

SEQ ID NO: 81346 - DNA, 15 bp, Homo sapiens
acattaagcagtggc

SEQ ID NO: 81347 - DNA, 15 bp, Homo sapiens
tacattaagcagtgg

SEQ ID NO: 81348 - DNA, 15 bp, Homo sapiens
atacattaagcagtg

SEQ ID NO: 81349 - DNA, 15 bp, Homo sapiens
gatacattaagcagt

SEQ ID NO: 81350 - DNA, 15 bp, Homo sapiens
cgatacattaagcag

SEQ ID NO: 81351 - DNA, 15 bp, Homo sapiens
tcgatacattaagca

SEQ ID NO: 81352 - DNA, 15 bp, Homo sapiens
ctcgatacattaagc

SEQ ID NO: 81353 - DNA, 15 bp, Homo sapiens
tctcgatacattaag

SEQ ID NO: 81354 - DNA, 15 bp, Homo sapiens
ttctcgatacattaa

SEQ ID NO: 81355 - DNA, 15 bp, Homo sapiens
cttctcgatacatta

SEQ ID NO: 81356 - DNA, 15 bp, Homo sapiens
gcttctcgatacatt

SEQ ID NO: 81357 - DNA, 15 bp, Homo sapiens
agcttctcgatacat

SEQ ID NO: 81358 - DNA, 15 bp, Homo sapiens
gagcttctcgataca

SEQ ID NO: 81359 - DNA, 15 bp, Homo sapiens
agagcttctcgatac

SEQ ID NO: 81360 - DNA, 15 bp, Homo sapiens
cagagcttctcgata

SEQ ID NO: 81361 - DNA, 15 bp, Homo sapiens
acagagcttctcgat

SEQ ID NO: 81362 - DNA, 15 bp, Homo sapiens
cacagagcttctcga

SEQ ID NO: 81363 - DNA, 15 bp, Homo sapiens
ccacagagcttctcg

SEQ ID NO: 81364 - DNA, 15 bp, Homo sapiens
cccacagagcttctc

SEQ ID NO: 81365 - DNA, 15 bp, Homo sapiens
ccccacagagcttct

SEQ ID NO: 81366 - DNA, 15 bp, Homo sapiens
tccccacagagcttc

SEQ ID NO: 81367 - DNA, 15 bp, Homo sapiens
ctccccacagagctt

SEQ ID NO: 81368 - DNA, 15 bp, Homo sapiens
cctccccacagagct

SEQ ID NO: 81369 - DNA, 15 bp, Homo sapiens
ccctccccacagagc

SEQ ID NO: 81370 - DNA, 15 bp, Homo sapiens
accctccccacagag

SEQ ID NO: 81371 - DNA, 15 bp, Homo sapiens
taccctccccacaga

SEQ ID NO: 81372 - DNA, 15 bp, Homo sapiens
gtaccctccccacag

SEQ ID NO: 81373 - DNA, 15 bp, Homo sapiens
agtaccctccccaca

SEQ ID NO: 81374 - DNA, 15 bp, Homo sapiens
tagtaccctccccac

SEQ ID NO: 81375 - DNA, 15 bp, Homo sapiens
ctagtaccctcccca

SEQ ID NO: 81376 - DNA, 15 bp, Homo sapiens
actagtaccctcccc

SEQ ID NO: 81377 - DNA, 15 bp, Homo sapiens
aactagtaccctccc

SEQ ID NO: 81378 - DNA, 15 bp, Homo sapiens
taactagtaccctcc

SEQ ID NO: 81379 - DNA, 15 bp, Homo sapiens
ttaactagtaccctc

SEQ ID NO: 81380 - DNA, 15 bp, Homo sapiens
cttaactagtaccct

SEQ ID NO: 81381 - DNA, 15 bp, Homo sapiens
tcttaactagtaccc

SEQ ID NO: 81382 - DNA, 15 bp, Homo sapiens
ttcttaactagtacc

SEQ ID NO: 81383 - DNA, 15 bp, Homo sapiens
cttcttaactagtac

SEQ ID NO: 81384 - DNA, 15 bp, Homo sapiens
tcttcttaactagta

SEQ ID NO: 81385 - DNA, 15 bp, Homo sapiens
gtcttcttaactagt

SEQ ID NO: 81386 - DNA, 15 bp, Homo sapiens
tgtcttcttaactag

SEQ ID NO: 81387 - DNA, 15 bp, Homo sapiens
ctgtcttcttaacta

SEQ ID NO: 81388 - DNA, 15 bp, Homo sapiens
actgtcttcttaact

SEQ ID NO: 81389 - DNA, 15 bp, Homo sapiens
gactgtcttcttaac

SEQ ID NO: 81390 - DNA, 15 bp, Homo sapiens
agactgtcttcttaa

SEQ ID NO: 81391 - DNA, 15 bp, Homo sapiens
aagactgtcttctta

SEQ ID NO: 81392 - DNA, 15 bp, Homo sapiens
caagactgtcttctt

SEQ ID NO: 81393 - DNA, 15 bp, Homo sapiens
ccaagactgtcttct

SEQ ID NO: 81394 - DNA, 15 bp, Homo sapiens
accaagactgtcttc

SEQ ID NO: 81395 - DNA, 15 bp, Homo sapiens
aaccaagactgtctt

SEQ ID NO: 81396 - DNA, 15 bp, Homo sapiens
aaaccaagactgtct

SEQ ID NO: 81397 - DNA, 15 bp, Homo sapiens
caaaccaagactgtc

SEQ ID NO: 81398 - DNA, 15 bp, Homo sapiens
tcaaaccaagactgt

SEQ ID NO: 81399 - DNA, 15 bp, Homo sapiens
ttcaaaccaagactg

SEQ ID NO: 81400 - DNA, 15 bp, Homo sapiens
attcaaaccaagact

SEQ ID NO: 81401 - DNA, 15 bp, Homo sapiens
gattcaaaccaagac

SEQ ID NO: 81402 - DNA, 15 bp, Homo sapiens
ggattcaaaccaaga

SEQ ID NO: 81403 - DNA, 15 bp, Homo sapiens
gggattcaaaccaag

SEQ ID NO: 81404 - DNA, 15 bp, Homo sapiens
tgggattcaaaccaa

SEQ ID NO: 81405 - DNA, 15 bp, Homo sapiens
ctgggattcaaacca

SEQ ID NO: 81406 - DNA, 15 bp, Homo sapiens
gctgggattcaaacc

SEQ ID NO: 81407 - DNA, 15 bp, Homo sapiens
ggctgggattcaaac

SEQ ID NO: 81408 - DNA, 15 bp, Homo sapiens
aggctgggattcaaa

SEQ ID NO: 81409 - DNA, 15 bp, Homo sapiens
gaggctgggattcaa

SEQ ID NO: 81410 - DNA, 15 bp, Homo sapiens
tgaggctgggattca

SEQ ID NO: 81411 - DNA, 15 bp, Homo sapiens
gtgaggctgggattc

SEQ ID NO: 81412 - DNA, 15 bp, Homo sapiens
ggtgaggctgggatt

SEQ ID NO: 81413 - DNA, 15 bp, Homo sapiens
gggtgaggctgggat

SEQ ID NO: 81414 - DNA, 15 bp, Homo sapiens
agggtgaggctggga

SEQ ID NO: 81415 - DNA, 15 bp, Homo sapiens
aagggtgaggctggg

SEQ ID NO: 81416 - DNA, 15 bp, Homo sapiens
aaagggtgaggctgg

SEQ ID NO: 81417 - DNA, 15 bp, Homo sapiens
caaagggtgaggctg

SEQ ID NO: 81418 - DNA, 15 bp, Homo sapiens
acaaagggtgaggct

SEQ ID NO: 81419 - DNA, 15 bp, Homo sapiens
aacaaagggtgaggc

SEQ ID NO: 81420 - DNA, 15 bp, Homo sapiens
taacaaagggtgagg

SEQ ID NO: 81421 - DNA, 15 bp, Homo sapiens
ctaacaaagggtgag

SEQ ID NO: 81422 - DNA, 15 bp, Homo sapiens
gctaacaaagggtga

SEQ ID NO: 81423 - DNA, 15 bp, Homo sapiens
agctaacaaagggtg

SEQ ID NO: 81424 - DNA, 15 bp, Homo sapiens
aagctaacaaagggt

SEQ ID NO: 81425 - DNA, 15 bp, Homo sapiens
aaagctaacaaaggg

SEQ ID NO: 81426 - DNA, 15 bp, Homo sapiens
caaagctaacaaagg

SEQ ID NO: 81427 - DNA, 15 bp, Homo sapiens
acaaagctaacaaag

SEQ ID NO: 81428 - DNA, 15 bp, Homo sapiens
cacaaagctaacaaa

SEQ ID NO: 81429 - DNA, 15 bp, Homo sapiens
tcacaaagctaacaa

SEQ ID NO: 81430 - DNA, 15 bp, Homo sapiens
gtcacaaagctaaca

SEQ ID NO: 81431 - DNA, 15 bp, Homo sapiens
tgtcacaaagctaac

SEQ ID NO: 81432 - DNA, 15 bp, Homo sapiens
atgtcacaaagctaa

SEQ ID NO: 81433 - DNA, 15 bp, Homo sapiens
catgtcacaaagcta

SEQ ID NO: 81434 - DNA, 15 bp, Homo sapiens
ccatgtcacaaagct

SEQ ID NO: 81435 - DNA, 15 bp, Homo sapiens
cccatgtcacaaagc

SEQ ID NO: 81436 - DNA, 15 bp, Homo sapiens
tcccatgtcacaaag

SEQ ID NO: 81437 - DNA, 15 bp, Homo sapiens
gtcccatgtcacaaa

SEQ ID NO: 81438 - DNA, 15 bp, Homo sapiens
tgtcccatgtcacaa

SEQ ID NO: 81439 - DNA, 15 bp, Homo sapiens
ctgtcccatgtcaca

SEQ ID NO: 81440 - DNA, 15 bp, Homo sapiens
actgtcccatgtcac

SEQ ID NO: 81441 - DNA, 15 bp, Homo sapiens
aactgtcccatgtca

SEQ ID NO: 81442 - DNA, 15 bp, Homo sapiens
taactgtcccatgtc

SEQ ID NO: 81443 - DNA, 15 bp, Homo sapiens
gtaactgtcccatgt

SEQ ID NO: 81444 - DNA, 15 bp, Homo sapiens
agtaactgtcccatg

SEQ ID NO: 81445 - DNA, 15 bp, Homo sapiens
cagtaactgtcccat

SEQ ID NO: 81446 - DNA, 15 bp, Homo sapiens
tcagtaactgtccca

SEQ ID NO: 81447 - DNA, 15 bp, Homo sapiens
ttcagtaactgtccc

SEQ ID NO: 81448 - DNA, 15 bp, Homo sapiens
tttcagtaactgtcc

SEQ ID NO: 81449 - DNA, 15 bp, Homo sapiens
ttttcagtaactgtc

SEQ ID NO: 81450 - DNA, 15 bp, Homo sapiens
gttttcagtaactgt

SEQ ID NO: 81451 - DNA, 15 bp, Homo sapiens
ggttttcagtaactg

SEQ ID NO: 81452 - DNA, 15 bp, Homo sapiens
aggttttcagtaact

SEQ ID NO: 81453 - DNA, 15 bp, Homo sapiens
gaggttttcagtaac

SEQ ID NO: 81454 - DNA, 15 bp, Homo sapiens
agaggttttcagtaa

SEQ ID NO: 81455 - DNA, 15 bp, Homo sapiens
cagaggttttcagta

SEQ ID NO: 81456 - DNA, 15 bp, Homo sapiens
acagaggttttcagt

SEQ ID NO: 81457 - DNA, 15 bp, Homo sapiens
cacagaggttttcag

SEQ ID NO: 81458 - DNA, 15 bp, Homo sapiens
tcacagaggttttca

SEQ ID NO: 81459 - DNA, 15 bp, Homo sapiens
ctcacagaggttttc

SEQ ID NO: 81460 - DNA, 15 bp, Homo sapiens
gctcacagaggtttt

SEQ ID NO: 81461 - DNA, 15 bp, Homo sapiens
agctcacagaggttt

SEQ ID NO: 81462 - DNA, 15 bp, Homo sapiens
gagctcacagaggtt

SEQ ID NO: 81463 - DNA, 15 bp, Homo sapiens
tgagctcacagaggt

SEQ ID NO: 81464 - DNA, 15 bp, Homo sapiens
ctgagctcacagagg

SEQ ID NO: 81465 - DNA, 15 bp, Homo sapiens
actgagctcacagag

SEQ ID NO: 81466 - DNA, 15 bp, Homo sapiens
tactgagctcacaga

SEQ ID NO: 81467 - DNA, 15 bp, Homo sapiens
gtactgagctcacag

SEQ ID NO: 81468 - DNA, 15 bp, Homo sapiens
ggtactgagctcaca

SEQ ID NO: 81469 - DNA, 15 bp, Homo sapiens
aggtactgagctcac

SEQ ID NO: 81470 - DNA, 15 bp, Homo sapiens
aaggtactgagctca

SEQ ID NO: 81471 - DNA, 15 bp, Homo sapiens
gaaggtactgagctc

SEQ ID NO: 81472 - DNA, 15 bp, Homo sapiens
tgaaggtactgagct

SEQ ID NO: 81473 - DNA, 15 bp, Homo sapiens
atgaaggtactgagc

SEQ ID NO: 81474 - DNA, 15 bp, Homo sapiens
gatgaaggtactgag

SEQ ID NO: 81475 - DNA, 15 bp, Homo sapiens
agatgaaggtactga

SEQ ID NO: 81476 - DNA, 15 bp, Homo sapiens
gagatgaaggtactg

SEQ ID NO: 81477 - DNA, 15 bp, Homo sapiens
agagatgaaggtact

SEQ ID NO: 81478 - DNA, 15 bp, Homo sapiens
tagagatgaaggtac

SEQ ID NO: 81479 - DNA, 15 bp, Homo sapiens
ttagagatgaaggta

SEQ ID NO: 81480 - DNA, 15 bp, Homo sapiens
tttagagatgaaggt

SEQ ID NO: 81481 - DNA, 15 bp, Homo sapiens
ctttagagatgaagg

SEQ ID NO: 81482 - DNA, 15 bp, Homo sapiens
cctttagagatgaag

SEQ ID NO: 81483 - DNA, 15 bp, Homo sapiens
ccctttagagatgaa

SEQ ID NO: 81484 - DNA, 15 bp, Homo sapiens
cccctttagagatga

SEQ ID NO: 81485 - DNA, 15 bp, Homo sapiens
tcccctttagagatg

SEQ ID NO: 81486 - DNA, 15 bp, Homo sapiens
atcccctttagagat

SEQ ID NO: 81487 - DNA, 15 bp, Homo sapiens
tatcccctttagaga

SEQ ID NO: 81488 - DNA, 15 bp, Homo sapiens
ttatcccctttagag

SEQ ID NO: 81489 - DNA, 15 bp, Homo sapiens
attatcccctttaga

SEQ ID NO: 81490 - DNA, 15 bp, Homo sapiens
tattatcccctttag

SEQ ID NO: 81491 - DNA, 15 bp, Homo sapiens
ttattatccccttta

SEQ ID NO: 81492 - DNA, 15 bp, Homo sapiens
attattatccccttt

SEQ ID NO: 81493 - DNA, 15 bp, Homo sapiens
tattattatcccctt

SEQ ID NO: 81494 - DNA, 15 bp, Homo sapiens
ctattattatcccct

SEQ ID NO: 81495 - DNA, 15 bp, Homo sapiens
actattattatcccc

SEQ ID NO: 81496 - DNA, 15 bp, Homo sapiens
cactattattatccc

SEQ ID NO: 81497 - DNA, 15 bp, Homo sapiens
acactattattatcc

SEQ ID NO: 81498 - DNA, 15 bp, Homo sapiens
tacactattattatc

SEQ ID NO: 81499 - DNA, 15 bp, Homo sapiens
atacactattattat

SEQ ID NO: 81500 - DNA, 15 bp, Homo sapiens
tatacactattatta

SEQ ID NO: 81501 - DNA, 15 bp, Homo sapiens
gtatacactattatt

SEQ ID NO: 81502 - DNA, 15 bp, Homo sapiens
agtatacactattat

SEQ ID NO: 81503 - DNA, 15 bp, Homo sapiens
aagtatacactatta

SEQ ID NO: 81504 - DNA, 15 bp, Homo sapiens
aaagtatacactatt

SEQ ID NO: 81505 - DNA, 15 bp, Homo sapiens
aaaagtatacactat

SEQ ID NO: 81506 - DNA, 15 bp, Homo sapiens
aaaaagtatacacta

SEQ ID NO: 81507 - DNA, 15 bp, Homo sapiens
taaaaagtatacact

SEQ ID NO: 81508 - DNA, 15 bp, Homo sapiens
ctaaaaagtatacac

SEQ ID NO: 81509 - DNA, 15 bp, Homo sapiens
cctaaaaagtataca

SEQ ID NO: 81510 - DNA, 15 bp, Homo sapiens
ccctaaaaagtatac

SEQ ID NO: 81511 - DNA, 15 bp, Homo sapiens
accctaaaaagtata

SEQ ID NO: 81512 - DNA, 15 bp, Homo sapiens
caccctaaaaagtat

SEQ ID NO: 81513 - DNA, 15 bp, Homo sapiens
gcaccctaaaaagta

SEQ ID NO: 81514 - DNA, 15 bp, Homo sapiens
agcaccctaaaaagt

SEQ ID NO: 81515 - DNA, 15 bp, Homo sapiens
cagcaccctaaaaag

SEQ ID NO: 81516 - DNA, 15 bp, Homo sapiens
ccagcaccctaaaaa

SEQ ID NO: 81517 - DNA, 15 bp, Homo sapiens
accagcaccctaaaa

SEQ ID NO: 81518 - DNA, 15 bp, Homo sapiens
caccagcaccctaaa

SEQ ID NO: 81519 - DNA, 15 bp, Homo sapiens
tcaccagcaccctaa

SEQ ID NO: 81520 - DNA, 15 bp, Homo sapiens
ctcaccagcacccta

SEQ ID NO: 81521 - DNA, 15 bp, Homo sapiens
cctcaccagcaccct

SEQ ID NO: 81522 - DNA, 15 bp, Homo sapiens
tcctcaccagcaccc

SEQ ID NO: 81523 - DNA, 15 bp, Homo sapiens
atcctcaccagcacc

SEQ ID NO: 81524 - DNA, 15 bp, Homo sapiens
aatcctcaccagcac

SEQ ID NO: 81525 - DNA, 15 bp, Homo sapiens
gaatcctcaccagca

SEQ ID NO: 81526 - DNA, 15 bp, Homo sapiens
ggaatcctcaccagc

SEQ ID NO: 81527 - DNA, 15 bp, Homo sapiens
aggaatcctcaccag

SEQ ID NO: 81528 - DNA, 15 bp, Homo sapiens
aaggaatcctcacca

SEQ ID NO: 81529 - DNA, 15 bp, Homo sapiens
caaggaatcctcacc

SEQ ID NO: 81530 - DNA, 15 bp, Homo sapiens
tcaaggaatcctcac

SEQ ID NO: 81531 - DNA, 15 bp, Homo sapiens
ctcaaggaatcctca

SEQ ID NO: 81532 - DNA, 15 bp, Homo sapiens
actcaaggaatcctc

SEQ ID NO: 81533 - DNA, 15 bp, Homo sapiens
aactcaaggaatcct

SEQ ID NO: 81534 - DNA, 15 bp, Homo sapiens
taactcaaggaatcc

SEQ ID NO: 81535 - DNA, 15 bp, Homo sapiens
ttaactcaaggaatc

SEQ ID NO: 81536 - DNA, 15 bp, Homo sapiens
attaactcaaggaat

SEQ ID NO: 81537 - DNA, 15 bp, Homo sapiens
tattaactcaaggaa

SEQ ID NO: 81538 - DNA, 15 bp, Homo sapiens
ttattaactcaagga

SEQ ID NO: 81539 - DNA, 15 bp, Homo sapiens
attattaactcaagg

SEQ ID NO: 81540 - DNA, 15 bp, Homo sapiens
tattattaactcaag

SEQ ID NO: 81541 - DNA, 15 bp, Homo sapiens
ctattattaactcaa

SEQ ID NO: 81542 - DNA, 15 bp, Homo sapiens
tctattattaactca

SEQ ID NO: 81543 - DNA, 15 bp, Homo sapiens
gtctattattaactc

SEQ ID NO: 81544 - DNA, 15 bp, Homo sapiens
tgtctattattaact

SEQ ID NO: 81545 - DNA, 15 bp, Homo sapiens
atgtctattattaac

SEQ ID NO: 81546 - DNA, 15 bp, Homo sapiens
tatgtctattattaa

SEQ ID NO: 81547 - DNA, 15 bp, Homo sapiens
ttatgtctattatta

SEQ ID NO: 81548 - DNA, 15 bp, Homo sapiens
tttatgtctattatt

SEQ ID NO: 81549 - DNA, 15 bp, Homo sapiens
ttttatgtctattat

SEQ ID NO: 81550 - DNA, 15 bp, Homo sapiens
gttttatgtctatta

SEQ ID NO: 81551 - DNA, 15 bp, Homo sapiens
tgttttatgtctatt

SEQ ID NO: 81552 - DNA, 15 bp, Homo sapiens
gtgttttatgtctat

SEQ ID NO: 81553 - DNA, 15 bp, Homo sapiens
agtgttttatgtcta

SEQ ID NO: 81554 - DNA, 15 bp, Homo sapiens
aagtgttttatgtct

SEQ ID NO: 81555 - DNA, 15 bp, Homo sapiens
taagtgttttatgtc

SEQ ID NO: 81556 - DNA, 15 bp, Homo sapiens
ctaagtgttttatgt

SEQ ID NO: 81557 - DNA, 15 bp, Homo sapiens
tctaagtgttttatg

SEQ ID NO: 81558 - DNA, 15 bp, Homo sapiens
ttctaagtgttttat

SEQ ID NO: 81559 - DNA, 15 bp, Homo sapiens
tttctaagtgtttta

SEQ ID NO: 81560 - DNA, 15 bp, Homo sapiens
ctttctaagtgtttt

SEQ ID NO: 81561 - DNA, 15 bp, Homo sapiens
cctttctaagtgttt

SEQ ID NO: 81562 - DNA, 15 bp, Homo sapiens
ccctttctaagtgtt

SEQ ID NO: 81563 - DNA, 15 bp, Homo sapiens
cccctttctaagtgt

SEQ ID NO: 81564 - DNA, 15 bp, Homo sapiens
gcccctttctaagtg

SEQ ID NO: 81565 - DNA, 15 bp, Homo sapiens
ggcccctttctaagt

SEQ ID NO: 81566 - DNA, 15 bp, Homo sapiens
cggcccctttctaag

SEQ ID NO: 81567 - DNA, 15 bp, Homo sapiens
ccggcccctttctaa

SEQ ID NO: 81568 - DNA, 15 bp, Homo sapiens
cccggcccctttcta

SEQ ID NO: 81569 - DNA, 15 bp, Homo sapiens
acccggcccctttct

SEQ ID NO: 81570 - DNA, 15 bp, Homo sapiens
tacccggcccctttc

SEQ ID NO: 81571 - DNA, 15 bp, Homo sapiens
ctacccggccccttt

SEQ ID NO: 81572 - DNA, 15 bp, Homo sapiens
tctacccggcccctt

SEQ ID NO: 81573 - DNA, 15 bp, Homo sapiens
ttctacccggcccct

SEQ ID NO: 81574 - DNA, 15 bp, Homo sapiens
cttctacccggcccc

SEQ ID NO: 81575 - DNA, 15 bp, Homo sapiens
ccttctacccggccc

SEQ ID NO: 81576 - DNA, 15 bp, Homo sapiens
gccttctacccggcc

SEQ ID NO: 81577 - DNA, 15 bp, Homo sapiens
ggccttctacccggc

SEQ ID NO: 81578 - DNA, 15 bp, Homo sapiens
tggccttctacccgg

SEQ ID NO: 81579 - DNA, 15 bp, Homo sapiens
ctggccttctacccg

SEQ ID NO: 81580 - DNA, 15 bp, Homo sapiens
gctggccttctaccc

SEQ ID NO: 81581 - DNA, 15 bp, Homo sapiens
tgctggccttctacc

SEQ ID NO: 81582 - DNA, 15 bp, Homo sapiens
ttgctggccttctac

SEQ ID NO: 81583 - DNA, 15 bp, Homo sapiens
attgctggccttcta

SEQ ID NO: 81584 - DNA, 15 bp, Homo sapiens
gattgctggccttct

SEQ ID NO: 81585 - DNA, 15 bp, Homo sapiens
tgattgctggccttc

SEQ ID NO: 81586 - DNA, 15 bp, Homo sapiens
ctgattgctggcctt

SEQ ID NO: 81587 - DNA, 15 bp, Homo sapiens
actgattgctggcct

SEQ ID NO: 81588 - DNA, 15 bp, Homo sapiens
cactgattgctggcc

SEQ ID NO: 81589 - DNA, 15 bp, Homo sapiens
tcactgattgctggc

SEQ ID NO: 81590 - DNA, 15 bp, Homo sapiens
atcactgattgctgg

SEQ ID NO: 81591 - DNA, 15 bp, Homo sapiens
gatcactgattgctg

SEQ ID NO: 81592 - DNA, 15 bp, Homo sapiens
cgatcactgattgct

SEQ ID NO: 81593 - DNA, 15 bp, Homo sapiens
acgatcactgattgc

SEQ ID NO: 81594 - DNA, 15 bp, Homo sapiens
cacgatcactgattg

SEQ ID NO: 81595 - DNA, 15 bp, Homo sapiens
tcacgatcactgatt

SEQ ID NO: 81596 - DNA, 15 bp, Homo sapiens
gtcacgatcactgat

SEQ ID NO: 81597 - DNA, 15 bp, Homo sapiens
agtcacgatcactga

SEQ ID NO: 81598 - DNA, 15 bp, Homo sapiens
gagtcacgatcactg

SEQ ID NO: 81599 - DNA, 15 bp, Homo sapiens
ggagtcacgatcact

SEQ ID NO: 81600 - DNA, 15 bp, Homo sapiens
aggagtcacgatcac

SEQ ID NO: 81601 - DNA, 15 bp, Homo sapiens
gaggagtcacgatca

SEQ ID NO: 81602 - DNA, 15 bp, Homo sapiens
agaggagtcacgatc

SEQ ID NO: 81603 - DNA, 15 bp, Homo sapiens
aagaggagtcacgat

SEQ ID NO: 81604 - DNA, 15 bp, Homo sapiens
caagaggagtcacga

SEQ ID NO: 81605 - DNA, 15 bp, Homo sapiens
acaagaggagtcacg

SEQ ID NO: 81606 - DNA, 15 bp, Homo sapiens
aacaagaggagtcac

SEQ ID NO: 81607 - DNA, 15 bp, Homo sapiens
gaacaagaggagtca

SEQ ID NO: 81608 - DNA, 15 bp, Homo sapiens
ggaacaagaggagtc

SEQ ID NO: 81609 - DNA, 15 bp, Homo sapiens
aggaacaagaggagt

SEQ ID NO: 81610 - DNA, 15 bp, Homo sapiens
gaggaacaagaggag

SEQ ID NO: 81611 - DNA, 15 bp, Homo sapiens
ggaggaacaagagga

SEQ ID NO: 81612 - DNA, 15 bp, Homo sapiens
aggaggaacaagagg

SEQ ID NO: 81613 - DNA, 15 bp, Homo sapiens
aaggaggaacaagag

SEQ ID NO: 81614 - DNA, 15 bp, Homo sapiens
caaggaggaacaaga

SEQ ID NO: 81615 - DNA, 15 bp, Homo sapiens
gcaaggaggaacaag

SEQ ID NO: 81616 - DNA, 15 bp, Homo sapiens
agcaaggaggaacaa

SEQ ID NO: 81617 - DNA, 15 bp, Homo sapiens
cagcaaggaggaaca

SEQ ID NO: 81618 - DNA, 15 bp, Homo sapiens
acagcaaggaggaac

SEQ ID NO: 81619 - DNA, 15 bp, Homo sapiens
cacagcaaggaggaa

SEQ ID NO: 81620 - DNA, 15 bp, Homo sapiens
ccacagcaaggagga

SEQ ID NO: 81621 - DNA, 15 bp, Homo sapiens
accacagcaaggagg

SEQ ID NO: 81622 - DNA, 15 bp, Homo sapiens
aaccacagcaaggag

SEQ ID NO: 81623 - DNA, 15 bp, Homo sapiens
aaaccacagcaagga

SEQ ID NO: 81624 - DNA, 15 bp, Homo sapiens
aaaaccacagcaagg

SEQ ID NO: 81625 - DNA, 15 bp, Homo sapiens
caaaaccacagcaag

SEQ ID NO: 81626 - DNA, 15 bp, Homo sapiens
tcaaaaccacagcaa

SEQ ID NO: 81627 - DNA, 15 bp, Homo sapiens
gtcaaaaccacagca

SEQ ID NO: 81628 - DNA, 15 bp, Homo sapiens
ggtcaaaaccacagc

SEQ ID NO: 81629 - DNA, 15 bp, Homo sapiens
tggtcaaaaccacag

SEQ ID NO: 81630 - DNA, 15 bp, Homo sapiens
ttggtcaaaaccaca

SEQ ID NO: 81631 - DNA, 15 bp, Homo sapiens
gttggtcaaaaccac

SEQ ID NO: 81632 - DNA, 15 bp, Homo sapiens
ggttggtcaaaacca

SEQ ID NO: 81633 - DNA, 15 bp, Homo sapiens
aggttggtcaaaacc

SEQ ID NO: 81634 - DNA, 15 bp, Homo sapiens
aaggttggtcaaaac

SEQ ID NO: 81635 - DNA, 15 bp, Homo sapiens
gaaggttggtcaaaa

SEQ ID NO: 81636 - DNA, 15 bp, Homo sapiens
agaaggttggtcaaa

SEQ ID NO: 81637 - DNA, 15 bp, Homo sapiens
gagaaggttggtcaa

SEQ ID NO: 81638 - DNA, 15 bp, Homo sapiens
tgagaaggttggtca

SEQ ID NO: 81639 - DNA, 15 bp, Homo sapiens
ttgagaaggttggtc

SEQ ID NO: 81640 - DNA, 15 bp, Homo sapiens
gttgagaaggttggt

SEQ ID NO: 81641 - DNA, 15 bp, Homo sapiens
tgttgagaaggttgg

SEQ ID NO: 81642 - DNA, 15 bp, Homo sapiens
gtgttgagaaggttg

SEQ ID NO: 81643 - DNA, 15 bp, Homo sapiens
ggtgttgagaaggtt

SEQ ID NO: 81644 - DNA, 15 bp, Homo sapiens
aggtgttgagaaggt

SEQ ID NO: 81645 - DNA, 15 bp, Homo sapiens
gaggtgttgagaagg

SEQ ID NO: 81646 - DNA, 15 bp, Homo sapiens
agaggtgttgagaag

SEQ ID NO: 81647 - DNA, 15 bp, Homo sapiens
gagaggtgttgagaa

SEQ ID NO: 81648 - DNA, 15 bp, Homo sapiens
tgagaggtgttgaga

SEQ ID NO: 81649 - DNA, 15 bp, Homo sapiens
ttgagaggtgttgag

SEQ ID NO: 81650 - DNA, 15 bp, Homo sapiens
tttgagaggtgttga

SEQ ID NO: 81651 - DNA, 15 bp, Homo sapiens
gtttgagaggtgttg

SEQ ID NO: 81652 - DNA, 15 bp, Homo sapiens
ggtttgagaggtgtt

SEQ ID NO: 81653 - DNA, 15 bp, Homo sapiens
aggtttgagaggtgt

SEQ ID NO: 81654 - DNA, 15 bp, Homo sapiens
caggtttgagaggtg

SEQ ID NO: 81655 - DNA, 15 bp, Homo sapiens
acaggtttgagaggt

SEQ ID NO: 81656 - DNA, 15 bp, Homo sapiens
gacaggtttgagagg

SEQ ID NO: 81657 - DNA, 15 bp, Homo sapiens
ggacaggtttgagag

SEQ ID NO: 81658 - DNA, 15 bp, Homo sapiens
aggacaggtttgaga

SEQ ID NO: 81659 - DNA, 15 bp, Homo sapiens
aaggacaggtttgag

SEQ ID NO: 81660 - DNA, 15 bp, Homo sapiens
aaaggacaggtttga

SEQ ID NO: 81661 - DNA, 15 bp, Homo sapiens
gaaaggacaggtttg

SEQ ID NO: 81662 - DNA, 15 bp, Homo sapiens
cgaaaggacaggttt

SEQ ID NO: 81663 - DNA, 15 bp, Homo sapiens
acgaaaggacaggtt

SEQ ID NO: 81664 - DNA, 15 bp, Homo sapiens
gacgaaaggacaggt

SEQ ID NO: 81665 - DNA, 15 bp, Homo sapiens
agacgaaaggacagg

SEQ ID NO: 81666 - DNA, 15 bp, Homo sapiens
aagacgaaaggacag

SEQ ID NO: 81667 - DNA, 15 bp, Homo sapiens
gaagacgaaaggaca

SEQ ID NO: 81668 - DNA, 15 bp, Homo sapiens
ggaagacgaaaggac

SEQ ID NO: 81669 - DNA, 15 bp, Homo sapiens
aggaagacgaaagga

SEQ ID NO: 81670 - DNA, 15 bp, Homo sapiens
aaggaagacgaaagg

SEQ ID NO: 81671 - DNA, 15 bp, Homo sapiens
gaaggaagacgaaag

SEQ ID NO: 81672 - DNA, 15 bp, Homo sapiens
ggaaggaagacgaaa

SEQ ID NO: 81673 - DNA, 15 bp, Homo sapiens
gggaaggaagacgaa

SEQ ID NO: 81674 - DNA, 15 bp, Homo sapiens
tgggaaggaagacga

SEQ ID NO: 81675 - DNA, 15 bp, Homo sapiens
gtgggaaggaagacg

SEQ ID NO: 81676 - DNA, 15 bp, Homo sapiens
agtgggaaggaagac

SEQ ID NO: 81677 - DNA, 15 bp, Homo sapiens
cagtgggaaggaaga

SEQ ID NO: 81678 - DNA, 15 bp, Homo sapiens
acagtgggaaggaag

SEQ ID NO: 81679 - DNA, 15 bp, Homo sapiens
aacagtgggaaggaa

SEQ ID NO: 81680 - DNA, 15 bp, Homo sapiens
taacagtgggaagga

SEQ ID NO: 81681 - DNA, 15 bp, Homo sapiens
gtaacagtgggaagg

SEQ ID NO: 81682 - DNA, 15 bp, Homo sapiens
agtaacagtgggaag

SEQ ID NO: 81683 - DNA, 15 bp, Homo sapiens
tagtaacagtgggaa

SEQ ID NO: 81684 - DNA, 15 bp, Homo sapiens
atagtaacagtggga

SEQ ID NO: 81685 - DNA, 15 bp, Homo sapiens
gatagtaacagtggg

SEQ ID NO: 81686 - DNA, 15 bp, Homo sapiens
agatagtaacagtgg

SEQ ID NO: 81687 - DNA, 15 bp, Homo sapiens
aagatagtaacagtg

SEQ ID NO: 81688 - DNA, 15 bp, Homo sapiens
taagatagtaacagt

SEQ ID NO: 81689 - DNA, 15 bp, Homo sapiens
ctaagatagtaacag

SEQ ID NO: 81690 - DNA, 15 bp, Homo sapiens
actaagatagtaaca

SEQ ID NO: 81691 - DNA, 15 bp, Homo sapiens
aactaagatagtaac

SEQ ID NO: 81692 - DNA, 15 bp, Homo sapiens
caactaagatagtaa

SEQ ID NO: 81693 - DNA, 15 bp, Homo sapiens
acaactaagatagta

SEQ ID NO: 81694 - DNA, 15 bp, Homo sapiens
cacaactaagatagt

SEQ ID NO: 81695 - DNA, 15 bp, Homo sapiens
tcacaactaagatag

SEQ ID NO: 81696 - DNA, 15 bp, Homo sapiens
gtcacaactaagata

SEQ ID NO: 81697 - DNA, 15 bp, Homo sapiens
agtcacaactaagat

SEQ ID NO: 81698 - DNA, 15 bp, Homo sapiens
gagtcacaactaaga

SEQ ID NO: 81699 - DNA, 15 bp, Homo sapiens
ggagtcacaactaag

SEQ ID NO: 81700 - DNA, 15 bp, Homo sapiens
gggagtcacaactaa

SEQ ID NO: 81701 - DNA, 15 bp, Homo sapiens
cgggagtcacaacta

SEQ ID NO: 81702 - DNA, 15 bp, Homo sapiens
acgggagtcacaact

SEQ ID NO: 81703 - DNA, 15 bp, Homo sapiens
aacgggagtcacaac

SEQ ID NO: 81704 - DNA, 15 bp, Homo sapiens
caacgggagtcacaa

SEQ ID NO: 81705 - DNA, 15 bp, Homo sapiens
gcaacgggagtcaca

SEQ ID NO: 81706 - DNA, 15 bp, Homo sapiens
agcaacgggagtcac

SEQ ID NO: 81707 - DNA, 15 bp, Homo sapiens
aagcaacgggagtca

SEQ ID NO: 81708 - DNA, 15 bp, Homo sapiens
aaagcaacgggagtc

SEQ ID NO: 81709 - DNA, 15 bp, Homo sapiens
gaaagcaacgggagt

SEQ ID NO: 81710 - DNA, 15 bp, Homo sapiens
tgaaagcaacgggag

SEQ ID NO: 81711 - DNA, 15 bp, Homo sapiens
gtgaaagcaacggga

SEQ ID NO: 81712 - DNA, 15 bp, Homo sapiens
tgtgaaagcaacggg

SEQ ID NO: 81713 - DNA, 15 bp, Homo sapiens
ctgtgaaagcaacgg

SEQ ID NO: 81714 - DNA, 15 bp, Homo sapiens
gctgtgaaagcaacg

SEQ ID NO: 81715 - DNA, 15 bp, Homo sapiens
ggctgtgaaagcaac

SEQ ID NO: 81716 - DNA, 15 bp, Homo sapiens
aggctgtgaaagcaa

SEQ ID NO: 81717 - DNA, 15 bp, Homo sapiens
caggctgtgaaagca

SEQ ID NO: 81718 - DNA, 15 bp, Homo sapiens
acaggctgtgaaagc

SEQ ID NO: 81719 - DNA, 15 bp, Homo sapiens
aacaggctgtgaaag

SEQ ID NO: 81720 - DNA, 15 bp, Homo sapiens
gaacaggctgtgaaa

SEQ ID NO: 81721 - DNA, 15 bp, Homo sapiens
agaacaggctgtgaa

SEQ ID NO: 81722 - DNA, 15 bp, Homo sapiens
gagaacaggctgtga

SEQ ID NO: 81723 - DNA, 15 bp, Homo sapiens
cgagaacaggctgtg

SEQ ID NO: 81724 - DNA, 15 bp, Homo sapiens
tcgagaacaggctgt

SEQ ID NO: 81725 - DNA, 15 bp, Homo sapiens
gtcgagaacaggctg

SEQ ID NO: 81726 - DNA, 15 bp, Homo sapiens
agtcgagaacaggct

SEQ ID NO: 81727 - DNA, 15 bp, Homo sapiens
gagtcgagaacaggc

SEQ ID NO: 81728 - DNA, 15 bp, Homo sapiens
cgagtcgagaacagg

SEQ ID NO: 81729 - DNA, 15 bp, Homo sapiens
acgagtcgagaacag

SEQ ID NO: 81730 - DNA, 15 bp, Homo sapiens
gacgagtcgagaaca

SEQ ID NO: 81731 - DNA, 15 bp, Homo sapiens
agacgagtcgagaac

SEQ ID NO: 81732 - DNA, 15 bp, Homo sapiens
gagacgagtcgagaa

SEQ ID NO: 81733 - DNA, 15 bp, Homo sapiens
agagacgagtcgaga

SEQ ID NO: 81734 - DNA, 15 bp, Homo sapiens
gagagacgagtcgag

SEQ ID NO: 81735 - DNA, 15 bp, Homo sapiens
agagagacgagtcga

SEQ ID NO: 81736 - DNA, 15 bp, Homo sapiens
aagagagacgagtcg

SEQ ID NO: 81737 - DNA, 15 bp, Homo sapiens
aaagagagacgagtc

SEQ ID NO: 81738 - DNA, 15 bp, Homo sapiens
taaagagagacgagt

SEQ ID NO: 81739 - DNA, 15 bp, Homo sapiens
ttaaagagagacgag

SEQ ID NO: 81740 - DNA, 15 bp, Homo sapiens
attaaagagagacga

SEQ ID NO: 81741 - DNA, 15 bp, Homo sapiens
cattaaagagagacg

SEQ ID NO: 81742 - DNA, 15 bp, Homo sapiens
gcattaaagagagac

SEQ ID NO: 81743 - DNA, 15 bp, Homo sapiens
ggcattaaagagaga

SEQ ID NO: 81744 - DNA, 15 bp, Homo sapiens
aggcattaaagagag

SEQ ID NO: 81745 - DNA, 15 bp, Homo sapiens
aaggcattaaagaga

SEQ ID NO: 81746 - DNA, 15 bp, Homo sapiens
gaaggcattaaagag

SEQ ID NO: 81747 - DNA, 15 bp, Homo sapiens
agaaggcattaaaga

SEQ ID NO: 81748 - DNA, 15 bp, Homo sapiens
gagaaggcattaaag

SEQ ID NO: 81749 - DNA, 15 bp, Homo sapiens
ggagaaggcattaaa

SEQ ID NO: 81750 - DNA, 15 bp, Homo sapiens
aggagaaggcattaa

SEQ ID NO: 81751 - DNA, 15 bp, Homo sapiens
gaggagaaggcatta

SEQ ID NO: 81752 - DNA, 15 bp, Homo sapiens
tgaggagaaggcatt

SEQ ID NO: 81753 - DNA, 15 bp, Homo sapiens
ctgaggagaaggcat

SEQ ID NO: 81754 - DNA, 15 bp, Homo sapiens
actgaggagaaggca

SEQ ID NO: 81755 - DNA, 15 bp, Homo sapiens
cactgaggagaaggc

SEQ ID NO: 81756 - DNA, 15 bp, Homo sapiens
tcactgaggagaagg

SEQ ID NO: 81757 - DNA, 15 bp, Homo sapiens
ttcactgaggagaag

SEQ ID NO: 81758 - DNA, 15 bp, Homo sapiens
gttcactgaggagaa

SEQ ID NO: 81759 - DNA, 15 bp, Homo sapiens
tgttcactgaggaga

SEQ ID NO: 81760 - DNA, 15 bp, Homo sapiens
gtgttcactgaggag

SEQ ID NO: 81761 - DNA, 15 bp, Homo sapiens
agtgttcactgagga

SEQ ID NO: 81762 - DNA, 15 bp, Homo sapiens
tagtgttcactgagg

SEQ ID NO: 81763 - DNA, 15 bp, Homo sapiens
ttagtgttcactgag

SEQ ID NO: 81764 - DNA, 15 bp, Homo sapiens
tttagtgttcactga

SEQ ID NO: 81765 - DNA, 15 bp, Homo sapiens
ctttagtgttcactg

SEQ ID NO: 81766 - DNA, 15 bp, Homo sapiens
cctttagtgttcact

SEQ ID NO: 81767 - DNA, 15 bp, Homo sapiens
tcctttagtgttcac

SEQ ID NO: 81768 - DNA, 15 bp, Homo sapiens
atcctttagtgttca

SEQ ID NO: 81769 - DNA, 15 bp, Homo sapiens
tatcctttagtgttc

SEQ ID NO: 81770 - DNA, 15 bp, Homo sapiens
ttatcctttagtgtt

SEQ ID NO: 81771 - DNA, 15 bp, Homo sapiens
tttatcctttagtgt

SEQ ID NO: 81772 - DNA, 15 bp, Homo sapiens
atttatcctttagtg

SEQ ID NO: 81773 - DNA, 15 bp, Homo sapiens
tatttatcctttagt

SEQ ID NO: 81774 - DNA, 15 bp, Homo sapiens
ctatttatcctttag

SEQ ID NO: 81775 - DNA, 15 bp, Homo sapiens
tctatttatccttta

SEQ ID NO: 81776 - DNA, 15 bp, Homo sapiens
ttctatttatccttt

SEQ ID NO: 81777 - DNA, 15 bp, Homo sapiens
attctatttatcctt

SEQ ID NO: 81778 - DNA, 15 bp, Homo sapiens
gattctatttatcct

SEQ ID NO: 81779 - DNA, 15 bp, Homo sapiens
tgattctatttatcc

SEQ ID NO: 81780 - DNA, 15 bp, Homo sapiens
atgattctatttatc

SEQ ID NO: 81781 - DNA, 15 bp, Homo sapiens
catgattctatttat

SEQ ID NO: 81782 - DNA, 15 bp, Homo sapiens
acatgattctattta

SEQ ID NO: 81783 - DNA, 15 bp, Homo sapiens
gacatgattctattt

SEQ ID NO: 81784 - DNA, 15 bp, Homo sapiens
tgacatgattctatt

SEQ ID NO: 81785 - DNA, 15 bp, Homo sapiens
ctgacatgattctat

SEQ ID NO: 81786 - DNA, 15 bp, Homo sapiens
actgacatgattcta

SEQ ID NO: 81787 - DNA, 15 bp, Homo sapiens
aactgacatgattct

SEQ ID NO: 81788 - DNA, 15 bp, Homo sapiens
gaactgacatgattc

SEQ ID NO: 81789 - DNA, 15 bp, Homo sapiens
ggaactgacatgatt

SEQ ID NO: 81790 - DNA, 15 bp, Homo sapiens
tggaactgacatgat

SEQ ID NO: 81791 - DNA, 15 bp, Homo sapiens
atggaactgacatga

SEQ ID NO: 81792 - DNA, 15 bp, Homo sapiens
catggaactgacatg

SEQ ID NO: 81793 - DNA, 15 bp, Homo sapiens
gcatggaactgacat

SEQ ID NO: 81794 - DNA, 15 bp, Homo sapiens
tgcatggaactgaca

SEQ ID NO: 81795 - DNA, 15 bp, Homo sapiens
atgcatggaactgac

SEQ ID NO: 81796 - DNA, 15 bp, Homo sapiens
tatgcatggaactga

SEQ ID NO: 81797 - DNA, 15 bp, Homo sapiens
ctatgcatggaactg

SEQ ID NO: 81798 - DNA, 15 bp, Homo sapiens
tctatgcatggaact

SEQ ID NO: 81799 - DNA, 15 bp, Homo sapiens
ttctatgcatggaac

SEQ ID NO: 81800 - DNA, 15 bp, Homo sapiens
gttctatgcatggaa

SEQ ID NO: 81801 - DNA, 15 bp, Homo sapiens
agttctatgcatgga

SEQ ID NO: 81802 - DNA, 15 bp, Homo sapiens
gagttctatgcatgg

SEQ ID NO: 81803 - DNA, 15 bp, Homo sapiens
agagttctatgcatg

SEQ ID NO: 81804 - DNA, 15 bp, Homo sapiens
gagagttctatgcat

SEQ ID NO: 81805 - DNA, 15 bp, Homo sapiens
ggagagttctatgca

SEQ ID NO: 81806 - DNA, 15 bp, Homo sapiens
gggagagttctatgc

SEQ ID NO: 81807 - DNA, 15 bp, Homo sapiens
agggagagttctatg

SEQ ID NO: 81808 - DNA, 15 bp, Homo sapiens
aagggagagttctat

SEQ ID NO: 81809 - DNA, 15 bp, Homo sapiens
caagggagagttcta

SEQ ID NO: 81810 - DNA, 15 bp, Homo sapiens
ccaagggagagttct

SEQ ID NO: 81811 - DNA, 15 bp, Homo sapiens
gccaagggagagttc

SEQ ID NO: 81812 - DNA, 15 bp, Homo sapiens
agccaagggagagtt

SEQ ID NO: 81813 - DNA, 15 bp, Homo sapiens
gagccaagggagagt

SEQ ID NO: 81814 - DNA, 15 bp, Homo sapiens
agagccaagggagag

SEQ ID NO: 81815 - DNA, 15 bp, Homo sapiens
gagagccaagggaga

SEQ ID NO: 81816 - DNA, 15 bp, Homo sapiens
tgagagccaagggag

SEQ ID NO: 81817 - DNA, 15 bp, Homo sapiens
ttgagagccaaggga

SEQ ID NO: 81818 - DNA, 15 bp, Homo sapiens
gttgagagccaaggg

SEQ ID NO: 81819 - DNA, 15 bp, Homo sapiens
agttgagagccaagg

SEQ ID NO: 81820 - DNA, 15 bp, Homo sapiens
cagttgagagccaag

SEQ ID NO: 81821 - DNA, 15 bp, Homo sapiens
gcagttgagagccaa

SEQ ID NO: 81822 - DNA, 15 bp, Homo sapiens
ggcagttgagagcca

SEQ ID NO: 81823 - DNA, 15 bp, Homo sapiens
aggcagttgagagcc

SEQ ID NO: 81824 - DNA, 15 bp, Homo sapiens
aaggcagttgagagc

SEQ ID NO: 81825 - DNA, 15 bp, Homo sapiens
aaaggcagttgagag

SEQ ID NO: 81826 - DNA, 15 bp, Homo sapiens
caaaggcagttgaga

SEQ ID NO: 81827 - DNA, 15 bp, Homo sapiens
ccaaaggcagttgag

SEQ ID NO: 81828 - DNA, 15 bp, Homo sapiens
cccaaaggcagttga

SEQ ID NO: 81829 - DNA, 15 bp, Homo sapiens
acccaaaggcagttg

SEQ ID NO: 81830 - DNA, 15 bp, Homo sapiens
aacccaaaggcagtt

SEQ ID NO: 81831 - DNA, 15 bp, Homo sapiens
taacccaaaggcagt

SEQ ID NO: 81832 - DNA, 15 bp, Homo sapiens
ttaacccaaaggcag

SEQ ID NO: 81833 - DNA, 15 bp, Homo sapiens
cttaacccaaaggca

SEQ ID NO: 81834 - DNA, 15 bp, Homo sapiens
acttaacccaaaggc

SEQ ID NO: 81835 - DNA, 15 bp, Homo sapiens
gacttaacccaaagg

SEQ ID NO: 81836 - DNA, 15 bp, Homo sapiens
ggacttaacccaaag

SEQ ID NO: 81837 - DNA, 15 bp, Homo sapiens
tggacttaacccaaa

SEQ ID NO: 81838 - DNA, 15 bp, Homo sapiens
ttggacttaacccaa

SEQ ID NO: 81839 - DNA, 15 bp, Homo sapiens
tttggacttaaccca

SEQ ID NO: 81840 - DNA, 15 bp, Homo sapiens
gtttggacttaaccc

SEQ ID NO: 81841 - DNA, 15 bp, Homo sapiens
agtttggacttaacc

SEQ ID NO: 81842 - DNA, 15 bp, Homo sapiens
gagtttggacttaac

SEQ ID NO: 81843 - DNA, 15 bp, Homo sapiens
ggagtttggacttaa

SEQ ID NO: 81844 - DNA, 15 bp, Homo sapiens
aggagtttggactta

SEQ ID NO: 81845 - DNA, 15 bp, Homo sapiens
aaggagtttggactt

SEQ ID NO: 81846 - DNA, 15 bp, Homo sapiens
taaggagtttggact

SEQ ID NO: 81847 - DNA, 15 bp, Homo sapiens
ttaaggagtttggac

SEQ ID NO: 81848 - DNA, 15 bp, Homo sapiens
attaaggagtttgga

SEQ ID NO: 81849 - DNA, 15 bp, Homo sapiens
tattaaggagtttgg

SEQ ID NO: 81850 - DNA, 15 bp, Homo sapiens
atattaaggagtttg

SEQ ID NO: 81851 - DNA, 15 bp, Homo sapiens
catattaaggagttt

SEQ ID NO: 81852 - DNA, 15 bp, Homo sapiens
acatattaaggagtt

SEQ ID NO: 81853 - DNA, 15 bp, Homo sapiens
gacatattaaggagt

SEQ ID NO: 81854 - DNA, 15 bp, Homo sapiens
ggacatattaaggag

SEQ ID NO: 81855 - DNA, 15 bp, Homo sapiens
aggacatattaagga

SEQ ID NO: 81856 - DNA, 15 bp, Homo sapiens
caggacatattaagg

SEQ ID NO: 81857 - DNA, 15 bp, Homo sapiens
gcaggacatattaag

SEQ ID NO: 81858 - DNA, 15 bp, Homo sapiens
tgcaggacatattaa

SEQ ID NO: 81859 - DNA, 15 bp, Homo sapiens
ctgcaggacatatta

SEQ ID NO: 81860 - DNA, 15 bp, Homo sapiens
cctgcaggacatatt

SEQ ID NO: 81861 - DNA, 15 bp, Homo sapiens
ccctgcaggacatat

SEQ ID NO: 81862 - DNA, 15 bp, Homo sapiens
gccctgcaggacata

SEQ ID NO: 81863 - DNA, 15 bp, Homo sapiens
ggccctgcaggacat

SEQ ID NO: 81864 - DNA, 15 bp, Homo sapiens
aggccctgcaggaca

SEQ ID NO: 81865 - DNA, 15 bp, Homo sapiens
aaggccctgcaggac

SEQ ID NO: 81866 - DNA, 15 bp, Homo sapiens
gaaggccctgcagga

SEQ ID NO: 81867 - DNA, 15 bp, Homo sapiens
agaaggccctgcagg

SEQ ID NO: 81868 - DNA, 15 bp, Homo sapiens
aagaaggccctgcag

SEQ ID NO: 81869 - DNA, 15 bp, Homo sapiens
caagaaggccctgca

SEQ ID NO: 81870 - DNA, 15 bp, Homo sapiens
acaagaaggccctgc

SEQ ID NO: 81871 - DNA, 15 bp, Homo sapiens
tacaagaaggccctg

SEQ ID NO: 81872 - DNA, 15 bp, Homo sapiens
ctacaagaaggccct

SEQ ID NO: 81873 - DNA, 15 bp, Homo sapiens
gctacaagaaggccc

SEQ ID NO: 81874 - DNA, 15 bp, Homo sapiens
agctacaagaaggcc

SEQ ID NO: 81875 - DNA, 15 bp, Homo sapiens
cagctacaagaaggc

SEQ ID NO: 81876 - DNA, 15 bp, Homo sapiens
ccagctacaagaagg

SEQ ID NO: 81877 - DNA, 15 bp, Homo sapiens
accagctacaagaag

SEQ ID NO: 81878 - DNA, 15 bp, Homo sapiens
gaccagctacaagaa

SEQ ID NO: 81879 - DNA, 15 bp, Homo sapiens
ggaccagctacaaga

SEQ ID NO: 81880 - DNA, 15 bp, Homo sapiens
tggaccagctacaag

SEQ ID NO: 81881 - DNA, 15 bp, Homo sapiens
atggaccagctacaa

SEQ ID NO: 81882 - DNA, 15 bp, Homo sapiens
catggaccagctaca

SEQ ID NO: 81883 - DNA, 15 bp, Homo sapiens
acatggaccagctac

SEQ ID NO: 81884 - DNA, 15 bp, Homo sapiens
cacatggaccagcta

SEQ ID NO: 81885 - DNA, 15 bp, Homo sapiens
tcacatggaccagct

SEQ ID NO: 81886 - DNA, 15 bp, Homo sapiens
atcacatggaccagc

SEQ ID NO: 81887 - DNA, 15 bp, Homo sapiens
aatcacatggaccag

SEQ ID NO: 81888 - DNA, 15 bp, Homo sapiens
gaatcacatggacca

SEQ ID NO: 81889 - DNA, 15 bp, Homo sapiens
agaatcacatggacc

SEQ ID NO: 81890 - DNA, 15 bp, Homo sapiens
aagaatcacatggac

SEQ ID NO: 81891 - DNA, 15 bp, Homo sapiens
caagaatcacatgga

SEQ ID NO: 81892 - DNA, 15 bp, Homo sapiens
ccaagaatcacatgg

SEQ ID NO: 81893 - DNA, 15 bp, Homo sapiens
gccaagaatcacatg

SEQ ID NO: 81894 - DNA, 15 bp, Homo sapiens
ggccaagaatcacat

SEQ ID NO: 81895 - DNA, 15 bp, Homo sapiens
tggccaagaatcaca

SEQ ID NO: 81896 - DNA, 15 bp, Homo sapiens
gtggccaagaatcac

SEQ ID NO: 81897 - DNA, 15 bp, Homo sapiens
tgtggccaagaatca

SEQ ID NO: 81898 - DNA, 15 bp, Homo sapiens
atgtggccaagaatc

SEQ ID NO: 81899 - DNA, 15 bp, Homo sapiens
gatgtggccaagaat

SEQ ID NO: 81900 - DNA, 15 bp, Homo sapiens
cgatgtggccaagaa

SEQ ID NO: 81901 - DNA, 15 bp, Homo sapiens
acgatgtggccaaga

SEQ ID NO: 81902 - DNA, 15 bp, Homo sapiens
gacgatgtggccaag

SEQ ID NO: 81903 - DNA, 15 bp, Homo sapiens
tgacgatgtggccaa

SEQ ID NO: 81904 - DNA, 15 bp, Homo sapiens
ttgacgatgtggcca

SEQ ID NO: 81905 - DNA, 15 bp, Homo sapiens
attgacgatgtggcc

SEQ ID NO: 81906 - DNA, 15 bp, Homo sapiens
aattgacgatgtggc

SEQ ID NO: 81907 - DNA, 15 bp, Homo sapiens
caattgacgatgtgg

SEQ ID NO: 81908 - DNA, 15 bp, Homo sapiens
acaattgacgatgtg

SEQ ID NO: 81909 - DNA, 15 bp, Homo sapiens
gacaattgacgatgt

SEQ ID NO: 81910 - DNA, 15 bp, Homo sapiens
ggacaattgacgatg

SEQ ID NO: 81911 - DNA, 15 bp, Homo sapiens
gggacaattgacgat

SEQ ID NO: 81912 - DNA, 15 bp, Homo sapiens
agggacaattgacga

SEQ ID NO: 81913 - DNA, 15 bp, Homo sapiens
gagggacaattgacg

SEQ ID NO: 81914 - DNA, 15 bp, Homo sapiens
ggagggacaattgac

SEQ ID NO: 81915 - DNA, 15 bp, Homo sapiens
gggagggacaattga

SEQ ID NO: 81916 - DNA, 15 bp, Homo sapiens
agggagggacaattg

SEQ ID NO: 81917 - DNA, 15 bp, Homo sapiens
aagggagggacaatt

SEQ ID NO: 81918 - DNA, 15 bp, Homo sapiens
caagggagggacaat

SEQ ID NO: 81919 - DNA, 15 bp, Homo sapiens
acaagggagggacaa

SEQ ID NO: 81920 - DNA, 15 bp, Homo sapiens
cacaagggagggaca

SEQ ID NO: 81921 - DNA, 15 bp, Homo sapiens
tcacaagggagggac

SEQ ID NO: 81922 - DNA, 15 bp, Homo sapiens
ctcacaagggaggga

SEQ ID NO: 81923 - DNA, 15 bp, Homo sapiens
actcacaagggaggg

SEQ ID NO: 81924 - DNA, 15 bp, Homo sapiens
aactcacaagggagg

SEQ ID NO: 81925 - DNA, 15 bp, Homo sapiens
gaactcacaagggag

SEQ ID NO: 81926 - DNA, 15 bp, Homo sapiens
tgaactcacaaggga

SEQ ID NO: 81927 - DNA, 15 bp, Homo sapiens
ctgaactcacaaggg

SEQ ID NO: 81928 - DNA, 15 bp, Homo sapiens
actgaactcacaagg

SEQ ID NO: 81929 - DNA, 15 bp, Homo sapiens
tactgaactcacaag

SEQ ID NO: 81930 - DNA, 15 bp, Homo sapiens
gtactgaactcacaa

SEQ ID NO: 81931 - DNA, 15 bp, Homo sapiens
agtactgaactcaca

SEQ ID NO: 81932 - DNA, 15 bp, Homo sapiens
gagtactgaactcac

SEQ ID NO: 81933 - DNA, 15 bp, Homo sapiens
tgagtactgaactca

SEQ ID NO: 81934 - DNA, 15 bp, Homo sapiens
atgagtactgaactc

SEQ ID NO: 81935 - DNA, 15 bp, Homo sapiens
aatgagtactgaact

SEQ ID NO: 81936 - DNA, 15 bp, Homo sapiens
taatgagtactgaac

SEQ ID NO: 81937 - DNA, 15 bp, Homo sapiens
ataatgagtactgaa

SEQ ID NO: 81938 - DNA, 15 bp, Homo sapiens
aataatgagtactga

SEQ ID NO: 81939 - DNA, 15 bp, Homo sapiens
gaataatgagtactg

SEQ ID NO: 81940 - DNA, 15 bp, Homo sapiens
ggaataatgagtact

SEQ ID NO: 81941 - DNA, 15 bp, Homo sapiens
tggaataatgagtac

SEQ ID NO: 81942 - DNA, 15 bp, Homo sapiens
ctggaataatgagta

SEQ ID NO: 81943 - DNA, 15 bp, Homo sapiens
tctggaataatgagt

SEQ ID NO: 81944 - DNA, 15 bp, Homo sapiens
gtctggaataatgag

SEQ ID NO: 81945 - DNA, 15 bp, Homo sapiens
tgtctggaataatga

SEQ ID NO: 81946 - DNA, 15 bp, Homo sapiens
gtgtctggaataatg

SEQ ID NO: 81947 - DNA, 15 bp, Homo sapiens
cgtgtctggaataat

SEQ ID NO: 81948 - DNA, 15 bp, Homo sapiens
gcgtgtctggaataa

SEQ ID NO: 81949 - DNA, 15 bp, Homo sapiens
ggcgtgtctggaata

SEQ ID NO: 81950 - DNA, 15 bp, Homo sapiens
aggcgtgtctggaat

SEQ ID NO: 81951 - DNA, 15 bp, Homo sapiens
taggcgtgtctggaa

SEQ ID NO: 81952 - DNA, 15 bp, Homo sapiens
ttaggcgtgtctgga

SEQ ID NO: 81953 - DNA, 15 bp, Homo sapiens
gttaggcgtgtctgg

SEQ ID NO: 81954 - DNA, 15 bp, Homo sapiens
agttaggcgtgtctg

SEQ ID NO: 81955 - DNA, 15 bp, Homo sapiens
tagttaggcgtgtct

SEQ ID NO: 81956 - DNA, 15 bp, Homo sapiens
ttagttaggcgtgtc

SEQ ID NO: 81957 - DNA, 15 bp, Homo sapiens
attagttaggcgtgt

SEQ ID NO: 81958 - DNA, 15 bp, Homo sapiens
tattagttaggcgtg

SEQ ID NO: 81959 - DNA, 15 bp, Homo sapiens
gtattagttaggcgt

SEQ ID NO: 81960 - DNA, 15 bp, Homo sapiens
agtattagttaggcg

SEQ ID NO: 81961 - DNA, 15 bp, Homo sapiens
aagtattagttaggc

SEQ ID NO: 81962 - DNA, 15 bp, Homo sapiens
caagtattagttagg

SEQ ID NO: 81963 - DNA, 15 bp, Homo sapiens
gcaagtattagttag

SEQ ID NO: 81964 - DNA, 15 bp, Homo sapiens
tgcaagtattagtta

SEQ ID NO: 81965 - DNA, 15 bp, Homo sapiens
ctgcaagtattagtt

SEQ ID NO: 81966 - DNA, 15 bp, Homo sapiens
actgcaagtattagt

SEQ ID NO: 81967 - DNA, 15 bp, Homo sapiens
aactgcaagtattag

SEQ ID NO: 81968 - DNA, 15 bp, Homo sapiens
aaactgcaagtatta

SEQ ID NO: 81969 - DNA, 15 bp, Homo sapiens
caaactgcaagtatt

SEQ ID NO: 81970 - DNA, 15 bp, Homo sapiens
gcaaactgcaagtat

SEQ ID NO: 81971 - DNA, 15 bp, Homo sapiens
tgcaaactgcaagta

SEQ ID NO: 81972 - DNA, 15 bp, Homo sapiens
ttgcaaactgcaagt

SEQ ID NO: 81973 - DNA, 15 bp, Homo sapiens
tttgcaaactgcaag

SEQ ID NO: 81974 - DNA, 15 bp, Homo sapiens
ttttgcaaactgcaa

SEQ ID NO: 81975 - DNA, 15 bp, Homo sapiens
attttgcaaactgca

SEQ ID NO: 81976 - DNA, 15 bp, Homo sapiens
cattttgcaaactgc

SEQ ID NO: 81977 - DNA, 15 bp, Homo sapiens
acattttgcaaactg

SEQ ID NO: 81978 - DNA, 15 bp, Homo sapiens
cacattttgcaaact

SEQ ID NO: 81979 - DNA, 15 bp, Homo sapiens
tcacattttgcaaac

SEQ ID NO: 81980 - DNA, 15 bp, Homo sapiens
atcacattttgcaaa

SEQ ID NO: 81981 - DNA, 15 bp, Homo sapiens
gatcacattttgcaa

SEQ ID NO: 81982 - DNA, 15 bp, Homo sapiens
agatcacattttgca

SEQ ID NO: 81983 - DNA, 15 bp, Homo sapiens
aagatcacattttgc

SEQ ID NO: 81984 - DNA, 15 bp, Homo sapiens
gaagatcacattttg

SEQ ID NO: 81985 - DNA, 15 bp, Homo sapiens
ggaagatcacatttt

SEQ ID NO: 81986 - DNA, 15 bp, Homo sapiens
gggaagatcacattt

SEQ ID NO: 81987 - DNA, 15 bp, Homo sapiens
agggaagatcacatt

SEQ ID NO: 81988 - DNA, 15 bp, Homo sapiens
aagggaagatcacat

SEQ ID NO: 81989 - DNA, 15 bp, Homo sapiens
aaagggaagatcaca

SEQ ID NO: 81990 - DNA, 15 bp, Homo sapiens
gaaagggaagatcac

SEQ ID NO: 81991 - DNA, 15 bp, Homo sapiens
agaaagggaagatca

SEQ ID NO: 81992 - DNA, 15 bp, Homo sapiens
gagaaagggaagatc

SEQ ID NO: 81993 - DNA, 15 bp, Homo sapiens
agagaaagggaagat

SEQ ID NO: 81994 - DNA, 15 bp, Homo sapiens
cagagaaagggaaga

SEQ ID NO: 81995 - DNA, 15 bp, Homo sapiens
gcagagaaagggaag

SEQ ID NO: 81996 - DNA, 15 bp, Homo sapiens
agcagagaaagggaa

SEQ ID NO: 81997 - DNA, 15 bp, Homo sapiens
aagcagagaaaggga

SEQ ID NO: 81998 - DNA, 15 bp, Homo sapiens
aaagcagagaaaggg

SEQ ID NO: 81999 - DNA, 15 bp, Homo sapiens
gaaagcagagaaagg

SEQ ID NO: 82000 - DNA, 15 bp, Homo sapiens
ggaaagcagagaaag

SEQ ID NO: 82001 - DNA, 15 bp, Homo sapiens
gggaaagcagagaaa

SEQ ID NO: 82002 - DNA, 15 bp, Homo sapiens
agggaaagcagagaa

SEQ ID NO: 82003 - DNA, 15 bp, Homo sapiens
aagggaaagcagaga

SEQ ID NO: 82004 - DNA, 15 bp, Homo sapiens
caagggaaagcagag

SEQ ID NO: 82005 - DNA, 15 bp, Homo sapiens
ccaagggaaagcaga

SEQ ID NO: 82006 - DNA, 15 bp, Homo sapiens
gccaagggaaagcag

SEQ ID NO: 82007 - DNA, 15 bp, Homo sapiens
tgccaagggaaagca

SEQ ID NO: 82008 - DNA, 15 bp, Homo sapiens
ttgccaagggaaagc

SEQ ID NO: 82009 - DNA, 15 bp, Homo sapiens
cttgccaagggaaag

SEQ ID NO: 82010 - DNA, 15 bp, Homo sapiens
ccttgccaagggaaa

SEQ ID NO: 82011 - DNA, 15 bp, Homo sapiens
cccttgccaagggaa

SEQ ID NO: 82012 - DNA, 15 bp, Homo sapiens
tcccttgccaaggga

SEQ ID NO: 82013 - DNA, 15 bp, Homo sapiens
ttcccttgccaaggg

SEQ ID NO: 82014 - DNA, 15 bp, Homo sapiens
tttcccttgccaagg

SEQ ID NO: 82015 - DNA, 15 bp, Homo sapiens
gtttcccttgccaag

SEQ ID NO: 82016 - DNA, 15 bp, Homo sapiens
agtttcccttgccaa

SEQ ID NO: 82017 - DNA, 15 bp, Homo sapiens
gagtttcccttgcca

SEQ ID NO: 82018 - DNA, 15 bp, Homo sapiens
ggagtttcccttgcc

SEQ ID NO: 82019 - DNA, 15 bp, Homo sapiens
aggagtttcccttgc

SEQ ID NO: 82020 - DNA, 15 bp, Homo sapiens
gaggagtttcccttg

SEQ ID NO: 82021 - DNA, 15 bp, Homo sapiens
tgaggagtttccctt

SEQ ID NO: 82022 - DNA, 15 bp, Homo sapiens
ctgaggagtttccct

SEQ ID NO: 82023 - DNA, 15 bp, Homo sapiens
actgaggagtttccc

SEQ ID NO: 82024 - DNA, 15 bp, Homo sapiens
cactgaggagtttcc

SEQ ID NO: 82025 - DNA, 15 bp, Homo sapiens
acactgaggagtttc

SEQ ID NO: 82026 - DNA, 15 bp, Homo sapiens
tacactgaggagttt

SEQ ID NO: 82027 - DNA, 15 bp, Homo sapiens
ttacactgaggagtt

SEQ ID NO: 82028 - DNA, 15 bp, Homo sapiens
attacactgaggagt

SEQ ID NO: 82029 - DNA, 15 bp, Homo sapiens
cattacactgaggag

SEQ ID NO: 82030 - DNA, 15 bp, Homo sapiens
gcattacactgagga

SEQ ID NO: 82031 - DNA, 15 bp, Homo sapiens
agcattacactgagg

SEQ ID NO: 82032 - DNA, 15 bp, Homo sapiens
cagcattacactgag

SEQ ID NO: 82033 - DNA, 15 bp, Homo sapiens
acagcattacactga

SEQ ID NO: 82034 - DNA, 15 bp, Homo sapiens
aacagcattacactg

SEQ ID NO: 82035 - DNA, 15 bp, Homo sapiens
caacagcattacact

SEQ ID NO: 82036 - DNA, 15 bp, Homo sapiens
acaacagcattacac

SEQ ID NO: 82037 - DNA, 15 bp, Homo sapiens
aacaacagcattaca

SEQ ID NO: 82038 - DNA, 15 bp, Homo sapiens
gaacaacagcattac

SEQ ID NO: 82039 - DNA, 15 bp, Homo sapiens
agaacaacagcatta

SEQ ID NO: 82040 - DNA, 15 bp, Homo sapiens
gagaacaacagcatt

SEQ ID NO: 82041 - DNA, 15 bp, Homo sapiens
ggagaacaacagcat

SEQ ID NO: 82042 - DNA, 15 bp, Homo sapiens
aggagaacaacagca

SEQ ID NO: 82043 - DNA, 15 bp, Homo sapiens
aaggagaacaacagc

SEQ ID NO: 82044 - DNA, 15 bp, Homo sapiens
aaaggagaacaacag

SEQ ID NO: 82045 - DNA, 15 bp, Homo sapiens
taaaggagaacaaca

SEQ ID NO: 82046 - DNA, 15 bp, Homo sapiens
ctaaaggagaacaac

SEQ ID NO: 82047 - DNA, 15 bp, Homo sapiens
cctaaaggagaacaa

SEQ ID NO: 82048 - DNA, 15 bp, Homo sapiens
tcctaaaggagaaca

SEQ ID NO: 82049 - DNA, 15 bp, Homo sapiens
ttcctaaaggagaac

SEQ ID NO: 82050 - DNA, 15 bp, Homo sapiens
cttcctaaaggagaa

SEQ ID NO: 82051 - DNA, 15 bp, Homo sapiens
gcttcctaaaggaga

SEQ ID NO: 82052 - DNA, 15 bp, Homo sapiens
ggcttcctaaaggag

SEQ ID NO: 82053 - DNA, 15 bp, Homo sapiens
tggcttcctaaagga

SEQ ID NO: 82054 - DNA, 15 bp, Homo sapiens
atggcttcctaaagg

SEQ ID NO: 82055 - DNA, 15 bp, Homo sapiens
gatggcttcctaaag

SEQ ID NO: 82056 - DNA, 15 bp, Homo sapiens
ggatggcttcctaaa

SEQ ID NO: 82057 - DNA, 15 bp, Homo sapiens
tggatggcttcctaa

SEQ ID NO: 82058 - DNA, 15 bp, Homo sapiens
atggatggcttccta

SEQ ID NO: 82059 - DNA, 15 bp, Homo sapiens
catggatggcttcct

SEQ ID NO: 82060 - DNA, 15 bp, Homo sapiens
gcatggatggcttcc

SEQ ID NO: 82061 - DNA, 15 bp, Homo sapiens
ggcatggatggcttc

SEQ ID NO: 82062 - DNA, 15 bp, Homo sapiens
gggcatggatggctt

SEQ ID NO: 82063 - DNA, 15 bp, Homo sapiens
ggggcatggatggct

SEQ ID NO: 82064 - DNA, 15 bp, Homo sapiens
tggggcatggatggc

SEQ ID NO: 82065 - DNA, 15 bp, Homo sapiens
ttggggcatggatgg

SEQ ID NO: 82066 - DNA, 15 bp, Homo sapiens
attggggcatggatg

SEQ ID NO: 82067 - DNA, 15 bp, Homo sapiens
aattggggcatggat

SEQ ID NO: 82068 - DNA, 15 bp, Homo sapiens
caattggggcatgga

SEQ ID NO: 82069 - DNA, 15 bp, Homo sapiens
ccaattggggcatgg

SEQ ID NO: 82070 - DNA, 15 bp, Homo sapiens
tccaattggggcatg

SEQ ID NO: 82071 - DNA, 15 bp, Homo sapiens
atccaattggggcat

SEQ ID NO: 82072 - DNA, 15 bp, Homo sapiens
aatccaattggggca

SEQ ID NO: 82073 - DNA, 15 bp, Homo sapiens
taatccaattggggc

SEQ ID NO: 82074 - DNA, 15 bp, Homo sapiens
ctaatccaattgggg

SEQ ID NO: 82075 - DNA, 15 bp, Homo sapiens
tctaatccaattggg

SEQ ID NO: 82076 - DNA, 15 bp, Homo sapiens
ttctaatccaattgg

SEQ ID NO: 82077 - DNA, 15 bp, Homo sapiens
cttctaatccaattg

SEQ ID NO: 82078 - DNA, 15 bp, Homo sapiens
gcttctaatccaatt

SEQ ID NO: 82079 - DNA, 15 bp, Homo sapiens
ggcttctaatccaat

SEQ ID NO: 82080 - DNA, 15 bp, Homo sapiens
tggcttctaatccaa

SEQ ID NO: 82081 - DNA, 15 bp, Homo sapiens
gtggcttctaatcca

SEQ ID NO: 82082 - DNA, 15 bp, Homo sapiens
agtggcttctaatcc

SEQ ID NO: 82083 - DNA, 15 bp, Homo sapiens
gagtggcttctaatc

SEQ ID NO: 82084 - DNA, 15 bp, Homo sapiens
ggagtggcttctaat

SEQ ID NO: 82085 - DNA, 15 bp, Homo sapiens
aggagtggcttctaa

SEQ ID NO: 82086 - DNA, 15 bp, Homo sapiens
caggagtggcttcta

SEQ ID NO: 82087 - DNA, 15 bp, Homo sapiens
acaggagtggcttct

SEQ ID NO: 82088 - DNA, 15 bp, Homo sapiens
cacaggagtggcttc

SEQ ID NO: 82089 - DNA, 15 bp, Homo sapiens
tcacaggagtggctt

SEQ ID NO: 82090 - DNA, 15 bp, Homo sapiens
ttcacaggagtggct

SEQ ID NO: 82091 - DNA, 15 bp, Homo sapiens
attcacaggagtggc

SEQ ID NO: 82092 - DNA, 15 bp, Homo sapiens
aattcacaggagtgg

SEQ ID NO: 82093 - DNA, 15 bp, Homo sapiens
gaattcacaggagtg

SEQ ID NO: 82094 - DNA, 15 bp, Homo sapiens
ggaattcacaggagt

SEQ ID NO: 82095 - DNA, 15 bp, Homo sapiens
aggaattcacaggag

SEQ ID NO: 82096 - DNA, 15 bp, Homo sapiens
caggaattcacagga

SEQ ID NO: 82097 - DNA, 15 bp, Homo sapiens
ccaggaattcacagg

SEQ ID NO: 82098 - DNA, 15 bp, Homo sapiens
tccaggaattcacag

SEQ ID NO: 82099 - DNA, 15 bp, Homo sapiens
ttccaggaattcaca

SEQ ID NO: 82100 - DNA, 15 bp, Homo sapiens
attccaggaattcac

SEQ ID NO: 82101 - DNA, 15 bp, Homo sapiens
aattccaggaattca

SEQ ID NO: 82102 - DNA, 15 bp, Homo sapiens
taattccaggaattc

SEQ ID NO: 82103 - DNA, 15 bp, Homo sapiens
ctaattccaggaatt

SEQ ID NO: 82104 - DNA, 15 bp, Homo sapiens
gctaattccaggaat

SEQ ID NO: 82105 - DNA, 15 bp, Homo sapiens
tgctaattccaggaa

SEQ ID NO: 82106 - DNA, 15 bp, Homo sapiens
gtgctaattccagga

SEQ ID NO: 82107 - DNA, 15 bp, Homo sapiens
ggtgctaattccagg

SEQ ID NO: 82108 - DNA, 15 bp, Homo sapiens
aggtgctaattccag

SEQ ID NO: 82109 - DNA, 15 bp, Homo sapiens
taggtgctaattcca

SEQ ID NO: 82110 - DNA, 15 bp, Homo sapiens
ctaggtgctaattcc

SEQ ID NO: 82111 - DNA, 15 bp, Homo sapiens
gctaggtgctaattc

SEQ ID NO: 82112 - DNA, 15 bp, Homo sapiens
tgctaggtgctaatt

SEQ ID NO: 82113 - DNA, 15 bp, Homo sapiens
ttgctaggtgctaat

SEQ ID NO: 82114 - DNA, 15 bp, Homo sapiens
tttgctaggtgctaa

SEQ ID NO: 82115 - DNA, 15 bp, Homo sapiens
atttgctaggtgcta

SEQ ID NO: 82116 - DNA, 15 bp, Homo sapiens
aatttgctaggtgct

SEQ ID NO: 82117 - DNA, 15 bp, Homo sapiens
gaatttgctaggtgc

SEQ ID NO: 82118 - DNA, 15 bp, Homo sapiens
agaatttgctaggtg

SEQ ID NO: 82119 - DNA, 15 bp, Homo sapiens
aagaatttgctaggt

SEQ ID NO: 82120 - DNA, 15 bp, Homo sapiens
aaagaatttgctagg

SEQ ID NO: 82121 - DNA, 15 bp, Homo sapiens
aaaagaatttgctag

SEQ ID NO: 82122 - DNA, 15 bp, Homo sapiens
caaaagaatttgcta

SEQ ID NO: 82123 - DNA, 15 bp, Homo sapiens
acaaaagaatttgct

SEQ ID NO: 82124 - DNA, 15 bp, Homo sapiens
aacaaaagaatttgc

SEQ ID NO: 82125 - DNA, 15 bp, Homo sapiens
taacaaaagaatttg

SEQ ID NO: 82126 - DNA, 15 bp, Homo sapiens
ataacaaaagaattt

SEQ ID NO: 82127 - DNA, 15 bp, Homo sapiens
aataacaaaagaatt

SEQ ID NO: 82128 - DNA, 15 bp, Homo sapiens
caataacaaaagaat

SEQ ID NO: 82129 - DNA, 15 bp, Homo sapiens
gcaataacaaaagaa

SEQ ID NO: 82130 - DNA, 15 bp, Homo sapiens
ggcaataacaaaaga

SEQ ID NO: 82131 - DNA, 15 bp, Homo sapiens
aggcaataacaaaag

SEQ ID NO: 82132 - DNA, 15 bp, Homo sapiens
caggcaataacaaaa

SEQ ID NO: 82133 - DNA, 15 bp, Homo sapiens
acaggcaataacaaa

SEQ ID NO: 82134 - DNA, 15 bp, Homo sapiens
aacaggcaataacaa

SEQ ID NO: 82135 - DNA, 15 bp, Homo sapiens
taacaggcaataaca

SEQ ID NO: 82136 - DNA, 15 bp, Homo sapiens
gtaacaggcaataac

SEQ ID NO: 82137 - DNA, 15 bp, Homo sapiens
agtaacaggcaataa

SEQ ID NO: 82138 - DNA, 15 bp, Homo sapiens
aagtaacaggcaata

SEQ ID NO: 82139 - DNA, 15 bp, Homo sapiens
aaagtaacaggcaat

SEQ ID NO: 82140 - DNA, 15 bp, Homo sapiens
gaaagtaacaggcaa

SEQ ID NO: 82141 - DNA, 15 bp, Homo sapiens
ggaaagtaacaggca

SEQ ID NO: 82142 - DNA, 15 bp, Homo sapiens
tggaaagtaacaggc

SEQ ID NO: 82143 - DNA, 15 bp, Homo sapiens
atggaaagtaacagg

SEQ ID NO: 82144 - DNA, 15 bp, Homo sapiens
aatggaaagtaacag

SEQ ID NO: 82145 - DNA, 15 bp, Homo sapiens
caatggaaagtaaca

SEQ ID NO: 82146 - DNA, 15 bp, Homo sapiens
gcaatggaaagtaac

SEQ ID NO: 82147 - DNA, 15 bp, Homo sapiens
agcaatggaaagtaa

SEQ ID NO: 82148 - DNA, 15 bp, Homo sapiens
aagcaatggaaagta

SEQ ID NO: 82149 - DNA, 15 bp, Homo sapiens
taagcaatggaaagt

SEQ ID NO: 82150 - DNA, 15 bp, Homo sapiens
gtaagcaatggaaag

SEQ ID NO: 82151 - DNA, 15 bp, Homo sapiens
agtaagcaatggaaa

SEQ ID NO: 82152 - DNA, 15 bp, Homo sapiens
tagtaagcaatggaa

SEQ ID NO: 82153 - DNA, 15 bp, Homo sapiens
ctagtaagcaatgga

SEQ ID NO: 82154 - DNA, 15 bp, Homo sapiens
tctagtaagcaatgg

SEQ ID NO: 82155 - DNA, 15 bp, Homo sapiens
gtctagtaagcaatg

SEQ ID NO: 82156 - DNA, 15 bp, Homo sapiens
agtctagtaagcaat

SEQ ID NO: 82157 - DNA, 15 bp, Homo sapiens
tagtctagtaagcaa

SEQ ID NO: 82158 - DNA, 15 bp, Homo sapiens
ctagtctagtaagca

SEQ ID NO: 82159 - DNA, 15 bp, Homo sapiens
tctagtctagtaagc

SEQ ID NO: 82160 - DNA, 15 bp, Homo sapiens
ttctagtctagtaag

SEQ ID NO: 82161 - DNA, 15 bp, Homo sapiens
cttctagtctagtaa

SEQ ID NO: 82162 - DNA, 15 bp, Homo sapiens
gcttctagtctagta

SEQ ID NO: 82163 - DNA, 15 bp, Homo sapiens
agcttctagtctagt

SEQ ID NO: 82164 - DNA, 15 bp, Homo sapiens
gagcttctagtctag

SEQ ID NO: 82165 - DNA, 15 bp, Homo sapiens
ggagcttctagtcta

SEQ ID NO: 82166 - DNA, 15 bp, Homo sapiens
aggagcttctagtct

SEQ ID NO: 82167 - DNA, 15 bp, Homo sapiens
aaggagcttctagtc

SEQ ID NO: 82168 - DNA, 15 bp, Homo sapiens
caaggagcttctagt

SEQ ID NO: 82169 - DNA, 15 bp, Homo sapiens
ccaaggagcttctag

SEQ ID NO: 82170 - DNA, 15 bp, Homo sapiens
cccaaggagcttcta

SEQ ID NO: 82171 - DNA, 15 bp, Homo sapiens
tcccaaggagcttct

SEQ ID NO: 82172 - DNA, 15 bp, Homo sapiens
ctcccaaggagcttc

SEQ ID NO: 82173 - DNA, 15 bp, Homo sapiens
gctcccaaggagctt

SEQ ID NO: 82174 - DNA, 15 bp, Homo sapiens
agctcccaaggagct

SEQ ID NO: 82175 - DNA, 15 bp, Homo sapiens
cagctcccaaggagc

SEQ ID NO: 82176 - DNA, 15 bp, Homo sapiens
tcagctcccaaggag

SEQ ID NO: 82177 - DNA, 15 bp, Homo sapiens
ctcagctcccaagga

SEQ ID NO: 82178 - DNA, 15 bp, Homo sapiens
tctcagctcccaagg

SEQ ID NO: 82179 - DNA, 15 bp, Homo sapiens
atctcagctcccaag

SEQ ID NO: 82180 - DNA, 15 bp, Homo sapiens
aatctcagctcccaa

SEQ ID NO: 82181 - DNA, 15 bp, Homo sapiens
aaatctcagctccca

SEQ ID NO: 82182 - DNA, 15 bp, Homo sapiens
caaatctcagctccc

SEQ ID NO: 82183 - DNA, 15 bp, Homo sapiens
acaaatctcagctcc

SEQ ID NO: 82184 - DNA, 15 bp, Homo sapiens
tacaaatctcagctc

SEQ ID NO: 82185 - DNA, 15 bp, Homo sapiens
atacaaatctcagct

SEQ ID NO: 82186 - DNA, 15 bp, Homo sapiens
gatacaaatctcagc

SEQ ID NO: 82187 - DNA, 15 bp, Homo sapiens
agatacaaatctcag

SEQ ID NO: 82188 - DNA, 15 bp, Homo sapiens
cagatacaaatctca

SEQ ID NO: 82189 - DNA, 15 bp, Homo sapiens
ccagatacaaatctc

SEQ ID NO: 82190 - DNA, 15 bp, Homo sapiens
accagatacaaatct

SEQ ID NO: 82191 - DNA, 15 bp, Homo sapiens
aaccagatacaaatc

SEQ ID NO: 82192 - DNA, 15 bp, Homo sapiens
gaaccagatacaaat

SEQ ID NO: 82193 - DNA, 15 bp, Homo sapiens
tgaaccagatacaaa

SEQ ID NO: 82194 - DNA, 15 bp, Homo sapiens
gtgaaccagatacaa

SEQ ID NO: 82195 - DNA, 15 bp, Homo sapiens
agtgaaccagataca

SEQ ID NO: 82196 - DNA, 15 bp, Homo sapiens
aagtgaaccagatac

SEQ ID NO: 82197 - DNA, 15 bp, Homo sapiens
aaagtgaaccagata

SEQ ID NO: 82198 - DNA, 15 bp, Homo sapiens
gaaagtgaaccagat

SEQ ID NO: 82199 - DNA, 15 bp, Homo sapiens
tgaaagtgaaccaga

SEQ ID NO: 82200 - DNA, 15 bp, Homo sapiens
atgaaagtgaaccag

SEQ ID NO: 82201 - DNA, 15 bp, Homo sapiens
tatgaaagtgaacca

SEQ ID NO: 82202 - DNA, 15 bp, Homo sapiens
atatgaaagtgaacc

SEQ ID NO: 82203 - DNA, 15 bp, Homo sapiens
gatatgaaagtgaac

SEQ ID NO: 82204 - DNA, 15 bp, Homo sapiens
tgatatgaaagtgaa

SEQ ID NO: 82205 - DNA, 15 bp, Homo sapiens
ttgatatgaaagtga

SEQ ID NO: 82206 - DNA, 15 bp, Homo sapiens
cttgatatgaaagtg

SEQ ID NO: 82207 - DNA, 15 bp, Homo sapiens
tcttgatatgaaagt

SEQ ID NO: 82208 - DNA, 15 bp, Homo sapiens
ctcttgatatgaaag

SEQ ID NO: 82209 - DNA, 15 bp, Homo sapiens
gctcttgatatgaaa

SEQ ID NO: 82210 - DNA, 15 bp, Homo sapiens
ggctcttgatatgaa

SEQ ID NO: 82211 - DNA, 15 bp, Homo sapiens
gggctcttgatatga

SEQ ID NO: 82212 - DNA, 15 bp, Homo sapiens
tgggctcttgatatg

SEQ ID NO: 82213 - DNA, 15 bp, Homo sapiens
ctgggctcttgatat

SEQ ID NO: 82214 - DNA, 15 bp, Homo sapiens
gctgggctcttgata

SEQ ID NO: 82215 - DNA, 15 bp, Homo sapiens
ggctgggctcttgat

SEQ ID NO: 82216 - DNA, 15 bp, Homo sapiens
gggctgggctcttga

SEQ ID NO: 82217 - DNA, 15 bp, Homo sapiens
tgggctgggctcttg

SEQ ID NO: 82218 - DNA, 15 bp, Homo sapiens
ctgggctgggctctt

SEQ ID NO: 82219 - DNA, 15 bp, Homo sapiens
actgggctgggctct

SEQ ID NO: 82220 - DNA, 15 bp, Homo sapiens
cactgggctgggctc

SEQ ID NO: 82221 - DNA, 15 bp, Homo sapiens
gcactgggctgggct

SEQ ID NO: 82222 - DNA, 15 bp, Homo sapiens
ggcactgggctgggc

SEQ ID NO: 82223 - DNA, 15 bp, Homo sapiens
aggcactgggctggg

SEQ ID NO: 82224 - DNA, 15 bp, Homo sapiens
caggcactgggctgg

SEQ ID NO: 82225 - DNA, 15 bp, Homo sapiens
tcaggcactgggctg

SEQ ID NO: 82226 - DNA, 15 bp, Homo sapiens
gtcaggcactgggct

SEQ ID NO: 82227 - DNA, 15 bp, Homo sapiens
tgtcaggcactgggc

SEQ ID NO: 82228 - DNA, 15 bp, Homo sapiens
atgtcaggcactggg

SEQ ID NO: 82229 - DNA, 15 bp, Homo sapiens
aatgtcaggcactgg

SEQ ID NO: 82230 - DNA, 15 bp, Homo sapiens
aaatgtcaggcactg

SEQ ID NO: 82231 - DNA, 15 bp, Homo sapiens
taaatgtcaggcact

SEQ ID NO: 82232 - DNA, 15 bp, Homo sapiens
ctaaatgtcaggcac

SEQ ID NO: 82233 - DNA, 15 bp, Homo sapiens
actaaatgtcaggca

SEQ ID NO: 82234 - DNA, 15 bp, Homo sapiens
tactaaatgtcaggc

SEQ ID NO: 82235 - DNA, 15 bp, Homo sapiens
ttactaaatgtcagg

SEQ ID NO: 82236 - DNA, 15 bp, Homo sapiens
cttactaaatgtcag

SEQ ID NO: 82237 - DNA, 15 bp, Homo sapiens
ccttactaaatgtca

SEQ ID NO: 82238 - DNA, 15 bp, Homo sapiens
gccttactaaatgtc

SEQ ID NO: 82239 - DNA, 15 bp, Homo sapiens
agccttactaaatgt

SEQ ID NO: 82240 - DNA, 15 bp, Homo sapiens
gagccttactaaatg

SEQ ID NO: 82241 - DNA, 15 bp, Homo sapiens
tgagccttactaaat

SEQ ID NO: 82242 - DNA, 15 bp, Homo sapiens
ttgagccttactaaa

SEQ ID NO: 82243 - DNA, 15 bp, Homo sapiens
attgagccttactaa

SEQ ID NO: 82244 - DNA, 15 bp, Homo sapiens
gattgagccttacta

SEQ ID NO: 82245 - DNA, 15 bp, Homo sapiens
tgattgagccttact

SEQ ID NO: 82246 - DNA, 15 bp, Homo sapiens
atgattgagccttac

SEQ ID NO: 82247 - DNA, 15 bp, Homo sapiens
aatgattgagcctta

SEQ ID NO: 82248 - DNA, 15 bp, Homo sapiens
taatgattgagcctt

SEQ ID NO: 82249 - DNA, 15 bp, Homo sapiens
gtaatgattgagcct

SEQ ID NO: 82250 - DNA, 15 bp, Homo sapiens
tgtaatgattgagcc

SEQ ID NO: 82251 - DNA, 15 bp, Homo sapiens
atgtaatgattgagc

SEQ ID NO: 82252 - DNA, 15 bp, Homo sapiens
tatgtaatgattgag

SEQ ID NO: 82253 - DNA, 15 bp, Homo sapiens
atatgtaatgattga

SEQ ID NO: 82254 - DNA, 15 bp, Homo sapiens
aatatgtaatgattg

SEQ ID NO: 82255 - DNA, 15 bp, Homo sapiens
caatatgtaatgatt

SEQ ID NO: 82256 - DNA, 15 bp, Homo sapiens
tcaatatgtaatgat

SEQ ID NO: 82257 - DNA, 15 bp, Homo sapiens
ttcaatatgtaatga

SEQ ID NO: 82258 - DNA, 15 bp, Homo sapiens
gttcaatatgtaatg

SEQ ID NO: 82259 - DNA, 15 bp, Homo sapiens
tgttcaatatgtaat

SEQ ID NO: 82260 - DNA, 15 bp, Homo sapiens
ttgttcaatatgtaa

SEQ ID NO: 82261 - DNA, 15 bp, Homo sapiens
tttgttcaatatgta

SEQ ID NO: 82262 - DNA, 15 bp, Homo sapiens
ttttgttcaatatgt

SEQ ID NO: 82263 - DNA, 15 bp, Homo sapiens
cttttgttcaatatg

SEQ ID NO: 82264 - DNA, 15 bp, Homo sapiens
tcttttgttcaatat

SEQ ID NO: 82265 - DNA, 15 bp, Homo sapiens
ttcttttgttcaata

SEQ ID NO: 82266 - DNA, 15 bp, Homo sapiens
cttcttttgttcaat

SEQ ID NO: 82267 - DNA, 15 bp, Homo sapiens
tcttcttttgttcaa

SEQ ID NO: 82268 - DNA, 15 bp, Homo sapiens
atcttcttttgttca

SEQ ID NO: 82269 - DNA, 15 bp, Homo sapiens
catcttcttttgttc

SEQ ID NO: 82270 - DNA, 15 bp, Homo sapiens
acatcttcttttgtt

SEQ ID NO: 82271 - DNA, 15 bp, Homo sapiens
aacatcttcttttgt

SEQ ID NO: 82272 - DNA, 15 bp, Homo sapiens
taacatcttcttttg

SEQ ID NO: 82273 - DNA, 15 bp, Homo sapiens
ttaacatcttctttt

SEQ ID NO: 82274 - DNA, 15 bp, Homo sapiens
gttaacatcttcttt

SEQ ID NO: 82275 - DNA, 15 bp, Homo sapiens
agttaacatcttctt

SEQ ID NO: 82276 - DNA, 15 bp, Homo sapiens
aagttaacatcttct

SEQ ID NO: 82277 - DNA, 15 bp, Homo sapiens
aaagttaacatcttc

SEQ ID NO: 82278 - DNA, 15 bp, Homo sapiens
taaagttaacatctt

SEQ ID NO: 82279 - DNA, 15 bp, Homo sapiens
ctaaagttaacatct

SEQ ID NO: 82280 - DNA, 15 bp, Homo sapiens
actaaagttaacatc

SEQ ID NO: 82281 - DNA, 15 bp, Homo sapiens
tactaaagttaacat

SEQ ID NO: 82282 - DNA, 15 bp, Homo sapiens
ttactaaagttaaca

SEQ ID NO: 82283 - DNA, 15 bp, Homo sapiens
attactaaagttaac

SEQ ID NO: 82284 - DNA, 15 bp, Homo sapiens
cattactaaagttaa

SEQ ID NO: 82285 - DNA, 15 bp, Homo sapiens
acattactaaagtta

SEQ ID NO: 82286 - DNA, 15 bp, Homo sapiens
gacattactaaagtt

SEQ ID NO: 82287 - DNA, 15 bp, Homo sapiens
agacattactaaagt

SEQ ID NO: 82288 - DNA, 15 bp, Homo sapiens
cagacattactaaag

SEQ ID NO: 82289 - DNA, 15 bp, Homo sapiens
acagacattactaaa

SEQ ID NO: 82290 - DNA, 15 bp, Homo sapiens
tacagacattactaa

SEQ ID NO: 82291 - DNA, 15 bp, Homo sapiens
gtacagacattacta

SEQ ID NO: 82292 - DNA, 15 bp, Homo sapiens
agtacagacattact

SEQ ID NO: 82293 - DNA, 15 bp, Homo sapiens
aagtacagacattac

SEQ ID NO: 82294 - DNA, 15 bp, Homo sapiens
caagtacagacatta

SEQ ID NO: 82295 - DNA, 15 bp, Homo sapiens
acaagtacagacatt

SEQ ID NO: 82296 - DNA, 15 bp, Homo sapiens
aacaagtacagacat

SEQ ID NO: 82297 - DNA, 15 bp, Homo sapiens
gaacaagtacagaca

SEQ ID NO: 82298 - DNA, 15 bp, Homo sapiens
agaacaagtacagac

SEQ ID NO: 82299 - DNA, 15 bp, Homo sapiens
aagaacaagtacaga

SEQ ID NO: 82300 - DNA, 15 bp, Homo sapiens
aaagaacaagtacag

SEQ ID NO: 82301 - DNA, 15 bp, Homo sapiens
caaagaacaagtaca

SEQ ID NO: 82302 - DNA, 15 bp, Homo sapiens
gcaaagaacaagtac

SEQ ID NO: 82303 - DNA, 15 bp, Homo sapiens
agcaaagaacaagta

SEQ ID NO: 82304 - DNA, 15 bp, Homo sapiens
cagcaaagaacaagt

SEQ ID NO: 82305 - DNA, 15 bp, Homo sapiens
tcagcaaagaacaag

SEQ ID NO: 82306 - DNA, 15 bp, Homo sapiens
atcagcaaagaacaa

SEQ ID NO: 82307 - DNA, 15 bp, Homo sapiens
aatcagcaaagaaca

SEQ ID NO: 82308 - DNA, 15 bp, Homo sapiens
taatcagcaaagaac

SEQ ID NO: 82309 - DNA, 15 bp, Homo sapiens
ataatcagcaaagaa

SEQ ID NO: 82310 - DNA, 15 bp, Homo sapiens
gataatcagcaaaga

SEQ ID NO: 82311 - DNA, 15 bp, Homo sapiens
agataatcagcaaag

SEQ ID NO: 82312 - DNA, 15 bp, Homo sapiens
tagataatcagcaaa

SEQ ID NO: 82313 - DNA, 15 bp, Homo sapiens
ttagataatcagcaa

SEQ ID NO: 82314 - DNA, 15 bp, Homo sapiens
gttagataatcagca

SEQ ID NO: 82315 - DNA, 15 bp, Homo sapiens
ggttagataatcagc

SEQ ID NO: 82316 - DNA, 15 bp, Homo sapiens
tggttagataatcag

SEQ ID NO: 82317 - DNA, 15 bp, Homo sapiens
ttggttagataatca

SEQ ID NO: 82318 - DNA, 15 bp, Homo sapiens
gttggttagataatc

SEQ ID NO: 82319 - DNA, 15 bp, Homo sapiens
agttggttagataat

SEQ ID NO: 82320 - DNA, 15 bp, Homo sapiens
gagttggttagataa

SEQ ID NO: 82321 - DNA, 15 bp, Homo sapiens
agagttggttagata

SEQ ID NO: 82322 - DNA, 15 bp, Homo sapiens
cagagttggttagat

SEQ ID NO: 82323 - DNA, 15 bp, Homo sapiens
ccagagttggttaga

SEQ ID NO: 82324 - DNA, 15 bp, Homo sapiens
accagagttggttag

SEQ ID NO: 82325 - DNA, 15 bp, Homo sapiens
aaccagagttggtta

SEQ ID NO: 82326 - DNA, 15 bp, Homo sapiens
aaaccagagttggtt

SEQ ID NO: 82327 - DNA, 15 bp, Homo sapiens
aaaaccagagttggt

SEQ ID NO: 82328 - DNA, 15 bp, Homo sapiens
aaaaaccagagttgg

SEQ ID NO: 82329 - DNA, 15 bp, Homo sapiens
taaaaaccagagttg

SEQ ID NO: 82330 - DNA, 15 bp, Homo sapiens
ataaaaaccagagtt

SEQ ID NO: 82331 - DNA, 15 bp, Homo sapiens
aataaaaaccagagt

SEQ ID NO: 82332 - DNA, 15 bp, Homo sapiens
taataaaaaccagag

SEQ ID NO: 82333 - DNA, 15 bp, Homo sapiens
ataataaaaaccaga

SEQ ID NO: 82334 - DNA, 15 bp, Homo sapiens
gataataaaaaccag

SEQ ID NO: 82335 - DNA, 15 bp, Homo sapiens
agataataaaaacca

SEQ ID NO: 82336 - DNA, 15 bp, Homo sapiens
tagataataaaaacc

SEQ ID NO: 82337 - DNA, 15 bp, Homo sapiens
atagataataaaaac

SEQ ID NO: 82338 - DNA, 15 bp, Homo sapiens
tatagataataaaaa

SEQ ID NO: 82339 - DNA, 15 bp, Homo sapiens
ttatagataataaaa

SEQ ID NO: 82340 - DNA, 15 bp, Homo sapiens
cttatagataataaa

SEQ ID NO: 82341 - DNA, 15 bp, Homo sapiens
gcttatagataataa

SEQ ID NO: 82342 - DNA, 15 bp, Homo sapiens
tgcttatagataata

SEQ ID NO: 82343 - DNA, 15 bp, Homo sapiens
atgcttatagataat

SEQ ID NO: 82344 - DNA, 15 bp, Homo sapiens
aatgcttatagataa

SEQ ID NO: 82345 - DNA, 15 bp, Homo sapiens
aaatgcttatagata

SEQ ID NO: 82346 - DNA, 15 bp, Homo sapiens
taaatgcttatagat

SEQ ID NO: 82347 - DNA, 15 bp, Homo sapiens
ataaatgcttataga

SEQ ID NO: 82348 - DNA, 15 bp, Homo sapiens
tataaatgcttatag

SEQ ID NO: 82349 - DNA, 15 bp, Homo sapiens
ttataaatgcttata

SEQ ID NO: 82350 - DNA, 15 bp, Homo sapiens
tttataaatgcttat

SEQ ID NO: 82351 - DNA, 15 bp, Homo sapiens
ttttataaatgctta

SEQ ID NO: 82352 - DNA, 15 bp, Homo sapiens
tttttataaatgctt

SEQ ID NO: 82353 - DNA, 15 bp, Homo sapiens
atttttataaatgct

SEQ ID NO: 82354 - DNA, 15 bp, Homo sapiens
tatttttataaatgc

SEQ ID NO: 82355 - DNA, 15 bp, Homo sapiens
gtatttttataaatg

SEQ ID NO: 82356 - DNA, 15 bp, Homo sapiens
tgtatttttataaat

SEQ ID NO: 82357 - DNA, 15 bp, Homo sapiens
ttgtatttttataaa

SEQ ID NO: 82358 - DNA, 15 bp, Homo sapiens
cttgtatttttataa

SEQ ID NO: 82359 - DNA, 15 bp, Homo sapiens
acttgtatttttata

SEQ ID NO: 82360 - DNA, 15 bp, Homo sapiens
cacttgtatttttat

SEQ ID NO: 82361 - DNA, 15 bp, Homo sapiens
tcacttgtattttta

SEQ ID NO: 82362 - DNA, 15 bp, Homo sapiens
atcacttgtattttt

SEQ ID NO: 82363 - DNA, 15 bp, Homo sapiens
aatcacttgtatttt

SEQ ID NO: 82364 - DNA, 15 bp, Homo sapiens
gaatcacttgtattt

SEQ ID NO: 82365 - DNA, 15 bp, Homo sapiens
ggaatcacttgtatt

SEQ ID NO: 82366 - DNA, 15 bp, Homo sapiens
aggaatcacttgtat

SEQ ID NO: 82367 - DNA, 15 bp, Homo sapiens
aaggaatcacttgta

SEQ ID NO: 82368 - DNA, 15 bp, Homo sapiens
taaggaatcacttgt

SEQ ID NO: 82369 - DNA, 15 bp, Homo sapiens
ataaggaatcacttg

SEQ ID NO: 82370 - DNA, 15 bp, Homo sapiens
tataaggaatcactt

SEQ ID NO: 82371 - DNA, 15 bp, Homo sapiens
ttataaggaatcact

SEQ ID NO: 82372 - DNA, 15 bp, Homo sapiens
tttataaggaatcac

SEQ ID NO: 82373 - DNA, 15 bp, Homo sapiens
ctttataaggaatca

SEQ ID NO: 82374 - DNA, 15 bp, Homo sapiens
cctttataaggaatc

SEQ ID NO: 82375 - DNA, 15 bp, Homo sapiens
acctttataaggaat

SEQ ID NO: 82376 - DNA, 15 bp, Homo sapiens
cacctttataaggaa

SEQ ID NO: 82377 - DNA, 15 bp, Homo sapiens
tcacctttataagga

SEQ ID NO: 82378 - DNA, 15 bp, Homo sapiens
ttcacctttataagg

SEQ ID NO: 82379 - DNA, 15 bp, Homo sapiens
tttcacctttataag

SEQ ID NO: 82380 - DNA, 15 bp, Homo sapiens
ttttcacctttataa

SEQ ID NO: 82381 - DNA, 15 bp, Homo sapiens
attttcacctttata

SEQ ID NO: 82382 - DNA, 15 bp, Homo sapiens
aattttcacctttat

SEQ ID NO: 82383 - DNA, 15 bp, Homo sapiens
caattttcaccttta

SEQ ID NO: 82384 - DNA, 15 bp, Homo sapiens
acaattttcaccttt

SEQ ID NO: 82385 - DNA, 15 bp, Homo sapiens
aacaattttcacctt

SEQ ID NO: 82386 - DNA, 15 bp, Homo sapiens
aaacaattttcacct

SEQ ID NO: 82387 - DNA, 15 bp, Homo sapiens
aaaacaattttcacc

SEQ ID NO: 82388 - DNA, 15 bp, Homo sapiens
taaaacaattttcac

SEQ ID NO: 82389 - DNA, 15 bp, Homo sapiens
ttaaaacaattttca

SEQ ID NO: 82390 - DNA, 15 bp, Homo sapiens
attaaaacaattttc

SEQ ID NO: 82391 - DNA, 15 bp, Homo sapiens
tattaaaacaatttt

SEQ ID NO: 82392 - DNA, 15 bp, Homo sapiens
atattaaaacaattt

SEQ ID NO: 82393 - DNA, 15 bp, Homo sapiens
catattaaaacaatt

SEQ ID NO: 82394 - DNA, 15 bp, Homo sapiens
acatattaaaacaat

SEQ ID NO: 82395 - DNA, 15 bp, Homo sapiens
tacatattaaaacaa

SEQ ID NO: 82396 - DNA, 15 bp, Homo sapiens
ttacatattaaaaca

SEQ ID NO: 82397 - DNA, 15 bp, Homo sapiens
tttacatattaaaac

SEQ ID NO: 82398 - DNA, 15 bp, Homo sapiens
ctttacatattaaaa

SEQ ID NO: 82399 - DNA, 15 bp, Homo sapiens
actttacatattaaa

SEQ ID NO: 82400 - DNA, 15 bp, Homo sapiens
aactttacatattaa

SEQ ID NO: 82401 - DNA, 15 bp, Homo sapiens
aaactttacatatta

SEQ ID NO: 82402 - DNA, 15 bp, Homo sapiens
aaaactttacatatt

SEQ ID NO: 82403 - DNA, 15 bp, Homo sapiens
taaaactttacatat

SEQ ID NO: 82404 - DNA, 15 bp, Homo sapiens
ttaaaactttacata

SEQ ID NO: 82405 - DNA, 15 bp, Homo sapiens
tttaaaactttacat

SEQ ID NO: 82406 - DNA, 15 bp, Homo sapiens
ttttaaaactttaca

SEQ ID NO: 82407 - DNA, 15 bp, Homo sapiens
tttttaaaactttac

SEQ ID NO: 82408 - DNA, 15 bp, Homo sapiens
atttttaaaacttta

SEQ ID NO: 82409 - DNA, 15 bp, Homo sapiens
aatttttaaaacttt

SEQ ID NO: 82410 - DNA, 15 bp, Homo sapiens
aaatttttaaaactt

SEQ ID NO: 82411 - DNA, 15 bp, Homo sapiens
aaaatttttaaaact

SEQ ID NO: 82412 - DNA, 15 bp, Homo sapiens
aaaaatttttaaaac

SEQ ID NO: 82413 - DNA, 15 bp, Homo sapiens
taaaaatttttaaaa

SEQ ID NO: 82414 - DNA, 15 bp, Homo sapiens
ataaaaatttttaaa

SEQ ID NO: 82415 - DNA, 15 bp, Homo sapiens
aataaaaatttttaa

SEQ ID NO: 82416 - DNA, 15 bp, Homo sapiens
aaataaaaattttta

SEQ ID NO: 82417 - DNA, 15 bp, Homo sapiens
taaataaaaattttt

SEQ ID NO: 82418 - DNA, 15 bp, Homo sapiens
ttaaataaaaatttt

SEQ ID NO: 82419 - DNA, 15 bp, Homo sapiens
cttaaataaaaattt

SEQ ID NO: 82420 - DNA, 15 bp, Homo sapiens
ccttaaataaaaatt

SEQ ID NO: 82421 - DNA, 15 bp, Homo sapiens
gccttaaataaaaat

SEQ ID NO: 82422 - DNA, 15 bp, Homo sapiens
ggccttaaataaaaa

SEQ ID NO: 82423 - DNA, 15 bp, Homo sapiens
tggccttaaataaaa

SEQ ID NO: 82424 - DNA, 15 bp, Homo sapiens
ctggccttaaataaa

SEQ ID NO: 82425 - DNA, 15 bp, Homo sapiens
cctggccttaaataa

SEQ ID NO: 82426 - DNA, 15 bp, Homo sapiens
gcctggccttaaata

SEQ ID NO: 82427 - DNA, 15 bp, Homo sapiens
tgcctggccttaaat

SEQ ID NO: 82428 - DNA, 15 bp, Homo sapiens
atgcctggccttaaa

SEQ ID NO: 82429 - DNA, 15 bp, Homo sapiens
catgcctggccttaa

SEQ ID NO: 82430 - DNA, 15 bp, Homo sapiens
ccatgcctggcctta

SEQ ID NO: 82431 - DNA, 15 bp, Homo sapiens
accatgcctggcctt

SEQ ID NO: 82432 - DNA, 15 bp, Homo sapiens
caccatgcctggcct

SEQ ID NO: 82433 - DNA, 15 bp, Homo sapiens
ccaccatgcctggcc

SEQ ID NO: 82434 - DNA, 15 bp, Homo sapiens
cccaccatgcctggc

SEQ ID NO: 82435 - DNA, 15 bp, Homo sapiens
acccaccatgcctgg

SEQ ID NO: 82436 - DNA, 15 bp, Homo sapiens
gacccaccatgcctg

SEQ ID NO: 82437 - DNA, 15 bp, Homo sapiens
tgacccaccatgcct

SEQ ID NO: 82438 - DNA, 15 bp, Homo sapiens
atgacccaccatgcc

SEQ ID NO: 82439 - DNA, 15 bp, Homo sapiens
catgacccaccatgc

SEQ ID NO: 82440 - DNA, 15 bp, Homo sapiens
tcatgacccaccatg

SEQ ID NO: 82441 - DNA, 15 bp, Homo sapiens
gtcatgacccaccat

SEQ ID NO: 82442 - DNA, 15 bp, Homo sapiens
agtcatgacccacca

SEQ ID NO: 82443 - DNA, 15 bp, Homo sapiens
cagtcatgacccacc

SEQ ID NO: 82444 - DNA, 15 bp, Homo sapiens
acagtcatgacccac

SEQ ID NO: 82445 - DNA, 15 bp, Homo sapiens
tacagtcatgaccca

SEQ ID NO: 82446 - DNA, 15 bp, Homo sapiens
ttacagtcatgaccc

SEQ ID NO: 82447 - DNA, 15 bp, Homo sapiens
attacagtcatgacc

SEQ ID NO: 82448 - DNA, 15 bp, Homo sapiens
gattacagtcatgac

SEQ ID NO: 82449 - DNA, 15 bp, Homo sapiens
tgattacagtcatga

SEQ ID NO: 82450 - DNA, 15 bp, Homo sapiens
gtgattacagtcatg

SEQ ID NO: 82451 - DNA, 15 bp, Homo sapiens
tgtgattacagtcat

SEQ ID NO: 82452 - DNA, 15 bp, Homo sapiens
ctgtgattacagtca

SEQ ID NO: 82453 - DNA, 15 bp, Homo sapiens
gctgtgattacagtc

SEQ ID NO: 82454 - DNA, 15 bp, Homo sapiens
tgctgtgattacagt

SEQ ID NO: 82455 - DNA, 15 bp, Homo sapiens
gtgctgtgattacag

SEQ ID NO: 82456 - DNA, 15 bp, Homo sapiens
agtgctgtgattaca

SEQ ID NO: 82457 - DNA, 15 bp, Homo sapiens
aagtgctgtgattac

SEQ ID NO: 82458 - DNA, 15 bp, Homo sapiens
aaagtgctgtgatta

SEQ ID NO: 82459 - DNA, 15 bp, Homo sapiens
caaagtgctgtgatt

SEQ ID NO: 82460 - DNA, 15 bp, Homo sapiens
ccaaagtgctgtgat

SEQ ID NO: 82461 - DNA, 15 bp, Homo sapiens
cccaaagtgctgtga

SEQ ID NO: 82462 - DNA, 15 bp, Homo sapiens
tcccaaagtgctgtg

SEQ ID NO: 82463 - DNA, 15 bp, Homo sapiens
ctcccaaagtgctgt

SEQ ID NO: 82464 - DNA, 15 bp, Homo sapiens
ggcccgccttggcct

SEQ ID NO: 82465 - DNA, 15 bp, Homo sapiens
cggcccgccttggcc

SEQ ID NO: 82466 - DNA, 15 bp, Homo sapiens
tcggcccgccttggc

SEQ ID NO: 82467 - DNA, 15 bp, Homo sapiens
atcggcccgccttgg

SEQ ID NO: 82468 - DNA, 15 bp, Homo sapiens
gatcggcccgccttg

SEQ ID NO: 82469 - DNA, 15 bp, Homo sapiens
tgatcggcccgcctt

SEQ ID NO: 82470 - DNA, 15 bp, Homo sapiens
atgatcggcccgcct

SEQ ID NO: 82471 - DNA, 15 bp, Homo sapiens
catgatcggcccgcc

SEQ ID NO: 82472 - DNA, 15 bp, Homo sapiens
tcatgatcggcccgc

SEQ ID NO: 82473 - DNA, 15 bp, Homo sapiens
ctcatgatcggcccg

SEQ ID NO: 82474 - DNA, 15 bp, Homo sapiens
cctcatgatcggccc

SEQ ID NO: 82475 - DNA, 15 bp, Homo sapiens
acctcatgatcggcc

SEQ ID NO: 82476 - DNA, 15 bp, Homo sapiens
gacctcatgatcggc

SEQ ID NO: 82477 - DNA, 15 bp, Homo sapiens
tgacctcatgatcgg

SEQ ID NO: 82478 - DNA, 15 bp, Homo sapiens
ctgacctcatgatcg

SEQ ID NO: 82479 - DNA, 15 bp, Homo sapiens
gctgacctcatgatc

SEQ ID NO: 82480 - DNA, 15 bp, Homo sapiens
ggctgacctcatgat

SEQ ID NO: 82481 - DNA, 15 bp, Homo sapiens
aggctgacctcatga

SEQ ID NO: 82482 - DNA, 15 bp, Homo sapiens
caggctgacctcatg

SEQ ID NO: 82483 - DNA, 15 bp, Homo sapiens
ccaggctgacctcat

SEQ ID NO: 82484 - DNA, 15 bp, Homo sapiens
gccaggctgacctca

SEQ ID NO: 82485 - DNA, 15 bp, Homo sapiens
ggccaggctgacctc

SEQ ID NO: 82486 - DNA, 15 bp, Homo sapiens
tggccaggctgacct

SEQ ID NO: 82487 - DNA, 15 bp, Homo sapiens
ttggccaggctgacc

SEQ ID NO: 82488 - DNA, 15 bp, Homo sapiens
gttggccaggctgac

SEQ ID NO: 82489 - DNA, 15 bp, Homo sapiens
tgttggccaggctga

SEQ ID NO: 82490 - DNA, 15 bp, Homo sapiens
agagtttcaccatgt

SEQ ID NO: 82491 - DNA, 15 bp, Homo sapiens
cagagtttcaccatg

SEQ ID NO: 82492 - DNA, 15 bp, Homo sapiens
acagagtttcaccat

SEQ ID NO: 82493 - DNA, 15 bp, Homo sapiens
gacagagtttcacca

SEQ ID NO: 82494 - DNA, 15 bp, Homo sapiens
agacagagtttcacc

SEQ ID NO: 82495 - DNA, 15 bp, Homo sapiens
gagacagagtttcac

SEQ ID NO: 82496 - DNA, 15 bp, Homo sapiens
agagacagagtttca

SEQ ID NO: 82497 - DNA, 15 bp, Homo sapiens
tagagacagagtttc

SEQ ID NO: 82498 - DNA, 15 bp, Homo sapiens
gtagagacagagttt

SEQ ID NO: 82499 - DNA, 15 bp, Homo sapiens
agtagagacagagtt

SEQ ID NO: 82500 - DNA, 15 bp, Homo sapiens
tagtagagacagagt

SEQ ID NO: 82501 - DNA, 15 bp, Homo sapiens
ttagtagagacagag

SEQ ID NO: 82502 - DNA, 15 bp, Homo sapiens
tttagtagagacaga

SEQ ID NO: 82503 - DNA, 15 bp, Homo sapiens
gcccaccaccacacc

SEQ ID NO: 82504 - DNA, 15 bp, Homo sapiens
tgcccaccaccacac

SEQ ID NO: 82505 - DNA, 15 bp, Homo sapiens
gtgcccaccaccaca

SEQ ID NO: 82506 - DNA, 15 bp, Homo sapiens
ggtgcccaccaccac

SEQ ID NO: 82507 - DNA, 15 bp, Homo sapiens
aggattataggtgcc

SEQ ID NO: 82508 - DNA, 15 bp, Homo sapiens
taggattataggtgc

SEQ ID NO: 82509 - DNA, 15 bp, Homo sapiens
ctaggattataggtg

SEQ ID NO: 82510 - DNA, 15 bp, Homo sapiens
gctaggattataggt

SEQ ID NO: 82511 - DNA, 15 bp, Homo sapiens
gagtagctaggatta

SEQ ID NO: 82512 - DNA, 15 bp, Homo sapiens
cgagtagctaggatt

SEQ ID NO: 82513 - DNA, 15 bp, Homo sapiens
ccgagtagctaggat

SEQ ID NO: 82514 - DNA, 15 bp, Homo sapiens
cccgagtagctagga

SEQ ID NO: 82515 - DNA, 15 bp, Homo sapiens
tcccgagtagctagg

SEQ ID NO: 82516 - DNA, 15 bp, Homo sapiens
ctcccgagtagctag

SEQ ID NO: 82517 - DNA, 15 bp, Homo sapiens
cctcccgagtagcta

SEQ ID NO: 82518 - DNA, 15 bp, Homo sapiens
ggattctcctgcctc

SEQ ID NO: 82519 - DNA, 15 bp, Homo sapiens
aggattctcctgcct

SEQ ID NO: 82520 - DNA, 15 bp, Homo sapiens
aaggattctcctgcc

SEQ ID NO: 82521 - DNA, 15 bp, Homo sapiens
aaaggattctcctgc

SEQ ID NO: 82522 - DNA, 15 bp, Homo sapiens
caaaggattctcctg

SEQ ID NO: 82523 - DNA, 15 bp, Homo sapiens
tcaaaggattctcct

SEQ ID NO: 82524 - DNA, 15 bp, Homo sapiens
ttcaaaggattctcc

SEQ ID NO: 82525 - DNA, 15 bp, Homo sapiens
attcaaaggattctc

SEQ ID NO: 82526 - DNA, 15 bp, Homo sapiens
gattcaaaggattct

SEQ ID NO: 82527 - DNA, 15 bp, Homo sapiens
agattcaaaggattc

SEQ ID NO: 82528 - DNA, 15 bp, Homo sapiens
cagattcaaaggatt

SEQ ID NO: 82529 - DNA, 15 bp, Homo sapiens
ccagattcaaaggat

SEQ ID NO: 82530 - DNA, 15 bp, Homo sapiens
tccagattcaaagga

SEQ ID NO: 82531 - DNA, 15 bp, Homo sapiens
ctccagattcaaagg

SEQ ID NO: 82532 - DNA, 15 bp, Homo sapiens
cctccagattcaaag

SEQ ID NO: 82533 - DNA, 15 bp, Homo sapiens
gcctccagattcaaa

SEQ ID NO: 82534 - DNA, 15 bp, Homo sapiens
cgcctccagattcaa

SEQ ID NO: 82535 - DNA, 15 bp, Homo sapiens
ccgcctccagattca

SEQ ID NO: 82536 - DNA, 15 bp, Homo sapiens
tccgcctccagattc

SEQ ID NO: 82537 - DNA, 15 bp, Homo sapiens
ctccgcctccagatt

SEQ ID NO: 82538 - DNA, 15 bp, Homo sapiens
cctccgcctccagat

SEQ ID NO: 82539 - DNA, 15 bp, Homo sapiens
acctccgcctccaga

SEQ ID NO: 82540 - DNA, 15 bp, Homo sapiens
cgatctcggctcact

SEQ ID NO: 82541 - DNA, 15 bp, Homo sapiens
acgatctcggctcac

SEQ ID NO: 82542 - DNA, 15 bp, Homo sapiens
cacgatctcggctca

SEQ ID NO: 82543 - DNA, 15 bp, Homo sapiens
gcacgatctcggctc

SEQ ID NO: 82544 - DNA, 15 bp, Homo sapiens
ggcacgatctcggct

SEQ ID NO: 82545 - DNA, 15 bp, Homo sapiens
tggcacgatctcggc

SEQ ID NO: 82546 - DNA, 15 bp, Homo sapiens
atggcacgatctcgg

SEQ ID NO: 82547 - DNA, 15 bp, Homo sapiens
aatggcacgatctcg

SEQ ID NO: 82548 - DNA, 15 bp, Homo sapiens
caatggcacgatctc

SEQ ID NO: 82549 - DNA, 15 bp, Homo sapiens
gcaatggcacgatct

SEQ ID NO: 82550 - DNA, 15 bp, Homo sapiens
tgcaatggcacgatc

SEQ ID NO: 82551 - DNA, 15 bp, Homo sapiens
gtgcaatggcacgat

SEQ ID NO: 82552 - DNA, 15 bp, Homo sapiens
agtgcaatggcacga

SEQ ID NO: 82553 - DNA, 15 bp, Homo sapiens
gagtgcaatggcacg

SEQ ID NO: 82554 - DNA, 15 bp, Homo sapiens
tgagtgcaatggcac

SEQ ID NO: 82555 - DNA, 15 bp, Homo sapiens
ttgagtgcaatggca

SEQ ID NO: 82556 - DNA, 15 bp, Homo sapiens
cttgagtgcaatggc

SEQ ID NO: 82557 - DNA, 15 bp, Homo sapiens
gcttgagtgcaatgg

SEQ ID NO: 82558 - DNA, 15 bp, Homo sapiens
ggcttgagtgcaatg

SEQ ID NO: 82559 - DNA, 15 bp, Homo sapiens
aggcttgagtgcaat

SEQ ID NO: 82560 - DNA, 15 bp, Homo sapiens
caggcttgagtgcaa

SEQ ID NO: 82561 - DNA, 15 bp, Homo sapiens
ccaggcttgagtgca

SEQ ID NO: 82562 - DNA, 15 bp, Homo sapiens
cccaggcttgagtgc

SEQ ID NO: 82563 - DNA, 15 bp, Homo sapiens
acccaggcttgagtg

SEQ ID NO: 82564 - DNA, 15 bp, Homo sapiens
cacccaggcttgagt

SEQ ID NO: 82565 - DNA, 15 bp, Homo sapiens
tcacccaggcttgag

SEQ ID NO: 82566 - DNA, 15 bp, Homo sapiens
gtcacccaggcttga

SEQ ID NO: 82567 - DNA, 15 bp, Homo sapiens
tgtcacccaggcttg

SEQ ID NO: 82568 - DNA, 15 bp, Homo sapiens
ctgtcacccaggctt

SEQ ID NO: 82569 - DNA, 15 bp, Homo sapiens
cctgtcacccaggct

SEQ ID NO: 82570 - DNA, 15 bp, Homo sapiens
ccctgtcacccaggc

SEQ ID NO: 82571 - DNA, 15 bp, Homo sapiens
gccctgtcacccagg

SEQ ID NO: 82572 - DNA, 15 bp, Homo sapiens
cgccctgtcacccag

SEQ ID NO: 82573 - DNA, 15 bp, Homo sapiens
tcgccctgtcaccca

SEQ ID NO: 82574 - DNA, 15 bp, Homo sapiens
ctcgccctgtcaccc

SEQ ID NO: 82575 - DNA, 15 bp, Homo sapiens
tctcgccctgtcacc

SEQ ID NO: 82576 - DNA, 15 bp, Homo sapiens
gtctcgccctgtcac

SEQ ID NO: 82577 - DNA, 15 bp, Homo sapiens
agtctcgccctgtca

SEQ ID NO: 82578 - DNA, 15 bp, Homo sapiens
gagtctcgccctgtc

SEQ ID NO: 82579 - DNA, 15 bp, Homo sapiens
ggagtctcgccctgt

SEQ ID NO: 82580 - DNA, 15 bp, Homo sapiens
tggagtctcgccctg

SEQ ID NO: 82581 - DNA, 15 bp, Homo sapiens
atggagtctcgccct

SEQ ID NO: 82582 - DNA, 15 bp, Homo sapiens
gatggagtctcgccc

SEQ ID NO: 82583 - DNA, 15 bp, Homo sapiens
agatggagtctcgcc

SEQ ID NO: 82584 - DNA, 15 bp, Homo sapiens
gagatggagtctcgc

SEQ ID NO: 82585 - DNA, 15 bp, Homo sapiens
cgagatggagtctcg

SEQ ID NO: 82586 - DNA, 15 bp, Homo sapiens
tcgagatggagtctc

SEQ ID NO: 82587 - DNA, 15 bp, Homo sapiens
ttcgagatggagtct

SEQ ID NO: 82588 - DNA, 15 bp, Homo sapiens
tttcgagatggagtc

SEQ ID NO: 82589 - DNA, 15 bp, Homo sapiens
gtttcgagatggagt

SEQ ID NO: 82590 - DNA, 15 bp, Homo sapiens
tgtttcgagatggag

SEQ ID NO: 82591 - DNA, 15 bp, Homo sapiens
ttgtttcgagatgga

SEQ ID NO: 82592 - DNA, 15 bp, Homo sapiens
gttgtttcgagatgg

SEQ ID NO: 82593 - DNA, 15 bp, Homo sapiens
tgttgtttcgagatg

SEQ ID NO: 82594 - DNA, 15 bp, Homo sapiens
ttgttgtttcgagat

SEQ ID NO: 82595 - DNA, 15 bp, Homo sapiens
gttgttgtttcgaga

SEQ ID NO: 82596 - DNA, 15 bp, Homo sapiens
tgttgttgtttcgag

SEQ ID NO: 82597 - DNA, 15 bp, Homo sapiens
ttgttgttgtttcga

SEQ ID NO: 82598 - DNA, 15 bp, Homo sapiens
gttgttgttgtttcg

SEQ ID NO: 82599 - DNA, 15 bp, Homo sapiens
tgttgttgttgtttc

SEQ ID NO: 82600 - DNA, 15 bp, Homo sapiens
ttgttgttgttgttt

SEQ ID NO: 82601 - DNA, 15 bp, Homo sapiens
gttgttgttgttgtt

SEQ ID NO: 82602 - DNA, 15 bp, Homo sapiens
tgttgttgttgttgt

SEQ ID NO: 82603 - DNA, 15 bp, Homo sapiens
ttgttgttgttgttg

SEQ ID NO: 82604 - DNA, 15 bp, Homo sapiens
tttgttgttgttgtt

SEQ ID NO: 82605 - DNA, 15 bp, Homo sapiens
atttgttgttgttgt

SEQ ID NO: 82606 - DNA, 15 bp, Homo sapiens
aatttgttgttgttg

SEQ ID NO: 82607 - DNA, 15 bp, Homo sapiens
taatttgttgttgtt

SEQ ID NO: 82608 - DNA, 15 bp, Homo sapiens
ataatttgttgttgt

SEQ ID NO: 82609 - DNA, 15 bp, Homo sapiens
aataatttgttgttg

SEQ ID NO: 82610 - DNA, 15 bp, Homo sapiens
aaataatttgttgtt

SEQ ID NO: 82611 - DNA, 15 bp, Homo sapiens
taaataatttgttgt

SEQ ID NO: 82612 - DNA, 15 bp, Homo sapiens
ttaaataatttgttg

SEQ ID NO: 82613 - DNA, 15 bp, Homo sapiens
attaaataatttgtt

SEQ ID NO: 82614 - DNA, 15 bp, Homo sapiens
aattaaataatttgt

SEQ ID NO: 82615 - DNA, 15 bp, Homo sapiens
taattaaataatttg

SEQ ID NO: 82616 - DNA, 15 bp, Homo sapiens
aataattaaataatt

SEQ ID NO: 82617 - DNA, 15 bp, Homo sapiens
aaataattaaataat

SEQ ID NO: 82618 - DNA, 15 bp, Homo sapiens
aaaataattaaataa

SEQ ID NO: 82619 - DNA, 15 bp, Homo sapiens
gaaaataattaaata

SEQ ID NO: 82620 - DNA, 15 bp, Homo sapiens
agaaaataattaaat

SEQ ID NO: 82621 - DNA, 15 bp, Homo sapiens
aagaaaataattaaa

SEQ ID NO: 82622 - DNA, 15 bp, Homo sapiens
gaagaaaataattaa

SEQ ID NO: 82623 - DNA, 15 bp, Homo sapiens
tgaagaaaataatta

SEQ ID NO: 82624 - DNA, 15 bp, Homo sapiens
ttgaagaaaataatt

SEQ ID NO: 82625 - DNA, 15 bp, Homo sapiens
attgaagaaaataat

SEQ ID NO: 82626 - DNA, 15 bp, Homo sapiens
aattgaagaaaataa

SEQ ID NO: 82627 - DNA, 15 bp, Homo sapiens
caattgaagaaaata

SEQ ID NO: 82628 - DNA, 15 bp, Homo sapiens
acaattgaagaaaat

SEQ ID NO: 82629 - DNA, 15 bp, Homo sapiens
aacaattgaagaaaa

SEQ ID NO: 82630 - DNA, 15 bp, Homo sapiens
aaacaattgaagaaa

SEQ ID NO: 82631 - DNA, 15 bp, Homo sapiens
taaacaattgaagaa

SEQ ID NO: 82632 - DNA, 15 bp, Homo sapiens
ataaacaattgaaga

SEQ ID NO: 82633 - DNA, 15 bp, Homo sapiens
aataaacaattgaag

SEQ ID NO: 82634 - DNA, 15 bp, Homo sapiens
taataaacaattgaa

SEQ ID NO: 82635 - DNA, 15 bp, Homo sapiens
ttaataaacaattga

SEQ ID NO: 82636 - DNA, 15 bp, Homo sapiens
gttaataaacaattg

SEQ ID NO: 82637 - DNA, 15 bp, Homo sapiens
ggttaataaacaatt

SEQ ID NO: 82638 - DNA, 15 bp, Homo sapiens
gggttaataaacaat

SEQ ID NO: 82639 - DNA, 15 bp, Homo sapiens
agggttaataaacaa

SEQ ID NO: 82640 - DNA, 15 bp, Homo sapiens
tagggttaataaaca

SEQ ID NO: 82641 - DNA, 15 bp, Homo sapiens
atagggttaataaac

SEQ ID NO: 82642 - DNA, 15 bp, Homo sapiens
tatagggttaataaa

SEQ ID NO: 82643 - DNA, 15 bp, Homo sapiens
ttatagggttaataa

SEQ ID NO: 82644 - DNA, 15 bp, Homo sapiens
attatagggttaata

SEQ ID NO: 82645 - DNA, 15 bp, Homo sapiens
tattatagggttaat

SEQ ID NO: 82646 - DNA, 15 bp, Homo sapiens
atattatagggttaa

SEQ ID NO: 82647 - DNA, 15 bp, Homo sapiens
aatattatagggtta

SEQ ID NO: 82648 - DNA, 15 bp, Homo sapiens
taatattatagggtt

SEQ ID NO: 82649 - DNA, 15 bp, Homo sapiens
ataatattatagggt

SEQ ID NO: 82650 - DNA, 15 bp, Homo sapiens
aataatattataggg

SEQ ID NO: 82651 - DNA, 15 bp, Homo sapiens
taataatattatagg

SEQ ID NO: 82652 - DNA, 15 bp, Homo sapiens
gtaataatattatag

SEQ ID NO: 82653 - DNA, 15 bp, Homo sapiens
agtaataatattata

SEQ ID NO: 82654 - DNA, 15 bp, Homo sapiens
gagtaataatattat

SEQ ID NO: 82655 - DNA, 15 bp, Homo sapiens
agagtaataatatta

SEQ ID NO: 82656 - DNA, 15 bp, Homo sapiens
aagagtaataatatt

SEQ ID NO: 82657 - DNA, 15 bp, Homo sapiens
aaagagtaataatat

SEQ ID NO: 82658 - DNA, 15 bp, Homo sapiens
aaaagagtaataata

SEQ ID NO: 82659 - DNA, 15 bp, Homo sapiens
gaaaagagtaataat

SEQ ID NO: 82660 - DNA, 15 bp, Homo sapiens
tgaaaagagtaataa

SEQ ID NO: 82661 - DNA, 15 bp, Homo sapiens
atgaaaagagtaata

SEQ ID NO: 82662 - DNA, 15 bp, Homo sapiens
tatgaaaagagtaat

SEQ ID NO: 82663 - DNA, 15 bp, Homo sapiens
gtatgaaaagagtaa

SEQ ID NO: 82664 - DNA, 15 bp, Homo sapiens
agtatgaaaagagta

SEQ ID NO: 82665 - DNA, 15 bp, Homo sapiens
aagtatgaaaagagt

SEQ ID NO: 82666 - DNA, 15 bp, Homo sapiens
aaagtatgaaaagag

SEQ ID NO: 82667 - DNA, 15 bp, Homo sapiens
aaaagtatgaaaaga

SEQ ID NO: 82668 - DNA, 15 bp, Homo sapiens
taaaagtatgaaaag

SEQ ID NO: 82669 - DNA, 15 bp, Homo sapiens
ctaaaagtatgaaaa

SEQ ID NO: 82670 - DNA, 15 bp, Homo sapiens
actaaaagtatgaaa

SEQ ID NO: 82671 - DNA, 15 bp, Homo sapiens
aactaaaagtatgaa

SEQ ID NO: 82672 - DNA, 15 bp, Homo sapiens
caactaaaagtatga

SEQ ID NO: 82673 - DNA, 15 bp, Homo sapiens
acaactaaaagtatg

SEQ ID NO: 82674 - DNA, 15 bp, Homo sapiens
tacaactaaaagtat

SEQ ID NO: 82675 - DNA, 15 bp, Homo sapiens
ttacaactaaaagta

SEQ ID NO: 82676 - DNA, 15 bp, Homo sapiens
tttacaactaaaagt

SEQ ID NO: 82677 - DNA, 15 bp, Homo sapiens
atttacaactaaaag

SEQ ID NO: 82678 - DNA, 15 bp, Homo sapiens
tatttacaactaaaa

SEQ ID NO: 82679 - DNA, 15 bp, Homo sapiens
atatttacaactaaa

SEQ ID NO: 82680 - DNA, 15 bp, Homo sapiens
tatatttacaactaa

SEQ ID NO: 82681 - DNA, 15 bp, Homo sapiens
atatatttacaacta

SEQ ID NO: 82682 - DNA, 15 bp, Homo sapiens
catatatttacaact

SEQ ID NO: 82683 - DNA, 15 bp, Homo sapiens
tcatatatttacaac

SEQ ID NO: 82684 - DNA, 15 bp, Homo sapiens
atcatatatttacaa

SEQ ID NO: 82685 - DNA, 15 bp, Homo sapiens
gatcatatatttaca

SEQ ID NO: 82686 - DNA, 15 bp, Homo sapiens
agatcatatatttac

SEQ ID NO: 82687 - DNA, 15 bp, Homo sapiens
gagatcatatattta

SEQ ID NO: 82688 - DNA, 15 bp, Homo sapiens
tgagatcatatattt

SEQ ID NO: 82689 - DNA, 15 bp, Homo sapiens
atgagatcatatatt

SEQ ID NO: 82690 - DNA, 15 bp, Homo sapiens
aatgagatcatatat

SEQ ID NO: 82691 - DNA, 15 bp, Homo sapiens
aaatgagatcatata

SEQ ID NO: 82692 - DNA, 15 bp, Homo sapiens
aaaatgagatcatat

SEQ ID NO: 82693 - DNA, 15 bp, Homo sapiens
caaaatgagatcata

SEQ ID NO: 82694 - DNA, 15 bp, Homo sapiens
gcaaaatgagatcat

SEQ ID NO: 82695 - DNA, 15 bp, Homo sapiens
tgcaaaatgagatca

SEQ ID NO: 82696 - DNA, 15 bp, Homo sapiens
atgcaaaatgagatc

SEQ ID NO: 82697 - DNA, 15 bp, Homo sapiens
catgcaaaatgagat

SEQ ID NO: 82698 - DNA, 15 bp, Homo sapiens
ccatgcaaaatgaga

SEQ ID NO: 82699 - DNA, 15 bp, Homo sapiens
accatgcaaaatgag

SEQ ID NO: 82700 - DNA, 15 bp, Homo sapiens
aaccatgcaaaatga

SEQ ID NO: 82701 - DNA, 15 bp, Homo sapiens
taaccatgcaaaatg

SEQ ID NO: 82702 - DNA, 15 bp, Homo sapiens
gtaaccatgcaaaat

SEQ ID NO: 82703 - DNA, 15 bp, Homo sapiens
ggtaaccatgcaaaa

SEQ ID NO: 82704 - DNA, 15 bp, Homo sapiens
gggtaaccatgcaaa

SEQ ID NO: 82705 - DNA, 15 bp, Homo sapiens
agggtaaccatgcaa

SEQ ID NO: 82706 - DNA, 15 bp, Homo sapiens
tagggtaaccatgca

SEQ ID NO: 82707 - DNA, 15 bp, Homo sapiens
atagggtaaccatgc

SEQ ID NO: 82708 - DNA, 15 bp, Homo sapiens
aatagggtaaccatg

SEQ ID NO: 82709 - DNA, 15 bp, Homo sapiens
aaatagggtaaccat

SEQ ID NO: 82710 - DNA, 15 bp, Homo sapiens
gaaatagggtaacca

SEQ ID NO: 82711 - DNA, 15 bp, Homo sapiens
agaaatagggtaacc

SEQ ID NO: 82712 - DNA, 15 bp, Homo sapiens
cagaaatagggtaac

SEQ ID NO: 82713 - DNA, 15 bp, Homo sapiens
ccagaaatagggtaa

SEQ ID NO: 82714 - DNA, 15 bp, Homo sapiens
cccagaaatagggta

SEQ ID NO: 82715 - DNA, 15 bp, Homo sapiens
acccagaaatagggt

SEQ ID NO: 82716 - DNA, 15 bp, Homo sapiens
aacccagaaataggg

SEQ ID NO: 82717 - DNA, 15 bp, Homo sapiens
caacccagaaatagg

SEQ ID NO: 82718 - DNA, 15 bp, Homo sapiens
gcaacccagaaatag

SEQ ID NO: 82719 - DNA, 15 bp, Homo sapiens
agcaacccagaaata

SEQ ID NO: 82720 - DNA, 15 bp, Homo sapiens
cagcaacccagaaat

SEQ ID NO: 82721 - DNA, 15 bp, Homo sapiens
acagcaacccagaaa

SEQ ID NO: 82722 - DNA, 15 bp, Homo sapiens
aacagcaacccagaa

SEQ ID NO: 82723 - DNA, 15 bp, Homo sapiens
aaacagcaacccaga

SEQ ID NO: 82724 - DNA, 15 bp, Homo sapiens
aaaacagcaacccag

SEQ ID NO: 82725 - DNA, 15 bp, Homo sapiens
aaaaacagcaaccca

SEQ ID NO: 82726 - DNA, 15 bp, Homo sapiens
caaaaacagcaaccc

SEQ ID NO: 82727 - DNA, 15 bp, Homo sapiens
ccaaaaacagcaacc

SEQ ID NO: 82728 - DNA, 15 bp, Homo sapiens
cccaaaaacagcaac

SEQ ID NO: 82729 - DNA, 15 bp, Homo sapiens
ccccaaaaacagcaa

SEQ ID NO: 82730 - DNA, 15 bp, Homo sapiens
cccccaaaaacagca

SEQ ID NO: 82731 - DNA, 15 bp, Homo sapiens
tcccccaaaaacagc

SEQ ID NO: 82732 - DNA, 15 bp, Homo sapiens
ctcccccaaaaacag

SEQ ID NO: 82733 - DNA, 15 bp, Homo sapiens
actcccccaaaaaca

SEQ ID NO: 82734 - DNA, 15 bp, Homo sapiens
cactcccccaaaaac

SEQ ID NO: 82735 - DNA, 15 bp, Homo sapiens
tcactcccccaaaaa

SEQ ID NO: 82736 - DNA, 15 bp, Homo sapiens
atcactcccccaaaa

SEQ ID NO: 82737 - DNA, 15 bp, Homo sapiens
tatcactcccccaaa

SEQ ID NO: 82738 - DNA, 15 bp, Homo sapiens
ttatcactcccccaa

SEQ ID NO: 82739 - DNA, 15 bp, Homo sapiens
tttatcactccccca

SEQ ID NO: 82740 - DNA, 15 bp, Homo sapiens
ttttatcactccccc

SEQ ID NO: 82741 - DNA, 15 bp, Homo sapiens
tttttatcactcccc

SEQ ID NO: 82742 - DNA, 15 bp, Homo sapiens
ctttttatcactccc

SEQ ID NO: 82743 - DNA, 15 bp, Homo sapiens
tctttttatcactcc

SEQ ID NO: 82744 - DNA, 15 bp, Homo sapiens
gtctttttatcactc

SEQ ID NO: 82745 - DNA, 15 bp, Homo sapiens
tgtctttttatcact

SEQ ID NO: 82746 - DNA, 15 bp, Homo sapiens
atgtctttttatcac

SEQ ID NO: 82747 - DNA, 15 bp, Homo sapiens
tatgtctttttatca

SEQ ID NO: 82748 - DNA, 15 bp, Homo sapiens
atatgtctttttatc

SEQ ID NO: 82749 - DNA, 15 bp, Homo sapiens
aatatgtctttttat

SEQ ID NO: 82750 - DNA, 15 bp, Homo sapiens
gaatatgtcttttta

SEQ ID NO: 82751 - DNA, 15 bp, Homo sapiens
ggaatatgtcttttt

SEQ ID NO: 82752 - DNA, 15 bp, Homo sapiens
aggaatatgtctttt

SEQ ID NO: 82753 - DNA, 15 bp, Homo sapiens
caggaatatgtcttt

SEQ ID NO: 82754 - DNA, 15 bp, Homo sapiens
tcaggaatatgtctt

SEQ ID NO: 82755 - DNA, 15 bp, Homo sapiens
atcaggaatatgtct

SEQ ID NO: 82756 - DNA, 15 bp, Homo sapiens
catcaggaatatgtc

SEQ ID NO: 82757 - DNA, 15 bp, Homo sapiens
tcatcaggaatatgt

SEQ ID NO: 82758 - DNA, 15 bp, Homo sapiens
ctcatcaggaatatg

SEQ ID NO: 82759 - DNA, 15 bp, Homo sapiens
gctcatcaggaatat

SEQ ID NO: 82760 - DNA, 15 bp, Homo sapiens
tgctcatcaggaata

SEQ ID NO: 82761 - DNA, 15 bp, Homo sapiens
atgctcatcaggaat

SEQ ID NO: 82762 - DNA, 15 bp, Homo sapiens
aatgctcatcaggaa

SEQ ID NO: 82763 - DNA, 15 bp, Homo sapiens
aaatgctcatcagga

SEQ ID NO: 82764 - DNA, 15 bp, Homo sapiens
caaatgctcatcagg

SEQ ID NO: 82765 - DNA, 15 bp, Homo sapiens
tcaaatgctcatcag

SEQ ID NO: 82766 - DNA, 15 bp, Homo sapiens
ctcaaatgctcatca

SEQ ID NO: 82767 - DNA, 15 bp, Homo sapiens
actcaaatgctcatc

SEQ ID NO: 82768 - DNA, 15 bp, Homo sapiens
aactcaaatgctcat

SEQ ID NO: 82769 - DNA, 15 bp, Homo sapiens
caactcaaatgctca

SEQ ID NO: 82770 - DNA, 15 bp, Homo sapiens
gcaactcaaatgctc

SEQ ID NO: 82771 - DNA, 15 bp, Homo sapiens
agcaactcaaatgct

SEQ ID NO: 82772 - DNA, 15 bp, Homo sapiens
gagcaactcaaatgc

SEQ ID NO: 82773 - DNA, 15 bp, Homo sapiens
agagcaactcaaatg

SEQ ID NO: 82774 - DNA, 15 bp, Homo sapiens
aagagcaactcaaat

SEQ ID NO: 82775 - DNA, 15 bp, Homo sapiens
aaagagcaactcaaa

SEQ ID NO: 82776 - DNA, 15 bp, Homo sapiens
gaaagagcaactcaa

SEQ ID NO: 82777 - DNA, 15 bp, Homo sapiens
agaaagagcaactca

SEQ ID NO: 82778 - DNA, 15 bp, Homo sapiens
cagaaagagcaactc

SEQ ID NO: 82779 - DNA, 15 bp, Homo sapiens
ccagaaagagcaact

SEQ ID NO: 82780 - DNA, 15 bp, Homo sapiens
tccagaaagagcaac

SEQ ID NO: 82781 - DNA, 15 bp, Homo sapiens
ctccagaaagagcaa

SEQ ID NO: 82782 - DNA, 15 bp, Homo sapiens
actccagaaagagca

SEQ ID NO: 82783 - DNA, 15 bp, Homo sapiens
gactccagaaagagc

SEQ ID NO: 82784 - DNA, 15 bp, Homo sapiens
tgactccagaaagag

SEQ ID NO: 82785 - DNA, 15 bp, Homo sapiens
ttgactccagaaaga

SEQ ID NO: 82786 - DNA, 15 bp, Homo sapiens
cttgactccagaaag

SEQ ID NO: 82787 - DNA, 15 bp, Homo sapiens
acttgactccagaaa

SEQ ID NO: 82788 - DNA, 15 bp, Homo sapiens
tacttgactccagaa

SEQ ID NO: 82789 - DNA, 15 bp, Homo sapiens
ttacttgactccaga

SEQ ID NO: 82790 - DNA, 15 bp, Homo sapiens
tttacttgactccag

SEQ ID NO: 82791 - DNA, 15 bp, Homo sapiens
ttttacttgactcca

SEQ ID NO: 82792 - DNA, 15 bp, Homo sapiens
gttttacttgactcc

SEQ ID NO: 82793 - DNA, 15 bp, Homo sapiens
tgttttacttgactc

SEQ ID NO: 82794 - DNA, 15 bp, Homo sapiens
ctgttttacttgact

SEQ ID NO: 82795 - DNA, 15 bp, Homo sapiens
actgttttacttgac

SEQ ID NO: 82796 - DNA, 15 bp, Homo sapiens
tactgttttacttga

SEQ ID NO: 82797 - DNA, 15 bp, Homo sapiens
ctactgttttacttg

SEQ ID NO: 82798 - DNA, 15 bp, Homo sapiens
tctactgttttactt

SEQ ID NO: 82799 - DNA, 15 bp, Homo sapiens
ttctactgttttact

SEQ ID NO: 82800 - DNA, 15 bp, Homo sapiens
cttctactgttttac

SEQ ID NO: 82801 - DNA, 15 bp, Homo sapiens
ccttctactgtttta

SEQ ID NO: 82802 - DNA, 15 bp, Homo sapiens
tccttctactgtttt

SEQ ID NO: 82803 - DNA, 15 bp, Homo sapiens
ttccttctactgttt

SEQ ID NO: 82804 - DNA, 15 bp, Homo sapiens
tttccttctactgtt

SEQ ID NO: 82805 - DNA, 15 bp, Homo sapiens
gtttccttctactgt

SEQ ID NO: 82806 - DNA, 15 bp, Homo sapiens
tgtttccttctactg

SEQ ID NO: 82807 - DNA, 15 bp, Homo sapiens
atgtttccttctact

SEQ ID NO: 82808 - DNA, 15 bp, Homo sapiens
catgtttccttctac

SEQ ID NO: 82809 - DNA, 15 bp, Homo sapiens
tcatgtttccttcta

SEQ ID NO: 82810 - DNA, 15 bp, Homo sapiens
gtcatgtttccttct

SEQ ID NO: 82811 - DNA, 15 bp, Homo sapiens
tgtcatgtttccttc

SEQ ID NO: 82812 - DNA, 15 bp, Homo sapiens
ttgtcatgtttcctt

SEQ ID NO: 82813 - DNA, 15 bp, Homo sapiens
tttgtcatgtttcct

SEQ ID NO: 82814 - DNA, 15 bp, Homo sapiens
atttgtcatgtttcc

SEQ ID NO: 82815 - DNA, 15 bp, Homo sapiens
catttgtcatgtttc

SEQ ID NO: 82816 - DNA, 15 bp, Homo sapiens
ccatttgtcatgttt

SEQ ID NO: 82817 - DNA, 15 bp, Homo sapiens
accatttgtcatgtt

SEQ ID NO: 82818 - DNA, 15 bp, Homo sapiens
gaccatttgtcatgt

SEQ ID NO: 82819 - DNA, 15 bp, Homo sapiens
tgaccatttgtcatg

SEQ ID NO: 82820 - DNA, 15 bp, Homo sapiens
gtgaccatttgtcat

SEQ ID NO: 82821 - DNA, 15 bp, Homo sapiens
ggtgaccatttgtca

SEQ ID NO: 82822 - DNA, 15 bp, Homo sapiens
aggtgaccatttgtc

SEQ ID NO: 82823 - DNA, 15 bp, Homo sapiens
gaggtgaccatttgt

SEQ ID NO: 82824 - DNA, 15 bp, Homo sapiens
agaggtgaccatttg

SEQ ID NO: 82825 - DNA, 15 bp, Homo sapiens
cagaggtgaccattt

SEQ ID NO: 82826 - DNA, 15 bp, Homo sapiens
tcagaggtgaccatt

SEQ ID NO: 82827 - DNA, 15 bp, Homo sapiens
ttcagaggtgaccat

SEQ ID NO: 82828 - DNA, 15 bp, Homo sapiens
attcagaggtgacca

SEQ ID NO: 82829 - DNA, 15 bp, Homo sapiens
gattcagaggtgacc

SEQ ID NO: 82830 - DNA, 15 bp, Homo sapiens
agattcagaggtgac

SEQ ID NO: 82831 - DNA, 15 bp, Homo sapiens
aagattcagaggtga

SEQ ID NO: 82832 - DNA, 15 bp, Homo sapiens
gaagattcagaggtg

SEQ ID NO: 82833 - DNA, 15 bp, Homo sapiens
tgaagattcagaggt

SEQ ID NO: 82834 - DNA, 15 bp, Homo sapiens
ttgaagattcagagg

SEQ ID NO: 82835 - DNA, 15 bp, Homo sapiens
tttgaagattcagag

SEQ ID NO: 82836 - DNA, 15 bp, Homo sapiens
gtttgaagattcaga

SEQ ID NO: 82837 - DNA, 15 bp, Homo sapiens
tgtttgaagattcag

SEQ ID NO: 82838 - DNA, 15 bp, Homo sapiens
ctgtttgaagattca

SEQ ID NO: 82839 - DNA, 15 bp, Homo sapiens
cctgtttgaagattc

SEQ ID NO: 82840 - DNA, 15 bp, Homo sapiens
acctgtttgaagatt

SEQ ID NO: 82841 - DNA, 15 bp, Homo sapiens
aacctgtttgaagat

SEQ ID NO: 82842 - DNA, 15 bp, Homo sapiens
aaacctgtttgaaga

SEQ ID NO: 82843 - DNA, 15 bp, Homo sapiens
caaacctgtttgaag

SEQ ID NO: 82844 - DNA, 15 bp, Homo sapiens
tcaaacctgtttgaa

SEQ ID NO: 82845 - DNA, 15 bp, Homo sapiens
atcaaacctgtttga

SEQ ID NO: 82846 - DNA, 15 bp, Homo sapiens
catcaaacctgtttg

SEQ ID NO: 82847 - DNA, 15 bp, Homo sapiens
gcatcaaacctgttt

SEQ ID NO: 82848 - DNA, 15 bp, Homo sapiens
agcatcaaacctgtt

SEQ ID NO: 82849 - DNA, 15 bp, Homo sapiens
tagcatcaaacctgt

SEQ ID NO: 82850 - DNA, 15 bp, Homo sapiens
atagcatcaaacctg

SEQ ID NO: 82851 - DNA, 15 bp, Homo sapiens
tatagcatcaaacct

SEQ ID NO: 82852 - DNA, 15 bp, Homo sapiens
ttatagcatcaaacc

SEQ ID NO: 82853 - DNA, 15 bp, Homo sapiens
cttatagcatcaaac

SEQ ID NO: 82854 - DNA, 15 bp, Homo sapiens
acttatagcatcaaa

SEQ ID NO: 82855 - DNA, 15 bp, Homo sapiens
cacttatagcatcaa

SEQ ID NO: 82856 - DNA, 15 bp, Homo sapiens
gcacttatagcatca

SEQ ID NO: 82857 - DNA, 15 bp, Homo sapiens
tgcacttatagcatc

SEQ ID NO: 82858 - DNA, 15 bp, Homo sapiens
ctgcacttatagcat

SEQ ID NO: 82859 - DNA, 15 bp, Homo sapiens
tctgcacttatagca

SEQ ID NO: 82860 - DNA, 15 bp, Homo sapiens
ctctgcacttatagc

SEQ ID NO: 82861 - DNA, 15 bp, Homo sapiens
gctctgcacttatag

SEQ ID NO: 82862 - DNA, 15 bp, Homo sapiens
agctctgcacttata

SEQ ID NO: 82863 - DNA, 15 bp, Homo sapiens
cagctctgcacttat

SEQ ID NO: 82864 - DNA, 15 bp, Homo sapiens
acagctctgcactta

SEQ ID NO: 82865 - DNA, 15 bp, Homo sapiens
aacagctctgcactt

SEQ ID NO: 82866 - DNA, 15 bp, Homo sapiens
caacagctctgcact

SEQ ID NO: 82867 - DNA, 15 bp, Homo sapiens
tcaacagctctgcac

SEQ ID NO: 82868 - DNA, 15 bp, Homo sapiens
ttcaacagctctgca

SEQ ID NO: 82869 - DNA, 15 bp, Homo sapiens
gttcaacagctctgc

SEQ ID NO: 82870 - DNA, 15 bp, Homo sapiens
agttcaacagctctg

SEQ ID NO: 82871 - DNA, 15 bp, Homo sapiens
cagttcaacagctct

SEQ ID NO: 82872 - DNA, 15 bp, Homo sapiens
ccagttcaacagctc

SEQ ID NO: 82873 - DNA, 15 bp, Homo sapiens
tccagttcaacagct

SEQ ID NO: 82874 - DNA, 15 bp, Homo sapiens
atccagttcaacagc

SEQ ID NO: 82875 - DNA, 15 bp, Homo sapiens
aatccagttcaacag

SEQ ID NO: 82876 - DNA, 15 bp, Homo sapiens
aaatccagttcaaca

SEQ ID NO: 82877 - DNA, 15 bp, Homo sapiens
aaaatccagttcaac

SEQ ID NO: 82878 - DNA, 15 bp, Homo sapiens
caaaatccagttcaa

SEQ ID NO: 82879 - DNA, 15 bp, Homo sapiens
tcaaaatccagttca

SEQ ID NO: 82880 - DNA, 15 bp, Homo sapiens
ttcaaaatccagttc

SEQ ID NO: 82881 - DNA, 15 bp, Homo sapiens
tttcaaaatccagtt

SEQ ID NO: 82882 - DNA, 15 bp, Homo sapiens
atttcaaaatccagt

SEQ ID NO: 82883 - DNA, 15 bp, Homo sapiens
catttcaaaatccag

SEQ ID NO: 82884 - DNA, 15 bp, Homo sapiens
ccatttcaaaatcca

SEQ ID NO: 82885 - DNA, 15 bp, Homo sapiens
tccatttcaaaatcc

SEQ ID NO: 82886 - DNA, 15 bp, Homo sapiens
ttccatttcaaaatc

SEQ ID NO: 82887 - DNA, 15 bp, Homo sapiens
tttccatttcaaaat

SEQ ID NO: 82888 - DNA, 15 bp, Homo sapiens
ttttccatttcaaaa

SEQ ID NO: 82889 - DNA, 15 bp, Homo sapiens
gttttccatttcaaa

SEQ ID NO: 82890 - DNA, 15 bp, Homo sapiens
agttttccatttcaa

SEQ ID NO: 82891 - DNA, 15 bp, Homo sapiens
cagttttccatttca

SEQ ID NO: 82892 - DNA, 15 bp, Homo sapiens
gcagttttccatttc

SEQ ID NO: 82893 - DNA, 15 bp, Homo sapiens
ggcagttttccattt

SEQ ID NO: 82894 - DNA, 15 bp, Homo sapiens
tggcagttttccatt

SEQ ID NO: 82895 - DNA, 15 bp, Homo sapiens
atggcagttttccat

SEQ ID NO: 82896 - DNA, 15 bp, Homo sapiens
aatggcagttttcca

SEQ ID NO: 82897 - DNA, 15 bp, Homo sapiens
gaatggcagttttcc

SEQ ID NO: 82898 - DNA, 15 bp, Homo sapiens
tgaatggcagttttc

SEQ ID NO: 82899 - DNA, 15 bp, Homo sapiens
ctgaatggcagtttt

SEQ ID NO: 82900 - DNA, 15 bp, Homo sapiens
tctgaatggcagttt

SEQ ID NO: 82901 - DNA, 15 bp, Homo sapiens
gtctgaatggcagtt

SEQ ID NO: 82902 - DNA, 15 bp, Homo sapiens
ggtctgaatggcagt

SEQ ID NO: 82903 - DNA, 15 bp, Homo sapiens
tggtctgaatggcag

SEQ ID NO: 82904 - DNA, 15 bp, Homo sapiens
gtggtctgaatggca

SEQ ID NO: 82905 - DNA, 15 bp, Homo sapiens
tgtggtctgaatggc

SEQ ID NO: 82906 - DNA, 15 bp, Homo sapiens
ctgtggtctgaatgg

SEQ ID NO: 82907 - DNA, 15 bp, Homo sapiens
tctgtggtctgaatg

SEQ ID NO: 82908 - DNA, 15 bp, Homo sapiens
ctctgtggtctgaat

SEQ ID NO: 82909 - DNA, 15 bp, Homo sapiens
tctctgtggtctgaa

SEQ ID NO: 82910 - DNA, 15 bp, Homo sapiens
atctctgtggtctga

SEQ ID NO: 82911 - DNA, 15 bp, Homo sapiens
tatctctgtggtctg

SEQ ID NO: 82912 - DNA, 15 bp, Homo sapiens
ttatctctgtggtct

SEQ ID NO: 82913 - DNA, 15 bp, Homo sapiens
tttatctctgtggtc

SEQ ID NO: 82914 - DNA, 15 bp, Homo sapiens
ttttatctctgtggt

SEQ ID NO: 82915 - DNA, 15 bp, Homo sapiens
cttttatctctgtgg

SEQ ID NO: 82916 - DNA, 15 bp, Homo sapiens
tcttttatctctgtg

SEQ ID NO: 82917 - DNA, 15 bp, Homo sapiens
ctcttttatctctgt

SEQ ID NO: 82918 - DNA, 15 bp, Homo sapiens
actcttttatctctg

SEQ ID NO: 82919 - DNA, 15 bp, Homo sapiens
tactcttttatctct

SEQ ID NO: 82920 - DNA, 15 bp, Homo sapiens
atactcttttatctc

SEQ ID NO: 82921 - DNA, 15 bp, Homo sapiens
tatactcttttatct

SEQ ID NO: 82922 - DNA, 15 bp, Homo sapiens
atatactcttttatc

SEQ ID NO: 82923 - DNA, 15 bp, Homo sapiens
catatactcttttat

SEQ ID NO: 82924 - DNA, 15 bp, Homo sapiens
tcatatactctttta

SEQ ID NO: 82925 - DNA, 15 bp, Homo sapiens
ttcatatactctttt

SEQ ID NO: 82926 - DNA, 15 bp, Homo sapiens
cttcatatactcttt

SEQ ID NO: 82927 - DNA, 15 bp, Homo sapiens
tcttcatatactctt

SEQ ID NO: 82928 - DNA, 15 bp, Homo sapiens
atcttcatatactct

SEQ ID NO: 82929 - DNA, 15 bp, Homo sapiens
catcttcatatactc

SEQ ID NO: 82930 - DNA, 15 bp, Homo sapiens
gcatcttcatatact

SEQ ID NO: 82931 - DNA, 15 bp, Homo sapiens
tgcatcttcatatac

SEQ ID NO: 82932 - DNA, 15 bp, Homo sapiens
ttgcatcttcatata

SEQ ID NO: 82933 - DNA, 15 bp, Homo sapiens
cttgcatcttcatat

SEQ ID NO: 82934 - DNA, 15 bp, Homo sapiens
tcttgcatcttcata

SEQ ID NO: 82935 - DNA, 15 bp, Homo sapiens
gtcttgcatcttcat

SEQ ID NO: 82936 - DNA, 15 bp, Homo sapiens
tgtcttgcatcttca

SEQ ID NO: 82937 - DNA, 15 bp, Homo sapiens
gtgtcttgcatcttc

SEQ ID NO: 82938 - DNA, 15 bp, Homo sapiens
agtgtcttgcatctt

SEQ ID NO: 82939 - DNA, 15 bp, Homo sapiens
aagtgtcttgcatct

SEQ ID NO: 82940 - DNA, 15 bp, Homo sapiens
gaagtgtcttgcatc

SEQ ID NO: 82941 - DNA, 15 bp, Homo sapiens
ggaagtgtcttgcat

SEQ ID NO: 82942 - DNA, 15 bp, Homo sapiens
cggaagtgtcttgca

SEQ ID NO: 82943 - DNA, 15 bp, Homo sapiens
tcggaagtgtcttgc

SEQ ID NO: 82944 - DNA, 15 bp, Homo sapiens
ttcggaagtgtcttg

SEQ ID NO: 82945 - DNA, 15 bp, Homo sapiens
tttcggaagtgtctt

SEQ ID NO: 82946 - DNA, 15 bp, Homo sapiens
atttcggaagtgtct

SEQ ID NO: 82947 - DNA, 15 bp, Homo sapiens
catttcggaagtgtc

SEQ ID NO: 82948 - DNA, 15 bp, Homo sapiens
tcatttcggaagtgt

SEQ ID NO: 82949 - DNA, 15 bp, Homo sapiens
ttcatttcggaagtg

SEQ ID NO: 82950 - DNA, 15 bp, Homo sapiens
tttcatttcggaagt

SEQ ID NO: 82951 - DNA, 15 bp, Homo sapiens
ttttcatttcggaag

SEQ ID NO: 82952 - DNA, 15 bp, Homo sapiens
tttttcatttcggaa

SEQ ID NO: 82953 - DNA, 15 bp, Homo sapiens
ctttttcatttcgga

SEQ ID NO: 82954 - DNA, 15 bp, Homo sapiens
tctttttcatttcgg

SEQ ID NO: 82955 - DNA, 15 bp, Homo sapiens
ttctttttcatttcg

SEQ ID NO: 82956 - DNA, 15 bp, Homo sapiens
cttctttttcatttc

SEQ ID NO: 82957 - DNA, 15 bp, Homo sapiens
acttctttttcattt

SEQ ID NO: 82958 - DNA, 15 bp, Homo sapiens
aacttctttttcatt

SEQ ID NO: 82959 - DNA, 15 bp, Homo sapiens
caacttctttttcat

SEQ ID NO: 82960 - DNA, 15 bp, Homo sapiens
tcaacttctttttca

SEQ ID NO: 82961 - DNA, 15 bp, Homo sapiens
ttcaacttctttttc

SEQ ID NO: 82962 - DNA, 15 bp, Homo sapiens
cttcaacttcttttt

SEQ ID NO: 82963 - DNA, 15 bp, Homo sapiens
ccttcaacttctttt

SEQ ID NO: 82964 - DNA, 15 bp, Homo sapiens
accttcaacttcttt

SEQ ID NO: 82965 - DNA, 15 bp, Homo sapiens
taccttcaacttctt

SEQ ID NO: 82966 - DNA, 15 bp, Homo sapiens
ttaccttcaacttct

SEQ ID NO: 82967 - DNA, 15 bp, Homo sapiens
tttaccttcaacttc

SEQ ID NO: 82968 - DNA, 15 bp, Homo sapiens
ttttaccttcaactt

SEQ ID NO: 82969 - DNA, 15 bp, Homo sapiens
tttttaccttcaact

SEQ ID NO: 82970 - DNA, 15 bp, Homo sapiens
ttttttaccttcaac

SEQ ID NO: 82971 - DNA, 15 bp, Homo sapiens
gttttttaccttcaa

SEQ ID NO: 82972 - DNA, 15 bp, Homo sapiens
tgttttttaccttca

SEQ ID NO: 82973 - DNA, 15 bp, Homo sapiens
atgttttttaccttc

SEQ ID NO: 82974 - DNA, 15 bp, Homo sapiens
tatgttttttacctt

SEQ ID NO: 82975 - DNA, 15 bp, Homo sapiens
ttatgttttttacct

SEQ ID NO: 82976 - DNA, 15 bp, Homo sapiens
tttatgttttttacc

SEQ ID NO: 82977 - DNA, 15 bp, Homo sapiens
gtttatgttttttac

SEQ ID NO: 82978 - DNA, 15 bp, Homo sapiens
ggtttatgtttttta

SEQ ID NO: 82979 - DNA, 15 bp, Homo sapiens
tggtttatgtttttt

SEQ ID NO: 82980 - DNA, 15 bp, Homo sapiens
gtggtttatgttttt

SEQ ID NO: 82981 - DNA, 15 bp, Homo sapiens
tgtggtttatgtttt

SEQ ID NO: 82982 - DNA, 15 bp, Homo sapiens
atgtggtttatgttt

SEQ ID NO: 82983 - DNA, 15 bp, Homo sapiens
tatgtggtttatgtt

SEQ ID NO: 82984 - DNA, 15 bp, Homo sapiens
atatgtggtttatgt

SEQ ID NO: 82985 - DNA, 15 bp, Homo sapiens
tatatgtggtttatg

SEQ ID NO: 82986 - DNA, 15 bp, Homo sapiens
atatatgtggtttat

SEQ ID NO: 82987 - DNA, 15 bp, Homo sapiens
gatatatgtggttta

SEQ ID NO: 82988 - DNA, 15 bp, Homo sapiens
ggatatatgtggttt

SEQ ID NO: 82989 - DNA, 15 bp, Homo sapiens
aggatatatgtggtt

SEQ ID NO: 82990 - DNA, 15 bp, Homo sapiens
taggatatatgtggt

SEQ ID NO: 82991 - DNA, 15 bp, Homo sapiens
ctaggatatatgtgg

SEQ ID NO: 82992 - DNA, 15 bp, Homo sapiens
actaggatatatgtg

SEQ ID NO: 82993 - DNA, 15 bp, Homo sapiens
cactaggatatatgt

SEQ ID NO: 82994 - DNA, 15 bp, Homo sapiens
gcactaggatatatg

SEQ ID NO: 82995 - DNA, 15 bp, Homo sapiens
tgcactaggatatat

SEQ ID NO: 82996 - DNA, 15 bp, Homo sapiens
atgcactaggatata

SEQ ID NO: 82997 - DNA, 15 bp, Homo sapiens
tatgcactaggatat

SEQ ID NO: 82998 - DNA, 15 bp, Homo sapiens
ttatgcactaggata

SEQ ID NO: 82999 - DNA, 15 bp, Homo sapiens
tttatgcactaggat

SEQ ID NO: 83000 - DNA, 15 bp, Homo sapiens
ttttatgcactagga

SEQ ID NO: 83001 - DNA, 15 bp, Homo sapiens
attttatgcactagg

SEQ ID NO: 83002 - DNA, 15 bp, Homo sapiens
tattttatgcactag

SEQ ID NO: 83003 - DNA, 15 bp, Homo sapiens
ctattttatgcacta

SEQ ID NO: 83004 - DNA, 15 bp, Homo sapiens
actattttatgcact

SEQ ID NO: 83005 - DNA, 15 bp, Homo sapiens
aactattttatgcac

SEQ ID NO: 83006 - DNA, 15 bp, Homo sapiens
gaactattttatgca

SEQ ID NO: 83007 - DNA, 15 bp, Homo sapiens
tgaactattttatgc

SEQ ID NO: 83008 - DNA, 15 bp, Homo sapiens
atgaactattttatg

SEQ ID NO: 83009 - DNA, 15 bp, Homo sapiens
gatgaactattttat

SEQ ID NO: 83010 - DNA, 15 bp, Homo sapiens
tgatgaactatttta

SEQ ID NO: 83011 - DNA, 15 bp, Homo sapiens
atgatgaactatttt

SEQ ID NO: 83012 - DNA, 15 bp, Homo sapiens
catgatgaactattt

SEQ ID NO: 83013 - DNA, 15 bp, Homo sapiens
gcatgatgaactatt

SEQ ID NO: 83014 - DNA, 15 bp, Homo sapiens
agcatgatgaactat

SEQ ID NO: 83015 - DNA, 15 bp, Homo sapiens
cagcatgatgaacta

SEQ ID NO: 83016 - DNA, 15 bp, Homo sapiens
ccagcatgatgaact

SEQ ID NO: 83017 - DNA, 15 bp, Homo sapiens
tccagcatgatgaac

SEQ ID NO: 83018 - DNA, 15 bp, Homo sapiens
atccagcatgatgaa

SEQ ID NO: 83019 - DNA, 15 bp, Homo sapiens
aatccagcatgatga

SEQ ID NO: 83020 - DNA, 15 bp, Homo sapiens
aaatccagcatgatg

SEQ ID NO: 83021 - DNA, 15 bp, Homo sapiens
aaaatccagcatgat

SEQ ID NO: 83022 - DNA, 15 bp, Homo sapiens
gaaaatccagcatga

SEQ ID NO: 83023 - DNA, 15 bp, Homo sapiens
agaaaatccagcatg

SEQ ID NO: 83024 - DNA, 15 bp, Homo sapiens
cagaaaatccagcat

SEQ ID NO: 83025 - DNA, 15 bp, Homo sapiens
gcagaaaatccagca

SEQ ID NO: 83026 - DNA, 15 bp, Homo sapiens
agcagaaaatccagc

SEQ ID NO: 83027 - DNA, 15 bp, Homo sapiens
cagcagaaaatccag

SEQ ID NO: 83028 - DNA, 15 bp, Homo sapiens
ccagcagaaaatcca

SEQ ID NO: 83029 - DNA, 15 bp, Homo sapiens
gccagcagaaaatcc

SEQ ID NO: 83030 - DNA, 15 bp, Homo sapiens
tgccagcagaaaatc

SEQ ID NO: 83031 - DNA, 15 bp, Homo sapiens
atgccagcagaaaat

SEQ ID NO: 83032 - DNA, 15 bp, Homo sapiens
tatgccagcagaaaa

SEQ ID NO: 83033 - DNA, 15 bp, Homo sapiens
ttatgccagcagaaa

SEQ ID NO: 83034 - DNA, 15 bp, Homo sapiens
tttatgccagcagaa

SEQ ID NO: 83035 - DNA, 15 bp, Homo sapiens
ctttatgccagcaga

SEQ ID NO: 83036 - DNA, 15 bp, Homo sapiens
tctttatgccagcag

SEQ ID NO: 83037 - DNA, 15 bp, Homo sapiens
gtctttatgccagca

SEQ ID NO: 83038 - DNA, 15 bp, Homo sapiens
tgtctttatgccagc

SEQ ID NO: 83039 - DNA, 15 bp, Homo sapiens
atgtctttatgccag

SEQ ID NO: 83040 - DNA, 15 bp, Homo sapiens
aatgtctttatgcca

SEQ ID NO: 83041 - DNA, 15 bp, Homo sapiens
taatgtctttatgcc

SEQ ID NO: 83042 - DNA, 15 bp, Homo sapiens
ataatgtctttatgc

SEQ ID NO: 83043 - DNA, 15 bp, Homo sapiens
cataatgtctttatg

SEQ ID NO: 83044 - DNA, 15 bp, Homo sapiens
ccataatgtctttat

SEQ ID NO: 83045 - DNA, 15 bp, Homo sapiens
tccataatgtcttta

SEQ ID NO: 83046 - DNA, 15 bp, Homo sapiens
ttccataatgtcttt

SEQ ID NO: 83047 - DNA, 15 bp, Homo sapiens
attccataatgtctt

SEQ ID NO: 83048 - DNA, 15 bp, Homo sapiens
aattccataatgtct

SEQ ID NO: 83049 - DNA, 15 bp, Homo sapiens
gaattccataatgtc

SEQ ID NO: 83050 - DNA, 15 bp, Homo sapiens
tgaattccataatgt

SEQ ID NO: 83051 - DNA, 15 bp, Homo sapiens
ttgaattccataatg

SEQ ID NO: 83052 - DNA, 15 bp, Homo sapiens
tttgaattccataat

SEQ ID NO: 83053 - DNA, 15 bp, Homo sapiens
ttttgaattccataa

SEQ ID NO: 83054 - DNA, 15 bp, Homo sapiens
cttttgaattccata

SEQ ID NO: 83055 - DNA, 15 bp, Homo sapiens
gcttttgaattccat

SEQ ID NO: 83056 - DNA, 15 bp, Homo sapiens
ggcttttgaattcca

SEQ ID NO: 83057 - DNA, 15 bp, Homo sapiens
aggcttttgaattcc

SEQ ID NO: 83058 - DNA, 15 bp, Homo sapiens
gaggcttttgaattc

SEQ ID NO: 83059 - DNA, 15 bp, Homo sapiens
ggaggcttttgaatt

SEQ ID NO: 83060 - DNA, 15 bp, Homo sapiens
aggaggcttttgaat

SEQ ID NO: 83061 - DNA, 15 bp, Homo sapiens
caggaggcttttgaa

SEQ ID NO: 83062 - DNA, 15 bp, Homo sapiens
acaggaggcttttga

SEQ ID NO: 83063 - DNA, 15 bp, Homo sapiens
tacaggaggcttttg

SEQ ID NO: 83064 - DNA, 15 bp, Homo sapiens
ttacaggaggctttt

SEQ ID NO: 83065 - DNA, 15 bp, Homo sapiens
tttacaggaggcttt

SEQ ID NO: 83066 - DNA, 15 bp, Homo sapiens
ttttacaggaggctt

SEQ ID NO: 83067 - DNA, 15 bp, Homo sapiens
attttacaggaggct

SEQ ID NO: 83068 - DNA, 15 bp, Homo sapiens
tattttacaggaggc

SEQ ID NO: 83069 - DNA, 15 bp, Homo sapiens
ttattttacaggagg

SEQ ID NO: 83070 - DNA, 15 bp, Homo sapiens
tttattttacaggag

SEQ ID NO: 83071 - DNA, 15 bp, Homo sapiens
atttattttacagga

SEQ ID NO: 83072 - DNA, 15 bp, Homo sapiens
catttattttacagg

SEQ ID NO: 83073 - DNA, 15 bp, Homo sapiens
acatttattttacag

SEQ ID NO: 83074 - DNA, 15 bp, Homo sapiens
tacatttattttaca

SEQ ID NO: 83075 - DNA, 15 bp, Homo sapiens
ctacatttattttac

SEQ ID NO: 83076 - DNA, 15 bp, Homo sapiens
cctacatttatttta

SEQ ID NO: 83077 - DNA, 15 bp, Homo sapiens
gcctacatttatttt

SEQ ID NO: 83078 - DNA, 15 bp, Homo sapiens
tgcctacatttattt

SEQ ID NO: 83079 - DNA, 15 bp, Homo sapiens
ctgcctacatttatt

SEQ ID NO: 83080 - DNA, 15 bp, Homo sapiens
tctgcctacatttat

SEQ ID NO: 83081 - DNA, 15 bp, Homo sapiens
ttctgcctacattta

SEQ ID NO: 83082 - DNA, 15 bp, Homo sapiens
cttctgcctacattt

SEQ ID NO: 83083 - DNA, 15 bp, Homo sapiens
ccttctgcctacatt

SEQ ID NO: 83084 - DNA, 15 bp, Homo sapiens
accttctgcctacat

SEQ ID NO: 83085 - DNA, 15 bp, Homo sapiens
taccttctgcctaca

SEQ ID NO: 83086 - DNA, 15 bp, Homo sapiens
ctaccttctgcctac

SEQ ID NO: 83087 - DNA, 15 bp, Homo sapiens
gctaccttctgccta

SEQ ID NO: 83088 - DNA, 15 bp, Homo sapiens
agctaccttctgcct

SEQ ID NO: 83089 - DNA, 15 bp, Homo sapiens
aagctaccttctgcc

SEQ ID NO: 83090 - DNA, 15 bp, Homo sapiens
aaagctaccttctgc

SEQ ID NO: 83091 - DNA, 15 bp, Homo sapiens
aaaagctaccttctg

SEQ ID NO: 83092 - DNA, 15 bp, Homo sapiens
taaaagctaccttct

SEQ ID NO: 83093 - DNA, 15 bp, Homo sapiens
ctaaaagctaccttc

SEQ ID NO: 83094 - DNA, 15 bp, Homo sapiens
actaaaagctacctt

SEQ ID NO: 83095 - DNA, 15 bp, Homo sapiens
tactaaaagctacct

SEQ ID NO: 83096 - DNA, 15 bp, Homo sapiens
gtactaaaagctacc

SEQ ID NO: 83097 - DNA, 15 bp, Homo sapiens
tgtactaaaagctac

SEQ ID NO: 83098 - DNA, 15 bp, Homo sapiens
atgtactaaaagcta

SEQ ID NO: 83099 - DNA, 15 bp, Homo sapiens
aatgtactaaaagct

SEQ ID NO: 83100 - DNA, 15 bp, Homo sapiens
caatgtactaaaagc

SEQ ID NO: 83101 - DNA, 15 bp, Homo sapiens
acaatgtactaaaag

SEQ ID NO: 83102 - DNA, 15 bp, Homo sapiens
tacaatgtactaaaa

SEQ ID NO: 83103 - DNA, 15 bp, Homo sapiens
ctacaatgtactaaa

SEQ ID NO: 83104 - DNA, 15 bp, Homo sapiens
actacaatgtactaa

SEQ ID NO: 83105 - DNA, 15 bp, Homo sapiens
cactacaatgtacta

SEQ ID NO: 83106 - DNA, 15 bp, Homo sapiens
tcactacaatgtact

SEQ ID NO: 83107 - DNA, 15 bp, Homo sapiens
ttcactacaatgtac

SEQ ID NO: 83108 - DNA, 15 bp, Homo sapiens
attcactacaatgta

SEQ ID NO: 83109 - DNA, 15 bp, Homo sapiens
aattcactacaatgt

SEQ ID NO: 83110 - DNA, 15 bp, Homo sapiens
aaattcactacaatg

SEQ ID NO: 83111 - DNA, 15 bp, Homo sapiens
aaaattcactacaat

SEQ ID NO: 83112 - DNA, 15 bp, Homo sapiens
caaaattcactacaa

SEQ ID NO: 83113 - DNA, 15 bp, Homo sapiens
tcaaaattcactaca

SEQ ID NO: 83114 - DNA, 15 bp, Homo sapiens
ttcaaaattcactac

SEQ ID NO: 83115 - DNA, 15 bp, Homo sapiens
attcaaaattcacta

SEQ ID NO: 83116 - DNA, 15 bp, Homo sapiens
gattcaaaattcact

SEQ ID NO: 83117 - DNA, 15 bp, Homo sapiens
ggattcaaaattcac

SEQ ID NO: 83118 - DNA, 15 bp, Homo sapiens
tggattcaaaattca

SEQ ID NO: 83119 - DNA, 15 bp, Homo sapiens
atggattcaaaattc

SEQ ID NO: 83120 - DNA, 15 bp, Homo sapiens
aatggattcaaaatt

SEQ ID NO: 83121 - DNA, 15 bp, Homo sapiens
gaatggattcaaaat

SEQ ID NO: 83122 - DNA, 15 bp, Homo sapiens
tgaatggattcaaaa

SEQ ID NO: 83123 - DNA, 15 bp, Homo sapiens
atgaatggattcaaa

SEQ ID NO: 83124 - DNA, 15 bp, Homo sapiens
catgaatggattcaa

SEQ ID NO: 83125 - DNA, 15 bp, Homo sapiens
gcatgaatggattca

SEQ ID NO: 83126 - DNA, 15 bp, Homo sapiens
agcatgaatggattc

SEQ ID NO: 83127 - DNA, 15 bp, Homo sapiens
tagcatgaatggatt

SEQ ID NO: 83128 - DNA, 15 bp, Homo sapiens
ctagcatgaatggat

SEQ ID NO: 83129 - DNA, 15 bp, Homo sapiens
gctagcatgaatgga

SEQ ID NO: 83130 - DNA, 15 bp, Homo sapiens
agctagcatgaatgg

SEQ ID NO: 83131 - DNA, 15 bp, Homo sapiens
cagctagcatgaatg

SEQ ID NO: 83132 - DNA, 15 bp, Homo sapiens
acagctagcatgaat

SEQ ID NO: 83133 - DNA, 15 bp, Homo sapiens
gacagctagcatgaa

SEQ ID NO: 83134 - DNA, 15 bp, Homo sapiens
tgacagctagcatga

SEQ ID NO: 83135 - DNA, 15 bp, Homo sapiens
atgacagctagcatg

SEQ ID NO: 83136 - DNA, 15 bp, Homo sapiens
gatgacagctagcat

SEQ ID NO: 83137 - DNA, 15 bp, Homo sapiens
tgatgacagctagca

SEQ ID NO: 83138 - DNA, 15 bp, Homo sapiens
ctgatgacagctagc

SEQ ID NO: 83139 - DNA, 15 bp, Homo sapiens
tctgatgacagctag

SEQ ID NO: 83140 - DNA, 15 bp, Homo sapiens
atctgatgacagcta

SEQ ID NO: 83141 - DNA, 15 bp, Homo sapiens
gatctgatgacagct

SEQ ID NO: 83142 - DNA, 15 bp, Homo sapiens
ggatctgatgacagc

SEQ ID NO: 83143 - DNA, 15 bp, Homo sapiens
gggatctgatgacag

SEQ ID NO: 83144 - DNA, 15 bp, Homo sapiens
agggatctgatgaca

SEQ ID NO: 83145 - DNA, 15 bp, Homo sapiens
tagggatctgatgac

SEQ ID NO: 83146 - DNA, 15 bp, Homo sapiens
atagggatctgatga

SEQ ID NO: 83147 - DNA, 15 bp, Homo sapiens
aatagggatctgatg

SEQ ID NO: 83148 - DNA, 15 bp, Homo sapiens
aaatagggatctgat

SEQ ID NO: 83149 - DNA, 15 bp, Homo sapiens
caaatagggatctga

SEQ ID NO: 83150 - DNA, 15 bp, Homo sapiens
ccaaatagggatctg

SEQ ID NO: 83151 - DNA, 15 bp, Homo sapiens
tccaaatagggatct

SEQ ID NO: 83152 - DNA, 15 bp, Homo sapiens
ctccaaatagggatc

SEQ ID NO: 83153 - DNA, 15 bp, Homo sapiens
cctccaaatagggat

SEQ ID NO: 83154 - DNA, 15 bp, Homo sapiens
tcctccaaataggga

SEQ ID NO: 83155 - DNA, 15 bp, Homo sapiens
gtcctccaaataggg

SEQ ID NO: 83156 - DNA, 15 bp, Homo sapiens
cgtcctccaaatagg

SEQ ID NO: 83157 - DNA, 15 bp, Homo sapiens
acgtcctccaaatag

SEQ ID NO: 83158 - DNA, 15 bp, Homo sapiens
aacgtcctccaaata

SEQ ID NO: 83159 - DNA, 15 bp, Homo sapiens
aaacgtcctccaaat

SEQ ID NO: 83160 - DNA, 15 bp, Homo sapiens
aaaacgtcctccaaa

SEQ ID NO: 83161 - DNA, 15 bp, Homo sapiens
aaaaacgtcctccaa

SEQ ID NO: 83162 - DNA, 15 bp, Homo sapiens
aaaaaacgtcctcca

SEQ ID NO: 83163 - DNA, 15 bp, Homo sapiens
aaaaaaacgtcctcc

SEQ ID NO: 83164 - DNA, 15 bp, Homo sapiens
aaaaaaaacgtcctc

SEQ ID NO: 83165 - DNA, 15 bp, Homo sapiens
aaaaaaaaacgtcct

SEQ ID NO: 83166 - DNA, 15 bp, Homo sapiens
aaaaaaaaaacgtcc

SEQ ID NO: 83167 - DNA, 15 bp, Homo sapiens
aaaaaaaaaaacgtc

SEQ ID NO: 83168 - DNA, 15 bp, Homo sapiens
aaaaaaaaaaaacgt

SEQ ID NO: 83169 - DNA, 15 bp, Homo sapiens
gaaaaaaaaaaaacg

SEQ ID NO: 83170 - DNA, 15 bp, Homo sapiens
tgaaaaaaaaaaaac

SEQ ID NO: 83171 - DNA, 15 bp, Homo sapiens
atgaaaaaaaaaaaa

SEQ ID NO: 83172 - DNA, 15 bp, Homo sapiens
gatgaaaaaaaaaaa

SEQ ID NO: 83173 - DNA, 15 bp, Homo sapiens
agatgaaaaaaaaaa

SEQ ID NO: 83174 - DNA, 15 bp, Homo sapiens
aagatgaaaaaaaaa

SEQ ID NO: 83175 - DNA, 15 bp, Homo sapiens
aaagatgaaaaaaaa

SEQ ID NO: 83176 - DNA, 15 bp, Homo sapiens
caaagatgaaaaaaa

SEQ ID NO: 83177 - DNA, 15 bp, Homo sapiens
acaaagatgaaaaaa

SEQ ID NO: 83178 - DNA, 15 bp, Homo sapiens
gacaaagatgaaaaa

SEQ ID NO: 83179 - DNA, 15 bp, Homo sapiens
tgacaaagatgaaaa

SEQ ID NO: 83180 - DNA, 15 bp, Homo sapiens
ctgacaaagatgaaa

SEQ ID NO: 83181 - DNA, 15 bp, Homo sapiens
actgacaaagatgaa

SEQ ID NO: 83182 - DNA, 15 bp, Homo sapiens
gactgacaaagatga

SEQ ID NO: 83183 - DNA, 15 bp, Homo sapiens
tgactgacaaagatg

SEQ ID NO: 83184 - DNA, 15 bp, Homo sapiens
gtgactgacaaagat

SEQ ID NO: 83185 - DNA, 15 bp, Homo sapiens
agtgactgacaaaga

SEQ ID NO: 83186 - DNA, 15 bp, Homo sapiens
cagtgactgacaaag

SEQ ID NO: 83187 - DNA, 15 bp, Homo sapiens
tcagtgactgacaaa

SEQ ID NO: 83188 - DNA, 15 bp, Homo sapiens
ctcagtgactgacaa

SEQ ID NO: 83189 - DNA, 15 bp, Homo sapiens
tctcagtgactgaca

SEQ ID NO: 83190 - DNA, 15 bp, Homo sapiens
atctcagtgactgac

SEQ ID NO: 83191 - DNA, 15 bp, Homo sapiens
catctcagtgactga

SEQ ID NO: 83192 - DNA, 15 bp, Homo sapiens
acatctcagtgactg

SEQ ID NO: 83193 - DNA, 15 bp, Homo sapiens
tacatctcagtgact

SEQ ID NO: 83194 - DNA, 15 bp, Homo sapiens
gtacatctcagtgac

SEQ ID NO: 83195 - DNA, 15 bp, Homo sapiens
tgtacatctcagtga

SEQ ID NO: 83196 - DNA, 15 bp, Homo sapiens
ctgtacatctcagtg

SEQ ID NO: 83197 - DNA, 15 bp, Homo sapiens
actgtacatctcagt

SEQ ID NO: 83198 - DNA, 15 bp, Homo sapiens
cactgtacatctcag

SEQ ID NO: 83199 - DNA, 15 bp, Homo sapiens
tcactgtacatctca

SEQ ID NO: 83200 - DNA, 15 bp, Homo sapiens
ctcactgtacatctc

SEQ ID NO: 83201 - DNA, 15 bp, Homo sapiens
cctcactgtacatct

SEQ ID NO: 83202 - DNA, 15 bp, Homo sapiens
tcctcactgtacatc

SEQ ID NO: 83203 - DNA, 15 bp, Homo sapiens
ttcctcactgtacat

SEQ ID NO: 83204 - DNA, 15 bp, Homo sapiens
attcctcactgtaca

SEQ ID NO: 83205 - DNA, 15 bp, Homo sapiens
tattcctcactgtac

SEQ ID NO: 83206 - DNA, 15 bp, Homo sapiens
gtattcctcactgta

SEQ ID NO: 83207 - DNA, 15 bp, Homo sapiens
agtattcctcactgt

SEQ ID NO: 83208 - DNA, 15 bp, Homo sapiens
aagtattcctcactg

SEQ ID NO: 83209 - DNA, 15 bp, Homo sapiens
gaagtattcctcact

SEQ ID NO: 83210 - DNA, 15 bp, Homo sapiens
agaagtattcctcac

SEQ ID NO: 83211 - DNA, 15 bp, Homo sapiens
aagaagtattcctca

SEQ ID NO: 83212 - DNA, 15 bp, Homo sapiens
taagaagtattcctc

SEQ ID NO: 83213 - DNA, 15 bp, Homo sapiens
ataagaagtattcct

SEQ ID NO: 83214 - DNA, 15 bp, Homo sapiens
cataagaagtattcc

SEQ ID NO: 83215 - DNA, 15 bp, Homo sapiens
ccataagaagtattc

SEQ ID NO: 83216 - DNA, 15 bp, Homo sapiens
accataagaagtatt

SEQ ID NO: 83217 - DNA, 15 bp, Homo sapiens
caccataagaagtat

SEQ ID NO: 83218 - DNA, 15 bp, Homo sapiens
tcaccataagaagta

SEQ ID NO: 83219 - DNA, 15 bp, Homo sapiens
atcaccataagaagt

SEQ ID NO: 83220 - DNA, 15 bp, Homo sapiens
gatcaccataagaag

SEQ ID NO: 83221 - DNA, 15 bp, Homo sapiens
ggatcaccataagaa

SEQ ID NO: 83222 - DNA, 15 bp, Homo sapiens
tggatcaccataaga

SEQ ID NO: 83223 - DNA, 15 bp, Homo sapiens
ctggatcaccataag

SEQ ID NO: 83224 - DNA, 15 bp, Homo sapiens
actggatcaccataa

SEQ ID NO: 83225 - DNA, 15 bp, Homo sapiens
aactggatcaccata

SEQ ID NO: 83226 - DNA, 15 bp, Homo sapiens
taactggatcaccat

SEQ ID NO: 83227 - DNA, 15 bp, Homo sapiens
ctaactggatcacca

SEQ ID NO: 83228 - DNA, 15 bp, Homo sapiens
actaactggatcacc

SEQ ID NO: 83229 - DNA, 15 bp, Homo sapiens
cactaactggatcac

SEQ ID NO: 83230 - DNA, 15 bp, Homo sapiens
ccactaactggatca

SEQ ID NO: 83231 - DNA, 15 bp, Homo sapiens
accactaactggatc

SEQ ID NO: 83232 - DNA, 15 bp, Homo sapiens
taccactaactggat

SEQ ID NO: 83233 - DNA, 15 bp, Homo sapiens
gtaccactaactgga

SEQ ID NO: 83234 - DNA, 15 bp, Homo sapiens
agtaccactaactgg

SEQ ID NO: 83235 - DNA, 15 bp, Homo sapiens
tagtaccactaactg

SEQ ID NO: 83236 - DNA, 15 bp, Homo sapiens
gtagtaccactaact

SEQ ID NO: 83237 - DNA, 15 bp, Homo sapiens
agtagtaccactaac

SEQ ID NO: 83238 - DNA, 15 bp, Homo sapiens
aagtagtaccactaa

SEQ ID NO: 83239 - DNA, 15 bp, Homo sapiens
aaagtagtaccacta

SEQ ID NO: 83240 - DNA, 15 bp, Homo sapiens
aaaagtagtaccact

SEQ ID NO: 83241 - DNA, 15 bp, Homo sapiens
aaaaagtagtaccac

SEQ ID NO: 83242 - DNA, 15 bp, Homo sapiens
taaaaagtagtacca

SEQ ID NO: 83243 - DNA, 15 bp, Homo sapiens
ctaaaaagtagtacc

SEQ ID NO: 83244 - DNA, 15 bp, Homo sapiens
actaaaaagtagtac

SEQ ID NO: 83245 - DNA, 15 bp, Homo sapiens
aactaaaaagtagta

SEQ ID NO: 83246 - DNA, 15 bp, Homo sapiens
taactaaaaagtagt

SEQ ID NO: 83247 - DNA, 15 bp, Homo sapiens
ctaactaaaaagtag

SEQ ID NO: 83248 - DNA, 15 bp, Homo sapiens
actaactaaaaagta

SEQ ID NO: 83249 - DNA, 15 bp, Homo sapiens
aactaactaaaaagt

SEQ ID NO: 83250 - DNA, 15 bp, Homo sapiens
aaactaactaaaaag

SEQ ID NO: 83251 - DNA, 15 bp, Homo sapiens
taaactaactaaaaa

SEQ ID NO: 83252 - DNA, 15 bp, Homo sapiens
ctaaactaactaaaa

SEQ ID NO: 83253 - DNA, 15 bp, Homo sapiens
tctaaactaactaaa

SEQ ID NO: 83254 - DNA, 15 bp, Homo sapiens
atctaaactaactaa

SEQ ID NO: 83255 - DNA, 15 bp, Homo sapiens
gatctaaactaacta

SEQ ID NO: 83256 - DNA, 15 bp, Homo sapiens
tgatctaaactaact

SEQ ID NO: 83257 - DNA, 15 bp, Homo sapiens
gtgatctaaactaac

SEQ ID NO: 83258 - DNA, 15 bp, Homo sapiens
ggtgatctaaactaa

SEQ ID NO: 83259 - DNA, 15 bp, Homo sapiens
gggtgatctaaacta

SEQ ID NO: 83260 - DNA, 15 bp, Homo sapiens
agggtgatctaaact

SEQ ID NO: 83261 - DNA, 15 bp, Homo sapiens
aagggtgatctaaac

SEQ ID NO: 83262 - DNA, 15 bp, Homo sapiens
taagggtgatctaaa

SEQ ID NO: 83263 - DNA, 15 bp, Homo sapiens
ttaagggtgatctaa

SEQ ID NO: 83264 - DNA, 15 bp, Homo sapiens
attaagggtgatcta

SEQ ID NO: 83265 - DNA, 15 bp, Homo sapiens
gattaagggtgatct

SEQ ID NO: 83266 - DNA, 15 bp, Homo sapiens
agattaagggtgatc

SEQ ID NO: 83267 - DNA, 15 bp, Homo sapiens
cagattaagggtgat

SEQ ID NO: 83268 - DNA, 15 bp, Homo sapiens
ccagattaagggtga

SEQ ID NO: 83269 - DNA, 15 bp, Homo sapiens
accagattaagggtg

SEQ ID NO: 83270 - DNA, 15 bp, Homo sapiens
taccagattaagggt

SEQ ID NO: 83271 - DNA, 15 bp, Homo sapiens
ataccagattaaggg

SEQ ID NO: 83272 - DNA, 15 bp, Homo sapiens
gataccagattaagg

SEQ ID NO: 83273 - DNA, 15 bp, Homo sapiens
agataccagattaag

SEQ ID NO: 83274 - DNA, 15 bp, Homo sapiens
tagataccagattaa

SEQ ID NO: 83275 - DNA, 15 bp, Homo sapiens
ttagataccagatta

SEQ ID NO: 83276 - DNA, 15 bp, Homo sapiens
attagataccagatt

SEQ ID NO: 83277 - DNA, 15 bp, Homo sapiens
tattagataccagat

SEQ ID NO: 83278 - DNA, 15 bp, Homo sapiens
ttattagataccaga

SEQ ID NO: 83279 - DNA, 15 bp, Homo sapiens
attattagataccag

SEQ ID NO: 83280 - DNA, 15 bp, Homo sapiens
aattattagatacca

SEQ ID NO: 83281 - DNA, 15 bp, Homo sapiens
aaattattagatacc

SEQ ID NO: 83282 - DNA, 15 bp, Homo sapiens
taaattattagatac

SEQ ID NO: 83283 - DNA, 15 bp, Homo sapiens
ataaattattagata

SEQ ID NO: 83284 - DNA, 15 bp, Homo sapiens
cataaattattagat

SEQ ID NO: 83285 - DNA, 15 bp, Homo sapiens
tcataaattattaga

SEQ ID NO: 83286 - DNA, 15 bp, Homo sapiens
gtcataaattattag

SEQ ID NO: 83287 - DNA, 15 bp, Homo sapiens
agtcataaattatta

SEQ ID NO: 83288 - DNA, 15 bp, Homo sapiens
gagtcataaattatt

SEQ ID NO: 83289 - DNA, 15 bp, Homo sapiens
agagtcataaattat

SEQ ID NO: 83290 - DNA, 15 bp, Homo sapiens
tagagtcataaatta

SEQ ID NO: 83291 - DNA, 15 bp, Homo sapiens
atagagtcataaatt

SEQ ID NO: 83292 - DNA, 15 bp, Homo sapiens
tatagagtcataaat

SEQ ID NO: 83293 - DNA, 15 bp, Homo sapiens
atatagagtcataaa

SEQ ID NO: 83294 - DNA, 15 bp, Homo sapiens
aatatagagtcataa

SEQ ID NO: 83295 - DNA, 15 bp, Homo sapiens
taatatagagtcata

SEQ ID NO: 83296 - DNA, 15 bp, Homo sapiens
ttaatatagagtcat

SEQ ID NO: 83297 - DNA, 15 bp, Homo sapiens
gttaatatagagtca

SEQ ID NO: 83298 - DNA, 15 bp, Homo sapiens
tgttaatatagagtc

SEQ ID NO: 83299 - DNA, 15 bp, Homo sapiens
atgttaatatagagt

SEQ ID NO: 83300 - DNA, 15 bp, Homo sapiens
aatgttaatatagag

SEQ ID NO: 83301 - DNA, 15 bp, Homo sapiens
taatgttaatataga

SEQ ID NO: 83302 - DNA, 15 bp, Homo sapiens
ataatgttaatatag

SEQ ID NO: 83303 - DNA, 15 bp, Homo sapiens
cataatgttaatata

SEQ ID NO: 83304 - DNA, 15 bp, Homo sapiens
gcataatgttaatat

SEQ ID NO: 83305 - DNA, 15 bp, Homo sapiens
agcataatgttaata

SEQ ID NO: 83306 - DNA, 15 bp, Homo sapiens
cagcataatgttaat

SEQ ID NO: 83307 - DNA, 15 bp, Homo sapiens
tcagcataatgttaa

SEQ ID NO: 83308 - DNA, 15 bp, Homo sapiens
ttcagcataatgtta

SEQ ID NO: 83309 - DNA, 15 bp, Homo sapiens
cttcagcataatgtt

SEQ ID NO: 83310 - DNA, 15 bp, Homo sapiens
tcttcagcataatgt

SEQ ID NO: 83311 - DNA, 15 bp, Homo sapiens
atcttcagcataatg

SEQ ID NO: 83312 - DNA, 15 bp, Homo sapiens
catcttcagcataat

SEQ ID NO: 83313 - DNA, 15 bp, Homo sapiens
acatcttcagcataa

SEQ ID NO: 83314 - DNA, 15 bp, Homo sapiens
aacatcttcagcata

SEQ ID NO: 83315 - DNA, 15 bp, Homo sapiens
aaacatcttcagcat

SEQ ID NO: 83316 - DNA, 15 bp, Homo sapiens
aaaacatcttcagca

SEQ ID NO: 83317 - DNA, 15 bp, Homo sapiens
caaaacatcttcagc

SEQ ID NO: 83318 - DNA, 15 bp, Homo sapiens
gcaaaacatcttcag

SEQ ID NO: 83319 - DNA, 15 bp, Homo sapiens
ggcaaaacatcttca

SEQ ID NO: 83320 - DNA, 15 bp, Homo sapiens
aggcaaaacatcttc

SEQ ID NO: 83321 - DNA, 15 bp, Homo sapiens
aaggcaaaacatctt

SEQ ID NO: 83322 - DNA, 15 bp, Homo sapiens
gaaggcaaaacatct

SEQ ID NO: 83323 - DNA, 15 bp, Homo sapiens
cgaaggcaaaacatc

SEQ ID NO: 83324 - DNA, 15 bp, Homo sapiens
ccgaaggcaaaacat

SEQ ID NO: 83325 - DNA, 15 bp, Homo sapiens
tccgaaggcaaaaca

SEQ ID NO: 83326 - DNA, 15 bp, Homo sapiens
ttccgaaggcaaaac

SEQ ID NO: 83327 - DNA, 15 bp, Homo sapiens
attccgaaggcaaaa

SEQ ID NO: 83328 - DNA, 15 bp, Homo sapiens
tattccgaaggcaaa

SEQ ID NO: 83329 - DNA, 15 bp, Homo sapiens
gtattccgaaggcaa

SEQ ID NO: 83330 - DNA, 15 bp, Homo sapiens
tgtattccgaaggca

SEQ ID NO: 83331 - DNA, 15 bp, Homo sapiens
ttgtattccgaaggc

SEQ ID NO: 83332 - DNA, 15 bp, Homo sapiens
gttgtattccgaagg

SEQ ID NO: 83333 - DNA, 15 bp, Homo sapiens
tgttgtattccgaag

SEQ ID NO: 83334 - DNA, 15 bp, Homo sapiens
ttgttgtattccgaa

SEQ ID NO: 83335 - DNA, 15 bp, Homo sapiens
tttgttgtattccga

SEQ ID NO: 83336 - DNA, 15 bp, Homo sapiens
gtttgttgtattccg

SEQ ID NO: 83337 - DNA, 15 bp, Homo sapiens
agtttgttgtattcc

SEQ ID NO: 83338 - DNA, 15 bp, Homo sapiens
tagtttgttgtattc

SEQ ID NO: 83339 - DNA, 15 bp, Homo sapiens
atagtttgttgtatt

SEQ ID NO: 83340 - DNA, 15 bp, Homo sapiens
aatagtttgttgtat

SEQ ID NO: 83341 - DNA, 15 bp, Homo sapiens
aaatagtttgttgta

SEQ ID NO: 83342 - DNA, 15 bp, Homo sapiens
aaaatagtttgttgt

SEQ ID NO: 83343 - DNA, 15 bp, Homo sapiens
taaaatagtttgttg

SEQ ID NO: 83344 - DNA, 15 bp, Homo sapiens
ttaaaatagtttgtt

SEQ ID NO: 83345 - DNA, 15 bp, Homo sapiens
tttaaaatagtttgt

SEQ ID NO: 83346 - DNA, 15 bp, Homo sapiens
atttaaaatagtttg

SEQ ID NO: 83347 - DNA, 15 bp, Homo sapiens
gatttaaaatagttt

SEQ ID NO: 83348 - DNA, 15 bp, Homo sapiens
tgatttaaaatagtt

SEQ ID NO: 83349 - DNA, 15 bp, Homo sapiens
ttgatttaaaatagt

SEQ ID NO: 83350 - DNA, 15 bp, Homo sapiens
tttgatttaaaatag

SEQ ID NO: 83351 - DNA, 15 bp, Homo sapiens
ttttgatttaaaata

SEQ ID NO: 83352 - DNA, 15 bp, Homo sapiens
tttttgatttaaaat

SEQ ID NO: 83353 - DNA, 15 bp, Homo sapiens
ctttttgatttaaaa

SEQ ID NO: 83354 - DNA, 15 bp, Homo sapiens
actttttgatttaaa

SEQ ID NO: 83355 - DNA, 15 bp, Homo sapiens
cactttttgatttaa

SEQ ID NO: 83356 - DNA, 15 bp, Homo sapiens
acactttttgattta

SEQ ID NO: 83357 - DNA, 15 bp, Homo sapiens
tacactttttgattt

SEQ ID NO: 83358 - DNA, 15 bp, Homo sapiens
atacactttttgatt

SEQ ID NO: 83359 - DNA, 15 bp, Homo sapiens
aatacactttttgat

SEQ ID NO: 83360 - DNA, 15 bp, Homo sapiens
gaatacactttttga

SEQ ID NO: 83361 - DNA, 15 bp, Homo sapiens
tgaatacactttttg

SEQ ID NO: 83362 - DNA, 15 bp, Homo sapiens
ttgaatacacttttt

SEQ ID NO: 83363 - DNA, 15 bp, Homo sapiens
attgaatacactttt

SEQ ID NO: 83364 - DNA, 15 bp, Homo sapiens
tattgaatacacttt

SEQ ID NO: 83365 - DNA, 15 bp, Homo sapiens
atattgaatacactt

SEQ ID NO: 83366 - DNA, 15 bp, Homo sapiens
tatattgaatacact

SEQ ID NO: 83367 - DNA, 15 bp, Homo sapiens
atatattgaatacac

SEQ ID NO: 83368 - DNA, 15 bp, Homo sapiens
aatatattgaataca

SEQ ID NO: 83369 - DNA, 15 bp, Homo sapiens
aaatatattgaatac

SEQ ID NO: 83370 - DNA, 15 bp, Homo sapiens
aaaatatattgaata

SEQ ID NO: 83371 - DNA, 15 bp, Homo sapiens
gaaaatatattgaat

SEQ ID NO: 83372 - DNA, 15 bp, Homo sapiens
agaaaatatattgaa

SEQ ID NO: 83373 - DNA, 15 bp, Homo sapiens
aagaaaatatattga

SEQ ID NO: 83374 - DNA, 15 bp, Homo sapiens
aaagaaaatatattg

SEQ ID NO: 83375 - DNA, 15 bp, Homo sapiens
taaagaaaatatatt

SEQ ID NO: 83376 - DNA, 15 bp, Homo sapiens
ctaaagaaaatatat

SEQ ID NO: 83377 - DNA, 15 bp, Homo sapiens
tctaaagaaaatata

SEQ ID NO: 83378 - DNA, 15 bp, Homo sapiens
ctctaaagaaaatat

SEQ ID NO: 83379 - DNA, 15 bp, Homo sapiens
actctaaagaaaata

SEQ ID NO: 83380 - DNA, 15 bp, Homo sapiens
aactctaaagaaaat

SEQ ID NO: 83381 - DNA, 15 bp, Homo sapiens
caactctaaagaaaa

SEQ ID NO: 83382 - DNA, 15 bp, Homo sapiens
acaactctaaagaaa

SEQ ID NO: 83383 - DNA, 15 bp, Homo sapiens
tacaactctaaagaa

SEQ ID NO: 83384 - DNA, 15 bp, Homo sapiens
ttacaactctaaaga

SEQ ID NO: 83385 - DNA, 15 bp, Homo sapiens
tttacaactctaaag

SEQ ID NO: 83386 - DNA, 15 bp, Homo sapiens
ttttacaactctaaa

SEQ ID NO: 83387 - DNA, 15 bp, Homo sapiens
tttttacaactctaa

SEQ ID NO: 83388 - DNA, 15 bp, Homo sapiens
ttttttacaactcta

SEQ ID NO: 83389 - DNA, 15 bp, Homo sapiens
attttttacaactct

SEQ ID NO: 83390 - DNA, 15 bp, Homo sapiens
tattttttacaactc

SEQ ID NO: 83391 - DNA, 15 bp, Homo sapiens
ttattttttacaact

SEQ ID NO: 83392 - DNA, 15 bp, Homo sapiens
tttattttttacaac

SEQ ID NO: 83393 - DNA, 15 bp, Homo sapiens
atttattttttacaa

SEQ ID NO: 83394 - DNA, 15 bp, Homo sapiens
tatttattttttaca

SEQ ID NO: 83395 - DNA, 15 bp, Homo sapiens
gtatttattttttac

SEQ ID NO: 83396 - DNA, 15 bp, Homo sapiens
tgtatttatttttta

SEQ ID NO: 83397 - DNA, 15 bp, Homo sapiens
ttgtatttatttttt

SEQ ID NO: 83398 - DNA, 15 bp, Homo sapiens
attgtatttattttt

SEQ ID NO: 83399 - DNA, 15 bp, Homo sapiens
aattgtatttatttt

SEQ ID NO: 83400 - DNA, 15 bp, Homo sapiens
taattgtatttattt

SEQ ID NO: 83401 - DNA, 15 bp, Homo sapiens
ttaattgtatttatt

SEQ ID NO: 83402 - DNA, 15 bp, Homo sapiens
tttaattgtatttat

SEQ ID NO: 83403 - DNA, 15 bp, Homo sapiens
ttttaattgtattta

SEQ ID NO: 83404 - DNA, 15 bp, Homo sapiens
cttttaattgtattt

SEQ ID NO: 83405 - DNA, 15 bp, Homo sapiens
ccttttaattgtatt

SEQ ID NO: 83406 - DNA, 15 bp, Homo sapiens
accttttaattgtat

SEQ ID NO: 83407 - DNA, 15 bp, Homo sapiens
caccttttaattgta

SEQ ID NO: 83408 - DNA, 15 bp, Homo sapiens
acaccttttaattgt

SEQ ID NO: 83409 - DNA, 15 bp, Homo sapiens
cacaccttttaattg

SEQ ID NO: 83410 - DNA, 15 bp, Homo sapiens
ccacaccttttaatt

SEQ ID NO: 83411 - DNA, 15 bp, Homo sapiens
cccacaccttttaat

SEQ ID NO: 83412 - DNA, 15 bp, Homo sapiens
tcccacaccttttaa

SEQ ID NO: 83413 - DNA, 15 bp, Homo sapiens
atcccacacctttta

SEQ ID NO: 83414 - DNA, 15 bp, Homo sapiens
gatcccacacctttt

SEQ ID NO: 83415 - DNA, 15 bp, Homo sapiens
agatcccacaccttt

SEQ ID NO: 83416 - DNA, 15 bp, Homo sapiens
aagatcccacacctt

SEQ ID NO: 83417 - DNA, 15 bp, Homo sapiens
taagatcccacacct

SEQ ID NO: 83418 - DNA, 15 bp, Homo sapiens
ctaagatcccacacc

SEQ ID NO: 83419 - DNA, 15 bp, Homo sapiens
gctaagatcccacac

SEQ ID NO: 83420 - DNA, 15 bp, Homo sapiens
ggctaagatcccaca

SEQ ID NO: 83421 - DNA, 15 bp, Homo sapiens
gggctaagatcccac

SEQ ID NO: 83422 - DNA, 15 bp, Homo sapiens
agggctaagatccca

SEQ ID NO: 83423 - DNA, 15 bp, Homo sapiens
cagggctaagatccc

SEQ ID NO: 83424 - DNA, 15 bp, Homo sapiens
gcagggctaagatcc

SEQ ID NO: 83425 - DNA, 15 bp, Homo sapiens
ggcagggctaagatc

SEQ ID NO: 83426 - DNA, 15 bp, Homo sapiens
cggcagggctaagat

SEQ ID NO: 83427 - DNA, 15 bp, Homo sapiens
gcggcagggctaaga

SEQ ID NO: 83428 - DNA, 15 bp, Homo sapiens
agcggcagggctaag

SEQ ID NO: 83429 - DNA, 15 bp, Homo sapiens
aagcggcagggctaa

SEQ ID NO: 83430 - DNA, 15 bp, Homo sapiens
aaagcggcagggcta

SEQ ID NO: 83431 - DNA, 15 bp, Homo sapiens
gaaagcggcagggct

SEQ ID NO: 83432 - DNA, 15 bp, Homo sapiens
ggaaagcggcagggc

SEQ ID NO: 83433 - DNA, 15 bp, Homo sapiens
tggaaagcggcaggg

SEQ ID NO: 83434 - DNA, 15 bp, Homo sapiens
atggaaagcggcagg

SEQ ID NO: 83435 - DNA, 15 bp, Homo sapiens
catggaaagcggcag

SEQ ID NO: 83436 - DNA, 15 bp, Homo sapiens
gcatggaaagcggca

SEQ ID NO: 83437 - DNA, 15 bp, Homo sapiens
agcatggaaagcggc

SEQ ID NO: 83438 - DNA, 15 bp, Homo sapiens
aagcatggaaagcgg

SEQ ID NO: 83439 - DNA, 15 bp, Homo sapiens
taagcatggaaagcg

SEQ ID NO: 83440 - DNA, 15 bp, Homo sapiens
ataagcatggaaagc

SEQ ID NO: 83441 - DNA, 15 bp, Homo sapiens
cataagcatggaaag

SEQ ID NO: 83442 - DNA, 15 bp, Homo sapiens
acataagcatggaaa

SEQ ID NO: 83443 - DNA, 15 bp, Homo sapiens
cacataagcatggaa

SEQ ID NO: 83444 - DNA, 15 bp, Homo sapiens
acacataagcatgga

SEQ ID NO: 83445 - DNA, 15 bp, Homo sapiens
cacacataagcatgg

SEQ ID NO: 83446 - DNA, 15 bp, Homo sapiens
acacacataagcatg

SEQ ID NO: 83447 - DNA, 15 bp, Homo sapiens
aacacacataagcat

SEQ ID NO: 83448 - DNA, 15 bp, Homo sapiens
aaacacacataagca

SEQ ID NO: 83449 - DNA, 15 bp, Homo sapiens
gaaacacacataagc

SEQ ID NO: 83450 - DNA, 15 bp, Homo sapiens
agaaacacacataag

SEQ ID NO: 83451 - DNA, 15 bp, Homo sapiens
cagaaacacacataa

SEQ ID NO: 83452 - DNA, 15 bp, Homo sapiens
tcagaaacacacata

SEQ ID NO: 83453 - DNA, 15 bp, Homo sapiens
ttcagaaacacacat

SEQ ID NO: 83454 - DNA, 15 bp, Homo sapiens
cttcagaaacacaca

SEQ ID NO: 83455 - DNA, 15 bp, Homo sapiens
tcttcagaaacacac

SEQ ID NO: 83456 - DNA, 15 bp, Homo sapiens
ctcttcagaaacaca

SEQ ID NO: 83457 - DNA, 15 bp, Homo sapiens
actcttcagaaacac

SEQ ID NO: 83458 - DNA, 15 bp, Homo sapiens
cactcttcagaaaca

SEQ ID NO: 83459 - DNA, 15 bp, Homo sapiens
acactcttcagaaac

SEQ ID NO: 83460 - DNA, 15 bp, Homo sapiens
cacactcttcagaaa

SEQ ID NO: 83461 - DNA, 15 bp, Homo sapiens
tcacactcttcagaa

SEQ ID NO: 83462 - DNA, 15 bp, Homo sapiens
atcacactcttcaga

SEQ ID NO: 83463 - DNA, 15 bp, Homo sapiens
catcacactcttcag

SEQ ID NO: 83464 - DNA, 15 bp, Homo sapiens
ccatcacactcttca

SEQ ID NO: 83465 - DNA, 15 bp, Homo sapiens
cccatcacactcttc

SEQ ID NO: 83466 - DNA, 15 bp, Homo sapiens
tcccatcacactctt

SEQ ID NO: 83467 - DNA, 15 bp, Homo sapiens
ttcccatcacactct

SEQ ID NO: 83468 - DNA, 15 bp, Homo sapiens
gttcccatcacactc

SEQ ID NO: 83469 - DNA, 15 bp, Homo sapiens
agttcccatcacact

SEQ ID NO: 83470 - DNA, 15 bp, Homo sapiens
aagttcccatcacac

SEQ ID NO: 83471 - DNA, 15 bp, Homo sapiens
caagttcccatcaca

SEQ ID NO: 83472 - DNA, 15 bp, Homo sapiens
gcaagttcccatcac

SEQ ID NO: 83473 - DNA, 15 bp, Homo sapiens
tgcaagttcccatca

SEQ ID NO: 83474 - DNA, 15 bp, Homo sapiens
ctgcaagttcccatc

SEQ ID NO: 83475 - DNA, 15 bp, Homo sapiens
tctgcaagttcccat

SEQ ID NO: 83476 - DNA, 15 bp, Homo sapiens
ctctgcaagttccca

SEQ ID NO: 83477 - DNA, 15 bp, Homo sapiens
gctctgcaagttccc

SEQ ID NO: 83478 - DNA, 15 bp, Homo sapiens
agctctgcaagttcc

SEQ ID NO: 83479 - DNA, 15 bp, Homo sapiens
aagctctgcaagttc

SEQ ID NO: 83480 - DNA, 15 bp, Homo sapiens
aaagctctgcaagtt

SEQ ID NO: 83481 - DNA, 15 bp, Homo sapiens
aaaagctctgcaagt

SEQ ID NO: 83482 - DNA, 15 bp, Homo sapiens
aaaaagctctgcaag

SEQ ID NO: 83483 - DNA, 15 bp, Homo sapiens
aaaaaagctctgcaa

SEQ ID NO: 83484 - DNA, 15 bp, Homo sapiens
caaaaaagctctgca

SEQ ID NO: 83485 - DNA, 15 bp, Homo sapiens
acaaaaaagctctgc

SEQ ID NO: 83486 - DNA, 15 bp, Homo sapiens
gacaaaaaagctctg

SEQ ID NO: 83487 - DNA, 15 bp, Homo sapiens
ggacaaaaaagctct

SEQ ID NO: 83488 - DNA, 15 bp, Homo sapiens
aggacaaaaaagctc

SEQ ID NO: 83489 - DNA, 15 bp, Homo sapiens
caggacaaaaaagct

SEQ ID NO: 83490 - DNA, 15 bp, Homo sapiens
ccaggacaaaaaagc

SEQ ID NO: 83491 - DNA, 15 bp, Homo sapiens
cccaggacaaaaaag

SEQ ID NO: 83492 - DNA, 15 bp, Homo sapiens
acccaggacaaaaaa

SEQ ID NO: 83493 - DNA, 15 bp, Homo sapiens
cacccaggacaaaaa

SEQ ID NO: 83494 - DNA, 15 bp, Homo sapiens
gcacccaggacaaaa

SEQ ID NO: 83495 - DNA, 15 bp, Homo sapiens
agcacccaggacaaa

SEQ ID NO: 83496 - DNA, 15 bp, Homo sapiens
gagcacccaggacaa

SEQ ID NO: 83497 - DNA, 15 bp, Homo sapiens
tgagcacccaggaca

SEQ ID NO: 83498 - DNA, 15 bp, Homo sapiens
atgagcacccaggac

SEQ ID NO: 83499 - DNA, 15 bp, Homo sapiens
tatgagcacccagga

SEQ ID NO: 83500 - DNA, 15 bp, Homo sapiens
gtatgagcacccagg

SEQ ID NO: 83501 - DNA, 15 bp, Homo sapiens
cgtatgagcacccag

SEQ ID NO: 83502 - DNA, 15 bp, Homo sapiens
acgtatgagcaccca

SEQ ID NO: 83503 - DNA, 15 bp, Homo sapiens
gacgtatgagcaccc

SEQ ID NO: 83504 - DNA, 15 bp, Homo sapiens
agacgtatgagcacc

SEQ ID NO: 83505 - DNA, 15 bp, Homo sapiens
gagacgtatgagcac

SEQ ID NO: 83506 - DNA, 15 bp, Homo sapiens
ggagacgtatgagca

SEQ ID NO: 83507 - DNA, 15 bp, Homo sapiens
aggagacgtatgagc

SEQ ID NO: 83508 - DNA, 15 bp, Homo sapiens
taggagacgtatgag

SEQ ID NO: 83509 - DNA, 15 bp, Homo sapiens
gtaggagacgtatga

SEQ ID NO: 83510 - DNA, 15 bp, Homo sapiens
tgtaggagacgtatg

SEQ ID NO: 83511 - DNA, 15 bp, Homo sapiens
gtgtaggagacgtat

SEQ ID NO: 83512 - DNA, 15 bp, Homo sapiens
tgtgtaggagacgta

SEQ ID NO: 83513 - DNA, 15 bp, Homo sapiens
atgtgtaggagacgt

SEQ ID NO: 83514 - DNA, 15 bp, Homo sapiens
aatgtgtaggagacg

SEQ ID NO: 83515 - DNA, 15 bp, Homo sapiens
taatgtgtaggagac

SEQ ID NO: 83516 - DNA, 15 bp, Homo sapiens
gtaatgtgtaggaga

SEQ ID NO: 83517 - DNA, 15 bp, Homo sapiens
agtaatgtgtaggag

SEQ ID NO: 83518 - DNA, 15 bp, Homo sapiens
cagtaatgtgtagga

SEQ ID NO: 83519 - DNA, 15 bp, Homo sapiens
gcagtaatgtgtagg

SEQ ID NO: 83520 - DNA, 15 bp, Homo sapiens
tgcagtaatgtgtag

SEQ ID NO: 83521 - DNA, 15 bp, Homo sapiens
atgcagtaatgtgta

SEQ ID NO: 83522 - DNA, 15 bp, Homo sapiens
aatgcagtaatgtgt

SEQ ID NO: 83523 - DNA, 15 bp, Homo sapiens
taatgcagtaatgtg

SEQ ID NO: 83524 - DNA, 15 bp, Homo sapiens
ttaatgcagtaatgt

SEQ ID NO: 83525 - DNA, 15 bp, Homo sapiens
gttaatgcagtaatg

SEQ ID NO: 83526 - DNA, 15 bp, Homo sapiens
agttaatgcagtaat

SEQ ID NO: 83527 - DNA, 15 bp, Homo sapiens
tagttaatgcagtaa

SEQ ID NO: 83528 - DNA, 15 bp, Homo sapiens
atagttaatgcagta

SEQ ID NO: 83529 - DNA, 15 bp, Homo sapiens
aatagttaatgcagt

SEQ ID NO: 83530 - DNA, 15 bp, Homo sapiens
aaatagttaatgcag

SEQ ID NO: 83531 - DNA, 15 bp, Homo sapiens
caaatagttaatgca

SEQ ID NO: 83532 - DNA, 15 bp, Homo sapiens
ccaaatagttaatgc

SEQ ID NO: 83533 - DNA, 15 bp, Homo sapiens
cccaaatagttaatg

SEQ ID NO: 83534 - DNA, 15 bp, Homo sapiens
gcccaaatagttaat

SEQ ID NO: 83535 - DNA, 15 bp, Homo sapiens
tgcccaaatagttaa

SEQ ID NO: 83536 - DNA, 15 bp, Homo sapiens
gtgcccaaatagtta

SEQ ID NO: 83537 - DNA, 15 bp, Homo sapiens
ggtgcccaaatagtt

SEQ ID NO: 83538 - DNA, 15 bp, Homo sapiens
aggtgcccaaatagt

SEQ ID NO: 83539 - DNA, 15 bp, Homo sapiens
caggtgcccaaatag

SEQ ID NO: 83540 - DNA, 15 bp, Homo sapiens
ccaggtgcccaaata

SEQ ID NO: 83541 - DNA, 15 bp, Homo sapiens
cccaggtgcccaaat

SEQ ID NO: 83542 - DNA, 15 bp, Homo sapiens
acccaggtgcccaaa

SEQ ID NO: 83543 - DNA, 15 bp, Homo sapiens
tacccaggtgcccaa

SEQ ID NO: 83544 - DNA, 15 bp, Homo sapiens
ctacccaggtgccca

SEQ ID NO: 83545 - DNA, 15 bp, Homo sapiens
tctacccaggtgccc

SEQ ID NO: 83546 - DNA, 15 bp, Homo sapiens
ctctacccaggtgcc

SEQ ID NO: 83547 - DNA, 15 bp, Homo sapiens
tctctacccaggtgc

SEQ ID NO: 83548 - DNA, 15 bp, Homo sapiens
ttctctacccaggtg

SEQ ID NO: 83549 - DNA, 15 bp, Homo sapiens
attctctacccaggt

SEQ ID NO: 83550 - DNA, 15 bp, Homo sapiens
gattctctacccagg

SEQ ID NO: 83551 - DNA, 15 bp, Homo sapiens
agattctctacccag

SEQ ID NO: 83552 - DNA, 15 bp, Homo sapiens
tagattctctaccca

SEQ ID NO: 83553 - DNA, 15 bp, Homo sapiens
atagattctctaccc

SEQ ID NO: 83554 - DNA, 15 bp, Homo sapiens
tatagattctctacc

SEQ ID NO: 83555 - DNA, 15 bp, Homo sapiens
ctatagattctctac

SEQ ID NO: 83556 - DNA, 15 bp, Homo sapiens
actatagattctcta

SEQ ID NO: 83557 - DNA, 15 bp, Homo sapiens
gactatagattctct

SEQ ID NO: 83558 - DNA, 15 bp, Homo sapiens
agactatagattctc

SEQ ID NO: 83559 - DNA, 15 bp, Homo sapiens
tagactatagattct

SEQ ID NO: 83560 - DNA, 15 bp, Homo sapiens
ctagactatagattc

SEQ ID NO: 83561 - DNA, 15 bp, Homo sapiens
actagactatagatt

SEQ ID NO: 83562 - DNA, 15 bp, Homo sapiens
gactagactatagat

SEQ ID NO: 83563 - DNA, 15 bp, Homo sapiens
agactagactataga

SEQ ID NO: 83564 - DNA, 15 bp, Homo sapiens
gagactagactatag

SEQ ID NO: 83565 - DNA, 15 bp, Homo sapiens
ggagactagactata

SEQ ID NO: 83566 - DNA, 15 bp, Homo sapiens
aggagactagactat

SEQ ID NO: 83567 - DNA, 15 bp, Homo sapiens
caggagactagacta

SEQ ID NO: 83568 - DNA, 15 bp, Homo sapiens
gcaggagactagact

SEQ ID NO: 83569 - DNA, 15 bp, Homo sapiens
ggcaggagactagac

SEQ ID NO: 83570 - DNA, 15 bp, Homo sapiens
tggcaggagactaga

SEQ ID NO: 83571 - DNA, 15 bp, Homo sapiens
atggcaggagactag

SEQ ID NO: 83572 - DNA, 15 bp, Homo sapiens
gatggcaggagacta

SEQ ID NO: 83573 - DNA, 15 bp, Homo sapiens
agatggcaggagact

SEQ ID NO: 83574 - DNA, 15 bp, Homo sapiens
aagatggcaggagac

SEQ ID NO: 83575 - DNA, 15 bp, Homo sapiens
taagatggcaggaga

SEQ ID NO: 83576 - DNA, 15 bp, Homo sapiens
ttaagatggcaggag

SEQ ID NO: 83577 - DNA, 15 bp, Homo sapiens
cttaagatggcagga

SEQ ID NO: 83578 - DNA, 15 bp, Homo sapiens
tcttaagatggcagg

SEQ ID NO: 83579 - DNA, 15 bp, Homo sapiens
ctcttaagatggcag

SEQ ID NO: 83580 - DNA, 15 bp, Homo sapiens
cctcttaagatggca

SEQ ID NO: 83581 - DNA, 15 bp, Homo sapiens
acctcttaagatggc

SEQ ID NO: 83582 - DNA, 15 bp, Homo sapiens
tacctcttaagatgg

SEQ ID NO: 83583 - DNA, 15 bp, Homo sapiens
ctacctcttaagatg

SEQ ID NO: 83584 - DNA, 15 bp, Homo sapiens
gctacctcttaagat

SEQ ID NO: 83585 - DNA, 15 bp, Homo sapiens
tgctacctcttaaga

SEQ ID NO: 83586 - DNA, 15 bp, Homo sapiens
ttgctacctcttaag

SEQ ID NO: 83587 - DNA, 15 bp, Homo sapiens
tttgctacctcttaa

SEQ ID NO: 83588 - DNA, 15 bp, Homo sapiens
ttttgctacctctta

SEQ ID NO: 83589 - DNA, 15 bp, Homo sapiens
tttttgctacctctt

SEQ ID NO: 83590 - DNA, 15 bp, Homo sapiens
ttttttgctacctct

SEQ ID NO: 83591 - DNA, 15 bp, Homo sapiens
attttttgctacctc

SEQ ID NO: 83592 - DNA, 15 bp, Homo sapiens
gattttttgctacct

SEQ ID NO: 83593 - DNA, 15 bp, Homo sapiens
tgattttttgctacc

SEQ ID NO: 83594 - DNA, 15 bp, Homo sapiens
ttgattttttgctac

SEQ ID NO: 83595 - DNA, 15 bp, Homo sapiens
gttgattttttgcta

SEQ ID NO: 83596 - DNA, 15 bp, Homo sapiens
agttgattttttgct

SEQ ID NO: 83597 - DNA, 15 bp, Homo sapiens
aagttgattttttgc

SEQ ID NO: 83598 - DNA, 15 bp, Homo sapiens
caagttgattttttg

SEQ ID NO: 83599 - DNA, 15 bp, Homo sapiens
ttacaagttgatttt

SEQ ID NO: 83600 - DNA, 15 bp, Homo sapiens
tttacaagttgattt

SEQ ID NO: 83601 - DNA, 15 bp, Homo sapiens
ttttacaagttgatt

SEQ ID NO: 83602 - DNA, 15 bp, Homo sapiens
tttttacaagttgat

SEQ ID NO: 83603 - DNA, 15 bp, Homo sapiens
ctttttacaagttga

SEQ ID NO: 83604 - DNA, 15 bp, Homo sapiens
actttttacaagttg

SEQ ID NO: 83605 - DNA, 15 bp, Homo sapiens
tactttttacaagtt

SEQ ID NO: 83606 - DNA, 15 bp, Homo sapiens
ctactttttacaagt

SEQ ID NO: 83607 - DNA, 15 bp, Homo sapiens
tctactttttacaag

SEQ ID NO: 83608 - DNA, 15 bp, Homo sapiens
atctactttttacaa

SEQ ID NO: 83609 - DNA, 15 bp, Homo sapiens
tatctactttttaca

SEQ ID NO: 83610 - DNA, 15 bp, Homo sapiens
ttatctactttttac

SEQ ID NO: 83611 - DNA, 15 bp, Homo sapiens
attatctacttttta

SEQ ID NO: 83612 - DNA, 15 bp, Homo sapiens
aattatctacttttt

SEQ ID NO: 83613 - DNA, 15 bp, Homo sapiens
caattatctactttt

SEQ ID NO: 83614 - DNA, 15 bp, Homo sapiens
gcaattatctacttt

SEQ ID NO: 83615 - DNA, 15 bp, Homo sapiens
ggcaattatctactt

SEQ ID NO: 83616 - DNA, 15 bp, Homo sapiens
aggcaattatctact

SEQ ID NO: 83617 - DNA, 15 bp, Homo sapiens
aaggcaattatctac

SEQ ID NO: 83618 - DNA, 15 bp, Homo sapiens
aaaggcaattatcta

SEQ ID NO: 83619 - DNA, 15 bp, Homo sapiens
aaaaggcaattatct

SEQ ID NO: 83620 - DNA, 15 bp, Homo sapiens
aaaaaggcaattatc

SEQ ID NO: 83621 - DNA, 15 bp, Homo sapiens
gaaaaaggcaattat

SEQ ID NO: 83622 - DNA, 15 bp, Homo sapiens
agaaaaaggcaatta

SEQ ID NO: 83623 - DNA, 15 bp, Homo sapiens
gagaaaaaggcaatt

SEQ ID NO: 83624 - DNA, 15 bp, Homo sapiens
ggagaaaaaggcaat

SEQ ID NO: 83625 - DNA, 15 bp, Homo sapiens
tggagaaaaaggcaa

SEQ ID NO: 83626 - DNA, 15 bp, Homo sapiens
ctggagaaaaaggca

SEQ ID NO: 83627 - DNA, 15 bp, Homo sapiens
actggagaaaaaggc

SEQ ID NO: 83628 - DNA, 15 bp, Homo sapiens
aactggagaaaaagg

SEQ ID NO: 83629 - DNA, 15 bp, Homo sapiens
gaactggagaaaaag

SEQ ID NO: 83630 - DNA, 15 bp, Homo sapiens
cgaactggagaaaaa

SEQ ID NO: 83631 - DNA, 15 bp, Homo sapiens
tcgaactggagaaaa

SEQ ID NO: 83632 - DNA, 15 bp, Homo sapiens
atcgaactggagaaa

SEQ ID NO: 83633 - DNA, 15 bp, Homo sapiens
catcgaactggagaa

SEQ ID NO: 83634 - DNA, 15 bp, Homo sapiens
ccatcgaactggaga

SEQ ID NO: 83635 - DNA, 15 bp, Homo sapiens
accatcgaactggag

SEQ ID NO: 83636 - DNA, 15 bp, Homo sapiens
caccatcgaactgga

SEQ ID NO: 83637 - DNA, 15 bp, Homo sapiens
tcaccatcgaactgg

SEQ ID NO: 83638 - DNA, 15 bp, Homo sapiens
gtcaccatcgaactg

SEQ ID NO: 83639 - DNA, 15 bp, Homo sapiens
agtcaccatcgaact

SEQ ID NO: 83640 - DNA, 15 bp, Homo sapiens
aagtcaccatcgaac

SEQ ID NO: 83641 - DNA, 15 bp, Homo sapiens
aaagtcaccatcgaa

SEQ ID NO: 83642 - DNA, 15 bp, Homo sapiens
aaaagtcaccatcga

SEQ ID NO: 83643 - DNA, 15 bp, Homo sapiens
taaaagtcaccatcg

SEQ ID NO: 83644 - DNA, 15 bp, Homo sapiens
gtaaaagtcaccatc

SEQ ID NO: 83645 - DNA, 15 bp, Homo sapiens
tgtaaaagtcaccat

SEQ ID NO: 83646 - DNA, 15 bp, Homo sapiens
atgtaaaagtcacca

SEQ ID NO: 83647 - DNA, 15 bp, Homo sapiens
aatgtaaaagtcacc

SEQ ID NO: 83648 - DNA, 15 bp, Homo sapiens
caatgtaaaagtcac

SEQ ID NO: 83649 - DNA, 15 bp, Homo sapiens
tcaatgtaaaagtca

SEQ ID NO: 83650 - DNA, 15 bp, Homo sapiens
atcaatgtaaaagtc

SEQ ID NO: 83651 - DNA, 15 bp, Homo sapiens
gatcaatgtaaaagt

SEQ ID NO: 83652 - DNA, 15 bp, Homo sapiens
agatcaatgtaaaag

SEQ ID NO: 83653 - DNA, 15 bp, Homo sapiens
aagatcaatgtaaaa

SEQ ID NO: 83654 - DNA, 15 bp, Homo sapiens
aaagatcaatgtaaa

SEQ ID NO: 83655 - DNA, 15 bp, Homo sapiens
taaagatcaatgtaa

SEQ ID NO: 83656 - DNA, 15 bp, Homo sapiens
ctaaagatcaatgta

SEQ ID NO: 83657 - DNA, 15 bp, Homo sapiens
actaaagatcaatgt

SEQ ID NO: 83658 - DNA, 15 bp, Homo sapiens
aactaaagatcaatg

SEQ ID NO: 83659 - DNA, 15 bp, Homo sapiens
taactaaagatcaat

SEQ ID NO: 83660 - DNA, 15 bp, Homo sapiens
ctaactaaagatcaa

SEQ ID NO: 83661 - DNA, 15 bp, Homo sapiens
tctaactaaagatca

SEQ ID NO: 83662 - DNA, 15 bp, Homo sapiens
gtctaactaaagatc

SEQ ID NO: 83663 - DNA, 15 bp, Homo sapiens
tgtctaactaaagat

SEQ ID NO: 83664 - DNA, 15 bp, Homo sapiens
ttgtctaactaaaga

SEQ ID NO: 83665 - DNA, 15 bp, Homo sapiens
tttgtctaactaaag

SEQ ID NO: 83666 - DNA, 15 bp, Homo sapiens
ttttgtctaactaaa

SEQ ID NO: 83667 - DNA, 15 bp, Homo sapiens
attttgtctaactaa

SEQ ID NO: 83668 - DNA, 15 bp, Homo sapiens
tattttgtctaacta

SEQ ID NO: 83669 - DNA, 15 bp, Homo sapiens
ttattttgtctaact

SEQ ID NO: 83670 - DNA, 15 bp, Homo sapiens
tttattttgtctaac

SEQ ID NO: 83671 - DNA, 15 bp, Homo sapiens
gtttattttgtctaa

SEQ ID NO: 83672 - DNA, 15 bp, Homo sapiens
cgtttattttgtcta

SEQ ID NO: 83673 - DNA, 15 bp, Homo sapiens
ccgtttattttgtct

SEQ ID NO: 83674 - DNA, 15 bp, Homo sapiens
accgtttattttgtc

SEQ ID NO: 83675 - DNA, 15 bp, Homo sapiens
caccgtttattttgt

SEQ ID NO: 83676 - DNA, 15 bp, Homo sapiens
acaccgtttattttg

SEQ ID NO: 83677 - DNA, 15 bp, Homo sapiens
aacaccgtttatttt

SEQ ID NO: 83678 - DNA, 15 bp, Homo sapiens
aaacaccgtttattt

SEQ ID NO: 83679 - DNA, 15 bp, Homo sapiens
gaaacaccgtttatt

SEQ ID NO: 83680 - DNA, 15 bp, Homo sapiens
agaaacaccgtttat

SEQ ID NO: 83681 - DNA, 15 bp, Homo sapiens
aagaaacaccgttta

SEQ ID NO: 83682 - DNA, 15 bp, Homo sapiens
taagaaacaccgttt

SEQ ID NO: 83683 - DNA, 15 bp, Homo sapiens
ctaagaaacaccgtt

SEQ ID NO: 83684 - DNA, 15 bp, Homo sapiens
tctaagaaacaccgt

SEQ ID NO: 83685 - DNA, 15 bp, Homo sapiens
ctctaagaaacaccg

SEQ ID NO: 83686 - DNA, 15 bp, Homo sapiens
actctaagaaacacc

SEQ ID NO: 83687 - DNA, 15 bp, Homo sapiens
gactctaagaaacac

SEQ ID NO: 83688 - DNA, 15 bp, Homo sapiens
agactctaagaaaca

SEQ ID NO: 83689 - DNA, 15 bp, Homo sapiens
gagactctaagaaac

SEQ ID NO: 83690 - DNA, 15 bp, Homo sapiens
agagactctaagaaa

SEQ ID NO: 83691 - DNA, 15 bp, Homo sapiens
aagagactctaagaa

SEQ ID NO: 83692 - DNA, 15 bp, Homo sapiens
taagagactctaaga

SEQ ID NO: 83693 - DNA, 15 bp, Homo sapiens
gtaagagactctaag

SEQ ID NO: 83694 - DNA, 15 bp, Homo sapiens
agtaagagactctaa

SEQ ID NO: 83695 - DNA, 15 bp, Homo sapiens
tagtaagagactcta

SEQ ID NO: 83696 - DNA, 15 bp, Homo sapiens
ttagtaagagactct

SEQ ID NO: 83697 - DNA, 15 bp, Homo sapiens
attagtaagagactc

SEQ ID NO: 83698 - DNA, 15 bp, Homo sapiens
tattagtaagagact

SEQ ID NO: 83699 - DNA, 15 bp, Homo sapiens
atattagtaagagac

SEQ ID NO: 83700 - DNA, 15 bp, Homo sapiens
aatattagtaagaga

SEQ ID NO: 83701 - DNA, 15 bp, Homo sapiens
gaatattagtaagag

SEQ ID NO: 83702 - DNA, 15 bp, Homo sapiens
ggaatattagtaaga

SEQ ID NO: 83703 - DNA, 15 bp, Homo sapiens
aggaatattagtaag

SEQ ID NO: 83704 - DNA, 15 bp, Homo sapiens
aaggaatattagtaa

SEQ ID NO: 83705 - DNA, 15 bp, Homo sapiens
caaggaatattagta

SEQ ID NO: 83706 - DNA, 15 bp, Homo sapiens
tcaaggaatattagt

SEQ ID NO: 83707 - DNA, 15 bp, Homo sapiens
atcaaggaatattag

SEQ ID NO: 83708 - DNA, 15 bp, Homo sapiens
gatcaaggaatatta

SEQ ID NO: 83709 - DNA, 15 bp, Homo sapiens
agatcaaggaatatt

SEQ ID NO: 83710 - DNA, 15 bp, Homo sapiens
aagatcaaggaatat

SEQ ID NO: 83711 - DNA, 15 bp, Homo sapiens
aaagatcaaggaata

SEQ ID NO: 83712 - DNA, 15 bp, Homo sapiens
caaagatcaaggaat

SEQ ID NO: 83713 - DNA, 15 bp, Homo sapiens
tcaaagatcaaggaa

SEQ ID NO: 83714 - DNA, 15 bp, Homo sapiens
gtcaaagatcaagga

SEQ ID NO: 83715 - DNA, 15 bp, Homo sapiens
agtcaaagatcaagg

SEQ ID NO: 83716 - DNA, 15 bp, Homo sapiens
tagtcaaagatcaag

SEQ ID NO: 83717 - DNA, 15 bp, Homo sapiens
atagtcaaagatcaa

SEQ ID NO: 83718 - DNA, 15 bp, Homo sapiens
tatagtcaaagatca

SEQ ID NO: 83719 - DNA, 15 bp, Homo sapiens
ttatagtcaaagatc

SEQ ID NO: 83720 - DNA, 15 bp, Homo sapiens
cttatagtcaaagat

SEQ ID NO: 83721 - DNA, 15 bp, Homo sapiens
tcttatagtcaaaga

SEQ ID NO: 83722 - DNA, 15 bp, Homo sapiens
ttcttatagtcaaag

SEQ ID NO: 83723 - DNA, 15 bp, Homo sapiens
cttcttatagtcaaa

SEQ ID NO: 83724 - DNA, 15 bp, Homo sapiens
ccttcttatagtcaa

SEQ ID NO: 83725 - DNA, 15 bp, Homo sapiens
accttcttatagtca

SEQ ID NO: 83726 - DNA, 15 bp, Homo sapiens
aaccttcttatagtc

SEQ ID NO: 83727 - DNA, 15 bp, Homo sapiens
caaccttcttatagt

SEQ ID NO: 83728 - DNA, 15 bp, Homo sapiens
acaaccttcttatag

SEQ ID NO: 83729 - DNA, 15 bp, Homo sapiens
aacaaccttcttata

SEQ ID NO: 83730 - DNA, 15 bp, Homo sapiens
gaacaaccttcttat

SEQ ID NO: 83731 - DNA, 15 bp, Homo sapiens
agaacaaccttctta

SEQ ID NO: 83732 - DNA, 15 bp, Homo sapiens
tagaacaaccttctt

SEQ ID NO: 83733 - DNA, 15 bp, Homo sapiens
gtagaacaaccttct

SEQ ID NO: 83734 - DNA, 15 bp, Homo sapiens
ggtagaacaaccttc

SEQ ID NO: 83735 - DNA, 15 bp, Homo sapiens
aggtagaacaacctt

SEQ ID NO: 83736 - DNA, 15 bp, Homo sapiens
taggtagaacaacct

SEQ ID NO: 83737 - DNA, 15 bp, Homo sapiens
ctaggtagaacaacc

SEQ ID NO: 83738 - DNA, 15 bp, Homo sapiens
actaggtagaacaac

SEQ ID NO: 83739 - DNA, 15 bp, Homo sapiens
gactaggtagaacaa

SEQ ID NO: 83740 - DNA, 15 bp, Homo sapiens
tgactaggtagaaca

SEQ ID NO: 83741 - DNA, 15 bp, Homo sapiens
gtgactaggtagaac

SEQ ID NO: 83742 - DNA, 15 bp, Homo sapiens
tgtgactaggtagaa

SEQ ID NO: 83743 - DNA, 15 bp, Homo sapiens
ctgtgactaggtaga

SEQ ID NO: 83744 - DNA, 15 bp, Homo sapiens
actgtgactaggtag

SEQ ID NO: 83745 - DNA, 15 bp, Homo sapiens
tactgtgactaggta

SEQ ID NO: 83746 - DNA, 15 bp, Homo sapiens
ttactgtgactaggt

SEQ ID NO: 83747 - DNA, 15 bp, Homo sapiens
tttactgtgactagg

SEQ ID NO: 83748 - DNA, 15 bp, Homo sapiens
gtttactgtgactag

SEQ ID NO: 83749 - DNA, 15 bp, Homo sapiens
agtttactgtgacta

SEQ ID NO: 83750 - DNA, 15 bp, Homo sapiens
aagtttactgtgact

SEQ ID NO: 83751 - DNA, 15 bp, Homo sapiens
aaagtttactgtgac

SEQ ID NO: 83752 - DNA, 15 bp, Homo sapiens
caaagtttactgtga

SEQ ID NO: 83753 - DNA, 15 bp, Homo sapiens
acaaagtttactgtg

SEQ ID NO: 83754 - DNA, 15 bp, Homo sapiens
cacaaagtttactgt

SEQ ID NO: 83755 - DNA, 15 bp, Homo sapiens
tcacaaagtttactg

SEQ ID NO: 83756 - DNA, 15 bp, Homo sapiens
ttcacaaagtttact

SEQ ID NO: 83757 - DNA, 15 bp, Homo sapiens
tttcacaaagtttac

SEQ ID NO: 83758 - DNA, 15 bp, Homo sapiens
ttttcacaaagttta

SEQ ID NO: 83759 - DNA, 15 bp, Homo sapiens
attttcacaaagttt

SEQ ID NO: 83760 - DNA, 15 bp, Homo sapiens
gattttcacaaagtt

SEQ ID NO: 83761 - DNA, 15 bp, Homo sapiens
tgattttcacaaagt

SEQ ID NO: 83762 - DNA, 15 bp, Homo sapiens
ttgattttcacaaag

SEQ ID NO: 83763 - DNA, 15 bp, Homo sapiens
tttgattttcacaaa

SEQ ID NO: 83764 - DNA, 15 bp, Homo sapiens
ctttgattttcacaa

SEQ ID NO: 83765 - DNA, 15 bp, Homo sapiens
actttgattttcaca

SEQ ID NO: 83766 - DNA, 15 bp, Homo sapiens
tactttgattttcac

SEQ ID NO: 83767 - DNA, 15 bp, Homo sapiens
ctactttgattttca

SEQ ID NO: 83768 - DNA, 15 bp, Homo sapiens
cctactttgattttc

SEQ ID NO: 83769 - DNA, 15 bp, Homo sapiens
tcctactttgatttt

SEQ ID NO: 83770 - DNA, 15 bp, Homo sapiens
atcctactttgattt

SEQ ID NO: 83771 - DNA, 15 bp, Homo sapiens
tatcctactttgatt

SEQ ID NO: 83772 - DNA, 15 bp, Homo sapiens
ctatcctactttgat

SEQ ID NO: 83773 - DNA, 15 bp, Homo sapiens
gctatcctactttga

SEQ ID NO: 83774 - DNA, 15 bp, Homo sapiens
agctatcctactttg

SEQ ID NO: 83775 - DNA, 15 bp, Homo sapiens
cagctatcctacttt

SEQ ID NO: 83776 - DNA, 15 bp, Homo sapiens
tcagctatcctactt

SEQ ID NO: 83777 - DNA, 15 bp, Homo sapiens
ttcagctatcctact

SEQ ID NO: 83778 - DNA, 15 bp, Homo sapiens
attcagctatcctac

SEQ ID NO: 83779 - DNA, 15 bp, Homo sapiens
aattcagctatccta

SEQ ID NO: 83780 - DNA, 15 bp, Homo sapiens
aaattcagctatcct

SEQ ID NO: 83781 - DNA, 15 bp, Homo sapiens
taaattcagctatcc

SEQ ID NO: 83782 - DNA, 15 bp, Homo sapiens
ataaattcagctatc

SEQ ID NO: 83783 - DNA, 15 bp, Homo sapiens
aataaattcagctat

SEQ ID NO: 83784 - DNA, 15 bp, Homo sapiens
aaataaattcagcta

SEQ ID NO: 83785 - DNA, 15 bp, Homo sapiens
caaataaattcagct

SEQ ID NO: 83786 - DNA, 15 bp, Homo sapiens
tcaaataaattcagc

SEQ ID NO: 83787 - DNA, 15 bp, Homo sapiens
atcaaataaattcag

SEQ ID NO: 83788 - DNA, 15 bp, Homo sapiens
tatcaaataaattca

SEQ ID NO: 83789 - DNA, 15 bp, Homo sapiens
ctatcaaataaattc

SEQ ID NO: 83790 - DNA, 15 bp, Homo sapiens
gctatcaaataaatt

SEQ ID NO: 83791 - DNA, 15 bp, Homo sapiens
tgctatcaaataaat

SEQ ID NO: 83792 - DNA, 15 bp, Homo sapiens
gtgctatcaaataaa

SEQ ID NO: 83793 - DNA, 15 bp, Homo sapiens
agtgctatcaaataa

SEQ ID NO: 83794 - DNA, 15 bp, Homo sapiens
aagtgctatcaaata

SEQ ID NO: 83795 - DNA, 15 bp, Homo sapiens
taagtgctatcaaat

SEQ ID NO: 83796 - DNA, 15 bp, Homo sapiens
gtaagtgctatcaaa

SEQ ID NO: 83797 - DNA, 15 bp, Homo sapiens
tgtaagtgctatcaa

SEQ ID NO: 83798 - DNA, 15 bp, Homo sapiens
atgtaagtgctatca

SEQ ID NO: 83799 - DNA, 15 bp, Homo sapiens
catgtaagtgctatc

SEQ ID NO: 83800 - DNA, 15 bp, Homo sapiens
acatgtaagtgctat

SEQ ID NO: 83801 - DNA, 15 bp, Homo sapiens
tacatgtaagtgcta

SEQ ID NO: 83802 - DNA, 15 bp, Homo sapiens
ttacatgtaagtgct

SEQ ID NO: 83803 - DNA, 15 bp, Homo sapiens
tttacatgtaagtgc

SEQ ID NO: 83804 - DNA, 15 bp, Homo sapiens
gtttacatgtaagtg

SEQ ID NO: 83805 - DNA, 15 bp, Homo sapiens
tgtttacatgtaagt

SEQ ID NO: 83806 - DNA, 15 bp, Homo sapiens
ttgtttacatgtaag

SEQ ID NO: 83807 - DNA, 15 bp, Homo sapiens
attgtttacatgtaa

SEQ ID NO: 83808 - DNA, 15 bp, Homo sapiens
aattgtttacatgta

SEQ ID NO: 83809 - DNA, 15 bp, Homo sapiens
aaattgtttacatgt

SEQ ID NO: 83810 - DNA, 15 bp, Homo sapiens
taaattgtttacatg

SEQ ID NO: 83811 - DNA, 15 bp, Homo sapiens
ctaaattgtttacat

SEQ ID NO: 83812 - DNA, 15 bp, Homo sapiens
tctaaattgtttaca

SEQ ID NO: 83813 - DNA, 15 bp, Homo sapiens
ttctaaattgtttac

SEQ ID NO: 83814 - DNA, 15 bp, Homo sapiens
attctaaattgttta

SEQ ID NO: 83815 - DNA, 15 bp, Homo sapiens
aattctaaattgttt

SEQ ID NO: 83816 - DNA, 15 bp, Homo sapiens
caattctaaattgtt

SEQ ID NO: 83817 - DNA, 15 bp, Homo sapiens
ccaattctaaattgt

SEQ ID NO: 83818 - DNA, 15 bp, Homo sapiens
cccaattctaaattg

SEQ ID NO: 83819 - DNA, 15 bp, Homo sapiens
tcccaattctaaatt

SEQ ID NO: 83820 - DNA, 15 bp, Homo sapiens
atcccaattctaaat

SEQ ID NO: 83821 - DNA, 15 bp, Homo sapiens
aatcccaattctaaa

SEQ ID NO: 83822 - DNA, 15 bp, Homo sapiens
gaatcccaattctaa

SEQ ID NO: 83823 - DNA, 15 bp, Homo sapiens
agaatcccaattcta

SEQ ID NO: 83824 - DNA, 15 bp, Homo sapiens
aagaatcccaattct

SEQ ID NO: 83825 - DNA, 15 bp, Homo sapiens
gaagaatcccaattc

SEQ ID NO: 83826 - DNA, 15 bp, Homo sapiens
agaagaatcccaatt

SEQ ID NO: 83827 - DNA, 15 bp, Homo sapiens
gagaagaatcccaat

SEQ ID NO: 83828 - DNA, 15 bp, Homo sapiens
agagaagaatcccaa

SEQ ID NO: 83829 - DNA, 15 bp, Homo sapiens
cagagaagaatccca

SEQ ID NO: 83830 - DNA, 15 bp, Homo sapiens
ccagagaagaatccc

SEQ ID NO: 83831 - DNA, 15 bp, Homo sapiens
tccagagaagaatcc

SEQ ID NO: 83832 - DNA, 15 bp, Homo sapiens
atccagagaagaatc

SEQ ID NO: 83833 - DNA, 15 bp, Homo sapiens
aatccagagaagaat

SEQ ID NO: 83834 - DNA, 15 bp, Homo sapiens
caatccagagaagaa

SEQ ID NO: 83835 - DNA, 15 bp, Homo sapiens
acaatccagagaaga

SEQ ID NO: 83836 - DNA, 15 bp, Homo sapiens
gacaatccagagaag

SEQ ID NO: 83837 - DNA, 15 bp, Homo sapiens
agacaatccagagaa

SEQ ID NO: 83838 - DNA, 15 bp, Homo sapiens
cagacaatccagaga

SEQ ID NO: 83839 - DNA, 15 bp, Homo sapiens
ccagacaatccagag

SEQ ID NO: 83840 - DNA, 15 bp, Homo sapiens
accagacaatccaga

SEQ ID NO: 83841 - DNA, 15 bp, Homo sapiens
aaccagacaatccag

SEQ ID NO: 83842 - DNA, 15 bp, Homo sapiens
caaccagacaatcca

SEQ ID NO: 83843 - DNA, 15 bp, Homo sapiens
tcaaccagacaatcc

SEQ ID NO: 83844 - DNA, 15 bp, Homo sapiens
ttcaaccagacaatc

SEQ ID NO: 83845 - DNA, 15 bp, Homo sapiens
cttcaaccagacaat

SEQ ID NO: 83846 - DNA, 15 bp, Homo sapiens
acttcaaccagacaa

SEQ ID NO: 83847 - DNA, 15 bp, Homo sapiens
tacttcaaccagaca

SEQ ID NO: 83848 - DNA, 15 bp, Homo sapiens
ttacttcaaccagac

SEQ ID NO: 83849 - DNA, 15 bp, Homo sapiens
attacttcaaccaga

SEQ ID NO: 83850 - DNA, 15 bp, Homo sapiens
tattacttcaaccag

SEQ ID NO: 83851 - DNA, 15 bp, Homo sapiens
atattacttcaacca

SEQ ID NO: 83852 - DNA, 15 bp, Homo sapiens
catattacttcaacc

SEQ ID NO: 83853 - DNA, 15 bp, Homo sapiens
ccatattacttcaac

SEQ ID NO: 83854 - DNA, 15 bp, Homo sapiens
cccatattacttcaa

SEQ ID NO: 83855 - DNA, 15 bp, Homo sapiens
acccatattacttca

SEQ ID NO: 83856 - DNA, 15 bp, Homo sapiens
aacccatattacttc

SEQ ID NO: 83857 - DNA, 15 bp, Homo sapiens
caacccatattactt

SEQ ID NO: 83858 - DNA, 15 bp, Homo sapiens
gcaacccatattact

SEQ ID NO: 83859 - DNA, 15 bp, Homo sapiens
agcaacccatattac

SEQ ID NO: 83860 - DNA, 15 bp, Homo sapiens
gagcaacccatatta

SEQ ID NO: 83861 - DNA, 15 bp, Homo sapiens
tgagcaacccatatt

SEQ ID NO: 83862 - DNA, 15 bp, Homo sapiens
ctgagcaacccatat

SEQ ID NO: 83863 - DNA, 15 bp, Homo sapiens
tctgagcaacccata

SEQ ID NO: 83864 - DNA, 15 bp, Homo sapiens
ttctgagcaacccat

SEQ ID NO: 83865 - DNA, 15 bp, Homo sapiens
cttctgagcaaccca

SEQ ID NO: 83866 - DNA, 15 bp, Homo sapiens
acttctgagcaaccc

SEQ ID NO: 83867 - DNA, 15 bp, Homo sapiens
aacttctgagcaacc

SEQ ID NO: 83868 - DNA, 15 bp, Homo sapiens
caacttctgagcaac

SEQ ID NO: 83869 - DNA, 15 bp, Homo sapiens
acaacttctgagcaa

SEQ ID NO: 83870 - DNA, 15 bp, Homo sapiens
cacaacttctgagca

SEQ ID NO: 83871 - DNA, 15 bp, Homo sapiens
tcacaacttctgagc

SEQ ID NO: 83872 - DNA, 15 bp, Homo sapiens
atcacaacttctgag

SEQ ID NO: 83873 - DNA, 15 bp, Homo sapiens
aatcacaacttctga

SEQ ID NO: 83874 - DNA, 15 bp, Homo sapiens
caatcacaacttctg

SEQ ID NO: 83875 - DNA, 15 bp, Homo sapiens
acaatcacaacttct

SEQ ID NO: 83876 - DNA, 15 bp, Homo sapiens
cacaatcacaacttc

SEQ ID NO: 83877 - DNA, 15 bp, Homo sapiens
acacaatcacaactt

SEQ ID NO: 83878 - DNA, 15 bp, Homo sapiens
aacacaatcacaact

SEQ ID NO: 83879 - DNA, 15 bp, Homo sapiens
taacacaatcacaac

SEQ ID NO: 83880 - DNA, 15 bp, Homo sapiens
ataacacaatcacaa

SEQ ID NO: 83881 - DNA, 15 bp, Homo sapiens
cataacacaatcaca

SEQ ID NO: 83882 - DNA, 15 bp, Homo sapiens
tcataacacaatcac

SEQ ID NO: 83883 - DNA, 15 bp, Homo sapiens
atcataacacaatca

SEQ ID NO: 83884 - DNA, 15 bp, Homo sapiens
catcataacacaatc

SEQ ID NO: 83885 - DNA, 15 bp, Homo sapiens
ccatcataacacaat

SEQ ID NO: 83886 - DNA, 15 bp, Homo sapiens
tccatcataacacaa

SEQ ID NO: 83887 - DNA, 15 bp, Homo sapiens
atccatcataacaca

SEQ ID NO: 83888 - DNA, 15 bp, Homo sapiens
tatccatcataacac

SEQ ID NO: 83889 - DNA, 15 bp, Homo sapiens
gtatccatcataaca

SEQ ID NO: 83890 - DNA, 15 bp, Homo sapiens
agtatccatcataac

SEQ ID NO: 83891 - DNA, 15 bp, Homo sapiens
tagtatccatcataa

SEQ ID NO: 83892 - DNA, 15 bp, Homo sapiens
atagtatccatcata

SEQ ID NO: 83893 - DNA, 15 bp, Homo sapiens
aatagtatccatcat

SEQ ID NO: 83894 - DNA, 15 bp, Homo sapiens
aaatagtatccatca

SEQ ID NO: 83895 - DNA, 15 bp, Homo sapiens
caaatagtatccatc

SEQ ID NO: 83896 - DNA, 15 bp, Homo sapiens
tcaaatagtatccat

SEQ ID NO: 83897 - DNA, 15 bp, Homo sapiens
ttcaaatagtatcca

SEQ ID NO: 83898 - DNA, 15 bp, Homo sapiens
attcaaatagtatcc

SEQ ID NO: 83899 - DNA, 15 bp, Homo sapiens
tattcaaatagtatc

SEQ ID NO: 83900 - DNA, 15 bp, Homo sapiens
ctattcaaatagtat

SEQ ID NO: 83901 - DNA, 15 bp, Homo sapiens
actattcaaatagta

SEQ ID NO: 83902 - DNA, 15 bp, Homo sapiens
tactattcaaatagt

SEQ ID NO: 83903 - DNA, 15 bp, Homo sapiens
atactattcaaatag

SEQ ID NO: 83904 - DNA, 15 bp, Homo sapiens
tatactattcaaata

SEQ ID NO: 83905 - DNA, 15 bp, Homo sapiens
atatactattcaaat

SEQ ID NO: 83906 - DNA, 15 bp, Homo sapiens
tatatactattcaaa

SEQ ID NO: 83907 - DNA, 15 bp, Homo sapiens
ttatatactattcaa

SEQ ID NO: 83908 - DNA, 15 bp, Homo sapiens
tttatatactattca

SEQ ID NO: 83909 - DNA, 15 bp, Homo sapiens
atttatatactattc

SEQ ID NO: 83910 - DNA, 15 bp, Homo sapiens
tatttatatactatt

SEQ ID NO: 83911 - DNA, 15 bp, Homo sapiens
atatttatatactat

SEQ ID NO: 83912 - DNA, 15 bp, Homo sapiens
catatttatatacta

SEQ ID NO: 83913 - DNA, 15 bp, Homo sapiens
tcatatttatatact

SEQ ID NO: 83914 - DNA, 15 bp, Homo sapiens
ttcatatttatatac

SEQ ID NO: 83915 - DNA, 15 bp, Homo sapiens
attcatatttatata

SEQ ID NO: 83916 - DNA, 15 bp, Homo sapiens
tattcatatttatat

SEQ ID NO: 83917 - DNA, 15 bp, Homo sapiens
ttattcatatttata

SEQ ID NO: 83918 - DNA, 15 bp, Homo sapiens
attattcatatttat

SEQ ID NO: 83919 - DNA, 15 bp, Homo sapiens
tattattcatattta

SEQ ID NO: 83920 - DNA, 15 bp, Homo sapiens
atattattcatattt

SEQ ID NO: 83921 - DNA, 15 bp, Homo sapiens
tatattattcatatt

SEQ ID NO: 83922 - DNA, 15 bp, Homo sapiens
atatattattcatat

SEQ ID NO: 83923 - DNA, 15 bp, Homo sapiens
tatatattattcata

SEQ ID NO: 83924 - DNA, 15 bp, Homo sapiens
ttatatattattcat

SEQ ID NO: 83925 - DNA, 15 bp, Homo sapiens
tttatatattattca

SEQ ID NO: 83926 - DNA, 15 bp, Homo sapiens
atttatatattattc

SEQ ID NO: 83927 - DNA, 15 bp, Homo sapiens
tatttatatattatt

SEQ ID NO: 83928 - DNA, 15 bp, Homo sapiens
atatttatatattat

SEQ ID NO: 83929 - DNA, 15 bp, Homo sapiens
gatatttatatatta

SEQ ID NO: 83930 - DNA, 15 bp, Homo sapiens
tgatatttatatatt

SEQ ID NO: 83931 - DNA, 15 bp, Homo sapiens
ctgatatttatatat

SEQ ID NO: 83932 - DNA, 15 bp, Homo sapiens
actgatatttatata

SEQ ID NO: 83933 - DNA, 15 bp, Homo sapiens
aactgatatttatat

SEQ ID NO: 83934 - DNA, 15 bp, Homo sapiens
caactgatatttata

SEQ ID NO: 83935 - DNA, 15 bp, Homo sapiens
ccaactgatatttat

SEQ ID NO: 83936 - DNA, 15 bp, Homo sapiens
cccaactgatattta

SEQ ID NO: 83937 - DNA, 15 bp, Homo sapiens
ccccaactgatattt

SEQ ID NO: 83938 - DNA, 15 bp, Homo sapiens
tccccaactgatatt

SEQ ID NO: 83939 - DNA, 15 bp, Homo sapiens
atccccaactgatat

SEQ ID NO: 83940 - DNA, 15 bp, Homo sapiens
catccccaactgata

SEQ ID NO: 83941 - DNA, 15 bp, Homo sapiens
ccatccccaactgat

SEQ ID NO: 83942 - DNA, 15 bp, Homo sapiens
tccatccccaactga

SEQ ID NO: 83943 - DNA, 15 bp, Homo sapiens
ctccatccccaactg

SEQ ID NO: 83944 - DNA, 15 bp, Homo sapiens
cctccatccccaact

SEQ ID NO: 83945 - DNA, 15 bp, Homo sapiens
tcctccatccccaac

SEQ ID NO: 83946 - DNA, 15 bp, Homo sapiens
ttcctccatccccaa

SEQ ID NO: 83947 - DNA, 15 bp, Homo sapiens
attcctccatcccca

SEQ ID NO: 83948 - DNA, 15 bp, Homo sapiens
cattcctccatcccc

SEQ ID NO: 83949 - DNA, 15 bp, Homo sapiens
tcattcctccatccc

SEQ ID NO: 83950 - DNA, 15 bp, Homo sapiens
ctcattcctccatcc

SEQ ID NO: 83951 - DNA, 15 bp, Homo sapiens
tctcattcctccatc

SEQ ID NO: 83952 - DNA, 15 bp, Homo sapiens
ctctcattcctccat

SEQ ID NO: 83953 - DNA, 15 bp, Homo sapiens
tctctcattcctcca

SEQ ID NO: 83954 - DNA, 15 bp, Homo sapiens
ttctctcattcctcc

SEQ ID NO: 83955 - DNA, 15 bp, Homo sapiens
tttctctcattcctc

SEQ ID NO: 83956 - DNA, 15 bp, Homo sapiens
ttttctctcattcct

SEQ ID NO: 83957 - DNA, 15 bp, Homo sapiens
attttctctcattcc

SEQ ID NO: 83958 - DNA, 15 bp, Homo sapiens
aattttctctcattc

SEQ ID NO: 83959 - DNA, 15 bp, Homo sapiens
gaattttctctcatt

SEQ ID NO: 83960 - DNA, 15 bp, Homo sapiens
tgaattttctctcat

SEQ ID NO: 83961 - DNA, 15 bp, Homo sapiens
ttgaattttctctca

SEQ ID NO: 83962 - DNA, 15 bp, Homo sapiens
tttgaattttctctc

SEQ ID NO: 83963 - DNA, 15 bp, Homo sapiens
atttgaattttctct

SEQ ID NO: 83964 - DNA, 15 bp, Homo sapiens
tatttgaattttctc

SEQ ID NO: 83965 - DNA, 15 bp, Homo sapiens
gtatttgaattttct

SEQ ID NO: 83966 - DNA, 15 bp, Homo sapiens
ggtatttgaattttc

SEQ ID NO: 83967 - DNA, 15 bp, Homo sapiens
cggtatttgaatttt

SEQ ID NO: 83968 - DNA, 15 bp, Homo sapiens
tcggtatttgaattt

SEQ ID NO: 83969 - DNA, 15 bp, Homo sapiens
ctcggtatttgaatt

SEQ ID NO: 83970 - DNA, 15 bp, Homo sapiens
actcggtatttgaat

SEQ ID NO: 83971 - DNA, 15 bp, Homo sapiens
aactcggtatttgaa

SEQ ID NO: 83972 - DNA, 15 bp, Homo sapiens
caactcggtatttga

SEQ ID NO: 83973 - DNA, 15 bp, Homo sapiens
acaactcggtatttg

SEQ ID NO: 83974 - DNA, 15 bp, Homo sapiens
cacaactcggtattt

SEQ ID NO: 83975 - DNA, 15 bp, Homo sapiens
acacaactcggtatt

SEQ ID NO: 83976 - DNA, 15 bp, Homo sapiens
cacacaactcggtat

SEQ ID NO: 83977 - DNA, 15 bp, Homo sapiens
gcacacaactcggta

SEQ ID NO: 83978 - DNA, 15 bp, Homo sapiens
tgcacacaactcggt

SEQ ID NO: 83979 - DNA, 15 bp, Homo sapiens
gtgcacacaactcgg

SEQ ID NO: 83980 - DNA, 15 bp, Homo sapiens
tgtgcacacaactcg

SEQ ID NO: 83981 - DNA, 15 bp, Homo sapiens
atgtgcacacaactc

SEQ ID NO: 83982 - DNA, 15 bp, Homo sapiens
tatgtgcacacaact

SEQ ID NO: 83983 - DNA, 15 bp, Homo sapiens
atatgtgcacacaac

SEQ ID NO: 83984 - DNA, 15 bp, Homo sapiens
tatatgtgcacacaa

SEQ ID NO: 83985 - DNA, 15 bp, Homo sapiens
ctatatgtgcacaca

SEQ ID NO: 83986 - DNA, 15 bp, Homo sapiens
actatatgtgcacac

SEQ ID NO: 83987 - DNA, 15 bp, Homo sapiens
aactatatgtgcaca

SEQ ID NO: 83988 - DNA, 15 bp, Homo sapiens
caactatatgtgcac

SEQ ID NO: 83989 - DNA, 15 bp, Homo sapiens
acaactatatgtgca

SEQ ID NO: 83990 - DNA, 15 bp, Homo sapiens
cacaactatatgtgc

SEQ ID NO: 83991 - DNA, 15 bp, Homo sapiens
acacaactatatgtg

SEQ ID NO: 83992 - DNA, 15 bp, Homo sapiens
aacacaactatatgt

SEQ ID NO: 83993 - DNA, 15 bp, Homo sapiens
aaacacaactatatg

SEQ ID NO: 83994 - DNA, 15 bp, Homo sapiens
aaaacacaactatat

SEQ ID NO: 83995 - DNA, 15 bp, Homo sapiens
aaaaacacaactata

SEQ ID NO: 83996 - DNA, 15 bp, Homo sapiens
caaaaacacaactat

SEQ ID NO: 83997 - DNA, 15 bp, Homo sapiens
acaaaaacacaacta

SEQ ID NO: 83998 - DNA, 15 bp, Homo sapiens
cacaaaaacacaact

SEQ ID NO: 83999 - DNA, 15 bp, Homo sapiens
acacaaaaacacaac

SEQ ID NO: 84000 - DNA, 15 bp, Homo sapiens
cacacaaaaacacaa

SEQ ID NO: 84001 - DNA, 15 bp, Homo sapiens
acacacaaaaacaca

SEQ ID NO: 84002 - DNA, 15 bp, Homo sapiens
tacacacaaaaacac

SEQ ID NO: 84003 - DNA, 15 bp, Homo sapiens
atacacacaaaaaca

SEQ ID NO: 84004 - DNA, 15 bp, Homo sapiens
tatacacacaaaaac

SEQ ID NO: 84005 - DNA, 15 bp, Homo sapiens
gtatacacacaaaaa

SEQ ID NO: 84006 - DNA, 15 bp, Homo sapiens
tgtatacacacaaaa

SEQ ID NO: 84007 - DNA, 15 bp, Homo sapiens
atgtatacacacaaa

SEQ ID NO: 84008 - DNA, 15 bp, Homo sapiens
catgtatacacacaa

SEQ ID NO: 84009 - DNA, 15 bp, Homo sapiens
tcatgtatacacaca

SEQ ID NO: 84010 - DNA, 15 bp, Homo sapiens
atcatgtatacacac

SEQ ID NO: 84011 - DNA, 15 bp, Homo sapiens
aatcatgtatacaca

SEQ ID NO: 84012 - DNA, 15 bp, Homo sapiens
aaatcatgtatacac

SEQ ID NO: 84013 - DNA, 15 bp, Homo sapiens
aaaatcatgtataca

SEQ ID NO: 84014 - DNA, 15 bp, Homo sapiens
taaaatcatgtatac

SEQ ID NO: 84015 - DNA, 15 bp, Homo sapiens
gtaaaatcatgtata

SEQ ID NO: 84016 - DNA, 15 bp, Homo sapiens
agtaaaatcatgtat

SEQ ID NO: 84017 - DNA, 15 bp, Homo sapiens
aagtaaaatcatgta

SEQ ID NO: 84018 - DNA, 15 bp, Homo sapiens
caagtaaaatcatgt

SEQ ID NO: 84019 - DNA, 15 bp, Homo sapiens
gcaagtaaaatcatg

SEQ ID NO: 84020 - DNA, 15 bp, Homo sapiens
agcaagtaaaatcat

SEQ ID NO: 84021 - DNA, 15 bp, Homo sapiens
aagcaagtaaaatca

SEQ ID NO: 84022 - DNA, 15 bp, Homo sapiens
gaagcaagtaaaatc

SEQ ID NO: 84023 - DNA, 15 bp, Homo sapiens
tgaagcaagtaaaat

SEQ ID NO: 84024 - DNA, 15 bp, Homo sapiens
atgaagcaagtaaaa

SEQ ID NO: 84025 - DNA, 15 bp, Homo sapiens
aatgaagcaagtaaa

SEQ ID NO: 84026 - DNA, 15 bp, Homo sapiens
gaatgaagcaagtaa

SEQ ID NO: 84027 - DNA, 15 bp, Homo sapiens
agaatgaagcaagta

SEQ ID NO: 84028 - DNA, 15 bp, Homo sapiens
aagaatgaagcaagt

SEQ ID NO: 84029 - DNA, 15 bp, Homo sapiens
taagaatgaagcaag

SEQ ID NO: 84030 - DNA, 15 bp, Homo sapiens
gtaagaatgaagcaa

SEQ ID NO: 84031 - DNA, 15 bp, Homo sapiens
agtaagaatgaagca

SEQ ID NO: 84032 - DNA, 15 bp, Homo sapiens
tagtaagaatgaagc

SEQ ID NO: 84033 - DNA, 15 bp, Homo sapiens
ctagtaagaatgaag

SEQ ID NO: 84034 - DNA, 15 bp, Homo sapiens
actagtaagaatgaa

SEQ ID NO: 84035 - DNA, 15 bp, Homo sapiens
aactagtaagaatga

SEQ ID NO: 84036 - DNA, 15 bp, Homo sapiens
gaactagtaagaatg

SEQ ID NO: 84037 - DNA, 15 bp, Homo sapiens
agaactagtaagaat

SEQ ID NO: 84038 - DNA, 15 bp, Homo sapiens
cagaactagtaagaa

SEQ ID NO: 84039 - DNA, 15 bp, Homo sapiens
ccagaactagtaaga

SEQ ID NO: 84040 - DNA, 15 bp, Homo sapiens
tccagaactagtaag

SEQ ID NO: 84041 - DNA, 15 bp, Homo sapiens
ttccagaactagtaa

SEQ ID NO: 84042 - DNA, 15 bp, Homo sapiens
tttccagaactagta

SEQ ID NO: 84043 - DNA, 15 bp, Homo sapiens
ctttccagaactagt

SEQ ID NO: 84044 - DNA, 15 bp, Homo sapiens
tctttccagaactag

SEQ ID NO: 84045 - DNA, 15 bp, Homo sapiens
ttctttccagaacta

SEQ ID NO: 84046 - DNA, 15 bp, Homo sapiens
attctttccagaact

SEQ ID NO: 84047 - DNA, 15 bp, Homo sapiens
aattctttccagaac

SEQ ID NO: 84048 - DNA, 15 bp, Homo sapiens
aaattctttccagaa

SEQ ID NO: 84049 - DNA, 15 bp, Homo sapiens
aaaattctttccaga

SEQ ID NO: 84050 - DNA, 15 bp, Homo sapiens
caaaattctttccag

SEQ ID NO: 84051 - DNA, 15 bp, Homo sapiens
acaaaattctttcca

SEQ ID NO: 84052 - DNA, 15 bp, Homo sapiens
gacaaaattctttcc

SEQ ID NO: 84053 - DNA, 15 bp, Homo sapiens
agacaaaattctttc

SEQ ID NO: 84054 - DNA, 15 bp, Homo sapiens
aagacaaaattcttt

SEQ ID NO: 84055 - DNA, 15 bp, Homo sapiens
caagacaaaattctt

SEQ ID NO: 84056 - DNA, 15 bp, Homo sapiens
ccaagacaaaattct

SEQ ID NO: 84057 - DNA, 15 bp, Homo sapiens
cccaagacaaaattc

SEQ ID NO: 84058 - DNA, 15 bp, Homo sapiens
tcccaagacaaaatt

SEQ ID NO: 84059 - DNA, 15 bp, Homo sapiens
ctcccaagacaaaat

SEQ ID NO: 84060 - DNA, 15 bp, Homo sapiens
actcccaagacaaaa

SEQ ID NO: 84061 - DNA, 15 bp, Homo sapiens
tactcccaagacaaa

SEQ ID NO: 84062 - DNA, 15 bp, Homo sapiens
atactcccaagacaa

SEQ ID NO: 84063 - DNA, 15 bp, Homo sapiens
gatactcccaagaca

SEQ ID NO: 84064 - DNA, 15 bp, Homo sapiens
tgatactcccaagac

SEQ ID NO: 84065 - DNA, 15 bp, Homo sapiens
ttgatactcccaaga

SEQ ID NO: 84066 - DNA, 15 bp, Homo sapiens
tttgatactcccaag

SEQ ID NO: 84067 - DNA, 15 bp, Homo sapiens
gtttgatactcccaa

SEQ ID NO: 84068 - DNA, 15 bp, Homo sapiens
agtttgatactccca

SEQ ID NO: 84069 - DNA, 15 bp, Homo sapiens
tagtttgatactccc

SEQ ID NO: 84070 - DNA, 15 bp, Homo sapiens
atagtttgatactcc

SEQ ID NO: 84071 - DNA, 15 bp, Homo sapiens
tatagtttgatactc

SEQ ID NO: 84072 - DNA, 15 bp, Homo sapiens
ctatagtttgatact

SEQ ID NO: 84073 - DNA, 15 bp, Homo sapiens
tctatagtttgatac

SEQ ID NO: 84074 - DNA, 15 bp, Homo sapiens
ctctatagtttgata

SEQ ID NO: 84075 - DNA, 15 bp, Homo sapiens
tctctatagtttgat

SEQ ID NO: 84076 - DNA, 15 bp, Homo sapiens
atctctatagtttga

SEQ ID NO: 84077 - DNA, 15 bp, Homo sapiens
tatctctatagtttg

SEQ ID NO: 84078 - DNA, 15 bp, Homo sapiens
ttatctctatagttt

SEQ ID NO: 84079 - DNA, 15 bp, Homo sapiens
tttatctctatagtt

SEQ ID NO: 84080 - DNA, 15 bp, Homo sapiens
ttttatctctatagt

SEQ ID NO: 84081 - DNA, 15 bp, Homo sapiens
tttttatctctatag

SEQ ID NO: 84082 - DNA, 15 bp, Homo sapiens
ttttttatctctata

SEQ ID NO: 84083 - DNA, 15 bp, Homo sapiens
tttttttatctctat

SEQ ID NO: 84084 - DNA, 15 bp, Homo sapiens
ttttttttatctcta

SEQ ID NO: 84085 - DNA, 15 bp, Homo sapiens
attttttttatctct

SEQ ID NO: 84086 - DNA, 15 bp, Homo sapiens
tattttttttatctc

SEQ ID NO: 84087 - DNA, 15 bp, Homo sapiens
ttattttttttatct

SEQ ID NO: 84088 - DNA, 15 bp, Homo sapiens
attattttttttatc

SEQ ID NO: 84089 - DNA, 15 bp, Homo sapiens
cattattttttttat

SEQ ID NO: 84090 - DNA, 15 bp, Homo sapiens
tcattatttttttta

SEQ ID NO: 84091 - DNA, 15 bp, Homo sapiens
ttcattatttttttt

SEQ ID NO: 84092 - DNA, 15 bp, Homo sapiens
tttcattattttttt

SEQ ID NO: 84093 - DNA, 15 bp, Homo sapiens
atttcattatttttt

SEQ ID NO: 84094 - DNA, 15 bp, Homo sapiens
aatttcattattttt

SEQ ID NO: 84095 - DNA, 15 bp, Homo sapiens
taatttcattatttt

SEQ ID NO: 84096 - DNA, 15 bp, Homo sapiens
ctaatttcattattt

SEQ ID NO: 84097 - DNA, 15 bp, Homo sapiens
cctaatttcattatt

SEQ ID NO: 84098 - DNA, 15 bp, Homo sapiens
tcctaatttcattat

SEQ ID NO: 84099 - DNA, 15 bp, Homo sapiens
ctcctaatttcatta

SEQ ID NO: 84100 - DNA, 15 bp, Homo sapiens
gctcctaatttcatt

SEQ ID NO: 84101 - DNA, 15 bp, Homo sapiens
ggctcctaatttcat

SEQ ID NO: 84102 - DNA, 15 bp, Homo sapiens
tggctcctaatttca

SEQ ID NO: 84103 - DNA, 15 bp, Homo sapiens
atggctcctaatttc

SEQ ID NO: 84104 - DNA, 15 bp, Homo sapiens
aatggctcctaattt

SEQ ID NO: 84105 - DNA, 15 bp, Homo sapiens
gaatggctcctaatt

SEQ ID NO: 84106 - DNA, 15 bp, Homo sapiens
ggaatggctcctaat

SEQ ID NO: 84107 - DNA, 15 bp, Homo sapiens
aggaatggctcctaa

SEQ ID NO: 84108 - DNA, 15 bp, Homo sapiens
gaggaatggctccta

SEQ ID NO: 84109 - DNA, 15 bp, Homo sapiens
tgaggaatggctcct

SEQ ID NO: 84110 - DNA, 15 bp, Homo sapiens
ttgaggaatggctcc

SEQ ID NO: 84111 - DNA, 15 bp, Homo sapiens
gttgaggaatggctc

SEQ ID NO: 84112 - DNA, 15 bp, Homo sapiens
tgttgaggaatggct

SEQ ID NO: 84113 - DNA, 15 bp, Homo sapiens
atgttgaggaatggc

SEQ ID NO: 84114 - DNA, 15 bp, Homo sapiens
tatgttgaggaatgg

SEQ ID NO: 84115 - DNA, 15 bp, Homo sapiens
ttatgttgaggaatg

SEQ ID NO: 84116 - DNA, 15 bp, Homo sapiens
tttatgttgaggaat

SEQ ID NO: 84117 - DNA, 15 bp, Homo sapiens
ctttatgttgaggaa

SEQ ID NO: 84118 - DNA, 15 bp, Homo sapiens
tctttatgttgagga

SEQ ID NO: 84119 - DNA, 15 bp, Homo sapiens
ttctttatgttgagg

SEQ ID NO: 84120 - DNA, 15 bp, Homo sapiens
gttctttatgttgag

SEQ ID NO: 84121 - DNA, 15 bp, Homo sapiens
tgttctttatgttga

SEQ ID NO: 84122 - DNA, 15 bp, Homo sapiens
ttgttctttatgttg

SEQ ID NO: 84123 - DNA, 15 bp, Homo sapiens
tttgttctttatgtt

SEQ ID NO: 84124 - DNA, 15 bp, Homo sapiens
ttttgttctttatgt

SEQ ID NO: 84125 - DNA, 15 bp, Homo sapiens
attttgttctttatg

SEQ ID NO: 84126 - DNA, 15 bp, Homo sapiens
cattttgttctttat

SEQ ID NO: 84127 - DNA, 15 bp, Homo sapiens
acattttgttcttta

SEQ ID NO: 84128 - DNA, 15 bp, Homo sapiens
cacattttgttcttt

SEQ ID NO: 84129 - DNA, 15 bp, Homo sapiens
ccacattttgttctt

SEQ ID NO: 84130 - DNA, 15 bp, Homo sapiens
cccacattttgttct

SEQ ID NO: 84131 - DNA, 15 bp, Homo sapiens
acccacattttgttc

SEQ ID NO: 84132 - DNA, 15 bp, Homo sapiens
aacccacattttgtt

SEQ ID NO: 84133 - DNA, 15 bp, Homo sapiens
caacccacattttgt

SEQ ID NO: 84134 - DNA, 15 bp, Homo sapiens
ccaacccacattttg

SEQ ID NO: 84135 - DNA, 15 bp, Homo sapiens
cccaacccacatttt

SEQ ID NO: 84136 - DNA, 15 bp, Homo sapiens
gcccaacccacattt

SEQ ID NO: 84137 - DNA, 15 bp, Homo sapiens
agcccaacccacatt

SEQ ID NO: 84138 - DNA, 15 bp, Homo sapiens
aagcccaacccacat

SEQ ID NO: 84139 - DNA, 15 bp, Homo sapiens
caagcccaacccaca

SEQ ID NO: 84140 - DNA, 15 bp, Homo sapiens
gcaagcccaacccac

SEQ ID NO: 84141 - DNA, 15 bp, Homo sapiens
ggcaagcccaaccca

SEQ ID NO: 84142 - DNA, 15 bp, Homo sapiens
tggcaagcccaaccc

SEQ ID NO: 84143 - DNA, 15 bp, Homo sapiens
atggcaagcccaacc

SEQ ID NO: 84144 - DNA, 15 bp, Homo sapiens
catggcaagcccaac

SEQ ID NO: 84145 - DNA, 15 bp, Homo sapiens
ccatggcaagcccaa

SEQ ID NO: 84146 - DNA, 15 bp, Homo sapiens
gccatggcaagccca

SEQ ID NO: 84147 - DNA, 15 bp, Homo sapiens
agccatggcaagccc

SEQ ID NO: 84148 - DNA, 15 bp, Homo sapiens
gagccatggcaagcc

SEQ ID NO: 84149 - DNA, 15 bp, Homo sapiens
tgagccatggcaagc

SEQ ID NO: 84150 - DNA, 15 bp, Homo sapiens
gtgagccatggcaag

SEQ ID NO: 84151 - DNA, 15 bp, Homo sapiens
cgtgagccatggcaa

SEQ ID NO: 84152 - DNA, 15 bp, Homo sapiens
gcgtgagccatggca

SEQ ID NO: 84153 - DNA, 15 bp, Homo sapiens
agcgtgagccatggc

SEQ ID NO: 84154 - DNA, 15 bp, Homo sapiens
aagcgtgagccatgg

SEQ ID NO: 84155 - DNA, 15 bp, Homo sapiens
taagcgtgagccatg

SEQ ID NO: 84156 - DNA, 15 bp, Homo sapiens
ataagcgtgagccat

SEQ ID NO: 84157 - DNA, 15 bp, Homo sapiens
tataagcgtgagcca

SEQ ID NO: 84158 - DNA, 15 bp, Homo sapiens
ttataagcgtgagcc

SEQ ID NO: 84159 - DNA, 15 bp, Homo sapiens
attataagcgtgagc

SEQ ID NO: 84160 - DNA, 15 bp, Homo sapiens
aattataagcgtgag

SEQ ID NO: 84161 - DNA, 15 bp, Homo sapiens
gaattataagcgtga

SEQ ID NO: 84162 - DNA, 15 bp, Homo sapiens
ggaattataagcgtg

SEQ ID NO: 84163 - DNA, 15 bp, Homo sapiens
tggaattataagcgt

SEQ ID NO: 84164 - DNA, 15 bp, Homo sapiens
ctggaattataagcg

SEQ ID NO: 84165 - DNA, 15 bp, Homo sapiens
gctggaattataagc

SEQ ID NO: 84166 - DNA, 15 bp, Homo sapiens
tgctggaattataag

SEQ ID NO: 84167 - DNA, 15 bp, Homo sapiens
gtgctggaattataa

SEQ ID NO: 84168 - DNA, 15 bp, Homo sapiens
tgtgctggaattata

SEQ ID NO: 84169 - DNA, 15 bp, Homo sapiens
ttgtgctggaattat

SEQ ID NO: 84170 - DNA, 15 bp, Homo sapiens
cttgtgctggaatta

SEQ ID NO: 84171 - DNA, 15 bp, Homo sapiens
ccttgtgctggaatt

SEQ ID NO: 84172 - DNA, 15 bp, Homo sapiens
gccttgtgctggaat

SEQ ID NO: 84173 - DNA, 15 bp, Homo sapiens
tgccttgtgctggaa

SEQ ID NO: 84174 - DNA, 15 bp, Homo sapiens
ctgccttgtgctgga

SEQ ID NO: 84175 - DNA, 15 bp, Homo sapiens
cctgccttgtgctgg

SEQ ID NO: 84176 - DNA, 15 bp, Homo sapiens
tcctgccttgtgctg

SEQ ID NO: 84177 - DNA, 15 bp, Homo sapiens
ctcctgccttgtgct

SEQ ID NO: 84178 - DNA, 15 bp, Homo sapiens
cctcctgccttgtgc

SEQ ID NO: 84179 - DNA, 15 bp, Homo sapiens
tcctcctgccttgtg

SEQ ID NO: 84180 - DNA, 15 bp, Homo sapiens
atcctcctgccttgt

SEQ ID NO: 84181 - DNA, 15 bp, Homo sapiens
aatcctcctgccttg

SEQ ID NO: 84182 - DNA, 15 bp, Homo sapiens
caatcctcctgcctt

SEQ ID NO: 84183 - DNA, 15 bp, Homo sapiens
ggctcaagcaatcct

SEQ ID NO: 84184 - DNA, 15 bp, Homo sapiens
gtgcccaggctggtc

SEQ ID NO: 84185 - DNA, 15 bp, Homo sapiens
ggtgcccaggctggt

SEQ ID NO: 84186 - DNA, 15 bp, Homo sapiens
tatggtgcccaggct

SEQ ID NO: 84187 - DNA, 15 bp, Homo sapiens
ctatggtgcccaggc

SEQ ID NO: 84188 - DNA, 15 bp, Homo sapiens
cctatggtgcccagg

SEQ ID NO: 84189 - DNA, 15 bp, Homo sapiens
ccctatggtgcccag

SEQ ID NO: 84190 - DNA, 15 bp, Homo sapiens
tccctatggtgccca

SEQ ID NO: 84191 - DNA, 15 bp, Homo sapiens
ctccctatggtgccc

SEQ ID NO: 84192 - DNA, 15 bp, Homo sapiens
tctccctatggtgcc

SEQ ID NO: 84193 - DNA, 15 bp, Homo sapiens
gtctccctatggtgc

SEQ ID NO: 84194 - DNA, 15 bp, Homo sapiens
ggtctccctatggtg

SEQ ID NO: 84195 - DNA, 15 bp, Homo sapiens
gggtctccctatggt

SEQ ID NO: 84196 - DNA, 15 bp, Homo sapiens
ggggtctccctatgg

SEQ ID NO: 84197 - DNA, 15 bp, Homo sapiens
gggggtctccctatg

SEQ ID NO: 84198 - DNA, 15 bp, Homo sapiens
cgggggtctccctat

SEQ ID NO: 84199 - DNA, 15 bp, Homo sapiens
acgggggtctcccta

SEQ ID NO: 84200 - DNA, 15 bp, Homo sapiens
gacgggggtctccct

SEQ ID NO: 84201 - DNA, 15 bp, Homo sapiens
agacgggggtctccc

SEQ ID NO: 84202 - DNA, 15 bp, Homo sapiens
gagacgggggtctcc

SEQ ID NO: 84203 - DNA, 15 bp, Homo sapiens
agagacgggggtctc

SEQ ID NO: 84204 - DNA, 15 bp, Homo sapiens
tagagacgggggtct

SEQ ID NO: 84205 - DNA, 15 bp, Homo sapiens
gtagagacgggggtc

SEQ ID NO: 84206 - DNA, 15 bp, Homo sapiens
tgtagagacgggggt

SEQ ID NO: 84207 - DNA, 15 bp, Homo sapiens
ttgtagagacggggg

SEQ ID NO: 84208 - DNA, 15 bp, Homo sapiens
tttgtagagacgggg

SEQ ID NO: 84209 - DNA, 15 bp, Homo sapiens
ttttgtagagacggg

SEQ ID NO: 84210 - DNA, 15 bp, Homo sapiens
tttttgtagagacgg

SEQ ID NO: 84211 - DNA, 15 bp, Homo sapiens
ctttttgtagagacg

SEQ ID NO: 84212 - DNA, 15 bp, Homo sapiens
actttttgtagagac

SEQ ID NO: 84213 - DNA, 15 bp, Homo sapiens
tactttttgtagaga

SEQ ID NO: 84214 - DNA, 15 bp, Homo sapiens
ttactttttgtagag

SEQ ID NO: 84215 - DNA, 15 bp, Homo sapiens
tttactttttgtaga

SEQ ID NO: 84216 - DNA, 15 bp, Homo sapiens
ttttactttttgtag

SEQ ID NO: 84217 - DNA, 15 bp, Homo sapiens
tttttactttttgta

SEQ ID NO: 84218 - DNA, 15 bp, Homo sapiens
ttttttactttttgt

SEQ ID NO: 84219 - DNA, 15 bp, Homo sapiens
tttttttactttttg

SEQ ID NO: 84220 - DNA, 15 bp, Homo sapiens
ttttttttacttttt

SEQ ID NO: 84221 - DNA, 15 bp, Homo sapiens
tttttttttactttt

SEQ ID NO: 84222 - DNA, 15 bp, Homo sapiens
aaatttttttttttt

SEQ ID NO: 84223 - DNA, 15 bp, Homo sapiens
caaattttttttttt

SEQ ID NO: 84224 - DNA, 15 bp, Homo sapiens
acaaatttttttttt

SEQ ID NO: 84225 - DNA, 15 bp, Homo sapiens
cacaaattttttttt

SEQ ID NO: 84226 - DNA, 15 bp, Homo sapiens
ccacaaatttttttt

SEQ ID NO: 84227 - DNA, 15 bp, Homo sapiens
cccacaaattttttt

SEQ ID NO: 84228 - DNA, 15 bp, Homo sapiens
ccccacaaatttttt

SEQ ID NO: 84229 - DNA, 15 bp, Homo sapiens
gccccacaaattttt

SEQ ID NO: 84230 - DNA, 15 bp, Homo sapiens
cgccccacaaatttt

SEQ ID NO: 84231 - DNA, 15 bp, Homo sapiens
acgccccacaaattt

SEQ ID NO: 84232 - DNA, 15 bp, Homo sapiens
cacgccccacaaatt

SEQ ID NO: 84233 - DNA, 15 bp, Homo sapiens
tcacgccccacaaat

SEQ ID NO: 84234 - DNA, 15 bp, Homo sapiens
ctcacgccccacaaa

SEQ ID NO: 84235 - DNA, 15 bp, Homo sapiens
gctcacgccccacaa

SEQ ID NO: 84236 - DNA, 15 bp, Homo sapiens
agctcacgccccaca

SEQ ID NO: 84237 - DNA, 15 bp, Homo sapiens
aagctcacgccccac

SEQ ID NO: 84238 - DNA, 15 bp, Homo sapiens
caagctcacgcccca

SEQ ID NO: 84239 - DNA, 15 bp, Homo sapiens
gcaagctcacgcccc

SEQ ID NO: 84240 - DNA, 15 bp, Homo sapiens
tgcaagctcacgccc

SEQ ID NO: 84241 - DNA, 15 bp, Homo sapiens
gtgcaagctcacgcc

SEQ ID NO: 84242 - DNA, 15 bp, Homo sapiens
agtgcaagctcacgc

SEQ ID NO: 84243 - DNA, 15 bp, Homo sapiens
aagtgcaagctcacg

SEQ ID NO: 84244 - DNA, 15 bp, Homo sapiens
caagtgcaagctcac

SEQ ID NO: 84245 - DNA, 15 bp, Homo sapiens
acaagtgcaagctca

SEQ ID NO: 84246 - DNA, 15 bp, Homo sapiens
tacaagtgcaagctc

SEQ ID NO: 84247 - DNA, 15 bp, Homo sapiens
ttacaagtgcaagct

SEQ ID NO: 84248 - DNA, 15 bp, Homo sapiens
gttacaagtgcaagc

SEQ ID NO: 84249 - DNA, 15 bp, Homo sapiens
agttacaagtgcaag

SEQ ID NO: 84250 - DNA, 15 bp, Homo sapiens
gagttacaagtgcaa

SEQ ID NO: 84251 - DNA, 15 bp, Homo sapiens
ggagttacaagtgca

SEQ ID NO: 84252 - DNA, 15 bp, Homo sapiens
tggagttacaagtgc

SEQ ID NO: 84253 - DNA, 15 bp, Homo sapiens
ttggagttacaagtg

SEQ ID NO: 84254 - DNA, 15 bp, Homo sapiens
gttggagttacaagt

SEQ ID NO: 84255 - DNA, 15 bp, Homo sapiens
agttggagttacaag

SEQ ID NO: 84256 - DNA, 15 bp, Homo sapiens
tagttggagttacaa

SEQ ID NO: 84257 - DNA, 15 bp, Homo sapiens
gtagttggagttaca

SEQ ID NO: 84258 - DNA, 15 bp, Homo sapiens
agtagttggagttac

SEQ ID NO: 84259 - DNA, 15 bp, Homo sapiens
gagtagttggagtta

SEQ ID NO: 84260 - DNA, 15 bp, Homo sapiens
cgagtagttggagtt

SEQ ID NO: 84261 - DNA, 15 bp, Homo sapiens
ccgagtagttggagt

SEQ ID NO: 84262 - DNA, 15 bp, Homo sapiens
cccgagtagttggag

SEQ ID NO: 84263 - DNA, 15 bp, Homo sapiens
tcccgagtagttgga

SEQ ID NO: 84264 - DNA, 15 bp, Homo sapiens
ctcccgagtagttgg

SEQ ID NO: 84265 - DNA, 15 bp, Homo sapiens
cctcccgagtagttg

SEQ ID NO: 84266 - DNA, 15 bp, Homo sapiens
gcctcccgagtagtt

SEQ ID NO: 84267 - DNA, 15 bp, Homo sapiens
agcctcccgagtagt

SEQ ID NO: 84268 - DNA, 15 bp, Homo sapiens
tctcagcctcccgag

SEQ ID NO: 84269 - DNA, 15 bp, Homo sapiens
atctcagcctcccga

SEQ ID NO: 84270 - DNA, 15 bp, Homo sapiens
tatctcagcctcccg

SEQ ID NO: 84271 - DNA, 15 bp, Homo sapiens
ctatctcagcctccc

SEQ ID NO: 84272 - DNA, 15 bp, Homo sapiens
cctatctcagcctcc

SEQ ID NO: 84273 - DNA, 15 bp, Homo sapiens
tcctatctcagcctc

SEQ ID NO: 84274 - DNA, 15 bp, Homo sapiens
ctcctatctcagcct

SEQ ID NO: 84275 - DNA, 15 bp, Homo sapiens
cctcctatctcagcc

SEQ ID NO: 84276 - DNA, 15 bp, Homo sapiens
tcctcctatctcagc

SEQ ID NO: 84277 - DNA, 15 bp, Homo sapiens
atcctcctatctcag

SEQ ID NO: 84278 - DNA, 15 bp, Homo sapiens
gatcctcctatctca

SEQ ID NO: 84279 - DNA, 15 bp, Homo sapiens
ggatcctcctatctc

SEQ ID NO: 84280 - DNA, 15 bp, Homo sapiens
aggatcctcctatct

SEQ ID NO: 84281 - DNA, 15 bp, Homo sapiens
aaggatcctcctatc

SEQ ID NO: 84282 - DNA, 15 bp, Homo sapiens
aaaggatcctcctat

SEQ ID NO: 84283 - DNA, 15 bp, Homo sapiens
caaaggatcctccta

SEQ ID NO: 84284 - DNA, 15 bp, Homo sapiens
tcaaaggatcctcct

SEQ ID NO: 84285 - DNA, 15 bp, Homo sapiens
ctcaaaggatcctcc

SEQ ID NO: 84286 - DNA, 15 bp, Homo sapiens
gctcaaaggatcctc

SEQ ID NO: 84287 - DNA, 15 bp, Homo sapiens
ggctcaaaggatcct

SEQ ID NO: 84288 - DNA, 15 bp, Homo sapiens
gggctcaaaggatcc

SEQ ID NO: 84289 - DNA, 15 bp, Homo sapiens
tgggctcaaaggatc

SEQ ID NO: 84290 - DNA, 15 bp, Homo sapiens
ctgggctcaaaggat

SEQ ID NO: 84291 - DNA, 15 bp, Homo sapiens
cctgggctcaaagga

SEQ ID NO: 84292 - DNA, 15 bp, Homo sapiens
tcctgggctcaaagg

SEQ ID NO: 84293 - DNA, 15 bp, Homo sapiens
ctcctgggctcaaag

SEQ ID NO: 84294 - DNA, 15 bp, Homo sapiens
cctcctgggctcaaa

SEQ ID NO: 84295 - DNA, 15 bp, Homo sapiens
acctcctgggctcaa

SEQ ID NO: 84296 - DNA, 15 bp, Homo sapiens
aacctcctgggctca

SEQ ID NO: 84297 - DNA, 15 bp, Homo sapiens
caacctcctgggctc

SEQ ID NO: 84298 - DNA, 15 bp, Homo sapiens
tcaacctcctgggct

SEQ ID NO: 84299 - DNA, 15 bp, Homo sapiens
ctcaacctcctgggc

SEQ ID NO: 84300 - DNA, 15 bp, Homo sapiens
cctcaacctcctggg

SEQ ID NO: 84301 - DNA, 15 bp, Homo sapiens
gcctcaacctcctgg

SEQ ID NO: 84302 - DNA, 15 bp, Homo sapiens
agcctcaacctcctg

SEQ ID NO: 84303 - DNA, 15 bp, Homo sapiens
cagcctcaacctcct

SEQ ID NO: 84304 - DNA, 15 bp, Homo sapiens
gcagcctcaacctcc

SEQ ID NO: 84305 - DNA, 15 bp, Homo sapiens
tgcagcctcaacctc

SEQ ID NO: 84306 - DNA, 15 bp, Homo sapiens
ctgcagcctcaacct

SEQ ID NO: 84307 - DNA, 15 bp, Homo sapiens
actgcagcctcaacc

SEQ ID NO: 84308 - DNA, 15 bp, Homo sapiens
cactgcagcctcaac

SEQ ID NO: 84309 - DNA, 15 bp, Homo sapiens
tcactgcagcctcaa

SEQ ID NO: 84310 - DNA, 15 bp, Homo sapiens
ctcactgcagcctca

SEQ ID NO: 84311 - DNA, 15 bp, Homo sapiens
tggctcactgcagcc

SEQ ID NO: 84312 - DNA, 15 bp, Homo sapiens
atggctcactgcagc

SEQ ID NO: 84313 - DNA, 15 bp, Homo sapiens
catggctcactgcag

SEQ ID NO: 84314 - DNA, 15 bp, Homo sapiens
tcatggctcactgca

SEQ ID NO: 84315 - DNA, 15 bp, Homo sapiens
atcatggctcactgc

SEQ ID NO: 84316 - DNA, 15 bp, Homo sapiens
aatcatggctcactg

SEQ ID NO: 84317 - DNA, 15 bp, Homo sapiens
caatcatggctcact

SEQ ID NO: 84318 - DNA, 15 bp, Homo sapiens
acaatcatggctcac

SEQ ID NO: 84319 - DNA, 15 bp, Homo sapiens
cacaatcatggctca

SEQ ID NO: 84320 - DNA, 15 bp, Homo sapiens
gcacaatcatggctc

SEQ ID NO: 84321 - DNA, 15 bp, Homo sapiens
ggcacaatcatggct

SEQ ID NO: 84322 - DNA, 15 bp, Homo sapiens
tggcacaatcatggc

SEQ ID NO: 84323 - DNA, 15 bp, Homo sapiens
gtggcacaatcatgg

SEQ ID NO: 84324 - DNA, 15 bp, Homo sapiens
agtggcacaatcatg

SEQ ID NO: 84325 - DNA, 15 bp, Homo sapiens
cagtggcacaatcat

SEQ ID NO: 84326 - DNA, 15 bp, Homo sapiens
gcagtggcacaatca

SEQ ID NO: 84327 - DNA, 15 bp, Homo sapiens
ggtgcagtggcacaa

SEQ ID NO: 84328 - DNA, 15 bp, Homo sapiens
gggtgcagtggcaca

SEQ ID NO: 84329 - DNA, 15 bp, Homo sapiens
ggggtgcagtggcac

SEQ ID NO: 84330 - DNA, 15 bp, Homo sapiens
tggggtgcagtggca

SEQ ID NO: 84331 - DNA, 15 bp, Homo sapiens
ctggggtgcagtggc

SEQ ID NO: 84332 - DNA, 15 bp, Homo sapiens
gctggggtgcagtgg

SEQ ID NO: 84333 - DNA, 15 bp, Homo sapiens
ggctggggtgcagtg

SEQ ID NO: 84334 - DNA, 15 bp, Homo sapiens
aggctggggtgcagt

SEQ ID NO: 84335 - DNA, 15 bp, Homo sapiens
caggctggggtgcag

SEQ ID NO: 84336 - DNA, 15 bp, Homo sapiens
ccaggctggggtgca

SEQ ID NO: 84337 - DNA, 15 bp, Homo sapiens
cccaggctggggtgc

SEQ ID NO: 84338 - DNA, 15 bp, Homo sapiens
acccaggctggggtg

SEQ ID NO: 84339 - DNA, 15 bp, Homo sapiens
cacccaggctggggt

SEQ ID NO: 84340 - DNA, 15 bp, Homo sapiens
tcacccaggctgggg

SEQ ID NO: 84341 - DNA, 15 bp, Homo sapiens
gtcacccaggctggg

SEQ ID NO: 84342 - DNA, 15 bp, Homo sapiens
gtcactctgtcaccc

SEQ ID NO: 84343 - DNA, 15 bp, Homo sapiens
tgtcactctgtcacc

SEQ ID NO: 84344 - DNA, 15 bp, Homo sapiens
ttgtcactctgtcac

SEQ ID NO: 84345 - DNA, 15 bp, Homo sapiens
gttgtcactctgtca

SEQ ID NO: 84346 - DNA, 15 bp, Homo sapiens
ggttgtcactctgtc

SEQ ID NO: 84347 - DNA, 15 bp, Homo sapiens
aggttgtcactctgt

SEQ ID NO: 84348 - DNA, 15 bp, Homo sapiens
caggttgtcactctg

SEQ ID NO: 84349 - DNA, 15 bp, Homo sapiens
gcaggttgtcactct

SEQ ID NO: 84350 - DNA, 15 bp, Homo sapiens
ggcaggttgtcactc

SEQ ID NO: 84351 - DNA, 15 bp, Homo sapiens
aggcaggttgtcact

SEQ ID NO: 84352 - DNA, 15 bp, Homo sapiens
gaggcaggttgtcac

SEQ ID NO: 84353 - DNA, 15 bp, Homo sapiens
tgaggcaggttgtca

SEQ ID NO: 84354 - DNA, 15 bp, Homo sapiens
ttgaggcaggttgtc

SEQ ID NO: 84355 - DNA, 15 bp, Homo sapiens
tttgaggcaggttgt

SEQ ID NO: 84356 - DNA, 15 bp, Homo sapiens
ctttgaggcaggttg

SEQ ID NO: 84357 - DNA, 15 bp, Homo sapiens
tctttgaggcaggtt

SEQ ID NO: 84358 - DNA, 15 bp, Homo sapiens
ttctttgaggcaggt

SEQ ID NO: 84359 - DNA, 15 bp, Homo sapiens
tttctttgaggcagg

SEQ ID NO: 84360 - DNA, 15 bp, Homo sapiens
ttttctttgaggcag

SEQ ID NO: 84361 - DNA, 15 bp, Homo sapiens
tttttctttgaggca

SEQ ID NO: 84362 - DNA, 15 bp, Homo sapiens
ttttttctttgaggc

SEQ ID NO: 84363 - DNA, 15 bp, Homo sapiens
tttttttctttgagg

SEQ ID NO: 84364 - DNA, 15 bp, Homo sapiens
ttttttttctttgag

SEQ ID NO: 84365 - DNA, 15 bp, Homo sapiens
tttttttttctttga

SEQ ID NO: 84366 - DNA, 15 bp, Homo sapiens
ttttttttttctttg

SEQ ID NO: 84367 - DNA, 15 bp, Homo sapiens
tttttttttttcttt

SEQ ID NO: 84368 - DNA, 15 bp, Homo sapiens
ttttttttttttctt

SEQ ID NO: 84369 - DNA, 15 bp, Homo sapiens
tttttttttttttct

SEQ ID NO: 84370 - DNA, 15 bp, Homo sapiens
ttttttttttttttc

SEQ ID NO: 84371 - DNA, 15 bp, Homo sapiens
ccttttttttttttt

SEQ ID NO: 84372 - DNA, 15 bp, Homo sapiens
gttcctttttttttt

SEQ ID NO: 84373 - DNA, 15 bp, Homo sapiens
tgttccttttttttt

SEQ ID NO: 84374 - DNA, 15 bp, Homo sapiens
ttgttcctttttttt

SEQ ID NO: 84375 - DNA, 15 bp, Homo sapiens
tttgttccttttttt

SEQ ID NO: 84376 - DNA, 15 bp, Homo sapiens
ttttgttcctttttt

SEQ ID NO: 84377 - DNA, 15 bp, Homo sapiens
attttgttccttttt

SEQ ID NO: 84378 - DNA, 15 bp, Homo sapiens
cattttgttcctttt

SEQ ID NO: 84379 - DNA, 15 bp, Homo sapiens
gcattttgttccttt

SEQ ID NO: 84380 - DNA, 15 bp, Homo sapiens
agcattttgttcctt

SEQ ID NO: 84381 - DNA, 15 bp, Homo sapiens
aagcattttgttcct

SEQ ID NO: 84382 - DNA, 15 bp, Homo sapiens
aaagcattttgttcc

SEQ ID NO: 84383 - DNA, 15 bp, Homo sapiens
caaagcattttgttc

SEQ ID NO: 84384 - DNA, 15 bp, Homo sapiens
ccaaagcattttgtt

SEQ ID NO: 84385 - DNA, 15 bp, Homo sapiens
accaaagcattttgt

SEQ ID NO: 84386 - DNA, 15 bp, Homo sapiens
aaccaaagcattttg

SEQ ID NO: 84387 - DNA, 15 bp, Homo sapiens
aaaccaaagcatttt

SEQ ID NO: 84388 - DNA, 15 bp, Homo sapiens
caaaccaaagcattt

SEQ ID NO: 84389 - DNA, 15 bp, Homo sapiens
ccaaaccaaagcatt

SEQ ID NO: 84390 - DNA, 15 bp, Homo sapiens
cccaaaccaaagcat

SEQ ID NO: 84391 - DNA, 15 bp, Homo sapiens
acccaaaccaaagca

SEQ ID NO: 84392 - DNA, 15 bp, Homo sapiens
aacccaaaccaaagc

SEQ ID NO: 84393 - DNA, 15 bp, Homo sapiens
gaacccaaaccaaag

SEQ ID NO: 84394 - DNA, 15 bp, Homo sapiens
agaacccaaaccaaa

SEQ ID NO: 84395 - DNA, 15 bp, Homo sapiens
tagaacccaaaccaa

SEQ ID NO: 84396 - DNA, 15 bp, Homo sapiens
ttagaacccaaacca

SEQ ID NO: 84397 - DNA, 15 bp, Homo sapiens
tttagaacccaaacc

SEQ ID NO: 84398 - DNA, 15 bp, Homo sapiens
ctttagaacccaaac

SEQ ID NO: 84399 - DNA, 15 bp, Homo sapiens
gctttagaacccaaa

SEQ ID NO: 84400 - DNA, 15 bp, Homo sapiens
tgctttagaacccaa

SEQ ID NO: 84401 - DNA, 15 bp, Homo sapiens
atgctttagaaccca

SEQ ID NO: 84402 - DNA, 15 bp, Homo sapiens
tatgctttagaaccc

SEQ ID NO: 84403 - DNA, 15 bp, Homo sapiens
atatgctttagaacc

SEQ ID NO: 84404 - DNA, 15 bp, Homo sapiens
aatatgctttagaac

SEQ ID NO: 84405 - DNA, 15 bp, Homo sapiens
aaatatgctttagaa

SEQ ID NO: 84406 - DNA, 15 bp, Homo sapiens
taaatatgctttaga

SEQ ID NO: 84407 - DNA, 15 bp, Homo sapiens
gtaaatatgctttag

SEQ ID NO: 84408 - DNA, 15 bp, Homo sapiens
agtaaatatgcttta

SEQ ID NO: 84409 - DNA, 15 bp, Homo sapiens
tagtaaatatgcttt

SEQ ID NO: 84410 - DNA, 15 bp, Homo sapiens
atagtaaatatgctt

SEQ ID NO: 84411 - DNA, 15 bp, Homo sapiens
aatagtaaatatgct

SEQ ID NO: 84412 - DNA, 15 bp, Homo sapiens
aaatagtaaatatgc

SEQ ID NO: 84413 - DNA, 15 bp, Homo sapiens
aaaatagtaaatatg

SEQ ID NO: 84414 - DNA, 15 bp, Homo sapiens
gaaaatagtaaatat

SEQ ID NO: 84415 - DNA, 15 bp, Homo sapiens
tgaaaatagtaaata

SEQ ID NO: 84416 - DNA, 15 bp, Homo sapiens
atgaaaatagtaaat

SEQ ID NO: 84417 - DNA, 15 bp, Homo sapiens
aatgaaaatagtaaa

SEQ ID NO: 84418 - DNA, 15 bp, Homo sapiens
taatgaaaatagtaa

SEQ ID NO: 84419 - DNA, 15 bp, Homo sapiens
ataatgaaaatagta

SEQ ID NO: 84420 - DNA, 15 bp, Homo sapiens
aataatgaaaatagt

SEQ ID NO: 84421 - DNA, 15 bp, Homo sapiens
aaataatgaaaatag

SEQ ID NO: 84422 - DNA, 15 bp, Homo sapiens
taaataatgaaaata

SEQ ID NO: 84423 - DNA, 15 bp, Homo sapiens
ttaaataatgaaaat

SEQ ID NO: 84424 - DNA, 15 bp, Homo sapiens
tttaaataatgaaaa

SEQ ID NO: 84425 - DNA, 15 bp, Homo sapiens
ttttaaataatgaaa

SEQ ID NO: 84426 - DNA, 15 bp, Homo sapiens
tttttaaataatgaa

SEQ ID NO: 84427 - DNA, 15 bp, Homo sapiens
atttttaaataatga

SEQ ID NO: 84428 - DNA, 15 bp, Homo sapiens
aatttttaaataatg

SEQ ID NO: 84429 - DNA, 15 bp, Homo sapiens
taatttttaaataat

SEQ ID NO: 84430 - DNA, 15 bp, Homo sapiens
ataatttttaaataa

SEQ ID NO: 84431 - DNA, 15 bp, Homo sapiens
cataatttttaaata

SEQ ID NO: 84432 - DNA, 15 bp, Homo sapiens
acataatttttaaat

SEQ ID NO: 84433 - DNA, 15 bp, Homo sapiens
tacataatttttaaa

SEQ ID NO: 84434 - DNA, 15 bp, Homo sapiens
atacataatttttaa

SEQ ID NO: 84435 - DNA, 15 bp, Homo sapiens
catacataattttta

SEQ ID NO: 84436 - DNA, 15 bp, Homo sapiens
tcatacataattttt

SEQ ID NO: 84437 - DNA, 15 bp, Homo sapiens
ttcatacataatttt

SEQ ID NO: 84438 - DNA, 15 bp, Homo sapiens
tttcatacataattt

SEQ ID NO: 84439 - DNA, 15 bp, Homo sapiens
atttcatacataatt

SEQ ID NO: 84440 - DNA, 15 bp, Homo sapiens
tatttcatacataat

SEQ ID NO: 84441 - DNA, 15 bp, Homo sapiens
atatttcatacataa

SEQ ID NO: 84442 - DNA, 15 bp, Homo sapiens
catatttcatacata

SEQ ID NO: 84443 - DNA, 15 bp, Homo sapiens
tcatatttcatacat

SEQ ID NO: 84444 - DNA, 15 bp, Homo sapiens
atcatatttcataca

SEQ ID NO: 84445 - DNA, 15 bp, Homo sapiens
aatcatatttcatac

SEQ ID NO: 84446 - DNA, 15 bp, Homo sapiens
caatcatatttcata

SEQ ID NO: 84447 - DNA, 15 bp, Homo sapiens
acaatcatatttcat

SEQ ID NO: 84448 - DNA, 15 bp, Homo sapiens
cacaatcatatttca

SEQ ID NO: 84449 - DNA, 15 bp, Homo sapiens
gcacaatcatatttc

SEQ ID NO: 84450 - DNA, 15 bp, Homo sapiens
agcacaatcatattt

SEQ ID NO: 84451 - DNA, 15 bp, Homo sapiens
aagcacaatcatatt

SEQ ID NO: 84452 - DNA, 15 bp, Homo sapiens
caagcacaatcatat

SEQ ID NO: 84453 - DNA, 15 bp, Homo sapiens
tcaagcacaatcata

SEQ ID NO: 84454 - DNA, 15 bp, Homo sapiens
ttcaagcacaatcat

SEQ ID NO: 84455 - DNA, 15 bp, Homo sapiens
cttcaagcacaatca

SEQ ID NO: 84456 - DNA, 15 bp, Homo sapiens
acttcaagcacaatc

SEQ ID NO: 84457 - DNA, 15 bp, Homo sapiens
aacttcaagcacaat

SEQ ID NO: 84458 - DNA, 15 bp, Homo sapiens
aaacttcaagcacaa

SEQ ID NO: 84459 - DNA, 15 bp, Homo sapiens
caaacttcaagcaca

SEQ ID NO: 84460 - DNA, 15 bp, Homo sapiens
gcaaacttcaagcac

SEQ ID NO: 84461 - DNA, 15 bp, Homo sapiens
tgcaaacttcaagca

SEQ ID NO: 84462 - DNA, 15 bp, Homo sapiens
atgcaaacttcaagc

SEQ ID NO: 84463 - DNA, 15 bp, Homo sapiens
aatgcaaacttcaag

SEQ ID NO: 84464 - DNA, 15 bp, Homo sapiens
caatgcaaacttcaa

SEQ ID NO: 84465 - DNA, 15 bp, Homo sapiens
tcaatgcaaacttca

SEQ ID NO: 84466 - DNA, 15 bp, Homo sapiens
ttcaatgcaaacttc

SEQ ID NO: 84467 - DNA, 15 bp, Homo sapiens
gttcaatgcaaactt

SEQ ID NO: 84468 - DNA, 15 bp, Homo sapiens
ggttcaatgcaaact

SEQ ID NO: 84469 - DNA, 15 bp, Homo sapiens
gggttcaatgcaaac

SEQ ID NO: 84470 - DNA, 15 bp, Homo sapiens
agggttcaatgcaaa

SEQ ID NO: 84471 - DNA, 15 bp, Homo sapiens
tagggttcaatgcaa

SEQ ID NO: 84472 - DNA, 15 bp, Homo sapiens
ctagggttcaatgca

SEQ ID NO: 84473 - DNA, 15 bp, Homo sapiens
tctagggttcaatgc

SEQ ID NO: 84474 - DNA, 15 bp, Homo sapiens
gtctagggttcaatg

SEQ ID NO: 84475 - DNA, 15 bp, Homo sapiens
agtctagggttcaat

SEQ ID NO: 84476 - DNA, 15 bp, Homo sapiens
aagtctagggttcaa

SEQ ID NO: 84477 - DNA, 15 bp, Homo sapiens
taagtctagggttca

SEQ ID NO: 84478 - DNA, 15 bp, Homo sapiens
ttaagtctagggttc

SEQ ID NO: 84479 - DNA, 15 bp, Homo sapiens
attaagtctagggtt

SEQ ID NO: 84480 - DNA, 15 bp, Homo sapiens
tattaagtctagggt

SEQ ID NO: 84481 - DNA, 15 bp, Homo sapiens
atattaagtctaggg

SEQ ID NO: 84482 - DNA, 15 bp, Homo sapiens
tatattaagtctagg

SEQ ID NO: 84483 - DNA, 15 bp, Homo sapiens
ttatattaagtctag

SEQ ID NO: 84484 - DNA, 15 bp, Homo sapiens
gttatattaagtcta

SEQ ID NO: 84485 - DNA, 15 bp, Homo sapiens
ggttatattaagtct

SEQ ID NO: 84486 - DNA, 15 bp, Homo sapiens
gggttatattaagtc

SEQ ID NO: 84487 - DNA, 15 bp, Homo sapiens
tgggttatattaagt

SEQ ID NO: 84488 - DNA, 15 bp, Homo sapiens
ttgggttatattaag

SEQ ID NO: 84489 - DNA, 15 bp, Homo sapiens
tttgggttatattaa

SEQ ID NO: 84490 - DNA, 15 bp, Homo sapiens
gtttgggttatatta

SEQ ID NO: 84491 - DNA, 15 bp, Homo sapiens
tgtttgggttatatt

SEQ ID NO: 84492 - DNA, 15 bp, Homo sapiens
ttgtttgggttatat

SEQ ID NO: 84493 - DNA, 15 bp, Homo sapiens
tttgtttgggttata

SEQ ID NO: 84494 - DNA, 15 bp, Homo sapiens
atttgtttgggttat

SEQ ID NO: 84495 - DNA, 15 bp, Homo sapiens
tatttgtttgggtta

SEQ ID NO: 84496 - DNA, 15 bp, Homo sapiens
ttatttgtttgggtt

SEQ ID NO: 84497 - DNA, 15 bp, Homo sapiens
attatttgtttgggt

SEQ ID NO: 84498 - DNA, 15 bp, Homo sapiens
tattatttgtttggg

SEQ ID NO: 84499 - DNA, 15 bp, Homo sapiens
gtattatttgtttgg

SEQ ID NO: 84500 - DNA, 15 bp, Homo sapiens
agtattatttgtttg

SEQ ID NO: 84501 - DNA, 15 bp, Homo sapiens
cagtattatttgttt

SEQ ID NO: 84502 - DNA, 15 bp, Homo sapiens
tcagtattatttgtt

SEQ ID NO: 84503 - DNA, 15 bp, Homo sapiens
ctcagtattatttgt

SEQ ID NO: 84504 - DNA, 15 bp, Homo sapiens
gctcagtattatttg

SEQ ID NO: 84505 - DNA, 15 bp, Homo sapiens
ggctcagtattattt

SEQ ID NO: 84506 - DNA, 15 bp, Homo sapiens
aggctcagtattatt

SEQ ID NO: 84507 - DNA, 15 bp, Homo sapiens
gaggctcagtattat

SEQ ID NO: 84508 - DNA, 15 bp, Homo sapiens
tgaggctcagtatta

SEQ ID NO: 84509 - DNA, 15 bp, Homo sapiens
ttgaggctcagtatt

SEQ ID NO: 84510 - DNA, 15 bp, Homo sapiens
tttgaggctcagtat

SEQ ID NO: 84511 - DNA, 15 bp, Homo sapiens
ttttgaggctcagta

SEQ ID NO: 84512 - DNA, 15 bp, Homo sapiens
attttgaggctcagt

SEQ ID NO: 84513 - DNA, 15 bp, Homo sapiens
tattttgaggctcag

SEQ ID NO: 84514 - DNA, 15 bp, Homo sapiens
atattttgaggctca

SEQ ID NO: 84515 - DNA, 15 bp, Homo sapiens
aatattttgaggctc

SEQ ID NO: 84516 - DNA, 15 bp, Homo sapiens
aaatattttgaggct

SEQ ID NO: 84517 - DNA, 15 bp, Homo sapiens
gaaatattttgaggc

SEQ ID NO: 84518 - DNA, 15 bp, Homo sapiens
agaaatattttgagg

SEQ ID NO: 84519 - DNA, 15 bp, Homo sapiens
tagaaatattttgag

SEQ ID NO: 84520 - DNA, 15 bp, Homo sapiens
atagaaatattttga

SEQ ID NO: 84521 - DNA, 15 bp, Homo sapiens
gatagaaatattttg

SEQ ID NO: 84522 - DNA, 15 bp, Homo sapiens
ggatagaaatatttt

SEQ ID NO: 84523 - DNA, 15 bp, Homo sapiens
tggatagaaatattt

SEQ ID NO: 84524 - DNA, 15 bp, Homo sapiens
atggatagaaatatt

SEQ ID NO: 84525 - DNA, 15 bp, Homo sapiens
aatggatagaaatat

SEQ ID NO: 84526 - DNA, 15 bp, Homo sapiens
aaatggatagaaata

SEQ ID NO: 84527 - DNA, 15 bp, Homo sapiens
aaaatggatagaaat

SEQ ID NO: 84528 - DNA, 15 bp, Homo sapiens
aaaaatggatagaaa

SEQ ID NO: 84529 - DNA, 15 bp, Homo sapiens
aaaaaatggatagaa

SEQ ID NO: 84530 - DNA, 15 bp, Homo sapiens
gaaaaaatggataga

SEQ ID NO: 84531 - DNA, 15 bp, Homo sapiens
agaaaaaatggatag

SEQ ID NO: 84532 - DNA, 15 bp, Homo sapiens
cagaaaaaatggata

SEQ ID NO: 84533 - DNA, 15 bp, Homo sapiens
acagaaaaaatggat

SEQ ID NO: 84534 - DNA, 15 bp, Homo sapiens
aacagaaaaaatgga

SEQ ID NO: 84535 - DNA, 15 bp, Homo sapiens
aaacagaaaaaatgg

SEQ ID NO: 84536 - DNA, 15 bp, Homo sapiens
aaaacagaaaaaatg

SEQ ID NO: 84537 - DNA, 15 bp, Homo sapiens
gaaaacagaaaaaat

SEQ ID NO: 84538 - DNA, 15 bp, Homo sapiens
agaaaacagaaaaaa

SEQ ID NO: 84539 - DNA, 15 bp, Homo sapiens
aagaaaacagaaaaa

SEQ ID NO: 84540 - DNA, 15 bp, Homo sapiens
aaagaaaacagaaaa

SEQ ID NO: 84541 - DNA, 15 bp, Homo sapiens
gaaagaaaacagaaa

SEQ ID NO: 84542 - DNA, 15 bp, Homo sapiens
agaaagaaaacagaa

SEQ ID NO: 84543 - DNA, 15 bp, Homo sapiens
aagaaagaaaacaga

SEQ ID NO: 84544 - DNA, 15 bp, Homo sapiens
aaagaaagaaaacag

SEQ ID NO: 84545 - DNA, 15 bp, Homo sapiens
caaaagaaagaaaac

SEQ ID NO: 84546 - DNA, 15 bp, Homo sapiens
tcaaaagaaagaaaa

SEQ ID NO: 84547 - DNA, 15 bp, Homo sapiens
ctcaaaagaaagaaa

SEQ ID NO: 84548 - DNA, 15 bp, Homo sapiens
tctcaaaagaaagaa

SEQ ID NO: 84549 - DNA, 15 bp, Homo sapiens
atctcaaaagaaaga

SEQ ID NO: 84550 - DNA, 15 bp, Homo sapiens
catctcaaaagaaag

SEQ ID NO: 84551 - DNA, 15 bp, Homo sapiens
ccatctcaaaagaaa

SEQ ID NO: 84552 - DNA, 15 bp, Homo sapiens
cccatctcaaaagaa

SEQ ID NO: 84553 - DNA, 15 bp, Homo sapiens
tcccatctcaaaaga

SEQ ID NO: 84554 - DNA, 15 bp, Homo sapiens
ctcccatctcaaaag

SEQ ID NO: 84555 - DNA, 15 bp, Homo sapiens
actcccatctcaaaa

SEQ ID NO: 84556 - DNA, 15 bp, Homo sapiens
aactcccatctcaaa

SEQ ID NO: 84557 - DNA, 15 bp, Homo sapiens
aaactcccatctcaa

SEQ ID NO: 84558 - DNA, 15 bp, Homo sapiens
aaaactcccatctca

SEQ ID NO: 84559 - DNA, 15 bp, Homo sapiens
caaaactcccatctc

SEQ ID NO: 84560 - DNA, 15 bp, Homo sapiens
gcaaaactcccatct

SEQ ID NO: 84561 - DNA, 15 bp, Homo sapiens
agcaaaactcccatc

SEQ ID NO: 84562 - DNA, 15 bp, Homo sapiens
gagcaaaactcccat

SEQ ID NO: 84563 - DNA, 15 bp, Homo sapiens
agagcaaaactccca

SEQ ID NO: 84564 - DNA, 15 bp, Homo sapiens
cagagcaaaactccc

SEQ ID NO: 84565 - DNA, 15 bp, Homo sapiens
acagagcaaaactcc

SEQ ID NO: 84566 - DNA, 15 bp, Homo sapiens
aacagagcaaaactc

SEQ ID NO: 84567 - DNA, 15 bp, Homo sapiens
caacagagcaaaact

SEQ ID NO: 84568 - DNA, 15 bp, Homo sapiens
gcaacagagcaaaac

SEQ ID NO: 84569 - DNA, 15 bp, Homo sapiens
ggcaacagagcaaaa

SEQ ID NO: 84570 - DNA, 15 bp, Homo sapiens
gggcaacagagcaaa

SEQ ID NO: 84571 - DNA, 15 bp, Homo sapiens
ggagccgagattgca

SEQ ID NO: 84572 - DNA, 15 bp, Homo sapiens
gggagccgagattgc

SEQ ID NO: 84573 - DNA, 15 bp, Homo sapiens
agggagccgagattg

SEQ ID NO: 84574 - DNA, 15 bp, Homo sapiens
cagggagccgagatt

SEQ ID NO: 84575 - DNA, 15 bp, Homo sapiens
gcagggagccgagat

SEQ ID NO: 84576 - DNA, 15 bp, Homo sapiens
tgcagggagccgaga

SEQ ID NO: 84577 - DNA, 15 bp, Homo sapiens
ttgcagggagccgag

SEQ ID NO: 84578 - DNA, 15 bp, Homo sapiens
gttgcagggagccga

SEQ ID NO: 84579 - DNA, 15 bp, Homo sapiens
ggttgcagggagccg

SEQ ID NO: 84580 - DNA, 15 bp, Homo sapiens
ttgaacccgggaggc

SEQ ID NO: 84581 - DNA, 15 bp, Homo sapiens
tgcttgaacccggga

SEQ ID NO: 84582 - DNA, 15 bp, Homo sapiens
ttgcttgaacccggg

SEQ ID NO: 84583 - DNA, 15 bp, Homo sapiens
attgcttgaacccgg

SEQ ID NO: 84584 - DNA, 15 bp, Homo sapiens
tgagaattgcttgaa

SEQ ID NO: 84585 - DNA, 15 bp, Homo sapiens
atgagaattgcttga

SEQ ID NO: 84586 - DNA, 15 bp, Homo sapiens
catgagaattgcttg

SEQ ID NO: 84587 - DNA, 15 bp, Homo sapiens
gcatgagaattgctt

SEQ ID NO: 84588 - DNA, 15 bp, Homo sapiens
ggcatgagaattgct

SEQ ID NO: 84589 - DNA, 15 bp, Homo sapiens
aggcatgagaattgc

SEQ ID NO: 84590 - DNA, 15 bp, Homo sapiens
taggcatgagaattg

SEQ ID NO: 84591 - DNA, 15 bp, Homo sapiens
ttaggcatgagaatt

SEQ ID NO: 84592 - DNA, 15 bp, Homo sapiens
cttaggcatgagaat

SEQ ID NO: 84593 - DNA, 15 bp, Homo sapiens
gcttaggcatgagaa

SEQ ID NO: 84594 - DNA, 15 bp, Homo sapiens
ggcttaggcatgaga

SEQ ID NO: 84595 - DNA, 15 bp, Homo sapiens
aggcttaggcatgag

SEQ ID NO: 84596 - DNA, 15 bp, Homo sapiens
gaggcttaggcatga

SEQ ID NO: 84597 - DNA, 15 bp, Homo sapiens
ggaggcttaggcatg

SEQ ID NO: 84598 - DNA, 15 bp, Homo sapiens
aggaggcttaggcat

SEQ ID NO: 84599 - DNA, 15 bp, Homo sapiens
caggaggcttaggca

SEQ ID NO: 84600 - DNA, 15 bp, Homo sapiens
tcaggaggcttaggc

SEQ ID NO: 84601 - DNA, 15 bp, Homo sapiens
ctcaggaggcttagg

SEQ ID NO: 84602 - DNA, 15 bp, Homo sapiens
gctcaggaggcttag

SEQ ID NO: 84603 - DNA, 15 bp, Homo sapiens
tgctcaggaggctta

SEQ ID NO: 84604 - DNA, 15 bp, Homo sapiens
ctgctcaggaggctt

SEQ ID NO: 84605 - DNA, 15 bp, Homo sapiens
gctgctcaggaggct

SEQ ID NO: 84606 - DNA, 15 bp, Homo sapiens
agctgctcaggaggc

SEQ ID NO: 84607 - DNA, 15 bp, Homo sapiens
cagctgctcaggagg

SEQ ID NO: 84608 - DNA, 15 bp, Homo sapiens
ccagctgctcaggag

SEQ ID NO: 84609 - DNA, 15 bp, Homo sapiens
cccagctgctcagga

SEQ ID NO: 84610 - DNA, 15 bp, Homo sapiens
tcccagctgctcagg

SEQ ID NO: 84611 - DNA, 15 bp, Homo sapiens
atcccagctgctcag

SEQ ID NO: 84612 - DNA, 15 bp, Homo sapiens
aatcccagctgctca

SEQ ID NO: 84613 - DNA, 15 bp, Homo sapiens
taatcccagctgctc

SEQ ID NO: 84614 - DNA, 15 bp, Homo sapiens
ataatcccagctgct

SEQ ID NO: 84615 - DNA, 15 bp, Homo sapiens
tataatcccagctgc

SEQ ID NO: 84616 - DNA, 15 bp, Homo sapiens
ctataatcccagctg

SEQ ID NO: 84617 - DNA, 15 bp, Homo sapiens
tgtgcctataatccc

SEQ ID NO: 84618 - DNA, 15 bp, Homo sapiens
gtgtgcctataatcc

SEQ ID NO: 84619 - DNA, 15 bp, Homo sapiens
cgtgtgcctataatc

SEQ ID NO: 84620 - DNA, 15 bp, Homo sapiens
gcgtgtgcctataat

SEQ ID NO: 84621 - DNA, 15 bp, Homo sapiens
ggcgtgtgcctataa

SEQ ID NO: 84622 - DNA, 15 bp, Homo sapiens
tggcgtgtgcctata

SEQ ID NO: 84623 - DNA, 15 bp, Homo sapiens
gtggcgtgtgcctat

SEQ ID NO: 84624 - DNA, 15 bp, Homo sapiens
ggtggcgtgtgccta

SEQ ID NO: 84625 - DNA, 15 bp, Homo sapiens
agcgtggtggcgtgt

SEQ ID NO: 84626 - DNA, 15 bp, Homo sapiens
aagcgtggtggcgtg

SEQ ID NO: 84627 - DNA, 15 bp, Homo sapiens
caagcgtggtggcgt

SEQ ID NO: 84628 - DNA, 15 bp, Homo sapiens
ccaagcgtggtggcg

SEQ ID NO: 84629 - DNA, 15 bp, Homo sapiens
gccaagcgtggtggc

SEQ ID NO: 84630 - DNA, 15 bp, Homo sapiens
agccaagcgtggtgg

SEQ ID NO: 84631 - DNA, 15 bp, Homo sapiens
tagccaagcgtggtg

SEQ ID NO: 84632 - DNA, 15 bp, Homo sapiens
ttagccaagcgtggt

SEQ ID NO: 84633 - DNA, 15 bp, Homo sapiens
attagccaagcgtgg

SEQ ID NO: 84634 - DNA, 15 bp, Homo sapiens
aattagccaagcgtg

SEQ ID NO: 84635 - DNA, 15 bp, Homo sapiens
aaattagccaagcgt

SEQ ID NO: 84636 - DNA, 15 bp, Homo sapiens
aaaattagccaagcg

SEQ ID NO: 84637 - DNA, 15 bp, Homo sapiens
aaaaattagccaagc

SEQ ID NO: 84638 - DNA, 15 bp, Homo sapiens
caaaaattagccaag

SEQ ID NO: 84639 - DNA, 15 bp, Homo sapiens
acaaaaattagccaa

SEQ ID NO: 84640 - DNA, 15 bp, Homo sapiens
actctactaaaaata

SEQ ID NO: 84641 - DNA, 15 bp, Homo sapiens
aactctactaaaaat

SEQ ID NO: 84642 - DNA, 15 bp, Homo sapiens
caactctactaaaaa

SEQ ID NO: 84643 - DNA, 15 bp, Homo sapiens
ccaactctactaaaa

SEQ ID NO: 84644 - DNA, 15 bp, Homo sapiens
cccaactctactaaa

SEQ ID NO: 84645 - DNA, 15 bp, Homo sapiens
ccccaactctactaa

SEQ ID NO: 84646 - DNA, 15 bp, Homo sapiens
accccaactctacta

SEQ ID NO: 84647 - DNA, 15 bp, Homo sapiens
aaccccaactctact

SEQ ID NO: 84648 - DNA, 15 bp, Homo sapiens
aaaccccaactctac

SEQ ID NO: 84649 - DNA, 15 bp, Homo sapiens
gaaaccccaactcta

SEQ ID NO: 84650 - DNA, 15 bp, Homo sapiens
tgaaaccccaactct

SEQ ID NO: 84651 - DNA, 15 bp, Homo sapiens
gtgaaaccccaactc

SEQ ID NO: 84652 - DNA, 15 bp, Homo sapiens
ggtgaaaccccaact

SEQ ID NO: 84653 - DNA, 15 bp, Homo sapiens
tggtgaaaccccaac

SEQ ID NO: 84654 - DNA, 15 bp, Homo sapiens
atggtgaaaccccaa

SEQ ID NO: 84655 - DNA, 15 bp, Homo sapiens
tctggccaacatggt

SEQ ID NO: 84656 - DNA, 15 bp, Homo sapiens
gtctggccaacatgg

SEQ ID NO: 84657 - DNA, 15 bp, Homo sapiens
agtctggccaacatg

SEQ ID NO: 84658 - DNA, 15 bp, Homo sapiens
cagtctggccaacat

SEQ ID NO: 84659 - DNA, 15 bp, Homo sapiens
ccagtctggccaaca

SEQ ID NO: 84660 - DNA, 15 bp, Homo sapiens
accagtctggccaac

SEQ ID NO: 84661 - DNA, 15 bp, Homo sapiens
gaccagtctggccaa

SEQ ID NO: 84662 - DNA, 15 bp, Homo sapiens
agaccagtctggcca

SEQ ID NO: 84663 - DNA, 15 bp, Homo sapiens
gagaccagtctggcc

SEQ ID NO: 84664 - DNA, 15 bp, Homo sapiens
tgagaccagtctggc

SEQ ID NO: 84665 - DNA, 15 bp, Homo sapiens
ttgagaccagtctgg

SEQ ID NO: 84666 - DNA, 15 bp, Homo sapiens
tttgagaccagtctg

SEQ ID NO: 84667 - DNA, 15 bp, Homo sapiens
gtttgagaccagtct

SEQ ID NO: 84668 - DNA, 15 bp, Homo sapiens
agtttgagaccagtc

SEQ ID NO: 84669 - DNA, 15 bp, Homo sapiens
gagtttgagaccagt

SEQ ID NO: 84670 - DNA, 15 bp, Homo sapiens
agaggtcaggagttt

SEQ ID NO: 84671 - DNA, 15 bp, Homo sapiens
tagaggtcaggagtt

SEQ ID NO: 84672 - DNA, 15 bp, Homo sapiens
ctagaggtcaggagt

SEQ ID NO: 84673 - DNA, 15 bp, Homo sapiens
actagaggtcaggag

SEQ ID NO: 84674 - DNA, 15 bp, Homo sapiens
cactagaggtcagga

SEQ ID NO: 84675 - DNA, 15 bp, Homo sapiens
tcactagaggtcagg

SEQ ID NO: 84676 - DNA, 15 bp, Homo sapiens
atcactagaggtcag

SEQ ID NO: 84677 - DNA, 15 bp, Homo sapiens
gatcactagaggtca

SEQ ID NO: 84678 - DNA, 15 bp, Homo sapiens
ggatcactagaggtc

SEQ ID NO: 84679 - DNA, 15 bp, Homo sapiens
tggatcactagaggt

SEQ ID NO: 84680 - DNA, 15 bp, Homo sapiens
gtggatcactagagg

SEQ ID NO: 84681 - DNA, 15 bp, Homo sapiens
ggtggatcactagag

SEQ ID NO: 84682 - DNA, 15 bp, Homo sapiens
gggtggatcactaga

SEQ ID NO: 84683 - DNA, 15 bp, Homo sapiens
ggggtggatcactag

SEQ ID NO: 84684 - DNA, 15 bp, Homo sapiens
gggggtggatcacta

SEQ ID NO: 84685 - DNA, 15 bp, Homo sapiens
ggggggtggatcact

SEQ ID NO: 84686 - DNA, 15 bp, Homo sapiens
aggggggtggatcac

SEQ ID NO: 84687 - DNA, 15 bp, Homo sapiens
gaggggggtggatca

SEQ ID NO: 84688 - DNA, 15 bp, Homo sapiens
tgaggggggtggatc

SEQ ID NO: 84689 - DNA, 15 bp, Homo sapiens
ctgaggggggtggat

SEQ ID NO: 84690 - DNA, 15 bp, Homo sapiens
gctgaggggggtgga

SEQ ID NO: 84691 - DNA, 15 bp, Homo sapiens
ggctgaggggggtgg

SEQ ID NO: 84692 - DNA, 15 bp, Homo sapiens
aggctgaggggggtg

SEQ ID NO: 84693 - DNA, 15 bp, Homo sapiens
aaggctgaggggggt

SEQ ID NO: 84694 - DNA, 15 bp, Homo sapiens
gaaggctgagggggg

SEQ ID NO: 84695 - DNA, 15 bp, Homo sapiens
ggaaggctgaggggg

SEQ ID NO: 84696 - DNA, 15 bp, Homo sapiens
tggaaggctgagggg

SEQ ID NO: 84697 - DNA, 15 bp, Homo sapiens
ttggaaggctgaggg

SEQ ID NO: 84698 - DNA, 15 bp, Homo sapiens
tttggaaggctgagg

SEQ ID NO: 84699 - DNA, 15 bp, Homo sapiens
ctttggaaggctgag

SEQ ID NO: 84700 - DNA, 15 bp, Homo sapiens
actttggaaggctga

SEQ ID NO: 84701 - DNA, 15 bp, Homo sapiens
cactttggaaggctg

SEQ ID NO: 84702 - DNA, 15 bp, Homo sapiens
acactttggaaggct

SEQ ID NO: 84703 - DNA, 15 bp, Homo sapiens
aacactttggaaggc

SEQ ID NO: 84704 - DNA, 15 bp, Homo sapiens
caacactttggaagg

SEQ ID NO: 84705 - DNA, 15 bp, Homo sapiens
ccaacactttggaag

SEQ ID NO: 84706 - DNA, 15 bp, Homo sapiens
cccaacactttggaa

SEQ ID NO: 84707 - DNA, 15 bp, Homo sapiens
tcccaacactttgga

SEQ ID NO: 84708 - DNA, 15 bp, Homo sapiens
gataggctgggcatg

SEQ ID NO: 84709 - DNA, 15 bp, Homo sapiens
ggataggctgggcat

SEQ ID NO: 84710 - DNA, 15 bp, Homo sapiens
aggataggctgggca

SEQ ID NO: 84711 - DNA, 15 bp, Homo sapiens
aaggataggctgggc

SEQ ID NO: 84712 - DNA, 15 bp, Homo sapiens
aaaggataggctggg

SEQ ID NO: 84713 - DNA, 15 bp, Homo sapiens
aaaaggataggctgg

SEQ ID NO: 84714 - DNA, 15 bp, Homo sapiens
aaaaaggataggctg

SEQ ID NO: 84715 - DNA, 15 bp, Homo sapiens
aaaaaaggataggct

SEQ ID NO: 84716 - DNA, 15 bp, Homo sapiens
gaaaaaaggataggc

SEQ ID NO: 84717 - DNA, 15 bp, Homo sapiens
agaaaaaaggatagg

SEQ ID NO: 84718 - DNA, 15 bp, Homo sapiens
aagaaaaaaggatag

SEQ ID NO: 84719 - DNA, 15 bp, Homo sapiens
caagaaaaaaggata

SEQ ID NO: 84720 - DNA, 15 bp, Homo sapiens
acaagaaaaaaggat

SEQ ID NO: 84721 - DNA, 15 bp, Homo sapiens
aacaagaaaaaagga

SEQ ID NO: 84722 - DNA, 15 bp, Homo sapiens
taacaagaaaaaagg

SEQ ID NO: 84723 - DNA, 15 bp, Homo sapiens
ctaacaagaaaaaag

SEQ ID NO: 84724 - DNA, 15 bp, Homo sapiens
actaacaagaaaaaa

SEQ ID NO: 84725 - DNA, 15 bp, Homo sapiens
aactaacaagaaaaa

SEQ ID NO: 84726 - DNA, 15 bp, Homo sapiens
taactaacaagaaaa

SEQ ID NO: 84727 - DNA, 15 bp, Homo sapiens
ttaactaacaagaaa

SEQ ID NO: 84728 - DNA, 15 bp, Homo sapiens
attaactaacaagaa

SEQ ID NO: 84729 - DNA, 15 bp, Homo sapiens
aattaactaacaaga

SEQ ID NO: 84730 - DNA, 15 bp, Homo sapiens
aaattaactaacaag

SEQ ID NO: 84731 - DNA, 15 bp, Homo sapiens
aaaattaactaacaa

SEQ ID NO: 84732 - DNA, 15 bp, Homo sapiens
aaaaattaactaaca

SEQ ID NO: 84733 - DNA, 15 bp, Homo sapiens
caaaaattaactaac

SEQ ID NO: 84734 - DNA, 15 bp, Homo sapiens
acaaaaattaactaa

SEQ ID NO: 84735 - DNA, 15 bp, Homo sapiens
aacaaaaattaacta

SEQ ID NO: 84736 - DNA, 15 bp, Homo sapiens
gaacaaaaattaact

SEQ ID NO: 84737 - DNA, 15 bp, Homo sapiens
tgaacaaaaattaac

SEQ ID NO: 84738 - DNA, 15 bp, Homo sapiens
ttgaacaaaaattaa

SEQ ID NO: 84739 - DNA, 15 bp, Homo sapiens
gttgaacaaaaatta

SEQ ID NO: 84740 - DNA, 15 bp, Homo sapiens
tgttgaacaaaaatt

SEQ ID NO: 84741 - DNA, 15 bp, Homo sapiens
ttgttgaacaaaaat

SEQ ID NO: 84742 - DNA, 15 bp, Homo sapiens
gttgttgaacaaaaa

SEQ ID NO: 84743 - DNA, 15 bp, Homo sapiens
agttgttgaacaaaa

SEQ ID NO: 84744 - DNA, 15 bp, Homo sapiens
aagttgttgaacaaa

SEQ ID NO: 84745 - DNA, 15 bp, Homo sapiens
gaagttgttgaacaa

SEQ ID NO: 84746 - DNA, 15 bp, Homo sapiens
agaagttgttgaaca

SEQ ID NO: 84747 - DNA, 15 bp, Homo sapiens
cagaagttgttgaac

SEQ ID NO: 84748 - DNA, 15 bp, Homo sapiens
acagaagttgttgaa

SEQ ID NO: 84749 - DNA, 15 bp, Homo sapiens
gacagaagttgttga

SEQ ID NO: 84750 - DNA, 15 bp, Homo sapiens
tgacagaagttgttg

SEQ ID NO: 84751 - DNA, 15 bp, Homo sapiens
atgacagaagttgtt

SEQ ID NO: 84752 - DNA, 15 bp, Homo sapiens
tatgacagaagttgt

SEQ ID NO: 84753 - DNA, 15 bp, Homo sapiens
ttatgacagaagttg

SEQ ID NO: 84754 - DNA, 15 bp, Homo sapiens
gttatgacagaagtt

SEQ ID NO: 84755 - DNA, 15 bp, Homo sapiens
tgttatgacagaagt

SEQ ID NO: 84756 - DNA, 15 bp, Homo sapiens
gtgttatgacagaag

SEQ ID NO: 84757 - DNA, 15 bp, Homo sapiens
tgtgttatgacagaa

SEQ ID NO: 84758 - DNA, 15 bp, Homo sapiens
atgtgttatgacaga

SEQ ID NO: 84759 - DNA, 15 bp, Homo sapiens
aatgtgttatgacag

SEQ ID NO: 84760 - DNA, 15 bp, Homo sapiens
gaatgtgttatgaca

SEQ ID NO: 84761 - DNA, 15 bp, Homo sapiens
tgaatgtgttatgac

SEQ ID NO: 84762 - DNA, 15 bp, Homo sapiens
ttgaatgtgttatga

SEQ ID NO: 84763 - DNA, 15 bp, Homo sapiens
attgaatgtgttatg

SEQ ID NO: 84764 - DNA, 15 bp, Homo sapiens
aattgaatgtgttat

SEQ ID NO: 84765 - DNA, 15 bp, Homo sapiens
gaattgaatgtgtta

SEQ ID NO: 84766 - DNA, 15 bp, Homo sapiens
agaattgaatgtgtt

SEQ ID NO: 84767 - DNA, 15 bp, Homo sapiens
aagaattgaatgtgt

SEQ ID NO: 84768 - DNA, 15 bp, Homo sapiens
aaagaattgaatgtg

SEQ ID NO: 84769 - DNA, 15 bp, Homo sapiens
aaaagaattgaatgt

SEQ ID NO: 84770 - DNA, 15 bp, Homo sapiens
caaaagaattgaatg

SEQ ID NO: 84771 - DNA, 15 bp, Homo sapiens
tcaaaagaattgaat

SEQ ID NO: 84772 - DNA, 15 bp, Homo sapiens
gtcaaaagaattgaa

SEQ ID NO: 84773 - DNA, 15 bp, Homo sapiens
agtcaaaagaattga

SEQ ID NO: 84774 - DNA, 15 bp, Homo sapiens
gagtcaaaagaattg

SEQ ID NO: 84775 - DNA, 15 bp, Homo sapiens
tgagtcaaaagaatt

SEQ ID NO: 84776 - DNA, 15 bp, Homo sapiens
ttgagtcaaaagaat

SEQ ID NO: 84777 - DNA, 15 bp, Homo sapiens
tttgagtcaaaagaa

SEQ ID NO: 84778 - DNA, 15 bp, Homo sapiens
gtttgagtcaaaaga

SEQ ID NO: 84779 - DNA, 15 bp, Homo sapiens
ggtttgagtcaaaag

SEQ ID NO: 84780 - DNA, 15 bp, Homo sapiens
tggtttgagtcaaaa

SEQ ID NO: 84781 - DNA, 15 bp, Homo sapiens
atggtttgagtcaaa

SEQ ID NO: 84782 - DNA, 15 bp, Homo sapiens
aatggtttgagtcaa

SEQ ID NO: 84783 - DNA, 15 bp, Homo sapiens
taatggtttgagtca

SEQ ID NO: 84784 - DNA, 15 bp, Homo sapiens
ataatggtttgagtc

SEQ ID NO: 84785 - DNA, 15 bp, Homo sapiens
aataatggtttgagt

SEQ ID NO: 84786 - DNA, 15 bp, Homo sapiens
aaataatggtttgag

SEQ ID NO: 84787 - DNA, 15 bp, Homo sapiens
aaaataatggtttga

SEQ ID NO: 84788 - DNA, 15 bp, Homo sapiens
aaaaataatggtttg

SEQ ID NO: 84789 - DNA, 15 bp, Homo sapiens
taaaaataatggttt

SEQ ID NO: 84790 - DNA, 15 bp, Homo sapiens
ataaaaataatggtt

SEQ ID NO: 84791 - DNA, 15 bp, Homo sapiens
cataaaaataatggt

SEQ ID NO: 84792 - DNA, 15 bp, Homo sapiens
ccataaaaataatgg

SEQ ID NO: 84793 - DNA, 15 bp, Homo sapiens
gccataaaaataatg

SEQ ID NO: 84794 - DNA, 15 bp, Homo sapiens
tgccataaaaataat

SEQ ID NO: 84795 - DNA, 15 bp, Homo sapiens
atgccataaaaataa

SEQ ID NO: 84796 - DNA, 15 bp, Homo sapiens
catgccataaaaata

SEQ ID NO: 84797 - DNA, 15 bp, Homo sapiens
ccatgccataaaaat

SEQ ID NO: 84798 - DNA, 15 bp, Homo sapiens
gccatgccataaaaa

SEQ ID NO: 84799 - DNA, 15 bp, Homo sapiens
cgccatgccataaaa

SEQ ID NO: 84800 - DNA, 15 bp, Homo sapiens
acgccatgccataaa

SEQ ID NO: 84801 - DNA, 15 bp, Homo sapiens
tacgccatgccataa

SEQ ID NO: 84802 - DNA, 15 bp, Homo sapiens
gtacgccatgccata

SEQ ID NO: 84803 - DNA, 15 bp, Homo sapiens
agtacgccatgccat

SEQ ID NO: 84804 - DNA, 15 bp, Homo sapiens
gagtacgccatgcca

SEQ ID NO: 84805 - DNA, 15 bp, Homo sapiens
tgagtacgccatgcc

SEQ ID NO: 84806 - DNA, 15 bp, Homo sapiens
ctgagtacgccatgc

SEQ ID NO: 84807 - DNA, 15 bp, Homo sapiens
cctgagtacgccatg

SEQ ID NO: 84808 - DNA, 15 bp, Homo sapiens
ccctgagtacgccat

SEQ ID NO: 84809 - DNA, 15 bp, Homo sapiens
accctgagtacgcca

SEQ ID NO: 84810 - DNA, 15 bp, Homo sapiens
taccctgagtacgcc

SEQ ID NO: 84811 - DNA, 15 bp, Homo sapiens
ataccctgagtacgc

SEQ ID NO: 84812 - DNA, 15 bp, Homo sapiens
cataccctgagtacg

SEQ ID NO: 84813 - DNA, 15 bp, Homo sapiens
acataccctgagtac

SEQ ID NO: 84814 - DNA, 15 bp, Homo sapiens
tacataccctgagta

SEQ ID NO: 84815 - DNA, 15 bp, Homo sapiens
atacataccctgagt

SEQ ID NO: 84816 - DNA, 15 bp, Homo sapiens
catacataccctgag

SEQ ID NO: 84817 - DNA, 15 bp, Homo sapiens
acatacataccctga

SEQ ID NO: 84818 - DNA, 15 bp, Homo sapiens
cacatacataccctg

SEQ ID NO: 84819 - DNA, 15 bp, Homo sapiens
tcacatacataccct

SEQ ID NO: 84820 - DNA, 15 bp, Homo sapiens
ttcacatacataccc

SEQ ID NO: 84821 - DNA, 15 bp, Homo sapiens
attcacatacatacc

SEQ ID NO: 84822 - DNA, 15 bp, Homo sapiens
tattcacatacatac

SEQ ID NO: 84823 - DNA, 15 bp, Homo sapiens
ctattcacatacata

SEQ ID NO: 84824 - DNA, 15 bp, Homo sapiens
tctattcacatacat

SEQ ID NO: 84825 - DNA, 15 bp, Homo sapiens
atctattcacataca

SEQ ID NO: 84826 - DNA, 15 bp, Homo sapiens
tatctattcacatac

SEQ ID NO: 84827 - DNA, 15 bp, Homo sapiens
atatctattcacata

SEQ ID NO: 84828 - DNA, 15 bp, Homo sapiens
gatatctattcacat

SEQ ID NO: 84829 - DNA, 15 bp, Homo sapiens
ggatatctattcaca

SEQ ID NO: 84830 - DNA, 15 bp, Homo sapiens
aggatatctattcac

SEQ ID NO: 84831 - DNA, 15 bp, Homo sapiens
caggatatctattca

SEQ ID NO: 84832 - DNA, 15 bp, Homo sapiens
ccaggatatctattc

SEQ ID NO: 84833 - DNA, 15 bp, Homo sapiens
tccaggatatctatt

SEQ ID NO: 84834 - DNA, 15 bp, Homo sapiens
atccaggatatctat

SEQ ID NO: 84835 - DNA, 15 bp, Homo sapiens
gatccaggatatcta

SEQ ID NO: 84836 - DNA, 15 bp, Homo sapiens
agatccaggatatct

SEQ ID NO: 84837 - DNA, 15 bp, Homo sapiens
tagatccaggatatc

SEQ ID NO: 84838 - DNA, 15 bp, Homo sapiens
ttagatccaggatat

SEQ ID NO: 84839 - DNA, 15 bp, Homo sapiens
tttagatccaggata

SEQ ID NO: 84840 - DNA, 15 bp, Homo sapiens
ttttagatccaggat

SEQ ID NO: 84841 - DNA, 15 bp, Homo sapiens
gttttagatccagga

SEQ ID NO: 84842 - DNA, 15 bp, Homo sapiens
tgttttagatccagg

SEQ ID NO: 84843 - DNA, 15 bp, Homo sapiens
atgttttagatccag

SEQ ID NO: 84844 - DNA, 15 bp, Homo sapiens
tatgttttagatcca

SEQ ID NO: 84845 - DNA, 15 bp, Homo sapiens
ttatgttttagatcc

SEQ ID NO: 84846 - DNA, 15 bp, Homo sapiens
attatgttttagatc

SEQ ID NO: 84847 - DNA, 15 bp, Homo sapiens
aattatgttttagat

SEQ ID NO: 84848 - DNA, 15 bp, Homo sapiens
aaattatgttttaga

SEQ ID NO: 84849 - DNA, 15 bp, Homo sapiens
aaaattatgttttag

SEQ ID NO: 84850 - DNA, 15 bp, Homo sapiens
taaaattatgtttta

SEQ ID NO: 84851 - DNA, 15 bp, Homo sapiens
ttaaaattatgtttt

SEQ ID NO: 84852 - DNA, 15 bp, Homo sapiens
attaaaattatgttt

SEQ ID NO: 84853 - DNA, 15 bp, Homo sapiens
aattaaaattatgtt

SEQ ID NO: 84854 - DNA, 15 bp, Homo sapiens
taattaaaattatgt

SEQ ID NO: 84855 - DNA, 15 bp, Homo sapiens
ataattaaaattatg

SEQ ID NO: 84856 - DNA, 15 bp, Homo sapiens
aataattaaaattat

SEQ ID NO: 84857 - DNA, 15 bp, Homo sapiens
aaataattaaaatta

SEQ ID NO: 84858 - DNA, 15 bp, Homo sapiens
gaaataattaaaatt

SEQ ID NO: 84859 - DNA, 15 bp, Homo sapiens
ggaaataattaaaat

SEQ ID NO: 84860 - DNA, 15 bp, Homo sapiens
aggaaataattaaaa

SEQ ID NO: 84861 - DNA, 15 bp, Homo sapiens
aaggaaataattaaa

SEQ ID NO: 84862 - DNA, 15 bp, Homo sapiens
gaaggaaataattaa

SEQ ID NO: 84863 - DNA, 15 bp, Homo sapiens
agaaggaaataatta

SEQ ID NO: 84864 - DNA, 15 bp, Homo sapiens
tagaaggaaataatt

SEQ ID NO: 84865 - DNA, 15 bp, Homo sapiens
ttagaaggaaataat

SEQ ID NO: 84866 - DNA, 15 bp, Homo sapiens
attagaaggaaataa

SEQ ID NO: 84867 - DNA, 15 bp, Homo sapiens
tattagaaggaaata

SEQ ID NO: 84868 - DNA, 15 bp, Homo sapiens
ctattagaaggaaat

SEQ ID NO: 84869 - DNA, 15 bp, Homo sapiens
cctattagaaggaaa

SEQ ID NO: 84870 - DNA, 15 bp, Homo sapiens
tcctattagaaggaa

SEQ ID NO: 84871 - DNA, 15 bp, Homo sapiens
ctcctattagaagga

SEQ ID NO: 84872 - DNA, 15 bp, Homo sapiens
gctcctattagaagg

SEQ ID NO: 84873 - DNA, 15 bp, Homo sapiens
agctcctattagaag

SEQ ID NO: 84874 - DNA, 15 bp, Homo sapiens
aagctcctattagaa

SEQ ID NO: 84875 - DNA, 15 bp, Homo sapiens
taagctcctattaga

SEQ ID NO: 84876 - DNA, 15 bp, Homo sapiens
ataagctcctattag

SEQ ID NO: 84877 - DNA, 15 bp, Homo sapiens
tataagctcctatta

SEQ ID NO: 84878 - DNA, 15 bp, Homo sapiens
ttataagctcctatt

SEQ ID NO: 84879 - DNA, 15 bp, Homo sapiens
attataagctcctat

SEQ ID NO: 84880 - DNA, 15 bp, Homo sapiens
aattataagctccta

SEQ ID NO: 84881 - DNA, 15 bp, Homo sapiens
taattataagctcct

SEQ ID NO: 84882 - DNA, 15 bp, Homo sapiens
ataattataagctcc

SEQ ID NO: 84883 - DNA, 15 bp, Homo sapiens
cataattataagctc

SEQ ID NO: 84884 - DNA, 15 bp, Homo sapiens
tcataattataagct

SEQ ID NO: 84885 - DNA, 15 bp, Homo sapiens
ctcataattataagc

SEQ ID NO: 84886 - DNA, 15 bp, Homo sapiens
cctcataattataag

SEQ ID NO: 84887 - DNA, 15 bp, Homo sapiens
acctcataattataa

SEQ ID NO: 84888 - DNA, 15 bp, Homo sapiens
tacctcataattata

SEQ ID NO: 84889 - DNA, 15 bp, Homo sapiens
gtacctcataattat

SEQ ID NO: 84890 - DNA, 15 bp, Homo sapiens
tgtacctcataatta

SEQ ID NO: 84891 - DNA, 15 bp, Homo sapiens
atgtacctcataatt

SEQ ID NO: 84892 - DNA, 15 bp, Homo sapiens
aatgtacctcataat

SEQ ID NO: 84893 - DNA, 15 bp, Homo sapiens
aaatgtacctcataa

SEQ ID NO: 84894 - DNA, 15 bp, Homo sapiens
aaaatgtacctcata

SEQ ID NO: 84895 - DNA, 15 bp, Homo sapiens
aaaaatgtacctcat

SEQ ID NO: 84896 - DNA, 15 bp, Homo sapiens
aaaaaatgtacctca

SEQ ID NO: 84897 - DNA, 15 bp, Homo sapiens
aaaaaaatgtacctc

SEQ ID NO: 84898 - DNA, 15 bp, Homo sapiens
aaaaaaaatgtacct

SEQ ID NO: 84899 - DNA, 15 bp, Homo sapiens
gaaaaaaaatgtacc

SEQ ID NO: 84900 - DNA, 15 bp, Homo sapiens
agaaaaaaaatgtac

SEQ ID NO: 84901 - DNA, 15 bp, Homo sapiens
aagaaaaaaaatgta

SEQ ID NO: 84902 - DNA, 15 bp, Homo sapiens
taagaaaaaaaatgt

SEQ ID NO: 84903 - DNA, 15 bp, Homo sapiens
gtaagaaaaaaaatg

SEQ ID NO: 84904 - DNA, 15 bp, Homo sapiens
tgtaagaaaaaaaat

SEQ ID NO: 84905 - DNA, 15 bp, Homo sapiens
ttgtaagaaaaaaaa

SEQ ID NO: 84906 - DNA, 15 bp, Homo sapiens
tttgtaagaaaaaaa

SEQ ID NO: 84907 - DNA, 15 bp, Homo sapiens
ttttgtaagaaaaaa

SEQ ID NO: 84908 - DNA, 15 bp, Homo sapiens
cttttgtaagaaaaa

SEQ ID NO: 84909 - DNA, 15 bp, Homo sapiens
tcttttgtaagaaaa

SEQ ID NO: 84910 - DNA, 15 bp, Homo sapiens
ttcttttgtaagaaa

SEQ ID NO: 84911 - DNA, 15 bp, Homo sapiens
tttcttttgtaagaa

SEQ ID NO: 84912 - DNA, 15 bp, Homo sapiens
gtttcttttgtaaga

SEQ ID NO: 84913 - DNA, 15 bp, Homo sapiens
ggtttcttttgtaag

SEQ ID NO: 84914 - DNA, 15 bp, Homo sapiens
tggtttcttttgtaa

SEQ ID NO: 84915 - DNA, 15 bp, Homo sapiens
ttggtttcttttgta

SEQ ID NO: 84916 - DNA, 15 bp, Homo sapiens
attggtttcttttgt

SEQ ID NO: 84917 - DNA, 15 bp, Homo sapiens
cattggtttcttttg

SEQ ID NO: 84918 - DNA, 15 bp, Homo sapiens
gcattggtttctttt

SEQ ID NO: 84919 - DNA, 15 bp, Homo sapiens
agcattggtttcttt

SEQ ID NO: 84920 - DNA, 15 bp, Homo sapiens
aagcattggtttctt

SEQ ID NO: 84921 - DNA, 15 bp, Homo sapiens
aaagcattggtttct

SEQ ID NO: 84922 - DNA, 15 bp, Homo sapiens
aaaagcattggtttc

SEQ ID NO: 84923 - DNA, 15 bp, Homo sapiens
aaaaagcattggttt

SEQ ID NO: 84924 - DNA, 15 bp, Homo sapiens
taaaaagcattggtt

SEQ ID NO: 84925 - DNA, 15 bp, Homo sapiens
ctaaaaagcattggt

SEQ ID NO: 84926 - DNA, 15 bp, Homo sapiens
actaaaaagcattgg

SEQ ID NO: 84927 - DNA, 15 bp, Homo sapiens
aactaaaaagcattg

SEQ ID NO: 84928 - DNA, 15 bp, Homo sapiens
caactaaaaagcatt

SEQ ID NO: 84929 - DNA, 15 bp, Homo sapiens
gcaactaaaaagcat

SEQ ID NO: 84930 - DNA, 15 bp, Homo sapiens
agcaactaaaaagca

SEQ ID NO: 84931 - DNA, 15 bp, Homo sapiens
tagcaactaaaaagc

SEQ ID NO: 84932 - DNA, 15 bp, Homo sapiens
atagcaactaaaaag

SEQ ID NO: 84933 - DNA, 15 bp, Homo sapiens
catagcaactaaaaa

SEQ ID NO: 84934 - DNA, 15 bp, Homo sapiens
tcatagcaactaaaa

SEQ ID NO: 84935 - DNA, 15 bp, Homo sapiens
atcatagcaactaaa

SEQ ID NO: 84936 - DNA, 15 bp, Homo sapiens
aatcatagcaactaa

SEQ ID NO: 84937 - DNA, 15 bp, Homo sapiens
taatcatagcaacta

SEQ ID NO: 84938 - DNA, 15 bp, Homo sapiens
gtaatcatagcaact

SEQ ID NO: 84939 - DNA, 15 bp, Homo sapiens
cgtaatcatagcaac

SEQ ID NO: 84940 - DNA, 15 bp, Homo sapiens
acgtaatcatagcaa

SEQ ID NO: 84941 - DNA, 15 bp, Homo sapiens
aacgtaatcatagca

SEQ ID NO: 84942 - DNA, 15 bp, Homo sapiens
aaacgtaatcatagc

SEQ ID NO: 84943 - DNA, 15 bp, Homo sapiens
caaacgtaatcatag

SEQ ID NO: 84944 - DNA, 15 bp, Homo sapiens
tcaaacgtaatcata

SEQ ID NO: 84945 - DNA, 15 bp, Homo sapiens
ttcaaacgtaatcat

SEQ ID NO: 84946 - DNA, 15 bp, Homo sapiens
attcaaacgtaatca

SEQ ID NO: 84947 - DNA, 15 bp, Homo sapiens
aattcaaacgtaatc

SEQ ID NO: 84948 - DNA, 15 bp, Homo sapiens
aaattcaaacgtaat

SEQ ID NO: 84949 - DNA, 15 bp, Homo sapiens
taaattcaaacgtaa

SEQ ID NO: 84950 - DNA, 15 bp, Homo sapiens
gtaaattcaaacgta

SEQ ID NO: 84951 - DNA, 15 bp, Homo sapiens
ggtaaattcaaacgt

SEQ ID NO: 84952 - DNA, 15 bp, Homo sapiens
aggtaaattcaaacg

SEQ ID NO: 84953 - DNA, 15 bp, Homo sapiens
aaggtaaattcaaac

SEQ ID NO: 84954 - DNA, 15 bp, Homo sapiens
aaaggtaaattcaaa

SEQ ID NO: 84955 - DNA, 15 bp, Homo sapiens
aaaaggtaaattcaa

SEQ ID NO: 84956 - DNA, 15 bp, Homo sapiens
gaaaaggtaaattca

SEQ ID NO: 84957 - DNA, 15 bp, Homo sapiens
tgaaaaggtaaattc

SEQ ID NO: 84958 - DNA, 15 bp, Homo sapiens
ctgaaaaggtaaatt

SEQ ID NO: 84959 - DNA, 15 bp, Homo sapiens
tctgaaaaggtaaat

SEQ ID NO: 84960 - DNA, 15 bp, Homo sapiens
atctgaaaaggtaaa

SEQ ID NO: 84961 - DNA, 15 bp, Homo sapiens
aatctgaaaaggtaa

SEQ ID NO: 84962 - DNA, 15 bp, Homo sapiens
aaatctgaaaaggta

SEQ ID NO: 84963 - DNA, 15 bp, Homo sapiens
taaatctgaaaaggt

SEQ ID NO: 84964 - DNA, 15 bp, Homo sapiens
ttaaatctgaaaagg

SEQ ID NO: 84965 - DNA, 15 bp, Homo sapiens
tttaaatctgaaaag

SEQ ID NO: 84966 - DNA, 15 bp, Homo sapiens
ttttaaatctgaaaa

SEQ ID NO: 84967 - DNA, 15 bp, Homo sapiens
tttttaaatctgaaa

SEQ ID NO: 84968 - DNA, 15 bp, Homo sapiens
ctttttaaatctgaa

SEQ ID NO: 84969 - DNA, 15 bp, Homo sapiens
tctttttaaatctga

SEQ ID NO: 84970 - DNA, 15 bp, Homo sapiens
ttctttttaaatctg

SEQ ID NO: 84971 - DNA, 15 bp, Homo sapiens
attctttttaaatct

SEQ ID NO: 84972 - DNA, 15 bp, Homo sapiens
cattctttttaaatc

SEQ ID NO: 84973 - DNA, 15 bp, Homo sapiens
acattctttttaaat

SEQ ID NO: 84974 - DNA, 15 bp, Homo sapiens
tacattctttttaaa

SEQ ID NO: 84975 - DNA, 15 bp, Homo sapiens
ctacattctttttaa

SEQ ID NO: 84976 - DNA, 15 bp, Homo sapiens
cctacattcttttta

SEQ ID NO: 84977 - DNA, 15 bp, Homo sapiens
tcctacattcttttt

SEQ ID NO: 84978 - DNA, 15 bp, Homo sapiens
ctcctacattctttt

SEQ ID NO: 84979 - DNA, 15 bp, Homo sapiens
cctcctacattcttt

SEQ ID NO: 84980 - DNA, 15 bp, Homo sapiens
ccctcctacattctt

SEQ ID NO: 84981 - DNA, 15 bp, Homo sapiens
gccctcctacattct

SEQ ID NO: 84982 - DNA, 15 bp, Homo sapiens
ggccctcctacattc

SEQ ID NO: 84983 - DNA, 15 bp, Homo sapiens
tggccctcctacatt

SEQ ID NO: 84984 - DNA, 15 bp, Homo sapiens
atggccctcctacat

SEQ ID NO: 84985 - DNA, 15 bp, Homo sapiens
aatggccctcctaca

SEQ ID NO: 84986 - DNA, 15 bp, Homo sapiens
gaatggccctcctac

SEQ ID NO: 84987 - DNA, 15 bp, Homo sapiens
tgaatggccctccta

SEQ ID NO: 84988 - DNA, 15 bp, Homo sapiens
ttgaatggccctcct

SEQ ID NO: 84989 - DNA, 15 bp, Homo sapiens
gttgaatggccctcc

SEQ ID NO: 84990 - DNA, 15 bp, Homo sapiens
agttgaatggccctc

SEQ ID NO: 84991 - DNA, 15 bp, Homo sapiens
aagttgaatggccct

SEQ ID NO: 84992 - DNA, 15 bp, Homo sapiens
taagttgaatggccc

SEQ ID NO: 84993 - DNA, 15 bp, Homo sapiens
ttaagttgaatggcc

SEQ ID NO: 84994 - DNA, 15 bp, Homo sapiens
tttaagttgaatggc

SEQ ID NO: 84995 - DNA, 15 bp, Homo sapiens
gtttaagttgaatgg

SEQ ID NO: 84996 - DNA, 15 bp, Homo sapiens
tgtttaagttgaatg

SEQ ID NO: 84997 - DNA, 15 bp, Homo sapiens
atgtttaagttgaat

SEQ ID NO: 84998 - DNA, 15 bp, Homo sapiens
aatgtttaagttgaa

SEQ ID NO: 84999 - DNA, 15 bp, Homo sapiens
aaatgtttaagttga

SEQ ID NO: 85000 - DNA, 15 bp, Homo sapiens
taaatgtttaagttg

SEQ ID NO: 85001 - DNA, 15 bp, Homo sapiens
ttaaatgtttaagtt

SEQ ID NO: 85002 - DNA, 15 bp, Homo sapiens
tttaaatgtttaagt

SEQ ID NO: 85003 - DNA, 15 bp, Homo sapiens
ttttaaatgtttaag

SEQ ID NO: 85004 - DNA, 15 bp, Homo sapiens
gttttaaatgtttaa

SEQ ID NO: 85005 - DNA, 15 bp, Homo sapiens
tgttttaaatgttta

SEQ ID NO: 85006 - DNA, 15 bp, Homo sapiens
ctgttttaaatgttt

SEQ ID NO: 85007 - DNA, 15 bp, Homo sapiens
gctgttttaaatgtt

SEQ ID NO: 85008 - DNA, 15 bp, Homo sapiens
tgctgttttaaatgt

SEQ ID NO: 85009 - DNA, 15 bp, Homo sapiens
ttgctgttttaaatg

SEQ ID NO: 85010 - DNA, 15 bp, Homo sapiens
gttgctgttttaaat

SEQ ID NO: 85011 - DNA, 15 bp, Homo sapiens
tgttgctgttttaaa

SEQ ID NO: 85012 - DNA, 15 bp, Homo sapiens
atgttgctgttttaa

SEQ ID NO: 85013 - DNA, 15 bp, Homo sapiens
aatgttgctgtttta

SEQ ID NO: 85014 - DNA, 15 bp, Homo sapiens
taatgttgctgtttt

SEQ ID NO: 85015 - DNA, 15 bp, Homo sapiens
ataatgttgctgttt

SEQ ID NO: 85016 - DNA, 15 bp, Homo sapiens
tataatgttgctgtt

SEQ ID NO: 85017 - DNA, 15 bp, Homo sapiens
atataatgttgctgt

SEQ ID NO: 85018 - DNA, 15 bp, Homo sapiens
aatataatgttgctg

SEQ ID NO: 85019 - DNA, 15 bp, Homo sapiens
caatataatgttgct

SEQ ID NO: 85020 - DNA, 15 bp, Homo sapiens
tcaatataatgttgc

SEQ ID NO: 85021 - DNA, 15 bp, Homo sapiens
ctcaatataatgttg

SEQ ID NO: 85022 - DNA, 15 bp, Homo sapiens
tctcaatataatgtt

SEQ ID NO: 85023 - DNA, 15 bp, Homo sapiens
ttctcaatataatgt

SEQ ID NO: 85024 - DNA, 15 bp, Homo sapiens
cttctcaatataatg

SEQ ID NO: 85025 - DNA, 15 bp, Homo sapiens
tcttctcaatataat

SEQ ID NO: 85026 - DNA, 15 bp, Homo sapiens
ttcttctcaatataa

SEQ ID NO: 85027 - DNA, 15 bp, Homo sapiens
tttcttctcaatata

SEQ ID NO: 85028 - DNA, 15 bp, Homo sapiens
ctttcttctcaatat

SEQ ID NO: 85029 - DNA, 15 bp, Homo sapiens
actttcttctcaata

SEQ ID NO: 85030 - DNA, 15 bp, Homo sapiens
aactttcttctcaat

SEQ ID NO: 85031 - DNA, 15 bp, Homo sapiens
aaactttcttctcaa

SEQ ID NO: 85032 - DNA, 15 bp, Homo sapiens
caaactttcttctca

SEQ ID NO: 85033 - DNA, 15 bp, Homo sapiens
gcaaactttcttctc

SEQ ID NO: 85034 - DNA, 15 bp, Homo sapiens
tgcaaactttcttct

SEQ ID NO: 85035 - DNA, 15 bp, Homo sapiens
ttgcaaactttcttc

SEQ ID NO: 85036 - DNA, 15 bp, Homo sapiens
attgcaaactttctt

SEQ ID NO: 85037 - DNA, 15 bp, Homo sapiens
tattgcaaactttct

SEQ ID NO: 85038 - DNA, 15 bp, Homo sapiens
atattgcaaactttc

SEQ ID NO: 85039 - DNA, 15 bp, Homo sapiens
aatattgcaaacttt

SEQ ID NO: 85040 - DNA, 15 bp, Homo sapiens
gaatattgcaaactt

SEQ ID NO: 85041 - DNA, 15 bp, Homo sapiens
agaatattgcaaact

SEQ ID NO: 85042 - DNA, 15 bp, Homo sapiens
aagaatattgcaaac

SEQ ID NO: 85043 - DNA, 15 bp, Homo sapiens
taagaatattgcaaa

SEQ ID NO: 85044 - DNA, 15 bp, Homo sapiens
ataagaatattgcaa

SEQ ID NO: 85045 - DNA, 15 bp, Homo sapiens
cataagaatattgca

SEQ ID NO: 85046 - DNA, 15 bp, Homo sapiens
acataagaatattgc

SEQ ID NO: 85047 - DNA, 15 bp, Homo sapiens
aacataagaatattg

SEQ ID NO: 85048 - DNA, 15 bp, Homo sapiens
caacataagaatatt

SEQ ID NO: 85049 - DNA, 15 bp, Homo sapiens
ccaacataagaatat

SEQ ID NO: 85050 - DNA, 15 bp, Homo sapiens
cccaacataagaata

SEQ ID NO: 85051 - DNA, 15 bp, Homo sapiens
tcccaacataagaat

SEQ ID NO: 85052 - DNA, 15 bp, Homo sapiens
gtcccaacataagaa

SEQ ID NO: 85053 - DNA, 15 bp, Homo sapiens
agtcccaacataaga

SEQ ID NO: 85054 - DNA, 15 bp, Homo sapiens
aagtcccaacataag

SEQ ID NO: 85055 - DNA, 15 bp, Homo sapiens
gaagtcccaacataa

SEQ ID NO: 85056 - DNA, 15 bp, Homo sapiens
tgaagtcccaacata

SEQ ID NO: 85057 - DNA, 15 bp, Homo sapiens
atgaagtcccaacat

SEQ ID NO: 85058 - DNA, 15 bp, Homo sapiens
aatgaagtcccaaca

SEQ ID NO: 85059 - DNA, 15 bp, Homo sapiens
aaatgaagtcccaac

SEQ ID NO: 85060 - DNA, 15 bp, Homo sapiens
caaatgaagtcccaa

SEQ ID NO: 85061 - DNA, 15 bp, Homo sapiens
gcaaatgaagtccca

SEQ ID NO: 85062 - DNA, 15 bp, Homo sapiens
tgcaaatgaagtccc

SEQ ID NO: 85063 - DNA, 15 bp, Homo sapiens
ctgcaaatgaagtcc

SEQ ID NO: 85064 - DNA, 15 bp, Homo sapiens
cctgcaaatgaagtc

SEQ ID NO: 85065 - DNA, 15 bp, Homo sapiens
gcctgcaaatgaagt

SEQ ID NO: 85066 - DNA, 15 bp, Homo sapiens
tgcctgcaaatgaag

SEQ ID NO: 85067 - DNA, 15 bp, Homo sapiens
atgcctgcaaatgaa

SEQ ID NO: 85068 - DNA, 15 bp, Homo sapiens
aatgcctgcaaatga

SEQ ID NO: 85069 - DNA, 15 bp, Homo sapiens
taatgcctgcaaatg

SEQ ID NO: 85070 - DNA, 15 bp, Homo sapiens
ctaatgcctgcaaat

SEQ ID NO: 85071 - DNA, 15 bp, Homo sapiens
tctaatgcctgcaaa

SEQ ID NO: 85072 - DNA, 15 bp, Homo sapiens
ttctaatgcctgcaa

SEQ ID NO: 85073 - DNA, 15 bp, Homo sapiens
tttctaatgcctgca

SEQ ID NO: 85074 - DNA, 15 bp, Homo sapiens
ttttctaatgcctgc

SEQ ID NO: 85075 - DNA, 15 bp, Homo sapiens
tttttctaatgcctg

SEQ ID NO: 85076 - DNA, 15 bp, Homo sapiens
ctttttctaatgcct

SEQ ID NO: 85077 - DNA, 15 bp, Homo sapiens
tctttttctaatgcc

SEQ ID NO: 85078 - DNA, 15 bp, Homo sapiens
ttctttttctaatgc

SEQ ID NO: 85079 - DNA, 15 bp, Homo sapiens
gttctttttctaatg

SEQ ID NO: 85080 - DNA, 15 bp, Homo sapiens
tgttctttttctaat

SEQ ID NO: 85081 - DNA, 15 bp, Homo sapiens
ctgttctttttctaa

SEQ ID NO: 85082 - DNA, 15 bp, Homo sapiens
tctgttctttttcta

SEQ ID NO: 85083 - DNA, 15 bp, Homo sapiens
ctctgttctttttct

SEQ ID NO: 85084 - DNA, 15 bp, Homo sapiens
tctctgttctttttc

SEQ ID NO: 85085 - DNA, 15 bp, Homo sapiens
ctctctgttcttttt

SEQ ID NO: 85086 - DNA, 15 bp, Homo sapiens
tctctctgttctttt

SEQ ID NO: 85087 - DNA, 15 bp, Homo sapiens
ttctctctgttcttt

SEQ ID NO: 85088 - DNA, 15 bp, Homo sapiens
tttctctctgttctt

SEQ ID NO: 85089 - DNA, 15 bp, Homo sapiens
ctttctctctgttct

SEQ ID NO: 85090 - DNA, 15 bp, Homo sapiens
tctttctctctgttc

SEQ ID NO: 85091 - DNA, 15 bp, Homo sapiens
ttctttctctctgtt

SEQ ID NO: 85092 - DNA, 15 bp, Homo sapiens
attctttctctctgt

SEQ ID NO: 85093 - DNA, 15 bp, Homo sapiens
gattctttctctctg

SEQ ID NO: 85094 - DNA, 15 bp, Homo sapiens
ggattctttctctct

SEQ ID NO: 85095 - DNA, 15 bp, Homo sapiens
gggattctttctctc

SEQ ID NO: 85096 - DNA, 15 bp, Homo sapiens
ggggattctttctct

SEQ ID NO: 85097 - DNA, 15 bp, Homo sapiens
tggggattctttctc

SEQ ID NO: 85098 - DNA, 15 bp, Homo sapiens
ctggggattctttct

SEQ ID NO: 85099 - DNA, 15 bp, Homo sapiens
tctggggattctttc

SEQ ID NO: 85100 - DNA, 15 bp, Homo sapiens
ctctggggattcttt

SEQ ID NO: 85101 - DNA, 15 bp, Homo sapiens
gctctggggattctt

SEQ ID NO: 85102 - DNA, 15 bp, Homo sapiens
tgctctggggattct

SEQ ID NO: 85103 - DNA, 15 bp, Homo sapiens
ctgctctggggattc

SEQ ID NO: 85104 - DNA, 15 bp, Homo sapiens
tctgctctggggatt

SEQ ID NO: 85105 - DNA, 15 bp, Homo sapiens
atctgctctggggat

SEQ ID NO: 85106 - DNA, 15 bp, Homo sapiens
catctgctctgggga

SEQ ID NO: 85107 - DNA, 15 bp, Homo sapiens
tcatctgctctgggg

SEQ ID NO: 85108 - DNA, 15 bp, Homo sapiens
ttcatctgctctggg

SEQ ID NO: 85109 - DNA, 15 bp, Homo sapiens
attcatctgctctgg

SEQ ID NO: 85110 - DNA, 15 bp, Homo sapiens
aattcatctgctctg

SEQ ID NO: 85111 - DNA, 15 bp, Homo sapiens
taattcatctgctct

SEQ ID NO: 85112 - DNA, 15 bp, Homo sapiens
ttaattcatctgctc

SEQ ID NO: 85113 - DNA, 15 bp, Homo sapiens
tttaattcatctgct

SEQ ID NO: 85114 - DNA, 15 bp, Homo sapiens
gtttaattcatctgc

SEQ ID NO: 85115 - DNA, 15 bp, Homo sapiens
ggtttaattcatctg

SEQ ID NO: 85116 - DNA, 15 bp, Homo sapiens
tggtttaattcatct

SEQ ID NO: 85117 - DNA, 15 bp, Homo sapiens
ttggtttaattcatc

SEQ ID NO: 85118 - DNA, 15 bp, Homo sapiens
tttggtttaattcat

SEQ ID NO: 85119 - DNA, 15 bp, Homo sapiens
gtttggtttaattca

SEQ ID NO: 85120 - DNA, 15 bp, Homo sapiens
agtttggtttaattc

SEQ ID NO: 85121 - DNA, 15 bp, Homo sapiens
cagtttggtttaatt

SEQ ID NO: 85122 - DNA, 15 bp, Homo sapiens
ccagtttggtttaat

SEQ ID NO: 85123 - DNA, 15 bp, Homo sapiens
tccagtttggtttaa

SEQ ID NO: 85124 - DNA, 15 bp, Homo sapiens
gtccagtttggttta

SEQ ID NO: 85125 - DNA, 15 bp, Homo sapiens
tgtccagtttggttt

SEQ ID NO: 85126 - DNA, 15 bp, Homo sapiens
ttgtccagtttggtt

SEQ ID NO: 85127 - DNA, 15 bp, Homo sapiens
tttgtccagtttggt

SEQ ID NO: 85128 - DNA, 15 bp, Homo sapiens
atttgtccagtttgg

SEQ ID NO: 85129 - DNA, 15 bp, Homo sapiens
gatttgtccagtttg

SEQ ID NO: 85130 - DNA, 15 bp, Homo sapiens
ggatttgtccagttt

SEQ ID NO: 85131 - DNA, 15 bp, Homo sapiens
aggatttgtccagtt

SEQ ID NO: 85132 - DNA, 15 bp, Homo sapiens
aaggatttgtccagt

SEQ ID NO: 85133 - DNA, 15 bp, Homo sapiens
caaggatttgtccag

SEQ ID NO: 85134 - DNA, 15 bp, Homo sapiens
acaaggatttgtcca

SEQ ID NO: 85135 - DNA, 15 bp, Homo sapiens
cacaaggatttgtcc

SEQ ID NO: 85136 - DNA, 15 bp, Homo sapiens
ccacaaggatttgtc

SEQ ID NO: 85137 - DNA, 15 bp, Homo sapiens
tccacaaggatttgt

SEQ ID NO: 85138 - DNA, 15 bp, Homo sapiens
ctccacaaggatttg

SEQ ID NO: 85139 - DNA, 15 bp, Homo sapiens
gctccacaaggattt

SEQ ID NO: 85140 - DNA, 15 bp, Homo sapiens
tgctccacaaggatt

SEQ ID NO: 85141 - DNA, 15 bp, Homo sapiens
ttgctccacaaggat

SEQ ID NO: 85142 - DNA, 15 bp, Homo sapiens
tttgctccacaagga

SEQ ID NO: 85143 - DNA, 15 bp, Homo sapiens
atttgctccacaagg

SEQ ID NO: 85144 - DNA, 15 bp, Homo sapiens
catttgctccacaag

SEQ ID NO: 85145 - DNA, 15 bp, Homo sapiens
ccatttgctccacaa

SEQ ID NO: 85146 - DNA, 15 bp, Homo sapiens
cccatttgctccaca

SEQ ID NO: 85147 - DNA, 15 bp, Homo sapiens
tcccatttgctccac

SEQ ID NO: 85148 - DNA, 15 bp, Homo sapiens
ttcccatttgctcca

SEQ ID NO: 85149 - DNA, 15 bp, Homo sapiens
tttcccatttgctcc

SEQ ID NO: 85150 - DNA, 15 bp, Homo sapiens
ttttcccatttgctc

SEQ ID NO: 85151 - DNA, 15 bp, Homo sapiens
cttttcccatttgct

SEQ ID NO: 85152 - DNA, 15 bp, Homo sapiens
ccttttcccatttgc

SEQ ID NO: 85153 - DNA, 15 bp, Homo sapiens
accttttcccatttg

SEQ ID NO: 85154 - DNA, 15 bp, Homo sapiens
taccttttcccattt

SEQ ID NO: 85155 - DNA, 15 bp, Homo sapiens
ttaccttttcccatt

SEQ ID NO: 85156 - DNA, 15 bp, Homo sapiens
cttaccttttcccat

SEQ ID NO: 85157 - DNA, 15 bp, Homo sapiens
tcttaccttttccca

SEQ ID NO: 85158 - DNA, 15 bp, Homo sapiens
atcttaccttttccc

SEQ ID NO: 85159 - DNA, 15 bp, Homo sapiens
gatcttaccttttcc

SEQ ID NO: 85160 - DNA, 15 bp, Homo sapiens
ggatcttaccttttc

SEQ ID NO: 85161 - DNA, 15 bp, Homo sapiens
aggatcttacctttt

SEQ ID NO: 85162 - DNA, 15 bp, Homo sapiens
aaggatcttaccttt

SEQ ID NO: 85163 - DNA, 15 bp, Homo sapiens
caaggatcttacctt

SEQ ID NO: 85164 - DNA, 15 bp, Homo sapiens
tcaaggatcttacct

SEQ ID NO: 85165 - DNA, 15 bp, Homo sapiens
atcaaggatcttacc

SEQ ID NO: 85166 - DNA, 15 bp, Homo sapiens
aatcaaggatcttac

SEQ ID NO: 85167 - DNA, 15 bp, Homo sapiens
aaatcaaggatctta

SEQ ID NO: 85168 - DNA, 15 bp, Homo sapiens
aaaatcaaggatctt

SEQ ID NO: 85169 - DNA, 15 bp, Homo sapiens
aaaaatcaaggatct

SEQ ID NO: 85170 - DNA, 15 bp, Homo sapiens
aaaaaatcaaggatc

SEQ ID NO: 85171 - DNA, 15 bp, Homo sapiens
aaaaaaatcaaggat

SEQ ID NO: 85172 - DNA, 15 bp, Homo sapiens
gaaaaaaatcaagga

SEQ ID NO: 85173 - DNA, 15 bp, Homo sapiens
ggaaaaaaatcaagg

SEQ ID NO: 85174 - DNA, 15 bp, Homo sapiens
gggaaaaaaatcaag

SEQ ID NO: 85175 - DNA, 15 bp, Homo sapiens
ggggaaaaaaatcaa

SEQ ID NO: 85176 - DNA, 15 bp, Homo sapiens
aggggaaaaaaatca

SEQ ID NO: 85177 - DNA, 15 bp, Homo sapiens
taggggaaaaaaatc

SEQ ID NO: 85178 - DNA, 15 bp, Homo sapiens
ataggggaaaaaaat

SEQ ID NO: 85179 - DNA, 15 bp, Homo sapiens
tataggggaaaaaaa

SEQ ID NO: 85180 - DNA, 15 bp, Homo sapiens
atataggggaaaaaa

SEQ ID NO: 85181 - DNA, 15 bp, Homo sapiens
aatataggggaaaaa

SEQ ID NO: 85182 - DNA, 15 bp, Homo sapiens
aaatataggggaaaa

SEQ ID NO: 85183 - DNA, 15 bp, Homo sapiens
aaaatataggggaaa

SEQ ID NO: 85184 - DNA, 15 bp, Homo sapiens
aaaaatataggggaa

SEQ ID NO: 85185 - DNA, 15 bp, Homo sapiens
gaaaaatatagggga

SEQ ID NO: 85186 - DNA, 15 bp, Homo sapiens
tgaaaaatatagggg

SEQ ID NO: 85187 - DNA, 15 bp, Homo sapiens
ctgaaaaatataggg

SEQ ID NO: 85188 - DNA, 15 bp, Homo sapiens
tctgaaaaatatagg

SEQ ID NO: 85189 - DNA, 15 bp, Homo sapiens
atctgaaaaatatag

SEQ ID NO: 85190 - DNA, 15 bp, Homo sapiens
catctgaaaaatata

SEQ ID NO: 85191 - DNA, 15 bp, Homo sapiens
ccatctgaaaaatat

SEQ ID NO: 85192 - DNA, 15 bp, Homo sapiens
accatctgaaaaata

SEQ ID NO: 85193 - DNA, 15 bp, Homo sapiens
caccatctgaaaaat

SEQ ID NO: 85194 - DNA, 15 bp, Homo sapiens
ccaccatctgaaaaa

SEQ ID NO: 85195 - DNA, 15 bp, Homo sapiens
gccaccatctgaaaa

SEQ ID NO: 85196 - DNA, 15 bp, Homo sapiens
tgccaccatctgaaa

SEQ ID NO: 85197 - DNA, 15 bp, Homo sapiens
atgccaccatctgaa

SEQ ID NO: 85198 - DNA, 15 bp, Homo sapiens
gatgccaccatctga

SEQ ID NO: 85199 - DNA, 15 bp, Homo sapiens
cgatgccaccatctg

SEQ ID NO: 85200 - DNA, 15 bp, Homo sapiens
tcgatgccaccatct

SEQ ID NO: 85201 - DNA, 15 bp, Homo sapiens
ttcgatgccaccatc

SEQ ID NO: 85202 - DNA, 15 bp, Homo sapiens
attcgatgccaccat

SEQ ID NO: 85203 - DNA, 15 bp, Homo sapiens
tattcgatgccacca

SEQ ID NO: 85204 - DNA, 15 bp, Homo sapiens
ttattcgatgccacc

SEQ ID NO: 85205 - DNA, 15 bp, Homo sapiens
attattcgatgccac

SEQ ID NO: 85206 - DNA, 15 bp, Homo sapiens
tattattcgatgcca

SEQ ID NO: 85207 - DNA, 15 bp, Homo sapiens
atattattcgatgcc

SEQ ID NO: 85208 - DNA, 15 bp, Homo sapiens
aatattattcgatgc

SEQ ID NO: 85209 - DNA, 15 bp, Homo sapiens
taatattattcgatg

SEQ ID NO: 85210 - DNA, 15 bp, Homo sapiens
gtaatattattcgat

SEQ ID NO: 85211 - DNA, 15 bp, Homo sapiens
tgtaatattattcga

SEQ ID NO: 85212 - DNA, 15 bp, Homo sapiens
ctgtaatattattcg

SEQ ID NO: 85213 - DNA, 15 bp, Homo sapiens
actgtaatattattc

SEQ ID NO: 85214 - DNA, 15 bp, Homo sapiens
aactgtaatattatt

SEQ ID NO: 85215 - DNA, 15 bp, Homo sapiens
aaactgtaatattat

SEQ ID NO: 85216 - DNA, 15 bp, Homo sapiens
caaactgtaatatta

SEQ ID NO: 85217 - DNA, 15 bp, Homo sapiens
gcaaactgtaatatt

SEQ ID NO: 85218 - DNA, 15 bp, Homo sapiens
ggcaaactgtaatat

SEQ ID NO: 85219 - DNA, 15 bp, Homo sapiens
gggcaaactgtaata

SEQ ID NO: 85220 - DNA, 15 bp, Homo sapiens
agggcaaactgtaat

SEQ ID NO: 85221 - DNA, 15 bp, Homo sapiens
tagggcaaactgtaa

SEQ ID NO: 85222 - DNA, 15 bp, Homo sapiens
atagggcaaactgta

SEQ ID NO: 85223 - DNA, 15 bp, Homo sapiens
aatagggcaaactgt

SEQ ID NO: 85224 - DNA, 15 bp, Homo sapiens
taatagggcaaactg

SEQ ID NO: 85225 - DNA, 15 bp, Homo sapiens
ttaatagggcaaact

SEQ ID NO: 85226 - DNA, 15 bp, Homo sapiens
tttaatagggcaaac

SEQ ID NO: 85227 - DNA, 15 bp, Homo sapiens
atttaatagggcaaa

SEQ ID NO: 85228 - DNA, 15 bp, Homo sapiens
tatttaatagggcaa

SEQ ID NO: 85229 - DNA, 15 bp, Homo sapiens
atatttaatagggca

SEQ ID NO: 85230 - DNA, 15 bp, Homo sapiens
aatatttaatagggc

SEQ ID NO: 85231 - DNA, 15 bp, Homo sapiens
aaatatttaataggg

SEQ ID NO: 85232 - DNA, 15 bp, Homo sapiens
aaaatatttaatagg

SEQ ID NO: 85233 - DNA, 15 bp, Homo sapiens
caaaatatttaatag

SEQ ID NO: 85234 - DNA, 15 bp, Homo sapiens
gcaaaatatttaata

SEQ ID NO: 85235 - DNA, 15 bp, Homo sapiens
agcaaaatatttaat

SEQ ID NO: 85236 - DNA, 15 bp, Homo sapiens
aagcaaaatatttaa

SEQ ID NO: 85237 - DNA, 15 bp, Homo sapiens
aaagcaaaatattta

SEQ ID NO: 85238 - DNA, 15 bp, Homo sapiens
taaagcaaaatattt

SEQ ID NO: 85239 - DNA, 15 bp, Homo sapiens
ttaaagcaaaatatt

SEQ ID NO: 85240 - DNA, 15 bp, Homo sapiens
attaaagcaaaatat

SEQ ID NO: 85241 - DNA, 15 bp, Homo sapiens
tattaaagcaaaata

SEQ ID NO: 85242 - DNA, 15 bp, Homo sapiens
gtattaaagcaaaat

SEQ ID NO: 85243 - DNA, 15 bp, Homo sapiens
agtattaaagcaaaa

SEQ ID NO: 85244 - DNA, 15 bp, Homo sapiens
gagtattaaagcaaa

SEQ ID NO: 85245 - DNA, 15 bp, Homo sapiens
cgagtattaaagcaa

SEQ ID NO: 85246 - DNA, 15 bp, Homo sapiens
tcgagtattaaagca

SEQ ID NO: 85247 - DNA, 15 bp, Homo sapiens
ttcgagtattaaagc

SEQ ID NO: 85248 - DNA, 15 bp, Homo sapiens
attcgagtattaaag

SEQ ID NO: 85249 - DNA, 15 bp, Homo sapiens
gattcgagtattaaa

SEQ ID NO: 85250 - DNA, 15 bp, Homo sapiens
ggattcgagtattaa

SEQ ID NO: 85251 - DNA, 15 bp, Homo sapiens
aggattcgagtatta

SEQ ID NO: 85252 - DNA, 15 bp, Homo sapiens
gaggattcgagtatt

SEQ ID NO: 85253 - DNA, 15 bp, Homo sapiens
agaggattcgagtat

SEQ ID NO: 85254 - DNA, 15 bp, Homo sapiens
aagaggattcgagta

SEQ ID NO: 85255 - DNA, 15 bp, Homo sapiens
aaagaggattcgagt

SEQ ID NO: 85256 - DNA, 15 bp, Homo sapiens
aaaagaggattcgag

SEQ ID NO: 85257 - DNA, 15 bp, Homo sapiens
caaaagaggattcga

SEQ ID NO: 85258 - DNA, 15 bp, Homo sapiens
ccaaaagaggattcg

SEQ ID NO: 85259 - DNA, 15 bp, Homo sapiens
gccaaaagaggattc

SEQ ID NO: 85260 - DNA, 15 bp, Homo sapiens
agccaaaagaggatt

SEQ ID NO: 85261 - DNA, 15 bp, Homo sapiens
tagccaaaagaggat

SEQ ID NO: 85262 - DNA, 15 bp, Homo sapiens
ctagccaaaagagga

SEQ ID NO: 85263 - DNA, 15 bp, Homo sapiens
tctagccaaaagagg

SEQ ID NO: 85264 - DNA, 15 bp, Homo sapiens
atctagccaaaagag

SEQ ID NO: 85265 - DNA, 15 bp, Homo sapiens
tatctagccaaaaga

SEQ ID NO: 85266 - DNA, 15 bp, Homo sapiens
ttatctagccaaaag

SEQ ID NO: 85267 - DNA, 15 bp, Homo sapiens
tttatctagccaaaa

SEQ ID NO: 85268 - DNA, 15 bp, Homo sapiens
atttatctagccaaa

SEQ ID NO: 85269 - DNA, 15 bp, Homo sapiens
catttatctagccaa

SEQ ID NO: 85270 - DNA, 15 bp, Homo sapiens
ccatttatctagcca

SEQ ID NO: 85271 - DNA, 15 bp, Homo sapiens
accatttatctagcc

SEQ ID NO: 85272 - DNA, 15 bp, Homo sapiens
aaccatttatctagc

SEQ ID NO: 85273 - DNA, 15 bp, Homo sapiens
aaaccatttatctag

SEQ ID NO: 85274 - DNA, 15 bp, Homo sapiens
aaaaccatttatcta

SEQ ID NO: 85275 - DNA, 15 bp, Homo sapiens
gaaaaccatttatct

SEQ ID NO: 85276 - DNA, 15 bp, Homo sapiens
tgaaaaccatttatc

SEQ ID NO: 85277 - DNA, 15 bp, Homo sapiens
ttgaaaaccatttat

SEQ ID NO: 85278 - DNA, 15 bp, Homo sapiens
tttgaaaaccattta

SEQ ID NO: 85279 - DNA, 15 bp, Homo sapiens
catttttgaaaacca

SEQ ID NO: 85280 - DNA, 15 bp, Homo sapiens
acatttttgaaaacc

SEQ ID NO: 85281 - DNA, 15 bp, Homo sapiens
aacatttttgaaaac

SEQ ID NO: 85282 - DNA, 15 bp, Homo sapiens
aaacatttttgaaaa

SEQ ID NO: 85283 - DNA, 15 bp, Homo sapiens
aaaacatttttgaaa

SEQ ID NO: 85284 - DNA, 15 bp, Homo sapiens
aaaaacatttttgaa

SEQ ID NO: 85285 - DNA, 15 bp, Homo sapiens
taaaaacatttttga

SEQ ID NO: 85286 - DNA, 15 bp, Homo sapiens
ctaaaaacatttttg

SEQ ID NO: 85287 - DNA, 15 bp, Homo sapiens
cctaaaaacattttt

SEQ ID NO: 85288 - DNA, 15 bp, Homo sapiens
gcctaaaaacatttt

SEQ ID NO: 85289 - DNA, 15 bp, Homo sapiens
tgcctaaaaacattt

SEQ ID NO: 85290 - DNA, 15 bp, Homo sapiens
ctgcctaaaaacatt

SEQ ID NO: 85291 - DNA, 15 bp, Homo sapiens
gctgcctaaaaacat

SEQ ID NO: 85292 - DNA, 15 bp, Homo sapiens
tgctgcctaaaaaca

SEQ ID NO: 85293 - DNA, 15 bp, Homo sapiens
ctgctgcctaaaaac

SEQ ID NO: 85294 - DNA, 15 bp, Homo sapiens
tctgctgcctaaaaa

SEQ ID NO: 85295 - DNA, 15 bp, Homo sapiens
ttctgctgcctaaaa

SEQ ID NO: 85296 - DNA, 15 bp, Homo sapiens
attctgctgcctaaa

SEQ ID NO: 85297 - DNA, 15 bp, Homo sapiens
gattctgctgcctaa

SEQ ID NO: 85298 - DNA, 15 bp, Homo sapiens
agattctgctgccta

SEQ ID NO: 85299 - DNA, 15 bp, Homo sapiens
aagattctgctgcct

SEQ ID NO: 85300 - DNA, 15 bp, Homo sapiens
aaagattctgctgcc

SEQ ID NO: 85301 - DNA, 15 bp, Homo sapiens
taaagattctgctgc

SEQ ID NO: 85302 - DNA, 15 bp, Homo sapiens
ttaaagattctgctg

SEQ ID NO: 85303 - DNA, 15 bp, Homo sapiens
tttaaagattctgct

SEQ ID NO: 85304 - DNA, 15 bp, Homo sapiens
ttttaaagattctgc

SEQ ID NO: 85305 - DNA, 15 bp, Homo sapiens
tttttaaagattctg

SEQ ID NO: 85306 - DNA, 15 bp, Homo sapiens
atttttaaagattct

SEQ ID NO: 85307 - DNA, 15 bp, Homo sapiens
catttttaaagattc

SEQ ID NO: 85308 - DNA, 15 bp, Homo sapiens
tcatttttaaagatt

SEQ ID NO: 85309 - DNA, 15 bp, Homo sapiens
ttcatttttaaagat

SEQ ID NO: 85310 - DNA, 15 bp, Homo sapiens
tttcatttttaaaga

SEQ ID NO: 85311 - DNA, 15 bp, Homo sapiens
atttcatttttaaag

SEQ ID NO: 85312 - DNA, 15 bp, Homo sapiens
aatttcatttttaaa

SEQ ID NO: 85313 - DNA, 15 bp, Homo sapiens
aaatttcatttttaa

SEQ ID NO: 85314 - DNA, 15 bp, Homo sapiens
aaaatttcattttta

SEQ ID NO: 85315 - DNA, 15 bp, Homo sapiens
taaaatttcattttt

SEQ ID NO: 85316 - DNA, 15 bp, Homo sapiens
ataaaatttcatttt

SEQ ID NO: 85317 - DNA, 15 bp, Homo sapiens
aataaaatttcattt

SEQ ID NO: 85318 - DNA, 15 bp, Homo sapiens
gaataaaatttcatt

SEQ ID NO: 85319 - DNA, 15 bp, Homo sapiens
agaataaaatttcat

SEQ ID NO: 85320 - DNA, 15 bp, Homo sapiens
cagaataaaatttca

SEQ ID NO: 85321 - DNA, 15 bp, Homo sapiens
tcagaataaaatttc

SEQ ID NO: 85322 - DNA, 15 bp, Homo sapiens
ttcagaataaaattt

SEQ ID NO: 85323 - DNA, 15 bp, Homo sapiens
cttcagaataaaatt

SEQ ID NO: 85324 - DNA, 15 bp, Homo sapiens
gcttcagaataaaat

SEQ ID NO: 85325 - DNA, 15 bp, Homo sapiens
agcttcagaataaaa

SEQ ID NO: 85326 - DNA, 15 bp, Homo sapiens
cagcttcagaataaa

SEQ ID NO: 85327 - DNA, 15 bp, Homo sapiens
tcagcttcagaataa

SEQ ID NO: 85328 - DNA, 15 bp, Homo sapiens
atcagcttcagaata

SEQ ID NO: 85329 - DNA, 15 bp, Homo sapiens
aatcagcttcagaat

SEQ ID NO: 85330 - DNA, 15 bp, Homo sapiens
caatcagcttcagaa

SEQ ID NO: 85331 - DNA, 15 bp, Homo sapiens
acaatcagcttcaga

SEQ ID NO: 85332 - DNA, 15 bp, Homo sapiens
tacaatcagcttcag

SEQ ID NO: 85333 - DNA, 15 bp, Homo sapiens
ttacaatcagcttca

SEQ ID NO: 85334 - DNA, 15 bp, Homo sapiens
tttacaatcagcttc

SEQ ID NO: 85335 - DNA, 15 bp, Homo sapiens
ttttacaatcagctt

SEQ ID NO: 85336 - DNA, 15 bp, Homo sapiens
tttttacaatcagct

SEQ ID NO: 85337 - DNA, 15 bp, Homo sapiens
ttttttacaatcagc

SEQ ID NO: 85338 - DNA, 15 bp, Homo sapiens
cttttttacaatcag

SEQ ID NO: 85339 - DNA, 15 bp, Homo sapiens
gcttttttacaatca

SEQ ID NO: 85340 - DNA, 15 bp, Homo sapiens
tgcttttttacaatc

SEQ ID NO: 85341 - DNA, 15 bp, Homo sapiens
ctgcttttttacaat

SEQ ID NO: 85342 - DNA, 15 bp, Homo sapiens
tctgcttttttacaa

SEQ ID NO: 85343 - DNA, 15 bp, Homo sapiens
atctgcttttttaca

SEQ ID NO: 85344 - DNA, 15 bp, Homo sapiens
tatctgcttttttac

SEQ ID NO: 85345 - DNA, 15 bp, Homo sapiens
ttatctgctttttta

SEQ ID NO: 85346 - DNA, 15 bp, Homo sapiens
tttatctgctttttt

SEQ ID NO: 85347 - DNA, 15 bp, Homo sapiens
ttttatctgcttttt

SEQ ID NO: 85348 - DNA, 15 bp, Homo sapiens
cttttatctgctttt

SEQ ID NO: 85349 - DNA, 15 bp, Homo sapiens
gcttttatctgcttt

SEQ ID NO: 85350 - DNA, 15 bp, Homo sapiens
tgcttttatctgctt

SEQ ID NO: 85351 - DNA, 15 bp, Homo sapiens
ttgcttttatctgct

SEQ ID NO: 85352 - DNA, 15 bp, Homo sapiens
tttgcttttatctgc

SEQ ID NO: 85353 - DNA, 15 bp, Homo sapiens
ctttgcttttatctg

SEQ ID NO: 85354 - DNA, 15 bp, Homo sapiens
actttgcttttatct

SEQ ID NO: 85355 - DNA, 15 bp, Homo sapiens
aactttgcttttatc

SEQ ID NO: 85356 - DNA, 15 bp, Homo sapiens
caactttgcttttat

SEQ ID NO: 85357 - DNA, 15 bp, Homo sapiens
acaactttgctttta

SEQ ID NO: 85358 - DNA, 15 bp, Homo sapiens
aacaactttgctttt

SEQ ID NO: 85359 - DNA, 15 bp, Homo sapiens
gaacaactttgcttt

SEQ ID NO: 85360 - DNA, 15 bp, Homo sapiens
agaacaactttgctt

SEQ ID NO: 85361 - DNA, 15 bp, Homo sapiens
cagaacaactttgct

SEQ ID NO: 85362 - DNA, 15 bp, Homo sapiens
tcagaacaactttgc

SEQ ID NO: 85363 - DNA, 15 bp, Homo sapiens
atcagaacaactttg

SEQ ID NO: 85364 - DNA, 15 bp, Homo sapiens
aatcagaacaacttt

SEQ ID NO: 85365 - DNA, 15 bp, Homo sapiens
aaatcagaacaactt

SEQ ID NO: 85366 - DNA, 15 bp, Homo sapiens
aaaatcagaacaact

SEQ ID NO: 85367 - DNA, 15 bp, Homo sapiens
taaaatcagaacaac

SEQ ID NO: 85368 - DNA, 15 bp, Homo sapiens
ataaaatcagaacaa

SEQ ID NO: 85369 - DNA, 15 bp, Homo sapiens
tataaaatcagaaca

SEQ ID NO: 85370 - DNA, 15 bp, Homo sapiens
atataaaatcagaac

SEQ ID NO: 85371 - DNA, 15 bp, Homo sapiens
catataaaatcagaa

SEQ ID NO: 85372 - DNA, 15 bp, Homo sapiens
ccatataaaatcaga

SEQ ID NO: 85373 - DNA, 15 bp, Homo sapiens
cccatataaaatcag

SEQ ID NO: 85374 - DNA, 15 bp, Homo sapiens
ccccatataaaatca

SEQ ID NO: 85375 - DNA, 15 bp, Homo sapiens
accccatataaaatc

SEQ ID NO: 85376 - DNA, 15 bp, Homo sapiens
gaccccatataaaat

SEQ ID NO: 85377 - DNA, 15 bp, Homo sapiens
cgaccccatataaaa

SEQ ID NO: 85378 - DNA, 15 bp, Homo sapiens
ccgaccccatataaa

SEQ ID NO: 85379 - DNA, 15 bp, Homo sapiens
cccgaccccatataa

SEQ ID NO: 85380 - DNA, 15 bp, Homo sapiens
ccccgaccccatata

SEQ ID NO: 85381 - DNA, 15 bp, Homo sapiens
gccccgaccccatat

SEQ ID NO: 85382 - DNA, 15 bp, Homo sapiens
agccccgaccccata

SEQ ID NO: 85383 - DNA, 15 bp, Homo sapiens
cagccccgaccccat

SEQ ID NO: 85384 - DNA, 15 bp, Homo sapiens
ccagccccgacccca

SEQ ID NO: 85385 - DNA, 15 bp, Homo sapiens
tccagccccgacccc

SEQ ID NO: 85386 - DNA, 15 bp, Homo sapiens
atccagccccgaccc

SEQ ID NO: 85387 - DNA, 15 bp, Homo sapiens
tatccagccccgacc

SEQ ID NO: 85388 - DNA, 15 bp, Homo sapiens
gtatccagccccgac

SEQ ID NO: 85389 - DNA, 15 bp, Homo sapiens
ggtatccagccccga

SEQ ID NO: 85390 - DNA, 15 bp, Homo sapiens
gggtatccagccccg

SEQ ID NO: 85391 - DNA, 15 bp, Homo sapiens
agggtatccagcccc

SEQ ID NO: 85392 - DNA, 15 bp, Homo sapiens
cagggtatccagccc

SEQ ID NO: 85393 - DNA, 15 bp, Homo sapiens
tcagggtatccagcc

SEQ ID NO: 85394 - DNA, 15 bp, Homo sapiens
atcagggtatccagc

SEQ ID NO: 85395 - DNA, 15 bp, Homo sapiens
aatcagggtatccag

SEQ ID NO: 85396 - DNA, 15 bp, Homo sapiens
taatcagggtatcca

SEQ ID NO: 85397 - DNA, 15 bp, Homo sapiens
ctaatcagggtatcc

SEQ ID NO: 85398 - DNA, 15 bp, Homo sapiens
gctaatcagggtatc

SEQ ID NO: 85399 - DNA, 15 bp, Homo sapiens
tgctaatcagggtat

SEQ ID NO: 85400 - DNA, 15 bp, Homo sapiens
ctgctaatcagggta

SEQ ID NO: 85401 - DNA, 15 bp, Homo sapiens
tctgctaatcagggt

SEQ ID NO: 85402 - DNA, 15 bp, Homo sapiens
ttctgctaatcaggg

SEQ ID NO: 85403 - DNA, 15 bp, Homo sapiens
gttctgctaatcagg

SEQ ID NO: 85404 - DNA, 15 bp, Homo sapiens
tgttctgctaatcag

SEQ ID NO: 85405 - DNA, 15 bp, Homo sapiens
ctgttctgctaatca

SEQ ID NO: 85406 - DNA, 15 bp, Homo sapiens
actgttctgctaatc

SEQ ID NO: 85407 - DNA, 15 bp, Homo sapiens
aactgttctgctaat

SEQ ID NO: 85408 - DNA, 15 bp, Homo sapiens
taactgttctgctaa

SEQ ID NO: 85409 - DNA, 15 bp, Homo sapiens
ttaactgttctgcta

SEQ ID NO: 85410 - DNA, 15 bp, Homo sapiens
tttaactgttctgct

SEQ ID NO: 85411 - DNA, 15 bp, Homo sapiens
ttttaactgttctgc

SEQ ID NO: 85412 - DNA, 15 bp, Homo sapiens
gttttaactgttctg

SEQ ID NO: 85413 - DNA, 15 bp, Homo sapiens
ggttttaactgttct

SEQ ID NO: 85414 - DNA, 15 bp, Homo sapiens
gggttttaactgttc

SEQ ID NO: 85415 - DNA, 15 bp, Homo sapiens
tgggttttaactgtt

SEQ ID NO: 85416 - DNA, 15 bp, Homo sapiens
gtgggttttaactgt

SEQ ID NO: 85417 - DNA, 15 bp, Homo sapiens
agtgggttttaactg

SEQ ID NO: 85418 - DNA, 15 bp, Homo sapiens
tagtgggttttaact

SEQ ID NO: 85419 - DNA, 15 bp, Homo sapiens
ctagtgggttttaac

SEQ ID NO: 85420 - DNA, 15 bp, Homo sapiens
gctagtgggttttaa

SEQ ID NO: 85421 - DNA, 15 bp, Homo sapiens
tgctagtgggtttta

SEQ ID NO: 85422 - DNA, 15 bp, Homo sapiens
atgctagtgggtttt

SEQ ID NO: 85423 - DNA, 15 bp, Homo sapiens
tatgctagtgggttt

SEQ ID NO: 85424 - DNA, 15 bp, Homo sapiens
ctatgctagtgggtt

SEQ ID NO: 85425 - DNA, 15 bp, Homo sapiens
actatgctagtgggt

SEQ ID NO: 85426 - DNA, 15 bp, Homo sapiens
tactatgctagtggg

SEQ ID NO: 85427 - DNA, 15 bp, Homo sapiens
atactatgctagtgg

SEQ ID NO: 85428 - DNA, 15 bp, Homo sapiens
tatactatgctagtg

SEQ ID NO: 85429 - DNA, 15 bp, Homo sapiens
atatactatgctagt

SEQ ID NO: 85430 - DNA, 15 bp, Homo sapiens
aatatactatgctag

SEQ ID NO: 85431 - DNA, 15 bp, Homo sapiens
aaatatactatgcta

SEQ ID NO: 85432 - DNA, 15 bp, Homo sapiens
aaaatatactatgct

SEQ ID NO: 85433 - DNA, 15 bp, Homo sapiens
taaaatatactatgc

SEQ ID NO: 85434 - DNA, 15 bp, Homo sapiens
ttaaaatatactatg

SEQ ID NO: 85435 - DNA, 15 bp, Homo sapiens
tttaaaatatactat

SEQ ID NO: 85436 - DNA, 15 bp, Homo sapiens
ttttaaaatatacta

SEQ ID NO: 85437 - DNA, 15 bp, Homo sapiens
gttttaaaatatact

SEQ ID NO: 85438 - DNA, 15 bp, Homo sapiens
agttttaaaatatac

SEQ ID NO: 85439 - DNA, 15 bp, Homo sapiens
cagttttaaaatata

SEQ ID NO: 85440 - DNA, 15 bp, Homo sapiens
acagttttaaaatat

SEQ ID NO: 85441 - DNA, 15 bp, Homo sapiens
tacagttttaaaata

SEQ ID NO: 85442 - DNA, 15 bp, Homo sapiens
atacagttttaaaat

SEQ ID NO: 85443 - DNA, 15 bp, Homo sapiens
gatacagttttaaaa

SEQ ID NO: 85444 - DNA, 15 bp, Homo sapiens
ggatacagttttaaa

SEQ ID NO: 85445 - DNA, 15 bp, Homo sapiens
aggatacagttttaa

SEQ ID NO: 85446 - DNA, 15 bp, Homo sapiens
aaggatacagtttta

SEQ ID NO: 85447 - DNA, 15 bp, Homo sapiens
aaaggatacagtttt

SEQ ID NO: 85448 - DNA, 15 bp, Homo sapiens
caaaggatacagttt

SEQ ID NO: 85449 - DNA, 15 bp, Homo sapiens
ccaaaggatacagtt

SEQ ID NO: 85450 - DNA, 15 bp, Homo sapiens
cccaaaggatacagt

SEQ ID NO: 85451 - DNA, 15 bp, Homo sapiens
acccaaaggatacag

SEQ ID NO: 85452 - DNA, 15 bp, Homo sapiens
aacccaaaggataca

SEQ ID NO: 85453 - DNA, 15 bp, Homo sapiens
aaacccaaaggatac

SEQ ID NO: 85454 - DNA, 15 bp, Homo sapiens
taaacccaaaggata

SEQ ID NO: 85455 - DNA, 15 bp, Homo sapiens
ataaacccaaaggat

SEQ ID NO: 85456 - DNA, 15 bp, Homo sapiens
atataaacccaaagg

SEQ ID NO: 85457 - DNA, 15 bp, Homo sapiens
tatataaacccaaag

SEQ ID NO: 85458 - DNA, 15 bp, Homo sapiens
atatataaacccaaa

SEQ ID NO: 85459 - DNA, 15 bp, Homo sapiens
aatatataaacccaa

SEQ ID NO: 85460 - DNA, 15 bp, Homo sapiens
caatatataaaccca

SEQ ID NO: 85461 - DNA, 15 bp, Homo sapiens
ccaatatataaaccc

SEQ ID NO: 85462 - DNA, 15 bp, Homo sapiens
cccaatatataaacc

SEQ ID NO: 85463 - DNA, 15 bp, Homo sapiens
tcccaatatataaac

SEQ ID NO: 85464 - DNA, 15 bp, Homo sapiens
ttcccaatatataaa

SEQ ID NO: 85465 - DNA, 15 bp, Homo sapiens
attcccaatatataa

SEQ ID NO: 85466 - DNA, 15 bp, Homo sapiens
aattcccaatatata

SEQ ID NO: 85467 - DNA, 15 bp, Homo sapiens
aaattcccaatatat

SEQ ID NO: 85468 - DNA, 15 bp, Homo sapiens
caaattcccaatata

SEQ ID NO: 85469 - DNA, 15 bp, Homo sapiens
acaaattcccaatat

SEQ ID NO: 85470 - DNA, 15 bp, Homo sapiens
aacaaattcccaata

SEQ ID NO: 85471 - DNA, 15 bp, Homo sapiens
aaacaaattcccaat

SEQ ID NO: 85472 - DNA, 15 bp, Homo sapiens
caaacaaattcccaa

SEQ ID NO: 85473 - DNA, 15 bp, Homo sapiens
gcaaacaaattccca

SEQ ID NO: 85474 - DNA, 15 bp, Homo sapiens
tgcaaacaaattccc

SEQ ID NO: 85475 - DNA, 15 bp, Homo sapiens
ctgcaaacaaattcc

SEQ ID NO: 85476 - DNA, 15 bp, Homo sapiens
cctgcaaacaaattc

SEQ ID NO: 85477 - DNA, 15 bp, Homo sapiens
ccctgcaaacaaatt

SEQ ID NO: 85478 - DNA, 15 bp, Homo sapiens
accctgcaaacaaat

SEQ ID NO: 85479 - DNA, 15 bp, Homo sapiens
caccctgcaaacaaa

SEQ ID NO: 85480 - DNA, 15 bp, Homo sapiens
ccaccctgcaaacaa

SEQ ID NO: 85481 - DNA, 15 bp, Homo sapiens
accaccctgcaaaca

SEQ ID NO: 85482 - DNA, 15 bp, Homo sapiens
taccaccctgcaaac

SEQ ID NO: 85483 - DNA, 15 bp, Homo sapiens
ctaccaccctgcaaa

SEQ ID NO: 85484 - DNA, 15 bp, Homo sapiens
gctaccaccctgcaa

SEQ ID NO: 85485 - DNA, 15 bp, Homo sapiens
tgctaccaccctgca

SEQ ID NO: 85486 - DNA, 15 bp, Homo sapiens
ttgctaccaccctgc

SEQ ID NO: 85487 - DNA, 15 bp, Homo sapiens
tttgctaccaccctg

SEQ ID NO: 85488 - DNA, 15 bp, Homo sapiens
ttttgctaccaccct

SEQ ID NO: 85489 - DNA, 15 bp, Homo sapiens
cttttgctaccaccc

SEQ ID NO: 85490 - DNA, 15 bp, Homo sapiens
tcttttgctaccacc

SEQ ID NO: 85491 - DNA, 15 bp, Homo sapiens
ttcttttgctaccac

SEQ ID NO: 85492 - DNA, 15 bp, Homo sapiens
tttcttttgctacca

SEQ ID NO: 85493 - DNA, 15 bp, Homo sapiens
ttttcttttgctacc

SEQ ID NO: 85494 - DNA, 15 bp, Homo sapiens
gttttcttttgctac

SEQ ID NO: 85495 - DNA, 15 bp, Homo sapiens
agttttcttttgcta

SEQ ID NO: 85496 - DNA, 15 bp, Homo sapiens
aagttttcttttgct

SEQ ID NO: 85497 - DNA, 15 bp, Homo sapiens
aaagttttcttttgc

SEQ ID NO: 85498 - DNA, 15 bp, Homo sapiens
taaagttttcttttg

SEQ ID NO: 85499 - DNA, 15 bp, Homo sapiens
gtaaagttttctttt

SEQ ID NO: 85500 - DNA, 15 bp, Homo sapiens
agtaaagttttcttt

SEQ ID NO: 85501 - DNA, 15 bp, Homo sapiens
aagtaaagttttctt

SEQ ID NO: 85502 - DNA, 15 bp, Homo sapiens
caagtaaagttttct

SEQ ID NO: 85503 - DNA, 15 bp, Homo sapiens
ccaagtaaagttttc

SEQ ID NO: 85504 - DNA, 15 bp, Homo sapiens
gccaagtaaagtttt

SEQ ID NO: 85505 - DNA, 15 bp, Homo sapiens
tgccaagtaaagttt

SEQ ID NO: 85506 - DNA, 15 bp, Homo sapiens
ttgccaagtaaagtt

SEQ ID NO: 85507 - DNA, 15 bp, Homo sapiens
gttgccaagtaaagt

SEQ ID NO: 85508 - DNA, 15 bp, Homo sapiens
tgttgccaagtaaag

SEQ ID NO: 85509 - DNA, 15 bp, Homo sapiens
atgttgccaagtaaa

SEQ ID NO: 85510 - DNA, 15 bp, Homo sapiens
aatgttgccaagtaa

SEQ ID NO: 85511 - DNA, 15 bp, Homo sapiens
aaatgttgccaagta

SEQ ID NO: 85512 - DNA, 15 bp, Homo sapiens
caaatgttgccaagt

SEQ ID NO: 85513 - DNA, 15 bp, Homo sapiens
ccaaatgttgccaag

SEQ ID NO: 85514 - DNA, 15 bp, Homo sapiens
cccaaatgttgccaa

SEQ ID NO: 85515 - DNA, 15 bp, Homo sapiens
tcccaaatgttgcca

SEQ ID NO: 85516 - DNA, 15 bp, Homo sapiens
ttcccaaatgttgcc

SEQ ID NO: 85517 - DNA, 15 bp, Homo sapiens
tttcccaaatgttgc

SEQ ID NO: 85518 - DNA, 15 bp, Homo sapiens
gtttcccaaatgttg

SEQ ID NO: 85519 - DNA, 15 bp, Homo sapiens
cgtttcccaaatgtt

SEQ ID NO: 85520 - DNA, 15 bp, Homo sapiens
tcgtttcccaaatgt

SEQ ID NO: 85521 - DNA, 15 bp, Homo sapiens
ttcgtttcccaaatg

SEQ ID NO: 85522 - DNA, 15 bp, Homo sapiens
cttcgtttcccaaat

SEQ ID NO: 85523 - DNA, 15 bp, Homo sapiens
acttcgtttcccaaa

SEQ ID NO: 85524 - DNA, 15 bp, Homo sapiens
aacttcgtttcccaa

SEQ ID NO: 85525 - DNA, 15 bp, Homo sapiens
taacttcgtttccca

SEQ ID NO: 85526 - DNA, 15 bp, Homo sapiens
gtaacttcgtttccc

SEQ ID NO: 85527 - DNA, 15 bp, Homo sapiens
cgtaacttcgtttcc

SEQ ID NO: 85528 - DNA, 15 bp, Homo sapiens
acgtaacttcgtttc

SEQ ID NO: 85529 - DNA, 15 bp, Homo sapiens
aacgtaacttcgttt

SEQ ID NO: 85530 - DNA, 15 bp, Homo sapiens
taacgtaacttcgtt

SEQ ID NO: 85531 - DNA, 15 bp, Homo sapiens
ttaacgtaacttcgt

SEQ ID NO: 85532 - DNA, 15 bp, Homo sapiens
tttaacgtaacttcg

SEQ ID NO: 85533 - DNA, 15 bp, Homo sapiens
atttaacgtaacttc

SEQ ID NO: 85534 - DNA, 15 bp, Homo sapiens
aatttaacgtaactt

SEQ ID NO: 85535 - DNA, 15 bp, Homo sapiens
gaatttaacgtaact

SEQ ID NO: 85536 - DNA, 15 bp, Homo sapiens
tgaatttaacgtaac

SEQ ID NO: 85537 - DNA, 15 bp, Homo sapiens
atgaatttaacgtaa

SEQ ID NO: 85538 - DNA, 15 bp, Homo sapiens
aatgaatttaacgta

SEQ ID NO: 85539 - DNA, 15 bp, Homo sapiens
taatgaatttaacgt

SEQ ID NO: 85540 - DNA, 15 bp, Homo sapiens
ttaatgaatttaacg

SEQ ID NO: 85541 - DNA, 15 bp, Homo sapiens
cttaatgaatttaac

SEQ ID NO: 85542 - DNA, 15 bp, Homo sapiens
ccttaatgaatttaa

SEQ ID NO: 85543 - DNA, 15 bp, Homo sapiens
cccttaatgaattta

SEQ ID NO: 85544 - DNA, 15 bp, Homo sapiens
acccttaatgaattt

SEQ ID NO: 85545 - DNA, 15 bp, Homo sapiens
tacccttaatgaatt

SEQ ID NO: 85546 - DNA, 15 bp, Homo sapiens
atacccttaatgaat

SEQ ID NO: 85547 - DNA, 15 bp, Homo sapiens
aatacccttaatgaa

SEQ ID NO: 85548 - DNA, 15 bp, Homo sapiens
aaatacccttaatga

SEQ ID NO: 85549 - DNA, 15 bp, Homo sapiens
caaatacccttaatg

SEQ ID NO: 85550 - DNA, 15 bp, Homo sapiens
tcaaatacccttaat

SEQ ID NO: 85551 - DNA, 15 bp, Homo sapiens
atcaaatacccttaa

SEQ ID NO: 85552 - DNA, 15 bp, Homo sapiens
aatcaaataccctta

SEQ ID NO: 85553 - DNA, 15 bp, Homo sapiens
aaatcaaataccctt

SEQ ID NO: 85554 - DNA, 15 bp, Homo sapiens
aaaatcaaataccct

SEQ ID NO: 85555 - DNA, 15 bp, Homo sapiens
aaaaatcaaataccc

SEQ ID NO: 85556 - DNA, 15 bp, Homo sapiens
caaaaatcaaatacc

SEQ ID NO: 85557 - DNA, 15 bp, Homo sapiens
tcaaaaatcaaatac

SEQ ID NO: 85558 - DNA, 15 bp, Homo sapiens
atcaaaaatcaaata

SEQ ID NO: 85559 - DNA, 15 bp, Homo sapiens
tatcaaaaatcaaat

SEQ ID NO: 85560 - DNA, 15 bp, Homo sapiens
ttatcaaaaatcaaa

SEQ ID NO: 85561 - DNA, 15 bp, Homo sapiens
gttatcaaaaatcaa

SEQ ID NO: 85562 - DNA, 15 bp, Homo sapiens
agttatcaaaaatca

SEQ ID NO: 85563 - DNA, 15 bp, Homo sapiens
aagttatcaaaaatc

SEQ ID NO: 85564 - DNA, 15 bp, Homo sapiens
aaagttatcaaaaat

SEQ ID NO: 85565 - DNA, 15 bp, Homo sapiens
aaaagttatcaaaaa

SEQ ID NO: 85566 - DNA, 15 bp, Homo sapiens
taaaagttatcaaaa

SEQ ID NO: 85567 - DNA, 15 bp, Homo sapiens
ttaaaagttatcaaa

SEQ ID NO: 85568 - DNA, 15 bp, Homo sapiens
attaaaagttatcaa

SEQ ID NO: 85569 - DNA, 15 bp, Homo sapiens
cattaaaagttatca

SEQ ID NO: 85570 - DNA, 15 bp, Homo sapiens
gcattaaaagttatc

SEQ ID NO: 85571 - DNA, 15 bp, Homo sapiens
tgcattaaaagttat

SEQ ID NO: 85572 - DNA, 15 bp, Homo sapiens
atgcattaaaagtta

SEQ ID NO: 85573 - DNA, 15 bp, Homo sapiens
aatgcattaaaagtt

SEQ ID NO: 85574 - DNA, 15 bp, Homo sapiens
taatgcattaaaagt

SEQ ID NO: 85575 - DNA, 15 bp, Homo sapiens
ataatgcattaaaag

SEQ ID NO: 85576 - DNA, 15 bp, Homo sapiens
tataatgcattaaaa

SEQ ID NO: 85577 - DNA, 15 bp, Homo sapiens
atataatgcattaaa

SEQ ID NO: 85578 - DNA, 15 bp, Homo sapiens
aatataatgcattaa

SEQ ID NO: 85579 - DNA, 15 bp, Homo sapiens
aaatataatgcatta

SEQ ID NO: 85580 - DNA, 15 bp, Homo sapiens
taaatataatgcatt

SEQ ID NO: 85581 - DNA, 15 bp, Homo sapiens
ataaatataatgcat

SEQ ID NO: 85582 - DNA, 15 bp, Homo sapiens
aataaatataatgca

SEQ ID NO: 85583 - DNA, 15 bp, Homo sapiens
aaataaatataatgc

SEQ ID NO: 85584 - DNA, 15 bp, Homo sapiens
taaataaatataatg

SEQ ID NO: 85585 - DNA, 15 bp, Homo sapiens
gtaaataaatataat

SEQ ID NO: 85586 - DNA, 15 bp, Homo sapiens
agtaaataaatataa

SEQ ID NO: 85587 - DNA, 15 bp, Homo sapiens
tagtaaataaatata

SEQ ID NO: 85588 - DNA, 15 bp, Homo sapiens
gtagtaaataaatat

SEQ ID NO: 85589 - DNA, 15 bp, Homo sapiens
tgtagtaaataaata

SEQ ID NO: 85590 - DNA, 15 bp, Homo sapiens
ctgtagtaaataaat

SEQ ID NO: 85591 - DNA, 15 bp, Homo sapiens
actgtagtaaataaa

SEQ ID NO: 85592 - DNA, 15 bp, Homo sapiens
tactgtagtaaataa

SEQ ID NO: 85593 - DNA, 15 bp, Homo sapiens
atactgtagtaaata

SEQ ID NO: 85594 - DNA, 15 bp, Homo sapiens
aatactgtagtaaat

SEQ ID NO: 85595 - DNA, 15 bp, Homo sapiens
aaatactgtagtaaa

SEQ ID NO: 85596 - DNA, 15 bp, Homo sapiens
aaaatactgtagtaa

SEQ ID NO: 85597 - DNA, 15 bp, Homo sapiens
aaaaatactgtagta

SEQ ID NO: 85598 - DNA, 15 bp, Homo sapiens
taaaaatactgtagt

SEQ ID NO: 85599 - DNA, 15 bp, Homo sapiens
ataaaaatactgtag

SEQ ID NO: 85600 - DNA, 15 bp, Homo sapiens
tataaaaatactgta

SEQ ID NO: 85601 - DNA, 15 bp, Homo sapiens
ctataaaaatactgt

SEQ ID NO: 85602 - DNA, 15 bp, Homo sapiens
actataaaaatactg

SEQ ID NO: 85603 - DNA, 15 bp, Homo sapiens
aactataaaaatact

SEQ ID NO: 85604 - DNA, 15 bp, Homo sapiens
taactataaaaatac

SEQ ID NO: 85605 - DNA, 15 bp, Homo sapiens
ttaactataaaaata

SEQ ID NO: 85606 - DNA, 15 bp, Homo sapiens
cttaactataaaaat

SEQ ID NO: 85607 - DNA, 15 bp, Homo sapiens
acttaactataaaaa

SEQ ID NO: 85608 - DNA, 15 bp, Homo sapiens
aacttaactataaaa

SEQ ID NO: 85609 - DNA, 15 bp, Homo sapiens
aaacttaactataaa

SEQ ID NO: 85610 - DNA, 15 bp, Homo sapiens
caaacttaactataa

SEQ ID NO: 85611 - DNA, 15 bp, Homo sapiens
tcaaacttaactata

SEQ ID NO: 85612 - DNA, 15 bp, Homo sapiens
atcaaacttaactat

SEQ ID NO: 85613 - DNA, 15 bp, Homo sapiens
tatcaaacttaacta

SEQ ID NO: 85614 - DNA, 15 bp, Homo sapiens
ttatcaaacttaact

SEQ ID NO: 85615 - DNA, 15 bp, Homo sapiens
cttatcaaacttaac

SEQ ID NO: 85616 - DNA, 15 bp, Homo sapiens
ccttatcaaacttaa

SEQ ID NO: 85617 - DNA, 15 bp, Homo sapiens
accttatcaaactta

SEQ ID NO: 85618 - DNA, 15 bp, Homo sapiens
caccttatcaaactt

SEQ ID NO: 85619 - DNA, 15 bp, Homo sapiens
acaccttatcaaact

SEQ ID NO: 85620 - DNA, 15 bp, Homo sapiens
aacaccttatcaaac

SEQ ID NO: 85621 - DNA, 15 bp, Homo sapiens
taacaccttatcaaa

SEQ ID NO: 85622 - DNA, 15 bp, Homo sapiens
gtaacaccttatcaa

SEQ ID NO: 85623 - DNA, 15 bp, Homo sapiens
agtaacaccttatca

SEQ ID NO: 85624 - DNA, 15 bp, Homo sapiens
aagtaacaccttatc

SEQ ID NO: 85625 - DNA, 15 bp, Homo sapiens
taagtaacaccttat

SEQ ID NO: 85626 - DNA, 15 bp, Homo sapiens
ataagtaacacctta

SEQ ID NO: 85627 - DNA, 15 bp, Homo sapiens
tataagtaacacctt

SEQ ID NO: 85628 - DNA, 15 bp, Homo sapiens
atataagtaacacct

SEQ ID NO: 85629 - DNA, 15 bp, Homo sapiens
tatataagtaacacc

SEQ ID NO: 85630 - DNA, 15 bp, Homo sapiens
atatataagtaacac

SEQ ID NO: 85631 - DNA, 15 bp, Homo sapiens
catatataagtaaca

SEQ ID NO: 85632 - DNA, 15 bp, Homo sapiens
tcatatataagtaac

SEQ ID NO: 85633 - DNA, 15 bp, Homo sapiens
ttcatatataagtaa

SEQ ID NO: 85634 - DNA, 15 bp, Homo sapiens
tttcatatataagta

SEQ ID NO: 85635 - DNA, 15 bp, Homo sapiens
atttcatatataagt

SEQ ID NO: 85636 - DNA, 15 bp, Homo sapiens
aatttcatatataag

SEQ ID NO: 85637 - DNA, 15 bp, Homo sapiens
aaatttcatatataa

SEQ ID NO: 85638 - DNA, 15 bp, Homo sapiens
aaaatttcatatata

SEQ ID NO: 85639 - DNA, 15 bp, Homo sapiens
aaaaatttcatatat

SEQ ID NO: 85640 - DNA, 15 bp, Homo sapiens
taaaaatttcatata

SEQ ID NO: 85641 - DNA, 15 bp, Homo sapiens
ttaaaaatttcatat

SEQ ID NO: 85642 - DNA, 15 bp, Homo sapiens
tttaaaaatttcata

SEQ ID NO: 85643 - DNA, 15 bp, Homo sapiens
atttaaaaatttcat

SEQ ID NO: 85644 - DNA, 15 bp, Homo sapiens
catttaaaaatttca

SEQ ID NO: 85645 - DNA, 15 bp, Homo sapiens
gcatttaaaaatttc

SEQ ID NO: 85646 - DNA, 15 bp, Homo sapiens
agcatttaaaaattt

SEQ ID NO: 85647 - DNA, 15 bp, Homo sapiens
gagcatttaaaaatt

SEQ ID NO: 85648 - DNA, 15 bp, Homo sapiens
ggagcatttaaaaat

SEQ ID NO: 85649 - DNA, 15 bp, Homo sapiens
gggagcatttaaaaa

SEQ ID NO: 85650 - DNA, 15 bp, Homo sapiens
tgggagcatttaaaa

SEQ ID NO: 85651 - DNA, 15 bp, Homo sapiens
ttgggagcatttaaa

SEQ ID NO: 85652 - DNA, 15 bp, Homo sapiens
cttgggagcatttaa

SEQ ID NO: 85653 - DNA, 15 bp, Homo sapiens
tcttgggagcattta

SEQ ID NO: 85654 - DNA, 15 bp, Homo sapiens
gtcttgggagcattt

SEQ ID NO: 85655 - DNA, 15 bp, Homo sapiens
agtcttgggagcatt

SEQ ID NO: 85656 - DNA, 15 bp, Homo sapiens
aagtcttgggagcat

SEQ ID NO: 85657 - DNA, 15 bp, Homo sapiens
aaagtcttgggagca

SEQ ID NO: 85658 - DNA, 15 bp, Homo sapiens
aaaagtcttgggagc

SEQ ID NO: 85659 - DNA, 15 bp, Homo sapiens
aaaaagtcttgggag

SEQ ID NO: 85660 - DNA, 15 bp, Homo sapiens
aaaaaagtcttggga

SEQ ID NO: 85661 - DNA, 15 bp, Homo sapiens
aaaaaaagtcttggg

SEQ ID NO: 85662 - DNA, 15 bp, Homo sapiens
aaaaaaaagtcttgg

SEQ ID NO: 85663 - DNA, 15 bp, Homo sapiens
aaaaaaaaagtcttg

SEQ ID NO: 85664 - DNA, 15 bp, Homo sapiens
aaaaaaaaaagtctt

SEQ ID NO: 85665 - DNA, 15 bp, Homo sapiens
caaaaaaaaaagtct

SEQ ID NO: 85666 - DNA, 15 bp, Homo sapiens
gcaaaaaaaaaagtc

SEQ ID NO: 85667 - DNA, 15 bp, Homo sapiens
acagcaaaaaaaaaa

SEQ ID NO: 85668 - DNA, 15 bp, Homo sapiens
tacagcaaaaaaaaa

SEQ ID NO: 85669 - DNA, 15 bp, Homo sapiens
ctacagcaaaaaaaa

SEQ ID NO: 85670 - DNA, 15 bp, Homo sapiens
gctacagcaaaaaaa

SEQ ID NO: 85671 - DNA, 15 bp, Homo sapiens
agctacagcaaaaaa

SEQ ID NO: 85672 - DNA, 15 bp, Homo sapiens
gagctacagcaaaaa

SEQ ID NO: 85673 - DNA, 15 bp, Homo sapiens
ggagctacagcaaaa

SEQ ID NO: 85674 - DNA, 15 bp, Homo sapiens
gggagctacagcaaa

SEQ ID NO: 85675 - DNA, 15 bp, Homo sapiens
tgggagctacagcaa

SEQ ID NO: 85676 - DNA, 15 bp, Homo sapiens
ctgggagctacagca

SEQ ID NO: 85677 - DNA, 15 bp, Homo sapiens
actgggagctacagc

SEQ ID NO: 85678 - DNA, 15 bp, Homo sapiens
cactgggagctacag

SEQ ID NO: 85679 - DNA, 15 bp, Homo sapiens
tcactgggagctaca

SEQ ID NO: 85680 - DNA, 15 bp, Homo sapiens
gtcactgggagctac

SEQ ID NO: 85681 - DNA, 15 bp, Homo sapiens
agtcactgggagcta

SEQ ID NO: 85682 - DNA, 15 bp, Homo sapiens
gagtcactgggagct

SEQ ID NO: 85683 - DNA, 15 bp, Homo sapiens
tgagtcactgggagc

SEQ ID NO: 85684 - DNA, 15 bp, Homo sapiens
ctgagtcactgggag

SEQ ID NO: 85685 - DNA, 15 bp, Homo sapiens
tctgagtcactggga

SEQ ID NO: 85686 - DNA, 15 bp, Homo sapiens
ttctgagtcactggg

SEQ ID NO: 85687 - DNA, 15 bp, Homo sapiens
attctgagtcactgg

SEQ ID NO: 85688 - DNA, 15 bp, Homo sapiens
tattctgagtcactg

SEQ ID NO: 85689 - DNA, 15 bp, Homo sapiens
ttattctgagtcact

SEQ ID NO: 85690 - DNA, 15 bp, Homo sapiens
cttattctgagtcac

SEQ ID NO: 85691 - DNA, 15 bp, Homo sapiens
gcttattctgagtca

SEQ ID NO: 85692 - DNA, 15 bp, Homo sapiens
agcttattctgagtc

SEQ ID NO: 85693 - DNA, 15 bp, Homo sapiens
tagcttattctgagt

SEQ ID NO: 85694 - DNA, 15 bp, Homo sapiens
ttagcttattctgag

SEQ ID NO: 85695 - DNA, 15 bp, Homo sapiens
tttagcttattctga

SEQ ID NO: 85696 - DNA, 15 bp, Homo sapiens
ctttagcttattctg

SEQ ID NO: 85697 - DNA, 15 bp, Homo sapiens
tctttagcttattct

SEQ ID NO: 85698 - DNA, 15 bp, Homo sapiens
atctttagcttattc

SEQ ID NO: 85699 - DNA, 15 bp, Homo sapiens
aatctttagcttatt

SEQ ID NO: 85700 - DNA, 15 bp, Homo sapiens
taatctttagcttat

SEQ ID NO: 85701 - DNA, 15 bp, Homo sapiens
ttaatctttagctta

SEQ ID NO: 85702 - DNA, 15 bp, Homo sapiens
attaatctttagctt

SEQ ID NO: 85703 - DNA, 15 bp, Homo sapiens
tattaatctttagct

SEQ ID NO: 85704 - DNA, 15 bp, Homo sapiens
atattaatctttagc

SEQ ID NO: 85705 - DNA, 15 bp, Homo sapiens
aatattaatctttag

SEQ ID NO: 85706 - DNA, 15 bp, Homo sapiens
gaatattaatcttta

SEQ ID NO: 85707 - DNA, 15 bp, Homo sapiens
agaatattaatcttt

SEQ ID NO: 85708 - DNA, 15 bp, Homo sapiens
aagaatattaatctt

SEQ ID NO: 85709 - DNA, 15 bp, Homo sapiens
caagaatattaatct

SEQ ID NO: 85710 - DNA, 15 bp, Homo sapiens
tcaagaatattaatc

SEQ ID NO: 85711 - DNA, 15 bp, Homo sapiens
atcaagaatattaat

SEQ ID NO: 85712 - DNA, 15 bp, Homo sapiens
catcaagaatattaa

SEQ ID NO: 85713 - DNA, 15 bp, Homo sapiens
acatcaagaatatta

SEQ ID NO: 85714 - DNA, 15 bp, Homo sapiens
cacatcaagaatatt

SEQ ID NO: 85715 - DNA, 15 bp, Homo sapiens
gcacatcaagaatat

SEQ ID NO: 85716 - DNA, 15 bp, Homo sapiens
tgcacatcaagaata

SEQ ID NO: 85717 - DNA, 15 bp, Homo sapiens
ctgcacatcaagaat

SEQ ID NO: 85718 - DNA, 15 bp, Homo sapiens
actgcacatcaagaa

SEQ ID NO: 85719 - DNA, 15 bp, Homo sapiens
aactgcacatcaaga

SEQ ID NO: 85720 - DNA, 15 bp, Homo sapiens
aaactgcacatcaag

SEQ ID NO: 85721 - DNA, 15 bp, Homo sapiens
aaaactgcacatcaa

SEQ ID NO: 85722 - DNA, 15 bp, Homo sapiens
caaaactgcacatca

SEQ ID NO: 85723 - DNA, 15 bp, Homo sapiens
gcaaaactgcacatc

SEQ ID NO: 85724 - DNA, 15 bp, Homo sapiens
tgcaaaactgcacat

SEQ ID NO: 85725 - DNA, 15 bp, Homo sapiens
atgcaaaactgcaca

SEQ ID NO: 85726 - DNA, 15 bp, Homo sapiens
tatgcaaaactgcac

SEQ ID NO: 85727 - DNA, 15 bp, Homo sapiens
atatgcaaaactgca

SEQ ID NO: 85728 - DNA, 15 bp, Homo sapiens
catatgcaaaactgc

SEQ ID NO: 85729 - DNA, 15 bp, Homo sapiens
tcatatgcaaaactg

SEQ ID NO: 85730 - DNA, 15 bp, Homo sapiens
ttcatatgcaaaact

SEQ ID NO: 85731 - DNA, 15 bp, Homo sapiens
attcatatgcaaaac

SEQ ID NO: 85732 - DNA, 15 bp, Homo sapiens
gattcatatgcaaaa

SEQ ID NO: 85733 - DNA, 15 bp, Homo sapiens
agattcatatgcaaa

SEQ ID NO: 85734 - DNA, 15 bp, Homo sapiens
gagattcatatgcaa

SEQ ID NO: 85735 - DNA, 15 bp, Homo sapiens
agagattcatatgca

SEQ ID NO: 85736 - DNA, 15 bp, Homo sapiens
gagagattcatatgc

SEQ ID NO: 85737 - DNA, 15 bp, Homo sapiens
agagagattcatatg

SEQ ID NO: 85738 - DNA, 15 bp, Homo sapiens
aagagagattcatat

SEQ ID NO: 85739 - DNA, 15 bp, Homo sapiens
aaagagagattcata

SEQ ID NO: 85740 - DNA, 15 bp, Homo sapiens
caaagagagattcat

SEQ ID NO: 85741 - DNA, 15 bp, Homo sapiens
acaaagagagattca

SEQ ID NO: 85742 - DNA, 15 bp, Homo sapiens
aacaaagagagattc

SEQ ID NO: 85743 - DNA, 15 bp, Homo sapiens
gaacaaagagagatt

SEQ ID NO: 85744 - DNA, 15 bp, Homo sapiens
agaacaaagagagat

SEQ ID NO: 85745 - DNA, 15 bp, Homo sapiens
tagaacaaagagaga

SEQ ID NO: 85746 - DNA, 15 bp, Homo sapiens
ctagaacaaagagag

SEQ ID NO: 85747 - DNA, 15 bp, Homo sapiens
tctagaacaaagaga

SEQ ID NO: 85748 - DNA, 15 bp, Homo sapiens
ctctagaacaaagag

SEQ ID NO: 85749 - DNA, 15 bp, Homo sapiens
tctctagaacaaaga

SEQ ID NO: 85750 - DNA, 15 bp, Homo sapiens
ttctctagaacaaag

SEQ ID NO: 85751 - DNA, 15 bp, Homo sapiens
tttctctagaacaaa

SEQ ID NO: 85752 - DNA, 15 bp, Homo sapiens
atttctctagaacaa

SEQ ID NO: 85753 - DNA, 15 bp, Homo sapiens
catttctctagaaca

SEQ ID NO: 85754 - DNA, 15 bp, Homo sapiens
acatttctctagaac

SEQ ID NO: 85755 - DNA, 15 bp, Homo sapiens
aacatttctctagaa

SEQ ID NO: 85756 - DNA, 15 bp, Homo sapiens
caacatttctctaga

SEQ ID NO: 85757 - DNA, 15 bp, Homo sapiens
tcaacatttctctag

SEQ ID NO: 85758 - DNA, 15 bp, Homo sapiens
ttcaacatttctcta

SEQ ID NO: 85759 - DNA, 15 bp, Homo sapiens
tttcaacatttctct

SEQ ID NO: 85760 - DNA, 15 bp, Homo sapiens
ctttcaacatttctc

SEQ ID NO: 85761 - DNA, 15 bp, Homo sapiens
tctttcaacatttct

SEQ ID NO: 85762 - DNA, 15 bp, Homo sapiens
gtctttcaacatttc

SEQ ID NO: 85763 - DNA, 15 bp, Homo sapiens
tgtctttcaacattt

SEQ ID NO: 85764 - DNA, 15 bp, Homo sapiens
atgtctttcaacatt

SEQ ID NO: 85765 - DNA, 15 bp, Homo sapiens
aatgtctttcaacat

SEQ ID NO: 85766 - DNA, 15 bp, Homo sapiens
aaatgtctttcaaca

SEQ ID NO: 85767 - DNA, 15 bp, Homo sapiens
gaaatgtctttcaac

SEQ ID NO: 85768 - DNA, 15 bp, Homo sapiens
agaaatgtctttcaa

SEQ ID NO: 85769 - DNA, 15 bp, Homo sapiens
aagaaatgtctttca

SEQ ID NO: 85770 - DNA, 15 bp, Homo sapiens
caagaaatgtctttc

SEQ ID NO: 85771 - DNA, 15 bp, Homo sapiens
gcaagaaatgtcttt

SEQ ID NO: 85772 - DNA, 15 bp, Homo sapiens
tgcaagaaatgtctt

SEQ ID NO: 85773 - DNA, 15 bp, Homo sapiens
gtgcaagaaatgtct

SEQ ID NO: 85774 - DNA, 15 bp, Homo sapiens
agtgcaagaaatgtc

SEQ ID NO: 85775 - DNA, 15 bp, Homo sapiens
gagtgcaagaaatgt

SEQ ID NO: 85776 - DNA, 15 bp, Homo sapiens
ggagtgcaagaaatg

SEQ ID NO: 85777 - DNA, 15 bp, Homo sapiens
tggagtgcaagaaat

SEQ ID NO: 85778 - DNA, 15 bp, Homo sapiens
atggagtgcaagaaa

SEQ ID NO: 85779 - DNA, 15 bp, Homo sapiens
catggagtgcaagaa

SEQ ID NO: 85780 - DNA, 15 bp, Homo sapiens
acatggagtgcaaga

SEQ ID NO: 85781 - DNA, 15 bp, Homo sapiens
tacatggagtgcaag

SEQ ID NO: 85782 - DNA, 15 bp, Homo sapiens
gtacatggagtgcaa

SEQ ID NO: 85783 - DNA, 15 bp, Homo sapiens
cgtacatggagtgca

SEQ ID NO: 85784 - DNA, 15 bp, Homo sapiens
acgtacatggagtgc

SEQ ID NO: 85785 - DNA, 15 bp, Homo sapiens
aacgtacatggagtg

SEQ ID NO: 85786 - DNA, 15 bp, Homo sapiens
caacgtacatggagt

SEQ ID NO: 85787 - DNA, 15 bp, Homo sapiens
ccaacgtacatggag

SEQ ID NO: 85788 - DNA, 15 bp, Homo sapiens
accaacgtacatgga

SEQ ID NO: 85789 - DNA, 15 bp, Homo sapiens
gaccaacgtacatgg

SEQ ID NO: 85790 - DNA, 15 bp, Homo sapiens
agaccaacgtacatg

SEQ ID NO: 85791 - DNA, 15 bp, Homo sapiens
tagaccaacgtacat

SEQ ID NO: 85792 - DNA, 15 bp, Homo sapiens
ttagaccaacgtaca

SEQ ID NO: 85793 - DNA, 15 bp, Homo sapiens
attagaccaacgtac

SEQ ID NO: 85794 - DNA, 15 bp, Homo sapiens
tattagaccaacgta

SEQ ID NO: 85795 - DNA, 15 bp, Homo sapiens
ttattagaccaacgt

SEQ ID NO: 85796 - DNA, 15 bp, Homo sapiens
attattagaccaacg

SEQ ID NO: 85797 - DNA, 15 bp, Homo sapiens
cattattagaccaac

SEQ ID NO: 85798 - DNA, 15 bp, Homo sapiens
ccattattagaccaa

SEQ ID NO: 85799 - DNA, 15 bp, Homo sapiens
accattattagacca

SEQ ID NO: 85800 - DNA, 15 bp, Homo sapiens
taccattattagacc

SEQ ID NO: 85801 - DNA, 15 bp, Homo sapiens
ttaccattattagac

SEQ ID NO: 85802 - DNA, 15 bp, Homo sapiens
cttaccattattaga

SEQ ID NO: 85803 - DNA, 15 bp, Homo sapiens
gcttaccattattag

SEQ ID NO: 85804 - DNA, 15 bp, Homo sapiens
tgcttaccattatta

SEQ ID NO: 85805 - DNA, 15 bp, Homo sapiens
gtgcttaccattatt

SEQ ID NO: 85806 - DNA, 15 bp, Homo sapiens
agtgcttaccattat

SEQ ID NO: 85807 - DNA, 15 bp, Homo sapiens
aagtgcttaccatta

SEQ ID NO: 85808 - DNA, 15 bp, Homo sapiens
aaagtgcttaccatt

SEQ ID NO: 85809 - DNA, 15 bp, Homo sapiens
caaagtgcttaccat

SEQ ID NO: 85810 - DNA, 15 bp, Homo sapiens
ccaaagtgcttacca

SEQ ID NO: 85811 - DNA, 15 bp, Homo sapiens
tccaaagtgcttacc

SEQ ID NO: 85812 - DNA, 15 bp, Homo sapiens
ttccaaagtgcttac

SEQ ID NO: 85813 - DNA, 15 bp, Homo sapiens
cttccaaagtgctta

SEQ ID NO: 85814 - DNA, 15 bp, Homo sapiens
ccttccaaagtgctt

SEQ ID NO: 85815 - DNA, 15 bp, Homo sapiens
gccttccaaagtgct

SEQ ID NO: 85816 - DNA, 15 bp, Homo sapiens
agccttccaaagtgc

SEQ ID NO: 85817 - DNA, 15 bp, Homo sapiens
cagccttccaaagtg

SEQ ID NO: 85818 - DNA, 15 bp, Homo sapiens
gcagccttccaaagt

SEQ ID NO: 85819 - DNA, 15 bp, Homo sapiens
agcagccttccaaag

SEQ ID NO: 85820 - DNA, 15 bp, Homo sapiens
cagcagccttccaaa

SEQ ID NO: 85821 - DNA, 15 bp, Homo sapiens
acagcagccttccaa

SEQ ID NO: 85822 - DNA, 15 bp, Homo sapiens
tacagcagccttcca

SEQ ID NO: 85823 - DNA, 15 bp, Homo sapiens
ctacagcagccttcc

SEQ ID NO: 85824 - DNA, 15 bp, Homo sapiens
gctacagcagccttc

SEQ ID NO: 85825 - DNA, 15 bp, Homo sapiens
agctacagcagcctt

SEQ ID NO: 85826 - DNA, 15 bp, Homo sapiens
gagctacagcagcct

SEQ ID NO: 85827 - DNA, 15 bp, Homo sapiens
agagctacagcagcc

SEQ ID NO: 85828 - DNA, 15 bp, Homo sapiens
gagagctacagcagc

SEQ ID NO: 85829 - DNA, 15 bp, Homo sapiens
ggagagctacagcag

SEQ ID NO: 85830 - DNA, 15 bp, Homo sapiens
aggagagctacagca

SEQ ID NO: 85831 - DNA, 15 bp, Homo sapiens
aaggagagctacagc

SEQ ID NO: 85832 - DNA, 15 bp, Homo sapiens
caaggagagctacag

SEQ ID NO: 85833 - DNA, 15 bp, Homo sapiens
tcaaggagagctaca

SEQ ID NO: 85834 - DNA, 15 bp, Homo sapiens
gtcaaggagagctac

SEQ ID NO: 85835 - DNA, 15 bp, Homo sapiens
tgtcaaggagagcta

SEQ ID NO: 85836 - DNA, 15 bp, Homo sapiens
gtgtcaaggagagct

SEQ ID NO: 85837 - DNA, 15 bp, Homo sapiens
ggtgtcaaggagagc

SEQ ID NO: 85838 - DNA, 15 bp, Homo sapiens
aggtgtcaaggagag

SEQ ID NO: 85839 - DNA, 15 bp, Homo sapiens
caggtgtcaaggaga

SEQ ID NO: 85840 - DNA, 15 bp, Homo sapiens
acaggtgtcaaggag

SEQ ID NO: 85841 - DNA, 15 bp, Homo sapiens
tacaggtgtcaagga

SEQ ID NO: 85842 - DNA, 15 bp, Homo sapiens
gtacaggtgtcaagg

SEQ ID NO: 85843 - DNA, 15 bp, Homo sapiens
tgtacaggtgtcaag

SEQ ID NO: 85844 - DNA, 15 bp, Homo sapiens
ctgtacaggtgtcaa

SEQ ID NO: 85845 - DNA, 15 bp, Homo sapiens
tctgtacaggtgtca

SEQ ID NO: 85846 - DNA, 15 bp, Homo sapiens
atctgtacaggtgtc

SEQ ID NO: 85847 - DNA, 15 bp, Homo sapiens
tatctgtacaggtgt

SEQ ID NO: 85848 - DNA, 15 bp, Homo sapiens
gtatctgtacaggtg

SEQ ID NO: 85849 - DNA, 15 bp, Homo sapiens
ggtatctgtacaggt

SEQ ID NO: 85850 - DNA, 15 bp, Homo sapiens
aggtatctgtacagg

SEQ ID NO: 85851 - DNA, 15 bp, Homo sapiens
taggtatctgtacag

SEQ ID NO: 85852 - DNA, 15 bp, Homo sapiens
ataggtatctgtaca

SEQ ID NO: 85853 - DNA, 15 bp, Homo sapiens
tataggtatctgtac

SEQ ID NO: 85854 - DNA, 15 bp, Homo sapiens
gtataggtatctgta

SEQ ID NO: 85855 - DNA, 15 bp, Homo sapiens
tgtataggtatctgt

SEQ ID NO: 85856 - DNA, 15 bp, Homo sapiens
ctgtataggtatctg

SEQ ID NO: 85857 - DNA, 15 bp, Homo sapiens
tctgtataggtatct

SEQ ID NO: 85858 - DNA, 15 bp, Homo sapiens
ttctgtataggtatc

SEQ ID NO: 85859 - DNA, 15 bp, Homo sapiens
attctgtataggtat

SEQ ID NO: 85860 - DNA, 15 bp, Homo sapiens
aattctgtataggta

SEQ ID NO: 85861 - DNA, 15 bp, Homo sapiens
taattctgtataggt

SEQ ID NO: 85862 - DNA, 15 bp, Homo sapiens
ctaattctgtatagg

SEQ ID NO: 85863 - DNA, 15 bp, Homo sapiens
cctaattctgtatag

SEQ ID NO: 85864 - DNA, 15 bp, Homo sapiens
tcctaattctgtata

SEQ ID NO: 85865 - DNA, 15 bp, Homo sapiens
ttcctaattctgtat

SEQ ID NO: 85866 - DNA, 15 bp, Homo sapiens
attcctaattctgta

SEQ ID NO: 85867 - DNA, 15 bp, Homo sapiens
tattcctaattctgt

SEQ ID NO: 85868 - DNA, 15 bp, Homo sapiens
atattcctaattctg

SEQ ID NO: 85869 - DNA, 15 bp, Homo sapiens
aatattcctaattct

SEQ ID NO: 85870 - DNA, 15 bp, Homo sapiens
taatattcctaattc

SEQ ID NO: 85871 - DNA, 15 bp, Homo sapiens
ctaatattcctaatt

SEQ ID NO: 85872 - DNA, 15 bp, Homo sapiens
actaatattcctaat

SEQ ID NO: 85873 - DNA, 15 bp, Homo sapiens
aactaatattcctaa

SEQ ID NO: 85874 - DNA, 15 bp, Homo sapiens
aaactaatattccta

SEQ ID NO: 85875 - DNA, 15 bp, Homo sapiens
caaactaatattcct

SEQ ID NO: 85876 - DNA, 15 bp, Homo sapiens
tcaaactaatattcc

SEQ ID NO: 85877 - DNA, 15 bp, Homo sapiens
gtcaaactaatattc

SEQ ID NO: 85878 - DNA, 15 bp, Homo sapiens
tgtcaaactaatatt

SEQ ID NO: 85879 - DNA, 15 bp, Homo sapiens
ttgtcaaactaatat

SEQ ID NO: 85880 - DNA, 15 bp, Homo sapiens
cttgtcaaactaata

SEQ ID NO: 85881 - DNA, 15 bp, Homo sapiens
tcttgtcaaactaat

SEQ ID NO: 85882 - DNA, 15 bp, Homo sapiens
ttcttgtcaaactaa

SEQ ID NO: 85883 - DNA, 15 bp, Homo sapiens
attcttgtcaaacta

SEQ ID NO: 85884 - DNA, 15 bp, Homo sapiens
gattcttgtcaaact

SEQ ID NO: 85885 - DNA, 15 bp, Homo sapiens
agattcttgtcaaac

SEQ ID NO: 85886 - DNA, 15 bp, Homo sapiens
aagattcttgtcaaa

SEQ ID NO: 85887 - DNA, 15 bp, Homo sapiens
taagattcttgtcaa

SEQ ID NO: 85888 - DNA, 15 bp, Homo sapiens
ttaagattcttgtca

SEQ ID NO: 85889 - DNA, 15 bp, Homo sapiens
tttaagattcttgtc

SEQ ID NO: 85890 - DNA, 15 bp, Homo sapiens
ttttaagattcttgt

SEQ ID NO: 85891 - DNA, 15 bp, Homo sapiens
cttttaagattcttg

SEQ ID NO: 85892 - DNA, 15 bp, Homo sapiens
gcttttaagattctt

SEQ ID NO: 85893 - DNA, 15 bp, Homo sapiens
ctgcttttaagattc

SEQ ID NO: 85894 - DNA, 15 bp, Homo sapiens
actgcttttaagatt

SEQ ID NO: 85895 - DNA, 15 bp, Homo sapiens
tactgcttttaagat

SEQ ID NO: 85896 - DNA, 15 bp, Homo sapiens
ctactgcttttaaga

SEQ ID NO: 85897 - DNA, 15 bp, Homo sapiens
gctactgcttttaag

SEQ ID NO: 85898 - DNA, 15 bp, Homo sapiens
tgctactgcttttaa

SEQ ID NO: 85899 - DNA, 15 bp, Homo sapiens
atgctactgctttta

SEQ ID NO: 85900 - DNA, 15 bp, Homo sapiens
aatgctactgctttt

SEQ ID NO: 85901 - DNA, 15 bp, Homo sapiens
aaatgctactgcttt

SEQ ID NO: 85902 - DNA, 15 bp, Homo sapiens
taaatgctactgctt

SEQ ID NO: 85903 - DNA, 15 bp, Homo sapiens
ttaaatgctactgct

SEQ ID NO: 85904 - DNA, 15 bp, Homo sapiens
attaaatgctactgc

SEQ ID NO: 85905 - DNA, 15 bp, Homo sapiens
aattaaatgctactg

SEQ ID NO: 85906 - DNA, 15 bp, Homo sapiens
aaattaaatgctact

SEQ ID NO: 85907 - DNA, 15 bp, Homo sapiens
aaaattaaatgctac

SEQ ID NO: 85908 - DNA, 15 bp, Homo sapiens
aaaaattaaatgcta

SEQ ID NO: 85909 - DNA, 15 bp, Homo sapiens
aaaaaattaaatgct

SEQ ID NO: 85910 - DNA, 15 bp, Homo sapiens
taaaaaattaaatgc

SEQ ID NO: 85911 - DNA, 15 bp, Homo sapiens
ataaaaaattaaatg

SEQ ID NO: 85912 - DNA, 15 bp, Homo sapiens
aataaaaaattaaat

SEQ ID NO: 85913 - DNA, 15 bp, Homo sapiens
caataaaaaattaaa

SEQ ID NO: 85914 - DNA, 15 bp, Homo sapiens
acaataaaaaattaa

SEQ ID NO: 85915 - DNA, 15 bp, Homo sapiens
aacaataaaaaatta

SEQ ID NO: 85916 - DNA, 15 bp, Homo sapiens
aaacaataaaaaatt

SEQ ID NO: 85917 - DNA, 15 bp, Homo sapiens
caaacaataaaaaat

SEQ ID NO: 85918 - DNA, 15 bp, Homo sapiens
tcaaacaataaaaaa

SEQ ID NO: 85919 - DNA, 15 bp, Homo sapiens
gtcaaacaataaaaa

SEQ ID NO: 85920 - DNA, 15 bp, Homo sapiens
agtcaaacaataaaa

SEQ ID NO: 85921 - DNA, 15 bp, Homo sapiens
aagtcaaacaataaa

SEQ ID NO: 85922 - DNA, 15 bp, Homo sapiens
aaagtcaaacaataa

SEQ ID NO: 85923 - DNA, 15 bp, Homo sapiens
aaaagtcaaacaata

SEQ ID NO: 85924 - DNA, 15 bp, Homo sapiens
aaaaagtcaaacaat

SEQ ID NO: 85925 - DNA, 15 bp, Homo sapiens
caaaaagtcaaacaa

SEQ ID NO: 85926 - DNA, 15 bp, Homo sapiens
acaaaaagtcaaaca

SEQ ID NO: 85927 - DNA, 15 bp, Homo sapiens
aacaaaaagtcaaac

SEQ ID NO: 85928 - DNA, 15 bp, Homo sapiens
taacaaaaagtcaaa

SEQ ID NO: 85929 - DNA, 15 bp, Homo sapiens
ataacaaaaagtcaa

SEQ ID NO: 85930 - DNA, 15 bp, Homo sapiens
cataacaaaaagtca

SEQ ID NO: 85931 - DNA, 15 bp, Homo sapiens
ccataacaaaaagtc

SEQ ID NO: 85932 - DNA, 15 bp, Homo sapiens
tccataacaaaaagt

SEQ ID NO: 85933 - DNA, 15 bp, Homo sapiens
ttccataacaaaaag

SEQ ID NO: 85934 - DNA, 15 bp, Homo sapiens
tttccataacaaaaa

SEQ ID NO: 85935 - DNA, 15 bp, Homo sapiens
ttttccataacaaaa

SEQ ID NO: 85936 - DNA, 15 bp, Homo sapiens
attttccataacaaa

SEQ ID NO: 85937 - DNA, 15 bp, Homo sapiens
tattttccataacaa

SEQ ID NO: 85938 - DNA, 15 bp, Homo sapiens
atattttccataaca

SEQ ID NO: 85939 - DNA, 15 bp, Homo sapiens
tatattttccataac

SEQ ID NO: 85940 - DNA, 15 bp, Homo sapiens
ttatattttccataa

SEQ ID NO: 85941 - DNA, 15 bp, Homo sapiens
gttatattttccata

SEQ ID NO: 85942 - DNA, 15 bp, Homo sapiens
agttatattttccat

SEQ ID NO: 85943 - DNA, 15 bp, Homo sapiens
cagttatattttcca

SEQ ID NO: 85944 - DNA, 15 bp, Homo sapiens
acagttatattttcc

SEQ ID NO: 85945 - DNA, 15 bp, Homo sapiens
tacagttatattttc

SEQ ID NO: 85946 - DNA, 15 bp, Homo sapiens
atacagttatatttt

SEQ ID NO: 85947 - DNA, 15 bp, Homo sapiens
tatacagttatattt

SEQ ID NO: 85948 - DNA, 15 bp, Homo sapiens
ttatacagttatatt

SEQ ID NO: 85949 - DNA, 15 bp, Homo sapiens
tttatacagttatat

SEQ ID NO: 85950 - DNA, 15 bp, Homo sapiens
ttttatacagttata

SEQ ID NO: 85951 - DNA, 15 bp, Homo sapiens
cttttatacagttat

SEQ ID NO: 85952 - DNA, 15 bp, Homo sapiens
gcttttatacagtta

SEQ ID NO: 85953 - DNA, 15 bp, Homo sapiens
tgcttttatacagtt

SEQ ID NO: 85954 - DNA, 15 bp, Homo sapiens
ttgcttttatacagt

SEQ ID NO: 85955 - DNA, 15 bp, Homo sapiens
tttgcttttatacag

SEQ ID NO: 85956 - DNA, 15 bp, Homo sapiens
atttgcttttataca

SEQ ID NO: 85957 - DNA, 15 bp, Homo sapiens
tatttgcttttatac

SEQ ID NO: 85958 - DNA, 15 bp, Homo sapiens
ctatttgcttttata

SEQ ID NO: 85959 - DNA, 15 bp, Homo sapiens
tctatttgcttttat

SEQ ID NO: 85960 - DNA, 15 bp, Homo sapiens
ttctatttgctttta

SEQ ID NO: 85961 - DNA, 15 bp, Homo sapiens
attctatttgctttt

SEQ ID NO: 85962 - DNA, 15 bp, Homo sapiens
tattctatttgcttt

SEQ ID NO: 85963 - DNA, 15 bp, Homo sapiens
gtattctatttgctt

SEQ ID NO: 85964 - DNA, 15 bp, Homo sapiens
agtattctatttgct

SEQ ID NO: 85965 - DNA, 15 bp, Homo sapiens
tagtattctatttgc

SEQ ID NO: 85966 - DNA, 15 bp, Homo sapiens
atagtattctatttg

SEQ ID NO: 85967 - DNA, 15 bp, Homo sapiens
tatagtattctattt

SEQ ID NO: 85968 - DNA, 15 bp, Homo sapiens
ttatagtattctatt

SEQ ID NO: 85969 - DNA, 15 bp, Homo sapiens
attatagtattctat

SEQ ID NO: 85970 - DNA, 15 bp, Homo sapiens
cattatagtattcta

SEQ ID NO: 85971 - DNA, 15 bp, Homo sapiens
tcattatagtattct

SEQ ID NO: 85972 - DNA, 15 bp, Homo sapiens
ttcattatagtattc

SEQ ID NO: 85973 - DNA, 15 bp, Homo sapiens
gttcattatagtatt

SEQ ID NO: 85974 - DNA, 15 bp, Homo sapiens
agttcattatagtat

SEQ ID NO: 85975 - DNA, 15 bp, Homo sapiens
aagttcattatagta

SEQ ID NO: 85976 - DNA, 15 bp, Homo sapiens
gaagttcattatagt

SEQ ID NO: 85977 - DNA, 15 bp, Homo sapiens
ggaagttcattatag

SEQ ID NO: 85978 - DNA, 15 bp, Homo sapiens
aggaagttcattata

SEQ ID NO: 85979 - DNA, 15 bp, Homo sapiens
aaggaagttcattat

SEQ ID NO: 85980 - DNA, 15 bp, Homo sapiens
caaggaagttcatta

SEQ ID NO: 85981 - DNA, 15 bp, Homo sapiens
acaaggaagttcatt

SEQ ID NO: 85982 - DNA, 15 bp, Homo sapiens
tacaaggaagttcat

SEQ ID NO: 85983 - DNA, 15 bp, Homo sapiens
atacaaggaagttca

SEQ ID NO: 85984 - DNA, 15 bp, Homo sapiens
gatacaaggaagttc

SEQ ID NO: 85985 - DNA, 15 bp, Homo sapiens
tgatacaaggaagtt

SEQ ID NO: 85986 - DNA, 15 bp, Homo sapiens
ctgatacaaggaagt

SEQ ID NO: 85987 - DNA, 15 bp, Homo sapiens
actgatacaaggaag

SEQ ID NO: 85988 - DNA, 15 bp, Homo sapiens
aactgatacaaggaa

SEQ ID NO: 85989 - DNA, 15 bp, Homo sapiens
taactgatacaagga

SEQ ID NO: 85990 - DNA, 15 bp, Homo sapiens
gtaactgatacaagg

SEQ ID NO: 85991 - DNA, 15 bp, Homo sapiens
ggtaactgatacaag

SEQ ID NO: 85992 - DNA, 15 bp, Homo sapiens
aggtaactgatacaa

SEQ ID NO: 85993 - DNA, 15 bp, Homo sapiens
taggtaactgataca

SEQ ID NO: 85994 - DNA, 15 bp, Homo sapiens
ctaggtaactgatac

SEQ ID NO: 85995 - DNA, 15 bp, Homo sapiens
actaggtaactgata

SEQ ID NO: 85996 - DNA, 15 bp, Homo sapiens
aactaggtaactgat

SEQ ID NO: 85997 - DNA, 15 bp, Homo sapiens
aaactaggtaactga

SEQ ID NO: 85998 - DNA, 15 bp, Homo sapiens
taaactaggtaactg

SEQ ID NO: 85999 - DNA, 15 bp, Homo sapiens
ctaaactaggtaact

SEQ ID NO: 86000 - DNA, 15 bp, Homo sapiens
actaaactaggtaac

SEQ ID NO: 86001 - DNA, 15 bp, Homo sapiens
tactaaactaggtaa

SEQ ID NO: 86002 - DNA, 15 bp, Homo sapiens
ttactaaactaggta

SEQ ID NO: 86003 - DNA, 15 bp, Homo sapiens
attactaaactaggt

SEQ ID NO: 86004 - DNA, 15 bp, Homo sapiens
aattactaaactagg

SEQ ID NO: 86005 - DNA, 15 bp, Homo sapiens
caattactaaactag

SEQ ID NO: 86006 - DNA, 15 bp, Homo sapiens
tcaattactaaacta

SEQ ID NO: 86007 - DNA, 15 bp, Homo sapiens
gtcaattactaaact

SEQ ID NO: 86008 - DNA, 15 bp, Homo sapiens
tgtcaattactaaac

SEQ ID NO: 86009 - DNA, 15 bp, Homo sapiens
ttgtcaattactaaa

SEQ ID NO: 86010 - DNA, 15 bp, Homo sapiens
attgtcaattactaa

SEQ ID NO: 86011 - DNA, 15 bp, Homo sapiens
tattgtcaattacta

SEQ ID NO: 86012 - DNA, 15 bp, Homo sapiens
atattgtcaattact

SEQ ID NO: 86013 - DNA, 15 bp, Homo sapiens
aatattgtcaattac

SEQ ID NO: 86014 - DNA, 15 bp, Homo sapiens
gaatattgtcaatta

SEQ ID NO: 86015 - DNA, 15 bp, Homo sapiens
agaatattgtcaatt

SEQ ID NO: 86016 - DNA, 15 bp, Homo sapiens
cagaatattgtcaat

SEQ ID NO: 86017 - DNA, 15 bp, Homo sapiens
gcagaatattgtcaa

SEQ ID NO: 86018 - DNA, 15 bp, Homo sapiens
ggcagaatattgtca

SEQ ID NO: 86019 - DNA, 15 bp, Homo sapiens
tggcagaatattgtc

SEQ ID NO: 86020 - DNA, 15 bp, Homo sapiens
atggcagaatattgt

SEQ ID NO: 86021 - DNA, 15 bp, Homo sapiens
aatggcagaatattg

SEQ ID NO: 86022 - DNA, 15 bp, Homo sapiens
gaatggcagaatatt

SEQ ID NO: 86023 - DNA, 15 bp, Homo sapiens
agaatggcagaatat

SEQ ID NO: 86024 - DNA, 15 bp, Homo sapiens
aagaatggcagaata

SEQ ID NO: 86025 - DNA, 15 bp, Homo sapiens
caagaatggcagaat

SEQ ID NO: 86026 - DNA, 15 bp, Homo sapiens
tcaagaatggcagaa

SEQ ID NO: 86027 - DNA, 15 bp, Homo sapiens
ttcaagaatggcaga

SEQ ID NO: 86028 - DNA, 15 bp, Homo sapiens
attcaagaatggcag

SEQ ID NO: 86029 - DNA, 15 bp, Homo sapiens
aattcaagaatggca

SEQ ID NO: 86030 - DNA, 15 bp, Homo sapiens
taattcaagaatggc

SEQ ID NO: 86031 - DNA, 15 bp, Homo sapiens
ataattcaagaatgg

SEQ ID NO: 86032 - DNA, 15 bp, Homo sapiens
gataattcaagaatg

SEQ ID NO: 86033 - DNA, 15 bp, Homo sapiens
agataattcaagaat

SEQ ID NO: 86034 - DNA, 15 bp, Homo sapiens
tagataattcaagaa

SEQ ID NO: 86035 - DNA, 15 bp, Homo sapiens
atagataattcaaga

SEQ ID NO: 86036 - DNA, 15 bp, Homo sapiens
tatagataattcaag

SEQ ID NO: 86037 - DNA, 15 bp, Homo sapiens
gtatagataattcaa

SEQ ID NO: 86038 - DNA, 15 bp, Homo sapiens
ggtatagataattca

SEQ ID NO: 86039 - DNA, 15 bp, Homo sapiens
aggtatagataattc

SEQ ID NO: 86040 - DNA, 15 bp, Homo sapiens
aaggtatagataatt

SEQ ID NO: 86041 - DNA, 15 bp, Homo sapiens
aaaggtatagataat

SEQ ID NO: 86042 - DNA, 15 bp, Homo sapiens
taaaggtatagataa

SEQ ID NO: 86043 - DNA, 15 bp, Homo sapiens
gtaaaggtatagata

SEQ ID NO: 86044 - DNA, 15 bp, Homo sapiens
agtaaaggtatagat

SEQ ID NO: 86045 - DNA, 15 bp, Homo sapiens
gagtaaaggtataga

SEQ ID NO: 86046 - DNA, 15 bp, Homo sapiens
cgagtaaaggtatag

SEQ ID NO: 86047 - DNA, 15 bp, Homo sapiens
acgagtaaaggtata

SEQ ID NO: 86048 - DNA, 15 bp, Homo sapiens
aacgagtaaaggtat

SEQ ID NO: 86049 - DNA, 15 bp, Homo sapiens
gaacgagtaaaggta

SEQ ID NO: 86050 - DNA, 15 bp, Homo sapiens
ggaacgagtaaaggt

SEQ ID NO: 86051 - DNA, 15 bp, Homo sapiens
aggaacgagtaaagg

SEQ ID NO: 86052 - DNA, 15 bp, Homo sapiens
gaggaacgagtaaag

SEQ ID NO: 86053 - DNA, 15 bp, Homo sapiens
tgaggaacgagtaaa

SEQ ID NO: 86054 - DNA, 15 bp, Homo sapiens
ctgaggaacgagtaa

SEQ ID NO: 86055 - DNA, 15 bp, Homo sapiens
gctgaggaacgagta

SEQ ID NO: 86056 - DNA, 15 bp, Homo sapiens
ggctgaggaacgagt

SEQ ID NO: 86057 - DNA, 15 bp, Homo sapiens
aggctgaggaacgag

SEQ ID NO: 86058 - DNA, 15 bp, Homo sapiens
gaggctgaggaacga

SEQ ID NO: 86059 - DNA, 15 bp, Homo sapiens
agaggctgaggaacg

SEQ ID NO: 86060 - DNA, 15 bp, Homo sapiens
gagaggctgaggaac

SEQ ID NO: 86061 - DNA, 15 bp, Homo sapiens
tgagaggctgaggaa

SEQ ID NO: 86062 - DNA, 15 bp, Homo sapiens
ttgagaggctgagga

SEQ ID NO: 86063 - DNA, 15 bp, Homo sapiens
attgagaggctgagg

SEQ ID NO: 86064 - DNA, 15 bp, Homo sapiens
aattgagaggctgag

SEQ ID NO: 86065 - DNA, 15 bp, Homo sapiens
taattgagaggctga

SEQ ID NO: 86066 - DNA, 15 bp, Homo sapiens
ataattgagaggctg

SEQ ID NO: 86067 - DNA, 15 bp, Homo sapiens
aataattgagaggct

SEQ ID NO: 86068 - DNA, 15 bp, Homo sapiens
taataattgagaggc

SEQ ID NO: 86069 - DNA, 15 bp, Homo sapiens
gtaataattgagagg

SEQ ID NO: 86070 - DNA, 15 bp, Homo sapiens
agtaataattgagag

SEQ ID NO: 86071 - DNA, 15 bp, Homo sapiens
tagtaataattgaga

SEQ ID NO: 86072 - DNA, 15 bp, Homo sapiens
atagtaataattgag

SEQ ID NO: 86073 - DNA, 15 bp, Homo sapiens
aatagtaataattga

SEQ ID NO: 86074 - DNA, 15 bp, Homo sapiens
aaatagtaataattg

SEQ ID NO: 86075 - DNA, 15 bp, Homo sapiens
aaaatagtaataatt

SEQ ID NO: 86076 - DNA, 15 bp, Homo sapiens
aaaaatagtaataat

SEQ ID NO: 86077 - DNA, 15 bp, Homo sapiens
taaaaatagtaataa

SEQ ID NO: 86078 - DNA, 15 bp, Homo sapiens
gtaaaaatagtaata

SEQ ID NO: 86079 - DNA, 15 bp, Homo sapiens
tgtaaaaatagtaat

SEQ ID NO: 86080 - DNA, 15 bp, Homo sapiens
ctgtaaaaatagtaa

SEQ ID NO: 86081 - DNA, 15 bp, Homo sapiens
actgtaaaaatagta

SEQ ID NO: 86082 - DNA, 15 bp, Homo sapiens
aactgtaaaaatagt

SEQ ID NO: 86083 - DNA, 15 bp, Homo sapiens
aaactgtaaaaatag

SEQ ID NO: 86084 - DNA, 15 bp, Homo sapiens
aaaactgtaaaaata

SEQ ID NO: 86085 - DNA, 15 bp, Homo sapiens
gaaaactgtaaaaat

SEQ ID NO: 86086 - DNA, 15 bp, Homo sapiens
agaaaactgtaaaaa

SEQ ID NO: 86087 - DNA, 15 bp, Homo sapiens
aagaaaactgtaaaa

SEQ ID NO: 86088 - DNA, 15 bp, Homo sapiens
caagaaaactgtaaa

SEQ ID NO: 86089 - DNA, 15 bp, Homo sapiens
ccaagaaaactgtaa

SEQ ID NO: 86090 - DNA, 15 bp, Homo sapiens
tccaagaaaactgta

SEQ ID NO: 86091 - DNA, 15 bp, Homo sapiens
ttccaagaaaactgt

SEQ ID NO: 86092 - DNA, 15 bp, Homo sapiens
cttccaagaaaactg

SEQ ID NO: 86093 - DNA, 15 bp, Homo sapiens
acttccaagaaaact

SEQ ID NO: 86094 - DNA, 15 bp, Homo sapiens
tacttccaagaaaac

SEQ ID NO: 86095 - DNA, 15 bp, Homo sapiens
ttacttccaagaaaa

SEQ ID NO: 86096 - DNA, 15 bp, Homo sapiens
tttacttccaagaaa

SEQ ID NO: 86097 - DNA, 15 bp, Homo sapiens
ttttacttccaagaa

SEQ ID NO: 86098 - DNA, 15 bp, Homo sapiens
attttacttccaaga

SEQ ID NO: 86099 - DNA, 15 bp, Homo sapiens
aattttacttccaag

SEQ ID NO: 86100 - DNA, 15 bp, Homo sapiens
aaattttacttccaa

SEQ ID NO: 86101 - DNA, 15 bp, Homo sapiens
taaattttacttcca

SEQ ID NO: 86102 - DNA, 15 bp, Homo sapiens
gtaaattttacttcc

SEQ ID NO: 86103 - DNA, 15 bp, Homo sapiens
agtaaattttacttc

SEQ ID NO: 86104 - DNA, 15 bp, Homo sapiens
aagtaaattttactt

SEQ ID NO: 86105 - DNA, 15 bp, Homo sapiens
taagtaaattttact

SEQ ID NO: 86106 - DNA, 15 bp, Homo sapiens
gtaagtaaattttac

SEQ ID NO: 86107 - DNA, 15 bp, Homo sapiens
tgtaagtaaatttta

SEQ ID NO: 86108 - DNA, 15 bp, Homo sapiens
atgtaagtaaatttt

SEQ ID NO: 86109 - DNA, 15 bp, Homo sapiens
aatgtaagtaaattt

SEQ ID NO: 86110 - DNA, 15 bp, Homo sapiens
caatgtaagtaaatt

SEQ ID NO: 86111 - DNA, 15 bp, Homo sapiens
tcaatgtaagtaaat

SEQ ID NO: 86112 - DNA, 15 bp, Homo sapiens
ttcaatgtaagtaaa

SEQ ID NO: 86113 - DNA, 15 bp, Homo sapiens
tttcaatgtaagtaa

SEQ ID NO: 86114 - DNA, 15 bp, Homo sapiens
atttcaatgtaagta

SEQ ID NO: 86115 - DNA, 15 bp, Homo sapiens
tatttcaatgtaagt

SEQ ID NO: 86116 - DNA, 15 bp, Homo sapiens
gtatttcaatgtaag

SEQ ID NO: 86117 - DNA, 15 bp, Homo sapiens
tgtatttcaatgtaa

SEQ ID NO: 86118 - DNA, 15 bp, Homo sapiens
atgtatttcaatgta

SEQ ID NO: 86119 - DNA, 15 bp, Homo sapiens
catgtatttcaatgt

SEQ ID NO: 86120 - DNA, 15 bp, Homo sapiens
tcatgtatttcaatg

SEQ ID NO: 86121 - DNA, 15 bp, Homo sapiens
gtcatgtatttcaat

SEQ ID NO: 86122 - DNA, 15 bp, Homo sapiens
agtcatgtatttcaa

SEQ ID NO: 86123 - DNA, 15 bp, Homo sapiens
aagtcatgtatttca

SEQ ID NO: 86124 - DNA, 15 bp, Homo sapiens
taagtcatgtatttc

SEQ ID NO: 86125 - DNA, 15 bp, Homo sapiens
ctaagtcatgtattt

SEQ ID NO: 86126 - DNA, 15 bp, Homo sapiens
gctaagtcatgtatt

SEQ ID NO: 86127 - DNA, 15 bp, Homo sapiens
agctaagtcatgtat

SEQ ID NO: 86128 - DNA, 15 bp, Homo sapiens
cagctaagtcatgta

SEQ ID NO: 86129 - DNA, 15 bp, Homo sapiens
acagctaagtcatgt

SEQ ID NO: 86130 - DNA, 15 bp, Homo sapiens
cacagctaagtcatg

SEQ ID NO: 86131 - DNA, 15 bp, Homo sapiens
gcacagctaagtcat

SEQ ID NO: 86132 - DNA, 15 bp, Homo sapiens
agcacagctaagtca

SEQ ID NO: 86133 - DNA, 15 bp, Homo sapiens
cagcacagctaagtc

SEQ ID NO: 86134 - DNA, 15 bp, Homo sapiens
acagcacagctaagt

SEQ ID NO: 86135 - DNA, 15 bp, Homo sapiens
aacagcacagctaag

SEQ ID NO: 86136 - DNA, 15 bp, Homo sapiens
aaacagcacagctaa

SEQ ID NO: 86137 - DNA, 15 bp, Homo sapiens
aaaacagcacagcta

SEQ ID NO: 86138 - DNA, 15 bp, Homo sapiens
caaaacagcacagct

SEQ ID NO: 86139 - DNA, 15 bp, Homo sapiens
tcaaaacagcacagc

SEQ ID NO: 86140 - DNA, 15 bp, Homo sapiens
gtcaaaacagcacag

SEQ ID NO: 86141 - DNA, 15 bp, Homo sapiens
tgtcaaaacagcaca

SEQ ID NO: 86142 - DNA, 15 bp, Homo sapiens
ttgtcaaaacagcac

SEQ ID NO: 86143 - DNA, 15 bp, Homo sapiens
tttgtcaaaacagca

SEQ ID NO: 86144 - DNA, 15 bp, Homo sapiens
atttgtcaaaacagc

SEQ ID NO: 86145 - DNA, 15 bp, Homo sapiens
tatttgtcaaaacag

SEQ ID NO: 86146 - DNA, 15 bp, Homo sapiens
ctatttgtcaaaaca

SEQ ID NO: 86147 - DNA, 15 bp, Homo sapiens
tctatttgtcaaaac

SEQ ID NO: 86148 - DNA, 15 bp, Homo sapiens
atctatttgtcaaaa

SEQ ID NO: 86149 - DNA, 15 bp, Homo sapiens
tatctatttgtcaaa

SEQ ID NO: 86150 - DNA, 15 bp, Homo sapiens
atatctatttgtcaa

SEQ ID NO: 86151 - DNA, 15 bp, Homo sapiens
tatatctatttgtca

SEQ ID NO: 86152 - DNA, 15 bp, Homo sapiens
gtatatctatttgtc

SEQ ID NO: 86153 - DNA, 15 bp, Homo sapiens
ggtatatctatttgt

SEQ ID NO: 86154 - DNA, 15 bp, Homo sapiens
aggtatatctatttg

SEQ ID NO: 86155 - DNA, 15 bp, Homo sapiens
caggtatatctattt

SEQ ID NO: 86156 - DNA, 15 bp, Homo sapiens
acaggtatatctatt

SEQ ID NO: 86157 - DNA, 15 bp, Homo sapiens
cacaggtatatctat

SEQ ID NO: 86158 - DNA, 15 bp, Homo sapiens
acacaggtatatcta

SEQ ID NO: 86159 - DNA, 15 bp, Homo sapiens
tacacaggtatatct

SEQ ID NO: 86160 - DNA, 15 bp, Homo sapiens
ttacacaggtatatc

SEQ ID NO: 86161 - DNA, 15 bp, Homo sapiens
gttacacaggtatat

SEQ ID NO: 86162 - DNA, 15 bp, Homo sapiens
ggttacacaggtata

SEQ ID NO: 86163 - DNA, 15 bp, Homo sapiens
aggttacacaggtat

SEQ ID NO: 86164 - DNA, 15 bp, Homo sapiens
taggttacacaggta

SEQ ID NO: 86165 - DNA, 15 bp, Homo sapiens
gtaggttacacaggt

SEQ ID NO: 86166 - DNA, 15 bp, Homo sapiens
tgtaggttacacagg

SEQ ID NO: 86167 - DNA, 15 bp, Homo sapiens
gtgtaggttacacag

SEQ ID NO: 86168 - DNA, 15 bp, Homo sapiens
tgtgtaggttacaca

SEQ ID NO: 86169 - DNA, 15 bp, Homo sapiens
gtgtgtaggttacac

SEQ ID NO: 86170 - DNA, 15 bp, Homo sapiens
tgtgtgtaggttaca

SEQ ID NO: 86171 - DNA, 15 bp, Homo sapiens
gtgtgtgtaggttac

SEQ ID NO: 86172 - DNA, 15 bp, Homo sapiens
tgtgtgtgtaggtta

SEQ ID NO: 86173 - DNA, 15 bp, Homo sapiens
gtgtgtgtgtaggtt

SEQ ID NO: 86174 - DNA, 15 bp, Homo sapiens
tgtgtgtgtgtaggt

SEQ ID NO: 86175 - DNA, 15 bp, Homo sapiens
atgtgtgtgtgtagg

SEQ ID NO: 86176 - DNA, 15 bp, Homo sapiens
gatgtgtgtgtgtag

SEQ ID NO: 86177 - DNA, 15 bp, Homo sapiens
tgatgtgtgtgtgta

SEQ ID NO: 86178 - DNA, 15 bp, Homo sapiens
gtgatgtgtgtgtgt

SEQ ID NO: 86179 - DNA, 15 bp, Homo sapiens
agtgatgtgtgtgtg

SEQ ID NO: 86180 - DNA, 15 bp, Homo sapiens
cagtgatgtgtgtgt

SEQ ID NO: 86181 - DNA, 15 bp, Homo sapiens
acagtgatgtgtgtg

SEQ ID NO: 86182 - DNA, 15 bp, Homo sapiens
tacagtgatgtgtgt

SEQ ID NO: 86183 - DNA, 15 bp, Homo sapiens
ctacagtgatgtgtg

SEQ ID NO: 86184 - DNA, 15 bp, Homo sapiens
tctacagtgatgtgt

SEQ ID NO: 86185 - DNA, 15 bp, Homo sapiens
ttctacagtgatgtg

SEQ ID NO: 86186 - DNA, 15 bp, Homo sapiens
tttctacagtgatgt

SEQ ID NO: 86187 - DNA, 15 bp, Homo sapiens
ttttctacagtgatg

SEQ ID NO: 86188 - DNA, 15 bp, Homo sapiens
attttctacagtgat

SEQ ID NO: 86189 - DNA, 15 bp, Homo sapiens
aattttctacagtga

SEQ ID NO: 86190 - DNA, 15 bp, Homo sapiens
aaattttctacagtg

SEQ ID NO: 86191 - DNA, 15 bp, Homo sapiens
gaaattttctacagt

SEQ ID NO: 86192 - DNA, 15 bp, Homo sapiens
ggaaattttctacag

SEQ ID NO: 86193 - DNA, 15 bp, Homo sapiens
tggaaattttctaca

SEQ ID NO: 86194 - DNA, 15 bp, Homo sapiens
atggaaattttctac

SEQ ID NO: 86195 - DNA, 15 bp, Homo sapiens
gatggaaattttcta

SEQ ID NO: 86196 - DNA, 15 bp, Homo sapiens
agatggaaattttct

SEQ ID NO: 86197 - DNA, 15 bp, Homo sapiens
aagatggaaattttc

SEQ ID NO: 86198 - DNA, 15 bp, Homo sapiens
aaagatggaaatttt

SEQ ID NO: 86199 - DNA, 15 bp, Homo sapiens
gaaagatggaaattt

SEQ ID NO: 86200 - DNA, 15 bp, Homo sapiens
ggaaagatggaaatt

SEQ ID NO: 86201 - DNA, 15 bp, Homo sapiens
tggaaagatggaaat

SEQ ID NO: 86202 - DNA, 15 bp, Homo sapiens
ctggaaagatggaaa

SEQ ID NO: 86203 - DNA, 15 bp, Homo sapiens
tctggaaagatggaa

SEQ ID NO: 86204 - DNA, 15 bp, Homo sapiens
ttctggaaagatgga

SEQ ID NO: 86205 - DNA, 15 bp, Homo sapiens
tttctggaaagatgg

SEQ ID NO: 86206 - DNA, 15 bp, Homo sapiens
atttctggaaagatg

SEQ ID NO: 86207 - DNA, 15 bp, Homo sapiens
aatttctggaaagat

SEQ ID NO: 86208 - DNA, 15 bp, Homo sapiens
aaatttctggaaaga

SEQ ID NO: 86209 - DNA, 15 bp, Homo sapiens
gaaatttctggaaag

SEQ ID NO: 86210 - DNA, 15 bp, Homo sapiens
agaaatttctggaaa

SEQ ID NO: 86211 - DNA, 15 bp, Homo sapiens
gagaaatttctggaa

SEQ ID NO: 86212 - DNA, 15 bp, Homo sapiens
agagaaatttctgga

SEQ ID NO: 86213 - DNA, 15 bp, Homo sapiens
aagagaaatttctgg

SEQ ID NO: 86214 - DNA, 15 bp, Homo sapiens
aaagagaaatttctg

SEQ ID NO: 86215 - DNA, 15 bp, Homo sapiens
aaaagagaaatttct

SEQ ID NO: 86216 - DNA, 15 bp, Homo sapiens
caaaagagaaatttc

SEQ ID NO: 86217 - DNA, 15 bp, Homo sapiens
ccaaaagagaaattt

SEQ ID NO: 86218 - DNA, 15 bp, Homo sapiens
cccaaaagagaaatt

SEQ ID NO: 86219 - DNA, 15 bp, Homo sapiens
acccaaaagagaaat

SEQ ID NO: 86220 - DNA, 15 bp, Homo sapiens
aacccaaaagagaaa

SEQ ID NO: 86221 - DNA, 15 bp, Homo sapiens
taacccaaaagagaa

SEQ ID NO: 86222 - DNA, 15 bp, Homo sapiens
ctaacccaaaagaga

SEQ ID NO: 86223 - DNA, 15 bp, Homo sapiens
actaacccaaaagag

SEQ ID NO: 86224 - DNA, 15 bp, Homo sapiens
gactaacccaaaaga

SEQ ID NO: 86225 - DNA, 15 bp, Homo sapiens
tgactaacccaaaag

SEQ ID NO: 86226 - DNA, 15 bp, Homo sapiens
gtgactaacccaaaa

SEQ ID NO: 86227 - DNA, 15 bp, Homo sapiens
ggtgactaacccaaa

SEQ ID NO: 86228 - DNA, 15 bp, Homo sapiens
aggtgactaacccaa

SEQ ID NO: 86229 - DNA, 15 bp, Homo sapiens
aaggtgactaaccca

SEQ ID NO: 86230 - DNA, 15 bp, Homo sapiens
gaaggtgactaaccc

SEQ ID NO: 86231 - DNA, 15 bp, Homo sapiens
ggaaggtgactaacc

SEQ ID NO: 86232 - DNA, 15 bp, Homo sapiens
aggaaggtgactaac

SEQ ID NO: 86233 - DNA, 15 bp, Homo sapiens
gaggaaggtgactaa

SEQ ID NO: 86234 - DNA, 15 bp, Homo sapiens
ggaggaaggtgacta

SEQ ID NO: 86235 - DNA, 15 bp, Homo sapiens
gggaggaaggtgact

SEQ ID NO: 86236 - DNA, 15 bp, Homo sapiens
agggaggaaggtgac

SEQ ID NO: 86237 - DNA, 15 bp, Homo sapiens
gagggaggaaggtga

SEQ ID NO: 86238 - DNA, 15 bp, Homo sapiens
ggagggaggaaggtg

SEQ ID NO: 86239 - DNA, 15 bp, Homo sapiens
tggagggaggaaggt

SEQ ID NO: 86240 - DNA, 15 bp, Homo sapiens
ctggagggaggaagg

SEQ ID NO: 86241 - DNA, 15 bp, Homo sapiens
tctggagggaggaag

SEQ ID NO: 86242 - DNA, 15 bp, Homo sapiens
ttctggagggaggaa

SEQ ID NO: 86243 - DNA, 15 bp, Homo sapiens
tttctggagggagga

SEQ ID NO: 86244 - DNA, 15 bp, Homo sapiens
ttttctggagggagg

SEQ ID NO: 86245 - DNA, 15 bp, Homo sapiens
gttttctggagggag

SEQ ID NO: 86246 - DNA, 15 bp, Homo sapiens
tgttttctggaggga

SEQ ID NO: 86247 - DNA, 15 bp, Homo sapiens
ttgttttctggaggg

SEQ ID NO: 86248 - DNA, 15 bp, Homo sapiens
gttgttttctggagg

SEQ ID NO: 86249 - DNA, 15 bp, Homo sapiens
agttgttttctggag

SEQ ID NO: 86250 - DNA, 15 bp, Homo sapiens
cagttgttttctgga

SEQ ID NO: 86251 - DNA, 15 bp, Homo sapiens
acagttgttttctgg

SEQ ID NO: 86252 - DNA, 15 bp, Homo sapiens
aacagttgttttctg

SEQ ID NO: 86253 - DNA, 15 bp, Homo sapiens
gaacagttgttttct

SEQ ID NO: 86254 - DNA, 15 bp, Homo sapiens
tgaacagttgttttc

SEQ ID NO: 86255 - DNA, 15 bp, Homo sapiens
atgaacagttgtttt

SEQ ID NO: 86256 - DNA, 15 bp, Homo sapiens
catgaacagttgttt

SEQ ID NO: 86257 - DNA, 15 bp, Homo sapiens
acatgaacagttgtt

SEQ ID NO: 86258 - DNA, 15 bp, Homo sapiens
aacatgaacagttgt

SEQ ID NO: 86259 - DNA, 15 bp, Homo sapiens
caacatgaacagttg

SEQ ID NO: 86260 - DNA, 15 bp, Homo sapiens
acaacatgaacagtt

SEQ ID NO: 86261 - DNA, 15 bp, Homo sapiens
aacaacatgaacagt

SEQ ID NO: 86262 - DNA, 15 bp, Homo sapiens
aaacaacatgaacag

SEQ ID NO: 86263 - DNA, 15 bp, Homo sapiens
aaaacaacatgaaca

SEQ ID NO: 86264 - DNA, 15 bp, Homo sapiens
caaaacaacatgaac

SEQ ID NO: 86265 - DNA, 15 bp, Homo sapiens
tcaaaacaacatgaa

SEQ ID NO: 86266 - DNA, 15 bp, Homo sapiens
gtcaaaacaacatga

SEQ ID NO: 86267 - DNA, 15 bp, Homo sapiens
ggtcaaaacaacatg

SEQ ID NO: 86268 - DNA, 15 bp, Homo sapiens
aggtcaaaacaacat

SEQ ID NO: 86269 - DNA, 15 bp, Homo sapiens
aaggtcaaaacaaca

SEQ ID NO: 86270 - DNA, 15 bp, Homo sapiens
taaggtcaaaacaac

SEQ ID NO: 86271 - DNA, 15 bp, Homo sapiens
ctaaggtcaaaacaa

SEQ ID NO: 86272 - DNA, 15 bp, Homo sapiens
tctaaggtcaaaaca

SEQ ID NO: 86273 - DNA, 15 bp, Homo sapiens
atctaaggtcaaaac

SEQ ID NO: 86274 - DNA, 15 bp, Homo sapiens
aatctaaggtcaaaa

SEQ ID NO: 86275 - DNA, 15 bp, Homo sapiens
taatctaaggtcaaa

SEQ ID NO: 86276 - DNA, 15 bp, Homo sapiens
ataatctaaggtcaa

SEQ ID NO: 86277 - DNA, 15 bp, Homo sapiens
aataatctaaggtca

SEQ ID NO: 86278 - DNA, 15 bp, Homo sapiens
aaataatctaaggtc

SEQ ID NO: 86279 - DNA, 15 bp, Homo sapiens
aaaataatctaaggt

SEQ ID NO: 86280 - DNA, 15 bp, Homo sapiens
caaaataatctaagg

SEQ ID NO: 86281 - DNA, 15 bp, Homo sapiens
gcaaaataatctaag

SEQ ID NO: 86282 - DNA, 15 bp, Homo sapiens
ggcaaaataatctaa

SEQ ID NO: 86283 - DNA, 15 bp, Homo sapiens
aggcaaaataatcta

SEQ ID NO: 86284 - DNA, 15 bp, Homo sapiens
gaggcaaaataatct

SEQ ID NO: 86285 - DNA, 15 bp, Homo sapiens
ggaggcaaaataatc

SEQ ID NO: 86286 - DNA, 15 bp, Homo sapiens
tggaggcaaaataat

SEQ ID NO: 86287 - DNA, 15 bp, Homo sapiens
ctggaggcaaaataa

SEQ ID NO: 86288 - DNA, 15 bp, Homo sapiens
gctggaggcaaaata

SEQ ID NO: 86289 - DNA, 15 bp, Homo sapiens
ggctggaggcaaaat

SEQ ID NO: 86290 - DNA, 15 bp, Homo sapiens
aggctggaggcaaaa

SEQ ID NO: 86291 - DNA, 15 bp, Homo sapiens
aaggctggaggcaaa

SEQ ID NO: 86292 - DNA, 15 bp, Homo sapiens
aaaggctggaggcaa

SEQ ID NO: 86293 - DNA, 15 bp, Homo sapiens
taaaggctggaggca

SEQ ID NO: 86294 - DNA, 15 bp, Homo sapiens
ttaaaggctggaggc

SEQ ID NO: 86295 - DNA, 15 bp, Homo sapiens
gttaaaggctggagg

SEQ ID NO: 86296 - DNA, 15 bp, Homo sapiens
tgttaaaggctggag

SEQ ID NO: 86297 - DNA, 15 bp, Homo sapiens
ttgttaaaggctgga

SEQ ID NO: 86298 - DNA, 15 bp, Homo sapiens
tttgttaaaggctgg

SEQ ID NO: 86299 - DNA, 15 bp, Homo sapiens
atttgttaaaggctg

SEQ ID NO: 86300 - DNA, 15 bp, Homo sapiens
tatttgttaaaggct

SEQ ID NO: 86301 - DNA, 15 bp, Homo sapiens
atatttgttaaaggc

SEQ ID NO: 86302 - DNA, 15 bp, Homo sapiens
catatttgttaaagg

SEQ ID NO: 86303 - DNA, 15 bp, Homo sapiens
acatatttgttaaag

SEQ ID NO: 86304 - DNA, 15 bp, Homo sapiens
aacatatttgttaaa

SEQ ID NO: 86305 - DNA, 15 bp, Homo sapiens
aaacatatttgttaa

SEQ ID NO: 86306 - DNA, 15 bp, Homo sapiens
taaacatatttgtta

SEQ ID NO: 86307 - DNA, 15 bp, Homo sapiens
ataaacatatttgtt

SEQ ID NO: 86308 - DNA, 15 bp, Homo sapiens
aataaacatatttgt

SEQ ID NO: 86309 - DNA, 15 bp, Homo sapiens
aaataaacatatttg

SEQ ID NO: 86310 - DNA, 15 bp, Homo sapiens
taaataaacatattt

SEQ ID NO: 86311 - DNA, 15 bp, Homo sapiens
ataaataaacatatt

SEQ ID NO: 86312 - DNA, 15 bp, Homo sapiens
aataaataaacatat

SEQ ID NO: 86313 - DNA, 15 bp, Homo sapiens
aaataaataaacata

SEQ ID NO: 86314 - DNA, 15 bp, Homo sapiens
taaataaataaacat

SEQ ID NO: 86315 - DNA, 15 bp, Homo sapiens
ctaaataaataaaca

SEQ ID NO: 86316 - DNA, 15 bp, Homo sapiens
actaaataaataaac

SEQ ID NO: 86317 - DNA, 15 bp, Homo sapiens
tactaaataaataaa

SEQ ID NO: 86318 - DNA, 15 bp, Homo sapiens
atactaaataaataa

SEQ ID NO: 86319 - DNA, 15 bp, Homo sapiens
catactaaataaata

SEQ ID NO: 86320 - DNA, 15 bp, Homo sapiens
acatactaaataaat

SEQ ID NO: 86321 - DNA, 15 bp, Homo sapiens
tacatactaaataaa

SEQ ID NO: 86322 - DNA, 15 bp, Homo sapiens
atacatactaaataa

SEQ ID NO: 86323 - DNA, 15 bp, Homo sapiens
tatacatactaaata

SEQ ID NO: 86324 - DNA, 15 bp, Homo sapiens
gtatacatactaaat

SEQ ID NO: 86325 - DNA, 15 bp, Homo sapiens
agtatacatactaaa

SEQ ID NO: 86326 - DNA, 15 bp, Homo sapiens
cagtatacatactaa

SEQ ID NO: 86327 - DNA, 15 bp, Homo sapiens
ccagtatacatacta

SEQ ID NO: 86328 - DNA, 15 bp, Homo sapiens
tccagtatacatact

SEQ ID NO: 86329 - DNA, 15 bp, Homo sapiens
atccagtatacatac

SEQ ID NO: 86330 - DNA, 15 bp, Homo sapiens
tatccagtatacata

SEQ ID NO: 86331 - DNA, 15 bp, Homo sapiens
atatccagtatacat

SEQ ID NO: 86332 - DNA, 15 bp, Homo sapiens
catatccagtataca

SEQ ID NO: 86333 - DNA, 15 bp, Homo sapiens
acatatccagtatac

SEQ ID NO: 86334 - DNA, 15 bp, Homo sapiens
cacatatccagtata

SEQ ID NO: 86335 - DNA, 15 bp, Homo sapiens
acacatatccagtat

SEQ ID NO: 86336 - DNA, 15 bp, Homo sapiens
tacacatatccagta

SEQ ID NO: 86337 - DNA, 15 bp, Homo sapiens
atacacatatccagt

SEQ ID NO: 86338 - DNA, 15 bp, Homo sapiens
tatacacatatccag

SEQ ID NO: 86339 - DNA, 15 bp, Homo sapiens
gtatacacatatcca

SEQ ID NO: 86340 - DNA, 15 bp, Homo sapiens
tgtatacacatatcc

SEQ ID NO: 86341 - DNA, 15 bp, Homo sapiens
gtgtatacacatatc

SEQ ID NO: 86342 - DNA, 15 bp, Homo sapiens
tgtgtatacacatat

SEQ ID NO: 86343 - DNA, 15 bp, Homo sapiens
gtgtgtatacacata

SEQ ID NO: 86344 - DNA, 15 bp, Homo sapiens
tgtgtgtatacacat

SEQ ID NO: 86345 - DNA, 15 bp, Homo sapiens
gtgtgtgtgtgtata

SEQ ID NO: 86346 - DNA, 15 bp, Homo sapiens
tttgtgtgtgtgtgt

SEQ ID NO: 86347 - DNA, 15 bp, Homo sapiens
gtttgtgtgtgtgtg

SEQ ID NO: 86348 - DNA, 15 bp, Homo sapiens
tgtttgtgtgtgtgt

SEQ ID NO: 86349 - DNA, 15 bp, Homo sapiens
gtgtttgtgtgtgtg

SEQ ID NO: 86350 - DNA, 15 bp, Homo sapiens
tgtgtttgtgtgtgt

SEQ ID NO: 86351 - DNA, 15 bp, Homo sapiens
gtgtgtttgtgtgtg

SEQ ID NO: 86352 - DNA, 15 bp, Homo sapiens
tgtgtgtttgtgtgt

SEQ ID NO: 86353 - DNA, 15 bp, Homo sapiens
ctgtgtgtttgtgtg

SEQ ID NO: 86354 - DNA, 15 bp, Homo sapiens
tctgtgtgtttgtgt

SEQ ID NO: 86355 - DNA, 15 bp, Homo sapiens
tttctgtgtgtttgt

SEQ ID NO: 86356 - DNA, 15 bp, Homo sapiens
gtttctgtgtgtttg

SEQ ID NO: 86357 - DNA, 15 bp, Homo sapiens
tgtttctgtgtgttt

SEQ ID NO: 86358 - DNA, 15 bp, Homo sapiens
atgtttctgtgtgtt

SEQ ID NO: 86359 - DNA, 15 bp, Homo sapiens
tatgtttctgtgtgt

SEQ ID NO: 86360 - DNA, 15 bp, Homo sapiens
atatgtttctgtgtg

SEQ ID NO: 86361 - DNA, 15 bp, Homo sapiens
tatatgtttctgtgt

SEQ ID NO: 86362 - DNA, 15 bp, Homo sapiens
atatatgtttctgtg

SEQ ID NO: 86363 - DNA, 15 bp, Homo sapiens
tatatatgtttctgt

SEQ ID NO: 86364 - DNA, 15 bp, Homo sapiens
gtatatatgtttctg

SEQ ID NO: 86365 - DNA, 15 bp, Homo sapiens
tgtatatatgtttct

SEQ ID NO: 86366 - DNA, 15 bp, Homo sapiens
gtgtatatatgtttc

SEQ ID NO: 86367 - DNA, 15 bp, Homo sapiens
tgtgtatatatgttt

SEQ ID NO: 86368 - DNA, 15 bp, Homo sapiens
gtgtgtatatatgtt

SEQ ID NO: 86369 - DNA, 15 bp, Homo sapiens
tgtgtgtatatatgt

SEQ ID NO: 86370 - DNA, 15 bp, Homo sapiens
gtgtgtgtatatatg

SEQ ID NO: 86371 - DNA, 15 bp, Homo sapiens
ttgtgtgtgtatata

SEQ ID NO: 86372 - DNA, 15 bp, Homo sapiens
tttgtgtgtgtatat

SEQ ID NO: 86373 - DNA, 15 bp, Homo sapiens
gtttgtgtgtgtata

SEQ ID NO: 86374 - DNA, 15 bp, Homo sapiens
tgtttgtgtgtgtat

SEQ ID NO: 86375 - DNA, 15 bp, Homo sapiens
atgtttgtgtgtgta

SEQ ID NO: 86376 - DNA, 15 bp, Homo sapiens
tatgtttgtgtgtgt

SEQ ID NO: 86377 - DNA, 15 bp, Homo sapiens
atatgtttgtgtgtg

SEQ ID NO: 86378 - DNA, 15 bp, Homo sapiens
tatatgtttgtgtgt

SEQ ID NO: 86379 - DNA, 15 bp, Homo sapiens
atatatgtttgtgtg

SEQ ID NO: 86380 - DNA, 15 bp, Homo sapiens
tatatatgtttgtgt

SEQ ID NO: 86381 - DNA, 15 bp, Homo sapiens
ctatatatgtttgtg

SEQ ID NO: 86382 - DNA, 15 bp, Homo sapiens
tctatatatgtttgt

SEQ ID NO: 86383 - DNA, 15 bp, Homo sapiens
atctatatatgtttg

SEQ ID NO: 86384 - DNA, 15 bp, Homo sapiens
tatctatatatgttt

SEQ ID NO: 86385 - DNA, 15 bp, Homo sapiens
atatctatatatgtt

SEQ ID NO: 86386 - DNA, 15 bp, Homo sapiens
tatatctatatatgt

SEQ ID NO: 86387 - DNA, 15 bp, Homo sapiens
atatatctatatatg

SEQ ID NO: 86388 - DNA, 15 bp, Homo sapiens
tatatatctatatat

SEQ ID NO: 86389 - DNA, 15 bp, Homo sapiens
gtatatatctatata

SEQ ID NO: 86390 - DNA, 15 bp, Homo sapiens
tgtatatatctatat

SEQ ID NO: 86391 - DNA, 15 bp, Homo sapiens
gtgtatatatctata

SEQ ID NO: 86392 - DNA, 15 bp, Homo sapiens
tgtgtatatatctat

SEQ ID NO: 86393 - DNA, 15 bp, Homo sapiens
atgtgtatatatcta

SEQ ID NO: 86394 - DNA, 15 bp, Homo sapiens
tatgtgtatatatct

SEQ ID NO: 86395 - DNA, 15 bp, Homo sapiens
gtatgtgtatatatc

SEQ ID NO: 86396 - DNA, 15 bp, Homo sapiens
tgtatgtgtatatat

SEQ ID NO: 86397 - DNA, 15 bp, Homo sapiens
gtgtatgtgtatata

SEQ ID NO: 86398 - DNA, 15 bp, Homo sapiens
tgtgtatgtgtatat

SEQ ID NO: 86399 - DNA, 15 bp, Homo sapiens
gtgtgtatgtgtata

SEQ ID NO: 86400 - DNA, 15 bp, Homo sapiens
tgtgtgtatgtgtat

SEQ ID NO: 86401 - DNA, 15 bp, Homo sapiens
ttgtgtgtatgtgta

SEQ ID NO: 86402 - DNA, 15 bp, Homo sapiens
tttgtgtgtatgtgt

SEQ ID NO: 86403 - DNA, 15 bp, Homo sapiens
ttttgtgtgtatgtg

SEQ ID NO: 86404 - DNA, 15 bp, Homo sapiens
attttgtgtgtatgt

SEQ ID NO: 86405 - DNA, 15 bp, Homo sapiens
tattttgtgtgtatg

SEQ ID NO: 86406 - DNA, 15 bp, Homo sapiens
atattttgtgtgtat

SEQ ID NO: 86407 - DNA, 15 bp, Homo sapiens
catattttgtgtgta

SEQ ID NO: 86408 - DNA, 15 bp, Homo sapiens
ccatattttgtgtgt

SEQ ID NO: 86409 - DNA, 15 bp, Homo sapiens
tccatattttgtgtg

SEQ ID NO: 86410 - DNA, 15 bp, Homo sapiens
ttccatattttgtgt

SEQ ID NO: 86411 - DNA, 15 bp, Homo sapiens
attccatattttgtg

SEQ ID NO: 86412 - DNA, 15 bp, Homo sapiens
cattccatattttgt

SEQ ID NO: 86413 - DNA, 15 bp, Homo sapiens
acattccatattttg

SEQ ID NO: 86414 - DNA, 15 bp, Homo sapiens
tacattccatatttt

SEQ ID NO: 86415 - DNA, 15 bp, Homo sapiens
atacattccatattt

SEQ ID NO: 86416 - DNA, 15 bp, Homo sapiens
tatacattccatatt

SEQ ID NO: 86417 - DNA, 15 bp, Homo sapiens
gtatacattccatat

SEQ ID NO: 86418 - DNA, 15 bp, Homo sapiens
ggtatacattccata

SEQ ID NO: 86419 - DNA, 15 bp, Homo sapiens
tggtatacattccat

SEQ ID NO: 86420 - DNA, 15 bp, Homo sapiens
atggtatacattcca

SEQ ID NO: 86421 - DNA, 15 bp, Homo sapiens
catggtatacattcc

SEQ ID NO: 86422 - DNA, 15 bp, Homo sapiens
acatggtatacattc

SEQ ID NO: 86423 - DNA, 15 bp, Homo sapiens
cacatggtatacatt

SEQ ID NO: 86424 - DNA, 15 bp, Homo sapiens
ccacatggtatacat

SEQ ID NO: 86425 - DNA, 15 bp, Homo sapiens
tccacatggtataca

SEQ ID NO: 86426 - DNA, 15 bp, Homo sapiens
gtccacatggtatac

SEQ ID NO: 86427 - DNA, 15 bp, Homo sapiens
tgtccacatggtata

SEQ ID NO: 86428 - DNA, 15 bp, Homo sapiens
ctgtccacatggtat

SEQ ID NO: 86429 - DNA, 15 bp, Homo sapiens
actgtccacatggta

SEQ ID NO: 86430 - DNA, 15 bp, Homo sapiens
cactgtccacatggt

SEQ ID NO: 86431 - DNA, 15 bp, Homo sapiens
acactgtccacatgg

SEQ ID NO: 86432 - DNA, 15 bp, Homo sapiens
tacactgtccacatg

SEQ ID NO: 86433 - DNA, 15 bp, Homo sapiens
atacactgtccacat

SEQ ID NO: 86434 - DNA, 15 bp, Homo sapiens
catacactgtccaca

SEQ ID NO: 86435 - DNA, 15 bp, Homo sapiens
acatacactgtccac

SEQ ID NO: 86436 - DNA, 15 bp, Homo sapiens
gacatacactgtcca

SEQ ID NO: 86437 - DNA, 15 bp, Homo sapiens
ggacatacactgtcc

SEQ ID NO: 86438 - DNA, 15 bp, Homo sapiens
tggacatacactgtc

SEQ ID NO: 86439 - DNA, 15 bp, Homo sapiens
atggacatacactgt

SEQ ID NO: 86440 - DNA, 15 bp, Homo sapiens
aatggacatacactg

SEQ ID NO: 86441 - DNA, 15 bp, Homo sapiens
aaatggacatacact

SEQ ID NO: 86442 - DNA, 15 bp, Homo sapiens
taaatggacatacac

SEQ ID NO: 86443 - DNA, 15 bp, Homo sapiens
ataaatggacataca

SEQ ID NO: 86444 - DNA, 15 bp, Homo sapiens
aataaatggacatac

SEQ ID NO: 86445 - DNA, 15 bp, Homo sapiens
aaataaatggacata

SEQ ID NO: 86446 - DNA, 15 bp, Homo sapiens
aaaataaatggacat

SEQ ID NO: 86447 - DNA, 15 bp, Homo sapiens
caaaataaatggaca

SEQ ID NO: 86448 - DNA, 15 bp, Homo sapiens
tcaaaataaatggac

SEQ ID NO: 86449 - DNA, 15 bp, Homo sapiens
ttcaaaataaatgga

SEQ ID NO: 86450 - DNA, 15 bp, Homo sapiens
tttcaaaataaatgg

SEQ ID NO: 86451 - DNA, 15 bp, Homo sapiens
atttcaaaataaatg

SEQ ID NO: 86452 - DNA, 15 bp, Homo sapiens
aatttcaaaataaat

SEQ ID NO: 86453 - DNA, 15 bp, Homo sapiens
taatttcaaaataaa

SEQ ID NO: 86454 - DNA, 15 bp, Homo sapiens
ataatttcaaaataa

SEQ ID NO: 86455 - DNA, 15 bp, Homo sapiens
cataatttcaaaata

SEQ ID NO: 86456 - DNA, 15 bp, Homo sapiens
gcataatttcaaaat

SEQ ID NO: 86457 - DNA, 15 bp, Homo sapiens
tgcataatttcaaaa

SEQ ID NO: 86458 - DNA, 15 bp, Homo sapiens
ttgcataatttcaaa

SEQ ID NO: 86459 - DNA, 15 bp, Homo sapiens
tttgcataatttcaa

SEQ ID NO: 86460 - DNA, 15 bp, Homo sapiens
atttgcataatttca

SEQ ID NO: 86461 - DNA, 15 bp, Homo sapiens
catttgcataatttc

SEQ ID NO: 86462 - DNA, 15 bp, Homo sapiens
acatttgcataattt

SEQ ID NO: 86463 - DNA, 15 bp, Homo sapiens
tacatttgcataatt

SEQ ID NO: 86464 - DNA, 15 bp, Homo sapiens
atacatttgcataat

SEQ ID NO: 86465 - DNA, 15 bp, Homo sapiens
aatacatttgcataa

SEQ ID NO: 86466 - DNA, 15 bp, Homo sapiens
taatacatttgcata

SEQ ID NO: 86467 - DNA, 15 bp, Homo sapiens
ataatacatttgcat

SEQ ID NO: 86468 - DNA, 15 bp, Homo sapiens
gataatacatttgca

SEQ ID NO: 86469 - DNA, 15 bp, Homo sapiens
tgataatacatttgc

SEQ ID NO: 86470 - DNA, 15 bp, Homo sapiens
ttgataatacatttg

SEQ ID NO: 86471 - DNA, 15 bp, Homo sapiens
attgataatacattt

SEQ ID NO: 86472 - DNA, 15 bp, Homo sapiens
gattgataatacatt

SEQ ID NO: 86473 - DNA, 15 bp, Homo sapiens
ggattgataatacat

SEQ ID NO: 86474 - DNA, 15 bp, Homo sapiens
tggattgataataca

SEQ ID NO: 86475 - DNA, 15 bp, Homo sapiens
atggattgataatac

SEQ ID NO: 86476 - DNA, 15 bp, Homo sapiens
aatggattgataata

SEQ ID NO: 86477 - DNA, 15 bp, Homo sapiens
aaatggattgataat

SEQ ID NO: 86478 - DNA, 15 bp, Homo sapiens
taaatggattgataa

SEQ ID NO: 86479 - DNA, 15 bp, Homo sapiens
ataaatggattgata

SEQ ID NO: 86480 - DNA, 15 bp, Homo sapiens
aataaatggattgat

SEQ ID NO: 86481 - DNA, 15 bp, Homo sapiens
taataaatggattga

SEQ ID NO: 86482 - DNA, 15 bp, Homo sapiens
ataataaatggattg

SEQ ID NO: 86483 - DNA, 15 bp, Homo sapiens
aataataaatggatt

SEQ ID NO: 86484 - DNA, 15 bp, Homo sapiens
taataataaatggat

SEQ ID NO: 86485 - DNA, 15 bp, Homo sapiens
ttaataataaatgga

SEQ ID NO: 86486 - DNA, 15 bp, Homo sapiens
attaataataaatgg

SEQ ID NO: 86487 - DNA, 15 bp, Homo sapiens
tattaataataaatg

SEQ ID NO: 86488 - DNA, 15 bp, Homo sapiens
ttattaataataaat

SEQ ID NO: 86489 - DNA, 15 bp, Homo sapiens
tttattaataataaa

SEQ ID NO: 86490 - DNA, 15 bp, Homo sapiens
atttattaataataa

SEQ ID NO: 86491 - DNA, 15 bp, Homo sapiens
catttattaataata

SEQ ID NO: 86492 - DNA, 15 bp, Homo sapiens
acatttattaataat

SEQ ID NO: 86493 - DNA, 15 bp, Homo sapiens
aacatttattaataa

SEQ ID NO: 86494 - DNA, 15 bp, Homo sapiens
taacatttattaata

SEQ ID NO: 86495 - DNA, 15 bp, Homo sapiens
ttaacatttattaat

SEQ ID NO: 86496 - DNA, 15 bp, Homo sapiens
attaacatttattaa

SEQ ID NO: 86497 - DNA, 15 bp, Homo sapiens
aattaacatttatta

SEQ ID NO: 86498 - DNA, 15 bp, Homo sapiens
aaattaacatttatt

SEQ ID NO: 86499 - DNA, 15 bp, Homo sapiens
gaaattaacatttat

SEQ ID NO: 86500 - DNA, 15 bp, Homo sapiens
agaaattaacattta

SEQ ID NO: 86501 - DNA, 15 bp, Homo sapiens
aagaaattaacattt

SEQ ID NO: 86502 - DNA, 15 bp, Homo sapiens
aaagaaattaacatt

SEQ ID NO: 86503 - DNA, 15 bp, Homo sapiens
gaaagaaattaacat

SEQ ID NO: 86504 - DNA, 15 bp, Homo sapiens
agaaagaaattaaca

SEQ ID NO: 86505 - DNA, 15 bp, Homo sapiens
aagaaagaaattaac

SEQ ID NO: 86506 - DNA, 15 bp, Homo sapiens
aaagaaagaaattaa

SEQ ID NO: 86507 - DNA, 15 bp, Homo sapiens
taaagaaagaaatta

SEQ ID NO: 86508 - DNA, 15 bp, Homo sapiens
ttaaagaaagaaatt

SEQ ID NO: 86509 - DNA, 15 bp, Homo sapiens
tttaaagaaagaaat

SEQ ID NO: 86510 - DNA, 15 bp, Homo sapiens
atttaaagaaagaaa

SEQ ID NO: 86511 - DNA, 15 bp, Homo sapiens
tatttaaagaaagaa

SEQ ID NO: 86512 - DNA, 15 bp, Homo sapiens
ttatttaaagaaaga

SEQ ID NO: 86513 - DNA, 15 bp, Homo sapiens
tttatttaaagaaag

SEQ ID NO: 86514 - DNA, 15 bp, Homo sapiens
atttatttaaagaaa

SEQ ID NO: 86515 - DNA, 15 bp, Homo sapiens
aatttatttaaagaa

SEQ ID NO: 86516 - DNA, 15 bp, Homo sapiens
taatttatttaaaga

SEQ ID NO: 86517 - DNA, 15 bp, Homo sapiens
ttaatttatttaaag

SEQ ID NO: 86518 - DNA, 15 bp, Homo sapiens
tttaatttatttaaa

SEQ ID NO: 86519 - DNA, 15 bp, Homo sapiens
atttaatttatttaa

SEQ ID NO: 86520 - DNA, 15 bp, Homo sapiens
tatttaatttattta

SEQ ID NO: 86521 - DNA, 15 bp, Homo sapiens
ctatttaatttattt

SEQ ID NO: 86522 - DNA, 15 bp, Homo sapiens
tctatttaatttatt

SEQ ID NO: 86523 - DNA, 15 bp, Homo sapiens
ttctatttaatttat

SEQ ID NO: 86524 - DNA, 15 bp, Homo sapiens
attctatttaattta

SEQ ID NO: 86525 - DNA, 15 bp, Homo sapiens
tattctatttaattt

SEQ ID NO: 86526 - DNA, 15 bp, Homo sapiens
ctattctatttaatt

SEQ ID NO: 86527 - DNA, 15 bp, Homo sapiens
actattctatttaat

SEQ ID NO: 86528 - DNA, 15 bp, Homo sapiens
tactattctatttaa

SEQ ID NO: 86529 - DNA, 15 bp, Homo sapiens
atactattctattta

SEQ ID NO: 86530 - DNA, 15 bp, Homo sapiens
aatactattctattt

SEQ ID NO: 86531 - DNA, 15 bp, Homo sapiens
aaatactattctatt

SEQ ID NO: 86532 - DNA, 15 bp, Homo sapiens
taaatactattctat

SEQ ID NO: 86533 - DNA, 15 bp, Homo sapiens
ttaaatactattcta

SEQ ID NO: 86534 - DNA, 15 bp, Homo sapiens
attaaatactattct

SEQ ID NO: 86535 - DNA, 15 bp, Homo sapiens
tattaaatactattc

SEQ ID NO: 86536 - DNA, 15 bp, Homo sapiens
atattaaatactatt

SEQ ID NO: 86537 - DNA, 15 bp, Homo sapiens
aatattaaatactat

SEQ ID NO: 86538 - DNA, 15 bp, Homo sapiens
aaatattaaatacta

SEQ ID NO: 86539 - DNA, 15 bp, Homo sapiens
aaaatattaaatact

SEQ ID NO: 86540 - DNA, 15 bp, Homo sapiens
gaaaatattaaatac

SEQ ID NO: 86541 - DNA, 15 bp, Homo sapiens
agaaaatattaaata

SEQ ID NO: 86542 - DNA, 15 bp, Homo sapiens
aagaaaatattaaat

SEQ ID NO: 86543 - DNA, 15 bp, Homo sapiens
aaagaaaatattaaa

SEQ ID NO: 86544 - DNA, 15 bp, Homo sapiens
gaaagaaaatattaa

SEQ ID NO: 86545 - DNA, 15 bp, Homo sapiens
tgaaagaaaatatta

SEQ ID NO: 86546 - DNA, 15 bp, Homo sapiens
ttgaaagaaaatatt

SEQ ID NO: 86547 - DNA, 15 bp, Homo sapiens
tttgaaagaaaatat

SEQ ID NO: 86548 - DNA, 15 bp, Homo sapiens
ttttgaaagaaaata

SEQ ID NO: 86549 - DNA, 15 bp, Homo sapiens
attttgaaagaaaat

SEQ ID NO: 86550 - DNA, 15 bp, Homo sapiens
gattttgaaagaaaa

SEQ ID NO: 86551 - DNA, 15 bp, Homo sapiens
ggattttgaaagaaa

SEQ ID NO: 86552 - DNA, 15 bp, Homo sapiens
tggattttgaaagaa

SEQ ID NO: 86553 - DNA, 15 bp, Homo sapiens
atggattttgaaaga

SEQ ID NO: 86554 - DNA, 15 bp, Homo sapiens
aatggattttgaaag

SEQ ID NO: 86555 - DNA, 15 bp, Homo sapiens
gaatggattttgaaa

SEQ ID NO: 86556 - DNA, 15 bp, Homo sapiens
agaatggattttgaa

SEQ ID NO: 86557 - DNA, 15 bp, Homo sapiens
tagaatggattttga

SEQ ID NO: 86558 - DNA, 15 bp, Homo sapiens
ctagaatggattttg

SEQ ID NO: 86559 - DNA, 15 bp, Homo sapiens
gctagaatggatttt

SEQ ID NO: 86560 - DNA, 15 bp, Homo sapiens
tgctagaatggattt

SEQ ID NO: 86561 - DNA, 15 bp, Homo sapiens
ctgctagaatggatt

SEQ ID NO: 86562 - DNA, 15 bp, Homo sapiens
tctgctagaatggat

SEQ ID NO: 86563 - DNA, 15 bp, Homo sapiens
atctgctagaatgga

SEQ ID NO: 86564 - DNA, 15 bp, Homo sapiens
aatctgctagaatgg

SEQ ID NO: 86565 - DNA, 15 bp, Homo sapiens
caatctgctagaatg

SEQ ID NO: 86566 - DNA, 15 bp, Homo sapiens
acaatctgctagaat

SEQ ID NO: 86567 - DNA, 15 bp, Homo sapiens
gacaatctgctagaa

SEQ ID NO: 86568 - DNA, 15 bp, Homo sapiens
agacaatctgctaga

SEQ ID NO: 86569 - DNA, 15 bp, Homo sapiens
aagacaatctgctag

SEQ ID NO: 86570 - DNA, 15 bp, Homo sapiens
taagacaatctgcta

SEQ ID NO: 86571 - DNA, 15 bp, Homo sapiens
ctaagacaatctgct

SEQ ID NO: 86572 - DNA, 15 bp, Homo sapiens
actaagacaatctgc

SEQ ID NO: 86573 - DNA, 15 bp, Homo sapiens
aactaagacaatctg

SEQ ID NO: 86574 - DNA, 15 bp, Homo sapiens
caactaagacaatct

SEQ ID NO: 86575 - DNA, 15 bp, Homo sapiens
acaactaagacaatc

SEQ ID NO: 86576 - DNA, 15 bp, Homo sapiens
gacaactaagacaat

SEQ ID NO: 86577 - DNA, 15 bp, Homo sapiens
ggacaactaagacaa

SEQ ID NO: 86578 - DNA, 15 bp, Homo sapiens
aggacaactaagaca

SEQ ID NO: 86579 - DNA, 15 bp, Homo sapiens
aaggacaactaagac

SEQ ID NO: 86580 - DNA, 15 bp, Homo sapiens
gaaggacaactaaga

SEQ ID NO: 86581 - DNA, 15 bp, Homo sapiens
ggaaggacaactaag

SEQ ID NO: 86582 - DNA, 15 bp, Homo sapiens
aggaaggacaactaa

SEQ ID NO: 86583 - DNA, 15 bp, Homo sapiens
caggaaggacaacta

SEQ ID NO: 86584 - DNA, 15 bp, Homo sapiens
acaggaaggacaact

SEQ ID NO: 86585 - DNA, 15 bp, Homo sapiens
cacaggaaggacaac

SEQ ID NO: 86586 - DNA, 15 bp, Homo sapiens
ccacaggaaggacaa

SEQ ID NO: 86587 - DNA, 15 bp, Homo sapiens
cccacaggaaggaca

SEQ ID NO: 86588 - DNA, 15 bp, Homo sapiens
gcccacaggaaggac

SEQ ID NO: 86589 - DNA, 15 bp, Homo sapiens
tgcccacaggaagga

SEQ ID NO: 86590 - DNA, 15 bp, Homo sapiens
atgcccacaggaagg

SEQ ID NO: 86591 - DNA, 15 bp, Homo sapiens
gatgcccacaggaag

SEQ ID NO: 86592 - DNA, 15 bp, Homo sapiens
ggatgcccacaggaa

SEQ ID NO: 86593 - DNA, 15 bp, Homo sapiens
gggatgcccacagga

SEQ ID NO: 86594 - DNA, 15 bp, Homo sapiens
tgggatgcccacagg

SEQ ID NO: 86595 - DNA, 15 bp, Homo sapiens
gtgggatgcccacag

SEQ ID NO: 86596 - DNA, 15 bp, Homo sapiens
agtgggatgcccaca

SEQ ID NO: 86597 - DNA, 15 bp, Homo sapiens
aagtgggatgcccac

SEQ ID NO: 86598 - DNA, 15 bp, Homo sapiens
caagtgggatgccca

SEQ ID NO: 86599 - DNA, 15 bp, Homo sapiens
ccaagtgggatgccc

SEQ ID NO: 86600 - DNA, 15 bp, Homo sapiens
tccaagtgggatgcc

SEQ ID NO: 86601 - DNA, 15 bp, Homo sapiens
ctccaagtgggatgc

SEQ ID NO: 86602 - DNA, 15 bp, Homo sapiens
cctccaagtgggatg

SEQ ID NO: 86603 - DNA, 15 bp, Homo sapiens
acctccaagtgggat

SEQ ID NO: 86604 - DNA, 15 bp, Homo sapiens
aacctccaagtggga

SEQ ID NO: 86605 - DNA, 15 bp, Homo sapiens
taacctccaagtggg

SEQ ID NO: 86606 - DNA, 15 bp, Homo sapiens
gtaacctccaagtgg

SEQ ID NO: 86607 - DNA, 15 bp, Homo sapiens
agtaacctccaagtg

SEQ ID NO: 86608 - DNA, 15 bp, Homo sapiens
gagtaacctccaagt

SEQ ID NO: 86609 - DNA, 15 bp, Homo sapiens
agagtaacctccaag

SEQ ID NO: 86610 - DNA, 15 bp, Homo sapiens
aagagtaacctccaa

SEQ ID NO: 86611 - DNA, 15 bp, Homo sapiens
aaagagtaacctcca

SEQ ID NO: 86612 - DNA, 15 bp, Homo sapiens
gaaagagtaacctcc

SEQ ID NO: 86613 - DNA, 15 bp, Homo sapiens
ggaaagagtaacctc

SEQ ID NO: 86614 - DNA, 15 bp, Homo sapiens
tggaaagagtaacct

SEQ ID NO: 86615 - DNA, 15 bp, Homo sapiens
ctggaaagagtaacc

SEQ ID NO: 86616 - DNA, 15 bp, Homo sapiens
actggaaagagtaac

SEQ ID NO: 86617 - DNA, 15 bp, Homo sapiens
tactggaaagagtaa

SEQ ID NO: 86618 - DNA, 15 bp, Homo sapiens
atactggaaagagta

SEQ ID NO: 86619 - DNA, 15 bp, Homo sapiens
aatactggaaagagt

SEQ ID NO: 86620 - DNA, 15 bp, Homo sapiens
aaatactggaaagag

SEQ ID NO: 86621 - DNA, 15 bp, Homo sapiens
taaatactggaaaga

SEQ ID NO: 86622 - DNA, 15 bp, Homo sapiens
gtaaatactggaaag

SEQ ID NO: 86623 - DNA, 15 bp, Homo sapiens
agtaaatactggaaa

SEQ ID NO: 86624 - DNA, 15 bp, Homo sapiens
aagtaaatactggaa

SEQ ID NO: 86625 - DNA, 15 bp, Homo sapiens
caagtaaatactgga

SEQ ID NO: 86626 - DNA, 15 bp, Homo sapiens
tcaagtaaatactgg

SEQ ID NO: 86627 - DNA, 15 bp, Homo sapiens
ttcaagtaaatactg

SEQ ID NO: 86628 - DNA, 15 bp, Homo sapiens
cttcaagtaaatact

SEQ ID NO: 86629 - DNA, 15 bp, Homo sapiens
tcttcaagtaaatac

SEQ ID NO: 86630 - DNA, 15 bp, Homo sapiens
ctcttcaagtaaata

SEQ ID NO: 86631 - DNA, 15 bp, Homo sapiens
tctcttcaagtaaat

SEQ ID NO: 86632 - DNA, 15 bp, Homo sapiens
atctcttcaagtaaa

SEQ ID NO: 86633 - DNA, 15 bp, Homo sapiens
gatctcttcaagtaa

SEQ ID NO: 86634 - DNA, 15 bp, Homo sapiens
ggatctcttcaagta

SEQ ID NO: 86635 - DNA, 15 bp, Homo sapiens
tggatctcttcaagt

SEQ ID NO: 86636 - DNA, 15 bp, Homo sapiens
ctggatctcttcaag

SEQ ID NO: 86637 - DNA, 15 bp, Homo sapiens
tctggatctcttcaa

SEQ ID NO: 86638 - DNA, 15 bp, Homo sapiens
ctctggatctcttca

SEQ ID NO: 86639 - DNA, 15 bp, Homo sapiens
tctctggatctcttc

SEQ ID NO: 86640 - DNA, 15 bp, Homo sapiens
gtctctggatctctt

SEQ ID NO: 86641 - DNA, 15 bp, Homo sapiens
tgtctctggatctct

SEQ ID NO: 86642 - DNA, 15 bp, Homo sapiens
gtgtctctggatctc

SEQ ID NO: 86643 - DNA, 15 bp, Homo sapiens
tgtgtctctggatct

SEQ ID NO: 86644 - DNA, 15 bp, Homo sapiens
ttgtgtctctggatc

SEQ ID NO: 86645 - DNA, 15 bp, Homo sapiens
tttgtgtctctggat

SEQ ID NO: 86646 - DNA, 15 bp, Homo sapiens
gtttgtgtctctgga

SEQ ID NO: 86647 - DNA, 15 bp, Homo sapiens
tgtttgtgtctctgg

SEQ ID NO: 86648 - DNA, 15 bp, Homo sapiens
ctgtttgtgtctctg

SEQ ID NO: 86649 - DNA, 15 bp, Homo sapiens
tctgtttgtgtctct

SEQ ID NO: 86650 - DNA, 15 bp, Homo sapiens
atctgtttgtgtctc

SEQ ID NO: 86651 - DNA, 15 bp, Homo sapiens
catctgtttgtgtct

SEQ ID NO: 86652 - DNA, 15 bp, Homo sapiens
tcatctgtttgtgtc

SEQ ID NO: 86653 - DNA, 15 bp, Homo sapiens
atcatctgtttgtgt

SEQ ID NO: 86654 - DNA, 15 bp, Homo sapiens
tatcatctgtttgtg

SEQ ID NO: 86655 - DNA, 15 bp, Homo sapiens
ttatcatctgtttgt

SEQ ID NO: 86656 - DNA, 15 bp, Homo sapiens
gttatcatctgtttg

SEQ ID NO: 86657 - DNA, 15 bp, Homo sapiens
agttatcatctgttt

SEQ ID NO: 86658 - DNA, 15 bp, Homo sapiens
aagttatcatctgtt

SEQ ID NO: 86659 - DNA, 15 bp, Homo sapiens
gaagttatcatctgt

SEQ ID NO: 86660 - DNA, 15 bp, Homo sapiens
ggaagttatcatctg

SEQ ID NO: 86661 - DNA, 15 bp, Homo sapiens
gggaagttatcatct

SEQ ID NO: 86662 - DNA, 15 bp, Homo sapiens
agggaagttatcatc

SEQ ID NO: 86663 - DNA, 15 bp, Homo sapiens
aagggaagttatcat

SEQ ID NO: 86664 - DNA, 15 bp, Homo sapiens
caagggaagttatca

SEQ ID NO: 86665 - DNA, 15 bp, Homo sapiens
tcaagggaagttatc

SEQ ID NO: 86666 - DNA, 15 bp, Homo sapiens
ctcaagggaagttat

SEQ ID NO: 86667 - DNA, 15 bp, Homo sapiens
tctcaagggaagtta

SEQ ID NO: 86668 - DNA, 15 bp, Homo sapiens
atctcaagggaagtt

SEQ ID NO: 86669 - DNA, 15 bp, Homo sapiens
aatctcaagggaagt

SEQ ID NO: 86670 - DNA, 15 bp, Homo sapiens
gaatctcaagggaag

SEQ ID NO: 86671 - DNA, 15 bp, Homo sapiens
tgaatctcaagggaa

SEQ ID NO: 86672 - DNA, 15 bp, Homo sapiens
atgaatctcaaggga

SEQ ID NO: 86673 - DNA, 15 bp, Homo sapiens
aatgaatctcaaggg

SEQ ID NO: 86674 - DNA, 15 bp, Homo sapiens
gaatgaatctcaagg

SEQ ID NO: 86675 - DNA, 15 bp, Homo sapiens
tgaatgaatctcaag

SEQ ID NO: 86676 - DNA, 15 bp, Homo sapiens
ttgaatgaatctcaa

SEQ ID NO: 86677 - DNA, 15 bp, Homo sapiens
attgaatgaatctca

SEQ ID NO: 86678 - DNA, 15 bp, Homo sapiens
tattgaatgaatctc

SEQ ID NO: 86679 - DNA, 15 bp, Homo sapiens
ttattgaatgaatct

SEQ ID NO: 86680 - DNA, 15 bp, Homo sapiens
attattgaatgaatc

SEQ ID NO: 86681 - DNA, 15 bp, Homo sapiens
aattattgaatgaat

SEQ ID NO: 86682 - DNA, 15 bp, Homo sapiens
ataattattgaatga

SEQ ID NO: 86683 - DNA, 15 bp, Homo sapiens
tataattattgaatg

SEQ ID NO: 86684 - DNA, 15 bp, Homo sapiens
ttataattattgaat

SEQ ID NO: 86685 - DNA, 15 bp, Homo sapiens
attataattattgaa

SEQ ID NO: 86686 - DNA, 15 bp, Homo sapiens
cattataattattga

SEQ ID NO: 86687 - DNA, 15 bp, Homo sapiens
gcattataattattg

SEQ ID NO: 86688 - DNA, 15 bp, Homo sapiens
tgcattataattatt

SEQ ID NO: 86689 - DNA, 15 bp, Homo sapiens
atgcattataattat

SEQ ID NO: 86690 - DNA, 15 bp, Homo sapiens
aatgcattataatta

SEQ ID NO: 86691 - DNA, 15 bp, Homo sapiens
caatgcattataatt

SEQ ID NO: 86692 - DNA, 15 bp, Homo sapiens
ccaatgcattataat

SEQ ID NO: 86693 - DNA, 15 bp, Homo sapiens
tccaatgcattataa

SEQ ID NO: 86694 - DNA, 15 bp, Homo sapiens
atccaatgcattata

SEQ ID NO: 86695 - DNA, 15 bp, Homo sapiens
catccaatgcattat

SEQ ID NO: 86696 - DNA, 15 bp, Homo sapiens
acatccaatgcatta

SEQ ID NO: 86697 - DNA, 15 bp, Homo sapiens
aacatccaatgcatt

SEQ ID NO: 86698 - DNA, 15 bp, Homo sapiens
caacatccaatgcat

SEQ ID NO: 86699 - DNA, 15 bp, Homo sapiens
tcaacatccaatgca

SEQ ID NO: 86700 - DNA, 15 bp, Homo sapiens
ttcaacatccaatgc

SEQ ID NO: 86701 - DNA, 15 bp, Homo sapiens
attcaacatccaatg

SEQ ID NO: 86702 - DNA, 15 bp, Homo sapiens
aattcaacatccaat

SEQ ID NO: 86703 - DNA, 15 bp, Homo sapiens
aaattcaacatccaa

SEQ ID NO: 86704 - DNA, 15 bp, Homo sapiens
taaattcaacatcca

SEQ ID NO: 86705 - DNA, 15 bp, Homo sapiens
ataaattcaacatcc

SEQ ID NO: 86706 - DNA, 15 bp, Homo sapiens
aataaattcaacatc

SEQ ID NO: 86707 - DNA, 15 bp, Homo sapiens
aaataaattcaacat

SEQ ID NO: 86708 - DNA, 15 bp, Homo sapiens
gaaataaattcaaca

SEQ ID NO: 86709 - DNA, 15 bp, Homo sapiens
ggaaataaattcaac

SEQ ID NO: 86710 - DNA, 15 bp, Homo sapiens
aggaaataaattcaa

SEQ ID NO: 86711 - DNA, 15 bp, Homo sapiens
aaggaaataaattca

SEQ ID NO: 86712 - DNA, 15 bp, Homo sapiens
aaaggaaataaattc

SEQ ID NO: 86713 - DNA, 15 bp, Homo sapiens
taaaggaaataaatt

SEQ ID NO: 86714 - DNA, 15 bp, Homo sapiens
gtaaaggaaataaat

SEQ ID NO: 86715 - DNA, 15 bp, Homo sapiens
tgtaaaggaaataaa

SEQ ID NO: 86716 - DNA, 15 bp, Homo sapiens
ttgtaaaggaaataa

SEQ ID NO: 86717 - DNA, 15 bp, Homo sapiens
cttgtaaaggaaata

SEQ ID NO: 86718 - DNA, 15 bp, Homo sapiens
gcttgtaaaggaaat

SEQ ID NO: 86719 - DNA, 15 bp, Homo sapiens
tgcttgtaaaggaaa

SEQ ID NO: 86720 - DNA, 15 bp, Homo sapiens
atgcttgtaaaggaa

SEQ ID NO: 86721 - DNA, 15 bp, Homo sapiens
tatgcttgtaaagga

SEQ ID NO: 86722 - DNA, 15 bp, Homo sapiens
ctatgcttgtaaagg

SEQ ID NO: 86723 - DNA, 15 bp, Homo sapiens
tctatgcttgtaaag

SEQ ID NO: 86724 - DNA, 15 bp, Homo sapiens
atctatgcttgtaaa

SEQ ID NO: 86725 - DNA, 15 bp, Homo sapiens
aatctatgcttgtaa

SEQ ID NO: 86726 - DNA, 15 bp, Homo sapiens
aaatctatgcttgta

SEQ ID NO: 86727 - DNA, 15 bp, Homo sapiens
aaaatctatgcttgt

SEQ ID NO: 86728 - DNA, 15 bp, Homo sapiens
aaaaatctatgcttg

SEQ ID NO: 86729 - DNA, 15 bp, Homo sapiens
aaaaaatctatgctt

SEQ ID NO: 86730 - DNA, 15 bp, Homo sapiens
taaaaaatctatgct

SEQ ID NO: 86731 - DNA, 15 bp, Homo sapiens
gtaaaaaatctatgc

SEQ ID NO: 86732 - DNA, 15 bp, Homo sapiens
agtaaaaaatctatg

SEQ ID NO: 86733 - DNA, 15 bp, Homo sapiens
aagtaaaaaatctat

SEQ ID NO: 86734 - DNA, 15 bp, Homo sapiens
gaagtaaaaaatcta

SEQ ID NO: 86735 - DNA, 15 bp, Homo sapiens
agaagtaaaaaatct

SEQ ID NO: 86736 - DNA, 15 bp, Homo sapiens
tagaagtaaaaaatc

SEQ ID NO: 86737 - DNA, 15 bp, Homo sapiens
gtagaagtaaaaaat

SEQ ID NO: 86738 - DNA, 15 bp, Homo sapiens
ggtagaagtaaaaaa

SEQ ID NO: 86739 - DNA, 15 bp, Homo sapiens
aggtagaagtaaaaa

SEQ ID NO: 86740 - DNA, 15 bp, Homo sapiens
gaggtagaagtaaaa

SEQ ID NO: 86741 - DNA, 15 bp, Homo sapiens
tgaggtagaagtaaa

SEQ ID NO: 86742 - DNA, 15 bp, Homo sapiens
ctgaggtagaagtaa

SEQ ID NO: 86743 - DNA, 15 bp, Homo sapiens
gctgaggtagaagta

SEQ ID NO: 86744 - DNA, 15 bp, Homo sapiens
tgctgaggtagaagt

SEQ ID NO: 86745 - DNA, 15 bp, Homo sapiens
atgctgaggtagaag

SEQ ID NO: 86746 - DNA, 15 bp, Homo sapiens
aatgctgaggtagaa

SEQ ID NO: 86747 - DNA, 15 bp, Homo sapiens
caatgctgaggtaga

SEQ ID NO: 86748 - DNA, 15 bp, Homo sapiens
acaatgctgaggtag

SEQ ID NO: 86749 - DNA, 15 bp, Homo sapiens
tacaatgctgaggta

SEQ ID NO: 86750 - DNA, 15 bp, Homo sapiens
gtacaatgctgaggt

SEQ ID NO: 86751 - DNA, 15 bp, Homo sapiens
ggtacaatgctgagg

SEQ ID NO: 86752 - DNA, 15 bp, Homo sapiens
aggtacaatgctgag

SEQ ID NO: 86753 - DNA, 15 bp, Homo sapiens
caggtacaatgctga

SEQ ID NO: 86754 - DNA, 15 bp, Homo sapiens
ccaggtacaatgctg

SEQ ID NO: 86755 - DNA, 15 bp, Homo sapiens
accaggtacaatgct

SEQ ID NO: 86756 - DNA, 15 bp, Homo sapiens
caccaggtacaatgc

SEQ ID NO: 86757 - DNA, 15 bp, Homo sapiens
tcaccaggtacaatg

SEQ ID NO: 86758 - DNA, 15 bp, Homo sapiens
gtcaccaggtacaat

SEQ ID NO: 86759 - DNA, 15 bp, Homo sapiens
agtcaccaggtacaa

SEQ ID NO: 86760 - DNA, 15 bp, Homo sapiens
gagtcaccaggtaca

SEQ ID NO: 86761 - DNA, 15 bp, Homo sapiens
agagtcaccaggtac

SEQ ID NO: 86762 - DNA, 15 bp, Homo sapiens
cagagtcaccaggta

SEQ ID NO: 86763 - DNA, 15 bp, Homo sapiens
tcagagtcaccaggt

SEQ ID NO: 86764 - DNA, 15 bp, Homo sapiens
gtcagagtcaccagg

SEQ ID NO: 86765 - DNA, 15 bp, Homo sapiens
agtcagagtcaccag

SEQ ID NO: 86766 - DNA, 15 bp, Homo sapiens
aagtcagagtcacca

SEQ ID NO: 86767 - DNA, 15 bp, Homo sapiens
aaagtcagagtcacc

SEQ ID NO: 86768 - DNA, 15 bp, Homo sapiens
taaagtcagagtcac

SEQ ID NO: 86769 - DNA, 15 bp, Homo sapiens
ataaagtcagagtca

SEQ ID NO: 86770 - DNA, 15 bp, Homo sapiens
gataaagtcagagtc

SEQ ID NO: 86771 - DNA, 15 bp, Homo sapiens
agataaagtcagagt

SEQ ID NO: 86772 - DNA, 15 bp, Homo sapiens
cagataaagtcagag

SEQ ID NO: 86773 - DNA, 15 bp, Homo sapiens
tcagataaagtcaga

SEQ ID NO: 86774 - DNA, 15 bp, Homo sapiens
atcagataaagtcag

SEQ ID NO: 86775 - DNA, 15 bp, Homo sapiens
catcagataaagtca

SEQ ID NO: 86776 - DNA, 15 bp, Homo sapiens
acatcagataaagtc

SEQ ID NO: 86777 - DNA, 15 bp, Homo sapiens
cacatcagataaagt

SEQ ID NO: 86778 - DNA, 15 bp, Homo sapiens
tcacatcagataaag

SEQ ID NO: 86779 - DNA, 15 bp, Homo sapiens
ttcacatcagataaa

SEQ ID NO: 86780 - DNA, 15 bp, Homo sapiens
attcacatcagataa

SEQ ID NO: 86781 - DNA, 15 bp, Homo sapiens
tattcacatcagata

SEQ ID NO: 86782 - DNA, 15 bp, Homo sapiens
atattcacatcagat

SEQ ID NO: 86783 - DNA, 15 bp, Homo sapiens
catattcacatcaga

SEQ ID NO: 86784 - DNA, 15 bp, Homo sapiens
ccatattcacatcag

SEQ ID NO: 86785 - DNA, 15 bp, Homo sapiens
cccatattcacatca

SEQ ID NO: 86786 - DNA, 15 bp, Homo sapiens
tcccatattcacatc

SEQ ID NO: 86787 - DNA, 15 bp, Homo sapiens
atcccatattcacat

SEQ ID NO: 86788 - DNA, 15 bp, Homo sapiens
tatcccatattcaca

SEQ ID NO: 86789 - DNA, 15 bp, Homo sapiens
ttatcccatattcac

SEQ ID NO: 86790 - DNA, 15 bp, Homo sapiens
attatcccatattca

SEQ ID NO: 86791 - DNA, 15 bp, Homo sapiens
aattatcccatattc

SEQ ID NO: 86792 - DNA, 15 bp, Homo sapiens
aaattatcccatatt

SEQ ID NO: 86793 - DNA, 15 bp, Homo sapiens
gaaattatcccatat

SEQ ID NO: 86794 - DNA, 15 bp, Homo sapiens
agaaattatcccata

SEQ ID NO: 86795 - DNA, 15 bp, Homo sapiens
aagaaattatcccat

SEQ ID NO: 86796 - DNA, 15 bp, Homo sapiens
caagaaattatccca

SEQ ID NO: 86797 - DNA, 15 bp, Homo sapiens
tcaagaaattatccc

SEQ ID NO: 86798 - DNA, 15 bp, Homo sapiens
ttcaagaaattatcc

SEQ ID NO: 86799 - DNA, 15 bp, Homo sapiens
attcaagaaattatc

SEQ ID NO: 86800 - DNA, 15 bp, Homo sapiens
gattcaagaaattat

SEQ ID NO: 86801 - DNA, 15 bp, Homo sapiens
agattcaagaaatta

SEQ ID NO: 86802 - DNA, 15 bp, Homo sapiens
cagattcaagaaatt

SEQ ID NO: 86803 - DNA, 15 bp, Homo sapiens
acagattcaagaaat

SEQ ID NO: 86804 - DNA, 15 bp, Homo sapiens
cacagattcaagaaa

SEQ ID NO: 86805 - DNA, 15 bp, Homo sapiens
acacagattcaagaa

SEQ ID NO: 86806 - DNA, 15 bp, Homo sapiens
tacacagattcaaga

SEQ ID NO: 86807 - DNA, 15 bp, Homo sapiens
gtacacagattcaag

SEQ ID NO: 86808 - DNA, 15 bp, Homo sapiens
agtacacagattcaa

SEQ ID NO: 86809 - DNA, 15 bp, Homo sapiens
cagtacacagattca

SEQ ID NO: 86810 - DNA, 15 bp, Homo sapiens
tcagtacacagattc

SEQ ID NO: 86811 - DNA, 15 bp, Homo sapiens
ttcagtacacagatt

SEQ ID NO: 86812 - DNA, 15 bp, Homo sapiens
attcagtacacagat

SEQ ID NO: 86813 - DNA, 15 bp, Homo sapiens
aattcagtacacaga

SEQ ID NO: 86814 - DNA, 15 bp, Homo sapiens
aaattcagtacacag

SEQ ID NO: 86815 - DNA, 15 bp, Homo sapiens
taaattcagtacaca

SEQ ID NO: 86816 - DNA, 15 bp, Homo sapiens
gtaaattcagtacac

SEQ ID NO: 86817 - DNA, 15 bp, Homo sapiens
agtaaattcagtaca

SEQ ID NO: 86818 - DNA, 15 bp, Homo sapiens
gagtaaattcagtac

SEQ ID NO: 86819 - DNA, 15 bp, Homo sapiens
ggagtaaattcagta

SEQ ID NO: 86820 - DNA, 15 bp, Homo sapiens
gggagtaaattcagt

SEQ ID NO: 86821 - DNA, 15 bp, Homo sapiens
tgggagtaaattcag

SEQ ID NO: 86822 - DNA, 15 bp, Homo sapiens
atgggagtaaattca

SEQ ID NO: 86823 - DNA, 15 bp, Homo sapiens
aatgggagtaaattc

SEQ ID NO: 86824 - DNA, 15 bp, Homo sapiens
aaatgggagtaaatt

SEQ ID NO: 86825 - DNA, 15 bp, Homo sapiens
gaaatgggagtaaat

SEQ ID NO: 86826 - DNA, 15 bp, Homo sapiens
agaaatgggagtaaa

SEQ ID NO: 86827 - DNA, 15 bp, Homo sapiens
cagaaatgggagtaa

SEQ ID NO: 86828 - DNA, 15 bp, Homo sapiens
acagaaatgggagta

SEQ ID NO: 86829 - DNA, 15 bp, Homo sapiens
gacagaaatgggagt

SEQ ID NO: 86830 - DNA, 15 bp, Homo sapiens
tgacagaaatgggag

SEQ ID NO: 86831 - DNA, 15 bp, Homo sapiens
ctgacagaaatggga

SEQ ID NO: 86832 - DNA, 15 bp, Homo sapiens
cctgacagaaatggg

SEQ ID NO: 86833 - DNA, 15 bp, Homo sapiens
acctgacagaaatgg

SEQ ID NO: 86834 - DNA, 15 bp, Homo sapiens
aacctgacagaaatg

SEQ ID NO: 86835 - DNA, 15 bp, Homo sapiens
aaacctgacagaaat

SEQ ID NO: 86836 - DNA, 15 bp, Homo sapiens
aaaacctgacagaaa

SEQ ID NO: 86837 - DNA, 15 bp, Homo sapiens
gaaaacctgacagaa

SEQ ID NO: 86838 - DNA, 15 bp, Homo sapiens
tgaaaacctgacaga

SEQ ID NO: 86839 - DNA, 15 bp, Homo sapiens
ctgaaaacctgacag

SEQ ID NO: 86840 - DNA, 15 bp, Homo sapiens
gctgaaaacctgaca

SEQ ID NO: 86841 - DNA, 15 bp, Homo sapiens
tgctgaaaacctgac

SEQ ID NO: 86842 - DNA, 15 bp, Homo sapiens
ctgctgaaaacctga

SEQ ID NO: 86843 - DNA, 15 bp, Homo sapiens
actgctgaaaacctg

SEQ ID NO: 86844 - DNA, 15 bp, Homo sapiens
cactgctgaaaacct

SEQ ID NO: 86845 - DNA, 15 bp, Homo sapiens
acactgctgaaaacc

SEQ ID NO: 86846 - DNA, 15 bp, Homo sapiens
cacactgctgaaaac

SEQ ID NO: 86847 - DNA, 15 bp, Homo sapiens
ccacactgctgaaaa

SEQ ID NO: 86848 - DNA, 15 bp, Homo sapiens
gccacactgctgaaa

SEQ ID NO: 86849 - DNA, 15 bp, Homo sapiens
tgccacactgctgaa

SEQ ID NO: 86850 - DNA, 15 bp, Homo sapiens
ctgccacactgctga

SEQ ID NO: 86851 - DNA, 15 bp, Homo sapiens
tctgccacactgctg

SEQ ID NO: 86852 - DNA, 15 bp, Homo sapiens
ttctgccacactgct

SEQ ID NO: 86853 - DNA, 15 bp, Homo sapiens
attctgccacactgc

SEQ ID NO: 86854 - DNA, 15 bp, Homo sapiens
aattctgccacactg

SEQ ID NO: 86855 - DNA, 15 bp, Homo sapiens
taattctgccacact

SEQ ID NO: 86856 - DNA, 15 bp, Homo sapiens
ataattctgccacac

SEQ ID NO: 86857 - DNA, 15 bp, Homo sapiens
cataattctgccaca

SEQ ID NO: 86858 - DNA, 15 bp, Homo sapiens
tcataattctgccac

SEQ ID NO: 86859 - DNA, 15 bp, Homo sapiens
ttcataattctgcca

SEQ ID NO: 86860 - DNA, 15 bp, Homo sapiens
cttcataattctgcc

SEQ ID NO: 86861 - DNA, 15 bp, Homo sapiens
tcttcataattctgc

SEQ ID NO: 86862 - DNA, 15 bp, Homo sapiens
atcttcataattctg

SEQ ID NO: 86863 - DNA, 15 bp, Homo sapiens
catcttcataattct

SEQ ID NO: 86864 - DNA, 15 bp, Homo sapiens
ccatcttcataattc

SEQ ID NO: 86865 - DNA, 15 bp, Homo sapiens
cccatcttcataatt

SEQ ID NO: 86866 - DNA, 15 bp, Homo sapiens
ccccatcttcataat

SEQ ID NO: 86867 - DNA, 15 bp, Homo sapiens
cccccatcttcataa

SEQ ID NO: 86868 - DNA, 15 bp, Homo sapiens
tcccccatcttcata

SEQ ID NO: 86869 - DNA, 15 bp, Homo sapiens
ctcccccatcttcat

SEQ ID NO: 86870 - DNA, 15 bp, Homo sapiens
tctcccccatcttca

SEQ ID NO: 86871 - DNA, 15 bp, Homo sapiens
gtctcccccatcttc

SEQ ID NO: 86872 - DNA, 15 bp, Homo sapiens
agtctcccccatctt

SEQ ID NO: 86873 - DNA, 15 bp, Homo sapiens
aagtctcccccatct

SEQ ID NO: 86874 - DNA, 15 bp, Homo sapiens
caagtctcccccatc

SEQ ID NO: 86875 - DNA, 15 bp, Homo sapiens
tcaagtctcccccat

SEQ ID NO: 86876 - DNA, 15 bp, Homo sapiens
atcaagtctccccca

SEQ ID NO: 86877 - DNA, 15 bp, Homo sapiens
catcaagtctccccc

SEQ ID NO: 86878 - DNA, 15 bp, Homo sapiens
acatcaagtctcccc

SEQ ID NO: 86879 - DNA, 15 bp, Homo sapiens
tacatcaagtctccc

SEQ ID NO: 86880 - DNA, 15 bp, Homo sapiens
ctacatcaagtctcc

SEQ ID NO: 86881 - DNA, 15 bp, Homo sapiens
tctacatcaagtctc

SEQ ID NO: 86882 - DNA, 15 bp, Homo sapiens
atctacatcaagtct

SEQ ID NO: 86883 - DNA, 15 bp, Homo sapiens
catctacatcaagtc

SEQ ID NO: 86884 - DNA, 15 bp, Homo sapiens
tcatctacatcaagt

SEQ ID NO: 86885 - DNA, 15 bp, Homo sapiens
ctcatctacatcaag

SEQ ID NO: 86886 - DNA, 15 bp, Homo sapiens
tctcatctacatcaa

SEQ ID NO: 86887 - DNA, 15 bp, Homo sapiens
ttctcatctacatca

SEQ ID NO: 86888 - DNA, 15 bp, Homo sapiens
cttctcatctacatc

SEQ ID NO: 86889 - DNA, 15 bp, Homo sapiens
acttctcatctacat

SEQ ID NO: 86890 - DNA, 15 bp, Homo sapiens
aacttctcatctaca

SEQ ID NO: 86891 - DNA, 15 bp, Homo sapiens
caacttctcatctac

SEQ ID NO: 86892 - DNA, 15 bp, Homo sapiens
ccaacttctcatcta

SEQ ID NO: 86893 - DNA, 15 bp, Homo sapiens
accaacttctcatct

SEQ ID NO: 86894 - DNA, 15 bp, Homo sapiens
caccaacttctcatc

SEQ ID NO: 86895 - DNA, 15 bp, Homo sapiens
gcaccaacttctcat

SEQ ID NO: 86896 - DNA, 15 bp, Homo sapiens
cgcaccaacttctca

SEQ ID NO: 86897 - DNA, 15 bp, Homo sapiens
tcgcaccaacttctc

SEQ ID NO: 86898 - DNA, 15 bp, Homo sapiens
ctcgcaccaacttct

SEQ ID NO: 86899 - DNA, 15 bp, Homo sapiens
cctcgcaccaacttc

SEQ ID NO: 86900 - DNA, 15 bp, Homo sapiens
acctcgcaccaactt

SEQ ID NO: 86901 - DNA, 15 bp, Homo sapiens
cacctcgcaccaact

SEQ ID NO: 86902 - DNA, 15 bp, Homo sapiens
tcacctcgcaccaac

SEQ ID NO: 86903 - DNA, 15 bp, Homo sapiens
atcacctcgcaccaa

SEQ ID NO: 86904 - DNA, 15 bp, Homo sapiens
catcacctcgcacca

SEQ ID NO: 86905 - DNA, 15 bp, Homo sapiens
acatcacctcgcacc

SEQ ID NO: 86906 - DNA, 15 bp, Homo sapiens
aacatcacctcgcac

SEQ ID NO: 86907 - DNA, 15 bp, Homo sapiens
taacatcacctcgca

SEQ ID NO: 86908 - DNA, 15 bp, Homo sapiens
ataacatcacctcgc

SEQ ID NO: 86909 - DNA, 15 bp, Homo sapiens
tataacatcacctcg

SEQ ID NO: 86910 - DNA, 15 bp, Homo sapiens
ctataacatcacctc

SEQ ID NO: 86911 - DNA, 15 bp, Homo sapiens
actataacatcacct

SEQ ID NO: 86912 - DNA, 15 bp, Homo sapiens
cactataacatcacc

SEQ ID NO: 86913 - DNA, 15 bp, Homo sapiens
tcactataacatcac

SEQ ID NO: 86914 - DNA, 15 bp, Homo sapiens
ctcactataacatca

SEQ ID NO: 86915 - DNA, 15 bp, Homo sapiens
tctcactataacatc

SEQ ID NO: 86916 - DNA, 15 bp, Homo sapiens
ttctcactataacat

SEQ ID NO: 86917 - DNA, 15 bp, Homo sapiens
attctcactataaca

SEQ ID NO: 86918 - DNA, 15 bp, Homo sapiens
tattctcactataac

SEQ ID NO: 86919 - DNA, 15 bp, Homo sapiens
ttattctcactataa

SEQ ID NO: 86920 - DNA, 15 bp, Homo sapiens
gttattctcactata

SEQ ID NO: 86921 - DNA, 15 bp, Homo sapiens
tgttattctcactat

SEQ ID NO: 86922 - DNA, 15 bp, Homo sapiens
ctgttattctcacta

SEQ ID NO: 86923 - DNA, 15 bp, Homo sapiens
actgttattctcact

SEQ ID NO: 86924 - DNA, 15 bp, Homo sapiens
cactgttattctcac

SEQ ID NO: 86925 - DNA, 15 bp, Homo sapiens
tcactgttattctca

SEQ ID NO: 86926 - DNA, 15 bp, Homo sapiens
atcactgttattctc

SEQ ID NO: 86927 - DNA, 15 bp, Homo sapiens
aatcactgttattct

SEQ ID NO: 86928 - DNA, 15 bp, Homo sapiens
caatcactgttattc

SEQ ID NO: 86929 - DNA, 15 bp, Homo sapiens
ccaatcactgttatt

SEQ ID NO: 86930 - DNA, 15 bp, Homo sapiens
cccaatcactgttat

SEQ ID NO: 86931 - DNA, 15 bp, Homo sapiens
ccccaatcactgtta

SEQ ID NO: 86932 - DNA, 15 bp, Homo sapiens
cccccaatcactgtt

SEQ ID NO: 86933 - DNA, 15 bp, Homo sapiens
tcccccaatcactgt

SEQ ID NO: 86934 - DNA, 15 bp, Homo sapiens
ttcccccaatcactg

SEQ ID NO: 86935 - DNA, 15 bp, Homo sapiens
attcccccaatcact

SEQ ID NO: 86936 - DNA, 15 bp, Homo sapiens
cattcccccaatcac

SEQ ID NO: 86937 - DNA, 15 bp, Homo sapiens
ccattcccccaatca

SEQ ID NO: 86938 - DNA, 15 bp, Homo sapiens
cccattcccccaatc

SEQ ID NO: 86939 - DNA, 15 bp, Homo sapiens
gcccattcccccaat

SEQ ID NO: 86940 - DNA, 15 bp, Homo sapiens
tgcccattcccccaa

SEQ ID NO: 86941 - DNA, 15 bp, Homo sapiens
ttgcccattccccca

SEQ ID NO: 86942 - DNA, 15 bp, Homo sapiens
tttgcccattccccc

SEQ ID NO: 86943 - DNA, 15 bp, Homo sapiens
gtttgcccattcccc

SEQ ID NO: 86944 - DNA, 15 bp, Homo sapiens
agtttgcccattccc

SEQ ID NO: 86945 - DNA, 15 bp, Homo sapiens
aagtttgcccattcc

SEQ ID NO: 86946 - DNA, 15 bp, Homo sapiens
caagtttgcccattc

SEQ ID NO: 86947 - DNA, 15 bp, Homo sapiens
ccaagtttgcccatt

SEQ ID NO: 86948 - DNA, 15 bp, Homo sapiens
tccaagtttgcccat

SEQ ID NO: 86949 - DNA, 15 bp, Homo sapiens
atccaagtttgccca

SEQ ID NO: 86950 - DNA, 15 bp, Homo sapiens
aatccaagtttgccc

SEQ ID NO: 86951 - DNA, 15 bp, Homo sapiens
gaatccaagtttgcc

SEQ ID NO: 86952 - DNA, 15 bp, Homo sapiens
agaatccaagtttgc

SEQ ID NO: 86953 - DNA, 15 bp, Homo sapiens
gagaatccaagtttg

SEQ ID NO: 86954 - DNA, 15 bp, Homo sapiens
ggagaatccaagttt

SEQ ID NO: 86955 - DNA, 15 bp, Homo sapiens
aggagaatccaagtt

SEQ ID NO: 86956 - DNA, 15 bp, Homo sapiens
caggagaatccaagt

SEQ ID NO: 86957 - DNA, 15 bp, Homo sapiens
acaggagaatccaag

SEQ ID NO: 86958 - DNA, 15 bp, Homo sapiens
gacaggagaatccaa

SEQ ID NO: 86959 - DNA, 15 bp, Homo sapiens
ggacaggagaatcca

SEQ ID NO: 86960 - DNA, 15 bp, Homo sapiens
aggacaggagaatcc

SEQ ID NO: 86961 - DNA, 15 bp, Homo sapiens
aaggacaggagaatc

SEQ ID NO: 86962 - DNA, 15 bp, Homo sapiens
aaaggacaggagaat

SEQ ID NO: 86963 - DNA, 15 bp, Homo sapiens
aaaaggacaggagaa

SEQ ID NO: 86964 - DNA, 15 bp, Homo sapiens
gaaaaggacaggaga

SEQ ID NO: 86965 - DNA, 15 bp, Homo sapiens
agaaaaggacaggag

SEQ ID NO: 86966 - DNA, 15 bp, Homo sapiens
tagaaaaggacagga

SEQ ID NO: 86967 - DNA, 15 bp, Homo sapiens
ctagaaaaggacagg

SEQ ID NO: 86968 - DNA, 15 bp, Homo sapiens
actagaaaaggacag

SEQ ID NO: 86969 - DNA, 15 bp, Homo sapiens
aactagaaaaggaca

SEQ ID NO: 86970 - DNA, 15 bp, Homo sapiens
aaactagaaaaggac

SEQ ID NO: 86971 - DNA, 15 bp, Homo sapiens
gaaactagaaaagga

SEQ ID NO: 86972 - DNA, 15 bp, Homo sapiens
agaaactagaaaagg

SEQ ID NO: 86973 - DNA, 15 bp, Homo sapiens
aagaaactagaaaag

SEQ ID NO: 86974 - DNA, 15 bp, Homo sapiens
taagaaactagaaaa

SEQ ID NO: 86975 - DNA, 15 bp, Homo sapiens
ataagaaactagaaa

SEQ ID NO: 86976 - DNA, 15 bp, Homo sapiens
gataagaaactagaa

SEQ ID NO: 86977 - DNA, 15 bp, Homo sapiens
ggataagaaactaga

SEQ ID NO: 86978 - DNA, 15 bp, Homo sapiens
aggataagaaactag

SEQ ID NO: 86979 - DNA, 15 bp, Homo sapiens
aaggataagaaacta

SEQ ID NO: 86980 - DNA, 15 bp, Homo sapiens
caaggataagaaact

SEQ ID NO: 86981 - DNA, 15 bp, Homo sapiens
ccaaggataagaaac

SEQ ID NO: 86982 - DNA, 15 bp, Homo sapiens
cccaaggataagaaa

SEQ ID NO: 86983 - DNA, 15 bp, Homo sapiens
tcccaaggataagaa

SEQ ID NO: 86984 - DNA, 15 bp, Homo sapiens
ttcccaaggataaga

SEQ ID NO: 86985 - DNA, 15 bp, Homo sapiens
tttcccaaggataag

SEQ ID NO: 86986 - DNA, 15 bp, Homo sapiens
ctttcccaaggataa

SEQ ID NO: 86987 - DNA, 15 bp, Homo sapiens
actttcccaaggata

SEQ ID NO: 86988 - DNA, 15 bp, Homo sapiens
gactttcccaaggat

SEQ ID NO: 86989 - DNA, 15 bp, Homo sapiens
agactttcccaagga

SEQ ID NO: 86990 - DNA, 15 bp, Homo sapiens
aagactttcccaagg

SEQ ID NO: 86991 - DNA, 15 bp, Homo sapiens
caagactttcccaag

SEQ ID NO: 86992 - DNA, 15 bp, Homo sapiens
ccaagactttcccaa

SEQ ID NO: 86993 - DNA, 15 bp, Homo sapiens
tccaagactttccca

SEQ ID NO: 86994 - DNA, 15 bp, Homo sapiens
ttccaagactttccc

SEQ ID NO: 86995 - DNA, 15 bp, Homo sapiens
gttccaagactttcc

SEQ ID NO: 86996 - DNA, 15 bp, Homo sapiens
ggttccaagactttc

SEQ ID NO: 86997 - DNA, 15 bp, Homo sapiens
gggttccaagacttt

SEQ ID NO: 86998 - DNA, 15 bp, Homo sapiens
agggttccaagactt

SEQ ID NO: 86999 - DNA, 15 bp, Homo sapiens
aagggttccaagact

SEQ ID NO: 87000 - DNA, 15 bp, Homo sapiens
caagggttccaagac

SEQ ID NO: 87001 - DNA, 15 bp, Homo sapiens
acaagggttccaaga

SEQ ID NO: 87002 - DNA, 15 bp, Homo sapiens
aacaagggttccaag

SEQ ID NO: 87003 - DNA, 15 bp, Homo sapiens
aaacaagggttccaa

SEQ ID NO: 87004 - DNA, 15 bp, Homo sapiens
gaaacaagggttcca

SEQ ID NO: 87005 - DNA, 15 bp, Homo sapiens
agaaacaagggttcc

SEQ ID NO: 87006 - DNA, 15 bp, Homo sapiens
aagaaacaagggttc

SEQ ID NO: 87007 - DNA, 15 bp, Homo sapiens
aaagaaacaagggtt

SEQ ID NO: 87008 - DNA, 15 bp, Homo sapiens
caaagaaacaagggt

SEQ ID NO: 87009 - DNA, 15 bp, Homo sapiens
gcaaagaaacaaggg

SEQ ID NO: 87010 - DNA, 15 bp, Homo sapiens
ggcaaagaaacaagg

SEQ ID NO: 87011 - DNA, 15 bp, Homo sapiens
aggcaaagaaacaag

SEQ ID NO: 87012 - DNA, 15 bp, Homo sapiens
aaggcaaagaaacaa

SEQ ID NO: 87013 - DNA, 15 bp, Homo sapiens
caaggcaaagaaaca

SEQ ID NO: 87014 - DNA, 15 bp, Homo sapiens
ccaaggcaaagaaac

SEQ ID NO: 87015 - DNA, 15 bp, Homo sapiens
accaaggcaaagaaa

SEQ ID NO: 87016 - DNA, 15 bp, Homo sapiens
caccaaggcaaagaa

SEQ ID NO: 87017 - DNA, 15 bp, Homo sapiens
acaccaaggcaaaga

SEQ ID NO: 87018 - DNA, 15 bp, Homo sapiens
gacaccaaggcaaag

SEQ ID NO: 87019 - DNA, 15 bp, Homo sapiens
agacaccaaggcaaa

SEQ ID NO: 87020 - DNA, 15 bp, Homo sapiens
cagacaccaaggcaa

SEQ ID NO: 87021 - DNA, 15 bp, Homo sapiens
ccagacaccaaggca

SEQ ID NO: 87022 - DNA, 15 bp, Homo sapiens
tccagacaccaaggc

SEQ ID NO: 87023 - DNA, 15 bp, Homo sapiens
ttccagacaccaagg

SEQ ID NO: 87024 - DNA, 15 bp, Homo sapiens
tttccagacaccaag

SEQ ID NO: 87025 - DNA, 15 bp, Homo sapiens
ttttccagacaccaa

SEQ ID NO: 87026 - DNA, 15 bp, Homo sapiens
attttccagacacca

SEQ ID NO: 87027 - DNA, 15 bp, Homo sapiens
cattttccagacacc

SEQ ID NO: 87028 - DNA, 15 bp, Homo sapiens
tcattttccagacac

SEQ ID NO: 87029 - DNA, 15 bp, Homo sapiens
ctcattttccagaca

SEQ ID NO: 87030 - DNA, 15 bp, Homo sapiens
cctcattttccagac

SEQ ID NO: 87031 - DNA, 15 bp, Homo sapiens
ccctcattttccaga

SEQ ID NO: 87032 - DNA, 15 bp, Homo sapiens
tccctcattttccag

SEQ ID NO: 87033 - DNA, 15 bp, Homo sapiens
ctccctcattttcca

SEQ ID NO: 87034 - DNA, 15 bp, Homo sapiens
actccctcattttcc

SEQ ID NO: 87035 - DNA, 15 bp, Homo sapiens
aactccctcattttc

SEQ ID NO: 87036 - DNA, 15 bp, Homo sapiens
aaactccctcatttt

SEQ ID NO: 87037 - DNA, 15 bp, Homo sapiens
taaactccctcattt

SEQ ID NO: 87038 - DNA, 15 bp, Homo sapiens
ataaactccctcatt

SEQ ID NO: 87039 - DNA, 15 bp, Homo sapiens
aataaactccctcat

SEQ ID NO: 87040 - DNA, 15 bp, Homo sapiens
taataaactccctca

SEQ ID NO: 87041 - DNA, 15 bp, Homo sapiens
ctaataaactccctc

SEQ ID NO: 87042 - DNA, 15 bp, Homo sapiens
gctaataaactccct

SEQ ID NO: 87043 - DNA, 15 bp, Homo sapiens
agctaataaactccc

SEQ ID NO: 87044 - DNA, 15 bp, Homo sapiens
cagctaataaactcc

SEQ ID NO: 87045 - DNA, 15 bp, Homo sapiens
tcagctaataaactc

SEQ ID NO: 87046 - DNA, 15 bp, Homo sapiens
gtcagctaataaact

SEQ ID NO: 87047 - DNA, 15 bp, Homo sapiens
agtcagctaataaac

SEQ ID NO: 87048 - DNA, 15 bp, Homo sapiens
gagtcagctaataaa

SEQ ID NO: 87049 - DNA, 15 bp, Homo sapiens
agagtcagctaataa

SEQ ID NO: 87050 - DNA, 15 bp, Homo sapiens
aagagtcagctaata

SEQ ID NO: 87051 - DNA, 15 bp, Homo sapiens
taagagtcagctaat

SEQ ID NO: 87052 - DNA, 15 bp, Homo sapiens
ctaagagtcagctaa

SEQ ID NO: 87053 - DNA, 15 bp, Homo sapiens
gctaagagtcagcta

SEQ ID NO: 87054 - DNA, 15 bp, Homo sapiens
agctaagagtcagct

SEQ ID NO: 87055 - DNA, 15 bp, Homo sapiens
cagctaagagtcagc

SEQ ID NO: 87056 - DNA, 15 bp, Homo sapiens
acagctaagagtcag

SEQ ID NO: 87057 - DNA, 15 bp, Homo sapiens
aacagctaagagtca

SEQ ID NO: 87058 - DNA, 15 bp, Homo sapiens
taacagctaagagtc

SEQ ID NO: 87059 - DNA, 15 bp, Homo sapiens
ctaacagctaagagt

SEQ ID NO: 87060 - DNA, 15 bp, Homo sapiens
actaacagctaagag

SEQ ID NO: 87061 - DNA, 15 bp, Homo sapiens
aactaacagctaaga

SEQ ID NO: 87062 - DNA, 15 bp, Homo sapiens
aaactaacagctaag

SEQ ID NO: 87063 - DNA, 15 bp, Homo sapiens
taaactaacagctaa

SEQ ID NO: 87064 - DNA, 15 bp, Homo sapiens
ataaactaacagcta

SEQ ID NO: 87065 - DNA, 15 bp, Homo sapiens
gataaactaacagct

SEQ ID NO: 87066 - DNA, 15 bp, Homo sapiens
tgataaactaacagc

SEQ ID NO: 87067 - DNA, 15 bp, Homo sapiens
ctgataaactaacag

SEQ ID NO: 87068 - DNA, 15 bp, Homo sapiens
cctgataaactaaca

SEQ ID NO: 87069 - DNA, 15 bp, Homo sapiens
acctgataaactaac

SEQ ID NO: 87070 - DNA, 15 bp, Homo sapiens
cacctgataaactaa

SEQ ID NO: 87071 - DNA, 15 bp, Homo sapiens
tcacctgataaacta

SEQ ID NO: 87072 - DNA, 15 bp, Homo sapiens
gtcacctgataaact

SEQ ID NO: 87073 - DNA, 15 bp, Homo sapiens
agtcacctgataaac

SEQ ID NO: 87074 - DNA, 15 bp, Homo sapiens
tagtcacctgataaa

SEQ ID NO: 87075 - DNA, 15 bp, Homo sapiens
atagtcacctgataa

SEQ ID NO: 87076 - DNA, 15 bp, Homo sapiens
aatagtcacctgata

SEQ ID NO: 87077 - DNA, 15 bp, Homo sapiens
taatagtcacctgat

SEQ ID NO: 87078 - DNA, 15 bp, Homo sapiens
ctaatagtcacctga

SEQ ID NO: 87079 - DNA, 15 bp, Homo sapiens
actaatagtcacctg

SEQ ID NO: 87080 - DNA, 15 bp, Homo sapiens
aactaatagtcacct

SEQ ID NO: 87081 - DNA, 15 bp, Homo sapiens
aaactaatagtcacc

SEQ ID NO: 87082 - DNA, 15 bp, Homo sapiens
taaactaatagtcac

SEQ ID NO: 87083 - DNA, 15 bp, Homo sapiens
ataaactaatagtca

SEQ ID NO: 87084 - DNA, 15 bp, Homo sapiens
aataaactaatagtc

SEQ ID NO: 87085 - DNA, 15 bp, Homo sapiens
taataaactaatagt

SEQ ID NO: 87086 - DNA, 15 bp, Homo sapiens
ctaataaactaatag

SEQ ID NO: 87087 - DNA, 15 bp, Homo sapiens
gctaataaactaata

SEQ ID NO: 87088 - DNA, 15 bp, Homo sapiens
agctaataaactaat

SEQ ID NO: 87089 - DNA, 15 bp, Homo sapiens
cagctaataaactaa

SEQ ID NO: 87090 - DNA, 15 bp, Homo sapiens
tcagctaataaacta

SEQ ID NO: 87091 - DNA, 15 bp, Homo sapiens
tagtcagctaataaa

SEQ ID NO: 87092 - DNA, 15 bp, Homo sapiens
atagtcagctaataa

SEQ ID NO: 87093 - DNA, 15 bp, Homo sapiens
tatagtcagctaata

SEQ ID NO: 87094 - DNA, 15 bp, Homo sapiens
ctatagtcagctaat

SEQ ID NO: 87095 - DNA, 15 bp, Homo sapiens
cctatagtcagctaa

SEQ ID NO: 87096 - DNA, 15 bp, Homo sapiens
gcctatagtcagcta

SEQ ID NO: 87097 - DNA, 15 bp, Homo sapiens
agcctatagtcagct

SEQ ID NO: 87098 - DNA, 15 bp, Homo sapiens
aagcctatagtcagc

SEQ ID NO: 87099 - DNA, 15 bp, Homo sapiens
aaagcctatagtcag

SEQ ID NO: 87100 - DNA, 15 bp, Homo sapiens
caaagcctatagtca

SEQ ID NO: 87101 - DNA, 15 bp, Homo sapiens
ccaaagcctatagtc

SEQ ID NO: 87102 - DNA, 15 bp, Homo sapiens
accaaagcctatagt

SEQ ID NO: 87103 - DNA, 15 bp, Homo sapiens
gaccaaagcctatag

SEQ ID NO: 87104 - DNA, 15 bp, Homo sapiens
ggaccaaagcctata

SEQ ID NO: 87105 - DNA, 15 bp, Homo sapiens
tggaccaaagcctat

SEQ ID NO: 87106 - DNA, 15 bp, Homo sapiens
atggaccaaagccta

SEQ ID NO: 87107 - DNA, 15 bp, Homo sapiens
tatggaccaaagcct

SEQ ID NO: 87108 - DNA, 15 bp, Homo sapiens
ttatggaccaaagcc

SEQ ID NO: 87109 - DNA, 15 bp, Homo sapiens
tttatggaccaaagc

SEQ ID NO: 87110 - DNA, 15 bp, Homo sapiens
ttttatggaccaaag

SEQ ID NO: 87111 - DNA, 15 bp, Homo sapiens
attttatggaccaaa

SEQ ID NO: 87112 - DNA, 15 bp, Homo sapiens
aattttatggaccaa

SEQ ID NO: 87113 - DNA, 15 bp, Homo sapiens
gaattttatggacca

SEQ ID NO: 87114 - DNA, 15 bp, Homo sapiens
agaattttatggacc

SEQ ID NO: 87115 - DNA, 15 bp, Homo sapiens
tagaattttatggac

SEQ ID NO: 87116 - DNA, 15 bp, Homo sapiens
gtagaattttatgga

SEQ ID NO: 87117 - DNA, 15 bp, Homo sapiens
ggtagaattttatgg

SEQ ID NO: 87118 - DNA, 15 bp, Homo sapiens
tggtagaattttatg

SEQ ID NO: 87119 - DNA, 15 bp, Homo sapiens
atggtagaattttat

SEQ ID NO: 87120 - DNA, 15 bp, Homo sapiens
tatggtagaatttta

SEQ ID NO: 87121 - DNA, 15 bp, Homo sapiens
ttatggtagaatttt

SEQ ID NO: 87122 - DNA, 15 bp, Homo sapiens
tttatggtagaattt

SEQ ID NO: 87123 - DNA, 15 bp, Homo sapiens
atttatggtagaatt

SEQ ID NO: 87124 - DNA, 15 bp, Homo sapiens
catttatggtagaat

SEQ ID NO: 87125 - DNA, 15 bp, Homo sapiens
ccatttatggtagaa

SEQ ID NO: 87126 - DNA, 15 bp, Homo sapiens
cccatttatggtaga

SEQ ID NO: 87127 - DNA, 15 bp, Homo sapiens
acccatttatggtag

SEQ ID NO: 87128 - DNA, 15 bp, Homo sapiens
gacccatttatggta

SEQ ID NO: 87129 - DNA, 15 bp, Homo sapiens
ggacccatttatggt

SEQ ID NO: 87130 - DNA, 15 bp, Homo sapiens
aggacccatttatgg

SEQ ID NO: 87131 - DNA, 15 bp, Homo sapiens
taggacccatttatg

SEQ ID NO: 87132 - DNA, 15 bp, Homo sapiens
ttaggacccatttat

SEQ ID NO: 87133 - DNA, 15 bp, Homo sapiens
tttaggacccattta

SEQ ID NO: 87134 - DNA, 15 bp, Homo sapiens
atttaggacccattt

SEQ ID NO: 87135 - DNA, 15 bp, Homo sapiens
tatttaggacccatt

SEQ ID NO: 87136 - DNA, 15 bp, Homo sapiens
ctatttaggacccat

SEQ ID NO: 87137 - DNA, 15 bp, Homo sapiens
tctatttaggaccca

SEQ ID NO: 87138 - DNA, 15 bp, Homo sapiens
gtctatttaggaccc

SEQ ID NO: 87139 - DNA, 15 bp, Homo sapiens
tgtctatttaggacc

SEQ ID NO: 87140 - DNA, 15 bp, Homo sapiens
gtgtctatttaggac

SEQ ID NO: 87141 - DNA, 15 bp, Homo sapiens
tgtgtctatttagga

SEQ ID NO: 87142 - DNA, 15 bp, Homo sapiens
agagctctaggaaca

SEQ ID NO: 87143 - DNA, 15 bp, Homo sapiens
aagagctctaggaac

SEQ ID NO: 87144 - DNA, 15 bp, Homo sapiens
gaagagctctaggaa

SEQ ID NO: 87145 - DNA, 15 bp, Homo sapiens
tgaagagctctagga

SEQ ID NO: 87146 - DNA, 15 bp, Homo sapiens
atgaagagctctagg

SEQ ID NO: 87147 - DNA, 15 bp, Homo sapiens
gatgaagagctctag

SEQ ID NO: 87148 - DNA, 15 bp, Homo sapiens
agatgaagagctcta

SEQ ID NO: 87149 - DNA, 15 bp, Homo sapiens
tagatgaagagctct

SEQ ID NO: 87150 - DNA, 15 bp, Homo sapiens
ctagatgaagagctc

SEQ ID NO: 87151 - DNA, 15 bp, Homo sapiens
actagatgaagagct

SEQ ID NO: 87152 - DNA, 15 bp, Homo sapiens
tactagatgaagagc

SEQ ID NO: 87153 - DNA, 15 bp, Homo sapiens
ttactagatgaagag

SEQ ID NO: 87154 - DNA, 15 bp, Homo sapiens
tttactagatgaaga

SEQ ID NO: 87155 - DNA, 15 bp, Homo sapiens
ttttactagatgaag

SEQ ID NO: 87156 - DNA, 15 bp, Homo sapiens
attttactagatgaa

SEQ ID NO: 87157 - DNA, 15 bp, Homo sapiens
tattttactagatga

SEQ ID NO: 87158 - DNA, 15 bp, Homo sapiens
gtattttactagatg

SEQ ID NO: 87159 - DNA, 15 bp, Homo sapiens
tgtattttactagat

SEQ ID NO: 87160 - DNA, 15 bp, Homo sapiens
ctgtattttactaga

SEQ ID NO: 87161 - DNA, 15 bp, Homo sapiens
actgtattttactag

SEQ ID NO: 87162 - DNA, 15 bp, Homo sapiens
tactgtattttacta

SEQ ID NO: 87163 - DNA, 15 bp, Homo sapiens
ctactgtattttact

SEQ ID NO: 87164 - DNA, 15 bp, Homo sapiens
tctactgtattttac

SEQ ID NO: 87165 - DNA, 15 bp, Homo sapiens
ctctactgtatttta

SEQ ID NO: 87166 - DNA, 15 bp, Homo sapiens
actctactgtatttt

SEQ ID NO: 87167 - DNA, 15 bp, Homo sapiens
tactctactgtattt

SEQ ID NO: 87168 - DNA, 15 bp, Homo sapiens
ctactctactgtatt

SEQ ID NO: 87169 - DNA, 15 bp, Homo sapiens
actactctactgtat

SEQ ID NO: 87170 - DNA, 15 bp, Homo sapiens
aactactctactgta

SEQ ID NO: 87171 - DNA, 15 bp, Homo sapiens
caactactctactgt

SEQ ID NO: 87172 - DNA, 15 bp, Homo sapiens
ccaactactctactg

SEQ ID NO: 87173 - DNA, 15 bp, Homo sapiens
cccaactactctact

SEQ ID NO: 87174 - DNA, 15 bp, Homo sapiens
gcccaactactctac

SEQ ID NO: 87175 - DNA, 15 bp, Homo sapiens
tgcccaactactcta

SEQ ID NO: 87176 - DNA, 15 bp, Homo sapiens
atgcccaactactct

SEQ ID NO: 87177 - DNA, 15 bp, Homo sapiens
gatgcccaactactc

SEQ ID NO: 87178 - DNA, 15 bp, Homo sapiens
agatgcccaactact

SEQ ID NO: 87179 - DNA, 15 bp, Homo sapiens
cagatgcccaactac

SEQ ID NO: 87180 - DNA, 15 bp, Homo sapiens
ccagatgcccaacta

SEQ ID NO: 87181 - DNA, 15 bp, Homo sapiens
tccagatgcccaact

SEQ ID NO: 87182 - DNA, 15 bp, Homo sapiens
atccagatgcccaac

SEQ ID NO: 87183 - DNA, 15 bp, Homo sapiens
tatccagatgcccaa

SEQ ID NO: 87184 - DNA, 15 bp, Homo sapiens
ttatccagatgccca

SEQ ID NO: 87185 - DNA, 15 bp, Homo sapiens
attatccagatgccc

SEQ ID NO: 87186 - DNA, 15 bp, Homo sapiens
cattatccagatgcc

SEQ ID NO: 87187 - DNA, 15 bp, Homo sapiens
acattatccagatgc

SEQ ID NO: 87188 - DNA, 15 bp, Homo sapiens
cacattatccagatg

SEQ ID NO: 87189 - DNA, 15 bp, Homo sapiens
ccacattatccagat

SEQ ID NO: 87190 - DNA, 15 bp, Homo sapiens
gccacattatccaga

SEQ ID NO: 87191 - DNA, 15 bp, Homo sapiens
agccacattatccag

SEQ ID NO: 87192 - DNA, 15 bp, Homo sapiens
aagccacattatcca

SEQ ID NO: 87193 - DNA, 15 bp, Homo sapiens
aaagccacattatcc

SEQ ID NO: 87194 - DNA, 15 bp, Homo sapiens
taaagccacattatc

SEQ ID NO: 87195 - DNA, 15 bp, Homo sapiens
ataaagccacattat

SEQ ID NO: 87196 - DNA, 15 bp, Homo sapiens
cataaagccacatta

SEQ ID NO: 87197 - DNA, 15 bp, Homo sapiens
tcataaagccacatt

SEQ ID NO: 87198 - DNA, 15 bp, Homo sapiens
ttcataaagccacat

SEQ ID NO: 87199 - DNA, 15 bp, Homo sapiens
attcataaagccaca

SEQ ID NO: 87200 - DNA, 15 bp, Homo sapiens
gattcataaagccac

SEQ ID NO: 87201 - DNA, 15 bp, Homo sapiens
tgattcataaagcca

SEQ ID NO: 87202 - DNA, 15 bp, Homo sapiens
ttgattcataaagcc

SEQ ID NO: 87203 - DNA, 15 bp, Homo sapiens
attgattcataaagc

SEQ ID NO: 87204 - DNA, 15 bp, Homo sapiens
cattgattcataaag

SEQ ID NO: 87205 - DNA, 15 bp, Homo sapiens
gcattgattcataaa

SEQ ID NO: 87206 - DNA, 15 bp, Homo sapiens
ggcattgattcataa

SEQ ID NO: 87207 - DNA, 15 bp, Homo sapiens
gggcattgattcata

SEQ ID NO: 87208 - DNA, 15 bp, Homo sapiens
tgggcattgattcat

SEQ ID NO: 87209 - DNA, 15 bp, Homo sapiens
atgggcattgattca

SEQ ID NO: 87210 - DNA, 15 bp, Homo sapiens
aatgggcattgattc

SEQ ID NO: 87211 - DNA, 15 bp, Homo sapiens
caatgggcattgatt

SEQ ID NO: 87212 - DNA, 15 bp, Homo sapiens
acaatgggcattgat

SEQ ID NO: 87213 - DNA, 15 bp, Homo sapiens
cacaatgggcattga

SEQ ID NO: 87214 - DNA, 15 bp, Homo sapiens
ccacaatgggcattg

SEQ ID NO: 87215 - DNA, 15 bp, Homo sapiens
accacaatgggcatt

SEQ ID NO: 87216 - DNA, 15 bp, Homo sapiens
aaccacaatgggcat

SEQ ID NO: 87217 - DNA, 15 bp, Homo sapiens
caaccacaatgggca

SEQ ID NO: 87218 - DNA, 15 bp, Homo sapiens
gcaaccacaatgggc

SEQ ID NO: 87219 - DNA, 15 bp, Homo sapiens
ggcaaccacaatggg

SEQ ID NO: 87220 - DNA, 15 bp, Homo sapiens
aggcaaccacaatgg

SEQ ID NO: 87221 - DNA, 15 bp, Homo sapiens
taggcaaccacaatg

SEQ ID NO: 87222 - DNA, 15 bp, Homo sapiens
ttaggcaaccacaat

SEQ ID NO: 87223 - DNA, 15 bp, Homo sapiens
cttaggcaaccacaa

SEQ ID NO: 87224 - DNA, 15 bp, Homo sapiens
gcttaggcaaccaca

SEQ ID NO: 87225 - DNA, 15 bp, Homo sapiens
tgcttaggcaaccac

SEQ ID NO: 87226 - DNA, 15 bp, Homo sapiens
atgcttaggcaacca

SEQ ID NO: 87227 - DNA, 15 bp, Homo sapiens
tatgcttaggcaacc

SEQ ID NO: 87228 - DNA, 15 bp, Homo sapiens
atatgcttaggcaac

SEQ ID NO: 87229 - DNA, 15 bp, Homo sapiens
tatatgcttaggcaa

SEQ ID NO: 87230 - DNA, 15 bp, Homo sapiens
ttatatgcttaggca

SEQ ID NO: 87231 - DNA, 15 bp, Homo sapiens
cttatatgcttaggc

SEQ ID NO: 87232 - DNA, 15 bp, Homo sapiens
gcttatatgcttagg

SEQ ID NO: 87233 - DNA, 15 bp, Homo sapiens
ggcttatatgcttag

SEQ ID NO: 87234 - DNA, 15 bp, Homo sapiens
gggcttatatgctta

SEQ ID NO: 87235 - DNA, 15 bp, Homo sapiens
tgggcttatatgctt

SEQ ID NO: 87236 - DNA, 15 bp, Homo sapiens
ctgggcttatatgct

SEQ ID NO: 87237 - DNA, 15 bp, Homo sapiens
cctgggcttatatgc

SEQ ID NO: 87238 - DNA, 15 bp, Homo sapiens
tcctgggcttatatg

SEQ ID NO: 87239 - DNA, 15 bp, Homo sapiens
ttcctgggcttatat

SEQ ID NO: 87240 - DNA, 15 bp, Homo sapiens
cttcctgggcttata

SEQ ID NO: 87241 - DNA, 15 bp, Homo sapiens
acttcctgggcttat

SEQ ID NO: 87242 - DNA, 15 bp, Homo sapiens
aacttcctgggctta

SEQ ID NO: 87243 - DNA, 15 bp, Homo sapiens
aaacttcctgggctt

SEQ ID NO: 87244 - DNA, 15 bp, Homo sapiens
caaacttcctgggct

SEQ ID NO: 87245 - DNA, 15 bp, Homo sapiens
ccaaacttcctgggc

SEQ ID NO: 87246 - DNA, 15 bp, Homo sapiens
accaaacttcctggg

SEQ ID NO: 87247 - DNA, 15 bp, Homo sapiens
caccaaacttcctgg

SEQ ID NO: 87248 - DNA, 15 bp, Homo sapiens
tcaccaaacttcctg

SEQ ID NO: 87249 - DNA, 15 bp, Homo sapiens
ttcaccaaacttcct

SEQ ID NO: 87250 - DNA, 15 bp, Homo sapiens
cttcaccaaacttcc

SEQ ID NO: 87251 - DNA, 15 bp, Homo sapiens
ccttcaccaaacttc

SEQ ID NO: 87252 - DNA, 15 bp, Homo sapiens
accttcaccaaactt

SEQ ID NO: 87253 - DNA, 15 bp, Homo sapiens
gaccttcaccaaact

SEQ ID NO: 87254 - DNA, 15 bp, Homo sapiens
ggaccttcaccaaac

SEQ ID NO: 87255 - DNA, 15 bp, Homo sapiens
aggaccttcaccaaa

SEQ ID NO: 87256 - DNA, 15 bp, Homo sapiens
taggaccttcaccaa

SEQ ID NO: 87257 - DNA, 15 bp, Homo sapiens
ataggaccttcacca

SEQ ID NO: 87258 - DNA, 15 bp, Homo sapiens
cataggaccttcacc

SEQ ID NO: 87259 - DNA, 15 bp, Homo sapiens
acataggaccttcac

SEQ ID NO: 87260 - DNA, 15 bp, Homo sapiens
aacataggaccttca

SEQ ID NO: 87261 - DNA, 15 bp, Homo sapiens
aaacataggaccttc

SEQ ID NO: 87262 - DNA, 15 bp, Homo sapiens
aaaacataggacctt

SEQ ID NO: 87263 - DNA, 15 bp, Homo sapiens
caaaacataggacct

SEQ ID NO: 87264 - DNA, 15 bp, Homo sapiens
acaaaacataggacc

SEQ ID NO: 87265 - DNA, 15 bp, Homo sapiens
tacaaaacataggac

SEQ ID NO: 87266 - DNA, 15 bp, Homo sapiens
ttacaaaacatagga

SEQ ID NO: 87267 - DNA, 15 bp, Homo sapiens
tttacaaaacatagg

SEQ ID NO: 87268 - DNA, 15 bp, Homo sapiens
gtttacaaaacatag

SEQ ID NO: 87269 - DNA, 15 bp, Homo sapiens
cgtttacaaaacata

SEQ ID NO: 87270 - DNA, 15 bp, Homo sapiens
acgtttacaaaacat

SEQ ID NO: 87271 - DNA, 15 bp, Homo sapiens
aacgtttacaaaaca

SEQ ID NO: 87272 - DNA, 15 bp, Homo sapiens
aaacgtttacaaaac

SEQ ID NO: 87273 - DNA, 15 bp, Homo sapiens
gaaacgtttacaaaa

SEQ ID NO: 87274 - DNA, 15 bp, Homo sapiens
ggaaacgtttacaaa

SEQ ID NO: 87275 - DNA, 15 bp, Homo sapiens
gggaaacgtttacaa

SEQ ID NO: 87276 - DNA, 15 bp, Homo sapiens
agggaaacgtttaca

SEQ ID NO: 87277 - DNA, 15 bp, Homo sapiens
aagggaaacgtttac

SEQ ID NO: 87278 - DNA, 15 bp, Homo sapiens
caagggaaacgttta

SEQ ID NO: 87279 - DNA, 15 bp, Homo sapiens
tcaagggaaacgttt

SEQ ID NO: 87280 - DNA, 15 bp, Homo sapiens
atcaagggaaacgtt

SEQ ID NO: 87281 - DNA, 15 bp, Homo sapiens
aatcaagggaaacgt

SEQ ID NO: 87282 - DNA, 15 bp, Homo sapiens
gaatcaagggaaacg

SEQ ID NO: 87283 - DNA, 15 bp, Homo sapiens
ggaatcaagggaaac

SEQ ID NO: 87284 - DNA, 15 bp, Homo sapiens
tggaatcaagggaaa

SEQ ID NO: 87285 - DNA, 15 bp, Homo sapiens
ttggaatcaagggaa

SEQ ID NO: 87286 - DNA, 15 bp, Homo sapiens
attggaatcaaggga

SEQ ID NO: 87287 - DNA, 15 bp, Homo sapiens
tattggaatcaaggg

SEQ ID NO: 87288 - DNA, 15 bp, Homo sapiens
ctattggaatcaagg

SEQ ID NO: 87289 - DNA, 15 bp, Homo sapiens
actattggaatcaag

SEQ ID NO: 87290 - DNA, 15 bp, Homo sapiens
cactattggaatcaa

SEQ ID NO: 87291 - DNA, 15 bp, Homo sapiens
tcactattggaatca

SEQ ID NO: 87292 - DNA, 15 bp, Homo sapiens
atcactattggaatc

SEQ ID NO: 87293 - DNA, 15 bp, Homo sapiens
tatcactattggaat

SEQ ID NO: 87294 - DNA, 15 bp, Homo sapiens
ctatcactattggaa

SEQ ID NO: 87295 - DNA, 15 bp, Homo sapiens
tctatcactattgga

SEQ ID NO: 87296 - DNA, 15 bp, Homo sapiens
gtctatcactattgg

SEQ ID NO: 87297 - DNA, 15 bp, Homo sapiens
agtctatcactattg

SEQ ID NO: 87298 - DNA, 15 bp, Homo sapiens
cagtctatcactatt

SEQ ID NO: 87299 - DNA, 15 bp, Homo sapiens
tcagtctatcactat

SEQ ID NO: 87300 - DNA, 15 bp, Homo sapiens
ctcagtctatcacta

SEQ ID NO: 87301 - DNA, 15 bp, Homo sapiens
tctcagtctatcact

SEQ ID NO: 87302 - DNA, 15 bp, Homo sapiens
ttctcagtctatcac

SEQ ID NO: 87303 - DNA, 15 bp, Homo sapiens
cttctcagtctatca

SEQ ID NO: 87304 - DNA, 15 bp, Homo sapiens
acttctcagtctatc

SEQ ID NO: 87305 - DNA, 15 bp, Homo sapiens
cacttctcagtctat

SEQ ID NO: 87306 - DNA, 15 bp, Homo sapiens
acacttctcagtcta

SEQ ID NO: 87307 - DNA, 15 bp, Homo sapiens
tacacttctcagtct

SEQ ID NO: 87308 - DNA, 15 bp, Homo sapiens
ttacacttctcagtc

SEQ ID NO: 87309 - DNA, 15 bp, Homo sapiens
tttacacttctcagt

SEQ ID NO: 87310 - DNA, 15 bp, Homo sapiens
ctttacacttctcag

SEQ ID NO: 87311 - DNA, 15 bp, Homo sapiens
actttacacttctca

SEQ ID NO: 87312 - DNA, 15 bp, Homo sapiens
gactttacacttctc

SEQ ID NO: 87313 - DNA, 15 bp, Homo sapiens
tgactttacacttct

SEQ ID NO: 87314 - DNA, 15 bp, Homo sapiens
ttgactttacacttc

SEQ ID NO: 87315 - DNA, 15 bp, Homo sapiens
cttgactttacactt

SEQ ID NO: 87316 - DNA, 15 bp, Homo sapiens
acttgactttacact

SEQ ID NO: 87317 - DNA, 15 bp, Homo sapiens
cacttgactttacac

SEQ ID NO: 87318 - DNA, 15 bp, Homo sapiens
tcacttgactttaca

SEQ ID NO: 87319 - DNA, 15 bp, Homo sapiens
ctcacttgactttac

SEQ ID NO: 87320 - DNA, 15 bp, Homo sapiens
tctcacttgacttta

SEQ ID NO: 87321 - DNA, 15 bp, Homo sapiens
gtctcacttgacttt

SEQ ID NO: 87322 - DNA, 15 bp, Homo sapiens
agtctcacttgactt

SEQ ID NO: 87323 - DNA, 15 bp, Homo sapiens
cagtctcacttgact

SEQ ID NO: 87324 - DNA, 15 bp, Homo sapiens
tcagtctcacttgac

SEQ ID NO: 87325 - DNA, 15 bp, Homo sapiens
ctcagtctcacttga

SEQ ID NO: 87326 - DNA, 15 bp, Homo sapiens
actcagtctcacttg

SEQ ID NO: 87327 - DNA, 15 bp, Homo sapiens
cactcagtctcactt

SEQ ID NO: 87328 - DNA, 15 bp, Homo sapiens
ccactcagtctcact

SEQ ID NO: 87329 - DNA, 15 bp, Homo sapiens
gccactcagtctcac

SEQ ID NO: 87330 - DNA, 15 bp, Homo sapiens
tgccactcagtctca

SEQ ID NO: 87331 - DNA, 15 bp, Homo sapiens
ctgccactcagtctc

SEQ ID NO: 87332 - DNA, 15 bp, Homo sapiens
cctgccactcagtct

SEQ ID NO: 87333 - DNA, 15 bp, Homo sapiens
tcctgccactcagtc

SEQ ID NO: 87334 - DNA, 15 bp, Homo sapiens
ttcctgccactcagt

SEQ ID NO: 87335 - DNA, 15 bp, Homo sapiens
attcctgccactcag

SEQ ID NO: 87336 - DNA, 15 bp, Homo sapiens
cattcctgccactca

SEQ ID NO: 87337 - DNA, 15 bp, Homo sapiens
acattcctgccactc

SEQ ID NO: 87338 - DNA, 15 bp, Homo sapiens
cacattcctgccact

SEQ ID NO: 87339 - DNA, 15 bp, Homo sapiens
acacattcctgccac

SEQ ID NO: 87340 - DNA, 15 bp, Homo sapiens
aacacattcctgcca

SEQ ID NO: 87341 - DNA, 15 bp, Homo sapiens
gaacacattcctgcc

SEQ ID NO: 87342 - DNA, 15 bp, Homo sapiens
agaacacattcctgc

SEQ ID NO: 87343 - DNA, 15 bp, Homo sapiens
tagaacacattcctg

SEQ ID NO: 87344 - DNA, 15 bp, Homo sapiens
atagaacacattcct

SEQ ID NO: 87345 - DNA, 15 bp, Homo sapiens
catagaacacattcc

SEQ ID NO: 87346 - DNA, 15 bp, Homo sapiens
acatagaacacattc

SEQ ID NO: 87347 - DNA, 15 bp, Homo sapiens
aacatagaacacatt

SEQ ID NO: 87348 - DNA, 15 bp, Homo sapiens
gaacatagaacacat

SEQ ID NO: 87349 - DNA, 15 bp, Homo sapiens
agaacatagaacaca

SEQ ID NO: 87350 - DNA, 15 bp, Homo sapiens
gagaacatagaacac

SEQ ID NO: 87351 - DNA, 15 bp, Homo sapiens
ggagaacatagaaca

SEQ ID NO: 87352 - DNA, 15 bp, Homo sapiens
gggagaacatagaac

SEQ ID NO: 87353 - DNA, 15 bp, Homo sapiens
agggagaacatagaa

SEQ ID NO: 87354 - DNA, 15 bp, Homo sapiens
aagggagaacataga

SEQ ID NO: 87355 - DNA, 15 bp, Homo sapiens
aaagggagaacatag

SEQ ID NO: 87356 - DNA, 15 bp, Homo sapiens
aaaagggagaacata

SEQ ID NO: 87357 - DNA, 15 bp, Homo sapiens
taaaagggagaacat

SEQ ID NO: 87358 - DNA, 15 bp, Homo sapiens
ctaaaagggagaaca

SEQ ID NO: 87359 - DNA, 15 bp, Homo sapiens
tctaaaagggagaac

SEQ ID NO: 87360 - DNA, 15 bp, Homo sapiens
gtctaaaagggagaa

SEQ ID NO: 87361 - DNA, 15 bp, Homo sapiens
tgtctaaaagggaga

SEQ ID NO: 87362 - DNA, 15 bp, Homo sapiens
ttgtctaaaagggag

SEQ ID NO: 87363 - DNA, 15 bp, Homo sapiens
attgtctaaaaggga

SEQ ID NO: 87364 - DNA, 15 bp, Homo sapiens
aattgtctaaaaggg

SEQ ID NO: 87365 - DNA, 15 bp, Homo sapiens
taattgtctaaaagg

SEQ ID NO: 87366 - DNA, 15 bp, Homo sapiens
ttaattgtctaaaag

SEQ ID NO: 87367 - DNA, 15 bp, Homo sapiens
attaattgtctaaaa

SEQ ID NO: 87368 - DNA, 15 bp, Homo sapiens
tattaattgtctaaa

SEQ ID NO: 87369 - DNA, 15 bp, Homo sapiens
ttattaattgtctaa

SEQ ID NO: 87370 - DNA, 15 bp, Homo sapiens
tttattaattgtcta

SEQ ID NO: 87371 - DNA, 15 bp, Homo sapiens
ctttattaattgtct

SEQ ID NO: 87372 - DNA, 15 bp, Homo sapiens
actttattaattgtc

SEQ ID NO: 87373 - DNA, 15 bp, Homo sapiens
cactttattaattgt

SEQ ID NO: 87374 - DNA, 15 bp, Homo sapiens
tcactttattaattg

SEQ ID NO: 87375 - DNA, 15 bp, Homo sapiens
atcactttattaatt

SEQ ID NO: 87376 - DNA, 15 bp, Homo sapiens
gatcactttattaat

SEQ ID NO: 87377 - DNA, 15 bp, Homo sapiens
agatcactttattaa

SEQ ID NO: 87378 - DNA, 15 bp, Homo sapiens
aagatcactttatta

SEQ ID NO: 87379 - DNA, 15 bp, Homo sapiens
gaagatcactttatt

SEQ ID NO: 87380 - DNA, 15 bp, Homo sapiens
agaagatcactttat

SEQ ID NO: 87381 - DNA, 15 bp, Homo sapiens
cagaagatcacttta

SEQ ID NO: 87382 - DNA, 15 bp, Homo sapiens
acagaagatcacttt

SEQ ID NO: 87383 - DNA, 15 bp, Homo sapiens
aacagaagatcactt

SEQ ID NO: 87384 - DNA, 15 bp, Homo sapiens
caacagaagatcact

SEQ ID NO: 87385 - DNA, 15 bp, Homo sapiens
tcaacagaagatcac

SEQ ID NO: 87386 - DNA, 15 bp, Homo sapiens
atcaacagaagatca

SEQ ID NO: 87387 - DNA, 15 bp, Homo sapiens
aatcaacagaagatc

SEQ ID NO: 87388 - DNA, 15 bp, Homo sapiens
aaatcaacagaagat

SEQ ID NO: 87389 - DNA, 15 bp, Homo sapiens
aaaatcaacagaaga

SEQ ID NO: 87390 - DNA, 15 bp, Homo sapiens
caaaatcaacagaag

SEQ ID NO: 87391 - DNA, 15 bp, Homo sapiens
gcaaaatcaacagaa

SEQ ID NO: 87392 - DNA, 15 bp, Homo sapiens
ggcaaaatcaacaga

SEQ ID NO: 87393 - DNA, 15 bp, Homo sapiens
aggcaaaatcaacag

SEQ ID NO: 87394 - DNA, 15 bp, Homo sapiens
aaggcaaaatcaaca

SEQ ID NO: 87395 - DNA, 15 bp, Homo sapiens
aaaggcaaaatcaac

SEQ ID NO: 87396 - DNA, 15 bp, Homo sapiens
aaaaggcaaaatcaa

SEQ ID NO: 87397 - DNA, 15 bp, Homo sapiens
caaaaggcaaaatca

SEQ ID NO: 87398 - DNA, 15 bp, Homo sapiens
tcaaaaggcaaaatc

SEQ ID NO: 87399 - DNA, 15 bp, Homo sapiens
gtcaaaaggcaaaat

SEQ ID NO: 87400 - DNA, 15 bp, Homo sapiens
agtcaaaaggcaaaa

SEQ ID NO: 87401 - DNA, 15 bp, Homo sapiens
tagtcaaaaggcaaa

SEQ ID NO: 87402 - DNA, 15 bp, Homo sapiens
ctagtcaaaaggcaa

SEQ ID NO: 87403 - DNA, 15 bp, Homo sapiens
actagtcaaaaggca

SEQ ID NO: 87404 - DNA, 15 bp, Homo sapiens
gactagtcaaaaggc

SEQ ID NO: 87405 - DNA, 15 bp, Homo sapiens
tgactagtcaaaagg

SEQ ID NO: 87406 - DNA, 15 bp, Homo sapiens
gtgactagtcaaaag

SEQ ID NO: 87407 - DNA, 15 bp, Homo sapiens
ggtgactagtcaaaa

SEQ ID NO: 87408 - DNA, 15 bp, Homo sapiens
aggtgactagtcaaa

SEQ ID NO: 87409 - DNA, 15 bp, Homo sapiens
aaggtgactagtcaa

SEQ ID NO: 87410 - DNA, 15 bp, Homo sapiens
gaaggtgactagtca

SEQ ID NO: 87411 - DNA, 15 bp, Homo sapiens
agaaggtgactagtc

SEQ ID NO: 87412 - DNA, 15 bp, Homo sapiens
tagaaggtgactagt

SEQ ID NO: 87413 - DNA, 15 bp, Homo sapiens
ttagaaggtgactag

SEQ ID NO: 87414 - DNA, 15 bp, Homo sapiens
cttagaaggtgacta

SEQ ID NO: 87415 - DNA, 15 bp, Homo sapiens
tcttagaaggtgact

SEQ ID NO: 87416 - DNA, 15 bp, Homo sapiens
ttcttagaaggtgac

SEQ ID NO: 87417 - DNA, 15 bp, Homo sapiens
gttcttagaaggtga

SEQ ID NO: 87418 - DNA, 15 bp, Homo sapiens
agttcttagaaggtg

SEQ ID NO: 87419 - DNA, 15 bp, Homo sapiens
gagttcttagaaggt

SEQ ID NO: 87420 - DNA, 15 bp, Homo sapiens
agagttcttagaagg

SEQ ID NO: 87421 - DNA, 15 bp, Homo sapiens
cagagttcttagaag

SEQ ID NO: 87422 - DNA, 15 bp, Homo sapiens
acagagttcttagaa

SEQ ID NO: 87423 - DNA, 15 bp, Homo sapiens
cacagagttcttaga

SEQ ID NO: 87424 - DNA, 15 bp, Homo sapiens
acacagagttcttag

SEQ ID NO: 87425 - DNA, 15 bp, Homo sapiens
aacacagagttctta

SEQ ID NO: 87426 - DNA, 15 bp, Homo sapiens
aaacacagagttctt

SEQ ID NO: 87427 - DNA, 15 bp, Homo sapiens
aaaacacagagttct

SEQ ID NO: 87428 - DNA, 15 bp, Homo sapiens
taaaacacagagttc

SEQ ID NO: 87429 - DNA, 15 bp, Homo sapiens
ataaaacacagagtt

SEQ ID NO: 87430 - DNA, 15 bp, Homo sapiens
tataaaacacagagt

SEQ ID NO: 87431 - DNA, 15 bp, Homo sapiens
ctataaaacacagag

SEQ ID NO: 87432 - DNA, 15 bp, Homo sapiens
tctataaaacacaga

SEQ ID NO: 87433 - DNA, 15 bp, Homo sapiens
ttctataaaacacag

SEQ ID NO: 87434 - DNA, 15 bp, Homo sapiens
tttctataaaacaca

SEQ ID NO: 87435 - DNA, 15 bp, Homo sapiens
atttctataaaacac

SEQ ID NO: 87436 - DNA, 15 bp, Homo sapiens
tatttctataaaaca

SEQ ID NO: 87437 - DNA, 15 bp, Homo sapiens
ctatttctataaaac

SEQ ID NO: 87438 - DNA, 15 bp, Homo sapiens
tctatttctataaaa

SEQ ID NO: 87439 - DNA, 15 bp, Homo sapiens
ttctatttctataaa

SEQ ID NO: 87440 - DNA, 15 bp, Homo sapiens
tttctatttctataa

SEQ ID NO: 87441 - DNA, 15 bp, Homo sapiens
ttttctatttctata

SEQ ID NO: 87442 - DNA, 15 bp, Homo sapiens
attttctatttctat

SEQ ID NO: 87443 - DNA, 15 bp, Homo sapiens
aattttctatttcta

SEQ ID NO: 87444 - DNA, 15 bp, Homo sapiens
aaattttctatttct

SEQ ID NO: 87445 - DNA, 15 bp, Homo sapiens
aaaattttctatttc

SEQ ID NO: 87446 - DNA, 15 bp, Homo sapiens
taaaattttctattt

SEQ ID NO: 87447 - DNA, 15 bp, Homo sapiens
ttaaaattttctatt

SEQ ID NO: 87448 - DNA, 15 bp, Homo sapiens
tttaaaattttctat

SEQ ID NO: 87449 - DNA, 15 bp, Homo sapiens
gtttaaaattttcta

SEQ ID NO: 87450 - DNA, 15 bp, Homo sapiens
agtttaaaattttct

SEQ ID NO: 87451 - DNA, 15 bp, Homo sapiens
gagtttaaaattttc

SEQ ID NO: 87452 - DNA, 15 bp, Homo sapiens
agagtttaaaatttt

SEQ ID NO: 87453 - DNA, 15 bp, Homo sapiens
cagagtttaaaattt

SEQ ID NO: 87454 - DNA, 15 bp, Homo sapiens
ccagagtttaaaatt

SEQ ID NO: 87455 - DNA, 15 bp, Homo sapiens
tccagagtttaaaat

SEQ ID NO: 87456 - DNA, 15 bp, Homo sapiens
atccagagtttaaaa

SEQ ID NO: 87457 - DNA, 15 bp, Homo sapiens
gatccagagtttaaa

SEQ ID NO: 87458 - DNA, 15 bp, Homo sapiens
agatccagagtttaa

SEQ ID NO: 87459 - DNA, 15 bp, Homo sapiens
gagatccagagttta

SEQ ID NO: 87460 - DNA, 15 bp, Homo sapiens
agagatccagagttt

SEQ ID NO: 87461 - DNA, 15 bp, Homo sapiens
cagagatccagagtt

SEQ ID NO: 87462 - DNA, 15 bp, Homo sapiens
ccagagatccagagt

SEQ ID NO: 87463 - DNA, 15 bp, Homo sapiens
cccagagatccagag

SEQ ID NO: 87464 - DNA, 15 bp, Homo sapiens
tcccagagatccaga

SEQ ID NO: 87465 - DNA, 15 bp, Homo sapiens
ctcccagagatccag

SEQ ID NO: 87466 - DNA, 15 bp, Homo sapiens
actcccagagatcca

SEQ ID NO: 87467 - DNA, 15 bp, Homo sapiens
tactcccagagatcc

SEQ ID NO: 87468 - DNA, 15 bp, Homo sapiens
ttactcccagagatc

SEQ ID NO: 87469 - DNA, 15 bp, Homo sapiens
tttactcccagagat

SEQ ID NO: 87470 - DNA, 15 bp, Homo sapiens
ttttactcccagaga

SEQ ID NO: 87471 - DNA, 15 bp, Homo sapiens
gttttactcccagag

SEQ ID NO: 87472 - DNA, 15 bp, Homo sapiens
tgttttactcccaga

SEQ ID NO: 87473 - DNA, 15 bp, Homo sapiens
ttgttttactcccag

SEQ ID NO: 87474 - DNA, 15 bp, Homo sapiens
gttgttttactccca

SEQ ID NO: 87475 - DNA, 15 bp, Homo sapiens
agttgttttactccc

SEQ ID NO: 87476 - DNA, 15 bp, Homo sapiens
tagttgttttactcc

SEQ ID NO: 87477 - DNA, 15 bp, Homo sapiens
atagttgttttactc

SEQ ID NO: 87478 - DNA, 15 bp, Homo sapiens
aatagttgttttact

SEQ ID NO: 87479 - DNA, 15 bp, Homo sapiens
aaatagttgttttac

SEQ ID NO: 87480 - DNA, 15 bp, Homo sapiens
aaaatagttgtttta

SEQ ID NO: 87481 - DNA, 15 bp, Homo sapiens
aaaaatagttgtttt

SEQ ID NO: 87482 - DNA, 15 bp, Homo sapiens
taaaaatagttgttt

SEQ ID NO: 87483 - DNA, 15 bp, Homo sapiens
ttaaaaatagttgtt

SEQ ID NO: 87484 - DNA, 15 bp, Homo sapiens
tttaaaaatagttgt

SEQ ID NO: 87485 - DNA, 15 bp, Homo sapiens
ctttaaaaatagttg

SEQ ID NO: 87486 - DNA, 15 bp, Homo sapiens
tctttaaaaatagtt

SEQ ID NO: 87487 - DNA, 15 bp, Homo sapiens
gtctttaaaaatagt

SEQ ID NO: 87488 - DNA, 15 bp, Homo sapiens
tgtctttaaaaatag

SEQ ID NO: 87489 - DNA, 15 bp, Homo sapiens
ttgtctttaaaaata

SEQ ID NO: 87490 - DNA, 15 bp, Homo sapiens
attgtctttaaaaat

SEQ ID NO: 87491 - DNA, 15 bp, Homo sapiens
cattgtctttaaaaa

SEQ ID NO: 87492 - DNA, 15 bp, Homo sapiens
acattgtctttaaaa

SEQ ID NO: 87493 - DNA, 15 bp, Homo sapiens
cacattgtctttaaa

SEQ ID NO: 87494 - DNA, 15 bp, Homo sapiens
gcacattgtctttaa

SEQ ID NO: 87495 - DNA, 15 bp, Homo sapiens
tgcacattgtcttta

SEQ ID NO: 87496 - DNA, 15 bp, Homo sapiens
ctgcacattgtcttt

SEQ ID NO: 87497 - DNA, 15 bp, Homo sapiens
actgcacattgtctt

SEQ ID NO: 87498 - DNA, 15 bp, Homo sapiens
aactgcacattgtct

SEQ ID NO: 87499 - DNA, 15 bp, Homo sapiens
aaactgcacattgtc

SEQ ID NO: 87500 - DNA, 15 bp, Homo sapiens
aaaactgcacattgt

SEQ ID NO: 87501 - DNA, 15 bp, Homo sapiens
gaaaactgcacattg

SEQ ID NO: 87502 - DNA, 15 bp, Homo sapiens
ggaaaactgcacatt

SEQ ID NO: 87503 - DNA, 15 bp, Homo sapiens
aggaaaactgcacat

SEQ ID NO: 87504 - DNA, 15 bp, Homo sapiens
aaggaaaactgcaca

SEQ ID NO: 87505 - DNA, 15 bp, Homo sapiens
aaaggaaaactgcac

SEQ ID NO: 87506 - DNA, 15 bp, Homo sapiens
aaaaggaaaactgca

SEQ ID NO: 87507 - DNA, 15 bp, Homo sapiens
taaaaggaaaactgc

SEQ ID NO: 87508 - DNA, 15 bp, Homo sapiens
ataaaaggaaaactg

SEQ ID NO: 87509 - DNA, 15 bp, Homo sapiens
tataaaaggaaaact

SEQ ID NO: 87510 - DNA, 15 bp, Homo sapiens
ttataaaaggaaaac

SEQ ID NO: 87511 - DNA, 15 bp, Homo sapiens
cttataaaaggaaaa

SEQ ID NO: 87512 - DNA, 15 bp, Homo sapiens
tcttataaaaggaaa

SEQ ID NO: 87513 - DNA, 15 bp, Homo sapiens
atcttataaaaggaa

SEQ ID NO: 87514 - DNA, 15 bp, Homo sapiens
catcttataaaagga

SEQ ID NO: 87515 - DNA, 15 bp, Homo sapiens
acatcttataaaagg

SEQ ID NO: 87516 - DNA, 15 bp, Homo sapiens
tacatcttataaaag

SEQ ID NO: 87517 - DNA, 15 bp, Homo sapiens
ttacatcttataaaa

SEQ ID NO: 87518 - DNA, 15 bp, Homo sapiens
tttacatcttataaa

SEQ ID NO: 87519 - DNA, 15 bp, Homo sapiens
atttacatcttataa

SEQ ID NO: 87520 - DNA, 15 bp, Homo sapiens
aatttacatcttata

SEQ ID NO: 87521 - DNA, 15 bp, Homo sapiens
caatttacatcttat

SEQ ID NO: 87522 - DNA, 15 bp, Homo sapiens
acaatttacatctta

SEQ ID NO: 87523 - DNA, 15 bp, Homo sapiens
cacaatttacatctt

SEQ ID NO: 87524 - DNA, 15 bp, Homo sapiens
acacaatttacatct

SEQ ID NO: 87525 - DNA, 15 bp, Homo sapiens
aacacaatttacatc

SEQ ID NO: 87526 - DNA, 15 bp, Homo sapiens
aaacacaatttacat

SEQ ID NO: 87527 - DNA, 15 bp, Homo sapiens
caaacacaatttaca

SEQ ID NO: 87528 - DNA, 15 bp, Homo sapiens
tcaaacacaatttac

SEQ ID NO: 87529 - DNA, 15 bp, Homo sapiens
ttcaaacacaattta

SEQ ID NO: 87530 - DNA, 15 bp, Homo sapiens
attcaaacacaattt

SEQ ID NO: 87531 - DNA, 15 bp, Homo sapiens
gattcaaacacaatt

SEQ ID NO: 87532 - DNA, 15 bp, Homo sapiens
tgattcaaacacaat

SEQ ID NO: 87533 - DNA, 15 bp, Homo sapiens
atgattcaaacacaa

SEQ ID NO: 87534 - DNA, 15 bp, Homo sapiens
aatgattcaaacaca

SEQ ID NO: 87535 - DNA, 15 bp, Homo sapiens
taatgattcaaacac

SEQ ID NO: 87536 - DNA, 15 bp, Homo sapiens
gtaatgattcaaaca

SEQ ID NO: 87537 - DNA, 15 bp, Homo sapiens
ggtaatgattcaaac

SEQ ID NO: 87538 - DNA, 15 bp, Homo sapiens
cggtaatgattcaaa

SEQ ID NO: 87539 - DNA, 15 bp, Homo sapiens
ccggtaatgattcaa

SEQ ID NO: 87540 - DNA, 15 bp, Homo sapiens
cccggtaatgattca

SEQ ID NO: 87541 - DNA, 15 bp, Homo sapiens
gcccggtaatgattc

SEQ ID NO: 87542 - DNA, 15 bp, Homo sapiens
tgcccggtaatgatt

SEQ ID NO: 87543 - DNA, 15 bp, Homo sapiens
atgcccggtaatgat

SEQ ID NO: 87544 - DNA, 15 bp, Homo sapiens
gatgcccggtaatga

SEQ ID NO: 87545 - DNA, 15 bp, Homo sapiens
tgatgcccggtaatg

SEQ ID NO: 87546 - DNA, 15 bp, Homo sapiens
gtgatgcccggtaat

SEQ ID NO: 87547 - DNA, 15 bp, Homo sapiens
agtgatgcccggtaa

SEQ ID NO: 87548 - DNA, 15 bp, Homo sapiens
cagtgatgcccggta

SEQ ID NO: 87549 - DNA, 15 bp, Homo sapiens
acagtgatgcccggt

SEQ ID NO: 87550 - DNA, 15 bp, Homo sapiens
tacagtgatgcccgg

SEQ ID NO: 87551 - DNA, 15 bp, Homo sapiens
ttacagtgatgcccg

SEQ ID NO: 87552 - DNA, 15 bp, Homo sapiens
gttacagtgatgccc

SEQ ID NO: 87553 - DNA, 15 bp, Homo sapiens
ggttacagtgatgcc

SEQ ID NO: 87554 - DNA, 15 bp, Homo sapiens
tggttacagtgatgc

SEQ ID NO: 87555 - DNA, 15 bp, Homo sapiens
ctggttacagtgatg

SEQ ID NO: 87556 - DNA, 15 bp, Homo sapiens
gctggttacagtgat

SEQ ID NO: 87557 - DNA, 15 bp, Homo sapiens
tgctggttacagtga

SEQ ID NO: 87558 - DNA, 15 bp, Homo sapiens
ttgctggttacagtg

SEQ ID NO: 87559 - DNA, 15 bp, Homo sapiens
attgctggttacagt

SEQ ID NO: 87560 - DNA, 15 bp, Homo sapiens
tattgctggttacag

SEQ ID NO: 87561 - DNA, 15 bp, Homo sapiens
atattgctggttaca

SEQ ID NO: 87562 - DNA, 15 bp, Homo sapiens
gatattgctggttac

SEQ ID NO: 87563 - DNA, 15 bp, Homo sapiens
agatattgctggtta

SEQ ID NO: 87564 - DNA, 15 bp, Homo sapiens
gagatattgctggtt

SEQ ID NO: 87565 - DNA, 15 bp, Homo sapiens
tgagatattgctggt

SEQ ID NO: 87566 - DNA, 15 bp, Homo sapiens
ctgagatattgctgg

SEQ ID NO: 87567 - DNA, 15 bp, Homo sapiens
cctgagatattgctg

SEQ ID NO: 87568 - DNA, 15 bp, Homo sapiens
tcctgagatattgct

SEQ ID NO: 87569 - DNA, 15 bp, Homo sapiens
atcctgagatattgc

SEQ ID NO: 87570 - DNA, 15 bp, Homo sapiens
aatcctgagatattg

SEQ ID NO: 87571 - DNA, 15 bp, Homo sapiens
taatcctgagatatt

SEQ ID NO: 87572 - DNA, 15 bp, Homo sapiens
ctaatcctgagatat

SEQ ID NO: 87573 - DNA, 15 bp, Homo sapiens
tctaatcctgagata

SEQ ID NO: 87574 - DNA, 15 bp, Homo sapiens
ctctaatcctgagat

SEQ ID NO: 87575 - DNA, 15 bp, Homo sapiens
tctctaatcctgaga

SEQ ID NO: 87576 - DNA, 15 bp, Homo sapiens
ttctctaatcctgag

SEQ ID NO: 87577 - DNA, 15 bp, Homo sapiens
tttctctaatcctga

SEQ ID NO: 87578 - DNA, 15 bp, Homo sapiens
ctttctctaatcctg

SEQ ID NO: 87579 - DNA, 15 bp, Homo sapiens
cctttctctaatcct

SEQ ID NO: 87580 - DNA, 15 bp, Homo sapiens
ccctttctctaatcc

SEQ ID NO: 87581 - DNA, 15 bp, Homo sapiens
tccctttctctaatc

SEQ ID NO: 87582 - DNA, 15 bp, Homo sapiens
ctccctttctctaat

SEQ ID NO: 87583 - DNA, 15 bp, Homo sapiens
tctccctttctctaa

SEQ ID NO: 87584 - DNA, 15 bp, Homo sapiens
atctccctttctcta

SEQ ID NO: 87585 - DNA, 15 bp, Homo sapiens
aatctccctttctct

SEQ ID NO: 87586 - DNA, 15 bp, Homo sapiens
gaatctccctttctc

SEQ ID NO: 87587 - DNA, 15 bp, Homo sapiens
tgaatctccctttct

SEQ ID NO: 87588 - DNA, 15 bp, Homo sapiens
ctgaatctccctttc

SEQ ID NO: 87589 - DNA, 15 bp, Homo sapiens
tctgaatctcccttt

SEQ ID NO: 87590 - DNA, 15 bp, Homo sapiens
atctgaatctccctt

SEQ ID NO: 87591 - DNA, 15 bp, Homo sapiens
catctgaatctccct

SEQ ID NO: 87592 - DNA, 15 bp, Homo sapiens
acatctgaatctccc

SEQ ID NO: 87593 - DNA, 15 bp, Homo sapiens
aacatctgaatctcc

SEQ ID NO: 87594 - DNA, 15 bp, Homo sapiens
aaacatctgaatctc

SEQ ID NO: 87595 - DNA, 15 bp, Homo sapiens
taaacatctgaatct

SEQ ID NO: 87596 - DNA, 15 bp, Homo sapiens
ttaaacatctgaatc

SEQ ID NO: 87597 - DNA, 15 bp, Homo sapiens
tttaaacatctgaat

SEQ ID NO: 87598 - DNA, 15 bp, Homo sapiens
ttttaaacatctgaa

SEQ ID NO: 87599 - DNA, 15 bp, Homo sapiens
attttaaacatctga

SEQ ID NO: 87600 - DNA, 15 bp, Homo sapiens
aattttaaacatctg

SEQ ID NO: 87601 - DNA, 15 bp, Homo sapiens
caattttaaacatct

SEQ ID NO: 87602 - DNA, 15 bp, Homo sapiens
ccaattttaaacatc

SEQ ID NO: 87603 - DNA, 15 bp, Homo sapiens
accaattttaaacat

SEQ ID NO: 87604 - DNA, 15 bp, Homo sapiens
aaccaattttaaaca

SEQ ID NO: 87605 - DNA, 15 bp, Homo sapiens
aaaccaattttaaac

SEQ ID NO: 87606 - DNA, 15 bp, Homo sapiens
taaaccaattttaaa

SEQ ID NO: 87607 - DNA, 15 bp, Homo sapiens
ttaaaccaattttaa

SEQ ID NO: 87608 - DNA, 15 bp, Homo sapiens
tttaaaccaatttta

SEQ ID NO: 87609 - DNA, 15 bp, Homo sapiens
ctttaaaccaatttt

SEQ ID NO: 87610 - DNA, 15 bp, Homo sapiens
tctttaaaccaattt

SEQ ID NO: 87611 - DNA, 15 bp, Homo sapiens
ctctttaaaccaatt

SEQ ID NO: 87612 - DNA, 15 bp, Homo sapiens
cctctttaaaccaat

SEQ ID NO: 87613 - DNA, 15 bp, Homo sapiens
gcctctttaaaccaa

SEQ ID NO: 87614 - DNA, 15 bp, Homo sapiens
tgcctctttaaacca

SEQ ID NO: 87615 - DNA, 15 bp, Homo sapiens
ttgcctctttaaacc

SEQ ID NO: 87616 - DNA, 15 bp, Homo sapiens
tttgcctctttaaac

SEQ ID NO: 87617 - DNA, 15 bp, Homo sapiens
ttttgcctctttaaa

SEQ ID NO: 87618 - DNA, 15 bp, Homo sapiens
attttgcctctttaa

SEQ ID NO: 87619 - DNA, 15 bp, Homo sapiens
cattttgcctcttta

SEQ ID NO: 87620 - DNA, 15 bp, Homo sapiens
tcattttgcctcttt

SEQ ID NO: 87621 - DNA, 15 bp, Homo sapiens
ttcattttgcctctt

SEQ ID NO: 87622 - DNA, 15 bp, Homo sapiens
attcattttgcctct

SEQ ID NO: 87623 - DNA, 15 bp, Homo sapiens
cattcattttgcctc

SEQ ID NO: 87624 - DNA, 15 bp, Homo sapiens
ccattcattttgcct

SEQ ID NO: 87625 - DNA, 15 bp, Homo sapiens
gccattcattttgcc

SEQ ID NO: 87626 - DNA, 15 bp, Homo sapiens
agccattcattttgc

SEQ ID NO: 87627 - DNA, 15 bp, Homo sapiens
aagccattcattttg

SEQ ID NO: 87628 - DNA, 15 bp, Homo sapiens
caagccattcatttt

SEQ ID NO: 87629 - DNA, 15 bp, Homo sapiens
acaagccattcattt

SEQ ID NO: 87630 - DNA, 15 bp, Homo sapiens
tacaagccattcatt

SEQ ID NO: 87631 - DNA, 15 bp, Homo sapiens
ttacaagccattcat

SEQ ID NO: 87632 - DNA, 15 bp, Homo sapiens
cttacaagccattca

SEQ ID NO: 87633 - DNA, 15 bp, Homo sapiens
tcttacaagccattc

SEQ ID NO: 87634 - DNA, 15 bp, Homo sapiens
gtcttacaagccatt

SEQ ID NO: 87635 - DNA, 15 bp, Homo sapiens
tgtcttacaagccat

SEQ ID NO: 87636 - DNA, 15 bp, Homo sapiens
atgtcttacaagcca

SEQ ID NO: 87637 - DNA, 15 bp, Homo sapiens
aatgtcttacaagcc

SEQ ID NO: 87638 - DNA, 15 bp, Homo sapiens
caatgtcttacaagc

SEQ ID NO: 87639 - DNA, 15 bp, Homo sapiens
acaatgtcttacaag

SEQ ID NO: 87640 - DNA, 15 bp, Homo sapiens
gacaatgtcttacaa

SEQ ID NO: 87641 - DNA, 15 bp, Homo sapiens
tgacaatgtcttaca

SEQ ID NO: 87642 - DNA, 15 bp, Homo sapiens
ctgacaatgtcttac

SEQ ID NO: 87643 - DNA, 15 bp, Homo sapiens
actgacaatgtctta

SEQ ID NO: 87644 - DNA, 15 bp, Homo sapiens
cactgacaatgtctt

SEQ ID NO: 87645 - DNA, 15 bp, Homo sapiens
tcactgacaatgtct

SEQ ID NO: 87646 - DNA, 15 bp, Homo sapiens
ttcactgacaatgtc

SEQ ID NO: 87647 - DNA, 15 bp, Homo sapiens
tttcactgacaatgt

SEQ ID NO: 87648 - DNA, 15 bp, Homo sapiens
ttttcactgacaatg

SEQ ID NO: 87649 - DNA, 15 bp, Homo sapiens
tttttcactgacaat

SEQ ID NO: 87650 - DNA, 15 bp, Homo sapiens
ttttttcactgacaa

SEQ ID NO: 87651 - DNA, 15 bp, Homo sapiens
attttttcactgaca

SEQ ID NO: 87652 - DNA, 15 bp, Homo sapiens
tattttttcactgac

SEQ ID NO: 87653 - DNA, 15 bp, Homo sapiens
ttattttttcactga

SEQ ID NO: 87654 - DNA, 15 bp, Homo sapiens
gttattttttcactg

SEQ ID NO: 87655 - DNA, 15 bp, Homo sapiens
agttattttttcact

SEQ ID NO: 87656 - DNA, 15 bp, Homo sapiens
cagttattttttcac

SEQ ID NO: 87657 - DNA, 15 bp, Homo sapiens
tcagttattttttca

SEQ ID NO: 87658 - DNA, 15 bp, Homo sapiens
ttcagttattttttc

SEQ ID NO: 87659 - DNA, 15 bp, Homo sapiens
cttcagttatttttt

SEQ ID NO: 87660 - DNA, 15 bp, Homo sapiens
acttcagttattttt

SEQ ID NO: 87661 - DNA, 15 bp, Homo sapiens
aacttcagttatttt

SEQ ID NO: 87662 - DNA, 15 bp, Homo sapiens
caacttcagttattt

SEQ ID NO: 87663 - DNA, 15 bp, Homo sapiens
acaacttcagttatt

SEQ ID NO: 87664 - DNA, 15 bp, Homo sapiens
aacaacttcagttat

SEQ ID NO: 87665 - DNA, 15 bp, Homo sapiens
aaacaacttcagtta

SEQ ID NO: 87666 - DNA, 15 bp, Homo sapiens
aaaacaacttcagtt

SEQ ID NO: 87667 - DNA, 15 bp, Homo sapiens
taaaacaacttcagt

SEQ ID NO: 87668 - DNA, 15 bp, Homo sapiens
ttaaaacaacttcag

SEQ ID NO: 87669 - DNA, 15 bp, Homo sapiens
gttaaaacaacttca

SEQ ID NO: 87670 - DNA, 15 bp, Homo sapiens
ggttaaaacaacttc

SEQ ID NO: 87671 - DNA, 15 bp, Homo sapiens
cggttaaaacaactt

SEQ ID NO: 87672 - DNA, 15 bp, Homo sapiens
gcggttaaaacaact

SEQ ID NO: 87673 - DNA, 15 bp, Homo sapiens
ggcggttaaaacaac

SEQ ID NO: 87674 - DNA, 15 bp, Homo sapiens
gggcggttaaaacaa

SEQ ID NO: 87675 - DNA, 15 bp, Homo sapiens
agggcggttaaaaca

SEQ ID NO: 87676 - DNA, 15 bp, Homo sapiens
aagggcggttaaaac

SEQ ID NO: 87677 - DNA, 15 bp, Homo sapiens
caagggcggttaaaa

SEQ ID NO: 87678 - DNA, 15 bp, Homo sapiens
acaagggcggttaaa

SEQ ID NO: 87679 - DNA, 15 bp, Homo sapiens
aacaagggcggttaa

SEQ ID NO: 87680 - DNA, 15 bp, Homo sapiens
gaacaagggcggtta

SEQ ID NO: 87681 - DNA, 15 bp, Homo sapiens
agaacaagggcggtt

SEQ ID NO: 87682 - DNA, 15 bp, Homo sapiens
aagaacaagggcggt

SEQ ID NO: 87683 - DNA, 15 bp, Homo sapiens
caagaacaagggcgg

SEQ ID NO: 87684 - DNA, 15 bp, Homo sapiens
tcaagaacaagggcg

SEQ ID NO: 87685 - DNA, 15 bp, Homo sapiens
ttcaagaacaagggc

SEQ ID NO: 87686 - DNA, 15 bp, Homo sapiens
cttcaagaacaaggg

SEQ ID NO: 87687 - DNA, 15 bp, Homo sapiens
acttcaagaacaagg

SEQ ID NO: 87688 - DNA, 15 bp, Homo sapiens
cacttcaagaacaag

SEQ ID NO: 87689 - DNA, 15 bp, Homo sapiens
tcacttcaagaacaa

SEQ ID NO: 87690 - DNA, 15 bp, Homo sapiens
ctcacttcaagaaca

SEQ ID NO: 87691 - DNA, 15 bp, Homo sapiens
gctcacttcaagaac

SEQ ID NO: 87692 - DNA, 15 bp, Homo sapiens
tgctcacttcaagaa

SEQ ID NO: 87693 - DNA, 15 bp, Homo sapiens
gtgctcacttcaaga

SEQ ID NO: 87694 - DNA, 15 bp, Homo sapiens
ggtgctcacttcaag

SEQ ID NO: 87695 - DNA, 15 bp, Homo sapiens
aggtgctcacttcaa

SEQ ID NO: 87696 - DNA, 15 bp, Homo sapiens
gaggtgctcacttca

SEQ ID NO: 87697 - DNA, 15 bp, Homo sapiens
agaggtgctcacttc

SEQ ID NO: 87698 - DNA, 15 bp, Homo sapiens
aagaggtgctcactt

SEQ ID NO: 87699 - DNA, 15 bp, Homo sapiens
aaagaggtgctcact

SEQ ID NO: 87700 - DNA, 15 bp, Homo sapiens
gaaagaggtgctcac

SEQ ID NO: 87701 - DNA, 15 bp, Homo sapiens
ggaaagaggtgctca

SEQ ID NO: 87702 - DNA, 15 bp, Homo sapiens
tggaaagaggtgctc

SEQ ID NO: 87703 - DNA, 15 bp, Homo sapiens
ctggaaagaggtgct

SEQ ID NO: 87704 - DNA, 15 bp, Homo sapiens
actggaaagaggtgc

SEQ ID NO: 87705 - DNA, 15 bp, Homo sapiens
aactggaaagaggtg

SEQ ID NO: 87706 - DNA, 15 bp, Homo sapiens
aaactggaaagaggt

SEQ ID NO: 87707 - DNA, 15 bp, Homo sapiens
aaaactggaaagagg

SEQ ID NO: 87708 - DNA, 15 bp, Homo sapiens
gaaaactggaaagag

SEQ ID NO: 87709 - DNA, 15 bp, Homo sapiens
agaaaactggaaaga

SEQ ID NO: 87710 - DNA, 15 bp, Homo sapiens
tagaaaactggaaag

SEQ ID NO: 87711 - DNA, 15 bp, Homo sapiens
ctagaaaactggaaa

SEQ ID NO: 87712 - DNA, 15 bp, Homo sapiens
tctagaaaactggaa

SEQ ID NO: 87713 - DNA, 15 bp, Homo sapiens
atctagaaaactgga

SEQ ID NO: 87714 - DNA, 15 bp, Homo sapiens
catctagaaaactgg

SEQ ID NO: 87715 - DNA, 15 bp, Homo sapiens
tcatctagaaaactg

SEQ ID NO: 87716 - DNA, 15 bp, Homo sapiens
ctcatctagaaaact

SEQ ID NO: 87717 - DNA, 15 bp, Homo sapiens
actcatctagaaaac

SEQ ID NO: 87718 - DNA, 15 bp, Homo sapiens
tactcatctagaaaa

SEQ ID NO: 87719 - DNA, 15 bp, Homo sapiens
ctactcatctagaaa

SEQ ID NO: 87720 - DNA, 15 bp, Homo sapiens
actactcatctagaa

SEQ ID NO: 87721 - DNA, 15 bp, Homo sapiens
cactactcatctaga

SEQ ID NO: 87722 - DNA, 15 bp, Homo sapiens
ccactactcatctag

SEQ ID NO: 87723 - DNA, 15 bp, Homo sapiens
accactactcatcta

SEQ ID NO: 87724 - DNA, 15 bp, Homo sapiens
taccactactcatct

SEQ ID NO: 87725 - DNA, 15 bp, Homo sapiens
ttaccactactcatc

SEQ ID NO: 87726 - DNA, 15 bp, Homo sapiens
attaccactactcat

SEQ ID NO: 87727 - DNA, 15 bp, Homo sapiens
aattaccactactca

SEQ ID NO: 87728 - DNA, 15 bp, Homo sapiens
aaattaccactactc

SEQ ID NO: 87729 - DNA, 15 bp, Homo sapiens
aaaattaccactact

SEQ ID NO: 87730 - DNA, 15 bp, Homo sapiens
gaaaattaccactac

SEQ ID NO: 87731 - DNA, 15 bp, Homo sapiens
ggaaaattaccacta

SEQ ID NO: 87732 - DNA, 15 bp, Homo sapiens
tggaaaattaccact

SEQ ID NO: 87733 - DNA, 15 bp, Homo sapiens
atggaaaattaccac

SEQ ID NO: 87734 - DNA, 15 bp, Homo sapiens
gatggaaaattacca

SEQ ID NO: 87735 - DNA, 15 bp, Homo sapiens
agatggaaaattacc

SEQ ID NO: 87736 - DNA, 15 bp, Homo sapiens
gagatggaaaattac

SEQ ID NO: 87737 - DNA, 15 bp, Homo sapiens
tgagatggaaaatta

SEQ ID NO: 87738 - DNA, 15 bp, Homo sapiens
ctgagatggaaaatt

SEQ ID NO: 87739 - DNA, 15 bp, Homo sapiens
tctgagatggaaaat

SEQ ID NO: 87740 - DNA, 15 bp, Homo sapiens
ttctgagatggaaaa

SEQ ID NO: 87741 - DNA, 15 bp, Homo sapiens
tttctgagatggaaa

SEQ ID NO: 87742 - DNA, 15 bp, Homo sapiens
atttctgagatggaa

SEQ ID NO: 87743 - DNA, 15 bp, Homo sapiens
aatttctgagatgga

SEQ ID NO: 87744 - DNA, 15 bp, Homo sapiens
aaatttctgagatgg

SEQ ID NO: 87745 - DNA, 15 bp, Homo sapiens
aaaatttctgagatg

SEQ ID NO: 87746 - DNA, 15 bp, Homo sapiens
taaaatttctgagat

SEQ ID NO: 87747 - DNA, 15 bp, Homo sapiens
ataaaatttctgaga

SEQ ID NO: 87748 - DNA, 15 bp, Homo sapiens
aataaaatttctgag

SEQ ID NO: 87749 - DNA, 15 bp, Homo sapiens
aaataaaatttctga

SEQ ID NO: 87750 - DNA, 15 bp, Homo sapiens
taaataaaatttctg

SEQ ID NO: 87751 - DNA, 15 bp, Homo sapiens
gtaaataaaatttct

SEQ ID NO: 87752 - DNA, 15 bp, Homo sapiens
ggtaaataaaatttc

SEQ ID NO: 87753 - DNA, 15 bp, Homo sapiens
aggtaaataaaattt

SEQ ID NO: 87754 - DNA, 15 bp, Homo sapiens
taggtaaataaaatt

SEQ ID NO: 87755 - DNA, 15 bp, Homo sapiens
gtaggtaaataaaat

SEQ ID NO: 87756 - DNA, 15 bp, Homo sapiens
agtaggtaaataaaa

SEQ ID NO: 87757 - DNA, 15 bp, Homo sapiens
aagtaggtaaataaa

SEQ ID NO: 87758 - DNA, 15 bp, Homo sapiens
taagtaggtaaataa

SEQ ID NO: 87759 - DNA, 15 bp, Homo sapiens
ttaagtaggtaaata

SEQ ID NO: 87760 - DNA, 15 bp, Homo sapiens
attaagtaggtaaat

SEQ ID NO: 87761 - DNA, 15 bp, Homo sapiens
aattaagtaggtaaa

SEQ ID NO: 87762 - DNA, 15 bp, Homo sapiens
aaattaagtaggtaa

SEQ ID NO: 87763 - DNA, 15 bp, Homo sapiens
aaaattaagtaggta

SEQ ID NO: 87764 - DNA, 15 bp, Homo sapiens
gaaaattaagtaggt

SEQ ID NO: 87765 - DNA, 15 bp, Homo sapiens
agaaaattaagtagg

SEQ ID NO: 87766 - DNA, 15 bp, Homo sapiens
aagaaaattaagtag

SEQ ID NO: 87767 - DNA, 15 bp, Homo sapiens
gaagaaaattaagta

SEQ ID NO: 87768 - DNA, 15 bp, Homo sapiens
ggaagaaaattaagt

SEQ ID NO: 87769 - DNA, 15 bp, Homo sapiens
aggaagaaaattaag

SEQ ID NO: 87770 - DNA, 15 bp, Homo sapiens
aaggaagaaaattaa

SEQ ID NO: 87771 - DNA, 15 bp, Homo sapiens
caaggaagaaaatta

SEQ ID NO: 87772 - DNA, 15 bp, Homo sapiens
tcaaggaagaaaatt

SEQ ID NO: 87773 - DNA, 15 bp, Homo sapiens
atcaaggaagaaaat

SEQ ID NO: 87774 - DNA, 15 bp, Homo sapiens
aatcaaggaagaaaa

SEQ ID NO: 87775 - DNA, 15 bp, Homo sapiens
taatcaaggaagaaa

SEQ ID NO: 87776 - DNA, 15 bp, Homo sapiens
ctaatcaaggaagaa

SEQ ID NO: 87777 - DNA, 15 bp, Homo sapiens
actaatcaaggaaga

SEQ ID NO: 87778 - DNA, 15 bp, Homo sapiens
tactaatcaaggaag

SEQ ID NO: 87779 - DNA, 15 bp, Homo sapiens
atactaatcaaggaa

SEQ ID NO: 87780 - DNA, 15 bp, Homo sapiens
catactaatcaagga

SEQ ID NO: 87781 - DNA, 15 bp, Homo sapiens
tcatactaatcaagg

SEQ ID NO: 87782 - DNA, 15 bp, Homo sapiens
ttcatactaatcaag

SEQ ID NO: 87783 - DNA, 15 bp, Homo sapiens
attcatactaatcaa

SEQ ID NO: 87784 - DNA, 15 bp, Homo sapiens
aattcatactaatca

SEQ ID NO: 87785 - DNA, 15 bp, Homo sapiens
caattcatactaatc

SEQ ID NO: 87786 - DNA, 15 bp, Homo sapiens
acaattcatactaat

SEQ ID NO: 87787 - DNA, 15 bp, Homo sapiens
gacaattcatactaa

SEQ ID NO: 87788 - DNA, 15 bp, Homo sapiens
ggacaattcatacta

SEQ ID NO: 87789 - DNA, 15 bp, Homo sapiens
tggacaattcatact

SEQ ID NO: 87790 - DNA, 15 bp, Homo sapiens
ttggacaattcatac

SEQ ID NO: 87791 - DNA, 15 bp, Homo sapiens
gttggacaattcata

SEQ ID NO: 87792 - DNA, 15 bp, Homo sapiens
tgttggacaattcat

SEQ ID NO: 87793 - DNA, 15 bp, Homo sapiens
atgttggacaattca

SEQ ID NO: 87794 - DNA, 15 bp, Homo sapiens
tatgttggacaattc

SEQ ID NO: 87795 - DNA, 15 bp, Homo sapiens
ttatgttggacaatt

SEQ ID NO: 87796 - DNA, 15 bp, Homo sapiens
tttatgttggacaat

SEQ ID NO: 87797 - DNA, 15 bp, Homo sapiens
ctttatgttggacaa

SEQ ID NO: 87798 - DNA, 15 bp, Homo sapiens
tctttatgttggaca

SEQ ID NO: 87799 - DNA, 15 bp, Homo sapiens
atctttatgttggac

SEQ ID NO: 87800 - DNA, 15 bp, Homo sapiens
catctttatgttgga

SEQ ID NO: 87801 - DNA, 15 bp, Homo sapiens
tcatctttatgttgg

SEQ ID NO: 87802 - DNA, 15 bp, Homo sapiens
atcatctttatgttg

SEQ ID NO: 87803 - DNA, 15 bp, Homo sapiens
catcatctttatgtt

SEQ ID NO: 87804 - DNA, 15 bp, Homo sapiens
acatcatctttatgt

SEQ ID NO: 87805 - DNA, 15 bp, Homo sapiens
cacatcatctttatg

SEQ ID NO: 87806 - DNA, 15 bp, Homo sapiens
ccacatcatctttat

SEQ ID NO: 87807 - DNA, 15 bp, Homo sapiens
gccacatcatcttta

SEQ ID NO: 87808 - DNA, 15 bp, Homo sapiens
agccacatcatcttt

SEQ ID NO: 87809 - DNA, 15 bp, Homo sapiens
cagccacatcatctt

SEQ ID NO: 87810 - DNA, 15 bp, Homo sapiens
ccagccacatcatct

SEQ ID NO: 87811 - DNA, 15 bp, Homo sapiens
accagccacatcatc

SEQ ID NO: 87812 - DNA, 15 bp, Homo sapiens
caccagccacatcat

SEQ ID NO: 87813 - DNA, 15 bp, Homo sapiens
acaccagccacatca

SEQ ID NO: 87814 - DNA, 15 bp, Homo sapiens
aacaccagccacatc

SEQ ID NO: 87815 - DNA, 15 bp, Homo sapiens
taacaccagccacat

SEQ ID NO: 87816 - DNA, 15 bp, Homo sapiens
gtaacaccagccaca

SEQ ID NO: 87817 - DNA, 15 bp, Homo sapiens
agtaacaccagccac

SEQ ID NO: 87818 - DNA, 15 bp, Homo sapiens
tagtaacaccagcca

SEQ ID NO: 87819 - DNA, 15 bp, Homo sapiens
atagtaacaccagcc

SEQ ID NO: 87820 - DNA, 15 bp, Homo sapiens
aatagtaacaccagc

SEQ ID NO: 87821 - DNA, 15 bp, Homo sapiens
gaatagtaacaccag

SEQ ID NO: 87822 - DNA, 15 bp, Homo sapiens
ggaatagtaacacca

SEQ ID NO: 87823 - DNA, 15 bp, Homo sapiens
aggaatagtaacacc

SEQ ID NO: 87824 - DNA, 15 bp, Homo sapiens
aaggaatagtaacac

SEQ ID NO: 87825 - DNA, 15 bp, Homo sapiens
aaaggaatagtaaca

SEQ ID NO: 87826 - DNA, 15 bp, Homo sapiens
caaaggaatagtaac

SEQ ID NO: 87827 - DNA, 15 bp, Homo sapiens
gcaaaggaatagtaa

SEQ ID NO: 87828 - DNA, 15 bp, Homo sapiens
ggcaaaggaatagta

SEQ ID NO: 87829 - DNA, 15 bp, Homo sapiens
aggcaaaggaatagt

SEQ ID NO: 87830 - DNA, 15 bp, Homo sapiens
caggcaaaggaatag

SEQ ID NO: 87831 - DNA, 15 bp, Homo sapiens
gcaggcaaaggaata

SEQ ID NO: 87832 - DNA, 15 bp, Homo sapiens
ggcaggcaaaggaat

SEQ ID NO: 87833 - DNA, 15 bp, Homo sapiens
aggcaggcaaaggaa

SEQ ID NO: 87834 - DNA, 15 bp, Homo sapiens
taggcaggcaaagga

SEQ ID NO: 87835 - DNA, 15 bp, Homo sapiens
ctaggcaggcaaagg

SEQ ID NO: 87836 - DNA, 15 bp, Homo sapiens
tctaggcaggcaaag

SEQ ID NO: 87837 - DNA, 15 bp, Homo sapiens
ttctaggcaggcaaa

SEQ ID NO: 87838 - DNA, 15 bp, Homo sapiens
attctaggcaggcaa

SEQ ID NO: 87839 - DNA, 15 bp, Homo sapiens
tattctaggcaggca

SEQ ID NO: 87840 - DNA, 15 bp, Homo sapiens
ctattctaggcaggc

SEQ ID NO: 87841 - DNA, 15 bp, Homo sapiens
tctattctaggcagg

SEQ ID NO: 87842 - DNA, 15 bp, Homo sapiens
ttctattctaggcag

SEQ ID NO: 87843 - DNA, 15 bp, Homo sapiens
tttctattctaggca

SEQ ID NO: 87844 - DNA, 15 bp, Homo sapiens
atttctattctaggc

SEQ ID NO: 87845 - DNA, 15 bp, Homo sapiens
catttctattctagg

SEQ ID NO: 87846 - DNA, 15 bp, Homo sapiens
tcatttctattctag

SEQ ID NO: 87847 - DNA, 15 bp, Homo sapiens
atcatttctattcta

SEQ ID NO: 87848 - DNA, 15 bp, Homo sapiens
catcatttctattct

SEQ ID NO: 87849 - DNA, 15 bp, Homo sapiens
ccatcatttctattc

SEQ ID NO: 87850 - DNA, 15 bp, Homo sapiens
cccatcatttctatt

SEQ ID NO: 87851 - DNA, 15 bp, Homo sapiens
ccccatcatttctat

SEQ ID NO: 87852 - DNA, 15 bp, Homo sapiens
gccccatcatttcta

SEQ ID NO: 87853 - DNA, 15 bp, Homo sapiens
tgccccatcatttct

SEQ ID NO: 87854 - DNA, 15 bp, Homo sapiens
ctgccccatcatttc

SEQ ID NO: 87855 - DNA, 15 bp, Homo sapiens
cctgccccatcattt

SEQ ID NO: 87856 - DNA, 15 bp, Homo sapiens
ccctgccccatcatt

SEQ ID NO: 87857 - DNA, 15 bp, Homo sapiens
cccctgccccatcat

SEQ ID NO: 87858 - DNA, 15 bp, Homo sapiens
gcccctgccccatca

SEQ ID NO: 87859 - DNA, 15 bp, Homo sapiens
tgcccctgccccatc

SEQ ID NO: 87860 - DNA, 15 bp, Homo sapiens
atgcccctgccccat

SEQ ID NO: 87861 - DNA, 15 bp, Homo sapiens
catgcccctgcccca

SEQ ID NO: 87862 - DNA, 15 bp, Homo sapiens
tcatgcccctgcccc

SEQ ID NO: 87863 - DNA, 15 bp, Homo sapiens
gtcatgcccctgccc

SEQ ID NO: 87864 - DNA, 15 bp, Homo sapiens
ggtcatgcccctgcc

SEQ ID NO: 87865 - DNA, 15 bp, Homo sapiens
gggtcatgcccctgc

SEQ ID NO: 87866 - DNA, 15 bp, Homo sapiens
tgggtcatgcccctg

SEQ ID NO: 87867 - DNA, 15 bp, Homo sapiens
atgggtcatgcccct

SEQ ID NO: 87868 - DNA, 15 bp, Homo sapiens
tatgggtcatgcccc

SEQ ID NO: 87869 - DNA, 15 bp, Homo sapiens
atatgggtcatgccc

SEQ ID NO: 87870 - DNA, 15 bp, Homo sapiens
gatatgggtcatgcc

SEQ ID NO: 87871 - DNA, 15 bp, Homo sapiens
agatatgggtcatgc

SEQ ID NO: 87872 - DNA, 15 bp, Homo sapiens
gagatatgggtcatg

SEQ ID NO: 87873 - DNA, 15 bp, Homo sapiens
ggagatatgggtcat

SEQ ID NO: 87874 - DNA, 15 bp, Homo sapiens
tggagatatgggtca

SEQ ID NO: 87875 - DNA, 15 bp, Homo sapiens
atggagatatgggtc

SEQ ID NO: 87876 - DNA, 15 bp, Homo sapiens
aatggagatatgggt

SEQ ID NO: 87877 - DNA, 15 bp, Homo sapiens
caatggagatatggg

SEQ ID NO: 87878 - DNA, 15 bp, Homo sapiens
acaatggagatatgg

SEQ ID NO: 87879 - DNA, 15 bp, Homo sapiens
aacaatggagatatg

SEQ ID NO: 87880 - DNA, 15 bp, Homo sapiens
gaacaatggagatat

SEQ ID NO: 87881 - DNA, 15 bp, Homo sapiens
tgaacaatggagata

SEQ ID NO: 87882 - DNA, 15 bp, Homo sapiens
atgaacaatggagat

SEQ ID NO: 87883 - DNA, 15 bp, Homo sapiens
tatgaacaatggaga

SEQ ID NO: 87884 - DNA, 15 bp, Homo sapiens
atatgaacaatggag

SEQ ID NO: 87885 - DNA, 15 bp, Homo sapiens
aatatgaacaatgga

SEQ ID NO: 87886 - DNA, 15 bp, Homo sapiens
caatatgaacaatgg

SEQ ID NO: 87887 - DNA, 15 bp, Homo sapiens
acaatatgaacaatg

SEQ ID NO: 87888 - DNA, 15 bp, Homo sapiens
aacaatatgaacaat

SEQ ID NO: 87889 - DNA, 15 bp, Homo sapiens
taacaatatgaacaa

SEQ ID NO: 87890 - DNA, 15 bp, Homo sapiens
ctaacaatatgaaca

SEQ ID NO: 87891 - DNA, 15 bp, Homo sapiens
cctaacaatatgaac

SEQ ID NO: 87892 - DNA, 15 bp, Homo sapiens
tcctaacaatatgaa

SEQ ID NO: 87893 - DNA, 15 bp, Homo sapiens
ttcctaacaatatga

SEQ ID NO: 87894 - DNA, 15 bp, Homo sapiens
tttcctaacaatatg

SEQ ID NO: 87895 - DNA, 15 bp, Homo sapiens
ttttcctaacaatat

SEQ ID NO: 87896 - DNA, 15 bp, Homo sapiens
attttcctaacaata

SEQ ID NO: 87897 - DNA, 15 bp, Homo sapiens
cattttcctaacaat

SEQ ID NO: 87898 - DNA, 15 bp, Homo sapiens
ccattttcctaacaa

SEQ ID NO: 87899 - DNA, 15 bp, Homo sapiens
accattttcctaaca

SEQ ID NO: 87900 - DNA, 15 bp, Homo sapiens
caccattttcctaac

SEQ ID NO: 87901 - DNA, 15 bp, Homo sapiens
tcaccattttcctaa

SEQ ID NO: 87902 - DNA, 15 bp, Homo sapiens
atcaccattttccta

SEQ ID NO: 87903 - DNA, 15 bp, Homo sapiens
aatcaccattttcct

SEQ ID NO: 87904 - DNA, 15 bp, Homo sapiens
aaatcaccattttcc

SEQ ID NO: 87905 - DNA, 15 bp, Homo sapiens
caaatcaccattttc

SEQ ID NO: 87906 - DNA, 15 bp, Homo sapiens
acaaatcaccatttt

SEQ ID NO: 87907 - DNA, 15 bp, Homo sapiens
aacaaatcaccattt

SEQ ID NO: 87908 - DNA, 15 bp, Homo sapiens
aaacaaatcaccatt

SEQ ID NO: 87909 - DNA, 15 bp, Homo sapiens
aaaacaaatcaccat

SEQ ID NO: 87910 - DNA, 15 bp, Homo sapiens
caaaacaaatcacca

SEQ ID NO: 87911 - DNA, 15 bp, Homo sapiens
acaaaacaaatcacc

SEQ ID NO: 87912 - DNA, 15 bp, Homo sapiens
tacaaaacaaatcac

SEQ ID NO: 87913 - DNA, 15 bp, Homo sapiens
atacaaaacaaatca

SEQ ID NO: 87914 - DNA, 15 bp, Homo sapiens
tatacaaaacaaatc

SEQ ID NO: 87915 - DNA, 15 bp, Homo sapiens
gtatacaaaacaaat

SEQ ID NO: 87916 - DNA, 15 bp, Homo sapiens
agtatacaaaacaaa

SEQ ID NO: 87917 - DNA, 15 bp, Homo sapiens
gagtatacaaaacaa

SEQ ID NO: 87918 - DNA, 15 bp, Homo sapiens
agagtatacaaaaca

SEQ ID NO: 87919 - DNA, 15 bp, Homo sapiens
gagagtatacaaaac

SEQ ID NO: 87920 - DNA, 15 bp, Homo sapiens
ggagagtatacaaaa

SEQ ID NO: 87921 - DNA, 15 bp, Homo sapiens
gggagagtatacaaa

SEQ ID NO: 87922 - DNA, 15 bp, Homo sapiens
ggggagagtatacaa

SEQ ID NO: 87923 - DNA, 15 bp, Homo sapiens
tggggagagtataca

SEQ ID NO: 87924 - DNA, 15 bp, Homo sapiens
atggggagagtatac

SEQ ID NO: 87925 - DNA, 15 bp, Homo sapiens
aatggggagagtata

SEQ ID NO: 87926 - DNA, 15 bp, Homo sapiens
taatggggagagtat

SEQ ID NO: 87927 - DNA, 15 bp, Homo sapiens
ttaatggggagagta

SEQ ID NO: 87928 - DNA, 15 bp, Homo sapiens
gttaatggggagagt

SEQ ID NO: 87929 - DNA, 15 bp, Homo sapiens
tgttaatggggagag

SEQ ID NO: 87930 - DNA, 15 bp, Homo sapiens
ctgttaatggggaga

SEQ ID NO: 87931 - DNA, 15 bp, Homo sapiens
cctgttaatggggag

SEQ ID NO: 87932 - DNA, 15 bp, Homo sapiens
ccctgttaatgggga

SEQ ID NO: 87933 - DNA, 15 bp, Homo sapiens
cccctgttaatgggg

SEQ ID NO: 87934 - DNA, 15 bp, Homo sapiens
acccctgttaatggg

SEQ ID NO: 87935 - DNA, 15 bp, Homo sapiens
tacccctgttaatgg

SEQ ID NO: 87936 - DNA, 15 bp, Homo sapiens
ttacccctgttaatg

SEQ ID NO: 87937 - DNA, 15 bp, Homo sapiens
attacccctgttaat

SEQ ID NO: 87938 - DNA, 15 bp, Homo sapiens
cattacccctgttaa

SEQ ID NO: 87939 - DNA, 15 bp, Homo sapiens
gcattacccctgtta

SEQ ID NO: 87940 - DNA, 15 bp, Homo sapiens
tgcattacccctgtt

SEQ ID NO: 87941 - DNA, 15 bp, Homo sapiens
ctgcattacccctgt

SEQ ID NO: 87942 - DNA, 15 bp, Homo sapiens
gctgcattacccctg

SEQ ID NO: 87943 - DNA, 15 bp, Homo sapiens
tgctgcattacccct

SEQ ID NO: 87944 - DNA, 15 bp, Homo sapiens
atgctgcattacccc

SEQ ID NO: 87945 - DNA, 15 bp, Homo sapiens
catgctgcattaccc

SEQ ID NO: 87946 - DNA, 15 bp, Homo sapiens
ccatgctgcattacc

SEQ ID NO: 87947 - DNA, 15 bp, Homo sapiens
gccatgctgcattac

SEQ ID NO: 87948 - DNA, 15 bp, Homo sapiens
agccatgctgcatta

SEQ ID NO: 87949 - DNA, 15 bp, Homo sapiens
aagccatgctgcatt

SEQ ID NO: 87950 - DNA, 15 bp, Homo sapiens
caagccatgctgcat

SEQ ID NO: 87951 - DNA, 15 bp, Homo sapiens
acaagccatgctgca

SEQ ID NO: 87952 - DNA, 15 bp, Homo sapiens
cacaagccatgctgc

SEQ ID NO: 87953 - DNA, 15 bp, Homo sapiens
ccacaagccatgctg

SEQ ID NO: 87954 - DNA, 15 bp, Homo sapiens
accacaagccatgct

SEQ ID NO: 87955 - DNA, 15 bp, Homo sapiens
caccacaagccatgc

SEQ ID NO: 87956 - DNA, 15 bp, Homo sapiens
acaccacaagccatg

SEQ ID NO: 87957 - DNA, 15 bp, Homo sapiens
cacaccacaagccat

SEQ ID NO: 87958 - DNA, 15 bp, Homo sapiens
tcacaccacaagcca

SEQ ID NO: 87959 - DNA, 15 bp, Homo sapiens
ttcacaccacaagcc

SEQ ID NO: 87960 - DNA, 15 bp, Homo sapiens
attcacaccacaagc

SEQ ID NO: 87961 - DNA, 15 bp, Homo sapiens
cattcacaccacaag

SEQ ID NO: 87962 - DNA, 15 bp, Homo sapiens
gcattcacaccacaa

SEQ ID NO: 87963 - DNA, 15 bp, Homo sapiens
agcattcacaccaca

SEQ ID NO: 87964 - DNA, 15 bp, Homo sapiens
aagcattcacaccac

SEQ ID NO: 87965 - DNA, 15 bp, Homo sapiens
aaagcattcacacca

SEQ ID NO: 87966 - DNA, 15 bp, Homo sapiens
caaagcattcacacc

SEQ ID NO: 87967 - DNA, 15 bp, Homo sapiens
gcaaagcattcacac

SEQ ID NO: 87968 - DNA, 15 bp, Homo sapiens
agcaaagcattcaca

SEQ ID NO: 87969 - DNA, 15 bp, Homo sapiens
aagcaaagcattcac

SEQ ID NO: 87970 - DNA, 15 bp, Homo sapiens
taagcaaagcattca

SEQ ID NO: 87971 - DNA, 15 bp, Homo sapiens
ataagcaaagcattc

SEQ ID NO: 87972 - DNA, 15 bp, Homo sapiens
cataagcaaagcatt

SEQ ID NO: 87973 - DNA, 15 bp, Homo sapiens
acataagcaaagcat

SEQ ID NO: 87974 - DNA, 15 bp, Homo sapiens
gacataagcaaagca

SEQ ID NO: 87975 - DNA, 15 bp, Homo sapiens
agacataagcaaagc

SEQ ID NO: 87976 - DNA, 15 bp, Homo sapiens
gagacataagcaaag

SEQ ID NO: 87977 - DNA, 15 bp, Homo sapiens
tgagacataagcaaa

SEQ ID NO: 87978 - DNA, 15 bp, Homo sapiens
atgagacataagcaa

SEQ ID NO: 87979 - DNA, 15 bp, Homo sapiens
tatgagacataagca

SEQ ID NO: 87980 - DNA, 15 bp, Homo sapiens
atatgagacataagc

SEQ ID NO: 87981 - DNA, 15 bp, Homo sapiens
aatatgagacataag

SEQ ID NO: 87982 - DNA, 15 bp, Homo sapiens
gaatatgagacataa

SEQ ID NO: 87983 - DNA, 15 bp, Homo sapiens
agaatatgagacata

SEQ ID NO: 87984 - DNA, 15 bp, Homo sapiens
gagaatatgagacat

SEQ ID NO: 87985 - DNA, 15 bp, Homo sapiens
agagaatatgagaca

SEQ ID NO: 87986 - DNA, 15 bp, Homo sapiens
aagagaatatgagac

SEQ ID NO: 87987 - DNA, 15 bp, Homo sapiens
taagagaatatgaga

SEQ ID NO: 87988 - DNA, 15 bp, Homo sapiens
gtaagagaatatgag

SEQ ID NO: 87989 - DNA, 15 bp, Homo sapiens
ggtaagagaatatga

SEQ ID NO: 87990 - DNA, 15 bp, Homo sapiens
aggtaagagaatatg

SEQ ID NO: 87991 - DNA, 15 bp, Homo sapiens
caggtaagagaatat

SEQ ID NO: 87992 - DNA, 15 bp, Homo sapiens
tcaggtaagagaata

SEQ ID NO: 87993 - DNA, 15 bp, Homo sapiens
ctcaggtaagagaat

SEQ ID NO: 87994 - DNA, 15 bp, Homo sapiens
tctcaggtaagagaa

SEQ ID NO: 87995 - DNA, 15 bp, Homo sapiens
ctctcaggtaagaga

SEQ ID NO: 87996 - DNA, 15 bp, Homo sapiens
tctctcaggtaagag

SEQ ID NO: 87997 - DNA, 15 bp, Homo sapiens
atctctcaggtaaga

SEQ ID NO: 87998 - DNA, 15 bp, Homo sapiens
catctctcaggtaag

SEQ ID NO: 87999 - DNA, 15 bp, Homo sapiens
ccatctctcaggtaa

SEQ ID NO: 88000 - DNA, 15 bp, Homo sapiens
accatctctcaggta

SEQ ID NO: 88001 - DNA, 15 bp, Homo sapiens
caccatctctcaggt

SEQ ID NO: 88002 - DNA, 15 bp, Homo sapiens
ccaccatctctcagg

SEQ ID NO: 88003 - DNA, 15 bp, Homo sapiens
accaccatctctcag

SEQ ID NO: 88004 - DNA, 15 bp, Homo sapiens
caccaccatctctca

SEQ ID NO: 88005 - DNA, 15 bp, Homo sapiens
tcaccaccatctctc

SEQ ID NO: 88006 - DNA, 15 bp, Homo sapiens
ttcaccaccatctct

SEQ ID NO: 88007 - DNA, 15 bp, Homo sapiens
gttcaccaccatctc

SEQ ID NO: 88008 - DNA, 15 bp, Homo sapiens
tgttcaccaccatct

SEQ ID NO: 88009 - DNA, 15 bp, Homo sapiens
ctgttcaccaccatc

SEQ ID NO: 88010 - DNA, 15 bp, Homo sapiens
actgttcaccaccat

SEQ ID NO: 88011 - DNA, 15 bp, Homo sapiens
cactgttcaccacca

SEQ ID NO: 88012 - DNA, 15 bp, Homo sapiens
tcactgttcaccacc

SEQ ID NO: 88013 - DNA, 15 bp, Homo sapiens
ttcactgttcaccac

SEQ ID NO: 88014 - DNA, 15 bp, Homo sapiens
gttcactgttcacca

SEQ ID NO: 88015 - DNA, 15 bp, Homo sapiens
agttcactgttcacc

SEQ ID NO: 88016 - DNA, 15 bp, Homo sapiens
aagttcactgttcac

SEQ ID NO: 88017 - DNA, 15 bp, Homo sapiens
gaagttcactgttca

SEQ ID NO: 88018 - DNA, 15 bp, Homo sapiens
agaagttcactgttc

SEQ ID NO: 88019 - DNA, 15 bp, Homo sapiens
cagaagttcactgtt

SEQ ID NO: 88020 - DNA, 15 bp, Homo sapiens
gcagaagttcactgt

SEQ ID NO: 88021 - DNA, 15 bp, Homo sapiens
tgcagaagttcactg

SEQ ID NO: 88022 - DNA, 15 bp, Homo sapiens
ttgcagaagttcact

SEQ ID NO: 88023 - DNA, 15 bp, Homo sapiens
attgcagaagttcac

SEQ ID NO: 88024 - DNA, 15 bp, Homo sapiens
aattgcagaagttca

SEQ ID NO: 88025 - DNA, 15 bp, Homo sapiens
caattgcagaagttc

SEQ ID NO: 88026 - DNA, 15 bp, Homo sapiens
tcaattgcagaagtt

SEQ ID NO: 88027 - DNA, 15 bp, Homo sapiens
gtcaattgcagaagt

SEQ ID NO: 88028 - DNA, 15 bp, Homo sapiens
tgtcaattgcagaag

SEQ ID NO: 88029 - DNA, 15 bp, Homo sapiens
atgtcaattgcagaa

SEQ ID NO: 88030 - DNA, 15 bp, Homo sapiens
tatgtcaattgcaga

SEQ ID NO: 88031 - DNA, 15 bp, Homo sapiens
ctatgtcaattgcag

SEQ ID NO: 88032 - DNA, 15 bp, Homo sapiens
cctatgtcaattgca

SEQ ID NO: 88033 - DNA, 15 bp, Homo sapiens
acctatgtcaattgc

SEQ ID NO: 88034 - DNA, 15 bp, Homo sapiens
cacctatgtcaattg

SEQ ID NO: 88035 - DNA, 15 bp, Homo sapiens
tcacctatgtcaatt

SEQ ID NO: 88036 - DNA, 15 bp, Homo sapiens
gtcacctatgtcaat

SEQ ID NO: 88037 - DNA, 15 bp, Homo sapiens
tgtcacctatgtcaa

SEQ ID NO: 88038 - DNA, 15 bp, Homo sapiens
gtgtcacctatgtca

SEQ ID NO: 88039 - DNA, 15 bp, Homo sapiens
tgtgtcacctatgtc

SEQ ID NO: 88040 - DNA, 15 bp, Homo sapiens
atgtgtcacctatgt

SEQ ID NO: 88041 - DNA, 15 bp, Homo sapiens
aatgtgtcacctatg

SEQ ID NO: 88042 - DNA, 15 bp, Homo sapiens
gaatgtgtcacctat

SEQ ID NO: 88043 - DNA, 15 bp, Homo sapiens
tgaatgtgtcaccta

SEQ ID NO: 88044 - DNA, 15 bp, Homo sapiens
ttgaatgtgtcacct

SEQ ID NO: 88045 - DNA, 15 bp, Homo sapiens
atttgaatgtgtcac

SEQ ID NO: 88046 - DNA, 15 bp, Homo sapiens
catttgaatgtgtca

SEQ ID NO: 88047 - DNA, 15 bp, Homo sapiens
tcatttgaatgtgtc

SEQ ID NO: 88048 - DNA, 15 bp, Homo sapiens
gtcatttgaatgtgt

SEQ ID NO: 88049 - DNA, 15 bp, Homo sapiens
tgtcatttgaatgtg

SEQ ID NO: 88050 - DNA, 15 bp, Homo sapiens
ctgtcatttgaatgt

SEQ ID NO: 88051 - DNA, 15 bp, Homo sapiens
gctgtcatttgaatg

SEQ ID NO: 88052 - DNA, 15 bp, Homo sapiens
tgctgtcatttgaat

SEQ ID NO: 88053 - DNA, 15 bp, Homo sapiens
atgctgtcatttgaa

SEQ ID NO: 88054 - DNA, 15 bp, Homo sapiens
catgctgtcatttga

SEQ ID NO: 88055 - DNA, 15 bp, Homo sapiens
tcatgctgtcatttg

SEQ ID NO: 88056 - DNA, 15 bp, Homo sapiens
atcatgctgtcattt

SEQ ID NO: 88057 - DNA, 15 bp, Homo sapiens
tatcatgctgtcatt

SEQ ID NO: 88058 - DNA, 15 bp, Homo sapiens
atatcatgctgtcat

SEQ ID NO: 88059 - DNA, 15 bp, Homo sapiens
catatcatgctgtca

SEQ ID NO: 88060 - DNA, 15 bp, Homo sapiens
gcatatcatgctgtc

SEQ ID NO: 88061 - DNA, 15 bp, Homo sapiens
ggcatatcatgctgt

SEQ ID NO: 88062 - DNA, 15 bp, Homo sapiens
gggcatatcatgctg

SEQ ID NO: 88063 - DNA, 15 bp, Homo sapiens
agggcatatcatgct

SEQ ID NO: 88064 - DNA, 15 bp, Homo sapiens
gagggcatatcatgc

SEQ ID NO: 88065 - DNA, 15 bp, Homo sapiens
tgagggcatatcatg

SEQ ID NO: 88066 - DNA, 15 bp, Homo sapiens
atgagggcatatcat

SEQ ID NO: 88067 - DNA, 15 bp, Homo sapiens
aatgagggcatatca

SEQ ID NO: 88068 - DNA, 15 bp, Homo sapiens
aaatgagggcatatc

SEQ ID NO: 88069 - DNA, 15 bp, Homo sapiens
taaatgagggcatat

SEQ ID NO: 88070 - DNA, 15 bp, Homo sapiens
ataaatgagggcata

SEQ ID NO: 88071 - DNA, 15 bp, Homo sapiens
cataaatgagggcat

SEQ ID NO: 88072 - DNA, 15 bp, Homo sapiens
tcataaatgagggca

SEQ ID NO: 88073 - DNA, 15 bp, Homo sapiens
atcataaatgagggc

SEQ ID NO: 88074 - DNA, 15 bp, Homo sapiens
aatcataaatgaggg

SEQ ID NO: 88075 - DNA, 15 bp, Homo sapiens
aaatcataaatgagg

SEQ ID NO: 88076 - DNA, 15 bp, Homo sapiens
aaaatcataaatgag

SEQ ID NO: 88077 - DNA, 15 bp, Homo sapiens
gaaaatcataaatga

SEQ ID NO: 88078 - DNA, 15 bp, Homo sapiens
tgaaaatcataaatg

SEQ ID NO: 88079 - DNA, 15 bp, Homo sapiens
ctgaaaatcataaat

SEQ ID NO: 88080 - DNA, 15 bp, Homo sapiens
actgaaaatcataaa

SEQ ID NO: 88081 - DNA, 15 bp, Homo sapiens
tactgaaaatcataa

SEQ ID NO: 88082 - DNA, 15 bp, Homo sapiens
ctactgaaaatcata

SEQ ID NO: 88083 - DNA, 15 bp, Homo sapiens
tctactgaaaatcat

SEQ ID NO: 88084 - DNA, 15 bp, Homo sapiens
gtctactgaaaatca

SEQ ID NO: 88085 - DNA, 15 bp, Homo sapiens
tgtctactgaaaatc

SEQ ID NO: 88086 - DNA, 15 bp, Homo sapiens
gtgtctactgaaaat

SEQ ID NO: 88087 - DNA, 15 bp, Homo sapiens
tgtgtctactgaaaa

SEQ ID NO: 88088 - DNA, 15 bp, Homo sapiens
ctgtgtctactgaaa

SEQ ID NO: 88089 - DNA, 15 bp, Homo sapiens
actgtgtctactgaa

SEQ ID NO: 88090 - DNA, 15 bp, Homo sapiens
cactgtgtctactga

SEQ ID NO: 88091 - DNA, 15 bp, Homo sapiens
acactgtgtctactg

SEQ ID NO: 88092 - DNA, 15 bp, Homo sapiens
tacactgtgtctact

SEQ ID NO: 88093 - DNA, 15 bp, Homo sapiens
atacactgtgtctac

SEQ ID NO: 88094 - DNA, 15 bp, Homo sapiens
aatacactgtgtcta

SEQ ID NO: 88095 - DNA, 15 bp, Homo sapiens
taatacactgtgtct

SEQ ID NO: 88096 - DNA, 15 bp, Homo sapiens
ataatacactgtgtc

SEQ ID NO: 88097 - DNA, 15 bp, Homo sapiens
tataatacactgtgt

SEQ ID NO: 88098 - DNA, 15 bp, Homo sapiens
ttataatacactgtg

SEQ ID NO: 88099 - DNA, 15 bp, Homo sapiens
tttataatacactgt

SEQ ID NO: 88100 - DNA, 15 bp, Homo sapiens
ttttataatacactg

SEQ ID NO: 88101 - DNA, 15 bp, Homo sapiens
tttttataatacact

SEQ ID NO: 88102 - DNA, 15 bp, Homo sapiens
atttttataatacac

SEQ ID NO: 88103 - DNA, 15 bp, Homo sapiens
aatttttataataca

SEQ ID NO: 88104 - DNA, 15 bp, Homo sapiens
aaatttttataatac

SEQ ID NO: 88105 - DNA, 15 bp, Homo sapiens
aaaatttttataata

SEQ ID NO: 88106 - DNA, 15 bp, Homo sapiens
gaaaatttttataat

SEQ ID NO: 88107 - DNA, 15 bp, Homo sapiens
tgaaaatttttataa

SEQ ID NO: 88108 - DNA, 15 bp, Homo sapiens
ttgaaaatttttata

SEQ ID NO: 88109 - DNA, 15 bp, Homo sapiens
tttgaaaatttttat

SEQ ID NO: 88110 - DNA, 15 bp, Homo sapiens
ctttgaaaattttta

SEQ ID NO: 88111 - DNA, 15 bp, Homo sapiens
actttgaaaattttt

SEQ ID NO: 88112 - DNA, 15 bp, Homo sapiens
aactttgaaaatttt

SEQ ID NO: 88113 - DNA, 15 bp, Homo sapiens
caactttgaaaattt

SEQ ID NO: 88114 - DNA, 15 bp, Homo sapiens
gcaactttgaaaatt

SEQ ID NO: 88115 - DNA, 15 bp, Homo sapiens
tgcaactttgaaaat

SEQ ID NO: 88116 - DNA, 15 bp, Homo sapiens
atgcaactttgaaaa

SEQ ID NO: 88117 - DNA, 15 bp, Homo sapiens
aatgcaactttgaaa

SEQ ID NO: 88118 - DNA, 15 bp, Homo sapiens
caatgcaactttgaa

SEQ ID NO: 88119 - DNA, 15 bp, Homo sapiens
acaatgcaactttga

SEQ ID NO: 88120 - DNA, 15 bp, Homo sapiens
gacaatgcaactttg

SEQ ID NO: 88121 - DNA, 15 bp, Homo sapiens
agacaatgcaacttt

SEQ ID NO: 88122 - DNA, 15 bp, Homo sapiens
cagacaatgcaactt

SEQ ID NO: 88123 - DNA, 15 bp, Homo sapiens
acagacaatgcaact

SEQ ID NO: 88124 - DNA, 15 bp, Homo sapiens
cacagacaatgcaac

SEQ ID NO: 88125 - DNA, 15 bp, Homo sapiens
ccacagacaatgcaa

SEQ ID NO: 88126 - DNA, 15 bp, Homo sapiens
tccacagacaatgca

SEQ ID NO: 88127 - DNA, 15 bp, Homo sapiens
atccacagacaatgc

SEQ ID NO: 88128 - DNA, 15 bp, Homo sapiens
gatccacagacaatg

SEQ ID NO: 88129 - DNA, 15 bp, Homo sapiens
tgatccacagacaat

SEQ ID NO: 88130 - DNA, 15 bp, Homo sapiens
atgatccacagacaa

SEQ ID NO: 88131 - DNA, 15 bp, Homo sapiens
tatgatccacagaca

SEQ ID NO: 88132 - DNA, 15 bp, Homo sapiens
gtatgatccacagac

SEQ ID NO: 88133 - DNA, 15 bp, Homo sapiens
tgtatgatccacaga

SEQ ID NO: 88134 - DNA, 15 bp, Homo sapiens
atgtatgatccacag

SEQ ID NO: 88135 - DNA, 15 bp, Homo sapiens
catgtatgatccaca

SEQ ID NO: 88136 - DNA, 15 bp, Homo sapiens
tcatgtatgatccac

SEQ ID NO: 88137 - DNA, 15 bp, Homo sapiens
gtcatgtatgatcca

SEQ ID NO: 88138 - DNA, 15 bp, Homo sapiens
agtcatgtatgatcc

SEQ ID NO: 88139 - DNA, 15 bp, Homo sapiens
aagtcatgtatgatc

SEQ ID NO: 88140 - DNA, 15 bp, Homo sapiens
aaagtcatgtatgat

SEQ ID NO: 88141 - DNA, 15 bp, Homo sapiens
aaaagtcatgtatga

SEQ ID NO: 88142 - DNA, 15 bp, Homo sapiens
aaaaagtcatgtatg

SEQ ID NO: 88143 - DNA, 15 bp, Homo sapiens
caaaaagtcatgtat

SEQ ID NO: 88144 - DNA, 15 bp, Homo sapiens
acaaaaagtcatgta

SEQ ID NO: 88145 - DNA, 15 bp, Homo sapiens
aacaaaaagtcatgt

SEQ ID NO: 88146 - DNA, 15 bp, Homo sapiens
aaacaaaaagtcatg

SEQ ID NO: 88147 - DNA, 15 bp, Homo sapiens
aaaacaaaaagtcat

SEQ ID NO: 88148 - DNA, 15 bp, Homo sapiens
aaaaacaaaaagtca

SEQ ID NO: 88149 - DNA, 15 bp, Homo sapiens
taaaaacaaaaagtc

SEQ ID NO: 88150 - DNA, 15 bp, Homo sapiens
ataaaaacaaaaagt

SEQ ID NO: 88151 - DNA, 15 bp, Homo sapiens
cataaaaacaaaaag

SEQ ID NO: 88152 - DNA, 15 bp, Homo sapiens
gcataaaaacaaaaa

SEQ ID NO: 88153 - DNA, 15 bp, Homo sapiens
ggcataaaaacaaaa

SEQ ID NO: 88154 - DNA, 15 bp, Homo sapiens
aggcataaaaacaaa

SEQ ID NO: 88155 - DNA, 15 bp, Homo sapiens
aaggcataaaaacaa

SEQ ID NO: 88156 - DNA, 15 bp, Homo sapiens
aaaggcataaaaaca

SEQ ID NO: 88157 - DNA, 15 bp, Homo sapiens
caaaggcataaaaac

SEQ ID NO: 88158 - DNA, 15 bp, Homo sapiens
acaaaggcataaaaa

SEQ ID NO: 88159 - DNA, 15 bp, Homo sapiens
aacaaaggcataaaa

SEQ ID NO: 88160 - DNA, 15 bp, Homo sapiens
aaacaaaggcataaa

SEQ ID NO: 88161 - DNA, 15 bp, Homo sapiens
aaaacaaaggcataa

SEQ ID NO: 88162 - DNA, 15 bp, Homo sapiens
aaaaacaaaggcata

SEQ ID NO: 88163 - DNA, 15 bp, Homo sapiens
aaaaaacaaaggcat

SEQ ID NO: 88164 - DNA, 15 bp, Homo sapiens
taaaaaacaaaggca

SEQ ID NO: 88165 - DNA, 15 bp, Homo sapiens
ctaaaaaacaaaggc

SEQ ID NO: 88166 - DNA, 15 bp, Homo sapiens
actaaaaaacaaagg

SEQ ID NO: 88167 - DNA, 15 bp, Homo sapiens
aactaaaaaacaaag

SEQ ID NO: 88168 - DNA, 15 bp, Homo sapiens
gaactaaaaaacaaa

SEQ ID NO: 88169 - DNA, 15 bp, Homo sapiens
tgaactaaaaaacaa

SEQ ID NO: 88170 - DNA, 15 bp, Homo sapiens
ttgaactaaaaaaca

SEQ ID NO: 88171 - DNA, 15 bp, Homo sapiens
cttgaactaaaaaac

SEQ ID NO: 88172 - DNA, 15 bp, Homo sapiens
gcttgaactaaaaaa

SEQ ID NO: 88173 - DNA, 15 bp, Homo sapiens
agcttgaactaaaaa

SEQ ID NO: 88174 - DNA, 15 bp, Homo sapiens
gagcttgaactaaaa

SEQ ID NO: 88175 - DNA, 15 bp, Homo sapiens
agagcttgaactaaa

SEQ ID NO: 88176 - DNA, 15 bp, Homo sapiens
gagagcttgaactaa

SEQ ID NO: 88177 - DNA, 15 bp, Homo sapiens
tgagagcttgaacta

SEQ ID NO: 88178 - DNA, 15 bp, Homo sapiens
atgagagcttgaact

SEQ ID NO: 88179 - DNA, 15 bp, Homo sapiens
aatgagagcttgaac

SEQ ID NO: 88180 - DNA, 15 bp, Homo sapiens
taatgagagcttgaa

SEQ ID NO: 88181 - DNA, 15 bp, Homo sapiens
ataatgagagcttga

SEQ ID NO: 88182 - DNA, 15 bp, Homo sapiens
gataatgagagcttg

SEQ ID NO: 88183 - DNA, 15 bp, Homo sapiens
ggataatgagagctt

SEQ ID NO: 88184 - DNA, 15 bp, Homo sapiens
aggataatgagagct

SEQ ID NO: 88185 - DNA, 15 bp, Homo sapiens
caggataatgagagc

SEQ ID NO: 88186 - DNA, 15 bp, Homo sapiens
ccaggataatgagag

SEQ ID NO: 88187 - DNA, 15 bp, Homo sapiens
tccaggataatgaga

SEQ ID NO: 88188 - DNA, 15 bp, Homo sapiens
atccaggataatgag

SEQ ID NO: 88189 - DNA, 15 bp, Homo sapiens
aatccaggataatga

SEQ ID NO: 88190 - DNA, 15 bp, Homo sapiens
aaatccaggataatg

SEQ ID NO: 88191 - DNA, 15 bp, Homo sapiens
aaaatccaggataat

SEQ ID NO: 88192 - DNA, 15 bp, Homo sapiens
caaaatccaggataa

SEQ ID NO: 88193 - DNA, 15 bp, Homo sapiens
tcaaaatccaggata

SEQ ID NO: 88194 - DNA, 15 bp, Homo sapiens
atcaaaatccaggat

SEQ ID NO: 88195 - DNA, 15 bp, Homo sapiens
gatcaaaatccagga

SEQ ID NO: 88196 - DNA, 15 bp, Homo sapiens
tgatcaaaatccagg

SEQ ID NO: 88197 - DNA, 15 bp, Homo sapiens
atgatcaaaatccag

SEQ ID NO: 88198 - DNA, 15 bp, Homo sapiens
tatgatcaaaatcca

SEQ ID NO: 88199 - DNA, 15 bp, Homo sapiens
atatgatcaaaatcc

SEQ ID NO: 88200 - DNA, 15 bp, Homo sapiens
tatatgatcaaaatc

SEQ ID NO: 88201 - DNA, 15 bp, Homo sapiens
atatatgatcaaaat

SEQ ID NO: 88202 - DNA, 15 bp, Homo sapiens
catatatgatcaaaa

SEQ ID NO: 88203 - DNA, 15 bp, Homo sapiens
acatatatgatcaaa

SEQ ID NO: 88204 - DNA, 15 bp, Homo sapiens
aacatatatgatcaa

SEQ ID NO: 88205 - DNA, 15 bp, Homo sapiens
aaacatatatgatca

SEQ ID NO: 88206 - DNA, 15 bp, Homo sapiens
taaacatatatgatc

SEQ ID NO: 88207 - DNA, 15 bp, Homo sapiens
ataaacatatatgat

SEQ ID NO: 88208 - DNA, 15 bp, Homo sapiens
tataaacatatatga

SEQ ID NO: 88209 - DNA, 15 bp, Homo sapiens
ttataaacatatatg

SEQ ID NO: 88210 - DNA, 15 bp, Homo sapiens
tttataaacatatat

SEQ ID NO: 88211 - DNA, 15 bp, Homo sapiens
ctttataaacatata

SEQ ID NO: 88212 - DNA, 15 bp, Homo sapiens
gctttataaacatat

SEQ ID NO: 88213 - DNA, 15 bp, Homo sapiens
tgctttataaacata

SEQ ID NO: 88214 - DNA, 15 bp, Homo sapiens
ctgctttataaacat

SEQ ID NO: 88215 - DNA, 15 bp, Homo sapiens
cctgctttataaaca

SEQ ID NO: 88216 - DNA, 15 bp, Homo sapiens
tcctgctttataaac

SEQ ID NO: 88217 - DNA, 15 bp, Homo sapiens
atcctgctttataaa

SEQ ID NO: 88218 - DNA, 15 bp, Homo sapiens
aatcctgctttataa

SEQ ID NO: 88219 - DNA, 15 bp, Homo sapiens
caatcctgctttata

SEQ ID NO: 88220 - DNA, 15 bp, Homo sapiens
acaatcctgctttat

SEQ ID NO: 88221 - DNA, 15 bp, Homo sapiens
aacaatcctgcttta

SEQ ID NO: 88222 - DNA, 15 bp, Homo sapiens
aaacaatcctgcttt

SEQ ID NO: 88223 - DNA, 15 bp, Homo sapiens
aaaacaatcctgctt

SEQ ID NO: 88224 - DNA, 15 bp, Homo sapiens
taaaacaatcctgct

SEQ ID NO: 88225 - DNA, 15 bp, Homo sapiens
ataaaacaatcctgc

SEQ ID NO: 88226 - DNA, 15 bp, Homo sapiens
aataaaacaatcctg

SEQ ID NO: 88227 - DNA, 15 bp, Homo sapiens
caataaaacaatcct

SEQ ID NO: 88228 - DNA, 15 bp, Homo sapiens
gcaataaaacaatcc

SEQ ID NO: 88229 - DNA, 15 bp, Homo sapiens
agcaataaaacaatc

SEQ ID NO: 88230 - DNA, 15 bp, Homo sapiens
aagcaataaaacaat

SEQ ID NO: 88231 - DNA, 15 bp, Homo sapiens
aaagcaataaaacaa

SEQ ID NO: 88232 - DNA, 15 bp, Homo sapiens
gaaagcaataaaaca

SEQ ID NO: 88233 - DNA, 15 bp, Homo sapiens
ggaaagcaataaaac

SEQ ID NO: 88234 - DNA, 15 bp, Homo sapiens
aggaaagcaataaaa

SEQ ID NO: 88235 - DNA, 15 bp, Homo sapiens
taggaaagcaataaa

SEQ ID NO: 88236 - DNA, 15 bp, Homo sapiens
gtaggaaagcaataa

SEQ ID NO: 88237 - DNA, 15 bp, Homo sapiens
agtaggaaagcaata

SEQ ID NO: 88238 - DNA, 15 bp, Homo sapiens
gagtaggaaagcaat

SEQ ID NO: 88239 - DNA, 15 bp, Homo sapiens
tgagtaggaaagcaa

SEQ ID NO: 88240 - DNA, 15 bp, Homo sapiens
ttgagtaggaaagca

SEQ ID NO: 88241 - DNA, 15 bp, Homo sapiens
attgagtaggaaagc

SEQ ID NO: 88242 - DNA, 15 bp, Homo sapiens
tattgagtaggaaag

SEQ ID NO: 88243 - DNA, 15 bp, Homo sapiens
ttattgagtaggaaa

SEQ ID NO: 88244 - DNA, 15 bp, Homo sapiens
tttattgagtaggaa

SEQ ID NO: 88245 - DNA, 15 bp, Homo sapiens
ttttattgagtagga

SEQ ID NO: 88246 - DNA, 15 bp, Homo sapiens
tttttattgagtagg

SEQ ID NO: 88247 - DNA, 15 bp, Homo sapiens
atttttattgagtag

SEQ ID NO: 88248 - DNA, 15 bp, Homo sapiens
catttttattgagta

SEQ ID NO: 88249 - DNA, 15 bp, Homo sapiens
acatttttattgagt

SEQ ID NO: 88250 - DNA, 15 bp, Homo sapiens
cacatttttattgag

SEQ ID NO: 88251 - DNA, 15 bp, Homo sapiens
tcacatttttattga

SEQ ID NO: 88252 - DNA, 15 bp, Homo sapiens
ttcacatttttattg

SEQ ID NO: 88253 - DNA, 15 bp, Homo sapiens
cttcacatttttatt

SEQ ID NO: 88254 - DNA, 15 bp, Homo sapiens
gcttcacatttttat

SEQ ID NO: 88255 - DNA, 15 bp, Homo sapiens
ggcttcacattttta

SEQ ID NO: 88256 - DNA, 15 bp, Homo sapiens
tggcttcacattttt

SEQ ID NO: 88257 - DNA, 15 bp, Homo sapiens
atggcttcacatttt

SEQ ID NO: 88258 - DNA, 15 bp, Homo sapiens
gatggcttcacattt

SEQ ID NO: 88259 - DNA, 15 bp, Homo sapiens
ggatggcttcacatt

SEQ ID NO: 88260 - DNA, 15 bp, Homo sapiens
aggatggcttcacat

SEQ ID NO: 88261 - DNA, 15 bp, Homo sapiens
aaggatggcttcaca

SEQ ID NO: 88262 - DNA, 15 bp, Homo sapiens
aaaggatggcttcac

SEQ ID NO: 88263 - DNA, 15 bp, Homo sapiens
aaaaggatggcttca

SEQ ID NO: 88264 - DNA, 15 bp, Homo sapiens
caaaaggatggcttc

SEQ ID NO: 88265 - DNA, 15 bp, Homo sapiens
ccaaaaggatggctt

SEQ ID NO: 88266 - DNA, 15 bp, Homo sapiens
accaaaaggatggct

SEQ ID NO: 88267 - DNA, 15 bp, Homo sapiens
taccaaaaggatggc

SEQ ID NO: 88268 - DNA, 15 bp, Homo sapiens
ataccaaaaggatgg

SEQ ID NO: 88269 - DNA, 15 bp, Homo sapiens
cataccaaaaggatg

SEQ ID NO: 88270 - DNA, 15 bp, Homo sapiens
gcataccaaaaggat

SEQ ID NO: 88271 - DNA, 15 bp, Homo sapiens
tgcataccaaaagga

SEQ ID NO: 88272 - DNA, 15 bp, Homo sapiens
atgcataccaaaagg

SEQ ID NO: 88273 - DNA, 15 bp, Homo sapiens
catgcataccaaaag

SEQ ID NO: 88274 - DNA, 15 bp, Homo sapiens
acatgcataccaaaa

SEQ ID NO: 88275 - DNA, 15 bp, Homo sapiens
aacatgcataccaaa

SEQ ID NO: 88276 - DNA, 15 bp, Homo sapiens
aaacatgcataccaa

SEQ ID NO: 88277 - DNA, 15 bp, Homo sapiens
aaaacatgcatacca

SEQ ID NO: 88278 - DNA, 15 bp, Homo sapiens
gaaaacatgcatacc

SEQ ID NO: 88279 - DNA, 15 bp, Homo sapiens
ggaaaacatgcatac

SEQ ID NO: 88280 - DNA, 15 bp, Homo sapiens
aggaaaacatgcata

SEQ ID NO: 88281 - DNA, 15 bp, Homo sapiens
gaggaaaacatgcat

SEQ ID NO: 88282 - DNA, 15 bp, Homo sapiens
ggaggaaaacatgca

SEQ ID NO: 88283 - DNA, 15 bp, Homo sapiens
cggaggaaaacatgc

SEQ ID NO: 88284 - DNA, 15 bp, Homo sapiens
tcggaggaaaacatg

SEQ ID NO: 88285 - DNA, 15 bp, Homo sapiens
ttcggaggaaaacat

SEQ ID NO: 88286 - DNA, 15 bp, Homo sapiens
attcggaggaaaaca

SEQ ID NO: 88287 - DNA, 15 bp, Homo sapiens
tattcggaggaaaac

SEQ ID NO: 88288 - DNA, 15 bp, Homo sapiens
ctattcggaggaaaa

SEQ ID NO: 88289 - DNA, 15 bp, Homo sapiens
tctattcggaggaaa

SEQ ID NO: 88290 - DNA, 15 bp, Homo sapiens
ttctattcggaggaa

SEQ ID NO: 88291 - DNA, 15 bp, Homo sapiens
tttctattcggagga

SEQ ID NO: 88292 - DNA, 15 bp, Homo sapiens
ctttctattcggagg

SEQ ID NO: 88293 - DNA, 15 bp, Homo sapiens
tctttctattcggag

SEQ ID NO: 88294 - DNA, 15 bp, Homo sapiens
atctttctattcgga

SEQ ID NO: 88295 - DNA, 15 bp, Homo sapiens
aatctttctattcgg

SEQ ID NO: 88296 - DNA, 15 bp, Homo sapiens
gaatctttctattcg

SEQ ID NO: 88297 - DNA, 15 bp, Homo sapiens
ggaatctttctattc

SEQ ID NO: 88298 - DNA, 15 bp, Homo sapiens
aggaatctttctatt

SEQ ID NO: 88299 - DNA, 15 bp, Homo sapiens
aaggaatctttctat

SEQ ID NO: 88300 - DNA, 15 bp, Homo sapiens
aaaggaatctttcta

SEQ ID NO: 88301 - DNA, 15 bp, Homo sapiens
caaaggaatctttct

SEQ ID NO: 88302 - DNA, 15 bp, Homo sapiens
tcaaaggaatctttc

SEQ ID NO: 88303 - DNA, 15 bp, Homo sapiens
ttcaaaggaatcttt

SEQ ID NO: 88304 - DNA, 15 bp, Homo sapiens
cttcaaaggaatctt

SEQ ID NO: 88305 - DNA, 15 bp, Homo sapiens
tcttcaaaggaatct

SEQ ID NO: 88306 - DNA, 15 bp, Homo sapiens
atcttcaaaggaatc

SEQ ID NO: 88307 - DNA, 15 bp, Homo sapiens
aatcttcaaaggaat

SEQ ID NO: 88308 - DNA, 15 bp, Homo sapiens
aaatcttcaaaggaa

SEQ ID NO: 88309 - DNA, 15 bp, Homo sapiens
gaaatcttcaaagga

SEQ ID NO: 88310 - DNA, 15 bp, Homo sapiens
ggaaatcttcaaagg

SEQ ID NO: 88311 - DNA, 15 bp, Homo sapiens
gggaaatcttcaaag

SEQ ID NO: 88312 - DNA, 15 bp, Homo sapiens
tgggaaatcttcaaa

SEQ ID NO: 88313 - DNA, 15 bp, Homo sapiens
atgggaaatcttcaa

SEQ ID NO: 88314 - DNA, 15 bp, Homo sapiens
tatgggaaatcttca

SEQ ID NO: 88315 - DNA, 15 bp, Homo sapiens
gtatgggaaatcttc

SEQ ID NO: 88316 - DNA, 15 bp, Homo sapiens
agtatgggaaatctt

SEQ ID NO: 88317 - DNA, 15 bp, Homo sapiens
aagtatgggaaatct

SEQ ID NO: 88318 - DNA, 15 bp, Homo sapiens
aaagtatgggaaatc

SEQ ID NO: 88319 - DNA, 15 bp, Homo sapiens
aaaagtatgggaaat

SEQ ID NO: 88320 - DNA, 15 bp, Homo sapiens
aaaaagtatgggaaa

SEQ ID NO: 88321 - DNA, 15 bp, Homo sapiens
gaaaaagtatgggaa

SEQ ID NO: 88322 - DNA, 15 bp, Homo sapiens
tgaaaaagtatggga

SEQ ID NO: 88323 - DNA, 15 bp, Homo sapiens
atgaaaaagtatggg

SEQ ID NO: 88324 - DNA, 15 bp, Homo sapiens
tatgaaaaagtatgg

SEQ ID NO: 88325 - DNA, 15 bp, Homo sapiens
ctatgaaaaagtatg

SEQ ID NO: 88326 - DNA, 15 bp, Homo sapiens
actatgaaaaagtat

SEQ ID NO: 88327 - DNA, 15 bp, Homo sapiens
gactatgaaaaagta

SEQ ID NO: 88328 - DNA, 15 bp, Homo sapiens
tgactatgaaaaagt

SEQ ID NO: 88329 - DNA, 15 bp, Homo sapiens
atgactatgaaaaag

SEQ ID NO: 88330 - DNA, 15 bp, Homo sapiens
aatgactatgaaaaa

SEQ ID NO: 88331 - DNA, 15 bp, Homo sapiens
aaatgactatgaaaa

SEQ ID NO: 88332 - DNA, 15 bp, Homo sapiens
aaaatgactatgaaa

SEQ ID NO: 88333 - DNA, 15 bp, Homo sapiens
taaaatgactatgaa

SEQ ID NO: 88334 - DNA, 15 bp, Homo sapiens
ctaaaatgactatga

SEQ ID NO: 88335 - DNA, 15 bp, Homo sapiens
tctaaaatgactatg

SEQ ID NO: 88336 - DNA, 15 bp, Homo sapiens
ctctaaaatgactat

SEQ ID NO: 88337 - DNA, 15 bp, Homo sapiens
cctctaaaatgacta

SEQ ID NO: 88338 - DNA, 15 bp, Homo sapiens
tcctctaaaatgact

SEQ ID NO: 88339 - DNA, 15 bp, Homo sapiens
atcctctaaaatgac

SEQ ID NO: 88340 - DNA, 15 bp, Homo sapiens
aatcctctaaaatga

SEQ ID NO: 88341 - DNA, 15 bp, Homo sapiens
aaatcctctaaaatg

SEQ ID NO: 88342 - DNA, 15 bp, Homo sapiens
caaatcctctaaaat

SEQ ID NO: 88343 - DNA, 15 bp, Homo sapiens
tcaaatcctctaaaa

SEQ ID NO: 88344 - DNA, 15 bp, Homo sapiens
ttcaaatcctctaaa

SEQ ID NO: 88345 - DNA, 15 bp, Homo sapiens
cttcaaatcctctaa

SEQ ID NO: 88346 - DNA, 15 bp, Homo sapiens
ccttcaaatcctcta

SEQ ID NO: 88347 - DNA, 15 bp, Homo sapiens
accttcaaatcctct

SEQ ID NO: 88348 - DNA, 15 bp, Homo sapiens
taccttcaaatcctc

SEQ ID NO: 88349 - DNA, 15 bp, Homo sapiens
ataccttcaaatcct

SEQ ID NO: 88350 - DNA, 15 bp, Homo sapiens
aataccttcaaatcc

SEQ ID NO: 88351 - DNA, 15 bp, Homo sapiens
aaataccttcaaatc

SEQ ID NO: 88352 - DNA, 15 bp, Homo sapiens
aaaataccttcaaat

SEQ ID NO: 88353 - DNA, 15 bp, Homo sapiens
taaaataccttcaaa

SEQ ID NO: 88354 - DNA, 15 bp, Homo sapiens
ctaaaataccttcaa

SEQ ID NO: 88355 - DNA, 15 bp, Homo sapiens
tctaaaataccttca

SEQ ID NO: 88356 - DNA, 15 bp, Homo sapiens
atctaaaataccttc

SEQ ID NO: 88357 - DNA, 15 bp, Homo sapiens
aatctaaaatacctt

SEQ ID NO: 88358 - DNA, 15 bp, Homo sapiens
taatctaaaatacct

SEQ ID NO: 88359 - DNA, 15 bp, Homo sapiens
ttaatctaaaatacc

SEQ ID NO: 88360 - DNA, 15 bp, Homo sapiens
cttaatctaaaatac

SEQ ID NO: 88361 - DNA, 15 bp, Homo sapiens
ccttaatctaaaata

SEQ ID NO: 88362 - DNA, 15 bp, Homo sapiens
cccttaatctaaaat

SEQ ID NO: 88363 - DNA, 15 bp, Homo sapiens
tcccttaatctaaaa

SEQ ID NO: 88364 - DNA, 15 bp, Homo sapiens
ttcccttaatctaaa

SEQ ID NO: 88365 - DNA, 15 bp, Homo sapiens
cttcccttaatctaa

SEQ ID NO: 88366 - DNA, 15 bp, Homo sapiens
ccttcccttaatcta

SEQ ID NO: 88367 - DNA, 15 bp, Homo sapiens
tccttcccttaatct

SEQ ID NO: 88368 - DNA, 15 bp, Homo sapiens
gtccttcccttaatc

SEQ ID NO: 88369 - DNA, 15 bp, Homo sapiens
agtccttcccttaat

SEQ ID NO: 88370 - DNA, 15 bp, Homo sapiens
tagtccttcccttaa

SEQ ID NO: 88371 - DNA, 15 bp, Homo sapiens
atagtccttccctta

SEQ ID NO: 88372 - DNA, 15 bp, Homo sapiens
catagtccttccctt

SEQ ID NO: 88373 - DNA, 15 bp, Homo sapiens
tcatagtccttccct

SEQ ID NO: 88374 - DNA, 15 bp, Homo sapiens
atcatagtccttccc

SEQ ID NO: 88375 - DNA, 15 bp, Homo sapiens
tatcatagtccttcc

SEQ ID NO: 88376 - DNA, 15 bp, Homo sapiens
ttatcatagtccttc

SEQ ID NO: 88377 - DNA, 15 bp, Homo sapiens
tttatcatagtcctt

SEQ ID NO: 88378 - DNA, 15 bp, Homo sapiens
ttttatcatagtcct

SEQ ID NO: 88379 - DNA, 15 bp, Homo sapiens
gttttatcatagtcc

SEQ ID NO: 88380 - DNA, 15 bp, Homo sapiens
ggttttatcatagtc

SEQ ID NO: 88381 - DNA, 15 bp, Homo sapiens
aggttttatcatagt

SEQ ID NO: 88382 - DNA, 15 bp, Homo sapiens
taggttttatcatag

SEQ ID NO: 88383 - DNA, 15 bp, Homo sapiens
ataggttttatcata

SEQ ID NO: 88384 - DNA, 15 bp, Homo sapiens
aataggttttatcat

SEQ ID NO: 88385 - DNA, 15 bp, Homo sapiens
taataggttttatca

SEQ ID NO: 88386 - DNA, 15 bp, Homo sapiens
ataataggttttatc

SEQ ID NO: 88387 - DNA, 15 bp, Homo sapiens
aataataggttttat

SEQ ID NO: 88388 - DNA, 15 bp, Homo sapiens
taataataggtttta

SEQ ID NO: 88389 - DNA, 15 bp, Homo sapiens
ataataataggtttt

SEQ ID NO: 88390 - DNA, 15 bp, Homo sapiens
tataataataggttt

SEQ ID NO: 88391 - DNA, 15 bp, Homo sapiens
atataataataggtt

SEQ ID NO: 88392 - DNA, 15 bp, Homo sapiens
tatataataataggt

SEQ ID NO: 88393 - DNA, 15 bp, Homo sapiens
atatataataatagg

SEQ ID NO: 88394 - DNA, 15 bp, Homo sapiens
catatataataatag

SEQ ID NO: 88395 - DNA, 15 bp, Homo sapiens
tcatatataataata

SEQ ID NO: 88396 - DNA, 15 bp, Homo sapiens
gtcatatataataat

SEQ ID NO: 88397 - DNA, 15 bp, Homo sapiens
agtcatatataataa

SEQ ID NO: 88398 - DNA, 15 bp, Homo sapiens
aagtcatatataata

SEQ ID NO: 88399 - DNA, 15 bp, Homo sapiens
aaagtcatatataat

SEQ ID NO: 88400 - DNA, 15 bp, Homo sapiens
taaagtcatatataa

SEQ ID NO: 88401 - DNA, 15 bp, Homo sapiens
ataaagtcatatata

SEQ ID NO: 88402 - DNA, 15 bp, Homo sapiens
aataaagtcatatat

SEQ ID NO: 88403 - DNA, 15 bp, Homo sapiens
taataaagtcatata

SEQ ID NO: 88404 - DNA, 15 bp, Homo sapiens
ataataaagtcatat

SEQ ID NO: 88405 - DNA, 15 bp, Homo sapiens
aataataaagtcata

SEQ ID NO: 88406 - DNA, 15 bp, Homo sapiens
aaataataaagtcat

SEQ ID NO: 88407 - DNA, 15 bp, Homo sapiens
aaaataataaagtca

SEQ ID NO: 88408 - DNA, 15 bp, Homo sapiens
aaaaataataaagtc

SEQ ID NO: 88409 - DNA, 15 bp, Homo sapiens
taaaaataataaagt

SEQ ID NO: 88410 - DNA, 15 bp, Homo sapiens
ctaaaaataataaag

SEQ ID NO: 88411 - DNA, 15 bp, Homo sapiens
cctaaaaataataaa

SEQ ID NO: 88412 - DNA, 15 bp, Homo sapiens
tcctaaaaataataa

SEQ ID NO: 88413 - DNA, 15 bp, Homo sapiens
ttcctaaaaataata

SEQ ID NO: 88414 - DNA, 15 bp, Homo sapiens
gttcctaaaaataat

SEQ ID NO: 88415 - DNA, 15 bp, Homo sapiens
tgttcctaaaaataa

SEQ ID NO: 88416 - DNA, 15 bp, Homo sapiens
atgttcctaaaaata

SEQ ID NO: 88417 - DNA, 15 bp, Homo sapiens
aatgttcctaaaaat

SEQ ID NO: 88418 - DNA, 15 bp, Homo sapiens
gaatgttcctaaaaa

SEQ ID NO: 88419 - DNA, 15 bp, Homo sapiens
agaatgttcctaaaa

SEQ ID NO: 88420 - DNA, 15 bp, Homo sapiens
gagaatgttcctaaa

SEQ ID NO: 88421 - DNA, 15 bp, Homo sapiens
agagaatgttcctaa

SEQ ID NO: 88422 - DNA, 15 bp, Homo sapiens
tagagaatgttccta

SEQ ID NO: 88423 - DNA, 15 bp, Homo sapiens
gtagagaatgttcct

SEQ ID NO: 88424 - DNA, 15 bp, Homo sapiens
agtagagaatgttcc

SEQ ID NO: 88425 - DNA, 15 bp, Homo sapiens
aagtagagaatgttc

SEQ ID NO: 88426 - DNA, 15 bp, Homo sapiens
aaagtagagaatgtt

SEQ ID NO: 88427 - DNA, 15 bp, Homo sapiens
aaaagtagagaatgt

SEQ ID NO: 88428 - DNA, 15 bp, Homo sapiens
gaaaagtagagaatg

SEQ ID NO: 88429 - DNA, 15 bp, Homo sapiens
tgaaaagtagagaat

SEQ ID NO: 88430 - DNA, 15 bp, Homo sapiens
ttgaaaagtagagaa

SEQ ID NO: 88431 - DNA, 15 bp, Homo sapiens
tttgaaaagtagaga

SEQ ID NO: 88432 - DNA, 15 bp, Homo sapiens
ttttgaaaagtagag

SEQ ID NO: 88433 - DNA, 15 bp, Homo sapiens
tttttgaaaagtaga

SEQ ID NO: 88434 - DNA, 15 bp, Homo sapiens
atttttgaaaagtag

SEQ ID NO: 88435 - DNA, 15 bp, Homo sapiens
tatttttgaaaagta

SEQ ID NO: 88436 - DNA, 15 bp, Homo sapiens
atatttttgaaaagt

SEQ ID NO: 88437 - DNA, 15 bp, Homo sapiens
gatatttttgaaaag

SEQ ID NO: 88438 - DNA, 15 bp, Homo sapiens
cgatatttttgaaaa

SEQ ID NO: 88439 - DNA, 15 bp, Homo sapiens
ccgatatttttgaaa

SEQ ID NO: 88440 - DNA, 15 bp, Homo sapiens
tccgatatttttgaa

SEQ ID NO: 88441 - DNA, 15 bp, Homo sapiens
gtccgatatttttga

SEQ ID NO: 88442 - DNA, 15 bp, Homo sapiens
tgtccgatatttttg

SEQ ID NO: 88443 - DNA, 15 bp, Homo sapiens
ttgtccgatattttt

SEQ ID NO: 88444 - DNA, 15 bp, Homo sapiens
tttgtccgatatttt

SEQ ID NO: 88445 - DNA, 15 bp, Homo sapiens
atttgtccgatattt

SEQ ID NO: 88446 - DNA, 15 bp, Homo sapiens
tatttgtccgatatt

SEQ ID NO: 88447 - DNA, 15 bp, Homo sapiens
ttatttgtccgatat

SEQ ID NO: 88448 - DNA, 15 bp, Homo sapiens
tttatttgtccgata

SEQ ID NO: 88449 - DNA, 15 bp, Homo sapiens
ttttatttgtccgat

SEQ ID NO: 88450 - DNA, 15 bp, Homo sapiens
attttatttgtccga

SEQ ID NO: 88451 - DNA, 15 bp, Homo sapiens
cattttatttgtccg

SEQ ID NO: 88452 - DNA, 15 bp, Homo sapiens
tcattttatttgtcc

SEQ ID NO: 88453 - DNA, 15 bp, Homo sapiens
atcattttatttgtc

SEQ ID NO: 88454 - DNA, 15 bp, Homo sapiens
tatcattttatttgt

SEQ ID NO: 88455 - DNA, 15 bp, Homo sapiens
ttatcattttatttg

SEQ ID NO: 88456 - DNA, 15 bp, Homo sapiens
cttatcattttattt

SEQ ID NO: 88457 - DNA, 15 bp, Homo sapiens
tcttatcattttatt

SEQ ID NO: 88458 - DNA, 15 bp, Homo sapiens
atcttatcattttat

SEQ ID NO: 88459 - DNA, 15 bp, Homo sapiens
aatcttatcatttta

SEQ ID NO: 88460 - DNA, 15 bp, Homo sapiens
aaatcttatcatttt

SEQ ID NO: 88461 - DNA, 15 bp, Homo sapiens
gaaatcttatcattt

SEQ ID NO: 88462 - DNA, 15 bp, Homo sapiens
tgaaatcttatcatt

SEQ ID NO: 88463 - DNA, 15 bp, Homo sapiens
ctgaaatcttatcat

SEQ ID NO: 88464 - DNA, 15 bp, Homo sapiens
actgaaatcttatca

SEQ ID NO: 88465 - DNA, 15 bp, Homo sapiens
tactgaaatcttatc

SEQ ID NO: 88466 - DNA, 15 bp, Homo sapiens
ttactgaaatcttat

SEQ ID NO: 88467 - DNA, 15 bp, Homo sapiens
attactgaaatctta

SEQ ID NO: 88468 - DNA, 15 bp, Homo sapiens
tattactgaaatctt

SEQ ID NO: 88469 - DNA, 15 bp, Homo sapiens
ttattactgaaatct

SEQ ID NO: 88470 - DNA, 15 bp, Homo sapiens
tttattactgaaatc

SEQ ID NO: 88471 - DNA, 15 bp, Homo sapiens
ttttattactgaaat

SEQ ID NO: 88472 - DNA, 15 bp, Homo sapiens
tttttattactgaaa

SEQ ID NO: 88473 - DNA, 15 bp, Homo sapiens
atttttattactgaa

SEQ ID NO: 88474 - DNA, 15 bp, Homo sapiens
catttttattactga

SEQ ID NO: 88475 - DNA, 15 bp, Homo sapiens
ccatttttattactg

SEQ ID NO: 88476 - DNA, 15 bp, Homo sapiens
accatttttattact

SEQ ID NO: 88477 - DNA, 15 bp, Homo sapiens
caccatttttattac

SEQ ID NO: 88478 - DNA, 15 bp, Homo sapiens
ccaccatttttatta

SEQ ID NO: 88479 - DNA, 15 bp, Homo sapiens
gccaccatttttatt

SEQ ID NO: 88480 - DNA, 15 bp, Homo sapiens
tgccaccatttttat

SEQ ID NO: 88481 - DNA, 15 bp, Homo sapiens
atgccaccattttta

SEQ ID NO: 88482 - DNA, 15 bp, Homo sapiens
aatgccaccattttt

SEQ ID NO: 88483 - DNA, 15 bp, Homo sapiens
caatgccaccatttt

SEQ ID NO: 88484 - DNA, 15 bp, Homo sapiens
acaatgccaccattt

SEQ ID NO: 88485 - DNA, 15 bp, Homo sapiens
aacaatgccaccatt

SEQ ID NO: 88486 - DNA, 15 bp, Homo sapiens
aaacaatgccaccat

SEQ ID NO: 88487 - DNA, 15 bp, Homo sapiens
aaaacaatgccacca

SEQ ID NO: 88488 - DNA, 15 bp, Homo sapiens
gaaaacaatgccacc

SEQ ID NO: 88489 - DNA, 15 bp, Homo sapiens
ggaaaacaatgccac

SEQ ID NO: 88490 - DNA, 15 bp, Homo sapiens
gggaaaacaatgcca

SEQ ID NO: 88491 - DNA, 15 bp, Homo sapiens
agggaaaacaatgcc

SEQ ID NO: 88492 - DNA, 15 bp, Homo sapiens
cagggaaaacaatgc

SEQ ID NO: 88493 - DNA, 15 bp, Homo sapiens
tcagggaaaacaatg

SEQ ID NO: 88494 - DNA, 15 bp, Homo sapiens
atcagggaaaacaat

SEQ ID NO: 88495 - DNA, 15 bp, Homo sapiens
catcagggaaaacaa

SEQ ID NO: 88496 - DNA, 15 bp, Homo sapiens
acatcagggaaaaca

SEQ ID NO: 88497 - DNA, 15 bp, Homo sapiens
cacatcagggaaaac

SEQ ID NO: 88498 - DNA, 15 bp, Homo sapiens
acacatcagggaaaa

SEQ ID NO: 88499 - DNA, 15 bp, Homo sapiens
aacacatcagggaaa

SEQ ID NO: 88500 - DNA, 15 bp, Homo sapiens
aaacacatcagggaa

SEQ ID NO: 88501 - DNA, 15 bp, Homo sapiens
gaaacacatcaggga

SEQ ID NO: 88502 - DNA, 15 bp, Homo sapiens
agaaacacatcaggg

SEQ ID NO: 88503 - DNA, 15 bp, Homo sapiens
tagaaacacatcagg

SEQ ID NO: 88504 - DNA, 15 bp, Homo sapiens
ttagaaacacatcag

SEQ ID NO: 88505 - DNA, 15 bp, Homo sapiens
tttagaaacacatca

SEQ ID NO: 88506 - DNA, 15 bp, Homo sapiens
ctttagaaacacatc

SEQ ID NO: 88507 - DNA, 15 bp, Homo sapiens
actttagaaacacat

SEQ ID NO: 88508 - DNA, 15 bp, Homo sapiens
tactttagaaacaca

SEQ ID NO: 88509 - DNA, 15 bp, Homo sapiens
ctactttagaaacac

SEQ ID NO: 88510 - DNA, 15 bp, Homo sapiens
tctactttagaaaca

SEQ ID NO: 88511 - DNA, 15 bp, Homo sapiens
atctactttagaaac

SEQ ID NO: 88512 - DNA, 15 bp, Homo sapiens
gatctactttagaaa

SEQ ID NO: 88513 - DNA, 15 bp, Homo sapiens
tgatctactttagaa

SEQ ID NO: 88514 - DNA, 15 bp, Homo sapiens
atgatctactttaga

SEQ ID NO: 88515 - DNA, 15 bp, Homo sapiens
gatgatctactttag

SEQ ID NO: 88516 - DNA, 15 bp, Homo sapiens
agatgatctacttta

SEQ ID NO: 88517 - DNA, 15 bp, Homo sapiens
aagatgatctacttt

SEQ ID NO: 88518 - DNA, 15 bp, Homo sapiens
taagatgatctactt

SEQ ID NO: 88519 - DNA, 15 bp, Homo sapiens
ataagatgatctact

SEQ ID NO: 88520 - DNA, 15 bp, Homo sapiens
aataagatgatctac

SEQ ID NO: 88521 - DNA, 15 bp, Homo sapiens
caataagatgatcta

SEQ ID NO: 88522 - DNA, 15 bp, Homo sapiens
gcaataagatgatct

SEQ ID NO: 88523 - DNA, 15 bp, Homo sapiens
agcaataagatgatc

SEQ ID NO: 88524 - DNA, 15 bp, Homo sapiens
cagcaataagatgat

SEQ ID NO: 88525 - DNA, 15 bp, Homo sapiens
gcagcaataagatga

SEQ ID NO: 88526 - DNA, 15 bp, Homo sapiens
ggcagcaataagatg

SEQ ID NO: 88527 - DNA, 15 bp, Homo sapiens
aggcagcaataagat

SEQ ID NO: 88528 - DNA, 15 bp, Homo sapiens
gaggcagcaataaga

SEQ ID NO: 88529 - DNA, 15 bp, Homo sapiens
tgaggcagcaataag

SEQ ID NO: 88530 - DNA, 15 bp, Homo sapiens
ctgaggcagcaataa

SEQ ID NO: 88531 - DNA, 15 bp, Homo sapiens
actgaggcagcaata

SEQ ID NO: 88532 - DNA, 15 bp, Homo sapiens
gactgaggcagcaat

SEQ ID NO: 88533 - DNA, 15 bp, Homo sapiens
agactgaggcagcaa

SEQ ID NO: 88534 - DNA, 15 bp, Homo sapiens
aagactgaggcagca

SEQ ID NO: 88535 - DNA, 15 bp, Homo sapiens
aaagactgaggcagc

SEQ ID NO: 88536 - DNA, 15 bp, Homo sapiens
aaaagactgaggcag

SEQ ID NO: 88537 - DNA, 15 bp, Homo sapiens
caaaagactgaggca

SEQ ID NO: 88538 - DNA, 15 bp, Homo sapiens
ccaaaagactgaggc

SEQ ID NO: 88539 - DNA, 15 bp, Homo sapiens
accaaaagactgagg

SEQ ID NO: 88540 - DNA, 15 bp, Homo sapiens
taccaaaagactgag

SEQ ID NO: 88541 - DNA, 15 bp, Homo sapiens
ataccaaaagactga

SEQ ID NO: 88542 - DNA, 15 bp, Homo sapiens
aataccaaaagactg

SEQ ID NO: 88543 - DNA, 15 bp, Homo sapiens
aaataccaaaagact

SEQ ID NO: 88544 - DNA, 15 bp, Homo sapiens
caaataccaaaagac

SEQ ID NO: 88545 - DNA, 15 bp, Homo sapiens
gcaaataccaaaaga

SEQ ID NO: 88546 - DNA, 15 bp, Homo sapiens
agcaaataccaaaag

SEQ ID NO: 88547 - DNA, 15 bp, Homo sapiens
aagcaaataccaaaa

SEQ ID NO: 88548 - DNA, 15 bp, Homo sapiens
taagcaaataccaaa

SEQ ID NO: 88549 - DNA, 15 bp, Homo sapiens
ataagcaaataccaa

SEQ ID NO: 88550 - DNA, 15 bp, Homo sapiens
aataagcaaatacca

SEQ ID NO: 88551 - DNA, 15 bp, Homo sapiens
aaataagcaaatacc

SEQ ID NO: 88552 - DNA, 15 bp, Homo sapiens
taaataagcaaatac

SEQ ID NO: 88553 - DNA, 15 bp, Homo sapiens
ataaataagcaaata

SEQ ID NO: 88554 - DNA, 15 bp, Homo sapiens
cataaataagcaaat

SEQ ID NO: 88555 - DNA, 15 bp, Homo sapiens
acataaataagcaaa

SEQ ID NO: 88556 - DNA, 15 bp, Homo sapiens
cacataaataagcaa

SEQ ID NO: 88557 - DNA, 15 bp, Homo sapiens
gcacataaataagca

SEQ ID NO: 88558 - DNA, 15 bp, Homo sapiens
tgcacataaataagc

SEQ ID NO: 88559 - DNA, 15 bp, Homo sapiens
ttgcacataaataag

SEQ ID NO: 88560 - DNA, 15 bp, Homo sapiens
cttgcacataaataa

SEQ ID NO: 88561 - DNA, 15 bp, Homo sapiens
ccttgcacataaata

SEQ ID NO: 88562 - DNA, 15 bp, Homo sapiens
accttgcacataaat

SEQ ID NO: 88563 - DNA, 15 bp, Homo sapiens
gaccttgcacataaa

SEQ ID NO: 88564 - DNA, 15 bp, Homo sapiens
agaccttgcacataa

SEQ ID NO: 88565 - DNA, 15 bp, Homo sapiens
gagaccttgcacata

SEQ ID NO: 88566 - DNA, 15 bp, Homo sapiens
ggagaccttgcacat

SEQ ID NO: 88567 - DNA, 15 bp, Homo sapiens
tggagaccttgcaca

SEQ ID NO: 88568 - DNA, 15 bp, Homo sapiens
ctggagaccttgcac

SEQ ID NO: 88569 - DNA, 15 bp, Homo sapiens
actggagaccttgca

SEQ ID NO: 88570 - DNA, 15 bp, Homo sapiens
cactggagaccttgc

SEQ ID NO: 88571 - DNA, 15 bp, Homo sapiens
ccactggagaccttg

SEQ ID NO: 88572 - DNA, 15 bp, Homo sapiens
cccactggagacctt

SEQ ID NO: 88573 - DNA, 15 bp, Homo sapiens
gcccactggagacct

SEQ ID NO: 88574 - DNA, 15 bp, Homo sapiens
agcccactggagacc

SEQ ID NO: 88575 - DNA, 15 bp, Homo sapiens
aagcccactggagac

SEQ ID NO: 88576 - DNA, 15 bp, Homo sapiens
caagcccactggaga

SEQ ID NO: 88577 - DNA, 15 bp, Homo sapiens
gcaagcccactggag

SEQ ID NO: 88578 - DNA, 15 bp, Homo sapiens
agcaagcccactgga

SEQ ID NO: 88579 - DNA, 15 bp, Homo sapiens
cagcaagcccactgg

SEQ ID NO: 88580 - DNA, 15 bp, Homo sapiens
tcagcaagcccactg

SEQ ID NO: 88581 - DNA, 15 bp, Homo sapiens
atcagcaagcccact

SEQ ID NO: 88582 - DNA, 15 bp, Homo sapiens
catcagcaagcccac

SEQ ID NO: 88583 - DNA, 15 bp, Homo sapiens
gcatcagcaagccca

SEQ ID NO: 88584 - DNA, 15 bp, Homo sapiens
agcatcagcaagccc

SEQ ID NO: 88585 - DNA, 15 bp, Homo sapiens
aagcatcagcaagcc

SEQ ID NO: 88586 - DNA, 15 bp, Homo sapiens
gaagcatcagcaagc

SEQ ID NO: 88587 - DNA, 15 bp, Homo sapiens
agaagcatcagcaag

SEQ ID NO: 88588 - DNA, 15 bp, Homo sapiens
tagaagcatcagcaa

SEQ ID NO: 88589 - DNA, 15 bp, Homo sapiens
ctagaagcatcagca

SEQ ID NO: 88590 - DNA, 15 bp, Homo sapiens
tctagaagcatcagc

SEQ ID NO: 88591 - DNA, 15 bp, Homo sapiens
ctctagaagcatcag

SEQ ID NO: 88592 - DNA, 15 bp, Homo sapiens
gctctagaagcatca

SEQ ID NO: 88593 - DNA, 15 bp, Homo sapiens
ggctctagaagcatc

SEQ ID NO: 88594 - DNA, 15 bp, Homo sapiens
aggctctagaagcat

SEQ ID NO: 88595 - DNA, 15 bp, Homo sapiens
caggctctagaagca

SEQ ID NO: 88596 - DNA, 15 bp, Homo sapiens
ccaggctctagaagc

SEQ ID NO: 88597 - DNA, 15 bp, Homo sapiens
gccaggctctagaag

SEQ ID NO: 88598 - DNA, 15 bp, Homo sapiens
agccaggctctagaa

SEQ ID NO: 88599 - DNA, 15 bp, Homo sapiens
cagccaggctctaga

SEQ ID NO: 88600 - DNA, 15 bp, Homo sapiens
gcagccaggctctag

SEQ ID NO: 88601 - DNA, 15 bp, Homo sapiens
agcagccaggctcta

SEQ ID NO: 88602 - DNA, 15 bp, Homo sapiens
cagcagccaggctct

SEQ ID NO: 88603 - DNA, 15 bp, Homo sapiens
ccagcagccaggctc

SEQ ID NO: 88604 - DNA, 15 bp, Homo sapiens
gccagcagccaggct

SEQ ID NO: 88605 - DNA, 15 bp, Homo sapiens
agccagcagccaggc

SEQ ID NO: 88606 - DNA, 15 bp, Homo sapiens
aagccagcagccagg

SEQ ID NO: 88607 - DNA, 15 bp, Homo sapiens
taagccagcagccag

SEQ ID NO: 88608 - DNA, 15 bp, Homo sapiens
ttaagccagcagcca

SEQ ID NO: 88609 - DNA, 15 bp, Homo sapiens
attaagccagcagcc

SEQ ID NO: 88610 - DNA, 15 bp, Homo sapiens
tattaagccagcagc

SEQ ID NO: 88611 - DNA, 15 bp, Homo sapiens
atattaagccagcag

SEQ ID NO: 88612 - DNA, 15 bp, Homo sapiens
aatattaagccagca

SEQ ID NO: 88613 - DNA, 15 bp, Homo sapiens
gaatattaagccagc

SEQ ID NO: 88614 - DNA, 15 bp, Homo sapiens
ggaatattaagccag

SEQ ID NO: 88615 - DNA, 15 bp, Homo sapiens
aggaatattaagcca

SEQ ID NO: 88616 - DNA, 15 bp, Homo sapiens
caggaatattaagcc

SEQ ID NO: 88617 - DNA, 15 bp, Homo sapiens
gcaggaatattaagc

SEQ ID NO: 88618 - DNA, 15 bp, Homo sapiens
tgcaggaatattaag

SEQ ID NO: 88619 - DNA, 15 bp, Homo sapiens
gtgcaggaatattaa

SEQ ID NO: 88620 - DNA, 15 bp, Homo sapiens
agtgcaggaatatta

SEQ ID NO: 88621 - DNA, 15 bp, Homo sapiens
gagtgcaggaatatt

SEQ ID NO: 88622 - DNA, 15 bp, Homo sapiens
tgagtgcaggaatat

SEQ ID NO: 88623 - DNA, 15 bp, Homo sapiens
gtgagtgcaggaata

SEQ ID NO: 88624 - DNA, 15 bp, Homo sapiens
ggtgagtgcaggaat

SEQ ID NO: 88625 - DNA, 15 bp, Homo sapiens
tggtgagtgcaggaa

SEQ ID NO: 88626 - DNA, 15 bp, Homo sapiens
ctggtgagtgcagga

SEQ ID NO: 88627 - DNA, 15 bp, Homo sapiens
cctggtgagtgcagg

SEQ ID NO: 88628 - DNA, 15 bp, Homo sapiens
acctggtgagtgcag

SEQ ID NO: 88629 - DNA, 15 bp, Homo sapiens
aacctggtgagtgca

SEQ ID NO: 88630 - DNA, 15 bp, Homo sapiens
caacctggtgagtgc

SEQ ID NO: 88631 - DNA, 15 bp, Homo sapiens
gcaacctggtgagtg

SEQ ID NO: 88632 - DNA, 15 bp, Homo sapiens
agcaacctggtgagt

SEQ ID NO: 88633 - DNA, 15 bp, Homo sapiens
aagcaacctggtgag

SEQ ID NO: 88634 - DNA, 15 bp, Homo sapiens
gaagcaacctggtga

SEQ ID NO: 88635 - DNA, 15 bp, Homo sapiens
ggaagcaacctggtg

SEQ ID NO: 88636 - DNA, 15 bp, Homo sapiens
gggaagcaacctggt

SEQ ID NO: 88637 - DNA, 15 bp, Homo sapiens
tgggaagcaacctgg

SEQ ID NO: 88638 - DNA, 15 bp, Homo sapiens
ctgggaagcaacctg

SEQ ID NO: 88639 - DNA, 15 bp, Homo sapiens
gctgggaagcaacct

SEQ ID NO: 88640 - DNA, 15 bp, Homo sapiens
tgctgggaagcaacc

SEQ ID NO: 88641 - DNA, 15 bp, Homo sapiens
atgctgggaagcaac

SEQ ID NO: 88642 - DNA, 15 bp, Homo sapiens
tatgctgggaagcaa

SEQ ID NO: 88643 - DNA, 15 bp, Homo sapiens
ttatgctgggaagca

SEQ ID NO: 88644 - DNA, 15 bp, Homo sapiens
cttatgctgggaagc

SEQ ID NO: 88645 - DNA, 15 bp, Homo sapiens
ccttatgctgggaag

SEQ ID NO: 88646 - DNA, 15 bp, Homo sapiens
gccttatgctgggaa

SEQ ID NO: 88647 - DNA, 15 bp, Homo sapiens
tgccttatgctggga

SEQ ID NO: 88648 - DNA, 15 bp, Homo sapiens
atgccttatgctggg

SEQ ID NO: 88649 - DNA, 15 bp, Homo sapiens
gatgccttatgctgg

SEQ ID NO: 88650 - DNA, 15 bp, Homo sapiens
ggatgccttatgctg

SEQ ID NO: 88651 - DNA, 15 bp, Homo sapiens
aggatgccttatgct

SEQ ID NO: 88652 - DNA, 15 bp, Homo sapiens
gaggatgccttatgc

SEQ ID NO: 88653 - DNA, 15 bp, Homo sapiens
cgaggatgccttatg

SEQ ID NO: 88654 - DNA, 15 bp, Homo sapiens
gcgaggatgccttat

SEQ ID NO: 88655 - DNA, 15 bp, Homo sapiens
ggcgaggatgcctta

SEQ ID NO: 88656 - DNA, 15 bp, Homo sapiens
tggcgaggatgcctt

SEQ ID NO: 88657 - DNA, 15 bp, Homo sapiens
atggcgaggatgcct

SEQ ID NO: 88658 - DNA, 15 bp, Homo sapiens
aatggcgaggatgcc

SEQ ID NO: 88659 - DNA, 15 bp, Homo sapiens
gaatggcgaggatgc

SEQ ID NO: 88660 - DNA, 15 bp, Homo sapiens
tgaatggcgaggatg

SEQ ID NO: 88661 - DNA, 15 bp, Homo sapiens
atgaatggcgaggat

SEQ ID NO: 88662 - DNA, 15 bp, Homo sapiens
aatgaatggcgagga

SEQ ID NO: 88663 - DNA, 15 bp, Homo sapiens
aaatgaatggcgagg

SEQ ID NO: 88664 - DNA, 15 bp, Homo sapiens
aaaatgaatggcgag

SEQ ID NO: 88665 - DNA, 15 bp, Homo sapiens
aaaaatgaatggcga

SEQ ID NO: 88666 - DNA, 15 bp, Homo sapiens
aaaaaatgaatggcg

SEQ ID NO: 88667 - DNA, 15 bp, Homo sapiens
taaaaaatgaatggc

SEQ ID NO: 88668 - DNA, 15 bp, Homo sapiens
ttaaaaaatgaatgg

SEQ ID NO: 88669 - DNA, 15 bp, Homo sapiens
attaaaaaatgaatg

SEQ ID NO: 88670 - DNA, 15 bp, Homo sapiens
taaattaaaaaatga

SEQ ID NO: 88671 - DNA, 15 bp, Homo sapiens
ataaattaaaaaatg

SEQ ID NO: 88672 - DNA, 15 bp, Homo sapiens
tataaattaaaaaat

SEQ ID NO: 88673 - DNA, 15 bp, Homo sapiens
atataaattaaaaaa

SEQ ID NO: 88674 - DNA, 15 bp, Homo sapiens
catataaattaaaaa

SEQ ID NO: 88675 - DNA, 15 bp, Homo sapiens
tcatataaattaaaa

SEQ ID NO: 88676 - DNA, 15 bp, Homo sapiens
gtcatataaattaaa

SEQ ID NO: 88677 - DNA, 15 bp, Homo sapiens
tgtcatataaattaa

SEQ ID NO: 88678 - DNA, 15 bp, Homo sapiens
gtgtcatataaatta

SEQ ID NO: 88679 - DNA, 15 bp, Homo sapiens
agtgtcatataaatt

SEQ ID NO: 88680 - DNA, 15 bp, Homo sapiens
cagtgtcatataaat

SEQ ID NO: 88681 - DNA, 15 bp, Homo sapiens
acagtgtcatataaa

SEQ ID NO: 88682 - DNA, 15 bp, Homo sapiens
cacagtgtcatataa

SEQ ID NO: 88683 - DNA, 15 bp, Homo sapiens
gcacagtgtcatata

SEQ ID NO: 88684 - DNA, 15 bp, Homo sapiens
agcacagtgtcatat

SEQ ID NO: 88685 - DNA, 15 bp, Homo sapiens
aagcacagtgtcata

SEQ ID NO: 88686 - DNA, 15 bp, Homo sapiens
aaagcacagtgtcat

SEQ ID NO: 88687 - DNA, 15 bp, Homo sapiens
caaagcacagtgtca

SEQ ID NO: 88688 - DNA, 15 bp, Homo sapiens
ccaaagcacagtgtc

SEQ ID NO: 88689 - DNA, 15 bp, Homo sapiens
accaaagcacagtgt

SEQ ID NO: 88690 - DNA, 15 bp, Homo sapiens
gaccaaagcacagtg

SEQ ID NO: 88691 - DNA, 15 bp, Homo sapiens
tgaccaaagcacagt

SEQ ID NO: 88692 - DNA, 15 bp, Homo sapiens
gtgaccaaagcacag

SEQ ID NO: 88693 - DNA, 15 bp, Homo sapiens
ggtgaccaaagcaca

SEQ ID NO: 88694 - DNA, 15 bp, Homo sapiens
tggtgaccaaagcac

SEQ ID NO: 88695 - DNA, 15 bp, Homo sapiens
ttggtgaccaaagca

SEQ ID NO: 88696 - DNA, 15 bp, Homo sapiens
cttggtgaccaaagc

SEQ ID NO: 88697 - DNA, 15 bp, Homo sapiens
tcttggtgaccaaag

SEQ ID NO: 88698 - DNA, 15 bp, Homo sapiens
gtcttggtgaccaaa

SEQ ID NO: 88699 - DNA, 15 bp, Homo sapiens
ggtcttggtgaccaa

SEQ ID NO: 88700 - DNA, 15 bp, Homo sapiens
aggtcttggtgacca

SEQ ID NO: 88701 - DNA, 15 bp, Homo sapiens
caggtcttggtgacc

SEQ ID NO: 88702 - DNA, 15 bp, Homo sapiens
tcaggtcttggtgac

SEQ ID NO: 88703 - DNA, 15 bp, Homo sapiens
ctcaggtcttggtga

SEQ ID NO: 88704 - DNA, 15 bp, Homo sapiens
gctcaggtcttggtg

SEQ ID NO: 88705 - DNA, 15 bp, Homo sapiens
agctcaggtcttggt

SEQ ID NO: 88706 - DNA, 15 bp, Homo sapiens
cagctcaggtcttgg

SEQ ID NO: 88707 - DNA, 15 bp, Homo sapiens
gcagctcaggtcttg

SEQ ID NO: 88708 - DNA, 15 bp, Homo sapiens
ggcagctcaggtctt

SEQ ID NO: 88709 - DNA, 15 bp, Homo sapiens
aggcagctcaggtct

SEQ ID NO: 88710 - DNA, 15 bp, Homo sapiens
gaggcagctcaggtc

SEQ ID NO: 88711 - DNA, 15 bp, Homo sapiens
ggaggcagctcaggt

SEQ ID NO: 88712 - DNA, 15 bp, Homo sapiens
aggaggcagctcagg

SEQ ID NO: 88713 - DNA, 15 bp, Homo sapiens
taggaggcagctcag

SEQ ID NO: 88714 - DNA, 15 bp, Homo sapiens
ctaggaggcagctca

SEQ ID NO: 88715 - DNA, 15 bp, Homo sapiens
actaggaggcagctc

SEQ ID NO: 88716 - DNA, 15 bp, Homo sapiens
aactaggaggcagct

SEQ ID NO: 88717 - DNA, 15 bp, Homo sapiens
aaactaggaggcagc

SEQ ID NO: 88718 - DNA, 15 bp, Homo sapiens
aaaactaggaggcag

SEQ ID NO: 88719 - DNA, 15 bp, Homo sapiens
aaaaactaggaggca

SEQ ID NO: 88720 - DNA, 15 bp, Homo sapiens
gaaaaactaggaggc

SEQ ID NO: 88721 - DNA, 15 bp, Homo sapiens
agaaaaactaggagg

SEQ ID NO: 88722 - DNA, 15 bp, Homo sapiens
tagaaaaactaggag

SEQ ID NO: 88723 - DNA, 15 bp, Homo sapiens
ctagaaaaactagga

SEQ ID NO: 88724 - DNA, 15 bp, Homo sapiens
gctagaaaaactagg

SEQ ID NO: 88725 - DNA, 15 bp, Homo sapiens
ggctagaaaaactag

SEQ ID NO: 88726 - DNA, 15 bp, Homo sapiens
tggctagaaaaacta

SEQ ID NO: 88727 - DNA, 15 bp, Homo sapiens
ctggctagaaaaact

SEQ ID NO: 88728 - DNA, 15 bp, Homo sapiens
gctggctagaaaaac

SEQ ID NO: 88729 - DNA, 15 bp, Homo sapiens
agctggctagaaaaa

SEQ ID NO: 88730 - DNA, 15 bp, Homo sapiens
aagctggctagaaaa

SEQ ID NO: 88731 - DNA, 15 bp, Homo sapiens
aaagctggctagaaa

SEQ ID NO: 88732 - DNA, 15 bp, Homo sapiens
gaaagctggctagaa

SEQ ID NO: 88733 - DNA, 15 bp, Homo sapiens
agaaagctggctaga

SEQ ID NO: 88734 - DNA, 15 bp, Homo sapiens
aagaaagctggctag

SEQ ID NO: 88735 - DNA, 15 bp, Homo sapiens
aaagaaagctggcta

SEQ ID NO: 88736 - DNA, 15 bp, Homo sapiens
aaaagaaagctggct

SEQ ID NO: 88737 - DNA, 15 bp, Homo sapiens
aaaaagaaagctggc

SEQ ID NO: 88738 - DNA, 15 bp, Homo sapiens
aaaaaagaaagctgg

SEQ ID NO: 88739 - DNA, 15 bp, Homo sapiens
aaaaaaagaaagctg

SEQ ID NO: 88740 - DNA, 15 bp, Homo sapiens
gaaaaaaagaaagct

SEQ ID NO: 88741 - DNA, 15 bp, Homo sapiens
agaaaaaaagaaagc

SEQ ID NO: 88742 - DNA, 15 bp, Homo sapiens
taagaaaaaaagaaa

SEQ ID NO: 88743 - DNA, 15 bp, Homo sapiens
ctaagaaaaaaagaa

SEQ ID NO: 88744 - DNA, 15 bp, Homo sapiens
cctaagaaaaaaaga

SEQ ID NO: 88745 - DNA, 15 bp, Homo sapiens
tcctaagaaaaaaag

SEQ ID NO: 88746 - DNA, 15 bp, Homo sapiens
gtcctaagaaaaaaa

SEQ ID NO: 88747 - DNA, 15 bp, Homo sapiens
tgtcctaagaaaaaa

SEQ ID NO: 88748 - DNA, 15 bp, Homo sapiens
ttgtcctaagaaaaa

SEQ ID NO: 88749 - DNA, 15 bp, Homo sapiens
tttgtcctaagaaaa

SEQ ID NO: 88750 - DNA, 15 bp, Homo sapiens
ctttgtcctaagaaa

SEQ ID NO: 88751 - DNA, 15 bp, Homo sapiens
cctttgtcctaagaa

SEQ ID NO: 88752 - DNA, 15 bp, Homo sapiens
ccctttgtcctaaga

SEQ ID NO: 88753 - DNA, 15 bp, Homo sapiens
accctttgtcctaag

SEQ ID NO: 88754 - DNA, 15 bp, Homo sapiens
gaccctttgtcctaa

SEQ ID NO: 88755 - DNA, 15 bp, Homo sapiens
agaccctttgtccta

SEQ ID NO: 88756 - DNA, 15 bp, Homo sapiens
aagaccctttgtcct

SEQ ID NO: 88757 - DNA, 15 bp, Homo sapiens
gaagaccctttgtcc

SEQ ID NO: 88758 - DNA, 15 bp, Homo sapiens
agaagaccctttgtc

SEQ ID NO: 88759 - DNA, 15 bp, Homo sapiens
aagaagaccctttgt

SEQ ID NO: 88760 - DNA, 15 bp, Homo sapiens
aaagaagaccctttg

SEQ ID NO: 88761 - DNA, 15 bp, Homo sapiens
gaaagaagacccttt

SEQ ID NO: 88762 - DNA, 15 bp, Homo sapiens
agaaagaagaccctt

SEQ ID NO: 88763 - DNA, 15 bp, Homo sapiens
cagaaagaagaccct

SEQ ID NO: 88764 - DNA, 15 bp, Homo sapiens
tcagaaagaagaccc

SEQ ID NO: 88765 - DNA, 15 bp, Homo sapiens
ttcagaaagaagacc

SEQ ID NO: 88766 - DNA, 15 bp, Homo sapiens
cttcagaaagaagac

SEQ ID NO: 88767 - DNA, 15 bp, Homo sapiens
acttcagaaagaaga

SEQ ID NO: 88768 - DNA, 15 bp, Homo sapiens
gacttcagaaagaag

SEQ ID NO: 88769 - DNA, 15 bp, Homo sapiens
cgacttcagaaagaa

SEQ ID NO: 88770 - DNA, 15 bp, Homo sapiens
ccgacttcagaaaga

SEQ ID NO: 88771 - DNA, 15 bp, Homo sapiens
cccgacttcagaaag

SEQ ID NO: 88772 - DNA, 15 bp, Homo sapiens
gcccgacttcagaaa

SEQ ID NO: 88773 - DNA, 15 bp, Homo sapiens
ggcccgacttcagaa

SEQ ID NO: 88774 - DNA, 15 bp, Homo sapiens
aggcccgacttcaga

SEQ ID NO: 88775 - DNA, 15 bp, Homo sapiens
taggcccgacttcag

SEQ ID NO: 88776 - DNA, 15 bp, Homo sapiens
ctaggcccgacttca

SEQ ID NO: 88777 - DNA, 15 bp, Homo sapiens
tctaggcccgacttc

SEQ ID NO: 88778 - DNA, 15 bp, Homo sapiens
gtctaggcccgactt

SEQ ID NO: 88779 - DNA, 15 bp, Homo sapiens
tgtctaggcccgact

SEQ ID NO: 88780 - DNA, 15 bp, Homo sapiens
ctgtctaggcccgac

SEQ ID NO: 88781 - DNA, 15 bp, Homo sapiens
tctgtctaggcccga

SEQ ID NO: 88782 - DNA, 15 bp, Homo sapiens
atctgtctaggcccg

SEQ ID NO: 88783 - DNA, 15 bp, Homo sapiens
gatctgtctaggccc

SEQ ID NO: 88784 - DNA, 15 bp, Homo sapiens
tgatctgtctaggcc

SEQ ID NO: 88785 - DNA, 15 bp, Homo sapiens
ttgatctgtctaggc

SEQ ID NO: 88786 - DNA, 15 bp, Homo sapiens
cttgatctgtctagg

SEQ ID NO: 88787 - DNA, 15 bp, Homo sapiens
ccttgatctgtctag

SEQ ID NO: 88788 - DNA, 15 bp, Homo sapiens
accttgatctgtcta

SEQ ID NO: 88789 - DNA, 15 bp, Homo sapiens
taccttgatctgtct

SEQ ID NO: 88790 - DNA, 15 bp, Homo sapiens
ctaccttgatctgtc

SEQ ID NO: 88791 - DNA, 15 bp, Homo sapiens
actaccttgatctgt

SEQ ID NO: 88792 - DNA, 15 bp, Homo sapiens
aactaccttgatctg

SEQ ID NO: 88793 - DNA, 15 bp, Homo sapiens
caactaccttgatct

SEQ ID NO: 88794 - DNA, 15 bp, Homo sapiens
tcaactaccttgatc

SEQ ID NO: 88795 - DNA, 15 bp, Homo sapiens
atcaactaccttgat

SEQ ID NO: 88796 - DNA, 15 bp, Homo sapiens
gatcaactaccttga

SEQ ID NO: 88797 - DNA, 15 bp, Homo sapiens
agatcaactaccttg

SEQ ID NO: 88798 - DNA, 15 bp, Homo sapiens
aagatcaactacctt

SEQ ID NO: 88799 - DNA, 15 bp, Homo sapiens
taagatcaactacct

SEQ ID NO: 88800 - DNA, 15 bp, Homo sapiens
ataagatcaactacc

SEQ ID NO: 88801 - DNA, 15 bp, Homo sapiens
aataagatcaactac

SEQ ID NO: 88802 - DNA, 15 bp, Homo sapiens
aaataagatcaacta

SEQ ID NO: 88803 - DNA, 15 bp, Homo sapiens
gaaataagatcaact

SEQ ID NO: 88804 - DNA, 15 bp, Homo sapiens
tgaaataagatcaac

SEQ ID NO: 88805 - DNA, 15 bp, Homo sapiens
gtgaaataagatcaa

SEQ ID NO: 88806 - DNA, 15 bp, Homo sapiens
agtgaaataagatca

SEQ ID NO: 88807 - DNA, 15 bp, Homo sapiens
cagtgaaataagatc

SEQ ID NO: 88808 - DNA, 15 bp, Homo sapiens
ccagtgaaataagat

SEQ ID NO: 88809 - DNA, 15 bp, Homo sapiens
accagtgaaataaga

SEQ ID NO: 88810 - DNA, 15 bp, Homo sapiens
aaccagtgaaataag

SEQ ID NO: 88811 - DNA, 15 bp, Homo sapiens
gaaccagtgaaataa

SEQ ID NO: 88812 - DNA, 15 bp, Homo sapiens
tgaaccagtgaaata

SEQ ID NO: 88813 - DNA, 15 bp, Homo sapiens
ctgaaccagtgaaat

SEQ ID NO: 88814 - DNA, 15 bp, Homo sapiens
cctgaaccagtgaaa

SEQ ID NO: 88815 - DNA, 15 bp, Homo sapiens
acctgaaccagtgaa

SEQ ID NO: 88816 - DNA, 15 bp, Homo sapiens
cacctgaaccagtga

SEQ ID NO: 88817 - DNA, 15 bp, Homo sapiens
tcacctgaaccagtg

SEQ ID NO: 88818 - DNA, 15 bp, Homo sapiens
atcacctgaaccagt

SEQ ID NO: 88819 - DNA, 15 bp, Homo sapiens
tatcacctgaaccag

SEQ ID NO: 88820 - DNA, 15 bp, Homo sapiens
ttatcacctgaacca

SEQ ID NO: 88821 - DNA, 15 bp, Homo sapiens
tttatcacctgaacc

SEQ ID NO: 88822 - DNA, 15 bp, Homo sapiens
gtttatcacctgaac

SEQ ID NO: 88823 - DNA, 15 bp, Homo sapiens
agtttatcacctgaa

SEQ ID NO: 88824 - DNA, 15 bp, Homo sapiens
tagtttatcacctga

SEQ ID NO: 88825 - DNA, 15 bp, Homo sapiens
ctagtttatcacctg

SEQ ID NO: 88826 - DNA, 15 bp, Homo sapiens
gctagtttatcacct

SEQ ID NO: 88827 - DNA, 15 bp, Homo sapiens
tgctagtttatcacc

SEQ ID NO: 88828 - DNA, 15 bp, Homo sapiens
ctgctagtttatcac

SEQ ID NO: 88829 - DNA, 15 bp, Homo sapiens
tctgctagtttatca

SEQ ID NO: 88830 - DNA, 15 bp, Homo sapiens
ctctgctagtttatc

SEQ ID NO: 88831 - DNA, 15 bp, Homo sapiens
actctgctagtttat

SEQ ID NO: 88832 - DNA, 15 bp, Homo sapiens
tactctgctagttta

SEQ ID NO: 88833 - DNA, 15 bp, Homo sapiens
ctactctgctagttt

SEQ ID NO: 88834 - DNA, 15 bp, Homo sapiens
tctactctgctagtt

SEQ ID NO: 88835 - DNA, 15 bp, Homo sapiens
ttctactctgctagt

SEQ ID NO: 88836 - DNA, 15 bp, Homo sapiens
cttctactctgctag

SEQ ID NO: 88837 - DNA, 15 bp, Homo sapiens
gcttctactctgcta

SEQ ID NO: 88838 - DNA, 15 bp, Homo sapiens
tgcttctactctgct

SEQ ID NO: 88839 - DNA, 15 bp, Homo sapiens
atgcttctactctgc

SEQ ID NO: 88840 - DNA, 15 bp, Homo sapiens
catgcttctactctg

SEQ ID NO: 88841 - DNA, 15 bp, Homo sapiens
ccatgcttctactct

SEQ ID NO: 88842 - DNA, 15 bp, Homo sapiens
gccatgcttctactc

SEQ ID NO: 88843 - DNA, 15 bp, Homo sapiens
tgccatgcttctact

SEQ ID NO: 88844 - DNA, 15 bp, Homo sapiens
atgccatgcttctac

SEQ ID NO: 88845 - DNA, 15 bp, Homo sapiens
catgccatgcttcta

SEQ ID NO: 88846 - DNA, 15 bp, Homo sapiens
ccatgccatgcttct

SEQ ID NO: 88847 - DNA, 15 bp, Homo sapiens
tccatgccatgcttc

SEQ ID NO: 88848 - DNA, 15 bp, Homo sapiens
atccatgccatgctt

SEQ ID NO: 88849 - DNA, 15 bp, Homo sapiens
catccatgccatgct

SEQ ID NO: 88850 - DNA, 15 bp, Homo sapiens
ccatccatgccatgc

SEQ ID NO: 88851 - DNA, 15 bp, Homo sapiens
tccatccatgccatg

SEQ ID NO: 88852 - DNA, 15 bp, Homo sapiens
ttccatccatgccat

SEQ ID NO: 88853 - DNA, 15 bp, Homo sapiens
tttccatccatgcca

SEQ ID NO: 88854 - DNA, 15 bp, Homo sapiens
gtttccatccatgcc

SEQ ID NO: 88855 - DNA, 15 bp, Homo sapiens
tgtttccatccatgc

SEQ ID NO: 88856 - DNA, 15 bp, Homo sapiens
atgtttccatccatg

SEQ ID NO: 88857 - DNA, 15 bp, Homo sapiens
tatgtttccatccat

SEQ ID NO: 88858 - DNA, 15 bp, Homo sapiens
atatgtttccatcca

SEQ ID NO: 88859 - DNA, 15 bp, Homo sapiens
tatatgtttccatcc

SEQ ID NO: 88860 - DNA, 15 bp, Homo sapiens
atatatgtttccatc

SEQ ID NO: 88861 - DNA, 15 bp, Homo sapiens
aatatatgtttccat

SEQ ID NO: 88862 - DNA, 15 bp, Homo sapiens
taatatatgtttcca

SEQ ID NO: 88863 - DNA, 15 bp, Homo sapiens
ataatatatgtttcc

SEQ ID NO: 88864 - DNA, 15 bp, Homo sapiens
gataatatatgtttc

SEQ ID NO: 88865 - DNA, 15 bp, Homo sapiens
agataatatatgttt

SEQ ID NO: 88866 - DNA, 15 bp, Homo sapiens
tagataatatatgtt

SEQ ID NO: 88867 - DNA, 15 bp, Homo sapiens
ctagataatatatgt

SEQ ID NO: 88868 - DNA, 15 bp, Homo sapiens
tctagataatatatg

SEQ ID NO: 88869 - DNA, 15 bp, Homo sapiens
ttctagataatatat

SEQ ID NO: 88870 - DNA, 15 bp, Homo sapiens
tttctagataatata

SEQ ID NO: 88871 - DNA, 15 bp, Homo sapiens
ttttctagataatat

SEQ ID NO: 88872 - DNA, 15 bp, Homo sapiens
cttttctagataata

SEQ ID NO: 88873 - DNA, 15 bp, Homo sapiens
ccttttctagataat

SEQ ID NO: 88874 - DNA, 15 bp, Homo sapiens
gccttttctagataa

SEQ ID NO: 88875 - DNA, 15 bp, Homo sapiens
tgccttttctagata

SEQ ID NO: 88876 - DNA, 15 bp, Homo sapiens
ctgccttttctagat

SEQ ID NO: 88877 - DNA, 15 bp, Homo sapiens
actgccttttctaga

SEQ ID NO: 88878 - DNA, 15 bp, Homo sapiens
cactgccttttctag

SEQ ID NO: 88879 - DNA, 15 bp, Homo sapiens
ccactgccttttcta

SEQ ID NO: 88880 - DNA, 15 bp, Homo sapiens
gccactgccttttct

SEQ ID NO: 88881 - DNA, 15 bp, Homo sapiens
agccactgccttttc

SEQ ID NO: 88882 - DNA, 15 bp, Homo sapiens
cagccactgcctttt

SEQ ID NO: 88883 - DNA, 15 bp, Homo sapiens
tcagccactgccttt

SEQ ID NO: 88884 - DNA, 15 bp, Homo sapiens
ttcagccactgcctt

SEQ ID NO: 88885 - DNA, 15 bp, Homo sapiens
cttcagccactgcct

SEQ ID NO: 88886 - DNA, 15 bp, Homo sapiens
acttcagccactgcc

SEQ ID NO: 88887 - DNA, 15 bp, Homo sapiens
aacttcagccactgc

SEQ ID NO: 88888 - DNA, 15 bp, Homo sapiens
gaacttcagccactg

SEQ ID NO: 88889 - DNA, 15 bp, Homo sapiens
agaacttcagccact

SEQ ID NO: 88890 - DNA, 15 bp, Homo sapiens
tagaacttcagccac

SEQ ID NO: 88891 - DNA, 15 bp, Homo sapiens
gtagaacttcagcca

SEQ ID NO: 88892 - DNA, 15 bp, Homo sapiens
agtagaacttcagcc

SEQ ID NO: 88893 - DNA, 15 bp, Homo sapiens
cagtagaacttcagc

SEQ ID NO: 88894 - DNA, 15 bp, Homo sapiens
tcagtagaacttcag

SEQ ID NO: 88895 - DNA, 15 bp, Homo sapiens
atcagtagaacttca

SEQ ID NO: 88896 - DNA, 15 bp, Homo sapiens
catcagtagaacttc

SEQ ID NO: 88897 - DNA, 15 bp, Homo sapiens
acatcagtagaactt

SEQ ID NO: 88898 - DNA, 15 bp, Homo sapiens
cacatcagtagaact

SEQ ID NO: 88899 - DNA, 15 bp, Homo sapiens
gcacatcagtagaac

SEQ ID NO: 88900 - DNA, 15 bp, Homo sapiens
ggcacatcagtagaa

SEQ ID NO: 88901 - DNA, 15 bp, Homo sapiens
aggcacatcagtaga

SEQ ID NO: 88902 - DNA, 15 bp, Homo sapiens
caggcacatcagtag

SEQ ID NO: 88903 - DNA, 15 bp, Homo sapiens
tcaggcacatcagta

SEQ ID NO: 88904 - DNA, 15 bp, Homo sapiens
ttcaggcacatcagt

SEQ ID NO: 88905 - DNA, 15 bp, Homo sapiens
attcaggcacatcag

SEQ ID NO: 88906 - DNA, 15 bp, Homo sapiens
gattcaggcacatca

SEQ ID NO: 88907 - DNA, 15 bp, Homo sapiens
cgattcaggcacatc

SEQ ID NO: 88908 - DNA, 15 bp, Homo sapiens
acgattcaggcacat

SEQ ID NO: 88909 - DNA, 15 bp, Homo sapiens
aacgattcaggcaca

SEQ ID NO: 88910 - DNA, 15 bp, Homo sapiens
taacgattcaggcac

SEQ ID NO: 88911 - DNA, 15 bp, Homo sapiens
ataacgattcaggca

SEQ ID NO: 88912 - DNA, 15 bp, Homo sapiens
aataacgattcaggc

SEQ ID NO: 88913 - DNA, 15 bp, Homo sapiens
aaataacgattcagg

SEQ ID NO: 88914 - DNA, 15 bp, Homo sapiens
aaaataacgattcag

SEQ ID NO: 88915 - DNA, 15 bp, Homo sapiens
taaaataacgattca

SEQ ID NO: 88916 - DNA, 15 bp, Homo sapiens
ttaaaataacgattc

SEQ ID NO: 88917 - DNA, 15 bp, Homo sapiens
tttaaaataacgatt

SEQ ID NO: 88918 - DNA, 15 bp, Homo sapiens
ttttaaaataacgat

SEQ ID NO: 88919 - DNA, 15 bp, Homo sapiens
attttaaaataacga

SEQ ID NO: 88920 - DNA, 15 bp, Homo sapiens
cattttaaaataacg

SEQ ID NO: 88921 - DNA, 15 bp, Homo sapiens
acattttaaaataac

SEQ ID NO: 88922 - DNA, 15 bp, Homo sapiens
gacattttaaaataa

SEQ ID NO: 88923 - DNA, 15 bp, Homo sapiens
agacattttaaaata

SEQ ID NO: 88924 - DNA, 15 bp, Homo sapiens
aagacattttaaaat

SEQ ID NO: 88925 - DNA, 15 bp, Homo sapiens
aaagacattttaaaa

SEQ ID NO: 88926 - DNA, 15 bp, Homo sapiens
gaaagacattttaaa

SEQ ID NO: 88927 - DNA, 15 bp, Homo sapiens
agaaagacattttaa

SEQ ID NO: 88928 - DNA, 15 bp, Homo sapiens
aagaaagacatttta

SEQ ID NO: 88929 - DNA, 15 bp, Homo sapiens
gaagaaagacatttt

SEQ ID NO: 88930 - DNA, 15 bp, Homo sapiens
agaagaaagacattt

SEQ ID NO: 88931 - DNA, 15 bp, Homo sapiens
aagaagaaagacatt

SEQ ID NO: 88932 - DNA, 15 bp, Homo sapiens
aaagaagaaagacat

SEQ ID NO: 88933 - DNA, 15 bp, Homo sapiens
caaagaagaaagaca

SEQ ID NO: 88934 - DNA, 15 bp, Homo sapiens
acaaagaagaaagac

SEQ ID NO: 88935 - DNA, 15 bp, Homo sapiens
aacaaagaagaaaga

SEQ ID NO: 88936 - DNA, 15 bp, Homo sapiens
gaacaaagaagaaag

SEQ ID NO: 88937 - DNA, 15 bp, Homo sapiens
tgaacaaagaagaaa

SEQ ID NO: 88938 - DNA, 15 bp, Homo sapiens
ttgaacaaagaagaa

SEQ ID NO: 88939 - DNA, 15 bp, Homo sapiens
cttgaacaaagaaga

SEQ ID NO: 88940 - DNA, 15 bp, Homo sapiens
ccttgaacaaagaag

SEQ ID NO: 88941 - DNA, 15 bp, Homo sapiens
tccttgaacaaagaa

SEQ ID NO: 88942 - DNA, 15 bp, Homo sapiens
ttccttgaacaaaga

SEQ ID NO: 88943 - DNA, 15 bp, Homo sapiens
attccttgaacaaag

SEQ ID NO: 88944 - DNA, 15 bp, Homo sapiens
aattccttgaacaaa

SEQ ID NO: 88945 - DNA, 15 bp, Homo sapiens
caattccttgaacaa

SEQ ID NO: 88946 - DNA, 15 bp, Homo sapiens
tcaattccttgaaca

SEQ ID NO: 88947 - DNA, 15 bp, Homo sapiens
ttcaattccttgaac

SEQ ID NO: 88948 - DNA, 15 bp, Homo sapiens
tttcaattccttgaa

SEQ ID NO: 88949 - DNA, 15 bp, Homo sapiens
atttcaattccttga

SEQ ID NO: 88950 - DNA, 15 bp, Homo sapiens
tatttcaattccttg

SEQ ID NO: 88951 - DNA, 15 bp, Homo sapiens
ttatttcaattcctt

SEQ ID NO: 88952 - DNA, 15 bp, Homo sapiens
tttatttcaattcct

SEQ ID NO: 88953 - DNA, 15 bp, Homo sapiens
gtttatttcaattcc

SEQ ID NO: 88954 - DNA, 15 bp, Homo sapiens
tgtttatttcaattc

SEQ ID NO: 88955 - DNA, 15 bp, Homo sapiens
atgtttatttcaatt

SEQ ID NO: 88956 - DNA, 15 bp, Homo sapiens
gatgtttatttcaat

SEQ ID NO: 88957 - DNA, 15 bp, Homo sapiens
tgatgtttatttcaa

SEQ ID NO: 88958 - DNA, 15 bp, Homo sapiens
atgatgtttatttca

SEQ ID NO: 88959 - DNA, 15 bp, Homo sapiens
aatgatgtttatttc

SEQ ID NO: 88960 - DNA, 15 bp, Homo sapiens
taatgatgtttattt

SEQ ID NO: 88961 - DNA, 15 bp, Homo sapiens
ataatgatgtttatt

SEQ ID NO: 88962 - DNA, 15 bp, Homo sapiens
aataatgatgtttat

SEQ ID NO: 88963 - DNA, 15 bp, Homo sapiens
aaataatgatgttta

SEQ ID NO: 88964 - DNA, 15 bp, Homo sapiens
aaaataatgatgttt

SEQ ID NO: 88965 - DNA, 15 bp, Homo sapiens
aaaaataatgatgtt

SEQ ID NO: 88966 - DNA, 15 bp, Homo sapiens
taaaaataatgatgt

SEQ ID NO: 88967 - DNA, 15 bp, Homo sapiens
ttaaaaataatgatg

SEQ ID NO: 88968 - DNA, 15 bp, Homo sapiens
cttaaaaataatgat

SEQ ID NO: 88969 - DNA, 15 bp, Homo sapiens
acttaaaaataatga

SEQ ID NO: 88970 - DNA, 15 bp, Homo sapiens
cacttaaaaataatg

SEQ ID NO: 88971 - DNA, 15 bp, Homo sapiens
gcacttaaaaataat

SEQ ID NO: 88972 - DNA, 15 bp, Homo sapiens
tgcacttaaaaataa

SEQ ID NO: 88973 - DNA, 15 bp, Homo sapiens
atgcacttaaaaata

SEQ ID NO: 88974 - DNA, 15 bp, Homo sapiens
gatgcacttaaaaat

SEQ ID NO: 88975 - DNA, 15 bp, Homo sapiens
tgatgcacttaaaaa

SEQ ID NO: 88976 - DNA, 15 bp, Homo sapiens
atgatgcacttaaaa

SEQ ID NO: 88977 - DNA, 15 bp, Homo sapiens
aatgatgcacttaaa

SEQ ID NO: 88978 - DNA, 15 bp, Homo sapiens
taatgatgcacttaa

SEQ ID NO: 88979 - DNA, 15 bp, Homo sapiens
ataatgatgcactta

SEQ ID NO: 88980 - DNA, 15 bp, Homo sapiens
tataatgatgcactt

SEQ ID NO: 88981 - DNA, 15 bp, Homo sapiens
ttataatgatgcact

SEQ ID NO: 88982 - DNA, 15 bp, Homo sapiens
tttataatgatgcac

SEQ ID NO: 88983 - DNA, 15 bp, Homo sapiens
atttataatgatgca

SEQ ID NO: 88984 - DNA, 15 bp, Homo sapiens
aatttataatgatgc

SEQ ID NO: 88985 - DNA, 15 bp, Homo sapiens
aaatttataatgatg

SEQ ID NO: 88986 - DNA, 15 bp, Homo sapiens
aaaatttataatgat

SEQ ID NO: 88987 - DNA, 15 bp, Homo sapiens
aaaaatttataatga

SEQ ID NO: 88988 - DNA, 15 bp, Homo sapiens
caaaaatttataatg

SEQ ID NO: 88989 - DNA, 15 bp, Homo sapiens
acaaaaatttataat

SEQ ID NO: 88990 - DNA, 15 bp, Homo sapiens
aacaaaaatttataa

SEQ ID NO: 88991 - DNA, 15 bp, Homo sapiens
caacaaaaatttata

SEQ ID NO: 88992 - DNA, 15 bp, Homo sapiens
acaacaaaaatttat

SEQ ID NO: 88993 - DNA, 15 bp, Homo sapiens
aacaacaaaaattta

SEQ ID NO: 88994 - DNA, 15 bp, Homo sapiens
caacaacaaaaattt

SEQ ID NO: 88995 - DNA, 15 bp, Homo sapiens
acaacaacaaaaatt

SEQ ID NO: 88996 - DNA, 15 bp, Homo sapiens
tacaacaacaaaaat

SEQ ID NO: 88997 - DNA, 15 bp, Homo sapiens
atacaacaacaaaaa

SEQ ID NO: 88998 - DNA, 15 bp, Homo sapiens
aatacaacaacaaaa

SEQ ID NO: 88999 - DNA, 15 bp, Homo sapiens
taatacaacaacaaa

SEQ ID NO: 89000 - DNA, 15 bp, Homo sapiens
ttaatacaacaacaa

SEQ ID NO: 89001 - DNA, 15 bp, Homo sapiens
tttaatacaacaaca

SEQ ID NO: 89002 - DNA, 15 bp, Homo sapiens
ttttaatacaacaac

SEQ ID NO: 89003 - DNA, 15 bp, Homo sapiens
cttttaatacaacaa

SEQ ID NO: 89004 - DNA, 15 bp, Homo sapiens
ccttttaatacaaca

SEQ ID NO: 89005 - DNA, 15 bp, Homo sapiens
cccttttaatacaac

SEQ ID NO: 89006 - DNA, 15 bp, Homo sapiens
tcccttttaatacaa

SEQ ID NO: 89007 - DNA, 15 bp, Homo sapiens
gtcccttttaataca

SEQ ID NO: 89008 - DNA, 15 bp, Homo sapiens
agtcccttttaatac

SEQ ID NO: 89009 - DNA, 15 bp, Homo sapiens
aagtcccttttaata

SEQ ID NO: 89010 - DNA, 15 bp, Homo sapiens
taagtcccttttaat

SEQ ID NO: 89011 - DNA, 15 bp, Homo sapiens
ttaagtcccttttaa

SEQ ID NO: 89012 - DNA, 15 bp, Homo sapiens
cttaagtccctttta

SEQ ID NO: 89013 - DNA, 15 bp, Homo sapiens
tcttaagtccctttt

SEQ ID NO: 89014 - DNA, 15 bp, Homo sapiens
ttcttaagtcccttt

SEQ ID NO: 89015 - DNA, 15 bp, Homo sapiens
tttcttaagtccctt

SEQ ID NO: 89016 - DNA, 15 bp, Homo sapiens
ctttcttaagtccct

SEQ ID NO: 89017 - DNA, 15 bp, Homo sapiens
actttcttaagtccc

SEQ ID NO: 89018 - DNA, 15 bp, Homo sapiens
cactttcttaagtcc

SEQ ID NO: 89019 - DNA, 15 bp, Homo sapiens
tcactttcttaagtc

SEQ ID NO: 89020 - DNA, 15 bp, Homo sapiens
atcactttcttaagt

SEQ ID NO: 89021 - DNA, 15 bp, Homo sapiens
gatcactttcttaag

SEQ ID NO: 89022 - DNA, 15 bp, Homo sapiens
tgatcactttcttaa

SEQ ID NO: 89023 - DNA, 15 bp, Homo sapiens
atgatcactttctta

SEQ ID NO: 89024 - DNA, 15 bp, Homo sapiens
aatgatcactttctt

SEQ ID NO: 89025 - DNA, 15 bp, Homo sapiens
taatgatcactttct

SEQ ID NO: 89026 - DNA, 15 bp, Homo sapiens
ataatgatcactttc

SEQ ID NO: 89027 - DNA, 15 bp, Homo sapiens
cataatgatcacttt

SEQ ID NO: 89028 - DNA, 15 bp, Homo sapiens
acataatgatcactt

SEQ ID NO: 89029 - DNA, 15 bp, Homo sapiens
cacataatgatcact

SEQ ID NO: 89030 - DNA, 15 bp, Homo sapiens
acacataatgatcac

SEQ ID NO: 89031 - DNA, 15 bp, Homo sapiens
cacacataatgatca

SEQ ID NO: 89032 - DNA, 15 bp, Homo sapiens
tcacacataatgatc

SEQ ID NO: 89033 - DNA, 15 bp, Homo sapiens
gtcacacataatgat

SEQ ID NO: 89034 - DNA, 15 bp, Homo sapiens
tgtcacacataatga

SEQ ID NO: 89035 - DNA, 15 bp, Homo sapiens
atgtcacacataatg

SEQ ID NO: 89036 - DNA, 15 bp, Homo sapiens
aatgtcacacataat

SEQ ID NO: 89037 - DNA, 15 bp, Homo sapiens
caatgtcacacataa

SEQ ID NO: 89038 - DNA, 15 bp, Homo sapiens
gcaatgtcacacata

SEQ ID NO: 89039 - DNA, 15 bp, Homo sapiens
ggcaatgtcacacat

SEQ ID NO: 89040 - DNA, 15 bp, Homo sapiens
aggcaatgtcacaca

SEQ ID NO: 89041 - DNA, 15 bp, Homo sapiens
gaggcaatgtcacac

SEQ ID NO: 89042 - DNA, 15 bp, Homo sapiens
tgaggcaatgtcaca

SEQ ID NO: 89043 - DNA, 15 bp, Homo sapiens
gtgaggcaatgtcac

SEQ ID NO: 89044 - DNA, 15 bp, Homo sapiens
agtgaggcaatgtca

SEQ ID NO: 89045 - DNA, 15 bp, Homo sapiens
tagtgaggcaatgtc

SEQ ID NO: 89046 - DNA, 15 bp, Homo sapiens
atagtgaggcaatgt

SEQ ID NO: 89047 - DNA, 15 bp, Homo sapiens
aatagtgaggcaatg

SEQ ID NO: 89048 - DNA, 15 bp, Homo sapiens
gaatagtgaggcaat

SEQ ID NO: 89049 - DNA, 15 bp, Homo sapiens
agaatagtgaggcaa

SEQ ID NO: 89050 - DNA, 15 bp, Homo sapiens
cagaatagtgaggca

SEQ ID NO: 89051 - DNA, 15 bp, Homo sapiens
tcagaatagtgaggc

SEQ ID NO: 89052 - DNA, 15 bp, Homo sapiens
ctcagaatagtgagg

SEQ ID NO: 89053 - DNA, 15 bp, Homo sapiens
actcagaatagtgag

SEQ ID NO: 89054 - DNA, 15 bp, Homo sapiens
cactcagaatagtga

SEQ ID NO: 89055 - DNA, 15 bp, Homo sapiens
acactcagaatagtg

SEQ ID NO: 89056 - DNA, 15 bp, Homo sapiens
aacactcagaatagt

SEQ ID NO: 89057 - DNA, 15 bp, Homo sapiens
taacactcagaatag

SEQ ID NO: 89058 - DNA, 15 bp, Homo sapiens
ctaacactcagaata

SEQ ID NO: 89059 - DNA, 15 bp, Homo sapiens
tctaacactcagaat

SEQ ID NO: 89060 - DNA, 15 bp, Homo sapiens
ttctaacactcagaa

SEQ ID NO: 89061 - DNA, 15 bp, Homo sapiens
attctaacactcaga

SEQ ID NO: 89062 - DNA, 15 bp, Homo sapiens
cattctaacactcag

SEQ ID NO: 89063 - DNA, 15 bp, Homo sapiens
acattctaacactca

SEQ ID NO: 89064 - DNA, 15 bp, Homo sapiens
aacattctaacactc

SEQ ID NO: 89065 - DNA, 15 bp, Homo sapiens
gaacattctaacact

SEQ ID NO: 89066 - DNA, 15 bp, Homo sapiens
tgaacattctaacac

SEQ ID NO: 89067 - DNA, 15 bp, Homo sapiens
ctgaacattctaaca

SEQ ID NO: 89068 - DNA, 15 bp, Homo sapiens
tctgaacattctaac

SEQ ID NO: 89069 - DNA, 15 bp, Homo sapiens
ttctgaacattctaa

SEQ ID NO: 89070 - DNA, 15 bp, Homo sapiens
attctgaacattcta

SEQ ID NO: 89071 - DNA, 15 bp, Homo sapiens
tattctgaacattct

SEQ ID NO: 89072 - DNA, 15 bp, Homo sapiens
ttattctgaacattc

SEQ ID NO: 89073 - DNA, 15 bp, Homo sapiens
tttattctgaacatt

SEQ ID NO: 89074 - DNA, 15 bp, Homo sapiens
atttattctgaacat

SEQ ID NO: 89075 - DNA, 15 bp, Homo sapiens
aatttattctgaaca

SEQ ID NO: 89076 - DNA, 15 bp, Homo sapiens
gaatttattctgaac

SEQ ID NO: 89077 - DNA, 15 bp, Homo sapiens
tgaatttattctgaa

SEQ ID NO: 89078 - DNA, 15 bp, Homo sapiens
ttgaatttattctga

SEQ ID NO: 89079 - DNA, 15 bp, Homo sapiens
cttgaatttattctg

SEQ ID NO: 89080 - DNA, 15 bp, Homo sapiens
tcttgaatttattct

SEQ ID NO: 89081 - DNA, 15 bp, Homo sapiens
gtcttgaatttattc

SEQ ID NO: 89082 - DNA, 15 bp, Homo sapiens
tgtcttgaatttatt

SEQ ID NO: 89083 - DNA, 15 bp, Homo sapiens
gtgtcttgaatttat

SEQ ID NO: 89084 - DNA, 15 bp, Homo sapiens
tgtgtcttgaattta

SEQ ID NO: 89085 - DNA, 15 bp, Homo sapiens
atgtgtcttgaattt

SEQ ID NO: 89086 - DNA, 15 bp, Homo sapiens
aatgtgtcttgaatt

SEQ ID NO: 89087 - DNA, 15 bp, Homo sapiens
aaatgtgtcttgaat

SEQ ID NO: 89088 - DNA, 15 bp, Homo sapiens
aaaatgtgtcttgaa

SEQ ID NO: 89089 - DNA, 15 bp, Homo sapiens
caaaatgtgtcttga

SEQ ID NO: 89090 - DNA, 15 bp, Homo sapiens
acaaaatgtgtcttg

SEQ ID NO: 89091 - DNA, 15 bp, Homo sapiens
tacaaaatgtgtctt

SEQ ID NO: 89092 - DNA, 15 bp, Homo sapiens
ttacaaaatgtgtct

SEQ ID NO: 89093 - DNA, 15 bp, Homo sapiens
attacaaaatgtgtc

SEQ ID NO: 89094 - DNA, 15 bp, Homo sapiens
tattacaaaatgtgt

SEQ ID NO: 89095 - DNA, 15 bp, Homo sapiens
atattacaaaatgtg

SEQ ID NO: 89096 - DNA, 15 bp, Homo sapiens
tatattacaaaatgt

SEQ ID NO: 89097 - DNA, 15 bp, Homo sapiens
atatattacaaaatg

SEQ ID NO: 89098 - DNA, 15 bp, Homo sapiens
tatatattacaaaat

SEQ ID NO: 89099 - DNA, 15 bp, Homo sapiens
ctatatattacaaaa

SEQ ID NO: 89100 - DNA, 15 bp, Homo sapiens
tctatatattacaaa

SEQ ID NO: 89101 - DNA, 15 bp, Homo sapiens
gtctatatattacaa

SEQ ID NO: 89102 - DNA, 15 bp, Homo sapiens
agtctatatattaca

SEQ ID NO: 89103 - DNA, 15 bp, Homo sapiens
cagtctatatattac

SEQ ID NO: 89104 - DNA, 15 bp, Homo sapiens
acagtctatatatta

SEQ ID NO: 89105 - DNA, 15 bp, Homo sapiens
aacagtctatatatt

SEQ ID NO: 89106 - DNA, 15 bp, Homo sapiens
aaacagtctatatat

SEQ ID NO: 89107 - DNA, 15 bp, Homo sapiens
caaacagtctatata

SEQ ID NO: 89108 - DNA, 15 bp, Homo sapiens
gcaaacagtctatat

SEQ ID NO: 89109 - DNA, 15 bp, Homo sapiens
agcaaacagtctata

SEQ ID NO: 89110 - DNA, 15 bp, Homo sapiens
aagcaaacagtctat

SEQ ID NO: 89111 - DNA, 15 bp, Homo sapiens
caagcaaacagtcta

SEQ ID NO: 89112 - DNA, 15 bp, Homo sapiens
acaagcaaacagtct

SEQ ID NO: 89113 - DNA, 15 bp, Homo sapiens
aacaagcaaacagtc

SEQ ID NO: 89114 - DNA, 15 bp, Homo sapiens
aaacaagcaaacagt

SEQ ID NO: 89115 - DNA, 15 bp, Homo sapiens
aaaacaagcaaacag

SEQ ID NO: 89116 - DNA, 15 bp, Homo sapiens
aaaaacaagcaaaca

SEQ ID NO: 89117 - DNA, 15 bp, Homo sapiens
gaaaaacaagcaaac

SEQ ID NO: 89118 - DNA, 15 bp, Homo sapiens
tgaaaaacaagcaaa

SEQ ID NO: 89119 - DNA, 15 bp, Homo sapiens
atgaaaaacaagcaa

SEQ ID NO: 89120 - DNA, 15 bp, Homo sapiens
catgaaaaacaagca

SEQ ID NO: 89121 - DNA, 15 bp, Homo sapiens
acatgaaaaacaagc

SEQ ID NO: 89122 - DNA, 15 bp, Homo sapiens
gacatgaaaaacaag

SEQ ID NO: 89123 - DNA, 15 bp, Homo sapiens
agacatgaaaaacaa

SEQ ID NO: 89124 - DNA, 15 bp, Homo sapiens
cagacatgaaaaaca

SEQ ID NO: 89125 - DNA, 15 bp, Homo sapiens
gcagacatgaaaaac

SEQ ID NO: 89126 - DNA, 15 bp, Homo sapiens
tgcagacatgaaaaa

SEQ ID NO: 89127 - DNA, 15 bp, Homo sapiens
atgcagacatgaaaa

SEQ ID NO: 89128 - DNA, 15 bp, Homo sapiens
tatgcagacatgaaa

SEQ ID NO: 89129 - DNA, 15 bp, Homo sapiens
ctatgcagacatgaa

SEQ ID NO: 89130 - DNA, 15 bp, Homo sapiens
tctatgcagacatga

SEQ ID NO: 89131 - DNA, 15 bp, Homo sapiens
ttctatgcagacatg

SEQ ID NO: 89132 - DNA, 15 bp, Homo sapiens
cttctatgcagacat

SEQ ID NO: 89133 - DNA, 15 bp, Homo sapiens
ccttctatgcagaca

SEQ ID NO: 89134 - DNA, 15 bp, Homo sapiens
gccttctatgcagac

SEQ ID NO: 89135 - DNA, 15 bp, Homo sapiens
ggccttctatgcaga

SEQ ID NO: 89136 - DNA, 15 bp, Homo sapiens
aggccttctatgcag

SEQ ID NO: 89137 - DNA, 15 bp, Homo sapiens
aaggccttctatgca

SEQ ID NO: 89138 - DNA, 15 bp, Homo sapiens
gaaggccttctatgc

SEQ ID NO: 89139 - DNA, 15 bp, Homo sapiens
ggaaggccttctatg

SEQ ID NO: 89140 - DNA, 15 bp, Homo sapiens
aggaaggccttctat

SEQ ID NO: 89141 - DNA, 15 bp, Homo sapiens
taggaaggccttcta

SEQ ID NO: 89142 - DNA, 15 bp, Homo sapiens
gtaggaaggccttct

SEQ ID NO: 89143 - DNA, 15 bp, Homo sapiens
agtaggaaggccttc

SEQ ID NO: 89144 - DNA, 15 bp, Homo sapiens
cagtaggaaggcctt

SEQ ID NO: 89145 - DNA, 15 bp, Homo sapiens
tcagtaggaaggcct

SEQ ID NO: 89146 - DNA, 15 bp, Homo sapiens
ttcagtaggaaggcc

SEQ ID NO: 89147 - DNA, 15 bp, Homo sapiens
cttcagtaggaaggc

SEQ ID NO: 89148 - DNA, 15 bp, Homo sapiens
tcttcagtaggaagg

SEQ ID NO: 89149 - DNA, 15 bp, Homo sapiens
ttcttcagtaggaag

SEQ ID NO: 89150 - DNA, 15 bp, Homo sapiens
tttcttcagtaggaa

SEQ ID NO: 89151 - DNA, 15 bp, Homo sapiens
atttcttcagtagga

SEQ ID NO: 89152 - DNA, 15 bp, Homo sapiens
tatttcttcagtagg

SEQ ID NO: 89153 - DNA, 15 bp, Homo sapiens
ttatttcttcagtag

SEQ ID NO: 89154 - DNA, 15 bp, Homo sapiens
tttatttcttcagta

SEQ ID NO: 89155 - DNA, 15 bp, Homo sapiens
ttttatttcttcagt

SEQ ID NO: 89156 - DNA, 15 bp, Homo sapiens
tttttatttcttcag

SEQ ID NO: 89157 - DNA, 15 bp, Homo sapiens
ttttttatttcttca

SEQ ID NO: 89158 - DNA, 15 bp, Homo sapiens
attttttatttcttc

SEQ ID NO: 89159 - DNA, 15 bp, Homo sapiens
cattttttatttctt

SEQ ID NO: 89160 - DNA, 15 bp, Homo sapiens
acattttttatttct

SEQ ID NO: 89161 - DNA, 15 bp, Homo sapiens
aacattttttatttc

SEQ ID NO: 89162 - DNA, 15 bp, Homo sapiens
gaacattttttattt

SEQ ID NO: 89163 - DNA, 15 bp, Homo sapiens
agaacattttttatt

SEQ ID NO: 89164 - DNA, 15 bp, Homo sapiens
cagaacattttttat

SEQ ID NO: 89165 - DNA, 15 bp, Homo sapiens
ccagaacatttttta

SEQ ID NO: 89166 - DNA, 15 bp, Homo sapiens
tccagaacatttttt

SEQ ID NO: 89167 - DNA, 15 bp, Homo sapiens
ctccagaacattttt

SEQ ID NO: 89168 - DNA, 15 bp, Homo sapiens
ttctccagaacattt

SEQ ID NO: 89169 - DNA, 15 bp, Homo sapiens
cttctccagaacatt

SEQ ID NO: 89170 - DNA, 15 bp, Homo sapiens
ccttctccagaacat

SEQ ID NO: 89171 - DNA, 15 bp, Homo sapiens
accttctccagaaca

SEQ ID NO: 89172 - DNA, 15 bp, Homo sapiens
aaccttctccagaac

SEQ ID NO: 89173 - DNA, 15 bp, Homo sapiens
aaaccttctccagaa

SEQ ID NO: 89174 - DNA, 15 bp, Homo sapiens
gaaaccttctccaga

SEQ ID NO: 89175 - DNA, 15 bp, Homo sapiens
tgaaaccttctccag

SEQ ID NO: 89176 - DNA, 15 bp, Homo sapiens
atgaaaccttctcca

SEQ ID NO: 89177 - DNA, 15 bp, Homo sapiens
gatgaaaccttctcc

SEQ ID NO: 89178 - DNA, 15 bp, Homo sapiens
tgatgaaaccttctc

SEQ ID NO: 89179 - DNA, 15 bp, Homo sapiens
ctgatgaaaccttct

SEQ ID NO: 89180 - DNA, 15 bp, Homo sapiens
tctgatgaaaccttc

SEQ ID NO: 89181 - DNA, 15 bp, Homo sapiens
ttctgatgaaacctt

SEQ ID NO: 89182 - DNA, 15 bp, Homo sapiens
attctgatgaaacct

SEQ ID NO: 89183 - DNA, 15 bp, Homo sapiens
cattctgatgaaacc

SEQ ID NO: 89184 - DNA, 15 bp, Homo sapiens
ccattctgatgaaac

SEQ ID NO: 89185 - DNA, 15 bp, Homo sapiens
tccattctgatgaaa

SEQ ID NO: 89186 - DNA, 15 bp, Homo sapiens
ttccattctgatgaa

SEQ ID NO: 89187 - DNA, 15 bp, Homo sapiens
cttccattctgatga

SEQ ID NO: 89188 - DNA, 15 bp, Homo sapiens
tcttccattctgatg

SEQ ID NO: 89189 - DNA, 15 bp, Homo sapiens
ttcttccattctgat

SEQ ID NO: 89190 - DNA, 15 bp, Homo sapiens
attcttccattctga

SEQ ID NO: 89191 - DNA, 15 bp, Homo sapiens
cattcttccattctg

SEQ ID NO: 89192 - DNA, 15 bp, Homo sapiens
acattcttccattct

SEQ ID NO: 89193 - DNA, 15 bp, Homo sapiens
tacattcttccattc

SEQ ID NO: 89194 - DNA, 15 bp, Homo sapiens
atacattcttccatt

SEQ ID NO: 89195 - DNA, 15 bp, Homo sapiens
gatacattcttccat

SEQ ID NO: 89196 - DNA, 15 bp, Homo sapiens
agatacattcttcca

SEQ ID NO: 89197 - DNA, 15 bp, Homo sapiens
gagatacattcttcc

SEQ ID NO: 89198 - DNA, 15 bp, Homo sapiens
tgagatacattcttc

SEQ ID NO: 89199 - DNA, 15 bp, Homo sapiens
ttgagatacattctt

SEQ ID NO: 89200 - DNA, 15 bp, Homo sapiens
gttgagatacattct

SEQ ID NO: 89201 - DNA, 15 bp, Homo sapiens
tgttgagatacattc

SEQ ID NO: 89202 - DNA, 15 bp, Homo sapiens
atgttgagatacatt

SEQ ID NO: 89203 - DNA, 15 bp, Homo sapiens
aatgttgagatacat

SEQ ID NO: 89204 - DNA, 15 bp, Homo sapiens
aaatgttgagataca

SEQ ID NO: 89205 - DNA, 15 bp, Homo sapiens
caaatgttgagatac

SEQ ID NO: 89206 - DNA, 15 bp, Homo sapiens
ccaaatgttgagata

SEQ ID NO: 89207 - DNA, 15 bp, Homo sapiens
tccaaatgttgagat

SEQ ID NO: 89208 - DNA, 15 bp, Homo sapiens
ttccaaatgttgaga

SEQ ID NO: 89209 - DNA, 15 bp, Homo sapiens
cttccaaatgttgag

SEQ ID NO: 89210 - DNA, 15 bp, Homo sapiens
tcttccaaatgttga

SEQ ID NO: 89211 - DNA, 15 bp, Homo sapiens
atcttccaaatgttg

SEQ ID NO: 89212 - DNA, 15 bp, Homo sapiens
gatcttccaaatgtt

SEQ ID NO: 89213 - DNA, 15 bp, Homo sapiens
agatcttccaaatgt

SEQ ID NO: 89214 - DNA, 15 bp, Homo sapiens
tagatcttccaaatg

SEQ ID NO: 89215 - DNA, 15 bp, Homo sapiens
ctagatcttccaaat

SEQ ID NO: 89216 - DNA, 15 bp, Homo sapiens
tctagatcttccaaa

SEQ ID NO: 89217 - DNA, 15 bp, Homo sapiens
ttctagatcttccaa

SEQ ID NO: 89218 - DNA, 15 bp, Homo sapiens
tttctagatcttcca

SEQ ID NO: 89219 - DNA, 15 bp, Homo sapiens
ctttctagatcttcc

SEQ ID NO: 89220 - DNA, 15 bp, Homo sapiens
tctttctagatcttc

SEQ ID NO: 89221 - DNA, 15 bp, Homo sapiens
ttctttctagatctt

SEQ ID NO: 89222 - DNA, 15 bp, Homo sapiens
tttctttctagatct

SEQ ID NO: 89223 - DNA, 15 bp, Homo sapiens
ctttctttctagatc

SEQ ID NO: 89224 - DNA, 15 bp, Homo sapiens
tctttctttctagat

SEQ ID NO: 89225 - DNA, 15 bp, Homo sapiens
atctttctttctaga

SEQ ID NO: 89226 - DNA, 15 bp, Homo sapiens
aatctttctttctag

SEQ ID NO: 89227 - DNA, 15 bp, Homo sapiens
gaatctttctttcta

SEQ ID NO: 89228 - DNA, 15 bp, Homo sapiens
tgaatctttctttct

SEQ ID NO: 89229 - DNA, 15 bp, Homo sapiens
ctgaatctttctttc

SEQ ID NO: 89230 - DNA, 15 bp, Homo sapiens
gctgaatctttcttt

SEQ ID NO: 89231 - DNA, 15 bp, Homo sapiens
agctgaatctttctt

SEQ ID NO: 89232 - DNA, 15 bp, Homo sapiens
tagctgaatctttct

SEQ ID NO: 89233 - DNA, 15 bp, Homo sapiens
gtagctgaatctttc

SEQ ID NO: 89234 - DNA, 15 bp, Homo sapiens
tgtagctgaatcttt

SEQ ID NO: 89235 - DNA, 15 bp, Homo sapiens
ctgtagctgaatctt

SEQ ID NO: 89236 - DNA, 15 bp, Homo sapiens
cctgtagctgaatct

SEQ ID NO: 89237 - DNA, 15 bp, Homo sapiens
tcctgtagctgaatc

SEQ ID NO: 89238 - DNA, 15 bp, Homo sapiens
ttcctgtagctgaat

SEQ ID NO: 89239 - DNA, 15 bp, Homo sapiens
cttcctgtagctgaa

SEQ ID NO: 89240 - DNA, 15 bp, Homo sapiens
tcttcctgtagctga

SEQ ID NO: 89241 - DNA, 15 bp, Homo sapiens
atcttcctgtagctg

SEQ ID NO: 89242 - DNA, 15 bp, Homo sapiens
tatcttcctgtagct

SEQ ID NO: 89243 - DNA, 15 bp, Homo sapiens
atatcttcctgtagc

SEQ ID NO: 89244 - DNA, 15 bp, Homo sapiens
tatatcttcctgtag

SEQ ID NO: 89245 - DNA, 15 bp, Homo sapiens
ttatatcttcctgta

SEQ ID NO: 89246 - DNA, 15 bp, Homo sapiens
tttatatcttcctgt

SEQ ID NO: 89247 - DNA, 15 bp, Homo sapiens
atttatatcttcctg

SEQ ID NO: 89248 - DNA, 15 bp, Homo sapiens
catttatatcttcct

SEQ ID NO: 89249 - DNA, 15 bp, Homo sapiens
gcatttatatcttcc

SEQ ID NO: 89250 - DNA, 15 bp, Homo sapiens
agcatttatatcttc

SEQ ID NO: 89251 - DNA, 15 bp, Homo sapiens
aagcatttatatctt

SEQ ID NO: 89252 - DNA, 15 bp, Homo sapiens
taagcatttatatct

SEQ ID NO: 89253 - DNA, 15 bp, Homo sapiens
ataagcatttatatc

SEQ ID NO: 89254 - DNA, 15 bp, Homo sapiens
aataagcatttatat

SEQ ID NO: 89255 - DNA, 15 bp, Homo sapiens
aaataagcatttata

SEQ ID NO: 89256 - DNA, 15 bp, Homo sapiens
gaaataagcatttat

SEQ ID NO: 89257 - DNA, 15 bp, Homo sapiens
tgaaataagcattta

SEQ ID NO: 89258 - DNA, 15 bp, Homo sapiens
ttgaaataagcattt

SEQ ID NO: 89259 - DNA, 15 bp, Homo sapiens
cttgaaataagcatt

SEQ ID NO: 89260 - DNA, 15 bp, Homo sapiens
gcttgaaataagcat

SEQ ID NO: 89261 - DNA, 15 bp, Homo sapiens
tgcttgaaataagca

SEQ ID NO: 89262 - DNA, 15 bp, Homo sapiens
ctgcttgaaataagc

SEQ ID NO: 89263 - DNA, 15 bp, Homo sapiens
gctgcttgaaataag

SEQ ID NO: 89264 - DNA, 15 bp, Homo sapiens
agctgcttgaaataa

SEQ ID NO: 89265 - DNA, 15 bp, Homo sapiens
aagctgcttgaaata

SEQ ID NO: 89266 - DNA, 15 bp, Homo sapiens
caagctgcttgaaat

SEQ ID NO: 89267 - DNA, 15 bp, Homo sapiens
tcaagctgcttgaaa

SEQ ID NO: 89268 - DNA, 15 bp, Homo sapiens
atcaagctgcttgaa

SEQ ID NO: 89269 - DNA, 15 bp, Homo sapiens
catcaagctgcttga

SEQ ID NO: 89270 - DNA, 15 bp, Homo sapiens
tcatcaagctgcttg

SEQ ID NO: 89271 - DNA, 15 bp, Homo sapiens
ctcatcaagctgctt

SEQ ID NO: 89272 - DNA, 15 bp, Homo sapiens
gctcatcaagctgct

SEQ ID NO: 89273 - DNA, 15 bp, Homo sapiens
agctcatcaagctgc

SEQ ID NO: 89274 - DNA, 15 bp, Homo sapiens
aagctcatcaagctg

SEQ ID NO: 89275 - DNA, 15 bp, Homo sapiens
caagctcatcaagct

SEQ ID NO: 89276 - DNA, 15 bp, Homo sapiens
tcaagctcatcaagc

SEQ ID NO: 89277 - DNA, 15 bp, Homo sapiens
ttcaagctcatcaag

SEQ ID NO: 89278 - DNA, 15 bp, Homo sapiens
tttcaagctcatcaa

SEQ ID NO: 89279 - DNA, 15 bp, Homo sapiens
ttttcaagctcatca

SEQ ID NO: 89280 - DNA, 15 bp, Homo sapiens
cttttcaagctcatc

SEQ ID NO: 89281 - DNA, 15 bp, Homo sapiens
ccttttcaagctcat

SEQ ID NO: 89282 - DNA, 15 bp, Homo sapiens
accttttcaagctca

SEQ ID NO: 89283 - DNA, 15 bp, Homo sapiens
gaccttttcaagctc

SEQ ID NO: 89284 - DNA, 15 bp, Homo sapiens
tgaccttttcaagct

SEQ ID NO: 89285 - DNA, 15 bp, Homo sapiens
atgaccttttcaagc

SEQ ID NO: 89286 - DNA, 15 bp, Homo sapiens
gatgaccttttcaag

SEQ ID NO: 89287 - DNA, 15 bp, Homo sapiens
tgatgaccttttcaa

SEQ ID NO: 89288 - DNA, 15 bp, Homo sapiens
ttgatgaccttttca

SEQ ID NO: 89289 - DNA, 15 bp, Homo sapiens
cttgatgaccttttc

SEQ ID NO: 89290 - DNA, 15 bp, Homo sapiens
tcttgatgacctttt

SEQ ID NO: 89291 - DNA, 15 bp, Homo sapiens
gtcttgatgaccttt

SEQ ID NO: 89292 - DNA, 15 bp, Homo sapiens
tgtcttgatgacctt

SEQ ID NO: 89293 - DNA, 15 bp, Homo sapiens
ttgtcttgatgacct

SEQ ID NO: 89294 - DNA, 15 bp, Homo sapiens
tttgtcttgatgacc

SEQ ID NO: 89295 - DNA, 15 bp, Homo sapiens
ctttgtcttgatgac

SEQ ID NO: 89296 - DNA, 15 bp, Homo sapiens
cctttgtcttgatga

SEQ ID NO: 89297 - DNA, 15 bp, Homo sapiens
tcctttgtcttgatg

SEQ ID NO: 89298 - DNA, 15 bp, Homo sapiens
ctcctttgtcttgat

SEQ ID NO: 89299 - DNA, 15 bp, Homo sapiens
cctcctttgtcttga

SEQ ID NO: 89300 - DNA, 15 bp, Homo sapiens
tcctcctttgtcttg

SEQ ID NO: 89301 - DNA, 15 bp, Homo sapiens
ctcctcctttgtctt

SEQ ID NO: 89302 - DNA, 15 bp, Homo sapiens
actcctcctttgtct

SEQ ID NO: 89303 - DNA, 15 bp, Homo sapiens
cactcctcctttgtc

SEQ ID NO: 89304 - DNA, 15 bp, Homo sapiens
ccactcctcctttgt

SEQ ID NO: 89305 - DNA, 15 bp, Homo sapiens
cccactcctcctttg

SEQ ID NO: 89306 - DNA, 15 bp, Homo sapiens
acccactcctccttt

SEQ ID NO: 89307 - DNA, 15 bp, Homo sapiens
tacccactcctcctt

SEQ ID NO: 89308 - DNA, 15 bp, Homo sapiens
ttacccactcctcct

SEQ ID NO: 89309 - DNA, 15 bp, Homo sapiens
tttacccactcctcc

SEQ ID NO: 89310 - DNA, 15 bp, Homo sapiens
ttttacccactcctc

SEQ ID NO: 89311 - DNA, 15 bp, Homo sapiens
gttttacccactcct

SEQ ID NO: 89312 - DNA, 15 bp, Homo sapiens
tgttttacccactcc

SEQ ID NO: 89313 - DNA, 15 bp, Homo sapiens
gtgttttacccactc

SEQ ID NO: 89314 - DNA, 15 bp, Homo sapiens
tgtgttttacccact

SEQ ID NO: 89315 - DNA, 15 bp, Homo sapiens
gtgtgttttacccac

SEQ ID NO: 89316 - DNA, 15 bp, Homo sapiens
agtgtgttttaccca

SEQ ID NO: 89317 - DNA, 15 bp, Homo sapiens
aagtgtgttttaccc

SEQ ID NO: 89318 - DNA, 15 bp, Homo sapiens
gaagtgtgttttacc

SEQ ID NO: 89319 - DNA, 15 bp, Homo sapiens
ggaagtgtgttttac

SEQ ID NO: 89320 - DNA, 15 bp, Homo sapiens
tggaagtgtgtttta

SEQ ID NO: 89321 - DNA, 15 bp, Homo sapiens
atggaagtgtgtttt

SEQ ID NO: 89322 - DNA, 15 bp, Homo sapiens
aatggaagtgtgttt

SEQ ID NO: 89323 - DNA, 15 bp, Homo sapiens
aaatggaagtgtgtt

SEQ ID NO: 89324 - DNA, 15 bp, Homo sapiens
gaaatggaagtgtgt

SEQ ID NO: 89325 - DNA, 15 bp, Homo sapiens
agaaatggaagtgtg

SEQ ID NO: 89326 - DNA, 15 bp, Homo sapiens
cagaaatggaagtgt

SEQ ID NO: 89327 - DNA, 15 bp, Homo sapiens
tcagaaatggaagtg

SEQ ID NO: 89328 - DNA, 15 bp, Homo sapiens
ttcagaaatggaagt

SEQ ID NO: 89329 - DNA, 15 bp, Homo sapiens
attcagaaatggaag

SEQ ID NO: 89330 - DNA, 15 bp, Homo sapiens
gattcagaaatggaa

SEQ ID NO: 89331 - DNA, 15 bp, Homo sapiens
agattcagaaatgga

SEQ ID NO: 89332 - DNA, 15 bp, Homo sapiens
aagattcagaaatgg

SEQ ID NO: 89333 - DNA, 15 bp, Homo sapiens
gaagattcagaaatg

SEQ ID NO: 89334 - DNA, 15 bp, Homo sapiens
ggaagattcagaaat

SEQ ID NO: 89335 - DNA, 15 bp, Homo sapiens
gggaagattcagaaa

SEQ ID NO: 89336 - DNA, 15 bp, Homo sapiens
cgggaagattcagaa

SEQ ID NO: 89337 - DNA, 15 bp, Homo sapiens
ccgggaagattcaga

SEQ ID NO: 89338 - DNA, 15 bp, Homo sapiens
gccgggaagattcag

SEQ ID NO: 89339 - DNA, 15 bp, Homo sapiens
tgccgggaagattca

SEQ ID NO: 89340 - DNA, 15 bp, Homo sapiens
ctgccgggaagattc

SEQ ID NO: 89341 - DNA, 15 bp, Homo sapiens
actgccgggaagatt

SEQ ID NO: 89342 - DNA, 15 bp, Homo sapiens
gactgccgggaagat

SEQ ID NO: 89343 - DNA, 15 bp, Homo sapiens
ggactgccgggaaga

SEQ ID NO: 89344 - DNA, 15 bp, Homo sapiens
aggactgccgggaag

SEQ ID NO: 89345 - DNA, 15 bp, Homo sapiens
aaggactgccgggaa

SEQ ID NO: 89346 - DNA, 15 bp, Homo sapiens
caaggactgccggga

SEQ ID NO: 89347 - DNA, 15 bp, Homo sapiens
gcaaggactgccggg

SEQ ID NO: 89348 - DNA, 15 bp, Homo sapiens
ggcaaggactgccgg

SEQ ID NO: 89349 - DNA, 15 bp, Homo sapiens
tggcaaggactgccg

SEQ ID NO: 89350 - DNA, 15 bp, Homo sapiens
ttggcaaggactgcc

SEQ ID NO: 89351 - DNA, 15 bp, Homo sapiens
cttggcaaggactgc

SEQ ID NO: 89352 - DNA, 15 bp, Homo sapiens
gcttggcaaggactg

SEQ ID NO: 89353 - DNA, 15 bp, Homo sapiens
agcttggcaaggact

SEQ ID NO: 89354 - DNA, 15 bp, Homo sapiens
aagcttggcaaggac

SEQ ID NO: 89355 - DNA, 15 bp, Homo sapiens
caagcttggcaagga

SEQ ID NO: 89356 - DNA, 15 bp, Homo sapiens
tcaagcttggcaagg

SEQ ID NO: 89357 - DNA, 15 bp, Homo sapiens
ttcaagcttggcaag

SEQ ID NO: 89358 - DNA, 15 bp, Homo sapiens
cttcaagcttggcaa

SEQ ID NO: 89359 - DNA, 15 bp, Homo sapiens
ccttcaagcttggca

SEQ ID NO: 89360 - DNA, 15 bp, Homo sapiens
tccttcaagcttggc

SEQ ID NO: 89361 - DNA, 15 bp, Homo sapiens
atccttcaagcttgg

SEQ ID NO: 89362 - DNA, 15 bp, Homo sapiens
aatccttcaagcttg

SEQ ID NO: 89363 - DNA, 15 bp, Homo sapiens
gaatccttcaagctt

SEQ ID NO: 89364 - DNA, 15 bp, Homo sapiens
ggaatccttcaagct

SEQ ID NO: 89365 - DNA, 15 bp, Homo sapiens
aggaatccttcaagc

SEQ ID NO: 89366 - DNA, 15 bp, Homo sapiens
caggaatccttcaag

SEQ ID NO: 89367 - DNA, 15 bp, Homo sapiens
acaggaatccttcaa

SEQ ID NO: 89368 - DNA, 15 bp, Homo sapiens
gacaggaatccttca

SEQ ID NO: 89369 - DNA, 15 bp, Homo sapiens
tgacaggaatccttc

SEQ ID NO: 89370 - DNA, 15 bp, Homo sapiens
ctgacaggaatcctt

SEQ ID NO: 89371 - DNA, 15 bp, Homo sapiens
cctgacaggaatcct

SEQ ID NO: 89372 - DNA, 15 bp, Homo sapiens
acctgacaggaatcc

SEQ ID NO: 89373 - DNA, 15 bp, Homo sapiens
tacctgacaggaatc

SEQ ID NO: 89374 - DNA, 15 bp, Homo sapiens
ttacctgacaggaat

SEQ ID NO: 89375 - DNA, 15 bp, Homo sapiens
cttacctgacaggaa

SEQ ID NO: 89376 - DNA, 15 bp, Homo sapiens
ccttacctgacagga

SEQ ID NO: 89377 - DNA, 15 bp, Homo sapiens
tccttacctgacagg

SEQ ID NO: 89378 - DNA, 15 bp, Homo sapiens
ctccttacctgacag

SEQ ID NO: 89379 - DNA, 15 bp, Homo sapiens
gctccttacctgaca

SEQ ID NO: 89380 - DNA, 15 bp, Homo sapiens
ggctccttacctgac

SEQ ID NO: 89381 - DNA, 15 bp, Homo sapiens
tggctccttacctga

SEQ ID NO: 89382 - DNA, 15 bp, Homo sapiens
ttggctccttacctg

SEQ ID NO: 89383 - DNA, 15 bp, Homo sapiens
gttggctccttacct

SEQ ID NO: 89384 - DNA, 15 bp, Homo sapiens
cgttggctccttacc

SEQ ID NO: 89385 - DNA, 15 bp, Homo sapiens
ccgttggctccttac

SEQ ID NO: 89386 - DNA, 15 bp, Homo sapiens
accgttggctcctta

SEQ ID NO: 89387 - DNA, 15 bp, Homo sapiens
gaccgttggctcctt

SEQ ID NO: 89388 - DNA, 15 bp, Homo sapiens
agaccgttggctcct

SEQ ID NO: 89389 - DNA, 15 bp, Homo sapiens
cagaccgttggctcc

SEQ ID NO: 89390 - DNA, 15 bp, Homo sapiens
ccagaccgttggctc

SEQ ID NO: 89391 - DNA, 15 bp, Homo sapiens
tccagaccgttggct

SEQ ID NO: 89392 - DNA, 15 bp, Homo sapiens
ttccagaccgttggc

SEQ ID NO: 89393 - DNA, 15 bp, Homo sapiens
tttccagaccgttgg

SEQ ID NO: 89394 - DNA, 15 bp, Homo sapiens
ctttccagaccgttg

SEQ ID NO: 89395 - DNA, 15 bp, Homo sapiens
actttccagaccgtt

SEQ ID NO: 89396 - DNA, 15 bp, Homo sapiens
cactttccagaccgt

SEQ ID NO: 89397 - DNA, 15 bp, Homo sapiens
ccactttccagaccg

SEQ ID NO: 89398 - DNA, 15 bp, Homo sapiens
tccactttccagacc

SEQ ID NO: 89399 - DNA, 15 bp, Homo sapiens
ctccactttccagac

SEQ ID NO: 89400 - DNA, 15 bp, Homo sapiens
cctccactttccaga

SEQ ID NO: 89401 - DNA, 15 bp, Homo sapiens
tcctccactttccag

SEQ ID NO: 89402 - DNA, 15 bp, Homo sapiens
ttcctccactttcca

SEQ ID NO: 89403 - DNA, 15 bp, Homo sapiens
attcctccactttcc

SEQ ID NO: 89404 - DNA, 15 bp, Homo sapiens
aattcctccactttc

SEQ ID NO: 89405 - DNA, 15 bp, Homo sapiens
gaattcctccacttt

SEQ ID NO: 89406 - DNA, 15 bp, Homo sapiens
agaattcctccactt

SEQ ID NO: 89407 - DNA, 15 bp, Homo sapiens
tagaattcctccact

SEQ ID NO: 89408 - DNA, 15 bp, Homo sapiens
atagaattcctccac

SEQ ID NO: 89409 - DNA, 15 bp, Homo sapiens
catagaattcctcca

SEQ ID NO: 89410 - DNA, 15 bp, Homo sapiens
acatagaattcctcc

SEQ ID NO: 89411 - DNA, 15 bp, Homo sapiens
cacatagaattcctc

SEQ ID NO: 89412 - DNA, 15 bp, Homo sapiens
gcacatagaattcct

SEQ ID NO: 89413 - DNA, 15 bp, Homo sapiens
tgcacatagaattcc

SEQ ID NO: 89414 - DNA, 15 bp, Homo sapiens
ctgcacatagaattc

SEQ ID NO: 89415 - DNA, 15 bp, Homo sapiens
actgcacatagaatt

SEQ ID NO: 89416 - DNA, 15 bp, Homo sapiens
aactgcacatagaat

SEQ ID NO: 89417 - DNA, 15 bp, Homo sapiens
gaactgcacatagaa

SEQ ID NO: 89418 - DNA, 15 bp, Homo sapiens
ggaactgcacataga

SEQ ID NO: 89419 - DNA, 15 bp, Homo sapiens
tggaactgcacatag

SEQ ID NO: 89420 - DNA, 15 bp, Homo sapiens
ctggaactgcacata

SEQ ID NO: 89421 - DNA, 15 bp, Homo sapiens
tctggaactgcacat

SEQ ID NO: 89422 - DNA, 15 bp, Homo sapiens
ctctggaactgcaca

SEQ ID NO: 89423 - DNA, 15 bp, Homo sapiens
actctggaactgcac

SEQ ID NO: 89424 - DNA, 15 bp, Homo sapiens
aactctggaactgca

SEQ ID NO: 89425 - DNA, 15 bp, Homo sapiens
taactctggaactgc

SEQ ID NO: 89426 - DNA, 15 bp, Homo sapiens
ttaactctggaactg

SEQ ID NO: 89427 - DNA, 15 bp, Homo sapiens
cttaactctggaact

SEQ ID NO: 89428 - DNA, 15 bp, Homo sapiens
ccttaactctggaac

SEQ ID NO: 89429 - DNA, 15 bp, Homo sapiens
tccttaactctggaa

SEQ ID NO: 89430 - DNA, 15 bp, Homo sapiens
ctccttaactctgga

SEQ ID NO: 89431 - DNA, 15 bp, Homo sapiens
cctccttaactctgg

SEQ ID NO: 89432 - DNA, 15 bp, Homo sapiens
ccctccttaactctg

SEQ ID NO: 89433 - DNA, 15 bp, Homo sapiens
gccctccttaactct

SEQ ID NO: 89434 - DNA, 15 bp, Homo sapiens
agccctccttaactc

SEQ ID NO: 89435 - DNA, 15 bp, Homo sapiens
aagccctccttaact

SEQ ID NO: 89436 - DNA, 15 bp, Homo sapiens
gaagccctccttaac

SEQ ID NO: 89437 - DNA, 15 bp, Homo sapiens
agaagccctccttaa

SEQ ID NO: 89438 - DNA, 15 bp, Homo sapiens
gagaagccctcctta

SEQ ID NO: 89439 - DNA, 15 bp, Homo sapiens
cgagaagccctcctt

SEQ ID NO: 89440 - DNA, 15 bp, Homo sapiens
acgagaagccctcct

SEQ ID NO: 89441 - DNA, 15 bp, Homo sapiens
tacgagaagccctcc

SEQ ID NO: 89442 - DNA, 15 bp, Homo sapiens
atacgagaagccctc

SEQ ID NO: 89443 - DNA, 15 bp, Homo sapiens
gatacgagaagccct

SEQ ID NO: 89444 - DNA, 15 bp, Homo sapiens
tgatacgagaagccc

SEQ ID NO: 89445 - DNA, 15 bp, Homo sapiens
atgatacgagaagcc

SEQ ID NO: 89446 - DNA, 15 bp, Homo sapiens
catgatacgagaagc

SEQ ID NO: 89447 - DNA, 15 bp, Homo sapiens
tcatgatacgagaag

SEQ ID NO: 89448 - DNA, 15 bp, Homo sapiens
ttcatgatacgagaa

SEQ ID NO: 89449 - DNA, 15 bp, Homo sapiens
gttcatgatacgaga

SEQ ID NO: 89450 - DNA, 15 bp, Homo sapiens
agttcatgatacgag

SEQ ID NO: 89451 - DNA, 15 bp, Homo sapiens
aagttcatgatacga

SEQ ID NO: 89452 - DNA, 15 bp, Homo sapiens
aaagttcatgatacg

SEQ ID NO: 89453 - DNA, 15 bp, Homo sapiens
taaagttcatgatac

SEQ ID NO: 89454 - DNA, 15 bp, Homo sapiens
ttaaagttcatgata

SEQ ID NO: 89455 - DNA, 15 bp, Homo sapiens
cttaaagttcatgat

SEQ ID NO: 89456 - DNA, 15 bp, Homo sapiens
acttaaagttcatga

SEQ ID NO: 89457 - DNA, 15 bp, Homo sapiens
aacttaaagttcatg

SEQ ID NO: 89458 - DNA, 15 bp, Homo sapiens
taacttaaagttcat

SEQ ID NO: 89459 - DNA, 15 bp, Homo sapiens
ttaacttaaagttca

SEQ ID NO: 89460 - DNA, 15 bp, Homo sapiens
attaacttaaagttc

SEQ ID NO: 89461 - DNA, 15 bp, Homo sapiens
cattaacttaaagtt

SEQ ID NO: 89462 - DNA, 15 bp, Homo sapiens
gcattaacttaaagt

SEQ ID NO: 89463 - DNA, 15 bp, Homo sapiens
agcattaacttaaag

SEQ ID NO: 89464 - DNA, 15 bp, Homo sapiens
cagcattaacttaaa

SEQ ID NO: 89465 - DNA, 15 bp, Homo sapiens
gcagcattaacttaa

SEQ ID NO: 89466 - DNA, 15 bp, Homo sapiens
ggcagcattaactta

SEQ ID NO: 89467 - DNA, 15 bp, Homo sapiens
gggcagcattaactt

SEQ ID NO: 89468 - DNA, 15 bp, Homo sapiens
agggcagcattaact

SEQ ID NO: 89469 - DNA, 15 bp, Homo sapiens
cagggcagcattaac

SEQ ID NO: 89470 - DNA, 15 bp, Homo sapiens
tcagggcagcattaa

SEQ ID NO: 89471 - DNA, 15 bp, Homo sapiens
atcagggcagcatta

SEQ ID NO: 89472 - DNA, 15 bp, Homo sapiens
aatcagggcagcatt

SEQ ID NO: 89473 - DNA, 15 bp, Homo sapiens
taatcagggcagcat

SEQ ID NO: 89474 - DNA, 15 bp, Homo sapiens
ttaatcagggcagca

SEQ ID NO: 89475 - DNA, 15 bp, Homo sapiens
gttaatcagggcagc

SEQ ID NO: 89476 - DNA, 15 bp, Homo sapiens
agttaatcagggcag

SEQ ID NO: 89477 - DNA, 15 bp, Homo sapiens
aagttaatcagggca

SEQ ID NO: 89478 - DNA, 15 bp, Homo sapiens
gaagttaatcagggc

SEQ ID NO: 89479 - DNA, 15 bp, Homo sapiens
ggaagttaatcaggg

SEQ ID NO: 89480 - DNA, 15 bp, Homo sapiens
aggaagttaatcagg

SEQ ID NO: 89481 - DNA, 15 bp, Homo sapiens
caggaagttaatcag

SEQ ID NO: 89482 - DNA, 15 bp, Homo sapiens
acaggaagttaatca

SEQ ID NO: 89483 - DNA, 15 bp, Homo sapiens
cacaggaagttaatc

SEQ ID NO: 89484 - DNA, 15 bp, Homo sapiens
tcacaggaagttaat

SEQ ID NO: 89485 - DNA, 15 bp, Homo sapiens
ctcacaggaagttaa

SEQ ID NO: 89486 - DNA, 15 bp, Homo sapiens
cctcacaggaagtta

SEQ ID NO: 89487 - DNA, 15 bp, Homo sapiens
tcctcacaggaagtt

SEQ ID NO: 89488 - DNA, 15 bp, Homo sapiens
atcctcacaggaagt

SEQ ID NO: 89489 - DNA, 15 bp, Homo sapiens
catcctcacaggaag

SEQ ID NO: 89490 - DNA, 15 bp, Homo sapiens
acatcctcacaggaa

SEQ ID NO: 89491 - DNA, 15 bp, Homo sapiens
aacatcctcacagga

SEQ ID NO: 89492 - DNA, 15 bp, Homo sapiens
gaacatcctcacagg

SEQ ID NO: 89493 - DNA, 15 bp, Homo sapiens
tgaacatcctcacag

SEQ ID NO: 89494 - DNA, 15 bp, Homo sapiens
atgaacatcctcaca

SEQ ID NO: 89495 - DNA, 15 bp, Homo sapiens
gatgaacatcctcac

SEQ ID NO: 89496 - DNA, 15 bp, Homo sapiens
agatgaacatcctca

SEQ ID NO: 89497 - DNA, 15 bp, Homo sapiens
aagatgaacatcctc

SEQ ID NO: 89498 - DNA, 15 bp, Homo sapiens
gaagatgaacatcct

SEQ ID NO: 89499 - DNA, 15 bp, Homo sapiens
tgaagatgaacatcc

SEQ ID NO: 89500 - DNA, 15 bp, Homo sapiens
ctgaagatgaacatc

SEQ ID NO: 89501 - DNA, 15 bp, Homo sapiens
actgaagatgaacat

SEQ ID NO: 89502 - DNA, 15 bp, Homo sapiens
cactgaagatgaaca

SEQ ID NO: 89503 - DNA, 15 bp, Homo sapiens
tcactgaagatgaac

SEQ ID NO: 89504 - DNA, 15 bp, Homo sapiens
ctcactgaagatgaa

SEQ ID NO: 89505 - DNA, 15 bp, Homo sapiens
actcactgaagatga

SEQ ID NO: 89506 - DNA, 15 bp, Homo sapiens
aactcactgaagatg

SEQ ID NO: 89507 - DNA, 15 bp, Homo sapiens
caactcactgaagat

SEQ ID NO: 89508 - DNA, 15 bp, Homo sapiens
acaactcactgaaga

SEQ ID NO: 89509 - DNA, 15 bp, Homo sapiens
cacaactcactgaag

SEQ ID NO: 89510 - DNA, 15 bp, Homo sapiens
acacaactcactgaa

SEQ ID NO: 89511 - DNA, 15 bp, Homo sapiens
cacacaactcactga

SEQ ID NO: 89512 - DNA, 15 bp, Homo sapiens
tcacacaactcactg

SEQ ID NO: 89513 - DNA, 15 bp, Homo sapiens
gtcacacaactcact

SEQ ID NO: 89514 - DNA, 15 bp, Homo sapiens
ggtcacacaactcac

SEQ ID NO: 89515 - DNA, 15 bp, Homo sapiens
cggtcacacaactca

SEQ ID NO: 89516 - DNA, 15 bp, Homo sapiens
acggtcacacaactc

SEQ ID NO: 89517 - DNA, 15 bp, Homo sapiens
tacggtcacacaact

SEQ ID NO: 89518 - DNA, 15 bp, Homo sapiens
atacggtcacacaac

SEQ ID NO: 89519 - DNA, 15 bp, Homo sapiens
aatacggtcacacaa

SEQ ID NO: 89520 - DNA, 15 bp, Homo sapiens
aaatacggtcacaca

SEQ ID NO: 89521 - DNA, 15 bp, Homo sapiens
aaaatacggtcacac

SEQ ID NO: 89522 - DNA, 15 bp, Homo sapiens
gaaaatacggtcaca

SEQ ID NO: 89523 - DNA, 15 bp, Homo sapiens
agaaaatacggtcac

SEQ ID NO: 89524 - DNA, 15 bp, Homo sapiens
gagaaaatacggtca

SEQ ID NO: 89525 - DNA, 15 bp, Homo sapiens
agagaaaatacggtc

SEQ ID NO: 89526 - DNA, 15 bp, Homo sapiens
aagagaaaatacggt

SEQ ID NO: 89527 - DNA, 15 bp, Homo sapiens
gaagagaaaatacgg

SEQ ID NO: 89528 - DNA, 15 bp, Homo sapiens
ggaagagaaaatacg

SEQ ID NO: 89529 - DNA, 15 bp, Homo sapiens
aggaagagaaaatac

SEQ ID NO: 89530 - DNA, 15 bp, Homo sapiens
aaggaagagaaaata

SEQ ID NO: 89531 - DNA, 15 bp, Homo sapiens
taaggaagagaaaat

SEQ ID NO: 89532 - DNA, 15 bp, Homo sapiens
ctaaggaagagaaaa

SEQ ID NO: 89533 - DNA, 15 bp, Homo sapiens
gctaaggaagagaaa

SEQ ID NO: 89534 - DNA, 15 bp, Homo sapiens
cgctaaggaagagaa

SEQ ID NO: 89535 - DNA, 15 bp, Homo sapiens
ccgctaaggaagaga

SEQ ID NO: 89536 - DNA, 15 bp, Homo sapiens
cccgctaaggaagag

SEQ ID NO: 89537 - DNA, 15 bp, Homo sapiens
tcccgctaaggaaga

SEQ ID NO: 89538 - DNA, 15 bp, Homo sapiens
ttcccgctaaggaag

SEQ ID NO: 89539 - DNA, 15 bp, Homo sapiens
attcccgctaaggaa

SEQ ID NO: 89540 - DNA, 15 bp, Homo sapiens
aattcccgctaagga

SEQ ID NO: 89541 - DNA, 15 bp, Homo sapiens
caattcccgctaagg

SEQ ID NO: 89542 - DNA, 15 bp, Homo sapiens
tcaattcccgctaag

SEQ ID NO: 89543 - DNA, 15 bp, Homo sapiens
gtcaattcccgctaa

SEQ ID NO: 89544 - DNA, 15 bp, Homo sapiens
tgtcaattcccgcta

SEQ ID NO: 89545 - DNA, 15 bp, Homo sapiens
ttgtcaattcccgct

SEQ ID NO: 89546 - DNA, 15 bp, Homo sapiens
tttgtcaattcccgc

SEQ ID NO: 89547 - DNA, 15 bp, Homo sapiens
atttgtcaattcccg

SEQ ID NO: 89548 - DNA, 15 bp, Homo sapiens
gatttgtcaattccc

SEQ ID NO: 89549 - DNA, 15 bp, Homo sapiens
agatttgtcaattcc

SEQ ID NO: 89550 - DNA, 15 bp, Homo sapiens
aagatttgtcaattc

SEQ ID NO: 89551 - DNA, 15 bp, Homo sapiens
gaagatttgtcaatt

SEQ ID NO: 89552 - DNA, 15 bp, Homo sapiens
agaagatttgtcaat

SEQ ID NO: 89553 - DNA, 15 bp, Homo sapiens
aagaagatttgtcaa

SEQ ID NO: 89554 - DNA, 15 bp, Homo sapiens
caagaagatttgtca

SEQ ID NO: 89555 - DNA, 15 bp, Homo sapiens
ccaagaagatttgtc

SEQ ID NO: 89556 - DNA, 15 bp, Homo sapiens
gccaagaagatttgt

SEQ ID NO: 89557 - DNA, 15 bp, Homo sapiens
ggccaagaagatttg

SEQ ID NO: 89558 - DNA, 15 bp, Homo sapiens
aggccaagaagattt

SEQ ID NO: 89559 - DNA, 15 bp, Homo sapiens
aaggccaagaagatt

SEQ ID NO: 89560 - DNA, 15 bp, Homo sapiens
gaaggccaagaagat

SEQ ID NO: 89561 - DNA, 15 bp, Homo sapiens
tgaaggccaagaaga

SEQ ID NO: 89562 - DNA, 15 bp, Homo sapiens
gtgaaggccaagaag

SEQ ID NO: 89563 - DNA, 15 bp, Homo sapiens
ggtgaaggccaagaa

SEQ ID NO: 89564 - DNA, 15 bp, Homo sapiens
gggtgaaggccaaga

SEQ ID NO: 89565 - DNA, 15 bp, Homo sapiens
ggggtgaaggccaag

SEQ ID NO: 89566 - DNA, 15 bp, Homo sapiens
tggggtgaaggccaa

SEQ ID NO: 89567 - DNA, 15 bp, Homo sapiens
ttggggtgaaggcca

SEQ ID NO: 89568 - DNA, 15 bp, Homo sapiens
tttggggtgaaggcc

SEQ ID NO: 89569 - DNA, 15 bp, Homo sapiens
ttttggggtgaaggc

SEQ ID NO: 89570 - DNA, 15 bp, Homo sapiens
attttggggtgaagg

SEQ ID NO: 89571 - DNA, 15 bp, Homo sapiens
aattttggggtgaag

SEQ ID NO: 89572 - DNA, 15 bp, Homo sapiens
caattttggggtgaa

SEQ ID NO: 89573 - DNA, 15 bp, Homo sapiens
tcaattttggggtga

SEQ ID NO: 89574 - DNA, 15 bp, Homo sapiens
ttcaattttggggtg

SEQ ID NO: 89575 - DNA, 15 bp, Homo sapiens
tttcaattttggggt

SEQ ID NO: 89576 - DNA, 15 bp, Homo sapiens
atttcaattttgggg

SEQ ID NO: 89577 - DNA, 15 bp, Homo sapiens
catttcaattttggg

SEQ ID NO: 89578 - DNA, 15 bp, Homo sapiens
ccatttcaattttgg

SEQ ID NO: 89579 - DNA, 15 bp, Homo sapiens
gccatttcaattttg

SEQ ID NO: 89580 - DNA, 15 bp, Homo sapiens
agccatttcaatttt

SEQ ID NO: 89581 - DNA, 15 bp, Homo sapiens
gagccatttcaattt

SEQ ID NO: 89582 - DNA, 15 bp, Homo sapiens
cgagccatttcaatt

SEQ ID NO: 89583 - DNA, 15 bp, Homo sapiens
acgagccatttcaat

SEQ ID NO: 89584 - DNA, 15 bp, Homo sapiens
cacgagccatttcaa

SEQ ID NO: 89585 - DNA, 15 bp, Homo sapiens
gcacgagccatttca

SEQ ID NO: 89586 - DNA, 15 bp, Homo sapiens
tgcacgagccatttc

SEQ ID NO: 89587 - DNA, 15 bp, Homo sapiens
ttgcacgagccattt

SEQ ID NO: 89588 - DNA, 15 bp, Homo sapiens
cttgcacgagccatt

SEQ ID NO: 89589 - DNA, 15 bp, Homo sapiens
gcttgcacgagccat

SEQ ID NO: 89590 - DNA, 15 bp, Homo sapiens
agcttgcacgagcca

SEQ ID NO: 89591 - DNA, 15 bp, Homo sapiens
cagcttgcacgagcc

SEQ ID NO: 89592 - DNA, 15 bp, Homo sapiens
gcagcttgcacgagc

SEQ ID NO: 89593 - DNA, 15 bp, Homo sapiens
agcagcttgcacgag

SEQ ID NO: 89594 - DNA, 15 bp, Homo sapiens
gagcagcttgcacga

SEQ ID NO: 89595 - DNA, 15 bp, Homo sapiens
cgagcagcttgcacg

SEQ ID NO: 89596 - DNA, 15 bp, Homo sapiens
ccgagcagcttgcac

SEQ ID NO: 89597 - DNA, 15 bp, Homo sapiens
gccgagcagcttgca

SEQ ID NO: 89598 - DNA, 15 bp, Homo sapiens
ggccgagcagcttgc

SEQ ID NO: 89599 - DNA, 15 bp, Homo sapiens
gggccgagcagcttg

SEQ ID NO: 89600 - DNA, 15 bp, Homo sapiens
agggccgagcagctt

SEQ ID NO: 89601 - DNA, 15 bp, Homo sapiens
cagggccgagcagct

SEQ ID NO: 89602 - DNA, 15 bp, Homo sapiens
tcagggccgagcagc

SEQ ID NO: 89603 - DNA, 15 bp, Homo sapiens
atcagggccgagcag

SEQ ID NO: 89604 - DNA, 15 bp, Homo sapiens
catcagggccgagca

SEQ ID NO: 89605 - DNA, 15 bp, Homo sapiens
acatcagggccgagc

SEQ ID NO: 89606 - DNA, 15 bp, Homo sapiens
gacatcagggccgag

SEQ ID NO: 89607 - DNA, 15 bp, Homo sapiens
agacatcagggccga

SEQ ID NO: 89608 - DNA, 15 bp, Homo sapiens
gagacatcagggccg

SEQ ID NO: 89609 - DNA, 15 bp, Homo sapiens
tgagacatcagggcc

SEQ ID NO: 89610 - DNA, 15 bp, Homo sapiens
ctgagacatcagggc

SEQ ID NO: 89611 - DNA, 15 bp, Homo sapiens
gctgagacatcaggg

SEQ ID NO: 89612 - DNA, 15 bp, Homo sapiens
ggctgagacatcagg

SEQ ID NO: 89613 - DNA, 15 bp, Homo sapiens
aggctgagacatcag

SEQ ID NO: 89614 - DNA, 15 bp, Homo sapiens
aaggctgagacatca

SEQ ID NO: 89615 - DNA, 15 bp, Homo sapiens
gaaggctgagacatc

SEQ ID NO: 89616 - DNA, 15 bp, Homo sapiens
agaaggctgagacat

SEQ ID NO: 89617 - DNA, 15 bp, Homo sapiens
cagaaggctgagaca

SEQ ID NO: 89618 - DNA, 15 bp, Homo sapiens
gcagaaggctgagac

SEQ ID NO: 89619 - DNA, 15 bp, Homo sapiens
ggcagaaggctgaga

SEQ ID NO: 89620 - DNA, 15 bp, Homo sapiens
gggcagaaggctgag

SEQ ID NO: 89621 - DNA, 15 bp, Homo sapiens
ggggcagaaggctga

SEQ ID NO: 89622 - DNA, 15 bp, Homo sapiens
tggggcagaaggctg

SEQ ID NO: 89623 - DNA, 15 bp, Homo sapiens
ctggggcagaaggct

SEQ ID NO: 89624 - DNA, 15 bp, Homo sapiens
tctggggcagaaggc

SEQ ID NO: 89625 - DNA, 15 bp, Homo sapiens
atctggggcagaagg

SEQ ID NO: 89626 - DNA, 15 bp, Homo sapiens
aatctggggcagaag

SEQ ID NO: 89627 - DNA, 15 bp, Homo sapiens
aaatctggggcagaa

SEQ ID NO: 89628 - DNA, 15 bp, Homo sapiens
aaaatctggggcaga

SEQ ID NO: 89629 - DNA, 15 bp, Homo sapiens
caaaatctggggcag

SEQ ID NO: 89630 - DNA, 15 bp, Homo sapiens
acaaaatctggggca

SEQ ID NO: 89631 - DNA, 15 bp, Homo sapiens
gacaaaatctggggc

SEQ ID NO: 89632 - DNA, 15 bp, Homo sapiens
ggacaaaatctgggg

SEQ ID NO: 89633 - DNA, 15 bp, Homo sapiens
tggacaaaatctggg

SEQ ID NO: 89634 - DNA, 15 bp, Homo sapiens
ctggacaaaatctgg

SEQ ID NO: 89635 - DNA, 15 bp, Homo sapiens
gctggacaaaatctg

SEQ ID NO: 89636 - DNA, 15 bp, Homo sapiens
cgctggacaaaatct

SEQ ID NO: 89637 - DNA, 15 bp, Homo sapiens
ccgctggacaaaatc

SEQ ID NO: 89638 - DNA, 15 bp, Homo sapiens
cccgctggacaaaat

SEQ ID NO: 89639 - DNA, 15 bp, Homo sapiens
ccccgctggacaaaa

SEQ ID NO: 89640 - DNA, 15 bp, Homo sapiens
gccccgctggacaaa

SEQ ID NO: 89641 - DNA, 15 bp, Homo sapiens
agccccgctggacaa

SEQ ID NO: 89642 - DNA, 15 bp, Homo sapiens
aagccccgctggaca

SEQ ID NO: 89643 - DNA, 15 bp, Homo sapiens
gaagccccgctggac

SEQ ID NO: 89644 - DNA, 15 bp, Homo sapiens
cgaagccccgctgga

SEQ ID NO: 89645 - DNA, 15 bp, Homo sapiens
tcgaagccccgctgg

SEQ ID NO: 89646 - DNA, 15 bp, Homo sapiens
atcgaagccccgctg

SEQ ID NO: 89647 - DNA, 15 bp, Homo sapiens
tatcgaagccccgct

SEQ ID NO: 89648 - DNA, 15 bp, Homo sapiens
ctatcgaagccccgc

SEQ ID NO: 89649 - DNA, 15 bp, Homo sapiens
gctatcgaagccccg

SEQ ID NO: 89650 - DNA, 15 bp, Homo sapiens
agctatcgaagcccc

SEQ ID NO: 89651 - DNA, 15 bp, Homo sapiens
aagctatcgaagccc

SEQ ID NO: 89652 - DNA, 15 bp, Homo sapiens
aaagctatcgaagcc

SEQ ID NO: 89653 - DNA, 15 bp, Homo sapiens
gaaagctatcgaagc

SEQ ID NO: 89654 - DNA, 15 bp, Homo sapiens
agaaagctatcgaag

SEQ ID NO: 89655 - DNA, 15 bp, Homo sapiens
cagaaagctatcgaa

SEQ ID NO: 89656 - DNA, 15 bp, Homo sapiens
ccagaaagctatcga

SEQ ID NO: 89657 - DNA, 15 bp, Homo sapiens
cccagaaagctatcg

SEQ ID NO: 89658 - DNA, 15 bp, Homo sapiens
gcccagaaagctatc

SEQ ID NO: 89659 - DNA, 15 bp, Homo sapiens
ggcccagaaagctat

SEQ ID NO: 89660 - DNA, 15 bp, Homo sapiens
cggcccagaaagcta

SEQ ID NO: 89661 - DNA, 15 bp, Homo sapiens
gcggcccagaaagct

SEQ ID NO: 89662 - DNA, 15 bp, Homo sapiens
agcggcccagaaagc

SEQ ID NO: 89663 - DNA, 15 bp, Homo sapiens
tagcggcccagaaag

SEQ ID NO: 89664 - DNA, 15 bp, Homo sapiens
gtagcggcccagaaa

SEQ ID NO: 89665 - DNA, 15 bp, Homo sapiens
ggtagcggcccagaa

SEQ ID NO: 89666 - DNA, 15 bp, Homo sapiens
tggtagcggcccaga

SEQ ID NO: 89667 - DNA, 15 bp, Homo sapiens
ttggtagcggcccag

SEQ ID NO: 89668 - DNA, 15 bp, Homo sapiens
cttggtagcggccca

SEQ ID NO: 89669 - DNA, 15 bp, Homo sapiens
gcttggtagcggccc

SEQ ID NO: 89670 - DNA, 15 bp, Homo sapiens
agcttggtagcggcc

SEQ ID NO: 89671 - DNA, 15 bp, Homo sapiens
cagcttggtagcggc

SEQ ID NO: 89672 - DNA, 15 bp, Homo sapiens
acagcttggtagcgg

SEQ ID NO: 89673 - DNA, 15 bp, Homo sapiens
tacagcttggtagcg

SEQ ID NO: 89674 - DNA, 15 bp, Homo sapiens
gtacagcttggtagc

SEQ ID NO: 89675 - DNA, 15 bp, Homo sapiens
tgtacagcttggtag

SEQ ID NO: 89676 - DNA, 15 bp, Homo sapiens
ttgtacagcttggta

SEQ ID NO: 89677 - DNA, 15 bp, Homo sapiens
cttgtacagcttggt

SEQ ID NO: 89678 - DNA, 15 bp, Homo sapiens
tcttgtacagcttgg

SEQ ID NO: 89679 - DNA, 15 bp, Homo sapiens
ctcttgtacagcttg

SEQ ID NO: 89680 - DNA, 15 bp, Homo sapiens
cctcttgtacagctt

SEQ ID NO: 89681 - DNA, 15 bp, Homo sapiens
gcctcttgtacagct

SEQ ID NO: 89682 - DNA, 15 bp, Homo sapiens
agcctcttgtacagc

SEQ ID NO: 89683 - DNA, 15 bp, Homo sapiens
cagcctcttgtacag

SEQ ID NO: 89684 - DNA, 15 bp, Homo sapiens
acagcctcttgtaca

SEQ ID NO: 89685 - DNA, 15 bp, Homo sapiens
tacagcctcttgtac

SEQ ID NO: 89686 - DNA, 15 bp, Homo sapiens
ctacagcctcttgta

SEQ ID NO: 89687 - DNA, 15 bp, Homo sapiens
tctacagcctcttgt

SEQ ID NO: 89688 - DNA, 15 bp, Homo sapiens
ctctacagcctcttg

SEQ ID NO: 89689 - DNA, 15 bp, Homo sapiens
cctctacagcctctt

SEQ ID NO: 89690 - DNA, 15 bp, Homo sapiens
tcctctacagcctct

SEQ ID NO: 89691 - DNA, 15 bp, Homo sapiens
atcctctacagcctc

SEQ ID NO: 89692 - DNA, 15 bp, Homo sapiens
gatcctctacagcct

SEQ ID NO: 89693 - DNA, 15 bp, Homo sapiens
cgatcctctacagcc

SEQ ID NO: 89694 - DNA, 15 bp, Homo sapiens
acgatcctctacagc

SEQ ID NO: 89695 - DNA, 15 bp, Homo sapiens
gacgatcctctacag

SEQ ID NO: 89696 - DNA, 15 bp, Homo sapiens
tgacgatcctctaca

SEQ ID NO: 89697 - DNA, 15 bp, Homo sapiens
ttgacgatcctctac

SEQ ID NO: 89698 - DNA, 15 bp, Homo sapiens
gttgacgatcctcta

SEQ ID NO: 89699 - DNA, 15 bp, Homo sapiens
tgttgacgatcctct

SEQ ID NO: 89700 - DNA, 15 bp, Homo sapiens
ttgttgacgatcctc

SEQ ID NO: 89701 - DNA, 15 bp, Homo sapiens
gttgttgacgatcct

SEQ ID NO: 89702 - DNA, 15 bp, Homo sapiens
tgttgttgacgatcc

SEQ ID NO: 89703 - DNA, 15 bp, Homo sapiens
atgttgttgacgatc

SEQ ID NO: 89704 - DNA, 15 bp, Homo sapiens
gatgttgttgacgat

SEQ ID NO: 89705 - DNA, 15 bp, Homo sapiens
agatgttgttgacga

SEQ ID NO: 89706 - DNA, 15 bp, Homo sapiens
tagatgttgttgacg

SEQ ID NO: 89707 - DNA, 15 bp, Homo sapiens
ctagatgttgttgac

SEQ ID NO: 89708 - DNA, 15 bp, Homo sapiens
tctagatgttgttga

SEQ ID NO: 89709 - DNA, 15 bp, Homo sapiens
ctctagatgttgttg

SEQ ID NO: 89710 - DNA, 15 bp, Homo sapiens
tctctagatgttgtt

SEQ ID NO: 89711 - DNA, 15 bp, Homo sapiens
ttctctagatgttgt

SEQ ID NO: 89712 - DNA, 15 bp, Homo sapiens
attctctagatgttg

SEQ ID NO: 89713 - DNA, 15 bp, Homo sapiens
cattctctagatgtt

SEQ ID NO: 89714 - DNA, 15 bp, Homo sapiens
ccattctctagatgt

SEQ ID NO: 89715 - DNA, 15 bp, Homo sapiens
accattctctagatg

SEQ ID NO: 89716 - DNA, 15 bp, Homo sapiens
taccattctctagat

SEQ ID NO: 89717 - DNA, 15 bp, Homo sapiens
ttaccattctctaga

SEQ ID NO: 89718 - DNA, 15 bp, Homo sapiens
tttaccattctctag

SEQ ID NO: 89719 - DNA, 15 bp, Homo sapiens
gtttaccattctcta

SEQ ID NO: 89720 - DNA, 15 bp, Homo sapiens
ggtttaccattctct

SEQ ID NO: 89721 - DNA, 15 bp, Homo sapiens
gggtttaccattctc

SEQ ID NO: 89722 - DNA, 15 bp, Homo sapiens
tgggtttaccattct

SEQ ID NO: 89723 - DNA, 15 bp, Homo sapiens
ttgggtttaccattc

SEQ ID NO: 89724 - DNA, 15 bp, Homo sapiens
gttgggtttaccatt

SEQ ID NO: 89725 - DNA, 15 bp, Homo sapiens
tgttgggtttaccat

SEQ ID NO: 89726 - DNA, 15 bp, Homo sapiens
ttgttgggtttacca

SEQ ID NO: 89727 - DNA, 15 bp, Homo sapiens
attgttgggtttacc

SEQ ID NO: 89728 - DNA, 15 bp, Homo sapiens
aattgttgggtttac

SEQ ID NO: 89729 - DNA, 15 bp, Homo sapiens
aaattgttgggttta

SEQ ID NO: 89730 - DNA, 15 bp, Homo sapiens
aaaattgttgggttt

SEQ ID NO: 89731 - DNA, 15 bp, Homo sapiens
taaaattgttgggtt

SEQ ID NO: 89732 - DNA, 15 bp, Homo sapiens
ttaaaattgttgggt

SEQ ID NO: 89733 - DNA, 15 bp, Homo sapiens
tttaaaattgttggg

SEQ ID NO: 89734 - DNA, 15 bp, Homo sapiens
ttttaaaattgttgg

SEQ ID NO: 89735 - DNA, 15 bp, Homo sapiens
attttaaaattgttg

SEQ ID NO: 89736 - DNA, 15 bp, Homo sapiens
gattttaaaattgtt

SEQ ID NO: 89737 - DNA, 15 bp, Homo sapiens
agattttaaaattgt

SEQ ID NO: 89738 - DNA, 15 bp, Homo sapiens
gagattttaaaattg

SEQ ID NO: 89739 - DNA, 15 bp, Homo sapiens
ggagattttaaaatt

SEQ ID NO: 89740 - DNA, 15 bp, Homo sapiens
aggagattttaaaat

SEQ ID NO: 89741 - DNA, 15 bp, Homo sapiens
caggagattttaaaa

SEQ ID NO: 89742 - DNA, 15 bp, Homo sapiens
acaggagattttaaa

SEQ ID NO: 89743 - DNA, 15 bp, Homo sapiens
gacaggagattttaa

SEQ ID NO: 89744 - DNA, 15 bp, Homo sapiens
agacaggagatttta

SEQ ID NO: 89745 - DNA, 15 bp, Homo sapiens
gagacaggagatttt

SEQ ID NO: 89746 - DNA, 15 bp, Homo sapiens
tgagacaggagattt

SEQ ID NO: 89747 - DNA, 15 bp, Homo sapiens
ctgagacaggagatt

SEQ ID NO: 89748 - DNA, 15 bp, Homo sapiens
actgagacaggagat

SEQ ID NO: 89749 - DNA, 15 bp, Homo sapiens
aactgagacaggaga

SEQ ID NO: 89750 - DNA, 15 bp, Homo sapiens
aaactgagacaggag

SEQ ID NO: 89751 - DNA, 15 bp, Homo sapiens
caaactgagacagga

SEQ ID NO: 89752 - DNA, 15 bp, Homo sapiens
gcaaactgagacagg

SEQ ID NO: 89753 - DNA, 15 bp, Homo sapiens
ggcaaactgagacag

SEQ ID NO: 89754 - DNA, 15 bp, Homo sapiens
aggcaaactgagaca

SEQ ID NO: 89755 - DNA, 15 bp, Homo sapiens
aaggcaaactgagac

SEQ ID NO: 89756 - DNA, 15 bp, Homo sapiens
taaggcaaactgaga

SEQ ID NO: 89757 - DNA, 15 bp, Homo sapiens
ttaaggcaaactgag

SEQ ID NO: 89758 - DNA, 15 bp, Homo sapiens
attaaggcaaactga

SEQ ID NO: 89759 - DNA, 15 bp, Homo sapiens
cattaaggcaaactg

SEQ ID NO: 89760 - DNA, 15 bp, Homo sapiens
acattaaggcaaact

SEQ ID NO: 89761 - DNA, 15 bp, Homo sapiens
tacattaaggcaaac

SEQ ID NO: 89762 - DNA, 15 bp, Homo sapiens
ttacattaaggcaaa

SEQ ID NO: 89763 - DNA, 15 bp, Homo sapiens
tttacattaaggcaa

SEQ ID NO: 89764 - DNA, 15 bp, Homo sapiens
gtttacattaaggca

SEQ ID NO: 89765 - DNA, 15 bp, Homo sapiens
tgtttacattaaggc

SEQ ID NO: 89766 - DNA, 15 bp, Homo sapiens
atgtttacattaagg

SEQ ID NO: 89767 - DNA, 15 bp, Homo sapiens
catgtttacattaag

SEQ ID NO: 89768 - DNA, 15 bp, Homo sapiens
tcatgtttacattaa

SEQ ID NO: 89769 - DNA, 15 bp, Homo sapiens
gtcatgtttacatta

SEQ ID NO: 89770 - DNA, 15 bp, Homo sapiens
agtcatgtttacatt

SEQ ID NO: 89771 - DNA, 15 bp, Homo sapiens
gagtcatgtttacat

SEQ ID NO: 89772 - DNA, 15 bp, Homo sapiens
ggagtcatgtttaca

SEQ ID NO: 89773 - DNA, 15 bp, Homo sapiens
gggagtcatgtttac

SEQ ID NO: 89774 - DNA, 15 bp, Homo sapiens
tgggagtcatgttta

SEQ ID NO: 89775 - DNA, 15 bp, Homo sapiens
ttgggagtcatgttt

SEQ ID NO: 89776 - DNA, 15 bp, Homo sapiens
gttgggagtcatgtt

SEQ ID NO: 89777 - DNA, 15 bp, Homo sapiens
tgttgggagtcatgt

SEQ ID NO: 89778 - DNA, 15 bp, Homo sapiens
atgttgggagtcatg

SEQ ID NO: 89779 - DNA, 15 bp, Homo sapiens
aatgttgggagtcat

SEQ ID NO: 89780 - DNA, 15 bp, Homo sapiens
aaatgttgggagtca

SEQ ID NO: 89781 - DNA, 15 bp, Homo sapiens
taaatgttgggagtc

SEQ ID NO: 89782 - DNA, 15 bp, Homo sapiens
ctaaatgttgggagt

SEQ ID NO: 89783 - DNA, 15 bp, Homo sapiens
tctaaatgttgggag

SEQ ID NO: 89784 - DNA, 15 bp, Homo sapiens
ttctaaatgttggga

SEQ ID NO: 89785 - DNA, 15 bp, Homo sapiens
gttctaaatgttggg

SEQ ID NO: 89786 - DNA, 15 bp, Homo sapiens
agttctaaatgttgg

SEQ ID NO: 89787 - DNA, 15 bp, Homo sapiens
aagttctaaatgttg

SEQ ID NO: 89788 - DNA, 15 bp, Homo sapiens
caagttctaaatgtt

SEQ ID NO: 89789 - DNA, 15 bp, Homo sapiens
tcaagttctaaatgt

SEQ ID NO: 89790 - DNA, 15 bp, Homo sapiens
ctcaagttctaaatg

SEQ ID NO: 89791 - DNA, 15 bp, Homo sapiens
actcaagttctaaat

SEQ ID NO: 89792 - DNA, 15 bp, Homo sapiens
tactcaagttctaaa

SEQ ID NO: 89793 - DNA, 15 bp, Homo sapiens
gtactcaagttctaa

SEQ ID NO: 89794 - DNA, 15 bp, Homo sapiens
tgtactcaagttcta

SEQ ID NO: 89795 - DNA, 15 bp, Homo sapiens
gtgtactcaagttct

SEQ ID NO: 89796 - DNA, 15 bp, Homo sapiens
agtgtactcaagttc

SEQ ID NO: 89797 - DNA, 15 bp, Homo sapiens
aagtgtactcaagtt

SEQ ID NO: 89798 - DNA, 15 bp, Homo sapiens
caagtgtactcaagt

SEQ ID NO: 89799 - DNA, 15 bp, Homo sapiens
gcaagtgtactcaag

SEQ ID NO: 89800 - DNA, 15 bp, Homo sapiens
agcaagtgtactcaa

SEQ ID NO: 89801 - DNA, 15 bp, Homo sapiens
aagcaagtgtactca

SEQ ID NO: 89802 - DNA, 15 bp, Homo sapiens
caagcaagtgtactc

SEQ ID NO: 89803 - DNA, 15 bp, Homo sapiens
gcaagcaagtgtact

SEQ ID NO: 89804 - DNA, 15 bp, Homo sapiens
agcaagcaagtgtac

SEQ ID NO: 89805 - DNA, 15 bp, Homo sapiens
aagcaagcaagtgta

SEQ ID NO: 89806 - DNA, 15 bp, Homo sapiens
aaagcaagcaagtgt

SEQ ID NO: 89807 - DNA, 15 bp, Homo sapiens
caaagcaagcaagtg

SEQ ID NO: 89808 - DNA, 15 bp, Homo sapiens
gcaaagcaagcaagt

SEQ ID NO: 89809 - DNA, 15 bp, Homo sapiens
tgcaaagcaagcaag

SEQ ID NO: 89810 - DNA, 15 bp, Homo sapiens
gtgcaaagcaagcaa

SEQ ID NO: 89811 - DNA, 15 bp, Homo sapiens
ggtgcaaagcaagca

SEQ ID NO: 89812 - DNA, 15 bp, Homo sapiens
tggtgcaaagcaagc

SEQ ID NO: 89813 - DNA, 15 bp, Homo sapiens
ttggtgcaaagcaag

SEQ ID NO: 89814 - DNA, 15 bp, Homo sapiens
gttggtgcaaagcaa

SEQ ID NO: 89815 - DNA, 15 bp, Homo sapiens
ggttggtgcaaagca

SEQ ID NO: 89816 - DNA, 15 bp, Homo sapiens
aggttggtgcaaagc

SEQ ID NO: 89817 - DNA, 15 bp, Homo sapiens
aaggttggtgcaaag

SEQ ID NO: 89818 - DNA, 15 bp, Homo sapiens
gaaggttggtgcaaa

SEQ ID NO: 89819 - DNA, 15 bp, Homo sapiens
agaaggttggtgcaa

SEQ ID NO: 89820 - DNA, 15 bp, Homo sapiens
gagaaggttggtgca

SEQ ID NO: 89821 - DNA, 15 bp, Homo sapiens
ggagaaggttggtgc

SEQ ID NO: 89822 - DNA, 15 bp, Homo sapiens
tggagaaggttggtg

SEQ ID NO: 89823 - DNA, 15 bp, Homo sapiens
atggagaaggttggt

SEQ ID NO: 89824 - DNA, 15 bp, Homo sapiens
aatggagaaggttgg

SEQ ID NO: 89825 - DNA, 15 bp, Homo sapiens
aaatggagaaggttg

SEQ ID NO: 89826 - DNA, 15 bp, Homo sapiens
aaaatggagaaggtt

SEQ ID NO: 89827 - DNA, 15 bp, Homo sapiens
gaaaatggagaaggt

SEQ ID NO: 89828 - DNA, 15 bp, Homo sapiens
ggaaaatggagaagg

SEQ ID NO: 89829 - DNA, 15 bp, Homo sapiens
aggaaaatggagaag

SEQ ID NO: 89830 - DNA, 15 bp, Homo sapiens
aaggaaaatggagaa

SEQ ID NO: 89831 - DNA, 15 bp, Homo sapiens
aaaggaaaatggaga

SEQ ID NO: 89832 - DNA, 15 bp, Homo sapiens
caaaggaaaatggag

SEQ ID NO: 89833 - DNA, 15 bp, Homo sapiens
acaaaggaaaatgga

SEQ ID NO: 89834 - DNA, 15 bp, Homo sapiens
cacaaaggaaaatgg

SEQ ID NO: 89835 - DNA, 15 bp, Homo sapiens
gcacaaaggaaaatg

SEQ ID NO: 89836 - DNA, 15 bp, Homo sapiens
ggcacaaaggaaaat

SEQ ID NO: 89837 - DNA, 15 bp, Homo sapiens
aggcacaaaggaaaa

SEQ ID NO: 89838 - DNA, 15 bp, Homo sapiens
caggcacaaaggaaa

SEQ ID NO: 89839 - DNA, 15 bp, Homo sapiens
acaggcacaaaggaa

SEQ ID NO: 89840 - DNA, 15 bp, Homo sapiens
tacaggcacaaagga

SEQ ID NO: 89841 - DNA, 15 bp, Homo sapiens
atacaggcacaaagg

SEQ ID NO: 89842 - DNA, 15 bp, Homo sapiens
aatacaggcacaaag

SEQ ID NO: 89843 - DNA, 15 bp, Homo sapiens
caatacaggcacaaa

SEQ ID NO: 89844 - DNA, 15 bp, Homo sapiens
acaatacaggcacaa

SEQ ID NO: 89845 - DNA, 15 bp, Homo sapiens
aacaatacaggcaca

SEQ ID NO: 89846 - DNA, 15 bp, Homo sapiens
gaacaatacaggcac

SEQ ID NO: 89847 - DNA, 15 bp, Homo sapiens
tgaacaatacaggca

SEQ ID NO: 89848 - DNA, 15 bp, Homo sapiens
ttgaacaatacaggc

SEQ ID NO: 89849 - DNA, 15 bp, Homo sapiens
tttgaacaatacagg

SEQ ID NO: 89850 - DNA, 15 bp, Homo sapiens
ctttgaacaatacag

SEQ ID NO: 89851 - DNA, 15 bp, Homo sapiens
actttgaacaataca

SEQ ID NO: 89852 - DNA, 15 bp, Homo sapiens
gactttgaacaatac

SEQ ID NO: 89853 - DNA, 15 bp, Homo sapiens
agactttgaacaata

SEQ ID NO: 89854 - DNA, 15 bp, Homo sapiens
aagactttgaacaat

SEQ ID NO: 89855 - DNA, 15 bp, Homo sapiens
taagactttgaacaa

SEQ ID NO: 89856 - DNA, 15 bp, Homo sapiens
ttaagactttgaaca

SEQ ID NO: 89857 - DNA, 15 bp, Homo sapiens
tttaagactttgaac

SEQ ID NO: 89858 - DNA, 15 bp, Homo sapiens
ctttaagactttgaa

SEQ ID NO: 89859 - DNA, 15 bp, Homo sapiens
actttaagactttga

SEQ ID NO: 89860 - DNA, 15 bp, Homo sapiens
gactttaagactttg

SEQ ID NO: 89861 - DNA, 15 bp, Homo sapiens
agactttaagacttt

SEQ ID NO: 89862 - DNA, 15 bp, Homo sapiens
aagactttaagactt

SEQ ID NO: 89863 - DNA, 15 bp, Homo sapiens
gaagactttaagact

SEQ ID NO: 89864 - DNA, 15 bp, Homo sapiens
agaagactttaagac

SEQ ID NO: 89865 - DNA, 15 bp, Homo sapiens
cagaagactttaaga

SEQ ID NO: 89866 - DNA, 15 bp, Homo sapiens
acagaagactttaag

SEQ ID NO: 89867 - DNA, 15 bp, Homo sapiens
tacagaagactttaa

SEQ ID NO: 89868 - DNA, 15 bp, Homo sapiens
atacagaagacttta

SEQ ID NO: 89869 - DNA, 15 bp, Homo sapiens
aatacagaagacttt

SEQ ID NO: 89870 - DNA, 15 bp, Homo sapiens
gaatacagaagactt

SEQ ID NO: 89871 - DNA, 15 bp, Homo sapiens
tgaatacagaagact

SEQ ID NO: 89872 - DNA, 15 bp, Homo sapiens
ctgaatacagaagac

SEQ ID NO: 89873 - DNA, 15 bp, Homo sapiens
tctgaatacagaaga

SEQ ID NO: 89874 - DNA, 15 bp, Homo sapiens
atctgaatacagaag

SEQ ID NO: 89875 - DNA, 15 bp, Homo sapiens
aatctgaatacagaa

SEQ ID NO: 89876 - DNA, 15 bp, Homo sapiens
gaatctgaatacaga

SEQ ID NO: 89877 - DNA, 15 bp, Homo sapiens
agaatctgaatacag

SEQ ID NO: 89878 - DNA, 15 bp, Homo sapiens
aagaatctgaataca

SEQ ID NO: 89879 - DNA, 15 bp, Homo sapiens
aaagaatctgaatac

SEQ ID NO: 89880 - DNA, 15 bp, Homo sapiens
aaaagaatctgaata

SEQ ID NO: 89881 - DNA, 15 bp, Homo sapiens
gaaaagaatctgaat

SEQ ID NO: 89882 - DNA, 15 bp, Homo sapiens
ggaaaagaatctgaa

SEQ ID NO: 89883 - DNA, 15 bp, Homo sapiens
tggaaaagaatctga

SEQ ID NO: 89884 - DNA, 15 bp, Homo sapiens
ctggaaaagaatctg

SEQ ID NO: 89885 - DNA, 15 bp, Homo sapiens
tctggaaaagaatct

SEQ ID NO: 89886 - DNA, 15 bp, Homo sapiens
atctggaaaagaatc

SEQ ID NO: 89887 - DNA, 15 bp, Homo sapiens
aatctggaaaagaat

SEQ ID NO: 89888 - DNA, 15 bp, Homo sapiens
gaatctggaaaagaa

SEQ ID NO: 89889 - DNA, 15 bp, Homo sapiens
tgaatctggaaaaga

SEQ ID NO: 89890 - DNA, 15 bp, Homo sapiens
gtgaatctggaaaag

SEQ ID NO: 89891 - DNA, 15 bp, Homo sapiens
tgtgaatctggaaaa

SEQ ID NO: 89892 - DNA, 15 bp, Homo sapiens
gtgtgaatctggaaa

SEQ ID NO: 89893 - DNA, 15 bp, Homo sapiens
ggtgtgaatctggaa

SEQ ID NO: 89894 - DNA, 15 bp, Homo sapiens
aggtgtgaatctgga

SEQ ID NO: 89895 - DNA, 15 bp, Homo sapiens
aaggtgtgaatctgg

SEQ ID NO: 89896 - DNA, 15 bp, Homo sapiens
aaaggtgtgaatctg

SEQ ID NO: 89897 - DNA, 15 bp, Homo sapiens
aaaaggtgtgaatct

SEQ ID NO: 89898 - DNA, 15 bp, Homo sapiens
aaaaaggtgtgaatc

SEQ ID NO: 89899 - DNA, 15 bp, Homo sapiens
caaaaaggtgtgaat

SEQ ID NO: 89900 - DNA, 15 bp, Homo sapiens
acaaaaaggtgtgaa

SEQ ID NO: 89901 - DNA, 15 bp, Homo sapiens
tacaaaaaggtgtga

SEQ ID NO: 89902 - DNA, 15 bp, Homo sapiens
ttacaaaaaggtgtg

SEQ ID NO: 89903 - DNA, 15 bp, Homo sapiens
tttacaaaaaggtgt

SEQ ID NO: 89904 - DNA, 15 bp, Homo sapiens
gtttacaaaaaggtg

SEQ ID NO: 89905 - DNA, 15 bp, Homo sapiens
tgtttacaaaaaggt

SEQ ID NO: 89906 - DNA, 15 bp, Homo sapiens
atgtttacaaaaagg

SEQ ID NO: 89907 - DNA, 15 bp, Homo sapiens
tatgtttacaaaaag

SEQ ID NO: 89908 - DNA, 15 bp, Homo sapiens
gtatgtttacaaaaa

SEQ ID NO: 89909 - DNA, 15 bp, Homo sapiens
tgtatgtttacaaaa

SEQ ID NO: 89910 - DNA, 15 bp, Homo sapiens
ttgtatgtttacaaa

SEQ ID NO: 89911 - DNA, 15 bp, Homo sapiens
cttgtatgtttacaa

SEQ ID NO: 89912 - DNA, 15 bp, Homo sapiens
gcttgtatgtttaca

SEQ ID NO: 89913 - DNA, 15 bp, Homo sapiens
tgcttgtatgtttac

SEQ ID NO: 89914 - DNA, 15 bp, Homo sapiens
ttgcttgtatgttta

SEQ ID NO: 89915 - DNA, 15 bp, Homo sapiens
cttgcttgtatgttt

SEQ ID NO: 89916 - DNA, 15 bp, Homo sapiens
acttgcttgtatgtt

SEQ ID NO: 89917 - DNA, 15 bp, Homo sapiens
aacttgcttgtatgt

SEQ ID NO: 89918 - DNA, 15 bp, Homo sapiens
aaacttgcttgtatg

SEQ ID NO: 89919 - DNA, 15 bp, Homo sapiens
gaaacttgcttgtat

SEQ ID NO: 89920 - DNA, 15 bp, Homo sapiens
tgaaacttgcttgta

SEQ ID NO: 89921 - DNA, 15 bp, Homo sapiens
gtgaaacttgcttgt

SEQ ID NO: 89922 - DNA, 15 bp, Homo sapiens
tgtgaaacttgcttg

SEQ ID NO: 89923 - DNA, 15 bp, Homo sapiens
atgtgaaacttgctt

SEQ ID NO: 89924 - DNA, 15 bp, Homo sapiens
aatgtgaaacttgct

SEQ ID NO: 89925 - DNA, 15 bp, Homo sapiens
gaatgtgaaacttgc

SEQ ID NO: 89926 - DNA, 15 bp, Homo sapiens
agaatgtgaaacttg

SEQ ID NO: 89927 - DNA, 15 bp, Homo sapiens
gagaatgtgaaactt

SEQ ID NO: 89928 - DNA, 15 bp, Homo sapiens
agagaatgtgaaact

SEQ ID NO: 89929 - DNA, 15 bp, Homo sapiens
tagagaatgtgaaac

SEQ ID NO: 89930 - DNA, 15 bp, Homo sapiens
ttagagaatgtgaaa

SEQ ID NO: 89931 - DNA, 15 bp, Homo sapiens
tttagagaatgtgaa

SEQ ID NO: 89932 - DNA, 15 bp, Homo sapiens
ttttagagaatgtga

SEQ ID NO: 89933 - DNA, 15 bp, Homo sapiens
attttagagaatgtg

SEQ ID NO: 89934 - DNA, 15 bp, Homo sapiens
aattttagagaatgt

SEQ ID NO: 89935 - DNA, 15 bp, Homo sapiens
caattttagagaatg

SEQ ID NO: 89936 - DNA, 15 bp, Homo sapiens
acaattttagagaat

SEQ ID NO: 89937 - DNA, 15 bp, Homo sapiens
cacaattttagagaa

SEQ ID NO: 89938 - DNA, 15 bp, Homo sapiens
acacaattttagaga

SEQ ID NO: 89939 - DNA, 15 bp, Homo sapiens
gacacaattttagag

SEQ ID NO: 89940 - DNA, 15 bp, Homo sapiens
tgacacaattttaga

SEQ ID NO: 89941 - DNA, 15 bp, Homo sapiens
ctgacacaattttag

SEQ ID NO: 89942 - DNA, 15 bp, Homo sapiens
actgacacaatttta

SEQ ID NO: 89943 - DNA, 15 bp, Homo sapiens
tactgacacaatttt

SEQ ID NO: 89944 - DNA, 15 bp, Homo sapiens
ctactgacacaattt

SEQ ID NO: 89945 - DNA, 15 bp, Homo sapiens
cctactgacacaatt

SEQ ID NO: 89946 - DNA, 15 bp, Homo sapiens
tcctactgacacaat

SEQ ID NO: 89947 - DNA, 15 bp, Homo sapiens
atcctactgacacaa

SEQ ID NO: 89948 - DNA, 15 bp, Homo sapiens
tatcctactgacaca

SEQ ID NO: 89949 - DNA, 15 bp, Homo sapiens
atatcctactgacac

SEQ ID NO: 89950 - DNA, 15 bp, Homo sapiens
tatatcctactgaca

SEQ ID NO: 89951 - DNA, 15 bp, Homo sapiens
ttatatcctactgac

SEQ ID NO: 89952 - DNA, 15 bp, Homo sapiens
attatatcctactga

SEQ ID NO: 89953 - DNA, 15 bp, Homo sapiens
tattatatcctactg

SEQ ID NO: 89954 - DNA, 15 bp, Homo sapiens
ttattatatcctact

SEQ ID NO: 89955 - DNA, 15 bp, Homo sapiens
attattatatcctac

SEQ ID NO: 89956 - DNA, 15 bp, Homo sapiens
tattattatatccta

SEQ ID NO: 89957 - DNA, 15 bp, Homo sapiens
ttattattatatcct

SEQ ID NO: 89958 - DNA, 15 bp, Homo sapiens
attattattatatcc

SEQ ID NO: 89959 - DNA, 15 bp, Homo sapiens
aattattattatatc

SEQ ID NO: 89960 - DNA, 15 bp, Homo sapiens
aaattattattatat

SEQ ID NO: 89961 - DNA, 15 bp, Homo sapiens
aaaattattattata

SEQ ID NO: 89962 - DNA, 15 bp, Homo sapiens
aaaaattattattat

SEQ ID NO: 89963 - DNA, 15 bp, Homo sapiens
aaaaaattattatta

SEQ ID NO: 89964 - DNA, 15 bp, Homo sapiens
aaaaaaattattatt

SEQ ID NO: 89965 - DNA, 15 bp, Homo sapiens
aaaaaaaattattat

SEQ ID NO: 89966 - DNA, 15 bp, Homo sapiens
aaaaaaaaattatta

SEQ ID NO: 89967 - DNA, 15 bp, Homo sapiens
aaaaaaaaaattatt

SEQ ID NO: 89968 - DNA, 15 bp, Homo sapiens
caaaaaaaaaaatta

SEQ ID NO: 89969 - DNA, 15 bp, Homo sapiens
acaaaaaaaaaaatt

SEQ ID NO: 89970 - DNA, 15 bp, Homo sapiens
tacaaaaaaaaaaat

SEQ ID NO: 89971 - DNA, 15 bp, Homo sapiens
gctacaaaaaaaaaa

SEQ ID NO: 89972 - DNA, 15 bp, Homo sapiens
agctacaaaaaaaaa

SEQ ID NO: 89973 - DNA, 15 bp, Homo sapiens
tagctacaaaaaaaa

SEQ ID NO: 89974 - DNA, 15 bp, Homo sapiens
gtagctacaaaaaaa

SEQ ID NO: 89975 - DNA, 15 bp, Homo sapiens
tgtagctacaaaaaa

SEQ ID NO: 89976 - DNA, 15 bp, Homo sapiens
ctgtagctacaaaaa

SEQ ID NO: 89977 - DNA, 15 bp, Homo sapiens
cctgtagctacaaaa

SEQ ID NO: 89978 - DNA, 15 bp, Homo sapiens
tcctgtagctacaaa

SEQ ID NO: 89979 - DNA, 15 bp, Homo sapiens
atcctgtagctacaa

SEQ ID NO: 89980 - DNA, 15 bp, Homo sapiens
gatcctgtagctaca

SEQ ID NO: 89981 - DNA, 15 bp, Homo sapiens
agatcctgtagctac

SEQ ID NO: 89982 - DNA, 15 bp, Homo sapiens
gagatcctgtagcta

SEQ ID NO: 89983 - DNA, 15 bp, Homo sapiens
tgagatcctgtagct

SEQ ID NO: 89984 - DNA, 15 bp, Homo sapiens
gtgagatcctgtagc

SEQ ID NO: 89985 - DNA, 15 bp, Homo sapiens
agtgagatcctgtag

SEQ ID NO: 89986 - DNA, 15 bp, Homo sapiens
gagtgagatcctgta

SEQ ID NO: 89987 - DNA, 15 bp, Homo sapiens
agagtgagatcctgt

SEQ ID NO: 89988 - DNA, 15 bp, Homo sapiens
cagagtgagatcctg

SEQ ID NO: 89989 - DNA, 15 bp, Homo sapiens
acagagtgagatcct

SEQ ID NO: 89990 - DNA, 15 bp, Homo sapiens
gacagagtgagatcc

SEQ ID NO: 89991 - DNA, 15 bp, Homo sapiens
tgacagagtgagatc

SEQ ID NO: 89992 - DNA, 15 bp, Homo sapiens
gtgacagagtgagat

SEQ ID NO: 89993 - DNA, 15 bp, Homo sapiens
gctctccagcctggg

SEQ ID NO: 89994 - DNA, 15 bp, Homo sapiens
tgctctccagcctgg

SEQ ID NO: 89995 - DNA, 15 bp, Homo sapiens
ctgctctccagcctg

SEQ ID NO: 89996 - DNA, 15 bp, Homo sapiens
actgctctccagcct

SEQ ID NO: 89997 - DNA, 15 bp, Homo sapiens
cactgctctccagcc

SEQ ID NO: 89998 - DNA, 15 bp, Homo sapiens
ccactgctctccagc

SEQ ID NO: 89999 - DNA, 15 bp, Homo sapiens
accactgctctccag

SEQ ID NO: 90000 - DNA, 15 bp, Homo sapiens
caccactgctctcca

SEQ ID NO: 90001 - DNA, 15 bp, Homo sapiens
gcaccactgctctcc

SEQ ID NO: 90002 - DNA, 15 bp, Homo sapiens
tgcaccactgctctc

SEQ ID NO: 90003 - DNA, 15 bp, Homo sapiens
ttgcaccactgctct

SEQ ID NO: 90004 - DNA, 15 bp, Homo sapiens
attgcaccactgctc

SEQ ID NO: 90005 - DNA, 15 bp, Homo sapiens
gattgcaccactgct

SEQ ID NO: 90006 - DNA, 15 bp, Homo sapiens
tgattgcaccactgc

SEQ ID NO: 90007 - DNA, 15 bp, Homo sapiens
atgattgcaccactg

SEQ ID NO: 90008 - DNA, 15 bp, Homo sapiens
tatgattgcaccact

SEQ ID NO: 90009 - DNA, 15 bp, Homo sapiens
ctatgattgcaccac

SEQ ID NO: 90010 - DNA, 15 bp, Homo sapiens
gctatgattgcacca

SEQ ID NO: 90011 - DNA, 15 bp, Homo sapiens
agctatgattgcacc

SEQ ID NO: 90012 - DNA, 15 bp, Homo sapiens
cagctatgattgcac

SEQ ID NO: 90013 - DNA, 15 bp, Homo sapiens
gcagctatgattgca

SEQ ID NO: 90014 - DNA, 15 bp, Homo sapiens
tgcagctatgattgc

SEQ ID NO: 90015 - DNA, 15 bp, Homo sapiens
ctgcagctatgattg

SEQ ID NO: 90016 - DNA, 15 bp, Homo sapiens
actgcagctatgatt

SEQ ID NO: 90017 - DNA, 15 bp, Homo sapiens
gactgcagctatgat

SEQ ID NO: 90018 - DNA, 15 bp, Homo sapiens
agactgcagctatga

SEQ ID NO: 90019 - DNA, 15 bp, Homo sapiens
aagactgcagctatg

SEQ ID NO: 90020 - DNA, 15 bp, Homo sapiens
caagactgcagctat

SEQ ID NO: 90021 - DNA, 15 bp, Homo sapiens
tcaagactgcagcta

SEQ ID NO: 90022 - DNA, 15 bp, Homo sapiens
gtcaagactgcagct

SEQ ID NO: 90023 - DNA, 15 bp, Homo sapiens
ggtcaagactgcagc

SEQ ID NO: 90024 - DNA, 15 bp, Homo sapiens
aggtcaagactgcag

SEQ ID NO: 90025 - DNA, 15 bp, Homo sapiens
gaggtcaagactgca

SEQ ID NO: 90026 - DNA, 15 bp, Homo sapiens
ggaggtcaagactgc

SEQ ID NO: 90027 - DNA, 15 bp, Homo sapiens
aggaggtcaagactg

SEQ ID NO: 90028 - DNA, 15 bp, Homo sapiens
caggaggtcaagact

SEQ ID NO: 90029 - DNA, 15 bp, Homo sapiens
cccaggaggtcaaga

SEQ ID NO: 90030 - DNA, 15 bp, Homo sapiens
acccaggaggtcaag

SEQ ID NO: 90031 - DNA, 15 bp, Homo sapiens
aacccaggaggtcaa

SEQ ID NO: 90032 - DNA, 15 bp, Homo sapiens
aaacccaggaggtca

SEQ ID NO: 90033 - DNA, 15 bp, Homo sapiens
gaaacccaggaggtc

SEQ ID NO: 90034 - DNA, 15 bp, Homo sapiens
tgaaacccaggaggt

SEQ ID NO: 90035 - DNA, 15 bp, Homo sapiens
ctgaaacccaggagg

SEQ ID NO: 90036 - DNA, 15 bp, Homo sapiens
actgaaacccaggag

SEQ ID NO: 90037 - DNA, 15 bp, Homo sapiens
cactgaaacccagga

SEQ ID NO: 90038 - DNA, 15 bp, Homo sapiens
ccactgaaacccagg

SEQ ID NO: 90039 - DNA, 15 bp, Homo sapiens
accactgaaacccag

SEQ ID NO: 90040 - DNA, 15 bp, Homo sapiens
gaccactgaaaccca

SEQ ID NO: 90041 - DNA, 15 bp, Homo sapiens
ggaccactgaaaccc

SEQ ID NO: 90042 - DNA, 15 bp, Homo sapiens
aggaccactgaaacc

SEQ ID NO: 90043 - DNA, 15 bp, Homo sapiens
aaggaccactgaaac

SEQ ID NO: 90044 - DNA, 15 bp, Homo sapiens
gaaggaccactgaaa

SEQ ID NO: 90045 - DNA, 15 bp, Homo sapiens
agaaggaccactgaa

SEQ ID NO: 90046 - DNA, 15 bp, Homo sapiens
cagaaggaccactga

SEQ ID NO: 90047 - DNA, 15 bp, Homo sapiens
gcagaaggaccactg

SEQ ID NO: 90048 - DNA, 15 bp, Homo sapiens
ggcagaaggaccact

SEQ ID NO: 90049 - DNA, 15 bp, Homo sapiens
aggcagaaggaccac

SEQ ID NO: 90050 - DNA, 15 bp, Homo sapiens
gaggcagaaggacca

SEQ ID NO: 90051 - DNA, 15 bp, Homo sapiens
tgaggcagaaggacc

SEQ ID NO: 90052 - DNA, 15 bp, Homo sapiens
ctgaggcagaaggac

SEQ ID NO: 90053 - DNA, 15 bp, Homo sapiens
gctgaggcagaagga

SEQ ID NO: 90054 - DNA, 15 bp, Homo sapiens
ggctgaggcagaagg

SEQ ID NO: 90055 - DNA, 15 bp, Homo sapiens
taggctgaggcagaa

SEQ ID NO: 90056 - DNA, 15 bp, Homo sapiens
gtaggctgaggcaga

SEQ ID NO: 90057 - DNA, 15 bp, Homo sapiens
agtaggctgaggcag

SEQ ID NO: 90058 - DNA, 15 bp, Homo sapiens
cagtaggctgaggca

SEQ ID NO: 90059 - DNA, 15 bp, Homo sapiens
tcagtaggctgaggc

SEQ ID NO: 90060 - DNA, 15 bp, Homo sapiens
ctcagtaggctgagg

SEQ ID NO: 90061 - DNA, 15 bp, Homo sapiens
actcagtaggctgag

SEQ ID NO: 90062 - DNA, 15 bp, Homo sapiens
tactcagtaggctga

SEQ ID NO: 90063 - DNA, 15 bp, Homo sapiens
ctactcagtaggctg

SEQ ID NO: 90064 - DNA, 15 bp, Homo sapiens
gctactcagtaggct

SEQ ID NO: 90065 - DNA, 15 bp, Homo sapiens
agctactcagtaggc

SEQ ID NO: 90066 - DNA, 15 bp, Homo sapiens
cagctactcagtagg

SEQ ID NO: 90067 - DNA, 15 bp, Homo sapiens
ccagctactcagtag

SEQ ID NO: 90068 - DNA, 15 bp, Homo sapiens
cccagctactcagta

SEQ ID NO: 90069 - DNA, 15 bp, Homo sapiens
tcccagctactcagt

SEQ ID NO: 90070 - DNA, 15 bp, Homo sapiens
gcatgcctgtagtcc

SEQ ID NO: 90071 - DNA, 15 bp, Homo sapiens
tgcatgcctgtagtc

SEQ ID NO: 90072 - DNA, 15 bp, Homo sapiens
gtgcatgcctgtagt

SEQ ID NO: 90073 - DNA, 15 bp, Homo sapiens
ggtgcatgcctgtag

SEQ ID NO: 90074 - DNA, 15 bp, Homo sapiens
cagccaggcatggtg

SEQ ID NO: 90075 - DNA, 15 bp, Homo sapiens
ccagccaggcatggt

SEQ ID NO: 90076 - DNA, 15 bp, Homo sapiens
accagccaggcatgg

SEQ ID NO: 90077 - DNA, 15 bp, Homo sapiens
aaccagccaggcatg

SEQ ID NO: 90078 - DNA, 15 bp, Homo sapiens
aaaccagccaggcat

SEQ ID NO: 90079 - DNA, 15 bp, Homo sapiens
aaaaccagccaggca

SEQ ID NO: 90080 - DNA, 15 bp, Homo sapiens
aaaaaccagccaggc

SEQ ID NO: 90081 - DNA, 15 bp, Homo sapiens
aaaaaaccagccagg

SEQ ID NO: 90082 - DNA, 15 bp, Homo sapiens
taaaaaaccagccag

SEQ ID NO: 90083 - DNA, 15 bp, Homo sapiens
ataaaaaaccagcca

SEQ ID NO: 90084 - DNA, 15 bp, Homo sapiens
aataaaaaaccagcc

SEQ ID NO: 90085 - DNA, 15 bp, Homo sapiens
aaataaaaaaccagc

SEQ ID NO: 90086 - DNA, 15 bp, Homo sapiens
aaaataaaaaaccag

SEQ ID NO: 90087 - DNA, 15 bp, Homo sapiens
aaaaataaaaaacca

SEQ ID NO: 90088 - DNA, 15 bp, Homo sapiens
taaaaataaaaaacc

SEQ ID NO: 90089 - DNA, 15 bp, Homo sapiens
ctaaaaataaaaaac

SEQ ID NO: 90090 - DNA, 15 bp, Homo sapiens
actaaaaataaaaaa

SEQ ID NO: 90091 - DNA, 15 bp, Homo sapiens
tactaaaaataaaaa

SEQ ID NO: 90092 - DNA, 15 bp, Homo sapiens
ctactaaaaataaaa

SEQ ID NO: 90093 - DNA, 15 bp, Homo sapiens
tctactaaaaataaa

SEQ ID NO: 90094 - DNA, 15 bp, Homo sapiens
gctctactaaaaata

SEQ ID NO: 90095 - DNA, 15 bp, Homo sapiens
ggctctactaaaaat

SEQ ID NO: 90096 - DNA, 15 bp, Homo sapiens
tggctctactaaaaa

SEQ ID NO: 90097 - DNA, 15 bp, Homo sapiens
ctggctctactaaaa

SEQ ID NO: 90098 - DNA, 15 bp, Homo sapiens
cctggctctactaaa

SEQ ID NO: 90099 - DNA, 15 bp, Homo sapiens
ccctggctctactaa

SEQ ID NO: 90100 - DNA, 15 bp, Homo sapiens
accctggctctacta

SEQ ID NO: 90101 - DNA, 15 bp, Homo sapiens
gaccctggctctact

SEQ ID NO: 90102 - DNA, 15 bp, Homo sapiens
agaccctggctctac

SEQ ID NO: 90103 - DNA, 15 bp, Homo sapiens
tagaccctggctcta

SEQ ID NO: 90104 - DNA, 15 bp, Homo sapiens
ctagaccctggctct

SEQ ID NO: 90105 - DNA, 15 bp, Homo sapiens
gctagaccctggctc

SEQ ID NO: 90106 - DNA, 15 bp, Homo sapiens
agctagaccctggct

SEQ ID NO: 90107 - DNA, 15 bp, Homo sapiens
tagctagaccctggc

SEQ ID NO: 90108 - DNA, 15 bp, Homo sapiens
atagctagaccctgg

SEQ ID NO: 90109 - DNA, 15 bp, Homo sapiens
catagctagaccctg

SEQ ID NO: 90110 - DNA, 15 bp, Homo sapiens
acatagctagaccct

SEQ ID NO: 90111 - DNA, 15 bp, Homo sapiens
aacatagctagaccc

SEQ ID NO: 90112 - DNA, 15 bp, Homo sapiens
caacatagctagacc

SEQ ID NO: 90113 - DNA, 15 bp, Homo sapiens
gcaacatagctagac

SEQ ID NO: 90114 - DNA, 15 bp, Homo sapiens
ggcaacatagctaga

SEQ ID NO: 90115 - DNA, 15 bp, Homo sapiens
gggcaacatagctag

SEQ ID NO: 90116 - DNA, 15 bp, Homo sapiens
tgggcaacatagcta

SEQ ID NO: 90117 - DNA, 15 bp, Homo sapiens
gtgggcaacatagct

SEQ ID NO: 90118 - DNA, 15 bp, Homo sapiens
cgtgggcaacatagc

SEQ ID NO: 90119 - DNA, 15 bp, Homo sapiens
gcgtgggcaacatag

SEQ ID NO: 90120 - DNA, 15 bp, Homo sapiens
agcgtgggcaacata

SEQ ID NO: 90121 - DNA, 15 bp, Homo sapiens
cagcgtgggcaacat

SEQ ID NO: 90122 - DNA, 15 bp, Homo sapiens
ccagcgtgggcaaca

SEQ ID NO: 90123 - DNA, 15 bp, Homo sapiens
accagcgtgggcaac

SEQ ID NO: 90124 - DNA, 15 bp, Homo sapiens
gaccagcgtgggcaa

SEQ ID NO: 90125 - DNA, 15 bp, Homo sapiens
agaccagcgtgggca

SEQ ID NO: 90126 - DNA, 15 bp, Homo sapiens
tagaccagcgtgggc

SEQ ID NO: 90127 - DNA, 15 bp, Homo sapiens
ctagaccagcgtggg

SEQ ID NO: 90128 - DNA, 15 bp, Homo sapiens
tctagaccagcgtgg

SEQ ID NO: 90129 - DNA, 15 bp, Homo sapiens
ttctagaccagcgtg

SEQ ID NO: 90130 - DNA, 15 bp, Homo sapiens
gttctagaccagcgt

SEQ ID NO: 90131 - DNA, 15 bp, Homo sapiens
agttctagaccagcg

SEQ ID NO: 90132 - DNA, 15 bp, Homo sapiens
gagttctagaccagc

SEQ ID NO: 90133 - DNA, 15 bp, Homo sapiens
ggagttctagaccag

SEQ ID NO: 90134 - DNA, 15 bp, Homo sapiens
aggagttctagacca

SEQ ID NO: 90135 - DNA, 15 bp, Homo sapiens
caggagttctagacc

SEQ ID NO: 90136 - DNA, 15 bp, Homo sapiens
ccaggagttctagac

SEQ ID NO: 90137 - DNA, 15 bp, Homo sapiens
cccaggagttctaga

SEQ ID NO: 90138 - DNA, 15 bp, Homo sapiens
gcccaggagttctag

SEQ ID NO: 90139 - DNA, 15 bp, Homo sapiens
agcccaggagttcta

SEQ ID NO: 90140 - DNA, 15 bp, Homo sapiens
gagcccaggagttct

SEQ ID NO: 90141 - DNA, 15 bp, Homo sapiens
gaagatcacttgagc

SEQ ID NO: 90142 - DNA, 15 bp, Homo sapiens
ggaagatcacttgag

SEQ ID NO: 90143 - DNA, 15 bp, Homo sapiens
gggaagatcacttga

SEQ ID NO: 90144 - DNA, 15 bp, Homo sapiens
tgggaagatcacttg

SEQ ID NO: 90145 - DNA, 15 bp, Homo sapiens
gtgggaagatcactt

SEQ ID NO: 90146 - DNA, 15 bp, Homo sapiens
ggtgggaagatcact

SEQ ID NO: 90147 - DNA, 15 bp, Homo sapiens
aggctgaggtgggaa

SEQ ID NO: 90148 - DNA, 15 bp, Homo sapiens
tgggaggctgaggtg

SEQ ID NO: 90149 - DNA, 15 bp, Homo sapiens
ttgggaggctgaggt

SEQ ID NO: 90150 - DNA, 15 bp, Homo sapiens
tattttgggaggctg

SEQ ID NO: 90151 - DNA, 15 bp, Homo sapiens
ttattttgggaggct

SEQ ID NO: 90152 - DNA, 15 bp, Homo sapiens
gttattttgggaggc

SEQ ID NO: 90153 - DNA, 15 bp, Homo sapiens
tgttattttgggagg

SEQ ID NO: 90154 - DNA, 15 bp, Homo sapiens
ctgttattttgggag

SEQ ID NO: 90155 - DNA, 15 bp, Homo sapiens
cctgttattttggga

SEQ ID NO: 90156 - DNA, 15 bp, Homo sapiens
acctgttattttggg

SEQ ID NO: 90157 - DNA, 15 bp, Homo sapiens
cacctgttattttgg

SEQ ID NO: 90158 - DNA, 15 bp, Homo sapiens
acacctgttattttg

SEQ ID NO: 90159 - DNA, 15 bp, Homo sapiens
tacacctgttatttt

SEQ ID NO: 90160 - DNA, 15 bp, Homo sapiens
ttacacctgttattt

SEQ ID NO: 90161 - DNA, 15 bp, Homo sapiens
cttacacctgttatt

SEQ ID NO: 90162 - DNA, 15 bp, Homo sapiens
gcttacacctgttat

SEQ ID NO: 90163 - DNA, 15 bp, Homo sapiens
ggcttacacctgtta

SEQ ID NO: 90164 - DNA, 15 bp, Homo sapiens
tggcttacacctgtt

SEQ ID NO: 90165 - DNA, 15 bp, Homo sapiens
atggcttacacctgt

SEQ ID NO: 90166 - DNA, 15 bp, Homo sapiens
aatggcttacacctg

SEQ ID NO: 90167 - DNA, 15 bp, Homo sapiens
taatggcttacacct

SEQ ID NO: 90168 - DNA, 15 bp, Homo sapiens
ataatggcttacacc

SEQ ID NO: 90169 - DNA, 15 bp, Homo sapiens
tataatggcttacac

SEQ ID NO: 90170 - DNA, 15 bp, Homo sapiens
ttataatggcttaca

SEQ ID NO: 90171 - DNA, 15 bp, Homo sapiens
gttataatggcttac

SEQ ID NO: 90172 - DNA, 15 bp, Homo sapiens
tgttataatggctta

SEQ ID NO: 90173 - DNA, 15 bp, Homo sapiens
ctgttataatggctt

SEQ ID NO: 90174 - DNA, 15 bp, Homo sapiens
cctgttataatggct

SEQ ID NO: 90175 - DNA, 15 bp, Homo sapiens
acctgttataatggc

SEQ ID NO: 90176 - DNA, 15 bp, Homo sapiens
cacctgttataatgg

SEQ ID NO: 90177 - DNA, 15 bp, Homo sapiens
tcacctgttataatg

SEQ ID NO: 90178 - DNA, 15 bp, Homo sapiens
atcacctgttataat

SEQ ID NO: 90179 - DNA, 15 bp, Homo sapiens
tatcacctgttataa

SEQ ID NO: 90180 - DNA, 15 bp, Homo sapiens
atatcacctgttata

SEQ ID NO: 90181 - DNA, 15 bp, Homo sapiens
tatatcacctgttat

SEQ ID NO: 90182 - DNA, 15 bp, Homo sapiens
ttatatcacctgtta

SEQ ID NO: 90183 - DNA, 15 bp, Homo sapiens
gttatatcacctgtt

SEQ ID NO: 90184 - DNA, 15 bp, Homo sapiens
tgttatatcacctgt

SEQ ID NO: 90185 - DNA, 15 bp, Homo sapiens
ctgttatatcacctg

SEQ ID NO: 90186 - DNA, 15 bp, Homo sapiens
gctgttatatcacct

SEQ ID NO: 90187 - DNA, 15 bp, Homo sapiens
ggctgttatatcacc

SEQ ID NO: 90188 - DNA, 15 bp, Homo sapiens
aggctgttatatcac

SEQ ID NO: 90189 - DNA, 15 bp, Homo sapiens
gaggctgttatatca

SEQ ID NO: 90190 - DNA, 15 bp, Homo sapiens
ggaggctgttatatc

SEQ ID NO: 90191 - DNA, 15 bp, Homo sapiens
gggaggctgttatat

SEQ ID NO: 90192 - DNA, 15 bp, Homo sapiens
tgggaggctgttata

SEQ ID NO: 90193 - DNA, 15 bp, Homo sapiens
ttgggaggctgttat

SEQ ID NO: 90194 - DNA, 15 bp, Homo sapiens
tttgggaggctgtta

SEQ ID NO: 90195 - DNA, 15 bp, Homo sapiens
ttttgggaggctgtt

SEQ ID NO: 90196 - DNA, 15 bp, Homo sapiens
attttgggaggctgt

SEQ ID NO: 90197 - DNA, 15 bp, Homo sapiens
aacacctgttatttt

SEQ ID NO: 90198 - DNA, 15 bp, Homo sapiens
taacacctgttattt

SEQ ID NO: 90199 - DNA, 15 bp, Homo sapiens
ctaacacctgttatt

SEQ ID NO: 90200 - DNA, 15 bp, Homo sapiens
cctaacacctgttat

SEQ ID NO: 90201 - DNA, 15 bp, Homo sapiens
gcctaacacctgtta

SEQ ID NO: 90202 - DNA, 15 bp, Homo sapiens
tgcctaacacctgtt

SEQ ID NO: 90203 - DNA, 15 bp, Homo sapiens
ttgcctaacacctgt

SEQ ID NO: 90204 - DNA, 15 bp, Homo sapiens
tttgcctaacacctg

SEQ ID NO: 90205 - DNA, 15 bp, Homo sapiens
ttttgcctaacacct

SEQ ID NO: 90206 - DNA, 15 bp, Homo sapiens
attttgcctaacacc

SEQ ID NO: 90207 - DNA, 15 bp, Homo sapiens
tattttgcctaacac

SEQ ID NO: 90208 - DNA, 15 bp, Homo sapiens
ttattttgcctaaca

SEQ ID NO: 90209 - DNA, 15 bp, Homo sapiens
gttattttgcctaac

SEQ ID NO: 90210 - DNA, 15 bp, Homo sapiens
tgttattttgcctaa

SEQ ID NO: 90211 - DNA, 15 bp, Homo sapiens
ctgttattttgccta

SEQ ID NO: 90212 - DNA, 15 bp, Homo sapiens
tctgttattttgcct

SEQ ID NO: 90213 - DNA, 15 bp, Homo sapiens
atctgttattttgcc

SEQ ID NO: 90214 - DNA, 15 bp, Homo sapiens
catctgttattttgc

SEQ ID NO: 90215 - DNA, 15 bp, Homo sapiens
acatctgttattttg

SEQ ID NO: 90216 - DNA, 15 bp, Homo sapiens
aacatctgttatttt

SEQ ID NO: 90217 - DNA, 15 bp, Homo sapiens
taacatctgttattt

SEQ ID NO: 90218 - DNA, 15 bp, Homo sapiens
ctaacatctgttatt

SEQ ID NO: 90219 - DNA, 15 bp, Homo sapiens
gctaacatctgttat

SEQ ID NO: 90220 - DNA, 15 bp, Homo sapiens
ggctaacatctgtta

SEQ ID NO: 90221 - DNA, 15 bp, Homo sapiens
aggctaacatctgtt

SEQ ID NO: 90222 - DNA, 15 bp, Homo sapiens
gaggctaacatctgt

SEQ ID NO: 90223 - DNA, 15 bp, Homo sapiens
ggaggctaacatctg

SEQ ID NO: 90224 - DNA, 15 bp, Homo sapiens
gggaggctaacatct

SEQ ID NO: 90225 - DNA, 15 bp, Homo sapiens
tgggaggctaacatc

SEQ ID NO: 90226 - DNA, 15 bp, Homo sapiens
ttgggaggctaacat

SEQ ID NO: 90227 - DNA, 15 bp, Homo sapiens
tttgggaggctaaca

SEQ ID NO: 90228 - DNA, 15 bp, Homo sapiens
ttttgggaggctaac

SEQ ID NO: 90229 - DNA, 15 bp, Homo sapiens
attttgggaggctaa

SEQ ID NO: 90230 - DNA, 15 bp, Homo sapiens
tattttgggaggcta

SEQ ID NO: 90231 - DNA, 15 bp, Homo sapiens
gtattttgggaggct

SEQ ID NO: 90232 - DNA, 15 bp, Homo sapiens
ggtattttgggaggc

SEQ ID NO: 90233 - DNA, 15 bp, Homo sapiens
tggtattttgggagg

SEQ ID NO: 90234 - DNA, 15 bp, Homo sapiens
ctggtattttgggag

SEQ ID NO: 90235 - DNA, 15 bp, Homo sapiens
cctggtattttggga

SEQ ID NO: 90236 - DNA, 15 bp, Homo sapiens
ccctggtattttggg

SEQ ID NO: 90237 - DNA, 15 bp, Homo sapiens
tccctggtattttgg

SEQ ID NO: 90238 - DNA, 15 bp, Homo sapiens
atccctggtattttg

SEQ ID NO: 90239 - DNA, 15 bp, Homo sapiens
tatccctggtatttt

SEQ ID NO: 90240 - DNA, 15 bp, Homo sapiens
ttatccctggtattt

SEQ ID NO: 90241 - DNA, 15 bp, Homo sapiens
gttatccctggtatt

SEQ ID NO: 90242 - DNA, 15 bp, Homo sapiens
tgttatccctggtat

SEQ ID NO: 90243 - DNA, 15 bp, Homo sapiens
ctgttatccctggta

SEQ ID NO: 90244 - DNA, 15 bp, Homo sapiens
cctgttatccctggt

SEQ ID NO: 90245 - DNA, 15 bp, Homo sapiens
acctgttatccctgg

SEQ ID NO: 90246 - DNA, 15 bp, Homo sapiens
cacctgttatccctg

SEQ ID NO: 90247 - DNA, 15 bp, Homo sapiens
acacctgttatccct

SEQ ID NO: 90248 - DNA, 15 bp, Homo sapiens
gacacctgttatccc

SEQ ID NO: 90249 - DNA, 15 bp, Homo sapiens
tgacacctgttatcc

SEQ ID NO: 90250 - DNA, 15 bp, Homo sapiens
ctgacacctgttatc

SEQ ID NO: 90251 - DNA, 15 bp, Homo sapiens
gctgacacctgttat

SEQ ID NO: 90252 - DNA, 15 bp, Homo sapiens
ggctgacacctgtta

SEQ ID NO: 90253 - DNA, 15 bp, Homo sapiens
tggctgacacctgtt

SEQ ID NO: 90254 - DNA, 15 bp, Homo sapiens
atggctgacacctgt

SEQ ID NO: 90255 - DNA, 15 bp, Homo sapiens
aatggctgacacctg

SEQ ID NO: 90256 - DNA, 15 bp, Homo sapiens
caatggctgacacct

SEQ ID NO: 90257 - DNA, 15 bp, Homo sapiens
acaatggctgacacc

SEQ ID NO: 90258 - DNA, 15 bp, Homo sapiens
tacaatggctgacac

SEQ ID NO: 90259 - DNA, 15 bp, Homo sapiens
gtacaatggctgaca

SEQ ID NO: 90260 - DNA, 15 bp, Homo sapiens
ggtacaatggctgac

SEQ ID NO: 90261 - DNA, 15 bp, Homo sapiens
aggtacaatggctga

SEQ ID NO: 90262 - DNA, 15 bp, Homo sapiens
caggtacaatggctg

SEQ ID NO: 90263 - DNA, 15 bp, Homo sapiens
tcaggtacaatggct

SEQ ID NO: 90264 - DNA, 15 bp, Homo sapiens
gtcaggtacaatggc

SEQ ID NO: 90265 - DNA, 15 bp, Homo sapiens
ggtcaggtacaatgg

SEQ ID NO: 90266 - DNA, 15 bp, Homo sapiens
aggtcaggtacaatg

SEQ ID NO: 90267 - DNA, 15 bp, Homo sapiens
caggtcaggtacaat

SEQ ID NO: 90268 - DNA, 15 bp, Homo sapiens
ccaggtcaggtacaa

SEQ ID NO: 90269 - DNA, 15 bp, Homo sapiens
tccaggtcaggtaca

SEQ ID NO: 90270 - DNA, 15 bp, Homo sapiens
atccaggtcaggtac

SEQ ID NO: 90271 - DNA, 15 bp, Homo sapiens
tatccaggtcaggta

SEQ ID NO: 90272 - DNA, 15 bp, Homo sapiens
atatccaggtcaggt

SEQ ID NO: 90273 - DNA, 15 bp, Homo sapiens
tatatccaggtcagg

SEQ ID NO: 90274 - DNA, 15 bp, Homo sapiens
ttatatccaggtcag

SEQ ID NO: 90275 - DNA, 15 bp, Homo sapiens
attatatccaggtca

SEQ ID NO: 90276 - DNA, 15 bp, Homo sapiens
cattatatccaggtc

SEQ ID NO: 90277 - DNA, 15 bp, Homo sapiens
tcattatatccaggt

SEQ ID NO: 90278 - DNA, 15 bp, Homo sapiens
atcattatatccagg

SEQ ID NO: 90279 - DNA, 15 bp, Homo sapiens
aatcattatatccag

SEQ ID NO: 90280 - DNA, 15 bp, Homo sapiens
aaatcattatatcca

SEQ ID NO: 90281 - DNA, 15 bp, Homo sapiens
aaaatcattatatcc

SEQ ID NO: 90282 - DNA, 15 bp, Homo sapiens
aaaaatcattatatc

SEQ ID NO: 90283 - DNA, 15 bp, Homo sapiens
taaaaatcattatat

SEQ ID NO: 90284 - DNA, 15 bp, Homo sapiens
ttaaaaatcattata

SEQ ID NO: 90285 - DNA, 15 bp, Homo sapiens
tttaaaaatcattat

SEQ ID NO: 90286 - DNA, 15 bp, Homo sapiens
ctttaaaaatcatta

SEQ ID NO: 90287 - DNA, 15 bp, Homo sapiens
tctttaaaaatcatt

SEQ ID NO: 90288 - DNA, 15 bp, Homo sapiens
atctttaaaaatcat

SEQ ID NO: 90289 - DNA, 15 bp, Homo sapiens
aatctttaaaaatca

SEQ ID NO: 90290 - DNA, 15 bp, Homo sapiens
aaatctttaaaaatc

SEQ ID NO: 90291 - DNA, 15 bp, Homo sapiens
aaaatctttaaaaat

SEQ ID NO: 90292 - DNA, 15 bp, Homo sapiens
aaaaatctttaaaaa

SEQ ID NO: 90293 - DNA, 15 bp, Homo sapiens
aaaaaatctttaaaa

SEQ ID NO: 90294 - DNA, 15 bp, Homo sapiens
aaaaaaatctttaaa

SEQ ID NO: 90295 - DNA, 15 bp, Homo sapiens
aaaaaaaatctttaa

SEQ ID NO: 90296 - DNA, 15 bp, Homo sapiens
aaaaaaaaatcttta

SEQ ID NO: 90297 - DNA, 15 bp, Homo sapiens
aaaaaaaaaatcttt

SEQ ID NO: 90298 - DNA, 15 bp, Homo sapiens
aaaaaaaaaaatctt

SEQ ID NO: 90299 - DNA, 15 bp, Homo sapiens
aaaaaaaaaaaatct

SEQ ID NO: 90300 - DNA, 15 bp, Homo sapiens
ttctcaaaaaaaaaa

SEQ ID NO: 90301 - DNA, 15 bp, Homo sapiens
tttctcaaaaaaaaa

SEQ ID NO: 90302 - DNA, 15 bp, Homo sapiens
gtttctcaaaaaaaa

SEQ ID NO: 90303 - DNA, 15 bp, Homo sapiens
tgtttctcaaaaaaa

SEQ ID NO: 90304 - DNA, 15 bp, Homo sapiens
ctgtttctcaaaaaa

SEQ ID NO: 90305 - DNA, 15 bp, Homo sapiens
cctgtttctcaaaaa

SEQ ID NO: 90306 - DNA, 15 bp, Homo sapiens
acctgtttctcaaaa

SEQ ID NO: 90307 - DNA, 15 bp, Homo sapiens
cacctgtttctcaaa

SEQ ID NO: 90308 - DNA, 15 bp, Homo sapiens
gcacctgtttctcaa

SEQ ID NO: 90309 - DNA, 15 bp, Homo sapiens
tgcacctgtttctca

SEQ ID NO: 90310 - DNA, 15 bp, Homo sapiens
ttgcacctgtttctc

SEQ ID NO: 90311 - DNA, 15 bp, Homo sapiens
attgcacctgtttct

SEQ ID NO: 90312 - DNA, 15 bp, Homo sapiens
aattgcacctgtttc

SEQ ID NO: 90313 - DNA, 15 bp, Homo sapiens
aaattgcacctgttt

SEQ ID NO: 90314 - DNA, 15 bp, Homo sapiens
gaaattgcacctgtt

SEQ ID NO: 90315 - DNA, 15 bp, Homo sapiens
agaaattgcacctgt

SEQ ID NO: 90316 - DNA, 15 bp, Homo sapiens
aagaaattgcacctg

SEQ ID NO: 90317 - DNA, 15 bp, Homo sapiens
gaagaaattgcacct

SEQ ID NO: 90318 - DNA, 15 bp, Homo sapiens
ggaagaaattgcacc

SEQ ID NO: 90319 - DNA, 15 bp, Homo sapiens
aggaagaaattgcac

SEQ ID NO: 90320 - DNA, 15 bp, Homo sapiens
aaggaagaaattgca

SEQ ID NO: 90321 - DNA, 15 bp, Homo sapiens
aaaggaagaaattgc

SEQ ID NO: 90322 - DNA, 15 bp, Homo sapiens
caaaggaagaaattg

SEQ ID NO: 90323 - DNA, 15 bp, Homo sapiens
ccaaaggaagaaatt

SEQ ID NO: 90324 - DNA, 15 bp, Homo sapiens
accaaaggaagaaat

SEQ ID NO: 90325 - DNA, 15 bp, Homo sapiens
aaccaaaggaagaaa

SEQ ID NO: 90326 - DNA, 15 bp, Homo sapiens
caaccaaaggaagaa

SEQ ID NO: 90327 - DNA, 15 bp, Homo sapiens
tcaaccaaaggaaga

SEQ ID NO: 90328 - DNA, 15 bp, Homo sapiens
ctcaaccaaaggaag

SEQ ID NO: 90329 - DNA, 15 bp, Homo sapiens
cctcaaccaaaggaa

SEQ ID NO: 90330 - DNA, 15 bp, Homo sapiens
tcctcaaccaaagga

SEQ ID NO: 90331 - DNA, 15 bp, Homo sapiens
ctcctcaaccaaagg

SEQ ID NO: 90332 - DNA, 15 bp, Homo sapiens
cctcctcaaccaaag

SEQ ID NO: 90333 - DNA, 15 bp, Homo sapiens
gcctcctcaaccaaa

SEQ ID NO: 90334 - DNA, 15 bp, Homo sapiens
ggcctcctcaaccaa

SEQ ID NO: 90335 - DNA, 15 bp, Homo sapiens
tggcctcctcaacca

SEQ ID NO: 90336 - DNA, 15 bp, Homo sapiens
gtggcctcctcaacc

SEQ ID NO: 90337 - DNA, 15 bp, Homo sapiens
agtggcctcctcaac

SEQ ID NO: 90338 - DNA, 15 bp, Homo sapiens
aagtggcctcctcaa

SEQ ID NO: 90339 - DNA, 15 bp, Homo sapiens
taagtggcctcctca

SEQ ID NO: 90340 - DNA, 15 bp, Homo sapiens
ttaagtggcctcctc

SEQ ID NO: 90341 - DNA, 15 bp, Homo sapiens
attaagtggcctcct

SEQ ID NO: 90342 - DNA, 15 bp, Homo sapiens
tattaagtggcctcc

SEQ ID NO: 90343 - DNA, 15 bp, Homo sapiens
atattaagtggcctc

SEQ ID NO: 90344 - DNA, 15 bp, Homo sapiens
gatattaagtggcct

SEQ ID NO: 90345 - DNA, 15 bp, Homo sapiens
tgatattaagtggcc

SEQ ID NO: 90346 - DNA, 15 bp, Homo sapiens
atgatattaagtggc

SEQ ID NO: 90347 - DNA, 15 bp, Homo sapiens
aatgatattaagtgg

SEQ ID NO: 90348 - DNA, 15 bp, Homo sapiens
caatgatattaagtg

SEQ ID NO: 90349 - DNA, 15 bp, Homo sapiens
gcaatgatattaagt

SEQ ID NO: 90350 - DNA, 15 bp, Homo sapiens
agcaatgatattaag

SEQ ID NO: 90351 - DNA, 15 bp, Homo sapiens
tagcaatgatattaa

SEQ ID NO: 90352 - DNA, 15 bp, Homo sapiens
ctagcaatgatatta

SEQ ID NO: 90353 - DNA, 15 bp, Homo sapiens
cctagcaatgatatt

SEQ ID NO: 90354 - DNA, 15 bp, Homo sapiens
tcctagcaatgatat

SEQ ID NO: 90355 - DNA, 15 bp, Homo sapiens
ctcctagcaatgata

SEQ ID NO: 90356 - DNA, 15 bp, Homo sapiens
cctcctagcaatgat

SEQ ID NO: 90357 - DNA, 15 bp, Homo sapiens
tcctcctagcaatga

SEQ ID NO: 90358 - DNA, 15 bp, Homo sapiens
atcctcctagcaatg

SEQ ID NO: 90359 - DNA, 15 bp, Homo sapiens
gatcctcctagcaat

SEQ ID NO: 90360 - DNA, 15 bp, Homo sapiens
tgatcctcctagcaa

SEQ ID NO: 90361 - DNA, 15 bp, Homo sapiens
ttgatcctcctagca

SEQ ID NO: 90362 - DNA, 15 bp, Homo sapiens
tttgatcctcctagc

SEQ ID NO: 90363 - DNA, 15 bp, Homo sapiens
ttttgatcctcctag

SEQ ID NO: 90364 - DNA, 15 bp, Homo sapiens
attttgatcctccta

SEQ ID NO: 90365 - DNA, 15 bp, Homo sapiens
cattttgatcctcct

SEQ ID NO: 90366 - DNA, 15 bp, Homo sapiens
tcattttgatcctcc

SEQ ID NO: 90367 - DNA, 15 bp, Homo sapiens
ttcattttgatcctc

SEQ ID NO: 90368 - DNA, 15 bp, Homo sapiens
attcattttgatcct

SEQ ID NO: 90369 - DNA, 15 bp, Homo sapiens
cattcattttgatcc

SEQ ID NO: 90370 - DNA, 15 bp, Homo sapiens
tcattcattttgatc

SEQ ID NO: 90371 - DNA, 15 bp, Homo sapiens
atcattcattttgat

SEQ ID NO: 90372 - DNA, 15 bp, Homo sapiens
gatcattcattttga

SEQ ID NO: 90373 - DNA, 15 bp, Homo sapiens
ggatcattcattttg

SEQ ID NO: 90374 - DNA, 15 bp, Homo sapiens
gggatcattcatttt

SEQ ID NO: 90375 - DNA, 15 bp, Homo sapiens
agggatcattcattt

SEQ ID NO: 90376 - DNA, 15 bp, Homo sapiens
aagggatcattcatt

SEQ ID NO: 90377 - DNA, 15 bp, Homo sapiens
taagggatcattcat

SEQ ID NO: 90378 - DNA, 15 bp, Homo sapiens
gtaagggatcattca

SEQ ID NO: 90379 - DNA, 15 bp, Homo sapiens
agtaagggatcattc

SEQ ID NO: 90380 - DNA, 15 bp, Homo sapiens
aagtaagggatcatt

SEQ ID NO: 90381 - DNA, 15 bp, Homo sapiens
gaagtaagggatcat

SEQ ID NO: 90382 - DNA, 15 bp, Homo sapiens
agaagtaagggatca

SEQ ID NO: 90383 - DNA, 15 bp, Homo sapiens
cagaagtaagggatc

SEQ ID NO: 90384 - DNA, 15 bp, Homo sapiens
acagaagtaagggat

SEQ ID NO: 90385 - DNA, 15 bp, Homo sapiens
aacagaagtaaggga

SEQ ID NO: 90386 - DNA, 15 bp, Homo sapiens
aaacagaagtaaggg

SEQ ID NO: 90387 - DNA, 15 bp, Homo sapiens
gaaacagaagtaagg

SEQ ID NO: 90388 - DNA, 15 bp, Homo sapiens
ggaaacagaagtaag

SEQ ID NO: 90389 - DNA, 15 bp, Homo sapiens
aggaaacagaagtaa

SEQ ID NO: 90390 - DNA, 15 bp, Homo sapiens
gaggaaacagaagta

SEQ ID NO: 90391 - DNA, 15 bp, Homo sapiens
tgaggaaacagaagt

SEQ ID NO: 90392 - DNA, 15 bp, Homo sapiens
ttgaggaaacagaag

SEQ ID NO: 90393 - DNA, 15 bp, Homo sapiens
tttgaggaaacagaa

SEQ ID NO: 90394 - DNA, 15 bp, Homo sapiens
ttttgaggaaacaga

SEQ ID NO: 90395 - DNA, 15 bp, Homo sapiens
attttgaggaaacag

SEQ ID NO: 90396 - DNA, 15 bp, Homo sapiens
tattttgaggaaaca

SEQ ID NO: 90397 - DNA, 15 bp, Homo sapiens
ctattttgaggaaac

SEQ ID NO: 90398 - DNA, 15 bp, Homo sapiens
actattttgaggaaa

SEQ ID NO: 90399 - DNA, 15 bp, Homo sapiens
aactattttgaggaa

SEQ ID NO: 90400 - DNA, 15 bp, Homo sapiens
taactattttgagga

SEQ ID NO: 90401 - DNA, 15 bp, Homo sapiens
ttaactattttgagg

SEQ ID NO: 90402 - DNA, 15 bp, Homo sapiens
tttaactattttgag

SEQ ID NO: 90403 - DNA, 15 bp, Homo sapiens
ctttaactattttga

SEQ ID NO: 90404 - DNA, 15 bp, Homo sapiens
actttaactattttg

SEQ ID NO: 90405 - DNA, 15 bp, Homo sapiens
aactttaactatttt

SEQ ID NO: 90406 - DNA, 15 bp, Homo sapiens
aaactttaactattt

SEQ ID NO: 90407 - DNA, 15 bp, Homo sapiens
aaaactttaactatt

SEQ ID NO: 90408 - DNA, 15 bp, Homo sapiens
caaaactttaactat

SEQ ID NO: 90409 - DNA, 15 bp, Homo sapiens
ccaaaactttaacta

SEQ ID NO: 90410 - DNA, 15 bp, Homo sapiens
gccaaaactttaact

SEQ ID NO: 90411 - DNA, 15 bp, Homo sapiens
tgccaaaactttaac

SEQ ID NO: 90412 - DNA, 15 bp, Homo sapiens
ctgccaaaactttaa

SEQ ID NO: 90413 - DNA, 15 bp, Homo sapiens
actgccaaaacttta

SEQ ID NO: 90414 - DNA, 15 bp, Homo sapiens
gactgccaaaacttt

SEQ ID NO: 90415 - DNA, 15 bp, Homo sapiens
agactgccaaaactt

SEQ ID NO: 90416 - DNA, 15 bp, Homo sapiens
gagactgccaaaact

SEQ ID NO: 90417 - DNA, 15 bp, Homo sapiens
tgagactgccaaaac

SEQ ID NO: 90418 - DNA, 15 bp, Homo sapiens
atgagactgccaaaa

SEQ ID NO: 90419 - DNA, 15 bp, Homo sapiens
tatgagactgccaaa

SEQ ID NO: 90420 - DNA, 15 bp, Homo sapiens
gtatgagactgccaa

SEQ ID NO: 90421 - DNA, 15 bp, Homo sapiens
agtatgagactgcca

SEQ ID NO: 90422 - DNA, 15 bp, Homo sapiens
cagtatgagactgcc

SEQ ID NO: 90423 - DNA, 15 bp, Homo sapiens
acagtatgagactgc

SEQ ID NO: 90424 - DNA, 15 bp, Homo sapiens
gacagtatgagactg

SEQ ID NO: 90425 - DNA, 15 bp, Homo sapiens
agacagtatgagact

SEQ ID NO: 90426 - DNA, 15 bp, Homo sapiens
aagacagtatgagac

SEQ ID NO: 90427 - DNA, 15 bp, Homo sapiens
aaagacagtatgaga

SEQ ID NO: 90428 - DNA, 15 bp, Homo sapiens
aaaagacagtatgag

SEQ ID NO: 90429 - DNA, 15 bp, Homo sapiens
taaaagacagtatga

SEQ ID NO: 90430 - DNA, 15 bp, Homo sapiens
ttaaaagacagtatg

SEQ ID NO: 90431 - DNA, 15 bp, Homo sapiens
tttaaaagacagtat

SEQ ID NO: 90432 - DNA, 15 bp, Homo sapiens
ttttaaaagacagta

SEQ ID NO: 90433 - DNA, 15 bp, Homo sapiens
cttttaaaagacagt

SEQ ID NO: 90434 - DNA, 15 bp, Homo sapiens
tcttttaaaagacag

SEQ ID NO: 90435 - DNA, 15 bp, Homo sapiens
ttcttttaaaagaca

SEQ ID NO: 90436 - DNA, 15 bp, Homo sapiens
tttcttttaaaagac

SEQ ID NO: 90437 - DNA, 15 bp, Homo sapiens
atttcttttaaaaga

SEQ ID NO: 90438 - DNA, 15 bp, Homo sapiens
gatttcttttaaaag

SEQ ID NO: 90439 - DNA, 15 bp, Homo sapiens
tgatttcttttaaaa

SEQ ID NO: 90440 - DNA, 15 bp, Homo sapiens
atgatttcttttaaa

SEQ ID NO: 90441 - DNA, 15 bp, Homo sapiens
tatgatttcttttaa

SEQ ID NO: 90442 - DNA, 15 bp, Homo sapiens
atatgatttctttta

SEQ ID NO: 90443 - DNA, 15 bp, Homo sapiens
aatatgatttctttt

SEQ ID NO: 90444 - DNA, 15 bp, Homo sapiens
gaatatgatttcttt

SEQ ID NO: 90445 - DNA, 15 bp, Homo sapiens
ggaatatgatttctt

SEQ ID NO: 90446 - DNA, 15 bp, Homo sapiens
tggaatatgatttct

SEQ ID NO: 90447 - DNA, 15 bp, Homo sapiens
gtggaatatgatttc

SEQ ID NO: 90448 - DNA, 15 bp, Homo sapiens
agtggaatatgattt

SEQ ID NO: 90449 - DNA, 15 bp, Homo sapiens
cagtggaatatgatt

SEQ ID NO: 90450 - DNA, 15 bp, Homo sapiens
acagtggaatatgat

SEQ ID NO: 90451 - DNA, 15 bp, Homo sapiens
gacagtggaatatga

SEQ ID NO: 90452 - DNA, 15 bp, Homo sapiens
tgacagtggaatatg

SEQ ID NO: 90453 - DNA, 15 bp, Homo sapiens
ctgacagtggaatat

SEQ ID NO: 90454 - DNA, 15 bp, Homo sapiens
tctgacagtggaata

SEQ ID NO: 90455 - DNA, 15 bp, Homo sapiens
atctgacagtggaat

SEQ ID NO: 90456 - DNA, 15 bp, Homo sapiens
aatctgacagtggaa

SEQ ID NO: 90457 - DNA, 15 bp, Homo sapiens
gaatctgacagtgga

SEQ ID NO: 90458 - DNA, 15 bp, Homo sapiens
tgaatctgacagtgg

SEQ ID NO: 90459 - DNA, 15 bp, Homo sapiens
ctgaatctgacagtg

SEQ ID NO: 90460 - DNA, 15 bp, Homo sapiens
tctgaatctgacagt

SEQ ID NO: 90461 - DNA, 15 bp, Homo sapiens
ttctgaatctgacag

SEQ ID NO: 90462 - DNA, 15 bp, Homo sapiens
tttctgaatctgaca

SEQ ID NO: 90463 - DNA, 15 bp, Homo sapiens
ttttctgaatctgac

SEQ ID NO: 90464 - DNA, 15 bp, Homo sapiens
tttttctgaatctga

SEQ ID NO: 90465 - DNA, 15 bp, Homo sapiens
atttttctgaatctg

SEQ ID NO: 90466 - DNA, 15 bp, Homo sapiens
aatttttctgaatct

SEQ ID NO: 90467 - DNA, 15 bp, Homo sapiens
aaatttttctgaatc

SEQ ID NO: 90468 - DNA, 15 bp, Homo sapiens
aaaatttttctgaat

SEQ ID NO: 90469 - DNA, 15 bp, Homo sapiens
taaaatttttctgaa

SEQ ID NO: 90470 - DNA, 15 bp, Homo sapiens
ctaaaatttttctga

SEQ ID NO: 90471 - DNA, 15 bp, Homo sapiens
tctaaaatttttctg

SEQ ID NO: 90472 - DNA, 15 bp, Homo sapiens
ctctaaaatttttct

SEQ ID NO: 90473 - DNA, 15 bp, Homo sapiens
actctaaaatttttc

SEQ ID NO: 90474 - DNA, 15 bp, Homo sapiens
aactctaaaattttt

SEQ ID NO: 90475 - DNA, 15 bp, Homo sapiens
gaactctaaaatttt

SEQ ID NO: 90476 - DNA, 15 bp, Homo sapiens
agaactctaaaattt

SEQ ID NO: 90477 - DNA, 15 bp, Homo sapiens
aagaactctaaaatt

SEQ ID NO: 90478 - DNA, 15 bp, Homo sapiens
taagaactctaaaat

SEQ ID NO: 90479 - DNA, 15 bp, Homo sapiens
gtaagaactctaaaa

SEQ ID NO: 90480 - DNA, 15 bp, Homo sapiens
agtaagaactctaaa

SEQ ID NO: 90481 - DNA, 15 bp, Homo sapiens
aagtaagaactctaa

SEQ ID NO: 90482 - DNA, 15 bp, Homo sapiens
aaagtaagaactcta

SEQ ID NO: 90483 - DNA, 15 bp, Homo sapiens
aaaagtaagaactct

SEQ ID NO: 90484 - DNA, 15 bp, Homo sapiens
caaaagtaagaactc

SEQ ID NO: 90485 - DNA, 15 bp, Homo sapiens
ccaaaagtaagaact

SEQ ID NO: 90486 - DNA, 15 bp, Homo sapiens
tccaaaagtaagaac

SEQ ID NO: 90487 - DNA, 15 bp, Homo sapiens
ttccaaaagtaagaa

SEQ ID NO: 90488 - DNA, 15 bp, Homo sapiens
attccaaaagtaaga

SEQ ID NO: 90489 - DNA, 15 bp, Homo sapiens
tattccaaaagtaag

SEQ ID NO: 90490 - DNA, 15 bp, Homo sapiens
gtattccaaaagtaa

SEQ ID NO: 90491 - DNA, 15 bp, Homo sapiens
tgtattccaaaagta

SEQ ID NO: 90492 - DNA, 15 bp, Homo sapiens
gtgtattccaaaagt

SEQ ID NO: 90493 - DNA, 15 bp, Homo sapiens
agtgtattccaaaag

SEQ ID NO: 90494 - DNA, 15 bp, Homo sapiens
aagtgtattccaaaa

SEQ ID NO: 90495 - DNA, 15 bp, Homo sapiens
caagtgtattccaaa

SEQ ID NO: 90496 - DNA, 15 bp, Homo sapiens
ccaagtgtattccaa

SEQ ID NO: 90497 - DNA, 15 bp, Homo sapiens
accaagtgtattcca

SEQ ID NO: 90498 - DNA, 15 bp, Homo sapiens
aaccaagtgtattcc

SEQ ID NO: 90499 - DNA, 15 bp, Homo sapiens
aaaccaagtgtattc

SEQ ID NO: 90500 - DNA, 15 bp, Homo sapiens
aaaaccaagtgtatt

SEQ ID NO: 90501 - DNA, 15 bp, Homo sapiens
caaaaccaagtgtat

SEQ ID NO: 90502 - DNA, 15 bp, Homo sapiens
ccaaaaccaagtgta

SEQ ID NO: 90503 - DNA, 15 bp, Homo sapiens
tccaaaaccaagtgt

SEQ ID NO: 90504 - DNA, 15 bp, Homo sapiens
ttccaaaaccaagtg

SEQ ID NO: 90505 - DNA, 15 bp, Homo sapiens
cttccaaaaccaagt

SEQ ID NO: 90506 - DNA, 15 bp, Homo sapiens
ccttccaaaaccaag

SEQ ID NO: 90507 - DNA, 15 bp, Homo sapiens
accttccaaaaccaa

SEQ ID NO: 90508 - DNA, 15 bp, Homo sapiens
aaccttccaaaacca

SEQ ID NO: 90509 - DNA, 15 bp, Homo sapiens
gaaccttccaaaacc

SEQ ID NO: 90510 - DNA, 15 bp, Homo sapiens
tgaaccttccaaaac

SEQ ID NO: 90511 - DNA, 15 bp, Homo sapiens
gtgaaccttccaaaa

SEQ ID NO: 90512 - DNA, 15 bp, Homo sapiens
agtgaaccttccaaa

SEQ ID NO: 90513 - DNA, 15 bp, Homo sapiens
cagtgaaccttccaa

SEQ ID NO: 90514 - DNA, 15 bp, Homo sapiens
acagtgaaccttcca

SEQ ID NO: 90515 - DNA, 15 bp, Homo sapiens
aacagtgaaccttcc

SEQ ID NO: 90516 - DNA, 15 bp, Homo sapiens
taacagtgaaccttc

SEQ ID NO: 90517 - DNA, 15 bp, Homo sapiens
ttaacagtgaacctt

SEQ ID NO: 90518 - DNA, 15 bp, Homo sapiens
tttaacagtgaacct

SEQ ID NO: 90519 - DNA, 15 bp, Homo sapiens
ctttaacagtgaacc

SEQ ID NO: 90520 - DNA, 15 bp, Homo sapiens
tctttaacagtgaac

SEQ ID NO: 90521 - DNA, 15 bp, Homo sapiens
atctttaacagtgaa

SEQ ID NO: 90522 - DNA, 15 bp, Homo sapiens
aatctttaacagtga

SEQ ID NO: 90523 - DNA, 15 bp, Homo sapiens
aaatctttaacagtg

SEQ ID NO: 90524 - DNA, 15 bp, Homo sapiens
aaaatctttaacagt

SEQ ID NO: 90525 - DNA, 15 bp, Homo sapiens
caaaatctttaacag

SEQ ID NO: 90526 - DNA, 15 bp, Homo sapiens
tcaaaatctttaaca

SEQ ID NO: 90527 - DNA, 15 bp, Homo sapiens
ttcaaaatctttaac

SEQ ID NO: 90528 - DNA, 15 bp, Homo sapiens
tttcaaaatctttaa

SEQ ID NO: 90529 - DNA, 15 bp, Homo sapiens
ctttcaaaatcttta

SEQ ID NO: 90530 - DNA, 15 bp, Homo sapiens
gctttcaaaatcttt

SEQ ID NO: 90531 - DNA, 15 bp, Homo sapiens
agctttcaaaatctt

SEQ ID NO: 90532 - DNA, 15 bp, Homo sapiens
gagctttcaaaatct

SEQ ID NO: 90533 - DNA, 15 bp, Homo sapiens
tgagctttcaaaatc

SEQ ID NO: 90534 - DNA, 15 bp, Homo sapiens
atgagctttcaaaat

SEQ ID NO: 90535 - DNA, 15 bp, Homo sapiens
gatgagctttcaaaa

SEQ ID NO: 90536 - DNA, 15 bp, Homo sapiens
ggatgagctttcaaa

SEQ ID NO: 90537 - DNA, 15 bp, Homo sapiens
gggatgagctttcaa

SEQ ID NO: 90538 - DNA, 15 bp, Homo sapiens
agggatgagctttca

SEQ ID NO: 90539 - DNA, 15 bp, Homo sapiens
gagggatgagctttc

SEQ ID NO: 90540 - DNA, 15 bp, Homo sapiens
ggagggatgagcttt

SEQ ID NO: 90541 - DNA, 15 bp, Homo sapiens
aggagggatgagctt

SEQ ID NO: 90542 - DNA, 15 bp, Homo sapiens
taggagggatgagct

SEQ ID NO: 90543 - DNA, 15 bp, Homo sapiens
gtaggagggatgagc

SEQ ID NO: 90544 - DNA, 15 bp, Homo sapiens
cgtaggagggatgag

SEQ ID NO: 90545 - DNA, 15 bp, Homo sapiens
acgtaggagggatga

SEQ ID NO: 90546 - DNA, 15 bp, Homo sapiens
aacgtaggagggatg

SEQ ID NO: 90547 - DNA, 15 bp, Homo sapiens
taacgtaggagggat

SEQ ID NO: 90548 - DNA, 15 bp, Homo sapiens
gtaacgtaggaggga

SEQ ID NO: 90549 - DNA, 15 bp, Homo sapiens
tgtaacgtaggaggg

SEQ ID NO: 90550 - DNA, 15 bp, Homo sapiens
gtgtaacgtaggagg

SEQ ID NO: 90551 - DNA, 15 bp, Homo sapiens
agtgtaacgtaggag

SEQ ID NO: 90552 - DNA, 15 bp, Homo sapiens
tagtgtaacgtagga

SEQ ID NO: 90553 - DNA, 15 bp, Homo sapiens
atagtgtaacgtagg

SEQ ID NO: 90554 - DNA, 15 bp, Homo sapiens
aatagtgtaacgtag

SEQ ID NO: 90555 - DNA, 15 bp, Homo sapiens
aaatagtgtaacgta

SEQ ID NO: 90556 - DNA, 15 bp, Homo sapiens
taaatagtgtaacgt

SEQ ID NO: 90557 - DNA, 15 bp, Homo sapiens
gtaaatagtgtaacg

SEQ ID NO: 90558 - DNA, 15 bp, Homo sapiens
agtaaatagtgtaac

SEQ ID NO: 90559 - DNA, 15 bp, Homo sapiens
aagtaaatagtgtaa

SEQ ID NO: 90560 - DNA, 15 bp, Homo sapiens
gaagtaaatagtgta

SEQ ID NO: 90561 - DNA, 15 bp, Homo sapiens
ggaagtaaatagtgt

SEQ ID NO: 90562 - DNA, 15 bp, Homo sapiens
aggaagtaaatagtg

SEQ ID NO: 90563 - DNA, 15 bp, Homo sapiens
taggaagtaaatagt

SEQ ID NO: 90564 - DNA, 15 bp, Homo sapiens
ctaggaagtaaatag

SEQ ID NO: 90565 - DNA, 15 bp, Homo sapiens
gctaggaagtaaata

SEQ ID NO: 90566 - DNA, 15 bp, Homo sapiens
agctaggaagtaaat

SEQ ID NO: 90567 - DNA, 15 bp, Homo sapiens
cagctaggaagtaaa

SEQ ID NO: 90568 - DNA, 15 bp, Homo sapiens
gcagctaggaagtaa

SEQ ID NO: 90569 - DNA, 15 bp, Homo sapiens
ggcagctaggaagta

SEQ ID NO: 90570 - DNA, 15 bp, Homo sapiens
tggcagctaggaagt

SEQ ID NO: 90571 - DNA, 15 bp, Homo sapiens
atggcagctaggaag

SEQ ID NO: 90572 - DNA, 15 bp, Homo sapiens
aatggcagctaggaa

SEQ ID NO: 90573 - DNA, 15 bp, Homo sapiens
aaatggcagctagga

SEQ ID NO: 90574 - DNA, 15 bp, Homo sapiens
caaatggcagctagg

SEQ ID NO: 90575 - DNA, 15 bp, Homo sapiens
tcaaatggcagctag

SEQ ID NO: 90576 - DNA, 15 bp, Homo sapiens
ctcaaatggcagcta

SEQ ID NO: 90577 - DNA, 15 bp, Homo sapiens
actcaaatggcagct

SEQ ID NO: 90578 - DNA, 15 bp, Homo sapiens
aactcaaatggcagc

SEQ ID NO: 90579 - DNA, 15 bp, Homo sapiens
taactcaaatggcag

SEQ ID NO: 90580 - DNA, 15 bp, Homo sapiens
ctaactcaaatggca

SEQ ID NO: 90581 - DNA, 15 bp, Homo sapiens
cctaactcaaatggc

SEQ ID NO: 90582 - DNA, 15 bp, Homo sapiens
tcctaactcaaatgg

SEQ ID NO: 90583 - DNA, 15 bp, Homo sapiens
ttcctaactcaaatg

SEQ ID NO: 90584 - DNA, 15 bp, Homo sapiens
gttcctaactcaaat

SEQ ID NO: 90585 - DNA, 15 bp, Homo sapiens
agttcctaactcaaa

SEQ ID NO: 90586 - DNA, 15 bp, Homo sapiens
cagttcctaactcaa

SEQ ID NO: 90587 - DNA, 15 bp, Homo sapiens
acagttcctaactca

SEQ ID NO: 90588 - DNA, 15 bp, Homo sapiens
cacagttcctaactc

SEQ ID NO: 90589 - DNA, 15 bp, Homo sapiens
acacagttcctaact

SEQ ID NO: 90590 - DNA, 15 bp, Homo sapiens
aacacagttcctaac

SEQ ID NO: 90591 - DNA, 15 bp, Homo sapiens
caacacagttcctaa

SEQ ID NO: 90592 - DNA, 15 bp, Homo sapiens
gcaacacagttccta

SEQ ID NO: 90593 - DNA, 15 bp, Homo sapiens
tgcaacacagttcct

SEQ ID NO: 90594 - DNA, 15 bp, Homo sapiens
atgcaacacagttcc

SEQ ID NO: 90595 - DNA, 15 bp, Homo sapiens
aatgcaacacagttc

SEQ ID NO: 90596 - DNA, 15 bp, Homo sapiens
caatgcaacacagtt

SEQ ID NO: 90597 - DNA, 15 bp, Homo sapiens
acaatgcaacacagt

SEQ ID NO: 90598 - DNA, 15 bp, Homo sapiens
cacaatgcaacacag

SEQ ID NO: 90599 - DNA, 15 bp, Homo sapiens
gcacaatgcaacaca

SEQ ID NO: 90600 - DNA, 15 bp, Homo sapiens
tgcacaatgcaacac

SEQ ID NO: 90601 - DNA, 15 bp, Homo sapiens
atgcacaatgcaaca

SEQ ID NO: 90602 - DNA, 15 bp, Homo sapiens
aatgcacaatgcaac

SEQ ID NO: 90603 - DNA, 15 bp, Homo sapiens
taatgcacaatgcaa

SEQ ID NO: 90604 - DNA, 15 bp, Homo sapiens
ataatgcacaatgca

SEQ ID NO: 90605 - DNA, 15 bp, Homo sapiens
aataatgcacaatgc

SEQ ID NO: 90606 - DNA, 15 bp, Homo sapiens
aaataatgcacaatg

SEQ ID NO: 90607 - DNA, 15 bp, Homo sapiens
aaaataatgcacaat

SEQ ID NO: 90608 - DNA, 15 bp, Homo sapiens
caaaataatgcacaa

SEQ ID NO: 90609 - DNA, 15 bp, Homo sapiens
acaaaataatgcaca

SEQ ID NO: 90610 - DNA, 15 bp, Homo sapiens
cacaaaataatgcac

SEQ ID NO: 90611 - DNA, 15 bp, Homo sapiens
tcacaaaataatgca

SEQ ID NO: 90612 - DNA, 15 bp, Homo sapiens
ttcacaaaataatgc

SEQ ID NO: 90613 - DNA, 15 bp, Homo sapiens
tttcacaaaataatg

SEQ ID NO: 90614 - DNA, 15 bp, Homo sapiens
atttcacaaaataat

SEQ ID NO: 90615 - DNA, 15 bp, Homo sapiens
catttcacaaaataa

SEQ ID NO: 90616 - DNA, 15 bp, Homo sapiens
gcatttcacaaaata

SEQ ID NO: 90617 - DNA, 15 bp, Homo sapiens
tgcatttcacaaaat

SEQ ID NO: 90618 - DNA, 15 bp, Homo sapiens
atgcatttcacaaaa

SEQ ID NO: 90619 - DNA, 15 bp, Homo sapiens
aatgcatttcacaaa

SEQ ID NO: 90620 - DNA, 15 bp, Homo sapiens
caatgcatttcacaa

SEQ ID NO: 90621 - DNA, 15 bp, Homo sapiens
tcaatgcatttcaca

SEQ ID NO: 90622 - DNA, 15 bp, Homo sapiens
ctcaatgcatttcac

SEQ ID NO: 90623 - DNA, 15 bp, Homo sapiens
gctcaatgcatttca

SEQ ID NO: 90624 - DNA, 15 bp, Homo sapiens
tgctcaatgcatttc

SEQ ID NO: 90625 - DNA, 15 bp, Homo sapiens
atgctcaatgcattt

SEQ ID NO: 90626 - DNA, 15 bp, Homo sapiens
aatgctcaatgcatt

SEQ ID NO: 90627 - DNA, 15 bp, Homo sapiens
caatgctcaatgcat

SEQ ID NO: 90628 - DNA, 15 bp, Homo sapiens
acaatgctcaatgca

SEQ ID NO: 90629 - DNA, 15 bp, Homo sapiens
cacaatgctcaatgc

SEQ ID NO: 90630 - DNA, 15 bp, Homo sapiens
acacaatgctcaatg

SEQ ID NO: 90631 - DNA, 15 bp, Homo sapiens
cacacaatgctcaat

SEQ ID NO: 90632 - DNA, 15 bp, Homo sapiens
tcacacaatgctcaa

SEQ ID NO: 90633 - DNA, 15 bp, Homo sapiens
ttcacacaatgctca

SEQ ID NO: 90634 - DNA, 15 bp, Homo sapiens
tttcacacaatgctc

SEQ ID NO: 90635 - DNA, 15 bp, Homo sapiens
atttcacacaatgct

SEQ ID NO: 90636 - DNA, 15 bp, Homo sapiens
catttcacacaatgc

SEQ ID NO: 90637 - DNA, 15 bp, Homo sapiens
gcatttcacacaatg

SEQ ID NO: 90638 - DNA, 15 bp, Homo sapiens
agcatttcacacaat

SEQ ID NO: 90639 - DNA, 15 bp, Homo sapiens
gagcatttcacacaa

SEQ ID NO: 90640 - DNA, 15 bp, Homo sapiens
ggagcatttcacaca

SEQ ID NO: 90641 - DNA, 15 bp, Homo sapiens
tggagcatttcacac

SEQ ID NO: 90642 - DNA, 15 bp, Homo sapiens
gtggagcatttcaca

SEQ ID NO: 90643 - DNA, 15 bp, Homo sapiens
tgtggagcatttcac

SEQ ID NO: 90644 - DNA, 15 bp, Homo sapiens
atgtggagcatttca

SEQ ID NO: 90645 - DNA, 15 bp, Homo sapiens
catgtggagcatttc

SEQ ID NO: 90646 - DNA, 15 bp, Homo sapiens
acatgtggagcattt

SEQ ID NO: 90647 - DNA, 15 bp, Homo sapiens
tacatgtggagcatt

SEQ ID NO: 90648 - DNA, 15 bp, Homo sapiens
ttacatgtggagcat

SEQ ID NO: 90649 - DNA, 15 bp, Homo sapiens
gttacatgtggagca

SEQ ID NO: 90650 - DNA, 15 bp, Homo sapiens
ggttacatgtggagc

SEQ ID NO: 90651 - DNA, 15 bp, Homo sapiens
gggttacatgtggag

SEQ ID NO: 90652 - DNA, 15 bp, Homo sapiens
tgggttacatgtgga

SEQ ID NO: 90653 - DNA, 15 bp, Homo sapiens
ctgggttacatgtgg

SEQ ID NO: 90654 - DNA, 15 bp, Homo sapiens
gctgggttacatgtg

SEQ ID NO: 90655 - DNA, 15 bp, Homo sapiens
ggctgggttacatgt

SEQ ID NO: 90656 - DNA, 15 bp, Homo sapiens
aggctgggttacatg

SEQ ID NO: 90657 - DNA, 15 bp, Homo sapiens
taggctgggttacat

SEQ ID NO: 90658 - DNA, 15 bp, Homo sapiens
ttaggctgggttaca

SEQ ID NO: 90659 - DNA, 15 bp, Homo sapiens
gttaggctgggttac

SEQ ID NO: 90660 - DNA, 15 bp, Homo sapiens
agttaggctgggtta

SEQ ID NO: 90661 - DNA, 15 bp, Homo sapiens
aagttaggctgggtt

SEQ ID NO: 90662 - DNA, 15 bp, Homo sapiens
gaagttaggctgggt

SEQ ID NO: 90663 - DNA, 15 bp, Homo sapiens
tgaagttaggctggg

SEQ ID NO: 90664 - DNA, 15 bp, Homo sapiens
ctgaagttaggctgg

SEQ ID NO: 90665 - DNA, 15 bp, Homo sapiens
gctgaagttaggctg

SEQ ID NO: 90666 - DNA, 15 bp, Homo sapiens
tgctgaagttaggct

SEQ ID NO: 90667 - DNA, 15 bp, Homo sapiens
ttgctgaagttaggc

SEQ ID NO: 90668 - DNA, 15 bp, Homo sapiens
attgctgaagttagg

SEQ ID NO: 90669 - DNA, 15 bp, Homo sapiens
aattgctgaagttag

SEQ ID NO: 90670 - DNA, 15 bp, Homo sapiens
caattgctgaagtta

SEQ ID NO: 90671 - DNA, 15 bp, Homo sapiens
acaattgctgaagtt

SEQ ID NO: 90672 - DNA, 15 bp, Homo sapiens
tacaattgctgaagt

SEQ ID NO: 90673 - DNA, 15 bp, Homo sapiens
ctacaattgctgaag

SEQ ID NO: 90674 - DNA, 15 bp, Homo sapiens
tctacaattgctgaa

SEQ ID NO: 90675 - DNA, 15 bp, Homo sapiens
atctacaattgctga

SEQ ID NO: 90676 - DNA, 15 bp, Homo sapiens
aatctacaattgctg

SEQ ID NO: 90677 - DNA, 15 bp, Homo sapiens
caatctacaattgct

SEQ ID NO: 90678 - DNA, 15 bp, Homo sapiens
acaatctacaattgc

SEQ ID NO: 90679 - DNA, 15 bp, Homo sapiens
cacaatctacaattg

SEQ ID NO: 90680 - DNA, 15 bp, Homo sapiens
acacaatctacaatt

SEQ ID NO: 90681 - DNA, 15 bp, Homo sapiens
cacacaatctacaat

SEQ ID NO: 90682 - DNA, 15 bp, Homo sapiens
tcacacaatctacaa

SEQ ID NO: 90683 - DNA, 15 bp, Homo sapiens
atcacacaatctaca

SEQ ID NO: 90684 - DNA, 15 bp, Homo sapiens
catcacacaatctac

SEQ ID NO: 90685 - DNA, 15 bp, Homo sapiens
tcatcacacaatcta

SEQ ID NO: 90686 - DNA, 15 bp, Homo sapiens
gtcatcacacaatct

SEQ ID NO: 90687 - DNA, 15 bp, Homo sapiens
agtcatcacacaatc

SEQ ID NO: 90688 - DNA, 15 bp, Homo sapiens
cagtcatcacacaat

SEQ ID NO: 90689 - DNA, 15 bp, Homo sapiens
ccagtcatcacacaa

SEQ ID NO: 90690 - DNA, 15 bp, Homo sapiens
tccagtcatcacaca

SEQ ID NO: 90691 - DNA, 15 bp, Homo sapiens
ttccagtcatcacac

SEQ ID NO: 90692 - DNA, 15 bp, Homo sapiens
cttccagtcatcaca

SEQ ID NO: 90693 - DNA, 15 bp, Homo sapiens
acttccagtcatcac

SEQ ID NO: 90694 - DNA, 15 bp, Homo sapiens
cacttccagtcatca

SEQ ID NO: 90695 - DNA, 15 bp, Homo sapiens
acacttccagtcatc

SEQ ID NO: 90696 - DNA, 15 bp, Homo sapiens
gacacttccagtcat

SEQ ID NO: 90697 - DNA, 15 bp, Homo sapiens
agacacttccagtca

SEQ ID NO: 90698 - DNA, 15 bp, Homo sapiens
cagacacttccagtc

SEQ ID NO: 90699 - DNA, 15 bp, Homo sapiens
acagacacttccagt

SEQ ID NO: 90700 - DNA, 15 bp, Homo sapiens
tacagacacttccag

SEQ ID NO: 90701 - DNA, 15 bp, Homo sapiens
atacagacacttcca

SEQ ID NO: 90702 - DNA, 15 bp, Homo sapiens
catacagacacttcc

SEQ ID NO: 90703 - DNA, 15 bp, Homo sapiens
acatacagacacttc

SEQ ID NO: 90704 - DNA, 15 bp, Homo sapiens
cacatacagacactt

SEQ ID NO: 90705 - DNA, 15 bp, Homo sapiens
acacatacagacact

SEQ ID NO: 90706 - DNA, 15 bp, Homo sapiens
cacacatacagacac

SEQ ID NO: 90707 - DNA, 15 bp, Homo sapiens
gcacacatacagaca

SEQ ID NO: 90708 - DNA, 15 bp, Homo sapiens
tgcacacatacagac

SEQ ID NO: 90709 - DNA, 15 bp, Homo sapiens
atgcacacatacaga

SEQ ID NO: 90710 - DNA, 15 bp, Homo sapiens
catgcacacatacag

SEQ ID NO: 90711 - DNA, 15 bp, Homo sapiens
gcatgcacacataca

SEQ ID NO: 90712 - DNA, 15 bp, Homo sapiens
agcatgcacacatac

SEQ ID NO: 90713 - DNA, 15 bp, Homo sapiens
tagcatgcacacata

SEQ ID NO: 90714 - DNA, 15 bp, Homo sapiens
ctagcatgcacacat

SEQ ID NO: 90715 - DNA, 15 bp, Homo sapiens
cctagcatgcacaca

SEQ ID NO: 90716 - DNA, 15 bp, Homo sapiens
gcctagcatgcacac

SEQ ID NO: 90717 - DNA, 15 bp, Homo sapiens
tgcctagcatgcaca

SEQ ID NO: 90718 - DNA, 15 bp, Homo sapiens
ttgcctagcatgcac

SEQ ID NO: 90719 - DNA, 15 bp, Homo sapiens
tttgcctagcatgca

SEQ ID NO: 90720 - DNA, 15 bp, Homo sapiens
atttgcctagcatgc

SEQ ID NO: 90721 - DNA, 15 bp, Homo sapiens
catttgcctagcatg

SEQ ID NO: 90722 - DNA, 15 bp, Homo sapiens
acatttgcctagcat

SEQ ID NO: 90723 - DNA, 15 bp, Homo sapiens
cacatttgcctagca

SEQ ID NO: 90724 - DNA, 15 bp, Homo sapiens
acacatttgcctagc

SEQ ID NO: 90725 - DNA, 15 bp, Homo sapiens
gacacatttgcctag

SEQ ID NO: 90726 - DNA, 15 bp, Homo sapiens
cgacacatttgccta

SEQ ID NO: 90727 - DNA, 15 bp, Homo sapiens
acgacacatttgcct

SEQ ID NO: 90728 - DNA, 15 bp, Homo sapiens
tacgacacatttgcc

SEQ ID NO: 90729 - DNA, 15 bp, Homo sapiens
atacgacacatttgc

SEQ ID NO: 90730 - DNA, 15 bp, Homo sapiens
aatacgacacatttg

SEQ ID NO: 90731 - DNA, 15 bp, Homo sapiens
caatacgacacattt

SEQ ID NO: 90732 - DNA, 15 bp, Homo sapiens
gcaatacgacacatt

SEQ ID NO: 90733 - DNA, 15 bp, Homo sapiens
ggcaatacgacacat

SEQ ID NO: 90734 - DNA, 15 bp, Homo sapiens
aggcaatacgacaca

SEQ ID NO: 90735 - DNA, 15 bp, Homo sapiens
aaggcaatacgacac

SEQ ID NO: 90736 - DNA, 15 bp, Homo sapiens
aaaggcaatacgaca

SEQ ID NO: 90737 - DNA, 15 bp, Homo sapiens
gaaaggcaatacgac

SEQ ID NO: 90738 - DNA, 15 bp, Homo sapiens
agaaaggcaatacga

SEQ ID NO: 90739 - DNA, 15 bp, Homo sapiens
aagaaaggcaatacg

SEQ ID NO: 90740 - DNA, 15 bp, Homo sapiens
gaagaaaggcaatac

SEQ ID NO: 90741 - DNA, 15 bp, Homo sapiens
agaagaaaggcaata

SEQ ID NO: 90742 - DNA, 15 bp, Homo sapiens
cagaagaaaggcaat

SEQ ID NO: 90743 - DNA, 15 bp, Homo sapiens
tcagaagaaaggcaa

SEQ ID NO: 90744 - DNA, 15 bp, Homo sapiens
ttcagaagaaaggca

SEQ ID NO: 90745 - DNA, 15 bp, Homo sapiens
tttcagaagaaaggc

SEQ ID NO: 90746 - DNA, 15 bp, Homo sapiens
ctttcagaagaaagg

SEQ ID NO: 90747 - DNA, 15 bp, Homo sapiens
actttcagaagaaag

SEQ ID NO: 90748 - DNA, 15 bp, Homo sapiens
cactttcagaagaaa

SEQ ID NO: 90749 - DNA, 15 bp, Homo sapiens
gcactttcagaagaa

SEQ ID NO: 90750 - DNA, 15 bp, Homo sapiens
tgcactttcagaaga

SEQ ID NO: 90751 - DNA, 15 bp, Homo sapiens
atgcactttcagaag

SEQ ID NO: 90752 - DNA, 15 bp, Homo sapiens
gatgcactttcagaa

SEQ ID NO: 90753 - DNA, 15 bp, Homo sapiens
agatgcactttcaga

SEQ ID NO: 90754 - DNA, 15 bp, Homo sapiens
cagatgcactttcag

SEQ ID NO: 90755 - DNA, 15 bp, Homo sapiens
ccagatgcactttca

SEQ ID NO: 90756 - DNA, 15 bp, Homo sapiens
tccagatgcactttc

SEQ ID NO: 90757 - DNA, 15 bp, Homo sapiens
gtccagatgcacttt

SEQ ID NO: 90758 - DNA, 15 bp, Homo sapiens
tgtccagatgcactt

SEQ ID NO: 90759 - DNA, 15 bp, Homo sapiens
ctgtccagatgcact

SEQ ID NO: 90760 - DNA, 15 bp, Homo sapiens
gctgtccagatgcac

SEQ ID NO: 90761 - DNA, 15 bp, Homo sapiens
tgctgtccagatgca

SEQ ID NO: 90762 - DNA, 15 bp, Homo sapiens
atgctgtccagatgc

SEQ ID NO: 90763 - DNA, 15 bp, Homo sapiens
catgctgtccagatg

SEQ ID NO: 90764 - DNA, 15 bp, Homo sapiens
acatgctgtccagat

SEQ ID NO: 90765 - DNA, 15 bp, Homo sapiens
gacatgctgtccaga

SEQ ID NO: 90766 - DNA, 15 bp, Homo sapiens
agacatgctgtccag

SEQ ID NO: 90767 - DNA, 15 bp, Homo sapiens
aagacatgctgtcca

SEQ ID NO: 90768 - DNA, 15 bp, Homo sapiens
aaagacatgctgtcc

SEQ ID NO: 90769 - DNA, 15 bp, Homo sapiens
caaagacatgctgtc

SEQ ID NO: 90770 - DNA, 15 bp, Homo sapiens
acaaagacatgctgt

SEQ ID NO: 90771 - DNA, 15 bp, Homo sapiens
aacaaagacatgctg

SEQ ID NO: 90772 - DNA, 15 bp, Homo sapiens
gaacaaagacatgct

SEQ ID NO: 90773 - DNA, 15 bp, Homo sapiens
ggaacaaagacatgc

SEQ ID NO: 90774 - DNA, 15 bp, Homo sapiens
aggaacaaagacatg

SEQ ID NO: 90775 - DNA, 15 bp, Homo sapiens
aaggaacaaagacat

SEQ ID NO: 90776 - DNA, 15 bp, Homo sapiens
caaggaacaaagaca

SEQ ID NO: 90777 - DNA, 15 bp, Homo sapiens
tcaaggaacaaagac

SEQ ID NO: 90778 - DNA, 15 bp, Homo sapiens
ttcaaggaacaaaga

SEQ ID NO: 90779 - DNA, 15 bp, Homo sapiens
attcaaggaacaaag

SEQ ID NO: 90780 - DNA, 15 bp, Homo sapiens
aattcaaggaacaaa

SEQ ID NO: 90781 - DNA, 15 bp, Homo sapiens
gaattcaaggaacaa

SEQ ID NO: 90782 - DNA, 15 bp, Homo sapiens
tgaattcaaggaaca

SEQ ID NO: 90783 - DNA, 15 bp, Homo sapiens
ctgaattcaaggaac

SEQ ID NO: 90784 - DNA, 15 bp, Homo sapiens
actgaattcaaggaa

SEQ ID NO: 90785 - DNA, 15 bp, Homo sapiens
aactgaattcaagga

SEQ ID NO: 90786 - DNA, 15 bp, Homo sapiens
taactgaattcaagg

SEQ ID NO: 90787 - DNA, 15 bp, Homo sapiens
ataactgaattcaag

SEQ ID NO: 90788 - DNA, 15 bp, Homo sapiens
cataactgaattcaa

SEQ ID NO: 90789 - DNA, 15 bp, Homo sapiens
acataactgaattca

SEQ ID NO: 90790 - DNA, 15 bp, Homo sapiens
cacataactgaattc

SEQ ID NO: 90791 - DNA, 15 bp, Homo sapiens
tcacataactgaatt

SEQ ID NO: 90792 - DNA, 15 bp, Homo sapiens
ttcacataactgaat

SEQ ID NO: 90793 - DNA, 15 bp, Homo sapiens
tttcacataactgaa

SEQ ID NO: 90794 - DNA, 15 bp, Homo sapiens
atttcacataactga

SEQ ID NO: 90795 - DNA, 15 bp, Homo sapiens
tatttcacataactg

SEQ ID NO: 90796 - DNA, 15 bp, Homo sapiens
atatttcacataact

SEQ ID NO: 90797 - DNA, 15 bp, Homo sapiens
catatttcacataac

SEQ ID NO: 90798 - DNA, 15 bp, Homo sapiens
acatatttcacataa

SEQ ID NO: 90799 - DNA, 15 bp, Homo sapiens
gacatatttcacata

SEQ ID NO: 90800 - DNA, 15 bp, Homo sapiens
agacatatttcacat

SEQ ID NO: 90801 - DNA, 15 bp, Homo sapiens
aagacatatttcaca

SEQ ID NO: 90802 - DNA, 15 bp, Homo sapiens
aaagacatatttcac

SEQ ID NO: 90803 - DNA, 15 bp, Homo sapiens
caaagacatatttca

SEQ ID NO: 90804 - DNA, 15 bp, Homo sapiens
tcaaagacatatttc

SEQ ID NO: 90805 - DNA, 15 bp, Homo sapiens
ctcaaagacatattt

SEQ ID NO: 90806 - DNA, 15 bp, Homo sapiens
cctcaaagacatatt

SEQ ID NO: 90807 - DNA, 15 bp, Homo sapiens
ccctcaaagacatat

SEQ ID NO: 90808 - DNA, 15 bp, Homo sapiens
accctcaaagacata

SEQ ID NO: 90809 - DNA, 15 bp, Homo sapiens
taccctcaaagacat

SEQ ID NO: 90810 - DNA, 15 bp, Homo sapiens
gtaccctcaaagaca

SEQ ID NO: 90811 - DNA, 15 bp, Homo sapiens
ggtaccctcaaagac

SEQ ID NO: 90812 - DNA, 15 bp, Homo sapiens
aggtaccctcaaaga

SEQ ID NO: 90813 - DNA, 15 bp, Homo sapiens
gaggtaccctcaaag

SEQ ID NO: 90814 - DNA, 15 bp, Homo sapiens
agaggtaccctcaaa

SEQ ID NO: 90815 - DNA, 15 bp, Homo sapiens
aagaggtaccctcaa

SEQ ID NO: 90816 - DNA, 15 bp, Homo sapiens
aaagaggtaccctca

SEQ ID NO: 90817 - DNA, 15 bp, Homo sapiens
gaaagaggtaccctc

SEQ ID NO: 90818 - DNA, 15 bp, Homo sapiens
agaaagaggtaccct

SEQ ID NO: 90819 - DNA, 15 bp, Homo sapiens
gagaaagaggtaccc

SEQ ID NO: 90820 - DNA, 15 bp, Homo sapiens
ggagaaagaggtacc

SEQ ID NO: 90821 - DNA, 15 bp, Homo sapiens
tggagaaagaggtac

SEQ ID NO: 90822 - DNA, 15 bp, Homo sapiens
gtggagaaagaggta

SEQ ID NO: 90823 - DNA, 15 bp, Homo sapiens
agtggagaaagaggt

SEQ ID NO: 90824 - DNA, 15 bp, Homo sapiens
aagtggagaaagagg

SEQ ID NO: 90825 - DNA, 15 bp, Homo sapiens
taagtggagaaagag

SEQ ID NO: 90826 - DNA, 15 bp, Homo sapiens
ataagtggagaaaga

SEQ ID NO: 90827 - DNA, 15 bp, Homo sapiens
aataagtggagaaag

SEQ ID NO: 90828 - DNA, 15 bp, Homo sapiens
caataagtggagaaa

SEQ ID NO: 90829 - DNA, 15 bp, Homo sapiens
ccaataagtggagaa

SEQ ID NO: 90830 - DNA, 15 bp, Homo sapiens
accaataagtggaga

SEQ ID NO: 90831 - DNA, 15 bp, Homo sapiens
taccaataagtggag

SEQ ID NO: 90832 - DNA, 15 bp, Homo sapiens
gtaccaataagtgga

SEQ ID NO: 90833 - DNA, 15 bp, Homo sapiens
tgtaccaataagtgg

SEQ ID NO: 90834 - DNA, 15 bp, Homo sapiens
ttgtaccaataagtg

SEQ ID NO: 90835 - DNA, 15 bp, Homo sapiens
cttgtaccaataagt

SEQ ID NO: 90836 - DNA, 15 bp, Homo sapiens
gcttgtaccaataag

SEQ ID NO: 90837 - DNA, 15 bp, Homo sapiens
agcttgtaccaataa

SEQ ID NO: 90838 - DNA, 15 bp, Homo sapiens
cagcttgtaccaata

SEQ ID NO: 90839 - DNA, 15 bp, Homo sapiens
acagcttgtaccaat

SEQ ID NO: 90840 - DNA, 15 bp, Homo sapiens
cacagcttgtaccaa

SEQ ID NO: 90841 - DNA, 15 bp, Homo sapiens
gcacagcttgtacca

SEQ ID NO: 90842 - DNA, 15 bp, Homo sapiens
agcacagcttgtacc

SEQ ID NO: 90843 - DNA, 15 bp, Homo sapiens
aagcacagcttgtac

SEQ ID NO: 90844 - DNA, 15 bp, Homo sapiens
aaagcacagcttgta

SEQ ID NO: 90845 - DNA, 15 bp, Homo sapiens
gaaagcacagcttgt

SEQ ID NO: 90846 - DNA, 15 bp, Homo sapiens
tgaaagcacagcttg

SEQ ID NO: 90847 - DNA, 15 bp, Homo sapiens
gtgaaagcacagctt

SEQ ID NO: 90848 - DNA, 15 bp, Homo sapiens
agtgaaagcacagct

SEQ ID NO: 90849 - DNA, 15 bp, Homo sapiens
aagtgaaagcacagc

SEQ ID NO: 90850 - DNA, 15 bp, Homo sapiens
aaagtgaaagcacag

SEQ ID NO: 90851 - DNA, 15 bp, Homo sapiens
aaaagtgaaagcaca

SEQ ID NO: 90852 - DNA, 15 bp, Homo sapiens
caaaagtgaaagcac

SEQ ID NO: 90853 - DNA, 15 bp, Homo sapiens
tcaaaagtgaaagca

SEQ ID NO: 90854 - DNA, 15 bp, Homo sapiens
gtcaaaagtgaaagc

SEQ ID NO: 90855 - DNA, 15 bp, Homo sapiens
tgtcaaaagtgaaag

SEQ ID NO: 90856 - DNA, 15 bp, Homo sapiens
ttgtcaaaagtgaaa

SEQ ID NO: 90857 - DNA, 15 bp, Homo sapiens
cttgtcaaaagtgaa

SEQ ID NO: 90858 - DNA, 15 bp, Homo sapiens
ccttgtcaaaagtga

SEQ ID NO: 90859 - DNA, 15 bp, Homo sapiens
tccttgtcaaaagtg

SEQ ID NO: 90860 - DNA, 15 bp, Homo sapiens
atccttgtcaaaagt

SEQ ID NO: 90861 - DNA, 15 bp, Homo sapiens
gatccttgtcaaaag

SEQ ID NO: 90862 - DNA, 15 bp, Homo sapiens
tgatccttgtcaaaa

SEQ ID NO: 90863 - DNA, 15 bp, Homo sapiens
ctgatccttgtcaaa

SEQ ID NO: 90864 - DNA, 15 bp, Homo sapiens
actgatccttgtcaa

SEQ ID NO: 90865 - DNA, 15 bp, Homo sapiens
tactgatccttgtca

SEQ ID NO: 90866 - DNA, 15 bp, Homo sapiens
ctactgatccttgtc

SEQ ID NO: 90867 - DNA, 15 bp, Homo sapiens
cctactgatccttgt

SEQ ID NO: 90868 - DNA, 15 bp, Homo sapiens
gcctactgatccttg

SEQ ID NO: 90869 - DNA, 15 bp, Homo sapiens
tgcctactgatcctt

SEQ ID NO: 90870 - DNA, 15 bp, Homo sapiens
ctgcctactgatcct

SEQ ID NO: 90871 - DNA, 15 bp, Homo sapiens
actgcctactgatcc

SEQ ID NO: 90872 - DNA, 15 bp, Homo sapiens
aactgcctactgatc

SEQ ID NO: 90873 - DNA, 15 bp, Homo sapiens
aaactgcctactgat

SEQ ID NO: 90874 - DNA, 15 bp, Homo sapiens
taaactgcctactga

SEQ ID NO: 90875 - DNA, 15 bp, Homo sapiens
ttaaactgcctactg

SEQ ID NO: 90876 - DNA, 15 bp, Homo sapiens
gttaaactgcctact

SEQ ID NO: 90877 - DNA, 15 bp, Homo sapiens
agttaaactgcctac

SEQ ID NO: 90878 - DNA, 15 bp, Homo sapiens
aagttaaactgccta

SEQ ID NO: 90879 - DNA, 15 bp, Homo sapiens
aaagttaaactgcct

SEQ ID NO: 90880 - DNA, 15 bp, Homo sapiens
aaaagttaaactgcc

SEQ ID NO: 90881 - DNA, 15 bp, Homo sapiens
caaaagttaaactgc

SEQ ID NO: 90882 - DNA, 15 bp, Homo sapiens
gcaaaagttaaactg

SEQ ID NO: 90883 - DNA, 15 bp, Homo sapiens
agcaaaagttaaact

SEQ ID NO: 90884 - DNA, 15 bp, Homo sapiens
cagcaaaagttaaac

SEQ ID NO: 90885 - DNA, 15 bp, Homo sapiens
gcagcaaaagttaaa

SEQ ID NO: 90886 - DNA, 15 bp, Homo sapiens
agcagcaaaagttaa

SEQ ID NO: 90887 - DNA, 15 bp, Homo sapiens
tagcagcaaaagtta

SEQ ID NO: 90888 - DNA, 15 bp, Homo sapiens
ctagcagcaaaagtt

SEQ ID NO: 90889 - DNA, 15 bp, Homo sapiens
actagcagcaaaagt

SEQ ID NO: 90890 - DNA, 15 bp, Homo sapiens
aactagcagcaaaag

SEQ ID NO: 90891 - DNA, 15 bp, Homo sapiens
caactagcagcaaaa

SEQ ID NO: 90892 - DNA, 15 bp, Homo sapiens
ccaactagcagcaaa

SEQ ID NO: 90893 - DNA, 15 bp, Homo sapiens
accaactagcagcaa

SEQ ID NO: 90894 - DNA, 15 bp, Homo sapiens
aaccaactagcagca

SEQ ID NO: 90895 - DNA, 15 bp, Homo sapiens
aaaccaactagcagc

SEQ ID NO: 90896 - DNA, 15 bp, Homo sapiens
gaaaccaactagcag

SEQ ID NO: 90897 - DNA, 15 bp, Homo sapiens
tgaaaccaactagca

SEQ ID NO: 90898 - DNA, 15 bp, Homo sapiens
gtgaaaccaactagc

SEQ ID NO: 90899 - DNA, 15 bp, Homo sapiens
ggtgaaaccaactag

SEQ ID NO: 90900 - DNA, 15 bp, Homo sapiens
aggtgaaaccaacta

SEQ ID NO: 90901 - DNA, 15 bp, Homo sapiens
gaggtgaaaccaact

SEQ ID NO: 90902 - DNA, 15 bp, Homo sapiens
agaggtgaaaccaac

SEQ ID NO: 90903 - DNA, 15 bp, Homo sapiens
aagaggtgaaaccaa

SEQ ID NO: 90904 - DNA, 15 bp, Homo sapiens
aaagaggtgaaacca

SEQ ID NO: 90905 - DNA, 15 bp, Homo sapiens
caaagaggtgaaacc

SEQ ID NO: 90906 - DNA, 15 bp, Homo sapiens
acaaagaggtgaaac

SEQ ID NO: 90907 - DNA, 15 bp, Homo sapiens
cacaaagaggtgaaa

SEQ ID NO: 90908 - DNA, 15 bp, Homo sapiens
gcacaaagaggtgaa

SEQ ID NO: 90909 - DNA, 15 bp, Homo sapiens
agcacaaagaggtga

SEQ ID NO: 90910 - DNA, 15 bp, Homo sapiens
aagcacaaagaggtg

SEQ ID NO: 90911 - DNA, 15 bp, Homo sapiens
gaagcacaaagaggt

SEQ ID NO: 90912 - DNA, 15 bp, Homo sapiens
tgaagcacaaagagg

SEQ ID NO: 90913 - DNA, 15 bp, Homo sapiens
ttgaagcacaaagag

SEQ ID NO: 90914 - DNA, 15 bp, Homo sapiens
cttgaagcacaaaga

SEQ ID NO: 90915 - DNA, 15 bp, Homo sapiens
tcttgaagcacaaag

SEQ ID NO: 90916 - DNA, 15 bp, Homo sapiens
ctcttgaagcacaaa

SEQ ID NO: 90917 - DNA, 15 bp, Homo sapiens
tctcttgaagcacaa

SEQ ID NO: 90918 - DNA, 15 bp, Homo sapiens
ttctcttgaagcaca

SEQ ID NO: 90919 - DNA, 15 bp, Homo sapiens
gttctcttgaagcac

SEQ ID NO: 90920 - DNA, 15 bp, Homo sapiens
agttctcttgaagca

SEQ ID NO: 90921 - DNA, 15 bp, Homo sapiens
gagttctcttgaagc

SEQ ID NO: 90922 - DNA, 15 bp, Homo sapiens
tgagttctcttgaag

SEQ ID NO: 90923 - DNA, 15 bp, Homo sapiens
gtgagttctcttgaa

SEQ ID NO: 90924 - DNA, 15 bp, Homo sapiens
agtgagttctcttga

SEQ ID NO: 90925 - DNA, 15 bp, Homo sapiens
aagtgagttctcttg

SEQ ID NO: 90926 - DNA, 15 bp, Homo sapiens
gaagtgagttctctt

SEQ ID NO: 90927 - DNA, 15 bp, Homo sapiens
ggaagtgagttctct

SEQ ID NO: 90928 - DNA, 15 bp, Homo sapiens
aggaagtgagttctc

SEQ ID NO: 90929 - DNA, 15 bp, Homo sapiens
aaggaagtgagttct

SEQ ID NO: 90930 - DNA, 15 bp, Homo sapiens
aaaggaagtgagttc

SEQ ID NO: 90931 - DNA, 15 bp, Homo sapiens
gaaaggaagtgagtt

SEQ ID NO: 90932 - DNA, 15 bp, Homo sapiens
ggaaaggaagtgagt

SEQ ID NO: 90933 - DNA, 15 bp, Homo sapiens
tggaaaggaagtgag

SEQ ID NO: 90934 - DNA, 15 bp, Homo sapiens
gtggaaaggaagtga

SEQ ID NO: 90935 - DNA, 15 bp, Homo sapiens
cgtggaaaggaagtg

SEQ ID NO: 90936 - DNA, 15 bp, Homo sapiens
gcgtggaaaggaagt

SEQ ID NO: 90937 - DNA, 15 bp, Homo sapiens
tgcgtggaaaggaag

SEQ ID NO: 90938 - DNA, 15 bp, Homo sapiens
ttgcgtggaaaggaa

SEQ ID NO: 90939 - DNA, 15 bp, Homo sapiens
cttgcgtggaaagga

SEQ ID NO: 90940 - DNA, 15 bp, Homo sapiens
acttgcgtggaaagg

SEQ ID NO: 90941 - DNA, 15 bp, Homo sapiens
cacttgcgtggaaag

SEQ ID NO: 90942 - DNA, 15 bp, Homo sapiens
acacttgcgtggaaa

SEQ ID NO: 90943 - DNA, 15 bp, Homo sapiens
aacacttgcgtggaa

SEQ ID NO: 90944 - DNA, 15 bp, Homo sapiens
taacacttgcgtgga

SEQ ID NO: 90945 - DNA, 15 bp, Homo sapiens
gtaacacttgcgtgg

SEQ ID NO: 90946 - DNA, 15 bp, Homo sapiens
agtaacacttgcgtg

SEQ ID NO: 90947 - DNA, 15 bp, Homo sapiens
aagtaacacttgcgt

SEQ ID NO: 90948 - DNA, 15 bp, Homo sapiens
gaagtaacacttgcg

SEQ ID NO: 90949 - DNA, 15 bp, Homo sapiens
agaagtaacacttgc

SEQ ID NO: 90950 - DNA, 15 bp, Homo sapiens
cagaagtaacacttg

SEQ ID NO: 90951 - DNA, 15 bp, Homo sapiens
acagaagtaacactt

SEQ ID NO: 90952 - DNA, 15 bp, Homo sapiens
cacagaagtaacact

SEQ ID NO: 90953 - DNA, 15 bp, Homo sapiens
tcacagaagtaacac

SEQ ID NO: 90954 - DNA, 15 bp, Homo sapiens
atcacagaagtaaca

SEQ ID NO: 90955 - DNA, 15 bp, Homo sapiens
tatcacagaagtaac

SEQ ID NO: 90956 - DNA, 15 bp, Homo sapiens
atatcacagaagtaa

SEQ ID NO: 90957 - DNA, 15 bp, Homo sapiens
aatatcacagaagta

SEQ ID NO: 90958 - DNA, 15 bp, Homo sapiens
aaatatcacagaagt

SEQ ID NO: 90959 - DNA, 15 bp, Homo sapiens
aaaatatcacagaag

SEQ ID NO: 90960 - DNA, 15 bp, Homo sapiens
aaaaatatcacagaa

SEQ ID NO: 90961 - DNA, 15 bp, Homo sapiens
taaaaatatcacaga

SEQ ID NO: 90962 - DNA, 15 bp, Homo sapiens
gtaaaaatatcacag

SEQ ID NO: 90963 - DNA, 15 bp, Homo sapiens
tgtaaaaatatcaca

SEQ ID NO: 90964 - DNA, 15 bp, Homo sapiens
atgtaaaaatatcac

SEQ ID NO: 90965 - DNA, 15 bp, Homo sapiens
aatgtaaaaatatca

SEQ ID NO: 90966 - DNA, 15 bp, Homo sapiens
taatgtaaaaatatc

SEQ ID NO: 90967 - DNA, 15 bp, Homo sapiens
ctaatgtaaaaatat

SEQ ID NO: 90968 - DNA, 15 bp, Homo sapiens
actaatgtaaaaata

SEQ ID NO: 90969 - DNA, 15 bp, Homo sapiens
cactaatgtaaaaat

SEQ ID NO: 90970 - DNA, 15 bp, Homo sapiens
tcactaatgtaaaaa

SEQ ID NO: 90971 - DNA, 15 bp, Homo sapiens
gtcactaatgtaaaa

SEQ ID NO: 90972 - DNA, 15 bp, Homo sapiens
agtcactaatgtaaa

SEQ ID NO: 90973 - DNA, 15 bp, Homo sapiens
cagtcactaatgtaa

SEQ ID NO: 90974 - DNA, 15 bp, Homo sapiens
tcagtcactaatgta

SEQ ID NO: 90975 - DNA, 15 bp, Homo sapiens
ctcagtcactaatgt

SEQ ID NO: 90976 - DNA, 15 bp, Homo sapiens
cctcagtcactaatg

SEQ ID NO: 90977 - DNA, 15 bp, Homo sapiens
acctcagtcactaat

SEQ ID NO: 90978 - DNA, 15 bp, Homo sapiens
tacctcagtcactaa

SEQ ID NO: 90979 - DNA, 15 bp, Homo sapiens
ctacctcagtcacta

SEQ ID NO: 90980 - DNA, 15 bp, Homo sapiens
tctacctcagtcact

SEQ ID NO: 90981 - DNA, 15 bp, Homo sapiens
gtctacctcagtcac

SEQ ID NO: 90982 - DNA, 15 bp, Homo sapiens
tgtctacctcagtca

SEQ ID NO: 90983 - DNA, 15 bp, Homo sapiens
gtgtctacctcagtc

SEQ ID NO: 90984 - DNA, 15 bp, Homo sapiens
agtgtctacctcagt

SEQ ID NO: 90985 - DNA, 15 bp, Homo sapiens
cagtgtctacctcag

SEQ ID NO: 90986 - DNA, 15 bp, Homo sapiens
acagtgtctacctca

SEQ ID NO: 90987 - DNA, 15 bp, Homo sapiens
aacagtgtctacctc

SEQ ID NO: 90988 - DNA, 15 bp, Homo sapiens
gaacagtgtctacct

SEQ ID NO: 90989 - DNA, 15 bp, Homo sapiens
ggaacagtgtctacc

SEQ ID NO: 90990 - DNA, 15 bp, Homo sapiens
tggaacagtgtctac

SEQ ID NO: 90991 - DNA, 15 bp, Homo sapiens
ctggaacagtgtcta

SEQ ID NO: 90992 - DNA, 15 bp, Homo sapiens
gctggaacagtgtct

SEQ ID NO: 90993 - DNA, 15 bp, Homo sapiens
agctggaacagtgtc

SEQ ID NO: 90994 - DNA, 15 bp, Homo sapiens
cagctggaacagtgt

SEQ ID NO: 90995 - DNA, 15 bp, Homo sapiens
ccagctggaacagtg

SEQ ID NO: 90996 - DNA, 15 bp, Homo sapiens
gccagctggaacagt

SEQ ID NO: 90997 - DNA, 15 bp, Homo sapiens
agccagctggaacag

SEQ ID NO: 90998 - DNA, 15 bp, Homo sapiens
cagccagctggaaca

SEQ ID NO: 90999 - DNA, 15 bp, Homo sapiens
acagccagctggaac

SEQ ID NO: 91000 - DNA, 15 bp, Homo sapiens
aacagccagctggaa

SEQ ID NO: 91001 - DNA, 15 bp, Homo sapiens
gaacagccagctgga

SEQ ID NO: 91002 - DNA, 15 bp, Homo sapiens
tgaacagccagctgg

SEQ ID NO: 91003 - DNA, 15 bp, Homo sapiens
ctgaacagccagctg

SEQ ID NO: 91004 - DNA, 15 bp, Homo sapiens
actgaacagccagct

SEQ ID NO: 91005 - DNA, 15 bp, Homo sapiens
gactgaacagccagc

SEQ ID NO: 91006 - DNA, 15 bp, Homo sapiens
tgactgaacagccag

SEQ ID NO: 91007 - DNA, 15 bp, Homo sapiens
atgactgaacagcca

SEQ ID NO: 91008 - DNA, 15 bp, Homo sapiens
aatgactgaacagcc

SEQ ID NO: 91009 - DNA, 15 bp, Homo sapiens
taatgactgaacagc

SEQ ID NO: 91010 - DNA, 15 bp, Homo sapiens
ataatgactgaacag

SEQ ID NO: 91011 - DNA, 15 bp, Homo sapiens
aataatgactgaaca

SEQ ID NO: 91012 - DNA, 15 bp, Homo sapiens
aaataatgactgaac

SEQ ID NO: 91013 - DNA, 15 bp, Homo sapiens
gaaataatgactgaa

SEQ ID NO: 91014 - DNA, 15 bp, Homo sapiens
agaaataatgactga

SEQ ID NO: 91015 - DNA, 15 bp, Homo sapiens
gagaaataatgactg

SEQ ID NO: 91016 - DNA, 15 bp, Homo sapiens
tgagaaataatgact

SEQ ID NO: 91017 - DNA, 15 bp, Homo sapiens
ctgagaaataatgac

SEQ ID NO: 91018 - DNA, 15 bp, Homo sapiens
cctgagaaataatga

SEQ ID NO: 91019 - DNA, 15 bp, Homo sapiens
ccctgagaaataatg

SEQ ID NO: 91020 - DNA, 15 bp, Homo sapiens
accctgagaaataat

SEQ ID NO: 91021 - DNA, 15 bp, Homo sapiens
taccctgagaaataa

SEQ ID NO: 91022 - DNA, 15 bp, Homo sapiens
gtaccctgagaaata

SEQ ID NO: 91023 - DNA, 15 bp, Homo sapiens
ggtaccctgagaaat

SEQ ID NO: 91024 - DNA, 15 bp, Homo sapiens
aggtaccctgagaaa

SEQ ID NO: 91025 - DNA, 15 bp, Homo sapiens
caggtaccctgagaa

SEQ ID NO: 91026 - DNA, 15 bp, Homo sapiens
ccaggtaccctgaga

SEQ ID NO: 91027 - DNA, 15 bp, Homo sapiens
cccaggtaccctgag

SEQ ID NO: 91028 - DNA, 15 bp, Homo sapiens
gcccaggtaccctga

SEQ ID NO: 91029 - DNA, 15 bp, Homo sapiens
tgcccaggtaccctg

SEQ ID NO: 91030 - DNA, 15 bp, Homo sapiens
ctgcccaggtaccct

SEQ ID NO: 91031 - DNA, 15 bp, Homo sapiens
gctgcccaggtaccc

SEQ ID NO: 91032 - DNA, 15 bp, Homo sapiens
tgctgcccaggtacc

SEQ ID NO: 91033 - DNA, 15 bp, Homo sapiens
atgctgcccaggtac

SEQ ID NO: 91034 - DNA, 15 bp, Homo sapiens
catgctgcccaggta

SEQ ID NO: 91035 - DNA, 15 bp, Homo sapiens
ccatgctgcccaggt

SEQ ID NO: 91036 - DNA, 15 bp, Homo sapiens
accatgctgcccagg

SEQ ID NO: 91037 - DNA, 15 bp, Homo sapiens
caccatgctgcccag

SEQ ID NO: 91038 - DNA, 15 bp, Homo sapiens
ccaccatgctgccca

SEQ ID NO: 91039 - DNA, 15 bp, Homo sapiens
gccaccatgctgccc

SEQ ID NO: 91040 - DNA, 15 bp, Homo sapiens
tgccaccatgctgcc

SEQ ID NO: 91041 - DNA, 15 bp, Homo sapiens
ctgccaccatgctgc

SEQ ID NO: 91042 - DNA, 15 bp, Homo sapiens
actgccaccatgctg

SEQ ID NO: 91043 - DNA, 15 bp, Homo sapiens
tactgccaccatgct

SEQ ID NO: 91044 - DNA, 15 bp, Homo sapiens
atactgccaccatgc

SEQ ID NO: 91045 - DNA, 15 bp, Homo sapiens
aatactgccaccatg

SEQ ID NO: 91046 - DNA, 15 bp, Homo sapiens
aaatactgccaccat

SEQ ID NO: 91047 - DNA, 15 bp, Homo sapiens
gaaatactgccacca

SEQ ID NO: 91048 - DNA, 15 bp, Homo sapiens
ggaaatactgccacc

SEQ ID NO: 91049 - DNA, 15 bp, Homo sapiens
tggaaatactgccac

SEQ ID NO: 91050 - DNA, 15 bp, Homo sapiens
atggaaatactgcca

SEQ ID NO: 91051 - DNA, 15 bp, Homo sapiens
tatggaaatactgcc

SEQ ID NO: 91052 - DNA, 15 bp, Homo sapiens
atatggaaatactgc

SEQ ID NO: 91053 - DNA, 15 bp, Homo sapiens
tatatggaaatactg

SEQ ID NO: 91054 - DNA, 15 bp, Homo sapiens
ttatatggaaatact

SEQ ID NO: 91055 - DNA, 15 bp, Homo sapiens
attatatggaaatac

SEQ ID NO: 91056 - DNA, 15 bp, Homo sapiens
gattatatggaaata

SEQ ID NO: 91057 - DNA, 15 bp, Homo sapiens
agattatatggaaat

SEQ ID NO: 91058 - DNA, 15 bp, Homo sapiens
gagattatatggaaa

SEQ ID NO: 91059 - DNA, 15 bp, Homo sapiens
ggaggagattatatg

SEQ ID NO: 91060 - DNA, 15 bp, Homo sapiens
tggaggagattatat

SEQ ID NO: 91061 - DNA, 15 bp, Homo sapiens
gtggaggagattata

SEQ ID NO: 91062 - DNA, 15 bp, Homo sapiens
agtggaggagattat

SEQ ID NO: 91063 - DNA, 15 bp, Homo sapiens
gagtggaggagatta

SEQ ID NO: 91064 - DNA, 15 bp, Homo sapiens
agagtggaggagatt

SEQ ID NO: 91065 - DNA, 15 bp, Homo sapiens
cagagtggaggagat

SEQ ID NO: 91066 - DNA, 15 bp, Homo sapiens
ccagagtggaggaga

SEQ ID NO: 91067 - DNA, 15 bp, Homo sapiens
tccagagtggaggag

SEQ ID NO: 91068 - DNA, 15 bp, Homo sapiens
gtccagagtggagga

SEQ ID NO: 91069 - DNA, 15 bp, Homo sapiens
ggtccagagtggagg

SEQ ID NO: 91070 - DNA, 15 bp, Homo sapiens
aggtccagagtggag

SEQ ID NO: 91071 - DNA, 15 bp, Homo sapiens
caggtccagagtgga

SEQ ID NO: 91072 - DNA, 15 bp, Homo sapiens
ccaggtccagagtgg

SEQ ID NO: 91073 - DNA, 15 bp, Homo sapiens
cccaggtccagagtg

SEQ ID NO: 91074 - DNA, 15 bp, Homo sapiens
acccaggtccagagt

SEQ ID NO: 91075 - DNA, 15 bp, Homo sapiens
aacccaggtccagag

SEQ ID NO: 91076 - DNA, 15 bp, Homo sapiens
aaacccaggtccaga

SEQ ID NO: 91077 - DNA, 15 bp, Homo sapiens
caaacccaggtccag

SEQ ID NO: 91078 - DNA, 15 bp, Homo sapiens
acaaacccaggtcca

SEQ ID NO: 91079 - DNA, 15 bp, Homo sapiens
gacaaacccaggtcc

SEQ ID NO: 91080 - DNA, 15 bp, Homo sapiens
agacaaacccaggtc

SEQ ID NO: 91081 - DNA, 15 bp, Homo sapiens
tagacaaacccaggt

SEQ ID NO: 91082 - DNA, 15 bp, Homo sapiens
gtagacaaacccagg

SEQ ID NO: 91083 - DNA, 15 bp, Homo sapiens
tgtagacaaacccag

SEQ ID NO: 91084 - DNA, 15 bp, Homo sapiens
gtgtagacaaaccca

SEQ ID NO: 91085 - DNA, 15 bp, Homo sapiens
cgtgtagacaaaccc

SEQ ID NO: 91086 - DNA, 15 bp, Homo sapiens
ccgtgtagacaaacc

SEQ ID NO: 91087 - DNA, 15 bp, Homo sapiens
accgtgtagacaaac

SEQ ID NO: 91088 - DNA, 15 bp, Homo sapiens
caccgtgtagacaaa

SEQ ID NO: 91089 - DNA, 15 bp, Homo sapiens
ccaccgtgtagacaa

SEQ ID NO: 91090 - DNA, 15 bp, Homo sapiens
tccaccgtgtagaca

SEQ ID NO: 91091 - DNA, 15 bp, Homo sapiens
ctccaccgtgtagac

SEQ ID NO: 91092 - DNA, 15 bp, Homo sapiens
gctccaccgtgtaga

SEQ ID NO: 91093 - DNA, 15 bp, Homo sapiens
agctccaccgtgtag

SEQ ID NO: 91094 - DNA, 15 bp, Homo sapiens
aagctccaccgtgta

SEQ ID NO: 91095 - DNA, 15 bp, Homo sapiens
taagctccaccgtgt

SEQ ID NO: 91096 - DNA, 15 bp, Homo sapiens
gtaagctccaccgtg

SEQ ID NO: 91097 - DNA, 15 bp, Homo sapiens
tgtaagctccaccgt

SEQ ID NO: 91098 - DNA, 15 bp, Homo sapiens
ctgtaagctccaccg

SEQ ID NO: 91099 - DNA, 15 bp, Homo sapiens
gctgtaagctccacc

SEQ ID NO: 91100 - DNA, 15 bp, Homo sapiens
tgctgtaagctccac

SEQ ID NO: 91101 - DNA, 15 bp, Homo sapiens
ttgctgtaagctcca

SEQ ID NO: 91102 - DNA, 15 bp, Homo sapiens
cttgctgtaagctcc

SEQ ID NO: 91103 - DNA, 15 bp, Homo sapiens
tcttgctgtaagctc

SEQ ID NO: 91104 - DNA, 15 bp, Homo sapiens
gtcttgctgtaagct

SEQ ID NO: 91105 - DNA, 15 bp, Homo sapiens
agtcttgctgtaagc

SEQ ID NO: 91106 - DNA, 15 bp, Homo sapiens
cagtcttgctgtaag

SEQ ID NO: 91107 - DNA, 15 bp, Homo sapiens
ccagtcttgctgtaa

SEQ ID NO: 91108 - DNA, 15 bp, Homo sapiens
accagtcttgctgta

SEQ ID NO: 91109 - DNA, 15 bp, Homo sapiens
aaccagtcttgctgt

SEQ ID NO: 91110 - DNA, 15 bp, Homo sapiens
caaccagtcttgctg

SEQ ID NO: 91111 - DNA, 15 bp, Homo sapiens
tcaaccagtcttgct

SEQ ID NO: 91112 - DNA, 15 bp, Homo sapiens
ttcaaccagtcttgc

SEQ ID NO: 91113 - DNA, 15 bp, Homo sapiens
cttcaaccagtcttg

SEQ ID NO: 91114 - DNA, 15 bp, Homo sapiens
ccttcaaccagtctt

SEQ ID NO: 91115 - DNA, 15 bp, Homo sapiens
cccttcaaccagtct

SEQ ID NO: 91116 - DNA, 15 bp, Homo sapiens
tcccttcaaccagtc

SEQ ID NO: 91117 - DNA, 15 bp, Homo sapiens
atcccttcaaccagt

SEQ ID NO: 91118 - DNA, 15 bp, Homo sapiens
gatcccttcaaccag

SEQ ID NO: 91119 - DNA, 15 bp, Homo sapiens
agatcccttcaacca

SEQ ID NO: 91120 - DNA, 15 bp, Homo sapiens
aagatcccttcaacc

SEQ ID NO: 91121 - DNA, 15 bp, Homo sapiens
aaagatcccttcaac

SEQ ID NO: 91122 - DNA, 15 bp, Homo sapiens
caaagatcccttcaa

SEQ ID NO: 91123 - DNA, 15 bp, Homo sapiens
acaaagatcccttca

SEQ ID NO: 91124 - DNA, 15 bp, Homo sapiens
aacaaagatcccttc

SEQ ID NO: 91125 - DNA, 15 bp, Homo sapiens
aaacaaagatccctt

SEQ ID NO: 91126 - DNA, 15 bp, Homo sapiens
aaaacaaagatccct

SEQ ID NO: 91127 - DNA, 15 bp, Homo sapiens
gaaaacaaagatccc

SEQ ID NO: 91128 - DNA, 15 bp, Homo sapiens
agaaaacaaagatcc

SEQ ID NO: 91129 - DNA, 15 bp, Homo sapiens
aagaaaacaaagatc

SEQ ID NO: 91130 - DNA, 15 bp, Homo sapiens
aaagaaaacaaagat

SEQ ID NO: 91131 - DNA, 15 bp, Homo sapiens
aaaagaaaacaaaga

SEQ ID NO: 91132 - DNA, 15 bp, Homo sapiens
taaaagaaaacaaag

SEQ ID NO: 91133 - DNA, 15 bp, Homo sapiens
ataaaagaaaacaaa

SEQ ID NO: 91134 - DNA, 15 bp, Homo sapiens
aataaaagaaaacaa

SEQ ID NO: 91135 - DNA, 15 bp, Homo sapiens
gaataaaagaaaaca

SEQ ID NO: 91136 - DNA, 15 bp, Homo sapiens
agaataaaagaaaac

SEQ ID NO: 91137 - DNA, 15 bp, Homo sapiens
aagaataaaagaaaa

SEQ ID NO: 91138 - DNA, 15 bp, Homo sapiens
aaagaataaaagaaa

SEQ ID NO: 91139 - DNA, 15 bp, Homo sapiens
caaagaataaaagaa

SEQ ID NO: 91140 - DNA, 15 bp, Homo sapiens
acaaagaataaaaga

SEQ ID NO: 91141 - DNA, 15 bp, Homo sapiens
cacaaagaataaaag

SEQ ID NO: 91142 - DNA, 15 bp, Homo sapiens
acacaaagaataaaa

SEQ ID NO: 91143 - DNA, 15 bp, Homo sapiens
tacacaaagaataaa

SEQ ID NO: 91144 - DNA, 15 bp, Homo sapiens
ctacacaaagaataa

SEQ ID NO: 91145 - DNA, 15 bp, Homo sapiens
gctacacaaagaata

SEQ ID NO: 91146 - DNA, 15 bp, Homo sapiens
agctacacaaagaat

SEQ ID NO: 91147 - DNA, 15 bp, Homo sapiens
cagctacacaaagaa

SEQ ID NO: 91148 - DNA, 15 bp, Homo sapiens
acagctacacaaaga

SEQ ID NO: 91149 - DNA, 15 bp, Homo sapiens
aacagctacacaaag

SEQ ID NO: 91150 - DNA, 15 bp, Homo sapiens
taacagctacacaaa

SEQ ID NO: 91151 - DNA, 15 bp, Homo sapiens
ttaacagctacacaa

SEQ ID NO: 91152 - DNA, 15 bp, Homo sapiens
cttaacagctacaca

SEQ ID NO: 91153 - DNA, 15 bp, Homo sapiens
ccttaacagctacac

SEQ ID NO: 91154 - DNA, 15 bp, Homo sapiens
tccttaacagctaca

SEQ ID NO: 91155 - DNA, 15 bp, Homo sapiens
ttccttaacagctac

SEQ ID NO: 91156 - DNA, 15 bp, Homo sapiens
cttccttaacagcta

SEQ ID NO: 91157 - DNA, 15 bp, Homo sapiens
tcttccttaacagct

SEQ ID NO: 91158 - DNA, 15 bp, Homo sapiens
ctcttccttaacagc

SEQ ID NO: 91159 - DNA, 15 bp, Homo sapiens
cctcttccttaacag

SEQ ID NO: 91160 - DNA, 15 bp, Homo sapiens
tcctcttccttaaca

SEQ ID NO: 91161 - DNA, 15 bp, Homo sapiens
ctcctcttccttaac

SEQ ID NO: 91162 - DNA, 15 bp, Homo sapiens
tctcctcttccttaa

SEQ ID NO: 91163 - DNA, 15 bp, Homo sapiens
atctcctcttcctta

SEQ ID NO: 91164 - DNA, 15 bp, Homo sapiens
aatctcctcttcctt

SEQ ID NO: 91165 - DNA, 15 bp, Homo sapiens
taatctcctcttcct

SEQ ID NO: 91166 - DNA, 15 bp, Homo sapiens
ataatctcctcttcc

SEQ ID NO: 91167 - DNA, 15 bp, Homo sapiens
tataatctcctcttc

SEQ ID NO: 91168 - DNA, 15 bp, Homo sapiens
atataatctcctctt

SEQ ID NO: 91169 - DNA, 15 bp, Homo sapiens
catataatctcctct

SEQ ID NO: 91170 - DNA, 15 bp, Homo sapiens
gttccatataatctc

SEQ ID NO: 91171 - DNA, 15 bp, Homo sapiens
tgttccatataatct

SEQ ID NO: 91172 - DNA, 15 bp, Homo sapiens
ttgttccatataatc

SEQ ID NO: 91173 - DNA, 15 bp, Homo sapiens
tttgttccatataat

SEQ ID NO: 91174 - DNA, 15 bp, Homo sapiens
ttttgttccatataa

SEQ ID NO: 91175 - DNA, 15 bp, Homo sapiens
cttttgttccatata

SEQ ID NO: 91176 - DNA, 15 bp, Homo sapiens
ccttttgttccatat

SEQ ID NO: 91177 - DNA, 15 bp, Homo sapiens
cccttttgttccata

SEQ ID NO: 91178 - DNA, 15 bp, Homo sapiens
tcccttttgttccat

SEQ ID NO: 91179 - DNA, 15 bp, Homo sapiens
gtcccttttgttcca

SEQ ID NO: 91180 - DNA, 15 bp, Homo sapiens
tgtcccttttgttcc

SEQ ID NO: 91181 - DNA, 15 bp, Homo sapiens
atgtcccttttgttc

SEQ ID NO: 91182 - DNA, 15 bp, Homo sapiens
aatgtcccttttgtt

SEQ ID NO: 91183 - DNA, 15 bp, Homo sapiens
caatgtcccttttgt

SEQ ID NO: 91184 - DNA, 15 bp, Homo sapiens
acaatgtcccttttg

SEQ ID NO: 91185 - DNA, 15 bp, Homo sapiens
aacaatgtccctttt

SEQ ID NO: 91186 - DNA, 15 bp, Homo sapiens
caacaatgtcccttt

SEQ ID NO: 91187 - DNA, 15 bp, Homo sapiens
acaacaatgtccctt

SEQ ID NO: 91188 - DNA, 15 bp, Homo sapiens
aacaacaatgtccct

SEQ ID NO: 91189 - DNA, 15 bp, Homo sapiens
gaacaacaatgtccc

SEQ ID NO: 91190 - DNA, 15 bp, Homo sapiens
ggaacaacaatgtcc

SEQ ID NO: 91191 - DNA, 15 bp, Homo sapiens
tggaacaacaatgtc

SEQ ID NO: 91192 - DNA, 15 bp, Homo sapiens
atggaacaacaatgt

SEQ ID NO: 91193 - DNA, 15 bp, Homo sapiens
gatggaacaacaatg

SEQ ID NO: 91194 - DNA, 15 bp, Homo sapiens
agatggaacaacaat

SEQ ID NO: 91195 - DNA, 15 bp, Homo sapiens
aagatggaacaacaa

SEQ ID NO: 91196 - DNA, 15 bp, Homo sapiens
gaagatggaacaaca

SEQ ID NO: 91197 - DNA, 15 bp, Homo sapiens
tgaagatggaacaac

SEQ ID NO: 91198 - DNA, 15 bp, Homo sapiens
ctgaagatggaacaa

SEQ ID NO: 91199 - DNA, 15 bp, Homo sapiens
tctgaagatggaaca

SEQ ID NO: 91200 - DNA, 15 bp, Homo sapiens
ctctgaagatggaac

SEQ ID NO: 91201 - DNA, 15 bp, Homo sapiens
tctctgaagatggaa

SEQ ID NO: 91202 - DNA, 15 bp, Homo sapiens
ctctctgaagatgga

SEQ ID NO: 91203 - DNA, 15 bp, Homo sapiens
tctctctgaagatgg

SEQ ID NO: 91204 - DNA, 15 bp, Homo sapiens
gtctctctgaagatg

SEQ ID NO: 91205 - DNA, 15 bp, Homo sapiens
tgtctctctgaagat

SEQ ID NO: 91206 - DNA, 15 bp, Homo sapiens
atgtctctctgaaga

SEQ ID NO: 91207 - DNA, 15 bp, Homo sapiens
aatgtctctctgaag

SEQ ID NO: 91208 - DNA, 15 bp, Homo sapiens
aaatgtctctctgaa

SEQ ID NO: 91209 - DNA, 15 bp, Homo sapiens
gaaatgtctctctga

SEQ ID NO: 91210 - DNA, 15 bp, Homo sapiens
tgaaatgtctctctg

SEQ ID NO: 91211 - DNA, 15 bp, Homo sapiens
atgaaatgtctctct

SEQ ID NO: 91212 - DNA, 15 bp, Homo sapiens
gatgaaatgtctctc

SEQ ID NO: 91213 - DNA, 15 bp, Homo sapiens
tgatgaaatgtctct

SEQ ID NO: 91214 - DNA, 15 bp, Homo sapiens
atgatgaaatgtctc

SEQ ID NO: 91215 - DNA, 15 bp, Homo sapiens
catgatgaaatgtct

SEQ ID NO: 91216 - DNA, 15 bp, Homo sapiens
tcatgatgaaatgtc

SEQ ID NO: 91217 - DNA, 15 bp, Homo sapiens
ttcatgatgaaatgt

SEQ ID NO: 91218 - DNA, 15 bp, Homo sapiens
cttcatgatgaaatg

SEQ ID NO: 91219 - DNA, 15 bp, Homo sapiens
tcttcatgatgaaat

SEQ ID NO: 91220 - DNA, 15 bp, Homo sapiens
ttcttcatgatgaaa

SEQ ID NO: 91221 - DNA, 15 bp, Homo sapiens
tttcttcatgatgaa

SEQ ID NO: 91222 - DNA, 15 bp, Homo sapiens
atttcttcatgatga

SEQ ID NO: 91223 - DNA, 15 bp, Homo sapiens
catttcttcatgatg

SEQ ID NO: 91224 - DNA, 15 bp, Homo sapiens
tcatttcttcatgat

SEQ ID NO: 91225 - DNA, 15 bp, Homo sapiens
ttcatttcttcatga

SEQ ID NO: 91226 - DNA, 15 bp, Homo sapiens
cttcatttcttcatg

SEQ ID NO: 91227 - DNA, 15 bp, Homo sapiens
tcttcatttcttcat

SEQ ID NO: 91228 - DNA, 15 bp, Homo sapiens
ttcttcatttcttca

SEQ ID NO: 91229 - DNA, 15 bp, Homo sapiens
tttcttcatttcttc

SEQ ID NO: 91230 - DNA, 15 bp, Homo sapiens
ttttcttcatttctt

SEQ ID NO: 91231 - DNA, 15 bp, Homo sapiens
tttttcttcatttct

SEQ ID NO: 91232 - DNA, 15 bp, Homo sapiens
atttttcttcatttc

SEQ ID NO: 91233 - DNA, 15 bp, Homo sapiens
aatttttcttcattt

SEQ ID NO: 91234 - DNA, 15 bp, Homo sapiens
taatttttcttcatt

SEQ ID NO: 91235 - DNA, 15 bp, Homo sapiens
ataatttttcttcat

SEQ ID NO: 91236 - DNA, 15 bp, Homo sapiens
tataatttttcttca

SEQ ID NO: 91237 - DNA, 15 bp, Homo sapiens
ctataatttttcttc

SEQ ID NO: 91238 - DNA, 15 bp, Homo sapiens
actataatttttctt

SEQ ID NO: 91239 - DNA, 15 bp, Homo sapiens
cactataatttttct

SEQ ID NO: 91240 - DNA, 15 bp, Homo sapiens
ccactataatttttc

SEQ ID NO: 91241 - DNA, 15 bp, Homo sapiens
cccactataattttt

SEQ ID NO: 91242 - DNA, 15 bp, Homo sapiens
acccactataatttt

SEQ ID NO: 91243 - DNA, 15 bp, Homo sapiens
aacccactataattt

SEQ ID NO: 91244 - DNA, 15 bp, Homo sapiens
taacccactataatt

SEQ ID NO: 91245 - DNA, 15 bp, Homo sapiens
ctaacccactataat

SEQ ID NO: 91246 - DNA, 15 bp, Homo sapiens
actaacccactataa

SEQ ID NO: 91247 - DNA, 15 bp, Homo sapiens
aactaacccactata

SEQ ID NO: 91248 - DNA, 15 bp, Homo sapiens
taactaacccactat

SEQ ID NO: 91249 - DNA, 15 bp, Homo sapiens
ttaactaacccacta

SEQ ID NO: 91250 - DNA, 15 bp, Homo sapiens
attaactaacccact

SEQ ID NO: 91251 - DNA, 15 bp, Homo sapiens
tattaactaacccac

SEQ ID NO: 91252 - DNA, 15 bp, Homo sapiens
atattaactaaccca

SEQ ID NO: 91253 - DNA, 15 bp, Homo sapiens
aatattaactaaccc

SEQ ID NO: 91254 - DNA, 15 bp, Homo sapiens
aaatattaactaacc

SEQ ID NO: 91255 - DNA, 15 bp, Homo sapiens
gaaatattaactaac

SEQ ID NO: 91256 - DNA, 15 bp, Homo sapiens
tgaaatattaactaa

SEQ ID NO: 91257 - DNA, 15 bp, Homo sapiens
ttgaaatattaacta

SEQ ID NO: 91258 - DNA, 15 bp, Homo sapiens
tttgaaatattaact

SEQ ID NO: 91259 - DNA, 15 bp, Homo sapiens
gtttgaaatattaac

SEQ ID NO: 91260 - DNA, 15 bp, Homo sapiens
cgtttgaaatattaa

SEQ ID NO: 91261 - DNA, 15 bp, Homo sapiens
acgtttgaaatatta

SEQ ID NO: 91262 - DNA, 15 bp, Homo sapiens
gacgtttgaaatatt

SEQ ID NO: 91263 - DNA, 15 bp, Homo sapiens
tgacgtttgaaatat

SEQ ID NO: 91264 - DNA, 15 bp, Homo sapiens
ttgacgtttgaaata

SEQ ID NO: 91265 - DNA, 15 bp, Homo sapiens
gttgacgtttgaaat

SEQ ID NO: 91266 - DNA, 15 bp, Homo sapiens
tgttgacgtttgaaa

SEQ ID NO: 91267 - DNA, 15 bp, Homo sapiens
atgttgacgtttgaa

SEQ ID NO: 91268 - DNA, 15 bp, Homo sapiens
gatgttgacgtttga

SEQ ID NO: 91269 - DNA, 15 bp, Homo sapiens
ggatgttgacgtttg

SEQ ID NO: 91270 - DNA, 15 bp, Homo sapiens
cggatgttgacgttt

SEQ ID NO: 91271 - DNA, 15 bp, Homo sapiens
gcggatgttgacgtt

SEQ ID NO: 91272 - DNA, 15 bp, Homo sapiens
tgcggatgttgacgt

SEQ ID NO: 91273 - DNA, 15 bp, Homo sapiens
ctgcggatgttgacg

SEQ ID NO: 91274 - DNA, 15 bp, Homo sapiens
cctgcggatgttgac

SEQ ID NO: 91275 - DNA, 15 bp, Homo sapiens
tcctgcggatgttga

SEQ ID NO: 91276 - DNA, 15 bp, Homo sapiens
ttcctgcggatgttg

SEQ ID NO: 91277 - DNA, 15 bp, Homo sapiens
attcctgcggatgtt

SEQ ID NO: 91278 - DNA, 15 bp, Homo sapiens
cattcctgcggatgt

SEQ ID NO: 91279 - DNA, 15 bp, Homo sapiens
tcattcctgcggatg

SEQ ID NO: 91280 - DNA, 15 bp, Homo sapiens
ttcattcctgcggat

SEQ ID NO: 91281 - DNA, 15 bp, Homo sapiens
cttcattcctgcgga

SEQ ID NO: 91282 - DNA, 15 bp, Homo sapiens
acttcattcctgcgg

SEQ ID NO: 91283 - DNA, 15 bp, Homo sapiens
gacttcattcctgcg

SEQ ID NO: 91284 - DNA, 15 bp, Homo sapiens
tgacttcattcctgc

SEQ ID NO: 91285 - DNA, 15 bp, Homo sapiens
gtgacttcattcctg

SEQ ID NO: 91286 - DNA, 15 bp, Homo sapiens
agtgacttcattcct

SEQ ID NO: 91287 - DNA, 15 bp, Homo sapiens
cagtgacttcattcc

SEQ ID NO: 91288 - DNA, 15 bp, Homo sapiens
acagtgacttcattc

SEQ ID NO: 91289 - DNA, 15 bp, Homo sapiens
gacagtgacttcatt

SEQ ID NO: 91290 - DNA, 15 bp, Homo sapiens
agacagtgacttcat

SEQ ID NO: 91291 - DNA, 15 bp, Homo sapiens
cagacagtgacttca

SEQ ID NO: 91292 - DNA, 15 bp, Homo sapiens
tcagacagtgacttc

SEQ ID NO: 91293 - DNA, 15 bp, Homo sapiens
gtcagacagtgactt

SEQ ID NO: 91294 - DNA, 15 bp, Homo sapiens
agtcagacagtgact

SEQ ID NO: 91295 - DNA, 15 bp, Homo sapiens
gagtcagacagtgac

SEQ ID NO: 91296 - DNA, 15 bp, Homo sapiens
agagtcagacagtga

SEQ ID NO: 91297 - DNA, 15 bp, Homo sapiens
gagagtcagacagtg

SEQ ID NO: 91298 - DNA, 15 bp, Homo sapiens
tgagagtcagacagt

SEQ ID NO: 91299 - DNA, 15 bp, Homo sapiens
ctgagagtcagacag

SEQ ID NO: 91300 - DNA, 15 bp, Homo sapiens
tctgagagtcagaca

SEQ ID NO: 91301 - DNA, 15 bp, Homo sapiens
ttctgagagtcagac

SEQ ID NO: 91302 - DNA, 15 bp, Homo sapiens
tttctgagagtcaga

SEQ ID NO: 91303 - DNA, 15 bp, Homo sapiens
atttctgagagtcag

SEQ ID NO: 91304 - DNA, 15 bp, Homo sapiens
catttctgagagtca

SEQ ID NO: 91305 - DNA, 15 bp, Homo sapiens
gcatttctgagagtc

SEQ ID NO: 91306 - DNA, 15 bp, Homo sapiens
ggcatttctgagagt

SEQ ID NO: 91307 - DNA, 15 bp, Homo sapiens
tggcatttctgagag

SEQ ID NO: 91308 - DNA, 15 bp, Homo sapiens
ttggcatttctgaga

SEQ ID NO: 91309 - DNA, 15 bp, Homo sapiens
attggcatttctgag

SEQ ID NO: 91310 - DNA, 15 bp, Homo sapiens
cattggcatttctga

SEQ ID NO: 91311 - DNA, 15 bp, Homo sapiens
ccattggcatttctg

SEQ ID NO: 91312 - DNA, 15 bp, Homo sapiens
tccattggcatttct

SEQ ID NO: 91313 - DNA, 15 bp, Homo sapiens
ttccattggcatttc

SEQ ID NO: 91314 - DNA, 15 bp, Homo sapiens
attccattggcattt

SEQ ID NO: 91315 - DNA, 15 bp, Homo sapiens
cattccattggcatt

SEQ ID NO: 91316 - DNA, 15 bp, Homo sapiens
tcattccattggcat

SEQ ID NO: 91317 - DNA, 15 bp, Homo sapiens
atcattccattggca

SEQ ID NO: 91318 - DNA, 15 bp, Homo sapiens
gatcattccattggc

SEQ ID NO: 91319 - DNA, 15 bp, Homo sapiens
agatcattccattgg

SEQ ID NO: 91320 - DNA, 15 bp, Homo sapiens
tagatcattccattg

SEQ ID NO: 91321 - DNA, 15 bp, Homo sapiens
atagatcattccatt

SEQ ID NO: 91322 - DNA, 15 bp, Homo sapiens
catagatcattccat

SEQ ID NO: 91323 - DNA, 15 bp, Homo sapiens
acatagatcattcca

SEQ ID NO: 91324 - DNA, 15 bp, Homo sapiens
aacatagatcattcc

SEQ ID NO: 91325 - DNA, 15 bp, Homo sapiens
caacatagatcattc

SEQ ID NO: 91326 - DNA, 15 bp, Homo sapiens
acaacatagatcatt

SEQ ID NO: 91327 - DNA, 15 bp, Homo sapiens
aacaacatagatcat

SEQ ID NO: 91328 - DNA, 15 bp, Homo sapiens
taacaacatagatca

SEQ ID NO: 91329 - DNA, 15 bp, Homo sapiens
ttaacaacatagatc

SEQ ID NO: 91330 - DNA, 15 bp, Homo sapiens
attaacaacatagat

SEQ ID NO: 91331 - DNA, 15 bp, Homo sapiens
aattaacaacataga

SEQ ID NO: 91332 - DNA, 15 bp, Homo sapiens
taattaacaacatag

SEQ ID NO: 91333 - DNA, 15 bp, Homo sapiens
ttaattaacaacata

SEQ ID NO: 91334 - DNA, 15 bp, Homo sapiens
gttaattaacaacat

SEQ ID NO: 91335 - DNA, 15 bp, Homo sapiens
tgttaattaacaaca

SEQ ID NO: 91336 - DNA, 15 bp, Homo sapiens
ctgttaattaacaac

SEQ ID NO: 91337 - DNA, 15 bp, Homo sapiens
tctgttaattaacaa

SEQ ID NO: 91338 - DNA, 15 bp, Homo sapiens
ctctgttaattaaca

SEQ ID NO: 91339 - DNA, 15 bp, Homo sapiens
tctctgttaattaac

SEQ ID NO: 91340 - DNA, 15 bp, Homo sapiens
gtctctgttaattaa

SEQ ID NO: 91341 - DNA, 15 bp, Homo sapiens
ggtctctgttaatta

SEQ ID NO: 91342 - DNA, 15 bp, Homo sapiens
gggtctctgttaatt

SEQ ID NO: 91343 - DNA, 15 bp, Homo sapiens
agggtctctgttaat

SEQ ID NO: 91344 - DNA, 15 bp, Homo sapiens
aagggtctctgttaa

SEQ ID NO: 91345 - DNA, 15 bp, Homo sapiens
aaagggtctctgtta

SEQ ID NO: 91346 - DNA, 15 bp, Homo sapiens
aaaagggtctctgtt

SEQ ID NO: 91347 - DNA, 15 bp, Homo sapiens
taaaagggtctctgt

SEQ ID NO: 91348 - DNA, 15 bp, Homo sapiens
gtaaaagggtctctg

SEQ ID NO: 91349 - DNA, 15 bp, Homo sapiens
tgtaaaagggtctct

SEQ ID NO: 91350 - DNA, 15 bp, Homo sapiens
atgtaaaagggtctc

SEQ ID NO: 91351 - DNA, 15 bp, Homo sapiens
aatgtaaaagggtct

SEQ ID NO: 91352 - DNA, 15 bp, Homo sapiens
aaatgtaaaagggtc

SEQ ID NO: 91353 - DNA, 15 bp, Homo sapiens
aaaatgtaaaagggt

SEQ ID NO: 91354 - DNA, 15 bp, Homo sapiens
taaaatgtaaaaggg

SEQ ID NO: 91355 - DNA, 15 bp, Homo sapiens
ttaaaatgtaaaagg

SEQ ID NO: 91356 - DNA, 15 bp, Homo sapiens
attaaaatgtaaaag

SEQ ID NO: 91357 - DNA, 15 bp, Homo sapiens
gattaaaatgtaaaa

SEQ ID NO: 91358 - DNA, 15 bp, Homo sapiens
tgattaaaatgtaaa

SEQ ID NO: 91359 - DNA, 15 bp, Homo sapiens
atgattaaaatgtaa

SEQ ID NO: 91360 - DNA, 15 bp, Homo sapiens
catgattaaaatgta

SEQ ID NO: 91361 - DNA, 15 bp, Homo sapiens
ccatgattaaaatgt

SEQ ID NO: 91362 - DNA, 15 bp, Homo sapiens
cccatgattaaaatg

SEQ ID NO: 91363 - DNA, 15 bp, Homo sapiens
ccccatgattaaaat

SEQ ID NO: 91364 - DNA, 15 bp, Homo sapiens
accccatgattaaaa

SEQ ID NO: 91365 - DNA, 15 bp, Homo sapiens
gaccccatgattaaa

SEQ ID NO: 91366 - DNA, 15 bp, Homo sapiens
agaccccatgattaa

SEQ ID NO: 91367 - DNA, 15 bp, Homo sapiens
gagaccccatgatta

SEQ ID NO: 91368 - DNA, 15 bp, Homo sapiens
ggagaccccatgatt

SEQ ID NO: 91369 - DNA, 15 bp, Homo sapiens
aggagaccccatgat

SEQ ID NO: 91370 - DNA, 15 bp, Homo sapiens
aaggagaccccatga

SEQ ID NO: 91371 - DNA, 15 bp, Homo sapiens
aaaggagaccccatg

SEQ ID NO: 91372 - DNA, 15 bp, Homo sapiens
caaaggagaccccat

SEQ ID NO: 91373 - DNA, 15 bp, Homo sapiens
gcaaaggagacccca

SEQ ID NO: 91374 - DNA, 15 bp, Homo sapiens
ggcaaaggagacccc

SEQ ID NO: 91375 - DNA, 15 bp, Homo sapiens
tggcaaaggagaccc

SEQ ID NO: 91376 - DNA, 15 bp, Homo sapiens
atggcaaaggagacc

SEQ ID NO: 91377 - DNA, 15 bp, Homo sapiens
catggcaaaggagac

SEQ ID NO: 91378 - DNA, 15 bp, Homo sapiens
acatggcaaaggaga

SEQ ID NO: 91379 - DNA, 15 bp, Homo sapiens
tacatggcaaaggag

SEQ ID NO: 91380 - DNA, 15 bp, Homo sapiens
atacatggcaaagga

SEQ ID NO: 91381 - DNA, 15 bp, Homo sapiens
aatacatggcaaagg

SEQ ID NO: 91382 - DNA, 15 bp, Homo sapiens
caatacatggcaaag

SEQ ID NO: 91383 - DNA, 15 bp, Homo sapiens
ccaatacatggcaaa

SEQ ID NO: 91384 - DNA, 15 bp, Homo sapiens
tccaatacatggcaa

SEQ ID NO: 91385 - DNA, 15 bp, Homo sapiens
ttccaatacatggca

SEQ ID NO: 91386 - DNA, 15 bp, Homo sapiens
attccaatacatggc

SEQ ID NO: 91387 - DNA, 15 bp, Homo sapiens
aattccaatacatgg

SEQ ID NO: 91388 - DNA, 15 bp, Homo sapiens
gaattccaatacatg

SEQ ID NO: 91389 - DNA, 15 bp, Homo sapiens
tgaattccaatacat

SEQ ID NO: 91390 - DNA, 15 bp, Homo sapiens
atgaattccaataca

SEQ ID NO: 91391 - DNA, 15 bp, Homo sapiens
aatgaattccaatac

SEQ ID NO: 91392 - DNA, 15 bp, Homo sapiens
aaatgaattccaata

SEQ ID NO: 91393 - DNA, 15 bp, Homo sapiens
taaatgaattccaat

SEQ ID NO: 91394 - DNA, 15 bp, Homo sapiens
ctaaatgaattccaa

SEQ ID NO: 91395 - DNA, 15 bp, Homo sapiens
cctaaatgaattcca

SEQ ID NO: 91396 - DNA, 15 bp, Homo sapiens
tcctaaatgaattcc

SEQ ID NO: 91397 - DNA, 15 bp, Homo sapiens
atcctaaatgaattc

SEQ ID NO: 91398 - DNA, 15 bp, Homo sapiens
tatcctaaatgaatt

SEQ ID NO: 91399 - DNA, 15 bp, Homo sapiens
ttatcctaaatgaat

SEQ ID NO: 91400 - DNA, 15 bp, Homo sapiens
attatcctaaatgaa

SEQ ID NO: 91401 - DNA, 15 bp, Homo sapiens
cattatcctaaatga

SEQ ID NO: 91402 - DNA, 15 bp, Homo sapiens
ccattatcctaaatg

SEQ ID NO: 91403 - DNA, 15 bp, Homo sapiens
accattatcctaaat

SEQ ID NO: 91404 - DNA, 15 bp, Homo sapiens
gaccattatcctaaa

SEQ ID NO: 91405 - DNA, 15 bp, Homo sapiens
agaccattatcctaa

SEQ ID NO: 91406 - DNA, 15 bp, Homo sapiens
tagaccattatccta

SEQ ID NO: 91407 - DNA, 15 bp, Homo sapiens
atagaccattatcct

SEQ ID NO: 91408 - DNA, 15 bp, Homo sapiens
catagaccattatcc

SEQ ID NO: 91409 - DNA, 15 bp, Homo sapiens
acatagaccattatc

SEQ ID NO: 91410 - DNA, 15 bp, Homo sapiens
tacatagaccattat

SEQ ID NO: 91411 - DNA, 15 bp, Homo sapiens
ttacatagaccatta

SEQ ID NO: 91412 - DNA, 15 bp, Homo sapiens
attacatagaccatt

SEQ ID NO: 91413 - DNA, 15 bp, Homo sapiens
tattacatagaccat

SEQ ID NO: 91414 - DNA, 15 bp, Homo sapiens
ttattacatagacca

SEQ ID NO: 91415 - DNA, 15 bp, Homo sapiens
attattacatagacc

SEQ ID NO: 91416 - DNA, 15 bp, Homo sapiens
tattattacatagac

SEQ ID NO: 91417 - DNA, 15 bp, Homo sapiens
atattattacataga

SEQ ID NO: 91418 - DNA, 15 bp, Homo sapiens
aatattattacatag

SEQ ID NO: 91419 - DNA, 15 bp, Homo sapiens
caatattattacata

SEQ ID NO: 91420 - DNA, 15 bp, Homo sapiens
ccaatattattacat

SEQ ID NO: 91421 - DNA, 15 bp, Homo sapiens
accaatattattaca

SEQ ID NO: 91422 - DNA, 15 bp, Homo sapiens
aaccaatattattac

SEQ ID NO: 91423 - DNA, 15 bp, Homo sapiens
gaaccaatattatta

SEQ ID NO: 91424 - DNA, 15 bp, Homo sapiens
ggaaccaatattatt

SEQ ID NO: 91425 - DNA, 15 bp, Homo sapiens
aggaaccaatattat

SEQ ID NO: 91426 - DNA, 15 bp, Homo sapiens
taggaaccaatatta

SEQ ID NO: 91427 - DNA, 15 bp, Homo sapiens
ttaggaaccaatatt

SEQ ID NO: 91428 - DNA, 15 bp, Homo sapiens
attaggaaccaatat

SEQ ID NO: 91429 - DNA, 15 bp, Homo sapiens
tattaggaaccaata

SEQ ID NO: 91430 - DNA, 15 bp, Homo sapiens
atattaggaaccaat

SEQ ID NO: 91431 - DNA, 15 bp, Homo sapiens
catattaggaaccaa

SEQ ID NO: 91432 - DNA, 15 bp, Homo sapiens
tcatattaggaacca

SEQ ID NO: 91433 - DNA, 15 bp, Homo sapiens
atcatattaggaacc

SEQ ID NO: 91434 - DNA, 15 bp, Homo sapiens
aatcatattaggaac

SEQ ID NO: 91435 - DNA, 15 bp, Homo sapiens
aaatcatattaggaa

SEQ ID NO: 91436 - DNA, 15 bp, Homo sapiens
aaaatcatattagga

SEQ ID NO: 91437 - DNA, 15 bp, Homo sapiens
aaaaatcatattagg

SEQ ID NO: 91438 - DNA, 15 bp, Homo sapiens
aaaaaatcatattag

SEQ ID NO: 91439 - DNA, 15 bp, Homo sapiens
gaaaaaatcatatta

SEQ ID NO: 91440 - DNA, 15 bp, Homo sapiens
tgaaaaaatcatatt

SEQ ID NO: 91441 - DNA, 15 bp, Homo sapiens
ttgaaaaaatcatat

SEQ ID NO: 91442 - DNA, 15 bp, Homo sapiens
tttgaaaaaatcata

SEQ ID NO: 91443 - DNA, 15 bp, Homo sapiens
gtttgaaaaaatcat

SEQ ID NO: 91444 - DNA, 15 bp, Homo sapiens
agtttgaaaaaatca

SEQ ID NO: 91445 - DNA, 15 bp, Homo sapiens
tagtttgaaaaaatc

SEQ ID NO: 91446 - DNA, 15 bp, Homo sapiens
ttagtttgaaaaaat

SEQ ID NO: 91447 - DNA, 15 bp, Homo sapiens
tttagtttgaaaaaa

SEQ ID NO: 91448 - DNA, 15 bp, Homo sapiens
atttagtttgaaaaa

SEQ ID NO: 91449 - DNA, 15 bp, Homo sapiens
tatttagtttgaaaa

SEQ ID NO: 91450 - DNA, 15 bp, Homo sapiens
atatttagtttgaaa

SEQ ID NO: 91451 - DNA, 15 bp, Homo sapiens
aatatttagtttgaa

SEQ ID NO: 91452 - DNA, 15 bp, Homo sapiens
aaatatttagtttga

SEQ ID NO: 91453 - DNA, 15 bp, Homo sapiens
aaaatatttagtttg

SEQ ID NO: 91454 - DNA, 15 bp, Homo sapiens
aaaaatatttagttt

SEQ ID NO: 91455 - DNA, 15 bp, Homo sapiens
taaaaatatttagtt

SEQ ID NO: 91456 - DNA, 15 bp, Homo sapiens
ttaaaaatatttagt

SEQ ID NO: 91457 - DNA, 15 bp, Homo sapiens
tttaaaaatatttag

SEQ ID NO: 91458 - DNA, 15 bp, Homo sapiens
atttaaaaatattta

SEQ ID NO: 91459 - DNA, 15 bp, Homo sapiens
tatttaaaaatattt

SEQ ID NO: 91460 - DNA, 15 bp, Homo sapiens
ttatttaaaaatatt

SEQ ID NO: 91461 - DNA, 15 bp, Homo sapiens
tttatttaaaaatat

SEQ ID NO: 91462 - DNA, 15 bp, Homo sapiens
gtttatttaaaaata

SEQ ID NO: 91463 - DNA, 15 bp, Homo sapiens
tgtttatttaaaaat

SEQ ID NO: 91464 - DNA, 15 bp, Homo sapiens
ctgtttatttaaaaa

SEQ ID NO: 91465 - DNA, 15 bp, Homo sapiens
tctgtttatttaaaa

SEQ ID NO: 91466 - DNA, 15 bp, Homo sapiens
ttctgtttatttaaa

SEQ ID NO: 91467 - DNA, 15 bp, Homo sapiens
gttctgtttatttaa

SEQ ID NO: 91468 - DNA, 15 bp, Homo sapiens
agttctgtttattta

SEQ ID NO: 91469 - DNA, 15 bp, Homo sapiens
cagttctgtttattt

SEQ ID NO: 91470 - DNA, 15 bp, Homo sapiens
tcagttctgtttatt

SEQ ID NO: 91471 - DNA, 15 bp, Homo sapiens
ttcagttctgtttat

SEQ ID NO: 91472 - DNA, 15 bp, Homo sapiens
cttcagttctgttta

SEQ ID NO: 91473 - DNA, 15 bp, Homo sapiens
ccttcagttctgttt

SEQ ID NO: 91474 - DNA, 15 bp, Homo sapiens
cccttcagttctgtt

SEQ ID NO: 91475 - DNA, 15 bp, Homo sapiens
gcccttcagttctgt

SEQ ID NO: 91476 - DNA, 15 bp, Homo sapiens
ggcccttcagttctg

SEQ ID NO: 91477 - DNA, 15 bp, Homo sapiens
tggcccttcagttct

SEQ ID NO: 91478 - DNA, 15 bp, Homo sapiens
ttggcccttcagttc

SEQ ID NO: 91479 - DNA, 15 bp, Homo sapiens
gttggcccttcagtt

SEQ ID NO: 91480 - DNA, 15 bp, Homo sapiens
ggttggcccttcagt

SEQ ID NO: 91481 - DNA, 15 bp, Homo sapiens
aggttggcccttcag

SEQ ID NO: 91482 - DNA, 15 bp, Homo sapiens
caggttggcccttca

SEQ ID NO: 91483 - DNA, 15 bp, Homo sapiens
ccaggttggcccttc

SEQ ID NO: 91484 - DNA, 15 bp, Homo sapiens
tccaggttggccctt

SEQ ID NO: 91485 - DNA, 15 bp, Homo sapiens
gtccaggttggccct

SEQ ID NO: 91486 - DNA, 15 bp, Homo sapiens
tgtccaggttggccc

SEQ ID NO: 91487 - DNA, 15 bp, Homo sapiens
atgtccaggttggcc

SEQ ID NO: 91488 - DNA, 15 bp, Homo sapiens
catgtccaggttggc

SEQ ID NO: 91489 - DNA, 15 bp, Homo sapiens
gcatgtccaggttgg

SEQ ID NO: 91490 - DNA, 15 bp, Homo sapiens
tgcatgtccaggttg

SEQ ID NO: 91491 - DNA, 15 bp, Homo sapiens
atgcatgtccaggtt

SEQ ID NO: 91492 - DNA, 15 bp, Homo sapiens
tatgcatgtccaggt

SEQ ID NO: 91493 - DNA, 15 bp, Homo sapiens
atatgcatgtccagg

SEQ ID NO: 91494 - DNA, 15 bp, Homo sapiens
gatatgcatgtccag

SEQ ID NO: 91495 - DNA, 15 bp, Homo sapiens
agatatgcatgtcca

SEQ ID NO: 91496 - DNA, 15 bp, Homo sapiens
cagatatgcatgtcc

SEQ ID NO: 91497 - DNA, 15 bp, Homo sapiens
ccagatatgcatgtc

SEQ ID NO: 91498 - DNA, 15 bp, Homo sapiens
tccagatatgcatgt

SEQ ID NO: 91499 - DNA, 15 bp, Homo sapiens
ttccagatatgcatg

SEQ ID NO: 91500 - DNA, 15 bp, Homo sapiens
tttccagatatgcat

SEQ ID NO: 91501 - DNA, 15 bp, Homo sapiens
gtttccagatatgca

SEQ ID NO: 91502 - DNA, 15 bp, Homo sapiens
tgtttccagatatgc

SEQ ID NO: 91503 - DNA, 15 bp, Homo sapiens
atgtttccagatatg

SEQ ID NO: 91504 - DNA, 15 bp, Homo sapiens
aatgtttccagatat

SEQ ID NO: 91505 - DNA, 15 bp, Homo sapiens
caatgtttccagata

SEQ ID NO: 91506 - DNA, 15 bp, Homo sapiens
tcaatgtttccagat

SEQ ID NO: 91507 - DNA, 15 bp, Homo sapiens
ttcaatgtttccaga

SEQ ID NO: 91508 - DNA, 15 bp, Homo sapiens
tttcaatgtttccag

SEQ ID NO: 91509 - DNA, 15 bp, Homo sapiens
ttttcaatgtttcca

SEQ ID NO: 91510 - DNA, 15 bp, Homo sapiens
gttttcaatgtttcc

SEQ ID NO: 91511 - DNA, 15 bp, Homo sapiens
tgttttcaatgtttc

SEQ ID NO: 91512 - DNA, 15 bp, Homo sapiens
gtgttttcaatgttt

SEQ ID NO: 91513 - DNA, 15 bp, Homo sapiens
agtgttttcaatgtt

SEQ ID NO: 91514 - DNA, 15 bp, Homo sapiens
cagtgttttcaatgt

SEQ ID NO: 91515 - DNA, 15 bp, Homo sapiens
tcagtgttttcaatg

SEQ ID NO: 91516 - DNA, 15 bp, Homo sapiens
ttcagtgttttcaat

SEQ ID NO: 91517 - DNA, 15 bp, Homo sapiens
tttcagtgttttcaa

SEQ ID NO: 91518 - DNA, 15 bp, Homo sapiens
ctttcagtgttttca

SEQ ID NO: 91519 - DNA, 15 bp, Homo sapiens
tctttcagtgttttc

SEQ ID NO: 91520 - DNA, 15 bp, Homo sapiens
atctttcagtgtttt

SEQ ID NO: 91521 - DNA, 15 bp, Homo sapiens
catctttcagtgttt

SEQ ID NO: 91522 - DNA, 15 bp, Homo sapiens
acatctttcagtgtt

SEQ ID NO: 91523 - DNA, 15 bp, Homo sapiens
cacatctttcagtgt

SEQ ID NO: 91524 - DNA, 15 bp, Homo sapiens
gcacatctttcagtg

SEQ ID NO: 91525 - DNA, 15 bp, Homo sapiens
agcacatctttcagt

SEQ ID NO: 91526 - DNA, 15 bp, Homo sapiens
tagcacatctttcag

SEQ ID NO: 91527 - DNA, 15 bp, Homo sapiens
ttagcacatctttca

SEQ ID NO: 91528 - DNA, 15 bp, Homo sapiens
tttagcacatctttc

SEQ ID NO: 91529 - DNA, 15 bp, Homo sapiens
atttagcacatcttt

SEQ ID NO: 91530 - DNA, 15 bp, Homo sapiens
catttagcacatctt

SEQ ID NO: 91531 - DNA, 15 bp, Homo sapiens
tcatttagcacatct

SEQ ID NO: 91532 - DNA, 15 bp, Homo sapiens
atcatttagcacatc

SEQ ID NO: 91533 - DNA, 15 bp, Homo sapiens
aatcatttagcacat

SEQ ID NO: 91534 - DNA, 15 bp, Homo sapiens
gaatcatttagcaca

SEQ ID NO: 91535 - DNA, 15 bp, Homo sapiens
tgaatcatttagcac

SEQ ID NO: 91536 - DNA, 15 bp, Homo sapiens
ctgaatcatttagca

SEQ ID NO: 91537 - DNA, 15 bp, Homo sapiens
tctgaatcatttagc

SEQ ID NO: 91538 - DNA, 15 bp, Homo sapiens
ttctgaatcatttag

SEQ ID NO: 91539 - DNA, 15 bp, Homo sapiens
tttctgaatcattta

SEQ ID NO: 91540 - DNA, 15 bp, Homo sapiens
ttttctgaatcattt

SEQ ID NO: 91541 - DNA, 15 bp, Homo sapiens
attttctgaatcatt

SEQ ID NO: 91542 - DNA, 15 bp, Homo sapiens
tattttctgaatcat

SEQ ID NO: 91543 - DNA, 15 bp, Homo sapiens
ttattttctgaatca

SEQ ID NO: 91544 - DNA, 15 bp, Homo sapiens
cttattttctgaatc

SEQ ID NO: 91545 - DNA, 15 bp, Homo sapiens
ccttattttctgaat

SEQ ID NO: 91546 - DNA, 15 bp, Homo sapiens
gccttattttctgaa

SEQ ID NO: 91547 - DNA, 15 bp, Homo sapiens
ggccttattttctga

SEQ ID NO: 91548 - DNA, 15 bp, Homo sapiens
gggccttattttctg

SEQ ID NO: 91549 - DNA, 15 bp, Homo sapiens
tgggccttattttct

SEQ ID NO: 91550 - DNA, 15 bp, Homo sapiens
ctgggccttattttc

SEQ ID NO: 91551 - DNA, 15 bp, Homo sapiens
cctgggccttatttt

SEQ ID NO: 91552 - DNA, 15 bp, Homo sapiens
acctgggccttattt

SEQ ID NO: 91553 - DNA, 15 bp, Homo sapiens
cacctgggccttatt

SEQ ID NO: 91554 - DNA, 15 bp, Homo sapiens
acacctgggccttat

SEQ ID NO: 91555 - DNA, 15 bp, Homo sapiens
gacacctgggcctta

SEQ ID NO: 91556 - DNA, 15 bp, Homo sapiens
agacacctgggcctt

SEQ ID NO: 91557 - DNA, 15 bp, Homo sapiens
gagacacctgggcct

SEQ ID NO: 91558 - DNA, 15 bp, Homo sapiens
agagacacctgggcc

SEQ ID NO: 91559 - DNA, 15 bp, Homo sapiens
cagagacacctgggc

SEQ ID NO: 91560 - DNA, 15 bp, Homo sapiens
tcagagacacctggg

SEQ ID NO: 91561 - DNA, 15 bp, Homo sapiens
ttcagagacacctgg

SEQ ID NO: 91562 - DNA, 15 bp, Homo sapiens
attcagagacacctg

SEQ ID NO: 91563 - DNA, 15 bp, Homo sapiens
cattcagagacacct

SEQ ID NO: 91564 - DNA, 15 bp, Homo sapiens
acattcagagacacc

SEQ ID NO: 91565 - DNA, 15 bp, Homo sapiens
gacattcagagacac

SEQ ID NO: 91566 - DNA, 15 bp, Homo sapiens
ggacattcagagaca

SEQ ID NO: 91567 - DNA, 15 bp, Homo sapiens
aggacattcagagac

SEQ ID NO: 91568 - DNA, 15 bp, Homo sapiens
aaggacattcagaga

SEQ ID NO: 91569 - DNA, 15 bp, Homo sapiens
taaggacattcagag

SEQ ID NO: 91570 - DNA, 15 bp, Homo sapiens
ttaaggacattcaga

SEQ ID NO: 91571 - DNA, 15 bp, Homo sapiens
attaaggacattcag

SEQ ID NO: 91572 - DNA, 15 bp, Homo sapiens
cattaaggacattca

SEQ ID NO: 91573 - DNA, 15 bp, Homo sapiens
tcattaaggacattc

SEQ ID NO: 91574 - DNA, 15 bp, Homo sapiens
atcattaaggacatt

SEQ ID NO: 91575 - DNA, 15 bp, Homo sapiens
gatcattaaggacat

SEQ ID NO: 91576 - DNA, 15 bp, Homo sapiens
agatcattaaggaca

SEQ ID NO: 91577 - DNA, 15 bp, Homo sapiens
aagatcattaaggac

SEQ ID NO: 91578 - DNA, 15 bp, Homo sapiens
caagatcattaagga

SEQ ID NO: 91579 - DNA, 15 bp, Homo sapiens
gcaagatcattaagg

SEQ ID NO: 91580 - DNA, 15 bp, Homo sapiens
ggcaagatcattaag

SEQ ID NO: 91581 - DNA, 15 bp, Homo sapiens
tggcaagatcattaa

SEQ ID NO: 91582 - DNA, 15 bp, Homo sapiens
ttggcaagatcatta

SEQ ID NO: 91583 - DNA, 15 bp, Homo sapiens
cttggcaagatcatt

SEQ ID NO: 91584 - DNA, 15 bp, Homo sapiens
ccttggcaagatcat

SEQ ID NO: 91585 - DNA, 15 bp, Homo sapiens
accttggcaagatca

SEQ ID NO: 91586 - DNA, 15 bp, Homo sapiens
caccttggcaagatc

SEQ ID NO: 91587 - DNA, 15 bp, Homo sapiens
ccaccttggcaagat

SEQ ID NO: 91588 - DNA, 15 bp, Homo sapiens
tccaccttggcaaga

SEQ ID NO: 91589 - DNA, 15 bp, Homo sapiens
ctccaccttggcaag

SEQ ID NO: 91590 - DNA, 15 bp, Homo sapiens
tctccaccttggcaa

SEQ ID NO: 91591 - DNA, 15 bp, Homo sapiens
ttctccaccttggca

SEQ ID NO: 91592 - DNA, 15 bp, Homo sapiens
cttctccaccttggc

SEQ ID NO: 91593 - DNA, 15 bp, Homo sapiens
ccttctccaccttgg

SEQ ID NO: 91594 - DNA, 15 bp, Homo sapiens
gccttctccaccttg

SEQ ID NO: 91595 - DNA, 15 bp, Homo sapiens
ggccttctccacctt

SEQ ID NO: 91596 - DNA, 15 bp, Homo sapiens
gggccttctccacct

SEQ ID NO: 91597 - DNA, 15 bp, Homo sapiens
agggccttctccacc

SEQ ID NO: 91598 - DNA, 15 bp, Homo sapiens
cagggccttctccac

SEQ ID NO: 91599 - DNA, 15 bp, Homo sapiens
gcagggccttctcca

SEQ ID NO: 91600 - DNA, 15 bp, Homo sapiens
tgcagggccttctcc

SEQ ID NO: 91601 - DNA, 15 bp, Homo sapiens
ttgcagggccttctc

SEQ ID NO: 91602 - DNA, 15 bp, Homo sapiens
cttgcagggccttct

SEQ ID NO: 91603 - DNA, 15 bp, Homo sapiens
tcttgcagggccttc

SEQ ID NO: 91604 - DNA, 15 bp, Homo sapiens
ttcttgcagggcctt

SEQ ID NO: 91605 - DNA, 15 bp, Homo sapiens
tttcttgcagggcct

SEQ ID NO: 91606 - DNA, 15 bp, Homo sapiens
ttttcttgcagggcc

SEQ ID NO: 91607 - DNA, 15 bp, Homo sapiens
tttttcttgcagggc

SEQ ID NO: 91608 - DNA, 15 bp, Homo sapiens
ttttttcttgcaggg

SEQ ID NO: 91609 - DNA, 15 bp, Homo sapiens
tttttttcttgcagg

SEQ ID NO: 91610 - DNA, 15 bp, Homo sapiens
ctttttttcttgcag

SEQ ID NO: 91611 - DNA, 15 bp, Homo sapiens
cctttttttcttgca

SEQ ID NO: 91612 - DNA, 15 bp, Homo sapiens
acctttttttcttgc

SEQ ID NO: 91613 - DNA, 15 bp, Homo sapiens
tacctttttttcttg

SEQ ID NO: 91614 - DNA, 15 bp, Homo sapiens
ttacctttttttctt

SEQ ID NO: 91615 - DNA, 15 bp, Homo sapiens
gttacctttttttct

SEQ ID NO: 91616 - DNA, 15 bp, Homo sapiens
tgttacctttttttc

SEQ ID NO: 91617 - DNA, 15 bp, Homo sapiens
atgttaccttttttt

SEQ ID NO: 91618 - DNA, 15 bp, Homo sapiens
tatgttacctttttt

SEQ ID NO: 91619 - DNA, 15 bp, Homo sapiens
atatgttaccttttt

SEQ ID NO: 91620 - DNA, 15 bp, Homo sapiens
tatatgttacctttt

SEQ ID NO: 91621 - DNA, 15 bp, Homo sapiens
atatatgttaccttt

SEQ ID NO: 91622 - DNA, 15 bp, Homo sapiens
gatatatgttacctt

SEQ ID NO: 91623 - DNA, 15 bp, Homo sapiens
agatatatgttacct

SEQ ID NO: 91624 - DNA, 15 bp, Homo sapiens
aagatatatgttacc

SEQ ID NO: 91625 - DNA, 15 bp, Homo sapiens
gaagatatatgttac

SEQ ID NO: 91626 - DNA, 15 bp, Homo sapiens
ggaagatatatgtta

SEQ ID NO: 91627 - DNA, 15 bp, Homo sapiens
tggaagatatatgtt

SEQ ID NO: 91628 - DNA, 15 bp, Homo sapiens
atggaagatatatgt

SEQ ID NO: 91629 - DNA, 15 bp, Homo sapiens
catggaagatatatg

SEQ ID NO: 91630 - DNA, 15 bp, Homo sapiens
acatggaagatatat

SEQ ID NO: 91631 - DNA, 15 bp, Homo sapiens
aacatggaagatata

SEQ ID NO: 91632 - DNA, 15 bp, Homo sapiens
taacatggaagatat

SEQ ID NO: 91633 - DNA, 15 bp, Homo sapiens
ctaacatggaagata

SEQ ID NO: 91634 - DNA, 15 bp, Homo sapiens
tctaacatggaagat

SEQ ID NO: 91635 - DNA, 15 bp, Homo sapiens
ttctaacatggaaga

SEQ ID NO: 91636 - DNA, 15 bp, Homo sapiens
gttctaacatggaag

SEQ ID NO: 91637 - DNA, 15 bp, Homo sapiens
agttctaacatggaa

SEQ ID NO: 91638 - DNA, 15 bp, Homo sapiens
gagttctaacatgga

SEQ ID NO: 91639 - DNA, 15 bp, Homo sapiens
agagttctaacatgg

SEQ ID NO: 91640 - DNA, 15 bp, Homo sapiens
tagagttctaacatg

SEQ ID NO: 91641 - DNA, 15 bp, Homo sapiens
ctagagttctaacat

SEQ ID NO: 91642 - DNA, 15 bp, Homo sapiens
gctagagttctaaca

SEQ ID NO: 91643 - DNA, 15 bp, Homo sapiens
cgctagagttctaac

SEQ ID NO: 91644 - DNA, 15 bp, Homo sapiens
gcgctagagttctaa

SEQ ID NO: 91645 - DNA, 15 bp, Homo sapiens
agcgctagagttcta

SEQ ID NO: 91646 - DNA, 15 bp, Homo sapiens
aagcgctagagttct

SEQ ID NO: 91647 - DNA, 15 bp, Homo sapiens
gaagcgctagagttc

SEQ ID NO: 91648 - DNA, 15 bp, Homo sapiens
agaagcgctagagtt

SEQ ID NO: 91649 - DNA, 15 bp, Homo sapiens
aagaagcgctagagt

SEQ ID NO: 91650 - DNA, 15 bp, Homo sapiens
gaagaagcgctagag

SEQ ID NO: 91651 - DNA, 15 bp, Homo sapiens
agaagaagcgctaga

SEQ ID NO: 91652 - DNA, 15 bp, Homo sapiens
tagaagaagcgctag

SEQ ID NO: 91653 - DNA, 15 bp, Homo sapiens
ttagaagaagcgcta

SEQ ID NO: 91654 - DNA, 15 bp, Homo sapiens
attagaagaagcgct

SEQ ID NO: 91655 - DNA, 15 bp, Homo sapiens
tattagaagaagcgc

SEQ ID NO: 91656 - DNA, 15 bp, Homo sapiens
atattagaagaagcg

SEQ ID NO: 91657 - DNA, 15 bp, Homo sapiens
gatattagaagaagc

SEQ ID NO: 91658 - DNA, 15 bp, Homo sapiens
agatattagaagaag

SEQ ID NO: 91659 - DNA, 15 bp, Homo sapiens
gagatattagaagaa

SEQ ID NO: 91660 - DNA, 15 bp, Homo sapiens
ggagatattagaaga

SEQ ID NO: 91661 - DNA, 15 bp, Homo sapiens
aggagatattagaag

SEQ ID NO: 91662 - DNA, 15 bp, Homo sapiens
gaggagatattagaa

SEQ ID NO: 91663 - DNA, 15 bp, Homo sapiens
agaggagatattaga

SEQ ID NO: 91664 - DNA, 15 bp, Homo sapiens
aagaggagatattag

SEQ ID NO: 91665 - DNA, 15 bp, Homo sapiens
taagaggagatatta

SEQ ID NO: 91666 - DNA, 15 bp, Homo sapiens
gtaagaggagatatt

SEQ ID NO: 91667 - DNA, 15 bp, Homo sapiens
tgtaagaggagatat

SEQ ID NO: 91668 - DNA, 15 bp, Homo sapiens
atgtaagaggagata

SEQ ID NO: 91669 - DNA, 15 bp, Homo sapiens
tatgtaagaggagat

SEQ ID NO: 91670 - DNA, 15 bp, Homo sapiens
atatgtaagaggaga

SEQ ID NO: 91671 - DNA, 15 bp, Homo sapiens
aatatgtaagaggag

SEQ ID NO: 91672 - DNA, 15 bp, Homo sapiens
aaatatgtaagagga

SEQ ID NO: 91673 - DNA, 15 bp, Homo sapiens
aaaatatgtaagagg

SEQ ID NO: 91674 - DNA, 15 bp, Homo sapiens
caaaatatgtaagag

SEQ ID NO: 91675 - DNA, 15 bp, Homo sapiens
tcaaaatatgtaaga

SEQ ID NO: 91676 - DNA, 15 bp, Homo sapiens
ttcaaaatatgtaag

SEQ ID NO: 91677 - DNA, 15 bp, Homo sapiens
tttcaaaatatgtaa

SEQ ID NO: 91678 - DNA, 15 bp, Homo sapiens
atttcaaaatatgta

SEQ ID NO: 91679 - DNA, 15 bp, Homo sapiens
catttcaaaatatgt

SEQ ID NO: 91680 - DNA, 15 bp, Homo sapiens
acatttcaaaatatg

SEQ ID NO: 91681 - DNA, 15 bp, Homo sapiens
aacatttcaaaatat

SEQ ID NO: 91682 - DNA, 15 bp, Homo sapiens
aaacatttcaaaata

SEQ ID NO: 91683 - DNA, 15 bp, Homo sapiens
aaaacatttcaaaat

SEQ ID NO: 91684 - DNA, 15 bp, Homo sapiens
aaaaacatttcaaaa

SEQ ID NO: 91685 - DNA, 15 bp, Homo sapiens
aaaaaacatttcaaa

SEQ ID NO: 91686 - DNA, 15 bp, Homo sapiens
gaaaaaacatttcaa

SEQ ID NO: 91687 - DNA, 15 bp, Homo sapiens
tgaaaaaacatttca

SEQ ID NO: 91688 - DNA, 15 bp, Homo sapiens
ctgaaaaaacatttc

SEQ ID NO: 91689 - DNA, 15 bp, Homo sapiens
tctgaaaaaacattt

SEQ ID NO: 91690 - DNA, 15 bp, Homo sapiens
ctctgaaaaaacatt

SEQ ID NO: 91691 - DNA, 15 bp, Homo sapiens
tctctgaaaaaacat

SEQ ID NO: 91692 - DNA, 15 bp, Homo sapiens
atctctgaaaaaaca

SEQ ID NO: 91693 - DNA, 15 bp, Homo sapiens
aatctctgaaaaaac

SEQ ID NO: 91694 - DNA, 15 bp, Homo sapiens
taatctctgaaaaaa

SEQ ID NO: 91695 - DNA, 15 bp, Homo sapiens
ttaatctctgaaaaa

SEQ ID NO: 91696 - DNA, 15 bp, Homo sapiens
tttttttaatctctg

SEQ ID NO: 91697 - DNA, 15 bp, Homo sapiens
ttttttttaatctct

SEQ ID NO: 91698 - DNA, 15 bp, Homo sapiens
tttttttttaatctc

SEQ ID NO: 91699 - DNA, 15 bp, Homo sapiens
ctttttttttaatct

SEQ ID NO: 91700 - DNA, 15 bp, Homo sapiens
actttttttttaatc

SEQ ID NO: 91701 - DNA, 15 bp, Homo sapiens
aactttttttttaat

SEQ ID NO: 91702 - DNA, 15 bp, Homo sapiens
caactttttttttaa

SEQ ID NO: 91703 - DNA, 15 bp, Homo sapiens
ccaacttttttttta

SEQ ID NO: 91704 - DNA, 15 bp, Homo sapiens
accaacttttttttt

SEQ ID NO: 91705 - DNA, 15 bp, Homo sapiens
gaccaactttttttt

SEQ ID NO: 91706 - DNA, 15 bp, Homo sapiens
tgaccaacttttttt

SEQ ID NO: 91707 - DNA, 15 bp, Homo sapiens
ctgaccaactttttt

SEQ ID NO: 91708 - DNA, 15 bp, Homo sapiens
actgaccaacttttt

SEQ ID NO: 91709 - DNA, 15 bp, Homo sapiens
aactgaccaactttt

SEQ ID NO: 91710 - DNA, 15 bp, Homo sapiens
aaactgaccaacttt

SEQ ID NO: 91711 - DNA, 15 bp, Homo sapiens
aaaactgaccaactt

SEQ ID NO: 91712 - DNA, 15 bp, Homo sapiens
caaaactgaccaact

SEQ ID NO: 91713 - DNA, 15 bp, Homo sapiens
acaaaactgaccaac

SEQ ID NO: 91714 - DNA, 15 bp, Homo sapiens
aacaaaactgaccaa

SEQ ID NO: 91715 - DNA, 15 bp, Homo sapiens
gaacaaaactgacca

SEQ ID NO: 91716 - DNA, 15 bp, Homo sapiens
tgaacaaaactgacc

SEQ ID NO: 91717 - DNA, 15 bp, Homo sapiens
atgaacaaaactgac

SEQ ID NO: 91718 - DNA, 15 bp, Homo sapiens
gatgaacaaaactga

SEQ ID NO: 91719 - DNA, 15 bp, Homo sapiens
tgatgaacaaaactg

SEQ ID NO: 91720 - DNA, 15 bp, Homo sapiens
atgatgaacaaaact

SEQ ID NO: 91721 - DNA, 15 bp, Homo sapiens
aatgatgaacaaaac

SEQ ID NO: 91722 - DNA, 15 bp, Homo sapiens
caatgatgaacaaaa

SEQ ID NO: 91723 - DNA, 15 bp, Homo sapiens
ccaatgatgaacaaa

SEQ ID NO: 91724 - DNA, 15 bp, Homo sapiens
accaatgatgaacaa

SEQ ID NO: 91725 - DNA, 15 bp, Homo sapiens
caccaatgatgaaca

SEQ ID NO: 91726 - DNA, 15 bp, Homo sapiens
gcaccaatgatgaac

SEQ ID NO: 91727 - DNA, 15 bp, Homo sapiens
tgcaccaatgatgaa

SEQ ID NO: 91728 - DNA, 15 bp, Homo sapiens
ttgcaccaatgatga

SEQ ID NO: 91729 - DNA, 15 bp, Homo sapiens
tttgcaccaatgatg

SEQ ID NO: 91730 - DNA, 15 bp, Homo sapiens
ttttgcaccaatgat

SEQ ID NO: 91731 - DNA, 15 bp, Homo sapiens
tttttgcaccaatga

SEQ ID NO: 91732 - DNA, 15 bp, Homo sapiens
atttttgcaccaatg

SEQ ID NO: 91733 - DNA, 15 bp, Homo sapiens
catttttgcaccaat

SEQ ID NO: 91734 - DNA, 15 bp, Homo sapiens
acatttttgcaccaa

SEQ ID NO: 91735 - DNA, 15 bp, Homo sapiens
cacatttttgcacca

SEQ ID NO: 91736 - DNA, 15 bp, Homo sapiens
acacatttttgcacc

SEQ ID NO: 91737 - DNA, 15 bp, Homo sapiens
aacacatttttgcac

SEQ ID NO: 91738 - DNA, 15 bp, Homo sapiens
aaacacatttttgca

SEQ ID NO: 91739 - DNA, 15 bp, Homo sapiens
taaacacatttttgc

SEQ ID NO: 91740 - DNA, 15 bp, Homo sapiens
ataaacacatttttg

SEQ ID NO: 91741 - DNA, 15 bp, Homo sapiens
cataaacacattttt

SEQ ID NO: 91742 - DNA, 15 bp, Homo sapiens
tcataaacacatttt

SEQ ID NO: 91743 - DNA, 15 bp, Homo sapiens
atcataaacacattt

SEQ ID NO: 91744 - DNA, 15 bp, Homo sapiens
aatcataaacacatt

SEQ ID NO: 91745 - DNA, 15 bp, Homo sapiens
aaatcataaacacat

SEQ ID NO: 91746 - DNA, 15 bp, Homo sapiens
caaatcataaacaca

SEQ ID NO: 91747 - DNA, 15 bp, Homo sapiens
tcaaatcataaacac

SEQ ID NO: 91748 - DNA, 15 bp, Homo sapiens
ctcaaatcataaaca

SEQ ID NO: 91749 - DNA, 15 bp, Homo sapiens
cctcaaatcataaac

SEQ ID NO: 91750 - DNA, 15 bp, Homo sapiens
ccctcaaatcataaa

SEQ ID NO: 91751 - DNA, 15 bp, Homo sapiens
accctcaaatcataa

SEQ ID NO: 91752 - DNA, 15 bp, Homo sapiens
aaccctcaaatcata

SEQ ID NO: 91753 - DNA, 15 bp, Homo sapiens
taaccctcaaatcat

SEQ ID NO: 91754 - DNA, 15 bp, Homo sapiens
ctaaccctcaaatca

SEQ ID NO: 91755 - DNA, 15 bp, Homo sapiens
actaaccctcaaatc

SEQ ID NO: 91756 - DNA, 15 bp, Homo sapiens
aactaaccctcaaat

SEQ ID NO: 91757 - DNA, 15 bp, Homo sapiens
aaactaaccctcaaa

SEQ ID NO: 91758 - DNA, 15 bp, Homo sapiens
caaactaaccctcaa

SEQ ID NO: 91759 - DNA, 15 bp, Homo sapiens
tcaaactaaccctca

SEQ ID NO: 91760 - DNA, 15 bp, Homo sapiens
gtcaaactaaccctc

SEQ ID NO: 91761 - DNA, 15 bp, Homo sapiens
ggtcaaactaaccct

SEQ ID NO: 91762 - DNA, 15 bp, Homo sapiens
aggtcaaactaaccc

SEQ ID NO: 91763 - DNA, 15 bp, Homo sapiens
gaggtcaaactaacc

SEQ ID NO: 91764 - DNA, 15 bp, Homo sapiens
tgaggtcaaactaac

SEQ ID NO: 91765 - DNA, 15 bp, Homo sapiens
gtgaggtcaaactaa

SEQ ID NO: 91766 - DNA, 15 bp, Homo sapiens
tgtgaggtcaaacta

SEQ ID NO: 91767 - DNA, 15 bp, Homo sapiens
atgtgaggtcaaact

SEQ ID NO: 91768 - DNA, 15 bp, Homo sapiens
tatgtgaggtcaaac

SEQ ID NO: 91769 - DNA, 15 bp, Homo sapiens
ttatgtgaggtcaaa

SEQ ID NO: 91770 - DNA, 15 bp, Homo sapiens
tttatgtgaggtcaa

SEQ ID NO: 91771 - DNA, 15 bp, Homo sapiens
ttttatgtgaggtca

SEQ ID NO: 91772 - DNA, 15 bp, Homo sapiens
cttttatgtgaggtc

SEQ ID NO: 91773 - DNA, 15 bp, Homo sapiens
tcttttatgtgaggt

SEQ ID NO: 91774 - DNA, 15 bp, Homo sapiens
ttcttttatgtgagg

SEQ ID NO: 91775 - DNA, 15 bp, Homo sapiens
tttcttttatgtgag

SEQ ID NO: 91776 - DNA, 15 bp, Homo sapiens
ctttcttttatgtga

SEQ ID NO: 91777 - DNA, 15 bp, Homo sapiens
actttcttttatgtg

SEQ ID NO: 91778 - DNA, 15 bp, Homo sapiens
tactttcttttatgt

SEQ ID NO: 91779 - DNA, 15 bp, Homo sapiens
gtactttcttttatg

SEQ ID NO: 91780 - DNA, 15 bp, Homo sapiens
tgtactttcttttat

SEQ ID NO: 91781 - DNA, 15 bp, Homo sapiens
ctgtactttctttta

SEQ ID NO: 91782 - DNA, 15 bp, Homo sapiens
actgtactttctttt

SEQ ID NO: 91783 - DNA, 15 bp, Homo sapiens
aactgtactttcttt

SEQ ID NO: 91784 - DNA, 15 bp, Homo sapiens
taactgtactttctt

SEQ ID NO: 91785 - DNA, 15 bp, Homo sapiens
ataactgtactttct

SEQ ID NO: 91786 - DNA, 15 bp, Homo sapiens
aataactgtactttc

SEQ ID NO: 91787 - DNA, 15 bp, Homo sapiens
taataactgtacttt

SEQ ID NO: 91788 - DNA, 15 bp, Homo sapiens
ttaataactgtactt

SEQ ID NO: 91789 - DNA, 15 bp, Homo sapiens
tttaataactgtact

SEQ ID NO: 91790 - DNA, 15 bp, Homo sapiens
ttttaataactgtac

SEQ ID NO: 91791 - DNA, 15 bp, Homo sapiens
tttttaataactgta

SEQ ID NO: 91792 - DNA, 15 bp, Homo sapiens
atttttaataactgt

SEQ ID NO: 91793 - DNA, 15 bp, Homo sapiens
aatttttaataactg

SEQ ID NO: 91794 - DNA, 15 bp, Homo sapiens
aaatttttaataact

SEQ ID NO: 91795 - DNA, 15 bp, Homo sapiens
aaaatttttaataac

SEQ ID NO: 91796 - DNA, 15 bp, Homo sapiens
aaaaatttttaataa

SEQ ID NO: 91797 - DNA, 15 bp, Homo sapiens
aaaaaatttttaata

SEQ ID NO: 91798 - DNA, 15 bp, Homo sapiens
gaaaaaatttttaat

SEQ ID NO: 91799 - DNA, 15 bp, Homo sapiens
tgaaaaaatttttaa

SEQ ID NO: 91800 - DNA, 15 bp, Homo sapiens
atgaaaaaattttta

SEQ ID NO: 91801 - DNA, 15 bp, Homo sapiens
tatgaaaaaattttt

SEQ ID NO: 91802 - DNA, 15 bp, Homo sapiens
ctatgaaaaaatttt

SEQ ID NO: 91803 - DNA, 15 bp, Homo sapiens
tctatgaaaaaattt

SEQ ID NO: 91804 - DNA, 15 bp, Homo sapiens
ttctatgaaaaaatt

SEQ ID NO: 91805 - DNA, 15 bp, Homo sapiens
cttctatgaaaaaat

SEQ ID NO: 91806 - DNA, 15 bp, Homo sapiens
tcttctatgaaaaaa

SEQ ID NO: 91807 - DNA, 15 bp, Homo sapiens
ttcttctatgaaaaa

SEQ ID NO: 91808 - DNA, 15 bp, Homo sapiens
tttcttctatgaaaa

SEQ ID NO: 91809 - DNA, 15 bp, Homo sapiens
ttttcttctatgaaa

SEQ ID NO: 91810 - DNA, 15 bp, Homo sapiens
cttttcttctatgaa

SEQ ID NO: 91811 - DNA, 15 bp, Homo sapiens
gcttttcttctatga

SEQ ID NO: 91812 - DNA, 15 bp, Homo sapiens
tgcttttcttctatg

SEQ ID NO: 91813 - DNA, 15 bp, Homo sapiens
atgcttttcttctat

SEQ ID NO: 91814 - DNA, 15 bp, Homo sapiens
tatgcttttcttcta

SEQ ID NO: 91815 - DNA, 15 bp, Homo sapiens
atatgcttttcttct

SEQ ID NO: 91816 - DNA, 15 bp, Homo sapiens
aatatgcttttcttc

SEQ ID NO: 91817 - DNA, 15 bp, Homo sapiens
aaatatgcttttctt

SEQ ID NO: 91818 - DNA, 15 bp, Homo sapiens
aaaatatgcttttct

SEQ ID NO: 91819 - DNA, 15 bp, Homo sapiens
gaaaatatgcttttc

SEQ ID NO: 91820 - DNA, 15 bp, Homo sapiens
agaaaatatgctttt

SEQ ID NO: 91821 - DNA, 15 bp, Homo sapiens
gagaaaatatgcttt

SEQ ID NO: 91822 - DNA, 15 bp, Homo sapiens
ggagaaaatatgctt

SEQ ID NO: 91823 - DNA, 15 bp, Homo sapiens
aggagaaaatatgct

SEQ ID NO: 91824 - DNA, 15 bp, Homo sapiens
aaggagaaaatatgc

SEQ ID NO: 91825 - DNA, 15 bp, Homo sapiens
gaaggagaaaatatg

SEQ ID NO: 91826 - DNA, 15 bp, Homo sapiens
agaaggagaaaatat

SEQ ID NO: 91827 - DNA, 15 bp, Homo sapiens
cagaaggagaaaata

SEQ ID NO: 91828 - DNA, 15 bp, Homo sapiens
gcagaaggagaaaat

SEQ ID NO: 91829 - DNA, 15 bp, Homo sapiens
agcagaaggagaaaa

SEQ ID NO: 91830 - DNA, 15 bp, Homo sapiens
cagcagaaggagaaa

SEQ ID NO: 91831 - DNA, 15 bp, Homo sapiens
acagcagaaggagaa

SEQ ID NO: 91832 - DNA, 15 bp, Homo sapiens
cacagcagaaggaga

SEQ ID NO: 91833 - DNA, 15 bp, Homo sapiens
tcacagcagaaggag

SEQ ID NO: 91834 - DNA, 15 bp, Homo sapiens
atcacagcagaagga

SEQ ID NO: 91835 - DNA, 15 bp, Homo sapiens
aatcacagcagaagg

SEQ ID NO: 91836 - DNA, 15 bp, Homo sapiens
taatcacagcagaag

SEQ ID NO: 91837 - DNA, 15 bp, Homo sapiens
ctaatcacagcagaa

SEQ ID NO: 91838 - DNA, 15 bp, Homo sapiens
gctaatcacagcaga

SEQ ID NO: 91839 - DNA, 15 bp, Homo sapiens
agctaatcacagcag

SEQ ID NO: 91840 - DNA, 15 bp, Homo sapiens
aagctaatcacagca

SEQ ID NO: 91841 - DNA, 15 bp, Homo sapiens
taagctaatcacagc

SEQ ID NO: 91842 - DNA, 15 bp, Homo sapiens
ttaagctaatcacag

SEQ ID NO: 91843 - DNA, 15 bp, Homo sapiens
tttaagctaatcaca

SEQ ID NO: 91844 - DNA, 15 bp, Homo sapiens
ttttaagctaatcac

SEQ ID NO: 91845 - DNA, 15 bp, Homo sapiens
attttaagctaatca

SEQ ID NO: 91846 - DNA, 15 bp, Homo sapiens
aattttaagctaatc

SEQ ID NO: 91847 - DNA, 15 bp, Homo sapiens
gaattttaagctaat

SEQ ID NO: 91848 - DNA, 15 bp, Homo sapiens
agaattttaagctaa

SEQ ID NO: 91849 - DNA, 15 bp, Homo sapiens
gagaattttaagcta

SEQ ID NO: 91850 - DNA, 15 bp, Homo sapiens
tgagaattttaagct

SEQ ID NO: 91851 - DNA, 15 bp, Homo sapiens
ttgagaattttaagc

SEQ ID NO: 91852 - DNA, 15 bp, Homo sapiens
gttgagaattttaag

SEQ ID NO: 91853 - DNA, 15 bp, Homo sapiens
ggttgagaattttaa

SEQ ID NO: 91854 - DNA, 15 bp, Homo sapiens
aggttgagaatttta

SEQ ID NO: 91855 - DNA, 15 bp, Homo sapiens
caggttgagaatttt

SEQ ID NO: 91856 - DNA, 15 bp, Homo sapiens
acaggttgagaattt

SEQ ID NO: 91857 - DNA, 15 bp, Homo sapiens
aacaggttgagaatt

SEQ ID NO: 91858 - DNA, 15 bp, Homo sapiens
gaacaggttgagaat

SEQ ID NO: 91859 - DNA, 15 bp, Homo sapiens
tgaacaggttgagaa

SEQ ID NO: 91860 - DNA, 15 bp, Homo sapiens
atgaacaggttgaga

SEQ ID NO: 91861 - DNA, 15 bp, Homo sapiens
tatgaacaggttgag

SEQ ID NO: 91862 - DNA, 15 bp, Homo sapiens
ttatgaacaggttga

SEQ ID NO: 91863 - DNA, 15 bp, Homo sapiens
tttatgaacaggttg

SEQ ID NO: 91864 - DNA, 15 bp, Homo sapiens
ttttatgaacaggtt

SEQ ID NO: 91865 - DNA, 15 bp, Homo sapiens
attttatgaacaggt

SEQ ID NO: 91866 - DNA, 15 bp, Homo sapiens
gattttatgaacagg

SEQ ID NO: 91867 - DNA, 15 bp, Homo sapiens
agattttatgaacag

SEQ ID NO: 91868 - DNA, 15 bp, Homo sapiens
cagattttatgaaca

SEQ ID NO: 91869 - DNA, 15 bp, Homo sapiens
gcagattttatgaac

SEQ ID NO: 91870 - DNA, 15 bp, Homo sapiens
agcagattttatgaa

SEQ ID NO: 91871 - DNA, 15 bp, Homo sapiens
tagcagattttatga

SEQ ID NO: 91872 - DNA, 15 bp, Homo sapiens
ttagcagattttatg

SEQ ID NO: 91873 - DNA, 15 bp, Homo sapiens
tttagcagattttat

SEQ ID NO: 91874 - DNA, 15 bp, Homo sapiens
ttttagcagatttta

SEQ ID NO: 91875 - DNA, 15 bp, Homo sapiens
attttagcagatttt

SEQ ID NO: 91876 - DNA, 15 bp, Homo sapiens
tattttagcagattt

SEQ ID NO: 91877 - DNA, 15 bp, Homo sapiens
atattttagcagatt

SEQ ID NO: 91878 - DNA, 15 bp, Homo sapiens
gatattttagcagat

SEQ ID NO: 91879 - DNA, 15 bp, Homo sapiens
agatattttagcaga

SEQ ID NO: 91880 - DNA, 15 bp, Homo sapiens
aagatattttagcag

SEQ ID NO: 91881 - DNA, 15 bp, Homo sapiens
aaagatattttagca

SEQ ID NO: 91882 - DNA, 15 bp, Homo sapiens
taaagatattttagc

SEQ ID NO: 91883 - DNA, 15 bp, Homo sapiens
ataaagatattttag

SEQ ID NO: 91884 - DNA, 15 bp, Homo sapiens
cataaagatatttta

SEQ ID NO: 91885 - DNA, 15 bp, Homo sapiens
tcataaagatatttt

SEQ ID NO: 91886 - DNA, 15 bp, Homo sapiens
ttcataaagatattt

SEQ ID NO: 91887 - DNA, 15 bp, Homo sapiens
tttcataaagatatt

SEQ ID NO: 91888 - DNA, 15 bp, Homo sapiens
atttcataaagatat

SEQ ID NO: 91889 - DNA, 15 bp, Homo sapiens
catttcataaagata

SEQ ID NO: 91890 - DNA, 15 bp, Homo sapiens
tcatttcataaagat

SEQ ID NO: 91891 - DNA, 15 bp, Homo sapiens
ctcatttcataaaga

SEQ ID NO: 91892 - DNA, 15 bp, Homo sapiens
cctcatttcataaag

SEQ ID NO: 91893 - DNA, 15 bp, Homo sapiens
tcctcatttcataaa

SEQ ID NO: 91894 - DNA, 15 bp, Homo sapiens
gtcctcatttcataa

SEQ ID NO: 91895 - DNA, 15 bp, Homo sapiens
agtcctcatttcata

SEQ ID NO: 91896 - DNA, 15 bp, Homo sapiens
tagtcctcatttcat

SEQ ID NO: 91897 - DNA, 15 bp, Homo sapiens
atagtcctcatttca

SEQ ID NO: 91898 - DNA, 15 bp, Homo sapiens
gatagtcctcatttc

SEQ ID NO: 91899 - DNA, 15 bp, Homo sapiens
tgatagtcctcattt

SEQ ID NO: 91900 - DNA, 15 bp, Homo sapiens
ctgatagtcctcatt

SEQ ID NO: 91901 - DNA, 15 bp, Homo sapiens
actgatagtcctcat

SEQ ID NO: 91902 - DNA, 15 bp, Homo sapiens
aactgatagtcctca

SEQ ID NO: 91903 - DNA, 15 bp, Homo sapiens
caactgatagtcctc

SEQ ID NO: 91904 - DNA, 15 bp, Homo sapiens
tcaactgatagtcct

SEQ ID NO: 91905 - DNA, 15 bp, Homo sapiens
gtcaactgatagtcc

SEQ ID NO: 91906 - DNA, 15 bp, Homo sapiens
cgtcaactgatagtc

SEQ ID NO: 91907 - DNA, 15 bp, Homo sapiens
acgtcaactgatagt

SEQ ID NO: 91908 - DNA, 15 bp, Homo sapiens
cacgtcaactgatag

SEQ ID NO: 91909 - DNA, 15 bp, Homo sapiens
acacgtcaactgata

SEQ ID NO: 91910 - DNA, 15 bp, Homo sapiens
aacacgtcaactgat

SEQ ID NO: 91911 - DNA, 15 bp, Homo sapiens
caacacgtcaactga

SEQ ID NO: 91912 - DNA, 15 bp, Homo sapiens
tcaacacgtcaactg

SEQ ID NO: 91913 - DNA, 15 bp, Homo sapiens
atcaacacgtcaact

SEQ ID NO: 91914 - DNA, 15 bp, Homo sapiens
catcaacacgtcaac

SEQ ID NO: 91915 - DNA, 15 bp, Homo sapiens
acatcaacacgtcaa

SEQ ID NO: 91916 - DNA, 15 bp, Homo sapiens
tacatcaacacgtca

SEQ ID NO: 91917 - DNA, 15 bp, Homo sapiens
atacatcaacacgtc

SEQ ID NO: 91918 - DNA, 15 bp, Homo sapiens
tatacatcaacacgt

SEQ ID NO: 91919 - DNA, 15 bp, Homo sapiens
gtatacatcaacacg

SEQ ID NO: 91920 - DNA, 15 bp, Homo sapiens
agtatacatcaacac

SEQ ID NO: 91921 - DNA, 15 bp, Homo sapiens
aagtatacatcaaca

SEQ ID NO: 91922 - DNA, 15 bp, Homo sapiens
aaagtatacatcaac

SEQ ID NO: 91923 - DNA, 15 bp, Homo sapiens
aaaagtatacatcaa

SEQ ID NO: 91924 - DNA, 15 bp, Homo sapiens
aaaaagtatacatca

SEQ ID NO: 91925 - DNA, 15 bp, Homo sapiens
aaaaaagtatacatc

SEQ ID NO: 91926 - DNA, 15 bp, Homo sapiens
gaaaaaagtatacat

SEQ ID NO: 91927 - DNA, 15 bp, Homo sapiens
agaaaaaagtataca

SEQ ID NO: 91928 - DNA, 15 bp, Homo sapiens
cagaaaaaagtatac

SEQ ID NO: 91929 - DNA, 15 bp, Homo sapiens
gcagaaaaaagtata

SEQ ID NO: 91930 - DNA, 15 bp, Homo sapiens
tgcagaaaaaagtat

SEQ ID NO: 91931 - DNA, 15 bp, Homo sapiens
atgcagaaaaaagta

SEQ ID NO: 91932 - DNA, 15 bp, Homo sapiens
gatgcagaaaaaagt

SEQ ID NO: 91933 - DNA, 15 bp, Homo sapiens
cgatgcagaaaaaag

SEQ ID NO: 91934 - DNA, 15 bp, Homo sapiens
tcgatgcagaaaaaa

SEQ ID NO: 91935 - DNA, 15 bp, Homo sapiens
ttcgatgcagaaaaa

SEQ ID NO: 91936 - DNA, 15 bp, Homo sapiens
attcgatgcagaaaa

SEQ ID NO: 91937 - DNA, 15 bp, Homo sapiens
tattcgatgcagaaa

SEQ ID NO: 91938 - DNA, 15 bp, Homo sapiens
ctattcgatgcagaa

SEQ ID NO: 91939 - DNA, 15 bp, Homo sapiens
cctattcgatgcaga

SEQ ID NO: 91940 - DNA, 15 bp, Homo sapiens
tcctattcgatgcag

SEQ ID NO: 91941 - DNA, 15 bp, Homo sapiens
ttcctattcgatgca

SEQ ID NO: 91942 - DNA, 15 bp, Homo sapiens
attcctattcgatgc

SEQ ID NO: 91943 - DNA, 15 bp, Homo sapiens
cattcctattcgatg

SEQ ID NO: 91944 - DNA, 15 bp, Homo sapiens
acattcctattcgat

SEQ ID NO: 91945 - DNA, 15 bp, Homo sapiens
aacattcctattcga

SEQ ID NO: 91946 - DNA, 15 bp, Homo sapiens
aaacattcctattcg

SEQ ID NO: 91947 - DNA, 15 bp, Homo sapiens
gaaacattcctattc

SEQ ID NO: 91948 - DNA, 15 bp, Homo sapiens
ggaaacattcctatt

SEQ ID NO: 91949 - DNA, 15 bp, Homo sapiens
cggaaacattcctat

SEQ ID NO: 91950 - DNA, 15 bp, Homo sapiens
tcggaaacattccta

SEQ ID NO: 91951 - DNA, 15 bp, Homo sapiens
ctcggaaacattcct

SEQ ID NO: 91952 - DNA, 15 bp, Homo sapiens
cctcggaaacattcc

SEQ ID NO: 91953 - DNA, 15 bp, Homo sapiens
acctcggaaacattc

SEQ ID NO: 91954 - DNA, 15 bp, Homo sapiens
gacctcggaaacatt

SEQ ID NO: 91955 - DNA, 15 bp, Homo sapiens
tgacctcggaaacat

SEQ ID NO: 91956 - DNA, 15 bp, Homo sapiens
atgacctcggaaaca

SEQ ID NO: 91957 - DNA, 15 bp, Homo sapiens
aatgacctcggaaac

SEQ ID NO: 91958 - DNA, 15 bp, Homo sapiens
aaatgacctcggaaa

SEQ ID NO: 91959 - DNA, 15 bp, Homo sapiens
taaatgacctcggaa

SEQ ID NO: 91960 - DNA, 15 bp, Homo sapiens
ctaaatgacctcgga

SEQ ID NO: 91961 - DNA, 15 bp, Homo sapiens
actaaatgacctcgg

SEQ ID NO: 91962 - DNA, 15 bp, Homo sapiens
aactaaatgacctcg

SEQ ID NO: 91963 - DNA, 15 bp, Homo sapiens
caactaaatgacctc

SEQ ID NO: 91964 - DNA, 15 bp, Homo sapiens
tcaactaaatgacct

SEQ ID NO: 91965 - DNA, 15 bp, Homo sapiens
ctcaactaaatgacc

SEQ ID NO: 91966 - DNA, 15 bp, Homo sapiens
actcaactaaatgac

SEQ ID NO: 91967 - DNA, 15 bp, Homo sapiens
tactcaactaaatga

SEQ ID NO: 91968 - DNA, 15 bp, Homo sapiens
ctactcaactaaatg

SEQ ID NO: 91969 - DNA, 15 bp, Homo sapiens
gctactcaactaaat

SEQ ID NO: 91970 - DNA, 15 bp, Homo sapiens
ggctactcaactaaa

SEQ ID NO: 91971 - DNA, 15 bp, Homo sapiens
aggctactcaactaa

SEQ ID NO: 91972 - DNA, 15 bp, Homo sapiens
aaggctactcaacta

SEQ ID NO: 91973 - DNA, 15 bp, Homo sapiens
taaggctactcaact

SEQ ID NO: 91974 - DNA, 15 bp, Homo sapiens
ataaggctactcaac

SEQ ID NO: 91975 - DNA, 15 bp, Homo sapiens
cataaggctactcaa

SEQ ID NO: 91976 - DNA, 15 bp, Homo sapiens
ccataaggctactca

SEQ ID NO: 91977 - DNA, 15 bp, Homo sapiens
gccataaggctactc

SEQ ID NO: 91978 - DNA, 15 bp, Homo sapiens
agccataaggctact

SEQ ID NO: 91979 - DNA, 15 bp, Homo sapiens
gagccataaggctac

SEQ ID NO: 91980 - DNA, 15 bp, Homo sapiens
agagccataaggcta

SEQ ID NO: 91981 - DNA, 15 bp, Homo sapiens
cagagccataaggct

SEQ ID NO: 91982 - DNA, 15 bp, Homo sapiens
acagagccataaggc

SEQ ID NO: 91983 - DNA, 15 bp, Homo sapiens
cacagagccataagg

SEQ ID NO: 91984 - DNA, 15 bp, Homo sapiens
gcacagagccataag

SEQ ID NO: 91985 - DNA, 15 bp, Homo sapiens
agcacagagccataa

SEQ ID NO: 91986 - DNA, 15 bp, Homo sapiens
tagcacagagccata

SEQ ID NO: 91987 - DNA, 15 bp, Homo sapiens
atagcacagagccat

SEQ ID NO: 91988 - DNA, 15 bp, Homo sapiens
aatagcacagagcca

SEQ ID NO: 91989 - DNA, 15 bp, Homo sapiens
taatagcacagagcc

SEQ ID NO: 91990 - DNA, 15 bp, Homo sapiens
ctaatagcacagagc

SEQ ID NO: 91991 - DNA, 15 bp, Homo sapiens
tctaatagcacagag

SEQ ID NO: 91992 - DNA, 15 bp, Homo sapiens
atctaatagcacaga

SEQ ID NO: 91993 - DNA, 15 bp, Homo sapiens
catctaatagcacag

SEQ ID NO: 91994 - DNA, 15 bp, Homo sapiens
tcatctaatagcaca

SEQ ID NO: 91995 - DNA, 15 bp, Homo sapiens
ttcatctaatagcac

SEQ ID NO: 91996 - DNA, 15 bp, Homo sapiens
tttcatctaatagca

SEQ ID NO: 91997 - DNA, 15 bp, Homo sapiens
ttttcatctaatagc

SEQ ID NO: 91998 - DNA, 15 bp, Homo sapiens
cttttcatctaatag

SEQ ID NO: 91999 - DNA, 15 bp, Homo sapiens
ccttttcatctaata

SEQ ID NO: 92000 - DNA, 15 bp, Homo sapiens
tccttttcatctaat

SEQ ID NO: 92001 - DNA, 15 bp, Homo sapiens
ctccttttcatctaa

SEQ ID NO: 92002 - DNA, 15 bp, Homo sapiens
tctccttttcatcta

SEQ ID NO: 92003 - DNA, 15 bp, Homo sapiens
ctctccttttcatct

SEQ ID NO: 92004 - DNA, 15 bp, Homo sapiens
gctctccttttcatc

SEQ ID NO: 92005 - DNA, 15 bp, Homo sapiens
tgctctccttttcat

SEQ ID NO: 92006 - DNA, 15 bp, Homo sapiens
ctgctctccttttca

SEQ ID NO: 92007 - DNA, 15 bp, Homo sapiens
gctgctctccttttc

SEQ ID NO: 92008 - DNA, 15 bp, Homo sapiens
ggctgctctcctttt

SEQ ID NO: 92009 - DNA, 15 bp, Homo sapiens
tggctgctctccttt

SEQ ID NO: 92010 - DNA, 15 bp, Homo sapiens
atggctgctctcctt

SEQ ID NO: 92011 - DNA, 15 bp, Homo sapiens
aatggctgctctcct

SEQ ID NO: 92012 - DNA, 15 bp, Homo sapiens
caatggctgctctcc

SEQ ID NO: 92013 - DNA, 15 bp, Homo sapiens
tcaatggctgctctc

SEQ ID NO: 92014 - DNA, 15 bp, Homo sapiens
ctcaatggctgctct

SEQ ID NO: 92015 - DNA, 15 bp, Homo sapiens
gctcaatggctgctc

SEQ ID NO: 92016 - DNA, 15 bp, Homo sapiens
tgctcaatggctgct

SEQ ID NO: 92017 - DNA, 15 bp, Homo sapiens
gtgctcaatggctgc

SEQ ID NO: 92018 - DNA, 15 bp, Homo sapiens
agtgctcaatggctg

SEQ ID NO: 92019 - DNA, 15 bp, Homo sapiens
cagtgctcaatggct

SEQ ID NO: 92020 - DNA, 15 bp, Homo sapiens
gcagtgctcaatggc

SEQ ID NO: 92021 - DNA, 15 bp, Homo sapiens
tgcagtgctcaatgg

SEQ ID NO: 92022 - DNA, 15 bp, Homo sapiens
gtgcagtgctcaatg

SEQ ID NO: 92023 - DNA, 15 bp, Homo sapiens
tgtgcagtgctcaat

SEQ ID NO: 92024 - DNA, 15 bp, Homo sapiens
gtgtgcagtgctcaa

SEQ ID NO: 92025 - DNA, 15 bp, Homo sapiens
agtgtgcagtgctca

SEQ ID NO: 92026 - DNA, 15 bp, Homo sapiens
aagtgtgcagtgctc

SEQ ID NO: 92027 - DNA, 15 bp, Homo sapiens
caagtgtgcagtgct

SEQ ID NO: 92028 - DNA, 15 bp, Homo sapiens
ccaagtgtgcagtgc

SEQ ID NO: 92029 - DNA, 15 bp, Homo sapiens
gccaagtgtgcagtg

SEQ ID NO: 92030 - DNA, 15 bp, Homo sapiens
ggccaagtgtgcagt

SEQ ID NO: 92031 - DNA, 15 bp, Homo sapiens
gggccaagtgtgcag

SEQ ID NO: 92032 - DNA, 15 bp, Homo sapiens
tgggccaagtgtgca

SEQ ID NO: 92033 - DNA, 15 bp, Homo sapiens
gtgggccaagtgtgc

SEQ ID NO: 92034 - DNA, 15 bp, Homo sapiens
tgtgggccaagtgtg

SEQ ID NO: 92035 - DNA, 15 bp, Homo sapiens
gtgtgggccaagtgt

SEQ ID NO: 92036 - DNA, 15 bp, Homo sapiens
agtgtgggccaagtg

SEQ ID NO: 92037 - DNA, 15 bp, Homo sapiens
cagtgtgggccaagt

SEQ ID NO: 92038 - DNA, 15 bp, Homo sapiens
ccagtgtgggccaag

SEQ ID NO: 92039 - DNA, 15 bp, Homo sapiens
cccagtgtgggccaa

SEQ ID NO: 92040 - DNA, 15 bp, Homo sapiens
acccagtgtgggcca

SEQ ID NO: 92041 - DNA, 15 bp, Homo sapiens
aacccagtgtgggcc

SEQ ID NO: 92042 - DNA, 15 bp, Homo sapiens
aaacccagtgtgggc

SEQ ID NO: 92043 - DNA, 15 bp, Homo sapiens
caaacccagtgtggg

SEQ ID NO: 92044 - DNA, 15 bp, Homo sapiens
gcaaacccagtgtgg

SEQ ID NO: 92045 - DNA, 15 bp, Homo sapiens
agcaaacccagtgtg

SEQ ID NO: 92046 - DNA, 15 bp, Homo sapiens
cagcaaacccagtgt

SEQ ID NO: 92047 - DNA, 15 bp, Homo sapiens
acagcaaacccagtg

SEQ ID NO: 92048 - DNA, 15 bp, Homo sapiens
aacagcaaacccagt

SEQ ID NO: 92049 - DNA, 15 bp, Homo sapiens
gaacagcaaacccag

SEQ ID NO: 92050 - DNA, 15 bp, Homo sapiens
ggaacagcaaaccca

SEQ ID NO: 92051 - DNA, 15 bp, Homo sapiens
gggaacagcaaaccc

SEQ ID NO: 92052 - DNA, 15 bp, Homo sapiens
agggaacagcaaacc

SEQ ID NO: 92053 - DNA, 15 bp, Homo sapiens
aagggaacagcaaac

SEQ ID NO: 92054 - DNA, 15 bp, Homo sapiens
caagggaacagcaaa

SEQ ID NO: 92055 - DNA, 15 bp, Homo sapiens
ccaagggaacagcaa

SEQ ID NO: 92056 - DNA, 15 bp, Homo sapiens
accaagggaacagca

SEQ ID NO: 92057 - DNA, 15 bp, Homo sapiens
aaccaagggaacagc

SEQ ID NO: 92058 - DNA, 15 bp, Homo sapiens
aaaccaagggaacag

SEQ ID NO: 92059 - DNA, 15 bp, Homo sapiens
aaaaccaagggaaca

SEQ ID NO: 92060 - DNA, 15 bp, Homo sapiens
aaaaaccaagggaac

SEQ ID NO: 92061 - DNA, 15 bp, Homo sapiens
taaaaaccaagggaa

SEQ ID NO: 92062 - DNA, 15 bp, Homo sapiens
ctaaaaaccaaggga

SEQ ID NO: 92063 - DNA, 15 bp, Homo sapiens
cctaaaaaccaaggg

SEQ ID NO: 92064 - DNA, 15 bp, Homo sapiens
ccctaaaaaccaagg

SEQ ID NO: 92065 - DNA, 15 bp, Homo sapiens
accctaaaaaccaag

SEQ ID NO: 92066 - DNA, 15 bp, Homo sapiens
aaccctaaaaaccaa

SEQ ID NO: 92067 - DNA, 15 bp, Homo sapiens
caaccctaaaaacca

SEQ ID NO: 92068 - DNA, 15 bp, Homo sapiens
tcaaccctaaaaacc

SEQ ID NO: 92069 - DNA, 15 bp, Homo sapiens
ctcaaccctaaaaac

SEQ ID NO: 92070 - DNA, 15 bp, Homo sapiens
tctcaaccctaaaaa

SEQ ID NO: 92071 - DNA, 15 bp, Homo sapiens
ttctcaaccctaaaa

SEQ ID NO: 92072 - DNA, 15 bp, Homo sapiens
attctcaaccctaaa

SEQ ID NO: 92073 - DNA, 15 bp, Homo sapiens
tattctcaaccctaa

SEQ ID NO: 92074 - DNA, 15 bp, Homo sapiens
gtattctcaacccta

SEQ ID NO: 92075 - DNA, 15 bp, Homo sapiens
tgtattctcaaccct

SEQ ID NO: 92076 - DNA, 15 bp, Homo sapiens
gtgtattctcaaccc

SEQ ID NO: 92077 - DNA, 15 bp, Homo sapiens
agtgtattctcaacc

SEQ ID NO: 92078 - DNA, 15 bp, Homo sapiens
cagtgtattctcaac

SEQ ID NO: 92079 - DNA, 15 bp, Homo sapiens
acagtgtattctcaa

SEQ ID NO: 92080 - DNA, 15 bp, Homo sapiens
tacagtgtattctca

SEQ ID NO: 92081 - DNA, 15 bp, Homo sapiens
atacagtgtattctc

SEQ ID NO: 92082 - DNA, 15 bp, Homo sapiens
aatacagtgtattct

SEQ ID NO: 92083 - DNA, 15 bp, Homo sapiens
caatacagtgtattc

SEQ ID NO: 92084 - DNA, 15 bp, Homo sapiens
gcaatacagtgtatt

SEQ ID NO: 92085 - DNA, 15 bp, Homo sapiens
ggcaatacagtgtat

SEQ ID NO: 92086 - DNA, 15 bp, Homo sapiens
gggcaatacagtgta

SEQ ID NO: 92087 - DNA, 15 bp, Homo sapiens
tgggcaatacagtgt

SEQ ID NO: 92088 - DNA, 15 bp, Homo sapiens
gtgggcaatacagtg

SEQ ID NO: 92089 - DNA, 15 bp, Homo sapiens
tgtgggcaatacagt

SEQ ID NO: 92090 - DNA, 15 bp, Homo sapiens
gtgtgggcaatacag

SEQ ID NO: 92091 - DNA, 15 bp, Homo sapiens
tgtgtgggcaataca

SEQ ID NO: 92092 - DNA, 15 bp, Homo sapiens
gtgtgtgggcaatac

SEQ ID NO: 92093 - DNA, 15 bp, Homo sapiens
tgtgtgtgggcaata

SEQ ID NO: 92094 - DNA, 15 bp, Homo sapiens
ttgtgtgtgggcaat

SEQ ID NO: 92095 - DNA, 15 bp, Homo sapiens
gttgtgtgtgggcaa

SEQ ID NO: 92096 - DNA, 15 bp, Homo sapiens
agttgtgtgtgggca

SEQ ID NO: 92097 - DNA, 15 bp, Homo sapiens
gagttgtgtgtgggc

SEQ ID NO: 92098 - DNA, 15 bp, Homo sapiens
tgagttgtgtgtggg

SEQ ID NO: 92099 - DNA, 15 bp, Homo sapiens
atgagttgtgtgtgg

SEQ ID NO: 92100 - DNA, 15 bp, Homo sapiens
catgagttgtgtgtg

SEQ ID NO: 92101 - DNA, 15 bp, Homo sapiens
tcatgagttgtgtgt

SEQ ID NO: 92102 - DNA, 15 bp, Homo sapiens
ttcatgagttgtgtg

SEQ ID NO: 92103 - DNA, 15 bp, Homo sapiens
cttcatgagttgtgt

SEQ ID NO: 92104 - DNA, 15 bp, Homo sapiens
tcttcatgagttgtg

SEQ ID NO: 92105 - DNA, 15 bp, Homo sapiens
ttcttcatgagttgt

SEQ ID NO: 92106 - DNA, 15 bp, Homo sapiens
tttcttcatgagttg

SEQ ID NO: 92107 - DNA, 15 bp, Homo sapiens
ttttcttcatgagtt

SEQ ID NO: 92108 - DNA, 15 bp, Homo sapiens
tttttcttcatgagt

SEQ ID NO: 92109 - DNA, 15 bp, Homo sapiens
ctttttcttcatgag

SEQ ID NO: 92110 - DNA, 15 bp, Homo sapiens
gctttttcttcatga

SEQ ID NO: 92111 - DNA, 15 bp, Homo sapiens
agctttttcttcatg

SEQ ID NO: 92112 - DNA, 15 bp, Homo sapiens
aagctttttcttcat

SEQ ID NO: 92113 - DNA, 15 bp, Homo sapiens
aaagctttttcttca

SEQ ID NO: 92114 - DNA, 15 bp, Homo sapiens
taaagctttttcttc

SEQ ID NO: 92115 - DNA, 15 bp, Homo sapiens
ttaaagctttttctt

SEQ ID NO: 92116 - DNA, 15 bp, Homo sapiens
attaaagctttttct

SEQ ID NO: 92117 - DNA, 15 bp, Homo sapiens
aattaaagctttttc

SEQ ID NO: 92118 - DNA, 15 bp, Homo sapiens
aaattaaagcttttt

SEQ ID NO: 92119 - DNA, 15 bp, Homo sapiens
aaaattaaagctttt

SEQ ID NO: 92120 - DNA, 15 bp, Homo sapiens
aaaaattaaagcttt

SEQ ID NO: 92121 - DNA, 15 bp, Homo sapiens
taaaaattaaagctt

SEQ ID NO: 92122 - DNA, 15 bp, Homo sapiens
ataaaaattaaagct

SEQ ID NO: 92123 - DNA, 15 bp, Homo sapiens
cataaaaattaaagc

SEQ ID NO: 92124 - DNA, 15 bp, Homo sapiens
tcataaaaattaaag

SEQ ID NO: 92125 - DNA, 15 bp, Homo sapiens
atcataaaaattaaa

SEQ ID NO: 92126 - DNA, 15 bp, Homo sapiens
aatcataaaaattaa

SEQ ID NO: 92127 - DNA, 15 bp, Homo sapiens
taatcataaaaatta

SEQ ID NO: 92128 - DNA, 15 bp, Homo sapiens
ataatcataaaaatt

SEQ ID NO: 92129 - DNA, 15 bp, Homo sapiens
cataatcataaaaat

SEQ ID NO: 92130 - DNA, 15 bp, Homo sapiens
gcataatcataaaaa

SEQ ID NO: 92131 - DNA, 15 bp, Homo sapiens
ggcataatcataaaa

SEQ ID NO: 92132 - DNA, 15 bp, Homo sapiens
aggcataatcataaa

SEQ ID NO: 92133 - DNA, 15 bp, Homo sapiens
taggcataatcataa

SEQ ID NO: 92134 - DNA, 15 bp, Homo sapiens
ataggcataatcata

SEQ ID NO: 92135 - DNA, 15 bp, Homo sapiens
aataggcataatcat

SEQ ID NO: 92136 - DNA, 15 bp, Homo sapiens
aaataggcataatca

SEQ ID NO: 92137 - DNA, 15 bp, Homo sapiens
aaaataggcataatc

SEQ ID NO: 92138 - DNA, 15 bp, Homo sapiens
aaaaataggcataat

SEQ ID NO: 92139 - DNA, 15 bp, Homo sapiens
aaaaaataggcataa

SEQ ID NO: 92140 - DNA, 15 bp, Homo sapiens
aaaaaaataggcata

SEQ ID NO: 92141 - DNA, 15 bp, Homo sapiens
gaaaaaaataggcat

SEQ ID NO: 92142 - DNA, 15 bp, Homo sapiens
tgaaaaaaataggca

SEQ ID NO: 92143 - DNA, 15 bp, Homo sapiens
atgaaaaaaataggc

SEQ ID NO: 92144 - DNA, 15 bp, Homo sapiens
catgaaaaaaatagg

SEQ ID NO: 92145 - DNA, 15 bp, Homo sapiens
tcatgaaaaaaatag

SEQ ID NO: 92146 - DNA, 15 bp, Homo sapiens
ctcatgaaaaaaata

SEQ ID NO: 92147 - DNA, 15 bp, Homo sapiens
actcatgaaaaaaat

SEQ ID NO: 92148 - DNA, 15 bp, Homo sapiens
aactcatgaaaaaaa

SEQ ID NO: 92149 - DNA, 15 bp, Homo sapiens
aaactcatgaaaaaa

SEQ ID NO: 92150 - DNA, 15 bp, Homo sapiens
aaaactcatgaaaaa

SEQ ID NO: 92151 - DNA, 15 bp, Homo sapiens
aaaaactcatgaaaa

SEQ ID NO: 92152 - DNA, 15 bp, Homo sapiens
gaaaaactcatgaaa

SEQ ID NO: 92153 - DNA, 15 bp, Homo sapiens
tgaaaaactcatgaa

SEQ ID NO: 92154 - DNA, 15 bp, Homo sapiens
atgaaaaactcatga

SEQ ID NO: 92155 - DNA, 15 bp, Homo sapiens
catgaaaaactcatg

SEQ ID NO: 92156 - DNA, 15 bp, Homo sapiens
acatgaaaaactcat

SEQ ID NO: 92157 - DNA, 15 bp, Homo sapiens
aacatgaaaaactca

SEQ ID NO: 92158 - DNA, 15 bp, Homo sapiens
aaacatgaaaaactc

SEQ ID NO: 92159 - DNA, 15 bp, Homo sapiens
aaaacatgaaaaact

SEQ ID NO: 92160 - DNA, 15 bp, Homo sapiens
caaaacatgaaaaac

SEQ ID NO: 92161 - DNA, 15 bp, Homo sapiens
acaaaacatgaaaaa

SEQ ID NO: 92162 - DNA, 15 bp, Homo sapiens
aacaaaacatgaaaa

SEQ ID NO: 92163 - DNA, 15 bp, Homo sapiens
aaacaaaacatgaaa

SEQ ID NO: 92164 - DNA, 15 bp, Homo sapiens
aaaacaaaacatgaa

SEQ ID NO: 92165 - DNA, 15 bp, Homo sapiens
caaaacaaaacatga

SEQ ID NO: 92166 - DNA, 15 bp, Homo sapiens
acaaaacaaaacatg

SEQ ID NO: 92167 - DNA, 15 bp, Homo sapiens
aacaaaacaaaacat

SEQ ID NO: 92168 - DNA, 15 bp, Homo sapiens
aaaaacaaaacaaaa

SEQ ID NO: 92169 - DNA, 15 bp, Homo sapiens
aaaaaacaaaacaaa

SEQ ID NO: 92170 - DNA, 15 bp, Homo sapiens
caaaaaacaaaacaa

SEQ ID NO: 92171 - DNA, 15 bp, Homo sapiens
tcaaaaaacaaaaca

SEQ ID NO: 92172 - DNA, 15 bp, Homo sapiens
atcaaaaaacaaaac

SEQ ID NO: 92173 - DNA, 15 bp, Homo sapiens
aatcaaaaaacaaaa

SEQ ID NO: 92174 - DNA, 15 bp, Homo sapiens
aaatcaaaaaacaaa

SEQ ID NO: 92175 - DNA, 15 bp, Homo sapiens
gaaatcaaaaaacaa

SEQ ID NO: 92176 - DNA, 15 bp, Homo sapiens
ggaaatcaaaaaaca

SEQ ID NO: 92177 - DNA, 15 bp, Homo sapiens
tggaaatcaaaaaac

SEQ ID NO: 92178 - DNA, 15 bp, Homo sapiens
ttggaaatcaaaaaa

SEQ ID NO: 92179 - DNA, 15 bp, Homo sapiens
gttggaaatcaaaaa

SEQ ID NO: 92180 - DNA, 15 bp, Homo sapiens
agttggaaatcaaaa

SEQ ID NO: 92181 - DNA, 15 bp, Homo sapiens
aagttggaaatcaaa

SEQ ID NO: 92182 - DNA, 15 bp, Homo sapiens
aaagttggaaatcaa

SEQ ID NO: 92183 - DNA, 15 bp, Homo sapiens
aaaagttggaaatca

SEQ ID NO: 92184 - DNA, 15 bp, Homo sapiens
taaaagttggaaatc

SEQ ID NO: 92185 - DNA, 15 bp, Homo sapiens
ataaaagttggaaat

SEQ ID NO: 92186 - DNA, 15 bp, Homo sapiens
aataaaagttggaaa

SEQ ID NO: 92187 - DNA, 15 bp, Homo sapiens
aaataaaagttggaa

SEQ ID NO: 92188 - DNA, 15 bp, Homo sapiens
aaaataaaagttgga

SEQ ID NO: 92189 - DNA, 15 bp, Homo sapiens
taaaataaaagttgg

SEQ ID NO: 92190 - DNA, 15 bp, Homo sapiens
ttaaaataaaagttg

SEQ ID NO: 92191 - DNA, 15 bp, Homo sapiens
gaacttaaaataaaa

SEQ ID NO: 92192 - DNA, 15 bp, Homo sapiens
tgaacttaaaataaa

SEQ ID NO: 92193 - DNA, 15 bp, Homo sapiens
ctgaacttaaaataa

SEQ ID NO: 92194 - DNA, 15 bp, Homo sapiens
cctgaacttaaaata

SEQ ID NO: 92195 - DNA, 15 bp, Homo sapiens
ccctgaacttaaaat

SEQ ID NO: 92196 - DNA, 15 bp, Homo sapiens
cccctgaacttaaaa

SEQ ID NO: 92197 - DNA, 15 bp, Homo sapiens
acccctgaacttaaa

SEQ ID NO: 92198 - DNA, 15 bp, Homo sapiens
tacccctgaacttaa

SEQ ID NO: 92199 - DNA, 15 bp, Homo sapiens
gtacccctgaactta

SEQ ID NO: 92200 - DNA, 15 bp, Homo sapiens
agtacccctgaactt

SEQ ID NO: 92201 - DNA, 15 bp, Homo sapiens
aagtacccctgaact

SEQ ID NO: 92202 - DNA, 15 bp, Homo sapiens
caagtacccctgaac

SEQ ID NO: 92203 - DNA, 15 bp, Homo sapiens
acaagtacccctgaa

SEQ ID NO: 92204 - DNA, 15 bp, Homo sapiens
cacaagtacccctga

SEQ ID NO: 92205 - DNA, 15 bp, Homo sapiens
gcacaagtacccctg

SEQ ID NO: 92206 - DNA, 15 bp, Homo sapiens
tgcacaagtacccct

SEQ ID NO: 92207 - DNA, 15 bp, Homo sapiens
ctgcacaagtacccc

SEQ ID NO: 92208 - DNA, 15 bp, Homo sapiens
cctgcacaagtaccc

SEQ ID NO: 92209 - DNA, 15 bp, Homo sapiens
tcctgcacaagtacc

SEQ ID NO: 92210 - DNA, 15 bp, Homo sapiens
atcctgcacaagtac

SEQ ID NO: 92211 - DNA, 15 bp, Homo sapiens
catcctgcacaagta

SEQ ID NO: 92212 - DNA, 15 bp, Homo sapiens
acatcctgcacaagt

SEQ ID NO: 92213 - DNA, 15 bp, Homo sapiens
cacatcctgcacaag

SEQ ID NO: 92214 - DNA, 15 bp, Homo sapiens
gcacatcctgcacaa

SEQ ID NO: 92215 - DNA, 15 bp, Homo sapiens
tgcacatcctgcaca

SEQ ID NO: 92216 - DNA, 15 bp, Homo sapiens
ctgcacatcctgcac

SEQ ID NO: 92217 - DNA, 15 bp, Homo sapiens
cctgcacatcctgca

SEQ ID NO: 92218 - DNA, 15 bp, Homo sapiens
acctgcacatcctgc

SEQ ID NO: 92219 - DNA, 15 bp, Homo sapiens
aacctgcacatcctg

SEQ ID NO: 92220 - DNA, 15 bp, Homo sapiens
aaacctgcacatcct

SEQ ID NO: 92221 - DNA, 15 bp, Homo sapiens
caaacctgcacatcc

SEQ ID NO: 92222 - DNA, 15 bp, Homo sapiens
acaaacctgcacatc

SEQ ID NO: 92223 - DNA, 15 bp, Homo sapiens
aacaaacctgcacat

SEQ ID NO: 92224 - DNA, 15 bp, Homo sapiens
ttaacaaacctgcac

SEQ ID NO: 92225 - DNA, 15 bp, Homo sapiens
tttaacaaacctgca

SEQ ID NO: 92226 - DNA, 15 bp, Homo sapiens
atttaacaaacctgc

SEQ ID NO: 92227 - DNA, 15 bp, Homo sapiens
catttaacaaacctg

SEQ ID NO: 92228 - DNA, 15 bp, Homo sapiens
ccatttaacaaacct

SEQ ID NO: 92229 - DNA, 15 bp, Homo sapiens
cccatttaacaaacc

SEQ ID NO: 92230 - DNA, 15 bp, Homo sapiens
acccatttaacaaac

SEQ ID NO: 92231 - DNA, 15 bp, Homo sapiens
tacccatttaacaaa

SEQ ID NO: 92232 - DNA, 15 bp, Homo sapiens
ttacccatttaacaa

SEQ ID NO: 92233 - DNA, 15 bp, Homo sapiens
tttacccatttaaca

SEQ ID NO: 92234 - DNA, 15 bp, Homo sapiens
gtttacccatttaac

SEQ ID NO: 92235 - DNA, 15 bp, Homo sapiens
cgtttacccatttaa

SEQ ID NO: 92236 - DNA, 15 bp, Homo sapiens
acgtttacccattta

SEQ ID NO: 92237 - DNA, 15 bp, Homo sapiens
cacgtttacccattt

SEQ ID NO: 92238 - DNA, 15 bp, Homo sapiens
acacgtttacccatt

SEQ ID NO: 92239 - DNA, 15 bp, Homo sapiens
cacacgtttacccat

SEQ ID NO: 92240 - DNA, 15 bp, Homo sapiens
acacacgtttaccca

SEQ ID NO: 92241 - DNA, 15 bp, Homo sapiens
gacacacgtttaccc

SEQ ID NO: 92242 - DNA, 15 bp, Homo sapiens
tgacacacgtttacc

SEQ ID NO: 92243 - DNA, 15 bp, Homo sapiens
atgacacacgtttac

SEQ ID NO: 92244 - DNA, 15 bp, Homo sapiens
catgacacacgttta

SEQ ID NO: 92245 - DNA, 15 bp, Homo sapiens
ccatgacacacgttt

SEQ ID NO: 92246 - DNA, 15 bp, Homo sapiens
accatgacacacgtt

SEQ ID NO: 92247 - DNA, 15 bp, Homo sapiens
taccatgacacacgt

SEQ ID NO: 92248 - DNA, 15 bp, Homo sapiens
ctaccatgacacacg

SEQ ID NO: 92249 - DNA, 15 bp, Homo sapiens
actaccatgacacac

SEQ ID NO: 92250 - DNA, 15 bp, Homo sapiens
aactaccatgacaca

SEQ ID NO: 92251 - DNA, 15 bp, Homo sapiens
aaactaccatgacac

SEQ ID NO: 92252 - DNA, 15 bp, Homo sapiens
caaactaccatgaca

SEQ ID NO: 92253 - DNA, 15 bp, Homo sapiens
gcaaactaccatgac

SEQ ID NO: 92254 - DNA, 15 bp, Homo sapiens
agcaaactaccatga

SEQ ID NO: 92255 - DNA, 15 bp, Homo sapiens
cagcaaactaccatg

SEQ ID NO: 92256 - DNA, 15 bp, Homo sapiens
gcagcaaactaccat

SEQ ID NO: 92257 - DNA, 15 bp, Homo sapiens
tgcagcaaactacca

SEQ ID NO: 92258 - DNA, 15 bp, Homo sapiens
gtgcagcaaactacc

SEQ ID NO: 92259 - DNA, 15 bp, Homo sapiens
agtgcagcaaactac

SEQ ID NO: 92260 - DNA, 15 bp, Homo sapiens
tagtgcagcaaacta

SEQ ID NO: 92261 - DNA, 15 bp, Homo sapiens
gtagtgcagcaaact

SEQ ID NO: 92262 - DNA, 15 bp, Homo sapiens
cgtagtgcagcaaac

SEQ ID NO: 92263 - DNA, 15 bp, Homo sapiens
acgtagtgcagcaaa

SEQ ID NO: 92264 - DNA, 15 bp, Homo sapiens
tacgtagtgcagcaa

SEQ ID NO: 92265 - DNA, 15 bp, Homo sapiens
atacgtagtgcagca

SEQ ID NO: 92266 - DNA, 15 bp, Homo sapiens
aatacgtagtgcagc

SEQ ID NO: 92267 - DNA, 15 bp, Homo sapiens
taatacgtagtgcag

SEQ ID NO: 92268 - DNA, 15 bp, Homo sapiens
ttaatacgtagtgca

SEQ ID NO: 92269 - DNA, 15 bp, Homo sapiens
cttaatacgtagtgc

SEQ ID NO: 92270 - DNA, 15 bp, Homo sapiens
gcttaatacgtagtg

SEQ ID NO: 92271 - DNA, 15 bp, Homo sapiens
ggcttaatacgtagt

SEQ ID NO: 92272 - DNA, 15 bp, Homo sapiens
gggcttaatacgtag

SEQ ID NO: 92273 - DNA, 15 bp, Homo sapiens
tgggcttaatacgta

SEQ ID NO: 92274 - DNA, 15 bp, Homo sapiens
ctgggcttaatacgt

SEQ ID NO: 92275 - DNA, 15 bp, Homo sapiens
gctgggcttaatacg

SEQ ID NO: 92276 - DNA, 15 bp, Homo sapiens
tgctgggcttaatac

SEQ ID NO: 92277 - DNA, 15 bp, Homo sapiens
atgctgggcttaata

SEQ ID NO: 92278 - DNA, 15 bp, Homo sapiens
gatgctgggcttaat

SEQ ID NO: 92279 - DNA, 15 bp, Homo sapiens
ggatgctgggcttaa

SEQ ID NO: 92280 - DNA, 15 bp, Homo sapiens
tggatgctgggctta

SEQ ID NO: 92281 - DNA, 15 bp, Homo sapiens
atggatgctgggctt

SEQ ID NO: 92282 - DNA, 15 bp, Homo sapiens
aatggatgctgggct

SEQ ID NO: 92283 - DNA, 15 bp, Homo sapiens
taatggatgctgggc

SEQ ID NO: 92284 - DNA, 15 bp, Homo sapiens
ctaatggatgctggg

SEQ ID NO: 92285 - DNA, 15 bp, Homo sapiens
gctaatggatgctgg

SEQ ID NO: 92286 - DNA, 15 bp, Homo sapiens
agctaatggatgctg

SEQ ID NO: 92287 - DNA, 15 bp, Homo sapiens
gagctaatggatgct

SEQ ID NO: 92288 - DNA, 15 bp, Homo sapiens
agagctaatggatgc

SEQ ID NO: 92289 - DNA, 15 bp, Homo sapiens
aagagctaatggatg

SEQ ID NO: 92290 - DNA, 15 bp, Homo sapiens
gaagagctaatggat

SEQ ID NO: 92291 - DNA, 15 bp, Homo sapiens
agaagagctaatgga

SEQ ID NO: 92292 - DNA, 15 bp, Homo sapiens
aagaagagctaatgg

SEQ ID NO: 92293 - DNA, 15 bp, Homo sapiens
gaagaagagctaatg

SEQ ID NO: 92294 - DNA, 15 bp, Homo sapiens
ggaagaagagctaat

SEQ ID NO: 92295 - DNA, 15 bp, Homo sapiens
aggaagaagagctaa

SEQ ID NO: 92296 - DNA, 15 bp, Homo sapiens
caggaagaagagcta

SEQ ID NO: 92297 - DNA, 15 bp, Homo sapiens
tcaggaagaagagct

SEQ ID NO: 92298 - DNA, 15 bp, Homo sapiens
atcaggaagaagagc

SEQ ID NO: 92299 - DNA, 15 bp, Homo sapiens
catcaggaagaagag

SEQ ID NO: 92300 - DNA, 15 bp, Homo sapiens
gcatcaggaagaaga

SEQ ID NO: 92301 - DNA, 15 bp, Homo sapiens
agcatcaggaagaag

SEQ ID NO: 92302 - DNA, 15 bp, Homo sapiens
aagcatcaggaagaa

SEQ ID NO: 92303 - DNA, 15 bp, Homo sapiens
aaagcatcaggaaga

SEQ ID NO: 92304 - DNA, 15 bp, Homo sapiens
gaaagcatcaggaag

SEQ ID NO: 92305 - DNA, 15 bp, Homo sapiens
ggaaagcatcaggaa

SEQ ID NO: 92306 - DNA, 15 bp, Homo sapiens
gggaaagcatcagga

SEQ ID NO: 92307 - DNA, 15 bp, Homo sapiens
agggaaagcatcagg

SEQ ID NO: 92308 - DNA, 15 bp, Homo sapiens
gagggaaagcatcag

SEQ ID NO: 92309 - DNA, 15 bp, Homo sapiens
ggagggaaagcatca

SEQ ID NO: 92310 - DNA, 15 bp, Homo sapiens
gggagggaaagcatc

SEQ ID NO: 92311 - DNA, 15 bp, Homo sapiens
tgggagggaaagcat

SEQ ID NO: 92312 - DNA, 15 bp, Homo sapiens
gtgggagggaaagca

SEQ ID NO: 92313 - DNA, 15 bp, Homo sapiens
ggtgggagggaaagc

SEQ ID NO: 92314 - DNA, 15 bp, Homo sapiens
tggtgggagggaaag

SEQ ID NO: 92315 - DNA, 15 bp, Homo sapiens
atggtgggagggaaa

SEQ ID NO: 92316 - DNA, 15 bp, Homo sapiens
catggtgggagggaa

SEQ ID NO: 92317 - DNA, 15 bp, Homo sapiens
gcatggtgggaggga

SEQ ID NO: 92318 - DNA, 15 bp, Homo sapiens
ggcatggtgggaggg

SEQ ID NO: 92319 - DNA, 15 bp, Homo sapiens
gggcatggtgggagg

SEQ ID NO: 92320 - DNA, 15 bp, Homo sapiens
ggggcatggtgggag

SEQ ID NO: 92321 - DNA, 15 bp, Homo sapiens
tggggcatggtggga

SEQ ID NO: 92322 - DNA, 15 bp, Homo sapiens
gtggggcatggtggg

SEQ ID NO: 92323 - DNA, 15 bp, Homo sapiens
ggtggggcatggtgg

SEQ ID NO: 92324 - DNA, 15 bp, Homo sapiens
gggtggggcatggtg

SEQ ID NO: 92325 - DNA, 15 bp, Homo sapiens
agggtggggcatggt

SEQ ID NO: 92326 - DNA, 15 bp, Homo sapiens
gagggtggggcatgg

SEQ ID NO: 92327 - DNA, 15 bp, Homo sapiens
ggagggtggggcatg

SEQ ID NO: 92328 - DNA, 15 bp, Homo sapiens
tggagggtggggcat

SEQ ID NO: 92329 - DNA, 15 bp, Homo sapiens
ttggagggtggggca

SEQ ID NO: 92330 - DNA, 15 bp, Homo sapiens
gttggagggtggggc

SEQ ID NO: 92331 - DNA, 15 bp, Homo sapiens
tgttggagggtgggg

SEQ ID NO: 92332 - DNA, 15 bp, Homo sapiens
ctgttggagggtggg

SEQ ID NO: 92333 - DNA, 15 bp, Homo sapiens
tctgttggagggtgg

SEQ ID NO: 92334 - DNA, 15 bp, Homo sapiens
gtctgttggagggtg

SEQ ID NO: 92335 - DNA, 15 bp, Homo sapiens
ggtctgttggagggt

SEQ ID NO: 92336 - DNA, 15 bp, Homo sapiens
gggtctgttggaggg

SEQ ID NO: 92337 - DNA, 15 bp, Homo sapiens
ggggtctgttggagg

SEQ ID NO: 92338 - DNA, 15 bp, Homo sapiens
tggggtctgttggag

SEQ ID NO: 92339 - DNA, 15 bp, Homo sapiens
ctggggtctgttgga

SEQ ID NO: 92340 - DNA, 15 bp, Homo sapiens
actggggtctgttgg

SEQ ID NO: 92341 - DNA, 15 bp, Homo sapiens
cactggggtctgttg

SEQ ID NO: 92342 - DNA, 15 bp, Homo sapiens
acactggggtctgtt

SEQ ID NO: 92343 - DNA, 15 bp, Homo sapiens
cacactggggtctgt

SEQ ID NO: 92344 - DNA, 15 bp, Homo sapiens
acacactggggtctg

SEQ ID NO: 92345 - DNA, 15 bp, Homo sapiens
cacacactggggtct

SEQ ID NO: 92346 - DNA, 15 bp, Homo sapiens
acacacactggggtc

SEQ ID NO: 92347 - DNA, 15 bp, Homo sapiens
aacacacactggggt

SEQ ID NO: 92348 - DNA, 15 bp, Homo sapiens
aaacacacactgggg

SEQ ID NO: 92349 - DNA, 15 bp, Homo sapiens
aaaacacacactggg

SEQ ID NO: 92350 - DNA, 15 bp, Homo sapiens
aaaaacacacactgg

SEQ ID NO: 92351 - DNA, 15 bp, Homo sapiens
gaaaaacacacactg

SEQ ID NO: 92352 - DNA, 15 bp, Homo sapiens
ggaaaaacacacact

SEQ ID NO: 92353 - DNA, 15 bp, Homo sapiens
gggaaaaacacacac

SEQ ID NO: 92354 - DNA, 15 bp, Homo sapiens
ggggaaaaacacaca

SEQ ID NO: 92355 - DNA, 15 bp, Homo sapiens
tggggaaaaacacac

SEQ ID NO: 92356 - DNA, 15 bp, Homo sapiens
gtggggaaaaacaca

SEQ ID NO: 92357 - DNA, 15 bp, Homo sapiens
ggtggggaaaaacac

SEQ ID NO: 92358 - DNA, 15 bp, Homo sapiens
tggtggggaaaaaca

SEQ ID NO: 92359 - DNA, 15 bp, Homo sapiens
atggtggggaaaaac

SEQ ID NO: 92360 - DNA, 15 bp, Homo sapiens
catggtggggaaaaa

SEQ ID NO: 92361 - DNA, 15 bp, Homo sapiens
acatggtggggaaaa

SEQ ID NO: 92362 - DNA, 15 bp, Homo sapiens
cacatggtggggaaa

SEQ ID NO: 92363 - DNA, 15 bp, Homo sapiens
acacatggtggggaa

SEQ ID NO: 92364 - DNA, 15 bp, Homo sapiens
gacacatggtgggga

SEQ ID NO: 92365 - DNA, 15 bp, Homo sapiens
ggacacatggtgggg

SEQ ID NO: 92366 - DNA, 15 bp, Homo sapiens
cggacacatggtggg

SEQ ID NO: 92367 - DNA, 15 bp, Homo sapiens
acggacacatggtgg

SEQ ID NO: 92368 - DNA, 15 bp, Homo sapiens
tacggacacatggtg

SEQ ID NO: 92369 - DNA, 15 bp, Homo sapiens
atacggacacatggt

SEQ ID NO: 92370 - DNA, 15 bp, Homo sapiens
catacggacacatgg

SEQ ID NO: 92371 - DNA, 15 bp, Homo sapiens
acatacggacacatg

SEQ ID NO: 92372 - DNA, 15 bp, Homo sapiens
aacatacggacacat

SEQ ID NO: 92373 - DNA, 15 bp, Homo sapiens
gaacatacggacaca

SEQ ID NO: 92374 - DNA, 15 bp, Homo sapiens
agaacatacggacac

SEQ ID NO: 92375 - DNA, 15 bp, Homo sapiens
gagaacatacggaca

SEQ ID NO: 92376 - DNA, 15 bp, Homo sapiens
tgagaacatacggac

SEQ ID NO: 92377 - DNA, 15 bp, Homo sapiens
atgagaacatacgga

SEQ ID NO: 92378 - DNA, 15 bp, Homo sapiens
aatgagaacatacgg

SEQ ID NO: 92379 - DNA, 15 bp, Homo sapiens
taatgagaacatacg

SEQ ID NO: 92380 - DNA, 15 bp, Homo sapiens
ataatgagaacatac

SEQ ID NO: 92381 - DNA, 15 bp, Homo sapiens
aataatgagaacata

SEQ ID NO: 92382 - DNA, 15 bp, Homo sapiens
gaataatgagaacat

SEQ ID NO: 92383 - DNA, 15 bp, Homo sapiens
tgaataatgagaaca

SEQ ID NO: 92384 - DNA, 15 bp, Homo sapiens
ctgaataatgagaac

SEQ ID NO: 92385 - DNA, 15 bp, Homo sapiens
gctgaataatgagaa

SEQ ID NO: 92386 - DNA, 15 bp, Homo sapiens
agctgaataatgaga

SEQ ID NO: 92387 - DNA, 15 bp, Homo sapiens
gagctgaataatgag

SEQ ID NO: 92388 - DNA, 15 bp, Homo sapiens
ggagctgaataatga

SEQ ID NO: 92389 - DNA, 15 bp, Homo sapiens
gggagctgaataatg

SEQ ID NO: 92390 - DNA, 15 bp, Homo sapiens
tgggagctgaataat

SEQ ID NO: 92391 - DNA, 15 bp, Homo sapiens
gtgggagctgaataa

SEQ ID NO: 92392 - DNA, 15 bp, Homo sapiens
agtgggagctgaata

SEQ ID NO: 92393 - DNA, 15 bp, Homo sapiens
aagtgggagctgaat

SEQ ID NO: 92394 - DNA, 15 bp, Homo sapiens
taagtgggagctgaa

SEQ ID NO: 92395 - DNA, 15 bp, Homo sapiens
ataagtgggagctga

SEQ ID NO: 92396 - DNA, 15 bp, Homo sapiens
tataagtgggagctg

SEQ ID NO: 92397 - DNA, 15 bp, Homo sapiens
ttataagtgggagct

SEQ ID NO: 92398 - DNA, 15 bp, Homo sapiens
cttataagtgggagc

SEQ ID NO: 92399 - DNA, 15 bp, Homo sapiens
acttataagtgggag

SEQ ID NO: 92400 - DNA, 15 bp, Homo sapiens
cacttataagtggga

SEQ ID NO: 92401 - DNA, 15 bp, Homo sapiens
tcacttataagtggg

SEQ ID NO: 92402 - DNA, 15 bp, Homo sapiens
ctcacttataagtgg

SEQ ID NO: 92403 - DNA, 15 bp, Homo sapiens
tctcacttataagtg

SEQ ID NO: 92404 - DNA, 15 bp, Homo sapiens
ttctcacttataagt

SEQ ID NO: 92405 - DNA, 15 bp, Homo sapiens
attctcacttataag

SEQ ID NO: 92406 - DNA, 15 bp, Homo sapiens
tattctcacttataa

SEQ ID NO: 92407 - DNA, 15 bp, Homo sapiens
atattctcacttata

SEQ ID NO: 92408 - DNA, 15 bp, Homo sapiens
catattctcacttat

SEQ ID NO: 92409 - DNA, 15 bp, Homo sapiens
gcatattctcactta

SEQ ID NO: 92410 - DNA, 15 bp, Homo sapiens
cgcatattctcactt

SEQ ID NO: 92411 - DNA, 15 bp, Homo sapiens
ccgcatattctcact

SEQ ID NO: 92412 - DNA, 15 bp, Homo sapiens
accgcatattctcac

SEQ ID NO: 92413 - DNA, 15 bp, Homo sapiens
taccgcatattctca

SEQ ID NO: 92414 - DNA, 15 bp, Homo sapiens
ataccgcatattctc

SEQ ID NO: 92415 - DNA, 15 bp, Homo sapiens
aataccgcatattct

SEQ ID NO: 92416 - DNA, 15 bp, Homo sapiens
aaataccgcatattc

SEQ ID NO: 92417 - DNA, 15 bp, Homo sapiens
aaaataccgcatatt

SEQ ID NO: 92418 - DNA, 15 bp, Homo sapiens
aaaaataccgcatat

SEQ ID NO: 92419 - DNA, 15 bp, Homo sapiens
aaaaaataccgcata

SEQ ID NO: 92420 - DNA, 15 bp, Homo sapiens
aaaaaaataccgcat

SEQ ID NO: 92421 - DNA, 15 bp, Homo sapiens
aaaaaaaataccgca

SEQ ID NO: 92422 - DNA, 15 bp, Homo sapiens
aaaaaaaaataccgc

SEQ ID NO: 92423 - DNA, 15 bp, Homo sapiens
caaaaaaaaataccg

SEQ ID NO: 92424 - DNA, 15 bp, Homo sapiens
acaaaaaaaaatacc

SEQ ID NO: 92425 - DNA, 15 bp, Homo sapiens
aacaaaaaaaaatac

SEQ ID NO: 92426 - DNA, 15 bp, Homo sapiens
caacaaaaaaaaata

SEQ ID NO: 92427 - DNA, 15 bp, Homo sapiens
acaacaaaaaaaaat

SEQ ID NO: 92428 - DNA, 15 bp, Homo sapiens
aacaacaaaaaaaaa

SEQ ID NO: 92429 - DNA, 15 bp, Homo sapiens
aaacaacaaaaaaaa

SEQ ID NO: 92430 - DNA, 15 bp, Homo sapiens
gaaacaacaaaaaaa

SEQ ID NO: 92431 - DNA, 15 bp, Homo sapiens
agaaacaacaaaaaa

SEQ ID NO: 92432 - DNA, 15 bp, Homo sapiens
cagaaacaacaaaaa

SEQ ID NO: 92433 - DNA, 15 bp, Homo sapiens
tcagaaacaacaaaa

SEQ ID NO: 92434 - DNA, 15 bp, Homo sapiens
ttcagaaacaacaaa

SEQ ID NO: 92435 - DNA, 15 bp, Homo sapiens
attcagaaacaacaa

SEQ ID NO: 92436 - DNA, 15 bp, Homo sapiens
aattcagaaacaaca

SEQ ID NO: 92437 - DNA, 15 bp, Homo sapiens
taattcagaaacaac

SEQ ID NO: 92438 - DNA, 15 bp, Homo sapiens
ctaattcagaaacaa

SEQ ID NO: 92439 - DNA, 15 bp, Homo sapiens
actaattcagaaaca

SEQ ID NO: 92440 - DNA, 15 bp, Homo sapiens
aactaattcagaaac

SEQ ID NO: 92441 - DNA, 15 bp, Homo sapiens
aaactaattcagaaa

SEQ ID NO: 92442 - DNA, 15 bp, Homo sapiens
caaactaattcagaa

SEQ ID NO: 92443 - DNA, 15 bp, Homo sapiens
gcaaactaattcaga

SEQ ID NO: 92444 - DNA, 15 bp, Homo sapiens
ggcaaactaattcag

SEQ ID NO: 92445 - DNA, 15 bp, Homo sapiens
cggcaaactaattca

SEQ ID NO: 92446 - DNA, 15 bp, Homo sapiens
tcggcaaactaattc

SEQ ID NO: 92447 - DNA, 15 bp, Homo sapiens
ctcggcaaactaatt

SEQ ID NO: 92448 - DNA, 15 bp, Homo sapiens
cctcggcaaactaat

SEQ ID NO: 92449 - DNA, 15 bp, Homo sapiens
tcctcggcaaactaa

SEQ ID NO: 92450 - DNA, 15 bp, Homo sapiens
atcctcggcaaacta

SEQ ID NO: 92451 - DNA, 15 bp, Homo sapiens
tatcctcggcaaact

SEQ ID NO: 92452 - DNA, 15 bp, Homo sapiens
ttatcctcggcaaac

SEQ ID NO: 92453 - DNA, 15 bp, Homo sapiens
attatcctcggcaaa

SEQ ID NO: 92454 - DNA, 15 bp, Homo sapiens
cattatcctcggcaa

SEQ ID NO: 92455 - DNA, 15 bp, Homo sapiens
ccattatcctcggca

SEQ ID NO: 92456 - DNA, 15 bp, Homo sapiens
gccattatcctcggc

SEQ ID NO: 92457 - DNA, 15 bp, Homo sapiens
agccattatcctcgg

SEQ ID NO: 92458 - DNA, 15 bp, Homo sapiens
aagccattatcctcg

SEQ ID NO: 92459 - DNA, 15 bp, Homo sapiens
gaagccattatcctc

SEQ ID NO: 92460 - DNA, 15 bp, Homo sapiens
ggaagccattatcct

SEQ ID NO: 92461 - DNA, 15 bp, Homo sapiens
tggaagccattatcc

SEQ ID NO: 92462 - DNA, 15 bp, Homo sapiens
ctggaagccattatc

SEQ ID NO: 92463 - DNA, 15 bp, Homo sapiens
gctggaagccattat

SEQ ID NO: 92464 - DNA, 15 bp, Homo sapiens
agctggaagccatta

SEQ ID NO: 92465 - DNA, 15 bp, Homo sapiens
gagctggaagccatt

SEQ ID NO: 92466 - DNA, 15 bp, Homo sapiens
ggagctggaagccat

SEQ ID NO: 92467 - DNA, 15 bp, Homo sapiens
tggagctggaagcca

SEQ ID NO: 92468 - DNA, 15 bp, Homo sapiens
atggagctggaagcc

SEQ ID NO: 92469 - DNA, 15 bp, Homo sapiens
gatggagctggaagc

SEQ ID NO: 92470 - DNA, 15 bp, Homo sapiens
ggatggagctggaag

SEQ ID NO: 92471 - DNA, 15 bp, Homo sapiens
tggatggagctggaa

SEQ ID NO: 92472 - DNA, 15 bp, Homo sapiens
tatggatggagctgg

SEQ ID NO: 92473 - DNA, 15 bp, Homo sapiens
atatggatggagctg

SEQ ID NO: 92474 - DNA, 15 bp, Homo sapiens
tatatggatggagct

SEQ ID NO: 92475 - DNA, 15 bp, Homo sapiens
gtatatggatggagc

SEQ ID NO: 92476 - DNA, 15 bp, Homo sapiens
ggtatatggatggag

SEQ ID NO: 92477 - DNA, 15 bp, Homo sapiens
aggtatatggatgga

SEQ ID NO: 92478 - DNA, 15 bp, Homo sapiens
caggtatatggatgg

SEQ ID NO: 92479 - DNA, 15 bp, Homo sapiens
gcaggtatatggatg

SEQ ID NO: 92480 - DNA, 15 bp, Homo sapiens
tgcaggtatatggat

SEQ ID NO: 92481 - DNA, 15 bp, Homo sapiens
ttgcaggtatatgga

SEQ ID NO: 92482 - DNA, 15 bp, Homo sapiens
tttgcaggtatatgg

SEQ ID NO: 92483 - DNA, 15 bp, Homo sapiens
ctttgcaggtatatg

SEQ ID NO: 92484 - DNA, 15 bp, Homo sapiens
cctttgcaggtatat

SEQ ID NO: 92485 - DNA, 15 bp, Homo sapiens
tcctttgcaggtata

SEQ ID NO: 92486 - DNA, 15 bp, Homo sapiens
gtcctttgcaggtat

SEQ ID NO: 92487 - DNA, 15 bp, Homo sapiens
tgtcctttgcaggta

SEQ ID NO: 92488 - DNA, 15 bp, Homo sapiens
atgtcctttgcaggt

SEQ ID NO: 92489 - DNA, 15 bp, Homo sapiens
catgtcctttgcagg

SEQ ID NO: 92490 - DNA, 15 bp, Homo sapiens
tcatgtcctttgcag

SEQ ID NO: 92491 - DNA, 15 bp, Homo sapiens
atcatgtcctttgca

SEQ ID NO: 92492 - DNA, 15 bp, Homo sapiens
gatcatgtcctttgc

SEQ ID NO: 92493 - DNA, 15 bp, Homo sapiens
agatcatgtcctttg

SEQ ID NO: 92494 - DNA, 15 bp, Homo sapiens
aagatcatgtccttt

SEQ ID NO: 92495 - DNA, 15 bp, Homo sapiens
caagatcatgtcctt

SEQ ID NO: 92496 - DNA, 15 bp, Homo sapiens
acaagatcatgtcct

SEQ ID NO: 92497 - DNA, 15 bp, Homo sapiens
aacaagatcatgtcc

SEQ ID NO: 92498 - DNA, 15 bp, Homo sapiens
gaacaagatcatgtc

SEQ ID NO: 92499 - DNA, 15 bp, Homo sapiens
ggaacaagatcatgt

SEQ ID NO: 92500 - DNA, 15 bp, Homo sapiens
aggaacaagatcatg

SEQ ID NO: 92501 - DNA, 15 bp, Homo sapiens
aaggaacaagatcat

SEQ ID NO: 92502 - DNA, 15 bp, Homo sapiens
aaaggaacaagatca

SEQ ID NO: 92503 - DNA, 15 bp, Homo sapiens
aaaaggaacaagatc

SEQ ID NO: 92504 - DNA, 15 bp, Homo sapiens
aaaaaggaacaagat

SEQ ID NO: 92505 - DNA, 15 bp, Homo sapiens
taaaaaggaacaaga

SEQ ID NO: 92506 - DNA, 15 bp, Homo sapiens
ataaaaaggaacaag

SEQ ID NO: 92507 - DNA, 15 bp, Homo sapiens
cataaaaaggaacaa

SEQ ID NO: 92508 - DNA, 15 bp, Homo sapiens
ccataaaaaggaaca

SEQ ID NO: 92509 - DNA, 15 bp, Homo sapiens
gccataaaaaggaac

SEQ ID NO: 92510 - DNA, 15 bp, Homo sapiens
agccataaaaaggaa

SEQ ID NO: 92511 - DNA, 15 bp, Homo sapiens
cagccataaaaagga

SEQ ID NO: 92512 - DNA, 15 bp, Homo sapiens
gcagccataaaaagg

SEQ ID NO: 92513 - DNA, 15 bp, Homo sapiens
tgcagccataaaaag

SEQ ID NO: 92514 - DNA, 15 bp, Homo sapiens
catggaatactatgc

SEQ ID NO: 92515 - DNA, 15 bp, Homo sapiens
ccatggaatactatg

SEQ ID NO: 92516 - DNA, 15 bp, Homo sapiens
aaccatggaatacta

SEQ ID NO: 92517 - DNA, 15 bp, Homo sapiens
caaccatggaatact

SEQ ID NO: 92518 - DNA, 15 bp, Homo sapiens
tcaaccatggaatac

SEQ ID NO: 92519 - DNA, 15 bp, Homo sapiens
atcaaccatggaata

SEQ ID NO: 92520 - DNA, 15 bp, Homo sapiens
tatcaaccatggaat

SEQ ID NO: 92521 - DNA, 15 bp, Homo sapiens
atatcaaccatggaa

SEQ ID NO: 92522 - DNA, 15 bp, Homo sapiens
catatcaaccatgga

SEQ ID NO: 92523 - DNA, 15 bp, Homo sapiens
acatatcaaccatgg

SEQ ID NO: 92524 - DNA, 15 bp, Homo sapiens
tacatatcaaccatg

SEQ ID NO: 92525 - DNA, 15 bp, Homo sapiens
gtacatatcaaccat

SEQ ID NO: 92526 - DNA, 15 bp, Homo sapiens
ggtacatatcaacca

SEQ ID NO: 92527 - DNA, 15 bp, Homo sapiens
tggtacatatcaacc

SEQ ID NO: 92528 - DNA, 15 bp, Homo sapiens
gtggtacatatcaac

SEQ ID NO: 92529 - DNA, 15 bp, Homo sapiens
tgtggtacatatcaa

SEQ ID NO: 92530 - DNA, 15 bp, Homo sapiens
atgtggtacatatca

SEQ ID NO: 92531 - DNA, 15 bp, Homo sapiens
aatgtggtacatatc

SEQ ID NO: 92532 - DNA, 15 bp, Homo sapiens
aaatgtggtacatat

SEQ ID NO: 92533 - DNA, 15 bp, Homo sapiens
aaaatgtggtacata

SEQ ID NO: 92534 - DNA, 15 bp, Homo sapiens
gaaaatgtggtacat

SEQ ID NO: 92535 - DNA, 15 bp, Homo sapiens
agaaaatgtggtaca

SEQ ID NO: 92536 - DNA, 15 bp, Homo sapiens
aagaaaatgtggtac

SEQ ID NO: 92537 - DNA, 15 bp, Homo sapiens
aaagaaaatgtggta

SEQ ID NO: 92538 - DNA, 15 bp, Homo sapiens
taaagaaaatgtggt

SEQ ID NO: 92539 - DNA, 15 bp, Homo sapiens
ttaaagaaaatgtgg

SEQ ID NO: 92540 - DNA, 15 bp, Homo sapiens
cttaaagaaaatgtg

SEQ ID NO: 92541 - DNA, 15 bp, Homo sapiens
acttaaagaaaatgt

SEQ ID NO: 92542 - DNA, 15 bp, Homo sapiens
tacttaaagaaaatg

SEQ ID NO: 92543 - DNA, 15 bp, Homo sapiens
ctacttaaagaaaat

SEQ ID NO: 92544 - DNA, 15 bp, Homo sapiens
actacttaaagaaaa

SEQ ID NO: 92545 - DNA, 15 bp, Homo sapiens
gactacttaaagaaa

SEQ ID NO: 92546 - DNA, 15 bp, Homo sapiens
agactacttaaagaa

SEQ ID NO: 92547 - DNA, 15 bp, Homo sapiens
tagactacttaaaga

SEQ ID NO: 92548 - DNA, 15 bp, Homo sapiens
atagactacttaaag

SEQ ID NO: 92549 - DNA, 15 bp, Homo sapiens
gatagactacttaaa

SEQ ID NO: 92550 - DNA, 15 bp, Homo sapiens
tgatagactacttaa

SEQ ID NO: 92551 - DNA, 15 bp, Homo sapiens
atgatagactactta

SEQ ID NO: 92552 - DNA, 15 bp, Homo sapiens
aatgatagactactt

SEQ ID NO: 92553 - DNA, 15 bp, Homo sapiens
caatgatagactact

SEQ ID NO: 92554 - DNA, 15 bp, Homo sapiens
tcaatgatagactac

SEQ ID NO: 92555 - DNA, 15 bp, Homo sapiens
atcaatgatagacta

SEQ ID NO: 92556 - DNA, 15 bp, Homo sapiens
catcaatgatagact

SEQ ID NO: 92557 - DNA, 15 bp, Homo sapiens
ccatcaatgatagac

SEQ ID NO: 92558 - DNA, 15 bp, Homo sapiens
cccatcaatgataga

SEQ ID NO: 92559 - DNA, 15 bp, Homo sapiens
gcccatcaatgatag

SEQ ID NO: 92560 - DNA, 15 bp, Homo sapiens
tgcccatcaatgata

SEQ ID NO: 92561 - DNA, 15 bp, Homo sapiens
atgcccatcaatgat

SEQ ID NO: 92562 - DNA, 15 bp, Homo sapiens
aatgcccatcaatga

SEQ ID NO: 92563 - DNA, 15 bp, Homo sapiens
caaatgcccatcaat

SEQ ID NO: 92564 - DNA, 15 bp, Homo sapiens
ccaaatgcccatcaa

SEQ ID NO: 92565 - DNA, 15 bp, Homo sapiens
acccaaatgcccatc

SEQ ID NO: 92566 - DNA, 15 bp, Homo sapiens
aacccaaatgcccat

SEQ ID NO: 92567 - DNA, 15 bp, Homo sapiens
caacccaaatgccca

SEQ ID NO: 92568 - DNA, 15 bp, Homo sapiens
tcaacccaaatgccc

SEQ ID NO: 92569 - DNA, 15 bp, Homo sapiens
atcaacccaaatgcc

SEQ ID NO: 92570 - DNA, 15 bp, Homo sapiens
aatcaacccaaatgc

SEQ ID NO: 92571 - DNA, 15 bp, Homo sapiens
gaatcaacccaaatg

SEQ ID NO: 92572 - DNA, 15 bp, Homo sapiens
ggaatcaacccaaat

SEQ ID NO: 92573 - DNA, 15 bp, Homo sapiens
aggaatcaacccaaa

SEQ ID NO: 92574 - DNA, 15 bp, Homo sapiens
aaggaatcaacccaa

SEQ ID NO: 92575 - DNA, 15 bp, Homo sapiens
caaggaatcaaccca

SEQ ID NO: 92576 - DNA, 15 bp, Homo sapiens
acaaggaatcaaccc

SEQ ID NO: 92577 - DNA, 15 bp, Homo sapiens
gacaaggaatcaacc

SEQ ID NO: 92578 - DNA, 15 bp, Homo sapiens
ggacaaggaatcaac

SEQ ID NO: 92579 - DNA, 15 bp, Homo sapiens
aggacaaggaatcaa

SEQ ID NO: 92580 - DNA, 15 bp, Homo sapiens
aaggacaaggaatca

SEQ ID NO: 92581 - DNA, 15 bp, Homo sapiens
caaggacaaggaatc

SEQ ID NO: 92582 - DNA, 15 bp, Homo sapiens
gcaaggacaaggaat

SEQ ID NO: 92583 - DNA, 15 bp, Homo sapiens
agcaaggacaaggaa

SEQ ID NO: 92584 - DNA, 15 bp, Homo sapiens
tagcaaggacaagga

SEQ ID NO: 92585 - DNA, 15 bp, Homo sapiens
atagcaaggacaagg

SEQ ID NO: 92586 - DNA, 15 bp, Homo sapiens
aatagcaaggacaag

SEQ ID NO: 92587 - DNA, 15 bp, Homo sapiens
caatagcaaggacaa

SEQ ID NO: 92588 - DNA, 15 bp, Homo sapiens
acaatagcaaggaca

SEQ ID NO: 92589 - DNA, 15 bp, Homo sapiens
cacaatagcaaggac

SEQ ID NO: 92590 - DNA, 15 bp, Homo sapiens
tcacaatagcaagga

SEQ ID NO: 92591 - DNA, 15 bp, Homo sapiens
ttcacaatagcaagg

SEQ ID NO: 92592 - DNA, 15 bp, Homo sapiens
attcacaatagcaag

SEQ ID NO: 92593 - DNA, 15 bp, Homo sapiens
aattcacaatagcaa

SEQ ID NO: 92594 - DNA, 15 bp, Homo sapiens
caattcacaatagca

SEQ ID NO: 92595 - DNA, 15 bp, Homo sapiens
acaattcacaatagc

SEQ ID NO: 92596 - DNA, 15 bp, Homo sapiens
cacaattcacaatag

SEQ ID NO: 92597 - DNA, 15 bp, Homo sapiens
gcacaattcacaata

SEQ ID NO: 92598 - DNA, 15 bp, Homo sapiens
tgcagcacaattcac

SEQ ID NO: 92599 - DNA, 15 bp, Homo sapiens
ttgcagcacaattca

SEQ ID NO: 92600 - DNA, 15 bp, Homo sapiens
attgcagcacaattc

SEQ ID NO: 92601 - DNA, 15 bp, Homo sapiens
cattgcagcacaatt

SEQ ID NO: 92602 - DNA, 15 bp, Homo sapiens
tcattgcagcacaat

SEQ ID NO: 92603 - DNA, 15 bp, Homo sapiens
ttcattgcagcacaa

SEQ ID NO: 92604 - DNA, 15 bp, Homo sapiens
gttcattgcagcaca

SEQ ID NO: 92605 - DNA, 15 bp, Homo sapiens
tgttcattgcagcac

SEQ ID NO: 92606 - DNA, 15 bp, Homo sapiens
atgttcattgcagca

SEQ ID NO: 92607 - DNA, 15 bp, Homo sapiens
tatgttcattgcagc

SEQ ID NO: 92608 - DNA, 15 bp, Homo sapiens
ctatgttcattgcag

SEQ ID NO: 92609 - DNA, 15 bp, Homo sapiens
actatgttcattgca

SEQ ID NO: 92610 - DNA, 15 bp, Homo sapiens
cactatgttcattgc

SEQ ID NO: 92611 - DNA, 15 bp, Homo sapiens
acactatgttcattg

SEQ ID NO: 92612 - DNA, 15 bp, Homo sapiens
cacactatgttcatt

SEQ ID NO: 92613 - DNA, 15 bp, Homo sapiens
gcacactatgttcat

SEQ ID NO: 92614 - DNA, 15 bp, Homo sapiens
tgcacactatgttca

SEQ ID NO: 92615 - DNA, 15 bp, Homo sapiens
atgcacactatgttc

SEQ ID NO: 92616 - DNA, 15 bp, Homo sapiens
tatgcacactatgtt

SEQ ID NO: 92617 - DNA, 15 bp, Homo sapiens
atatgcacactatgt

SEQ ID NO: 92618 - DNA, 15 bp, Homo sapiens
tatatgcacactatg

SEQ ID NO: 92619 - DNA, 15 bp, Homo sapiens
atatatgcacactat

SEQ ID NO: 92620 - DNA, 15 bp, Homo sapiens
gatatatgcacacta

SEQ ID NO: 92621 - DNA, 15 bp, Homo sapiens
agatatatgcacact

SEQ ID NO: 92622 - DNA, 15 bp, Homo sapiens
aagatatatgcacac

SEQ ID NO: 92623 - DNA, 15 bp, Homo sapiens
aaagatatatgcaca

SEQ ID NO: 92624 - DNA, 15 bp, Homo sapiens
taaagatatatgcac

SEQ ID NO: 92625 - DNA, 15 bp, Homo sapiens
ataaagatatatgca

SEQ ID NO: 92626 - DNA, 15 bp, Homo sapiens
tataaagatatatgc

SEQ ID NO: 92627 - DNA, 15 bp, Homo sapiens
ttataaagatatatg

SEQ ID NO: 92628 - DNA, 15 bp, Homo sapiens
gttataaagatatat

SEQ ID NO: 92629 - DNA, 15 bp, Homo sapiens
tgttataaagatata

SEQ ID NO: 92630 - DNA, 15 bp, Homo sapiens
ctgttataaagatat

SEQ ID NO: 92631 - DNA, 15 bp, Homo sapiens
tctgttataaagata

SEQ ID NO: 92632 - DNA, 15 bp, Homo sapiens
ttctgttataaagat

SEQ ID NO: 92633 - DNA, 15 bp, Homo sapiens
attctgttataaaga

SEQ ID NO: 92634 - DNA, 15 bp, Homo sapiens
cattctgttataaag

SEQ ID NO: 92635 - DNA, 15 bp, Homo sapiens
tcattctgttataaa

SEQ ID NO: 92636 - DNA, 15 bp, Homo sapiens
atcattctgttataa

SEQ ID NO: 92637 - DNA, 15 bp, Homo sapiens
aatcattctgttata

SEQ ID NO: 92638 - DNA, 15 bp, Homo sapiens
aaatcattctgttat

SEQ ID NO: 92639 - DNA, 15 bp, Homo sapiens
caaatcattctgtta

SEQ ID NO: 92640 - DNA, 15 bp, Homo sapiens
acaaatcattctgtt

SEQ ID NO: 92641 - DNA, 15 bp, Homo sapiens
tacaaatcattctgt

SEQ ID NO: 92642 - DNA, 15 bp, Homo sapiens
atacaaatcattctg

SEQ ID NO: 92643 - DNA, 15 bp, Homo sapiens
aatacaaatcattct

SEQ ID NO: 92644 - DNA, 15 bp, Homo sapiens
gaatacaaatcattc

SEQ ID NO: 92645 - DNA, 15 bp, Homo sapiens
ggaatacaaatcatt

SEQ ID NO: 92646 - DNA, 15 bp, Homo sapiens
aggaatacaaatcat

SEQ ID NO: 92647 - DNA, 15 bp, Homo sapiens
aaggaatacaaatca

SEQ ID NO: 92648 - DNA, 15 bp, Homo sapiens
aaaggaatacaaatc

SEQ ID NO: 92649 - DNA, 15 bp, Homo sapiens
caaaggaatacaaat

SEQ ID NO: 92650 - DNA, 15 bp, Homo sapiens
ccaaaggaatacaaa

SEQ ID NO: 92651 - DNA, 15 bp, Homo sapiens
cccaaaggaatacaa

SEQ ID NO: 92652 - DNA, 15 bp, Homo sapiens
acccaaaggaataca

SEQ ID NO: 92653 - DNA, 15 bp, Homo sapiens
tacccaaaggaatac

SEQ ID NO: 92654 - DNA, 15 bp, Homo sapiens
atacccaaaggaata

SEQ ID NO: 92655 - DNA, 15 bp, Homo sapiens
tatacccaaaggaat

SEQ ID NO: 92656 - DNA, 15 bp, Homo sapiens
atatacccaaaggaa

SEQ ID NO: 92657 - DNA, 15 bp, Homo sapiens
tatatacccaaagga

SEQ ID NO: 92658 - DNA, 15 bp, Homo sapiens
gtatatacccaaagg

SEQ ID NO: 92659 - DNA, 15 bp, Homo sapiens
ggtatatacccaaag

SEQ ID NO: 92660 - DNA, 15 bp, Homo sapiens
gggtatatacccaaa

SEQ ID NO: 92661 - DNA, 15 bp, Homo sapiens
tgggtatatacccaa

SEQ ID NO: 92662 - DNA, 15 bp, Homo sapiens
ctgggtatataccca

SEQ ID NO: 92663 - DNA, 15 bp, Homo sapiens
actgggtatataccc

SEQ ID NO: 92664 - DNA, 15 bp, Homo sapiens
cactgggtatatacc

SEQ ID NO: 92665 - DNA, 15 bp, Homo sapiens
tcactgggtatatac

SEQ ID NO: 92666 - DNA, 15 bp, Homo sapiens
ctcactgggtatata

SEQ ID NO: 92667 - DNA, 15 bp, Homo sapiens
tctcactgggtatat

SEQ ID NO: 92668 - DNA, 15 bp, Homo sapiens
atctcactgggtata

SEQ ID NO: 92669 - DNA, 15 bp, Homo sapiens
aatctcactgggtat

SEQ ID NO: 92670 - DNA, 15 bp, Homo sapiens
caatctcactgggta

SEQ ID NO: 92671 - DNA, 15 bp, Homo sapiens
gcaatctcactgggt

SEQ ID NO: 92672 - DNA, 15 bp, Homo sapiens
agcaatctcactggg

SEQ ID NO: 92673 - DNA, 15 bp, Homo sapiens
cagcaatctcactgg

SEQ ID NO: 92674 - DNA, 15 bp, Homo sapiens
ccagcaatctcactg

SEQ ID NO: 92675 - DNA, 15 bp, Homo sapiens
cccagcaatctcact

SEQ ID NO: 92676 - DNA, 15 bp, Homo sapiens
acccagcaatctcac

SEQ ID NO: 92677 - DNA, 15 bp, Homo sapiens
gacccagcaatctca

SEQ ID NO: 92678 - DNA, 15 bp, Homo sapiens
tgacccagcaatctc

SEQ ID NO: 92679 - DNA, 15 bp, Homo sapiens
ttgacccagcaatct

SEQ ID NO: 92680 - DNA, 15 bp, Homo sapiens
catttgacccagcaa

SEQ ID NO: 92681 - DNA, 15 bp, Homo sapiens
ccatttgacccagca

SEQ ID NO: 92682 - DNA, 15 bp, Homo sapiens
gccatttgacccagc

SEQ ID NO: 92683 - DNA, 15 bp, Homo sapiens
tgccatttgacccag

SEQ ID NO: 92684 - DNA, 15 bp, Homo sapiens
atgccatttgaccca

SEQ ID NO: 92685 - DNA, 15 bp, Homo sapiens
aatgccatttgaccc

SEQ ID NO: 92686 - DNA, 15 bp, Homo sapiens
aaatgccatttgacc

SEQ ID NO: 92687 - DNA, 15 bp, Homo sapiens
gaaatgccatttgac

SEQ ID NO: 92688 - DNA, 15 bp, Homo sapiens
agaaatgccatttga

SEQ ID NO: 92689 - DNA, 15 bp, Homo sapiens
cagaaatgccatttg

SEQ ID NO: 92690 - DNA, 15 bp, Homo sapiens
ccagaaatgccattt

SEQ ID NO: 92691 - DNA, 15 bp, Homo sapiens
accagaaatgccatt

SEQ ID NO: 92692 - DNA, 15 bp, Homo sapiens
aaccagaaatgccat

SEQ ID NO: 92693 - DNA, 15 bp, Homo sapiens
aaaccagaaatgcca

SEQ ID NO: 92694 - DNA, 15 bp, Homo sapiens
aaaaccagaaatgcc

SEQ ID NO: 92695 - DNA, 15 bp, Homo sapiens
taaaaccagaaatgc

SEQ ID NO: 92696 - DNA, 15 bp, Homo sapiens
ctaaaaccagaaatg

SEQ ID NO: 92697 - DNA, 15 bp, Homo sapiens
cctaaaaccagaaat

SEQ ID NO: 92698 - DNA, 15 bp, Homo sapiens
acctaaaaccagaaa

SEQ ID NO: 92699 - DNA, 15 bp, Homo sapiens
gacctaaaaccagaa

SEQ ID NO: 92700 - DNA, 15 bp, Homo sapiens
agacctaaaaccaga

SEQ ID NO: 92701 - DNA, 15 bp, Homo sapiens
aagacctaaaaccag

SEQ ID NO: 92702 - DNA, 15 bp, Homo sapiens
aaagacctaaaacca

SEQ ID NO: 92703 - DNA, 15 bp, Homo sapiens
caaagacctaaaacc

SEQ ID NO: 92704 - DNA, 15 bp, Homo sapiens
tcaaagacctaaaac

SEQ ID NO: 92705 - DNA, 15 bp, Homo sapiens
ctcaaagacctaaaa

SEQ ID NO: 92706 - DNA, 15 bp, Homo sapiens
gattcctcaaagacc

SEQ ID NO: 92707 - DNA, 15 bp, Homo sapiens
tgattcctcaaagac

SEQ ID NO: 92708 - DNA, 15 bp, Homo sapiens
gtgattcctcaaaga

SEQ ID NO: 92709 - DNA, 15 bp, Homo sapiens
ggtgattcctcaaag

SEQ ID NO: 92710 - DNA, 15 bp, Homo sapiens
tggtgattcctcaaa

SEQ ID NO: 92711 - DNA, 15 bp, Homo sapiens
gtggtgattcctcaa

SEQ ID NO: 92712 - DNA, 15 bp, Homo sapiens
tgtggtgattcctca

SEQ ID NO: 92713 - DNA, 15 bp, Homo sapiens
gtgtggtgattcctc

SEQ ID NO: 92714 - DNA, 15 bp, Homo sapiens
agtgtggtgattcct

SEQ ID NO: 92715 - DNA, 15 bp, Homo sapiens
cagtgtggtgattcc

SEQ ID NO: 92716 - DNA, 15 bp, Homo sapiens
acagtgtggtgattc

SEQ ID NO: 92717 - DNA, 15 bp, Homo sapiens
gacagtgtggtgatt

SEQ ID NO: 92718 - DNA, 15 bp, Homo sapiens
agacagtgtggtgat

SEQ ID NO: 92719 - DNA, 15 bp, Homo sapiens
aagacagtgtggtga

SEQ ID NO: 92720 - DNA, 15 bp, Homo sapiens
gaagacagtgtggtg

SEQ ID NO: 92721 - DNA, 15 bp, Homo sapiens
ggaagacagtgtggt

SEQ ID NO: 92722 - DNA, 15 bp, Homo sapiens
tggaagacagtgtgg

SEQ ID NO: 92723 - DNA, 15 bp, Homo sapiens
gtggaagacagtgtg

SEQ ID NO: 92724 - DNA, 15 bp, Homo sapiens
tgtggaagacagtgt

SEQ ID NO: 92725 - DNA, 15 bp, Homo sapiens
ctgtggaagacagtg

SEQ ID NO: 92726 - DNA, 15 bp, Homo sapiens
actgtggaagacagt

SEQ ID NO: 92727 - DNA, 15 bp, Homo sapiens
cactgtggaagacag

SEQ ID NO: 92728 - DNA, 15 bp, Homo sapiens
ccactgtggaagaca

SEQ ID NO: 92729 - DNA, 15 bp, Homo sapiens
accactgtggaagac

SEQ ID NO: 92730 - DNA, 15 bp, Homo sapiens
aaccactgtggaaga

SEQ ID NO: 92731 - DNA, 15 bp, Homo sapiens
caaccactgtggaag

SEQ ID NO: 92732 - DNA, 15 bp, Homo sapiens
tcaaccactgtggaa

SEQ ID NO: 92733 - DNA, 15 bp, Homo sapiens
ttcaaccactgtgga

SEQ ID NO: 92734 - DNA, 15 bp, Homo sapiens
gttcaaccactgtgg

SEQ ID NO: 92735 - DNA, 15 bp, Homo sapiens
agttcaaccactgtg

SEQ ID NO: 92736 - DNA, 15 bp, Homo sapiens
tagttcaaccactgt

SEQ ID NO: 92737 - DNA, 15 bp, Homo sapiens
ttagttcaaccactg

SEQ ID NO: 92738 - DNA, 15 bp, Homo sapiens
attagttcaaccact

SEQ ID NO: 92739 - DNA, 15 bp, Homo sapiens
aattagttcaaccac

SEQ ID NO: 92740 - DNA, 15 bp, Homo sapiens
gaattagttcaacca

SEQ ID NO: 92741 - DNA, 15 bp, Homo sapiens
tgaattagttcaacc

SEQ ID NO: 92742 - DNA, 15 bp, Homo sapiens
gtgaattagttcaac

SEQ ID NO: 92743 - DNA, 15 bp, Homo sapiens
tgtgaattagttcaa

SEQ ID NO: 92744 - DNA, 15 bp, Homo sapiens
gtgtgaattagttca

SEQ ID NO: 92745 - DNA, 15 bp, Homo sapiens
agtgtgaattagttc

SEQ ID NO: 92746 - DNA, 15 bp, Homo sapiens
gagtgtgaattagtt

SEQ ID NO: 92747 - DNA, 15 bp, Homo sapiens
ggagtgtgaattagt

SEQ ID NO: 92748 - DNA, 15 bp, Homo sapiens
gggagtgtgaattag

SEQ ID NO: 92749 - DNA, 15 bp, Homo sapiens
tgggagtgtgaatta

SEQ ID NO: 92750 - DNA, 15 bp, Homo sapiens
gtgggagtgtgaatt

SEQ ID NO: 92751 - DNA, 15 bp, Homo sapiens
ggtgggagtgtgaat

SEQ ID NO: 92752 - DNA, 15 bp, Homo sapiens
gggtgggagtgtgaa

SEQ ID NO: 92753 - DNA, 15 bp, Homo sapiens
tgggtgggagtgtga

SEQ ID NO: 92754 - DNA, 15 bp, Homo sapiens
gtgggtgggagtgtg

SEQ ID NO: 92755 - DNA, 15 bp, Homo sapiens
agtgggtgggagtgt

SEQ ID NO: 92756 - DNA, 15 bp, Homo sapiens
cagtgggtgggagtg

SEQ ID NO: 92757 - DNA, 15 bp, Homo sapiens
acagtgggtgggagt

SEQ ID NO: 92758 - DNA, 15 bp, Homo sapiens
aacagtgggtgggag

SEQ ID NO: 92759 - DNA, 15 bp, Homo sapiens
gaacagtgggtggga

SEQ ID NO: 92760 - DNA, 15 bp, Homo sapiens
agaacagtgggtggg

SEQ ID NO: 92761 - DNA, 15 bp, Homo sapiens
aagaacagtgggtgg

SEQ ID NO: 92762 - DNA, 15 bp, Homo sapiens
aaagaacagtgggtg

SEQ ID NO: 92763 - DNA, 15 bp, Homo sapiens
aaaagaacagtgggt

SEQ ID NO: 92764 - DNA, 15 bp, Homo sapiens
aaaaagaacagtggg

SEQ ID NO: 92765 - DNA, 15 bp, Homo sapiens
taaaaagaacagtgg

SEQ ID NO: 92766 - DNA, 15 bp, Homo sapiens
ctaaaaagaacagtg

SEQ ID NO: 92767 - DNA, 15 bp, Homo sapiens
tctaaaaagaacagt

SEQ ID NO: 92768 - DNA, 15 bp, Homo sapiens
atctaaaaagaacag

SEQ ID NO: 92769 - DNA, 15 bp, Homo sapiens
tatctaaaaagaaca

SEQ ID NO: 92770 - DNA, 15 bp, Homo sapiens
ttatctaaaaagaac

SEQ ID NO: 92771 - DNA, 15 bp, Homo sapiens
tttatctaaaaagaa

SEQ ID NO: 92772 - DNA, 15 bp, Homo sapiens
ttttatctaaaaaga

SEQ ID NO: 92773 - DNA, 15 bp, Homo sapiens
tttttatctaaaaag

SEQ ID NO: 92774 - DNA, 15 bp, Homo sapiens
atttttatctaaaaa

SEQ ID NO: 92775 - DNA, 15 bp, Homo sapiens
catttttatctaaaa

SEQ ID NO: 92776 - DNA, 15 bp, Homo sapiens
gcatttttatctaaa

SEQ ID NO: 92777 - DNA, 15 bp, Homo sapiens
agcatttttatctaa

SEQ ID NO: 92778 - DNA, 15 bp, Homo sapiens
aagcatttttatcta

SEQ ID NO: 92779 - DNA, 15 bp, Homo sapiens
aaagcatttttatct

SEQ ID NO: 92780 - DNA, 15 bp, Homo sapiens
gaaagcatttttatc

SEQ ID NO: 92781 - DNA, 15 bp, Homo sapiens
agaaagcatttttat

SEQ ID NO: 92782 - DNA, 15 bp, Homo sapiens
tagaaagcattttta

SEQ ID NO: 92783 - DNA, 15 bp, Homo sapiens
ttagaaagcattttt

SEQ ID NO: 92784 - DNA, 15 bp, Homo sapiens
attagaaagcatttt

SEQ ID NO: 92785 - DNA, 15 bp, Homo sapiens
cattagaaagcattt

SEQ ID NO: 92786 - DNA, 15 bp, Homo sapiens
gcattagaaagcatt

SEQ ID NO: 92787 - DNA, 15 bp, Homo sapiens
tgcattagaaagcat

SEQ ID NO: 92788 - DNA, 15 bp, Homo sapiens
atgcattagaaagca

SEQ ID NO: 92789 - DNA, 15 bp, Homo sapiens
aatgcattagaaagc

SEQ ID NO: 92790 - DNA, 15 bp, Homo sapiens
aaatgcattagaaag

SEQ ID NO: 92791 - DNA, 15 bp, Homo sapiens
aaaatgcattagaaa

SEQ ID NO: 92792 - DNA, 15 bp, Homo sapiens
taaaatgcattagaa

SEQ ID NO: 92793 - DNA, 15 bp, Homo sapiens
ttaaaatgcattaga

SEQ ID NO: 92794 - DNA, 15 bp, Homo sapiens
tttaaaatgcattag

SEQ ID NO: 92795 - DNA, 15 bp, Homo sapiens
ctttaaaatgcatta

SEQ ID NO: 92796 - DNA, 15 bp, Homo sapiens
actttaaaatgcatt

SEQ ID NO: 92797 - DNA, 15 bp, Homo sapiens
cactttaaaatgcat

SEQ ID NO: 92798 - DNA, 15 bp, Homo sapiens
tcactttaaaatgca

SEQ ID NO: 92799 - DNA, 15 bp, Homo sapiens
gtcactttaaaatgc

SEQ ID NO: 92800 - DNA, 15 bp, Homo sapiens
agtcactttaaaatg

SEQ ID NO: 92801 - DNA, 15 bp, Homo sapiens
aagtcactttaaaat

SEQ ID NO: 92802 - DNA, 15 bp, Homo sapiens
aaagtcactttaaaa

SEQ ID NO: 92803 - DNA, 15 bp, Homo sapiens
aaaagtcactttaaa

SEQ ID NO: 92804 - DNA, 15 bp, Homo sapiens
caaaagtcactttaa

SEQ ID NO: 92805 - DNA, 15 bp, Homo sapiens
tcaaaagtcacttta

SEQ ID NO: 92806 - DNA, 15 bp, Homo sapiens
gtcaaaagtcacttt

SEQ ID NO: 92807 - DNA, 15 bp, Homo sapiens
agtcaaaagtcactt

SEQ ID NO: 92808 - DNA, 15 bp, Homo sapiens
aagtcaaaagtcact

SEQ ID NO: 92809 - DNA, 15 bp, Homo sapiens
aaagtcaaaagtcac

SEQ ID NO: 92810 - DNA, 15 bp, Homo sapiens
taaagtcaaaagtca

SEQ ID NO: 92811 - DNA, 15 bp, Homo sapiens
ataaagtcaaaagtc

SEQ ID NO: 92812 - DNA, 15 bp, Homo sapiens
tataaagtcaaaagt

SEQ ID NO: 92813 - DNA, 15 bp, Homo sapiens
atataaagtcaaaag

SEQ ID NO: 92814 - DNA, 15 bp, Homo sapiens
tatataaagtcaaaa

SEQ ID NO: 92815 - DNA, 15 bp, Homo sapiens
ctatataaagtcaaa

SEQ ID NO: 92816 - DNA, 15 bp, Homo sapiens
gctatataaagtcaa

SEQ ID NO: 92817 - DNA, 15 bp, Homo sapiens
ggctatataaagtca

SEQ ID NO: 92818 - DNA, 15 bp, Homo sapiens
gggctatataaagtc

SEQ ID NO: 92819 - DNA, 15 bp, Homo sapiens
tgggctatataaagt

SEQ ID NO: 92820 - DNA, 15 bp, Homo sapiens
atgggctatataaag

SEQ ID NO: 92821 - DNA, 15 bp, Homo sapiens
aatgggctatataaa

SEQ ID NO: 92822 - DNA, 15 bp, Homo sapiens
aaatgggctatataa

SEQ ID NO: 92823 - DNA, 15 bp, Homo sapiens
aaaatgggctatata

SEQ ID NO: 92824 - DNA, 15 bp, Homo sapiens
taaaatgggctatat

SEQ ID NO: 92825 - DNA, 15 bp, Homo sapiens
gtaaaatgggctata

SEQ ID NO: 92826 - DNA, 15 bp, Homo sapiens
agtaaaatgggctat

SEQ ID NO: 92827 - DNA, 15 bp, Homo sapiens
tagtaaaatgggcta

SEQ ID NO: 92828 - DNA, 15 bp, Homo sapiens
atagtaaaatgggct

SEQ ID NO: 92829 - DNA, 15 bp, Homo sapiens
tatagtaaaatgggc

SEQ ID NO: 92830 - DNA, 15 bp, Homo sapiens
atatagtaaaatggg

SEQ ID NO: 92831 - DNA, 15 bp, Homo sapiens
gatatagtaaaatgg

SEQ ID NO: 92832 - DNA, 15 bp, Homo sapiens
agatatagtaaaatg

SEQ ID NO: 92833 - DNA, 15 bp, Homo sapiens
cagatatagtaaaat

SEQ ID NO: 92834 - DNA, 15 bp, Homo sapiens
acagatatagtaaaa

SEQ ID NO: 92835 - DNA, 15 bp, Homo sapiens
cacagatatagtaaa

SEQ ID NO: 92836 - DNA, 15 bp, Homo sapiens
gcacagatatagtaa

SEQ ID NO: 92837 - DNA, 15 bp, Homo sapiens
tgcacagatatagta

SEQ ID NO: 92838 - DNA, 15 bp, Homo sapiens
ctgcacagatatagt

SEQ ID NO: 92839 - DNA, 15 bp, Homo sapiens
tctgcacagatatag

SEQ ID NO: 92840 - DNA, 15 bp, Homo sapiens
gtctgcacagatata

SEQ ID NO: 92841 - DNA, 15 bp, Homo sapiens
tgtctgcacagatat

SEQ ID NO: 92842 - DNA, 15 bp, Homo sapiens
gtgtctgcacagata

SEQ ID NO: 92843 - DNA, 15 bp, Homo sapiens
tgtgtctgcacagat

SEQ ID NO: 92844 - DNA, 15 bp, Homo sapiens
atgtgtctgcacaga

SEQ ID NO: 92845 - DNA, 15 bp, Homo sapiens
aatgtgtctgcacag

SEQ ID NO: 92846 - DNA, 15 bp, Homo sapiens
aaatgtgtctgcaca

SEQ ID NO: 92847 - DNA, 15 bp, Homo sapiens
aaaatgtgtctgcac

SEQ ID NO: 92848 - DNA, 15 bp, Homo sapiens
aaaaatgtgtctgca

SEQ ID NO: 92849 - DNA, 15 bp, Homo sapiens
caaaaatgtgtctgc

SEQ ID NO: 92850 - DNA, 15 bp, Homo sapiens
acaaaaatgtgtctg

SEQ ID NO: 92851 - DNA, 15 bp, Homo sapiens
cacaaaaatgtgtct

SEQ ID NO: 92852 - DNA, 15 bp, Homo sapiens
gcacaaaaatgtgtc

SEQ ID NO: 92853 - DNA, 15 bp, Homo sapiens
tgcacaaaaatgtgt

SEQ ID NO: 92854 - DNA, 15 bp, Homo sapiens
atgcacaaaaatgtg

SEQ ID NO: 92855 - DNA, 15 bp, Homo sapiens
tatgcacaaaaatgt

SEQ ID NO: 92856 - DNA, 15 bp, Homo sapiens
atatgcacaaaaatg

SEQ ID NO: 92857 - DNA, 15 bp, Homo sapiens
aatatgcacaaaaat

SEQ ID NO: 92858 - DNA, 15 bp, Homo sapiens
aaatatgcacaaaaa

SEQ ID NO: 92859 - DNA, 15 bp, Homo sapiens
aaaatatgcacaaaa

SEQ ID NO: 92860 - DNA, 15 bp, Homo sapiens
aaaaatatgcacaaa

SEQ ID NO: 92861 - DNA, 15 bp, Homo sapiens
taaaaatatgcacaa

SEQ ID NO: 92862 - DNA, 15 bp, Homo sapiens
ttaaaaatatgcaca

SEQ ID NO: 92863 - DNA, 15 bp, Homo sapiens
attaaaaatatgcac

SEQ ID NO: 92864 - DNA, 15 bp, Homo sapiens
gattaaaaatatgca

SEQ ID NO: 92865 - DNA, 15 bp, Homo sapiens
agattaaaaatatgc

SEQ ID NO: 92866 - DNA, 15 bp, Homo sapiens
aagattaaaaatatg

SEQ ID NO: 92867 - DNA, 15 bp, Homo sapiens
aaagattaaaaatat

SEQ ID NO: 92868 - DNA, 15 bp, Homo sapiens
aaaagattaaaaata

SEQ ID NO: 92869 - DNA, 15 bp, Homo sapiens
taaaagattaaaaat

SEQ ID NO: 92870 - DNA, 15 bp, Homo sapiens
ttaaaagattaaaaa

SEQ ID NO: 92871 - DNA, 15 bp, Homo sapiens
tttaaaagattaaaa

SEQ ID NO: 92872 - DNA, 15 bp, Homo sapiens
ttttaaaagattaaa

SEQ ID NO: 92873 - DNA, 15 bp, Homo sapiens
gttttaaaagattaa

SEQ ID NO: 92874 - DNA, 15 bp, Homo sapiens
agttttaaaagatta

SEQ ID NO: 92875 - DNA, 15 bp, Homo sapiens
aagttttaaaagatt

SEQ ID NO: 92876 - DNA, 15 bp, Homo sapiens
aaagttttaaaagat

SEQ ID NO: 92877 - DNA, 15 bp, Homo sapiens
aaaagttttaaaaga

SEQ ID NO: 92878 - DNA, 15 bp, Homo sapiens
aaaaagttttaaaag

SEQ ID NO: 92879 - DNA, 15 bp, Homo sapiens
gaaaaagttttaaaa

SEQ ID NO: 92880 - DNA, 15 bp, Homo sapiens
ggaaaaagttttaaa

SEQ ID NO: 92881 - DNA, 15 bp, Homo sapiens
tggaaaaagttttaa

SEQ ID NO: 92882 - DNA, 15 bp, Homo sapiens
ctggaaaaagtttta

SEQ ID NO: 92883 - DNA, 15 bp, Homo sapiens
tctggaaaaagtttt

SEQ ID NO: 92884 - DNA, 15 bp, Homo sapiens
gtctggaaaaagttt

SEQ ID NO: 92885 - DNA, 15 bp, Homo sapiens
ggtctggaaaaagtt

SEQ ID NO: 92886 - DNA, 15 bp, Homo sapiens
gggtctggaaaaagt

SEQ ID NO: 92887 - DNA, 15 bp, Homo sapiens
agggtctggaaaaag

SEQ ID NO: 92888 - DNA, 15 bp, Homo sapiens
aagggtctggaaaaa

SEQ ID NO: 92889 - DNA, 15 bp, Homo sapiens
caagggtctggaaaa

SEQ ID NO: 92890 - DNA, 15 bp, Homo sapiens
tcaagggtctggaaa

SEQ ID NO: 92891 - DNA, 15 bp, Homo sapiens
atcaagggtctggaa

SEQ ID NO: 92892 - DNA, 15 bp, Homo sapiens
catcaagggtctgga

SEQ ID NO: 92893 - DNA, 15 bp, Homo sapiens
tcatcaagggtctgg

SEQ ID NO: 92894 - DNA, 15 bp, Homo sapiens
ttcatcaagggtctg

SEQ ID NO: 92895 - DNA, 15 bp, Homo sapiens
tttcatcaagggtct

SEQ ID NO: 92896 - DNA, 15 bp, Homo sapiens
atttcatcaagggtc

SEQ ID NO: 92897 - DNA, 15 bp, Homo sapiens
gatttcatcaagggt

SEQ ID NO: 92898 - DNA, 15 bp, Homo sapiens
ggatttcatcaaggg

SEQ ID NO: 92899 - DNA, 15 bp, Homo sapiens
aggatttcatcaagg

SEQ ID NO: 92900 - DNA, 15 bp, Homo sapiens
aaggatttcatcaag

SEQ ID NO: 92901 - DNA, 15 bp, Homo sapiens
caaggatttcatcaa

SEQ ID NO: 92902 - DNA, 15 bp, Homo sapiens
tcaaggatttcatca

SEQ ID NO: 92903 - DNA, 15 bp, Homo sapiens
ctcaaggatttcatc

SEQ ID NO: 92904 - DNA, 15 bp, Homo sapiens
tctcaaggatttcat

SEQ ID NO: 92905 - DNA, 15 bp, Homo sapiens
ttctcaaggatttca

SEQ ID NO: 92906 - DNA, 15 bp, Homo sapiens
attctcaaggatttc

SEQ ID NO: 92907 - DNA, 15 bp, Homo sapiens
gattctcaaggattt

SEQ ID NO: 92908 - DNA, 15 bp, Homo sapiens
tgattctcaaggatt

SEQ ID NO: 92909 - DNA, 15 bp, Homo sapiens
ctgattctcaaggat

SEQ ID NO: 92910 - DNA, 15 bp, Homo sapiens
tctgattctcaagga

SEQ ID NO: 92911 - DNA, 15 bp, Homo sapiens
ttctgattctcaagg

SEQ ID NO: 92912 - DNA, 15 bp, Homo sapiens
tttctgattctcaag

SEQ ID NO: 92913 - DNA, 15 bp, Homo sapiens
gtttctgattctcaa

SEQ ID NO: 92914 - DNA, 15 bp, Homo sapiens
ggtttctgattctca

SEQ ID NO: 92915 - DNA, 15 bp, Homo sapiens
aggtttctgattctc

SEQ ID NO: 92916 - DNA, 15 bp, Homo sapiens
caggtttctgattct

SEQ ID NO: 92917 - DNA, 15 bp, Homo sapiens
gcaggtttctgattc

SEQ ID NO: 92918 - DNA, 15 bp, Homo sapiens
tgcaggtttctgatt

SEQ ID NO: 92919 - DNA, 15 bp, Homo sapiens
atgcaggtttctgat

SEQ ID NO: 92920 - DNA, 15 bp, Homo sapiens
aatgcaggtttctga

SEQ ID NO: 92921 - DNA, 15 bp, Homo sapiens
taatgcaggtttctg

SEQ ID NO: 92922 - DNA, 15 bp, Homo sapiens
gtaatgcaggtttct

SEQ ID NO: 92923 - DNA, 15 bp, Homo sapiens
tgtaatgcaggtttc

SEQ ID NO: 92924 - DNA, 15 bp, Homo sapiens
atgtaatgcaggttt

SEQ ID NO: 92925 - DNA, 15 bp, Homo sapiens
tatgtaatgcaggtt

SEQ ID NO: 92926 - DNA, 15 bp, Homo sapiens
ttatgtaatgcaggt

SEQ ID NO: 92927 - DNA, 15 bp, Homo sapiens
tttatgtaatgcagg

SEQ ID NO: 92928 - DNA, 15 bp, Homo sapiens
gtttatgtaatgcag

SEQ ID NO: 92929 - DNA, 15 bp, Homo sapiens
agtttatgtaatgca

SEQ ID NO: 92930 - DNA, 15 bp, Homo sapiens
aagtttatgtaatgc

SEQ ID NO: 92931 - DNA, 15 bp, Homo sapiens
caagtttatgtaatg

SEQ ID NO: 92932 - DNA, 15 bp, Homo sapiens
gcaagtttatgtaat

SEQ ID NO: 92933 - DNA, 15 bp, Homo sapiens
tgcaagtttatgtaa

SEQ ID NO: 92934 - DNA, 15 bp, Homo sapiens
ctgcaagtttatgta

SEQ ID NO: 92935 - DNA, 15 bp, Homo sapiens
tctgcaagtttatgt

SEQ ID NO: 92936 - DNA, 15 bp, Homo sapiens
ttctgcaagtttatg

SEQ ID NO: 92937 - DNA, 15 bp, Homo sapiens
cttctgcaagtttat

SEQ ID NO: 92938 - DNA, 15 bp, Homo sapiens
tcttctgcaagttta

SEQ ID NO: 92939 - DNA, 15 bp, Homo sapiens
ttcttctgcaagttt

SEQ ID NO: 92940 - DNA, 15 bp, Homo sapiens
tttcttctgcaagtt

SEQ ID NO: 92941 - DNA, 15 bp, Homo sapiens
gtttcttctgcaagt

SEQ ID NO: 92942 - DNA, 15 bp, Homo sapiens
tgtttcttctgcaag

SEQ ID NO: 92943 - DNA, 15 bp, Homo sapiens
ttgtttcttctgcaa

SEQ ID NO: 92944 - DNA, 15 bp, Homo sapiens
tttgtttcttctgca

SEQ ID NO: 92945 - DNA, 15 bp, Homo sapiens
ctttgtttcttctgc

SEQ ID NO: 92946 - DNA, 15 bp, Homo sapiens
cctttgtttcttctg

SEQ ID NO: 92947 - DNA, 15 bp, Homo sapiens
gcctttgtttcttct

SEQ ID NO: 92948 - DNA, 15 bp, Homo sapiens
agcctttgtttcttc

SEQ ID NO: 92949 - DNA, 15 bp, Homo sapiens
gagcctttgtttctt

SEQ ID NO: 92950 - DNA, 15 bp, Homo sapiens
agagcctttgtttct

SEQ ID NO: 92951 - DNA, 15 bp, Homo sapiens
cagagcctttgtttc

SEQ ID NO: 92952 - DNA, 15 bp, Homo sapiens
ccagagcctttgttt

SEQ ID NO: 92953 - DNA, 15 bp, Homo sapiens
tccagagcctttgtt

SEQ ID NO: 92954 - DNA, 15 bp, Homo sapiens
ctccagagcctttgt

SEQ ID NO: 92955 - DNA, 15 bp, Homo sapiens
tctccagagcctttg

SEQ ID NO: 92956 - DNA, 15 bp, Homo sapiens
ttctccagagccttt

SEQ ID NO: 92957 - DNA, 15 bp, Homo sapiens
tttctccagagcctt

SEQ ID NO: 92958 - DNA, 15 bp, Homo sapiens
ttttctccagagcct

SEQ ID NO: 92959 - DNA, 15 bp, Homo sapiens
tttttctccagagcc

SEQ ID NO: 92960 - DNA, 15 bp, Homo sapiens
atttttctccagagc

SEQ ID NO: 92961 - DNA, 15 bp, Homo sapiens
catttttctccagag

SEQ ID NO: 92962 - DNA, 15 bp, Homo sapiens
acatttttctccaga

SEQ ID NO: 92963 - DNA, 15 bp, Homo sapiens
aacatttttctccag

SEQ ID NO: 92964 - DNA, 15 bp, Homo sapiens
gaacatttttctcca

SEQ ID NO: 92965 - DNA, 15 bp, Homo sapiens
tgaacatttttctcc

SEQ ID NO: 92966 - DNA, 15 bp, Homo sapiens
atgaacatttttctc

SEQ ID NO: 92967 - DNA, 15 bp, Homo sapiens
gatgaacatttttct

SEQ ID NO: 92968 - DNA, 15 bp, Homo sapiens
ggatgaacatttttc

SEQ ID NO: 92969 - DNA, 15 bp, Homo sapiens
aggatgaacattttt

SEQ ID NO: 92970 - DNA, 15 bp, Homo sapiens
caggatgaacatttt

SEQ ID NO: 92971 - DNA, 15 bp, Homo sapiens
tcaggatgaacattt

SEQ ID NO: 92972 - DNA, 15 bp, Homo sapiens
atcaggatgaacatt

SEQ ID NO: 92973 - DNA, 15 bp, Homo sapiens
catcaggatgaacat

SEQ ID NO: 92974 - DNA, 15 bp, Homo sapiens
acatcaggatgaaca

SEQ ID NO: 92975 - DNA, 15 bp, Homo sapiens
tacatcaggatgaac

SEQ ID NO: 92976 - DNA, 15 bp, Homo sapiens
ctacatcaggatgaa

SEQ ID NO: 92977 - DNA, 15 bp, Homo sapiens
tctacatcaggatga

SEQ ID NO: 92978 - DNA, 15 bp, Homo sapiens
ttctacatcaggatg

SEQ ID NO: 92979 - DNA, 15 bp, Homo sapiens
tttctacatcaggat

SEQ ID NO: 92980 - DNA, 15 bp, Homo sapiens
ttttctacatcagga

SEQ ID NO: 92981 - DNA, 15 bp, Homo sapiens
tttttctacatcagg

SEQ ID NO: 92982 - DNA, 15 bp, Homo sapiens
atttttctacatcag

SEQ ID NO: 92983 - DNA, 15 bp, Homo sapiens
aatttttctacatca

SEQ ID NO: 92984 - DNA, 15 bp, Homo sapiens
taatttttctacatc

SEQ ID NO: 92985 - DNA, 15 bp, Homo sapiens
ataatttttctacat

SEQ ID NO: 92986 - DNA, 15 bp, Homo sapiens
tataatttttctaca

SEQ ID NO: 92987 - DNA, 15 bp, Homo sapiens
atataatttttctac

SEQ ID NO: 92988 - DNA, 15 bp, Homo sapiens
tatataatttttcta

SEQ ID NO: 92989 - DNA, 15 bp, Homo sapiens
ttatataatttttct

SEQ ID NO: 92990 - DNA, 15 bp, Homo sapiens
cttatataatttttc

SEQ ID NO: 92991 - DNA, 15 bp, Homo sapiens
gcttatataattttt

SEQ ID NO: 92992 - DNA, 15 bp, Homo sapiens
tgcttatataatttt

SEQ ID NO: 92993 - DNA, 15 bp, Homo sapiens
ttgcttatataattt

SEQ ID NO: 92994 - DNA, 15 bp, Homo sapiens
cttgcttatataatt

SEQ ID NO: 92995 - DNA, 15 bp, Homo sapiens
tcttgcttatataat

SEQ ID NO: 92996 - DNA, 15 bp, Homo sapiens
ttcttgcttatataa

SEQ ID NO: 92997 - DNA, 15 bp, Homo sapiens
attcttgcttatata

SEQ ID NO: 92998 - DNA, 15 bp, Homo sapiens
aattcttgcttatat

SEQ ID NO: 92999 - DNA, 15 bp, Homo sapiens
aaattcttgcttata

SEQ ID NO: 93000 - DNA, 15 bp, Homo sapiens
caaattcttgcttat

SEQ ID NO: 93001 - DNA, 15 bp, Homo sapiens
tcaaattcttgctta

SEQ ID NO: 93002 - DNA, 15 bp, Homo sapiens
atcaaattcttgctt

SEQ ID NO: 93003 - DNA, 15 bp, Homo sapiens
catcaaattcttgct

SEQ ID NO: 93004 - DNA, 15 bp, Homo sapiens
tcatcaaattcttgc

SEQ ID NO: 93005 - DNA, 15 bp, Homo sapiens
atcatcaaattcttg

SEQ ID NO: 93006 - DNA, 15 bp, Homo sapiens
catcatcaaattctt

SEQ ID NO: 93007 - DNA, 15 bp, Homo sapiens
acatcatcaaattct

SEQ ID NO: 93008 - DNA, 15 bp, Homo sapiens
cacatcatcaaattc

SEQ ID NO: 93009 - DNA, 15 bp, Homo sapiens
gcacatcatcaaatt

SEQ ID NO: 93010 - DNA, 15 bp, Homo sapiens
tgcacatcatcaaat

SEQ ID NO: 93011 - DNA, 15 bp, Homo sapiens
ttgcacatcatcaaa

SEQ ID NO: 93012 - DNA, 15 bp, Homo sapiens
cttgcacatcatcaa

SEQ ID NO: 93013 - DNA, 15 bp, Homo sapiens
ccttgcacatcatca

SEQ ID NO: 93014 - DNA, 15 bp, Homo sapiens
tccttgcacatcatc

SEQ ID NO: 93015 - DNA, 15 bp, Homo sapiens
ttccttgcacatcat

SEQ ID NO: 93016 - DNA, 15 bp, Homo sapiens
tttccttgcacatca

SEQ ID NO: 93017 - DNA, 15 bp, Homo sapiens
ctttccttgcacatc

SEQ ID NO: 93018 - DNA, 15 bp, Homo sapiens
actttccttgcacat

SEQ ID NO: 93019 - DNA, 15 bp, Homo sapiens
cactttccttgcaca

SEQ ID NO: 93020 - DNA, 15 bp, Homo sapiens
ccactttccttgcac

SEQ ID NO: 93021 - DNA, 15 bp, Homo sapiens
tccactttccttgca

SEQ ID NO: 93022 - DNA, 15 bp, Homo sapiens
ttccactttccttgc

SEQ ID NO: 93023 - DNA, 15 bp, Homo sapiens
gttccactttccttg

SEQ ID NO: 93024 - DNA, 15 bp, Homo sapiens
tgttccactttcctt

SEQ ID NO: 93025 - DNA, 15 bp, Homo sapiens
ttgttccactttcct

SEQ ID NO: 93026 - DNA, 15 bp, Homo sapiens
cttgttccactttcc

SEQ ID NO: 93027 - DNA, 15 bp, Homo sapiens
gcttgttccactttc

SEQ ID NO: 93028 - DNA, 15 bp, Homo sapiens
agcttgttccacttt

SEQ ID NO: 93029 - DNA, 15 bp, Homo sapiens
tagcttgttccactt

SEQ ID NO: 93030 - DNA, 15 bp, Homo sapiens
ttagcttgttccact

SEQ ID NO: 93031 - DNA, 15 bp, Homo sapiens
tttagcttgttccac

SEQ ID NO: 93032 - DNA, 15 bp, Homo sapiens
ctttagcttgttcca

SEQ ID NO: 93033 - DNA, 15 bp, Homo sapiens
cctttagcttgttcc

SEQ ID NO: 93034 - DNA, 15 bp, Homo sapiens
acctttagcttgttc

SEQ ID NO: 93035 - DNA, 15 bp, Homo sapiens
gacctttagcttgtt

SEQ ID NO: 93036 - DNA, 15 bp, Homo sapiens
agacctttagcttgt

SEQ ID NO: 93037 - DNA, 15 bp, Homo sapiens
aagacctttagcttg

SEQ ID NO: 93038 - DNA, 15 bp, Homo sapiens
caagacctttagctt

SEQ ID NO: 93039 - DNA, 15 bp, Homo sapiens
ccaagacctttagct

SEQ ID NO: 93040 - DNA, 15 bp, Homo sapiens
accaagacctttagc

SEQ ID NO: 93041 - DNA, 15 bp, Homo sapiens
aaccaagacctttag

SEQ ID NO: 93042 - DNA, 15 bp, Homo sapiens
aaaccaagaccttta

SEQ ID NO: 93043 - DNA, 15 bp, Homo sapiens
gaaaccaagaccttt

SEQ ID NO: 93044 - DNA, 15 bp, Homo sapiens
ggaaaccaagacctt

SEQ ID NO: 93045 - DNA, 15 bp, Homo sapiens
tggaaaccaagacct

SEQ ID NO: 93046 - DNA, 15 bp, Homo sapiens
ttggaaaccaagacc

SEQ ID NO: 93047 - DNA, 15 bp, Homo sapiens
tttggaaaccaagac

SEQ ID NO: 93048 - DNA, 15 bp, Homo sapiens
ctttggaaaccaaga

SEQ ID NO: 93049 - DNA, 15 bp, Homo sapiens
tctttggaaaccaag

SEQ ID NO: 93050 - DNA, 15 bp, Homo sapiens
atctttggaaaccaa

SEQ ID NO: 93051 - DNA, 15 bp, Homo sapiens
gatctttggaaacca

SEQ ID NO: 93052 - DNA, 15 bp, Homo sapiens
agatctttggaaacc

SEQ ID NO: 93053 - DNA, 15 bp, Homo sapiens
tagatctttggaaac

SEQ ID NO: 93054 - DNA, 15 bp, Homo sapiens
gtagatctttggaaa

SEQ ID NO: 93055 - DNA, 15 bp, Homo sapiens
tgtagatctttggaa

SEQ ID NO: 93056 - DNA, 15 bp, Homo sapiens
atgtagatctttgga

SEQ ID NO: 93057 - DNA, 15 bp, Homo sapiens
aatgtagatctttgg

SEQ ID NO: 93058 - DNA, 15 bp, Homo sapiens
aaatgtagatctttg

SEQ ID NO: 93059 - DNA, 15 bp, Homo sapiens
caaatgtagatcttt

SEQ ID NO: 93060 - DNA, 15 bp, Homo sapiens
gcaaatgtagatctt

SEQ ID NO: 93061 - DNA, 15 bp, Homo sapiens
agcaaatgtagatct

SEQ ID NO: 93062 - DNA, 15 bp, Homo sapiens
aagcaaatgtagatc

SEQ ID NO: 93063 - DNA, 15 bp, Homo sapiens
caagcaaatgtagat

SEQ ID NO: 93064 - DNA, 15 bp, Homo sapiens
tcaagcaaatgtaga

SEQ ID NO: 93065 - DNA, 15 bp, Homo sapiens
ctcaagcaaatgtag

SEQ ID NO: 93066 - DNA, 15 bp, Homo sapiens
cctcaagcaaatgta

SEQ ID NO: 93067 - DNA, 15 bp, Homo sapiens
tcctcaagcaaatgt

SEQ ID NO: 93068 - DNA, 15 bp, Homo sapiens
ttcctcaagcaaatg

SEQ ID NO: 93069 - DNA, 15 bp, Homo sapiens
tttcctcaagcaaat

SEQ ID NO: 93070 - DNA, 15 bp, Homo sapiens
atttcctcaagcaaa

SEQ ID NO: 93071 - DNA, 15 bp, Homo sapiens
aatttcctcaagcaa

SEQ ID NO: 93072 - DNA, 15 bp, Homo sapiens
caatttcctcaagca

SEQ ID NO: 93073 - DNA, 15 bp, Homo sapiens
gcaatttcctcaagc

SEQ ID NO: 93074 - DNA, 15 bp, Homo sapiens
agcaatttcctcaag

SEQ ID NO: 93075 - DNA, 15 bp, Homo sapiens
gagcaatttcctcaa

SEQ ID NO: 93076 - DNA, 15 bp, Homo sapiens
agagcaatttcctca

SEQ ID NO: 93077 - DNA, 15 bp, Homo sapiens
gagagcaatttcctc

SEQ ID NO: 93078 - DNA, 15 bp, Homo sapiens
tgagagcaatttcct

SEQ ID NO: 93079 - DNA, 15 bp, Homo sapiens
gtgagagcaatttcc

SEQ ID NO: 93080 - DNA, 15 bp, Homo sapiens
tgtgagagcaatttc

SEQ ID NO: 93081 - DNA, 15 bp, Homo sapiens
gtgtgagagcaattt

SEQ ID NO: 93082 - DNA, 15 bp, Homo sapiens
agtgtgagagcaatt

SEQ ID NO: 93083 - DNA, 15 bp, Homo sapiens
gagtgtgagagcaat

SEQ ID NO: 93084 - DNA, 15 bp, Homo sapiens
tgagtgtgagagcaa

SEQ ID NO: 93085 - DNA, 15 bp, Homo sapiens
ctgagtgtgagagca

SEQ ID NO: 93086 - DNA, 15 bp, Homo sapiens
tctgagtgtgagagc

SEQ ID NO: 93087 - DNA, 15 bp, Homo sapiens
ctctgagtgtgagag

SEQ ID NO: 93088 - DNA, 15 bp, Homo sapiens
gctctgagtgtgaga

SEQ ID NO: 93089 - DNA, 15 bp, Homo sapiens
agctctgagtgtgag

SEQ ID NO: 93090 - DNA, 15 bp, Homo sapiens
aagctctgagtgtga

SEQ ID NO: 93091 - DNA, 15 bp, Homo sapiens
aaagctctgagtgtg

SEQ ID NO: 93092 - DNA, 15 bp, Homo sapiens
aaaagctctgagtgt

SEQ ID NO: 93093 - DNA, 15 bp, Homo sapiens
caaaagctctgagtg

SEQ ID NO: 93094 - DNA, 15 bp, Homo sapiens
tcaaaagctctgagt

SEQ ID NO: 93095 - DNA, 15 bp, Homo sapiens
ctcaaaagctctgag

SEQ ID NO: 93096 - DNA, 15 bp, Homo sapiens
cctcaaaagctctga

SEQ ID NO: 93097 - DNA, 15 bp, Homo sapiens
acctcaaaagctctg

SEQ ID NO: 93098 - DNA, 15 bp, Homo sapiens
tacctcaaaagctct

SEQ ID NO: 93099 - DNA, 15 bp, Homo sapiens
ttacctcaaaagctc

SEQ ID NO: 93100 - DNA, 15 bp, Homo sapiens
tttacctcaaaagct

SEQ ID NO: 93101 - DNA, 15 bp, Homo sapiens
atttacctcaaaagc

SEQ ID NO: 93102 - DNA, 15 bp, Homo sapiens
gatttacctcaaaag

SEQ ID NO: 93103 - DNA, 15 bp, Homo sapiens
ggatttacctcaaaa

SEQ ID NO: 93104 - DNA, 15 bp, Homo sapiens
tggatttacctcaaa

SEQ ID NO: 93105 - DNA, 15 bp, Homo sapiens
ctggatttacctcaa

SEQ ID NO: 93106 - DNA, 15 bp, Homo sapiens
tctggatttacctca

SEQ ID NO: 93107 - DNA, 15 bp, Homo sapiens
ctctggatttacctc

SEQ ID NO: 93108 - DNA, 15 bp, Homo sapiens
cctctggatttacct

SEQ ID NO: 93109 - DNA, 15 bp, Homo sapiens
gcctctggatttacc

SEQ ID NO: 93110 - DNA, 15 bp, Homo sapiens
ggcctctggatttac

SEQ ID NO: 93111 - DNA, 15 bp, Homo sapiens
tggcctctggattta

SEQ ID NO: 93112 - DNA, 15 bp, Homo sapiens
gtggcctctggattt

SEQ ID NO: 93113 - DNA, 15 bp, Homo sapiens
agtggcctctggatt

SEQ ID NO: 93114 - DNA, 15 bp, Homo sapiens
cagtggcctctggat

SEQ ID NO: 93115 - DNA, 15 bp, Homo sapiens
ccagtggcctctgga

SEQ ID NO: 93116 - DNA, 15 bp, Homo sapiens
cccagtggcctctgg

SEQ ID NO: 93117 - DNA, 15 bp, Homo sapiens
tcccagtggcctctg

SEQ ID NO: 93118 - DNA, 15 bp, Homo sapiens
ctcccagtggcctct

SEQ ID NO: 93119 - DNA, 15 bp, Homo sapiens
actcccagtggcctc

SEQ ID NO: 93120 - DNA, 15 bp, Homo sapiens
aactcccagtggcct

SEQ ID NO: 93121 - DNA, 15 bp, Homo sapiens
aaactcccagtggcc

SEQ ID NO: 93122 - DNA, 15 bp, Homo sapiens
taaactcccagtggc

SEQ ID NO: 93123 - DNA, 15 bp, Homo sapiens
ttaaactcccagtgg

SEQ ID NO: 93124 - DNA, 15 bp, Homo sapiens
cttaaactcccagtg

SEQ ID NO: 93125 - DNA, 15 bp, Homo sapiens
acttaaactcccagt

SEQ ID NO: 93126 - DNA, 15 bp, Homo sapiens
aacttaaactcccag

SEQ ID NO: 93127 - DNA, 15 bp, Homo sapiens
aaacttaaactccca

SEQ ID NO: 93128 - DNA, 15 bp, Homo sapiens
taaacttaaactccc

SEQ ID NO: 93129 - DNA, 15 bp, Homo sapiens
ataaacttaaactcc

SEQ ID NO: 93130 - DNA, 15 bp, Homo sapiens
aataaacttaaactc

SEQ ID NO: 93131 - DNA, 15 bp, Homo sapiens
taataaacttaaact

SEQ ID NO: 93132 - DNA, 15 bp, Homo sapiens
gtaataaacttaaac

SEQ ID NO: 93133 - DNA, 15 bp, Homo sapiens
cgtaataaacttaaa

SEQ ID NO: 93134 - DNA, 15 bp, Homo sapiens
ccgtaataaacttaa

SEQ ID NO: 93135 - DNA, 15 bp, Homo sapiens
cccgtaataaactta

SEQ ID NO: 93136 - DNA, 15 bp, Homo sapiens
ccccgtaataaactt

SEQ ID NO: 93137 - DNA, 15 bp, Homo sapiens
accccgtaataaact

SEQ ID NO: 93138 - DNA, 15 bp, Homo sapiens
taccccgtaataaac

SEQ ID NO: 93139 - DNA, 15 bp, Homo sapiens
ttaccccgtaataaa

SEQ ID NO: 93140 - DNA, 15 bp, Homo sapiens
tttaccccgtaataa

SEQ ID NO: 93141 - DNA, 15 bp, Homo sapiens
atttaccccgtaata

SEQ ID NO: 93142 - DNA, 15 bp, Homo sapiens
tatttaccccgtaat

SEQ ID NO: 93143 - DNA, 15 bp, Homo sapiens
ctatttaccccgtaa

SEQ ID NO: 93144 - DNA, 15 bp, Homo sapiens
actatttaccccgta

SEQ ID NO: 93145 - DNA, 15 bp, Homo sapiens
tactatttaccccgt

SEQ ID NO: 93146 - DNA, 15 bp, Homo sapiens
ttactatttaccccg

SEQ ID NO: 93147 - DNA, 15 bp, Homo sapiens
attactatttacccc

SEQ ID NO: 93148 - DNA, 15 bp, Homo sapiens
aattactatttaccc

SEQ ID NO: 93149 - DNA, 15 bp, Homo sapiens
taattactatttacc

SEQ ID NO: 93150 - DNA, 15 bp, Homo sapiens
ataattactatttac

SEQ ID NO: 93151 - DNA, 15 bp, Homo sapiens
gataattactattta

SEQ ID NO: 93152 - DNA, 15 bp, Homo sapiens
agataattactattt

SEQ ID NO: 93153 - DNA, 15 bp, Homo sapiens
aagataattactatt

SEQ ID NO: 93154 - DNA, 15 bp, Homo sapiens
taagataattactat

SEQ ID NO: 93155 - DNA, 15 bp, Homo sapiens
ataagataattacta

SEQ ID NO: 93156 - DNA, 15 bp, Homo sapiens
tataagataattact

SEQ ID NO: 93157 - DNA, 15 bp, Homo sapiens
ttataagataattac

SEQ ID NO: 93158 - DNA, 15 bp, Homo sapiens
cttataagataatta

SEQ ID NO: 93159 - DNA, 15 bp, Homo sapiens
tcttataagataatt

SEQ ID NO: 93160 - DNA, 15 bp, Homo sapiens
atcttataagataat

SEQ ID NO: 93161 - DNA, 15 bp, Homo sapiens
aatcttataagataa

SEQ ID NO: 93162 - DNA, 15 bp, Homo sapiens
gaatcttataagata

SEQ ID NO: 93163 - DNA, 15 bp, Homo sapiens
tgaatcttataagat

SEQ ID NO: 93164 - DNA, 15 bp, Homo sapiens
gtgaatcttataaga

SEQ ID NO: 93165 - DNA, 15 bp, Homo sapiens
cgtgaatcttataag

SEQ ID NO: 93166 - DNA, 15 bp, Homo sapiens
acgtgaatcttataa

SEQ ID NO: 93167 - DNA, 15 bp, Homo sapiens
tacgtgaatcttata

SEQ ID NO: 93168 - DNA, 15 bp, Homo sapiens
atacgtgaatcttat

SEQ ID NO: 93169 - DNA, 15 bp, Homo sapiens
aatacgtgaatctta

SEQ ID NO: 93170 - DNA, 15 bp, Homo sapiens
aaatacgtgaatctt

SEQ ID NO: 93171 - DNA, 15 bp, Homo sapiens
taaatacgtgaatct

SEQ ID NO: 93172 - DNA, 15 bp, Homo sapiens
ataaatacgtgaatc

SEQ ID NO: 93173 - DNA, 15 bp, Homo sapiens
aataaatacgtgaat

SEQ ID NO: 93174 - DNA, 15 bp, Homo sapiens
taataaatacgtgaa

SEQ ID NO: 93175 - DNA, 15 bp, Homo sapiens
ataataaatacgtga

SEQ ID NO: 93176 - DNA, 15 bp, Homo sapiens
aataataaatacgtg

SEQ ID NO: 93177 - DNA, 15 bp, Homo sapiens
aaataataaatacgt

SEQ ID NO: 93178 - DNA, 15 bp, Homo sapiens
taaataataaatacg

SEQ ID NO: 93179 - DNA, 15 bp, Homo sapiens
ttaaataataaatac

SEQ ID NO: 93180 - DNA, 15 bp, Homo sapiens
tttaaataataaata

SEQ ID NO: 93181 - DNA, 15 bp, Homo sapiens
atttaaataataaat

SEQ ID NO: 93182 - DNA, 15 bp, Homo sapiens
tatttaaataataaa

SEQ ID NO: 93183 - DNA, 15 bp, Homo sapiens
atatttaaataataa

SEQ ID NO: 93184 - DNA, 15 bp, Homo sapiens
aatatttaaataata

SEQ ID NO: 93185 - DNA, 15 bp, Homo sapiens
aaatatttaaataat

SEQ ID NO: 93186 - DNA, 15 bp, Homo sapiens
aaaatatttaaataa

SEQ ID NO: 93187 - DNA, 15 bp, Homo sapiens
taaaatatttaaata

SEQ ID NO: 93188 - DNA, 15 bp, Homo sapiens
gtaaaatatttaaat

SEQ ID NO: 93189 - DNA, 15 bp, Homo sapiens
tgtaaaatatttaaa

SEQ ID NO: 93190 - DNA, 15 bp, Homo sapiens
atgtaaaatatttaa

SEQ ID NO: 93191 - DNA, 15 bp, Homo sapiens
gaatgtaaaatattt

SEQ ID NO: 93192 - DNA, 15 bp, Homo sapiens
agaatgtaaaatatt

SEQ ID NO: 93193 - DNA, 15 bp, Homo sapiens
aagaatgtaaaatat

SEQ ID NO: 93194 - DNA, 15 bp, Homo sapiens
aaagaatgtaaaata

SEQ ID NO: 93195 - DNA, 15 bp, Homo sapiens
gaaagaatgtaaaat

SEQ ID NO: 93196 - DNA, 15 bp, Homo sapiens
agaaagaatgtaaaa

SEQ ID NO: 93197 - DNA, 15 bp, Homo sapiens
tagaaagaatgtaaa

SEQ ID NO: 93198 - DNA, 15 bp, Homo sapiens
ctagaaagaatgtaa

SEQ ID NO: 93199 - DNA, 15 bp, Homo sapiens
tctagaaagaatgta

SEQ ID NO: 93200 - DNA, 15 bp, Homo sapiens
atctagaaagaatgt

SEQ ID NO: 93201 - DNA, 15 bp, Homo sapiens
gatctagaaagaatg

SEQ ID NO: 93202 - DNA, 15 bp, Homo sapiens
ggatctagaaagaat

SEQ ID NO: 93203 - DNA, 15 bp, Homo sapiens
gggatctagaaagaa

SEQ ID NO: 93204 - DNA, 15 bp, Homo sapiens
ggggatctagaaaga

SEQ ID NO: 93205 - DNA, 15 bp, Homo sapiens
tggggatctagaaag

SEQ ID NO: 93206 - DNA, 15 bp, Homo sapiens
atggggatctagaaa

SEQ ID NO: 93207 - DNA, 15 bp, Homo sapiens
aatggggatctagaa

SEQ ID NO: 93208 - DNA, 15 bp, Homo sapiens
aaatggggatctaga

SEQ ID NO: 93209 - DNA, 15 bp, Homo sapiens
taaatggggatctag

SEQ ID NO: 93210 - DNA, 15 bp, Homo sapiens
ataaatggggatcta

SEQ ID NO: 93211 - DNA, 15 bp, Homo sapiens
aataaatggggatct

SEQ ID NO: 93212 - DNA, 15 bp, Homo sapiens
taataaatggggatc

SEQ ID NO: 93213 - DNA, 15 bp, Homo sapiens
ataataaatggggat

SEQ ID NO: 93214 - DNA, 15 bp, Homo sapiens
cataataaatgggga

SEQ ID NO: 93215 - DNA, 15 bp, Homo sapiens
acataataaatgggg

SEQ ID NO: 93216 - DNA, 15 bp, Homo sapiens
tacataataaatggg

SEQ ID NO: 93217 - DNA, 15 bp, Homo sapiens
atacataataaatgg

SEQ ID NO: 93218 - DNA, 15 bp, Homo sapiens
aatacataataaatg

SEQ ID NO: 93219 - DNA, 15 bp, Homo sapiens
aaatacataataaat

SEQ ID NO: 93220 - DNA, 15 bp, Homo sapiens
taaatacataataaa

SEQ ID NO: 93221 - DNA, 15 bp, Homo sapiens
ttaaatacataataa

SEQ ID NO: 93222 - DNA, 15 bp, Homo sapiens
cttaaatacataata

SEQ ID NO: 93223 - DNA, 15 bp, Homo sapiens
acttaaatacataat

SEQ ID NO: 93224 - DNA, 15 bp, Homo sapiens
aacttaaatacataa

SEQ ID NO: 93225 - DNA, 15 bp, Homo sapiens
caacttaaatacata

SEQ ID NO: 93226 - DNA, 15 bp, Homo sapiens
ccaacttaaatacat

SEQ ID NO: 93227 - DNA, 15 bp, Homo sapiens
cccaacttaaataca

SEQ ID NO: 93228 - DNA, 15 bp, Homo sapiens
tcccaacttaaatac

SEQ ID NO: 93229 - DNA, 15 bp, Homo sapiens
gtcccaacttaaata

SEQ ID NO: 93230 - DNA, 15 bp, Homo sapiens
agtcccaacttaaat

SEQ ID NO: 93231 - DNA, 15 bp, Homo sapiens
aagtcccaacttaaa

SEQ ID NO: 93232 - DNA, 15 bp, Homo sapiens
taagtcccaacttaa

SEQ ID NO: 93233 - DNA, 15 bp, Homo sapiens
ataagtcccaactta

SEQ ID NO: 93234 - DNA, 15 bp, Homo sapiens
gataagtcccaactt

SEQ ID NO: 93235 - DNA, 15 bp, Homo sapiens
tgataagtcccaact

SEQ ID NO: 93236 - DNA, 15 bp, Homo sapiens
ttgataagtcccaac

SEQ ID NO: 93237 - DNA, 15 bp, Homo sapiens
tttgataagtcccaa

SEQ ID NO: 93238 - DNA, 15 bp, Homo sapiens
ctttgataagtccca

SEQ ID NO: 93239 - DNA, 15 bp, Homo sapiens
tctttgataagtccc

SEQ ID NO: 93240 - DNA, 15 bp, Homo sapiens
atctttgataagtcc

SEQ ID NO: 93241 - DNA, 15 bp, Homo sapiens
catctttgataagtc

SEQ ID NO: 93242 - DNA, 15 bp, Homo sapiens
acatctttgataagt

SEQ ID NO: 93243 - DNA, 15 bp, Homo sapiens
tacatctttgataag

SEQ ID NO: 93244 - DNA, 15 bp, Homo sapiens
gtacatctttgataa

SEQ ID NO: 93245 - DNA, 15 bp, Homo sapiens
agtacatctttgata

SEQ ID NO: 93246 - DNA, 15 bp, Homo sapiens
aagtacatctttgat

SEQ ID NO: 93247 - DNA, 15 bp, Homo sapiens
aaagtacatctttga

SEQ ID NO: 93248 - DNA, 15 bp, Homo sapiens
aaaagtacatctttg

SEQ ID NO: 93249 - DNA, 15 bp, Homo sapiens
taaaagtacatcttt

SEQ ID NO: 93250 - DNA, 15 bp, Homo sapiens
ttaaaagtacatctt

SEQ ID NO: 93251 - DNA, 15 bp, Homo sapiens
attaaaagtacatct

SEQ ID NO: 93252 - DNA, 15 bp, Homo sapiens
cattaaaagtacatc

SEQ ID NO: 93253 - DNA, 15 bp, Homo sapiens
acattaaaagtacat

SEQ ID NO: 93254 - DNA, 15 bp, Homo sapiens
cacattaaaagtaca

SEQ ID NO: 93255 - DNA, 15 bp, Homo sapiens
gcacattaaaagtac

SEQ ID NO: 93256 - DNA, 15 bp, Homo sapiens
agcacattaaaagta

SEQ ID NO: 93257 - DNA, 15 bp, Homo sapiens
tagcacattaaaagt

SEQ ID NO: 93258 - DNA, 15 bp, Homo sapiens
ctagcacattaaaag

SEQ ID NO: 93259 - DNA, 15 bp, Homo sapiens
tctagcacattaaaa

SEQ ID NO: 93260 - DNA, 15 bp, Homo sapiens
ctctagcacattaaa

SEQ ID NO: 93261 - DNA, 15 bp, Homo sapiens
tctctagcacattaa

SEQ ID NO: 93262 - DNA, 15 bp, Homo sapiens
ctctctagcacatta

SEQ ID NO: 93263 - DNA, 15 bp, Homo sapiens
gctctctagcacatt

SEQ ID NO: 93264 - DNA, 15 bp, Homo sapiens
tgctctctagcacat

SEQ ID NO: 93265 - DNA, 15 bp, Homo sapiens
gtgctctctagcaca

SEQ ID NO: 93266 - DNA, 15 bp, Homo sapiens
tgtgctctctagcac

SEQ ID NO: 93267 - DNA, 15 bp, Homo sapiens
atgtgctctctagca

SEQ ID NO: 93268 - DNA, 15 bp, Homo sapiens
aatgtgctctctagc

SEQ ID NO: 93269 - DNA, 15 bp, Homo sapiens
aaatgtgctctctag

SEQ ID NO: 93270 - DNA, 15 bp, Homo sapiens
taaatgtgctctcta

SEQ ID NO: 93271 - DNA, 15 bp, Homo sapiens
ataaatgtgctctct

SEQ ID NO: 93272 - DNA, 15 bp, Homo sapiens
aataaatgtgctctc

SEQ ID NO: 93273 - DNA, 15 bp, Homo sapiens
aaataaatgtgctct

SEQ ID NO: 93274 - DNA, 15 bp, Homo sapiens
gaaataaatgtgctc

SEQ ID NO: 93275 - DNA, 15 bp, Homo sapiens
ggaaataaatgtgct

SEQ ID NO: 93276 - DNA, 15 bp, Homo sapiens
aggaaataaatgtgc

SEQ ID NO: 93277 - DNA, 15 bp, Homo sapiens
aaggaaataaatgtg

SEQ ID NO: 93278 - DNA, 15 bp, Homo sapiens
aaaggaaataaatgt

SEQ ID NO: 93279 - DNA, 15 bp, Homo sapiens
aaaaggaaataaatg

SEQ ID NO: 93280 - DNA, 15 bp, Homo sapiens
caaaaggaaataaat

SEQ ID NO: 93281 - DNA, 15 bp, Homo sapiens
gcaaaaggaaataaa

SEQ ID NO: 93282 - DNA, 15 bp, Homo sapiens
ggcaaaaggaaataa

SEQ ID NO: 93283 - DNA, 15 bp, Homo sapiens
aggcaaaaggaaata

SEQ ID NO: 93284 - DNA, 15 bp, Homo sapiens
caggcaaaaggaaat

SEQ ID NO: 93285 - DNA, 15 bp, Homo sapiens
ccaggcaaaaggaaa

SEQ ID NO: 93286 - DNA, 15 bp, Homo sapiens
tccaggcaaaaggaa

SEQ ID NO: 93287 - DNA, 15 bp, Homo sapiens
ttccaggcaaaagga

SEQ ID NO: 93288 - DNA, 15 bp, Homo sapiens
cttccaggcaaaagg

SEQ ID NO: 93289 - DNA, 15 bp, Homo sapiens
gcttccaggcaaaag

SEQ ID NO: 93290 - DNA, 15 bp, Homo sapiens
tgcttccaggcaaaa

SEQ ID NO: 93291 - DNA, 15 bp, Homo sapiens
ttgcttccaggcaaa

SEQ ID NO: 93292 - DNA, 15 bp, Homo sapiens
tttgcttccaggcaa

SEQ ID NO: 93293 - DNA, 15 bp, Homo sapiens
ctttgcttccaggca

SEQ ID NO: 93294 - DNA, 15 bp, Homo sapiens
actttgcttccaggc

SEQ ID NO: 93295 - DNA, 15 bp, Homo sapiens
gactttgcttccagg

SEQ ID NO: 93296 - DNA, 15 bp, Homo sapiens
tgactttgcttccag

SEQ ID NO: 93297 - DNA, 15 bp, Homo sapiens
ttgactttgcttcca

SEQ ID NO: 93298 - DNA, 15 bp, Homo sapiens
tttgactttgcttcc

SEQ ID NO: 93299 - DNA, 15 bp, Homo sapiens
ttttgactttgcttc

SEQ ID NO: 93300 - DNA, 15 bp, Homo sapiens
cttttgactttgctt

SEQ ID NO: 93301 - DNA, 15 bp, Homo sapiens
acttttgactttgct

SEQ ID NO: 93302 - DNA, 15 bp, Homo sapiens
tacttttgactttgc

SEQ ID NO: 93303 - DNA, 15 bp, Homo sapiens
ctacttttgactttg

SEQ ID NO: 93304 - DNA, 15 bp, Homo sapiens
tctacttttgacttt

SEQ ID NO: 93305 - DNA, 15 bp, Homo sapiens
ctctacttttgactt

SEQ ID NO: 93306 - DNA, 15 bp, Homo sapiens
actctacttttgact

SEQ ID NO: 93307 - DNA, 15 bp, Homo sapiens
tactctacttttgac

SEQ ID NO: 93308 - DNA, 15 bp, Homo sapiens
ttactctacttttga

SEQ ID NO: 93309 - DNA, 15 bp, Homo sapiens
tttactctacttttg

SEQ ID NO: 93310 - DNA, 15 bp, Homo sapiens
gtttactctactttt

SEQ ID NO: 93311 - DNA, 15 bp, Homo sapiens
agtttactctacttt

SEQ ID NO: 93312 - DNA, 15 bp, Homo sapiens
cagtttactctactt

SEQ ID NO: 93313 - DNA, 15 bp, Homo sapiens
ccagtttactctact

SEQ ID NO: 93314 - DNA, 15 bp, Homo sapiens
tccagtttactctac

SEQ ID NO: 93315 - DNA, 15 bp, Homo sapiens
gtccagtttactcta

SEQ ID NO: 93316 - DNA, 15 bp, Homo sapiens
ggtccagtttactct

SEQ ID NO: 93317 - DNA, 15 bp, Homo sapiens
aggtccagtttactc

SEQ ID NO: 93318 - DNA, 15 bp, Homo sapiens
aaggtccagtttact

SEQ ID NO: 93319 - DNA, 15 bp, Homo sapiens
caaggtccagtttac

SEQ ID NO: 93320 - DNA, 15 bp, Homo sapiens
tcaaggtccagttta

SEQ ID NO: 93321 - DNA, 15 bp, Homo sapiens
ttcaaggtccagttt

SEQ ID NO: 93322 - DNA, 15 bp, Homo sapiens
cttcaaggtccagtt

SEQ ID NO: 93323 - DNA, 15 bp, Homo sapiens
tcttcaaggtccagt

SEQ ID NO: 93324 - DNA, 15 bp, Homo sapiens
atcttcaaggtccag

SEQ ID NO: 93325 - DNA, 15 bp, Homo sapiens
tatcttcaaggtcca

SEQ ID NO: 93326 - DNA, 15 bp, Homo sapiens
ttatcttcaaggtcc

SEQ ID NO: 93327 - DNA, 15 bp, Homo sapiens
cttatcttcaaggtc

SEQ ID NO: 93328 - DNA, 15 bp, Homo sapiens
tcttatcttcaaggt

SEQ ID NO: 93329 - DNA, 15 bp, Homo sapiens
ctcttatcttcaagg

SEQ ID NO: 93330 - DNA, 15 bp, Homo sapiens
tctcttatcttcaag

SEQ ID NO: 93331 - DNA, 15 bp, Homo sapiens
ttctcttatcttcaa

SEQ ID NO: 93332 - DNA, 15 bp, Homo sapiens
tttctcttatcttca

SEQ ID NO: 93333 - DNA, 15 bp, Homo sapiens
ttttctcttatcttc

SEQ ID NO: 93334 - DNA, 15 bp, Homo sapiens
attttctcttatctt

SEQ ID NO: 93335 - DNA, 15 bp, Homo sapiens
aattttctcttatct

SEQ ID NO: 93336 - DNA, 15 bp, Homo sapiens
caattttctcttatc

SEQ ID NO: 93337 - DNA, 15 bp, Homo sapiens
gcaattttctcttat

SEQ ID NO: 93338 - DNA, 15 bp, Homo sapiens
agcaattttctctta

SEQ ID NO: 93339 - DNA, 15 bp, Homo sapiens
aagcaattttctctt

SEQ ID NO: 93340 - DNA, 15 bp, Homo sapiens
taagcaattttctct

SEQ ID NO: 93341 - DNA, 15 bp, Homo sapiens
ttaagcaattttctc

SEQ ID NO: 93342 - DNA, 15 bp, Homo sapiens
tttaagcaattttct

SEQ ID NO: 93343 - DNA, 15 bp, Homo sapiens
ttttaagcaattttc

SEQ ID NO: 93344 - DNA, 15 bp, Homo sapiens
tttttaagcaatttt

SEQ ID NO: 93345 - DNA, 15 bp, Homo sapiens
atttttaagcaattt

SEQ ID NO: 93346 - DNA, 15 bp, Homo sapiens
catttttaagcaatt

SEQ ID NO: 93347 - DNA, 15 bp, Homo sapiens
ccatttttaagcaat

SEQ ID NO: 93348 - DNA, 15 bp, Homo sapiens
accatttttaagcaa

SEQ ID NO: 93349 - DNA, 15 bp, Homo sapiens
gaccatttttaagca

SEQ ID NO: 93350 - DNA, 15 bp, Homo sapiens
tgaccatttttaagc

SEQ ID NO: 93351 - DNA, 15 bp, Homo sapiens
ttgaccatttttaag

SEQ ID NO: 93352 - DNA, 15 bp, Homo sapiens
tttgaccatttttaa

SEQ ID NO: 93353 - DNA, 15 bp, Homo sapiens
ttttgaccattttta

SEQ ID NO: 93354 - DNA, 15 bp, Homo sapiens
cattattttgaccat

SEQ ID NO: 93355 - DNA, 15 bp, Homo sapiens
acattattttgacca

SEQ ID NO: 93356 - DNA, 15 bp, Homo sapiens
aacattattttgacc

SEQ ID NO: 93357 - DNA, 15 bp, Homo sapiens
aaacattattttgac

SEQ ID NO: 93358 - DNA, 15 bp, Homo sapiens
gaaacattattttga

SEQ ID NO: 93359 - DNA, 15 bp, Homo sapiens
tgaaacattattttg

SEQ ID NO: 93360 - DNA, 15 bp, Homo sapiens
ctgaaacattatttt

SEQ ID NO: 93361 - DNA, 15 bp, Homo sapiens
cctgaaacattattt

SEQ ID NO: 93362 - DNA, 15 bp, Homo sapiens
gcctgaaacattatt

SEQ ID NO: 93363 - DNA, 15 bp, Homo sapiens
tgcctgaaacattat

SEQ ID NO: 93364 - DNA, 15 bp, Homo sapiens
atgcctgaaacatta

SEQ ID NO: 93365 - DNA, 15 bp, Homo sapiens
catgcctgaaacatt

SEQ ID NO: 93366 - DNA, 15 bp, Homo sapiens
ccatgcctgaaacat

SEQ ID NO: 93367 - DNA, 15 bp, Homo sapiens
tccatgcctgaaaca

SEQ ID NO: 93368 - DNA, 15 bp, Homo sapiens
ctccatgcctgaaac

SEQ ID NO: 93369 - DNA, 15 bp, Homo sapiens
cctccatgcctgaaa

SEQ ID NO: 93370 - DNA, 15 bp, Homo sapiens
ccctccatgcctgaa

SEQ ID NO: 93371 - DNA, 15 bp, Homo sapiens
gccctccatgcctga

SEQ ID NO: 93372 - DNA, 15 bp, Homo sapiens
ggccctccatgcctg

SEQ ID NO: 93373 - DNA, 15 bp, Homo sapiens
aggccctccatgcct

SEQ ID NO: 93374 - DNA, 15 bp, Homo sapiens
caggccctccatgcc

SEQ ID NO: 93375 - DNA, 15 bp, Homo sapiens
acaggccctccatgc

SEQ ID NO: 93376 - DNA, 15 bp, Homo sapiens
cacaggccctccatg

SEQ ID NO: 93377 - DNA, 15 bp, Homo sapiens
acacaggccctccat

SEQ ID NO: 93378 - DNA, 15 bp, Homo sapiens
cacacaggccctcca

SEQ ID NO: 93379 - DNA, 15 bp, Homo sapiens
tcacacaggccctcc

SEQ ID NO: 93380 - DNA, 15 bp, Homo sapiens
ttcacacaggccctc

SEQ ID NO: 93381 - DNA, 15 bp, Homo sapiens
tttcacacaggccct

SEQ ID NO: 93382 - DNA, 15 bp, Homo sapiens
atttcacacaggccc

SEQ ID NO: 93383 - DNA, 15 bp, Homo sapiens
tatttcacacaggcc

SEQ ID NO: 93384 - DNA, 15 bp, Homo sapiens
gtatttcacacaggc

SEQ ID NO: 93385 - DNA, 15 bp, Homo sapiens
tgtatttcacacagg

SEQ ID NO: 93386 - DNA, 15 bp, Homo sapiens
ctgtatttcacacag

SEQ ID NO: 93387 - DNA, 15 bp, Homo sapiens
tctgtatttcacaca

SEQ ID NO: 93388 - DNA, 15 bp, Homo sapiens
gtctgtatttcacac

SEQ ID NO: 93389 - DNA, 15 bp, Homo sapiens
agtctgtatttcaca

SEQ ID NO: 93390 - DNA, 15 bp, Homo sapiens
cagtctgtatttcac

SEQ ID NO: 93391 - DNA, 15 bp, Homo sapiens
acagtctgtatttca

SEQ ID NO: 93392 - DNA, 15 bp, Homo sapiens
aacagtctgtatttc

SEQ ID NO: 93393 - DNA, 15 bp, Homo sapiens
caacagtctgtattt

SEQ ID NO: 93394 - DNA, 15 bp, Homo sapiens
tcaacagtctgtatt

SEQ ID NO: 93395 - DNA, 15 bp, Homo sapiens
atcaacagtctgtat

SEQ ID NO: 93396 - DNA, 15 bp, Homo sapiens
aatcaacagtctgta

SEQ ID NO: 93397 - DNA, 15 bp, Homo sapiens
taatcaacagtctgt

SEQ ID NO: 93398 - DNA, 15 bp, Homo sapiens
ctaatcaacagtctg

SEQ ID NO: 93399 - DNA, 15 bp, Homo sapiens
tctaatcaacagtct

SEQ ID NO: 93400 - DNA, 15 bp, Homo sapiens
atctaatcaacagtc

SEQ ID NO: 93401 - DNA, 15 bp, Homo sapiens
aatctaatcaacagt

SEQ ID NO: 93402 - DNA, 15 bp, Homo sapiens
taatctaatcaacag

SEQ ID NO: 93403 - DNA, 15 bp, Homo sapiens
ataatctaatcaaca

SEQ ID NO: 93404 - DNA, 15 bp, Homo sapiens
tataatctaatcaac

SEQ ID NO: 93405 - DNA, 15 bp, Homo sapiens
ctataatctaatcaa

SEQ ID NO: 93406 - DNA, 15 bp, Homo sapiens
actataatctaatca

SEQ ID NO: 93407 - DNA, 15 bp, Homo sapiens
tactataatctaatc

SEQ ID NO: 93408 - DNA, 15 bp, Homo sapiens
ctactataatctaat

SEQ ID NO: 93409 - DNA, 15 bp, Homo sapiens
actactataatctaa

SEQ ID NO: 93410 - DNA, 15 bp, Homo sapiens
tactactataatcta

SEQ ID NO: 93411 - DNA, 15 bp, Homo sapiens
ttactactataatct

SEQ ID NO: 93412 - DNA, 15 bp, Homo sapiens
gttactactataatc

SEQ ID NO: 93413 - DNA, 15 bp, Homo sapiens
agttactactataat

SEQ ID NO: 93414 - DNA, 15 bp, Homo sapiens
aagttactactataa

SEQ ID NO: 93415 - DNA, 15 bp, Homo sapiens
caagttactactata

SEQ ID NO: 93416 - DNA, 15 bp, Homo sapiens
ccaagttactactat

SEQ ID NO: 93417 - DNA, 15 bp, Homo sapiens
accaagttactacta

SEQ ID NO: 93418 - DNA, 15 bp, Homo sapiens
aaccaagttactact

SEQ ID NO: 93419 - DNA, 15 bp, Homo sapiens
caaccaagttactac

SEQ ID NO: 93420 - DNA, 15 bp, Homo sapiens
ccaaccaagttacta

SEQ ID NO: 93421 - DNA, 15 bp, Homo sapiens
cccaaccaagttact

SEQ ID NO: 93422 - DNA, 15 bp, Homo sapiens
ccccaaccaagttac

SEQ ID NO: 93423 - DNA, 15 bp, Homo sapiens
accccaaccaagtta

SEQ ID NO: 93424 - DNA, 15 bp, Homo sapiens
caccccaaccaagtt

SEQ ID NO: 93425 - DNA, 15 bp, Homo sapiens
ccaccccaaccaagt

SEQ ID NO: 93426 - DNA, 15 bp, Homo sapiens
accaccccaaccaag

SEQ ID NO: 93427 - DNA, 15 bp, Homo sapiens
taccaccccaaccaa

SEQ ID NO: 93428 - DNA, 15 bp, Homo sapiens
ctaccaccccaacca

SEQ ID NO: 93429 - DNA, 15 bp, Homo sapiens
tctaccaccccaacc

SEQ ID NO: 93430 - DNA, 15 bp, Homo sapiens
ttctaccaccccaac

SEQ ID NO: 93431 - DNA, 15 bp, Homo sapiens
tttctaccaccccaa

SEQ ID NO: 93432 - DNA, 15 bp, Homo sapiens
atttctaccacccca

SEQ ID NO: 93433 - DNA, 15 bp, Homo sapiens
tatttctaccacccc

SEQ ID NO: 93434 - DNA, 15 bp, Homo sapiens
ctatttctaccaccc

SEQ ID NO: 93435 - DNA, 15 bp, Homo sapiens
gctatttctaccacc

SEQ ID NO: 93436 - DNA, 15 bp, Homo sapiens
ggctatttctaccac

SEQ ID NO: 93437 - DNA, 15 bp, Homo sapiens
gggctatttctacca

SEQ ID NO: 93438 - DNA, 15 bp, Homo sapiens
tgggctatttctacc

SEQ ID NO: 93439 - DNA, 15 bp, Homo sapiens
ctgggctatttctac

SEQ ID NO: 93440 - DNA, 15 bp, Homo sapiens
cctgggctatttcta

SEQ ID NO: 93441 - DNA, 15 bp, Homo sapiens
acctgggctatttct

SEQ ID NO: 93442 - DNA, 15 bp, Homo sapiens
tacctgggctatttc

SEQ ID NO: 93443 - DNA, 15 bp, Homo sapiens
ctacctgggctattt

SEQ ID NO: 93444 - DNA, 15 bp, Homo sapiens
actacctgggctatt

SEQ ID NO: 93445 - DNA, 15 bp, Homo sapiens
tactacctgggctat

SEQ ID NO: 93446 - DNA, 15 bp, Homo sapiens
ctactacctgggcta

SEQ ID NO: 93447 - DNA, 15 bp, Homo sapiens
actactacctgggct

SEQ ID NO: 93448 - DNA, 15 bp, Homo sapiens
tactactacctgggc

SEQ ID NO: 93449 - DNA, 15 bp, Homo sapiens
ttactactacctggg

SEQ ID NO: 93450 - DNA, 15 bp, Homo sapiens
tttactactacctgg

SEQ ID NO: 93451 - DNA, 15 bp, Homo sapiens
atttactactacctg

SEQ ID NO: 93452 - DNA, 15 bp, Homo sapiens
aatttactactacct

SEQ ID NO: 93453 - DNA, 15 bp, Homo sapiens
caatttactactacc

SEQ ID NO: 93454 - DNA, 15 bp, Homo sapiens
gcaatttactactac

SEQ ID NO: 93455 - DNA, 15 bp, Homo sapiens
agcaatttactacta

SEQ ID NO: 93456 - DNA, 15 bp, Homo sapiens
cagcaatttactact

SEQ ID NO: 93457 - DNA, 15 bp, Homo sapiens
tcagcaatttactac

SEQ ID NO: 93458 - DNA, 15 bp, Homo sapiens
ttcagcaatttacta

SEQ ID NO: 93459 - DNA, 15 bp, Homo sapiens
attcagcaatttact

SEQ ID NO: 93460 - DNA, 15 bp, Homo sapiens
tattcagcaatttac

SEQ ID NO: 93461 - DNA, 15 bp, Homo sapiens
gtattcagcaattta

SEQ ID NO: 93462 - DNA, 15 bp, Homo sapiens
tgtattcagcaattt

SEQ ID NO: 93463 - DNA, 15 bp, Homo sapiens
atgtattcagcaatt

SEQ ID NO: 93464 - DNA, 15 bp, Homo sapiens
catgtattcagcaat

SEQ ID NO: 93465 - DNA, 15 bp, Homo sapiens
tcatgtattcagcaa

SEQ ID NO: 93466 - DNA, 15 bp, Homo sapiens
ttcatgtattcagca

SEQ ID NO: 93467 - DNA, 15 bp, Homo sapiens
tttcatgtattcagc

SEQ ID NO: 93468 - DNA, 15 bp, Homo sapiens
gtttcatgtattcag

SEQ ID NO: 93469 - DNA, 15 bp, Homo sapiens
agtttcatgtattca

SEQ ID NO: 93470 - DNA, 15 bp, Homo sapiens
tagtttcatgtattc

SEQ ID NO: 93471 - DNA, 15 bp, Homo sapiens
gtagtttcatgtatt

SEQ ID NO: 93472 - DNA, 15 bp, Homo sapiens
agtagtttcatgtat

SEQ ID NO: 93473 - DNA, 15 bp, Homo sapiens
aagtagtttcatgta

SEQ ID NO: 93474 - DNA, 15 bp, Homo sapiens
aaagtagtttcatgt

SEQ ID NO: 93475 - DNA, 15 bp, Homo sapiens
aaaagtagtttcatg

SEQ ID NO: 93476 - DNA, 15 bp, Homo sapiens
aaaaagtagtttcat

SEQ ID NO: 93477 - DNA, 15 bp, Homo sapiens
caaaaagtagtttca

SEQ ID NO: 93478 - DNA, 15 bp, Homo sapiens
gcaaaaagtagtttc

SEQ ID NO: 93479 - DNA, 15 bp, Homo sapiens
tgcaaaaagtagttt

SEQ ID NO: 93480 - DNA, 15 bp, Homo sapiens
ctgcaaaaagtagtt

SEQ ID NO: 93481 - DNA, 15 bp, Homo sapiens
cctgcaaaaagtagt

SEQ ID NO: 93482 - DNA, 15 bp, Homo sapiens
acctgcaaaaagtag

SEQ ID NO: 93483 - DNA, 15 bp, Homo sapiens
aacctgcaaaaagta

SEQ ID NO: 93484 - DNA, 15 bp, Homo sapiens
aaacctgcaaaaagt

SEQ ID NO: 93485 - DNA, 15 bp, Homo sapiens
aaaacctgcaaaaag

SEQ ID NO: 93486 - DNA, 15 bp, Homo sapiens
aaaaacctgcaaaaa

SEQ ID NO: 93487 - DNA, 15 bp, Homo sapiens
caaaaacctgcaaaa

SEQ ID NO: 93488 - DNA, 15 bp, Homo sapiens
tcaaaaacctgcaaa

SEQ ID NO: 93489 - DNA, 15 bp, Homo sapiens
gtcaaaaacctgcaa

SEQ ID NO: 93490 - DNA, 15 bp, Homo sapiens
tgtcaaaaacctgca

SEQ ID NO: 93491 - DNA, 15 bp, Homo sapiens
atgtcaaaaacctgc

SEQ ID NO: 93492 - DNA, 15 bp, Homo sapiens
aatgtcaaaaacctg

SEQ ID NO: 93493 - DNA, 15 bp, Homo sapiens
aaatgtcaaaaacct

SEQ ID NO: 93494 - DNA, 15 bp, Homo sapiens
caaatgtcaaaaacc

SEQ ID NO: 93495 - DNA, 15 bp, Homo sapiens
tcaaatgtcaaaaac

SEQ ID NO: 93496 - DNA, 15 bp, Homo sapiens
ttcaaatgtcaaaaa

SEQ ID NO: 93497 - DNA, 15 bp, Homo sapiens
cttcaaatgtcaaaa

SEQ ID NO: 93498 - DNA, 15 bp, Homo sapiens
acttcaaatgtcaaa

SEQ ID NO: 93499 - DNA, 15 bp, Homo sapiens
gacttcaaatgtcaa

SEQ ID NO: 93500 - DNA, 15 bp, Homo sapiens
tgacttcaaatgtca

SEQ ID NO: 93501 - DNA, 15 bp, Homo sapiens
ttgacttcaaatgtc

SEQ ID NO: 93502 - DNA, 15 bp, Homo sapiens
tttgacttcaaatgt

SEQ ID NO: 93503 - DNA, 15 bp, Homo sapiens
ttttgacttcaaatg

SEQ ID NO: 93504 - DNA, 15 bp, Homo sapiens
cttttgacttcaaat

SEQ ID NO: 93505 - DNA, 15 bp, Homo sapiens
acttttgacttcaaa

SEQ ID NO: 93506 - DNA, 15 bp, Homo sapiens
gacttttgacttcaa

SEQ ID NO: 93507 - DNA, 15 bp, Homo sapiens
tgacttttgacttca

SEQ ID NO: 93508 - DNA, 15 bp, Homo sapiens
ctgacttttgacttc

SEQ ID NO: 93509 - DNA, 15 bp, Homo sapiens
tctgacttttgactt

SEQ ID NO: 93510 - DNA, 15 bp, Homo sapiens
ctctgacttttgact

SEQ ID NO: 93511 - DNA, 15 bp, Homo sapiens
tctctgacttttgac

SEQ ID NO: 93512 - DNA, 15 bp, Homo sapiens
atctctgacttttga

SEQ ID NO: 93513 - DNA, 15 bp, Homo sapiens
tatctctgacttttg

SEQ ID NO: 93514 - DNA, 15 bp, Homo sapiens
ctatctctgactttt

SEQ ID NO: 93515 - DNA, 15 bp, Homo sapiens
cctatctctgacttt

SEQ ID NO: 93516 - DNA, 15 bp, Homo sapiens
gcctatctctgactt

SEQ ID NO: 93517 - DNA, 15 bp, Homo sapiens
ggcctatctctgact

SEQ ID NO: 93518 - DNA, 15 bp, Homo sapiens
tggcctatctctgac

SEQ ID NO: 93519 - DNA, 15 bp, Homo sapiens
atggcctatctctga

SEQ ID NO: 93520 - DNA, 15 bp, Homo sapiens
aatggcctatctctg

SEQ ID NO: 93521 - DNA, 15 bp, Homo sapiens
caatggcctatctct

SEQ ID NO: 93522 - DNA, 15 bp, Homo sapiens
tcaatggcctatctc

SEQ ID NO: 93523 - DNA, 15 bp, Homo sapiens
gtcaatggcctatct

SEQ ID NO: 93524 - DNA, 15 bp, Homo sapiens
tgtcaatggcctatc

SEQ ID NO: 93525 - DNA, 15 bp, Homo sapiens
ctgtcaatggcctat

SEQ ID NO: 93526 - DNA, 15 bp, Homo sapiens
actgtcaatggccta

SEQ ID NO: 93527 - DNA, 15 bp, Homo sapiens
cactgtcaatggcct

SEQ ID NO: 93528 - DNA, 15 bp, Homo sapiens
acactgtcaatggcc

SEQ ID NO: 93529 - DNA, 15 bp, Homo sapiens
gacactgtcaatggc

SEQ ID NO: 93530 - DNA, 15 bp, Homo sapiens
tgacactgtcaatgg

SEQ ID NO: 93531 - DNA, 15 bp, Homo sapiens
ctgacactgtcaatg

SEQ ID NO: 93532 - DNA, 15 bp, Homo sapiens
tctgacactgtcaat

SEQ ID NO: 93533 - DNA, 15 bp, Homo sapiens
ctctgacactgtcaa

SEQ ID NO: 93534 - DNA, 15 bp, Homo sapiens
actctgacactgtca

SEQ ID NO: 93535 - DNA, 15 bp, Homo sapiens
cactctgacactgtc

SEQ ID NO: 93536 - DNA, 15 bp, Homo sapiens
ccactctgacactgt

SEQ ID NO: 93537 - DNA, 15 bp, Homo sapiens
cccactctgacactg

SEQ ID NO: 93538 - DNA, 15 bp, Homo sapiens
tcccactctgacact

SEQ ID NO: 93539 - DNA, 15 bp, Homo sapiens
ttcccactctgacac

SEQ ID NO: 93540 - DNA, 15 bp, Homo sapiens
cttcccactctgaca

SEQ ID NO: 93541 - DNA, 15 bp, Homo sapiens
ccttcccactctgac

SEQ ID NO: 93542 - DNA, 15 bp, Homo sapiens
gccttcccactctga

SEQ ID NO: 93543 - DNA, 15 bp, Homo sapiens
tgccttcccactctg

SEQ ID NO: 93544 - DNA, 15 bp, Homo sapiens
ttgccttcccactct

SEQ ID NO: 93545 - DNA, 15 bp, Homo sapiens
tttgccttcccactc

SEQ ID NO: 93546 - DNA, 15 bp, Homo sapiens
atttgccttcccact

SEQ ID NO: 93547 - DNA, 15 bp, Homo sapiens
gatttgccttcccac

SEQ ID NO: 93548 - DNA, 15 bp, Homo sapiens
cgatttgccttccca

SEQ ID NO: 93549 - DNA, 15 bp, Homo sapiens
acgatttgccttccc

SEQ ID NO: 93550 - DNA, 15 bp, Homo sapiens
aacgatttgccttcc

SEQ ID NO: 93551 - DNA, 15 bp, Homo sapiens
gaacgatttgccttc

SEQ ID NO: 93552 - DNA, 15 bp, Homo sapiens
ggaacgatttgcctt

SEQ ID NO: 93553 - DNA, 15 bp, Homo sapiens
tggaacgatttgcct

SEQ ID NO: 93554 - DNA, 15 bp, Homo sapiens
ctggaacgatttgcc

SEQ ID NO: 93555 - DNA, 15 bp, Homo sapiens
cctggaacgatttgc

SEQ ID NO: 93556 - DNA, 15 bp, Homo sapiens
ccctggaacgatttg

SEQ ID NO: 93557 - DNA, 15 bp, Homo sapiens
tccctggaacgattt

SEQ ID NO: 93558 - DNA, 15 bp, Homo sapiens
gtccctggaacgatt

SEQ ID NO: 93559 - DNA, 15 bp, Homo sapiens
tgtccctggaacgat

SEQ ID NO: 93560 - DNA, 15 bp, Homo sapiens
atgtccctggaacga

SEQ ID NO: 93561 - DNA, 15 bp, Homo sapiens
catgtccctggaacg

SEQ ID NO: 93562 - DNA, 15 bp, Homo sapiens
tcatgtccctggaac

SEQ ID NO: 93563 - DNA, 15 bp, Homo sapiens
ttcatgtccctggaa

SEQ ID NO: 93564 - DNA, 15 bp, Homo sapiens
tttcatgtccctgga

SEQ ID NO: 93565 - DNA, 15 bp, Homo sapiens
ttttcatgtccctgg

SEQ ID NO: 93566 - DNA, 15 bp, Homo sapiens
attttcatgtccctg

SEQ ID NO: 93567 - DNA, 15 bp, Homo sapiens
aattttcatgtccct

SEQ ID NO: 93568 - DNA, 15 bp, Homo sapiens
gaattttcatgtccc

SEQ ID NO: 93569 - DNA, 15 bp, Homo sapiens
tgaattttcatgtcc

SEQ ID NO: 93570 - DNA, 15 bp, Homo sapiens
ctgaattttcatgtc

SEQ ID NO: 93571 - DNA, 15 bp, Homo sapiens
tctgaattttcatgt

SEQ ID NO: 93572 - DNA, 15 bp, Homo sapiens
ttctgaattttcatg

SEQ ID NO: 93573 - DNA, 15 bp, Homo sapiens
tttctgaattttcat

SEQ ID NO: 93574 - DNA, 15 bp, Homo sapiens
gtttctgaattttca

SEQ ID NO: 93575 - DNA, 15 bp, Homo sapiens
tgtttctgaattttc

SEQ ID NO: 93576 - DNA, 15 bp, Homo sapiens
ctgtttctgaatttt

SEQ ID NO: 93577 - DNA, 15 bp, Homo sapiens
cctgtttctgaattt

SEQ ID NO: 93578 - DNA, 15 bp, Homo sapiens
tcctgtttctgaatt

SEQ ID NO: 93579 - DNA, 15 bp, Homo sapiens
atcctgtttctgaat

SEQ ID NO: 93580 - DNA, 15 bp, Homo sapiens
gatcctgtttctgaa

SEQ ID NO: 93581 - DNA, 15 bp, Homo sapiens
ggatcctgtttctga

SEQ ID NO: 93582 - DNA, 15 bp, Homo sapiens
aggatcctgtttctg

SEQ ID NO: 93583 - DNA, 15 bp, Homo sapiens
aaggatcctgtttct

SEQ ID NO: 93584 - DNA, 15 bp, Homo sapiens
gaaggatcctgtttc

SEQ ID NO: 93585 - DNA, 15 bp, Homo sapiens
tgaaggatcctgttt

SEQ ID NO: 93586 - DNA, 15 bp, Homo sapiens
gtgaaggatcctgtt

SEQ ID NO: 93587 - DNA, 15 bp, Homo sapiens
agtgaaggatcctgt

SEQ ID NO: 93588 - DNA, 15 bp, Homo sapiens
tagtgaaggatcctg

SEQ ID NO: 93589 - DNA, 15 bp, Homo sapiens
gtagtgaaggatcct

SEQ ID NO: 93590 - DNA, 15 bp, Homo sapiens
tgtagtgaaggatcc

SEQ ID NO: 93591 - DNA, 15 bp, Homo sapiens
gtgtagtgaaggatc

SEQ ID NO: 93592 - DNA, 15 bp, Homo sapiens
ggtgtagtgaaggat

SEQ ID NO: 93593 - DNA, 15 bp, Homo sapiens
aggtgtagtgaagga

SEQ ID NO: 93594 - DNA, 15 bp, Homo sapiens
caggtgtagtgaagg

SEQ ID NO: 93595 - DNA, 15 bp, Homo sapiens
tcaggtgtagtgaag

SEQ ID NO: 93596 - DNA, 15 bp, Homo sapiens
ttcaggtgtagtgaa

SEQ ID NO: 93597 - DNA, 15 bp, Homo sapiens
tttcaggtgtagtga

SEQ ID NO: 93598 - DNA, 15 bp, Homo sapiens
ttttcaggtgtagtg

SEQ ID NO: 93599 - DNA, 15 bp, Homo sapiens
attttcaggtgtagt

SEQ ID NO: 93600 - DNA, 15 bp, Homo sapiens
cattttcaggtgtag

SEQ ID NO: 93601 - DNA, 15 bp, Homo sapiens
acattttcaggtgta

SEQ ID NO: 93602 - DNA, 15 bp, Homo sapiens
aacattttcaggtgt

SEQ ID NO: 93603 - DNA, 15 bp, Homo sapiens
caacattttcaggtg

SEQ ID NO: 93604 - DNA, 15 bp, Homo sapiens
tcaacattttcaggt

SEQ ID NO: 93605 - DNA, 15 bp, Homo sapiens
gtcaacattttcagg

SEQ ID NO: 93606 - DNA, 15 bp, Homo sapiens
tgtcaacattttcag

SEQ ID NO: 93607 - DNA, 15 bp, Homo sapiens
ctgtcaacattttca

SEQ ID NO: 93608 - DNA, 15 bp, Homo sapiens
tctgtcaacattttc

SEQ ID NO: 93609 - DNA, 15 bp, Homo sapiens
atctgtcaacatttt

SEQ ID NO: 93610 - DNA, 15 bp, Homo sapiens
catctgtcaacattt

SEQ ID NO: 93611 - DNA, 15 bp, Homo sapiens
gcatctgtcaacatt

SEQ ID NO: 93612 - DNA, 15 bp, Homo sapiens
tgcatctgtcaacat

SEQ ID NO: 93613 - DNA, 15 bp, Homo sapiens
ctgcatctgtcaaca

SEQ ID NO: 93614 - DNA, 15 bp, Homo sapiens
gctgcatctgtcaac

SEQ ID NO: 93615 - DNA, 15 bp, Homo sapiens
tgctgcatctgtcaa

SEQ ID NO: 93616 - DNA, 15 bp, Homo sapiens
ctgctgcatctgtca

SEQ ID NO: 93617 - DNA, 15 bp, Homo sapiens
actgctgcatctgtc

SEQ ID NO: 93618 - DNA, 15 bp, Homo sapiens
cactgctgcatctgt

SEQ ID NO: 93619 - DNA, 15 bp, Homo sapiens
tcactgctgcatctg

SEQ ID NO: 93620 - DNA, 15 bp, Homo sapiens
atcactgctgcatct

SEQ ID NO: 93621 - DNA, 15 bp, Homo sapiens
tatcactgctgcatc

SEQ ID NO: 93622 - DNA, 15 bp, Homo sapiens
ttatcactgctgcat

SEQ ID NO: 93623 - DNA, 15 bp, Homo sapiens
tttatcactgctgca

SEQ ID NO: 93624 - DNA, 15 bp, Homo sapiens
ctttatcactgctgc

SEQ ID NO: 93625 - DNA, 15 bp, Homo sapiens
actttatcactgctg

SEQ ID NO: 93626 - DNA, 15 bp, Homo sapiens
aactttatcactgct

SEQ ID NO: 93627 - DNA, 15 bp, Homo sapiens
aaactttatcactgc

SEQ ID NO: 93628 - DNA, 15 bp, Homo sapiens
taaactttatcactg

SEQ ID NO: 93629 - DNA, 15 bp, Homo sapiens
ttaaactttatcact

SEQ ID NO: 93630 - DNA, 15 bp, Homo sapiens
cttaaactttatcac

SEQ ID NO: 93631 - DNA, 15 bp, Homo sapiens
tcttaaactttatca

SEQ ID NO: 93632 - DNA, 15 bp, Homo sapiens
ctcttaaactttatc

SEQ ID NO: 93633 - DNA, 15 bp, Homo sapiens
cctcttaaactttat

SEQ ID NO: 93634 - DNA, 15 bp, Homo sapiens
tcctcttaaacttta

SEQ ID NO: 93635 - DNA, 15 bp, Homo sapiens
ttcctcttaaacttt

SEQ ID NO: 93636 - DNA, 15 bp, Homo sapiens
tttcctcttaaactt

SEQ ID NO: 93637 - DNA, 15 bp, Homo sapiens
ctttcctcttaaact

SEQ ID NO: 93638 - DNA, 15 bp, Homo sapiens
cctttcctcttaaac

SEQ ID NO: 93639 - DNA, 15 bp, Homo sapiens
tcctttcctcttaaa

SEQ ID NO: 93640 - DNA, 15 bp, Homo sapiens
atcctttcctcttaa

SEQ ID NO: 93641 - DNA, 15 bp, Homo sapiens
tatcctttcctctta

SEQ ID NO: 93642 - DNA, 15 bp, Homo sapiens
ttatcctttcctctt

SEQ ID NO: 93643 - DNA, 15 bp, Homo sapiens
tttatcctttcctct

SEQ ID NO: 93644 - DNA, 15 bp, Homo sapiens
atttatcctttcctc

SEQ ID NO: 93645 - DNA, 15 bp, Homo sapiens
catttatcctttcct

SEQ ID NO: 93646 - DNA, 15 bp, Homo sapiens
acatttatcctttcc

SEQ ID NO: 93647 - DNA, 15 bp, Homo sapiens
cacatttatcctttc

SEQ ID NO: 93648 - DNA, 15 bp, Homo sapiens
tcacatttatccttt

SEQ ID NO: 93649 - DNA, 15 bp, Homo sapiens
ctcacatttatcctt

SEQ ID NO: 93650 - DNA, 15 bp, Homo sapiens
cctcacatttatcct

SEQ ID NO: 93651 - DNA, 15 bp, Homo sapiens
tcctcacatttatcc

SEQ ID NO: 93652 - DNA, 15 bp, Homo sapiens
atcctcacatttatc

SEQ ID NO: 93653 - DNA, 15 bp, Homo sapiens
catcctcacatttat

SEQ ID NO: 93654 - DNA, 15 bp, Homo sapiens
acatcctcacattta

SEQ ID NO: 93655 - DNA, 15 bp, Homo sapiens
tacatcctcacattt

SEQ ID NO: 93656 - DNA, 15 bp, Homo sapiens
atacatcctcacatt

SEQ ID NO: 93657 - DNA, 15 bp, Homo sapiens
tatacatcctcacat

SEQ ID NO: 93658 - DNA, 15 bp, Homo sapiens
ttatacatcctcaca

SEQ ID NO: 93659 - DNA, 15 bp, Homo sapiens
cttatacatcctcac

SEQ ID NO: 93660 - DNA, 15 bp, Homo sapiens
ccttatacatcctca

SEQ ID NO: 93661 - DNA, 15 bp, Homo sapiens
tccttatacatcctc

SEQ ID NO: 93662 - DNA, 15 bp, Homo sapiens
ctccttatacatcct

SEQ ID NO: 93663 - DNA, 15 bp, Homo sapiens
tctccttatacatcc

SEQ ID NO: 93664 - DNA, 15 bp, Homo sapiens
ctctccttatacatc

SEQ ID NO: 93665 - DNA, 15 bp, Homo sapiens
tctctccttatacat

SEQ ID NO: 93666 - DNA, 15 bp, Homo sapiens
ctctctccttataca

SEQ ID NO: 93667 - DNA, 15 bp, Homo sapiens
actctctccttatac

SEQ ID NO: 93668 - DNA, 15 bp, Homo sapiens
gactctctccttata

SEQ ID NO: 93669 - DNA, 15 bp, Homo sapiens
tgactctctccttat

SEQ ID NO: 93670 - DNA, 15 bp, Homo sapiens
ttgactctctcctta

SEQ ID NO: 93671 - DNA, 15 bp, Homo sapiens
attgactctctcctt

SEQ ID NO: 93672 - DNA, 15 bp, Homo sapiens
cattgactctctcct

SEQ ID NO: 93673 - DNA, 15 bp, Homo sapiens
acattgactctctcc

SEQ ID NO: 93674 - DNA, 15 bp, Homo sapiens
gacattgactctctc

SEQ ID NO: 93675 - DNA, 15 bp, Homo sapiens
tgacattgactctct

SEQ ID NO: 93676 - DNA, 15 bp, Homo sapiens
ttgacattgactctc

SEQ ID NO: 93677 - DNA, 15 bp, Homo sapiens
attgacattgactct

SEQ ID NO: 93678 - DNA, 15 bp, Homo sapiens
tattgacattgactc

SEQ ID NO: 93679 - DNA, 15 bp, Homo sapiens
ctattgacattgact

SEQ ID NO: 93680 - DNA, 15 bp, Homo sapiens
tctattgacattgac

SEQ ID NO: 93681 - DNA, 15 bp, Homo sapiens
ttctattgacattga

SEQ ID NO: 93682 - DNA, 15 bp, Homo sapiens
cttctattgacattg

SEQ ID NO: 93683 - DNA, 15 bp, Homo sapiens
acttctattgacatt

SEQ ID NO: 93684 - DNA, 15 bp, Homo sapiens
gacttctattgacat

SEQ ID NO: 93685 - DNA, 15 bp, Homo sapiens
tgacttctattgaca

SEQ ID NO: 93686 - DNA, 15 bp, Homo sapiens
ctgacttctattgac

SEQ ID NO: 93687 - DNA, 15 bp, Homo sapiens
actgacttctattga

SEQ ID NO: 93688 - DNA, 15 bp, Homo sapiens
cactgacttctattg

SEQ ID NO: 93689 - DNA, 15 bp, Homo sapiens
acactgacttctatt

SEQ ID NO: 93690 - DNA, 15 bp, Homo sapiens
gacactgacttctat

SEQ ID NO: 93691 - DNA, 15 bp, Homo sapiens
tgacactgacttcta

SEQ ID NO: 93692 - DNA, 15 bp, Homo sapiens
ctgacactgacttct

SEQ ID NO: 93693 - DNA, 15 bp, Homo sapiens
tctgacactgacttc

SEQ ID NO: 93694 - DNA, 15 bp, Homo sapiens
atctgacactgactt

SEQ ID NO: 93695 - DNA, 15 bp, Homo sapiens
aatctgacactgact

SEQ ID NO: 93696 - DNA, 15 bp, Homo sapiens
aaatctgacactgac

SEQ ID NO: 93697 - DNA, 15 bp, Homo sapiens
aaaatctgacactga

SEQ ID NO: 93698 - DNA, 15 bp, Homo sapiens
taaaatctgacactg

SEQ ID NO: 93699 - DNA, 15 bp, Homo sapiens
ttaaaatctgacact

SEQ ID NO: 93700 - DNA, 15 bp, Homo sapiens
gttaaaatctgacac

SEQ ID NO: 93701 - DNA, 15 bp, Homo sapiens
tgttaaaatctgaca

SEQ ID NO: 93702 - DNA, 15 bp, Homo sapiens
atgttaaaatctgac

SEQ ID NO: 93703 - DNA, 15 bp, Homo sapiens
aatgttaaaatctga

SEQ ID NO: 93704 - DNA, 15 bp, Homo sapiens
gaatgttaaaatctg

SEQ ID NO: 93705 - DNA, 15 bp, Homo sapiens
agaatgttaaaatct

SEQ ID NO: 93706 - DNA, 15 bp, Homo sapiens
cagaatgttaaaatc

SEQ ID NO: 93707 - DNA, 15 bp, Homo sapiens
gcagaatgttaaaat

SEQ ID NO: 93708 - DNA, 15 bp, Homo sapiens
ggcagaatgttaaaa

SEQ ID NO: 93709 - DNA, 15 bp, Homo sapiens
aggcagaatgttaaa

SEQ ID NO: 93710 - DNA, 15 bp, Homo sapiens
caggcagaatgttaa

SEQ ID NO: 93711 - DNA, 15 bp, Homo sapiens
acaggcagaatgtta

SEQ ID NO: 93712 - DNA, 15 bp, Homo sapiens
cacaggcagaatgtt

SEQ ID NO: 93713 - DNA, 15 bp, Homo sapiens
tcacaggcagaatgt

SEQ ID NO: 93714 - DNA, 15 bp, Homo sapiens
ctcacaggcagaatg

SEQ ID NO: 93715 - DNA, 15 bp, Homo sapiens
tctcacaggcagaat

SEQ ID NO: 93716 - DNA, 15 bp, Homo sapiens
ttctcacaggcagaa

SEQ ID NO: 93717 - DNA, 15 bp, Homo sapiens
tttctcacaggcaga

SEQ ID NO: 93718 - DNA, 15 bp, Homo sapiens
ctttctcacaggcag

SEQ ID NO: 93719 - DNA, 15 bp, Homo sapiens
tctttctcacaggca

SEQ ID NO: 93720 - DNA, 15 bp, Homo sapiens
atctttctcacaggc

SEQ ID NO: 93721 - DNA, 15 bp, Homo sapiens
catctttctcacagg

SEQ ID NO: 93722 - DNA, 15 bp, Homo sapiens
ccatctttctcacag

SEQ ID NO: 93723 - DNA, 15 bp, Homo sapiens
tccatctttctcaca

SEQ ID NO: 93724 - DNA, 15 bp, Homo sapiens
ctccatctttctcac

SEQ ID NO: 93725 - DNA, 15 bp, Homo sapiens
tctccatctttctca

SEQ ID NO: 93726 - DNA, 15 bp, Homo sapiens
ttctccatctttctc

SEQ ID NO: 93727 - DNA, 15 bp, Homo sapiens
cttctccatctttct

SEQ ID NO: 93728 - DNA, 15 bp, Homo sapiens
ctgcttctccatctt

SEQ ID NO: 93729 - DNA, 15 bp, Homo sapiens
tctgcttctccatct

SEQ ID NO: 93730 - DNA, 15 bp, Homo sapiens
ctctgcttctccatc

SEQ ID NO: 93731 - DNA, 15 bp, Homo sapiens
actctgcttctccat

SEQ ID NO: 93732 - DNA, 15 bp, Homo sapiens
aactctgcttctcca

SEQ ID NO: 93733 - DNA, 15 bp, Homo sapiens
aaactctgcttctcc

SEQ ID NO: 93734 - DNA, 15 bp, Homo sapiens
gaaactctgcttctc

SEQ ID NO: 93735 - DNA, 15 bp, Homo sapiens
ggaaactctgcttct

SEQ ID NO: 93736 - DNA, 15 bp, Homo sapiens
tggaaactctgcttc

SEQ ID NO: 93737 - DNA, 15 bp, Homo sapiens
ctggaaactctgctt

SEQ ID NO: 93738 - DNA, 15 bp, Homo sapiens
cctggaaactctgct

SEQ ID NO: 93739 - DNA, 15 bp, Homo sapiens
acctggaaactctgc

SEQ ID NO: 93740 - DNA, 15 bp, Homo sapiens
gacctggaaactctg

SEQ ID NO: 93741 - DNA, 15 bp, Homo sapiens
tgacctggaaactct

SEQ ID NO: 93742 - DNA, 15 bp, Homo sapiens
gtgacctggaaactc

SEQ ID NO: 93743 - DNA, 15 bp, Homo sapiens
ggtgacctggaaact

SEQ ID NO: 93744 - DNA, 15 bp, Homo sapiens
aggtgacctggaaac

SEQ ID NO: 93745 - DNA, 15 bp, Homo sapiens
caggtgacctggaaa

SEQ ID NO: 93746 - DNA, 15 bp, Homo sapiens
ccaggtgacctggaa

SEQ ID NO: 93747 - DNA, 15 bp, Homo sapiens
accaggtgacctgga

SEQ ID NO: 93748 - DNA, 15 bp, Homo sapiens
taccaggtgacctgg

SEQ ID NO: 93749 - DNA, 15 bp, Homo sapiens
ataccaggtgacctg

SEQ ID NO: 93750 - DNA, 15 bp, Homo sapiens
aataccaggtgacct

SEQ ID NO: 93751 - DNA, 15 bp, Homo sapiens
aaataccaggtgacc

SEQ ID NO: 93752 - DNA, 15 bp, Homo sapiens
aaaataccaggtgac

SEQ ID NO: 93753 - DNA, 15 bp, Homo sapiens
taaaataccaggtga

SEQ ID NO: 93754 - DNA, 15 bp, Homo sapiens
ttaaaataccaggtg

SEQ ID NO: 93755 - DNA, 15 bp, Homo sapiens
attaaaataccaggt

SEQ ID NO: 93756 - DNA, 15 bp, Homo sapiens
tattaaaataccagg

SEQ ID NO: 93757 - DNA, 15 bp, Homo sapiens
ctattaaaataccag

SEQ ID NO: 93758 - DNA, 15 bp, Homo sapiens
cctattaaaatacca

SEQ ID NO: 93759 - DNA, 15 bp, Homo sapiens
tcctattaaaatacc

SEQ ID NO: 93760 - DNA, 15 bp, Homo sapiens
ttcctattaaaatac

SEQ ID NO: 93761 - DNA, 15 bp, Homo sapiens
tttcctattaaaata

SEQ ID NO: 93762 - DNA, 15 bp, Homo sapiens
ctttcctattaaaat

SEQ ID NO: 93763 - DNA, 15 bp, Homo sapiens
actttcctattaaaa

SEQ ID NO: 93764 - DNA, 15 bp, Homo sapiens
aactttcctattaaa

SEQ ID NO: 93765 - DNA, 15 bp, Homo sapiens
gaactttcctattaa

SEQ ID NO: 93766 - DNA, 15 bp, Homo sapiens
agaactttcctatta

SEQ ID NO: 93767 - DNA, 15 bp, Homo sapiens
cagaactttcctatt

SEQ ID NO: 93768 - DNA, 15 bp, Homo sapiens
ccagaactttcctat

SEQ ID NO: 93769 - DNA, 15 bp, Homo sapiens
cccagaactttccta

SEQ ID NO: 93770 - DNA, 15 bp, Homo sapiens
acccagaactttcct

SEQ ID NO: 93771 - DNA, 15 bp, Homo sapiens
cacccagaactttcc

SEQ ID NO: 93772 - DNA, 15 bp, Homo sapiens
ccacccagaactttc

SEQ ID NO: 93773 - DNA, 15 bp, Homo sapiens
tccacccagaacttt

SEQ ID NO: 93774 - DNA, 15 bp, Homo sapiens
ctccacccagaactt

SEQ ID NO: 93775 - DNA, 15 bp, Homo sapiens
tctccacccagaact

SEQ ID NO: 93776 - DNA, 15 bp, Homo sapiens
ttctccacccagaac

SEQ ID NO: 93777 - DNA, 15 bp, Homo sapiens
attctccacccagaa

SEQ ID NO: 93778 - DNA, 15 bp, Homo sapiens
cattctccacccaga

SEQ ID NO: 93779 - DNA, 15 bp, Homo sapiens
tcattctccacccag

SEQ ID NO: 93780 - DNA, 15 bp, Homo sapiens
ttcattctccaccca

SEQ ID NO: 93781 - DNA, 15 bp, Homo sapiens
gttcattctccaccc

SEQ ID NO: 93782 - DNA, 15 bp, Homo sapiens
ggttcattctccacc

SEQ ID NO: 93783 - DNA, 15 bp, Homo sapiens
tggttcattctccac

SEQ ID NO: 93784 - DNA, 15 bp, Homo sapiens
ttggttcattctcca

SEQ ID NO: 93785 - DNA, 15 bp, Homo sapiens
attggttcattctcc

SEQ ID NO: 93786 - DNA, 15 bp, Homo sapiens
gattggttcattctc

SEQ ID NO: 93787 - DNA, 15 bp, Homo sapiens
tgattggttcattct

SEQ ID NO: 93788 - DNA, 15 bp, Homo sapiens
gtgattggttcattc

SEQ ID NO: 93789 - DNA, 15 bp, Homo sapiens
tgtgattggttcatt

SEQ ID NO: 93790 - DNA, 15 bp, Homo sapiens
gtgtgattggttcat

SEQ ID NO: 93791 - DNA, 15 bp, Homo sapiens
agtgtgattggttca

SEQ ID NO: 93792 - DNA, 15 bp, Homo sapiens
gagtgtgattggttc

SEQ ID NO: 93793 - DNA, 15 bp, Homo sapiens
agagtgtgattggtt

SEQ ID NO: 93794 - DNA, 15 bp, Homo sapiens
gagagtgtgattggt

SEQ ID NO: 93795 - DNA, 15 bp, Homo sapiens
agagagtgtgattgg

SEQ ID NO: 93796 - DNA, 15 bp, Homo sapiens
gagagagtgtgattg

SEQ ID NO: 93797 - DNA, 15 bp, Homo sapiens
ggagagagtgtgatt

SEQ ID NO: 93798 - DNA, 15 bp, Homo sapiens
gggagagagtgtgat

SEQ ID NO: 93799 - DNA, 15 bp, Homo sapiens
agggagagagtgtga

SEQ ID NO: 93800 - DNA, 15 bp, Homo sapiens
cagggagagagtgtg

SEQ ID NO: 93801 - DNA, 15 bp, Homo sapiens
gcagggagagagtgt

SEQ ID NO: 93802 - DNA, 15 bp, Homo sapiens
tgcagggagagagtg

SEQ ID NO: 93803 - DNA, 15 bp, Homo sapiens
ttgcagggagagagt

SEQ ID NO: 93804 - DNA, 15 bp, Homo sapiens
cttgcagggagagag

SEQ ID NO: 93805 - DNA, 15 bp, Homo sapiens
ccttgcagggagaga

SEQ ID NO: 93806 - DNA, 15 bp, Homo sapiens
gccttgcagggagag

SEQ ID NO: 93807 - DNA, 15 bp, Homo sapiens
agccttgcagggaga

SEQ ID NO: 93808 - DNA, 15 bp, Homo sapiens
aagccttgcagggag

SEQ ID NO: 93809 - DNA, 15 bp, Homo sapiens
gaagccttgcaggga

SEQ ID NO: 93810 - DNA, 15 bp, Homo sapiens
ggaagccttgcaggg

SEQ ID NO: 93811 - DNA, 15 bp, Homo sapiens
aggaagccttgcagg

SEQ ID NO: 93812 - DNA, 15 bp, Homo sapiens
taggaagccttgcag

SEQ ID NO: 93813 - DNA, 15 bp, Homo sapiens
ataggaagccttgca

SEQ ID NO: 93814 - DNA, 15 bp, Homo sapiens
gataggaagccttgc

SEQ ID NO: 93815 - DNA, 15 bp, Homo sapiens
ggataggaagccttg

SEQ ID NO: 93816 - DNA, 15 bp, Homo sapiens
aggataggaagcctt

SEQ ID NO: 93817 - DNA, 15 bp, Homo sapiens
gaggataggaagcct

SEQ ID NO: 93818 - DNA, 15 bp, Homo sapiens
ggaggataggaagcc

SEQ ID NO: 93819 - DNA, 15 bp, Homo sapiens
tggaggataggaagc

SEQ ID NO: 93820 - DNA, 15 bp, Homo sapiens
ctggaggataggaag

SEQ ID NO: 93821 - DNA, 15 bp, Homo sapiens
actggaggataggaa

SEQ ID NO: 93822 - DNA, 15 bp, Homo sapiens
cactggaggatagga

SEQ ID NO: 93823 - DNA, 15 bp, Homo sapiens
tcactggaggatagg

SEQ ID NO: 93824 - DNA, 15 bp, Homo sapiens
gtcactggaggatag

SEQ ID NO: 93825 - DNA, 15 bp, Homo sapiens
agtcactggaggata

SEQ ID NO: 93826 - DNA, 15 bp, Homo sapiens
gagtcactggaggat

SEQ ID NO: 93827 - DNA, 15 bp, Homo sapiens
ggagtcactggagga

SEQ ID NO: 93828 - DNA, 15 bp, Homo sapiens
aggagtcactggagg

SEQ ID NO: 93829 - DNA, 15 bp, Homo sapiens
aaggagtcactggag

SEQ ID NO: 93830 - DNA, 15 bp, Homo sapiens
taaggagtcactgga

SEQ ID NO: 93831 - DNA, 15 bp, Homo sapiens
gtaaggagtcactgg

SEQ ID NO: 93832 - DNA, 15 bp, Homo sapiens
ggtaaggagtcactg

SEQ ID NO: 93833 - DNA, 15 bp, Homo sapiens
aggtaaggagtcact

SEQ ID NO: 93834 - DNA, 15 bp, Homo sapiens
aaggtaaggagtcac

SEQ ID NO: 93835 - DNA, 15 bp, Homo sapiens
caaggtaaggagtca

SEQ ID NO: 93836 - DNA, 15 bp, Homo sapiens
ccaaggtaaggagtc

SEQ ID NO: 93837 - DNA, 15 bp, Homo sapiens
accaaggtaaggagt

SEQ ID NO: 93838 - DNA, 15 bp, Homo sapiens
gaccaaggtaaggag

SEQ ID NO: 93839 - DNA, 15 bp, Homo sapiens
agaccaaggtaagga

SEQ ID NO: 93840 - DNA, 15 bp, Homo sapiens
aagaccaaggtaagg

SEQ ID NO: 93841 - DNA, 15 bp, Homo sapiens
aaagaccaaggtaag

SEQ ID NO: 93842 - DNA, 15 bp, Homo sapiens
aaaagaccaaggtaa

SEQ ID NO: 93843 - DNA, 15 bp, Homo sapiens
aaaaagaccaaggta

SEQ ID NO: 93844 - DNA, 15 bp, Homo sapiens
aaaaaagaccaaggt

SEQ ID NO: 93845 - DNA, 15 bp, Homo sapiens
aaaaaaagaccaagg

SEQ ID NO: 93846 - DNA, 15 bp, Homo sapiens
aaaaaaaagaccaag

SEQ ID NO: 93847 - DNA, 15 bp, Homo sapiens
aaaaaaaaagaccaa

SEQ ID NO: 93848 - DNA, 15 bp, Homo sapiens
aaaaaaaaaagacca

SEQ ID NO: 93849 - DNA, 15 bp, Homo sapiens
aaaaaaaaaaagacc

SEQ ID NO: 93850 - DNA, 15 bp, Homo sapiens
ggaaaaaaaaaaaaa

SEQ ID NO: 93851 - DNA, 15 bp, Homo sapiens
gggaaaaaaaaaaaa

SEQ ID NO: 93852 - DNA, 15 bp, Homo sapiens
ggggaaaaaaaaaaa

SEQ ID NO: 93853 - DNA, 15 bp, Homo sapiens
tggggaaaaaaaaaa

SEQ ID NO: 93854 - DNA, 15 bp, Homo sapiens
atggggaaaaaaaaa

SEQ ID NO: 93855 - DNA, 15 bp, Homo sapiens
gatggggaaaaaaaa

SEQ ID NO: 93856 - DNA, 15 bp, Homo sapiens
tgatggggaaaaaaa

SEQ ID NO: 93857 - DNA, 15 bp, Homo sapiens
ctgatggggaaaaaa

SEQ ID NO: 93858 - DNA, 15 bp, Homo sapiens
actgatggggaaaaa

SEQ ID NO: 93859 - DNA, 15 bp, Homo sapiens
gactgatggggaaaa

SEQ ID NO: 93860 - DNA, 15 bp, Homo sapiens
tgactgatggggaaa

SEQ ID NO: 93861 - DNA, 15 bp, Homo sapiens
ctgactgatggggaa

SEQ ID NO: 93862 - DNA, 15 bp, Homo sapiens
cctgactgatgggga

SEQ ID NO: 93863 - DNA, 15 bp, Homo sapiens
ccctgactgatgggg

SEQ ID NO: 93864 - DNA, 15 bp, Homo sapiens
tccctgactgatggg

SEQ ID NO: 93865 - DNA, 15 bp, Homo sapiens
atccctgactgatgg

SEQ ID NO: 93866 - DNA, 15 bp, Homo sapiens
gatccctgactgatg

SEQ ID NO: 93867 - DNA, 15 bp, Homo sapiens
agatccctgactgat

SEQ ID NO: 93868 - DNA, 15 bp, Homo sapiens
aagatccctgactga

SEQ ID NO: 93869 - DNA, 15 bp, Homo sapiens
aaagatccctgactg

SEQ ID NO: 93870 - DNA, 15 bp, Homo sapiens
caaagatccctgact

SEQ ID NO: 93871 - DNA, 15 bp, Homo sapiens
acaaagatccctgac

SEQ ID NO: 93872 - DNA, 15 bp, Homo sapiens
gacaaagatccctga

SEQ ID NO: 93873 - DNA, 15 bp, Homo sapiens
agacaaagatccctg

SEQ ID NO: 93874 - DNA, 15 bp, Homo sapiens
aagacaaagatccct

SEQ ID NO: 93875 - DNA, 15 bp, Homo sapiens
aaagacaaagatccc

SEQ ID NO: 93876 - DNA, 15 bp, Homo sapiens
aaaagacaaagatcc

SEQ ID NO: 93877 - DNA, 15 bp, Homo sapiens
aaaaagacaaagatc

SEQ ID NO: 93878 - DNA, 15 bp, Homo sapiens
aaaaaagacaaagat

SEQ ID NO: 93879 - DNA, 15 bp, Homo sapiens
taaaaaagacaaaga

SEQ ID NO: 93880 - DNA, 15 bp, Homo sapiens
ttaaaaaagacaaag

SEQ ID NO: 93881 - DNA, 15 bp, Homo sapiens
tttaaaaaagacaaa

SEQ ID NO: 93882 - DNA, 15 bp, Homo sapiens
atttaaaaaagacaa

SEQ ID NO: 93883 - DNA, 15 bp, Homo sapiens
aatttaaaaaagaca

SEQ ID NO: 93884 - DNA, 15 bp, Homo sapiens
aaatttaaaaaagac

SEQ ID NO: 93885 - DNA, 15 bp, Homo sapiens
gaaatttaaaaaaga

SEQ ID NO: 93886 - DNA, 15 bp, Homo sapiens
agaaatttaaaaaag

SEQ ID NO: 93887 - DNA, 15 bp, Homo sapiens
aagaaatttaaaaaa

SEQ ID NO: 93888 - DNA, 15 bp, Homo sapiens
taagaaatttaaaaa

SEQ ID NO: 93889 - DNA, 15 bp, Homo sapiens
ataagaaatttaaaa

SEQ ID NO: 93890 - DNA, 15 bp, Homo sapiens
aataagaaatttaaa

SEQ ID NO: 93891 - DNA, 15 bp, Homo sapiens
gaataagaaatttaa

SEQ ID NO: 93892 - DNA, 15 bp, Homo sapiens
tgaataagaaattta

SEQ ID NO: 93893 - DNA, 15 bp, Homo sapiens
gtgaataagaaattt

SEQ ID NO: 93894 - DNA, 15 bp, Homo sapiens
ggtgaataagaaatt

SEQ ID NO: 93895 - DNA, 15 bp, Homo sapiens
cggtgaataagaaat

SEQ ID NO: 93896 - DNA, 15 bp, Homo sapiens
tcggtgaataagaaa

SEQ ID NO: 93897 - DNA, 15 bp, Homo sapiens
atcggtgaataagaa

SEQ ID NO: 93898 - DNA, 15 bp, Homo sapiens
catcggtgaataaga

SEQ ID NO: 93899 - DNA, 15 bp, Homo sapiens
acatcggtgaataag

SEQ ID NO: 93900 - DNA, 15 bp, Homo sapiens
tacatcggtgaataa

SEQ ID NO: 93901 - DNA, 15 bp, Homo sapiens
atacatcggtgaata

SEQ ID NO: 93902 - DNA, 15 bp, Homo sapiens
catacatcggtgaat

SEQ ID NO: 93903 - DNA, 15 bp, Homo sapiens
gcatacatcggtgaa

SEQ ID NO: 93904 - DNA, 15 bp, Homo sapiens
ggcatacatcggtga

SEQ ID NO: 93905 - DNA, 15 bp, Homo sapiens
tggcatacatcggtg

SEQ ID NO: 93906 - DNA, 15 bp, Homo sapiens
ttggcatacatcggt

SEQ ID NO: 93907 - DNA, 15 bp, Homo sapiens
cttggcatacatcgg

SEQ ID NO: 93908 - DNA, 15 bp, Homo sapiens
tcttggcatacatcg

SEQ ID NO: 93909 - DNA, 15 bp, Homo sapiens
atcttggcatacatc

SEQ ID NO: 93910 - DNA, 15 bp, Homo sapiens
catcttggcatacat

SEQ ID NO: 93911 - DNA, 15 bp, Homo sapiens
acatcttggcataca

SEQ ID NO: 93912 - DNA, 15 bp, Homo sapiens
tacatcttggcatac

SEQ ID NO: 93913 - DNA, 15 bp, Homo sapiens
gtacatcttggcata

SEQ ID NO: 93914 - DNA, 15 bp, Homo sapiens
agtacatcttggcat

SEQ ID NO: 93915 - DNA, 15 bp, Homo sapiens
gagtacatcttggca

SEQ ID NO: 93916 - DNA, 15 bp, Homo sapiens
tgagtacatcttggc

SEQ ID NO: 93917 - DNA, 15 bp, Homo sapiens
atgagtacatcttgg

SEQ ID NO: 93918 - DNA, 15 bp, Homo sapiens
tatgagtacatcttg

SEQ ID NO: 93919 - DNA, 15 bp, Homo sapiens
ttatgagtacatctt

SEQ ID NO: 93920 - DNA, 15 bp, Homo sapiens
gttatgagtacatct

SEQ ID NO: 93921 - DNA, 15 bp, Homo sapiens
agttatgagtacatc

SEQ ID NO: 93922 - DNA, 15 bp, Homo sapiens
tagttatgagtacat

SEQ ID NO: 93923 - DNA, 15 bp, Homo sapiens
ctagttatgagtaca

SEQ ID NO: 93924 - DNA, 15 bp, Homo sapiens
tctagttatgagtac

SEQ ID NO: 93925 - DNA, 15 bp, Homo sapiens
ctctagttatgagta

SEQ ID NO: 93926 - DNA, 15 bp, Homo sapiens
gctctagttatgagt

SEQ ID NO: 93927 - DNA, 15 bp, Homo sapiens
tgctctagttatgag

SEQ ID NO: 93928 - DNA, 15 bp, Homo sapiens
ttgctctagttatga

SEQ ID NO: 93929 - DNA, 15 bp, Homo sapiens
attgctctagttatg

SEQ ID NO: 93930 - DNA, 15 bp, Homo sapiens
cattgctctagttat

SEQ ID NO: 93931 - DNA, 15 bp, Homo sapiens
gcattgctctagtta

SEQ ID NO: 93932 - DNA, 15 bp, Homo sapiens
ggcattgctctagtt

SEQ ID NO: 93933 - DNA, 15 bp, Homo sapiens
aggcattgctctagt

SEQ ID NO: 93934 - DNA, 15 bp, Homo sapiens
caggcattgctctag

SEQ ID NO: 93935 - DNA, 15 bp, Homo sapiens
ccaggcattgctcta

SEQ ID NO: 93936 - DNA, 15 bp, Homo sapiens
gccaggcattgctct

SEQ ID NO: 93937 - DNA, 15 bp, Homo sapiens
tgccaggcattgctc

SEQ ID NO: 93938 - DNA, 15 bp, Homo sapiens
gtgccaggcattgct

SEQ ID NO: 93939 - DNA, 15 bp, Homo sapiens
tgtgccaggcattgc

SEQ ID NO: 93940 - DNA, 15 bp, Homo sapiens
ctgtgccaggcattg

SEQ ID NO: 93941 - DNA, 15 bp, Homo sapiens
tctgtgccaggcatt

SEQ ID NO: 93942 - DNA, 15 bp, Homo sapiens
ctctgtgccaggcat

SEQ ID NO: 93943 - DNA, 15 bp, Homo sapiens
tctctgtgccaggca

SEQ ID NO: 93944 - DNA, 15 bp, Homo sapiens
ttctctgtgccaggc

SEQ ID NO: 93945 - DNA, 15 bp, Homo sapiens
cttctctgtgccagg

SEQ ID NO: 93946 - DNA, 15 bp, Homo sapiens
ccttctctgtgccag

SEQ ID NO: 93947 - DNA, 15 bp, Homo sapiens
gccttctctgtgcca

SEQ ID NO: 93948 - DNA, 15 bp, Homo sapiens
tgccttctctgtgcc

SEQ ID NO: 93949 - DNA, 15 bp, Homo sapiens
atgccttctctgtgc

SEQ ID NO: 93950 - DNA, 15 bp, Homo sapiens
gatgccttctctgtg

SEQ ID NO: 93951 - DNA, 15 bp, Homo sapiens
ggatgccttctctgt

SEQ ID NO: 93952 - DNA, 15 bp, Homo sapiens
tggatgccttctctg

SEQ ID NO: 93953 - DNA, 15 bp, Homo sapiens
ttggatgccttctct

SEQ ID NO: 93954 - DNA, 15 bp, Homo sapiens
attggatgccttctc

SEQ ID NO: 93955 - DNA, 15 bp, Homo sapiens
gattggatgccttct

SEQ ID NO: 93956 - DNA, 15 bp, Homo sapiens
tgattggatgccttc

SEQ ID NO: 93957 - DNA, 15 bp, Homo sapiens
ttgattggatgcctt

SEQ ID NO: 93958 - DNA, 15 bp, Homo sapiens
attgattggatgcct

SEQ ID NO: 93959 - DNA, 15 bp, Homo sapiens
tattgattggatgcc

SEQ ID NO: 93960 - DNA, 15 bp, Homo sapiens
atattgattggatgc

SEQ ID NO: 93961 - DNA, 15 bp, Homo sapiens
aatattgattggatg

SEQ ID NO: 93962 - DNA, 15 bp, Homo sapiens
aaatattgattggat

SEQ ID NO: 93963 - DNA, 15 bp, Homo sapiens
aaaatattgattgga

SEQ ID NO: 93964 - DNA, 15 bp, Homo sapiens
aaaaatattgattgg

SEQ ID NO: 93965 - DNA, 15 bp, Homo sapiens
gaaaaatattgattg

SEQ ID NO: 93966 - DNA, 15 bp, Homo sapiens
tgaaaaatattgatt

SEQ ID NO: 93967 - DNA, 15 bp, Homo sapiens
ttgaaaaatattgat

SEQ ID NO: 93968 - DNA, 15 bp, Homo sapiens
gttgaaaaatattga

SEQ ID NO: 93969 - DNA, 15 bp, Homo sapiens
cgttgaaaaatattg

SEQ ID NO: 93970 - DNA, 15 bp, Homo sapiens
tcgttgaaaaatatt

SEQ ID NO: 93971 - DNA, 15 bp, Homo sapiens
ttcgttgaaaaatat

SEQ ID NO: 93972 - DNA, 15 bp, Homo sapiens
attcgttgaaaaata

SEQ ID NO: 93973 - DNA, 15 bp, Homo sapiens
cattcgttgaaaaat

SEQ ID NO: 93974 - DNA, 15 bp, Homo sapiens
tcattcgttgaaaaa

SEQ ID NO: 93975 - DNA, 15 bp, Homo sapiens
ttcattcgttgaaaa

SEQ ID NO: 93976 - DNA, 15 bp, Homo sapiens
tttcattcgttgaaa

SEQ ID NO: 93977 - DNA, 15 bp, Homo sapiens
atttcattcgttgaa

SEQ ID NO: 93978 - DNA, 15 bp, Homo sapiens
catttcattcgttga

SEQ ID NO: 93979 - DNA, 15 bp, Homo sapiens
tcatttcattcgttg

SEQ ID NO: 93980 - DNA, 15 bp, Homo sapiens
ttcatttcattcgtt

SEQ ID NO: 93981 - DNA, 15 bp, Homo sapiens
tttcatttcattcgt

SEQ ID NO: 93982 - DNA, 15 bp, Homo sapiens
atttcatttcattcg

SEQ ID NO: 93983 - DNA, 15 bp, Homo sapiens
aatttcatttcattc

SEQ ID NO: 93984 - DNA, 15 bp, Homo sapiens
taatttcatttcatt

SEQ ID NO: 93985 - DNA, 15 bp, Homo sapiens
ctaatttcatttcat

SEQ ID NO: 93986 - DNA, 15 bp, Homo sapiens
gctaatttcatttca

SEQ ID NO: 93987 - DNA, 15 bp, Homo sapiens
tgctaatttcatttc

SEQ ID NO: 93988 - DNA, 15 bp, Homo sapiens
ttgctaatttcattt

SEQ ID NO: 93989 - DNA, 15 bp, Homo sapiens
attgctaatttcatt

SEQ ID NO: 93990 - DNA, 15 bp, Homo sapiens
tattgctaatttcat

SEQ ID NO: 93991 - DNA, 15 bp, Homo sapiens
ctattgctaatttca

SEQ ID NO: 93992 - DNA, 15 bp, Homo sapiens
cctattgctaatttc

SEQ ID NO: 93993 - DNA, 15 bp, Homo sapiens
tcctattgctaattt

SEQ ID NO: 93994 - DNA, 15 bp, Homo sapiens
ctcctattgctaatt

SEQ ID NO: 93995 - DNA, 15 bp, Homo sapiens
tctcctattgctaat

SEQ ID NO: 93996 - DNA, 15 bp, Homo sapiens
atctcctattgctaa

SEQ ID NO: 93997 - DNA, 15 bp, Homo sapiens
aatctcctattgcta

SEQ ID NO: 93998 - DNA, 15 bp, Homo sapiens
aaatctcctattgct

SEQ ID NO: 93999 - DNA, 15 bp, Homo sapiens
taaatctcctattgc

SEQ ID NO: 94000 - DNA, 15 bp, Homo sapiens
ctaaatctcctattg

SEQ ID NO: 94001 - DNA, 15 bp, Homo sapiens
tctaaatctcctatt

SEQ ID NO: 94002 - DNA, 15 bp, Homo sapiens
atctaaatctcctat

SEQ ID NO: 94003 - DNA, 15 bp, Homo sapiens
aatctaaatctccta

SEQ ID NO: 94004 - DNA, 15 bp, Homo sapiens
aaatctaaatctcct

SEQ ID NO: 94005 - DNA, 15 bp, Homo sapiens
caaatctaaatctcc

SEQ ID NO: 94006 - DNA, 15 bp, Homo sapiens
ccaaatctaaatctc

SEQ ID NO: 94007 - DNA, 15 bp, Homo sapiens
tccaaatctaaatct

SEQ ID NO: 94008 - DNA, 15 bp, Homo sapiens
atccaaatctaaatc

SEQ ID NO: 94009 - DNA, 15 bp, Homo sapiens
tatccaaatctaaat

SEQ ID NO: 94010 - DNA, 15 bp, Homo sapiens
atatccaaatctaaa

SEQ ID NO: 94011 - DNA, 15 bp, Homo sapiens
tatatccaaatctaa

SEQ ID NO: 94012 - DNA, 15 bp, Homo sapiens
atatatccaaatcta

SEQ ID NO: 94013 - DNA, 15 bp, Homo sapiens
gatatatccaaatct

SEQ ID NO: 94014 - DNA, 15 bp, Homo sapiens
agatatatccaaatc

SEQ ID NO: 94015 - DNA, 15 bp, Homo sapiens
gagatatatccaaat

SEQ ID NO: 94016 - DNA, 15 bp, Homo sapiens
agagatatatccaaa

SEQ ID NO: 94017 - DNA, 15 bp, Homo sapiens
cagagatatatccaa

SEQ ID NO: 94018 - DNA, 15 bp, Homo sapiens
acagagatatatcca

SEQ ID NO: 94019 - DNA, 15 bp, Homo sapiens
tacagagatatatcc

SEQ ID NO: 94020 - DNA, 15 bp, Homo sapiens
atacagagatatatc

SEQ ID NO: 94021 - DNA, 15 bp, Homo sapiens
tatacagagatatat

SEQ ID NO: 94022 - DNA, 15 bp, Homo sapiens
atatacagagatata

SEQ ID NO: 94023 - DNA, 15 bp, Homo sapiens
gatatacagagatat

SEQ ID NO: 94024 - DNA, 15 bp, Homo sapiens
agatatacagagata

SEQ ID NO: 94025 - DNA, 15 bp, Homo sapiens
tagatatacagagat

SEQ ID NO: 94026 - DNA, 15 bp, Homo sapiens
atagatatacagaga

SEQ ID NO: 94027 - DNA, 15 bp, Homo sapiens
gatagatatacagag

SEQ ID NO: 94028 - DNA, 15 bp, Homo sapiens
agatagatatacaga

SEQ ID NO: 94029 - DNA, 15 bp, Homo sapiens
tagatagatatacag

SEQ ID NO: 94030 - DNA, 15 bp, Homo sapiens
atagatagatataca

SEQ ID NO: 94031 - DNA, 15 bp, Homo sapiens
gatagatagatatac

SEQ ID NO: 94032 - DNA, 15 bp, Homo sapiens
agatagatagatata

SEQ ID NO: 94033 - DNA, 15 bp, Homo sapiens
tagatagatagatat

SEQ ID NO: 94034 - DNA, 15 bp, Homo sapiens
tatagatagatagat

SEQ ID NO: 94035 - DNA, 15 bp, Homo sapiens
atatagatagataga

SEQ ID NO: 94036 - DNA, 15 bp, Homo sapiens
tatatagatagatag

SEQ ID NO: 94037 - DNA, 15 bp, Homo sapiens
atatatagatagata

SEQ ID NO: 94038 - DNA, 15 bp, Homo sapiens
tatatatagatagat

SEQ ID NO: 94039 - DNA, 15 bp, Homo sapiens
atatatatagataga

SEQ ID NO: 94040 - DNA, 15 bp, Homo sapiens
tatatatatagatag

SEQ ID NO: 94041 - DNA, 15 bp, Homo sapiens
ctatatatatagata

SEQ ID NO: 94042 - DNA, 15 bp, Homo sapiens
tctatatatatagat

SEQ ID NO: 94043 - DNA, 15 bp, Homo sapiens
atctatatatataga

SEQ ID NO: 94044 - DNA, 15 bp, Homo sapiens
tatctatatatatag

SEQ ID NO: 94045 - DNA, 15 bp, Homo sapiens
ctatctatatatata

SEQ ID NO: 94046 - DNA, 15 bp, Homo sapiens
tctatctatatatat

SEQ ID NO: 94047 - DNA, 15 bp, Homo sapiens
atctatctatatata

SEQ ID NO: 94048 - DNA, 15 bp, Homo sapiens
tatctatctatatat

SEQ ID NO: 94049 - DNA, 15 bp, Homo sapiens
ctatctatctatata

SEQ ID NO: 94050 - DNA, 15 bp, Homo sapiens
tctatctatctatat

SEQ ID NO: 94051 - DNA, 15 bp, Homo sapiens
atctatctatctata

SEQ ID NO: 94052 - DNA, 15 bp, Homo sapiens
aatctatctatctat

SEQ ID NO: 94053 - DNA, 15 bp, Homo sapiens
gaatctatctatcta

SEQ ID NO: 94054 - DNA, 15 bp, Homo sapiens
agaatctatctatct

SEQ ID NO: 94055 - DNA, 15 bp, Homo sapiens
gagaatctatctatc

SEQ ID NO: 94056 - DNA, 15 bp, Homo sapiens
agagaatctatctat

SEQ ID NO: 94057 - DNA, 15 bp, Homo sapiens
aagagaatctatcta

SEQ ID NO: 94058 - DNA, 15 bp, Homo sapiens
caagagaatctatct

SEQ ID NO: 94059 - DNA, 15 bp, Homo sapiens
ccaagagaatctatc

SEQ ID NO: 94060 - DNA, 15 bp, Homo sapiens
tccaagagaatctat

SEQ ID NO: 94061 - DNA, 15 bp, Homo sapiens
ttccaagagaatcta

SEQ ID NO: 94062 - DNA, 15 bp, Homo sapiens
cttccaagagaatct

SEQ ID NO: 94063 - DNA, 15 bp, Homo sapiens
gcttccaagagaatc

SEQ ID NO: 94064 - DNA, 15 bp, Homo sapiens
agcttccaagagaat

SEQ ID NO: 94065 - DNA, 15 bp, Homo sapiens
tagcttccaagagaa

SEQ ID NO: 94066 - DNA, 15 bp, Homo sapiens
ttagcttccaagaga

SEQ ID NO: 94067 - DNA, 15 bp, Homo sapiens
tttagcttccaagag

SEQ ID NO: 94068 - DNA, 15 bp, Homo sapiens
atttagcttccaaga

SEQ ID NO: 94069 - DNA, 15 bp, Homo sapiens
gatttagcttccaag

SEQ ID NO: 94070 - DNA, 15 bp, Homo sapiens
ggatttagcttccaa

SEQ ID NO: 94071 - DNA, 15 bp, Homo sapiens
tggatttagcttcca

SEQ ID NO: 94072 - DNA, 15 bp, Homo sapiens
ttggatttagcttcc

SEQ ID NO: 94073 - DNA, 15 bp, Homo sapiens
tttggatttagcttc

SEQ ID NO: 94074 - DNA, 15 bp, Homo sapiens
atttggatttagctt

SEQ ID NO: 94075 - DNA, 15 bp, Homo sapiens
tatttggatttagct

SEQ ID NO: 94076 - DNA, 15 bp, Homo sapiens
atatttggatttagc

SEQ ID NO: 94077 - DNA, 15 bp, Homo sapiens
catatttggatttag

SEQ ID NO: 94078 - DNA, 15 bp, Homo sapiens
acatatttggattta

SEQ ID NO: 94079 - DNA, 15 bp, Homo sapiens
cacatatttggattt

SEQ ID NO: 94080 - DNA, 15 bp, Homo sapiens
acacatatttggatt

SEQ ID NO: 94081 - DNA, 15 bp, Homo sapiens
tacacatatttggat

SEQ ID NO: 94082 - DNA, 15 bp, Homo sapiens
ctacacatatttgga

SEQ ID NO: 94083 - DNA, 15 bp, Homo sapiens
tctacacatatttgg

SEQ ID NO: 94084 - DNA, 15 bp, Homo sapiens
atctacacatatttg

SEQ ID NO: 94085 - DNA, 15 bp, Homo sapiens
tatctacacatattt

SEQ ID NO: 94086 - DNA, 15 bp, Homo sapiens
atatctacacatatt

SEQ ID NO: 94087 - DNA, 15 bp, Homo sapiens
tatatctacacatat

SEQ ID NO: 94088 - DNA, 15 bp, Homo sapiens
atatatctacacata

SEQ ID NO: 94089 - DNA, 15 bp, Homo sapiens
tatatatctacacat

SEQ ID NO: 94090 - DNA, 15 bp, Homo sapiens
atatatatctacaca

SEQ ID NO: 94091 - DNA, 15 bp, Homo sapiens
gatatatatctacac

SEQ ID NO: 94092 - DNA, 15 bp, Homo sapiens
agatatatatctaca

SEQ ID NO: 94093 - DNA, 15 bp, Homo sapiens
tagatatatatctac

SEQ ID NO: 94094 - DNA, 15 bp, Homo sapiens
atagatatatatcta

SEQ ID NO: 94095 - DNA, 15 bp, Homo sapiens
tatagatatatatct

SEQ ID NO: 94096 - DNA, 15 bp, Homo sapiens
atatagatatatatc

SEQ ID NO: 94097 - DNA, 15 bp, Homo sapiens
tatatagatatatat

SEQ ID NO: 94098 - DNA, 15 bp, Homo sapiens
atatatagatatata

SEQ ID NO: 94099 - DNA, 15 bp, Homo sapiens
tatatatagatatat

SEQ ID NO: 94100 - DNA, 15 bp, Homo sapiens
tatatatatagatat

SEQ ID NO: 94101 - DNA, 15 bp, Homo sapiens
cctatatatatagat

SEQ ID NO: 94102 - DNA, 15 bp, Homo sapiens
ccctatatatataga

SEQ ID NO: 94103 - DNA, 15 bp, Homo sapiens
tccctatatatatag

SEQ ID NO: 94104 - DNA, 15 bp, Homo sapiens
ctccctatatatata

SEQ ID NO: 94105 - DNA, 15 bp, Homo sapiens
tctccctatatatat

SEQ ID NO: 94106 - DNA, 15 bp, Homo sapiens
atctccctatatata

SEQ ID NO: 94107 - DNA, 15 bp, Homo sapiens
catctccctatatat

SEQ ID NO: 94108 - DNA, 15 bp, Homo sapiens
acatctccctatata

SEQ ID NO: 94109 - DNA, 15 bp, Homo sapiens
gacatctccctatat

SEQ ID NO: 94110 - DNA, 15 bp, Homo sapiens
agacatctccctata

SEQ ID NO: 94111 - DNA, 15 bp, Homo sapiens
gagacatctccctat

SEQ ID NO: 94112 - DNA, 15 bp, Homo sapiens
agagacatctcccta

SEQ ID NO: 94113 - DNA, 15 bp, Homo sapiens
cagagacatctccct

SEQ ID NO: 94114 - DNA, 15 bp, Homo sapiens
acagagacatctccc

SEQ ID NO: 94115 - DNA, 15 bp, Homo sapiens
tacagagacatctcc

SEQ ID NO: 94116 - DNA, 15 bp, Homo sapiens
atacagagacatctc

SEQ ID NO: 94117 - DNA, 15 bp, Homo sapiens
tatacagagacatct

SEQ ID NO: 94118 - DNA, 15 bp, Homo sapiens
atatacagagacatc

SEQ ID NO: 94119 - DNA, 15 bp, Homo sapiens
tatatacagagacat

SEQ ID NO: 94120 - DNA, 15 bp, Homo sapiens
atatatacagagaca

SEQ ID NO: 94121 - DNA, 15 bp, Homo sapiens
catatatacagagac

SEQ ID NO: 94122 - DNA, 15 bp, Homo sapiens
gcatatatacagaga

SEQ ID NO: 94123 - DNA, 15 bp, Homo sapiens
tgcatatatacagag

SEQ ID NO: 94124 - DNA, 15 bp, Homo sapiens
atgcatatatacaga

SEQ ID NO: 94125 - DNA, 15 bp, Homo sapiens
tatgcatatatacag

SEQ ID NO: 94126 - DNA, 15 bp, Homo sapiens
atatgcatatataca

SEQ ID NO: 94127 - DNA, 15 bp, Homo sapiens
tatatgcatatatac

SEQ ID NO: 94128 - DNA, 15 bp, Homo sapiens
gtatatgcatatata

SEQ ID NO: 94129 - DNA, 15 bp, Homo sapiens
tgtatatgcatatat

SEQ ID NO: 94130 - DNA, 15 bp, Homo sapiens
atgtatatgcatata

SEQ ID NO: 94131 - DNA, 15 bp, Homo sapiens
gatgtatatgcatat

SEQ ID NO: 94132 - DNA, 15 bp, Homo sapiens
agatgtatatgcata

SEQ ID NO: 94133 - DNA, 15 bp, Homo sapiens
aagatgtatatgcat

SEQ ID NO: 94134 - DNA, 15 bp, Homo sapiens
aaagatgtatatgca

SEQ ID NO: 94135 - DNA, 15 bp, Homo sapiens
taaagatgtatatgc

SEQ ID NO: 94136 - DNA, 15 bp, Homo sapiens
ataaagatgtatatg

SEQ ID NO: 94137 - DNA, 15 bp, Homo sapiens
aataaagatgtatat

SEQ ID NO: 94138 - DNA, 15 bp, Homo sapiens
aaataaagatgtata

SEQ ID NO: 94139 - DNA, 15 bp, Homo sapiens
taaataaagatgtat

SEQ ID NO: 94140 - DNA, 15 bp, Homo sapiens
ataaataaagatgta

SEQ ID NO: 94141 - DNA, 15 bp, Homo sapiens
tataaataaagatgt

SEQ ID NO: 94142 - DNA, 15 bp, Homo sapiens
atataaataaagatg

SEQ ID NO: 94143 - DNA, 15 bp, Homo sapiens
tatataaataaagat

SEQ ID NO: 94144 - DNA, 15 bp, Homo sapiens
ctatataaataaaga

SEQ ID NO: 94145 - DNA, 15 bp, Homo sapiens
tctatataaataaag

SEQ ID NO: 94146 - DNA, 15 bp, Homo sapiens
ctctatataaataaa

SEQ ID NO: 94147 - DNA, 15 bp, Homo sapiens
tctctatataaataa

SEQ ID NO: 94148 - DNA, 15 bp, Homo sapiens
ctctctatataaata

SEQ ID NO: 94149 - DNA, 15 bp, Homo sapiens
tctctctatataaat

SEQ ID NO: 94150 - DNA, 15 bp, Homo sapiens
ttctctctatataaa

SEQ ID NO: 94151 - DNA, 15 bp, Homo sapiens
attctctctatataa

SEQ ID NO: 94152 - DNA, 15 bp, Homo sapiens
gattctctctatata

SEQ ID NO: 94153 - DNA, 15 bp, Homo sapiens
agattctctctatat

SEQ ID NO: 94154 - DNA, 15 bp, Homo sapiens
tagattctctctata

SEQ ID NO: 94155 - DNA, 15 bp, Homo sapiens
ttagattctctctat

SEQ ID NO: 94156 - DNA, 15 bp, Homo sapiens
tttagattctctcta

SEQ ID NO: 94157 - DNA, 15 bp, Homo sapiens
atttagattctctct

SEQ ID NO: 94158 - DNA, 15 bp, Homo sapiens
gatttagattctctc

SEQ ID NO: 94159 - DNA, 15 bp, Homo sapiens
ggatttagattctct

SEQ ID NO: 94160 - DNA, 15 bp, Homo sapiens
cggatttagattctc

SEQ ID NO: 94161 - DNA, 15 bp, Homo sapiens
tcggatttagattct

SEQ ID NO: 94162 - DNA, 15 bp, Homo sapiens
ttcggatttagattc

SEQ ID NO: 94163 - DNA, 15 bp, Homo sapiens
attcggatttagatt

SEQ ID NO: 94164 - DNA, 15 bp, Homo sapiens
gattcggatttagat

SEQ ID NO: 94165 - DNA, 15 bp, Homo sapiens
agattcggatttaga

SEQ ID NO: 94166 - DNA, 15 bp, Homo sapiens
tagattcggatttag

SEQ ID NO: 94167 - DNA, 15 bp, Homo sapiens
atagattcggattta

SEQ ID NO: 94168 - DNA, 15 bp, Homo sapiens
tatagattcggattt

SEQ ID NO: 94169 - DNA, 15 bp, Homo sapiens
atatagattcggatt

SEQ ID NO: 94170 - DNA, 15 bp, Homo sapiens
tatatagattcggat

SEQ ID NO: 94171 - DNA, 15 bp, Homo sapiens
atatatagattcgga

SEQ ID NO: 94172 - DNA, 15 bp, Homo sapiens
tatatatagattcgg

SEQ ID NO: 94173 - DNA, 15 bp, Homo sapiens
atatatatagattcg

SEQ ID NO: 94174 - DNA, 15 bp, Homo sapiens
aatatatatagattc

SEQ ID NO: 94175 - DNA, 15 bp, Homo sapiens
aaatatatatagatt

SEQ ID NO: 94176 - DNA, 15 bp, Homo sapiens
taaatatatatagat

SEQ ID NO: 94177 - DNA, 15 bp, Homo sapiens
ctaaatatatataga

SEQ ID NO: 94178 - DNA, 15 bp, Homo sapiens
tctaaatatatatag

SEQ ID NO: 94179 - DNA, 15 bp, Homo sapiens
atctaaatatatata

SEQ ID NO: 94180 - DNA, 15 bp, Homo sapiens
catctaaatatatat

SEQ ID NO: 94181 - DNA, 15 bp, Homo sapiens
acatctaaatatata

SEQ ID NO: 94182 - DNA, 15 bp, Homo sapiens
tacatctaaatatat

SEQ ID NO: 94183 - DNA, 15 bp, Homo sapiens
ctacatctaaatata

SEQ ID NO: 94184 - DNA, 15 bp, Homo sapiens
tctacatctaaatat

SEQ ID NO: 94185 - DNA, 15 bp, Homo sapiens
atctacatctaaata

SEQ ID NO: 94186 - DNA, 15 bp, Homo sapiens
gatctacatctaaat

SEQ ID NO: 94187 - DNA, 15 bp, Homo sapiens
ggatctacatctaaa

SEQ ID NO: 94188 - DNA, 15 bp, Homo sapiens
tggatctacatctaa

SEQ ID NO: 94189 - DNA, 15 bp, Homo sapiens
ttggatctacatcta

SEQ ID NO: 94190 - DNA, 15 bp, Homo sapiens
tttggatctacatct

SEQ ID NO: 94191 - DNA, 15 bp, Homo sapiens
atttggatctacatc

SEQ ID NO: 94192 - DNA, 15 bp, Homo sapiens
tatttggatctacat

SEQ ID NO: 94193 - DNA, 15 bp, Homo sapiens
atatttggatctaca

SEQ ID NO: 94194 - DNA, 15 bp, Homo sapiens
tatatttggatctac

SEQ ID NO: 94195 - DNA, 15 bp, Homo sapiens
atatatttggatcta

SEQ ID NO: 94196 - DNA, 15 bp, Homo sapiens
catatatttggatct

SEQ ID NO: 94197 - DNA, 15 bp, Homo sapiens
acatatatttggatc

SEQ ID NO: 94198 - DNA, 15 bp, Homo sapiens
tacatatatttggat

SEQ ID NO: 94199 - DNA, 15 bp, Homo sapiens
ctacatatatttgga

SEQ ID NO: 94200 - DNA, 15 bp, Homo sapiens
tctacatatatttgg

SEQ ID NO: 94201 - DNA, 15 bp, Homo sapiens
atctacatatatttg

SEQ ID NO: 94202 - DNA, 15 bp, Homo sapiens
tatctacatatattt

SEQ ID NO: 94203 - DNA, 15 bp, Homo sapiens
gtatctacatatatt

SEQ ID NO: 94204 - DNA, 15 bp, Homo sapiens
tgtatctacatatat

SEQ ID NO: 94205 - DNA, 15 bp, Homo sapiens
ttgtatctacatata

SEQ ID NO: 94206 - DNA, 15 bp, Homo sapiens
attgtatctacatat

SEQ ID NO: 94207 - DNA, 15 bp, Homo sapiens
tattgtatctacata

SEQ ID NO: 94208 - DNA, 15 bp, Homo sapiens
atattgtatctacat

SEQ ID NO: 94209 - DNA, 15 bp, Homo sapiens
tatattgtatctaca

SEQ ID NO: 94210 - DNA, 15 bp, Homo sapiens
atatattgtatctac

SEQ ID NO: 94211 - DNA, 15 bp, Homo sapiens
tatatattgtatcta

SEQ ID NO: 94212 - DNA, 15 bp, Homo sapiens
atatatattgtatct

SEQ ID NO: 94213 - DNA, 15 bp, Homo sapiens
tatatatattgtatc

SEQ ID NO: 94214 - DNA, 15 bp, Homo sapiens
atatatatattgtat

SEQ ID NO: 94215 - DNA, 15 bp, Homo sapiens
gatatatatattgta

SEQ ID NO: 94216 - DNA, 15 bp, Homo sapiens
agatatatatattgt

SEQ ID NO: 94217 - DNA, 15 bp, Homo sapiens
tagatatatatattg

SEQ ID NO: 94218 - DNA, 15 bp, Homo sapiens
gtagatatatatatt

SEQ ID NO: 94219 - DNA, 15 bp, Homo sapiens
tgtagatatatatat

SEQ ID NO: 94220 - DNA, 15 bp, Homo sapiens
atgtagatatatata

SEQ ID NO: 94221 - DNA, 15 bp, Homo sapiens
tatgtagatatatat

SEQ ID NO: 94222 - DNA, 15 bp, Homo sapiens
atatgtagatatata

SEQ ID NO: 94223 - DNA, 15 bp, Homo sapiens
tatatgtagatatat

SEQ ID NO: 94224 - DNA, 15 bp, Homo sapiens
atatatgtagatata

SEQ ID NO: 94225 - DNA, 15 bp, Homo sapiens
aatatatgtagatat

SEQ ID NO: 94226 - DNA, 15 bp, Homo sapiens
aaatatatgtagata

SEQ ID NO: 94227 - DNA, 15 bp, Homo sapiens
caaatatatgtagat

SEQ ID NO: 94228 - DNA, 15 bp, Homo sapiens
ccaaatatatgtaga

SEQ ID NO: 94229 - DNA, 15 bp, Homo sapiens
tccaaatatatgtag

SEQ ID NO: 94230 - DNA, 15 bp, Homo sapiens
atccaaatatatgta

SEQ ID NO: 94231 - DNA, 15 bp, Homo sapiens
gatccaaatatatgt

SEQ ID NO: 94232 - DNA, 15 bp, Homo sapiens
agatccaaatatatg

SEQ ID NO: 94233 - DNA, 15 bp, Homo sapiens
tagatccaaatatat

SEQ ID NO: 94234 - DNA, 15 bp, Homo sapiens
gtagatccaaatata

SEQ ID NO: 94235 - DNA, 15 bp, Homo sapiens
tgtagatccaaatat

SEQ ID NO: 94236 - DNA, 15 bp, Homo sapiens
atgtagatccaaata

SEQ ID NO: 94237 - DNA, 15 bp, Homo sapiens
gatgtagatccaaat

SEQ ID NO: 94238 - DNA, 15 bp, Homo sapiens
agatgtagatccaaa

SEQ ID NO: 94239 - DNA, 15 bp, Homo sapiens
tagatgtagatccaa

SEQ ID NO: 94240 - DNA, 15 bp, Homo sapiens
ttagatgtagatcca

SEQ ID NO: 94241 - DNA, 15 bp, Homo sapiens
tttagatgtagatcc

SEQ ID NO: 94242 - DNA, 15 bp, Homo sapiens
atttagatgtagatc

SEQ ID NO: 94243 - DNA, 15 bp, Homo sapiens
tatttagatgtagat

SEQ ID NO: 94244 - DNA, 15 bp, Homo sapiens
atatttagatgtaga

SEQ ID NO: 94245 - DNA, 15 bp, Homo sapiens
aatatttagatgtag

SEQ ID NO: 94246 - DNA, 15 bp, Homo sapiens
taatatttagatgta

SEQ ID NO: 94247 - DNA, 15 bp, Homo sapiens
ataatatttagatgt

SEQ ID NO: 94248 - DNA, 15 bp, Homo sapiens
tataatatttagatg

SEQ ID NO: 94249 - DNA, 15 bp, Homo sapiens
atataatatttagat

SEQ ID NO: 94250 - DNA, 15 bp, Homo sapiens
gatataatatttaga

SEQ ID NO: 94251 - DNA, 15 bp, Homo sapiens
agatataatatttag

SEQ ID NO: 94252 - DNA, 15 bp, Homo sapiens
tagatataatattta

SEQ ID NO: 94253 - DNA, 15 bp, Homo sapiens
gtagatataatattt

SEQ ID NO: 94254 - DNA, 15 bp, Homo sapiens
tgtagatataatatt

SEQ ID NO: 94255 - DNA, 15 bp, Homo sapiens
atgtagatataatat

SEQ ID NO: 94256 - DNA, 15 bp, Homo sapiens
tatgtagatataata

SEQ ID NO: 94257 - DNA, 15 bp, Homo sapiens
atatgtagatataat

SEQ ID NO: 94258 - DNA, 15 bp, Homo sapiens
tatatgtagatataa

SEQ ID NO: 94259 - DNA, 15 bp, Homo sapiens
ctagatccaaatata

SEQ ID NO: 94260 - DNA, 15 bp, Homo sapiens
tctagatccaaatat

SEQ ID NO: 94261 - DNA, 15 bp, Homo sapiens
atctagatccaaata

SEQ ID NO: 94262 - DNA, 15 bp, Homo sapiens
gatctagatccaaat

SEQ ID NO: 94263 - DNA, 15 bp, Homo sapiens
agatctagatccaaa

SEQ ID NO: 94264 - DNA, 15 bp, Homo sapiens
tagatctagatccaa

SEQ ID NO: 94265 - DNA, 15 bp, Homo sapiens
ttagatctagatcca

SEQ ID NO: 94266 - DNA, 15 bp, Homo sapiens
tttagatctagatcc

SEQ ID NO: 94267 - DNA, 15 bp, Homo sapiens
atttagatctagatc

SEQ ID NO: 94268 - DNA, 15 bp, Homo sapiens
tatttagatctagat

SEQ ID NO: 94269 - DNA, 15 bp, Homo sapiens
atatttagatctaga

SEQ ID NO: 94270 - DNA, 15 bp, Homo sapiens
tatatttagatctag

SEQ ID NO: 94271 - DNA, 15 bp, Homo sapiens
atatatttagatcta

SEQ ID NO: 94272 - DNA, 15 bp, Homo sapiens
tatatatttagatct

SEQ ID NO: 94273 - DNA, 15 bp, Homo sapiens
atatatatttagatc

SEQ ID NO: 94274 - DNA, 15 bp, Homo sapiens
tatatatatttagat

SEQ ID NO: 94275 - DNA, 15 bp, Homo sapiens
ctatatatatttaga

SEQ ID NO: 94276 - DNA, 15 bp, Homo sapiens
tctatatatatttag

SEQ ID NO: 94277 - DNA, 15 bp, Homo sapiens
atctatatatattta

SEQ ID NO: 94278 - DNA, 15 bp, Homo sapiens
aatctatatatattt

SEQ ID NO: 94279 - DNA, 15 bp, Homo sapiens
aaatctatatatatt

SEQ ID NO: 94280 - DNA, 15 bp, Homo sapiens
caaatctatatatat

SEQ ID NO: 94281 - DNA, 15 bp, Homo sapiens
ccaaatctatatata

SEQ ID NO: 94282 - DNA, 15 bp, Homo sapiens
tccaaatctatatat

SEQ ID NO: 94283 - DNA, 15 bp, Homo sapiens
atccaaatctatata

SEQ ID NO: 94284 - DNA, 15 bp, Homo sapiens
aatccaaatctatat

SEQ ID NO: 94285 - DNA, 15 bp, Homo sapiens
aaatccaaatctata

SEQ ID NO: 94286 - DNA, 15 bp, Homo sapiens
taaatccaaatctat

SEQ ID NO: 94287 - DNA, 15 bp, Homo sapiens
ctaaatccaaatcta

SEQ ID NO: 94288 - DNA, 15 bp, Homo sapiens
tctaaatccaaatct

SEQ ID NO: 94289 - DNA, 15 bp, Homo sapiens
atctaaatccaaatc

SEQ ID NO: 94290 - DNA, 15 bp, Homo sapiens
catctaaatccaaat

SEQ ID NO: 94291 - DNA, 15 bp, Homo sapiens
gcatctaaatccaaa

SEQ ID NO: 94292 - DNA, 15 bp, Homo sapiens
agcatctaaatccaa

SEQ ID NO: 94293 - DNA, 15 bp, Homo sapiens
tagcatctaaatcca

SEQ ID NO: 94294 - DNA, 15 bp, Homo sapiens
ttagcatctaaatcc

SEQ ID NO: 94295 - DNA, 15 bp, Homo sapiens
cttagcatctaaatc

SEQ ID NO: 94296 - DNA, 15 bp, Homo sapiens
gcttagcatctaaat

SEQ ID NO: 94297 - DNA, 15 bp, Homo sapiens
tgcttagcatctaaa

SEQ ID NO: 94298 - DNA, 15 bp, Homo sapiens
ttgcttagcatctaa

SEQ ID NO: 94299 - DNA, 15 bp, Homo sapiens
tttgcttagcatcta

SEQ ID NO: 94300 - DNA, 15 bp, Homo sapiens
atttgcttagcatct

SEQ ID NO: 94301 - DNA, 15 bp, Homo sapiens
aatttgcttagcatc

SEQ ID NO: 94302 - DNA, 15 bp, Homo sapiens
aaatttgcttagcat

SEQ ID NO: 94303 - DNA, 15 bp, Homo sapiens
caaatttgcttagca

SEQ ID NO: 94304 - DNA, 15 bp, Homo sapiens
gcaaatttgcttagc

SEQ ID NO: 94305 - DNA, 15 bp, Homo sapiens
tgcaaatttgcttag

SEQ ID NO: 94306 - DNA, 15 bp, Homo sapiens
atgcaaatttgctta

SEQ ID NO: 94307 - DNA, 15 bp, Homo sapiens
tatgcaaatttgctt

SEQ ID NO: 94308 - DNA, 15 bp, Homo sapiens
ttatgcaaatttgct

SEQ ID NO: 94309 - DNA, 15 bp, Homo sapiens
cttatgcaaatttgc

SEQ ID NO: 94310 - DNA, 15 bp, Homo sapiens
ccttatgcaaatttg

SEQ ID NO: 94311 - DNA, 15 bp, Homo sapiens
tccttatgcaaattt

SEQ ID NO: 94312 - DNA, 15 bp, Homo sapiens
ttccttatgcaaatt

SEQ ID NO: 94313 - DNA, 15 bp, Homo sapiens
attccttatgcaaat

SEQ ID NO: 94314 - DNA, 15 bp, Homo sapiens
tattccttatgcaaa

SEQ ID NO: 94315 - DNA, 15 bp, Homo sapiens
atattccttatgcaa

SEQ ID NO: 94316 - DNA, 15 bp, Homo sapiens
aatattccttatgca

SEQ ID NO: 94317 - DNA, 15 bp, Homo sapiens
caatattccttatgc

SEQ ID NO: 94318 - DNA, 15 bp, Homo sapiens
gcaatattccttatg

SEQ ID NO: 94319 - DNA, 15 bp, Homo sapiens
ggcaatattccttat

SEQ ID NO: 94320 - DNA, 15 bp, Homo sapiens
gggcaatattcctta

SEQ ID NO: 94321 - DNA, 15 bp, Homo sapiens
ggggcaatattcctt

SEQ ID NO: 94322 - DNA, 15 bp, Homo sapiens
gggggcaatattcct

SEQ ID NO: 94323 - DNA, 15 bp, Homo sapiens
tgggggcaatattcc

SEQ ID NO: 94324 - DNA, 15 bp, Homo sapiens
ttgggggcaatattc

SEQ ID NO: 94325 - DNA, 15 bp, Homo sapiens
tttgggggcaatatt

SEQ ID NO: 94326 - DNA, 15 bp, Homo sapiens
ttttgggggcaatat

SEQ ID NO: 94327 - DNA, 15 bp, Homo sapiens
tttttgggggcaata

SEQ ID NO: 94328 - DNA, 15 bp, Homo sapiens
ctttttgggggcaat

SEQ ID NO: 94329 - DNA, 15 bp, Homo sapiens
actttttgggggcaa

SEQ ID NO: 94330 - DNA, 15 bp, Homo sapiens
cactttttgggggca

SEQ ID NO: 94331 - DNA, 15 bp, Homo sapiens
tcactttttgggggc

SEQ ID NO: 94332 - DNA, 15 bp, Homo sapiens
ttcactttttggggg

SEQ ID NO: 94333 - DNA, 15 bp, Homo sapiens
tttcactttttgggg

SEQ ID NO: 94334 - DNA, 15 bp, Homo sapiens
ttttcactttttggg

SEQ ID NO: 94335 - DNA, 15 bp, Homo sapiens
cttttcactttttgg

SEQ ID NO: 94336 - DNA, 15 bp, Homo sapiens
tcttttcactttttg

SEQ ID NO: 94337 - DNA, 15 bp, Homo sapiens
atcttttcacttttt

SEQ ID NO: 94338 - DNA, 15 bp, Homo sapiens
aatcttttcactttt

SEQ ID NO: 94339 - DNA, 15 bp, Homo sapiens
caatcttttcacttt

SEQ ID NO: 94340 - DNA, 15 bp, Homo sapiens
tcaatcttttcactt

SEQ ID NO: 94341 - DNA, 15 bp, Homo sapiens
ttcaatcttttcact

SEQ ID NO: 94342 - DNA, 15 bp, Homo sapiens
tttcaatcttttcac

SEQ ID NO: 94343 - DNA, 15 bp, Homo sapiens
ctttcaatcttttca

SEQ ID NO: 94344 - DNA, 15 bp, Homo sapiens
gctttcaatcttttc

SEQ ID NO: 94345 - DNA, 15 bp, Homo sapiens
cgctttcaatctttt

SEQ ID NO: 94346 - DNA, 15 bp, Homo sapiens
tcgctttcaatcttt

SEQ ID NO: 94347 - DNA, 15 bp, Homo sapiens
ttcgctttcaatctt

SEQ ID NO: 94348 - DNA, 15 bp, Homo sapiens
cttcgctttcaatct

SEQ ID NO: 94349 - DNA, 15 bp, Homo sapiens
tcttcgctttcaatc

SEQ ID NO: 94350 - DNA, 15 bp, Homo sapiens
gtcttcgctttcaat

SEQ ID NO: 94351 - DNA, 15 bp, Homo sapiens
tgtcttcgctttcaa

SEQ ID NO: 94352 - DNA, 15 bp, Homo sapiens
ttgtcttcgctttca

SEQ ID NO: 94353 - DNA, 15 bp, Homo sapiens
tttgtcttcgctttc

SEQ ID NO: 94354 - DNA, 15 bp, Homo sapiens
ttttgtcttcgcttt

SEQ ID NO: 94355 - DNA, 15 bp, Homo sapiens
tttttgtcttcgctt

SEQ ID NO: 94356 - DNA, 15 bp, Homo sapiens
atttttgtcttcgct

SEQ ID NO: 94357 - DNA, 15 bp, Homo sapiens
aatttttgtcttcgc

SEQ ID NO: 94358 - DNA, 15 bp, Homo sapiens
taatttttgtcttcg

SEQ ID NO: 94359 - DNA, 15 bp, Homo sapiens
ttaatttttgtcttc

SEQ ID NO: 94360 - DNA, 15 bp, Homo sapiens
attaatttttgtctt

SEQ ID NO: 94361 - DNA, 15 bp, Homo sapiens
cattaatttttgtct

SEQ ID NO: 94362 - DNA, 15 bp, Homo sapiens
tcattaatttttgtc

SEQ ID NO: 94363 - DNA, 15 bp, Homo sapiens
ttcattaatttttgt

SEQ ID NO: 94364 - DNA, 15 bp, Homo sapiens
tttcattaatttttg

SEQ ID NO: 94365 - DNA, 15 bp, Homo sapiens
ttttcattaattttt

SEQ ID NO: 94366 - DNA, 15 bp, Homo sapiens
attttcattaatttt

SEQ ID NO: 94367 - DNA, 15 bp, Homo sapiens
cattttcattaattt

SEQ ID NO: 94368 - DNA, 15 bp, Homo sapiens
acattttcattaatt

SEQ ID NO: 94369 - DNA, 15 bp, Homo sapiens
tacattttcattaat

SEQ ID NO: 94370 - DNA, 15 bp, Homo sapiens
atacattttcattaa

SEQ ID NO: 94371 - DNA, 15 bp, Homo sapiens
catacattttcatta

SEQ ID NO: 94372 - DNA, 15 bp, Homo sapiens
acatacattttcatt

SEQ ID NO: 94373 - DNA, 15 bp, Homo sapiens
aacatacattttcat

SEQ ID NO: 94374 - DNA, 15 bp, Homo sapiens
aaacatacattttca

SEQ ID NO: 94375 - DNA, 15 bp, Homo sapiens
aaaacatacattttc

SEQ ID NO: 94376 - DNA, 15 bp, Homo sapiens
caaaacatacatttt

SEQ ID NO: 94377 - DNA, 15 bp, Homo sapiens
tcaaaacatacattt

SEQ ID NO: 94378 - DNA, 15 bp, Homo sapiens
ttcaaaacatacatt

SEQ ID NO: 94379 - DNA, 15 bp, Homo sapiens
tttcaaaacatacat

SEQ ID NO: 94380 - DNA, 15 bp, Homo sapiens
ttttcaaaacataca

SEQ ID NO: 94381 - DNA, 15 bp, Homo sapiens
attttcaaaacatac

SEQ ID NO: 94382 - DNA, 15 bp, Homo sapiens
gattttcaaaacata

SEQ ID NO: 94383 - DNA, 15 bp, Homo sapiens
tgattttcaaaacat

SEQ ID NO: 94384 - DNA, 15 bp, Homo sapiens
ttgattttcaaaaca

SEQ ID NO: 94385 - DNA, 15 bp, Homo sapiens
tttgattttcaaaac

SEQ ID NO: 94386 - DNA, 15 bp, Homo sapiens
ctttgattttcaaaa

SEQ ID NO: 94387 - DNA, 15 bp, Homo sapiens
actttgattttcaaa

SEQ ID NO: 94388 - DNA, 15 bp, Homo sapiens
gactttgattttcaa

SEQ ID NO: 94389 - DNA, 15 bp, Homo sapiens
tgactttgattttca

SEQ ID NO: 94390 - DNA, 15 bp, Homo sapiens
ctgactttgattttc

SEQ ID NO: 94391 - DNA, 15 bp, Homo sapiens
tctgactttgatttt

SEQ ID NO: 94392 - DNA, 15 bp, Homo sapiens
ctctgactttgattt

SEQ ID NO: 94393 - DNA, 15 bp, Homo sapiens
tctctgactttgatt

SEQ ID NO: 94394 - DNA, 15 bp, Homo sapiens
ttctctgactttgat

SEQ ID NO: 94395 - DNA, 15 bp, Homo sapiens
gttctctgactttga

SEQ ID NO: 94396 - DNA, 15 bp, Homo sapiens
tgttctctgactttg

SEQ ID NO: 94397 - DNA, 15 bp, Homo sapiens
gtgttctctgacttt

SEQ ID NO: 94398 - DNA, 15 bp, Homo sapiens
cgtgttctctgactt

SEQ ID NO: 94399 - DNA, 15 bp, Homo sapiens
acgtgttctctgact

SEQ ID NO: 94400 - DNA, 15 bp, Homo sapiens
cacgtgttctctgac

SEQ ID NO: 94401 - DNA, 15 bp, Homo sapiens
ccacgtgttctctga

SEQ ID NO: 94402 - DNA, 15 bp, Homo sapiens
accacgtgttctctg

SEQ ID NO: 94403 - DNA, 15 bp, Homo sapiens
taccacgtgttctct

SEQ ID NO: 94404 - DNA, 15 bp, Homo sapiens
ctaccacgtgttctc

SEQ ID NO: 94405 - DNA, 15 bp, Homo sapiens
tctaccacgtgttct

SEQ ID NO: 94406 - DNA, 15 bp, Homo sapiens
ttctaccacgtgttc

SEQ ID NO: 94407 - DNA, 15 bp, Homo sapiens
cttctaccacgtgtt

SEQ ID NO: 94408 - DNA, 15 bp, Homo sapiens
tcttctaccacgtgt

SEQ ID NO: 94409 - DNA, 15 bp, Homo sapiens
ctcttctaccacgtg

SEQ ID NO: 94410 - DNA, 15 bp, Homo sapiens
cctcttctaccacgt

SEQ ID NO: 94411 - DNA, 15 bp, Homo sapiens
tcctcttctaccacg

SEQ ID NO: 94412 - DNA, 15 bp, Homo sapiens
ctcctcttctaccac

SEQ ID NO: 94413 - DNA, 15 bp, Homo sapiens
gctcctcttctacca

SEQ ID NO: 94414 - DNA, 15 bp, Homo sapiens
agctcctcttctacc

SEQ ID NO: 94415 - DNA, 15 bp, Homo sapiens
cagctcctcttctac

SEQ ID NO: 94416 - DNA, 15 bp, Homo sapiens
ccagctcctcttcta

SEQ ID NO: 94417 - DNA, 15 bp, Homo sapiens
tccagctcctcttct

SEQ ID NO: 94418 - DNA, 15 bp, Homo sapiens
ttccagctcctcttc

SEQ ID NO: 94419 - DNA, 15 bp, Homo sapiens
cttccagctcctctt

SEQ ID NO: 94420 - DNA, 15 bp, Homo sapiens
tcttccagctcctct

SEQ ID NO: 94421 - DNA, 15 bp, Homo sapiens
gtcttccagctcctc

SEQ ID NO: 94422 - DNA, 15 bp, Homo sapiens
ggtcttccagctcct

SEQ ID NO: 94423 - DNA, 15 bp, Homo sapiens
aggtcttccagctcc

SEQ ID NO: 94424 - DNA, 15 bp, Homo sapiens
gaggtcttccagctc

SEQ ID NO: 94425 - DNA, 15 bp, Homo sapiens
tgaggtcttccagct

SEQ ID NO: 94426 - DNA, 15 bp, Homo sapiens
gtgaggtcttccagc

SEQ ID NO: 94427 - DNA, 15 bp, Homo sapiens
tgtgaggtcttccag

SEQ ID NO: 94428 - DNA, 15 bp, Homo sapiens
ctgtgaggtcttcca

SEQ ID NO: 94429 - DNA, 15 bp, Homo sapiens
tctgtgaggtcttcc

SEQ ID NO: 94430 - DNA, 15 bp, Homo sapiens
atctgtgaggtcttc

SEQ ID NO: 94431 - DNA, 15 bp, Homo sapiens
aatctgtgaggtctt

SEQ ID NO: 94432 - DNA, 15 bp, Homo sapiens
taatctgtgaggtct

SEQ ID NO: 94433 - DNA, 15 bp, Homo sapiens
ctaatctgtgaggtc

SEQ ID NO: 94434 - DNA, 15 bp, Homo sapiens
actaatctgtgaggt

SEQ ID NO: 94435 - DNA, 15 bp, Homo sapiens
cactaatctgtgagg

SEQ ID NO: 94436 - DNA, 15 bp, Homo sapiens
acactaatctgtgag

SEQ ID NO: 94437 - DNA, 15 bp, Homo sapiens
cacactaatctgtga

SEQ ID NO: 94438 - DNA, 15 bp, Homo sapiens
ccacactaatctgtg

SEQ ID NO: 94439 - DNA, 15 bp, Homo sapiens
tccacactaatctgt

SEQ ID NO: 94440 - DNA, 15 bp, Homo sapiens
ttccacactaatctg

SEQ ID NO: 94441 - DNA, 15 bp, Homo sapiens
cttccacactaatct

SEQ ID NO: 94442 - DNA, 15 bp, Homo sapiens
ccttccacactaatc

SEQ ID NO: 94443 - DNA, 15 bp, Homo sapiens
cccttccacactaat

SEQ ID NO: 94444 - DNA, 15 bp, Homo sapiens
tcccttccacactaa

SEQ ID NO: 94445 - DNA, 15 bp, Homo sapiens
atcccttccacacta

SEQ ID NO: 94446 - DNA, 15 bp, Homo sapiens
gatcccttccacact

SEQ ID NO: 94447 - DNA, 15 bp, Homo sapiens
ggatcccttccacac

SEQ ID NO: 94448 - DNA, 15 bp, Homo sapiens
tggatcccttccaca

SEQ ID NO: 94449 - DNA, 15 bp, Homo sapiens
ctggatcccttccac

SEQ ID NO: 94450 - DNA, 15 bp, Homo sapiens
gctggatcccttcca

SEQ ID NO: 94451 - DNA, 15 bp, Homo sapiens
ggctggatcccttcc

SEQ ID NO: 94452 - DNA, 15 bp, Homo sapiens
tggctggatcccttc

SEQ ID NO: 94453 - DNA, 15 bp, Homo sapiens
ctggctggatccctt

SEQ ID NO: 94454 - DNA, 15 bp, Homo sapiens
tctggctggatccct

SEQ ID NO: 94455 - DNA, 15 bp, Homo sapiens
atctggctggatccc

SEQ ID NO: 94456 - DNA, 15 bp, Homo sapiens
aatctggctggatcc

SEQ ID NO: 94457 - DNA, 15 bp, Homo sapiens
gaatctggctggatc

SEQ ID NO: 94458 - DNA, 15 bp, Homo sapiens
agaatctggctggat

SEQ ID NO: 94459 - DNA, 15 bp, Homo sapiens
gagaatctggctgga

SEQ ID NO: 94460 - DNA, 15 bp, Homo sapiens
agagaatctggctgg

SEQ ID NO: 94461 - DNA, 15 bp, Homo sapiens
cagagaatctggctg

SEQ ID NO: 94462 - DNA, 15 bp, Homo sapiens
tcagagaatctggct

SEQ ID NO: 94463 - DNA, 15 bp, Homo sapiens
ctcagagaatctggc

SEQ ID NO: 94464 - DNA, 15 bp, Homo sapiens
actcagagaatctgg

SEQ ID NO: 94465 - DNA, 15 bp, Homo sapiens
cactcagagaatctg

SEQ ID NO: 94466 - DNA, 15 bp, Homo sapiens
ccactcagagaatct

SEQ ID NO: 94467 - DNA, 15 bp, Homo sapiens
tccactcagagaatc

SEQ ID NO: 94468 - DNA, 15 bp, Homo sapiens
gtccactcagagaat

SEQ ID NO: 94469 - DNA, 15 bp, Homo sapiens
ggtccactcagagaa

SEQ ID NO: 94470 - DNA, 15 bp, Homo sapiens
tggtccactcagaga

SEQ ID NO: 94471 - DNA, 15 bp, Homo sapiens
gtggtccactcagag

SEQ ID NO: 94472 - DNA, 15 bp, Homo sapiens
agtggtccactcaga

SEQ ID NO: 94473 - DNA, 15 bp, Homo sapiens
cagtggtccactcag

SEQ ID NO: 94474 - DNA, 15 bp, Homo sapiens
tcagtggtccactca

SEQ ID NO: 94475 - DNA, 15 bp, Homo sapiens
ttcagtggtccactc

SEQ ID NO: 94476 - DNA, 15 bp, Homo sapiens
attcagtggtccact

SEQ ID NO: 94477 - DNA, 15 bp, Homo sapiens
aattcagtggtccac

SEQ ID NO: 94478 - DNA, 15 bp, Homo sapiens
aaattcagtggtcca

SEQ ID NO: 94479 - DNA, 15 bp, Homo sapiens
caaattcagtggtcc

SEQ ID NO: 94480 - DNA, 15 bp, Homo sapiens
ccaaattcagtggtc

SEQ ID NO: 94481 - DNA, 15 bp, Homo sapiens
tccaaattcagtggt

SEQ ID NO: 94482 - DNA, 15 bp, Homo sapiens
ctccaaattcagtgg

SEQ ID NO: 94483 - DNA, 15 bp, Homo sapiens
cctccaaattcagtg

SEQ ID NO: 94484 - DNA, 15 bp, Homo sapiens
ccctccaaattcagt

SEQ ID NO: 94485 - DNA, 15 bp, Homo sapiens
cccctccaaattcag

SEQ ID NO: 94486 - DNA, 15 bp, Homo sapiens
gcccctccaaattca

SEQ ID NO: 94487 - DNA, 15 bp, Homo sapiens
cgcccctccaaattc

SEQ ID NO: 94488 - DNA, 15 bp, Homo sapiens
acgcccctccaaatt

SEQ ID NO: 94489 - DNA, 15 bp, Homo sapiens
aacgcccctccaaat

SEQ ID NO: 94490 - DNA, 15 bp, Homo sapiens
gaacgcccctccaaa

SEQ ID NO: 94491 - DNA, 15 bp, Homo sapiens
agaacgcccctccaa

SEQ ID NO: 94492 - DNA, 15 bp, Homo sapiens
aagaacgcccctcca

SEQ ID NO: 94493 - DNA, 15 bp, Homo sapiens
aaagaacgcccctcc

SEQ ID NO: 94494 - DNA, 15 bp, Homo sapiens
caaagaacgcccctc

SEQ ID NO: 94495 - DNA, 15 bp, Homo sapiens
tcaaagaacgcccct

SEQ ID NO: 94496 - DNA, 15 bp, Homo sapiens
gtcaaagaacgcccc

SEQ ID NO: 94497 - DNA, 15 bp, Homo sapiens
agtcaaagaacgccc

SEQ ID NO: 94498 - DNA, 15 bp, Homo sapiens
gagtcaaagaacgcc

SEQ ID NO: 94499 - DNA, 15 bp, Homo sapiens
tgagtcaaagaacgc

SEQ ID NO: 94500 - DNA, 15 bp, Homo sapiens
ctgagtcaaagaacg

SEQ ID NO: 94501 - DNA, 15 bp, Homo sapiens
cctgagtcaaagaac

SEQ ID NO: 94502 - DNA, 15 bp, Homo sapiens
tcctgagtcaaagaa

SEQ ID NO: 94503 - DNA, 15 bp, Homo sapiens
ttcctgagtcaaaga

SEQ ID NO: 94504 - DNA, 15 bp, Homo sapiens
gttcctgagtcaaag

SEQ ID NO: 94505 - DNA, 15 bp, Homo sapiens
agttcctgagtcaaa

SEQ ID NO: 94506 - DNA, 15 bp, Homo sapiens
tagttcctgagtcaa

SEQ ID NO: 94507 - DNA, 15 bp, Homo sapiens
ttagttcctgagtca

SEQ ID NO: 94508 - DNA, 15 bp, Homo sapiens
attagttcctgagtc

SEQ ID NO: 94509 - DNA, 15 bp, Homo sapiens
cattagttcctgagt

SEQ ID NO: 94510 - DNA, 15 bp, Homo sapiens
ccattagttcctgag

SEQ ID NO: 94511 - DNA, 15 bp, Homo sapiens
cccattagttcctga

SEQ ID NO: 94512 - DNA, 15 bp, Homo sapiens
acccattagttcctg

SEQ ID NO: 94513 - DNA, 15 bp, Homo sapiens
tacccattagttcct

SEQ ID NO: 94514 - DNA, 15 bp, Homo sapiens
ctacccattagttcc

SEQ ID NO: 94515 - DNA, 15 bp, Homo sapiens
actacccattagttc

SEQ ID NO: 94516 - DNA, 15 bp, Homo sapiens
aactacccattagtt

SEQ ID NO: 94517 - DNA, 15 bp, Homo sapiens
gaactacccattagt

SEQ ID NO: 94518 - DNA, 15 bp, Homo sapiens
ggaactacccattag

SEQ ID NO: 94519 - DNA, 15 bp, Homo sapiens
tggaactacccatta

SEQ ID NO: 94520 - DNA, 15 bp, Homo sapiens
ttggaactacccatt

SEQ ID NO: 94521 - DNA, 15 bp, Homo sapiens
attggaactacccat

SEQ ID NO: 94522 - DNA, 15 bp, Homo sapiens
cattggaactaccca

SEQ ID NO: 94523 - DNA, 15 bp, Homo sapiens
tcattggaactaccc

SEQ ID NO: 94524 - DNA, 15 bp, Homo sapiens
ttcattggaactacc

SEQ ID NO: 94525 - DNA, 15 bp, Homo sapiens
attcattggaactac

SEQ ID NO: 94526 - DNA, 15 bp, Homo sapiens
cattcattggaacta

SEQ ID NO: 94527 - DNA, 15 bp, Homo sapiens
tcattcattggaact

SEQ ID NO: 94528 - DNA, 15 bp, Homo sapiens
atcattcattggaac

SEQ ID NO: 94529 - DNA, 15 bp, Homo sapiens
gatcattcattggaa

SEQ ID NO: 94530 - DNA, 15 bp, Homo sapiens
tgatcattcattgga

SEQ ID NO: 94531 - DNA, 15 bp, Homo sapiens
ctgatcattcattgg

SEQ ID NO: 94532 - DNA, 15 bp, Homo sapiens
gctgatcattcattg

SEQ ID NO: 94533 - DNA, 15 bp, Homo sapiens
tgctgatcattcatt

SEQ ID NO: 94534 - DNA, 15 bp, Homo sapiens
ctgctgatcattcat

SEQ ID NO: 94535 - DNA, 15 bp, Homo sapiens
tctgctgatcattca

SEQ ID NO: 94536 - DNA, 15 bp, Homo sapiens
ttctgctgatcattc

SEQ ID NO: 94537 - DNA, 15 bp, Homo sapiens
cttctgctgatcatt

SEQ ID NO: 94538 - DNA, 15 bp, Homo sapiens
tcttctgctgatcat

SEQ ID NO: 94539 - DNA, 15 bp, Homo sapiens
atcttctgctgatca

SEQ ID NO: 94540 - DNA, 15 bp, Homo sapiens
tatcttctgctgatc

SEQ ID NO: 94541 - DNA, 15 bp, Homo sapiens
gtatcttctgctgat

SEQ ID NO: 94542 - DNA, 15 bp, Homo sapiens
tgtatcttctgctga

SEQ ID NO: 94543 - DNA, 15 bp, Homo sapiens
ctgtatcttctgctg

SEQ ID NO: 94544 - DNA, 15 bp, Homo sapiens
tctgtatcttctgct

SEQ ID NO: 94545 - DNA, 15 bp, Homo sapiens
atctgtatcttctgc

SEQ ID NO: 94546 - DNA, 15 bp, Homo sapiens
catctgtatcttctg

SEQ ID NO: 94547 - DNA, 15 bp, Homo sapiens
ccatctgtatcttct

SEQ ID NO: 94548 - DNA, 15 bp, Homo sapiens
tccatctgtatcttc

SEQ ID NO: 94549 - DNA, 15 bp, Homo sapiens
ctccatctgtatctt

SEQ ID NO: 94550 - DNA, 15 bp, Homo sapiens
cctccatctgtatct

SEQ ID NO: 94551 - DNA, 15 bp, Homo sapiens
ccctccatctgtatc

SEQ ID NO: 94552 - DNA, 15 bp, Homo sapiens
cccctccatctgtat

SEQ ID NO: 94553 - DNA, 15 bp, Homo sapiens
acccctccatctgta

SEQ ID NO: 94554 - DNA, 15 bp, Homo sapiens
aacccctccatctgt

SEQ ID NO: 94555 - DNA, 15 bp, Homo sapiens
caacccctccatctg

SEQ ID NO: 94556 - DNA, 15 bp, Homo sapiens
acaacccctccatct

SEQ ID NO: 94557 - DNA, 15 bp, Homo sapiens
cacaacccctccatc

SEQ ID NO: 94558 - DNA, 15 bp, Homo sapiens
acacaacccctccat

SEQ ID NO: 94559 - DNA, 15 bp, Homo sapiens
cacacaacccctcca

SEQ ID NO: 94560 - DNA, 15 bp, Homo sapiens
acacacaacccctcc

SEQ ID NO: 94561 - DNA, 15 bp, Homo sapiens
cacacacaacccctc

SEQ ID NO: 94562 - DNA, 15 bp, Homo sapiens
acacacacaacccct

SEQ ID NO: 94563 - DNA, 15 bp, Homo sapiens
cacacacacaacccc

SEQ ID NO: 94564 - DNA, 15 bp, Homo sapiens
acacacacacaaccc

SEQ ID NO: 94565 - DNA, 15 bp, Homo sapiens
cacacacacacaacc

SEQ ID NO: 94566 - DNA, 15 bp, Homo sapiens
acacacacacacaac

SEQ ID NO: 94567 - DNA, 15 bp, Homo sapiens
tacccacacacacac

SEQ ID NO: 94568 - DNA, 15 bp, Homo sapiens
ctacccacacacaca

SEQ ID NO: 94569 - DNA, 15 bp, Homo sapiens
gctacccacacacac

SEQ ID NO: 94570 - DNA, 15 bp, Homo sapiens
agctacccacacaca

SEQ ID NO: 94571 - DNA, 15 bp, Homo sapiens
cagctacccacacac

SEQ ID NO: 94572 - DNA, 15 bp, Homo sapiens
acagctacccacaca

SEQ ID NO: 94573 - DNA, 15 bp, Homo sapiens
cacagctacccacac

SEQ ID NO: 94574 - DNA, 15 bp, Homo sapiens
acacagctacccaca

SEQ ID NO: 94575 - DNA, 15 bp, Homo sapiens
cacacagctacccac

SEQ ID NO: 94576 - DNA, 15 bp, Homo sapiens
acacacagctaccca

SEQ ID NO: 94577 - DNA, 15 bp, Homo sapiens
cacacacagctaccc

SEQ ID NO: 94578 - DNA, 15 bp, Homo sapiens
tcacacacagctacc

SEQ ID NO: 94579 - DNA, 15 bp, Homo sapiens
atcacacacagctac

SEQ ID NO: 94580 - DNA, 15 bp, Homo sapiens
catcacacacagcta

SEQ ID NO: 94581 - DNA, 15 bp, Homo sapiens
ccatcacacacagct

SEQ ID NO: 94582 - DNA, 15 bp, Homo sapiens
accatcacacacagc

SEQ ID NO: 94583 - DNA, 15 bp, Homo sapiens
taccatcacacacag

SEQ ID NO: 94584 - DNA, 15 bp, Homo sapiens
ctaccatcacacaca

SEQ ID NO: 94585 - DNA, 15 bp, Homo sapiens
actaccatcacacac

SEQ ID NO: 94586 - DNA, 15 bp, Homo sapiens
cactaccatcacaca

SEQ ID NO: 94587 - DNA, 15 bp, Homo sapiens
tcactaccatcacac

SEQ ID NO: 94588 - DNA, 15 bp, Homo sapiens
gtcactaccatcaca

SEQ ID NO: 94589 - DNA, 15 bp, Homo sapiens
tgtcactaccatcac

SEQ ID NO: 94590 - DNA, 15 bp, Homo sapiens
ctgtcactaccatca

SEQ ID NO: 94591 - DNA, 15 bp, Homo sapiens
cctgtcactaccatc

SEQ ID NO: 94592 - DNA, 15 bp, Homo sapiens
tcctgtcactaccat

SEQ ID NO: 94593 - DNA, 15 bp, Homo sapiens
ctcctgtcactacca

SEQ ID NO: 94594 - DNA, 15 bp, Homo sapiens
cctcctgtcactacc

SEQ ID NO: 94595 - DNA, 15 bp, Homo sapiens
acctcctgtcactac

SEQ ID NO: 94596 - DNA, 15 bp, Homo sapiens
tacctcctgtcacta

SEQ ID NO: 94597 - DNA, 15 bp, Homo sapiens
ctacctcctgtcact

SEQ ID NO: 94598 - DNA, 15 bp, Homo sapiens
actacctcctgtcac

SEQ ID NO: 94599 - DNA, 15 bp, Homo sapiens
aactacctcctgtca

SEQ ID NO: 94600 - DNA, 15 bp, Homo sapiens
aaactacctcctgtc

SEQ ID NO: 94601 - DNA, 15 bp, Homo sapiens
aaaactacctcctgt

SEQ ID NO: 94602 - DNA, 15 bp, Homo sapiens
aaaaactacctcctg

SEQ ID NO: 94603 - DNA, 15 bp, Homo sapiens
gaaaaactacctcct

SEQ ID NO: 94604 - DNA, 15 bp, Homo sapiens
agaaaaactacctcc

SEQ ID NO: 94605 - DNA, 15 bp, Homo sapiens
gagaaaaactacctc

SEQ ID NO: 94606 - DNA, 15 bp, Homo sapiens
agagaaaaactacct

SEQ ID NO: 94607 - DNA, 15 bp, Homo sapiens
tagagaaaaactacc

SEQ ID NO: 94608 - DNA, 15 bp, Homo sapiens
ctagagaaaaactac

SEQ ID NO: 94609 - DNA, 15 bp, Homo sapiens
cctagagaaaaacta

SEQ ID NO: 94610 - DNA, 15 bp, Homo sapiens
acctagagaaaaact

SEQ ID NO: 94611 - DNA, 15 bp, Homo sapiens
cacctagagaaaaac

SEQ ID NO: 94612 - DNA, 15 bp, Homo sapiens
acacctagagaaaaa

SEQ ID NO: 94613 - DNA, 15 bp, Homo sapiens
tacacctagagaaaa

SEQ ID NO: 94614 - DNA, 15 bp, Homo sapiens
ttacacctagagaaa

SEQ ID NO: 94615 - DNA, 15 bp, Homo sapiens
cttacacctagagaa

SEQ ID NO: 94616 - DNA, 15 bp, Homo sapiens
acttacacctagaga

SEQ ID NO: 94617 - DNA, 15 bp, Homo sapiens
cacttacacctagag

SEQ ID NO: 94618 - DNA, 15 bp, Homo sapiens
gcacttacacctaga

SEQ ID NO: 94619 - DNA, 15 bp, Homo sapiens
tgcacttacacctag

SEQ ID NO: 94620 - DNA, 15 bp, Homo sapiens
ctgcacttacaccta

SEQ ID NO: 94621 - DNA, 15 bp, Homo sapiens
actgcacttacacct

SEQ ID NO: 94622 - DNA, 15 bp, Homo sapiens
aactgcacttacacc

SEQ ID NO: 94623 - DNA, 15 bp, Homo sapiens
gaactgcacttacac

SEQ ID NO: 94624 - DNA, 15 bp, Homo sapiens
agaactgcacttaca

SEQ ID NO: 94625 - DNA, 15 bp, Homo sapiens
tagaactgcacttac

SEQ ID NO: 94626 - DNA, 15 bp, Homo sapiens
ctagaactgcactta

SEQ ID NO: 94627 - DNA, 15 bp, Homo sapiens
tctagaactgcactt

SEQ ID NO: 94628 - DNA, 15 bp, Homo sapiens
atctagaactgcact

SEQ ID NO: 94629 - DNA, 15 bp, Homo sapiens
catctagaactgcac

SEQ ID NO: 94630 - DNA, 15 bp, Homo sapiens
ccatctagaactgca

SEQ ID NO: 94631 - DNA, 15 bp, Homo sapiens
tccatctagaactgc

SEQ ID NO: 94632 - DNA, 15 bp, Homo sapiens
ctccatctagaactg

SEQ ID NO: 94633 - DNA, 15 bp, Homo sapiens
tctccatctagaact

SEQ ID NO: 94634 - DNA, 15 bp, Homo sapiens
atctccatctagaac

SEQ ID NO: 94635 - DNA, 15 bp, Homo sapiens
gatctccatctagaa

SEQ ID NO: 94636 - DNA, 15 bp, Homo sapiens
agatctccatctaga

SEQ ID NO: 94637 - DNA, 15 bp, Homo sapiens
gagatctccatctag

SEQ ID NO: 94638 - DNA, 15 bp, Homo sapiens
tgagatctccatcta

SEQ ID NO: 94639 - DNA, 15 bp, Homo sapiens
atgagatctccatct

SEQ ID NO: 94640 - DNA, 15 bp, Homo sapiens
aatgagatctccatc

SEQ ID NO: 94641 - DNA, 15 bp, Homo sapiens
gaatgagatctccat

SEQ ID NO: 94642 - DNA, 15 bp, Homo sapiens
tgaatgagatctcca

SEQ ID NO: 94643 - DNA, 15 bp, Homo sapiens
ttgaatgagatctcc

SEQ ID NO: 94644 - DNA, 15 bp, Homo sapiens
tttgaatgagatctc

SEQ ID NO: 94645 - DNA, 15 bp, Homo sapiens
atttgaatgagatct

SEQ ID NO: 94646 - DNA, 15 bp, Homo sapiens
tatttgaatgagatc

SEQ ID NO: 94647 - DNA, 15 bp, Homo sapiens
ttatttgaatgagat

SEQ ID NO: 94648 - DNA, 15 bp, Homo sapiens
tttatttgaatgaga

SEQ ID NO: 94649 - DNA, 15 bp, Homo sapiens
gtttatttgaatgag

SEQ ID NO: 94650 - DNA, 15 bp, Homo sapiens
ggtttatttgaatga

SEQ ID NO: 94651 - DNA, 15 bp, Homo sapiens
tggtttatttgaatg

SEQ ID NO: 94652 - DNA, 15 bp, Homo sapiens
ctggtttatttgaat

SEQ ID NO: 94653 - DNA, 15 bp, Homo sapiens
actggtttatttgaa

SEQ ID NO: 94654 - DNA, 15 bp, Homo sapiens
tactggtttatttga

SEQ ID NO: 94655 - DNA, 15 bp, Homo sapiens
ttactggtttatttg

SEQ ID NO: 94656 - DNA, 15 bp, Homo sapiens
attactggtttattt

SEQ ID NO: 94657 - DNA, 15 bp, Homo sapiens
aattactggtttatt

SEQ ID NO: 94658 - DNA, 15 bp, Homo sapiens
taattactggtttat

SEQ ID NO: 94659 - DNA, 15 bp, Homo sapiens
ataattactggttta

SEQ ID NO: 94660 - DNA, 15 bp, Homo sapiens
cataattactggttt

SEQ ID NO: 94661 - DNA, 15 bp, Homo sapiens
ccataattactggtt

SEQ ID NO: 94662 - DNA, 15 bp, Homo sapiens
tccataattactggt

SEQ ID NO: 94663 - DNA, 15 bp, Homo sapiens
ctccataattactgg

SEQ ID NO: 94664 - DNA, 15 bp, Homo sapiens
tctccataattactg

SEQ ID NO: 94665 - DNA, 15 bp, Homo sapiens
ctctccataattact

SEQ ID NO: 94666 - DNA, 15 bp, Homo sapiens
tctctccataattac

SEQ ID NO: 94667 - DNA, 15 bp, Homo sapiens
ttctctccataatta

SEQ ID NO: 94668 - DNA, 15 bp, Homo sapiens
tttctctccataatt

SEQ ID NO: 94669 - DNA, 15 bp, Homo sapiens
atttctctccataat

SEQ ID NO: 94670 - DNA, 15 bp, Homo sapiens
catttctctccataa

SEQ ID NO: 94671 - DNA, 15 bp, Homo sapiens
acatttctctccata

SEQ ID NO: 94672 - DNA, 15 bp, Homo sapiens
cacatttctctccat

SEQ ID NO: 94673 - DNA, 15 bp, Homo sapiens
acacatttctctcca

SEQ ID NO: 94674 - DNA, 15 bp, Homo sapiens
aacacatttctctcc

SEQ ID NO: 94675 - DNA, 15 bp, Homo sapiens
aaacacatttctctc

SEQ ID NO: 94676 - DNA, 15 bp, Homo sapiens
aaaacacatttctct

SEQ ID NO: 94677 - DNA, 15 bp, Homo sapiens
caaaacacatttctc

SEQ ID NO: 94678 - DNA, 15 bp, Homo sapiens
acaaaacacatttct

SEQ ID NO: 94679 - DNA, 15 bp, Homo sapiens
cacaaaacacatttc

SEQ ID NO: 94680 - DNA, 15 bp, Homo sapiens
acacaaaacacattt

SEQ ID NO: 94681 - DNA, 15 bp, Homo sapiens
cacacaaaacacatt

SEQ ID NO: 94682 - DNA, 15 bp, Homo sapiens
ccacacaaaacacat

SEQ ID NO: 94683 - DNA, 15 bp, Homo sapiens
gccacacaaaacaca

SEQ ID NO: 94684 - DNA, 15 bp, Homo sapiens
agccacacaaaacac

SEQ ID NO: 94685 - DNA, 15 bp, Homo sapiens
aagccacacaaaaca

SEQ ID NO: 94686 - DNA, 15 bp, Homo sapiens
taagccacacaaaac

SEQ ID NO: 94687 - DNA, 15 bp, Homo sapiens
ctaagccacacaaaa

SEQ ID NO: 94688 - DNA, 15 bp, Homo sapiens
actaagccacacaaa

SEQ ID NO: 94689 - DNA, 15 bp, Homo sapiens
cactaagccacacaa

SEQ ID NO: 94690 - DNA, 15 bp, Homo sapiens
acactaagccacaca

SEQ ID NO: 94691 - DNA, 15 bp, Homo sapiens
aacactaagccacac

SEQ ID NO: 94692 - DNA, 15 bp, Homo sapiens
aaacactaagccaca

SEQ ID NO: 94693 - DNA, 15 bp, Homo sapiens
aaaacactaagccac

SEQ ID NO: 94694 - DNA, 15 bp, Homo sapiens
aaaaacactaagcca

SEQ ID NO: 94695 - DNA, 15 bp, Homo sapiens
caaaaacactaagcc

SEQ ID NO: 94696 - DNA, 15 bp, Homo sapiens
tcaaaaacactaagc

SEQ ID NO: 94697 - DNA, 15 bp, Homo sapiens
gtcaaaaacactaag

SEQ ID NO: 94698 - DNA, 15 bp, Homo sapiens
agtcaaaaacactaa

SEQ ID NO: 94699 - DNA, 15 bp, Homo sapiens
gagtcaaaaacacta

SEQ ID NO: 94700 - DNA, 15 bp, Homo sapiens
tgagtcaaaaacact

SEQ ID NO: 94701 - DNA, 15 bp, Homo sapiens
atgagtcaaaaacac

SEQ ID NO: 94702 - DNA, 15 bp, Homo sapiens
aatgagtcaaaaaca

SEQ ID NO: 94703 - DNA, 15 bp, Homo sapiens
aaatgagtcaaaaac

SEQ ID NO: 94704 - DNA, 15 bp, Homo sapiens
taaatgagtcaaaaa

SEQ ID NO: 94705 - DNA, 15 bp, Homo sapiens
gtaaatgagtcaaaa

SEQ ID NO: 94706 - DNA, 15 bp, Homo sapiens
agtaaatgagtcaaa

SEQ ID NO: 94707 - DNA, 15 bp, Homo sapiens
aagtaaatgagtcaa

SEQ ID NO: 94708 - DNA, 15 bp, Homo sapiens
aaagtaaatgagtca

SEQ ID NO: 94709 - DNA, 15 bp, Homo sapiens
aaaagtaaatgagtc

SEQ ID NO: 94710 - DNA, 15 bp, Homo sapiens
aaaaagtaaatgagt

SEQ ID NO: 94711 - DNA, 15 bp, Homo sapiens
aaaaaagtaaatgag

SEQ ID NO: 94712 - DNA, 15 bp, Homo sapiens
aaaaaaagtaaatga

SEQ ID NO: 94713 - DNA, 15 bp, Homo sapiens
aaaaaaaagtaaatg

SEQ ID NO: 94714 - DNA, 15 bp, Homo sapiens
aaaaaaaaagtaaat

SEQ ID NO: 94715 - DNA, 15 bp, Homo sapiens
aaaaaaaaaagtaaa

SEQ ID NO: 94716 - DNA, 15 bp, Homo sapiens
caaaaaaaaaaaagt

SEQ ID NO: 94717 - DNA, 15 bp, Homo sapiens
ggggcaacagagcaa

SEQ ID NO: 94718 - DNA, 15 bp, Homo sapiens
tggggcaacagagca

SEQ ID NO: 94719 - DNA, 15 bp, Homo sapiens
ctggggcaacagagc

SEQ ID NO: 94720 - DNA, 15 bp, Homo sapiens
cctggggcaacagag

SEQ ID NO: 94721 - DNA, 15 bp, Homo sapiens
gcctggggcaacaga

SEQ ID NO: 94722 - DNA, 15 bp, Homo sapiens
agcctggggcaacag

SEQ ID NO: 94723 - DNA, 15 bp, Homo sapiens
cagcctggggcaaca

SEQ ID NO: 94724 - DNA, 15 bp, Homo sapiens
ccagcctggggcaac

SEQ ID NO: 94725 - DNA, 15 bp, Homo sapiens
tccagcctggggcaa

SEQ ID NO: 94726 - DNA, 15 bp, Homo sapiens
ctccagcctggggca

SEQ ID NO: 94727 - DNA, 15 bp, Homo sapiens
actccagcctggggc

SEQ ID NO: 94728 - DNA, 15 bp, Homo sapiens
cactccagcctgggg

SEQ ID NO: 94729 - DNA, 15 bp, Homo sapiens
ggcactccagcctgg

SEQ ID NO: 94730 - DNA, 15 bp, Homo sapiens
tggcactccagcctg

SEQ ID NO: 94731 - DNA, 15 bp, Homo sapiens
atggcactccagcct

SEQ ID NO: 94732 - DNA, 15 bp, Homo sapiens
catggcactccagcc

SEQ ID NO: 94733 - DNA, 15 bp, Homo sapiens
ccatggcactccagc

SEQ ID NO: 94734 - DNA, 15 bp, Homo sapiens
accatggcactccag

SEQ ID NO: 94735 - DNA, 15 bp, Homo sapiens
caccatggcactcca

SEQ ID NO: 94736 - DNA, 15 bp, Homo sapiens
gcaccatggcactcc

SEQ ID NO: 94737 - DNA, 15 bp, Homo sapiens
tgcaccatggcactc

SEQ ID NO: 94738 - DNA, 15 bp, Homo sapiens
ttgcaccatggcact

SEQ ID NO: 94739 - DNA, 15 bp, Homo sapiens
attgcaccatggcac

SEQ ID NO: 94740 - DNA, 15 bp, Homo sapiens
gattgcaccatggca

SEQ ID NO: 94741 - DNA, 15 bp, Homo sapiens
agattgcaccatggc

SEQ ID NO: 94742 - DNA, 15 bp, Homo sapiens
aagattgcaccatgg

SEQ ID NO: 94743 - DNA, 15 bp, Homo sapiens
caagattgcaccatg

SEQ ID NO: 94744 - DNA, 15 bp, Homo sapiens
ccaagattgcaccat

SEQ ID NO: 94745 - DNA, 15 bp, Homo sapiens
aagccaagattgcac

SEQ ID NO: 94746 - DNA, 15 bp, Homo sapiens
taagccaagattgca

SEQ ID NO: 94747 - DNA, 15 bp, Homo sapiens
gtaagccaagattgc

SEQ ID NO: 94748 - DNA, 15 bp, Homo sapiens
agtaagccaagattg

SEQ ID NO: 94749 - DNA, 15 bp, Homo sapiens
cagtaagccaagatt

SEQ ID NO: 94750 - DNA, 15 bp, Homo sapiens
gcagtaagccaagat

SEQ ID NO: 94751 - DNA, 15 bp, Homo sapiens
tgcagtaagccaaga

SEQ ID NO: 94752 - DNA, 15 bp, Homo sapiens
ttgcagtaagccaag

SEQ ID NO: 94753 - DNA, 15 bp, Homo sapiens
gttgcagtaagccaa

SEQ ID NO: 94754 - DNA, 15 bp, Homo sapiens
agttgcagtaagcca

SEQ ID NO: 94755 - DNA, 15 bp, Homo sapiens
aagttgcagtaagcc

SEQ ID NO: 94756 - DNA, 15 bp, Homo sapiens
gaagttgcagtaagc

SEQ ID NO: 94757 - DNA, 15 bp, Homo sapiens
tgaagttgcagtaag

SEQ ID NO: 94758 - DNA, 15 bp, Homo sapiens
ctgaagttgcagtaa

SEQ ID NO: 94759 - DNA, 15 bp, Homo sapiens
gctgaagttgcagta

SEQ ID NO: 94760 - DNA, 15 bp, Homo sapiens
cgggaggctgaagtt

SEQ ID NO: 94761 - DNA, 15 bp, Homo sapiens
ccgggaggctgaagt

SEQ ID NO: 94762 - DNA, 15 bp, Homo sapiens
cccgggaggctgaag

SEQ ID NO: 94763 - DNA, 15 bp, Homo sapiens
acccgggaggctgaa

SEQ ID NO: 94764 - DNA, 15 bp, Homo sapiens
aacccgggaggctga

SEQ ID NO: 94765 - DNA, 15 bp, Homo sapiens
gaacccgggaggctg

SEQ ID NO: 94766 - DNA, 15 bp, Homo sapiens
tgaacccgggaggct

SEQ ID NO: 94767 - DNA, 15 bp, Homo sapiens
ctgcttgaacccggg

SEQ ID NO: 94768 - DNA, 15 bp, Homo sapiens
actgcttgaacccgg

SEQ ID NO: 94769 - DNA, 15 bp, Homo sapiens
aactgcttgaacccg

SEQ ID NO: 94770 - DNA, 15 bp, Homo sapiens
gaactgcttgaaccc

SEQ ID NO: 94771 - DNA, 15 bp, Homo sapiens
agaactgcttgaacc

SEQ ID NO: 94772 - DNA, 15 bp, Homo sapiens
gagaactgcttgaac

SEQ ID NO: 94773 - DNA, 15 bp, Homo sapiens
ggagaactgcttgaa

SEQ ID NO: 94774 - DNA, 15 bp, Homo sapiens
aggagaactgcttga

SEQ ID NO: 94775 - DNA, 15 bp, Homo sapiens
caggagaactgcttg

SEQ ID NO: 94776 - DNA, 15 bp, Homo sapiens
gcaggagaactgctt

SEQ ID NO: 94777 - DNA, 15 bp, Homo sapiens
ggcaggagaactgct

SEQ ID NO: 94778 - DNA, 15 bp, Homo sapiens
aggcaggagaactgc

SEQ ID NO: 94779 - DNA, 15 bp, Homo sapiens
gaggcaggagaactg

SEQ ID NO: 94780 - DNA, 15 bp, Homo sapiens
tgaggcaggagaact

SEQ ID NO: 94781 - DNA, 15 bp, Homo sapiens
ctgaggcaggagaac

SEQ ID NO: 94782 - DNA, 15 bp, Homo sapiens
atcaggaggctgagg

SEQ ID NO: 94783 - DNA, 15 bp, Homo sapiens
aatcaggaggctgag

SEQ ID NO: 94784 - DNA, 15 bp, Homo sapiens
taatcaggaggctga

SEQ ID NO: 94785 - DNA, 15 bp, Homo sapiens
ttaatcaggaggctg

SEQ ID NO: 94786 - DNA, 15 bp, Homo sapiens
gttaatcaggaggct

SEQ ID NO: 94787 - DNA, 15 bp, Homo sapiens
agttaatcaggaggc

SEQ ID NO: 94788 - DNA, 15 bp, Homo sapiens
cagttaatcaggagg

SEQ ID NO: 94789 - DNA, 15 bp, Homo sapiens
ccagttaatcaggag

SEQ ID NO: 94790 - DNA, 15 bp, Homo sapiens
cccagttaatcagga

SEQ ID NO: 94791 - DNA, 15 bp, Homo sapiens
tcccagttaatcagg

SEQ ID NO: 94792 - DNA, 15 bp, Homo sapiens
gtcccagttaatcag

SEQ ID NO: 94793 - DNA, 15 bp, Homo sapiens
agtcccagttaatca

SEQ ID NO: 94794 - DNA, 15 bp, Homo sapiens
tagtcccagttaatc

SEQ ID NO: 94795 - DNA, 15 bp, Homo sapiens
gtagtcccagttaat

SEQ ID NO: 94796 - DNA, 15 bp, Homo sapiens
tgtagtcccagttaa

SEQ ID NO: 94797 - DNA, 15 bp, Homo sapiens
ctgtagtcccagtta

SEQ ID NO: 94798 - DNA, 15 bp, Homo sapiens
cctgtagtcccagtt

SEQ ID NO: 94799 - DNA, 15 bp, Homo sapiens
gcctgtagtcccagt

SEQ ID NO: 94800 - DNA, 15 bp, Homo sapiens
tgtgcctgtagtccc

SEQ ID NO: 94801 - DNA, 15 bp, Homo sapiens
atgtgcctgtagtcc

SEQ ID NO: 94802 - DNA, 15 bp, Homo sapiens
catgtgcctgtagtc

SEQ ID NO: 94803 - DNA, 15 bp, Homo sapiens
gcatgtgcctgtagt

SEQ ID NO: 94804 - DNA, 15 bp, Homo sapiens
ggcatgtgcctgtag

SEQ ID NO: 94805 - DNA, 15 bp, Homo sapiens
tggcatgtgcctgta

SEQ ID NO: 94806 - DNA, 15 bp, Homo sapiens
agtggcatgtgcctg

SEQ ID NO: 94807 - DNA, 15 bp, Homo sapiens
tagtggcatgtgcct

SEQ ID NO: 94808 - DNA, 15 bp, Homo sapiens
atagtggcatgtgcc

SEQ ID NO: 94809 - DNA, 15 bp, Homo sapiens
catagtggcatgtgc

SEQ ID NO: 94810 - DNA, 15 bp, Homo sapiens
gcatagtggcatgtg

SEQ ID NO: 94811 - DNA, 15 bp, Homo sapiens
ggcatagtggcatgt

SEQ ID NO: 94812 - DNA, 15 bp, Homo sapiens
gggcatagtggcatg

SEQ ID NO: 94813 - DNA, 15 bp, Homo sapiens
cgggcatagtggcat

SEQ ID NO: 94814 - DNA, 15 bp, Homo sapiens
ccgggcatagtggca

SEQ ID NO: 94815 - DNA, 15 bp, Homo sapiens
gccgggcatagtggc

SEQ ID NO: 94816 - DNA, 15 bp, Homo sapiens
agccgggcatagtgg

SEQ ID NO: 94817 - DNA, 15 bp, Homo sapiens
tagccgggcatagtg

SEQ ID NO: 94818 - DNA, 15 bp, Homo sapiens
ttagccgggcatagt

SEQ ID NO: 94819 - DNA, 15 bp, Homo sapiens
cttagccgggcatag

SEQ ID NO: 94820 - DNA, 15 bp, Homo sapiens
ccttagccgggcata

SEQ ID NO: 94821 - DNA, 15 bp, Homo sapiens
accttagccgggcat

SEQ ID NO: 94822 - DNA, 15 bp, Homo sapiens
aaccttagccgggca

SEQ ID NO: 94823 - DNA, 15 bp, Homo sapiens
aaaccttagccgggc

SEQ ID NO: 94824 - DNA, 15 bp, Homo sapiens
aaaaccttagccggg

SEQ ID NO: 94825 - DNA, 15 bp, Homo sapiens
taaaaccttagccgg

SEQ ID NO: 94826 - DNA, 15 bp, Homo sapiens
ataaaaccttagccg

SEQ ID NO: 94827 - DNA, 15 bp, Homo sapiens
aataaaaccttagcc

SEQ ID NO: 94828 - DNA, 15 bp, Homo sapiens
aaataaaaccttagc

SEQ ID NO: 94829 - DNA, 15 bp, Homo sapiens
aaaataaaaccttag

SEQ ID NO: 94830 - DNA, 15 bp, Homo sapiens
aaaaataaaacctta

SEQ ID NO: 94831 - DNA, 15 bp, Homo sapiens
taaaaataaaacctt

SEQ ID NO: 94832 - DNA, 15 bp, Homo sapiens
ctaaaaataaaacct

SEQ ID NO: 94833 - DNA, 15 bp, Homo sapiens
actaaaaataaaacc

SEQ ID NO: 94834 - DNA, 15 bp, Homo sapiens
tactaaaaataaaac

SEQ ID NO: 94835 - DNA, 15 bp, Homo sapiens
taaaacctcatctct

SEQ ID NO: 94836 - DNA, 15 bp, Homo sapiens
gtaaaacctcatctc

SEQ ID NO: 94837 - DNA, 15 bp, Homo sapiens
ggtaaaacctcatct

SEQ ID NO: 94838 - DNA, 15 bp, Homo sapiens
tggtaaaacctcatc

SEQ ID NO: 94839 - DNA, 15 bp, Homo sapiens
atggtaaaacctcat

SEQ ID NO: 94840 - DNA, 15 bp, Homo sapiens
catggtaaaacctca

SEQ ID NO: 94841 - DNA, 15 bp, Homo sapiens
acatggtaaaacctc

SEQ ID NO: 94842 - DNA, 15 bp, Homo sapiens
aacatggtaaaacct

SEQ ID NO: 94843 - DNA, 15 bp, Homo sapiens
agggtggatcacctg

SEQ ID NO: 94844 - DNA, 15 bp, Homo sapiens
gagggtggatcacct

SEQ ID NO: 94845 - DNA, 15 bp, Homo sapiens
ggagggtggatcacc

SEQ ID NO: 94846 - DNA, 15 bp, Homo sapiens
aggagggtggatcac

SEQ ID NO: 94847 - DNA, 15 bp, Homo sapiens
gaggagggtggatca

SEQ ID NO: 94848 - DNA, 15 bp, Homo sapiens
cgaggagggtggatc

SEQ ID NO: 94849 - DNA, 15 bp, Homo sapiens
ccgaggagggtggat

SEQ ID NO: 94850 - DNA, 15 bp, Homo sapiens
gccgaggagggtgga

SEQ ID NO: 94851 - DNA, 15 bp, Homo sapiens
ggccgaggagggtgg

SEQ ID NO: 94852 - DNA, 15 bp, Homo sapiens
aggccgaggagggtg

SEQ ID NO: 94853 - DNA, 15 bp, Homo sapiens
gaggccgaggagggt

SEQ ID NO: 94854 - DNA, 15 bp, Homo sapiens
ttttgggaggccgag

SEQ ID NO: 94855 - DNA, 15 bp, Homo sapiens
attttgggaggccga

SEQ ID NO: 94856 - DNA, 15 bp, Homo sapiens
cattttgggaggccg

SEQ ID NO: 94857 - DNA, 15 bp, Homo sapiens
tagcattttgggagg

SEQ ID NO: 94858 - DNA, 15 bp, Homo sapiens
ctagcattttgggag

SEQ ID NO: 94859 - DNA, 15 bp, Homo sapiens
cctagcattttggga

SEQ ID NO: 94860 - DNA, 15 bp, Homo sapiens
tcctagcattttggg

SEQ ID NO: 94861 - DNA, 15 bp, Homo sapiens
atcctagcattttgg

SEQ ID NO: 94862 - DNA, 15 bp, Homo sapiens
aatcctagcattttg

SEQ ID NO: 94863 - DNA, 15 bp, Homo sapiens
taatcctagcatttt

SEQ ID NO: 94864 - DNA, 15 bp, Homo sapiens
gtaatcctagcattt

SEQ ID NO: 94865 - DNA, 15 bp, Homo sapiens
tgtaatcctagcatt

SEQ ID NO: 94866 - DNA, 15 bp, Homo sapiens
ctgtaatcctagcat

SEQ ID NO: 94867 - DNA, 15 bp, Homo sapiens
tctgtaatcctagca

SEQ ID NO: 94868 - DNA, 15 bp, Homo sapiens
gtctgtaatcctagc

SEQ ID NO: 94869 - DNA, 15 bp, Homo sapiens
tgtctgtaatcctag

SEQ ID NO: 94870 - DNA, 15 bp, Homo sapiens
atgtctgtaatccta

SEQ ID NO: 94871 - DNA, 15 bp, Homo sapiens
catgtctgtaatcct

SEQ ID NO: 94872 - DNA, 15 bp, Homo sapiens
tggtggctcatgtct

SEQ ID NO: 94873 - DNA, 15 bp, Homo sapiens
atggtggctcatgtc

SEQ ID NO: 94874 - DNA, 15 bp, Homo sapiens
catggtggctcatgt

SEQ ID NO: 94875 - DNA, 15 bp, Homo sapiens
aggcatggtggctca

SEQ ID NO: 94876 - DNA, 15 bp, Homo sapiens
caggcatggtggctc

SEQ ID NO: 94877 - DNA, 15 bp, Homo sapiens
taaaatgggccaggc

SEQ ID NO: 94878 - DNA, 15 bp, Homo sapiens
gtaaaatgggccagg

SEQ ID NO: 94879 - DNA, 15 bp, Homo sapiens
agtaaaatgggccag

SEQ ID NO: 94880 - DNA, 15 bp, Homo sapiens
aagtaaaatgggcca

SEQ ID NO: 94881 - DNA, 15 bp, Homo sapiens
aaagtaaaatgggcc

SEQ ID NO: 94882 - DNA, 15 bp, Homo sapiens
caaagtaaaatgggc

SEQ ID NO: 94883 - DNA, 15 bp, Homo sapiens
gcaaagtaaaatggg

SEQ ID NO: 94884 - DNA, 15 bp, Homo sapiens
cgcaaagtaaaatgg

SEQ ID NO: 94885 - DNA, 15 bp, Homo sapiens
tcgcaaagtaaaatg

SEQ ID NO: 94886 - DNA, 15 bp, Homo sapiens
atcgcaaagtaaaat

SEQ ID NO: 94887 - DNA, 15 bp, Homo sapiens
catcgcaaagtaaaa

SEQ ID NO: 94888 - DNA, 15 bp, Homo sapiens
ccatcgcaaagtaaa

SEQ ID NO: 94889 - DNA, 15 bp, Homo sapiens
accatcgcaaagtaa

SEQ ID NO: 94890 - DNA, 15 bp, Homo sapiens
gaccatcgcaaagta

SEQ ID NO: 94891 - DNA, 15 bp, Homo sapiens
ggaccatcgcaaagt

SEQ ID NO: 94892 - DNA, 15 bp, Homo sapiens
gggaccatcgcaaag

SEQ ID NO: 94893 - DNA, 15 bp, Homo sapiens
tgggaccatcgcaaa

SEQ ID NO: 94894 - DNA, 15 bp, Homo sapiens
gtgggaccatcgcaa

SEQ ID NO: 94895 - DNA, 15 bp, Homo sapiens
agtgggaccatcgca

SEQ ID NO: 94896 - DNA, 15 bp, Homo sapiens
aagtgggaccatcgc

SEQ ID NO: 94897 - DNA, 15 bp, Homo sapiens
gaagtgggaccatcg

SEQ ID NO: 94898 - DNA, 15 bp, Homo sapiens
agaagtgggaccatc

SEQ ID NO: 94899 - DNA, 15 bp, Homo sapiens
gagaagtgggaccat

SEQ ID NO: 94900 - DNA, 15 bp, Homo sapiens
cgagaagtgggacca

SEQ ID NO: 94901 - DNA, 15 bp, Homo sapiens
acgagaagtgggacc

SEQ ID NO: 94902 - DNA, 15 bp, Homo sapiens
aacgagaagtgggac

SEQ ID NO: 94903 - DNA, 15 bp, Homo sapiens
caacgagaagtggga

SEQ ID NO: 94904 - DNA, 15 bp, Homo sapiens
acaacgagaagtggg

SEQ ID NO: 94905 - DNA, 15 bp, Homo sapiens
cacaacgagaagtgg

SEQ ID NO: 94906 - DNA, 15 bp, Homo sapiens
acacaacgagaagtg

SEQ ID NO: 94907 - DNA, 15 bp, Homo sapiens
tacacaacgagaagt

SEQ ID NO: 94908 - DNA, 15 bp, Homo sapiens
atacacaacgagaag

SEQ ID NO: 94909 - DNA, 15 bp, Homo sapiens
aatacacaacgagaa

SEQ ID NO: 94910 - DNA, 15 bp, Homo sapiens
taatacacaacgaga

SEQ ID NO: 94911 - DNA, 15 bp, Homo sapiens
ataatacacaacgag

SEQ ID NO: 94912 - DNA, 15 bp, Homo sapiens
cataatacacaacga

SEQ ID NO: 94913 - DNA, 15 bp, Homo sapiens
tcataatacacaacg

SEQ ID NO: 94914 - DNA, 15 bp, Homo sapiens
ctcataatacacaac

SEQ ID NO: 94915 - DNA, 15 bp, Homo sapiens
actcataatacacaa

SEQ ID NO: 94916 - DNA, 15 bp, Homo sapiens
aactcataatacaca

SEQ ID NO: 94917 - DNA, 15 bp, Homo sapiens
caactcataatacac

SEQ ID NO: 94918 - DNA, 15 bp, Homo sapiens
gcaactcataataca

SEQ ID NO: 94919 - DNA, 15 bp, Homo sapiens
tgcaactcataatac

SEQ ID NO: 94920 - DNA, 15 bp, Homo sapiens
ttgcaactcataata

SEQ ID NO: 94921 - DNA, 15 bp, Homo sapiens
attgcaactcataat

SEQ ID NO: 94922 - DNA, 15 bp, Homo sapiens
aattgcaactcataa

SEQ ID NO: 94923 - DNA, 15 bp, Homo sapiens
caattgcaactcata

SEQ ID NO: 94924 - DNA, 15 bp, Homo sapiens
acaattgcaactcat

SEQ ID NO: 94925 - DNA, 15 bp, Homo sapiens
aacaattgcaactca

SEQ ID NO: 94926 - DNA, 15 bp, Homo sapiens
gaacaattgcaactc

SEQ ID NO: 94927 - DNA, 15 bp, Homo sapiens
ggaacaattgcaact

SEQ ID NO: 94928 - DNA, 15 bp, Homo sapiens
gggaacaattgcaac

SEQ ID NO: 94929 - DNA, 15 bp, Homo sapiens
cgggaacaattgcaa

SEQ ID NO: 94930 - DNA, 15 bp, Homo sapiens
ccgggaacaattgca

SEQ ID NO: 94931 - DNA, 15 bp, Homo sapiens
gccgggaacaattgc

SEQ ID NO: 94932 - DNA, 15 bp, Homo sapiens
agccgggaacaattg

SEQ ID NO: 94933 - DNA, 15 bp, Homo sapiens
aagccgggaacaatt

SEQ ID NO: 94934 - DNA, 15 bp, Homo sapiens
aaagccgggaacaat

SEQ ID NO: 94935 - DNA, 15 bp, Homo sapiens
gaaagccgggaacaa

SEQ ID NO: 94936 - DNA, 15 bp, Homo sapiens
tgaaagccgggaaca

SEQ ID NO: 94937 - DNA, 15 bp, Homo sapiens
ttgaaagccgggaac

SEQ ID NO: 94938 - DNA, 15 bp, Homo sapiens
tttgaaagccgggaa

SEQ ID NO: 94939 - DNA, 15 bp, Homo sapiens
ttttgaaagccggga

SEQ ID NO: 94940 - DNA, 15 bp, Homo sapiens
attttgaaagccggg

SEQ ID NO: 94941 - DNA, 15 bp, Homo sapiens
cattttgaaagccgg

SEQ ID NO: 94942 - DNA, 15 bp, Homo sapiens
tcattttgaaagccg

SEQ ID NO: 94943 - DNA, 15 bp, Homo sapiens
ctcattttgaaagcc

SEQ ID NO: 94944 - DNA, 15 bp, Homo sapiens
gctcattttgaaagc

SEQ ID NO: 94945 - DNA, 15 bp, Homo sapiens
cattttctatttcct

SEQ ID NO: 94946 - DNA, 15 bp, Homo sapiens
ccattttctatttcc

SEQ ID NO: 94947 - DNA, 15 bp, Homo sapiens
accattttctatttc

SEQ ID NO: 94948 - DNA, 15 bp, Homo sapiens
aaccattttctattt

SEQ ID NO: 94949 - DNA, 15 bp, Homo sapiens
aaaccattttctatt

SEQ ID NO: 94950 - DNA, 15 bp, Homo sapiens
caaaccattttctat

SEQ ID NO: 94951 - DNA, 15 bp, Homo sapiens
ccaaaccattttcta

SEQ ID NO: 94952 - DNA, 15 bp, Homo sapiens
tccaaaccattttct

SEQ ID NO: 94953 - DNA, 15 bp, Homo sapiens
ttccaaaccattttc

SEQ ID NO: 94954 - DNA, 15 bp, Homo sapiens
cttccaaaccatttt

SEQ ID NO: 94955 - DNA, 15 bp, Homo sapiens
acttccaaaccattt

SEQ ID NO: 94956 - DNA, 15 bp, Homo sapiens
cacttccaaaccatt

SEQ ID NO: 94957 - DNA, 15 bp, Homo sapiens
ccacttccaaaccat

SEQ ID NO: 94958 - DNA, 15 bp, Homo sapiens
gccacttccaaacca

SEQ ID NO: 94959 - DNA, 15 bp, Homo sapiens
tgccacttccaaacc

SEQ ID NO: 94960 - DNA, 15 bp, Homo sapiens
ttgccacttccaaac

SEQ ID NO: 94961 - DNA, 15 bp, Homo sapiens
attgccacttccaaa

SEQ ID NO: 94962 - DNA, 15 bp, Homo sapiens
cattgccacttccaa

SEQ ID NO: 94963 - DNA, 15 bp, Homo sapiens
ctcattgccacttcc

SEQ ID NO: 94964 - DNA, 15 bp, Homo sapiens
cctcattgccacttc

SEQ ID NO: 94965 - DNA, 15 bp, Homo sapiens
tcctcattgccactt

SEQ ID NO: 94966 - DNA, 15 bp, Homo sapiens
atcctcattgccact

SEQ ID NO: 94967 - DNA, 15 bp, Homo sapiens
gatcctcattgccac

SEQ ID NO: 94968 - DNA, 15 bp, Homo sapiens
tgatcctcattgcca

SEQ ID NO: 94969 - DNA, 15 bp, Homo sapiens
ttgatcctcattgcc

SEQ ID NO: 94970 - DNA, 15 bp, Homo sapiens
cttgatcctcattgc

SEQ ID NO: 94971 - DNA, 15 bp, Homo sapiens
ccttgatcctcattg

SEQ ID NO: 94972 - DNA, 15 bp, Homo sapiens
tccttgatcctcatt

SEQ ID NO: 94973 - DNA, 15 bp, Homo sapiens
ttccttgatcctcat

SEQ ID NO: 94974 - DNA, 15 bp, Homo sapiens
cttccttgatcctca

SEQ ID NO: 94975 - DNA, 15 bp, Homo sapiens
ccttccttgatcctc

SEQ ID NO: 94976 - DNA, 15 bp, Homo sapiens
accttccttgatcct

SEQ ID NO: 94977 - DNA, 15 bp, Homo sapiens
caccttccttgatcc

SEQ ID NO: 94978 - DNA, 15 bp, Homo sapiens
tcaccttccttgatc

SEQ ID NO: 94979 - DNA, 15 bp, Homo sapiens
atcaccttccttgat

SEQ ID NO: 94980 - DNA, 15 bp, Homo sapiens
tatcaccttccttga

SEQ ID NO: 94981 - DNA, 15 bp, Homo sapiens
ttatcaccttccttg

SEQ ID NO: 94982 - DNA, 15 bp, Homo sapiens
attatcaccttcctt

SEQ ID NO: 94983 - DNA, 15 bp, Homo sapiens
aattatcaccttcct

SEQ ID NO: 94984 - DNA, 15 bp, Homo sapiens
taattatcaccttcc

SEQ ID NO: 94985 - DNA, 15 bp, Homo sapiens
ctaattatcaccttc

SEQ ID NO: 94986 - DNA, 15 bp, Homo sapiens
tctaattatcacctt

SEQ ID NO: 94987 - DNA, 15 bp, Homo sapiens
ttctaattatcacct

SEQ ID NO: 94988 - DNA, 15 bp, Homo sapiens
cttctaattatcacc

SEQ ID NO: 94989 - DNA, 15 bp, Homo sapiens
acttctaattatcac

SEQ ID NO: 94990 - DNA, 15 bp, Homo sapiens
aacttctaattatca

SEQ ID NO: 94991 - DNA, 15 bp, Homo sapiens
aaacttctaattatc

SEQ ID NO: 94992 - DNA, 15 bp, Homo sapiens
caaacttctaattat

SEQ ID NO: 94993 - DNA, 15 bp, Homo sapiens
acaaacttctaatta

SEQ ID NO: 94994 - DNA, 15 bp, Homo sapiens
tacaaacttctaatt

SEQ ID NO: 94995 - DNA, 15 bp, Homo sapiens
atacaaacttctaat

SEQ ID NO: 94996 - DNA, 15 bp, Homo sapiens
gatacaaacttctaa

SEQ ID NO: 94997 - DNA, 15 bp, Homo sapiens
agatacaaacttcta

SEQ ID NO: 94998 - DNA, 15 bp, Homo sapiens
gagatacaaacttct

SEQ ID NO: 94999 - DNA, 15 bp, Homo sapiens
agagatacaaacttc

SEQ ID NO: 95000 - DNA, 15 bp, Homo sapiens
tagagatacaaactt

SEQ ID NO: 95001 - DNA, 15 bp, Homo sapiens
atagagatacaaact

SEQ ID NO: 95002 - DNA, 15 bp, Homo sapiens
gatagagatacaaac

SEQ ID NO: 95003 - DNA, 15 bp, Homo sapiens
agatagagatacaaa

SEQ ID NO: 95004 - DNA, 15 bp, Homo sapiens
tagatagagatacaa

SEQ ID NO: 95005 - DNA, 15 bp, Homo sapiens
atagatagagataca

SEQ ID NO: 95006 - DNA, 15 bp, Homo sapiens
gatagatagagatac

SEQ ID NO: 95007 - DNA, 15 bp, Homo sapiens
ggatagatagataga

SEQ ID NO: 95008 - DNA, 15 bp, Homo sapiens
tggatagatagatag

SEQ ID NO: 95009 - DNA, 15 bp, Homo sapiens
atggatagatagata

SEQ ID NO: 95010 - DNA, 15 bp, Homo sapiens
gatggatagatagat

SEQ ID NO: 95011 - DNA, 15 bp, Homo sapiens
ggatggatagataga

SEQ ID NO: 95012 - DNA, 15 bp, Homo sapiens
tggatggatagatag

SEQ ID NO: 95013 - DNA, 15 bp, Homo sapiens
atggatggatagata

SEQ ID NO: 95014 - DNA, 15 bp, Homo sapiens
gatggatggatagat

SEQ ID NO: 95015 - DNA, 15 bp, Homo sapiens
ggatggatggataga

SEQ ID NO: 95016 - DNA, 15 bp, Homo sapiens
tggatggatggatag

SEQ ID NO: 95017 - DNA, 15 bp, Homo sapiens
gtggatggatggata

SEQ ID NO: 95018 - DNA, 15 bp, Homo sapiens
tgtggatggatggat

SEQ ID NO: 95019 - DNA, 15 bp, Homo sapiens
atgtggatggatgga

SEQ ID NO: 95020 - DNA, 15 bp, Homo sapiens
tatgtggatggatgg

SEQ ID NO: 95021 - DNA, 15 bp, Homo sapiens
gtatgtggatggatg

SEQ ID NO: 95022 - DNA, 15 bp, Homo sapiens
tgtatgtggatggat

SEQ ID NO: 95023 - DNA, 15 bp, Homo sapiens
atgtatgtggatgga

SEQ ID NO: 95024 - DNA, 15 bp, Homo sapiens
tatgtatgtggatgg

SEQ ID NO: 95025 - DNA, 15 bp, Homo sapiens
atatgtatgtggatg

SEQ ID NO: 95026 - DNA, 15 bp, Homo sapiens
catatgtatgtggat

SEQ ID NO: 95027 - DNA, 15 bp, Homo sapiens
ccatatgtatgtgga

SEQ ID NO: 95028 - DNA, 15 bp, Homo sapiens
accatatgtatgtgg

SEQ ID NO: 95029 - DNA, 15 bp, Homo sapiens
caccatatgtatgtg

SEQ ID NO: 95030 - DNA, 15 bp, Homo sapiens
tcaccatatgtatgt

SEQ ID NO: 95031 - DNA, 15 bp, Homo sapiens
gtcaccatatgtatg

SEQ ID NO: 95032 - DNA, 15 bp, Homo sapiens
tgtcaccatatgtat

SEQ ID NO: 95033 - DNA, 15 bp, Homo sapiens
ttgtcaccatatgta

SEQ ID NO: 95034 - DNA, 15 bp, Homo sapiens
tttgtcaccatatgt

SEQ ID NO: 95035 - DNA, 15 bp, Homo sapiens
atttgtcaccatatg

SEQ ID NO: 95036 - DNA, 15 bp, Homo sapiens
tatttgtcaccatat

SEQ ID NO: 95037 - DNA, 15 bp, Homo sapiens
ttatttgtcaccata

SEQ ID NO: 95038 - DNA, 15 bp, Homo sapiens
attatttgtcaccat

SEQ ID NO: 95039 - DNA, 15 bp, Homo sapiens
aattatttgtcacca

SEQ ID NO: 95040 - DNA, 15 bp, Homo sapiens
gaattatttgtcacc

SEQ ID NO: 95041 - DNA, 15 bp, Homo sapiens
tgaattatttgtcac

SEQ ID NO: 95042 - DNA, 15 bp, Homo sapiens
atgaattatttgtca

SEQ ID NO: 95043 - DNA, 15 bp, Homo sapiens
aatgaattatttgtc

SEQ ID NO: 95044 - DNA, 15 bp, Homo sapiens
caatgaattatttgt

SEQ ID NO: 95045 - DNA, 15 bp, Homo sapiens
acaatgaattatttg

SEQ ID NO: 95046 - DNA, 15 bp, Homo sapiens
cacaatgaattattt

SEQ ID NO: 95047 - DNA, 15 bp, Homo sapiens
tcacaatgaattatt

SEQ ID NO: 95048 - DNA, 15 bp, Homo sapiens
ttcacaatgaattat

SEQ ID NO: 95049 - DNA, 15 bp, Homo sapiens
attcacaatgaatta

SEQ ID NO: 95050 - DNA, 15 bp, Homo sapiens
aattcacaatgaatt

SEQ ID NO: 95051 - DNA, 15 bp, Homo sapiens
taattcacaatgaat

SEQ ID NO: 95052 - DNA, 15 bp, Homo sapiens
gtaattcacaatgaa

SEQ ID NO: 95053 - DNA, 15 bp, Homo sapiens
agtaattcacaatga

SEQ ID NO: 95054 - DNA, 15 bp, Homo sapiens
cagtaattcacaatg

SEQ ID NO: 95055 - DNA, 15 bp, Homo sapiens
tcagtaattcacaat

SEQ ID NO: 95056 - DNA, 15 bp, Homo sapiens
atcagtaattcacaa

SEQ ID NO: 95057 - DNA, 15 bp, Homo sapiens
aatcagtaattcaca

SEQ ID NO: 95058 - DNA, 15 bp, Homo sapiens
gaatcagtaattcac

SEQ ID NO: 95059 - DNA, 15 bp, Homo sapiens
tgaatcagtaattca

SEQ ID NO: 95060 - DNA, 15 bp, Homo sapiens
ttgaatcagtaattc

SEQ ID NO: 95061 - DNA, 15 bp, Homo sapiens
tttgaatcagtaatt

SEQ ID NO: 95062 - DNA, 15 bp, Homo sapiens
ttttgaatcagtaat

SEQ ID NO: 95063 - DNA, 15 bp, Homo sapiens
attttgaatcagtaa

SEQ ID NO: 95064 - DNA, 15 bp, Homo sapiens
tattttgaatcagta

SEQ ID NO: 95065 - DNA, 15 bp, Homo sapiens
gtattttgaatcagt

SEQ ID NO: 95066 - DNA, 15 bp, Homo sapiens
tgtattttgaatcag

SEQ ID NO: 95067 - DNA, 15 bp, Homo sapiens
ctgtattttgaatca

SEQ ID NO: 95068 - DNA, 15 bp, Homo sapiens
cctgtattttgaatc

SEQ ID NO: 95069 - DNA, 15 bp, Homo sapiens
tcctgtattttgaat

SEQ ID NO: 95070 - DNA, 15 bp, Homo sapiens
ttcctgtattttgaa

SEQ ID NO: 95071 - DNA, 15 bp, Homo sapiens
attcctgtattttga

SEQ ID NO: 95072 - DNA, 15 bp, Homo sapiens
tattcctgtattttg

SEQ ID NO: 95073 - DNA, 15 bp, Homo sapiens
ttattcctgtatttt

SEQ ID NO: 95074 - DNA, 15 bp, Homo sapiens
tttattcctgtattt

SEQ ID NO: 95075 - DNA, 15 bp, Homo sapiens
atttattcctgtatt

SEQ ID NO: 95076 - DNA, 15 bp, Homo sapiens
tatttattcctgtat

SEQ ID NO: 95077 - DNA, 15 bp, Homo sapiens
atatttattcctgta

SEQ ID NO: 95078 - DNA, 15 bp, Homo sapiens
tatatttattcctgt

SEQ ID NO: 95079 - DNA, 15 bp, Homo sapiens
atatatttattcctg

SEQ ID NO: 95080 - DNA, 15 bp, Homo sapiens
catatatttattcct

SEQ ID NO: 95081 - DNA, 15 bp, Homo sapiens
ccatatatttattcc

SEQ ID NO: 95082 - DNA, 15 bp, Homo sapiens
cccatatatttattc

SEQ ID NO: 95083 - DNA, 15 bp, Homo sapiens
tcccatatatttatt

SEQ ID NO: 95084 - DNA, 15 bp, Homo sapiens
ttcccatatatttat

SEQ ID NO: 95085 - DNA, 15 bp, Homo sapiens
tttcccatatattta

SEQ ID NO: 95086 - DNA, 15 bp, Homo sapiens
atttcccatatattt

SEQ ID NO: 95087 - DNA, 15 bp, Homo sapiens
aatttcccatatatt

SEQ ID NO: 95088 - DNA, 15 bp, Homo sapiens
aaatttcccatatat

SEQ ID NO: 95089 - DNA, 15 bp, Homo sapiens
taaatttcccatata

SEQ ID NO: 95090 - DNA, 15 bp, Homo sapiens
ttaaatttcccatat

SEQ ID NO: 95091 - DNA, 15 bp, Homo sapiens
tttaaatttcccata

SEQ ID NO: 95092 - DNA, 15 bp, Homo sapiens
ctttaaatttcccat

SEQ ID NO: 95093 - DNA, 15 bp, Homo sapiens
actttaaatttccca

SEQ ID NO: 95094 - DNA, 15 bp, Homo sapiens
cactttaaatttccc

SEQ ID NO: 95095 - DNA, 15 bp, Homo sapiens
acactttaaatttcc

SEQ ID NO: 95096 - DNA, 15 bp, Homo sapiens
gacactttaaatttc

SEQ ID NO: 95097 - DNA, 15 bp, Homo sapiens
ggacactttaaattt

SEQ ID NO: 95098 - DNA, 15 bp, Homo sapiens
aggacactttaaatt

SEQ ID NO: 95099 - DNA, 15 bp, Homo sapiens
gaggacactttaaat

SEQ ID NO: 95100 - DNA, 15 bp, Homo sapiens
tgaggacactttaaa

SEQ ID NO: 95101 - DNA, 15 bp, Homo sapiens
ctgaggacactttaa

SEQ ID NO: 95102 - DNA, 15 bp, Homo sapiens
cctgaggacacttta

SEQ ID NO: 95103 - DNA, 15 bp, Homo sapiens
tcctgaggacacttt

SEQ ID NO: 95104 - DNA, 15 bp, Homo sapiens
ttcctgaggacactt

SEQ ID NO: 95105 - DNA, 15 bp, Homo sapiens
cttcctgaggacact

SEQ ID NO: 95106 - DNA, 15 bp, Homo sapiens
ccttcctgaggacac

SEQ ID NO: 95107 - DNA, 15 bp, Homo sapiens
tccttcctgaggaca

SEQ ID NO: 95108 - DNA, 15 bp, Homo sapiens
ctccttcctgaggac

SEQ ID NO: 95109 - DNA, 15 bp, Homo sapiens
cctccttcctgagga

SEQ ID NO: 95110 - DNA, 15 bp, Homo sapiens
acctccttcctgagg

SEQ ID NO: 95111 - DNA, 15 bp, Homo sapiens
tacctccttcctgag

SEQ ID NO: 95112 - DNA, 15 bp, Homo sapiens
ttacctccttcctga

SEQ ID NO: 95113 - DNA, 15 bp, Homo sapiens
gttacctccttcctg

SEQ ID NO: 95114 - DNA, 15 bp, Homo sapiens
ggttacctccttcct

SEQ ID NO: 95115 - DNA, 15 bp, Homo sapiens
tggttacctccttcc

SEQ ID NO: 95116 - DNA, 15 bp, Homo sapiens
gtggttacctccttc

SEQ ID NO: 95117 - DNA, 15 bp, Homo sapiens
tgtggttacctcctt

SEQ ID NO: 95118 - DNA, 15 bp, Homo sapiens
atgtggttacctcct

SEQ ID NO: 95119 - DNA, 15 bp, Homo sapiens
catgtggttacctcc

SEQ ID NO: 95120 - DNA, 15 bp, Homo sapiens
acatgtggttacctc

SEQ ID NO: 95121 - DNA, 15 bp, Homo sapiens
cacatgtggttacct

SEQ ID NO: 95122 - DNA, 15 bp, Homo sapiens
acacatgtggttacc

SEQ ID NO: 95123 - DNA, 15 bp, Homo sapiens
cacacatgtggttac

SEQ ID NO: 95124 - DNA, 15 bp, Homo sapiens
tcacacatgtggtta

SEQ ID NO: 95125 - DNA, 15 bp, Homo sapiens
ttcacacatgtggtt

SEQ ID NO: 95126 - DNA, 15 bp, Homo sapiens
attcacacatgtggt

SEQ ID NO: 95127 - DNA, 15 bp, Homo sapiens
tattcacacatgtgg

SEQ ID NO: 95128 - DNA, 15 bp, Homo sapiens
ttattcacacatgtg

SEQ ID NO: 95129 - DNA, 15 bp, Homo sapiens
attattcacacatgt

SEQ ID NO: 95130 - DNA, 15 bp, Homo sapiens
aattattcacacatg

SEQ ID NO: 95131 - DNA, 15 bp, Homo sapiens
taattattcacacat

SEQ ID NO: 95132 - DNA, 15 bp, Homo sapiens
ataattattcacaca

SEQ ID NO: 95133 - DNA, 15 bp, Homo sapiens
gataattattcacac

SEQ ID NO: 95134 - DNA, 15 bp, Homo sapiens
agataattattcaca

SEQ ID NO: 95135 - DNA, 15 bp, Homo sapiens
tagataattattcac

SEQ ID NO: 95136 - DNA, 15 bp, Homo sapiens
ctagataattattca

SEQ ID NO: 95137 - DNA, 15 bp, Homo sapiens
tctagataattattc

SEQ ID NO: 95138 - DNA, 15 bp, Homo sapiens
ctctagataattatt

SEQ ID NO: 95139 - DNA, 15 bp, Homo sapiens
gctctagataattat

SEQ ID NO: 95140 - DNA, 15 bp, Homo sapiens
tgctctagataatta

SEQ ID NO: 95141 - DNA, 15 bp, Homo sapiens
atgctctagataatt

SEQ ID NO: 95142 - DNA, 15 bp, Homo sapiens
aatgctctagataat

SEQ ID NO: 95143 - DNA, 15 bp, Homo sapiens
aaatgctctagataa

SEQ ID NO: 95144 - DNA, 15 bp, Homo sapiens
gaaatgctctagata

SEQ ID NO: 95145 - DNA, 15 bp, Homo sapiens
ggaaatgctctagat

SEQ ID NO: 95146 - DNA, 15 bp, Homo sapiens
tggaaatgctctaga

SEQ ID NO: 95147 - DNA, 15 bp, Homo sapiens
ctggaaatgctctag

SEQ ID NO: 95148 - DNA, 15 bp, Homo sapiens
tctggaaatgctcta

SEQ ID NO: 95149 - DNA, 15 bp, Homo sapiens
gtctggaaatgctct

SEQ ID NO: 95150 - DNA, 15 bp, Homo sapiens
agtctggaaatgctc

SEQ ID NO: 95151 - DNA, 15 bp, Homo sapiens
tagtctggaaatgct

SEQ ID NO: 95152 - DNA, 15 bp, Homo sapiens
atagtctggaaatgc

SEQ ID NO: 95153 - DNA, 15 bp, Homo sapiens
aatagtctggaaatg

SEQ ID NO: 95154 - DNA, 15 bp, Homo sapiens
caatagtctggaaat

SEQ ID NO: 95155 - DNA, 15 bp, Homo sapiens
gcaatagtctggaaa

SEQ ID NO: 95156 - DNA, 15 bp, Homo sapiens
tgcaatagtctggaa

SEQ ID NO: 95157 - DNA, 15 bp, Homo sapiens
atgcaatagtctgga

SEQ ID NO: 95158 - DNA, 15 bp, Homo sapiens
aatgcaatagtctgg

SEQ ID NO: 95159 - DNA, 15 bp, Homo sapiens
caatgcaatagtctg

SEQ ID NO: 95160 - DNA, 15 bp, Homo sapiens
gcaatgcaatagtct

SEQ ID NO: 95161 - DNA, 15 bp, Homo sapiens
tgcaatgcaatagtc

SEQ ID NO: 95162 - DNA, 15 bp, Homo sapiens
atgcaatgcaatagt

SEQ ID NO: 95163 - DNA, 15 bp, Homo sapiens
aatgcaatgcaatag

SEQ ID NO: 95164 - DNA, 15 bp, Homo sapiens
caatgcaatgcaata

SEQ ID NO: 95165 - DNA, 15 bp, Homo sapiens
tcaatgcaatgcaat

SEQ ID NO: 95166 - DNA, 15 bp, Homo sapiens
gtcaatgcaatgcaa

SEQ ID NO: 95167 - DNA, 15 bp, Homo sapiens
agtcaatgcaatgca

SEQ ID NO: 95168 - DNA, 15 bp, Homo sapiens
tagtcaatgcaatgc

SEQ ID NO: 95169 - DNA, 15 bp, Homo sapiens
ctagtcaatgcaatg

SEQ ID NO: 95170 - DNA, 15 bp, Homo sapiens
actagtcaatgcaat

SEQ ID NO: 95171 - DNA, 15 bp, Homo sapiens
tactagtcaatgcaa

SEQ ID NO: 95172 - DNA, 15 bp, Homo sapiens
gtactagtcaatgca

SEQ ID NO: 95173 - DNA, 15 bp, Homo sapiens
tgtactagtcaatgc

SEQ ID NO: 95174 - DNA, 15 bp, Homo sapiens
ttgtactagtcaatg

SEQ ID NO: 95175 - DNA, 15 bp, Homo sapiens
tttgtactagtcaat

SEQ ID NO: 95176 - DNA, 15 bp, Homo sapiens
atttgtactagtcaa

SEQ ID NO: 95177 - DNA, 15 bp, Homo sapiens
catttgtactagtca

SEQ ID NO: 95178 - DNA, 15 bp, Homo sapiens
acatttgtactagtc

SEQ ID NO: 95179 - DNA, 15 bp, Homo sapiens
aacatttgtactagt

SEQ ID NO: 95180 - DNA, 15 bp, Homo sapiens
caacatttgtactag

SEQ ID NO: 95181 - DNA, 15 bp, Homo sapiens
tcaacatttgtacta

SEQ ID NO: 95182 - DNA, 15 bp, Homo sapiens
ttcaacatttgtact

SEQ ID NO: 95183 - DNA, 15 bp, Homo sapiens
cttcaacatttgtac

SEQ ID NO: 95184 - DNA, 15 bp, Homo sapiens
acttcaacatttgta

SEQ ID NO: 95185 - DNA, 15 bp, Homo sapiens
tacttcaacatttgt

SEQ ID NO: 95186 - DNA, 15 bp, Homo sapiens
ctacttcaacatttg

SEQ ID NO: 95187 - DNA, 15 bp, Homo sapiens
actacttcaacattt

SEQ ID NO: 95188 - DNA, 15 bp, Homo sapiens
aactacttcaacatt

SEQ ID NO: 95189 - DNA, 15 bp, Homo sapiens
aaactacttcaacat

SEQ ID NO: 95190 - DNA, 15 bp, Homo sapiens
aaaactacttcaaca

SEQ ID NO: 95191 - DNA, 15 bp, Homo sapiens
caaaactacttcaac

SEQ ID NO: 95192 - DNA, 15 bp, Homo sapiens
ccaaaactacttcaa

SEQ ID NO: 95193 - DNA, 15 bp, Homo sapiens
tccaaaactacttca

SEQ ID NO: 95194 - DNA, 15 bp, Homo sapiens
gtccaaaactacttc

SEQ ID NO: 95195 - DNA, 15 bp, Homo sapiens
tgtccaaaactactt

SEQ ID NO: 95196 - DNA, 15 bp, Homo sapiens
ttgtccaaaactact

SEQ ID NO: 95197 - DNA, 15 bp, Homo sapiens
tttgtccaaaactac

SEQ ID NO: 95198 - DNA, 15 bp, Homo sapiens
gtttgtccaaaacta

SEQ ID NO: 95199 - DNA, 15 bp, Homo sapiens
tgtttgtccaaaact

SEQ ID NO: 95200 - DNA, 15 bp, Homo sapiens
atgtttgtccaaaac

SEQ ID NO: 95201 - DNA, 15 bp, Homo sapiens
tatgtttgtccaaaa

SEQ ID NO: 95202 - DNA, 15 bp, Homo sapiens
ttatgtttgtccaaa

SEQ ID NO: 95203 - DNA, 15 bp, Homo sapiens
attatgtttgtccaa

SEQ ID NO: 95204 - DNA, 15 bp, Homo sapiens
aattatgtttgtcca

SEQ ID NO: 95205 - DNA, 15 bp, Homo sapiens
aaattatgtttgtcc

SEQ ID NO: 95206 - DNA, 15 bp, Homo sapiens
aaaattatgtttgtc

SEQ ID NO: 95207 - DNA, 15 bp, Homo sapiens
caaaattatgtttgt

SEQ ID NO: 95208 - DNA, 15 bp, Homo sapiens
gcaaaattatgtttg

SEQ ID NO: 95209 - DNA, 15 bp, Homo sapiens
ggcaaaattatgttt

SEQ ID NO: 95210 - DNA, 15 bp, Homo sapiens
tggcaaaattatgtt

SEQ ID NO: 95211 - DNA, 15 bp, Homo sapiens
ttggcaaaattatgt

SEQ ID NO: 95212 - DNA, 15 bp, Homo sapiens
tttggcaaaattatg

SEQ ID NO: 95213 - DNA, 15 bp, Homo sapiens
atttggcaaaattat

SEQ ID NO: 95214 - DNA, 15 bp, Homo sapiens
aatttggcaaaatta

SEQ ID NO: 95215 - DNA, 15 bp, Homo sapiens
aaatttggcaaaatt

SEQ ID NO: 95216 - DNA, 15 bp, Homo sapiens
aaaatttggcaaaat

SEQ ID NO: 95217 - DNA, 15 bp, Homo sapiens
gaaaatttggcaaaa

SEQ ID NO: 95218 - DNA, 15 bp, Homo sapiens
tgaaaatttggcaaa

SEQ ID NO: 95219 - DNA, 15 bp, Homo sapiens
atgaaaatttggcaa

SEQ ID NO: 95220 - DNA, 15 bp, Homo sapiens
aatgaaaatttggca

SEQ ID NO: 95221 - DNA, 15 bp, Homo sapiens
aaatgaaaatttggc

SEQ ID NO: 95222 - DNA, 15 bp, Homo sapiens
aaaatgaaaatttgg

SEQ ID NO: 95223 - DNA, 15 bp, Homo sapiens
caaaatgaaaatttg

SEQ ID NO: 95224 - DNA, 15 bp, Homo sapiens
gcaaaatgaaaattt

SEQ ID NO: 95225 - DNA, 15 bp, Homo sapiens
agcaaaatgaaaatt

SEQ ID NO: 95226 - DNA, 15 bp, Homo sapiens
tagcaaaatgaaaat

SEQ ID NO: 95227 - DNA, 15 bp, Homo sapiens
ttagcaaaatgaaaa

SEQ ID NO: 95228 - DNA, 15 bp, Homo sapiens
tttagcaaaatgaaa

SEQ ID NO: 95229 - DNA, 15 bp, Homo sapiens
ttttagcaaaatgaa

SEQ ID NO: 95230 - DNA, 15 bp, Homo sapiens
tttttagcaaaatga

SEQ ID NO: 95231 - DNA, 15 bp, Homo sapiens
ctttttagcaaaatg

SEQ ID NO: 95232 - DNA, 15 bp, Homo sapiens
tctttttagcaaaat

SEQ ID NO: 95233 - DNA, 15 bp, Homo sapiens
ttctttttagcaaaa

SEQ ID NO: 95234 - DNA, 15 bp, Homo sapiens
gttctttttagcaaa

SEQ ID NO: 95235 - DNA, 15 bp, Homo sapiens
tgttctttttagcaa

SEQ ID NO: 95236 - DNA, 15 bp, Homo sapiens
ctgttctttttagca

SEQ ID NO: 95237 - DNA, 15 bp, Homo sapiens
cctgttctttttagc

SEQ ID NO: 95238 - DNA, 15 bp, Homo sapiens
gcctgttctttttag

SEQ ID NO: 95239 - DNA, 15 bp, Homo sapiens
tgcctgttcttttta

SEQ ID NO: 95240 - DNA, 15 bp, Homo sapiens
atgcctgttcttttt

SEQ ID NO: 95241 - DNA, 15 bp, Homo sapiens
tatgcctgttctttt

SEQ ID NO: 95242 - DNA, 15 bp, Homo sapiens
atatgcctgttcttt

SEQ ID NO: 95243 - DNA, 15 bp, Homo sapiens
tatatgcctgttctt

SEQ ID NO: 95244 - DNA, 15 bp, Homo sapiens
ttatatgcctgttct

SEQ ID NO: 95245 - DNA, 15 bp, Homo sapiens
tttatatgcctgttc

SEQ ID NO: 95246 - DNA, 15 bp, Homo sapiens
ttttatatgcctgtt

SEQ ID NO: 95247 - DNA, 15 bp, Homo sapiens
gttttatatgcctgt

SEQ ID NO: 95248 - DNA, 15 bp, Homo sapiens
tgttttatatgcctg

SEQ ID NO: 95249 - DNA, 15 bp, Homo sapiens
ttgttttatatgcct

SEQ ID NO: 95250 - DNA, 15 bp, Homo sapiens
tttgttttatatgcc

SEQ ID NO: 95251 - DNA, 15 bp, Homo sapiens
atttgttttatatgc

SEQ ID NO: 95252 - DNA, 15 bp, Homo sapiens
gatttgttttatatg

SEQ ID NO: 95253 - DNA, 15 bp, Homo sapiens
tgatttgttttatat

SEQ ID NO: 95254 - DNA, 15 bp, Homo sapiens
ttgatttgttttata

SEQ ID NO: 95255 - DNA, 15 bp, Homo sapiens
gttgatttgttttat

SEQ ID NO: 95256 - DNA, 15 bp, Homo sapiens
tgttgatttgtttta

SEQ ID NO: 95257 - DNA, 15 bp, Homo sapiens
ttgttgatttgtttt

SEQ ID NO: 95258 - DNA, 15 bp, Homo sapiens
tttgttgatttgttt

SEQ ID NO: 95259 - DNA, 15 bp, Homo sapiens
gtttgttgatttgtt

SEQ ID NO: 95260 - DNA, 15 bp, Homo sapiens
tgtttgttgatttgt

SEQ ID NO: 95261 - DNA, 15 bp, Homo sapiens
ttgtttgttgatttg

SEQ ID NO: 95262 - DNA, 15 bp, Homo sapiens
tttgtttgttgattt

SEQ ID NO: 95263 - DNA, 15 bp, Homo sapiens
ctttgtttgttgatt

SEQ ID NO: 95264 - DNA, 15 bp, Homo sapiens
tctttgtttgttgat

SEQ ID NO: 95265 - DNA, 15 bp, Homo sapiens
atctttgtttgttga

SEQ ID NO: 95266 - DNA, 15 bp, Homo sapiens
tatctttgtttgttg

SEQ ID NO: 95267 - DNA, 15 bp, Homo sapiens
ctatctttgtttgtt

SEQ ID NO: 95268 - DNA, 15 bp, Homo sapiens
actatctttgtttgt

SEQ ID NO: 95269 - DNA, 15 bp, Homo sapiens
gactatctttgtttg

SEQ ID NO: 95270 - DNA, 15 bp, Homo sapiens
agactatctttgttt

SEQ ID NO: 95271 - DNA, 15 bp, Homo sapiens
tagactatctttgtt

SEQ ID NO: 95272 - DNA, 15 bp, Homo sapiens
atagactatctttgt

SEQ ID NO: 95273 - DNA, 15 bp, Homo sapiens
aatagactatctttg

SEQ ID NO: 95274 - DNA, 15 bp, Homo sapiens
aaatagactatcttt

SEQ ID NO: 95275 - DNA, 15 bp, Homo sapiens
gaaatagactatctt

SEQ ID NO: 95276 - DNA, 15 bp, Homo sapiens
tgaaatagactatct

SEQ ID NO: 95277 - DNA, 15 bp, Homo sapiens
atgaaatagactatc

SEQ ID NO: 95278 - DNA, 15 bp, Homo sapiens
gatgaaatagactat

SEQ ID NO: 95279 - DNA, 15 bp, Homo sapiens
agatgaaatagacta

SEQ ID NO: 95280 - DNA, 15 bp, Homo sapiens
tagatgaaatagact

SEQ ID NO: 95281 - DNA, 15 bp, Homo sapiens
atagatgaaatagac

SEQ ID NO: 95282 - DNA, 15 bp, Homo sapiens
aatagatgaaataga

SEQ ID NO: 95283 - DNA, 15 bp, Homo sapiens
taatagatgaaatag

SEQ ID NO: 95284 - DNA, 15 bp, Homo sapiens
ataatagatgaaata

SEQ ID NO: 95285 - DNA, 15 bp, Homo sapiens
tataatagatgaaat

SEQ ID NO: 95286 - DNA, 15 bp, Homo sapiens
atataatagatgaaa

SEQ ID NO: 95287 - DNA, 15 bp, Homo sapiens
aatataatagatgaa

SEQ ID NO: 95288 - DNA, 15 bp, Homo sapiens
gaatataatagatga

SEQ ID NO: 95289 - DNA, 15 bp, Homo sapiens
tgaatataatagatg

SEQ ID NO: 95290 - DNA, 15 bp, Homo sapiens
atgaatataatagat

SEQ ID NO: 95291 - DNA, 15 bp, Homo sapiens
catgaatataataga

SEQ ID NO: 95292 - DNA, 15 bp, Homo sapiens
tcatgaatataatag

SEQ ID NO: 95293 - DNA, 15 bp, Homo sapiens
atcatgaatataata

SEQ ID NO: 95294 - DNA, 15 bp, Homo sapiens
tatcatgaatataat

SEQ ID NO: 95295 - DNA, 15 bp, Homo sapiens
atatcatgaatataa

SEQ ID NO: 95296 - DNA, 15 bp, Homo sapiens
gatatcatgaatata

SEQ ID NO: 95297 - DNA, 15 bp, Homo sapiens
ggatatcatgaatat

SEQ ID NO: 95298 - DNA, 15 bp, Homo sapiens
aggatatcatgaata

SEQ ID NO: 95299 - DNA, 15 bp, Homo sapiens
caggatatcatgaat

SEQ ID NO: 95300 - DNA, 15 bp, Homo sapiens
tcaggatatcatgaa

SEQ ID NO: 95301 - DNA, 15 bp, Homo sapiens
ttcaggatatcatga

SEQ ID NO: 95302 - DNA, 15 bp, Homo sapiens
tttcaggatatcatg

SEQ ID NO: 95303 - DNA, 15 bp, Homo sapiens
ttttcaggatatcat

SEQ ID NO: 95304 - DNA, 15 bp, Homo sapiens
tttttcaggatatca

SEQ ID NO: 95305 - DNA, 15 bp, Homo sapiens
ttttttcaggatatc

SEQ ID NO: 95306 - DNA, 15 bp, Homo sapiens
tttttttcaggatat

SEQ ID NO: 95307 - DNA, 15 bp, Homo sapiens
ctttttttcaggata

SEQ ID NO: 95308 - DNA, 15 bp, Homo sapiens
cctttttttcaggat

SEQ ID NO: 95309 - DNA, 15 bp, Homo sapiens
tcctttttttcagga

SEQ ID NO: 95310 - DNA, 15 bp, Homo sapiens
ttcctttttttcagg

SEQ ID NO: 95311 - DNA, 15 bp, Homo sapiens
gttcctttttttcag

SEQ ID NO: 95312 - DNA, 15 bp, Homo sapiens
tgttcctttttttca

SEQ ID NO: 95313 - DNA, 15 bp, Homo sapiens
atgttcctttttttc

SEQ ID NO: 95314 - DNA, 15 bp, Homo sapiens
aatgttccttttttt

SEQ ID NO: 95315 - DNA, 15 bp, Homo sapiens
aaatgttcctttttt

SEQ ID NO: 95316 - DNA, 15 bp, Homo sapiens
aaaatgttccttttt

SEQ ID NO: 95317 - DNA, 15 bp, Homo sapiens
taaaatgttcctttt

SEQ ID NO: 95318 - DNA, 15 bp, Homo sapiens
ttaaaatgttccttt

SEQ ID NO: 95319 - DNA, 15 bp, Homo sapiens
attaaaatgttcctt

SEQ ID NO: 95320 - DNA, 15 bp, Homo sapiens
cattaaaatgttcct

SEQ ID NO: 95321 - DNA, 15 bp, Homo sapiens
gcattaaaatgttcc

SEQ ID NO: 95322 - DNA, 15 bp, Homo sapiens
ggcattaaaatgttc

SEQ ID NO: 95323 - DNA, 15 bp, Homo sapiens
tggcattaaaatgtt

SEQ ID NO: 95324 - DNA, 15 bp, Homo sapiens
ttggcattaaaatgt

SEQ ID NO: 95325 - DNA, 15 bp, Homo sapiens
tttggcattaaaatg

SEQ ID NO: 95326 - DNA, 15 bp, Homo sapiens
ttttggcattaaaat

SEQ ID NO: 95327 - DNA, 15 bp, Homo sapiens
tttttggcattaaaa

SEQ ID NO: 95328 - DNA, 15 bp, Homo sapiens
ttttttggcattaaa

SEQ ID NO: 95329 - DNA, 15 bp, Homo sapiens
attttttggcattaa

SEQ ID NO: 95330 - DNA, 15 bp, Homo sapiens
tattttttggcatta

SEQ ID NO: 95331 - DNA, 15 bp, Homo sapiens
ctattttttggcatt

SEQ ID NO: 95332 - DNA, 15 bp, Homo sapiens
tctattttttggcat

SEQ ID NO: 95333 - DNA, 15 bp, Homo sapiens
ttctattttttggca

SEQ ID NO: 95334 - DNA, 15 bp, Homo sapiens
tttctattttttggc

SEQ ID NO: 95335 - DNA, 15 bp, Homo sapiens
ctttctattttttgg

SEQ ID NO: 95336 - DNA, 15 bp, Homo sapiens
actttctattttttg

SEQ ID NO: 95337 - DNA, 15 bp, Homo sapiens
tactttctatttttt

SEQ ID NO: 95338 - DNA, 15 bp, Homo sapiens
atactttctattttt

SEQ ID NO: 95339 - DNA, 15 bp, Homo sapiens
tatactttctatttt

SEQ ID NO: 95340 - DNA, 15 bp, Homo sapiens
atatactttctattt

SEQ ID NO: 95341 - DNA, 15 bp, Homo sapiens
tatatactttctatt

SEQ ID NO: 95342 - DNA, 15 bp, Homo sapiens
atatatactttctat

SEQ ID NO: 95343 - DNA, 15 bp, Homo sapiens
aatatatactttcta

SEQ ID NO: 95344 - DNA, 15 bp, Homo sapiens
gaatatatactttct

SEQ ID NO: 95345 - DNA, 15 bp, Homo sapiens
agaatatatactttc

SEQ ID NO: 95346 - DNA, 15 bp, Homo sapiens
gagaatatatacttt

SEQ ID NO: 95347 - DNA, 15 bp, Homo sapiens
tgagaatatatactt

SEQ ID NO: 95348 - DNA, 15 bp, Homo sapiens
ctgagaatatatact

SEQ ID NO: 95349 - DNA, 15 bp, Homo sapiens
cctgagaatatatac

SEQ ID NO: 95350 - DNA, 15 bp, Homo sapiens
tcctgagaatatata

SEQ ID NO: 95351 - DNA, 15 bp, Homo sapiens
atcctgagaatatat

SEQ ID NO: 95352 - DNA, 15 bp, Homo sapiens
tatcctgagaatata

SEQ ID NO: 95353 - DNA, 15 bp, Homo sapiens
ttatcctgagaatat

SEQ ID NO: 95354 - DNA, 15 bp, Homo sapiens
attatcctgagaata

SEQ ID NO: 95355 - DNA, 15 bp, Homo sapiens
aattatcctgagaat

SEQ ID NO: 95356 - DNA, 15 bp, Homo sapiens
taattatcctgagaa

SEQ ID NO: 95357 - DNA, 15 bp, Homo sapiens
ttaattatcctgaga

SEQ ID NO: 95358 - DNA, 15 bp, Homo sapiens
tttaattatcctgag

SEQ ID NO: 95359 - DNA, 15 bp, Homo sapiens
ctttaattatcctga

SEQ ID NO: 95360 - DNA, 15 bp, Homo sapiens
tctttaattatcctg

SEQ ID NO: 95361 - DNA, 15 bp, Homo sapiens
atctttaattatcct

SEQ ID NO: 95362 - DNA, 15 bp, Homo sapiens
tatctttaattatcc

SEQ ID NO: 95363 - DNA, 15 bp, Homo sapiens
ttatctttaattatc

SEQ ID NO: 95364 - DNA, 15 bp, Homo sapiens
attatctttaattat

SEQ ID NO: 95365 - DNA, 15 bp, Homo sapiens
aattatctttaatta

SEQ ID NO: 95366 - DNA, 15 bp, Homo sapiens
aaattatctttaatt

SEQ ID NO: 95367 - DNA, 15 bp, Homo sapiens
aaaattatctttaat

SEQ ID NO: 95368 - DNA, 15 bp, Homo sapiens
caaaattatctttaa

SEQ ID NO: 95369 - DNA, 15 bp, Homo sapiens
tcaaaattatcttta

SEQ ID NO: 95370 - DNA, 15 bp, Homo sapiens
ctcaaaattatcttt

SEQ ID NO: 95371 - DNA, 15 bp, Homo sapiens
cctcaaaattatctt

SEQ ID NO: 95372 - DNA, 15 bp, Homo sapiens
ccctcaaaattatct

SEQ ID NO: 95373 - DNA, 15 bp, Homo sapiens
accctcaaaattatc

SEQ ID NO: 95374 - DNA, 15 bp, Homo sapiens
caccctcaaaattat

SEQ ID NO: 95375 - DNA, 15 bp, Homo sapiens
acaccctcaaaatta

SEQ ID NO: 95376 - DNA, 15 bp, Homo sapiens
aacaccctcaaaatt

SEQ ID NO: 95377 - DNA, 15 bp, Homo sapiens
aaacaccctcaaaat

SEQ ID NO: 95378 - DNA, 15 bp, Homo sapiens
aaaacaccctcaaaa

SEQ ID NO: 95379 - DNA, 15 bp, Homo sapiens
caaaacaccctcaaa

SEQ ID NO: 95380 - DNA, 15 bp, Homo sapiens
acaaaacaccctcaa

SEQ ID NO: 95381 - DNA, 15 bp, Homo sapiens
aacaaaacaccctca

SEQ ID NO: 95382 - DNA, 15 bp, Homo sapiens
caacaaaacaccctc

SEQ ID NO: 95383 - DNA, 15 bp, Homo sapiens
acaacaaaacaccct

SEQ ID NO: 95384 - DNA, 15 bp, Homo sapiens
aacaacaaaacaccc

SEQ ID NO: 95385 - DNA, 15 bp, Homo sapiens
caacaacaaaacacc

SEQ ID NO: 95386 - DNA, 15 bp, Homo sapiens
acaacaacaaaacac

SEQ ID NO: 95387 - DNA, 15 bp, Homo sapiens
aacaacaacaaaaca

SEQ ID NO: 95388 - DNA, 15 bp, Homo sapiens
taacaacaacaaaac

SEQ ID NO: 95389 - DNA, 15 bp, Homo sapiens
ttaacaacaacaaaa

SEQ ID NO: 95390 - DNA, 15 bp, Homo sapiens
cttaacaacaacaaa

SEQ ID NO: 95391 - DNA, 15 bp, Homo sapiens
gcttaacaacaacaa

SEQ ID NO: 95392 - DNA, 15 bp, Homo sapiens
agcttaacaacaaca

SEQ ID NO: 95393 - DNA, 15 bp, Homo sapiens
aagcttaacaacaac

SEQ ID NO: 95394 - DNA, 15 bp, Homo sapiens
taagcttaacaacaa

SEQ ID NO: 95395 - DNA, 15 bp, Homo sapiens
ataagcttaacaaca

SEQ ID NO: 95396 - DNA, 15 bp, Homo sapiens
cataagcttaacaac

SEQ ID NO: 95397 - DNA, 15 bp, Homo sapiens
ccataagcttaacaa

SEQ ID NO: 95398 - DNA, 15 bp, Homo sapiens
accataagcttaaca

SEQ ID NO: 95399 - DNA, 15 bp, Homo sapiens
taccataagcttaac

SEQ ID NO: 95400 - DNA, 15 bp, Homo sapiens
ctaccataagcttaa

SEQ ID NO: 95401 - DNA, 15 bp, Homo sapiens
actaccataagctta

SEQ ID NO: 95402 - DNA, 15 bp, Homo sapiens
cactaccataagctt

SEQ ID NO: 95403 - DNA, 15 bp, Homo sapiens
acactaccataagct

SEQ ID NO: 95404 - DNA, 15 bp, Homo sapiens
gacactaccataagc

SEQ ID NO: 95405 - DNA, 15 bp, Homo sapiens
agacactaccataag

SEQ ID NO: 95406 - DNA, 15 bp, Homo sapiens
aagacactaccataa

SEQ ID NO: 95407 - DNA, 15 bp, Homo sapiens
aaagacactaccata

SEQ ID NO: 95408 - DNA, 15 bp, Homo sapiens
taaagacactaccat

SEQ ID NO: 95409 - DNA, 15 bp, Homo sapiens
ataaagacactacca

SEQ ID NO: 95410 - DNA, 15 bp, Homo sapiens
aataaagacactacc

SEQ ID NO: 95411 - DNA, 15 bp, Homo sapiens
aaataaagacactac

SEQ ID NO: 95412 - DNA, 15 bp, Homo sapiens
aaaataaagacacta

SEQ ID NO: 95413 - DNA, 15 bp, Homo sapiens
gaaaataaagacact

SEQ ID NO: 95414 - DNA, 15 bp, Homo sapiens
agaaaataaagacac

SEQ ID NO: 95415 - DNA, 15 bp, Homo sapiens
aagaaaataaagaca

SEQ ID NO: 95416 - DNA, 15 bp, Homo sapiens
gaagaaaataaagac

SEQ ID NO: 95417 - DNA, 15 bp, Homo sapiens
tgaagaaaataaaga

SEQ ID NO: 95418 - DNA, 15 bp, Homo sapiens
atgaagaaaataaag

SEQ ID NO: 95419 - DNA, 15 bp, Homo sapiens
aatgaagaaaataaa

SEQ ID NO: 95420 - DNA, 15 bp, Homo sapiens
aaatgaagaaaataa

SEQ ID NO: 95421 - DNA, 15 bp, Homo sapiens
gaaatgaagaaaata

SEQ ID NO: 95422 - DNA, 15 bp, Homo sapiens
agaaatgaagaaaat

SEQ ID NO: 95423 - DNA, 15 bp, Homo sapiens
aaagaaatgaagaaa

SEQ ID NO: 95424 - DNA, 15 bp, Homo sapiens
aaaagaaatgaagaa

SEQ ID NO: 95425 - DNA, 15 bp, Homo sapiens
aaaaagaaatgaaga

SEQ ID NO: 95426 - DNA, 15 bp, Homo sapiens
caaaaagaaatgaag

SEQ ID NO: 95427 - DNA, 15 bp, Homo sapiens
ccaaaaagaaatgaa

SEQ ID NO: 95428 - DNA, 15 bp, Homo sapiens
tccaaaaagaaatga

SEQ ID NO: 95429 - DNA, 15 bp, Homo sapiens
atccaaaaagaaatg

SEQ ID NO: 95430 - DNA, 15 bp, Homo sapiens
gatccaaaaagaaat

SEQ ID NO: 95431 - DNA, 15 bp, Homo sapiens
agatccaaaaagaaa

SEQ ID NO: 95432 - DNA, 15 bp, Homo sapiens
cagatccaaaaagaa

SEQ ID NO: 95433 - DNA, 15 bp, Homo sapiens
acagatccaaaaaga

SEQ ID NO: 95434 - DNA, 15 bp, Homo sapiens
cacagatccaaaaag

SEQ ID NO: 95435 - DNA, 15 bp, Homo sapiens
tcacagatccaaaaa

SEQ ID NO: 95436 - DNA, 15 bp, Homo sapiens
ttcacagatccaaaa

SEQ ID NO: 95437 - DNA, 15 bp, Homo sapiens
tttcacagatccaaa

SEQ ID NO: 95438 - DNA, 15 bp, Homo sapiens
ttttcacagatccaa

SEQ ID NO: 95439 - DNA, 15 bp, Homo sapiens
attttcacagatcca

SEQ ID NO: 95440 - DNA, 15 bp, Homo sapiens
aattttcacagatcc

SEQ ID NO: 95441 - DNA, 15 bp, Homo sapiens
taattttcacagatc

SEQ ID NO: 95442 - DNA, 15 bp, Homo sapiens
ataattttcacagat

SEQ ID NO: 95443 - DNA, 15 bp, Homo sapiens
tataattttcacaga

SEQ ID NO: 95444 - DNA, 15 bp, Homo sapiens
atataattttcacag

SEQ ID NO: 95445 - DNA, 15 bp, Homo sapiens
aatataattttcaca

SEQ ID NO: 95446 - DNA, 15 bp, Homo sapiens
caatataattttcac

SEQ ID NO: 95447 - DNA, 15 bp, Homo sapiens
gcaatataattttca

SEQ ID NO: 95448 - DNA, 15 bp, Homo sapiens
agcaatataattttc

SEQ ID NO: 95449 - DNA, 15 bp, Homo sapiens
cagcaatataatttt

SEQ ID NO: 95450 - DNA, 15 bp, Homo sapiens
tcagcaatataattt

SEQ ID NO: 95451 - DNA, 15 bp, Homo sapiens
gtcagcaatataatt

SEQ ID NO: 95452 - DNA, 15 bp, Homo sapiens
agtcagcaatataat

SEQ ID NO: 95453 - DNA, 15 bp, Homo sapiens
tagtcagcaatataa

SEQ ID NO: 95454 - DNA, 15 bp, Homo sapiens
ctagtcagcaatata

SEQ ID NO: 95455 - DNA, 15 bp, Homo sapiens
actagtcagcaatat

SEQ ID NO: 95456 - DNA, 15 bp, Homo sapiens
cactagtcagcaata

SEQ ID NO: 95457 - DNA, 15 bp, Homo sapiens
acactagtcagcaat

SEQ ID NO: 95458 - DNA, 15 bp, Homo sapiens
aacactagtcagcaa

SEQ ID NO: 95459 - DNA, 15 bp, Homo sapiens
gaacactagtcagca

SEQ ID NO: 95460 - DNA, 15 bp, Homo sapiens
tgaacactagtcagc

SEQ ID NO: 95461 - DNA, 15 bp, Homo sapiens
ttgaacactagtcag

SEQ ID NO: 95462 - DNA, 15 bp, Homo sapiens
cttgaacactagtca

SEQ ID NO: 95463 - DNA, 15 bp, Homo sapiens
tcttgaacactagtc

SEQ ID NO: 95464 - DNA, 15 bp, Homo sapiens
ttcttgaacactagt

SEQ ID NO: 95465 - DNA, 15 bp, Homo sapiens
cttcttgaacactag

SEQ ID NO: 95466 - DNA, 15 bp, Homo sapiens
acttcttgaacacta

SEQ ID NO: 95467 - DNA, 15 bp, Homo sapiens
tacttcttgaacact

SEQ ID NO: 95468 - DNA, 15 bp, Homo sapiens
gtacttcttgaacac

SEQ ID NO: 95469 - DNA, 15 bp, Homo sapiens
tgtacttcttgaaca

SEQ ID NO: 95470 - DNA, 15 bp, Homo sapiens
gtgtacttcttgaac

SEQ ID NO: 95471 - DNA, 15 bp, Homo sapiens
tgtgtacttcttgaa

SEQ ID NO: 95472 - DNA, 15 bp, Homo sapiens
atgtgtacttcttga

SEQ ID NO: 95473 - DNA, 15 bp, Homo sapiens
tatgtgtacttcttg

SEQ ID NO: 95474 - DNA, 15 bp, Homo sapiens
gtatgtgtacttctt

SEQ ID NO: 95475 - DNA, 15 bp, Homo sapiens
tgtatgtgtacttct

SEQ ID NO: 95476 - DNA, 15 bp, Homo sapiens
ctgtatgtgtacttc

SEQ ID NO: 95477 - DNA, 15 bp, Homo sapiens
tctgtatgtgtactt

SEQ ID NO: 95478 - DNA, 15 bp, Homo sapiens
ctctgtatgtgtact

SEQ ID NO: 95479 - DNA, 15 bp, Homo sapiens
tctctgtatgtgtac

SEQ ID NO: 95480 - DNA, 15 bp, Homo sapiens
ttctctgtatgtgta

SEQ ID NO: 95481 - DNA, 15 bp, Homo sapiens
attctctgtatgtgt

SEQ ID NO: 95482 - DNA, 15 bp, Homo sapiens
aattctctgtatgtg

SEQ ID NO: 95483 - DNA, 15 bp, Homo sapiens
aaattctctgtatgt

SEQ ID NO: 95484 - DNA, 15 bp, Homo sapiens
aaaattctctgtatg

SEQ ID NO: 95485 - DNA, 15 bp, Homo sapiens
gaaaattctctgtat

SEQ ID NO: 95486 - DNA, 15 bp, Homo sapiens
agaaaattctctgta

SEQ ID NO: 95487 - DNA, 15 bp, Homo sapiens
cagaaaattctctgt

SEQ ID NO: 95488 - DNA, 15 bp, Homo sapiens
ccagaaaattctctg

SEQ ID NO: 95489 - DNA, 15 bp, Homo sapiens
tccagaaaattctct

SEQ ID NO: 95490 - DNA, 15 bp, Homo sapiens
ttccagaaaattctc

SEQ ID NO: 95491 - DNA, 15 bp, Homo sapiens
tttccagaaaattct

SEQ ID NO: 95492 - DNA, 15 bp, Homo sapiens
atttccagaaaattc

SEQ ID NO: 95493 - DNA, 15 bp, Homo sapiens
catttccagaaaatt

SEQ ID NO: 95494 - DNA, 15 bp, Homo sapiens
ccatttccagaaaat

SEQ ID NO: 95495 - DNA, 15 bp, Homo sapiens
cccatttccagaaaa

SEQ ID NO: 95496 - DNA, 15 bp, Homo sapiens
ccccatttccagaaa

SEQ ID NO: 95497 - DNA, 15 bp, Homo sapiens
gccccatttccagaa

SEQ ID NO: 95498 - DNA, 15 bp, Homo sapiens
ggccccatttccaga

SEQ ID NO: 95499 - DNA, 15 bp, Homo sapiens
gggccccatttccag

SEQ ID NO: 95500 - DNA, 15 bp, Homo sapiens
tgggccccatttcca

SEQ ID NO: 95501 - DNA, 15 bp, Homo sapiens
ttgggccccatttcc

SEQ ID NO: 95502 - DNA, 15 bp, Homo sapiens
cttgggccccatttc

SEQ ID NO: 95503 - DNA, 15 bp, Homo sapiens
tcttgggccccattt

SEQ ID NO: 95504 - DNA, 15 bp, Homo sapiens
ttcttgggccccatt

SEQ ID NO: 95505 - DNA, 15 bp, Homo sapiens
attcttgggccccat

SEQ ID NO: 95506 - DNA, 15 bp, Homo sapiens
gattcttgggcccca

SEQ ID NO: 95507 - DNA, 15 bp, Homo sapiens
agattcttgggcccc

SEQ ID NO: 95508 - DNA, 15 bp, Homo sapiens
gagattcttgggccc

SEQ ID NO: 95509 - DNA, 15 bp, Homo sapiens
agagattcttgggcc

SEQ ID NO: 95510 - DNA, 15 bp, Homo sapiens
cagagattcttgggc

SEQ ID NO: 95511 - DNA, 15 bp, Homo sapiens
acagagattcttggg

SEQ ID NO: 95512 - DNA, 15 bp, Homo sapiens
gacagagattcttgg

SEQ ID NO: 95513 - DNA, 15 bp, Homo sapiens
agacagagattcttg

SEQ ID NO: 95514 - DNA, 15 bp, Homo sapiens
gagacagagattctt

SEQ ID NO: 95515 - DNA, 15 bp, Homo sapiens
agagacagagattct

SEQ ID NO: 95516 - DNA, 15 bp, Homo sapiens
gagagacagagattc

SEQ ID NO: 95517 - DNA, 15 bp, Homo sapiens
agagagacagagatt

SEQ ID NO: 95518 - DNA, 15 bp, Homo sapiens
gagagagacagagat

SEQ ID NO: 95519 - DNA, 15 bp, Homo sapiens
aagagagagacagag

SEQ ID NO: 95520 - DNA, 15 bp, Homo sapiens
aaagagagagacaga

SEQ ID NO: 95521 - DNA, 15 bp, Homo sapiens
gaaagagagagacag

SEQ ID NO: 95522 - DNA, 15 bp, Homo sapiens
agaaagagagagaca

SEQ ID NO: 95523 - DNA, 15 bp, Homo sapiens
gagaaagagagagac

SEQ ID NO: 95524 - DNA, 15 bp, Homo sapiens
agagaaagagagaga

SEQ ID NO: 95525 - DNA, 15 bp, Homo sapiens
aagagaaagagagag

SEQ ID NO: 95526 - DNA, 15 bp, Homo sapiens
aaagagaaagagaga

SEQ ID NO: 95527 - DNA, 15 bp, Homo sapiens
gaaagagaaagagag

SEQ ID NO: 95528 - DNA, 15 bp, Homo sapiens
agaaagagaaagaga

SEQ ID NO: 95529 - DNA, 15 bp, Homo sapiens
cagaaagagaaagag

SEQ ID NO: 95530 - DNA, 15 bp, Homo sapiens
acagaaagagaaaga

SEQ ID NO: 95531 - DNA, 15 bp, Homo sapiens
cacagaaagagaaag

SEQ ID NO: 95532 - DNA, 15 bp, Homo sapiens
acacagaaagagaaa

SEQ ID NO: 95533 - DNA, 15 bp, Homo sapiens
cacacagaaagagaa

SEQ ID NO: 95534 - DNA, 15 bp, Homo sapiens
acacacagaaagaga

SEQ ID NO: 95535 - DNA, 15 bp, Homo sapiens
cacacacagaaagag

SEQ ID NO: 95536 - DNA, 15 bp, Homo sapiens
acacacacagaaaga

SEQ ID NO: 95537 - DNA, 15 bp, Homo sapiens
cacacacacagaaag

SEQ ID NO: 95538 - DNA, 15 bp, Homo sapiens
gcacacacacagaaa

SEQ ID NO: 95539 - DNA, 15 bp, Homo sapiens
tgcacacacacagaa

SEQ ID NO: 95540 - DNA, 15 bp, Homo sapiens
atgcacacacacaga

SEQ ID NO: 95541 - DNA, 15 bp, Homo sapiens
catgcacacacacag

SEQ ID NO: 95542 - DNA, 15 bp, Homo sapiens
tacatgcacacacac

SEQ ID NO: 95543 - DNA, 15 bp, Homo sapiens
atacatgcacacaca

SEQ ID NO: 95544 - DNA, 15 bp, Homo sapiens
aatacatgcacacac

SEQ ID NO: 95545 - DNA, 15 bp, Homo sapiens
aaatacatgcacaca

SEQ ID NO: 95546 - DNA, 15 bp, Homo sapiens
aaaatacatgcacac

SEQ ID NO: 95547 - DNA, 15 bp, Homo sapiens
aaaaatacatgcaca

SEQ ID NO: 95548 - DNA, 15 bp, Homo sapiens
taaaaatacatgcac

SEQ ID NO: 95549 - DNA, 15 bp, Homo sapiens
ataaaaatacatgca

SEQ ID NO: 95550 - DNA, 15 bp, Homo sapiens
cataaaaatacatgc

SEQ ID NO: 95551 - DNA, 15 bp, Homo sapiens
tcataaaaatacatg

SEQ ID NO: 95552 - DNA, 15 bp, Homo sapiens
ttcataaaaatacat

SEQ ID NO: 95553 - DNA, 15 bp, Homo sapiens
tttcataaaaataca

SEQ ID NO: 95554 - DNA, 15 bp, Homo sapiens
ttttcataaaaatac

SEQ ID NO: 95555 - DNA, 15 bp, Homo sapiens
cttttcataaaaata

SEQ ID NO: 95556 - DNA, 15 bp, Homo sapiens
gcttttcataaaaat

SEQ ID NO: 95557 - DNA, 15 bp, Homo sapiens
agcttttcataaaaa

SEQ ID NO: 95558 - DNA, 15 bp, Homo sapiens
cagcttttcataaaa

SEQ ID NO: 95559 - DNA, 15 bp, Homo sapiens
tcagcttttcataaa

SEQ ID NO: 95560 - DNA, 15 bp, Homo sapiens
gtcagcttttcataa

SEQ ID NO: 95561 - DNA, 15 bp, Homo sapiens
ggtcagcttttcata

SEQ ID NO: 95562 - DNA, 15 bp, Homo sapiens
tggtcagcttttcat

SEQ ID NO: 95563 - DNA, 15 bp, Homo sapiens
ctggtcagcttttca

SEQ ID NO: 95564 - DNA, 15 bp, Homo sapiens
cctggtcagcttttc

SEQ ID NO: 95565 - DNA, 15 bp, Homo sapiens
acctggtcagctttt

SEQ ID NO: 95566 - DNA, 15 bp, Homo sapiens
aacctggtcagcttt

SEQ ID NO: 95567 - DNA, 15 bp, Homo sapiens
taacctggtcagctt

SEQ ID NO: 95568 - DNA, 15 bp, Homo sapiens
ttaacctggtcagct

SEQ ID NO: 95569 - DNA, 15 bp, Homo sapiens
gttaacctggtcagc

SEQ ID NO: 95570 - DNA, 15 bp, Homo sapiens
ggttaacctggtcag

SEQ ID NO: 95571 - DNA, 15 bp, Homo sapiens
aggttaacctggtca

SEQ ID NO: 95572 - DNA, 15 bp, Homo sapiens
caggttaacctggtc

SEQ ID NO: 95573 - DNA, 15 bp, Homo sapiens
tcaggttaacctggt

SEQ ID NO: 95574 - DNA, 15 bp, Homo sapiens
atcaggttaacctgg

SEQ ID NO: 95575 - DNA, 15 bp, Homo sapiens
catcaggttaacctg

SEQ ID NO: 95576 - DNA, 15 bp, Homo sapiens
tcatcaggttaacct

SEQ ID NO: 95577 - DNA, 15 bp, Homo sapiens
atcatcaggttaacc

SEQ ID NO: 95578 - DNA, 15 bp, Homo sapiens
gatcatcaggttaac

SEQ ID NO: 95579 - DNA, 15 bp, Homo sapiens
tgatcatcaggttaa

SEQ ID NO: 95580 - DNA, 15 bp, Homo sapiens
ctgatcatcaggtta

SEQ ID NO: 95581 - DNA, 15 bp, Homo sapiens
gctgatcatcaggtt

SEQ ID NO: 95582 - DNA, 15 bp, Homo sapiens
ggctgatcatcaggt

SEQ ID NO: 95583 - DNA, 15 bp, Homo sapiens
tggctgatcatcagg

SEQ ID NO: 95584 - DNA, 15 bp, Homo sapiens
ctggctgatcatcag

SEQ ID NO: 95585 - DNA, 15 bp, Homo sapiens
cctggctgatcatca

SEQ ID NO: 95586 - DNA, 15 bp, Homo sapiens
gcctggctgatcatc

SEQ ID NO: 95587 - DNA, 15 bp, Homo sapiens
agcctggctgatcat

SEQ ID NO: 95588 - DNA, 15 bp, Homo sapiens
aagcctggctgatca

SEQ ID NO: 95589 - DNA, 15 bp, Homo sapiens
caagcctggctgatc

SEQ ID NO: 95590 - DNA, 15 bp, Homo sapiens
ccaagcctggctgat

SEQ ID NO: 95591 - DNA, 15 bp, Homo sapiens
cccaagcctggctga

SEQ ID NO: 95592 - DNA, 15 bp, Homo sapiens
tcccaagcctggctg

SEQ ID NO: 95593 - DNA, 15 bp, Homo sapiens
ttcccaagcctggct

SEQ ID NO: 95594 - DNA, 15 bp, Homo sapiens
attcccaagcctggc

SEQ ID NO: 95595 - DNA, 15 bp, Homo sapiens
cattcccaagcctgg

SEQ ID NO: 95596 - DNA, 15 bp, Homo sapiens
ccattcccaagcctg

SEQ ID NO: 95597 - DNA, 15 bp, Homo sapiens
cccattcccaagcct

SEQ ID NO: 95598 - DNA, 15 bp, Homo sapiens
tcccattcccaagcc

SEQ ID NO: 95599 - DNA, 15 bp, Homo sapiens
atcccattcccaagc

SEQ ID NO: 95600 - DNA, 15 bp, Homo sapiens
aatcccattcccaag

SEQ ID NO: 95601 - DNA, 15 bp, Homo sapiens
caatcccattcccaa

SEQ ID NO: 95602 - DNA, 15 bp, Homo sapiens
acaatcccattccca

SEQ ID NO: 95603 - DNA, 15 bp, Homo sapiens
cacaatcccattccc

SEQ ID NO: 95604 - DNA, 15 bp, Homo sapiens
tcacaatcccattcc

SEQ ID NO: 95605 - DNA, 15 bp, Homo sapiens
ctcacaatcccattc

SEQ ID NO: 95606 - DNA, 15 bp, Homo sapiens
actcacaatcccatt

SEQ ID NO: 95607 - DNA, 15 bp, Homo sapiens
cactcacaatcccat

SEQ ID NO: 95608 - DNA, 15 bp, Homo sapiens
acactcacaatccca

SEQ ID NO: 95609 - DNA, 15 bp, Homo sapiens
aacactcacaatccc

SEQ ID NO: 95610 - DNA, 15 bp, Homo sapiens
caacactcacaatcc

SEQ ID NO: 95611 - DNA, 15 bp, Homo sapiens
gcaacactcacaatc

SEQ ID NO: 95612 - DNA, 15 bp, Homo sapiens
agcaacactcacaat

SEQ ID NO: 95613 - DNA, 15 bp, Homo sapiens
cagcaacactcacaa

SEQ ID NO: 95614 - DNA, 15 bp, Homo sapiens
ccagcaacactcaca

SEQ ID NO: 95615 - DNA, 15 bp, Homo sapiens
gccagcaacactcac

SEQ ID NO: 95616 - DNA, 15 bp, Homo sapiens
tgccagcaacactca

SEQ ID NO: 95617 - DNA, 15 bp, Homo sapiens
atgccagcaacactc

SEQ ID NO: 95618 - DNA, 15 bp, Homo sapiens
gatgccagcaacact

SEQ ID NO: 95619 - DNA, 15 bp, Homo sapiens
tgatgccagcaacac

SEQ ID NO: 95620 - DNA, 15 bp, Homo sapiens
ctgatgccagcaaca

SEQ ID NO: 95621 - DNA, 15 bp, Homo sapiens
gctgatgccagcaac

SEQ ID NO: 95622 - DNA, 15 bp, Homo sapiens
agctgatgccagcaa

SEQ ID NO: 95623 - DNA, 15 bp, Homo sapiens
gagctgatgccagca

SEQ ID NO: 95624 - DNA, 15 bp, Homo sapiens
ggagctgatgccagc

SEQ ID NO: 95625 - DNA, 15 bp, Homo sapiens
aggagctgatgccag

SEQ ID NO: 95626 - DNA, 15 bp, Homo sapiens
aaggagctgatgcca

SEQ ID NO: 95627 - DNA, 15 bp, Homo sapiens
caaggagctgatgcc

SEQ ID NO: 95628 - DNA, 15 bp, Homo sapiens
ccaaggagctgatgc

SEQ ID NO: 95629 - DNA, 15 bp, Homo sapiens
accaaggagctgatg

SEQ ID NO: 95630 - DNA, 15 bp, Homo sapiens
aaccaaggagctgat

SEQ ID NO: 95631 - DNA, 15 bp, Homo sapiens
taaccaaggagctga

SEQ ID NO: 95632 - DNA, 15 bp, Homo sapiens
gtaaccaaggagctg

SEQ ID NO: 95633 - DNA, 15 bp, Homo sapiens
ggtaaccaaggagct

SEQ ID NO: 95634 - DNA, 15 bp, Homo sapiens
gggtaaccaaggagc

SEQ ID NO: 95635 - DNA, 15 bp, Homo sapiens
agggtaaccaaggag

SEQ ID NO: 95636 - DNA, 15 bp, Homo sapiens
cagggtaaccaagga

SEQ ID NO: 95637 - DNA, 15 bp, Homo sapiens
acagggtaaccaagg

SEQ ID NO: 95638 - DNA, 15 bp, Homo sapiens
cacagggtaaccaag

SEQ ID NO: 95639 - DNA, 15 bp, Homo sapiens
ccacagggtaaccaa

SEQ ID NO: 95640 - DNA, 15 bp, Homo sapiens
cccacagggtaacca

SEQ ID NO: 95641 - DNA, 15 bp, Homo sapiens
ccccacagggtaacc

SEQ ID NO: 95642 - DNA, 15 bp, Homo sapiens
tccccacagggtaac

SEQ ID NO: 95643 - DNA, 15 bp, Homo sapiens
gtccccacagggtaa

SEQ ID NO: 95644 - DNA, 15 bp, Homo sapiens
tgtccccacagggta

SEQ ID NO: 95645 - DNA, 15 bp, Homo sapiens
ctgtccccacagggt

SEQ ID NO: 95646 - DNA, 15 bp, Homo sapiens
actgtccccacaggg

SEQ ID NO: 95647 - DNA, 15 bp, Homo sapiens
cactgtccccacagg

SEQ ID NO: 95648 - DNA, 15 bp, Homo sapiens
ccactgtccccacag

SEQ ID NO: 95649 - DNA, 15 bp, Homo sapiens
tccactgtccccaca

SEQ ID NO: 95650 - DNA, 15 bp, Homo sapiens
ttccactgtccccac

SEQ ID NO: 95651 - DNA, 15 bp, Homo sapiens
cttccactgtcccca

SEQ ID NO: 95652 - DNA, 15 bp, Homo sapiens
tcttccactgtcccc

SEQ ID NO: 95653 - DNA, 15 bp, Homo sapiens
ttcttccactgtccc

SEQ ID NO: 95654 - DNA, 15 bp, Homo sapiens
tttcttccactgtcc

SEQ ID NO: 95655 - DNA, 15 bp, Homo sapiens
ttttcttccactgtc

SEQ ID NO: 95656 - DNA, 15 bp, Homo sapiens
cttttcttccactgt

SEQ ID NO: 95657 - DNA, 15 bp, Homo sapiens
gcttttcttccactg

SEQ ID NO: 95658 - DNA, 15 bp, Homo sapiens
agcttttcttccact

SEQ ID NO: 95659 - DNA, 15 bp, Homo sapiens
gagcttttcttccac

SEQ ID NO: 95660 - DNA, 15 bp, Homo sapiens
agagcttttcttcca

SEQ ID NO: 95661 - DNA, 15 bp, Homo sapiens
aagagcttttcttcc

SEQ ID NO: 95662 - DNA, 15 bp, Homo sapiens
caagagcttttcttc

SEQ ID NO: 95663 - DNA, 15 bp, Homo sapiens
acaagagcttttctt

SEQ ID NO: 95664 - DNA, 15 bp, Homo sapiens
aacaagagcttttct

SEQ ID NO: 95665 - DNA, 15 bp, Homo sapiens
aaacaagagcttttc

SEQ ID NO: 95666 - DNA, 15 bp, Homo sapiens
caaacaagagctttt

SEQ ID NO: 95667 - DNA, 15 bp, Homo sapiens
ccaaacaagagcttt

SEQ ID NO: 95668 - DNA, 15 bp, Homo sapiens
accaaacaagagctt

SEQ ID NO: 95669 - DNA, 15 bp, Homo sapiens
gaccaaacaagagct

SEQ ID NO: 95670 - DNA, 15 bp, Homo sapiens
ggaccaaacaagagc

SEQ ID NO: 95671 - DNA, 15 bp, Homo sapiens
aggaccaaacaagag

SEQ ID NO: 95672 - DNA, 15 bp, Homo sapiens
caggaccaaacaaga

SEQ ID NO: 95673 - DNA, 15 bp, Homo sapiens
acaggaccaaacaag

SEQ ID NO: 95674 - DNA, 15 bp, Homo sapiens
gacaggaccaaacaa

SEQ ID NO: 95675 - DNA, 15 bp, Homo sapiens
agacaggaccaaaca

SEQ ID NO: 95676 - DNA, 15 bp, Homo sapiens
tagacaggaccaaac

SEQ ID NO: 95677 - DNA, 15 bp, Homo sapiens
atagacaggaccaaa

SEQ ID NO: 95678 - DNA, 15 bp, Homo sapiens
aatagacaggaccaa

SEQ ID NO: 95679 - DNA, 15 bp, Homo sapiens
aaatagacaggacca

SEQ ID NO: 95680 - DNA, 15 bp, Homo sapiens
aaaatagacaggacc

SEQ ID NO: 95681 - DNA, 15 bp, Homo sapiens
aaaaatagacaggac

SEQ ID NO: 95682 - DNA, 15 bp, Homo sapiens
taaaaatagacagga

SEQ ID NO: 95683 - DNA, 15 bp, Homo sapiens
ataaaaatagacagg

SEQ ID NO: 95684 - DNA, 15 bp, Homo sapiens
cataaaaatagacag

SEQ ID NO: 95685 - DNA, 15 bp, Homo sapiens
gcataaaaatagaca

SEQ ID NO: 95686 - DNA, 15 bp, Homo sapiens
ggcataaaaatagac

SEQ ID NO: 95687 - DNA, 15 bp, Homo sapiens
cggcataaaaataga

SEQ ID NO: 95688 - DNA, 15 bp, Homo sapiens
ccggcataaaaatag

SEQ ID NO: 95689 - DNA, 15 bp, Homo sapiens
tccggcataaaaata

SEQ ID NO: 95690 - DNA, 15 bp, Homo sapiens
ctccggcataaaaat

SEQ ID NO: 95691 - DNA, 15 bp, Homo sapiens
tctccggcataaaaa

SEQ ID NO: 95692 - DNA, 15 bp, Homo sapiens
atctccggcataaaa

SEQ ID NO: 95693 - DNA, 15 bp, Homo sapiens
gatctccggcataaa

SEQ ID NO: 95694 - DNA, 15 bp, Homo sapiens
ggatctccggcataa

SEQ ID NO: 95695 - DNA, 15 bp, Homo sapiens
aggatctccggcata

SEQ ID NO: 95696 - DNA, 15 bp, Homo sapiens
caggatctccggcat

SEQ ID NO: 95697 - DNA, 15 bp, Homo sapiens
acaggatctccggca

SEQ ID NO: 95698 - DNA, 15 bp, Homo sapiens
aacaggatctccggc

SEQ ID NO: 95699 - DNA, 15 bp, Homo sapiens
aaacaggatctccgg

SEQ ID NO: 95700 - DNA, 15 bp, Homo sapiens
caaacaggatctccg

SEQ ID NO: 95701 - DNA, 15 bp, Homo sapiens
ccaaacaggatctcc

SEQ ID NO: 95702 - DNA, 15 bp, Homo sapiens
tccaaacaggatctc

SEQ ID NO: 95703 - DNA, 15 bp, Homo sapiens
ctccaaacaggatct

SEQ ID NO: 95704 - DNA, 15 bp, Homo sapiens
cctccaaacaggatc

SEQ ID NO: 95705 - DNA, 15 bp, Homo sapiens
ccctccaaacaggat

SEQ ID NO: 95706 - DNA, 15 bp, Homo sapiens
tccctccaaacagga

SEQ ID NO: 95707 - DNA, 15 bp, Homo sapiens
ctccctccaaacagg

SEQ ID NO: 95708 - DNA, 15 bp, Homo sapiens
cctccctccaaacag

SEQ ID NO: 95709 - DNA, 15 bp, Homo sapiens
ccctccctccaaaca

SEQ ID NO: 95710 - DNA, 15 bp, Homo sapiens
tccctccctccaaac

SEQ ID NO: 95711 - DNA, 15 bp, Homo sapiens
gtccctccctccaaa

SEQ ID NO: 95712 - DNA, 15 bp, Homo sapiens
agtccctccctccaa

SEQ ID NO: 95713 - DNA, 15 bp, Homo sapiens
cagtccctccctcca

SEQ ID NO: 95714 - DNA, 15 bp, Homo sapiens
ccagtccctccctcc

SEQ ID NO: 95715 - DNA, 15 bp, Homo sapiens
cccagtccctccctc

SEQ ID NO: 95716 - DNA, 15 bp, Homo sapiens
tcccagtccctccct

SEQ ID NO: 95717 - DNA, 15 bp, Homo sapiens
ttcccagtccctccc

SEQ ID NO: 95718 - DNA, 15 bp, Homo sapiens
tttcccagtccctcc

SEQ ID NO: 95719 - DNA, 15 bp, Homo sapiens
ctttcccagtccctc

SEQ ID NO: 95720 - DNA, 15 bp, Homo sapiens
gctttcccagtccct

SEQ ID NO: 95721 - DNA, 15 bp, Homo sapiens
ggctttcccagtccc

SEQ ID NO: 95722 - DNA, 15 bp, Homo sapiens
aggctttcccagtcc

SEQ ID NO: 95723 - DNA, 15 bp, Homo sapiens
gaggctttcccagtc

SEQ ID NO: 95724 - DNA, 15 bp, Homo sapiens
agaggctttcccagt

SEQ ID NO: 95725 - DNA, 15 bp, Homo sapiens
cagaggctttcccag

SEQ ID NO: 95726 - DNA, 15 bp, Homo sapiens
acagaggctttccca

SEQ ID NO: 95727 - DNA, 15 bp, Homo sapiens
gacagaggctttccc

SEQ ID NO: 95728 - DNA, 15 bp, Homo sapiens
agacagaggctttcc

SEQ ID NO: 95729 - DNA, 15 bp, Homo sapiens
gagacagaggctttc

SEQ ID NO: 95730 - DNA, 15 bp, Homo sapiens
agagacagaggcttt

SEQ ID NO: 95731 - DNA, 15 bp, Homo sapiens
aagagacagaggctt

SEQ ID NO: 95732 - DNA, 15 bp, Homo sapiens
caagagacagaggct

SEQ ID NO: 95733 - DNA, 15 bp, Homo sapiens
gcaagagacagaggc

SEQ ID NO: 95734 - DNA, 15 bp, Homo sapiens
agcaagagacagagg

SEQ ID NO: 95735 - DNA, 15 bp, Homo sapiens
aagcaagagacagag

SEQ ID NO: 95736 - DNA, 15 bp, Homo sapiens
taagcaagagacaga

SEQ ID NO: 95737 - DNA, 15 bp, Homo sapiens
ttaagcaagagacag

SEQ ID NO: 95738 - DNA, 15 bp, Homo sapiens
gttaagcaagagaca

SEQ ID NO: 95739 - DNA, 15 bp, Homo sapiens
agttaagcaagagac

SEQ ID NO: 95740 - DNA, 15 bp, Homo sapiens
gagttaagcaagaga

SEQ ID NO: 95741 - DNA, 15 bp, Homo sapiens
agagttaagcaagag

SEQ ID NO: 95742 - DNA, 15 bp, Homo sapiens
tagagttaagcaaga

SEQ ID NO: 95743 - DNA, 15 bp, Homo sapiens
ttagagttaagcaag

SEQ ID NO: 95744 - DNA, 15 bp, Homo sapiens
gttagagttaagcaa

SEQ ID NO: 95745 - DNA, 15 bp, Homo sapiens
agttagagttaagca

SEQ ID NO: 95746 - DNA, 15 bp, Homo sapiens
aagttagagttaagc

SEQ ID NO: 95747 - DNA, 15 bp, Homo sapiens
gaagttagagttaag

SEQ ID NO: 95748 - DNA, 15 bp, Homo sapiens
agaagttagagttaa

SEQ ID NO: 95749 - DNA, 15 bp, Homo sapiens
cagaagttagagtta

SEQ ID NO: 95750 - DNA, 15 bp, Homo sapiens
acagaagttagagtt

SEQ ID NO: 95751 - DNA, 15 bp, Homo sapiens
cacagaagttagagt

SEQ ID NO: 95752 - DNA, 15 bp, Homo sapiens
tcacagaagttagag

SEQ ID NO: 95753 - DNA, 15 bp, Homo sapiens
ctcacagaagttaga

SEQ ID NO: 95754 - DNA, 15 bp, Homo sapiens
tctcacagaagttag

SEQ ID NO: 95755 - DNA, 15 bp, Homo sapiens
ttctcacagaagtta

SEQ ID NO: 95756 - DNA, 15 bp, Homo sapiens
gttctcacagaagtt

SEQ ID NO: 95757 - DNA, 15 bp, Homo sapiens
ggttctcacagaagt

SEQ ID NO: 95758 - DNA, 15 bp, Homo sapiens
tggttctcacagaag

SEQ ID NO: 95759 - DNA, 15 bp, Homo sapiens
atggttctcacagaa

SEQ ID NO: 95760 - DNA, 15 bp, Homo sapiens
gatggttctcacaga

SEQ ID NO: 95761 - DNA, 15 bp, Homo sapiens
ggatggttctcacag

SEQ ID NO: 95762 - DNA, 15 bp, Homo sapiens
tggatggttctcaca

SEQ ID NO: 95763 - DNA, 15 bp, Homo sapiens
ctggatggttctcac

SEQ ID NO: 95764 - DNA, 15 bp, Homo sapiens
gctggatggttctca

SEQ ID NO: 95765 - DNA, 15 bp, Homo sapiens
agctggatggttctc

SEQ ID NO: 95766 - DNA, 15 bp, Homo sapiens
gagctggatggttct

SEQ ID NO: 95767 - DNA, 15 bp, Homo sapiens
ggagctggatggttc

SEQ ID NO: 95768 - DNA, 15 bp, Homo sapiens
aggagctggatggtt

SEQ ID NO: 95769 - DNA, 15 bp, Homo sapiens
caggagctggatggt

SEQ ID NO: 95770 - DNA, 15 bp, Homo sapiens
acaggagctggatgg

SEQ ID NO: 95771 - DNA, 15 bp, Homo sapiens
cacaggagctggatg

SEQ ID NO: 95772 - DNA, 15 bp, Homo sapiens
gcacaggagctggat

SEQ ID NO: 95773 - DNA, 15 bp, Homo sapiens
agcacaggagctgga

SEQ ID NO: 95774 - DNA, 15 bp, Homo sapiens
cagcacaggagctgg

SEQ ID NO: 95775 - DNA, 15 bp, Homo sapiens
ccagcacaggagctg

SEQ ID NO: 95776 - DNA, 15 bp, Homo sapiens
gccagcacaggagct

SEQ ID NO: 95777 - DNA, 15 bp, Homo sapiens
ggccagcacaggagc

SEQ ID NO: 95778 - DNA, 15 bp, Homo sapiens
aggccagcacaggag

SEQ ID NO: 95779 - DNA, 15 bp, Homo sapiens
aaggccagcacagga

SEQ ID NO: 95780 - DNA, 15 bp, Homo sapiens
aaaggccagcacagg

SEQ ID NO: 95781 - DNA, 15 bp, Homo sapiens
caaaggccagcacag

SEQ ID NO: 95782 - DNA, 15 bp, Homo sapiens
ccaaaggccagcaca

SEQ ID NO: 95783 - DNA, 15 bp, Homo sapiens
accaaaggccagcac

SEQ ID NO: 95784 - DNA, 15 bp, Homo sapiens
aaccaaaggccagca

SEQ ID NO: 95785 - DNA, 15 bp, Homo sapiens
taaccaaaggccagc

SEQ ID NO: 95786 - DNA, 15 bp, Homo sapiens
gtaaccaaaggccag

SEQ ID NO: 95787 - DNA, 15 bp, Homo sapiens
agtaaccaaaggcca

SEQ ID NO: 95788 - DNA, 15 bp, Homo sapiens
tagtaaccaaaggcc

SEQ ID NO: 95789 - DNA, 15 bp, Homo sapiens
atagtaaccaaaggc

SEQ ID NO: 95790 - DNA, 15 bp, Homo sapiens
gatagtaaccaaagg

SEQ ID NO: 95791 - DNA, 15 bp, Homo sapiens
ggatagtaaccaaag

SEQ ID NO: 95792 - DNA, 15 bp, Homo sapiens
tggatagtaaccaaa

SEQ ID NO: 95793 - DNA, 15 bp, Homo sapiens
gtggatagtaaccaa

SEQ ID NO: 95794 - DNA, 15 bp, Homo sapiens
ggtggatagtaacca

SEQ ID NO: 95795 - DNA, 15 bp, Homo sapiens
aggtggatagtaacc

SEQ ID NO: 95796 - DNA, 15 bp, Homo sapiens
taggtggatagtaac

SEQ ID NO: 95797 - DNA, 15 bp, Homo sapiens
ctaggtggatagtaa

SEQ ID NO: 95798 - DNA, 15 bp, Homo sapiens
gctaggtggatagta

SEQ ID NO: 95799 - DNA, 15 bp, Homo sapiens
tgctaggtggatagt

SEQ ID NO: 95800 - DNA, 15 bp, Homo sapiens
ctgctaggtggatag

SEQ ID NO: 95801 - DNA, 15 bp, Homo sapiens
gctgctaggtggata

SEQ ID NO: 95802 - DNA, 15 bp, Homo sapiens
ggctgctaggtggat

SEQ ID NO: 95803 - DNA, 15 bp, Homo sapiens
tggctgctaggtgga

SEQ ID NO: 95804 - DNA, 15 bp, Homo sapiens
ttggctgctaggtgg

SEQ ID NO: 95805 - DNA, 15 bp, Homo sapiens
cttggctgctaggtg

SEQ ID NO: 95806 - DNA, 15 bp, Homo sapiens
gcttggctgctaggt

SEQ ID NO: 95807 - DNA, 15 bp, Homo sapiens
tgcttggctgctagg

SEQ ID NO: 95808 - DNA, 15 bp, Homo sapiens
ctgcttggctgctag

SEQ ID NO: 95809 - DNA, 15 bp, Homo sapiens
cctgcttggctgcta

SEQ ID NO: 95810 - DNA, 15 bp, Homo sapiens
gcctgcttggctgct

SEQ ID NO: 95811 - DNA, 15 bp, Homo sapiens
ggcctgcttggctgc

SEQ ID NO: 95812 - DNA, 15 bp, Homo sapiens
gggcctgcttggctg

SEQ ID NO: 95813 - DNA, 15 bp, Homo sapiens
agggcctgcttggct

SEQ ID NO: 95814 - DNA, 15 bp, Homo sapiens
cagggcctgcttggc

SEQ ID NO: 95815 - DNA, 15 bp, Homo sapiens
ccagggcctgcttgg

SEQ ID NO: 95816 - DNA, 15 bp, Homo sapiens
gccagggcctgcttg

SEQ ID NO: 95817 - DNA, 15 bp, Homo sapiens
tgccagggcctgctt

SEQ ID NO: 95818 - DNA, 15 bp, Homo sapiens
ctgccagggcctgct

SEQ ID NO: 95819 - DNA, 15 bp, Homo sapiens
cctgccagggcctgc

SEQ ID NO: 95820 - DNA, 15 bp, Homo sapiens
ccctgccagggcctg

SEQ ID NO: 95821 - DNA, 15 bp, Homo sapiens
accctgccagggcct

SEQ ID NO: 95822 - DNA, 15 bp, Homo sapiens
caccctgccagggcc

SEQ ID NO: 95823 - DNA, 15 bp, Homo sapiens
ccaccctgccagggc

SEQ ID NO: 95824 - DNA, 15 bp, Homo sapiens
gccaccctgccaggg

SEQ ID NO: 95825 - DNA, 15 bp, Homo sapiens
ggccaccctgccagg

SEQ ID NO: 95826 - DNA, 15 bp, Homo sapiens
tggccaccctgccag

SEQ ID NO: 95827 - DNA, 15 bp, Homo sapiens
gtggccaccctgcca

SEQ ID NO: 95828 - DNA, 15 bp, Homo sapiens
agtggccaccctgcc

SEQ ID NO: 95829 - DNA, 15 bp, Homo sapiens
tagtggccaccctgc

SEQ ID NO: 95830 - DNA, 15 bp, Homo sapiens
gtagtggccaccctg

SEQ ID NO: 95831 - DNA, 15 bp, Homo sapiens
agtagtggccaccct

SEQ ID NO: 95832 - DNA, 15 bp, Homo sapiens
cagtagtggccaccc

SEQ ID NO: 95833 - DNA, 15 bp, Homo sapiens
acagtagtggccacc

SEQ ID NO: 95834 - DNA, 15 bp, Homo sapiens
cacagtagtggccac

SEQ ID NO: 95835 - DNA, 15 bp, Homo sapiens
ccacagtagtggcca

SEQ ID NO: 95836 - DNA, 15 bp, Homo sapiens
gccacagtagtggcc

SEQ ID NO: 95837 - DNA, 15 bp, Homo sapiens
cgccacagtagtggc

SEQ ID NO: 95838 - DNA, 15 bp, Homo sapiens
acgccacagtagtgg

SEQ ID NO: 95839 - DNA, 15 bp, Homo sapiens
aacgccacagtagtg

SEQ ID NO: 95840 - DNA, 15 bp, Homo sapiens
aaacgccacagtagt

SEQ ID NO: 95841 - DNA, 15 bp, Homo sapiens
taaacgccacagtag

SEQ ID NO: 95842 - DNA, 15 bp, Homo sapiens
ttaaacgccacagta

SEQ ID NO: 95843 - DNA, 15 bp, Homo sapiens
attaaacgccacagt

SEQ ID NO: 95844 - DNA, 15 bp, Homo sapiens
aattaaacgccacag

SEQ ID NO: 95845 - DNA, 15 bp, Homo sapiens
aaattaaacgccaca

SEQ ID NO: 95846 - DNA, 15 bp, Homo sapiens
caaattaaacgccac

SEQ ID NO: 95847 - DNA, 15 bp, Homo sapiens
tcaaattaaacgcca

SEQ ID NO: 95848 - DNA, 15 bp, Homo sapiens
ctcaaattaaacgcc

SEQ ID NO: 95849 - DNA, 15 bp, Homo sapiens
gctcaaattaaacgc

SEQ ID NO: 95850 - DNA, 15 bp, Homo sapiens
tgctcaaattaaacg

SEQ ID NO: 95851 - DNA, 15 bp, Homo sapiens
atgctcaaattaaac

SEQ ID NO: 95852 - DNA, 15 bp, Homo sapiens
catgctcaaattaaa

SEQ ID NO: 95853 - DNA, 15 bp, Homo sapiens
tcatgctcaaattaa

SEQ ID NO: 95854 - DNA, 15 bp, Homo sapiens
ctcatgctcaaatta

SEQ ID NO: 95855 - DNA, 15 bp, Homo sapiens
cctcatgctcaaatt

SEQ ID NO: 95856 - DNA, 15 bp, Homo sapiens
gcctcatgctcaaat

SEQ ID NO: 95857 - DNA, 15 bp, Homo sapiens
agcctcatgctcaaa

SEQ ID NO: 95858 - DNA, 15 bp, Homo sapiens
cagcctcatgctcaa

SEQ ID NO: 95859 - DNA, 15 bp, Homo sapiens
tcagcctcatgctca

SEQ ID NO: 95860 - DNA, 15 bp, Homo sapiens
ttcagcctcatgctc

SEQ ID NO: 95861 - DNA, 15 bp, Homo sapiens
gttcagcctcatgct

SEQ ID NO: 95862 - DNA, 15 bp, Homo sapiens
ggttcagcctcatgc

SEQ ID NO: 95863 - DNA, 15 bp, Homo sapiens
aggttcagcctcatg

SEQ ID NO: 95864 - DNA, 15 bp, Homo sapiens
caggttcagcctcat

SEQ ID NO: 95865 - DNA, 15 bp, Homo sapiens
gcaggttcagcctca

SEQ ID NO: 95866 - DNA, 15 bp, Homo sapiens
ggcaggttcagcctc

SEQ ID NO: 95867 - DNA, 15 bp, Homo sapiens
tggcaggttcagcct

SEQ ID NO: 95868 - DNA, 15 bp, Homo sapiens
ttggcaggttcagcc

SEQ ID NO: 95869 - DNA, 15 bp, Homo sapiens
cttggcaggttcagc

SEQ ID NO: 95870 - DNA, 15 bp, Homo sapiens
acttggcaggttcag

SEQ ID NO: 95871 - DNA, 15 bp, Homo sapiens
tacttggcaggttca

SEQ ID NO: 95872 - DNA, 15 bp, Homo sapiens
ctacttggcaggttc

SEQ ID NO: 95873 - DNA, 15 bp, Homo sapiens
tctacttggcaggtt

SEQ ID NO: 95874 - DNA, 15 bp, Homo sapiens
ctctacttggcaggt

SEQ ID NO: 95875 - DNA, 15 bp, Homo sapiens
cctctacttggcagg

SEQ ID NO: 95876 - DNA, 15 bp, Homo sapiens
acctctacttggcag

SEQ ID NO: 95877 - DNA, 15 bp, Homo sapiens
aacctctacttggca

SEQ ID NO: 95878 - DNA, 15 bp, Homo sapiens
caacctctacttggc

SEQ ID NO: 95879 - DNA, 15 bp, Homo sapiens
ccaacctctacttgg

SEQ ID NO: 95880 - DNA, 15 bp, Homo sapiens
tccaacctctacttg

SEQ ID NO: 95881 - DNA, 15 bp, Homo sapiens
gtccaacctctactt

SEQ ID NO: 95882 - DNA, 15 bp, Homo sapiens
agtccaacctctact

SEQ ID NO: 95883 - DNA, 15 bp, Homo sapiens
cagtccaacctctac

SEQ ID NO: 95884 - DNA, 15 bp, Homo sapiens
acagtccaacctcta

SEQ ID NO: 95885 - DNA, 15 bp, Homo sapiens
cacagtccaacctct

SEQ ID NO: 95886 - DNA, 15 bp, Homo sapiens
tcacagtccaacctc

SEQ ID NO: 95887 - DNA, 15 bp, Homo sapiens
gtcacagtccaacct

SEQ ID NO: 95888 - DNA, 15 bp, Homo sapiens
agtcacagtccaacc

SEQ ID NO: 95889 - DNA, 15 bp, Homo sapiens
cagtcacagtccaac

SEQ ID NO: 95890 - DNA, 15 bp, Homo sapiens
gcagtcacagtccaa

SEQ ID NO: 95891 - DNA, 15 bp, Homo sapiens
tgcagtcacagtcca

SEQ ID NO: 95892 - DNA, 15 bp, Homo sapiens
ctgcagtcacagtcc

SEQ ID NO: 95893 - DNA, 15 bp, Homo sapiens
tctgcagtcacagtc

SEQ ID NO: 95894 - DNA, 15 bp, Homo sapiens
ttctgcagtcacagt

SEQ ID NO: 95895 - DNA, 15 bp, Homo sapiens
gttctgcagtcacag

SEQ ID NO: 95896 - DNA, 15 bp, Homo sapiens
cgttctgcagtcaca

SEQ ID NO: 95897 - DNA, 15 bp, Homo sapiens
ccgttctgcagtcac

SEQ ID NO: 95898 - DNA, 15 bp, Homo sapiens
gccgttctgcagtca

SEQ ID NO: 95899 - DNA, 15 bp, Homo sapiens
cgccgttctgcagtc

SEQ ID NO: 95900 - DNA, 15 bp, Homo sapiens
gcgccgttctgcagt

SEQ ID NO: 95901 - DNA, 15 bp, Homo sapiens
ggcgccgttctgcag

SEQ ID NO: 95902 - DNA, 15 bp, Homo sapiens
aggcgccgttctgca

SEQ ID NO: 95903 - DNA, 15 bp, Homo sapiens
aaggcgccgttctgc

SEQ ID NO: 95904 - DNA, 15 bp, Homo sapiens
gaaggcgccgttctg

SEQ ID NO: 95905 - DNA, 15 bp, Homo sapiens
agaaggcgccgttct

SEQ ID NO: 95906 - DNA, 15 bp, Homo sapiens
gagaaggcgccgttc

SEQ ID NO: 95907 - DNA, 15 bp, Homo sapiens
agagaaggcgccgtt

SEQ ID NO: 95908 - DNA, 15 bp, Homo sapiens
gagagaaggcgccgt

SEQ ID NO: 95909 - DNA, 15 bp, Homo sapiens
tgagagaaggcgccg

SEQ ID NO: 95910 - DNA, 15 bp, Homo sapiens
gtgagagaaggcgcc

SEQ ID NO: 95911 - DNA, 15 bp, Homo sapiens
tgtgagagaaggcgc

SEQ ID NO: 95912 - DNA, 15 bp, Homo sapiens
ctgtgagagaaggcg

SEQ ID NO: 95913 - DNA, 15 bp, Homo sapiens
actgtgagagaaggc

SEQ ID NO: 95914 - DNA, 15 bp, Homo sapiens
tactgtgagagaagg

SEQ ID NO: 95915 - DNA, 15 bp, Homo sapiens
ctactgtgagagaag

SEQ ID NO: 95916 - DNA, 15 bp, Homo sapiens
tctactgtgagagaa

SEQ ID NO: 95917 - DNA, 15 bp, Homo sapiens
ttctactgtgagaga

SEQ ID NO: 95918 - DNA, 15 bp, Homo sapiens
cttctactgtgagag

SEQ ID NO: 95919 - DNA, 15 bp, Homo sapiens
acttctactgtgaga

SEQ ID NO: 95920 - DNA, 15 bp, Homo sapiens
gacttctactgtgag

SEQ ID NO: 95921 - DNA, 15 bp, Homo sapiens
tgacttctactgtga

SEQ ID NO: 95922 - DNA, 15 bp, Homo sapiens
ctgacttctactgtg

SEQ ID NO: 95923 - DNA, 15 bp, Homo sapiens
actgacttctactgt

SEQ ID NO: 95924 - DNA, 15 bp, Homo sapiens
aactgacttctactg

SEQ ID NO: 95925 - DNA, 15 bp, Homo sapiens
aaactgacttctact

SEQ ID NO: 95926 - DNA, 15 bp, Homo sapiens
caaactgacttctac

SEQ ID NO: 95927 - DNA, 15 bp, Homo sapiens
acaaactgacttcta

SEQ ID NO: 95928 - DNA, 15 bp, Homo sapiens
gacaaactgacttct

SEQ ID NO: 95929 - DNA, 15 bp, Homo sapiens
cgacaaactgacttc

SEQ ID NO: 95930 - DNA, 15 bp, Homo sapiens
acgacaaactgactt

SEQ ID NO: 95931 - DNA, 15 bp, Homo sapiens
aacgacaaactgact

SEQ ID NO: 95932 - DNA, 15 bp, Homo sapiens
taacgacaaactgac

SEQ ID NO: 95933 - DNA, 15 bp, Homo sapiens
ataacgacaaactga

SEQ ID NO: 95934 - DNA, 15 bp, Homo sapiens
cataacgacaaactg

SEQ ID NO: 95935 - DNA, 15 bp, Homo sapiens
ccataacgacaaact

SEQ ID NO: 95936 - DNA, 15 bp, Homo sapiens
cccataacgacaaac

SEQ ID NO: 95937 - DNA, 15 bp, Homo sapiens
ccccataacgacaaa

SEQ ID NO: 95938 - DNA, 15 bp, Homo sapiens
tccccataacgacaa

SEQ ID NO: 95939 - DNA, 15 bp, Homo sapiens
ctccccataacgaca

SEQ ID NO: 95940 - DNA, 15 bp, Homo sapiens
cctccccataacgac

SEQ ID NO: 95941 - DNA, 15 bp, Homo sapiens
tcctccccataacga

SEQ ID NO: 95942 - DNA, 15 bp, Homo sapiens
ctcctccccataacg

SEQ ID NO: 95943 - DNA, 15 bp, Homo sapiens
actcctccccataac

SEQ ID NO: 95944 - DNA, 15 bp, Homo sapiens
cactcctccccataa

SEQ ID NO: 95945 - DNA, 15 bp, Homo sapiens
gcactcctccccata

SEQ ID NO: 95946 - DNA, 15 bp, Homo sapiens
agcactcctccccat

SEQ ID NO: 95947 - DNA, 15 bp, Homo sapiens
gagcactcctcccca

SEQ ID NO: 95948 - DNA, 15 bp, Homo sapiens
agagcactcctcccc

SEQ ID NO: 95949 - DNA, 15 bp, Homo sapiens
cagagcactcctccc

SEQ ID NO: 95950 - DNA, 15 bp, Homo sapiens
tcagagcactcctcc

SEQ ID NO: 95951 - DNA, 15 bp, Homo sapiens
ttcagagcactcctc

SEQ ID NO: 95952 - DNA, 15 bp, Homo sapiens
tttcagagcactcct

SEQ ID NO: 95953 - DNA, 15 bp, Homo sapiens
ttttcagagcactcc

SEQ ID NO: 95954 - DNA, 15 bp, Homo sapiens
attttcagagcactc

SEQ ID NO: 95955 - DNA, 15 bp, Homo sapiens
tattttcagagcact

SEQ ID NO: 95956 - DNA, 15 bp, Homo sapiens
atattttcagagcac

SEQ ID NO: 95957 - DNA, 15 bp, Homo sapiens
aatattttcagagca

SEQ ID NO: 95958 - DNA, 15 bp, Homo sapiens
aaatattttcagagc

SEQ ID NO: 95959 - DNA, 15 bp, Homo sapiens
gaaatattttcagag

SEQ ID NO: 95960 - DNA, 15 bp, Homo sapiens
agaaatattttcaga

SEQ ID NO: 95961 - DNA, 15 bp, Homo sapiens
tagaaatattttcag

SEQ ID NO: 95962 - DNA, 15 bp, Homo sapiens
ctagaaatattttca

SEQ ID NO: 95963 - DNA, 15 bp, Homo sapiens
tctagaaatattttc

SEQ ID NO: 95964 - DNA, 15 bp, Homo sapiens
gtctagaaatatttt

SEQ ID NO: 95965 - DNA, 15 bp, Homo sapiens
agtctagaaatattt

SEQ ID NO: 95966 - DNA, 15 bp, Homo sapiens
aagtctagaaatatt

SEQ ID NO: 95967 - DNA, 15 bp, Homo sapiens
gaagtctagaaatat

SEQ ID NO: 95968 - DNA, 15 bp, Homo sapiens
agaagtctagaaata

SEQ ID NO: 95969 - DNA, 15 bp, Homo sapiens
gagaagtctagaaat

SEQ ID NO: 95970 - DNA, 15 bp, Homo sapiens
ggagaagtctagaaa

SEQ ID NO: 95971 - DNA, 15 bp, Homo sapiens
tggagaagtctagaa

SEQ ID NO: 95972 - DNA, 15 bp, Homo sapiens
ttggagaagtctaga

SEQ ID NO: 95973 - DNA, 15 bp, Homo sapiens
tttggagaagtctag

SEQ ID NO: 95974 - DNA, 15 bp, Homo sapiens
ttttggagaagtcta

SEQ ID NO: 95975 - DNA, 15 bp, Homo sapiens
attttggagaagtct

SEQ ID NO: 95976 - DNA, 15 bp, Homo sapiens
aattttggagaagtc

SEQ ID NO: 95977 - DNA, 15 bp, Homo sapiens
aaattttggagaagt

SEQ ID NO: 95978 - DNA, 15 bp, Homo sapiens
aaaattttggagaag

SEQ ID NO: 95979 - DNA, 15 bp, Homo sapiens
aaaaattttggagaa

SEQ ID NO: 95980 - DNA, 15 bp, Homo sapiens
taaaaattttggaga

SEQ ID NO: 95981 - DNA, 15 bp, Homo sapiens
ttaaaaattttggag

SEQ ID NO: 95982 - DNA, 15 bp, Homo sapiens
gttaaaaattttgga

SEQ ID NO: 95983 - DNA, 15 bp, Homo sapiens
agttaaaaattttgg

SEQ ID NO: 95984 - DNA, 15 bp, Homo sapiens
tagttaaaaattttg

SEQ ID NO: 95985 - DNA, 15 bp, Homo sapiens
ttagttaaaaatttt

SEQ ID NO: 95986 - DNA, 15 bp, Homo sapiens
cttagttaaaaattt

SEQ ID NO: 95987 - DNA, 15 bp, Homo sapiens
acttagttaaaaatt

SEQ ID NO: 95988 - DNA, 15 bp, Homo sapiens
aacttagttaaaaat

SEQ ID NO: 95989 - DNA, 15 bp, Homo sapiens
taacttagttaaaaa

SEQ ID NO: 95990 - DNA, 15 bp, Homo sapiens
gtaacttagttaaaa

SEQ ID NO: 95991 - DNA, 15 bp, Homo sapiens
agtaacttagttaaa

SEQ ID NO: 95992 - DNA, 15 bp, Homo sapiens
cagtaacttagttaa

SEQ ID NO: 95993 - DNA, 15 bp, Homo sapiens
tcagtaacttagtta

SEQ ID NO: 95994 - DNA, 15 bp, Homo sapiens
ttcagtaacttagtt

SEQ ID NO: 95995 - DNA, 15 bp, Homo sapiens
attcagtaacttagt

SEQ ID NO: 95996 - DNA, 15 bp, Homo sapiens
gattcagtaacttag

SEQ ID NO: 95997 - DNA, 15 bp, Homo sapiens
tgattcagtaactta

SEQ ID NO: 95998 - DNA, 15 bp, Homo sapiens
ctgattcagtaactt

SEQ ID NO: 95999 - DNA, 15 bp, Homo sapiens
tctgattcagtaact

SEQ ID NO: 96000 - DNA, 15 bp, Homo sapiens
ttctgattcagtaac

SEQ ID NO: 96001 - DNA, 15 bp, Homo sapiens
attctgattcagtaa

SEQ ID NO: 96002 - DNA, 15 bp, Homo sapiens
gattctgattcagta

SEQ ID NO: 96003 - DNA, 15 bp, Homo sapiens
tgattctgattcagt

SEQ ID NO: 96004 - DNA, 15 bp, Homo sapiens
ctgattctgattcag

SEQ ID NO: 96005 - DNA, 15 bp, Homo sapiens
tctgattctgattca

SEQ ID NO: 96006 - DNA, 15 bp, Homo sapiens
gtctgattctgattc

SEQ ID NO: 96007 - DNA, 15 bp, Homo sapiens
tgtctgattctgatt

SEQ ID NO: 96008 - DNA, 15 bp, Homo sapiens
ttgtctgattctgat

SEQ ID NO: 96009 - DNA, 15 bp, Homo sapiens
gttgtctgattctga

SEQ ID NO: 96010 - DNA, 15 bp, Homo sapiens
agttgtctgattctg

SEQ ID NO: 96011 - DNA, 15 bp, Homo sapiens
tagttgtctgattct

SEQ ID NO: 96012 - DNA, 15 bp, Homo sapiens
atagttgtctgattc

SEQ ID NO: 96013 - DNA, 15 bp, Homo sapiens
gatagttgtctgatt

SEQ ID NO: 96014 - DNA, 15 bp, Homo sapiens
agatagttgtctgat

SEQ ID NO: 96015 - DNA, 15 bp, Homo sapiens
tagatagttgtctga

SEQ ID NO: 96016 - DNA, 15 bp, Homo sapiens
atagatagttgtctg

SEQ ID NO: 96017 - DNA, 15 bp, Homo sapiens
aatagatagttgtct

SEQ ID NO: 96018 - DNA, 15 bp, Homo sapiens
aaatagatagttgtc

SEQ ID NO: 96019 - DNA, 15 bp, Homo sapiens
aaaatagatagttgt

SEQ ID NO: 96020 - DNA, 15 bp, Homo sapiens
aaaaatagatagttg

SEQ ID NO: 96021 - DNA, 15 bp, Homo sapiens
aaaaaatagatagtt

SEQ ID NO: 96022 - DNA, 15 bp, Homo sapiens
taaaaaatagatagt

SEQ ID NO: 96023 - DNA, 15 bp, Homo sapiens
gtaaaaaatagatag

SEQ ID NO: 96024 - DNA, 15 bp, Homo sapiens
agtaaaaaatagata

SEQ ID NO: 96025 - DNA, 15 bp, Homo sapiens
cagtaaaaaatagat

SEQ ID NO: 96026 - DNA, 15 bp, Homo sapiens
acagtaaaaaataga

SEQ ID NO: 96027 - DNA, 15 bp, Homo sapiens
tacagtaaaaaatag

SEQ ID NO: 96028 - DNA, 15 bp, Homo sapiens
ttacagtaaaaaata

SEQ ID NO: 96029 - DNA, 15 bp, Homo sapiens
gttacagtaaaaaat

SEQ ID NO: 96030 - DNA, 15 bp, Homo sapiens
agttacagtaaaaaa

SEQ ID NO: 96031 - DNA, 15 bp, Homo sapiens
aagttacagtaaaaa

SEQ ID NO: 96032 - DNA, 15 bp, Homo sapiens
aaagttacagtaaaa

SEQ ID NO: 96033 - DNA, 15 bp, Homo sapiens
aaaagttacagtaaa

SEQ ID NO: 96034 - DNA, 15 bp, Homo sapiens
aaaaagttacagtaa

SEQ ID NO: 96035 - DNA, 15 bp, Homo sapiens
aaaaaagttacagta

SEQ ID NO: 96036 - DNA, 15 bp, Homo sapiens
caaaaaagttacagt

SEQ ID NO: 96037 - DNA, 15 bp, Homo sapiens
acaaaaaagttacag

SEQ ID NO: 96038 - DNA, 15 bp, Homo sapiens
cacaaaaaagttaca

SEQ ID NO: 96039 - DNA, 15 bp, Homo sapiens
acacaaaaaagttac

SEQ ID NO: 96040 - DNA, 15 bp, Homo sapiens
gacacaaaaaagtta

SEQ ID NO: 96041 - DNA, 15 bp, Homo sapiens
agacacaaaaaagtt

SEQ ID NO: 96042 - DNA, 15 bp, Homo sapiens
cagacacaaaaaagt

SEQ ID NO: 96043 - DNA, 15 bp, Homo sapiens
acagacacaaaaaag

SEQ ID NO: 96044 - DNA, 15 bp, Homo sapiens
cacagacacaaaaaa

SEQ ID NO: 96045 - DNA, 15 bp, Homo sapiens
acacagacacaaaaa

SEQ ID NO: 96046 - DNA, 15 bp, Homo sapiens
cacacagacacaaaa

SEQ ID NO: 96047 - DNA, 15 bp, Homo sapiens
ccacacagacacaaa

SEQ ID NO: 96048 - DNA, 15 bp, Homo sapiens
gccacacagacacaa

SEQ ID NO: 96049 - DNA, 15 bp, Homo sapiens
tgccacacagacaca

SEQ ID NO: 96050 - DNA, 15 bp, Homo sapiens
atgccacacagacac

SEQ ID NO: 96051 - DNA, 15 bp, Homo sapiens
tatgccacacagaca

SEQ ID NO: 96052 - DNA, 15 bp, Homo sapiens
atatgccacacagac

SEQ ID NO: 96053 - DNA, 15 bp, Homo sapiens
tatatgccacacaga

SEQ ID NO: 96054 - DNA, 15 bp, Homo sapiens
gtatatgccacacag

SEQ ID NO: 96055 - DNA, 15 bp, Homo sapiens
tgtatatgccacaca

SEQ ID NO: 96056 - DNA, 15 bp, Homo sapiens
ttgtatatgccacac

SEQ ID NO: 96057 - DNA, 15 bp, Homo sapiens
tttgtatatgccaca

SEQ ID NO: 96058 - DNA, 15 bp, Homo sapiens
gtttgtatatgccac

SEQ ID NO: 96059 - DNA, 15 bp, Homo sapiens
tgtttgtatatgcca

SEQ ID NO: 96060 - DNA, 15 bp, Homo sapiens
atgtttgtatatgcc

SEQ ID NO: 96061 - DNA, 15 bp, Homo sapiens
tatgtttgtatatgc

SEQ ID NO: 96062 - DNA, 15 bp, Homo sapiens
ctatgtttgtatatg

SEQ ID NO: 96063 - DNA, 15 bp, Homo sapiens
actatgtttgtatat

SEQ ID NO: 96064 - DNA, 15 bp, Homo sapiens
tactatgtttgtata

SEQ ID NO: 96065 - DNA, 15 bp, Homo sapiens
ctactatgtttgtat

SEQ ID NO: 96066 - DNA, 15 bp, Homo sapiens
tctactatgtttgta

SEQ ID NO: 96067 - DNA, 15 bp, Homo sapiens
gtctactatgtttgt

SEQ ID NO: 96068 - DNA, 15 bp, Homo sapiens
tgtctactatgtttg

SEQ ID NO: 96069 - DNA, 15 bp, Homo sapiens
atgtctactatgttt

SEQ ID NO: 96070 - DNA, 15 bp, Homo sapiens
gatgtctactatgtt

SEQ ID NO: 96071 - DNA, 15 bp, Homo sapiens
tgatgtctactatgt

SEQ ID NO: 96072 - DNA, 15 bp, Homo sapiens
ttgatgtctactatg

SEQ ID NO: 96073 - DNA, 15 bp, Homo sapiens
tttgatgtctactat

SEQ ID NO: 96074 - DNA, 15 bp, Homo sapiens
ttttgatgtctacta

SEQ ID NO: 96075 - DNA, 15 bp, Homo sapiens
gttttgatgtctact

SEQ ID NO: 96076 - DNA, 15 bp, Homo sapiens
ggttttgatgtctac

SEQ ID NO: 96077 - DNA, 15 bp, Homo sapiens
tggttttgatgtcta

SEQ ID NO: 96078 - DNA, 15 bp, Homo sapiens
ttggttttgatgtct

SEQ ID NO: 96079 - DNA, 15 bp, Homo sapiens
tttggttttgatgtc

SEQ ID NO: 96080 - DNA, 15 bp, Homo sapiens
ttttggttttgatgt

SEQ ID NO: 96081 - DNA, 15 bp, Homo sapiens
attttggttttgatg

SEQ ID NO: 96082 - DNA, 15 bp, Homo sapiens
aattttggttttgat

SEQ ID NO: 96083 - DNA, 15 bp, Homo sapiens
aaattttggttttga

SEQ ID NO: 96084 - DNA, 15 bp, Homo sapiens
aaaattttggttttg

SEQ ID NO: 96085 - DNA, 15 bp, Homo sapiens
taaaattttggtttt

SEQ ID NO: 96086 - DNA, 15 bp, Homo sapiens
ataaaattttggttt

SEQ ID NO: 96087 - DNA, 15 bp, Homo sapiens
tataaaattttggtt

SEQ ID NO: 96088 - DNA, 15 bp, Homo sapiens
ctataaaattttggt

SEQ ID NO: 96089 - DNA, 15 bp, Homo sapiens
tctataaaattttgg

SEQ ID NO: 96090 - DNA, 15 bp, Homo sapiens
ctctataaaattttg

SEQ ID NO: 96091 - DNA, 15 bp, Homo sapiens
gctctataaaatttt

SEQ ID NO: 96092 - DNA, 15 bp, Homo sapiens
cgctctataaaattt

SEQ ID NO: 96093 - DNA, 15 bp, Homo sapiens
ccgctctataaaatt

SEQ ID NO: 96094 - DNA, 15 bp, Homo sapiens
accgctctataaaat

SEQ ID NO: 96095 - DNA, 15 bp, Homo sapiens
caccgctctataaaa

SEQ ID NO: 96096 - DNA, 15 bp, Homo sapiens
acaccgctctataaa

SEQ ID NO: 96097 - DNA, 15 bp, Homo sapiens
gacaccgctctataa

SEQ ID NO: 96098 - DNA, 15 bp, Homo sapiens
agacaccgctctata

SEQ ID NO: 96099 - DNA, 15 bp, Homo sapiens
aagacaccgctctat

SEQ ID NO: 96100 - DNA, 15 bp, Homo sapiens
taagacaccgctcta

SEQ ID NO: 96101 - DNA, 15 bp, Homo sapiens
ataagacaccgctct

SEQ ID NO: 96102 - DNA, 15 bp, Homo sapiens
cataagacaccgctc

SEQ ID NO: 96103 - DNA, 15 bp, Homo sapiens
tcataagacaccgct

SEQ ID NO: 96104 - DNA, 15 bp, Homo sapiens
gtcataagacaccgc

SEQ ID NO: 96105 - DNA, 15 bp, Homo sapiens
tgtcataagacaccg

SEQ ID NO: 96106 - DNA, 15 bp, Homo sapiens
atgtcataagacacc

SEQ ID NO: 96107 - DNA, 15 bp, Homo sapiens
gatgtcataagacac

SEQ ID NO: 96108 - DNA, 15 bp, Homo sapiens
agatgtcataagaca

SEQ ID NO: 96109 - DNA, 15 bp, Homo sapiens
aagatgtcataagac

SEQ ID NO: 96110 - DNA, 15 bp, Homo sapiens
aaagatgtcataaga

SEQ ID NO: 96111 - DNA, 15 bp, Homo sapiens
taaagatgtcataag

SEQ ID NO: 96112 - DNA, 15 bp, Homo sapiens
ttaaagatgtcataa

SEQ ID NO: 96113 - DNA, 15 bp, Homo sapiens
attaaagatgtcata

SEQ ID NO: 96114 - DNA, 15 bp, Homo sapiens
tattaaagatgtcat

SEQ ID NO: 96115 - DNA, 15 bp, Homo sapiens
ctattaaagatgtca

SEQ ID NO: 96116 - DNA, 15 bp, Homo sapiens
gctattaaagatgtc

SEQ ID NO: 96117 - DNA, 15 bp, Homo sapiens
tgctattaaagatgt

SEQ ID NO: 96118 - DNA, 15 bp, Homo sapiens
ctgctattaaagatg

SEQ ID NO: 96119 - DNA, 15 bp, Homo sapiens
gctgctattaaagat

SEQ ID NO: 96120 - DNA, 15 bp, Homo sapiens
ggctgctattaaaga

SEQ ID NO: 96121 - DNA, 15 bp, Homo sapiens
aggctgctattaaag

SEQ ID NO: 96122 - DNA, 15 bp, Homo sapiens
gaggctgctattaaa

SEQ ID NO: 96123 - DNA, 15 bp, Homo sapiens
agaggctgctattaa

SEQ ID NO: 96124 - DNA, 15 bp, Homo sapiens
gagaggctgctatta

SEQ ID NO: 96125 - DNA, 15 bp, Homo sapiens
ggagaggctgctatt

SEQ ID NO: 96126 - DNA, 15 bp, Homo sapiens
gggagaggctgctat

SEQ ID NO: 96127 - DNA, 15 bp, Homo sapiens
agggagaggctgcta

SEQ ID NO: 96128 - DNA, 15 bp, Homo sapiens
gagggagaggctgct

SEQ ID NO: 96129 - DNA, 15 bp, Homo sapiens
agggagggagaggct

SEQ ID NO: 96130 - DNA, 15 bp, Homo sapiens
cagggagggagaggc

SEQ ID NO: 96131 - DNA, 15 bp, Homo sapiens
gcagggagggagagg

SEQ ID NO: 96132 - DNA, 15 bp, Homo sapiens
agcagggagggagag

SEQ ID NO: 96133 - DNA, 15 bp, Homo sapiens
aagcagggagggaga

SEQ ID NO: 96134 - DNA, 15 bp, Homo sapiens
aaagcagggagggag

SEQ ID NO: 96135 - DNA, 15 bp, Homo sapiens
aaaagcagggaggga

SEQ ID NO: 96136 - DNA, 15 bp, Homo sapiens
aaaaagcagggaggg

SEQ ID NO: 96137 - DNA, 15 bp, Homo sapiens
taaaaagcagggagg

SEQ ID NO: 96138 - DNA, 15 bp, Homo sapiens
ttaaaaagcagggag

SEQ ID NO: 96139 - DNA, 15 bp, Homo sapiens
tttaaaaagcaggga

SEQ ID NO: 96140 - DNA, 15 bp, Homo sapiens
ttttaaaaagcaggg

SEQ ID NO: 96141 - DNA, 15 bp, Homo sapiens
cttttaaaaagcagg

SEQ ID NO: 96142 - DNA, 15 bp, Homo sapiens
acttttaaaaagcag

SEQ ID NO: 96143 - DNA, 15 bp, Homo sapiens
cacttttaaaaagca

SEQ ID NO: 96144 - DNA, 15 bp, Homo sapiens
tcacttttaaaaagc

SEQ ID NO: 96145 - DNA, 15 bp, Homo sapiens
ttcacttttaaaaag

SEQ ID NO: 96146 - DNA, 15 bp, Homo sapiens
tttcacttttaaaaa

SEQ ID NO: 96147 - DNA, 15 bp, Homo sapiens
atttcacttttaaaa

SEQ ID NO: 96148 - DNA, 15 bp, Homo sapiens
gatttcacttttaaa

SEQ ID NO: 96149 - DNA, 15 bp, Homo sapiens
agatttcacttttaa

SEQ ID NO: 96150 - DNA, 15 bp, Homo sapiens
aagatttcactttta

SEQ ID NO: 96151 - DNA, 15 bp, Homo sapiens
taagatttcactttt

SEQ ID NO: 96152 - DNA, 15 bp, Homo sapiens
ttaagatttcacttt

SEQ ID NO: 96153 - DNA, 15 bp, Homo sapiens
attaagatttcactt

SEQ ID NO: 96154 - DNA, 15 bp, Homo sapiens
cattaagatttcact

SEQ ID NO: 96155 - DNA, 15 bp, Homo sapiens
ccattaagatttcac

SEQ ID NO: 96156 - DNA, 15 bp, Homo sapiens
cccattaagatttca

SEQ ID NO: 96157 - DNA, 15 bp, Homo sapiens
tcccattaagatttc

SEQ ID NO: 96158 - DNA, 15 bp, Homo sapiens
ttcccattaagattt

SEQ ID NO: 96159 - DNA, 15 bp, Homo sapiens
cttcccattaagatt

SEQ ID NO: 96160 - DNA, 15 bp, Homo sapiens
acttcccattaagat

SEQ ID NO: 96161 - DNA, 15 bp, Homo sapiens
cacttcccattaaga

SEQ ID NO: 96162 - DNA, 15 bp, Homo sapiens
gcacttcccattaag

SEQ ID NO: 96163 - DNA, 15 bp, Homo sapiens
tgcacttcccattaa

SEQ ID NO: 96164 - DNA, 15 bp, Homo sapiens
ctgcacttcccatta

SEQ ID NO: 96165 - DNA, 15 bp, Homo sapiens
actgcacttcccatt

SEQ ID NO: 96166 - DNA, 15 bp, Homo sapiens
aactgcacttcccat

SEQ ID NO: 96167 - DNA, 15 bp, Homo sapiens
taactgcacttccca

SEQ ID NO: 96168 - DNA, 15 bp, Homo sapiens
ttaactgcacttccc

SEQ ID NO: 96169 - DNA, 15 bp, Homo sapiens
tttaactgcacttcc

SEQ ID NO: 96170 - DNA, 15 bp, Homo sapiens
ttttaactgcacttc

SEQ ID NO: 96171 - DNA, 15 bp, Homo sapiens
tttttaactgcactt

SEQ ID NO: 96172 - DNA, 15 bp, Homo sapiens
ctttttaactgcact

SEQ ID NO: 96173 - DNA, 15 bp, Homo sapiens
tctttttaactgcac

SEQ ID NO: 96174 - DNA, 15 bp, Homo sapiens
ttctttttaactgca

SEQ ID NO: 96175 - DNA, 15 bp, Homo sapiens
cttctttttaactgc

SEQ ID NO: 96176 - DNA, 15 bp, Homo sapiens
tcttctttttaactg

SEQ ID NO: 96177 - DNA, 15 bp, Homo sapiens
ttcttctttttaact

SEQ ID NO: 96178 - DNA, 15 bp, Homo sapiens
tttcttctttttaac

SEQ ID NO: 96179 - DNA, 15 bp, Homo sapiens
ttttcttctttttaa

SEQ ID NO: 96180 - DNA, 15 bp, Homo sapiens
attttcttcttttta

SEQ ID NO: 96181 - DNA, 15 bp, Homo sapiens
cattttcttcttttt

SEQ ID NO: 96182 - DNA, 15 bp, Homo sapiens
ccattttcttctttt

SEQ ID NO: 96183 - DNA, 15 bp, Homo sapiens
tccattttcttcttt

SEQ ID NO: 96184 - DNA, 15 bp, Homo sapiens
gtccattttcttctt

SEQ ID NO: 96185 - DNA, 15 bp, Homo sapiens
tgtccattttcttct

SEQ ID NO: 96186 - DNA, 15 bp, Homo sapiens
atgtccattttcttc

SEQ ID NO: 96187 - DNA, 15 bp, Homo sapiens
aatgtccattttctt

SEQ ID NO: 96188 - DNA, 15 bp, Homo sapiens
aaatgtccattttct

SEQ ID NO: 96189 - DNA, 15 bp, Homo sapiens
aaaatgtccattttc

SEQ ID NO: 96190 - DNA, 15 bp, Homo sapiens
caaaatgtccatttt

SEQ ID NO: 96191 - DNA, 15 bp, Homo sapiens
tcaaaatgtccattt

SEQ ID NO: 96192 - DNA, 15 bp, Homo sapiens
atcaaaatgtccatt

SEQ ID NO: 96193 - DNA, 15 bp, Homo sapiens
aatcaaaatgtccat

SEQ ID NO: 96194 - DNA, 15 bp, Homo sapiens
caatcaaaatgtcca

SEQ ID NO: 96195 - DNA, 15 bp, Homo sapiens
gcaatcaaaatgtcc

SEQ ID NO: 96196 - DNA, 15 bp, Homo sapiens
agcaatcaaaatgtc

SEQ ID NO: 96197 - DNA, 15 bp, Homo sapiens
aagcaatcaaaatgt

SEQ ID NO: 96198 - DNA, 15 bp, Homo sapiens
gaagcaatcaaaatg

SEQ ID NO: 96199 - DNA, 15 bp, Homo sapiens
agaagcaatcaaaat

SEQ ID NO: 96200 - DNA, 15 bp, Homo sapiens
tagaagcaatcaaaa

SEQ ID NO: 96201 - DNA, 15 bp, Homo sapiens
ctagaagcaatcaaa

SEQ ID NO: 96202 - DNA, 15 bp, Homo sapiens
cctagaagcaatcaa

SEQ ID NO: 96203 - DNA, 15 bp, Homo sapiens
ccctagaagcaatca

SEQ ID NO: 96204 - DNA, 15 bp, Homo sapiens
cccctagaagcaatc

SEQ ID NO: 96205 - DNA, 15 bp, Homo sapiens
acccctagaagcaat

SEQ ID NO: 96206 - DNA, 15 bp, Homo sapiens
aacccctagaagcaa

SEQ ID NO: 96207 - DNA, 15 bp, Homo sapiens
aaacccctagaagca

SEQ ID NO: 96208 - DNA, 15 bp, Homo sapiens
aaaacccctagaagc

SEQ ID NO: 96209 - DNA, 15 bp, Homo sapiens
aaaaacccctagaag

SEQ ID NO: 96210 - DNA, 15 bp, Homo sapiens
aaaaaacccctagaa

SEQ ID NO: 96211 - DNA, 15 bp, Homo sapiens
aaaaaaacccctaga

SEQ ID NO: 96212 - DNA, 15 bp, Homo sapiens
aaaaaaaacccctag

SEQ ID NO: 96213 - DNA, 15 bp, Homo sapiens
aaaaaaaaaccccta

SEQ ID NO: 96214 - DNA, 15 bp, Homo sapiens
aaaaaaaaaacccct

SEQ ID NO: 96215 - DNA, 15 bp, Homo sapiens
aaaaaaaaaaacccc

SEQ ID NO: 96216 - DNA, 15 bp, Homo sapiens
aaaaaaaaaaaaccc

SEQ ID NO: 96217 - DNA, 15 bp, Homo sapiens
gaacagagcgagact

SEQ ID NO: 96218 - DNA, 15 bp, Homo sapiens
ggaacagagcgagac

SEQ ID NO: 96219 - DNA, 15 bp, Homo sapiens
gggaacagagcgaga

SEQ ID NO: 96220 - DNA, 15 bp, Homo sapiens
agggaacagagcgag

SEQ ID NO: 96221 - DNA, 15 bp, Homo sapiens
cagggaacagagcga

SEQ ID NO: 96222 - DNA, 15 bp, Homo sapiens
ccagggaacagagcg

SEQ ID NO: 96223 - DNA, 15 bp, Homo sapiens
cccagggaacagagc

SEQ ID NO: 96224 - DNA, 15 bp, Homo sapiens
acccagggaacagag

SEQ ID NO: 96225 - DNA, 15 bp, Homo sapiens
aacccagggaacaga

SEQ ID NO: 96226 - DNA, 15 bp, Homo sapiens
taacccagggaacag

SEQ ID NO: 96227 - DNA, 15 bp, Homo sapiens
ctaacccagggaaca

SEQ ID NO: 96228 - DNA, 15 bp, Homo sapiens
tctaacccagggaac

SEQ ID NO: 96229 - DNA, 15 bp, Homo sapiens
ctctaacccagggaa

SEQ ID NO: 96230 - DNA, 15 bp, Homo sapiens
actctaacccaggga

SEQ ID NO: 96231 - DNA, 15 bp, Homo sapiens
cactctaacccaggg

SEQ ID NO: 96232 - DNA, 15 bp, Homo sapiens
gcactctaacccagg

SEQ ID NO: 96233 - DNA, 15 bp, Homo sapiens
tgcactctaacccag

SEQ ID NO: 96234 - DNA, 15 bp, Homo sapiens
ctgcactctaaccca

SEQ ID NO: 96235 - DNA, 15 bp, Homo sapiens
actgcactctaaccc

SEQ ID NO: 96236 - DNA, 15 bp, Homo sapiens
cactgcactctaacc

SEQ ID NO: 96237 - DNA, 15 bp, Homo sapiens
ccactgcactctaac

SEQ ID NO: 96238 - DNA, 15 bp, Homo sapiens
accactgcactctaa

SEQ ID NO: 96239 - DNA, 15 bp, Homo sapiens
cgagatcgcaccact

SEQ ID NO: 96240 - DNA, 15 bp, Homo sapiens
ccgagatcgcaccac

SEQ ID NO: 96241 - DNA, 15 bp, Homo sapiens
tggcagaggttgcag

SEQ ID NO: 96242 - DNA, 15 bp, Homo sapiens
gtggcagaggttgca

SEQ ID NO: 96243 - DNA, 15 bp, Homo sapiens
ggtggcagaggttgc

SEQ ID NO: 96244 - DNA, 15 bp, Homo sapiens
gggtggcagaggttg

SEQ ID NO: 96245 - DNA, 15 bp, Homo sapiens
tgggtggcagaggtt

SEQ ID NO: 96246 - DNA, 15 bp, Homo sapiens
ctgggtggcagaggt

SEQ ID NO: 96247 - DNA, 15 bp, Homo sapiens
cctgggtggcagagg

SEQ ID NO: 96248 - DNA, 15 bp, Homo sapiens
acctgggtggcagag

SEQ ID NO: 96249 - DNA, 15 bp, Homo sapiens
aacctgggtggcaga

SEQ ID NO: 96250 - DNA, 15 bp, Homo sapiens
gaacctgggtggcag

SEQ ID NO: 96251 - DNA, 15 bp, Homo sapiens
tgaacctgggtggca

SEQ ID NO: 96252 - DNA, 15 bp, Homo sapiens
ctgaacctgggtggc

SEQ ID NO: 96253 - DNA, 15 bp, Homo sapiens
cctgaacctgggtgg

SEQ ID NO: 96254 - DNA, 15 bp, Homo sapiens
gcctgaacctgggtg

SEQ ID NO: 96255 - DNA, 15 bp, Homo sapiens
tgcctgaacctgggt

SEQ ID NO: 96256 - DNA, 15 bp, Homo sapiens
ttgcctgaacctggg

SEQ ID NO: 96257 - DNA, 15 bp, Homo sapiens
attgcctgaacctgg

SEQ ID NO: 96258 - DNA, 15 bp, Homo sapiens
aattgcctgaacctg

SEQ ID NO: 96259 - DNA, 15 bp, Homo sapiens
gaattgcctgaacct

SEQ ID NO: 96260 - DNA, 15 bp, Homo sapiens
agaattgcctgaacc

SEQ ID NO: 96261 - DNA, 15 bp, Homo sapiens
gagaattgcctgaac

SEQ ID NO: 96262 - DNA, 15 bp, Homo sapiens
ggagaattgcctgaa

SEQ ID NO: 96263 - DNA, 15 bp, Homo sapiens
gggagaattgcctga

SEQ ID NO: 96264 - DNA, 15 bp, Homo sapiens
cgggagaattgcctg

SEQ ID NO: 96265 - DNA, 15 bp, Homo sapiens
gcgggagaattgcct

SEQ ID NO: 96266 - DNA, 15 bp, Homo sapiens
ggcgggagaattgcc

SEQ ID NO: 96267 - DNA, 15 bp, Homo sapiens
aggcgggagaattgc

SEQ ID NO: 96268 - DNA, 15 bp, Homo sapiens
gaggcgggagaattg

SEQ ID NO: 96269 - DNA, 15 bp, Homo sapiens
agaggcgggagaatt

SEQ ID NO: 96270 - DNA, 15 bp, Homo sapiens
tagaggcgggagaat

SEQ ID NO: 96271 - DNA, 15 bp, Homo sapiens
gtagaggcgggagaa

SEQ ID NO: 96272 - DNA, 15 bp, Homo sapiens
ggtagaggcgggaga

SEQ ID NO: 96273 - DNA, 15 bp, Homo sapiens
aggtagaggcgggag

SEQ ID NO: 96274 - DNA, 15 bp, Homo sapiens
gaggtagaggcggga

SEQ ID NO: 96275 - DNA, 15 bp, Homo sapiens
ggaggtagaggcggg

SEQ ID NO: 96276 - DNA, 15 bp, Homo sapiens
gggaggtagaggcgg

SEQ ID NO: 96277 - DNA, 15 bp, Homo sapiens
tgggaggtagaggcg

SEQ ID NO: 96278 - DNA, 15 bp, Homo sapiens
ttgggaggtagaggc

SEQ ID NO: 96279 - DNA, 15 bp, Homo sapiens
cttgggaggtagagg

SEQ ID NO: 96280 - DNA, 15 bp, Homo sapiens
acttgggaggtagag

SEQ ID NO: 96281 - DNA, 15 bp, Homo sapiens
tacttgggaggtaga

SEQ ID NO: 96282 - DNA, 15 bp, Homo sapiens
ctacttgggaggtag

SEQ ID NO: 96283 - DNA, 15 bp, Homo sapiens
gctacttgggaggta

SEQ ID NO: 96284 - DNA, 15 bp, Homo sapiens
accaggcatggtggt

SEQ ID NO: 96285 - DNA, 15 bp, Homo sapiens
aaccaggcatggtgg

SEQ ID NO: 96286 - DNA, 15 bp, Homo sapiens
taaccaggcatggtg

SEQ ID NO: 96287 - DNA, 15 bp, Homo sapiens
ctaaccaggcatggt

SEQ ID NO: 96288 - DNA, 15 bp, Homo sapiens
actaaccaggcatgg

SEQ ID NO: 96289 - DNA, 15 bp, Homo sapiens
aactaaccaggcatg

SEQ ID NO: 96290 - DNA, 15 bp, Homo sapiens
aaactaaccaggcat

SEQ ID NO: 96291 - DNA, 15 bp, Homo sapiens
aaaactaaccaggca

SEQ ID NO: 96292 - DNA, 15 bp, Homo sapiens
aaaaactaaccaggc

SEQ ID NO: 96293 - DNA, 15 bp, Homo sapiens
caaaaactaaccagg

SEQ ID NO: 96294 - DNA, 15 bp, Homo sapiens
acaaaaactaaccag

SEQ ID NO: 96295 - DNA, 15 bp, Homo sapiens
tacaaaaactaacca

SEQ ID NO: 96296 - DNA, 15 bp, Homo sapiens
atacaaaaactaacc

SEQ ID NO: 96297 - DNA, 15 bp, Homo sapiens
aatacaaaaactaac

SEQ ID NO: 96298 - DNA, 15 bp, Homo sapiens
aaatacaaaaactaa

SEQ ID NO: 96299 - DNA, 15 bp, Homo sapiens
taaaaatacaaaaac

SEQ ID NO: 96300 - DNA, 15 bp, Homo sapiens
atggcaaaaccccat

SEQ ID NO: 96301 - DNA, 15 bp, Homo sapiens
catggcaaaacccca

SEQ ID NO: 96302 - DNA, 15 bp, Homo sapiens
atggccaacatggca

SEQ ID NO: 96303 - DNA, 15 bp, Homo sapiens
catggccaacatggc

SEQ ID NO: 96304 - DNA, 15 bp, Homo sapiens
gcatggccaacatgg

SEQ ID NO: 96305 - DNA, 15 bp, Homo sapiens
agcatggccaacatg

SEQ ID NO: 96306 - DNA, 15 bp, Homo sapiens
cagcatggccaacat

SEQ ID NO: 96307 - DNA, 15 bp, Homo sapiens
tcagcatggccaaca

SEQ ID NO: 96308 - DNA, 15 bp, Homo sapiens
atcagcatggccaac

SEQ ID NO: 96309 - DNA, 15 bp, Homo sapiens
gatcagcatggccaa

SEQ ID NO: 96310 - DNA, 15 bp, Homo sapiens
agatcagcatggcca

SEQ ID NO: 96311 - DNA, 15 bp, Homo sapiens
gagatcagcatggcc

SEQ ID NO: 96312 - DNA, 15 bp, Homo sapiens
tgagatcagcatggc

SEQ ID NO: 96313 - DNA, 15 bp, Homo sapiens
ttgagatcagcatgg

SEQ ID NO: 96314 - DNA, 15 bp, Homo sapiens
tttgagatcagcatg

SEQ ID NO: 96315 - DNA, 15 bp, Homo sapiens
gtttgagatcagcat

SEQ ID NO: 96316 - DNA, 15 bp, Homo sapiens
agtttgagatcagca

SEQ ID NO: 96317 - DNA, 15 bp, Homo sapiens
gagtttgagatcagc

SEQ ID NO: 96318 - DNA, 15 bp, Homo sapiens
ggagtttgagatcag

SEQ ID NO: 96319 - DNA, 15 bp, Homo sapiens
aggagtttgagatca

SEQ ID NO: 96320 - DNA, 15 bp, Homo sapiens
caggagtttgagatc

SEQ ID NO: 96321 - DNA, 15 bp, Homo sapiens
tcaggagtttgagat

SEQ ID NO: 96322 - DNA, 15 bp, Homo sapiens
gggatcacctgaggt

SEQ ID NO: 96323 - DNA, 15 bp, Homo sapiens
ggggatcacctgagg

SEQ ID NO: 96324 - DNA, 15 bp, Homo sapiens
gggggatcacctgag

SEQ ID NO: 96325 - DNA, 15 bp, Homo sapiens
agggggatcacctga

SEQ ID NO: 96326 - DNA, 15 bp, Homo sapiens
cagggggatcacctg

SEQ ID NO: 96327 - DNA, 15 bp, Homo sapiens
gcagggggatcacct

SEQ ID NO: 96328 - DNA, 15 bp, Homo sapiens
ggcagggggatcacc

SEQ ID NO: 96329 - DNA, 15 bp, Homo sapiens
cggcagggggatcac

SEQ ID NO: 96330 - DNA, 15 bp, Homo sapiens
acggcagggggatca

SEQ ID NO: 96331 - DNA, 15 bp, Homo sapiens
cacggcagggggatc

SEQ ID NO: 96332 - DNA, 15 bp, Homo sapiens
ccacggcagggggat

SEQ ID NO: 96333 - DNA, 15 bp, Homo sapiens
gccacggcaggggga

SEQ ID NO: 96334 - DNA, 15 bp, Homo sapiens
ggccacggcaggggg

SEQ ID NO: 96335 - DNA, 15 bp, Homo sapiens
aggccacggcagggg

SEQ ID NO: 96336 - DNA, 15 bp, Homo sapiens
gaggccacggcaggg

SEQ ID NO: 96337 - DNA, 15 bp, Homo sapiens
ggaggccacggcagg

SEQ ID NO: 96338 - DNA, 15 bp, Homo sapiens
gggaggccacggcag

SEQ ID NO: 96339 - DNA, 15 bp, Homo sapiens
tgggaggccacggca

SEQ ID NO: 96340 - DNA, 15 bp, Homo sapiens
ttgggaggccacggc

SEQ ID NO: 96341 - DNA, 15 bp, Homo sapiens
tttgggaggccacgg

SEQ ID NO: 96342 - DNA, 15 bp, Homo sapiens
ctttgggaggccacg

SEQ ID NO: 96343 - DNA, 15 bp, Homo sapiens
actttgggaggccac

SEQ ID NO: 96344 - DNA, 15 bp, Homo sapiens
ttggtggctcacacc

SEQ ID NO: 96345 - DNA, 15 bp, Homo sapiens
cttggtggctcacac

SEQ ID NO: 96346 - DNA, 15 bp, Homo sapiens
tcttggtggctcaca

SEQ ID NO: 96347 - DNA, 15 bp, Homo sapiens
gtcttggtggctcac

SEQ ID NO: 96348 - DNA, 15 bp, Homo sapiens
agtcttggtggctca

SEQ ID NO: 96349 - DNA, 15 bp, Homo sapiens
cagtcttggtggctc

SEQ ID NO: 96350 - DNA, 15 bp, Homo sapiens
tcagtcttggtggct

SEQ ID NO: 96351 - DNA, 15 bp, Homo sapiens
gtcagtcttggtggc

SEQ ID NO: 96352 - DNA, 15 bp, Homo sapiens
agtcagtcttggtgg

SEQ ID NO: 96353 - DNA, 15 bp, Homo sapiens
cagtcagtcttggtg

SEQ ID NO: 96354 - DNA, 15 bp, Homo sapiens
ccagtcagtcttggt

SEQ ID NO: 96355 - DNA, 15 bp, Homo sapiens
gccagtcagtcttgg

SEQ ID NO: 96356 - DNA, 15 bp, Homo sapiens
agccagtcagtcttg

SEQ ID NO: 96357 - DNA, 15 bp, Homo sapiens
aagccagtcagtctt

SEQ ID NO: 96358 - DNA, 15 bp, Homo sapiens
gaagccagtcagtct

SEQ ID NO: 96359 - DNA, 15 bp, Homo sapiens
agaagccagtcagtc

SEQ ID NO: 96360 - DNA, 15 bp, Homo sapiens
tagaagccagtcagt

SEQ ID NO: 96361 - DNA, 15 bp, Homo sapiens
ctagaagccagtcag

SEQ ID NO: 96362 - DNA, 15 bp, Homo sapiens
tctagaagccagtca

SEQ ID NO: 96363 - DNA, 15 bp, Homo sapiens
atctagaagccagtc

SEQ ID NO: 96364 - DNA, 15 bp, Homo sapiens
aatctagaagccagt

SEQ ID NO: 96365 - DNA, 15 bp, Homo sapiens
aaatctagaagccag

SEQ ID NO: 96366 - DNA, 15 bp, Homo sapiens
aaaatctagaagcca

SEQ ID NO: 96367 - DNA, 15 bp, Homo sapiens
aaaaatctagaagcc

SEQ ID NO: 96368 - DNA, 15 bp, Homo sapiens
aaaaaatctagaagc

SEQ ID NO: 96369 - DNA, 15 bp, Homo sapiens
caaaaaatctagaag

SEQ ID NO: 96370 - DNA, 15 bp, Homo sapiens
acaaaaaatctagaa

SEQ ID NO: 96371 - DNA, 15 bp, Homo sapiens
aacaaaaaatctaga

SEQ ID NO: 96372 - DNA, 15 bp, Homo sapiens
aaacaaaaaatctag

SEQ ID NO: 96373 - DNA, 15 bp, Homo sapiens
aaaacaaaaaatcta

SEQ ID NO: 96374 - DNA, 15 bp, Homo sapiens
aaaaacaaaaaatct

SEQ ID NO: 96375 - DNA, 15 bp, Homo sapiens
caaaaacaaaaaatc

SEQ ID NO: 96376 - DNA, 15 bp, Homo sapiens
gcaaaaacaaaaaat

SEQ ID NO: 96377 - DNA, 15 bp, Homo sapiens
agcaaaaacaaaaaa

SEQ ID NO: 96378 - DNA, 15 bp, Homo sapiens
aagcaaaaacaaaaa

SEQ ID NO: 96379 - DNA, 15 bp, Homo sapiens
aaagcaaaaacaaaa

SEQ ID NO: 96380 - DNA, 15 bp, Homo sapiens
gaaagcaaaaacaaa

SEQ ID NO: 96381 - DNA, 15 bp, Homo sapiens
agaaagcaaaaacaa

SEQ ID NO: 96382 - DNA, 15 bp, Homo sapiens
aagaaagcaaaaaca

SEQ ID NO: 96383 - DNA, 15 bp, Homo sapiens
aaagaaagcaaaaac

SEQ ID NO: 96384 - DNA, 15 bp, Homo sapiens
aaaagaaagcaaaaa

SEQ ID NO: 96385 - DNA, 15 bp, Homo sapiens
aaaaagaaagcaaaa

SEQ ID NO: 96386 - DNA, 15 bp, Homo sapiens
aaaaaagaaagcaaa

SEQ ID NO: 96387 - DNA, 15 bp, Homo sapiens
gaaaaaagaaagcaa

SEQ ID NO: 96388 - DNA, 15 bp, Homo sapiens
agaaaaaagaaagca

SEQ ID NO: 96389 - DNA, 15 bp, Homo sapiens
aagaaaaaagaaagc

SEQ ID NO: 96390 - DNA, 15 bp, Homo sapiens
aaagaaaaaagaaag

SEQ ID NO: 96391 - DNA, 15 bp, Homo sapiens
aaaagaaaaaagaaa

SEQ ID NO: 96392 - DNA, 15 bp, Homo sapiens
aaaaagaaaaaagaa

SEQ ID NO: 96393 - DNA, 15 bp, Homo sapiens
aaaaaagaaaaaaga

SEQ ID NO: 96394 - DNA, 15 bp, Homo sapiens
gaaaaaagaaaaaag

SEQ ID NO: 96395 - DNA, 15 bp, Homo sapiens
ggaaaaaagaaaaaa

SEQ ID NO: 96396 - DNA, 15 bp, Homo sapiens
tggaaaaaagaaaaa

SEQ ID NO: 96397 - DNA, 15 bp, Homo sapiens
atggaaaaaagaaaa

SEQ ID NO: 96398 - DNA, 15 bp, Homo sapiens
tataatggaaaaaag

SEQ ID NO: 96399 - DNA, 15 bp, Homo sapiens
ttataatggaaaaaa

SEQ ID NO: 96400 - DNA, 15 bp, Homo sapiens
cttataatggaaaaa

SEQ ID NO: 96401 - DNA, 15 bp, Homo sapiens
acttataatggaaaa

SEQ ID NO: 96402 - DNA, 15 bp, Homo sapiens
tacttataatggaaa

SEQ ID NO: 96403 - DNA, 15 bp, Homo sapiens
ctacttataatggaa

SEQ ID NO: 96404 - DNA, 15 bp, Homo sapiens
actacttataatgga

SEQ ID NO: 96405 - DNA, 15 bp, Homo sapiens
cactacttataatgg

SEQ ID NO: 96406 - DNA, 15 bp, Homo sapiens
gcactacttataatg

SEQ ID NO: 96407 - DNA, 15 bp, Homo sapiens
agcactacttataat

SEQ ID NO: 96408 - DNA, 15 bp, Homo sapiens
tagcactacttataa

SEQ ID NO: 96409 - DNA, 15 bp, Homo sapiens
gtagcactacttata

SEQ ID NO: 96410 - DNA, 15 bp, Homo sapiens
tgtagcactacttat

SEQ ID NO: 96411 - DNA, 15 bp, Homo sapiens
atgtagcactactta

SEQ ID NO: 96412 - DNA, 15 bp, Homo sapiens
aatgtagcactactt

SEQ ID NO: 96413 - DNA, 15 bp, Homo sapiens
taatgtagcactact

SEQ ID NO: 96414 - DNA, 15 bp, Homo sapiens
ttaatgtagcactac

SEQ ID NO: 96415 - DNA, 15 bp, Homo sapiens
tttaatgtagcacta

SEQ ID NO: 96416 - DNA, 15 bp, Homo sapiens
atttaatgtagcact

SEQ ID NO: 96417 - DNA, 15 bp, Homo sapiens
aatttaatgtagcac

SEQ ID NO: 96418 - DNA, 15 bp, Homo sapiens
aaatttaatgtagca

SEQ ID NO: 96419 - DNA, 15 bp, Homo sapiens
taaatttaatgtagc

SEQ ID NO: 96420 - DNA, 15 bp, Homo sapiens
gtaaatttaatgtag

SEQ ID NO: 96421 - DNA, 15 bp, Homo sapiens
agtaaatttaatgta

SEQ ID NO: 96422 - DNA, 15 bp, Homo sapiens
aagtaaatttaatgt

SEQ ID NO: 96423 - DNA, 15 bp, Homo sapiens
gaagtaaatttaatg

SEQ ID NO: 96424 - DNA, 15 bp, Homo sapiens
tgaagtaaatttaat

SEQ ID NO: 96425 - DNA, 15 bp, Homo sapiens
atgaagtaaatttaa

SEQ ID NO: 96426 - DNA, 15 bp, Homo sapiens
tatgaagtaaattta

SEQ ID NO: 96427 - DNA, 15 bp, Homo sapiens
atatgaagtaaattt

SEQ ID NO: 96428 - DNA, 15 bp, Homo sapiens
tatatgaagtaaatt

SEQ ID NO: 96429 - DNA, 15 bp, Homo sapiens
atatatgaagtaaat

SEQ ID NO: 96430 - DNA, 15 bp, Homo sapiens
catatatgaagtaaa

SEQ ID NO: 96431 - DNA, 15 bp, Homo sapiens
acatatatgaagtaa

SEQ ID NO: 96432 - DNA, 15 bp, Homo sapiens
cacatatatgaagta

SEQ ID NO: 96433 - DNA, 15 bp, Homo sapiens
gcacatatatgaagt

SEQ ID NO: 96434 - DNA, 15 bp, Homo sapiens
agcacatatatgaag

SEQ ID NO: 96435 - DNA, 15 bp, Homo sapiens
aagcacatatatgaa

SEQ ID NO: 96436 - DNA, 15 bp, Homo sapiens
aaagcacatatatga

SEQ ID NO: 96437 - DNA, 15 bp, Homo sapiens
aaaagcacatatatg

SEQ ID NO: 96438 - DNA, 15 bp, Homo sapiens
taaaagcacatatat

SEQ ID NO: 96439 - DNA, 15 bp, Homo sapiens
gtaaaagcacatata

SEQ ID NO: 96440 - DNA, 15 bp, Homo sapiens
agtaaaagcacatat

SEQ ID NO: 96441 - DNA, 15 bp, Homo sapiens
cagtaaaagcacata

SEQ ID NO: 96442 - DNA, 15 bp, Homo sapiens
acagtaaaagcacat

SEQ ID NO: 96443 - DNA, 15 bp, Homo sapiens
aacagtaaaagcaca

SEQ ID NO: 96444 - DNA, 15 bp, Homo sapiens
taacagtaaaagcac

SEQ ID NO: 96445 - DNA, 15 bp, Homo sapiens
ataacagtaaaagca

SEQ ID NO: 96446 - DNA, 15 bp, Homo sapiens
tataacagtaaaagc

SEQ ID NO: 96447 - DNA, 15 bp, Homo sapiens
ctataacagtaaaag

SEQ ID NO: 96448 - DNA, 15 bp, Homo sapiens
tctataacagtaaaa

SEQ ID NO: 96449 - DNA, 15 bp, Homo sapiens
atctataacagtaaa

SEQ ID NO: 96450 - DNA, 15 bp, Homo sapiens
aatctataacagtaa

SEQ ID NO: 96451 - DNA, 15 bp, Homo sapiens
taatctataacagta

SEQ ID NO: 96452 - DNA, 15 bp, Homo sapiens
ctaatctataacagt

SEQ ID NO: 96453 - DNA, 15 bp, Homo sapiens
tctaatctataacag

SEQ ID NO: 96454 - DNA, 15 bp, Homo sapiens
atctaatctataaca

SEQ ID NO: 96455 - DNA, 15 bp, Homo sapiens
aatctaatctataac

SEQ ID NO: 96456 - DNA, 15 bp, Homo sapiens
gaatctaatctataa

SEQ ID NO: 96457 - DNA, 15 bp, Homo sapiens
ggaatctaatctata

SEQ ID NO: 96458 - DNA, 15 bp, Homo sapiens
aggaatctaatctat

SEQ ID NO: 96459 - DNA, 15 bp, Homo sapiens
taggaatctaatcta

SEQ ID NO: 96460 - DNA, 15 bp, Homo sapiens
gtaggaatctaatct

SEQ ID NO: 96461 - DNA, 15 bp, Homo sapiens
tgtaggaatctaatc

SEQ ID NO: 96462 - DNA, 15 bp, Homo sapiens
atgtaggaatctaat

SEQ ID NO: 96463 - DNA, 15 bp, Homo sapiens
gatgtaggaatctaa

SEQ ID NO: 96464 - DNA, 15 bp, Homo sapiens
agatgtaggaatcta

SEQ ID NO: 96465 - DNA, 15 bp, Homo sapiens
cagatgtaggaatct

SEQ ID NO: 96466 - DNA, 15 bp, Homo sapiens
ccagatgtaggaatc

SEQ ID NO: 96467 - DNA, 15 bp, Homo sapiens
cccagatgtaggaat

SEQ ID NO: 96468 - DNA, 15 bp, Homo sapiens
tcccagatgtaggaa

SEQ ID NO: 96469 - DNA, 15 bp, Homo sapiens
atcccagatgtagga

SEQ ID NO: 96470 - DNA, 15 bp, Homo sapiens
aatcccagatgtagg

SEQ ID NO: 96471 - DNA, 15 bp, Homo sapiens
taatcccagatgtag

SEQ ID NO: 96472 - DNA, 15 bp, Homo sapiens
gtaatcccagatgta

SEQ ID NO: 96473 - DNA, 15 bp, Homo sapiens
tgtaatcccagatgt

SEQ ID NO: 96474 - DNA, 15 bp, Homo sapiens
ctgtaatcccagatg

SEQ ID NO: 96475 - DNA, 15 bp, Homo sapiens
actgtaatcccagat

SEQ ID NO: 96476 - DNA, 15 bp, Homo sapiens
gactgtaatcccaga

SEQ ID NO: 96477 - DNA, 15 bp, Homo sapiens
tgactgtaatcccag

SEQ ID NO: 96478 - DNA, 15 bp, Homo sapiens
ttgactgtaatccca

SEQ ID NO: 96479 - DNA, 15 bp, Homo sapiens
gttgactgtaatccc

SEQ ID NO: 96480 - DNA, 15 bp, Homo sapiens
tgttgactgtaatcc

SEQ ID NO: 96481 - DNA, 15 bp, Homo sapiens
ctgttgactgtaatc

SEQ ID NO: 96482 - DNA, 15 bp, Homo sapiens
actgttgactgtaat

SEQ ID NO: 96483 - DNA, 15 bp, Homo sapiens
aactgttgactgtaa

SEQ ID NO: 96484 - DNA, 15 bp, Homo sapiens
taactgttgactgta

SEQ ID NO: 96485 - DNA, 15 bp, Homo sapiens
ataactgttgactgt

SEQ ID NO: 96486 - DNA, 15 bp, Homo sapiens
cataactgttgactg

SEQ ID NO: 96487 - DNA, 15 bp, Homo sapiens
gcataactgttgact

SEQ ID NO: 96488 - DNA, 15 bp, Homo sapiens
tgcataactgttgac

SEQ ID NO: 96489 - DNA, 15 bp, Homo sapiens
atgcataactgttga

SEQ ID NO: 96490 - DNA, 15 bp, Homo sapiens
aatgcataactgttg

SEQ ID NO: 96491 - DNA, 15 bp, Homo sapiens
caatgcataactgtt

SEQ ID NO: 96492 - DNA, 15 bp, Homo sapiens
acaatgcataactgt

SEQ ID NO: 96493 - DNA, 15 bp, Homo sapiens
gacaatgcataactg

SEQ ID NO: 96494 - DNA, 15 bp, Homo sapiens
tgacaatgcataact

SEQ ID NO: 96495 - DNA, 15 bp, Homo sapiens
ttgacaatgcataac

SEQ ID NO: 96496 - DNA, 15 bp, Homo sapiens
tttgacaatgcataa

SEQ ID NO: 96497 - DNA, 15 bp, Homo sapiens
ttttgacaatgcata

SEQ ID NO: 96498 - DNA, 15 bp, Homo sapiens
attttgacaatgcat

SEQ ID NO: 96499 - DNA, 15 bp, Homo sapiens
aattttgacaatgca

SEQ ID NO: 96500 - DNA, 15 bp, Homo sapiens
taattttgacaatgc

SEQ ID NO: 96501 - DNA, 15 bp, Homo sapiens
ataattttgacaatg

SEQ ID NO: 96502 - DNA, 15 bp, Homo sapiens
tataattttgacaat

SEQ ID NO: 96503 - DNA, 15 bp, Homo sapiens
ttataattttgacaa

SEQ ID NO: 96504 - DNA, 15 bp, Homo sapiens
attataattttgaca

SEQ ID NO: 96505 - DNA, 15 bp, Homo sapiens
tattataattttgac

SEQ ID NO: 96506 - DNA, 15 bp, Homo sapiens
ctattataattttga

SEQ ID NO: 96507 - DNA, 15 bp, Homo sapiens
gctattataattttg

SEQ ID NO: 96508 - DNA, 15 bp, Homo sapiens
agctattataatttt

SEQ ID NO: 96509 - DNA, 15 bp, Homo sapiens
tagctattataattt

SEQ ID NO: 96510 - DNA, 15 bp, Homo sapiens
atagctattataatt

SEQ ID NO: 96511 - DNA, 15 bp, Homo sapiens
aatagctattataat

SEQ ID NO: 96512 - DNA, 15 bp, Homo sapiens
aaatagctattataa

SEQ ID NO: 96513 - DNA, 15 bp, Homo sapiens
gaaatagctattata

SEQ ID NO: 96514 - DNA, 15 bp, Homo sapiens
cgaaatagctattat

SEQ ID NO: 96515 - DNA, 15 bp, Homo sapiens
tcgaaatagctatta

SEQ ID NO: 96516 - DNA, 15 bp, Homo sapiens
ctcgaaatagctatt

SEQ ID NO: 96517 - DNA, 15 bp, Homo sapiens
tctcgaaatagctat

SEQ ID NO: 96518 - DNA, 15 bp, Homo sapiens
atctcgaaatagcta

SEQ ID NO: 96519 - DNA, 15 bp, Homo sapiens
tatctcgaaatagct

SEQ ID NO: 96520 - DNA, 15 bp, Homo sapiens
ttatctcgaaatagc

SEQ ID NO: 96521 - DNA, 15 bp, Homo sapiens
cttatctcgaaatag

SEQ ID NO: 96522 - DNA, 15 bp, Homo sapiens
tcttatctcgaaata

SEQ ID NO: 96523 - DNA, 15 bp, Homo sapiens
ctcttatctcgaaat

SEQ ID NO: 96524 - DNA, 15 bp, Homo sapiens
actcttatctcgaaa

SEQ ID NO: 96525 - DNA, 15 bp, Homo sapiens
tactcttatctcgaa

SEQ ID NO: 96526 - DNA, 15 bp, Homo sapiens
atactcttatctcga

SEQ ID NO: 96527 - DNA, 15 bp, Homo sapiens
aatactcttatctcg

SEQ ID NO: 96528 - DNA, 15 bp, Homo sapiens
taatactcttatctc

SEQ ID NO: 96529 - DNA, 15 bp, Homo sapiens
ataatactcttatct

SEQ ID NO: 96530 - DNA, 15 bp, Homo sapiens
gataatactcttatc

SEQ ID NO: 96531 - DNA, 15 bp, Homo sapiens
ggataatactcttat

SEQ ID NO: 96532 - DNA, 15 bp, Homo sapiens
tggataatactctta

SEQ ID NO: 96533 - DNA, 15 bp, Homo sapiens
ttggataatactctt

SEQ ID NO: 96534 - DNA, 15 bp, Homo sapiens
tttggataatactct

SEQ ID NO: 96535 - DNA, 15 bp, Homo sapiens
atttggataatactc

SEQ ID NO: 96536 - DNA, 15 bp, Homo sapiens
catttggataatact

SEQ ID NO: 96537 - DNA, 15 bp, Homo sapiens
acatttggataatac

SEQ ID NO: 96538 - DNA, 15 bp, Homo sapiens
cacatttggataata

SEQ ID NO: 96539 - DNA, 15 bp, Homo sapiens
ccacatttggataat

SEQ ID NO: 96540 - DNA, 15 bp, Homo sapiens
accacatttggataa

SEQ ID NO: 96541 - DNA, 15 bp, Homo sapiens
caccacatttggata

SEQ ID NO: 96542 - DNA, 15 bp, Homo sapiens
acaccacatttggat

SEQ ID NO: 96543 - DNA, 15 bp, Homo sapiens
cacaccacatttgga

SEQ ID NO: 96544 - DNA, 15 bp, Homo sapiens
ccacaccacatttgg

SEQ ID NO: 96545 - DNA, 15 bp, Homo sapiens
tccacaccacatttg

SEQ ID NO: 96546 - DNA, 15 bp, Homo sapiens
ttccacaccacattt

SEQ ID NO: 96547 - DNA, 15 bp, Homo sapiens
attccacaccacatt

SEQ ID NO: 96548 - DNA, 15 bp, Homo sapiens
gattccacaccacat

SEQ ID NO: 96549 - DNA, 15 bp, Homo sapiens
ggattccacaccaca

SEQ ID NO: 96550 - DNA, 15 bp, Homo sapiens
gggattccacaccac

SEQ ID NO: 96551 - DNA, 15 bp, Homo sapiens
tgggattccacacca

SEQ ID NO: 96552 - DNA, 15 bp, Homo sapiens
ctgggattccacacc

SEQ ID NO: 96553 - DNA, 15 bp, Homo sapiens
actgggattccacac

SEQ ID NO: 96554 - DNA, 15 bp, Homo sapiens
gactgggattccaca

SEQ ID NO: 96555 - DNA, 15 bp, Homo sapiens
agactgggattccac

SEQ ID NO: 96556 - DNA, 15 bp, Homo sapiens
aagactgggattcca

SEQ ID NO: 96557 - DNA, 15 bp, Homo sapiens
taagactgggattcc

SEQ ID NO: 96558 - DNA, 15 bp, Homo sapiens
ttaagactgggattc

SEQ ID NO: 96559 - DNA, 15 bp, Homo sapiens
cttaagactgggatt

SEQ ID NO: 96560 - DNA, 15 bp, Homo sapiens
tcttaagactgggat

SEQ ID NO: 96561 - DNA, 15 bp, Homo sapiens
atcttaagactggga

SEQ ID NO: 96562 - DNA, 15 bp, Homo sapiens
aatcttaagactggg

SEQ ID NO: 96563 - DNA, 15 bp, Homo sapiens
taatcttaagactgg

SEQ ID NO: 96564 - DNA, 15 bp, Homo sapiens
ataatcttaagactg

SEQ ID NO: 96565 - DNA, 15 bp, Homo sapiens
aataatcttaagact

SEQ ID NO: 96566 - DNA, 15 bp, Homo sapiens
aaataatcttaagac

SEQ ID NO: 96567 - DNA, 15 bp, Homo sapiens
aaaataatcttaaga

SEQ ID NO: 96568 - DNA, 15 bp, Homo sapiens
gaaaataatcttaag

SEQ ID NO: 96569 - DNA, 15 bp, Homo sapiens
tgaaaataatcttaa

SEQ ID NO: 96570 - DNA, 15 bp, Homo sapiens
atgaaaataatctta

SEQ ID NO: 96571 - DNA, 15 bp, Homo sapiens
aatgaaaataatctt

SEQ ID NO: 96572 - DNA, 15 bp, Homo sapiens
taatgaaaataatct

SEQ ID NO: 96573 - DNA, 15 bp, Homo sapiens
gtaatgaaaataatc

SEQ ID NO: 96574 - DNA, 15 bp, Homo sapiens
agtaatgaaaataat

SEQ ID NO: 96575 - DNA, 15 bp, Homo sapiens
cagtaatgaaaataa

SEQ ID NO: 96576 - DNA, 15 bp, Homo sapiens
gcagtaatgaaaata

SEQ ID NO: 96577 - DNA, 15 bp, Homo sapiens
agcagtaatgaaaat

SEQ ID NO: 96578 - DNA, 15 bp, Homo sapiens
aagcagtaatgaaaa

SEQ ID NO: 96579 - DNA, 15 bp, Homo sapiens
taagcagtaatgaaa

SEQ ID NO: 96580 - DNA, 15 bp, Homo sapiens
ataagcagtaatgaa

SEQ ID NO: 96581 - DNA, 15 bp, Homo sapiens
tataagcagtaatga

SEQ ID NO: 96582 - DNA, 15 bp, Homo sapiens
atataagcagtaatg

SEQ ID NO: 96583 - DNA, 15 bp, Homo sapiens
aatataagcagtaat

SEQ ID NO: 96584 - DNA, 15 bp, Homo sapiens
gaatataagcagtaa

SEQ ID NO: 96585 - DNA, 15 bp, Homo sapiens
ggaatataagcagta

SEQ ID NO: 96586 - DNA, 15 bp, Homo sapiens
tggaatataagcagt

SEQ ID NO: 96587 - DNA, 15 bp, Homo sapiens
gtggaatataagcag

SEQ ID NO: 96588 - DNA, 15 bp, Homo sapiens
tgtggaatataagca

SEQ ID NO: 96589 - DNA, 15 bp, Homo sapiens
ctgtggaatataagc

SEQ ID NO: 96590 - DNA, 15 bp, Homo sapiens
gctgtggaatataag

SEQ ID NO: 96591 - DNA, 15 bp, Homo sapiens
cgctgtggaatataa

SEQ ID NO: 96592 - DNA, 15 bp, Homo sapiens
acgctgtggaatata

SEQ ID NO: 96593 - DNA, 15 bp, Homo sapiens
aacgctgtggaatat

SEQ ID NO: 96594 - DNA, 15 bp, Homo sapiens
taacgctgtggaata

SEQ ID NO: 96595 - DNA, 15 bp, Homo sapiens
ctaacgctgtggaat

SEQ ID NO: 96596 - DNA, 15 bp, Homo sapiens
gctaacgctgtggaa

SEQ ID NO: 96597 - DNA, 15 bp, Homo sapiens
tgctaacgctgtgga

SEQ ID NO: 96598 - DNA, 15 bp, Homo sapiens
atgctaacgctgtgg

SEQ ID NO: 96599 - DNA, 15 bp, Homo sapiens
catgctaacgctgtg

SEQ ID NO: 96600 - DNA, 15 bp, Homo sapiens
tcatgctaacgctgt

SEQ ID NO: 96601 - DNA, 15 bp, Homo sapiens
ctcatgctaacgctg

SEQ ID NO: 96602 - DNA, 15 bp, Homo sapiens
tctcatgctaacgct

SEQ ID NO: 96603 - DNA, 15 bp, Homo sapiens
atctcatgctaacgc

SEQ ID NO: 96604 - DNA, 15 bp, Homo sapiens
catctcatgctaacg

SEQ ID NO: 96605 - DNA, 15 bp, Homo sapiens
acatctcatgctaac

SEQ ID NO: 96606 - DNA, 15 bp, Homo sapiens
tacatctcatgctaa

SEQ ID NO: 96607 - DNA, 15 bp, Homo sapiens
atacatctcatgcta

SEQ ID NO: 96608 - DNA, 15 bp, Homo sapiens
catacatctcatgct

SEQ ID NO: 96609 - DNA, 15 bp, Homo sapiens
tcatacatctcatgc

SEQ ID NO: 96610 - DNA, 15 bp, Homo sapiens
ctcatacatctcatg

SEQ ID NO: 96611 - DNA, 15 bp, Homo sapiens
tctcatacatctcat

SEQ ID NO: 96612 - DNA, 15 bp, Homo sapiens
atctcatacatctca

SEQ ID NO: 96613 - DNA, 15 bp, Homo sapiens
aatctcatacatctc

SEQ ID NO: 96614 - DNA, 15 bp, Homo sapiens
aaatctcatacatct

SEQ ID NO: 96615 - DNA, 15 bp, Homo sapiens
aaaatctcatacatc

SEQ ID NO: 96616 - DNA, 15 bp, Homo sapiens
taaaatctcatacat

SEQ ID NO: 96617 - DNA, 15 bp, Homo sapiens
ataaaatctcataca

SEQ ID NO: 96618 - DNA, 15 bp, Homo sapiens
gataaaatctcatac

SEQ ID NO: 96619 - DNA, 15 bp, Homo sapiens
agataaaatctcata

SEQ ID NO: 96620 - DNA, 15 bp, Homo sapiens
cagataaaatctcat

SEQ ID NO: 96621 - DNA, 15 bp, Homo sapiens
tcagataaaatctca

SEQ ID NO: 96622 - DNA, 15 bp, Homo sapiens
ttcagataaaatctc

SEQ ID NO: 96623 - DNA, 15 bp, Homo sapiens
attcagataaaatct

SEQ ID NO: 96624 - DNA, 15 bp, Homo sapiens
aattcagataaaatc

SEQ ID NO: 96625 - DNA, 15 bp, Homo sapiens
aaattcagataaaat

SEQ ID NO: 96626 - DNA, 15 bp, Homo sapiens
aaaattcagataaaa

SEQ ID NO: 96627 - DNA, 15 bp, Homo sapiens
taaaattcagataaa

SEQ ID NO: 96628 - DNA, 15 bp, Homo sapiens
ttaaaattcagataa

SEQ ID NO: 96629 - DNA, 15 bp, Homo sapiens
tttaaaattcagata

SEQ ID NO: 96630 - DNA, 15 bp, Homo sapiens
ctttaaaattcagat

SEQ ID NO: 96631 - DNA, 15 bp, Homo sapiens
gctttaaaattcaga

SEQ ID NO: 96632 - DNA, 15 bp, Homo sapiens
tgctttaaaattcag

SEQ ID NO: 96633 - DNA, 15 bp, Homo sapiens
atgctttaaaattca

SEQ ID NO: 96634 - DNA, 15 bp, Homo sapiens
catgctttaaaattc

SEQ ID NO: 96635 - DNA, 15 bp, Homo sapiens
gcatgctttaaaatt

SEQ ID NO: 96636 - DNA, 15 bp, Homo sapiens
tgcatgctttaaaat

SEQ ID NO: 96637 - DNA, 15 bp, Homo sapiens
ttgcatgctttaaaa

SEQ ID NO: 96638 - DNA, 15 bp, Homo sapiens
attgcatgctttaaa

SEQ ID NO: 96639 - DNA, 15 bp, Homo sapiens
aattgcatgctttaa

SEQ ID NO: 96640 - DNA, 15 bp, Homo sapiens
gaattgcatgcttta

SEQ ID NO: 96641 - DNA, 15 bp, Homo sapiens
cgaattgcatgcttt

SEQ ID NO: 96642 - DNA, 15 bp, Homo sapiens
acgaattgcatgctt

SEQ ID NO: 96643 - DNA, 15 bp, Homo sapiens
aacgaattgcatgct

SEQ ID NO: 96644 - DNA, 15 bp, Homo sapiens
caacgaattgcatgc

SEQ ID NO: 96645 - DNA, 15 bp, Homo sapiens
acaacgaattgcatg

SEQ ID NO: 96646 - DNA, 15 bp, Homo sapiens
cacaacgaattgcat

SEQ ID NO: 96647 - DNA, 15 bp, Homo sapiens
ccacaacgaattgca

SEQ ID NO: 96648 - DNA, 15 bp, Homo sapiens
tccacaacgaattgc

SEQ ID NO: 96649 - DNA, 15 bp, Homo sapiens
ttccacaacgaattg

SEQ ID NO: 96650 - DNA, 15 bp, Homo sapiens
tttccacaacgaatt

SEQ ID NO: 96651 - DNA, 15 bp, Homo sapiens
ctttccacaacgaat

SEQ ID NO: 96652 - DNA, 15 bp, Homo sapiens
actttccacaacgaa

SEQ ID NO: 96653 - DNA, 15 bp, Homo sapiens
aactttccacaacga

SEQ ID NO: 96654 - DNA, 15 bp, Homo sapiens
taactttccacaacg

SEQ ID NO: 96655 - DNA, 15 bp, Homo sapiens
ataactttccacaac

SEQ ID NO: 96656 - DNA, 15 bp, Homo sapiens
aataactttccacaa

SEQ ID NO: 96657 - DNA, 15 bp, Homo sapiens
taataactttccaca

SEQ ID NO: 96658 - DNA, 15 bp, Homo sapiens
gtaataactttccac

SEQ ID NO: 96659 - DNA, 15 bp, Homo sapiens
agtaataactttcca

SEQ ID NO: 96660 - DNA, 15 bp, Homo sapiens
cagtaataactttcc

SEQ ID NO: 96661 - DNA, 15 bp, Homo sapiens
acagtaataactttc

SEQ ID NO: 96662 - DNA, 15 bp, Homo sapiens
cacagtaataacttt

SEQ ID NO: 96663 - DNA, 15 bp, Homo sapiens
gcacagtaataactt

SEQ ID NO: 96664 - DNA, 15 bp, Homo sapiens
ggcacagtaataact

SEQ ID NO: 96665 - DNA, 15 bp, Homo sapiens
aggcacagtaataac

SEQ ID NO: 96666 - DNA, 15 bp, Homo sapiens
aaggcacagtaataa

SEQ ID NO: 96667 - DNA, 15 bp, Homo sapiens
aaaggcacagtaata

SEQ ID NO: 96668 - DNA, 15 bp, Homo sapiens
taaaggcacagtaat

SEQ ID NO: 96669 - DNA, 15 bp, Homo sapiens
ttaaaggcacagtaa

SEQ ID NO: 96670 - DNA, 15 bp, Homo sapiens
tttaaaggcacagta

SEQ ID NO: 96671 - DNA, 15 bp, Homo sapiens
atttaaaggcacagt

SEQ ID NO: 96672 - DNA, 15 bp, Homo sapiens
tatttaaaggcacag

SEQ ID NO: 96673 - DNA, 15 bp, Homo sapiens
atatttaaaggcaca

SEQ ID NO: 96674 - DNA, 15 bp, Homo sapiens
aatatttaaaggcac

SEQ ID NO: 96675 - DNA, 15 bp, Homo sapiens
taatatttaaaggca

SEQ ID NO: 96676 - DNA, 15 bp, Homo sapiens
ttaatatttaaaggc

SEQ ID NO: 96677 - DNA, 15 bp, Homo sapiens
cttaatatttaaagg

SEQ ID NO: 96678 - DNA, 15 bp, Homo sapiens
tcttaatatttaaag

SEQ ID NO: 96679 - DNA, 15 bp, Homo sapiens
ctcttaatatttaaa

SEQ ID NO: 96680 - DNA, 15 bp, Homo sapiens
gctcttaatatttaa

SEQ ID NO: 96681 - DNA, 15 bp, Homo sapiens
agctcttaatattta

SEQ ID NO: 96682 - DNA, 15 bp, Homo sapiens
tagctcttaatattt

SEQ ID NO: 96683 - DNA, 15 bp, Homo sapiens
ttagctcttaatatt

SEQ ID NO: 96684 - DNA, 15 bp, Homo sapiens
tttagctcttaatat

SEQ ID NO: 96685 - DNA, 15 bp, Homo sapiens
ttttagctcttaata

SEQ ID NO: 96686 - DNA, 15 bp, Homo sapiens
gttttagctcttaat

SEQ ID NO: 96687 - DNA, 15 bp, Homo sapiens
agttttagctcttaa

SEQ ID NO: 96688 - DNA, 15 bp, Homo sapiens
aagttttagctctta

SEQ ID NO: 96689 - DNA, 15 bp, Homo sapiens
caagttttagctctt

SEQ ID NO: 96690 - DNA, 15 bp, Homo sapiens
tcaagttttagctct

SEQ ID NO: 96691 - DNA, 15 bp, Homo sapiens
gtcaagttttagctc

SEQ ID NO: 96692 - DNA, 15 bp, Homo sapiens
tgtcaagttttagct

SEQ ID NO: 96693 - DNA, 15 bp, Homo sapiens
atgtcaagttttagc

SEQ ID NO: 96694 - DNA, 15 bp, Homo sapiens
aatgtcaagttttag

SEQ ID NO: 96695 - DNA, 15 bp, Homo sapiens
caatgtcaagtttta

SEQ ID NO: 96696 - DNA, 15 bp, Homo sapiens
tcaatgtcaagtttt

SEQ ID NO: 96697 - DNA, 15 bp, Homo sapiens
ttcaatgtcaagttt

SEQ ID NO: 96698 - DNA, 15 bp, Homo sapiens
gttcaatgtcaagtt

SEQ ID NO: 96699 - DNA, 15 bp, Homo sapiens
tgttcaatgtcaagt

SEQ ID NO: 96700 - DNA, 15 bp, Homo sapiens
gtgttcaatgtcaag

SEQ ID NO: 96701 - DNA, 15 bp, Homo sapiens
tgtgttcaatgtcaa

SEQ ID NO: 96702 - DNA, 15 bp, Homo sapiens
atgtgttcaatgtca

SEQ ID NO: 96703 - DNA, 15 bp, Homo sapiens
aatgtgttcaatgtc

SEQ ID NO: 96704 - DNA, 15 bp, Homo sapiens
taatgtgttcaatgt

SEQ ID NO: 96705 - DNA, 15 bp, Homo sapiens
ttaatgtgttcaatg

SEQ ID NO: 96706 - DNA, 15 bp, Homo sapiens
gttaatgtgttcaat

SEQ ID NO: 96707 - DNA, 15 bp, Homo sapiens
tgttaatgtgttcaa

SEQ ID NO: 96708 - DNA, 15 bp, Homo sapiens
atgttaatgtgttca

SEQ ID NO: 96709 - DNA, 15 bp, Homo sapiens
aatgttaatgtgttc

SEQ ID NO: 96710 - DNA, 15 bp, Homo sapiens
aaatgttaatgtgtt

SEQ ID NO: 96711 - DNA, 15 bp, Homo sapiens
caaatgttaatgtgt

SEQ ID NO: 96712 - DNA, 15 bp, Homo sapiens
acaaatgttaatgtg

SEQ ID NO: 96713 - DNA, 15 bp, Homo sapiens
aacaaatgttaatgt

SEQ ID NO: 96714 - DNA, 15 bp, Homo sapiens
aaacaaatgttaatg

SEQ ID NO: 96715 - DNA, 15 bp, Homo sapiens
taaacaaatgttaat

SEQ ID NO: 96716 - DNA, 15 bp, Homo sapiens
ataaacaaatgttaa

SEQ ID NO: 96717 - DNA, 15 bp, Homo sapiens
aataaacaaatgtta

SEQ ID NO: 96718 - DNA, 15 bp, Homo sapiens
aaataaacaaatgtt

SEQ ID NO: 96719 - DNA, 15 bp, Homo sapiens
caaataaacaaatgt

SEQ ID NO: 96720 - DNA, 15 bp, Homo sapiens
ccaaataaacaaatg

SEQ ID NO: 96721 - DNA, 15 bp, Homo sapiens
cccaaataaacaaat

SEQ ID NO: 96722 - DNA, 15 bp, Homo sapiens
ccccaaataaacaaa

SEQ ID NO: 96723 - DNA, 15 bp, Homo sapiens
cccccaaataaacaa

SEQ ID NO: 96724 - DNA, 15 bp, Homo sapiens
tcccccaaataaaca

SEQ ID NO: 96725 - DNA, 15 bp, Homo sapiens
ttcccccaaataaac

SEQ ID NO: 96726 - DNA, 15 bp, Homo sapiens
attcccccaaataaa

SEQ ID NO: 96727 - DNA, 15 bp, Homo sapiens
cattcccccaaataa

SEQ ID NO: 96728 - DNA, 15 bp, Homo sapiens
ccattcccccaaata

SEQ ID NO: 96729 - DNA, 15 bp, Homo sapiens
gccattcccccaaat

SEQ ID NO: 96730 - DNA, 15 bp, Homo sapiens
agccattcccccaaa

SEQ ID NO: 96731 - DNA, 15 bp, Homo sapiens
aagccattcccccaa

SEQ ID NO: 96732 - DNA, 15 bp, Homo sapiens
aaagccattccccca

SEQ ID NO: 96733 - DNA, 15 bp, Homo sapiens
aaaagccattccccc

SEQ ID NO: 96734 - DNA, 15 bp, Homo sapiens
gaaaagccattcccc

SEQ ID NO: 96735 - DNA, 15 bp, Homo sapiens
ggaaaagccattccc

SEQ ID NO: 96736 - DNA, 15 bp, Homo sapiens
aggaaaagccattcc

SEQ ID NO: 96737 - DNA, 15 bp, Homo sapiens
aaggaaaagccattc

SEQ ID NO: 96738 - DNA, 15 bp, Homo sapiens
aaaggaaaagccatt

SEQ ID NO: 96739 - DNA, 15 bp, Homo sapiens
caaaggaaaagccat

SEQ ID NO: 96740 - DNA, 15 bp, Homo sapiens
acaaaggaaaagcca

SEQ ID NO: 96741 - DNA, 15 bp, Homo sapiens
tacaaaggaaaagcc

SEQ ID NO: 96742 - DNA, 15 bp, Homo sapiens
ctacaaaggaaaagc

SEQ ID NO: 96743 - DNA, 15 bp, Homo sapiens
tctacaaaggaaaag

SEQ ID NO: 96744 - DNA, 15 bp, Homo sapiens
atctacaaaggaaaa

SEQ ID NO: 96745 - DNA, 15 bp, Homo sapiens
gatctacaaaggaaa

SEQ ID NO: 96746 - DNA, 15 bp, Homo sapiens
cgatctacaaaggaa

SEQ ID NO: 96747 - DNA, 15 bp, Homo sapiens
gcgatctacaaagga

SEQ ID NO: 96748 - DNA, 15 bp, Homo sapiens
agcgatctacaaagg

SEQ ID NO: 96749 - DNA, 15 bp, Homo sapiens
tagcgatctacaaag

SEQ ID NO: 96750 - DNA, 15 bp, Homo sapiens
gtagcgatctacaaa

SEQ ID NO: 96751 - DNA, 15 bp, Homo sapiens
agtagcgatctacaa

SEQ ID NO: 96752 - DNA, 15 bp, Homo sapiens
gagtagcgatctaca

SEQ ID NO: 96753 - DNA, 15 bp, Homo sapiens
tgagtagcgatctac

SEQ ID NO: 96754 - DNA, 15 bp, Homo sapiens
ttgagtagcgatcta

SEQ ID NO: 96755 - DNA, 15 bp, Homo sapiens
tttgagtagcgatct

SEQ ID NO: 96756 - DNA, 15 bp, Homo sapiens
ttttgagtagcgatc

SEQ ID NO: 96757 - DNA, 15 bp, Homo sapiens
tttttgagtagcgat

SEQ ID NO: 96758 - DNA, 15 bp, Homo sapiens
ttttttgagtagcga

SEQ ID NO: 96759 - DNA, 15 bp, Homo sapiens
cttttttgagtagcg

SEQ ID NO: 96760 - DNA, 15 bp, Homo sapiens
acttttttgagtagc

SEQ ID NO: 96761 - DNA, 15 bp, Homo sapiens
tacttttttgagtag

SEQ ID NO: 96762 - DNA, 15 bp, Homo sapiens
ctacttttttgagta

SEQ ID NO: 96763 - DNA, 15 bp, Homo sapiens
cctacttttttgagt

SEQ ID NO: 96764 - DNA, 15 bp, Homo sapiens
acctacttttttgag

SEQ ID NO: 96765 - DNA, 15 bp, Homo sapiens
aacctacttttttga

SEQ ID NO: 96766 - DNA, 15 bp, Homo sapiens
caacctacttttttg

SEQ ID NO: 96767 - DNA, 15 bp, Homo sapiens
acaacctactttttt

SEQ ID NO: 96768 - DNA, 15 bp, Homo sapiens
gacaacctacttttt

SEQ ID NO: 96769 - DNA, 15 bp, Homo sapiens
agacaacctactttt

SEQ ID NO: 96770 - DNA, 15 bp, Homo sapiens
cagacaacctacttt

SEQ ID NO: 96771 - DNA, 15 bp, Homo sapiens
tcagacaacctactt

SEQ ID NO: 96772 - DNA, 15 bp, Homo sapiens
ttcagacaacctact

SEQ ID NO: 96773 - DNA, 15 bp, Homo sapiens
tttcagacaacctac

SEQ ID NO: 96774 - DNA, 15 bp, Homo sapiens
ctttcagacaaccta

SEQ ID NO: 96775 - DNA, 15 bp, Homo sapiens
actttcagacaacct

SEQ ID NO: 96776 - DNA, 15 bp, Homo sapiens
gactttcagacaacc

SEQ ID NO: 96777 - DNA, 15 bp, Homo sapiens
tgactttcagacaac

SEQ ID NO: 96778 - DNA, 15 bp, Homo sapiens
ttgactttcagacaa

SEQ ID NO: 96779 - DNA, 15 bp, Homo sapiens
cttgactttcagaca

SEQ ID NO: 96780 - DNA, 15 bp, Homo sapiens
tcttgactttcagac

SEQ ID NO: 96781 - DNA, 15 bp, Homo sapiens
ttcttgactttcaga

SEQ ID NO: 96782 - DNA, 15 bp, Homo sapiens
tttcttgactttcag

SEQ ID NO: 96783 - DNA, 15 bp, Homo sapiens
ttttcttgactttca

SEQ ID NO: 96784 - DNA, 15 bp, Homo sapiens
tttttcttgactttc

SEQ ID NO: 96785 - DNA, 15 bp, Homo sapiens
ctttttcttgacttt

SEQ ID NO: 96786 - DNA, 15 bp, Homo sapiens
gctttttcttgactt

SEQ ID NO: 96787 - DNA, 15 bp, Homo sapiens
agctttttcttgact

SEQ ID NO: 96788 - DNA, 15 bp, Homo sapiens
cagctttttcttgac

SEQ ID NO: 96789 - DNA, 15 bp, Homo sapiens
gcagctttttcttga

SEQ ID NO: 96790 - DNA, 15 bp, Homo sapiens
cgcagctttttcttg

SEQ ID NO: 96791 - DNA, 15 bp, Homo sapiens
tcgcagctttttctt

SEQ ID NO: 96792 - DNA, 15 bp, Homo sapiens
ttcgcagctttttct

SEQ ID NO: 96793 - DNA, 15 bp, Homo sapiens
gttcgcagctttttc

SEQ ID NO: 96794 - DNA, 15 bp, Homo sapiens
ggttcgcagcttttt

SEQ ID NO: 96795 - DNA, 15 bp, Homo sapiens
aggttcgcagctttt

SEQ ID NO: 96796 - DNA, 15 bp, Homo sapiens
caggttcgcagcttt

SEQ ID NO: 96797 - DNA, 15 bp, Homo sapiens
tcaggttcgcagctt

SEQ ID NO: 96798 - DNA, 15 bp, Homo sapiens
ttcaggttcgcagct

SEQ ID NO: 96799 - DNA, 15 bp, Homo sapiens
cttcaggttcgcagc

SEQ ID NO: 96800 - DNA, 15 bp, Homo sapiens
tcttcaggttcgcag

SEQ ID NO: 96801 - DNA, 15 bp, Homo sapiens
ttcttcaggttcgca

SEQ ID NO: 96802 - DNA, 15 bp, Homo sapiens
tttcttcaggttcgc

SEQ ID NO: 96803 - DNA, 15 bp, Homo sapiens
ctttcttcaggttcg

SEQ ID NO: 96804 - DNA, 15 bp, Homo sapiens
tctttcttcaggttc

SEQ ID NO: 96805 - DNA, 15 bp, Homo sapiens
gtctttcttcaggtt

SEQ ID NO: 96806 - DNA, 15 bp, Homo sapiens
agtctttcttcaggt

SEQ ID NO: 96807 - DNA, 15 bp, Homo sapiens
aagtctttcttcagg

SEQ ID NO: 96808 - DNA, 15 bp, Homo sapiens
caagtctttcttcag

SEQ ID NO: 96809 - DNA, 15 bp, Homo sapiens
ccaagtctttcttca

SEQ ID NO: 96810 - DNA, 15 bp, Homo sapiens
gccaagtctttcttc

SEQ ID NO: 96811 - DNA, 15 bp, Homo sapiens
tgccaagtctttctt

SEQ ID NO: 96812 - DNA, 15 bp, Homo sapiens
ctgccaagtctttct

SEQ ID NO: 96813 - DNA, 15 bp, Homo sapiens
tctgccaagtctttc

SEQ ID NO: 96814 - DNA, 15 bp, Homo sapiens
ctctgccaagtcttt

SEQ ID NO: 96815 - DNA, 15 bp, Homo sapiens
tctctgccaagtctt

SEQ ID NO: 96816 - DNA, 15 bp, Homo sapiens
atctctgccaagtct

SEQ ID NO: 96817 - DNA, 15 bp, Homo sapiens
catctctgccaagtc

SEQ ID NO: 96818 - DNA, 15 bp, Homo sapiens
gcatctctgccaagt

SEQ ID NO: 96819 - DNA, 15 bp, Homo sapiens
tgcatctctgccaag

SEQ ID NO: 96820 - DNA, 15 bp, Homo sapiens
ctgcatctctgccaa

SEQ ID NO: 96821 - DNA, 15 bp, Homo sapiens
cctgcatctctgcca

SEQ ID NO: 96822 - DNA, 15 bp, Homo sapiens
tcctgcatctctgcc

SEQ ID NO: 96823 - DNA, 15 bp, Homo sapiens
ttcctgcatctctgc

SEQ ID NO: 96824 - DNA, 15 bp, Homo sapiens
attcctgcatctctg

SEQ ID NO: 96825 - DNA, 15 bp, Homo sapiens
cattcctgcatctct

SEQ ID NO: 96826 - DNA, 15 bp, Homo sapiens
ccattcctgcatctc

SEQ ID NO: 96827 - DNA, 15 bp, Homo sapiens
tccattcctgcatct

SEQ ID NO: 96828 - DNA, 15 bp, Homo sapiens
atccattcctgcatc

SEQ ID NO: 96829 - DNA, 15 bp, Homo sapiens
catccattcctgcat

SEQ ID NO: 96830 - DNA, 15 bp, Homo sapiens
tcatccattcctgca

SEQ ID NO: 96831 - DNA, 15 bp, Homo sapiens
gtcatccattcctgc

SEQ ID NO: 96832 - DNA, 15 bp, Homo sapiens
ggtcatccattcctg

SEQ ID NO: 96833 - DNA, 15 bp, Homo sapiens
gggtcatccattcct

SEQ ID NO: 96834 - DNA, 15 bp, Homo sapiens
tgggtcatccattcc

SEQ ID NO: 96835 - DNA, 15 bp, Homo sapiens
ctgggtcatccattc

SEQ ID NO: 96836 - DNA, 15 bp, Homo sapiens
cctgggtcatccatt

SEQ ID NO: 96837 - DNA, 15 bp, Homo sapiens
gcctgggtcatccat

SEQ ID NO: 96838 - DNA, 15 bp, Homo sapiens
ggcctgggtcatcca

SEQ ID NO: 96839 - DNA, 15 bp, Homo sapiens
cggcctgggtcatcc

SEQ ID NO: 96840 - DNA, 15 bp, Homo sapiens
tcggcctgggtcatc

SEQ ID NO: 96841 - DNA, 15 bp, Homo sapiens
ctcggcctgggtcat

SEQ ID NO: 96842 - DNA, 15 bp, Homo sapiens
cctcggcctgggtca

SEQ ID NO: 96843 - DNA, 15 bp, Homo sapiens
tcctcggcctgggtc

SEQ ID NO: 96844 - DNA, 15 bp, Homo sapiens
ttcctcggcctgggt

SEQ ID NO: 96845 - DNA, 15 bp, Homo sapiens
cttcctcggcctggg

SEQ ID NO: 96846 - DNA, 15 bp, Homo sapiens
tcttcctcggcctgg

SEQ ID NO: 96847 - DNA, 15 bp, Homo sapiens
ttcttcctcggcctg

SEQ ID NO: 96848 - DNA, 15 bp, Homo sapiens
attcttcctcggcct

SEQ ID NO: 96849 - DNA, 15 bp, Homo sapiens
tattcttcctcggcc

SEQ ID NO: 96850 - DNA, 15 bp, Homo sapiens
atattcttcctcggc

SEQ ID NO: 96851 - DNA, 15 bp, Homo sapiens
aatattcttcctcgg

SEQ ID NO: 96852 - DNA, 15 bp, Homo sapiens
aaatattcttcctcg

SEQ ID NO: 96853 - DNA, 15 bp, Homo sapiens
caaatattcttcctc

SEQ ID NO: 96854 - DNA, 15 bp, Homo sapiens
ccaaatattcttcct

SEQ ID NO: 96855 - DNA, 15 bp, Homo sapiens
tccaaatattcttcc

SEQ ID NO: 96856 - DNA, 15 bp, Homo sapiens
ctccaaatattcttc

SEQ ID NO: 96857 - DNA, 15 bp, Homo sapiens
gctccaaatattctt

SEQ ID NO: 96858 - DNA, 15 bp, Homo sapiens
cgctccaaatattct

SEQ ID NO: 96859 - DNA, 15 bp, Homo sapiens
ccgctccaaatattc

SEQ ID NO: 96860 - DNA, 15 bp, Homo sapiens
cccgctccaaatatt

SEQ ID NO: 96861 - DNA, 15 bp, Homo sapiens
tcccgctccaaatat

SEQ ID NO: 96862 - DNA, 15 bp, Homo sapiens
atcccgctccaaata

SEQ ID NO: 96863 - DNA, 15 bp, Homo sapiens
aatcccgctccaaat

SEQ ID NO: 96864 - DNA, 15 bp, Homo sapiens
aaatcccgctccaaa

SEQ ID NO: 96865 - DNA, 15 bp, Homo sapiens
aaaatcccgctccaa

SEQ ID NO: 96866 - DNA, 15 bp, Homo sapiens
caaaatcccgctcca

SEQ ID NO: 96867 - DNA, 15 bp, Homo sapiens
tcaaaatcccgctcc

SEQ ID NO: 96868 - DNA, 15 bp, Homo sapiens
ctcaaaatcccgctc

SEQ ID NO: 96869 - DNA, 15 bp, Homo sapiens
actcaaaatcccgct

SEQ ID NO: 96870 - DNA, 15 bp, Homo sapiens
tactcaaaatcccgc

SEQ ID NO: 96871 - DNA, 15 bp, Homo sapiens
gtactcaaaatcccg

SEQ ID NO: 96872 - DNA, 15 bp, Homo sapiens
tgtactcaaaatccc

SEQ ID NO: 96873 - DNA, 15 bp, Homo sapiens
ttgtactcaaaatcc

SEQ ID NO: 96874 - DNA, 15 bp, Homo sapiens
cttgtactcaaaatc

SEQ ID NO: 96875 - DNA, 15 bp, Homo sapiens
acttgtactcaaaat

SEQ ID NO: 96876 - DNA, 15 bp, Homo sapiens
gacttgtactcaaaa

SEQ ID NO: 96877 - DNA, 15 bp, Homo sapiens
tgacttgtactcaaa

SEQ ID NO: 96878 - DNA, 15 bp, Homo sapiens
gtgacttgtactcaa

SEQ ID NO: 96879 - DNA, 15 bp, Homo sapiens
ggtgacttgtactca

SEQ ID NO: 96880 - DNA, 15 bp, Homo sapiens
tggtgacttgtactc

SEQ ID NO: 96881 - DNA, 15 bp, Homo sapiens
ctggtgacttgtact

SEQ ID NO: 96882 - DNA, 15 bp, Homo sapiens
tctggtgacttgtac

SEQ ID NO: 96883 - DNA, 15 bp, Homo sapiens
ttctggtgacttgta

SEQ ID NO: 96884 - DNA, 15 bp, Homo sapiens
cttctggtgacttgt

SEQ ID NO: 96885 - DNA, 15 bp, Homo sapiens
tcttctggtgacttg

SEQ ID NO: 96886 - DNA, 15 bp, Homo sapiens
ctcttctggtgactt

SEQ ID NO: 96887 - DNA, 15 bp, Homo sapiens
gctcttctggtgact

SEQ ID NO: 96888 - DNA, 15 bp, Homo sapiens
agctcttctggtgac

SEQ ID NO: 96889 - DNA, 15 bp, Homo sapiens
aagctcttctggtga

SEQ ID NO: 96890 - DNA, 15 bp, Homo sapiens
caagctcttctggtg

SEQ ID NO: 96891 - DNA, 15 bp, Homo sapiens
tcaagctcttctggt

SEQ ID NO: 96892 - DNA, 15 bp, Homo sapiens
ctcaagctcttctgg

SEQ ID NO: 96893 - DNA, 15 bp, Homo sapiens
tctcaagctcttctg

SEQ ID NO: 96894 - DNA, 15 bp, Homo sapiens
ctctcaagctcttct

SEQ ID NO: 96895 - DNA, 15 bp, Homo sapiens
actctcaagctcttc

SEQ ID NO: 96896 - DNA, 15 bp, Homo sapiens
cactctcaagctctt

SEQ ID NO: 96897 - DNA, 15 bp, Homo sapiens
gcactctcaagctct

SEQ ID NO: 96898 - DNA, 15 bp, Homo sapiens
agcactctcaagctc

SEQ ID NO: 96899 - DNA, 15 bp, Homo sapiens
cagcactctcaagct

SEQ ID NO: 96900 - DNA, 15 bp, Homo sapiens
acagcactctcaagc

SEQ ID NO: 96901 - DNA, 15 bp, Homo sapiens
cacagcactctcaag

SEQ ID NO: 96902 - DNA, 15 bp, Homo sapiens
ccacagcactctcaa

SEQ ID NO: 96903 - DNA, 15 bp, Homo sapiens
tccacagcactctca

SEQ ID NO: 96904 - DNA, 15 bp, Homo sapiens
ttccacagcactctc

SEQ ID NO: 96905 - DNA, 15 bp, Homo sapiens
cttccacagcactct

SEQ ID NO: 96906 - DNA, 15 bp, Homo sapiens
tcttccacagcactc

SEQ ID NO: 96907 - DNA, 15 bp, Homo sapiens
ctcttccacagcact

SEQ ID NO: 96908 - DNA, 15 bp, Homo sapiens
tctcttccacagcac

SEQ ID NO: 96909 - DNA, 15 bp, Homo sapiens
atctcttccacagca

SEQ ID NO: 96910 - DNA, 15 bp, Homo sapiens
catctcttccacagc

SEQ ID NO: 96911 - DNA, 15 bp, Homo sapiens
tcatctcttccacag

SEQ ID NO: 96912 - DNA, 15 bp, Homo sapiens
ttcatctcttccaca

SEQ ID NO: 96913 - DNA, 15 bp, Homo sapiens
cttcatctcttccac

SEQ ID NO: 96914 - DNA, 15 bp, Homo sapiens
ccttcatctcttcca

SEQ ID NO: 96915 - DNA, 15 bp, Homo sapiens
accttcatctcttcc

SEQ ID NO: 96916 - DNA, 15 bp, Homo sapiens
caccttcatctcttc

SEQ ID NO: 96917 - DNA, 15 bp, Homo sapiens
tcaccttcatctctt

SEQ ID NO: 96918 - DNA, 15 bp, Homo sapiens
ctcaccttcatctct

SEQ ID NO: 96919 - DNA, 15 bp, Homo sapiens
cctcaccttcatctc

SEQ ID NO: 96920 - DNA, 15 bp, Homo sapiens
gcctcaccttcatct

SEQ ID NO: 96921 - DNA, 15 bp, Homo sapiens
cgcctcaccttcatc

SEQ ID NO: 96922 - DNA, 15 bp, Homo sapiens
ccgcctcaccttcat

SEQ ID NO: 96923 - DNA, 15 bp, Homo sapiens
cccgcctcaccttca

SEQ ID NO: 96924 - DNA, 15 bp, Homo sapiens
ccccgcctcaccttc

SEQ ID NO: 96925 - DNA, 15 bp, Homo sapiens
tccccgcctcacctt

SEQ ID NO: 96926 - DNA, 15 bp, Homo sapiens
gtccccgcctcacct

SEQ ID NO: 96927 - DNA, 15 bp, Homo sapiens
cgtccccgcctcacc

SEQ ID NO: 96928 - DNA, 15 bp, Homo sapiens
tcgtccccgcctcac

SEQ ID NO: 96929 - DNA, 15 bp, Homo sapiens
gtcgtccccgcctca

SEQ ID NO: 96930 - DNA, 15 bp, Homo sapiens
ggtcgtccccgcctc

SEQ ID NO: 96931 - DNA, 15 bp, Homo sapiens
tggtcgtccccgcct

SEQ ID NO: 96932 - DNA, 15 bp, Homo sapiens
ctggtcgtccccgcc

SEQ ID NO: 96933 - DNA, 15 bp, Homo sapiens
actggtcgtccccgc

SEQ ID NO: 96934 - DNA, 15 bp, Homo sapiens
cactggtcgtccccg

SEQ ID NO: 96935 - DNA, 15 bp, Homo sapiens
gcactggtcgtcccc

SEQ ID NO: 96936 - DNA, 15 bp, Homo sapiens
ggcactggtcgtccc

SEQ ID NO: 96937 - DNA, 15 bp, Homo sapiens
tggcactggtcgtcc

SEQ ID NO: 96938 - DNA, 15 bp, Homo sapiens
ttggcactggtcgtc

SEQ ID NO: 96939 - DNA, 15 bp, Homo sapiens
gttggcactggtcgt

SEQ ID NO: 96940 - DNA, 15 bp, Homo sapiens
tgttggcactggtcg

SEQ ID NO: 96941 - DNA, 15 bp, Homo sapiens
ctgttggcactggtc

SEQ ID NO: 96942 - DNA, 15 bp, Homo sapiens
cctgttggcactggt

SEQ ID NO: 96943 - DNA, 15 bp, Homo sapiens
gcctgttggcactgg

SEQ ID NO: 96944 - DNA, 15 bp, Homo sapiens
agcctgttggcactg

SEQ ID NO: 96945 - DNA, 15 bp, Homo sapiens
aagcctgttggcact

SEQ ID NO: 96946 - DNA, 15 bp, Homo sapiens
gaagcctgttggcac

SEQ ID NO: 96947 - DNA, 15 bp, Homo sapiens
tgaagcctgttggca

SEQ ID NO: 96948 - DNA, 15 bp, Homo sapiens
atgaagcctgttggc

SEQ ID NO: 96949 - DNA, 15 bp, Homo sapiens
catgaagcctgttgg

SEQ ID NO: 96950 - DNA, 15 bp, Homo sapiens
gcatgaagcctgttg

SEQ ID NO: 96951 - DNA, 15 bp, Homo sapiens
ggcatgaagcctgtt

SEQ ID NO: 96952 - DNA, 15 bp, Homo sapiens
aggcatgaagcctgt

SEQ ID NO: 96953 - DNA, 15 bp, Homo sapiens
gaggcatgaagcctg

SEQ ID NO: 96954 - DNA, 15 bp, Homo sapiens
ggaggcatgaagcct

SEQ ID NO: 96955 - DNA, 15 bp, Homo sapiens
gggaggcatgaagcc

SEQ ID NO: 96956 - DNA, 15 bp, Homo sapiens
agggaggcatgaagc

SEQ ID NO: 96957 - DNA, 15 bp, Homo sapiens
gagggaggcatgaag

SEQ ID NO: 96958 - DNA, 15 bp, Homo sapiens
ggagggaggcatgaa

SEQ ID NO: 96959 - DNA, 15 bp, Homo sapiens
aggagggaggcatga

SEQ ID NO: 96960 - DNA, 15 bp, Homo sapiens
gaggagggaggcatg

SEQ ID NO: 96961 - DNA, 15 bp, Homo sapiens
ggaggagggaggcat

SEQ ID NO: 96962 - DNA, 15 bp, Homo sapiens
gggaggagggaggca

SEQ ID NO: 96963 - DNA, 15 bp, Homo sapiens
agggaggagggaggc

SEQ ID NO: 96964 - DNA, 15 bp, Homo sapiens
aagggaggagggagg

SEQ ID NO: 96965 - DNA, 15 bp, Homo sapiens
aaagggaggagggag

SEQ ID NO: 96966 - DNA, 15 bp, Homo sapiens
taaagggaggaggga

SEQ ID NO: 96967 - DNA, 15 bp, Homo sapiens
ttaaagggaggaggg

SEQ ID NO: 96968 - DNA, 15 bp, Homo sapiens
tttaaagggaggagg

SEQ ID NO: 96969 - DNA, 15 bp, Homo sapiens
ttttaaagggaggag

SEQ ID NO: 96970 - DNA, 15 bp, Homo sapiens
gttttaaagggagga

SEQ ID NO: 96971 - DNA, 15 bp, Homo sapiens
ggttttaaagggagg

SEQ ID NO: 96972 - DNA, 15 bp, Homo sapiens
tggttttaaagggag

SEQ ID NO: 96973 - DNA, 15 bp, Homo sapiens
ctggttttaaaggga

SEQ ID NO: 96974 - DNA, 15 bp, Homo sapiens
gctggttttaaaggg

SEQ ID NO: 96975 - DNA, 15 bp, Homo sapiens
tgctggttttaaagg

SEQ ID NO: 96976 - DNA, 15 bp, Homo sapiens
gtgctggttttaaag

SEQ ID NO: 96977 - DNA, 15 bp, Homo sapiens
tgtgctggttttaaa

SEQ ID NO: 96978 - DNA, 15 bp, Homo sapiens
atgtgctggttttaa

SEQ ID NO: 96979 - DNA, 15 bp, Homo sapiens
gatgtgctggtttta

SEQ ID NO: 96980 - DNA, 15 bp, Homo sapiens
tgatgtgctggtttt

SEQ ID NO: 96981 - DNA, 15 bp, Homo sapiens
ttgatgtgctggttt

SEQ ID NO: 96982 - DNA, 15 bp, Homo sapiens
attgatgtgctggtt

SEQ ID NO: 96983 - DNA, 15 bp, Homo sapiens
gattgatgtgctggt

SEQ ID NO: 96984 - DNA, 15 bp, Homo sapiens
tgattgatgtgctgg

SEQ ID NO: 96985 - DNA, 15 bp, Homo sapiens
atgattgatgtgctg

SEQ ID NO: 96986 - DNA, 15 bp, Homo sapiens
gatgattgatgtgct

SEQ ID NO: 96987 - DNA, 15 bp, Homo sapiens
agatgattgatgtgc

SEQ ID NO: 96988 - DNA, 15 bp, Homo sapiens
cagatgattgatgtg

SEQ ID NO: 96989 - DNA, 15 bp, Homo sapiens
acagatgattgatgt

SEQ ID NO: 96990 - DNA, 15 bp, Homo sapiens
gacagatgattgatg

SEQ ID NO: 96991 - DNA, 15 bp, Homo sapiens
agacagatgattgat

SEQ ID NO: 96992 - DNA, 15 bp, Homo sapiens
tagacagatgattga

SEQ ID NO: 96993 - DNA, 15 bp, Homo sapiens
atagacagatgattg

SEQ ID NO: 96994 - DNA, 15 bp, Homo sapiens
gatagacagatgatt

SEQ ID NO: 96995 - DNA, 15 bp, Homo sapiens
agatagacagatgat

SEQ ID NO: 96996 - DNA, 15 bp, Homo sapiens
cagatagacagatga

SEQ ID NO: 96997 - DNA, 15 bp, Homo sapiens
acagatagacagatg

SEQ ID NO: 96998 - DNA, 15 bp, Homo sapiens
gacagatagacagat

SEQ ID NO: 96999 - DNA, 15 bp, Homo sapiens
tgacagatagacaga

SEQ ID NO: 97000 - DNA, 15 bp, Homo sapiens
ttgacagatagacag

SEQ ID NO: 97001 - DNA, 15 bp, Homo sapiens
tttgacagatagaca

SEQ ID NO: 97002 - DNA, 15 bp, Homo sapiens
gtttgacagatagac

SEQ ID NO: 97003 - DNA, 15 bp, Homo sapiens
tgtttgacagataga

SEQ ID NO: 97004 - DNA, 15 bp, Homo sapiens
gtgtttgacagatag

SEQ ID NO: 97005 - DNA, 15 bp, Homo sapiens
agtgtttgacagata

SEQ ID NO: 97006 - DNA, 15 bp, Homo sapiens
tagtgtttgacagat

SEQ ID NO: 97007 - DNA, 15 bp, Homo sapiens
atagtgtttgacaga

SEQ ID NO: 97008 - DNA, 15 bp, Homo sapiens
catagtgtttgacag

SEQ ID NO: 97009 - DNA, 15 bp, Homo sapiens
acatagtgtttgaca

SEQ ID NO: 97010 - DNA, 15 bp, Homo sapiens
cacatagtgtttgac

SEQ ID NO: 97011 - DNA, 15 bp, Homo sapiens
gcacatagtgtttga

SEQ ID NO: 97012 - DNA, 15 bp, Homo sapiens
tgcacatagtgtttg

SEQ ID NO: 97013 - DNA, 15 bp, Homo sapiens
atgcacatagtgttt

SEQ ID NO: 97014 - DNA, 15 bp, Homo sapiens
catgcacatagtgtt

SEQ ID NO: 97015 - DNA, 15 bp, Homo sapiens
acatgcacatagtgt

SEQ ID NO: 97016 - DNA, 15 bp, Homo sapiens
tacatgcacatagtg

SEQ ID NO: 97017 - DNA, 15 bp, Homo sapiens
ctacatgcacatagt

SEQ ID NO: 97018 - DNA, 15 bp, Homo sapiens
gctacatgcacatag

SEQ ID NO: 97019 - DNA, 15 bp, Homo sapiens
tgctacatgcacata

SEQ ID NO: 97020 - DNA, 15 bp, Homo sapiens
atgctacatgcacat

SEQ ID NO: 97021 - DNA, 15 bp, Homo sapiens
gatgctacatgcaca

SEQ ID NO: 97022 - DNA, 15 bp, Homo sapiens
agatgctacatgcac

SEQ ID NO: 97023 - DNA, 15 bp, Homo sapiens
aagatgctacatgca

SEQ ID NO: 97024 - DNA, 15 bp, Homo sapiens
aaagatgctacatgc

SEQ ID NO: 97025 - DNA, 15 bp, Homo sapiens
gaaagatgctacatg

SEQ ID NO: 97026 - DNA, 15 bp, Homo sapiens
tgaaagatgctacat

SEQ ID NO: 97027 - DNA, 15 bp, Homo sapiens
gtgaaagatgctaca

SEQ ID NO: 97028 - DNA, 15 bp, Homo sapiens
tgtgaaagatgctac

SEQ ID NO: 97029 - DNA, 15 bp, Homo sapiens
ctgtgaaagatgcta

SEQ ID NO: 97030 - DNA, 15 bp, Homo sapiens
actgtgaaagatgct

SEQ ID NO: 97031 - DNA, 15 bp, Homo sapiens
tactgtgaaagatgc

SEQ ID NO: 97032 - DNA, 15 bp, Homo sapiens
ctactgtgaaagatg

SEQ ID NO: 97033 - DNA, 15 bp, Homo sapiens
cctactgtgaaagat

SEQ ID NO: 97034 - DNA, 15 bp, Homo sapiens
acctactgtgaaaga

SEQ ID NO: 97035 - DNA, 15 bp, Homo sapiens
aacctactgtgaaag

SEQ ID NO: 97036 - DNA, 15 bp, Homo sapiens
aaacctactgtgaaa

SEQ ID NO: 97037 - DNA, 15 bp, Homo sapiens
aaaacctactgtgaa

SEQ ID NO: 97038 - DNA, 15 bp, Homo sapiens
aaaaacctactgtga

SEQ ID NO: 97039 - DNA, 15 bp, Homo sapiens
caaaaacctactgtg

SEQ ID NO: 97040 - DNA, 15 bp, Homo sapiens
tcaaaaacctactgt

SEQ ID NO: 97041 - DNA, 15 bp, Homo sapiens
ttcaaaaacctactg

SEQ ID NO: 97042 - DNA, 15 bp, Homo sapiens
attcaaaaacctact

SEQ ID NO: 97043 - DNA, 15 bp, Homo sapiens
aattcaaaaacctac

SEQ ID NO: 97044 - DNA, 15 bp, Homo sapiens
taattcaaaaaccta

SEQ ID NO: 97045 - DNA, 15 bp, Homo sapiens
ttaattcaaaaacct

SEQ ID NO: 97046 - DNA, 15 bp, Homo sapiens
tttaattcaaaaacc

SEQ ID NO: 97047 - DNA, 15 bp, Homo sapiens
ttttaattcaaaaac

SEQ ID NO: 97048 - DNA, 15 bp, Homo sapiens
tttttaattcaaaaa

SEQ ID NO: 97049 - DNA, 15 bp, Homo sapiens
ttttttaattcaaaa

SEQ ID NO: 97050 - DNA, 15 bp, Homo sapiens
tttttttaattcaaa

SEQ ID NO: 97051 - DNA, 15 bp, Homo sapiens
gtttttttaattcaa

SEQ ID NO: 97052 - DNA, 15 bp, Homo sapiens
tgtttttttaattca

SEQ ID NO: 97053 - DNA, 15 bp, Homo sapiens
atgtttttttaattc

SEQ ID NO: 97054 - DNA, 15 bp, Homo sapiens
tatgtttttttaatt

SEQ ID NO: 97055 - DNA, 15 bp, Homo sapiens
ttatgtttttttaat

SEQ ID NO: 97056 - DNA, 15 bp, Homo sapiens
gttatgtttttttaa

SEQ ID NO: 97057 - DNA, 15 bp, Homo sapiens
tgttatgttttttta

SEQ ID NO: 97058 - DNA, 15 bp, Homo sapiens
ctgttatgttttttt

SEQ ID NO: 97059 - DNA, 15 bp, Homo sapiens
cctgttatgtttttt

SEQ ID NO: 97060 - DNA, 15 bp, Homo sapiens
ccctgttatgttttt

SEQ ID NO: 97061 - DNA, 15 bp, Homo sapiens
accctgttatgtttt

SEQ ID NO: 97062 - DNA, 15 bp, Homo sapiens
taccctgttatgttt

SEQ ID NO: 97063 - DNA, 15 bp, Homo sapiens
ctaccctgttatgtt

SEQ ID NO: 97064 - DNA, 15 bp, Homo sapiens
gctaccctgttatgt

SEQ ID NO: 97065 - DNA, 15 bp, Homo sapiens
agctaccctgttatg

SEQ ID NO: 97066 - DNA, 15 bp, Homo sapiens
cagctaccctgttat

SEQ ID NO: 97067 - DNA, 15 bp, Homo sapiens
gcagctaccctgtta

SEQ ID NO: 97068 - DNA, 15 bp, Homo sapiens
agcagctaccctgtt

SEQ ID NO: 97069 - DNA, 15 bp, Homo sapiens
gagcagctaccctgt

SEQ ID NO: 97070 - DNA, 15 bp, Homo sapiens
agagcagctaccctg

SEQ ID NO: 97071 - DNA, 15 bp, Homo sapiens
tagagcagctaccct

SEQ ID NO: 97072 - DNA, 15 bp, Homo sapiens
ttagagcagctaccc

SEQ ID NO: 97073 - DNA, 15 bp, Homo sapiens
attagagcagctacc

SEQ ID NO: 97074 - DNA, 15 bp, Homo sapiens
aattagagcagctac

SEQ ID NO: 97075 - DNA, 15 bp, Homo sapiens
aaattagagcagcta

SEQ ID NO: 97076 - DNA, 15 bp, Homo sapiens
aaaattagagcagct

SEQ ID NO: 97077 - DNA, 15 bp, Homo sapiens
taaaattagagcagc

SEQ ID NO: 97078 - DNA, 15 bp, Homo sapiens
ctaaaattagagcag

SEQ ID NO: 97079 - DNA, 15 bp, Homo sapiens
gctaaaattagagca

SEQ ID NO: 97080 - DNA, 15 bp, Homo sapiens
tgctaaaattagagc

SEQ ID NO: 97081 - DNA, 15 bp, Homo sapiens
ctgctaaaattagag

SEQ ID NO: 97082 - DNA, 15 bp, Homo sapiens
cctgctaaaattaga

SEQ ID NO: 97083 - DNA, 15 bp, Homo sapiens
ccctgctaaaattag

SEQ ID NO: 97084 - DNA, 15 bp, Homo sapiens
cccctgctaaaatta

SEQ ID NO: 97085 - DNA, 15 bp, Homo sapiens
tcccctgctaaaatt

SEQ ID NO: 97086 - DNA, 15 bp, Homo sapiens
ttcccctgctaaaat

SEQ ID NO: 97087 - DNA, 15 bp, Homo sapiens
cttcccctgctaaaa

SEQ ID NO: 97088 - DNA, 15 bp, Homo sapiens
tcttcccctgctaaa

SEQ ID NO: 97089 - DNA, 15 bp, Homo sapiens
ttcttcccctgctaa

SEQ ID NO: 97090 - DNA, 15 bp, Homo sapiens
tttcttcccctgcta

SEQ ID NO: 97091 - DNA, 15 bp, Homo sapiens
ctttcttcccctgct

SEQ ID NO: 97092 - DNA, 15 bp, Homo sapiens
gctttcttcccctgc

SEQ ID NO: 97093 - DNA, 15 bp, Homo sapiens
ggctttcttcccctg

SEQ ID NO: 97094 - DNA, 15 bp, Homo sapiens
tggctttcttcccct

SEQ ID NO: 97095 - DNA, 15 bp, Homo sapiens
ctggctttcttcccc

SEQ ID NO: 97096 - DNA, 15 bp, Homo sapiens
cctggctttcttccc

SEQ ID NO: 97097 - DNA, 15 bp, Homo sapiens
tcctggctttcttcc

SEQ ID NO: 97098 - DNA, 15 bp, Homo sapiens
ctcctggctttcttc

SEQ ID NO: 97099 - DNA, 15 bp, Homo sapiens
actcctggctttctt

SEQ ID NO: 97100 - DNA, 15 bp, Homo sapiens
gactcctggctttct

SEQ ID NO: 97101 - DNA, 15 bp, Homo sapiens
ggactcctggctttc

SEQ ID NO: 97102 - DNA, 15 bp, Homo sapiens
tggactcctggcttt

SEQ ID NO: 97103 - DNA, 15 bp, Homo sapiens
gtggactcctggctt

SEQ ID NO: 97104 - DNA, 15 bp, Homo sapiens
tgtggactcctggct

SEQ ID NO: 97105 - DNA, 15 bp, Homo sapiens
atgtggactcctggc

SEQ ID NO: 97106 - DNA, 15 bp, Homo sapiens
tatgtggactcctgg

SEQ ID NO: 97107 - DNA, 15 bp, Homo sapiens
atatgtggactcctg

SEQ ID NO: 97108 - DNA, 15 bp, Homo sapiens
aatatgtggactcct

SEQ ID NO: 97109 - DNA, 15 bp, Homo sapiens
aaatatgtggactcc

SEQ ID NO: 97110 - DNA, 15 bp, Homo sapiens
caaatatgtggactc

SEQ ID NO: 97111 - DNA, 15 bp, Homo sapiens
ccaaatatgtggact

SEQ ID NO: 97112 - DNA, 15 bp, Homo sapiens
gccaaatatgtggac

SEQ ID NO: 97113 - DNA, 15 bp, Homo sapiens
agccaaatatgtgga

SEQ ID NO: 97114 - DNA, 15 bp, Homo sapiens
aagccaaatatgtgg

SEQ ID NO: 97115 - DNA, 15 bp, Homo sapiens
caagccaaatatgtg

SEQ ID NO: 97116 - DNA, 15 bp, Homo sapiens
ccaagccaaatatgt

SEQ ID NO: 97117 - DNA, 15 bp, Homo sapiens
gccaagccaaatatg

SEQ ID NO: 97118 - DNA, 15 bp, Homo sapiens
ggccaagccaaatat

SEQ ID NO: 97119 - DNA, 15 bp, Homo sapiens
gggccaagccaaata

SEQ ID NO: 97120 - DNA, 15 bp, Homo sapiens
tgggccaagccaaat

SEQ ID NO: 97121 - DNA, 15 bp, Homo sapiens
atgggccaagccaaa

SEQ ID NO: 97122 - DNA, 15 bp, Homo sapiens
catgggccaagccaa

SEQ ID NO: 97123 - DNA, 15 bp, Homo sapiens
tcatgggccaagcca

SEQ ID NO: 97124 - DNA, 15 bp, Homo sapiens
ctcatgggccaagcc

SEQ ID NO: 97125 - DNA, 15 bp, Homo sapiens
actcatgggccaagc

SEQ ID NO: 97126 - DNA, 15 bp, Homo sapiens
aactcatgggccaag

SEQ ID NO: 97127 - DNA, 15 bp, Homo sapiens
caactcatgggccaa

SEQ ID NO: 97128 - DNA, 15 bp, Homo sapiens
tcaactcatgggcca

SEQ ID NO: 97129 - DNA, 15 bp, Homo sapiens
ctcaactcatgggcc

SEQ ID NO: 97130 - DNA, 15 bp, Homo sapiens
actcaactcatgggc

SEQ ID NO: 97131 - DNA, 15 bp, Homo sapiens
gactcaactcatggg

SEQ ID NO: 97132 - DNA, 15 bp, Homo sapiens
ggactcaactcatgg

SEQ ID NO: 97133 - DNA, 15 bp, Homo sapiens
tggactcaactcatg

SEQ ID NO: 97134 - DNA, 15 bp, Homo sapiens
atggactcaactcat

SEQ ID NO: 97135 - DNA, 15 bp, Homo sapiens
catggactcaactca

SEQ ID NO: 97136 - DNA, 15 bp, Homo sapiens
tcatggactcaactc

SEQ ID NO: 97137 - DNA, 15 bp, Homo sapiens
ctcatggactcaact

SEQ ID NO: 97138 - DNA, 15 bp, Homo sapiens
cctcatggactcaac

SEQ ID NO: 97139 - DNA, 15 bp, Homo sapiens
ccctcatggactcaa

SEQ ID NO: 97140 - DNA, 15 bp, Homo sapiens
gccctcatggactca

SEQ ID NO: 97141 - DNA, 15 bp, Homo sapiens
ggccctcatggactc

SEQ ID NO: 97142 - DNA, 15 bp, Homo sapiens
gggccctcatggact

SEQ ID NO: 97143 - DNA, 15 bp, Homo sapiens
tgggccctcatggac

SEQ ID NO: 97144 - DNA, 15 bp, Homo sapiens
atgggccctcatgga

SEQ ID NO: 97145 - DNA, 15 bp, Homo sapiens
catgggccctcatgg

SEQ ID NO: 97146 - DNA, 15 bp, Homo sapiens
tcatgggccctcatg

SEQ ID NO: 97147 - DNA, 15 bp, Homo sapiens
ctcatgggccctcat

SEQ ID NO: 97148 - DNA, 15 bp, Homo sapiens
tctcatgggccctca

SEQ ID NO: 97149 - DNA, 15 bp, Homo sapiens
gtctcatgggccctc

SEQ ID NO: 97150 - DNA, 15 bp, Homo sapiens
tgtctcatgggccct

SEQ ID NO: 97151 - DNA, 15 bp, Homo sapiens
ttgtctcatgggccc

SEQ ID NO: 97152 - DNA, 15 bp, Homo sapiens
cttgtctcatgggcc

SEQ ID NO: 97153 - DNA, 15 bp, Homo sapiens
gcttgtctcatgggc

SEQ ID NO: 97154 - DNA, 15 bp, Homo sapiens
agcttgtctcatggg

SEQ ID NO: 97155 - DNA, 15 bp, Homo sapiens
gagcttgtctcatgg

SEQ ID NO: 97156 - DNA, 15 bp, Homo sapiens
agagcttgtctcatg

SEQ ID NO: 97157 - DNA, 15 bp, Homo sapiens
aagagcttgtctcat

SEQ ID NO: 97158 - DNA, 15 bp, Homo sapiens
taagagcttgtctca

SEQ ID NO: 97159 - DNA, 15 bp, Homo sapiens
ttaagagcttgtctc

SEQ ID NO: 97160 - DNA, 15 bp, Homo sapiens
cttaagagcttgtct

SEQ ID NO: 97161 - DNA, 15 bp, Homo sapiens
acttaagagcttgtc

SEQ ID NO: 97162 - DNA, 15 bp, Homo sapiens
aacttaagagcttgt

SEQ ID NO: 97163 - DNA, 15 bp, Homo sapiens
taacttaagagcttg

SEQ ID NO: 97164 - DNA, 15 bp, Homo sapiens
ctaacttaagagctt

SEQ ID NO: 97165 - DNA, 15 bp, Homo sapiens
tctaacttaagagct

SEQ ID NO: 97166 - DNA, 15 bp, Homo sapiens
gtctaacttaagagc

SEQ ID NO: 97167 - DNA, 15 bp, Homo sapiens
ggtctaacttaagag

SEQ ID NO: 97168 - DNA, 15 bp, Homo sapiens
aggtctaacttaaga

SEQ ID NO: 97169 - DNA, 15 bp, Homo sapiens
aaggtctaacttaag

SEQ ID NO: 97170 - DNA, 15 bp, Homo sapiens
aaaggtctaacttaa

SEQ ID NO: 97171 - DNA, 15 bp, Homo sapiens
caaaggtctaactta

SEQ ID NO: 97172 - DNA, 15 bp, Homo sapiens
ccaaaggtctaactt

SEQ ID NO: 97173 - DNA, 15 bp, Homo sapiens
cccaaaggtctaact

SEQ ID NO: 97174 - DNA, 15 bp, Homo sapiens
tcccaaaggtctaac

SEQ ID NO: 97175 - DNA, 15 bp, Homo sapiens
ctcccaaaggtctaa

SEQ ID NO: 97176 - DNA, 15 bp, Homo sapiens
cctcccaaaggtcta

SEQ ID NO: 97177 - DNA, 15 bp, Homo sapiens
gcctcccaaaggtct

SEQ ID NO: 97178 - DNA, 15 bp, Homo sapiens
agcctcccaaaggtc

SEQ ID NO: 97179 - DNA, 15 bp, Homo sapiens
tagcctcccaaaggt

SEQ ID NO: 97180 - DNA, 15 bp, Homo sapiens
gtagcctcccaaagg

SEQ ID NO: 97181 - DNA, 15 bp, Homo sapiens
tgtagcctcccaaag

SEQ ID NO: 97182 - DNA, 15 bp, Homo sapiens
ctgtagcctcccaaa

SEQ ID NO: 97183 - DNA, 15 bp, Homo sapiens
tctgtagcctcccaa

SEQ ID NO: 97184 - DNA, 15 bp, Homo sapiens
ctctgtagcctccca

SEQ ID NO: 97185 - DNA, 15 bp, Homo sapiens
tctctgtagcctccc

SEQ ID NO: 97186 - DNA, 15 bp, Homo sapiens
ttctctgtagcctcc

SEQ ID NO: 97187 - DNA, 15 bp, Homo sapiens
attctctgtagcctc

SEQ ID NO: 97188 - DNA, 15 bp, Homo sapiens
cattctctgtagcct

SEQ ID NO: 97189 - DNA, 15 bp, Homo sapiens
tcattctctgtagcc

SEQ ID NO: 97190 - DNA, 15 bp, Homo sapiens
gtcattctctgtagc

SEQ ID NO: 97191 - DNA, 15 bp, Homo sapiens
agtcattctctgtag

SEQ ID NO: 97192 - DNA, 15 bp, Homo sapiens
aagtcattctctgta

SEQ ID NO: 97193 - DNA, 15 bp, Homo sapiens
taagtcattctctgt

SEQ ID NO: 97194 - DNA, 15 bp, Homo sapiens
ttaagtcattctctg

SEQ ID NO: 97195 - DNA, 15 bp, Homo sapiens
tttaagtcattctct

SEQ ID NO: 97196 - DNA, 15 bp, Homo sapiens
ttttaagtcattctc

SEQ ID NO: 97197 - DNA, 15 bp, Homo sapiens
tttttaagtcattct

SEQ ID NO: 97198 - DNA, 15 bp, Homo sapiens
gtttttaagtcattc

SEQ ID NO: 97199 - DNA, 15 bp, Homo sapiens
ggtttttaagtcatt

SEQ ID NO: 97200 - DNA, 15 bp, Homo sapiens
aggtttttaagtcat

SEQ ID NO: 97201 - DNA, 15 bp, Homo sapiens
gaggtttttaagtca

SEQ ID NO: 97202 - DNA, 15 bp, Homo sapiens
agaggtttttaagtc

SEQ ID NO: 97203 - DNA, 15 bp, Homo sapiens
cagaggtttttaagt

SEQ ID NO: 97204 - DNA, 15 bp, Homo sapiens
ccagaggtttttaag

SEQ ID NO: 97205 - DNA, 15 bp, Homo sapiens
accagaggtttttaa

SEQ ID NO: 97206 - DNA, 15 bp, Homo sapiens
taccagaggttttta

SEQ ID NO: 97207 - DNA, 15 bp, Homo sapiens
ctaccagaggttttt

SEQ ID NO: 97208 - DNA, 15 bp, Homo sapiens
actaccagaggtttt

SEQ ID NO: 97209 - DNA, 15 bp, Homo sapiens
cactaccagaggttt

SEQ ID NO: 97210 - DNA, 15 bp, Homo sapiens
ccactaccagaggtt

SEQ ID NO: 97211 - DNA, 15 bp, Homo sapiens
cccactaccagaggt

SEQ ID NO: 97212 - DNA, 15 bp, Homo sapiens
gcccactaccagagg

SEQ ID NO: 97213 - DNA, 15 bp, Homo sapiens
tgcccactaccagag

SEQ ID NO: 97214 - DNA, 15 bp, Homo sapiens
atgcccactaccaga

SEQ ID NO: 97215 - DNA, 15 bp, Homo sapiens
catgcccactaccag

SEQ ID NO: 97216 - DNA, 15 bp, Homo sapiens
tcatgcccactacca

SEQ ID NO: 97217 - DNA, 15 bp, Homo sapiens
ctcatgcccactacc

SEQ ID NO: 97218 - DNA, 15 bp, Homo sapiens
cctcatgcccactac

SEQ ID NO: 97219 - DNA, 15 bp, Homo sapiens
tcctcatgcccacta

SEQ ID NO: 97220 - DNA, 15 bp, Homo sapiens
ttcctcatgcccact

SEQ ID NO: 97221 - DNA, 15 bp, Homo sapiens
cttcctcatgcccac

SEQ ID NO: 97222 - DNA, 15 bp, Homo sapiens
tcttcctcatgccca

SEQ ID NO: 97223 - DNA, 15 bp, Homo sapiens
ttcttcctcatgccc

SEQ ID NO: 97224 - DNA, 15 bp, Homo sapiens
attcttcctcatgcc

SEQ ID NO: 97225 - DNA, 15 bp, Homo sapiens
cattcttcctcatgc

SEQ ID NO: 97226 - DNA, 15 bp, Homo sapiens
tcattcttcctcatg

SEQ ID NO: 97227 - DNA, 15 bp, Homo sapiens
atcattcttcctcat

SEQ ID NO: 97228 - DNA, 15 bp, Homo sapiens
gatcattcttcctca

SEQ ID NO: 97229 - DNA, 15 bp, Homo sapiens
tgatcattcttcctc

SEQ ID NO: 97230 - DNA, 15 bp, Homo sapiens
atgatcattcttcct

SEQ ID NO: 97231 - DNA, 15 bp, Homo sapiens
aatgatcattcttcc

SEQ ID NO: 97232 - DNA, 15 bp, Homo sapiens
aaatgatcattcttc

SEQ ID NO: 97233 - DNA, 15 bp, Homo sapiens
aaaatgatcattctt

SEQ ID NO: 97234 - DNA, 15 bp, Homo sapiens
aaaaatgatcattct

SEQ ID NO: 97235 - DNA, 15 bp, Homo sapiens
aaaaaatgatcattc

SEQ ID NO: 97236 - DNA, 15 bp, Homo sapiens
aaaaaaatgatcatt

SEQ ID NO: 97237 - DNA, 15 bp, Homo sapiens
aaaaaaaatgatcat

SEQ ID NO: 97238 - DNA, 15 bp, Homo sapiens
aaaaaaaaatgatca

SEQ ID NO: 97239 - DNA, 15 bp, Homo sapiens
taaaaaaaaatgatc

SEQ ID NO: 97240 - DNA, 15 bp, Homo sapiens
ttaaaaaaaaatgat

SEQ ID NO: 97241 - DNA, 15 bp, Homo sapiens
attaaaaaaaaatga

SEQ ID NO: 97242 - DNA, 15 bp, Homo sapiens
aattaaaaaaaaatg

SEQ ID NO: 97243 - DNA, 15 bp, Homo sapiens
caattaaaaaaaaat

SEQ ID NO: 97244 - DNA, 15 bp, Homo sapiens
ccaattaaaaaaaaa

SEQ ID NO: 97245 - DNA, 15 bp, Homo sapiens
cccaattaaaaaaaa

SEQ ID NO: 97246 - DNA, 15 bp, Homo sapiens
ccccaattaaaaaaa

SEQ ID NO: 97247 - DNA, 15 bp, Homo sapiens
accccaattaaaaaa

SEQ ID NO: 97248 - DNA, 15 bp, Homo sapiens
taccccaattaaaaa

SEQ ID NO: 97249 - DNA, 15 bp, Homo sapiens
ttaccccaattaaaa

SEQ ID NO: 97250 - DNA, 15 bp, Homo sapiens
tttaccccaattaaa

SEQ ID NO: 97251 - DNA, 15 bp, Homo sapiens
atttaccccaattaa

SEQ ID NO: 97252 - DNA, 15 bp, Homo sapiens
tatttaccccaatta

SEQ ID NO: 97253 - DNA, 15 bp, Homo sapiens
gtatttaccccaatt

SEQ ID NO: 97254 - DNA, 15 bp, Homo sapiens
tgtatttaccccaat

SEQ ID NO: 97255 - DNA, 15 bp, Homo sapiens
atgtatttaccccaa

SEQ ID NO: 97256 - DNA, 15 bp, Homo sapiens
tatgtatttacccca

SEQ ID NO: 97257 - DNA, 15 bp, Homo sapiens
atatgtatttacccc

SEQ ID NO: 97258 - DNA, 15 bp, Homo sapiens
tatatgtatttaccc

SEQ ID NO: 97259 - DNA, 15 bp, Homo sapiens
ttatatgtatttacc

SEQ ID NO: 97260 - DNA, 15 bp, Homo sapiens
gttatatgtatttac

SEQ ID NO: 97261 - DNA, 15 bp, Homo sapiens
tgttatatgtattta

SEQ ID NO: 97262 - DNA, 15 bp, Homo sapiens
atgttatatgtattt

SEQ ID NO: 97263 - DNA, 15 bp, Homo sapiens
aatgttatatgtatt

SEQ ID NO: 97264 - DNA, 15 bp, Homo sapiens
caatgttatatgtat

SEQ ID NO: 97265 - DNA, 15 bp, Homo sapiens
ccaatgttatatgta

SEQ ID NO: 97266 - DNA, 15 bp, Homo sapiens
accaatgttatatgt

SEQ ID NO: 97267 - DNA, 15 bp, Homo sapiens
gaccaatgttatatg

SEQ ID NO: 97268 - DNA, 15 bp, Homo sapiens
tgaccaatgttatat

SEQ ID NO: 97269 - DNA, 15 bp, Homo sapiens
ctgaccaatgttata

SEQ ID NO: 97270 - DNA, 15 bp, Homo sapiens
gctgaccaatgttat

SEQ ID NO: 97271 - DNA, 15 bp, Homo sapiens
agctgaccaatgtta

SEQ ID NO: 97272 - DNA, 15 bp, Homo sapiens
aagctgaccaatgtt

SEQ ID NO: 97273 - DNA, 15 bp, Homo sapiens
taagctgaccaatgt

SEQ ID NO: 97274 - DNA, 15 bp, Homo sapiens
ttaagctgaccaatg

SEQ ID NO: 97275 - DNA, 15 bp, Homo sapiens
attaagctgaccaat

SEQ ID NO: 97276 - DNA, 15 bp, Homo sapiens
aattaagctgaccaa

SEQ ID NO: 97277 - DNA, 15 bp, Homo sapiens
aaattaagctgacca

SEQ ID NO: 97278 - DNA, 15 bp, Homo sapiens
aaaattaagctgacc

SEQ ID NO: 97279 - DNA, 15 bp, Homo sapiens
aaaaattaagctgac

SEQ ID NO: 97280 - DNA, 15 bp, Homo sapiens
taaaaattaagctga

SEQ ID NO: 97281 - DNA, 15 bp, Homo sapiens
ttaaaaattaagctg

SEQ ID NO: 97282 - DNA, 15 bp, Homo sapiens
cttaaaaattaagct

SEQ ID NO: 97283 - DNA, 15 bp, Homo sapiens
acttaaaaattaagc

SEQ ID NO: 97284 - DNA, 15 bp, Homo sapiens
cacttaaaaattaag

SEQ ID NO: 97285 - DNA, 15 bp, Homo sapiens
gcacttaaaaattaa

SEQ ID NO: 97286 - DNA, 15 bp, Homo sapiens
tgcacttaaaaatta

SEQ ID NO: 97287 - DNA, 15 bp, Homo sapiens
gtgcacttaaaaatt

SEQ ID NO: 97288 - DNA, 15 bp, Homo sapiens
tgtgcacttaaaaat

SEQ ID NO: 97289 - DNA, 15 bp, Homo sapiens
ttgtgcacttaaaaa

SEQ ID NO: 97290 - DNA, 15 bp, Homo sapiens
attgtgcacttaaaa

SEQ ID NO: 97291 - DNA, 15 bp, Homo sapiens
gattgtgcacttaaa

SEQ ID NO: 97292 - DNA, 15 bp, Homo sapiens
ggattgtgcacttaa

SEQ ID NO: 97293 - DNA, 15 bp, Homo sapiens
tggattgtgcactta

SEQ ID NO: 97294 - DNA, 15 bp, Homo sapiens
ctggattgtgcactt

SEQ ID NO: 97295 - DNA, 15 bp, Homo sapiens
actggattgtgcact

SEQ ID NO: 97296 - DNA, 15 bp, Homo sapiens
cactggattgtgcac

SEQ ID NO: 97297 - DNA, 15 bp, Homo sapiens
ccactggattgtgca

SEQ ID NO: 97298 - DNA, 15 bp, Homo sapiens
gccactggattgtgc

SEQ ID NO: 97299 - DNA, 15 bp, Homo sapiens
tgccactggattgtg

SEQ ID NO: 97300 - DNA, 15 bp, Homo sapiens
atgccactggattgt

SEQ ID NO: 97301 - DNA, 15 bp, Homo sapiens
aatgccactggattg

SEQ ID NO: 97302 - DNA, 15 bp, Homo sapiens
taatgccactggatt

SEQ ID NO: 97303 - DNA, 15 bp, Homo sapiens
ttaatgccactggat

SEQ ID NO: 97304 - DNA, 15 bp, Homo sapiens
attaatgccactgga

SEQ ID NO: 97305 - DNA, 15 bp, Homo sapiens
aattaatgccactgg

SEQ ID NO: 97306 - DNA, 15 bp, Homo sapiens
caattaatgccactg

SEQ ID NO: 97307 - DNA, 15 bp, Homo sapiens
gcaattaatgccact

SEQ ID NO: 97308 - DNA, 15 bp, Homo sapiens
tgcaattaatgccac

SEQ ID NO: 97309 - DNA, 15 bp, Homo sapiens
atgcaattaatgcca

SEQ ID NO: 97310 - DNA, 15 bp, Homo sapiens
aatgcaattaatgcc

SEQ ID NO: 97311 - DNA, 15 bp, Homo sapiens
gaatgcaattaatgc

SEQ ID NO: 97312 - DNA, 15 bp, Homo sapiens
tgaatgcaattaatg

SEQ ID NO: 97313 - DNA, 15 bp, Homo sapiens
atgaatgcaattaat

SEQ ID NO: 97314 - DNA, 15 bp, Homo sapiens
gatgaatgcaattaa

SEQ ID NO: 97315 - DNA, 15 bp, Homo sapiens
tgatgaatgcaatta

SEQ ID NO: 97316 - DNA, 15 bp, Homo sapiens
gtgatgaatgcaatt

SEQ ID NO: 97317 - DNA, 15 bp, Homo sapiens
agtgatgaatgcaat

SEQ ID NO: 97318 - DNA, 15 bp, Homo sapiens
tagtgatgaatgcaa

SEQ ID NO: 97319 - DNA, 15 bp, Homo sapiens
atagtgatgaatgca

SEQ ID NO: 97320 - DNA, 15 bp, Homo sapiens
aatagtgatgaatgc

SEQ ID NO: 97321 - DNA, 15 bp, Homo sapiens
aaatagtgatgaatg

SEQ ID NO: 97322 - DNA, 15 bp, Homo sapiens
gaaatagtgatgaat

SEQ ID NO: 97323 - DNA, 15 bp, Homo sapiens
ggaaatagtgatgaa

SEQ ID NO: 97324 - DNA, 15 bp, Homo sapiens
tggaaatagtgatga

SEQ ID NO: 97325 - DNA, 15 bp, Homo sapiens
ttggaaatagtgatg

SEQ ID NO: 97326 - DNA, 15 bp, Homo sapiens
tttggaaatagtgat

SEQ ID NO: 97327 - DNA, 15 bp, Homo sapiens
gtttggaaatagtga

SEQ ID NO: 97328 - DNA, 15 bp, Homo sapiens
tgtttggaaatagtg

SEQ ID NO: 97329 - DNA, 15 bp, Homo sapiens
atgtttggaaatagt

SEQ ID NO: 97330 - DNA, 15 bp, Homo sapiens
aatgtttggaaatag

SEQ ID NO: 97331 - DNA, 15 bp, Homo sapiens
aaatgtttggaaata

SEQ ID NO: 97332 - DNA, 15 bp, Homo sapiens
aaaatgtttggaaat

SEQ ID NO: 97333 - DNA, 15 bp, Homo sapiens
gaaaatgtttggaaa

SEQ ID NO: 97334 - DNA, 15 bp, Homo sapiens
tgaaaatgtttggaa

SEQ ID NO: 97335 - DNA, 15 bp, Homo sapiens
gtgaaaatgtttgga

SEQ ID NO: 97336 - DNA, 15 bp, Homo sapiens
tgtgaaaatgtttgg

SEQ ID NO: 97337 - DNA, 15 bp, Homo sapiens
ttgtgaaaatgtttg

SEQ ID NO: 97338 - DNA, 15 bp, Homo sapiens
tttgtgaaaatgttt

SEQ ID NO: 97339 - DNA, 15 bp, Homo sapiens
ctttgtgaaaatgtt

SEQ ID NO: 97340 - DNA, 15 bp, Homo sapiens
tctttgtgaaaatgt

SEQ ID NO: 97341 - DNA, 15 bp, Homo sapiens
ctctttgtgaaaatg

SEQ ID NO: 97342 - DNA, 15 bp, Homo sapiens
actctttgtgaaaat

SEQ ID NO: 97343 - DNA, 15 bp, Homo sapiens
aactctttgtgaaaa

SEQ ID NO: 97344 - DNA, 15 bp, Homo sapiens
taactctttgtgaaa

SEQ ID NO: 97345 - DNA, 15 bp, Homo sapiens
ataactctttgtgaa

SEQ ID NO: 97346 - DNA, 15 bp, Homo sapiens
aataactctttgtga

SEQ ID NO: 97347 - DNA, 15 bp, Homo sapiens
aaataactctttgtg

SEQ ID NO: 97348 - DNA, 15 bp, Homo sapiens
aaaataactctttgt

SEQ ID NO: 97349 - DNA, 15 bp, Homo sapiens
aaaaataactctttg

SEQ ID NO: 97350 - DNA, 15 bp, Homo sapiens
aaaaaataactcttt

SEQ ID NO: 97351 - DNA, 15 bp, Homo sapiens
caaaaaataactctt

SEQ ID NO: 97352 - DNA, 15 bp, Homo sapiens
acaaaaaataactct

SEQ ID NO: 97353 - DNA, 15 bp, Homo sapiens
tacaaaaaataactc

SEQ ID NO: 97354 - DNA, 15 bp, Homo sapiens
ttacaaaaaataact

SEQ ID NO: 97355 - DNA, 15 bp, Homo sapiens
cttacaaaaaataac

SEQ ID NO: 97356 - DNA, 15 bp, Homo sapiens
ccttacaaaaaataa

SEQ ID NO: 97357 - DNA, 15 bp, Homo sapiens
cccttacaaaaaata

SEQ ID NO: 97358 - DNA, 15 bp, Homo sapiens
ccccttacaaaaaat

SEQ ID NO: 97359 - DNA, 15 bp, Homo sapiens
tccccttacaaaaaa

SEQ ID NO: 97360 - DNA, 15 bp, Homo sapiens
ttccccttacaaaaa

SEQ ID NO: 97361 - DNA, 15 bp, Homo sapiens
gttccccttacaaaa

SEQ ID NO: 97362 - DNA, 15 bp, Homo sapiens
tgttccccttacaaa

SEQ ID NO: 97363 - DNA, 15 bp, Homo sapiens
ttgttccccttacaa

SEQ ID NO: 97364 - DNA, 15 bp, Homo sapiens
tttgttccccttaca

SEQ ID NO: 97365 - DNA, 15 bp, Homo sapiens
ttttgttccccttac

SEQ ID NO: 97366 - DNA, 15 bp, Homo sapiens
cttttgttcccctta

SEQ ID NO: 97367 - DNA, 15 bp, Homo sapiens
tcttttgttcccctt

SEQ ID NO: 97368 - DNA, 15 bp, Homo sapiens
ctcttttgttcccct

SEQ ID NO: 97369 - DNA, 15 bp, Homo sapiens
tctcttttgttcccc

SEQ ID NO: 97370 - DNA, 15 bp, Homo sapiens
gtctcttttgttccc

SEQ ID NO: 97371 - DNA, 15 bp, Homo sapiens
ggtctcttttgttcc

SEQ ID NO: 97372 - DNA, 15 bp, Homo sapiens
aggtctcttttgttc

SEQ ID NO: 97373 - DNA, 15 bp, Homo sapiens
gaggtctcttttgtt

SEQ ID NO: 97374 - DNA, 15 bp, Homo sapiens
ggaggtctcttttgt

SEQ ID NO: 97375 - DNA, 15 bp, Homo sapiens
gggaggtctcttttg

SEQ ID NO: 97376 - DNA, 15 bp, Homo sapiens
tgggaggtctctttt

SEQ ID NO: 97377 - DNA, 15 bp, Homo sapiens
ttgggaggtctcttt

SEQ ID NO: 97378 - DNA, 15 bp, Homo sapiens
cttgggaggtctctt

SEQ ID NO: 97379 - DNA, 15 bp, Homo sapiens
acttgggaggtctct

SEQ ID NO: 97380 - DNA, 15 bp, Homo sapiens
aacttgggaggtctc

SEQ ID NO: 97381 - DNA, 15 bp, Homo sapiens
caacttgggaggtct

SEQ ID NO: 97382 - DNA, 15 bp, Homo sapiens
acaacttgggaggtc

SEQ ID NO: 97383 - DNA, 15 bp, Homo sapiens
gacaacttgggaggt

SEQ ID NO: 97384 - DNA, 15 bp, Homo sapiens
agacaacttgggagg

SEQ ID NO: 97385 - DNA, 15 bp, Homo sapiens
cagacaacttgggag

SEQ ID NO: 97386 - DNA, 15 bp, Homo sapiens
tcagacaacttggga

SEQ ID NO: 97387 - DNA, 15 bp, Homo sapiens
ctcagacaacttggg

SEQ ID NO: 97388 - DNA, 15 bp, Homo sapiens
cctcagacaacttgg

SEQ ID NO: 97389 - DNA, 15 bp, Homo sapiens
acctcagacaacttg

SEQ ID NO: 97390 - DNA, 15 bp, Homo sapiens
aacctcagacaactt

SEQ ID NO: 97391 - DNA, 15 bp, Homo sapiens
aaacctcagacaact

SEQ ID NO: 97392 - DNA, 15 bp, Homo sapiens
taaacctcagacaac

SEQ ID NO: 97393 - DNA, 15 bp, Homo sapiens
ataaacctcagacaa

SEQ ID NO: 97394 - DNA, 15 bp, Homo sapiens
aataaacctcagaca

SEQ ID NO: 97395 - DNA, 15 bp, Homo sapiens
gaataaacctcagac

SEQ ID NO: 97396 - DNA, 15 bp, Homo sapiens
agaataaacctcaga

SEQ ID NO: 97397 - DNA, 15 bp, Homo sapiens
aagaataaacctcag

SEQ ID NO: 97398 - DNA, 15 bp, Homo sapiens
taagaataaacctca

SEQ ID NO: 97399 - DNA, 15 bp, Homo sapiens
ataagaataaacctc

SEQ ID NO: 97400 - DNA, 15 bp, Homo sapiens
aataagaataaacct

SEQ ID NO: 97401 - DNA, 15 bp, Homo sapiens
aaataagaataaacc

SEQ ID NO: 97402 - DNA, 15 bp, Homo sapiens
aaaataagaataaac

SEQ ID NO: 97403 - DNA, 15 bp, Homo sapiens
gaaaataagaataaa

SEQ ID NO: 97404 - DNA, 15 bp, Homo sapiens
ggaaaataagaataa

SEQ ID NO: 97405 - DNA, 15 bp, Homo sapiens
aggaaaataagaata

SEQ ID NO: 97406 - DNA, 15 bp, Homo sapiens
caggaaaataagaat

SEQ ID NO: 97407 - DNA, 15 bp, Homo sapiens
acaggaaaataagaa

SEQ ID NO: 97408 - DNA, 15 bp, Homo sapiens
aacaggaaaataaga

SEQ ID NO: 97409 - DNA, 15 bp, Homo sapiens
taacaggaaaataag

SEQ ID NO: 97410 - DNA, 15 bp, Homo sapiens
gtaacaggaaaataa

SEQ ID NO: 97411 - DNA, 15 bp, Homo sapiens
agtaacaggaaaata

SEQ ID NO: 97412 - DNA, 15 bp, Homo sapiens
tagtaacaggaaaat

SEQ ID NO: 97413 - DNA, 15 bp, Homo sapiens
ttagtaacaggaaaa

SEQ ID NO: 97414 - DNA, 15 bp, Homo sapiens
attagtaacaggaaa

SEQ ID NO: 97415 - DNA, 15 bp, Homo sapiens
gattagtaacaggaa

SEQ ID NO: 97416 - DNA, 15 bp, Homo sapiens
agattagtaacagga

SEQ ID NO: 97417 - DNA, 15 bp, Homo sapiens
aagattagtaacagg

SEQ ID NO: 97418 - DNA, 15 bp, Homo sapiens
gaagattagtaacag

SEQ ID NO: 97419 - DNA, 15 bp, Homo sapiens
ggaagattagtaaca

SEQ ID NO: 97420 - DNA, 15 bp, Homo sapiens
tggaagattagtaac

SEQ ID NO: 97421 - DNA, 15 bp, Homo sapiens
ctggaagattagtaa

SEQ ID NO: 97422 - DNA, 15 bp, Homo sapiens
actggaagattagta

SEQ ID NO: 97423 - DNA, 15 bp, Homo sapiens
aactggaagattagt

SEQ ID NO: 97424 - DNA, 15 bp, Homo sapiens
taactggaagattag

SEQ ID NO: 97425 - DNA, 15 bp, Homo sapiens
ttaactggaagatta

SEQ ID NO: 97426 - DNA, 15 bp, Homo sapiens
attaactggaagatt

SEQ ID NO: 97427 - DNA, 15 bp, Homo sapiens
tattaactggaagat

SEQ ID NO: 97428 - DNA, 15 bp, Homo sapiens
gtattaactggaaga

SEQ ID NO: 97429 - DNA, 15 bp, Homo sapiens
tgtattaactggaag

SEQ ID NO: 97430 - DNA, 15 bp, Homo sapiens
atgtattaactggaa

SEQ ID NO: 97431 - DNA, 15 bp, Homo sapiens
tatgtattaactgga

SEQ ID NO: 97432 - DNA, 15 bp, Homo sapiens
gtatgtattaactgg

SEQ ID NO: 97433 - DNA, 15 bp, Homo sapiens
cgtatgtattaactg

SEQ ID NO: 97434 - DNA, 15 bp, Homo sapiens
ccgtatgtattaact

SEQ ID NO: 97435 - DNA, 15 bp, Homo sapiens
gccgtatgtattaac

SEQ ID NO: 97436 - DNA, 15 bp, Homo sapiens
tgccgtatgtattaa

SEQ ID NO: 97437 - DNA, 15 bp, Homo sapiens
gtgccgtatgtatta

SEQ ID NO: 97438 - DNA, 15 bp, Homo sapiens
tgtgccgtatgtatt

SEQ ID NO: 97439 - DNA, 15 bp, Homo sapiens
atgtgccgtatgtat

SEQ ID NO: 97440 - DNA, 15 bp, Homo sapiens
tatgtgccgtatgta

SEQ ID NO: 97441 - DNA, 15 bp, Homo sapiens
atatgtgccgtatgt

SEQ ID NO: 97442 - DNA, 15 bp, Homo sapiens
catatgtgccgtatg

SEQ ID NO: 97443 - DNA, 15 bp, Homo sapiens
tcatatgtgccgtat

SEQ ID NO: 97444 - DNA, 15 bp, Homo sapiens
ttcatatgtgccgta

SEQ ID NO: 97445 - DNA, 15 bp, Homo sapiens
gttcatatgtgccgt

SEQ ID NO: 97446 - DNA, 15 bp, Homo sapiens
tgttcatatgtgccg

SEQ ID NO: 97447 - DNA, 15 bp, Homo sapiens
gtgttcatatgtgcc

SEQ ID NO: 97448 - DNA, 15 bp, Homo sapiens
agtgttcatatgtgc

SEQ ID NO: 97449 - DNA, 15 bp, Homo sapiens
cagtgttcatatgtg

SEQ ID NO: 97450 - DNA, 15 bp, Homo sapiens
tcagtgttcatatgt

SEQ ID NO: 97451 - DNA, 15 bp, Homo sapiens
gtcagtgttcatatg

SEQ ID NO: 97452 - DNA, 15 bp, Homo sapiens
cgtcagtgttcatat

SEQ ID NO: 97453 - DNA, 15 bp, Homo sapiens
acgtcagtgttcata

SEQ ID NO: 97454 - DNA, 15 bp, Homo sapiens
aacgtcagtgttcat

SEQ ID NO: 97455 - DNA, 15 bp, Homo sapiens
aaacgtcagtgttca

SEQ ID NO: 97456 - DNA, 15 bp, Homo sapiens
gaaacgtcagtgttc

SEQ ID NO: 97457 - DNA, 15 bp, Homo sapiens
tgaaacgtcagtgtt

SEQ ID NO: 97458 - DNA, 15 bp, Homo sapiens
atgaaacgtcagtgt

SEQ ID NO: 97459 - DNA, 15 bp, Homo sapiens
aatgaaacgtcagtg

SEQ ID NO: 97460 - DNA, 15 bp, Homo sapiens
taatgaaacgtcagt

SEQ ID NO: 97461 - DNA, 15 bp, Homo sapiens
ctaatgaaacgtcag

SEQ ID NO: 97462 - DNA, 15 bp, Homo sapiens
tctaatgaaacgtca

SEQ ID NO: 97463 - DNA, 15 bp, Homo sapiens
ctctaatgaaacgtc

SEQ ID NO: 97464 - DNA, 15 bp, Homo sapiens
gctctaatgaaacgt

SEQ ID NO: 97465 - DNA, 15 bp, Homo sapiens
tgctctaatgaaacg

SEQ ID NO: 97466 - DNA, 15 bp, Homo sapiens
ctgctctaatgaaac

SEQ ID NO: 97467 - DNA, 15 bp, Homo sapiens
cctgctctaatgaaa

SEQ ID NO: 97468 - DNA, 15 bp, Homo sapiens
acctgctctaatgaa

SEQ ID NO: 97469 - DNA, 15 bp, Homo sapiens
tacctgctctaatga

SEQ ID NO: 97470 - DNA, 15 bp, Homo sapiens
ctacctgctctaatg

SEQ ID NO: 97471 - DNA, 15 bp, Homo sapiens
cctacctgctctaat

SEQ ID NO: 97472 - DNA, 15 bp, Homo sapiens
tcctacctgctctaa

SEQ ID NO: 97473 - DNA, 15 bp, Homo sapiens
ttcctacctgctcta

SEQ ID NO: 97474 - DNA, 15 bp, Homo sapiens
attcctacctgctct

SEQ ID NO: 97475 - DNA, 15 bp, Homo sapiens
tattcctacctgctc

SEQ ID NO: 97476 - DNA, 15 bp, Homo sapiens
ctattcctacctgct

SEQ ID NO: 97477 - DNA, 15 bp, Homo sapiens
gctattcctacctgc

SEQ ID NO: 97478 - DNA, 15 bp, Homo sapiens
cgctattcctacctg

SEQ ID NO: 97479 - DNA, 15 bp, Homo sapiens
ccgctattcctacct

SEQ ID NO: 97480 - DNA, 15 bp, Homo sapiens
accgctattcctacc

SEQ ID NO: 97481 - DNA, 15 bp, Homo sapiens
taccgctattcctac

SEQ ID NO: 97482 - DNA, 15 bp, Homo sapiens
ctaccgctattccta

SEQ ID NO: 97483 - DNA, 15 bp, Homo sapiens
cctaccgctattcct

SEQ ID NO: 97484 - DNA, 15 bp, Homo sapiens
tcctaccgctattcc

SEQ ID NO: 97485 - DNA, 15 bp, Homo sapiens
ttcctaccgctattc

SEQ ID NO: 97486 - DNA, 15 bp, Homo sapiens
attcctaccgctatt

SEQ ID NO: 97487 - DNA, 15 bp, Homo sapiens
cattcctaccgctat

SEQ ID NO: 97488 - DNA, 15 bp, Homo sapiens
gcattcctaccgcta

SEQ ID NO: 97489 - DNA, 15 bp, Homo sapiens
tgcattcctaccgct

SEQ ID NO: 97490 - DNA, 15 bp, Homo sapiens
atgcattcctaccgc

SEQ ID NO: 97491 - DNA, 15 bp, Homo sapiens
gatgcattcctaccg

SEQ ID NO: 97492 - DNA, 15 bp, Homo sapiens
cgatgcattcctacc

SEQ ID NO: 97493 - DNA, 15 bp, Homo sapiens
ccgatgcattcctac

SEQ ID NO: 97494 - DNA, 15 bp, Homo sapiens
cccgatgcattccta

SEQ ID NO: 97495 - DNA, 15 bp, Homo sapiens
ccccgatgcattcct

SEQ ID NO: 97496 - DNA, 15 bp, Homo sapiens
tccccgatgcattcc

SEQ ID NO: 97497 - DNA, 15 bp, Homo sapiens
ctccccgatgcattc

SEQ ID NO: 97498 - DNA, 15 bp, Homo sapiens
actccccgatgcatt

SEQ ID NO: 97499 - DNA, 15 bp, Homo sapiens
aactccccgatgcat

SEQ ID NO: 97500 - DNA, 15 bp, Homo sapiens
gaactccccgatgca

SEQ ID NO: 97501 - DNA, 15 bp, Homo sapiens
tgaactccccgatgc

SEQ ID NO: 97502 - DNA, 15 bp, Homo sapiens
atgaactccccgatg

SEQ ID NO: 97503 - DNA, 15 bp, Homo sapiens
tatgaactccccgat

SEQ ID NO: 97504 - DNA, 15 bp, Homo sapiens
atatgaactccccga

SEQ ID NO: 97505 - DNA, 15 bp, Homo sapiens
aatatgaactccccg

SEQ ID NO: 97506 - DNA, 15 bp, Homo sapiens
taatatgaactcccc

SEQ ID NO: 97507 - DNA, 15 bp, Homo sapiens
ctaatatgaactccc

SEQ ID NO: 97508 - DNA, 15 bp, Homo sapiens
actaatatgaactcc

SEQ ID NO: 97509 - DNA, 15 bp, Homo sapiens
aactaatatgaactc

SEQ ID NO: 97510 - DNA, 15 bp, Homo sapiens
caactaatatgaact

SEQ ID NO: 97511 - DNA, 15 bp, Homo sapiens
ccaactaatatgaac

SEQ ID NO: 97512 - DNA, 15 bp, Homo sapiens
tccaactaatatgaa

SEQ ID NO: 97513 - DNA, 15 bp, Homo sapiens
atccaactaatatga

SEQ ID NO: 97514 - DNA, 15 bp, Homo sapiens
gatccaactaatatg

SEQ ID NO: 97515 - DNA, 15 bp, Homo sapiens
ggatccaactaatat

SEQ ID NO: 97516 - DNA, 15 bp, Homo sapiens
tggatccaactaata

SEQ ID NO: 97517 - DNA, 15 bp, Homo sapiens
gtggatccaactaat

SEQ ID NO: 97518 - DNA, 15 bp, Homo sapiens
agtggatccaactaa

SEQ ID NO: 97519 - DNA, 15 bp, Homo sapiens
cagtggatccaacta

SEQ ID NO: 97520 - DNA, 15 bp, Homo sapiens
ccagtggatccaact

SEQ ID NO: 97521 - DNA, 15 bp, Homo sapiens
tccagtggatccaac

SEQ ID NO: 97522 - DNA, 15 bp, Homo sapiens
atccagtggatccaa

SEQ ID NO: 97523 - DNA, 15 bp, Homo sapiens
tatccagtggatcca

SEQ ID NO: 97524 - DNA, 15 bp, Homo sapiens
gtatccagtggatcc

SEQ ID NO: 97525 - DNA, 15 bp, Homo sapiens
tgtatccagtggatc

SEQ ID NO: 97526 - DNA, 15 bp, Homo sapiens
atgtatccagtggat

SEQ ID NO: 97527 - DNA, 15 bp, Homo sapiens
aatgtatccagtgga

SEQ ID NO: 97528 - DNA, 15 bp, Homo sapiens
aaatgtatccagtgg

SEQ ID NO: 97529 - DNA, 15 bp, Homo sapiens
gaaatgtatccagtg

SEQ ID NO: 97530 - DNA, 15 bp, Homo sapiens
ggaaatgtatccagt

SEQ ID NO: 97531 - DNA, 15 bp, Homo sapiens
aggaaatgtatccag

SEQ ID NO: 97532 - DNA, 15 bp, Homo sapiens
caggaaatgtatcca

SEQ ID NO: 97533 - DNA, 15 bp, Homo sapiens
acaggaaatgtatcc

SEQ ID NO: 97534 - DNA, 15 bp, Homo sapiens
tacaggaaatgtatc

SEQ ID NO: 97535 - DNA, 15 bp, Homo sapiens
ttacaggaaatgtat

SEQ ID NO: 97536 - DNA, 15 bp, Homo sapiens
tttacaggaaatgta

SEQ ID NO: 97537 - DNA, 15 bp, Homo sapiens
gtttacaggaaatgt

SEQ ID NO: 97538 - DNA, 15 bp, Homo sapiens
agtttacaggaaatg

SEQ ID NO: 97539 - DNA, 15 bp, Homo sapiens
aagtttacaggaaat

SEQ ID NO: 97540 - DNA, 15 bp, Homo sapiens
caagtttacaggaaa

SEQ ID NO: 97541 - DNA, 15 bp, Homo sapiens
acaagtttacaggaa

SEQ ID NO: 97542 - DNA, 15 bp, Homo sapiens
tacaagtttacagga

SEQ ID NO: 97543 - DNA, 15 bp, Homo sapiens
gtacaagtttacagg

SEQ ID NO: 97544 - DNA, 15 bp, Homo sapiens
agtacaagtttacag

SEQ ID NO: 97545 - DNA, 15 bp, Homo sapiens
gagtacaagtttaca

SEQ ID NO: 97546 - DNA, 15 bp, Homo sapiens
ggagtacaagtttac

SEQ ID NO: 97547 - DNA, 15 bp, Homo sapiens
aggagtacaagttta

SEQ ID NO: 97548 - DNA, 15 bp, Homo sapiens
gaggagtacaagttt

SEQ ID NO: 97549 - DNA, 15 bp, Homo sapiens
agaggagtacaagtt

SEQ ID NO: 97550 - DNA, 15 bp, Homo sapiens
cagaggagtacaagt

SEQ ID NO: 97551 - DNA, 15 bp, Homo sapiens
acagaggagtacaag

SEQ ID NO: 97552 - DNA, 15 bp, Homo sapiens
gacagaggagtacaa

SEQ ID NO: 97553 - DNA, 15 bp, Homo sapiens
cgacagaggagtaca

SEQ ID NO: 97554 - DNA, 15 bp, Homo sapiens
tcgacagaggagtac

SEQ ID NO: 97555 - DNA, 15 bp, Homo sapiens
atcgacagaggagta

SEQ ID NO: 97556 - DNA, 15 bp, Homo sapiens
tatcgacagaggagt

SEQ ID NO: 97557 - DNA, 15 bp, Homo sapiens
ctatcgacagaggag

SEQ ID NO: 97558 - DNA, 15 bp, Homo sapiens
actatcgacagagga

SEQ ID NO: 97559 - DNA, 15 bp, Homo sapiens
gactatcgacagagg

SEQ ID NO: 97560 - DNA, 15 bp, Homo sapiens
agactatcgacagag

SEQ ID NO: 97561 - DNA, 15 bp, Homo sapiens
aagactatcgacaga

SEQ ID NO: 97562 - DNA, 15 bp, Homo sapiens
caagactatcgacag

SEQ ID NO: 97563 - DNA, 15 bp, Homo sapiens
tcaagactatcgaca

SEQ ID NO: 97564 - DNA, 15 bp, Homo sapiens
ttcaagactatcgac

SEQ ID NO: 97565 - DNA, 15 bp, Homo sapiens
gttcaagactatcga

SEQ ID NO: 97566 - DNA, 15 bp, Homo sapiens
tgttcaagactatcg

SEQ ID NO: 97567 - DNA, 15 bp, Homo sapiens
gtgttcaagactatc

SEQ ID NO: 97568 - DNA, 15 bp, Homo sapiens
agtgttcaagactat

SEQ ID NO: 97569 - DNA, 15 bp, Homo sapiens
gagtgttcaagacta

SEQ ID NO: 97570 - DNA, 15 bp, Homo sapiens
agagtgttcaagact

SEQ ID NO: 97571 - DNA, 15 bp, Homo sapiens
gagagtgttcaagac

SEQ ID NO: 97572 - DNA, 15 bp, Homo sapiens
agagagtgttcaaga

SEQ ID NO: 97573 - DNA, 15 bp, Homo sapiens
aagagagtgttcaag

SEQ ID NO: 97574 - DNA, 15 bp, Homo sapiens
aaagagagtgttcaa

SEQ ID NO: 97575 - DNA, 15 bp, Homo sapiens
aaaagagagtgttca

SEQ ID NO: 97576 - DNA, 15 bp, Homo sapiens
aaaaagagagtgttc

SEQ ID NO: 97577 - DNA, 15 bp, Homo sapiens
taaaaagagagtgtt

SEQ ID NO: 97578 - DNA, 15 bp, Homo sapiens
ataaaaagagagtgt

SEQ ID NO: 97579 - DNA, 15 bp, Homo sapiens
tataaaaagagagtg

SEQ ID NO: 97580 - DNA, 15 bp, Homo sapiens
atataaaaagagagt

SEQ ID NO: 97581 - DNA, 15 bp, Homo sapiens
tatataaaaagagag

SEQ ID NO: 97582 - DNA, 15 bp, Homo sapiens
atatataaaaagaga

SEQ ID NO: 97583 - DNA, 15 bp, Homo sapiens
tatatataaaaagag

SEQ ID NO: 97584 - DNA, 15 bp, Homo sapiens
ttatatataaaaaga

SEQ ID NO: 97585 - DNA, 15 bp, Homo sapiens
attatatataaaaag

SEQ ID NO: 97586 - DNA, 15 bp, Homo sapiens
tattatatataaaaa

SEQ ID NO: 97587 - DNA, 15 bp, Homo sapiens
ttattatatataaaa

SEQ ID NO: 97588 - DNA, 15 bp, Homo sapiens
tttattatatataaa

SEQ ID NO: 97589 - DNA, 15 bp, Homo sapiens
ttttattatatataa

SEQ ID NO: 97590 - DNA, 15 bp, Homo sapiens
cttttattatatata

SEQ ID NO: 97591 - DNA, 15 bp, Homo sapiens
tcttttattatatat

SEQ ID NO: 97592 - DNA, 15 bp, Homo sapiens
ttcttttattatata

SEQ ID NO: 97593 - DNA, 15 bp, Homo sapiens
gttcttttattatat

SEQ ID NO: 97594 - DNA, 15 bp, Homo sapiens
agttcttttattata

SEQ ID NO: 97595 - DNA, 15 bp, Homo sapiens
cagttcttttattat

SEQ ID NO: 97596 - DNA, 15 bp, Homo sapiens
ccagttcttttatta

SEQ ID NO: 97597 - DNA, 15 bp, Homo sapiens
cccagttcttttatt

SEQ ID NO: 97598 - DNA, 15 bp, Homo sapiens
gcccagttcttttat

SEQ ID NO: 97599 - DNA, 15 bp, Homo sapiens
tgcccagttctttta

SEQ ID NO: 97600 - DNA, 15 bp, Homo sapiens
atgcccagttctttt

SEQ ID NO: 97601 - DNA, 15 bp, Homo sapiens
gatgcccagttcttt

SEQ ID NO: 97602 - DNA, 15 bp, Homo sapiens
tgatgcccagttctt

SEQ ID NO: 97603 - DNA, 15 bp, Homo sapiens
atgatgcccagttct

SEQ ID NO: 97604 - DNA, 15 bp, Homo sapiens
aatgatgcccagttc

SEQ ID NO: 97605 - DNA, 15 bp, Homo sapiens
gaatgatgcccagtt

SEQ ID NO: 97606 - DNA, 15 bp, Homo sapiens
ggaatgatgcccagt

SEQ ID NO: 97607 - DNA, 15 bp, Homo sapiens
gggaatgatgcccag

SEQ ID NO: 97608 - DNA, 15 bp, Homo sapiens
tgggaatgatgccca

SEQ ID NO: 97609 - DNA, 15 bp, Homo sapiens
ttgggaatgatgccc

SEQ ID NO: 97610 - DNA, 15 bp, Homo sapiens
tttgggaatgatgcc

SEQ ID NO: 97611 - DNA, 15 bp, Homo sapiens
atttgggaatgatgc

SEQ ID NO: 97612 - DNA, 15 bp, Homo sapiens
aatttgggaatgatg

SEQ ID NO: 97613 - DNA, 15 bp, Homo sapiens
aaatttgggaatgat

SEQ ID NO: 97614 - DNA, 15 bp, Homo sapiens
gaaatttgggaatga

SEQ ID NO: 97615 - DNA, 15 bp, Homo sapiens
agaaatttgggaatg

SEQ ID NO: 97616 - DNA, 15 bp, Homo sapiens
tagaaatttgggaat

SEQ ID NO: 97617 - DNA, 15 bp, Homo sapiens
ttagaaatttgggaa

SEQ ID NO: 97618 - DNA, 15 bp, Homo sapiens
gttagaaatttggga

SEQ ID NO: 97619 - DNA, 15 bp, Homo sapiens
tgttagaaatttggg

SEQ ID NO: 97620 - DNA, 15 bp, Homo sapiens
gtgttagaaatttgg

SEQ ID NO: 97621 - DNA, 15 bp, Homo sapiens
tgtgttagaaatttg

SEQ ID NO: 97622 - DNA, 15 bp, Homo sapiens
ctgtgttagaaattt

SEQ ID NO: 97623 - DNA, 15 bp, Homo sapiens
gctgtgttagaaatt

SEQ ID NO: 97624 - DNA, 15 bp, Homo sapiens
agctgtgttagaaat

SEQ ID NO: 97625 - DNA, 15 bp, Homo sapiens
aagctgtgttagaaa

SEQ ID NO: 97626 - DNA, 15 bp, Homo sapiens
gaagctgtgttagaa

SEQ ID NO: 97627 - DNA, 15 bp, Homo sapiens
tgaagctgtgttaga

SEQ ID NO: 97628 - DNA, 15 bp, Homo sapiens
ttgaagctgtgttag

SEQ ID NO: 97629 - DNA, 15 bp, Homo sapiens
gttgaagctgtgtta

SEQ ID NO: 97630 - DNA, 15 bp, Homo sapiens
agttgaagctgtgtt

SEQ ID NO: 97631 - DNA, 15 bp, Homo sapiens
cagttgaagctgtgt

SEQ ID NO: 97632 - DNA, 15 bp, Homo sapiens
acagttgaagctgtg

SEQ ID NO: 97633 - DNA, 15 bp, Homo sapiens
gacagttgaagctgt

SEQ ID NO: 97634 - DNA, 15 bp, Homo sapiens
ggacagttgaagctg

SEQ ID NO: 97635 - DNA, 15 bp, Homo sapiens
aggacagttgaagct

SEQ ID NO: 97636 - DNA, 15 bp, Homo sapiens
aaggacagttgaagc

SEQ ID NO: 97637 - DNA, 15 bp, Homo sapiens
caaggacagttgaag

SEQ ID NO: 97638 - DNA, 15 bp, Homo sapiens
tcaaggacagttgaa

SEQ ID NO: 97639 - DNA, 15 bp, Homo sapiens
ttcaaggacagttga

SEQ ID NO: 97640 - DNA, 15 bp, Homo sapiens
attcaaggacagttg

SEQ ID NO: 97641 - DNA, 15 bp, Homo sapiens
cattcaaggacagtt

SEQ ID NO: 97642 - DNA, 15 bp, Homo sapiens
acattcaaggacagt

SEQ ID NO: 97643 - DNA, 15 bp, Homo sapiens
aacattcaaggacag

SEQ ID NO: 97644 - DNA, 15 bp, Homo sapiens
gaacattcaaggaca

SEQ ID NO: 97645 - DNA, 15 bp, Homo sapiens
tgaacattcaaggac

SEQ ID NO: 97646 - DNA, 15 bp, Homo sapiens
ttgaacattcaagga

SEQ ID NO: 97647 - DNA, 15 bp, Homo sapiens
cttgaacattcaagg

SEQ ID NO: 97648 - DNA, 15 bp, Homo sapiens
gcttgaacattcaag

SEQ ID NO: 97649 - DNA, 15 bp, Homo sapiens
ggcttgaacattcaa

SEQ ID NO: 97650 - DNA, 15 bp, Homo sapiens
tggcttgaacattca

SEQ ID NO: 97651 - DNA, 15 bp, Homo sapiens
ttggcttgaacattc

SEQ ID NO: 97652 - DNA, 15 bp, Homo sapiens
tttggcttgaacatt

SEQ ID NO: 97653 - DNA, 15 bp, Homo sapiens
ctttggcttgaacat

SEQ ID NO: 97654 - DNA, 15 bp, Homo sapiens
cctttggcttgaaca

SEQ ID NO: 97655 - DNA, 15 bp, Homo sapiens
tcctttggcttgaac

SEQ ID NO: 97656 - DNA, 15 bp, Homo sapiens
ctcctttggcttgaa

SEQ ID NO: 97657 - DNA, 15 bp, Homo sapiens
tctcctttggcttga

SEQ ID NO: 97658 - DNA, 15 bp, Homo sapiens
atctcctttggcttg

SEQ ID NO: 97659 - DNA, 15 bp, Homo sapiens
catctcctttggctt

SEQ ID NO: 97660 - DNA, 15 bp, Homo sapiens
ccatctcctttggct

SEQ ID NO: 97661 - DNA, 15 bp, Homo sapiens
accatctcctttggc

SEQ ID NO: 97662 - DNA, 15 bp, Homo sapiens
caccatctcctttgg

SEQ ID NO: 97663 - DNA, 15 bp, Homo sapiens
acaccatctcctttg

SEQ ID NO: 97664 - DNA, 15 bp, Homo sapiens
aacaccatctccttt

SEQ ID NO: 97665 - DNA, 15 bp, Homo sapiens
aaacaccatctcctt

SEQ ID NO: 97666 - DNA, 15 bp, Homo sapiens
aaaacaccatctcct

SEQ ID NO: 97667 - DNA, 15 bp, Homo sapiens
gaaaacaccatctcc

SEQ ID NO: 97668 - DNA, 15 bp, Homo sapiens
tgaaaacaccatctc

SEQ ID NO: 97669 - DNA, 15 bp, Homo sapiens
ttgaaaacaccatct

SEQ ID NO: 97670 - DNA, 15 bp, Homo sapiens
tttgaaaacaccatc

SEQ ID NO: 97671 - DNA, 15 bp, Homo sapiens
ctttgaaaacaccat

SEQ ID NO: 97672 - DNA, 15 bp, Homo sapiens
gctttgaaaacacca

SEQ ID NO: 97673 - DNA, 15 bp, Homo sapiens
agctttgaaaacacc

SEQ ID NO: 97674 - DNA, 15 bp, Homo sapiens
aagctttgaaaacac

SEQ ID NO: 97675 - DNA, 15 bp, Homo sapiens
aaagctttgaaaaca

SEQ ID NO: 97676 - DNA, 15 bp, Homo sapiens
aaaagctttgaaaac

SEQ ID NO: 97677 - DNA, 15 bp, Homo sapiens
aaaaagctttgaaaa

SEQ ID NO: 97678 - DNA, 15 bp, Homo sapiens
aaaaaagctttgaaa

SEQ ID NO: 97679 - DNA, 15 bp, Homo sapiens
aaaaaaagctttgaa

SEQ ID NO: 97680 - DNA, 15 bp, Homo sapiens
aaaaaaaagctttga

SEQ ID NO: 97681 - DNA, 15 bp, Homo sapiens
gaaaaaaaagctttg

SEQ ID NO: 97682 - DNA, 15 bp, Homo sapiens
ggaaaaaaaagcttt

SEQ ID NO: 97683 - DNA, 15 bp, Homo sapiens
aggaaaaaaaagctt

SEQ ID NO: 97684 - DNA, 15 bp, Homo sapiens
caggaaaaaaaagct

SEQ ID NO: 97685 - DNA, 15 bp, Homo sapiens
acaggaaaaaaaagc

SEQ ID NO: 97686 - DNA, 15 bp, Homo sapiens
tacaggaaaaaaaag

SEQ ID NO: 97687 - DNA, 15 bp, Homo sapiens
ttacaggaaaaaaaa

SEQ ID NO: 97688 - DNA, 15 bp, Homo sapiens
cttacaggaaaaaaa

SEQ ID NO: 97689 - DNA, 15 bp, Homo sapiens
gcttacaggaaaaaa

SEQ ID NO: 97690 - DNA, 15 bp, Homo sapiens
agcttacaggaaaaa

SEQ ID NO: 97691 - DNA, 15 bp, Homo sapiens
aagcttacaggaaaa

SEQ ID NO: 97692 - DNA, 15 bp, Homo sapiens
taagcttacaggaaa

SEQ ID NO: 97693 - DNA, 15 bp, Homo sapiens
ttaagcttacaggaa

SEQ ID NO: 97694 - DNA, 15 bp, Homo sapiens
cttaagcttacagga

SEQ ID NO: 97695 - DNA, 15 bp, Homo sapiens
gcttaagcttacagg

SEQ ID NO: 97696 - DNA, 15 bp, Homo sapiens
tgcttaagcttacag

SEQ ID NO: 97697 - DNA, 15 bp, Homo sapiens
ttgcttaagcttaca

SEQ ID NO: 97698 - DNA, 15 bp, Homo sapiens
gttgcttaagcttac

SEQ ID NO: 97699 - DNA, 15 bp, Homo sapiens
tgttgcttaagctta

SEQ ID NO: 97700 - DNA, 15 bp, Homo sapiens
gtgttgcttaagctt

SEQ ID NO: 97701 - DNA, 15 bp, Homo sapiens
tgtgttgcttaagct

SEQ ID NO: 97702 - DNA, 15 bp, Homo sapiens
ctgtgttgcttaagc

SEQ ID NO: 97703 - DNA, 15 bp, Homo sapiens
actgtgttgcttaag

SEQ ID NO: 97704 - DNA, 15 bp, Homo sapiens
cactgtgttgcttaa

SEQ ID NO: 97705 - DNA, 15 bp, Homo sapiens
tcactgtgttgctta

SEQ ID NO: 97706 - DNA, 15 bp, Homo sapiens
gtcactgtgttgctt

SEQ ID NO: 97707 - DNA, 15 bp, Homo sapiens
agtcactgtgttgct

SEQ ID NO: 97708 - DNA, 15 bp, Homo sapiens
tagtcactgtgttgc

SEQ ID NO: 97709 - DNA, 15 bp, Homo sapiens
ttagtcactgtgttg

SEQ ID NO: 97710 - DNA, 15 bp, Homo sapiens
attagtcactgtgtt

SEQ ID NO: 97711 - DNA, 15 bp, Homo sapiens
cattagtcactgtgt

SEQ ID NO: 97712 - DNA, 15 bp, Homo sapiens
acattagtcactgtg

SEQ ID NO: 97713 - DNA, 15 bp, Homo sapiens
aacattagtcactgt

SEQ ID NO: 97714 - DNA, 15 bp, Homo sapiens
aaacattagtcactg

SEQ ID NO: 97715 - DNA, 15 bp, Homo sapiens
aaaacattagtcact

SEQ ID NO: 97716 - DNA, 15 bp, Homo sapiens
taaaacattagtcac

SEQ ID NO: 97717 - DNA, 15 bp, Homo sapiens
gtaaaacattagtca

SEQ ID NO: 97718 - DNA, 15 bp, Homo sapiens
ggtaaaacattagtc

SEQ ID NO: 97719 - DNA, 15 bp, Homo sapiens
aggtaaaacattagt

SEQ ID NO: 97720 - DNA, 15 bp, Homo sapiens
gaggtaaaacattag

SEQ ID NO: 97721 - DNA, 15 bp, Homo sapiens
tgaggtaaaacatta

SEQ ID NO: 97722 - DNA, 15 bp, Homo sapiens
ttgaggtaaaacatt

SEQ ID NO: 97723 - DNA, 15 bp, Homo sapiens
tttgaggtaaaacat

SEQ ID NO: 97724 - DNA, 15 bp, Homo sapiens
ctttgaggtaaaaca

SEQ ID NO: 97725 - DNA, 15 bp, Homo sapiens
actttgaggtaaaac

SEQ ID NO: 97726 - DNA, 15 bp, Homo sapiens
aactttgaggtaaaa

SEQ ID NO: 97727 - DNA, 15 bp, Homo sapiens
taactttgaggtaaa

SEQ ID NO: 97728 - DNA, 15 bp, Homo sapiens
ttaactttgaggtaa

SEQ ID NO: 97729 - DNA, 15 bp, Homo sapiens
gttaactttgaggta

SEQ ID NO: 97730 - DNA, 15 bp, Homo sapiens
agttaactttgaggt

SEQ ID NO: 97731 - DNA, 15 bp, Homo sapiens
aagttaactttgagg

SEQ ID NO: 97732 - DNA, 15 bp, Homo sapiens
taagttaactttgag

SEQ ID NO: 97733 - DNA, 15 bp, Homo sapiens
gtaagttaactttga

SEQ ID NO: 97734 - DNA, 15 bp, Homo sapiens
ggtaagttaactttg

SEQ ID NO: 97735 - DNA, 15 bp, Homo sapiens
aggtaagttaacttt

SEQ ID NO: 97736 - DNA, 15 bp, Homo sapiens
taggtaagttaactt

SEQ ID NO: 97737 - DNA, 15 bp, Homo sapiens
ctaggtaagttaact

SEQ ID NO: 97738 - DNA, 15 bp, Homo sapiens
tctaggtaagttaac

SEQ ID NO: 97739 - DNA, 15 bp, Homo sapiens
ttctaggtaagttaa

SEQ ID NO: 97740 - DNA, 15 bp, Homo sapiens
cttctaggtaagtta

SEQ ID NO: 97741 - DNA, 15 bp, Homo sapiens
acttctaggtaagtt

SEQ ID NO: 97742 - DNA, 15 bp, Homo sapiens
cacttctaggtaagt

SEQ ID NO: 97743 - DNA, 15 bp, Homo sapiens
acacttctaggtaag

SEQ ID NO: 97744 - DNA, 15 bp, Homo sapiens
tacacttctaggtaa

SEQ ID NO: 97745 - DNA, 15 bp, Homo sapiens
ttacacttctaggta

SEQ ID NO: 97746 - DNA, 15 bp, Homo sapiens
gttacacttctaggt

SEQ ID NO: 97747 - DNA, 15 bp, Homo sapiens
agttacacttctagg

SEQ ID NO: 97748 - DNA, 15 bp, Homo sapiens
tagttacacttctag

SEQ ID NO: 97749 - DNA, 15 bp, Homo sapiens
ttagttacacttcta

SEQ ID NO: 97750 - DNA, 15 bp, Homo sapiens
tttagttacacttct

SEQ ID NO: 97751 - DNA, 15 bp, Homo sapiens
ctttagttacacttc

SEQ ID NO: 97752 - DNA, 15 bp, Homo sapiens
gctttagttacactt

SEQ ID NO: 97753 - DNA, 15 bp, Homo sapiens
tgctttagttacact

SEQ ID NO: 97754 - DNA, 15 bp, Homo sapiens
ttgctttagttacac

SEQ ID NO: 97755 - DNA, 15 bp, Homo sapiens
tttgctttagttaca

SEQ ID NO: 97756 - DNA, 15 bp, Homo sapiens
ttttgctttagttac

SEQ ID NO: 97757 - DNA, 15 bp, Homo sapiens
tttttgctttagtta

SEQ ID NO: 97758 - DNA, 15 bp, Homo sapiens
atttttgctttagtt

SEQ ID NO: 97759 - DNA, 15 bp, Homo sapiens
gatttttgctttagt

SEQ ID NO: 97760 - DNA, 15 bp, Homo sapiens
agatttttgctttag

SEQ ID NO: 97761 - DNA, 15 bp, Homo sapiens
cagatttttgcttta

SEQ ID NO: 97762 - DNA, 15 bp, Homo sapiens
acagatttttgcttt

SEQ ID NO: 97763 - DNA, 15 bp, Homo sapiens
cacagatttttgctt

SEQ ID NO: 97764 - DNA, 15 bp, Homo sapiens
tcacagatttttgct

SEQ ID NO: 97765 - DNA, 15 bp, Homo sapiens
atcacagatttttgc

SEQ ID NO: 97766 - DNA, 15 bp, Homo sapiens
aatcacagatttttg

SEQ ID NO: 97767 - DNA, 15 bp, Homo sapiens
aaatcacagattttt

SEQ ID NO: 97768 - DNA, 15 bp, Homo sapiens
aaaatcacagatttt

SEQ ID NO: 97769 - DNA, 15 bp, Homo sapiens
aaaaatcacagattt

SEQ ID NO: 97770 - DNA, 15 bp, Homo sapiens
aaaaaatcacagatt

SEQ ID NO: 97771 - DNA, 15 bp, Homo sapiens
aaaaaaatcacagat

SEQ ID NO: 97772 - DNA, 15 bp, Homo sapiens
gaaaaaaatcacaga

SEQ ID NO: 97773 - DNA, 15 bp, Homo sapiens
tgaaaaaaatcacag

SEQ ID NO: 97774 - DNA, 15 bp, Homo sapiens
ttgaaaaaaatcaca

SEQ ID NO: 97775 - DNA, 15 bp, Homo sapiens
tttgaaaaaaatcac

SEQ ID NO: 97776 - DNA, 15 bp, Homo sapiens
ttttgaaaaaaatca

SEQ ID NO: 97777 - DNA, 15 bp, Homo sapiens
tttttgaaaaaaatc

SEQ ID NO: 97778 - DNA, 15 bp, Homo sapiens
ttttttgaaaaaaat

SEQ ID NO: 97779 - DNA, 15 bp, Homo sapiens
cttttttgaaaaaaa

SEQ ID NO: 97780 - DNA, 15 bp, Homo sapiens
ccttttttgaaaaaa

SEQ ID NO: 97781 - DNA, 15 bp, Homo sapiens
cccttttttgaaaaa

SEQ ID NO: 97782 - DNA, 15 bp, Homo sapiens
tcccttttttgaaaa

SEQ ID NO: 97783 - DNA, 15 bp, Homo sapiens
atcccttttttgaaa

SEQ ID NO: 97784 - DNA, 15 bp, Homo sapiens
aatcccttttttgaa

SEQ ID NO: 97785 - DNA, 15 bp, Homo sapiens
taatcccttttttga

SEQ ID NO: 97786 - DNA, 15 bp, Homo sapiens
ataatcccttttttg

SEQ ID NO: 97787 - DNA, 15 bp, Homo sapiens
tataatccctttttt

SEQ ID NO: 97788 - DNA, 15 bp, Homo sapiens
atataatcccttttt

SEQ ID NO: 97789 - DNA, 15 bp, Homo sapiens
catataatccctttt

SEQ ID NO: 97790 - DNA, 15 bp, Homo sapiens
tcatataatcccttt

SEQ ID NO: 97791 - DNA, 15 bp, Homo sapiens
gtcatataatccctt

SEQ ID NO: 97792 - DNA, 15 bp, Homo sapiens
tgtcatataatccct

SEQ ID NO: 97793 - DNA, 15 bp, Homo sapiens
atgtcatataatccc

SEQ ID NO: 97794 - DNA, 15 bp, Homo sapiens
aatgtcatataatcc

SEQ ID NO: 97795 - DNA, 15 bp, Homo sapiens
gaatgtcatataatc

SEQ ID NO: 97796 - DNA, 15 bp, Homo sapiens
tgaatgtcatataat

SEQ ID NO: 97797 - DNA, 15 bp, Homo sapiens
atgaatgtcatataa

SEQ ID NO: 97798 - DNA, 15 bp, Homo sapiens
tatgaatgtcatata

SEQ ID NO: 97799 - DNA, 15 bp, Homo sapiens
gtatgaatgtcatat

SEQ ID NO: 97800 - DNA, 15 bp, Homo sapiens
tgtatgaatgtcata

SEQ ID NO: 97801 - DNA, 15 bp, Homo sapiens
atgtatgaatgtcat

SEQ ID NO: 97802 - DNA, 15 bp, Homo sapiens
aatgtatgaatgtca

SEQ ID NO: 97803 - DNA, 15 bp, Homo sapiens
taatgtatgaatgtc

SEQ ID NO: 97804 - DNA, 15 bp, Homo sapiens
ataatgtatgaatgt

SEQ ID NO: 97805 - DNA, 15 bp, Homo sapiens
aataatgtatgaatg

SEQ ID NO: 97806 - DNA, 15 bp, Homo sapiens
taataatgtatgaat

SEQ ID NO: 97807 - DNA, 15 bp, Homo sapiens
ataataatgtatgaa

SEQ ID NO: 97808 - DNA, 15 bp, Homo sapiens
tataataatgtatga

SEQ ID NO: 97809 - DNA, 15 bp, Homo sapiens
gtataataatgtatg

SEQ ID NO: 97810 - DNA, 15 bp, Homo sapiens
tgtataataatgtat

SEQ ID NO: 97811 - DNA, 15 bp, Homo sapiens
atgtataataatgta

SEQ ID NO: 97812 - DNA, 15 bp, Homo sapiens
catgtataataatgt

SEQ ID NO: 97813 - DNA, 15 bp, Homo sapiens
tcatgtataataatg

SEQ ID NO: 97814 - DNA, 15 bp, Homo sapiens
ttcatgtataataat

SEQ ID NO: 97815 - DNA, 15 bp, Homo sapiens
attcatgtataataa

SEQ ID NO: 97816 - DNA, 15 bp, Homo sapiens
gattcatgtataata

SEQ ID NO: 97817 - DNA, 15 bp, Homo sapiens
tgattcatgtataat

SEQ ID NO: 97818 - DNA, 15 bp, Homo sapiens
ttgattcatgtataa

SEQ ID NO: 97819 - DNA, 15 bp, Homo sapiens
tttgattcatgtata

SEQ ID NO: 97820 - DNA, 15 bp, Homo sapiens
ctttgattcatgtat

SEQ ID NO: 97821 - DNA, 15 bp, Homo sapiens
actttgattcatgta

SEQ ID NO: 97822 - DNA, 15 bp, Homo sapiens
tactttgattcatgt

SEQ ID NO: 97823 - DNA, 15 bp, Homo sapiens
ttactttgattcatg

SEQ ID NO: 97824 - DNA, 15 bp, Homo sapiens
tttactttgattcat

SEQ ID NO: 97825 - DNA, 15 bp, Homo sapiens
atttactttgattca

SEQ ID NO: 97826 - DNA, 15 bp, Homo sapiens
tatttactttgattc

SEQ ID NO: 97827 - DNA, 15 bp, Homo sapiens
atatttactttgatt

SEQ ID NO: 97828 - DNA, 15 bp, Homo sapiens
catatttactttgat

SEQ ID NO: 97829 - DNA, 15 bp, Homo sapiens
tcatatttactttga

SEQ ID NO: 97830 - DNA, 15 bp, Homo sapiens
gtcatatttactttg

SEQ ID NO: 97831 - DNA, 15 bp, Homo sapiens
tgtcatatttacttt

SEQ ID NO: 97832 - DNA, 15 bp, Homo sapiens
ctgtcatatttactt

SEQ ID NO: 97833 - DNA, 15 bp, Homo sapiens
cctgtcatatttact

SEQ ID NO: 97834 - DNA, 15 bp, Homo sapiens
tcctgtcatatttac

SEQ ID NO: 97835 - DNA, 15 bp, Homo sapiens
ctcctgtcatattta

SEQ ID NO: 97836 - DNA, 15 bp, Homo sapiens
tctcctgtcatattt

SEQ ID NO: 97837 - DNA, 15 bp, Homo sapiens
gtctcctgtcatatt

SEQ ID NO: 97838 - DNA, 15 bp, Homo sapiens
agtctcctgtcatat

SEQ ID NO: 97839 - DNA, 15 bp, Homo sapiens
aagtctcctgtcata

SEQ ID NO: 97840 - DNA, 15 bp, Homo sapiens
caagtctcctgtcat

SEQ ID NO: 97841 - DNA, 15 bp, Homo sapiens
acaagtctcctgtca

SEQ ID NO: 97842 - DNA, 15 bp, Homo sapiens
aacaagtctcctgtc

SEQ ID NO: 97843 - DNA, 15 bp, Homo sapiens
caacaagtctcctgt

SEQ ID NO: 97844 - DNA, 15 bp, Homo sapiens
ccaacaagtctcctg

SEQ ID NO: 97845 - DNA, 15 bp, Homo sapiens
tccaacaagtctcct

SEQ ID NO: 97846 - DNA, 15 bp, Homo sapiens
ttccaacaagtctcc

SEQ ID NO: 97847 - DNA, 15 bp, Homo sapiens
cttccaacaagtctc

SEQ ID NO: 97848 - DNA, 15 bp, Homo sapiens
acttccaacaagtct

SEQ ID NO: 97849 - DNA, 15 bp, Homo sapiens
aacttccaacaagtc

SEQ ID NO: 97850 - DNA, 15 bp, Homo sapiens
caacttccaacaagt

SEQ ID NO: 97851 - DNA, 15 bp, Homo sapiens
acaacttccaacaag

SEQ ID NO: 97852 - DNA, 15 bp, Homo sapiens
aacaacttccaacaa

SEQ ID NO: 97853 - DNA, 15 bp, Homo sapiens
aaacaacttccaaca

SEQ ID NO: 97854 - DNA, 15 bp, Homo sapiens
aaaacaacttccaac

SEQ ID NO: 97855 - DNA, 15 bp, Homo sapiens
aaaaacaacttccaa

SEQ ID NO: 97856 - DNA, 15 bp, Homo sapiens
aaaaaacaacttcca

SEQ ID NO: 97857 - DNA, 15 bp, Homo sapiens
gaaaaaacaacttcc

SEQ ID NO: 97858 - DNA, 15 bp, Homo sapiens
tgaaaaaacaacttc

SEQ ID NO: 97859 - DNA, 15 bp, Homo sapiens
gtgaaaaaacaactt

SEQ ID NO: 97860 - DNA, 15 bp, Homo sapiens
agtgaaaaaacaact

SEQ ID NO: 97861 - DNA, 15 bp, Homo sapiens
tagtgaaaaaacaac

SEQ ID NO: 97862 - DNA, 15 bp, Homo sapiens
ttagtgaaaaaacaa

SEQ ID NO: 97863 - DNA, 15 bp, Homo sapiens
tttagtgaaaaaaca

SEQ ID NO: 97864 - DNA, 15 bp, Homo sapiens
ttttagtgaaaaaac

SEQ ID NO: 97865 - DNA, 15 bp, Homo sapiens
gttttagtgaaaaaa

SEQ ID NO: 97866 - DNA, 15 bp, Homo sapiens
tgttttagtgaaaaa

SEQ ID NO: 97867 - DNA, 15 bp, Homo sapiens
atgttttagtgaaaa

SEQ ID NO: 97868 - DNA, 15 bp, Homo sapiens
gatgttttagtgaaa

SEQ ID NO: 97869 - DNA, 15 bp, Homo sapiens
agatgttttagtgaa

SEQ ID NO: 97870 - DNA, 15 bp, Homo sapiens
aagatgttttagtga

SEQ ID NO: 97871 - DNA, 15 bp, Homo sapiens
aaagatgttttagtg

SEQ ID NO: 97872 - DNA, 15 bp, Homo sapiens
aaaagatgttttagt

SEQ ID NO: 97873 - DNA, 15 bp, Homo sapiens
aaaaagatgttttag

SEQ ID NO: 97874 - DNA, 15 bp, Homo sapiens
aaaaaagatgtttta

SEQ ID NO: 97875 - DNA, 15 bp, Homo sapiens
taaaaaagatgtttt

SEQ ID NO: 97876 - DNA, 15 bp, Homo sapiens
ctaaaaaagatgttt

SEQ ID NO: 97877 - DNA, 15 bp, Homo sapiens
actaaaaaagatgtt

SEQ ID NO: 97878 - DNA, 15 bp, Homo sapiens
cactaaaaaagatgt

SEQ ID NO: 97879 - DNA, 15 bp, Homo sapiens
acactaaaaaagatg

SEQ ID NO: 97880 - DNA, 15 bp, Homo sapiens
tacactaaaaaagat

SEQ ID NO: 97881 - DNA, 15 bp, Homo sapiens
ctacactaaaaaaga

SEQ ID NO: 97882 - DNA, 15 bp, Homo sapiens
gctacactaaaaaag

SEQ ID NO: 97883 - DNA, 15 bp, Homo sapiens
agctacactaaaaaa

SEQ ID NO: 97884 - DNA, 15 bp, Homo sapiens
gagctacactaaaaa

SEQ ID NO: 97885 - DNA, 15 bp, Homo sapiens
agagctacactaaaa

SEQ ID NO: 97886 - DNA, 15 bp, Homo sapiens
aagagctacactaaa

SEQ ID NO: 97887 - DNA, 15 bp, Homo sapiens
aaagagctacactaa

SEQ ID NO: 97888 - DNA, 15 bp, Homo sapiens
aaaagagctacacta

SEQ ID NO: 97889 - DNA, 15 bp, Homo sapiens
aaaaagagctacact

SEQ ID NO: 97890 - DNA, 15 bp, Homo sapiens
caaaaagagctacac

SEQ ID NO: 97891 - DNA, 15 bp, Homo sapiens
tcaaaaagagctaca

SEQ ID NO: 97892 - DNA, 15 bp, Homo sapiens
ttcaaaaagagctac

SEQ ID NO: 97893 - DNA, 15 bp, Homo sapiens
tttcaaaaagagcta

SEQ ID NO: 97894 - DNA, 15 bp, Homo sapiens
ctttcaaaaagagct

SEQ ID NO: 97895 - DNA, 15 bp, Homo sapiens
tctttcaaaaagagc

SEQ ID NO: 97896 - DNA, 15 bp, Homo sapiens
atctttcaaaaagag

SEQ ID NO: 97897 - DNA, 15 bp, Homo sapiens
aatctttcaaaaaga

SEQ ID NO: 97898 - DNA, 15 bp, Homo sapiens
aaatctttcaaaaag

SEQ ID NO: 97899 - DNA, 15 bp, Homo sapiens
taaatctttcaaaaa

SEQ ID NO: 97900 - DNA, 15 bp, Homo sapiens
ttaaatctttcaaaa

SEQ ID NO: 97901 - DNA, 15 bp, Homo sapiens
tttaaatctttcaaa

SEQ ID NO: 97902 - DNA, 15 bp, Homo sapiens
ttttaaatctttcaa

SEQ ID NO: 97903 - DNA, 15 bp, Homo sapiens
tttttaaatctttca

SEQ ID NO: 97904 - DNA, 15 bp, Homo sapiens
atttttaaatctttc

SEQ ID NO: 97905 - DNA, 15 bp, Homo sapiens
tatttttaaatcttt

SEQ ID NO: 97906 - DNA, 15 bp, Homo sapiens
gtatttttaaatctt

SEQ ID NO: 97907 - DNA, 15 bp, Homo sapiens
agtatttttaaatct

SEQ ID NO: 97908 - DNA, 15 bp, Homo sapiens
gagtatttttaaatc

SEQ ID NO: 97909 - DNA, 15 bp, Homo sapiens
tgagtatttttaaat

SEQ ID NO: 97910 - DNA, 15 bp, Homo sapiens
ctgagtatttttaaa

SEQ ID NO: 97911 - DNA, 15 bp, Homo sapiens
actgagtatttttaa

SEQ ID NO: 97912 - DNA, 15 bp, Homo sapiens
tactgagtattttta

SEQ ID NO: 97913 - DNA, 15 bp, Homo sapiens
gtactgagtattttt

SEQ ID NO: 97914 - DNA, 15 bp, Homo sapiens
tgtactgagtatttt

SEQ ID NO: 97915 - DNA, 15 bp, Homo sapiens
atgtactgagtattt

SEQ ID NO: 97916 - DNA, 15 bp, Homo sapiens
tatgtactgagtatt

SEQ ID NO: 97917 - DNA, 15 bp, Homo sapiens
ttatgtactgagtat

SEQ ID NO: 97918 - DNA, 15 bp, Homo sapiens
cttatgtactgagta

SEQ ID NO: 97919 - DNA, 15 bp, Homo sapiens
ccttatgtactgagt

SEQ ID NO: 97920 - DNA, 15 bp, Homo sapiens
accttatgtactgag

SEQ ID NO: 97921 - DNA, 15 bp, Homo sapiens
taccttatgtactga

SEQ ID NO: 97922 - DNA, 15 bp, Homo sapiens
ataccttatgtactg

SEQ ID NO: 97923 - DNA, 15 bp, Homo sapiens
aataccttatgtact

SEQ ID NO: 97924 - DNA, 15 bp, Homo sapiens
aaataccttatgtac

SEQ ID NO: 97925 - DNA, 15 bp, Homo sapiens
aaaataccttatgta

SEQ ID NO: 97926 - DNA, 15 bp, Homo sapiens
taaaataccttatgt

SEQ ID NO: 97927 - DNA, 15 bp, Homo sapiens
ttaaaataccttatg

SEQ ID NO: 97928 - DNA, 15 bp, Homo sapiens
tttaaaataccttat

SEQ ID NO: 97929 - DNA, 15 bp, Homo sapiens
ttttaaaatacctta

SEQ ID NO: 97930 - DNA, 15 bp, Homo sapiens
attttaaaatacctt

SEQ ID NO: 97931 - DNA, 15 bp, Homo sapiens
tattttaaaatacct

SEQ ID NO: 97932 - DNA, 15 bp, Homo sapiens
ctattttaaaatacc

SEQ ID NO: 97933 - DNA, 15 bp, Homo sapiens
cctattttaaaatac

SEQ ID NO: 97934 - DNA, 15 bp, Homo sapiens
gcctattttaaaata

SEQ ID NO: 97935 - DNA, 15 bp, Homo sapiens
agcctattttaaaat

SEQ ID NO: 97936 - DNA, 15 bp, Homo sapiens
tagcctattttaaaa

SEQ ID NO: 97937 - DNA, 15 bp, Homo sapiens
gtagcctattttaaa

SEQ ID NO: 97938 - DNA, 15 bp, Homo sapiens
ggtagcctattttaa

SEQ ID NO: 97939 - DNA, 15 bp, Homo sapiens
tggtagcctatttta

SEQ ID NO: 97940 - DNA, 15 bp, Homo sapiens
atggtagcctatttt

SEQ ID NO: 97941 - DNA, 15 bp, Homo sapiens
catggtagcctattt

SEQ ID NO: 97942 - DNA, 15 bp, Homo sapiens
acatggtagcctatt

SEQ ID NO: 97943 - DNA, 15 bp, Homo sapiens
aacatggtagcctat

SEQ ID NO: 97944 - DNA, 15 bp, Homo sapiens
taacatggtagccta

SEQ ID NO: 97945 - DNA, 15 bp, Homo sapiens
ttaacatggtagcct

SEQ ID NO: 97946 - DNA, 15 bp, Homo sapiens
cttaacatggtagcc

SEQ ID NO: 97947 - DNA, 15 bp, Homo sapiens
tcttaacatggtagc

SEQ ID NO: 97948 - DNA, 15 bp, Homo sapiens
ttcttaacatggtag

SEQ ID NO: 97949 - DNA, 15 bp, Homo sapiens
attcttaacatggta

SEQ ID NO: 97950 - DNA, 15 bp, Homo sapiens
aattcttaacatggt

SEQ ID NO: 97951 - DNA, 15 bp, Homo sapiens
caattcttaacatgg

SEQ ID NO: 97952 - DNA, 15 bp, Homo sapiens
acaattcttaacatg

SEQ ID NO: 97953 - DNA, 15 bp, Homo sapiens
gacaattcttaacat

SEQ ID NO: 97954 - DNA, 15 bp, Homo sapiens
agacaattcttaaca

SEQ ID NO: 97955 - DNA, 15 bp, Homo sapiens
gagacaattcttaac

SEQ ID NO: 97956 - DNA, 15 bp, Homo sapiens
tgagacaattcttaa

SEQ ID NO: 97957 - DNA, 15 bp, Homo sapiens
atgagacaattctta

SEQ ID NO: 97958 - DNA, 15 bp, Homo sapiens
aatgagacaattctt

SEQ ID NO: 97959 - DNA, 15 bp, Homo sapiens
aaatgagacaattct

SEQ ID NO: 97960 - DNA, 15 bp, Homo sapiens
taaatgagacaattc

SEQ ID NO: 97961 - DNA, 15 bp, Homo sapiens
ataaatgagacaatt

SEQ ID NO: 97962 - DNA, 15 bp, Homo sapiens
aataaatgagacaat

SEQ ID NO: 97963 - DNA, 15 bp, Homo sapiens
caataaatgagacaa

SEQ ID NO: 97964 - DNA, 15 bp, Homo sapiens
acaataaatgagaca

SEQ ID NO: 97965 - DNA, 15 bp, Homo sapiens
gacaataaatgagac

SEQ ID NO: 97966 - DNA, 15 bp, Homo sapiens
agacaataaatgaga

SEQ ID NO: 97967 - DNA, 15 bp, Homo sapiens
aagacaataaatgag

SEQ ID NO: 97968 - DNA, 15 bp, Homo sapiens
aaagacaataaatga

SEQ ID NO: 97969 - DNA, 15 bp, Homo sapiens
gaaagacaataaatg

SEQ ID NO: 97970 - DNA, 15 bp, Homo sapiens
agaaagacaataaat

SEQ ID NO: 97971 - DNA, 15 bp, Homo sapiens
aagaaagacaataaa

SEQ ID NO: 97972 - DNA, 15 bp, Homo sapiens
aaagaaagacaataa

SEQ ID NO: 97973 - DNA, 15 bp, Homo sapiens
taaagaaagacaata

SEQ ID NO: 97974 - DNA, 15 bp, Homo sapiens
gtaaagaaagacaat

SEQ ID NO: 97975 - DNA, 15 bp, Homo sapiens
tgtaaagaaagacaa

SEQ ID NO: 97976 - DNA, 15 bp, Homo sapiens
gtgtaaagaaagaca

SEQ ID NO: 97977 - DNA, 15 bp, Homo sapiens
agtgtaaagaaagac

SEQ ID NO: 97978 - DNA, 15 bp, Homo sapiens
tagtgtaaagaaaga

SEQ ID NO: 97979 - DNA, 15 bp, Homo sapiens
atagtgtaaagaaag

SEQ ID NO: 97980 - DNA, 15 bp, Homo sapiens
aatagtgtaaagaaa

SEQ ID NO: 97981 - DNA, 15 bp, Homo sapiens
caatagtgtaaagaa

SEQ ID NO: 97982 - DNA, 15 bp, Homo sapiens
ccaatagtgtaaaga

SEQ ID NO: 97983 - DNA, 15 bp, Homo sapiens
gccaatagtgtaaag

SEQ ID NO: 97984 - DNA, 15 bp, Homo sapiens
tgccaatagtgtaaa

SEQ ID NO: 97985 - DNA, 15 bp, Homo sapiens
atgccaatagtgtaa

SEQ ID NO: 97986 - DNA, 15 bp, Homo sapiens
aatgccaatagtgta

SEQ ID NO: 97987 - DNA, 15 bp, Homo sapiens
caatgccaatagtgt

SEQ ID NO: 97988 - DNA, 15 bp, Homo sapiens
acaatgccaatagtg

SEQ ID NO: 97989 - DNA, 15 bp, Homo sapiens
tacaatgccaatagt

SEQ ID NO: 97990 - DNA, 15 bp, Homo sapiens
ctacaatgccaatag

SEQ ID NO: 97991 - DNA, 15 bp, Homo sapiens
actacaatgccaata

SEQ ID NO: 97992 - DNA, 15 bp, Homo sapiens
aactacaatgccaat

SEQ ID NO: 97993 - DNA, 15 bp, Homo sapiens
gaactacaatgccaa

SEQ ID NO: 97994 - DNA, 15 bp, Homo sapiens
agaactacaatgcca

SEQ ID NO: 97995 - DNA, 15 bp, Homo sapiens
cagaactacaatgcc

SEQ ID NO: 97996 - DNA, 15 bp, Homo sapiens
acagaactacaatgc

SEQ ID NO: 97997 - DNA, 15 bp, Homo sapiens
cacagaactacaatg

SEQ ID NO: 97998 - DNA, 15 bp, Homo sapiens
ccacagaactacaat

SEQ ID NO: 97999 - DNA, 15 bp, Homo sapiens
tccacagaactacaa

SEQ ID NO: 98000 - DNA, 15 bp, Homo sapiens
atccacagaactaca

SEQ ID NO: 98001 - DNA, 15 bp, Homo sapiens
aatccacagaactac

SEQ ID NO: 98002 - DNA, 15 bp, Homo sapiens
aaatccacagaacta

SEQ ID NO: 98003 - DNA, 15 bp, Homo sapiens
aaaatccacagaact

SEQ ID NO: 98004 - DNA, 15 bp, Homo sapiens
taaaatccacagaac

SEQ ID NO: 98005 - DNA, 15 bp, Homo sapiens
ttaaaatccacagaa

SEQ ID NO: 98006 - DNA, 15 bp, Homo sapiens
tttaaaatccacaga

SEQ ID NO: 98007 - DNA, 15 bp, Homo sapiens
ttttaaaatccacag

SEQ ID NO: 98008 - DNA, 15 bp, Homo sapiens
cttttaaaatccaca

SEQ ID NO: 98009 - DNA, 15 bp, Homo sapiens
acttttaaaatccac

SEQ ID NO: 98010 - DNA, 15 bp, Homo sapiens
aacttttaaaatcca

SEQ ID NO: 98011 - DNA, 15 bp, Homo sapiens
caacttttaaaatcc

SEQ ID NO: 98012 - DNA, 15 bp, Homo sapiens
gcaacttttaaaatc

SEQ ID NO: 98013 - DNA, 15 bp, Homo sapiens
agcaacttttaaaat

SEQ ID NO: 98014 - DNA, 15 bp, Homo sapiens
tagcaacttttaaaa

SEQ ID NO: 98015 - DNA, 15 bp, Homo sapiens
atagcaacttttaaa

SEQ ID NO: 98016 - DNA, 15 bp, Homo sapiens
tatagcaacttttaa

SEQ ID NO: 98017 - DNA, 15 bp, Homo sapiens
ctatagcaactttta

SEQ ID NO: 98018 - DNA, 15 bp, Homo sapiens
tctatagcaactttt

SEQ ID NO: 98019 - DNA, 15 bp, Homo sapiens
atctatagcaacttt

SEQ ID NO: 98020 - DNA, 15 bp, Homo sapiens
catctatagcaactt

SEQ ID NO: 98021 - DNA, 15 bp, Homo sapiens
tcatctatagcaact

SEQ ID NO: 98022 - DNA, 15 bp, Homo sapiens
ctcatctatagcaac

SEQ ID NO: 98023 - DNA, 15 bp, Homo sapiens
tctcatctatagcaa

SEQ ID NO: 98024 - DNA, 15 bp, Homo sapiens
atctcatctatagca

SEQ ID NO: 98025 - DNA, 15 bp, Homo sapiens
aatctcatctatagc

SEQ ID NO: 98026 - DNA, 15 bp, Homo sapiens
aaatctcatctatag

SEQ ID NO: 98027 - DNA, 15 bp, Homo sapiens
caaatctcatctata

SEQ ID NO: 98028 - DNA, 15 bp, Homo sapiens
tcaaatctcatctat

SEQ ID NO: 98029 - DNA, 15 bp, Homo sapiens
ctcaaatctcatcta

SEQ ID NO: 98030 - DNA, 15 bp, Homo sapiens
tctcaaatctcatct

SEQ ID NO: 98031 - DNA, 15 bp, Homo sapiens
ttctcaaatctcatc

SEQ ID NO: 98032 - DNA, 15 bp, Homo sapiens
tttctcaaatctcat

SEQ ID NO: 98033 - DNA, 15 bp, Homo sapiens
ttttctcaaatctca

SEQ ID NO: 98034 - DNA, 15 bp, Homo sapiens
tttttctcaaatctc

SEQ ID NO: 98035 - DNA, 15 bp, Homo sapiens
atttttctcaaatct

SEQ ID NO: 98036 - DNA, 15 bp, Homo sapiens
catttttctcaaatc

SEQ ID NO: 98037 - DNA, 15 bp, Homo sapiens
tcatttttctcaaat

SEQ ID NO: 98038 - DNA, 15 bp, Homo sapiens
atcatttttctcaaa

SEQ ID NO: 98039 - DNA, 15 bp, Homo sapiens
tatcatttttctcaa

SEQ ID NO: 98040 - DNA, 15 bp, Homo sapiens
atatcatttttctca

SEQ ID NO: 98041 - DNA, 15 bp, Homo sapiens
aatatcatttttctc

SEQ ID NO: 98042 - DNA, 15 bp, Homo sapiens
aaatatcatttttct

SEQ ID NO: 98043 - DNA, 15 bp, Homo sapiens
taaatatcatttttc

SEQ ID NO: 98044 - DNA, 15 bp, Homo sapiens
ttaaatatcattttt

SEQ ID NO: 98045 - DNA, 15 bp, Homo sapiens
tttaaatatcatttt

SEQ ID NO: 98046 - DNA, 15 bp, Homo sapiens
atttaaatatcattt

SEQ ID NO: 98047 - DNA, 15 bp, Homo sapiens
tatttaaatatcatt

SEQ ID NO: 98048 - DNA, 15 bp, Homo sapiens
atatttaaatatcat

SEQ ID NO: 98049 - DNA, 15 bp, Homo sapiens
aatatttaaatatca

SEQ ID NO: 98050 - DNA, 15 bp, Homo sapiens
aaatatttaaatatc

SEQ ID NO: 98051 - DNA, 15 bp, Homo sapiens
caaatatttaaatat

SEQ ID NO: 98052 - DNA, 15 bp, Homo sapiens
tcaaatatttaaata

SEQ ID NO: 98053 - DNA, 15 bp, Homo sapiens
atcaaatatttaaat

SEQ ID NO: 98054 - DNA, 15 bp, Homo sapiens
aatcaaatatttaaa

SEQ ID NO: 98055 - DNA, 15 bp, Homo sapiens
caatcaaatatttaa

SEQ ID NO: 98056 - DNA, 15 bp, Homo sapiens
ccaatcaaatattta

SEQ ID NO: 98057 - DNA, 15 bp, Homo sapiens
cccaatcaaatattt

SEQ ID NO: 98058 - DNA, 15 bp, Homo sapiens
gcccaatcaaatatt

SEQ ID NO: 98059 - DNA, 15 bp, Homo sapiens
tgcccaatcaaatat

SEQ ID NO: 98060 - DNA, 15 bp, Homo sapiens
ttgcccaatcaaata

SEQ ID NO: 98061 - DNA, 15 bp, Homo sapiens
gttgcccaatcaaat

SEQ ID NO: 98062 - DNA, 15 bp, Homo sapiens
tgttgcccaatcaaa

SEQ ID NO: 98063 - DNA, 15 bp, Homo sapiens
atgttgcccaatcaa

SEQ ID NO: 98064 - DNA, 15 bp, Homo sapiens
aatgttgcccaatca

SEQ ID NO: 98065 - DNA, 15 bp, Homo sapiens
aaatgttgcccaatc

SEQ ID NO: 98066 - DNA, 15 bp, Homo sapiens
aaaatgttgcccaat

SEQ ID NO: 98067 - DNA, 15 bp, Homo sapiens
taaaatgttgcccaa

SEQ ID NO: 98068 - DNA, 15 bp, Homo sapiens
ataaaatgttgccca

SEQ ID NO: 98069 - DNA, 15 bp, Homo sapiens
aataaaatgttgccc

SEQ ID NO: 98070 - DNA, 15 bp, Homo sapiens
aaataaaatgttgcc

SEQ ID NO: 98071 - DNA, 15 bp, Homo sapiens
taaataaaatgttgc

SEQ ID NO: 98072 - DNA, 15 bp, Homo sapiens
ataaataaaatgttg

SEQ ID NO: 98073 - DNA, 15 bp, Homo sapiens
aataaataaaatgtt

SEQ ID NO: 98074 - DNA, 15 bp, Homo sapiens
aaataaataaaatgt

SEQ ID NO: 98075 - DNA, 15 bp, Homo sapiens
aaaataaataaaatg

SEQ ID NO: 98076 - DNA, 15 bp, Homo sapiens
aaaaataaataaaat

SEQ ID NO: 98077 - DNA, 15 bp, Homo sapiens
taaaaataaataaaa

SEQ ID NO: 98078 - DNA, 15 bp, Homo sapiens
ataaaaataaataaa

SEQ ID NO: 98079 - DNA, 15 bp, Homo sapiens
aataaaaataaataa

SEQ ID NO: 98080 - DNA, 15 bp, Homo sapiens
gaataaaaataaata

SEQ ID NO: 98081 - DNA, 15 bp, Homo sapiens
agaataaaaataaat

SEQ ID NO: 98082 - DNA, 15 bp, Homo sapiens
aagaataaaaataaa

SEQ ID NO: 98083 - DNA, 15 bp, Homo sapiens
aaagaataaaaataa

SEQ ID NO: 98084 - DNA, 15 bp, Homo sapiens
gaaagaataaaaata

SEQ ID NO: 98085 - DNA, 15 bp, Homo sapiens
tgaaagaataaaaat

SEQ ID NO: 98086 - DNA, 15 bp, Homo sapiens
ttgaaagaataaaaa

SEQ ID NO: 98087 - DNA, 15 bp, Homo sapiens
tttgaaagaataaaa

SEQ ID NO: 98088 - DNA, 15 bp, Homo sapiens
gtttgaaagaataaa

SEQ ID NO: 98089 - DNA, 15 bp, Homo sapiens
tgtttgaaagaataa

SEQ ID NO: 98090 - DNA, 15 bp, Homo sapiens
ctgtttgaaagaata

SEQ ID NO: 98091 - DNA, 15 bp, Homo sapiens
gctgtttgaaagaat

SEQ ID NO: 98092 - DNA, 15 bp, Homo sapiens
ggctgtttgaaagaa

SEQ ID NO: 98093 - DNA, 15 bp, Homo sapiens
tggctgtttgaaaga

SEQ ID NO: 98094 - DNA, 15 bp, Homo sapiens
atggctgtttgaaag

SEQ ID NO: 98095 - DNA, 15 bp, Homo sapiens
aatggctgtttgaaa

SEQ ID NO: 98096 - DNA, 15 bp, Homo sapiens
taatggctgtttgaa

SEQ ID NO: 98097 - DNA, 15 bp, Homo sapiens
ctaatggctgtttga

SEQ ID NO: 98098 - DNA, 15 bp, Homo sapiens
cctaatggctgtttg

SEQ ID NO: 98099 - DNA, 15 bp, Homo sapiens
tcctaatggctgttt

SEQ ID NO: 98100 - DNA, 15 bp, Homo sapiens
gtcctaatggctgtt

SEQ ID NO: 98101 - DNA, 15 bp, Homo sapiens
agtcctaatggctgt

SEQ ID NO: 98102 - DNA, 15 bp, Homo sapiens
aagtcctaatggctg

SEQ ID NO: 98103 - DNA, 15 bp, Homo sapiens
taagtcctaatggct

SEQ ID NO: 98104 - DNA, 15 bp, Homo sapiens
gtaagtcctaatggc

SEQ ID NO: 98105 - DNA, 15 bp, Homo sapiens
tgtaagtcctaatgg

SEQ ID NO: 98106 - DNA, 15 bp, Homo sapiens
ttgtaagtcctaatg

SEQ ID NO: 98107 - DNA, 15 bp, Homo sapiens
tttgtaagtcctaat

SEQ ID NO: 98108 - DNA, 15 bp, Homo sapiens
ttttgtaagtcctaa

SEQ ID NO: 98109 - DNA, 15 bp, Homo sapiens
gttttgtaagtccta

SEQ ID NO: 98110 - DNA, 15 bp, Homo sapiens
ggttttgtaagtcct

SEQ ID NO: 98111 - DNA, 15 bp, Homo sapiens
tggttttgtaagtcc

SEQ ID NO: 98112 - DNA, 15 bp, Homo sapiens
gtggttttgtaagtc

SEQ ID NO: 98113 - DNA, 15 bp, Homo sapiens
agtggttttgtaagt

SEQ ID NO: 98114 - DNA, 15 bp, Homo sapiens
tagtggttttgtaag

SEQ ID NO: 98115 - DNA, 15 bp, Homo sapiens
gtagtggttttgtaa

SEQ ID NO: 98116 - DNA, 15 bp, Homo sapiens
tgtagtggttttgta

SEQ ID NO: 98117 - DNA, 15 bp, Homo sapiens
gtgtagtggttttgt

SEQ ID NO: 98118 - DNA, 15 bp, Homo sapiens
agtgtagtggttttg

SEQ ID NO: 98119 - DNA, 15 bp, Homo sapiens
aagtgtagtggtttt

SEQ ID NO: 98120 - DNA, 15 bp, Homo sapiens
taagtgtagtggttt

SEQ ID NO: 98121 - DNA, 15 bp, Homo sapiens
ttaagtgtagtggtt

SEQ ID NO: 98122 - DNA, 15 bp, Homo sapiens
attaagtgtagtggt

SEQ ID NO: 98123 - DNA, 15 bp, Homo sapiens
aattaagtgtagtgg

SEQ ID NO: 98124 - DNA, 15 bp, Homo sapiens
taattaagtgtagtg

SEQ ID NO: 98125 - DNA, 15 bp, Homo sapiens
gtaattaagtgtagt

SEQ ID NO: 98126 - DNA, 15 bp, Homo sapiens
agtaattaagtgtag

SEQ ID NO: 98127 - DNA, 15 bp, Homo sapiens
aagtaattaagtgta

SEQ ID NO: 98128 - DNA, 15 bp, Homo sapiens
aaagtaattaagtgt

SEQ ID NO: 98129 - DNA, 15 bp, Homo sapiens
gaaagtaattaagtg

SEQ ID NO: 98130 - DNA, 15 bp, Homo sapiens
ggaaagtaattaagt

SEQ ID NO: 98131 - DNA, 15 bp, Homo sapiens
gggaaagtaattaag

SEQ ID NO: 98132 - DNA, 15 bp, Homo sapiens
ggggaaagtaattaa

SEQ ID NO: 98133 - DNA, 15 bp, Homo sapiens
gggggaaagtaatta

SEQ ID NO: 98134 - DNA, 15 bp, Homo sapiens
tgggggaaagtaatt

SEQ ID NO: 98135 - DNA, 15 bp, Homo sapiens
ttgggggaaagtaat

SEQ ID NO: 98136 - DNA, 15 bp, Homo sapiens
attgggggaaagtaa

SEQ ID NO: 98137 - DNA, 15 bp, Homo sapiens
gattgggggaaagta

SEQ ID NO: 98138 - DNA, 15 bp, Homo sapiens
agattgggggaaagt

SEQ ID NO: 98139 - DNA, 15 bp, Homo sapiens
tagattgggggaaag

SEQ ID NO: 98140 - DNA, 15 bp, Homo sapiens
ttagattgggggaaa

SEQ ID NO: 98141 - DNA, 15 bp, Homo sapiens
cttagattgggggaa

SEQ ID NO: 98142 - DNA, 15 bp, Homo sapiens
ccttagattggggga

SEQ ID NO: 98143 - DNA, 15 bp, Homo sapiens
tccttagattggggg

SEQ ID NO: 98144 - DNA, 15 bp, Homo sapiens
ttccttagattgggg

SEQ ID NO: 98145 - DNA, 15 bp, Homo sapiens
cttccttagattggg

SEQ ID NO: 98146 - DNA, 15 bp, Homo sapiens
acttccttagattgg

SEQ ID NO: 98147 - DNA, 15 bp, Homo sapiens
aacttccttagattg

SEQ ID NO: 98148 - DNA, 15 bp, Homo sapiens
gaacttccttagatt

SEQ ID NO: 98149 - DNA, 15 bp, Homo sapiens
tgaacttccttagat

SEQ ID NO: 98150 - DNA, 15 bp, Homo sapiens
ttgaacttccttaga

SEQ ID NO: 98151 - DNA, 15 bp, Homo sapiens
tttgaacttccttag

SEQ ID NO: 98152 - DNA, 15 bp, Homo sapiens
ttttgaacttcctta

SEQ ID NO: 98153 - DNA, 15 bp, Homo sapiens
gttttgaacttcctt

SEQ ID NO: 98154 - DNA, 15 bp, Homo sapiens
ggttttgaacttcct

SEQ ID NO: 98155 - DNA, 15 bp, Homo sapiens
tggttttgaacttcc

SEQ ID NO: 98156 - DNA, 15 bp, Homo sapiens
atggttttgaacttc

SEQ ID NO: 98157 - DNA, 15 bp, Homo sapiens
aatggttttgaactt

SEQ ID NO: 98158 - DNA, 15 bp, Homo sapiens
taatggttttgaact

SEQ ID NO: 98159 - DNA, 15 bp, Homo sapiens
ttaatggttttgaac

SEQ ID NO: 98160 - DNA, 15 bp, Homo sapiens
cttaatggttttgaa

SEQ ID NO: 98161 - DNA, 15 bp, Homo sapiens
acttaatggttttga

SEQ ID NO: 98162 - DNA, 15 bp, Homo sapiens
tacttaatggttttg

SEQ ID NO: 98163 - DNA, 15 bp, Homo sapiens
ctacttaatggtttt

SEQ ID NO: 98164 - DNA, 15 bp, Homo sapiens
actacttaatggttt

SEQ ID NO: 98165 - DNA, 15 bp, Homo sapiens
tactacttaatggtt

SEQ ID NO: 98166 - DNA, 15 bp, Homo sapiens
ctactacttaatggt

SEQ ID NO: 98167 - DNA, 15 bp, Homo sapiens
tctactacttaatgg

SEQ ID NO: 98168 - DNA, 15 bp, Homo sapiens
ctctactacttaatg

SEQ ID NO: 98169 - DNA, 15 bp, Homo sapiens
tctctactacttaat

SEQ ID NO: 98170 - DNA, 15 bp, Homo sapiens
ttctctactacttaa

SEQ ID NO: 98171 - DNA, 15 bp, Homo sapiens
tttctctactactta

SEQ ID NO: 98172 - DNA, 15 bp, Homo sapiens
ttttctctactactt

SEQ ID NO: 98173 - DNA, 15 bp, Homo sapiens
cttttctctactact

SEQ ID NO: 98174 - DNA, 15 bp, Homo sapiens
acttttctctactac

SEQ ID NO: 98175 - DNA, 15 bp, Homo sapiens
tacttttctctacta

SEQ ID NO: 98176 - DNA, 15 bp, Homo sapiens
ttacttttctctact

SEQ ID NO: 98177 - DNA, 15 bp, Homo sapiens
tttacttttctctac

SEQ ID NO: 98178 - DNA, 15 bp, Homo sapiens
ctttacttttctcta

SEQ ID NO: 98179 - DNA, 15 bp, Homo sapiens
cctttacttttctct

SEQ ID NO: 98180 - DNA, 15 bp, Homo sapiens
ccctttacttttctc

SEQ ID NO: 98181 - DNA, 15 bp, Homo sapiens
cccctttacttttct

SEQ ID NO: 98182 - DNA, 15 bp, Homo sapiens
tcccctttacttttc

SEQ ID NO: 98183 - DNA, 15 bp, Homo sapiens
ttcccctttactttt

SEQ ID NO: 98184 - DNA, 15 bp, Homo sapiens
tttcccctttacttt

SEQ ID NO: 98185 - DNA, 15 bp, Homo sapiens
ctttcccctttactt

SEQ ID NO: 98186 - DNA, 15 bp, Homo sapiens
actttcccctttact

SEQ ID NO: 98187 - DNA, 15 bp, Homo sapiens
cactttcccctttac

SEQ ID NO: 98188 - DNA, 15 bp, Homo sapiens
tcactttccccttta

SEQ ID NO: 98189 - DNA, 15 bp, Homo sapiens
ttcactttccccttt

SEQ ID NO: 98190 - DNA, 15 bp, Homo sapiens
tttcactttcccctt

SEQ ID NO: 98191 - DNA, 15 bp, Homo sapiens
ctttcactttcccct

SEQ ID NO: 98192 - DNA, 15 bp, Homo sapiens
tctttcactttcccc

SEQ ID NO: 98193 - DNA, 15 bp, Homo sapiens
gtctttcactttccc

SEQ ID NO: 98194 - DNA, 15 bp, Homo sapiens
agtctttcactttcc

SEQ ID NO: 98195 - DNA, 15 bp, Homo sapiens
cagtctttcactttc

SEQ ID NO: 98196 - DNA, 15 bp, Homo sapiens
acagtctttcacttt

SEQ ID NO: 98197 - DNA, 15 bp, Homo sapiens
aacagtctttcactt

SEQ ID NO: 98198 - DNA, 15 bp, Homo sapiens
aaacagtctttcact

SEQ ID NO: 98199 - DNA, 15 bp, Homo sapiens
aaaacagtctttcac

SEQ ID NO: 98200 - DNA, 15 bp, Homo sapiens
taaaacagtctttca

SEQ ID NO: 98201 - DNA, 15 bp, Homo sapiens
ataaaacagtctttc

SEQ ID NO: 98202 - DNA, 15 bp, Homo sapiens
aataaaacagtcttt

SEQ ID NO: 98203 - DNA, 15 bp, Homo sapiens
aaataaaacagtctt

SEQ ID NO: 98204 - DNA, 15 bp, Homo sapiens
caaataaaacagtct

SEQ ID NO: 98205 - DNA, 15 bp, Homo sapiens
acaaataaaacagtc

SEQ ID NO: 98206 - DNA, 15 bp, Homo sapiens
tacaaataaaacagt

SEQ ID NO: 98207 - DNA, 15 bp, Homo sapiens
atacaaataaaacag

SEQ ID NO: 98208 - DNA, 15 bp, Homo sapiens
aatacaaataaaaca

SEQ ID NO: 98209 - DNA, 15 bp, Homo sapiens
aaatacaaataaaac

SEQ ID NO: 98210 - DNA, 15 bp, Homo sapiens
taaatacaaataaaa

SEQ ID NO: 98211 - DNA, 15 bp, Homo sapiens
ataaatacaaataaa

SEQ ID NO: 98212 - DNA, 15 bp, Homo sapiens
aataaatacaaataa

SEQ ID NO: 98213 - DNA, 15 bp, Homo sapiens
caataaatacaaata

SEQ ID NO: 98214 - DNA, 15 bp, Homo sapiens
gcaataaatacaaat

SEQ ID NO: 98215 - DNA, 15 bp, Homo sapiens
ggcaataaatacaaa

SEQ ID NO: 98216 - DNA, 15 bp, Homo sapiens
tggcaataaatacaa

SEQ ID NO: 98217 - DNA, 15 bp, Homo sapiens
atggcaataaataca

SEQ ID NO: 98218 - DNA, 15 bp, Homo sapiens
aatggcaataaatac

SEQ ID NO: 98219 - DNA, 15 bp, Homo sapiens
taatggcaataaata

SEQ ID NO: 98220 - DNA, 15 bp, Homo sapiens
ttaatggcaataaat

SEQ ID NO: 98221 - DNA, 15 bp, Homo sapiens
tttaatggcaataaa

SEQ ID NO: 98222 - DNA, 15 bp, Homo sapiens
ttttaatggcaataa

SEQ ID NO: 98223 - DNA, 15 bp, Homo sapiens
cttttaatggcaata

SEQ ID NO: 98224 - DNA, 15 bp, Homo sapiens
acttttaatggcaat

SEQ ID NO: 98225 - DNA, 15 bp, Homo sapiens
tacttttaatggcaa

SEQ ID NO: 98226 - DNA, 15 bp, Homo sapiens
ttacttttaatggca

SEQ ID NO: 98227 - DNA, 15 bp, Homo sapiens
attacttttaatggc

SEQ ID NO: 98228 - DNA, 15 bp, Homo sapiens
cattacttttaatgg

SEQ ID NO: 98229 - DNA, 15 bp, Homo sapiens
ccattacttttaatg

SEQ ID NO: 98230 - DNA, 15 bp, Homo sapiens
gccattacttttaat

SEQ ID NO: 98231 - DNA, 15 bp, Homo sapiens
tgccattacttttaa

SEQ ID NO: 98232 - DNA, 15 bp, Homo sapiens
atgccattactttta

SEQ ID NO: 98233 - DNA, 15 bp, Homo sapiens
tatgccattactttt

SEQ ID NO: 98234 - DNA, 15 bp, Homo sapiens
ttatgccattacttt

SEQ ID NO: 98235 - DNA, 15 bp, Homo sapiens
tttatgccattactt

SEQ ID NO: 98236 - DNA, 15 bp, Homo sapiens
gtttatgccattact

SEQ ID NO: 98237 - DNA, 15 bp, Homo sapiens
agtttatgccattac

SEQ ID NO: 98238 - DNA, 15 bp, Homo sapiens
cagtttatgccatta

SEQ ID NO: 98239 - DNA, 15 bp, Homo sapiens
gcagtttatgccatt

SEQ ID NO: 98240 - DNA, 15 bp, Homo sapiens
tgcagtttatgccat

SEQ ID NO: 98241 - DNA, 15 bp, Homo sapiens
ttgcagtttatgcca

SEQ ID NO: 98242 - DNA, 15 bp, Homo sapiens
attgcagtttatgcc

SEQ ID NO: 98243 - DNA, 15 bp, Homo sapiens
aattgcagtttatgc

SEQ ID NO: 98244 - DNA, 15 bp, Homo sapiens
taattgcagtttatg

SEQ ID NO: 98245 - DNA, 15 bp, Homo sapiens
gtaattgcagtttat

SEQ ID NO: 98246 - DNA, 15 bp, Homo sapiens
agtaattgcagttta

SEQ ID NO: 98247 - DNA, 15 bp, Homo sapiens
aagtaattgcagttt

SEQ ID NO: 98248 - DNA, 15 bp, Homo sapiens
aaagtaattgcagtt

SEQ ID NO: 98249 - DNA, 15 bp, Homo sapiens
aaaagtaattgcagt

SEQ ID NO: 98250 - DNA, 15 bp, Homo sapiens
caaaagtaattgcag

SEQ ID NO: 98251 - DNA, 15 bp, Homo sapiens
gcaaaagtaattgca

SEQ ID NO: 98252 - DNA, 15 bp, Homo sapiens
tgcaaaagtaattgc

SEQ ID NO: 98253 - DNA, 15 bp, Homo sapiens
gtgcaaaagtaattg

SEQ ID NO: 98254 - DNA, 15 bp, Homo sapiens
ggtgcaaaagtaatt

SEQ ID NO: 98255 - DNA, 15 bp, Homo sapiens
tggtgcaaaagtaat

SEQ ID NO: 98256 - DNA, 15 bp, Homo sapiens
ttggtgcaaaagtaa

SEQ ID NO: 98257 - DNA, 15 bp, Homo sapiens
gttggtgcaaaagta

SEQ ID NO: 98258 - DNA, 15 bp, Homo sapiens
ggttggtgcaaaagt

SEQ ID NO: 98259 - DNA, 15 bp, Homo sapiens
aggttggtgcaaaag

SEQ ID NO: 98260 - DNA, 15 bp, Homo sapiens
caggttggtgcaaaa

SEQ ID NO: 98261 - DNA, 15 bp, Homo sapiens
tcaggttggtgcaaa

SEQ ID NO: 98262 - DNA, 15 bp, Homo sapiens
atcaggttggtgcaa

SEQ ID NO: 98263 - DNA, 15 bp, Homo sapiens
tatcaggttggtgca

SEQ ID NO: 98264 - DNA, 15 bp, Homo sapiens
ctatcaggttggtgc

SEQ ID NO: 98265 - DNA, 15 bp, Homo sapiens
cctatcaggttggtg

SEQ ID NO: 98266 - DNA, 15 bp, Homo sapiens
acctatcaggttggt

SEQ ID NO: 98267 - DNA, 15 bp, Homo sapiens
aacctatcaggttgg

SEQ ID NO: 98268 - DNA, 15 bp, Homo sapiens
caacctatcaggttg

SEQ ID NO: 98269 - DNA, 15 bp, Homo sapiens
tcaacctatcaggtt

SEQ ID NO: 98270 - DNA, 15 bp, Homo sapiens
atcaacctatcaggt

SEQ ID NO: 98271 - DNA, 15 bp, Homo sapiens
aatcaacctatcagg

SEQ ID NO: 98272 - DNA, 15 bp, Homo sapiens
aaatcaacctatcag

SEQ ID NO: 98273 - DNA, 15 bp, Homo sapiens
aaaatcaacctatca

SEQ ID NO: 98274 - DNA, 15 bp, Homo sapiens
gaaaatcaacctatc

SEQ ID NO: 98275 - DNA, 15 bp, Homo sapiens
ggaaaatcaacctat

SEQ ID NO: 98276 - DNA, 15 bp, Homo sapiens
aggaaaatcaaccta

SEQ ID NO: 98277 - DNA, 15 bp, Homo sapiens
caggaaaatcaacct

SEQ ID NO: 98278 - DNA, 15 bp, Homo sapiens
tcaggaaaatcaacc

SEQ ID NO: 98279 - DNA, 15 bp, Homo sapiens
ttcaggaaaatcaac

SEQ ID NO: 98280 - DNA, 15 bp, Homo sapiens
attcaggaaaatcaa

SEQ ID NO: 98281 - DNA, 15 bp, Homo sapiens
cattcaggaaaatca

SEQ ID NO: 98282 - DNA, 15 bp, Homo sapiens
acattcaggaaaatc

SEQ ID NO: 98283 - DNA, 15 bp, Homo sapiens
gacattcaggaaaat

SEQ ID NO: 98284 - DNA, 15 bp, Homo sapiens
tgacattcaggaaaa

SEQ ID NO: 98285 - DNA, 15 bp, Homo sapiens
ctgacattcaggaaa

SEQ ID NO: 98286 - DNA, 15 bp, Homo sapiens
tctgacattcaggaa

SEQ ID NO: 98287 - DNA, 15 bp, Homo sapiens
atctgacattcagga

SEQ ID NO: 98288 - DNA, 15 bp, Homo sapiens
aatctgacattcagg

SEQ ID NO: 98289 - DNA, 15 bp, Homo sapiens
caatctgacattcag

SEQ ID NO: 98290 - DNA, 15 bp, Homo sapiens
acaatctgacattca

SEQ ID NO: 98291 - DNA, 15 bp, Homo sapiens
aacaatctgacattc

SEQ ID NO: 98292 - DNA, 15 bp, Homo sapiens
aaacaatctgacatt

SEQ ID NO: 98293 - DNA, 15 bp, Homo sapiens
taaacaatctgacat

SEQ ID NO: 98294 - DNA, 15 bp, Homo sapiens
ataaacaatctgaca

SEQ ID NO: 98295 - DNA, 15 bp, Homo sapiens
gataaacaatctgac

SEQ ID NO: 98296 - DNA, 15 bp, Homo sapiens
agataaacaatctga

SEQ ID NO: 98297 - DNA, 15 bp, Homo sapiens
aagataaacaatctg

SEQ ID NO: 98298 - DNA, 15 bp, Homo sapiens
taagataaacaatct

SEQ ID NO: 98299 - DNA, 15 bp, Homo sapiens
ctaagataaacaatc

SEQ ID NO: 98300 - DNA, 15 bp, Homo sapiens
gctaagataaacaat

SEQ ID NO: 98301 - DNA, 15 bp, Homo sapiens
tgctaagataaacaa

SEQ ID NO: 98302 - DNA, 15 bp, Homo sapiens
gtgctaagataaaca

SEQ ID NO: 98303 - DNA, 15 bp, Homo sapiens
agtgctaagataaac

SEQ ID NO: 98304 - DNA, 15 bp, Homo sapiens
cagtgctaagataaa

SEQ ID NO: 98305 - DNA, 15 bp, Homo sapiens
tcagtgctaagataa

SEQ ID NO: 98306 - DNA, 15 bp, Homo sapiens
ctcagtgctaagata

SEQ ID NO: 98307 - DNA, 15 bp, Homo sapiens
tctcagtgctaagat

SEQ ID NO: 98308 - DNA, 15 bp, Homo sapiens
ttctcagtgctaaga

SEQ ID NO: 98309 - DNA, 15 bp, Homo sapiens
tttctcagtgctaag

SEQ ID NO: 98310 - DNA, 15 bp, Homo sapiens
gtttctcagtgctaa

SEQ ID NO: 98311 - DNA, 15 bp, Homo sapiens
tgtttctcagtgcta

SEQ ID NO: 98312 - DNA, 15 bp, Homo sapiens
ctgtttctcagtgct

SEQ ID NO: 98313 - DNA, 15 bp, Homo sapiens
gctgtttctcagtgc

SEQ ID NO: 98314 - DNA, 15 bp, Homo sapiens
agctgtttctcagtg

SEQ ID NO: 98315 - DNA, 15 bp, Homo sapiens
tagctgtttctcagt

SEQ ID NO: 98316 - DNA, 15 bp, Homo sapiens
atagctgtttctcag

SEQ ID NO: 98317 - DNA, 15 bp, Homo sapiens
aatagctgtttctca

SEQ ID NO: 98318 - DNA, 15 bp, Homo sapiens
aaatagctgtttctc

SEQ ID NO: 98319 - DNA, 15 bp, Homo sapiens
gaaatagctgtttct

SEQ ID NO: 98320 - DNA, 15 bp, Homo sapiens
agaaatagctgtttc

SEQ ID NO: 98321 - DNA, 15 bp, Homo sapiens
cagaaatagctgttt

SEQ ID NO: 98322 - DNA, 15 bp, Homo sapiens
ccagaaatagctgtt

SEQ ID NO: 98323 - DNA, 15 bp, Homo sapiens
tccagaaatagctgt

SEQ ID NO: 98324 - DNA, 15 bp, Homo sapiens
atccagaaatagctg

SEQ ID NO: 98325 - DNA, 15 bp, Homo sapiens
gatccagaaatagct

SEQ ID NO: 98326 - DNA, 15 bp, Homo sapiens
tgatccagaaatagc

SEQ ID NO: 98327 - DNA, 15 bp, Homo sapiens
ctgatccagaaatag

SEQ ID NO: 98328 - DNA, 15 bp, Homo sapiens
tctgatccagaaata

SEQ ID NO: 98329 - DNA, 15 bp, Homo sapiens
atctgatccagaaat

SEQ ID NO: 98330 - DNA, 15 bp, Homo sapiens
gatctgatccagaaa

SEQ ID NO: 98331 - DNA, 15 bp, Homo sapiens
tgatctgatccagaa

SEQ ID NO: 98332 - DNA, 15 bp, Homo sapiens
atgatctgatccaga

SEQ ID NO: 98333 - DNA, 15 bp, Homo sapiens
gatgatctgatccag

SEQ ID NO: 98334 - DNA, 15 bp, Homo sapiens
agatgatctgatcca

SEQ ID NO: 98335 - DNA, 15 bp, Homo sapiens
gagatgatctgatcc

SEQ ID NO: 98336 - DNA, 15 bp, Homo sapiens
tgagatgatctgatc

SEQ ID NO: 98337 - DNA, 15 bp, Homo sapiens
ctgagatgatctgat

SEQ ID NO: 98338 - DNA, 15 bp, Homo sapiens
actgagatgatctga

SEQ ID NO: 98339 - DNA, 15 bp, Homo sapiens
gactgagatgatctg

SEQ ID NO: 98340 - DNA, 15 bp, Homo sapiens
agactgagatgatct

SEQ ID NO: 98341 - DNA, 15 bp, Homo sapiens
tagactgagatgatc

SEQ ID NO: 98342 - DNA, 15 bp, Homo sapiens
ttagactgagatgat

SEQ ID NO: 98343 - DNA, 15 bp, Homo sapiens
gttagactgagatga

SEQ ID NO: 98344 - DNA, 15 bp, Homo sapiens
agttagactgagatg

SEQ ID NO: 98345 - DNA, 15 bp, Homo sapiens
aagttagactgagat

SEQ ID NO: 98346 - DNA, 15 bp, Homo sapiens
aaagttagactgaga

SEQ ID NO: 98347 - DNA, 15 bp, Homo sapiens
taaagttagactgag

SEQ ID NO: 98348 - DNA, 15 bp, Homo sapiens
ataaagttagactga

SEQ ID NO: 98349 - DNA, 15 bp, Homo sapiens
gataaagttagactg

SEQ ID NO: 98350 - DNA, 15 bp, Homo sapiens
tgataaagttagact

SEQ ID NO: 98351 - DNA, 15 bp, Homo sapiens
atgataaagttagac

SEQ ID NO: 98352 - DNA, 15 bp, Homo sapiens
aatgataaagttaga

SEQ ID NO: 98353 - DNA, 15 bp, Homo sapiens
caatgataaagttag

SEQ ID NO: 98354 - DNA, 15 bp, Homo sapiens
tcaatgataaagtta

SEQ ID NO: 98355 - DNA, 15 bp, Homo sapiens
ttcaatgataaagtt

SEQ ID NO: 98356 - DNA, 15 bp, Homo sapiens
tttcaatgataaagt

SEQ ID NO: 98357 - DNA, 15 bp, Homo sapiens
atttcaatgataaag

SEQ ID NO: 98358 - DNA, 15 bp, Homo sapiens
catttcaatgataaa

SEQ ID NO: 98359 - DNA, 15 bp, Homo sapiens
gcatttcaatgataa

SEQ ID NO: 98360 - DNA, 15 bp, Homo sapiens
agcatttcaatgata

SEQ ID NO: 98361 - DNA, 15 bp, Homo sapiens
tagcatttcaatgat

SEQ ID NO: 98362 - DNA, 15 bp, Homo sapiens
atagcatttcaatga

SEQ ID NO: 98363 - DNA, 15 bp, Homo sapiens
aatagcatttcaatg

SEQ ID NO: 98364 - DNA, 15 bp, Homo sapiens
taatagcatttcaat

SEQ ID NO: 98365 - DNA, 15 bp, Homo sapiens
ttaatagcatttcaa

SEQ ID NO: 98366 - DNA, 15 bp, Homo sapiens
attaatagcatttca

SEQ ID NO: 98367 - DNA, 15 bp, Homo sapiens
aattaatagcatttc

SEQ ID NO: 98368 - DNA, 15 bp, Homo sapiens
taattaatagcattt

SEQ ID NO: 98369 - DNA, 15 bp, Homo sapiens
ctaattaatagcatt

SEQ ID NO: 98370 - DNA, 15 bp, Homo sapiens
gctaattaatagcat

SEQ ID NO: 98371 - DNA, 15 bp, Homo sapiens
tgctaattaatagca

SEQ ID NO: 98372 - DNA, 15 bp, Homo sapiens
ctgctaattaatagc

SEQ ID NO: 98373 - DNA, 15 bp, Homo sapiens
tctgctaattaatag

SEQ ID NO: 98374 - DNA, 15 bp, Homo sapiens
ttctgctaattaata

SEQ ID NO: 98375 - DNA, 15 bp, Homo sapiens
cttctgctaattaat

SEQ ID NO: 98376 - DNA, 15 bp, Homo sapiens
ccttctgctaattaa

SEQ ID NO: 98377 - DNA, 15 bp, Homo sapiens
tccttctgctaatta

SEQ ID NO: 98378 - DNA, 15 bp, Homo sapiens
atccttctgctaatt

SEQ ID NO: 98379 - DNA, 15 bp, Homo sapiens
tatccttctgctaat

SEQ ID NO: 98380 - DNA, 15 bp, Homo sapiens
gtatccttctgctaa

SEQ ID NO: 98381 - DNA, 15 bp, Homo sapiens
tgtatccttctgcta

SEQ ID NO: 98382 - DNA, 15 bp, Homo sapiens
atgtatccttctgct

SEQ ID NO: 98383 - DNA, 15 bp, Homo sapiens
catgtatccttctgc

SEQ ID NO: 98384 - DNA, 15 bp, Homo sapiens
acatgtatccttctg

SEQ ID NO: 98385 - DNA, 15 bp, Homo sapiens
cacatgtatccttct

SEQ ID NO: 98386 - DNA, 15 bp, Homo sapiens
gcacatgtatccttc

SEQ ID NO: 98387 - DNA, 15 bp, Homo sapiens
ggcacatgtatcctt

SEQ ID NO: 98388 - DNA, 15 bp, Homo sapiens
aggcacatgtatcct

SEQ ID NO: 98389 - DNA, 15 bp, Homo sapiens
taggcacatgtatcc

SEQ ID NO: 98390 - DNA, 15 bp, Homo sapiens
ataggcacatgtatc

SEQ ID NO: 98391 - DNA, 15 bp, Homo sapiens
cataggcacatgtat

SEQ ID NO: 98392 - DNA, 15 bp, Homo sapiens
acataggcacatgta

SEQ ID NO: 98393 - DNA, 15 bp, Homo sapiens
aacataggcacatgt

SEQ ID NO: 98394 - DNA, 15 bp, Homo sapiens
gaacataggcacatg

SEQ ID NO: 98395 - DNA, 15 bp, Homo sapiens
agaacataggcacat

SEQ ID NO: 98396 - DNA, 15 bp, Homo sapiens
tagaacataggcaca

SEQ ID NO: 98397 - DNA, 15 bp, Homo sapiens
atagaacataggcac

SEQ ID NO: 98398 - DNA, 15 bp, Homo sapiens
tatagaacataggca

SEQ ID NO: 98399 - DNA, 15 bp, Homo sapiens
ttatagaacataggc

SEQ ID NO: 98400 - DNA, 15 bp, Homo sapiens
attatagaacatagg

SEQ ID NO: 98401 - DNA, 15 bp, Homo sapiens
aattatagaacatag

SEQ ID NO: 98402 - DNA, 15 bp, Homo sapiens
aaattatagaacata

SEQ ID NO: 98403 - DNA, 15 bp, Homo sapiens
aaaattatagaacat

SEQ ID NO: 98404 - DNA, 15 bp, Homo sapiens
aaaaattatagaaca

SEQ ID NO: 98405 - DNA, 15 bp, Homo sapiens
aaaaaattatagaac

SEQ ID NO: 98406 - DNA, 15 bp, Homo sapiens
taaaaaattatagaa

SEQ ID NO: 98407 - DNA, 15 bp, Homo sapiens
ttaaaaaattataga

SEQ ID NO: 98408 - DNA, 15 bp, Homo sapiens
tttaaaaaattatag

SEQ ID NO: 98409 - DNA, 15 bp, Homo sapiens
ttttaaaaaattata

SEQ ID NO: 98410 - DNA, 15 bp, Homo sapiens
tttttaaaaaattat

SEQ ID NO: 98411 - DNA, 15 bp, Homo sapiens
ctttttaaaaaatta

SEQ ID NO: 98412 - DNA, 15 bp, Homo sapiens
gctttttaaaaaatt

SEQ ID NO: 98413 - DNA, 15 bp, Homo sapiens
agctttttaaaaaat

SEQ ID NO: 98414 - DNA, 15 bp, Homo sapiens
aagctttttaaaaaa

SEQ ID NO: 98415 - DNA, 15 bp, Homo sapiens
taagctttttaaaaa

SEQ ID NO: 98416 - DNA, 15 bp, Homo sapiens
ttaagctttttaaaa

SEQ ID NO: 98417 - DNA, 15 bp, Homo sapiens
tttaagctttttaaa

SEQ ID NO: 98418 - DNA, 15 bp, Homo sapiens
atttaagctttttaa

SEQ ID NO: 98419 - DNA, 15 bp, Homo sapiens
aatttaagcttttta

SEQ ID NO: 98420 - DNA, 15 bp, Homo sapiens
taatttaagcttttt

SEQ ID NO: 98421 - DNA, 15 bp, Homo sapiens
ataatttaagctttt

SEQ ID NO: 98422 - DNA, 15 bp, Homo sapiens
aataatttaagcttt

SEQ ID NO: 98423 - DNA, 15 bp, Homo sapiens
aaataatttaagctt

SEQ ID NO: 98424 - DNA, 15 bp, Homo sapiens
taaataatttaagct

SEQ ID NO: 98425 - DNA, 15 bp, Homo sapiens
ctaaataatttaagc

SEQ ID NO: 98426 - DNA, 15 bp, Homo sapiens
tctaaataatttaag

SEQ ID NO: 98427 - DNA, 15 bp, Homo sapiens
ctctaaataatttaa

SEQ ID NO: 98428 - DNA, 15 bp, Homo sapiens
tctctaaataattta

SEQ ID NO: 98429 - DNA, 15 bp, Homo sapiens
ttctctaaataattt

SEQ ID NO: 98430 - DNA, 15 bp, Homo sapiens
gttctctaaataatt

SEQ ID NO: 98431 - DNA, 15 bp, Homo sapiens
agttctctaaataat

SEQ ID NO: 98432 - DNA, 15 bp, Homo sapiens
aagttctctaaataa

SEQ ID NO: 98433 - DNA, 15 bp, Homo sapiens
aaagttctctaaata

SEQ ID NO: 98434 - DNA, 15 bp, Homo sapiens
aaaagttctctaaat

SEQ ID NO: 98435 - DNA, 15 bp, Homo sapiens
taaaagttctctaaa

SEQ ID NO: 98436 - DNA, 15 bp, Homo sapiens
ttaaaagttctctaa

SEQ ID NO: 98437 - DNA, 15 bp, Homo sapiens
tttaaaagttctcta

SEQ ID NO: 98438 - DNA, 15 bp, Homo sapiens
ctttaaaagttctct

SEQ ID NO: 98439 - DNA, 15 bp, Homo sapiens
tctttaaaagttctc

SEQ ID NO: 98440 - DNA, 15 bp, Homo sapiens
atctttaaaagttct

SEQ ID NO: 98441 - DNA, 15 bp, Homo sapiens
tatctttaaaagttc

SEQ ID NO: 98442 - DNA, 15 bp, Homo sapiens
gtatctttaaaagtt

SEQ ID NO: 98443 - DNA, 15 bp, Homo sapiens
agtatctttaaaagt

SEQ ID NO: 98444 - DNA, 15 bp, Homo sapiens
aagtatctttaaaag

SEQ ID NO: 98445 - DNA, 15 bp, Homo sapiens
gaagtatctttaaaa

SEQ ID NO: 98446 - DNA, 15 bp, Homo sapiens
agaagtatctttaaa

SEQ ID NO: 98447 - DNA, 15 bp, Homo sapiens
tagaagtatctttaa

SEQ ID NO: 98448 - DNA, 15 bp, Homo sapiens
gtagaagtatcttta

SEQ ID NO: 98449 - DNA, 15 bp, Homo sapiens
ggtagaagtatcttt

SEQ ID NO: 98450 - DNA, 15 bp, Homo sapiens
tggtagaagtatctt

SEQ ID NO: 98451 - DNA, 15 bp, Homo sapiens
atggtagaagtatct

SEQ ID NO: 98452 - DNA, 15 bp, Homo sapiens
tatggtagaagtatc

SEQ ID NO: 98453 - DNA, 15 bp, Homo sapiens
ctatggtagaagtat

SEQ ID NO: 98454 - DNA, 15 bp, Homo sapiens
actatggtagaagta

SEQ ID NO: 98455 - DNA, 15 bp, Homo sapiens
cactatggtagaagt

SEQ ID NO: 98456 - DNA, 15 bp, Homo sapiens
acactatggtagaag

SEQ ID NO: 98457 - DNA, 15 bp, Homo sapiens
tacactatggtagaa

SEQ ID NO: 98458 - DNA, 15 bp, Homo sapiens
gtacactatggtaga

SEQ ID NO: 98459 - DNA, 15 bp, Homo sapiens
ggtacactatggtag

SEQ ID NO: 98460 - DNA, 15 bp, Homo sapiens
aggtacactatggta

SEQ ID NO: 98461 - DNA, 15 bp, Homo sapiens
gaggtacactatggt

SEQ ID NO: 98462 - DNA, 15 bp, Homo sapiens
tgaggtacactatgg

SEQ ID NO: 98463 - DNA, 15 bp, Homo sapiens
ttgaggtacactatg

SEQ ID NO: 98464 - DNA, 15 bp, Homo sapiens
attgaggtacactat

SEQ ID NO: 98465 - DNA, 15 bp, Homo sapiens
aattgaggtacacta

SEQ ID NO: 98466 - DNA, 15 bp, Homo sapiens
aaattgaggtacact

SEQ ID NO: 98467 - DNA, 15 bp, Homo sapiens
aaaattgaggtacac

SEQ ID NO: 98468 - DNA, 15 bp, Homo sapiens
aaaaattgaggtaca

SEQ ID NO: 98469 - DNA, 15 bp, Homo sapiens
caaaaattgaggtac

SEQ ID NO: 98470 - DNA, 15 bp, Homo sapiens
acaaaaattgaggta

SEQ ID NO: 98471 - DNA, 15 bp, Homo sapiens
cacaaaaattgaggt

SEQ ID NO: 98472 - DNA, 15 bp, Homo sapiens
tcacaaaaattgagg

SEQ ID NO: 98473 - DNA, 15 bp, Homo sapiens
ttcacaaaaattgag

SEQ ID NO: 98474 - DNA, 15 bp, Homo sapiens
tttcacaaaaattga

SEQ ID NO: 98475 - DNA, 15 bp, Homo sapiens
ttttcacaaaaattg

SEQ ID NO: 98476 - DNA, 15 bp, Homo sapiens
attttcacaaaaatt

SEQ ID NO: 98477 - DNA, 15 bp, Homo sapiens
tattttcacaaaaat

SEQ ID NO: 98478 - DNA, 15 bp, Homo sapiens
atattttcacaaaaa

SEQ ID NO: 98479 - DNA, 15 bp, Homo sapiens
tatattttcacaaaa

SEQ ID NO: 98480 - DNA, 15 bp, Homo sapiens
atatattttcacaaa

SEQ ID NO: 98481 - DNA, 15 bp, Homo sapiens
aatatattttcacaa

SEQ ID NO: 98482 - DNA, 15 bp, Homo sapiens
aaatatattttcaca

SEQ ID NO: 98483 - DNA, 15 bp, Homo sapiens
taaatatattttcac

SEQ ID NO: 98484 - DNA, 15 bp, Homo sapiens
ataaatatattttca

SEQ ID NO: 98485 - DNA, 15 bp, Homo sapiens
gataaatatattttc

SEQ ID NO: 98486 - DNA, 15 bp, Homo sapiens
tgataaatatatttt

SEQ ID NO: 98487 - DNA, 15 bp, Homo sapiens
gtgataaatatattt

SEQ ID NO: 98488 - DNA, 15 bp, Homo sapiens
tgtgataaatatatt

SEQ ID NO: 98489 - DNA, 15 bp, Homo sapiens
ctgtgataaatatat

SEQ ID NO: 98490 - DNA, 15 bp, Homo sapiens
actgtgataaatata

SEQ ID NO: 98491 - DNA, 15 bp, Homo sapiens
cactgtgataaatat

SEQ ID NO: 98492 - DNA, 15 bp, Homo sapiens
acactgtgataaata

SEQ ID NO: 98493 - DNA, 15 bp, Homo sapiens
tacactgtgataaat

SEQ ID NO: 98494 - DNA, 15 bp, Homo sapiens
ttacactgtgataaa

SEQ ID NO: 98495 - DNA, 15 bp, Homo sapiens
attacactgtgataa

SEQ ID NO: 98496 - DNA, 15 bp, Homo sapiens
gattacactgtgata

SEQ ID NO: 98497 - DNA, 15 bp, Homo sapiens
agattacactgtgat

SEQ ID NO: 98498 - DNA, 15 bp, Homo sapiens
cagattacactgtga

SEQ ID NO: 98499 - DNA, 15 bp, Homo sapiens
gcagattacactgtg

SEQ ID NO: 98500 - DNA, 15 bp, Homo sapiens
agcagattacactgt

SEQ ID NO: 98501 - DNA, 15 bp, Homo sapiens
gagcagattacactg

SEQ ID NO: 98502 - DNA, 15 bp, Homo sapiens
tgagcagattacact

SEQ ID NO: 98503 - DNA, 15 bp, Homo sapiens
ctgagcagattacac

SEQ ID NO: 98504 - DNA, 15 bp, Homo sapiens
gctgagcagattaca

SEQ ID NO: 98505 - DNA, 15 bp, Homo sapiens
ggctgagcagattac

SEQ ID NO: 98506 - DNA, 15 bp, Homo sapiens
gggctgagcagatta

SEQ ID NO: 98507 - DNA, 15 bp, Homo sapiens
agggctgagcagatt

SEQ ID NO: 98508 - DNA, 15 bp, Homo sapiens
gagggctgagcagat

SEQ ID NO: 98509 - DNA, 15 bp, Homo sapiens
ggagggctgagcaga

SEQ ID NO: 98510 - DNA, 15 bp, Homo sapiens
tggagggctgagcag

SEQ ID NO: 98511 - DNA, 15 bp, Homo sapiens
ctggagggctgagca

SEQ ID NO: 98512 - DNA, 15 bp, Homo sapiens
actggagggctgagc

SEQ ID NO: 98513 - DNA, 15 bp, Homo sapiens
cactggagggctgag

SEQ ID NO: 98514 - DNA, 15 bp, Homo sapiens
tcactggagggctga

SEQ ID NO: 98515 - DNA, 15 bp, Homo sapiens
atcactggagggctg

SEQ ID NO: 98516 - DNA, 15 bp, Homo sapiens
tatcactggagggct

SEQ ID NO: 98517 - DNA, 15 bp, Homo sapiens
ttatcactggagggc

SEQ ID NO: 98518 - DNA, 15 bp, Homo sapiens
attatcactggaggg

SEQ ID NO: 98519 - DNA, 15 bp, Homo sapiens
cattatcactggagg

SEQ ID NO: 98520 - DNA, 15 bp, Homo sapiens
tcattatcactggag

SEQ ID NO: 98521 - DNA, 15 bp, Homo sapiens
ttcattatcactgga

SEQ ID NO: 98522 - DNA, 15 bp, Homo sapiens
tttcattatcactgg

SEQ ID NO: 98523 - DNA, 15 bp, Homo sapiens
ttttcattatcactg

SEQ ID NO: 98524 - DNA, 15 bp, Homo sapiens
attttcattatcact

SEQ ID NO: 98525 - DNA, 15 bp, Homo sapiens
aattttcattatcac

SEQ ID NO: 98526 - DNA, 15 bp, Homo sapiens
gaattttcattatca

SEQ ID NO: 98527 - DNA, 15 bp, Homo sapiens
tgaattttcattatc

SEQ ID NO: 98528 - DNA, 15 bp, Homo sapiens
gtgaattttcattat

SEQ ID NO: 98529 - DNA, 15 bp, Homo sapiens
agtgaattttcatta

SEQ ID NO: 98530 - DNA, 15 bp, Homo sapiens
gagtgaattttcatt

SEQ ID NO: 98531 - DNA, 15 bp, Homo sapiens
tgagtgaattttcat

SEQ ID NO: 98532 - DNA, 15 bp, Homo sapiens
gtgagtgaattttca

SEQ ID NO: 98533 - DNA, 15 bp, Homo sapiens
agtgagtgaattttc

SEQ ID NO: 98534 - DNA, 15 bp, Homo sapiens
aagtgagtgaatttt

SEQ ID NO: 98535 - DNA, 15 bp, Homo sapiens
taagtgagtgaattt

SEQ ID NO: 98536 - DNA, 15 bp, Homo sapiens
ttaagtgagtgaatt

SEQ ID NO: 98537 - DNA, 15 bp, Homo sapiens
tttaagtgagtgaat

SEQ ID NO: 98538 - DNA, 15 bp, Homo sapiens
atttaagtgagtgaa

SEQ ID NO: 98539 - DNA, 15 bp, Homo sapiens
aatttaagtgagtga

SEQ ID NO: 98540 - DNA, 15 bp, Homo sapiens
gaatttaagtgagtg

SEQ ID NO: 98541 - DNA, 15 bp, Homo sapiens
agaatttaagtgagt

SEQ ID NO: 98542 - DNA, 15 bp, Homo sapiens
cagaatttaagtgag

SEQ ID NO: 98543 - DNA, 15 bp, Homo sapiens
tcagaatttaagtga

SEQ ID NO: 98544 - DNA, 15 bp, Homo sapiens
atcagaatttaagtg

SEQ ID NO: 98545 - DNA, 15 bp, Homo sapiens
gatcagaatttaagt

SEQ ID NO: 98546 - DNA, 15 bp, Homo sapiens
agatcagaatttaag

SEQ ID NO: 98547 - DNA, 15 bp, Homo sapiens
aagatcagaatttaa

SEQ ID NO: 98548 - DNA, 15 bp, Homo sapiens
caagatcagaattta

SEQ ID NO: 98549 - DNA, 15 bp, Homo sapiens
ccaagatcagaattt

SEQ ID NO: 98550 - DNA, 15 bp, Homo sapiens
tccaagatcagaatt

SEQ ID NO: 98551 - DNA, 15 bp, Homo sapiens
gtccaagatcagaat

SEQ ID NO: 98552 - DNA, 15 bp, Homo sapiens
ggtccaagatcagaa

SEQ ID NO: 98553 - DNA, 15 bp, Homo sapiens
gggtccaagatcaga

SEQ ID NO: 98554 - DNA, 15 bp, Homo sapiens
tgggtccaagatcag

SEQ ID NO: 98555 - DNA, 15 bp, Homo sapiens
ctgggtccaagatca

SEQ ID NO: 98556 - DNA, 15 bp, Homo sapiens
tctgggtccaagatc

SEQ ID NO: 98557 - DNA, 15 bp, Homo sapiens
gtctgggtccaagat

SEQ ID NO: 98558 - DNA, 15 bp, Homo sapiens
agtctgggtccaaga

SEQ ID NO: 98559 - DNA, 15 bp, Homo sapiens
aagtctgggtccaag

SEQ ID NO: 98560 - DNA, 15 bp, Homo sapiens
aaagtctgggtccaa

SEQ ID NO: 98561 - DNA, 15 bp, Homo sapiens
caaagtctgggtcca

SEQ ID NO: 98562 - DNA, 15 bp, Homo sapiens
tcaaagtctgggtcc

SEQ ID NO: 98563 - DNA, 15 bp, Homo sapiens
ttcaaagtctgggtc

SEQ ID NO: 98564 - DNA, 15 bp, Homo sapiens
tttcaaagtctgggt

SEQ ID NO: 98565 - DNA, 15 bp, Homo sapiens
ttttcaaagtctggg

SEQ ID NO: 98566 - DNA, 15 bp, Homo sapiens
attttcaaagtctgg

SEQ ID NO: 98567 - DNA, 15 bp, Homo sapiens
tattttcaaagtctg

SEQ ID NO: 98568 - DNA, 15 bp, Homo sapiens
gtattttcaaagtct

SEQ ID NO: 98569 - DNA, 15 bp, Homo sapiens
agtattttcaaagtc

SEQ ID NO: 98570 - DNA, 15 bp, Homo sapiens
aagtattttcaaagt

SEQ ID NO: 98571 - DNA, 15 bp, Homo sapiens
gaagtattttcaaag

SEQ ID NO: 98572 - DNA, 15 bp, Homo sapiens
tgaagtattttcaaa

SEQ ID NO: 98573 - DNA, 15 bp, Homo sapiens
atgaagtattttcaa

SEQ ID NO: 98574 - DNA, 15 bp, Homo sapiens
catgaagtattttca

SEQ ID NO: 98575 - DNA, 15 bp, Homo sapiens
acatgaagtattttc

SEQ ID NO: 98576 - DNA, 15 bp, Homo sapiens
gacatgaagtatttt

SEQ ID NO: 98577 - DNA, 15 bp, Homo sapiens
tgacatgaagtattt

SEQ ID NO: 98578 - DNA, 15 bp, Homo sapiens
ctgacatgaagtatt

SEQ ID NO: 98579 - DNA, 15 bp, Homo sapiens
actgacatgaagtat

SEQ ID NO: 98580 - DNA, 15 bp, Homo sapiens
tactgacatgaagta

SEQ ID NO: 98581 - DNA, 15 bp, Homo sapiens
ttactgacatgaagt

SEQ ID NO: 98582 - DNA, 15 bp, Homo sapiens
tttactgacatgaag

SEQ ID NO: 98583 - DNA, 15 bp, Homo sapiens
gtttactgacatgaa

SEQ ID NO: 98584 - DNA, 15 bp, Homo sapiens
tgtttactgacatga

SEQ ID NO: 98585 - DNA, 15 bp, Homo sapiens
atgtttactgacatg

SEQ ID NO: 98586 - DNA, 15 bp, Homo sapiens
tatgtttactgacat

SEQ ID NO: 98587 - DNA, 15 bp, Homo sapiens
gtatgtttactgaca

SEQ ID NO: 98588 - DNA, 15 bp, Homo sapiens
agtatgtttactgac

SEQ ID NO: 98589 - DNA, 15 bp, Homo sapiens
aagtatgtttactga

SEQ ID NO: 98590 - DNA, 15 bp, Homo sapiens
aaagtatgtttactg

SEQ ID NO: 98591 - DNA, 15 bp, Homo sapiens
caaagtatgtttact

SEQ ID NO: 98592 - DNA, 15 bp, Homo sapiens
ccaaagtatgtttac

SEQ ID NO: 98593 - DNA, 15 bp, Homo sapiens
tccaaagtatgttta

SEQ ID NO: 98594 - DNA, 15 bp, Homo sapiens
atccaaagtatgttt

SEQ ID NO: 98595 - DNA, 15 bp, Homo sapiens
tatccaaagtatgtt

SEQ ID NO: 98596 - DNA, 15 bp, Homo sapiens
ttatccaaagtatgt

SEQ ID NO: 98597 - DNA, 15 bp, Homo sapiens
gttatccaaagtatg

SEQ ID NO: 98598 - DNA, 15 bp, Homo sapiens
agttatccaaagtat

SEQ ID NO: 98599 - DNA, 15 bp, Homo sapiens
aagttatccaaagta

SEQ ID NO: 98600 - DNA, 15 bp, Homo sapiens
taagttatccaaagt

SEQ ID NO: 98601 - DNA, 15 bp, Homo sapiens
gtaagttatccaaag

SEQ ID NO: 98602 - DNA, 15 bp, Homo sapiens
cgtaagttatccaaa

SEQ ID NO: 98603 - DNA, 15 bp, Homo sapiens
acgtaagttatccaa

SEQ ID NO: 98604 - DNA, 15 bp, Homo sapiens
aacgtaagttatcca

SEQ ID NO: 98605 - DNA, 15 bp, Homo sapiens
taacgtaagttatcc

SEQ ID NO: 98606 - DNA, 15 bp, Homo sapiens
ttaacgtaagttatc

SEQ ID NO: 98607 - DNA, 15 bp, Homo sapiens
gttaacgtaagttat

SEQ ID NO: 98608 - DNA, 15 bp, Homo sapiens
tgttaacgtaagtta

SEQ ID NO: 98609 - DNA, 15 bp, Homo sapiens
gtgttaacgtaagtt

SEQ ID NO: 98610 - DNA, 15 bp, Homo sapiens
agtgttaacgtaagt

SEQ ID NO: 98611 - DNA, 15 bp, Homo sapiens
cagtgttaacgtaag

SEQ ID NO: 98612 - DNA, 15 bp, Homo sapiens
gcagtgttaacgtaa

SEQ ID NO: 98613 - DNA, 15 bp, Homo sapiens
agcagtgttaacgta

SEQ ID NO: 98614 - DNA, 15 bp, Homo sapiens
cagcagtgttaacgt

SEQ ID NO: 98615 - DNA, 15 bp, Homo sapiens
acagcagtgttaacg

SEQ ID NO: 98616 - DNA, 15 bp, Homo sapiens
aacagcagtgttaac

SEQ ID NO: 98617 - DNA, 15 bp, Homo sapiens
taacagcagtgttaa

SEQ ID NO: 98618 - DNA, 15 bp, Homo sapiens
ataacagcagtgtta

SEQ ID NO: 98619 - DNA, 15 bp, Homo sapiens
cataacagcagtgtt

SEQ ID NO: 98620 - DNA, 15 bp, Homo sapiens
tcataacagcagtgt

SEQ ID NO: 98621 - DNA, 15 bp, Homo sapiens
ttcataacagcagtg

SEQ ID NO: 98622 - DNA, 15 bp, Homo sapiens
tttcataacagcagt

SEQ ID NO: 98623 - DNA, 15 bp, Homo sapiens
atttcataacagcag

SEQ ID NO: 98624 - DNA, 15 bp, Homo sapiens
catttcataacagca

SEQ ID NO: 98625 - DNA, 15 bp, Homo sapiens
tcatttcataacagc

SEQ ID NO: 98626 - DNA, 15 bp, Homo sapiens
ttcatttcataacag

SEQ ID NO: 98627 - DNA, 15 bp, Homo sapiens
tttcatttcataaca

SEQ ID NO: 98628 - DNA, 15 bp, Homo sapiens
ttttcatttcataac

SEQ ID NO: 98629 - DNA, 15 bp, Homo sapiens
gttttcatttcataa

SEQ ID NO: 98630 - DNA, 15 bp, Homo sapiens
tgttttcatttcata

SEQ ID NO: 98631 - DNA, 15 bp, Homo sapiens
atgttttcatttcat

SEQ ID NO: 98632 - DNA, 15 bp, Homo sapiens
aatgttttcatttca

SEQ ID NO: 98633 - DNA, 15 bp, Homo sapiens
aaatgttttcatttc

SEQ ID NO: 98634 - DNA, 15 bp, Homo sapiens
caaatgttttcattt

SEQ ID NO: 98635 - DNA, 15 bp, Homo sapiens
acaaatgttttcatt

SEQ ID NO: 98636 - DNA, 15 bp, Homo sapiens
cacaaatgttttcat

SEQ ID NO: 98637 - DNA, 15 bp, Homo sapiens
ccacaaatgttttca

SEQ ID NO: 98638 - DNA, 15 bp, Homo sapiens
cccacaaatgttttc

SEQ ID NO: 98639 - DNA, 15 bp, Homo sapiens
tcccacaaatgtttt

SEQ ID NO: 98640 - DNA, 15 bp, Homo sapiens
ctcccacaaatgttt

SEQ ID NO: 98641 - DNA, 15 bp, Homo sapiens
gctcccacaaatgtt

SEQ ID NO: 98642 - DNA, 15 bp, Homo sapiens
agctcccacaaatgt

SEQ ID NO: 98643 - DNA, 15 bp, Homo sapiens
cagctcccacaaatg

SEQ ID NO: 98644 - DNA, 15 bp, Homo sapiens
tcagctcccacaaat

SEQ ID NO: 98645 - DNA, 15 bp, Homo sapiens
ctcagctcccacaaa

SEQ ID NO: 98646 - DNA, 15 bp, Homo sapiens
actcagctcccacaa

SEQ ID NO: 98647 - DNA, 15 bp, Homo sapiens
tactcagctcccaca

SEQ ID NO: 98648 - DNA, 15 bp, Homo sapiens
gtactcagctcccac

SEQ ID NO: 98649 - DNA, 15 bp, Homo sapiens
tgtactcagctccca

SEQ ID NO: 98650 - DNA, 15 bp, Homo sapiens
atgtactcagctccc

SEQ ID NO: 98651 - DNA, 15 bp, Homo sapiens
aatgtactcagctcc

SEQ ID NO: 98652 - DNA, 15 bp, Homo sapiens
caatgtactcagctc

SEQ ID NO: 98653 - DNA, 15 bp, Homo sapiens
ccaatgtactcagct

SEQ ID NO: 98654 - DNA, 15 bp, Homo sapiens
tccaatgtactcagc

SEQ ID NO: 98655 - DNA, 15 bp, Homo sapiens
atccaatgtactcag

SEQ ID NO: 98656 - DNA, 15 bp, Homo sapiens
catccaatgtactca

SEQ ID NO: 98657 - DNA, 15 bp, Homo sapiens
gcatccaatgtactc

SEQ ID NO: 98658 - DNA, 15 bp, Homo sapiens
tgcatccaatgtact

SEQ ID NO: 98659 - DNA, 15 bp, Homo sapiens
atgcatccaatgtac

SEQ ID NO: 98660 - DNA, 15 bp, Homo sapiens
catgcatccaatgta

SEQ ID NO: 98661 - DNA, 15 bp, Homo sapiens
tcatgcatccaatgt

SEQ ID NO: 98662 - DNA, 15 bp, Homo sapiens
ctcatgcatccaatg

SEQ ID NO: 98663 - DNA, 15 bp, Homo sapiens
actcatgcatccaat

SEQ ID NO: 98664 - DNA, 15 bp, Homo sapiens
cactcatgcatccaa

SEQ ID NO: 98665 - DNA, 15 bp, Homo sapiens
tcactcatgcatcca

SEQ ID NO: 98666 - DNA, 15 bp, Homo sapiens
ttcactcatgcatcc

SEQ ID NO: 98667 - DNA, 15 bp, Homo sapiens
tttcactcatgcatc

SEQ ID NO: 98668 - DNA, 15 bp, Homo sapiens
atttcactcatgcat

SEQ ID NO: 98669 - DNA, 15 bp, Homo sapiens
aatttcactcatgca

SEQ ID NO: 98670 - DNA, 15 bp, Homo sapiens
aaatttcactcatgc

SEQ ID NO: 98671 - DNA, 15 bp, Homo sapiens
gaaatttcactcatg

SEQ ID NO: 98672 - DNA, 15 bp, Homo sapiens
tgaaatttcactcat

SEQ ID NO: 98673 - DNA, 15 bp, Homo sapiens
ctgaaatttcactca

SEQ ID NO: 98674 - DNA, 15 bp, Homo sapiens
tctgaaatttcactc

SEQ ID NO: 98675 - DNA, 15 bp, Homo sapiens
ctctgaaatttcact

SEQ ID NO: 98676 - DNA, 15 bp, Homo sapiens
actctgaaatttcac

SEQ ID NO: 98677 - DNA, 15 bp, Homo sapiens
aactctgaaatttca

SEQ ID NO: 98678 - DNA, 15 bp, Homo sapiens
taactctgaaatttc

SEQ ID NO: 98679 - DNA, 15 bp, Homo sapiens
ctaactctgaaattt

SEQ ID NO: 98680 - DNA, 15 bp, Homo sapiens
gctaactctgaaatt

SEQ ID NO: 98681 - DNA, 15 bp, Homo sapiens
tgctaactctgaaat

SEQ ID NO: 98682 - DNA, 15 bp, Homo sapiens
atgctaactctgaaa

SEQ ID NO: 98683 - DNA, 15 bp, Homo sapiens
aatgctaactctgaa

SEQ ID NO: 98684 - DNA, 15 bp, Homo sapiens
gaatgctaactctga

SEQ ID NO: 98685 - DNA, 15 bp, Homo sapiens
agaatgctaactctg

SEQ ID NO: 98686 - DNA, 15 bp, Homo sapiens
aagaatgctaactct

SEQ ID NO: 98687 - DNA, 15 bp, Homo sapiens
taagaatgctaactc

SEQ ID NO: 98688 - DNA, 15 bp, Homo sapiens
ataagaatgctaact

SEQ ID NO: 98689 - DNA, 15 bp, Homo sapiens
aataagaatgctaac

SEQ ID NO: 98690 - DNA, 15 bp, Homo sapiens
aaataagaatgctaa

SEQ ID NO: 98691 - DNA, 15 bp, Homo sapiens
gaaataagaatgcta

SEQ ID NO: 98692 - DNA, 15 bp, Homo sapiens
tgaaataagaatgct

SEQ ID NO: 98693 - DNA, 15 bp, Homo sapiens
ttgaaataagaatgc

SEQ ID NO: 98694 - DNA, 15 bp, Homo sapiens
tttgaaataagaatg

SEQ ID NO: 98695 - DNA, 15 bp, Homo sapiens
ttttgaaataagaat

SEQ ID NO: 98696 - DNA, 15 bp, Homo sapiens
tttttgaaataagaa

SEQ ID NO: 98697 - DNA, 15 bp, Homo sapiens
gtttttgaaataaga

SEQ ID NO: 98698 - DNA, 15 bp, Homo sapiens
cgtttttgaaataag

SEQ ID NO: 98699 - DNA, 15 bp, Homo sapiens
gcgtttttgaaataa

SEQ ID NO: 98700 - DNA, 15 bp, Homo sapiens
agcgtttttgaaata

SEQ ID NO: 98701 - DNA, 15 bp, Homo sapiens
gagcgtttttgaaat

SEQ ID NO: 98702 - DNA, 15 bp, Homo sapiens
tgagcgtttttgaaa

SEQ ID NO: 98703 - DNA, 15 bp, Homo sapiens
ttgagcgtttttgaa

SEQ ID NO: 98704 - DNA, 15 bp, Homo sapiens
gttgagcgtttttga

SEQ ID NO: 98705 - DNA, 15 bp, Homo sapiens
agttgagcgtttttg

SEQ ID NO: 98706 - DNA, 15 bp, Homo sapiens
cagttgagcgttttt

SEQ ID NO: 98707 - DNA, 15 bp, Homo sapiens
ccagttgagcgtttt

SEQ ID NO: 98708 - DNA, 15 bp, Homo sapiens
cccagttgagcgttt

SEQ ID NO: 98709 - DNA, 15 bp, Homo sapiens
gcccagttgagcgtt

SEQ ID NO: 98710 - DNA, 15 bp, Homo sapiens
agcccagttgagcgt

SEQ ID NO: 98711 - DNA, 15 bp, Homo sapiens
cagcccagttgagcg

SEQ ID NO: 98712 - DNA, 15 bp, Homo sapiens
ccagcccagttgagc

SEQ ID NO: 98713 - DNA, 15 bp, Homo sapiens
cccagcccagttgag

SEQ ID NO: 98714 - DNA, 15 bp, Homo sapiens
acccagcccagttga

SEQ ID NO: 98715 - DNA, 15 bp, Homo sapiens
cacccagcccagttg

SEQ ID NO: 98716 - DNA, 15 bp, Homo sapiens
gcacccagcccagtt

SEQ ID NO: 98717 - DNA, 15 bp, Homo sapiens
tgcacccagcccagt

SEQ ID NO: 98718 - DNA, 15 bp, Homo sapiens
ctgcacccagcccag

SEQ ID NO: 98719 - DNA, 15 bp, Homo sapiens
actgcacccagccca

SEQ ID NO: 98720 - DNA, 15 bp, Homo sapiens
cactgcacccagccc

SEQ ID NO: 98721 - DNA, 15 bp, Homo sapiens
gaggcgtgagccact

SEQ ID NO: 98722 - DNA, 15 bp, Homo sapiens
agaggcgtgagccac

SEQ ID NO: 98723 - DNA, 15 bp, Homo sapiens
tagaggcgtgagcca

SEQ ID NO: 98724 - DNA, 15 bp, Homo sapiens
ttagaggcgtgagcc

SEQ ID NO: 98725 - DNA, 15 bp, Homo sapiens
attagaggcgtgagc

SEQ ID NO: 98726 - DNA, 15 bp, Homo sapiens
gattagaggcgtgag

SEQ ID NO: 98727 - DNA, 15 bp, Homo sapiens
ggattagaggcgtga

SEQ ID NO: 98728 - DNA, 15 bp, Homo sapiens
gggattagaggcgtg

SEQ ID NO: 98729 - DNA, 15 bp, Homo sapiens
tgggattagaggcgt

SEQ ID NO: 98730 - DNA, 15 bp, Homo sapiens
ctgggattagaggcg

SEQ ID NO: 98731 - DNA, 15 bp, Homo sapiens
gctgggattagaggc

SEQ ID NO: 98732 - DNA, 15 bp, Homo sapiens
tgctgggattagagg

SEQ ID NO: 98733 - DNA, 15 bp, Homo sapiens
gtgctgggattagag

SEQ ID NO: 98734 - DNA, 15 bp, Homo sapiens
agtgctgggattaga

SEQ ID NO: 98735 - DNA, 15 bp, Homo sapiens
aagtgctgggattag

SEQ ID NO: 98736 - DNA, 15 bp, Homo sapiens
ggtgatccacccacc

SEQ ID NO: 98737 - DNA, 15 bp, Homo sapiens
aggtgatccacccac

SEQ ID NO: 98738 - DNA, 15 bp, Homo sapiens
gaggtgatccaccca

SEQ ID NO: 98739 - DNA, 15 bp, Homo sapiens
tgaggtgatccaccc

SEQ ID NO: 98740 - DNA, 15 bp, Homo sapiens
ctgaggtgatccacc

SEQ ID NO: 98741 - DNA, 15 bp, Homo sapiens
cctgaggtgatccac

SEQ ID NO: 98742 - DNA, 15 bp, Homo sapiens
acctgaggtgatcca

SEQ ID NO: 98743 - DNA, 15 bp, Homo sapiens
gacctgaggtgatcc

SEQ ID NO: 98744 - DNA, 15 bp, Homo sapiens
tgacctgaggtgatc

SEQ ID NO: 98745 - DNA, 15 bp, Homo sapiens
ctgacctgaggtgat

SEQ ID NO: 98746 - DNA, 15 bp, Homo sapiens
cctgacctgaggtga

SEQ ID NO: 98747 - DNA, 15 bp, Homo sapiens
tcctgacctgaggtg

SEQ ID NO: 98748 - DNA, 15 bp, Homo sapiens
ctcctgacctgaggt

SEQ ID NO: 98749 - DNA, 15 bp, Homo sapiens
actcctgacctgagg

SEQ ID NO: 98750 - DNA, 15 bp, Homo sapiens
aactcctgacctgag

SEQ ID NO: 98751 - DNA, 15 bp, Homo sapiens
aaactcctgacctga

SEQ ID NO: 98752 - DNA, 15 bp, Homo sapiens
caaactcctgacctg

SEQ ID NO: 98753 - DNA, 15 bp, Homo sapiens
gggctggtctcaaac

SEQ ID NO: 98754 - DNA, 15 bp, Homo sapiens
ggggctggtctcaaa

SEQ ID NO: 98755 - DNA, 15 bp, Homo sapiens
cggggctggtctcaa

SEQ ID NO: 98756 - DNA, 15 bp, Homo sapiens
gcggggctggtctca

SEQ ID NO: 98757 - DNA, 15 bp, Homo sapiens
ggcggggctggtctc

SEQ ID NO: 98758 - DNA, 15 bp, Homo sapiens
tggcggggctggtct

SEQ ID NO: 98759 - DNA, 15 bp, Homo sapiens
ttggcggggctggtc

SEQ ID NO: 98760 - DNA, 15 bp, Homo sapiens
gttggcggggctggt

SEQ ID NO: 98761 - DNA, 15 bp, Homo sapiens
tgttggcggggctgg

SEQ ID NO: 98762 - DNA, 15 bp, Homo sapiens
atgttggcggggctg

SEQ ID NO: 98763 - DNA, 15 bp, Homo sapiens
catgttggcggggct

SEQ ID NO: 98764 - DNA, 15 bp, Homo sapiens
ccatgttggcggggc

SEQ ID NO: 98765 - DNA, 15 bp, Homo sapiens
gccatgttggcgggg

SEQ ID NO: 98766 - DNA, 15 bp, Homo sapiens
cgccatgttggcggg

SEQ ID NO: 98767 - DNA, 15 bp, Homo sapiens
tcgccatgttggcgg

SEQ ID NO: 98768 - DNA, 15 bp, Homo sapiens
ttcgccatgttggcg

SEQ ID NO: 98769 - DNA, 15 bp, Homo sapiens
cttcgccatgttggc

SEQ ID NO: 98770 - DNA, 15 bp, Homo sapiens
gcttcgccatgttgg

SEQ ID NO: 98771 - DNA, 15 bp, Homo sapiens
ggcttcgccatgttg

SEQ ID NO: 98772 - DNA, 15 bp, Homo sapiens
aggcttcgccatgtt

SEQ ID NO: 98773 - DNA, 15 bp, Homo sapiens
gaggcttcgccatgt

SEQ ID NO: 98774 - DNA, 15 bp, Homo sapiens
tgaggcttcgccatg

SEQ ID NO: 98775 - DNA, 15 bp, Homo sapiens
atgaggcttcgccat

SEQ ID NO: 98776 - DNA, 15 bp, Homo sapiens
gatgaggcttcgcca

SEQ ID NO: 98777 - DNA, 15 bp, Homo sapiens
agatgaggcttcgcc

SEQ ID NO: 98778 - DNA, 15 bp, Homo sapiens
gagatgaggcttcgc

SEQ ID NO: 98779 - DNA, 15 bp, Homo sapiens
cgagatgaggcttcg

SEQ ID NO: 98780 - DNA, 15 bp, Homo sapiens
tcgagatgaggcttc

SEQ ID NO: 98781 - DNA, 15 bp, Homo sapiens
gtcgagatgaggctt

SEQ ID NO: 98782 - DNA, 15 bp, Homo sapiens
agtcgagatgaggct

SEQ ID NO: 98783 - DNA, 15 bp, Homo sapiens
tagtcgagatgaggc

SEQ ID NO: 98784 - DNA, 15 bp, Homo sapiens
ttagtcgagatgagg

SEQ ID NO: 98785 - DNA, 15 bp, Homo sapiens
tttagtcgagatgag

SEQ ID NO: 98786 - DNA, 15 bp, Homo sapiens
ttttagtcgagatga

SEQ ID NO: 98787 - DNA, 15 bp, Homo sapiens
tttttagtcgagatg

SEQ ID NO: 98788 - DNA, 15 bp, Homo sapiens
ttttttagtcgagat

SEQ ID NO: 98789 - DNA, 15 bp, Homo sapiens
attttttagtcgaga

SEQ ID NO: 98790 - DNA, 15 bp, Homo sapiens
tattttttagtcgag

SEQ ID NO: 98791 - DNA, 15 bp, Homo sapiens
atattttttagtcga

SEQ ID NO: 98792 - DNA, 15 bp, Homo sapiens
catattttttagtcg

SEQ ID NO: 98793 - DNA, 15 bp, Homo sapiens
tcatattttttagtc

SEQ ID NO: 98794 - DNA, 15 bp, Homo sapiens
ttcatattttttagt

SEQ ID NO: 98795 - DNA, 15 bp, Homo sapiens
tttcatattttttag

SEQ ID NO: 98796 - DNA, 15 bp, Homo sapiens
cctaattttcatatt

SEQ ID NO: 98797 - DNA, 15 bp, Homo sapiens
acctaattttcatat

SEQ ID NO: 98798 - DNA, 15 bp, Homo sapiens
tacctaattttcata

SEQ ID NO: 98799 - DNA, 15 bp, Homo sapiens
ctacctaattttcat

SEQ ID NO: 98800 - DNA, 15 bp, Homo sapiens
cctacctaattttca

SEQ ID NO: 98801 - DNA, 15 bp, Homo sapiens
gcctacctaattttc

SEQ ID NO: 98802 - DNA, 15 bp, Homo sapiens
tgcctacctaatttt

SEQ ID NO: 98803 - DNA, 15 bp, Homo sapiens
atgcctacctaattt

SEQ ID NO: 98804 - DNA, 15 bp, Homo sapiens
tatgcctacctaatt

SEQ ID NO: 98805 - DNA, 15 bp, Homo sapiens
ctatgcctacctaat

SEQ ID NO: 98806 - DNA, 15 bp, Homo sapiens
actatgcctacctaa

SEQ ID NO: 98807 - DNA, 15 bp, Homo sapiens
cactatgcctaccta

SEQ ID NO: 98808 - DNA, 15 bp, Homo sapiens
ccactatgcctacct

SEQ ID NO: 98809 - DNA, 15 bp, Homo sapiens
accactatgcctacc

SEQ ID NO: 98810 - DNA, 15 bp, Homo sapiens
caccactatgcctac

SEQ ID NO: 98811 - DNA, 15 bp, Homo sapiens
ccaccactatgccta

SEQ ID NO: 98812 - DNA, 15 bp, Homo sapiens
cccaccactatgcct

SEQ ID NO: 98813 - DNA, 15 bp, Homo sapiens
acccaccactatgcc

SEQ ID NO: 98814 - DNA, 15 bp, Homo sapiens
cacccaccactatgc

SEQ ID NO: 98815 - DNA, 15 bp, Homo sapiens
gcacccaccactatg

SEQ ID NO: 98816 - DNA, 15 bp, Homo sapiens
ggcacccaccactat

SEQ ID NO: 98817 - DNA, 15 bp, Homo sapiens
aggcacccaccacta

SEQ ID NO: 98818 - DNA, 15 bp, Homo sapiens
caggcacccaccact

SEQ ID NO: 98819 - DNA, 15 bp, Homo sapiens
acaggcacccaccac

SEQ ID NO: 98820 - DNA, 15 bp, Homo sapiens
tacaggcacccacca

SEQ ID NO: 98821 - DNA, 15 bp, Homo sapiens
tgattacaggcaccc

SEQ ID NO: 98822 - DNA, 15 bp, Homo sapiens
gtgattacaggcacc

SEQ ID NO: 98823 - DNA, 15 bp, Homo sapiens
tgtgattacaggcac

SEQ ID NO: 98824 - DNA, 15 bp, Homo sapiens
ctgtgattacaggca

SEQ ID NO: 98825 - DNA, 15 bp, Homo sapiens
gctgtgattacaggc

SEQ ID NO: 98826 - DNA, 15 bp, Homo sapiens
agctgtgattacagg

SEQ ID NO: 98827 - DNA, 15 bp, Homo sapiens
aagctgtgattacag

SEQ ID NO: 98828 - DNA, 15 bp, Homo sapiens
gaagctgtgattaca

SEQ ID NO: 98829 - DNA, 15 bp, Homo sapiens
agaagctgtgattac

SEQ ID NO: 98830 - DNA, 15 bp, Homo sapiens
gagaagctgtgatta

SEQ ID NO: 98831 - DNA, 15 bp, Homo sapiens
cgagaagctgtgatt

SEQ ID NO: 98832 - DNA, 15 bp, Homo sapiens
ccgagaagctgtgat

SEQ ID NO: 98833 - DNA, 15 bp, Homo sapiens
cccgagaagctgtga

SEQ ID NO: 98834 - DNA, 15 bp, Homo sapiens
tcccgagaagctgtg

SEQ ID NO: 98835 - DNA, 15 bp, Homo sapiens
ctcccgagaagctgt

SEQ ID NO: 98836 - DNA, 15 bp, Homo sapiens
cctcccgagaagctg

SEQ ID NO: 98837 - DNA, 15 bp, Homo sapiens
gcctcccgagaagct

SEQ ID NO: 98838 - DNA, 15 bp, Homo sapiens
agcctcccgagaagc

SEQ ID NO: 98839 - DNA, 15 bp, Homo sapiens
cagcctcccgagaag

SEQ ID NO: 98840 - DNA, 15 bp, Homo sapiens
tcagcctcccgagaa

SEQ ID NO: 98841 - DNA, 15 bp, Homo sapiens
ctcagcctcccgaga

SEQ ID NO: 98842 - DNA, 15 bp, Homo sapiens
aaattctcctgcctc

SEQ ID NO: 98843 - DNA, 15 bp, Homo sapiens
gaaattctcctgcct

SEQ ID NO: 98844 - DNA, 15 bp, Homo sapiens
agaaattctcctgcc

SEQ ID NO: 98845 - DNA, 15 bp, Homo sapiens
aagaaattctcctgc

SEQ ID NO: 98846 - DNA, 15 bp, Homo sapiens
caagaaattctcctg

SEQ ID NO: 98847 - DNA, 15 bp, Homo sapiens
tcaagaaattctcct

SEQ ID NO: 98848 - DNA, 15 bp, Homo sapiens
ttcaagaaattctcc

SEQ ID NO: 98849 - DNA, 15 bp, Homo sapiens
gttcaagaaattctc

SEQ ID NO: 98850 - DNA, 15 bp, Homo sapiens
agttcaagaaattct

SEQ ID NO: 98851 - DNA, 15 bp, Homo sapiens
cagttcaagaaattc

SEQ ID NO: 98852 - DNA, 15 bp, Homo sapiens
ccagttcaagaaatt

SEQ ID NO: 98853 - DNA, 15 bp, Homo sapiens
cccagttcaagaaat

SEQ ID NO: 98854 - DNA, 15 bp, Homo sapiens
tcccagttcaagaaa

SEQ ID NO: 98855 - DNA, 15 bp, Homo sapiens
ctcccagttcaagaa

SEQ ID NO: 98856 - DNA, 15 bp, Homo sapiens
cctcccagttcaaga

SEQ ID NO: 98857 - DNA, 15 bp, Homo sapiens
ttcactacaacctct

SEQ ID NO: 98858 - DNA, 15 bp, Homo sapiens
gttcactacaacctc

SEQ ID NO: 98859 - DNA, 15 bp, Homo sapiens
tgttcactacaacct

SEQ ID NO: 98860 - DNA, 15 bp, Homo sapiens
ttgttcactacaacc

SEQ ID NO: 98861 - DNA, 15 bp, Homo sapiens
cttgttcactacaac

SEQ ID NO: 98862 - DNA, 15 bp, Homo sapiens
tcttgttcactacaa

SEQ ID NO: 98863 - DNA, 15 bp, Homo sapiens
gtcttgttcactaca

SEQ ID NO: 98864 - DNA, 15 bp, Homo sapiens
agtcttgttcactac

SEQ ID NO: 98865 - DNA, 15 bp, Homo sapiens
gagtcttgttcacta

SEQ ID NO: 98866 - DNA, 15 bp, Homo sapiens
agagtcttgttcact

SEQ ID NO: 98867 - DNA, 15 bp, Homo sapiens
tagagtcttgttcac

SEQ ID NO: 98868 - DNA, 15 bp, Homo sapiens
atagagtcttgttca

SEQ ID NO: 98869 - DNA, 15 bp, Homo sapiens
gatagagtcttgttc

SEQ ID NO: 98870 - DNA, 15 bp, Homo sapiens
agatagagtcttgtt

SEQ ID NO: 98871 - DNA, 15 bp, Homo sapiens
gagatagagtcttgt

SEQ ID NO: 98872 - DNA, 15 bp, Homo sapiens
tgagatagagtcttg

SEQ ID NO: 98873 - DNA, 15 bp, Homo sapiens
ttgagatagagtctt

SEQ ID NO: 98874 - DNA, 15 bp, Homo sapiens
tttgagatagagtct

SEQ ID NO: 98875 - DNA, 15 bp, Homo sapiens
ttttgagatagagtc

SEQ ID NO: 98876 - DNA, 15 bp, Homo sapiens
tttttgagatagagt

SEQ ID NO: 98877 - DNA, 15 bp, Homo sapiens
gtttttgagatagag

SEQ ID NO: 98878 - DNA, 15 bp, Homo sapiens
tgtttttgagataga

SEQ ID NO: 98879 - DNA, 15 bp, Homo sapiens
ttgtttttgagatag

SEQ ID NO: 98880 - DNA, 15 bp, Homo sapiens
tttgtttttgagata

SEQ ID NO: 98881 - DNA, 15 bp, Homo sapiens
ttttgtttttgagat

SEQ ID NO: 98882 - DNA, 15 bp, Homo sapiens
tttttgtttttgaga

SEQ ID NO: 98883 - DNA, 15 bp, Homo sapiens
gtttttgtttttgag

SEQ ID NO: 98884 - DNA, 15 bp, Homo sapiens
tgtttttgtttttga

SEQ ID NO: 98885 - DNA, 15 bp, Homo sapiens
gtttttgtttttgtt

SEQ ID NO: 98886 - DNA, 15 bp, Homo sapiens
gttttgtttttgttt

SEQ ID NO: 98887 - DNA, 15 bp, Homo sapiens
ggttttgtttttgtt

SEQ ID NO: 98888 - DNA, 15 bp, Homo sapiens
gggttttgtttttgt

SEQ ID NO: 98889 - DNA, 15 bp, Homo sapiens
ggggttttgtttttg

SEQ ID NO: 98890 - DNA, 15 bp, Homo sapiens
tggggttttgttttt

SEQ ID NO: 98891 - DNA, 15 bp, Homo sapiens
gtggggttttgtttt

SEQ ID NO: 98892 - DNA, 15 bp, Homo sapiens
tgtggggttttgttt

SEQ ID NO: 98893 - DNA, 15 bp, Homo sapiens
ttgtggggttttgtt

SEQ ID NO: 98894 - DNA, 15 bp, Homo sapiens
tttgtggggttttgt

SEQ ID NO: 98895 - DNA, 15 bp, Homo sapiens
ctttgtggggttttg

SEQ ID NO: 98896 - DNA, 15 bp, Homo sapiens
tctttgtggggtttt

SEQ ID NO: 98897 - DNA, 15 bp, Homo sapiens
ttctttgtggggttt

SEQ ID NO: 98898 - DNA, 15 bp, Homo sapiens
gttctttgtggggtt

SEQ ID NO: 98899 - DNA, 15 bp, Homo sapiens
ggttctttgtggggt

SEQ ID NO: 98900 - DNA, 15 bp, Homo sapiens
tggttctttgtgggg

SEQ ID NO: 98901 - DNA, 15 bp, Homo sapiens
atggttctttgtggg

SEQ ID NO: 98902 - DNA, 15 bp, Homo sapiens
aatggttctttgtgg

SEQ ID NO: 98903 - DNA, 15 bp, Homo sapiens
gaatggttctttgtg

SEQ ID NO: 98904 - DNA, 15 bp, Homo sapiens
tgaatggttctttgt

SEQ ID NO: 98905 - DNA, 15 bp, Homo sapiens
gtgaatggttctttg

SEQ ID NO: 98906 - DNA, 15 bp, Homo sapiens
agtgaatggttcttt

SEQ ID NO: 98907 - DNA, 15 bp, Homo sapiens
cagtgaatggttctt

SEQ ID NO: 98908 - DNA, 15 bp, Homo sapiens
acagtgaatggttct

SEQ ID NO: 98909 - DNA, 15 bp, Homo sapiens
aacagtgaatggttc

SEQ ID NO: 98910 - DNA, 15 bp, Homo sapiens
taacagtgaatggtt

SEQ ID NO: 98911 - DNA, 15 bp, Homo sapiens
gtaacagtgaatggt

SEQ ID NO: 98912 - DNA, 15 bp, Homo sapiens
ggtaacagtgaatgg

SEQ ID NO: 98913 - DNA, 15 bp, Homo sapiens
aggtaacagtgaatg

SEQ ID NO: 98914 - DNA, 15 bp, Homo sapiens
taggtaacagtgaat

SEQ ID NO: 98915 - DNA, 15 bp, Homo sapiens
ttaggtaacagtgaa

SEQ ID NO: 98916 - DNA, 15 bp, Homo sapiens
tttaggtaacagtga

SEQ ID NO: 98917 - DNA, 15 bp, Homo sapiens
atttaggtaacagtg

SEQ ID NO: 98918 - DNA, 15 bp, Homo sapiens
tatttaggtaacagt

SEQ ID NO: 98919 - DNA, 15 bp, Homo sapiens
ttatttaggtaacag

SEQ ID NO: 98920 - DNA, 15 bp, Homo sapiens
attatttaggtaaca

SEQ ID NO: 98921 - DNA, 15 bp, Homo sapiens
cattatttaggtaac

SEQ ID NO: 98922 - DNA, 15 bp, Homo sapiens
acattatttaggtaa

SEQ ID NO: 98923 - DNA, 15 bp, Homo sapiens
aacattatttaggta

SEQ ID NO: 98924 - DNA, 15 bp, Homo sapiens
gaacattatttaggt

SEQ ID NO: 98925 - DNA, 15 bp, Homo sapiens
agaacattatttagg

SEQ ID NO: 98926 - DNA, 15 bp, Homo sapiens
tagaacattatttag

SEQ ID NO: 98927 - DNA, 15 bp, Homo sapiens
atagaacattattta

SEQ ID NO: 98928 - DNA, 15 bp, Homo sapiens
aatagaacattattt

SEQ ID NO: 98929 - DNA, 15 bp, Homo sapiens
aaatagaacattatt

SEQ ID NO: 98930 - DNA, 15 bp, Homo sapiens
aaaatagaacattat

SEQ ID NO: 98931 - DNA, 15 bp, Homo sapiens
caaaatagaacatta

SEQ ID NO: 98932 - DNA, 15 bp, Homo sapiens
ccaaaatagaacatt

SEQ ID NO: 98933 - DNA, 15 bp, Homo sapiens
gccaaaatagaacat

SEQ ID NO: 98934 - DNA, 15 bp, Homo sapiens
tgccaaaatagaaca

SEQ ID NO: 98935 - DNA, 15 bp, Homo sapiens
ctgccaaaatagaac

SEQ ID NO: 98936 - DNA, 15 bp, Homo sapiens
actgccaaaatagaa

SEQ ID NO: 98937 - DNA, 15 bp, Homo sapiens
aactgccaaaataga

SEQ ID NO: 98938 - DNA, 15 bp, Homo sapiens
taactgccaaaatag

SEQ ID NO: 98939 - DNA, 15 bp, Homo sapiens
ctaactgccaaaata

SEQ ID NO: 98940 - DNA, 15 bp, Homo sapiens
tctaactgccaaaat

SEQ ID NO: 98941 - DNA, 15 bp, Homo sapiens
ttctaactgccaaaa

SEQ ID NO: 98942 - DNA, 15 bp, Homo sapiens
attctaactgccaaa

SEQ ID NO: 98943 - DNA, 15 bp, Homo sapiens
gattctaactgccaa

SEQ ID NO: 98944 - DNA, 15 bp, Homo sapiens
tgattctaactgcca

SEQ ID NO: 98945 - DNA, 15 bp, Homo sapiens
atgattctaactgcc

SEQ ID NO: 98946 - DNA, 15 bp, Homo sapiens
gatgattctaactgc

SEQ ID NO: 98947 - DNA, 15 bp, Homo sapiens
ggatgattctaactg

SEQ ID NO: 98948 - DNA, 15 bp, Homo sapiens
tggatgattctaact

SEQ ID NO: 98949 - DNA, 15 bp, Homo sapiens
ctggatgattctaac

SEQ ID NO: 98950 - DNA, 15 bp, Homo sapiens
tctggatgattctaa

SEQ ID NO: 98951 - DNA, 15 bp, Homo sapiens
atctggatgattcta

SEQ ID NO: 98952 - DNA, 15 bp, Homo sapiens
catctggatgattct

SEQ ID NO: 98953 - DNA, 15 bp, Homo sapiens
acatctggatgattc

SEQ ID NO: 98954 - DNA, 15 bp, Homo sapiens
aacatctggatgatt

SEQ ID NO: 98955 - DNA, 15 bp, Homo sapiens
aaacatctggatgat

SEQ ID NO: 98956 - DNA, 15 bp, Homo sapiens
aaaacatctggatga

SEQ ID NO: 98957 - DNA, 15 bp, Homo sapiens
taaaacatctggatg

SEQ ID NO: 98958 - DNA, 15 bp, Homo sapiens
ttaaaacatctggat

SEQ ID NO: 98959 - DNA, 15 bp, Homo sapiens
gttaaaacatctgga

SEQ ID NO: 98960 - DNA, 15 bp, Homo sapiens
agttaaaacatctgg

SEQ ID NO: 98961 - DNA, 15 bp, Homo sapiens
aagttaaaacatctg

SEQ ID NO: 98962 - DNA, 15 bp, Homo sapiens
aaagttaaaacatct

SEQ ID NO: 98963 - DNA, 15 bp, Homo sapiens
caaagttaaaacatc

SEQ ID NO: 98964 - DNA, 15 bp, Homo sapiens
ccaaagttaaaacat

SEQ ID NO: 98965 - DNA, 15 bp, Homo sapiens
accaaagttaaaaca

SEQ ID NO: 98966 - DNA, 15 bp, Homo sapiens
aaccaaagttaaaac

SEQ ID NO: 98967 - DNA, 15 bp, Homo sapiens
aaaccaaagttaaaa

SEQ ID NO: 98968 - DNA, 15 bp, Homo sapiens
taaaccaaagttaaa

SEQ ID NO: 98969 - DNA, 15 bp, Homo sapiens
ttaaaccaaagttaa

SEQ ID NO: 98970 - DNA, 15 bp, Homo sapiens
attaaaccaaagtta

SEQ ID NO: 98971 - DNA, 15 bp, Homo sapiens
aattaaaccaaagtt

SEQ ID NO: 98972 - DNA, 15 bp, Homo sapiens
gaattaaaccaaagt

SEQ ID NO: 98973 - DNA, 15 bp, Homo sapiens
agaattaaaccaaag

SEQ ID NO: 98974 - DNA, 15 bp, Homo sapiens
aagaattaaaccaaa

SEQ ID NO: 98975 - DNA, 15 bp, Homo sapiens
caagaattaaaccaa

SEQ ID NO: 98976 - DNA, 15 bp, Homo sapiens
tcaagaattaaacca

SEQ ID NO: 98977 - DNA, 15 bp, Homo sapiens
ttcaagaattaaacc

SEQ ID NO: 98978 - DNA, 15 bp, Homo sapiens
tttcaagaattaaac

SEQ ID NO: 98979 - DNA, 15 bp, Homo sapiens
ttttcaagaattaaa

SEQ ID NO: 98980 - DNA, 15 bp, Homo sapiens
tttttcaagaattaa

SEQ ID NO: 98981 - DNA, 15 bp, Homo sapiens
ttttttcaagaatta

SEQ ID NO: 98982 - DNA, 15 bp, Homo sapiens
tttttttcaagaatt

SEQ ID NO: 98983 - DNA, 15 bp, Homo sapiens
ttttttttcaagaat

SEQ ID NO: 98984 - DNA, 15 bp, Homo sapiens
tttttttttcaagaa

SEQ ID NO: 98985 - DNA, 15 bp, Homo sapiens
ctttttttttcaaga

SEQ ID NO: 98986 - DNA, 15 bp, Homo sapiens
tctttttttttcaag

SEQ ID NO: 98987 - DNA, 15 bp, Homo sapiens
ttctttttttttcaa

SEQ ID NO: 98988 - DNA, 15 bp, Homo sapiens
tttctttttttttca

SEQ ID NO: 98989 - DNA, 15 bp, Homo sapiens
ctttctttttttttc

SEQ ID NO: 98990 - DNA, 15 bp, Homo sapiens
ttttctttctttttt

SEQ ID NO: 98991 - DNA, 15 bp, Homo sapiens
cttttctttcttttt

SEQ ID NO: 98992 - DNA, 15 bp, Homo sapiens
tcttttctttctttt

SEQ ID NO: 98993 - DNA, 15 bp, Homo sapiens
ttcttttctttcttt

SEQ ID NO: 98994 - DNA, 15 bp, Homo sapiens
tttcttttctttctt

SEQ ID NO: 98995 - DNA, 15 bp, Homo sapiens
atttcttttctttct

SEQ ID NO: 98996 - DNA, 15 bp, Homo sapiens
aatttcttttctttc

SEQ ID NO: 98997 - DNA, 15 bp, Homo sapiens
caatttcttttcttt

SEQ ID NO: 98998 - DNA, 15 bp, Homo sapiens
ccaatttcttttctt

SEQ ID NO: 98999 - DNA, 15 bp, Homo sapiens
accaatttcttttct

SEQ ID NO: 99000 - DNA, 15 bp, Homo sapiens
aaccaatttcttttc

SEQ ID NO: 99001 - DNA, 15 bp, Homo sapiens
taaccaatttctttt

SEQ ID NO: 99002 - DNA, 15 bp, Homo sapiens
gtaaccaatttcttt

SEQ ID NO: 99003 - DNA, 15 bp, Homo sapiens
agtaaccaatttctt

SEQ ID NO: 99004 - DNA, 15 bp, Homo sapiens
cagtaaccaatttct

SEQ ID NO: 99005 - DNA, 15 bp, Homo sapiens
tcagtaaccaatttc

SEQ ID NO: 99006 - DNA, 15 bp, Homo sapiens
ctcagtaaccaattt

SEQ ID NO: 99007 - DNA, 15 bp, Homo sapiens
tctcagtaaccaatt

SEQ ID NO: 99008 - DNA, 15 bp, Homo sapiens
ttctcagtaaccaat

SEQ ID NO: 99009 - DNA, 15 bp, Homo sapiens
tttctcagtaaccaa

SEQ ID NO: 99010 - DNA, 15 bp, Homo sapiens
ctttctcagtaacca

SEQ ID NO: 99011 - DNA, 15 bp, Homo sapiens
cctttctcagtaacc

SEQ ID NO: 99012 - DNA, 15 bp, Homo sapiens
ccctttctcagtaac

SEQ ID NO: 99013 - DNA, 15 bp, Homo sapiens
tccctttctcagtaa

SEQ ID NO: 99014 - DNA, 15 bp, Homo sapiens
ctccctttctcagta

SEQ ID NO: 99015 - DNA, 15 bp, Homo sapiens
tctccctttctcagt

SEQ ID NO: 99016 - DNA, 15 bp, Homo sapiens
gtctccctttctcag

SEQ ID NO: 99017 - DNA, 15 bp, Homo sapiens
cgtctccctttctca

SEQ ID NO: 99018 - DNA, 15 bp, Homo sapiens
acgtctccctttctc

SEQ ID NO: 99019 - DNA, 15 bp, Homo sapiens
aacgtctccctttct

SEQ ID NO: 99020 - DNA, 15 bp, Homo sapiens
aaacgtctccctttc

SEQ ID NO: 99021 - DNA, 15 bp, Homo sapiens
aaaacgtctcccttt

SEQ ID NO: 99022 - DNA, 15 bp, Homo sapiens
aaaaacgtctccctt

SEQ ID NO: 99023 - DNA, 15 bp, Homo sapiens
gaaaaacgtctccct

SEQ ID NO: 99024 - DNA, 15 bp, Homo sapiens
tgaaaaacgtctccc

SEQ ID NO: 99025 - DNA, 15 bp, Homo sapiens
ttgaaaaacgtctcc

SEQ ID NO: 99026 - DNA, 15 bp, Homo sapiens
cttgaaaaacgtctc

SEQ ID NO: 99027 - DNA, 15 bp, Homo sapiens
acttgaaaaacgtct

SEQ ID NO: 99028 - DNA, 15 bp, Homo sapiens
aacttgaaaaacgtc

SEQ ID NO: 99029 - DNA, 15 bp, Homo sapiens
gaacttgaaaaacgt

SEQ ID NO: 99030 - DNA, 15 bp, Homo sapiens
tgaacttgaaaaacg

SEQ ID NO: 99031 - DNA, 15 bp, Homo sapiens
atgaacttgaaaaac

SEQ ID NO: 99032 - DNA, 15 bp, Homo sapiens
gatgaacttgaaaaa

SEQ ID NO: 99033 - DNA, 15 bp, Homo sapiens
ggatgaacttgaaaa

SEQ ID NO: 99034 - DNA, 15 bp, Homo sapiens
tggatgaacttgaaa

SEQ ID NO: 99035 - DNA, 15 bp, Homo sapiens
atggatgaacttgaa

SEQ ID NO: 99036 - DNA, 15 bp, Homo sapiens
gatggatgaacttga

SEQ ID NO: 99037 - DNA, 15 bp, Homo sapiens
ggatggatgaacttg

SEQ ID NO: 99038 - DNA, 15 bp, Homo sapiens
aggatggatgaactt

SEQ ID NO: 99039 - DNA, 15 bp, Homo sapiens
aaggatggatgaact

SEQ ID NO: 99040 - DNA, 15 bp, Homo sapiens
aaaggatggatgaac

SEQ ID NO: 99041 - DNA, 15 bp, Homo sapiens
gaaaggatggatgaa

SEQ ID NO: 99042 - DNA, 15 bp, Homo sapiens
agaaaggatggatga

SEQ ID NO: 99043 - DNA, 15 bp, Homo sapiens
aagaaaggatggatg

SEQ ID NO: 99044 - DNA, 15 bp, Homo sapiens
caagaaaggatggat

SEQ ID NO: 99045 - DNA, 15 bp, Homo sapiens
ccaagaaaggatgga

SEQ ID NO: 99046 - DNA, 15 bp, Homo sapiens
tccaagaaaggatgg

SEQ ID NO: 99047 - DNA, 15 bp, Homo sapiens
ttccaagaaaggatg

SEQ ID NO: 99048 - DNA, 15 bp, Homo sapiens
gttccaagaaaggat

SEQ ID NO: 99049 - DNA, 15 bp, Homo sapiens
tgttccaagaaagga

SEQ ID NO: 99050 - DNA, 15 bp, Homo sapiens
ctgttccaagaaagg

SEQ ID NO: 99051 - DNA, 15 bp, Homo sapiens
tctgttccaagaaag

SEQ ID NO: 99052 - DNA, 15 bp, Homo sapiens
ctctgttccaagaaa

SEQ ID NO: 99053 - DNA, 15 bp, Homo sapiens
cctctgttccaagaa

SEQ ID NO: 99054 - DNA, 15 bp, Homo sapiens
ccctctgttccaaga

SEQ ID NO: 99055 - DNA, 15 bp, Homo sapiens
gccctctgttccaag

SEQ ID NO: 99056 - DNA, 15 bp, Homo sapiens
tgccctctgttccaa

SEQ ID NO: 99057 - DNA, 15 bp, Homo sapiens
ttgccctctgttcca

SEQ ID NO: 99058 - DNA, 15 bp, Homo sapiens
tttgccctctgttcc

SEQ ID NO: 99059 - DNA, 15 bp, Homo sapiens
ttttgccctctgttc

SEQ ID NO: 99060 - DNA, 15 bp, Homo sapiens
cttttgccctctgtt

SEQ ID NO: 99061 - DNA, 15 bp, Homo sapiens
tcttttgccctctgt

SEQ ID NO: 99062 - DNA, 15 bp, Homo sapiens
ctcttttgccctctg

SEQ ID NO: 99063 - DNA, 15 bp, Homo sapiens
cctcttttgccctct

SEQ ID NO: 99064 - DNA, 15 bp, Homo sapiens
tcctcttttgccctc

SEQ ID NO: 99065 - DNA, 15 bp, Homo sapiens
atcctcttttgccct

SEQ ID NO: 99066 - DNA, 15 bp, Homo sapiens
catcctcttttgccc

SEQ ID NO: 99067 - DNA, 15 bp, Homo sapiens
acatcctcttttgcc

SEQ ID NO: 99068 - DNA, 15 bp, Homo sapiens
cacatcctcttttgc

SEQ ID NO: 99069 - DNA, 15 bp, Homo sapiens
acacatcctcttttg

SEQ ID NO: 99070 - DNA, 15 bp, Homo sapiens
aacacatcctctttt

SEQ ID NO: 99071 - DNA, 15 bp, Homo sapiens
caacacatcctcttt

SEQ ID NO: 99072 - DNA, 15 bp, Homo sapiens
gcaacacatcctctt

SEQ ID NO: 99073 - DNA, 15 bp, Homo sapiens
tgcaacacatcctct

SEQ ID NO: 99074 - DNA, 15 bp, Homo sapiens
ctgcaacacatcctc

SEQ ID NO: 99075 - DNA, 15 bp, Homo sapiens
tctgcaacacatcct

SEQ ID NO: 99076 - DNA, 15 bp, Homo sapiens
ttctgcaacacatcc

SEQ ID NO: 99077 - DNA, 15 bp, Homo sapiens
cttctgcaacacatc

SEQ ID NO: 99078 - DNA, 15 bp, Homo sapiens
ccttctgcaacacat

SEQ ID NO: 99079 - DNA, 15 bp, Homo sapiens
tccttctgcaacaca

SEQ ID NO: 99080 - DNA, 15 bp, Homo sapiens
ctccttctgcaacac

SEQ ID NO: 99081 - DNA, 15 bp, Homo sapiens
cctccttctgcaaca

SEQ ID NO: 99082 - DNA, 15 bp, Homo sapiens
acctccttctgcaac

SEQ ID NO: 99083 - DNA, 15 bp, Homo sapiens
cacctccttctgcaa

SEQ ID NO: 99084 - DNA, 15 bp, Homo sapiens
tcacctccttctgca

SEQ ID NO: 99085 - DNA, 15 bp, Homo sapiens
ctcacctccttctgc

SEQ ID NO: 99086 - DNA, 15 bp, Homo sapiens
tctcacctccttctg

SEQ ID NO: 99087 - DNA, 15 bp, Homo sapiens
ctctcacctccttct

SEQ ID NO: 99088 - DNA, 15 bp, Homo sapiens
actctcacctccttc

SEQ ID NO: 99089 - DNA, 15 bp, Homo sapiens
cactctcacctcctt

SEQ ID NO: 99090 - DNA, 15 bp, Homo sapiens
tcactctcacctcct

SEQ ID NO: 99091 - DNA, 15 bp, Homo sapiens
ttcactctcacctcc

SEQ ID NO: 99092 - DNA, 15 bp, Homo sapiens
cttcactctcacctc

SEQ ID NO: 99093 - DNA, 15 bp, Homo sapiens
tcttcactctcacct

SEQ ID NO: 99094 - DNA, 15 bp, Homo sapiens
atcttcactctcacc

SEQ ID NO: 99095 - DNA, 15 bp, Homo sapiens
aatcttcactctcac

SEQ ID NO: 99096 - DNA, 15 bp, Homo sapiens
gaatcttcactctca

SEQ ID NO: 99097 - DNA, 15 bp, Homo sapiens
agaatcttcactctc

SEQ ID NO: 99098 - DNA, 15 bp, Homo sapiens
gagaatcttcactct

SEQ ID NO: 99099 - DNA, 15 bp, Homo sapiens
tgagaatcttcactc

SEQ ID NO: 99100 - DNA, 15 bp, Homo sapiens
ttgagaatcttcact

SEQ ID NO: 99101 - DNA, 15 bp, Homo sapiens
cttgagaatcttcac

SEQ ID NO: 99102 - DNA, 15 bp, Homo sapiens
ccttgagaatcttca

SEQ ID NO: 99103 - DNA, 15 bp, Homo sapiens
tccttgagaatcttc

SEQ ID NO: 99104 - DNA, 15 bp, Homo sapiens
gtccttgagaatctt

SEQ ID NO: 99105 - DNA, 15 bp, Homo sapiens
tgtccttgagaatct

SEQ ID NO: 99106 - DNA, 15 bp, Homo sapiens
ttgtccttgagaatc

SEQ ID NO: 99107 - DNA, 15 bp, Homo sapiens
gttgtccttgagaat

SEQ ID NO: 99108 - DNA, 15 bp, Homo sapiens
tgttgtccttgagaa

SEQ ID NO: 99109 - DNA, 15 bp, Homo sapiens
atgttgtccttgaga

SEQ ID NO: 99110 - DNA, 15 bp, Homo sapiens
gatgttgtccttgag

SEQ ID NO: 99111 - DNA, 15 bp, Homo sapiens
tgatgttgtccttga

SEQ ID NO: 99112 - DNA, 15 bp, Homo sapiens
ttgatgttgtccttg

SEQ ID NO: 99113 - DNA, 15 bp, Homo sapiens
cttgatgttgtcctt

SEQ ID NO: 99114 - DNA, 15 bp, Homo sapiens
acttgatgttgtcct

SEQ ID NO: 99115 - DNA, 15 bp, Homo sapiens
aacttgatgttgtcc

SEQ ID NO: 99116 - DNA, 15 bp, Homo sapiens
taacttgatgttgtc

SEQ ID NO: 99117 - DNA, 15 bp, Homo sapiens
ataacttgatgttgt

SEQ ID NO: 99118 - DNA, 15 bp, Homo sapiens
aataacttgatgttg

SEQ ID NO: 99119 - DNA, 15 bp, Homo sapiens
taataacttgatgtt

SEQ ID NO: 99120 - DNA, 15 bp, Homo sapiens
ctaataacttgatgt

SEQ ID NO: 99121 - DNA, 15 bp, Homo sapiens
gctaataacttgatg

SEQ ID NO: 99122 - DNA, 15 bp, Homo sapiens
agctaataacttgat

SEQ ID NO: 99123 - DNA, 15 bp, Homo sapiens
cagctaataacttga

SEQ ID NO: 99124 - DNA, 15 bp, Homo sapiens
gcagctaataacttg

SEQ ID NO: 99125 - DNA, 15 bp, Homo sapiens
ggcagctaataactt

SEQ ID NO: 99126 - DNA, 15 bp, Homo sapiens
tggcagctaataact

SEQ ID NO: 99127 - DNA, 15 bp, Homo sapiens
ttggcagctaataac

SEQ ID NO: 99128 - DNA, 15 bp, Homo sapiens
cttggcagctaataa

SEQ ID NO: 99129 - DNA, 15 bp, Homo sapiens
ccttggcagctaata

SEQ ID NO: 99130 - DNA, 15 bp, Homo sapiens
accttggcagctaat

SEQ ID NO: 99131 - DNA, 15 bp, Homo sapiens
caccttggcagctaa

SEQ ID NO: 99132 - DNA, 15 bp, Homo sapiens
gcaccttggcagcta

SEQ ID NO: 99133 - DNA, 15 bp, Homo sapiens
ggcaccttggcagct

SEQ ID NO: 99134 - DNA, 15 bp, Homo sapiens
gggcaccttggcagc

SEQ ID NO: 99135 - DNA, 15 bp, Homo sapiens
agggcaccttggcag

SEQ ID NO: 99136 - DNA, 15 bp, Homo sapiens
gagggcaccttggca

SEQ ID NO: 99137 - DNA, 15 bp, Homo sapiens
agagggcaccttggc

SEQ ID NO: 99138 - DNA, 15 bp, Homo sapiens
cagagggcaccttgg

SEQ ID NO: 99139 - DNA, 15 bp, Homo sapiens
ccagagggcaccttg

SEQ ID NO: 99140 - DNA, 15 bp, Homo sapiens
accagagggcacctt

SEQ ID NO: 99141 - DNA, 15 bp, Homo sapiens
caccagagggcacct

SEQ ID NO: 99142 - DNA, 15 bp, Homo sapiens
ccaccagagggcacc

SEQ ID NO: 99143 - DNA, 15 bp, Homo sapiens
gccaccagagggcac

SEQ ID NO: 99144 - DNA, 15 bp, Homo sapiens
ggccaccagagggca

SEQ ID NO: 99145 - DNA, 15 bp, Homo sapiens
tggccaccagagggc

SEQ ID NO: 99146 - DNA, 15 bp, Homo sapiens
ctggccaccagaggg

SEQ ID NO: 99147 - DNA, 15 bp, Homo sapiens
cctggccaccagagg

SEQ ID NO: 99148 - DNA, 15 bp, Homo sapiens
tcctggccaccagag

SEQ ID NO: 99149 - DNA, 15 bp, Homo sapiens
ctcctggccaccaga

SEQ ID NO: 99150 - DNA, 15 bp, Homo sapiens
actcctggccaccag

SEQ ID NO: 99151 - DNA, 15 bp, Homo sapiens
aactcctggccacca

SEQ ID NO: 99152 - DNA, 15 bp, Homo sapiens
caactcctggccacc

SEQ ID NO: 99153 - DNA, 15 bp, Homo sapiens
tcaactcctggccac

SEQ ID NO: 99154 - DNA, 15 bp, Homo sapiens
gtcaactcctggcca

SEQ ID NO: 99155 - DNA, 15 bp, Homo sapiens
cgtcaactcctggcc

SEQ ID NO: 99156 - DNA, 15 bp, Homo sapiens
acgtcaactcctggc

SEQ ID NO: 99157 - DNA, 15 bp, Homo sapiens
gacgtcaactcctgg

SEQ ID NO: 99158 - DNA, 15 bp, Homo sapiens
agacgtcaactcctg

SEQ ID NO: 99159 - DNA, 15 bp, Homo sapiens
cagacgtcaactcct

SEQ ID NO: 99160 - DNA, 15 bp, Homo sapiens
tcagacgtcaactcc

SEQ ID NO: 99161 - DNA, 15 bp, Homo sapiens
ctcagacgtcaactc

SEQ ID NO: 99162 - DNA, 15 bp, Homo sapiens
gctcagacgtcaact

SEQ ID NO: 99163 - DNA, 15 bp, Homo sapiens
agctcagacgtcaac

SEQ ID NO: 99164 - DNA, 15 bp, Homo sapiens
cagctcagacgtcaa

SEQ ID NO: 99165 - DNA, 15 bp, Homo sapiens
tcagctcagacgtca

SEQ ID NO: 99166 - DNA, 15 bp, Homo sapiens
ttcagctcagacgtc

SEQ ID NO: 99167 - DNA, 15 bp, Homo sapiens
attcagctcagacgt

SEQ ID NO: 99168 - DNA, 15 bp, Homo sapiens
cattcagctcagacg

SEQ ID NO: 99169 - DNA, 15 bp, Homo sapiens
acattcagctcagac

SEQ ID NO: 99170 - DNA, 15 bp, Homo sapiens
aacattcagctcaga

SEQ ID NO: 99171 - DNA, 15 bp, Homo sapiens
caacattcagctcag

SEQ ID NO: 99172 - DNA, 15 bp, Homo sapiens
acaacattcagctca

SEQ ID NO: 99173 - DNA, 15 bp, Homo sapiens
cacaacattcagctc

SEQ ID NO: 99174 - DNA, 15 bp, Homo sapiens
gcacaacattcagct

SEQ ID NO: 99175 - DNA, 15 bp, Homo sapiens
agcacaacattcagc

SEQ ID NO: 99176 - DNA, 15 bp, Homo sapiens
cagcacaacattcag

SEQ ID NO: 99177 - DNA, 15 bp, Homo sapiens
ccagcacaacattca

SEQ ID NO: 99178 - DNA, 15 bp, Homo sapiens
tccagcacaacattc

SEQ ID NO: 99179 - DNA, 15 bp, Homo sapiens
ctccagcacaacatt

SEQ ID NO: 99180 - DNA, 15 bp, Homo sapiens
tctccagcacaacat

SEQ ID NO: 99181 - DNA, 15 bp, Homo sapiens
ttctccagcacaaca

SEQ ID NO: 99182 - DNA, 15 bp, Homo sapiens
attctccagcacaac

SEQ ID NO: 99183 - DNA, 15 bp, Homo sapiens
aattctccagcacaa

SEQ ID NO: 99184 - DNA, 15 bp, Homo sapiens
taattctccagcaca

SEQ ID NO: 99185 - DNA, 15 bp, Homo sapiens
gtaattctccagcac

SEQ ID NO: 99186 - DNA, 15 bp, Homo sapiens
ggtaattctccagca

SEQ ID NO: 99187 - DNA, 15 bp, Homo sapiens
tggtaattctccagc

SEQ ID NO: 99188 - DNA, 15 bp, Homo sapiens
ttggtaattctccag

SEQ ID NO: 99189 - DNA, 15 bp, Homo sapiens
gttggtaattctcca

SEQ ID NO: 99190 - DNA, 15 bp, Homo sapiens
agttggtaattctcc

SEQ ID NO: 99191 - DNA, 15 bp, Homo sapiens
aagttggtaattctc

SEQ ID NO: 99192 - DNA, 15 bp, Homo sapiens
gaagttggtaattct

SEQ ID NO: 99193 - DNA, 15 bp, Homo sapiens
agaagttggtaattc

SEQ ID NO: 99194 - DNA, 15 bp, Homo sapiens
aagaagttggtaatt

SEQ ID NO: 99195 - DNA, 15 bp, Homo sapiens
aaagaagttggtaat

SEQ ID NO: 99196 - DNA, 15 bp, Homo sapiens
caaagaagttggtaa

SEQ ID NO: 99197 - DNA, 15 bp, Homo sapiens
acaaagaagttggta

SEQ ID NO: 99198 - DNA, 15 bp, Homo sapiens
tacaaagaagttggt

SEQ ID NO: 99199 - DNA, 15 bp, Homo sapiens
ttacaaagaagttgg

SEQ ID NO: 99200 - DNA, 15 bp, Homo sapiens
attacaaagaagttg

SEQ ID NO: 99201 - DNA, 15 bp, Homo sapiens
tattacaaagaagtt

SEQ ID NO: 99202 - DNA, 15 bp, Homo sapiens
ctattacaaagaagt

SEQ ID NO: 99203 - DNA, 15 bp, Homo sapiens
tctattacaaagaag

SEQ ID NO: 99204 - DNA, 15 bp, Homo sapiens
ttctattacaaagaa

SEQ ID NO: 99205 - DNA, 15 bp, Homo sapiens
attctattacaaaga

SEQ ID NO: 99206 - DNA, 15 bp, Homo sapiens
aattctattacaaag

SEQ ID NO: 99207 - DNA, 15 bp, Homo sapiens
gaattctattacaaa

SEQ ID NO: 99208 - DNA, 15 bp, Homo sapiens
cgaattctattacaa

SEQ ID NO: 99209 - DNA, 15 bp, Homo sapiens
tcgaattctattaca

SEQ ID NO: 99210 - DNA, 15 bp, Homo sapiens
ctcgaattctattac

SEQ ID NO: 99211 - DNA, 15 bp, Homo sapiens
cctcgaattctatta

SEQ ID NO: 99212 - DNA, 15 bp, Homo sapiens
tcctcgaattctatt

SEQ ID NO: 99213 - DNA, 15 bp, Homo sapiens
ttcctcgaattctat

SEQ ID NO: 99214 - DNA, 15 bp, Homo sapiens
tttcctcgaattcta

SEQ ID NO: 99215 - DNA, 15 bp, Homo sapiens
ctttcctcgaattct

SEQ ID NO: 99216 - DNA, 15 bp, Homo sapiens
actttcctcgaattc

SEQ ID NO: 99217 - DNA, 15 bp, Homo sapiens
cactttcctcgaatt

SEQ ID NO: 99218 - DNA, 15 bp, Homo sapiens
gcactttcctcgaat

SEQ ID NO: 99219 - DNA, 15 bp, Homo sapiens
ggcactttcctcgaa

SEQ ID NO: 99220 - DNA, 15 bp, Homo sapiens
tggcactttcctcga

SEQ ID NO: 99221 - DNA, 15 bp, Homo sapiens
gtggcactttcctcg

SEQ ID NO: 99222 - DNA, 15 bp, Homo sapiens
tgtggcactttcctc

SEQ ID NO: 99223 - DNA, 15 bp, Homo sapiens
gtgtggcactttcct

SEQ ID NO: 99224 - DNA, 15 bp, Homo sapiens
cgtgtggcactttcc

SEQ ID NO: 99225 - DNA, 15 bp, Homo sapiens
gcgtgtggcactttc

SEQ ID NO: 99226 - DNA, 15 bp, Homo sapiens
agcgtgtggcacttt

SEQ ID NO: 99227 - DNA, 15 bp, Homo sapiens
tagcgtgtggcactt

SEQ ID NO: 99228 - DNA, 15 bp, Homo sapiens
ctagcgtgtggcact

SEQ ID NO: 99229 - DNA, 15 bp, Homo sapiens
tctagcgtgtggcac

SEQ ID NO: 99230 - DNA, 15 bp, Homo sapiens
ctctagcgtgtggca

SEQ ID NO: 99231 - DNA, 15 bp, Homo sapiens
cctctagcgtgtggc

SEQ ID NO: 99232 - DNA, 15 bp, Homo sapiens
acctctagcgtgtgg

SEQ ID NO: 99233 - DNA, 15 bp, Homo sapiens
tacctctagcgtgtg

SEQ ID NO: 99234 - DNA, 15 bp, Homo sapiens
atacctctagcgtgt

SEQ ID NO: 99235 - DNA, 15 bp, Homo sapiens
catacctctagcgtg

SEQ ID NO: 99236 - DNA, 15 bp, Homo sapiens
gcatacctctagcgt

SEQ ID NO: 99237 - DNA, 15 bp, Homo sapiens
agcatacctctagcg

SEQ ID NO: 99238 - DNA, 15 bp, Homo sapiens
tagcatacctctagc

SEQ ID NO: 99239 - DNA, 15 bp, Homo sapiens
atagcatacctctag

SEQ ID NO: 99240 - DNA, 15 bp, Homo sapiens
aatagcatacctcta

SEQ ID NO: 99241 - DNA, 15 bp, Homo sapiens
taatagcatacctct

SEQ ID NO: 99242 - DNA, 15 bp, Homo sapiens
ataatagcatacctc

SEQ ID NO: 99243 - DNA, 15 bp, Homo sapiens
aataatagcatacct

SEQ ID NO: 99244 - DNA, 15 bp, Homo sapiens
taataatagcatacc

SEQ ID NO: 99245 - DNA, 15 bp, Homo sapiens
ataataatagcatac

SEQ ID NO: 99246 - DNA, 15 bp, Homo sapiens
aataataatagcata

SEQ ID NO: 99247 - DNA, 15 bp, Homo sapiens
taataataatagcat

SEQ ID NO: 99248 - DNA, 15 bp, Homo sapiens
ataataataatagca

SEQ ID NO: 99249 - DNA, 15 bp, Homo sapiens
aataataataatagc

SEQ ID NO: 99250 - DNA, 15 bp, Homo sapiens
caataataataatag

SEQ ID NO: 99251 - DNA, 15 bp, Homo sapiens
acaataataataata

SEQ ID NO: 99252 - DNA, 15 bp, Homo sapiens
aacaataataataat

SEQ ID NO: 99253 - DNA, 15 bp, Homo sapiens
caacaataataataa

SEQ ID NO: 99254 - DNA, 15 bp, Homo sapiens
taacaacaataataa

SEQ ID NO: 99255 - DNA, 15 bp, Homo sapiens
ataacaacaataata

SEQ ID NO: 99256 - DNA, 15 bp, Homo sapiens
aataacaacaataat

SEQ ID NO: 99257 - DNA, 15 bp, Homo sapiens
taataacaacaataa

SEQ ID NO: 99258 - DNA, 15 bp, Homo sapiens
ataataacaacaata

SEQ ID NO: 99259 - DNA, 15 bp, Homo sapiens
aataataacaacaat

SEQ ID NO: 99260 - DNA, 15 bp, Homo sapiens
taataataacaacaa

SEQ ID NO: 99261 - DNA, 15 bp, Homo sapiens
ataataataacaaca

SEQ ID NO: 99262 - DNA, 15 bp, Homo sapiens
aataataataacaac

SEQ ID NO: 99263 - DNA, 15 bp, Homo sapiens
gaaaataataataat

SEQ ID NO: 99264 - DNA, 15 bp, Homo sapiens
tgaaaataataataa

SEQ ID NO: 99265 - DNA, 15 bp, Homo sapiens
ctgaaaataataata

SEQ ID NO: 99266 - DNA, 15 bp, Homo sapiens
actgaaaataataat

SEQ ID NO: 99267 - DNA, 15 bp, Homo sapiens
cactgaaaataataa

SEQ ID NO: 99268 - DNA, 15 bp, Homo sapiens
tcactgaaaataata

SEQ ID NO: 99269 - DNA, 15 bp, Homo sapiens
atcactgaaaataat

SEQ ID NO: 99270 - DNA, 15 bp, Homo sapiens
catcactgaaaataa

SEQ ID NO: 99271 - DNA, 15 bp, Homo sapiens
acatcactgaaaata

SEQ ID NO: 99272 - DNA, 15 bp, Homo sapiens
tacatcactgaaaat

SEQ ID NO: 99273 - DNA, 15 bp, Homo sapiens
atacatcactgaaaa

SEQ ID NO: 99274 - DNA, 15 bp, Homo sapiens
aatacatcactgaaa

SEQ ID NO: 99275 - DNA, 15 bp, Homo sapiens
aaatacatcactgaa

SEQ ID NO: 99276 - DNA, 15 bp, Homo sapiens
gaaatacatcactga

SEQ ID NO: 99277 - DNA, 15 bp, Homo sapiens
agaaatacatcactg

SEQ ID NO: 99278 - DNA, 15 bp, Homo sapiens
cagaaatacatcact

SEQ ID NO: 99279 - DNA, 15 bp, Homo sapiens
tcagaaatacatcac

SEQ ID NO: 99280 - DNA, 15 bp, Homo sapiens
ctcagaaatacatca

SEQ ID NO: 99281 - DNA, 15 bp, Homo sapiens
tctcagaaatacatc

SEQ ID NO: 99282 - DNA, 15 bp, Homo sapiens
atctcagaaatacat

SEQ ID NO: 99283 - DNA, 15 bp, Homo sapiens
gatctcagaaataca

SEQ ID NO: 99284 - DNA, 15 bp, Homo sapiens
ggatctcagaaatac

SEQ ID NO: 99285 - DNA, 15 bp, Homo sapiens
tggatctcagaaata

SEQ ID NO: 99286 - DNA, 15 bp, Homo sapiens
ttggatctcagaaat

SEQ ID NO: 99287 - DNA, 15 bp, Homo sapiens
tttggatctcagaaa

SEQ ID NO: 99288 - DNA, 15 bp, Homo sapiens
gtttggatctcagaa

SEQ ID NO: 99289 - DNA, 15 bp, Homo sapiens
agtttggatctcaga

SEQ ID NO: 99290 - DNA, 15 bp, Homo sapiens
gagtttggatctcag

SEQ ID NO: 99291 - DNA, 15 bp, Homo sapiens
agagtttggatctca

SEQ ID NO: 99292 - DNA, 15 bp, Homo sapiens
cagagtttggatctc

SEQ ID NO: 99293 - DNA, 15 bp, Homo sapiens
acagagtttggatct

SEQ ID NO: 99294 - DNA, 15 bp, Homo sapiens
tacagagtttggatc

SEQ ID NO: 99295 - DNA, 15 bp, Homo sapiens
ttacagagtttggat

SEQ ID NO: 99296 - DNA, 15 bp, Homo sapiens
attacagagtttgga

SEQ ID NO: 99297 - DNA, 15 bp, Homo sapiens
cattacagagtttgg

SEQ ID NO: 99298 - DNA, 15 bp, Homo sapiens
acattacagagtttg

SEQ ID NO: 99299 - DNA, 15 bp, Homo sapiens
aacattacagagttt

SEQ ID NO: 99300 - DNA, 15 bp, Homo sapiens
aaacattacagagtt

SEQ ID NO: 99301 - DNA, 15 bp, Homo sapiens
aaaacattacagagt

SEQ ID NO: 99302 - DNA, 15 bp, Homo sapiens
caaaacattacagag

SEQ ID NO: 99303 - DNA, 15 bp, Homo sapiens
ccaaaacattacaga

SEQ ID NO: 99304 - DNA, 15 bp, Homo sapiens
gccaaaacattacag

SEQ ID NO: 99305 - DNA, 15 bp, Homo sapiens
ggccaaaacattaca

SEQ ID NO: 99306 - DNA, 15 bp, Homo sapiens
tggccaaaacattac

SEQ ID NO: 99307 - DNA, 15 bp, Homo sapiens
atggccaaaacatta

SEQ ID NO: 99308 - DNA, 15 bp, Homo sapiens
aatggccaaaacatt

SEQ ID NO: 99309 - DNA, 15 bp, Homo sapiens
aaatggccaaaacat

SEQ ID NO: 99310 - DNA, 15 bp, Homo sapiens
aaaatggccaaaaca

SEQ ID NO: 99311 - DNA, 15 bp, Homo sapiens
gaaaatggccaaaac

SEQ ID NO: 99312 - DNA, 15 bp, Homo sapiens
tgaaaatggccaaaa

SEQ ID NO: 99313 - DNA, 15 bp, Homo sapiens
ttgaaaatggccaaa

SEQ ID NO: 99314 - DNA, 15 bp, Homo sapiens
tttgaaaatggccaa

SEQ ID NO: 99315 - DNA, 15 bp, Homo sapiens
atttgaaaatggcca

SEQ ID NO: 99316 - DNA, 15 bp, Homo sapiens
gatttgaaaatggcc

SEQ ID NO: 99317 - DNA, 15 bp, Homo sapiens
agatttgaaaatggc

SEQ ID NO: 99318 - DNA, 15 bp, Homo sapiens
aagatttgaaaatgg

SEQ ID NO: 99319 - DNA, 15 bp, Homo sapiens
caagatttgaaaatg

SEQ ID NO: 99320 - DNA, 15 bp, Homo sapiens
ccaagatttgaaaat

SEQ ID NO: 99321 - DNA, 15 bp, Homo sapiens
tccaagatttgaaaa

SEQ ID NO: 99322 - DNA, 15 bp, Homo sapiens
ctccaagatttgaaa

SEQ ID NO: 99323 - DNA, 15 bp, Homo sapiens
tctccaagatttgaa

SEQ ID NO: 99324 - DNA, 15 bp, Homo sapiens
ttctccaagatttga

SEQ ID NO: 99325 - DNA, 15 bp, Homo sapiens
tttctccaagatttg

SEQ ID NO: 99326 - DNA, 15 bp, Homo sapiens
ttttctccaagattt

SEQ ID NO: 99327 - DNA, 15 bp, Homo sapiens
gttttctccaagatt

SEQ ID NO: 99328 - DNA, 15 bp, Homo sapiens
agttttctccaagat

SEQ ID NO: 99329 - DNA, 15 bp, Homo sapiens
aagttttctccaaga

SEQ ID NO: 99330 - DNA, 15 bp, Homo sapiens
gaagttttctccaag

SEQ ID NO: 99331 - DNA, 15 bp, Homo sapiens
agaagttttctccaa

SEQ ID NO: 99332 - DNA, 15 bp, Homo sapiens
gagaagttttctcca

SEQ ID NO: 99333 - DNA, 15 bp, Homo sapiens
agagaagttttctcc

SEQ ID NO: 99334 - DNA, 15 bp, Homo sapiens
aagagaagttttctc

SEQ ID NO: 99335 - DNA, 15 bp, Homo sapiens
aaagagaagttttct

SEQ ID NO: 99336 - DNA, 15 bp, Homo sapiens
aaaagagaagttttc

SEQ ID NO: 99337 - DNA, 15 bp, Homo sapiens
gaaaagagaagtttt

SEQ ID NO: 99338 - DNA, 15 bp, Homo sapiens
agaaaagagaagttt

SEQ ID NO: 99339 - DNA, 15 bp, Homo sapiens
aagaaaagagaagtt

SEQ ID NO: 99340 - DNA, 15 bp, Homo sapiens
aaagaaaagagaagt

SEQ ID NO: 99341 - DNA, 15 bp, Homo sapiens
gaaagaaaagagaag

SEQ ID NO: 99342 - DNA, 15 bp, Homo sapiens
tgaaagaaaagagaa

SEQ ID NO: 99343 - DNA, 15 bp, Homo sapiens
ttgaaagaaaagaga

SEQ ID NO: 99344 - DNA, 15 bp, Homo sapiens
tttgaaagaaaagag

SEQ ID NO: 99345 - DNA, 15 bp, Homo sapiens
atttgaaagaaaaga

SEQ ID NO: 99346 - DNA, 15 bp, Homo sapiens
aatttgaaagaaaag

SEQ ID NO: 99347 - DNA, 15 bp, Homo sapiens
gaatttgaaagaaaa

SEQ ID NO: 99348 - DNA, 15 bp, Homo sapiens
agaatttgaaagaaa

SEQ ID NO: 99349 - DNA, 15 bp, Homo sapiens
cagaatttgaaagaa

SEQ ID NO: 99350 - DNA, 15 bp, Homo sapiens
ccagaatttgaaaga

SEQ ID NO: 99351 - DNA, 15 bp, Homo sapiens
tccagaatttgaaag

SEQ ID NO: 99352 - DNA, 15 bp, Homo sapiens
atccagaatttgaaa

SEQ ID NO: 99353 - DNA, 15 bp, Homo sapiens
aatccagaatttgaa

SEQ ID NO: 99354 - DNA, 15 bp, Homo sapiens
taatccagaatttga

SEQ ID NO: 99355 - DNA, 15 bp, Homo sapiens
ataatccagaatttg

SEQ ID NO: 99356 - DNA, 15 bp, Homo sapiens
tataatccagaattt

SEQ ID NO: 99357 - DNA, 15 bp, Homo sapiens
ttataatccagaatt

SEQ ID NO: 99358 - DNA, 15 bp, Homo sapiens
tttataatccagaat

SEQ ID NO: 99359 - DNA, 15 bp, Homo sapiens
ctttataatccagaa

SEQ ID NO: 99360 - DNA, 15 bp, Homo sapiens
tctttataatccaga

SEQ ID NO: 99361 - DNA, 15 bp, Homo sapiens
ttctttataatccag

SEQ ID NO: 99362 - DNA, 15 bp, Homo sapiens
tttctttataatcca

SEQ ID NO: 99363 - DNA, 15 bp, Homo sapiens
ttttctttataatcc

SEQ ID NO: 99364 - DNA, 15 bp, Homo sapiens
tttttctttataatc

SEQ ID NO: 99365 - DNA, 15 bp, Homo sapiens
ttttttctttataat

SEQ ID NO: 99366 - DNA, 15 bp, Homo sapiens
attttttctttataa

SEQ ID NO: 99367 - DNA, 15 bp, Homo sapiens
tattttttctttata

SEQ ID NO: 99368 - DNA, 15 bp, Homo sapiens
ctattttttctttat

SEQ ID NO: 99369 - DNA, 15 bp, Homo sapiens
actattttttcttta

SEQ ID NO: 99370 - DNA, 15 bp, Homo sapiens
aactattttttcttt

SEQ ID NO: 99371 - DNA, 15 bp, Homo sapiens
gaactattttttctt

SEQ ID NO: 99372 - DNA, 15 bp, Homo sapiens
agaactattttttct

SEQ ID NO: 99373 - DNA, 15 bp, Homo sapiens
aagaactattttttc

SEQ ID NO: 99374 - DNA, 15 bp, Homo sapiens
caagaactatttttt

SEQ ID NO: 99375 - DNA, 15 bp, Homo sapiens
ccaagaactattttt

SEQ ID NO: 99376 - DNA, 15 bp, Homo sapiens
cccaagaactatttt

SEQ ID NO: 99377 - DNA, 15 bp, Homo sapiens
tcccaagaactattt

SEQ ID NO: 99378 - DNA, 15 bp, Homo sapiens
ttcccaagaactatt

SEQ ID NO: 99379 - DNA, 15 bp, Homo sapiens
tttcccaagaactat

SEQ ID NO: 99380 - DNA, 15 bp, Homo sapiens
atttcccaagaacta

SEQ ID NO: 99381 - DNA, 15 bp, Homo sapiens
tatttcccaagaact

SEQ ID NO: 99382 - DNA, 15 bp, Homo sapiens
ctatttcccaagaac

SEQ ID NO: 99383 - DNA, 15 bp, Homo sapiens
actatttcccaagaa

SEQ ID NO: 99384 - DNA, 15 bp, Homo sapiens
aactatttcccaaga

SEQ ID NO: 99385 - DNA, 15 bp, Homo sapiens
aaactatttcccaag

SEQ ID NO: 99386 - DNA, 15 bp, Homo sapiens
caaactatttcccaa

SEQ ID NO: 99387 - DNA, 15 bp, Homo sapiens
tcaaactatttccca

SEQ ID NO: 99388 - DNA, 15 bp, Homo sapiens
atcaaactatttccc

SEQ ID NO: 99389 - DNA, 15 bp, Homo sapiens
tatcaaactatttcc

SEQ ID NO: 99390 - DNA, 15 bp, Homo sapiens
ttatcaaactatttc

SEQ ID NO: 99391 - DNA, 15 bp, Homo sapiens
tttatcaaactattt

SEQ ID NO: 99392 - DNA, 15 bp, Homo sapiens
ttttatcaaactatt

SEQ ID NO: 99393 - DNA, 15 bp, Homo sapiens
tttttatcaaactat

SEQ ID NO: 99394 - DNA, 15 bp, Homo sapiens
atttttatcaaacta

SEQ ID NO: 99395 - DNA, 15 bp, Homo sapiens
catttttatcaaact

SEQ ID NO: 99396 - DNA, 15 bp, Homo sapiens
tcatttttatcaaac

SEQ ID NO: 99397 - DNA, 15 bp, Homo sapiens
ttcatttttatcaaa

SEQ ID NO: 99398 - DNA, 15 bp, Homo sapiens
tttcatttttatcaa

SEQ ID NO: 99399 - DNA, 15 bp, Homo sapiens
ctttcatttttatca

SEQ ID NO: 99400 - DNA, 15 bp, Homo sapiens
tctttcatttttatc

SEQ ID NO: 99401 - DNA, 15 bp, Homo sapiens
ctctttcatttttat

SEQ ID NO: 99402 - DNA, 15 bp, Homo sapiens
cctctttcattttta

SEQ ID NO: 99403 - DNA, 15 bp, Homo sapiens
ccctctttcattttt

SEQ ID NO: 99404 - DNA, 15 bp, Homo sapiens
cccctctttcatttt

SEQ ID NO: 99405 - DNA, 15 bp, Homo sapiens
acccctctttcattt

SEQ ID NO: 99406 - DNA, 15 bp, Homo sapiens
aacccctctttcatt

SEQ ID NO: 99407 - DNA, 15 bp, Homo sapiens
taacccctctttcat

SEQ ID NO: 99408 - DNA, 15 bp, Homo sapiens
ttaacccctctttca

SEQ ID NO: 99409 - DNA, 15 bp, Homo sapiens
tttaacccctctttc

SEQ ID NO: 99410 - DNA, 15 bp, Homo sapiens
ttttaacccctcttt

SEQ ID NO: 99411 - DNA, 15 bp, Homo sapiens
tttttaacccctctt

SEQ ID NO: 99412 - DNA, 15 bp, Homo sapiens
gtttttaacccctct

SEQ ID NO: 99413 - DNA, 15 bp, Homo sapiens
tgtttttaacccctc

SEQ ID NO: 99414 - DNA, 15 bp, Homo sapiens
ctgtttttaacccct

SEQ ID NO: 99415 - DNA, 15 bp, Homo sapiens
cctgtttttaacccc

SEQ ID NO: 99416 - DNA, 15 bp, Homo sapiens
tcctgtttttaaccc

SEQ ID NO: 99417 - DNA, 15 bp, Homo sapiens
ctcctgtttttaacc

SEQ ID NO: 99418 - DNA, 15 bp, Homo sapiens
tctcctgtttttaac

SEQ ID NO: 99419 - DNA, 15 bp, Homo sapiens
gtctcctgtttttaa

SEQ ID NO: 99420 - DNA, 15 bp, Homo sapiens
ggtctcctgttttta

SEQ ID NO: 99421 - DNA, 15 bp, Homo sapiens
tggtctcctgttttt

SEQ ID NO: 99422 - DNA, 15 bp, Homo sapiens
ttggtctcctgtttt

SEQ ID NO: 99423 - DNA, 15 bp, Homo sapiens
tttggtctcctgttt

SEQ ID NO: 99424 - DNA, 15 bp, Homo sapiens
ttttggtctcctgtt

SEQ ID NO: 99425 - DNA, 15 bp, Homo sapiens
attttggtctcctgt

SEQ ID NO: 99426 - DNA, 15 bp, Homo sapiens
gattttggtctcctg

SEQ ID NO: 99427 - DNA, 15 bp, Homo sapiens
agattttggtctcct

SEQ ID NO: 99428 - DNA, 15 bp, Homo sapiens
cagattttggtctcc

SEQ ID NO: 99429 - DNA, 15 bp, Homo sapiens
acagattttggtctc

SEQ ID NO: 99430 - DNA, 15 bp, Homo sapiens
gacagattttggtct

SEQ ID NO: 99431 - DNA, 15 bp, Homo sapiens
ggacagattttggtc

SEQ ID NO: 99432 - DNA, 15 bp, Homo sapiens
gggacagattttggt

SEQ ID NO: 99433 - DNA, 15 bp, Homo sapiens
agggacagattttgg

SEQ ID NO: 99434 - DNA, 15 bp, Homo sapiens
tagggacagattttg

SEQ ID NO: 99435 - DNA, 15 bp, Homo sapiens
ttagggacagatttt

SEQ ID NO: 99436 - DNA, 15 bp, Homo sapiens
attagggacagattt

SEQ ID NO: 99437 - DNA, 15 bp, Homo sapiens
aattagggacagatt

SEQ ID NO: 99438 - DNA, 15 bp, Homo sapiens
taattagggacagat

SEQ ID NO: 99439 - DNA, 15 bp, Homo sapiens
ataattagggacaga

SEQ ID NO: 99440 - DNA, 15 bp, Homo sapiens
gataattagggacag

SEQ ID NO: 99441 - DNA, 15 bp, Homo sapiens
tgataattagggaca

SEQ ID NO: 99442 - DNA, 15 bp, Homo sapiens
ctgataattagggac

SEQ ID NO: 99443 - DNA, 15 bp, Homo sapiens
tctgataattaggga

SEQ ID NO: 99444 - DNA, 15 bp, Homo sapiens
ttctgataattaggg

SEQ ID NO: 99445 - DNA, 15 bp, Homo sapiens
cttctgataattagg

SEQ ID NO: 99446 - DNA, 15 bp, Homo sapiens
ccttctgataattag

SEQ ID NO: 99447 - DNA, 15 bp, Homo sapiens
accttctgataatta

SEQ ID NO: 99448 - DNA, 15 bp, Homo sapiens
aaccttctgataatt

SEQ ID NO: 99449 - DNA, 15 bp, Homo sapiens
gaaccttctgataat

SEQ ID NO: 99450 - DNA, 15 bp, Homo sapiens
agaaccttctgataa

SEQ ID NO: 99451 - DNA, 15 bp, Homo sapiens
aagaaccttctgata

SEQ ID NO: 99452 - DNA, 15 bp, Homo sapiens
caagaaccttctgat

SEQ ID NO: 99453 - DNA, 15 bp, Homo sapiens
ccaagaaccttctga

SEQ ID NO: 99454 - DNA, 15 bp, Homo sapiens
cccaagaaccttctg

SEQ ID NO: 99455 - DNA, 15 bp, Homo sapiens
gcccaagaaccttct

SEQ ID NO: 99456 - DNA, 15 bp, Homo sapiens
tgcccaagaaccttc

SEQ ID NO: 99457 - DNA, 15 bp, Homo sapiens
ttgcccaagaacctt

SEQ ID NO: 99458 - DNA, 15 bp, Homo sapiens
cttgcccaagaacct

SEQ ID NO: 99459 - DNA, 15 bp, Homo sapiens
acttgcccaagaacc

SEQ ID NO: 99460 - DNA, 15 bp, Homo sapiens
gacttgcccaagaac

SEQ ID NO: 99461 - DNA, 15 bp, Homo sapiens
tgacttgcccaagaa

SEQ ID NO: 99462 - DNA, 15 bp, Homo sapiens
atgacttgcccaaga

SEQ ID NO: 99463 - DNA, 15 bp, Homo sapiens
aatgacttgcccaag

SEQ ID NO: 99464 - DNA, 15 bp, Homo sapiens
aaatgacttgcccaa

SEQ ID NO: 99465 - DNA, 15 bp, Homo sapiens
aaaatgacttgccca

SEQ ID NO: 99466 - DNA, 15 bp, Homo sapiens
caaaatgacttgccc

SEQ ID NO: 99467 - DNA, 15 bp, Homo sapiens
acaaaatgacttgcc

SEQ ID NO: 99468 - DNA, 15 bp, Homo sapiens
tacaaaatgacttgc

SEQ ID NO: 99469 - DNA, 15 bp, Homo sapiens
atacaaaatgacttg

SEQ ID NO: 99470 - DNA, 15 bp, Homo sapiens
tatacaaaatgactt

SEQ ID NO: 99471 - DNA, 15 bp, Homo sapiens
atatacaaaatgact

SEQ ID NO: 99472 - DNA, 15 bp, Homo sapiens
aatatacaaaatgac

SEQ ID NO: 99473 - DNA, 15 bp, Homo sapiens
gaatatacaaaatga

SEQ ID NO: 99474 - DNA, 15 bp, Homo sapiens
tgaatatacaaaatg

SEQ ID NO: 99475 - DNA, 15 bp, Homo sapiens
ttgaatatacaaaat

SEQ ID NO: 99476 - DNA, 15 bp, Homo sapiens
tttgaatatacaaaa

SEQ ID NO: 99477 - DNA, 15 bp, Homo sapiens
gtttgaatatacaaa

SEQ ID NO: 99478 - DNA, 15 bp, Homo sapiens
agtttgaatatacaa

SEQ ID NO: 99479 - DNA, 15 bp, Homo sapiens
aagtttgaatataca

SEQ ID NO: 99480 - DNA, 15 bp, Homo sapiens
aaagtttgaatatac

SEQ ID NO: 99481 - DNA, 15 bp, Homo sapiens
taaagtttgaatata

SEQ ID NO: 99482 - DNA, 15 bp, Homo sapiens
gtaaagtttgaatat

SEQ ID NO: 99483 - DNA, 15 bp, Homo sapiens
agtaaagtttgaata

SEQ ID NO: 99484 - DNA, 15 bp, Homo sapiens
aagtaaagtttgaat

SEQ ID NO: 99485 - DNA, 15 bp, Homo sapiens
aaagtaaagtttgaa

SEQ ID NO: 99486 - DNA, 15 bp, Homo sapiens
aaaagtaaagtttga

SEQ ID NO: 99487 - DNA, 15 bp, Homo sapiens
aaaaagtaaagtttg

SEQ ID NO: 99488 - DNA, 15 bp, Homo sapiens
aaaaaagtaaagttt

SEQ ID NO: 99489 - DNA, 15 bp, Homo sapiens
aaaaaaagtaaagtt

SEQ ID NO: 99490 - DNA, 15 bp, Homo sapiens
taaaaaaagtaaagt

SEQ ID NO: 99491 - DNA, 15 bp, Homo sapiens
ataaaaaaagtaaag

SEQ ID NO: 99492 - DNA, 15 bp, Homo sapiens
tataaaaaaagtaaa

SEQ ID NO: 99493 - DNA, 15 bp, Homo sapiens
ctataaaaaaagtaa

SEQ ID NO: 99494 - DNA, 15 bp, Homo sapiens
cctataaaaaaagta

SEQ ID NO: 99495 - DNA, 15 bp, Homo sapiens
acctataaaaaaagt

SEQ ID NO: 99496 - DNA, 15 bp, Homo sapiens
cacctataaaaaaag

SEQ ID NO: 99497 - DNA, 15 bp, Homo sapiens
gcacctataaaaaaa

SEQ ID NO: 99498 - DNA, 15 bp, Homo sapiens
tgcacctataaaaaa

SEQ ID NO: 99499 - DNA, 15 bp, Homo sapiens
ttgcacctataaaaa

SEQ ID NO: 99500 - DNA, 15 bp, Homo sapiens
attgcacctataaaa

SEQ ID NO: 99501 - DNA, 15 bp, Homo sapiens
gattgcacctataaa

SEQ ID NO: 99502 - DNA, 15 bp, Homo sapiens
ggattgcacctataa

SEQ ID NO: 99503 - DNA, 15 bp, Homo sapiens
tggattgcacctata

SEQ ID NO: 99504 - DNA, 15 bp, Homo sapiens
ctggattgcacctat

SEQ ID NO: 99505 - DNA, 15 bp, Homo sapiens
cctggattgcaccta

SEQ ID NO: 99506 - DNA, 15 bp, Homo sapiens
acctggattgcacct

SEQ ID NO: 99507 - DNA, 15 bp, Homo sapiens
aacctggattgcacc

SEQ ID NO: 99508 - DNA, 15 bp, Homo sapiens
aaacctggattgcac

SEQ ID NO: 99509 - DNA, 15 bp, Homo sapiens
aaaacctggattgca

SEQ ID NO: 99510 - DNA, 15 bp, Homo sapiens
gaaaacctggattgc

SEQ ID NO: 99511 - DNA, 15 bp, Homo sapiens
tgaaaacctggattg

SEQ ID NO: 99512 - DNA, 15 bp, Homo sapiens
atgaaaacctggatt

SEQ ID NO: 99513 - DNA, 15 bp, Homo sapiens
catgaaaacctggat

SEQ ID NO: 99514 - DNA, 15 bp, Homo sapiens
acatgaaaacctgga

SEQ ID NO: 99515 - DNA, 15 bp, Homo sapiens
tacatgaaaacctgg

SEQ ID NO: 99516 - DNA, 15 bp, Homo sapiens
ttacatgaaaacctg

SEQ ID NO: 99517 - DNA, 15 bp, Homo sapiens
gttacatgaaaacct

SEQ ID NO: 99518 - DNA, 15 bp, Homo sapiens
tgttacatgaaaacc

SEQ ID NO: 99519 - DNA, 15 bp, Homo sapiens
ctgttacatgaaaac

SEQ ID NO: 99520 - DNA, 15 bp, Homo sapiens
tctgttacatgaaaa

SEQ ID NO: 99521 - DNA, 15 bp, Homo sapiens
atctgttacatgaaa

SEQ ID NO: 99522 - DNA, 15 bp, Homo sapiens
catctgttacatgaa

SEQ ID NO: 99523 - DNA, 15 bp, Homo sapiens
tcatctgttacatga

SEQ ID NO: 99524 - DNA, 15 bp, Homo sapiens
atcatctgttacatg

SEQ ID NO: 99525 - DNA, 15 bp, Homo sapiens
gatcatctgttacat

SEQ ID NO: 99526 - DNA, 15 bp, Homo sapiens
agatcatctgttaca

SEQ ID NO: 99527 - DNA, 15 bp, Homo sapiens
cagatcatctgttac

SEQ ID NO: 99528 - DNA, 15 bp, Homo sapiens
acagatcatctgtta

SEQ ID NO: 99529 - DNA, 15 bp, Homo sapiens
tacagatcatctgtt

SEQ ID NO: 99530 - DNA, 15 bp, Homo sapiens
ctacagatcatctgt

SEQ ID NO: 99531 - DNA, 15 bp, Homo sapiens
cctacagatcatctg

SEQ ID NO: 99532 - DNA, 15 bp, Homo sapiens
ccctacagatcatct

SEQ ID NO: 99533 - DNA, 15 bp, Homo sapiens
gccctacagatcatc

SEQ ID NO: 99534 - DNA, 15 bp, Homo sapiens
ggccctacagatcat

SEQ ID NO: 99535 - DNA, 15 bp, Homo sapiens
aggccctacagatca

SEQ ID NO: 99536 - DNA, 15 bp, Homo sapiens
taggccctacagatc

SEQ ID NO: 99537 - DNA, 15 bp, Homo sapiens
ataggccctacagat

SEQ ID NO: 99538 - DNA, 15 bp, Homo sapiens
aataggccctacaga

SEQ ID NO: 99539 - DNA, 15 bp, Homo sapiens
gaataggccctacag

SEQ ID NO: 99540 - DNA, 15 bp, Homo sapiens
ggaataggccctaca

SEQ ID NO: 99541 - DNA, 15 bp, Homo sapiens
tggaataggccctac

SEQ ID NO: 99542 - DNA, 15 bp, Homo sapiens
ctggaataggcccta

SEQ ID NO: 99543 - DNA, 15 bp, Homo sapiens
actggaataggccct

SEQ ID NO: 99544 - DNA, 15 bp, Homo sapiens
gactggaataggccc

SEQ ID NO: 99545 - DNA, 15 bp, Homo sapiens
ggactggaataggcc

SEQ ID NO: 99546 - DNA, 15 bp, Homo sapiens
tggactggaataggc

SEQ ID NO: 99547 - DNA, 15 bp, Homo sapiens
ttggactggaatagg

SEQ ID NO: 99548 - DNA, 15 bp, Homo sapiens
tttggactggaatag

SEQ ID NO: 99549 - DNA, 15 bp, Homo sapiens
ttttggactggaata

SEQ ID NO: 99550 - DNA, 15 bp, Homo sapiens
tttttggactggaat

SEQ ID NO: 99551 - DNA, 15 bp, Homo sapiens
atttttggactggaa

SEQ ID NO: 99552 - DNA, 15 bp, Homo sapiens
aatttttggactgga

SEQ ID NO: 99553 - DNA, 15 bp, Homo sapiens
caatttttggactgg

SEQ ID NO: 99554 - DNA, 15 bp, Homo sapiens
gcaatttttggactg

SEQ ID NO: 99555 - DNA, 15 bp, Homo sapiens
tgcaatttttggact

SEQ ID NO: 99556 - DNA, 15 bp, Homo sapiens
ctgcaatttttggac

SEQ ID NO: 99557 - DNA, 15 bp, Homo sapiens
tctgcaatttttgga

SEQ ID NO: 99558 - DNA, 15 bp, Homo sapiens
ctctgcaatttttgg

SEQ ID NO: 99559 - DNA, 15 bp, Homo sapiens
gctctgcaatttttg

SEQ ID NO: 99560 - DNA, 15 bp, Homo sapiens
tgctctgcaattttt

SEQ ID NO: 99561 - DNA, 15 bp, Homo sapiens
gtgctctgcaatttt

SEQ ID NO: 99562 - DNA, 15 bp, Homo sapiens
tgtgctctgcaattt

SEQ ID NO: 99563 - DNA, 15 bp, Homo sapiens
atgtgctctgcaatt

SEQ ID NO: 99564 - DNA, 15 bp, Homo sapiens
aatgtgctctgcaat

SEQ ID NO: 99565 - DNA, 15 bp, Homo sapiens
aaatgtgctctgcaa

SEQ ID NO: 99566 - DNA, 15 bp, Homo sapiens
gaaatgtgctctgca

SEQ ID NO: 99567 - DNA, 15 bp, Homo sapiens
tgaaatgtgctctgc

SEQ ID NO: 99568 - DNA, 15 bp, Homo sapiens
ttgaaatgtgctctg

SEQ ID NO: 99569 - DNA, 15 bp, Homo sapiens
cttgaaatgtgctct

SEQ ID NO: 99570 - DNA, 15 bp, Homo sapiens
gcttgaaatgtgctc

SEQ ID NO: 99571 - DNA, 15 bp, Homo sapiens
ggcttgaaatgtgct

SEQ ID NO: 99572 - DNA, 15 bp, Homo sapiens
aggcttgaaatgtgc

SEQ ID NO: 99573 - DNA, 15 bp, Homo sapiens
gaggcttgaaatgtg

SEQ ID NO: 99574 - DNA, 15 bp, Homo sapiens
agaggcttgaaatgt

SEQ ID NO: 99575 - DNA, 15 bp, Homo sapiens
gagaggcttgaaatg

SEQ ID NO: 99576 - DNA, 15 bp, Homo sapiens
agagaggcttgaaat

SEQ ID NO: 99577 - DNA, 15 bp, Homo sapiens
aagagaggcttgaaa

SEQ ID NO: 99578 - DNA, 15 bp, Homo sapiens
aaagagaggcttgaa

SEQ ID NO: 99579 - DNA, 15 bp, Homo sapiens
aaaagagaggcttga

SEQ ID NO: 99580 - DNA, 15 bp, Homo sapiens
caaaagagaggcttg

SEQ ID NO: 99581 - DNA, 15 bp, Homo sapiens
acaaaagagaggctt

SEQ ID NO: 99582 - DNA, 15 bp, Homo sapiens
aacaaaagagaggct

SEQ ID NO: 99583 - DNA, 15 bp, Homo sapiens
aaacaaaagagaggc

SEQ ID NO: 99584 - DNA, 15 bp, Homo sapiens
aaaacaaaagagagg

SEQ ID NO: 99585 - DNA, 15 bp, Homo sapiens
caaaacaaaagagag

SEQ ID NO: 99586 - DNA, 15 bp, Homo sapiens
acaaaacaaaagaga

SEQ ID NO: 99587 - DNA, 15 bp, Homo sapiens
aacaaaacaaaagag

SEQ ID NO: 99588 - DNA, 15 bp, Homo sapiens
aaacaaaacaaaaga

SEQ ID NO: 99589 - DNA, 15 bp, Homo sapiens
aaaacaaaacaaaag

SEQ ID NO: 99590 - DNA, 15 bp, Homo sapiens
gcaaaacaaaacaaa

SEQ ID NO: 99591 - DNA, 15 bp, Homo sapiens
ggcaaaacaaaacaa

SEQ ID NO: 99592 - DNA, 15 bp, Homo sapiens
aggcaaaacaaaaca

SEQ ID NO: 99593 - DNA, 15 bp, Homo sapiens
caggcaaaacaaaac

SEQ ID NO: 99594 - DNA, 15 bp, Homo sapiens
ccaggcaaaacaaaa

SEQ ID NO: 99595 - DNA, 15 bp, Homo sapiens
accaggcaaaacaaa

SEQ ID NO: 99596 - DNA, 15 bp, Homo sapiens
aaccaggcaaaacaa

SEQ ID NO: 99597 - DNA, 15 bp, Homo sapiens
caaccaggcaaaaca

SEQ ID NO: 99598 - DNA, 15 bp, Homo sapiens
tcaaccaggcaaaac

SEQ ID NO: 99599 - DNA, 15 bp, Homo sapiens
ctcaaccaggcaaaa

SEQ ID NO: 99600 - DNA, 15 bp, Homo sapiens
actcaaccaggcaaa

SEQ ID NO: 99601 - DNA, 15 bp, Homo sapiens
tactcaaccaggcaa

SEQ ID NO: 99602 - DNA, 15 bp, Homo sapiens
gtactcaaccaggca

SEQ ID NO: 99603 - DNA, 15 bp, Homo sapiens
tgtactcaaccaggc

SEQ ID NO: 99604 - DNA, 15 bp, Homo sapiens
atgtactcaaccagg

SEQ ID NO: 99605 - DNA, 15 bp, Homo sapiens
tatgtactcaaccag

SEQ ID NO: 99606 - DNA, 15 bp, Homo sapiens
ctatgtactcaacca

SEQ ID NO: 99607 - DNA, 15 bp, Homo sapiens
tctatgtactcaacc

SEQ ID NO: 99608 - DNA, 15 bp, Homo sapiens
ctctatgtactcaac

SEQ ID NO: 99609 - DNA, 15 bp, Homo sapiens
tctctatgtactcaa

SEQ ID NO: 99610 - DNA, 15 bp, Homo sapiens
ctctctatgtactca

SEQ ID NO: 99611 - DNA, 15 bp, Homo sapiens
cctctctatgtactc

SEQ ID NO: 99612 - DNA, 15 bp, Homo sapiens
tcctctctatgtact

SEQ ID NO: 99613 - DNA, 15 bp, Homo sapiens
ttcctctctatgtac

SEQ ID NO: 99614 - DNA, 15 bp, Homo sapiens
attcctctctatgta

SEQ ID NO: 99615 - DNA, 15 bp, Homo sapiens
aattcctctctatgt

SEQ ID NO: 99616 - DNA, 15 bp, Homo sapiens
taattcctctctatg

SEQ ID NO: 99617 - DNA, 15 bp, Homo sapiens
ataattcctctctat

SEQ ID NO: 99618 - DNA, 15 bp, Homo sapiens
aataattcctctcta

SEQ ID NO: 99619 - DNA, 15 bp, Homo sapiens
aaataattcctctct

SEQ ID NO: 99620 - DNA, 15 bp, Homo sapiens
aaaataattcctctc

SEQ ID NO: 99621 - DNA, 15 bp, Homo sapiens
gaaaataattcctct

SEQ ID NO: 99622 - DNA, 15 bp, Homo sapiens
agaaaataattcctc

SEQ ID NO: 99623 - DNA, 15 bp, Homo sapiens
aagaaaataattcct

SEQ ID NO: 99624 - DNA, 15 bp, Homo sapiens
aaagaaaataattcc

SEQ ID NO: 99625 - DNA, 15 bp, Homo sapiens
aaaagaaaataattc

SEQ ID NO: 99626 - DNA, 15 bp, Homo sapiens
caaaagaaaataatt

SEQ ID NO: 99627 - DNA, 15 bp, Homo sapiens
tcaaaagaaaataat

SEQ ID NO: 99628 - DNA, 15 bp, Homo sapiens
ctcaaaagaaaataa

SEQ ID NO: 99629 - DNA, 15 bp, Homo sapiens
actcaaaagaaaata

SEQ ID NO: 99630 - DNA, 15 bp, Homo sapiens
cactcaaaagaaaat

SEQ ID NO: 99631 - DNA, 15 bp, Homo sapiens
ccactcaaaagaaaa

SEQ ID NO: 99632 - DNA, 15 bp, Homo sapiens
accactcaaaagaaa

SEQ ID NO: 99633 - DNA, 15 bp, Homo sapiens
caccactcaaaagaa

SEQ ID NO: 99634 - DNA, 15 bp, Homo sapiens
acaccactcaaaaga

SEQ ID NO: 99635 - DNA, 15 bp, Homo sapiens
gacaccactcaaaag

SEQ ID NO: 99636 - DNA, 15 bp, Homo sapiens
agacaccactcaaaa

SEQ ID NO: 99637 - DNA, 15 bp, Homo sapiens
tagacaccactcaaa

SEQ ID NO: 99638 - DNA, 15 bp, Homo sapiens
ttagacaccactcaa

SEQ ID NO: 99639 - DNA, 15 bp, Homo sapiens
tttagacaccactca

SEQ ID NO: 99640 - DNA, 15 bp, Homo sapiens
ctttagacaccactc

SEQ ID NO: 99641 - DNA, 15 bp, Homo sapiens
actttagacaccact

SEQ ID NO: 99642 - DNA, 15 bp, Homo sapiens
aactttagacaccac

SEQ ID NO: 99643 - DNA, 15 bp, Homo sapiens
gaactttagacacca

SEQ ID NO: 99644 - DNA, 15 bp, Homo sapiens
tgaactttagacacc

SEQ ID NO: 99645 - DNA, 15 bp, Homo sapiens
ttgaactttagacac

SEQ ID NO: 99646 - DNA, 15 bp, Homo sapiens
cttgaactttagaca

SEQ ID NO: 99647 - DNA, 15 bp, Homo sapiens
tcttgaactttagac

SEQ ID NO: 99648 - DNA, 15 bp, Homo sapiens
ctcttgaactttaga

SEQ ID NO: 99649 - DNA, 15 bp, Homo sapiens
actcttgaactttag

SEQ ID NO: 99650 - DNA, 15 bp, Homo sapiens
gactcttgaacttta

SEQ ID NO: 99651 - DNA, 15 bp, Homo sapiens
tgactcttgaacttt

SEQ ID NO: 99652 - DNA, 15 bp, Homo sapiens
gtgactcttgaactt

SEQ ID NO: 99653 - DNA, 15 bp, Homo sapiens
ggtgactcttgaact

SEQ ID NO: 99654 - DNA, 15 bp, Homo sapiens
aggtgactcttgaac

SEQ ID NO: 99655 - DNA, 15 bp, Homo sapiens
caggtgactcttgaa

SEQ ID NO: 99656 - DNA, 15 bp, Homo sapiens
tcaggtgactcttga

SEQ ID NO: 99657 - DNA, 15 bp, Homo sapiens
ttcaggtgactcttg

SEQ ID NO: 99658 - DNA, 15 bp, Homo sapiens
cttcaggtgactctt

SEQ ID NO: 99659 - DNA, 15 bp, Homo sapiens
ccttcaggtgactct

SEQ ID NO: 99660 - DNA, 15 bp, Homo sapiens
tccttcaggtgactc

SEQ ID NO: 99661 - DNA, 15 bp, Homo sapiens
ttccttcaggtgact

SEQ ID NO: 99662 - DNA, 15 bp, Homo sapiens
tttccttcaggtgac

SEQ ID NO: 99663 - DNA, 15 bp, Homo sapiens
ttttccttcaggtga

SEQ ID NO: 99664 - DNA, 15 bp, Homo sapiens
tttttccttcaggtg

SEQ ID NO: 99665 - DNA, 15 bp, Homo sapiens
atttttccttcaggt

SEQ ID NO: 99666 - DNA, 15 bp, Homo sapiens
tatttttccttcagg

SEQ ID NO: 99667 - DNA, 15 bp, Homo sapiens
ctatttttccttcag

SEQ ID NO: 99668 - DNA, 15 bp, Homo sapiens
tctatttttccttca

SEQ ID NO: 99669 - DNA, 15 bp, Homo sapiens
ttctatttttccttc

SEQ ID NO: 99670 - DNA, 15 bp, Homo sapiens
gttctatttttcctt

SEQ ID NO: 99671 - DNA, 15 bp, Homo sapiens
agttctatttttcct

SEQ ID NO: 99672 - DNA, 15 bp, Homo sapiens
aagttctatttttcc

SEQ ID NO: 99673 - DNA, 15 bp, Homo sapiens
taagttctatttttc

SEQ ID NO: 99674 - DNA, 15 bp, Homo sapiens
ttaagttctattttt

SEQ ID NO: 99675 - DNA, 15 bp, Homo sapiens
tttaagttctatttt

SEQ ID NO: 99676 - DNA, 15 bp, Homo sapiens
atttaagttctattt

SEQ ID NO: 99677 - DNA, 15 bp, Homo sapiens
tatttaagttctatt

SEQ ID NO: 99678 - DNA, 15 bp, Homo sapiens
atatttaagttctat

SEQ ID NO: 99679 - DNA, 15 bp, Homo sapiens
catatttaagttcta

SEQ ID NO: 99680 - DNA, 15 bp, Homo sapiens
acatatttaagttct

SEQ ID NO: 99681 - DNA, 15 bp, Homo sapiens
cacatatttaagttc

SEQ ID NO: 99682 - DNA, 15 bp, Homo sapiens
tcacatatttaagtt

SEQ ID NO: 99683 - DNA, 15 bp, Homo sapiens
gtcacatatttaagt

SEQ ID NO: 99684 - DNA, 15 bp, Homo sapiens
tgtcacatatttaag

SEQ ID NO: 99685 - DNA, 15 bp, Homo sapiens
ctgtcacatatttaa

SEQ ID NO: 99686 - DNA, 15 bp, Homo sapiens
actgtcacatattta

SEQ ID NO: 99687 - DNA, 15 bp, Homo sapiens
aactgtcacatattt

SEQ ID NO: 99688 - DNA, 15 bp, Homo sapiens
aaactgtcacatatt

SEQ ID NO: 99689 - DNA, 15 bp, Homo sapiens
aaaactgtcacatat

SEQ ID NO: 99690 - DNA, 15 bp, Homo sapiens
taaaactgtcacata

SEQ ID NO: 99691 - DNA, 15 bp, Homo sapiens
gtaaaactgtcacat

SEQ ID NO: 99692 - DNA, 15 bp, Homo sapiens
agtaaaactgtcaca

SEQ ID NO: 99693 - DNA, 15 bp, Homo sapiens
cagtaaaactgtcac

SEQ ID NO: 99694 - DNA, 15 bp, Homo sapiens
ccagtaaaactgtca

SEQ ID NO: 99695 - DNA, 15 bp, Homo sapiens
cccagtaaaactgtc

SEQ ID NO: 99696 - DNA, 15 bp, Homo sapiens
acccagtaaaactgt

SEQ ID NO: 99697 - DNA, 15 bp, Homo sapiens
gacccagtaaaactg

SEQ ID NO: 99698 - DNA, 15 bp, Homo sapiens
agacccagtaaaact

SEQ ID NO: 99699 - DNA, 15 bp, Homo sapiens
aagacccagtaaaac

SEQ ID NO: 99700 - DNA, 15 bp, Homo sapiens
taagacccagtaaaa

SEQ ID NO: 99701 - DNA, 15 bp, Homo sapiens
ctaagacccagtaaa

SEQ ID NO: 99702 - DNA, 15 bp, Homo sapiens
tctaagacccagtaa

SEQ ID NO: 99703 - DNA, 15 bp, Homo sapiens
atctaagacccagta

SEQ ID NO: 99704 - DNA, 15 bp, Homo sapiens
tatctaagacccagt

SEQ ID NO: 99705 - DNA, 15 bp, Homo sapiens
ttatctaagacccag

SEQ ID NO: 99706 - DNA, 15 bp, Homo sapiens
tttatctaagaccca

SEQ ID NO: 99707 - DNA, 15 bp, Homo sapiens
ttttatctaagaccc

SEQ ID NO: 99708 - DNA, 15 bp, Homo sapiens
attttatctaagacc

SEQ ID NO: 99709 - DNA, 15 bp, Homo sapiens
tattttatctaagac

SEQ ID NO: 99710 - DNA, 15 bp, Homo sapiens
gtattttatctaaga

SEQ ID NO: 99711 - DNA, 15 bp, Homo sapiens
ggtattttatctaag

SEQ ID NO: 99712 - DNA, 15 bp, Homo sapiens
aggtattttatctaa

SEQ ID NO: 99713 - DNA, 15 bp, Homo sapiens
aaggtattttatcta

SEQ ID NO: 99714 - DNA, 15 bp, Homo sapiens
aaaggtattttatct

SEQ ID NO: 99715 - DNA, 15 bp, Homo sapiens
aaaaggtattttatc

SEQ ID NO: 99716 - DNA, 15 bp, Homo sapiens
aaaaaggtattttat

SEQ ID NO: 99717 - DNA, 15 bp, Homo sapiens
aaaaaaggtatttta

SEQ ID NO: 99718 - DNA, 15 bp, Homo sapiens
aaaaaaaggtatttt

SEQ ID NO: 99719 - DNA, 15 bp, Homo sapiens
aaaaaaaaggtattt

SEQ ID NO: 99720 - DNA, 15 bp, Homo sapiens
aaaaaaaaaggtatt

SEQ ID NO: 99721 - DNA, 15 bp, Homo sapiens
aaaaaaaaaaggtat

SEQ ID NO: 99722 - DNA, 15 bp, Homo sapiens
gaaaaaaaaaaggta

SEQ ID NO: 99723 - DNA, 15 bp, Homo sapiens
agaaaaaaaaaaggt

SEQ ID NO: 99724 - DNA, 15 bp, Homo sapiens
gagaaaaaaaaaagg

SEQ ID NO: 99725 - DNA, 15 bp, Homo sapiens
gggagaaaaaaaaaa

SEQ ID NO: 99726 - DNA, 15 bp, Homo sapiens
agggagaaaaaaaaa

SEQ ID NO: 99727 - DNA, 15 bp, Homo sapiens
cagggagaaaaaaaa

SEQ ID NO: 99728 - DNA, 15 bp, Homo sapiens
ccagggagaaaaaaa

SEQ ID NO: 99729 - DNA, 15 bp, Homo sapiens
gccagggagaaaaaa

SEQ ID NO: 99730 - DNA, 15 bp, Homo sapiens
ggccagggagaaaaa

SEQ ID NO: 99731 - DNA, 15 bp, Homo sapiens
tggccagggagaaaa

SEQ ID NO: 99732 - DNA, 15 bp, Homo sapiens
atggccagggagaaa

SEQ ID NO: 99733 - DNA, 15 bp, Homo sapiens
aatggccagggagaa

SEQ ID NO: 99734 - DNA, 15 bp, Homo sapiens
taatggccagggaga

SEQ ID NO: 99735 - DNA, 15 bp, Homo sapiens
gtaatggccagggag

SEQ ID NO: 99736 - DNA, 15 bp, Homo sapiens
tgtaatggccaggga

SEQ ID NO: 99737 - DNA, 15 bp, Homo sapiens
gtgtaatggccaggg

SEQ ID NO: 99738 - DNA, 15 bp, Homo sapiens
cgtgtaatggccagg

SEQ ID NO: 99739 - DNA, 15 bp, Homo sapiens
acgtgtaatggccag

SEQ ID NO: 99740 - DNA, 15 bp, Homo sapiens
tacgtgtaatggcca

SEQ ID NO: 99741 - DNA, 15 bp, Homo sapiens
ttacgtgtaatggcc

SEQ ID NO: 99742 - DNA, 15 bp, Homo sapiens
tttacgtgtaatggc

SEQ ID NO: 99743 - DNA, 15 bp, Homo sapiens
ttttacgtgtaatgg

SEQ ID NO: 99744 - DNA, 15 bp, Homo sapiens
attttacgtgtaatg

SEQ ID NO: 99745 - DNA, 15 bp, Homo sapiens
cattttacgtgtaat

SEQ ID NO: 99746 - DNA, 15 bp, Homo sapiens
acattttacgtgtaa

SEQ ID NO: 99747 - DNA, 15 bp, Homo sapiens
tacattttacgtgta

SEQ ID NO: 99748 - DNA, 15 bp, Homo sapiens
ctacattttacgtgt

SEQ ID NO: 99749 - DNA, 15 bp, Homo sapiens
tctacattttacgtg

SEQ ID NO: 99750 - DNA, 15 bp, Homo sapiens
atctacattttacgt

SEQ ID NO: 99751 - DNA, 15 bp, Homo sapiens
catctacattttacg

SEQ ID NO: 99752 - DNA, 15 bp, Homo sapiens
tcatctacattttac

SEQ ID NO: 99753 - DNA, 15 bp, Homo sapiens
ctcatctacatttta

SEQ ID NO: 99754 - DNA, 15 bp, Homo sapiens
actcatctacatttt

SEQ ID NO: 99755 - DNA, 15 bp, Homo sapiens
gactcatctacattt

SEQ ID NO: 99756 - DNA, 15 bp, Homo sapiens
agactcatctacatt

SEQ ID NO: 99757 - DNA, 15 bp, Homo sapiens
tagactcatctacat

SEQ ID NO: 99758 - DNA, 15 bp, Homo sapiens
atagactcatctaca

SEQ ID NO: 99759 - DNA, 15 bp, Homo sapiens
catagactcatctac

SEQ ID NO: 99760 - DNA, 15 bp, Homo sapiens
tcatagactcatcta

SEQ ID NO: 99761 - DNA, 15 bp, Homo sapiens
ttcatagactcatct

SEQ ID NO: 99762 - DNA, 15 bp, Homo sapiens
tttcatagactcatc

SEQ ID NO: 99763 - DNA, 15 bp, Homo sapiens
atttcatagactcat

SEQ ID NO: 99764 - DNA, 15 bp, Homo sapiens
aatttcatagactca

SEQ ID NO: 99765 - DNA, 15 bp, Homo sapiens
aaatttcatagactc

SEQ ID NO: 99766 - DNA, 15 bp, Homo sapiens
aaaatttcatagact

SEQ ID NO: 99767 - DNA, 15 bp, Homo sapiens
aaaaatttcatagac

SEQ ID NO: 99768 - DNA, 15 bp, Homo sapiens
aaaaaatttcataga

SEQ ID NO: 99769 - DNA, 15 bp, Homo sapiens
aaaaaaatttcatag

SEQ ID NO: 99770 - DNA, 15 bp, Homo sapiens
taaaaaaatttcata

SEQ ID NO: 99771 - DNA, 15 bp, Homo sapiens
ttaaaaaaatttcat

SEQ ID NO: 99772 - DNA, 15 bp, Homo sapiens
tttaaaaaaatttca

SEQ ID NO: 99773 - DNA, 15 bp, Homo sapiens
gtttaaaaaaatttc

SEQ ID NO: 99774 - DNA, 15 bp, Homo sapiens
agtttaaaaaaattt

SEQ ID NO: 99775 - DNA, 15 bp, Homo sapiens
tagtttaaaaaaatt

SEQ ID NO: 99776 - DNA, 15 bp, Homo sapiens
ttagtttaaaaaaat

SEQ ID NO: 99777 - DNA, 15 bp, Homo sapiens
cttagtttaaaaaaa

SEQ ID NO: 99778 - DNA, 15 bp, Homo sapiens
tcttagtttaaaaaa

SEQ ID NO: 99779 - DNA, 15 bp, Homo sapiens
ctcttagtttaaaaa

SEQ ID NO: 99780 - DNA, 15 bp, Homo sapiens
actcttagtttaaaa

SEQ ID NO: 99781 - DNA, 15 bp, Homo sapiens
cactcttagtttaaa

SEQ ID NO: 99782 - DNA, 15 bp, Homo sapiens
tcactcttagtttaa

SEQ ID NO: 99783 - DNA, 15 bp, Homo sapiens
ctcactcttagttta

SEQ ID NO: 99784 - DNA, 15 bp, Homo sapiens
cctcactcttagttt

SEQ ID NO: 99785 - DNA, 15 bp, Homo sapiens
acctcactcttagtt

SEQ ID NO: 99786 - DNA, 15 bp, Homo sapiens
aacctcactcttagt

SEQ ID NO: 99787 - DNA, 15 bp, Homo sapiens
aaacctcactcttag

SEQ ID NO: 99788 - DNA, 15 bp, Homo sapiens
aaaacctcactctta

SEQ ID NO: 99789 - DNA, 15 bp, Homo sapiens
caaaacctcactctt

SEQ ID NO: 99790 - DNA, 15 bp, Homo sapiens
gcaaaacctcactct

SEQ ID NO: 99791 - DNA, 15 bp, Homo sapiens
agcaaaacctcactc

SEQ ID NO: 99792 - DNA, 15 bp, Homo sapiens
aagcaaaacctcact

SEQ ID NO: 99793 - DNA, 15 bp, Homo sapiens
caagcaaaacctcac

SEQ ID NO: 99794 - DNA, 15 bp, Homo sapiens
acaagcaaaacctca

SEQ ID NO: 99795 - DNA, 15 bp, Homo sapiens
aacaagcaaaacctc

SEQ ID NO: 99796 - DNA, 15 bp, Homo sapiens
aaacaagcaaaacct

SEQ ID NO: 99797 - DNA, 15 bp, Homo sapiens
caaacaagcaaaacc

SEQ ID NO: 99798 - DNA, 15 bp, Homo sapiens
acaaacaagcaaaac

SEQ ID NO: 99799 - DNA, 15 bp, Homo sapiens
aacaaacaagcaaaa

SEQ ID NO: 99800 - DNA, 15 bp, Homo sapiens
aaacaaacaagcaaa

SEQ ID NO: 99801 - DNA, 15 bp, Homo sapiens
aaaacaaacaagcaa

SEQ ID NO: 99802 - DNA, 15 bp, Homo sapiens
aaaaacaaacaagca

SEQ ID NO: 99803 - DNA, 15 bp, Homo sapiens
taaaaacaaacaagc

SEQ ID NO: 99804 - DNA, 15 bp, Homo sapiens
ataaaaacaaacaag

SEQ ID NO: 99805 - DNA, 15 bp, Homo sapiens
tataaaaacaaacaa

SEQ ID NO: 99806 - DNA, 15 bp, Homo sapiens
ctataaaaacaaaca

SEQ ID NO: 99807 - DNA, 15 bp, Homo sapiens
actataaaaacaaac

SEQ ID NO: 99808 - DNA, 15 bp, Homo sapiens
tactataaaaacaaa

SEQ ID NO: 99809 - DNA, 15 bp, Homo sapiens
ctactataaaaacaa

SEQ ID NO: 99810 - DNA, 15 bp, Homo sapiens
actactataaaaaca

SEQ ID NO: 99811 - DNA, 15 bp, Homo sapiens
tactactataaaaac

SEQ ID NO: 99812 - DNA, 15 bp, Homo sapiens
atactactataaaaa

SEQ ID NO: 99813 - DNA, 15 bp, Homo sapiens
catactactataaaa

SEQ ID NO: 99814 - DNA, 15 bp, Homo sapiens
tcatactactataaa

SEQ ID NO: 99815 - DNA, 15 bp, Homo sapiens
gtcatactactataa

SEQ ID NO: 99816 - DNA, 15 bp, Homo sapiens
agtcatactactata

SEQ ID NO: 99817 - DNA, 15 bp, Homo sapiens
aagtcatactactat

SEQ ID NO: 99818 - DNA, 15 bp, Homo sapiens
aaagtcatactacta

SEQ ID NO: 99819 - DNA, 15 bp, Homo sapiens
aaaagtcatactact

SEQ ID NO: 99820 - DNA, 15 bp, Homo sapiens
caaaagtcatactac

SEQ ID NO: 99821 - DNA, 15 bp, Homo sapiens
acaaaagtcatacta

SEQ ID NO: 99822 - DNA, 15 bp, Homo sapiens
aacaaaagtcatact

SEQ ID NO: 99823 - DNA, 15 bp, Homo sapiens
taacaaaagtcatac

SEQ ID NO: 99824 - DNA, 15 bp, Homo sapiens
ataacaaaagtcata

SEQ ID NO: 99825 - DNA, 15 bp, Homo sapiens
aataacaaaagtcat

SEQ ID NO: 99826 - DNA, 15 bp, Homo sapiens
caataacaaaagtca

SEQ ID NO: 99827 - DNA, 15 bp, Homo sapiens
gcaataacaaaagtc

SEQ ID NO: 99828 - DNA, 15 bp, Homo sapiens
agcaataacaaaagt

SEQ ID NO: 99829 - DNA, 15 bp, Homo sapiens
aagcaataacaaaag

SEQ ID NO: 99830 - DNA, 15 bp, Homo sapiens
caagcaataacaaaa

SEQ ID NO: 99831 - DNA, 15 bp, Homo sapiens
acaagcaataacaaa

SEQ ID NO: 99832 - DNA, 15 bp, Homo sapiens
aacaagcaataacaa

SEQ ID NO: 99833 - DNA, 15 bp, Homo sapiens
caacaagcaataaca

SEQ ID NO: 99834 - DNA, 15 bp, Homo sapiens
ccaacaagcaataac

SEQ ID NO: 99835 - DNA, 15 bp, Homo sapiens
tccaacaagcaataa

SEQ ID NO: 99836 - DNA, 15 bp, Homo sapiens
ttccaacaagcaata

SEQ ID NO: 99837 - DNA, 15 bp, Homo sapiens
cttccaacaagcaat

SEQ ID NO: 99838 - DNA, 15 bp, Homo sapiens
tcttccaacaagcaa

SEQ ID NO: 99839 - DNA, 15 bp, Homo sapiens
atcttccaacaagca

SEQ ID NO: 99840 - DNA, 15 bp, Homo sapiens
aatcttccaacaagc

SEQ ID NO: 99841 - DNA, 15 bp, Homo sapiens
aaatcttccaacaag

SEQ ID NO: 99842 - DNA, 15 bp, Homo sapiens
taaatcttccaacaa

SEQ ID NO: 99843 - DNA, 15 bp, Homo sapiens
ttaaatcttccaaca

SEQ ID NO: 99844 - DNA, 15 bp, Homo sapiens
cttaaatcttccaac

SEQ ID NO: 99845 - DNA, 15 bp, Homo sapiens
tcttaaatcttccaa

SEQ ID NO: 99846 - DNA, 15 bp, Homo sapiens
ttcttaaatcttcca

SEQ ID NO: 99847 - DNA, 15 bp, Homo sapiens
cttcttaaatcttcc

SEQ ID NO: 99848 - DNA, 15 bp, Homo sapiens
ccttcttaaatcttc

SEQ ID NO: 99849 - DNA, 15 bp, Homo sapiens
gccttcttaaatctt

SEQ ID NO: 99850 - DNA, 15 bp, Homo sapiens
agccttcttaaatct

SEQ ID NO: 99851 - DNA, 15 bp, Homo sapiens
aagccttcttaaatc

SEQ ID NO: 99852 - DNA, 15 bp, Homo sapiens
aaagccttcttaaat

SEQ ID NO: 99853 - DNA, 15 bp, Homo sapiens
gaaagccttcttaaa

SEQ ID NO: 99854 - DNA, 15 bp, Homo sapiens
tgaaagccttcttaa

SEQ ID NO: 99855 - DNA, 15 bp, Homo sapiens
ttgaaagccttctta

SEQ ID NO: 99856 - DNA, 15 bp, Homo sapiens
attgaaagccttctt

SEQ ID NO: 99857 - DNA, 15 bp, Homo sapiens
aattgaaagccttct

SEQ ID NO: 99858 - DNA, 15 bp, Homo sapiens
aaattgaaagccttc

SEQ ID NO: 99859 - DNA, 15 bp, Homo sapiens
taaattgaaagcctt

SEQ ID NO: 99860 - DNA, 15 bp, Homo sapiens
gtaaattgaaagcct

SEQ ID NO: 99861 - DNA, 15 bp, Homo sapiens
tgtaaattgaaagcc

SEQ ID NO: 99862 - DNA, 15 bp, Homo sapiens
ttgtaaattgaaagc

SEQ ID NO: 99863 - DNA, 15 bp, Homo sapiens
gttgtaaattgaaag

SEQ ID NO: 99864 - DNA, 15 bp, Homo sapiens
tgttgtaaattgaaa

SEQ ID NO: 99865 - DNA, 15 bp, Homo sapiens
ttgttgtaaattgaa

SEQ ID NO: 99866 - DNA, 15 bp, Homo sapiens
attgttgtaaattga

SEQ ID NO: 99867 - DNA, 15 bp, Homo sapiens
aattgttgtaaattg

SEQ ID NO: 99868 - DNA, 15 bp, Homo sapiens
aaattgttgtaaatt

SEQ ID NO: 99869 - DNA, 15 bp, Homo sapiens
taaattgttgtaaat

SEQ ID NO: 99870 - DNA, 15 bp, Homo sapiens
ttaaattgttgtaaa

SEQ ID NO: 99871 - DNA, 15 bp, Homo sapiens
attaaattgttgtaa

SEQ ID NO: 99872 - DNA, 15 bp, Homo sapiens
aattaaattgttgta

SEQ ID NO: 99873 - DNA, 15 bp, Homo sapiens
aaattaaattgttgt

SEQ ID NO: 99874 - DNA, 15 bp, Homo sapiens
taaattaaattgttg

SEQ ID NO: 99875 - DNA, 15 bp, Homo sapiens
gtaaattaaattgtt

SEQ ID NO: 99876 - DNA, 15 bp, Homo sapiens
tgtaaattaaattgt

SEQ ID NO: 99877 - DNA, 15 bp, Homo sapiens
atgtaaattaaattg

SEQ ID NO: 99878 - DNA, 15 bp, Homo sapiens
aatgtaaattaaatt

SEQ ID NO: 99879 - DNA, 15 bp, Homo sapiens
gaatgtaaattaaat

SEQ ID NO: 99880 - DNA, 15 bp, Homo sapiens
tgaatgtaaattaaa

SEQ ID NO: 99881 - DNA, 15 bp, Homo sapiens
ttgaatgtaaattaa

SEQ ID NO: 99882 - DNA, 15 bp, Homo sapiens
attgaatgtaaatta

SEQ ID NO: 99883 - DNA, 15 bp, Homo sapiens
aattgaatgtaaatt

SEQ ID NO: 99884 - DNA, 15 bp, Homo sapiens
aaattgaatgtaaat

SEQ ID NO: 99885 - DNA, 15 bp, Homo sapiens
caaattgaatgtaaa

SEQ ID NO: 99886 - DNA, 15 bp, Homo sapiens
tcaaattgaatgtaa

SEQ ID NO: 99887 - DNA, 15 bp, Homo sapiens
gtcaaattgaatgta

SEQ ID NO: 99888 - DNA, 15 bp, Homo sapiens
cgtcaaattgaatgt

SEQ ID NO: 99889 - DNA, 15 bp, Homo sapiens
acgtcaaattgaatg

SEQ ID NO: 99890 - DNA, 15 bp, Homo sapiens
tacgtcaaattgaat

SEQ ID NO: 99891 - DNA, 15 bp, Homo sapiens
ttacgtcaaattgaa

SEQ ID NO: 99892 - DNA, 15 bp, Homo sapiens
tttacgtcaaattga

SEQ ID NO: 99893 - DNA, 15 bp, Homo sapiens
ttttacgtcaaattg

SEQ ID NO: 99894 - DNA, 15 bp, Homo sapiens
gttttacgtcaaatt

SEQ ID NO: 99895 - DNA, 15 bp, Homo sapiens
tgttttacgtcaaat

SEQ ID NO: 99896 - DNA, 15 bp, Homo sapiens
ttgttttacgtcaaa

SEQ ID NO: 99897 - DNA, 15 bp, Homo sapiens
tttgttttacgtcaa

SEQ ID NO: 99898 - DNA, 15 bp, Homo sapiens
atttgttttacgtca

SEQ ID NO: 99899 - DNA, 15 bp, Homo sapiens
tatttgttttacgtc

SEQ ID NO: 99900 - DNA, 15 bp, Homo sapiens
atatttgttttacgt

SEQ ID NO: 99901 - DNA, 15 bp, Homo sapiens
aatatttgttttacg

SEQ ID NO: 99902 - DNA, 15 bp, Homo sapiens
aaatatttgttttac

SEQ ID NO: 99903 - DNA, 15 bp, Homo sapiens
caaatatttgtttta

SEQ ID NO: 99904 - DNA, 15 bp, Homo sapiens
acaaatatttgtttt

SEQ ID NO: 99905 - DNA, 15 bp, Homo sapiens
tacaaatatttgttt

SEQ ID NO: 99906 - DNA, 15 bp, Homo sapiens
atacaaatatttgtt

SEQ ID NO: 99907 - DNA, 15 bp, Homo sapiens
aatacaaatatttgt

SEQ ID NO: 99908 - DNA, 15 bp, Homo sapiens
caatacaaatatttg

SEQ ID NO: 99909 - DNA, 15 bp, Homo sapiens
acaatacaaatattt

SEQ ID NO: 99910 - DNA, 15 bp, Homo sapiens
cacaatacaaatatt

SEQ ID NO: 99911 - DNA, 15 bp, Homo sapiens
ccacaatacaaatat

SEQ ID NO: 99912 - DNA, 15 bp, Homo sapiens
gccacaatacaaata

SEQ ID NO: 99913 - DNA, 15 bp, Homo sapiens
tgccacaatacaaat

SEQ ID NO: 99914 - DNA, 15 bp, Homo sapiens
ttgccacaatacaaa

SEQ ID NO: 99915 - DNA, 15 bp, Homo sapiens
tttgccacaatacaa

SEQ ID NO: 99916 - DNA, 15 bp, Homo sapiens
atttgccacaataca

SEQ ID NO: 99917 - DNA, 15 bp, Homo sapiens
gatttgccacaatac

SEQ ID NO: 99918 - DNA, 15 bp, Homo sapiens
agatttgccacaata

SEQ ID NO: 99919 - DNA, 15 bp, Homo sapiens
aagatttgccacaat

SEQ ID NO: 99920 - DNA, 15 bp, Homo sapiens
caagatttgccacaa

SEQ ID NO: 99921 - DNA, 15 bp, Homo sapiens
tcaagatttgccaca

SEQ ID NO: 99922 - DNA, 15 bp, Homo sapiens
ttcaagatttgccac

SEQ ID NO: 99923 - DNA, 15 bp, Homo sapiens
tttcaagatttgcca

SEQ ID NO: 99924 - DNA, 15 bp, Homo sapiens
atttcaagatttgcc

SEQ ID NO: 99925 - DNA, 15 bp, Homo sapiens
catttcaagatttgc

SEQ ID NO: 99926 - DNA, 15 bp, Homo sapiens
ccatttcaagatttg

SEQ ID NO: 99927 - DNA, 15 bp, Homo sapiens
accatttcaagattt

SEQ ID NO: 99928 - DNA, 15 bp, Homo sapiens
taccatttcaagatt

SEQ ID NO: 99929 - DNA, 15 bp, Homo sapiens
ttaccatttcaagat

SEQ ID NO: 99930 - DNA, 15 bp, Homo sapiens
tttaccatttcaaga

SEQ ID NO: 99931 - DNA, 15 bp, Homo sapiens
ttttaccatttcaag

SEQ ID NO: 99932 - DNA, 15 bp, Homo sapiens
tttttaccatttcaa

SEQ ID NO: 99933 - DNA, 15 bp, Homo sapiens
ttttttaccatttca

SEQ ID NO: 99934 - DNA, 15 bp, Homo sapiens
attttttaccatttc

SEQ ID NO: 99935 - DNA, 15 bp, Homo sapiens
cattttttaccattt

SEQ ID NO: 99936 - DNA, 15 bp, Homo sapiens
ccattttttaccatt

SEQ ID NO: 99937 - DNA, 15 bp, Homo sapiens
gccattttttaccat

SEQ ID NO: 99938 - DNA, 15 bp, Homo sapiens
tgccattttttacca

SEQ ID NO: 99939 - DNA, 15 bp, Homo sapiens
ttgccattttttacc

SEQ ID NO: 99940 - DNA, 15 bp, Homo sapiens
gttgccattttttac

SEQ ID NO: 99941 - DNA, 15 bp, Homo sapiens
agttgccatttttta

SEQ ID NO: 99942 - DNA, 15 bp, Homo sapiens
cagttgccatttttt

SEQ ID NO: 99943 - DNA, 15 bp, Homo sapiens
gcagttgccattttt

SEQ ID NO: 99944 - DNA, 15 bp, Homo sapiens
tgcagttgccatttt

SEQ ID NO: 99945 - DNA, 15 bp, Homo sapiens
ttgcagttgccattt

SEQ ID NO: 99946 - DNA, 15 bp, Homo sapiens
attgcagttgccatt

SEQ ID NO: 99947 - DNA, 15 bp, Homo sapiens
tattgcagttgccat

SEQ ID NO: 99948 - DNA, 15 bp, Homo sapiens
atattgcagttgcca

SEQ ID NO: 99949 - DNA, 15 bp, Homo sapiens
aatattgcagttgcc

SEQ ID NO: 99950 - DNA, 15 bp, Homo sapiens
aaatattgcagttgc

SEQ ID NO: 99951 - DNA, 15 bp, Homo sapiens
taaatattgcagttg

SEQ ID NO: 99952 - DNA, 15 bp, Homo sapiens
ttaaatattgcagtt

SEQ ID NO: 99953 - DNA, 15 bp, Homo sapiens
gttaaatattgcagt

SEQ ID NO: 99954 - DNA, 15 bp, Homo sapiens
ggttaaatattgcag

SEQ ID NO: 99955 - DNA, 15 bp, Homo sapiens
aggttaaatattgca

SEQ ID NO: 99956 - DNA, 15 bp, Homo sapiens
taggttaaatattgc

SEQ ID NO: 99957 - DNA, 15 bp, Homo sapiens
ttaggttaaatattg

SEQ ID NO: 99958 - DNA, 15 bp, Homo sapiens
tttaggttaaatatt

SEQ ID NO: 99959 - DNA, 15 bp, Homo sapiens
atttaggttaaatat

SEQ ID NO: 99960 - DNA, 15 bp, Homo sapiens
aatttaggttaaata

SEQ ID NO: 99961 - DNA, 15 bp, Homo sapiens
gaatttaggttaaat

SEQ ID NO: 99962 - DNA, 15 bp, Homo sapiens
tgaatttaggttaaa

SEQ ID NO: 99963 - DNA, 15 bp, Homo sapiens
atgaatttaggttaa

SEQ ID NO: 99964 - DNA, 15 bp, Homo sapiens
aatgaatttaggtta

SEQ ID NO: 99965 - DNA, 15 bp, Homo sapiens
gaatgaatttaggtt

SEQ ID NO: 99966 - DNA, 15 bp, Homo sapiens
tgaatgaatttaggt

SEQ ID NO: 99967 - DNA, 15 bp, Homo sapiens
atgaatgaatttagg

SEQ ID NO: 99968 - DNA, 15 bp, Homo sapiens
aatgaatgaatttag

SEQ ID NO: 99969 - DNA, 15 bp, Homo sapiens
taatgaatgaattta

SEQ ID NO: 99970 - DNA, 15 bp, Homo sapiens
gtaatgaatgaattt

SEQ ID NO: 99971 - DNA, 15 bp, Homo sapiens
agtaatgaatgaatt

SEQ ID NO: 99972 - DNA, 15 bp, Homo sapiens
aagtaatgaatgaat

SEQ ID NO: 99973 - DNA, 15 bp, Homo sapiens
aaagtaatgaatgaa

SEQ ID NO: 99974 - DNA, 15 bp, Homo sapiens
caaagtaatgaatga

SEQ ID NO: 99975 - DNA, 15 bp, Homo sapiens
tcaaagtaatgaatg

SEQ ID NO: 99976 - DNA, 15 bp, Homo sapiens
atcaaagtaatgaat

SEQ ID NO: 99977 - DNA, 15 bp, Homo sapiens
gatcaaagtaatgaa

SEQ ID NO: 99978 - DNA, 15 bp, Homo sapiens
tgatcaaagtaatga

SEQ ID NO: 99979 - DNA, 15 bp, Homo sapiens
atgatcaaagtaatg

SEQ ID NO: 99980 - DNA, 15 bp, Homo sapiens
aatgatcaaagtaat

SEQ ID NO: 99981 - DNA, 15 bp, Homo sapiens
gaatgatcaaagtaa

SEQ ID NO: 99982 - DNA, 15 bp, Homo sapiens
tgaatgatcaaagta

SEQ ID NO: 99983 - DNA, 15 bp, Homo sapiens
atgaatgatcaaagt

SEQ ID NO: 99984 - DNA, 15 bp, Homo sapiens
aatgaatgatcaaag

SEQ ID NO: 99985 - DNA, 15 bp, Homo sapiens
gaatgaatgatcaaa

SEQ ID NO: 99986 - DNA, 15 bp, Homo sapiens
tgaatgaatgatcaa

SEQ ID NO: 99987 - DNA, 15 bp, Homo sapiens
atgaatgaatgatca

SEQ ID NO: 99988 - DNA, 15 bp, Homo sapiens
aatgaatgaatgatc

SEQ ID NO: 99989 - DNA, 15 bp, Homo sapiens
aaatgaatgaatgat

SEQ ID NO: 99990 - DNA, 15 bp, Homo sapiens
caaatgaatgaatga

SEQ ID NO: 99991 - DNA, 15 bp, Homo sapiens
acaaatgaatgaatg

SEQ ID NO: 99992 - DNA, 15 bp, Homo sapiens
tacaaatgaatgaat

SEQ ID NO: 99993 - DNA, 15 bp, Homo sapiens
ttacaaatgaatgaa

SEQ ID NO: 99994 - DNA, 15 bp, Homo sapiens
tttacaaatgaatga

SEQ ID NO: 99995 - DNA, 15 bp, Homo sapiens
atttacaaatgaatg

SEQ ID NO: 99996 - DNA, 15 bp, Homo sapiens
aatttacaaatgaat

SEQ ID NO: 99997 - DNA, 15 bp, Homo sapiens
gaatttacaaatgaa

SEQ ID NO: 99998 - DNA, 15 bp, Homo sapiens
tgaatttacaaatga

SEQ ID NO: 99999 - DNA, 15 bp, Homo sapiens
atgaatttacaaatg

SEQ ID NO: 100000 - DNA, 15 bp, Homo sapiens
aatgaatttacaaat

SEQ ID NO: 100001 - DNA, 15 bp, Homo sapiens
gaatgaatttacaaa

SEQ ID NO: 100002 - DNA, 15 bp, Homo sapiens
cgaatgaatttacaa

SEQ ID NO: 100003 - DNA, 15 bp, Homo sapiens
acgaatgaatttaca

SEQ ID NO: 100004 - DNA, 15 bp, Homo sapiens
aacgaatgaatttac

SEQ ID NO: 100005 - DNA, 15 bp, Homo sapiens
aaacgaatgaattta

SEQ ID NO: 100006 - DNA, 15 bp, Homo sapiens
gaaacgaatgaattt

SEQ ID NO: 100007 - DNA, 15 bp, Homo sapiens
agaaacgaatgaatt

SEQ ID NO: 100008 - DNA, 15 bp, Homo sapiens
aagaaacgaatgaat

SEQ ID NO: 100009 - DNA, 15 bp, Homo sapiens
caagaaacgaatgaa

SEQ ID NO: 100010 - DNA, 15 bp, Homo sapiens
acaagaaacgaatga

SEQ ID NO: 100011 - DNA, 15 bp, Homo sapiens
aacaagaaacgaatg

SEQ ID NO: 100012 - DNA, 15 bp, Homo sapiens
gaacaagaaacgaat

SEQ ID NO: 100013 - DNA, 15 bp, Homo sapiens
agaacaagaaacgaa

SEQ ID NO: 100014 - DNA, 15 bp, Homo sapiens
tagaacaagaaacga

SEQ ID NO: 100015 - DNA, 15 bp, Homo sapiens
ttagaacaagaaacg

SEQ ID NO: 100016 - DNA, 15 bp, Homo sapiens
tttagaacaagaaac

SEQ ID NO: 100017 - DNA, 15 bp, Homo sapiens
gtttagaacaagaaa

SEQ ID NO: 100018 - DNA, 15 bp, Homo sapiens
ggtttagaacaagaa

SEQ ID NO: 100019 - DNA, 15 bp, Homo sapiens
tggtttagaacaaga

SEQ ID NO: 100020 - DNA, 15 bp, Homo sapiens
ttggtttagaacaag

SEQ ID NO: 100021 - DNA, 15 bp, Homo sapiens
attggtttagaacaa

SEQ ID NO: 100022 - DNA, 15 bp, Homo sapiens
aattggtttagaaca

SEQ ID NO: 100023 - DNA, 15 bp, Homo sapiens
aaattggtttagaac

SEQ ID NO: 100024 - DNA, 15 bp, Homo sapiens
aaaattggtttagaa

SEQ ID NO: 100025 - DNA, 15 bp, Homo sapiens
caaaattggtttaga

SEQ ID NO: 100026 - DNA, 15 bp, Homo sapiens
acaaaattggtttag

SEQ ID NO: 100027 - DNA, 15 bp, Homo sapiens
cacaaaattggttta

SEQ ID NO: 100028 - DNA, 15 bp, Homo sapiens
gcacaaaattggttt

SEQ ID NO: 100029 - DNA, 15 bp, Homo sapiens
agcacaaaattggtt

SEQ ID NO: 100030 - DNA, 15 bp, Homo sapiens
tagcacaaaattggt

SEQ ID NO: 100031 - DNA, 15 bp, Homo sapiens
ttagcacaaaattgg

SEQ ID NO: 100032 - DNA, 15 bp, Homo sapiens
cttagcacaaaattg

SEQ ID NO: 100033 - DNA, 15 bp, Homo sapiens
tcttagcacaaaatt

SEQ ID NO: 100034 - DNA, 15 bp, Homo sapiens
atcttagcacaaaat

SEQ ID NO: 100035 - DNA, 15 bp, Homo sapiens
tatcttagcacaaaa

SEQ ID NO: 100036 - DNA, 15 bp, Homo sapiens
ttatcttagcacaaa

SEQ ID NO: 100037 - DNA, 15 bp, Homo sapiens
tttatcttagcacaa

SEQ ID NO: 100038 - DNA, 15 bp, Homo sapiens
atttatcttagcaca

SEQ ID NO: 100039 - DNA, 15 bp, Homo sapiens
tatttatcttagcac

SEQ ID NO: 100040 - DNA, 15 bp, Homo sapiens
atatttatcttagca

SEQ ID NO: 100041 - DNA, 15 bp, Homo sapiens
tatatttatcttagc

SEQ ID NO: 100042 - DNA, 15 bp, Homo sapiens
atatatttatcttag

SEQ ID NO: 100043 - DNA, 15 bp, Homo sapiens
tatatatttatctta

SEQ ID NO: 100044 - DNA, 15 bp, Homo sapiens
atatatatttatctt

SEQ ID NO: 100045 - DNA, 15 bp, Homo sapiens
gatatatatttatct

SEQ ID NO: 100046 - DNA, 15 bp, Homo sapiens
tgatatatatttatc

SEQ ID NO: 100047 - DNA, 15 bp, Homo sapiens
atgatatatatttat

SEQ ID NO: 100048 - DNA, 15 bp, Homo sapiens
aatgatatatattta

SEQ ID NO: 100049 - DNA, 15 bp, Homo sapiens
caatgatatatattt

SEQ ID NO: 100050 - DNA, 15 bp, Homo sapiens
tcaatgatatatatt

SEQ ID NO: 100051 - DNA, 15 bp, Homo sapiens
ctcaatgatatatat

SEQ ID NO: 100052 - DNA, 15 bp, Homo sapiens
cctcaatgatatata

SEQ ID NO: 100053 - DNA, 15 bp, Homo sapiens
gcctcaatgatatat

SEQ ID NO: 100054 - DNA, 15 bp, Homo sapiens
tgcctcaatgatata

SEQ ID NO: 100055 - DNA, 15 bp, Homo sapiens
ttgcctcaatgatat

SEQ ID NO: 100056 - DNA, 15 bp, Homo sapiens
cttgcctcaatgata

SEQ ID NO: 100057 - DNA, 15 bp, Homo sapiens
acttgcctcaatgat

SEQ ID NO: 100058 - DNA, 15 bp, Homo sapiens
aacttgcctcaatga

SEQ ID NO: 100059 - DNA, 15 bp, Homo sapiens
taacttgcctcaatg

SEQ ID NO: 100060 - DNA, 15 bp, Homo sapiens
ctaacttgcctcaat

SEQ ID NO: 100061 - DNA, 15 bp, Homo sapiens
actaacttgcctcaa

SEQ ID NO: 100062 - DNA, 15 bp, Homo sapiens
tactaacttgcctca

SEQ ID NO: 100063 - DNA, 15 bp, Homo sapiens
ttactaacttgcctc

SEQ ID NO: 100064 - DNA, 15 bp, Homo sapiens
cttactaacttgcct

SEQ ID NO: 100065 - DNA, 15 bp, Homo sapiens
tcttactaacttgcc

SEQ ID NO: 100066 - DNA, 15 bp, Homo sapiens
ttcttactaacttgc

SEQ ID NO: 100067 - DNA, 15 bp, Homo sapiens
tttcttactaacttg

SEQ ID NO: 100068 - DNA, 15 bp, Homo sapiens
ctttcttactaactt

SEQ ID NO: 100069 - DNA, 15 bp, Homo sapiens
gctttcttactaact

SEQ ID NO: 100070 - DNA, 15 bp, Homo sapiens
agctttcttactaac

SEQ ID NO: 100071 - DNA, 15 bp, Homo sapiens
tagctttcttactaa

SEQ ID NO: 100072 - DNA, 15 bp, Homo sapiens
gtagctttcttacta

SEQ ID NO: 100073 - DNA, 15 bp, Homo sapiens
agtagctttcttact

SEQ ID NO: 100074 - DNA, 15 bp, Homo sapiens
aagtagctttcttac

SEQ ID NO: 100075 - DNA, 15 bp, Homo sapiens
caagtagctttctta

SEQ ID NO: 100076 - DNA, 15 bp, Homo sapiens
tcaagtagctttctt

SEQ ID NO: 100077 - DNA, 15 bp, Homo sapiens
atcaagtagctttct

SEQ ID NO: 100078 - DNA, 15 bp, Homo sapiens
aatcaagtagctttc

SEQ ID NO: 100079 - DNA, 15 bp, Homo sapiens
aaatcaagtagcttt

SEQ ID NO: 100080 - DNA, 15 bp, Homo sapiens
caaatcaagtagctt

SEQ ID NO: 100081 - DNA, 15 bp, Homo sapiens
ccaaatcaagtagct

SEQ ID NO: 100082 - DNA, 15 bp, Homo sapiens
cccaaatcaagtagc

SEQ ID NO: 100083 - DNA, 15 bp, Homo sapiens
tcccaaatcaagtag

SEQ ID NO: 100084 - DNA, 15 bp, Homo sapiens
atcccaaatcaagta

SEQ ID NO: 100085 - DNA, 15 bp, Homo sapiens
gatcccaaatcaagt

SEQ ID NO: 100086 - DNA, 15 bp, Homo sapiens
agatcccaaatcaag

SEQ ID NO: 100087 - DNA, 15 bp, Homo sapiens
cagatcccaaatcaa

SEQ ID NO: 100088 - DNA, 15 bp, Homo sapiens
acagatcccaaatca

SEQ ID NO: 100089 - DNA, 15 bp, Homo sapiens
gacagatcccaaatc

SEQ ID NO: 100090 - DNA, 15 bp, Homo sapiens
agacagatcccaaat

SEQ ID NO: 100091 - DNA, 15 bp, Homo sapiens
cagacagatcccaaa

SEQ ID NO: 100092 - DNA, 15 bp, Homo sapiens
gcagacagatcccaa

SEQ ID NO: 100093 - DNA, 15 bp, Homo sapiens
agcagacagatccca

SEQ ID NO: 100094 - DNA, 15 bp, Homo sapiens
aagcagacagatccc

SEQ ID NO: 100095 - DNA, 15 bp, Homo sapiens
gaagcagacagatcc

SEQ ID NO: 100096 - DNA, 15 bp, Homo sapiens
agaagcagacagatc

SEQ ID NO: 100097 - DNA, 15 bp, Homo sapiens
aagaagcagacagat

SEQ ID NO: 100098 - DNA, 15 bp, Homo sapiens
caagaagcagacaga

SEQ ID NO: 100099 - DNA, 15 bp, Homo sapiens
ccaagaagcagacag

SEQ ID NO: 100100 - DNA, 15 bp, Homo sapiens
tccaagaagcagaca

SEQ ID NO: 100101 - DNA, 15 bp, Homo sapiens
ttccaagaagcagac

SEQ ID NO: 100102 - DNA, 15 bp, Homo sapiens
cttccaagaagcaga

SEQ ID NO: 100103 - DNA, 15 bp, Homo sapiens
acttccaagaagcag

SEQ ID NO: 100104 - DNA, 15 bp, Homo sapiens
cacttccaagaagca

SEQ ID NO: 100105 - DNA, 15 bp, Homo sapiens
ccacttccaagaagc

SEQ ID NO: 100106 - DNA, 15 bp, Homo sapiens
accacttccaagaag

SEQ ID NO: 100107 - DNA, 15 bp, Homo sapiens
gaccacttccaagaa

SEQ ID NO: 100108 - DNA, 15 bp, Homo sapiens
agaccacttccaaga

SEQ ID NO: 100109 - DNA, 15 bp, Homo sapiens
aagaccacttccaag

SEQ ID NO: 100110 - DNA, 15 bp, Homo sapiens
gaagaccacttccaa

SEQ ID NO: 100111 - DNA, 15 bp, Homo sapiens
agaagaccacttcca

SEQ ID NO: 100112 - DNA, 15 bp, Homo sapiens
aagaagaccacttcc

SEQ ID NO: 100113 - DNA, 15 bp, Homo sapiens
aaagaagaccacttc

SEQ ID NO: 100114 - DNA, 15 bp, Homo sapiens
caaagaagaccactt

SEQ ID NO: 100115 - DNA, 15 bp, Homo sapiens
tcaaagaagaccact

SEQ ID NO: 100116 - DNA, 15 bp, Homo sapiens
ctcaaagaagaccac

SEQ ID NO: 100117 - DNA, 15 bp, Homo sapiens
actcaaagaagacca

SEQ ID NO: 100118 - DNA, 15 bp, Homo sapiens
gactcaaagaagacc

SEQ ID NO: 100119 - DNA, 15 bp, Homo sapiens
tgactcaaagaagac

SEQ ID NO: 100120 - DNA, 15 bp, Homo sapiens
atgactcaaagaaga

SEQ ID NO: 100121 - DNA, 15 bp, Homo sapiens
aatgactcaaagaag

SEQ ID NO: 100122 - DNA, 15 bp, Homo sapiens
aaatgactcaaagaa

SEQ ID NO: 100123 - DNA, 15 bp, Homo sapiens
aaaatgactcaaaga

SEQ ID NO: 100124 - DNA, 15 bp, Homo sapiens
aaaaatgactcaaag

SEQ ID NO: 100125 - DNA, 15 bp, Homo sapiens
aaaaaatgactcaaa

SEQ ID NO: 100126 - DNA, 15 bp, Homo sapiens
gaaaaaatgactcaa

SEQ ID NO: 100127 - DNA, 15 bp, Homo sapiens
agaaaaaatgactca

SEQ ID NO: 100128 - DNA, 15 bp, Homo sapiens
aagaaaaaatgactc

SEQ ID NO: 100129 - DNA, 15 bp, Homo sapiens
aaagaaaaaatgact

SEQ ID NO: 100130 - DNA, 15 bp, Homo sapiens
gaaagaaaaaatgac

SEQ ID NO: 100131 - DNA, 15 bp, Homo sapiens
ggaaagaaaaaatga

SEQ ID NO: 100132 - DNA, 15 bp, Homo sapiens
gggaaagaaaaaatg

SEQ ID NO: 100133 - DNA, 15 bp, Homo sapiens
tgggaaagaaaaaat

SEQ ID NO: 100134 - DNA, 15 bp, Homo sapiens
atgggaaagaaaaaa

SEQ ID NO: 100135 - DNA, 15 bp, Homo sapiens
tatgggaaagaaaaa

SEQ ID NO: 100136 - DNA, 15 bp, Homo sapiens
ttatgggaaagaaaa

SEQ ID NO: 100137 - DNA, 15 bp, Homo sapiens
cttatgggaaagaaa

SEQ ID NO: 100138 - DNA, 15 bp, Homo sapiens
tcttatgggaaagaa

SEQ ID NO: 100139 - DNA, 15 bp, Homo sapiens
ttcttatgggaaaga

SEQ ID NO: 100140 - DNA, 15 bp, Homo sapiens
tttcttatgggaaag

SEQ ID NO: 100141 - DNA, 15 bp, Homo sapiens
ttttcttatgggaaa

SEQ ID NO: 100142 - DNA, 15 bp, Homo sapiens
cttttcttatgggaa

SEQ ID NO: 100143 - DNA, 15 bp, Homo sapiens
tcttttcttatggga

SEQ ID NO: 100144 - DNA, 15 bp, Homo sapiens
ctcttttcttatggg

SEQ ID NO: 100145 - DNA, 15 bp, Homo sapiens
cctcttttcttatgg

SEQ ID NO: 100146 - DNA, 15 bp, Homo sapiens
acctcttttcttatg

SEQ ID NO: 100147 - DNA, 15 bp, Homo sapiens
aacctcttttcttat

SEQ ID NO: 100148 - DNA, 15 bp, Homo sapiens
caacctcttttctta

SEQ ID NO: 100149 - DNA, 15 bp, Homo sapiens
acaacctcttttctt

SEQ ID NO: 100150 - DNA, 15 bp, Homo sapiens
cacaacctcttttct

SEQ ID NO: 100151 - DNA, 15 bp, Homo sapiens
gcacaacctcttttc

SEQ ID NO: 100152 - DNA, 15 bp, Homo sapiens
agcacaacctctttt

SEQ ID NO: 100153 - DNA, 15 bp, Homo sapiens
aagcacaacctcttt

SEQ ID NO: 100154 - DNA, 15 bp, Homo sapiens
caagcacaacctctt

SEQ ID NO: 100155 - DNA, 15 bp, Homo sapiens
gcaagcacaacctct

SEQ ID NO: 100156 - DNA, 15 bp, Homo sapiens
tgcaagcacaacctc

SEQ ID NO: 100157 - DNA, 15 bp, Homo sapiens
atgcaagcacaacct

SEQ ID NO: 100158 - DNA, 15 bp, Homo sapiens
gatgcaagcacaacc

SEQ ID NO: 100159 - DNA, 15 bp, Homo sapiens
agatgcaagcacaac

SEQ ID NO: 100160 - DNA, 15 bp, Homo sapiens
cagatgcaagcacaa

SEQ ID NO: 100161 - DNA, 15 bp, Homo sapiens
tcagatgcaagcaca

SEQ ID NO: 100162 - DNA, 15 bp, Homo sapiens
ctcagatgcaagcac

SEQ ID NO: 100163 - DNA, 15 bp, Homo sapiens
gctcagatgcaagca

SEQ ID NO: 100164 - DNA, 15 bp, Homo sapiens
tgctcagatgcaagc

SEQ ID NO: 100165 - DNA, 15 bp, Homo sapiens
ctgctcagatgcaag

SEQ ID NO: 100166 - DNA, 15 bp, Homo sapiens
tctgctcagatgcaa

SEQ ID NO: 100167 - DNA, 15 bp, Homo sapiens
atctgctcagatgca

SEQ ID NO: 100168 - DNA, 15 bp, Homo sapiens
aatctgctcagatgc

SEQ ID NO: 100169 - DNA, 15 bp, Homo sapiens
aaatctgctcagatg

SEQ ID NO: 100170 - DNA, 15 bp, Homo sapiens
aaaatctgctcagat

SEQ ID NO: 100171 - DNA, 15 bp, Homo sapiens
aaaaatctgctcaga

SEQ ID NO: 100172 - DNA, 15 bp, Homo sapiens
caaaaatctgctcag

SEQ ID NO: 100173 - DNA, 15 bp, Homo sapiens
ccaaaaatctgctca

SEQ ID NO: 100174 - DNA, 15 bp, Homo sapiens
accaaaaatctgctc

SEQ ID NO: 100175 - DNA, 15 bp, Homo sapiens
gaccaaaaatctgct

SEQ ID NO: 100176 - DNA, 15 bp, Homo sapiens
agaccaaaaatctgc

SEQ ID NO: 100177 - DNA, 15 bp, Homo sapiens
cagaccaaaaatctg

SEQ ID NO: 100178 - DNA, 15 bp, Homo sapiens
gcagaccaaaaatct

SEQ ID NO: 100179 - DNA, 15 bp, Homo sapiens
agcagaccaaaaatc

SEQ ID NO: 100180 - DNA, 15 bp, Homo sapiens
aagcagaccaaaaat

SEQ ID NO: 100181 - DNA, 15 bp, Homo sapiens
aaagcagaccaaaaa

SEQ ID NO: 100182 - DNA, 15 bp, Homo sapiens
aaaagcagaccaaaa

SEQ ID NO: 100183 - DNA, 15 bp, Homo sapiens
aaaaagcagaccaaa

SEQ ID NO: 100184 - DNA, 15 bp, Homo sapiens
caaaaagcagaccaa

SEQ ID NO: 100185 - DNA, 15 bp, Homo sapiens
gcaaaaagcagacca

SEQ ID NO: 100186 - DNA, 15 bp, Homo sapiens
agcaaaaagcagacc

SEQ ID NO: 100187 - DNA, 15 bp, Homo sapiens
aagcaaaaagcagac

SEQ ID NO: 100188 - DNA, 15 bp, Homo sapiens
caagcaaaaagcaga

SEQ ID NO: 100189 - DNA, 15 bp, Homo sapiens
acaagcaaaaagcag

SEQ ID NO: 100190 - DNA, 15 bp, Homo sapiens
cacaagcaaaaagca

SEQ ID NO: 100191 - DNA, 15 bp, Homo sapiens
ccacaagcaaaaagc

SEQ ID NO: 100192 - DNA, 15 bp, Homo sapiens
tccacaagcaaaaag

SEQ ID NO: 100193 - DNA, 15 bp, Homo sapiens
ttccacaagcaaaaa

SEQ ID NO: 100194 - DNA, 15 bp, Homo sapiens
tttccacaagcaaaa

SEQ ID NO: 100195 - DNA, 15 bp, Homo sapiens
atttccacaagcaaa

SEQ ID NO: 100196 - DNA, 15 bp, Homo sapiens
aatttccacaagcaa

SEQ ID NO: 100197 - DNA, 15 bp, Homo sapiens
caatttccacaagca

SEQ ID NO: 100198 - DNA, 15 bp, Homo sapiens
ccaatttccacaagc

SEQ ID NO: 100199 - DNA, 15 bp, Homo sapiens
cccaatttccacaag

SEQ ID NO: 100200 - DNA, 15 bp, Homo sapiens
ccccaatttccacaa

SEQ ID NO: 100201 - DNA, 15 bp, Homo sapiens
cccccaatttccaca

SEQ ID NO: 100202 - DNA, 15 bp, Homo sapiens
tcccccaatttccac

SEQ ID NO: 100203 - DNA, 15 bp, Homo sapiens
gtcccccaatttcca

SEQ ID NO: 100204 - DNA, 15 bp, Homo sapiens
agtcccccaatttcc

SEQ ID NO: 100205 - DNA, 15 bp, Homo sapiens
tagtcccccaatttc

SEQ ID NO: 100206 - DNA, 15 bp, Homo sapiens
ctagtcccccaattt

SEQ ID NO: 100207 - DNA, 15 bp, Homo sapiens
tctagtcccccaatt

SEQ ID NO: 100208 - DNA, 15 bp, Homo sapiens
ttctagtcccccaat

SEQ ID NO: 100209 - DNA, 15 bp, Homo sapiens
gttctagtcccccaa

SEQ ID NO: 100210 - DNA, 15 bp, Homo sapiens
ggttctagtccccca

SEQ ID NO: 100211 - DNA, 15 bp, Homo sapiens
aggttctagtccccc

SEQ ID NO: 100212 - DNA, 15 bp, Homo sapiens
gaggttctagtcccc

SEQ ID NO: 100213 - DNA, 15 bp, Homo sapiens
agaggttctagtccc

SEQ ID NO: 100214 - DNA, 15 bp, Homo sapiens
aagaggttctagtcc

SEQ ID NO: 100215 - DNA, 15 bp, Homo sapiens
aaagaggttctagtc

SEQ ID NO: 100216 - DNA, 15 bp, Homo sapiens
aaaagaggttctagt

SEQ ID NO: 100217 - DNA, 15 bp, Homo sapiens
gaaaagaggttctag

SEQ ID NO: 100218 - DNA, 15 bp, Homo sapiens
agaaaagaggttcta

SEQ ID NO: 100219 - DNA, 15 bp, Homo sapiens
aagaaaagaggttct

SEQ ID NO: 100220 - DNA, 15 bp, Homo sapiens
aaagaaaagaggttc

SEQ ID NO: 100221 - DNA, 15 bp, Homo sapiens
aaaagaaaagaggtt

SEQ ID NO: 100222 - DNA, 15 bp, Homo sapiens
taaaagaaaagaggt

SEQ ID NO: 100223 - DNA, 15 bp, Homo sapiens
ataaaagaaaagagg

SEQ ID NO: 100224 - DNA, 15 bp, Homo sapiens
aataaaagaaaagag

SEQ ID NO: 100225 - DNA, 15 bp, Homo sapiens
gaataaaagaaaaga

SEQ ID NO: 100226 - DNA, 15 bp, Homo sapiens
agaataaaagaaaag

SEQ ID NO: 100227 - DNA, 15 bp, Homo sapiens
tagaataaaagaaaa

SEQ ID NO: 100228 - DNA, 15 bp, Homo sapiens
ttagaataaaagaaa

SEQ ID NO: 100229 - DNA, 15 bp, Homo sapiens
attagaataaaagaa

SEQ ID NO: 100230 - DNA, 15 bp, Homo sapiens
aattagaataaaaga

SEQ ID NO: 100231 - DNA, 15 bp, Homo sapiens
gaattagaataaaag

SEQ ID NO: 100232 - DNA, 15 bp, Homo sapiens
tgaattagaataaaa

SEQ ID NO: 100233 - DNA, 15 bp, Homo sapiens
ctgaattagaataaa

SEQ ID NO: 100234 - DNA, 15 bp, Homo sapiens
actgaattagaataa

SEQ ID NO: 100235 - DNA, 15 bp, Homo sapiens
cactgaattagaata

SEQ ID NO: 100236 - DNA, 15 bp, Homo sapiens
ccactgaattagaat

SEQ ID NO: 100237 - DNA, 15 bp, Homo sapiens
gccactgaattagaa

SEQ ID NO: 100238 - DNA, 15 bp, Homo sapiens
agccactgaattaga

SEQ ID NO: 100239 - DNA, 15 bp, Homo sapiens
cagccactgaattag

SEQ ID NO: 100240 - DNA, 15 bp, Homo sapiens
ccagccactgaatta

SEQ ID NO: 100241 - DNA, 15 bp, Homo sapiens
tccagccactgaatt

SEQ ID NO: 100242 - DNA, 15 bp, Homo sapiens
ttccagccactgaat

SEQ ID NO: 100243 - DNA, 15 bp, Homo sapiens
tttccagccactgaa

SEQ ID NO: 100244 - DNA, 15 bp, Homo sapiens
ttttccagccactga

SEQ ID NO: 100245 - DNA, 15 bp, Homo sapiens
attttccagccactg

SEQ ID NO: 100246 - DNA, 15 bp, Homo sapiens
aattttccagccact

SEQ ID NO: 100247 - DNA, 15 bp, Homo sapiens
taattttccagccac

SEQ ID NO: 100248 - DNA, 15 bp, Homo sapiens
ataattttccagcca

SEQ ID NO: 100249 - DNA, 15 bp, Homo sapiens
cataattttccagcc

SEQ ID NO: 100250 - DNA, 15 bp, Homo sapiens
ccataattttccagc

SEQ ID NO: 100251 - DNA, 15 bp, Homo sapiens
gccataattttccag

SEQ ID NO: 100252 - DNA, 15 bp, Homo sapiens
agccataattttcca

SEQ ID NO: 100253 - DNA, 15 bp, Homo sapiens
cagccataattttcc

SEQ ID NO: 100254 - DNA, 15 bp, Homo sapiens
tcagccataattttc

SEQ ID NO: 100255 - DNA, 15 bp, Homo sapiens
ctcagccataatttt

SEQ ID NO: 100256 - DNA, 15 bp, Homo sapiens
cctcagccataattt

SEQ ID NO: 100257 - DNA, 15 bp, Homo sapiens
tcctcagccataatt

SEQ ID NO: 100258 - DNA, 15 bp, Homo sapiens
atcctcagccataat

SEQ ID NO: 100259 - DNA, 15 bp, Homo sapiens
aatcctcagccataa

SEQ ID NO: 100260 - DNA, 15 bp, Homo sapiens
aaatcctcagccata

SEQ ID NO: 100261 - DNA, 15 bp, Homo sapiens
aaaatcctcagccat

SEQ ID NO: 100262 - DNA, 15 bp, Homo sapiens
caaaatcctcagcca

SEQ ID NO: 100263 - DNA, 15 bp, Homo sapiens
acaaaatcctcagcc

SEQ ID NO: 100264 - DNA, 15 bp, Homo sapiens
aacaaaatcctcagc

SEQ ID NO: 100265 - DNA, 15 bp, Homo sapiens
aaacaaaatcctcag

SEQ ID NO: 100266 - DNA, 15 bp, Homo sapiens
aaaacaaaatcctca

SEQ ID NO: 100267 - DNA, 15 bp, Homo sapiens
caaaacaaaatcctc

SEQ ID NO: 100268 - DNA, 15 bp, Homo sapiens
acaaaacaaaatcct

SEQ ID NO: 100269 - DNA, 15 bp, Homo sapiens
aaaacaaaacaaaat

SEQ ID NO: 100270 - DNA, 15 bp, Homo sapiens
caaacaaaacaaaac

SEQ ID NO: 100271 - DNA, 15 bp, Homo sapiens
tcaaacaaaacaaaa

SEQ ID NO: 100272 - DNA, 15 bp, Homo sapiens
ctcaaacaaaacaaa

SEQ ID NO: 100273 - DNA, 15 bp, Homo sapiens
tctcaaacaaaacaa

SEQ ID NO: 100274 - DNA, 15 bp, Homo sapiens
gtctcaaacaaaaca

SEQ ID NO: 100275 - DNA, 15 bp, Homo sapiens
tgtctcaaacaaaac

SEQ ID NO: 100276 - DNA, 15 bp, Homo sapiens
ctgtctcaaacaaaa

SEQ ID NO: 100277 - DNA, 15 bp, Homo sapiens
cctgtctcaaacaaa

SEQ ID NO: 100278 - DNA, 15 bp, Homo sapiens
ccctgtctcaaacaa

SEQ ID NO: 100279 - DNA, 15 bp, Homo sapiens
accctgtctcaaaca

SEQ ID NO: 100280 - DNA, 15 bp, Homo sapiens
gaccctgtctcaaac

SEQ ID NO: 100281 - DNA, 15 bp, Homo sapiens
aggtgacagagcaag

SEQ ID NO: 100282 - DNA, 15 bp, Homo sapiens
taggtgacagagcaa

SEQ ID NO: 100283 - DNA, 15 bp, Homo sapiens
ataggtgacagagca

SEQ ID NO: 100284 - DNA, 15 bp, Homo sapiens
cataggtgacagagc

SEQ ID NO: 100285 - DNA, 15 bp, Homo sapiens
gcataggtgacagag

SEQ ID NO: 100286 - DNA, 15 bp, Homo sapiens
agcataggtgacaga

SEQ ID NO: 100287 - DNA, 15 bp, Homo sapiens
cagcataggtgacag

SEQ ID NO: 100288 - DNA, 15 bp, Homo sapiens
ccagcataggtgaca

SEQ ID NO: 100289 - DNA, 15 bp, Homo sapiens
tccagcataggtgac

SEQ ID NO: 100290 - DNA, 15 bp, Homo sapiens
ctccagcataggtga

SEQ ID NO: 100291 - DNA, 15 bp, Homo sapiens
actccagcataggtg

SEQ ID NO: 100292 - DNA, 15 bp, Homo sapiens
cactccagcataggt

SEQ ID NO: 100293 - DNA, 15 bp, Homo sapiens
gcactccagcatagg

SEQ ID NO: 100294 - DNA, 15 bp, Homo sapiens
tgcactccagcatag

SEQ ID NO: 100295 - DNA, 15 bp, Homo sapiens
ctgcactccagcata

SEQ ID NO: 100296 - DNA, 15 bp, Homo sapiens
actgcactccagcat

SEQ ID NO: 100297 - DNA, 15 bp, Homo sapiens
cactgcactccagca

SEQ ID NO: 100298 - DNA, 15 bp, Homo sapiens
taccactgcactcca

SEQ ID NO: 100299 - DNA, 15 bp, Homo sapiens
ataccactgcactcc

SEQ ID NO: 100300 - DNA, 15 bp, Homo sapiens
cataccactgcactc

SEQ ID NO: 100301 - DNA, 15 bp, Homo sapiens
tcataccactgcact

SEQ ID NO: 100302 - DNA, 15 bp, Homo sapiens
atcataccactgcac

SEQ ID NO: 100303 - DNA, 15 bp, Homo sapiens
gatcataccactgca

SEQ ID NO: 100304 - DNA, 15 bp, Homo sapiens
tgatcataccactgc

SEQ ID NO: 100305 - DNA, 15 bp, Homo sapiens
gtgatcataccactg

SEQ ID NO: 100306 - DNA, 15 bp, Homo sapiens
tgtgatcataccact

SEQ ID NO: 100307 - DNA, 15 bp, Homo sapiens
ctgtgatcataccac

SEQ ID NO: 100308 - DNA, 15 bp, Homo sapiens
gctgtgatcatacca

SEQ ID NO: 100309 - DNA, 15 bp, Homo sapiens
agctgtgatcatacc

SEQ ID NO: 100310 - DNA, 15 bp, Homo sapiens
gagctgtgatcatac

SEQ ID NO: 100311 - DNA, 15 bp, Homo sapiens
tgagctgtgatcata

SEQ ID NO: 100312 - DNA, 15 bp, Homo sapiens
gtgagctgtgatcat

SEQ ID NO: 100313 - DNA, 15 bp, Homo sapiens
agtgagctgtgatca

SEQ ID NO: 100314 - DNA, 15 bp, Homo sapiens
cagtgagctgtgatc

SEQ ID NO: 100315 - DNA, 15 bp, Homo sapiens
acagtgagctgtgat

SEQ ID NO: 100316 - DNA, 15 bp, Homo sapiens
tacagtgagctgtga

SEQ ID NO: 100317 - DNA, 15 bp, Homo sapiens
ttacagtgagctgtg

SEQ ID NO: 100318 - DNA, 15 bp, Homo sapiens
gttacagtgagctgt

SEQ ID NO: 100319 - DNA, 15 bp, Homo sapiens
ggttacagtgagctg

SEQ ID NO: 100320 - DNA, 15 bp, Homo sapiens
aggttacagtgagct

SEQ ID NO: 100321 - DNA, 15 bp, Homo sapiens
gaggttacagtgagc

SEQ ID NO: 100322 - DNA, 15 bp, Homo sapiens
tgaggttacagtgag

SEQ ID NO: 100323 - DNA, 15 bp, Homo sapiens
ttgaggttacagtga

SEQ ID NO: 100324 - DNA, 15 bp, Homo sapiens
tttgaggttacagtg

SEQ ID NO: 100325 - DNA, 15 bp, Homo sapiens
gtttgaggttacagt

SEQ ID NO: 100326 - DNA, 15 bp, Homo sapiens
agtttgaggttacag

SEQ ID NO: 100327 - DNA, 15 bp, Homo sapiens
gagtttgaggttaca

SEQ ID NO: 100328 - DNA, 15 bp, Homo sapiens
ggagtttgaggttac

SEQ ID NO: 100329 - DNA, 15 bp, Homo sapiens
aggagtttgaggtta

SEQ ID NO: 100330 - DNA, 15 bp, Homo sapiens
caggagtttgaggtt

SEQ ID NO: 100331 - DNA, 15 bp, Homo sapiens
ccaggagtttgaggt

SEQ ID NO: 100332 - DNA, 15 bp, Homo sapiens
gtcacttgagcccag

SEQ ID NO: 100333 - DNA, 15 bp, Homo sapiens
ggtcacttgagccca

SEQ ID NO: 100334 - DNA, 15 bp, Homo sapiens
aggtcacttgagccc

SEQ ID NO: 100335 - DNA, 15 bp, Homo sapiens
aaggtcacttgagcc

SEQ ID NO: 100336 - DNA, 15 bp, Homo sapiens
gaaggtcacttgagc

SEQ ID NO: 100337 - DNA, 15 bp, Homo sapiens
ggaaggtcacttgag

SEQ ID NO: 100338 - DNA, 15 bp, Homo sapiens
aggaaggtcacttga

SEQ ID NO: 100339 - DNA, 15 bp, Homo sapiens
caggaaggtcacttg

SEQ ID NO: 100340 - DNA, 15 bp, Homo sapiens
gcaggaaggtcactt

SEQ ID NO: 100341 - DNA, 15 bp, Homo sapiens
ggcaggaaggtcact

SEQ ID NO: 100342 - DNA, 15 bp, Homo sapiens
gggcaggaaggtcac

SEQ ID NO: 100343 - DNA, 15 bp, Homo sapiens
ggggcaggaaggtca

SEQ ID NO: 100344 - DNA, 15 bp, Homo sapiens
gggggcaggaaggtc

SEQ ID NO: 100345 - DNA, 15 bp, Homo sapiens
cgggggcaggaaggt

SEQ ID NO: 100346 - DNA, 15 bp, Homo sapiens
gcgggggcaggaagg

SEQ ID NO: 100347 - DNA, 15 bp, Homo sapiens
agcgggggcaggaag

SEQ ID NO: 100348 - DNA, 15 bp, Homo sapiens
aagcgggggcaggaa

SEQ ID NO: 100349 - DNA, 15 bp, Homo sapiens
gaagcgggggcagga

SEQ ID NO: 100350 - DNA, 15 bp, Homo sapiens
ggaagcgggggcagg

SEQ ID NO: 100351 - DNA, 15 bp, Homo sapiens
aggaagcgggggcag

SEQ ID NO: 100352 - DNA, 15 bp, Homo sapiens
caggaagcgggggca

SEQ ID NO: 100353 - DNA, 15 bp, Homo sapiens
tcaggaagcgggggc

SEQ ID NO: 100354 - DNA, 15 bp, Homo sapiens
ctcaggaagcggggg

SEQ ID NO: 100355 - DNA, 15 bp, Homo sapiens
actcaggaagcgggg

SEQ ID NO: 100356 - DNA, 15 bp, Homo sapiens
tactcaggaagcggg

SEQ ID NO: 100357 - DNA, 15 bp, Homo sapiens
ctactcaggaagcgg

SEQ ID NO: 100358 - DNA, 15 bp, Homo sapiens
gctactcaggaagcg

SEQ ID NO: 100359 - DNA, 15 bp, Homo sapiens
tagctactcaggaag

SEQ ID NO: 100360 - DNA, 15 bp, Homo sapiens
atagctactcaggaa

SEQ ID NO: 100361 - DNA, 15 bp, Homo sapiens
catagctactcagga

SEQ ID NO: 100362 - DNA, 15 bp, Homo sapiens
tcatagctactcagg

SEQ ID NO: 100363 - DNA, 15 bp, Homo sapiens
gtcatagctactcag

SEQ ID NO: 100364 - DNA, 15 bp, Homo sapiens
agtcatagctactca

SEQ ID NO: 100365 - DNA, 15 bp, Homo sapiens
gagtcatagctactc

SEQ ID NO: 100366 - DNA, 15 bp, Homo sapiens
ggagtcatagctact

SEQ ID NO: 100367 - DNA, 15 bp, Homo sapiens
tggagtcatagctac

SEQ ID NO: 100368 - DNA, 15 bp, Homo sapiens
ctggagtcatagcta

SEQ ID NO: 100369 - DNA, 15 bp, Homo sapiens
gctggagtcatagct

SEQ ID NO: 100370 - DNA, 15 bp, Homo sapiens
ggctggagtcatagc

SEQ ID NO: 100371 - DNA, 15 bp, Homo sapiens
aggctggagtcatag

SEQ ID NO: 100372 - DNA, 15 bp, Homo sapiens
aaggctggagtcata

SEQ ID NO: 100373 - DNA, 15 bp, Homo sapiens
caaggctggagtcat

SEQ ID NO: 100374 - DNA, 15 bp, Homo sapiens
gcaaggctggagtca

SEQ ID NO: 100375 - DNA, 15 bp, Homo sapiens
tgcaaggctggagtc

SEQ ID NO: 100376 - DNA, 15 bp, Homo sapiens
ttgcaaggctggagt

SEQ ID NO: 100377 - DNA, 15 bp, Homo sapiens
attgcaaggctggag

SEQ ID NO: 100378 - DNA, 15 bp, Homo sapiens
cattgcaaggctgga

SEQ ID NO: 100379 - DNA, 15 bp, Homo sapiens
gcattgcaaggctgg

SEQ ID NO: 100380 - DNA, 15 bp, Homo sapiens
ggcattgcaaggctg

SEQ ID NO: 100381 - DNA, 15 bp, Homo sapiens
tggcattgcaaggct

SEQ ID NO: 100382 - DNA, 15 bp, Homo sapiens
gtggcattgcaaggc

SEQ ID NO: 100383 - DNA, 15 bp, Homo sapiens
tgtggcattgcaagg

SEQ ID NO: 100384 - DNA, 15 bp, Homo sapiens
gtgtggcattgcaag

SEQ ID NO: 100385 - DNA, 15 bp, Homo sapiens
ggtgtggcattgcaa

SEQ ID NO: 100386 - DNA, 15 bp, Homo sapiens
aggtgtggcattgca

SEQ ID NO: 100387 - DNA, 15 bp, Homo sapiens
caggtgtggcattgc

SEQ ID NO: 100388 - DNA, 15 bp, Homo sapiens
ccaggtgtggcattg

SEQ ID NO: 100389 - DNA, 15 bp, Homo sapiens
gccaggtgtggcatt

SEQ ID NO: 100390 - DNA, 15 bp, Homo sapiens
agccaggtgtggcat

SEQ ID NO: 100391 - DNA, 15 bp, Homo sapiens
tagccaggtgtggca

SEQ ID NO: 100392 - DNA, 15 bp, Homo sapiens
ttagccaggtgtggc

SEQ ID NO: 100393 - DNA, 15 bp, Homo sapiens
taattagccaggtgt

SEQ ID NO: 100394 - DNA, 15 bp, Homo sapiens
ataattagccaggtg

SEQ ID NO: 100395 - DNA, 15 bp, Homo sapiens
aataattagccaggt

SEQ ID NO: 100396 - DNA, 15 bp, Homo sapiens
aaataattagccagg

SEQ ID NO: 100397 - DNA, 15 bp, Homo sapiens
aaaataattagccag

SEQ ID NO: 100398 - DNA, 15 bp, Homo sapiens
aaaaataattagcca

SEQ ID NO: 100399 - DNA, 15 bp, Homo sapiens
taaaaataattagcc

SEQ ID NO: 100400 - DNA, 15 bp, Homo sapiens
ttaaaaataattagc

SEQ ID NO: 100401 - DNA, 15 bp, Homo sapiens
tttaaaaataattag

SEQ ID NO: 100402 - DNA, 15 bp, Homo sapiens
atttaaaaataatta

SEQ ID NO: 100403 - DNA, 15 bp, Homo sapiens
aatttaaaaataatt

SEQ ID NO: 100404 - DNA, 15 bp, Homo sapiens
aaatttaaaaataat

SEQ ID NO: 100405 - DNA, 15 bp, Homo sapiens
aaaatttaaaaataa

SEQ ID NO: 100406 - DNA, 15 bp, Homo sapiens
aaaaatttaaaaata

SEQ ID NO: 100407 - DNA, 15 bp, Homo sapiens
aaaaaatttaaaaat

SEQ ID NO: 100408 - DNA, 15 bp, Homo sapiens
aaaaaaatttaaaaa

SEQ ID NO: 100409 - DNA, 15 bp, Homo sapiens
aaaaaaaatttaaaa

SEQ ID NO: 100410 - DNA, 15 bp, Homo sapiens
caaaaaaaatttaaa

SEQ ID NO: 100411 - DNA, 15 bp, Homo sapiens
acaaaaaaaatttaa

SEQ ID NO: 100412 - DNA, 15 bp, Homo sapiens
tacaaaaaaaattta

SEQ ID NO: 100413 - DNA, 15 bp, Homo sapiens
ctacaaaaaaaattt

SEQ ID NO: 100414 - DNA, 15 bp, Homo sapiens
tctacaaaaaaaatt

SEQ ID NO: 100415 - DNA, 15 bp, Homo sapiens
ctctacaaaaaaaat

SEQ ID NO: 100416 - DNA, 15 bp, Homo sapiens
cccccatctctacaa

SEQ ID NO: 100417 - DNA, 15 bp, Homo sapiens
acccccatctctaca

SEQ ID NO: 100418 - DNA, 15 bp, Homo sapiens
gacccccatctctac

SEQ ID NO: 100419 - DNA, 15 bp, Homo sapiens
agacccccatctcta

SEQ ID NO: 100420 - DNA, 15 bp, Homo sapiens
aagacccccatctct

SEQ ID NO: 100421 - DNA, 15 bp, Homo sapiens
caagacccccatctc

SEQ ID NO: 100422 - DNA, 15 bp, Homo sapiens
gcaagacccccatct

SEQ ID NO: 100423 - DNA, 15 bp, Homo sapiens
agcaagacccccatc

SEQ ID NO: 100424 - DNA, 15 bp, Homo sapiens
tagcaagacccccat

SEQ ID NO: 100425 - DNA, 15 bp, Homo sapiens
atagcaagaccccca

SEQ ID NO: 100426 - DNA, 15 bp, Homo sapiens
catagcaagaccccc

SEQ ID NO: 100427 - DNA, 15 bp, Homo sapiens
acatagcaagacccc

SEQ ID NO: 100428 - DNA, 15 bp, Homo sapiens
aacatagcaagaccc

SEQ ID NO: 100429 - DNA, 15 bp, Homo sapiens
caacatagcaagacc

SEQ ID NO: 100430 - DNA, 15 bp, Homo sapiens
gcaacatagcaagac

SEQ ID NO: 100431 - DNA, 15 bp, Homo sapiens
ggcaacatagcaaga

SEQ ID NO: 100432 - DNA, 15 bp, Homo sapiens
gggcaacatagcaag

SEQ ID NO: 100433 - DNA, 15 bp, Homo sapiens
tgggcaacatagcaa

SEQ ID NO: 100434 - DNA, 15 bp, Homo sapiens
ttgggcaacatagca

SEQ ID NO: 100435 - DNA, 15 bp, Homo sapiens
cttgggcaacatagc

SEQ ID NO: 100436 - DNA, 15 bp, Homo sapiens
acttgggcaacatag

SEQ ID NO: 100437 - DNA, 15 bp, Homo sapiens
aacttgggcaacata

SEQ ID NO: 100438 - DNA, 15 bp, Homo sapiens
caacttgggcaacat

SEQ ID NO: 100439 - DNA, 15 bp, Homo sapiens
ccaacttgggcaaca

SEQ ID NO: 100440 - DNA, 15 bp, Homo sapiens
accaacttgggcaac

SEQ ID NO: 100441 - DNA, 15 bp, Homo sapiens
gaccaacttgggcaa

SEQ ID NO: 100442 - DNA, 15 bp, Homo sapiens
agaccaacttgggca

SEQ ID NO: 100443 - DNA, 15 bp, Homo sapiens
cagaccaacttgggc

SEQ ID NO: 100444 - DNA, 15 bp, Homo sapiens
ccagaccaacttggg

SEQ ID NO: 100445 - DNA, 15 bp, Homo sapiens
tccagaccaacttgg

SEQ ID NO: 100446 - DNA, 15 bp, Homo sapiens
ttccagaccaacttg

SEQ ID NO: 100447 - DNA, 15 bp, Homo sapiens
gttccagaccaactt

SEQ ID NO: 100448 - DNA, 15 bp, Homo sapiens
agttccagaccaact

SEQ ID NO: 100449 - DNA, 15 bp, Homo sapiens
gagttccagaccaac

SEQ ID NO: 100450 - DNA, 15 bp, Homo sapiens
agagttccagaccaa

SEQ ID NO: 100451 - DNA, 15 bp, Homo sapiens
aagagttccagacca

SEQ ID NO: 100452 - DNA, 15 bp, Homo sapiens
caagagttccagacc

SEQ ID NO: 100453 - DNA, 15 bp, Homo sapiens
ccaagagttccagac

SEQ ID NO: 100454 - DNA, 15 bp, Homo sapiens
cccaagagttccaga

SEQ ID NO: 100455 - DNA, 15 bp, Homo sapiens
gcccaagagttccag

SEQ ID NO: 100456 - DNA, 15 bp, Homo sapiens
agcccaagagttcca

SEQ ID NO: 100457 - DNA, 15 bp, Homo sapiens
gagcccaagagttcc

SEQ ID NO: 100458 - DNA, 15 bp, Homo sapiens
tgagcccaagagttc

SEQ ID NO: 100459 - DNA, 15 bp, Homo sapiens
ttgagcccaagagtt

SEQ ID NO: 100460 - DNA, 15 bp, Homo sapiens
cttgagcccaagagt

SEQ ID NO: 100461 - DNA, 15 bp, Homo sapiens
gcttgagcccaagag

SEQ ID NO: 100462 - DNA, 15 bp, Homo sapiens
ggcttgagcccaaga

SEQ ID NO: 100463 - DNA, 15 bp, Homo sapiens
tggcttgagcccaag

SEQ ID NO: 100464 - DNA, 15 bp, Homo sapiens
atggcttgagcccaa

SEQ ID NO: 100465 - DNA, 15 bp, Homo sapiens
aggaggatggcttga

SEQ ID NO: 100466 - DNA, 15 bp, Homo sapiens
caggaggatggcttg

SEQ ID NO: 100467 - DNA, 15 bp, Homo sapiens
gcaggaggatggctt

SEQ ID NO: 100468 - DNA, 15 bp, Homo sapiens
ggcaggaggatggct

SEQ ID NO: 100469 - DNA, 15 bp, Homo sapiens
aggcaggaggatggc

SEQ ID NO: 100470 - DNA, 15 bp, Homo sapiens
aaggcaggaggatgg

SEQ ID NO: 100471 - DNA, 15 bp, Homo sapiens
caaggcaggaggatg

SEQ ID NO: 100472 - DNA, 15 bp, Homo sapiens
taggccaaggcagga

SEQ ID NO: 100473 - DNA, 15 bp, Homo sapiens
gtaggccaaggcagg

SEQ ID NO: 100474 - DNA, 15 bp, Homo sapiens
ggtaggccaaggcag

SEQ ID NO: 100475 - DNA, 15 bp, Homo sapiens
tggtaggccaaggca

SEQ ID NO: 100476 - DNA, 15 bp, Homo sapiens
ttggtaggccaaggc

SEQ ID NO: 100477 - DNA, 15 bp, Homo sapiens
tttggtaggccaagg

SEQ ID NO: 100478 - DNA, 15 bp, Homo sapiens
ctttggtaggccaag

SEQ ID NO: 100479 - DNA, 15 bp, Homo sapiens
actttggtaggccaa

SEQ ID NO: 100480 - DNA, 15 bp, Homo sapiens
gactttggtaggcca

SEQ ID NO: 100481 - DNA, 15 bp, Homo sapiens
ggactttggtaggcc

SEQ ID NO: 100482 - DNA, 15 bp, Homo sapiens
aggactttggtaggc

SEQ ID NO: 100483 - DNA, 15 bp, Homo sapiens
caggactttggtagg

SEQ ID NO: 100484 - DNA, 15 bp, Homo sapiens
ccaggactttggtag

SEQ ID NO: 100485 - DNA, 15 bp, Homo sapiens
cccaggactttggta

SEQ ID NO: 100486 - DNA, 15 bp, Homo sapiens
tcccaggactttggt

SEQ ID NO: 100487 - DNA, 15 bp, Homo sapiens
atcccaggactttgg

SEQ ID NO: 100488 - DNA, 15 bp, Homo sapiens
aatcccaggactttg

SEQ ID NO: 100489 - DNA, 15 bp, Homo sapiens
taatcccaggacttt

SEQ ID NO: 100490 - DNA, 15 bp, Homo sapiens
ttaatcccaggactt

SEQ ID NO: 100491 - DNA, 15 bp, Homo sapiens
tttaatcccaggact

SEQ ID NO: 100492 - DNA, 15 bp, Homo sapiens
ctttaatcccaggac

SEQ ID NO: 100493 - DNA, 15 bp, Homo sapiens
cctttaatcccagga

SEQ ID NO: 100494 - DNA, 15 bp, Homo sapiens
gcctttaatcccagg

SEQ ID NO: 100495 - DNA, 15 bp, Homo sapiens
tgcctttaatcccag

SEQ ID NO: 100496 - DNA, 15 bp, Homo sapiens
atgcctttaatccca

SEQ ID NO: 100497 - DNA, 15 bp, Homo sapiens
aatgcctttaatccc

SEQ ID NO: 100498 - DNA, 15 bp, Homo sapiens
taatgcctttaatcc

SEQ ID NO: 100499 - DNA, 15 bp, Homo sapiens
ctaatgcctttaatc

SEQ ID NO: 100500 - DNA, 15 bp, Homo sapiens
gctaatgcctttaat

SEQ ID NO: 100501 - DNA, 15 bp, Homo sapiens
ggctaatgcctttaa

SEQ ID NO: 100502 - DNA, 15 bp, Homo sapiens
tggctaatgccttta

SEQ ID NO: 100503 - DNA, 15 bp, Homo sapiens
gtggctaatgccttt

SEQ ID NO: 100504 - DNA, 15 bp, Homo sapiens
agtggctaatgcctt

SEQ ID NO: 100505 - DNA, 15 bp, Homo sapiens
cagtggctaatgcct

SEQ ID NO: 100506 - DNA, 15 bp, Homo sapiens
gcagtggctaatgcc

SEQ ID NO: 100507 - DNA, 15 bp, Homo sapiens
tgcagtggctaatgc

SEQ ID NO: 100508 - DNA, 15 bp, Homo sapiens
gtgcagtggctaatg

SEQ ID NO: 100509 - DNA, 15 bp, Homo sapiens
ggtgcagtggctaat

SEQ ID NO: 100510 - DNA, 15 bp, Homo sapiens
gggtgcagtggctaa

SEQ ID NO: 100511 - DNA, 15 bp, Homo sapiens
cgggtgcagtggcta

SEQ ID NO: 100512 - DNA, 15 bp, Homo sapiens
ccgggtgcagtggct

SEQ ID NO: 100513 - DNA, 15 bp, Homo sapiens
tccgggtgcagtggc

SEQ ID NO: 100514 - DNA, 15 bp, Homo sapiens
gtccgggtgcagtgg

SEQ ID NO: 100515 - DNA, 15 bp, Homo sapiens
agtccgggtgcagtg

SEQ ID NO: 100516 - DNA, 15 bp, Homo sapiens
cagtccgggtgcagt

SEQ ID NO: 100517 - DNA, 15 bp, Homo sapiens
ccagtccgggtgcag

SEQ ID NO: 100518 - DNA, 15 bp, Homo sapiens
gccagtccgggtgca

SEQ ID NO: 100519 - DNA, 15 bp, Homo sapiens
agccagtccgggtgc

SEQ ID NO: 100520 - DNA, 15 bp, Homo sapiens
cagccagtccgggtg

SEQ ID NO: 100521 - DNA, 15 bp, Homo sapiens
tcagccagtccgggt

SEQ ID NO: 100522 - DNA, 15 bp, Homo sapiens
ctcagccagtccggg

SEQ ID NO: 100523 - DNA, 15 bp, Homo sapiens
cctcagccagtccgg

SEQ ID NO: 100524 - DNA, 15 bp, Homo sapiens
ccctcagccagtccg

SEQ ID NO: 100525 - DNA, 15 bp, Homo sapiens
accctcagccagtcc

SEQ ID NO: 100526 - DNA, 15 bp, Homo sapiens
aaccctcagccagtc

SEQ ID NO: 100527 - DNA, 15 bp, Homo sapiens
aaaccctcagccagt

SEQ ID NO: 100528 - DNA, 15 bp, Homo sapiens
taaaccctcagccag

SEQ ID NO: 100529 - DNA, 15 bp, Homo sapiens
ttaaaccctcagcca

SEQ ID NO: 100530 - DNA, 15 bp, Homo sapiens
tttaaaccctcagcc

SEQ ID NO: 100531 - DNA, 15 bp, Homo sapiens
atttaaaccctcagc

SEQ ID NO: 100532 - DNA, 15 bp, Homo sapiens
gatttaaaccctcag

SEQ ID NO: 100533 - DNA, 15 bp, Homo sapiens
agatttaaaccctca

SEQ ID NO: 100534 - DNA, 15 bp, Homo sapiens
tagatttaaaccctc

SEQ ID NO: 100535 - DNA, 15 bp, Homo sapiens
ttagatttaaaccct

SEQ ID NO: 100536 - DNA, 15 bp, Homo sapiens
gttagatttaaaccc

SEQ ID NO: 100537 - DNA, 15 bp, Homo sapiens
agttagatttaaacc

SEQ ID NO: 100538 - DNA, 15 bp, Homo sapiens
aagttagatttaaac

SEQ ID NO: 100539 - DNA, 15 bp, Homo sapiens
caagttagatttaaa

SEQ ID NO: 100540 - DNA, 15 bp, Homo sapiens
acaagttagatttaa

SEQ ID NO: 100541 - DNA, 15 bp, Homo sapiens
tacaagttagattta

SEQ ID NO: 100542 - DNA, 15 bp, Homo sapiens
actacaagttagatt

SEQ ID NO: 100543 - DNA, 15 bp, Homo sapiens
aactacaagttagat

SEQ ID NO: 100544 - DNA, 15 bp, Homo sapiens
aaactacaagttaga

SEQ ID NO: 100545 - DNA, 15 bp, Homo sapiens
caaactacaagttag

SEQ ID NO: 100546 - DNA, 15 bp, Homo sapiens
ccaaactacaagtta

SEQ ID NO: 100547 - DNA, 15 bp, Homo sapiens
accaaactacaagtt

SEQ ID NO: 100548 - DNA, 15 bp, Homo sapiens
aaccaaactacaagt

SEQ ID NO: 100549 - DNA, 15 bp, Homo sapiens
aaaccaaactacaag

SEQ ID NO: 100550 - DNA, 15 bp, Homo sapiens
aaaaccaaactacaa

SEQ ID NO: 100551 - DNA, 15 bp, Homo sapiens
caaaaccaaactaca

SEQ ID NO: 100552 - DNA, 15 bp, Homo sapiens
ccaaaaccaaactac

SEQ ID NO: 100553 - DNA, 15 bp, Homo sapiens
tccaaaaccaaacta

SEQ ID NO: 100554 - DNA, 15 bp, Homo sapiens
atccaaaaccaaact

SEQ ID NO: 100555 - DNA, 15 bp, Homo sapiens
tatccaaaaccaaac

SEQ ID NO: 100556 - DNA, 15 bp, Homo sapiens
gtatccaaaaccaaa

SEQ ID NO: 100557 - DNA, 15 bp, Homo sapiens
ggtatccaaaaccaa

SEQ ID NO: 100558 - DNA, 15 bp, Homo sapiens
aggtatccaaaacca

SEQ ID NO: 100559 - DNA, 15 bp, Homo sapiens
caggtatccaaaacc

SEQ ID NO: 100560 - DNA, 15 bp, Homo sapiens
ccaggtatccaaaac

SEQ ID NO: 100561 - DNA, 15 bp, Homo sapiens
accaggtatccaaaa

SEQ ID NO: 100562 - DNA, 15 bp, Homo sapiens
aaccaggtatccaaa

SEQ ID NO: 100563 - DNA, 15 bp, Homo sapiens
taaccaggtatccaa

SEQ ID NO: 100564 - DNA, 15 bp, Homo sapiens
ttaaccaggtatcca

SEQ ID NO: 100565 - DNA, 15 bp, Homo sapiens
gttaaccaggtatcc

SEQ ID NO: 100566 - DNA, 15 bp, Homo sapiens
agttaaccaggtatc

SEQ ID NO: 100567 - DNA, 15 bp, Homo sapiens
cagttaaccaggtat

SEQ ID NO: 100568 - DNA, 15 bp, Homo sapiens
tcagttaaccaggta

SEQ ID NO: 100569 - DNA, 15 bp, Homo sapiens
ctcagttaaccaggt

SEQ ID NO: 100570 - DNA, 15 bp, Homo sapiens
tctcagttaaccagg

SEQ ID NO: 100571 - DNA, 15 bp, Homo sapiens
ttctcagttaaccag

SEQ ID NO: 100572 - DNA, 15 bp, Homo sapiens
attctcagttaacca

SEQ ID NO: 100573 - DNA, 15 bp, Homo sapiens
tattctcagttaacc

SEQ ID NO: 100574 - DNA, 15 bp, Homo sapiens
ctattctcagttaac

SEQ ID NO: 100575 - DNA, 15 bp, Homo sapiens
actattctcagttaa

SEQ ID NO: 100576 - DNA, 15 bp, Homo sapiens
aactattctcagtta

SEQ ID NO: 100577 - DNA, 15 bp, Homo sapiens
aaactattctcagtt

SEQ ID NO: 100578 - DNA, 15 bp, Homo sapiens
taaactattctcagt

SEQ ID NO: 100579 - DNA, 15 bp, Homo sapiens
ataaactattctcag

SEQ ID NO: 100580 - DNA, 15 bp, Homo sapiens
tataaactattctca

SEQ ID NO: 100581 - DNA, 15 bp, Homo sapiens
gtataaactattctc

SEQ ID NO: 100582 - DNA, 15 bp, Homo sapiens
tgtataaactattct

SEQ ID NO: 100583 - DNA, 15 bp, Homo sapiens
atgtataaactattc

SEQ ID NO: 100584 - DNA, 15 bp, Homo sapiens
aatgtataaactatt

SEQ ID NO: 100585 - DNA, 15 bp, Homo sapiens
aaatgtataaactat

SEQ ID NO: 100586 - DNA, 15 bp, Homo sapiens
gaaatgtataaacta

SEQ ID NO: 100587 - DNA, 15 bp, Homo sapiens
agaaatgtataaact

SEQ ID NO: 100588 - DNA, 15 bp, Homo sapiens
gagaaatgtataaac

SEQ ID NO: 100589 - DNA, 15 bp, Homo sapiens
tgagaaatgtataaa

SEQ ID NO: 100590 - DNA, 15 bp, Homo sapiens
ttgagaaatgtataa

SEQ ID NO: 100591 - DNA, 15 bp, Homo sapiens
cttgagaaatgtata

SEQ ID NO: 100592 - DNA, 15 bp, Homo sapiens
ccttgagaaatgtat

SEQ ID NO: 100593 - DNA, 15 bp, Homo sapiens
cccttgagaaatgta

SEQ ID NO: 100594 - DNA, 15 bp, Homo sapiens
acccttgagaaatgt

SEQ ID NO: 100595 - DNA, 15 bp, Homo sapiens
aacccttgagaaatg

SEQ ID NO: 100596 - DNA, 15 bp, Homo sapiens
caacccttgagaaat

SEQ ID NO: 100597 - DNA, 15 bp, Homo sapiens
acaacccttgagaaa

SEQ ID NO: 100598 - DNA, 15 bp, Homo sapiens
tacaacccttgagaa

SEQ ID NO: 100599 - DNA, 15 bp, Homo sapiens
gtacaacccttgaga

SEQ ID NO: 100600 - DNA, 15 bp, Homo sapiens
tgtacaacccttgag

SEQ ID NO: 100601 - DNA, 15 bp, Homo sapiens
ttgtacaacccttga

SEQ ID NO: 100602 - DNA, 15 bp, Homo sapiens
gttgtacaacccttg

SEQ ID NO: 100603 - DNA, 15 bp, Homo sapiens
tgttgtacaaccctt

SEQ ID NO: 100604 - DNA, 15 bp, Homo sapiens
gtgttgtacaaccct

SEQ ID NO: 100605 - DNA, 15 bp, Homo sapiens
tgtgttgtacaaccc

SEQ ID NO: 100606 - DNA, 15 bp, Homo sapiens
atgtgttgtacaacc

SEQ ID NO: 100607 - DNA, 15 bp, Homo sapiens
tatgtgttgtacaac

SEQ ID NO: 100608 - DNA, 15 bp, Homo sapiens
gtatgtgttgtacaa

SEQ ID NO: 100609 - DNA, 15 bp, Homo sapiens
ggtatgtgttgtaca

SEQ ID NO: 100610 - DNA, 15 bp, Homo sapiens
gggtatgtgttgtac

SEQ ID NO: 100611 - DNA, 15 bp, Homo sapiens
ggggtatgtgttgta

SEQ ID NO: 100612 - DNA, 15 bp, Homo sapiens
gggggtatgtgttgt

SEQ ID NO: 100613 - DNA, 15 bp, Homo sapiens
ggggggtatgtgttg

SEQ ID NO: 100614 - DNA, 15 bp, Homo sapiens
aggggggtatgtgtt

SEQ ID NO: 100615 - DNA, 15 bp, Homo sapiens
gaggggggtatgtgt

SEQ ID NO: 100616 - DNA, 15 bp, Homo sapiens
ggaggggggtatgtg

SEQ ID NO: 100617 - DNA, 15 bp, Homo sapiens
tggaggggggtatgt

SEQ ID NO: 100618 - DNA, 15 bp, Homo sapiens
ttggaggggggtatg

SEQ ID NO: 100619 - DNA, 15 bp, Homo sapiens
cttggaggggggtat

SEQ ID NO: 100620 - DNA, 15 bp, Homo sapiens
tcttggaggggggta

SEQ ID NO: 100621 - DNA, 15 bp, Homo sapiens
ttcttggaggggggt

SEQ ID NO: 100622 - DNA, 15 bp, Homo sapiens
cttcttggagggggg

SEQ ID NO: 100623 - DNA, 15 bp, Homo sapiens
tcttcttggaggggg

SEQ ID NO: 100624 - DNA, 15 bp, Homo sapiens
ttcttcttggagggg

SEQ ID NO: 100625 - DNA, 15 bp, Homo sapiens
attcttcttggaggg

SEQ ID NO: 100626 - DNA, 15 bp, Homo sapiens
gattcttcttggagg

SEQ ID NO: 100627 - DNA, 15 bp, Homo sapiens
agattcttcttggag

SEQ ID NO: 100628 - DNA, 15 bp, Homo sapiens
cagattcttcttgga

SEQ ID NO: 100629 - DNA, 15 bp, Homo sapiens
acagattcttcttgg

SEQ ID NO: 100630 - DNA, 15 bp, Homo sapiens
cacagattcttcttg

SEQ ID NO: 100631 - DNA, 15 bp, Homo sapiens
tcacagattcttctt

SEQ ID NO: 100632 - DNA, 15 bp, Homo sapiens
atcacagattcttct

SEQ ID NO: 100633 - DNA, 15 bp, Homo sapiens
tatcacagattcttc

SEQ ID NO: 100634 - DNA, 15 bp, Homo sapiens
ctatcacagattctt

SEQ ID NO: 100635 - DNA, 15 bp, Homo sapiens
cctatcacagattct

SEQ ID NO: 100636 - DNA, 15 bp, Homo sapiens
tcctatcacagattc

SEQ ID NO: 100637 - DNA, 15 bp, Homo sapiens
ttcctatcacagatt

SEQ ID NO: 100638 - DNA, 15 bp, Homo sapiens
cttcctatcacagat

SEQ ID NO: 100639 - DNA, 15 bp, Homo sapiens
gcttcctatcacaga

SEQ ID NO: 100640 - DNA, 15 bp, Homo sapiens
tgcttcctatcacag

SEQ ID NO: 100641 - DNA, 15 bp, Homo sapiens
ttgcttcctatcaca

SEQ ID NO: 100642 - DNA, 15 bp, Homo sapiens
tttgcttcctatcac

SEQ ID NO: 100643 - DNA, 15 bp, Homo sapiens
atttgcttcctatca

SEQ ID NO: 100644 - DNA, 15 bp, Homo sapiens
catttgcttcctatc

SEQ ID NO: 100645 - DNA, 15 bp, Homo sapiens
acatttgcttcctat

SEQ ID NO: 100646 - DNA, 15 bp, Homo sapiens
cacatttgcttccta

SEQ ID NO: 100647 - DNA, 15 bp, Homo sapiens
acacatttgcttcct

SEQ ID NO: 100648 - DNA, 15 bp, Homo sapiens
gacacatttgcttcc

SEQ ID NO: 100649 - DNA, 15 bp, Homo sapiens
ggacacatttgcttc

SEQ ID NO: 100650 - DNA, 15 bp, Homo sapiens
aggacacatttgctt

SEQ ID NO: 100651 - DNA, 15 bp, Homo sapiens
gaggacacatttgct

SEQ ID NO: 100652 - DNA, 15 bp, Homo sapiens
ggaggacacatttgc

SEQ ID NO: 100653 - DNA, 15 bp, Homo sapiens
gggaggacacatttg

SEQ ID NO: 100654 - DNA, 15 bp, Homo sapiens
tgggaggacacattt

SEQ ID NO: 100655 - DNA, 15 bp, Homo sapiens
ttgggaggacacatt

SEQ ID NO: 100656 - DNA, 15 bp, Homo sapiens
tttgggaggacacat

SEQ ID NO: 100657 - DNA, 15 bp, Homo sapiens
ttttgggaggacaca

SEQ ID NO: 100658 - DNA, 15 bp, Homo sapiens
gttttgggaggacac

SEQ ID NO: 100659 - DNA, 15 bp, Homo sapiens
ggttttgggaggaca

SEQ ID NO: 100660 - DNA, 15 bp, Homo sapiens
aggttttgggaggac

SEQ ID NO: 100661 - DNA, 15 bp, Homo sapiens
taggttttgggagga

SEQ ID NO: 100662 - DNA, 15 bp, Homo sapiens
ttaggttttgggagg

SEQ ID NO: 100663 - DNA, 15 bp, Homo sapiens
tttaggttttgggag

SEQ ID NO: 100664 - DNA, 15 bp, Homo sapiens
ttttaggttttggga

SEQ ID NO: 100665 - DNA, 15 bp, Homo sapiens
attttaggttttggg

SEQ ID NO: 100666 - DNA, 15 bp, Homo sapiens
tattttaggttttgg

SEQ ID NO: 100667 - DNA, 15 bp, Homo sapiens
atattttaggttttg

SEQ ID NO: 100668 - DNA, 15 bp, Homo sapiens
aatattttaggtttt

SEQ ID NO: 100669 - DNA, 15 bp, Homo sapiens
aaatattttaggttt

SEQ ID NO: 100670 - DNA, 15 bp, Homo sapiens
taaatattttaggtt

SEQ ID NO: 100671 - DNA, 15 bp, Homo sapiens
gtaaatattttaggt

SEQ ID NO: 100672 - DNA, 15 bp, Homo sapiens
agtaaatattttagg

SEQ ID NO: 100673 - DNA, 15 bp, Homo sapiens
cagtaaatattttag

SEQ ID NO: 100674 - DNA, 15 bp, Homo sapiens
ccagtaaatatttta

SEQ ID NO: 100675 - DNA, 15 bp, Homo sapiens
gccagtaaatatttt

SEQ ID NO: 100676 - DNA, 15 bp, Homo sapiens
agccagtaaatattt

SEQ ID NO: 100677 - DNA, 15 bp, Homo sapiens
cagccagtaaatatt

SEQ ID NO: 100678 - DNA, 15 bp, Homo sapiens
ccagccagtaaatat

SEQ ID NO: 100679 - DNA, 15 bp, Homo sapiens
gccagccagtaaata

SEQ ID NO: 100680 - DNA, 15 bp, Homo sapiens
ggccagccagtaaat

SEQ ID NO: 100681 - DNA, 15 bp, Homo sapiens
gggccagccagtaaa

SEQ ID NO: 100682 - DNA, 15 bp, Homo sapiens
agggccagccagtaa

SEQ ID NO: 100683 - DNA, 15 bp, Homo sapiens
aagggccagccagta

SEQ ID NO: 100684 - DNA, 15 bp, Homo sapiens
aaagggccagccagt

SEQ ID NO: 100685 - DNA, 15 bp, Homo sapiens
caaagggccagccag

SEQ ID NO: 100686 - DNA, 15 bp, Homo sapiens
acaaagggccagcca

SEQ ID NO: 100687 - DNA, 15 bp, Homo sapiens
tacaaagggccagcc

SEQ ID NO: 100688 - DNA, 15 bp, Homo sapiens
ctacaaagggccagc

SEQ ID NO: 100689 - DNA, 15 bp, Homo sapiens
tctacaaagggccag

SEQ ID NO: 100690 - DNA, 15 bp, Homo sapiens
ttctacaaagggcca

SEQ ID NO: 100691 - DNA, 15 bp, Homo sapiens
tttctacaaagggcc

SEQ ID NO: 100692 - DNA, 15 bp, Homo sapiens
ttttctacaaagggc

SEQ ID NO: 100693 - DNA, 15 bp, Homo sapiens
tttttctacaaaggg

SEQ ID NO: 100694 - DNA, 15 bp, Homo sapiens
atttttctacaaagg

SEQ ID NO: 100695 - DNA, 15 bp, Homo sapiens
catttttctacaaag

SEQ ID NO: 100696 - DNA, 15 bp, Homo sapiens
acatttttctacaaa

SEQ ID NO: 100697 - DNA, 15 bp, Homo sapiens
tacatttttctacaa

SEQ ID NO: 100698 - DNA, 15 bp, Homo sapiens
gtacatttttctaca

SEQ ID NO: 100699 - DNA, 15 bp, Homo sapiens
agtacatttttctac

SEQ ID NO: 100700 - DNA, 15 bp, Homo sapiens
cagtacatttttcta

SEQ ID NO: 100701 - DNA, 15 bp, Homo sapiens
gcagtacatttttct

SEQ ID NO: 100702 - DNA, 15 bp, Homo sapiens
agcagtacatttttc

SEQ ID NO: 100703 - DNA, 15 bp, Homo sapiens
gagcagtacattttt

SEQ ID NO: 100704 - DNA, 15 bp, Homo sapiens
ggagcagtacatttt

SEQ ID NO: 100705 - DNA, 15 bp, Homo sapiens
aggagcagtacattt

SEQ ID NO: 100706 - DNA, 15 bp, Homo sapiens
aaggagcagtacatt

SEQ ID NO: 100707 - DNA, 15 bp, Homo sapiens
caaggagcagtacat

SEQ ID NO: 100708 - DNA, 15 bp, Homo sapiens
tcaaggagcagtaca

SEQ ID NO: 100709 - DNA, 15 bp, Homo sapiens
atcaaggagcagtac

SEQ ID NO: 100710 - DNA, 15 bp, Homo sapiens
gatcaaggagcagta

SEQ ID NO: 100711 - DNA, 15 bp, Homo sapiens
agatcaaggagcagt

SEQ ID NO: 100712 - DNA, 15 bp, Homo sapiens
cagatcaaggagcag

SEQ ID NO: 100713 - DNA, 15 bp, Homo sapiens
ccagatcaaggagca

SEQ ID NO: 100714 - DNA, 15 bp, Homo sapiens
accagatcaaggagc

SEQ ID NO: 100715 - DNA, 15 bp, Homo sapiens
taccagatcaaggag

SEQ ID NO: 100716 - DNA, 15 bp, Homo sapiens
ttaccagatcaagga

SEQ ID NO: 100717 - DNA, 15 bp, Homo sapiens
cttaccagatcaagg

SEQ ID NO: 100718 - DNA, 15 bp, Homo sapiens
gcttaccagatcaag

SEQ ID NO: 100719 - DNA, 15 bp, Homo sapiens
tgcttaccagatcaa

SEQ ID NO: 100720 - DNA, 15 bp, Homo sapiens
atgcttaccagatca

SEQ ID NO: 100721 - DNA, 15 bp, Homo sapiens
tatgcttaccagatc

SEQ ID NO: 100722 - DNA, 15 bp, Homo sapiens
gtatgcttaccagat

SEQ ID NO: 100723 - DNA, 15 bp, Homo sapiens
agtatgcttaccaga

SEQ ID NO: 100724 - DNA, 15 bp, Homo sapiens
aagtatgcttaccag

SEQ ID NO: 100725 - DNA, 15 bp, Homo sapiens
gaagtatgcttacca

SEQ ID NO: 100726 - DNA, 15 bp, Homo sapiens
tgaagtatgcttacc

SEQ ID NO: 100727 - DNA, 15 bp, Homo sapiens
atgaagtatgcttac

SEQ ID NO: 100728 - DNA, 15 bp, Homo sapiens
tatgaagtatgctta

SEQ ID NO: 100729 - DNA, 15 bp, Homo sapiens
atatgaagtatgctt

SEQ ID NO: 100730 - DNA, 15 bp, Homo sapiens
catatgaagtatgct

SEQ ID NO: 100731 - DNA, 15 bp, Homo sapiens
ccatatgaagtatgc

SEQ ID NO: 100732 - DNA, 15 bp, Homo sapiens
tccatatgaagtatg

SEQ ID NO: 100733 - DNA, 15 bp, Homo sapiens
ctccatatgaagtat

SEQ ID NO: 100734 - DNA, 15 bp, Homo sapiens
tctccatatgaagta

SEQ ID NO: 100735 - DNA, 15 bp, Homo sapiens
ctctccatatgaagt

SEQ ID NO: 100736 - DNA, 15 bp, Homo sapiens
actctccatatgaag

SEQ ID NO: 100737 - DNA, 15 bp, Homo sapiens
cactctccatatgaa

SEQ ID NO: 100738 - DNA, 15 bp, Homo sapiens
ccactctccatatga

SEQ ID NO: 100739 - DNA, 15 bp, Homo sapiens
tccactctccatatg

SEQ ID NO: 100740 - DNA, 15 bp, Homo sapiens
gtccactctccatat

SEQ ID NO: 100741 - DNA, 15 bp, Homo sapiens
ggtccactctccata

SEQ ID NO: 100742 - DNA, 15 bp, Homo sapiens
cggtccactctccat

SEQ ID NO: 100743 - DNA, 15 bp, Homo sapiens
ccggtccactctcca

SEQ ID NO: 100744 - DNA, 15 bp, Homo sapiens
gccggtccactctcc

SEQ ID NO: 100745 - DNA, 15 bp, Homo sapiens
tgccggtccactctc

SEQ ID NO: 100746 - DNA, 15 bp, Homo sapiens
ctgccggtccactct

SEQ ID NO: 100747 - DNA, 15 bp, Homo sapiens
cctgccggtccactc

SEQ ID NO: 100748 - DNA, 15 bp, Homo sapiens
acctgccggtccact

SEQ ID NO: 100749 - DNA, 15 bp, Homo sapiens
cacctgccggtccac

SEQ ID NO: 100750 - DNA, 15 bp, Homo sapiens
gcacctgccggtcca

SEQ ID NO: 100751 - DNA, 15 bp, Homo sapiens
ggcacctgccggtcc

SEQ ID NO: 100752 - DNA, 15 bp, Homo sapiens
aggcacctgccggtc

SEQ ID NO: 100753 - DNA, 15 bp, Homo sapiens
aaggcacctgccggt

SEQ ID NO: 100754 - DNA, 15 bp, Homo sapiens
gaaggcacctgccgg

SEQ ID NO: 100755 - DNA, 15 bp, Homo sapiens
tgaaggcacctgccg

SEQ ID NO: 100756 - DNA, 15 bp, Homo sapiens
gtgaaggcacctgcc

SEQ ID NO: 100757 - DNA, 15 bp, Homo sapiens
agtgaaggcacctgc

SEQ ID NO: 100758 - DNA, 15 bp, Homo sapiens
gagtgaaggcacctg

SEQ ID NO: 100759 - DNA, 15 bp, Homo sapiens
tgagtgaaggcacct

SEQ ID NO: 100760 - DNA, 15 bp, Homo sapiens
atgagtgaaggcacc

SEQ ID NO: 100761 - DNA, 15 bp, Homo sapiens
aatgagtgaaggcac

SEQ ID NO: 100762 - DNA, 15 bp, Homo sapiens
aaatgagtgaaggca

SEQ ID NO: 100763 - DNA, 15 bp, Homo sapiens
taaatgagtgaaggc

SEQ ID NO: 100764 - DNA, 15 bp, Homo sapiens
ataaatgagtgaagg

SEQ ID NO: 100765 - DNA, 15 bp, Homo sapiens
cataaatgagtgaag

SEQ ID NO: 100766 - DNA, 15 bp, Homo sapiens
acataaatgagtgaa

SEQ ID NO: 100767 - DNA, 15 bp, Homo sapiens
tacataaatgagtga

SEQ ID NO: 100768 - DNA, 15 bp, Homo sapiens
ttacataaatgagtg

SEQ ID NO: 100769 - DNA, 15 bp, Homo sapiens
tttacataaatgagt

SEQ ID NO: 100770 - DNA, 15 bp, Homo sapiens
gtttacataaatgag

SEQ ID NO: 100771 - DNA, 15 bp, Homo sapiens
ggtttacataaatga

SEQ ID NO: 100772 - DNA, 15 bp, Homo sapiens
tggtttacataaatg

SEQ ID NO: 100773 - DNA, 15 bp, Homo sapiens
ctggtttacataaat

SEQ ID NO: 100774 - DNA, 15 bp, Homo sapiens
tctggtttacataaa

SEQ ID NO: 100775 - DNA, 15 bp, Homo sapiens
ttctggtttacataa

SEQ ID NO: 100776 - DNA, 15 bp, Homo sapiens
cttctggtttacata

SEQ ID NO: 100777 - DNA, 15 bp, Homo sapiens
tcttctggtttacat

SEQ ID NO: 100778 - DNA, 15 bp, Homo sapiens
atcttctggtttaca

SEQ ID NO: 100779 - DNA, 15 bp, Homo sapiens
catcttctggtttac

SEQ ID NO: 100780 - DNA, 15 bp, Homo sapiens
gcatcttctggttta

SEQ ID NO: 100781 - DNA, 15 bp, Homo sapiens
ggcatcttctggttt

SEQ ID NO: 100782 - DNA, 15 bp, Homo sapiens
aggcatcttctggtt

SEQ ID NO: 100783 - DNA, 15 bp, Homo sapiens
gaggcatcttctggt

SEQ ID NO: 100784 - DNA, 15 bp, Homo sapiens
ggaggcatcttctgg

SEQ ID NO: 100785 - DNA, 15 bp, Homo sapiens
tggaggcatcttctg

SEQ ID NO: 100786 - DNA, 15 bp, Homo sapiens
gtggaggcatcttct

SEQ ID NO: 100787 - DNA, 15 bp, Homo sapiens
agtggaggcatcttc

SEQ ID NO: 100788 - DNA, 15 bp, Homo sapiens
gagtggaggcatctt

SEQ ID NO: 100789 - DNA, 15 bp, Homo sapiens
tgagtggaggcatct

SEQ ID NO: 100790 - DNA, 15 bp, Homo sapiens
atgagtggaggcatc

SEQ ID NO: 100791 - DNA, 15 bp, Homo sapiens
aatgagtggaggcat

SEQ ID NO: 100792 - DNA, 15 bp, Homo sapiens
gaatgagtggaggca

SEQ ID NO: 100793 - DNA, 15 bp, Homo sapiens
tgaatgagtggaggc

SEQ ID NO: 100794 - DNA, 15 bp, Homo sapiens
ctgaatgagtggagg

SEQ ID NO: 100795 - DNA, 15 bp, Homo sapiens
actgaatgagtggag

SEQ ID NO: 100796 - DNA, 15 bp, Homo sapiens
tactgaatgagtgga

SEQ ID NO: 100797 - DNA, 15 bp, Homo sapiens
gtactgaatgagtgg

SEQ ID NO: 100798 - DNA, 15 bp, Homo sapiens
tgtactgaatgagtg

SEQ ID NO: 100799 - DNA, 15 bp, Homo sapiens
atgtactgaatgagt

SEQ ID NO: 100800 - DNA, 15 bp, Homo sapiens
aatgtactgaatgag

SEQ ID NO: 100801 - DNA, 15 bp, Homo sapiens
gaatgtactgaatga

SEQ ID NO: 100802 - DNA, 15 bp, Homo sapiens
tgaatgtactgaatg

SEQ ID NO: 100803 - DNA, 15 bp, Homo sapiens
ttgaatgtactgaat

SEQ ID NO: 100804 - DNA, 15 bp, Homo sapiens
cttgaatgtactgaa

SEQ ID NO: 100805 - DNA, 15 bp, Homo sapiens
tcttgaatgtactga

SEQ ID NO: 100806 - DNA, 15 bp, Homo sapiens
gtcttgaatgtactg

SEQ ID NO: 100807 - DNA, 15 bp, Homo sapiens
cgtcttgaatgtact

SEQ ID NO: 100808 - DNA, 15 bp, Homo sapiens
tcgtcttgaatgtac

SEQ ID NO: 100809 - DNA, 15 bp, Homo sapiens
gtcgtcttgaatgta

SEQ ID NO: 100810 - DNA, 15 bp, Homo sapiens
tgtcgtcttgaatgt

SEQ ID NO: 100811 - DNA, 15 bp, Homo sapiens
ttgtcgtcttgaatg

SEQ ID NO: 100812 - DNA, 15 bp, Homo sapiens
cttgtcgtcttgaat

SEQ ID NO: 100813 - DNA, 15 bp, Homo sapiens
gcttgtcgtcttgaa

SEQ ID NO: 100814 - DNA, 15 bp, Homo sapiens
ggcttgtcgtcttga

SEQ ID NO: 100815 - DNA, 15 bp, Homo sapiens
gggcttgtcgtcttg

SEQ ID NO: 100816 - DNA, 15 bp, Homo sapiens
tgggcttgtcgtctt

SEQ ID NO: 100817 - DNA, 15 bp, Homo sapiens
ctgggcttgtcgtct

SEQ ID NO: 100818 - DNA, 15 bp, Homo sapiens
cctgggcttgtcgtc

SEQ ID NO: 100819 - DNA, 15 bp, Homo sapiens
tcctgggcttgtcgt

SEQ ID NO: 100820 - DNA, 15 bp, Homo sapiens
ctcctgggcttgtcg

SEQ ID NO: 100821 - DNA, 15 bp, Homo sapiens
cctcctgggcttgtc

SEQ ID NO: 100822 - DNA, 15 bp, Homo sapiens
gcctcctgggcttgt

SEQ ID NO: 100823 - DNA, 15 bp, Homo sapiens
tgcctcctgggcttg

SEQ ID NO: 100824 - DNA, 15 bp, Homo sapiens
atgcctcctgggctt

SEQ ID NO: 100825 - DNA, 15 bp, Homo sapiens
gatgcctcctgggct

SEQ ID NO: 100826 - DNA, 15 bp, Homo sapiens
ggatgcctcctgggc

SEQ ID NO: 100827 - DNA, 15 bp, Homo sapiens
tggatgcctcctggg

SEQ ID NO: 100828 - DNA, 15 bp, Homo sapiens
ctggatgcctcctgg

SEQ ID NO: 100829 - DNA, 15 bp, Homo sapiens
gctggatgcctcctg

SEQ ID NO: 100830 - DNA, 15 bp, Homo sapiens
agctggatgcctcct

SEQ ID NO: 100831 - DNA, 15 bp, Homo sapiens
cagctggatgcctcc

SEQ ID NO: 100832 - DNA, 15 bp, Homo sapiens
tcagctggatgcctc

SEQ ID NO: 100833 - DNA, 15 bp, Homo sapiens
ctcagctggatgcct

SEQ ID NO: 100834 - DNA, 15 bp, Homo sapiens
actcagctggatgcc

SEQ ID NO: 100835 - DNA, 15 bp, Homo sapiens
aactcagctggatgc

SEQ ID NO: 100836 - DNA, 15 bp, Homo sapiens
gaactcagctggatg

SEQ ID NO: 100837 - DNA, 15 bp, Homo sapiens
agaactcagctggat

SEQ ID NO: 100838 - DNA, 15 bp, Homo sapiens
aagaactcagctgga

SEQ ID NO: 100839 - DNA, 15 bp, Homo sapiens
aaagaactcagctgg

SEQ ID NO: 100840 - DNA, 15 bp, Homo sapiens
gaaagaactcagctg

SEQ ID NO: 100841 - DNA, 15 bp, Homo sapiens
agaaagaactcagct

SEQ ID NO: 100842 - DNA, 15 bp, Homo sapiens
gagaaagaactcagc

SEQ ID NO: 100843 - DNA, 15 bp, Homo sapiens
ggagaaagaactcag

SEQ ID NO: 100844 - DNA, 15 bp, Homo sapiens
aggagaaagaactca

SEQ ID NO: 100845 - DNA, 15 bp, Homo sapiens
taggagaaagaactc

SEQ ID NO: 100846 - DNA, 15 bp, Homo sapiens
ttaggagaaagaact

SEQ ID NO: 100847 - DNA, 15 bp, Homo sapiens
tttaggagaaagaac

SEQ ID NO: 100848 - DNA, 15 bp, Homo sapiens
gtttaggagaaagaa

SEQ ID NO: 100849 - DNA, 15 bp, Homo sapiens
agtttaggagaaaga

SEQ ID NO: 100850 - DNA, 15 bp, Homo sapiens
aagtttaggagaaag

SEQ ID NO: 100851 - DNA, 15 bp, Homo sapiens
taagtttaggagaaa

SEQ ID NO: 100852 - DNA, 15 bp, Homo sapiens
gtaagtttaggagaa

SEQ ID NO: 100853 - DNA, 15 bp, Homo sapiens
ggtaagtttaggaga

SEQ ID NO: 100854 - DNA, 15 bp, Homo sapiens
tggtaagtttaggag

SEQ ID NO: 100855 - DNA, 15 bp, Homo sapiens
gtggtaagtttagga

SEQ ID NO: 100856 - DNA, 15 bp, Homo sapiens
agtggtaagtttagg

SEQ ID NO: 100857 - DNA, 15 bp, Homo sapiens
gagtggtaagtttag

SEQ ID NO: 100858 - DNA, 15 bp, Homo sapiens
tgagtggtaagttta

SEQ ID NO: 100859 - DNA, 15 bp, Homo sapiens
ttgagtggtaagttt

SEQ ID NO: 100860 - DNA, 15 bp, Homo sapiens
tttgagtggtaagtt

SEQ ID NO: 100861 - DNA, 15 bp, Homo sapiens
atttgagtggtaagt

SEQ ID NO: 100862 - DNA, 15 bp, Homo sapiens
tatttgagtggtaag

SEQ ID NO: 100863 - DNA, 15 bp, Homo sapiens
ttatttgagtggtaa

SEQ ID NO: 100864 - DNA, 15 bp, Homo sapiens
cttatttgagtggta

SEQ ID NO: 100865 - DNA, 15 bp, Homo sapiens
acttatttgagtggt

SEQ ID NO: 100866 - DNA, 15 bp, Homo sapiens
aacttatttgagtgg

SEQ ID NO: 100867 - DNA, 15 bp, Homo sapiens
gaacttatttgagtg

SEQ ID NO: 100868 - DNA, 15 bp, Homo sapiens
ggaacttatttgagt

SEQ ID NO: 100869 - DNA, 15 bp, Homo sapiens
aggaacttatttgag

SEQ ID NO: 100870 - DNA, 15 bp, Homo sapiens
gaggaacttatttga

SEQ ID NO: 100871 - DNA, 15 bp, Homo sapiens
agaggaacttatttg

SEQ ID NO: 100872 - DNA, 15 bp, Homo sapiens
aagaggaacttattt

SEQ ID NO: 100873 - DNA, 15 bp, Homo sapiens
taagaggaacttatt

SEQ ID NO: 100874 - DNA, 15 bp, Homo sapiens
ataagaggaacttat

SEQ ID NO: 100875 - DNA, 15 bp, Homo sapiens
tataagaggaactta

SEQ ID NO: 100876 - DNA, 15 bp, Homo sapiens
ttataagaggaactt

SEQ ID NO: 100877 - DNA, 15 bp, Homo sapiens
attataagaggaact

SEQ ID NO: 100878 - DNA, 15 bp, Homo sapiens
tattataagaggaac

SEQ ID NO: 100879 - DNA, 15 bp, Homo sapiens
ttattataagaggaa

SEQ ID NO: 100880 - DNA, 15 bp, Homo sapiens
cttattataagagga

SEQ ID NO: 100881 - DNA, 15 bp, Homo sapiens
ccttattataagagg

SEQ ID NO: 100882 - DNA, 15 bp, Homo sapiens
cccttattataagag

SEQ ID NO: 100883 - DNA, 15 bp, Homo sapiens
tcccttattataaga

SEQ ID NO: 100884 - DNA, 15 bp, Homo sapiens
atcccttattataag

SEQ ID NO: 100885 - DNA, 15 bp, Homo sapiens
aatcccttattataa

SEQ ID NO: 100886 - DNA, 15 bp, Homo sapiens
taatcccttattata

SEQ ID NO: 100887 - DNA, 15 bp, Homo sapiens
ataatcccttattat

SEQ ID NO: 100888 - DNA, 15 bp, Homo sapiens
tataatcccttatta

SEQ ID NO: 100889 - DNA, 15 bp, Homo sapiens
ttataatcccttatt

SEQ ID NO: 100890 - DNA, 15 bp, Homo sapiens
tttataatcccttat

SEQ ID NO: 100891 - DNA, 15 bp, Homo sapiens
atttataatccctta

SEQ ID NO: 100892 - DNA, 15 bp, Homo sapiens
aatttataatccctt

SEQ ID NO: 100893 - DNA, 15 bp, Homo sapiens
aaatttataatccct

SEQ ID NO: 100894 - DNA, 15 bp, Homo sapiens
taaatttataatccc

SEQ ID NO: 100895 - DNA, 15 bp, Homo sapiens
ataaatttataatcc

SEQ ID NO: 100896 - DNA, 15 bp, Homo sapiens
tataaatttataatc

SEQ ID NO: 100897 - DNA, 15 bp, Homo sapiens
ttataaatttataat

SEQ ID NO: 100898 - DNA, 15 bp, Homo sapiens
tttataaatttataa

SEQ ID NO: 100899 - DNA, 15 bp, Homo sapiens
atttataaatttata

SEQ ID NO: 100900 - DNA, 15 bp, Homo sapiens
catttataaatttat

SEQ ID NO: 100901 - DNA, 15 bp, Homo sapiens
acatttataaattta

SEQ ID NO: 100902 - DNA, 15 bp, Homo sapiens
aacatttataaattt

SEQ ID NO: 100903 - DNA, 15 bp, Homo sapiens
aaacatttataaatt

SEQ ID NO: 100904 - DNA, 15 bp, Homo sapiens
gaaacatttataaat

SEQ ID NO: 100905 - DNA, 15 bp, Homo sapiens
ggaaacatttataaa

SEQ ID NO: 100906 - DNA, 15 bp, Homo sapiens
tggaaacatttataa

SEQ ID NO: 100907 - DNA, 15 bp, Homo sapiens
gtggaaacatttata

SEQ ID NO: 100908 - DNA, 15 bp, Homo sapiens
ggtggaaacatttat

SEQ ID NO: 100909 - DNA, 15 bp, Homo sapiens
gggtggaaacattta

SEQ ID NO: 100910 - DNA, 15 bp, Homo sapiens
tgggtggaaacattt

SEQ ID NO: 100911 - DNA, 15 bp, Homo sapiens
gtgggtggaaacatt

SEQ ID NO: 100912 - DNA, 15 bp, Homo sapiens
agtgggtggaaacat

SEQ ID NO: 100913 - DNA, 15 bp, Homo sapiens
tagtgggtggaaaca

SEQ ID NO: 100914 - DNA, 15 bp, Homo sapiens
gtagtgggtggaaac

SEQ ID NO: 100915 - DNA, 15 bp, Homo sapiens
tgtagtgggtggaaa

SEQ ID NO: 100916 - DNA, 15 bp, Homo sapiens
gtgtagtgggtggaa

SEQ ID NO: 100917 - DNA, 15 bp, Homo sapiens
tgtgtagtgggtgga

SEQ ID NO: 100918 - DNA, 15 bp, Homo sapiens
ttgtgtagtgggtgg

SEQ ID NO: 100919 - DNA, 15 bp, Homo sapiens
gttgtgtagtgggtg

SEQ ID NO: 100920 - DNA, 15 bp, Homo sapiens
ggttgtgtagtgggt

SEQ ID NO: 100921 - DNA, 15 bp, Homo sapiens
gggttgtgtagtggg

SEQ ID NO: 100922 - DNA, 15 bp, Homo sapiens
ggggttgtgtagtgg

SEQ ID NO: 100923 - DNA, 15 bp, Homo sapiens
aggggttgtgtagtg

SEQ ID NO: 100924 - DNA, 15 bp, Homo sapiens
caggggttgtgtagt

SEQ ID NO: 100925 - DNA, 15 bp, Homo sapiens
ccaggggttgtgtag

SEQ ID NO: 100926 - DNA, 15 bp, Homo sapiens
cccaggggttgtgta

SEQ ID NO: 100927 - DNA, 15 bp, Homo sapiens
acccaggggttgtgt

SEQ ID NO: 100928 - DNA, 15 bp, Homo sapiens
gacccaggggttgtg

SEQ ID NO: 100929 - DNA, 15 bp, Homo sapiens
ggacccaggggttgt

SEQ ID NO: 100930 - DNA, 15 bp, Homo sapiens
gggacccaggggttg

SEQ ID NO: 100931 - DNA, 15 bp, Homo sapiens
agggacccaggggtt

SEQ ID NO: 100932 - DNA, 15 bp, Homo sapiens
cagggacccaggggt

SEQ ID NO: 100933 - DNA, 15 bp, Homo sapiens
gcagggacccagggg

SEQ ID NO: 100934 - DNA, 15 bp, Homo sapiens
agcagggacccaggg

SEQ ID NO: 100935 - DNA, 15 bp, Homo sapiens
gagcagggacccagg

SEQ ID NO: 100936 - DNA, 15 bp, Homo sapiens
agagcagggacccag

SEQ ID NO: 100937 - DNA, 15 bp, Homo sapiens
cagagcagggaccca

SEQ ID NO: 100938 - DNA, 15 bp, Homo sapiens
ccagagcagggaccc

SEQ ID NO: 100939 - DNA, 15 bp, Homo sapiens
tccagagcagggacc

SEQ ID NO: 100940 - DNA, 15 bp, Homo sapiens
ttccagagcagggac

SEQ ID NO: 100941 - DNA, 15 bp, Homo sapiens
tttccagagcaggga

SEQ ID NO: 100942 - DNA, 15 bp, Homo sapiens
gtttccagagcaggg

SEQ ID NO: 100943 - DNA, 15 bp, Homo sapiens
ggtttccagagcagg

SEQ ID NO: 100944 - DNA, 15 bp, Homo sapiens
aggtttccagagcag

SEQ ID NO: 100945 - DNA, 15 bp, Homo sapiens
gaggtttccagagca

SEQ ID NO: 100946 - DNA, 15 bp, Homo sapiens
tgaggtttccagagc

SEQ ID NO: 100947 - DNA, 15 bp, Homo sapiens
ctgaggtttccagag

SEQ ID NO: 100948 - DNA, 15 bp, Homo sapiens
tctgaggtttccaga

SEQ ID NO: 100949 - DNA, 15 bp, Homo sapiens
ctctgaggtttccag

SEQ ID NO: 100950 - DNA, 15 bp, Homo sapiens
cctctgaggtttcca

SEQ ID NO: 100951 - DNA, 15 bp, Homo sapiens
ccctctgaggtttcc

SEQ ID NO: 100952 - DNA, 15 bp, Homo sapiens
cccctctgaggtttc

SEQ ID NO: 100953 - DNA, 15 bp, Homo sapiens
tcccctctgaggttt

SEQ ID NO: 100954 - DNA, 15 bp, Homo sapiens
ttcccctctgaggtt

SEQ ID NO: 100955 - DNA, 15 bp, Homo sapiens
attcccctctgaggt

SEQ ID NO: 100956 - DNA, 15 bp, Homo sapiens
cattcccctctgagg

SEQ ID NO: 100957 - DNA, 15 bp, Homo sapiens
tcattcccctctgag

SEQ ID NO: 100958 - DNA, 15 bp, Homo sapiens
ctcattcccctctga

SEQ ID NO: 100959 - DNA, 15 bp, Homo sapiens
actcattcccctctg

SEQ ID NO: 100960 - DNA, 15 bp, Homo sapiens
cactcattcccctct

SEQ ID NO: 100961 - DNA, 15 bp, Homo sapiens
tcactcattcccctc

SEQ ID NO: 100962 - DNA, 15 bp, Homo sapiens
atcactcattcccct

SEQ ID NO: 100963 - DNA, 15 bp, Homo sapiens
gatcactcattcccc

SEQ ID NO: 100964 - DNA, 15 bp, Homo sapiens
tgatcactcattccc

SEQ ID NO: 100965 - DNA, 15 bp, Homo sapiens
ttgatcactcattcc

SEQ ID NO: 100966 - DNA, 15 bp, Homo sapiens
tttgatcactcattc

SEQ ID NO: 100967 - DNA, 15 bp, Homo sapiens
ttttgatcactcatt

SEQ ID NO: 100968 - DNA, 15 bp, Homo sapiens
gttttgatcactcat

SEQ ID NO: 100969 - DNA, 15 bp, Homo sapiens
ggttttgatcactca

SEQ ID NO: 100970 - DNA, 15 bp, Homo sapiens
tggttttgatcactc

SEQ ID NO: 100971 - DNA, 15 bp, Homo sapiens
ttggttttgatcact

SEQ ID NO: 100972 - DNA, 15 bp, Homo sapiens
gttggttttgatcac

SEQ ID NO: 100973 - DNA, 15 bp, Homo sapiens
tgttggttttgatca

SEQ ID NO: 100974 - DNA, 15 bp, Homo sapiens
gtgttggttttgatc

SEQ ID NO: 100975 - DNA, 15 bp, Homo sapiens
tgtgttggttttgat

SEQ ID NO: 100976 - DNA, 15 bp, Homo sapiens
ctgtgttggttttga

SEQ ID NO: 100977 - DNA, 15 bp, Homo sapiens
actgtgttggttttg

SEQ ID NO: 100978 - DNA, 15 bp, Homo sapiens
tactgtgttggtttt

SEQ ID NO: 100979 - DNA, 15 bp, Homo sapiens
ttactgtgttggttt

SEQ ID NO: 100980 - DNA, 15 bp, Homo sapiens
cttactgtgttggtt

SEQ ID NO: 100981 - DNA, 15 bp, Homo sapiens
tcttactgtgttggt

SEQ ID NO: 100982 - DNA, 15 bp, Homo sapiens
ttcttactgtgttgg

SEQ ID NO: 100983 - DNA, 15 bp, Homo sapiens
gttcttactgtgttg

SEQ ID NO: 100984 - DNA, 15 bp, Homo sapiens
tgttcttactgtgtt

SEQ ID NO: 100985 - DNA, 15 bp, Homo sapiens
ctgttcttactgtgt

SEQ ID NO: 100986 - DNA, 15 bp, Homo sapiens
actgttcttactgtg

SEQ ID NO: 100987 - DNA, 15 bp, Homo sapiens
tactgttcttactgt

SEQ ID NO: 100988 - DNA, 15 bp, Homo sapiens
atactgttcttactg

SEQ ID NO: 100989 - DNA, 15 bp, Homo sapiens
tatactgttcttact

SEQ ID NO: 100990 - DNA, 15 bp, Homo sapiens
ttatactgttcttac

SEQ ID NO: 100991 - DNA, 15 bp, Homo sapiens
gttatactgttctta

SEQ ID NO: 100992 - DNA, 15 bp, Homo sapiens
agttatactgttctt

SEQ ID NO: 100993 - DNA, 15 bp, Homo sapiens
gagttatactgttct

SEQ ID NO: 100994 - DNA, 15 bp, Homo sapiens
ggagttatactgttc

SEQ ID NO: 100995 - DNA, 15 bp, Homo sapiens
tggagttatactgtt

SEQ ID NO: 100996 - DNA, 15 bp, Homo sapiens
ctggagttatactgt

SEQ ID NO: 100997 - DNA, 15 bp, Homo sapiens
actggagttatactg

SEQ ID NO: 100998 - DNA, 15 bp, Homo sapiens
aactggagttatact

SEQ ID NO: 100999 - DNA, 15 bp, Homo sapiens
aaactggagttatac

SEQ ID NO: 101000 - DNA, 15 bp, Homo sapiens
aaaactggagttata

SEQ ID NO: 101001 - DNA, 15 bp, Homo sapiens
caaaactggagttat

SEQ ID NO: 101002 - DNA, 15 bp, Homo sapiens
ccaaaactggagtta

SEQ ID NO: 101003 - DNA, 15 bp, Homo sapiens
accaaaactggagtt

SEQ ID NO: 101004 - DNA, 15 bp, Homo sapiens
taccaaaactggagt

SEQ ID NO: 101005 - DNA, 15 bp, Homo sapiens
ttaccaaaactggag

SEQ ID NO: 101006 - DNA, 15 bp, Homo sapiens
tttaccaaaactgga

SEQ ID NO: 101007 - DNA, 15 bp, Homo sapiens
ttttaccaaaactgg

SEQ ID NO: 101008 - DNA, 15 bp, Homo sapiens
attttaccaaaactg

SEQ ID NO: 101009 - DNA, 15 bp, Homo sapiens
cattttaccaaaact

SEQ ID NO: 101010 - DNA, 15 bp, Homo sapiens
acattttaccaaaac

SEQ ID NO: 101011 - DNA, 15 bp, Homo sapiens
cacattttaccaaaa

SEQ ID NO: 101012 - DNA, 15 bp, Homo sapiens
ccacattttaccaaa

SEQ ID NO: 101013 - DNA, 15 bp, Homo sapiens
gccacattttaccaa

SEQ ID NO: 101014 - DNA, 15 bp, Homo sapiens
agccacattttacca

SEQ ID NO: 101015 - DNA, 15 bp, Homo sapiens
gagccacattttacc

SEQ ID NO: 101016 - DNA, 15 bp, Homo sapiens
agagccacattttac

SEQ ID NO: 101017 - DNA, 15 bp, Homo sapiens
gagagccacatttta

SEQ ID NO: 101018 - DNA, 15 bp, Homo sapiens
agagagccacatttt

SEQ ID NO: 101019 - DNA, 15 bp, Homo sapiens
aagagagccacattt

SEQ ID NO: 101020 - DNA, 15 bp, Homo sapiens
taagagagccacatt

SEQ ID NO: 101021 - DNA, 15 bp, Homo sapiens
ataagagagccacat

SEQ ID NO: 101022 - DNA, 15 bp, Homo sapiens
tataagagagccaca

SEQ ID NO: 101023 - DNA, 15 bp, Homo sapiens
atataagagagccac

SEQ ID NO: 101024 - DNA, 15 bp, Homo sapiens
aatataagagagcca

SEQ ID NO: 101025 - DNA, 15 bp, Homo sapiens
caatataagagagcc

SEQ ID NO: 101026 - DNA, 15 bp, Homo sapiens
tcaatataagagagc

SEQ ID NO: 101027 - DNA, 15 bp, Homo sapiens
gtcaatataagagag

SEQ ID NO: 101028 - DNA, 15 bp, Homo sapiens
tgtcaatataagaga

SEQ ID NO: 101029 - DNA, 15 bp, Homo sapiens
atgtcaatataagag

SEQ ID NO: 101030 - DNA, 15 bp, Homo sapiens
catgtcaatataaga

SEQ ID NO: 101031 - DNA, 15 bp, Homo sapiens
acatgtcaatataag

SEQ ID NO: 101032 - DNA, 15 bp, Homo sapiens
gacatgtcaatataa

SEQ ID NO: 101033 - DNA, 15 bp, Homo sapiens
ggacatgtcaatata

SEQ ID NO: 101034 - DNA, 15 bp, Homo sapiens
aggacatgtcaatat

SEQ ID NO: 101035 - DNA, 15 bp, Homo sapiens
gaggacatgtcaata

SEQ ID NO: 101036 - DNA, 15 bp, Homo sapiens
tgaggacatgtcaat

SEQ ID NO: 101037 - DNA, 15 bp, Homo sapiens
atgaggacatgtcaa

SEQ ID NO: 101038 - DNA, 15 bp, Homo sapiens
catgaggacatgtca

SEQ ID NO: 101039 - DNA, 15 bp, Homo sapiens
tcatgaggacatgtc

SEQ ID NO: 101040 - DNA, 15 bp, Homo sapiens
ttcatgaggacatgt

SEQ ID NO: 101041 - DNA, 15 bp, Homo sapiens
attcatgaggacatg

SEQ ID NO: 101042 - DNA, 15 bp, Homo sapiens
aattcatgaggacat

SEQ ID NO: 101043 - DNA, 15 bp, Homo sapiens
aaattcatgaggaca

SEQ ID NO: 101044 - DNA, 15 bp, Homo sapiens
taaattcatgaggac

SEQ ID NO: 101045 - DNA, 15 bp, Homo sapiens
ctaaattcatgagga

SEQ ID NO: 101046 - DNA, 15 bp, Homo sapiens
tctaaattcatgagg

SEQ ID NO: 101047 - DNA, 15 bp, Homo sapiens
ttctaaattcatgag

SEQ ID NO: 101048 - DNA, 15 bp, Homo sapiens
tttctaaattcatga

SEQ ID NO: 101049 - DNA, 15 bp, Homo sapiens
ttttctaaattcatg

SEQ ID NO: 101050 - DNA, 15 bp, Homo sapiens
tttttctaaattcat

SEQ ID NO: 101051 - DNA, 15 bp, Homo sapiens
ttttttctaaattca

SEQ ID NO: 101052 - DNA, 15 bp, Homo sapiens
cttttttctaaattc

SEQ ID NO: 101053 - DNA, 15 bp, Homo sapiens
acttttttctaaatt

SEQ ID NO: 101054 - DNA, 15 bp, Homo sapiens
aacttttttctaaat

SEQ ID NO: 101055 - DNA, 15 bp, Homo sapiens
caacttttttctaaa

SEQ ID NO: 101056 - DNA, 15 bp, Homo sapiens
ccaacttttttctaa

SEQ ID NO: 101057 - DNA, 15 bp, Homo sapiens
cccaacttttttcta

SEQ ID NO: 101058 - DNA, 15 bp, Homo sapiens
tcccaacttttttct

SEQ ID NO: 101059 - DNA, 15 bp, Homo sapiens
ttcccaacttttttc

SEQ ID NO: 101060 - DNA, 15 bp, Homo sapiens
cttcccaactttttt

SEQ ID NO: 101061 - DNA, 15 bp, Homo sapiens
ccttcccaacttttt

SEQ ID NO: 101062 - DNA, 15 bp, Homo sapiens
gccttcccaactttt

SEQ ID NO: 101063 - DNA, 15 bp, Homo sapiens
agccttcccaacttt

SEQ ID NO: 101064 - DNA, 15 bp, Homo sapiens
tagccttcccaactt

SEQ ID NO: 101065 - DNA, 15 bp, Homo sapiens
gtagccttcccaact

SEQ ID NO: 101066 - DNA, 15 bp, Homo sapiens
tgtagccttcccaac

SEQ ID NO: 101067 - DNA, 15 bp, Homo sapiens
atgtagccttcccaa

SEQ ID NO: 101068 - DNA, 15 bp, Homo sapiens
aatgtagccttccca

SEQ ID NO: 101069 - DNA, 15 bp, Homo sapiens
caatgtagccttccc

SEQ ID NO: 101070 - DNA, 15 bp, Homo sapiens
gcaatgtagccttcc

SEQ ID NO: 101071 - DNA, 15 bp, Homo sapiens
tgcaatgtagccttc

SEQ ID NO: 101072 - DNA, 15 bp, Homo sapiens
ttgcaatgtagcctt

SEQ ID NO: 101073 - DNA, 15 bp, Homo sapiens
tttgcaatgtagcct

SEQ ID NO: 101074 - DNA, 15 bp, Homo sapiens
gtttgcaatgtagcc

SEQ ID NO: 101075 - DNA, 15 bp, Homo sapiens
agtttgcaatgtagc

SEQ ID NO: 101076 - DNA, 15 bp, Homo sapiens
aagtttgcaatgtag

SEQ ID NO: 101077 - DNA, 15 bp, Homo sapiens
aaagtttgcaatgta

SEQ ID NO: 101078 - DNA, 15 bp, Homo sapiens
aaaagtttgcaatgt

SEQ ID NO: 101079 - DNA, 15 bp, Homo sapiens
taaaagtttgcaatg

SEQ ID NO: 101080 - DNA, 15 bp, Homo sapiens
gtaaaagtttgcaat

SEQ ID NO: 101081 - DNA, 15 bp, Homo sapiens
tgtaaaagtttgcaa

SEQ ID NO: 101082 - DNA, 15 bp, Homo sapiens
atgtaaaagtttgca

SEQ ID NO: 101083 - DNA, 15 bp, Homo sapiens
gatgtaaaagtttgc

SEQ ID NO: 101084 - DNA, 15 bp, Homo sapiens
tgatgtaaaagtttg

SEQ ID NO: 101085 - DNA, 15 bp, Homo sapiens
ctgatgtaaaagttt

SEQ ID NO: 101086 - DNA, 15 bp, Homo sapiens
actgatgtaaaagtt

SEQ ID NO: 101087 - DNA, 15 bp, Homo sapiens
aactgatgtaaaagt

SEQ ID NO: 101088 - DNA, 15 bp, Homo sapiens
taactgatgtaaaag

SEQ ID NO: 101089 - DNA, 15 bp, Homo sapiens
ctaactgatgtaaaa

SEQ ID NO: 101090 - DNA, 15 bp, Homo sapiens
gctaactgatgtaaa

SEQ ID NO: 101091 - DNA, 15 bp, Homo sapiens
agctaactgatgtaa

SEQ ID NO: 101092 - DNA, 15 bp, Homo sapiens
gagctaactgatgta

SEQ ID NO: 101093 - DNA, 15 bp, Homo sapiens
ggagctaactgatgt

SEQ ID NO: 101094 - DNA, 15 bp, Homo sapiens
tggagctaactgatg

SEQ ID NO: 101095 - DNA, 15 bp, Homo sapiens
ttggagctaactgat

SEQ ID NO: 101096 - DNA, 15 bp, Homo sapiens
cttggagctaactga

SEQ ID NO: 101097 - DNA, 15 bp, Homo sapiens
acttggagctaactg

SEQ ID NO: 101098 - DNA, 15 bp, Homo sapiens
aacttggagctaact

SEQ ID NO: 101099 - DNA, 15 bp, Homo sapiens
caacttggagctaac

SEQ ID NO: 101100 - DNA, 15 bp, Homo sapiens
ccaacttggagctaa

SEQ ID NO: 101101 - DNA, 15 bp, Homo sapiens
tccaacttggagcta

SEQ ID NO: 101102 - DNA, 15 bp, Homo sapiens
ttccaacttggagct

SEQ ID NO: 101103 - DNA, 15 bp, Homo sapiens
attccaacttggagc

SEQ ID NO: 101104 - DNA, 15 bp, Homo sapiens
aattccaacttggag

SEQ ID NO: 101105 - DNA, 15 bp, Homo sapiens
caattccaacttgga

SEQ ID NO: 101106 - DNA, 15 bp, Homo sapiens
ccaattccaacttgg

SEQ ID NO: 101107 - DNA, 15 bp, Homo sapiens
cccaattccaacttg

SEQ ID NO: 101108 - DNA, 15 bp, Homo sapiens
acccaattccaactt

SEQ ID NO: 101109 - DNA, 15 bp, Homo sapiens
cacccaattccaact

SEQ ID NO: 101110 - DNA, 15 bp, Homo sapiens
ccacccaattccaac

SEQ ID NO: 101111 - DNA, 15 bp, Homo sapiens
cccacccaattccaa

SEQ ID NO: 101112 - DNA, 15 bp, Homo sapiens
ccccacccaattcca

SEQ ID NO: 101113 - DNA, 15 bp, Homo sapiens
gccccacccaattcc

SEQ ID NO: 101114 - DNA, 15 bp, Homo sapiens
ggccccacccaattc

SEQ ID NO: 101115 - DNA, 15 bp, Homo sapiens
gggccccacccaatt

SEQ ID NO: 101116 - DNA, 15 bp, Homo sapiens
tgggccccacccaat

SEQ ID NO: 101117 - DNA, 15 bp, Homo sapiens
ctgggccccacccaa

SEQ ID NO: 101118 - DNA, 15 bp, Homo sapiens
cctgggccccaccca

SEQ ID NO: 101119 - DNA, 15 bp, Homo sapiens
tcctgggccccaccc

SEQ ID NO: 101120 - DNA, 15 bp, Homo sapiens
ctcctgggccccacc

SEQ ID NO: 101121 - DNA, 15 bp, Homo sapiens
tctcctgggccccac

SEQ ID NO: 101122 - DNA, 15 bp, Homo sapiens
atctcctgggcccca

SEQ ID NO: 101123 - DNA, 15 bp, Homo sapiens
aatctcctgggcccc

SEQ ID NO: 101124 - DNA, 15 bp, Homo sapiens
aaatctcctgggccc

SEQ ID NO: 101125 - DNA, 15 bp, Homo sapiens
gaaatctcctgggcc

SEQ ID NO: 101126 - DNA, 15 bp, Homo sapiens
tgaaatctcctgggc

SEQ ID NO: 101127 - DNA, 15 bp, Homo sapiens
ttgaaatctcctggg

SEQ ID NO: 101128 - DNA, 15 bp, Homo sapiens
attgaaatctcctgg

SEQ ID NO: 101129 - DNA, 15 bp, Homo sapiens
aattgaaatctcctg

SEQ ID NO: 101130 - DNA, 15 bp, Homo sapiens
aaattgaaatctcct

SEQ ID NO: 101131 - DNA, 15 bp, Homo sapiens
aaaattgaaatctcc

SEQ ID NO: 101132 - DNA, 15 bp, Homo sapiens
gaaaattgaaatctc

SEQ ID NO: 101133 - DNA, 15 bp, Homo sapiens
agaaaattgaaatct

SEQ ID NO: 101134 - DNA, 15 bp, Homo sapiens
tagaaaattgaaatc

SEQ ID NO: 101135 - DNA, 15 bp, Homo sapiens
atagaaaattgaaat

SEQ ID NO: 101136 - DNA, 15 bp, Homo sapiens
catagaaaattgaaa

SEQ ID NO: 101137 - DNA, 15 bp, Homo sapiens
tcatagaaaattgaa

SEQ ID NO: 101138 - DNA, 15 bp, Homo sapiens
ttcatagaaaattga

SEQ ID NO: 101139 - DNA, 15 bp, Homo sapiens
tttcatagaaaattg

SEQ ID NO: 101140 - DNA, 15 bp, Homo sapiens
atttcatagaaaatt

SEQ ID NO: 101141 - DNA, 15 bp, Homo sapiens
aatttcatagaaaat

SEQ ID NO: 101142 - DNA, 15 bp, Homo sapiens
taatttcatagaaaa

SEQ ID NO: 101143 - DNA, 15 bp, Homo sapiens
ataatttcatagaaa

SEQ ID NO: 101144 - DNA, 15 bp, Homo sapiens
aataatttcatagaa

SEQ ID NO: 101145 - DNA, 15 bp, Homo sapiens
aaataatttcataga

SEQ ID NO: 101146 - DNA, 15 bp, Homo sapiens
aaaataatttcatag

SEQ ID NO: 101147 - DNA, 15 bp, Homo sapiens
aaaaataatttcata

SEQ ID NO: 101148 - DNA, 15 bp, Homo sapiens
aaaaaataatttcat

SEQ ID NO: 101149 - DNA, 15 bp, Homo sapiens
taaaaaataatttca

SEQ ID NO: 101150 - DNA, 15 bp, Homo sapiens
ttaaaaaataatttc

SEQ ID NO: 101151 - DNA, 15 bp, Homo sapiens
tttaaaaaataattt

SEQ ID NO: 101152 - DNA, 15 bp, Homo sapiens
ttttaaaaaataatt

SEQ ID NO: 101153 - DNA, 15 bp, Homo sapiens
tttttaaaaaataat

SEQ ID NO: 101154 - DNA, 15 bp, Homo sapiens
atttttaaaaaataa

SEQ ID NO: 101155 - DNA, 15 bp, Homo sapiens
aatttttaaaaaata

SEQ ID NO: 101156 - DNA, 15 bp, Homo sapiens
aaatttttaaaaaat

SEQ ID NO: 101157 - DNA, 15 bp, Homo sapiens
gtaaatttttaaaaa

SEQ ID NO: 101158 - DNA, 15 bp, Homo sapiens
tgtaaatttttaaaa

SEQ ID NO: 101159 - DNA, 15 bp, Homo sapiens
ttgtaaatttttaaa

SEQ ID NO: 101160 - DNA, 15 bp, Homo sapiens
attgtaaatttttaa

SEQ ID NO: 101161 - DNA, 15 bp, Homo sapiens
aattgtaaattttta

SEQ ID NO: 101162 - DNA, 15 bp, Homo sapiens
caattgtaaattttt

SEQ ID NO: 101163 - DNA, 15 bp, Homo sapiens
ccaattgtaaatttt

SEQ ID NO: 101164 - DNA, 15 bp, Homo sapiens
cccaattgtaaattt

SEQ ID NO: 101165 - DNA, 15 bp, Homo sapiens
tcccaattgtaaatt

SEQ ID NO: 101166 - DNA, 15 bp, Homo sapiens
ctcccaattgtaaat

SEQ ID NO: 101167 - DNA, 15 bp, Homo sapiens
gctcccaattgtaaa

SEQ ID NO: 101168 - DNA, 15 bp, Homo sapiens
tgctcccaattgtaa

SEQ ID NO: 101169 - DNA, 15 bp, Homo sapiens
ttgctcccaattgta

SEQ ID NO: 101170 - DNA, 15 bp, Homo sapiens
attgctcccaattgt

SEQ ID NO: 101171 - DNA, 15 bp, Homo sapiens
aattgctcccaattg

SEQ ID NO: 101172 - DNA, 15 bp, Homo sapiens
aaattgctcccaatt

SEQ ID NO: 101173 - DNA, 15 bp, Homo sapiens
aaaattgctcccaat

SEQ ID NO: 101174 - DNA, 15 bp, Homo sapiens
aaaaattgctcccaa

SEQ ID NO: 101175 - DNA, 15 bp, Homo sapiens
aaaaaattgctccca

SEQ ID NO: 101176 - DNA, 15 bp, Homo sapiens
gaaaaaattgctccc

SEQ ID NO: 101177 - DNA, 15 bp, Homo sapiens
tgaaaaaattgctcc

SEQ ID NO: 101178 - DNA, 15 bp, Homo sapiens
atgaaaaaattgctc

SEQ ID NO: 101179 - DNA, 15 bp, Homo sapiens
aatgaaaaaattgct

SEQ ID NO: 101180 - DNA, 15 bp, Homo sapiens
aaatgaaaaaattgc

SEQ ID NO: 101181 - DNA, 15 bp, Homo sapiens
aaaatgaaaaaattg

SEQ ID NO: 101182 - DNA, 15 bp, Homo sapiens
caaaatgaaaaaatt

SEQ ID NO: 101183 - DNA, 15 bp, Homo sapiens
acaaaatgaaaaaat

SEQ ID NO: 101184 - DNA, 15 bp, Homo sapiens
aacaaaatgaaaaaa

SEQ ID NO: 101185 - DNA, 15 bp, Homo sapiens
gaacaaaatgaaaaa

SEQ ID NO: 101186 - DNA, 15 bp, Homo sapiens
tgaacaaaatgaaaa

SEQ ID NO: 101187 - DNA, 15 bp, Homo sapiens
ttgaacaaaatgaaa

SEQ ID NO: 101188 - DNA, 15 bp, Homo sapiens
tttgaacaaaatgaa

SEQ ID NO: 101189 - DNA, 15 bp, Homo sapiens
ttttgaacaaaatga

SEQ ID NO: 101190 - DNA, 15 bp, Homo sapiens
tttttgaacaaaatg

SEQ ID NO: 101191 - DNA, 15 bp, Homo sapiens
gtttttgaacaaaat

SEQ ID NO: 101192 - DNA, 15 bp, Homo sapiens
ggtttttgaacaaaa

SEQ ID NO: 101193 - DNA, 15 bp, Homo sapiens
tggtttttgaacaaa

SEQ ID NO: 101194 - DNA, 15 bp, Homo sapiens
ttggtttttgaacaa

SEQ ID NO: 101195 - DNA, 15 bp, Homo sapiens
tttggtttttgaaca

SEQ ID NO: 101196 - DNA, 15 bp, Homo sapiens
gtttggtttttgaac

SEQ ID NO: 101197 - DNA, 15 bp, Homo sapiens
agtttggtttttgaa

SEQ ID NO: 101198 - DNA, 15 bp, Homo sapiens
aagtttggtttttga

SEQ ID NO: 101199 - DNA, 15 bp, Homo sapiens
aaagtttggtttttg

SEQ ID NO: 101200 - DNA, 15 bp, Homo sapiens
aaaagtttggttttt

SEQ ID NO: 101201 - DNA, 15 bp, Homo sapiens
aaaaagtttggtttt

SEQ ID NO: 101202 - DNA, 15 bp, Homo sapiens
aaaaaagtttggttt

SEQ ID NO: 101203 - DNA, 15 bp, Homo sapiens
aaaaaaagtttggtt

SEQ ID NO: 101204 - DNA, 15 bp, Homo sapiens
aaaaaaaagtttggt

SEQ ID NO: 101205 - DNA, 15 bp, Homo sapiens
aaaaaaaaagtttgg

SEQ ID NO: 101206 - DNA, 15 bp, Homo sapiens
aaaaaaaaaagtttg

SEQ ID NO: 101207 - DNA, 15 bp, Homo sapiens
taacaagagtgaaac

SEQ ID NO: 101208 - DNA, 15 bp, Homo sapiens
gtaacaagagtgaaa

SEQ ID NO: 101209 - DNA, 15 bp, Homo sapiens
ggtaacaagagtgaa

SEQ ID NO: 101210 - DNA, 15 bp, Homo sapiens
gggtaacaagagtga

SEQ ID NO: 101211 - DNA, 15 bp, Homo sapiens
tgggtaacaagagtg

SEQ ID NO: 101212 - DNA, 15 bp, Homo sapiens
ctgggtaacaagagt

SEQ ID NO: 101213 - DNA, 15 bp, Homo sapiens
cctgggtaacaagag

SEQ ID NO: 101214 - DNA, 15 bp, Homo sapiens
gcctgggtaacaaga

SEQ ID NO: 101215 - DNA, 15 bp, Homo sapiens
agcctgggtaacaag

SEQ ID NO: 101216 - DNA, 15 bp, Homo sapiens
cagcctgggtaacaa

SEQ ID NO: 101217 - DNA, 15 bp, Homo sapiens
cctccagcctgggta

SEQ ID NO: 101218 - DNA, 15 bp, Homo sapiens
ctgccctccagcctg

SEQ ID NO: 101219 - DNA, 15 bp, Homo sapiens
actgccctccagcct

SEQ ID NO: 101220 - DNA, 15 bp, Homo sapiens
gccactgccctccag

SEQ ID NO: 101221 - DNA, 15 bp, Homo sapiens
cgccactgccctcca

SEQ ID NO: 101222 - DNA, 15 bp, Homo sapiens
acgccactgccctcc

SEQ ID NO: 101223 - DNA, 15 bp, Homo sapiens
cacgccactgccctc

SEQ ID NO: 101224 - DNA, 15 bp, Homo sapiens
ccacgccactgccct

SEQ ID NO: 101225 - DNA, 15 bp, Homo sapiens
gccacgccactgccc

SEQ ID NO: 101226 - DNA, 15 bp, Homo sapiens
ggccacgccactgcc

SEQ ID NO: 101227 - DNA, 15 bp, Homo sapiens
aggccacgccactgc

SEQ ID NO: 101228 - DNA, 15 bp, Homo sapiens
caggccacgccactg

SEQ ID NO: 101229 - DNA, 15 bp, Homo sapiens
ccaggccacgccact

SEQ ID NO: 101230 - DNA, 15 bp, Homo sapiens
cccaggccacgccac

SEQ ID NO: 101231 - DNA, 15 bp, Homo sapiens
gcccaggccacgcca

SEQ ID NO: 101232 - DNA, 15 bp, Homo sapiens
agcccaggccacgcc

SEQ ID NO: 101233 - DNA, 15 bp, Homo sapiens
aagcccaggccacgc

SEQ ID NO: 101234 - DNA, 15 bp, Homo sapiens
taagcccaggccacg

SEQ ID NO: 101235 - DNA, 15 bp, Homo sapiens
gtaagcccaggccac

SEQ ID NO: 101236 - DNA, 15 bp, Homo sapiens
agtaagcccaggcca

SEQ ID NO: 101237 - DNA, 15 bp, Homo sapiens
cagtaagcccaggcc

SEQ ID NO: 101238 - DNA, 15 bp, Homo sapiens
acagtaagcccaggc

SEQ ID NO: 101239 - DNA, 15 bp, Homo sapiens
tacagtaagcccagg

SEQ ID NO: 101240 - DNA, 15 bp, Homo sapiens
ttacagtaagcccag

SEQ ID NO: 101241 - DNA, 15 bp, Homo sapiens
gttacagtaagccca

SEQ ID NO: 101242 - DNA, 15 bp, Homo sapiens
ggttacagtaagccc

SEQ ID NO: 101243 - DNA, 15 bp, Homo sapiens
aggttacagtaagcc

SEQ ID NO: 101244 - DNA, 15 bp, Homo sapiens
gaggttacagtaagc

SEQ ID NO: 101245 - DNA, 15 bp, Homo sapiens
agaggttacagtaag

SEQ ID NO: 101246 - DNA, 15 bp, Homo sapiens
cagaggttacagtaa

SEQ ID NO: 101247 - DNA, 15 bp, Homo sapiens
gcagaggttacagta

SEQ ID NO: 101248 - DNA, 15 bp, Homo sapiens
ggcagaggttacagt

SEQ ID NO: 101249 - DNA, 15 bp, Homo sapiens
aggcagaggttacag

SEQ ID NO: 101250 - DNA, 15 bp, Homo sapiens
gaggcagaggttaca

SEQ ID NO: 101251 - DNA, 15 bp, Homo sapiens
ggaggcagaggttac

SEQ ID NO: 101252 - DNA, 15 bp, Homo sapiens
gggaggcagaggtta

SEQ ID NO: 101253 - DNA, 15 bp, Homo sapiens
gggcatggtggcagg

SEQ ID NO: 101254 - DNA, 15 bp, Homo sapiens
tgggcatggtggcag

SEQ ID NO: 101255 - DNA, 15 bp, Homo sapiens
ctagctgggcatggt

SEQ ID NO: 101256 - DNA, 15 bp, Homo sapiens
actagctgggcatgg

SEQ ID NO: 101257 - DNA, 15 bp, Homo sapiens
aactagctgggcatg

SEQ ID NO: 101258 - DNA, 15 bp, Homo sapiens
aaactagctgggcat

SEQ ID NO: 101259 - DNA, 15 bp, Homo sapiens
aaaactagctgggca

SEQ ID NO: 101260 - DNA, 15 bp, Homo sapiens
aaaaactagctgggc

SEQ ID NO: 101261 - DNA, 15 bp, Homo sapiens
caaaaactagctggg

SEQ ID NO: 101262 - DNA, 15 bp, Homo sapiens
acaaaaactagctgg

SEQ ID NO: 101263 - DNA, 15 bp, Homo sapiens
tacaaaaactagctg

SEQ ID NO: 101264 - DNA, 15 bp, Homo sapiens
atacaaaaactagct

SEQ ID NO: 101265 - DNA, 15 bp, Homo sapiens
acatgaggtcaggag

SEQ ID NO: 101266 - DNA, 15 bp, Homo sapiens
cacatgaggtcagga

SEQ ID NO: 101267 - DNA, 15 bp, Homo sapiens
tcacatgaggtcagg

SEQ ID NO: 101268 - DNA, 15 bp, Homo sapiens
atcacatgaggtcag

SEQ ID NO: 101269 - DNA, 15 bp, Homo sapiens
gatcacatgaggtca

SEQ ID NO: 101270 - DNA, 15 bp, Homo sapiens
ggatcacatgaggtc

SEQ ID NO: 101271 - DNA, 15 bp, Homo sapiens
tggatcacatgaggt

SEQ ID NO: 101272 - DNA, 15 bp, Homo sapiens
gtggatcacatgagg

SEQ ID NO: 101273 - DNA, 15 bp, Homo sapiens
ggtggatcacatgag

SEQ ID NO: 101274 - DNA, 15 bp, Homo sapiens
aggtggatcacatga

SEQ ID NO: 101275 - DNA, 15 bp, Homo sapiens
caggtggatcacatg

SEQ ID NO: 101276 - DNA, 15 bp, Homo sapiens
gcaggtggatcacat

SEQ ID NO: 101277 - DNA, 15 bp, Homo sapiens
ggcaggtggatcaca

SEQ ID NO: 101278 - DNA, 15 bp, Homo sapiens
aaggcaggtggatca

SEQ ID NO: 101279 - DNA, 15 bp, Homo sapiens
caaggcaggtggatc

SEQ ID NO: 101280 - DNA, 15 bp, Homo sapiens
ccaaggcaggtggat

SEQ ID NO: 101281 - DNA, 15 bp, Homo sapiens
gccaaggcaggtgga

SEQ ID NO: 101282 - DNA, 15 bp, Homo sapiens
ggccaaggcaggtgg

SEQ ID NO: 101283 - DNA, 15 bp, Homo sapiens
aggccaaggcaggtg

SEQ ID NO: 101284 - DNA, 15 bp, Homo sapiens
gaggccaaggcaggt

SEQ ID NO: 101285 - DNA, 15 bp, Homo sapiens
tcagcattttgggag

SEQ ID NO: 101286 - DNA, 15 bp, Homo sapiens
ctcagcattttggga

SEQ ID NO: 101287 - DNA, 15 bp, Homo sapiens
tctcagcattttggg

SEQ ID NO: 101288 - DNA, 15 bp, Homo sapiens
atctcagcattttgg

SEQ ID NO: 101289 - DNA, 15 bp, Homo sapiens
aatctcagcattttg

SEQ ID NO: 101290 - DNA, 15 bp, Homo sapiens
taatctcagcatttt

SEQ ID NO: 101291 - DNA, 15 bp, Homo sapiens
gtaatctcagcattt

SEQ ID NO: 101292 - DNA, 15 bp, Homo sapiens
tgtaatctcagcatt

SEQ ID NO: 101293 - DNA, 15 bp, Homo sapiens
ctgtaatctcagcat

SEQ ID NO: 101294 - DNA, 15 bp, Homo sapiens
tcacacctgtaatct

SEQ ID NO: 101295 - DNA, 15 bp, Homo sapiens
ttcacacctgtaatc

SEQ ID NO: 101296 - DNA, 15 bp, Homo sapiens
gttcacacctgtaat

SEQ ID NO: 101297 - DNA, 15 bp, Homo sapiens
ggttcacacctgtaa

SEQ ID NO: 101298 - DNA, 15 bp, Homo sapiens
tggttcacacctgta

SEQ ID NO: 101299 - DNA, 15 bp, Homo sapiens
gtggttcacacctgt

SEQ ID NO: 101300 - DNA, 15 bp, Homo sapiens
ggtggttcacacctg

SEQ ID NO: 101301 - DNA, 15 bp, Homo sapiens
cggtggttcacacct

SEQ ID NO: 101302 - DNA, 15 bp, Homo sapiens
gcggtggttcacacc

SEQ ID NO: 101303 - DNA, 15 bp, Homo sapiens
tgcggtggttcacac

SEQ ID NO: 101304 - DNA, 15 bp, Homo sapiens
gtgcggtggttcaca

SEQ ID NO: 101305 - DNA, 15 bp, Homo sapiens
agtgcggtggttcac

SEQ ID NO: 101306 - DNA, 15 bp, Homo sapiens
aagtgcggtggttca

SEQ ID NO: 101307 - DNA, 15 bp, Homo sapiens
caagtgcggtggttc

SEQ ID NO: 101308 - DNA, 15 bp, Homo sapiens
ccaagtgcggtggtt

SEQ ID NO: 101309 - DNA, 15 bp, Homo sapiens
accaagtgcggtggt

SEQ ID NO: 101310 - DNA, 15 bp, Homo sapiens
gaccaagtgcggtgg

SEQ ID NO: 101311 - DNA, 15 bp, Homo sapiens
agaccaagtgcggtg

SEQ ID NO: 101312 - DNA, 15 bp, Homo sapiens
aagaccaagtgcggt

SEQ ID NO: 101313 - DNA, 15 bp, Homo sapiens
aaagaccaagtgcgg

SEQ ID NO: 101314 - DNA, 15 bp, Homo sapiens
taaagaccaagtgcg

SEQ ID NO: 101315 - DNA, 15 bp, Homo sapiens
ttaaagaccaagtgc

SEQ ID NO: 101316 - DNA, 15 bp, Homo sapiens
tttaaagaccaagtg

SEQ ID NO: 101317 - DNA, 15 bp, Homo sapiens
ttttaaagaccaagt

SEQ ID NO: 101318 - DNA, 15 bp, Homo sapiens
tttttaaagaccaag

SEQ ID NO: 101319 - DNA, 15 bp, Homo sapiens
ttttttaaagaccaa

SEQ ID NO: 101320 - DNA, 15 bp, Homo sapiens
gttttttaaagacca

SEQ ID NO: 101321 - DNA, 15 bp, Homo sapiens
tgttttttaaagacc

SEQ ID NO: 101322 - DNA, 15 bp, Homo sapiens
ttgttttttaaagac

SEQ ID NO: 101323 - DNA, 15 bp, Homo sapiens
tttgttttttaaaga

SEQ ID NO: 101324 - DNA, 15 bp, Homo sapiens
gtttgttttttaaag

SEQ ID NO: 101325 - DNA, 15 bp, Homo sapiens
agtttgttttttaaa

SEQ ID NO: 101326 - DNA, 15 bp, Homo sapiens
tagtttgttttttaa

SEQ ID NO: 101327 - DNA, 15 bp, Homo sapiens
ttagtttgtttttta

SEQ ID NO: 101328 - DNA, 15 bp, Homo sapiens
tttagtttgtttttt

SEQ ID NO: 101329 - DNA, 15 bp, Homo sapiens
atttagtttgttttt

SEQ ID NO: 101330 - DNA, 15 bp, Homo sapiens
tatttagtttgtttt

SEQ ID NO: 101331 - DNA, 15 bp, Homo sapiens
ttatttagtttgttt

SEQ ID NO: 101332 - DNA, 15 bp, Homo sapiens
attatttagtttgtt

SEQ ID NO: 101333 - DNA, 15 bp, Homo sapiens
cattatttagtttgt

SEQ ID NO: 101334 - DNA, 15 bp, Homo sapiens
acattatttagtttg

SEQ ID NO: 101335 - DNA, 15 bp, Homo sapiens
aacattatttagttt

SEQ ID NO: 101336 - DNA, 15 bp, Homo sapiens
aaacattatttagtt

SEQ ID NO: 101337 - DNA, 15 bp, Homo sapiens
gaaacattatttagt

SEQ ID NO: 101338 - DNA, 15 bp, Homo sapiens
agaaacattatttag

SEQ ID NO: 101339 - DNA, 15 bp, Homo sapiens
gagaaacattattta

SEQ ID NO: 101340 - DNA, 15 bp, Homo sapiens
agagaaacattattt

SEQ ID NO: 101341 - DNA, 15 bp, Homo sapiens
gagagaaacattatt

SEQ ID NO: 101342 - DNA, 15 bp, Homo sapiens
ggagagaaacattat

SEQ ID NO: 101343 - DNA, 15 bp, Homo sapiens
aggagagaaacatta

SEQ ID NO: 101344 - DNA, 15 bp, Homo sapiens
caggagagaaacatt

SEQ ID NO: 101345 - DNA, 15 bp, Homo sapiens
acaggagagaaacat

SEQ ID NO: 101346 - DNA, 15 bp, Homo sapiens
aacaggagagaaaca

SEQ ID NO: 101347 - DNA, 15 bp, Homo sapiens
aaacaggagagaaac

SEQ ID NO: 101348 - DNA, 15 bp, Homo sapiens
aaaacaggagagaaa

SEQ ID NO: 101349 - DNA, 15 bp, Homo sapiens
aaaaacaggagagaa

SEQ ID NO: 101350 - DNA, 15 bp, Homo sapiens
gaaaaacaggagaga

SEQ ID NO: 101351 - DNA, 15 bp, Homo sapiens
agaaaaacaggagag

SEQ ID NO: 101352 - DNA, 15 bp, Homo sapiens
aagaaaaacaggaga

SEQ ID NO: 101353 - DNA, 15 bp, Homo sapiens
taagaaaaacaggag

SEQ ID NO: 101354 - DNA, 15 bp, Homo sapiens
gtaagaaaaacagga

SEQ ID NO: 101355 - DNA, 15 bp, Homo sapiens
agtaagaaaaacagg

SEQ ID NO: 101356 - DNA, 15 bp, Homo sapiens
tagtaagaaaaacag

SEQ ID NO: 101357 - DNA, 15 bp, Homo sapiens
ttagtaagaaaaaca

SEQ ID NO: 101358 - DNA, 15 bp, Homo sapiens
attagtaagaaaaac

SEQ ID NO: 101359 - DNA, 15 bp, Homo sapiens
aattagtaagaaaaa

SEQ ID NO: 101360 - DNA, 15 bp, Homo sapiens
taattagtaagaaaa

SEQ ID NO: 101361 - DNA, 15 bp, Homo sapiens
ataattagtaagaaa

SEQ ID NO: 101362 - DNA, 15 bp, Homo sapiens
tataattagtaagaa

SEQ ID NO: 101363 - DNA, 15 bp, Homo sapiens
atataattagtaaga

SEQ ID NO: 101364 - DNA, 15 bp, Homo sapiens
tatataattagtaag

SEQ ID NO: 101365 - DNA, 15 bp, Homo sapiens
ctatataattagtaa

SEQ ID NO: 101366 - DNA, 15 bp, Homo sapiens
actatataattagta

SEQ ID NO: 101367 - DNA, 15 bp, Homo sapiens
aactatataattagt

SEQ ID NO: 101368 - DNA, 15 bp, Homo sapiens
gaactatataattag

SEQ ID NO: 101369 - DNA, 15 bp, Homo sapiens
agaactatataatta

SEQ ID NO: 101370 - DNA, 15 bp, Homo sapiens
tagaactatataatt

SEQ ID NO: 101371 - DNA, 15 bp, Homo sapiens
atagaactatataat

SEQ ID NO: 101372 - DNA, 15 bp, Homo sapiens
aatagaactatataa

SEQ ID NO: 101373 - DNA, 15 bp, Homo sapiens
aaatagaactatata

SEQ ID NO: 101374 - DNA, 15 bp, Homo sapiens
aaaatagaactatat

SEQ ID NO: 101375 - DNA, 15 bp, Homo sapiens
aaaaatagaactata

SEQ ID NO: 101376 - DNA, 15 bp, Homo sapiens
caaaaatagaactat

SEQ ID NO: 101377 - DNA, 15 bp, Homo sapiens
tcaaaaatagaacta

SEQ ID NO: 101378 - DNA, 15 bp, Homo sapiens
gtcaaaaatagaact

SEQ ID NO: 101379 - DNA, 15 bp, Homo sapiens
tgtcaaaaatagaac

SEQ ID NO: 101380 - DNA, 15 bp, Homo sapiens
atgtcaaaaatagaa

SEQ ID NO: 101381 - DNA, 15 bp, Homo sapiens
aatgtcaaaaataga

SEQ ID NO: 101382 - DNA, 15 bp, Homo sapiens
aaatgtcaaaaatag

SEQ ID NO: 101383 - DNA, 15 bp, Homo sapiens
taaatgtcaaaaata

SEQ ID NO: 101384 - DNA, 15 bp, Homo sapiens
ttaaatgtcaaaaat

SEQ ID NO: 101385 - DNA, 15 bp, Homo sapiens
tttaaatgtcaaaaa

SEQ ID NO: 101386 - DNA, 15 bp, Homo sapiens
atttaaatgtcaaaa

SEQ ID NO: 101387 - DNA, 15 bp, Homo sapiens
gatttaaatgtcaaa

SEQ ID NO: 101388 - DNA, 15 bp, Homo sapiens
tgatttaaatgtcaa

SEQ ID NO: 101389 - DNA, 15 bp, Homo sapiens
ctgatttaaatgtca

SEQ ID NO: 101390 - DNA, 15 bp, Homo sapiens
tctgatttaaatgtc

SEQ ID NO: 101391 - DNA, 15 bp, Homo sapiens
atctgatttaaatgt

SEQ ID NO: 101392 - DNA, 15 bp, Homo sapiens
gatctgatttaaatg

SEQ ID NO: 101393 - DNA, 15 bp, Homo sapiens
tgatctgatttaaat

SEQ ID NO: 101394 - DNA, 15 bp, Homo sapiens
atgatctgatttaaa

SEQ ID NO: 101395 - DNA, 15 bp, Homo sapiens
catgatctgatttaa

SEQ ID NO: 101396 - DNA, 15 bp, Homo sapiens
ccatgatctgattta

SEQ ID NO: 101397 - DNA, 15 bp, Homo sapiens
tccatgatctgattt

SEQ ID NO: 101398 - DNA, 15 bp, Homo sapiens
ttccatgatctgatt

SEQ ID NO: 101399 - DNA, 15 bp, Homo sapiens
attccatgatctgat

SEQ ID NO: 101400 - DNA, 15 bp, Homo sapiens
aattccatgatctga

SEQ ID NO: 101401 - DNA, 15 bp, Homo sapiens
aaattccatgatctg

SEQ ID NO: 101402 - DNA, 15 bp, Homo sapiens
taaattccatgatct

SEQ ID NO: 101403 - DNA, 15 bp, Homo sapiens
ataaattccatgatc

SEQ ID NO: 101404 - DNA, 15 bp, Homo sapiens
aataaattccatgat

SEQ ID NO: 101405 - DNA, 15 bp, Homo sapiens
aaataaattccatga

SEQ ID NO: 101406 - DNA, 15 bp, Homo sapiens
aaaataaattccatg

SEQ ID NO: 101407 - DNA, 15 bp, Homo sapiens
taaaataaattccat

SEQ ID NO: 101408 - DNA, 15 bp, Homo sapiens
ttaaaataaattcca

SEQ ID NO: 101409 - DNA, 15 bp, Homo sapiens
tttaaaataaattcc

SEQ ID NO: 101410 - DNA, 15 bp, Homo sapiens
ctttaaaataaattc

SEQ ID NO: 101411 - DNA, 15 bp, Homo sapiens
tctttaaaataaatt

SEQ ID NO: 101412 - DNA, 15 bp, Homo sapiens
ctctttaaaataaat

SEQ ID NO: 101413 - DNA, 15 bp, Homo sapiens
actctttaaaataaa

SEQ ID NO: 101414 - DNA, 15 bp, Homo sapiens
cactctttaaaataa

SEQ ID NO: 101415 - DNA, 15 bp, Homo sapiens
tcactctttaaaata

SEQ ID NO: 101416 - DNA, 15 bp, Homo sapiens
ctcactctttaaaat

SEQ ID NO: 101417 - DNA, 15 bp, Homo sapiens
cctcactctttaaaa

SEQ ID NO: 101418 - DNA, 15 bp, Homo sapiens
gcctcactctttaaa

SEQ ID NO: 101419 - DNA, 15 bp, Homo sapiens
tgcctcactctttaa

SEQ ID NO: 101420 - DNA, 15 bp, Homo sapiens
ctgcctcactcttta

SEQ ID NO: 101421 - DNA, 15 bp, Homo sapiens
gctgcctcactcttt

SEQ ID NO: 101422 - DNA, 15 bp, Homo sapiens
ggctgcctcactctt

SEQ ID NO: 101423 - DNA, 15 bp, Homo sapiens
aggctgcctcactct

SEQ ID NO: 101424 - DNA, 15 bp, Homo sapiens
gaggctgcctcactc

SEQ ID NO: 101425 - DNA, 15 bp, Homo sapiens
agaggctgcctcact

SEQ ID NO: 101426 - DNA, 15 bp, Homo sapiens
aagaggctgcctcac

SEQ ID NO: 101427 - DNA, 15 bp, Homo sapiens
caagaggctgcctca

SEQ ID NO: 101428 - DNA, 15 bp, Homo sapiens
gcaagaggctgcctc

SEQ ID NO: 101429 - DNA, 15 bp, Homo sapiens
ggcaagaggctgcct

SEQ ID NO: 101430 - DNA, 15 bp, Homo sapiens
gggcaagaggctgcc

SEQ ID NO: 101431 - DNA, 15 bp, Homo sapiens
tgggcaagaggctgc

SEQ ID NO: 101432 - DNA, 15 bp, Homo sapiens
gtgggcaagaggctg

SEQ ID NO: 101433 - DNA, 15 bp, Homo sapiens
agtgggcaagaggct

SEQ ID NO: 101434 - DNA, 15 bp, Homo sapiens
gagtgggcaagaggc

SEQ ID NO: 101435 - DNA, 15 bp, Homo sapiens
agagtgggcaagagg

SEQ ID NO: 101436 - DNA, 15 bp, Homo sapiens
aagagtgggcaagag

SEQ ID NO: 101437 - DNA, 15 bp, Homo sapiens
aaagagtgggcaaga

SEQ ID NO: 101438 - DNA, 15 bp, Homo sapiens
caaagagtgggcaag

SEQ ID NO: 101439 - DNA, 15 bp, Homo sapiens
gcaaagagtgggcaa

SEQ ID NO: 101440 - DNA, 15 bp, Homo sapiens
agcaaagagtgggca

SEQ ID NO: 101441 - DNA, 15 bp, Homo sapiens
gagcaaagagtgggc

SEQ ID NO: 101442 - DNA, 15 bp, Homo sapiens
ggagcaaagagtggg

SEQ ID NO: 101443 - DNA, 15 bp, Homo sapiens
gggagcaaagagtgg

SEQ ID NO: 101444 - DNA, 15 bp, Homo sapiens
ggggagcaaagagtg

SEQ ID NO: 101445 - DNA, 15 bp, Homo sapiens
tggggagcaaagagt

SEQ ID NO: 101446 - DNA, 15 bp, Homo sapiens
gtggggagcaaagag

SEQ ID NO: 101447 - DNA, 15 bp, Homo sapiens
ggtggggagcaaaga

SEQ ID NO: 101448 - DNA, 15 bp, Homo sapiens
gggtggggagcaaag

SEQ ID NO: 101449 - DNA, 15 bp, Homo sapiens
agggtggggagcaaa

SEQ ID NO: 101450 - DNA, 15 bp, Homo sapiens
aagggtggggagcaa

SEQ ID NO: 101451 - DNA, 15 bp, Homo sapiens
gaagggtggggagca

SEQ ID NO: 101452 - DNA, 15 bp, Homo sapiens
tgaagggtggggagc

SEQ ID NO: 101453 - DNA, 15 bp, Homo sapiens
gtgaagggtggggag

SEQ ID NO: 101454 - DNA, 15 bp, Homo sapiens
ggtgaagggtgggga

SEQ ID NO: 101455 - DNA, 15 bp, Homo sapiens
tggtgaagggtgggg

SEQ ID NO: 101456 - DNA, 15 bp, Homo sapiens
ttggtgaagggtggg

SEQ ID NO: 101457 - DNA, 15 bp, Homo sapiens
gttggtgaagggtgg

SEQ ID NO: 101458 - DNA, 15 bp, Homo sapiens
agttggtgaagggtg

SEQ ID NO: 101459 - DNA, 15 bp, Homo sapiens
cagttggtgaagggt

SEQ ID NO: 101460 - DNA, 15 bp, Homo sapiens
ccagttggtgaaggg

SEQ ID NO: 101461 - DNA, 15 bp, Homo sapiens
accagttggtgaagg

SEQ ID NO: 101462 - DNA, 15 bp, Homo sapiens
gaccagttggtgaag

SEQ ID NO: 101463 - DNA, 15 bp, Homo sapiens
agaccagttggtgaa

SEQ ID NO: 101464 - DNA, 15 bp, Homo sapiens
gagaccagttggtga

SEQ ID NO: 101465 - DNA, 15 bp, Homo sapiens
tgagaccagttggtg

SEQ ID NO: 101466 - DNA, 15 bp, Homo sapiens
atgagaccagttggt

SEQ ID NO: 101467 - DNA, 15 bp, Homo sapiens
tatgagaccagttgg

SEQ ID NO: 101468 - DNA, 15 bp, Homo sapiens
atatgagaccagttg

SEQ ID NO: 101469 - DNA, 15 bp, Homo sapiens
catatgagaccagtt

SEQ ID NO: 101470 - DNA, 15 bp, Homo sapiens
tcatatgagaccagt

SEQ ID NO: 101471 - DNA, 15 bp, Homo sapiens
atcatatgagaccag

SEQ ID NO: 101472 - DNA, 15 bp, Homo sapiens
aatcatatgagacca

SEQ ID NO: 101473 - DNA, 15 bp, Homo sapiens
aaatcatatgagacc

SEQ ID NO: 101474 - DNA, 15 bp, Homo sapiens
aaaatcatatgagac

SEQ ID NO: 101475 - DNA, 15 bp, Homo sapiens
caaaatcatatgaga

SEQ ID NO: 101476 - DNA, 15 bp, Homo sapiens
acaaaatcatatgag

SEQ ID NO: 101477 - DNA, 15 bp, Homo sapiens
aacaaaatcatatga

SEQ ID NO: 101478 - DNA, 15 bp, Homo sapiens
caacaaaatcatatg

SEQ ID NO: 101479 - DNA, 15 bp, Homo sapiens
tcaacaaaatcatat

SEQ ID NO: 101480 - DNA, 15 bp, Homo sapiens
atcaacaaaatcata

SEQ ID NO: 101481 - DNA, 15 bp, Homo sapiens
aatcaacaaaatcat

SEQ ID NO: 101482 - DNA, 15 bp, Homo sapiens
taatcaacaaaatca

SEQ ID NO: 101483 - DNA, 15 bp, Homo sapiens
ataatcaacaaaatc

SEQ ID NO: 101484 - DNA, 15 bp, Homo sapiens
aataatcaacaaaat

SEQ ID NO: 101485 - DNA, 15 bp, Homo sapiens
aaataatcaacaaaa

SEQ ID NO: 101486 - DNA, 15 bp, Homo sapiens
aaaataatcaacaaa

SEQ ID NO: 101487 - DNA, 15 bp, Homo sapiens
taaaataatcaacaa

SEQ ID NO: 101488 - DNA, 15 bp, Homo sapiens
ataaaataatcaaca

SEQ ID NO: 101489 - DNA, 15 bp, Homo sapiens
aataaaataatcaac

SEQ ID NO: 101490 - DNA, 15 bp, Homo sapiens
aaataaaataatcaa

SEQ ID NO: 101491 - DNA, 15 bp, Homo sapiens
aaaataaaataatca

SEQ ID NO: 101492 - DNA, 15 bp, Homo sapiens
taaaataaaataatc

SEQ ID NO: 101493 - DNA, 15 bp, Homo sapiens
caaataaaataaaat

SEQ ID NO: 101494 - DNA, 15 bp, Homo sapiens
tcaaataaaataaaa

SEQ ID NO: 101495 - DNA, 15 bp, Homo sapiens
ctcaaataaaataaa

SEQ ID NO: 101496 - DNA, 15 bp, Homo sapiens
tctcaaataaaataa

SEQ ID NO: 101497 - DNA, 15 bp, Homo sapiens
atctcaaataaaata

SEQ ID NO: 101498 - DNA, 15 bp, Homo sapiens
catctcaaataaaat

SEQ ID NO: 101499 - DNA, 15 bp, Homo sapiens
ccatctcaaataaaa

SEQ ID NO: 101500 - DNA, 15 bp, Homo sapiens
ttgcaccactgcatt

SEQ ID NO: 101501 - DNA, 15 bp, Homo sapiens
attgcaccactgcat

SEQ ID NO: 101502 - DNA, 15 bp, Homo sapiens
tgagattgcaccact

SEQ ID NO: 101503 - DNA, 15 bp, Homo sapiens
ctgagattgcaccac

SEQ ID NO: 101504 - DNA, 15 bp, Homo sapiens
gctgagattgcacca

SEQ ID NO: 101505 - DNA, 15 bp, Homo sapiens
agctgagattgcacc

SEQ ID NO: 101506 - DNA, 15 bp, Homo sapiens
gagctgagattgcac

SEQ ID NO: 101507 - DNA, 15 bp, Homo sapiens
tgagctgagattgca

SEQ ID NO: 101508 - DNA, 15 bp, Homo sapiens
gtgagctgagattgc

SEQ ID NO: 101509 - DNA, 15 bp, Homo sapiens
ggtgagctgagattg

SEQ ID NO: 101510 - DNA, 15 bp, Homo sapiens
cggtgagctgagatt

SEQ ID NO: 101511 - DNA, 15 bp, Homo sapiens
gcggtgagctgagat

SEQ ID NO: 101512 - DNA, 15 bp, Homo sapiens
tgcggtgagctgaga

SEQ ID NO: 101513 - DNA, 15 bp, Homo sapiens
ttgcggtgagctgag

SEQ ID NO: 101514 - DNA, 15 bp, Homo sapiens
gttgcggtgagctga

SEQ ID NO: 101515 - DNA, 15 bp, Homo sapiens
ggttgcggtgagctg

SEQ ID NO: 101516 - DNA, 15 bp, Homo sapiens
aggttgcggtgagct

SEQ ID NO: 101517 - DNA, 15 bp, Homo sapiens
acccgggaggcggag

SEQ ID NO: 101518 - DNA, 15 bp, Homo sapiens
aacccgggaggcgga

SEQ ID NO: 101519 - DNA, 15 bp, Homo sapiens
gaacccgggaggcgg

SEQ ID NO: 101520 - DNA, 15 bp, Homo sapiens
tgaacccgggaggcg

SEQ ID NO: 101521 - DNA, 15 bp, Homo sapiens
gtgaacccgggaggc

SEQ ID NO: 101522 - DNA, 15 bp, Homo sapiens
ggaggcaggagaatg

SEQ ID NO: 101523 - DNA, 15 bp, Homo sapiens
aggaggcaggagaat

SEQ ID NO: 101524 - DNA, 15 bp, Homo sapiens
gaggaggcaggagaa

SEQ ID NO: 101525 - DNA, 15 bp, Homo sapiens
ggaggaggcaggaga

SEQ ID NO: 101526 - DNA, 15 bp, Homo sapiens
tggaggaggcaggag

SEQ ID NO: 101527 - DNA, 15 bp, Homo sapiens
ctggaggaggcagga

SEQ ID NO: 101528 - DNA, 15 bp, Homo sapiens
tctggaggaggcagg

SEQ ID NO: 101529 - DNA, 15 bp, Homo sapiens
ctctggaggaggcag

SEQ ID NO: 101530 - DNA, 15 bp, Homo sapiens
actctggaggaggca

SEQ ID NO: 101531 - DNA, 15 bp, Homo sapiens
tactctggaggaggc

SEQ ID NO: 101532 - DNA, 15 bp, Homo sapiens
ctactctggaggagg

SEQ ID NO: 101533 - DNA, 15 bp, Homo sapiens
gctactctggaggag

SEQ ID NO: 101534 - DNA, 15 bp, Homo sapiens
agctactctggagga

SEQ ID NO: 101535 - DNA, 15 bp, Homo sapiens
gatgcctgtagtccc

SEQ ID NO: 101536 - DNA, 15 bp, Homo sapiens
ggatgcctgtagtcc

SEQ ID NO: 101537 - DNA, 15 bp, Homo sapiens
cggatgcctgtagtc

SEQ ID NO: 101538 - DNA, 15 bp, Homo sapiens
gcggatgcctgtagt

SEQ ID NO: 101539 - DNA, 15 bp, Homo sapiens
ggcggatgcctgtag

SEQ ID NO: 101540 - DNA, 15 bp, Homo sapiens
tggcggatgcctgta

SEQ ID NO: 101541 - DNA, 15 bp, Homo sapiens
gtggcggatgcctgt

SEQ ID NO: 101542 - DNA, 15 bp, Homo sapiens
ggtggcggatgcctg

SEQ ID NO: 101543 - DNA, 15 bp, Homo sapiens
tggtggcggatgcct

SEQ ID NO: 101544 - DNA, 15 bp, Homo sapiens
gtggtggcggatgcc

SEQ ID NO: 101545 - DNA, 15 bp, Homo sapiens
tgtggtggcggatgc

SEQ ID NO: 101546 - DNA, 15 bp, Homo sapiens
gtgtggtggcggatg

SEQ ID NO: 101547 - DNA, 15 bp, Homo sapiens
ggtgtggtggcggat

SEQ ID NO: 101548 - DNA, 15 bp, Homo sapiens
gggtgtggtggcgga

SEQ ID NO: 101549 - DNA, 15 bp, Homo sapiens
cgggtgtggtggcgg

SEQ ID NO: 101550 - DNA, 15 bp, Homo sapiens
ccgggtgtggtggcg

SEQ ID NO: 101551 - DNA, 15 bp, Homo sapiens
ttagccgggtgtggt

SEQ ID NO: 101552 - DNA, 15 bp, Homo sapiens
attagccgggtgtgg

SEQ ID NO: 101553 - DNA, 15 bp, Homo sapiens
tattagccgggtgtg

SEQ ID NO: 101554 - DNA, 15 bp, Homo sapiens
atattagccgggtgt

SEQ ID NO: 101555 - DNA, 15 bp, Homo sapiens
aatattagccgggtg

SEQ ID NO: 101556 - DNA, 15 bp, Homo sapiens
aaatattagccgggt

SEQ ID NO: 101557 - DNA, 15 bp, Homo sapiens
aaaatattagccggg

SEQ ID NO: 101558 - DNA, 15 bp, Homo sapiens
aaaaatattagccgg

SEQ ID NO: 101559 - DNA, 15 bp, Homo sapiens
taaaaatattagccg

SEQ ID NO: 101560 - DNA, 15 bp, Homo sapiens
ataaaaatattagcc

SEQ ID NO: 101561 - DNA, 15 bp, Homo sapiens
tataaaaatattagc

SEQ ID NO: 101562 - DNA, 15 bp, Homo sapiens
atataaaaatattag

SEQ ID NO: 101563 - DNA, 15 bp, Homo sapiens
tatataaaaatatta

SEQ ID NO: 101564 - DNA, 15 bp, Homo sapiens
atatatataaaaata

SEQ ID NO: 101565 - DNA, 15 bp, Homo sapiens
tatatatataaaaat

SEQ ID NO: 101566 - DNA, 15 bp, Homo sapiens
atatatatataaaaa

SEQ ID NO: 101567 - DNA, 15 bp, Homo sapiens
tatatatatataaaa

SEQ ID NO: 101568 - DNA, 15 bp, Homo sapiens
atatatatatataaa

SEQ ID NO: 101569 - DNA, 15 bp, Homo sapiens
tatatatatatataa

SEQ ID NO: 101570 - DNA, 15 bp, Homo sapiens
aatatatatatatat

SEQ ID NO: 101571 - DNA, 15 bp, Homo sapiens
aaaatatatatatat

SEQ ID NO: 101572 - DNA, 15 bp, Homo sapiens
aaaaatatatatata

SEQ ID NO: 101573 - DNA, 15 bp, Homo sapiens
taaaaatatatatat

SEQ ID NO: 101574 - DNA, 15 bp, Homo sapiens
ctaaaaatatatata

SEQ ID NO: 101575 - DNA, 15 bp, Homo sapiens
actaaaaatatatat

SEQ ID NO: 101576 - DNA, 15 bp, Homo sapiens
tactaaaaatatata

SEQ ID NO: 101577 - DNA, 15 bp, Homo sapiens
ctactaaaaatatat

SEQ ID NO: 101578 - DNA, 15 bp, Homo sapiens
ggtgaaaccctgtct

SEQ ID NO: 101579 - DNA, 15 bp, Homo sapiens
cggtgaaaccctgtc

SEQ ID NO: 101580 - DNA, 15 bp, Homo sapiens
acggtgaaaccctgt

SEQ ID NO: 101581 - DNA, 15 bp, Homo sapiens
cacggtgaaaccctg

SEQ ID NO: 101582 - DNA, 15 bp, Homo sapiens
acacggtgaaaccct

SEQ ID NO: 101583 - DNA, 15 bp, Homo sapiens
aagaccatcctggct

SEQ ID NO: 101584 - DNA, 15 bp, Homo sapiens
taagaccatcctggc

SEQ ID NO: 101585 - DNA, 15 bp, Homo sapiens
ttaagaccatcctgg

SEQ ID NO: 101586 - DNA, 15 bp, Homo sapiens
attaagaccatcctg

SEQ ID NO: 101587 - DNA, 15 bp, Homo sapiens
gattaagaccatcct

SEQ ID NO: 101588 - DNA, 15 bp, Homo sapiens
agattaagaccatcc

SEQ ID NO: 101589 - DNA, 15 bp, Homo sapiens
gagattaagaccatc

SEQ ID NO: 101590 - DNA, 15 bp, Homo sapiens
ggagattaagaccat

SEQ ID NO: 101591 - DNA, 15 bp, Homo sapiens
atgaggtcaggagat

SEQ ID NO: 101592 - DNA, 15 bp, Homo sapiens
catgaggtcaggaga

SEQ ID NO: 101593 - DNA, 15 bp, Homo sapiens
agcaggcagatcatg

SEQ ID NO: 101594 - DNA, 15 bp, Homo sapiens
aagcaggcagatcat

SEQ ID NO: 101595 - DNA, 15 bp, Homo sapiens
gaagcaggcagatca

SEQ ID NO: 101596 - DNA, 15 bp, Homo sapiens
tgaagcaggcagatc

SEQ ID NO: 101597 - DNA, 15 bp, Homo sapiens
ctgaagcaggcagat

SEQ ID NO: 101598 - DNA, 15 bp, Homo sapiens
gctgaagcaggcaga

SEQ ID NO: 101599 - DNA, 15 bp, Homo sapiens
ggctgaagcaggcag

SEQ ID NO: 101600 - DNA, 15 bp, Homo sapiens
aggctgaagcaggca

SEQ ID NO: 101601 - DNA, 15 bp, Homo sapiens
tgggaggctgaagca

SEQ ID NO: 101602 - DNA, 15 bp, Homo sapiens
ttgggaggctgaagc

SEQ ID NO: 101603 - DNA, 15 bp, Homo sapiens
tttgggaggctgaag

SEQ ID NO: 101604 - DNA, 15 bp, Homo sapiens
ctttgggaggctgaa

SEQ ID NO: 101605 - DNA, 15 bp, Homo sapiens
aggcgtggtggctca

SEQ ID NO: 101606 - DNA, 15 bp, Homo sapiens
caggcgtggtggctc

SEQ ID NO: 101607 - DNA, 15 bp, Homo sapiens
ccaggcgtggtggct

SEQ ID NO: 101608 - DNA, 15 bp, Homo sapiens
ggccaggcgtggtgg

SEQ ID NO: 101609 - DNA, 15 bp, Homo sapiens
cggccaggcgtggtg

SEQ ID NO: 101610 - DNA, 15 bp, Homo sapiens
tcggccaggcgtggt

SEQ ID NO: 101611 - DNA, 15 bp, Homo sapiens
atcggccaggcgtgg

SEQ ID NO: 101612 - DNA, 15 bp, Homo sapiens
aatcggccaggcgtg

SEQ ID NO: 101613 - DNA, 15 bp, Homo sapiens
aaatcggccaggcgt

SEQ ID NO: 101614 - DNA, 15 bp, Homo sapiens
aaaatcggccaggcg

SEQ ID NO: 101615 - DNA, 15 bp, Homo sapiens
taaaatcggccaggc

SEQ ID NO: 101616 - DNA, 15 bp, Homo sapiens
ataaaatcggccagg

SEQ ID NO: 101617 - DNA, 15 bp, Homo sapiens
aataaaatcggccag

SEQ ID NO: 101618 - DNA, 15 bp, Homo sapiens
aaataaaatcggcca

SEQ ID NO: 101619 - DNA, 15 bp, Homo sapiens
aaaataaaatcggcc

SEQ ID NO: 101620 - DNA, 15 bp, Homo sapiens
taaaataaaatcggc

SEQ ID NO: 101621 - DNA, 15 bp, Homo sapiens
ataaaataaaatcgg

SEQ ID NO: 101622 - DNA, 15 bp, Homo sapiens
aataaaataaaatcg

SEQ ID NO: 101623 - DNA, 15 bp, Homo sapiens
aaataaaataaaatc

SEQ ID NO: 101624 - DNA, 15 bp, Homo sapiens
caaaaaaataaaata

SEQ ID NO: 101625 - DNA, 15 bp, Homo sapiens
tcaaaaaaataaaat

SEQ ID NO: 101626 - DNA, 15 bp, Homo sapiens
ttcaaaaaaataaaa

SEQ ID NO: 101627 - DNA, 15 bp, Homo sapiens
cttcaaaaaaataaa

SEQ ID NO: 101628 - DNA, 15 bp, Homo sapiens
acttcaaaaaaataa

SEQ ID NO: 101629 - DNA, 15 bp, Homo sapiens
aacttcaaaaaaata

SEQ ID NO: 101630 - DNA, 15 bp, Homo sapiens
aaacttcaaaaaaat

SEQ ID NO: 101631 - DNA, 15 bp, Homo sapiens
gaaacttcaaaaaaa

SEQ ID NO: 101632 - DNA, 15 bp, Homo sapiens
tgaaacttcaaaaaa

SEQ ID NO: 101633 - DNA, 15 bp, Homo sapiens
ttgaaacttcaaaaa

SEQ ID NO: 101634 - DNA, 15 bp, Homo sapiens
gttgaaacttcaaaa

SEQ ID NO: 101635 - DNA, 15 bp, Homo sapiens
agttgaaacttcaaa

SEQ ID NO: 101636 - DNA, 15 bp, Homo sapiens
gagttgaaacttcaa

SEQ ID NO: 101637 - DNA, 15 bp, Homo sapiens
ggagttgaaacttca

SEQ ID NO: 101638 - DNA, 15 bp, Homo sapiens
tggagttgaaacttc

SEQ ID NO: 101639 - DNA, 15 bp, Homo sapiens
atggagttgaaactt

SEQ ID NO: 101640 - DNA, 15 bp, Homo sapiens
gatggagttgaaact

SEQ ID NO: 101641 - DNA, 15 bp, Homo sapiens
tgatggagttgaaac

SEQ ID NO: 101642 - DNA, 15 bp, Homo sapiens
ctgatggagttgaaa

SEQ ID NO: 101643 - DNA, 15 bp, Homo sapiens
actgatggagttgaa

SEQ ID NO: 101644 - DNA, 15 bp, Homo sapiens
aactgatggagttga

SEQ ID NO: 101645 - DNA, 15 bp, Homo sapiens
gaactgatggagttg

SEQ ID NO: 101646 - DNA, 15 bp, Homo sapiens
agaactgatggagtt

SEQ ID NO: 101647 - DNA, 15 bp, Homo sapiens
cagaactgatggagt

SEQ ID NO: 101648 - DNA, 15 bp, Homo sapiens
tcagaactgatggag

SEQ ID NO: 101649 - DNA, 15 bp, Homo sapiens
ttcagaactgatgga

SEQ ID NO: 101650 - DNA, 15 bp, Homo sapiens
attcagaactgatgg

SEQ ID NO: 101651 - DNA, 15 bp, Homo sapiens
aattcagaactgatg

SEQ ID NO: 101652 - DNA, 15 bp, Homo sapiens
gaattcagaactgat

SEQ ID NO: 101653 - DNA, 15 bp, Homo sapiens
ggaattcagaactga

SEQ ID NO: 101654 - DNA, 15 bp, Homo sapiens
aggaattcagaactg

SEQ ID NO: 101655 - DNA, 15 bp, Homo sapiens
taggaattcagaact

SEQ ID NO: 101656 - DNA, 15 bp, Homo sapiens
ctaggaattcagaac

SEQ ID NO: 101657 - DNA, 15 bp, Homo sapiens
cctaggaattcagaa

SEQ ID NO: 101658 - DNA, 15 bp, Homo sapiens
acctaggaattcaga

SEQ ID NO: 101659 - DNA, 15 bp, Homo sapiens
tacctaggaattcag

SEQ ID NO: 101660 - DNA, 15 bp, Homo sapiens
atacctaggaattca

SEQ ID NO: 101661 - DNA, 15 bp, Homo sapiens
tatacctaggaattc

SEQ ID NO: 101662 - DNA, 15 bp, Homo sapiens
gtatacctaggaatt

SEQ ID NO: 101663 - DNA, 15 bp, Homo sapiens
agtatacctaggaat

SEQ ID NO: 101664 - DNA, 15 bp, Homo sapiens
gagtatacctaggaa

SEQ ID NO: 101665 - DNA, 15 bp, Homo sapiens
tgagtatacctagga

SEQ ID NO: 101666 - DNA, 15 bp, Homo sapiens
gtgagtatacctagg

SEQ ID NO: 101667 - DNA, 15 bp, Homo sapiens
tgtgagtatacctag

SEQ ID NO: 101668 - DNA, 15 bp, Homo sapiens
atgtgagtataccta

SEQ ID NO: 101669 - DNA, 15 bp, Homo sapiens
gatgtgagtatacct

SEQ ID NO: 101670 - DNA, 15 bp, Homo sapiens
ggatgtgagtatacc

SEQ ID NO: 101671 - DNA, 15 bp, Homo sapiens
tggatgtgagtatac

SEQ ID NO: 101672 - DNA, 15 bp, Homo sapiens
ttggatgtgagtata

SEQ ID NO: 101673 - DNA, 15 bp, Homo sapiens
tttggatgtgagtat

SEQ ID NO: 101674 - DNA, 15 bp, Homo sapiens
atttggatgtgagta

SEQ ID NO: 101675 - DNA, 15 bp, Homo sapiens
catttggatgtgagt

SEQ ID NO: 101676 - DNA, 15 bp, Homo sapiens
tcatttggatgtgag

SEQ ID NO: 101677 - DNA, 15 bp, Homo sapiens
ttcatttggatgtga

SEQ ID NO: 101678 - DNA, 15 bp, Homo sapiens
tttcatttggatgtg

SEQ ID NO: 101679 - DNA, 15 bp, Homo sapiens
atttcatttggatgt

SEQ ID NO: 101680 - DNA, 15 bp, Homo sapiens
aatttcatttggatg

SEQ ID NO: 101681 - DNA, 15 bp, Homo sapiens
taatttcatttggat

SEQ ID NO: 101682 - DNA, 15 bp, Homo sapiens
ataatttcatttgga

SEQ ID NO: 101683 - DNA, 15 bp, Homo sapiens
aataatttcatttgg

SEQ ID NO: 101684 - DNA, 15 bp, Homo sapiens
taataatttcatttg

SEQ ID NO: 101685 - DNA, 15 bp, Homo sapiens
ctaataatttcattt

SEQ ID NO: 101686 - DNA, 15 bp, Homo sapiens
gctaataatttcatt

SEQ ID NO: 101687 - DNA, 15 bp, Homo sapiens
cgctaataatttcat

SEQ ID NO: 101688 - DNA, 15 bp, Homo sapiens
tcgctaataatttca

SEQ ID NO: 101689 - DNA, 15 bp, Homo sapiens
atcgctaataatttc

SEQ ID NO: 101690 - DNA, 15 bp, Homo sapiens
aatcgctaataattt

SEQ ID NO: 101691 - DNA, 15 bp, Homo sapiens
taatcgctaataatt

SEQ ID NO: 101692 - DNA, 15 bp, Homo sapiens
ttaatcgctaataat

SEQ ID NO: 101693 - DNA, 15 bp, Homo sapiens
tttaatcgctaataa

SEQ ID NO: 101694 - DNA, 15 bp, Homo sapiens
ctttaatcgctaata

SEQ ID NO: 101695 - DNA, 15 bp, Homo sapiens
tctttaatcgctaat

SEQ ID NO: 101696 - DNA, 15 bp, Homo sapiens
ctctttaatcgctaa

SEQ ID NO: 101697 - DNA, 15 bp, Homo sapiens
tctctttaatcgcta

SEQ ID NO: 101698 - DNA, 15 bp, Homo sapiens
ttctctttaatcgct

SEQ ID NO: 101699 - DNA, 15 bp, Homo sapiens
attctctttaatcgc

SEQ ID NO: 101700 - DNA, 15 bp, Homo sapiens
cattctctttaatcg

SEQ ID NO: 101701 - DNA, 15 bp, Homo sapiens
acattctctttaatc

SEQ ID NO: 101702 - DNA, 15 bp, Homo sapiens
cacattctctttaat

SEQ ID NO: 101703 - DNA, 15 bp, Homo sapiens
acacattctctttaa

SEQ ID NO: 101704 - DNA, 15 bp, Homo sapiens
tacacattctcttta

SEQ ID NO: 101705 - DNA, 15 bp, Homo sapiens
ctacacattctcttt

SEQ ID NO: 101706 - DNA, 15 bp, Homo sapiens
actacacattctctt

SEQ ID NO: 101707 - DNA, 15 bp, Homo sapiens
tactacacattctct

SEQ ID NO: 101708 - DNA, 15 bp, Homo sapiens
gtactacacattctc

SEQ ID NO: 101709 - DNA, 15 bp, Homo sapiens
agtactacacattct

SEQ ID NO: 101710 - DNA, 15 bp, Homo sapiens
tagtactacacattc

SEQ ID NO: 101711 - DNA, 15 bp, Homo sapiens
ctagtactacacatt

SEQ ID NO: 101712 - DNA, 15 bp, Homo sapiens
tctagtactacacat

SEQ ID NO: 101713 - DNA, 15 bp, Homo sapiens
ctctagtactacaca

SEQ ID NO: 101714 - DNA, 15 bp, Homo sapiens
tctctagtactacac

SEQ ID NO: 101715 - DNA, 15 bp, Homo sapiens
atctctagtactaca

SEQ ID NO: 101716 - DNA, 15 bp, Homo sapiens
tatctctagtactac

SEQ ID NO: 101717 - DNA, 15 bp, Homo sapiens
gtatctctagtacta

SEQ ID NO: 101718 - DNA, 15 bp, Homo sapiens
cgtatctctagtact

SEQ ID NO: 101719 - DNA, 15 bp, Homo sapiens
tcgtatctctagtac

SEQ ID NO: 101720 - DNA, 15 bp, Homo sapiens
atcgtatctctagta

SEQ ID NO: 101721 - DNA, 15 bp, Homo sapiens
catcgtatctctagt

SEQ ID NO: 101722 - DNA, 15 bp, Homo sapiens
acatcgtatctctag

SEQ ID NO: 101723 - DNA, 15 bp, Homo sapiens
cacatcgtatctcta

SEQ ID NO: 101724 - DNA, 15 bp, Homo sapiens
acacatcgtatctct

SEQ ID NO: 101725 - DNA, 15 bp, Homo sapiens
cacacatcgtatctc

SEQ ID NO: 101726 - DNA, 15 bp, Homo sapiens
tcacacatcgtatct

SEQ ID NO: 101727 - DNA, 15 bp, Homo sapiens
ttcacacatcgtatc

SEQ ID NO: 101728 - DNA, 15 bp, Homo sapiens
tttcacacatcgtat

SEQ ID NO: 101729 - DNA, 15 bp, Homo sapiens
atttcacacatcgta

SEQ ID NO: 101730 - DNA, 15 bp, Homo sapiens
catttcacacatcgt

SEQ ID NO: 101731 - DNA, 15 bp, Homo sapiens
ccatttcacacatcg

SEQ ID NO: 101732 - DNA, 15 bp, Homo sapiens
gccatttcacacatc

SEQ ID NO: 101733 - DNA, 15 bp, Homo sapiens
agccatttcacacat

SEQ ID NO: 101734 - DNA, 15 bp, Homo sapiens
aagccatttcacaca

SEQ ID NO: 101735 - DNA, 15 bp, Homo sapiens
aaagccatttcacac

SEQ ID NO: 101736 - DNA, 15 bp, Homo sapiens
aaaagccatttcaca

SEQ ID NO: 101737 - DNA, 15 bp, Homo sapiens
aaaaagccatttcac

SEQ ID NO: 101738 - DNA, 15 bp, Homo sapiens
caaaaagccatttca

SEQ ID NO: 101739 - DNA, 15 bp, Homo sapiens
acaaaaagccatttc

SEQ ID NO: 101740 - DNA, 15 bp, Homo sapiens
gacaaaaagccattt

SEQ ID NO: 101741 - DNA, 15 bp, Homo sapiens
agacaaaaagccatt

SEQ ID NO: 101742 - DNA, 15 bp, Homo sapiens
tagacaaaaagccat

SEQ ID NO: 101743 - DNA, 15 bp, Homo sapiens
ttagacaaaaagcca

SEQ ID NO: 101744 - DNA, 15 bp, Homo sapiens
attagacaaaaagcc

SEQ ID NO: 101745 - DNA, 15 bp, Homo sapiens
aattagacaaaaagc

SEQ ID NO: 101746 - DNA, 15 bp, Homo sapiens
aaattagacaaaaag

SEQ ID NO: 101747 - DNA, 15 bp, Homo sapiens
taaattagacaaaaa

SEQ ID NO: 101748 - DNA, 15 bp, Homo sapiens
ttaaattagacaaaa

SEQ ID NO: 101749 - DNA, 15 bp, Homo sapiens
tttaaattagacaaa

SEQ ID NO: 101750 - DNA, 15 bp, Homo sapiens
ttttaaattagacaa

SEQ ID NO: 101751 - DNA, 15 bp, Homo sapiens
attttaaattagaca

SEQ ID NO: 101752 - DNA, 15 bp, Homo sapiens
aattttaaattagac

SEQ ID NO: 101753 - DNA, 15 bp, Homo sapiens
aaattttaaattaga

SEQ ID NO: 101754 - DNA, 15 bp, Homo sapiens
aaaattttaaattag

SEQ ID NO: 101755 - DNA, 15 bp, Homo sapiens
aaaaattttaaatta

SEQ ID NO: 101756 - DNA, 15 bp, Homo sapiens
gaaaaattttaaatt

SEQ ID NO: 101757 - DNA, 15 bp, Homo sapiens
tgaaaaattttaaat

SEQ ID NO: 101758 - DNA, 15 bp, Homo sapiens
atgaaaaattttaaa

SEQ ID NO: 101759 - DNA, 15 bp, Homo sapiens
catgaaaaattttaa

SEQ ID NO: 101760 - DNA, 15 bp, Homo sapiens
gcatgaaaaatttta

SEQ ID NO: 101761 - DNA, 15 bp, Homo sapiens
agcatgaaaaatttt

SEQ ID NO: 101762 - DNA, 15 bp, Homo sapiens
aagcatgaaaaattt

SEQ ID NO: 101763 - DNA, 15 bp, Homo sapiens
aaagcatgaaaaatt

SEQ ID NO: 101764 - DNA, 15 bp, Homo sapiens
taaagcatgaaaaat

SEQ ID NO: 101765 - DNA, 15 bp, Homo sapiens
ctaaagcatgaaaaa

SEQ ID NO: 101766 - DNA, 15 bp, Homo sapiens
cctaaagcatgaaaa

SEQ ID NO: 101767 - DNA, 15 bp, Homo sapiens
tcctaaagcatgaaa

SEQ ID NO: 101768 - DNA, 15 bp, Homo sapiens
ctcctaaagcatgaa

SEQ ID NO: 101769 - DNA, 15 bp, Homo sapiens
cctcctaaagcatga

SEQ ID NO: 101770 - DNA, 15 bp, Homo sapiens
acctcctaaagcatg

SEQ ID NO: 101771 - DNA, 15 bp, Homo sapiens
gacctcctaaagcat

SEQ ID NO: 101772 - DNA, 15 bp, Homo sapiens
agacctcctaaagca

SEQ ID NO: 101773 - DNA, 15 bp, Homo sapiens
cagacctcctaaagc

SEQ ID NO: 101774 - DNA, 15 bp, Homo sapiens
ccagacctcctaaag

SEQ ID NO: 101775 - DNA, 15 bp, Homo sapiens
accagacctcctaaa

SEQ ID NO: 101776 - DNA, 15 bp, Homo sapiens
gaccagacctcctaa

SEQ ID NO: 101777 - DNA, 15 bp, Homo sapiens
agaccagacctccta

SEQ ID NO: 101778 - DNA, 15 bp, Homo sapiens
aagaccagacctcct

SEQ ID NO: 101779 - DNA, 15 bp, Homo sapiens
caagaccagacctcc

SEQ ID NO: 101780 - DNA, 15 bp, Homo sapiens
acaagaccagacctc

SEQ ID NO: 101781 - DNA, 15 bp, Homo sapiens
aacaagaccagacct

SEQ ID NO: 101782 - DNA, 15 bp, Homo sapiens
caacaagaccagacc

SEQ ID NO: 101783 - DNA, 15 bp, Homo sapiens
ccaacaagaccagac

SEQ ID NO: 101784 - DNA, 15 bp, Homo sapiens
tccaacaagaccaga

SEQ ID NO: 101785 - DNA, 15 bp, Homo sapiens
atccaacaagaccag

SEQ ID NO: 101786 - DNA, 15 bp, Homo sapiens
aatccaacaagacca

SEQ ID NO: 101787 - DNA, 15 bp, Homo sapiens
caatccaacaagacc

SEQ ID NO: 101788 - DNA, 15 bp, Homo sapiens
tcaatccaacaagac

SEQ ID NO: 101789 - DNA, 15 bp, Homo sapiens
ttcaatccaacaaga

SEQ ID NO: 101790 - DNA, 15 bp, Homo sapiens
gttcaatccaacaag

SEQ ID NO: 101791 - DNA, 15 bp, Homo sapiens
agttcaatccaacaa

SEQ ID NO: 101792 - DNA, 15 bp, Homo sapiens
cagttcaatccaaca

SEQ ID NO: 101793 - DNA, 15 bp, Homo sapiens
gcagttcaatccaac

SEQ ID NO: 101794 - DNA, 15 bp, Homo sapiens
agcagttcaatccaa

SEQ ID NO: 101795 - DNA, 15 bp, Homo sapiens
aagcagttcaatcca

SEQ ID NO: 101796 - DNA, 15 bp, Homo sapiens
gaagcagttcaatcc

SEQ ID NO: 101797 - DNA, 15 bp, Homo sapiens
tgaagcagttcaatc

SEQ ID NO: 101798 - DNA, 15 bp, Homo sapiens
gtgaagcagttcaat

SEQ ID NO: 101799 - DNA, 15 bp, Homo sapiens
agtgaagcagttcaa

SEQ ID NO: 101800 - DNA, 15 bp, Homo sapiens
tagtgaagcagttca

SEQ ID NO: 101801 - DNA, 15 bp, Homo sapiens
atagtgaagcagttc

SEQ ID NO: 101802 - DNA, 15 bp, Homo sapiens
aatagtgaagcagtt

SEQ ID NO: 101803 - DNA, 15 bp, Homo sapiens
aaatagtgaagcagt

SEQ ID NO: 101804 - DNA, 15 bp, Homo sapiens
caaatagtgaagcag

SEQ ID NO: 101805 - DNA, 15 bp, Homo sapiens
ccaaatagtgaagca

SEQ ID NO: 101806 - DNA, 15 bp, Homo sapiens
tccaaatagtgaagc

SEQ ID NO: 101807 - DNA, 15 bp, Homo sapiens
atccaaatagtgaag

SEQ ID NO: 101808 - DNA, 15 bp, Homo sapiens
gatccaaatagtgaa

SEQ ID NO: 101809 - DNA, 15 bp, Homo sapiens
agatccaaatagtga

SEQ ID NO: 101810 - DNA, 15 bp, Homo sapiens
aagatccaaatagtg

SEQ ID NO: 101811 - DNA, 15 bp, Homo sapiens
caagatccaaatagt

SEQ ID NO: 101812 - DNA, 15 bp, Homo sapiens
tcaagatccaaatag

SEQ ID NO: 101813 - DNA, 15 bp, Homo sapiens
ttcaagatccaaata

SEQ ID NO: 101814 - DNA, 15 bp, Homo sapiens
tttcaagatccaaat

SEQ ID NO: 101815 - DNA, 15 bp, Homo sapiens
gtttcaagatccaaa

SEQ ID NO: 101816 - DNA, 15 bp, Homo sapiens
agtttcaagatccaa

SEQ ID NO: 101817 - DNA, 15 bp, Homo sapiens
tagtttcaagatcca

SEQ ID NO: 101818 - DNA, 15 bp, Homo sapiens
gtagtttcaagatcc

SEQ ID NO: 101819 - DNA, 15 bp, Homo sapiens
ggtagtttcaagatc

SEQ ID NO: 101820 - DNA, 15 bp, Homo sapiens
aggtagtttcaagat

SEQ ID NO: 101821 - DNA, 15 bp, Homo sapiens
caggtagtttcaaga

SEQ ID NO: 101822 - DNA, 15 bp, Homo sapiens
ccaggtagtttcaag

SEQ ID NO: 101823 - DNA, 15 bp, Homo sapiens
accaggtagtttcaa

SEQ ID NO: 101824 - DNA, 15 bp, Homo sapiens
aaccaggtagtttca

SEQ ID NO: 101825 - DNA, 15 bp, Homo sapiens
taaccaggtagtttc

SEQ ID NO: 101826 - DNA, 15 bp, Homo sapiens
ttaaccaggtagttt

SEQ ID NO: 101827 - DNA, 15 bp, Homo sapiens
tttaaccaggtagtt

SEQ ID NO: 101828 - DNA, 15 bp, Homo sapiens
gtttaaccaggtagt

SEQ ID NO: 101829 - DNA, 15 bp, Homo sapiens
tgtttaaccaggtag

SEQ ID NO: 101830 - DNA, 15 bp, Homo sapiens
gtgtttaaccaggta

SEQ ID NO: 101831 - DNA, 15 bp, Homo sapiens
agtgtttaaccaggt

SEQ ID NO: 101832 - DNA, 15 bp, Homo sapiens
aagtgtttaaccagg

SEQ ID NO: 101833 - DNA, 15 bp, Homo sapiens
aaagtgtttaaccag

SEQ ID NO: 101834 - DNA, 15 bp, Homo sapiens
caaagtgtttaacca

SEQ ID NO: 101835 - DNA, 15 bp, Homo sapiens
ccaaagtgtttaacc

SEQ ID NO: 101836 - DNA, 15 bp, Homo sapiens
tccaaagtgtttaac

SEQ ID NO: 101837 - DNA, 15 bp, Homo sapiens
ttccaaagtgtttaa

SEQ ID NO: 101838 - DNA, 15 bp, Homo sapiens
cttccaaagtgttta

SEQ ID NO: 101839 - DNA, 15 bp, Homo sapiens
tcttccaaagtgttt

SEQ ID NO: 101840 - DNA, 15 bp, Homo sapiens
ctcttccaaagtgtt

SEQ ID NO: 101841 - DNA, 15 bp, Homo sapiens
gctcttccaaagtgt

SEQ ID NO: 101842 - DNA, 15 bp, Homo sapiens
cgctcttccaaagtg

SEQ ID NO: 101843 - DNA, 15 bp, Homo sapiens
ccgctcttccaaagt

SEQ ID NO: 101844 - DNA, 15 bp, Homo sapiens
tccgctcttccaaag

SEQ ID NO: 101845 - DNA, 15 bp, Homo sapiens
atccgctcttccaaa

SEQ ID NO: 101846 - DNA, 15 bp, Homo sapiens
catccgctcttccaa

SEQ ID NO: 101847 - DNA, 15 bp, Homo sapiens
tcatccgctcttcca

SEQ ID NO: 101848 - DNA, 15 bp, Homo sapiens
ttcatccgctcttcc

SEQ ID NO: 101849 - DNA, 15 bp, Homo sapiens
cttcatccgctcttc

SEQ ID NO: 101850 - DNA, 15 bp, Homo sapiens
tcttcatccgctctt

SEQ ID NO: 101851 - DNA, 15 bp, Homo sapiens
ctcttcatccgctct

SEQ ID NO: 101852 - DNA, 15 bp, Homo sapiens
gctcttcatccgctc

SEQ ID NO: 101853 - DNA, 15 bp, Homo sapiens
tgctcttcatccgct

SEQ ID NO: 101854 - DNA, 15 bp, Homo sapiens
gtgctcttcatccgc

SEQ ID NO: 101855 - DNA, 15 bp, Homo sapiens
tgtgctcttcatccg

SEQ ID NO: 101856 - DNA, 15 bp, Homo sapiens
ctgtgctcttcatcc

SEQ ID NO: 101857 - DNA, 15 bp, Homo sapiens
tctgtgctcttcatc

SEQ ID NO: 101858 - DNA, 15 bp, Homo sapiens
ctctgtgctcttcat

SEQ ID NO: 101859 - DNA, 15 bp, Homo sapiens
cctctgtgctcttca

SEQ ID NO: 101860 - DNA, 15 bp, Homo sapiens
acctctgtgctcttc

SEQ ID NO: 101861 - DNA, 15 bp, Homo sapiens
gacctctgtgctctt

SEQ ID NO: 101862 - DNA, 15 bp, Homo sapiens
ggacctctgtgctct

SEQ ID NO: 101863 - DNA, 15 bp, Homo sapiens
aggacctctgtgctc

SEQ ID NO: 101864 - DNA, 15 bp, Homo sapiens
caggacctctgtgct

SEQ ID NO: 101865 - DNA, 15 bp, Homo sapiens
gcaggacctctgtgc

SEQ ID NO: 101866 - DNA, 15 bp, Homo sapiens
ggcaggacctctgtg

SEQ ID NO: 101867 - DNA, 15 bp, Homo sapiens
aggcaggacctctgt

SEQ ID NO: 101868 - DNA, 15 bp, Homo sapiens
caggcaggacctctg

SEQ ID NO: 101869 - DNA, 15 bp, Homo sapiens
tcaggcaggacctct

SEQ ID NO: 101870 - DNA, 15 bp, Homo sapiens
ctcaggcaggacctc

SEQ ID NO: 101871 - DNA, 15 bp, Homo sapiens
tctcaggcaggacct

SEQ ID NO: 101872 - DNA, 15 bp, Homo sapiens
ttctcaggcaggacc

SEQ ID NO: 101873 - DNA, 15 bp, Homo sapiens
cttctcaggcaggac

SEQ ID NO: 101874 - DNA, 15 bp, Homo sapiens
tcttctcaggcagga

SEQ ID NO: 101875 - DNA, 15 bp, Homo sapiens
gtcttctcaggcagg

SEQ ID NO: 101876 - DNA, 15 bp, Homo sapiens
cgtcttctcaggcag

SEQ ID NO: 101877 - DNA, 15 bp, Homo sapiens
ccgtcttctcaggca

SEQ ID NO: 101878 - DNA, 15 bp, Homo sapiens
tccgtcttctcaggc

SEQ ID NO: 101879 - DNA, 15 bp, Homo sapiens
atccgtcttctcagg

SEQ ID NO: 101880 - DNA, 15 bp, Homo sapiens
catccgtcttctcag

SEQ ID NO: 101881 - DNA, 15 bp, Homo sapiens
gcatccgtcttctca

SEQ ID NO: 101882 - DNA, 15 bp, Homo sapiens
agcatccgtcttctc

SEQ ID NO: 101883 - DNA, 15 bp, Homo sapiens
cagcatccgtcttct

SEQ ID NO: 101884 - DNA, 15 bp, Homo sapiens
acagcatccgtcttc

SEQ ID NO: 101885 - DNA, 15 bp, Homo sapiens
gacagcatccgtctt

SEQ ID NO: 101886 - DNA, 15 bp, Homo sapiens
tgacagcatccgtct

SEQ ID NO: 101887 - DNA, 15 bp, Homo sapiens
ttgacagcatccgtc

SEQ ID NO: 101888 - DNA, 15 bp, Homo sapiens
gttgacagcatccgt

SEQ ID NO: 101889 - DNA, 15 bp, Homo sapiens
cgttgacagcatccg

SEQ ID NO: 101890 - DNA, 15 bp, Homo sapiens
tcgttgacagcatcc

SEQ ID NO: 101891 - DNA, 15 bp, Homo sapiens
ttcgttgacagcatc

SEQ ID NO: 101892 - DNA, 15 bp, Homo sapiens
cttcgttgacagcat

SEQ ID NO: 101893 - DNA, 15 bp, Homo sapiens
gcttcgttgacagca

SEQ ID NO: 101894 - DNA, 15 bp, Homo sapiens
ggcttcgttgacagc

SEQ ID NO: 101895 - DNA, 15 bp, Homo sapiens
gggcttcgttgacag

SEQ ID NO: 101896 - DNA, 15 bp, Homo sapiens
agggcttcgttgaca

SEQ ID NO: 101897 - DNA, 15 bp, Homo sapiens
cagggcttcgttgac

SEQ ID NO: 101898 - DNA, 15 bp, Homo sapiens
ccagggcttcgttga

SEQ ID NO: 101899 - DNA, 15 bp, Homo sapiens
tccagggcttcgttg

SEQ ID NO: 101900 - DNA, 15 bp, Homo sapiens
ctccagggcttcgtt

SEQ ID NO: 101901 - DNA, 15 bp, Homo sapiens
cctccagggcttcgt

SEQ ID NO: 101902 - DNA, 15 bp, Homo sapiens
acctccagggcttcg

SEQ ID NO: 101903 - DNA, 15 bp, Homo sapiens
aacctccagggcttc

SEQ ID NO: 101904 - DNA, 15 bp, Homo sapiens
caacctccagggctt

SEQ ID NO: 101905 - DNA, 15 bp, Homo sapiens
ccaacctccagggct

SEQ ID NO: 101906 - DNA, 15 bp, Homo sapiens
tccaacctccagggc

SEQ ID NO: 101907 - DNA, 15 bp, Homo sapiens
ttccaacctccaggg

SEQ ID NO: 101908 - DNA, 15 bp, Homo sapiens
gttccaacctccagg

SEQ ID NO: 101909 - DNA, 15 bp, Homo sapiens
ggttccaacctccag

SEQ ID NO: 101910 - DNA, 15 bp, Homo sapiens
gggttccaacctcca

SEQ ID NO: 101911 - DNA, 15 bp, Homo sapiens
cgggttccaacctcc

SEQ ID NO: 101912 - DNA, 15 bp, Homo sapiens
acgggttccaacctc

SEQ ID NO: 101913 - DNA, 15 bp, Homo sapiens
cacgggttccaacct

SEQ ID NO: 101914 - DNA, 15 bp, Homo sapiens
tcacgggttccaacc

SEQ ID NO: 101915 - DNA, 15 bp, Homo sapiens
atcacgggttccaac

SEQ ID NO: 101916 - DNA, 15 bp, Homo sapiens
gatcacgggttccaa

SEQ ID NO: 101917 - DNA, 15 bp, Homo sapiens
agatcacgggttcca

SEQ ID NO: 101918 - DNA, 15 bp, Homo sapiens
gagatcacgggttcc

SEQ ID NO: 101919 - DNA, 15 bp, Homo sapiens
ggagatcacgggttc

SEQ ID NO: 101920 - DNA, 15 bp, Homo sapiens
tggagatcacgggtt

SEQ ID NO: 101921 - DNA, 15 bp, Homo sapiens
gtggagatcacgggt

SEQ ID NO: 101922 - DNA, 15 bp, Homo sapiens
cgtggagatcacggg

SEQ ID NO: 101923 - DNA, 15 bp, Homo sapiens
ccgtggagatcacgg

SEQ ID NO: 101924 - DNA, 15 bp, Homo sapiens
gccgtggagatcacg

SEQ ID NO: 101925 - DNA, 15 bp, Homo sapiens
tgccgtggagatcac

SEQ ID NO: 101926 - DNA, 15 bp, Homo sapiens
atgccgtggagatca

SEQ ID NO: 101927 - DNA, 15 bp, Homo sapiens
aatgccgtggagatc

SEQ ID NO: 101928 - DNA, 15 bp, Homo sapiens
aaatgccgtggagat

SEQ ID NO: 101929 - DNA, 15 bp, Homo sapiens
gaaatgccgtggaga

SEQ ID NO: 101930 - DNA, 15 bp, Homo sapiens
agaaatgccgtggag

SEQ ID NO: 101931 - DNA, 15 bp, Homo sapiens
gagaaatgccgtgga

SEQ ID NO: 101932 - DNA, 15 bp, Homo sapiens
agagaaatgccgtgg

SEQ ID NO: 101933 - DNA, 15 bp, Homo sapiens
aagagaaatgccgtg

SEQ ID NO: 101934 - DNA, 15 bp, Homo sapiens
aaagagaaatgccgt

SEQ ID NO: 101935 - DNA, 15 bp, Homo sapiens
caaagagaaatgccg

SEQ ID NO: 101936 - DNA, 15 bp, Homo sapiens
gcaaagagaaatgcc

SEQ ID NO: 101937 - DNA, 15 bp, Homo sapiens
agcaaagagaaatgc

SEQ ID NO: 101938 - DNA, 15 bp, Homo sapiens
cagcaaagagaaatg

SEQ ID NO: 101939 - DNA, 15 bp, Homo sapiens
acagcaaagagaaat

SEQ ID NO: 101940 - DNA, 15 bp, Homo sapiens
cacagcaaagagaaa

SEQ ID NO: 101941 - DNA, 15 bp, Homo sapiens
tcacagcaaagagaa

SEQ ID NO: 101942 - DNA, 15 bp, Homo sapiens
atcacagcaaagaga

SEQ ID NO: 101943 - DNA, 15 bp, Homo sapiens
catcacagcaaagag

SEQ ID NO: 101944 - DNA, 15 bp, Homo sapiens
tcatcacagcaaaga

SEQ ID NO: 101945 - DNA, 15 bp, Homo sapiens
ctcatcacagcaaag

SEQ ID NO: 101946 - DNA, 15 bp, Homo sapiens
cctcatcacagcaaa

SEQ ID NO: 101947 - DNA, 15 bp, Homo sapiens
gcctcatcacagcaa

SEQ ID NO: 101948 - DNA, 15 bp, Homo sapiens
ggcctcatcacagca

SEQ ID NO: 101949 - DNA, 15 bp, Homo sapiens
tggcctcatcacagc

SEQ ID NO: 101950 - DNA, 15 bp, Homo sapiens
gtggcctcatcacag

SEQ ID NO: 101951 - DNA, 15 bp, Homo sapiens
tgtggcctcatcaca

SEQ ID NO: 101952 - DNA, 15 bp, Homo sapiens
gtgtggcctcatcac

SEQ ID NO: 101953 - DNA, 15 bp, Homo sapiens
cgtgtggcctcatca

SEQ ID NO: 101954 - DNA, 15 bp, Homo sapiens
acgtgtggcctcatc

SEQ ID NO: 101955 - DNA, 15 bp, Homo sapiens
cacgtgtggcctcat

SEQ ID NO: 101956 - DNA, 15 bp, Homo sapiens
acacgtgtggcctca

SEQ ID NO: 101957 - DNA, 15 bp, Homo sapiens
tacacgtgtggcctc

SEQ ID NO: 101958 - DNA, 15 bp, Homo sapiens
atacacgtgtggcct

SEQ ID NO: 101959 - DNA, 15 bp, Homo sapiens
aatacacgtgtggcc

SEQ ID NO: 101960 - DNA, 15 bp, Homo sapiens
taatacacgtgtggc

SEQ ID NO: 101961 - DNA, 15 bp, Homo sapiens
gtaatacacgtgtgg

SEQ ID NO: 101962 - DNA, 15 bp, Homo sapiens
tgtaatacacgtgtg

SEQ ID NO: 101963 - DNA, 15 bp, Homo sapiens
ttgtaatacacgtgt

SEQ ID NO: 101964 - DNA, 15 bp, Homo sapiens
attgtaatacacgtg

SEQ ID NO: 101965 - DNA, 15 bp, Homo sapiens
cattgtaatacacgt

SEQ ID NO: 101966 - DNA, 15 bp, Homo sapiens
tcattgtaatacacg

SEQ ID NO: 101967 - DNA, 15 bp, Homo sapiens
ctcattgtaatacac

SEQ ID NO: 101968 - DNA, 15 bp, Homo sapiens
cctcattgtaataca

SEQ ID NO: 101969 - DNA, 15 bp, Homo sapiens
tcctcattgtaatac

SEQ ID NO: 101970 - DNA, 15 bp, Homo sapiens
ttcctcattgtaata

SEQ ID NO: 101971 - DNA, 15 bp, Homo sapiens
attcctcattgtaat

SEQ ID NO: 101972 - DNA, 15 bp, Homo sapiens
cattcctcattgtaa

SEQ ID NO: 101973 - DNA, 15 bp, Homo sapiens
acattcctcattgta

SEQ ID NO: 101974 - DNA, 15 bp, Homo sapiens
tacattcctcattgt

SEQ ID NO: 101975 - DNA, 15 bp, Homo sapiens
ttacattcctcattg

SEQ ID NO: 101976 - DNA, 15 bp, Homo sapiens
attacattcctcatt

SEQ ID NO: 101977 - DNA, 15 bp, Homo sapiens
cattacattcctcat

SEQ ID NO: 101978 - DNA, 15 bp, Homo sapiens
gcattacattcctca

SEQ ID NO: 101979 - DNA, 15 bp, Homo sapiens
agcattacattcctc

SEQ ID NO: 101980 - DNA, 15 bp, Homo sapiens
aagcattacattcct

SEQ ID NO: 101981 - DNA, 15 bp, Homo sapiens
aaagcattacattcc

SEQ ID NO: 101982 - DNA, 15 bp, Homo sapiens
taaagcattacattc

SEQ ID NO: 101983 - DNA, 15 bp, Homo sapiens
gtaaagcattacatt

SEQ ID NO: 101984 - DNA, 15 bp, Homo sapiens
cgtaaagcattacat

SEQ ID NO: 101985 - DNA, 15 bp, Homo sapiens
gcgtaaagcattaca

SEQ ID NO: 101986 - DNA, 15 bp, Homo sapiens
tgcgtaaagcattac

SEQ ID NO: 101987 - DNA, 15 bp, Homo sapiens
ctgcgtaaagcatta

SEQ ID NO: 101988 - DNA, 15 bp, Homo sapiens
cctgcgtaaagcatt

SEQ ID NO: 101989 - DNA, 15 bp, Homo sapiens
gcctgcgtaaagcat

SEQ ID NO: 101990 - DNA, 15 bp, Homo sapiens
tgcctgcgtaaagca

SEQ ID NO: 101991 - DNA, 15 bp, Homo sapiens
ttgcctgcgtaaagc

SEQ ID NO: 101992 - DNA, 15 bp, Homo sapiens
tttgcctgcgtaaag

SEQ ID NO: 101993 - DNA, 15 bp, Homo sapiens
atttgcctgcgtaaa

SEQ ID NO: 101994 - DNA, 15 bp, Homo sapiens
catttgcctgcgtaa

SEQ ID NO: 101995 - DNA, 15 bp, Homo sapiens
gcatttgcctgcgta

SEQ ID NO: 101996 - DNA, 15 bp, Homo sapiens
tgcatttgcctgcgt

SEQ ID NO: 101997 - DNA, 15 bp, Homo sapiens
atgcatttgcctgcg

SEQ ID NO: 101998 - DNA, 15 bp, Homo sapiens
aatgcatttgcctgc

SEQ ID NO: 101999 - DNA, 15 bp, Homo sapiens
aaatgcatttgcctg

SEQ ID NO: 102000 - DNA, 15 bp, Homo sapiens
caaatgcatttgcct

SEQ ID NO: 102001 - DNA, 15 bp, Homo sapiens
gcaaatgcatttgcc

SEQ ID NO: 102002 - DNA, 15 bp, Homo sapiens
agcaaatgcatttgc

SEQ ID NO: 102003 - DNA, 15 bp, Homo sapiens
aagcaaatgcatttg

SEQ ID NO: 102004 - DNA, 15 bp, Homo sapiens
gaagcaaatgcattt

SEQ ID NO: 102005 - DNA, 15 bp, Homo sapiens
ggaagcaaatgcatt

SEQ ID NO: 102006 - DNA, 15 bp, Homo sapiens
aggaagcaaatgcat

SEQ ID NO: 102007 - DNA, 15 bp, Homo sapiens
gaggaagcaaatgca

SEQ ID NO: 102008 - DNA, 15 bp, Homo sapiens
tgaggaagcaaatgc

SEQ ID NO: 102009 - DNA, 15 bp, Homo sapiens
ctgaggaagcaaatg

SEQ ID NO: 102010 - DNA, 15 bp, Homo sapiens
actgaggaagcaaat

SEQ ID NO: 102011 - DNA, 15 bp, Homo sapiens
cactgaggaagcaaa

SEQ ID NO: 102012 - DNA, 15 bp, Homo sapiens
ccactgaggaagcaa

SEQ ID NO: 102013 - DNA, 15 bp, Homo sapiens
accactgaggaagca

SEQ ID NO: 102014 - DNA, 15 bp, Homo sapiens
aaccactgaggaagc

SEQ ID NO: 102015 - DNA, 15 bp, Homo sapiens
aaaccactgaggaag

SEQ ID NO: 102016 - DNA, 15 bp, Homo sapiens
aaaaccactgaggaa

SEQ ID NO: 102017 - DNA, 15 bp, Homo sapiens
gaaaaccactgagga

SEQ ID NO: 102018 - DNA, 15 bp, Homo sapiens
tgaaaaccactgagg

SEQ ID NO: 102019 - DNA, 15 bp, Homo sapiens
ttgaaaaccactgag

SEQ ID NO: 102020 - DNA, 15 bp, Homo sapiens
attgaaaaccactga

SEQ ID NO: 102021 - DNA, 15 bp, Homo sapiens
cattgaaaaccactg

SEQ ID NO: 102022 - DNA, 15 bp, Homo sapiens
acattgaaaaccact

SEQ ID NO: 102023 - DNA, 15 bp, Homo sapiens
gacattgaaaaccac

SEQ ID NO: 102024 - DNA, 15 bp, Homo sapiens
tgacattgaaaacca

SEQ ID NO: 102025 - DNA, 15 bp, Homo sapiens
gtgacattgaaaacc

SEQ ID NO: 102026 - DNA, 15 bp, Homo sapiens
agtgacattgaaaac

SEQ ID NO: 102027 - DNA, 15 bp, Homo sapiens
aagtgacattgaaaa

SEQ ID NO: 102028 - DNA, 15 bp, Homo sapiens
caagtgacattgaaa

SEQ ID NO: 102029 - DNA, 15 bp, Homo sapiens
gcaagtgacattgaa

SEQ ID NO: 102030 - DNA, 15 bp, Homo sapiens
tgcaagtgacattga

SEQ ID NO: 102031 - DNA, 15 bp, Homo sapiens
atgcaagtgacattg

SEQ ID NO: 102032 - DNA, 15 bp, Homo sapiens
aatgcaagtgacatt

SEQ ID NO: 102033 - DNA, 15 bp, Homo sapiens
aaatgcaagtgacat

SEQ ID NO: 102034 - DNA, 15 bp, Homo sapiens
aaaatgcaagtgaca

SEQ ID NO: 102035 - DNA, 15 bp, Homo sapiens
gaaaatgcaagtgac

SEQ ID NO: 102036 - DNA, 15 bp, Homo sapiens
agaaaatgcaagtga

SEQ ID NO: 102037 - DNA, 15 bp, Homo sapiens
aagaaaatgcaagtg

SEQ ID NO: 102038 - DNA, 15 bp, Homo sapiens
gaagaaaatgcaagt

SEQ ID NO: 102039 - DNA, 15 bp, Homo sapiens
ggaagaaaatgcaag

SEQ ID NO: 102040 - DNA, 15 bp, Homo sapiens
tggaagaaaatgcaa

SEQ ID NO: 102041 - DNA, 15 bp, Homo sapiens
atggaagaaaatgca

SEQ ID NO: 102042 - DNA, 15 bp, Homo sapiens
tatggaagaaaatgc

SEQ ID NO: 102043 - DNA, 15 bp, Homo sapiens
ctatggaagaaaatg

SEQ ID NO: 102044 - DNA, 15 bp, Homo sapiens
gctatggaagaaaat

SEQ ID NO: 102045 - DNA, 15 bp, Homo sapiens
ggctatggaagaaaa

SEQ ID NO: 102046 - DNA, 15 bp, Homo sapiens
aggctatggaagaaa

SEQ ID NO: 102047 - DNA, 15 bp, Homo sapiens
caggctatggaagaa

SEQ ID NO: 102048 - DNA, 15 bp, Homo sapiens
tcaggctatggaaga

SEQ ID NO: 102049 - DNA, 15 bp, Homo sapiens
ttcaggctatggaag

SEQ ID NO: 102050 - DNA, 15 bp, Homo sapiens
cttcaggctatggaa

SEQ ID NO: 102051 - DNA, 15 bp, Homo sapiens
acttcaggctatgga

SEQ ID NO: 102052 - DNA, 15 bp, Homo sapiens
cacttcaggctatgg

SEQ ID NO: 102053 - DNA, 15 bp, Homo sapiens
acacttcaggctatg

SEQ ID NO: 102054 - DNA, 15 bp, Homo sapiens
aacacttcaggctat

SEQ ID NO: 102055 - DNA, 15 bp, Homo sapiens
aaacacttcaggcta

SEQ ID NO: 102056 - DNA, 15 bp, Homo sapiens
taaacacttcaggct

SEQ ID NO: 102057 - DNA, 15 bp, Homo sapiens
ataaacacttcaggc

SEQ ID NO: 102058 - DNA, 15 bp, Homo sapiens
tataaacacttcagg

SEQ ID NO: 102059 - DNA, 15 bp, Homo sapiens
gtataaacacttcag

SEQ ID NO: 102060 - DNA, 15 bp, Homo sapiens
tgtataaacacttca

SEQ ID NO: 102061 - DNA, 15 bp, Homo sapiens
ttgtataaacacttc

SEQ ID NO: 102062 - DNA, 15 bp, Homo sapiens
attgtataaacactt

SEQ ID NO: 102063 - DNA, 15 bp, Homo sapiens
gattgtataaacact

SEQ ID NO: 102064 - DNA, 15 bp, Homo sapiens
tgattgtataaacac

SEQ ID NO: 102065 - DNA, 15 bp, Homo sapiens
atgattgtataaaca

SEQ ID NO: 102066 - DNA, 15 bp, Homo sapiens
catgattgtataaac

SEQ ID NO: 102067 - DNA, 15 bp, Homo sapiens
acatgattgtataaa

SEQ ID NO: 102068 - DNA, 15 bp, Homo sapiens
cacatgattgtataa

SEQ ID NO: 102069 - DNA, 15 bp, Homo sapiens
acacatgattgtata

SEQ ID NO: 102070 - DNA, 15 bp, Homo sapiens
tacacatgattgtat

SEQ ID NO: 102071 - DNA, 15 bp, Homo sapiens
atacacatgattgta

SEQ ID NO: 102072 - DNA, 15 bp, Homo sapiens
aatacacatgattgt

SEQ ID NO: 102073 - DNA, 15 bp, Homo sapiens
aaatacacatgattg

SEQ ID NO: 102074 - DNA, 15 bp, Homo sapiens
taaatacacatgatt

SEQ ID NO: 102075 - DNA, 15 bp, Homo sapiens
ctaaatacacatgat

SEQ ID NO: 102076 - DNA, 15 bp, Homo sapiens
tctaaatacacatga

SEQ ID NO: 102077 - DNA, 15 bp, Homo sapiens
atctaaatacacatg

SEQ ID NO: 102078 - DNA, 15 bp, Homo sapiens
aatctaaatacacat

SEQ ID NO: 102079 - DNA, 15 bp, Homo sapiens
taatctaaatacaca

SEQ ID NO: 102080 - DNA, 15 bp, Homo sapiens
ataatctaaatacac

SEQ ID NO: 102081 - DNA, 15 bp, Homo sapiens
aataatctaaataca

SEQ ID NO: 102082 - DNA, 15 bp, Homo sapiens
caataatctaaatac

SEQ ID NO: 102083 - DNA, 15 bp, Homo sapiens
ccaataatctaaata

SEQ ID NO: 102084 - DNA, 15 bp, Homo sapiens
accaataatctaaat

SEQ ID NO: 102085 - DNA, 15 bp, Homo sapiens
caccaataatctaaa

SEQ ID NO: 102086 - DNA, 15 bp, Homo sapiens
tcaccaataatctaa

SEQ ID NO: 102087 - DNA, 15 bp, Homo sapiens
gtcaccaataatcta

SEQ ID NO: 102088 - DNA, 15 bp, Homo sapiens
ggtcaccaataatct

SEQ ID NO: 102089 - DNA, 15 bp, Homo sapiens
gggtcaccaataatc

SEQ ID NO: 102090 - DNA, 15 bp, Homo sapiens
tgggtcaccaataat

SEQ ID NO: 102091 - DNA, 15 bp, Homo sapiens
atgggtcaccaataa

SEQ ID NO: 102092 - DNA, 15 bp, Homo sapiens
aatgggtcaccaata

SEQ ID NO: 102093 - DNA, 15 bp, Homo sapiens
taatgggtcaccaat

SEQ ID NO: 102094 - DNA, 15 bp, Homo sapiens
ataatgggtcaccaa

SEQ ID NO: 102095 - DNA, 15 bp, Homo sapiens
tataatgggtcacca

SEQ ID NO: 102096 - DNA, 15 bp, Homo sapiens
atataatgggtcacc

SEQ ID NO: 102097 - DNA, 15 bp, Homo sapiens
gatataatgggtcac

SEQ ID NO: 102098 - DNA, 15 bp, Homo sapiens
tgatataatgggtca

SEQ ID NO: 102099 - DNA, 15 bp, Homo sapiens
ctgatataatgggtc

SEQ ID NO: 102100 - DNA, 15 bp, Homo sapiens
gctgatataatgggt

SEQ ID NO: 102101 - DNA, 15 bp, Homo sapiens
ggctgatataatggg

SEQ ID NO: 102102 - DNA, 15 bp, Homo sapiens
aggctgatataatgg

SEQ ID NO: 102103 - DNA, 15 bp, Homo sapiens
gaggctgatataatg

SEQ ID NO: 102104 - DNA, 15 bp, Homo sapiens
tgaggctgatataat

SEQ ID NO: 102105 - DNA, 15 bp, Homo sapiens
ttgaggctgatataa

SEQ ID NO: 102106 - DNA, 15 bp, Homo sapiens
cttgaggctgatata

SEQ ID NO: 102107 - DNA, 15 bp, Homo sapiens
tcttgaggctgatat

SEQ ID NO: 102108 - DNA, 15 bp, Homo sapiens
gtcttgaggctgata

SEQ ID NO: 102109 - DNA, 15 bp, Homo sapiens
cgtcttgaggctgat

SEQ ID NO: 102110 - DNA, 15 bp, Homo sapiens
acgtcttgaggctga

SEQ ID NO: 102111 - DNA, 15 bp, Homo sapiens
cacgtcttgaggctg

SEQ ID NO: 102112 - DNA, 15 bp, Homo sapiens
ccacgtcttgaggct

SEQ ID NO: 102113 - DNA, 15 bp, Homo sapiens
accacgtcttgaggc

SEQ ID NO: 102114 - DNA, 15 bp, Homo sapiens
aaccacgtcttgagg

SEQ ID NO: 102115 - DNA, 15 bp, Homo sapiens
taaccacgtcttgag

SEQ ID NO: 102116 - DNA, 15 bp, Homo sapiens
ctaaccacgtcttga

SEQ ID NO: 102117 - DNA, 15 bp, Homo sapiens
gctaaccacgtcttg

SEQ ID NO: 102118 - DNA, 15 bp, Homo sapiens
agctaaccacgtctt

SEQ ID NO: 102119 - DNA, 15 bp, Homo sapiens
cagctaaccacgtct

SEQ ID NO: 102120 - DNA, 15 bp, Homo sapiens
acagctaaccacgtc

SEQ ID NO: 102121 - DNA, 15 bp, Homo sapiens
aacagctaaccacgt

SEQ ID NO: 102122 - DNA, 15 bp, Homo sapiens
aaacagctaaccacg

SEQ ID NO: 102123 - DNA, 15 bp, Homo sapiens
caaacagctaaccac

SEQ ID NO: 102124 - DNA, 15 bp, Homo sapiens
tcaaacagctaacca

SEQ ID NO: 102125 - DNA, 15 bp, Homo sapiens
gtcaaacagctaacc

SEQ ID NO: 102126 - DNA, 15 bp, Homo sapiens
tgtcaaacagctaac

SEQ ID NO: 102127 - DNA, 15 bp, Homo sapiens
atgtcaaacagctaa

SEQ ID NO: 102128 - DNA, 15 bp, Homo sapiens
gatgtcaaacagcta

SEQ ID NO: 102129 - DNA, 15 bp, Homo sapiens
agatgtcaaacagct

SEQ ID NO: 102130 - DNA, 15 bp, Homo sapiens
aagatgtcaaacagc

SEQ ID NO: 102131 - DNA, 15 bp, Homo sapiens
taagatgtcaaacag

SEQ ID NO: 102132 - DNA, 15 bp, Homo sapiens
gtaagatgtcaaaca

SEQ ID NO: 102133 - DNA, 15 bp, Homo sapiens
tgtaagatgtcaaac

SEQ ID NO: 102134 - DNA, 15 bp, Homo sapiens
atgtaagatgtcaaa

SEQ ID NO: 102135 - DNA, 15 bp, Homo sapiens
aatgtaagatgtcaa

SEQ ID NO: 102136 - DNA, 15 bp, Homo sapiens
aaatgtaagatgtca

SEQ ID NO: 102137 - DNA, 15 bp, Homo sapiens
aaaatgtaagatgtc

SEQ ID NO: 102138 - DNA, 15 bp, Homo sapiens
taaaatgtaagatgt

SEQ ID NO: 102139 - DNA, 15 bp, Homo sapiens
ctaaaatgtaagatg

SEQ ID NO: 102140 - DNA, 15 bp, Homo sapiens
tctaaaatgtaagat

SEQ ID NO: 102141 - DNA, 15 bp, Homo sapiens
gtctaaaatgtaaga

SEQ ID NO: 102142 - DNA, 15 bp, Homo sapiens
tgtctaaaatgtaag

SEQ ID NO: 102143 - DNA, 15 bp, Homo sapiens
atgtctaaaatgtaa

SEQ ID NO: 102144 - DNA, 15 bp, Homo sapiens
catgtctaaaatgta

SEQ ID NO: 102145 - DNA, 15 bp, Homo sapiens
acatgtctaaaatgt

SEQ ID NO: 102146 - DNA, 15 bp, Homo sapiens
aacatgtctaaaatg

SEQ ID NO: 102147 - DNA, 15 bp, Homo sapiens
caacatgtctaaaat

SEQ ID NO: 102148 - DNA, 15 bp, Homo sapiens
tcaacatgtctaaaa

SEQ ID NO: 102149 - DNA, 15 bp, Homo sapiens
ttcaacatgtctaaa

SEQ ID NO: 102150 - DNA, 15 bp, Homo sapiens
cttcaacatgtctaa

SEQ ID NO: 102151 - DNA, 15 bp, Homo sapiens
gcttcaacatgtcta

SEQ ID NO: 102152 - DNA, 15 bp, Homo sapiens
tgcttcaacatgtct

SEQ ID NO: 102153 - DNA, 15 bp, Homo sapiens
gtgcttcaacatgtc

SEQ ID NO: 102154 - DNA, 15 bp, Homo sapiens
agtgcttcaacatgt

SEQ ID NO: 102155 - DNA, 15 bp, Homo sapiens
gagtgcttcaacatg

SEQ ID NO: 102156 - DNA, 15 bp, Homo sapiens
agagtgcttcaacat

SEQ ID NO: 102157 - DNA, 15 bp, Homo sapiens
tagagtgcttcaaca

SEQ ID NO: 102158 - DNA, 15 bp, Homo sapiens
ctagagtgcttcaac

SEQ ID NO: 102159 - DNA, 15 bp, Homo sapiens
actagagtgcttcaa

SEQ ID NO: 102160 - DNA, 15 bp, Homo sapiens
cactagagtgcttca

SEQ ID NO: 102161 - DNA, 15 bp, Homo sapiens
ccactagagtgcttc

SEQ ID NO: 102162 - DNA, 15 bp, Homo sapiens
accactagagtgctt

SEQ ID NO: 102163 - DNA, 15 bp, Homo sapiens
aaccactagagtgct

SEQ ID NO: 102164 - DNA, 15 bp, Homo sapiens
aaaccactagagtgc

SEQ ID NO: 102165 - DNA, 15 bp, Homo sapiens
aaaaccactagagtg

SEQ ID NO: 102166 - DNA, 15 bp, Homo sapiens
gaaaaccactagagt

SEQ ID NO: 102167 - DNA, 15 bp, Homo sapiens
ggaaaaccactagag

SEQ ID NO: 102168 - DNA, 15 bp, Homo sapiens
tggaaaaccactaga

SEQ ID NO: 102169 - DNA, 15 bp, Homo sapiens
ctggaaaaccactag

SEQ ID NO: 102170 - DNA, 15 bp, Homo sapiens
actggaaaaccacta

SEQ ID NO: 102171 - DNA, 15 bp, Homo sapiens
aactggaaaaccact

SEQ ID NO: 102172 - DNA, 15 bp, Homo sapiens
aaactggaaaaccac

SEQ ID NO: 102173 - DNA, 15 bp, Homo sapiens
taaactggaaaacca

SEQ ID NO: 102174 - DNA, 15 bp, Homo sapiens
ataaactggaaaacc

SEQ ID NO: 102175 - DNA, 15 bp, Homo sapiens
aataaactggaaaac

SEQ ID NO: 102176 - DNA, 15 bp, Homo sapiens
aaataaactggaaaa

SEQ ID NO: 102177 - DNA, 15 bp, Homo sapiens
aaaataaactggaaa

SEQ ID NO: 102178 - DNA, 15 bp, Homo sapiens
taaaataaactggaa

SEQ ID NO: 102179 - DNA, 15 bp, Homo sapiens
ctaaaataaactgga

SEQ ID NO: 102180 - DNA, 15 bp, Homo sapiens
actaaaataaactgg

SEQ ID NO: 102181 - DNA, 15 bp, Homo sapiens
tactaaaataaactg

SEQ ID NO: 102182 - DNA, 15 bp, Homo sapiens
ctactaaaataaact

SEQ ID NO: 102183 - DNA, 15 bp, Homo sapiens
cctactaaaataaac

SEQ ID NO: 102184 - DNA, 15 bp, Homo sapiens
gcctactaaaataaa

SEQ ID NO: 102185 - DNA, 15 bp, Homo sapiens
ggcctactaaaataa

SEQ ID NO: 102186 - DNA, 15 bp, Homo sapiens
gggcctactaaaata

SEQ ID NO: 102187 - DNA, 15 bp, Homo sapiens
agggcctactaaaat

SEQ ID NO: 102188 - DNA, 15 bp, Homo sapiens
cagggcctactaaaa

SEQ ID NO: 102189 - DNA, 15 bp, Homo sapiens
ccagggcctactaaa

SEQ ID NO: 102190 - DNA, 15 bp, Homo sapiens
tccagggcctactaa

SEQ ID NO: 102191 - DNA, 15 bp, Homo sapiens
gtccagggcctacta

SEQ ID NO: 102192 - DNA, 15 bp, Homo sapiens
tgtccagggcctact

SEQ ID NO: 102193 - DNA, 15 bp, Homo sapiens
ttgtccagggcctac

SEQ ID NO: 102194 - DNA, 15 bp, Homo sapiens
tttgtccagggccta

SEQ ID NO: 102195 - DNA, 15 bp, Homo sapiens
ctttgtccagggcct

SEQ ID NO: 102196 - DNA, 15 bp, Homo sapiens
gctttgtccagggcc

SEQ ID NO: 102197 - DNA, 15 bp, Homo sapiens
agctttgtccagggc

SEQ ID NO: 102198 - DNA, 15 bp, Homo sapiens
gagctttgtccaggg

SEQ ID NO: 102199 - DNA, 15 bp, Homo sapiens
agagctttgtccagg

SEQ ID NO: 102200 - DNA, 15 bp, Homo sapiens
cagagctttgtccag

SEQ ID NO: 102201 - DNA, 15 bp, Homo sapiens
gcagagctttgtcca

SEQ ID NO: 102202 - DNA, 15 bp, Homo sapiens
ggcagagctttgtcc

SEQ ID NO: 102203 - DNA, 15 bp, Homo sapiens
tggcagagctttgtc

SEQ ID NO: 102204 - DNA, 15 bp, Homo sapiens
atggcagagctttgt

SEQ ID NO: 102205 - DNA, 15 bp, Homo sapiens
tatggcagagctttg

SEQ ID NO: 102206 - DNA, 15 bp, Homo sapiens
atatggcagagcttt

SEQ ID NO: 102207 - DNA, 15 bp, Homo sapiens
catatggcagagctt

SEQ ID NO: 102208 - DNA, 15 bp, Homo sapiens
acatatggcagagct

SEQ ID NO: 102209 - DNA, 15 bp, Homo sapiens
aacatatggcagagc

SEQ ID NO: 102210 - DNA, 15 bp, Homo sapiens
taacatatggcagag

SEQ ID NO: 102211 - DNA, 15 bp, Homo sapiens
ataacatatggcaga

SEQ ID NO: 102212 - DNA, 15 bp, Homo sapiens
aataacatatggcag

SEQ ID NO: 102213 - DNA, 15 bp, Homo sapiens
taataacatatggca

SEQ ID NO: 102214 - DNA, 15 bp, Homo sapiens
ctaataacatatggc

SEQ ID NO: 102215 - DNA, 15 bp, Homo sapiens
cctaataacatatgg

SEQ ID NO: 102216 - DNA, 15 bp, Homo sapiens
tcctaataacatatg

SEQ ID NO: 102217 - DNA, 15 bp, Homo sapiens
gtcctaataacatat

SEQ ID NO: 102218 - DNA, 15 bp, Homo sapiens
tgtcctaataacata

SEQ ID NO: 102219 - DNA, 15 bp, Homo sapiens
ttgtcctaataacat

SEQ ID NO: 102220 - DNA, 15 bp, Homo sapiens
gttgtcctaataaca

SEQ ID NO: 102221 - DNA, 15 bp, Homo sapiens
agttgtcctaataac

SEQ ID NO: 102222 - DNA, 15 bp, Homo sapiens
cagttgtcctaataa

SEQ ID NO: 102223 - DNA, 15 bp, Homo sapiens
gcagttgtcctaata

SEQ ID NO: 102224 - DNA, 15 bp, Homo sapiens
agcagttgtcctaat

SEQ ID NO: 102225 - DNA, 15 bp, Homo sapiens
gagcagttgtcctaa

SEQ ID NO: 102226 - DNA, 15 bp, Homo sapiens
agagcagttgtccta

SEQ ID NO: 102227 - DNA, 15 bp, Homo sapiens
gagagcagttgtcct

SEQ ID NO: 102228 - DNA, 15 bp, Homo sapiens
agagagcagttgtcc

SEQ ID NO: 102229 - DNA, 15 bp, Homo sapiens
aagagagcagttgtc

SEQ ID NO: 102230 - DNA, 15 bp, Homo sapiens
caagagagcagttgt

SEQ ID NO: 102231 - DNA, 15 bp, Homo sapiens
acaagagagcagttg

SEQ ID NO: 102232 - DNA, 15 bp, Homo sapiens
aacaagagagcagtt

SEQ ID NO: 102233 - DNA, 15 bp, Homo sapiens
aaacaagagagcagt

SEQ ID NO: 102234 - DNA, 15 bp, Homo sapiens
gaaacaagagagcag

SEQ ID NO: 102235 - DNA, 15 bp, Homo sapiens
tgaaacaagagagca

SEQ ID NO: 102236 - DNA, 15 bp, Homo sapiens
atgaaacaagagagc

SEQ ID NO: 102237 - DNA, 15 bp, Homo sapiens
gatgaaacaagagag

SEQ ID NO: 102238 - DNA, 15 bp, Homo sapiens
tgatgaaacaagaga

SEQ ID NO: 102239 - DNA, 15 bp, Homo sapiens
ttgatgaaacaagag

SEQ ID NO: 102240 - DNA, 15 bp, Homo sapiens
gttgatgaaacaaga

SEQ ID NO: 102241 - DNA, 15 bp, Homo sapiens
tgttgatgaaacaag

SEQ ID NO: 102242 - DNA, 15 bp, Homo sapiens
ttgttgatgaaacaa

SEQ ID NO: 102243 - DNA, 15 bp, Homo sapiens
cttgttgatgaaaca

SEQ ID NO: 102244 - DNA, 15 bp, Homo sapiens
acttgttgatgaaac

SEQ ID NO: 102245 - DNA, 15 bp, Homo sapiens
aacttgttgatgaaa

SEQ ID NO: 102246 - DNA, 15 bp, Homo sapiens
taacttgttgatgaa

SEQ ID NO: 102247 - DNA, 15 bp, Homo sapiens
ataacttgttgatga

SEQ ID NO: 102248 - DNA, 15 bp, Homo sapiens
aataacttgttgatg

SEQ ID NO: 102249 - DNA, 15 bp, Homo sapiens
aaataacttgttgat

SEQ ID NO: 102250 - DNA, 15 bp, Homo sapiens
aaaataacttgttga

SEQ ID NO: 102251 - DNA, 15 bp, Homo sapiens
aaaaataacttgttg

SEQ ID NO: 102252 - DNA, 15 bp, Homo sapiens
taaaaataacttgtt

SEQ ID NO: 102253 - DNA, 15 bp, Homo sapiens
gtaaaaataacttgt

SEQ ID NO: 102254 - DNA, 15 bp, Homo sapiens
agtaaaaataacttg

SEQ ID NO: 102255 - DNA, 15 bp, Homo sapiens
gagtaaaaataactt

SEQ ID NO: 102256 - DNA, 15 bp, Homo sapiens
tgagtaaaaataact

SEQ ID NO: 102257 - DNA, 15 bp, Homo sapiens
gtgagtaaaaataac

SEQ ID NO: 102258 - DNA, 15 bp, Homo sapiens
agtgagtaaaaataa

SEQ ID NO: 102259 - DNA, 15 bp, Homo sapiens
tagtgagtaaaaata

SEQ ID NO: 102260 - DNA, 15 bp, Homo sapiens
ttagtgagtaaaaat

SEQ ID NO: 102261 - DNA, 15 bp, Homo sapiens
tttagtgagtaaaaa

SEQ ID NO: 102262 - DNA, 15 bp, Homo sapiens
gtttagtgagtaaaa

SEQ ID NO: 102263 - DNA, 15 bp, Homo sapiens
tgtttagtgagtaaa

SEQ ID NO: 102264 - DNA, 15 bp, Homo sapiens
gtgtttagtgagtaa

SEQ ID NO: 102265 - DNA, 15 bp, Homo sapiens
tgtgtttagtgagta

SEQ ID NO: 102266 - DNA, 15 bp, Homo sapiens
ctgtgtttagtgagt

SEQ ID NO: 102267 - DNA, 15 bp, Homo sapiens
gctgtgtttagtgag

SEQ ID NO: 102268 - DNA, 15 bp, Homo sapiens
tgctgtgtttagtga

SEQ ID NO: 102269 - DNA, 15 bp, Homo sapiens
gtgctgtgtttagtg

SEQ ID NO: 102270 - DNA, 15 bp, Homo sapiens
agtgctgtgtttagt

SEQ ID NO: 102271 - DNA, 15 bp, Homo sapiens
cagtgctgtgtttag

SEQ ID NO: 102272 - DNA, 15 bp, Homo sapiens
tcagtgctgtgttta

SEQ ID NO: 102273 - DNA, 15 bp, Homo sapiens
gtcagtgctgtgttt

SEQ ID NO: 102274 - DNA, 15 bp, Homo sapiens
tgtcagtgctgtgtt

SEQ ID NO: 102275 - DNA, 15 bp, Homo sapiens
ctgtcagtgctgtgt

SEQ ID NO: 102276 - DNA, 15 bp, Homo sapiens
actgtcagtgctgtg

SEQ ID NO: 102277 - DNA, 15 bp, Homo sapiens
aactgtcagtgctgt

SEQ ID NO: 102278 - DNA, 15 bp, Homo sapiens
aaactgtcagtgctg

SEQ ID NO: 102279 - DNA, 15 bp, Homo sapiens
taaactgtcagtgct

SEQ ID NO: 102280 - DNA, 15 bp, Homo sapiens
ataaactgtcagtgc

SEQ ID NO: 102281 - DNA, 15 bp, Homo sapiens
tataaactgtcagtg

SEQ ID NO: 102282 - DNA, 15 bp, Homo sapiens
ctataaactgtcagt

SEQ ID NO: 102283 - DNA, 15 bp, Homo sapiens
cctataaactgtcag

SEQ ID NO: 102284 - DNA, 15 bp, Homo sapiens
ccctataaactgtca

SEQ ID NO: 102285 - DNA, 15 bp, Homo sapiens
cccctataaactgtc

SEQ ID NO: 102286 - DNA, 15 bp, Homo sapiens
tcccctataaactgt

SEQ ID NO: 102287 - DNA, 15 bp, Homo sapiens
atcccctataaactg

SEQ ID NO: 102288 - DNA, 15 bp, Homo sapiens
aatcccctataaact

SEQ ID NO: 102289 - DNA, 15 bp, Homo sapiens
gaatcccctataaac

SEQ ID NO: 102290 - DNA, 15 bp, Homo sapiens
ggaatcccctataaa

SEQ ID NO: 102291 - DNA, 15 bp, Homo sapiens
aggaatcccctataa

SEQ ID NO: 102292 - DNA, 15 bp, Homo sapiens
caggaatcccctata

SEQ ID NO: 102293 - DNA, 15 bp, Homo sapiens
acaggaatcccctat

SEQ ID NO: 102294 - DNA, 15 bp, Homo sapiens
gacaggaatccccta

SEQ ID NO: 102295 - DNA, 15 bp, Homo sapiens
agacaggaatcccct

SEQ ID NO: 102296 - DNA, 15 bp, Homo sapiens
gagacaggaatcccc

SEQ ID NO: 102297 - DNA, 15 bp, Homo sapiens
agagacaggaatccc

SEQ ID NO: 102298 - DNA, 15 bp, Homo sapiens
aagagacaggaatcc

SEQ ID NO: 102299 - DNA, 15 bp, Homo sapiens
taagagacaggaatc

SEQ ID NO: 102300 - DNA, 15 bp, Homo sapiens
gtaagagacaggaat

SEQ ID NO: 102301 - DNA, 15 bp, Homo sapiens
ggtaagagacaggaa

SEQ ID NO: 102302 - DNA, 15 bp, Homo sapiens
aggtaagagacagga

SEQ ID NO: 102303 - DNA, 15 bp, Homo sapiens
aaggtaagagacagg

SEQ ID NO: 102304 - DNA, 15 bp, Homo sapiens
gaaggtaagagacag

SEQ ID NO: 102305 - DNA, 15 bp, Homo sapiens
tgaaggtaagagaca

SEQ ID NO: 102306 - DNA, 15 bp, Homo sapiens
ctgaaggtaagagac

SEQ ID NO: 102307 - DNA, 15 bp, Homo sapiens
tctgaaggtaagaga

SEQ ID NO: 102308 - DNA, 15 bp, Homo sapiens
atctgaaggtaagag

SEQ ID NO: 102309 - DNA, 15 bp, Homo sapiens
catctgaaggtaaga

SEQ ID NO: 102310 - DNA, 15 bp, Homo sapiens
gcatctgaaggtaag

SEQ ID NO: 102311 - DNA, 15 bp, Homo sapiens
agcatctgaaggtaa

SEQ ID NO: 102312 - DNA, 15 bp, Homo sapiens
tagcatctgaaggta

SEQ ID NO: 102313 - DNA, 15 bp, Homo sapiens
ctagcatctgaaggt

SEQ ID NO: 102314 - DNA, 15 bp, Homo sapiens
tctagcatctgaagg

SEQ ID NO: 102315 - DNA, 15 bp, Homo sapiens
ttctagcatctgaag

SEQ ID NO: 102316 - DNA, 15 bp, Homo sapiens
cttctagcatctgaa

SEQ ID NO: 102317 - DNA, 15 bp, Homo sapiens
acttctagcatctga

SEQ ID NO: 102318 - DNA, 15 bp, Homo sapiens
aacttctagcatctg

SEQ ID NO: 102319 - DNA, 15 bp, Homo sapiens
taacttctagcatct

SEQ ID NO: 102320 - DNA, 15 bp, Homo sapiens
ttaacttctagcatc

SEQ ID NO: 102321 - DNA, 15 bp, Homo sapiens
cttaacttctagcat

SEQ ID NO: 102322 - DNA, 15 bp, Homo sapiens
tcttaacttctagca

SEQ ID NO: 102323 - DNA, 15 bp, Homo sapiens
gtcttaacttctagc

SEQ ID NO: 102324 - DNA, 15 bp, Homo sapiens
tgtcttaacttctag

SEQ ID NO: 102325 - DNA, 15 bp, Homo sapiens
ctgtcttaacttcta

SEQ ID NO: 102326 - DNA, 15 bp, Homo sapiens
actgtcttaacttct

SEQ ID NO: 102327 - DNA, 15 bp, Homo sapiens
cactgtcttaacttc

SEQ ID NO: 102328 - DNA, 15 bp, Homo sapiens
ccactgtcttaactt

SEQ ID NO: 102329 - DNA, 15 bp, Homo sapiens
accactgtcttaact

SEQ ID NO: 102330 - DNA, 15 bp, Homo sapiens
aaccactgtcttaac

SEQ ID NO: 102331 - DNA, 15 bp, Homo sapiens
caaccactgtcttaa

SEQ ID NO: 102332 - DNA, 15 bp, Homo sapiens
tcaaccactgtctta

SEQ ID NO: 102333 - DNA, 15 bp, Homo sapiens
ctcaaccactgtctt

SEQ ID NO: 102334 - DNA, 15 bp, Homo sapiens
gctcaaccactgtct

SEQ ID NO: 102335 - DNA, 15 bp, Homo sapiens
ggctcaaccactgtc

SEQ ID NO: 102336 - DNA, 15 bp, Homo sapiens
tggctcaaccactgt

SEQ ID NO: 102337 - DNA, 15 bp, Homo sapiens
atggctcaaccactg

SEQ ID NO: 102338 - DNA, 15 bp, Homo sapiens
catggctcaaccact

SEQ ID NO: 102339 - DNA, 15 bp, Homo sapiens
ccatggctcaaccac

SEQ ID NO: 102340 - DNA, 15 bp, Homo sapiens
cccatggctcaacca

SEQ ID NO: 102341 - DNA, 15 bp, Homo sapiens
tcccatggctcaacc

SEQ ID NO: 102342 - DNA, 15 bp, Homo sapiens
atcccatggctcaac

SEQ ID NO: 102343 - DNA, 15 bp, Homo sapiens
gatcccatggctcaa

SEQ ID NO: 102344 - DNA, 15 bp, Homo sapiens
agatcccatggctca

SEQ ID NO: 102345 - DNA, 15 bp, Homo sapiens
aagatcccatggctc

SEQ ID NO: 102346 - DNA, 15 bp, Homo sapiens
caagatcccatggct

SEQ ID NO: 102347 - DNA, 15 bp, Homo sapiens
acaagatcccatggc

SEQ ID NO: 102348 - DNA, 15 bp, Homo sapiens
gacaagatcccatgg

SEQ ID NO: 102349 - DNA, 15 bp, Homo sapiens
cgacaagatcccatg

SEQ ID NO: 102350 - DNA, 15 bp, Homo sapiens
acgacaagatcccat

SEQ ID NO: 102351 - DNA, 15 bp, Homo sapiens
tacgacaagatccca

SEQ ID NO: 102352 - DNA, 15 bp, Homo sapiens
ctacgacaagatccc

SEQ ID NO: 102353 - DNA, 15 bp, Homo sapiens
cctacgacaagatcc

SEQ ID NO: 102354 - DNA, 15 bp, Homo sapiens
tcctacgacaagatc

SEQ ID NO: 102355 - DNA, 15 bp, Homo sapiens
ctcctacgacaagat

SEQ ID NO: 102356 - DNA, 15 bp, Homo sapiens
gctcctacgacaaga

SEQ ID NO: 102357 - DNA, 15 bp, Homo sapiens
agctcctacgacaag

SEQ ID NO: 102358 - DNA, 15 bp, Homo sapiens
aagctcctacgacaa

SEQ ID NO: 102359 - DNA, 15 bp, Homo sapiens
caagctcctacgaca

SEQ ID NO: 102360 - DNA, 15 bp, Homo sapiens
acaagctcctacgac

SEQ ID NO: 102361 - DNA, 15 bp, Homo sapiens
gacaagctcctacga

SEQ ID NO: 102362 - DNA, 15 bp, Homo sapiens
agacaagctcctacg

SEQ ID NO: 102363 - DNA, 15 bp, Homo sapiens
aagacaagctcctac

SEQ ID NO: 102364 - DNA, 15 bp, Homo sapiens
gaagacaagctccta

SEQ ID NO: 102365 - DNA, 15 bp, Homo sapiens
tgaagacaagctcct

SEQ ID NO: 102366 - DNA, 15 bp, Homo sapiens
ttgaagacaagctcc

SEQ ID NO: 102367 - DNA, 15 bp, Homo sapiens
cttgaagacaagctc

SEQ ID NO: 102368 - DNA, 15 bp, Homo sapiens
gcttgaagacaagct

SEQ ID NO: 102369 - DNA, 15 bp, Homo sapiens
ggcttgaagacaagc

SEQ ID NO: 102370 - DNA, 15 bp, Homo sapiens
aggcttgaagacaag

SEQ ID NO: 102371 - DNA, 15 bp, Homo sapiens
caggcttgaagacaa

SEQ ID NO: 102372 - DNA, 15 bp, Homo sapiens
ccaggcttgaagaca

SEQ ID NO: 102373 - DNA, 15 bp, Homo sapiens
tccaggcttgaagac

SEQ ID NO: 102374 - DNA, 15 bp, Homo sapiens
atccaggcttgaaga

SEQ ID NO: 102375 - DNA, 15 bp, Homo sapiens
aatccaggcttgaag

SEQ ID NO: 102376 - DNA, 15 bp, Homo sapiens
aaatccaggcttgaa

SEQ ID NO: 102377 - DNA, 15 bp, Homo sapiens
caaatccaggcttga

SEQ ID NO: 102378 - DNA, 15 bp, Homo sapiens
tcaaatccaggcttg

SEQ ID NO: 102379 - DNA, 15 bp, Homo sapiens
ttcaaatccaggctt

SEQ ID NO: 102380 - DNA, 15 bp, Homo sapiens
gttcaaatccaggct

SEQ ID NO: 102381 - DNA, 15 bp, Homo sapiens
agttcaaatccaggc

SEQ ID NO: 102382 - DNA, 15 bp, Homo sapiens
gagttcaaatccagg

SEQ ID NO: 102383 - DNA, 15 bp, Homo sapiens
ggagttcaaatccag

SEQ ID NO: 102384 - DNA, 15 bp, Homo sapiens
aggagttcaaatcca

SEQ ID NO: 102385 - DNA, 15 bp, Homo sapiens
aaggagttcaaatcc

SEQ ID NO: 102386 - DNA, 15 bp, Homo sapiens
caaggagttcaaatc

SEQ ID NO: 102387 - DNA, 15 bp, Homo sapiens
tcaaggagttcaaat

SEQ ID NO: 102388 - DNA, 15 bp, Homo sapiens
ctcaaggagttcaaa

SEQ ID NO: 102389 - DNA, 15 bp, Homo sapiens
cctcaaggagttcaa

SEQ ID NO: 102390 - DNA, 15 bp, Homo sapiens
gcctcaaggagttca

SEQ ID NO: 102391 - DNA, 15 bp, Homo sapiens
ggcctcaaggagttc

SEQ ID NO: 102392 - DNA, 15 bp, Homo sapiens
tggcctcaaggagtt

SEQ ID NO: 102393 - DNA, 15 bp, Homo sapiens
ttggcctcaaggagt

SEQ ID NO: 102394 - DNA, 15 bp, Homo sapiens
cttggcctcaaggag

SEQ ID NO: 102395 - DNA, 15 bp, Homo sapiens
tcttggcctcaagga

SEQ ID NO: 102396 - DNA, 15 bp, Homo sapiens
ttcttggcctcaagg

SEQ ID NO: 102397 - DNA, 15 bp, Homo sapiens
tttcttggcctcaag

SEQ ID NO: 102398 - DNA, 15 bp, Homo sapiens
atttcttggcctcaa

SEQ ID NO: 102399 - DNA, 15 bp, Homo sapiens
catttcttggcctca

SEQ ID NO: 102400 - DNA, 15 bp, Homo sapiens
acatttcttggcctc

SEQ ID NO: 102401 - DNA, 15 bp, Homo sapiens
tacatttcttggcct

SEQ ID NO: 102402 - DNA, 15 bp, Homo sapiens
gtacatttcttggcc

SEQ ID NO: 102403 - DNA, 15 bp, Homo sapiens
ggtacatttcttggc

SEQ ID NO: 102404 - DNA, 15 bp, Homo sapiens
gggtacatttcttgg

SEQ ID NO: 102405 - DNA, 15 bp, Homo sapiens
cgggtacatttcttg

SEQ ID NO: 102406 - DNA, 15 bp, Homo sapiens
tcgggtacatttctt

SEQ ID NO: 102407 - DNA, 15 bp, Homo sapiens
atcgggtacatttct

SEQ ID NO: 102408 - DNA, 15 bp, Homo sapiens
catcgggtacatttc

SEQ ID NO: 102409 - DNA, 15 bp, Homo sapiens
gcatcgggtacattt

SEQ ID NO: 102410 - DNA, 15 bp, Homo sapiens
agcatcgggtacatt

SEQ ID NO: 102411 - DNA, 15 bp, Homo sapiens
aagcatcgggtacat

SEQ ID NO: 102412 - DNA, 15 bp, Homo sapiens
aaagcatcgggtaca

SEQ ID NO: 102413 - DNA, 15 bp, Homo sapiens
caaagcatcgggtac

SEQ ID NO: 102414 - DNA, 15 bp, Homo sapiens
acaaagcatcgggta

SEQ ID NO: 102415 - DNA, 15 bp, Homo sapiens
aacaaagcatcgggt

SEQ ID NO: 102416 - DNA, 15 bp, Homo sapiens
taacaaagcatcggg

SEQ ID NO: 102417 - DNA, 15 bp, Homo sapiens
ataacaaagcatcgg

SEQ ID NO: 102418 - DNA, 15 bp, Homo sapiens
aataacaaagcatcg

SEQ ID NO: 102419 - DNA, 15 bp, Homo sapiens
gaataacaaagcatc

SEQ ID NO: 102420 - DNA, 15 bp, Homo sapiens
ggaataacaaagcat

SEQ ID NO: 102421 - DNA, 15 bp, Homo sapiens
aggaataacaaagca

SEQ ID NO: 102422 - DNA, 15 bp, Homo sapiens
gaggaataacaaagc

SEQ ID NO: 102423 - DNA, 15 bp, Homo sapiens
tgaggaataacaaag

SEQ ID NO: 102424 - DNA, 15 bp, Homo sapiens
ctgaggaataacaaa

SEQ ID NO: 102425 - DNA, 15 bp, Homo sapiens
actgaggaataacaa

SEQ ID NO: 102426 - DNA, 15 bp, Homo sapiens
aactgaggaataaca

SEQ ID NO: 102427 - DNA, 15 bp, Homo sapiens
gaactgaggaataac

SEQ ID NO: 102428 - DNA, 15 bp, Homo sapiens
ggaactgaggaataa

SEQ ID NO: 102429 - DNA, 15 bp, Homo sapiens
gggaactgaggaata

SEQ ID NO: 102430 - DNA, 15 bp, Homo sapiens
tgggaactgaggaat

SEQ ID NO: 102431 - DNA, 15 bp, Homo sapiens
ctgggaactgaggaa

SEQ ID NO: 102432 - DNA, 15 bp, Homo sapiens
gctgggaactgagga

SEQ ID NO: 102433 - DNA, 15 bp, Homo sapiens
tgctgggaactgagg

SEQ ID NO: 102434 - DNA, 15 bp, Homo sapiens
gtgctgggaactgag

SEQ ID NO: 102435 - DNA, 15 bp, Homo sapiens
tgtgctgggaactga

SEQ ID NO: 102436 - DNA, 15 bp, Homo sapiens
ctgtgctgggaactg

SEQ ID NO: 102437 - DNA, 15 bp, Homo sapiens
actgtgctgggaact

SEQ ID NO: 102438 - DNA, 15 bp, Homo sapiens
cactgtgctgggaac

SEQ ID NO: 102439 - DNA, 15 bp, Homo sapiens
acactgtgctgggaa

SEQ ID NO: 102440 - DNA, 15 bp, Homo sapiens
cacactgtgctggga

SEQ ID NO: 102441 - DNA, 15 bp, Homo sapiens
acacactgtgctggg

SEQ ID NO: 102442 - DNA, 15 bp, Homo sapiens
tacacactgtgctgg

SEQ ID NO: 102443 - DNA, 15 bp, Homo sapiens
ctacacactgtgctg

SEQ ID NO: 102444 - DNA, 15 bp, Homo sapiens
gctacacactgtgct

SEQ ID NO: 102445 - DNA, 15 bp, Homo sapiens
tgctacacactgtgc

SEQ ID NO: 102446 - DNA, 15 bp, Homo sapiens
gtgctacacactgtg

SEQ ID NO: 102447 - DNA, 15 bp, Homo sapiens
tgtgctacacactgt

SEQ ID NO: 102448 - DNA, 15 bp, Homo sapiens
atgtgctacacactg

SEQ ID NO: 102449 - DNA, 15 bp, Homo sapiens
catgtgctacacact

SEQ ID NO: 102450 - DNA, 15 bp, Homo sapiens
acatgtgctacacac

SEQ ID NO: 102451 - DNA, 15 bp, Homo sapiens
aacatgtgctacaca

SEQ ID NO: 102452 - DNA, 15 bp, Homo sapiens
taacatgtgctacac

SEQ ID NO: 102453 - DNA, 15 bp, Homo sapiens
ttaacatgtgctaca

SEQ ID NO: 102454 - DNA, 15 bp, Homo sapiens
gttaacatgtgctac

SEQ ID NO: 102455 - DNA, 15 bp, Homo sapiens
agttaacatgtgcta

SEQ ID NO: 102456 - DNA, 15 bp, Homo sapiens
aagttaacatgtgct

SEQ ID NO: 102457 - DNA, 15 bp, Homo sapiens
taagttaacatgtgc

SEQ ID NO: 102458 - DNA, 15 bp, Homo sapiens
ttaagttaacatgtg

SEQ ID NO: 102459 - DNA, 15 bp, Homo sapiens
attaagttaacatgt

SEQ ID NO: 102460 - DNA, 15 bp, Homo sapiens
tattaagttaacatg

SEQ ID NO: 102461 - DNA, 15 bp, Homo sapiens
ttattaagttaacat

SEQ ID NO: 102462 - DNA, 15 bp, Homo sapiens
gttattaagttaaca

SEQ ID NO: 102463 - DNA, 15 bp, Homo sapiens
ggttattaagttaac

SEQ ID NO: 102464 - DNA, 15 bp, Homo sapiens
cggttattaagttaa

SEQ ID NO: 102465 - DNA, 15 bp, Homo sapiens
acggttattaagtta

SEQ ID NO: 102466 - DNA, 15 bp, Homo sapiens
aacggttattaagtt

SEQ ID NO: 102467 - DNA, 15 bp, Homo sapiens
aaacggttattaagt

SEQ ID NO: 102468 - DNA, 15 bp, Homo sapiens
gaaacggttattaag

SEQ ID NO: 102469 - DNA, 15 bp, Homo sapiens
agaaacggttattaa

SEQ ID NO: 102470 - DNA, 15 bp, Homo sapiens
aagaaacggttatta

SEQ ID NO: 102471 - DNA, 15 bp, Homo sapiens
taagaaacggttatt

SEQ ID NO: 102472 - DNA, 15 bp, Homo sapiens
ttaagaaacggttat

SEQ ID NO: 102473 - DNA, 15 bp, Homo sapiens
tttaagaaacggtta

SEQ ID NO: 102474 - DNA, 15 bp, Homo sapiens
atttaagaaacggtt

SEQ ID NO: 102475 - DNA, 15 bp, Homo sapiens
catttaagaaacggt

SEQ ID NO: 102476 - DNA, 15 bp, Homo sapiens
tcatttaagaaacgg

SEQ ID NO: 102477 - DNA, 15 bp, Homo sapiens
ttcatttaagaaacg

SEQ ID NO: 102478 - DNA, 15 bp, Homo sapiens
tttcatttaagaaac

SEQ ID NO: 102479 - DNA, 15 bp, Homo sapiens
atttcatttaagaaa

SEQ ID NO: 102480 - DNA, 15 bp, Homo sapiens
tatttcatttaagaa

SEQ ID NO: 102481 - DNA, 15 bp, Homo sapiens
gtatttcatttaaga

SEQ ID NO: 102482 - DNA, 15 bp, Homo sapiens
tgtatttcatttaag

SEQ ID NO: 102483 - DNA, 15 bp, Homo sapiens
ctgtatttcatttaa

SEQ ID NO: 102484 - DNA, 15 bp, Homo sapiens
actgtatttcattta

SEQ ID NO: 102485 - DNA, 15 bp, Homo sapiens
cactgtatttcattt

SEQ ID NO: 102486 - DNA, 15 bp, Homo sapiens
gcactgtatttcatt

SEQ ID NO: 102487 - DNA, 15 bp, Homo sapiens
tgcactgtatttcat

SEQ ID NO: 102488 - DNA, 15 bp, Homo sapiens
ttgcactgtatttca

SEQ ID NO: 102489 - DNA, 15 bp, Homo sapiens
tttgcactgtatttc

SEQ ID NO: 102490 - DNA, 15 bp, Homo sapiens
ctttgcactgtattt

SEQ ID NO: 102491 - DNA, 15 bp, Homo sapiens
tctttgcactgtatt

SEQ ID NO: 102492 - DNA, 15 bp, Homo sapiens
ctctttgcactgtat

SEQ ID NO: 102493 - DNA, 15 bp, Homo sapiens
cctctttgcactgta

SEQ ID NO: 102494 - DNA, 15 bp, Homo sapiens
ccctctttgcactgt

SEQ ID NO: 102495 - DNA, 15 bp, Homo sapiens
accctctttgcactg

SEQ ID NO: 102496 - DNA, 15 bp, Homo sapiens
taccctctttgcact

SEQ ID NO: 102497 - DNA, 15 bp, Homo sapiens
ctaccctctttgcac

SEQ ID NO: 102498 - DNA, 15 bp, Homo sapiens
cctaccctctttgca

SEQ ID NO: 102499 - DNA, 15 bp, Homo sapiens
acctaccctctttgc

SEQ ID NO: 102500 - DNA, 15 bp, Homo sapiens
aacctaccctctttg

SEQ ID NO: 102501 - DNA, 15 bp, Homo sapiens
aaacctaccctcttt

SEQ ID NO: 102502 - DNA, 15 bp, Homo sapiens
caaacctaccctctt

SEQ ID NO: 102503 - DNA, 15 bp, Homo sapiens
gcaaacctaccctct

SEQ ID NO: 102504 - DNA, 15 bp, Homo sapiens
agcaaacctaccctc

SEQ ID NO: 102505 - DNA, 15 bp, Homo sapiens
aagcaaacctaccct

SEQ ID NO: 102506 - DNA, 15 bp, Homo sapiens
taagcaaacctaccc

SEQ ID NO: 102507 - DNA, 15 bp, Homo sapiens
ttaagcaaacctacc

SEQ ID NO: 102508 - DNA, 15 bp, Homo sapiens
gttaagcaaacctac

SEQ ID NO: 102509 - DNA, 15 bp, Homo sapiens
tgttaagcaaaccta

SEQ ID NO: 102510 - DNA, 15 bp, Homo sapiens
ttgttaagcaaacct

SEQ ID NO: 102511 - DNA, 15 bp, Homo sapiens
tttgttaagcaaacc

SEQ ID NO: 102512 - DNA, 15 bp, Homo sapiens
ttttgttaagcaaac

SEQ ID NO: 102513 - DNA, 15 bp, Homo sapiens
tttttgttaagcaaa

SEQ ID NO: 102514 - DNA, 15 bp, Homo sapiens
ttttttgttaagcaa

SEQ ID NO: 102515 - DNA, 15 bp, Homo sapiens
cttttttgttaagca

SEQ ID NO: 102516 - DNA, 15 bp, Homo sapiens
tcttttttgttaagc

SEQ ID NO: 102517 - DNA, 15 bp, Homo sapiens
ttcttttttgttaag

SEQ ID NO: 102518 - DNA, 15 bp, Homo sapiens
tttcttttttgttaa

SEQ ID NO: 102519 - DNA, 15 bp, Homo sapiens
ttttcttttttgtta

SEQ ID NO: 102520 - DNA, 15 bp, Homo sapiens
cttttcttttttgtt

SEQ ID NO: 102521 - DNA, 15 bp, Homo sapiens
ccttttcttttttgt

SEQ ID NO: 102522 - DNA, 15 bp, Homo sapiens
cccttttcttttttg

SEQ ID NO: 102523 - DNA, 15 bp, Homo sapiens
tcccttttctttttt

SEQ ID NO: 102524 - DNA, 15 bp, Homo sapiens
ttcccttttcttttt

SEQ ID NO: 102525 - DNA, 15 bp, Homo sapiens
cttcccttttctttt

SEQ ID NO: 102526 - DNA, 15 bp, Homo sapiens
ccttcccttttcttt

SEQ ID NO: 102527 - DNA, 15 bp, Homo sapiens
cccttcccttttctt

SEQ ID NO: 102528 - DNA, 15 bp, Homo sapiens
ccccttcccttttct

SEQ ID NO: 102529 - DNA, 15 bp, Homo sapiens
cccccttcccttttc

SEQ ID NO: 102530 - DNA, 15 bp, Homo sapiens
acccccttccctttt

SEQ ID NO: 102531 - DNA, 15 bp, Homo sapiens
tacccccttcccttt

SEQ ID NO: 102532 - DNA, 15 bp, Homo sapiens
ctacccccttccctt

SEQ ID NO: 102533 - DNA, 15 bp, Homo sapiens
tctacccccttccct

SEQ ID NO: 102534 - DNA, 15 bp, Homo sapiens
atctacccccttccc

SEQ ID NO: 102535 - DNA, 15 bp, Homo sapiens
tatctacccccttcc

SEQ ID NO: 102536 - DNA, 15 bp, Homo sapiens
ctatctacccccttc

SEQ ID NO: 102537 - DNA, 15 bp, Homo sapiens
cctatctaccccctt

SEQ ID NO: 102538 - DNA, 15 bp, Homo sapiens
gcctatctaccccct

SEQ ID NO: 102539 - DNA, 15 bp, Homo sapiens
agcctatctaccccc

SEQ ID NO: 102540 - DNA, 15 bp, Homo sapiens
aagcctatctacccc

SEQ ID NO: 102541 - DNA, 15 bp, Homo sapiens
aaagcctatctaccc

SEQ ID NO: 102542 - DNA, 15 bp, Homo sapiens
aaaagcctatctacc

SEQ ID NO: 102543 - DNA, 15 bp, Homo sapiens
taaaagcctatctac

SEQ ID NO: 102544 - DNA, 15 bp, Homo sapiens
ttaaaagcctatcta

SEQ ID NO: 102545 - DNA, 15 bp, Homo sapiens
tttaaaagcctatct

SEQ ID NO: 102546 - DNA, 15 bp, Homo sapiens
ttttaaaagcctatc

SEQ ID NO: 102547 - DNA, 15 bp, Homo sapiens
tttttaaaagcctat

SEQ ID NO: 102548 - DNA, 15 bp, Homo sapiens
atttttaaaagccta

SEQ ID NO: 102549 - DNA, 15 bp, Homo sapiens
catttttaaaagcct

SEQ ID NO: 102550 - DNA, 15 bp, Homo sapiens
acatttttaaaagcc

SEQ ID NO: 102551 - DNA, 15 bp, Homo sapiens
gacatttttaaaagc

SEQ ID NO: 102552 - DNA, 15 bp, Homo sapiens
tgacatttttaaaag

SEQ ID NO: 102553 - DNA, 15 bp, Homo sapiens
atgacatttttaaaa

SEQ ID NO: 102554 - DNA, 15 bp, Homo sapiens
catgacatttttaaa

SEQ ID NO: 102555 - DNA, 15 bp, Homo sapiens
ccatgacatttttaa

SEQ ID NO: 102556 - DNA, 15 bp, Homo sapiens
accatgacattttta

SEQ ID NO: 102557 - DNA, 15 bp, Homo sapiens
taccatgacattttt

SEQ ID NO: 102558 - DNA, 15 bp, Homo sapiens
gtaccatgacatttt

SEQ ID NO: 102559 - DNA, 15 bp, Homo sapiens
ggtaccatgacattt

SEQ ID NO: 102560 - DNA, 15 bp, Homo sapiens
tggtaccatgacatt

SEQ ID NO: 102561 - DNA, 15 bp, Homo sapiens
atggtaccatgacat

SEQ ID NO: 102562 - DNA, 15 bp, Homo sapiens
catggtaccatgaca

SEQ ID NO: 102563 - DNA, 15 bp, Homo sapiens
acatggtaccatgac

SEQ ID NO: 102564 - DNA, 15 bp, Homo sapiens
cacatggtaccatga

SEQ ID NO: 102565 - DNA, 15 bp, Homo sapiens
ccacatggtaccatg

SEQ ID NO: 102566 - DNA, 15 bp, Homo sapiens
cccacatggtaccat

SEQ ID NO: 102567 - DNA, 15 bp, Homo sapiens
tcccacatggtacca

SEQ ID NO: 102568 - DNA, 15 bp, Homo sapiens
ttcccacatggtacc

SEQ ID NO: 102569 - DNA, 15 bp, Homo sapiens
gttcccacatggtac

SEQ ID NO: 102570 - DNA, 15 bp, Homo sapiens
agttcccacatggta

SEQ ID NO: 102571 - DNA, 15 bp, Homo sapiens
cagttcccacatggt

SEQ ID NO: 102572 - DNA, 15 bp, Homo sapiens
tcagttcccacatgg

SEQ ID NO: 102573 - DNA, 15 bp, Homo sapiens
ctcagttcccacatg

SEQ ID NO: 102574 - DNA, 15 bp, Homo sapiens
actcagttcccacat

SEQ ID NO: 102575 - DNA, 15 bp, Homo sapiens
cactcagttcccaca

SEQ ID NO: 102576 - DNA, 15 bp, Homo sapiens
ccactcagttcccac

SEQ ID NO: 102577 - DNA, 15 bp, Homo sapiens
tccactcagttccca

SEQ ID NO: 102578 - DNA, 15 bp, Homo sapiens
gtccactcagttccc

SEQ ID NO: 102579 - DNA, 15 bp, Homo sapiens
tgtccactcagttcc

SEQ ID NO: 102580 - DNA, 15 bp, Homo sapiens
ttgtccactcagttc

SEQ ID NO: 102581 - DNA, 15 bp, Homo sapiens
gttgtccactcagtt

SEQ ID NO: 102582 - DNA, 15 bp, Homo sapiens
agttgtccactcagt

SEQ ID NO: 102583 - DNA, 15 bp, Homo sapiens
cagttgtccactcag

SEQ ID NO: 102584 - DNA, 15 bp, Homo sapiens
ccagttgtccactca

SEQ ID NO: 102585 - DNA, 15 bp, Homo sapiens
tccagttgtccactc

SEQ ID NO: 102586 - DNA, 15 bp, Homo sapiens
atccagttgtccact

SEQ ID NO: 102587 - DNA, 15 bp, Homo sapiens
aatccagttgtccac

SEQ ID NO: 102588 - DNA, 15 bp, Homo sapiens
taatccagttgtcca

SEQ ID NO: 102589 - DNA, 15 bp, Homo sapiens
ttaatccagttgtcc

SEQ ID NO: 102590 - DNA, 15 bp, Homo sapiens
tttaatccagttgtc

SEQ ID NO: 102591 - DNA, 15 bp, Homo sapiens
ctttaatccagttgt

SEQ ID NO: 102592 - DNA, 15 bp, Homo sapiens
cctttaatccagttg

SEQ ID NO: 102593 - DNA, 15 bp, Homo sapiens
acctttaatccagtt

SEQ ID NO: 102594 - DNA, 15 bp, Homo sapiens
gacctttaatccagt

SEQ ID NO: 102595 - DNA, 15 bp, Homo sapiens
tgacctttaatccag

SEQ ID NO: 102596 - DNA, 15 bp, Homo sapiens
ctgacctttaatcca

SEQ ID NO: 102597 - DNA, 15 bp, Homo sapiens
tctgacctttaatcc

SEQ ID NO: 102598 - DNA, 15 bp, Homo sapiens
ttctgacctttaatc

SEQ ID NO: 102599 - DNA, 15 bp, Homo sapiens
tttctgacctttaat

SEQ ID NO: 102600 - DNA, 15 bp, Homo sapiens
atttctgacctttaa

SEQ ID NO: 102601 - DNA, 15 bp, Homo sapiens
catttctgaccttta

SEQ ID NO: 102602 - DNA, 15 bp, Homo sapiens
tcatttctgaccttt

SEQ ID NO: 102603 - DNA, 15 bp, Homo sapiens
ctcatttctgacctt

SEQ ID NO: 102604 - DNA, 15 bp, Homo sapiens
actcatttctgacct

SEQ ID NO: 102605 - DNA, 15 bp, Homo sapiens
tactcatttctgacc

SEQ ID NO: 102606 - DNA, 15 bp, Homo sapiens
ttactcatttctgac

SEQ ID NO: 102607 - DNA, 15 bp, Homo sapiens
tttactcatttctga

SEQ ID NO: 102608 - DNA, 15 bp, Homo sapiens
ttttactcatttctg

SEQ ID NO: 102609 - DNA, 15 bp, Homo sapiens
attttactcatttct

SEQ ID NO: 102610 - DNA, 15 bp, Homo sapiens
cattttactcatttc

SEQ ID NO: 102611 - DNA, 15 bp, Homo sapiens
acattttactcattt

SEQ ID NO: 102612 - DNA, 15 bp, Homo sapiens
cacattttactcatt

SEQ ID NO: 102613 - DNA, 15 bp, Homo sapiens
ccacattttactcat

SEQ ID NO: 102614 - DNA, 15 bp, Homo sapiens
gccacattttactca

SEQ ID NO: 102615 - DNA, 15 bp, Homo sapiens
tgccacattttactc

SEQ ID NO: 102616 - DNA, 15 bp, Homo sapiens
gtgccacattttact

SEQ ID NO: 102617 - DNA, 15 bp, Homo sapiens
agtgccacattttac

SEQ ID NO: 102618 - DNA, 15 bp, Homo sapiens
aagtgccacatttta

SEQ ID NO: 102619 - DNA, 15 bp, Homo sapiens
taagtgccacatttt

SEQ ID NO: 102620 - DNA, 15 bp, Homo sapiens
gtaagtgccacattt

SEQ ID NO: 102621 - DNA, 15 bp, Homo sapiens
tgtaagtgccacatt

SEQ ID NO: 102622 - DNA, 15 bp, Homo sapiens
atgtaagtgccacat

SEQ ID NO: 102623 - DNA, 15 bp, Homo sapiens
aatgtaagtgccaca

SEQ ID NO: 102624 - DNA, 15 bp, Homo sapiens
gaatgtaagtgccac

SEQ ID NO: 102625 - DNA, 15 bp, Homo sapiens
ggaatgtaagtgcca

SEQ ID NO: 102626 - DNA, 15 bp, Homo sapiens
tggaatgtaagtgcc

SEQ ID NO: 102627 - DNA, 15 bp, Homo sapiens
ctggaatgtaagtgc

SEQ ID NO: 102628 - DNA, 15 bp, Homo sapiens
cctggaatgtaagtg

SEQ ID NO: 102629 - DNA, 15 bp, Homo sapiens
tcctggaatgtaagt

SEQ ID NO: 102630 - DNA, 15 bp, Homo sapiens
ctcctggaatgtaag

SEQ ID NO: 102631 - DNA, 15 bp, Homo sapiens
tctcctggaatgtaa

SEQ ID NO: 102632 - DNA, 15 bp, Homo sapiens
gtctcctggaatgta

SEQ ID NO: 102633 - DNA, 15 bp, Homo sapiens
cgtctcctggaatgt

SEQ ID NO: 102634 - DNA, 15 bp, Homo sapiens
ccgtctcctggaatg

SEQ ID NO: 102635 - DNA, 15 bp, Homo sapiens
tccgtctcctggaat

SEQ ID NO: 102636 - DNA, 15 bp, Homo sapiens
atccgtctcctggaa

SEQ ID NO: 102637 - DNA, 15 bp, Homo sapiens
catccgtctcctgga

SEQ ID NO: 102638 - DNA, 15 bp, Homo sapiens
gcatccgtctcctgg

SEQ ID NO: 102639 - DNA, 15 bp, Homo sapiens
agcatccgtctcctg

SEQ ID NO: 102640 - DNA, 15 bp, Homo sapiens
gagcatccgtctcct

SEQ ID NO: 102641 - DNA, 15 bp, Homo sapiens
agagcatccgtctcc

SEQ ID NO: 102642 - DNA, 15 bp, Homo sapiens
cagagcatccgtctc

SEQ ID NO: 102643 - DNA, 15 bp, Homo sapiens
gcagagcatccgtct

SEQ ID NO: 102644 - DNA, 15 bp, Homo sapiens
agcagagcatccgtc

SEQ ID NO: 102645 - DNA, 15 bp, Homo sapiens
tagcagagcatccgt

SEQ ID NO: 102646 - DNA, 15 bp, Homo sapiens
ctagcagagcatccg

SEQ ID NO: 102647 - DNA, 15 bp, Homo sapiens
tctagcagagcatcc

SEQ ID NO: 102648 - DNA, 15 bp, Homo sapiens
ctctagcagagcatc

SEQ ID NO: 102649 - DNA, 15 bp, Homo sapiens
tctctagcagagcat

SEQ ID NO: 102650 - DNA, 15 bp, Homo sapiens
ttctctagcagagca

SEQ ID NO: 102651 - DNA, 15 bp, Homo sapiens
tttctctagcagagc

SEQ ID NO: 102652 - DNA, 15 bp, Homo sapiens
ttttctctagcagag

SEQ ID NO: 102653 - DNA, 15 bp, Homo sapiens
cttttctctagcaga

SEQ ID NO: 102654 - DNA, 15 bp, Homo sapiens
tcttttctctagcag

SEQ ID NO: 102655 - DNA, 15 bp, Homo sapiens
atcttttctctagca

SEQ ID NO: 102656 - DNA, 15 bp, Homo sapiens
catcttttctctagc

SEQ ID NO: 102657 - DNA, 15 bp, Homo sapiens
acatcttttctctag

SEQ ID NO: 102658 - DNA, 15 bp, Homo sapiens
gacatcttttctcta

SEQ ID NO: 102659 - DNA, 15 bp, Homo sapiens
tgacatcttttctct

SEQ ID NO: 102660 - DNA, 15 bp, Homo sapiens
gtgacatcttttctc

SEQ ID NO: 102661 - DNA, 15 bp, Homo sapiens
agtgacatcttttct

SEQ ID NO: 102662 - DNA, 15 bp, Homo sapiens
aagtgacatcttttc

SEQ ID NO: 102663 - DNA, 15 bp, Homo sapiens
gaagtgacatctttt

SEQ ID NO: 102664 - DNA, 15 bp, Homo sapiens
agaagtgacatcttt

SEQ ID NO: 102665 - DNA, 15 bp, Homo sapiens
gagaagtgacatctt

SEQ ID NO: 102666 - DNA, 15 bp, Homo sapiens
tgagaagtgacatct

SEQ ID NO: 102667 - DNA, 15 bp, Homo sapiens
ttgagaagtgacatc

SEQ ID NO: 102668 - DNA, 15 bp, Homo sapiens
tttgagaagtgacat

SEQ ID NO: 102669 - DNA, 15 bp, Homo sapiens
atttgagaagtgaca

SEQ ID NO: 102670 - DNA, 15 bp, Homo sapiens
tatttgagaagtgac

SEQ ID NO: 102671 - DNA, 15 bp, Homo sapiens
atatttgagaagtga

SEQ ID NO: 102672 - DNA, 15 bp, Homo sapiens
tatatttgagaagtg

SEQ ID NO: 102673 - DNA, 15 bp, Homo sapiens
ctatatttgagaagt

SEQ ID NO: 102674 - DNA, 15 bp, Homo sapiens
gctatatttgagaag

SEQ ID NO: 102675 - DNA, 15 bp, Homo sapiens
tgctatatttgagaa

SEQ ID NO: 102676 - DNA, 15 bp, Homo sapiens
ctgctatatttgaga

SEQ ID NO: 102677 - DNA, 15 bp, Homo sapiens
tctgctatatttgag

SEQ ID NO: 102678 - DNA, 15 bp, Homo sapiens
ctctgctatatttga

SEQ ID NO: 102679 - DNA, 15 bp, Homo sapiens
actctgctatatttg

SEQ ID NO: 102680 - DNA, 15 bp, Homo sapiens
cactctgctatattt

SEQ ID NO: 102681 - DNA, 15 bp, Homo sapiens
tcactctgctatatt

SEQ ID NO: 102682 - DNA, 15 bp, Homo sapiens
ctcactctgctatat

SEQ ID NO: 102683 - DNA, 15 bp, Homo sapiens
tctcactctgctata

SEQ ID NO: 102684 - DNA, 15 bp, Homo sapiens
ctctcactctgctat

SEQ ID NO: 102685 - DNA, 15 bp, Homo sapiens
tctctcactctgcta

SEQ ID NO: 102686 - DNA, 15 bp, Homo sapiens
gtctctcactctgct

SEQ ID NO: 102687 - DNA, 15 bp, Homo sapiens
tgtctctcactctgc

SEQ ID NO: 102688 - DNA, 15 bp, Homo sapiens
ctgtctctcactctg

SEQ ID NO: 102689 - DNA, 15 bp, Homo sapiens
tctgtctctcactct

SEQ ID NO: 102690 - DNA, 15 bp, Homo sapiens
ctctgtctctcactc

SEQ ID NO: 102691 - DNA, 15 bp, Homo sapiens
actctgtctctcact

SEQ ID NO: 102692 - DNA, 15 bp, Homo sapiens
cactctgtctctcac

SEQ ID NO: 102693 - DNA, 15 bp, Homo sapiens
tcactctgtctctca

SEQ ID NO: 102694 - DNA, 15 bp, Homo sapiens
ttcactctgtctctc

SEQ ID NO: 102695 - DNA, 15 bp, Homo sapiens
attcactctgtctct

SEQ ID NO: 102696 - DNA, 15 bp, Homo sapiens
cattcactctgtctc

SEQ ID NO: 102697 - DNA, 15 bp, Homo sapiens
tcattcactctgtct

SEQ ID NO: 102698 - DNA, 15 bp, Homo sapiens
ttcattcactctgtc

SEQ ID NO: 102699 - DNA, 15 bp, Homo sapiens
tttcattcactctgt

SEQ ID NO: 102700 - DNA, 15 bp, Homo sapiens
ttttcattcactctg

SEQ ID NO: 102701 - DNA, 15 bp, Homo sapiens
tttttcattcactct

SEQ ID NO: 102702 - DNA, 15 bp, Homo sapiens
atttttcattcactc

SEQ ID NO: 102703 - DNA, 15 bp, Homo sapiens
tatttttcattcact

SEQ ID NO: 102704 - DNA, 15 bp, Homo sapiens
atatttttcattcac

SEQ ID NO: 102705 - DNA, 15 bp, Homo sapiens
catatttttcattca

SEQ ID NO: 102706 - DNA, 15 bp, Homo sapiens
tcatatttttcattc

SEQ ID NO: 102707 - DNA, 15 bp, Homo sapiens
ttcatatttttcatt

SEQ ID NO: 102708 - DNA, 15 bp, Homo sapiens
tttcatatttttcat

SEQ ID NO: 102709 - DNA, 15 bp, Homo sapiens
ttttcatatttttca

SEQ ID NO: 102710 - DNA, 15 bp, Homo sapiens
cttttcatatttttc

SEQ ID NO: 102711 - DNA, 15 bp, Homo sapiens
gcttttcatattttt

SEQ ID NO: 102712 - DNA, 15 bp, Homo sapiens
agcttttcatatttt

SEQ ID NO: 102713 - DNA, 15 bp, Homo sapiens
aagcttttcatattt

SEQ ID NO: 102714 - DNA, 15 bp, Homo sapiens
taagcttttcatatt

SEQ ID NO: 102715 - DNA, 15 bp, Homo sapiens
ttaagcttttcatat

SEQ ID NO: 102716 - DNA, 15 bp, Homo sapiens
attaagcttttcata

SEQ ID NO: 102717 - DNA, 15 bp, Homo sapiens
aattaagcttttcat

SEQ ID NO: 102718 - DNA, 15 bp, Homo sapiens
aaattaagcttttca

SEQ ID NO: 102719 - DNA, 15 bp, Homo sapiens
aaaattaagcttttc

SEQ ID NO: 102720 - DNA, 15 bp, Homo sapiens
aaaaattaagctttt

SEQ ID NO: 102721 - DNA, 15 bp, Homo sapiens
aaaaaattaagcttt

SEQ ID NO: 102722 - DNA, 15 bp, Homo sapiens
aaaaaaattaagctt

SEQ ID NO: 102723 - DNA, 15 bp, Homo sapiens
gaaaaaaattaagct

SEQ ID NO: 102724 - DNA, 15 bp, Homo sapiens
ggaaaaaaattaagc

SEQ ID NO: 102725 - DNA, 15 bp, Homo sapiens
aggaaaaaaattaag

SEQ ID NO: 102726 - DNA, 15 bp, Homo sapiens
taggaaaaaaattaa

SEQ ID NO: 102727 - DNA, 15 bp, Homo sapiens
ttaggaaaaaaatta

SEQ ID NO: 102728 - DNA, 15 bp, Homo sapiens
attaggaaaaaaatt

SEQ ID NO: 102729 - DNA, 15 bp, Homo sapiens
cattaggaaaaaaat

SEQ ID NO: 102730 - DNA, 15 bp, Homo sapiens
acattaggaaaaaaa

SEQ ID NO: 102731 - DNA, 15 bp, Homo sapiens
tacattaggaaaaaa

SEQ ID NO: 102732 - DNA, 15 bp, Homo sapiens
ttacattaggaaaaa

SEQ ID NO: 102733 - DNA, 15 bp, Homo sapiens
cttacattaggaaaa

SEQ ID NO: 102734 - DNA, 15 bp, Homo sapiens
tcttacattaggaaa

SEQ ID NO: 102735 - DNA, 15 bp, Homo sapiens
ctcttacattaggaa

SEQ ID NO: 102736 - DNA, 15 bp, Homo sapiens
actcttacattagga

SEQ ID NO: 102737 - DNA, 15 bp, Homo sapiens
cactcttacattagg

SEQ ID NO: 102738 - DNA, 15 bp, Homo sapiens
tcactcttacattag

SEQ ID NO: 102739 - DNA, 15 bp, Homo sapiens
ttcactcttacatta

SEQ ID NO: 102740 - DNA, 15 bp, Homo sapiens
attcactcttacatt

SEQ ID NO: 102741 - DNA, 15 bp, Homo sapiens
tattcactcttacat

SEQ ID NO: 102742 - DNA, 15 bp, Homo sapiens
gtattcactcttaca

SEQ ID NO: 102743 - DNA, 15 bp, Homo sapiens
cgtattcactcttac

SEQ ID NO: 102744 - DNA, 15 bp, Homo sapiens
acgtattcactctta

SEQ ID NO: 102745 - DNA, 15 bp, Homo sapiens
tacgtattcactctt

SEQ ID NO: 102746 - DNA, 15 bp, Homo sapiens
atacgtattcactct

SEQ ID NO: 102747 - DNA, 15 bp, Homo sapiens
tatacgtattcactc

SEQ ID NO: 102748 - DNA, 15 bp, Homo sapiens
atatacgtattcact

SEQ ID NO: 102749 - DNA, 15 bp, Homo sapiens
tatatacgtattcac

SEQ ID NO: 102750 - DNA, 15 bp, Homo sapiens
atatatacgtattca

SEQ ID NO: 102751 - DNA, 15 bp, Homo sapiens
aatatatacgtattc

SEQ ID NO: 102752 - DNA, 15 bp, Homo sapiens
gaatatatacgtatt

SEQ ID NO: 102753 - DNA, 15 bp, Homo sapiens
agaatatatacgtat

SEQ ID NO: 102754 - DNA, 15 bp, Homo sapiens
aagaatatatacgta

SEQ ID NO: 102755 - DNA, 15 bp, Homo sapiens
caagaatatatacgt

SEQ ID NO: 102756 - DNA, 15 bp, Homo sapiens
tcaagaatatatacg

SEQ ID NO: 102757 - DNA, 15 bp, Homo sapiens
ttcaagaatatatac

SEQ ID NO: 102758 - DNA, 15 bp, Homo sapiens
tttcaagaatatata

SEQ ID NO: 102759 - DNA, 15 bp, Homo sapiens
atttcaagaatatat

SEQ ID NO: 102760 - DNA, 15 bp, Homo sapiens
tatttcaagaatata

SEQ ID NO: 102761 - DNA, 15 bp, Homo sapiens
atatttcaagaatat

SEQ ID NO: 102762 - DNA, 15 bp, Homo sapiens
catatttcaagaata

SEQ ID NO: 102763 - DNA, 15 bp, Homo sapiens
ccatatttcaagaat

SEQ ID NO: 102764 - DNA, 15 bp, Homo sapiens
tccatatttcaagaa

SEQ ID NO: 102765 - DNA, 15 bp, Homo sapiens
ttccatatttcaaga

SEQ ID NO: 102766 - DNA, 15 bp, Homo sapiens
tttccatatttcaag

SEQ ID NO: 102767 - DNA, 15 bp, Homo sapiens
ttttccatatttcaa

SEQ ID NO: 102768 - DNA, 15 bp, Homo sapiens
attttccatatttca

SEQ ID NO: 102769 - DNA, 15 bp, Homo sapiens
tattttccatatttc

SEQ ID NO: 102770 - DNA, 15 bp, Homo sapiens
ttattttccatattt

SEQ ID NO: 102771 - DNA, 15 bp, Homo sapiens
tttattttccatatt

SEQ ID NO: 102772 - DNA, 15 bp, Homo sapiens
ctttattttccatat

SEQ ID NO: 102773 - DNA, 15 bp, Homo sapiens
tctttattttccata

SEQ ID NO: 102774 - DNA, 15 bp, Homo sapiens
ttctttattttccat

SEQ ID NO: 102775 - DNA, 15 bp, Homo sapiens
tttctttattttcca

SEQ ID NO: 102776 - DNA, 15 bp, Homo sapiens
ttttctttattttcc

SEQ ID NO: 102777 - DNA, 15 bp, Homo sapiens
cttttctttattttc

SEQ ID NO: 102778 - DNA, 15 bp, Homo sapiens
acttttctttatttt

SEQ ID NO: 102779 - DNA, 15 bp, Homo sapiens
tacttttctttattt

SEQ ID NO: 102780 - DNA, 15 bp, Homo sapiens
atacttttctttatt

SEQ ID NO: 102781 - DNA, 15 bp, Homo sapiens
tatacttttctttat

SEQ ID NO: 102782 - DNA, 15 bp, Homo sapiens
ttatacttttcttta

SEQ ID NO: 102783 - DNA, 15 bp, Homo sapiens
tttatacttttcttt

SEQ ID NO: 102784 - DNA, 15 bp, Homo sapiens
ctttatacttttctt

SEQ ID NO: 102785 - DNA, 15 bp, Homo sapiens
gctttatacttttct

SEQ ID NO: 102786 - DNA, 15 bp, Homo sapiens
tgctttatacttttc

SEQ ID NO: 102787 - DNA, 15 bp, Homo sapiens
ttgctttatactttt

SEQ ID NO: 102788 - DNA, 15 bp, Homo sapiens
tttgctttatacttt

SEQ ID NO: 102789 - DNA, 15 bp, Homo sapiens
gtttgctttatactt

SEQ ID NO: 102790 - DNA, 15 bp, Homo sapiens
agtttgctttatact

SEQ ID NO: 102791 - DNA, 15 bp, Homo sapiens
gagtttgctttatac

SEQ ID NO: 102792 - DNA, 15 bp, Homo sapiens
agagtttgctttata

SEQ ID NO: 102793 - DNA, 15 bp, Homo sapiens
tagagtttgctttat

SEQ ID NO: 102794 - DNA, 15 bp, Homo sapiens
ttagagtttgcttta

SEQ ID NO: 102795 - DNA, 15 bp, Homo sapiens
cttagagtttgcttt

SEQ ID NO: 102796 - DNA, 15 bp, Homo sapiens
tcttagagtttgctt

SEQ ID NO: 102797 - DNA, 15 bp, Homo sapiens
atcttagagtttgct

SEQ ID NO: 102798 - DNA, 15 bp, Homo sapiens
tatcttagagtttgc

SEQ ID NO: 102799 - DNA, 15 bp, Homo sapiens
ttatcttagagtttg

SEQ ID NO: 102800 - DNA, 15 bp, Homo sapiens
tttatcttagagttt

SEQ ID NO: 102801 - DNA, 15 bp, Homo sapiens
gtttatcttagagtt

SEQ ID NO: 102802 - DNA, 15 bp, Homo sapiens
tgtttatcttagagt

SEQ ID NO: 102803 - DNA, 15 bp, Homo sapiens
atgtttatcttagag

SEQ ID NO: 102804 - DNA, 15 bp, Homo sapiens
aatgtttatcttaga

SEQ ID NO: 102805 - DNA, 15 bp, Homo sapiens
aaatgtttatcttag

SEQ ID NO: 102806 - DNA, 15 bp, Homo sapiens
aaaatgtttatctta

SEQ ID NO: 102807 - DNA, 15 bp, Homo sapiens
taaaatgtttatctt

SEQ ID NO: 102808 - DNA, 15 bp, Homo sapiens
ttaaaatgtttatct

SEQ ID NO: 102809 - DNA, 15 bp, Homo sapiens
tttaaaatgtttatc

SEQ ID NO: 102810 - DNA, 15 bp, Homo sapiens
ttttaaaatgtttat

SEQ ID NO: 102811 - DNA, 15 bp, Homo sapiens
gttttaaaatgttta

SEQ ID NO: 102812 - DNA, 15 bp, Homo sapiens
tgttttaaaatgttt

SEQ ID NO: 102813 - DNA, 15 bp, Homo sapiens
ctgttttaaaatgtt

SEQ ID NO: 102814 - DNA, 15 bp, Homo sapiens
actgttttaaaatgt

SEQ ID NO: 102815 - DNA, 15 bp, Homo sapiens
aactgttttaaaatg

SEQ ID NO: 102816 - DNA, 15 bp, Homo sapiens
aaactgttttaaaat

SEQ ID NO: 102817 - DNA, 15 bp, Homo sapiens
caaactgttttaaaa

SEQ ID NO: 102818 - DNA, 15 bp, Homo sapiens
acaaactgttttaaa

SEQ ID NO: 102819 - DNA, 15 bp, Homo sapiens
tacaaactgttttaa

SEQ ID NO: 102820 - DNA, 15 bp, Homo sapiens
ctacaaactgtttta

SEQ ID NO: 102821 - DNA, 15 bp, Homo sapiens
tctacaaactgtttt

SEQ ID NO: 102822 - DNA, 15 bp, Homo sapiens
atctacaaactgttt

SEQ ID NO: 102823 - DNA, 15 bp, Homo sapiens
aatctacaaactgtt

SEQ ID NO: 102824 - DNA, 15 bp, Homo sapiens
aaatctacaaactgt

SEQ ID NO: 102825 - DNA, 15 bp, Homo sapiens
gaaatctacaaactg

SEQ ID NO: 102826 - DNA, 15 bp, Homo sapiens
agaaatctacaaact

SEQ ID NO: 102827 - DNA, 15 bp, Homo sapiens
aagaaatctacaaac

SEQ ID NO: 102828 - DNA, 15 bp, Homo sapiens
gaagaaatctacaaa

SEQ ID NO: 102829 - DNA, 15 bp, Homo sapiens
ggaagaaatctacaa

SEQ ID NO: 102830 - DNA, 15 bp, Homo sapiens
aggaagaaatctaca

SEQ ID NO: 102831 - DNA, 15 bp, Homo sapiens
taggaagaaatctac

SEQ ID NO: 102832 - DNA, 15 bp, Homo sapiens
ttaggaagaaatcta

SEQ ID NO: 102833 - DNA, 15 bp, Homo sapiens
attaggaagaaatct

SEQ ID NO: 102834 - DNA, 15 bp, Homo sapiens
aattaggaagaaatc

SEQ ID NO: 102835 - DNA, 15 bp, Homo sapiens
taattaggaagaaat

SEQ ID NO: 102836 - DNA, 15 bp, Homo sapiens
ataattaggaagaaa

SEQ ID NO: 102837 - DNA, 15 bp, Homo sapiens
aataattaggaagaa

SEQ ID NO: 102838 - DNA, 15 bp, Homo sapiens
taataattaggaaga

SEQ ID NO: 102839 - DNA, 15 bp, Homo sapiens
ataataattaggaag

SEQ ID NO: 102840 - DNA, 15 bp, Homo sapiens
gataataattaggaa

SEQ ID NO: 102841 - DNA, 15 bp, Homo sapiens
agataataattagga

SEQ ID NO: 102842 - DNA, 15 bp, Homo sapiens
aagataataattagg

SEQ ID NO: 102843 - DNA, 15 bp, Homo sapiens
aaagataataattag

SEQ ID NO: 102844 - DNA, 15 bp, Homo sapiens
aaaagataataatta

SEQ ID NO: 102845 - DNA, 15 bp, Homo sapiens
cataaaagataataa

SEQ ID NO: 102846 - DNA, 15 bp, Homo sapiens
acataaaagataata

SEQ ID NO: 102847 - DNA, 15 bp, Homo sapiens
tacataaaagataat

SEQ ID NO: 102848 - DNA, 15 bp, Homo sapiens
atacataaaagataa

SEQ ID NO: 102849 - DNA, 15 bp, Homo sapiens
catacataaaagata

SEQ ID NO: 102850 - DNA, 15 bp, Homo sapiens
gcatacataaaagat

SEQ ID NO: 102851 - DNA, 15 bp, Homo sapiens
tgcatacataaaaga

SEQ ID NO: 102852 - DNA, 15 bp, Homo sapiens
atgcatacataaaag

SEQ ID NO: 102853 - DNA, 15 bp, Homo sapiens
tatgcatacataaaa

SEQ ID NO: 102854 - DNA, 15 bp, Homo sapiens
gtatgcatacataaa

SEQ ID NO: 102855 - DNA, 15 bp, Homo sapiens
agtatgcatacataa

SEQ ID NO: 102856 - DNA, 15 bp, Homo sapiens
tagtatgcatacata

SEQ ID NO: 102857 - DNA, 15 bp, Homo sapiens
ctagtatgcatacat

SEQ ID NO: 102858 - DNA, 15 bp, Homo sapiens
tctagtatgcataca

SEQ ID NO: 102859 - DNA, 15 bp, Homo sapiens
ttctagtatgcatac

SEQ ID NO: 102860 - DNA, 15 bp, Homo sapiens
cttctagtatgcata

SEQ ID NO: 102861 - DNA, 15 bp, Homo sapiens
ccttctagtatgcat

SEQ ID NO: 102862 - DNA, 15 bp, Homo sapiens
accttctagtatgca

SEQ ID NO: 102863 - DNA, 15 bp, Homo sapiens
taccttctagtatgc

SEQ ID NO: 102864 - DNA, 15 bp, Homo sapiens
ctaccttctagtatg

SEQ ID NO: 102865 - DNA, 15 bp, Homo sapiens
actaccttctagtat

SEQ ID NO: 102866 - DNA, 15 bp, Homo sapiens
tactaccttctagta

SEQ ID NO: 102867 - DNA, 15 bp, Homo sapiens
atactaccttctagt

SEQ ID NO: 102868 - DNA, 15 bp, Homo sapiens
tatactaccttctag

SEQ ID NO: 102869 - DNA, 15 bp, Homo sapiens
atatactaccttcta

SEQ ID NO: 102870 - DNA, 15 bp, Homo sapiens
aatatactaccttct

SEQ ID NO: 102871 - DNA, 15 bp, Homo sapiens
caatatactaccttc

SEQ ID NO: 102872 - DNA, 15 bp, Homo sapiens
ccaatatactacctt

SEQ ID NO: 102873 - DNA, 15 bp, Homo sapiens
tccaatatactacct

SEQ ID NO: 102874 - DNA, 15 bp, Homo sapiens
atccaatatactacc

SEQ ID NO: 102875 - DNA, 15 bp, Homo sapiens
gatccaatatactac

SEQ ID NO: 102876 - DNA, 15 bp, Homo sapiens
tgatccaatatacta

SEQ ID NO: 102877 - DNA, 15 bp, Homo sapiens
ttgatccaatatact

SEQ ID NO: 102878 - DNA, 15 bp, Homo sapiens
tttgatccaatatac

SEQ ID NO: 102879 - DNA, 15 bp, Homo sapiens
ctttgatccaatata

SEQ ID NO: 102880 - DNA, 15 bp, Homo sapiens
cctttgatccaatat

SEQ ID NO: 102881 - DNA, 15 bp, Homo sapiens
gcctttgatccaata

SEQ ID NO: 102882 - DNA, 15 bp, Homo sapiens
agcctttgatccaat

SEQ ID NO: 102883 - DNA, 15 bp, Homo sapiens
aagcctttgatccaa

SEQ ID NO: 102884 - DNA, 15 bp, Homo sapiens
aaagcctttgatcca

SEQ ID NO: 102885 - DNA, 15 bp, Homo sapiens
caaagcctttgatcc

SEQ ID NO: 102886 - DNA, 15 bp, Homo sapiens
ccaaagcctttgatc

SEQ ID NO: 102887 - DNA, 15 bp, Homo sapiens
tccaaagcctttgat

SEQ ID NO: 102888 - DNA, 15 bp, Homo sapiens
ctccaaagcctttga

SEQ ID NO: 102889 - DNA, 15 bp, Homo sapiens
actccaaagcctttg

SEQ ID NO: 102890 - DNA, 15 bp, Homo sapiens
gactccaaagccttt

SEQ ID NO: 102891 - DNA, 15 bp, Homo sapiens
agactccaaagcctt

SEQ ID NO: 102892 - DNA, 15 bp, Homo sapiens
aagactccaaagcct

SEQ ID NO: 102893 - DNA, 15 bp, Homo sapiens
aaagactccaaagcc

SEQ ID NO: 102894 - DNA, 15 bp, Homo sapiens
aaaagactccaaagc

SEQ ID NO: 102895 - DNA, 15 bp, Homo sapiens
taaaagactccaaag

SEQ ID NO: 102896 - DNA, 15 bp, Homo sapiens
ataaaagactccaaa

SEQ ID NO: 102897 - DNA, 15 bp, Homo sapiens
aataaaagactccaa

SEQ ID NO: 102898 - DNA, 15 bp, Homo sapiens
aaataaaagactcca

SEQ ID NO: 102899 - DNA, 15 bp, Homo sapiens
taaataaaagactcc

SEQ ID NO: 102900 - DNA, 15 bp, Homo sapiens
gtaaataaaagactc

SEQ ID NO: 102901 - DNA, 15 bp, Homo sapiens
agtaaataaaagact

SEQ ID NO: 102902 - DNA, 15 bp, Homo sapiens
aagtaaataaaagac

SEQ ID NO: 102903 - DNA, 15 bp, Homo sapiens
taagtaaataaaaga

SEQ ID NO: 102904 - DNA, 15 bp, Homo sapiens
ataagtaaataaaag

SEQ ID NO: 102905 - DNA, 15 bp, Homo sapiens
aataagtaaataaaa

SEQ ID NO: 102906 - DNA, 15 bp, Homo sapiens
aaataagtaaataaa

SEQ ID NO: 102907 - DNA, 15 bp, Homo sapiens
taaataagtaaataa

SEQ ID NO: 102908 - DNA, 15 bp, Homo sapiens
ataaataagtaaata

SEQ ID NO: 102909 - DNA, 15 bp, Homo sapiens
gataaataagtaaat

SEQ ID NO: 102910 - DNA, 15 bp, Homo sapiens
agataaataagtaaa

SEQ ID NO: 102911 - DNA, 15 bp, Homo sapiens
aagataaataagtaa

SEQ ID NO: 102912 - DNA, 15 bp, Homo sapiens
aaagataaataagta

SEQ ID NO: 102913 - DNA, 15 bp, Homo sapiens
aaaagataaataagt

SEQ ID NO: 102914 - DNA, 15 bp, Homo sapiens
aaaaagataaataag

SEQ ID NO: 102915 - DNA, 15 bp, Homo sapiens
taaaaagataaataa

SEQ ID NO: 102916 - DNA, 15 bp, Homo sapiens
ataaaaagataaata

SEQ ID NO: 102917 - DNA, 15 bp, Homo sapiens
aataaaaagataaat

SEQ ID NO: 102918 - DNA, 15 bp, Homo sapiens
aaataaaaagataaa

SEQ ID NO: 102919 - DNA, 15 bp, Homo sapiens
caaataaaaagataa

SEQ ID NO: 102920 - DNA, 15 bp, Homo sapiens
tcaaataaaaagata

SEQ ID NO: 102921 - DNA, 15 bp, Homo sapiens
ctcaaataaaaagat

SEQ ID NO: 102922 - DNA, 15 bp, Homo sapiens
tctcaaataaaaaga

SEQ ID NO: 102923 - DNA, 15 bp, Homo sapiens
atctcaaataaaaag

SEQ ID NO: 102924 - DNA, 15 bp, Homo sapiens
catctcaaataaaaa

SEQ ID NO: 102925 - DNA, 15 bp, Homo sapiens
ttccatctcaaataa

SEQ ID NO: 102926 - DNA, 15 bp, Homo sapiens
attccatctcaaata

SEQ ID NO: 102927 - DNA, 15 bp, Homo sapiens
gattccatctcaaat

SEQ ID NO: 102928 - DNA, 15 bp, Homo sapiens
agattccatctcaaa

SEQ ID NO: 102929 - DNA, 15 bp, Homo sapiens
aagattccatctcaa

SEQ ID NO: 102930 - DNA, 15 bp, Homo sapiens
caagattccatctca

SEQ ID NO: 102931 - DNA, 15 bp, Homo sapiens
gcaagattccatctc

SEQ ID NO: 102932 - DNA, 15 bp, Homo sapiens
agcaagattccatct

SEQ ID NO: 102933 - DNA, 15 bp, Homo sapiens
tagcaagattccatc

SEQ ID NO: 102934 - DNA, 15 bp, Homo sapiens
atagcaagattccat

SEQ ID NO: 102935 - DNA, 15 bp, Homo sapiens
catagcaagattcca

SEQ ID NO: 102936 - DNA, 15 bp, Homo sapiens
acatagcaagattcc

SEQ ID NO: 102937 - DNA, 15 bp, Homo sapiens
aacatagcaagattc

SEQ ID NO: 102938 - DNA, 15 bp, Homo sapiens
caacatagcaagatt

SEQ ID NO: 102939 - DNA, 15 bp, Homo sapiens
gcaacatagcaagat

SEQ ID NO: 102940 - DNA, 15 bp, Homo sapiens
ctgggcaacatagca

SEQ ID NO: 102941 - DNA, 15 bp, Homo sapiens
aattgcactccagcc

SEQ ID NO: 102942 - DNA, 15 bp, Homo sapiens
caattgcactccagc

SEQ ID NO: 102943 - DNA, 15 bp, Homo sapiens
gcaattgcactccag

SEQ ID NO: 102944 - DNA, 15 bp, Homo sapiens
tgcaattgcactcca

SEQ ID NO: 102945 - DNA, 15 bp, Homo sapiens
atgcaattgcactcc

SEQ ID NO: 102946 - DNA, 15 bp, Homo sapiens
catgcaattgcactc

SEQ ID NO: 102947 - DNA, 15 bp, Homo sapiens
tcatgcaattgcact

SEQ ID NO: 102948 - DNA, 15 bp, Homo sapiens
atcatgcaattgcac

SEQ ID NO: 102949 - DNA, 15 bp, Homo sapiens
aatcatgcaattgca

SEQ ID NO: 102950 - DNA, 15 bp, Homo sapiens
aaatcatgcaattgc

SEQ ID NO: 102951 - DNA, 15 bp, Homo sapiens
aaaatcatgcaattg

SEQ ID NO: 102952 - DNA, 15 bp, Homo sapiens
caaaatcatgcaatt

SEQ ID NO: 102953 - DNA, 15 bp, Homo sapiens
ccaaaatcatgcaat

SEQ ID NO: 102954 - DNA, 15 bp, Homo sapiens
gccaaaatcatgcaa

SEQ ID NO: 102955 - DNA, 15 bp, Homo sapiens
agccaaaatcatgca

SEQ ID NO: 102956 - DNA, 15 bp, Homo sapiens
gagccaaaatcatgc

SEQ ID NO: 102957 - DNA, 15 bp, Homo sapiens
tgagccaaaatcatg

SEQ ID NO: 102958 - DNA, 15 bp, Homo sapiens
gtgagccaaaatcat

SEQ ID NO: 102959 - DNA, 15 bp, Homo sapiens
agtgagccaaaatca

SEQ ID NO: 102960 - DNA, 15 bp, Homo sapiens
cagtgagccaaaatc

SEQ ID NO: 102961 - DNA, 15 bp, Homo sapiens
gcagtgagccaaaat

SEQ ID NO: 102962 - DNA, 15 bp, Homo sapiens
tgcagtgagccaaaa

SEQ ID NO: 102963 - DNA, 15 bp, Homo sapiens
ttgcagtgagccaaa

SEQ ID NO: 102964 - DNA, 15 bp, Homo sapiens
aggaggtggaggttg

SEQ ID NO: 102965 - DNA, 15 bp, Homo sapiens
caggaggtggaggtt

SEQ ID NO: 102966 - DNA, 15 bp, Homo sapiens
tcaggaggtggaggt

SEQ ID NO: 102967 - DNA, 15 bp, Homo sapiens
ctcaggaggtggagg

SEQ ID NO: 102968 - DNA, 15 bp, Homo sapiens
actcaggaggtggag

SEQ ID NO: 102969 - DNA, 15 bp, Homo sapiens
aactcaggaggtgga

SEQ ID NO: 102970 - DNA, 15 bp, Homo sapiens
gaactcaggaggtgg

SEQ ID NO: 102971 - DNA, 15 bp, Homo sapiens
tgaactcaggaggtg

SEQ ID NO: 102972 - DNA, 15 bp, Homo sapiens
cttgaactcaggagg

SEQ ID NO: 102973 - DNA, 15 bp, Homo sapiens
tgcttgaactcagga

SEQ ID NO: 102974 - DNA, 15 bp, Homo sapiens
ttgcttgaactcagg

SEQ ID NO: 102975 - DNA, 15 bp, Homo sapiens
attgcttgaactcag

SEQ ID NO: 102976 - DNA, 15 bp, Homo sapiens
aattgcttgaactca

SEQ ID NO: 102977 - DNA, 15 bp, Homo sapiens
gaattgcttgaactc

SEQ ID NO: 102978 - DNA, 15 bp, Homo sapiens
agaattgcttgaact

SEQ ID NO: 102979 - DNA, 15 bp, Homo sapiens
gaggcatgagaattg

SEQ ID NO: 102980 - DNA, 15 bp, Homo sapiens
tgaggcatgagaatt

SEQ ID NO: 102981 - DNA, 15 bp, Homo sapiens
gatcccagctactca

SEQ ID NO: 102982 - DNA, 15 bp, Homo sapiens
tgatcccagctactc

SEQ ID NO: 102983 - DNA, 15 bp, Homo sapiens
gtgatcccagctact

SEQ ID NO: 102984 - DNA, 15 bp, Homo sapiens
cctgtgatcccagct

SEQ ID NO: 102985 - DNA, 15 bp, Homo sapiens
gcctgtgatcccagc

SEQ ID NO: 102986 - DNA, 15 bp, Homo sapiens
cgcctgtgatcccag

SEQ ID NO: 102987 - DNA, 15 bp, Homo sapiens
acgcctgtgatccca

SEQ ID NO: 102988 - DNA, 15 bp, Homo sapiens
cacgcctgtgatccc

SEQ ID NO: 102989 - DNA, 15 bp, Homo sapiens
acacgcctgtgatcc

SEQ ID NO: 102990 - DNA, 15 bp, Homo sapiens
cacacgcctgtgatc

SEQ ID NO: 102991 - DNA, 15 bp, Homo sapiens
gcacacgcctgtgat

SEQ ID NO: 102992 - DNA, 15 bp, Homo sapiens
ggcacacgcctgtga

SEQ ID NO: 102993 - DNA, 15 bp, Homo sapiens
tggcacacgcctgtg

SEQ ID NO: 102994 - DNA, 15 bp, Homo sapiens
ggtagtggcacacgc

SEQ ID NO: 102995 - DNA, 15 bp, Homo sapiens
gggtagtggcacacg

SEQ ID NO: 102996 - DNA, 15 bp, Homo sapiens
ggggtagtggcacac

SEQ ID NO: 102997 - DNA, 15 bp, Homo sapiens
tggggtagtggcaca

SEQ ID NO: 102998 - DNA, 15 bp, Homo sapiens
ctggggtagtggcac

SEQ ID NO: 102999 - DNA, 15 bp, Homo sapiens
gctggggtagtggca

SEQ ID NO: 103000 - DNA, 15 bp, Homo sapiens
agctggggtagtggc

SEQ ID NO: 103001 - DNA, 15 bp, Homo sapiens
tagctggggtagtgg

SEQ ID NO: 103002 - DNA, 15 bp, Homo sapiens
ttagctggggtagtg

SEQ ID NO: 103003 - DNA, 15 bp, Homo sapiens
attagctggggtagt

SEQ ID NO: 103004 - DNA, 15 bp, Homo sapiens
aattagctggggtag

SEQ ID NO: 103005 - DNA, 15 bp, Homo sapiens
aaattagctggggta

SEQ ID NO: 103006 - DNA, 15 bp, Homo sapiens
aaaattagctggggt

SEQ ID NO: 103007 - DNA, 15 bp, Homo sapiens
caaaattagctgggg

SEQ ID NO: 103008 - DNA, 15 bp, Homo sapiens
acaaaattagctggg

SEQ ID NO: 103009 - DNA, 15 bp, Homo sapiens
tacaaaattagctgg

SEQ ID NO: 103010 - DNA, 15 bp, Homo sapiens
atacaaaattagctg

SEQ ID NO: 103011 - DNA, 15 bp, Homo sapiens
aatacaaaattagct

SEQ ID NO: 103012 - DNA, 15 bp, Homo sapiens
gacatggtaaaaccc

SEQ ID NO: 103013 - DNA, 15 bp, Homo sapiens
cgacatggtaaaacc

SEQ ID NO: 103014 - DNA, 15 bp, Homo sapiens
ccgacatggtaaaac

SEQ ID NO: 103015 - DNA, 15 bp, Homo sapiens
gccgacatggtaaaa

SEQ ID NO: 103016 - DNA, 15 bp, Homo sapiens
ggccgacatggtaaa

SEQ ID NO: 103017 - DNA, 15 bp, Homo sapiens
tggccgacatggtaa

SEQ ID NO: 103018 - DNA, 15 bp, Homo sapiens
ctggccgacatggta

SEQ ID NO: 103019 - DNA, 15 bp, Homo sapiens
cctggccgacatggt

SEQ ID NO: 103020 - DNA, 15 bp, Homo sapiens
gcctggccgacatgg

SEQ ID NO: 103021 - DNA, 15 bp, Homo sapiens
agcctggccgacatg

SEQ ID NO: 103022 - DNA, 15 bp, Homo sapiens
cagcctggccgacat

SEQ ID NO: 103023 - DNA, 15 bp, Homo sapiens
ccagcctggccgaca

SEQ ID NO: 103024 - DNA, 15 bp, Homo sapiens
cccagcctggccgac

SEQ ID NO: 103025 - DNA, 15 bp, Homo sapiens
gcccagcctggccga

SEQ ID NO: 103026 - DNA, 15 bp, Homo sapiens
agcccagcctggccg

SEQ ID NO: 103027 - DNA, 15 bp, Homo sapiens
gagcccagcctggcc

SEQ ID NO: 103028 - DNA, 15 bp, Homo sapiens
cgagcccagcctggc

SEQ ID NO: 103029 - DNA, 15 bp, Homo sapiens
tcgagcccagcctgg

SEQ ID NO: 103030 - DNA, 15 bp, Homo sapiens
ttcgagcccagcctg

SEQ ID NO: 103031 - DNA, 15 bp, Homo sapiens
gttcgagcccagcct

SEQ ID NO: 103032 - DNA, 15 bp, Homo sapiens
agttcgagcccagcc

SEQ ID NO: 103033 - DNA, 15 bp, Homo sapiens
gagttcgagcccagc

SEQ ID NO: 103034 - DNA, 15 bp, Homo sapiens
ggagttcgagcccag

SEQ ID NO: 103035 - DNA, 15 bp, Homo sapiens
aggagttcgagccca

SEQ ID NO: 103036 - DNA, 15 bp, Homo sapiens
caggagttcgagccc

SEQ ID NO: 103037 - DNA, 15 bp, Homo sapiens
tcaggagttcgagcc

SEQ ID NO: 103038 - DNA, 15 bp, Homo sapiens
gtcaggagttcgagc

SEQ ID NO: 103039 - DNA, 15 bp, Homo sapiens
tgtcaggagttcgag

SEQ ID NO: 103040 - DNA, 15 bp, Homo sapiens
atgtcaggagttcga

SEQ ID NO: 103041 - DNA, 15 bp, Homo sapiens
gatgtcaggagttcg

SEQ ID NO: 103042 - DNA, 15 bp, Homo sapiens
tgatgtcaggagttc

SEQ ID NO: 103043 - DNA, 15 bp, Homo sapiens
ctgatgtcaggagtt

SEQ ID NO: 103044 - DNA, 15 bp, Homo sapiens
cctgatgtcaggagt

SEQ ID NO: 103045 - DNA, 15 bp, Homo sapiens
acctgatgtcaggag

SEQ ID NO: 103046 - DNA, 15 bp, Homo sapiens
cacctgatgtcagga

SEQ ID NO: 103047 - DNA, 15 bp, Homo sapiens
tcacctgatgtcagg

SEQ ID NO: 103048 - DNA, 15 bp, Homo sapiens
atcacctgatgtcag

SEQ ID NO: 103049 - DNA, 15 bp, Homo sapiens
gatcacctgatgtca

SEQ ID NO: 103050 - DNA, 15 bp, Homo sapiens
ggatcacctgatgtc

SEQ ID NO: 103051 - DNA, 15 bp, Homo sapiens
tggatcacctgatgt

SEQ ID NO: 103052 - DNA, 15 bp, Homo sapiens
gtggatcacctgatg

SEQ ID NO: 103053 - DNA, 15 bp, Homo sapiens
ggtggatcacctgat

SEQ ID NO: 103054 - DNA, 15 bp, Homo sapiens
agcgggtggatcacc

SEQ ID NO: 103055 - DNA, 15 bp, Homo sapiens
aagcgggtggatcac

SEQ ID NO: 103056 - DNA, 15 bp, Homo sapiens
gaagcgggtggatca

SEQ ID NO: 103057 - DNA, 15 bp, Homo sapiens
cgaagcgggtggatc

SEQ ID NO: 103058 - DNA, 15 bp, Homo sapiens
ccgaagcgggtggat

SEQ ID NO: 103059 - DNA, 15 bp, Homo sapiens
gccgaagcgggtgga

SEQ ID NO: 103060 - DNA, 15 bp, Homo sapiens
ggccgaagcgggtgg

SEQ ID NO: 103061 - DNA, 15 bp, Homo sapiens
aggccgaagcgggtg

SEQ ID NO: 103062 - DNA, 15 bp, Homo sapiens
gaggccgaagcgggt

SEQ ID NO: 103063 - DNA, 15 bp, Homo sapiens
ggaggccgaagcggg

SEQ ID NO: 103064 - DNA, 15 bp, Homo sapiens
gggaggccgaagcgg

SEQ ID NO: 103065 - DNA, 15 bp, Homo sapiens
tgggaggccgaagcg

SEQ ID NO: 103066 - DNA, 15 bp, Homo sapiens
ttgggaggccgaagc

SEQ ID NO: 103067 - DNA, 15 bp, Homo sapiens
attgggaggccgaag

SEQ ID NO: 103068 - DNA, 15 bp, Homo sapiens
cattgggaggccgaa

SEQ ID NO: 103069 - DNA, 15 bp, Homo sapiens
acattgggaggccga

SEQ ID NO: 103070 - DNA, 15 bp, Homo sapiens
cacattgggaggccg

SEQ ID NO: 103071 - DNA, 15 bp, Homo sapiens
gcacattgggaggcc

SEQ ID NO: 103072 - DNA, 15 bp, Homo sapiens
agcacattgggaggc

SEQ ID NO: 103073 - DNA, 15 bp, Homo sapiens
tagcacattgggagg

SEQ ID NO: 103074 - DNA, 15 bp, Homo sapiens
ctagcacattgggag

SEQ ID NO: 103075 - DNA, 15 bp, Homo sapiens
cctagcacattggga

SEQ ID NO: 103076 - DNA, 15 bp, Homo sapiens
tcctagcacattggg

SEQ ID NO: 103077 - DNA, 15 bp, Homo sapiens
atcctagcacattgg

SEQ ID NO: 103078 - DNA, 15 bp, Homo sapiens
aatcctagcacattg

SEQ ID NO: 103079 - DNA, 15 bp, Homo sapiens
taatcctagcacatt

SEQ ID NO: 103080 - DNA, 15 bp, Homo sapiens
ctaatcctagcacat

SEQ ID NO: 103081 - DNA, 15 bp, Homo sapiens
tctaatcctagcaca

SEQ ID NO: 103082 - DNA, 15 bp, Homo sapiens
ctctaatcctagcac

SEQ ID NO: 103083 - DNA, 15 bp, Homo sapiens
cctctaatcctagca

SEQ ID NO: 103084 - DNA, 15 bp, Homo sapiens
acctctaatcctagc

SEQ ID NO: 103085 - DNA, 15 bp, Homo sapiens
cacctctaatcctag

SEQ ID NO: 103086 - DNA, 15 bp, Homo sapiens
acacctctaatccta

SEQ ID NO: 103087 - DNA, 15 bp, Homo sapiens
cacacctctaatcct

SEQ ID NO: 103088 - DNA, 15 bp, Homo sapiens
tcacacctctaatcc

SEQ ID NO: 103089 - DNA, 15 bp, Homo sapiens
ctcacacctctaatc

SEQ ID NO: 103090 - DNA, 15 bp, Homo sapiens
gctcacacctctaat

SEQ ID NO: 103091 - DNA, 15 bp, Homo sapiens
ggctcacacctctaa

SEQ ID NO: 103092 - DNA, 15 bp, Homo sapiens
tggctcacacctcta

SEQ ID NO: 103093 - DNA, 15 bp, Homo sapiens
atggctcacacctct

SEQ ID NO: 103094 - DNA, 15 bp, Homo sapiens
gatggctcacacctc

SEQ ID NO: 103095 - DNA, 15 bp, Homo sapiens
cgatggctcacacct

SEQ ID NO: 103096 - DNA, 15 bp, Homo sapiens
gcgatggctcacacc

SEQ ID NO: 103097 - DNA, 15 bp, Homo sapiens
tgcgatggctcacac

SEQ ID NO: 103098 - DNA, 15 bp, Homo sapiens
gtgcgatggctcaca

SEQ ID NO: 103099 - DNA, 15 bp, Homo sapiens
agtgcgatggctcac

SEQ ID NO: 103100 - DNA, 15 bp, Homo sapiens
aagtgcgatggctca

SEQ ID NO: 103101 - DNA, 15 bp, Homo sapiens
caagtgcgatggctc

SEQ ID NO: 103102 - DNA, 15 bp, Homo sapiens
ccaagtgcgatggct

SEQ ID NO: 103103 - DNA, 15 bp, Homo sapiens
gccaagtgcgatggc

SEQ ID NO: 103104 - DNA, 15 bp, Homo sapiens
ggccaagtgcgatgg

SEQ ID NO: 103105 - DNA, 15 bp, Homo sapiens
tggccaagtgcgatg

SEQ ID NO: 103106 - DNA, 15 bp, Homo sapiens
ctggccaagtgcgat

SEQ ID NO: 103107 - DNA, 15 bp, Homo sapiens
cctggccaagtgcga

SEQ ID NO: 103108 - DNA, 15 bp, Homo sapiens
gcctggccaagtgcg

SEQ ID NO: 103109 - DNA, 15 bp, Homo sapiens
agcctggccaagtgc

SEQ ID NO: 103110 - DNA, 15 bp, Homo sapiens
aagcctggccaagtg

SEQ ID NO: 103111 - DNA, 15 bp, Homo sapiens
aaagcctggccaagt

SEQ ID NO: 103112 - DNA, 15 bp, Homo sapiens
caaagcctggccaag

SEQ ID NO: 103113 - DNA, 15 bp, Homo sapiens
ccaaagcctggccaa

SEQ ID NO: 103114 - DNA, 15 bp, Homo sapiens
tccaaagcctggcca

SEQ ID NO: 103115 - DNA, 15 bp, Homo sapiens
ctccaaagcctggcc

SEQ ID NO: 103116 - DNA, 15 bp, Homo sapiens
actccaaagcctggc

SEQ ID NO: 103117 - DNA, 15 bp, Homo sapiens
gactccaaagcctgg

SEQ ID NO: 103118 - DNA, 15 bp, Homo sapiens
agactccaaagcctg

SEQ ID NO: 103119 - DNA, 15 bp, Homo sapiens
taagactccaaagcc

SEQ ID NO: 103120 - DNA, 15 bp, Homo sapiens
ttaagactccaaagc

SEQ ID NO: 103121 - DNA, 15 bp, Homo sapiens
tttaagactccaaag

SEQ ID NO: 103122 - DNA, 15 bp, Homo sapiens
ctttaagactccaaa

SEQ ID NO: 103123 - DNA, 15 bp, Homo sapiens
gctttaagactccaa

SEQ ID NO: 103124 - DNA, 15 bp, Homo sapiens
agctttaagactcca

SEQ ID NO: 103125 - DNA, 15 bp, Homo sapiens
aagctttaagactcc

SEQ ID NO: 103126 - DNA, 15 bp, Homo sapiens
aaagctttaagactc

SEQ ID NO: 103127 - DNA, 15 bp, Homo sapiens
taaagctttaagact

SEQ ID NO: 103128 - DNA, 15 bp, Homo sapiens
ctaaagctttaagac

SEQ ID NO: 103129 - DNA, 15 bp, Homo sapiens
tctaaagctttaaga

SEQ ID NO: 103130 - DNA, 15 bp, Homo sapiens
ctctaaagctttaag

SEQ ID NO: 103131 - DNA, 15 bp, Homo sapiens
gctctaaagctttaa

SEQ ID NO: 103132 - DNA, 15 bp, Homo sapiens
ggctctaaagcttta

SEQ ID NO: 103133 - DNA, 15 bp, Homo sapiens
tggctctaaagcttt

SEQ ID NO: 103134 - DNA, 15 bp, Homo sapiens
atggctctaaagctt

SEQ ID NO: 103135 - DNA, 15 bp, Homo sapiens
catggctctaaagct

SEQ ID NO: 103136 - DNA, 15 bp, Homo sapiens
acatggctctaaagc

SEQ ID NO: 103137 - DNA, 15 bp, Homo sapiens
aacatggctctaaag

SEQ ID NO: 103138 - DNA, 15 bp, Homo sapiens
caacatggctctaaa

SEQ ID NO: 103139 - DNA, 15 bp, Homo sapiens
ccaacatggctctaa

SEQ ID NO: 103140 - DNA, 15 bp, Homo sapiens
tccaacatggctcta

SEQ ID NO: 103141 - DNA, 15 bp, Homo sapiens
ttccaacatggctct

SEQ ID NO: 103142 - DNA, 15 bp, Homo sapiens
attccaacatggctc

SEQ ID NO: 103143 - DNA, 15 bp, Homo sapiens
gattccaacatggct

SEQ ID NO: 103144 - DNA, 15 bp, Homo sapiens
agattccaacatggc

SEQ ID NO: 103145 - DNA, 15 bp, Homo sapiens
aagattccaacatgg

SEQ ID NO: 103146 - DNA, 15 bp, Homo sapiens
taagattccaacatg

SEQ ID NO: 103147 - DNA, 15 bp, Homo sapiens
ctaagattccaacat

SEQ ID NO: 103148 - DNA, 15 bp, Homo sapiens
gctaagattccaaca

SEQ ID NO: 103149 - DNA, 15 bp, Homo sapiens
agctaagattccaac

SEQ ID NO: 103150 - DNA, 15 bp, Homo sapiens
gagctaagattccaa

SEQ ID NO: 103151 - DNA, 15 bp, Homo sapiens
agagctaagattcca

SEQ ID NO: 103152 - DNA, 15 bp, Homo sapiens
aagagctaagattcc

SEQ ID NO: 103153 - DNA, 15 bp, Homo sapiens
gaagagctaagattc

SEQ ID NO: 103154 - DNA, 15 bp, Homo sapiens
agaagagctaagatt

SEQ ID NO: 103155 - DNA, 15 bp, Homo sapiens
aagaagagctaagat

SEQ ID NO: 103156 - DNA, 15 bp, Homo sapiens
aaagaagagctaaga

SEQ ID NO: 103157 - DNA, 15 bp, Homo sapiens
aaaagaagagctaag

SEQ ID NO: 103158 - DNA, 15 bp, Homo sapiens
caaaagaagagctaa

SEQ ID NO: 103159 - DNA, 15 bp, Homo sapiens
tcaaaagaagagcta

SEQ ID NO: 103160 - DNA, 15 bp, Homo sapiens
gtcaaaagaagagct

SEQ ID NO: 103161 - DNA, 15 bp, Homo sapiens
agtcaaaagaagagc

SEQ ID NO: 103162 - DNA, 15 bp, Homo sapiens
cagtcaaaagaagag

SEQ ID NO: 103163 - DNA, 15 bp, Homo sapiens
acagtcaaaagaaga

SEQ ID NO: 103164 - DNA, 15 bp, Homo sapiens
cacagtcaaaagaag

SEQ ID NO: 103165 - DNA, 15 bp, Homo sapiens
acacagtcaaaagaa

SEQ ID NO: 103166 - DNA, 15 bp, Homo sapiens
cacacagtcaaaaga

SEQ ID NO: 103167 - DNA, 15 bp, Homo sapiens
acacacagtcaaaag

SEQ ID NO: 103168 - DNA, 15 bp, Homo sapiens
tacacacagtcaaaa

SEQ ID NO: 103169 - DNA, 15 bp, Homo sapiens
atacacacagtcaaa

SEQ ID NO: 103170 - DNA, 15 bp, Homo sapiens
catacacacagtcaa

SEQ ID NO: 103171 - DNA, 15 bp, Homo sapiens
acatacacacagtca

SEQ ID NO: 103172 - DNA, 15 bp, Homo sapiens
tacatacacacagtc

SEQ ID NO: 103173 - DNA, 15 bp, Homo sapiens
ctacatacacacagt

SEQ ID NO: 103174 - DNA, 15 bp, Homo sapiens
cctacatacacacag

SEQ ID NO: 103175 - DNA, 15 bp, Homo sapiens
gcctacatacacaca

SEQ ID NO: 103176 - DNA, 15 bp, Homo sapiens
tgcctacatacacac

SEQ ID NO: 103177 - DNA, 15 bp, Homo sapiens
ttgcctacatacaca

SEQ ID NO: 103178 - DNA, 15 bp, Homo sapiens
cttgcctacatacac

SEQ ID NO: 103179 - DNA, 15 bp, Homo sapiens
acttgcctacataca

SEQ ID NO: 103180 - DNA, 15 bp, Homo sapiens
tacttgcctacatac

SEQ ID NO: 103181 - DNA, 15 bp, Homo sapiens
ttacttgcctacata

SEQ ID NO: 103182 - DNA, 15 bp, Homo sapiens
attacttgcctacat

SEQ ID NO: 103183 - DNA, 15 bp, Homo sapiens
aattacttgcctaca

SEQ ID NO: 103184 - DNA, 15 bp, Homo sapiens
aaattacttgcctac

SEQ ID NO: 103185 - DNA, 15 bp, Homo sapiens
taaattacttgccta

SEQ ID NO: 103186 - DNA, 15 bp, Homo sapiens
ttaaattacttgcct

SEQ ID NO: 103187 - DNA, 15 bp, Homo sapiens
gttaaattacttgcc

SEQ ID NO: 103188 - DNA, 15 bp, Homo sapiens
ggttaaattacttgc

SEQ ID NO: 103189 - DNA, 15 bp, Homo sapiens
aggttaaattacttg

SEQ ID NO: 103190 - DNA, 15 bp, Homo sapiens
aaggttaaattactt

SEQ ID NO: 103191 - DNA, 15 bp, Homo sapiens
aaaggttaaattact

SEQ ID NO: 103192 - DNA, 15 bp, Homo sapiens
gaaaggttaaattac

SEQ ID NO: 103193 - DNA, 15 bp, Homo sapiens
agaaaggttaaatta

SEQ ID NO: 103194 - DNA, 15 bp, Homo sapiens
cagaaaggttaaatt

SEQ ID NO: 103195 - DNA, 15 bp, Homo sapiens
tcagaaaggttaaat

SEQ ID NO: 103196 - DNA, 15 bp, Homo sapiens
ctcagaaaggttaaa

SEQ ID NO: 103197 - DNA, 15 bp, Homo sapiens
gctcagaaaggttaa

SEQ ID NO: 103198 - DNA, 15 bp, Homo sapiens
agctcagaaaggtta

SEQ ID NO: 103199 - DNA, 15 bp, Homo sapiens
aagctcagaaaggtt

SEQ ID NO: 103200 - DNA, 15 bp, Homo sapiens
gaagctcagaaaggt

SEQ ID NO: 103201 - DNA, 15 bp, Homo sapiens
tgaagctcagaaagg

SEQ ID NO: 103202 - DNA, 15 bp, Homo sapiens
ttgaagctcagaaag

SEQ ID NO: 103203 - DNA, 15 bp, Homo sapiens
attgaagctcagaaa

SEQ ID NO: 103204 - DNA, 15 bp, Homo sapiens
aattgaagctcagaa

SEQ ID NO: 103205 - DNA, 15 bp, Homo sapiens
aaattgaagctcaga

SEQ ID NO: 103206 - DNA, 15 bp, Homo sapiens
aaaattgaagctcag

SEQ ID NO: 103207 - DNA, 15 bp, Homo sapiens
gaaaattgaagctca

SEQ ID NO: 103208 - DNA, 15 bp, Homo sapiens
ggaaaattgaagctc

SEQ ID NO: 103209 - DNA, 15 bp, Homo sapiens
tggaaaattgaagct

SEQ ID NO: 103210 - DNA, 15 bp, Homo sapiens
ttggaaaattgaagc

SEQ ID NO: 103211 - DNA, 15 bp, Homo sapiens
attggaaaattgaag

SEQ ID NO: 103212 - DNA, 15 bp, Homo sapiens
gattggaaaattgaa

SEQ ID NO: 103213 - DNA, 15 bp, Homo sapiens
agattggaaaattga

SEQ ID NO: 103214 - DNA, 15 bp, Homo sapiens
cagattggaaaattg

SEQ ID NO: 103215 - DNA, 15 bp, Homo sapiens
acagattggaaaatt

SEQ ID NO: 103216 - DNA, 15 bp, Homo sapiens
tacagattggaaaat

SEQ ID NO: 103217 - DNA, 15 bp, Homo sapiens
ttacagattggaaaa

SEQ ID NO: 103218 - DNA, 15 bp, Homo sapiens
tttacagattggaaa

SEQ ID NO: 103219 - DNA, 15 bp, Homo sapiens
gtttacagattggaa

SEQ ID NO: 103220 - DNA, 15 bp, Homo sapiens
agtttacagattgga

SEQ ID NO: 103221 - DNA, 15 bp, Homo sapiens
cagtttacagattgg

SEQ ID NO: 103222 - DNA, 15 bp, Homo sapiens
ccagtttacagattg

SEQ ID NO: 103223 - DNA, 15 bp, Homo sapiens
cccagtttacagatt

SEQ ID NO: 103224 - DNA, 15 bp, Homo sapiens
tcccagtttacagat

SEQ ID NO: 103225 - DNA, 15 bp, Homo sapiens
ttcccagtttacaga

SEQ ID NO: 103226 - DNA, 15 bp, Homo sapiens
attcccagtttacag

SEQ ID NO: 103227 - DNA, 15 bp, Homo sapiens
cattcccagtttaca

SEQ ID NO: 103228 - DNA, 15 bp, Homo sapiens
gcattcccagtttac

SEQ ID NO: 103229 - DNA, 15 bp, Homo sapiens
agcattcccagttta

SEQ ID NO: 103230 - DNA, 15 bp, Homo sapiens
tagcattcccagttt

SEQ ID NO: 103231 - DNA, 15 bp, Homo sapiens
atagcattcccagtt

SEQ ID NO: 103232 - DNA, 15 bp, Homo sapiens
aatagcattcccagt

SEQ ID NO: 103233 - DNA, 15 bp, Homo sapiens
aaatagcattcccag

SEQ ID NO: 103234 - DNA, 15 bp, Homo sapiens
taaatagcattccca

SEQ ID NO: 103235 - DNA, 15 bp, Homo sapiens
ctaaatagcattccc

SEQ ID NO: 103236 - DNA, 15 bp, Homo sapiens
gctaaatagcattcc

SEQ ID NO: 103237 - DNA, 15 bp, Homo sapiens
ggctaaatagcattc

SEQ ID NO: 103238 - DNA, 15 bp, Homo sapiens
gggctaaatagcatt

SEQ ID NO: 103239 - DNA, 15 bp, Homo sapiens
tgggctaaatagcat

SEQ ID NO: 103240 - DNA, 15 bp, Homo sapiens
atgggctaaatagca

SEQ ID NO: 103241 - DNA, 15 bp, Homo sapiens
tatgggctaaatagc

SEQ ID NO: 103242 - DNA, 15 bp, Homo sapiens
atatgggctaaatag

SEQ ID NO: 103243 - DNA, 15 bp, Homo sapiens
catatgggctaaata

SEQ ID NO: 103244 - DNA, 15 bp, Homo sapiens
ccatatgggctaaat

SEQ ID NO: 103245 - DNA, 15 bp, Homo sapiens
accatatgggctaaa

SEQ ID NO: 103246 - DNA, 15 bp, Homo sapiens
aaccatatgggctaa

SEQ ID NO: 103247 - DNA, 15 bp, Homo sapiens
taaccatatgggcta

SEQ ID NO: 103248 - DNA, 15 bp, Homo sapiens
ttaaccatatgggct

SEQ ID NO: 103249 - DNA, 15 bp, Homo sapiens
attaaccatatgggc

SEQ ID NO: 103250 - DNA, 15 bp, Homo sapiens
aattaaccatatggg

SEQ ID NO: 103251 - DNA, 15 bp, Homo sapiens
taattaaccatatgg

SEQ ID NO: 103252 - DNA, 15 bp, Homo sapiens
ctaattaaccatatg

SEQ ID NO: 103253 - DNA, 15 bp, Homo sapiens
tctaattaaccatat

SEQ ID NO: 103254 - DNA, 15 bp, Homo sapiens
atctaattaaccata

SEQ ID NO: 103255 - DNA, 15 bp, Homo sapiens
aatctaattaaccat

SEQ ID NO: 103256 - DNA, 15 bp, Homo sapiens
aaatctaattaacca

SEQ ID NO: 103257 - DNA, 15 bp, Homo sapiens
taaatctaattaacc

SEQ ID NO: 103258 - DNA, 15 bp, Homo sapiens
ataaatctaattaac

SEQ ID NO: 103259 - DNA, 15 bp, Homo sapiens
cataaatctaattaa

SEQ ID NO: 103260 - DNA, 15 bp, Homo sapiens
acataaatctaatta

SEQ ID NO: 103261 - DNA, 15 bp, Homo sapiens
tacataaatctaatt

SEQ ID NO: 103262 - DNA, 15 bp, Homo sapiens
atacataaatctaat

SEQ ID NO: 103263 - DNA, 15 bp, Homo sapiens
tatacataaatctaa

SEQ ID NO: 103264 - DNA, 15 bp, Homo sapiens
atatacataaatcta

SEQ ID NO: 103265 - DNA, 15 bp, Homo sapiens
tatatacataaatct

SEQ ID NO: 103266 - DNA, 15 bp, Homo sapiens
ttatatacataaatc

SEQ ID NO: 103267 - DNA, 15 bp, Homo sapiens
tttatatacataaat

SEQ ID NO: 103268 - DNA, 15 bp, Homo sapiens
ttttatatacataaa

SEQ ID NO: 103269 - DNA, 15 bp, Homo sapiens
tttttatatacataa

SEQ ID NO: 103270 - DNA, 15 bp, Homo sapiens
ctttttatatacata

SEQ ID NO: 103271 - DNA, 15 bp, Homo sapiens
actttttatatacat

SEQ ID NO: 103272 - DNA, 15 bp, Homo sapiens
cactttttatataca

SEQ ID NO: 103273 - DNA, 15 bp, Homo sapiens
acactttttatatac

SEQ ID NO: 103274 - DNA, 15 bp, Homo sapiens
cacactttttatata

SEQ ID NO: 103275 - DNA, 15 bp, Homo sapiens
acacactttttatat

SEQ ID NO: 103276 - DNA, 15 bp, Homo sapiens
tacacactttttata

SEQ ID NO: 103277 - DNA, 15 bp, Homo sapiens
atacacactttttat

SEQ ID NO: 103278 - DNA, 15 bp, Homo sapiens
tatacacacttttta

SEQ ID NO: 103279 - DNA, 15 bp, Homo sapiens
atatacacacttttt

SEQ ID NO: 103280 - DNA, 15 bp, Homo sapiens
tatatacacactttt

SEQ ID NO: 103281 - DNA, 15 bp, Homo sapiens
ttatatacacacttt

SEQ ID NO: 103282 - DNA, 15 bp, Homo sapiens
tttatatacacactt

SEQ ID NO: 103283 - DNA, 15 bp, Homo sapiens
ttttatatacacact

SEQ ID NO: 103284 - DNA, 15 bp, Homo sapiens
gttttatatacacac

SEQ ID NO: 103285 - DNA, 15 bp, Homo sapiens
tgttttatatacaca

SEQ ID NO: 103286 - DNA, 15 bp, Homo sapiens
ttgttttatatacac

SEQ ID NO: 103287 - DNA, 15 bp, Homo sapiens
attgttttatataca

SEQ ID NO: 103288 - DNA, 15 bp, Homo sapiens
cattgttttatatac

SEQ ID NO: 103289 - DNA, 15 bp, Homo sapiens
gcattgttttatata

SEQ ID NO: 103290 - DNA, 15 bp, Homo sapiens
ggcattgttttatat

SEQ ID NO: 103291 - DNA, 15 bp, Homo sapiens
aggcattgttttata

SEQ ID NO: 103292 - DNA, 15 bp, Homo sapiens
gaggcattgttttat

SEQ ID NO: 103293 - DNA, 15 bp, Homo sapiens
agaggcattgtttta

SEQ ID NO: 103294 - DNA, 15 bp, Homo sapiens
aagaggcattgtttt

SEQ ID NO: 103295 - DNA, 15 bp, Homo sapiens
taagaggcattgttt

SEQ ID NO: 103296 - DNA, 15 bp, Homo sapiens
ataagaggcattgtt

SEQ ID NO: 103297 - DNA, 15 bp, Homo sapiens
aataagaggcattgt

SEQ ID NO: 103298 - DNA, 15 bp, Homo sapiens
gaataagaggcattg

SEQ ID NO: 103299 - DNA, 15 bp, Homo sapiens
agaataagaggcatt

SEQ ID NO: 103300 - DNA, 15 bp, Homo sapiens
cagaataagaggcat

SEQ ID NO: 103301 - DNA, 15 bp, Homo sapiens
gcagaataagaggca

SEQ ID NO: 103302 - DNA, 15 bp, Homo sapiens
tgcagaataagaggc

SEQ ID NO: 103303 - DNA, 15 bp, Homo sapiens
atgcagaataagagg

SEQ ID NO: 103304 - DNA, 15 bp, Homo sapiens
tatgcagaataagag

SEQ ID NO: 103305 - DNA, 15 bp, Homo sapiens
atatgcagaataaga

SEQ ID NO: 103306 - DNA, 15 bp, Homo sapiens
tatatgcagaataag

SEQ ID NO: 103307 - DNA, 15 bp, Homo sapiens
atatatgcagaataa

SEQ ID NO: 103308 - DNA, 15 bp, Homo sapiens
aatatatgcagaata

SEQ ID NO: 103309 - DNA, 15 bp, Homo sapiens
caatatatgcagaat

SEQ ID NO: 103310 - DNA, 15 bp, Homo sapiens
acaatatatgcagaa

SEQ ID NO: 103311 - DNA, 15 bp, Homo sapiens
tacaatatatgcaga

SEQ ID NO: 103312 - DNA, 15 bp, Homo sapiens
ctacaatatatgcag

SEQ ID NO: 103313 - DNA, 15 bp, Homo sapiens
cctacaatatatgca

SEQ ID NO: 103314 - DNA, 15 bp, Homo sapiens
tcctacaatatatgc

SEQ ID NO: 103315 - DNA, 15 bp, Homo sapiens
ttcctacaatatatg

SEQ ID NO: 103316 - DNA, 15 bp, Homo sapiens
tttcctacaatatat

SEQ ID NO: 103317 - DNA, 15 bp, Homo sapiens
ttttcctacaatata

SEQ ID NO: 103318 - DNA, 15 bp, Homo sapiens
attttcctacaatat

SEQ ID NO: 103319 - DNA, 15 bp, Homo sapiens
cattttcctacaata

SEQ ID NO: 103320 - DNA, 15 bp, Homo sapiens
tcattttcctacaat

SEQ ID NO: 103321 - DNA, 15 bp, Homo sapiens
gtcattttcctacaa

SEQ ID NO: 103322 - DNA, 15 bp, Homo sapiens
agtcattttcctaca

SEQ ID NO: 103323 - DNA, 15 bp, Homo sapiens
tagtcattttcctac

SEQ ID NO: 103324 - DNA, 15 bp, Homo sapiens
gtagtcattttccta

SEQ ID NO: 103325 - DNA, 15 bp, Homo sapiens
agtagtcattttcct

SEQ ID NO: 103326 - DNA, 15 bp, Homo sapiens
aagtagtcattttcc

SEQ ID NO: 103327 - DNA, 15 bp, Homo sapiens
taagtagtcattttc

SEQ ID NO: 103328 - DNA, 15 bp, Homo sapiens
ataagtagtcatttt

SEQ ID NO: 103329 - DNA, 15 bp, Homo sapiens
aataagtagtcattt

SEQ ID NO: 103330 - DNA, 15 bp, Homo sapiens
aaataagtagtcatt

SEQ ID NO: 103331 - DNA, 15 bp, Homo sapiens
aaaataagtagtcat

SEQ ID NO: 103332 - DNA, 15 bp, Homo sapiens
aaaaataagtagtca

SEQ ID NO: 103333 - DNA, 15 bp, Homo sapiens
taaaaataagtagtc

SEQ ID NO: 103334 - DNA, 15 bp, Homo sapiens
ctaaaaataagtagt

SEQ ID NO: 103335 - DNA, 15 bp, Homo sapiens
actaaaaataagtag

SEQ ID NO: 103336 - DNA, 15 bp, Homo sapiens
tactaaaaataagta

SEQ ID NO: 103337 - DNA, 15 bp, Homo sapiens
ttactaaaaataagt

SEQ ID NO: 103338 - DNA, 15 bp, Homo sapiens
attactaaaaataag

SEQ ID NO: 103339 - DNA, 15 bp, Homo sapiens
tattactaaaaataa

SEQ ID NO: 103340 - DNA, 15 bp, Homo sapiens
atattactaaaaata

SEQ ID NO: 103341 - DNA, 15 bp, Homo sapiens
ttatattactaaaaa

SEQ ID NO: 103342 - DNA, 15 bp, Homo sapiens
attatattactaaaa

SEQ ID NO: 103343 - DNA, 15 bp, Homo sapiens
aattatattactaaa

SEQ ID NO: 103344 - DNA, 15 bp, Homo sapiens
taattatattactaa

SEQ ID NO: 103345 - DNA, 15 bp, Homo sapiens
ttaattatattacta

SEQ ID NO: 103346 - DNA, 15 bp, Homo sapiens
attaattatattact

SEQ ID NO: 103347 - DNA, 15 bp, Homo sapiens
tattaattatattac

SEQ ID NO: 103348 - DNA, 15 bp, Homo sapiens
ttattaattatatta

SEQ ID NO: 103349 - DNA, 15 bp, Homo sapiens
tttattaattatatt

SEQ ID NO: 103350 - DNA, 15 bp, Homo sapiens
ttttattaattatat

SEQ ID NO: 103351 - DNA, 15 bp, Homo sapiens
cttttattaattata

SEQ ID NO: 103352 - DNA, 15 bp, Homo sapiens
acttttattaattat

SEQ ID NO: 103353 - DNA, 15 bp, Homo sapiens
aacttttattaatta

SEQ ID NO: 103354 - DNA, 15 bp, Homo sapiens
caacttttattaatt

SEQ ID NO: 103355 - DNA, 15 bp, Homo sapiens
tcaacttttattaat

SEQ ID NO: 103356 - DNA, 15 bp, Homo sapiens
ctcaacttttattaa

SEQ ID NO: 103357 - DNA, 15 bp, Homo sapiens
tctcaacttttatta

SEQ ID NO: 103358 - DNA, 15 bp, Homo sapiens
atctcaacttttatt

SEQ ID NO: 103359 - DNA, 15 bp, Homo sapiens
gatctcaacttttat

SEQ ID NO: 103360 - DNA, 15 bp, Homo sapiens
tgatctcaactttta

SEQ ID NO: 103361 - DNA, 15 bp, Homo sapiens
atgatctcaactttt

SEQ ID NO: 103362 - DNA, 15 bp, Homo sapiens
aatgatctcaacttt

SEQ ID NO: 103363 - DNA, 15 bp, Homo sapiens
aaatgatctcaactt

SEQ ID NO: 103364 - DNA, 15 bp, Homo sapiens
aaaatgatctcaact

SEQ ID NO: 103365 - DNA, 15 bp, Homo sapiens
caaaatgatctcaac

SEQ ID NO: 103366 - DNA, 15 bp, Homo sapiens
gcaaaatgatctcaa

SEQ ID NO: 103367 - DNA, 15 bp, Homo sapiens
agcaaaatgatctca

SEQ ID NO: 103368 - DNA, 15 bp, Homo sapiens
aagcaaaatgatctc

SEQ ID NO: 103369 - DNA, 15 bp, Homo sapiens
caagcaaaatgatct

SEQ ID NO: 103370 - DNA, 15 bp, Homo sapiens
acaagcaaaatgatc

SEQ ID NO: 103371 - DNA, 15 bp, Homo sapiens
tacaagcaaaatgat

SEQ ID NO: 103372 - DNA, 15 bp, Homo sapiens
atacaagcaaaatga

SEQ ID NO: 103373 - DNA, 15 bp, Homo sapiens
tatacaagcaaaatg

SEQ ID NO: 103374 - DNA, 15 bp, Homo sapiens
ctatacaagcaaaat

SEQ ID NO: 103375 - DNA, 15 bp, Homo sapiens
actatacaagcaaaa

SEQ ID NO: 103376 - DNA, 15 bp, Homo sapiens
tactatacaagcaaa

SEQ ID NO: 103377 - DNA, 15 bp, Homo sapiens
gtactatacaagcaa

SEQ ID NO: 103378 - DNA, 15 bp, Homo sapiens
agtactatacaagca

SEQ ID NO: 103379 - DNA, 15 bp, Homo sapiens
cagtactatacaagc

SEQ ID NO: 103380 - DNA, 15 bp, Homo sapiens
acagtactatacaag

SEQ ID NO: 103381 - DNA, 15 bp, Homo sapiens
aacagtactatacaa

SEQ ID NO: 103382 - DNA, 15 bp, Homo sapiens
gaacagtactataca

SEQ ID NO: 103383 - DNA, 15 bp, Homo sapiens
agaacagtactatac

SEQ ID NO: 103384 - DNA, 15 bp, Homo sapiens
gagaacagtactata

SEQ ID NO: 103385 - DNA, 15 bp, Homo sapiens
agagaacagtactat

SEQ ID NO: 103386 - DNA, 15 bp, Homo sapiens
cagagaacagtacta

SEQ ID NO: 103387 - DNA, 15 bp, Homo sapiens
gcagagaacagtact

SEQ ID NO: 103388 - DNA, 15 bp, Homo sapiens
ggcagagaacagtac

SEQ ID NO: 103389 - DNA, 15 bp, Homo sapiens
aggcagagaacagta

SEQ ID NO: 103390 - DNA, 15 bp, Homo sapiens
aaggcagagaacagt

SEQ ID NO: 103391 - DNA, 15 bp, Homo sapiens
aaaggcagagaacag

SEQ ID NO: 103392 - DNA, 15 bp, Homo sapiens
caaaggcagagaaca

SEQ ID NO: 103393 - DNA, 15 bp, Homo sapiens
tcaaaggcagagaac

SEQ ID NO: 103394 - DNA, 15 bp, Homo sapiens
ttcaaaggcagagaa

SEQ ID NO: 103395 - DNA, 15 bp, Homo sapiens
gttcaaaggcagaga

SEQ ID NO: 103396 - DNA, 15 bp, Homo sapiens
agttcaaaggcagag

SEQ ID NO: 103397 - DNA, 15 bp, Homo sapiens
aagttcaaaggcaga

SEQ ID NO: 103398 - DNA, 15 bp, Homo sapiens
aaagttcaaaggcag

SEQ ID NO: 103399 - DNA, 15 bp, Homo sapiens
caaagttcaaaggca

SEQ ID NO: 103400 - DNA, 15 bp, Homo sapiens
acaaagttcaaaggc

SEQ ID NO: 103401 - DNA, 15 bp, Homo sapiens
cacaaagttcaaagg

SEQ ID NO: 103402 - DNA, 15 bp, Homo sapiens
acacaaagttcaaag

SEQ ID NO: 103403 - DNA, 15 bp, Homo sapiens
gacacaaagttcaaa

SEQ ID NO: 103404 - DNA, 15 bp, Homo sapiens
tgacacaaagttcaa

SEQ ID NO: 103405 - DNA, 15 bp, Homo sapiens
atgacacaaagttca

SEQ ID NO: 103406 - DNA, 15 bp, Homo sapiens
catgacacaaagttc

SEQ ID NO: 103407 - DNA, 15 bp, Homo sapiens
tcatgacacaaagtt

SEQ ID NO: 103408 - DNA, 15 bp, Homo sapiens
ctcatgacacaaagt

SEQ ID NO: 103409 - DNA, 15 bp, Homo sapiens
gctcatgacacaaag

SEQ ID NO: 103410 - DNA, 15 bp, Homo sapiens
tgctcatgacacaaa

SEQ ID NO: 103411 - DNA, 15 bp, Homo sapiens
atgctcatgacacaa

SEQ ID NO: 103412 - DNA, 15 bp, Homo sapiens
aatgctcatgacaca

SEQ ID NO: 103413 - DNA, 15 bp, Homo sapiens
aaatgctcatgacac

SEQ ID NO: 103414 - DNA, 15 bp, Homo sapiens
gaaatgctcatgaca

SEQ ID NO: 103415 - DNA, 15 bp, Homo sapiens
ggaaatgctcatgac

SEQ ID NO: 103416 - DNA, 15 bp, Homo sapiens
gggaaatgctcatga

SEQ ID NO: 103417 - DNA, 15 bp, Homo sapiens
ggggaaatgctcatg

SEQ ID NO: 103418 - DNA, 15 bp, Homo sapiens
tggggaaatgctcat

SEQ ID NO: 103419 - DNA, 15 bp, Homo sapiens
atggggaaatgctca

SEQ ID NO: 103420 - DNA, 15 bp, Homo sapiens
tatggggaaatgctc

SEQ ID NO: 103421 - DNA, 15 bp, Homo sapiens
atatggggaaatgct

SEQ ID NO: 103422 - DNA, 15 bp, Homo sapiens
tatatggggaaatgc

SEQ ID NO: 103423 - DNA, 15 bp, Homo sapiens
ttatatggggaaatg

SEQ ID NO: 103424 - DNA, 15 bp, Homo sapiens
attatatggggaaat

SEQ ID NO: 103425 - DNA, 15 bp, Homo sapiens
aattatatggggaaa

SEQ ID NO: 103426 - DNA, 15 bp, Homo sapiens
taattatatggggaa

SEQ ID NO: 103427 - DNA, 15 bp, Homo sapiens
ttaattatatgggga

SEQ ID NO: 103428 - DNA, 15 bp, Homo sapiens
attaattatatgggg

SEQ ID NO: 103429 - DNA, 15 bp, Homo sapiens
tattaattatatggg

SEQ ID NO: 103430 - DNA, 15 bp, Homo sapiens
ttattaattatatgg

SEQ ID NO: 103431 - DNA, 15 bp, Homo sapiens
attattaattatatg

SEQ ID NO: 103432 - DNA, 15 bp, Homo sapiens
aattattaattatat

SEQ ID NO: 103433 - DNA, 15 bp, Homo sapiens
taattattaattata

SEQ ID NO: 103434 - DNA, 15 bp, Homo sapiens
ataattattaattat

SEQ ID NO: 103435 - DNA, 15 bp, Homo sapiens
aataattattaatta

SEQ ID NO: 103436 - DNA, 15 bp, Homo sapiens
aaataattattaatt

SEQ ID NO: 103437 - DNA, 15 bp, Homo sapiens
aaaataattattaat

SEQ ID NO: 103438 - DNA, 15 bp, Homo sapiens
aaaaataattattaa

SEQ ID NO: 103439 - DNA, 15 bp, Homo sapiens
taaaaataattatta

SEQ ID NO: 103440 - DNA, 15 bp, Homo sapiens
ttaaaaataattatt

SEQ ID NO: 103441 - DNA, 15 bp, Homo sapiens
gttaaaaataattat

SEQ ID NO: 103442 - DNA, 15 bp, Homo sapiens
agttaaaaataatta

SEQ ID NO: 103443 - DNA, 15 bp, Homo sapiens
aagttaaaaataatt

SEQ ID NO: 103444 - DNA, 15 bp, Homo sapiens
aaagttaaaaataat

SEQ ID NO: 103445 - DNA, 15 bp, Homo sapiens
aaaagttaaaaataa

SEQ ID NO: 103446 - DNA, 15 bp, Homo sapiens
aaaaagttaaaaata

SEQ ID NO: 103447 - DNA, 15 bp, Homo sapiens
taaaaagttaaaaat

SEQ ID NO: 103448 - DNA, 15 bp, Homo sapiens
ataaaaagttaaaaa

SEQ ID NO: 103449 - DNA, 15 bp, Homo sapiens
aataaaaagttaaaa

SEQ ID NO: 103450 - DNA, 15 bp, Homo sapiens
taataaaaagttaaa

SEQ ID NO: 103451 - DNA, 15 bp, Homo sapiens
ataataaaaagttaa

SEQ ID NO: 103452 - DNA, 15 bp, Homo sapiens
aataataaaaagtta

SEQ ID NO: 103453 - DNA, 15 bp, Homo sapiens
gaataataaaaagtt

SEQ ID NO: 103454 - DNA, 15 bp, Homo sapiens
tgaataataaaaagt

SEQ ID NO: 103455 - DNA, 15 bp, Homo sapiens
atgaataataaaaag

SEQ ID NO: 103456 - DNA, 15 bp, Homo sapiens
aatgaataataaaaa

SEQ ID NO: 103457 - DNA, 15 bp, Homo sapiens
aaatgaataataaaa

SEQ ID NO: 103458 - DNA, 15 bp, Homo sapiens
taaatgaataataaa

SEQ ID NO: 103459 - DNA, 15 bp, Homo sapiens
ataaatgaataataa

SEQ ID NO: 103460 - DNA, 15 bp, Homo sapiens
aataaatgaataata

SEQ ID NO: 103461 - DNA, 15 bp, Homo sapiens
aaataaatgaataat

SEQ ID NO: 103462 - DNA, 15 bp, Homo sapiens
taaataaatgaataa

SEQ ID NO: 103463 - DNA, 15 bp, Homo sapiens
ataaataaatgaata

SEQ ID NO: 103464 - DNA, 15 bp, Homo sapiens
aataaataaatgaat

SEQ ID NO: 103465 - DNA, 15 bp, Homo sapiens
caataaataaatgaa

SEQ ID NO: 103466 - DNA, 15 bp, Homo sapiens
acaataaataaatga

SEQ ID NO: 103467 - DNA, 15 bp, Homo sapiens
aacaataaataaatg

SEQ ID NO: 103468 - DNA, 15 bp, Homo sapiens
aaacaataaataaat

SEQ ID NO: 103469 - DNA, 15 bp, Homo sapiens
taaacaataaataaa

SEQ ID NO: 103470 - DNA, 15 bp, Homo sapiens
ctaaacaataaataa

SEQ ID NO: 103471 - DNA, 15 bp, Homo sapiens
tctaaacaataaata

SEQ ID NO: 103472 - DNA, 15 bp, Homo sapiens
ctctaaacaataaat

SEQ ID NO: 103473 - DNA, 15 bp, Homo sapiens
tctctaaacaataaa

SEQ ID NO: 103474 - DNA, 15 bp, Homo sapiens
gtctctaaacaataa

SEQ ID NO: 103475 - DNA, 15 bp, Homo sapiens
tgtctctaaacaata

SEQ ID NO: 103476 - DNA, 15 bp, Homo sapiens
atgtctctaaacaat

SEQ ID NO: 103477 - DNA, 15 bp, Homo sapiens
tatgtctctaaacaa

SEQ ID NO: 103478 - DNA, 15 bp, Homo sapiens
ctatgtctctaaaca

SEQ ID NO: 103479 - DNA, 15 bp, Homo sapiens
actatgtctctaaac

SEQ ID NO: 103480 - DNA, 15 bp, Homo sapiens
gactatgtctctaaa

SEQ ID NO: 103481 - DNA, 15 bp, Homo sapiens
agactatgtctctaa

SEQ ID NO: 103482 - DNA, 15 bp, Homo sapiens
gagactatgtctcta

SEQ ID NO: 103483 - DNA, 15 bp, Homo sapiens
cgagactatgtctct

SEQ ID NO: 103484 - DNA, 15 bp, Homo sapiens
gcgagactatgtctc

SEQ ID NO: 103485 - DNA, 15 bp, Homo sapiens
agcgagactatgtct

SEQ ID NO: 103486 - DNA, 15 bp, Homo sapiens
gagcgagactatgtc

SEQ ID NO: 103487 - DNA, 15 bp, Homo sapiens
agagcgagactatgt

SEQ ID NO: 103488 - DNA, 15 bp, Homo sapiens
cagagcgagactatg

SEQ ID NO: 103489 - DNA, 15 bp, Homo sapiens
acagagcgagactat

SEQ ID NO: 103490 - DNA, 15 bp, Homo sapiens
aacagagcgagacta

SEQ ID NO: 103491 - DNA, 15 bp, Homo sapiens
gactccagcctgggc

SEQ ID NO: 103492 - DNA, 15 bp, Homo sapiens
ggactccagcctggg

SEQ ID NO: 103493 - DNA, 15 bp, Homo sapiens
tggactccagcctgg

SEQ ID NO: 103494 - DNA, 15 bp, Homo sapiens
ctggactccagcctg

SEQ ID NO: 103495 - DNA, 15 bp, Homo sapiens
actggactccagcct

SEQ ID NO: 103496 - DNA, 15 bp, Homo sapiens
cactggactccagcc

SEQ ID NO: 103497 - DNA, 15 bp, Homo sapiens
ccactggactccagc

SEQ ID NO: 103498 - DNA, 15 bp, Homo sapiens
accactggactccag

SEQ ID NO: 103499 - DNA, 15 bp, Homo sapiens
taccactggactcca

SEQ ID NO: 103500 - DNA, 15 bp, Homo sapiens
ataccactggactcc

SEQ ID NO: 103501 - DNA, 15 bp, Homo sapiens
cataccactggactc

SEQ ID NO: 103502 - DNA, 15 bp, Homo sapiens
tcataccactggact

SEQ ID NO: 103503 - DNA, 15 bp, Homo sapiens
gtcataccactggac

SEQ ID NO: 103504 - DNA, 15 bp, Homo sapiens
tgtcataccactgga

SEQ ID NO: 103505 - DNA, 15 bp, Homo sapiens
ctgtcataccactgg

SEQ ID NO: 103506 - DNA, 15 bp, Homo sapiens
gctgtcataccactg

SEQ ID NO: 103507 - DNA, 15 bp, Homo sapiens
agctgtcataccact

SEQ ID NO: 103508 - DNA, 15 bp, Homo sapiens
gagctgtcataccac

SEQ ID NO: 103509 - DNA, 15 bp, Homo sapiens
tgagctgtcatacca

SEQ ID NO: 103510 - DNA, 15 bp, Homo sapiens
gtgagctgtcatacc

SEQ ID NO: 103511 - DNA, 15 bp, Homo sapiens
agtgagctgtcatac

SEQ ID NO: 103512 - DNA, 15 bp, Homo sapiens
cagtgagctgtcata

SEQ ID NO: 103513 - DNA, 15 bp, Homo sapiens
gcagtgagctgtcat

SEQ ID NO: 103514 - DNA, 15 bp, Homo sapiens
tgcagtgagctgtca

SEQ ID NO: 103515 - DNA, 15 bp, Homo sapiens
ctgcagtgagctgtc

SEQ ID NO: 103516 - DNA, 15 bp, Homo sapiens
gctgcagtgagctgt

SEQ ID NO: 103517 - DNA, 15 bp, Homo sapiens
ggctgcagtgagctg

SEQ ID NO: 103518 - DNA, 15 bp, Homo sapiens
aggctgcagtgagct

SEQ ID NO: 103519 - DNA, 15 bp, Homo sapiens
aaggctgcagtgagc

SEQ ID NO: 103520 - DNA, 15 bp, Homo sapiens
agagttcaaggctgc

SEQ ID NO: 103521 - DNA, 15 bp, Homo sapiens
aagagttcaaggctg

SEQ ID NO: 103522 - DNA, 15 bp, Homo sapiens
caagagttcaaggct

SEQ ID NO: 103523 - DNA, 15 bp, Homo sapiens
ccaagagttcaaggc

SEQ ID NO: 103524 - DNA, 15 bp, Homo sapiens
cccaagagttcaagg

SEQ ID NO: 103525 - DNA, 15 bp, Homo sapiens
gcccaagagttcaag

SEQ ID NO: 103526 - DNA, 15 bp, Homo sapiens
agcccaagagttcaa

SEQ ID NO: 103527 - DNA, 15 bp, Homo sapiens
gagcccaagagttca

SEQ ID NO: 103528 - DNA, 15 bp, Homo sapiens
acttgagcccaagag

SEQ ID NO: 103529 - DNA, 15 bp, Homo sapiens
cacttgagcccaaga

SEQ ID NO: 103530 - DNA, 15 bp, Homo sapiens
tcacttgagcccaag

SEQ ID NO: 103531 - DNA, 15 bp, Homo sapiens
atcacttgagcccaa

SEQ ID NO: 103532 - DNA, 15 bp, Homo sapiens
aggaggatcacttga

SEQ ID NO: 103533 - DNA, 15 bp, Homo sapiens
caggaggatcacttg

SEQ ID NO: 103534 - DNA, 15 bp, Homo sapiens
gaggcaggaggatca

SEQ ID NO: 103535 - DNA, 15 bp, Homo sapiens
tgaggcaggaggatc

SEQ ID NO: 103536 - DNA, 15 bp, Homo sapiens
gtgaggcaggaggat

SEQ ID NO: 103537 - DNA, 15 bp, Homo sapiens
ggtgaggcaggagga

SEQ ID NO: 103538 - DNA, 15 bp, Homo sapiens
gggtgaggcaggagg

SEQ ID NO: 103539 - DNA, 15 bp, Homo sapiens
agggtgaggcaggag

SEQ ID NO: 103540 - DNA, 15 bp, Homo sapiens
gagggtgaggcagga

SEQ ID NO: 103541 - DNA, 15 bp, Homo sapiens
atgggagggtgaggc

SEQ ID NO: 103542 - DNA, 15 bp, Homo sapiens
tatgggagggtgagg

SEQ ID NO: 103543 - DNA, 15 bp, Homo sapiens
ttatgggagggtgag

SEQ ID NO: 103544 - DNA, 15 bp, Homo sapiens
attatgggagggtga

SEQ ID NO: 103545 - DNA, 15 bp, Homo sapiens
aattatgggagggtg

SEQ ID NO: 103546 - DNA, 15 bp, Homo sapiens
taattatgggagggt

SEQ ID NO: 103547 - DNA, 15 bp, Homo sapiens
ttaattatgggaggg

SEQ ID NO: 103548 - DNA, 15 bp, Homo sapiens
attaattatgggagg

SEQ ID NO: 103549 - DNA, 15 bp, Homo sapiens
tattaattatgggag

SEQ ID NO: 103550 - DNA, 15 bp, Homo sapiens
ttattaattatggga

SEQ ID NO: 103551 - DNA, 15 bp, Homo sapiens
attattaattatggg

SEQ ID NO: 103552 - DNA, 15 bp, Homo sapiens
tattattaattatgg

SEQ ID NO: 103553 - DNA, 15 bp, Homo sapiens
ctattattaattatg

SEQ ID NO: 103554 - DNA, 15 bp, Homo sapiens
actattattaattat

SEQ ID NO: 103555 - DNA, 15 bp, Homo sapiens
aactattattaatta

SEQ ID NO: 103556 - DNA, 15 bp, Homo sapiens
caactattattaatt

SEQ ID NO: 103557 - DNA, 15 bp, Homo sapiens
tcaactattattaat

SEQ ID NO: 103558 - DNA, 15 bp, Homo sapiens
ttcaactattattaa

SEQ ID NO: 103559 - DNA, 15 bp, Homo sapiens
tttcaactattatta

SEQ ID NO: 103560 - DNA, 15 bp, Homo sapiens
atttcaactattatt

SEQ ID NO: 103561 - DNA, 15 bp, Homo sapiens
aatttcaactattat

SEQ ID NO: 103562 - DNA, 15 bp, Homo sapiens
taatttcaactatta

SEQ ID NO: 103563 - DNA, 15 bp, Homo sapiens
ataatttcaactatt

SEQ ID NO: 103564 - DNA, 15 bp, Homo sapiens
aataatttcaactat

SEQ ID NO: 103565 - DNA, 15 bp, Homo sapiens
aaataatttcaacta

SEQ ID NO: 103566 - DNA, 15 bp, Homo sapiens
aaaataatttcaact

SEQ ID NO: 103567 - DNA, 15 bp, Homo sapiens
aaaaataatttcaac

SEQ ID NO: 103568 - DNA, 15 bp, Homo sapiens
caaaaataatttcaa

SEQ ID NO: 103569 - DNA, 15 bp, Homo sapiens
acaaaaataatttca

SEQ ID NO: 103570 - DNA, 15 bp, Homo sapiens
cacaaaaataatttc

SEQ ID NO: 103571 - DNA, 15 bp, Homo sapiens
tcacaaaaataattt

SEQ ID NO: 103572 - DNA, 15 bp, Homo sapiens
ttcacaaaaataatt

SEQ ID NO: 103573 - DNA, 15 bp, Homo sapiens
tttcacaaaaataat

SEQ ID NO: 103574 - DNA, 15 bp, Homo sapiens
atttcacaaaaataa

SEQ ID NO: 103575 - DNA, 15 bp, Homo sapiens
aatttcacaaaaata

SEQ ID NO: 103576 - DNA, 15 bp, Homo sapiens
taatttcacaaaaat

SEQ ID NO: 103577 - DNA, 15 bp, Homo sapiens
ataatttcacaaaaa

SEQ ID NO: 103578 - DNA, 15 bp, Homo sapiens
tataatttcacaaaa

SEQ ID NO: 103579 - DNA, 15 bp, Homo sapiens
atataatttcacaaa

SEQ ID NO: 103580 - DNA, 15 bp, Homo sapiens
gatataatttcacaa

SEQ ID NO: 103581 - DNA, 15 bp, Homo sapiens
tgatataatttcaca

SEQ ID NO: 103582 - DNA, 15 bp, Homo sapiens
atgatataatttcac

SEQ ID NO: 103583 - DNA, 15 bp, Homo sapiens
tatgatataatttca

SEQ ID NO: 103584 - DNA, 15 bp, Homo sapiens
atatgatataatttc

SEQ ID NO: 103585 - DNA, 15 bp, Homo sapiens
tatatgatataattt

SEQ ID NO: 103586 - DNA, 15 bp, Homo sapiens
atatatgatataatt

SEQ ID NO: 103587 - DNA, 15 bp, Homo sapiens
gatatatgatataat

SEQ ID NO: 103588 - DNA, 15 bp, Homo sapiens
tgatatatgatataa

SEQ ID NO: 103589 - DNA, 15 bp, Homo sapiens
gtgatatatgatata

SEQ ID NO: 103590 - DNA, 15 bp, Homo sapiens
agtgatatatgatat

SEQ ID NO: 103591 - DNA, 15 bp, Homo sapiens
aagtgatatatgata

SEQ ID NO: 103592 - DNA, 15 bp, Homo sapiens
caagtgatatatgat

SEQ ID NO: 103593 - DNA, 15 bp, Homo sapiens
acaagtgatatatga

SEQ ID NO: 103594 - DNA, 15 bp, Homo sapiens
cacaagtgatatatg

SEQ ID NO: 103595 - DNA, 15 bp, Homo sapiens
gcacaagtgatatat

SEQ ID NO: 103596 - DNA, 15 bp, Homo sapiens
agcacaagtgatata

SEQ ID NO: 103597 - DNA, 15 bp, Homo sapiens
tagcacaagtgatat

SEQ ID NO: 103598 - DNA, 15 bp, Homo sapiens
ttagcacaagtgata

SEQ ID NO: 103599 - DNA, 15 bp, Homo sapiens
attagcacaagtgat

SEQ ID NO: 103600 - DNA, 15 bp, Homo sapiens
aattagcacaagtga

SEQ ID NO: 103601 - DNA, 15 bp, Homo sapiens
aaattagcacaagtg

SEQ ID NO: 103602 - DNA, 15 bp, Homo sapiens
gaaattagcacaagt

SEQ ID NO: 103603 - DNA, 15 bp, Homo sapiens
agaaattagcacaag

SEQ ID NO: 103604 - DNA, 15 bp, Homo sapiens
gagaaattagcacaa

SEQ ID NO: 103605 - DNA, 15 bp, Homo sapiens
tgagaaattagcaca

SEQ ID NO: 103606 - DNA, 15 bp, Homo sapiens
ttgagaaattagcac

SEQ ID NO: 103607 - DNA, 15 bp, Homo sapiens
attgagaaattagca

SEQ ID NO: 103608 - DNA, 15 bp, Homo sapiens
aattgagaaattagc

SEQ ID NO: 103609 - DNA, 15 bp, Homo sapiens
aaattgagaaattag

SEQ ID NO: 103610 - DNA, 15 bp, Homo sapiens
aaaattgagaaatta

SEQ ID NO: 103611 - DNA, 15 bp, Homo sapiens
taaaattgagaaatt

SEQ ID NO: 103612 - DNA, 15 bp, Homo sapiens
ataaaattgagaaat

SEQ ID NO: 103613 - DNA, 15 bp, Homo sapiens
cataaaattgagaaa

SEQ ID NO: 103614 - DNA, 15 bp, Homo sapiens
gcataaaattgagaa

SEQ ID NO: 103615 - DNA, 15 bp, Homo sapiens
tgcataaaattgaga

SEQ ID NO: 103616 - DNA, 15 bp, Homo sapiens
atgcataaaattgag

SEQ ID NO: 103617 - DNA, 15 bp, Homo sapiens
aatgcataaaattga

SEQ ID NO: 103618 - DNA, 15 bp, Homo sapiens
aaatgcataaaattg

SEQ ID NO: 103619 - DNA, 15 bp, Homo sapiens
aaaatgcataaaatt

SEQ ID NO: 103620 - DNA, 15 bp, Homo sapiens
aaaaatgcataaaat

SEQ ID NO: 103621 - DNA, 15 bp, Homo sapiens
aaaaaatgcataaaa

SEQ ID NO: 103622 - DNA, 15 bp, Homo sapiens
taaaaaatgcataaa

SEQ ID NO: 103623 - DNA, 15 bp, Homo sapiens
ttaaaaaatgcataa

SEQ ID NO: 103624 - DNA, 15 bp, Homo sapiens
attaaaaaatgcata

SEQ ID NO: 103625 - DNA, 15 bp, Homo sapiens
gattaaaaaatgcat

SEQ ID NO: 103626 - DNA, 15 bp, Homo sapiens
ggattaaaaaatgca

SEQ ID NO: 103627 - DNA, 15 bp, Homo sapiens
gggattaaaaaatgc

SEQ ID NO: 103628 - DNA, 15 bp, Homo sapiens
tgggattaaaaaatg

SEQ ID NO: 103629 - DNA, 15 bp, Homo sapiens
atgggattaaaaaat

SEQ ID NO: 103630 - DNA, 15 bp, Homo sapiens
catgggattaaaaaa

SEQ ID NO: 103631 - DNA, 15 bp, Homo sapiens
tcatgggattaaaaa

SEQ ID NO: 103632 - DNA, 15 bp, Homo sapiens
atcatgggattaaaa

SEQ ID NO: 103633 - DNA, 15 bp, Homo sapiens
catcatgggattaaa

SEQ ID NO: 103634 - DNA, 15 bp, Homo sapiens
ccatcatgggattaa

SEQ ID NO: 103635 - DNA, 15 bp, Homo sapiens
tccatcatgggatta

SEQ ID NO: 103636 - DNA, 15 bp, Homo sapiens
atccatcatgggatt

SEQ ID NO: 103637 - DNA, 15 bp, Homo sapiens
tatccatcatgggat

SEQ ID NO: 103638 - DNA, 15 bp, Homo sapiens
atatccatcatggga

SEQ ID NO: 103639 - DNA, 15 bp, Homo sapiens
aatatccatcatggg

SEQ ID NO: 103640 - DNA, 15 bp, Homo sapiens
aaatatccatcatgg

SEQ ID NO: 103641 - DNA, 15 bp, Homo sapiens
aaaatatccatcatg

SEQ ID NO: 103642 - DNA, 15 bp, Homo sapiens
aaaaatatccatcat

SEQ ID NO: 103643 - DNA, 15 bp, Homo sapiens
caaaaatatccatca

SEQ ID NO: 103644 - DNA, 15 bp, Homo sapiens
acaaaaatatccatc

SEQ ID NO: 103645 - DNA, 15 bp, Homo sapiens
cacaaaaatatccat

SEQ ID NO: 103646 - DNA, 15 bp, Homo sapiens
tcacaaaaatatcca

SEQ ID NO: 103647 - DNA, 15 bp, Homo sapiens
ttcacaaaaatatcc

SEQ ID NO: 103648 - DNA, 15 bp, Homo sapiens
attcacaaaaatatc

SEQ ID NO: 103649 - DNA, 15 bp, Homo sapiens
aattcacaaaaatat

SEQ ID NO: 103650 - DNA, 15 bp, Homo sapiens
taattcacaaaaata

SEQ ID NO: 103651 - DNA, 15 bp, Homo sapiens
ctaattcacaaaaat

SEQ ID NO: 103652 - DNA, 15 bp, Homo sapiens
actaattcacaaaaa

SEQ ID NO: 103653 - DNA, 15 bp, Homo sapiens
tactaattcacaaaa

SEQ ID NO: 103654 - DNA, 15 bp, Homo sapiens
ttactaattcacaaa

SEQ ID NO: 103655 - DNA, 15 bp, Homo sapiens
attactaattcacaa

SEQ ID NO: 103656 - DNA, 15 bp, Homo sapiens
aattactaattcaca

SEQ ID NO: 103657 - DNA, 15 bp, Homo sapiens
aaattactaattcac

SEQ ID NO: 103658 - DNA, 15 bp, Homo sapiens
taaattactaattca

SEQ ID NO: 103659 - DNA, 15 bp, Homo sapiens
gtaaattactaattc

SEQ ID NO: 103660 - DNA, 15 bp, Homo sapiens
agtaaattactaatt

SEQ ID NO: 103661 - DNA, 15 bp, Homo sapiens
aagtaaattactaat

SEQ ID NO: 103662 - DNA, 15 bp, Homo sapiens
taagtaaattactaa

SEQ ID NO: 103663 - DNA, 15 bp, Homo sapiens
ttaagtaaattacta

SEQ ID NO: 103664 - DNA, 15 bp, Homo sapiens
gttaagtaaattact

SEQ ID NO: 103665 - DNA, 15 bp, Homo sapiens
agttaagtaaattac

SEQ ID NO: 103666 - DNA, 15 bp, Homo sapiens
aagttaagtaaatta

SEQ ID NO: 103667 - DNA, 15 bp, Homo sapiens
aaagttaagtaaatt

SEQ ID NO: 103668 - DNA, 15 bp, Homo sapiens
aaaagttaagtaaat

SEQ ID NO: 103669 - DNA, 15 bp, Homo sapiens
caaaagttaagtaaa

SEQ ID NO: 103670 - DNA, 15 bp, Homo sapiens
ccaaaagttaagtaa

SEQ ID NO: 103671 - DNA, 15 bp, Homo sapiens
accaaaagttaagta

SEQ ID NO: 103672 - DNA, 15 bp, Homo sapiens
gaccaaaagttaagt

SEQ ID NO: 103673 - DNA, 15 bp, Homo sapiens
ggaccaaaagttaag

SEQ ID NO: 103674 - DNA, 15 bp, Homo sapiens
aggaccaaaagttaa

SEQ ID NO: 103675 - DNA, 15 bp, Homo sapiens
caggaccaaaagtta

SEQ ID NO: 103676 - DNA, 15 bp, Homo sapiens
acaggaccaaaagtt

SEQ ID NO: 103677 - DNA, 15 bp, Homo sapiens
aacaggaccaaaagt

SEQ ID NO: 103678 - DNA, 15 bp, Homo sapiens
taacaggaccaaaag

SEQ ID NO: 103679 - DNA, 15 bp, Homo sapiens
gtaacaggaccaaaa

SEQ ID NO: 103680 - DNA, 15 bp, Homo sapiens
agtaacaggaccaaa

SEQ ID NO: 103681 - DNA, 15 bp, Homo sapiens
aagtaacaggaccaa

SEQ ID NO: 103682 - DNA, 15 bp, Homo sapiens
taagtaacaggacca

SEQ ID NO: 103683 - DNA, 15 bp, Homo sapiens
ctaagtaacaggacc

SEQ ID NO: 103684 - DNA, 15 bp, Homo sapiens
cctaagtaacaggac

SEQ ID NO: 103685 - DNA, 15 bp, Homo sapiens
acctaagtaacagga

SEQ ID NO: 103686 - DNA, 15 bp, Homo sapiens
tacctaagtaacagg

SEQ ID NO: 103687 - DNA, 15 bp, Homo sapiens
ctacctaagtaacag

SEQ ID NO: 103688 - DNA, 15 bp, Homo sapiens
tctacctaagtaaca

SEQ ID NO: 103689 - DNA, 15 bp, Homo sapiens
atctacctaagtaac

SEQ ID NO: 103690 - DNA, 15 bp, Homo sapiens
aatctacctaagtaa

SEQ ID NO: 103691 - DNA, 15 bp, Homo sapiens
aaatctacctaagta

SEQ ID NO: 103692 - DNA, 15 bp, Homo sapiens
aaaatctacctaagt

SEQ ID NO: 103693 - DNA, 15 bp, Homo sapiens
aaaaatctacctaag

SEQ ID NO: 103694 - DNA, 15 bp, Homo sapiens
taaaaatctacctaa

SEQ ID NO: 103695 - DNA, 15 bp, Homo sapiens
ctaaaaatctaccta

SEQ ID NO: 103696 - DNA, 15 bp, Homo sapiens
tctaaaaatctacct

SEQ ID NO: 103697 - DNA, 15 bp, Homo sapiens
ttctaaaaatctacc

SEQ ID NO: 103698 - DNA, 15 bp, Homo sapiens
tttctaaaaatctac

SEQ ID NO: 103699 - DNA, 15 bp, Homo sapiens
ttttctaaaaatcta

SEQ ID NO: 103700 - DNA, 15 bp, Homo sapiens
attttctaaaaatct

SEQ ID NO: 103701 - DNA, 15 bp, Homo sapiens
tattttctaaaaatc

SEQ ID NO: 103702 - DNA, 15 bp, Homo sapiens
atattttctaaaaat

SEQ ID NO: 103703 - DNA, 15 bp, Homo sapiens
tatattttctaaaaa

SEQ ID NO: 103704 - DNA, 15 bp, Homo sapiens
ttatattttctaaaa

SEQ ID NO: 103705 - DNA, 15 bp, Homo sapiens
attatattttctaaa

SEQ ID NO: 103706 - DNA, 15 bp, Homo sapiens
aattatattttctaa

SEQ ID NO: 103707 - DNA, 15 bp, Homo sapiens
taattatattttcta

SEQ ID NO: 103708 - DNA, 15 bp, Homo sapiens
gtaattatattttct

SEQ ID NO: 103709 - DNA, 15 bp, Homo sapiens
agtaattatattttc

SEQ ID NO: 103710 - DNA, 15 bp, Homo sapiens
aagtaattatatttt

SEQ ID NO: 103711 - DNA, 15 bp, Homo sapiens
caagtaattatattt

SEQ ID NO: 103712 - DNA, 15 bp, Homo sapiens
acaagtaattatatt

SEQ ID NO: 103713 - DNA, 15 bp, Homo sapiens
aacaagtaattatat

SEQ ID NO: 103714 - DNA, 15 bp, Homo sapiens
aaacaagtaattata

SEQ ID NO: 103715 - DNA, 15 bp, Homo sapiens
taaacaagtaattat

SEQ ID NO: 103716 - DNA, 15 bp, Homo sapiens
ttaaacaagtaatta

SEQ ID NO: 103717 - DNA, 15 bp, Homo sapiens
gttaaacaagtaatt

SEQ ID NO: 103718 - DNA, 15 bp, Homo sapiens
tgttaaacaagtaat

SEQ ID NO: 103719 - DNA, 15 bp, Homo sapiens
ttgttaaacaagtaa

SEQ ID NO: 103720 - DNA, 15 bp, Homo sapiens
tttgttaaacaagta

SEQ ID NO: 103721 - DNA, 15 bp, Homo sapiens
atttgttaaacaagt

SEQ ID NO: 103722 - DNA, 15 bp, Homo sapiens
tatttgttaaacaag

SEQ ID NO: 103723 - DNA, 15 bp, Homo sapiens
ctatttgttaaacaa

SEQ ID NO: 103724 - DNA, 15 bp, Homo sapiens
tctatttgttaaaca

SEQ ID NO: 103725 - DNA, 15 bp, Homo sapiens
gtctatttgttaaac

SEQ ID NO: 103726 - DNA, 15 bp, Homo sapiens
tgtctatttgttaaa

SEQ ID NO: 103727 - DNA, 15 bp, Homo sapiens
atgtctatttgttaa

SEQ ID NO: 103728 - DNA, 15 bp, Homo sapiens
aatgtctatttgtta

SEQ ID NO: 103729 - DNA, 15 bp, Homo sapiens
aaatgtctatttgtt

SEQ ID NO: 103730 - DNA, 15 bp, Homo sapiens
aaaatgtctatttgt

SEQ ID NO: 103731 - DNA, 15 bp, Homo sapiens
caaaatgtctatttg

SEQ ID NO: 103732 - DNA, 15 bp, Homo sapiens
ccaaaatgtctattt

SEQ ID NO: 103733 - DNA, 15 bp, Homo sapiens
cccaaaatgtctatt

SEQ ID NO: 103734 - DNA, 15 bp, Homo sapiens
ccccaaaatgtctat

SEQ ID NO: 103735 - DNA, 15 bp, Homo sapiens
tccccaaaatgtcta

SEQ ID NO: 103736 - DNA, 15 bp, Homo sapiens
atccccaaaatgtct

SEQ ID NO: 103737 - DNA, 15 bp, Homo sapiens
gatccccaaaatgtc

SEQ ID NO: 103738 - DNA, 15 bp, Homo sapiens
ggatccccaaaatgt

SEQ ID NO: 103739 - DNA, 15 bp, Homo sapiens
aggatccccaaaatg

SEQ ID NO: 103740 - DNA, 15 bp, Homo sapiens
aaggatccccaaaat

SEQ ID NO: 103741 - DNA, 15 bp, Homo sapiens
caaggatccccaaaa

SEQ ID NO: 103742 - DNA, 15 bp, Homo sapiens
tcaaggatccccaaa

SEQ ID NO: 103743 - DNA, 15 bp, Homo sapiens
atcaaggatccccaa

SEQ ID NO: 103744 - DNA, 15 bp, Homo sapiens
tatcaaggatcccca

SEQ ID NO: 103745 - DNA, 15 bp, Homo sapiens
gtatcaaggatcccc

SEQ ID NO: 103746 - DNA, 15 bp, Homo sapiens
ggtatcaaggatccc

SEQ ID NO: 103747 - DNA, 15 bp, Homo sapiens
aggtatcaaggatcc

SEQ ID NO: 103748 - DNA, 15 bp, Homo sapiens
aaggtatcaaggatc

SEQ ID NO: 103749 - DNA, 15 bp, Homo sapiens
aaaggtatcaaggat

SEQ ID NO: 103750 - DNA, 15 bp, Homo sapiens
aaaaggtatcaagga

SEQ ID NO: 103751 - DNA, 15 bp, Homo sapiens
caaaaggtatcaagg

SEQ ID NO: 103752 - DNA, 15 bp, Homo sapiens
gcaaaaggtatcaag

SEQ ID NO: 103753 - DNA, 15 bp, Homo sapiens
ggcaaaaggtatcaa

SEQ ID NO: 103754 - DNA, 15 bp, Homo sapiens
aggcaaaaggtatca

SEQ ID NO: 103755 - DNA, 15 bp, Homo sapiens
aaggcaaaaggtatc

SEQ ID NO: 103756 - DNA, 15 bp, Homo sapiens
taaggcaaaaggtat

SEQ ID NO: 103757 - DNA, 15 bp, Homo sapiens
ctaaggcaaaaggta

SEQ ID NO: 103758 - DNA, 15 bp, Homo sapiens
actaaggcaaaaggt

SEQ ID NO: 103759 - DNA, 15 bp, Homo sapiens
tactaaggcaaaagg

SEQ ID NO: 103760 - DNA, 15 bp, Homo sapiens
ttactaaggcaaaag

SEQ ID NO: 103761 - DNA, 15 bp, Homo sapiens
tttactaaggcaaaa

SEQ ID NO: 103762 - DNA, 15 bp, Homo sapiens
atttactaaggcaaa

SEQ ID NO: 103763 - DNA, 15 bp, Homo sapiens
catttactaaggcaa

SEQ ID NO: 103764 - DNA, 15 bp, Homo sapiens
gcatttactaaggca

SEQ ID NO: 103765 - DNA, 15 bp, Homo sapiens
tgcatttactaaggc

SEQ ID NO: 103766 - DNA, 15 bp, Homo sapiens
atgcatttactaagg

SEQ ID NO: 103767 - DNA, 15 bp, Homo sapiens
aatgcatttactaag

SEQ ID NO: 103768 - DNA, 15 bp, Homo sapiens
taatgcatttactaa

SEQ ID NO: 103769 - DNA, 15 bp, Homo sapiens
ataatgcatttacta

SEQ ID NO: 103770 - DNA, 15 bp, Homo sapiens
aataatgcatttact

SEQ ID NO: 103771 - DNA, 15 bp, Homo sapiens
taataatgcatttac

SEQ ID NO: 103772 - DNA, 15 bp, Homo sapiens
ataataatgcattta

SEQ ID NO: 103773 - DNA, 15 bp, Homo sapiens
aataataatgcattt

SEQ ID NO: 103774 - DNA, 15 bp, Homo sapiens
aaataataatgcatt

SEQ ID NO: 103775 - DNA, 15 bp, Homo sapiens
aaaataataatgcat

SEQ ID NO: 103776 - DNA, 15 bp, Homo sapiens
aaaaataataatgca

SEQ ID NO: 103777 - DNA, 15 bp, Homo sapiens
aaaaaataataatgc

SEQ ID NO: 103778 - DNA, 15 bp, Homo sapiens
aaaaaaataataatg

SEQ ID NO: 103779 - DNA, 15 bp, Homo sapiens
gaaaaaaaaataata

SEQ ID NO: 103780 - DNA, 15 bp, Homo sapiens
ggaaaaaaaaataat

SEQ ID NO: 103781 - DNA, 15 bp, Homo sapiens
gggaaaaaaaaataa

SEQ ID NO: 103782 - DNA, 15 bp, Homo sapiens
tgggaaaaaaaaata

SEQ ID NO: 103783 - DNA, 15 bp, Homo sapiens
atgggaaaaaaaaat

SEQ ID NO: 103784 - DNA, 15 bp, Homo sapiens
gatgggaaaaaaaaa

SEQ ID NO: 103785 - DNA, 15 bp, Homo sapiens
agatgggaaaaaaaa

SEQ ID NO: 103786 - DNA, 15 bp, Homo sapiens
gagatgggaaaaaaa

SEQ ID NO: 103787 - DNA, 15 bp, Homo sapiens
ggagatgggaaaaaa

SEQ ID NO: 103788 - DNA, 15 bp, Homo sapiens
tggagatgggaaaaa

SEQ ID NO: 103789 - DNA, 15 bp, Homo sapiens
atggagatgggaaaa

SEQ ID NO: 103790 - DNA, 15 bp, Homo sapiens
aatggagatgggaaa

SEQ ID NO: 103791 - DNA, 15 bp, Homo sapiens
gaatggagatgggaa

SEQ ID NO: 103792 - DNA, 15 bp, Homo sapiens
ggaatggagatggga

SEQ ID NO: 103793 - DNA, 15 bp, Homo sapiens
tggaatggagatggg

SEQ ID NO: 103794 - DNA, 15 bp, Homo sapiens
ctggaatggagatgg

SEQ ID NO: 103795 - DNA, 15 bp, Homo sapiens
actggaatggagatg

SEQ ID NO: 103796 - DNA, 15 bp, Homo sapiens
gactggaatggagat

SEQ ID NO: 103797 - DNA, 15 bp, Homo sapiens
agactggaatggaga

SEQ ID NO: 103798 - DNA, 15 bp, Homo sapiens
gagactggaatggag

SEQ ID NO: 103799 - DNA, 15 bp, Homo sapiens
agagactggaatgga

SEQ ID NO: 103800 - DNA, 15 bp, Homo sapiens
cagagactggaatgg

SEQ ID NO: 103801 - DNA, 15 bp, Homo sapiens
ccagagactggaatg

SEQ ID NO: 103802 - DNA, 15 bp, Homo sapiens
tccagagactggaat

SEQ ID NO: 103803 - DNA, 15 bp, Homo sapiens
ttccagagactggaa

SEQ ID NO: 103804 - DNA, 15 bp, Homo sapiens
attccagagactgga

SEQ ID NO: 103805 - DNA, 15 bp, Homo sapiens
gattccagagactgg

SEQ ID NO: 103806 - DNA, 15 bp, Homo sapiens
agattccagagactg

SEQ ID NO: 103807 - DNA, 15 bp, Homo sapiens
cagattccagagact

SEQ ID NO: 103808 - DNA, 15 bp, Homo sapiens
acagattccagagac

SEQ ID NO: 103809 - DNA, 15 bp, Homo sapiens
aacagattccagaga

SEQ ID NO: 103810 - DNA, 15 bp, Homo sapiens
gaacagattccagag

SEQ ID NO: 103811 - DNA, 15 bp, Homo sapiens
agaacagattccaga

SEQ ID NO: 103812 - DNA, 15 bp, Homo sapiens
cagaacagattccag

SEQ ID NO: 103813 - DNA, 15 bp, Homo sapiens
gcagaacagattcca

SEQ ID NO: 103814 - DNA, 15 bp, Homo sapiens
cgcagaacagattcc

SEQ ID NO: 103815 - DNA, 15 bp, Homo sapiens
gcgcagaacagattc

SEQ ID NO: 103816 - DNA, 15 bp, Homo sapiens
ggcgcagaacagatt

SEQ ID NO: 103817 - DNA, 15 bp, Homo sapiens
tggcgcagaacagat

SEQ ID NO: 103818 - DNA, 15 bp, Homo sapiens
gtggcgcagaacaga

SEQ ID NO: 103819 - DNA, 15 bp, Homo sapiens
ggtggcgcagaacag

SEQ ID NO: 103820 - DNA, 15 bp, Homo sapiens
gggtggcgcagaaca

SEQ ID NO: 103821 - DNA, 15 bp, Homo sapiens
cgggtggcgcagaac

SEQ ID NO: 103822 - DNA, 15 bp, Homo sapiens
ccgggtggcgcagaa

SEQ ID NO: 103823 - DNA, 15 bp, Homo sapiens
gccgggtggcgcaga

SEQ ID NO: 103824 - DNA, 15 bp, Homo sapiens
tgccgggtggcgcag

SEQ ID NO: 103825 - DNA, 15 bp, Homo sapiens
ctgccgggtggcgca

SEQ ID NO: 103826 - DNA, 15 bp, Homo sapiens
tctgccgggtggcgc

SEQ ID NO: 103827 - DNA, 15 bp, Homo sapiens
atctgccgggtggcg

SEQ ID NO: 103828 - DNA, 15 bp, Homo sapiens
tatctgccgggtggc

SEQ ID NO: 103829 - DNA, 15 bp, Homo sapiens
ttatctgccgggtgg

SEQ ID NO: 103830 - DNA, 15 bp, Homo sapiens
attatctgccgggtg

SEQ ID NO: 103831 - DNA, 15 bp, Homo sapiens
gattatctgccgggt

SEQ ID NO: 103832 - DNA, 15 bp, Homo sapiens
cgattatctgccggg

SEQ ID NO: 103833 - DNA, 15 bp, Homo sapiens
gcgattatctgccgg

SEQ ID NO: 103834 - DNA, 15 bp, Homo sapiens
tgcgattatctgccg

SEQ ID NO: 103835 - DNA, 15 bp, Homo sapiens
gtgcgattatctgcc

SEQ ID NO: 103836 - DNA, 15 bp, Homo sapiens
ggtgcgattatctgc

SEQ ID NO: 103837 - DNA, 15 bp, Homo sapiens
gggtgcgattatctg

SEQ ID NO: 103838 - DNA, 15 bp, Homo sapiens
tgggtgcgattatct

SEQ ID NO: 103839 - DNA, 15 bp, Homo sapiens
ctgggtgcgattatc

SEQ ID NO: 103840 - DNA, 15 bp, Homo sapiens
tctgggtgcgattat

SEQ ID NO: 103841 - DNA, 15 bp, Homo sapiens
atctgggtgcgatta

SEQ ID NO: 103842 - DNA, 15 bp, Homo sapiens
aatctgggtgcgatt

SEQ ID NO: 103843 - DNA, 15 bp, Homo sapiens
gaatctgggtgcgat

SEQ ID NO: 103844 - DNA, 15 bp, Homo sapiens
cgaatctgggtgcga

SEQ ID NO: 103845 - DNA, 15 bp, Homo sapiens
tcgaatctgggtgcg

SEQ ID NO: 103846 - DNA, 15 bp, Homo sapiens
ctcgaatctgggtgc

SEQ ID NO: 103847 - DNA, 15 bp, Homo sapiens
tctcgaatctgggtg

SEQ ID NO: 103848 - DNA, 15 bp, Homo sapiens
ctctcgaatctgggt

SEQ ID NO: 103849 - DNA, 15 bp, Homo sapiens
gctctcgaatctggg

SEQ ID NO: 103850 - DNA, 15 bp, Homo sapiens
agctctcgaatctgg

SEQ ID NO: 103851 - DNA, 15 bp, Homo sapiens
aagctctcgaatctg

SEQ ID NO: 103852 - DNA, 15 bp, Homo sapiens
caagctctcgaatct

SEQ ID NO: 103853 - DNA, 15 bp, Homo sapiens
ccaagctctcgaatc

SEQ ID NO: 103854 - DNA, 15 bp, Homo sapiens
gccaagctctcgaat

SEQ ID NO: 103855 - DNA, 15 bp, Homo sapiens
ggccaagctctcgaa

SEQ ID NO: 103856 - DNA, 15 bp, Homo sapiens
tggccaagctctcga

SEQ ID NO: 103857 - DNA, 15 bp, Homo sapiens
ctggccaagctctcg

SEQ ID NO: 103858 - DNA, 15 bp, Homo sapiens
tctggccaagctctc

SEQ ID NO: 103859 - DNA, 15 bp, Homo sapiens
gtctggccaagctct

SEQ ID NO: 103860 - DNA, 15 bp, Homo sapiens
agtctggccaagctc

SEQ ID NO: 103861 - DNA, 15 bp, Homo sapiens
gagtctggccaagct

SEQ ID NO: 103862 - DNA, 15 bp, Homo sapiens
agagtctggccaagc

SEQ ID NO: 103863 - DNA, 15 bp, Homo sapiens
cagagtctggccaag

SEQ ID NO: 103864 - DNA, 15 bp, Homo sapiens
tcagagtctggccaa

SEQ ID NO: 103865 - DNA, 15 bp, Homo sapiens
atcagagtctggcca

SEQ ID NO: 103866 - DNA, 15 bp, Homo sapiens
aatcagagtctggcc

SEQ ID NO: 103867 - DNA, 15 bp, Homo sapiens
caatcagagtctggc

SEQ ID NO: 103868 - DNA, 15 bp, Homo sapiens
tcaatcagagtctgg

SEQ ID NO: 103869 - DNA, 15 bp, Homo sapiens
atcaatcagagtctg

SEQ ID NO: 103870 - DNA, 15 bp, Homo sapiens
catcaatcagagtct

SEQ ID NO: 103871 - DNA, 15 bp, Homo sapiens
ccatcaatcagagtc

SEQ ID NO: 103872 - DNA, 15 bp, Homo sapiens
cccatcaatcagagt

SEQ ID NO: 103873 - DNA, 15 bp, Homo sapiens
ccccatcaatcagag

SEQ ID NO: 103874 - DNA, 15 bp, Homo sapiens
cccccatcaatcaga

SEQ ID NO: 103875 - DNA, 15 bp, Homo sapiens
ccccccatcaatcag

SEQ ID NO: 103876 - DNA, 15 bp, Homo sapiens
tccccccatcaatca

SEQ ID NO: 103877 - DNA, 15 bp, Homo sapiens
atccccccatcaatc

SEQ ID NO: 103878 - DNA, 15 bp, Homo sapiens
gatccccccatcaat

SEQ ID NO: 103879 - DNA, 15 bp, Homo sapiens
ggatccccccatcaa

SEQ ID NO: 103880 - DNA, 15 bp, Homo sapiens
aggatccccccatca

SEQ ID NO: 103881 - DNA, 15 bp, Homo sapiens
caggatccccccatc

SEQ ID NO: 103882 - DNA, 15 bp, Homo sapiens
ccaggatccccccat

SEQ ID NO: 103883 - DNA, 15 bp, Homo sapiens
tccaggatcccccca

SEQ ID NO: 103884 - DNA, 15 bp, Homo sapiens
atccaggatcccccc

SEQ ID NO: 103885 - DNA, 15 bp, Homo sapiens
catccaggatccccc

SEQ ID NO: 103886 - DNA, 15 bp, Homo sapiens
tcatccaggatcccc

SEQ ID NO: 103887 - DNA, 15 bp, Homo sapiens
atcatccaggatccc

SEQ ID NO: 103888 - DNA, 15 bp, Homo sapiens
tatcatccaggatcc

SEQ ID NO: 103889 - DNA, 15 bp, Homo sapiens
atatcatccaggatc

SEQ ID NO: 103890 - DNA, 15 bp, Homo sapiens
tatatcatccaggat

SEQ ID NO: 103891 - DNA, 15 bp, Homo sapiens
ttatatcatccagga

SEQ ID NO: 103892 - DNA, 15 bp, Homo sapiens
attatatcatccagg

SEQ ID NO: 103893 - DNA, 15 bp, Homo sapiens
gattatatcatccag

SEQ ID NO: 103894 - DNA, 15 bp, Homo sapiens
tgattatatcatcca

SEQ ID NO: 103895 - DNA, 15 bp, Homo sapiens
ctgattatatcatcc

SEQ ID NO: 103896 - DNA, 15 bp, Homo sapiens
actgattatatcatc

SEQ ID NO: 103897 - DNA, 15 bp, Homo sapiens
cactgattatatcat

SEQ ID NO: 103898 - DNA, 15 bp, Homo sapiens
tcactgattatatca

SEQ ID NO: 103899 - DNA, 15 bp, Homo sapiens
ctcactgattatatc

SEQ ID NO: 103900 - DNA, 15 bp, Homo sapiens
tctcactgattatat

SEQ ID NO: 103901 - DNA, 15 bp, Homo sapiens
ttctcactgattata

SEQ ID NO: 103902 - DNA, 15 bp, Homo sapiens
tttctcactgattat

SEQ ID NO: 103903 - DNA, 15 bp, Homo sapiens
gtttctcactgatta

SEQ ID NO: 103904 - DNA, 15 bp, Homo sapiens
agtttctcactgatt

SEQ ID NO: 103905 - DNA, 15 bp, Homo sapiens
cagtttctcactgat

SEQ ID NO: 103906 - DNA, 15 bp, Homo sapiens
ccagtttctcactga

SEQ ID NO: 103907 - DNA, 15 bp, Homo sapiens
tccagtttctcactg

SEQ ID NO: 103908 - DNA, 15 bp, Homo sapiens
ctccagtttctcact

SEQ ID NO: 103909 - DNA, 15 bp, Homo sapiens
cctccagtttctcac

SEQ ID NO: 103910 - DNA, 15 bp, Homo sapiens
gcctccagtttctca

SEQ ID NO: 103911 - DNA, 15 bp, Homo sapiens
agcctccagtttctc

SEQ ID NO: 103912 - DNA, 15 bp, Homo sapiens
aagcctccagtttct

SEQ ID NO: 103913 - DNA, 15 bp, Homo sapiens
aaagcctccagtttc

SEQ ID NO: 103914 - DNA, 15 bp, Homo sapiens
gaaagcctccagttt

SEQ ID NO: 103915 - DNA, 15 bp, Homo sapiens
tgaaagcctccagtt

SEQ ID NO: 103916 - DNA, 15 bp, Homo sapiens
ttgaaagcctccagt

SEQ ID NO: 103917 - DNA, 15 bp, Homo sapiens
gttgaaagcctccag

SEQ ID NO: 103918 - DNA, 15 bp, Homo sapiens
tgttgaaagcctcca

SEQ ID NO: 103919 - DNA, 15 bp, Homo sapiens
ctgttgaaagcctcc

SEQ ID NO: 103920 - DNA, 15 bp, Homo sapiens
gctgttgaaagcctc

SEQ ID NO: 103921 - DNA, 15 bp, Homo sapiens
ggctgttgaaagcct

SEQ ID NO: 103922 - DNA, 15 bp, Homo sapiens
cggctgttgaaagcc

SEQ ID NO: 103923 - DNA, 15 bp, Homo sapiens
tcggctgttgaaagc

SEQ ID NO: 103924 - DNA, 15 bp, Homo sapiens
atcggctgttgaaag

SEQ ID NO: 103925 - DNA, 15 bp, Homo sapiens
tatcggctgttgaaa

SEQ ID NO: 103926 - DNA, 15 bp, Homo sapiens
atatcggctgttgaa

SEQ ID NO: 103927 - DNA, 15 bp, Homo sapiens
catatcggctgttga

SEQ ID NO: 103928 - DNA, 15 bp, Homo sapiens
tcatatcggctgttg

SEQ ID NO: 103929 - DNA, 15 bp, Homo sapiens
ttcatatcggctgtt

SEQ ID NO: 103930 - DNA, 15 bp, Homo sapiens
cttcatatcggctgt

SEQ ID NO: 103931 - DNA, 15 bp, Homo sapiens
tcttcatatcggctg

SEQ ID NO: 103932 - DNA, 15 bp, Homo sapiens
atcttcatatcggct

SEQ ID NO: 103933 - DNA, 15 bp, Homo sapiens
gatcttcatatcggc

SEQ ID NO: 103934 - DNA, 15 bp, Homo sapiens
agatcttcatatcgg

SEQ ID NO: 103935 - DNA, 15 bp, Homo sapiens
tagatcttcatatcg

SEQ ID NO: 103936 - DNA, 15 bp, Homo sapiens
ttagatcttcatatc

SEQ ID NO: 103937 - DNA, 15 bp, Homo sapiens
cttagatcttcatat

SEQ ID NO: 103938 - DNA, 15 bp, Homo sapiens
acttagatcttcata

SEQ ID NO: 103939 - DNA, 15 bp, Homo sapiens
gacttagatcttcat

SEQ ID NO: 103940 - DNA, 15 bp, Homo sapiens
tgacttagatcttca

SEQ ID NO: 103941 - DNA, 15 bp, Homo sapiens
gtgacttagatcttc

SEQ ID NO: 103942 - DNA, 15 bp, Homo sapiens
ggtgacttagatctt

SEQ ID NO: 103943 - DNA, 15 bp, Homo sapiens
aggtgacttagatct

SEQ ID NO: 103944 - DNA, 15 bp, Homo sapiens
caggtgacttagatc

SEQ ID NO: 103945 - DNA, 15 bp, Homo sapiens
ccaggtgacttagat

SEQ ID NO: 103946 - DNA, 15 bp, Homo sapiens
accaggtgacttaga

SEQ ID NO: 103947 - DNA, 15 bp, Homo sapiens
taccaggtgacttag

SEQ ID NO: 103948 - DNA, 15 bp, Homo sapiens
ttaccaggtgactta

SEQ ID NO: 103949 - DNA, 15 bp, Homo sapiens
cttaccaggtgactt

SEQ ID NO: 103950 - DNA, 15 bp, Homo sapiens
tcttaccaggtgact

SEQ ID NO: 103951 - DNA, 15 bp, Homo sapiens
ctcttaccaggtgac

SEQ ID NO: 103952 - DNA, 15 bp, Homo sapiens
actcttaccaggtga

SEQ ID NO: 103953 - DNA, 15 bp, Homo sapiens
aactcttaccaggtg

SEQ ID NO: 103954 - DNA, 15 bp, Homo sapiens
caactcttaccaggt

SEQ ID NO: 103955 - DNA, 15 bp, Homo sapiens
ccaactcttaccagg

SEQ ID NO: 103956 - DNA, 15 bp, Homo sapiens
cccaactcttaccag

SEQ ID NO: 103957 - DNA, 15 bp, Homo sapiens
tcccaactcttacca

SEQ ID NO: 103958 - DNA, 15 bp, Homo sapiens
gtcccaactcttacc

SEQ ID NO: 103959 - DNA, 15 bp, Homo sapiens
tgtcccaactcttac

SEQ ID NO: 103960 - DNA, 15 bp, Homo sapiens
atgtcccaactctta

SEQ ID NO: 103961 - DNA, 15 bp, Homo sapiens
tatgtcccaactctt

SEQ ID NO: 103962 - DNA, 15 bp, Homo sapiens
gtatgtcccaactct

SEQ ID NO: 103963 - DNA, 15 bp, Homo sapiens
tgtatgtcccaactc

SEQ ID NO: 103964 - DNA, 15 bp, Homo sapiens
atgtatgtcccaact

SEQ ID NO: 103965 - DNA, 15 bp, Homo sapiens
catgtatgtcccaac

SEQ ID NO: 103966 - DNA, 15 bp, Homo sapiens
ccatgtatgtcccaa

SEQ ID NO: 103967 - DNA, 15 bp, Homo sapiens
cccatgtatgtccca

SEQ ID NO: 103968 - DNA, 15 bp, Homo sapiens
acccatgtatgtccc

SEQ ID NO: 103969 - DNA, 15 bp, Homo sapiens
cacccatgtatgtcc

SEQ ID NO: 103970 - DNA, 15 bp, Homo sapiens
acacccatgtatgtc

SEQ ID NO: 103971 - DNA, 15 bp, Homo sapiens
aacacccatgtatgt

SEQ ID NO: 103972 - DNA, 15 bp, Homo sapiens
caacacccatgtatg

SEQ ID NO: 103973 - DNA, 15 bp, Homo sapiens
tcaacacccatgtat

SEQ ID NO: 103974 - DNA, 15 bp, Homo sapiens
atcaacacccatgta

SEQ ID NO: 103975 - DNA, 15 bp, Homo sapiens
aatcaacacccatgt

SEQ ID NO: 103976 - DNA, 15 bp, Homo sapiens
taatcaacacccatg

SEQ ID NO: 103977 - DNA, 15 bp, Homo sapiens
ctaatcaacacccat

SEQ ID NO: 103978 - DNA, 15 bp, Homo sapiens
cctaatcaacaccca

SEQ ID NO: 103979 - DNA, 15 bp, Homo sapiens
acctaatcaacaccc

SEQ ID NO: 103980 - DNA, 15 bp, Homo sapiens
tacctaatcaacacc

SEQ ID NO: 103981 - DNA, 15 bp, Homo sapiens
atacctaatcaacac

SEQ ID NO: 103982 - DNA, 15 bp, Homo sapiens
aatacctaatcaaca

SEQ ID NO: 103983 - DNA, 15 bp, Homo sapiens
caatacctaatcaac

SEQ ID NO: 103984 - DNA, 15 bp, Homo sapiens
tcaatacctaatcaa

SEQ ID NO: 103985 - DNA, 15 bp, Homo sapiens
atcaatacctaatca

SEQ ID NO: 103986 - DNA, 15 bp, Homo sapiens
catcaatacctaatc

SEQ ID NO: 103987 - DNA, 15 bp, Homo sapiens
tcatcaatacctaat

SEQ ID NO: 103988 - DNA, 15 bp, Homo sapiens
ttcatcaatacctaa

SEQ ID NO: 103989 - DNA, 15 bp, Homo sapiens
cttcatcaataccta

SEQ ID NO: 103990 - DNA, 15 bp, Homo sapiens
acttcatcaatacct

SEQ ID NO: 103991 - DNA, 15 bp, Homo sapiens
cacttcatcaatacc

SEQ ID NO: 103992 - DNA, 15 bp, Homo sapiens
ccacttcatcaatac

SEQ ID NO: 103993 - DNA, 15 bp, Homo sapiens
tccacttcatcaata

SEQ ID NO: 103994 - DNA, 15 bp, Homo sapiens
ctccacttcatcaat

SEQ ID NO: 103995 - DNA, 15 bp, Homo sapiens
gctccacttcatcaa

SEQ ID NO: 103996 - DNA, 15 bp, Homo sapiens
agctccacttcatca

SEQ ID NO: 103997 - DNA, 15 bp, Homo sapiens
cagctccacttcatc

SEQ ID NO: 103998 - DNA, 15 bp, Homo sapiens
ccagctccacttcat

SEQ ID NO: 103999 - DNA, 15 bp, Homo sapiens
gccagctccacttca

SEQ ID NO: 104000 - DNA, 15 bp, Homo sapiens
ggccagctccacttc

SEQ ID NO: 104001 - DNA, 15 bp, Homo sapiens
gggccagctccactt

SEQ ID NO: 104002 - DNA, 15 bp, Homo sapiens
agggccagctccact

SEQ ID NO: 104003 - DNA, 15 bp, Homo sapiens
tagggccagctccac

SEQ ID NO: 104004 - DNA, 15 bp, Homo sapiens
ttagggccagctcca

SEQ ID NO: 104005 - DNA, 15 bp, Homo sapiens
cttagggccagctcc

SEQ ID NO: 104006 - DNA, 15 bp, Homo sapiens
gcttagggccagctc

SEQ ID NO: 104007 - DNA, 15 bp, Homo sapiens
agcttagggccagct

SEQ ID NO: 104008 - DNA, 15 bp, Homo sapiens
gagcttagggccagc

SEQ ID NO: 104009 - DNA, 15 bp, Homo sapiens
ggagcttagggccag

SEQ ID NO: 104010 - DNA, 15 bp, Homo sapiens
tggagcttagggcca

SEQ ID NO: 104011 - DNA, 15 bp, Homo sapiens
atggagcttagggcc

SEQ ID NO: 104012 - DNA, 15 bp, Homo sapiens
tatggagcttagggc

SEQ ID NO: 104013 - DNA, 15 bp, Homo sapiens
atatggagcttaggg

SEQ ID NO: 104014 - DNA, 15 bp, Homo sapiens
gatatggagcttagg

SEQ ID NO: 104015 - DNA, 15 bp, Homo sapiens
tgatatggagcttag

SEQ ID NO: 104016 - DNA, 15 bp, Homo sapiens
atgatatggagctta

SEQ ID NO: 104017 - DNA, 15 bp, Homo sapiens
tatgatatggagctt

SEQ ID NO: 104018 - DNA, 15 bp, Homo sapiens
ctatgatatggagct

SEQ ID NO: 104019 - DNA, 15 bp, Homo sapiens
tctatgatatggagc

SEQ ID NO: 104020 - DNA, 15 bp, Homo sapiens
ctctatgatatggag

SEQ ID NO: 104021 - DNA, 15 bp, Homo sapiens
gctctatgatatgga

SEQ ID NO: 104022 - DNA, 15 bp, Homo sapiens
agctctatgatatgg

SEQ ID NO: 104023 - DNA, 15 bp, Homo sapiens
aagctctatgatatg

SEQ ID NO: 104024 - DNA, 15 bp, Homo sapiens
aaagctctatgatat

SEQ ID NO: 104025 - DNA, 15 bp, Homo sapiens
taaagctctatgata

SEQ ID NO: 104026 - DNA, 15 bp, Homo sapiens
ttaaagctctatgat

SEQ ID NO: 104027 - DNA, 15 bp, Homo sapiens
attaaagctctatga

SEQ ID NO: 104028 - DNA, 15 bp, Homo sapiens
cattaaagctctatg

SEQ ID NO: 104029 - DNA, 15 bp, Homo sapiens
acattaaagctctat

SEQ ID NO: 104030 - DNA, 15 bp, Homo sapiens
aacattaaagctcta

SEQ ID NO: 104031 - DNA, 15 bp, Homo sapiens
caacattaaagctct

SEQ ID NO: 104032 - DNA, 15 bp, Homo sapiens
ccaacattaaagctc

SEQ ID NO: 104033 - DNA, 15 bp, Homo sapiens
tccaacattaaagct

SEQ ID NO: 104034 - DNA, 15 bp, Homo sapiens
ttccaacattaaagc

SEQ ID NO: 104035 - DNA, 15 bp, Homo sapiens
tttccaacattaaag

SEQ ID NO: 104036 - DNA, 15 bp, Homo sapiens
ttttccaacattaaa

SEQ ID NO: 104037 - DNA, 15 bp, Homo sapiens
tttttccaacattaa

SEQ ID NO: 104038 - DNA, 15 bp, Homo sapiens
atttttccaacatta

SEQ ID NO: 104039 - DNA, 15 bp, Homo sapiens
gatttttccaacatt

SEQ ID NO: 104040 - DNA, 15 bp, Homo sapiens
agatttttccaacat

SEQ ID NO: 104041 - DNA, 15 bp, Homo sapiens
aagatttttccaaca

SEQ ID NO: 104042 - DNA, 15 bp, Homo sapiens
aaagatttttccaac

SEQ ID NO: 104043 - DNA, 15 bp, Homo sapiens
taaagatttttccaa

SEQ ID NO: 104044 - DNA, 15 bp, Homo sapiens
ttaaagatttttcca

SEQ ID NO: 104045 - DNA, 15 bp, Homo sapiens
attaaagatttttcc

SEQ ID NO: 104046 - DNA, 15 bp, Homo sapiens
cattaaagatttttc

SEQ ID NO: 104047 - DNA, 15 bp, Homo sapiens
acattaaagattttt

SEQ ID NO: 104048 - DNA, 15 bp, Homo sapiens
aacattaaagatttt

SEQ ID NO: 104049 - DNA, 15 bp, Homo sapiens
caacattaaagattt

SEQ ID NO: 104050 - DNA, 15 bp, Homo sapiens
ccaacattaaagatt

SEQ ID NO: 104051 - DNA, 15 bp, Homo sapiens
accaacattaaagat

SEQ ID NO: 104052 - DNA, 15 bp, Homo sapiens
aaccaacattaaaga

SEQ ID NO: 104053 - DNA, 15 bp, Homo sapiens
taaccaacattaaag

SEQ ID NO: 104054 - DNA, 15 bp, Homo sapiens
ttaaccaacattaaa

SEQ ID NO: 104055 - DNA, 15 bp, Homo sapiens
tttaaccaacattaa

SEQ ID NO: 104056 - DNA, 15 bp, Homo sapiens
ctttaaccaacatta

SEQ ID NO: 104057 - DNA, 15 bp, Homo sapiens
actttaaccaacatt

SEQ ID NO: 104058 - DNA, 15 bp, Homo sapiens
aactttaaccaacat

SEQ ID NO: 104059 - DNA, 15 bp, Homo sapiens
caactttaaccaaca

SEQ ID NO: 104060 - DNA, 15 bp, Homo sapiens
ccaactttaaccaac

SEQ ID NO: 104061 - DNA, 15 bp, Homo sapiens
accaactttaaccaa

SEQ ID NO: 104062 - DNA, 15 bp, Homo sapiens
taccaactttaacca

SEQ ID NO: 104063 - DNA, 15 bp, Homo sapiens
ttaccaactttaacc

SEQ ID NO: 104064 - DNA, 15 bp, Homo sapiens
gttaccaactttaac

SEQ ID NO: 104065 - DNA, 15 bp, Homo sapiens
ggttaccaactttaa

SEQ ID NO: 104066 - DNA, 15 bp, Homo sapiens
tggttaccaacttta

SEQ ID NO: 104067 - DNA, 15 bp, Homo sapiens
ttggttaccaacttt

SEQ ID NO: 104068 - DNA, 15 bp, Homo sapiens
attggttaccaactt

SEQ ID NO: 104069 - DNA, 15 bp, Homo sapiens
cattggttaccaact

SEQ ID NO: 104070 - DNA, 15 bp, Homo sapiens
gcattggttaccaac

SEQ ID NO: 104071 - DNA, 15 bp, Homo sapiens
agcattggttaccaa

SEQ ID NO: 104072 - DNA, 15 bp, Homo sapiens
tagcattggttacca

SEQ ID NO: 104073 - DNA, 15 bp, Homo sapiens
ttagcattggttacc

SEQ ID NO: 104074 - DNA, 15 bp, Homo sapiens
gttagcattggttac

SEQ ID NO: 104075 - DNA, 15 bp, Homo sapiens
tgttagcattggtta

SEQ ID NO: 104076 - DNA, 15 bp, Homo sapiens
ctgttagcattggtt

SEQ ID NO: 104077 - DNA, 15 bp, Homo sapiens
cctgttagcattggt

SEQ ID NO: 104078 - DNA, 15 bp, Homo sapiens
ccctgttagcattgg

SEQ ID NO: 104079 - DNA, 15 bp, Homo sapiens
cccctgttagcattg

SEQ ID NO: 104080 - DNA, 15 bp, Homo sapiens
gcccctgttagcatt

SEQ ID NO: 104081 - DNA, 15 bp, Homo sapiens
tgcccctgttagcat

SEQ ID NO: 104082 - DNA, 15 bp, Homo sapiens
atgcccctgttagca

SEQ ID NO: 104083 - DNA, 15 bp, Homo sapiens
aatgcccctgttagc

SEQ ID NO: 104084 - DNA, 15 bp, Homo sapiens
caatgcccctgttag

SEQ ID NO: 104085 - DNA, 15 bp, Homo sapiens
tcaatgcccctgtta

SEQ ID NO: 104086 - DNA, 15 bp, Homo sapiens
ctcaatgcccctgtt

SEQ ID NO: 104087 - DNA, 15 bp, Homo sapiens
cctcaatgcccctgt

SEQ ID NO: 104088 - DNA, 15 bp, Homo sapiens
ccctcaatgcccctg

SEQ ID NO: 104089 - DNA, 15 bp, Homo sapiens
accctcaatgcccct

SEQ ID NO: 104090 - DNA, 15 bp, Homo sapiens
taccctcaatgcccc

SEQ ID NO: 104091 - DNA, 15 bp, Homo sapiens
ataccctcaatgccc

SEQ ID NO: 104092 - DNA, 15 bp, Homo sapiens
aataccctcaatgcc

SEQ ID NO: 104093 - DNA, 15 bp, Homo sapiens
caataccctcaatgc

SEQ ID NO: 104094 - DNA, 15 bp, Homo sapiens
tcaataccctcaatg

SEQ ID NO: 104095 - DNA, 15 bp, Homo sapiens
ttcaataccctcaat

SEQ ID NO: 104096 - DNA, 15 bp, Homo sapiens
tttcaataccctcaa

SEQ ID NO: 104097 - DNA, 15 bp, Homo sapiens
atttcaataccctca

SEQ ID NO: 104098 - DNA, 15 bp, Homo sapiens
tatttcaataccctc

SEQ ID NO: 104099 - DNA, 15 bp, Homo sapiens
atatttcaataccct

SEQ ID NO: 104100 - DNA, 15 bp, Homo sapiens
aatatttcaataccc

SEQ ID NO: 104101 - DNA, 15 bp, Homo sapiens
gaatatttcaatacc

SEQ ID NO: 104102 - DNA, 15 bp, Homo sapiens
tgaatatttcaatac

SEQ ID NO: 104103 - DNA, 15 bp, Homo sapiens
ctgaatatttcaata

SEQ ID NO: 104104 - DNA, 15 bp, Homo sapiens
tctgaatatttcaat

SEQ ID NO: 104105 - DNA, 15 bp, Homo sapiens
ttctgaatatttcaa

SEQ ID NO: 104106 - DNA, 15 bp, Homo sapiens
tttctgaatatttca

SEQ ID NO: 104107 - DNA, 15 bp, Homo sapiens
ctttctgaatatttc

SEQ ID NO: 104108 - DNA, 15 bp, Homo sapiens
cctttctgaatattt

SEQ ID NO: 104109 - DNA, 15 bp, Homo sapiens
tcctttctgaatatt

SEQ ID NO: 104110 - DNA, 15 bp, Homo sapiens
ttcctttctgaatat

SEQ ID NO: 104111 - DNA, 15 bp, Homo sapiens
cttcctttctgaata

SEQ ID NO: 104112 - DNA, 15 bp, Homo sapiens
tcttcctttctgaat

SEQ ID NO: 104113 - DNA, 15 bp, Homo sapiens
ttcttcctttctgaa

SEQ ID NO: 104114 - DNA, 15 bp, Homo sapiens
attcttcctttctga

SEQ ID NO: 104115 - DNA, 15 bp, Homo sapiens
tattcttcctttctg

SEQ ID NO: 104116 - DNA, 15 bp, Homo sapiens
ctattcttcctttct

SEQ ID NO: 104117 - DNA, 15 bp, Homo sapiens
tctattcttcctttc

SEQ ID NO: 104118 - DNA, 15 bp, Homo sapiens
atctattcttccttt

SEQ ID NO: 104119 - DNA, 15 bp, Homo sapiens
gatctattcttcctt

SEQ ID NO: 104120 - DNA, 15 bp, Homo sapiens
agatctattcttcct

SEQ ID NO: 104121 - DNA, 15 bp, Homo sapiens
tagatctattcttcc

SEQ ID NO: 104122 - DNA, 15 bp, Homo sapiens
ttagatctattcttc

SEQ ID NO: 104123 - DNA, 15 bp, Homo sapiens
gttagatctattctt

SEQ ID NO: 104124 - DNA, 15 bp, Homo sapiens
tgttagatctattct

SEQ ID NO: 104125 - DNA, 15 bp, Homo sapiens
gtgttagatctattc

SEQ ID NO: 104126 - DNA, 15 bp, Homo sapiens
agtgttagatctatt

SEQ ID NO: 104127 - DNA, 15 bp, Homo sapiens
gagtgttagatctat

SEQ ID NO: 104128 - DNA, 15 bp, Homo sapiens
agagtgttagatcta

SEQ ID NO: 104129 - DNA, 15 bp, Homo sapiens
tagagtgttagatct

SEQ ID NO: 104130 - DNA, 15 bp, Homo sapiens
ttagagtgttagatc

SEQ ID NO: 104131 - DNA, 15 bp, Homo sapiens
cttagagtgttagat

SEQ ID NO: 104132 - DNA, 15 bp, Homo sapiens
tcttagagtgttaga

SEQ ID NO: 104133 - DNA, 15 bp, Homo sapiens
gtcttagagtgttag

SEQ ID NO: 104134 - DNA, 15 bp, Homo sapiens
tgtcttagagtgtta

SEQ ID NO: 104135 - DNA, 15 bp, Homo sapiens
ctgtcttagagtgtt

SEQ ID NO: 104136 - DNA, 15 bp, Homo sapiens
tctgtcttagagtgt

SEQ ID NO: 104137 - DNA, 15 bp, Homo sapiens
ttctgtcttagagtg

SEQ ID NO: 104138 - DNA, 15 bp, Homo sapiens
gttctgtcttagagt

SEQ ID NO: 104139 - DNA, 15 bp, Homo sapiens
agttctgtcttagag

SEQ ID NO: 104140 - DNA, 15 bp, Homo sapiens
cagttctgtcttaga

SEQ ID NO: 104141 - DNA, 15 bp, Homo sapiens
ccagttctgtcttag

SEQ ID NO: 104142 - DNA, 15 bp, Homo sapiens
tccagttctgtctta

SEQ ID NO: 104143 - DNA, 15 bp, Homo sapiens
atccagttctgtctt

SEQ ID NO: 104144 - DNA, 15 bp, Homo sapiens
catccagttctgtct

SEQ ID NO: 104145 - DNA, 15 bp, Homo sapiens
tcatccagttctgtc

SEQ ID NO: 104146 - DNA, 15 bp, Homo sapiens
atcatccagttctgt

SEQ ID NO: 104147 - DNA, 15 bp, Homo sapiens
aatcatccagttctg

SEQ ID NO: 104148 - DNA, 15 bp, Homo sapiens
taatcatccagttct

SEQ ID NO: 104149 - DNA, 15 bp, Homo sapiens
ttaatcatccagttc

SEQ ID NO: 104150 - DNA, 15 bp, Homo sapiens
tttaatcatccagtt

SEQ ID NO: 104151 - DNA, 15 bp, Homo sapiens
ttttaatcatccagt

SEQ ID NO: 104152 - DNA, 15 bp, Homo sapiens
tttttaatcatccag

SEQ ID NO: 104153 - DNA, 15 bp, Homo sapiens
ttttttaatcatcca

SEQ ID NO: 104154 - DNA, 15 bp, Homo sapiens
tttttttaatcatcc

SEQ ID NO: 104155 - DNA, 15 bp, Homo sapiens
atttttttaatcatc

SEQ ID NO: 104156 - DNA, 15 bp, Homo sapiens
aatttttttaatcat

SEQ ID NO: 104157 - DNA, 15 bp, Homo sapiens
taatttttttaatca

SEQ ID NO: 104158 - DNA, 15 bp, Homo sapiens
ataatttttttaatc

SEQ ID NO: 104159 - DNA, 15 bp, Homo sapiens
aataatttttttaat

SEQ ID NO: 104160 - DNA, 15 bp, Homo sapiens
aaataatttttttaa

SEQ ID NO: 104161 - DNA, 15 bp, Homo sapiens
aaaataattttttta

SEQ ID NO: 104162 - DNA, 15 bp, Homo sapiens
aaaaataattttttt

SEQ ID NO: 104163 - DNA, 15 bp, Homo sapiens
caaaaataatttttt

SEQ ID NO: 104164 - DNA, 15 bp, Homo sapiens
tcaaaaataattttt

SEQ ID NO: 104165 - DNA, 15 bp, Homo sapiens
ctcaaaaataatttt

SEQ ID NO: 104166 - DNA, 15 bp, Homo sapiens
tctcaaaaataattt

SEQ ID NO: 104167 - DNA, 15 bp, Homo sapiens
atctcaaaaataatt

SEQ ID NO: 104168 - DNA, 15 bp, Homo sapiens
aatctcaaaaataat

SEQ ID NO: 104169 - DNA, 15 bp, Homo sapiens
taatctcaaaaataa

SEQ ID NO: 104170 - DNA, 15 bp, Homo sapiens
gtaatctcaaaaata

SEQ ID NO: 104171 - DNA, 15 bp, Homo sapiens
agtaatctcaaaaat

SEQ ID NO: 104172 - DNA, 15 bp, Homo sapiens
aagtaatctcaaaaa

SEQ ID NO: 104173 - DNA, 15 bp, Homo sapiens
gaagtaatctcaaaa

SEQ ID NO: 104174 - DNA, 15 bp, Homo sapiens
agaagtaatctcaaa

SEQ ID NO: 104175 - DNA, 15 bp, Homo sapiens
tagaagtaatctcaa

SEQ ID NO: 104176 - DNA, 15 bp, Homo sapiens
gtagaagtaatctca

SEQ ID NO: 104177 - DNA, 15 bp, Homo sapiens
agtagaagtaatctc

SEQ ID NO: 104178 - DNA, 15 bp, Homo sapiens
aagtagaagtaatct

SEQ ID NO: 104179 - DNA, 15 bp, Homo sapiens
taagtagaagtaatc

SEQ ID NO: 104180 - DNA, 15 bp, Homo sapiens
gtaagtagaagtaat

SEQ ID NO: 104181 - DNA, 15 bp, Homo sapiens
tgtaagtagaagtaa

SEQ ID NO: 104182 - DNA, 15 bp, Homo sapiens
ttgtaagtagaagta

SEQ ID NO: 104183 - DNA, 15 bp, Homo sapiens
tttgtaagtagaagt

SEQ ID NO: 104184 - DNA, 15 bp, Homo sapiens
gtttgtaagtagaag

SEQ ID NO: 104185 - DNA, 15 bp, Homo sapiens
tgtttgtaagtagaa

SEQ ID NO: 104186 - DNA, 15 bp, Homo sapiens
atgtttgtaagtaga

SEQ ID NO: 104187 - DNA, 15 bp, Homo sapiens
aatgtttgtaagtag

SEQ ID NO: 104188 - DNA, 15 bp, Homo sapiens
aaatgtttgtaagta

SEQ ID NO: 104189 - DNA, 15 bp, Homo sapiens
taaatgtttgtaagt

SEQ ID NO: 104190 - DNA, 15 bp, Homo sapiens
ttaaatgtttgtaag

SEQ ID NO: 104191 - DNA, 15 bp, Homo sapiens
attaaatgtttgtaa

SEQ ID NO: 104192 - DNA, 15 bp, Homo sapiens
aattaaatgtttgta

SEQ ID NO: 104193 - DNA, 15 bp, Homo sapiens
aaattaaatgtttgt

SEQ ID NO: 104194 - DNA, 15 bp, Homo sapiens
aaaattaaatgtttg

SEQ ID NO: 104195 - DNA, 15 bp, Homo sapiens
gaaaattaaatgttt

SEQ ID NO: 104196 - DNA, 15 bp, Homo sapiens
tgaaaattaaatgtt

SEQ ID NO: 104197 - DNA, 15 bp, Homo sapiens
atgaaaattaaatgt

SEQ ID NO: 104198 - DNA, 15 bp, Homo sapiens
aatgaaaattaaatg

SEQ ID NO: 104199 - DNA, 15 bp, Homo sapiens
taatgaaaattaaat

SEQ ID NO: 104200 - DNA, 15 bp, Homo sapiens
ttaatgaaaattaaa

SEQ ID NO: 104201 - DNA, 15 bp, Homo sapiens
cttaatgaaaattaa

SEQ ID NO: 104202 - DNA, 15 bp, Homo sapiens
ccttaatgaaaatta

SEQ ID NO: 104203 - DNA, 15 bp, Homo sapiens
tccttaatgaaaatt

SEQ ID NO: 104204 - DNA, 15 bp, Homo sapiens
atccttaatgaaaat

SEQ ID NO: 104205 - DNA, 15 bp, Homo sapiens
gatccttaatgaaaa

SEQ ID NO: 104206 - DNA, 15 bp, Homo sapiens
tgatccttaatgaaa

SEQ ID NO: 104207 - DNA, 15 bp, Homo sapiens
atgatccttaatgaa

SEQ ID NO: 104208 - DNA, 15 bp, Homo sapiens
tatgatccttaatga

SEQ ID NO: 104209 - DNA, 15 bp, Homo sapiens
atatgatccttaatg

SEQ ID NO: 104210 - DNA, 15 bp, Homo sapiens
catatgatccttaat

SEQ ID NO: 104211 - DNA, 15 bp, Homo sapiens
tcatatgatccttaa

SEQ ID NO: 104212 - DNA, 15 bp, Homo sapiens
atcatatgatcctta

SEQ ID NO: 104213 - DNA, 15 bp, Homo sapiens
tatcatatgatcctt

SEQ ID NO: 104214 - DNA, 15 bp, Homo sapiens
ctatcatatgatcct

SEQ ID NO: 104215 - DNA, 15 bp, Homo sapiens
gctatcatatgatcc

SEQ ID NO: 104216 - DNA, 15 bp, Homo sapiens
agctatcatatgatc

SEQ ID NO: 104217 - DNA, 15 bp, Homo sapiens
cagctatcatatgat

SEQ ID NO: 104218 - DNA, 15 bp, Homo sapiens
acagctatcatatga

SEQ ID NO: 104219 - DNA, 15 bp, Homo sapiens
tacagctatcatatg

SEQ ID NO: 104220 - DNA, 15 bp, Homo sapiens
atacagctatcatat

SEQ ID NO: 104221 - DNA, 15 bp, Homo sapiens
tatacagctatcata

SEQ ID NO: 104222 - DNA, 15 bp, Homo sapiens
atatacagctatcat

SEQ ID NO: 104223 - DNA, 15 bp, Homo sapiens
tatatacagctatca

SEQ ID NO: 104224 - DNA, 15 bp, Homo sapiens
ttatatacagctatc

SEQ ID NO: 104225 - DNA, 15 bp, Homo sapiens
cttatatacagctat

SEQ ID NO: 104226 - DNA, 15 bp, Homo sapiens
tcttatatacagcta

SEQ ID NO: 104227 - DNA, 15 bp, Homo sapiens
ttcttatatacagct

SEQ ID NO: 104228 - DNA, 15 bp, Homo sapiens
gttcttatatacagc

SEQ ID NO: 104229 - DNA, 15 bp, Homo sapiens
tgttcttatatacag

SEQ ID NO: 104230 - DNA, 15 bp, Homo sapiens
ttgttcttatataca

SEQ ID NO: 104231 - DNA, 15 bp, Homo sapiens
gttgttcttatatac

SEQ ID NO: 104232 - DNA, 15 bp, Homo sapiens
tgttgttcttatata

SEQ ID NO: 104233 - DNA, 15 bp, Homo sapiens
ttgttgttcttatat

SEQ ID NO: 104234 - DNA, 15 bp, Homo sapiens
gttgttgttcttata

SEQ ID NO: 104235 - DNA, 15 bp, Homo sapiens
agttgttgttcttat

SEQ ID NO: 104236 - DNA, 15 bp, Homo sapiens
gagttgttgttctta

SEQ ID NO: 104237 - DNA, 15 bp, Homo sapiens
tgagttgttgttctt

SEQ ID NO: 104238 - DNA, 15 bp, Homo sapiens
atgagttgttgttct

SEQ ID NO: 104239 - DNA, 15 bp, Homo sapiens
tatgagttgttgttc

SEQ ID NO: 104240 - DNA, 15 bp, Homo sapiens
gtatgagttgttgtt

SEQ ID NO: 104241 - DNA, 15 bp, Homo sapiens
agtatgagttgttgt

SEQ ID NO: 104242 - DNA, 15 bp, Homo sapiens
tagtatgagttgttg

SEQ ID NO: 104243 - DNA, 15 bp, Homo sapiens
atagtatgagttgtt

SEQ ID NO: 104244 - DNA, 15 bp, Homo sapiens
gatagtatgagttgt

SEQ ID NO: 104245 - DNA, 15 bp, Homo sapiens
ggatagtatgagttg

SEQ ID NO: 104246 - DNA, 15 bp, Homo sapiens
aggatagtatgagtt

SEQ ID NO: 104247 - DNA, 15 bp, Homo sapiens
taggatagtatgagt

SEQ ID NO: 104248 - DNA, 15 bp, Homo sapiens
ctaggatagtatgag

SEQ ID NO: 104249 - DNA, 15 bp, Homo sapiens
actaggatagtatga

SEQ ID NO: 104250 - DNA, 15 bp, Homo sapiens
tactaggatagtatg

SEQ ID NO: 104251 - DNA, 15 bp, Homo sapiens
ttactaggatagtat

SEQ ID NO: 104252 - DNA, 15 bp, Homo sapiens
tttactaggatagta

SEQ ID NO: 104253 - DNA, 15 bp, Homo sapiens
atttactaggatagt

SEQ ID NO: 104254 - DNA, 15 bp, Homo sapiens
tatttactaggatag

SEQ ID NO: 104255 - DNA, 15 bp, Homo sapiens
atatttactaggata

SEQ ID NO: 104256 - DNA, 15 bp, Homo sapiens
aatatttactaggat

SEQ ID NO: 104257 - DNA, 15 bp, Homo sapiens
taatatttactagga

SEQ ID NO: 104258 - DNA, 15 bp, Homo sapiens
ctaatatttactagg

SEQ ID NO: 104259 - DNA, 15 bp, Homo sapiens
cctaatatttactag

SEQ ID NO: 104260 - DNA, 15 bp, Homo sapiens
ccctaatatttacta

SEQ ID NO: 104261 - DNA, 15 bp, Homo sapiens
gccctaatatttact

SEQ ID NO: 104262 - DNA, 15 bp, Homo sapiens
ggccctaatatttac

SEQ ID NO: 104263 - DNA, 15 bp, Homo sapiens
tggccctaatattta

SEQ ID NO: 104264 - DNA, 15 bp, Homo sapiens
atggccctaatattt

SEQ ID NO: 104265 - DNA, 15 bp, Homo sapiens
catggccctaatatt

SEQ ID NO: 104266 - DNA, 15 bp, Homo sapiens
tcatggccctaatat

SEQ ID NO: 104267 - DNA, 15 bp, Homo sapiens
atcatggccctaata

SEQ ID NO: 104268 - DNA, 15 bp, Homo sapiens
tatcatggccctaat

SEQ ID NO: 104269 - DNA, 15 bp, Homo sapiens
atatcatggccctaa

SEQ ID NO: 104270 - DNA, 15 bp, Homo sapiens
aatatcatggcccta

SEQ ID NO: 104271 - DNA, 15 bp, Homo sapiens
aaatatcatggccct

SEQ ID NO: 104272 - DNA, 15 bp, Homo sapiens
gaaatatcatggccc

SEQ ID NO: 104273 - DNA, 15 bp, Homo sapiens
tgaaatatcatggcc

SEQ ID NO: 104274 - DNA, 15 bp, Homo sapiens
gtgaaatatcatggc

SEQ ID NO: 104275 - DNA, 15 bp, Homo sapiens
tgtgaaatatcatgg

SEQ ID NO: 104276 - DNA, 15 bp, Homo sapiens
atgtgaaatatcatg

SEQ ID NO: 104277 - DNA, 15 bp, Homo sapiens
tatgtgaaatatcat

SEQ ID NO: 104278 - DNA, 15 bp, Homo sapiens
ttatgtgaaatatca

SEQ ID NO: 104279 - DNA, 15 bp, Homo sapiens
cttatgtgaaatatc

SEQ ID NO: 104280 - DNA, 15 bp, Homo sapiens
gcttatgtgaaatat

SEQ ID NO: 104281 - DNA, 15 bp, Homo sapiens
agcttatgtgaaata

SEQ ID NO: 104282 - DNA, 15 bp, Homo sapiens
cagcttatgtgaaat

SEQ ID NO: 104283 - DNA, 15 bp, Homo sapiens
gcagcttatgtgaaa

SEQ ID NO: 104284 - DNA, 15 bp, Homo sapiens
agcagcttatgtgaa

SEQ ID NO: 104285 - DNA, 15 bp, Homo sapiens
cagcagcttatgtga

SEQ ID NO: 104286 - DNA, 15 bp, Homo sapiens
acagcagcttatgtg

SEQ ID NO: 104287 - DNA, 15 bp, Homo sapiens
cacagcagcttatgt

SEQ ID NO: 104288 - DNA, 15 bp, Homo sapiens
tcacagcagcttatg

SEQ ID NO: 104289 - DNA, 15 bp, Homo sapiens
ttcacagcagcttat

SEQ ID NO: 104290 - DNA, 15 bp, Homo sapiens
tttcacagcagctta

SEQ ID NO: 104291 - DNA, 15 bp, Homo sapiens
ctttcacagcagctt

SEQ ID NO: 104292 - DNA, 15 bp, Homo sapiens
gctttcacagcagct

SEQ ID NO: 104293 - DNA, 15 bp, Homo sapiens
ggctttcacagcagc

SEQ ID NO: 104294 - DNA, 15 bp, Homo sapiens
tggctttcacagcag

SEQ ID NO: 104295 - DNA, 15 bp, Homo sapiens
atggctttcacagca

SEQ ID NO: 104296 - DNA, 15 bp, Homo sapiens
tatggctttcacagc

SEQ ID NO: 104297 - DNA, 15 bp, Homo sapiens
ctatggctttcacag

SEQ ID NO: 104298 - DNA, 15 bp, Homo sapiens
actatggctttcaca

SEQ ID NO: 104299 - DNA, 15 bp, Homo sapiens
gactatggctttcac

SEQ ID NO: 104300 - DNA, 15 bp, Homo sapiens
agactatggctttca

SEQ ID NO: 104301 - DNA, 15 bp, Homo sapiens
gagactatggctttc

SEQ ID NO: 104302 - DNA, 15 bp, Homo sapiens
agagactatggcttt

SEQ ID NO: 104303 - DNA, 15 bp, Homo sapiens
aagagactatggctt

SEQ ID NO: 104304 - DNA, 15 bp, Homo sapiens
taagagactatggct

SEQ ID NO: 104305 - DNA, 15 bp, Homo sapiens
ctaagagactatggc

SEQ ID NO: 104306 - DNA, 15 bp, Homo sapiens
actaagagactatgg

SEQ ID NO: 104307 - DNA, 15 bp, Homo sapiens
aactaagagactatg

SEQ ID NO: 104308 - DNA, 15 bp, Homo sapiens
gaactaagagactat

SEQ ID NO: 104309 - DNA, 15 bp, Homo sapiens
tgaactaagagacta

SEQ ID NO: 104310 - DNA, 15 bp, Homo sapiens
atgaactaagagact

SEQ ID NO: 104311 - DNA, 15 bp, Homo sapiens
tatgaactaagagac

SEQ ID NO: 104312 - DNA, 15 bp, Homo sapiens
atatgaactaagaga

SEQ ID NO: 104313 - DNA, 15 bp, Homo sapiens
gatatgaactaagag

SEQ ID NO: 104314 - DNA, 15 bp, Homo sapiens
ggatatgaactaaga

SEQ ID NO: 104315 - DNA, 15 bp, Homo sapiens
tggatatgaactaag

SEQ ID NO: 104316 - DNA, 15 bp, Homo sapiens
ctggatatgaactaa

SEQ ID NO: 104317 - DNA, 15 bp, Homo sapiens
cctggatatgaacta

SEQ ID NO: 104318 - DNA, 15 bp, Homo sapiens
acctggatatgaact

SEQ ID NO: 104319 - DNA, 15 bp, Homo sapiens
aacctggatatgaac

SEQ ID NO: 104320 - DNA, 15 bp, Homo sapiens
caacctggatatgaa

SEQ ID NO: 104321 - DNA, 15 bp, Homo sapiens
acaacctggatatga

SEQ ID NO: 104322 - DNA, 15 bp, Homo sapiens
tacaacctggatatg

SEQ ID NO: 104323 - DNA, 15 bp, Homo sapiens
ttacaacctggatat

SEQ ID NO: 104324 - DNA, 15 bp, Homo sapiens
gttacaacctggata

SEQ ID NO: 104325 - DNA, 15 bp, Homo sapiens
tgttacaacctggat

SEQ ID NO: 104326 - DNA, 15 bp, Homo sapiens
atgttacaacctgga

SEQ ID NO: 104327 - DNA, 15 bp, Homo sapiens
tatgttacaacctgg

SEQ ID NO: 104328 - DNA, 15 bp, Homo sapiens
gtatgttacaacctg

SEQ ID NO: 104329 - DNA, 15 bp, Homo sapiens
tgtatgttacaacct

SEQ ID NO: 104330 - DNA, 15 bp, Homo sapiens
atgtatgttacaacc

SEQ ID NO: 104331 - DNA, 15 bp, Homo sapiens
tatgtatgttacaac

SEQ ID NO: 104332 - DNA, 15 bp, Homo sapiens
atatgtatgttacaa

SEQ ID NO: 104333 - DNA, 15 bp, Homo sapiens
aatatgtatgttaca

SEQ ID NO: 104334 - DNA, 15 bp, Homo sapiens
gaatatgtatgttac

SEQ ID NO: 104335 - DNA, 15 bp, Homo sapiens
cgaatatgtatgtta

SEQ ID NO: 104336 - DNA, 15 bp, Homo sapiens
acgaatatgtatgtt

SEQ ID NO: 104337 - DNA, 15 bp, Homo sapiens
tacgaatatgtatgt

SEQ ID NO: 104338 - DNA, 15 bp, Homo sapiens
atacgaatatgtatg

SEQ ID NO: 104339 - DNA, 15 bp, Homo sapiens
gatacgaatatgtat

SEQ ID NO: 104340 - DNA, 15 bp, Homo sapiens
tgatacgaatatgta

SEQ ID NO: 104341 - DNA, 15 bp, Homo sapiens
gtgatacgaatatgt

SEQ ID NO: 104342 - DNA, 15 bp, Homo sapiens
tgtgatacgaatatg

SEQ ID NO: 104343 - DNA, 15 bp, Homo sapiens
ttgtgatacgaatat

SEQ ID NO: 104344 - DNA, 15 bp, Homo sapiens
tttgtgatacgaata

SEQ ID NO: 104345 - DNA, 15 bp, Homo sapiens
atttgtgatacgaat

SEQ ID NO: 104346 - DNA, 15 bp, Homo sapiens
aatttgtgatacgaa

SEQ ID NO: 104347 - DNA, 15 bp, Homo sapiens
taatttgtgatacga

SEQ ID NO: 104348 - DNA, 15 bp, Homo sapiens
ctaatttgtgatacg

SEQ ID NO: 104349 - DNA, 15 bp, Homo sapiens
tctaatttgtgatac

SEQ ID NO: 104350 - DNA, 15 bp, Homo sapiens
ctctaatttgtgata

SEQ ID NO: 104351 - DNA, 15 bp, Homo sapiens
tctctaatttgtgat

SEQ ID NO: 104352 - DNA, 15 bp, Homo sapiens
ttctctaatttgtga

SEQ ID NO: 104353 - DNA, 15 bp, Homo sapiens
tttctctaatttgtg

SEQ ID NO: 104354 - DNA, 15 bp, Homo sapiens
ctttctctaatttgt

SEQ ID NO: 104355 - DNA, 15 bp, Homo sapiens
tctttctctaatttg

SEQ ID NO: 104356 - DNA, 15 bp, Homo sapiens
ttctttctctaattt

SEQ ID NO: 104357 - DNA, 15 bp, Homo sapiens
gttctttctctaatt

SEQ ID NO: 104358 - DNA, 15 bp, Homo sapiens
tgttctttctctaat

SEQ ID NO: 104359 - DNA, 15 bp, Homo sapiens
atgttctttctctaa

SEQ ID NO: 104360 - DNA, 15 bp, Homo sapiens
aatgttctttctcta

SEQ ID NO: 104361 - DNA, 15 bp, Homo sapiens
aaatgttctttctct

SEQ ID NO: 104362 - DNA, 15 bp, Homo sapiens
gaaatgttctttctc

SEQ ID NO: 104363 - DNA, 15 bp, Homo sapiens
agaaatgttctttct

SEQ ID NO: 104364 - DNA, 15 bp, Homo sapiens
aagaaatgttctttc

SEQ ID NO: 104365 - DNA, 15 bp, Homo sapiens
aaagaaatgttcttt

SEQ ID NO: 104366 - DNA, 15 bp, Homo sapiens
aaaagaaatgttctt

SEQ ID NO: 104367 - DNA, 15 bp, Homo sapiens
taaaagaaatgttct

SEQ ID NO: 104368 - DNA, 15 bp, Homo sapiens
ataaaagaaatgttc

SEQ ID NO: 104369 - DNA, 15 bp, Homo sapiens
tataaaagaaatgtt

SEQ ID NO: 104370 - DNA, 15 bp, Homo sapiens
ctataaaagaaatgt

SEQ ID NO: 104371 - DNA, 15 bp, Homo sapiens
cctataaaagaaatg

SEQ ID NO: 104372 - DNA, 15 bp, Homo sapiens
tcctataaaagaaat

SEQ ID NO: 104373 - DNA, 15 bp, Homo sapiens
ttcctataaaagaaa

SEQ ID NO: 104374 - DNA, 15 bp, Homo sapiens
cttcctataaaagaa

SEQ ID NO: 104375 - DNA, 15 bp, Homo sapiens
ccttcctataaaaga

SEQ ID NO: 104376 - DNA, 15 bp, Homo sapiens
accttcctataaaag

SEQ ID NO: 104377 - DNA, 15 bp, Homo sapiens
aaccttcctataaaa

SEQ ID NO: 104378 - DNA, 15 bp, Homo sapiens
caaccttcctataaa

SEQ ID NO: 104379 - DNA, 15 bp, Homo sapiens
ccaaccttcctataa

SEQ ID NO: 104380 - DNA, 15 bp, Homo sapiens
cccaaccttcctata

SEQ ID NO: 104381 - DNA, 15 bp, Homo sapiens
acccaaccttcctat

SEQ ID NO: 104382 - DNA, 15 bp, Homo sapiens
tacccaaccttccta

SEQ ID NO: 104383 - DNA, 15 bp, Homo sapiens
atacccaaccttcct

SEQ ID NO: 104384 - DNA, 15 bp, Homo sapiens
catacccaaccttcc

SEQ ID NO: 104385 - DNA, 15 bp, Homo sapiens
tcatacccaaccttc

SEQ ID NO: 104386 - DNA, 15 bp, Homo sapiens
ttcatacccaacctt

SEQ ID NO: 104387 - DNA, 15 bp, Homo sapiens
attcatacccaacct

SEQ ID NO: 104388 - DNA, 15 bp, Homo sapiens
tattcatacccaacc

SEQ ID NO: 104389 - DNA, 15 bp, Homo sapiens
atattcatacccaac

SEQ ID NO: 104390 - DNA, 15 bp, Homo sapiens
aatattcatacccaa

SEQ ID NO: 104391 - DNA, 15 bp, Homo sapiens
taatattcataccca

SEQ ID NO: 104392 - DNA, 15 bp, Homo sapiens
ctaatattcataccc

SEQ ID NO: 104393 - DNA, 15 bp, Homo sapiens
cctaatattcatacc

SEQ ID NO: 104394 - DNA, 15 bp, Homo sapiens
acctaatattcatac

SEQ ID NO: 104395 - DNA, 15 bp, Homo sapiens
cacctaatattcata

SEQ ID NO: 104396 - DNA, 15 bp, Homo sapiens
gcacctaatattcat

SEQ ID NO: 104397 - DNA, 15 bp, Homo sapiens
agcacctaatattca

SEQ ID NO: 104398 - DNA, 15 bp, Homo sapiens
aagcacctaatattc

SEQ ID NO: 104399 - DNA, 15 bp, Homo sapiens
gaagcacctaatatt

SEQ ID NO: 104400 - DNA, 15 bp, Homo sapiens
ggaagcacctaatat

SEQ ID NO: 104401 - DNA, 15 bp, Homo sapiens
tggaagcacctaata

SEQ ID NO: 104402 - DNA, 15 bp, Homo sapiens
ttggaagcacctaat

SEQ ID NO: 104403 - DNA, 15 bp, Homo sapiens
tttggaagcacctaa

SEQ ID NO: 104404 - DNA, 15 bp, Homo sapiens
gtttggaagcaccta

SEQ ID NO: 104405 - DNA, 15 bp, Homo sapiens
tgtttggaagcacct

SEQ ID NO: 104406 - DNA, 15 bp, Homo sapiens
gtgtttggaagcacc

SEQ ID NO: 104407 - DNA, 15 bp, Homo sapiens
tgtgtttggaagcac

SEQ ID NO: 104408 - DNA, 15 bp, Homo sapiens
atgtgtttggaagca

SEQ ID NO: 104409 - DNA, 15 bp, Homo sapiens
tatgtgtttggaagc

SEQ ID NO: 104410 - DNA, 15 bp, Homo sapiens
atatgtgtttggaag

SEQ ID NO: 104411 - DNA, 15 bp, Homo sapiens
aatatgtgtttggaa

SEQ ID NO: 104412 - DNA, 15 bp, Homo sapiens
taatatgtgtttgga

SEQ ID NO: 104413 - DNA, 15 bp, Homo sapiens
ttaatatgtgtttgg

SEQ ID NO: 104414 - DNA, 15 bp, Homo sapiens
tttaatatgtgtttg

SEQ ID NO: 104415 - DNA, 15 bp, Homo sapiens
atttaatatgtgttt

SEQ ID NO: 104416 - DNA, 15 bp, Homo sapiens
tatttaatatgtgtt

SEQ ID NO: 104417 - DNA, 15 bp, Homo sapiens
ttatttaatatgtgt

SEQ ID NO: 104418 - DNA, 15 bp, Homo sapiens
attatttaatatgtg

SEQ ID NO: 104419 - DNA, 15 bp, Homo sapiens
tattatttaatatgt

SEQ ID NO: 104420 - DNA, 15 bp, Homo sapiens
ttattatttaatatg

SEQ ID NO: 104421 - DNA, 15 bp, Homo sapiens
gttattatttaatat

SEQ ID NO: 104422 - DNA, 15 bp, Homo sapiens
agttattatttaata

SEQ ID NO: 104423 - DNA, 15 bp, Homo sapiens
cagttattatttaat

SEQ ID NO: 104424 - DNA, 15 bp, Homo sapiens
acagttattatttaa

SEQ ID NO: 104425 - DNA, 15 bp, Homo sapiens
aacagttattattta

SEQ ID NO: 104426 - DNA, 15 bp, Homo sapiens
caacagttattattt

SEQ ID NO: 104427 - DNA, 15 bp, Homo sapiens
tcaacagttattatt

SEQ ID NO: 104428 - DNA, 15 bp, Homo sapiens
atcaacagttattat

SEQ ID NO: 104429 - DNA, 15 bp, Homo sapiens
catcaacagttatta

SEQ ID NO: 104430 - DNA, 15 bp, Homo sapiens
acatcaacagttatt

SEQ ID NO: 104431 - DNA, 15 bp, Homo sapiens
aacatcaacagttat

SEQ ID NO: 104432 - DNA, 15 bp, Homo sapiens
gaacatcaacagtta

SEQ ID NO: 104433 - DNA, 15 bp, Homo sapiens
tgaacatcaacagtt

SEQ ID NO: 104434 - DNA, 15 bp, Homo sapiens
ctgaacatcaacagt

SEQ ID NO: 104435 - DNA, 15 bp, Homo sapiens
gctgaacatcaacag

SEQ ID NO: 104436 - DNA, 15 bp, Homo sapiens
ggctgaacatcaaca

SEQ ID NO: 104437 - DNA, 15 bp, Homo sapiens
gggctgaacatcaac

SEQ ID NO: 104438 - DNA, 15 bp, Homo sapiens
tgggctgaacatcaa

SEQ ID NO: 104439 - DNA, 15 bp, Homo sapiens
atgggctgaacatca

SEQ ID NO: 104440 - DNA, 15 bp, Homo sapiens
catgggctgaacatc

SEQ ID NO: 104441 - DNA, 15 bp, Homo sapiens
tcatgggctgaacat

SEQ ID NO: 104442 - DNA, 15 bp, Homo sapiens
ttcatgggctgaaca

SEQ ID NO: 104443 - DNA, 15 bp, Homo sapiens
attcatgggctgaac

SEQ ID NO: 104444 - DNA, 15 bp, Homo sapiens
tattcatgggctgaa

SEQ ID NO: 104445 - DNA, 15 bp, Homo sapiens
ttattcatgggctga

SEQ ID NO: 104446 - DNA, 15 bp, Homo sapiens
gttattcatgggctg

SEQ ID NO: 104447 - DNA, 15 bp, Homo sapiens
tgttattcatgggct

SEQ ID NO: 104448 - DNA, 15 bp, Homo sapiens
atgttattcatgggc

SEQ ID NO: 104449 - DNA, 15 bp, Homo sapiens
gatgttattcatggg

SEQ ID NO: 104450 - DNA, 15 bp, Homo sapiens
tgatgttattcatgg

SEQ ID NO: 104451 - DNA, 15 bp, Homo sapiens
ttgatgttattcatg

SEQ ID NO: 104452 - DNA, 15 bp, Homo sapiens
cttgatgttattcat

SEQ ID NO: 104453 - DNA, 15 bp, Homo sapiens
gcttgatgttattca

SEQ ID NO: 104454 - DNA, 15 bp, Homo sapiens
agcttgatgttattc

SEQ ID NO: 104455 - DNA, 15 bp, Homo sapiens
aagcttgatgttatt

SEQ ID NO: 104456 - DNA, 15 bp, Homo sapiens
taagcttgatgttat

SEQ ID NO: 104457 - DNA, 15 bp, Homo sapiens
ttaagcttgatgtta

SEQ ID NO: 104458 - DNA, 15 bp, Homo sapiens
gttaagcttgatgtt

SEQ ID NO: 104459 - DNA, 15 bp, Homo sapiens
ggttaagcttgatgt

SEQ ID NO: 104460 - DNA, 15 bp, Homo sapiens
gggttaagcttgatg

SEQ ID NO: 104461 - DNA, 15 bp, Homo sapiens
tgggttaagcttgat

SEQ ID NO: 104462 - DNA, 15 bp, Homo sapiens
ttgggttaagcttga

SEQ ID NO: 104463 - DNA, 15 bp, Homo sapiens
tttgggttaagcttg

SEQ ID NO: 104464 - DNA, 15 bp, Homo sapiens
ttttgggttaagctt

SEQ ID NO: 104465 - DNA, 15 bp, Homo sapiens
cttttgggttaagct

SEQ ID NO: 104466 - DNA, 15 bp, Homo sapiens
acttttgggttaagc

SEQ ID NO: 104467 - DNA, 15 bp, Homo sapiens
cacttttgggttaag

SEQ ID NO: 104468 - DNA, 15 bp, Homo sapiens
gcacttttgggttaa

SEQ ID NO: 104469 - DNA, 15 bp, Homo sapiens
agcacttttgggtta

SEQ ID NO: 104470 - DNA, 15 bp, Homo sapiens
cagcacttttgggtt

SEQ ID NO: 104471 - DNA, 15 bp, Homo sapiens
acagcacttttgggt

SEQ ID NO: 104472 - DNA, 15 bp, Homo sapiens
tacagcacttttggg

SEQ ID NO: 104473 - DNA, 15 bp, Homo sapiens
ttacagcacttttgg

SEQ ID NO: 104474 - DNA, 15 bp, Homo sapiens
tttacagcacttttg

SEQ ID NO: 104475 - DNA, 15 bp, Homo sapiens
atttacagcactttt

SEQ ID NO: 104476 - DNA, 15 bp, Homo sapiens
tatttacagcacttt

SEQ ID NO: 104477 - DNA, 15 bp, Homo sapiens
ctatttacagcactt

SEQ ID NO: 104478 - DNA, 15 bp, Homo sapiens
actatttacagcact

SEQ ID NO: 104479 - DNA, 15 bp, Homo sapiens
tactatttacagcac

SEQ ID NO: 104480 - DNA, 15 bp, Homo sapiens
ctactatttacagca

SEQ ID NO: 104481 - DNA, 15 bp, Homo sapiens
actactatttacagc

SEQ ID NO: 104482 - DNA, 15 bp, Homo sapiens
aactactatttacag

SEQ ID NO: 104483 - DNA, 15 bp, Homo sapiens
aaactactatttaca

SEQ ID NO: 104484 - DNA, 15 bp, Homo sapiens
caaactactatttac

SEQ ID NO: 104485 - DNA, 15 bp, Homo sapiens
tcaaactactattta

SEQ ID NO: 104486 - DNA, 15 bp, Homo sapiens
atcaaactactattt

SEQ ID NO: 104487 - DNA, 15 bp, Homo sapiens
tatcaaactactatt

SEQ ID NO: 104488 - DNA, 15 bp, Homo sapiens
atatcaaactactat

SEQ ID NO: 104489 - DNA, 15 bp, Homo sapiens
catatcaaactacta

SEQ ID NO: 104490 - DNA, 15 bp, Homo sapiens
acatatcaaactact

SEQ ID NO: 104491 - DNA, 15 bp, Homo sapiens
tacatatcaaactac

SEQ ID NO: 104492 - DNA, 15 bp, Homo sapiens
atacatatcaaacta

SEQ ID NO: 104493 - DNA, 15 bp, Homo sapiens
catacatatcaaact

SEQ ID NO: 104494 - DNA, 15 bp, Homo sapiens
acatacatatcaaac

SEQ ID NO: 104495 - DNA, 15 bp, Homo sapiens
tacatacatatcaaa

SEQ ID NO: 104496 - DNA, 15 bp, Homo sapiens
gtacatacatatcaa

SEQ ID NO: 104497 - DNA, 15 bp, Homo sapiens
tgtacatacatatca

SEQ ID NO: 104498 - DNA, 15 bp, Homo sapiens
gtgtacatacatatc

SEQ ID NO: 104499 - DNA, 15 bp, Homo sapiens
ggtgtacatacatat

SEQ ID NO: 104500 - DNA, 15 bp, Homo sapiens
aggtgtacatacata

SEQ ID NO: 104501 - DNA, 15 bp, Homo sapiens
taggtgtacatacat

SEQ ID NO: 104502 - DNA, 15 bp, Homo sapiens
ataggtgtacataca

SEQ ID NO: 104503 - DNA, 15 bp, Homo sapiens
tataggtgtacatac

SEQ ID NO: 104504 - DNA, 15 bp, Homo sapiens
ctataggtgtacata

SEQ ID NO: 104505 - DNA, 15 bp, Homo sapiens
tctataggtgtacat

SEQ ID NO: 104506 - DNA, 15 bp, Homo sapiens
ttctataggtgtaca

SEQ ID NO: 104507 - DNA, 15 bp, Homo sapiens
attctataggtgtac

SEQ ID NO: 104508 - DNA, 15 bp, Homo sapiens
aattctataggtgta

SEQ ID NO: 104509 - DNA, 15 bp, Homo sapiens
aaattctataggtgt

SEQ ID NO: 104510 - DNA, 15 bp, Homo sapiens
caaattctataggtg

SEQ ID NO: 104511 - DNA, 15 bp, Homo sapiens
acaaattctataggt

SEQ ID NO: 104512 - DNA, 15 bp, Homo sapiens
aacaaattctatagg

SEQ ID NO: 104513 - DNA, 15 bp, Homo sapiens
aaacaaattctatag

SEQ ID NO: 104514 - DNA, 15 bp, Homo sapiens
aaaacaaattctata

SEQ ID NO: 104515 - DNA, 15 bp, Homo sapiens
taaaacaaattctat

SEQ ID NO: 104516 - DNA, 15 bp, Homo sapiens
ctaaaacaaattcta

SEQ ID NO: 104517 - DNA, 15 bp, Homo sapiens
cctaaaacaaattct

SEQ ID NO: 104518 - DNA, 15 bp, Homo sapiens
gcctaaaacaaattc

SEQ ID NO: 104519 - DNA, 15 bp, Homo sapiens
agcctaaaacaaatt

SEQ ID NO: 104520 - DNA, 15 bp, Homo sapiens
aagcctaaaacaaat

SEQ ID NO: 104521 - DNA, 15 bp, Homo sapiens
aaagcctaaaacaaa

SEQ ID NO: 104522 - DNA, 15 bp, Homo sapiens
caaagcctaaaacaa

SEQ ID NO: 104523 - DNA, 15 bp, Homo sapiens
ccaaagcctaaaaca

SEQ ID NO: 104524 - DNA, 15 bp, Homo sapiens
tccaaagcctaaaac

SEQ ID NO: 104525 - DNA, 15 bp, Homo sapiens
ttccaaagcctaaaa

SEQ ID NO: 104526 - DNA, 15 bp, Homo sapiens
tttccaaagcctaaa

SEQ ID NO: 104527 - DNA, 15 bp, Homo sapiens
ttttccaaagcctaa

SEQ ID NO: 104528 - DNA, 15 bp, Homo sapiens
tttttccaaagccta

SEQ ID NO: 104529 - DNA, 15 bp, Homo sapiens
ttttttccaaagcct

SEQ ID NO: 104530 - DNA, 15 bp, Homo sapiens
tttttttccaaagcc

SEQ ID NO: 104531 - DNA, 15 bp, Homo sapiens
ctttttttccaaagc

SEQ ID NO: 104532 - DNA, 15 bp, Homo sapiens
tctttttttccaaag

SEQ ID NO: 104533 - DNA, 15 bp, Homo sapiens
ctctttttttccaaa

SEQ ID NO: 104534 - DNA, 15 bp, Homo sapiens
tctctttttttccaa

SEQ ID NO: 104535 - DNA, 15 bp, Homo sapiens
gtctctttttttcca

SEQ ID NO: 104536 - DNA, 15 bp, Homo sapiens
agtctctttttttcc

SEQ ID NO: 104537 - DNA, 15 bp, Homo sapiens
gagtctctttttttc

SEQ ID NO: 104538 - DNA, 15 bp, Homo sapiens
agagtctcttttttt

SEQ ID NO: 104539 - DNA, 15 bp, Homo sapiens
cagagtctctttttt

SEQ ID NO: 104540 - DNA, 15 bp, Homo sapiens
tcagagtctcttttt

SEQ ID NO: 104541 - DNA, 15 bp, Homo sapiens
atcagagtctctttt

SEQ ID NO: 104542 - DNA, 15 bp, Homo sapiens
catcagagtctcttt

SEQ ID NO: 104543 - DNA, 15 bp, Homo sapiens
acatcagagtctctt

SEQ ID NO: 104544 - DNA, 15 bp, Homo sapiens
aacatcagagtctct

SEQ ID NO: 104545 - DNA, 15 bp, Homo sapiens
aaacatcagagtctc

SEQ ID NO: 104546 - DNA, 15 bp, Homo sapiens
caaacatcagagtct

SEQ ID NO: 104547 - DNA, 15 bp, Homo sapiens
acaaacatcagagtc

SEQ ID NO: 104548 - DNA, 15 bp, Homo sapiens
cacaaacatcagagt

SEQ ID NO: 104549 - DNA, 15 bp, Homo sapiens
acacaaacatcagag

SEQ ID NO: 104550 - DNA, 15 bp, Homo sapiens
tacacaaacatcaga

SEQ ID NO: 104551 - DNA, 15 bp, Homo sapiens
atacacaaacatcag

SEQ ID NO: 104552 - DNA, 15 bp, Homo sapiens
aatacacaaacatca

SEQ ID NO: 104553 - DNA, 15 bp, Homo sapiens
caatacacaaacatc

SEQ ID NO: 104554 - DNA, 15 bp, Homo sapiens
tcaatacacaaacat

SEQ ID NO: 104555 - DNA, 15 bp, Homo sapiens
atcaatacacaaaca

SEQ ID NO: 104556 - DNA, 15 bp, Homo sapiens
tatcaatacacaaac

SEQ ID NO: 104557 - DNA, 15 bp, Homo sapiens
ctatcaatacacaaa

SEQ ID NO: 104558 - DNA, 15 bp, Homo sapiens
tctatcaatacacaa

SEQ ID NO: 104559 - DNA, 15 bp, Homo sapiens
gtctatcaatacaca

SEQ ID NO: 104560 - DNA, 15 bp, Homo sapiens
tgtctatcaatacac

SEQ ID NO: 104561 - DNA, 15 bp, Homo sapiens
atgtctatcaataca

SEQ ID NO: 104562 - DNA, 15 bp, Homo sapiens
aatgtctatcaatac

SEQ ID NO: 104563 - DNA, 15 bp, Homo sapiens
aaatgtctatcaata

SEQ ID NO: 104564 - DNA, 15 bp, Homo sapiens
aaaatgtctatcaat

SEQ ID NO: 104565 - DNA, 15 bp, Homo sapiens
aaaaatgtctatcaa

SEQ ID NO: 104566 - DNA, 15 bp, Homo sapiens
gaaaaatgtctatca

SEQ ID NO: 104567 - DNA, 15 bp, Homo sapiens
agaaaaatgtctatc

SEQ ID NO: 104568 - DNA, 15 bp, Homo sapiens
aagaaaaatgtctat

SEQ ID NO: 104569 - DNA, 15 bp, Homo sapiens
taagaaaaatgtcta

SEQ ID NO: 104570 - DNA, 15 bp, Homo sapiens
ataagaaaaatgtct

SEQ ID NO: 104571 - DNA, 15 bp, Homo sapiens
cataagaaaaatgtc

SEQ ID NO: 104572 - DNA, 15 bp, Homo sapiens
acataagaaaaatgt

SEQ ID NO: 104573 - DNA, 15 bp, Homo sapiens
aacataagaaaaatg

SEQ ID NO: 104574 - DNA, 15 bp, Homo sapiens
aaacataagaaaaat

SEQ ID NO: 104575 - DNA, 15 bp, Homo sapiens
aaaacataagaaaaa

SEQ ID NO: 104576 - DNA, 15 bp, Homo sapiens
taaaacataagaaaa

SEQ ID NO: 104577 - DNA, 15 bp, Homo sapiens
ataaaacataagaaa

SEQ ID NO: 104578 - DNA, 15 bp, Homo sapiens
tataaaacataagaa

SEQ ID NO: 104579 - DNA, 15 bp, Homo sapiens
atataaaacataaga

SEQ ID NO: 104580 - DNA, 15 bp, Homo sapiens
aatataaaacataag

SEQ ID NO: 104581 - DNA, 15 bp, Homo sapiens
gaatataaaacataa

SEQ ID NO: 104582 - DNA, 15 bp, Homo sapiens
agaatataaaacata

SEQ ID NO: 104583 - DNA, 15 bp, Homo sapiens
aagaatataaaacat

SEQ ID NO: 104584 - DNA, 15 bp, Homo sapiens
taagaatataaaaca

SEQ ID NO: 104585 - DNA, 15 bp, Homo sapiens
ttaagaatataaaac

SEQ ID NO: 104586 - DNA, 15 bp, Homo sapiens
attaagaatataaaa

SEQ ID NO: 104587 - DNA, 15 bp, Homo sapiens
aattaagaatataaa

SEQ ID NO: 104588 - DNA, 15 bp, Homo sapiens
caattaagaatataa

SEQ ID NO: 104589 - DNA, 15 bp, Homo sapiens
ccaattaagaatata

SEQ ID NO: 104590 - DNA, 15 bp, Homo sapiens
gccaattaagaatat

SEQ ID NO: 104591 - DNA, 15 bp, Homo sapiens
tgccaattaagaata

SEQ ID NO: 104592 - DNA, 15 bp, Homo sapiens
ctgccaattaagaat

SEQ ID NO: 104593 - DNA, 15 bp, Homo sapiens
tctgccaattaagaa

SEQ ID NO: 104594 - DNA, 15 bp, Homo sapiens
gtctgccaattaaga

SEQ ID NO: 104595 - DNA, 15 bp, Homo sapiens
tgtctgccaattaag

SEQ ID NO: 104596 - DNA, 15 bp, Homo sapiens
atgtctgccaattaa

SEQ ID NO: 104597 - DNA, 15 bp, Homo sapiens
aatgtctgccaatta

SEQ ID NO: 104598 - DNA, 15 bp, Homo sapiens
caatgtctgccaatt

SEQ ID NO: 104599 - DNA, 15 bp, Homo sapiens
gcaatgtctgccaat

SEQ ID NO: 104600 - DNA, 15 bp, Homo sapiens
agcaatgtctgccaa

SEQ ID NO: 104601 - DNA, 15 bp, Homo sapiens
cagcaatgtctgcca

SEQ ID NO: 104602 - DNA, 15 bp, Homo sapiens
tcagcaatgtctgcc

SEQ ID NO: 104603 - DNA, 15 bp, Homo sapiens
atcagcaatgtctgc

SEQ ID NO: 104604 - DNA, 15 bp, Homo sapiens
aatcagcaatgtctg

SEQ ID NO: 104605 - DNA, 15 bp, Homo sapiens
gaatcagcaatgtct

SEQ ID NO: 104606 - DNA, 15 bp, Homo sapiens
ggaatcagcaatgtc

SEQ ID NO: 104607 - DNA, 15 bp, Homo sapiens
aggaatcagcaatgt

SEQ ID NO: 104608 - DNA, 15 bp, Homo sapiens
taggaatcagcaatg

SEQ ID NO: 104609 - DNA, 15 bp, Homo sapiens
ttaggaatcagcaat

SEQ ID NO: 104610 - DNA, 15 bp, Homo sapiens
tttaggaatcagcaa

SEQ ID NO: 104611 - DNA, 15 bp, Homo sapiens
ttttaggaatcagca

SEQ ID NO: 104612 - DNA, 15 bp, Homo sapiens
tttttaggaatcagc

SEQ ID NO: 104613 - DNA, 15 bp, Homo sapiens
atttttaggaatcag

SEQ ID NO: 104614 - DNA, 15 bp, Homo sapiens
catttttaggaatca

SEQ ID NO: 104615 - DNA, 15 bp, Homo sapiens
gcatttttaggaatc

SEQ ID NO: 104616 - DNA, 15 bp, Homo sapiens
agcatttttaggaat

SEQ ID NO: 104617 - DNA, 15 bp, Homo sapiens
aagcatttttaggaa

SEQ ID NO: 104618 - DNA, 15 bp, Homo sapiens
aaagcatttttagga

SEQ ID NO: 104619 - DNA, 15 bp, Homo sapiens
taaagcatttttagg

SEQ ID NO: 104620 - DNA, 15 bp, Homo sapiens
ttaaagcatttttag

SEQ ID NO: 104621 - DNA, 15 bp, Homo sapiens
tttaaagcattttta

SEQ ID NO: 104622 - DNA, 15 bp, Homo sapiens
ttttaaagcattttt

SEQ ID NO: 104623 - DNA, 15 bp, Homo sapiens
attttaaagcatttt

SEQ ID NO: 104624 - DNA, 15 bp, Homo sapiens
aattttaaagcattt

SEQ ID NO: 104625 - DNA, 15 bp, Homo sapiens
taattttaaagcatt

SEQ ID NO: 104626 - DNA, 15 bp, Homo sapiens
ataattttaaagcat

SEQ ID NO: 104627 - DNA, 15 bp, Homo sapiens
tataattttaaagca

SEQ ID NO: 104628 - DNA, 15 bp, Homo sapiens
ttataattttaaagc

SEQ ID NO: 104629 - DNA, 15 bp, Homo sapiens
attataattttaaag

SEQ ID NO: 104630 - DNA, 15 bp, Homo sapiens
tattataattttaaa

SEQ ID NO: 104631 - DNA, 15 bp, Homo sapiens
ttattataattttaa

SEQ ID NO: 104632 - DNA, 15 bp, Homo sapiens
tttattataatttta

SEQ ID NO: 104633 - DNA, 15 bp, Homo sapiens
atttattataatttt

SEQ ID NO: 104634 - DNA, 15 bp, Homo sapiens
tatttattataattt

SEQ ID NO: 104635 - DNA, 15 bp, Homo sapiens
ttatttattataatt

SEQ ID NO: 104636 - DNA, 15 bp, Homo sapiens
gttatttattataat

SEQ ID NO: 104637 - DNA, 15 bp, Homo sapiens
tgttatttattataa

SEQ ID NO: 104638 - DNA, 15 bp, Homo sapiens
gtgttatttattata

SEQ ID NO: 104639 - DNA, 15 bp, Homo sapiens
tgtgttatttattat

SEQ ID NO: 104640 - DNA, 15 bp, Homo sapiens
atgtgttatttatta

SEQ ID NO: 104641 - DNA, 15 bp, Homo sapiens
aatgtgttatttatt

SEQ ID NO: 104642 - DNA, 15 bp, Homo sapiens
aaatgtgttatttat

SEQ ID NO: 104643 - DNA, 15 bp, Homo sapiens
aaaatgtgttattta

SEQ ID NO: 104644 - DNA, 15 bp, Homo sapiens
aaaaatgtgttattt

SEQ ID NO: 104645 - DNA, 15 bp, Homo sapiens
taaaaatgtgttatt

SEQ ID NO: 104646 - DNA, 15 bp, Homo sapiens
ataaaaatgtgttat

SEQ ID NO: 104647 - DNA, 15 bp, Homo sapiens
gataaaaatgtgtta

SEQ ID NO: 104648 - DNA, 15 bp, Homo sapiens
agataaaaatgtgtt

SEQ ID NO: 104649 - DNA, 15 bp, Homo sapiens
aagataaaaatgtgt

SEQ ID NO: 104650 - DNA, 15 bp, Homo sapiens
gaagataaaaatgtg

SEQ ID NO: 104651 - DNA, 15 bp, Homo sapiens
agaagataaaaatgt

SEQ ID NO: 104652 - DNA, 15 bp, Homo sapiens
cagaagataaaaatg

SEQ ID NO: 104653 - DNA, 15 bp, Homo sapiens
acagaagataaaaat

SEQ ID NO: 104654 - DNA, 15 bp, Homo sapiens
aacagaagataaaaa

SEQ ID NO: 104655 - DNA, 15 bp, Homo sapiens
aaacagaagataaaa

SEQ ID NO: 104656 - DNA, 15 bp, Homo sapiens
taaacagaagataaa

SEQ ID NO: 104657 - DNA, 15 bp, Homo sapiens
ttaaacagaagataa

SEQ ID NO: 104658 - DNA, 15 bp, Homo sapiens
attaaacagaagata

SEQ ID NO: 104659 - DNA, 15 bp, Homo sapiens
cattaaacagaagat

SEQ ID NO: 104660 - DNA, 15 bp, Homo sapiens
gcattaaacagaaga

SEQ ID NO: 104661 - DNA, 15 bp, Homo sapiens
tgcattaaacagaag

SEQ ID NO: 104662 - DNA, 15 bp, Homo sapiens
atgcattaaacagaa

SEQ ID NO: 104663 - DNA, 15 bp, Homo sapiens
gatgcattaaacaga

SEQ ID NO: 104664 - DNA, 15 bp, Homo sapiens
agatgcattaaacag

SEQ ID NO: 104665 - DNA, 15 bp, Homo sapiens
aagatgcattaaaca

SEQ ID NO: 104666 - DNA, 15 bp, Homo sapiens
taagatgcattaaac

SEQ ID NO: 104667 - DNA, 15 bp, Homo sapiens
ataagatgcattaaa

SEQ ID NO: 104668 - DNA, 15 bp, Homo sapiens
cataagatgcattaa

SEQ ID NO: 104669 - DNA, 15 bp, Homo sapiens
ccataagatgcatta

SEQ ID NO: 104670 - DNA, 15 bp, Homo sapiens
cccataagatgcatt

SEQ ID NO: 104671 - DNA, 15 bp, Homo sapiens
tcccataagatgcat

SEQ ID NO: 104672 - DNA, 15 bp, Homo sapiens
ttcccataagatgca

SEQ ID NO: 104673 - DNA, 15 bp, Homo sapiens
tttcccataagatgc

SEQ ID NO: 104674 - DNA, 15 bp, Homo sapiens
gtttcccataagatg

SEQ ID NO: 104675 - DNA, 15 bp, Homo sapiens
ggtttcccataagat

SEQ ID NO: 104676 - DNA, 15 bp, Homo sapiens
aggtttcccataaga

SEQ ID NO: 104677 - DNA, 15 bp, Homo sapiens
aaggtttcccataag

SEQ ID NO: 104678 - DNA, 15 bp, Homo sapiens
aaaggtttcccataa

SEQ ID NO: 104679 - DNA, 15 bp, Homo sapiens
taaaggtttcccata

SEQ ID NO: 104680 - DNA, 15 bp, Homo sapiens
gtaaaggtttcccat

SEQ ID NO: 104681 - DNA, 15 bp, Homo sapiens
tgtaaaggtttccca

SEQ ID NO: 104682 - DNA, 15 bp, Homo sapiens
atgtaaaggtttccc

SEQ ID NO: 104683 - DNA, 15 bp, Homo sapiens
aatgtaaaggtttcc

SEQ ID NO: 104684 - DNA, 15 bp, Homo sapiens
aaatgtaaaggtttc

SEQ ID NO: 104685 - DNA, 15 bp, Homo sapiens
aaaatgtaaaggttt

SEQ ID NO: 104686 - DNA, 15 bp, Homo sapiens
aaaaatgtaaaggtt

SEQ ID NO: 104687 - DNA, 15 bp, Homo sapiens
caaaaatgtaaaggt

SEQ ID NO: 104688 - DNA, 15 bp, Homo sapiens
acaaaaatgtaaagg

SEQ ID NO: 104689 - DNA, 15 bp, Homo sapiens
tacaaaaatgtaaag

SEQ ID NO: 104690 - DNA, 15 bp, Homo sapiens
atacaaaaatgtaaa

SEQ ID NO: 104691 - DNA, 15 bp, Homo sapiens
aatacaaaaatgtaa

SEQ ID NO: 104692 - DNA, 15 bp, Homo sapiens
aaatacaaaaatgta

SEQ ID NO: 104693 - DNA, 15 bp, Homo sapiens
gaaatacaaaaatgt

SEQ ID NO: 104694 - DNA, 15 bp, Homo sapiens
tgaaatacaaaaatg

SEQ ID NO: 104695 - DNA, 15 bp, Homo sapiens
gttgaaatacaaaaa

SEQ ID NO: 104696 - DNA, 15 bp, Homo sapiens
tgttgaaatacaaaa

SEQ ID NO: 104697 - DNA, 15 bp, Homo sapiens
atgttgaaatacaaa

SEQ ID NO: 104698 - DNA, 15 bp, Homo sapiens
aatgttgaaatacaa

SEQ ID NO: 104699 - DNA, 15 bp, Homo sapiens
taatgttgaaataca

SEQ ID NO: 104700 - DNA, 15 bp, Homo sapiens
ataatgttgaaatac

SEQ ID NO: 104701 - DNA, 15 bp, Homo sapiens
tataatgttgaaata

SEQ ID NO: 104702 - DNA, 15 bp, Homo sapiens
atataatgttgaaat

SEQ ID NO: 104703 - DNA, 15 bp, Homo sapiens
tatataatgttgaaa

SEQ ID NO: 104704 - DNA, 15 bp, Homo sapiens
atatataatgttgaa

SEQ ID NO: 104705 - DNA, 15 bp, Homo sapiens
tatatataatgttga

SEQ ID NO: 104706 - DNA, 15 bp, Homo sapiens
ctatatataatgttg

SEQ ID NO: 104707 - DNA, 15 bp, Homo sapiens
tctatatataatgtt

SEQ ID NO: 104708 - DNA, 15 bp, Homo sapiens
ttctatatataatgt

SEQ ID NO: 104709 - DNA, 15 bp, Homo sapiens
tttctatatataatg

SEQ ID NO: 104710 - DNA, 15 bp, Homo sapiens
ctttctatatataat

SEQ ID NO: 104711 - DNA, 15 bp, Homo sapiens
tctttctatatataa

SEQ ID NO: 104712 - DNA, 15 bp, Homo sapiens
ttctttctatatata

SEQ ID NO: 104713 - DNA, 15 bp, Homo sapiens
cttctttctatatat

SEQ ID NO: 104714 - DNA, 15 bp, Homo sapiens
acttctttctatata

SEQ ID NO: 104715 - DNA, 15 bp, Homo sapiens
tacttctttctatat

SEQ ID NO: 104716 - DNA, 15 bp, Homo sapiens
ttacttctttctata

SEQ ID NO: 104717 - DNA, 15 bp, Homo sapiens
attacttctttctat

SEQ ID NO: 104718 - DNA, 15 bp, Homo sapiens
tattacttctttcta

SEQ ID NO: 104719 - DNA, 15 bp, Homo sapiens
ttattacttctttct

SEQ ID NO: 104720 - DNA, 15 bp, Homo sapiens
attattacttctttc

SEQ ID NO: 104721 - DNA, 15 bp, Homo sapiens
aattattacttcttt

SEQ ID NO: 104722 - DNA, 15 bp, Homo sapiens
taattattacttctt

SEQ ID NO: 104723 - DNA, 15 bp, Homo sapiens
ctaattattacttct

SEQ ID NO: 104724 - DNA, 15 bp, Homo sapiens
actaattattacttc

SEQ ID NO: 104725 - DNA, 15 bp, Homo sapiens
tactaattattactt

SEQ ID NO: 104726 - DNA, 15 bp, Homo sapiens
ttactaattattact

SEQ ID NO: 104727 - DNA, 15 bp, Homo sapiens
attactaattattac

SEQ ID NO: 104728 - DNA, 15 bp, Homo sapiens
aattactaattatta

SEQ ID NO: 104729 - DNA, 15 bp, Homo sapiens
gaattactaattatt

SEQ ID NO: 104730 - DNA, 15 bp, Homo sapiens
tgaattactaattat

SEQ ID NO: 104731 - DNA, 15 bp, Homo sapiens
ctgaattactaatta

SEQ ID NO: 104732 - DNA, 15 bp, Homo sapiens
gctgaattactaatt

SEQ ID NO: 104733 - DNA, 15 bp, Homo sapiens
agctgaattactaat

SEQ ID NO: 104734 - DNA, 15 bp, Homo sapiens
cagctgaattactaa

SEQ ID NO: 104735 - DNA, 15 bp, Homo sapiens
gcagctgaattacta

SEQ ID NO: 104736 - DNA, 15 bp, Homo sapiens
tgcagctgaattact

SEQ ID NO: 104737 - DNA, 15 bp, Homo sapiens
atgcagctgaattac

SEQ ID NO: 104738 - DNA, 15 bp, Homo sapiens
catgcagctgaatta

SEQ ID NO: 104739 - DNA, 15 bp, Homo sapiens
ccatgcagctgaatt

SEQ ID NO: 104740 - DNA, 15 bp, Homo sapiens
accatgcagctgaat

SEQ ID NO: 104741 - DNA, 15 bp, Homo sapiens
taccatgcagctgaa

SEQ ID NO: 104742 - DNA, 15 bp, Homo sapiens
gtaccatgcagctga

SEQ ID NO: 104743 - DNA, 15 bp, Homo sapiens
tgtaccatgcagctg

SEQ ID NO: 104744 - DNA, 15 bp, Homo sapiens
atgtaccatgcagct

SEQ ID NO: 104745 - DNA, 15 bp, Homo sapiens
tatgtaccatgcagc

SEQ ID NO: 104746 - DNA, 15 bp, Homo sapiens
ttatgtaccatgcag

SEQ ID NO: 104747 - DNA, 15 bp, Homo sapiens
cttatgtaccatgca

SEQ ID NO: 104748 - DNA, 15 bp, Homo sapiens
tcttatgtaccatgc

SEQ ID NO: 104749 - DNA, 15 bp, Homo sapiens
atcttatgtaccatg

SEQ ID NO: 104750 - DNA, 15 bp, Homo sapiens
gatcttatgtaccat

SEQ ID NO: 104751 - DNA, 15 bp, Homo sapiens
ggatcttatgtacca

SEQ ID NO: 104752 - DNA, 15 bp, Homo sapiens
aggatcttatgtacc

SEQ ID NO: 104753 - DNA, 15 bp, Homo sapiens
taggatcttatgtac

SEQ ID NO: 104754 - DNA, 15 bp, Homo sapiens
ctaggatcttatgta

SEQ ID NO: 104755 - DNA, 15 bp, Homo sapiens
actaggatcttatgt

SEQ ID NO: 104756 - DNA, 15 bp, Homo sapiens
cactaggatcttatg

SEQ ID NO: 104757 - DNA, 15 bp, Homo sapiens
ccactaggatcttat

SEQ ID NO: 104758 - DNA, 15 bp, Homo sapiens
cccactaggatctta

SEQ ID NO: 104759 - DNA, 15 bp, Homo sapiens
tcccactaggatctt

SEQ ID NO: 104760 - DNA, 15 bp, Homo sapiens
gtcccactaggatct

SEQ ID NO: 104761 - DNA, 15 bp, Homo sapiens
tgtcccactaggatc

SEQ ID NO: 104762 - DNA, 15 bp, Homo sapiens
atgtcccactaggat

SEQ ID NO: 104763 - DNA, 15 bp, Homo sapiens
aatgtcccactagga

SEQ ID NO: 104764 - DNA, 15 bp, Homo sapiens
aaatgtcccactagg

SEQ ID NO: 104765 - DNA, 15 bp, Homo sapiens
aaaatgtcccactag

SEQ ID NO: 104766 - DNA, 15 bp, Homo sapiens
gaaaatgtcccacta

SEQ ID NO: 104767 - DNA, 15 bp, Homo sapiens
tgaaaatgtcccact

SEQ ID NO: 104768 - DNA, 15 bp, Homo sapiens
gtgaaaatgtcccac

SEQ ID NO: 104769 - DNA, 15 bp, Homo sapiens
agtgaaaatgtccca

SEQ ID NO: 104770 - DNA, 15 bp, Homo sapiens
cagtgaaaatgtccc

SEQ ID NO: 104771 - DNA, 15 bp, Homo sapiens
acagtgaaaatgtcc

SEQ ID NO: 104772 - DNA, 15 bp, Homo sapiens
aacagtgaaaatgtc

SEQ ID NO: 104773 - DNA, 15 bp, Homo sapiens
taacagtgaaaatgt

SEQ ID NO: 104774 - DNA, 15 bp, Homo sapiens
ataacagtgaaaatg

SEQ ID NO: 104775 - DNA, 15 bp, Homo sapiens
gataacagtgaaaat

SEQ ID NO: 104776 - DNA, 15 bp, Homo sapiens
tgataacagtgaaaa

SEQ ID NO: 104777 - DNA, 15 bp, Homo sapiens
atgataacagtgaaa

SEQ ID NO: 104778 - DNA, 15 bp, Homo sapiens
aatgataacagtgaa

SEQ ID NO: 104779 - DNA, 15 bp, Homo sapiens
taatgataacagtga

SEQ ID NO: 104780 - DNA, 15 bp, Homo sapiens
ctaatgataacagtg

SEQ ID NO: 104781 - DNA, 15 bp, Homo sapiens
actaatgataacagt

SEQ ID NO: 104782 - DNA, 15 bp, Homo sapiens
tactaatgataacag

SEQ ID NO: 104783 - DNA, 15 bp, Homo sapiens
ttactaatgataaca

SEQ ID NO: 104784 - DNA, 15 bp, Homo sapiens
attactaatgataac

SEQ ID NO: 104785 - DNA, 15 bp, Homo sapiens
aattactaatgataa

SEQ ID NO: 104786 - DNA, 15 bp, Homo sapiens
taattactaatgata

SEQ ID NO: 104787 - DNA, 15 bp, Homo sapiens
ataattactaatgat

SEQ ID NO: 104788 - DNA, 15 bp, Homo sapiens
aataattactaatga

SEQ ID NO: 104789 - DNA, 15 bp, Homo sapiens
taataattactaatg

SEQ ID NO: 104790 - DNA, 15 bp, Homo sapiens
ataataattactaat

SEQ ID NO: 104791 - DNA, 15 bp, Homo sapiens
aataataattactaa

SEQ ID NO: 104792 - DNA, 15 bp, Homo sapiens
aaataataattacta

SEQ ID NO: 104793 - DNA, 15 bp, Homo sapiens
taaataataattact

SEQ ID NO: 104794 - DNA, 15 bp, Homo sapiens
ataaataataattac

SEQ ID NO: 104795 - DNA, 15 bp, Homo sapiens
aataaataataatta

SEQ ID NO: 104796 - DNA, 15 bp, Homo sapiens
aaataaataataatt

SEQ ID NO: 104797 - DNA, 15 bp, Homo sapiens
taaataaataataat

SEQ ID NO: 104798 - DNA, 15 bp, Homo sapiens
ataaataaataataa

SEQ ID NO: 104799 - DNA, 15 bp, Homo sapiens
tataaataaataata

SEQ ID NO: 104800 - DNA, 15 bp, Homo sapiens
ttataaataaataat

SEQ ID NO: 104801 - DNA, 15 bp, Homo sapiens
tttataaataaataa

SEQ ID NO: 104802 - DNA, 15 bp, Homo sapiens
ctttataaataaata

SEQ ID NO: 104803 - DNA, 15 bp, Homo sapiens
tctttataaataaat

SEQ ID NO: 104804 - DNA, 15 bp, Homo sapiens
ttctttataaataaa

SEQ ID NO: 104805 - DNA, 15 bp, Homo sapiens
tttctttataaataa

SEQ ID NO: 104806 - DNA, 15 bp, Homo sapiens
ctttctttataaata

SEQ ID NO: 104807 - DNA, 15 bp, Homo sapiens
gctttctttataaat

SEQ ID NO: 104808 - DNA, 15 bp, Homo sapiens
agctttctttataaa

SEQ ID NO: 104809 - DNA, 15 bp, Homo sapiens
tagctttctttataa

SEQ ID NO: 104810 - DNA, 15 bp, Homo sapiens
ttagctttctttata

SEQ ID NO: 104811 - DNA, 15 bp, Homo sapiens
tttagctttctttat

SEQ ID NO: 104812 - DNA, 15 bp, Homo sapiens
ctttagctttcttta

SEQ ID NO: 104813 - DNA, 15 bp, Homo sapiens
actttagctttcttt

SEQ ID NO: 104814 - DNA, 15 bp, Homo sapiens
gactttagctttctt

SEQ ID NO: 104815 - DNA, 15 bp, Homo sapiens
agactttagctttct

SEQ ID NO: 104816 - DNA, 15 bp, Homo sapiens
aagactttagctttc

SEQ ID NO: 104817 - DNA, 15 bp, Homo sapiens
caagactttagcttt

SEQ ID NO: 104818 - DNA, 15 bp, Homo sapiens
ccaagactttagctt

SEQ ID NO: 104819 - DNA, 15 bp, Homo sapiens
tccaagactttagct

SEQ ID NO: 104820 - DNA, 15 bp, Homo sapiens
atccaagactttagc

SEQ ID NO: 104821 - DNA, 15 bp, Homo sapiens
catccaagactttag

SEQ ID NO: 104822 - DNA, 15 bp, Homo sapiens
tcatccaagacttta

SEQ ID NO: 104823 - DNA, 15 bp, Homo sapiens
ttcatccaagacttt

SEQ ID NO: 104824 - DNA, 15 bp, Homo sapiens
tttcatccaagactt

SEQ ID NO: 104825 - DNA, 15 bp, Homo sapiens
ctttcatccaagact

SEQ ID NO: 104826 - DNA, 15 bp, Homo sapiens
gctttcatccaagac

SEQ ID NO: 104827 - DNA, 15 bp, Homo sapiens
agctttcatccaaga

SEQ ID NO: 104828 - DNA, 15 bp, Homo sapiens
aagctttcatccaag

SEQ ID NO: 104829 - DNA, 15 bp, Homo sapiens
aaagctttcatccaa

SEQ ID NO: 104830 - DNA, 15 bp, Homo sapiens
aaaagctttcatcca

SEQ ID NO: 104831 - DNA, 15 bp, Homo sapiens
taaaagctttcatcc

SEQ ID NO: 104832 - DNA, 15 bp, Homo sapiens
ataaaagctttcatc

SEQ ID NO: 104833 - DNA, 15 bp, Homo sapiens
cataaaagctttcat

SEQ ID NO: 104834 - DNA, 15 bp, Homo sapiens
ccataaaagctttca

SEQ ID NO: 104835 - DNA, 15 bp, Homo sapiens
accataaaagctttc

SEQ ID NO: 104836 - DNA, 15 bp, Homo sapiens
gaccataaaagcttt

SEQ ID NO: 104837 - DNA, 15 bp, Homo sapiens
agaccataaaagctt

SEQ ID NO: 104838 - DNA, 15 bp, Homo sapiens
aagaccataaaagct

SEQ ID NO: 104839 - DNA, 15 bp, Homo sapiens
aaagaccataaaagc

SEQ ID NO: 104840 - DNA, 15 bp, Homo sapiens
aaaagaccataaaag

SEQ ID NO: 104841 - DNA, 15 bp, Homo sapiens
gaaaagaccataaaa

SEQ ID NO: 104842 - DNA, 15 bp, Homo sapiens
agaaaagaccataaa

SEQ ID NO: 104843 - DNA, 15 bp, Homo sapiens
aagaaaagaccataa

SEQ ID NO: 104844 - DNA, 15 bp, Homo sapiens
taagaaaagaccata

SEQ ID NO: 104845 - DNA, 15 bp, Homo sapiens
ctaagaaaagaccat

SEQ ID NO: 104846 - DNA, 15 bp, Homo sapiens
actaagaaaagacca

SEQ ID NO: 104847 - DNA, 15 bp, Homo sapiens
cactaagaaaagacc

SEQ ID NO: 104848 - DNA, 15 bp, Homo sapiens
ccactaagaaaagac

SEQ ID NO: 104849 - DNA, 15 bp, Homo sapiens
gccactaagaaaaga

SEQ ID NO: 104850 - DNA, 15 bp, Homo sapiens
ggccactaagaaaag

SEQ ID NO: 104851 - DNA, 15 bp, Homo sapiens
tggccactaagaaaa

SEQ ID NO: 104852 - DNA, 15 bp, Homo sapiens
ctggccactaagaaa

SEQ ID NO: 104853 - DNA, 15 bp, Homo sapiens
tctggccactaagaa

SEQ ID NO: 104854 - DNA, 15 bp, Homo sapiens
ttctggccactaaga

SEQ ID NO: 104855 - DNA, 15 bp, Homo sapiens
attctggccactaag

SEQ ID NO: 104856 - DNA, 15 bp, Homo sapiens
tattctggccactaa

SEQ ID NO: 104857 - DNA, 15 bp, Homo sapiens
atattctggccacta

SEQ ID NO: 104858 - DNA, 15 bp, Homo sapiens
tatattctggccact

SEQ ID NO: 104859 - DNA, 15 bp, Homo sapiens
atatattctggccac

SEQ ID NO: 104860 - DNA, 15 bp, Homo sapiens
tatatattctggcca

SEQ ID NO: 104861 - DNA, 15 bp, Homo sapiens
atatatattctggcc

SEQ ID NO: 104862 - DNA, 15 bp, Homo sapiens
tatatatattctggc

SEQ ID NO: 104863 - DNA, 15 bp, Homo sapiens
atatatatattctgg

SEQ ID NO: 104864 - DNA, 15 bp, Homo sapiens
aatatatatattctg

SEQ ID NO: 104865 - DNA, 15 bp, Homo sapiens
gaatatatatattct

SEQ ID NO: 104866 - DNA, 15 bp, Homo sapiens
agaatatatatattc

SEQ ID NO: 104867 - DNA, 15 bp, Homo sapiens
cagaatatatatatt

SEQ ID NO: 104868 - DNA, 15 bp, Homo sapiens
gcagaatatatatat

SEQ ID NO: 104869 - DNA, 15 bp, Homo sapiens
agcagaatatatata

SEQ ID NO: 104870 - DNA, 15 bp, Homo sapiens
tagcagaatatatat

SEQ ID NO: 104871 - DNA, 15 bp, Homo sapiens
atagcagaatatata

SEQ ID NO: 104872 - DNA, 15 bp, Homo sapiens
aatagcagaatatat

SEQ ID NO: 104873 - DNA, 15 bp, Homo sapiens
aaatagcagaatata

SEQ ID NO: 104874 - DNA, 15 bp, Homo sapiens
taaatagcagaatat

SEQ ID NO: 104875 - DNA, 15 bp, Homo sapiens
ataaatagcagaata

SEQ ID NO: 104876 - DNA, 15 bp, Homo sapiens
tataaatagcagaat

SEQ ID NO: 104877 - DNA, 15 bp, Homo sapiens
atataaatagcagaa

SEQ ID NO: 104878 - DNA, 15 bp, Homo sapiens
aatataaatagcaga

SEQ ID NO: 104879 - DNA, 15 bp, Homo sapiens
aaatataaatagcag

SEQ ID NO: 104880 - DNA, 15 bp, Homo sapiens
caaatataaatagca

SEQ ID NO: 104881 - DNA, 15 bp, Homo sapiens
acaaatataaatagc

SEQ ID NO: 104882 - DNA, 15 bp, Homo sapiens
cacaaatataaatag

SEQ ID NO: 104883 - DNA, 15 bp, Homo sapiens
acacaaatataaata

SEQ ID NO: 104884 - DNA, 15 bp, Homo sapiens
aacacaaatataaat

SEQ ID NO: 104885 - DNA, 15 bp, Homo sapiens
caacacaaatataaa

SEQ ID NO: 104886 - DNA, 15 bp, Homo sapiens
ccaacacaaatataa

SEQ ID NO: 104887 - DNA, 15 bp, Homo sapiens
cccaacacaaatata

SEQ ID NO: 104888 - DNA, 15 bp, Homo sapiens
gcccaacacaaatat

SEQ ID NO: 104889 - DNA, 15 bp, Homo sapiens
tgcccaacacaaata

SEQ ID NO: 104890 - DNA, 15 bp, Homo sapiens
ttgcccaacacaaat

SEQ ID NO: 104891 - DNA, 15 bp, Homo sapiens
gttgcccaacacaaa

SEQ ID NO: 104892 - DNA, 15 bp, Homo sapiens
agttgcccaacacaa

SEQ ID NO: 104893 - DNA, 15 bp, Homo sapiens
tagttgcccaacaca

SEQ ID NO: 104894 - DNA, 15 bp, Homo sapiens
ttagttgcccaacac

SEQ ID NO: 104895 - DNA, 15 bp, Homo sapiens
attagttgcccaaca

SEQ ID NO: 104896 - DNA, 15 bp, Homo sapiens
cattagttgcccaac

SEQ ID NO: 104897 - DNA, 15 bp, Homo sapiens
tcattagttgcccaa

SEQ ID NO: 104898 - DNA, 15 bp, Homo sapiens
atcattagttgccca

SEQ ID NO: 104899 - DNA, 15 bp, Homo sapiens
aatcattagttgccc

SEQ ID NO: 104900 - DNA, 15 bp, Homo sapiens
gaatcattagttgcc

SEQ ID NO: 104901 - DNA, 15 bp, Homo sapiens
tgaatcattagttgc

SEQ ID NO: 104902 - DNA, 15 bp, Homo sapiens
ttgaatcattagttg

SEQ ID NO: 104903 - DNA, 15 bp, Homo sapiens
attgaatcattagtt

SEQ ID NO: 104904 - DNA, 15 bp, Homo sapiens
aattgaatcattagt

SEQ ID NO: 104905 - DNA, 15 bp, Homo sapiens
aaattgaatcattag

SEQ ID NO: 104906 - DNA, 15 bp, Homo sapiens
gaaattgaatcatta

SEQ ID NO: 104907 - DNA, 15 bp, Homo sapiens
agaaattgaatcatt

SEQ ID NO: 104908 - DNA, 15 bp, Homo sapiens
gagaaattgaatcat

SEQ ID NO: 104909 - DNA, 15 bp, Homo sapiens
ggagaaattgaatca

SEQ ID NO: 104910 - DNA, 15 bp, Homo sapiens
aggagaaattgaatc

SEQ ID NO: 104911 - DNA, 15 bp, Homo sapiens
aaggagaaattgaat

SEQ ID NO: 104912 - DNA, 15 bp, Homo sapiens
aaaggagaaattgaa

SEQ ID NO: 104913 - DNA, 15 bp, Homo sapiens
caaaggagaaattga

SEQ ID NO: 104914 - DNA, 15 bp, Homo sapiens
acaaaggagaaattg

SEQ ID NO: 104915 - DNA, 15 bp, Homo sapiens
cacaaaggagaaatt

SEQ ID NO: 104916 - DNA, 15 bp, Homo sapiens
gcacaaaggagaaat

SEQ ID NO: 104917 - DNA, 15 bp, Homo sapiens
tgcacaaaggagaaa

SEQ ID NO: 104918 - DNA, 15 bp, Homo sapiens
ctgcacaaaggagaa

SEQ ID NO: 104919 - DNA, 15 bp, Homo sapiens
cctgcacaaaggaga

SEQ ID NO: 104920 - DNA, 15 bp, Homo sapiens
gcctgcacaaaggag

SEQ ID NO: 104921 - DNA, 15 bp, Homo sapiens
tgcctgcacaaagga

SEQ ID NO: 104922 - DNA, 15 bp, Homo sapiens
ctgcctgcacaaagg

SEQ ID NO: 104923 - DNA, 15 bp, Homo sapiens
tctgcctgcacaaag

SEQ ID NO: 104924 - DNA, 15 bp, Homo sapiens
ctctgcctgcacaaa

SEQ ID NO: 104925 - DNA, 15 bp, Homo sapiens
tctctgcctgcacaa

SEQ ID NO: 104926 - DNA, 15 bp, Homo sapiens
ctctctgcctgcaca

SEQ ID NO: 104927 - DNA, 15 bp, Homo sapiens
gctctctgcctgcac

SEQ ID NO: 104928 - DNA, 15 bp, Homo sapiens
tgctctctgcctgca

SEQ ID NO: 104929 - DNA, 15 bp, Homo sapiens
ttgctctctgcctgc

SEQ ID NO: 104930 - DNA, 15 bp, Homo sapiens
cttgctctctgcctg

SEQ ID NO: 104931 - DNA, 15 bp, Homo sapiens
gcttgctctctgcct

SEQ ID NO: 104932 - DNA, 15 bp, Homo sapiens
tgcttgctctctgcc

SEQ ID NO: 104933 - DNA, 15 bp, Homo sapiens
ctgcttgctctctgc

SEQ ID NO: 104934 - DNA, 15 bp, Homo sapiens
tctgcttgctctctg

SEQ ID NO: 104935 - DNA, 15 bp, Homo sapiens
atctgcttgctctct

SEQ ID NO: 104936 - DNA, 15 bp, Homo sapiens
aatctgcttgctctc

SEQ ID NO: 104937 - DNA, 15 bp, Homo sapiens
aaatctgcttgctct

SEQ ID NO: 104938 - DNA, 15 bp, Homo sapiens
gaaatctgcttgctc

SEQ ID NO: 104939 - DNA, 15 bp, Homo sapiens
agaaatctgcttgct

SEQ ID NO: 104940 - DNA, 15 bp, Homo sapiens
aagaaatctgcttgc

SEQ ID NO: 104941 - DNA, 15 bp, Homo sapiens
aaagaaatctgcttg

SEQ ID NO: 104942 - DNA, 15 bp, Homo sapiens
caaagaaatctgctt

SEQ ID NO: 104943 - DNA, 15 bp, Homo sapiens
ccaaagaaatctgct

SEQ ID NO: 104944 - DNA, 15 bp, Homo sapiens
tccaaagaaatctgc

SEQ ID NO: 104945 - DNA, 15 bp, Homo sapiens
ttccaaagaaatctg

SEQ ID NO: 104946 - DNA, 15 bp, Homo sapiens
tttccaaagaaatct

SEQ ID NO: 104947 - DNA, 15 bp, Homo sapiens
ttttccaaagaaatc

SEQ ID NO: 104948 - DNA, 15 bp, Homo sapiens
cttttccaaagaaat

SEQ ID NO: 104949 - DNA, 15 bp, Homo sapiens
gcttttccaaagaaa

SEQ ID NO: 104950 - DNA, 15 bp, Homo sapiens
tgcttttccaaagaa

SEQ ID NO: 104951 - DNA, 15 bp, Homo sapiens
ttgcttttccaaaga

SEQ ID NO: 104952 - DNA, 15 bp, Homo sapiens
gttgcttttccaaag

SEQ ID NO: 104953 - DNA, 15 bp, Homo sapiens
agttgcttttccaaa

SEQ ID NO: 104954 - DNA, 15 bp, Homo sapiens
gagttgcttttccaa

SEQ ID NO: 104955 - DNA, 15 bp, Homo sapiens
ggagttgcttttcca

SEQ ID NO: 104956 - DNA, 15 bp, Homo sapiens
tggagttgcttttcc

SEQ ID NO: 104957 - DNA, 15 bp, Homo sapiens
ctggagttgcttttc

SEQ ID NO: 104958 - DNA, 15 bp, Homo sapiens
cctggagttgctttt

SEQ ID NO: 104959 - DNA, 15 bp, Homo sapiens
acctggagttgcttt

SEQ ID NO: 104960 - DNA, 15 bp, Homo sapiens
cacctggagttgctt

SEQ ID NO: 104961 - DNA, 15 bp, Homo sapiens
gcacctggagttgct

SEQ ID NO: 104962 - DNA, 15 bp, Homo sapiens
agcacctggagttgc

SEQ ID NO: 104963 - DNA, 15 bp, Homo sapiens
cagcacctggagttg

SEQ ID NO: 104964 - DNA, 15 bp, Homo sapiens
gcagcacctggagtt

SEQ ID NO: 104965 - DNA, 15 bp, Homo sapiens
cgcagcacctggagt

SEQ ID NO: 104966 - DNA, 15 bp, Homo sapiens
ccgcagcacctggag

SEQ ID NO: 104967 - DNA, 15 bp, Homo sapiens
cccgcagcacctgga

SEQ ID NO: 104968 - DNA, 15 bp, Homo sapiens
tcccgcagcacctgg

SEQ ID NO: 104969 - DNA, 15 bp, Homo sapiens
ttcccgcagcacctg

SEQ ID NO: 104970 - DNA, 15 bp, Homo sapiens
tttcccgcagcacct

SEQ ID NO: 104971 - DNA, 15 bp, Homo sapiens
gtttcccgcagcacc

SEQ ID NO: 104972 - DNA, 15 bp, Homo sapiens
agtttcccgcagcac

SEQ ID NO: 104973 - DNA, 15 bp, Homo sapiens
cagtttcccgcagca

SEQ ID NO: 104974 - DNA, 15 bp, Homo sapiens
tcagtttcccgcagc

SEQ ID NO: 104975 - DNA, 15 bp, Homo sapiens
gtcagtttcccgcag

SEQ ID NO: 104976 - DNA, 15 bp, Homo sapiens
ggtcagtttcccgca

SEQ ID NO: 104977 - DNA, 15 bp, Homo sapiens
tggtcagtttcccgc

SEQ ID NO: 104978 - DNA, 15 bp, Homo sapiens
ctggtcagtttcccg

SEQ ID NO: 104979 - DNA, 15 bp, Homo sapiens
tctggtcagtttccc

SEQ ID NO: 104980 - DNA, 15 bp, Homo sapiens
atctggtcagtttcc

SEQ ID NO: 104981 - DNA, 15 bp, Homo sapiens
catctggtcagtttc

SEQ ID NO: 104982 - DNA, 15 bp, Homo sapiens
gcatctggtcagttt

SEQ ID NO: 104983 - DNA, 15 bp, Homo sapiens
agcatctggtcagtt

SEQ ID NO: 104984 - DNA, 15 bp, Homo sapiens
aagcatctggtcagt

SEQ ID NO: 104985 - DNA, 15 bp, Homo sapiens
gaagcatctggtcag

SEQ ID NO: 104986 - DNA, 15 bp, Homo sapiens
tgaagcatctggtca

SEQ ID NO: 104987 - DNA, 15 bp, Homo sapiens
ttgaagcatctggtc

SEQ ID NO: 104988 - DNA, 15 bp, Homo sapiens
cttgaagcatctggt

SEQ ID NO: 104989 - DNA, 15 bp, Homo sapiens
acttgaagcatctgg

SEQ ID NO: 104990 - DNA, 15 bp, Homo sapiens
gacttgaagcatctg

SEQ ID NO: 104991 - DNA, 15 bp, Homo sapiens
agacttgaagcatct

SEQ ID NO: 104992 - DNA, 15 bp, Homo sapiens
aagacttgaagcatc

SEQ ID NO: 104993 - DNA, 15 bp, Homo sapiens
caagacttgaagcat

SEQ ID NO: 104994 - DNA, 15 bp, Homo sapiens
gcaagacttgaagca

SEQ ID NO: 104995 - DNA, 15 bp, Homo sapiens
tgcaagacttgaagc

SEQ ID NO: 104996 - DNA, 15 bp, Homo sapiens
ttgcaagacttgaag

SEQ ID NO: 104997 - DNA, 15 bp, Homo sapiens
cttgcaagacttgaa

SEQ ID NO: 104998 - DNA, 15 bp, Homo sapiens
tcttgcaagacttga

SEQ ID NO: 104999 - DNA, 15 bp, Homo sapiens
ctcttgcaagacttg

SEQ ID NO: 105000 - DNA, 15 bp, Homo sapiens
tctcttgcaagactt

SEQ ID NO: 105001 - DNA, 15 bp, Homo sapiens
ctctcttgcaagact

SEQ ID NO: 105002 - DNA, 15 bp, Homo sapiens
gctctcttgcaagac

SEQ ID NO: 105003 - DNA, 15 bp, Homo sapiens
ccaagctctcttgca

SEQ ID NO: 105004 - DNA, 15 bp, Homo sapiens
cccaagctctcttgc

SEQ ID NO: 105005 - DNA, 15 bp, Homo sapiens
ccccaagctctcttg

SEQ ID NO: 105006 - DNA, 15 bp, Homo sapiens
cccccaagctctctt

SEQ ID NO: 105007 - DNA, 15 bp, Homo sapiens
tcccccaagctctct

SEQ ID NO: 105008 - DNA, 15 bp, Homo sapiens
ctcccccaagctctc

SEQ ID NO: 105009 - DNA, 15 bp, Homo sapiens
gctcccccaagctct

SEQ ID NO: 105010 - DNA, 15 bp, Homo sapiens
agctcccccaagctc

SEQ ID NO: 105011 - DNA, 15 bp, Homo sapiens
cagctcccccaagct

SEQ ID NO: 105012 - DNA, 15 bp, Homo sapiens
ccagctcccccaagc

SEQ ID NO: 105013 - DNA, 15 bp, Homo sapiens
tccagctcccccaag

SEQ ID NO: 105014 - DNA, 15 bp, Homo sapiens
gtccagctcccccaa

SEQ ID NO: 105015 - DNA, 15 bp, Homo sapiens
tgtccagctccccca

SEQ ID NO: 105016 - DNA, 15 bp, Homo sapiens
ttgtccagctccccc

SEQ ID NO: 105017 - DNA, 15 bp, Homo sapiens
tttgtccagctcccc

SEQ ID NO: 105018 - DNA, 15 bp, Homo sapiens
gtttgtccagctccc

SEQ ID NO: 105019 - DNA, 15 bp, Homo sapiens
tgtttgtccagctcc

SEQ ID NO: 105020 - DNA, 15 bp, Homo sapiens
ctgtttgtccagctc

SEQ ID NO: 105021 - DNA, 15 bp, Homo sapiens
gctgtttgtccagct

SEQ ID NO: 105022 - DNA, 15 bp, Homo sapiens
agctgtttgtccagc

SEQ ID NO: 105023 - DNA, 15 bp, Homo sapiens
gagctgtttgtccag

SEQ ID NO: 105024 - DNA, 15 bp, Homo sapiens
tgagctgtttgtcca

SEQ ID NO: 105025 - DNA, 15 bp, Homo sapiens
gtgagctgtttgtcc

SEQ ID NO: 105026 - DNA, 15 bp, Homo sapiens
ggtgagctgtttgtc

SEQ ID NO: 105027 - DNA, 15 bp, Homo sapiens
tggtgagctgtttgt

SEQ ID NO: 105028 - DNA, 15 bp, Homo sapiens
gtggtgagctgtttg

SEQ ID NO: 105029 - DNA, 15 bp, Homo sapiens
tgtggtgagctgttt

SEQ ID NO: 105030 - DNA, 15 bp, Homo sapiens
atgtggtgagctgtt

SEQ ID NO: 105031 - DNA, 15 bp, Homo sapiens
tatgtggtgagctgt

SEQ ID NO: 105032 - DNA, 15 bp, Homo sapiens
gtatgtggtgagctg

SEQ ID NO: 105033 - DNA, 15 bp, Homo sapiens
ggtatgtggtgagct

SEQ ID NO: 105034 - DNA, 15 bp, Homo sapiens
aggtatgtggtgagc

SEQ ID NO: 105035 - DNA, 15 bp, Homo sapiens
caggtatgtggtgag

SEQ ID NO: 105036 - DNA, 15 bp, Homo sapiens
tcaggtatgtggtga

SEQ ID NO: 105037 - DNA, 15 bp, Homo sapiens
gtcaggtatgtggtg

SEQ ID NO: 105038 - DNA, 15 bp, Homo sapiens
agtcaggtatgtggt

SEQ ID NO: 105039 - DNA, 15 bp, Homo sapiens
cagtcaggtatgtgg

SEQ ID NO: 105040 - DNA, 15 bp, Homo sapiens
tcagtcaggtatgtg

SEQ ID NO: 105041 - DNA, 15 bp, Homo sapiens
gtcagtcaggtatgt

SEQ ID NO: 105042 - DNA, 15 bp, Homo sapiens
tgtcagtcaggtatg

SEQ ID NO: 105043 - DNA, 15 bp, Homo sapiens
ctgtcagtcaggtat

SEQ ID NO: 105044 - DNA, 15 bp, Homo sapiens
cctgtcagtcaggta

SEQ ID NO: 105045 - DNA, 15 bp, Homo sapiens
tcctgtcagtcaggt

SEQ ID NO: 105046 - DNA, 15 bp, Homo sapiens
atcctgtcagtcagg

SEQ ID NO: 105047 - DNA, 15 bp, Homo sapiens
tatcctgtcagtcag

SEQ ID NO: 105048 - DNA, 15 bp, Homo sapiens
ctatcctgtcagtca

SEQ ID NO: 105049 - DNA, 15 bp, Homo sapiens
tctatcctgtcagtc

SEQ ID NO: 105050 - DNA, 15 bp, Homo sapiens
atctatcctgtcagt

SEQ ID NO: 105051 - DNA, 15 bp, Homo sapiens
catctatcctgtcag

SEQ ID NO: 105052 - DNA, 15 bp, Homo sapiens
gcatctatcctgtca

SEQ ID NO: 105053 - DNA, 15 bp, Homo sapiens
agcatctatcctgtc

SEQ ID NO: 105054 - DNA, 15 bp, Homo sapiens
aagcatctatcctgt

SEQ ID NO: 105055 - DNA, 15 bp, Homo sapiens
aaagcatctatcctg

SEQ ID NO: 105056 - DNA, 15 bp, Homo sapiens
gaaagcatctatcct

SEQ ID NO: 105057 - DNA, 15 bp, Homo sapiens
ggaaagcatctatcc

SEQ ID NO: 105058 - DNA, 15 bp, Homo sapiens
tggaaagcatctatc

SEQ ID NO: 105059 - DNA, 15 bp, Homo sapiens
ttggaaagcatctat

SEQ ID NO: 105060 - DNA, 15 bp, Homo sapiens
cttggaaagcatcta

SEQ ID NO: 105061 - DNA, 15 bp, Homo sapiens
acttggaaagcatct

SEQ ID NO: 105062 - DNA, 15 bp, Homo sapiens
aacttggaaagcatc

SEQ ID NO: 105063 - DNA, 15 bp, Homo sapiens
gaacttggaaagcat

SEQ ID NO: 105064 - DNA, 15 bp, Homo sapiens
ggaacttggaaagca

SEQ ID NO: 105065 - DNA, 15 bp, Homo sapiens
tggaacttggaaagc

SEQ ID NO: 105066 - DNA, 15 bp, Homo sapiens
gtggaacttggaaag

SEQ ID NO: 105067 - DNA, 15 bp, Homo sapiens
tgtggaacttggaaa

SEQ ID NO: 105068 - DNA, 15 bp, Homo sapiens
ctgtggaacttggaa

SEQ ID NO: 105069 - DNA, 15 bp, Homo sapiens
cctgtggaacttgga

SEQ ID NO: 105070 - DNA, 15 bp, Homo sapiens
tcctgtggaacttgg

SEQ ID NO: 105071 - DNA, 15 bp, Homo sapiens
ttcctgtggaacttg

SEQ ID NO: 105072 - DNA, 15 bp, Homo sapiens
cttcctgtggaactt

SEQ ID NO: 105073 - DNA, 15 bp, Homo sapiens
gcttcctgtggaact

SEQ ID NO: 105074 - DNA, 15 bp, Homo sapiens
agcttcctgtggaac

SEQ ID NO: 105075 - DNA, 15 bp, Homo sapiens
gagcttcctgtggaa

SEQ ID NO: 105076 - DNA, 15 bp, Homo sapiens
tgagcttcctgtgga

SEQ ID NO: 105077 - DNA, 15 bp, Homo sapiens
ctgagcttcctgtgg

SEQ ID NO: 105078 - DNA, 15 bp, Homo sapiens
cctgagcttcctgtg

SEQ ID NO: 105079 - DNA, 15 bp, Homo sapiens
acctgagcttcctgt

SEQ ID NO: 105080 - DNA, 15 bp, Homo sapiens
tacctgagcttcctg

SEQ ID NO: 105081 - DNA, 15 bp, Homo sapiens
atacctgagcttcct

SEQ ID NO: 105082 - DNA, 15 bp, Homo sapiens
aatacctgagcttcc

SEQ ID NO: 105083 - DNA, 15 bp, Homo sapiens
caatacctgagcttc

SEQ ID NO: 105084 - DNA, 15 bp, Homo sapiens
gcaatacctgagctt

SEQ ID NO: 105085 - DNA, 15 bp, Homo sapiens
ggcaatacctgagct

SEQ ID NO: 105086 - DNA, 15 bp, Homo sapiens
cggcaatacctgagc

SEQ ID NO: 105087 - DNA, 15 bp, Homo sapiens
acggcaatacctgag

SEQ ID NO: 105088 - DNA, 15 bp, Homo sapiens
cacggcaatacctga

SEQ ID NO: 105089 - DNA, 15 bp, Homo sapiens
gcacggcaatacctg

SEQ ID NO: 105090 - DNA, 15 bp, Homo sapiens
tgcacggcaatacct

SEQ ID NO: 105091 - DNA, 15 bp, Homo sapiens
atgcacggcaatacc

SEQ ID NO: 105092 - DNA, 15 bp, Homo sapiens
aatgcacggcaatac

SEQ ID NO: 105093 - DNA, 15 bp, Homo sapiens
aaatgcacggcaata

SEQ ID NO: 105094 - DNA, 15 bp, Homo sapiens
caaatgcacggcaat

SEQ ID NO: 105095 - DNA, 15 bp, Homo sapiens
tcaaatgcacggcaa

SEQ ID NO: 105096 - DNA, 15 bp, Homo sapiens
ctcaaatgcacggca

SEQ ID NO: 105097 - DNA, 15 bp, Homo sapiens
cctcaaatgcacggc

SEQ ID NO: 105098 - DNA, 15 bp, Homo sapiens
ccctcaaatgcacgg

SEQ ID NO: 105099 - DNA, 15 bp, Homo sapiens
gccctcaaatgcacg

SEQ ID NO: 105100 - DNA, 15 bp, Homo sapiens
agccctcaaatgcac

SEQ ID NO: 105101 - DNA, 15 bp, Homo sapiens
aagccctcaaatgca

SEQ ID NO: 105102 - DNA, 15 bp, Homo sapiens
aaagccctcaaatgc

SEQ ID NO: 105103 - DNA, 15 bp, Homo sapiens
aaaagccctcaaatg

SEQ ID NO: 105104 - DNA, 15 bp, Homo sapiens
caaaagccctcaaat

SEQ ID NO: 105105 - DNA, 15 bp, Homo sapiens
tcaaaagccctcaaa

SEQ ID NO: 105106 - DNA, 15 bp, Homo sapiens
ctcaaaagccctcaa

SEQ ID NO: 105107 - DNA, 15 bp, Homo sapiens
gctcaaaagccctca

SEQ ID NO: 105108 - DNA, 15 bp, Homo sapiens
agctcaaaagccctc

SEQ ID NO: 105109 - DNA, 15 bp, Homo sapiens
cagctcaaaagccct

SEQ ID NO: 105110 - DNA, 15 bp, Homo sapiens
acagctcaaaagccc

SEQ ID NO: 105111 - DNA, 15 bp, Homo sapiens
tacagctcaaaagcc

SEQ ID NO: 105112 - DNA, 15 bp, Homo sapiens
ttacagctcaaaagc

SEQ ID NO: 105113 - DNA, 15 bp, Homo sapiens
tttacagctcaaaag

SEQ ID NO: 105114 - DNA, 15 bp, Homo sapiens
ctttacagctcaaaa

SEQ ID NO: 105115 - DNA, 15 bp, Homo sapiens
tctttacagctcaaa

SEQ ID NO: 105116 - DNA, 15 bp, Homo sapiens
ctctttacagctcaa

SEQ ID NO: 105117 - DNA, 15 bp, Homo sapiens
tctctttacagctca

SEQ ID NO: 105118 - DNA, 15 bp, Homo sapiens
ctctctttacagctc

SEQ ID NO: 105119 - DNA, 15 bp, Homo sapiens
gctctctttacagct

SEQ ID NO: 105120 - DNA, 15 bp, Homo sapiens
agctctctttacagc

SEQ ID NO: 105121 - DNA, 15 bp, Homo sapiens
aagctctctttacag

SEQ ID NO: 105122 - DNA, 15 bp, Homo sapiens
aaagctctctttaca

SEQ ID NO: 105123 - DNA, 15 bp, Homo sapiens
aaaagctctctttac

SEQ ID NO: 105124 - DNA, 15 bp, Homo sapiens
caaaagctctcttta

SEQ ID NO: 105125 - DNA, 15 bp, Homo sapiens
acaaaagctctcttt

SEQ ID NO: 105126 - DNA, 15 bp, Homo sapiens
tacaaaagctctctt

SEQ ID NO: 105127 - DNA, 15 bp, Homo sapiens
ttacaaaagctctct

SEQ ID NO: 105128 - DNA, 15 bp, Homo sapiens
attacaaaagctctc

SEQ ID NO: 105129 - DNA, 15 bp, Homo sapiens
aattacaaaagctct

SEQ ID NO: 105130 - DNA, 15 bp, Homo sapiens
caattacaaaagctc

SEQ ID NO: 105131 - DNA, 15 bp, Homo sapiens
gcaattacaaaagct

SEQ ID NO: 105132 - DNA, 15 bp, Homo sapiens
ggcaattacaaaagc

SEQ ID NO: 105133 - DNA, 15 bp, Homo sapiens
aggcaattacaaaag

SEQ ID NO: 105134 - DNA, 15 bp, Homo sapiens
gaggcaattacaaaa

SEQ ID NO: 105135 - DNA, 15 bp, Homo sapiens
ggaggcaattacaaa

SEQ ID NO: 105136 - DNA, 15 bp, Homo sapiens
aggaggcaattacaa

SEQ ID NO: 105137 - DNA, 15 bp, Homo sapiens
gaggaggcaattaca

SEQ ID NO: 105138 - DNA, 15 bp, Homo sapiens
tgaggaggcaattac

SEQ ID NO: 105139 - DNA, 15 bp, Homo sapiens
ttgaggaggcaatta

SEQ ID NO: 105140 - DNA, 15 bp, Homo sapiens
gttgaggaggcaatt

SEQ ID NO: 105141 - DNA, 15 bp, Homo sapiens
agttgaggaggcaat

SEQ ID NO: 105142 - DNA, 15 bp, Homo sapiens
tagttgaggaggcaa

SEQ ID NO: 105143 - DNA, 15 bp, Homo sapiens
atagttgaggaggca

SEQ ID NO: 105144 - DNA, 15 bp, Homo sapiens
tatagttgaggaggc

SEQ ID NO: 105145 - DNA, 15 bp, Homo sapiens
ttatagttgaggagg

SEQ ID NO: 105146 - DNA, 15 bp, Homo sapiens
cttatagttgaggag

SEQ ID NO: 105147 - DNA, 15 bp, Homo sapiens
tcttatagttgagga

SEQ ID NO: 105148 - DNA, 15 bp, Homo sapiens
ctcttatagttgagg

SEQ ID NO: 105149 - DNA, 15 bp, Homo sapiens
tctcttatagttgag

SEQ ID NO: 105150 - DNA, 15 bp, Homo sapiens
ttctcttatagttga

SEQ ID NO: 105151 - DNA, 15 bp, Homo sapiens
gttctcttatagttg

SEQ ID NO: 105152 - DNA, 15 bp, Homo sapiens
ggttctcttatagtt

SEQ ID NO: 105153 - DNA, 15 bp, Homo sapiens
gggttctcttatagt

SEQ ID NO: 105154 - DNA, 15 bp, Homo sapiens
ggggttctcttatag

SEQ ID NO: 105155 - DNA, 15 bp, Homo sapiens
aggggttctcttata

SEQ ID NO: 105156 - DNA, 15 bp, Homo sapiens
gaggggttctcttat

SEQ ID NO: 105157 - DNA, 15 bp, Homo sapiens
ggaggggttctctta

SEQ ID NO: 105158 - DNA, 15 bp, Homo sapiens
aggaggggttctctt

SEQ ID NO: 105159 - DNA, 15 bp, Homo sapiens
caggaggggttctct

SEQ ID NO: 105160 - DNA, 15 bp, Homo sapiens
gcaggaggggttctc

SEQ ID NO: 105161 - DNA, 15 bp, Homo sapiens
agcaggaggggttct

SEQ ID NO: 105162 - DNA, 15 bp, Homo sapiens
gagcaggaggggttc

SEQ ID NO: 105163 - DNA, 15 bp, Homo sapiens
agagcaggaggggtt

SEQ ID NO: 105164 - DNA, 15 bp, Homo sapiens
gagagcaggaggggt

SEQ ID NO: 105165 - DNA, 15 bp, Homo sapiens
ggagagcaggagggg

SEQ ID NO: 105166 - DNA, 15 bp, Homo sapiens
tggagagcaggaggg

SEQ ID NO: 105167 - DNA, 15 bp, Homo sapiens
ttggagagcaggagg

SEQ ID NO: 105168 - DNA, 15 bp, Homo sapiens
tttggagagcaggag

SEQ ID NO: 105169 - DNA, 15 bp, Homo sapiens
ttttggagagcagga

SEQ ID NO: 105170 - DNA, 15 bp, Homo sapiens
gttttggagagcagg

SEQ ID NO: 105171 - DNA, 15 bp, Homo sapiens
ggttttggagagcag

SEQ ID NO: 105172 - DNA, 15 bp, Homo sapiens
cggttttggagagca

SEQ ID NO: 105173 - DNA, 15 bp, Homo sapiens
tcggttttggagagc

SEQ ID NO: 105174 - DNA, 15 bp, Homo sapiens
ctcggttttggagag

SEQ ID NO: 105175 - DNA, 15 bp, Homo sapiens
tctcggttttggaga

SEQ ID NO: 105176 - DNA, 15 bp, Homo sapiens
ctctcggttttggag

SEQ ID NO: 105177 - DNA, 15 bp, Homo sapiens
actctcggttttgga

SEQ ID NO: 105178 - DNA, 15 bp, Homo sapiens
gactctcggttttgg

SEQ ID NO: 105179 - DNA, 15 bp, Homo sapiens
tgactctcggttttg

SEQ ID NO: 105180 - DNA, 15 bp, Homo sapiens
ttgactctcggtttt

SEQ ID NO: 105181 - DNA, 15 bp, Homo sapiens
attgactctcggttt

SEQ ID NO: 105182 - DNA, 15 bp, Homo sapiens
cattgactctcggtt

SEQ ID NO: 105183 - DNA, 15 bp, Homo sapiens
ccattgactctcggt

SEQ ID NO: 105184 - DNA, 15 bp, Homo sapiens
cccattgactctcgg

SEQ ID NO: 105185 - DNA, 15 bp, Homo sapiens
tcccattgactctcg

SEQ ID NO: 105186 - DNA, 15 bp, Homo sapiens
ttcccattgactctc

SEQ ID NO: 105187 - DNA, 15 bp, Homo sapiens
tttcccattgactct

SEQ ID NO: 105188 - DNA, 15 bp, Homo sapiens
ctttcccattgactc

SEQ ID NO: 105189 - DNA, 15 bp, Homo sapiens
tctttcccattgact

SEQ ID NO: 105190 - DNA, 15 bp, Homo sapiens
atctttcccattgac

SEQ ID NO: 105191 - DNA, 15 bp, Homo sapiens
aatctttcccattga

SEQ ID NO: 105192 - DNA, 15 bp, Homo sapiens
caatctttcccattg

SEQ ID NO: 105193 - DNA, 15 bp, Homo sapiens
tcaatctttcccatt

SEQ ID NO: 105194 - DNA, 15 bp, Homo sapiens
gtcaatctttcccat

SEQ ID NO: 105195 - DNA, 15 bp, Homo sapiens
ggtcaatctttccca

SEQ ID NO: 105196 - DNA, 15 bp, Homo sapiens
aggtcaatctttccc

SEQ ID NO: 105197 - DNA, 15 bp, Homo sapiens
aaggtcaatctttcc

SEQ ID NO: 105198 - DNA, 15 bp, Homo sapiens
taaggtcaatctttc

SEQ ID NO: 105199 - DNA, 15 bp, Homo sapiens
gtaaggtcaatcttt

SEQ ID NO: 105200 - DNA, 15 bp, Homo sapiens
agtaaggtcaatctt

SEQ ID NO: 105201 - DNA, 15 bp, Homo sapiens
aagtaaggtcaatct

SEQ ID NO: 105202 - DNA, 15 bp, Homo sapiens
taagtaaggtcaatc

SEQ ID NO: 105203 - DNA, 15 bp, Homo sapiens
gtaagtaaggtcaat

SEQ ID NO: 105204 - DNA, 15 bp, Homo sapiens
tgtaagtaaggtcaa

SEQ ID NO: 105205 - DNA, 15 bp, Homo sapiens
ctgtaagtaaggtca

SEQ ID NO: 105206 - DNA, 15 bp, Homo sapiens
cctgtaagtaaggtc

SEQ ID NO: 105207 - DNA, 15 bp, Homo sapiens
ccctgtaagtaaggt

SEQ ID NO: 105208 - DNA, 15 bp, Homo sapiens
gccctgtaagtaagg

SEQ ID NO: 105209 - DNA, 15 bp, Homo sapiens
tgccctgtaagtaag

SEQ ID NO: 105210 - DNA, 15 bp, Homo sapiens
ctgccctgtaagtaa

SEQ ID NO: 105211 - DNA, 15 bp, Homo sapiens
gctgccctgtaagta

SEQ ID NO: 105212 - DNA, 15 bp, Homo sapiens
tgctgccctgtaagt

SEQ ID NO: 105213 - DNA, 15 bp, Homo sapiens
atgctgccctgtaag

SEQ ID NO: 105214 - DNA, 15 bp, Homo sapiens
aatgctgccctgtaa

SEQ ID NO: 105215 - DNA, 15 bp, Homo sapiens
aaatgctgccctgta

SEQ ID NO: 105216 - DNA, 15 bp, Homo sapiens
caaatgctgccctgt

SEQ ID NO: 105217 - DNA, 15 bp, Homo sapiens
ccaaatgctgccctg

SEQ ID NO: 105218 - DNA, 15 bp, Homo sapiens
cccaaatgctgccct

SEQ ID NO: 105219 - DNA, 15 bp, Homo sapiens
acccaaatgctgccc

SEQ ID NO: 105220 - DNA, 15 bp, Homo sapiens
aacccaaatgctgcc

SEQ ID NO: 105221 - DNA, 15 bp, Homo sapiens
aaacccaaatgctgc

SEQ ID NO: 105222 - DNA, 15 bp, Homo sapiens
aaaacccaaatgctg

SEQ ID NO: 105223 - DNA, 15 bp, Homo sapiens
caaaacccaaatgct

SEQ ID NO: 105224 - DNA, 15 bp, Homo sapiens
ccaaaacccaaatgc

SEQ ID NO: 105225 - DNA, 15 bp, Homo sapiens
tccaaaacccaaatg

SEQ ID NO: 105226 - DNA, 15 bp, Homo sapiens
ctccaaaacccaaat

SEQ ID NO: 105227 - DNA, 15 bp, Homo sapiens
actccaaaacccaaa

SEQ ID NO: 105228 - DNA, 15 bp, Homo sapiens
aactccaaaacccaa

SEQ ID NO: 105229 - DNA, 15 bp, Homo sapiens
gaactccaaaaccca

SEQ ID NO: 105230 - DNA, 15 bp, Homo sapiens
agaactccaaaaccc

SEQ ID NO: 105231 - DNA, 15 bp, Homo sapiens
gagaactccaaaacc

SEQ ID NO: 105232 - DNA, 15 bp, Homo sapiens
agagaactccaaaac

SEQ ID NO: 105233 - DNA, 15 bp, Homo sapiens
aagagaactccaaaa

SEQ ID NO: 105234 - DNA, 15 bp, Homo sapiens
caagagaactccaaa

SEQ ID NO: 105235 - DNA, 15 bp, Homo sapiens
gcaagagaactccaa

SEQ ID NO: 105236 - DNA, 15 bp, Homo sapiens
agcaagagaactcca

SEQ ID NO: 105237 - DNA, 15 bp, Homo sapiens
aagcaagagaactcc

SEQ ID NO: 105238 - DNA, 15 bp, Homo sapiens
aaagcaagagaactc

SEQ ID NO: 105239 - DNA, 15 bp, Homo sapiens
gaaagcaagagaact

SEQ ID NO: 105240 - DNA, 15 bp, Homo sapiens
agaaagcaagagaac

SEQ ID NO: 105241 - DNA, 15 bp, Homo sapiens
tagaaagcaagagaa

SEQ ID NO: 105242 - DNA, 15 bp, Homo sapiens
atagaaagcaagaga

SEQ ID NO: 105243 - DNA, 15 bp, Homo sapiens
catagaaagcaagag

SEQ ID NO: 105244 - DNA, 15 bp, Homo sapiens
acatagaaagcaaga

SEQ ID NO: 105245 - DNA, 15 bp, Homo sapiens
cacatagaaagcaag

SEQ ID NO: 105246 - DNA, 15 bp, Homo sapiens
tcacatagaaagcaa

SEQ ID NO: 105247 - DNA, 15 bp, Homo sapiens
ctcacatagaaagca

SEQ ID NO: 105248 - DNA, 15 bp, Homo sapiens
tctcacatagaaagc

SEQ ID NO: 105249 - DNA, 15 bp, Homo sapiens
gtctcacatagaaag

SEQ ID NO: 105250 - DNA, 15 bp, Homo sapiens
agtctcacatagaaa

SEQ ID NO: 105251 - DNA, 15 bp, Homo sapiens
gagtctcacatagaa

SEQ ID NO: 105252 - DNA, 15 bp, Homo sapiens
agagtctcacataga

SEQ ID NO: 105253 - DNA, 15 bp, Homo sapiens
cagagtctcacatag

SEQ ID NO: 105254 - DNA, 15 bp, Homo sapiens
ccagagtctcacata

SEQ ID NO: 105255 - DNA, 15 bp, Homo sapiens
gccagagtctcacat

SEQ ID NO: 105256 - DNA, 15 bp, Homo sapiens
tgccagagtctcaca

SEQ ID NO: 105257 - DNA, 15 bp, Homo sapiens
ttgccagagtctcac

SEQ ID NO: 105258 - DNA, 15 bp, Homo sapiens
tttgccagagtctca

SEQ ID NO: 105259 - DNA, 15 bp, Homo sapiens
ttttgccagagtctc

SEQ ID NO: 105260 - DNA, 15 bp, Homo sapiens
cttttgccagagtct

SEQ ID NO: 105261 - DNA, 15 bp, Homo sapiens
acttttgccagagtc

SEQ ID NO: 105262 - DNA, 15 bp, Homo sapiens
gacttttgccagagt

SEQ ID NO: 105263 - DNA, 15 bp, Homo sapiens
agacttttgccagag

SEQ ID NO: 105264 - DNA, 15 bp, Homo sapiens
aagacttttgccaga

SEQ ID NO: 105265 - DNA, 15 bp, Homo sapiens
taagacttttgccag

SEQ ID NO: 105266 - DNA, 15 bp, Homo sapiens
ataagacttttgcca

SEQ ID NO: 105267 - DNA, 15 bp, Homo sapiens
tataagacttttgcc

SEQ ID NO: 105268 - DNA, 15 bp, Homo sapiens
atataagacttttgc

SEQ ID NO: 105269 - DNA, 15 bp, Homo sapiens
tatataagacttttg

SEQ ID NO: 105270 - DNA, 15 bp, Homo sapiens
ctatataagactttt

SEQ ID NO: 105271 - DNA, 15 bp, Homo sapiens
actatataagacttt

SEQ ID NO: 105272 - DNA, 15 bp, Homo sapiens
aactatataagactt

SEQ ID NO: 105273 - DNA, 15 bp, Homo sapiens
aaactatataagact

SEQ ID NO: 105274 - DNA, 15 bp, Homo sapiens
taaactatataagac

SEQ ID NO: 105275 - DNA, 15 bp, Homo sapiens
ataaactatataaga

SEQ ID NO: 105276 - DNA, 15 bp, Homo sapiens
aataaactatataag

SEQ ID NO: 105277 - DNA, 15 bp, Homo sapiens
aaataaactatataa

SEQ ID NO: 105278 - DNA, 15 bp, Homo sapiens
aaaataaactatata

SEQ ID NO: 105279 - DNA, 15 bp, Homo sapiens
taaaataaactatat

SEQ ID NO: 105280 - DNA, 15 bp, Homo sapiens
ataaaataaactata

SEQ ID NO: 105281 - DNA, 15 bp, Homo sapiens
aataaaataaactat

SEQ ID NO: 105282 - DNA, 15 bp, Homo sapiens
aaataaaataaacta

SEQ ID NO: 105283 - DNA, 15 bp, Homo sapiens
aaaataaaataaact

SEQ ID NO: 105284 - DNA, 15 bp, Homo sapiens
taaaataaaataaac

SEQ ID NO: 105285 - DNA, 15 bp, Homo sapiens
taaataaaataaaat

SEQ ID NO: 105286 - DNA, 15 bp, Homo sapiens
tctgtctcaaataaa

SEQ ID NO: 105287 - DNA, 15 bp, Homo sapiens
ttctgtctcaaataa

SEQ ID NO: 105288 - DNA, 15 bp, Homo sapiens
attctgtctcaaata

SEQ ID NO: 105289 - DNA, 15 bp, Homo sapiens
gattctgtctcaaat

SEQ ID NO: 105290 - DNA, 15 bp, Homo sapiens
ggattctgtctcaaa

SEQ ID NO: 105291 - DNA, 15 bp, Homo sapiens
gggattctgtctcaa

SEQ ID NO: 105292 - DNA, 15 bp, Homo sapiens
tgggattctgtctca

SEQ ID NO: 105293 - DNA, 15 bp, Homo sapiens
gtgggattctgtctc

SEQ ID NO: 105294 - DNA, 15 bp, Homo sapiens
agtgggattctgtct

SEQ ID NO: 105295 - DNA, 15 bp, Homo sapiens
tagtgggattctgtc

SEQ ID NO: 105296 - DNA, 15 bp, Homo sapiens
atagtgggattctgt

SEQ ID NO: 105297 - DNA, 15 bp, Homo sapiens
catagtgggattctg

SEQ ID NO: 105298 - DNA, 15 bp, Homo sapiens
acatagtgggattct

SEQ ID NO: 105299 - DNA, 15 bp, Homo sapiens
gacatagtgggattc

SEQ ID NO: 105300 - DNA, 15 bp, Homo sapiens
tgacatagtgggatt

SEQ ID NO: 105301 - DNA, 15 bp, Homo sapiens
gtgacatagtgggat

SEQ ID NO: 105302 - DNA, 15 bp, Homo sapiens
ggtgacatagtggga

SEQ ID NO: 105303 - DNA, 15 bp, Homo sapiens
gggtgacatagtggg

SEQ ID NO: 105304 - DNA, 15 bp, Homo sapiens
tgggtgacatagtgg

SEQ ID NO: 105305 - DNA, 15 bp, Homo sapiens
ctgggtgacatagtg

SEQ ID NO: 105306 - DNA, 15 bp, Homo sapiens
cctgggtgacatagt

SEQ ID NO: 105307 - DNA, 15 bp, Homo sapiens
gcctgggtgacatag

SEQ ID NO: 105308 - DNA, 15 bp, Homo sapiens
agcctgggtgacata

SEQ ID NO: 105309 - DNA, 15 bp, Homo sapiens
cagcctgggtgacat

SEQ ID NO: 105310 - DNA, 15 bp, Homo sapiens
gtcacttgaacccag

SEQ ID NO: 105311 - DNA, 15 bp, Homo sapiens
agtcacttgaaccca

SEQ ID NO: 105312 - DNA, 15 bp, Homo sapiens
gagtcacttgaaccc

SEQ ID NO: 105313 - DNA, 15 bp, Homo sapiens
agagtcacttgaacc

SEQ ID NO: 105314 - DNA, 15 bp, Homo sapiens
gagagtcacttgaac

SEQ ID NO: 105315 - DNA, 15 bp, Homo sapiens
ggagagtcacttgaa

SEQ ID NO: 105316 - DNA, 15 bp, Homo sapiens
aggagagtcacttga

SEQ ID NO: 105317 - DNA, 15 bp, Homo sapiens
caggagagtcacttg

SEQ ID NO: 105318 - DNA, 15 bp, Homo sapiens
gcaggagagtcactt

SEQ ID NO: 105319 - DNA, 15 bp, Homo sapiens
ggcaggagagtcact

SEQ ID NO: 105320 - DNA, 15 bp, Homo sapiens
aggcaggagagtcac

SEQ ID NO: 105321 - DNA, 15 bp, Homo sapiens
gaggcaggagagtca

SEQ ID NO: 105322 - DNA, 15 bp, Homo sapiens
tgaggcaggagagtc

SEQ ID NO: 105323 - DNA, 15 bp, Homo sapiens
attcgggaggctgag

SEQ ID NO: 105324 - DNA, 15 bp, Homo sapiens
tattcgggaggctga

SEQ ID NO: 105325 - DNA, 15 bp, Homo sapiens
ttattcgggaggctg

SEQ ID NO: 105326 - DNA, 15 bp, Homo sapiens
gttattcgggaggct

SEQ ID NO: 105327 - DNA, 15 bp, Homo sapiens
agttattcgggaggc

SEQ ID NO: 105328 - DNA, 15 bp, Homo sapiens
cagttattcgggagg

SEQ ID NO: 105329 - DNA, 15 bp, Homo sapiens
ccagttattcgggag

SEQ ID NO: 105330 - DNA, 15 bp, Homo sapiens
cccagttattcggga

SEQ ID NO: 105331 - DNA, 15 bp, Homo sapiens
tcccagttattcggg

SEQ ID NO: 105332 - DNA, 15 bp, Homo sapiens
gtcccagttattcgg

SEQ ID NO: 105333 - DNA, 15 bp, Homo sapiens
agtcccagttattcg

SEQ ID NO: 105334 - DNA, 15 bp, Homo sapiens
tagtcccagttattc

SEQ ID NO: 105335 - DNA, 15 bp, Homo sapiens
gtagtcccagttatt

SEQ ID NO: 105336 - DNA, 15 bp, Homo sapiens
tgtagtcccagttat

SEQ ID NO: 105337 - DNA, 15 bp, Homo sapiens
ttgtagtcccagtta

SEQ ID NO: 105338 - DNA, 15 bp, Homo sapiens
cttgtagtcccagtt

SEQ ID NO: 105339 - DNA, 15 bp, Homo sapiens
gcttgtagtcccagt

SEQ ID NO: 105340 - DNA, 15 bp, Homo sapiens
tgcttgtagtcccag

SEQ ID NO: 105341 - DNA, 15 bp, Homo sapiens
gtgcttgtagtccca

SEQ ID NO: 105342 - DNA, 15 bp, Homo sapiens
cgtgcttgtagtccc

SEQ ID NO: 105343 - DNA, 15 bp, Homo sapiens
gcgtgcttgtagtcc

SEQ ID NO: 105344 - DNA, 15 bp, Homo sapiens
cgcgtgcttgtagtc

SEQ ID NO: 105345 - DNA, 15 bp, Homo sapiens
gcgcgtgcttgtagt

SEQ ID NO: 105346 - DNA, 15 bp, Homo sapiens
ggcgcgtgcttgtag

SEQ ID NO: 105347 - DNA, 15 bp, Homo sapiens
tggcgcgtgcttgta

SEQ ID NO: 105348 - DNA, 15 bp, Homo sapiens
gtggcgcgtgcttgt

SEQ ID NO: 105349 - DNA, 15 bp, Homo sapiens
ggtggcgcgtgcttg

SEQ ID NO: 105350 - DNA, 15 bp, Homo sapiens
tggtggcgcgtgctt

SEQ ID NO: 105351 - DNA, 15 bp, Homo sapiens
gtggtggcgcgtgct

SEQ ID NO: 105352 - DNA, 15 bp, Homo sapiens
cgtggtggcgcgtgc

SEQ ID NO: 105353 - DNA, 15 bp, Homo sapiens
gcgtggtggcgcgtg

SEQ ID NO: 105354 - DNA, 15 bp, Homo sapiens
ggcgtggtggcgcgt

SEQ ID NO: 105355 - DNA, 15 bp, Homo sapiens
gggcgtggtggcgcg

SEQ ID NO: 105356 - DNA, 15 bp, Homo sapiens
cgggcgtggtggcgc

SEQ ID NO: 105357 - DNA, 15 bp, Homo sapiens
ctacaaaaaattagc

SEQ ID NO: 105358 - DNA, 15 bp, Homo sapiens
actacaaaaaattag

SEQ ID NO: 105359 - DNA, 15 bp, Homo sapiens
aactacaaaaaatta

SEQ ID NO: 105360 - DNA, 15 bp, Homo sapiens
aaactacaaaaaatt

SEQ ID NO: 105361 - DNA, 15 bp, Homo sapiens
aaaactacaaaaaat

SEQ ID NO: 105362 - DNA, 15 bp, Homo sapiens
taaaactacaaaaaa

SEQ ID NO: 105363 - DNA, 15 bp, Homo sapiens
gtctctactaaaact

SEQ ID NO: 105364 - DNA, 15 bp, Homo sapiens
cgtctctactaaaac

SEQ ID NO: 105365 - DNA, 15 bp, Homo sapiens
cgaaaccccgtctct

SEQ ID NO: 105366 - DNA, 15 bp, Homo sapiens
gcgaaaccccgtctc

SEQ ID NO: 105367 - DNA, 15 bp, Homo sapiens
ggcgaaaccccgtct

SEQ ID NO: 105368 - DNA, 15 bp, Homo sapiens
tggcgaaaccccgtc

SEQ ID NO: 105369 - DNA, 15 bp, Homo sapiens
atggcgaaaccccgt

SEQ ID NO: 105370 - DNA, 15 bp, Homo sapiens
catggcgaaaccccg

SEQ ID NO: 105371 - DNA, 15 bp, Homo sapiens
acatggcgaaacccc

SEQ ID NO: 105372 - DNA, 15 bp, Homo sapiens
agatcacttgaagtc

SEQ ID NO: 105373 - DNA, 15 bp, Homo sapiens
cagatcacttgaagt

SEQ ID NO: 105374 - DNA, 15 bp, Homo sapiens
gcagatcacttgaag

SEQ ID NO: 105375 - DNA, 15 bp, Homo sapiens
ggcagatcacttgaa

SEQ ID NO: 105376 - DNA, 15 bp, Homo sapiens
cgaggcaggcagatc

SEQ ID NO: 105377 - DNA, 15 bp, Homo sapiens
ccgaggcaggcagat

SEQ ID NO: 105378 - DNA, 15 bp, Homo sapiens
gccgaggcaggcaga

SEQ ID NO: 105379 - DNA, 15 bp, Homo sapiens
ggccgaggcaggcag

SEQ ID NO: 105380 - DNA, 15 bp, Homo sapiens
aggccgaggcaggca

SEQ ID NO: 105381 - DNA, 15 bp, Homo sapiens
attgggaggccgagg

SEQ ID NO: 105382 - DNA, 15 bp, Homo sapiens
tattgggaggccgag

SEQ ID NO: 105383 - DNA, 15 bp, Homo sapiens
ttattgggaggccga

SEQ ID NO: 105384 - DNA, 15 bp, Homo sapiens
attattgggaggccg

SEQ ID NO: 105385 - DNA, 15 bp, Homo sapiens
aattattgggaggcc

SEQ ID NO: 105386 - DNA, 15 bp, Homo sapiens
aaattattgggaggc

SEQ ID NO: 105387 - DNA, 15 bp, Homo sapiens
aaaattattgggagg

SEQ ID NO: 105388 - DNA, 15 bp, Homo sapiens
aaaaattattgggag

SEQ ID NO: 105389 - DNA, 15 bp, Homo sapiens
caaaaattattggga

SEQ ID NO: 105390 - DNA, 15 bp, Homo sapiens
acaaaaattattggg

SEQ ID NO: 105391 - DNA, 15 bp, Homo sapiens
tacaaaaattattgg

SEQ ID NO: 105392 - DNA, 15 bp, Homo sapiens
atacaaaaattattg

SEQ ID NO: 105393 - DNA, 15 bp, Homo sapiens
aatacaaaaattatt

SEQ ID NO: 105394 - DNA, 15 bp, Homo sapiens
aaatacaaaaattat

SEQ ID NO: 105395 - DNA, 15 bp, Homo sapiens
tatggcaaaaccccg

SEQ ID NO: 105396 - DNA, 15 bp, Homo sapiens
atatggcaaaacccc

SEQ ID NO: 105397 - DNA, 15 bp, Homo sapiens
aatatggcaaaaccc

SEQ ID NO: 105398 - DNA, 15 bp, Homo sapiens
caatatggcaaaacc

SEQ ID NO: 105399 - DNA, 15 bp, Homo sapiens
acaatatggcaaaac

SEQ ID NO: 105400 - DNA, 15 bp, Homo sapiens
gacaatatggcaaaa

SEQ ID NO: 105401 - DNA, 15 bp, Homo sapiens
ggacaatatggcaaa

SEQ ID NO: 105402 - DNA, 15 bp, Homo sapiens
tggacaatatggcaa

SEQ ID NO: 105403 - DNA, 15 bp, Homo sapiens
ctggacaatatggca

SEQ ID NO: 105404 - DNA, 15 bp, Homo sapiens
cctggacaatatggc

SEQ ID NO: 105405 - DNA, 15 bp, Homo sapiens
gcctggacaatatgg

SEQ ID NO: 105406 - DNA, 15 bp, Homo sapiens
agcctggacaatatg

SEQ ID NO: 105407 - DNA, 15 bp, Homo sapiens
tagcctggacaatat

SEQ ID NO: 105408 - DNA, 15 bp, Homo sapiens
ctagcctggacaata

SEQ ID NO: 105409 - DNA, 15 bp, Homo sapiens
actagcctggacaat

SEQ ID NO: 105410 - DNA, 15 bp, Homo sapiens
gactagcctggacaa

SEQ ID NO: 105411 - DNA, 15 bp, Homo sapiens
agactagcctggaca

SEQ ID NO: 105412 - DNA, 15 bp, Homo sapiens
gagactagcctggac

SEQ ID NO: 105413 - DNA, 15 bp, Homo sapiens
tgagactagcctgga

SEQ ID NO: 105414 - DNA, 15 bp, Homo sapiens
ttgagactagcctgg

SEQ ID NO: 105415 - DNA, 15 bp, Homo sapiens
tttgagactagcctg

SEQ ID NO: 105416 - DNA, 15 bp, Homo sapiens
gtttgagactagcct

SEQ ID NO: 105417 - DNA, 15 bp, Homo sapiens
agtttgagactagcc

SEQ ID NO: 105418 - DNA, 15 bp, Homo sapiens
gagtttgagactagc

SEQ ID NO: 105419 - DNA, 15 bp, Homo sapiens
ggagtttgagactag

SEQ ID NO: 105420 - DNA, 15 bp, Homo sapiens
aggagtttgagacta

SEQ ID NO: 105421 - DNA, 15 bp, Homo sapiens
caggagtttgagact

SEQ ID NO: 105422 - DNA, 15 bp, Homo sapiens
agtcaggagtttgag

SEQ ID NO: 105423 - DNA, 15 bp, Homo sapiens
aagtcaggagtttga

SEQ ID NO: 105424 - DNA, 15 bp, Homo sapiens
gaagtcaggagtttg

SEQ ID NO: 105425 - DNA, 15 bp, Homo sapiens
tgaagtcaggagttt

SEQ ID NO: 105426 - DNA, 15 bp, Homo sapiens
ctgaagtcaggagtt

SEQ ID NO: 105427 - DNA, 15 bp, Homo sapiens
cctgaagtcaggagt

SEQ ID NO: 105428 - DNA, 15 bp, Homo sapiens
acctgaagtcaggag

SEQ ID NO: 105429 - DNA, 15 bp, Homo sapiens
cacctgaagtcagga

SEQ ID NO: 105430 - DNA, 15 bp, Homo sapiens
tcacctgaagtcagg

SEQ ID NO: 105431 - DNA, 15 bp, Homo sapiens
atcacctgaagtcag

SEQ ID NO: 105432 - DNA, 15 bp, Homo sapiens
gatcacctgaagtca

SEQ ID NO: 105433 - DNA, 15 bp, Homo sapiens
ggatcacctgaagtc

SEQ ID NO: 105434 - DNA, 15 bp, Homo sapiens
tggatcacctgaagt

SEQ ID NO: 105435 - DNA, 15 bp, Homo sapiens
gtggatcacctgaag

SEQ ID NO: 105436 - DNA, 15 bp, Homo sapiens
ggtggatcacctgaa

SEQ ID NO: 105437 - DNA, 15 bp, Homo sapiens
aggtggatcacctga

SEQ ID NO: 105438 - DNA, 15 bp, Homo sapiens
aaggtggatcacctg

SEQ ID NO: 105439 - DNA, 15 bp, Homo sapiens
gaaggtggatcacct

SEQ ID NO: 105440 - DNA, 15 bp, Homo sapiens
ggaaggtggatcacc

SEQ ID NO: 105441 - DNA, 15 bp, Homo sapiens
aggaaggtggatcac

SEQ ID NO: 105442 - DNA, 15 bp, Homo sapiens
gaggaaggtggatca

SEQ ID NO: 105443 - DNA, 15 bp, Homo sapiens
cgaggaaggtggatc

SEQ ID NO: 105444 - DNA, 15 bp, Homo sapiens
ccgaggaaggtggat

SEQ ID NO: 105445 - DNA, 15 bp, Homo sapiens
gccgaggaaggtgga

SEQ ID NO: 105446 - DNA, 15 bp, Homo sapiens
ggccgaggaaggtgg

SEQ ID NO: 105447 - DNA, 15 bp, Homo sapiens
aggccgaggaaggtg

SEQ ID NO: 105448 - DNA, 15 bp, Homo sapiens
gaggccgaggaaggt

SEQ ID NO: 105449 - DNA, 15 bp, Homo sapiens
cagccaggcacagtg

SEQ ID NO: 105450 - DNA, 15 bp, Homo sapiens
tcagccaggcacagt

SEQ ID NO: 105451 - DNA, 15 bp, Homo sapiens
ttcagccaggcacag

SEQ ID NO: 105452 - DNA, 15 bp, Homo sapiens
tttcagccaggcaca

SEQ ID NO: 105453 - DNA, 15 bp, Homo sapiens
ttttcagccaggcac

SEQ ID NO: 105454 - DNA, 15 bp, Homo sapiens
cttttcagccaggca

SEQ ID NO: 105455 - DNA, 15 bp, Homo sapiens
acttttcagccaggc

SEQ ID NO: 105456 - DNA, 15 bp, Homo sapiens
gacttttcagccagg

SEQ ID NO: 105457 - DNA, 15 bp, Homo sapiens
ggacttttcagccag

SEQ ID NO: 105458 - DNA, 15 bp, Homo sapiens
aggacttttcagcca

SEQ ID NO: 105459 - DNA, 15 bp, Homo sapiens
caggacttttcagcc

SEQ ID NO: 105460 - DNA, 15 bp, Homo sapiens
acaggacttttcagc

SEQ ID NO: 105461 - DNA, 15 bp, Homo sapiens
tacaggacttttcag

SEQ ID NO: 105462 - DNA, 15 bp, Homo sapiens
atacaggacttttca

SEQ ID NO: 105463 - DNA, 15 bp, Homo sapiens
tatacaggacttttc

SEQ ID NO: 105464 - DNA, 15 bp, Homo sapiens
atatacaggactttt

SEQ ID NO: 105465 - DNA, 15 bp, Homo sapiens
aatatacaggacttt

SEQ ID NO: 105466 - DNA, 15 bp, Homo sapiens
aaatatacaggactt

SEQ ID NO: 105467 - DNA, 15 bp, Homo sapiens
aaaatatacaggact

SEQ ID NO: 105468 - DNA, 15 bp, Homo sapiens
taaaatatacaggac

SEQ ID NO: 105469 - DNA, 15 bp, Homo sapiens
ttaaaatatacagga

SEQ ID NO: 105470 - DNA, 15 bp, Homo sapiens
tttaaaatatacagg

SEQ ID NO: 105471 - DNA, 15 bp, Homo sapiens
atttaaaatatacag

SEQ ID NO: 105472 - DNA, 15 bp, Homo sapiens
aatttaaaatataca

SEQ ID NO: 105473 - DNA, 15 bp, Homo sapiens
caatttaaaatatac

SEQ ID NO: 105474 - DNA, 15 bp, Homo sapiens
acaatttaaaatata

SEQ ID NO: 105475 - DNA, 15 bp, Homo sapiens
tacaatttaaaatat

SEQ ID NO: 105476 - DNA, 15 bp, Homo sapiens
ctacaatttaaaata

SEQ ID NO: 105477 - DNA, 15 bp, Homo sapiens
actacaatttaaaat

SEQ ID NO: 105478 - DNA, 15 bp, Homo sapiens
aactacaatttaaaa

SEQ ID NO: 105479 - DNA, 15 bp, Homo sapiens
aaactacaatttaaa

SEQ ID NO: 105480 - DNA, 15 bp, Homo sapiens
aaaactacaatttaa

SEQ ID NO: 105481 - DNA, 15 bp, Homo sapiens
gaaaactacaattta

SEQ ID NO: 105482 - DNA, 15 bp, Homo sapiens
agaaaactacaattt

SEQ ID NO: 105483 - DNA, 15 bp, Homo sapiens
aagaaaactacaatt

SEQ ID NO: 105484 - DNA, 15 bp, Homo sapiens
taagaaaactacaat

SEQ ID NO: 105485 - DNA, 15 bp, Homo sapiens
ctaagaaaactacaa

SEQ ID NO: 105486 - DNA, 15 bp, Homo sapiens
gctaagaaaactaca

SEQ ID NO: 105487 - DNA, 15 bp, Homo sapiens
agctaagaaaactac

SEQ ID NO: 105488 - DNA, 15 bp, Homo sapiens
cagctaagaaaacta

SEQ ID NO: 105489 - DNA, 15 bp, Homo sapiens
acagctaagaaaact

SEQ ID NO: 105490 - DNA, 15 bp, Homo sapiens
cacagctaagaaaac

SEQ ID NO: 105491 - DNA, 15 bp, Homo sapiens
tcacagctaagaaaa

SEQ ID NO: 105492 - DNA, 15 bp, Homo sapiens
ttcacagctaagaaa

SEQ ID NO: 105493 - DNA, 15 bp, Homo sapiens
cttcacagctaagaa

SEQ ID NO: 105494 - DNA, 15 bp, Homo sapiens
acttcacagctaaga

SEQ ID NO: 105495 - DNA, 15 bp, Homo sapiens
aacttcacagctaag

SEQ ID NO: 105496 - DNA, 15 bp, Homo sapiens
caacttcacagctaa

SEQ ID NO: 105497 - DNA, 15 bp, Homo sapiens
ccaacttcacagcta

SEQ ID NO: 105498 - DNA, 15 bp, Homo sapiens
cccaacttcacagct

SEQ ID NO: 105499 - DNA, 15 bp, Homo sapiens
tcccaacttcacagc

SEQ ID NO: 105500 - DNA, 15 bp, Homo sapiens
gtcccaacttcacag

SEQ ID NO: 105501 - DNA, 15 bp, Homo sapiens
tgtcccaacttcaca

SEQ ID NO: 105502 - DNA, 15 bp, Homo sapiens
ttgtcccaacttcac

SEQ ID NO: 105503 - DNA, 15 bp, Homo sapiens
attgtcccaacttca

SEQ ID NO: 105504 - DNA, 15 bp, Homo sapiens
aattgtcccaacttc

SEQ ID NO: 105505 - DNA, 15 bp, Homo sapiens
gaattgtcccaactt

SEQ ID NO: 105506 - DNA, 15 bp, Homo sapiens
ggaattgtcccaact

SEQ ID NO: 105507 - DNA, 15 bp, Homo sapiens
aggaattgtcccaac

SEQ ID NO: 105508 - DNA, 15 bp, Homo sapiens
aaggaattgtcccaa

SEQ ID NO: 105509 - DNA, 15 bp, Homo sapiens
gaaggaattgtccca

SEQ ID NO: 105510 - DNA, 15 bp, Homo sapiens
ggaaggaattgtccc

SEQ ID NO: 105511 - DNA, 15 bp, Homo sapiens
aggaaggaattgtcc

SEQ ID NO: 105512 - DNA, 15 bp, Homo sapiens
aaggaaggaattgtc

SEQ ID NO: 105513 - DNA, 15 bp, Homo sapiens
taaggaaggaattgt

SEQ ID NO: 105514 - DNA, 15 bp, Homo sapiens
ataaggaaggaattg

SEQ ID NO: 105515 - DNA, 15 bp, Homo sapiens
tataaggaaggaatt

SEQ ID NO: 105516 - DNA, 15 bp, Homo sapiens
ttataaggaaggaat

SEQ ID NO: 105517 - DNA, 15 bp, Homo sapiens
tttataaggaaggaa

SEQ ID NO: 105518 - DNA, 15 bp, Homo sapiens
atttataaggaagga

SEQ ID NO: 105519 - DNA, 15 bp, Homo sapiens
tatttataaggaagg

SEQ ID NO: 105520 - DNA, 15 bp, Homo sapiens
ttatttataaggaag

SEQ ID NO: 105521 - DNA, 15 bp, Homo sapiens
cttatttataaggaa

SEQ ID NO: 105522 - DNA, 15 bp, Homo sapiens
acttatttataagga

SEQ ID NO: 105523 - DNA, 15 bp, Homo sapiens
aacttatttataagg

SEQ ID NO: 105524 - DNA, 15 bp, Homo sapiens
caacttatttataag

SEQ ID NO: 105525 - DNA, 15 bp, Homo sapiens
acaacttatttataa

SEQ ID NO: 105526 - DNA, 15 bp, Homo sapiens
cacaacttatttata

SEQ ID NO: 105527 - DNA, 15 bp, Homo sapiens
tcacaacttatttat

SEQ ID NO: 105528 - DNA, 15 bp, Homo sapiens
ttcacaacttattta

SEQ ID NO: 105529 - DNA, 15 bp, Homo sapiens
gttcacaacttattt

SEQ ID NO: 105530 - DNA, 15 bp, Homo sapiens
tgttcacaacttatt

SEQ ID NO: 105531 - DNA, 15 bp, Homo sapiens
atgttcacaacttat

SEQ ID NO: 105532 - DNA, 15 bp, Homo sapiens
aatgttcacaactta

SEQ ID NO: 105533 - DNA, 15 bp, Homo sapiens
taatgttcacaactt

SEQ ID NO: 105534 - DNA, 15 bp, Homo sapiens
ctaatgttcacaact

SEQ ID NO: 105535 - DNA, 15 bp, Homo sapiens
tctaatgttcacaac

SEQ ID NO: 105536 - DNA, 15 bp, Homo sapiens
ttctaatgttcacaa

SEQ ID NO: 105537 - DNA, 15 bp, Homo sapiens
tttctaatgttcaca

SEQ ID NO: 105538 - DNA, 15 bp, Homo sapiens
gtttctaatgttcac

SEQ ID NO: 105539 - DNA, 15 bp, Homo sapiens
cgtttctaatgttca

SEQ ID NO: 105540 - DNA, 15 bp, Homo sapiens
tcgtttctaatgttc

SEQ ID NO: 105541 - DNA, 15 bp, Homo sapiens
gtcgtttctaatgtt

SEQ ID NO: 105542 - DNA, 15 bp, Homo sapiens
tgtcgtttctaatgt

SEQ ID NO: 105543 - DNA, 15 bp, Homo sapiens
ttgtcgtttctaatg

SEQ ID NO: 105544 - DNA, 15 bp, Homo sapiens
tttgtcgtttctaat

SEQ ID NO: 105545 - DNA, 15 bp, Homo sapiens
atttgtcgtttctaa

SEQ ID NO: 105546 - DNA, 15 bp, Homo sapiens
catttgtcgtttcta

SEQ ID NO: 105547 - DNA, 15 bp, Homo sapiens
gcatttgtcgtttct

SEQ ID NO: 105548 - DNA, 15 bp, Homo sapiens
tgcatttgtcgtttc

SEQ ID NO: 105549 - DNA, 15 bp, Homo sapiens
ttgcatttgtcgttt

SEQ ID NO: 105550 - DNA, 15 bp, Homo sapiens
tttgcatttgtcgtt

SEQ ID NO: 105551 - DNA, 15 bp, Homo sapiens
ctttgcatttgtcgt

SEQ ID NO: 105552 - DNA, 15 bp, Homo sapiens
gctttgcatttgtcg

SEQ ID NO: 105553 - DNA, 15 bp, Homo sapiens
ggctttgcatttgtc

SEQ ID NO: 105554 - DNA, 15 bp, Homo sapiens
gggctttgcatttgt

SEQ ID NO: 105555 - DNA, 15 bp, Homo sapiens
agggctttgcatttg

SEQ ID NO: 105556 - DNA, 15 bp, Homo sapiens
aagggctttgcattt

SEQ ID NO: 105557 - DNA, 15 bp, Homo sapiens
taagggctttgcatt

SEQ ID NO: 105558 - DNA, 15 bp, Homo sapiens
ctaagggctttgcat

SEQ ID NO: 105559 - DNA, 15 bp, Homo sapiens
gctaagggctttgca

SEQ ID NO: 105560 - DNA, 15 bp, Homo sapiens
tgctaagggctttgc

SEQ ID NO: 105561 - DNA, 15 bp, Homo sapiens
ctgctaagggctttg

SEQ ID NO: 105562 - DNA, 15 bp, Homo sapiens
cctgctaagggcttt

SEQ ID NO: 105563 - DNA, 15 bp, Homo sapiens
acctgctaagggctt

SEQ ID NO: 105564 - DNA, 15 bp, Homo sapiens
cacctgctaagggct

SEQ ID NO: 105565 - DNA, 15 bp, Homo sapiens
gcacctgctaagggc

SEQ ID NO: 105566 - DNA, 15 bp, Homo sapiens
cgcacctgctaaggg

SEQ ID NO: 105567 - DNA, 15 bp, Homo sapiens
acgcacctgctaagg

SEQ ID NO: 105568 - DNA, 15 bp, Homo sapiens
gacgcacctgctaag

SEQ ID NO: 105569 - DNA, 15 bp, Homo sapiens
tgacgcacctgctaa

SEQ ID NO: 105570 - DNA, 15 bp, Homo sapiens
atgacgcacctgcta

SEQ ID NO: 105571 - DNA, 15 bp, Homo sapiens
catgacgcacctgct

SEQ ID NO: 105572 - DNA, 15 bp, Homo sapiens
acatgacgcacctgc

SEQ ID NO: 105573 - DNA, 15 bp, Homo sapiens
tacatgacgcacctg

SEQ ID NO: 105574 - DNA, 15 bp, Homo sapiens
gtacatgacgcacct

SEQ ID NO: 105575 - DNA, 15 bp, Homo sapiens
tgtacatgacgcacc

SEQ ID NO: 105576 - DNA, 15 bp, Homo sapiens
ttgtacatgacgcac

SEQ ID NO: 105577 - DNA, 15 bp, Homo sapiens
attgtacatgacgca

SEQ ID NO: 105578 - DNA, 15 bp, Homo sapiens
tattgtacatgacgc

SEQ ID NO: 105579 - DNA, 15 bp, Homo sapiens
ctattgtacatgacg

SEQ ID NO: 105580 - DNA, 15 bp, Homo sapiens
actattgtacatgac

SEQ ID NO: 105581 - DNA, 15 bp, Homo sapiens
gactattgtacatga

SEQ ID NO: 105582 - DNA, 15 bp, Homo sapiens
tgactattgtacatg

SEQ ID NO: 105583 - DNA, 15 bp, Homo sapiens
atgactattgtacat

SEQ ID NO: 105584 - DNA, 15 bp, Homo sapiens
tatgactattgtaca

SEQ ID NO: 105585 - DNA, 15 bp, Homo sapiens
gtatgactattgtac

SEQ ID NO: 105586 - DNA, 15 bp, Homo sapiens
ggtatgactattgta

SEQ ID NO: 105587 - DNA, 15 bp, Homo sapiens
tggtatgactattgt

SEQ ID NO: 105588 - DNA, 15 bp, Homo sapiens
atggtatgactattg

SEQ ID NO: 105589 - DNA, 15 bp, Homo sapiens
catggtatgactatt

SEQ ID NO: 105590 - DNA, 15 bp, Homo sapiens
gcatggtatgactat

SEQ ID NO: 105591 - DNA, 15 bp, Homo sapiens
tgcatggtatgacta

SEQ ID NO: 105592 - DNA, 15 bp, Homo sapiens
ctgcatggtatgact

SEQ ID NO: 105593 - DNA, 15 bp, Homo sapiens
actgcatggtatgac

SEQ ID NO: 105594 - DNA, 15 bp, Homo sapiens
cactgcatggtatga

SEQ ID NO: 105595 - DNA, 15 bp, Homo sapiens
ccactgcatggtatg

SEQ ID NO: 105596 - DNA, 15 bp, Homo sapiens
cccactgcatggtat

SEQ ID NO: 105597 - DNA, 15 bp, Homo sapiens
gcccactgcatggta

SEQ ID NO: 105598 - DNA, 15 bp, Homo sapiens
ggcccactgcatggt

SEQ ID NO: 105599 - DNA, 15 bp, Homo sapiens
tggcccactgcatgg

SEQ ID NO: 105600 - DNA, 15 bp, Homo sapiens
atggcccactgcatg

SEQ ID NO: 105601 - DNA, 15 bp, Homo sapiens
tatggcccactgcat

SEQ ID NO: 105602 - DNA, 15 bp, Homo sapiens
atatggcccactgca

SEQ ID NO: 105603 - DNA, 15 bp, Homo sapiens
aatatggcccactgc

SEQ ID NO: 105604 - DNA, 15 bp, Homo sapiens
taatatggcccactg

SEQ ID NO: 105605 - DNA, 15 bp, Homo sapiens
ataatatggcccact

SEQ ID NO: 105606 - DNA, 15 bp, Homo sapiens
aataatatggcccac

SEQ ID NO: 105607 - DNA, 15 bp, Homo sapiens
taataatatggccca

SEQ ID NO: 105608 - DNA, 15 bp, Homo sapiens
ataataatatggccc

SEQ ID NO: 105609 - DNA, 15 bp, Homo sapiens
aataataatatggcc

SEQ ID NO: 105610 - DNA, 15 bp, Homo sapiens
taataataatatggc

SEQ ID NO: 105611 - DNA, 15 bp, Homo sapiens
ataataataatatgg

SEQ ID NO: 105612 - DNA, 15 bp, Homo sapiens
aataataataatatg

SEQ ID NO: 105613 - DNA, 15 bp, Homo sapiens
taataataataatat

SEQ ID NO: 105614 - DNA, 15 bp, Homo sapiens
tgtataataataata

SEQ ID NO: 105615 - DNA, 15 bp, Homo sapiens
ttgtataataataat

SEQ ID NO: 105616 - DNA, 15 bp, Homo sapiens
tttgtataataataa

SEQ ID NO: 105617 - DNA, 15 bp, Homo sapiens
ttttgtataataata

SEQ ID NO: 105618 - DNA, 15 bp, Homo sapiens
tttttgtataataat

SEQ ID NO: 105619 - DNA, 15 bp, Homo sapiens
gtttttgtataataa

SEQ ID NO: 105620 - DNA, 15 bp, Homo sapiens
cgtttttgtataata

SEQ ID NO: 105621 - DNA, 15 bp, Homo sapiens
acgtttttgtataat

SEQ ID NO: 105622 - DNA, 15 bp, Homo sapiens
tacgtttttgtataa

SEQ ID NO: 105623 - DNA, 15 bp, Homo sapiens
atacgtttttgtata

SEQ ID NO: 105624 - DNA, 15 bp, Homo sapiens
aatacgtttttgtat

SEQ ID NO: 105625 - DNA, 15 bp, Homo sapiens
taatacgtttttgta

SEQ ID NO: 105626 - DNA, 15 bp, Homo sapiens
ataatacgtttttgt

SEQ ID NO: 105627 - DNA, 15 bp, Homo sapiens
aataatacgtttttg

SEQ ID NO: 105628 - DNA, 15 bp, Homo sapiens
taataatacgttttt

SEQ ID NO: 105629 - DNA, 15 bp, Homo sapiens
ataataatacgtttt

SEQ ID NO: 105630 - DNA, 15 bp, Homo sapiens
aataataatacgttt

SEQ ID NO: 105631 - DNA, 15 bp, Homo sapiens
taataataatacgtt

SEQ ID NO: 105632 - DNA, 15 bp, Homo sapiens
ataataataatacgt

SEQ ID NO: 105633 - DNA, 15 bp, Homo sapiens
aataataataatacg

SEQ ID NO: 105634 - DNA, 15 bp, Homo sapiens
aaataataataatac

SEQ ID NO: 105635 - DNA, 15 bp, Homo sapiens
taaaaaataataata

SEQ ID NO: 105636 - DNA, 15 bp, Homo sapiens
ctaaaaaataataat

SEQ ID NO: 105637 - DNA, 15 bp, Homo sapiens
tctaaaaaataataa

SEQ ID NO: 105638 - DNA, 15 bp, Homo sapiens
gtctaaaaaataata

SEQ ID NO: 105639 - DNA, 15 bp, Homo sapiens
cgtctaaaaaataat

SEQ ID NO: 105640 - DNA, 15 bp, Homo sapiens
ccgtctaaaaaataa

SEQ ID NO: 105641 - DNA, 15 bp, Homo sapiens
tccgtctaaaaaata

SEQ ID NO: 105642 - DNA, 15 bp, Homo sapiens
atccgtctaaaaaat

SEQ ID NO: 105643 - DNA, 15 bp, Homo sapiens
aatccgtctaaaaaa

SEQ ID NO: 105644 - DNA, 15 bp, Homo sapiens
gaatccgtctaaaaa

SEQ ID NO: 105645 - DNA, 15 bp, Homo sapiens
agaatccgtctaaaa

SEQ ID NO: 105646 - DNA, 15 bp, Homo sapiens
gagaatccgtctaaa

SEQ ID NO: 105647 - DNA, 15 bp, Homo sapiens
tgagaatccgtctaa

SEQ ID NO: 105648 - DNA, 15 bp, Homo sapiens
gtgagaatccgtcta

SEQ ID NO: 105649 - DNA, 15 bp, Homo sapiens
agtgagaatccgtct

SEQ ID NO: 105650 - DNA, 15 bp, Homo sapiens
gagtgagaatccgtc

SEQ ID NO: 105651 - DNA, 15 bp, Homo sapiens
agagtgagaatccgt

SEQ ID NO: 105652 - DNA, 15 bp, Homo sapiens
cagagtgagaatccg

SEQ ID NO: 105653 - DNA, 15 bp, Homo sapiens
acagagtgagaatcc

SEQ ID NO: 105654 - DNA, 15 bp, Homo sapiens
aacagagtgagaatc

SEQ ID NO: 105655 - DNA, 15 bp, Homo sapiens
caacagagtgagaat

SEQ ID NO: 105656 - DNA, 15 bp, Homo sapiens
gcaacagagtgagaa

SEQ ID NO: 105657 - DNA, 15 bp, Homo sapiens
cctgggcaacagagt

SEQ ID NO: 105658 - DNA, 15 bp, Homo sapiens
tagcctgggcaacag

SEQ ID NO: 105659 - DNA, 15 bp, Homo sapiens
ctagcctgggcaaca

SEQ ID NO: 105660 - DNA, 15 bp, Homo sapiens
tctagcctgggcaac

SEQ ID NO: 105661 - DNA, 15 bp, Homo sapiens
ctctagcctgggcaa

SEQ ID NO: 105662 - DNA, 15 bp, Homo sapiens
actctagcctgggca

SEQ ID NO: 105663 - DNA, 15 bp, Homo sapiens
gccactgcactctag

SEQ ID NO: 105664 - DNA, 15 bp, Homo sapiens
cgccactgcactcta

SEQ ID NO: 105665 - DNA, 15 bp, Homo sapiens
gcgccactgcactct

SEQ ID NO: 105666 - DNA, 15 bp, Homo sapiens
cgcgccactgcactc

SEQ ID NO: 105667 - DNA, 15 bp, Homo sapiens
tcgcgccactgcact

SEQ ID NO: 105668 - DNA, 15 bp, Homo sapiens
atcgcgccactgcac

SEQ ID NO: 105669 - DNA, 15 bp, Homo sapiens
gatcgcgccactgca

SEQ ID NO: 105670 - DNA, 15 bp, Homo sapiens
agatcgcgccactgc

SEQ ID NO: 105671 - DNA, 15 bp, Homo sapiens
gagatcgcgccactg

SEQ ID NO: 105672 - DNA, 15 bp, Homo sapiens
cgagatcgcgccact

SEQ ID NO: 105673 - DNA, 15 bp, Homo sapiens
ccgagatcgcgccac

SEQ ID NO: 105674 - DNA, 15 bp, Homo sapiens
tttgcagtgagccga

SEQ ID NO: 105675 - DNA, 15 bp, Homo sapiens
gtttgcagtgagccg

SEQ ID NO: 105676 - DNA, 15 bp, Homo sapiens
agtttgcagtgagcc

SEQ ID NO: 105677 - DNA, 15 bp, Homo sapiens
gagtttgcagtgagc

SEQ ID NO: 105678 - DNA, 15 bp, Homo sapiens
agagtttgcagtgag

SEQ ID NO: 105679 - DNA, 15 bp, Homo sapiens
cagagtttgcagtga

SEQ ID NO: 105680 - DNA, 15 bp, Homo sapiens
gcagagtttgcagtg

SEQ ID NO: 105681 - DNA, 15 bp, Homo sapiens
ggcagagtttgcagt

SEQ ID NO: 105682 - DNA, 15 bp, Homo sapiens
gggcagagtttgcag

SEQ ID NO: 105683 - DNA, 15 bp, Homo sapiens
ggggcagagtttgca

SEQ ID NO: 105684 - DNA, 15 bp, Homo sapiens
tggggcagagtttgc

SEQ ID NO: 105685 - DNA, 15 bp, Homo sapiens
gtggggcagagtttg

SEQ ID NO: 105686 - DNA, 15 bp, Homo sapiens
tgtggggcagagttt

SEQ ID NO: 105687 - DNA, 15 bp, Homo sapiens
ctgtggggcagagtt

SEQ ID NO: 105688 - DNA, 15 bp, Homo sapiens
cctgtggggcagagt

SEQ ID NO: 105689 - DNA, 15 bp, Homo sapiens
acctgtggggcagag

SEQ ID NO: 105690 - DNA, 15 bp, Homo sapiens
aacctgtggggcaga

SEQ ID NO: 105691 - DNA, 15 bp, Homo sapiens
gaacctgtggggcag

SEQ ID NO: 105692 - DNA, 15 bp, Homo sapiens
tgaacctgtggggca

SEQ ID NO: 105693 - DNA, 15 bp, Homo sapiens
ttgaacctgtggggc

SEQ ID NO: 105694 - DNA, 15 bp, Homo sapiens
cttgaacctgtgggg

SEQ ID NO: 105695 - DNA, 15 bp, Homo sapiens
gcttgaacctgtggg

SEQ ID NO: 105696 - DNA, 15 bp, Homo sapiens
tgcttgaacctgtgg

SEQ ID NO: 105697 - DNA, 15 bp, Homo sapiens
ttgcttgaacctgtg

SEQ ID NO: 105698 - DNA, 15 bp, Homo sapiens
attgcttgaacctgt

SEQ ID NO: 105699 - DNA, 15 bp, Homo sapiens
cgcctataatcccag

SEQ ID NO: 105700 - DNA, 15 bp, Homo sapiens
gcgcctataatccca

SEQ ID NO: 105701 - DNA, 15 bp, Homo sapiens
ggcgcctataatccc

SEQ ID NO: 105702 - DNA, 15 bp, Homo sapiens
gggcgcctataatcc

SEQ ID NO: 105703 - DNA, 15 bp, Homo sapiens
cgggcgcctataatc

SEQ ID NO: 105704 - DNA, 15 bp, Homo sapiens
gcgggcgcctataat

SEQ ID NO: 105705 - DNA, 15 bp, Homo sapiens
ggcgggcgcctataa

SEQ ID NO: 105706 - DNA, 15 bp, Homo sapiens
tggcgggcgcctata

SEQ ID NO: 105707 - DNA, 15 bp, Homo sapiens
gtggcgggcgcctat

SEQ ID NO: 105708 - DNA, 15 bp, Homo sapiens
ggtggcgggcgccta

SEQ ID NO: 105709 - DNA, 15 bp, Homo sapiens
cggtggcgggcgcct

SEQ ID NO: 105710 - DNA, 15 bp, Homo sapiens
acggtggcgggcgcc

SEQ ID NO: 105711 - DNA, 15 bp, Homo sapiens
cacggtggcgggcgc

SEQ ID NO: 105712 - DNA, 15 bp, Homo sapiens
gcacggtggcgggcg

SEQ ID NO: 105713 - DNA, 15 bp, Homo sapiens
ggcacggtggcgggc

SEQ ID NO: 105714 - DNA, 15 bp, Homo sapiens
gggcacggtggcggg

SEQ ID NO: 105715 - DNA, 15 bp, Homo sapiens
tgggcacggtggcgg

SEQ ID NO: 105716 - DNA, 15 bp, Homo sapiens
ctgggcacggtggcg

SEQ ID NO: 105717 - DNA, 15 bp, Homo sapiens
agctgggcacggtgg

SEQ ID NO: 105718 - DNA, 15 bp, Homo sapiens
tagctgggcacggtg

SEQ ID NO: 105719 - DNA, 15 bp, Homo sapiens
ttagctgggcacggt

SEQ ID NO: 105720 - DNA, 15 bp, Homo sapiens
attagctgggcacgg

SEQ ID NO: 105721 - DNA, 15 bp, Homo sapiens
aattagctgggcacg

SEQ ID NO: 105722 - DNA, 15 bp, Homo sapiens
aaattagctgggcac

SEQ ID NO: 105723 - DNA, 15 bp, Homo sapiens
gatggtgaaacccca

SEQ ID NO: 105724 - DNA, 15 bp, Homo sapiens
agatggtgaaacccc

SEQ ID NO: 105725 - DNA, 15 bp, Homo sapiens
aagatggtgaaaccc

SEQ ID NO: 105726 - DNA, 15 bp, Homo sapiens
caagatggtgaaacc

SEQ ID NO: 105727 - DNA, 15 bp, Homo sapiens
ccaagatggtgaaac

SEQ ID NO: 105728 - DNA, 15 bp, Homo sapiens
gccaagatggtgaaa

SEQ ID NO: 105729 - DNA, 15 bp, Homo sapiens
ggccaagatggtgaa

SEQ ID NO: 105730 - DNA, 15 bp, Homo sapiens
tggccaagatggtga

SEQ ID NO: 105731 - DNA, 15 bp, Homo sapiens
ctggccaagatggtg

SEQ ID NO: 105732 - DNA, 15 bp, Homo sapiens
cctggccaagatggt

SEQ ID NO: 105733 - DNA, 15 bp, Homo sapiens
gcctggccaagatgg

SEQ ID NO: 105734 - DNA, 15 bp, Homo sapiens
agcctggccaagatg

SEQ ID NO: 105735 - DNA, 15 bp, Homo sapiens
cagcctggccaagat

SEQ ID NO: 105736 - DNA, 15 bp, Homo sapiens
accagcctggccaag

SEQ ID NO: 105737 - DNA, 15 bp, Homo sapiens
atcaggagttcaaga

SEQ ID NO: 105738 - DNA, 15 bp, Homo sapiens
catcaggagttcaag

SEQ ID NO: 105739 - DNA, 15 bp, Homo sapiens
acatcaggagttcaa

SEQ ID NO: 105740 - DNA, 15 bp, Homo sapiens
gacatcaggagttca

SEQ ID NO: 105741 - DNA, 15 bp, Homo sapiens
cgacatcaggagttc

SEQ ID NO: 105742 - DNA, 15 bp, Homo sapiens
acgacatcaggagtt

SEQ ID NO: 105743 - DNA, 15 bp, Homo sapiens
cacgacatcaggagt

SEQ ID NO: 105744 - DNA, 15 bp, Homo sapiens
tcacgacatcaggag

SEQ ID NO: 105745 - DNA, 15 bp, Homo sapiens
atcacgacatcagga

SEQ ID NO: 105746 - DNA, 15 bp, Homo sapiens
gatcacgacatcagg

SEQ ID NO: 105747 - DNA, 15 bp, Homo sapiens
ggatcacgacatcag

SEQ ID NO: 105748 - DNA, 15 bp, Homo sapiens
tggatcacgacatca

SEQ ID NO: 105749 - DNA, 15 bp, Homo sapiens
gtggatcacgacatc

SEQ ID NO: 105750 - DNA, 15 bp, Homo sapiens
ggtggatcacgacat

SEQ ID NO: 105751 - DNA, 15 bp, Homo sapiens
gggtggatcacgaca

SEQ ID NO: 105752 - DNA, 15 bp, Homo sapiens
cgggtggatcacgac

SEQ ID NO: 105753 - DNA, 15 bp, Homo sapiens
gcgggtggatcacga

SEQ ID NO: 105754 - DNA, 15 bp, Homo sapiens
ggcgggtggatcacg

SEQ ID NO: 105755 - DNA, 15 bp, Homo sapiens
tatgcctgtaatccc

SEQ ID NO: 105756 - DNA, 15 bp, Homo sapiens
ttatgcctgtaatcc

SEQ ID NO: 105757 - DNA, 15 bp, Homo sapiens
cttatgcctgtaatc

SEQ ID NO: 105758 - DNA, 15 bp, Homo sapiens
gcttatgcctgtaat

SEQ ID NO: 105759 - DNA, 15 bp, Homo sapiens
caggtgcggtggctt

SEQ ID NO: 105760 - DNA, 15 bp, Homo sapiens
taggccaggtgcggt

SEQ ID NO: 105761 - DNA, 15 bp, Homo sapiens
gtaggccaggtgcgg

SEQ ID NO: 105762 - DNA, 15 bp, Homo sapiens
tgtaggccaggtgcg

SEQ ID NO: 105763 - DNA, 15 bp, Homo sapiens
ttgtaggccaggtgc

SEQ ID NO: 105764 - DNA, 15 bp, Homo sapiens
tttgtaggccaggtg

SEQ ID NO: 105765 - DNA, 15 bp, Homo sapiens
ttttgtaggccaggt

SEQ ID NO: 105766 - DNA, 15 bp, Homo sapiens
tttttgtaggccagg

SEQ ID NO: 105767 - DNA, 15 bp, Homo sapiens
gtttttgtaggccag

SEQ ID NO: 105768 - DNA, 15 bp, Homo sapiens
agtttttgtaggcca

SEQ ID NO: 105769 - DNA, 15 bp, Homo sapiens
aagtttttgtaggcc

SEQ ID NO: 105770 - DNA, 15 bp, Homo sapiens
taagtttttgtaggc

SEQ ID NO: 105771 - DNA, 15 bp, Homo sapiens
ataagtttttgtagg

SEQ ID NO: 105772 - DNA, 15 bp, Homo sapiens
aataagtttttgtag

SEQ ID NO: 105773 - DNA, 15 bp, Homo sapiens
taataagtttttgta

SEQ ID NO: 105774 - DNA, 15 bp, Homo sapiens
ttaataagtttttgt

SEQ ID NO: 105775 - DNA, 15 bp, Homo sapiens
tttaataagtttttg

SEQ ID NO: 105776 - DNA, 15 bp, Homo sapiens
ctttaataagttttt

SEQ ID NO: 105777 - DNA, 15 bp, Homo sapiens
gctttaataagtttt

SEQ ID NO: 105778 - DNA, 15 bp, Homo sapiens
agctttaataagttt

SEQ ID NO: 105779 - DNA, 15 bp, Homo sapiens
aagctttaataagtt

SEQ ID NO: 105780 - DNA, 15 bp, Homo sapiens
gaagctttaataagt

SEQ ID NO: 105781 - DNA, 15 bp, Homo sapiens
agaagctttaataag

SEQ ID NO: 105782 - DNA, 15 bp, Homo sapiens
cagaagctttaataa

SEQ ID NO: 105783 - DNA, 15 bp, Homo sapiens
acagaagctttaata

SEQ ID NO: 105784 - DNA, 15 bp, Homo sapiens
cacagaagctttaat

SEQ ID NO: 105785 - DNA, 15 bp, Homo sapiens
ccacagaagctttaa

SEQ ID NO: 105786 - DNA, 15 bp, Homo sapiens
tccacagaagcttta

SEQ ID NO: 105787 - DNA, 15 bp, Homo sapiens
ctccacagaagcttt

SEQ ID NO: 105788 - DNA, 15 bp, Homo sapiens
cctccacagaagctt

SEQ ID NO: 105789 - DNA, 15 bp, Homo sapiens
acctccacagaagct

SEQ ID NO: 105790 - DNA, 15 bp, Homo sapiens
gacctccacagaagc

SEQ ID NO: 105791 - DNA, 15 bp, Homo sapiens
tgacctccacagaag

SEQ ID NO: 105792 - DNA, 15 bp, Homo sapiens
ttgacctccacagaa

SEQ ID NO: 105793 - DNA, 15 bp, Homo sapiens
gttgacctccacaga

SEQ ID NO: 105794 - DNA, 15 bp, Homo sapiens
tgttgacctccacag

SEQ ID NO: 105795 - DNA, 15 bp, Homo sapiens
atgttgacctccaca

SEQ ID NO: 105796 - DNA, 15 bp, Homo sapiens
aatgttgacctccac

SEQ ID NO: 105797 - DNA, 15 bp, Homo sapiens
taatgttgacctcca

SEQ ID NO: 105798 - DNA, 15 bp, Homo sapiens
ataatgttgacctcc

SEQ ID NO: 105799 - DNA, 15 bp, Homo sapiens
cataatgttgacctc

SEQ ID NO: 105800 - DNA, 15 bp, Homo sapiens
acataatgttgacct

SEQ ID NO: 105801 - DNA, 15 bp, Homo sapiens
tacataatgttgacc

SEQ ID NO: 105802 - DNA, 15 bp, Homo sapiens
ttacataatgttgac

SEQ ID NO: 105803 - DNA, 15 bp, Homo sapiens
tttacataatgttga

SEQ ID NO: 105804 - DNA, 15 bp, Homo sapiens
ttttacataatgttg

SEQ ID NO: 105805 - DNA, 15 bp, Homo sapiens
attttacataatgtt

SEQ ID NO: 105806 - DNA, 15 bp, Homo sapiens
tattttacataatgt

SEQ ID NO: 105807 - DNA, 15 bp, Homo sapiens
gtattttacataatg

SEQ ID NO: 105808 - DNA, 15 bp, Homo sapiens
cgtattttacataat

SEQ ID NO: 105809 - DNA, 15 bp, Homo sapiens
tcgtattttacataa

SEQ ID NO: 105810 - DNA, 15 bp, Homo sapiens
atcgtattttacata

SEQ ID NO: 105811 - DNA, 15 bp, Homo sapiens
tatcgtattttacat

SEQ ID NO: 105812 - DNA, 15 bp, Homo sapiens
atatcgtattttaca

SEQ ID NO: 105813 - DNA, 15 bp, Homo sapiens
gatatcgtattttac

SEQ ID NO: 105814 - DNA, 15 bp, Homo sapiens
tgatatcgtatttta

SEQ ID NO: 105815 - DNA, 15 bp, Homo sapiens
atgatatcgtatttt

SEQ ID NO: 105816 - DNA, 15 bp, Homo sapiens
catgatatcgtattt

SEQ ID NO: 105817 - DNA, 15 bp, Homo sapiens
acatgatatcgtatt

SEQ ID NO: 105818 - DNA, 15 bp, Homo sapiens
tacatgatatcgtat

SEQ ID NO: 105819 - DNA, 15 bp, Homo sapiens
atacatgatatcgta

SEQ ID NO: 105820 - DNA, 15 bp, Homo sapiens
aatacatgatatcgt

SEQ ID NO: 105821 - DNA, 15 bp, Homo sapiens
taatacatgatatcg

SEQ ID NO: 105822 - DNA, 15 bp, Homo sapiens
gtaatacatgatatc

SEQ ID NO: 105823 - DNA, 15 bp, Homo sapiens
tgtaatacatgatat

SEQ ID NO: 105824 - DNA, 15 bp, Homo sapiens
gtgtaatacatgata

SEQ ID NO: 105825 - DNA, 15 bp, Homo sapiens
tgtgtaatacatgat

SEQ ID NO: 105826 - DNA, 15 bp, Homo sapiens
ttgtgtaatacatga

SEQ ID NO: 105827 - DNA, 15 bp, Homo sapiens
gttgtgtaatacatg

SEQ ID NO: 105828 - DNA, 15 bp, Homo sapiens
cgttgtgtaatacat

SEQ ID NO: 105829 - DNA, 15 bp, Homo sapiens
tcgttgtgtaataca

SEQ ID NO: 105830 - DNA, 15 bp, Homo sapiens
atcgttgtgtaatac

SEQ ID NO: 105831 - DNA, 15 bp, Homo sapiens
tatcgttgtgtaata

SEQ ID NO: 105832 - DNA, 15 bp, Homo sapiens
atatcgttgtgtaat

SEQ ID NO: 105833 - DNA, 15 bp, Homo sapiens
tatatcgttgtgtaa

SEQ ID NO: 105834 - DNA, 15 bp, Homo sapiens
ctatatcgttgtgta

SEQ ID NO: 105835 - DNA, 15 bp, Homo sapiens
tctatatcgttgtgt

SEQ ID NO: 105836 - DNA, 15 bp, Homo sapiens
ttctatatcgttgtg

SEQ ID NO: 105837 - DNA, 15 bp, Homo sapiens
gttctatatcgttgt

SEQ ID NO: 105838 - DNA, 15 bp, Homo sapiens
agttctatatcgttg

SEQ ID NO: 105839 - DNA, 15 bp, Homo sapiens
aagttctatatcgtt

SEQ ID NO: 105840 - DNA, 15 bp, Homo sapiens
aaagttctatatcgt

SEQ ID NO: 105841 - DNA, 15 bp, Homo sapiens
aaaagttctatatcg

SEQ ID NO: 105842 - DNA, 15 bp, Homo sapiens
caaaagttctatatc

SEQ ID NO: 105843 - DNA, 15 bp, Homo sapiens
acaaaagttctatat

SEQ ID NO: 105844 - DNA, 15 bp, Homo sapiens
tacaaaagttctata

SEQ ID NO: 105845 - DNA, 15 bp, Homo sapiens
atacaaaagttctat

SEQ ID NO: 105846 - DNA, 15 bp, Homo sapiens
aatacaaaagttcta

SEQ ID NO: 105847 - DNA, 15 bp, Homo sapiens
caatacaaaagttct

SEQ ID NO: 105848 - DNA, 15 bp, Homo sapiens
acaatacaaaagttc

SEQ ID NO: 105849 - DNA, 15 bp, Homo sapiens
gacaatacaaaagtt

SEQ ID NO: 105850 - DNA, 15 bp, Homo sapiens
agacaatacaaaagt

SEQ ID NO: 105851 - DNA, 15 bp, Homo sapiens
gagacaatacaaaag

SEQ ID NO: 105852 - DNA, 15 bp, Homo sapiens
agagacaatacaaaa

SEQ ID NO: 105853 - DNA, 15 bp, Homo sapiens
aagagacaatacaaa

SEQ ID NO: 105854 - DNA, 15 bp, Homo sapiens
aaagagacaatacaa

SEQ ID NO: 105855 - DNA, 15 bp, Homo sapiens
aaaagagacaataca

SEQ ID NO: 105856 - DNA, 15 bp, Homo sapiens
aaaaagagacaatac

SEQ ID NO: 105857 - DNA, 15 bp, Homo sapiens
taaaaagagacaata

SEQ ID NO: 105858 - DNA, 15 bp, Homo sapiens
ataaaaagagacaat

SEQ ID NO: 105859 - DNA, 15 bp, Homo sapiens
tataaaaagagacaa

SEQ ID NO: 105860 - DNA, 15 bp, Homo sapiens
gtataaaaagagaca

SEQ ID NO: 105861 - DNA, 15 bp, Homo sapiens
agtataaaaagagac

SEQ ID NO: 105862 - DNA, 15 bp, Homo sapiens
aagtataaaaagaga

SEQ ID NO: 105863 - DNA, 15 bp, Homo sapiens
taagtataaaaagag

SEQ ID NO: 105864 - DNA, 15 bp, Homo sapiens
ttaagtataaaaaga

SEQ ID NO: 105865 - DNA, 15 bp, Homo sapiens
cttaagtataaaaag

SEQ ID NO: 105866 - DNA, 15 bp, Homo sapiens
acttaagtataaaaa

SEQ ID NO: 105867 - DNA, 15 bp, Homo sapiens
tacttaagtataaaa

SEQ ID NO: 105868 - DNA, 15 bp, Homo sapiens
ttacttaagtataaa

SEQ ID NO: 105869 - DNA, 15 bp, Homo sapiens
tttacttaagtataa

SEQ ID NO: 105870 - DNA, 15 bp, Homo sapiens
ttttacttaagtata

SEQ ID NO: 105871 - DNA, 15 bp, Homo sapiens
tttttacttaagtat

SEQ ID NO: 105872 - DNA, 15 bp, Homo sapiens
ttttttacttaagta

SEQ ID NO: 105873 - DNA, 15 bp, Homo sapiens
tttttttacttaagt

SEQ ID NO: 105874 - DNA, 15 bp, Homo sapiens
ttttttttacttaag

SEQ ID NO: 105875 - DNA, 15 bp, Homo sapiens
tttttttttacttaa

SEQ ID NO: 105876 - DNA, 15 bp, Homo sapiens
ttttttttttactta

SEQ ID NO: 105877 - DNA, 15 bp, Homo sapiens
cttttttttttactt

SEQ ID NO: 105878 - DNA, 15 bp, Homo sapiens
ccttttttttttact

SEQ ID NO: 105879 - DNA, 15 bp, Homo sapiens
tccttttttttttac

SEQ ID NO: 105880 - DNA, 15 bp, Homo sapiens
gtcctttttttttta

SEQ ID NO: 105881 - DNA, 15 bp, Homo sapiens
tgtcctttttttttt

SEQ ID NO: 105882 - DNA, 15 bp, Homo sapiens
atgtccttttttttt

SEQ ID NO: 105883 - DNA, 15 bp, Homo sapiens
gatgtcctttttttt

SEQ ID NO: 105884 - DNA, 15 bp, Homo sapiens
ggatgtccttttttt

SEQ ID NO: 105885 - DNA, 15 bp, Homo sapiens
aggatgtcctttttt

SEQ ID NO: 105886 - DNA, 15 bp, Homo sapiens
gaggatgtccttttt

SEQ ID NO: 105887 - DNA, 15 bp, Homo sapiens
agaggatgtcctttt

SEQ ID NO: 105888 - DNA, 15 bp, Homo sapiens
gagaggatgtccttt

SEQ ID NO: 105889 - DNA, 15 bp, Homo sapiens
ggagaggatgtcctt

SEQ ID NO: 105890 - DNA, 15 bp, Homo sapiens
gggagaggatgtcct

SEQ ID NO: 105891 - DNA, 15 bp, Homo sapiens
ggggagaggatgtcc

SEQ ID NO: 105892 - DNA, 15 bp, Homo sapiens
aggggagaggatgtc

SEQ ID NO: 105893 - DNA, 15 bp, Homo sapiens
aaggggagaggatgt

SEQ ID NO: 105894 - DNA, 15 bp, Homo sapiens
aaaggggagaggatg

SEQ ID NO: 105895 - DNA, 15 bp, Homo sapiens
gaaaggggagaggat

SEQ ID NO: 105896 - DNA, 15 bp, Homo sapiens
ggaaaggggagagga

SEQ ID NO: 105897 - DNA, 15 bp, Homo sapiens
tggaaaggggagagg

SEQ ID NO: 105898 - DNA, 15 bp, Homo sapiens
ttggaaaggggagag

SEQ ID NO: 105899 - DNA, 15 bp, Homo sapiens
attggaaaggggaga

SEQ ID NO: 105900 - DNA, 15 bp, Homo sapiens
gattggaaaggggag

SEQ ID NO: 105901 - DNA, 15 bp, Homo sapiens
agattggaaagggga

SEQ ID NO: 105902 - DNA, 15 bp, Homo sapiens
gagattggaaagggg

SEQ ID NO: 105903 - DNA, 15 bp, Homo sapiens
agagattggaaaggg

SEQ ID NO: 105904 - DNA, 15 bp, Homo sapiens
aagagattggaaagg

SEQ ID NO: 105905 - DNA, 15 bp, Homo sapiens
aaagagattggaaag

SEQ ID NO: 105906 - DNA, 15 bp, Homo sapiens
aaaagagattggaaa

SEQ ID NO: 105907 - DNA, 15 bp, Homo sapiens
aaaaagagattggaa

SEQ ID NO: 105908 - DNA, 15 bp, Homo sapiens
taaaaagagattgga

SEQ ID NO: 105909 - DNA, 15 bp, Homo sapiens
ctaaaaagagattgg

SEQ ID NO: 105910 - DNA, 15 bp, Homo sapiens
tctaaaaagagattg

SEQ ID NO: 105911 - DNA, 15 bp, Homo sapiens
ttctaaaaagagatt

SEQ ID NO: 105912 - DNA, 15 bp, Homo sapiens
tttctaaaaagagat

SEQ ID NO: 105913 - DNA, 15 bp, Homo sapiens
ttttctaaaaagaga

SEQ ID NO: 105914 - DNA, 15 bp, Homo sapiens
attttctaaaaagag

SEQ ID NO: 105915 - DNA, 15 bp, Homo sapiens
gattttctaaaaaga

SEQ ID NO: 105916 - DNA, 15 bp, Homo sapiens
ggattttctaaaaag

SEQ ID NO: 105917 - DNA, 15 bp, Homo sapiens
tggattttctaaaaa

SEQ ID NO: 105918 - DNA, 15 bp, Homo sapiens
ttggattttctaaaa

SEQ ID NO: 105919 - DNA, 15 bp, Homo sapiens
cttggattttctaaa

SEQ ID NO: 105920 - DNA, 15 bp, Homo sapiens
gcttggattttctaa

SEQ ID NO: 105921 - DNA, 15 bp, Homo sapiens
tgcttggattttcta

SEQ ID NO: 105922 - DNA, 15 bp, Homo sapiens
ctgcttggattttct

SEQ ID NO: 105923 - DNA, 15 bp, Homo sapiens
tctgcttggattttc

SEQ ID NO: 105924 - DNA, 15 bp, Homo sapiens
ctctgcttggatttt

SEQ ID NO: 105925 - DNA, 15 bp, Homo sapiens
tctctgcttggattt

SEQ ID NO: 105926 - DNA, 15 bp, Homo sapiens
atctctgcttggatt

SEQ ID NO: 105927 - DNA, 15 bp, Homo sapiens
gatctctgcttggat

SEQ ID NO: 105928 - DNA, 15 bp, Homo sapiens
agatctctgcttgga

SEQ ID NO: 105929 - DNA, 15 bp, Homo sapiens
gagatctctgcttgg

SEQ ID NO: 105930 - DNA, 15 bp, Homo sapiens
tgagatctctgcttg

SEQ ID NO: 105931 - DNA, 15 bp, Homo sapiens
ctgagatctctgctt

SEQ ID NO: 105932 - DNA, 15 bp, Homo sapiens
gctgagatctctgct

SEQ ID NO: 105933 - DNA, 15 bp, Homo sapiens
ggctgagatctctgc

SEQ ID NO: 105934 - DNA, 15 bp, Homo sapiens
gggctgagatctctg

SEQ ID NO: 105935 - DNA, 15 bp, Homo sapiens
tgggctgagatctct

SEQ ID NO: 105936 - DNA, 15 bp, Homo sapiens
atgggctgagatctc

SEQ ID NO: 105937 - DNA, 15 bp, Homo sapiens
catgggctgagatct

SEQ ID NO: 105938 - DNA, 15 bp, Homo sapiens
tcatgggctgagatc

SEQ ID NO: 105939 - DNA, 15 bp, Homo sapiens
ctcatgggctgagat

SEQ ID NO: 105940 - DNA, 15 bp, Homo sapiens
gctcatgggctgaga

SEQ ID NO: 105941 - DNA, 15 bp, Homo sapiens
agctcatgggctgag

SEQ ID NO: 105942 - DNA, 15 bp, Homo sapiens
tagctcatgggctga

SEQ ID NO: 105943 - DNA, 15 bp, Homo sapiens
ttagctcatgggctg

SEQ ID NO: 105944 - DNA, 15 bp, Homo sapiens
gttagctcatgggct

SEQ ID NO: 105945 - DNA, 15 bp, Homo sapiens
ggttagctcatgggc

SEQ ID NO: 105946 - DNA, 15 bp, Homo sapiens
gggttagctcatggg

SEQ ID NO: 105947 - DNA, 15 bp, Homo sapiens
agggttagctcatgg

SEQ ID NO: 105948 - DNA, 15 bp, Homo sapiens
tagggttagctcatg

SEQ ID NO: 105949 - DNA, 15 bp, Homo sapiens
ctagggttagctcat

SEQ ID NO: 105950 - DNA, 15 bp, Homo sapiens
tctagggttagctca

SEQ ID NO: 105951 - DNA, 15 bp, Homo sapiens
ctctagggttagctc

SEQ ID NO: 105952 - DNA, 15 bp, Homo sapiens
cctctagggttagct

SEQ ID NO: 105953 - DNA, 15 bp, Homo sapiens
tcctctagggttagc

SEQ ID NO: 105954 - DNA, 15 bp, Homo sapiens
ctcctctagggttag

SEQ ID NO: 105955 - DNA, 15 bp, Homo sapiens
actcctctagggtta

SEQ ID NO: 105956 - DNA, 15 bp, Homo sapiens
aactcctctagggtt

SEQ ID NO: 105957 - DNA, 15 bp, Homo sapiens
caactcctctagggt

SEQ ID NO: 105958 - DNA, 15 bp, Homo sapiens
tcaactcctctaggg

SEQ ID NO: 105959 - DNA, 15 bp, Homo sapiens
ctcaactcctctagg

SEQ ID NO: 105960 - DNA, 15 bp, Homo sapiens
tctcaactcctctag

SEQ ID NO: 105961 - DNA, 15 bp, Homo sapiens
ttctcaactcctcta

SEQ ID NO: 105962 - DNA, 15 bp, Homo sapiens
cttctcaactcctct

SEQ ID NO: 105963 - DNA, 15 bp, Homo sapiens
tcttctcaactcctc

SEQ ID NO: 105964 - DNA, 15 bp, Homo sapiens
ttcttctcaactcct

SEQ ID NO: 105965 - DNA, 15 bp, Homo sapiens
tttcttctcaactcc

SEQ ID NO: 105966 - DNA, 15 bp, Homo sapiens
atttcttctcaactc

SEQ ID NO: 105967 - DNA, 15 bp, Homo sapiens
tatttcttctcaact

SEQ ID NO: 105968 - DNA, 15 bp, Homo sapiens
atatttcttctcaac

SEQ ID NO: 105969 - DNA, 15 bp, Homo sapiens
catatttcttctcaa

SEQ ID NO: 105970 - DNA, 15 bp, Homo sapiens
gcatatttcttctca

SEQ ID NO: 105971 - DNA, 15 bp, Homo sapiens
cgcatatttcttctc

SEQ ID NO: 105972 - DNA, 15 bp, Homo sapiens
acgcatatttcttct

SEQ ID NO: 105973 - DNA, 15 bp, Homo sapiens
aacgcatatttcttc

SEQ ID NO: 105974 - DNA, 15 bp, Homo sapiens
gaacgcatatttctt

SEQ ID NO: 105975 - DNA, 15 bp, Homo sapiens
agaacgcatatttct

SEQ ID NO: 105976 - DNA, 15 bp, Homo sapiens
gagaacgcatatttc

SEQ ID NO: 105977 - DNA, 15 bp, Homo sapiens
tgagaacgcatattt

SEQ ID NO: 105978 - DNA, 15 bp, Homo sapiens
ctgagaacgcatatt

SEQ ID NO: 105979 - DNA, 15 bp, Homo sapiens
gctgagaacgcatat

SEQ ID NO: 105980 - DNA, 15 bp, Homo sapiens
ggctgagaacgcata

SEQ ID NO: 105981 - DNA, 15 bp, Homo sapiens
gggctgagaacgcat

SEQ ID NO: 105982 - DNA, 15 bp, Homo sapiens
ggggctgagaacgca

SEQ ID NO: 105983 - DNA, 15 bp, Homo sapiens
aggggctgagaacgc

SEQ ID NO: 105984 - DNA, 15 bp, Homo sapiens
caggggctgagaacg

SEQ ID NO: 105985 - DNA, 15 bp, Homo sapiens
tcaggggctgagaac

SEQ ID NO: 105986 - DNA, 15 bp, Homo sapiens
gtcaggggctgagaa

SEQ ID NO: 105987 - DNA, 15 bp, Homo sapiens
ggtcaggggctgaga

SEQ ID NO: 105988 - DNA, 15 bp, Homo sapiens
aggtcaggggctgag

SEQ ID NO: 105989 - DNA, 15 bp, Homo sapiens
gaggtcaggggctga

SEQ ID NO: 105990 - DNA, 15 bp, Homo sapiens
ggaggtcaggggctg

SEQ ID NO: 105991 - DNA, 15 bp, Homo sapiens
gggaggtcaggggct

SEQ ID NO: 105992 - DNA, 15 bp, Homo sapiens
ggggaggtcaggggc

SEQ ID NO: 105993 - DNA, 15 bp, Homo sapiens
tggggaggtcagggg

SEQ ID NO: 105994 - DNA, 15 bp, Homo sapiens
ctggggaggtcaggg

SEQ ID NO: 105995 - DNA, 15 bp, Homo sapiens
tctggggaggtcagg

SEQ ID NO: 105996 - DNA, 15 bp, Homo sapiens
ctctggggaggtcag

SEQ ID NO: 105997 - DNA, 15 bp, Homo sapiens
tctctggggaggtca

SEQ ID NO: 105998 - DNA, 15 bp, Homo sapiens
ctctctggggaggtc

SEQ ID NO: 105999 - DNA, 15 bp, Homo sapiens
actctctggggaggt

SEQ ID NO: 106000 - DNA, 15 bp, Homo sapiens
tactctctggggagg

SEQ ID NO: 106001 - DNA, 15 bp, Homo sapiens
ctactctctggggag

SEQ ID NO: 106002 - DNA, 15 bp, Homo sapiens
cctactctctgggga

SEQ ID NO: 106003 - DNA, 15 bp, Homo sapiens
tcctactctctgggg

SEQ ID NO: 106004 - DNA, 15 bp, Homo sapiens
gtcctactctctggg

SEQ ID NO: 106005 - DNA, 15 bp, Homo sapiens
agtcctactctctgg

SEQ ID NO: 106006 - DNA, 15 bp, Homo sapiens
cagtcctactctctg

SEQ ID NO: 106007 - DNA, 15 bp, Homo sapiens
gcagtcctactctct

SEQ ID NO: 106008 - DNA, 15 bp, Homo sapiens
ggcagtcctactctc

SEQ ID NO: 106009 - DNA, 15 bp, Homo sapiens
tggcagtcctactct

SEQ ID NO: 106010 - DNA, 15 bp, Homo sapiens
ctggcagtcctactc

SEQ ID NO: 106011 - DNA, 15 bp, Homo sapiens
tctggcagtcctact

SEQ ID NO: 106012 - DNA, 15 bp, Homo sapiens
ctctggcagtcctac

SEQ ID NO: 106013 - DNA, 15 bp, Homo sapiens
cctctggcagtccta

SEQ ID NO: 106014 - DNA, 15 bp, Homo sapiens
tcctctggcagtcct

SEQ ID NO: 106015 - DNA, 15 bp, Homo sapiens
ctcctctggcagtcc

SEQ ID NO: 106016 - DNA, 15 bp, Homo sapiens
cctcctctggcagtc

SEQ ID NO: 106017 - DNA, 15 bp, Homo sapiens
tcctcctctggcagt

SEQ ID NO: 106018 - DNA, 15 bp, Homo sapiens
ttcctcctctggcag

SEQ ID NO: 106019 - DNA, 15 bp, Homo sapiens
cttcctcctctggca

SEQ ID NO: 106020 - DNA, 15 bp, Homo sapiens
acttcctcctctggc

SEQ ID NO: 106021 - DNA, 15 bp, Homo sapiens
gacttcctcctctgg

SEQ ID NO: 106022 - DNA, 15 bp, Homo sapiens
tgacttcctcctctg

SEQ ID NO: 106023 - DNA, 15 bp, Homo sapiens
ctgacttcctcctct

SEQ ID NO: 106024 - DNA, 15 bp, Homo sapiens
tctgacttcctcctc

SEQ ID NO: 106025 - DNA, 15 bp, Homo sapiens
atctgacttcctcct

SEQ ID NO: 106026 - DNA, 15 bp, Homo sapiens
catctgacttcctcc

SEQ ID NO: 106027 - DNA, 15 bp, Homo sapiens
ccatctgacttcctc

SEQ ID NO: 106028 - DNA, 15 bp, Homo sapiens
tccatctgacttcct

SEQ ID NO: 106029 - DNA, 15 bp, Homo sapiens
atccatctgacttcc

SEQ ID NO: 106030 - DNA, 15 bp, Homo sapiens
catccatctgacttc

SEQ ID NO: 106031 - DNA, 15 bp, Homo sapiens
acatccatctgactt

SEQ ID NO: 106032 - DNA, 15 bp, Homo sapiens
cacatccatctgact

SEQ ID NO: 106033 - DNA, 15 bp, Homo sapiens
gcacatccatctgac

SEQ ID NO: 106034 - DNA, 15 bp, Homo sapiens
agcacatccatctga

SEQ ID NO: 106035 - DNA, 15 bp, Homo sapiens
tagcacatccatctg

SEQ ID NO: 106036 - DNA, 15 bp, Homo sapiens
gtagcacatccatct

SEQ ID NO: 106037 - DNA, 15 bp, Homo sapiens
tgtagcacatccatc

SEQ ID NO: 106038 - DNA, 15 bp, Homo sapiens
ctgtagcacatccat

SEQ ID NO: 106039 - DNA, 15 bp, Homo sapiens
cctgtagcacatcca

SEQ ID NO: 106040 - DNA, 15 bp, Homo sapiens
acctgtagcacatcc

SEQ ID NO: 106041 - DNA, 15 bp, Homo sapiens
tacctgtagcacatc

SEQ ID NO: 106042 - DNA, 15 bp, Homo sapiens
ttacctgtagcacat

SEQ ID NO: 106043 - DNA, 15 bp, Homo sapiens
tttacctgtagcaca

SEQ ID NO: 106044 - DNA, 15 bp, Homo sapiens
ctttacctgtagcac

SEQ ID NO: 106045 - DNA, 15 bp, Homo sapiens
tctttacctgtagca

SEQ ID NO: 106046 - DNA, 15 bp, Homo sapiens
ttctttacctgtagc

SEQ ID NO: 106047 - DNA, 15 bp, Homo sapiens
cttctttacctgtag

SEQ ID NO: 106048 - DNA, 15 bp, Homo sapiens
ccttctttacctgta

SEQ ID NO: 106049 - DNA, 15 bp, Homo sapiens
gccttctttacctgt

SEQ ID NO: 106050 - DNA, 15 bp, Homo sapiens
ggccttctttacctg

SEQ ID NO: 106051 - DNA, 15 bp, Homo sapiens
tggccttctttacct

SEQ ID NO: 106052 - DNA, 15 bp, Homo sapiens
ctggccttctttacc

SEQ ID NO: 106053 - DNA, 15 bp, Homo sapiens
cctggccttctttac

SEQ ID NO: 106054 - DNA, 15 bp, Homo sapiens
tcctggccttcttta

SEQ ID NO: 106055 - DNA, 15 bp, Homo sapiens
ctcctggccttcttt

SEQ ID NO: 106056 - DNA, 15 bp, Homo sapiens
gctcctggccttctt

SEQ ID NO: 106057 - DNA, 15 bp, Homo sapiens
agctcctggccttct

SEQ ID NO: 106058 - DNA, 15 bp, Homo sapiens
aagctcctggccttc

SEQ ID NO: 106059 - DNA, 15 bp, Homo sapiens
gaagctcctggcctt

SEQ ID NO: 106060 - DNA, 15 bp, Homo sapiens
ggaagctcctggcct

SEQ ID NO: 106061 - DNA, 15 bp, Homo sapiens
aggaagctcctggcc

SEQ ID NO: 106062 - DNA, 15 bp, Homo sapiens
aaggaagctcctggc

SEQ ID NO: 106063 - DNA, 15 bp, Homo sapiens
aaaggaagctcctgg

SEQ ID NO: 106064 - DNA, 15 bp, Homo sapiens
aaaaggaagctcctg

SEQ ID NO: 106065 - DNA, 15 bp, Homo sapiens
taaaaggaagctcct

SEQ ID NO: 106066 - DNA, 15 bp, Homo sapiens
gtaaaaggaagctcc

SEQ ID NO: 106067 - DNA, 15 bp, Homo sapiens
agtaaaaggaagctc

SEQ ID NO: 106068 - DNA, 15 bp, Homo sapiens
aagtaaaaggaagct

SEQ ID NO: 106069 - DNA, 15 bp, Homo sapiens
aaagtaaaaggaagc

SEQ ID NO: 106070 - DNA, 15 bp, Homo sapiens
aaaagtaaaaggaag

SEQ ID NO: 106071 - DNA, 15 bp, Homo sapiens
gaaaagtaaaaggaa

SEQ ID NO: 106072 - DNA, 15 bp, Homo sapiens
tgaaaagtaaaagga

SEQ ID NO: 106073 - DNA, 15 bp, Homo sapiens
ttgaaaagtaaaagg

SEQ ID NO: 106074 - DNA, 15 bp, Homo sapiens
gttgaaaagtaaaag

SEQ ID NO: 106075 - DNA, 15 bp, Homo sapiens
agttgaaaagtaaaa

SEQ ID NO: 106076 - DNA, 15 bp, Homo sapiens
aagttgaaaagtaaa

SEQ ID NO: 106077 - DNA, 15 bp, Homo sapiens
caagttgaaaagtaa

SEQ ID NO: 106078 - DNA, 15 bp, Homo sapiens
acaagttgaaaagta

SEQ ID NO: 106079 - DNA, 15 bp, Homo sapiens
aacaagttgaaaagt

SEQ ID NO: 106080 - DNA, 15 bp, Homo sapiens
caacaagttgaaaag

SEQ ID NO: 106081 - DNA, 15 bp, Homo sapiens
ccaacaagttgaaaa

SEQ ID NO: 106082 - DNA, 15 bp, Homo sapiens
cccaacaagttgaaa

SEQ ID NO: 106083 - DNA, 15 bp, Homo sapiens
tcccaacaagttgaa

SEQ ID NO: 106084 - DNA, 15 bp, Homo sapiens
ttcccaacaagttga

SEQ ID NO: 106085 - DNA, 15 bp, Homo sapiens
attcccaacaagttg

SEQ ID NO: 106086 - DNA, 15 bp, Homo sapiens
aattcccaacaagtt

SEQ ID NO: 106087 - DNA, 15 bp, Homo sapiens
aaattcccaacaagt

SEQ ID NO: 106088 - DNA, 15 bp, Homo sapiens
aaaattcccaacaag

SEQ ID NO: 106089 - DNA, 15 bp, Homo sapiens
gaaaattcccaacaa

SEQ ID NO: 106090 - DNA, 15 bp, Homo sapiens
agaaaattcccaaca

SEQ ID NO: 106091 - DNA, 15 bp, Homo sapiens
aagaaaattcccaac

SEQ ID NO: 106092 - DNA, 15 bp, Homo sapiens
gaagaaaattcccaa

SEQ ID NO: 106093 - DNA, 15 bp, Homo sapiens
tgaagaaaattccca

SEQ ID NO: 106094 - DNA, 15 bp, Homo sapiens
ttgaagaaaattccc

SEQ ID NO: 106095 - DNA, 15 bp, Homo sapiens
tttgaagaaaattcc

SEQ ID NO: 106096 - DNA, 15 bp, Homo sapiens
ttttgaagaaaattc

SEQ ID NO: 106097 - DNA, 15 bp, Homo sapiens
tttttgaagaaaatt

SEQ ID NO: 106098 - DNA, 15 bp, Homo sapiens
ttttttgaagaaaat

SEQ ID NO: 106099 - DNA, 15 bp, Homo sapiens
cttttttgaagaaaa

SEQ ID NO: 106100 - DNA, 15 bp, Homo sapiens
tcttttttgaagaaa

SEQ ID NO: 106101 - DNA, 15 bp, Homo sapiens
ctcttttttgaagaa

SEQ ID NO: 106102 - DNA, 15 bp, Homo sapiens
tctcttttttgaaga

SEQ ID NO: 106103 - DNA, 15 bp, Homo sapiens
ttctcttttttgaag

SEQ ID NO: 106104 - DNA, 15 bp, Homo sapiens
tttctcttttttgaa

SEQ ID NO: 106105 - DNA, 15 bp, Homo sapiens
ctttctcttttttga

SEQ ID NO: 106106 - DNA, 15 bp, Homo sapiens
tctttctcttttttg

SEQ ID NO: 106107 - DNA, 15 bp, Homo sapiens
ttctttctctttttt

SEQ ID NO: 106108 - DNA, 15 bp, Homo sapiens
attctttctcttttt

SEQ ID NO: 106109 - DNA, 15 bp, Homo sapiens
aattctttctctttt

SEQ ID NO: 106110 - DNA, 15 bp, Homo sapiens
caattctttctcttt

SEQ ID NO: 106111 - DNA, 15 bp, Homo sapiens
tcaattctttctctt

SEQ ID NO: 106112 - DNA, 15 bp, Homo sapiens
atcaattctttctct

SEQ ID NO: 106113 - DNA, 15 bp, Homo sapiens
taatcaattctttct

SEQ ID NO: 106114 - DNA, 15 bp, Homo sapiens
gtaatcaattctttc

SEQ ID NO: 106115 - DNA, 15 bp, Homo sapiens
agtaatcaattcttt

SEQ ID NO: 106116 - DNA, 15 bp, Homo sapiens
aagtaatcaattctt

SEQ ID NO: 106117 - DNA, 15 bp, Homo sapiens
caagtaatcaattct

SEQ ID NO: 106118 - DNA, 15 bp, Homo sapiens
ccaagtaatcaattc

SEQ ID NO: 106119 - DNA, 15 bp, Homo sapiens
cccaagtaatcaatt

SEQ ID NO: 106120 - DNA, 15 bp, Homo sapiens
gcccaagtaatcaat

SEQ ID NO: 106121 - DNA, 15 bp, Homo sapiens
tgcccaagtaatcaa

SEQ ID NO: 106122 - DNA, 15 bp, Homo sapiens
gtgcccaagtaatca

SEQ ID NO: 106123 - DNA, 15 bp, Homo sapiens
ggtgcccaagtaatc

SEQ ID NO: 106124 - DNA, 15 bp, Homo sapiens
cggtgcccaagtaat

SEQ ID NO: 106125 - DNA, 15 bp, Homo sapiens
acggtgcccaagtaa

SEQ ID NO: 106126 - DNA, 15 bp, Homo sapiens
aacggtgcccaagta

SEQ ID NO: 106127 - DNA, 15 bp, Homo sapiens
aaacggtgcccaagt

SEQ ID NO: 106128 - DNA, 15 bp, Homo sapiens
caaacggtgcccaag

SEQ ID NO: 106129 - DNA, 15 bp, Homo sapiens
acaaacggtgcccaa

SEQ ID NO: 106130 - DNA, 15 bp, Homo sapiens
tacaaacggtgccca

SEQ ID NO: 106131 - DNA, 15 bp, Homo sapiens
atacaaacggtgccc

SEQ ID NO: 106132 - DNA, 15 bp, Homo sapiens
aatacaaacggtgcc

SEQ ID NO: 106133 - DNA, 15 bp, Homo sapiens
gaatacaaacggtgc

SEQ ID NO: 106134 - DNA, 15 bp, Homo sapiens
agaatacaaacggtg

SEQ ID NO: 106135 - DNA, 15 bp, Homo sapiens
aagaatacaaacggt

SEQ ID NO: 106136 - DNA, 15 bp, Homo sapiens
aaagaatacaaacgg

SEQ ID NO: 106137 - DNA, 15 bp, Homo sapiens
caaagaatacaaacg

SEQ ID NO: 106138 - DNA, 15 bp, Homo sapiens
acaaagaatacaaac

SEQ ID NO: 106139 - DNA, 15 bp, Homo sapiens
cacaaagaatacaaa

SEQ ID NO: 106140 - DNA, 15 bp, Homo sapiens
tcacaaagaatacaa

SEQ ID NO: 106141 - DNA, 15 bp, Homo sapiens
atcacaaagaataca

SEQ ID NO: 106142 - DNA, 15 bp, Homo sapiens
catcacaaagaatac

SEQ ID NO: 106143 - DNA, 15 bp, Homo sapiens
acatcacaaagaata

SEQ ID NO: 106144 - DNA, 15 bp, Homo sapiens
tacatcacaaagaat

SEQ ID NO: 106145 - DNA, 15 bp, Homo sapiens
ttacatcacaaagaa

SEQ ID NO: 106146 - DNA, 15 bp, Homo sapiens
tttacatcacaaaga

SEQ ID NO: 106147 - DNA, 15 bp, Homo sapiens
gtttacatcacaaag

SEQ ID NO: 106148 - DNA, 15 bp, Homo sapiens
ggtttacatcacaaa

SEQ ID NO: 106149 - DNA, 15 bp, Homo sapiens
tggtttacatcacaa

SEQ ID NO: 106150 - DNA, 15 bp, Homo sapiens
atggtttacatcaca

SEQ ID NO: 106151 - DNA, 15 bp, Homo sapiens
catggtttacatcac

SEQ ID NO: 106152 - DNA, 15 bp, Homo sapiens
ccatggtttacatca

SEQ ID NO: 106153 - DNA, 15 bp, Homo sapiens
cccatggtttacatc

SEQ ID NO: 106154 - DNA, 15 bp, Homo sapiens
tcccatggtttacat

SEQ ID NO: 106155 - DNA, 15 bp, Homo sapiens
atcccatggtttaca

SEQ ID NO: 106156 - DNA, 15 bp, Homo sapiens
catcccatggtttac

SEQ ID NO: 106157 - DNA, 15 bp, Homo sapiens
ccatcccatggttta

SEQ ID NO: 106158 - DNA, 15 bp, Homo sapiens
cccatcccatggttt

SEQ ID NO: 106159 - DNA, 15 bp, Homo sapiens
tcccatcccatggtt

SEQ ID NO: 106160 - DNA, 15 bp, Homo sapiens
ctcccatcccatggt

SEQ ID NO: 106161 - DNA, 15 bp, Homo sapiens
actcccatcccatgg

SEQ ID NO: 106162 - DNA, 15 bp, Homo sapiens
cactcccatcccatg

SEQ ID NO: 106163 - DNA, 15 bp, Homo sapiens
tcactcccatcccat

SEQ ID NO: 106164 - DNA, 15 bp, Homo sapiens
atcactcccatccca

SEQ ID NO: 106165 - DNA, 15 bp, Homo sapiens
catcactcccatccc

SEQ ID NO: 106166 - DNA, 15 bp, Homo sapiens
tcatcactcccatcc

SEQ ID NO: 106167 - DNA, 15 bp, Homo sapiens
atcatcactcccatc

SEQ ID NO: 106168 - DNA, 15 bp, Homo sapiens
catcatcactcccat

SEQ ID NO: 106169 - DNA, 15 bp, Homo sapiens
acatcatcactccca

SEQ ID NO: 106170 - DNA, 15 bp, Homo sapiens
cacatcatcactccc

SEQ ID NO: 106171 - DNA, 15 bp, Homo sapiens
acacatcatcactcc

SEQ ID NO: 106172 - DNA, 15 bp, Homo sapiens
aacacatcatcactc

SEQ ID NO: 106173 - DNA, 15 bp, Homo sapiens
caacacatcatcact

SEQ ID NO: 106174 - DNA, 15 bp, Homo sapiens
tcaacacatcatcac

SEQ ID NO: 106175 - DNA, 15 bp, Homo sapiens
ttcaacacatcatca

SEQ ID NO: 106176 - DNA, 15 bp, Homo sapiens
cttcaacacatcatc

SEQ ID NO: 106177 - DNA, 15 bp, Homo sapiens
ccttcaacacatcat

SEQ ID NO: 106178 - DNA, 15 bp, Homo sapiens
accttcaacacatca

SEQ ID NO: 106179 - DNA, 15 bp, Homo sapiens
aaccttcaacacatc

SEQ ID NO: 106180 - DNA, 15 bp, Homo sapiens
caaccttcaacacat

SEQ ID NO: 106181 - DNA, 15 bp, Homo sapiens
gcaaccttcaacaca

SEQ ID NO: 106182 - DNA, 15 bp, Homo sapiens
tgcaaccttcaacac

SEQ ID NO: 106183 - DNA, 15 bp, Homo sapiens
atgcaaccttcaaca

SEQ ID NO: 106184 - DNA, 15 bp, Homo sapiens
gatgcaaccttcaac

SEQ ID NO: 106185 - DNA, 15 bp, Homo sapiens
ggatgcaaccttcaa

SEQ ID NO: 106186 - DNA, 15 bp, Homo sapiens
aggatgcaaccttca

SEQ ID NO: 106187 - DNA, 15 bp, Homo sapiens
taggatgcaaccttc

SEQ ID NO: 106188 - DNA, 15 bp, Homo sapiens
ctaggatgcaacctt

SEQ ID NO: 106189 - DNA, 15 bp, Homo sapiens
cctaggatgcaacct

SEQ ID NO: 106190 - DNA, 15 bp, Homo sapiens
ccctaggatgcaacc

SEQ ID NO: 106191 - DNA, 15 bp, Homo sapiens
gccctaggatgcaac

SEQ ID NO: 106192 - DNA, 15 bp, Homo sapiens
tgccctaggatgcaa

SEQ ID NO: 106193 - DNA, 15 bp, Homo sapiens
ctgccctaggatgca

SEQ ID NO: 106194 - DNA, 15 bp, Homo sapiens
gctgccctaggatgc

SEQ ID NO: 106195 - DNA, 15 bp, Homo sapiens
tgctgccctaggatg

SEQ ID NO: 106196 - DNA, 15 bp, Homo sapiens
ctgctgccctaggat

SEQ ID NO: 106197 - DNA, 15 bp, Homo sapiens
tctgctgccctagga

SEQ ID NO: 106198 - DNA, 15 bp, Homo sapiens
ttctgctgccctagg

SEQ ID NO: 106199 - DNA, 15 bp, Homo sapiens
tttctgctgccctag

SEQ ID NO: 106200 - DNA, 15 bp, Homo sapiens
gtttctgctgcccta

SEQ ID NO: 106201 - DNA, 15 bp, Homo sapiens
tgtttctgctgccct

SEQ ID NO: 106202 - DNA, 15 bp, Homo sapiens
ttgtttctgctgccc

SEQ ID NO: 106203 - DNA, 15 bp, Homo sapiens
tttgtttctgctgcc

SEQ ID NO: 106204 - DNA, 15 bp, Homo sapiens
atttgtttctgctgc

SEQ ID NO: 106205 - DNA, 15 bp, Homo sapiens
aatttgtttctgctg

SEQ ID NO: 106206 - DNA, 15 bp, Homo sapiens
caatttgtttctgct

SEQ ID NO: 106207 - DNA, 15 bp, Homo sapiens
acaatttgtttctgc

SEQ ID NO: 106208 - DNA, 15 bp, Homo sapiens
aacaatttgtttctg

SEQ ID NO: 106209 - DNA, 15 bp, Homo sapiens
caacaatttgtttct

SEQ ID NO: 106210 - DNA, 15 bp, Homo sapiens
gcaacaatttgtttc

SEQ ID NO: 106211 - DNA, 15 bp, Homo sapiens
tgcaacaatttgttt

SEQ ID NO: 106212 - DNA, 15 bp, Homo sapiens
atgcaacaatttgtt

SEQ ID NO: 106213 - DNA, 15 bp, Homo sapiens
catgcaacaatttgt

SEQ ID NO: 106214 - DNA, 15 bp, Homo sapiens
acatgcaacaatttg

SEQ ID NO: 106215 - DNA, 15 bp, Homo sapiens
cacatgcaacaattt

SEQ ID NO: 106216 - DNA, 15 bp, Homo sapiens
acacatgcaacaatt

SEQ ID NO: 106217 - DNA, 15 bp, Homo sapiens
cacacatgcaacaat

SEQ ID NO: 106218 - DNA, 15 bp, Homo sapiens
ccacacatgcaacaa

SEQ ID NO: 106219 - DNA, 15 bp, Homo sapiens
tccacacatgcaaca

SEQ ID NO: 106220 - DNA, 15 bp, Homo sapiens
ttccacacatgcaac

SEQ ID NO: 106221 - DNA, 15 bp, Homo sapiens
tttccacacatgcaa

SEQ ID NO: 106222 - DNA, 15 bp, Homo sapiens
ttttccacacatgca

SEQ ID NO: 106223 - DNA, 15 bp, Homo sapiens
tttttccacacatgc

SEQ ID NO: 106224 - DNA, 15 bp, Homo sapiens
atttttccacacatg

SEQ ID NO: 106225 - DNA, 15 bp, Homo sapiens
tatttttccacacat

SEQ ID NO: 106226 - DNA, 15 bp, Homo sapiens
atatttttccacaca

SEQ ID NO: 106227 - DNA, 15 bp, Homo sapiens
catatttttccacac

SEQ ID NO: 106228 - DNA, 15 bp, Homo sapiens
tcatatttttccaca

SEQ ID NO: 106229 - DNA, 15 bp, Homo sapiens
ttcatatttttccac

SEQ ID NO: 106230 - DNA, 15 bp, Homo sapiens
tttcatatttttcca

SEQ ID NO: 106231 - DNA, 15 bp, Homo sapiens
atttcatatttttcc

SEQ ID NO: 106232 - DNA, 15 bp, Homo sapiens
gatttcatatttttc

SEQ ID NO: 106233 - DNA, 15 bp, Homo sapiens
agatttcatattttt

SEQ ID NO: 106234 - DNA, 15 bp, Homo sapiens
cagatttcatatttt

SEQ ID NO: 106235 - DNA, 15 bp, Homo sapiens
tcagatttcatattt

SEQ ID NO: 106236 - DNA, 15 bp, Homo sapiens
atcagatttcatatt

SEQ ID NO: 106237 - DNA, 15 bp, Homo sapiens
aatcagatttcatat

SEQ ID NO: 106238 - DNA, 15 bp, Homo sapiens
aaatcagatttcata

SEQ ID NO: 106239 - DNA, 15 bp, Homo sapiens
aaaatcagatttcat

SEQ ID NO: 106240 - DNA, 15 bp, Homo sapiens
caaaatcagatttca

SEQ ID NO: 106241 - DNA, 15 bp, Homo sapiens
tcaaaatcagatttc

SEQ ID NO: 106242 - DNA, 15 bp, Homo sapiens
atcaaaatcagattt

SEQ ID NO: 106243 - DNA, 15 bp, Homo sapiens
tatcaaaatcagatt

SEQ ID NO: 106244 - DNA, 15 bp, Homo sapiens
ctatcaaaatcagat

SEQ ID NO: 106245 - DNA, 15 bp, Homo sapiens
gctatcaaaatcaga

SEQ ID NO: 106246 - DNA, 15 bp, Homo sapiens
agctatcaaaatcag

SEQ ID NO: 106247 - DNA, 15 bp, Homo sapiens
cagctatcaaaatca

SEQ ID NO: 106248 - DNA, 15 bp, Homo sapiens
tcagctatcaaaatc

SEQ ID NO: 106249 - DNA, 15 bp, Homo sapiens
ctcagctatcaaaat

SEQ ID NO: 106250 - DNA, 15 bp, Homo sapiens
tctcagctatcaaaa

SEQ ID NO: 106251 - DNA, 15 bp, Homo sapiens
atctcagctatcaaa

SEQ ID NO: 106252 - DNA, 15 bp, Homo sapiens
catctcagctatcaa

SEQ ID NO: 106253 - DNA, 15 bp, Homo sapiens
tcatctcagctatca

SEQ ID NO: 106254 - DNA, 15 bp, Homo sapiens
ctcatctcagctatc

SEQ ID NO: 106255 - DNA, 15 bp, Homo sapiens
tctcatctcagctat

SEQ ID NO: 106256 - DNA, 15 bp, Homo sapiens
ttctcatctcagcta

SEQ ID NO: 106257 - DNA, 15 bp, Homo sapiens
tttctcatctcagct

SEQ ID NO: 106258 - DNA, 15 bp, Homo sapiens
gtttctcatctcagc

SEQ ID NO: 106259 - DNA, 15 bp, Homo sapiens
tgtttctcatctcag

SEQ ID NO: 106260 - DNA, 15 bp, Homo sapiens
ttgtttctcatctca

SEQ ID NO: 106261 - DNA, 15 bp, Homo sapiens
cttgtttctcatctc

SEQ ID NO: 106262 - DNA, 15 bp, Homo sapiens
tcttgtttctcatct

SEQ ID NO: 106263 - DNA, 15 bp, Homo sapiens
ctcttgtttctcatc

SEQ ID NO: 106264 - DNA, 15 bp, Homo sapiens
tctcttgtttctcat

SEQ ID NO: 106265 - DNA, 15 bp, Homo sapiens
ctctcttgtttctca

SEQ ID NO: 106266 - DNA, 15 bp, Homo sapiens
actctcttgtttctc

SEQ ID NO: 106267 - DNA, 15 bp, Homo sapiens
cactctcttgtttct

SEQ ID NO: 106268 - DNA, 15 bp, Homo sapiens
tcactctcttgtttc

SEQ ID NO: 106269 - DNA, 15 bp, Homo sapiens
ctcactctcttgttt

SEQ ID NO: 106270 - DNA, 15 bp, Homo sapiens
gctcactctcttgtt

SEQ ID NO: 106271 - DNA, 15 bp, Homo sapiens
ggctcactctcttgt

SEQ ID NO: 106272 - DNA, 15 bp, Homo sapiens
tggctcactctcttg

SEQ ID NO: 106273 - DNA, 15 bp, Homo sapiens
ctggctcactctctt

SEQ ID NO: 106274 - DNA, 15 bp, Homo sapiens
tctggctcactctct

SEQ ID NO: 106275 - DNA, 15 bp, Homo sapiens
atctggctcactctc

SEQ ID NO: 106276 - DNA, 15 bp, Homo sapiens
aatctggctcactct

SEQ ID NO: 106277 - DNA, 15 bp, Homo sapiens
aaatctggctcactc

SEQ ID NO: 106278 - DNA, 15 bp, Homo sapiens
taaatctggctcact

SEQ ID NO: 106279 - DNA, 15 bp, Homo sapiens
ctaaatctggctcac

SEQ ID NO: 106280 - DNA, 15 bp, Homo sapiens
tctaaatctggctca

SEQ ID NO: 106281 - DNA, 15 bp, Homo sapiens
ttctaaatctggctc

SEQ ID NO: 106282 - DNA, 15 bp, Homo sapiens
cttctaaatctggct

SEQ ID NO: 106283 - DNA, 15 bp, Homo sapiens
acttctaaatctggc

SEQ ID NO: 106284 - DNA, 15 bp, Homo sapiens
aacttctaaatctgg

SEQ ID NO: 106285 - DNA, 15 bp, Homo sapiens
taacttctaaatctg

SEQ ID NO: 106286 - DNA, 15 bp, Homo sapiens
ctaacttctaaatct

SEQ ID NO: 106287 - DNA, 15 bp, Homo sapiens
gctaacttctaaatc

SEQ ID NO: 106288 - DNA, 15 bp, Homo sapiens
agctaacttctaaat

SEQ ID NO: 106289 - DNA, 15 bp, Homo sapiens
aagctaacttctaaa

SEQ ID NO: 106290 - DNA, 15 bp, Homo sapiens
aaagctaacttctaa

SEQ ID NO: 106291 - DNA, 15 bp, Homo sapiens
taaagctaacttcta

SEQ ID NO: 106292 - DNA, 15 bp, Homo sapiens
ataaagctaacttct

SEQ ID NO: 106293 - DNA, 15 bp, Homo sapiens
tataaagctaacttc

SEQ ID NO: 106294 - DNA, 15 bp, Homo sapiens
atataaagctaactt

SEQ ID NO: 106295 - DNA, 15 bp, Homo sapiens
tatataaagctaact

SEQ ID NO: 106296 - DNA, 15 bp, Homo sapiens
gtatataaagctaac

SEQ ID NO: 106297 - DNA, 15 bp, Homo sapiens
tgtatataaagctaa

SEQ ID NO: 106298 - DNA, 15 bp, Homo sapiens
gtgtatataaagcta

SEQ ID NO: 106299 - DNA, 15 bp, Homo sapiens
agtgtatataaagct

SEQ ID NO: 106300 - DNA, 15 bp, Homo sapiens
aagtgtatataaagc

SEQ ID NO: 106301 - DNA, 15 bp, Homo sapiens
aaagtgtatataaag

SEQ ID NO: 106302 - DNA, 15 bp, Homo sapiens
aaaagtgtatataaa

SEQ ID NO: 106303 - DNA, 15 bp, Homo sapiens
aaaaagtgtatataa

SEQ ID NO: 106304 - DNA, 15 bp, Homo sapiens
gaaaaagtgtatata

SEQ ID NO: 106305 - DNA, 15 bp, Homo sapiens
agaaaaagtgtatat

SEQ ID NO: 106306 - DNA, 15 bp, Homo sapiens
aagaaaaagtgtata

SEQ ID NO: 106307 - DNA, 15 bp, Homo sapiens
aaagaaaaagtgtat

SEQ ID NO: 106308 - DNA, 15 bp, Homo sapiens
taaagaaaaagtgta

SEQ ID NO: 106309 - DNA, 15 bp, Homo sapiens
ttaaagaaaaagtgt

SEQ ID NO: 106310 - DNA, 15 bp, Homo sapiens
attaaagaaaaagtg

SEQ ID NO: 106311 - DNA, 15 bp, Homo sapiens
cattaaagaaaaagt

SEQ ID NO: 106312 - DNA, 15 bp, Homo sapiens
gcattaaagaaaaag

SEQ ID NO: 106313 - DNA, 15 bp, Homo sapiens
tgcattaaagaaaaa

SEQ ID NO: 106314 - DNA, 15 bp, Homo sapiens
ctgcattaaagaaaa

SEQ ID NO: 106315 - DNA, 15 bp, Homo sapiens
tctgcattaaagaaa

SEQ ID NO: 106316 - DNA, 15 bp, Homo sapiens
ctctgcattaaagaa

SEQ ID NO: 106317 - DNA, 15 bp, Homo sapiens
gctctgcattaaaga

SEQ ID NO: 106318 - DNA, 15 bp, Homo sapiens
ggctctgcattaaag

SEQ ID NO: 106319 - DNA, 15 bp, Homo sapiens
aggctctgcattaaa

SEQ ID NO: 106320 - DNA, 15 bp, Homo sapiens
gaggctctgcattaa

SEQ ID NO: 106321 - DNA, 15 bp, Homo sapiens
agaggctctgcatta

SEQ ID NO: 106322 - DNA, 15 bp, Homo sapiens
cagaggctctgcatt

SEQ ID NO: 106323 - DNA, 15 bp, Homo sapiens
acagaggctctgcat

SEQ ID NO: 106324 - DNA, 15 bp, Homo sapiens
gacagaggctctgca

SEQ ID NO: 106325 - DNA, 15 bp, Homo sapiens
tgacagaggctctgc

SEQ ID NO: 106326 - DNA, 15 bp, Homo sapiens
ctgacagaggctctg

SEQ ID NO: 106327 - DNA, 15 bp, Homo sapiens
actgacagaggctct

SEQ ID NO: 106328 - DNA, 15 bp, Homo sapiens
tactgacagaggctc

SEQ ID NO: 106329 - DNA, 15 bp, Homo sapiens
atactgacagaggct

SEQ ID NO: 106330 - DNA, 15 bp, Homo sapiens
gatactgacagaggc

SEQ ID NO: 106331 - DNA, 15 bp, Homo sapiens
cgatactgacagagg

SEQ ID NO: 106332 - DNA, 15 bp, Homo sapiens
acgatactgacagag

SEQ ID NO: 106333 - DNA, 15 bp, Homo sapiens
cacgatactgacaga

SEQ ID NO: 106334 - DNA, 15 bp, Homo sapiens
acacgatactgacag

SEQ ID NO: 106335 - DNA, 15 bp, Homo sapiens
cacacgatactgaca

SEQ ID NO: 106336 - DNA, 15 bp, Homo sapiens
ccacacgatactgac

SEQ ID NO: 106337 - DNA, 15 bp, Homo sapiens
gccacacgatactga

SEQ ID NO: 106338 - DNA, 15 bp, Homo sapiens
agccacacgatactg

SEQ ID NO: 106339 - DNA, 15 bp, Homo sapiens
cagccacacgatact

SEQ ID NO: 106340 - DNA, 15 bp, Homo sapiens
tcagccacacgatac

SEQ ID NO: 106341 - DNA, 15 bp, Homo sapiens
atcagccacacgata

SEQ ID NO: 106342 - DNA, 15 bp, Homo sapiens
catcagccacacgat

SEQ ID NO: 106343 - DNA, 15 bp, Homo sapiens
gcatcagccacacga

SEQ ID NO: 106344 - DNA, 15 bp, Homo sapiens
agcatcagccacacg

SEQ ID NO: 106345 - DNA, 15 bp, Homo sapiens
cagcatcagccacac

SEQ ID NO: 106346 - DNA, 15 bp, Homo sapiens
acagcatcagccaca

SEQ ID NO: 106347 - DNA, 15 bp, Homo sapiens
cacagcatcagccac

SEQ ID NO: 106348 - DNA, 15 bp, Homo sapiens
ccacagcatcagcca

SEQ ID NO: 106349 - DNA, 15 bp, Homo sapiens
cccacagcatcagcc

SEQ ID NO: 106350 - DNA, 15 bp, Homo sapiens
gcccacagcatcagc

SEQ ID NO: 106351 - DNA, 15 bp, Homo sapiens
tgcccacagcatcag

SEQ ID NO: 106352 - DNA, 15 bp, Homo sapiens
ctgcccacagcatca

SEQ ID NO: 106353 - DNA, 15 bp, Homo sapiens
cctgcccacagcatc

SEQ ID NO: 106354 - DNA, 15 bp, Homo sapiens
gcctgcccacagcat

SEQ ID NO: 106355 - DNA, 15 bp, Homo sapiens
ggcctgcccacagca

SEQ ID NO: 106356 - DNA, 15 bp, Homo sapiens
cggcctgcccacagc

SEQ ID NO: 106357 - DNA, 15 bp, Homo sapiens
tcggcctgcccacag

SEQ ID NO: 106358 - DNA, 15 bp, Homo sapiens
ctcggcctgcccaca

SEQ ID NO: 106359 - DNA, 15 bp, Homo sapiens
gctcggcctgcccac

SEQ ID NO: 106360 - DNA, 15 bp, Homo sapiens
tgctcggcctgccca

SEQ ID NO: 106361 - DNA, 15 bp, Homo sapiens
atgctcggcctgccc

SEQ ID NO: 106362 - DNA, 15 bp, Homo sapiens
catgctcggcctgcc

SEQ ID NO: 106363 - DNA, 15 bp, Homo sapiens
tcatgctcggcctgc

SEQ ID NO: 106364 - DNA, 15 bp, Homo sapiens
ttcatgctcggcctg

SEQ ID NO: 106365 - DNA, 15 bp, Homo sapiens
attcatgctcggcct

SEQ ID NO: 106366 - DNA, 15 bp, Homo sapiens
aattcatgctcggcc

SEQ ID NO: 106367 - DNA, 15 bp, Homo sapiens
caattcatgctcggc

SEQ ID NO: 106368 - DNA, 15 bp, Homo sapiens
ccaattcatgctcgg

SEQ ID NO: 106369 - DNA, 15 bp, Homo sapiens
tccaattcatgctcg

SEQ ID NO: 106370 - DNA, 15 bp, Homo sapiens
atccaattcatgctc

SEQ ID NO: 106371 - DNA, 15 bp, Homo sapiens
catccaattcatgct

SEQ ID NO: 106372 - DNA, 15 bp, Homo sapiens
gcatccaattcatgc

SEQ ID NO: 106373 - DNA, 15 bp, Homo sapiens
tgcatccaattcatg

SEQ ID NO: 106374 - DNA, 15 bp, Homo sapiens
ctgcatccaattcat

SEQ ID NO: 106375 - DNA, 15 bp, Homo sapiens
gctgcatccaattca

SEQ ID NO: 106376 - DNA, 15 bp, Homo sapiens
tgctgcatccaattc

SEQ ID NO: 106377 - DNA, 15 bp, Homo sapiens
atgctgcatccaatt

SEQ ID NO: 106378 - DNA, 15 bp, Homo sapiens
gatgctgcatccaat

SEQ ID NO: 106379 - DNA, 15 bp, Homo sapiens
tgatgctgcatccaa

SEQ ID NO: 106380 - DNA, 15 bp, Homo sapiens
atgatgctgcatcca

SEQ ID NO: 106381 - DNA, 15 bp, Homo sapiens
aatgatgctgcatcc

SEQ ID NO: 106382 - DNA, 15 bp, Homo sapiens
aaatgatgctgcatc

SEQ ID NO: 106383 - DNA, 15 bp, Homo sapiens
taaatgatgctgcat

SEQ ID NO: 106384 - DNA, 15 bp, Homo sapiens
ctaaatgatgctgca

SEQ ID NO: 106385 - DNA, 15 bp, Homo sapiens
actaaatgatgctgc

SEQ ID NO: 106386 - DNA, 15 bp, Homo sapiens
aactaaatgatgctg

SEQ ID NO: 106387 - DNA, 15 bp, Homo sapiens
gaactaaatgatgct

SEQ ID NO: 106388 - DNA, 15 bp, Homo sapiens
agaactaaatgatgc

SEQ ID NO: 106389 - DNA, 15 bp, Homo sapiens
aagaactaaatgatg

SEQ ID NO: 106390 - DNA, 15 bp, Homo sapiens
aaagaactaaatgat

SEQ ID NO: 106391 - DNA, 15 bp, Homo sapiens
gaaagaactaaatga

SEQ ID NO: 106392 - DNA, 15 bp, Homo sapiens
tgaaagaactaaatg

SEQ ID NO: 106393 - DNA, 15 bp, Homo sapiens
atgaaagaactaaat

SEQ ID NO: 106394 - DNA, 15 bp, Homo sapiens
catgaaagaactaaa

SEQ ID NO: 106395 - DNA, 15 bp, Homo sapiens
ccatgaaagaactaa

SEQ ID NO: 106396 - DNA, 15 bp, Homo sapiens
accatgaaagaacta

SEQ ID NO: 106397 - DNA, 15 bp, Homo sapiens
aaccatgaaagaact

SEQ ID NO: 106398 - DNA, 15 bp, Homo sapiens
caaccatgaaagaac

SEQ ID NO: 106399 - DNA, 15 bp, Homo sapiens
tcaaccatgaaagaa

SEQ ID NO: 106400 - DNA, 15 bp, Homo sapiens
atcaaccatgaaaga

SEQ ID NO: 106401 - DNA, 15 bp, Homo sapiens
tatcaaccatgaaag

SEQ ID NO: 106402 - DNA, 15 bp, Homo sapiens
atatcaaccatgaaa

SEQ ID NO: 106403 - DNA, 15 bp, Homo sapiens
catatcaaccatgaa

SEQ ID NO: 106404 - DNA, 15 bp, Homo sapiens
tcatatcaaccatga

SEQ ID NO: 106405 - DNA, 15 bp, Homo sapiens
gtcatatcaaccatg

SEQ ID NO: 106406 - DNA, 15 bp, Homo sapiens
tgtcatatcaaccat

SEQ ID NO: 106407 - DNA, 15 bp, Homo sapiens
atgtcatatcaacca

SEQ ID NO: 106408 - DNA, 15 bp, Homo sapiens
aatgtcatatcaacc

SEQ ID NO: 106409 - DNA, 15 bp, Homo sapiens
caatgtcatatcaac

SEQ ID NO: 106410 - DNA, 15 bp, Homo sapiens
tcaatgtcatatcaa

SEQ ID NO: 106411 - DNA, 15 bp, Homo sapiens
gtcaatgtcatatca

SEQ ID NO: 106412 - DNA, 15 bp, Homo sapiens
agtcaatgtcatatc

SEQ ID NO: 106413 - DNA, 15 bp, Homo sapiens
aagtcaatgtcatat

SEQ ID NO: 106414 - DNA, 15 bp, Homo sapiens
aaagtcaatgtcata

SEQ ID NO: 106415 - DNA, 15 bp, Homo sapiens
gaaagtcaatgtcat

SEQ ID NO: 106416 - DNA, 15 bp, Homo sapiens
tgaaagtcaatgtca

SEQ ID NO: 106417 - DNA, 15 bp, Homo sapiens
gtgaaagtcaatgtc

SEQ ID NO: 106418 - DNA, 15 bp, Homo sapiens
agtgaaagtcaatgt

SEQ ID NO: 106419 - DNA, 15 bp, Homo sapiens
gagtgaaagtcaatg

SEQ ID NO: 106420 - DNA, 15 bp, Homo sapiens
agagtgaaagtcaat

SEQ ID NO: 106421 - DNA, 15 bp, Homo sapiens
cagagtgaaagtcaa

SEQ ID NO: 106422 - DNA, 15 bp, Homo sapiens
tcagagtgaaagtca

SEQ ID NO: 106423 - DNA, 15 bp, Homo sapiens
ttcagagtgaaagtc

SEQ ID NO: 106424 - DNA, 15 bp, Homo sapiens
gttcagagtgaaagt

SEQ ID NO: 106425 - DNA, 15 bp, Homo sapiens
agttcagagtgaaag

SEQ ID NO: 106426 - DNA, 15 bp, Homo sapiens
aagttcagagtgaaa

SEQ ID NO: 106427 - DNA, 15 bp, Homo sapiens
caagttcagagtgaa

SEQ ID NO: 106428 - DNA, 15 bp, Homo sapiens
acaagttcagagtga

SEQ ID NO: 106429 - DNA, 15 bp, Homo sapiens
cacaagttcagagtg

SEQ ID NO: 106430 - DNA, 15 bp, Homo sapiens
tcacaagttcagagt

SEQ ID NO: 106431 - DNA, 15 bp, Homo sapiens
atcacaagttcagag

SEQ ID NO: 106432 - DNA, 15 bp, Homo sapiens
catcacaagttcaga

SEQ ID NO: 106433 - DNA, 15 bp, Homo sapiens
tcatcacaagttcag

SEQ ID NO: 106434 - DNA, 15 bp, Homo sapiens
ttcatcacaagttca

SEQ ID NO: 106435 - DNA, 15 bp, Homo sapiens
cttcatcacaagttc

SEQ ID NO: 106436 - DNA, 15 bp, Homo sapiens
ccttcatcacaagtt

SEQ ID NO: 106437 - DNA, 15 bp, Homo sapiens
cccttcatcacaagt

SEQ ID NO: 106438 - DNA, 15 bp, Homo sapiens
gcccttcatcacaag

SEQ ID NO: 106439 - DNA, 15 bp, Homo sapiens
tgcccttcatcacaa

SEQ ID NO: 106440 - DNA, 15 bp, Homo sapiens
atgcccttcatcaca

SEQ ID NO: 106441 - DNA, 15 bp, Homo sapiens
aatgcccttcatcac

SEQ ID NO: 106442 - DNA, 15 bp, Homo sapiens
aaatgcccttcatca

SEQ ID NO: 106443 - DNA, 15 bp, Homo sapiens
aaaatgcccttcatc

SEQ ID NO: 106444 - DNA, 15 bp, Homo sapiens
caaaatgcccttcat

SEQ ID NO: 106445 - DNA, 15 bp, Homo sapiens
tcaaaatgcccttca

SEQ ID NO: 106446 - DNA, 15 bp, Homo sapiens
ctcaaaatgcccttc

SEQ ID NO: 106447 - DNA, 15 bp, Homo sapiens
actcaaaatgccctt

SEQ ID NO: 106448 - DNA, 15 bp, Homo sapiens
aactcaaaatgccct

SEQ ID NO: 106449 - DNA, 15 bp, Homo sapiens
gaactcaaaatgccc

SEQ ID NO: 106450 - DNA, 15 bp, Homo sapiens
agaactcaaaatgcc

SEQ ID NO: 106451 - DNA, 15 bp, Homo sapiens
tagaactcaaaatgc

SEQ ID NO: 106452 - DNA, 15 bp, Homo sapiens
ctagaactcaaaatg

SEQ ID NO: 106453 - DNA, 15 bp, Homo sapiens
cctagaactcaaaat

SEQ ID NO: 106454 - DNA, 15 bp, Homo sapiens
acctagaactcaaaa

SEQ ID NO: 106455 - DNA, 15 bp, Homo sapiens
aacctagaactcaaa

SEQ ID NO: 106456 - DNA, 15 bp, Homo sapiens
gaacctagaactcaa

SEQ ID NO: 106457 - DNA, 15 bp, Homo sapiens
ggaacctagaactca

SEQ ID NO: 106458 - DNA, 15 bp, Homo sapiens
aggaacctagaactc

SEQ ID NO: 106459 - DNA, 15 bp, Homo sapiens
caggaacctagaact

SEQ ID NO: 106460 - DNA, 15 bp, Homo sapiens
tcaggaacctagaac

SEQ ID NO: 106461 - DNA, 15 bp, Homo sapiens
ttcaggaacctagaa

SEQ ID NO: 106462 - DNA, 15 bp, Homo sapiens
gttcaggaacctaga

SEQ ID NO: 106463 - DNA, 15 bp, Homo sapiens
agttcaggaacctag

SEQ ID NO: 106464 - DNA, 15 bp, Homo sapiens
tagttcaggaaccta

SEQ ID NO: 106465 - DNA, 15 bp, Homo sapiens
atagttcaggaacct

SEQ ID NO: 106466 - DNA, 15 bp, Homo sapiens
gatagttcaggaacc

SEQ ID NO: 106467 - DNA, 15 bp, Homo sapiens
agatagttcaggaac

SEQ ID NO: 106468 - DNA, 15 bp, Homo sapiens
aagatagttcaggaa

SEQ ID NO: 106469 - DNA, 15 bp, Homo sapiens
aaagatagttcagga

SEQ ID NO: 106470 - DNA, 15 bp, Homo sapiens
aaaagatagttcagg

SEQ ID NO: 106471 - DNA, 15 bp, Homo sapiens
aaaaagatagttcag

SEQ ID NO: 106472 - DNA, 15 bp, Homo sapiens
caaaaagatagttca

SEQ ID NO: 106473 - DNA, 15 bp, Homo sapiens
tcaaaaagatagttc

SEQ ID NO: 106474 - DNA, 15 bp, Homo sapiens
ttcaaaaagatagtt

SEQ ID NO: 106475 - DNA, 15 bp, Homo sapiens
gttcaaaaagatagt

SEQ ID NO: 106476 - DNA, 15 bp, Homo sapiens
tgttcaaaaagatag

SEQ ID NO: 106477 - DNA, 15 bp, Homo sapiens
atgttcaaaaagata

SEQ ID NO: 106478 - DNA, 15 bp, Homo sapiens
catgttcaaaaagat

SEQ ID NO: 106479 - DNA, 15 bp, Homo sapiens
tcatgttcaaaaaga

SEQ ID NO: 106480 - DNA, 15 bp, Homo sapiens
ttcatgttcaaaaag

SEQ ID NO: 106481 - DNA, 15 bp, Homo sapiens
cttcatgttcaaaaa

SEQ ID NO: 106482 - DNA, 15 bp, Homo sapiens
acttcatgttcaaaa

SEQ ID NO: 106483 - DNA, 15 bp, Homo sapiens
aacttcatgttcaaa

SEQ ID NO: 106484 - DNA, 15 bp, Homo sapiens
aaacttcatgttcaa

SEQ ID NO: 106485 - DNA, 15 bp, Homo sapiens
aaaacttcatgttca

SEQ ID NO: 106486 - DNA, 15 bp, Homo sapiens
taaaacttcatgttc

SEQ ID NO: 106487 - DNA, 15 bp, Homo sapiens
ttaaaacttcatgtt

SEQ ID NO: 106488 - DNA, 15 bp, Homo sapiens
attaaaacttcatgt

SEQ ID NO: 106489 - DNA, 15 bp, Homo sapiens
aattaaaacttcatg

SEQ ID NO: 106490 - DNA, 15 bp, Homo sapiens
gaattaaaacttcat

SEQ ID NO: 106491 - DNA, 15 bp, Homo sapiens
ggaattaaaacttca

SEQ ID NO: 106492 - DNA, 15 bp, Homo sapiens
tggaattaaaacttc

SEQ ID NO: 106493 - DNA, 15 bp, Homo sapiens
ctggaattaaaactt

SEQ ID NO: 106494 - DNA, 15 bp, Homo sapiens
actggaattaaaact

SEQ ID NO: 106495 - DNA, 15 bp, Homo sapiens
cactggaattaaaac

SEQ ID NO: 106496 - DNA, 15 bp, Homo sapiens
tcactggaattaaaa

SEQ ID NO: 106497 - DNA, 15 bp, Homo sapiens
ctcactggaattaaa

SEQ ID NO: 106498 - DNA, 15 bp, Homo sapiens
cctcactggaattaa

SEQ ID NO: 106499 - DNA, 15 bp, Homo sapiens
acctcactggaatta

SEQ ID NO: 106500 - DNA, 15 bp, Homo sapiens
gacctcactggaatt

SEQ ID NO: 106501 - DNA, 15 bp, Homo sapiens
tgacctcactggaat

SEQ ID NO: 106502 - DNA, 15 bp, Homo sapiens
ctgacctcactggaa

SEQ ID NO: 106503 - DNA, 15 bp, Homo sapiens
gctgacctcactgga

SEQ ID NO: 106504 - DNA, 15 bp, Homo sapiens
agctgacctcactgg

SEQ ID NO: 106505 - DNA, 15 bp, Homo sapiens
aagctgacctcactg

SEQ ID NO: 106506 - DNA, 15 bp, Homo sapiens
aaagctgacctcact

SEQ ID NO: 106507 - DNA, 15 bp, Homo sapiens
taaagctgacctcac

SEQ ID NO: 106508 - DNA, 15 bp, Homo sapiens
ataaagctgacctca

SEQ ID NO: 106509 - DNA, 15 bp, Homo sapiens
gataaagctgacctc

SEQ ID NO: 106510 - DNA, 15 bp, Homo sapiens
agataaagctgacct

SEQ ID NO: 106511 - DNA, 15 bp, Homo sapiens
tagataaagctgacc

SEQ ID NO: 106512 - DNA, 15 bp, Homo sapiens
ttagataaagctgac

SEQ ID NO: 106513 - DNA, 15 bp, Homo sapiens
tttagataaagctga

SEQ ID NO: 106514 - DNA, 15 bp, Homo sapiens
atttagataaagctg

SEQ ID NO: 106515 - DNA, 15 bp, Homo sapiens
aatttagataaagct

SEQ ID NO: 106516 - DNA, 15 bp, Homo sapiens
aaatttagataaagc

SEQ ID NO: 106517 - DNA, 15 bp, Homo sapiens
gaaatttagataaag

SEQ ID NO: 106518 - DNA, 15 bp, Homo sapiens
agaaatttagataaa

SEQ ID NO: 106519 - DNA, 15 bp, Homo sapiens
aagaaatttagataa

SEQ ID NO: 106520 - DNA, 15 bp, Homo sapiens
taagaaatttagata

SEQ ID NO: 106521 - DNA, 15 bp, Homo sapiens
ataagaaatttagat

SEQ ID NO: 106522 - DNA, 15 bp, Homo sapiens
gataagaaatttaga

SEQ ID NO: 106523 - DNA, 15 bp, Homo sapiens
ggataagaaatttag

SEQ ID NO: 106524 - DNA, 15 bp, Homo sapiens
tggataagaaattta

SEQ ID NO: 106525 - DNA, 15 bp, Homo sapiens
ttggataagaaattt

SEQ ID NO: 106526 - DNA, 15 bp, Homo sapiens
tttggataagaaatt

SEQ ID NO: 106527 - DNA, 15 bp, Homo sapiens
atttggataagaaat

SEQ ID NO: 106528 - DNA, 15 bp, Homo sapiens
gatttggataagaaa

SEQ ID NO: 106529 - DNA, 15 bp, Homo sapiens
agatttggataagaa

SEQ ID NO: 106530 - DNA, 15 bp, Homo sapiens
tagatttggataaga

SEQ ID NO: 106531 - DNA, 15 bp, Homo sapiens
atagatttggataag

SEQ ID NO: 106532 - DNA, 15 bp, Homo sapiens
aatagatttggataa

SEQ ID NO: 106533 - DNA, 15 bp, Homo sapiens
taatagatttggata

SEQ ID NO: 106534 - DNA, 15 bp, Homo sapiens
gtaatagatttggat

SEQ ID NO: 106535 - DNA, 15 bp, Homo sapiens
agtaatagatttgga

SEQ ID NO: 106536 - DNA, 15 bp, Homo sapiens
aagtaatagatttgg

SEQ ID NO: 106537 - DNA, 15 bp, Homo sapiens
gaagtaatagatttg

SEQ ID NO: 106538 - DNA, 15 bp, Homo sapiens
agaagtaatagattt

SEQ ID NO: 106539 - DNA, 15 bp, Homo sapiens
cagaagtaatagatt

SEQ ID NO: 106540 - DNA, 15 bp, Homo sapiens
tcagaagtaatagat

SEQ ID NO: 106541 - DNA, 15 bp, Homo sapiens
ctcagaagtaataga

SEQ ID NO: 106542 - DNA, 15 bp, Homo sapiens
tctcagaagtaatag

SEQ ID NO: 106543 - DNA, 15 bp, Homo sapiens
atctcagaagtaata

SEQ ID NO: 106544 - DNA, 15 bp, Homo sapiens
aatctcagaagtaat

SEQ ID NO: 106545 - DNA, 15 bp, Homo sapiens
caatctcagaagtaa

SEQ ID NO: 106546 - DNA, 15 bp, Homo sapiens
tcaatctcagaagta

SEQ ID NO: 106547 - DNA, 15 bp, Homo sapiens
ctcaatctcagaagt

SEQ ID NO: 106548 - DNA, 15 bp, Homo sapiens
tctcaatctcagaag

SEQ ID NO: 106549 - DNA, 15 bp, Homo sapiens
gtctcaatctcagaa

SEQ ID NO: 106550 - DNA, 15 bp, Homo sapiens
tgtctcaatctcaga

SEQ ID NO: 106551 - DNA, 15 bp, Homo sapiens
gtgtctcaatctcag

SEQ ID NO: 106552 - DNA, 15 bp, Homo sapiens
agtgtctcaatctca

SEQ ID NO: 106553 - DNA, 15 bp, Homo sapiens
cagtgtctcaatctc

SEQ ID NO: 106554 - DNA, 15 bp, Homo sapiens
tcagtgtctcaatct

SEQ ID NO: 106555 - DNA, 15 bp, Homo sapiens
ctcagtgtctcaatc

SEQ ID NO: 106556 - DNA, 15 bp, Homo sapiens
actcagtgtctcaat

SEQ ID NO: 106557 - DNA, 15 bp, Homo sapiens
cactcagtgtctcaa

SEQ ID NO: 106558 - DNA, 15 bp, Homo sapiens
acactcagtgtctca

SEQ ID NO: 106559 - DNA, 15 bp, Homo sapiens
aacactcagtgtctc

SEQ ID NO: 106560 - DNA, 15 bp, Homo sapiens
caacactcagtgtct

SEQ ID NO: 106561 - DNA, 15 bp, Homo sapiens
acaacactcagtgtc

SEQ ID NO: 106562 - DNA, 15 bp, Homo sapiens
tacaacactcagtgt

SEQ ID NO: 106563 - DNA, 15 bp, Homo sapiens
ttacaacactcagtg

SEQ ID NO: 106564 - DNA, 15 bp, Homo sapiens
attacaacactcagt

SEQ ID NO: 106565 - DNA, 15 bp, Homo sapiens
aattacaacactcag

SEQ ID NO: 106566 - DNA, 15 bp, Homo sapiens
aaattacaacactca

SEQ ID NO: 106567 - DNA, 15 bp, Homo sapiens
aaaattacaacactc

SEQ ID NO: 106568 - DNA, 15 bp, Homo sapiens
aaaaattacaacact

SEQ ID NO: 106569 - DNA, 15 bp, Homo sapiens
caaaaattacaacac

SEQ ID NO: 106570 - DNA, 15 bp, Homo sapiens
tcaaaaattacaaca

SEQ ID NO: 106571 - DNA, 15 bp, Homo sapiens
gtcaaaaattacaac

SEQ ID NO: 106572 - DNA, 15 bp, Homo sapiens
tgtcaaaaattacaa

SEQ ID NO: 106573 - DNA, 15 bp, Homo sapiens
gtgtcaaaaattaca

SEQ ID NO: 106574 - DNA, 15 bp, Homo sapiens
agtgtcaaaaattac

SEQ ID NO: 106575 - DNA, 15 bp, Homo sapiens
cagtgtcaaaaatta

SEQ ID NO: 106576 - DNA, 15 bp, Homo sapiens
ccagtgtcaaaaatt

SEQ ID NO: 106577 - DNA, 15 bp, Homo sapiens
cccagtgtcaaaaat

SEQ ID NO: 106578 - DNA, 15 bp, Homo sapiens
gcccagtgtcaaaaa

SEQ ID NO: 106579 - DNA, 15 bp, Homo sapiens
agcccagtgtcaaaa

SEQ ID NO: 106580 - DNA, 15 bp, Homo sapiens
tagcccagtgtcaaa

SEQ ID NO: 106581 - DNA, 15 bp, Homo sapiens
atagcccagtgtcaa

SEQ ID NO: 106582 - DNA, 15 bp, Homo sapiens
catagcccagtgtca

SEQ ID NO: 106583 - DNA, 15 bp, Homo sapiens
gcatagcccagtgtc

SEQ ID NO: 106584 - DNA, 15 bp, Homo sapiens
tgcatagcccagtgt

SEQ ID NO: 106585 - DNA, 15 bp, Homo sapiens
ctgcatagcccagtg

SEQ ID NO: 106586 - DNA, 15 bp, Homo sapiens
actgcatagcccagt

SEQ ID NO: 106587 - DNA, 15 bp, Homo sapiens
aactgcatagcccag

SEQ ID NO: 106588 - DNA, 15 bp, Homo sapiens
gaactgcatagccca

SEQ ID NO: 106589 - DNA, 15 bp, Homo sapiens
tgaactgcatagccc

SEQ ID NO: 106590 - DNA, 15 bp, Homo sapiens
gtgaactgcatagcc

SEQ ID NO: 106591 - DNA, 15 bp, Homo sapiens
agtgaactgcatagc

SEQ ID NO: 106592 - DNA, 15 bp, Homo sapiens
aagtgaactgcatag

SEQ ID NO: 106593 - DNA, 15 bp, Homo sapiens
taagtgaactgcata

SEQ ID NO: 106594 - DNA, 15 bp, Homo sapiens
ctaagtgaactgcat

SEQ ID NO: 106595 - DNA, 15 bp, Homo sapiens
cctaagtgaactgca

SEQ ID NO: 106596 - DNA, 15 bp, Homo sapiens
acctaagtgaactgc

SEQ ID NO: 106597 - DNA, 15 bp, Homo sapiens
cacctaagtgaactg

SEQ ID NO: 106598 - DNA, 15 bp, Homo sapiens
tcacctaagtgaact

SEQ ID NO: 106599 - DNA, 15 bp, Homo sapiens
atcacctaagtgaac

SEQ ID NO: 106600 - DNA, 15 bp, Homo sapiens
gatcacctaagtgaa

SEQ ID NO: 106601 - DNA, 15 bp, Homo sapiens
cgatcacctaagtga

SEQ ID NO: 106602 - DNA, 15 bp, Homo sapiens
ccgatcacctaagtg

SEQ ID NO: 106603 - DNA, 15 bp, Homo sapiens
cccgatcacctaagt

SEQ ID NO: 106604 - DNA, 15 bp, Homo sapiens
acccgatcacctaag

SEQ ID NO: 106605 - DNA, 15 bp, Homo sapiens
tacccgatcacctaa

SEQ ID NO: 106606 - DNA, 15 bp, Homo sapiens
gtacccgatcaccta

SEQ ID NO: 106607 - DNA, 15 bp, Homo sapiens
ggtacccgatcacct

SEQ ID NO: 106608 - DNA, 15 bp, Homo sapiens
gggtacccgatcacc

SEQ ID NO: 106609 - DNA, 15 bp, Homo sapiens
agggtacccgatcac

SEQ ID NO: 106610 - DNA, 15 bp, Homo sapiens
gagggtacccgatca

SEQ ID NO: 106611 - DNA, 15 bp, Homo sapiens
tgagggtacccgatc

SEQ ID NO: 106612 - DNA, 15 bp, Homo sapiens
gtgagggtacccgat

SEQ ID NO: 106613 - DNA, 15 bp, Homo sapiens
agtgagggtacccga

SEQ ID NO: 106614 - DNA, 15 bp, Homo sapiens
cagtgagggtacccg

SEQ ID NO: 106615 - DNA, 15 bp, Homo sapiens
tcagtgagggtaccc

SEQ ID NO: 106616 - DNA, 15 bp, Homo sapiens
ctcagtgagggtacc

SEQ ID NO: 106617 - DNA, 15 bp, Homo sapiens
tctcagtgagggtac

SEQ ID NO: 106618 - DNA, 15 bp, Homo sapiens
atctcagtgagggta

SEQ ID NO: 106619 - DNA, 15 bp, Homo sapiens
aatctcagtgagggt

SEQ ID NO: 106620 - DNA, 15 bp, Homo sapiens
gaatctcagtgaggg

SEQ ID NO: 106621 - DNA, 15 bp, Homo sapiens
tgaatctcagtgagg

SEQ ID NO: 106622 - DNA, 15 bp, Homo sapiens
atgaatctcagtgag

SEQ ID NO: 106623 - DNA, 15 bp, Homo sapiens
aatgaatctcagtga

SEQ ID NO: 106624 - DNA, 15 bp, Homo sapiens
taatgaatctcagtg

SEQ ID NO: 106625 - DNA, 15 bp, Homo sapiens
ctaatgaatctcagt

SEQ ID NO: 106626 - DNA, 15 bp, Homo sapiens
cctaatgaatctcag

SEQ ID NO: 106627 - DNA, 15 bp, Homo sapiens
tcctaatgaatctca

SEQ ID NO: 106628 - DNA, 15 bp, Homo sapiens
ctcctaatgaatctc

SEQ ID NO: 106629 - DNA, 15 bp, Homo sapiens
actcctaatgaatct

SEQ ID NO: 106630 - DNA, 15 bp, Homo sapiens
aactcctaatgaatc

SEQ ID NO: 106631 - DNA, 15 bp, Homo sapiens
aaactcctaatgaat

SEQ ID NO: 106632 - DNA, 15 bp, Homo sapiens
aaaactcctaatgaa

SEQ ID NO: 106633 - DNA, 15 bp, Homo sapiens
aaaaactcctaatga

SEQ ID NO: 106634 - DNA, 15 bp, Homo sapiens
aaaaaactcctaatg

SEQ ID NO: 106635 - DNA, 15 bp, Homo sapiens
taaaaaactcctaat

SEQ ID NO: 106636 - DNA, 15 bp, Homo sapiens
ataaaaaactcctaa

SEQ ID NO: 106637 - DNA, 15 bp, Homo sapiens
aataaaaaactccta

SEQ ID NO: 106638 - DNA, 15 bp, Homo sapiens
aaataaaaaactcct

SEQ ID NO: 106639 - DNA, 15 bp, Homo sapiens
aaaataaaaaactcc

SEQ ID NO: 106640 - DNA, 15 bp, Homo sapiens
caaaataaaaaactc

SEQ ID NO: 106641 - DNA, 15 bp, Homo sapiens
ccaaaataaaaaact

SEQ ID NO: 106642 - DNA, 15 bp, Homo sapiens
cccaaaataaaaaac

SEQ ID NO: 106643 - DNA, 15 bp, Homo sapiens
acccaaaataaaaaa

SEQ ID NO: 106644 - DNA, 15 bp, Homo sapiens
gacccaaaataaaaa

SEQ ID NO: 106645 - DNA, 15 bp, Homo sapiens
tgacccaaaataaaa

SEQ ID NO: 106646 - DNA, 15 bp, Homo sapiens
atgacccaaaataaa

SEQ ID NO: 106647 - DNA, 15 bp, Homo sapiens
tatgacccaaaataa

SEQ ID NO: 106648 - DNA, 15 bp, Homo sapiens
atatgacccaaaata

SEQ ID NO: 106649 - DNA, 15 bp, Homo sapiens
aatatgacccaaaat

SEQ ID NO: 106650 - DNA, 15 bp, Homo sapiens
aaatatgacccaaaa

SEQ ID NO: 106651 - DNA, 15 bp, Homo sapiens
gaaatatgacccaaa

SEQ ID NO: 106652 - DNA, 15 bp, Homo sapiens
agaaatatgacccaa

SEQ ID NO: 106653 - DNA, 15 bp, Homo sapiens
cagaaatatgaccca

SEQ ID NO: 106654 - DNA, 15 bp, Homo sapiens
tcagaaatatgaccc

SEQ ID NO: 106655 - DNA, 15 bp, Homo sapiens
ttcagaaatatgacc

SEQ ID NO: 106656 - DNA, 15 bp, Homo sapiens
attcagaaatatgac

SEQ ID NO: 106657 - DNA, 15 bp, Homo sapiens
aattcagaaatatga

SEQ ID NO: 106658 - DNA, 15 bp, Homo sapiens
aaattcagaaatatg

SEQ ID NO: 106659 - DNA, 15 bp, Homo sapiens
aaaattcagaaatat

SEQ ID NO: 106660 - DNA, 15 bp, Homo sapiens
aaaaattcagaaata

SEQ ID NO: 106661 - DNA, 15 bp, Homo sapiens
aaaaaattcagaaat

SEQ ID NO: 106662 - DNA, 15 bp, Homo sapiens
aaaaaaattcagaaa

SEQ ID NO: 106663 - DNA, 15 bp, Homo sapiens
gaaaaaaattcagaa

SEQ ID NO: 106664 - DNA, 15 bp, Homo sapiens
agaaaaaaattcaga

SEQ ID NO: 106665 - DNA, 15 bp, Homo sapiens
aagaaaaaaattcag

SEQ ID NO: 106666 - DNA, 15 bp, Homo sapiens
aaagaaaaaaattca

SEQ ID NO: 106667 - DNA, 15 bp, Homo sapiens
aaaagaaaaaaattc

SEQ ID NO: 106668 - DNA, 15 bp, Homo sapiens
caaaagaaaaaaatt

SEQ ID NO: 106669 - DNA, 15 bp, Homo sapiens
ccaaaagaaaaaaat

SEQ ID NO: 106670 - DNA, 15 bp, Homo sapiens
accaaaagaaaaaaa

SEQ ID NO: 106671 - DNA, 15 bp, Homo sapiens
taccaaaagaaaaaa

SEQ ID NO: 106672 - DNA, 15 bp, Homo sapiens
gtaccaaaagaaaaa

SEQ ID NO: 106673 - DNA, 15 bp, Homo sapiens
agtaccaaaagaaaa

SEQ ID NO: 106674 - DNA, 15 bp, Homo sapiens
aagtaccaaaagaaa

SEQ ID NO: 106675 - DNA, 15 bp, Homo sapiens
aaagtaccaaaagaa

SEQ ID NO: 106676 - DNA, 15 bp, Homo sapiens
taaagtaccaaaaga

SEQ ID NO: 106677 - DNA, 15 bp, Homo sapiens
ataaagtaccaaaag

SEQ ID NO: 106678 - DNA, 15 bp, Homo sapiens
cataaagtaccaaaa

SEQ ID NO: 106679 - DNA, 15 bp, Homo sapiens
ccataaagtaccaaa

SEQ ID NO: 106680 - DNA, 15 bp, Homo sapiens
accataaagtaccaa

SEQ ID NO: 106681 - DNA, 15 bp, Homo sapiens
taccataaagtacca

SEQ ID NO: 106682 - DNA, 15 bp, Homo sapiens
gtaccataaagtacc

SEQ ID NO: 106683 - DNA, 15 bp, Homo sapiens
tgtaccataaagtac

SEQ ID NO: 106684 - DNA, 15 bp, Homo sapiens
ttgtaccataaagta

SEQ ID NO: 106685 - DNA, 15 bp, Homo sapiens
tttgtaccataaagt

SEQ ID NO: 106686 - DNA, 15 bp, Homo sapiens
atttgtaccataaag

SEQ ID NO: 106687 - DNA, 15 bp, Homo sapiens
aatttgtaccataaa

SEQ ID NO: 106688 - DNA, 15 bp, Homo sapiens
aaatttgtaccataa

SEQ ID NO: 106689 - DNA, 15 bp, Homo sapiens
aaaatttgtaccata

SEQ ID NO: 106690 - DNA, 15 bp, Homo sapiens
aaaaatttgtaccat

SEQ ID NO: 106691 - DNA, 15 bp, Homo sapiens
taaaaatttgtacca

SEQ ID NO: 106692 - DNA, 15 bp, Homo sapiens
ctaaaaatttgtacc

SEQ ID NO: 106693 - DNA, 15 bp, Homo sapiens
actaaaaatttgtac

SEQ ID NO: 106694 - DNA, 15 bp, Homo sapiens
tactaaaaatttgta

SEQ ID NO: 106695 - DNA, 15 bp, Homo sapiens
ctactaaaaatttgt

SEQ ID NO: 106696 - DNA, 15 bp, Homo sapiens
actactaaaaatttg

SEQ ID NO: 106697 - DNA, 15 bp, Homo sapiens
tactactaaaaattt

SEQ ID NO: 106698 - DNA, 15 bp, Homo sapiens
atactactaaaaatt

SEQ ID NO: 106699 - DNA, 15 bp, Homo sapiens
gatactactaaaaat

SEQ ID NO: 106700 - DNA, 15 bp, Homo sapiens
agatactactaaaaa

SEQ ID NO: 106701 - DNA, 15 bp, Homo sapiens
cagatactactaaaa

SEQ ID NO: 106702 - DNA, 15 bp, Homo sapiens
acagatactactaaa

SEQ ID NO: 106703 - DNA, 15 bp, Homo sapiens
aacagatactactaa

SEQ ID NO: 106704 - DNA, 15 bp, Homo sapiens
taacagatactacta

SEQ ID NO: 106705 - DNA, 15 bp, Homo sapiens
ataacagatactact

SEQ ID NO: 106706 - DNA, 15 bp, Homo sapiens
cataacagatactac

SEQ ID NO: 106707 - DNA, 15 bp, Homo sapiens
gcataacagatacta

SEQ ID NO: 106708 - DNA, 15 bp, Homo sapiens
agcataacagatact

SEQ ID NO: 106709 - DNA, 15 bp, Homo sapiens
gagcataacagatac

SEQ ID NO: 106710 - DNA, 15 bp, Homo sapiens
tgagcataacagata

SEQ ID NO: 106711 - DNA, 15 bp, Homo sapiens
atgagcataacagat

SEQ ID NO: 106712 - DNA, 15 bp, Homo sapiens
catgagcataacaga

SEQ ID NO: 106713 - DNA, 15 bp, Homo sapiens
tcatgagcataacag

SEQ ID NO: 106714 - DNA, 15 bp, Homo sapiens
atcatgagcataaca

SEQ ID NO: 106715 - DNA, 15 bp, Homo sapiens
catcatgagcataac

SEQ ID NO: 106716 - DNA, 15 bp, Homo sapiens
tcatcatgagcataa

SEQ ID NO: 106717 - DNA, 15 bp, Homo sapiens
ctcatcatgagcata

SEQ ID NO: 106718 - DNA, 15 bp, Homo sapiens
tctcatcatgagcat

SEQ ID NO: 106719 - DNA, 15 bp, Homo sapiens
ctctcatcatgagca

SEQ ID NO: 106720 - DNA, 15 bp, Homo sapiens
tctctcatcatgagc

SEQ ID NO: 106721 - DNA, 15 bp, Homo sapiens
ctctctcatcatgag

SEQ ID NO: 106722 - DNA, 15 bp, Homo sapiens
tctctctcatcatga

SEQ ID NO: 106723 - DNA, 15 bp, Homo sapiens
atctctctcatcatg

SEQ ID NO: 106724 - DNA, 15 bp, Homo sapiens
tatctctctcatcat

SEQ ID NO: 106725 - DNA, 15 bp, Homo sapiens
ttatctctctcatca

SEQ ID NO: 106726 - DNA, 15 bp, Homo sapiens
attatctctctcatc

SEQ ID NO: 106727 - DNA, 15 bp, Homo sapiens
gattatctctctcat

SEQ ID NO: 106728 - DNA, 15 bp, Homo sapiens
tgattatctctctca

SEQ ID NO: 106729 - DNA, 15 bp, Homo sapiens
atgattatctctctc

SEQ ID NO: 106730 - DNA, 15 bp, Homo sapiens
gatgattatctctct

SEQ ID NO: 106731 - DNA, 15 bp, Homo sapiens
ggatgattatctctc

SEQ ID NO: 106732 - DNA, 15 bp, Homo sapiens
aggatgattatctct

SEQ ID NO: 106733 - DNA, 15 bp, Homo sapiens
caggatgattatctc

SEQ ID NO: 106734 - DNA, 15 bp, Homo sapiens
tcaggatgattatct

SEQ ID NO: 106735 - DNA, 15 bp, Homo sapiens
atcaggatgattatc

SEQ ID NO: 106736 - DNA, 15 bp, Homo sapiens
catcaggatgattat

SEQ ID NO: 106737 - DNA, 15 bp, Homo sapiens
ccatcaggatgatta

SEQ ID NO: 106738 - DNA, 15 bp, Homo sapiens
cccatcaggatgatt

SEQ ID NO: 106739 - DNA, 15 bp, Homo sapiens
tcccatcaggatgat

SEQ ID NO: 106740 - DNA, 15 bp, Homo sapiens
ttcccatcaggatga

SEQ ID NO: 106741 - DNA, 15 bp, Homo sapiens
attcccatcaggatg

SEQ ID NO: 106742 - DNA, 15 bp, Homo sapiens
aattcccatcaggat

SEQ ID NO: 106743 - DNA, 15 bp, Homo sapiens
caattcccatcagga

SEQ ID NO: 106744 - DNA, 15 bp, Homo sapiens
gcaattcccatcagg

SEQ ID NO: 106745 - DNA, 15 bp, Homo sapiens
tgcaattcccatcag

SEQ ID NO: 106746 - DNA, 15 bp, Homo sapiens
atgcaattcccatca

SEQ ID NO: 106747 - DNA, 15 bp, Homo sapiens
tatgcaattcccatc

SEQ ID NO: 106748 - DNA, 15 bp, Homo sapiens
atatgcaattcccat

SEQ ID NO: 106749 - DNA, 15 bp, Homo sapiens
aatatgcaattccca

SEQ ID NO: 106750 - DNA, 15 bp, Homo sapiens
aaatatgcaattccc

SEQ ID NO: 106751 - DNA, 15 bp, Homo sapiens
aaaatatgcaattcc

SEQ ID NO: 106752 - DNA, 15 bp, Homo sapiens
gaaaatatgcaattc

SEQ ID NO: 106753 - DNA, 15 bp, Homo sapiens
tgaaaatatgcaatt

SEQ ID NO: 106754 - DNA, 15 bp, Homo sapiens
atgaaaatatgcaat

SEQ ID NO: 106755 - DNA, 15 bp, Homo sapiens
aatgaaaatatgcaa

SEQ ID NO: 106756 - DNA, 15 bp, Homo sapiens
aaatgaaaatatgca

SEQ ID NO: 106757 - DNA, 15 bp, Homo sapiens
gaaatgaaaatatgc

SEQ ID NO: 106758 - DNA, 15 bp, Homo sapiens
agaaatgaaaatatg

SEQ ID NO: 106759 - DNA, 15 bp, Homo sapiens
cagaaatgaaaatat

SEQ ID NO: 106760 - DNA, 15 bp, Homo sapiens
gcagaaatgaaaata

SEQ ID NO: 106761 - DNA, 15 bp, Homo sapiens
tgcagaaatgaaaat

SEQ ID NO: 106762 - DNA, 15 bp, Homo sapiens
ttgcagaaatgaaaa

SEQ ID NO: 106763 - DNA, 15 bp, Homo sapiens
tttgcagaaatgaaa

SEQ ID NO: 106764 - DNA, 15 bp, Homo sapiens
gtttgcagaaatgaa

SEQ ID NO: 106765 - DNA, 15 bp, Homo sapiens
tgtttgcagaaatga

SEQ ID NO: 106766 - DNA, 15 bp, Homo sapiens
ctgtttgcagaaatg

SEQ ID NO: 106767 - DNA, 15 bp, Homo sapiens
tctgtttgcagaaat

SEQ ID NO: 106768 - DNA, 15 bp, Homo sapiens
ctctgtttgcagaaa

SEQ ID NO: 106769 - DNA, 15 bp, Homo sapiens
cctctgtttgcagaa

SEQ ID NO: 106770 - DNA, 15 bp, Homo sapiens
tcctctgtttgcaga

SEQ ID NO: 106771 - DNA, 15 bp, Homo sapiens
ttcctctgtttgcag

SEQ ID NO: 106772 - DNA, 15 bp, Homo sapiens
tttcctctgtttgca

SEQ ID NO: 106773 - DNA, 15 bp, Homo sapiens
gtttcctctgtttgc

SEQ ID NO: 106774 - DNA, 15 bp, Homo sapiens
agtttcctctgtttg

SEQ ID NO: 106775 - DNA, 15 bp, Homo sapiens
gagtttcctctgttt

SEQ ID NO: 106776 - DNA, 15 bp, Homo sapiens
ggagtttcctctgtt

SEQ ID NO: 106777 - DNA, 15 bp, Homo sapiens
cggagtttcctctgt

SEQ ID NO: 106778 - DNA, 15 bp, Homo sapiens
tcggagtttcctctg

SEQ ID NO: 106779 - DNA, 15 bp, Homo sapiens
ctcggagtttcctct

SEQ ID NO: 106780 - DNA, 15 bp, Homo sapiens
tctcggagtttcctc

SEQ ID NO: 106781 - DNA, 15 bp, Homo sapiens
ctctcggagtttcct

SEQ ID NO: 106782 - DNA, 15 bp, Homo sapiens
cctctcggagtttcc

SEQ ID NO: 106783 - DNA, 15 bp, Homo sapiens
acctctcggagtttc

SEQ ID NO: 106784 - DNA, 15 bp, Homo sapiens
cacctctcggagttt

SEQ ID NO: 106785 - DNA, 15 bp, Homo sapiens
acacctctcggagtt

SEQ ID NO: 106786 - DNA, 15 bp, Homo sapiens
gacacctctcggagt

SEQ ID NO: 106787 - DNA, 15 bp, Homo sapiens
ggacacctctcggag

SEQ ID NO: 106788 - DNA, 15 bp, Homo sapiens
tggacacctctcgga

SEQ ID NO: 106789 - DNA, 15 bp, Homo sapiens
gtggacacctctcgg

SEQ ID NO: 106790 - DNA, 15 bp, Homo sapiens
tgtggacacctctcg

SEQ ID NO: 106791 - DNA, 15 bp, Homo sapiens
ttgtggacacctctc

SEQ ID NO: 106792 - DNA, 15 bp, Homo sapiens
tttgtggacacctct

SEQ ID NO: 106793 - DNA, 15 bp, Homo sapiens
ctttgtggacacctc

SEQ ID NO: 106794 - DNA, 15 bp, Homo sapiens
actttgtggacacct

SEQ ID NO: 106795 - DNA, 15 bp, Homo sapiens
aactttgtggacacc

SEQ ID NO: 106796 - DNA, 15 bp, Homo sapiens
gaactttgtggacac

SEQ ID NO: 106797 - DNA, 15 bp, Homo sapiens
ggaactttgtggaca

SEQ ID NO: 106798 - DNA, 15 bp, Homo sapiens
tggaactttgtggac

SEQ ID NO: 106799 - DNA, 15 bp, Homo sapiens
ctggaactttgtgga

SEQ ID NO: 106800 - DNA, 15 bp, Homo sapiens
gctggaactttgtgg

SEQ ID NO: 106801 - DNA, 15 bp, Homo sapiens
agctggaactttgtg

SEQ ID NO: 106802 - DNA, 15 bp, Homo sapiens
aagctggaactttgt

SEQ ID NO: 106803 - DNA, 15 bp, Homo sapiens
aaagctggaactttg

SEQ ID NO: 106804 - DNA, 15 bp, Homo sapiens
aaaagctggaacttt

SEQ ID NO: 106805 - DNA, 15 bp, Homo sapiens
gaaaagctggaactt

SEQ ID NO: 106806 - DNA, 15 bp, Homo sapiens
ggaaaagctggaact

SEQ ID NO: 106807 - DNA, 15 bp, Homo sapiens
tggaaaagctggaac

SEQ ID NO: 106808 - DNA, 15 bp, Homo sapiens
ctggaaaagctggaa

SEQ ID NO: 106809 - DNA, 15 bp, Homo sapiens
tctggaaaagctgga

SEQ ID NO: 106810 - DNA, 15 bp, Homo sapiens
ttctggaaaagctgg

SEQ ID NO: 106811 - DNA, 15 bp, Homo sapiens
cttctggaaaagctg

SEQ ID NO: 106812 - DNA, 15 bp, Homo sapiens
gcttctggaaaagct

SEQ ID NO: 106813 - DNA, 15 bp, Homo sapiens
ggcttctggaaaagc

SEQ ID NO: 106814 - DNA, 15 bp, Homo sapiens
tggcttctggaaaag

SEQ ID NO: 106815 - DNA, 15 bp, Homo sapiens
ctggcttctggaaaa

SEQ ID NO: 106816 - DNA, 15 bp, Homo sapiens
gctggcttctggaaa

SEQ ID NO: 106817 - DNA, 15 bp, Homo sapiens
agctggcttctggaa

SEQ ID NO: 106818 - DNA, 15 bp, Homo sapiens
tagctggcttctgga

SEQ ID NO: 106819 - DNA, 15 bp, Homo sapiens
ttagctggcttctgg

SEQ ID NO: 106820 - DNA, 15 bp, Homo sapiens
gttagctggcttctg

SEQ ID NO: 106821 - DNA, 15 bp, Homo sapiens
agttagctggcttct

SEQ ID NO: 106822 - DNA, 15 bp, Homo sapiens
aagttagctggcttc

SEQ ID NO: 106823 - DNA, 15 bp, Homo sapiens
gaagttagctggctt

SEQ ID NO: 106824 - DNA, 15 bp, Homo sapiens
cgaagttagctggct

SEQ ID NO: 106825 - DNA, 15 bp, Homo sapiens
tcgaagttagctggc

SEQ ID NO: 106826 - DNA, 15 bp, Homo sapiens
ctcgaagttagctgg

SEQ ID NO: 106827 - DNA, 15 bp, Homo sapiens
gctcgaagttagctg

SEQ ID NO: 106828 - DNA, 15 bp, Homo sapiens
tgctcgaagttagct

SEQ ID NO: 106829 - DNA, 15 bp, Homo sapiens
ctgctcgaagttagc

SEQ ID NO: 106830 - DNA, 15 bp, Homo sapiens
gctgctcgaagttag

SEQ ID NO: 106831 - DNA, 15 bp, Homo sapiens
cgctgctcgaagtta

SEQ ID NO: 106832 - DNA, 15 bp, Homo sapiens
gcgctgctcgaagtt

SEQ ID NO: 106833 - DNA, 15 bp, Homo sapiens
tgcgctgctcgaagt

SEQ ID NO: 106834 - DNA, 15 bp, Homo sapiens
atgcgctgctcgaag

SEQ ID NO: 106835 - DNA, 15 bp, Homo sapiens
catgcgctgctcgaa

SEQ ID NO: 106836 - DNA, 15 bp, Homo sapiens
gcatgcgctgctcga

SEQ ID NO: 106837 - DNA, 15 bp, Homo sapiens
agcatgcgctgctcg

SEQ ID NO: 106838 - DNA, 15 bp, Homo sapiens
cagcatgcgctgctc

SEQ ID NO: 106839 - DNA, 15 bp, Homo sapiens
ccagcatgcgctgct

SEQ ID NO: 106840 - DNA, 15 bp, Homo sapiens
tccagcatgcgctgc

SEQ ID NO: 106841 - DNA, 15 bp, Homo sapiens
gtccagcatgcgctg

SEQ ID NO: 106842 - DNA, 15 bp, Homo sapiens
agtccagcatgcgct

SEQ ID NO: 106843 - DNA, 15 bp, Homo sapiens
cagtccagcatgcgc

SEQ ID NO: 106844 - DNA, 15 bp, Homo sapiens
gcagtccagcatgcg

SEQ ID NO: 106845 - DNA, 15 bp, Homo sapiens
tgcagtccagcatgc

SEQ ID NO: 106846 - DNA, 15 bp, Homo sapiens
ttgcagtccagcatg

SEQ ID NO: 106847 - DNA, 15 bp, Homo sapiens
cttgcagtccagcat

SEQ ID NO: 106848 - DNA, 15 bp, Homo sapiens
gcttgcagtccagca

SEQ ID NO: 106849 - DNA, 15 bp, Homo sapiens
cgcttgcagtccagc

SEQ ID NO: 106850 - DNA, 15 bp, Homo sapiens
acgcttgcagtccag

SEQ ID NO: 106851 - DNA, 15 bp, Homo sapiens
cacgcttgcagtcca

SEQ ID NO: 106852 - DNA, 15 bp, Homo sapiens
acacgcttgcagtcc

SEQ ID NO: 106853 - DNA, 15 bp, Homo sapiens
cacacgcttgcagtc

SEQ ID NO: 106854 - DNA, 15 bp, Homo sapiens
gcacacgcttgcagt

SEQ ID NO: 106855 - DNA, 15 bp, Homo sapiens
agcacacgcttgcag

SEQ ID NO: 106856 - DNA, 15 bp, Homo sapiens
cagcacacgcttgca

SEQ ID NO: 106857 - DNA, 15 bp, Homo sapiens
ccagcacacgcttgc

SEQ ID NO: 106858 - DNA, 15 bp, Homo sapiens
tccagcacacgcttg

SEQ ID NO: 106859 - DNA, 15 bp, Homo sapiens
atccagcacacgctt

SEQ ID NO: 106860 - DNA, 15 bp, Homo sapiens
catccagcacacgct

SEQ ID NO: 106861 - DNA, 15 bp, Homo sapiens
ccatccagcacacgc

SEQ ID NO: 106862 - DNA, 15 bp, Homo sapiens
gccatccagcacacg

SEQ ID NO: 106863 - DNA, 15 bp, Homo sapiens
cgccatccagcacac

SEQ ID NO: 106864 - DNA, 15 bp, Homo sapiens
acgccatccagcaca

SEQ ID NO: 106865 - DNA, 15 bp, Homo sapiens
cacgccatccagcac

SEQ ID NO: 106866 - DNA, 15 bp, Homo sapiens
tcacgccatccagca

SEQ ID NO: 106867 - DNA, 15 bp, Homo sapiens
ttcacgccatccagc

SEQ ID NO: 106868 - DNA, 15 bp, Homo sapiens
tttcacgccatccag

SEQ ID NO: 106869 - DNA, 15 bp, Homo sapiens
gctttcacgccatcc

SEQ ID NO: 106870 - DNA, 15 bp, Homo sapiens
tgctttcacgccatc

SEQ ID NO: 106871 - DNA, 15 bp, Homo sapiens
ctgctttcacgccat

SEQ ID NO: 106872 - DNA, 15 bp, Homo sapiens
tctgctttcacgcca

SEQ ID NO: 106873 - DNA, 15 bp, Homo sapiens
ttctgctttcacgcc

SEQ ID NO: 106874 - DNA, 15 bp, Homo sapiens
gttctgctttcacgc

SEQ ID NO: 106875 - DNA, 15 bp, Homo sapiens
agttctgctttcacg

SEQ ID NO: 106876 - DNA, 15 bp, Homo sapiens
aagttctgctttcac

SEQ ID NO: 106877 - DNA, 15 bp, Homo sapiens
gaagttctgctttca

SEQ ID NO: 106878 - DNA, 15 bp, Homo sapiens
tgaagttctgctttc

SEQ ID NO: 106879 - DNA, 15 bp, Homo sapiens
gtgaagttctgcttt

SEQ ID NO: 106880 - DNA, 15 bp, Homo sapiens
cgtgaagttctgctt

SEQ ID NO: 106881 - DNA, 15 bp, Homo sapiens
acgtgaagttctgct

SEQ ID NO: 106882 - DNA, 15 bp, Homo sapiens
aacgtgaagttctgc

SEQ ID NO: 106883 - DNA, 15 bp, Homo sapiens
gaacgtgaagttctg

SEQ ID NO: 106884 - DNA, 15 bp, Homo sapiens
agaacgtgaagttct

SEQ ID NO: 106885 - DNA, 15 bp, Homo sapiens
cagaacgtgaagttc

SEQ ID NO: 106886 - DNA, 15 bp, Homo sapiens
ccagaacgtgaagtt

SEQ ID NO: 106887 - DNA, 15 bp, Homo sapiens
tccagaacgtgaagt

SEQ ID NO: 106888 - DNA, 15 bp, Homo sapiens
atccagaacgtgaag

SEQ ID NO: 106889 - DNA, 15 bp, Homo sapiens
catccagaacgtgaa

SEQ ID NO: 106890 - DNA, 15 bp, Homo sapiens
acatccagaacgtga

SEQ ID NO: 106891 - DNA, 15 bp, Homo sapiens
cacatccagaacgtg

SEQ ID NO: 106892 - DNA, 15 bp, Homo sapiens
tcacatccagaacgt

SEQ ID NO: 106893 - DNA, 15 bp, Homo sapiens
ttcacatccagaacg

SEQ ID NO: 106894 - DNA, 15 bp, Homo sapiens
cttcacatccagaac

SEQ ID NO: 106895 - DNA, 15 bp, Homo sapiens
ccttcacatccagaa

SEQ ID NO: 106896 - DNA, 15 bp, Homo sapiens
tccttcacatccaga

SEQ ID NO: 106897 - DNA, 15 bp, Homo sapiens
gtccttcacatccag

SEQ ID NO: 106898 - DNA, 15 bp, Homo sapiens
cgtccttcacatcca

SEQ ID NO: 106899 - DNA, 15 bp, Homo sapiens
acgtccttcacatcc

SEQ ID NO: 106900 - DNA, 15 bp, Homo sapiens
tacgtccttcacatc

SEQ ID NO: 106901 - DNA, 15 bp, Homo sapiens
ctacgtccttcacat

SEQ ID NO: 106902 - DNA, 15 bp, Homo sapiens
tctacgtccttcaca

SEQ ID NO: 106903 - DNA, 15 bp, Homo sapiens
gtctacgtccttcac

SEQ ID NO: 106904 - DNA, 15 bp, Homo sapiens
ggtctacgtccttca

SEQ ID NO: 106905 - DNA, 15 bp, Homo sapiens
gggtctacgtccttc

SEQ ID NO: 106906 - DNA, 15 bp, Homo sapiens
agggtctacgtcctt

SEQ ID NO: 106907 - DNA, 15 bp, Homo sapiens
cagggtctacgtcct

SEQ ID NO: 106908 - DNA, 15 bp, Homo sapiens
tcagggtctacgtcc

SEQ ID NO: 106909 - DNA, 15 bp, Homo sapiens
gtcagggtctacgtc

SEQ ID NO: 106910 - DNA, 15 bp, Homo sapiens
cgtcagggtctacgt

SEQ ID NO: 106911 - DNA, 15 bp, Homo sapiens
acgtcagggtctacg

SEQ ID NO: 106912 - DNA, 15 bp, Homo sapiens
gacgtcagggtctac

SEQ ID NO: 106913 - DNA, 15 bp, Homo sapiens
tgacgtcagggtcta

SEQ ID NO: 106914 - DNA, 15 bp, Homo sapiens
atgacgtcagggtct

SEQ ID NO: 106915 - DNA, 15 bp, Homo sapiens
tatgacgtcagggtc

SEQ ID NO: 106916 - DNA, 15 bp, Homo sapiens
gtatgacgtcagggt

SEQ ID NO: 106917 - DNA, 15 bp, Homo sapiens
tgtatgacgtcaggg

SEQ ID NO: 106918 - DNA, 15 bp, Homo sapiens
ctgtatgacgtcagg

SEQ ID NO: 106919 - DNA, 15 bp, Homo sapiens
tctgtatgacgtcag

SEQ ID NO: 106920 - DNA, 15 bp, Homo sapiens
gtctgtatgacgtca

SEQ ID NO: 106921 - DNA, 15 bp, Homo sapiens
cgtctgtatgacgtc

SEQ ID NO: 106922 - DNA, 15 bp, Homo sapiens
gcgtctgtatgacgt

SEQ ID NO: 106923 - DNA, 15 bp, Homo sapiens
tgcgtctgtatgacg

SEQ ID NO: 106924 - DNA, 15 bp, Homo sapiens
gtgcgtctgtatgac

SEQ ID NO: 106925 - DNA, 15 bp, Homo sapiens
ggtgcgtctgtatga

SEQ ID NO: 106926 - DNA, 15 bp, Homo sapiens
aggtgcgtctgtatg

SEQ ID NO: 106927 - DNA, 15 bp, Homo sapiens
caggtgcgtctgtat

SEQ ID NO: 106928 - DNA, 15 bp, Homo sapiens
ccaggtgcgtctgta

SEQ ID NO: 106929 - DNA, 15 bp, Homo sapiens
tccaggtgcgtctgt

SEQ ID NO: 106930 - DNA, 15 bp, Homo sapiens
gtccaggtgcgtctg

SEQ ID NO: 106931 - DNA, 15 bp, Homo sapiens
tgtccaggtgcgtct

SEQ ID NO: 106932 - DNA, 15 bp, Homo sapiens
ttgtccaggtgcgtc

SEQ ID NO: 106933 - DNA, 15 bp, Homo sapiens
cttgtccaggtgcgt

SEQ ID NO: 106934 - DNA, 15 bp, Homo sapiens
acttgtccaggtgcg

SEQ ID NO: 106935 - DNA, 15 bp, Homo sapiens
cacttgtccaggtgc

SEQ ID NO: 106936 - DNA, 15 bp, Homo sapiens
acacttgtccaggtg

SEQ ID NO: 106937 - DNA, 15 bp, Homo sapiens
tacacttgtccaggt

SEQ ID NO: 106938 - DNA, 15 bp, Homo sapiens
atacacttgtccagg

SEQ ID NO: 106939 - DNA, 15 bp, Homo sapiens
catacacttgtccag

SEQ ID NO: 106940 - DNA, 15 bp, Homo sapiens
ccatacacttgtcca

SEQ ID NO: 106941 - DNA, 15 bp, Homo sapiens
accatacacttgtcc

SEQ ID NO: 106942 - DNA, 15 bp, Homo sapiens
caccatacacttgtc

SEQ ID NO: 106943 - DNA, 15 bp, Homo sapiens
tcaccatacacttgt

SEQ ID NO: 106944 - DNA, 15 bp, Homo sapiens
ctcaccatacacttg

SEQ ID NO: 106945 - DNA, 15 bp, Homo sapiens
cctcaccatacactt

SEQ ID NO: 106946 - DNA, 15 bp, Homo sapiens
gcctcaccatacact

SEQ ID NO: 106947 - DNA, 15 bp, Homo sapiens
agcctcaccatacac

SEQ ID NO: 106948 - DNA, 15 bp, Homo sapiens
aagcctcaccataca

SEQ ID NO: 106949 - DNA, 15 bp, Homo sapiens
aaagcctcaccatac

SEQ ID NO: 106950 - DNA, 15 bp, Homo sapiens
aaaagcctcaccata

SEQ ID NO: 106951 - DNA, 15 bp, Homo sapiens
caaaagcctcaccat

SEQ ID NO: 106952 - DNA, 15 bp, Homo sapiens
ccaaaagcctcacca

SEQ ID NO: 106953 - DNA, 15 bp, Homo sapiens
cccaaaagcctcacc

SEQ ID NO: 106954 - DNA, 15 bp, Homo sapiens
acccaaaagcctcac

SEQ ID NO: 106955 - DNA, 15 bp, Homo sapiens
cacccaaaagcctca

SEQ ID NO: 106956 - DNA, 15 bp, Homo sapiens
tcacccaaaagcctc

SEQ ID NO: 106957 - DNA, 15 bp, Homo sapiens
atcacccaaaagcct

SEQ ID NO: 106958 - DNA, 15 bp, Homo sapiens
aatcacccaaaagcc

SEQ ID NO: 106959 - DNA, 15 bp, Homo sapiens
caatcacccaaaagc

SEQ ID NO: 106960 - DNA, 15 bp, Homo sapiens
ccaatcacccaaaag

SEQ ID NO: 106961 - DNA, 15 bp, Homo sapiens
gccaatcacccaaaa

SEQ ID NO: 106962 - DNA, 15 bp, Homo sapiens
tgccaatcacccaaa

SEQ ID NO: 106963 - DNA, 15 bp, Homo sapiens
gtgccaatcacccaa

SEQ ID NO: 106964 - DNA, 15 bp, Homo sapiens
tgtgccaatcaccca

SEQ ID NO: 106965 - DNA, 15 bp, Homo sapiens
atgtgccaatcaccc

SEQ ID NO: 106966 - DNA, 15 bp, Homo sapiens
gatgtgccaatcacc

SEQ ID NO: 106967 - DNA, 15 bp, Homo sapiens
ggatgtgccaatcac

SEQ ID NO: 106968 - DNA, 15 bp, Homo sapiens
tggatgtgccaatca

SEQ ID NO: 106969 - DNA, 15 bp, Homo sapiens
ctggatgtgccaatc

SEQ ID NO: 106970 - DNA, 15 bp, Homo sapiens
actggatgtgccaat

SEQ ID NO: 106971 - DNA, 15 bp, Homo sapiens
cactggatgtgccaa

SEQ ID NO: 106972 - DNA, 15 bp, Homo sapiens
ccactggatgtgcca

SEQ ID NO: 106973 - DNA, 15 bp, Homo sapiens
gccactggatgtgcc

SEQ ID NO: 106974 - DNA, 15 bp, Homo sapiens
agccactggatgtgc

SEQ ID NO: 106975 - DNA, 15 bp, Homo sapiens
aagccactggatgtg

SEQ ID NO: 106976 - DNA, 15 bp, Homo sapiens
aaagccactggatgt

SEQ ID NO: 106977 - DNA, 15 bp, Homo sapiens
aaaagccactggatg

SEQ ID NO: 106978 - DNA, 15 bp, Homo sapiens
aaaaagccactggat

SEQ ID NO: 106979 - DNA, 15 bp, Homo sapiens
gaaaaagccactgga

SEQ ID NO: 106980 - DNA, 15 bp, Homo sapiens
tgaaaaagccactgg

SEQ ID NO: 106981 - DNA, 15 bp, Homo sapiens
ctgaaaaagccactg

SEQ ID NO: 106982 - DNA, 15 bp, Homo sapiens
gctgaaaaagccact

SEQ ID NO: 106983 - DNA, 15 bp, Homo sapiens
tgctgaaaaagccac

SEQ ID NO: 106984 - DNA, 15 bp, Homo sapiens
ctgctgaaaaagcca

SEQ ID NO: 106985 - DNA, 15 bp, Homo sapiens
gctgctgaaaaagcc

SEQ ID NO: 106986 - DNA, 15 bp, Homo sapiens
agctgctgaaaaagc

SEQ ID NO: 106987 - DNA, 15 bp, Homo sapiens
cagctgctgaaaaag

SEQ ID NO: 106988 - DNA, 15 bp, Homo sapiens
acagctgctgaaaaa

SEQ ID NO: 106989 - DNA, 15 bp, Homo sapiens
aacagctgctgaaaa

SEQ ID NO: 106990 - DNA, 15 bp, Homo sapiens
taacagctgctgaaa

SEQ ID NO: 106991 - DNA, 15 bp, Homo sapiens
ataacagctgctgaa

SEQ ID NO: 106992 - DNA, 15 bp, Homo sapiens
cataacagctgctga

SEQ ID NO: 106993 - DNA, 15 bp, Homo sapiens
ccataacagctgctg

SEQ ID NO: 106994 - DNA, 15 bp, Homo sapiens
gccataacagctgct

SEQ ID NO: 106995 - DNA, 15 bp, Homo sapiens
agccataacagctgc

SEQ ID NO: 106996 - DNA, 15 bp, Homo sapiens
aagccataacagctg

SEQ ID NO: 106997 - DNA, 15 bp, Homo sapiens
caagccataacagct

SEQ ID NO: 106998 - DNA, 15 bp, Homo sapiens
ccaagccataacagc

SEQ ID NO: 106999 - DNA, 15 bp, Homo sapiens
accaagccataacag

SEQ ID NO: 107000 - DNA, 15 bp, Homo sapiens
gaccaagccataaca

SEQ ID NO: 107001 - DNA, 15 bp, Homo sapiens
agaccaagccataac

SEQ ID NO: 107002 - DNA, 15 bp, Homo sapiens
tagaccaagccataa

SEQ ID NO: 107003 - DNA, 15 bp, Homo sapiens
ctagaccaagccata

SEQ ID NO: 107004 - DNA, 15 bp, Homo sapiens
gctagaccaagccat

SEQ ID NO: 107005 - DNA, 15 bp, Homo sapiens
tgctagaccaagcca

SEQ ID NO: 107006 - DNA, 15 bp, Homo sapiens
ttgctagaccaagcc

SEQ ID NO: 107007 - DNA, 15 bp, Homo sapiens
cttgctagaccaagc

SEQ ID NO: 107008 - DNA, 15 bp, Homo sapiens
acttgctagaccaag

SEQ ID NO: 107009 - DNA, 15 bp, Homo sapiens
tacttgctagaccaa

SEQ ID NO: 107010 - DNA, 15 bp, Homo sapiens
gtacttgctagacca

SEQ ID NO: 107011 - DNA, 15 bp, Homo sapiens
tgtacttgctagacc

SEQ ID NO: 107012 - DNA, 15 bp, Homo sapiens
atgtacttgctagac

SEQ ID NO: 107013 - DNA, 15 bp, Homo sapiens
catgtacttgctaga

SEQ ID NO: 107014 - DNA, 15 bp, Homo sapiens
gcatgtacttgctag

SEQ ID NO: 107015 - DNA, 15 bp, Homo sapiens
ggcatgtacttgcta

SEQ ID NO: 107016 - DNA, 15 bp, Homo sapiens
aggcatgtacttgct

SEQ ID NO: 107017 - DNA, 15 bp, Homo sapiens
taggcatgtacttgc

SEQ ID NO: 107018 - DNA, 15 bp, Homo sapiens
ctaggcatgtacttg

SEQ ID NO: 107019 - DNA, 15 bp, Homo sapiens
actaggcatgtactt

SEQ ID NO: 107020 - DNA, 15 bp, Homo sapiens
cactaggcatgtact

SEQ ID NO: 107021 - DNA, 15 bp, Homo sapiens
acactaggcatgtac

SEQ ID NO: 107022 - DNA, 15 bp, Homo sapiens
cacactaggcatgta

SEQ ID NO: 107023 - DNA, 15 bp, Homo sapiens
acacactaggcatgt

SEQ ID NO: 107024 - DNA, 15 bp, Homo sapiens
gacacactaggcatg

SEQ ID NO: 107025 - DNA, 15 bp, Homo sapiens
ggacacactaggcat

SEQ ID NO: 107026 - DNA, 15 bp, Homo sapiens
tggacacactaggca

SEQ ID NO: 107027 - DNA, 15 bp, Homo sapiens
ctggacacactaggc

SEQ ID NO: 107028 - DNA, 15 bp, Homo sapiens
actggacacactagg

SEQ ID NO: 107029 - DNA, 15 bp, Homo sapiens
cactggacacactag

SEQ ID NO: 107030 - DNA, 15 bp, Homo sapiens
tcactggacacacta

SEQ ID NO: 107031 - DNA, 15 bp, Homo sapiens
atcactggacacact

SEQ ID NO: 107032 - DNA, 15 bp, Homo sapiens
gatcactggacacac

SEQ ID NO: 107033 - DNA, 15 bp, Homo sapiens
tgatcactggacaca

SEQ ID NO: 107034 - DNA, 15 bp, Homo sapiens
gtgatcactggacac

SEQ ID NO: 107035 - DNA, 15 bp, Homo sapiens
agtgatcactggaca

SEQ ID NO: 107036 - DNA, 15 bp, Homo sapiens
tagtgatcactggac

SEQ ID NO: 107037 - DNA, 15 bp, Homo sapiens
ctagtgatcactgga

SEQ ID NO: 107038 - DNA, 15 bp, Homo sapiens
actagtgatcactgg

SEQ ID NO: 107039 - DNA, 15 bp, Homo sapiens
gactagtgatcactg

SEQ ID NO: 107040 - DNA, 15 bp, Homo sapiens
agactagtgatcact

SEQ ID NO: 107041 - DNA, 15 bp, Homo sapiens
tagactagtgatcac

SEQ ID NO: 107042 - DNA, 15 bp, Homo sapiens
gtagactagtgatca

SEQ ID NO: 107043 - DNA, 15 bp, Homo sapiens
tgtagactagtgatc

SEQ ID NO: 107044 - DNA, 15 bp, Homo sapiens
ctgtagactagtgat

SEQ ID NO: 107045 - DNA, 15 bp, Homo sapiens
actgtagactagtga

SEQ ID NO: 107046 - DNA, 15 bp, Homo sapiens
cactgtagactagtg

SEQ ID NO: 107047 - DNA, 15 bp, Homo sapiens
acactgtagactagt

SEQ ID NO: 107048 - DNA, 15 bp, Homo sapiens
cacactgtagactag

SEQ ID NO: 107049 - DNA, 15 bp, Homo sapiens
gcacactgtagacta

SEQ ID NO: 107050 - DNA, 15 bp, Homo sapiens
agcacactgtagact

SEQ ID NO: 107051 - DNA, 15 bp, Homo sapiens
tagcacactgtagac

SEQ ID NO: 107052 - DNA, 15 bp, Homo sapiens
ttagcacactgtaga

SEQ ID NO: 107053 - DNA, 15 bp, Homo sapiens
tttagcacactgtag

SEQ ID NO: 107054 - DNA, 15 bp, Homo sapiens
gtttagcacactgta

SEQ ID NO: 107055 - DNA, 15 bp, Homo sapiens
tgtttagcacactgt

SEQ ID NO: 107056 - DNA, 15 bp, Homo sapiens
atgtttagcacactg

SEQ ID NO: 107057 - DNA, 15 bp, Homo sapiens
tatgtttagcacact

SEQ ID NO: 107058 - DNA, 15 bp, Homo sapiens
ttatgtttagcacac

SEQ ID NO: 107059 - DNA, 15 bp, Homo sapiens
cttatgtttagcaca

SEQ ID NO: 107060 - DNA, 15 bp, Homo sapiens
ccttatgtttagcac

SEQ ID NO: 107061 - DNA, 15 bp, Homo sapiens
tccttatgtttagca

SEQ ID NO: 107062 - DNA, 15 bp, Homo sapiens
atccttatgtttagc

SEQ ID NO: 107063 - DNA, 15 bp, Homo sapiens
aatccttatgtttag

SEQ ID NO: 107064 - DNA, 15 bp, Homo sapiens
caatccttatgttta

SEQ ID NO: 107065 - DNA, 15 bp, Homo sapiens
tcaatccttatgttt

SEQ ID NO: 107066 - DNA, 15 bp, Homo sapiens
atcaatccttatgtt

SEQ ID NO: 107067 - DNA, 15 bp, Homo sapiens
catcaatccttatgt

SEQ ID NO: 107068 - DNA, 15 bp, Homo sapiens
tcatcaatccttatg

SEQ ID NO: 107069 - DNA, 15 bp, Homo sapiens
atcatcaatccttat

SEQ ID NO: 107070 - DNA, 15 bp, Homo sapiens
catcatcaatcctta

SEQ ID NO: 107071 - DNA, 15 bp, Homo sapiens
ccatcatcaatcctt

SEQ ID NO: 107072 - DNA, 15 bp, Homo sapiens
tccatcatcaatcct

SEQ ID NO: 107073 - DNA, 15 bp, Homo sapiens
ttccatcatcaatcc

SEQ ID NO: 107074 - DNA, 15 bp, Homo sapiens
tttccatcatcaatc

SEQ ID NO: 107075 - DNA, 15 bp, Homo sapiens
ttttccatcatcaat

SEQ ID NO: 107076 - DNA, 15 bp, Homo sapiens
gttttccatcatcaa

SEQ ID NO: 107077 - DNA, 15 bp, Homo sapiens
cgttttccatcatca

SEQ ID NO: 107078 - DNA, 15 bp, Homo sapiens
acgttttccatcatc

SEQ ID NO: 107079 - DNA, 15 bp, Homo sapiens
cacgttttccatcat

SEQ ID NO: 107080 - DNA, 15 bp, Homo sapiens
acacgttttccatca

SEQ ID NO: 107081 - DNA, 15 bp, Homo sapiens
aacacgttttccatc

SEQ ID NO: 107082 - DNA, 15 bp, Homo sapiens
taacacgttttccat

SEQ ID NO: 107083 - DNA, 15 bp, Homo sapiens
ttaacacgttttcca

SEQ ID NO: 107084 - DNA, 15 bp, Homo sapiens
tttaacacgttttcc

SEQ ID NO: 107085 - DNA, 15 bp, Homo sapiens
ttttaacacgttttc

SEQ ID NO: 107086 - DNA, 15 bp, Homo sapiens
tttttaacacgtttt

SEQ ID NO: 107087 - DNA, 15 bp, Homo sapiens
ttttttaacacgttt

SEQ ID NO: 107088 - DNA, 15 bp, Homo sapiens
attttttaacacgtt

SEQ ID NO: 107089 - DNA, 15 bp, Homo sapiens
tattttttaacacgt

SEQ ID NO: 107090 - DNA, 15 bp, Homo sapiens
ttattttttaacacg

SEQ ID NO: 107091 - DNA, 15 bp, Homo sapiens
cttattttttaacac

SEQ ID NO: 107092 - DNA, 15 bp, Homo sapiens
tcttattttttaaca

SEQ ID NO: 107093 - DNA, 15 bp, Homo sapiens
ttcttattttttaac

SEQ ID NO: 107094 - DNA, 15 bp, Homo sapiens
cttcttattttttaa

SEQ ID NO: 107095 - DNA, 15 bp, Homo sapiens
acttcttatttttta

SEQ ID NO: 107096 - DNA, 15 bp, Homo sapiens
cacttcttatttttt

SEQ ID NO: 107097 - DNA, 15 bp, Homo sapiens
acacttcttattttt

SEQ ID NO: 107098 - DNA, 15 bp, Homo sapiens
cacacttcttatttt

SEQ ID NO: 107099 - DNA, 15 bp, Homo sapiens
ccacacttcttattt

SEQ ID NO: 107100 - DNA, 15 bp, Homo sapiens
accacacttcttatt

SEQ ID NO: 107101 - DNA, 15 bp, Homo sapiens
gaccacacttcttat

SEQ ID NO: 107102 - DNA, 15 bp, Homo sapiens
agaccacacttctta

SEQ ID NO: 107103 - DNA, 15 bp, Homo sapiens
aagaccacacttctt

SEQ ID NO: 107104 - DNA, 15 bp, Homo sapiens
aaagaccacacttct

SEQ ID NO: 107105 - DNA, 15 bp, Homo sapiens
gaaagaccacacttc

SEQ ID NO: 107106 - DNA, 15 bp, Homo sapiens
ggaaagaccacactt

SEQ ID NO: 107107 - DNA, 15 bp, Homo sapiens
gggaaagaccacact

SEQ ID NO: 107108 - DNA, 15 bp, Homo sapiens
agggaaagaccacac

SEQ ID NO: 107109 - DNA, 15 bp, Homo sapiens
gagggaaagaccaca

SEQ ID NO: 107110 - DNA, 15 bp, Homo sapiens
ggagggaaagaccac

SEQ ID NO: 107111 - DNA, 15 bp, Homo sapiens
tggagggaaagacca

SEQ ID NO: 107112 - DNA, 15 bp, Homo sapiens
ttggagggaaagacc

SEQ ID NO: 107113 - DNA, 15 bp, Homo sapiens
tttggagggaaagac

SEQ ID NO: 107114 - DNA, 15 bp, Homo sapiens
ctttggagggaaaga

SEQ ID NO: 107115 - DNA, 15 bp, Homo sapiens
tctttggagggaaag

SEQ ID NO: 107116 - DNA, 15 bp, Homo sapiens
ttctttggagggaaa

SEQ ID NO: 107117 - DNA, 15 bp, Homo sapiens
tttctttggagggaa

SEQ ID NO: 107118 - DNA, 15 bp, Homo sapiens
atttctttggaggga

SEQ ID NO: 107119 - DNA, 15 bp, Homo sapiens
aatttctttggaggg

SEQ ID NO: 107120 - DNA, 15 bp, Homo sapiens
taatttctttggagg

SEQ ID NO: 107121 - DNA, 15 bp, Homo sapiens
ctaatttctttggag

SEQ ID NO: 107122 - DNA, 15 bp, Homo sapiens
tctaatttctttgga

SEQ ID NO: 107123 - DNA, 15 bp, Homo sapiens
ttctaatttctttgg

SEQ ID NO: 107124 - DNA, 15 bp, Homo sapiens
cttctaatttctttg

SEQ ID NO: 107125 - DNA, 15 bp, Homo sapiens
tcttctaatttcttt

SEQ ID NO: 107126 - DNA, 15 bp, Homo sapiens
ctcttctaatttctt

SEQ ID NO: 107127 - DNA, 15 bp, Homo sapiens
tctcttctaatttct

SEQ ID NO: 107128 - DNA, 15 bp, Homo sapiens
atctcttctaatttc

SEQ ID NO: 107129 - DNA, 15 bp, Homo sapiens
tatctcttctaattt

SEQ ID NO: 107130 - DNA, 15 bp, Homo sapiens
ttatctcttctaatt

SEQ ID NO: 107131 - DNA, 15 bp, Homo sapiens
cttatctcttctaat

SEQ ID NO: 107132 - DNA, 15 bp, Homo sapiens
tcttatctcttctaa

SEQ ID NO: 107133 - DNA, 15 bp, Homo sapiens
ctcttatctcttcta

SEQ ID NO: 107134 - DNA, 15 bp, Homo sapiens
tctcttatctcttct

SEQ ID NO: 107135 - DNA, 15 bp, Homo sapiens
ctctcttatctcttc

SEQ ID NO: 107136 - DNA, 15 bp, Homo sapiens
tctctcttatctctt

SEQ ID NO: 107137 - DNA, 15 bp, Homo sapiens
atctctcttatctct

SEQ ID NO: 107138 - DNA, 15 bp, Homo sapiens
tatctctcttatctc

SEQ ID NO: 107139 - DNA, 15 bp, Homo sapiens
ctatctctcttatct

SEQ ID NO: 107140 - DNA, 15 bp, Homo sapiens
gctatctctcttatc

SEQ ID NO: 107141 - DNA, 15 bp, Homo sapiens
agctatctctcttat

SEQ ID NO: 107142 - DNA, 15 bp, Homo sapiens
tagctatctctctta

SEQ ID NO: 107143 - DNA, 15 bp, Homo sapiens
ttagctatctctctt

SEQ ID NO: 107144 - DNA, 15 bp, Homo sapiens
cttagctatctctct

SEQ ID NO: 107145 - DNA, 15 bp, Homo sapiens
ccttagctatctctc

SEQ ID NO: 107146 - DNA, 15 bp, Homo sapiens
tccttagctatctct

SEQ ID NO: 107147 - DNA, 15 bp, Homo sapiens
ttccttagctatctc

SEQ ID NO: 107148 - DNA, 15 bp, Homo sapiens
tttccttagctatct

SEQ ID NO: 107149 - DNA, 15 bp, Homo sapiens
gtttccttagctatc

SEQ ID NO: 107150 - DNA, 15 bp, Homo sapiens
agtttccttagctat

SEQ ID NO: 107151 - DNA, 15 bp, Homo sapiens
tagtttccttagcta

SEQ ID NO: 107152 - DNA, 15 bp, Homo sapiens
ctagtttccttagct

SEQ ID NO: 107153 - DNA, 15 bp, Homo sapiens
tctagtttccttagc

SEQ ID NO: 107154 - DNA, 15 bp, Homo sapiens
ttctagtttccttag

SEQ ID NO: 107155 - DNA, 15 bp, Homo sapiens
attctagtttcctta

SEQ ID NO: 107156 - DNA, 15 bp, Homo sapiens
tattctagtttcctt

SEQ ID NO: 107157 - DNA, 15 bp, Homo sapiens
ctattctagtttcct

SEQ ID NO: 107158 - DNA, 15 bp, Homo sapiens
tctattctagtttcc

SEQ ID NO: 107159 - DNA, 15 bp, Homo sapiens
gtctattctagtttc

SEQ ID NO: 107160 - DNA, 15 bp, Homo sapiens
tgtctattctagttt

SEQ ID NO: 107161 - DNA, 15 bp, Homo sapiens
atgtctattctagtt

SEQ ID NO: 107162 - DNA, 15 bp, Homo sapiens
catgtctattctagt

SEQ ID NO: 107163 - DNA, 15 bp, Homo sapiens
acatgtctattctag

SEQ ID NO: 107164 - DNA, 15 bp, Homo sapiens
tacatgtctattcta

SEQ ID NO: 107165 - DNA, 15 bp, Homo sapiens
atacatgtctattct

SEQ ID NO: 107166 - DNA, 15 bp, Homo sapiens
tatacatgtctattc

SEQ ID NO: 107167 - DNA, 15 bp, Homo sapiens
atatacatgtctatt

SEQ ID NO: 107168 - DNA, 15 bp, Homo sapiens
tatatacatgtctat

SEQ ID NO: 107169 - DNA, 15 bp, Homo sapiens
ttatatacatgtcta

SEQ ID NO: 107170 - DNA, 15 bp, Homo sapiens
gttatatacatgtct

SEQ ID NO: 107171 - DNA, 15 bp, Homo sapiens
tgttatatacatgtc

SEQ ID NO: 107172 - DNA, 15 bp, Homo sapiens
atgttatatacatgt

SEQ ID NO: 107173 - DNA, 15 bp, Homo sapiens
catgttatatacatg

SEQ ID NO: 107174 - DNA, 15 bp, Homo sapiens
tcatgttatatacat

SEQ ID NO: 107175 - DNA, 15 bp, Homo sapiens
atcatgttatataca

SEQ ID NO: 107176 - DNA, 15 bp, Homo sapiens
catcatgttatatac

SEQ ID NO: 107177 - DNA, 15 bp, Homo sapiens
tcatcatgttatata

SEQ ID NO: 107178 - DNA, 15 bp, Homo sapiens
gtcatcatgttatat

SEQ ID NO: 107179 - DNA, 15 bp, Homo sapiens
tgtcatcatgttata

SEQ ID NO: 107180 - DNA, 15 bp, Homo sapiens
ttgtcatcatgttat

SEQ ID NO: 107181 - DNA, 15 bp, Homo sapiens
tttgtcatcatgtta

SEQ ID NO: 107182 - DNA, 15 bp, Homo sapiens
ttttgtcatcatgtt

SEQ ID NO: 107183 - DNA, 15 bp, Homo sapiens
tttttgtcatcatgt

SEQ ID NO: 107184 - DNA, 15 bp, Homo sapiens
gtttttgtcatcatg

SEQ ID NO: 107185 - DNA, 15 bp, Homo sapiens
ggtttttgtcatcat

SEQ ID NO: 107186 - DNA, 15 bp, Homo sapiens
tggtttttgtcatca

SEQ ID NO: 107187 - DNA, 15 bp, Homo sapiens
ttggtttttgtcatc

SEQ ID NO: 107188 - DNA, 15 bp, Homo sapiens
tttggtttttgtcat

SEQ ID NO: 107189 - DNA, 15 bp, Homo sapiens
ttttggtttttgtca

SEQ ID NO: 107190 - DNA, 15 bp, Homo sapiens
gttttggtttttgtc

SEQ ID NO: 107191 - DNA, 15 bp, Homo sapiens
tgttttggtttttgt

SEQ ID NO: 107192 - DNA, 15 bp, Homo sapiens
ttgttttggtttttg

SEQ ID NO: 107193 - DNA, 15 bp, Homo sapiens
tttgttttggttttt

SEQ ID NO: 107194 - DNA, 15 bp, Homo sapiens
ttttgttttggtttt

SEQ ID NO: 107195 - DNA, 15 bp, Homo sapiens
cttttgttttggttt

SEQ ID NO: 107196 - DNA, 15 bp, Homo sapiens
tcttttgttttggtt

SEQ ID NO: 107197 - DNA, 15 bp, Homo sapiens
ttcttttgttttggt

SEQ ID NO: 107198 - DNA, 15 bp, Homo sapiens
tttcttttgttttgg

SEQ ID NO: 107199 - DNA, 15 bp, Homo sapiens
atttcttttgttttg

SEQ ID NO: 107200 - DNA, 15 bp, Homo sapiens
tatttcttttgtttt

SEQ ID NO: 107201 - DNA, 15 bp, Homo sapiens
gctgtatttcttttg

SEQ ID NO: 107202 - DNA, 15 bp, Homo sapiens
agctgtatttctttt

SEQ ID NO: 107203 - DNA, 15 bp, Homo sapiens
aagctgtatttcttt

SEQ ID NO: 107204 - DNA, 15 bp, Homo sapiens
taagctgtatttctt

SEQ ID NO: 107205 - DNA, 15 bp, Homo sapiens
ttaagctgtatttct

SEQ ID NO: 107206 - DNA, 15 bp, Homo sapiens
attaagctgtatttc

SEQ ID NO: 107207 - DNA, 15 bp, Homo sapiens
gattaagctgtattt

SEQ ID NO: 107208 - DNA, 15 bp, Homo sapiens
tgattaagctgtatt

SEQ ID NO: 107209 - DNA, 15 bp, Homo sapiens
gtgattaagctgtat

SEQ ID NO: 107210 - DNA, 15 bp, Homo sapiens
ggtgattaagctgta

SEQ ID NO: 107211 - DNA, 15 bp, Homo sapiens
tggtgattaagctgt

SEQ ID NO: 107212 - DNA, 15 bp, Homo sapiens
atggtgattaagctg

SEQ ID NO: 107213 - DNA, 15 bp, Homo sapiens
catggtgattaagct

SEQ ID NO: 107214 - DNA, 15 bp, Homo sapiens
acatggtgattaagc

SEQ ID NO: 107215 - DNA, 15 bp, Homo sapiens
cacatggtgattaag

SEQ ID NO: 107216 - DNA, 15 bp, Homo sapiens
tcacatggtgattaa

SEQ ID NO: 107217 - DNA, 15 bp, Homo sapiens
ttcacatggtgatta

SEQ ID NO: 107218 - DNA, 15 bp, Homo sapiens
cttcacatggtgatt

SEQ ID NO: 107219 - DNA, 15 bp, Homo sapiens
acttcacatggtgat

SEQ ID NO: 107220 - DNA, 15 bp, Homo sapiens
aacttcacatggtga

SEQ ID NO: 107221 - DNA, 15 bp, Homo sapiens
taacttcacatggtg

SEQ ID NO: 107222 - DNA, 15 bp, Homo sapiens
ctaacttcacatggt

SEQ ID NO: 107223 - DNA, 15 bp, Homo sapiens
cctaacttcacatgg

SEQ ID NO: 107224 - DNA, 15 bp, Homo sapiens
tcctaacttcacatg

SEQ ID NO: 107225 - DNA, 15 bp, Homo sapiens
ctcctaacttcacat

SEQ ID NO: 107226 - DNA, 15 bp, Homo sapiens
cctcctaacttcaca

SEQ ID NO: 107227 - DNA, 15 bp, Homo sapiens
ccctcctaacttcac

SEQ ID NO: 107228 - DNA, 15 bp, Homo sapiens
gccctcctaacttca

SEQ ID NO: 107229 - DNA, 15 bp, Homo sapiens
agccctcctaacttc

SEQ ID NO: 107230 - DNA, 15 bp, Homo sapiens
aagccctcctaactt

SEQ ID NO: 107231 - DNA, 15 bp, Homo sapiens
gaagccctcctaact

SEQ ID NO: 107232 - DNA, 15 bp, Homo sapiens
tgaagccctcctaac

SEQ ID NO: 107233 - DNA, 15 bp, Homo sapiens
ctgaagccctcctaa

SEQ ID NO: 107234 - DNA, 15 bp, Homo sapiens
gctgaagccctccta

SEQ ID NO: 107235 - DNA, 15 bp, Homo sapiens
tgctgaagccctcct

SEQ ID NO: 107236 - DNA, 15 bp, Homo sapiens
ctgctgaagccctcc

SEQ ID NO: 107237 - DNA, 15 bp, Homo sapiens
tctgctgaagccctc

SEQ ID NO: 107238 - DNA, 15 bp, Homo sapiens
ctctgctgaagccct

SEQ ID NO: 107239 - DNA, 15 bp, Homo sapiens
actctgctgaagccc

SEQ ID NO: 107240 - DNA, 15 bp, Homo sapiens
cactctgctgaagcc

SEQ ID NO: 107241 - DNA, 15 bp, Homo sapiens
acactctgctgaagc

SEQ ID NO: 107242 - DNA, 15 bp, Homo sapiens
cacactctgctgaag

SEQ ID NO: 107243 - DNA, 15 bp, Homo sapiens
tcacactctgctgaa

SEQ ID NO: 107244 - DNA, 15 bp, Homo sapiens
gtcacactctgctga

SEQ ID NO: 107245 - DNA, 15 bp, Homo sapiens
agtcacactctgctg

SEQ ID NO: 107246 - DNA, 15 bp, Homo sapiens
tagtcacactctgct

SEQ ID NO: 107247 - DNA, 15 bp, Homo sapiens
ttagtcacactctgc

SEQ ID NO: 107248 - DNA, 15 bp, Homo sapiens
attagtcacactctg

SEQ ID NO: 107249 - DNA, 15 bp, Homo sapiens
tattagtcacactct

SEQ ID NO: 107250 - DNA, 15 bp, Homo sapiens
ttattagtcacactc

SEQ ID NO: 107251 - DNA, 15 bp, Homo sapiens
cttattagtcacact

SEQ ID NO: 107252 - DNA, 15 bp, Homo sapiens
gcttattagtcacac

SEQ ID NO: 107253 - DNA, 15 bp, Homo sapiens
tgcttattagtcaca

SEQ ID NO: 107254 - DNA, 15 bp, Homo sapiens
ttgcttattagtcac

SEQ ID NO: 107255 - DNA, 15 bp, Homo sapiens
tttgcttattagtca

SEQ ID NO: 107256 - DNA, 15 bp, Homo sapiens
ctttgcttattagtc

SEQ ID NO: 107257 - DNA, 15 bp, Homo sapiens
actttgcttattagt

SEQ ID NO: 107258 - DNA, 15 bp, Homo sapiens
aactttgcttattag

SEQ ID NO: 107259 - DNA, 15 bp, Homo sapiens
aaactttgcttatta

SEQ ID NO: 107260 - DNA, 15 bp, Homo sapiens
aaaactttgcttatt

SEQ ID NO: 107261 - DNA, 15 bp, Homo sapiens
gaaaactttgcttat

SEQ ID NO: 107262 - DNA, 15 bp, Homo sapiens
tgaaaactttgctta

SEQ ID NO: 107263 - DNA, 15 bp, Homo sapiens
ttgaaaactttgctt

SEQ ID NO: 107264 - DNA, 15 bp, Homo sapiens
cttgaaaactttgct

SEQ ID NO: 107265 - DNA, 15 bp, Homo sapiens
ccttgaaaactttgc

SEQ ID NO: 107266 - DNA, 15 bp, Homo sapiens
tccttgaaaactttg

SEQ ID NO: 107267 - DNA, 15 bp, Homo sapiens
atccttgaaaacttt

SEQ ID NO: 107268 - DNA, 15 bp, Homo sapiens
tatccttgaaaactt

SEQ ID NO: 107269 - DNA, 15 bp, Homo sapiens
ttatccttgaaaact

SEQ ID NO: 107270 - DNA, 15 bp, Homo sapiens
tttatccttgaaaac

SEQ ID NO: 107271 - DNA, 15 bp, Homo sapiens
atttatccttgaaaa

SEQ ID NO: 107272 - DNA, 15 bp, Homo sapiens
aatttatccttgaaa

SEQ ID NO: 107273 - DNA, 15 bp, Homo sapiens
aaatttatccttgaa

SEQ ID NO: 107274 - DNA, 15 bp, Homo sapiens
caaatttatccttga

SEQ ID NO: 107275 - DNA, 15 bp, Homo sapiens
tcaaatttatccttg

SEQ ID NO: 107276 - DNA, 15 bp, Homo sapiens
ttcaaatttatcctt

SEQ ID NO: 107277 - DNA, 15 bp, Homo sapiens
attcaaatttatcct

SEQ ID NO: 107278 - DNA, 15 bp, Homo sapiens
aattcaaatttatcc

SEQ ID NO: 107279 - DNA, 15 bp, Homo sapiens
taattcaaatttatc

SEQ ID NO: 107280 - DNA, 15 bp, Homo sapiens
ctaattcaaatttat

SEQ ID NO: 107281 - DNA, 15 bp, Homo sapiens
gctaattcaaattta

SEQ ID NO: 107282 - DNA, 15 bp, Homo sapiens
agctaattcaaattt

SEQ ID NO: 107283 - DNA, 15 bp, Homo sapiens
tagctaattcaaatt

SEQ ID NO: 107284 - DNA, 15 bp, Homo sapiens
ctagctaattcaaat

SEQ ID NO: 107285 - DNA, 15 bp, Homo sapiens
tctagctaattcaaa

SEQ ID NO: 107286 - DNA, 15 bp, Homo sapiens
ttctagctaattcaa

SEQ ID NO: 107287 - DNA, 15 bp, Homo sapiens
cttctagctaattca

SEQ ID NO: 107288 - DNA, 15 bp, Homo sapiens
tcttctagctaattc

SEQ ID NO: 107289 - DNA, 15 bp, Homo sapiens
ttcttctagctaatt

SEQ ID NO: 107290 - DNA, 15 bp, Homo sapiens
gttcttctagctaat

SEQ ID NO: 107291 - DNA, 15 bp, Homo sapiens
ggttcttctagctaa

SEQ ID NO: 107292 - DNA, 15 bp, Homo sapiens
tggttcttctagcta

SEQ ID NO: 107293 - DNA, 15 bp, Homo sapiens
atggttcttctagct

SEQ ID NO: 107294 - DNA, 15 bp, Homo sapiens
tatggttcttctagc

SEQ ID NO: 107295 - DNA, 15 bp, Homo sapiens
gtatggttcttctag

SEQ ID NO: 107296 - DNA, 15 bp, Homo sapiens
agtatggttcttcta

SEQ ID NO: 107297 - DNA, 15 bp, Homo sapiens
aagtatggttcttct

SEQ ID NO: 107298 - DNA, 15 bp, Homo sapiens
taagtatggttcttc

SEQ ID NO: 107299 - DNA, 15 bp, Homo sapiens
ctaagtatggttctt

SEQ ID NO: 107300 - DNA, 15 bp, Homo sapiens
tctaagtatggttct

SEQ ID NO: 107301 - DNA, 15 bp, Homo sapiens
ttctaagtatggttc

SEQ ID NO: 107302 - DNA, 15 bp, Homo sapiens
attctaagtatggtt

SEQ ID NO: 107303 - DNA, 15 bp, Homo sapiens
cattctaagtatggt

SEQ ID NO: 107304 - DNA, 15 bp, Homo sapiens
ccattctaagtatgg

SEQ ID NO: 107305 - DNA, 15 bp, Homo sapiens
tccattctaagtatg

SEQ ID NO: 107306 - DNA, 15 bp, Homo sapiens
atccattctaagtat

SEQ ID NO: 107307 - DNA, 15 bp, Homo sapiens
tatccattctaagta

SEQ ID NO: 107308 - DNA, 15 bp, Homo sapiens
atatccattctaagt

SEQ ID NO: 107309 - DNA, 15 bp, Homo sapiens
gatatccattctaag

SEQ ID NO: 107310 - DNA, 15 bp, Homo sapiens
cgatatccattctaa

SEQ ID NO: 107311 - DNA, 15 bp, Homo sapiens
acgatatccattcta

SEQ ID NO: 107312 - DNA, 15 bp, Homo sapiens
tacgatatccattct

SEQ ID NO: 107313 - DNA, 15 bp, Homo sapiens
ttacgatatccattc

SEQ ID NO: 107314 - DNA, 15 bp, Homo sapiens
tttacgatatccatt

SEQ ID NO: 107315 - DNA, 15 bp, Homo sapiens
ttttacgatatccat

SEQ ID NO: 107316 - DNA, 15 bp, Homo sapiens
tttttacgatatcca

SEQ ID NO: 107317 - DNA, 15 bp, Homo sapiens
atttttacgatatcc

SEQ ID NO: 107318 - DNA, 15 bp, Homo sapiens
aatttttacgatatc

SEQ ID NO: 107319 - DNA, 15 bp, Homo sapiens
gaatttttacgatat

SEQ ID NO: 107320 - DNA, 15 bp, Homo sapiens
ggaatttttacgata

SEQ ID NO: 107321 - DNA, 15 bp, Homo sapiens
tggaatttttacgat

SEQ ID NO: 107322 - DNA, 15 bp, Homo sapiens
atggaatttttacga

SEQ ID NO: 107323 - DNA, 15 bp, Homo sapiens
aatggaatttttacg

SEQ ID NO: 107324 - DNA, 15 bp, Homo sapiens
aaatggaatttttac

SEQ ID NO: 107325 - DNA, 15 bp, Homo sapiens
aaaatggaattttta

SEQ ID NO: 107326 - DNA, 15 bp, Homo sapiens
gaaaatggaattttt

SEQ ID NO: 107327 - DNA, 15 bp, Homo sapiens
agaaaatggaatttt

SEQ ID NO: 107328 - DNA, 15 bp, Homo sapiens
tagaaaatggaattt

SEQ ID NO: 107329 - DNA, 15 bp, Homo sapiens
ctagaaaatggaatt

SEQ ID NO: 107330 - DNA, 15 bp, Homo sapiens
cctagaaaatggaat

SEQ ID NO: 107331 - DNA, 15 bp, Homo sapiens
tcctagaaaatggaa

SEQ ID NO: 107332 - DNA, 15 bp, Homo sapiens
ttcctagaaaatgga

SEQ ID NO: 107333 - DNA, 15 bp, Homo sapiens
tttcctagaaaatgg

SEQ ID NO: 107334 - DNA, 15 bp, Homo sapiens
ttttcctagaaaatg

SEQ ID NO: 107335 - DNA, 15 bp, Homo sapiens
attttcctagaaaat

SEQ ID NO: 107336 - DNA, 15 bp, Homo sapiens
tattttcctagaaaa

SEQ ID NO: 107337 - DNA, 15 bp, Homo sapiens
ttattttcctagaaa

SEQ ID NO: 107338 - DNA, 15 bp, Homo sapiens
tttattttcctagaa

SEQ ID NO: 107339 - DNA, 15 bp, Homo sapiens
ttttattttcctaga

SEQ ID NO: 107340 - DNA, 15 bp, Homo sapiens
tttttattttcctag

SEQ ID NO: 107341 - DNA, 15 bp, Homo sapiens
atttttattttccta

SEQ ID NO: 107342 - DNA, 15 bp, Homo sapiens
aatttttattttcct

SEQ ID NO: 107343 - DNA, 15 bp, Homo sapiens
aaatttttattttcc

SEQ ID NO: 107344 - DNA, 15 bp, Homo sapiens
gaaatttttattttc

SEQ ID NO: 107345 - DNA, 15 bp, Homo sapiens
tgaaatttttatttt

SEQ ID NO: 107346 - DNA, 15 bp, Homo sapiens
ttgaaatttttattt

SEQ ID NO: 107347 - DNA, 15 bp, Homo sapiens
attgaaatttttatt

SEQ ID NO: 107348 - DNA, 15 bp, Homo sapiens
tattgaaatttttat

SEQ ID NO: 107349 - DNA, 15 bp, Homo sapiens
ctattgaaattttta

SEQ ID NO: 107350 - DNA, 15 bp, Homo sapiens
tctattgaaattttt

SEQ ID NO: 107351 - DNA, 15 bp, Homo sapiens
ttctattgaaatttt

SEQ ID NO: 107352 - DNA, 15 bp, Homo sapiens
tttctattgaaattt

SEQ ID NO: 107353 - DNA, 15 bp, Homo sapiens
atttctattgaaatt

SEQ ID NO: 107354 - DNA, 15 bp, Homo sapiens
aatttctattgaaat

SEQ ID NO: 107355 - DNA, 15 bp, Homo sapiens
aaatttctattgaaa

SEQ ID NO: 107356 - DNA, 15 bp, Homo sapiens
taaatttctattgaa

SEQ ID NO: 107357 - DNA, 15 bp, Homo sapiens
ttaaatttctattga

SEQ ID NO: 107358 - DNA, 15 bp, Homo sapiens
tttaaatttctattg

SEQ ID NO: 107359 - DNA, 15 bp, Homo sapiens
gtttaaatttctatt

SEQ ID NO: 107360 - DNA, 15 bp, Homo sapiens
ggtttaaatttctat

SEQ ID NO: 107361 - DNA, 15 bp, Homo sapiens
aggtttaaatttcta

SEQ ID NO: 107362 - DNA, 15 bp, Homo sapiens
aaggtttaaatttct

SEQ ID NO: 107363 - DNA, 15 bp, Homo sapiens
taaggtttaaatttc

SEQ ID NO: 107364 - DNA, 15 bp, Homo sapiens
ttaaggtttaaattt

SEQ ID NO: 107365 - DNA, 15 bp, Homo sapiens
cttaaggtttaaatt

SEQ ID NO: 107366 - DNA, 15 bp, Homo sapiens
tcttaaggtttaaat

SEQ ID NO: 107367 - DNA, 15 bp, Homo sapiens
atcttaaggtttaaa

SEQ ID NO: 107368 - DNA, 15 bp, Homo sapiens
tatcttaaggtttaa

SEQ ID NO: 107369 - DNA, 15 bp, Homo sapiens
ctatcttaaggttta

SEQ ID NO: 107370 - DNA, 15 bp, Homo sapiens
cctatcttaaggttt

SEQ ID NO: 107371 - DNA, 15 bp, Homo sapiens
tcctatcttaaggtt

SEQ ID NO: 107372 - DNA, 15 bp, Homo sapiens
ttcctatcttaaggt

SEQ ID NO: 107373 - DNA, 15 bp, Homo sapiens
tttcctatcttaagg

SEQ ID NO: 107374 - DNA, 15 bp, Homo sapiens
ctttcctatcttaag

SEQ ID NO: 107375 - DNA, 15 bp, Homo sapiens
tctttcctatcttaa

SEQ ID NO: 107376 - DNA, 15 bp, Homo sapiens
ttctttcctatctta

SEQ ID NO: 107377 - DNA, 15 bp, Homo sapiens
cttctttcctatctt

SEQ ID NO: 107378 - DNA, 15 bp, Homo sapiens
tcttctttcctatct

SEQ ID NO: 107379 - DNA, 15 bp, Homo sapiens
ttcttctttcctatc

SEQ ID NO: 107380 - DNA, 15 bp, Homo sapiens
tttcttctttcctat

SEQ ID NO: 107381 - DNA, 15 bp, Homo sapiens
atttcttctttccta

SEQ ID NO: 107382 - DNA, 15 bp, Homo sapiens
catttcttctttcct

SEQ ID NO: 107383 - DNA, 15 bp, Homo sapiens
tcatttcttctttcc

SEQ ID NO: 107384 - DNA, 15 bp, Homo sapiens
atcatttcttctttc

SEQ ID NO: 107385 - DNA, 15 bp, Homo sapiens
tatcatttcttcttt

SEQ ID NO: 107386 - DNA, 15 bp, Homo sapiens
atatcatttcttctt

SEQ ID NO: 107387 - DNA, 15 bp, Homo sapiens
tatatcatttcttct

SEQ ID NO: 107388 - DNA, 15 bp, Homo sapiens
atatatcatttcttc

SEQ ID NO: 107389 - DNA, 15 bp, Homo sapiens
tatatatcatttctt

SEQ ID NO: 107390 - DNA, 15 bp, Homo sapiens
ttatatatcatttct

SEQ ID NO: 107391 - DNA, 15 bp, Homo sapiens
cttatatatcatttc

SEQ ID NO: 107392 - DNA, 15 bp, Homo sapiens
ccttatatatcattt

SEQ ID NO: 107393 - DNA, 15 bp, Homo sapiens
gccttatatatcatt

SEQ ID NO: 107394 - DNA, 15 bp, Homo sapiens
ggccttatatatcat

SEQ ID NO: 107395 - DNA, 15 bp, Homo sapiens
aggccttatatatca

SEQ ID NO: 107396 - DNA, 15 bp, Homo sapiens
aaggccttatatatc

SEQ ID NO: 107397 - DNA, 15 bp, Homo sapiens
taaggccttatatat

SEQ ID NO: 107398 - DNA, 15 bp, Homo sapiens
ataaggccttatata

SEQ ID NO: 107399 - DNA, 15 bp, Homo sapiens
aataaggccttatat

SEQ ID NO: 107400 - DNA, 15 bp, Homo sapiens
taataaggccttata

SEQ ID NO: 107401 - DNA, 15 bp, Homo sapiens
gtaataaggccttat

SEQ ID NO: 107402 - DNA, 15 bp, Homo sapiens
agtaataaggcctta

SEQ ID NO: 107403 - DNA, 15 bp, Homo sapiens
aagtaataaggcctt

SEQ ID NO: 107404 - DNA, 15 bp, Homo sapiens
aaagtaataaggcct

SEQ ID NO: 107405 - DNA, 15 bp, Homo sapiens
aaaagtaataaggcc

SEQ ID NO: 107406 - DNA, 15 bp, Homo sapiens
aaaaagtaataaggc

SEQ ID NO: 107407 - DNA, 15 bp, Homo sapiens
aaaaaagtaataagg

SEQ ID NO: 107408 - DNA, 15 bp, Homo sapiens
taaaaaagtaataag

SEQ ID NO: 107409 - DNA, 15 bp, Homo sapiens
ctaaaaaagtaataa

SEQ ID NO: 107410 - DNA, 15 bp, Homo sapiens
actaaaaaagtaata

SEQ ID NO: 107411 - DNA, 15 bp, Homo sapiens
gactaaaaaagtaat

SEQ ID NO: 107412 - DNA, 15 bp, Homo sapiens
agactaaaaaagtaa

SEQ ID NO: 107413 - DNA, 15 bp, Homo sapiens
aagactaaaaaagta

SEQ ID NO: 107414 - DNA, 15 bp, Homo sapiens
caagactaaaaaagt

SEQ ID NO: 107415 - DNA, 15 bp, Homo sapiens
tcaagactaaaaaag

SEQ ID NO: 107416 - DNA, 15 bp, Homo sapiens
ttcaagactaaaaaa

SEQ ID NO: 107417 - DNA, 15 bp, Homo sapiens
gttcaagactaaaaa

SEQ ID NO: 107418 - DNA, 15 bp, Homo sapiens
agttcaagactaaaa

SEQ ID NO: 107419 - DNA, 15 bp, Homo sapiens
aagttcaagactaaa

SEQ ID NO: 107420 - DNA, 15 bp, Homo sapiens
aaagttcaagactaa

SEQ ID NO: 107421 - DNA, 15 bp, Homo sapiens
taaagttcaagacta

SEQ ID NO: 107422 - DNA, 15 bp, Homo sapiens
ataaagttcaagact

SEQ ID NO: 107423 - DNA, 15 bp, Homo sapiens
tataaagttcaagac

SEQ ID NO: 107424 - DNA, 15 bp, Homo sapiens
ttataaagttcaaga

SEQ ID NO: 107425 - DNA, 15 bp, Homo sapiens
attataaagttcaag

SEQ ID NO: 107426 - DNA, 15 bp, Homo sapiens
aattataaagttcaa

SEQ ID NO: 107427 - DNA, 15 bp, Homo sapiens
gaattataaagttca

SEQ ID NO: 107428 - DNA, 15 bp, Homo sapiens
tgaattataaagttc

SEQ ID NO: 107429 - DNA, 15 bp, Homo sapiens
ttgaattataaagtt

SEQ ID NO: 107430 - DNA, 15 bp, Homo sapiens
attgaattataaagt

SEQ ID NO: 107431 - DNA, 15 bp, Homo sapiens
aattgaattataaag

SEQ ID NO: 107432 - DNA, 15 bp, Homo sapiens
caattgaattataaa

SEQ ID NO: 107433 - DNA, 15 bp, Homo sapiens
tcaattgaattataa

SEQ ID NO: 107434 - DNA, 15 bp, Homo sapiens
ttcaattgaattata

SEQ ID NO: 107435 - DNA, 15 bp, Homo sapiens
attcaattgaattat

SEQ ID NO: 107436 - DNA, 15 bp, Homo sapiens
tattcaattgaatta

SEQ ID NO: 107437 - DNA, 15 bp, Homo sapiens
ctattcaattgaatt

SEQ ID NO: 107438 - DNA, 15 bp, Homo sapiens
tctattcaattgaat

SEQ ID NO: 107439 - DNA, 15 bp, Homo sapiens
ttctattcaattgaa

SEQ ID NO: 107440 - DNA, 15 bp, Homo sapiens
tttctattcaattga

SEQ ID NO: 107441 - DNA, 15 bp, Homo sapiens
atttctattcaattg

SEQ ID NO: 107442 - DNA, 15 bp, Homo sapiens
aatttctattcaatt

SEQ ID NO: 107443 - DNA, 15 bp, Homo sapiens
aaatttctattcaat

SEQ ID NO: 107444 - DNA, 15 bp, Homo sapiens
taaatttctattcaa

SEQ ID NO: 107445 - DNA, 15 bp, Homo sapiens
ttaaatttctattca

SEQ ID NO: 107446 - DNA, 15 bp, Homo sapiens
tttaaatttctattc

SEQ ID NO: 107447 - DNA, 15 bp, Homo sapiens
ttttaaatttctatt

SEQ ID NO: 107448 - DNA, 15 bp, Homo sapiens
tttttaaatttctat

SEQ ID NO: 107449 - DNA, 15 bp, Homo sapiens
atttttaaatttcta

SEQ ID NO: 107450 - DNA, 15 bp, Homo sapiens
tatttttaaatttct

SEQ ID NO: 107451 - DNA, 15 bp, Homo sapiens
ttatttttaaatttc

SEQ ID NO: 107452 - DNA, 15 bp, Homo sapiens
cattatttttaaatt

SEQ ID NO: 107453 - DNA, 15 bp, Homo sapiens
acattatttttaaat

SEQ ID NO: 107454 - DNA, 15 bp, Homo sapiens
cacattatttttaaa

SEQ ID NO: 107455 - DNA, 15 bp, Homo sapiens
ccacattatttttaa

SEQ ID NO: 107456 - DNA, 15 bp, Homo sapiens
gccacattattttta

SEQ ID NO: 107457 - DNA, 15 bp, Homo sapiens
agccacattattttt

SEQ ID NO: 107458 - DNA, 15 bp, Homo sapiens
tagccacattatttt

SEQ ID NO: 107459 - DNA, 15 bp, Homo sapiens
ttagccacattattt

SEQ ID NO: 107460 - DNA, 15 bp, Homo sapiens
cttagccacattatt

SEQ ID NO: 107461 - DNA, 15 bp, Homo sapiens
ccttagccacattat

SEQ ID NO: 107462 - DNA, 15 bp, Homo sapiens
cccttagccacatta

SEQ ID NO: 107463 - DNA, 15 bp, Homo sapiens
ccccttagccacatt

SEQ ID NO: 107464 - DNA, 15 bp, Homo sapiens
tccccttagccacat

SEQ ID NO: 107465 - DNA, 15 bp, Homo sapiens
gtccccttagccaca

SEQ ID NO: 107466 - DNA, 15 bp, Homo sapiens
tgtccccttagccac

SEQ ID NO: 107467 - DNA, 15 bp, Homo sapiens
gtgtccccttagcca

SEQ ID NO: 107468 - DNA, 15 bp, Homo sapiens
tgtgtccccttagcc

SEQ ID NO: 107469 - DNA, 15 bp, Homo sapiens
ttgtgtccccttagc

SEQ ID NO: 107470 - DNA, 15 bp, Homo sapiens
attgtgtccccttag

SEQ ID NO: 107471 - DNA, 15 bp, Homo sapiens
gattgtgtcccctta

SEQ ID NO: 107472 - DNA, 15 bp, Homo sapiens
agattgtgtcccctt

SEQ ID NO: 107473 - DNA, 15 bp, Homo sapiens
aagattgtgtcccct

SEQ ID NO: 107474 - DNA, 15 bp, Homo sapiens
taagattgtgtcccc

SEQ ID NO: 107475 - DNA, 15 bp, Homo sapiens
ctaagattgtgtccc

SEQ ID NO: 107476 - DNA, 15 bp, Homo sapiens
tctaagattgtgtcc

SEQ ID NO: 107477 - DNA, 15 bp, Homo sapiens
ttctaagattgtgtc

SEQ ID NO: 107478 - DNA, 15 bp, Homo sapiens
attctaagattgtgt

SEQ ID NO: 107479 - DNA, 15 bp, Homo sapiens
aattctaagattgtg

SEQ ID NO: 107480 - DNA, 15 bp, Homo sapiens
taattctaagattgt

SEQ ID NO: 107481 - DNA, 15 bp, Homo sapiens
ctaattctaagattg

SEQ ID NO: 107482 - DNA, 15 bp, Homo sapiens
actaattctaagatt

SEQ ID NO: 107483 - DNA, 15 bp, Homo sapiens
cactaattctaagat

SEQ ID NO: 107484 - DNA, 15 bp, Homo sapiens
acactaattctaaga

SEQ ID NO: 107485 - DNA, 15 bp, Homo sapiens
aacactaattctaag

SEQ ID NO: 107486 - DNA, 15 bp, Homo sapiens
gaacactaattctaa

SEQ ID NO: 107487 - DNA, 15 bp, Homo sapiens
agaacactaattcta

SEQ ID NO: 107488 - DNA, 15 bp, Homo sapiens
cagaacactaattct

SEQ ID NO: 107489 - DNA, 15 bp, Homo sapiens
gcagaacactaattc

SEQ ID NO: 107490 - DNA, 15 bp, Homo sapiens
agcagaacactaatt

SEQ ID NO: 107491 - DNA, 15 bp, Homo sapiens
aagcagaacactaat

SEQ ID NO: 107492 - DNA, 15 bp, Homo sapiens
caagcagaacactaa

SEQ ID NO: 107493 - DNA, 15 bp, Homo sapiens
tcaagcagaacacta

SEQ ID NO: 107494 - DNA, 15 bp, Homo sapiens
ctcaagcagaacact

SEQ ID NO: 107495 - DNA, 15 bp, Homo sapiens
tctcaagcagaacac

SEQ ID NO: 107496 - DNA, 15 bp, Homo sapiens
ttctcaagcagaaca

SEQ ID NO: 107497 - DNA, 15 bp, Homo sapiens
attctcaagcagaac

SEQ ID NO: 107498 - DNA, 15 bp, Homo sapiens
gattctcaagcagaa

SEQ ID NO: 107499 - DNA, 15 bp, Homo sapiens
tgattctcaagcaga

SEQ ID NO: 107500 - DNA, 15 bp, Homo sapiens
gtgattctcaagcag

SEQ ID NO: 107501 - DNA, 15 bp, Homo sapiens
tgtgattctcaagca

SEQ ID NO: 107502 - DNA, 15 bp, Homo sapiens
ctgtgattctcaagc

SEQ ID NO: 107503 - DNA, 15 bp, Homo sapiens
tctgtgattctcaag

SEQ ID NO: 107504 - DNA, 15 bp, Homo sapiens
ttctgtgattctcaa

SEQ ID NO: 107505 - DNA, 15 bp, Homo sapiens
gttctgtgattctca

SEQ ID NO: 107506 - DNA, 15 bp, Homo sapiens
agttctgtgattctc

SEQ ID NO: 107507 - DNA, 15 bp, Homo sapiens
aagttctgtgattct

SEQ ID NO: 107508 - DNA, 15 bp, Homo sapiens
taagttctgtgattc

SEQ ID NO: 107509 - DNA, 15 bp, Homo sapiens
ttaagttctgtgatt

SEQ ID NO: 107510 - DNA, 15 bp, Homo sapiens
cttaagttctgtgat

SEQ ID NO: 107511 - DNA, 15 bp, Homo sapiens
tcttaagttctgtga

SEQ ID NO: 107512 - DNA, 15 bp, Homo sapiens
atcttaagttctgtg

SEQ ID NO: 107513 - DNA, 15 bp, Homo sapiens
catcttaagttctgt

SEQ ID NO: 107514 - DNA, 15 bp, Homo sapiens
tcatcttaagttctg

SEQ ID NO: 107515 - DNA, 15 bp, Homo sapiens
ctcatcttaagttct

SEQ ID NO: 107516 - DNA, 15 bp, Homo sapiens
tctcatcttaagttc

SEQ ID NO: 107517 - DNA, 15 bp, Homo sapiens
gtctcatcttaagtt

SEQ ID NO: 107518 - DNA, 15 bp, Homo sapiens
agtctcatcttaagt

SEQ ID NO: 107519 - DNA, 15 bp, Homo sapiens
gagtctcatcttaag

SEQ ID NO: 107520 - DNA, 15 bp, Homo sapiens
agagtctcatcttaa

SEQ ID NO: 107521 - DNA, 15 bp, Homo sapiens
aagagtctcatctta

SEQ ID NO: 107522 - DNA, 15 bp, Homo sapiens
aaagagtctcatctt

SEQ ID NO: 107523 - DNA, 15 bp, Homo sapiens
taaagagtctcatct

SEQ ID NO: 107524 - DNA, 15 bp, Homo sapiens
ctaaagagtctcatc

SEQ ID NO: 107525 - DNA, 15 bp, Homo sapiens
cctaaagagtctcat

SEQ ID NO: 107526 - DNA, 15 bp, Homo sapiens
tcctaaagagtctca

SEQ ID NO: 107527 - DNA, 15 bp, Homo sapiens
gtcctaaagagtctc

SEQ ID NO: 107528 - DNA, 15 bp, Homo sapiens
tgtcctaaagagtct

SEQ ID NO: 107529 - DNA, 15 bp, Homo sapiens
ctgtcctaaagagtc

SEQ ID NO: 107530 - DNA, 15 bp, Homo sapiens
cctgtcctaaagagt

SEQ ID NO: 107531 - DNA, 15 bp, Homo sapiens
tcctgtcctaaagag

SEQ ID NO: 107532 - DNA, 15 bp, Homo sapiens
ctcctgtcctaaaga

SEQ ID NO: 107533 - DNA, 15 bp, Homo sapiens
tctcctgtcctaaag

SEQ ID NO: 107534 - DNA, 15 bp, Homo sapiens
ctctcctgtcctaaa

SEQ ID NO: 107535 - DNA, 15 bp, Homo sapiens
cctctcctgtcctaa

SEQ ID NO: 107536 - DNA, 15 bp, Homo sapiens
acctctcctgtccta

SEQ ID NO: 107537 - DNA, 15 bp, Homo sapiens
tacctctcctgtcct

SEQ ID NO: 107538 - DNA, 15 bp, Homo sapiens
atacctctcctgtcc

SEQ ID NO: 107539 - DNA, 15 bp, Homo sapiens
tatacctctcctgtc

SEQ ID NO: 107540 - DNA, 15 bp, Homo sapiens
ctatacctctcctgt

SEQ ID NO: 107541 - DNA, 15 bp, Homo sapiens
cctatacctctcctg

SEQ ID NO: 107542 - DNA, 15 bp, Homo sapiens
ccctatacctctcct

SEQ ID NO: 107543 - DNA, 15 bp, Homo sapiens
tccctatacctctcc

SEQ ID NO: 107544 - DNA, 15 bp, Homo sapiens
gtccctatacctctc

SEQ ID NO: 107545 - DNA, 15 bp, Homo sapiens
tgtccctatacctct

SEQ ID NO: 107546 - DNA, 15 bp, Homo sapiens
ctgtccctatacctc

SEQ ID NO: 107547 - DNA, 15 bp, Homo sapiens
actgtccctatacct

SEQ ID NO: 107548 - DNA, 15 bp, Homo sapiens
aactgtccctatacc

SEQ ID NO: 107549 - DNA, 15 bp, Homo sapiens
gaactgtccctatac

SEQ ID NO: 107550 - DNA, 15 bp, Homo sapiens
agaactgtccctata

SEQ ID NO: 107551 - DNA, 15 bp, Homo sapiens
aagaactgtccctat

SEQ ID NO: 107552 - DNA, 15 bp, Homo sapiens
aaagaactgtcccta

SEQ ID NO: 107553 - DNA, 15 bp, Homo sapiens
caaagaactgtccct

SEQ ID NO: 107554 - DNA, 15 bp, Homo sapiens
acaaagaactgtccc

SEQ ID NO: 107555 - DNA, 15 bp, Homo sapiens
cacaaagaactgtcc

SEQ ID NO: 107556 - DNA, 15 bp, Homo sapiens
gcacaaagaactgtc

SEQ ID NO: 107557 - DNA, 15 bp, Homo sapiens
agcacaaagaactgt

SEQ ID NO: 107558 - DNA, 15 bp, Homo sapiens
aagcacaaagaactg

SEQ ID NO: 107559 - DNA, 15 bp, Homo sapiens
aaagcacaaagaact

SEQ ID NO: 107560 - DNA, 15 bp, Homo sapiens
aaaagcacaaagaac

SEQ ID NO: 107561 - DNA, 15 bp, Homo sapiens
gaaaagcacaaagaa

SEQ ID NO: 107562 - DNA, 15 bp, Homo sapiens
tgaaaagcacaaaga

SEQ ID NO: 107563 - DNA, 15 bp, Homo sapiens
ttgaaaagcacaaag

SEQ ID NO: 107564 - DNA, 15 bp, Homo sapiens
tttgaaaagcacaaa

SEQ ID NO: 107565 - DNA, 15 bp, Homo sapiens
ttttgaaaagcacaa

SEQ ID NO: 107566 - DNA, 15 bp, Homo sapiens
gttttgaaaagcaca

SEQ ID NO: 107567 - DNA, 15 bp, Homo sapiens
tgttttgaaaagcac

SEQ ID NO: 107568 - DNA, 15 bp, Homo sapiens
ttgttttgaaaagca

SEQ ID NO: 107569 - DNA, 15 bp, Homo sapiens
tttgttttgaaaagc

SEQ ID NO: 107570 - DNA, 15 bp, Homo sapiens
ctttgttttgaaaag

SEQ ID NO: 107571 - DNA, 15 bp, Homo sapiens
cctttgttttgaaaa

SEQ ID NO: 107572 - DNA, 15 bp, Homo sapiens
tcctttgttttgaaa

SEQ ID NO: 107573 - DNA, 15 bp, Homo sapiens
atcctttgttttgaa

SEQ ID NO: 107574 - DNA, 15 bp, Homo sapiens
tatcctttgttttga

SEQ ID NO: 107575 - DNA, 15 bp, Homo sapiens
ttatcctttgttttg

SEQ ID NO: 107576 - DNA, 15 bp, Homo sapiens
tttatcctttgtttt

SEQ ID NO: 107577 - DNA, 15 bp, Homo sapiens
atttatcctttgttt

SEQ ID NO: 107578 - DNA, 15 bp, Homo sapiens
aatttatcctttgtt

SEQ ID NO: 107579 - DNA, 15 bp, Homo sapiens
aaatttatcctttgt

SEQ ID NO: 107580 - DNA, 15 bp, Homo sapiens
aaaatttatcctttg

SEQ ID NO: 107581 - DNA, 15 bp, Homo sapiens
taaaatttatccttt

SEQ ID NO: 107582 - DNA, 15 bp, Homo sapiens
ttaaaatttatcctt

SEQ ID NO: 107583 - DNA, 15 bp, Homo sapiens
attaaaatttatcct

SEQ ID NO: 107584 - DNA, 15 bp, Homo sapiens
tattaaaatttatcc

SEQ ID NO: 107585 - DNA, 15 bp, Homo sapiens
atattaaaatttatc

SEQ ID NO: 107586 - DNA, 15 bp, Homo sapiens
tatattaaaatttat

SEQ ID NO: 107587 - DNA, 15 bp, Homo sapiens
atatattaaaattta

SEQ ID NO: 107588 - DNA, 15 bp, Homo sapiens
tatatattaaaattt

SEQ ID NO: 107589 - DNA, 15 bp, Homo sapiens
atatatattaaaatt

SEQ ID NO: 107590 - DNA, 15 bp, Homo sapiens
catatatattaaaat

SEQ ID NO: 107591 - DNA, 15 bp, Homo sapiens
acatatatattaaaa

SEQ ID NO: 107592 - DNA, 15 bp, Homo sapiens
cacatatatattaaa

SEQ ID NO: 107593 - DNA, 15 bp, Homo sapiens
gcacatatatattaa

SEQ ID NO: 107594 - DNA, 15 bp, Homo sapiens
tgcacatatatatta

SEQ ID NO: 107595 - DNA, 15 bp, Homo sapiens
atgcacatatatatt

SEQ ID NO: 107596 - DNA, 15 bp, Homo sapiens
catgcacatatatat

SEQ ID NO: 107597 - DNA, 15 bp, Homo sapiens
acatgcacatatata

SEQ ID NO: 107598 - DNA, 15 bp, Homo sapiens
atacatgcacatata

SEQ ID NO: 107599 - DNA, 15 bp, Homo sapiens
catacatgcacatat

SEQ ID NO: 107600 - DNA, 15 bp, Homo sapiens
acatacatgcacata

SEQ ID NO: 107601 - DNA, 15 bp, Homo sapiens
tacatacatgcacat

SEQ ID NO: 107602 - DNA, 15 bp, Homo sapiens
ttacatacatgcaca

SEQ ID NO: 107603 - DNA, 15 bp, Homo sapiens
cttacatacatgcac

SEQ ID NO: 107604 - DNA, 15 bp, Homo sapiens
acttacatacatgca

SEQ ID NO: 107605 - DNA, 15 bp, Homo sapiens
tacttacatacatgc

SEQ ID NO: 107606 - DNA, 15 bp, Homo sapiens
atacttacatacatg

SEQ ID NO: 107607 - DNA, 15 bp, Homo sapiens
aatacttacatacat

SEQ ID NO: 107608 - DNA, 15 bp, Homo sapiens
aaatacttacataca

SEQ ID NO: 107609 - DNA, 15 bp, Homo sapiens
taaatacttacatac

SEQ ID NO: 107610 - DNA, 15 bp, Homo sapiens
ataaatacttacata

SEQ ID NO: 107611 - DNA, 15 bp, Homo sapiens
aataaatacttacat

SEQ ID NO: 107612 - DNA, 15 bp, Homo sapiens
aaataaatacttaca

SEQ ID NO: 107613 - DNA, 15 bp, Homo sapiens
caaataaatacttac

SEQ ID NO: 107614 - DNA, 15 bp, Homo sapiens
tcaaataaatactta

SEQ ID NO: 107615 - DNA, 15 bp, Homo sapiens
atcaaataaatactt

SEQ ID NO: 107616 - DNA, 15 bp, Homo sapiens
aatcaaataaatact

SEQ ID NO: 107617 - DNA, 15 bp, Homo sapiens
taatcaaataaatac

SEQ ID NO: 107618 - DNA, 15 bp, Homo sapiens
ataatcaaataaata

SEQ ID NO: 107619 - DNA, 15 bp, Homo sapiens
aataatcaaataaat

SEQ ID NO: 107620 - DNA, 15 bp, Homo sapiens
caataatcaaataaa

SEQ ID NO: 107621 - DNA, 15 bp, Homo sapiens
acaataatcaaataa

SEQ ID NO: 107622 - DNA, 15 bp, Homo sapiens
cacaataatcaaata

SEQ ID NO: 107623 - DNA, 15 bp, Homo sapiens
tcacaataatcaaat

SEQ ID NO: 107624 - DNA, 15 bp, Homo sapiens
gtcacaataatcaaa

SEQ ID NO: 107625 - DNA, 15 bp, Homo sapiens
tgtcacaataatcaa

SEQ ID NO: 107626 - DNA, 15 bp, Homo sapiens
atgtcacaataatca

SEQ ID NO: 107627 - DNA, 15 bp, Homo sapiens
tatgtcacaataatc

SEQ ID NO: 107628 - DNA, 15 bp, Homo sapiens
ttatgtcacaataat

SEQ ID NO: 107629 - DNA, 15 bp, Homo sapiens
attatgtcacaataa

SEQ ID NO: 107630 - DNA, 15 bp, Homo sapiens
cattatgtcacaata

SEQ ID NO: 107631 - DNA, 15 bp, Homo sapiens
ccattatgtcacaat

SEQ ID NO: 107632 - DNA, 15 bp, Homo sapiens
accattatgtcacaa

SEQ ID NO: 107633 - DNA, 15 bp, Homo sapiens
taccattatgtcaca

SEQ ID NO: 107634 - DNA, 15 bp, Homo sapiens
ttaccattatgtcac

SEQ ID NO: 107635 - DNA, 15 bp, Homo sapiens
attaccattatgtca

SEQ ID NO: 107636 - DNA, 15 bp, Homo sapiens
gattaccattatgtc

SEQ ID NO: 107637 - DNA, 15 bp, Homo sapiens
tgattaccattatgt

SEQ ID NO: 107638 - DNA, 15 bp, Homo sapiens
ctgattaccattatg

SEQ ID NO: 107639 - DNA, 15 bp, Homo sapiens
tctgattaccattat

SEQ ID NO: 107640 - DNA, 15 bp, Homo sapiens
ctctgattaccatta

SEQ ID NO: 107641 - DNA, 15 bp, Homo sapiens
tctctgattaccatt

SEQ ID NO: 107642 - DNA, 15 bp, Homo sapiens
ttctctgattaccat

SEQ ID NO: 107643 - DNA, 15 bp, Homo sapiens
tttctctgattacca

SEQ ID NO: 107644 - DNA, 15 bp, Homo sapiens
ctttctctgattacc

SEQ ID NO: 107645 - DNA, 15 bp, Homo sapiens
actttctctgattac

SEQ ID NO: 107646 - DNA, 15 bp, Homo sapiens
cactttctctgatta

SEQ ID NO: 107647 - DNA, 15 bp, Homo sapiens
gcactttctctgatt

SEQ ID NO: 107648 - DNA, 15 bp, Homo sapiens
agcactttctctgat

SEQ ID NO: 107649 - DNA, 15 bp, Homo sapiens
cagcactttctctga

SEQ ID NO: 107650 - DNA, 15 bp, Homo sapiens
acagcactttctctg

SEQ ID NO: 107651 - DNA, 15 bp, Homo sapiens
gacagcactttctct

SEQ ID NO: 107652 - DNA, 15 bp, Homo sapiens
ggacagcactttctc

SEQ ID NO: 107653 - DNA, 15 bp, Homo sapiens
aggacagcactttct

SEQ ID NO: 107654 - DNA, 15 bp, Homo sapiens
aaggacagcactttc

SEQ ID NO: 107655 - DNA, 15 bp, Homo sapiens
caaggacagcacttt

SEQ ID NO: 107656 - DNA, 15 bp, Homo sapiens
tcaaggacagcactt

SEQ ID NO: 107657 - DNA, 15 bp, Homo sapiens
gtcaaggacagcact

SEQ ID NO: 107658 - DNA, 15 bp, Homo sapiens
agtcaaggacagcac

SEQ ID NO: 107659 - DNA, 15 bp, Homo sapiens
aagtcaaggacagca

SEQ ID NO: 107660 - DNA, 15 bp, Homo sapiens
gaagtcaaggacagc

SEQ ID NO: 107661 - DNA, 15 bp, Homo sapiens
tgaagtcaaggacag

SEQ ID NO: 107662 - DNA, 15 bp, Homo sapiens
atgaagtcaaggaca

SEQ ID NO: 107663 - DNA, 15 bp, Homo sapiens
catgaagtcaaggac

SEQ ID NO: 107664 - DNA, 15 bp, Homo sapiens
ccatgaagtcaagga

SEQ ID NO: 107665 - DNA, 15 bp, Homo sapiens
tccatgaagtcaagg

SEQ ID NO: 107666 - DNA, 15 bp, Homo sapiens
ttccatgaagtcaag

SEQ ID NO: 107667 - DNA, 15 bp, Homo sapiens
gttccatgaagtcaa

SEQ ID NO: 107668 - DNA, 15 bp, Homo sapiens
tgttccatgaagtca

SEQ ID NO: 107669 - DNA, 15 bp, Homo sapiens
atgttccatgaagtc

SEQ ID NO: 107670 - DNA, 15 bp, Homo sapiens
tatgttccatgaagt

SEQ ID NO: 107671 - DNA, 15 bp, Homo sapiens
gtatgttccatgaag

SEQ ID NO: 107672 - DNA, 15 bp, Homo sapiens
tgtatgttccatgaa

SEQ ID NO: 107673 - DNA, 15 bp, Homo sapiens
atgtatgttccatga

SEQ ID NO: 107674 - DNA, 15 bp, Homo sapiens
tatgtatgttccatg

SEQ ID NO: 107675 - DNA, 15 bp, Homo sapiens
ctatgtatgttccat

SEQ ID NO: 107676 - DNA, 15 bp, Homo sapiens
actatgtatgttcca

SEQ ID NO: 107677 - DNA, 15 bp, Homo sapiens
aactatgtatgttcc

SEQ ID NO: 107678 - DNA, 15 bp, Homo sapiens
gaactatgtatgttc

SEQ ID NO: 107679 - DNA, 15 bp, Homo sapiens
tgaactatgtatgtt

SEQ ID NO: 107680 - DNA, 15 bp, Homo sapiens
ctgaactatgtatgt

SEQ ID NO: 107681 - DNA, 15 bp, Homo sapiens
cctgaactatgtatg

SEQ ID NO: 107682 - DNA, 15 bp, Homo sapiens
ccctgaactatgtat

SEQ ID NO: 107683 - DNA, 15 bp, Homo sapiens
cccctgaactatgta

SEQ ID NO: 107684 - DNA, 15 bp, Homo sapiens
acccctgaactatgt

SEQ ID NO: 107685 - DNA, 15 bp, Homo sapiens
gacccctgaactatg

SEQ ID NO: 107686 - DNA, 15 bp, Homo sapiens
agacccctgaactat

SEQ ID NO: 107687 - DNA, 15 bp, Homo sapiens
cagacccctgaacta

SEQ ID NO: 107688 - DNA, 15 bp, Homo sapiens
acagacccctgaact

SEQ ID NO: 107689 - DNA, 15 bp, Homo sapiens
aacagacccctgaac

SEQ ID NO: 107690 - DNA, 15 bp, Homo sapiens
taacagacccctgaa

SEQ ID NO: 107691 - DNA, 15 bp, Homo sapiens
gtaacagacccctga

SEQ ID NO: 107692 - DNA, 15 bp, Homo sapiens
tgtaacagacccctg

SEQ ID NO: 107693 - DNA, 15 bp, Homo sapiens
atgtaacagacccct

SEQ ID NO: 107694 - DNA, 15 bp, Homo sapiens
catgtaacagacccc

SEQ ID NO: 107695 - DNA, 15 bp, Homo sapiens
tcatgtaacagaccc

SEQ ID NO: 107696 - DNA, 15 bp, Homo sapiens
gtcatgtaacagacc

SEQ ID NO: 107697 - DNA, 15 bp, Homo sapiens
tgtcatgtaacagac

SEQ ID NO: 107698 - DNA, 15 bp, Homo sapiens
ctgtcatgtaacaga

SEQ ID NO: 107699 - DNA, 15 bp, Homo sapiens
gctgtcatgtaacag

SEQ ID NO: 107700 - DNA, 15 bp, Homo sapiens
cgctgtcatgtaaca

SEQ ID NO: 107701 - DNA, 15 bp, Homo sapiens
acgctgtcatgtaac

SEQ ID NO: 107702 - DNA, 15 bp, Homo sapiens
gacgctgtcatgtaa

SEQ ID NO: 107703 - DNA, 15 bp, Homo sapiens
ggacgctgtcatgta

SEQ ID NO: 107704 - DNA, 15 bp, Homo sapiens
aggacgctgtcatgt

SEQ ID NO: 107705 - DNA, 15 bp, Homo sapiens
taggacgctgtcatg

SEQ ID NO: 107706 - DNA, 15 bp, Homo sapiens
ataggacgctgtcat

SEQ ID NO: 107707 - DNA, 15 bp, Homo sapiens
cataggacgctgtca

SEQ ID NO: 107708 - DNA, 15 bp, Homo sapiens
tcataggacgctgtc

SEQ ID NO: 107709 - DNA, 15 bp, Homo sapiens
ctcataggacgctgt

SEQ ID NO: 107710 - DNA, 15 bp, Homo sapiens
tctcataggacgctg

SEQ ID NO: 107711 - DNA, 15 bp, Homo sapiens
atctcataggacgct

SEQ ID NO: 107712 - DNA, 15 bp, Homo sapiens
catctcataggacgc

SEQ ID NO: 107713 - DNA, 15 bp, Homo sapiens
acatctcataggacg

SEQ ID NO: 107714 - DNA, 15 bp, Homo sapiens
aacatctcataggac

SEQ ID NO: 107715 - DNA, 15 bp, Homo sapiens
caacatctcatagga

SEQ ID NO: 107716 - DNA, 15 bp, Homo sapiens
tcaacatctcatagg

SEQ ID NO: 107717 - DNA, 15 bp, Homo sapiens
ctcaacatctcatag

SEQ ID NO: 107718 - DNA, 15 bp, Homo sapiens
tctcaacatctcata

SEQ ID NO: 107719 - DNA, 15 bp, Homo sapiens
atctcaacatctcat

SEQ ID NO: 107720 - DNA, 15 bp, Homo sapiens
catctcaacatctca

SEQ ID NO: 107721 - DNA, 15 bp, Homo sapiens
tcatctcaacatctc

SEQ ID NO: 107722 - DNA, 15 bp, Homo sapiens
atcatctcaacatct

SEQ ID NO: 107723 - DNA, 15 bp, Homo sapiens
catcatctcaacatc

SEQ ID NO: 107724 - DNA, 15 bp, Homo sapiens
tcatcatctcaacat

SEQ ID NO: 107725 - DNA, 15 bp, Homo sapiens
atcatcatctcaaca

SEQ ID NO: 107726 - DNA, 15 bp, Homo sapiens
catcatcatctcaac

SEQ ID NO: 107727 - DNA, 15 bp, Homo sapiens
acatcatcatctcaa

SEQ ID NO: 107728 - DNA, 15 bp, Homo sapiens
tacatcatcatctca

SEQ ID NO: 107729 - DNA, 15 bp, Homo sapiens
atacatcatcatctc

SEQ ID NO: 107730 - DNA, 15 bp, Homo sapiens
tatacatcatcatct

SEQ ID NO: 107731 - DNA, 15 bp, Homo sapiens
ctatacatcatcatc

SEQ ID NO: 107732 - DNA, 15 bp, Homo sapiens
cctatacatcatcat

SEQ ID NO: 107733 - DNA, 15 bp, Homo sapiens
acctatacatcatca

SEQ ID NO: 107734 - DNA, 15 bp, Homo sapiens
cacctatacatcatc

SEQ ID NO: 107735 - DNA, 15 bp, Homo sapiens
acacctatacatcat

SEQ ID NO: 107736 - DNA, 15 bp, Homo sapiens
gacacctatacatca

SEQ ID NO: 107737 - DNA, 15 bp, Homo sapiens
tgacacctatacatc

SEQ ID NO: 107738 - DNA, 15 bp, Homo sapiens
ttgacacctatacat

SEQ ID NO: 107739 - DNA, 15 bp, Homo sapiens
cttgacacctataca

SEQ ID NO: 107740 - DNA, 15 bp, Homo sapiens
tcttgacacctatac

SEQ ID NO: 107741 - DNA, 15 bp, Homo sapiens
ctcttgacacctata

SEQ ID NO: 107742 - DNA, 15 bp, Homo sapiens
tctcttgacacctat

SEQ ID NO: 107743 - DNA, 15 bp, Homo sapiens
ttctcttgacaccta

SEQ ID NO: 107744 - DNA, 15 bp, Homo sapiens
cttctcttgacacct

SEQ ID NO: 107745 - DNA, 15 bp, Homo sapiens
gcttctcttgacacc

SEQ ID NO: 107746 - DNA, 15 bp, Homo sapiens
agcttctcttgacac

SEQ ID NO: 107747 - DNA, 15 bp, Homo sapiens
cagcttctcttgaca

SEQ ID NO: 107748 - DNA, 15 bp, Homo sapiens
acagcttctcttgac

SEQ ID NO: 107749 - DNA, 15 bp, Homo sapiens
aacagcttctcttga

SEQ ID NO: 107750 - DNA, 15 bp, Homo sapiens
aaacagcttctcttg

SEQ ID NO: 107751 - DNA, 15 bp, Homo sapiens
taaacagcttctctt

SEQ ID NO: 107752 - DNA, 15 bp, Homo sapiens
ctaaacagcttctct

SEQ ID NO: 107753 - DNA, 15 bp, Homo sapiens
tctaaacagcttctc

SEQ ID NO: 107754 - DNA, 15 bp, Homo sapiens
ttctaaacagcttct

SEQ ID NO: 107755 - DNA, 15 bp, Homo sapiens
attctaaacagcttc

SEQ ID NO: 107756 - DNA, 15 bp, Homo sapiens
tattctaaacagctt

SEQ ID NO: 107757 - DNA, 15 bp, Homo sapiens
ttattctaaacagct

SEQ ID NO: 107758 - DNA, 15 bp, Homo sapiens
tttattctaaacagc

SEQ ID NO: 107759 - DNA, 15 bp, Homo sapiens
ctttattctaaacag

SEQ ID NO: 107760 - DNA, 15 bp, Homo sapiens
gctttattctaaaca

SEQ ID NO: 107761 - DNA, 15 bp, Homo sapiens
agctttattctaaac

SEQ ID NO: 107762 - DNA, 15 bp, Homo sapiens
aagctttattctaaa

SEQ ID NO: 107763 - DNA, 15 bp, Homo sapiens
aaagctttattctaa

SEQ ID NO: 107764 - DNA, 15 bp, Homo sapiens
aaaagctttattcta

SEQ ID NO: 107765 - DNA, 15 bp, Homo sapiens
aaaaagctttattct

SEQ ID NO: 107766 - DNA, 15 bp, Homo sapiens
caaaaagctttattc

SEQ ID NO: 107767 - DNA, 15 bp, Homo sapiens
ccaaaaagctttatt

SEQ ID NO: 107768 - DNA, 15 bp, Homo sapiens
accaaaaagctttat

SEQ ID NO: 107769 - DNA, 15 bp, Homo sapiens
aaccaaaaagcttta

SEQ ID NO: 107770 - DNA, 15 bp, Homo sapiens
aaaccaaaaagcttt

SEQ ID NO: 107771 - DNA, 15 bp, Homo sapiens
gaaaccaaaaagctt

SEQ ID NO: 107772 - DNA, 15 bp, Homo sapiens
tgaaaccaaaaagct

SEQ ID NO: 107773 - DNA, 15 bp, Homo sapiens
ctgaaaccaaaaagc

SEQ ID NO: 107774 - DNA, 15 bp, Homo sapiens
cctgaaaccaaaaag

SEQ ID NO: 107775 - DNA, 15 bp, Homo sapiens
acctgaaaccaaaaa

SEQ ID NO: 107776 - DNA, 15 bp, Homo sapiens
tacctgaaaccaaaa

SEQ ID NO: 107777 - DNA, 15 bp, Homo sapiens
ttacctgaaaccaaa

SEQ ID NO: 107778 - DNA, 15 bp, Homo sapiens
gttacctgaaaccaa

SEQ ID NO: 107779 - DNA, 15 bp, Homo sapiens
agttacctgaaacca

SEQ ID NO: 107780 - DNA, 15 bp, Homo sapiens
tagttacctgaaacc

SEQ ID NO: 107781 - DNA, 15 bp, Homo sapiens
ctagttacctgaaac

SEQ ID NO: 107782 - DNA, 15 bp, Homo sapiens
cctagttacctgaaa

SEQ ID NO: 107783 - DNA, 15 bp, Homo sapiens
tcctagttacctgaa

SEQ ID NO: 107784 - DNA, 15 bp, Homo sapiens
ttcctagttacctga

SEQ ID NO: 107785 - DNA, 15 bp, Homo sapiens
cttcctagttacctg

SEQ ID NO: 107786 - DNA, 15 bp, Homo sapiens
tcttcctagttacct

SEQ ID NO: 107787 - DNA, 15 bp, Homo sapiens
ttcttcctagttacc

SEQ ID NO: 107788 - DNA, 15 bp, Homo sapiens
cttcttcctagttac

SEQ ID NO: 107789 - DNA, 15 bp, Homo sapiens
tcttcttcctagtta

SEQ ID NO: 107790 - DNA, 15 bp, Homo sapiens
gtcttcttcctagtt

SEQ ID NO: 107791 - DNA, 15 bp, Homo sapiens
tgtcttcttcctagt

SEQ ID NO: 107792 - DNA, 15 bp, Homo sapiens
ctgtcttcttcctag

SEQ ID NO: 107793 - DNA, 15 bp, Homo sapiens
gctgtcttcttccta

SEQ ID NO: 107794 - DNA, 15 bp, Homo sapiens
agctgtcttcttcct

SEQ ID NO: 107795 - DNA, 15 bp, Homo sapiens
gagctgtcttcttcc

SEQ ID NO: 107796 - DNA, 15 bp, Homo sapiens
agagctgtcttcttc

SEQ ID NO: 107797 - DNA, 15 bp, Homo sapiens
cagagctgtcttctt

SEQ ID NO: 107798 - DNA, 15 bp, Homo sapiens
tcagagctgtcttct

SEQ ID NO: 107799 - DNA, 15 bp, Homo sapiens
ttcagagctgtcttc

SEQ ID NO: 107800 - DNA, 15 bp, Homo sapiens
attcagagctgtctt

SEQ ID NO: 107801 - DNA, 15 bp, Homo sapiens
aattcagagctgtct

SEQ ID NO: 107802 - DNA, 15 bp, Homo sapiens
aaattcagagctgtc

SEQ ID NO: 107803 - DNA, 15 bp, Homo sapiens
caaattcagagctgt

SEQ ID NO: 107804 - DNA, 15 bp, Homo sapiens
tcaaattcagagctg

SEQ ID NO: 107805 - DNA, 15 bp, Homo sapiens
gtcaaattcagagct

SEQ ID NO: 107806 - DNA, 15 bp, Homo sapiens
ggtcaaattcagagc

SEQ ID NO: 107807 - DNA, 15 bp, Homo sapiens
aggtcaaattcagag

SEQ ID NO: 107808 - DNA, 15 bp, Homo sapiens
taggtcaaattcaga

SEQ ID NO: 107809 - DNA, 15 bp, Homo sapiens
gtaggtcaaattcag

SEQ ID NO: 107810 - DNA, 15 bp, Homo sapiens
tgtaggtcaaattca

SEQ ID NO: 107811 - DNA, 15 bp, Homo sapiens
ctgtaggtcaaattc

SEQ ID NO: 107812 - DNA, 15 bp, Homo sapiens
tctgtaggtcaaatt

SEQ ID NO: 107813 - DNA, 15 bp, Homo sapiens
ttctgtaggtcaaat

SEQ ID NO: 107814 - DNA, 15 bp, Homo sapiens
gttctgtaggtcaaa

SEQ ID NO: 107815 - DNA, 15 bp, Homo sapiens
agttctgtaggtcaa

SEQ ID NO: 107816 - DNA, 15 bp, Homo sapiens
tagttctgtaggtca

SEQ ID NO: 107817 - DNA, 15 bp, Homo sapiens
gtagttctgtaggtc

SEQ ID NO: 107818 - DNA, 15 bp, Homo sapiens
cgtagttctgtaggt

SEQ ID NO: 107819 - DNA, 15 bp, Homo sapiens
tcgtagttctgtagg

SEQ ID NO: 107820 - DNA, 15 bp, Homo sapiens
atcgtagttctgtag

SEQ ID NO: 107821 - DNA, 15 bp, Homo sapiens
aatcgtagttctgta

SEQ ID NO: 107822 - DNA, 15 bp, Homo sapiens
aaatcgtagttctgt

SEQ ID NO: 107823 - DNA, 15 bp, Homo sapiens
gaaatcgtagttctg

SEQ ID NO: 107824 - DNA, 15 bp, Homo sapiens
agaaatcgtagttct

SEQ ID NO: 107825 - DNA, 15 bp, Homo sapiens
aagaaatcgtagttc

SEQ ID NO: 107826 - DNA, 15 bp, Homo sapiens
aaagaaatcgtagtt

SEQ ID NO: 107827 - DNA, 15 bp, Homo sapiens
aaaagaaatcgtagt

SEQ ID NO: 107828 - DNA, 15 bp, Homo sapiens
aaaaagaaatcgtag

SEQ ID NO: 107829 - DNA, 15 bp, Homo sapiens
aaaaaagaaatcgta

SEQ ID NO: 107830 - DNA, 15 bp, Homo sapiens
aaaaaaagaaatcgt

SEQ ID NO: 107831 - DNA, 15 bp, Homo sapiens
taaaaaaagaaatcg

SEQ ID NO: 107832 - DNA, 15 bp, Homo sapiens
ataaaaaaagaaatc

SEQ ID NO: 107833 - DNA, 15 bp, Homo sapiens
tataaaaaaagaaat

SEQ ID NO: 107834 - DNA, 15 bp, Homo sapiens
atataaaaaaagaaa

SEQ ID NO: 107835 - DNA, 15 bp, Homo sapiens
aatataaaaaaagaa

SEQ ID NO: 107836 - DNA, 15 bp, Homo sapiens
aaatataaaaaaaga

SEQ ID NO: 107837 - DNA, 15 bp, Homo sapiens
taaatataaaaaaag

SEQ ID NO: 107838 - DNA, 15 bp, Homo sapiens
ttaaatataaaaaaa

SEQ ID NO: 107839 - DNA, 15 bp, Homo sapiens
tttaaatataaaaaa

SEQ ID NO: 107840 - DNA, 15 bp, Homo sapiens
atttaaatataaaaa

SEQ ID NO: 107841 - DNA, 15 bp, Homo sapiens
aatttaaatataaaa

SEQ ID NO: 107842 - DNA, 15 bp, Homo sapiens
aaatttaaatataaa

SEQ ID NO: 107843 - DNA, 15 bp, Homo sapiens
taaatttaaatataa

SEQ ID NO: 107844 - DNA, 15 bp, Homo sapiens
ataaatttaaatata

SEQ ID NO: 107845 - DNA, 15 bp, Homo sapiens
aataaatttaaatat

SEQ ID NO: 107846 - DNA, 15 bp, Homo sapiens
aaataaatttaaata

SEQ ID NO: 107847 - DNA, 15 bp, Homo sapiens
aaaataaatttaaat

SEQ ID NO: 107848 - DNA, 15 bp, Homo sapiens
aaaaataaatttaaa

SEQ ID NO: 107849 - DNA, 15 bp, Homo sapiens
taaaaataaatttaa

SEQ ID NO: 107850 - DNA, 15 bp, Homo sapiens
ataaaaataaattta

SEQ ID NO: 107851 - DNA, 15 bp, Homo sapiens
aataaaaataaattt

SEQ ID NO: 107852 - DNA, 15 bp, Homo sapiens
aaataaaaataaatt

SEQ ID NO: 107853 - DNA, 15 bp, Homo sapiens
aaaataaaaataaat

SEQ ID NO: 107854 - DNA, 15 bp, Homo sapiens
taaaaataaaaataa

SEQ ID NO: 107855 - DNA, 15 bp, Homo sapiens
ttaaaaataaaaata

SEQ ID NO: 107856 - DNA, 15 bp, Homo sapiens
attaaaaataaaaat

SEQ ID NO: 107857 - DNA, 15 bp, Homo sapiens
aattaaaaataaaaa

SEQ ID NO: 107858 - DNA, 15 bp, Homo sapiens
aaattaaaaataaaa

SEQ ID NO: 107859 - DNA, 15 bp, Homo sapiens
aaaattaaaaataaa

SEQ ID NO: 107860 - DNA, 15 bp, Homo sapiens
aaaaattaaaaataa

SEQ ID NO: 107861 - DNA, 15 bp, Homo sapiens
caaaaattaaaaata

SEQ ID NO: 107862 - DNA, 15 bp, Homo sapiens
tcaaaaattaaaaat

SEQ ID NO: 107863 - DNA, 15 bp, Homo sapiens
ttcaaaaattaaaaa

SEQ ID NO: 107864 - DNA, 15 bp, Homo sapiens
cttcaaaaattaaaa

SEQ ID NO: 107865 - DNA, 15 bp, Homo sapiens
tcttcaaaaattaaa

SEQ ID NO: 107866 - DNA, 15 bp, Homo sapiens
gtcttcaaaaattaa

SEQ ID NO: 107867 - DNA, 15 bp, Homo sapiens
agtcttcaaaaatta

SEQ ID NO: 107868 - DNA, 15 bp, Homo sapiens
aagtcttcaaaaatt

SEQ ID NO: 107869 - DNA, 15 bp, Homo sapiens
aaagtcttcaaaaat

SEQ ID NO: 107870 - DNA, 15 bp, Homo sapiens
aaaagtcttcaaaaa

SEQ ID NO: 107871 - DNA, 15 bp, Homo sapiens
taaaagtcttcaaaa

SEQ ID NO: 107872 - DNA, 15 bp, Homo sapiens
ctaaaagtcttcaaa

SEQ ID NO: 107873 - DNA, 15 bp, Homo sapiens
cctaaaagtcttcaa

SEQ ID NO: 107874 - DNA, 15 bp, Homo sapiens
acctaaaagtcttca

SEQ ID NO: 107875 - DNA, 15 bp, Homo sapiens
aacctaaaagtcttc

SEQ ID NO: 107876 - DNA, 15 bp, Homo sapiens
gaacctaaaagtctt

SEQ ID NO: 107877 - DNA, 15 bp, Homo sapiens
tgaacctaaaagtct

SEQ ID NO: 107878 - DNA, 15 bp, Homo sapiens
ctgaacctaaaagtc

SEQ ID NO: 107879 - DNA, 15 bp, Homo sapiens
cctgaacctaaaagt

SEQ ID NO: 107880 - DNA, 15 bp, Homo sapiens
tcctgaacctaaaag

SEQ ID NO: 107881 - DNA, 15 bp, Homo sapiens
ttcctgaacctaaaa

SEQ ID NO: 107882 - DNA, 15 bp, Homo sapiens
cttcctgaacctaaa

SEQ ID NO: 107883 - DNA, 15 bp, Homo sapiens
acttcctgaacctaa

SEQ ID NO: 107884 - DNA, 15 bp, Homo sapiens
tacttcctgaaccta

SEQ ID NO: 107885 - DNA, 15 bp, Homo sapiens
gtacttcctgaacct

SEQ ID NO: 107886 - DNA, 15 bp, Homo sapiens
tgtacttcctgaacc

SEQ ID NO: 107887 - DNA, 15 bp, Homo sapiens
atgtacttcctgaac

SEQ ID NO: 107888 - DNA, 15 bp, Homo sapiens
catgtacttcctgaa

SEQ ID NO: 107889 - DNA, 15 bp, Homo sapiens
acatgtacttcctga

SEQ ID NO: 107890 - DNA, 15 bp, Homo sapiens
cacatgtacttcctg

SEQ ID NO: 107891 - DNA, 15 bp, Homo sapiens
gcacatgtacttcct

SEQ ID NO: 107892 - DNA, 15 bp, Homo sapiens
tgcacatgtacttcc

SEQ ID NO: 107893 - DNA, 15 bp, Homo sapiens
gtgcacatgtacttc

SEQ ID NO: 107894 - DNA, 15 bp, Homo sapiens
cgtgcacatgtactt

SEQ ID NO: 107895 - DNA, 15 bp, Homo sapiens
acgtgcacatgtact

SEQ ID NO: 107896 - DNA, 15 bp, Homo sapiens
aacgtgcacatgtac

SEQ ID NO: 107897 - DNA, 15 bp, Homo sapiens
aaacgtgcacatgta

SEQ ID NO: 107898 - DNA, 15 bp, Homo sapiens
caaacgtgcacatgt

SEQ ID NO: 107899 - DNA, 15 bp, Homo sapiens
tcaaacgtgcacatg

SEQ ID NO: 107900 - DNA, 15 bp, Homo sapiens
atcaaacgtgcacat

SEQ ID NO: 107901 - DNA, 15 bp, Homo sapiens
tatcaaacgtgcaca

SEQ ID NO: 107902 - DNA, 15 bp, Homo sapiens
gtatcaaacgtgcac

SEQ ID NO: 107903 - DNA, 15 bp, Homo sapiens
tgtatcaaacgtgca

SEQ ID NO: 107904 - DNA, 15 bp, Homo sapiens
atgtatcaaacgtgc

SEQ ID NO: 107905 - DNA, 15 bp, Homo sapiens
catgtatcaaacgtg

SEQ ID NO: 107906 - DNA, 15 bp, Homo sapiens
ccatgtatcaaacgt

SEQ ID NO: 107907 - DNA, 15 bp, Homo sapiens
tccatgtatcaaacg

SEQ ID NO: 107908 - DNA, 15 bp, Homo sapiens
atccatgtatcaaac

SEQ ID NO: 107909 - DNA, 15 bp, Homo sapiens
tatccatgtatcaaa

SEQ ID NO: 107910 - DNA, 15 bp, Homo sapiens
atatccatgtatcaa

SEQ ID NO: 107911 - DNA, 15 bp, Homo sapiens
tatatccatgtatca

SEQ ID NO: 107912 - DNA, 15 bp, Homo sapiens
atatatccatgtatc

SEQ ID NO: 107913 - DNA, 15 bp, Homo sapiens
aatatatccatgtat

SEQ ID NO: 107914 - DNA, 15 bp, Homo sapiens
caatatatccatgta

SEQ ID NO: 107915 - DNA, 15 bp, Homo sapiens
acaatatatccatgt

SEQ ID NO: 107916 - DNA, 15 bp, Homo sapiens
tacaatatatccatg

SEQ ID NO: 107917 - DNA, 15 bp, Homo sapiens
atacaatatatccat

SEQ ID NO: 107918 - DNA, 15 bp, Homo sapiens
catacaatatatcca

SEQ ID NO: 107919 - DNA, 15 bp, Homo sapiens
tcatacaatatatcc

SEQ ID NO: 107920 - DNA, 15 bp, Homo sapiens
atcatacaatatatc

SEQ ID NO: 107921 - DNA, 15 bp, Homo sapiens
catcatacaatatat

SEQ ID NO: 107922 - DNA, 15 bp, Homo sapiens
gcatcatacaatata

SEQ ID NO: 107923 - DNA, 15 bp, Homo sapiens
agcatcatacaatat

SEQ ID NO: 107924 - DNA, 15 bp, Homo sapiens
cagcatcatacaata

SEQ ID NO: 107925 - DNA, 15 bp, Homo sapiens
tcagcatcatacaat

SEQ ID NO: 107926 - DNA, 15 bp, Homo sapiens
ctcagcatcatacaa

SEQ ID NO: 107927 - DNA, 15 bp, Homo sapiens
cctcagcatcataca

SEQ ID NO: 107928 - DNA, 15 bp, Homo sapiens
acctcagcatcatac

SEQ ID NO: 107929 - DNA, 15 bp, Homo sapiens
aacctcagcatcata

SEQ ID NO: 107930 - DNA, 15 bp, Homo sapiens
aaacctcagcatcat

SEQ ID NO: 107931 - DNA, 15 bp, Homo sapiens
caaacctcagcatca

SEQ ID NO: 107932 - DNA, 15 bp, Homo sapiens
ccaaacctcagcatc

SEQ ID NO: 107933 - DNA, 15 bp, Homo sapiens
cccaaacctcagcat

SEQ ID NO: 107934 - DNA, 15 bp, Homo sapiens
gcccaaacctcagca

SEQ ID NO: 107935 - DNA, 15 bp, Homo sapiens
agcccaaacctcagc

SEQ ID NO: 107936 - DNA, 15 bp, Homo sapiens
aagcccaaacctcag

SEQ ID NO: 107937 - DNA, 15 bp, Homo sapiens
gaagcccaaacctca

SEQ ID NO: 107938 - DNA, 15 bp, Homo sapiens
cgaagcccaaacctc

SEQ ID NO: 107939 - DNA, 15 bp, Homo sapiens
tcgaagcccaaacct

SEQ ID NO: 107940 - DNA, 15 bp, Homo sapiens
gtcgaagcccaaacc

SEQ ID NO: 107941 - DNA, 15 bp, Homo sapiens
agtcgaagcccaaac

SEQ ID NO: 107942 - DNA, 15 bp, Homo sapiens
cagtcgaagcccaaa

SEQ ID NO: 107943 - DNA, 15 bp, Homo sapiens
tcagtcgaagcccaa

SEQ ID NO: 107944 - DNA, 15 bp, Homo sapiens
ttcagtcgaagccca

SEQ ID NO: 107945 - DNA, 15 bp, Homo sapiens
gttcagtcgaagccc

SEQ ID NO: 107946 - DNA, 15 bp, Homo sapiens
ggttcagtcgaagcc

SEQ ID NO: 107947 - DNA, 15 bp, Homo sapiens
gggttcagtcgaagc

SEQ ID NO: 107948 - DNA, 15 bp, Homo sapiens
tgggttcagtcgaag

SEQ ID NO: 107949 - DNA, 15 bp, Homo sapiens
atgggttcagtcgaa

SEQ ID NO: 107950 - DNA, 15 bp, Homo sapiens
gatgggttcagtcga

SEQ ID NO: 107951 - DNA, 15 bp, Homo sapiens
tgatgggttcagtcg

SEQ ID NO: 107952 - DNA, 15 bp, Homo sapiens
gtgatgggttcagtc

SEQ ID NO: 107953 - DNA, 15 bp, Homo sapiens
ggtgatgggttcagt

SEQ ID NO: 107954 - DNA, 15 bp, Homo sapiens
gggtgatgggttcag

SEQ ID NO: 107955 - DNA, 15 bp, Homo sapiens
tgggtgatgggttca

SEQ ID NO: 107956 - DNA, 15 bp, Homo sapiens
ttgggtgatgggttc

SEQ ID NO: 107957 - DNA, 15 bp, Homo sapiens
tttgggtgatgggtt

SEQ ID NO: 107958 - DNA, 15 bp, Homo sapiens
atttgggtgatgggt

SEQ ID NO: 107959 - DNA, 15 bp, Homo sapiens
tatttgggtgatggg

SEQ ID NO: 107960 - DNA, 15 bp, Homo sapiens
ttatttgggtgatgg

SEQ ID NO: 107961 - DNA, 15 bp, Homo sapiens
attatttgggtgatg

SEQ ID NO: 107962 - DNA, 15 bp, Homo sapiens
tattatttgggtgat

SEQ ID NO: 107963 - DNA, 15 bp, Homo sapiens
ttattatttgggtga

SEQ ID NO: 107964 - DNA, 15 bp, Homo sapiens
tttattatttgggtg

SEQ ID NO: 107965 - DNA, 15 bp, Homo sapiens
atttattatttgggt

SEQ ID NO: 107966 - DNA, 15 bp, Homo sapiens
catttattatttggg

SEQ ID NO: 107967 - DNA, 15 bp, Homo sapiens
acatttattatttgg

SEQ ID NO: 107968 - DNA, 15 bp, Homo sapiens
tacatttattatttg

SEQ ID NO: 107969 - DNA, 15 bp, Homo sapiens
ctacatttattattt

SEQ ID NO: 107970 - DNA, 15 bp, Homo sapiens
actacatttattatt

SEQ ID NO: 107971 - DNA, 15 bp, Homo sapiens
tactacatttattat

SEQ ID NO: 107972 - DNA, 15 bp, Homo sapiens
gtactacatttatta

SEQ ID NO: 107973 - DNA, 15 bp, Homo sapiens
ggtactacatttatt

SEQ ID NO: 107974 - DNA, 15 bp, Homo sapiens
gggtactacatttat

SEQ ID NO: 107975 - DNA, 15 bp, Homo sapiens
tgggtactacattta

SEQ ID NO: 107976 - DNA, 15 bp, Homo sapiens
ttgggtactacattt

SEQ ID NO: 107977 - DNA, 15 bp, Homo sapiens
attgggtactacatt

SEQ ID NO: 107978 - DNA, 15 bp, Homo sapiens
aattgggtactacat

SEQ ID NO: 107979 - DNA, 15 bp, Homo sapiens
caattgggtactaca

SEQ ID NO: 107980 - DNA, 15 bp, Homo sapiens
ccaattgggtactac

SEQ ID NO: 107981 - DNA, 15 bp, Homo sapiens
accaattgggtacta

SEQ ID NO: 107982 - DNA, 15 bp, Homo sapiens
taccaattgggtact

SEQ ID NO: 107983 - DNA, 15 bp, Homo sapiens
ctaccaattgggtac

SEQ ID NO: 107984 - DNA, 15 bp, Homo sapiens
actaccaattgggta

SEQ ID NO: 107985 - DNA, 15 bp, Homo sapiens
aactaccaattgggt

SEQ ID NO: 107986 - DNA, 15 bp, Homo sapiens
aaactaccaattggg

SEQ ID NO: 107987 - DNA, 15 bp, Homo sapiens
aaaactaccaattgg

SEQ ID NO: 107988 - DNA, 15 bp, Homo sapiens
aaaaactaccaattg

SEQ ID NO: 107989 - DNA, 15 bp, Homo sapiens
gaaaaactaccaatt

SEQ ID NO: 107990 - DNA, 15 bp, Homo sapiens
tgaaaaactaccaat

SEQ ID NO: 107991 - DNA, 15 bp, Homo sapiens
ctgaaaaactaccaa

SEQ ID NO: 107992 - DNA, 15 bp, Homo sapiens
gctgaaaaactacca

SEQ ID NO: 107993 - DNA, 15 bp, Homo sapiens
agctgaaaaactacc

SEQ ID NO: 107994 - DNA, 15 bp, Homo sapiens
gagctgaaaaactac

SEQ ID NO: 107995 - DNA, 15 bp, Homo sapiens
agagctgaaaaacta

SEQ ID NO: 107996 - DNA, 15 bp, Homo sapiens
aagagctgaaaaact

SEQ ID NO: 107997 - DNA, 15 bp, Homo sapiens
caagagctgaaaaac

SEQ ID NO: 107998 - DNA, 15 bp, Homo sapiens
gcaagagctgaaaaa

SEQ ID NO: 107999 - DNA, 15 bp, Homo sapiens
ggcaagagctgaaaa

SEQ ID NO: 108000 - DNA, 15 bp, Homo sapiens
gggcaagagctgaaa

SEQ ID NO: 108001 - DNA, 15 bp, Homo sapiens
ggggcaagagctgaa

SEQ ID NO: 108002 - DNA, 15 bp, Homo sapiens
aggggcaagagctga

SEQ ID NO: 108003 - DNA, 15 bp, Homo sapiens
aaggggcaagagctg

SEQ ID NO: 108004 - DNA, 15 bp, Homo sapiens
aaaggggcaagagct

SEQ ID NO: 108005 - DNA, 15 bp, Homo sapiens
gaaaggggcaagagc

SEQ ID NO: 108006 - DNA, 15 bp, Homo sapiens
ggaaaggggcaagag

SEQ ID NO: 108007 - DNA, 15 bp, Homo sapiens
aggaaaggggcaaga

SEQ ID NO: 108008 - DNA, 15 bp, Homo sapiens
gaggaaaggggcaag

SEQ ID NO: 108009 - DNA, 15 bp, Homo sapiens
ggaggaaaggggcaa

SEQ ID NO: 108010 - DNA, 15 bp, Homo sapiens
aggaggaaaggggca

SEQ ID NO: 108011 - DNA, 15 bp, Homo sapiens
aaggaggaaaggggc

SEQ ID NO: 108012 - DNA, 15 bp, Homo sapiens
gaaggaggaaagggg

SEQ ID NO: 108013 - DNA, 15 bp, Homo sapiens
ggaaggaggaaaggg

SEQ ID NO: 108014 - DNA, 15 bp, Homo sapiens
gggaaggaggaaagg

SEQ ID NO: 108015 - DNA, 15 bp, Homo sapiens
agggaaggaggaaag

SEQ ID NO: 108016 - DNA, 15 bp, Homo sapiens
gagggaaggaggaaa

SEQ ID NO: 108017 - DNA, 15 bp, Homo sapiens
ggagggaaggaggaa

SEQ ID NO: 108018 - DNA, 15 bp, Homo sapiens
aggagggaaggagga

SEQ ID NO: 108019 - DNA, 15 bp, Homo sapiens
aaggagggaaggagg

SEQ ID NO: 108020 - DNA, 15 bp, Homo sapiens
aaaggagggaaggag

SEQ ID NO: 108021 - DNA, 15 bp, Homo sapiens
aaaaggagggaagga

SEQ ID NO: 108022 - DNA, 15 bp, Homo sapiens
caaaaggagggaagg

SEQ ID NO: 108023 - DNA, 15 bp, Homo sapiens
ccaaaaggagggaag

SEQ ID NO: 108024 - DNA, 15 bp, Homo sapiens
tccaaaaggagggaa

SEQ ID NO: 108025 - DNA, 15 bp, Homo sapiens
ctccaaaaggaggga

SEQ ID NO: 108026 - DNA, 15 bp, Homo sapiens
actccaaaaggaggg

SEQ ID NO: 108027 - DNA, 15 bp, Homo sapiens
gactccaaaaggagg

SEQ ID NO: 108028 - DNA, 15 bp, Homo sapiens
ggactccaaaaggag

SEQ ID NO: 108029 - DNA, 15 bp, Homo sapiens
gggactccaaaagga

SEQ ID NO: 108030 - DNA, 15 bp, Homo sapiens
tgggactccaaaagg

SEQ ID NO: 108031 - DNA, 15 bp, Homo sapiens
atgggactccaaaag

SEQ ID NO: 108032 - DNA, 15 bp, Homo sapiens
aatgggactccaaaa

SEQ ID NO: 108033 - DNA, 15 bp, Homo sapiens
caatgggactccaaa

SEQ ID NO: 108034 - DNA, 15 bp, Homo sapiens
acaatgggactccaa

SEQ ID NO: 108035 - DNA, 15 bp, Homo sapiens
gacaatgggactcca

SEQ ID NO: 108036 - DNA, 15 bp, Homo sapiens
agacaatgggactcc

SEQ ID NO: 108037 - DNA, 15 bp, Homo sapiens
aagacaatgggactc

SEQ ID NO: 108038 - DNA, 15 bp, Homo sapiens
aaagacaatgggact

SEQ ID NO: 108039 - DNA, 15 bp, Homo sapiens
caaagacaatgggac

SEQ ID NO: 108040 - DNA, 15 bp, Homo sapiens
gcaaagacaatggga

SEQ ID NO: 108041 - DNA, 15 bp, Homo sapiens
agcaaagacaatggg

SEQ ID NO: 108042 - DNA, 15 bp, Homo sapiens
aagcaaagacaatgg

SEQ ID NO: 108043 - DNA, 15 bp, Homo sapiens
aaagcaaagacaatg

SEQ ID NO: 108044 - DNA, 15 bp, Homo sapiens
gaaagcaaagacaat

SEQ ID NO: 108045 - DNA, 15 bp, Homo sapiens
ggaaagcaaagacaa

SEQ ID NO: 108046 - DNA, 15 bp, Homo sapiens
tggaaagcaaagaca

SEQ ID NO: 108047 - DNA, 15 bp, Homo sapiens
atggaaagcaaagac

SEQ ID NO: 108048 - DNA, 15 bp, Homo sapiens
gatggaaagcaaaga

SEQ ID NO: 108049 - DNA, 15 bp, Homo sapiens
agatggaaagcaaag

SEQ ID NO: 108050 - DNA, 15 bp, Homo sapiens
aagatggaaagcaaa

SEQ ID NO: 108051 - DNA, 15 bp, Homo sapiens
aaagatggaaagcaa

SEQ ID NO: 108052 - DNA, 15 bp, Homo sapiens
taaagatggaaagca

SEQ ID NO: 108053 - DNA, 15 bp, Homo sapiens
ataaagatggaaagc

SEQ ID NO: 108054 - DNA, 15 bp, Homo sapiens
cataaagatggaaag

SEQ ID NO: 108055 - DNA, 15 bp, Homo sapiens
acataaagatggaaa

SEQ ID NO: 108056 - DNA, 15 bp, Homo sapiens
cacataaagatggaa

SEQ ID NO: 108057 - DNA, 15 bp, Homo sapiens
gcacataaagatgga

SEQ ID NO: 108058 - DNA, 15 bp, Homo sapiens
tgcacataaagatgg

SEQ ID NO: 108059 - DNA, 15 bp, Homo sapiens
atgcacataaagatg

SEQ ID NO: 108060 - DNA, 15 bp, Homo sapiens
catgcacataaagat

SEQ ID NO: 108061 - DNA, 15 bp, Homo sapiens
acatgcacataaaga

SEQ ID NO: 108062 - DNA, 15 bp, Homo sapiens
cacatgcacataaag

SEQ ID NO: 108063 - DNA, 15 bp, Homo sapiens
acacatgcacataaa

SEQ ID NO: 108064 - DNA, 15 bp, Homo sapiens
cacacatgcacataa

SEQ ID NO: 108065 - DNA, 15 bp, Homo sapiens
gcacacatgcacata

SEQ ID NO: 108066 - DNA, 15 bp, Homo sapiens
ggcacacatgcacat

SEQ ID NO: 108067 - DNA, 15 bp, Homo sapiens
gggcacacatgcaca

SEQ ID NO: 108068 - DNA, 15 bp, Homo sapiens
tgggcacacatgcac

SEQ ID NO: 108069 - DNA, 15 bp, Homo sapiens
atgggcacacatgca

SEQ ID NO: 108070 - DNA, 15 bp, Homo sapiens
aatgggcacacatgc

SEQ ID NO: 108071 - DNA, 15 bp, Homo sapiens
caatgggcacacatg

SEQ ID NO: 108072 - DNA, 15 bp, Homo sapiens
acaatgggcacacat

SEQ ID NO: 108073 - DNA, 15 bp, Homo sapiens
aacaatgggcacaca

SEQ ID NO: 108074 - DNA, 15 bp, Homo sapiens
aaacaatgggcacac

SEQ ID NO: 108075 - DNA, 15 bp, Homo sapiens
taaacaatgggcaca

SEQ ID NO: 108076 - DNA, 15 bp, Homo sapiens
ttaaacaatgggcac

SEQ ID NO: 108077 - DNA, 15 bp, Homo sapiens
gttaaacaatgggca

SEQ ID NO: 108078 - DNA, 15 bp, Homo sapiens
agttaaacaatgggc

SEQ ID NO: 108079 - DNA, 15 bp, Homo sapiens
gagttaaacaatggg

SEQ ID NO: 108080 - DNA, 15 bp, Homo sapiens
ggagttaaacaatgg

SEQ ID NO: 108081 - DNA, 15 bp, Homo sapiens
gggagttaaacaatg

SEQ ID NO: 108082 - DNA, 15 bp, Homo sapiens
tgggagttaaacaat

SEQ ID NO: 108083 - DNA, 15 bp, Homo sapiens
gtgggagttaaacaa

SEQ ID NO: 108084 - DNA, 15 bp, Homo sapiens
agtgggagttaaaca

SEQ ID NO: 108085 - DNA, 15 bp, Homo sapiens
aagtgggagttaaac

SEQ ID NO: 108086 - DNA, 15 bp, Homo sapiens
taagtgggagttaaa

SEQ ID NO: 108087 - DNA, 15 bp, Homo sapiens
ataagtgggagttaa

SEQ ID NO: 108088 - DNA, 15 bp, Homo sapiens
tataagtgggagtta

SEQ ID NO: 108089 - DNA, 15 bp, Homo sapiens
ttataagtgggagtt

SEQ ID NO: 108090 - DNA, 15 bp, Homo sapiens
cttataagtgggagt

SEQ ID NO: 108091 - DNA, 15 bp, Homo sapiens
gttctcacttataag

SEQ ID NO: 108092 - DNA, 15 bp, Homo sapiens
tgttctcacttataa

SEQ ID NO: 108093 - DNA, 15 bp, Homo sapiens
atgttctcacttata

SEQ ID NO: 108094 - DNA, 15 bp, Homo sapiens
aatgttctcacttat

SEQ ID NO: 108095 - DNA, 15 bp, Homo sapiens
aaatgttctcactta

SEQ ID NO: 108096 - DNA, 15 bp, Homo sapiens
taaatgttctcactt

SEQ ID NO: 108097 - DNA, 15 bp, Homo sapiens
ctaaatgttctcact

SEQ ID NO: 108098 - DNA, 15 bp, Homo sapiens
actaaatgttctcac

SEQ ID NO: 108099 - DNA, 15 bp, Homo sapiens
tactaaatgttctca

SEQ ID NO: 108100 - DNA, 15 bp, Homo sapiens
atactaaatgttctc

SEQ ID NO: 108101 - DNA, 15 bp, Homo sapiens
aatactaaatgttct

SEQ ID NO: 108102 - DNA, 15 bp, Homo sapiens
aaatactaaatgttc

SEQ ID NO: 108103 - DNA, 15 bp, Homo sapiens
caaatactaaatgtt

SEQ ID NO: 108104 - DNA, 15 bp, Homo sapiens
ccaaatactaaatgt

SEQ ID NO: 108105 - DNA, 15 bp, Homo sapiens
accaaatactaaatg

SEQ ID NO: 108106 - DNA, 15 bp, Homo sapiens
aaccaaatactaaat

SEQ ID NO: 108107 - DNA, 15 bp, Homo sapiens
aaaccaaatactaaa

SEQ ID NO: 108108 - DNA, 15 bp, Homo sapiens
aaaaccaaatactaa

SEQ ID NO: 108109 - DNA, 15 bp, Homo sapiens
gaaaaccaaatacta

SEQ ID NO: 108110 - DNA, 15 bp, Homo sapiens
agaaaaccaaatact

SEQ ID NO: 108111 - DNA, 15 bp, Homo sapiens
cagaaaaccaaatac

SEQ ID NO: 108112 - DNA, 15 bp, Homo sapiens
acagaaaaccaaata

SEQ ID NO: 108113 - DNA, 15 bp, Homo sapiens
aacagaaaaccaaat

SEQ ID NO: 108114 - DNA, 15 bp, Homo sapiens
tcaggaacagaaaac

SEQ ID NO: 108115 - DNA, 15 bp, Homo sapiens
ttcaggaacagaaaa

SEQ ID NO: 108116 - DNA, 15 bp, Homo sapiens
attcaggaacagaaa

SEQ ID NO: 108117 - DNA, 15 bp, Homo sapiens
aattcaggaacagaa

SEQ ID NO: 108118 - DNA, 15 bp, Homo sapiens
taattcaggaacaga

SEQ ID NO: 108119 - DNA, 15 bp, Homo sapiens
ttaattcaggaacag

SEQ ID NO: 108120 - DNA, 15 bp, Homo sapiens
attaattcaggaaca

SEQ ID NO: 108121 - DNA, 15 bp, Homo sapiens
aattaattcaggaac

SEQ ID NO: 108122 - DNA, 15 bp, Homo sapiens
aaattaattcaggaa

SEQ ID NO: 108123 - DNA, 15 bp, Homo sapiens
taaattaattcagga

SEQ ID NO: 108124 - DNA, 15 bp, Homo sapiens
gtaaattaattcagg

SEQ ID NO: 108125 - DNA, 15 bp, Homo sapiens
agtaaattaattcag

SEQ ID NO: 108126 - DNA, 15 bp, Homo sapiens
aagtaaattaattca

SEQ ID NO: 108127 - DNA, 15 bp, Homo sapiens
taagtaaattaattc

SEQ ID NO: 108128 - DNA, 15 bp, Homo sapiens
ctaagtaaattaatt

SEQ ID NO: 108129 - DNA, 15 bp, Homo sapiens
cctaagtaaattaat

SEQ ID NO: 108130 - DNA, 15 bp, Homo sapiens
tcctaagtaaattaa

SEQ ID NO: 108131 - DNA, 15 bp, Homo sapiens
atcctaagtaaatta

SEQ ID NO: 108132 - DNA, 15 bp, Homo sapiens
tatcctaagtaaatt

SEQ ID NO: 108133 - DNA, 15 bp, Homo sapiens
ttatcctaagtaaat

SEQ ID NO: 108134 - DNA, 15 bp, Homo sapiens
attatcctaagtaaa

SEQ ID NO: 108135 - DNA, 15 bp, Homo sapiens
cattatcctaagtaa

SEQ ID NO: 108136 - DNA, 15 bp, Homo sapiens
ccattatcctaagta

SEQ ID NO: 108137 - DNA, 15 bp, Homo sapiens
gccattatcctaagt

SEQ ID NO: 108138 - DNA, 15 bp, Homo sapiens
ggccattatcctaag

SEQ ID NO: 108139 - DNA, 15 bp, Homo sapiens
aggccattatcctaa

SEQ ID NO: 108140 - DNA, 15 bp, Homo sapiens
aaggccattatccta

SEQ ID NO: 108141 - DNA, 15 bp, Homo sapiens
caaggccattatcct

SEQ ID NO: 108142 - DNA, 15 bp, Homo sapiens
tcaaggccattatcc

SEQ ID NO: 108143 - DNA, 15 bp, Homo sapiens
ctcaaggccattatc

SEQ ID NO: 108144 - DNA, 15 bp, Homo sapiens
gctcaaggccattat

SEQ ID NO: 108145 - DNA, 15 bp, Homo sapiens
agctcaaggccatta

SEQ ID NO: 108146 - DNA, 15 bp, Homo sapiens
cagctcaaggccatt

SEQ ID NO: 108147 - DNA, 15 bp, Homo sapiens
gcagctcaaggccat

SEQ ID NO: 108148 - DNA, 15 bp, Homo sapiens
tgcagctcaaggcca

SEQ ID NO: 108149 - DNA, 15 bp, Homo sapiens
atgcagctcaaggcc

SEQ ID NO: 108150 - DNA, 15 bp, Homo sapiens
aatgcagctcaaggc

SEQ ID NO: 108151 - DNA, 15 bp, Homo sapiens
gaatgcagctcaagg

SEQ ID NO: 108152 - DNA, 15 bp, Homo sapiens
tgaatgcagctcaag

SEQ ID NO: 108153 - DNA, 15 bp, Homo sapiens
atgaatgcagctcaa

SEQ ID NO: 108154 - DNA, 15 bp, Homo sapiens
catgaatgcagctca

SEQ ID NO: 108155 - DNA, 15 bp, Homo sapiens
gcatgaatgcagctc

SEQ ID NO: 108156 - DNA, 15 bp, Homo sapiens
agcatgaatgcagct

SEQ ID NO: 108157 - DNA, 15 bp, Homo sapiens
cagcatgaatgcagc

SEQ ID NO: 108158 - DNA, 15 bp, Homo sapiens
gcagcatgaatgcag

SEQ ID NO: 108159 - DNA, 15 bp, Homo sapiens
agcagcatgaatgca

SEQ ID NO: 108160 - DNA, 15 bp, Homo sapiens
cagcagcatgaatgc

SEQ ID NO: 108161 - DNA, 15 bp, Homo sapiens
gcagcagcatgaatg

SEQ ID NO: 108162 - DNA, 15 bp, Homo sapiens
tgcagcagcatgaat

SEQ ID NO: 108163 - DNA, 15 bp, Homo sapiens
ttgcagcagcatgaa

SEQ ID NO: 108164 - DNA, 15 bp, Homo sapiens
tttgcagcagcatga

SEQ ID NO: 108165 - DNA, 15 bp, Homo sapiens
ctttgcagcagcatg

SEQ ID NO: 108166 - DNA, 15 bp, Homo sapiens
cctttgcagcagcat

SEQ ID NO: 108167 - DNA, 15 bp, Homo sapiens
tcctttgcagcagca

SEQ ID NO: 108168 - DNA, 15 bp, Homo sapiens
gtcctttgcagcagc

SEQ ID NO: 108169 - DNA, 15 bp, Homo sapiens
tgtcctttgcagcag

SEQ ID NO: 108170 - DNA, 15 bp, Homo sapiens
atgtcctttgcagca

SEQ ID NO: 108171 - DNA, 15 bp, Homo sapiens
catgtcctttgcagc

SEQ ID NO: 108172 - DNA, 15 bp, Homo sapiens
aatcatgtcctttgc

SEQ ID NO: 108173 - DNA, 15 bp, Homo sapiens
aaatcatgtcctttg

SEQ ID NO: 108174 - DNA, 15 bp, Homo sapiens
gaaatcatgtccttt

SEQ ID NO: 108175 - DNA, 15 bp, Homo sapiens
tgaaatcatgtcctt

SEQ ID NO: 108176 - DNA, 15 bp, Homo sapiens
atgaaatcatgtcct

SEQ ID NO: 108177 - DNA, 15 bp, Homo sapiens
aatgaaatcatgtcc

SEQ ID NO: 108178 - DNA, 15 bp, Homo sapiens
aaatgaaatcatgtc

SEQ ID NO: 108179 - DNA, 15 bp, Homo sapiens
aaaatgaaatcatgt

SEQ ID NO: 108180 - DNA, 15 bp, Homo sapiens
aaaaatgaaatcatg

SEQ ID NO: 108181 - DNA, 15 bp, Homo sapiens
aaaaaatgaaatcat

SEQ ID NO: 108182 - DNA, 15 bp, Homo sapiens
taaaaaatgaaatca

SEQ ID NO: 108183 - DNA, 15 bp, Homo sapiens
ataaaaaatgaaatc

SEQ ID NO: 108184 - DNA, 15 bp, Homo sapiens
cataaaaaatgaaat

SEQ ID NO: 108185 - DNA, 15 bp, Homo sapiens
ccataaaaaatgaaa

SEQ ID NO: 108186 - DNA, 15 bp, Homo sapiens
gccataaaaaatgaa

SEQ ID NO: 108187 - DNA, 15 bp, Homo sapiens
acagccataaaaaat

SEQ ID NO: 108188 - DNA, 15 bp, Homo sapiens
cacagccataaaaaa

SEQ ID NO: 108189 - DNA, 15 bp, Homo sapiens
acacagccataaaaa

SEQ ID NO: 108190 - DNA, 15 bp, Homo sapiens
tacacagccataaaa

SEQ ID NO: 108191 - DNA, 15 bp, Homo sapiens
ctacacagccataaa

SEQ ID NO: 108192 - DNA, 15 bp, Homo sapiens
actacacagccataa

SEQ ID NO: 108193 - DNA, 15 bp, Homo sapiens
cactacacagccata

SEQ ID NO: 108194 - DNA, 15 bp, Homo sapiens
acactacacagccat

SEQ ID NO: 108195 - DNA, 15 bp, Homo sapiens
aacactacacagcca

SEQ ID NO: 108196 - DNA, 15 bp, Homo sapiens
gaacactacacagcc

SEQ ID NO: 108197 - DNA, 15 bp, Homo sapiens
ggaacactacacagc

SEQ ID NO: 108198 - DNA, 15 bp, Homo sapiens
cggaacactacacag

SEQ ID NO: 108199 - DNA, 15 bp, Homo sapiens
acggaacactacaca

SEQ ID NO: 108200 - DNA, 15 bp, Homo sapiens
cacggaacactacac

SEQ ID NO: 108201 - DNA, 15 bp, Homo sapiens
ccacggaacactaca

SEQ ID NO: 108202 - DNA, 15 bp, Homo sapiens
accacggaacactac

SEQ ID NO: 108203 - DNA, 15 bp, Homo sapiens
caccacggaacacta

SEQ ID NO: 108204 - DNA, 15 bp, Homo sapiens
acaccacggaacact

SEQ ID NO: 108205 - DNA, 15 bp, Homo sapiens
tacaccacggaacac

SEQ ID NO: 108206 - DNA, 15 bp, Homo sapiens
atacaccacggaaca

SEQ ID NO: 108207 - DNA, 15 bp, Homo sapiens
aatacaccacggaac

SEQ ID NO: 108208 - DNA, 15 bp, Homo sapiens
aaatacaccacggaa

SEQ ID NO: 108209 - DNA, 15 bp, Homo sapiens
caaatacaccacgga

SEQ ID NO: 108210 - DNA, 15 bp, Homo sapiens
acaaatacaccacgg

SEQ ID NO: 108211 - DNA, 15 bp, Homo sapiens
tacaaatacaccacg

SEQ ID NO: 108212 - DNA, 15 bp, Homo sapiens
gtacaaatacaccac

SEQ ID NO: 108213 - DNA, 15 bp, Homo sapiens
ggtacaaatacacca

SEQ ID NO: 108214 - DNA, 15 bp, Homo sapiens
tggtacaaatacacc

SEQ ID NO: 108215 - DNA, 15 bp, Homo sapiens
gtggtacaaatacac

SEQ ID NO: 108216 - DNA, 15 bp, Homo sapiens
cgtggtacaaataca

SEQ ID NO: 108217 - DNA, 15 bp, Homo sapiens
acgtggtacaaatac

SEQ ID NO: 108218 - DNA, 15 bp, Homo sapiens
aacgtggtacaaata

SEQ ID NO: 108219 - DNA, 15 bp, Homo sapiens
aaacgtggtacaaat

SEQ ID NO: 108220 - DNA, 15 bp, Homo sapiens
aaaacgtggtacaaa

SEQ ID NO: 108221 - DNA, 15 bp, Homo sapiens
gaaaacgtggtacaa

SEQ ID NO: 108222 - DNA, 15 bp, Homo sapiens
agaaaacgtggtaca

SEQ ID NO: 108223 - DNA, 15 bp, Homo sapiens
aagaaaacgtggtac

SEQ ID NO: 108224 - DNA, 15 bp, Homo sapiens
aaagaaaacgtggta

SEQ ID NO: 108225 - DNA, 15 bp, Homo sapiens
taaagaaaacgtggt

SEQ ID NO: 108226 - DNA, 15 bp, Homo sapiens
ataaagaaaacgtgg

SEQ ID NO: 108227 - DNA, 15 bp, Homo sapiens
gataaagaaaacgtg

SEQ ID NO: 108228 - DNA, 15 bp, Homo sapiens
ggataaagaaaacgt

SEQ ID NO: 108229 - DNA, 15 bp, Homo sapiens
tggataaagaaaacg

SEQ ID NO: 108230 - DNA, 15 bp, Homo sapiens
atggataaagaaaac

SEQ ID NO: 108231 - DNA, 15 bp, Homo sapiens
aatggataaagaaaa

SEQ ID NO: 108232 - DNA, 15 bp, Homo sapiens
gaatggataaagaaa

SEQ ID NO: 108233 - DNA, 15 bp, Homo sapiens
ggaatggataaagaa

SEQ ID NO: 108234 - DNA, 15 bp, Homo sapiens
gggaatggataaaga

SEQ ID NO: 108235 - DNA, 15 bp, Homo sapiens
ggggaatggataaag

SEQ ID NO: 108236 - DNA, 15 bp, Homo sapiens
gggggaatggataaa

SEQ ID NO: 108237 - DNA, 15 bp, Homo sapiens
tgggggaatggataa

SEQ ID NO: 108238 - DNA, 15 bp, Homo sapiens
atgggggaatggata

SEQ ID NO: 108239 - DNA, 15 bp, Homo sapiens
aatgggggaatggat

SEQ ID NO: 108240 - DNA, 15 bp, Homo sapiens
caatgggggaatgga

SEQ ID NO: 108241 - DNA, 15 bp, Homo sapiens
tcaatgggggaatgg

SEQ ID NO: 108242 - DNA, 15 bp, Homo sapiens
atcaatgggggaatg

SEQ ID NO: 108243 - DNA, 15 bp, Homo sapiens
catcaatgggggaat

SEQ ID NO: 108244 - DNA, 15 bp, Homo sapiens
ccatcaatgggggaa

SEQ ID NO: 108245 - DNA, 15 bp, Homo sapiens
cccatcaatggggga

SEQ ID NO: 108246 - DNA, 15 bp, Homo sapiens
gcccatcaatggggg

SEQ ID NO: 108247 - DNA, 15 bp, Homo sapiens
tgcccatcaatgggg

SEQ ID NO: 108248 - DNA, 15 bp, Homo sapiens
gtgcccatcaatggg

SEQ ID NO: 108249 - DNA, 15 bp, Homo sapiens
ggtgcccatcaatgg

SEQ ID NO: 108250 - DNA, 15 bp, Homo sapiens
aggtgcccatcaatg

SEQ ID NO: 108251 - DNA, 15 bp, Homo sapiens
taggtgcccatcaat

SEQ ID NO: 108252 - DNA, 15 bp, Homo sapiens
ctaggtgcccatcaa

SEQ ID NO: 108253 - DNA, 15 bp, Homo sapiens
tctaggtgcccatca

SEQ ID NO: 108254 - DNA, 15 bp, Homo sapiens
atctaggtgcccatc

SEQ ID NO: 108255 - DNA, 15 bp, Homo sapiens
aatctaggtgcccat

SEQ ID NO: 108256 - DNA, 15 bp, Homo sapiens
caatctaggtgccca

SEQ ID NO: 108257 - DNA, 15 bp, Homo sapiens
tcaatctaggtgccc

SEQ ID NO: 108258 - DNA, 15 bp, Homo sapiens
atcaatctaggtgcc

SEQ ID NO: 108259 - DNA, 15 bp, Homo sapiens
catcaatctaggtgc

SEQ ID NO: 108260 - DNA, 15 bp, Homo sapiens
tcatcaatctaggtg

SEQ ID NO: 108261 - DNA, 15 bp, Homo sapiens
gtcatcaatctaggt

SEQ ID NO: 108262 - DNA, 15 bp, Homo sapiens
tgtcatcaatctagg

SEQ ID NO: 108263 - DNA, 15 bp, Homo sapiens
atgtcatcaatctag

SEQ ID NO: 108264 - DNA, 15 bp, Homo sapiens
catgtcatcaatcta

SEQ ID NO: 108265 - DNA, 15 bp, Homo sapiens
acatgtcatcaatct

SEQ ID NO: 108266 - DNA, 15 bp, Homo sapiens
gacatgtcatcaatc

SEQ ID NO: 108267 - DNA, 15 bp, Homo sapiens
agacatgtcatcaat

SEQ ID NO: 108268 - DNA, 15 bp, Homo sapiens
aagacatgtcatcaa

SEQ ID NO: 108269 - DNA, 15 bp, Homo sapiens
aaagacatgtcatca

SEQ ID NO: 108270 - DNA, 15 bp, Homo sapiens
caaagacatgtcatc

SEQ ID NO: 108271 - DNA, 15 bp, Homo sapiens
gcaaagacatgtcat

SEQ ID NO: 108272 - DNA, 15 bp, Homo sapiens
agcaaagacatgtca

SEQ ID NO: 108273 - DNA, 15 bp, Homo sapiens
tagcaaagacatgtc

SEQ ID NO: 108274 - DNA, 15 bp, Homo sapiens
atagcaaagacatgt

SEQ ID NO: 108275 - DNA, 15 bp, Homo sapiens
aatagcaaagacatg

SEQ ID NO: 108276 - DNA, 15 bp, Homo sapiens
caatagcaaagacat

SEQ ID NO: 108277 - DNA, 15 bp, Homo sapiens
acaatagcaaagaca

SEQ ID NO: 108278 - DNA, 15 bp, Homo sapiens
cacaatagcaaagac

SEQ ID NO: 108279 - DNA, 15 bp, Homo sapiens
acacaatagcaaaga

SEQ ID NO: 108280 - DNA, 15 bp, Homo sapiens
cacacaatagcaaag

SEQ ID NO: 108281 - DNA, 15 bp, Homo sapiens
acacacaatagcaaa

SEQ ID NO: 108282 - DNA, 15 bp, Homo sapiens
tacacacaatagcaa

SEQ ID NO: 108283 - DNA, 15 bp, Homo sapiens
ctacacacaatagca

SEQ ID NO: 108284 - DNA, 15 bp, Homo sapiens
actacacacaatagc

SEQ ID NO: 108285 - DNA, 15 bp, Homo sapiens
cactacacacaatag

SEQ ID NO: 108286 - DNA, 15 bp, Homo sapiens
ccactacacacaata

SEQ ID NO: 108287 - DNA, 15 bp, Homo sapiens
accactacacacaat

SEQ ID NO: 108288 - DNA, 15 bp, Homo sapiens
caccactacacacaa

SEQ ID NO: 108289 - DNA, 15 bp, Homo sapiens
acaccactacacaca

SEQ ID NO: 108290 - DNA, 15 bp, Homo sapiens
cacaccactacacac

SEQ ID NO: 108291 - DNA, 15 bp, Homo sapiens
tcacaccactacaca

SEQ ID NO: 108292 - DNA, 15 bp, Homo sapiens
atcacaccactacac

SEQ ID NO: 108293 - DNA, 15 bp, Homo sapiens
tatcacaccactaca

SEQ ID NO: 108294 - DNA, 15 bp, Homo sapiens
ttatcacaccactac

SEQ ID NO: 108295 - DNA, 15 bp, Homo sapiens
tttatcacaccacta

SEQ ID NO: 108296 - DNA, 15 bp, Homo sapiens
gtttatcacaccact

SEQ ID NO: 108297 - DNA, 15 bp, Homo sapiens
tgtttatcacaccac

SEQ ID NO: 108298 - DNA, 15 bp, Homo sapiens
gtgtttatcacacca

SEQ ID NO: 108299 - DNA, 15 bp, Homo sapiens
cgtgtttatcacacc

SEQ ID NO: 108300 - DNA, 15 bp, Homo sapiens
ccgtgtttatcacac

SEQ ID NO: 108301 - DNA, 15 bp, Homo sapiens
cccgtgtttatcaca

SEQ ID NO: 108302 - DNA, 15 bp, Homo sapiens
tcccgtgtttatcac

SEQ ID NO: 108303 - DNA, 15 bp, Homo sapiens
ctcccgtgtttatca

SEQ ID NO: 108304 - DNA, 15 bp, Homo sapiens
actcccgtgtttatc

SEQ ID NO: 108305 - DNA, 15 bp, Homo sapiens
cactcccgtgtttat

SEQ ID NO: 108306 - DNA, 15 bp, Homo sapiens
gcactcccgtgttta

SEQ ID NO: 108307 - DNA, 15 bp, Homo sapiens
tgcactcccgtgttt

SEQ ID NO: 108308 - DNA, 15 bp, Homo sapiens
atgcactcccgtgtt

SEQ ID NO: 108309 - DNA, 15 bp, Homo sapiens
catgcactcccgtgt

SEQ ID NO: 108310 - DNA, 15 bp, Homo sapiens
acatgcactcccgtg

SEQ ID NO: 108311 - DNA, 15 bp, Homo sapiens
cacatgcactcccgt

SEQ ID NO: 108312 - DNA, 15 bp, Homo sapiens
acacatgcactcccg

SEQ ID NO: 108313 - DNA, 15 bp, Homo sapiens
gacacatgcactccc

SEQ ID NO: 108314 - DNA, 15 bp, Homo sapiens
ggacacatgcactcc

SEQ ID NO: 108315 - DNA, 15 bp, Homo sapiens
aggacacatgcactc

SEQ ID NO: 108316 - DNA, 15 bp, Homo sapiens
aaggacacatgcact

SEQ ID NO: 108317 - DNA, 15 bp, Homo sapiens
aaaggacacatgcac

SEQ ID NO: 108318 - DNA, 15 bp, Homo sapiens
aaaaggacacatgca

SEQ ID NO: 108319 - DNA, 15 bp, Homo sapiens
caaaaggacacatgc

SEQ ID NO: 108320 - DNA, 15 bp, Homo sapiens
ccaaaaggacacatg

SEQ ID NO: 108321 - DNA, 15 bp, Homo sapiens
accaaaaggacacat

SEQ ID NO: 108322 - DNA, 15 bp, Homo sapiens
taccaaaaggacaca

SEQ ID NO: 108323 - DNA, 15 bp, Homo sapiens
ctaccaaaaggacac

SEQ ID NO: 108324 - DNA, 15 bp, Homo sapiens
tctaccaaaaggaca

SEQ ID NO: 108325 - DNA, 15 bp, Homo sapiens
ttctaccaaaaggac

SEQ ID NO: 108326 - DNA, 15 bp, Homo sapiens
gttctaccaaaagga

SEQ ID NO: 108327 - DNA, 15 bp, Homo sapiens
cgttctaccaaaagg

SEQ ID NO: 108328 - DNA, 15 bp, Homo sapiens
tcgttctaccaaaag

SEQ ID NO: 108329 - DNA, 15 bp, Homo sapiens
atcgttctaccaaaa

SEQ ID NO: 108330 - DNA, 15 bp, Homo sapiens
aatcgttctaccaaa

SEQ ID NO: 108331 - DNA, 15 bp, Homo sapiens
taatcgttctaccaa

SEQ ID NO: 108332 - DNA, 15 bp, Homo sapiens
ataatcgttctacca

SEQ ID NO: 108333 - DNA, 15 bp, Homo sapiens
gataatcgttctacc

SEQ ID NO: 108334 - DNA, 15 bp, Homo sapiens
ggataatcgttctac

SEQ ID NO: 108335 - DNA, 15 bp, Homo sapiens
aggataatcgttcta

SEQ ID NO: 108336 - DNA, 15 bp, Homo sapiens
gaggataatcgttct

SEQ ID NO: 108337 - DNA, 15 bp, Homo sapiens
ggaggataatcgttc

SEQ ID NO: 108338 - DNA, 15 bp, Homo sapiens
aggaggataatcgtt

SEQ ID NO: 108339 - DNA, 15 bp, Homo sapiens
aaggaggataatcgt

SEQ ID NO: 108340 - DNA, 15 bp, Homo sapiens
aaaggaggataatcg

SEQ ID NO: 108341 - DNA, 15 bp, Homo sapiens
taaaggaggataatc

SEQ ID NO: 108342 - DNA, 15 bp, Homo sapiens
gtaaaggaggataat

SEQ ID NO: 108343 - DNA, 15 bp, Homo sapiens
agtaaaggaggataa

SEQ ID NO: 108344 - DNA, 15 bp, Homo sapiens
aagtaaaggaggata

SEQ ID NO: 108345 - DNA, 15 bp, Homo sapiens
ataagtaaaggagga

SEQ ID NO: 108346 - DNA, 15 bp, Homo sapiens
tataagtaaaggagg

SEQ ID NO: 108347 - DNA, 15 bp, Homo sapiens
atataagtaaaggag

SEQ ID NO: 108348 - DNA, 15 bp, Homo sapiens
tatataagtaaagga

SEQ ID NO: 108349 - DNA, 15 bp, Homo sapiens
gtatataagtaaagg

SEQ ID NO: 108350 - DNA, 15 bp, Homo sapiens
ggtatataagtaaag

SEQ ID NO: 108351 - DNA, 15 bp, Homo sapiens
gggtatataagtaaa

SEQ ID NO: 108352 - DNA, 15 bp, Homo sapiens
tgggtatataagtaa

SEQ ID NO: 108353 - DNA, 15 bp, Homo sapiens
ctgggtatataagta

SEQ ID NO: 108354 - DNA, 15 bp, Homo sapiens
actgggtatataagt

SEQ ID NO: 108355 - DNA, 15 bp, Homo sapiens
tactgggtatataag

SEQ ID NO: 108356 - DNA, 15 bp, Homo sapiens
ttactgggtatataa

SEQ ID NO: 108357 - DNA, 15 bp, Homo sapiens
attactgggtatata

SEQ ID NO: 108358 - DNA, 15 bp, Homo sapiens
tattactgggtatat

SEQ ID NO: 108359 - DNA, 15 bp, Homo sapiens
ctattactgggtata

SEQ ID NO: 108360 - DNA, 15 bp, Homo sapiens
cctattactgggtat

SEQ ID NO: 108361 - DNA, 15 bp, Homo sapiens
tcctattactgggta

SEQ ID NO: 108362 - DNA, 15 bp, Homo sapiens
atcctattactgggt

SEQ ID NO: 108363 - DNA, 15 bp, Homo sapiens
aatcctattactggg

SEQ ID NO: 108364 - DNA, 15 bp, Homo sapiens
aaatcctattactgg

SEQ ID NO: 108365 - DNA, 15 bp, Homo sapiens
gaaatcctattactg

SEQ ID NO: 108366 - DNA, 15 bp, Homo sapiens
agaaatcctattact

SEQ ID NO: 108367 - DNA, 15 bp, Homo sapiens
cagaaatcctattac

SEQ ID NO: 108368 - DNA, 15 bp, Homo sapiens
ccagaaatcctatta

SEQ ID NO: 108369 - DNA, 15 bp, Homo sapiens
cccagaaatcctatt

SEQ ID NO: 108370 - DNA, 15 bp, Homo sapiens
acccagaaatcctat

SEQ ID NO: 108371 - DNA, 15 bp, Homo sapiens
aacccagaaatccta

SEQ ID NO: 108372 - DNA, 15 bp, Homo sapiens
caacccagaaatcct

SEQ ID NO: 108373 - DNA, 15 bp, Homo sapiens
tcaacccagaaatcc

SEQ ID NO: 108374 - DNA, 15 bp, Homo sapiens
ttcaacccagaaatc

SEQ ID NO: 108375 - DNA, 15 bp, Homo sapiens
tattcaacccagaaa

SEQ ID NO: 108376 - DNA, 15 bp, Homo sapiens
ttattcaacccagaa

SEQ ID NO: 108377 - DNA, 15 bp, Homo sapiens
attattcaacccaga

SEQ ID NO: 108378 - DNA, 15 bp, Homo sapiens
tattattcaacccag

SEQ ID NO: 108379 - DNA, 15 bp, Homo sapiens
ttattattcaaccca

SEQ ID NO: 108380 - DNA, 15 bp, Homo sapiens
attattattcaaccc

SEQ ID NO: 108381 - DNA, 15 bp, Homo sapiens
aattattattcaacc

SEQ ID NO: 108382 - DNA, 15 bp, Homo sapiens
gaattattattcaac

SEQ ID NO: 108383 - DNA, 15 bp, Homo sapiens
agaattattattcaa

SEQ ID NO: 108384 - DNA, 15 bp, Homo sapiens
tagaattattattca

SEQ ID NO: 108385 - DNA, 15 bp, Homo sapiens
atagaattattattc

SEQ ID NO: 108386 - DNA, 15 bp, Homo sapiens
catagaattattatt

SEQ ID NO: 108387 - DNA, 15 bp, Homo sapiens
acatagaattattat

SEQ ID NO: 108388 - DNA, 15 bp, Homo sapiens
aacatagaattatta

SEQ ID NO: 108389 - DNA, 15 bp, Homo sapiens
aaacatagaattatt

SEQ ID NO: 108390 - DNA, 15 bp, Homo sapiens
taaacatagaattat

SEQ ID NO: 108391 - DNA, 15 bp, Homo sapiens
ctaaacatagaatta

SEQ ID NO: 108392 - DNA, 15 bp, Homo sapiens
actaaacatagaatt

SEQ ID NO: 108393 - DNA, 15 bp, Homo sapiens
aactaaacatagaat

SEQ ID NO: 108394 - DNA, 15 bp, Homo sapiens
gaactaaacatagaa

SEQ ID NO: 108395 - DNA, 15 bp, Homo sapiens
agaactaaacataga

SEQ ID NO: 108396 - DNA, 15 bp, Homo sapiens
aagaactaaacatag

SEQ ID NO: 108397 - DNA, 15 bp, Homo sapiens
aaagaactaaacata

SEQ ID NO: 108398 - DNA, 15 bp, Homo sapiens
caaagaactaaacat

SEQ ID NO: 108399 - DNA, 15 bp, Homo sapiens
tcaaagaactaaaca

SEQ ID NO: 108400 - DNA, 15 bp, Homo sapiens
ctcaaagaactaaac

SEQ ID NO: 108401 - DNA, 15 bp, Homo sapiens
tctcaaagaactaaa

SEQ ID NO: 108402 - DNA, 15 bp, Homo sapiens
atctcaaagaactaa

SEQ ID NO: 108403 - DNA, 15 bp, Homo sapiens
tatctcaaagaacta

SEQ ID NO: 108404 - DNA, 15 bp, Homo sapiens
atatctcaaagaact

SEQ ID NO: 108405 - DNA, 15 bp, Homo sapiens
aatatctcaaagaac

SEQ ID NO: 108406 - DNA, 15 bp, Homo sapiens
aaatatctcaaagaa

SEQ ID NO: 108407 - DNA, 15 bp, Homo sapiens
gaaatatctcaaaga

SEQ ID NO: 108408 - DNA, 15 bp, Homo sapiens
ggaaatatctcaaag

SEQ ID NO: 108409 - DNA, 15 bp, Homo sapiens
tggaaatatctcaaa

SEQ ID NO: 108410 - DNA, 15 bp, Homo sapiens
ttggaaatatctcaa

SEQ ID NO: 108411 - DNA, 15 bp, Homo sapiens
tttggaaatatctca

SEQ ID NO: 108412 - DNA, 15 bp, Homo sapiens
gtttggaaatatctc

SEQ ID NO: 108413 - DNA, 15 bp, Homo sapiens
agtttggaaatatct

SEQ ID NO: 108414 - DNA, 15 bp, Homo sapiens
cagtttggaaatatc

SEQ ID NO: 108415 - DNA, 15 bp, Homo sapiens
gcagtttggaaatat

SEQ ID NO: 108416 - DNA, 15 bp, Homo sapiens
agcagtttggaaata

SEQ ID NO: 108417 - DNA, 15 bp, Homo sapiens
aagcagtttggaaat

SEQ ID NO: 108418 - DNA, 15 bp, Homo sapiens
aaagcagtttggaaa

SEQ ID NO: 108419 - DNA, 15 bp, Homo sapiens
gaaagcagtttggaa

SEQ ID NO: 108420 - DNA, 15 bp, Homo sapiens
ggaaagcagtttgga

SEQ ID NO: 108421 - DNA, 15 bp, Homo sapiens
gggaaagcagtttgg

SEQ ID NO: 108422 - DNA, 15 bp, Homo sapiens
agggaaagcagtttg

SEQ ID NO: 108423 - DNA, 15 bp, Homo sapiens
tagggaaagcagttt

SEQ ID NO: 108424 - DNA, 15 bp, Homo sapiens
ctagggaaagcagtt

SEQ ID NO: 108425 - DNA, 15 bp, Homo sapiens
cctagggaaagcagt

SEQ ID NO: 108426 - DNA, 15 bp, Homo sapiens
ccctagggaaagcag

SEQ ID NO: 108427 - DNA, 15 bp, Homo sapiens
cccctagggaaagca

SEQ ID NO: 108428 - DNA, 15 bp, Homo sapiens
gcccctagggaaagc

SEQ ID NO: 108429 - DNA, 15 bp, Homo sapiens
agcccctagggaaag

SEQ ID NO: 108430 - DNA, 15 bp, Homo sapiens
cagcccctagggaaa

SEQ ID NO: 108431 - DNA, 15 bp, Homo sapiens
tcagcccctagggaa

SEQ ID NO: 108432 - DNA, 15 bp, Homo sapiens
ttcagcccctaggga

SEQ ID NO: 108433 - DNA, 15 bp, Homo sapiens
gttcagcccctaggg

SEQ ID NO: 108434 - DNA, 15 bp, Homo sapiens
agttcagcccctagg

SEQ ID NO: 108435 - DNA, 15 bp, Homo sapiens
cagttcagcccctag

SEQ ID NO: 108436 - DNA, 15 bp, Homo sapiens
tcagttcagccccta

SEQ ID NO: 108437 - DNA, 15 bp, Homo sapiens
atcagttcagcccct

SEQ ID NO: 108438 - DNA, 15 bp, Homo sapiens
aatcagttcagcccc

SEQ ID NO: 108439 - DNA, 15 bp, Homo sapiens
aaatcagttcagccc

SEQ ID NO: 108440 - DNA, 15 bp, Homo sapiens
taaatcagttcagcc

SEQ ID NO: 108441 - DNA, 15 bp, Homo sapiens
gtaaatcagttcagc

SEQ ID NO: 108442 - DNA, 15 bp, Homo sapiens
tgtaaatcagttcag

SEQ ID NO: 108443 - DNA, 15 bp, Homo sapiens
ttgtaaatcagttca

SEQ ID NO: 108444 - DNA, 15 bp, Homo sapiens
attgtaaatcagttc

SEQ ID NO: 108445 - DNA, 15 bp, Homo sapiens
gattgtaaatcagtt

SEQ ID NO: 108446 - DNA, 15 bp, Homo sapiens
ggattgtaaatcagt

SEQ ID NO: 108447 - DNA, 15 bp, Homo sapiens
aggattgtaaatcag

SEQ ID NO: 108448 - DNA, 15 bp, Homo sapiens
taggattgtaaatca

SEQ ID NO: 108449 - DNA, 15 bp, Homo sapiens
gtaggattgtaaatc

SEQ ID NO: 108450 - DNA, 15 bp, Homo sapiens
ggtaggattgtaaat

SEQ ID NO: 108451 - DNA, 15 bp, Homo sapiens
tggtaggattgtaaa

SEQ ID NO: 108452 - DNA, 15 bp, Homo sapiens
ttggtaggattgtaa

SEQ ID NO: 108453 - DNA, 15 bp, Homo sapiens
gttggtaggattgta

SEQ ID NO: 108454 - DNA, 15 bp, Homo sapiens
tgttggtaggattgt

SEQ ID NO: 108455 - DNA, 15 bp, Homo sapiens
ctgttggtaggattg

SEQ ID NO: 108456 - DNA, 15 bp, Homo sapiens
actgttggtaggatt

SEQ ID NO: 108457 - DNA, 15 bp, Homo sapiens
cactgttggtaggat

SEQ ID NO: 108458 - DNA, 15 bp, Homo sapiens
tacactgttggtagg

SEQ ID NO: 108459 - DNA, 15 bp, Homo sapiens
atacactgttggtag

SEQ ID NO: 108460 - DNA, 15 bp, Homo sapiens
catacactgttggta

SEQ ID NO: 108461 - DNA, 15 bp, Homo sapiens
ccatacactgttggt

SEQ ID NO: 108462 - DNA, 15 bp, Homo sapiens
accatacactgttgg

SEQ ID NO: 108463 - DNA, 15 bp, Homo sapiens
caccatacactgttg

SEQ ID NO: 108464 - DNA, 15 bp, Homo sapiens
acaccatacactgtt

SEQ ID NO: 108465 - DNA, 15 bp, Homo sapiens
aacaccatacactgt

SEQ ID NO: 108466 - DNA, 15 bp, Homo sapiens
gaacaccatacactg

SEQ ID NO: 108467 - DNA, 15 bp, Homo sapiens
ggaacaccatacact

SEQ ID NO: 108468 - DNA, 15 bp, Homo sapiens
gggaacaccatacac

SEQ ID NO: 108469 - DNA, 15 bp, Homo sapiens
agggaacaccataca

SEQ ID NO: 108470 - DNA, 15 bp, Homo sapiens
aagggaacaccatac

SEQ ID NO: 108471 - DNA, 15 bp, Homo sapiens
aaagggaacaccata

SEQ ID NO: 108472 - DNA, 15 bp, Homo sapiens
aaaagggaacaccat

SEQ ID NO: 108473 - DNA, 15 bp, Homo sapiens
gaaaagggaacacca

SEQ ID NO: 108474 - DNA, 15 bp, Homo sapiens
agaaaagggaacacc

SEQ ID NO: 108475 - DNA, 15 bp, Homo sapiens
gagaaaagggaacac

SEQ ID NO: 108476 - DNA, 15 bp, Homo sapiens
agagaaaagggaaca

SEQ ID NO: 108477 - DNA, 15 bp, Homo sapiens
cagagaaaagggaac

SEQ ID NO: 108478 - DNA, 15 bp, Homo sapiens
gcagagaaaagggaa

SEQ ID NO: 108479 - DNA, 15 bp, Homo sapiens
tgcagagaaaaggga

SEQ ID NO: 108480 - DNA, 15 bp, Homo sapiens
ctgcagagaaaaggg

SEQ ID NO: 108481 - DNA, 15 bp, Homo sapiens
gctgcagagaaaagg

SEQ ID NO: 108482 - DNA, 15 bp, Homo sapiens
ggctgcagagaaaag

SEQ ID NO: 108483 - DNA, 15 bp, Homo sapiens
aggctgcagagaaaa

SEQ ID NO: 108484 - DNA, 15 bp, Homo sapiens
aaggctgcagagaaa

SEQ ID NO: 108485 - DNA, 15 bp, Homo sapiens
caaggctgcagagaa

SEQ ID NO: 108486 - DNA, 15 bp, Homo sapiens
gcaaggctgcagaga

SEQ ID NO: 108487 - DNA, 15 bp, Homo sapiens
ggcaaggctgcagag

SEQ ID NO: 108488 - DNA, 15 bp, Homo sapiens
tggcaaggctgcaga

SEQ ID NO: 108489 - DNA, 15 bp, Homo sapiens
ctggcaaggctgcag

SEQ ID NO: 108490 - DNA, 15 bp, Homo sapiens
gctggcaaggctgca

SEQ ID NO: 108491 - DNA, 15 bp, Homo sapiens
tgctggcaaggctgc

SEQ ID NO: 108492 - DNA, 15 bp, Homo sapiens
atgctggcaaggctg

SEQ ID NO: 108493 - DNA, 15 bp, Homo sapiens
gatgctggcaaggct

SEQ ID NO: 108494 - DNA, 15 bp, Homo sapiens
agatgctggcaaggc

SEQ ID NO: 108495 - DNA, 15 bp, Homo sapiens
cagatgctggcaagg

SEQ ID NO: 108496 - DNA, 15 bp, Homo sapiens
acagatgctggcaag

SEQ ID NO: 108497 - DNA, 15 bp, Homo sapiens
aacagatgctggcaa

SEQ ID NO: 108498 - DNA, 15 bp, Homo sapiens
caacagatgctggca

SEQ ID NO: 108499 - DNA, 15 bp, Homo sapiens
acaacagatgctggc

SEQ ID NO: 108500 - DNA, 15 bp, Homo sapiens
aacaacagatgctgg

SEQ ID NO: 108501 - DNA, 15 bp, Homo sapiens
aaacaacagatgctg

SEQ ID NO: 108502 - DNA, 15 bp, Homo sapiens
aaaacaacagatgct

SEQ ID NO: 108503 - DNA, 15 bp, Homo sapiens
aaaaacaacagatgc

SEQ ID NO: 108504 - DNA, 15 bp, Homo sapiens
aaaaaacaacagatg

SEQ ID NO: 108505 - DNA, 15 bp, Homo sapiens
caaaaaacaacagat

SEQ ID NO: 108506 - DNA, 15 bp, Homo sapiens
tcaaaaaacaacaga

SEQ ID NO: 108507 - DNA, 15 bp, Homo sapiens
gtcaaaaaacaacag

SEQ ID NO: 108508 - DNA, 15 bp, Homo sapiens
agtcaaaaaacaaca

SEQ ID NO: 108509 - DNA, 15 bp, Homo sapiens
aagtcaaaaaacaac

SEQ ID NO: 108510 - DNA, 15 bp, Homo sapiens
aaagtcaaaaaacaa

SEQ ID NO: 108511 - DNA, 15 bp, Homo sapiens
aaaagtcaaaaaaca

SEQ ID NO: 108512 - DNA, 15 bp, Homo sapiens
aaaaagtcaaaaaac

SEQ ID NO: 108513 - DNA, 15 bp, Homo sapiens
taaaaagtcaaaaaa

SEQ ID NO: 108514 - DNA, 15 bp, Homo sapiens
ttaaaaagtcaaaaa

SEQ ID NO: 108515 - DNA, 15 bp, Homo sapiens
attaaaaagtcaaaa

SEQ ID NO: 108516 - DNA, 15 bp, Homo sapiens
tattaaaaagtcaaa

SEQ ID NO: 108517 - DNA, 15 bp, Homo sapiens
ttattaaaaagtcaa

SEQ ID NO: 108518 - DNA, 15 bp, Homo sapiens
attattaaaaagtca

SEQ ID NO: 108519 - DNA, 15 bp, Homo sapiens
cattattaaaaagtc

SEQ ID NO: 108520 - DNA, 15 bp, Homo sapiens
ccattattaaaaagt

SEQ ID NO: 108521 - DNA, 15 bp, Homo sapiens
accattattaaaaag

SEQ ID NO: 108522 - DNA, 15 bp, Homo sapiens
gaccattattaaaaa

SEQ ID NO: 108523 - DNA, 15 bp, Homo sapiens
tgaccattattaaaa

SEQ ID NO: 108524 - DNA, 15 bp, Homo sapiens
atgaccattattaaa

SEQ ID NO: 108525 - DNA, 15 bp, Homo sapiens
aatgaccattattaa

SEQ ID NO: 108526 - DNA, 15 bp, Homo sapiens
gaatgaccattatta

SEQ ID NO: 108527 - DNA, 15 bp, Homo sapiens
tgaatgaccattatt

SEQ ID NO: 108528 - DNA, 15 bp, Homo sapiens
ctgaatgaccattat

SEQ ID NO: 108529 - DNA, 15 bp, Homo sapiens
tctgaatgaccatta

SEQ ID NO: 108530 - DNA, 15 bp, Homo sapiens
gtctgaatgaccatt

SEQ ID NO: 108531 - DNA, 15 bp, Homo sapiens
agtctgaatgaccat

SEQ ID NO: 108532 - DNA, 15 bp, Homo sapiens
cagtctgaatgacca

SEQ ID NO: 108533 - DNA, 15 bp, Homo sapiens
ccagtctgaatgacc

SEQ ID NO: 108534 - DNA, 15 bp, Homo sapiens
accagtctgaatgac

SEQ ID NO: 108535 - DNA, 15 bp, Homo sapiens
caccagtctgaatga

SEQ ID NO: 108536 - DNA, 15 bp, Homo sapiens
acaccagtctgaatg

SEQ ID NO: 108537 - DNA, 15 bp, Homo sapiens
cacaccagtctgaat

SEQ ID NO: 108538 - DNA, 15 bp, Homo sapiens
tcacaccagtctgaa

SEQ ID NO: 108539 - DNA, 15 bp, Homo sapiens
ctcacaccagtctga

SEQ ID NO: 108540 - DNA, 15 bp, Homo sapiens
tctcacaccagtctg

SEQ ID NO: 108541 - DNA, 15 bp, Homo sapiens
atctcacaccagtct

SEQ ID NO: 108542 - DNA, 15 bp, Homo sapiens
tatctcacaccagtc

SEQ ID NO: 108543 - DNA, 15 bp, Homo sapiens
ctatctcacaccagt

SEQ ID NO: 108544 - DNA, 15 bp, Homo sapiens
actatctcacaccag

SEQ ID NO: 108545 - DNA, 15 bp, Homo sapiens
tactatctcacacca

SEQ ID NO: 108546 - DNA, 15 bp, Homo sapiens
atactatctcacacc

SEQ ID NO: 108547 - DNA, 15 bp, Homo sapiens
gatactatctcacac

SEQ ID NO: 108548 - DNA, 15 bp, Homo sapiens
agatactatctcaca

SEQ ID NO: 108549 - DNA, 15 bp, Homo sapiens
aagatactatctcac

SEQ ID NO: 108550 - DNA, 15 bp, Homo sapiens
taagatactatctca

SEQ ID NO: 108551 - DNA, 15 bp, Homo sapiens
ataagatactatctc

SEQ ID NO: 108552 - DNA, 15 bp, Homo sapiens
aataagatactatct

SEQ ID NO: 108553 - DNA, 15 bp, Homo sapiens
caataagatactatc

SEQ ID NO: 108554 - DNA, 15 bp, Homo sapiens
acaataagatactat

SEQ ID NO: 108555 - DNA, 15 bp, Homo sapiens
cacaataagatacta

SEQ ID NO: 108556 - DNA, 15 bp, Homo sapiens
ccacaataagatact

SEQ ID NO: 108557 - DNA, 15 bp, Homo sapiens
accacaataagatac

SEQ ID NO: 108558 - DNA, 15 bp, Homo sapiens
aaccacaataagata

SEQ ID NO: 108559 - DNA, 15 bp, Homo sapiens
aaaccacaataagat

SEQ ID NO: 108560 - DNA, 15 bp, Homo sapiens
aaaaccacaataaga

SEQ ID NO: 108561 - DNA, 15 bp, Homo sapiens
caaaaccacaataag

SEQ ID NO: 108562 - DNA, 15 bp, Homo sapiens
tcaaaaccacaataa

SEQ ID NO: 108563 - DNA, 15 bp, Homo sapiens
atcaaaaccacaata

SEQ ID NO: 108564 - DNA, 15 bp, Homo sapiens
gatgcaaatcaaaac

SEQ ID NO: 108565 - DNA, 15 bp, Homo sapiens
tgatgcaaatcaaaa

SEQ ID NO: 108566 - DNA, 15 bp, Homo sapiens
ctgatgcaaatcaaa

SEQ ID NO: 108567 - DNA, 15 bp, Homo sapiens
tctgatgcaaatcaa

SEQ ID NO: 108568 - DNA, 15 bp, Homo sapiens
ttctgatgcaaatca

SEQ ID NO: 108569 - DNA, 15 bp, Homo sapiens
tttctgatgcaaatc

SEQ ID NO: 108570 - DNA, 15 bp, Homo sapiens
atttctgatgcaaat

SEQ ID NO: 108571 - DNA, 15 bp, Homo sapiens
gatttctgatgcaaa

SEQ ID NO: 108572 - DNA, 15 bp, Homo sapiens
agatttctgatgcaa

SEQ ID NO: 108573 - DNA, 15 bp, Homo sapiens
cagatttctgatgca

SEQ ID NO: 108574 - DNA, 15 bp, Homo sapiens
acagatttctgatgc

SEQ ID NO: 108575 - DNA, 15 bp, Homo sapiens
aacagatttctgatg

SEQ ID NO: 108576 - DNA, 15 bp, Homo sapiens
aaacagatttctgat

SEQ ID NO: 108577 - DNA, 15 bp, Homo sapiens
taaacagatttctga

SEQ ID NO: 108578 - DNA, 15 bp, Homo sapiens
gtaaacagatttctg

SEQ ID NO: 108579 - DNA, 15 bp, Homo sapiens
agtaaacagatttct

SEQ ID NO: 108580 - DNA, 15 bp, Homo sapiens
aagtaaacagatttc

SEQ ID NO: 108581 - DNA, 15 bp, Homo sapiens
taagtaaacagattt

SEQ ID NO: 108582 - DNA, 15 bp, Homo sapiens
ataagtaaacagatt

SEQ ID NO: 108583 - DNA, 15 bp, Homo sapiens
tataagtaaacagat

SEQ ID NO: 108584 - DNA, 15 bp, Homo sapiens
ctataagtaaacaga

SEQ ID NO: 108585 - DNA, 15 bp, Homo sapiens
actataagtaaacag

SEQ ID NO: 108586 - DNA, 15 bp, Homo sapiens
aactataagtaaaca

SEQ ID NO: 108587 - DNA, 15 bp, Homo sapiens
taactataagtaaac

SEQ ID NO: 108588 - DNA, 15 bp, Homo sapiens
ataactataagtaaa

SEQ ID NO: 108589 - DNA, 15 bp, Homo sapiens
tataactataagtaa

SEQ ID NO: 108590 - DNA, 15 bp, Homo sapiens
atataactataagta

SEQ ID NO: 108591 - DNA, 15 bp, Homo sapiens
tatataactataagt

SEQ ID NO: 108592 - DNA, 15 bp, Homo sapiens
gtatataactataag

SEQ ID NO: 108593 - DNA, 15 bp, Homo sapiens
tgtatataactataa

SEQ ID NO: 108594 - DNA, 15 bp, Homo sapiens
atgtatataactata

SEQ ID NO: 108595 - DNA, 15 bp, Homo sapiens
gatgtatataactat

SEQ ID NO: 108596 - DNA, 15 bp, Homo sapiens
agatgtatataacta

SEQ ID NO: 108597 - DNA, 15 bp, Homo sapiens
aagatgtatataact

SEQ ID NO: 108598 - DNA, 15 bp, Homo sapiens
caagatgtatataac

SEQ ID NO: 108599 - DNA, 15 bp, Homo sapiens
tcaagatgtatataa

SEQ ID NO: 108600 - DNA, 15 bp, Homo sapiens
atcaagatgtatata

SEQ ID NO: 108601 - DNA, 15 bp, Homo sapiens
tatcaagatgtatat

SEQ ID NO: 108602 - DNA, 15 bp, Homo sapiens
atatcaagatgtata

SEQ ID NO: 108603 - DNA, 15 bp, Homo sapiens
tatatcaagatgtat

SEQ ID NO: 108604 - DNA, 15 bp, Homo sapiens
atatatcaagatgta

SEQ ID NO: 108605 - DNA, 15 bp, Homo sapiens
gatatatcaagatgt

SEQ ID NO: 108606 - DNA, 15 bp, Homo sapiens
cgatatatcaagatg

SEQ ID NO: 108607 - DNA, 15 bp, Homo sapiens
tcgatatatcaagat

SEQ ID NO: 108608 - DNA, 15 bp, Homo sapiens
ctcgatatatcaaga

SEQ ID NO: 108609 - DNA, 15 bp, Homo sapiens
actcgatatatcaag

SEQ ID NO: 108610 - DNA, 15 bp, Homo sapiens
aactcgatatatcaa

SEQ ID NO: 108611 - DNA, 15 bp, Homo sapiens
aaactcgatatatca

SEQ ID NO: 108612 - DNA, 15 bp, Homo sapiens
aaaactcgatatatc

SEQ ID NO: 108613 - DNA, 15 bp, Homo sapiens
caaaactcgatatat

SEQ ID NO: 108614 - DNA, 15 bp, Homo sapiens
acaaaactcgatata

SEQ ID NO: 108615 - DNA, 15 bp, Homo sapiens
tacaaaactcgatat

SEQ ID NO: 108616 - DNA, 15 bp, Homo sapiens
atacaaaactcgata

SEQ ID NO: 108617 - DNA, 15 bp, Homo sapiens
aatacaaaactcgat

SEQ ID NO: 108618 - DNA, 15 bp, Homo sapiens
aaatacaaaactcga

SEQ ID NO: 108619 - DNA, 15 bp, Homo sapiens
aaaatacaaaactcg

SEQ ID NO: 108620 - DNA, 15 bp, Homo sapiens
aaaaatacaaaactc

SEQ ID NO: 108621 - DNA, 15 bp, Homo sapiens
aaaaaatacaaaact

SEQ ID NO: 108622 - DNA, 15 bp, Homo sapiens
taaaaaatacaaaac

SEQ ID NO: 108623 - DNA, 15 bp, Homo sapiens
gataaaaaatacaaa

SEQ ID NO: 108624 - DNA, 15 bp, Homo sapiens
tgataaaaaatacaa

SEQ ID NO: 108625 - DNA, 15 bp, Homo sapiens
atgataaaaaataca

SEQ ID NO: 108626 - DNA, 15 bp, Homo sapiens
tatgataaaaaatac

SEQ ID NO: 108627 - DNA, 15 bp, Homo sapiens
gtatgataaaaaata

SEQ ID NO: 108628 - DNA, 15 bp, Homo sapiens
tgtatgataaaaaat

SEQ ID NO: 108629 - DNA, 15 bp, Homo sapiens
ttgtatgataaaaaa

SEQ ID NO: 108630 - DNA, 15 bp, Homo sapiens
tttgtatgataaaaa

SEQ ID NO: 108631 - DNA, 15 bp, Homo sapiens
atttgtatgataaaa

SEQ ID NO: 108632 - DNA, 15 bp, Homo sapiens
aatttgtatgataaa

SEQ ID NO: 108633 - DNA, 15 bp, Homo sapiens
taatttgtatgataa

SEQ ID NO: 108634 - DNA, 15 bp, Homo sapiens
ataatttgtatgata

SEQ ID NO: 108635 - DNA, 15 bp, Homo sapiens
tataatttgtatgat

SEQ ID NO: 108636 - DNA, 15 bp, Homo sapiens
atataatttgtatga

SEQ ID NO: 108637 - DNA, 15 bp, Homo sapiens
tatataatttgtatg

SEQ ID NO: 108638 - DNA, 15 bp, Homo sapiens
atatataatttgtat

SEQ ID NO: 108639 - DNA, 15 bp, Homo sapiens
catatataatttgta

SEQ ID NO: 108640 - DNA, 15 bp, Homo sapiens
acatatataatttgt

SEQ ID NO: 108641 - DNA, 15 bp, Homo sapiens
aacatatataatttg

SEQ ID NO: 108642 - DNA, 15 bp, Homo sapiens
gaacatatataattt

SEQ ID NO: 108643 - DNA, 15 bp, Homo sapiens
tgaacatatataatt

SEQ ID NO: 108644 - DNA, 15 bp, Homo sapiens
atgaacatatataat

SEQ ID NO: 108645 - DNA, 15 bp, Homo sapiens
aatgaacatatataa

SEQ ID NO: 108646 - DNA, 15 bp, Homo sapiens
caatgaacatatata

SEQ ID NO: 108647 - DNA, 15 bp, Homo sapiens
acaatgaacatatat

SEQ ID NO: 108648 - DNA, 15 bp, Homo sapiens
cacaatgaacatata

SEQ ID NO: 108649 - DNA, 15 bp, Homo sapiens
ccacaatgaacatat

SEQ ID NO: 108650 - DNA, 15 bp, Homo sapiens
accacaatgaacata

SEQ ID NO: 108651 - DNA, 15 bp, Homo sapiens
taccacaatgaacat

SEQ ID NO: 108652 - DNA, 15 bp, Homo sapiens
ctaccacaatgaaca

SEQ ID NO: 108653 - DNA, 15 bp, Homo sapiens
tctaccacaatgaac

SEQ ID NO: 108654 - DNA, 15 bp, Homo sapiens
gtctaccacaatgaa

SEQ ID NO: 108655 - DNA, 15 bp, Homo sapiens
agtctaccacaatga

SEQ ID NO: 108656 - DNA, 15 bp, Homo sapiens
aagtctaccacaatg

SEQ ID NO: 108657 - DNA, 15 bp, Homo sapiens
taagtctaccacaat

SEQ ID NO: 108658 - DNA, 15 bp, Homo sapiens
ctaagtctaccacaa

SEQ ID NO: 108659 - DNA, 15 bp, Homo sapiens
actaagtctaccaca

SEQ ID NO: 108660 - DNA, 15 bp, Homo sapiens
tactaagtctaccac

SEQ ID NO: 108661 - DNA, 15 bp, Homo sapiens
gtactaagtctacca

SEQ ID NO: 108662 - DNA, 15 bp, Homo sapiens
agtactaagtctacc

SEQ ID NO: 108663 - DNA, 15 bp, Homo sapiens
aagtactaagtctac

SEQ ID NO: 108664 - DNA, 15 bp, Homo sapiens
gaagtactaagtcta

SEQ ID NO: 108665 - DNA, 15 bp, Homo sapiens
agaagtactaagtct

SEQ ID NO: 108666 - DNA, 15 bp, Homo sapiens
cagaagtactaagtc

SEQ ID NO: 108667 - DNA, 15 bp, Homo sapiens
tcagaagtactaagt

SEQ ID NO: 108668 - DNA, 15 bp, Homo sapiens
ctcagaagtactaag

SEQ ID NO: 108669 - DNA, 15 bp, Homo sapiens
tctcagaagtactaa

SEQ ID NO: 108670 - DNA, 15 bp, Homo sapiens
ttctcagaagtacta

SEQ ID NO: 108671 - DNA, 15 bp, Homo sapiens
tttctcagaagtact

SEQ ID NO: 108672 - DNA, 15 bp, Homo sapiens
atttctcagaagtac

SEQ ID NO: 108673 - DNA, 15 bp, Homo sapiens
tatttctcagaagta

SEQ ID NO: 108674 - DNA, 15 bp, Homo sapiens
ctatttctcagaagt

SEQ ID NO: 108675 - DNA, 15 bp, Homo sapiens
tctatttctcagaag

SEQ ID NO: 108676 - DNA, 15 bp, Homo sapiens
ttctatttctcagaa

SEQ ID NO: 108677 - DNA, 15 bp, Homo sapiens
tttctatttctcaga

SEQ ID NO: 108678 - DNA, 15 bp, Homo sapiens
atttctatttctcag

SEQ ID NO: 108679 - DNA, 15 bp, Homo sapiens
tatttctatttctca

SEQ ID NO: 108680 - DNA, 15 bp, Homo sapiens
ttatttctatttctc

SEQ ID NO: 108681 - DNA, 15 bp, Homo sapiens
tttatttctatttct

SEQ ID NO: 108682 - DNA, 15 bp, Homo sapiens
atttatttctatttc

SEQ ID NO: 108683 - DNA, 15 bp, Homo sapiens
catttatttctattt

SEQ ID NO: 108684 - DNA, 15 bp, Homo sapiens
acatttatttctatt

SEQ ID NO: 108685 - DNA, 15 bp, Homo sapiens
aacatttatttctat

SEQ ID NO: 108686 - DNA, 15 bp, Homo sapiens
taacatttatttcta

SEQ ID NO: 108687 - DNA, 15 bp, Homo sapiens
ttaacatttatttct

SEQ ID NO: 108688 - DNA, 15 bp, Homo sapiens
attaacatttatttc

SEQ ID NO: 108689 - DNA, 15 bp, Homo sapiens
tattaacatttattt

SEQ ID NO: 108690 - DNA, 15 bp, Homo sapiens
ttattaacatttatt

SEQ ID NO: 108691 - DNA, 15 bp, Homo sapiens
attattaacatttat

SEQ ID NO: 108692 - DNA, 15 bp, Homo sapiens
aattattaacattta

SEQ ID NO: 108693 - DNA, 15 bp, Homo sapiens
gaattattaacattt

SEQ ID NO: 108694 - DNA, 15 bp, Homo sapiens
ggaattattaacatt

SEQ ID NO: 108695 - DNA, 15 bp, Homo sapiens
tggaattattaacat

SEQ ID NO: 108696 - DNA, 15 bp, Homo sapiens
ttggaattattaaca

SEQ ID NO: 108697 - DNA, 15 bp, Homo sapiens
tttggaattattaac

SEQ ID NO: 108698 - DNA, 15 bp, Homo sapiens
atttggaattattaa

SEQ ID NO: 108699 - DNA, 15 bp, Homo sapiens
gatttggaattatta

SEQ ID NO: 108700 - DNA, 15 bp, Homo sapiens
ggatttggaattatt

SEQ ID NO: 108701 - DNA, 15 bp, Homo sapiens
tggatttggaattat

SEQ ID NO: 108702 - DNA, 15 bp, Homo sapiens
ttggatttggaatta

SEQ ID NO: 108703 - DNA, 15 bp, Homo sapiens
gttggatttggaatt

SEQ ID NO: 108704 - DNA, 15 bp, Homo sapiens
tgttggatttggaat

SEQ ID NO: 108705 - DNA, 15 bp, Homo sapiens
ctgttggatttggaa

SEQ ID NO: 108706 - DNA, 15 bp, Homo sapiens
tctgttggatttgga

SEQ ID NO: 108707 - DNA, 15 bp, Homo sapiens
gtctgttggatttgg

SEQ ID NO: 108708 - DNA, 15 bp, Homo sapiens
tgtctgttggatttg

SEQ ID NO: 108709 - DNA, 15 bp, Homo sapiens
ctgtctgttggattt

SEQ ID NO: 108710 - DNA, 15 bp, Homo sapiens
gctgtctgttggatt

SEQ ID NO: 108711 - DNA, 15 bp, Homo sapiens
tgctgtctgttggat

SEQ ID NO: 108712 - DNA, 15 bp, Homo sapiens
ctgctgtctgttgga

SEQ ID NO: 108713 - DNA, 15 bp, Homo sapiens
actgctgtctgttgg

SEQ ID NO: 108714 - DNA, 15 bp, Homo sapiens
tactgctgtctgttg

SEQ ID NO: 108715 - DNA, 15 bp, Homo sapiens
ctactgctgtctgtt

SEQ ID NO: 108716 - DNA, 15 bp, Homo sapiens
gctactgctgtctgt

SEQ ID NO: 108717 - DNA, 15 bp, Homo sapiens
ggctactgctgtctg

SEQ ID NO: 108718 - DNA, 15 bp, Homo sapiens
tggctactgctgtct

SEQ ID NO: 108719 - DNA, 15 bp, Homo sapiens
ctggctactgctgtc

SEQ ID NO: 108720 - DNA, 15 bp, Homo sapiens
actggctactgctgt

SEQ ID NO: 108721 - DNA, 15 bp, Homo sapiens
cactggctactgctg

SEQ ID NO: 108722 - DNA, 15 bp, Homo sapiens
acactggctactgct

SEQ ID NO: 108723 - DNA, 15 bp, Homo sapiens
aacactggctactgc

SEQ ID NO: 108724 - DNA, 15 bp, Homo sapiens
caacactggctactg

SEQ ID NO: 108725 - DNA, 15 bp, Homo sapiens
ccaacactggctact

SEQ ID NO: 108726 - DNA, 15 bp, Homo sapiens
gccaacactggctac

SEQ ID NO: 108727 - DNA, 15 bp, Homo sapiens
agccaacactggcta

SEQ ID NO: 108728 - DNA, 15 bp, Homo sapiens
aagccaacactggct

SEQ ID NO: 108729 - DNA, 15 bp, Homo sapiens
caagccaacactggc

SEQ ID NO: 108730 - DNA, 15 bp, Homo sapiens
acaagccaacactgg

SEQ ID NO: 108731 - DNA, 15 bp, Homo sapiens
aacaagccaacactg

SEQ ID NO: 108732 - DNA, 15 bp, Homo sapiens
aaacaagccaacact

SEQ ID NO: 108733 - DNA, 15 bp, Homo sapiens
aaaacaagccaacac

SEQ ID NO: 108734 - DNA, 15 bp, Homo sapiens
taaaacaagccaaca

SEQ ID NO: 108735 - DNA, 15 bp, Homo sapiens
ctaaaacaagccaac

SEQ ID NO: 108736 - DNA, 15 bp, Homo sapiens
actaaaacaagccaa

SEQ ID NO: 108737 - DNA, 15 bp, Homo sapiens
gactaaaacaagcca

SEQ ID NO: 108738 - DNA, 15 bp, Homo sapiens
tgactaaaacaagcc

SEQ ID NO: 108739 - DNA, 15 bp, Homo sapiens
atgactaaaacaagc

SEQ ID NO: 108740 - DNA, 15 bp, Homo sapiens
tatgactaaaacaag

SEQ ID NO: 108741 - DNA, 15 bp, Homo sapiens
ttatgactaaaacaa

SEQ ID NO: 108742 - DNA, 15 bp, Homo sapiens
gttatgactaaaaca

SEQ ID NO: 108743 - DNA, 15 bp, Homo sapiens
tgttatgactaaaac

SEQ ID NO: 108744 - DNA, 15 bp, Homo sapiens
atgttatgactaaaa

SEQ ID NO: 108745 - DNA, 15 bp, Homo sapiens
catgttatgactaaa

SEQ ID NO: 108746 - DNA, 15 bp, Homo sapiens
gcatgttatgactaa

SEQ ID NO: 108747 - DNA, 15 bp, Homo sapiens
tgcatgttatgacta

SEQ ID NO: 108748 - DNA, 15 bp, Homo sapiens
ttgcatgttatgact

SEQ ID NO: 108749 - DNA, 15 bp, Homo sapiens
cttgcatgttatgac

SEQ ID NO: 108750 - DNA, 15 bp, Homo sapiens
tcttgcatgttatga

SEQ ID NO: 108751 - DNA, 15 bp, Homo sapiens
atcttgcatgttatg

SEQ ID NO: 108752 - DNA, 15 bp, Homo sapiens
aatcttgcatgttat

SEQ ID NO: 108753 - DNA, 15 bp, Homo sapiens
aaatcttgcatgtta

SEQ ID NO: 108754 - DNA, 15 bp, Homo sapiens
aaaatcttgcatgtt

SEQ ID NO: 108755 - DNA, 15 bp, Homo sapiens
aaaaatcttgcatgt

SEQ ID NO: 108756 - DNA, 15 bp, Homo sapiens
aaaaaatcttgcatg

SEQ ID NO: 108757 - DNA, 15 bp, Homo sapiens
taaaaaatcttgcat

SEQ ID NO: 108758 - DNA, 15 bp, Homo sapiens
ttaaaaaatcttgca

SEQ ID NO: 108759 - DNA, 15 bp, Homo sapiens
tttaaaaaatcttgc

SEQ ID NO: 108760 - DNA, 15 bp, Homo sapiens
ttttaaaaaatcttg

SEQ ID NO: 108761 - DNA, 15 bp, Homo sapiens
tttttaaaaaatctt

SEQ ID NO: 108762 - DNA, 15 bp, Homo sapiens
atttttaaaaaatct

SEQ ID NO: 108763 - DNA, 15 bp, Homo sapiens
catttttaaaaaatc

SEQ ID NO: 108764 - DNA, 15 bp, Homo sapiens
acatttttaaaaaat

SEQ ID NO: 108765 - DNA, 15 bp, Homo sapiens
tacatttttaaaaaa

SEQ ID NO: 108766 - DNA, 15 bp, Homo sapiens
ttacatttttaaaaa

SEQ ID NO: 108767 - DNA, 15 bp, Homo sapiens
attacatttttaaaa

SEQ ID NO: 108768 - DNA, 15 bp, Homo sapiens
aattacatttttaaa

SEQ ID NO: 108769 - DNA, 15 bp, Homo sapiens
aaattacatttttaa

SEQ ID NO: 108770 - DNA, 15 bp, Homo sapiens
aaaattacattttta

SEQ ID NO: 108771 - DNA, 15 bp, Homo sapiens
taaaattacattttt

SEQ ID NO: 108772 - DNA, 15 bp, Homo sapiens
ttaaaattacatttt

SEQ ID NO: 108773 - DNA, 15 bp, Homo sapiens
attaaaattacattt

SEQ ID NO: 108774 - DNA, 15 bp, Homo sapiens
aattaaaattacatt

SEQ ID NO: 108775 - DNA, 15 bp, Homo sapiens
caattaaaattacat

SEQ ID NO: 108776 - DNA, 15 bp, Homo sapiens
acaattaaaattaca

SEQ ID NO: 108777 - DNA, 15 bp, Homo sapiens
cacaattaaaattac

SEQ ID NO: 108778 - DNA, 15 bp, Homo sapiens
tcacaattaaaatta

SEQ ID NO: 108779 - DNA, 15 bp, Homo sapiens
atcacaattaaaatt

SEQ ID NO: 108780 - DNA, 15 bp, Homo sapiens
tatcacaattaaaat

SEQ ID NO: 108781 - DNA, 15 bp, Homo sapiens
ttatcacaattaaaa

SEQ ID NO: 108782 - DNA, 15 bp, Homo sapiens
tttatcacaattaaa

SEQ ID NO: 108783 - DNA, 15 bp, Homo sapiens
gtttatcacaattaa

SEQ ID NO: 108784 - DNA, 15 bp, Homo sapiens
tgtttatcacaatta

SEQ ID NO: 108785 - DNA, 15 bp, Homo sapiens
atgtttatcacaatt

SEQ ID NO: 108786 - DNA, 15 bp, Homo sapiens
aatgtttatcacaat

SEQ ID NO: 108787 - DNA, 15 bp, Homo sapiens
gaatgtttatcacaa

SEQ ID NO: 108788 - DNA, 15 bp, Homo sapiens
agaatgtttatcaca

SEQ ID NO: 108789 - DNA, 15 bp, Homo sapiens
cagaatgtttatcac

SEQ ID NO: 108790 - DNA, 15 bp, Homo sapiens
acagaatgtttatca

SEQ ID NO: 108791 - DNA, 15 bp, Homo sapiens
aacagaatgtttatc

SEQ ID NO: 108792 - DNA, 15 bp, Homo sapiens
aaacagaatgtttat

SEQ ID NO: 108793 - DNA, 15 bp, Homo sapiens
aaaacagaatgttta

SEQ ID NO: 108794 - DNA, 15 bp, Homo sapiens
aaaaacagaatgttt

SEQ ID NO: 108795 - DNA, 15 bp, Homo sapiens
taaaaacagaatgtt

SEQ ID NO: 108796 - DNA, 15 bp, Homo sapiens
ctaaaaacagaatgt

SEQ ID NO: 108797 - DNA, 15 bp, Homo sapiens
actaaaaacagaatg

SEQ ID NO: 108798 - DNA, 15 bp, Homo sapiens
gactaaaaacagaat

SEQ ID NO: 108799 - DNA, 15 bp, Homo sapiens
ggactaaaaacagaa

SEQ ID NO: 108800 - DNA, 15 bp, Homo sapiens
aggactaaaaacaga

SEQ ID NO: 108801 - DNA, 15 bp, Homo sapiens
taggactaaaaacag

SEQ ID NO: 108802 - DNA, 15 bp, Homo sapiens
ttaggactaaaaaca

SEQ ID NO: 108803 - DNA, 15 bp, Homo sapiens
attaggactaaaaac

SEQ ID NO: 108804 - DNA, 15 bp, Homo sapiens
cattaggactaaaaa

SEQ ID NO: 108805 - DNA, 15 bp, Homo sapiens
acattaggactaaaa

SEQ ID NO: 108806 - DNA, 15 bp, Homo sapiens
aacattaggactaaa

SEQ ID NO: 108807 - DNA, 15 bp, Homo sapiens
aaacattaggactaa

SEQ ID NO: 108808 - DNA, 15 bp, Homo sapiens
aaaacattaggacta

SEQ ID NO: 108809 - DNA, 15 bp, Homo sapiens
gaaaacattaggact

SEQ ID NO: 108810 - DNA, 15 bp, Homo sapiens
ggaaaacattaggac

SEQ ID NO: 108811 - DNA, 15 bp, Homo sapiens
gggaaaacattagga

SEQ ID NO: 108812 - DNA, 15 bp, Homo sapiens
tgggaaaacattagg

SEQ ID NO: 108813 - DNA, 15 bp, Homo sapiens
atgggaaaacattag

SEQ ID NO: 108814 - DNA, 15 bp, Homo sapiens
aatgggaaaacatta

SEQ ID NO: 108815 - DNA, 15 bp, Homo sapiens
aaatgggaaaacatt

SEQ ID NO: 108816 - DNA, 15 bp, Homo sapiens
aaaatgggaaaacat

SEQ ID NO: 108817 - DNA, 15 bp, Homo sapiens
taaaatgggaaaaca

SEQ ID NO: 108818 - DNA, 15 bp, Homo sapiens
ataaaatgggaaaac

SEQ ID NO: 108819 - DNA, 15 bp, Homo sapiens
cataaaatgggaaaa

SEQ ID NO: 108820 - DNA, 15 bp, Homo sapiens
acataaaatgggaaa

SEQ ID NO: 108821 - DNA, 15 bp, Homo sapiens
tacataaaatgggaa

SEQ ID NO: 108822 - DNA, 15 bp, Homo sapiens
ctacataaaatggga

SEQ ID NO: 108823 - DNA, 15 bp, Homo sapiens
cctacataaaatggg

SEQ ID NO: 108824 - DNA, 15 bp, Homo sapiens
tcctacataaaatgg

SEQ ID NO: 108825 - DNA, 15 bp, Homo sapiens
ttcctacataaaatg

SEQ ID NO: 108826 - DNA, 15 bp, Homo sapiens
tttcctacataaaat

SEQ ID NO: 108827 - DNA, 15 bp, Homo sapiens
ttttcctacataaaa

SEQ ID NO: 108828 - DNA, 15 bp, Homo sapiens
tttttcctacataaa

SEQ ID NO: 108829 - DNA, 15 bp, Homo sapiens
atttttcctacataa

SEQ ID NO: 108830 - DNA, 15 bp, Homo sapiens
tatttttcctacata

SEQ ID NO: 108831 - DNA, 15 bp, Homo sapiens
atatttttcctacat

SEQ ID NO: 108832 - DNA, 15 bp, Homo sapiens
aatatttttcctaca

SEQ ID NO: 108833 - DNA, 15 bp, Homo sapiens
aaatatttttcctac

SEQ ID NO: 108834 - DNA, 15 bp, Homo sapiens
taaatatttttccta

SEQ ID NO: 108835 - DNA, 15 bp, Homo sapiens
ataaatatttttcct

SEQ ID NO: 108836 - DNA, 15 bp, Homo sapiens
tataaatatttttcc

SEQ ID NO: 108837 - DNA, 15 bp, Homo sapiens
atataaatatttttc

SEQ ID NO: 108838 - DNA, 15 bp, Homo sapiens
aatataaatattttt

SEQ ID NO: 108839 - DNA, 15 bp, Homo sapiens
taatataaatatttt

SEQ ID NO: 108840 - DNA, 15 bp, Homo sapiens
ataatataaatattt

SEQ ID NO: 108841 - DNA, 15 bp, Homo sapiens
gataatataaatatt

SEQ ID NO: 108842 - DNA, 15 bp, Homo sapiens
tgataatataaatat

SEQ ID NO: 108843 - DNA, 15 bp, Homo sapiens
ttgataatataaata

SEQ ID NO: 108844 - DNA, 15 bp, Homo sapiens
cttgataatataaat

SEQ ID NO: 108845 - DNA, 15 bp, Homo sapiens
acttgataatataaa

SEQ ID NO: 108846 - DNA, 15 bp, Homo sapiens
tacttgataatataa

SEQ ID NO: 108847 - DNA, 15 bp, Homo sapiens
gtacttgataatata

SEQ ID NO: 108848 - DNA, 15 bp, Homo sapiens
agtacttgataatat

SEQ ID NO: 108849 - DNA, 15 bp, Homo sapiens
aagtacttgataata

SEQ ID NO: 108850 - DNA, 15 bp, Homo sapiens
aaagtacttgataat

SEQ ID NO: 108851 - DNA, 15 bp, Homo sapiens
gaaagtacttgataa

SEQ ID NO: 108852 - DNA, 15 bp, Homo sapiens
tgaaagtacttgata

SEQ ID NO: 108853 - DNA, 15 bp, Homo sapiens
atgaaagtacttgat

SEQ ID NO: 108854 - DNA, 15 bp, Homo sapiens
tatgaaagtacttga

SEQ ID NO: 108855 - DNA, 15 bp, Homo sapiens
ttatgaaagtacttg

SEQ ID NO: 108856 - DNA, 15 bp, Homo sapiens
cttatgaaagtactt

SEQ ID NO: 108857 - DNA, 15 bp, Homo sapiens
gcttatgaaagtact

SEQ ID NO: 108858 - DNA, 15 bp, Homo sapiens
tgcttatgaaagtac

SEQ ID NO: 108859 - DNA, 15 bp, Homo sapiens
atgcttatgaaagta

SEQ ID NO: 108860 - DNA, 15 bp, Homo sapiens
aatgcttatgaaagt

SEQ ID NO: 108861 - DNA, 15 bp, Homo sapiens
aaatgcttatgaaag

SEQ ID NO: 108862 - DNA, 15 bp, Homo sapiens
caaatgcttatgaaa

SEQ ID NO: 108863 - DNA, 15 bp, Homo sapiens
acaaatgcttatgaa

SEQ ID NO: 108864 - DNA, 15 bp, Homo sapiens
gacaaatgcttatga

SEQ ID NO: 108865 - DNA, 15 bp, Homo sapiens
agacaaatgcttatg

SEQ ID NO: 108866 - DNA, 15 bp, Homo sapiens
cagacaaatgcttat

SEQ ID NO: 108867 - DNA, 15 bp, Homo sapiens
tcagacaaatgctta

SEQ ID NO: 108868 - DNA, 15 bp, Homo sapiens
ctcagacaaatgctt

SEQ ID NO: 108869 - DNA, 15 bp, Homo sapiens
tctcagacaaatgct

SEQ ID NO: 108870 - DNA, 15 bp, Homo sapiens
atctcagacaaatgc

SEQ ID NO: 108871 - DNA, 15 bp, Homo sapiens
aatctcagacaaatg

SEQ ID NO: 108872 - DNA, 15 bp, Homo sapiens
aaatctcagacaaat

SEQ ID NO: 108873 - DNA, 15 bp, Homo sapiens
aaaatctcagacaaa

SEQ ID NO: 108874 - DNA, 15 bp, Homo sapiens
caaaatctcagacaa

SEQ ID NO: 108875 - DNA, 15 bp, Homo sapiens
tcaaaatctcagaca

SEQ ID NO: 108876 - DNA, 15 bp, Homo sapiens
ttcaaaatctcagac

SEQ ID NO: 108877 - DNA, 15 bp, Homo sapiens
tttcaaaatctcaga

SEQ ID NO: 108878 - DNA, 15 bp, Homo sapiens
ctttcaaaatctcag

SEQ ID NO: 108879 - DNA, 15 bp, Homo sapiens
tctttcaaaatctca

SEQ ID NO: 108880 - DNA, 15 bp, Homo sapiens
ttctttcaaaatctc

SEQ ID NO: 108881 - DNA, 15 bp, Homo sapiens
attctttcaaaatct

SEQ ID NO: 108882 - DNA, 15 bp, Homo sapiens
cattctttcaaaatc

SEQ ID NO: 108883 - DNA, 15 bp, Homo sapiens
tcattctttcaaaat

SEQ ID NO: 108884 - DNA, 15 bp, Homo sapiens
ctcattctttcaaaa

SEQ ID NO: 108885 - DNA, 15 bp, Homo sapiens
gctcattctttcaaa

SEQ ID NO: 108886 - DNA, 15 bp, Homo sapiens
tgctcattctttcaa

SEQ ID NO: 108887 - DNA, 15 bp, Homo sapiens
atgctcattctttca

SEQ ID NO: 108888 - DNA, 15 bp, Homo sapiens
tatgctcattctttc

SEQ ID NO: 108889 - DNA, 15 bp, Homo sapiens
ttatgctcattcttt

SEQ ID NO: 108890 - DNA, 15 bp, Homo sapiens
tttatgctcattctt

SEQ ID NO: 108891 - DNA, 15 bp, Homo sapiens
gtttatgctcattct

SEQ ID NO: 108892 - DNA, 15 bp, Homo sapiens
agtttatgctcattc

SEQ ID NO: 108893 - DNA, 15 bp, Homo sapiens
gagtttatgctcatt

SEQ ID NO: 108894 - DNA, 15 bp, Homo sapiens
agagtttatgctcat

SEQ ID NO: 108895 - DNA, 15 bp, Homo sapiens
tagagtttatgctca

SEQ ID NO: 108896 - DNA, 15 bp, Homo sapiens
atagagtttatgctc

SEQ ID NO: 108897 - DNA, 15 bp, Homo sapiens
aatagagtttatgct

SEQ ID NO: 108898 - DNA, 15 bp, Homo sapiens
taatagagtttatgc

SEQ ID NO: 108899 - DNA, 15 bp, Homo sapiens
ctaatagagtttatg

SEQ ID NO: 108900 - DNA, 15 bp, Homo sapiens
actaatagagtttat

SEQ ID NO: 108901 - DNA, 15 bp, Homo sapiens
aactaatagagttta

SEQ ID NO: 108902 - DNA, 15 bp, Homo sapiens
aaactaatagagttt

SEQ ID NO: 108903 - DNA, 15 bp, Homo sapiens
taaactaatagagtt

SEQ ID NO: 108904 - DNA, 15 bp, Homo sapiens
ataaactaatagagt

SEQ ID NO: 108905 - DNA, 15 bp, Homo sapiens
aataaactaatagag

SEQ ID NO: 108906 - DNA, 15 bp, Homo sapiens
aaataaactaataga

SEQ ID NO: 108907 - DNA, 15 bp, Homo sapiens
aaaataaactaatag

SEQ ID NO: 108908 - DNA, 15 bp, Homo sapiens
gaaaataaactaata

SEQ ID NO: 108909 - DNA, 15 bp, Homo sapiens
agaaaataaactaat

SEQ ID NO: 108910 - DNA, 15 bp, Homo sapiens
aagaaaataaactaa

SEQ ID NO: 108911 - DNA, 15 bp, Homo sapiens
caagaaaataaacta

SEQ ID NO: 108912 - DNA, 15 bp, Homo sapiens
acaagaaaataaact

SEQ ID NO: 108913 - DNA, 15 bp, Homo sapiens
gacaagaaaataaac

SEQ ID NO: 108914 - DNA, 15 bp, Homo sapiens
tgacaagaaaataaa

SEQ ID NO: 108915 - DNA, 15 bp, Homo sapiens
ctgacaagaaaataa

SEQ ID NO: 108916 - DNA, 15 bp, Homo sapiens
tctgacaagaaaata

SEQ ID NO: 108917 - DNA, 15 bp, Homo sapiens
atctgacaagaaaat

SEQ ID NO: 108918 - DNA, 15 bp, Homo sapiens
aatctgacaagaaaa

SEQ ID NO: 108919 - DNA, 15 bp, Homo sapiens
aaatctgacaagaaa

SEQ ID NO: 108920 - DNA, 15 bp, Homo sapiens
caaatctgacaagaa

SEQ ID NO: 108921 - DNA, 15 bp, Homo sapiens
tcaaatctgacaaga

SEQ ID NO: 108922 - DNA, 15 bp, Homo sapiens
ttcaaatctgacaag

SEQ ID NO: 108923 - DNA, 15 bp, Homo sapiens
cttcaaatctgacaa

SEQ ID NO: 108924 - DNA, 15 bp, Homo sapiens
tcttcaaatctgaca

SEQ ID NO: 108925 - DNA, 15 bp, Homo sapiens
ttcttcaaatctgac

SEQ ID NO: 108926 - DNA, 15 bp, Homo sapiens
cttcttcaaatctga

SEQ ID NO: 108927 - DNA, 15 bp, Homo sapiens
acttcttcaaatctg

SEQ ID NO: 108928 - DNA, 15 bp, Homo sapiens
aacttcttcaaatct

SEQ ID NO: 108929 - DNA, 15 bp, Homo sapiens
taacttcttcaaatc

SEQ ID NO: 108930 - DNA, 15 bp, Homo sapiens
ataacttcttcaaat

SEQ ID NO: 108931 - DNA, 15 bp, Homo sapiens
aataacttcttcaaa

SEQ ID NO: 108932 - DNA, 15 bp, Homo sapiens
taataacttcttcaa

SEQ ID NO: 108933 - DNA, 15 bp, Homo sapiens
gtaataacttcttca

SEQ ID NO: 108934 - DNA, 15 bp, Homo sapiens
tgtaataacttcttc

SEQ ID NO: 108935 - DNA, 15 bp, Homo sapiens
ttgtaataacttctt

SEQ ID NO: 108936 - DNA, 15 bp, Homo sapiens
cttgtaataacttct

SEQ ID NO: 108937 - DNA, 15 bp, Homo sapiens
gcttgtaataacttc

SEQ ID NO: 108938 - DNA, 15 bp, Homo sapiens
agcttgtaataactt

SEQ ID NO: 108939 - DNA, 15 bp, Homo sapiens
aagcttgtaataact

SEQ ID NO: 108940 - DNA, 15 bp, Homo sapiens
caagcttgtaataac

SEQ ID NO: 108941 - DNA, 15 bp, Homo sapiens
tcaagcttgtaataa

SEQ ID NO: 108942 - DNA, 15 bp, Homo sapiens
atcaagcttgtaata

SEQ ID NO: 108943 - DNA, 15 bp, Homo sapiens
aatcaagcttgtaat

SEQ ID NO: 108944 - DNA, 15 bp, Homo sapiens
aaatcaagcttgtaa

SEQ ID NO: 108945 - DNA, 15 bp, Homo sapiens
gaaatcaagcttgta

SEQ ID NO: 108946 - DNA, 15 bp, Homo sapiens
tgaaatcaagcttgt

SEQ ID NO: 108947 - DNA, 15 bp, Homo sapiens
atgaaatcaagcttg

SEQ ID NO: 108948 - DNA, 15 bp, Homo sapiens
aatgaaatcaagctt

SEQ ID NO: 108949 - DNA, 15 bp, Homo sapiens
aaatgaaatcaagct

SEQ ID NO: 108950 - DNA, 15 bp, Homo sapiens
caaatgaaatcaagc

SEQ ID NO: 108951 - DNA, 15 bp, Homo sapiens
tcaaatgaaatcaag

SEQ ID NO: 108952 - DNA, 15 bp, Homo sapiens
gtcaaatgaaatcaa

SEQ ID NO: 108953 - DNA, 15 bp, Homo sapiens
agtcaaatgaaatca

SEQ ID NO: 108954 - DNA, 15 bp, Homo sapiens
gagtcaaatgaaatc

SEQ ID NO: 108955 - DNA, 15 bp, Homo sapiens
cgagtcaaatgaaat

SEQ ID NO: 108956 - DNA, 15 bp, Homo sapiens
tcgagtcaaatgaaa

SEQ ID NO: 108957 - DNA, 15 bp, Homo sapiens
gtcgagtcaaatgaa

SEQ ID NO: 108958 - DNA, 15 bp, Homo sapiens
ggtcgagtcaaatga

SEQ ID NO: 108959 - DNA, 15 bp, Homo sapiens
aggtcgagtcaaatg

SEQ ID NO: 108960 - DNA, 15 bp, Homo sapiens
aaggtcgagtcaaat

SEQ ID NO: 108961 - DNA, 15 bp, Homo sapiens
gaaggtcgagtcaaa

SEQ ID NO: 108962 - DNA, 15 bp, Homo sapiens
tgaaggtcgagtcaa

SEQ ID NO: 108963 - DNA, 15 bp, Homo sapiens
ctgaaggtcgagtca

SEQ ID NO: 108964 - DNA, 15 bp, Homo sapiens
tctgaaggtcgagtc

SEQ ID NO: 108965 - DNA, 15 bp, Homo sapiens
gtctgaaggtcgagt

SEQ ID NO: 108966 - DNA, 15 bp, Homo sapiens
ggtctgaaggtcgag

SEQ ID NO: 108967 - DNA, 15 bp, Homo sapiens
tggtctgaaggtcga

SEQ ID NO: 108968 - DNA, 15 bp, Homo sapiens
ttggtctgaaggtcg

SEQ ID NO: 108969 - DNA, 15 bp, Homo sapiens
tttggtctgaaggtc

SEQ ID NO: 108970 - DNA, 15 bp, Homo sapiens
atttggtctgaaggt

SEQ ID NO: 108971 - DNA, 15 bp, Homo sapiens
gatttggtctgaagg

SEQ ID NO: 108972 - DNA, 15 bp, Homo sapiens
agatttggtctgaag

SEQ ID NO: 108973 - DNA, 15 bp, Homo sapiens
cagatttggtctgaa

SEQ ID NO: 108974 - DNA, 15 bp, Homo sapiens
tcagatttggtctga

SEQ ID NO: 108975 - DNA, 15 bp, Homo sapiens
ctcagatttggtctg

SEQ ID NO: 108976 - DNA, 15 bp, Homo sapiens
tctcagatttggtct

SEQ ID NO: 108977 - DNA, 15 bp, Homo sapiens
ttctcagatttggtc

SEQ ID NO: 108978 - DNA, 15 bp, Homo sapiens
tttctcagatttggt

SEQ ID NO: 108979 - DNA, 15 bp, Homo sapiens
ctttctcagatttgg

SEQ ID NO: 108980 - DNA, 15 bp, Homo sapiens
tctttctcagatttg

SEQ ID NO: 108981 - DNA, 15 bp, Homo sapiens
atctttctcagattt

SEQ ID NO: 108982 - DNA, 15 bp, Homo sapiens
catctttctcagatt

SEQ ID NO: 108983 - DNA, 15 bp, Homo sapiens
tcatctttctcagat

SEQ ID NO: 108984 - DNA, 15 bp, Homo sapiens
atcatctttctcaga

SEQ ID NO: 108985 - DNA, 15 bp, Homo sapiens
catcatctttctcag

SEQ ID NO: 108986 - DNA, 15 bp, Homo sapiens
ccatcatctttctca

SEQ ID NO: 108987 - DNA, 15 bp, Homo sapiens
gccatcatctttctc

SEQ ID NO: 108988 - DNA, 15 bp, Homo sapiens
ggccatcatctttct

SEQ ID NO: 108989 - DNA, 15 bp, Homo sapiens
aggccatcatctttc

SEQ ID NO: 108990 - DNA, 15 bp, Homo sapiens
aaggccatcatcttt

SEQ ID NO: 108991 - DNA, 15 bp, Homo sapiens
aaaggccatcatctt

SEQ ID NO: 108992 - DNA, 15 bp, Homo sapiens
caaaggccatcatct

SEQ ID NO: 108993 - DNA, 15 bp, Homo sapiens
tcaaaggccatcatc

SEQ ID NO: 108994 - DNA, 15 bp, Homo sapiens
atcaaaggccatcat

SEQ ID NO: 108995 - DNA, 15 bp, Homo sapiens
gatcaaaggccatca

SEQ ID NO: 108996 - DNA, 15 bp, Homo sapiens
tgatcaaaggccatc

SEQ ID NO: 108997 - DNA, 15 bp, Homo sapiens
gtgatcaaaggccat

SEQ ID NO: 108998 - DNA, 15 bp, Homo sapiens
ggtgatcaaaggcca

SEQ ID NO: 108999 - DNA, 15 bp, Homo sapiens
tggtgatcaaaggcc

SEQ ID NO: 109000 - DNA, 15 bp, Homo sapiens
atggtgatcaaaggc

SEQ ID NO: 109001 - DNA, 15 bp, Homo sapiens
tatggtgatcaaagg

SEQ ID NO: 109002 - DNA, 15 bp, Homo sapiens
ctatggtgatcaaag

SEQ ID NO: 109003 - DNA, 15 bp, Homo sapiens
actatggtgatcaaa

SEQ ID NO: 109004 - DNA, 15 bp, Homo sapiens
aactatggtgatcaa

SEQ ID NO: 109005 - DNA, 15 bp, Homo sapiens
taactatggtgatca

SEQ ID NO: 109006 - DNA, 15 bp, Homo sapiens
ctaactatggtgatc

SEQ ID NO: 109007 - DNA, 15 bp, Homo sapiens
cctaactatggtgat

SEQ ID NO: 109008 - DNA, 15 bp, Homo sapiens
acctaactatggtga

SEQ ID NO: 109009 - DNA, 15 bp, Homo sapiens
gacctaactatggtg

SEQ ID NO: 109010 - DNA, 15 bp, Homo sapiens
agacctaactatggt

SEQ ID NO: 109011 - DNA, 15 bp, Homo sapiens
aagacctaactatgg

SEQ ID NO: 109012 - DNA, 15 bp, Homo sapiens
caagacctaactatg

SEQ ID NO: 109013 - DNA, 15 bp, Homo sapiens
ccaagacctaactat

SEQ ID NO: 109014 - DNA, 15 bp, Homo sapiens
gccaagacctaacta

SEQ ID NO: 109015 - DNA, 15 bp, Homo sapiens
agccaagacctaact

SEQ ID NO: 109016 - DNA, 15 bp, Homo sapiens
cagccaagacctaac

SEQ ID NO: 109017 - DNA, 15 bp, Homo sapiens
acagccaagacctaa

SEQ ID NO: 109018 - DNA, 15 bp, Homo sapiens
gacagccaagaccta

SEQ ID NO: 109019 - DNA, 15 bp, Homo sapiens
tgacagccaagacct

SEQ ID NO: 109020 - DNA, 15 bp, Homo sapiens
ttgacagccaagacc

SEQ ID NO: 109021 - DNA, 15 bp, Homo sapiens
attgacagccaagac

SEQ ID NO: 109022 - DNA, 15 bp, Homo sapiens
gattgacagccaaga

SEQ ID NO: 109023 - DNA, 15 bp, Homo sapiens
agattgacagccaag

SEQ ID NO: 109024 - DNA, 15 bp, Homo sapiens
cagattgacagccaa

SEQ ID NO: 109025 - DNA, 15 bp, Homo sapiens
acagattgacagcca

SEQ ID NO: 109026 - DNA, 15 bp, Homo sapiens
cacagattgacagcc

SEQ ID NO: 109027 - DNA, 15 bp, Homo sapiens
acacagattgacagc

SEQ ID NO: 109028 - DNA, 15 bp, Homo sapiens
tacacagattgacag

SEQ ID NO: 109029 - DNA, 15 bp, Homo sapiens
ttacacagattgaca

SEQ ID NO: 109030 - DNA, 15 bp, Homo sapiens
cttacacagattgac

SEQ ID NO: 109031 - DNA, 15 bp, Homo sapiens
gcttacacagattga

SEQ ID NO: 109032 - DNA, 15 bp, Homo sapiens
agcttacacagattg

SEQ ID NO: 109033 - DNA, 15 bp, Homo sapiens
cagcttacacagatt

SEQ ID NO: 109034 - DNA, 15 bp, Homo sapiens
acagcttacacagat

SEQ ID NO: 109035 - DNA, 15 bp, Homo sapiens
cacagcttacacaga

SEQ ID NO: 109036 - DNA, 15 bp, Homo sapiens
ccacagcttacacag

SEQ ID NO: 109037 - DNA, 15 bp, Homo sapiens
accacagcttacaca

SEQ ID NO: 109038 - DNA, 15 bp, Homo sapiens
gaccacagcttacac

SEQ ID NO: 109039 - DNA, 15 bp, Homo sapiens
agaccacagcttaca

SEQ ID NO: 109040 - DNA, 15 bp, Homo sapiens
cagaccacagcttac

SEQ ID NO: 109041 - DNA, 15 bp, Homo sapiens
tcagaccacagctta

SEQ ID NO: 109042 - DNA, 15 bp, Homo sapiens
gtcagaccacagctt

SEQ ID NO: 109043 - DNA, 15 bp, Homo sapiens
tgtcagaccacagct

SEQ ID NO: 109044 - DNA, 15 bp, Homo sapiens
atgtcagaccacagc

SEQ ID NO: 109045 - DNA, 15 bp, Homo sapiens
catgtcagaccacag

SEQ ID NO: 109046 - DNA, 15 bp, Homo sapiens
tcatgtcagaccaca

SEQ ID NO: 109047 - DNA, 15 bp, Homo sapiens
atcatgtcagaccac

SEQ ID NO: 109048 - DNA, 15 bp, Homo sapiens
catcatgtcagacca

SEQ ID NO: 109049 - DNA, 15 bp, Homo sapiens
gcatcatgtcagacc

SEQ ID NO: 109050 - DNA, 15 bp, Homo sapiens
ggcatcatgtcagac

SEQ ID NO: 109051 - DNA, 15 bp, Homo sapiens
tggcatcatgtcaga

SEQ ID NO: 109052 - DNA, 15 bp, Homo sapiens
ctggcatcatgtcag

SEQ ID NO: 109053 - DNA, 15 bp, Homo sapiens
actggcatcatgtca

SEQ ID NO: 109054 - DNA, 15 bp, Homo sapiens
aactggcatcatgtc

SEQ ID NO: 109055 - DNA, 15 bp, Homo sapiens
caactggcatcatgt

SEQ ID NO: 109056 - DNA, 15 bp, Homo sapiens
ccaactggcatcatg

SEQ ID NO: 109057 - DNA, 15 bp, Homo sapiens
gccaactggcatcat

SEQ ID NO: 109058 - DNA, 15 bp, Homo sapiens
tgccaactggcatca

SEQ ID NO: 109059 - DNA, 15 bp, Homo sapiens
ttgccaactggcatc

SEQ ID NO: 109060 - DNA, 15 bp, Homo sapiens
cttgccaactggcat

SEQ ID NO: 109061 - DNA, 15 bp, Homo sapiens
acttgccaactggca

SEQ ID NO: 109062 - DNA, 15 bp, Homo sapiens
aacttgccaactggc

SEQ ID NO: 109063 - DNA, 15 bp, Homo sapiens
caacttgccaactgg

SEQ ID NO: 109064 - DNA, 15 bp, Homo sapiens
acaacttgccaactg

SEQ ID NO: 109065 - DNA, 15 bp, Homo sapiens
gacaacttgccaact

SEQ ID NO: 109066 - DNA, 15 bp, Homo sapiens
tgacaacttgccaac

SEQ ID NO: 109067 - DNA, 15 bp, Homo sapiens
gtgacaacttgccaa

SEQ ID NO: 109068 - DNA, 15 bp, Homo sapiens
ggtgacaacttgcca

SEQ ID NO: 109069 - DNA, 15 bp, Homo sapiens
tggtgacaacttgcc

SEQ ID NO: 109070 - DNA, 15 bp, Homo sapiens
gtggtgacaacttgc

SEQ ID NO: 109071 - DNA, 15 bp, Homo sapiens
tgtggtgacaacttg

SEQ ID NO: 109072 - DNA, 15 bp, Homo sapiens
ctgtggtgacaactt

SEQ ID NO: 109073 - DNA, 15 bp, Homo sapiens
actgtggtgacaact

SEQ ID NO: 109074 - DNA, 15 bp, Homo sapiens
cactgtggtgacaac

SEQ ID NO: 109075 - DNA, 15 bp, Homo sapiens
acactgtggtgacaa

SEQ ID NO: 109076 - DNA, 15 bp, Homo sapiens
cacactgtggtgaca

SEQ ID NO: 109077 - DNA, 15 bp, Homo sapiens
acacactgtggtgac

SEQ ID NO: 109078 - DNA, 15 bp, Homo sapiens
tacacactgtggtga

SEQ ID NO: 109079 - DNA, 15 bp, Homo sapiens
ttacacactgtggtg

SEQ ID NO: 109080 - DNA, 15 bp, Homo sapiens
attacacactgtggt

SEQ ID NO: 109081 - DNA, 15 bp, Homo sapiens
aattacacactgtgg

SEQ ID NO: 109082 - DNA, 15 bp, Homo sapiens
aaattacacactgtg

SEQ ID NO: 109083 - DNA, 15 bp, Homo sapiens
caaattacacactgt

SEQ ID NO: 109084 - DNA, 15 bp, Homo sapiens
acaaattacacactg

SEQ ID NO: 109085 - DNA, 15 bp, Homo sapiens
gacaaattacacact

SEQ ID NO: 109086 - DNA, 15 bp, Homo sapiens
agacaaattacacac

SEQ ID NO: 109087 - DNA, 15 bp, Homo sapiens
aagacaaattacaca

SEQ ID NO: 109088 - DNA, 15 bp, Homo sapiens
aaagacaaattacac

SEQ ID NO: 109089 - DNA, 15 bp, Homo sapiens
aaaagacaaattaca

SEQ ID NO: 109090 - DNA, 15 bp, Homo sapiens
aaaaagacaaattac

SEQ ID NO: 109091 - DNA, 15 bp, Homo sapiens
gaaaaagacaaatta

SEQ ID NO: 109092 - DNA, 15 bp, Homo sapiens
agaaaaagacaaatt

SEQ ID NO: 109093 - DNA, 15 bp, Homo sapiens
aagaaaaagacaaat

SEQ ID NO: 109094 - DNA, 15 bp, Homo sapiens
aaagaaaaagacaaa

SEQ ID NO: 109095 - DNA, 15 bp, Homo sapiens
caaagaaaaagacaa

SEQ ID NO: 109096 - DNA, 15 bp, Homo sapiens
acaaagaaaaagaca

SEQ ID NO: 109097 - DNA, 15 bp, Homo sapiens
aacaaagaaaaagac

SEQ ID NO: 109098 - DNA, 15 bp, Homo sapiens
aaacaaagaaaaaga

SEQ ID NO: 109099 - DNA, 15 bp, Homo sapiens
caaacaaagaaaaag

SEQ ID NO: 109100 - DNA, 15 bp, Homo sapiens
acaaacaaagaaaaa

SEQ ID NO: 109101 - DNA, 15 bp, Homo sapiens
aacaaacaaagaaaa

SEQ ID NO: 109102 - DNA, 15 bp, Homo sapiens
aaacaaacaaagaaa

SEQ ID NO: 109103 - DNA, 15 bp, Homo sapiens
aaaacaaacaaagaa

SEQ ID NO: 109104 - DNA, 15 bp, Homo sapiens
taaaacaaacaaaga

SEQ ID NO: 109105 - DNA, 15 bp, Homo sapiens
ttaaaacaaacaaag

SEQ ID NO: 109106 - DNA, 15 bp, Homo sapiens
tttaaaacaaacaaa

SEQ ID NO: 109107 - DNA, 15 bp, Homo sapiens
ctttaaaacaaacaa

SEQ ID NO: 109108 - DNA, 15 bp, Homo sapiens
tctttaaaacaaaca

SEQ ID NO: 109109 - DNA, 15 bp, Homo sapiens
ttctttaaaacaaac

SEQ ID NO: 109110 - DNA, 15 bp, Homo sapiens
tttctttaaaacaaa

SEQ ID NO: 109111 - DNA, 15 bp, Homo sapiens
gtttctttaaaacaa

SEQ ID NO: 109112 - DNA, 15 bp, Homo sapiens
agtttctttaaaaca

SEQ ID NO: 109113 - DNA, 15 bp, Homo sapiens
cagtttctttaaaac

SEQ ID NO: 109114 - DNA, 15 bp, Homo sapiens
acagtttctttaaaa

SEQ ID NO: 109115 - DNA, 15 bp, Homo sapiens
tacagtttctttaaa

SEQ ID NO: 109116 - DNA, 15 bp, Homo sapiens
atacagtttctttaa

SEQ ID NO: 109117 - DNA, 15 bp, Homo sapiens
tatacagtttcttta

SEQ ID NO: 109118 - DNA, 15 bp, Homo sapiens
ttatacagtttcttt

SEQ ID NO: 109119 - DNA, 15 bp, Homo sapiens
tttatacagtttctt

SEQ ID NO: 109120 - DNA, 15 bp, Homo sapiens
ttttatacagtttct

SEQ ID NO: 109121 - DNA, 15 bp, Homo sapiens
gttttatacagtttc

SEQ ID NO: 109122 - DNA, 15 bp, Homo sapiens
agttttatacagttt

SEQ ID NO: 109123 - DNA, 15 bp, Homo sapiens
aagttttatacagtt

SEQ ID NO: 109124 - DNA, 15 bp, Homo sapiens
aaagttttatacagt

SEQ ID NO: 109125 - DNA, 15 bp, Homo sapiens
caaagttttatacag

SEQ ID NO: 109126 - DNA, 15 bp, Homo sapiens
tcaaagttttataca

SEQ ID NO: 109127 - DNA, 15 bp, Homo sapiens
ctcaaagttttatac

SEQ ID NO: 109128 - DNA, 15 bp, Homo sapiens
actcaaagttttata

SEQ ID NO: 109129 - DNA, 15 bp, Homo sapiens
cactcaaagttttat

SEQ ID NO: 109130 - DNA, 15 bp, Homo sapiens
tcactcaaagtttta

SEQ ID NO: 109131 - DNA, 15 bp, Homo sapiens
ttcactcaaagtttt

SEQ ID NO: 109132 - DNA, 15 bp, Homo sapiens
cttcactcaaagttt

SEQ ID NO: 109133 - DNA, 15 bp, Homo sapiens
acttcactcaaagtt

SEQ ID NO: 109134 - DNA, 15 bp, Homo sapiens
gacttcactcaaagt

SEQ ID NO: 109135 - DNA, 15 bp, Homo sapiens
tgacttcactcaaag

SEQ ID NO: 109136 - DNA, 15 bp, Homo sapiens
ttgacttcactcaaa

SEQ ID NO: 109137 - DNA, 15 bp, Homo sapiens
tttgacttcactcaa

SEQ ID NO: 109138 - DNA, 15 bp, Homo sapiens
gtttgacttcactca

SEQ ID NO: 109139 - DNA, 15 bp, Homo sapiens
agtttgacttcactc

SEQ ID NO: 109140 - DNA, 15 bp, Homo sapiens
aagtttgacttcact

SEQ ID NO: 109141 - DNA, 15 bp, Homo sapiens
caagtttgacttcac

SEQ ID NO: 109142 - DNA, 15 bp, Homo sapiens
tcaagtttgacttca

SEQ ID NO: 109143 - DNA, 15 bp, Homo sapiens
ttcaagtttgacttc

SEQ ID NO: 109144 - DNA, 15 bp, Homo sapiens
cttcaagtttgactt

SEQ ID NO: 109145 - DNA, 15 bp, Homo sapiens
acttcaagtttgact

SEQ ID NO: 109146 - DNA, 15 bp, Homo sapiens
cacttcaagtttgac

SEQ ID NO: 109147 - DNA, 15 bp, Homo sapiens
ccacttcaagtttga

SEQ ID NO: 109148 - DNA, 15 bp, Homo sapiens
tccacttcaagtttg

SEQ ID NO: 109149 - DNA, 15 bp, Homo sapiens
ttccacttcaagttt

SEQ ID NO: 109150 - DNA, 15 bp, Homo sapiens
tttccacttcaagtt

SEQ ID NO: 109151 - DNA, 15 bp, Homo sapiens
gtttccacttcaagt

SEQ ID NO: 109152 - DNA, 15 bp, Homo sapiens
agtttccacttcaag

SEQ ID NO: 109153 - DNA, 15 bp, Homo sapiens
cagtttccacttcaa

SEQ ID NO: 109154 - DNA, 15 bp, Homo sapiens
acagtttccacttca

SEQ ID NO: 109155 - DNA, 15 bp, Homo sapiens
cacagtttccacttc

SEQ ID NO: 109156 - DNA, 15 bp, Homo sapiens
tcacagtttccactt

SEQ ID NO: 109157 - DNA, 15 bp, Homo sapiens
atcacagtttccact

SEQ ID NO: 109158 - DNA, 15 bp, Homo sapiens
aatcacagtttccac

SEQ ID NO: 109159 - DNA, 15 bp, Homo sapiens
taatcacagtttcca

SEQ ID NO: 109160 - DNA, 15 bp, Homo sapiens
ttaatcacagtttcc

SEQ ID NO: 109161 - DNA, 15 bp, Homo sapiens
tttaatcacagtttc

SEQ ID NO: 109162 - DNA, 15 bp, Homo sapiens
ttttaatcacagttt

SEQ ID NO: 109163 - DNA, 15 bp, Homo sapiens
gttttaatcacagtt

SEQ ID NO: 109164 - DNA, 15 bp, Homo sapiens
tgttttaatcacagt

SEQ ID NO: 109165 - DNA, 15 bp, Homo sapiens
ctgttttaatcacag

SEQ ID NO: 109166 - DNA, 15 bp, Homo sapiens
cctgttttaatcaca

SEQ ID NO: 109167 - DNA, 15 bp, Homo sapiens
tcctgttttaatcac

SEQ ID NO: 109168 - DNA, 15 bp, Homo sapiens
ttcctgttttaatca

SEQ ID NO: 109169 - DNA, 15 bp, Homo sapiens
cttcctgttttaatc

SEQ ID NO: 109170 - DNA, 15 bp, Homo sapiens
tcttcctgttttaat

SEQ ID NO: 109171 - DNA, 15 bp, Homo sapiens
gtcttcctgttttaa

SEQ ID NO: 109172 - DNA, 15 bp, Homo sapiens
tgtcttcctgtttta

SEQ ID NO: 109173 - DNA, 15 bp, Homo sapiens
atgtcttcctgtttt

SEQ ID NO: 109174 - DNA, 15 bp, Homo sapiens
tatgtcttcctgttt

SEQ ID NO: 109175 - DNA, 15 bp, Homo sapiens
atatgtcttcctgtt

SEQ ID NO: 109176 - DNA, 15 bp, Homo sapiens
aatatgtcttcctgt

SEQ ID NO: 109177 - DNA, 15 bp, Homo sapiens
caatatgtcttcctg

SEQ ID NO: 109178 - DNA, 15 bp, Homo sapiens
acaatatgtcttcct

SEQ ID NO: 109179 - DNA, 15 bp, Homo sapiens
gacaatatgtcttcc

SEQ ID NO: 109180 - DNA, 15 bp, Homo sapiens
ggacaatatgtcttc

SEQ ID NO: 109181 - DNA, 15 bp, Homo sapiens
tggacaatatgtctt

SEQ ID NO: 109182 - DNA, 15 bp, Homo sapiens
ctggacaatatgtct

SEQ ID NO: 109183 - DNA, 15 bp, Homo sapiens
tctggacaatatgtc

SEQ ID NO: 109184 - DNA, 15 bp, Homo sapiens
ttctggacaatatgt

SEQ ID NO: 109185 - DNA, 15 bp, Homo sapiens
tttctggacaatatg

SEQ ID NO: 109186 - DNA, 15 bp, Homo sapiens
gtttctggacaatat

SEQ ID NO: 109187 - DNA, 15 bp, Homo sapiens
tgtttctggacaata

SEQ ID NO: 109188 - DNA, 15 bp, Homo sapiens
ctgtttctggacaat

SEQ ID NO: 109189 - DNA, 15 bp, Homo sapiens
gctgtttctggacaa

SEQ ID NO: 109190 - DNA, 15 bp, Homo sapiens
tgctgtttctggaca

SEQ ID NO: 109191 - DNA, 15 bp, Homo sapiens
ttgctgtttctggac

SEQ ID NO: 109192 - DNA, 15 bp, Homo sapiens
tttgctgtttctgga

SEQ ID NO: 109193 - DNA, 15 bp, Homo sapiens
gtttgctgtttctgg

SEQ ID NO: 109194 - DNA, 15 bp, Homo sapiens
cgtttgctgtttctg

SEQ ID NO: 109195 - DNA, 15 bp, Homo sapiens
ccgtttgctgtttct

SEQ ID NO: 109196 - DNA, 15 bp, Homo sapiens
tccgtttgctgtttc

SEQ ID NO: 109197 - DNA, 15 bp, Homo sapiens
gtccgtttgctgttt

SEQ ID NO: 109198 - DNA, 15 bp, Homo sapiens
tgtccgtttgctgtt

SEQ ID NO: 109199 - DNA, 15 bp, Homo sapiens
ttgtccgtttgctgt

SEQ ID NO: 109200 - DNA, 15 bp, Homo sapiens
gttgtccgtttgctg

SEQ ID NO: 109201 - DNA, 15 bp, Homo sapiens
ggttgtccgtttgct

SEQ ID NO: 109202 - DNA, 15 bp, Homo sapiens
gggttgtccgtttgc

SEQ ID NO: 109203 - DNA, 15 bp, Homo sapiens
tgggttgtccgtttg

SEQ ID NO: 109204 - DNA, 15 bp, Homo sapiens
ttgggttgtccgttt

SEQ ID NO: 109205 - DNA, 15 bp, Homo sapiens
tttgggttgtccgtt

SEQ ID NO: 109206 - DNA, 15 bp, Homo sapiens
ttttgggttgtccgt

SEQ ID NO: 109207 - DNA, 15 bp, Homo sapiens
cttttgggttgtccg

SEQ ID NO: 109208 - DNA, 15 bp, Homo sapiens
ccttttgggttgtcc

SEQ ID NO: 109209 - DNA, 15 bp, Homo sapiens
cccttttgggttgtc

SEQ ID NO: 109210 - DNA, 15 bp, Homo sapiens
tcccttttgggttgt

SEQ ID NO: 109211 - DNA, 15 bp, Homo sapiens
atcccttttgggttg

SEQ ID NO: 109212 - DNA, 15 bp, Homo sapiens
catcccttttgggtt

SEQ ID NO: 109213 - DNA, 15 bp, Homo sapiens
ccatcccttttgggt

SEQ ID NO: 109214 - DNA, 15 bp, Homo sapiens
tccatcccttttggg

SEQ ID NO: 109215 - DNA, 15 bp, Homo sapiens
atccatcccttttgg

SEQ ID NO: 109216 - DNA, 15 bp, Homo sapiens
catccatcccttttg

SEQ ID NO: 109217 - DNA, 15 bp, Homo sapiens
tcatccatccctttt

SEQ ID NO: 109218 - DNA, 15 bp, Homo sapiens
ctcatccatcccttt

SEQ ID NO: 109219 - DNA, 15 bp, Homo sapiens
gctcatccatccctt

SEQ ID NO: 109220 - DNA, 15 bp, Homo sapiens
tgctcatccatccct

SEQ ID NO: 109221 - DNA, 15 bp, Homo sapiens
ctgctcatccatccc

SEQ ID NO: 109222 - DNA, 15 bp, Homo sapiens
gctgctcatccatcc

SEQ ID NO: 109223 - DNA, 15 bp, Homo sapiens
agctgctcatccatc

SEQ ID NO: 109224 - DNA, 15 bp, Homo sapiens
cagctgctcatccat

SEQ ID NO: 109225 - DNA, 15 bp, Homo sapiens
tcagctgctcatcca

SEQ ID NO: 109226 - DNA, 15 bp, Homo sapiens
gtcagctgctcatcc

SEQ ID NO: 109227 - DNA, 15 bp, Homo sapiens
agtcagctgctcatc

SEQ ID NO: 109228 - DNA, 15 bp, Homo sapiens
aagtcagctgctcat

SEQ ID NO: 109229 - DNA, 15 bp, Homo sapiens
gaagtcagctgctca

SEQ ID NO: 109230 - DNA, 15 bp, Homo sapiens
ggaagtcagctgctc

SEQ ID NO: 109231 - DNA, 15 bp, Homo sapiens
gggaagtcagctgct

SEQ ID NO: 109232 - DNA, 15 bp, Homo sapiens
agggaagtcagctgc

SEQ ID NO: 109233 - DNA, 15 bp, Homo sapiens
cagggaagtcagctg

SEQ ID NO: 109234 - DNA, 15 bp, Homo sapiens
tcagggaagtcagct

SEQ ID NO: 109235 - DNA, 15 bp, Homo sapiens
ttcagggaagtcagc

SEQ ID NO: 109236 - DNA, 15 bp, Homo sapiens
cttcagggaagtcag

SEQ ID NO: 109237 - DNA, 15 bp, Homo sapiens
ccttcagggaagtca

SEQ ID NO: 109238 - DNA, 15 bp, Homo sapiens
accttcagggaagtc

SEQ ID NO: 109239 - DNA, 15 bp, Homo sapiens
aaccttcagggaagt

SEQ ID NO: 109240 - DNA, 15 bp, Homo sapiens
gaaccttcagggaag

SEQ ID NO: 109241 - DNA, 15 bp, Homo sapiens
agaaccttcagggaa

SEQ ID NO: 109242 - DNA, 15 bp, Homo sapiens
aagaaccttcaggga

SEQ ID NO: 109243 - DNA, 15 bp, Homo sapiens
aaagaaccttcaggg

SEQ ID NO: 109244 - DNA, 15 bp, Homo sapiens
taaagaaccttcagg

SEQ ID NO: 109245 - DNA, 15 bp, Homo sapiens
gtaaagaaccttcag

SEQ ID NO: 109246 - DNA, 15 bp, Homo sapiens
tgtaaagaaccttca

SEQ ID NO: 109247 - DNA, 15 bp, Homo sapiens
ttgtaaagaaccttc

SEQ ID NO: 109248 - DNA, 15 bp, Homo sapiens
attgtaaagaacctt

SEQ ID NO: 109249 - DNA, 15 bp, Homo sapiens
cattgtaaagaacct

SEQ ID NO: 109250 - DNA, 15 bp, Homo sapiens
tcattgtaaagaacc

SEQ ID NO: 109251 - DNA, 15 bp, Homo sapiens
gtcattgtaaagaac

SEQ ID NO: 109252 - DNA, 15 bp, Homo sapiens
ggtcattgtaaagaa

SEQ ID NO: 109253 - DNA, 15 bp, Homo sapiens
aggtcattgtaaaga

SEQ ID NO: 109254 - DNA, 15 bp, Homo sapiens
caggtcattgtaaag

SEQ ID NO: 109255 - DNA, 15 bp, Homo sapiens
ccaggtcattgtaaa

SEQ ID NO: 109256 - DNA, 15 bp, Homo sapiens
cccaggtcattgtaa

SEQ ID NO: 109257 - DNA, 15 bp, Homo sapiens
gcccaggtcattgta

SEQ ID NO: 109258 - DNA, 15 bp, Homo sapiens
cgcccaggtcattgt

SEQ ID NO: 109259 - DNA, 15 bp, Homo sapiens
gcgcccaggtcattg

SEQ ID NO: 109260 - DNA, 15 bp, Homo sapiens
tgcgcccaggtcatt

SEQ ID NO: 109261 - DNA, 15 bp, Homo sapiens
gtgcgcccaggtcat

SEQ ID NO: 109262 - DNA, 15 bp, Homo sapiens
tgtgcgcccaggtca

SEQ ID NO: 109263 - DNA, 15 bp, Homo sapiens
ctgtgcgcccaggtc

SEQ ID NO: 109264 - DNA, 15 bp, Homo sapiens
cctgtgcgcccaggt

SEQ ID NO: 109265 - DNA, 15 bp, Homo sapiens
acctgtgcgcccagg

SEQ ID NO: 109266 - DNA, 15 bp, Homo sapiens
cacctgtgcgcccag

SEQ ID NO: 109267 - DNA, 15 bp, Homo sapiens
tcacctgtgcgccca

SEQ ID NO: 109268 - DNA, 15 bp, Homo sapiens
ctcacctgtgcgccc

SEQ ID NO: 109269 - DNA, 15 bp, Homo sapiens
cctcacctgtgcgcc

SEQ ID NO: 109270 - DNA, 15 bp, Homo sapiens
tcctcacctgtgcgc

SEQ ID NO: 109271 - DNA, 15 bp, Homo sapiens
ctcctcacctgtgcg

SEQ ID NO: 109272 - DNA, 15 bp, Homo sapiens
tctcctcacctgtgc

SEQ ID NO: 109273 - DNA, 15 bp, Homo sapiens
ctctcctcacctgtg

SEQ ID NO: 109274 - DNA, 15 bp, Homo sapiens
gctctcctcacctgt

SEQ ID NO: 109275 - DNA, 15 bp, Homo sapiens
tgctctcctcacctg

SEQ ID NO: 109276 - DNA, 15 bp, Homo sapiens
ctgctctcctcacct

SEQ ID NO: 109277 - DNA, 15 bp, Homo sapiens
gctgctctcctcacc

SEQ ID NO: 109278 - DNA, 15 bp, Homo sapiens
ggctgctctcctcac

SEQ ID NO: 109279 - DNA, 15 bp, Homo sapiens
gggctgctctcctca

SEQ ID NO: 109280 - DNA, 15 bp, Homo sapiens
ggggctgctctcctc

SEQ ID NO: 109281 - DNA, 15 bp, Homo sapiens
tggggctgctctcct

SEQ ID NO: 109282 - DNA, 15 bp, Homo sapiens
gtggggctgctctcc

SEQ ID NO: 109283 - DNA, 15 bp, Homo sapiens
tgtggggctgctctc

SEQ ID NO: 109284 - DNA, 15 bp, Homo sapiens
ctgtggggctgctct

SEQ ID NO: 109285 - DNA, 15 bp, Homo sapiens
gctgtggggctgctc

SEQ ID NO: 109286 - DNA, 15 bp, Homo sapiens
agctgtggggctgct

SEQ ID NO: 109287 - DNA, 15 bp, Homo sapiens
gagctgtggggctgc

SEQ ID NO: 109288 - DNA, 15 bp, Homo sapiens
tgagctgtggggctg

SEQ ID NO: 109289 - DNA, 15 bp, Homo sapiens
atgagctgtggggct

SEQ ID NO: 109290 - DNA, 15 bp, Homo sapiens
gatgagctgtggggc

SEQ ID NO: 109291 - DNA, 15 bp, Homo sapiens
agatgagctgtgggg

SEQ ID NO: 109292 - DNA, 15 bp, Homo sapiens
gagatgagctgtggg

SEQ ID NO: 109293 - DNA, 15 bp, Homo sapiens
agagatgagctgtgg

SEQ ID NO: 109294 - DNA, 15 bp, Homo sapiens
gagagatgagctgtg

SEQ ID NO: 109295 - DNA, 15 bp, Homo sapiens
agagagatgagctgt

SEQ ID NO: 109296 - DNA, 15 bp, Homo sapiens
cagagagatgagctg

SEQ ID NO: 109297 - DNA, 15 bp, Homo sapiens
acagagagatgagct

SEQ ID NO: 109298 - DNA, 15 bp, Homo sapiens
gacagagagatgagc

SEQ ID NO: 109299 - DNA, 15 bp, Homo sapiens
agacagagagatgag

SEQ ID NO: 109300 - DNA, 15 bp, Homo sapiens
gagacagagagatga

SEQ ID NO: 109301 - DNA, 15 bp, Homo sapiens
agagacagagagatg

SEQ ID NO: 109302 - DNA, 15 bp, Homo sapiens
gagagacagagagat

SEQ ID NO: 109303 - DNA, 15 bp, Homo sapiens
agagagacagagaga

SEQ ID NO: 109304 - DNA, 15 bp, Homo sapiens
gagagagagagagac

SEQ ID NO: 109305 - DNA, 15 bp, Homo sapiens
attgagagagagaga

SEQ ID NO: 109306 - DNA, 15 bp, Homo sapiens
gattgagagagagag

SEQ ID NO: 109307 - DNA, 15 bp, Homo sapiens
agattgagagagaga

SEQ ID NO: 109308 - DNA, 15 bp, Homo sapiens
gagattgagagagag

SEQ ID NO: 109309 - DNA, 15 bp, Homo sapiens
agagattgagagaga

SEQ ID NO: 109310 - DNA, 15 bp, Homo sapiens
gagagattgagagag

SEQ ID NO: 109311 - DNA, 15 bp, Homo sapiens
cgagagagagagaga

SEQ ID NO: 109312 - DNA, 15 bp, Homo sapiens
acgagagagagagag

SEQ ID NO: 109313 - DNA, 15 bp, Homo sapiens
aacgagagagagaga

SEQ ID NO: 109314 - DNA, 15 bp, Homo sapiens
gaacgagagagagag

SEQ ID NO: 109315 - DNA, 15 bp, Homo sapiens
agaacgagagagaga

SEQ ID NO: 109316 - DNA, 15 bp, Homo sapiens
gagaacgagagagag

SEQ ID NO: 109317 - DNA, 15 bp, Homo sapiens
agagaacgagagaga

SEQ ID NO: 109318 - DNA, 15 bp, Homo sapiens
gagagaacgagagag

SEQ ID NO: 109319 - DNA, 15 bp, Homo sapiens
agagagaacgagaga

SEQ ID NO: 109320 - DNA, 15 bp, Homo sapiens
gagagagaacgagag

SEQ ID NO: 109321 - DNA, 15 bp, Homo sapiens
tgagagagaacgaga

SEQ ID NO: 109322 - DNA, 15 bp, Homo sapiens
atgagagagaacgag

SEQ ID NO: 109323 - DNA, 15 bp, Homo sapiens
catgagagagaacga

SEQ ID NO: 109324 - DNA, 15 bp, Homo sapiens
acatgagagagaacg

SEQ ID NO: 109325 - DNA, 15 bp, Homo sapiens
tacatgagagagaac

SEQ ID NO: 109326 - DNA, 15 bp, Homo sapiens
atacatgagagagaa

SEQ ID NO: 109327 - DNA, 15 bp, Homo sapiens
aatacatgagagaga

SEQ ID NO: 109328 - DNA, 15 bp, Homo sapiens
aaatacatgagagag

SEQ ID NO: 109329 - DNA, 15 bp, Homo sapiens
aaaatacatgagaga

SEQ ID NO: 109330 - DNA, 15 bp, Homo sapiens
aaaaatacatgagag

SEQ ID NO: 109331 - DNA, 15 bp, Homo sapiens
taaaaatacatgaga

SEQ ID NO: 109332 - DNA, 15 bp, Homo sapiens
ttaaaaatacatgag

SEQ ID NO: 109333 - DNA, 15 bp, Homo sapiens
tttaaaaatacatga

SEQ ID NO: 109334 - DNA, 15 bp, Homo sapiens
atttaaaaatacatg

SEQ ID NO: 109335 - DNA, 15 bp, Homo sapiens
aatttaaaaatacat

SEQ ID NO: 109336 - DNA, 15 bp, Homo sapiens
aaatttaaaaataca

SEQ ID NO: 109337 - DNA, 15 bp, Homo sapiens
gaaatttaaaaatac

SEQ ID NO: 109338 - DNA, 15 bp, Homo sapiens
tgaaatttaaaaata

SEQ ID NO: 109339 - DNA, 15 bp, Homo sapiens
atgaaatttaaaaat

SEQ ID NO: 109340 - DNA, 15 bp, Homo sapiens
aatgaaatttaaaaa

SEQ ID NO: 109341 - DNA, 15 bp, Homo sapiens
aaatgaaatttaaaa

SEQ ID NO: 109342 - DNA, 15 bp, Homo sapiens
aaaatgaaatttaaa

SEQ ID NO: 109343 - DNA, 15 bp, Homo sapiens
aaaaatgaaatttaa

SEQ ID NO: 109344 - DNA, 15 bp, Homo sapiens
aaaaaatgaaattta

SEQ ID NO: 109345 - DNA, 15 bp, Homo sapiens
caaaaaatgaaattt

SEQ ID NO: 109346 - DNA, 15 bp, Homo sapiens
ccaaaaaatgaaatt

SEQ ID NO: 109347 - DNA, 15 bp, Homo sapiens
tccaaaaaatgaaat

SEQ ID NO: 109348 - DNA, 15 bp, Homo sapiens
ttccaaaaaatgaaa

SEQ ID NO: 109349 - DNA, 15 bp, Homo sapiens
tttccaaaaaatgaa

SEQ ID NO: 109350 - DNA, 15 bp, Homo sapiens
ttttccaaaaaatga

SEQ ID NO: 109351 - DNA, 15 bp, Homo sapiens
attttccaaaaaatg

SEQ ID NO: 109352 - DNA, 15 bp, Homo sapiens
cattttccaaaaaat

SEQ ID NO: 109353 - DNA, 15 bp, Homo sapiens
gcattttccaaaaaa

SEQ ID NO: 109354 - DNA, 15 bp, Homo sapiens
tgcattttccaaaaa

SEQ ID NO: 109355 - DNA, 15 bp, Homo sapiens
atgcattttccaaaa

SEQ ID NO: 109356 - DNA, 15 bp, Homo sapiens
catgcattttccaaa

SEQ ID NO: 109357 - DNA, 15 bp, Homo sapiens
acatgcattttccaa

SEQ ID NO: 109358 - DNA, 15 bp, Homo sapiens
aacatgcattttcca

SEQ ID NO: 109359 - DNA, 15 bp, Homo sapiens
aaacatgcattttcc

SEQ ID NO: 109360 - DNA, 15 bp, Homo sapiens
caaacatgcattttc

SEQ ID NO: 109361 - DNA, 15 bp, Homo sapiens
tcaaacatgcatttt

SEQ ID NO: 109362 - DNA, 15 bp, Homo sapiens
ttcaaacatgcattt

SEQ ID NO: 109363 - DNA, 15 bp, Homo sapiens
tttcaaacatgcatt

SEQ ID NO: 109364 - DNA, 15 bp, Homo sapiens
ttttcaaacatgcat

SEQ ID NO: 109365 - DNA, 15 bp, Homo sapiens
attttcaaacatgca

SEQ ID NO: 109366 - DNA, 15 bp, Homo sapiens
aattttcaaacatgc

SEQ ID NO: 109367 - DNA, 15 bp, Homo sapiens
taattttcaaacatg

SEQ ID NO: 109368 - DNA, 15 bp, Homo sapiens
ataattttcaaacat

SEQ ID NO: 109369 - DNA, 15 bp, Homo sapiens
cataattttcaaaca

SEQ ID NO: 109370 - DNA, 15 bp, Homo sapiens
tcataattttcaaac

SEQ ID NO: 109371 - DNA, 15 bp, Homo sapiens
ctcataattttcaaa

SEQ ID NO: 109372 - DNA, 15 bp, Homo sapiens
tctcataattttcaa

SEQ ID NO: 109373 - DNA, 15 bp, Homo sapiens
atctcataattttca

SEQ ID NO: 109374 - DNA, 15 bp, Homo sapiens
aatctcataattttc

SEQ ID NO: 109375 - DNA, 15 bp, Homo sapiens
gaatctcataatttt

SEQ ID NO: 109376 - DNA, 15 bp, Homo sapiens
tgaatctcataattt

SEQ ID NO: 109377 - DNA, 15 bp, Homo sapiens
atgaatctcataatt

SEQ ID NO: 109378 - DNA, 15 bp, Homo sapiens
tatgaatctcataat

SEQ ID NO: 109379 - DNA, 15 bp, Homo sapiens
gtatgaatctcataa

SEQ ID NO: 109380 - DNA, 15 bp, Homo sapiens
cgtatgaatctcata

SEQ ID NO: 109381 - DNA, 15 bp, Homo sapiens
acgtatgaatctcat

SEQ ID NO: 109382 - DNA, 15 bp, Homo sapiens
cacgtatgaatctca

SEQ ID NO: 109383 - DNA, 15 bp, Homo sapiens
acacgtatgaatctc

SEQ ID NO: 109384 - DNA, 15 bp, Homo sapiens
aacacgtatgaatct

SEQ ID NO: 109385 - DNA, 15 bp, Homo sapiens
aaacacgtatgaatc

SEQ ID NO: 109386 - DNA, 15 bp, Homo sapiens
aaaacacgtatgaat

SEQ ID NO: 109387 - DNA, 15 bp, Homo sapiens
gaaaacacgtatgaa

SEQ ID NO: 109388 - DNA, 15 bp, Homo sapiens
tgaaaacacgtatga

SEQ ID NO: 109389 - DNA, 15 bp, Homo sapiens
ttgaaaacacgtatg

SEQ ID NO: 109390 - DNA, 15 bp, Homo sapiens
attgaaaacacgtat

SEQ ID NO: 109391 - DNA, 15 bp, Homo sapiens
aattgaaaacacgta

SEQ ID NO: 109392 - DNA, 15 bp, Homo sapiens
aaattgaaaacacgt

SEQ ID NO: 109393 - DNA, 15 bp, Homo sapiens
taaattgaaaacacg

SEQ ID NO: 109394 - DNA, 15 bp, Homo sapiens
ataaattgaaaacac

SEQ ID NO: 109395 - DNA, 15 bp, Homo sapiens
aataaattgaaaaca

SEQ ID NO: 109396 - DNA, 15 bp, Homo sapiens
caataaattgaaaac

SEQ ID NO: 109397 - DNA, 15 bp, Homo sapiens
acaataaattgaaaa

SEQ ID NO: 109398 - DNA, 15 bp, Homo sapiens
tacaataaattgaaa

SEQ ID NO: 109399 - DNA, 15 bp, Homo sapiens
ttacaataaattgaa

SEQ ID NO: 109400 - DNA, 15 bp, Homo sapiens
attacaataaattga

SEQ ID NO: 109401 - DNA, 15 bp, Homo sapiens
tattacaataaattg

SEQ ID NO: 109402 - DNA, 15 bp, Homo sapiens
ttattacaataaatt

SEQ ID NO: 109403 - DNA, 15 bp, Homo sapiens
attattacaataaat

SEQ ID NO: 109404 - DNA, 15 bp, Homo sapiens
aattattacaataaa

SEQ ID NO: 109405 - DNA, 15 bp, Homo sapiens
caattattacaataa

SEQ ID NO: 109406 - DNA, 15 bp, Homo sapiens
acaattattacaata

SEQ ID NO: 109407 - DNA, 15 bp, Homo sapiens
aacaattattacaat

SEQ ID NO: 109408 - DNA, 15 bp, Homo sapiens
taacaattattacaa

SEQ ID NO: 109409 - DNA, 15 bp, Homo sapiens
ataacaattattaca

SEQ ID NO: 109410 - DNA, 15 bp, Homo sapiens
tataacaattattac

SEQ ID NO: 109411 - DNA, 15 bp, Homo sapiens
atataacaattatta

SEQ ID NO: 109412 - DNA, 15 bp, Homo sapiens
aatataacaattatt

SEQ ID NO: 109413 - DNA, 15 bp, Homo sapiens
aaatataacaattat

SEQ ID NO: 109414 - DNA, 15 bp, Homo sapiens
gaaatataacaatta

SEQ ID NO: 109415 - DNA, 15 bp, Homo sapiens
agaaatataacaatt

SEQ ID NO: 109416 - DNA, 15 bp, Homo sapiens
aagaaatataacaat

SEQ ID NO: 109417 - DNA, 15 bp, Homo sapiens
aaagaaatataacaa

SEQ ID NO: 109418 - DNA, 15 bp, Homo sapiens
taaagaaatataaca

SEQ ID NO: 109419 - DNA, 15 bp, Homo sapiens
ttaaagaaatataac

SEQ ID NO: 109420 - DNA, 15 bp, Homo sapiens
tttaaagaaatataa

SEQ ID NO: 109421 - DNA, 15 bp, Homo sapiens
atttaaagaaatata

SEQ ID NO: 109422 - DNA, 15 bp, Homo sapiens
catttaaagaaatat

SEQ ID NO: 109423 - DNA, 15 bp, Homo sapiens
acatttaaagaaata

SEQ ID NO: 109424 - DNA, 15 bp, Homo sapiens
tacatttaaagaaat

SEQ ID NO: 109425 - DNA, 15 bp, Homo sapiens
atacatttaaagaaa

SEQ ID NO: 109426 - DNA, 15 bp, Homo sapiens
catacatttaaagaa

SEQ ID NO: 109427 - DNA, 15 bp, Homo sapiens
acatacatttaaaga

SEQ ID NO: 109428 - DNA, 15 bp, Homo sapiens
cacatacatttaaag

SEQ ID NO: 109429 - DNA, 15 bp, Homo sapiens
ccacatacatttaaa

SEQ ID NO: 109430 - DNA, 15 bp, Homo sapiens
accacatacatttaa

SEQ ID NO: 109431 - DNA, 15 bp, Homo sapiens
taccacatacattta

SEQ ID NO: 109432 - DNA, 15 bp, Homo sapiens
ttaccacatacattt

SEQ ID NO: 109433 - DNA, 15 bp, Homo sapiens
attaccacatacatt

SEQ ID NO: 109434 - DNA, 15 bp, Homo sapiens
tattaccacatacat

SEQ ID NO: 109435 - DNA, 15 bp, Homo sapiens
atattaccacataca

SEQ ID NO: 109436 - DNA, 15 bp, Homo sapiens
aatattaccacatac

SEQ ID NO: 109437 - DNA, 15 bp, Homo sapiens
taatattaccacata

SEQ ID NO: 109438 - DNA, 15 bp, Homo sapiens
gtaatattaccacat

SEQ ID NO: 109439 - DNA, 15 bp, Homo sapiens
tgtaatattaccaca

SEQ ID NO: 109440 - DNA, 15 bp, Homo sapiens
ctgtaatattaccac

SEQ ID NO: 109441 - DNA, 15 bp, Homo sapiens
actgtaatattacca

SEQ ID NO: 109442 - DNA, 15 bp, Homo sapiens
cactgtaatattacc

SEQ ID NO: 109443 - DNA, 15 bp, Homo sapiens
tcactgtaatattac

SEQ ID NO: 109444 - DNA, 15 bp, Homo sapiens
atcactgtaatatta

SEQ ID NO: 109445 - DNA, 15 bp, Homo sapiens
aatcactgtaatatt

SEQ ID NO: 109446 - DNA, 15 bp, Homo sapiens
gaatcactgtaatat

SEQ ID NO: 109447 - DNA, 15 bp, Homo sapiens
tgaatcactgtaata

SEQ ID NO: 109448 - DNA, 15 bp, Homo sapiens
atgaatcactgtaat

SEQ ID NO: 109449 - DNA, 15 bp, Homo sapiens
tatgaatcactgtaa

SEQ ID NO: 109450 - DNA, 15 bp, Homo sapiens
ctatgaatcactgta

SEQ ID NO: 109451 - DNA, 15 bp, Homo sapiens
actatgaatcactgt

SEQ ID NO: 109452 - DNA, 15 bp, Homo sapiens
aactatgaatcactg

SEQ ID NO: 109453 - DNA, 15 bp, Homo sapiens
taactatgaatcact

SEQ ID NO: 109454 - DNA, 15 bp, Homo sapiens
gtaactatgaatcac

SEQ ID NO: 109455 - DNA, 15 bp, Homo sapiens
tgtaactatgaatca

SEQ ID NO: 109456 - DNA, 15 bp, Homo sapiens
atgtaactatgaatc

SEQ ID NO: 109457 - DNA, 15 bp, Homo sapiens
tatgtaactatgaat

SEQ ID NO: 109458 - DNA, 15 bp, Homo sapiens
ctatgtaactatgaa

SEQ ID NO: 109459 - DNA, 15 bp, Homo sapiens
tctatgtaactatga

SEQ ID NO: 109460 - DNA, 15 bp, Homo sapiens
ttctatgtaactatg

SEQ ID NO: 109461 - DNA, 15 bp, Homo sapiens
tttctatgtaactat

SEQ ID NO: 109462 - DNA, 15 bp, Homo sapiens
atttctatgtaacta

SEQ ID NO: 109463 - DNA, 15 bp, Homo sapiens
aatttctatgtaact

SEQ ID NO: 109464 - DNA, 15 bp, Homo sapiens
aaatttctatgtaac

SEQ ID NO: 109465 - DNA, 15 bp, Homo sapiens
taaatttctatgtaa

SEQ ID NO: 109466 - DNA, 15 bp, Homo sapiens
ataaatttctatgta

SEQ ID NO: 109467 - DNA, 15 bp, Homo sapiens
aataaatttctatgt

SEQ ID NO: 109468 - DNA, 15 bp, Homo sapiens
aaataaatttctatg

SEQ ID NO: 109469 - DNA, 15 bp, Homo sapiens
aaaataaatttctat

SEQ ID NO: 109470 - DNA, 15 bp, Homo sapiens
aaaaataaatttcta

SEQ ID NO: 109471 - DNA, 15 bp, Homo sapiens
caaaaataaatttct

SEQ ID NO: 109472 - DNA, 15 bp, Homo sapiens
ccaaaaataaatttc

SEQ ID NO: 109473 - DNA, 15 bp, Homo sapiens
gccaaaaataaattt

SEQ ID NO: 109474 - DNA, 15 bp, Homo sapiens
agccaaaaataaatt

SEQ ID NO: 109475 - DNA, 15 bp, Homo sapiens
tagccaaaaataaat

SEQ ID NO: 109476 - DNA, 15 bp, Homo sapiens
ctagccaaaaataaa

SEQ ID NO: 109477 - DNA, 15 bp, Homo sapiens
cctagccaaaaataa

SEQ ID NO: 109478 - DNA, 15 bp, Homo sapiens
gcctagccaaaaata

SEQ ID NO: 109479 - DNA, 15 bp, Homo sapiens
tgcctagccaaaaat

SEQ ID NO: 109480 - DNA, 15 bp, Homo sapiens
gtgcctagccaaaaa

SEQ ID NO: 109481 - DNA, 15 bp, Homo sapiens
tgtgcctagccaaaa

SEQ ID NO: 109482 - DNA, 15 bp, Homo sapiens
ctgtgcctagccaaa

SEQ ID NO: 109483 - DNA, 15 bp, Homo sapiens
actgtgcctagccaa

SEQ ID NO: 109484 - DNA, 15 bp, Homo sapiens
cactgtgcctagcca

SEQ ID NO: 109485 - DNA, 15 bp, Homo sapiens
ccactgtgcctagcc

SEQ ID NO: 109486 - DNA, 15 bp, Homo sapiens
gccactgtgcctagc

SEQ ID NO: 109487 - DNA, 15 bp, Homo sapiens
agccactgtgcctag

SEQ ID NO: 109488 - DNA, 15 bp, Homo sapiens
gagccactgtgccta

SEQ ID NO: 109489 - DNA, 15 bp, Homo sapiens
gcgtgagccactgtg

SEQ ID NO: 109490 - DNA, 15 bp, Homo sapiens
ggcgtgagccactgt

SEQ ID NO: 109491 - DNA, 15 bp, Homo sapiens
gacctgggattacag

SEQ ID NO: 109492 - DNA, 15 bp, Homo sapiens
agacctgggattaca

SEQ ID NO: 109493 - DNA, 15 bp, Homo sapiens
aagacctgggattac

SEQ ID NO: 109494 - DNA, 15 bp, Homo sapiens
aaagacctgggatta

SEQ ID NO: 109495 - DNA, 15 bp, Homo sapiens
caaagacctgggatt

SEQ ID NO: 109496 - DNA, 15 bp, Homo sapiens
ccaaagacctgggat

SEQ ID NO: 109497 - DNA, 15 bp, Homo sapiens
cccaaagacctggga

SEQ ID NO: 109498 - DNA, 15 bp, Homo sapiens
tcccaaagacctggg

SEQ ID NO: 109499 - DNA, 15 bp, Homo sapiens
ctcccaaagacctgg

SEQ ID NO: 109500 - DNA, 15 bp, Homo sapiens
cctcccaaagacctg

SEQ ID NO: 109501 - DNA, 15 bp, Homo sapiens
gcctcccaaagacct

SEQ ID NO: 109502 - DNA, 15 bp, Homo sapiens
agcctcccaaagacc

SEQ ID NO: 109503 - DNA, 15 bp, Homo sapiens
cagcctcccaaagac

SEQ ID NO: 109504 - DNA, 15 bp, Homo sapiens
tcagcctcccaaaga

SEQ ID NO: 109505 - DNA, 15 bp, Homo sapiens
actcagcctcccaaa

SEQ ID NO: 109506 - DNA, 15 bp, Homo sapiens
gactcagcctcccaa

SEQ ID NO: 109507 - DNA, 15 bp, Homo sapiens
tgactcagcctccca

SEQ ID NO: 109508 - DNA, 15 bp, Homo sapiens
ctgactcagcctccc

SEQ ID NO: 109509 - DNA, 15 bp, Homo sapiens
cctgactcagcctcc

SEQ ID NO: 109510 - DNA, 15 bp, Homo sapiens
acctgactcagcctc

SEQ ID NO: 109511 - DNA, 15 bp, Homo sapiens
tacctgactcagcct

SEQ ID NO: 109512 - DNA, 15 bp, Homo sapiens
ttacctgactcagcc

SEQ ID NO: 109513 - DNA, 15 bp, Homo sapiens
attacctgactcagc

SEQ ID NO: 109514 - DNA, 15 bp, Homo sapiens
cattacctgactcag

SEQ ID NO: 109515 - DNA, 15 bp, Homo sapiens
ccattacctgactca

SEQ ID NO: 109516 - DNA, 15 bp, Homo sapiens
gccattacctgactc

SEQ ID NO: 109517 - DNA, 15 bp, Homo sapiens
agccattacctgact

SEQ ID NO: 109518 - DNA, 15 bp, Homo sapiens
aagccattacctgac

SEQ ID NO: 109519 - DNA, 15 bp, Homo sapiens
caagccattacctga

SEQ ID NO: 109520 - DNA, 15 bp, Homo sapiens
tcaagccattacctg

SEQ ID NO: 109521 - DNA, 15 bp, Homo sapiens
ctcaagccattacct

SEQ ID NO: 109522 - DNA, 15 bp, Homo sapiens
gctcaagccattacc

SEQ ID NO: 109523 - DNA, 15 bp, Homo sapiens
ggctcaagccattac

SEQ ID NO: 109524 - DNA, 15 bp, Homo sapiens
gggctcaagccatta

SEQ ID NO: 109525 - DNA, 15 bp, Homo sapiens
tgggctcaagccatt

SEQ ID NO: 109526 - DNA, 15 bp, Homo sapiens
acccctgggctcaag

SEQ ID NO: 109527 - DNA, 15 bp, Homo sapiens
aacccctgggctcaa

SEQ ID NO: 109528 - DNA, 15 bp, Homo sapiens
aaacccctgggctca

SEQ ID NO: 109529 - DNA, 15 bp, Homo sapiens
caaacccctgggctc

SEQ ID NO: 109530 - DNA, 15 bp, Homo sapiens
tcaaacccctgggct

SEQ ID NO: 109531 - DNA, 15 bp, Homo sapiens
ctcaaacccctgggc

SEQ ID NO: 109532 - DNA, 15 bp, Homo sapiens
tctcaaacccctggg

SEQ ID NO: 109533 - DNA, 15 bp, Homo sapiens
gtctcaaacccctgg

SEQ ID NO: 109534 - DNA, 15 bp, Homo sapiens
ggtctcaaacccctg

SEQ ID NO: 109535 - DNA, 15 bp, Homo sapiens
tggtctcaaacccct

SEQ ID NO: 109536 - DNA, 15 bp, Homo sapiens
ctggtctcaaacccc

SEQ ID NO: 109537 - DNA, 15 bp, Homo sapiens
gctggtctcaaaccc

SEQ ID NO: 109538 - DNA, 15 bp, Homo sapiens
ggctggtctcaaacc

SEQ ID NO: 109539 - DNA, 15 bp, Homo sapiens
tcatgttgcccaggc

SEQ ID NO: 109540 - DNA, 15 bp, Homo sapiens
atcatgttgcccagg

SEQ ID NO: 109541 - DNA, 15 bp, Homo sapiens
catcatgttgcccag

SEQ ID NO: 109542 - DNA, 15 bp, Homo sapiens
tcatcatgttgccca

SEQ ID NO: 109543 - DNA, 15 bp, Homo sapiens
ttcatcatgttgccc

SEQ ID NO: 109544 - DNA, 15 bp, Homo sapiens
tttcatcatgttgcc

SEQ ID NO: 109545 - DNA, 15 bp, Homo sapiens
gtttcatcatgttgc

SEQ ID NO: 109546 - DNA, 15 bp, Homo sapiens
aggtttcatcatgtt

SEQ ID NO: 109547 - DNA, 15 bp, Homo sapiens
aaggtttcatcatgt

SEQ ID NO: 109548 - DNA, 15 bp, Homo sapiens
caaggtttcatcatg

SEQ ID NO: 109549 - DNA, 15 bp, Homo sapiens
acaaggtttcatcat

SEQ ID NO: 109550 - DNA, 15 bp, Homo sapiens
gacaaggtttcatca

SEQ ID NO: 109551 - DNA, 15 bp, Homo sapiens
agacaaggtttcatc

SEQ ID NO: 109552 - DNA, 15 bp, Homo sapiens
gagacaaggtttcat

SEQ ID NO: 109553 - DNA, 15 bp, Homo sapiens
agagacaaggtttca

SEQ ID NO: 109554 - DNA, 15 bp, Homo sapiens
tagagacaaggtttc

SEQ ID NO: 109555 - DNA, 15 bp, Homo sapiens
tgtagagacaaggtt

SEQ ID NO: 109556 - DNA, 15 bp, Homo sapiens
ttgtagagacaaggt

SEQ ID NO: 109557 - DNA, 15 bp, Homo sapiens
tttgtagagacaagg

SEQ ID NO: 109558 - DNA, 15 bp, Homo sapiens
ttttgtagagacaag

SEQ ID NO: 109559 - DNA, 15 bp, Homo sapiens
tttttgtagagacaa

SEQ ID NO: 109560 - DNA, 15 bp, Homo sapiens
tttttttgtagagac

SEQ ID NO: 109561 - DNA, 15 bp, Homo sapiens
atttttttgtagaga

SEQ ID NO: 109562 - DNA, 15 bp, Homo sapiens
tatttttttgtagag

SEQ ID NO: 109563 - DNA, 15 bp, Homo sapiens
gtatttttttgtaga

SEQ ID NO: 109564 - DNA, 15 bp, Homo sapiens
tgtatttttttgtag

SEQ ID NO: 109565 - DNA, 15 bp, Homo sapiens
ttgtatttttttgta

SEQ ID NO: 109566 - DNA, 15 bp, Homo sapiens
tttgtatttttttgt

SEQ ID NO: 109567 - DNA, 15 bp, Homo sapiens
atttgtatttttttg

SEQ ID NO: 109568 - DNA, 15 bp, Homo sapiens
catttgtattttttt

SEQ ID NO: 109569 - DNA, 15 bp, Homo sapiens
tcatttgtatttttt

SEQ ID NO: 109570 - DNA, 15 bp, Homo sapiens
ttcatttgtattttt

SEQ ID NO: 109571 - DNA, 15 bp, Homo sapiens
tttcatttgtatttt

SEQ ID NO: 109572 - DNA, 15 bp, Homo sapiens
ttttcatttgtattt

SEQ ID NO: 109573 - DNA, 15 bp, Homo sapiens
gttttcatttgtatt

SEQ ID NO: 109574 - DNA, 15 bp, Homo sapiens
ggttttcatttgtat

SEQ ID NO: 109575 - DNA, 15 bp, Homo sapiens
gaggttttcatttgt

SEQ ID NO: 109576 - DNA, 15 bp, Homo sapiens
ggaggttttcatttg

SEQ ID NO: 109577 - DNA, 15 bp, Homo sapiens
tggaggttttcattt

SEQ ID NO: 109578 - DNA, 15 bp, Homo sapiens
ttggaggttttcatt

SEQ ID NO: 109579 - DNA, 15 bp, Homo sapiens
tttggaggttttcat

SEQ ID NO: 109580 - DNA, 15 bp, Homo sapiens
ttttggaggttttca

SEQ ID NO: 109581 - DNA, 15 bp, Homo sapiens
tttttggaggttttc

SEQ ID NO: 109582 - DNA, 15 bp, Homo sapiens
gtttttggaggtttt

SEQ ID NO: 109583 - DNA, 15 bp, Homo sapiens
tgtttttggaggttt

SEQ ID NO: 109584 - DNA, 15 bp, Homo sapiens
ttgtttttggaggtt

SEQ ID NO: 109585 - DNA, 15 bp, Homo sapiens
tttgtttttggaggt

SEQ ID NO: 109586 - DNA, 15 bp, Homo sapiens
ttttgtttttggagg

SEQ ID NO: 109587 - DNA, 15 bp, Homo sapiens
gttttgtttttggag

SEQ ID NO: 109588 - DNA, 15 bp, Homo sapiens
tgttttgtttttgga

SEQ ID NO: 109589 - DNA, 15 bp, Homo sapiens
ttgttttgtttttgg

SEQ ID NO: 109590 - DNA, 15 bp, Homo sapiens
atttgttttgttttt

SEQ ID NO: 109591 - DNA, 15 bp, Homo sapiens
aatttgttttgtttt

SEQ ID NO: 109592 - DNA, 15 bp, Homo sapiens
aaatttgttttgttt

SEQ ID NO: 109593 - DNA, 15 bp, Homo sapiens
gaaatttgttttgtt

SEQ ID NO: 109594 - DNA, 15 bp, Homo sapiens
ggaaatttgttttgt

SEQ ID NO: 109595 - DNA, 15 bp, Homo sapiens
tggaaatttgttttg

SEQ ID NO: 109596 - DNA, 15 bp, Homo sapiens
ttggaaatttgtttt

SEQ ID NO: 109597 - DNA, 15 bp, Homo sapiens
tttggaaatttgttt

SEQ ID NO: 109598 - DNA, 15 bp, Homo sapiens
ttttggaaatttgtt

SEQ ID NO: 109599 - DNA, 15 bp, Homo sapiens
tttttggaaatttgt

SEQ ID NO: 109600 - DNA, 15 bp, Homo sapiens
ttttttggaaatttg

SEQ ID NO: 109601 - DNA, 15 bp, Homo sapiens
tttttttggaaattt

SEQ ID NO: 109602 - DNA, 15 bp, Homo sapiens
ttttttttggaaatt

SEQ ID NO: 109603 - DNA, 15 bp, Homo sapiens
tttttttttggaaat

SEQ ID NO: 109604 - DNA, 15 bp, Homo sapiens
atttttttttggaaa

SEQ ID NO: 109605 - DNA, 15 bp, Homo sapiens
aatttttttttggaa

SEQ ID NO: 109606 - DNA, 15 bp, Homo sapiens
taatttttttttgga

SEQ ID NO: 109607 - DNA, 15 bp, Homo sapiens
ctaatttttttttgg

SEQ ID NO: 109608 - DNA, 15 bp, Homo sapiens
gctaatttttttttg

SEQ ID NO: 109609 - DNA, 15 bp, Homo sapiens
atggctaattttttt

SEQ ID NO: 109610 - DNA, 15 bp, Homo sapiens
catggctaatttttt

SEQ ID NO: 109611 - DNA, 15 bp, Homo sapiens
ccatggctaattttt

SEQ ID NO: 109612 - DNA, 15 bp, Homo sapiens
accatggctaatttt

SEQ ID NO: 109613 - DNA, 15 bp, Homo sapiens
caccatggctaattt

SEQ ID NO: 109614 - DNA, 15 bp, Homo sapiens
ccaccatggctaatt

SEQ ID NO: 109615 - DNA, 15 bp, Homo sapiens
accaccatggctaat

SEQ ID NO: 109616 - DNA, 15 bp, Homo sapiens
caccaccatggctaa

SEQ ID NO: 109617 - DNA, 15 bp, Homo sapiens
tcaccaccatggcta

SEQ ID NO: 109618 - DNA, 15 bp, Homo sapiens
ctcaccaccatggct

SEQ ID NO: 109619 - DNA, 15 bp, Homo sapiens
actcaccaccatggc

SEQ ID NO: 109620 - DNA, 15 bp, Homo sapiens
tactcaccaccatgg

SEQ ID NO: 109621 - DNA, 15 bp, Homo sapiens
atactcaccaccatg

SEQ ID NO: 109622 - DNA, 15 bp, Homo sapiens
gatactcaccaccat

SEQ ID NO: 109623 - DNA, 15 bp, Homo sapiens
agatactcaccacca

SEQ ID NO: 109624 - DNA, 15 bp, Homo sapiens
cagatactcaccacc

SEQ ID NO: 109625 - DNA, 15 bp, Homo sapiens
acagatactcaccac

SEQ ID NO: 109626 - DNA, 15 bp, Homo sapiens
tacagatactcacca

SEQ ID NO: 109627 - DNA, 15 bp, Homo sapiens
ctacagatactcacc

SEQ ID NO: 109628 - DNA, 15 bp, Homo sapiens
actacagatactcac

SEQ ID NO: 109629 - DNA, 15 bp, Homo sapiens
gactacagatactca

SEQ ID NO: 109630 - DNA, 15 bp, Homo sapiens
ggactacagatactc

SEQ ID NO: 109631 - DNA, 15 bp, Homo sapiens
aggactacagatact

SEQ ID NO: 109632 - DNA, 15 bp, Homo sapiens
taggactacagatac

SEQ ID NO: 109633 - DNA, 15 bp, Homo sapiens
ctaggactacagata

SEQ ID NO: 109634 - DNA, 15 bp, Homo sapiens
gctaggactacagat

SEQ ID NO: 109635 - DNA, 15 bp, Homo sapiens
agctaggactacaga

SEQ ID NO: 109636 - DNA, 15 bp, Homo sapiens
tagctaggactacag

SEQ ID NO: 109637 - DNA, 15 bp, Homo sapiens
gtagctaggactaca

SEQ ID NO: 109638 - DNA, 15 bp, Homo sapiens
ggtagctaggactac

SEQ ID NO: 109639 - DNA, 15 bp, Homo sapiens
aggtagctaggacta

SEQ ID NO: 109640 - DNA, 15 bp, Homo sapiens
caggtagctaggact

SEQ ID NO: 109641 - DNA, 15 bp, Homo sapiens
ccaggtagctaggac

SEQ ID NO: 109642 - DNA, 15 bp, Homo sapiens
cccaggtagctagga

SEQ ID NO: 109643 - DNA, 15 bp, Homo sapiens
tcccaggtagctagg

SEQ ID NO: 109644 - DNA, 15 bp, Homo sapiens
ctcccaggtagctag

SEQ ID NO: 109645 - DNA, 15 bp, Homo sapiens
cctcccaggtagcta

SEQ ID NO: 109646 - DNA, 15 bp, Homo sapiens
agcctcccaggtagc

SEQ ID NO: 109647 - DNA, 15 bp, Homo sapiens
cagcctcccaggtag

SEQ ID NO: 109648 - DNA, 15 bp, Homo sapiens
tcagcctcccaggta

SEQ ID NO: 109649 - DNA, 15 bp, Homo sapiens
ctcagcctcccaggt

SEQ ID NO: 109650 - DNA, 15 bp, Homo sapiens
cctcagcctcccagg

SEQ ID NO: 109651 - DNA, 15 bp, Homo sapiens
acctcagcctcccag

SEQ ID NO: 109652 - DNA, 15 bp, Homo sapiens
tctcccacctcagcc

SEQ ID NO: 109653 - DNA, 15 bp, Homo sapiens
ctctcccacctcagc

SEQ ID NO: 109654 - DNA, 15 bp, Homo sapiens
gctctcccacctcag

SEQ ID NO: 109655 - DNA, 15 bp, Homo sapiens
agctctcccacctca

SEQ ID NO: 109656 - DNA, 15 bp, Homo sapiens
cagctctcccacctc

SEQ ID NO: 109657 - DNA, 15 bp, Homo sapiens
gcagctctcccacct

SEQ ID NO: 109658 - DNA, 15 bp, Homo sapiens
agcagctctcccacc

SEQ ID NO: 109659 - DNA, 15 bp, Homo sapiens
aagcagctctcccac

SEQ ID NO: 109660 - DNA, 15 bp, Homo sapiens
caagcagctctccca

SEQ ID NO: 109661 - DNA, 15 bp, Homo sapiens
tcaagcagctctccc

SEQ ID NO: 109662 - DNA, 15 bp, Homo sapiens
ttcaagcagctctcc

SEQ ID NO: 109663 - DNA, 15 bp, Homo sapiens
gttcaagcagctctc

SEQ ID NO: 109664 - DNA, 15 bp, Homo sapiens
ggttcaagcagctct

SEQ ID NO: 109665 - DNA, 15 bp, Homo sapiens
aggttcaagcagctc

SEQ ID NO: 109666 - DNA, 15 bp, Homo sapiens
caggttcaagcagct

SEQ ID NO: 109667 - DNA, 15 bp, Homo sapiens
tcaggttcaagcagc

SEQ ID NO: 109668 - DNA, 15 bp, Homo sapiens
ctcaggttcaagcag

SEQ ID NO: 109669 - DNA, 15 bp, Homo sapiens
tctcaggttcaagca

SEQ ID NO: 109670 - DNA, 15 bp, Homo sapiens
ctctcaggttcaagc

SEQ ID NO: 109671 - DNA, 15 bp, Homo sapiens
cctctcaggttcaag

SEQ ID NO: 109672 - DNA, 15 bp, Homo sapiens
gcctctcaggttcaa

SEQ ID NO: 109673 - DNA, 15 bp, Homo sapiens
tgcctctcaggttca

SEQ ID NO: 109674 - DNA, 15 bp, Homo sapiens
ctgcctctcaggttc

SEQ ID NO: 109675 - DNA, 15 bp, Homo sapiens
tctgcctctcaggtt

SEQ ID NO: 109676 - DNA, 15 bp, Homo sapiens
ctctgcctctcaggt

SEQ ID NO: 109677 - DNA, 15 bp, Homo sapiens
cctctgcctctcagg

SEQ ID NO: 109678 - DNA, 15 bp, Homo sapiens
acctctgcctctcag

SEQ ID NO: 109679 - DNA, 15 bp, Homo sapiens
aacctctgcctctca

SEQ ID NO: 109680 - DNA, 15 bp, Homo sapiens
caacctctgcctctc

SEQ ID NO: 109681 - DNA, 15 bp, Homo sapiens
gcaacctctgcctct

SEQ ID NO: 109682 - DNA, 15 bp, Homo sapiens
tagtggtgtgatctc

SEQ ID NO: 109683 - DNA, 15 bp, Homo sapiens
gtagtggtgtgatct

SEQ ID NO: 109684 - DNA, 15 bp, Homo sapiens
tgtagtggtgtgatc

SEQ ID NO: 109685 - DNA, 15 bp, Homo sapiens
gtgtagtggtgtgat

SEQ ID NO: 109686 - DNA, 15 bp, Homo sapiens
agtgtagtggtgtga

SEQ ID NO: 109687 - DNA, 15 bp, Homo sapiens
gagtgtagtggtgtg

SEQ ID NO: 109688 - DNA, 15 bp, Homo sapiens
ggagtgtagtggtgt

SEQ ID NO: 109689 - DNA, 15 bp, Homo sapiens
taggctggagtgtag

SEQ ID NO: 109690 - DNA, 15 bp, Homo sapiens
ctaggctggagtgta

SEQ ID NO: 109691 - DNA, 15 bp, Homo sapiens
cctaggctggagtgt

SEQ ID NO: 109692 - DNA, 15 bp, Homo sapiens
tcctaggctggagtg

SEQ ID NO: 109693 - DNA, 15 bp, Homo sapiens
ttcctaggctggagt

SEQ ID NO: 109694 - DNA, 15 bp, Homo sapiens
gttcctaggctggag

SEQ ID NO: 109695 - DNA, 15 bp, Homo sapiens
tgttcctaggctgga

SEQ ID NO: 109696 - DNA, 15 bp, Homo sapiens
ctgttcctaggctgg

SEQ ID NO: 109697 - DNA, 15 bp, Homo sapiens
tctgttcctaggctg

SEQ ID NO: 109698 - DNA, 15 bp, Homo sapiens
ctctgttcctaggct

SEQ ID NO: 109699 - DNA, 15 bp, Homo sapiens
actctgttcctaggc

SEQ ID NO: 109700 - DNA, 15 bp, Homo sapiens
cactctgttcctagg

SEQ ID NO: 109701 - DNA, 15 bp, Homo sapiens
tcactctgttcctag

SEQ ID NO: 109702 - DNA, 15 bp, Homo sapiens
ctcactctgttccta

SEQ ID NO: 109703 - DNA, 15 bp, Homo sapiens
tctcactctgttcct

SEQ ID NO: 109704 - DNA, 15 bp, Homo sapiens
gtctcactctgttcc

SEQ ID NO: 109705 - DNA, 15 bp, Homo sapiens
tgtctcactctgttc

SEQ ID NO: 109706 - DNA, 15 bp, Homo sapiens
gtgtctcactctgtt

SEQ ID NO: 109707 - DNA, 15 bp, Homo sapiens
agtgtctcactctgt

SEQ ID NO: 109708 - DNA, 15 bp, Homo sapiens
cagtgtctcactctg

SEQ ID NO: 109709 - DNA, 15 bp, Homo sapiens
acagtgtctcactct

SEQ ID NO: 109710 - DNA, 15 bp, Homo sapiens
aacagtgtctcactc

SEQ ID NO: 109711 - DNA, 15 bp, Homo sapiens
aaacagtgtctcact

SEQ ID NO: 109712 - DNA, 15 bp, Homo sapiens
aaaacagtgtctcac

SEQ ID NO: 109713 - DNA, 15 bp, Homo sapiens
aaaaacagtgtctca

SEQ ID NO: 109714 - DNA, 15 bp, Homo sapiens
taaaaacagtgtctc

SEQ ID NO: 109715 - DNA, 15 bp, Homo sapiens
ttaaaaacagtgtct

SEQ ID NO: 109716 - DNA, 15 bp, Homo sapiens
tttaaaaacagtgtc

SEQ ID NO: 109717 - DNA, 15 bp, Homo sapiens
ttttaaaaacagtgt

SEQ ID NO: 109718 - DNA, 15 bp, Homo sapiens
tttttaaaaacagtg

SEQ ID NO: 109719 - DNA, 15 bp, Homo sapiens
ttttttaaaaacagt

SEQ ID NO: 109720 - DNA, 15 bp, Homo sapiens
tttttttaaaaacag

SEQ ID NO: 109721 - DNA, 15 bp, Homo sapiens
ttttttttaaaaaca

SEQ ID NO: 109722 - DNA, 15 bp, Homo sapiens
attttttttaaaaac

SEQ ID NO: 109723 - DNA, 15 bp, Homo sapiens
aattttttttaaaaa

SEQ ID NO: 109724 - DNA, 15 bp, Homo sapiens
aaattttttttaaaa

SEQ ID NO: 109725 - DNA, 15 bp, Homo sapiens
taaattttttttaaa

SEQ ID NO: 109726 - DNA, 15 bp, Homo sapiens
ataaattttttttaa

SEQ ID NO: 109727 - DNA, 15 bp, Homo sapiens
aataaatttttttta

SEQ ID NO: 109728 - DNA, 15 bp, Homo sapiens
aaataaatttttttt

SEQ ID NO: 109729 - DNA, 15 bp, Homo sapiens
aaaataaattttttt

SEQ ID NO: 109730 - DNA, 15 bp, Homo sapiens
aaaaataaatttttt

SEQ ID NO: 109731 - DNA, 15 bp, Homo sapiens
taaaaataaattttt

SEQ ID NO: 109732 - DNA, 15 bp, Homo sapiens
ttaaaaataaatttt

SEQ ID NO: 109733 - DNA, 15 bp, Homo sapiens
attaaaaataaattt

SEQ ID NO: 109734 - DNA, 15 bp, Homo sapiens
tattaaaaataaatt

SEQ ID NO: 109735 - DNA, 15 bp, Homo sapiens
atattaaaaataaat

SEQ ID NO: 109736 - DNA, 15 bp, Homo sapiens
aatattaaaaataaa

SEQ ID NO: 109737 - DNA, 15 bp, Homo sapiens
aaatattaaaaataa

SEQ ID NO: 109738 - DNA, 15 bp, Homo sapiens
taaatattaaaaata

SEQ ID NO: 109739 - DNA, 15 bp, Homo sapiens
ttaaatattaaaaat

SEQ ID NO: 109740 - DNA, 15 bp, Homo sapiens
attaaatattaaaaa

SEQ ID NO: 109741 - DNA, 15 bp, Homo sapiens
aattaaatattaaaa

SEQ ID NO: 109742 - DNA, 15 bp, Homo sapiens
gaattaaatattaaa

SEQ ID NO: 109743 - DNA, 15 bp, Homo sapiens
tgaattaaatattaa

SEQ ID NO: 109744 - DNA, 15 bp, Homo sapiens
ctgaattaaatatta

SEQ ID NO: 109745 - DNA, 15 bp, Homo sapiens
cctgaattaaatatt

SEQ ID NO: 109746 - DNA, 15 bp, Homo sapiens
gcctgaattaaatat

SEQ ID NO: 109747 - DNA, 15 bp, Homo sapiens
agcctgaattaaata

SEQ ID NO: 109748 - DNA, 15 bp, Homo sapiens
tagcctgaattaaat

SEQ ID NO: 109749 - DNA, 15 bp, Homo sapiens
ttagcctgaattaaa

SEQ ID NO: 109750 - DNA, 15 bp, Homo sapiens
attagcctgaattaa

SEQ ID NO: 109751 - DNA, 15 bp, Homo sapiens
tattagcctgaatta

SEQ ID NO: 109752 - DNA, 15 bp, Homo sapiens
atattagcctgaatt

SEQ ID NO: 109753 - DNA, 15 bp, Homo sapiens
aatattagcctgaat

SEQ ID NO: 109754 - DNA, 15 bp, Homo sapiens
aaatattagcctgaa

SEQ ID NO: 109755 - DNA, 15 bp, Homo sapiens
taaatattagcctga

SEQ ID NO: 109756 - DNA, 15 bp, Homo sapiens
ataaatattagcctg

SEQ ID NO: 109757 - DNA, 15 bp, Homo sapiens
tataaatattagcct

SEQ ID NO: 109758 - DNA, 15 bp, Homo sapiens
gtataaatattagcc

SEQ ID NO: 109759 - DNA, 15 bp, Homo sapiens
agtataaatattagc

SEQ ID NO: 109760 - DNA, 15 bp, Homo sapiens
aagtataaatattag

SEQ ID NO: 109761 - DNA, 15 bp, Homo sapiens
aaagtataaatatta

SEQ ID NO: 109762 - DNA, 15 bp, Homo sapiens
gaaagtataaatatt

SEQ ID NO: 109763 - DNA, 15 bp, Homo sapiens
tgaaagtataaatat

SEQ ID NO: 109764 - DNA, 15 bp, Homo sapiens
ttgaaagtataaata

SEQ ID NO: 109765 - DNA, 15 bp, Homo sapiens
attgaaagtataaat

SEQ ID NO: 109766 - DNA, 15 bp, Homo sapiens
cattgaaagtataaa

SEQ ID NO: 109767 - DNA, 15 bp, Homo sapiens
ccattgaaagtataa

SEQ ID NO: 109768 - DNA, 15 bp, Homo sapiens
gccattgaaagtata

SEQ ID NO: 109769 - DNA, 15 bp, Homo sapiens
agccattgaaagtat

SEQ ID NO: 109770 - DNA, 15 bp, Homo sapiens
tagccattgaaagta

SEQ ID NO: 109771 - DNA, 15 bp, Homo sapiens
gtagccattgaaagt

SEQ ID NO: 109772 - DNA, 15 bp, Homo sapiens
agtagccattgaaag

SEQ ID NO: 109773 - DNA, 15 bp, Homo sapiens
cagtagccattgaaa

SEQ ID NO: 109774 - DNA, 15 bp, Homo sapiens
tcagtagccattgaa

SEQ ID NO: 109775 - DNA, 15 bp, Homo sapiens
atcagtagccattga

SEQ ID NO: 109776 - DNA, 15 bp, Homo sapiens
tatcagtagccattg

SEQ ID NO: 109777 - DNA, 15 bp, Homo sapiens
atatcagtagccatt

SEQ ID NO: 109778 - DNA, 15 bp, Homo sapiens
aatatcagtagccat

SEQ ID NO: 109779 - DNA, 15 bp, Homo sapiens
gaatatcagtagcca

SEQ ID NO: 109780 - DNA, 15 bp, Homo sapiens
ggaatatcagtagcc

SEQ ID NO: 109781 - DNA, 15 bp, Homo sapiens
tggaatatcagtagc

SEQ ID NO: 109782 - DNA, 15 bp, Homo sapiens
atggaatatcagtag

SEQ ID NO: 109783 - DNA, 15 bp, Homo sapiens
tatggaatatcagta

SEQ ID NO: 109784 - DNA, 15 bp, Homo sapiens
ttatggaatatcagt

SEQ ID NO: 109785 - DNA, 15 bp, Homo sapiens
tttatggaatatcag

SEQ ID NO: 109786 - DNA, 15 bp, Homo sapiens
atttatggaatatca

SEQ ID NO: 109787 - DNA, 15 bp, Homo sapiens
aatttatggaatatc

SEQ ID NO: 109788 - DNA, 15 bp, Homo sapiens
taatttatggaatat

SEQ ID NO: 109789 - DNA, 15 bp, Homo sapiens
ataatttatggaata

SEQ ID NO: 109790 - DNA, 15 bp, Homo sapiens
aataatttatggaat

SEQ ID NO: 109791 - DNA, 15 bp, Homo sapiens
gaataatttatggaa

SEQ ID NO: 109792 - DNA, 15 bp, Homo sapiens
agaataatttatgga

SEQ ID NO: 109793 - DNA, 15 bp, Homo sapiens
tagaataatttatgg

SEQ ID NO: 109794 - DNA, 15 bp, Homo sapiens
ttagaataatttatg

SEQ ID NO: 109795 - DNA, 15 bp, Homo sapiens
cttagaataatttat

SEQ ID NO: 109796 - DNA, 15 bp, Homo sapiens
ccttagaataattta

SEQ ID NO: 109797 - DNA, 15 bp, Homo sapiens
tccttagaataattt

SEQ ID NO: 109798 - DNA, 15 bp, Homo sapiens
atccttagaataatt

SEQ ID NO: 109799 - DNA, 15 bp, Homo sapiens
tatccttagaataat

SEQ ID NO: 109800 - DNA, 15 bp, Homo sapiens
gtatccttagaataa

SEQ ID NO: 109801 - DNA, 15 bp, Homo sapiens
agtatccttagaata

SEQ ID NO: 109802 - DNA, 15 bp, Homo sapiens
tagtatccttagaat

SEQ ID NO: 109803 - DNA, 15 bp, Homo sapiens
gtagtatccttagaa

SEQ ID NO: 109804 - DNA, 15 bp, Homo sapiens
tgtagtatccttaga

SEQ ID NO: 109805 - DNA, 15 bp, Homo sapiens
ttgtagtatccttag

SEQ ID NO: 109806 - DNA, 15 bp, Homo sapiens
cttgtagtatcctta

SEQ ID NO: 109807 - DNA, 15 bp, Homo sapiens
acttgtagtatcctt

SEQ ID NO: 109808 - DNA, 15 bp, Homo sapiens
tacttgtagtatcct

SEQ ID NO: 109809 - DNA, 15 bp, Homo sapiens
ttacttgtagtatcc

SEQ ID NO: 109810 - DNA, 15 bp, Homo sapiens
attacttgtagtatc

SEQ ID NO: 109811 - DNA, 15 bp, Homo sapiens
tattacttgtagtat

SEQ ID NO: 109812 - DNA, 15 bp, Homo sapiens
atattacttgtagta

SEQ ID NO: 109813 - DNA, 15 bp, Homo sapiens
tatattacttgtagt

SEQ ID NO: 109814 - DNA, 15 bp, Homo sapiens
atatattacttgtag

SEQ ID NO: 109815 - DNA, 15 bp, Homo sapiens
catatattacttgta

SEQ ID NO: 109816 - DNA, 15 bp, Homo sapiens
acatatattacttgt

SEQ ID NO: 109817 - DNA, 15 bp, Homo sapiens
aacatatattacttg

SEQ ID NO: 109818 - DNA, 15 bp, Homo sapiens
gaacatatattactt

SEQ ID NO: 109819 - DNA, 15 bp, Homo sapiens
tgaacatatattact

SEQ ID NO: 109820 - DNA, 15 bp, Homo sapiens
atgaacatatattac

SEQ ID NO: 109821 - DNA, 15 bp, Homo sapiens
aatgaacatatatta

SEQ ID NO: 109822 - DNA, 15 bp, Homo sapiens
caatgaacatatatt

SEQ ID NO: 109823 - DNA, 15 bp, Homo sapiens
cactaagtctaccac

SEQ ID NO: 109824 - DNA, 15 bp, Homo sapiens
acactaagtctacca

SEQ ID NO: 109825 - DNA, 15 bp, Homo sapiens
cacactaagtctacc

SEQ ID NO: 109826 - DNA, 15 bp, Homo sapiens
acacactaagtctac

SEQ ID NO: 109827 - DNA, 15 bp, Homo sapiens
gacacactaagtcta

SEQ ID NO: 109828 - DNA, 15 bp, Homo sapiens
agacacactaagtct

SEQ ID NO: 109829 - DNA, 15 bp, Homo sapiens
cagacacactaagtc

SEQ ID NO: 109830 - DNA, 15 bp, Homo sapiens
ccagacacactaagt

SEQ ID NO: 109831 - DNA, 15 bp, Homo sapiens
tccagacacactaag

SEQ ID NO: 109832 - DNA, 15 bp, Homo sapiens
ttccagacacactaa

SEQ ID NO: 109833 - DNA, 15 bp, Homo sapiens
attccagacacacta

SEQ ID NO: 109834 - DNA, 15 bp, Homo sapiens
aattccagacacact

SEQ ID NO: 109835 - DNA, 15 bp, Homo sapiens
caattccagacacac

SEQ ID NO: 109836 - DNA, 15 bp, Homo sapiens
ccaattccagacaca

SEQ ID NO: 109837 - DNA, 15 bp, Homo sapiens
accaattccagacac

SEQ ID NO: 109838 - DNA, 15 bp, Homo sapiens
caccaattccagaca

SEQ ID NO: 109839 - DNA, 15 bp, Homo sapiens
ccaccaattccagac

SEQ ID NO: 109840 - DNA, 15 bp, Homo sapiens
cccaccaattccaga

SEQ ID NO: 109841 - DNA, 15 bp, Homo sapiens
acccaccaattccag

SEQ ID NO: 109842 - DNA, 15 bp, Homo sapiens
aacccaccaattcca

SEQ ID NO: 109843 - DNA, 15 bp, Homo sapiens
gaacccaccaattcc

SEQ ID NO: 109844 - DNA, 15 bp, Homo sapiens
agaacccaccaattc

SEQ ID NO: 109845 - DNA, 15 bp, Homo sapiens
aagaacccaccaatt

SEQ ID NO: 109846 - DNA, 15 bp, Homo sapiens
caagaacccaccaat

SEQ ID NO: 109847 - DNA, 15 bp, Homo sapiens
ccaagaacccaccaa

SEQ ID NO: 109848 - DNA, 15 bp, Homo sapiens
accaagaacccacca

SEQ ID NO: 109849 - DNA, 15 bp, Homo sapiens
gaccaagaacccacc

SEQ ID NO: 109850 - DNA, 15 bp, Homo sapiens
agaccaagaacccac

SEQ ID NO: 109851 - DNA, 15 bp, Homo sapiens
gagaccaagaaccca

SEQ ID NO: 109852 - DNA, 15 bp, Homo sapiens
tgagaccaagaaccc

SEQ ID NO: 109853 - DNA, 15 bp, Homo sapiens
gtgagaccaagaacc

SEQ ID NO: 109854 - DNA, 15 bp, Homo sapiens
agtgagaccaagaac

SEQ ID NO: 109855 - DNA, 15 bp, Homo sapiens
cagtgagaccaagaa

SEQ ID NO: 109856 - DNA, 15 bp, Homo sapiens
tcagtgagaccaaga

SEQ ID NO: 109857 - DNA, 15 bp, Homo sapiens
gtcagtgagaccaag

SEQ ID NO: 109858 - DNA, 15 bp, Homo sapiens
agtcagtgagaccaa

SEQ ID NO: 109859 - DNA, 15 bp, Homo sapiens
aagtcagtgagacca

SEQ ID NO: 109860 - DNA, 15 bp, Homo sapiens
gaagtcagtgagacc

SEQ ID NO: 109861 - DNA, 15 bp, Homo sapiens
tgaagtcagtgagac

SEQ ID NO: 109862 - DNA, 15 bp, Homo sapiens
ttgaagtcagtgaga

SEQ ID NO: 109863 - DNA, 15 bp, Homo sapiens
cttgaagtcagtgag

SEQ ID NO: 109864 - DNA, 15 bp, Homo sapiens
tcttgaagtcagtga

SEQ ID NO: 109865 - DNA, 15 bp, Homo sapiens
ttcttgaagtcagtg

SEQ ID NO: 109866 - DNA, 15 bp, Homo sapiens
attcttgaagtcagt

SEQ ID NO: 109867 - DNA, 15 bp, Homo sapiens
cattcttgaagtcag

SEQ ID NO: 109868 - DNA, 15 bp, Homo sapiens
tcattcttgaagtca

SEQ ID NO: 109869 - DNA, 15 bp, Homo sapiens
ttcattcttgaagtc

SEQ ID NO: 109870 - DNA, 15 bp, Homo sapiens
cttcattcttgaagt

SEQ ID NO: 109871 - DNA, 15 bp, Homo sapiens
gcttcattcttgaag

SEQ ID NO: 109872 - DNA, 15 bp, Homo sapiens
agcttcattcttgaa

SEQ ID NO: 109873 - DNA, 15 bp, Homo sapiens
cagcttcattcttga

SEQ ID NO: 109874 - DNA, 15 bp, Homo sapiens
acagcttcattcttg

SEQ ID NO: 109875 - DNA, 15 bp, Homo sapiens
cacagcttcattctt

SEQ ID NO: 109876 - DNA, 15 bp, Homo sapiens
ccacagcttcattct

SEQ ID NO: 109877 - DNA, 15 bp, Homo sapiens
tccacagcttcattc

SEQ ID NO: 109878 - DNA, 15 bp, Homo sapiens
gtccacagcttcatt

SEQ ID NO: 109879 - DNA, 15 bp, Homo sapiens
ggtccacagcttcat

SEQ ID NO: 109880 - DNA, 15 bp, Homo sapiens
gggtccacagcttca

SEQ ID NO: 109881 - DNA, 15 bp, Homo sapiens
agggtccacagcttc

SEQ ID NO: 109882 - DNA, 15 bp, Homo sapiens
gagggtccacagctt

SEQ ID NO: 109883 - DNA, 15 bp, Homo sapiens
cgagggtccacagct

SEQ ID NO: 109884 - DNA, 15 bp, Homo sapiens
acgagggtccacagc

SEQ ID NO: 109885 - DNA, 15 bp, Homo sapiens
cacgagggtccacag

SEQ ID NO: 109886 - DNA, 15 bp, Homo sapiens
ccacgagggtccaca

SEQ ID NO: 109887 - DNA, 15 bp, Homo sapiens
accacgagggtccac

SEQ ID NO: 109888 - DNA, 15 bp, Homo sapiens
caccacgagggtcca

SEQ ID NO: 109889 - DNA, 15 bp, Homo sapiens
tcaccacgagggtcc

SEQ ID NO: 109890 - DNA, 15 bp, Homo sapiens
ctcaccacgagggtc

SEQ ID NO: 109891 - DNA, 15 bp, Homo sapiens
actcaccacgagggt

SEQ ID NO: 109892 - DNA, 15 bp, Homo sapiens
cactcaccacgaggg

SEQ ID NO: 109893 - DNA, 15 bp, Homo sapiens
acactcaccacgagg

SEQ ID NO: 109894 - DNA, 15 bp, Homo sapiens
aacactcaccacgag

SEQ ID NO: 109895 - DNA, 15 bp, Homo sapiens
taacactcaccacga

SEQ ID NO: 109896 - DNA, 15 bp, Homo sapiens
gtaacactcaccacg

SEQ ID NO: 109897 - DNA, 15 bp, Homo sapiens
tgtaacactcaccac

SEQ ID NO: 109898 - DNA, 15 bp, Homo sapiens
ctgtaacactcacca

SEQ ID NO: 109899 - DNA, 15 bp, Homo sapiens
gctgtaacactcacc

SEQ ID NO: 109900 - DNA, 15 bp, Homo sapiens
agctgtaacactcac

SEQ ID NO: 109901 - DNA, 15 bp, Homo sapiens
gagctgtaacactca

SEQ ID NO: 109902 - DNA, 15 bp, Homo sapiens
agagctgtaacactc

SEQ ID NO: 109903 - DNA, 15 bp, Homo sapiens
aagagctgtaacact

SEQ ID NO: 109904 - DNA, 15 bp, Homo sapiens
taagagctgtaacac

SEQ ID NO: 109905 - DNA, 15 bp, Homo sapiens
ttaagagctgtaaca

SEQ ID NO: 109906 - DNA, 15 bp, Homo sapiens
cttaagagctgtaac

SEQ ID NO: 109907 - DNA, 15 bp, Homo sapiens
ccttaagagctgtaa

SEQ ID NO: 109908 - DNA, 15 bp, Homo sapiens
accttaagagctgta

SEQ ID NO: 109909 - DNA, 15 bp, Homo sapiens
caccttaagagctgt

SEQ ID NO: 109910 - DNA, 15 bp, Homo sapiens
ccaccttaagagctg

SEQ ID NO: 109911 - DNA, 15 bp, Homo sapiens
gccaccttaagagct

SEQ ID NO: 109912 - DNA, 15 bp, Homo sapiens
cgccaccttaagagc

SEQ ID NO: 109913 - DNA, 15 bp, Homo sapiens
gcgccaccttaagag

SEQ ID NO: 109914 - DNA, 15 bp, Homo sapiens
tgcgccaccttaaga

SEQ ID NO: 109915 - DNA, 15 bp, Homo sapiens
atgcgccaccttaag

SEQ ID NO: 109916 - DNA, 15 bp, Homo sapiens
gatgcgccaccttaa

SEQ ID NO: 109917 - DNA, 15 bp, Homo sapiens
agatgcgccacctta

SEQ ID NO: 109918 - DNA, 15 bp, Homo sapiens
cagatgcgccacctt

SEQ ID NO: 109919 - DNA, 15 bp, Homo sapiens
ccagatgcgccacct

SEQ ID NO: 109920 - DNA, 15 bp, Homo sapiens
tccagatgcgccacc

SEQ ID NO: 109921 - DNA, 15 bp, Homo sapiens
ctccagatgcgccac

SEQ ID NO: 109922 - DNA, 15 bp, Homo sapiens
actccagatgcgcca

SEQ ID NO: 109923 - DNA, 15 bp, Homo sapiens
aactccagatgcgcc

SEQ ID NO: 109924 - DNA, 15 bp, Homo sapiens
aaactccagatgcgc

SEQ ID NO: 109925 - DNA, 15 bp, Homo sapiens
caaactccagatgcg

SEQ ID NO: 109926 - DNA, 15 bp, Homo sapiens
acaaactccagatgc

SEQ ID NO: 109927 - DNA, 15 bp, Homo sapiens
aacaaactccagatg

SEQ ID NO: 109928 - DNA, 15 bp, Homo sapiens
gaacaaactccagat

SEQ ID NO: 109929 - DNA, 15 bp, Homo sapiens
ggaacaaactccaga

SEQ ID NO: 109930 - DNA, 15 bp, Homo sapiens
aggaacaaactccag

SEQ ID NO: 109931 - DNA, 15 bp, Homo sapiens
aaggaacaaactcca

SEQ ID NO: 109932 - DNA, 15 bp, Homo sapiens
gaaggaacaaactcc

SEQ ID NO: 109933 - DNA, 15 bp, Homo sapiens
agaaggaacaaactc

SEQ ID NO: 109934 - DNA, 15 bp, Homo sapiens
cagaaggaacaaact

SEQ ID NO: 109935 - DNA, 15 bp, Homo sapiens
tcagaaggaacaaac

SEQ ID NO: 109936 - DNA, 15 bp, Homo sapiens
atcagaaggaacaaa

SEQ ID NO: 109937 - DNA, 15 bp, Homo sapiens
catcagaaggaacaa

SEQ ID NO: 109938 - DNA, 15 bp, Homo sapiens
acatcagaaggaaca

SEQ ID NO: 109939 - DNA, 15 bp, Homo sapiens
aacatcagaaggaac

SEQ ID NO: 109940 - DNA, 15 bp, Homo sapiens
gaacatcagaaggaa

SEQ ID NO: 109941 - DNA, 15 bp, Homo sapiens
cgaacatcagaagga

SEQ ID NO: 109942 - DNA, 15 bp, Homo sapiens
ccgaacatcagaagg

SEQ ID NO: 109943 - DNA, 15 bp, Homo sapiens
tccgaacatcagaag

SEQ ID NO: 109944 - DNA, 15 bp, Homo sapiens
atccgaacatcagaa

SEQ ID NO: 109945 - DNA, 15 bp, Homo sapiens
catccgaacatcaga

SEQ ID NO: 109946 - DNA, 15 bp, Homo sapiens
acatccgaacatcag

SEQ ID NO: 109947 - DNA, 15 bp, Homo sapiens
cacatccgaacatca

SEQ ID NO: 109948 - DNA, 15 bp, Homo sapiens
gcacatccgaacatc

SEQ ID NO: 109949 - DNA, 15 bp, Homo sapiens
agcacatccgaacat

SEQ ID NO: 109950 - DNA, 15 bp, Homo sapiens
aagcacatccgaaca

SEQ ID NO: 109951 - DNA, 15 bp, Homo sapiens
caagcacatccgaac

SEQ ID NO: 109952 - DNA, 15 bp, Homo sapiens
ccaagcacatccgaa

SEQ ID NO: 109953 - DNA, 15 bp, Homo sapiens
tccaagcacatccga

SEQ ID NO: 109954 - DNA, 15 bp, Homo sapiens
ctccaagcacatccg

SEQ ID NO: 109955 - DNA, 15 bp, Homo sapiens
actccaagcacatcc

SEQ ID NO: 109956 - DNA, 15 bp, Homo sapiens
aactccaagcacatc

SEQ ID NO: 109957 - DNA, 15 bp, Homo sapiens
aaactccaagcacat

SEQ ID NO: 109958 - DNA, 15 bp, Homo sapiens
gaaactccaagcaca

SEQ ID NO: 109959 - DNA, 15 bp, Homo sapiens
agaaactccaagcac

SEQ ID NO: 109960 - DNA, 15 bp, Homo sapiens
aagaaactccaagca

SEQ ID NO: 109961 - DNA, 15 bp, Homo sapiens
gaagaaactccaagc

SEQ ID NO: 109962 - DNA, 15 bp, Homo sapiens
ggaagaaactccaag

SEQ ID NO: 109963 - DNA, 15 bp, Homo sapiens
aggaagaaactccaa

SEQ ID NO: 109964 - DNA, 15 bp, Homo sapiens
aaggaagaaactcca

SEQ ID NO: 109965 - DNA, 15 bp, Homo sapiens
gaaggaagaaactcc

SEQ ID NO: 109966 - DNA, 15 bp, Homo sapiens
agaaggaagaaactc

SEQ ID NO: 109967 - DNA, 15 bp, Homo sapiens
cagaaggaagaaact

SEQ ID NO: 109968 - DNA, 15 bp, Homo sapiens
ccagaaggaagaaac

SEQ ID NO: 109969 - DNA, 15 bp, Homo sapiens
accagaaggaagaaa

SEQ ID NO: 109970 - DNA, 15 bp, Homo sapiens
caccagaaggaagaa

SEQ ID NO: 109971 - DNA, 15 bp, Homo sapiens
ccaccagaaggaaga

SEQ ID NO: 109972 - DNA, 15 bp, Homo sapiens
cccaccagaaggaag

SEQ ID NO: 109973 - DNA, 15 bp, Homo sapiens
acccaccagaaggaa

SEQ ID NO: 109974 - DNA, 15 bp, Homo sapiens
aacccaccagaagga

SEQ ID NO: 109975 - DNA, 15 bp, Homo sapiens
gaacccaccagaagg

SEQ ID NO: 109976 - DNA, 15 bp, Homo sapiens
tgaacccaccagaag

SEQ ID NO: 109977 - DNA, 15 bp, Homo sapiens
atgaacccaccagaa

SEQ ID NO: 109978 - DNA, 15 bp, Homo sapiens
catgaacccaccaga

SEQ ID NO: 109979 - DNA, 15 bp, Homo sapiens
ccatgaacccaccag

SEQ ID NO: 109980 - DNA, 15 bp, Homo sapiens
accatgaacccacca

SEQ ID NO: 109981 - DNA, 15 bp, Homo sapiens
gaccatgaacccacc

SEQ ID NO: 109982 - DNA, 15 bp, Homo sapiens
agaccatgaacccac

SEQ ID NO: 109983 - DNA, 15 bp, Homo sapiens
aagaccatgaaccca

SEQ ID NO: 109984 - DNA, 15 bp, Homo sapiens
gaagaccatgaaccc

SEQ ID NO: 109985 - DNA, 15 bp, Homo sapiens
ggaagaccatgaacc

SEQ ID NO: 109986 - DNA, 15 bp, Homo sapiens
aggaagaccatgaac

SEQ ID NO: 109987 - DNA, 15 bp, Homo sapiens
caggaagaccatgaa

SEQ ID NO: 109988 - DNA, 15 bp, Homo sapiens
ccaggaagaccatga

SEQ ID NO: 109989 - DNA, 15 bp, Homo sapiens
gccaggaagaccatg

SEQ ID NO: 109990 - DNA, 15 bp, Homo sapiens
agccaggaagaccat

SEQ ID NO: 109991 - DNA, 15 bp, Homo sapiens
gagccaggaagacca

SEQ ID NO: 109992 - DNA, 15 bp, Homo sapiens
tgagccaggaagacc

SEQ ID NO: 109993 - DNA, 15 bp, Homo sapiens
ctgagccaggaagac

SEQ ID NO: 109994 - DNA, 15 bp, Homo sapiens
cctgagccaggaaga

SEQ ID NO: 109995 - DNA, 15 bp, Homo sapiens
tcctgagccaggaag

SEQ ID NO: 109996 - DNA, 15 bp, Homo sapiens
ctcctgagccaggaa

SEQ ID NO: 109997 - DNA, 15 bp, Homo sapiens
actcctgagccagga

SEQ ID NO: 109998 - DNA, 15 bp, Homo sapiens
cactcctgagccagg

SEQ ID NO: 109999 - DNA, 15 bp, Homo sapiens
tcactcctgagccag

SEQ ID NO: 110000 - DNA, 15 bp, Homo sapiens
gtcactcctgagcca

SEQ ID NO: 110001 - DNA, 15 bp, Homo sapiens
cgtcactcctgagcc

SEQ ID NO: 110002 - DNA, 15 bp, Homo sapiens
gcgtcactcctgagc

SEQ ID NO: 110003 - DNA, 15 bp, Homo sapiens
agcgtcactcctgag

SEQ ID NO: 110004 - DNA, 15 bp, Homo sapiens
cagcgtcactcctga

SEQ ID NO: 110005 - DNA, 15 bp, Homo sapiens
gcagcgtcactcctg

SEQ ID NO: 110006 - DNA, 15 bp, Homo sapiens
tgcagcgtcactcct

SEQ ID NO: 110007 - DNA, 15 bp, Homo sapiens
ctgcagcgtcactcc

SEQ ID NO: 110008 - DNA, 15 bp, Homo sapiens
tctgcagcgtcactc

SEQ ID NO: 110009 - DNA, 15 bp, Homo sapiens
gtctgcagcgtcact

SEQ ID NO: 110010 - DNA, 15 bp, Homo sapiens
ggtctgcagcgtcac

SEQ ID NO: 110011 - DNA, 15 bp, Homo sapiens
aggtctgcagcgtca

SEQ ID NO: 110012 - DNA, 15 bp, Homo sapiens
aaggtctgcagcgtc

SEQ ID NO: 110013 - DNA, 15 bp, Homo sapiens
aaaggtctgcagcgt

SEQ ID NO: 110014 - DNA, 15 bp, Homo sapiens
caaaggtctgcagcg

SEQ ID NO: 110015 - DNA, 15 bp, Homo sapiens
gcaaaggtctgcagc

SEQ ID NO: 110016 - DNA, 15 bp, Homo sapiens
tgcaaaggtctgcag

SEQ ID NO: 110017 - DNA, 15 bp, Homo sapiens
ctgcaaaggtctgca

SEQ ID NO: 110018 - DNA, 15 bp, Homo sapiens
actgcaaaggtctgc

SEQ ID NO: 110019 - DNA, 15 bp, Homo sapiens
cactgcaaaggtctg

SEQ ID NO: 110020 - DNA, 15 bp, Homo sapiens
tcactgcaaaggtct

SEQ ID NO: 110021 - DNA, 15 bp, Homo sapiens
ctcactgcaaaggtc

SEQ ID NO: 110022 - DNA, 15 bp, Homo sapiens
actcactgcaaaggt

SEQ ID NO: 110023 - DNA, 15 bp, Homo sapiens
cactcactgcaaagg

SEQ ID NO: 110024 - DNA, 15 bp, Homo sapiens
acactcactgcaaag

SEQ ID NO: 110025 - DNA, 15 bp, Homo sapiens
aacactcactgcaaa

SEQ ID NO: 110026 - DNA, 15 bp, Homo sapiens
taacactcactgcaa

SEQ ID NO: 110027 - DNA, 15 bp, Homo sapiens
gtaacactcactgca

SEQ ID NO: 110028 - DNA, 15 bp, Homo sapiens
tgtaacactcactgc

SEQ ID NO: 110029 - DNA, 15 bp, Homo sapiens
ctgtaacactcactg

SEQ ID NO: 110030 - DNA, 15 bp, Homo sapiens
gctgtaacactcact

SEQ ID NO: 110031 - DNA, 15 bp, Homo sapiens
gccttaagagctgta

SEQ ID NO: 110032 - DNA, 15 bp, Homo sapiens
tgccttaagagctgt

SEQ ID NO: 110033 - DNA, 15 bp, Homo sapiens
ctgccttaagagctg

SEQ ID NO: 110034 - DNA, 15 bp, Homo sapiens
gctgccttaagagct

SEQ ID NO: 110035 - DNA, 15 bp, Homo sapiens
cgctgccttaagagc

SEQ ID NO: 110036 - DNA, 15 bp, Homo sapiens
gcgctgccttaagag

SEQ ID NO: 110037 - DNA, 15 bp, Homo sapiens
tgcgctgccttaaga

SEQ ID NO: 110038 - DNA, 15 bp, Homo sapiens
atgcgctgccttaag

SEQ ID NO: 110039 - DNA, 15 bp, Homo sapiens
gatgcgctgccttaa

SEQ ID NO: 110040 - DNA, 15 bp, Homo sapiens
agatgcgctgcctta

SEQ ID NO: 110041 - DNA, 15 bp, Homo sapiens
cagatgcgctgcctt

SEQ ID NO: 110042 - DNA, 15 bp, Homo sapiens
ccagatgcgctgcct

SEQ ID NO: 110043 - DNA, 15 bp, Homo sapiens
tccagatgcgctgcc

SEQ ID NO: 110044 - DNA, 15 bp, Homo sapiens
ctccagatgcgctgc

SEQ ID NO: 110045 - DNA, 15 bp, Homo sapiens
actccagatgcgctg

SEQ ID NO: 110046 - DNA, 15 bp, Homo sapiens
aactccagatgcgct

SEQ ID NO: 110047 - DNA, 15 bp, Homo sapiens
caactccagatgcgc

SEQ ID NO: 110048 - DNA, 15 bp, Homo sapiens
acaactccagatgcg

SEQ ID NO: 110049 - DNA, 15 bp, Homo sapiens
aacaactccagatgc

SEQ ID NO: 110050 - DNA, 15 bp, Homo sapiens
gaacaactccagatg

SEQ ID NO: 110051 - DNA, 15 bp, Homo sapiens
cgaacaactccagat

SEQ ID NO: 110052 - DNA, 15 bp, Homo sapiens
acgaacaactccaga

SEQ ID NO: 110053 - DNA, 15 bp, Homo sapiens
aacgaacaactccag

SEQ ID NO: 110054 - DNA, 15 bp, Homo sapiens
gaacgaacaactcca

SEQ ID NO: 110055 - DNA, 15 bp, Homo sapiens
ggaacgaacaactcc

SEQ ID NO: 110056 - DNA, 15 bp, Homo sapiens
aggaacgaacaactc

SEQ ID NO: 110057 - DNA, 15 bp, Homo sapiens
gaggaacgaacaact

SEQ ID NO: 110058 - DNA, 15 bp, Homo sapiens
ggaggaacgaacaac

SEQ ID NO: 110059 - DNA, 15 bp, Homo sapiens
gggaggaacgaacaa

SEQ ID NO: 110060 - DNA, 15 bp, Homo sapiens
tgggaggaacgaaca

SEQ ID NO: 110061 - DNA, 15 bp, Homo sapiens
ctgggaggaacgaac

SEQ ID NO: 110062 - DNA, 15 bp, Homo sapiens
actgggaggaacgaa

SEQ ID NO: 110063 - DNA, 15 bp, Homo sapiens
cactgggaggaacga

SEQ ID NO: 110064 - DNA, 15 bp, Homo sapiens
ccactgggaggaacg

SEQ ID NO: 110065 - DNA, 15 bp, Homo sapiens
cccactgggaggaac

SEQ ID NO: 110066 - DNA, 15 bp, Homo sapiens
gcccactgggaggaa

SEQ ID NO: 110067 - DNA, 15 bp, Homo sapiens
agcccactgggagga

SEQ ID NO: 110068 - DNA, 15 bp, Homo sapiens
aagcccactgggagg

SEQ ID NO: 110069 - DNA, 15 bp, Homo sapiens
caagcccactgggag

SEQ ID NO: 110070 - DNA, 15 bp, Homo sapiens
acaagcccactggga

SEQ ID NO: 110071 - DNA, 15 bp, Homo sapiens
cacaagcccactggg

SEQ ID NO: 110072 - DNA, 15 bp, Homo sapiens
ccacaagcccactgg

SEQ ID NO: 110073 - DNA, 15 bp, Homo sapiens
accacaagcccactg

SEQ ID NO: 110074 - DNA, 15 bp, Homo sapiens
gaccacaagcccact

SEQ ID NO: 110075 - DNA, 15 bp, Homo sapiens
agaccacaagcccac

SEQ ID NO: 110076 - DNA, 15 bp, Homo sapiens
gagaccacaagccca

SEQ ID NO: 110077 - DNA, 15 bp, Homo sapiens
cgagaccacaagccc

SEQ ID NO: 110078 - DNA, 15 bp, Homo sapiens
gcgagaccacaagcc

SEQ ID NO: 110079 - DNA, 15 bp, Homo sapiens
agcgagaccacaagc

SEQ ID NO: 110080 - DNA, 15 bp, Homo sapiens
cagcgagaccacaag

SEQ ID NO: 110081 - DNA, 15 bp, Homo sapiens
ccagcgagaccacaa

SEQ ID NO: 110082 - DNA, 15 bp, Homo sapiens
gccagcgagaccaca

SEQ ID NO: 110083 - DNA, 15 bp, Homo sapiens
agccagcgagaccac

SEQ ID NO: 110084 - DNA, 15 bp, Homo sapiens
aagccagcgagacca

SEQ ID NO: 110085 - DNA, 15 bp, Homo sapiens
gaagccagcgagacc

SEQ ID NO: 110086 - DNA, 15 bp, Homo sapiens
tgaagccagcgagac

SEQ ID NO: 110087 - DNA, 15 bp, Homo sapiens
ctgaagccagcgaga

SEQ ID NO: 110088 - DNA, 15 bp, Homo sapiens
cctgaagccagcgag

SEQ ID NO: 110089 - DNA, 15 bp, Homo sapiens
tcctgaagccagcga

SEQ ID NO: 110090 - DNA, 15 bp, Homo sapiens
ctcctgaagccagcg

SEQ ID NO: 110091 - DNA, 15 bp, Homo sapiens
actcctgaagccagc

SEQ ID NO: 110092 - DNA, 15 bp, Homo sapiens
cactcctgaagccag

SEQ ID NO: 110093 - DNA, 15 bp, Homo sapiens
tcactcctgaagcca

SEQ ID NO: 110094 - DNA, 15 bp, Homo sapiens
ttcactcctgaagcc

SEQ ID NO: 110095 - DNA, 15 bp, Homo sapiens
cttcactcctgaagc

SEQ ID NO: 110096 - DNA, 15 bp, Homo sapiens
gcttcactcctgaag

SEQ ID NO: 110097 - DNA, 15 bp, Homo sapiens
agcttcactcctgaa

SEQ ID NO: 110098 - DNA, 15 bp, Homo sapiens
cagcttcactcctga

SEQ ID NO: 110099 - DNA, 15 bp, Homo sapiens
gcagcttcactcctg

SEQ ID NO: 110100 - DNA, 15 bp, Homo sapiens
tgcagcttcactcct

SEQ ID NO: 110101 - DNA, 15 bp, Homo sapiens
ctgcagcttcactcc

SEQ ID NO: 110102 - DNA, 15 bp, Homo sapiens
tctgcagcttcactc

SEQ ID NO: 110103 - DNA, 15 bp, Homo sapiens
gtctgcagcttcact

SEQ ID NO: 110104 - DNA, 15 bp, Homo sapiens
ggtctgcagcttcac

SEQ ID NO: 110105 - DNA, 15 bp, Homo sapiens
aggtctgcagcttca

SEQ ID NO: 110106 - DNA, 15 bp, Homo sapiens
aaggtctgcagcttc

SEQ ID NO: 110107 - DNA, 15 bp, Homo sapiens
aaaggtctgcagctt

SEQ ID NO: 110108 - DNA, 15 bp, Homo sapiens
caaaggtctgcagct

SEQ ID NO: 110109 - DNA, 15 bp, Homo sapiens
tgagctgtaacactc

SEQ ID NO: 110110 - DNA, 15 bp, Homo sapiens
atgagctgtaacact

SEQ ID NO: 110111 - DNA, 15 bp, Homo sapiens
tatgagctgtaacac

SEQ ID NO: 110112 - DNA, 15 bp, Homo sapiens
ttatgagctgtaaca

SEQ ID NO: 110113 - DNA, 15 bp, Homo sapiens
tttatgagctgtaac

SEQ ID NO: 110114 - DNA, 15 bp, Homo sapiens
ttttatgagctgtaa

SEQ ID NO: 110115 - DNA, 15 bp, Homo sapiens
cttttatgagctgta

SEQ ID NO: 110116 - DNA, 15 bp, Homo sapiens
gcttttatgagctgt

SEQ ID NO: 110117 - DNA, 15 bp, Homo sapiens
tgcttttatgagctg

SEQ ID NO: 110118 - DNA, 15 bp, Homo sapiens
ctgcttttatgagct

SEQ ID NO: 110119 - DNA, 15 bp, Homo sapiens
actgcttttatgagc

SEQ ID NO: 110120 - DNA, 15 bp, Homo sapiens
cactgcttttatgag

SEQ ID NO: 110121 - DNA, 15 bp, Homo sapiens
acactgcttttatga

SEQ ID NO: 110122 - DNA, 15 bp, Homo sapiens
cacactgcttttatg

SEQ ID NO: 110123 - DNA, 15 bp, Homo sapiens
ccacactgcttttat

SEQ ID NO: 110124 - DNA, 15 bp, Homo sapiens
tccacactgctttta

SEQ ID NO: 110125 - DNA, 15 bp, Homo sapiens
gtccacactgctttt

SEQ ID NO: 110126 - DNA, 15 bp, Homo sapiens
ggtccacactgcttt

SEQ ID NO: 110127 - DNA, 15 bp, Homo sapiens
gggtccacactgctt

SEQ ID NO: 110128 - DNA, 15 bp, Homo sapiens
tgggtccacactgct

SEQ ID NO: 110129 - DNA, 15 bp, Homo sapiens
ttgggtccacactgc

SEQ ID NO: 110130 - DNA, 15 bp, Homo sapiens
tttgggtccacactg

SEQ ID NO: 110131 - DNA, 15 bp, Homo sapiens
ctttgggtccacact

SEQ ID NO: 110132 - DNA, 15 bp, Homo sapiens
tctttgggtccacac

SEQ ID NO: 110133 - DNA, 15 bp, Homo sapiens
ctctttgggtccaca

SEQ ID NO: 110134 - DNA, 15 bp, Homo sapiens
actctttgggtccac

SEQ ID NO: 110135 - DNA, 15 bp, Homo sapiens
cactctttgggtcca

SEQ ID NO: 110136 - DNA, 15 bp, Homo sapiens
tcactctttgggtcc

SEQ ID NO: 110137 - DNA, 15 bp, Homo sapiens
ctcactctttgggtc

SEQ ID NO: 110138 - DNA, 15 bp, Homo sapiens
gctcactctttgggt

SEQ ID NO: 110139 - DNA, 15 bp, Homo sapiens
tgctcactctttggg

SEQ ID NO: 110140 - DNA, 15 bp, Homo sapiens
ctgctcactctttgg

SEQ ID NO: 110141 - DNA, 15 bp, Homo sapiens
actgctcactctttg

SEQ ID NO: 110142 - DNA, 15 bp, Homo sapiens
tactgctcactcttt

SEQ ID NO: 110143 - DNA, 15 bp, Homo sapiens
ctactgctcactctt

SEQ ID NO: 110144 - DNA, 15 bp, Homo sapiens
gctactgctcactct

SEQ ID NO: 110145 - DNA, 15 bp, Homo sapiens
tgctactgctcactc

SEQ ID NO: 110146 - DNA, 15 bp, Homo sapiens
ttgctactgctcact

SEQ ID NO: 110147 - DNA, 15 bp, Homo sapiens
cttgctactgctcac

SEQ ID NO: 110148 - DNA, 15 bp, Homo sapiens
tcttgctactgctca

SEQ ID NO: 110149 - DNA, 15 bp, Homo sapiens
atcttgctactgctc

SEQ ID NO: 110150 - DNA, 15 bp, Homo sapiens
aatcttgctactgct

SEQ ID NO: 110151 - DNA, 15 bp, Homo sapiens
aaatcttgctactgc

SEQ ID NO: 110152 - DNA, 15 bp, Homo sapiens
taaatcttgctactg

SEQ ID NO: 110153 - DNA, 15 bp, Homo sapiens
ataaatcttgctact

SEQ ID NO: 110154 - DNA, 15 bp, Homo sapiens
aataaatcttgctac

SEQ ID NO: 110155 - DNA, 15 bp, Homo sapiens
caataaatcttgcta

SEQ ID NO: 110156 - DNA, 15 bp, Homo sapiens
gcaataaatcttgct

SEQ ID NO: 110157 - DNA, 15 bp, Homo sapiens
tgcaataaatcttgc

SEQ ID NO: 110158 - DNA, 15 bp, Homo sapiens
ttgcaataaatcttg

SEQ ID NO: 110159 - DNA, 15 bp, Homo sapiens
tttgcaataaatctt

SEQ ID NO: 110160 - DNA, 15 bp, Homo sapiens
ctttgcaataaatct

SEQ ID NO: 110161 - DNA, 15 bp, Homo sapiens
tctttgcaataaatc

SEQ ID NO: 110162 - DNA, 15 bp, Homo sapiens
ctctttgcaataaat

SEQ ID NO: 110163 - DNA, 15 bp, Homo sapiens
gctctttgcaataaa

SEQ ID NO: 110164 - DNA, 15 bp, Homo sapiens
tgctctttgcaataa

SEQ ID NO: 110165 - DNA, 15 bp, Homo sapiens
ttgctctttgcaata

SEQ ID NO: 110166 - DNA, 15 bp, Homo sapiens
tttgctctttgcaat

SEQ ID NO: 110167 - DNA, 15 bp, Homo sapiens
ttttgctctttgcaa

SEQ ID NO: 110168 - DNA, 15 bp, Homo sapiens
cttttgctctttgca

SEQ ID NO: 110169 - DNA, 15 bp, Homo sapiens
tcttttgctctttgc

SEQ ID NO: 110170 - DNA, 15 bp, Homo sapiens
ttcttttgctctttg

SEQ ID NO: 110171 - DNA, 15 bp, Homo sapiens
gttcttttgctcttt

SEQ ID NO: 110172 - DNA, 15 bp, Homo sapiens
tgttcttttgctctt

SEQ ID NO: 110173 - DNA, 15 bp, Homo sapiens
ttgttcttttgctct

SEQ ID NO: 110174 - DNA, 15 bp, Homo sapiens
tttgttcttttgctc

SEQ ID NO: 110175 - DNA, 15 bp, Homo sapiens
ctttgttcttttgct

SEQ ID NO: 110176 - DNA, 15 bp, Homo sapiens
gctttgttcttttgc

SEQ ID NO: 110177 - DNA, 15 bp, Homo sapiens
agctttgttcttttg

SEQ ID NO: 110178 - DNA, 15 bp, Homo sapiens
aagctttgttctttt

SEQ ID NO: 110179 - DNA, 15 bp, Homo sapiens
gaagctttgttcttt

SEQ ID NO: 110180 - DNA, 15 bp, Homo sapiens
ggaagctttgttctt

SEQ ID NO: 110181 - DNA, 15 bp, Homo sapiens
tggaagctttgttct

SEQ ID NO: 110182 - DNA, 15 bp, Homo sapiens
gtggaagctttgttc

SEQ ID NO: 110183 - DNA, 15 bp, Homo sapiens
tgtggaagctttgtt

SEQ ID NO: 110184 - DNA, 15 bp, Homo sapiens
ctgtggaagctttgt

SEQ ID NO: 110185 - DNA, 15 bp, Homo sapiens
actgtggaagctttg

SEQ ID NO: 110186 - DNA, 15 bp, Homo sapiens
cactgtggaagcttt

SEQ ID NO: 110187 - DNA, 15 bp, Homo sapiens
acactgtggaagctt

SEQ ID NO: 110188 - DNA, 15 bp, Homo sapiens
cacactgtggaagct

SEQ ID NO: 110189 - DNA, 15 bp, Homo sapiens
ccacactgtggaagc

SEQ ID NO: 110190 - DNA, 15 bp, Homo sapiens
tccacactgtggaag

SEQ ID NO: 110191 - DNA, 15 bp, Homo sapiens
ttccacactgtggaa

SEQ ID NO: 110192 - DNA, 15 bp, Homo sapiens
cttccacactgtgga

SEQ ID NO: 110193 - DNA, 15 bp, Homo sapiens
ccttccacactgtgg

SEQ ID NO: 110194 - DNA, 15 bp, Homo sapiens
cccttccacactgtg

SEQ ID NO: 110195 - DNA, 15 bp, Homo sapiens
ccccttccacactgt

SEQ ID NO: 110196 - DNA, 15 bp, Homo sapiens
tccccttccacactg

SEQ ID NO: 110197 - DNA, 15 bp, Homo sapiens
gtccccttccacact

SEQ ID NO: 110198 - DNA, 15 bp, Homo sapiens
ggtccccttccacac

SEQ ID NO: 110199 - DNA, 15 bp, Homo sapiens
gggtccccttccaca

SEQ ID NO: 110200 - DNA, 15 bp, Homo sapiens
cgggtccccttccac

SEQ ID NO: 110201 - DNA, 15 bp, Homo sapiens
tcgggtccccttcca

SEQ ID NO: 110202 - DNA, 15 bp, Homo sapiens
ctcgggtccccttcc

SEQ ID NO: 110203 - DNA, 15 bp, Homo sapiens
gctcgggtccccttc

SEQ ID NO: 110204 - DNA, 15 bp, Homo sapiens
cgctcgggtcccctt

SEQ ID NO: 110205 - DNA, 15 bp, Homo sapiens
ccgctcgggtcccct

SEQ ID NO: 110206 - DNA, 15 bp, Homo sapiens
cccgctcgggtcccc

SEQ ID NO: 110207 - DNA, 15 bp, Homo sapiens
acccgctcgggtccc

SEQ ID NO: 110208 - DNA, 15 bp, Homo sapiens
aacccgctcgggtcc

SEQ ID NO: 110209 - DNA, 15 bp, Homo sapiens
caacccgctcgggtc

SEQ ID NO: 110210 - DNA, 15 bp, Homo sapiens
gcaacccgctcgggt

SEQ ID NO: 110211 - DNA, 15 bp, Homo sapiens
ggcaacccgctcggg

SEQ ID NO: 110212 - DNA, 15 bp, Homo sapiens
tggcaacccgctcgg

SEQ ID NO: 110213 - DNA, 15 bp, Homo sapiens
gtggcaacccgctcg

SEQ ID NO: 110214 - DNA, 15 bp, Homo sapiens
agtggcaacccgctc

SEQ ID NO: 110215 - DNA, 15 bp, Homo sapiens
cagtggcaacccgct

SEQ ID NO: 110216 - DNA, 15 bp, Homo sapiens
gcagtggcaacccgc

SEQ ID NO: 110217 - DNA, 15 bp, Homo sapiens
agcagtggcaacccg

SEQ ID NO: 110218 - DNA, 15 bp, Homo sapiens
cagcagtggcaaccc

SEQ ID NO: 110219 - DNA, 15 bp, Homo sapiens
ccagcagtggcaacc

SEQ ID NO: 110220 - DNA, 15 bp, Homo sapiens
gccagcagtggcaac

SEQ ID NO: 110221 - DNA, 15 bp, Homo sapiens
agccagcagtggcaa

SEQ ID NO: 110222 - DNA, 15 bp, Homo sapiens
gagccagcagtggca

SEQ ID NO: 110223 - DNA, 15 bp, Homo sapiens
cgagccagcagtggc

SEQ ID NO: 110224 - DNA, 15 bp, Homo sapiens
gcgagccagcagtgg

SEQ ID NO: 110225 - DNA, 15 bp, Homo sapiens
cgcgagccagcagtg

SEQ ID NO: 110226 - DNA, 15 bp, Homo sapiens
gcgcgagccagcagt

SEQ ID NO: 110227 - DNA, 15 bp, Homo sapiens
tgcgcgagccagcag

SEQ ID NO: 110228 - DNA, 15 bp, Homo sapiens
ctgcgcgagccagca

SEQ ID NO: 110229 - DNA, 15 bp, Homo sapiens
gctgcgcgagccagc

SEQ ID NO: 110230 - DNA, 15 bp, Homo sapiens
ggctgcgcgagccag

SEQ ID NO: 110231 - DNA, 15 bp, Homo sapiens
aggctgcgcgagcca

SEQ ID NO: 110232 - DNA, 15 bp, Homo sapiens
caggctgcgcgagcc

SEQ ID NO: 110233 - DNA, 15 bp, Homo sapiens
gcaggctgcgcgagc

SEQ ID NO: 110234 - DNA, 15 bp, Homo sapiens
agcaggctgcgcgag

SEQ ID NO: 110235 - DNA, 15 bp, Homo sapiens
aagcaggctgcgcga

SEQ ID NO: 110236 - DNA, 15 bp, Homo sapiens
aaagcaggctgcgcg

SEQ ID NO: 110237 - DNA, 15 bp, Homo sapiens
aaaagcaggctgcgc

SEQ ID NO: 110238 - DNA, 15 bp, Homo sapiens
taaaagcaggctgcg

SEQ ID NO: 110239 - DNA, 15 bp, Homo sapiens
ataaaagcaggctgc

SEQ ID NO: 110240 - DNA, 15 bp, Homo sapiens
aataaaagcaggctg

SEQ ID NO: 110241 - DNA, 15 bp, Homo sapiens
gaataaaagcaggct

SEQ ID NO: 110242 - DNA, 15 bp, Homo sapiens
agaataaaagcaggc

SEQ ID NO: 110243 - DNA, 15 bp, Homo sapiens
gagaataaaagcagg

SEQ ID NO: 110244 - DNA, 15 bp, Homo sapiens
agagaataaaagcag

SEQ ID NO: 110245 - DNA, 15 bp, Homo sapiens
aagagaataaaagca

SEQ ID NO: 110246 - DNA, 15 bp, Homo sapiens
taagagaataaaagc

SEQ ID NO: 110247 - DNA, 15 bp, Homo sapiens
ataagagaataaaag

SEQ ID NO: 110248 - DNA, 15 bp, Homo sapiens
gataagagaataaaa

SEQ ID NO: 110249 - DNA, 15 bp, Homo sapiens
agataagagaataaa

SEQ ID NO: 110250 - DNA, 15 bp, Homo sapiens
cagataagagaataa

SEQ ID NO: 110251 - DNA, 15 bp, Homo sapiens
ccagataagagaata

SEQ ID NO: 110252 - DNA, 15 bp, Homo sapiens
gccagataagagaat

SEQ ID NO: 110253 - DNA, 15 bp, Homo sapiens
ggccagataagagaa

SEQ ID NO: 110254 - DNA, 15 bp, Homo sapiens
gggccagataagaga

SEQ ID NO: 110255 - DNA, 15 bp, Homo sapiens
agggccagataagag

SEQ ID NO: 110256 - DNA, 15 bp, Homo sapiens
tagggccagataaga

SEQ ID NO: 110257 - DNA, 15 bp, Homo sapiens
gtagggccagataag

SEQ ID NO: 110258 - DNA, 15 bp, Homo sapiens
ggtagggccagataa

SEQ ID NO: 110259 - DNA, 15 bp, Homo sapiens
gggtagggccagata

SEQ ID NO: 110260 - DNA, 15 bp, Homo sapiens
tgggtagggccagat

SEQ ID NO: 110261 - DNA, 15 bp, Homo sapiens
gtgggtagggccaga

SEQ ID NO: 110262 - DNA, 15 bp, Homo sapiens
tgtgggtagggccag

SEQ ID NO: 110263 - DNA, 15 bp, Homo sapiens
atgtgggtagggcca

SEQ ID NO: 110264 - DNA, 15 bp, Homo sapiens
gatgtgggtagggcc

SEQ ID NO: 110265 - DNA, 15 bp, Homo sapiens
ggatgtgggtagggc

SEQ ID NO: 110266 - DNA, 15 bp, Homo sapiens
aggatgtgggtaggg

SEQ ID NO: 110267 - DNA, 15 bp, Homo sapiens
caggatgtgggtagg

SEQ ID NO: 110268 - DNA, 15 bp, Homo sapiens
gcaggatgtgggtag

SEQ ID NO: 110269 - DNA, 15 bp, Homo sapiens
agcaggatgtgggta

SEQ ID NO: 110270 - DNA, 15 bp, Homo sapiens
cagcaggatgtgggt

SEQ ID NO: 110271 - DNA, 15 bp, Homo sapiens
tcagcaggatgtggg

SEQ ID NO: 110272 - DNA, 15 bp, Homo sapiens
atcagcaggatgtgg

SEQ ID NO: 110273 - DNA, 15 bp, Homo sapiens
aatcagcaggatgtg

SEQ ID NO: 110274 - DNA, 15 bp, Homo sapiens
caatcagcaggatgt

SEQ ID NO: 110275 - DNA, 15 bp, Homo sapiens
ccaatcagcaggatg

SEQ ID NO: 110276 - DNA, 15 bp, Homo sapiens
accaatcagcaggat

SEQ ID NO: 110277 - DNA, 15 bp, Homo sapiens
taccaatcagcagga

SEQ ID NO: 110278 - DNA, 15 bp, Homo sapiens
ctaccaatcagcagg

SEQ ID NO: 110279 - DNA, 15 bp, Homo sapiens
tctaccaatcagcag

SEQ ID NO: 110280 - DNA, 15 bp, Homo sapiens
ctctaccaatcagca

SEQ ID NO: 110281 - DNA, 15 bp, Homo sapiens
tctctaccaatcagc

SEQ ID NO: 110282 - DNA, 15 bp, Homo sapiens
gtctctaccaatcag

SEQ ID NO: 110283 - DNA, 15 bp, Homo sapiens
cgtctctaccaatca

SEQ ID NO: 110284 - DNA, 15 bp, Homo sapiens
tcgtctctaccaatc

SEQ ID NO: 110285 - DNA, 15 bp, Homo sapiens
ctcgtctctaccaat

SEQ ID NO: 110286 - DNA, 15 bp, Homo sapiens
actcgtctctaccaa

SEQ ID NO: 110287 - DNA, 15 bp, Homo sapiens
cactcgtctctacca

SEQ ID NO: 110288 - DNA, 15 bp, Homo sapiens
ccactcgtctctacc

SEQ ID NO: 110289 - DNA, 15 bp, Homo sapiens
accactcgtctctac

SEQ ID NO: 110290 - DNA, 15 bp, Homo sapiens
gaccactcgtctcta

SEQ ID NO: 110291 - DNA, 15 bp, Homo sapiens
agaccactcgtctct

SEQ ID NO: 110292 - DNA, 15 bp, Homo sapiens
cagaccactcgtctc

SEQ ID NO: 110293 - DNA, 15 bp, Homo sapiens
acagaccactcgtct

SEQ ID NO: 110294 - DNA, 15 bp, Homo sapiens
aacagaccactcgtc

SEQ ID NO: 110295 - DNA, 15 bp, Homo sapiens
aaacagaccactcgt

SEQ ID NO: 110296 - DNA, 15 bp, Homo sapiens
aaaacagaccactcg

SEQ ID NO: 110297 - DNA, 15 bp, Homo sapiens
caaaacagaccactc

SEQ ID NO: 110298 - DNA, 15 bp, Homo sapiens
tcaaaacagaccact

SEQ ID NO: 110299 - DNA, 15 bp, Homo sapiens
gtcaaaacagaccac

SEQ ID NO: 110300 - DNA, 15 bp, Homo sapiens
tgtcaaaacagacca

SEQ ID NO: 110301 - DNA, 15 bp, Homo sapiens
ctgtcaaaacagacc

SEQ ID NO: 110302 - DNA, 15 bp, Homo sapiens
cctgtcaaaacagac

SEQ ID NO: 110303 - DNA, 15 bp, Homo sapiens
ccctgtcaaaacaga

SEQ ID NO: 110304 - DNA, 15 bp, Homo sapiens
gccctgtcaaaacag

SEQ ID NO: 110305 - DNA, 15 bp, Homo sapiens
cgccctgtcaaaaca

SEQ ID NO: 110306 - DNA, 15 bp, Homo sapiens
gcgccctgtcaaaac

SEQ ID NO: 110307 - DNA, 15 bp, Homo sapiens
agcgccctgtcaaaa

SEQ ID NO: 110308 - DNA, 15 bp, Homo sapiens
cagcgccctgtcaaa

SEQ ID NO: 110309 - DNA, 15 bp, Homo sapiens
tcagcgccctgtcaa

SEQ ID NO: 110310 - DNA, 15 bp, Homo sapiens
atcagcgccctgtca

SEQ ID NO: 110311 - DNA, 15 bp, Homo sapiens
aatcagcgccctgtc

SEQ ID NO: 110312 - DNA, 15 bp, Homo sapiens
caatcagcgccctgt

SEQ ID NO: 110313 - DNA, 15 bp, Homo sapiens
ccaatcagcgccctg

SEQ ID NO: 110314 - DNA, 15 bp, Homo sapiens
accaatcagcgccct

SEQ ID NO: 110315 - DNA, 15 bp, Homo sapiens
caccaatcagcgccc

SEQ ID NO: 110316 - DNA, 15 bp, Homo sapiens
gcaccaatcagcgcc

SEQ ID NO: 110317 - DNA, 15 bp, Homo sapiens
cgcaccaatcagcgc

SEQ ID NO: 110318 - DNA, 15 bp, Homo sapiens
acgcaccaatcagcg

SEQ ID NO: 110319 - DNA, 15 bp, Homo sapiens
aacgcaccaatcagc

SEQ ID NO: 110320 - DNA, 15 bp, Homo sapiens
aaacgcaccaatcag

SEQ ID NO: 110321 - DNA, 15 bp, Homo sapiens
taaacgcaccaatca

SEQ ID NO: 110322 - DNA, 15 bp, Homo sapiens
gtaaacgcaccaatc

SEQ ID NO: 110323 - DNA, 15 bp, Homo sapiens
tgtaaacgcaccaat

SEQ ID NO: 110324 - DNA, 15 bp, Homo sapiens
ttgtaaacgcaccaa

SEQ ID NO: 110325 - DNA, 15 bp, Homo sapiens
attgtaaacgcacca

SEQ ID NO: 110326 - DNA, 15 bp, Homo sapiens
gattgtaaacgcacc

SEQ ID NO: 110327 - DNA, 15 bp, Homo sapiens
ggattgtaaacgcac

SEQ ID NO: 110328 - DNA, 15 bp, Homo sapiens
gggattgtaaacgca

SEQ ID NO: 110329 - DNA, 15 bp, Homo sapiens
agggattgtaaacgc

SEQ ID NO: 110330 - DNA, 15 bp, Homo sapiens
cagggattgtaaacg

SEQ ID NO: 110331 - DNA, 15 bp, Homo sapiens
tcagggattgtaaac

SEQ ID NO: 110332 - DNA, 15 bp, Homo sapiens
ctcagggattgtaaa

SEQ ID NO: 110333 - DNA, 15 bp, Homo sapiens
gctcagggattgtaa

SEQ ID NO: 110334 - DNA, 15 bp, Homo sapiens
agctcagggattgta

SEQ ID NO: 110335 - DNA, 15 bp, Homo sapiens
tagctcagggattgt

SEQ ID NO: 110336 - DNA, 15 bp, Homo sapiens
ctagctcagggattg

SEQ ID NO: 110337 - DNA, 15 bp, Homo sapiens
tctagctcagggatt

SEQ ID NO: 110338 - DNA, 15 bp, Homo sapiens
gtctagctcagggat

SEQ ID NO: 110339 - DNA, 15 bp, Homo sapiens
tgtctagctcaggga

SEQ ID NO: 110340 - DNA, 15 bp, Homo sapiens
gtgtctagctcaggg

SEQ ID NO: 110341 - DNA, 15 bp, Homo sapiens
tgtgtctagctcagg

SEQ ID NO: 110342 - DNA, 15 bp, Homo sapiens
ttgtgtctagctcag

SEQ ID NO: 110343 - DNA, 15 bp, Homo sapiens
tttgtgtctagctca

SEQ ID NO: 110344 - DNA, 15 bp, Homo sapiens
ctttgtgtctagctc

SEQ ID NO: 110345 - DNA, 15 bp, Homo sapiens
cctttgtgtctagct

SEQ ID NO: 110346 - DNA, 15 bp, Homo sapiens
acctttgtgtctagc

SEQ ID NO: 110347 - DNA, 15 bp, Homo sapiens
aacctttgtgtctag

SEQ ID NO: 110348 - DNA, 15 bp, Homo sapiens
gaacctttgtgtcta

SEQ ID NO: 110349 - DNA, 15 bp, Homo sapiens
agaacctttgtgtct

SEQ ID NO: 110350 - DNA, 15 bp, Homo sapiens
gagaacctttgtgtc

SEQ ID NO: 110351 - DNA, 15 bp, Homo sapiens
ggagaacctttgtgt

SEQ ID NO: 110352 - DNA, 15 bp, Homo sapiens
tggagaacctttgtg

SEQ ID NO: 110353 - DNA, 15 bp, Homo sapiens
atggagaacctttgt

SEQ ID NO: 110354 - DNA, 15 bp, Homo sapiens
catggagaacctttg

SEQ ID NO: 110355 - DNA, 15 bp, Homo sapiens
acatggagaaccttt

SEQ ID NO: 110356 - DNA, 15 bp, Homo sapiens
gacatggagaacctt

SEQ ID NO: 110357 - DNA, 15 bp, Homo sapiens
ggacatggagaacct

SEQ ID NO: 110358 - DNA, 15 bp, Homo sapiens
gggacatggagaacc

SEQ ID NO: 110359 - DNA, 15 bp, Homo sapiens
ggggacatggagaac

SEQ ID NO: 110360 - DNA, 15 bp, Homo sapiens
tggggacatggagaa

SEQ ID NO: 110361 - DNA, 15 bp, Homo sapiens
gtggggacatggaga

SEQ ID NO: 110362 - DNA, 15 bp, Homo sapiens
ggtggggacatggag

SEQ ID NO: 110363 - DNA, 15 bp, Homo sapiens
tggtggggacatgga

SEQ ID NO: 110364 - DNA, 15 bp, Homo sapiens
ctggtggggacatgg

SEQ ID NO: 110365 - DNA, 15 bp, Homo sapiens
tctggtggggacatg

SEQ ID NO: 110366 - DNA, 15 bp, Homo sapiens
atctggtggggacat

SEQ ID NO: 110367 - DNA, 15 bp, Homo sapiens
aatctggtggggaca

SEQ ID NO: 110368 - DNA, 15 bp, Homo sapiens
taatctggtggggac

SEQ ID NO: 110369 - DNA, 15 bp, Homo sapiens
ctaatctggtgggga

SEQ ID NO: 110370 - DNA, 15 bp, Homo sapiens
gctaatctggtgggg

SEQ ID NO: 110371 - DNA, 15 bp, Homo sapiens
agctaatctggtggg

SEQ ID NO: 110372 - DNA, 15 bp, Homo sapiens
tagctaatctggtgg

SEQ ID NO: 110373 - DNA, 15 bp, Homo sapiens
ctagctaatctggtg

SEQ ID NO: 110374 - DNA, 15 bp, Homo sapiens
tctagctaatctggt

SEQ ID NO: 110375 - DNA, 15 bp, Homo sapiens
atctagctaatctgg

SEQ ID NO: 110376 - DNA, 15 bp, Homo sapiens
tatctagctaatctg

SEQ ID NO: 110377 - DNA, 15 bp, Homo sapiens
gtatctagctaatct

SEQ ID NO: 110378 - DNA, 15 bp, Homo sapiens
tgtatctagctaatc

SEQ ID NO: 110379 - DNA, 15 bp, Homo sapiens
ctgtatctagctaat

SEQ ID NO: 110380 - DNA, 15 bp, Homo sapiens
tctgtatctagctaa

SEQ ID NO: 110381 - DNA, 15 bp, Homo sapiens
ctctgtatctagcta

SEQ ID NO: 110382 - DNA, 15 bp, Homo sapiens
actctgtatctagct

SEQ ID NO: 110383 - DNA, 15 bp, Homo sapiens
cactctgtatctagc

SEQ ID NO: 110384 - DNA, 15 bp, Homo sapiens
acactctgtatctag

SEQ ID NO: 110385 - DNA, 15 bp, Homo sapiens
cacactctgtatcta

SEQ ID NO: 110386 - DNA, 15 bp, Homo sapiens
ccacactctgtatct

SEQ ID NO: 110387 - DNA, 15 bp, Homo sapiens
tccacactctgtatc

SEQ ID NO: 110388 - DNA, 15 bp, Homo sapiens
gtccacactctgtat

SEQ ID NO: 110389 - DNA, 15 bp, Homo sapiens
tgtccacactctgta

SEQ ID NO: 110390 - DNA, 15 bp, Homo sapiens
gtgtccacactctgt

SEQ ID NO: 110391 - DNA, 15 bp, Homo sapiens
tgtgtccacactctg

SEQ ID NO: 110392 - DNA, 15 bp, Homo sapiens
ttgtgtccacactct

SEQ ID NO: 110393 - DNA, 15 bp, Homo sapiens
tttgtgtccacactc

SEQ ID NO: 110394 - DNA, 15 bp, Homo sapiens
ctttgtgtccacact

SEQ ID NO: 110395 - DNA, 15 bp, Homo sapiens
cctttgtgtccacac

SEQ ID NO: 110396 - DNA, 15 bp, Homo sapiens
acctttgtgtccaca

SEQ ID NO: 110397 - DNA, 15 bp, Homo sapiens
aacctttgtgtccac

SEQ ID NO: 110398 - DNA, 15 bp, Homo sapiens
gaacctttgtgtcca

SEQ ID NO: 110399 - DNA, 15 bp, Homo sapiens
agaacctttgtgtcc

SEQ ID NO: 110400 - DNA, 15 bp, Homo sapiens
ttggagaacctttgt

SEQ ID NO: 110401 - DNA, 15 bp, Homo sapiens
cttggagaacctttg

SEQ ID NO: 110402 - DNA, 15 bp, Homo sapiens
ccttggagaaccttt

SEQ ID NO: 110403 - DNA, 15 bp, Homo sapiens
gccttggagaacctt

SEQ ID NO: 110404 - DNA, 15 bp, Homo sapiens
ggccttggagaacct

SEQ ID NO: 110405 - DNA, 15 bp, Homo sapiens
gggccttggagaacc

SEQ ID NO: 110406 - DNA, 15 bp, Homo sapiens
ggggccttggagaac

SEQ ID NO: 110407 - DNA, 15 bp, Homo sapiens
tggggccttggagaa

SEQ ID NO: 110408 - DNA, 15 bp, Homo sapiens
gtggggccttggaga

SEQ ID NO: 110409 - DNA, 15 bp, Homo sapiens
ggtggggccttggag

SEQ ID NO: 110410 - DNA, 15 bp, Homo sapiens
tggtggggccttgga

SEQ ID NO: 110411 - DNA, 15 bp, Homo sapiens
ctggtggggccttgg

SEQ ID NO: 110412 - DNA, 15 bp, Homo sapiens
tctggtggggccttg

SEQ ID NO: 110413 - DNA, 15 bp, Homo sapiens
ctctggtggggcctt

SEQ ID NO: 110414 - DNA, 15 bp, Homo sapiens
actctggtggggcct

SEQ ID NO: 110415 - DNA, 15 bp, Homo sapiens
tactctggtggggcc

SEQ ID NO: 110416 - DNA, 15 bp, Homo sapiens
ctactctggtggggc

SEQ ID NO: 110417 - DNA, 15 bp, Homo sapiens
gctactctggtgggg

SEQ ID NO: 110418 - DNA, 15 bp, Homo sapiens
agctactctggtggg

SEQ ID NO: 110419 - DNA, 15 bp, Homo sapiens
tagctactctggtgg

SEQ ID NO: 110420 - DNA, 15 bp, Homo sapiens
ctagctactctggtg

SEQ ID NO: 110421 - DNA, 15 bp, Homo sapiens
tctagctactctggt

SEQ ID NO: 110422 - DNA, 15 bp, Homo sapiens
atctagctactctgg

SEQ ID NO: 110423 - DNA, 15 bp, Homo sapiens
tatctagctactctg

SEQ ID NO: 110424 - DNA, 15 bp, Homo sapiens
gtatctagctactct

SEQ ID NO: 110425 - DNA, 15 bp, Homo sapiens
tgtatctagctactc

SEQ ID NO: 110426 - DNA, 15 bp, Homo sapiens
ctgtatctagctact

SEQ ID NO: 110427 - DNA, 15 bp, Homo sapiens
tctgtatctagctac

SEQ ID NO: 110428 - DNA, 15 bp, Homo sapiens
aacactctgtatcta

SEQ ID NO: 110429 - DNA, 15 bp, Homo sapiens
caacactctgtatct

SEQ ID NO: 110430 - DNA, 15 bp, Homo sapiens
tcaacactctgtatc

SEQ ID NO: 110431 - DNA, 15 bp, Homo sapiens
atcaacactctgtat

SEQ ID NO: 110432 - DNA, 15 bp, Homo sapiens
aatcaacactctgta

SEQ ID NO: 110433 - DNA, 15 bp, Homo sapiens
caatcaacactctgt

SEQ ID NO: 110434 - DNA, 15 bp, Homo sapiens
ccaatcaacactctg

SEQ ID NO: 110435 - DNA, 15 bp, Homo sapiens
accaatcaacactct

SEQ ID NO: 110436 - DNA, 15 bp, Homo sapiens
caccaatcaacactc

SEQ ID NO: 110437 - DNA, 15 bp, Homo sapiens
gcaccaatcaacact

SEQ ID NO: 110438 - DNA, 15 bp, Homo sapiens
tgcaccaatcaacac

SEQ ID NO: 110439 - DNA, 15 bp, Homo sapiens
atgcaccaatcaaca

SEQ ID NO: 110440 - DNA, 15 bp, Homo sapiens
aatgcaccaatcaac

SEQ ID NO: 110441 - DNA, 15 bp, Homo sapiens
gaatgcaccaatcaa

SEQ ID NO: 110442 - DNA, 15 bp, Homo sapiens
tgaatgcaccaatca

SEQ ID NO: 110443 - DNA, 15 bp, Homo sapiens
gtgaatgcaccaatc

SEQ ID NO: 110444 - DNA, 15 bp, Homo sapiens
tgtgaatgcaccaat

SEQ ID NO: 110445 - DNA, 15 bp, Homo sapiens
ttgtgaatgcaccaa

SEQ ID NO: 110446 - DNA, 15 bp, Homo sapiens
tttgtgaatgcacca

SEQ ID NO: 110447 - DNA, 15 bp, Homo sapiens
gtttgtgaatgcacc

SEQ ID NO: 110448 - DNA, 15 bp, Homo sapiens
ggtttgtgaatgcac

SEQ ID NO: 110449 - DNA, 15 bp, Homo sapiens
gggtttgtgaatgca

SEQ ID NO: 110450 - DNA, 15 bp, Homo sapiens
agggtttgtgaatgc

SEQ ID NO: 110451 - DNA, 15 bp, Homo sapiens
cagggtttgtgaatg

SEQ ID NO: 110452 - DNA, 15 bp, Homo sapiens
tcagggtttgtgaat

SEQ ID NO: 110453 - DNA, 15 bp, Homo sapiens
ctcagggtttgtgaa

SEQ ID NO: 110454 - DNA, 15 bp, Homo sapiens
gctcagggtttgtga

SEQ ID NO: 110455 - DNA, 15 bp, Homo sapiens
agctcagggtttgtg

SEQ ID NO: 110456 - DNA, 15 bp, Homo sapiens
tagctcagggtttgt

SEQ ID NO: 110457 - DNA, 15 bp, Homo sapiens
ctagctcagggtttg

SEQ ID NO: 110458 - DNA, 15 bp, Homo sapiens
tctagctcagggttt

SEQ ID NO: 110459 - DNA, 15 bp, Homo sapiens
gtctagctcagggtt

SEQ ID NO: 110460 - DNA, 15 bp, Homo sapiens
tgtctagctcagggt

SEQ ID NO: 110461 - DNA, 15 bp, Homo sapiens
ctgtgtctagctcag

SEQ ID NO: 110462 - DNA, 15 bp, Homo sapiens
cctgtgtctagctca

SEQ ID NO: 110463 - DNA, 15 bp, Homo sapiens
ccctgtgtctagctc

SEQ ID NO: 110464 - DNA, 15 bp, Homo sapiens
accctgtgtctagct

SEQ ID NO: 110465 - DNA, 15 bp, Homo sapiens
caccctgtgtctagc

SEQ ID NO: 110466 - DNA, 15 bp, Homo sapiens
gcaccctgtgtctag

SEQ ID NO: 110467 - DNA, 15 bp, Homo sapiens
agcaccctgtgtcta

SEQ ID NO: 110468 - DNA, 15 bp, Homo sapiens
cagcaccctgtgtct

SEQ ID NO: 110469 - DNA, 15 bp, Homo sapiens
tcagcaccctgtgtc

SEQ ID NO: 110470 - DNA, 15 bp, Homo sapiens
atcagcaccctgtgt

SEQ ID NO: 110471 - DNA, 15 bp, Homo sapiens
aatcagcaccctgtg

SEQ ID NO: 110472 - DNA, 15 bp, Homo sapiens
caatcagcaccctgt

SEQ ID NO: 110473 - DNA, 15 bp, Homo sapiens
ccaatcagcaccctg

SEQ ID NO: 110474 - DNA, 15 bp, Homo sapiens
accaatcagcaccct

SEQ ID NO: 110475 - DNA, 15 bp, Homo sapiens
caccaatcagcaccc

SEQ ID NO: 110476 - DNA, 15 bp, Homo sapiens
acaccaatcagcacc

SEQ ID NO: 110477 - DNA, 15 bp, Homo sapiens
cacaccaatcagcac

SEQ ID NO: 110478 - DNA, 15 bp, Homo sapiens
acacaccaatcagca

SEQ ID NO: 110479 - DNA, 15 bp, Homo sapiens
aacacaccaatcagc

SEQ ID NO: 110480 - DNA, 15 bp, Homo sapiens
aaacacaccaatcag

SEQ ID NO: 110481 - DNA, 15 bp, Homo sapiens
taaacacaccaatca

SEQ ID NO: 110482 - DNA, 15 bp, Homo sapiens
gtaaacacaccaatc

SEQ ID NO: 110483 - DNA, 15 bp, Homo sapiens
tgtaaacacaccaat

SEQ ID NO: 110484 - DNA, 15 bp, Homo sapiens
ttgtaaacacaccaa

SEQ ID NO: 110485 - DNA, 15 bp, Homo sapiens
tttgtaaacacacca

SEQ ID NO: 110486 - DNA, 15 bp, Homo sapiens
gtttgtaaacacacc

SEQ ID NO: 110487 - DNA, 15 bp, Homo sapiens
ggtttgtaaacacac

SEQ ID NO: 110488 - DNA, 15 bp, Homo sapiens
aggtttgtaaacaca

SEQ ID NO: 110489 - DNA, 15 bp, Homo sapiens
aaggtttgtaaacac

SEQ ID NO: 110490 - DNA, 15 bp, Homo sapiens
caaggtttgtaaaca

SEQ ID NO: 110491 - DNA, 15 bp, Homo sapiens
tcaaggtttgtaaac

SEQ ID NO: 110492 - DNA, 15 bp, Homo sapiens
ctcaaggtttgtaaa

SEQ ID NO: 110493 - DNA, 15 bp, Homo sapiens
gctcaaggtttgtaa

SEQ ID NO: 110494 - DNA, 15 bp, Homo sapiens
agctcaaggtttgta

SEQ ID NO: 110495 - DNA, 15 bp, Homo sapiens
tagctcaaggtttgt

SEQ ID NO: 110496 - DNA, 15 bp, Homo sapiens
ctagctcaaggtttg

SEQ ID NO: 110497 - DNA, 15 bp, Homo sapiens
tctagctcaaggttt

SEQ ID NO: 110498 - DNA, 15 bp, Homo sapiens
atctagctcaaggtt

SEQ ID NO: 110499 - DNA, 15 bp, Homo sapiens
tatctagctcaaggt

SEQ ID NO: 110500 - DNA, 15 bp, Homo sapiens
gtatctagctcaagg

SEQ ID NO: 110501 - DNA, 15 bp, Homo sapiens
tgtatctagctcaag

SEQ ID NO: 110502 - DNA, 15 bp, Homo sapiens
ctgtatctagctcaa

SEQ ID NO: 110503 - DNA, 15 bp, Homo sapiens
tctgtatctagctca

SEQ ID NO: 110504 - DNA, 15 bp, Homo sapiens
ctctgtatctagctc

SEQ ID NO: 110505 - DNA, 15 bp, Homo sapiens
gcactctgtatctag

SEQ ID NO: 110506 - DNA, 15 bp, Homo sapiens
ggcactctgtatcta

SEQ ID NO: 110507 - DNA, 15 bp, Homo sapiens
tggcactctgtatct

SEQ ID NO: 110508 - DNA, 15 bp, Homo sapiens
ttggcactctgtatc

SEQ ID NO: 110509 - DNA, 15 bp, Homo sapiens
attggcactctgtat

SEQ ID NO: 110510 - DNA, 15 bp, Homo sapiens
aattggcactctgta

SEQ ID NO: 110511 - DNA, 15 bp, Homo sapiens
caattggcactctgt

SEQ ID NO: 110512 - DNA, 15 bp, Homo sapiens
ccaattggcactctg

SEQ ID NO: 110513 - DNA, 15 bp, Homo sapiens
accaattggcactct

SEQ ID NO: 110514 - DNA, 15 bp, Homo sapiens
caccaattggcactc

SEQ ID NO: 110515 - DNA, 15 bp, Homo sapiens
acaccaattggcact

SEQ ID NO: 110516 - DNA, 15 bp, Homo sapiens
tacaccaattggcac

SEQ ID NO: 110517 - DNA, 15 bp, Homo sapiens
atacaccaattggca

SEQ ID NO: 110518 - DNA, 15 bp, Homo sapiens
aatacaccaattggc

SEQ ID NO: 110519 - DNA, 15 bp, Homo sapiens
aaatacaccaattgg

SEQ ID NO: 110520 - DNA, 15 bp, Homo sapiens
taaatacaccaattg

SEQ ID NO: 110521 - DNA, 15 bp, Homo sapiens
gtaaatacaccaatt

SEQ ID NO: 110522 - DNA, 15 bp, Homo sapiens
tgtaaatacaccaat

SEQ ID NO: 110523 - DNA, 15 bp, Homo sapiens
ttgtaaatacaccaa

SEQ ID NO: 110524 - DNA, 15 bp, Homo sapiens
attgtaaatacacca

SEQ ID NO: 110525 - DNA, 15 bp, Homo sapiens
gattgtaaatacacc

SEQ ID NO: 110526 - DNA, 15 bp, Homo sapiens
ggattgtaaatacac

SEQ ID NO: 110527 - DNA, 15 bp, Homo sapiens
gggattgtaaataca

SEQ ID NO: 110528 - DNA, 15 bp, Homo sapiens
agggattgtaaatac

SEQ ID NO: 110529 - DNA, 15 bp, Homo sapiens
aagggattgtaaata

SEQ ID NO: 110530 - DNA, 15 bp, Homo sapiens
taagggattgtaaat

SEQ ID NO: 110531 - DNA, 15 bp, Homo sapiens
ctaagggattgtaaa

SEQ ID NO: 110532 - DNA, 15 bp, Homo sapiens
gctaagggattgtaa

SEQ ID NO: 110533 - DNA, 15 bp, Homo sapiens
agctaagggattgta

SEQ ID NO: 110534 - DNA, 15 bp, Homo sapiens
tagctaagggattgt

SEQ ID NO: 110535 - DNA, 15 bp, Homo sapiens
ctagctaagggattg

SEQ ID NO: 110536 - DNA, 15 bp, Homo sapiens
tctagctaagggatt

SEQ ID NO: 110537 - DNA, 15 bp, Homo sapiens
gtctagctaagggat

SEQ ID NO: 110538 - DNA, 15 bp, Homo sapiens
tgtctagctaaggga

SEQ ID NO: 110539 - DNA, 15 bp, Homo sapiens
atgtctagctaaggg

SEQ ID NO: 110540 - DNA, 15 bp, Homo sapiens
tatgtctagctaagg

SEQ ID NO: 110541 - DNA, 15 bp, Homo sapiens
ttatgtctagctaag

SEQ ID NO: 110542 - DNA, 15 bp, Homo sapiens
tttatgtctagctaa

SEQ ID NO: 110543 - DNA, 15 bp, Homo sapiens
ctttatgtctagcta

SEQ ID NO: 110544 - DNA, 15 bp, Homo sapiens
cctttatgtctagct

SEQ ID NO: 110545 - DNA, 15 bp, Homo sapiens
acctttatgtctagc

SEQ ID NO: 110546 - DNA, 15 bp, Homo sapiens
aacctttatgtctag

SEQ ID NO: 110547 - DNA, 15 bp, Homo sapiens
gaacctttatgtcta

SEQ ID NO: 110548 - DNA, 15 bp, Homo sapiens
agaacctttatgtct

SEQ ID NO: 110549 - DNA, 15 bp, Homo sapiens
gagaacctttatgtc

SEQ ID NO: 110550 - DNA, 15 bp, Homo sapiens
agagaacctttatgt

SEQ ID NO: 110551 - DNA, 15 bp, Homo sapiens
tagagaacctttatg

SEQ ID NO: 110552 - DNA, 15 bp, Homo sapiens
ttagagaacctttat

SEQ ID NO: 110553 - DNA, 15 bp, Homo sapiens
cttagagaaccttta

SEQ ID NO: 110554 - DNA, 15 bp, Homo sapiens
ccttagagaaccttt

SEQ ID NO: 110555 - DNA, 15 bp, Homo sapiens
gccttagagaacctt

SEQ ID NO: 110556 - DNA, 15 bp, Homo sapiens
ggccttagagaacct

SEQ ID NO: 110557 - DNA, 15 bp, Homo sapiens
gggccttagagaacc

SEQ ID NO: 110558 - DNA, 15 bp, Homo sapiens
ggggccttagagaac

SEQ ID NO: 110559 - DNA, 15 bp, Homo sapiens
tggggccttagagaa

SEQ ID NO: 110560 - DNA, 15 bp, Homo sapiens
gtggggccttagaga

SEQ ID NO: 110561 - DNA, 15 bp, Homo sapiens
ggtggggccttagag

SEQ ID NO: 110562 - DNA, 15 bp, Homo sapiens
tggtggggccttaga

SEQ ID NO: 110563 - DNA, 15 bp, Homo sapiens
ctggtggggccttag

SEQ ID NO: 110564 - DNA, 15 bp, Homo sapiens
tctggtggggcctta

SEQ ID NO: 110565 - DNA, 15 bp, Homo sapiens
atccacactctgtat

SEQ ID NO: 110566 - DNA, 15 bp, Homo sapiens
aatccacactctgta

SEQ ID NO: 110567 - DNA, 15 bp, Homo sapiens
caatccacactctgt

SEQ ID NO: 110568 - DNA, 15 bp, Homo sapiens
ccaatccacactctg

SEQ ID NO: 110569 - DNA, 15 bp, Homo sapiens
accaatccacactct

SEQ ID NO: 110570 - DNA, 15 bp, Homo sapiens
caccaatccacactc

SEQ ID NO: 110571 - DNA, 15 bp, Homo sapiens
gcaccaatccacact

SEQ ID NO: 110572 - DNA, 15 bp, Homo sapiens
tgcaccaatccacac

SEQ ID NO: 110573 - DNA, 15 bp, Homo sapiens
gtgcaccaatccaca

SEQ ID NO: 110574 - DNA, 15 bp, Homo sapiens
agtgcaccaatccac

SEQ ID NO: 110575 - DNA, 15 bp, Homo sapiens
gagtgcaccaatcca

SEQ ID NO: 110576 - DNA, 15 bp, Homo sapiens
tgagtgcaccaatcc

SEQ ID NO: 110577 - DNA, 15 bp, Homo sapiens
gtgagtgcaccaatc

SEQ ID NO: 110578 - DNA, 15 bp, Homo sapiens
tgtgagtgcaccaat

SEQ ID NO: 110579 - DNA, 15 bp, Homo sapiens
ttgtgagtgcaccaa

SEQ ID NO: 110580 - DNA, 15 bp, Homo sapiens
tttgtgagtgcacca

SEQ ID NO: 110581 - DNA, 15 bp, Homo sapiens
gtttgtgagtgcacc

SEQ ID NO: 110582 - DNA, 15 bp, Homo sapiens
ggtttgtgagtgcac

SEQ ID NO: 110583 - DNA, 15 bp, Homo sapiens
gggtttgtgagtgca

SEQ ID NO: 110584 - DNA, 15 bp, Homo sapiens
agggtttgtgagtgc

SEQ ID NO: 110585 - DNA, 15 bp, Homo sapiens
cagggtttgtgagtg

SEQ ID NO: 110586 - DNA, 15 bp, Homo sapiens
tcagggtttgtgagt

SEQ ID NO: 110587 - DNA, 15 bp, Homo sapiens
ctcagggtttgtgag

SEQ ID NO: 110588 - DNA, 15 bp, Homo sapiens
cggcactctgtatct

SEQ ID NO: 110589 - DNA, 15 bp, Homo sapiens
tcggcactctgtatc

SEQ ID NO: 110590 - DNA, 15 bp, Homo sapiens
atcggcactctgtat

SEQ ID NO: 110591 - DNA, 15 bp, Homo sapiens
aatcggcactctgta

SEQ ID NO: 110592 - DNA, 15 bp, Homo sapiens
caatcggcactctgt

SEQ ID NO: 110593 - DNA, 15 bp, Homo sapiens
ccaatcggcactctg

SEQ ID NO: 110594 - DNA, 15 bp, Homo sapiens
accaatcggcactct

SEQ ID NO: 110595 - DNA, 15 bp, Homo sapiens
caccaatcggcactc

SEQ ID NO: 110596 - DNA, 15 bp, Homo sapiens
acaccaatcggcact

SEQ ID NO: 110597 - DNA, 15 bp, Homo sapiens
tacaccaatcggcac

SEQ ID NO: 110598 - DNA, 15 bp, Homo sapiens
atacaccaatcggca

SEQ ID NO: 110599 - DNA, 15 bp, Homo sapiens
aatacaccaatcggc

SEQ ID NO: 110600 - DNA, 15 bp, Homo sapiens
aaatacaccaatcgg

SEQ ID NO: 110601 - DNA, 15 bp, Homo sapiens
taaatacaccaatcg

SEQ ID NO: 110602 - DNA, 15 bp, Homo sapiens
gtaaatacaccaatc

SEQ ID NO: 110603 - DNA, 15 bp, Homo sapiens
cagggattgtaaata

SEQ ID NO: 110604 - DNA, 15 bp, Homo sapiens
tcagggattgtaaat

SEQ ID NO: 110605 - DNA, 15 bp, Homo sapiens
atgtctagctcaggg

SEQ ID NO: 110606 - DNA, 15 bp, Homo sapiens
tatgtctagctcagg

SEQ ID NO: 110607 - DNA, 15 bp, Homo sapiens
ttatgtctagctcag

SEQ ID NO: 110608 - DNA, 15 bp, Homo sapiens
tttatgtctagctca

SEQ ID NO: 110609 - DNA, 15 bp, Homo sapiens
ctttatgtctagctc

SEQ ID NO: 110610 - DNA, 15 bp, Homo sapiens
tctttatgtctagct

SEQ ID NO: 110611 - DNA, 15 bp, Homo sapiens
gtctttatgtctagc

SEQ ID NO: 110612 - DNA, 15 bp, Homo sapiens
agtctttatgtctag

SEQ ID NO: 110613 - DNA, 15 bp, Homo sapiens
gagtctttatgtcta

SEQ ID NO: 110614 - DNA, 15 bp, Homo sapiens
agagtctttatgtct

SEQ ID NO: 110615 - DNA, 15 bp, Homo sapiens
gagagtctttatgtc

SEQ ID NO: 110616 - DNA, 15 bp, Homo sapiens
ggagagtctttatgt

SEQ ID NO: 110617 - DNA, 15 bp, Homo sapiens
tggagagtctttatg

SEQ ID NO: 110618 - DNA, 15 bp, Homo sapiens
gtggagagtctttat

SEQ ID NO: 110619 - DNA, 15 bp, Homo sapiens
cgtggagagtcttta

SEQ ID NO: 110620 - DNA, 15 bp, Homo sapiens
acgtggagagtcttt

SEQ ID NO: 110621 - DNA, 15 bp, Homo sapiens
gacgtggagagtctt

SEQ ID NO: 110622 - DNA, 15 bp, Homo sapiens
ggacgtggagagtct

SEQ ID NO: 110623 - DNA, 15 bp, Homo sapiens
gggacgtggagagtc

SEQ ID NO: 110624 - DNA, 15 bp, Homo sapiens
ggggacgtggagagt

SEQ ID NO: 110625 - DNA, 15 bp, Homo sapiens
tggggacgtggagag

SEQ ID NO: 110626 - DNA, 15 bp, Homo sapiens
gtggggacgtggaga

SEQ ID NO: 110627 - DNA, 15 bp, Homo sapiens
ggtggggacgtggag

SEQ ID NO: 110628 - DNA, 15 bp, Homo sapiens
tggtggggacgtgga

SEQ ID NO: 110629 - DNA, 15 bp, Homo sapiens
ctggtggggacgtgg

SEQ ID NO: 110630 - DNA, 15 bp, Homo sapiens
tctggtggggacgtg

SEQ ID NO: 110631 - DNA, 15 bp, Homo sapiens
gtctggtggggacgt

SEQ ID NO: 110632 - DNA, 15 bp, Homo sapiens
ggtctggtggggacg

SEQ ID NO: 110633 - DNA, 15 bp, Homo sapiens
gggtctggtggggac

SEQ ID NO: 110634 - DNA, 15 bp, Homo sapiens
tgggtctggtgggga

SEQ ID NO: 110635 - DNA, 15 bp, Homo sapiens
ctgggtctggtgggg

SEQ ID NO: 110636 - DNA, 15 bp, Homo sapiens
cctgggtctggtggg

SEQ ID NO: 110637 - DNA, 15 bp, Homo sapiens
tcctgggtctggtgg

SEQ ID NO: 110638 - DNA, 15 bp, Homo sapiens
ctcctgggtctggtg

SEQ ID NO: 110639 - DNA, 15 bp, Homo sapiens
actcctgggtctggt

SEQ ID NO: 110640 - DNA, 15 bp, Homo sapiens
gactcctgggtctgg

SEQ ID NO: 110641 - DNA, 15 bp, Homo sapiens
ggactcctgggtctg

SEQ ID NO: 110642 - DNA, 15 bp, Homo sapiens
tggactcctgggtct

SEQ ID NO: 110643 - DNA, 15 bp, Homo sapiens
ctggactcctgggtc

SEQ ID NO: 110644 - DNA, 15 bp, Homo sapiens
gctggactcctgggt

SEQ ID NO: 110645 - DNA, 15 bp, Homo sapiens
agctggactcctggg

SEQ ID NO: 110646 - DNA, 15 bp, Homo sapiens
cagctggactcctgg

SEQ ID NO: 110647 - DNA, 15 bp, Homo sapiens
ccagctggactcctg

SEQ ID NO: 110648 - DNA, 15 bp, Homo sapiens
gccagctggactcct

SEQ ID NO: 110649 - DNA, 15 bp, Homo sapiens
agccagctggactcc

SEQ ID NO: 110650 - DNA, 15 bp, Homo sapiens
aagccagctggactc

SEQ ID NO: 110651 - DNA, 15 bp, Homo sapiens
gaagccagctggact

SEQ ID NO: 110652 - DNA, 15 bp, Homo sapiens
tgaagccagctggac

SEQ ID NO: 110653 - DNA, 15 bp, Homo sapiens
gtgaagccagctgga

SEQ ID NO: 110654 - DNA, 15 bp, Homo sapiens
ggtgaagccagctgg

SEQ ID NO: 110655 - DNA, 15 bp, Homo sapiens
gggtgaagccagctg

SEQ ID NO: 110656 - DNA, 15 bp, Homo sapiens
tgggtgaagccagct

SEQ ID NO: 110657 - DNA, 15 bp, Homo sapiens
ctgggtgaagccagc

SEQ ID NO: 110658 - DNA, 15 bp, Homo sapiens
actgggtgaagccag

SEQ ID NO: 110659 - DNA, 15 bp, Homo sapiens
cactgggtgaagcca

SEQ ID NO: 110660 - DNA, 15 bp, Homo sapiens
ccactgggtgaagcc

SEQ ID NO: 110661 - DNA, 15 bp, Homo sapiens
tccactgggtgaagc

SEQ ID NO: 110662 - DNA, 15 bp, Homo sapiens
atccactgggtgaag

SEQ ID NO: 110663 - DNA, 15 bp, Homo sapiens
gatccactgggtgaa

SEQ ID NO: 110664 - DNA, 15 bp, Homo sapiens
ggatccactgggtga

SEQ ID NO: 110665 - DNA, 15 bp, Homo sapiens
gggatccactgggtg

SEQ ID NO: 110666 - DNA, 15 bp, Homo sapiens
cgggatccactgggt

SEQ ID NO: 110667 - DNA, 15 bp, Homo sapiens
gcgggatccactggg

SEQ ID NO: 110668 - DNA, 15 bp, Homo sapiens
tgcgggatccactgg

SEQ ID NO: 110669 - DNA, 15 bp, Homo sapiens
gtgcgggatccactg

SEQ ID NO: 110670 - DNA, 15 bp, Homo sapiens
ggtgcgggatccact

SEQ ID NO: 110671 - DNA, 15 bp, Homo sapiens
gggtgcgggatccac

SEQ ID NO: 110672 - DNA, 15 bp, Homo sapiens
cgggtgcgggatcca

SEQ ID NO: 110673 - DNA, 15 bp, Homo sapiens
ccgggtgcgggatcc

SEQ ID NO: 110674 - DNA, 15 bp, Homo sapiens
cccgggtgcgggatc

SEQ ID NO: 110675 - DNA, 15 bp, Homo sapiens
gcccgggtgcgggat

SEQ ID NO: 110676 - DNA, 15 bp, Homo sapiens
agcccgggtgcggga

SEQ ID NO: 110677 - DNA, 15 bp, Homo sapiens
cagcccgggtgcggg

SEQ ID NO: 110678 - DNA, 15 bp, Homo sapiens
gcagcccgggtgcgg

SEQ ID NO: 110679 - DNA, 15 bp, Homo sapiens
tgcagcccgggtgcg

SEQ ID NO: 110680 - DNA, 15 bp, Homo sapiens
ctgcagcccgggtgc

SEQ ID NO: 110681 - DNA, 15 bp, Homo sapiens
cctgcagcccgggtg

SEQ ID NO: 110682 - DNA, 15 bp, Homo sapiens
acctgcagcccgggt

SEQ ID NO: 110683 - DNA, 15 bp, Homo sapiens
cacctgcagcccggg

SEQ ID NO: 110684 - DNA, 15 bp, Homo sapiens
ccacctgcagcccgg

SEQ ID NO: 110685 - DNA, 15 bp, Homo sapiens
tccacctgcagcccg

SEQ ID NO: 110686 - DNA, 15 bp, Homo sapiens
ctccacctgcagccc

SEQ ID NO: 110687 - DNA, 15 bp, Homo sapiens
gctccacctgcagcc

SEQ ID NO: 110688 - DNA, 15 bp, Homo sapiens
agctccacctgcagc

SEQ ID NO: 110689 - DNA, 15 bp, Homo sapiens
cagctccacctgcag

SEQ ID NO: 110690 - DNA, 15 bp, Homo sapiens
gcagctccacctgca

SEQ ID NO: 110691 - DNA, 15 bp, Homo sapiens
ggcagctccacctgc

SEQ ID NO: 110692 - DNA, 15 bp, Homo sapiens
aggcagctccacctg

SEQ ID NO: 110693 - DNA, 15 bp, Homo sapiens
aaggcagctccacct

SEQ ID NO: 110694 - DNA, 15 bp, Homo sapiens
gaaggcagctccacc

SEQ ID NO: 110695 - DNA, 15 bp, Homo sapiens
ggaaggcagctccac

SEQ ID NO: 110696 - DNA, 15 bp, Homo sapiens
tggaaggcagctcca

SEQ ID NO: 110697 - DNA, 15 bp, Homo sapiens
ctggaaggcagctcc

SEQ ID NO: 110698 - DNA, 15 bp, Homo sapiens
actggaaggcagctc

SEQ ID NO: 110699 - DNA, 15 bp, Homo sapiens
gactggaaggcagct

SEQ ID NO: 110700 - DNA, 15 bp, Homo sapiens
ggactggaaggcagc

SEQ ID NO: 110701 - DNA, 15 bp, Homo sapiens
gggactggaaggcag

SEQ ID NO: 110702 - DNA, 15 bp, Homo sapiens
cgggactggaaggca

SEQ ID NO: 110703 - DNA, 15 bp, Homo sapiens
gcgggactggaaggc

SEQ ID NO: 110704 - DNA, 15 bp, Homo sapiens
tgcgggactggaagg

SEQ ID NO: 110705 - DNA, 15 bp, Homo sapiens
gtgcgggactggaag

SEQ ID NO: 110706 - DNA, 15 bp, Homo sapiens
ggtgcgggactggaa

SEQ ID NO: 110707 - DNA, 15 bp, Homo sapiens
cggtgcgggactgga

SEQ ID NO: 110708 - DNA, 15 bp, Homo sapiens
acggtgcgggactgg

SEQ ID NO: 110709 - DNA, 15 bp, Homo sapiens
cacggtgcgggactg

SEQ ID NO: 110710 - DNA, 15 bp, Homo sapiens
ccacggtgcgggact

SEQ ID NO: 110711 - DNA, 15 bp, Homo sapiens
cccacggtgcgggac

SEQ ID NO: 110712 - DNA, 15 bp, Homo sapiens
gcccacggtgcggga

SEQ ID NO: 110713 - DNA, 15 bp, Homo sapiens
agcccacggtgcggg

SEQ ID NO: 110714 - DNA, 15 bp, Homo sapiens
aagcccacggtgcgg

SEQ ID NO: 110715 - DNA, 15 bp, Homo sapiens
caagcccacggtgcg

SEQ ID NO: 110716 - DNA, 15 bp, Homo sapiens
gcaagcccacggtgc

SEQ ID NO: 110717 - DNA, 15 bp, Homo sapiens
tgcaagcccacggtg

SEQ ID NO: 110718 - DNA, 15 bp, Homo sapiens
gtgcaagcccacggt

SEQ ID NO: 110719 - DNA, 15 bp, Homo sapiens
agtgcaagcccacgg

SEQ ID NO: 110720 - DNA, 15 bp, Homo sapiens
gagtgcaagcccacg

SEQ ID NO: 110721 - DNA, 15 bp, Homo sapiens
ggagtgcaagcccac

SEQ ID NO: 110722 - DNA, 15 bp, Homo sapiens
aggagtgcaagccca

SEQ ID NO: 110723 - DNA, 15 bp, Homo sapiens
gaggagtgcaagccc

SEQ ID NO: 110724 - DNA, 15 bp, Homo sapiens
tgaggagtgcaagcc

SEQ ID NO: 110725 - DNA, 15 bp, Homo sapiens
ctgaggagtgcaagc

SEQ ID NO: 110726 - DNA, 15 bp, Homo sapiens
gctgaggagtgcaag

SEQ ID NO: 110727 - DNA, 15 bp, Homo sapiens
ggctgaggagtgcaa

SEQ ID NO: 110728 - DNA, 15 bp, Homo sapiens
gggctgaggagtgca

SEQ ID NO: 110729 - DNA, 15 bp, Homo sapiens
agggctgaggagtgc

SEQ ID NO: 110730 - DNA, 15 bp, Homo sapiens
aagggctgaggagtg

SEQ ID NO: 110731 - DNA, 15 bp, Homo sapiens
caagggctgaggagt

SEQ ID NO: 110732 - DNA, 15 bp, Homo sapiens
ccaagggctgaggag

SEQ ID NO: 110733 - DNA, 15 bp, Homo sapiens
cccaagggctgagga

SEQ ID NO: 110734 - DNA, 15 bp, Homo sapiens
acccaagggctgagg

SEQ ID NO: 110735 - DNA, 15 bp, Homo sapiens
cacccaagggctgag

SEQ ID NO: 110736 - DNA, 15 bp, Homo sapiens
ccacccaagggctga

SEQ ID NO: 110737 - DNA, 15 bp, Homo sapiens
accacccaagggctg

SEQ ID NO: 110738 - DNA, 15 bp, Homo sapiens
gaccacccaagggct

SEQ ID NO: 110739 - DNA, 15 bp, Homo sapiens
tgaccacccaagggc

SEQ ID NO: 110740 - DNA, 15 bp, Homo sapiens
ttgaccacccaaggg

SEQ ID NO: 110741 - DNA, 15 bp, Homo sapiens
attgaccacccaagg

SEQ ID NO: 110742 - DNA, 15 bp, Homo sapiens
cattgaccacccaag

SEQ ID NO: 110743 - DNA, 15 bp, Homo sapiens
ccattgaccacccaa

SEQ ID NO: 110744 - DNA, 15 bp, Homo sapiens
cccattgaccaccca

SEQ ID NO: 110745 - DNA, 15 bp, Homo sapiens
tcccattgaccaccc

SEQ ID NO: 110746 - DNA, 15 bp, Homo sapiens
ctcccattgaccacc

SEQ ID NO: 110747 - DNA, 15 bp, Homo sapiens
actcccattgaccac

SEQ ID NO: 110748 - DNA, 15 bp, Homo sapiens
cactcccattgacca

SEQ ID NO: 110749 - DNA, 15 bp, Homo sapiens
ccactcccattgacc

SEQ ID NO: 110750 - DNA, 15 bp, Homo sapiens
cccactcccattgac

SEQ ID NO: 110751 - DNA, 15 bp, Homo sapiens
gcccactcccattga

SEQ ID NO: 110752 - DNA, 15 bp, Homo sapiens
cgcccactcccattg

SEQ ID NO: 110753 - DNA, 15 bp, Homo sapiens
gcgcccactcccatt

SEQ ID NO: 110754 - DNA, 15 bp, Homo sapiens
ggcgcccactcccat

SEQ ID NO: 110755 - DNA, 15 bp, Homo sapiens
cggcgcccactccca

SEQ ID NO: 110756 - DNA, 15 bp, Homo sapiens
acggcgcccactccc

SEQ ID NO: 110757 - DNA, 15 bp, Homo sapiens
cacggcgcccactcc

SEQ ID NO: 110758 - DNA, 15 bp, Homo sapiens
ccacggcgcccactc

SEQ ID NO: 110759 - DNA, 15 bp, Homo sapiens
tccacggcgcccact

SEQ ID NO: 110760 - DNA, 15 bp, Homo sapiens
ctccacggcgcccac

SEQ ID NO: 110761 - DNA, 15 bp, Homo sapiens
gctccacggcgccca

SEQ ID NO: 110762 - DNA, 15 bp, Homo sapiens
tgctccacggcgccc

SEQ ID NO: 110763 - DNA, 15 bp, Homo sapiens
ctgctccacggcgcc

SEQ ID NO: 110764 - DNA, 15 bp, Homo sapiens
cctgctccacggcgc

SEQ ID NO: 110765 - DNA, 15 bp, Homo sapiens
ccctgctccacggcg

SEQ ID NO: 110766 - DNA, 15 bp, Homo sapiens
cccctgctccacggc

SEQ ID NO: 110767 - DNA, 15 bp, Homo sapiens
ccccctgctccacgg

SEQ ID NO: 110768 - DNA, 15 bp, Homo sapiens
accccctgctccacg

SEQ ID NO: 110769 - DNA, 15 bp, Homo sapiens
caccccctgctccac

SEQ ID NO: 110770 - DNA, 15 bp, Homo sapiens
ccaccccctgctcca

SEQ ID NO: 110771 - DNA, 15 bp, Homo sapiens
gccaccccctgctcc

SEQ ID NO: 110772 - DNA, 15 bp, Homo sapiens
tgccaccccctgctc

SEQ ID NO: 110773 - DNA, 15 bp, Homo sapiens
gtgccaccccctgct

SEQ ID NO: 110774 - DNA, 15 bp, Homo sapiens
agtgccaccccctgc

SEQ ID NO: 110775 - DNA, 15 bp, Homo sapiens
gagtgccaccccctg

SEQ ID NO: 110776 - DNA, 15 bp, Homo sapiens
tgagtgccaccccct

SEQ ID NO: 110777 - DNA, 15 bp, Homo sapiens
atgagtgccaccccc

SEQ ID NO: 110778 - DNA, 15 bp, Homo sapiens
gatgagtgccacccc

SEQ ID NO: 110779 - DNA, 15 bp, Homo sapiens
tgatgagtgccaccc

SEQ ID NO: 110780 - DNA, 15 bp, Homo sapiens
ctgatgagtgccacc

SEQ ID NO: 110781 - DNA, 15 bp, Homo sapiens
cctgatgagtgccac

SEQ ID NO: 110782 - DNA, 15 bp, Homo sapiens
ccctgatgagtgcca

SEQ ID NO: 110783 - DNA, 15 bp, Homo sapiens
tccctgatgagtgcc

SEQ ID NO: 110784 - DNA, 15 bp, Homo sapiens
ctccctgatgagtgc

SEQ ID NO: 110785 - DNA, 15 bp, Homo sapiens
cctccctgatgagtg

SEQ ID NO: 110786 - DNA, 15 bp, Homo sapiens
gcctccctgatgagt

SEQ ID NO: 110787 - DNA, 15 bp, Homo sapiens
agcctccctgatgag

SEQ ID NO: 110788 - DNA, 15 bp, Homo sapiens
gagcctccctgatga

SEQ ID NO: 110789 - DNA, 15 bp, Homo sapiens
ggagcctccctgatg

SEQ ID NO: 110790 - DNA, 15 bp, Homo sapiens
cggagcctccctgat

SEQ ID NO: 110791 - DNA, 15 bp, Homo sapiens
ccggagcctccctga

SEQ ID NO: 110792 - DNA, 15 bp, Homo sapiens
gccggagcctccctg

SEQ ID NO: 110793 - DNA, 15 bp, Homo sapiens
ggccggagcctccct

SEQ ID NO: 110794 - DNA, 15 bp, Homo sapiens
cggccggagcctccc

SEQ ID NO: 110795 - DNA, 15 bp, Homo sapiens
gcggccggagcctcc

SEQ ID NO: 110796 - DNA, 15 bp, Homo sapiens
tgcggccggagcctc

SEQ ID NO: 110797 - DNA, 15 bp, Homo sapiens
gtgcggccggagcct

SEQ ID NO: 110798 - DNA, 15 bp, Homo sapiens
tgtgcggccggagcc

SEQ ID NO: 110799 - DNA, 15 bp, Homo sapiens
ctgtgcggccggagc

SEQ ID NO: 110800 - DNA, 15 bp, Homo sapiens
cctgtgcggccggag

SEQ ID NO: 110801 - DNA, 15 bp, Homo sapiens
tcctgtgcggccgga

SEQ ID NO: 110802 - DNA, 15 bp, Homo sapiens
ctcctgtgcggccgg

SEQ ID NO: 110803 - DNA, 15 bp, Homo sapiens
gctcctgtgcggccg

SEQ ID NO: 110804 - DNA, 15 bp, Homo sapiens
ggctcctgtgcggcc

SEQ ID NO: 110805 - DNA, 15 bp, Homo sapiens
gggctcctgtgcggc

SEQ ID NO: 110806 - DNA, 15 bp, Homo sapiens
tgggctcctgtgcgg

SEQ ID NO: 110807 - DNA, 15 bp, Homo sapiens
atgggctcctgtgcg

SEQ ID NO: 110808 - DNA, 15 bp, Homo sapiens
catgggctcctgtgc

SEQ ID NO: 110809 - DNA, 15 bp, Homo sapiens
ccatgggctcctgtg

SEQ ID NO: 110810 - DNA, 15 bp, Homo sapiens
tccatgggctcctgt

SEQ ID NO: 110811 - DNA, 15 bp, Homo sapiens
ctccatgggctcctg

SEQ ID NO: 110812 - DNA, 15 bp, Homo sapiens
cctccatgggctcct

SEQ ID NO: 110813 - DNA, 15 bp, Homo sapiens
ccctccatgggctcc

SEQ ID NO: 110814 - DNA, 15 bp, Homo sapiens
cccctccatgggctc

SEQ ID NO: 110815 - DNA, 15 bp, Homo sapiens
ccccctccatgggct

SEQ ID NO: 110816 - DNA, 15 bp, Homo sapiens
accccctccatgggc

SEQ ID NO: 110817 - DNA, 15 bp, Homo sapiens
caccccctccatggg

SEQ ID NO: 110818 - DNA, 15 bp, Homo sapiens
ccaccccctccatgg

SEQ ID NO: 110819 - DNA, 15 bp, Homo sapiens
cccaccccctccatg

SEQ ID NO: 110820 - DNA, 15 bp, Homo sapiens
tcccaccccctccat

SEQ ID NO: 110821 - DNA, 15 bp, Homo sapiens
ctcccaccccctcca

SEQ ID NO: 110822 - DNA, 15 bp, Homo sapiens
cctcccaccccctcc

SEQ ID NO: 110823 - DNA, 15 bp, Homo sapiens
gcctcccaccccctc

SEQ ID NO: 110824 - DNA, 15 bp, Homo sapiens
agcctcccaccccct

SEQ ID NO: 110825 - DNA, 15 bp, Homo sapiens
gagcctcccaccccc

SEQ ID NO: 110826 - DNA, 15 bp, Homo sapiens
tgagcctcccacccc

SEQ ID NO: 110827 - DNA, 15 bp, Homo sapiens
ctgagcctcccaccc

SEQ ID NO: 110828 - DNA, 15 bp, Homo sapiens
cctgagcctcccacc

SEQ ID NO: 110829 - DNA, 15 bp, Homo sapiens
tcctgagcctcccac

SEQ ID NO: 110830 - DNA, 15 bp, Homo sapiens
ttcctgagcctccca

SEQ ID NO: 110831 - DNA, 15 bp, Homo sapiens
attcctgagcctccc

SEQ ID NO: 110832 - DNA, 15 bp, Homo sapiens
cattcctgagcctcc

SEQ ID NO: 110833 - DNA, 15 bp, Homo sapiens
ccattcctgagcctc

SEQ ID NO: 110834 - DNA, 15 bp, Homo sapiens
gccattcctgagcct

SEQ ID NO: 110835 - DNA, 15 bp, Homo sapiens
cgccattcctgagcc

SEQ ID NO: 110836 - DNA, 15 bp, Homo sapiens
ccgccattcctgagc

SEQ ID NO: 110837 - DNA, 15 bp, Homo sapiens
cccgccattcctgag

SEQ ID NO: 110838 - DNA, 15 bp, Homo sapiens
gcccgccattcctga

SEQ ID NO: 110839 - DNA, 15 bp, Homo sapiens
agcccgccattcctg

SEQ ID NO: 110840 - DNA, 15 bp, Homo sapiens
cagcccgccattcct

SEQ ID NO: 110841 - DNA, 15 bp, Homo sapiens
gcagcccgccattcc

SEQ ID NO: 110842 - DNA, 15 bp, Homo sapiens
tgcagcccgccattc

SEQ ID NO: 110843 - DNA, 15 bp, Homo sapiens
ctgcagcccgccatt

SEQ ID NO: 110844 - DNA, 15 bp, Homo sapiens
cctgcagcccgccat

SEQ ID NO: 110845 - DNA, 15 bp, Homo sapiens
acctgcagcccgcca

SEQ ID NO: 110846 - DNA, 15 bp, Homo sapiens
gacctgcagcccgcc

SEQ ID NO: 110847 - DNA, 15 bp, Homo sapiens
ggacctgcagcccgc

SEQ ID NO: 110848 - DNA, 15 bp, Homo sapiens
gggacctgcagcccg

SEQ ID NO: 110849 - DNA, 15 bp, Homo sapiens
cgggacctgcagccc

SEQ ID NO: 110850 - DNA, 15 bp, Homo sapiens
tcgggacctgcagcc

SEQ ID NO: 110851 - DNA, 15 bp, Homo sapiens
ctcgggacctgcagc

SEQ ID NO: 110852 - DNA, 15 bp, Homo sapiens
gctcgggacctgcag

SEQ ID NO: 110853 - DNA, 15 bp, Homo sapiens
ggctcgggacctgca

SEQ ID NO: 110854 - DNA, 15 bp, Homo sapiens
gggctcgggacctgc

SEQ ID NO: 110855 - DNA, 15 bp, Homo sapiens
agggctcgggacctg

SEQ ID NO: 110856 - DNA, 15 bp, Homo sapiens
cagggctcgggacct

SEQ ID NO: 110857 - DNA, 15 bp, Homo sapiens
gcagggctcgggacc

SEQ ID NO: 110858 - DNA, 15 bp, Homo sapiens
ggcagggctcgggac

SEQ ID NO: 110859 - DNA, 15 bp, Homo sapiens
gggcagggctcggga

SEQ ID NO: 110860 - DNA, 15 bp, Homo sapiens
ggggcagggctcggg

SEQ ID NO: 110861 - DNA, 15 bp, Homo sapiens
cggggcagggctcgg

SEQ ID NO: 110862 - DNA, 15 bp, Homo sapiens
gcggggcagggctcg

SEQ ID NO: 110863 - DNA, 15 bp, Homo sapiens
tgcggggcagggctc

SEQ ID NO: 110864 - DNA, 15 bp, Homo sapiens
ctgcggggcagggct

SEQ ID NO: 110865 - DNA, 15 bp, Homo sapiens
cctgcggggcagggc

SEQ ID NO: 110866 - DNA, 15 bp, Homo sapiens
tcctgcggggcaggg

SEQ ID NO: 110867 - DNA, 15 bp, Homo sapiens
ttcctgcggggcagg

SEQ ID NO: 110868 - DNA, 15 bp, Homo sapiens
cttcctgcggggcag

SEQ ID NO: 110869 - DNA, 15 bp, Homo sapiens
ccttcctgcggggca

SEQ ID NO: 110870 - DNA, 15 bp, Homo sapiens
gccttcctgcggggc

SEQ ID NO: 110871 - DNA, 15 bp, Homo sapiens
tgccttcctgcgggg

SEQ ID NO: 110872 - DNA, 15 bp, Homo sapiens
ctgccttcctgcggg

SEQ ID NO: 110873 - DNA, 15 bp, Homo sapiens
gctgccttcctgcgg

SEQ ID NO: 110874 - DNA, 15 bp, Homo sapiens
agctgccttcctgcg

SEQ ID NO: 110875 - DNA, 15 bp, Homo sapiens
tagctgccttcctgc

SEQ ID NO: 110876 - DNA, 15 bp, Homo sapiens
ttagctgccttcctg

SEQ ID NO: 110877 - DNA, 15 bp, Homo sapiens
cttagctgccttcct

SEQ ID NO: 110878 - DNA, 15 bp, Homo sapiens
ccttagctgccttcc

SEQ ID NO: 110879 - DNA, 15 bp, Homo sapiens
gccttagctgccttc

SEQ ID NO: 110880 - DNA, 15 bp, Homo sapiens
ggccttagctgcctt

SEQ ID NO: 110881 - DNA, 15 bp, Homo sapiens
gggccttagctgcct

SEQ ID NO: 110882 - DNA, 15 bp, Homo sapiens
cgggccttagctgcc

SEQ ID NO: 110883 - DNA, 15 bp, Homo sapiens
ccgggccttagctgc

SEQ ID NO: 110884 - DNA, 15 bp, Homo sapiens
accgggccttagctg

SEQ ID NO: 110885 - DNA, 15 bp, Homo sapiens
caccgggccttagct

SEQ ID NO: 110886 - DNA, 15 bp, Homo sapiens
tcaccgggccttagc

SEQ ID NO: 110887 - DNA, 15 bp, Homo sapiens
ctcaccgggccttag

SEQ ID NO: 110888 - DNA, 15 bp, Homo sapiens
tctcaccgggcctta

SEQ ID NO: 110889 - DNA, 15 bp, Homo sapiens
ttctcaccgggcctt

SEQ ID NO: 110890 - DNA, 15 bp, Homo sapiens
tttctcaccgggcct

SEQ ID NO: 110891 - DNA, 15 bp, Homo sapiens
atttctcaccgggcc

SEQ ID NO: 110892 - DNA, 15 bp, Homo sapiens
aatttctcaccgggc

SEQ ID NO: 110893 - DNA, 15 bp, Homo sapiens
caatttctcaccggg

SEQ ID NO: 110894 - DNA, 15 bp, Homo sapiens
tcaatttctcaccgg

SEQ ID NO: 110895 - DNA, 15 bp, Homo sapiens
ctcaatttctcaccg

SEQ ID NO: 110896 - DNA, 15 bp, Homo sapiens
gctcaatttctcacc

SEQ ID NO: 110897 - DNA, 15 bp, Homo sapiens
cgctcaatttctcac

SEQ ID NO: 110898 - DNA, 15 bp, Homo sapiens
gcgctcaatttctca

SEQ ID NO: 110899 - DNA, 15 bp, Homo sapiens
tgcgctcaatttctc

SEQ ID NO: 110900 - DNA, 15 bp, Homo sapiens
ctgcgctcaatttct

SEQ ID NO: 110901 - DNA, 15 bp, Homo sapiens
gctgcgctcaatttc

SEQ ID NO: 110902 - DNA, 15 bp, Homo sapiens
cgctgcgctcaattt

SEQ ID NO: 110903 - DNA, 15 bp, Homo sapiens
gcgctgcgctcaatt

SEQ ID NO: 110904 - DNA, 15 bp, Homo sapiens
ggcgctgcgctcaat

SEQ ID NO: 110905 - DNA, 15 bp, Homo sapiens
cggcgctgcgctcaa

SEQ ID NO: 110906 - DNA, 15 bp, Homo sapiens
ccggcgctgcgctca

SEQ ID NO: 110907 - DNA, 15 bp, Homo sapiens
accggcgctgcgctc

SEQ ID NO: 110908 - DNA, 15 bp, Homo sapiens
caccggcgctgcgct

SEQ ID NO: 110909 - DNA, 15 bp, Homo sapiens
ccaccggcgctgcgc

SEQ ID NO: 110910 - DNA, 15 bp, Homo sapiens
cccaccggcgctgcg

SEQ ID NO: 110911 - DNA, 15 bp, Homo sapiens
gcccaccggcgctgc

SEQ ID NO: 110912 - DNA, 15 bp, Homo sapiens
agcccaccggcgctg

SEQ ID NO: 110913 - DNA, 15 bp, Homo sapiens
cagcccaccggcgct

SEQ ID NO: 110914 - DNA, 15 bp, Homo sapiens
ccagcccaccggcgc

SEQ ID NO: 110915 - DNA, 15 bp, Homo sapiens
gccagcccaccggcg

SEQ ID NO: 110916 - DNA, 15 bp, Homo sapiens
tgccagcccaccggc

SEQ ID NO: 110917 - DNA, 15 bp, Homo sapiens
gtgccagcccaccgg

SEQ ID NO: 110918 - DNA, 15 bp, Homo sapiens
agtgccagcccaccg

SEQ ID NO: 110919 - DNA, 15 bp, Homo sapiens
cagtgccagcccacc

SEQ ID NO: 110920 - DNA, 15 bp, Homo sapiens
gcagtgccagcccac

SEQ ID NO: 110921 - DNA, 15 bp, Homo sapiens
agcagtgccagccca

SEQ ID NO: 110922 - DNA, 15 bp, Homo sapiens
cagcagtgccagccc

SEQ ID NO: 110923 - DNA, 15 bp, Homo sapiens
ccagcagtgccagcc

SEQ ID NO: 110924 - DNA, 15 bp, Homo sapiens
cccagcagtgccagc

SEQ ID NO: 110925 - DNA, 15 bp, Homo sapiens
ccccagcagtgccag

SEQ ID NO: 110926 - DNA, 15 bp, Homo sapiens
cccccagcagtgcca

SEQ ID NO: 110927 - DNA, 15 bp, Homo sapiens
tcccccagcagtgcc

SEQ ID NO: 110928 - DNA, 15 bp, Homo sapiens
gtcccccagcagtgc

SEQ ID NO: 110929 - DNA, 15 bp, Homo sapiens
ggtcccccagcagtg

SEQ ID NO: 110930 - DNA, 15 bp, Homo sapiens
gggtcccccagcagt

SEQ ID NO: 110931 - DNA, 15 bp, Homo sapiens
tgggtcccccagcag

SEQ ID NO: 110932 - DNA, 15 bp, Homo sapiens
ctgggtcccccagca

SEQ ID NO: 110933 - DNA, 15 bp, Homo sapiens
actgggtcccccagc

SEQ ID NO: 110934 - DNA, 15 bp, Homo sapiens
tactgggtcccccag

SEQ ID NO: 110935 - DNA, 15 bp, Homo sapiens
gtactgggtccccca

SEQ ID NO: 110936 - DNA, 15 bp, Homo sapiens
tgtactgggtccccc

SEQ ID NO: 110937 - DNA, 15 bp, Homo sapiens
gtgtactgggtcccc

SEQ ID NO: 110938 - DNA, 15 bp, Homo sapiens
ggtgtactgggtccc

SEQ ID NO: 110939 - DNA, 15 bp, Homo sapiens
gggtgtactgggtcc

SEQ ID NO: 110940 - DNA, 15 bp, Homo sapiens
agggtgtactgggtc

SEQ ID NO: 110941 - DNA, 15 bp, Homo sapiens
gagggtgtactgggt

SEQ ID NO: 110942 - DNA, 15 bp, Homo sapiens
ggagggtgtactggg

SEQ ID NO: 110943 - DNA, 15 bp, Homo sapiens
tggagggtgtactgg

SEQ ID NO: 110944 - DNA, 15 bp, Homo sapiens
gtggagggtgtactg

SEQ ID NO: 110945 - DNA, 15 bp, Homo sapiens
tgtggagggtgtact

SEQ ID NO: 110946 - DNA, 15 bp, Homo sapiens
ctgtggagggtgtac

SEQ ID NO: 110947 - DNA, 15 bp, Homo sapiens
gctgtggagggtgta

SEQ ID NO: 110948 - DNA, 15 bp, Homo sapiens
ggctgtggagggtgt

SEQ ID NO: 110949 - DNA, 15 bp, Homo sapiens
cggctgtggagggtg

SEQ ID NO: 110950 - DNA, 15 bp, Homo sapiens
gcggctgtggagggt

SEQ ID NO: 110951 - DNA, 15 bp, Homo sapiens
agcggctgtggaggg

SEQ ID NO: 110952 - DNA, 15 bp, Homo sapiens
cagcggctgtggagg

SEQ ID NO: 110953 - DNA, 15 bp, Homo sapiens
ccagcggctgtggag

SEQ ID NO: 110954 - DNA, 15 bp, Homo sapiens
gccagcggctgtgga

SEQ ID NO: 110955 - DNA, 15 bp, Homo sapiens
ggccagcggctgtgg

SEQ ID NO: 110956 - DNA, 15 bp, Homo sapiens
gggccagcggctgtg

SEQ ID NO: 110957 - DNA, 15 bp, Homo sapiens
cgggccagcggctgt

SEQ ID NO: 110958 - DNA, 15 bp, Homo sapiens
ccgggccagcggctg

SEQ ID NO: 110959 - DNA, 15 bp, Homo sapiens
accgggccagcggct

SEQ ID NO: 110960 - DNA, 15 bp, Homo sapiens
caccgggccagcggc

SEQ ID NO: 110961 - DNA, 15 bp, Homo sapiens
gcaccgggccagcgg

SEQ ID NO: 110962 - DNA, 15 bp, Homo sapiens
agcaccgggccagcg

SEQ ID NO: 110963 - DNA, 15 bp, Homo sapiens
tagcaccgggccagc

SEQ ID NO: 110964 - DNA, 15 bp, Homo sapiens
ttagcaccgggccag

SEQ ID NO: 110965 - DNA, 15 bp, Homo sapiens
cttagcaccgggcca

SEQ ID NO: 110966 - DNA, 15 bp, Homo sapiens
acttagcaccgggcc

SEQ ID NO: 110967 - DNA, 15 bp, Homo sapiens
gacttagcaccgggc

SEQ ID NO: 110968 - DNA, 15 bp, Homo sapiens
ggacttagcaccggg

SEQ ID NO: 110969 - DNA, 15 bp, Homo sapiens
gggacttagcaccgg

SEQ ID NO: 110970 - DNA, 15 bp, Homo sapiens
agggacttagcaccg

SEQ ID NO: 110971 - DNA, 15 bp, Homo sapiens
gagggacttagcacc

SEQ ID NO: 110972 - DNA, 15 bp, Homo sapiens
tgagggacttagcac

SEQ ID NO: 110973 - DNA, 15 bp, Homo sapiens
atgagggacttagca

SEQ ID NO: 110974 - DNA, 15 bp, Homo sapiens
aatgagggacttagc

SEQ ID NO: 110975 - DNA, 15 bp, Homo sapiens
caatgagggacttag

SEQ ID NO: 110976 - DNA, 15 bp, Homo sapiens
gcaatgagggactta

SEQ ID NO: 110977 - DNA, 15 bp, Homo sapiens
ggcaatgagggactt

SEQ ID NO: 110978 - DNA, 15 bp, Homo sapiens
aggcaatgagggact

SEQ ID NO: 110979 - DNA, 15 bp, Homo sapiens
caggcaatgagggac

SEQ ID NO: 110980 - DNA, 15 bp, Homo sapiens
ccaggcaatgaggga

SEQ ID NO: 110981 - DNA, 15 bp, Homo sapiens
cccaggcaatgaggg

SEQ ID NO: 110982 - DNA, 15 bp, Homo sapiens
ccccaggcaatgagg

SEQ ID NO: 110983 - DNA, 15 bp, Homo sapiens
gccccaggcaatgag

SEQ ID NO: 110984 - DNA, 15 bp, Homo sapiens
ggccccaggcaatga

SEQ ID NO: 110985 - DNA, 15 bp, Homo sapiens
cggccccaggcaatg

SEQ ID NO: 110986 - DNA, 15 bp, Homo sapiens
ccggccccaggcaat

SEQ ID NO: 110987 - DNA, 15 bp, Homo sapiens
gccggccccaggcaa

SEQ ID NO: 110988 - DNA, 15 bp, Homo sapiens
tgccggccccaggca

SEQ ID NO: 110989 - DNA, 15 bp, Homo sapiens
ctgccggccccaggc

SEQ ID NO: 110990 - DNA, 15 bp, Homo sapiens
cctgccggccccagg

SEQ ID NO: 110991 - DNA, 15 bp, Homo sapiens
ccctgccggccccag

SEQ ID NO: 110992 - DNA, 15 bp, Homo sapiens
gccctgccggcccca

SEQ ID NO: 110993 - DNA, 15 bp, Homo sapiens
ggccctgccggcccc

SEQ ID NO: 110994 - DNA, 15 bp, Homo sapiens
tggccctgccggccc

SEQ ID NO: 110995 - DNA, 15 bp, Homo sapiens
ctggccctgccggcc

SEQ ID NO: 110996 - DNA, 15 bp, Homo sapiens
gctggccctgccggc

SEQ ID NO: 110997 - DNA, 15 bp, Homo sapiens
ggctggccctgccgg

SEQ ID NO: 110998 - DNA, 15 bp, Homo sapiens
aggctggccctgccg

SEQ ID NO: 110999 - DNA, 15 bp, Homo sapiens
caggctggccctgcc

SEQ ID NO: 111000 - DNA, 15 bp, Homo sapiens
gcaggctggccctgc

SEQ ID NO: 111001 - DNA, 15 bp, Homo sapiens
agcaggctggccctg

SEQ ID NO: 111002 - DNA, 15 bp, Homo sapiens
cagcaggctggccct

SEQ ID NO: 111003 - DNA, 15 bp, Homo sapiens
gcagcaggctggccc

SEQ ID NO: 111004 - DNA, 15 bp, Homo sapiens
agcagcaggctggcc

SEQ ID NO: 111005 - DNA, 15 bp, Homo sapiens
gagcagcaggctggc

SEQ ID NO: 111006 - DNA, 15 bp, Homo sapiens
ggagcagcaggctgg

SEQ ID NO: 111007 - DNA, 15 bp, Homo sapiens
cggagcagcaggctg

SEQ ID NO: 111008 - DNA, 15 bp, Homo sapiens
tcggagcagcaggct

SEQ ID NO: 111009 - DNA, 15 bp, Homo sapiens
ctcggagcagcaggc

SEQ ID NO: 111010 - DNA, 15 bp, Homo sapiens
actcggagcagcagg

SEQ ID NO: 111011 - DNA, 15 bp, Homo sapiens
cactcggagcagcag

SEQ ID NO: 111012 - DNA, 15 bp, Homo sapiens
gcactcggagcagca

SEQ ID NO: 111013 - DNA, 15 bp, Homo sapiens
cgcactcggagcagc

SEQ ID NO: 111014 - DNA, 15 bp, Homo sapiens
ccgcactcggagcag

SEQ ID NO: 111015 - DNA, 15 bp, Homo sapiens
cccgcactcggagca

SEQ ID NO: 111016 - DNA, 15 bp, Homo sapiens
ccccgcactcggagc

SEQ ID NO: 111017 - DNA, 15 bp, Homo sapiens
gccccgcactcggag

SEQ ID NO: 111018 - DNA, 15 bp, Homo sapiens
ggccccgcactcgga

SEQ ID NO: 111019 - DNA, 15 bp, Homo sapiens
gggccccgcactcgg

SEQ ID NO: 111020 - DNA, 15 bp, Homo sapiens
cgggccccgcactcg

SEQ ID NO: 111021 - DNA, 15 bp, Homo sapiens
gcgggccccgcactc

SEQ ID NO: 111022 - DNA, 15 bp, Homo sapiens
ggcgggccccgcact

SEQ ID NO: 111023 - DNA, 15 bp, Homo sapiens
tggcgggccccgcac

SEQ ID NO: 111024 - DNA, 15 bp, Homo sapiens
ttggcgggccccgca

SEQ ID NO: 111025 - DNA, 15 bp, Homo sapiens
cttggcgggccccgc

SEQ ID NO: 111026 - DNA, 15 bp, Homo sapiens
gcttggcgggccccg

SEQ ID NO: 111027 - DNA, 15 bp, Homo sapiens
ggcttggcgggcccc

SEQ ID NO: 111028 - DNA, 15 bp, Homo sapiens
gggcttggcgggccc

SEQ ID NO: 111029 - DNA, 15 bp, Homo sapiens
tgggcttggcgggcc

SEQ ID NO: 111030 - DNA, 15 bp, Homo sapiens
gtgggcttggcgggc

SEQ ID NO: 111031 - DNA, 15 bp, Homo sapiens
ggtgggcttggcggg

SEQ ID NO: 111032 - DNA, 15 bp, Homo sapiens
gggtgggcttggcgg

SEQ ID NO: 111033 - DNA, 15 bp, Homo sapiens
cgggtgggcttggcg

SEQ ID NO: 111034 - DNA, 15 bp, Homo sapiens
ccgggtgggcttggc

SEQ ID NO: 111035 - DNA, 15 bp, Homo sapiens
tccgggtgggcttgg

SEQ ID NO: 111036 - DNA, 15 bp, Homo sapiens
ttccgggtgggcttg

SEQ ID NO: 111037 - DNA, 15 bp, Homo sapiens
gttccgggtgggctt

SEQ ID NO: 111038 - DNA, 15 bp, Homo sapiens
agttccgggtgggct

SEQ ID NO: 111039 - DNA, 15 bp, Homo sapiens
gagttccgggtgggc

SEQ ID NO: 111040 - DNA, 15 bp, Homo sapiens
ggagttccgggtggg

SEQ ID NO: 111041 - DNA, 15 bp, Homo sapiens
tggagttccgggtgg

SEQ ID NO: 111042 - DNA, 15 bp, Homo sapiens
ctggagttccgggtg

SEQ ID NO: 111043 - DNA, 15 bp, Homo sapiens
gctggagttccgggt

SEQ ID NO: 111044 - DNA, 15 bp, Homo sapiens
agctggagttccggg

SEQ ID NO: 111045 - DNA, 15 bp, Homo sapiens
cagctggagttccgg

SEQ ID NO: 111046 - DNA, 15 bp, Homo sapiens
ccagctggagttccg

SEQ ID NO: 111047 - DNA, 15 bp, Homo sapiens
gccagctggagttcc

SEQ ID NO: 111048 - DNA, 15 bp, Homo sapiens
ggccagctggagttc

SEQ ID NO: 111049 - DNA, 15 bp, Homo sapiens
gggccagctggagtt

SEQ ID NO: 111050 - DNA, 15 bp, Homo sapiens
tgggccagctggagt

SEQ ID NO: 111051 - DNA, 15 bp, Homo sapiens
gtgggccagctggag

SEQ ID NO: 111052 - DNA, 15 bp, Homo sapiens
tgtgggccagctgga

SEQ ID NO: 111053 - DNA, 15 bp, Homo sapiens
ttgtgggccagctgg

SEQ ID NO: 111054 - DNA, 15 bp, Homo sapiens
cttgtgggccagctg

SEQ ID NO: 111055 - DNA, 15 bp, Homo sapiens
gcttgtgggccagct

SEQ ID NO: 111056 - DNA, 15 bp, Homo sapiens
cgcttgtgggccagc

SEQ ID NO: 111057 - DNA, 15 bp, Homo sapiens
acgcttgtgggccag

SEQ ID NO: 111058 - DNA, 15 bp, Homo sapiens
cacgcttgtgggcca

SEQ ID NO: 111059 - DNA, 15 bp, Homo sapiens
ccacgcttgtgggcc

SEQ ID NO: 111060 - DNA, 15 bp, Homo sapiens
gccacgcttgtgggc

SEQ ID NO: 111061 - DNA, 15 bp, Homo sapiens
cgccacgcttgtggg

SEQ ID NO: 111062 - DNA, 15 bp, Homo sapiens
gcgccacgcttgtgg

SEQ ID NO: 111063 - DNA, 15 bp, Homo sapiens
cgcgccacgcttgtg

SEQ ID NO: 111064 - DNA, 15 bp, Homo sapiens
gcgcgccacgcttgt

SEQ ID NO: 111065 - DNA, 15 bp, Homo sapiens
tgcgcgccacgcttg

SEQ ID NO: 111066 - DNA, 15 bp, Homo sapiens
ctgcgcgccacgctt

SEQ ID NO: 111067 - DNA, 15 bp, Homo sapiens
gctgcgcgccacgct

SEQ ID NO: 111068 - DNA, 15 bp, Homo sapiens
ggctgcgcgccacgc

SEQ ID NO: 111069 - DNA, 15 bp, Homo sapiens
gggctgcgcgccacg

SEQ ID NO: 111070 - DNA, 15 bp, Homo sapiens
ggggctgcgcgccac

SEQ ID NO: 111071 - DNA, 15 bp, Homo sapiens
cggggctgcgcgcca

SEQ ID NO: 111072 - DNA, 15 bp, Homo sapiens
ccggggctgcgcgcc

SEQ ID NO: 111073 - DNA, 15 bp, Homo sapiens
accggggctgcgcgc

SEQ ID NO: 111074 - DNA, 15 bp, Homo sapiens
aaccggggctgcgcg

SEQ ID NO: 111075 - DNA, 15 bp, Homo sapiens
gaaccggggctgcgc

SEQ ID NO: 111076 - DNA, 15 bp, Homo sapiens
ggaaccggggctgcg

SEQ ID NO: 111077 - DNA, 15 bp, Homo sapiens
gggaaccggggctgc

SEQ ID NO: 111078 - DNA, 15 bp, Homo sapiens
cgggaaccggggctg

SEQ ID NO: 111079 - DNA, 15 bp, Homo sapiens
gcgggaaccggggct

SEQ ID NO: 111080 - DNA, 15 bp, Homo sapiens
agcgggaaccggggc

SEQ ID NO: 111081 - DNA, 15 bp, Homo sapiens
gagcgggaaccgggg

SEQ ID NO: 111082 - DNA, 15 bp, Homo sapiens
cgagcgggaaccggg

SEQ ID NO: 111083 - DNA, 15 bp, Homo sapiens
gcgagcgggaaccgg

SEQ ID NO: 111084 - DNA, 15 bp, Homo sapiens
cgcgagcgggaaccg

SEQ ID NO: 111085 - DNA, 15 bp, Homo sapiens
gcgcgagcgggaacc

SEQ ID NO: 111086 - DNA, 15 bp, Homo sapiens
ggcgcgagcgggaac

SEQ ID NO: 111087 - DNA, 15 bp, Homo sapiens
aggcgcgagcgggaa

SEQ ID NO: 111088 - DNA, 15 bp, Homo sapiens
gaggcgcgagcggga

SEQ ID NO: 111089 - DNA, 15 bp, Homo sapiens
agaggcgcgagcggg

SEQ ID NO: 111090 - DNA, 15 bp, Homo sapiens
gagaggcgcgagcgg

SEQ ID NO: 111091 - DNA, 15 bp, Homo sapiens
ggagaggcgcgagcg

SEQ ID NO: 111092 - DNA, 15 bp, Homo sapiens
gggagaggcgcgagc

SEQ ID NO: 111093 - DNA, 15 bp, Homo sapiens
agggagaggcgcgag

SEQ ID NO: 111094 - DNA, 15 bp, Homo sapiens
gagggagaggcgcga

SEQ ID NO: 111095 - DNA, 15 bp, Homo sapiens
ggagggagaggcgcg

SEQ ID NO: 111096 - DNA, 15 bp, Homo sapiens
tggagggagaggcgc

SEQ ID NO: 111097 - DNA, 15 bp, Homo sapiens
gtggagggagaggcg

SEQ ID NO: 111098 - DNA, 15 bp, Homo sapiens
tgtggagggagaggc

SEQ ID NO: 111099 - DNA, 15 bp, Homo sapiens
gtgtggagggagagg

SEQ ID NO: 111100 - DNA, 15 bp, Homo sapiens
ggtgtggagggagag

SEQ ID NO: 111101 - DNA, 15 bp, Homo sapiens
aggtgtggagggaga

SEQ ID NO: 111102 - DNA, 15 bp, Homo sapiens
gaggtgtggagggag

SEQ ID NO: 111103 - DNA, 15 bp, Homo sapiens
ggaggtgtggaggga

SEQ ID NO: 111104 - DNA, 15 bp, Homo sapiens
gggaggtgtggaggg

SEQ ID NO: 111105 - DNA, 15 bp, Homo sapiens
agggaggtgtggagg

SEQ ID NO: 111106 - DNA, 15 bp, Homo sapiens
cagggaggtgtggag

SEQ ID NO: 111107 - DNA, 15 bp, Homo sapiens
gcagggaggtgtgga

SEQ ID NO: 111108 - DNA, 15 bp, Homo sapiens
tgcagggaggtgtgg

SEQ ID NO: 111109 - DNA, 15 bp, Homo sapiens
ttgcagggaggtgtg

SEQ ID NO: 111110 - DNA, 15 bp, Homo sapiens
cttgcagggaggtgt

SEQ ID NO: 111111 - DNA, 15 bp, Homo sapiens
gcttgcagggaggtg

SEQ ID NO: 111112 - DNA, 15 bp, Homo sapiens
agcttgcagggaggt

SEQ ID NO: 111113 - DNA, 15 bp, Homo sapiens
cagcttgcagggagg

SEQ ID NO: 111114 - DNA, 15 bp, Homo sapiens
tcagcttgcagggag

SEQ ID NO: 111115 - DNA, 15 bp, Homo sapiens
ctcagcttgcaggga

SEQ ID NO: 111116 - DNA, 15 bp, Homo sapiens
cctcagcttgcaggg

SEQ ID NO: 111117 - DNA, 15 bp, Homo sapiens
ccctcagcttgcagg

SEQ ID NO: 111118 - DNA, 15 bp, Homo sapiens
tccctcagcttgcag

SEQ ID NO: 111119 - DNA, 15 bp, Homo sapiens
ctccctcagcttgca

SEQ ID NO: 111120 - DNA, 15 bp, Homo sapiens
actccctcagcttgc

SEQ ID NO: 111121 - DNA, 15 bp, Homo sapiens
cactccctcagcttg

SEQ ID NO: 111122 - DNA, 15 bp, Homo sapiens
ccactccctcagctt

SEQ ID NO: 111123 - DNA, 15 bp, Homo sapiens
cccactccctcagct

SEQ ID NO: 111124 - DNA, 15 bp, Homo sapiens
gcccactccctcagc

SEQ ID NO: 111125 - DNA, 15 bp, Homo sapiens
agcccactccctcag

SEQ ID NO: 111126 - DNA, 15 bp, Homo sapiens
gagcccactccctca

SEQ ID NO: 111127 - DNA, 15 bp, Homo sapiens
agagcccactccctc

SEQ ID NO: 111128 - DNA, 15 bp, Homo sapiens
cagagcccactccct

SEQ ID NO: 111129 - DNA, 15 bp, Homo sapiens
ccagagcccactccc

SEQ ID NO: 111130 - DNA, 15 bp, Homo sapiens
gccagagcccactcc

SEQ ID NO: 111131 - DNA, 15 bp, Homo sapiens
ggccagagcccactc

SEQ ID NO: 111132 - DNA, 15 bp, Homo sapiens
aggccagagcccact

SEQ ID NO: 111133 - DNA, 15 bp, Homo sapiens
aaggccagagcccac

SEQ ID NO: 111134 - DNA, 15 bp, Homo sapiens
caaggccagagccca

SEQ ID NO: 111135 - DNA, 15 bp, Homo sapiens
ccaaggccagagccc

SEQ ID NO: 111136 - DNA, 15 bp, Homo sapiens
gccaaggccagagcc

SEQ ID NO: 111137 - DNA, 15 bp, Homo sapiens
ggccaaggccagagc

SEQ ID NO: 111138 - DNA, 15 bp, Homo sapiens
tggccaaggccagag

SEQ ID NO: 111139 - DNA, 15 bp, Homo sapiens
ctggccaaggccaga

SEQ ID NO: 111140 - DNA, 15 bp, Homo sapiens
gctggccaaggccag

SEQ ID NO: 111141 - DNA, 15 bp, Homo sapiens
ggctggccaaggcca

SEQ ID NO: 111142 - DNA, 15 bp, Homo sapiens
gggctggccaaggcc

SEQ ID NO: 111143 - DNA, 15 bp, Homo sapiens
tgggctggccaaggc

SEQ ID NO: 111144 - DNA, 15 bp, Homo sapiens
ctgggctggccaagg

SEQ ID NO: 111145 - DNA, 15 bp, Homo sapiens
tctgggctggccaag

SEQ ID NO: 111146 - DNA, 15 bp, Homo sapiens
ttctgggctggccaa

SEQ ID NO: 111147 - DNA, 15 bp, Homo sapiens
tttctgggctggcca

SEQ ID NO: 111148 - DNA, 15 bp, Homo sapiens
ctttctgggctggcc

SEQ ID NO: 111149 - DNA, 15 bp, Homo sapiens
cctttctgggctggc

SEQ ID NO: 111150 - DNA, 15 bp, Homo sapiens
ccctttctgggctgg

SEQ ID NO: 111151 - DNA, 15 bp, Homo sapiens
cccctttctgggctg

SEQ ID NO: 111152 - DNA, 15 bp, Homo sapiens
acccctttctgggct

SEQ ID NO: 111153 - DNA, 15 bp, Homo sapiens
aacccctttctgggc

SEQ ID NO: 111154 - DNA, 15 bp, Homo sapiens
gaacccctttctggg

SEQ ID NO: 111155 - DNA, 15 bp, Homo sapiens
ggaacccctttctgg

SEQ ID NO: 111156 - DNA, 15 bp, Homo sapiens
gggaacccctttctg

SEQ ID NO: 111157 - DNA, 15 bp, Homo sapiens
tgggaacccctttct

SEQ ID NO: 111158 - DNA, 15 bp, Homo sapiens
gtgggaacccctttc

SEQ ID NO: 111159 - DNA, 15 bp, Homo sapiens
tgtgggaaccccttt

SEQ ID NO: 111160 - DNA, 15 bp, Homo sapiens
ctgtgggaacccctt

SEQ ID NO: 111161 - DNA, 15 bp, Homo sapiens
actgtgggaacccct

SEQ ID NO: 111162 - DNA, 15 bp, Homo sapiens
cactgtgggaacccc

SEQ ID NO: 111163 - DNA, 15 bp, Homo sapiens
gcactgtgggaaccc

SEQ ID NO: 111164 - DNA, 15 bp, Homo sapiens
tgcactgtgggaacc

SEQ ID NO: 111165 - DNA, 15 bp, Homo sapiens
ctgcactgtgggaac

SEQ ID NO: 111166 - DNA, 15 bp, Homo sapiens
gctgcactgtgggaa

SEQ ID NO: 111167 - DNA, 15 bp, Homo sapiens
cgctgcactgtggga

SEQ ID NO: 111168 - DNA, 15 bp, Homo sapiens
ccgctgcactgtggg

SEQ ID NO: 111169 - DNA, 15 bp, Homo sapiens
accgctgcactgtgg

SEQ ID NO: 111170 - DNA, 15 bp, Homo sapiens
caccgctgcactgtg

SEQ ID NO: 111171 - DNA, 15 bp, Homo sapiens
ccaccgctgcactgt

SEQ ID NO: 111172 - DNA, 15 bp, Homo sapiens
cccaccgctgcactg

SEQ ID NO: 111173 - DNA, 15 bp, Homo sapiens
gcccaccgctgcact

SEQ ID NO: 111174 - DNA, 15 bp, Homo sapiens
agcccaccgctgcac

SEQ ID NO: 111175 - DNA, 15 bp, Homo sapiens
cagcccaccgctgca

SEQ ID NO: 111176 - DNA, 15 bp, Homo sapiens
tcagcccaccgctgc

SEQ ID NO: 111177 - DNA, 15 bp, Homo sapiens
ttcagcccaccgctg

SEQ ID NO: 111178 - DNA, 15 bp, Homo sapiens
cttcagcccaccgct

SEQ ID NO: 111179 - DNA, 15 bp, Homo sapiens
tcttcagcccaccgc

SEQ ID NO: 111180 - DNA, 15 bp, Homo sapiens
ctcttcagcccaccg

SEQ ID NO: 111181 - DNA, 15 bp, Homo sapiens
gctcttcagcccacc

SEQ ID NO: 111182 - DNA, 15 bp, Homo sapiens
agctcttcagcccac

SEQ ID NO: 111183 - DNA, 15 bp, Homo sapiens
gagctcttcagccca

SEQ ID NO: 111184 - DNA, 15 bp, Homo sapiens
ggagctcttcagccc

SEQ ID NO: 111185 - DNA, 15 bp, Homo sapiens
aggagctcttcagcc

SEQ ID NO: 111186 - DNA, 15 bp, Homo sapiens
gaggagctcttcagc

SEQ ID NO: 111187 - DNA, 15 bp, Homo sapiens
tgaggagctcttcag

SEQ ID NO: 111188 - DNA, 15 bp, Homo sapiens
ttgaggagctcttca

SEQ ID NO: 111189 - DNA, 15 bp, Homo sapiens
cttgaggagctcttc

SEQ ID NO: 111190 - DNA, 15 bp, Homo sapiens
acttgaggagctctt

SEQ ID NO: 111191 - DNA, 15 bp, Homo sapiens
cacttgaggagctct

SEQ ID NO: 111192 - DNA, 15 bp, Homo sapiens
gcacttgaggagctc

SEQ ID NO: 111193 - DNA, 15 bp, Homo sapiens
agcacttgaggagct

SEQ ID NO: 111194 - DNA, 15 bp, Homo sapiens
cagcacttgaggagc

SEQ ID NO: 111195 - DNA, 15 bp, Homo sapiens
gcagcacttgaggag

SEQ ID NO: 111196 - DNA, 15 bp, Homo sapiens
ggcagcacttgagga

SEQ ID NO: 111197 - DNA, 15 bp, Homo sapiens
tggcagcacttgagg

SEQ ID NO: 111198 - DNA, 15 bp, Homo sapiens
ttggcagcacttgag

SEQ ID NO: 111199 - DNA, 15 bp, Homo sapiens
tttggcagcacttga

SEQ ID NO: 111200 - DNA, 15 bp, Homo sapiens
ctttggcagcacttg

SEQ ID NO: 111201 - DNA, 15 bp, Homo sapiens
actttggcagcactt

SEQ ID NO: 111202 - DNA, 15 bp, Homo sapiens
cactttggcagcact

SEQ ID NO: 111203 - DNA, 15 bp, Homo sapiens
ccactttggcagcac

SEQ ID NO: 111204 - DNA, 15 bp, Homo sapiens
cccactttggcagca

SEQ ID NO: 111205 - DNA, 15 bp, Homo sapiens
tcccactttggcagc

SEQ ID NO: 111206 - DNA, 15 bp, Homo sapiens
ctcccactttggcag

SEQ ID NO: 111207 - DNA, 15 bp, Homo sapiens
gctcccactttggca

SEQ ID NO: 111208 - DNA, 15 bp, Homo sapiens
ggctcccactttggc

SEQ ID NO: 111209 - DNA, 15 bp, Homo sapiens
gggctcccactttgg

SEQ ID NO: 111210 - DNA, 15 bp, Homo sapiens
tgggctcccactttg

SEQ ID NO: 111211 - DNA, 15 bp, Homo sapiens
ctgggctcccacttt

SEQ ID NO: 111212 - DNA, 15 bp, Homo sapiens
cctgggctcccactt

SEQ ID NO: 111213 - DNA, 15 bp, Homo sapiens
gcctgggctcccact

SEQ ID NO: 111214 - DNA, 15 bp, Homo sapiens
tgcctgggctcccac

SEQ ID NO: 111215 - DNA, 15 bp, Homo sapiens
ctgcctgggctccca

SEQ ID NO: 111216 - DNA, 15 bp, Homo sapiens
tctgcctgggctccc

SEQ ID NO: 111217 - DNA, 15 bp, Homo sapiens
ctctgcctgggctcc

SEQ ID NO: 111218 - DNA, 15 bp, Homo sapiens
cctctgcctgggctc

SEQ ID NO: 111219 - DNA, 15 bp, Homo sapiens
tcctctgcctgggct

SEQ ID NO: 111220 - DNA, 15 bp, Homo sapiens
ctcctctgcctgggc

SEQ ID NO: 111221 - DNA, 15 bp, Homo sapiens
cctcctctgcctggg

SEQ ID NO: 111222 - DNA, 15 bp, Homo sapiens
gcctcctctgcctgg

SEQ ID NO: 111223 - DNA, 15 bp, Homo sapiens
cgcctcctctgcctg

SEQ ID NO: 111224 - DNA, 15 bp, Homo sapiens
gcgcctcctctgcct

SEQ ID NO: 111225 - DNA, 15 bp, Homo sapiens
ggcgcctcctctgcc

SEQ ID NO: 111226 - DNA, 15 bp, Homo sapiens
cggcgcctcctctgc

SEQ ID NO: 111227 - DNA, 15 bp, Homo sapiens
tcggcgcctcctctg

SEQ ID NO: 111228 - DNA, 15 bp, Homo sapiens
ctcggcgcctcctct

SEQ ID NO: 111229 - DNA, 15 bp, Homo sapiens
tctcggcgcctcctc

SEQ ID NO: 111230 - DNA, 15 bp, Homo sapiens
ctctcggcgcctcct

SEQ ID NO: 111231 - DNA, 15 bp, Homo sapiens
gctctcggcgcctcc

SEQ ID NO: 111232 - DNA, 15 bp, Homo sapiens
cgctctcggcgcctc

SEQ ID NO: 111233 - DNA, 15 bp, Homo sapiens
tcgctctcggcgcct

SEQ ID NO: 111234 - DNA, 15 bp, Homo sapiens
ctcgctctcggcgcc

SEQ ID NO: 111235 - DNA, 15 bp, Homo sapiens
gctcgctctcggcgc

SEQ ID NO: 111236 - DNA, 15 bp, Homo sapiens
cgctcgctctcggcg

SEQ ID NO: 111237 - DNA, 15 bp, Homo sapiens
tcgctcgctctcggc

SEQ ID NO: 111238 - DNA, 15 bp, Homo sapiens
ctcgctcgctctcgg

SEQ ID NO: 111239 - DNA, 15 bp, Homo sapiens
cctcgctcgctctcg

SEQ ID NO: 111240 - DNA, 15 bp, Homo sapiens
ccctcgctcgctctc

SEQ ID NO: 111241 - DNA, 15 bp, Homo sapiens
gccctcgctcgctct

SEQ ID NO: 111242 - DNA, 15 bp, Homo sapiens
agccctcgctcgctc

SEQ ID NO: 111243 - DNA, 15 bp, Homo sapiens
cagccctcgctcgct

SEQ ID NO: 111244 - DNA, 15 bp, Homo sapiens
acagccctcgctcgc

SEQ ID NO: 111245 - DNA, 15 bp, Homo sapiens
cacagccctcgctcg

SEQ ID NO: 111246 - DNA, 15 bp, Homo sapiens
tcacagccctcgctc

SEQ ID NO: 111247 - DNA, 15 bp, Homo sapiens
ctcacagccctcgct

SEQ ID NO: 111248 - DNA, 15 bp, Homo sapiens
cctcacagccctcgc

SEQ ID NO: 111249 - DNA, 15 bp, Homo sapiens
tcctcacagccctcg

SEQ ID NO: 111250 - DNA, 15 bp, Homo sapiens
gtcctcacagccctc

SEQ ID NO: 111251 - DNA, 15 bp, Homo sapiens
agtcctcacagccct

SEQ ID NO: 111252 - DNA, 15 bp, Homo sapiens
cagtcctcacagccc

SEQ ID NO: 111253 - DNA, 15 bp, Homo sapiens
gcagtcctcacagcc

SEQ ID NO: 111254 - DNA, 15 bp, Homo sapiens
ggcagtcctcacagc

SEQ ID NO: 111255 - DNA, 15 bp, Homo sapiens
tggcagtcctcacag

SEQ ID NO: 111256 - DNA, 15 bp, Homo sapiens
ctggcagtcctcaca

SEQ ID NO: 111257 - DNA, 15 bp, Homo sapiens
gctggcagtcctcac

SEQ ID NO: 111258 - DNA, 15 bp, Homo sapiens
tgctggcagtcctca

SEQ ID NO: 111259 - DNA, 15 bp, Homo sapiens
atgctggcagtcctc

SEQ ID NO: 111260 - DNA, 15 bp, Homo sapiens
catgctggcagtcct

SEQ ID NO: 111261 - DNA, 15 bp, Homo sapiens
gcatgctggcagtcc

SEQ ID NO: 111262 - DNA, 15 bp, Homo sapiens
agcatgctggcagtc

SEQ ID NO: 111263 - DNA, 15 bp, Homo sapiens
cagcatgctggcagt

SEQ ID NO: 111264 - DNA, 15 bp, Homo sapiens
acagcatgctggcag

SEQ ID NO: 111265 - DNA, 15 bp, Homo sapiens
gacagcatgctggca

SEQ ID NO: 111266 - DNA, 15 bp, Homo sapiens
tgacagcatgctggc

SEQ ID NO: 111267 - DNA, 15 bp, Homo sapiens
gtgacagcatgctgg

SEQ ID NO: 111268 - DNA, 15 bp, Homo sapiens
ggtgacagcatgctg

SEQ ID NO: 111269 - DNA, 15 bp, Homo sapiens
aggtgacagcatgct

SEQ ID NO: 111270 - DNA, 15 bp, Homo sapiens
gaggtgacagcatgc

SEQ ID NO: 111271 - DNA, 15 bp, Homo sapiens
agaggtgacagcatg

SEQ ID NO: 111272 - DNA, 15 bp, Homo sapiens
gagaggtgacagcat

SEQ ID NO: 111273 - DNA, 15 bp, Homo sapiens
tgagaggtgacagca

SEQ ID NO: 111274 - DNA, 15 bp, Homo sapiens
atgagaggtgacagc

SEQ ID NO: 111275 - DNA, 15 bp, Homo sapiens
aatgagaggtgacag

SEQ ID NO: 111276 - DNA, 15 bp, Homo sapiens
taatgagaggtgaca

SEQ ID NO: 111277 - DNA, 15 bp, Homo sapiens
ctaatgagaggtgac

SEQ ID NO: 111278 - DNA, 15 bp, Homo sapiens
actaatgagaggtga

SEQ ID NO: 111279 - DNA, 15 bp, Homo sapiens
tactaatgagaggtg

SEQ ID NO: 111280 - DNA, 15 bp, Homo sapiens
gtactaatgagaggt

SEQ ID NO: 111281 - DNA, 15 bp, Homo sapiens
agtactaatgagagg

SEQ ID NO: 111282 - DNA, 15 bp, Homo sapiens
aagtactaatgagag

SEQ ID NO: 111283 - DNA, 15 bp, Homo sapiens
gaagtactaatgaga

SEQ ID NO: 111284 - DNA, 15 bp, Homo sapiens
tgaagtactaatgag

SEQ ID NO: 111285 - DNA, 15 bp, Homo sapiens
ttgaagtactaatga

SEQ ID NO: 111286 - DNA, 15 bp, Homo sapiens
tttgaagtactaatg

SEQ ID NO: 111287 - DNA, 15 bp, Homo sapiens
ctttgaagtactaat

SEQ ID NO: 111288 - DNA, 15 bp, Homo sapiens
tctttgaagtactaa

SEQ ID NO: 111289 - DNA, 15 bp, Homo sapiens
ttctttgaagtacta

SEQ ID NO: 111290 - DNA, 15 bp, Homo sapiens
tttctttgaagtact

SEQ ID NO: 111291 - DNA, 15 bp, Homo sapiens
atttctttgaagtac

SEQ ID NO: 111292 - DNA, 15 bp, Homo sapiens
tatttctttgaagta

SEQ ID NO: 111293 - DNA, 15 bp, Homo sapiens
gtatttctttgaagt

SEQ ID NO: 111294 - DNA, 15 bp, Homo sapiens
tgtatttctttgaag

SEQ ID NO: 111295 - DNA, 15 bp, Homo sapiens
ttgtatttctttgaa

SEQ ID NO: 111296 - DNA, 15 bp, Homo sapiens
cttgtatttctttga

SEQ ID NO: 111297 - DNA, 15 bp, Homo sapiens
ccttgtatttctttg

SEQ ID NO: 111298 - DNA, 15 bp, Homo sapiens
cccttgtatttcttt

SEQ ID NO: 111299 - DNA, 15 bp, Homo sapiens
tcccttgtatttctt

SEQ ID NO: 111300 - DNA, 15 bp, Homo sapiens
ttcccttgtatttct

SEQ ID NO: 111301 - DNA, 15 bp, Homo sapiens
tttcccttgtatttc

SEQ ID NO: 111302 - DNA, 15 bp, Homo sapiens
ttttcccttgtattt

SEQ ID NO: 111303 - DNA, 15 bp, Homo sapiens
tttttcccttgtatt

SEQ ID NO: 111304 - DNA, 15 bp, Homo sapiens
ttttttcccttgtat

SEQ ID NO: 111305 - DNA, 15 bp, Homo sapiens
attttttcccttgta

SEQ ID NO: 111306 - DNA, 15 bp, Homo sapiens
tattttttcccttgt

SEQ ID NO: 111307 - DNA, 15 bp, Homo sapiens
ttattttttcccttg

SEQ ID NO: 111308 - DNA, 15 bp, Homo sapiens
tttattttttccctt

SEQ ID NO: 111309 - DNA, 15 bp, Homo sapiens
atttattttttccct

SEQ ID NO: 111310 - DNA, 15 bp, Homo sapiens
catttattttttccc

SEQ ID NO: 111311 - DNA, 15 bp, Homo sapiens
acatttattttttcc

SEQ ID NO: 111312 - DNA, 15 bp, Homo sapiens
aacatttattttttc

SEQ ID NO: 111313 - DNA, 15 bp, Homo sapiens
taacatttatttttt

SEQ ID NO: 111314 - DNA, 15 bp, Homo sapiens
ttaacatttattttt

SEQ ID NO: 111315 - DNA, 15 bp, Homo sapiens
attaacatttatttt

SEQ ID NO: 111316 - DNA, 15 bp, Homo sapiens
aatttggaattatta

SEQ ID NO: 111317 - DNA, 15 bp, Homo sapiens
aaatttggaattatt

SEQ ID NO: 111318 - DNA, 15 bp, Homo sapiens
gaaatttggaattat

SEQ ID NO: 111319 - DNA, 15 bp, Homo sapiens
tgaaatttggaatta

SEQ ID NO: 111320 - DNA, 15 bp, Homo sapiens
ttgaaatttggaatt

SEQ ID NO: 111321 - DNA, 15 bp, Homo sapiens
attgaaatttggaat

SEQ ID NO: 111322 - DNA, 15 bp, Homo sapiens
cattgaaatttggaa

SEQ ID NO: 111323 - DNA, 15 bp, Homo sapiens
ccattgaaatttgga

SEQ ID NO: 111324 - DNA, 15 bp, Homo sapiens
tccattgaaatttgg

SEQ ID NO: 111325 - DNA, 15 bp, Homo sapiens
atccattgaaatttg

SEQ ID NO: 111326 - DNA, 15 bp, Homo sapiens
tatccattgaaattt

SEQ ID NO: 111327 - DNA, 15 bp, Homo sapiens
ctatccattgaaatt

SEQ ID NO: 111328 - DNA, 15 bp, Homo sapiens
gctatccattgaaat

SEQ ID NO: 111329 - DNA, 15 bp, Homo sapiens
tgctatccattgaaa

SEQ ID NO: 111330 - DNA, 15 bp, Homo sapiens
ctgctatccattgaa

SEQ ID NO: 111331 - DNA, 15 bp, Homo sapiens
actgctatccattga

SEQ ID NO: 111332 - DNA, 15 bp, Homo sapiens
tactgctatccattg

SEQ ID NO: 111333 - DNA, 15 bp, Homo sapiens
ctactgctatccatt

SEQ ID NO: 111334 - DNA, 15 bp, Homo sapiens
gctactgctatccat

SEQ ID NO: 111335 - DNA, 15 bp, Homo sapiens
ggctactgctatcca

SEQ ID NO: 111336 - DNA, 15 bp, Homo sapiens
cggctactgctatcc

SEQ ID NO: 111337 - DNA, 15 bp, Homo sapiens
ccggctactgctatc

SEQ ID NO: 111338 - DNA, 15 bp, Homo sapiens
accggctactgctat

SEQ ID NO: 111339 - DNA, 15 bp, Homo sapiens
caccggctactgcta

SEQ ID NO: 111340 - DNA, 15 bp, Homo sapiens
acaccggctactgct

SEQ ID NO: 111341 - DNA, 15 bp, Homo sapiens
aacaccggctactgc

SEQ ID NO: 111342 - DNA, 15 bp, Homo sapiens
caacaccggctactg

SEQ ID NO: 111343 - DNA, 15 bp, Homo sapiens
ccaacaccggctact

SEQ ID NO: 111344 - DNA, 15 bp, Homo sapiens
gccaacaccggctac

SEQ ID NO: 111345 - DNA, 15 bp, Homo sapiens
agccaacaccggcta

SEQ ID NO: 111346 - DNA, 15 bp, Homo sapiens
aagccaacaccggct

SEQ ID NO: 111347 - DNA, 15 bp, Homo sapiens
aaagccaacaccggc

SEQ ID NO: 111348 - DNA, 15 bp, Homo sapiens
aaaagccaacaccgg

SEQ ID NO: 111349 - DNA, 15 bp, Homo sapiens
aaaaagccaacaccg

SEQ ID NO: 111350 - DNA, 15 bp, Homo sapiens
aaaaaagccaacacc

SEQ ID NO: 111351 - DNA, 15 bp, Homo sapiens
gaaaaaagccaacac

SEQ ID NO: 111352 - DNA, 15 bp, Homo sapiens
agaaaaaagccaaca

SEQ ID NO: 111353 - DNA, 15 bp, Homo sapiens
tagaaaaaagccaac

SEQ ID NO: 111354 - DNA, 15 bp, Homo sapiens
ctagaaaaaagccaa

SEQ ID NO: 111355 - DNA, 15 bp, Homo sapiens
actagaaaaaagcca

SEQ ID NO: 111356 - DNA, 15 bp, Homo sapiens
gactagaaaaaagcc

SEQ ID NO: 111357 - DNA, 15 bp, Homo sapiens
cgactagaaaaaagc

SEQ ID NO: 111358 - DNA, 15 bp, Homo sapiens
gcgactagaaaaaag

SEQ ID NO: 111359 - DNA, 15 bp, Homo sapiens
tgcgactagaaaaaa

SEQ ID NO: 111360 - DNA, 15 bp, Homo sapiens
ttgcgactagaaaaa

SEQ ID NO: 111361 - DNA, 15 bp, Homo sapiens
gttgcgactagaaaa

SEQ ID NO: 111362 - DNA, 15 bp, Homo sapiens
tgttgcgactagaaa

SEQ ID NO: 111363 - DNA, 15 bp, Homo sapiens
atgttgcgactagaa

SEQ ID NO: 111364 - DNA, 15 bp, Homo sapiens
catgttgcgactaga

SEQ ID NO: 111365 - DNA, 15 bp, Homo sapiens
acatgttgcgactag

SEQ ID NO: 111366 - DNA, 15 bp, Homo sapiens
tacatgttgcgacta

SEQ ID NO: 111367 - DNA, 15 bp, Homo sapiens
ttacatgttgcgact

SEQ ID NO: 111368 - DNA, 15 bp, Homo sapiens
cttacatgttgcgac

SEQ ID NO: 111369 - DNA, 15 bp, Homo sapiens
tcttacatgttgcga

SEQ ID NO: 111370 - DNA, 15 bp, Homo sapiens
atcttacatgttgcg

SEQ ID NO: 111371 - DNA, 15 bp, Homo sapiens
aatcttacatgttgc

SEQ ID NO: 111372 - DNA, 15 bp, Homo sapiens
aaatcttacatgttg

SEQ ID NO: 111373 - DNA, 15 bp, Homo sapiens
aaaatcttacatgtt

SEQ ID NO: 111374 - DNA, 15 bp, Homo sapiens
aaaaatcttacatgt

SEQ ID NO: 111375 - DNA, 15 bp, Homo sapiens
gaaaaatcttacatg

SEQ ID NO: 111376 - DNA, 15 bp, Homo sapiens
agaaaaatcttacat

SEQ ID NO: 111377 - DNA, 15 bp, Homo sapiens
tagaaaaatcttaca

SEQ ID NO: 111378 - DNA, 15 bp, Homo sapiens
ttagaaaaatcttac

SEQ ID NO: 111379 - DNA, 15 bp, Homo sapiens
cttagaaaaatctta

SEQ ID NO: 111380 - DNA, 15 bp, Homo sapiens
acttagaaaaatctt

SEQ ID NO: 111381 - DNA, 15 bp, Homo sapiens
cacttagaaaaatct

SEQ ID NO: 111382 - DNA, 15 bp, Homo sapiens
acacttagaaaaatc

SEQ ID NO: 111383 - DNA, 15 bp, Homo sapiens
tacacttagaaaaat

SEQ ID NO: 111384 - DNA, 15 bp, Homo sapiens
ttacacttagaaaaa

SEQ ID NO: 111385 - DNA, 15 bp, Homo sapiens
attacacttagaaaa

SEQ ID NO: 111386 - DNA, 15 bp, Homo sapiens
aattacacttagaaa

SEQ ID NO: 111387 - DNA, 15 bp, Homo sapiens
aaattacacttagaa

SEQ ID NO: 111388 - DNA, 15 bp, Homo sapiens
aaaattacacttaga

SEQ ID NO: 111389 - DNA, 15 bp, Homo sapiens
taaaattacacttag

SEQ ID NO: 111390 - DNA, 15 bp, Homo sapiens
ttaaaattacactta

SEQ ID NO: 111391 - DNA, 15 bp, Homo sapiens
attaaaattacactt

SEQ ID NO: 111392 - DNA, 15 bp, Homo sapiens
aattaaaattacact

SEQ ID NO: 111393 - DNA, 15 bp, Homo sapiens
caattaaaattacac

SEQ ID NO: 111394 - DNA, 15 bp, Homo sapiens
ctcacaattaaaatt

SEQ ID NO: 111395 - DNA, 15 bp, Homo sapiens
tctcacaattaaaat

SEQ ID NO: 111396 - DNA, 15 bp, Homo sapiens
ttctcacaattaaaa

SEQ ID NO: 111397 - DNA, 15 bp, Homo sapiens
tttctcacaattaaa

SEQ ID NO: 111398 - DNA, 15 bp, Homo sapiens
gtttctcacaattaa

SEQ ID NO: 111399 - DNA, 15 bp, Homo sapiens
tgtttctcacaatta

SEQ ID NO: 111400 - DNA, 15 bp, Homo sapiens
atgtttctcacaatt

SEQ ID NO: 111401 - DNA, 15 bp, Homo sapiens
aatgtttctcacaat

SEQ ID NO: 111402 - DNA, 15 bp, Homo sapiens
gaatgtttctcacaa

SEQ ID NO: 111403 - DNA, 15 bp, Homo sapiens
agaatgtttctcaca

SEQ ID NO: 111404 - DNA, 15 bp, Homo sapiens
cagaatgtttctcac

SEQ ID NO: 111405 - DNA, 15 bp, Homo sapiens
acagaatgtttctca

SEQ ID NO: 111406 - DNA, 15 bp, Homo sapiens
aacagaatgtttctc

SEQ ID NO: 111407 - DNA, 15 bp, Homo sapiens
aaacagaatgtttct

SEQ ID NO: 111408 - DNA, 15 bp, Homo sapiens
aaaacagaatgtttc

SEQ ID NO: 111409 - DNA, 15 bp, Homo sapiens
gaaatgggaaaacat

SEQ ID NO: 111410 - DNA, 15 bp, Homo sapiens
tgaaatgggaaaaca

SEQ ID NO: 111411 - DNA, 15 bp, Homo sapiens
atgaaatgggaaaac

SEQ ID NO: 111412 - DNA, 15 bp, Homo sapiens
catgaaatgggaaaa

SEQ ID NO: 111413 - DNA, 15 bp, Homo sapiens
acatgaaatgggaaa

SEQ ID NO: 111414 - DNA, 15 bp, Homo sapiens
tacatgaaatgggaa

SEQ ID NO: 111415 - DNA, 15 bp, Homo sapiens
ctacatgaaatggga

SEQ ID NO: 111416 - DNA, 15 bp, Homo sapiens
cctacatgaaatggg

SEQ ID NO: 111417 - DNA, 15 bp, Homo sapiens
tcctacatgaaatgg

SEQ ID NO: 111418 - DNA, 15 bp, Homo sapiens
ttcctacatgaaatg

SEQ ID NO: 111419 - DNA, 15 bp, Homo sapiens
tttcctacatgaaat

SEQ ID NO: 111420 - DNA, 15 bp, Homo sapiens
ttttcctacatgaaa

SEQ ID NO: 111421 - DNA, 15 bp, Homo sapiens
tttttcctacatgaa

SEQ ID NO: 111422 - DNA, 15 bp, Homo sapiens
atttttcctacatga

SEQ ID NO: 111423 - DNA, 15 bp, Homo sapiens
catttttcctacatg

SEQ ID NO: 111424 - DNA, 15 bp, Homo sapiens
ccatttttcctacat

SEQ ID NO: 111425 - DNA, 15 bp, Homo sapiens
cccatttttcctaca

SEQ ID NO: 111426 - DNA, 15 bp, Homo sapiens
tcccatttttcctac

SEQ ID NO: 111427 - DNA, 15 bp, Homo sapiens
ttcccatttttccta

SEQ ID NO: 111428 - DNA, 15 bp, Homo sapiens
tttcccatttttcct

SEQ ID NO: 111429 - DNA, 15 bp, Homo sapiens
atttcccatttttcc

SEQ ID NO: 111430 - DNA, 15 bp, Homo sapiens
tatttcccatttttc

SEQ ID NO: 111431 - DNA, 15 bp, Homo sapiens
ttatttcccattttt

SEQ ID NO: 111432 - DNA, 15 bp, Homo sapiens
attatttcccatttt

SEQ ID NO: 111433 - DNA, 15 bp, Homo sapiens
tattatttcccattt

SEQ ID NO: 111434 - DNA, 15 bp, Homo sapiens
ttattatttcccatt

SEQ ID NO: 111435 - DNA, 15 bp, Homo sapiens
attattatttcccat

SEQ ID NO: 111436 - DNA, 15 bp, Homo sapiens
gattattatttccca

SEQ ID NO: 111437 - DNA, 15 bp, Homo sapiens
ggattattatttccc

SEQ ID NO: 111438 - DNA, 15 bp, Homo sapiens
gggattattatttcc

SEQ ID NO: 111439 - DNA, 15 bp, Homo sapiens
agggattattatttc

SEQ ID NO: 111440 - DNA, 15 bp, Homo sapiens
cagggattattattt

SEQ ID NO: 111441 - DNA, 15 bp, Homo sapiens
acagggattattatt

SEQ ID NO: 111442 - DNA, 15 bp, Homo sapiens
tacagggattattat

SEQ ID NO: 111443 - DNA, 15 bp, Homo sapiens
ttacagggattatta

SEQ ID NO: 111444 - DNA, 15 bp, Homo sapiens
tttacagggattatt

SEQ ID NO: 111445 - DNA, 15 bp, Homo sapiens
ttttacagggattat

SEQ ID NO: 111446 - DNA, 15 bp, Homo sapiens
tttttacagggatta

SEQ ID NO: 111447 - DNA, 15 bp, Homo sapiens
gtttttacagggatt

SEQ ID NO: 111448 - DNA, 15 bp, Homo sapiens
agtttttacagggat

SEQ ID NO: 111449 - DNA, 15 bp, Homo sapiens
gagtttttacaggga

SEQ ID NO: 111450 - DNA, 15 bp, Homo sapiens
tgagtttttacaggg

SEQ ID NO: 111451 - DNA, 15 bp, Homo sapiens
ttgagtttttacagg

SEQ ID NO: 111452 - DNA, 15 bp, Homo sapiens
cttgagtttttacag

SEQ ID NO: 111453 - DNA, 15 bp, Homo sapiens
acttgagtttttaca

SEQ ID NO: 111454 - DNA, 15 bp, Homo sapiens
aacttgagtttttac

SEQ ID NO: 111455 - DNA, 15 bp, Homo sapiens
caacttgagttttta

SEQ ID NO: 111456 - DNA, 15 bp, Homo sapiens
acaacttgagttttt

SEQ ID NO: 111457 - DNA, 15 bp, Homo sapiens
aacaacttgagtttt

SEQ ID NO: 111458 - DNA, 15 bp, Homo sapiens
caacaacttgagttt

SEQ ID NO: 111459 - DNA, 15 bp, Homo sapiens
ccaacaacttgagtt

SEQ ID NO: 111460 - DNA, 15 bp, Homo sapiens
accaacaacttgagt

SEQ ID NO: 111461 - DNA, 15 bp, Homo sapiens
gaccaacaacttgag

SEQ ID NO: 111462 - DNA, 15 bp, Homo sapiens
ggaccaacaacttga

SEQ ID NO: 111463 - DNA, 15 bp, Homo sapiens
aggaccaacaacttg

SEQ ID NO: 111464 - DNA, 15 bp, Homo sapiens
aaggaccaacaactt

SEQ ID NO: 111465 - DNA, 15 bp, Homo sapiens
taaggaccaacaact

SEQ ID NO: 111466 - DNA, 15 bp, Homo sapiens
ctaaggaccaacaac

SEQ ID NO: 111467 - DNA, 15 bp, Homo sapiens
tctaaggaccaacaa

SEQ ID NO: 111468 - DNA, 15 bp, Homo sapiens
atctaaggaccaaca

SEQ ID NO: 111469 - DNA, 15 bp, Homo sapiens
aatctaaggaccaac

SEQ ID NO: 111470 - DNA, 15 bp, Homo sapiens
aaatctaaggaccaa

SEQ ID NO: 111471 - DNA, 15 bp, Homo sapiens
gaaatctaaggacca

SEQ ID NO: 111472 - DNA, 15 bp, Homo sapiens
agaaatctaaggacc

SEQ ID NO: 111473 - DNA, 15 bp, Homo sapiens
tagaaatctaaggac

SEQ ID NO: 111474 - DNA, 15 bp, Homo sapiens
ttagaaatctaagga

SEQ ID NO: 111475 - DNA, 15 bp, Homo sapiens
tttagaaatctaagg

SEQ ID NO: 111476 - DNA, 15 bp, Homo sapiens
atttagaaatctaag

SEQ ID NO: 111477 - DNA, 15 bp, Homo sapiens
aatttagaaatctaa

SEQ ID NO: 111478 - DNA, 15 bp, Homo sapiens
caatttagaaatcta

SEQ ID NO: 111479 - DNA, 15 bp, Homo sapiens
tcaatttagaaatct

SEQ ID NO: 111480 - DNA, 15 bp, Homo sapiens
ttcaatttagaaatc

SEQ ID NO: 111481 - DNA, 15 bp, Homo sapiens
gttcaatttagaaat

SEQ ID NO: 111482 - DNA, 15 bp, Homo sapiens
tgttcaatttagaaa

SEQ ID NO: 111483 - DNA, 15 bp, Homo sapiens
ctgttcaatttagaa

SEQ ID NO: 111484 - DNA, 15 bp, Homo sapiens
actgttcaatttaga

SEQ ID NO: 111485 - DNA, 15 bp, Homo sapiens
gactgttcaatttag

SEQ ID NO: 111486 - DNA, 15 bp, Homo sapiens
agactgttcaattta

SEQ ID NO: 111487 - DNA, 15 bp, Homo sapiens
tagactgttcaattt

SEQ ID NO: 111488 - DNA, 15 bp, Homo sapiens
gtagactgttcaatt

SEQ ID NO: 111489 - DNA, 15 bp, Homo sapiens
ggtagactgttcaat

SEQ ID NO: 111490 - DNA, 15 bp, Homo sapiens
cggtagactgttcaa

SEQ ID NO: 111491 - DNA, 15 bp, Homo sapiens
tcggtagactgttca

SEQ ID NO: 111492 - DNA, 15 bp, Homo sapiens
ctcggtagactgttc

SEQ ID NO: 111493 - DNA, 15 bp, Homo sapiens
tctcggtagactgtt

SEQ ID NO: 111494 - DNA, 15 bp, Homo sapiens
ttctcggtagactgt

SEQ ID NO: 111495 - DNA, 15 bp, Homo sapiens
tttctcggtagactg

SEQ ID NO: 111496 - DNA, 15 bp, Homo sapiens
atttctcggtagact

SEQ ID NO: 111497 - DNA, 15 bp, Homo sapiens
catttctcggtagac

SEQ ID NO: 111498 - DNA, 15 bp, Homo sapiens
acatttctcggtaga

SEQ ID NO: 111499 - DNA, 15 bp, Homo sapiens
aacatttctcggtag

SEQ ID NO: 111500 - DNA, 15 bp, Homo sapiens
taacatttctcggta

SEQ ID NO: 111501 - DNA, 15 bp, Homo sapiens
ttaacatttctcggt

SEQ ID NO: 111502 - DNA, 15 bp, Homo sapiens
tttaacatttctcgg

SEQ ID NO: 111503 - DNA, 15 bp, Homo sapiens
ttttaacatttctcg

SEQ ID NO: 111504 - DNA, 15 bp, Homo sapiens
gttttaacatttctc

SEQ ID NO: 111505 - DNA, 15 bp, Homo sapiens
tgttttaacatttct

SEQ ID NO: 111506 - DNA, 15 bp, Homo sapiens
atgttttaacatttc

SEQ ID NO: 111507 - DNA, 15 bp, Homo sapiens
gatgttttaacattt

SEQ ID NO: 111508 - DNA, 15 bp, Homo sapiens
tgatgttttaacatt

SEQ ID NO: 111509 - DNA, 15 bp, Homo sapiens
ctgatgttttaacat

SEQ ID NO: 111510 - DNA, 15 bp, Homo sapiens
cctgatgttttaaca

SEQ ID NO: 111511 - DNA, 15 bp, Homo sapiens
ccctgatgttttaac

SEQ ID NO: 111512 - DNA, 15 bp, Homo sapiens
gccctgatgttttaa

SEQ ID NO: 111513 - DNA, 15 bp, Homo sapiens
agccctgatgtttta

SEQ ID NO: 111514 - DNA, 15 bp, Homo sapiens
gagccctgatgtttt

SEQ ID NO: 111515 - DNA, 15 bp, Homo sapiens
agagccctgatgttt

SEQ ID NO: 111516 - DNA, 15 bp, Homo sapiens
tagagccctgatgtt

SEQ ID NO: 111517 - DNA, 15 bp, Homo sapiens
ctagagccctgatgt

SEQ ID NO: 111518 - DNA, 15 bp, Homo sapiens
actagagccctgatg

SEQ ID NO: 111519 - DNA, 15 bp, Homo sapiens
tactagagccctgat

SEQ ID NO: 111520 - DNA, 15 bp, Homo sapiens
ttactagagccctga

SEQ ID NO: 111521 - DNA, 15 bp, Homo sapiens
tttactagagccctg

SEQ ID NO: 111522 - DNA, 15 bp, Homo sapiens
atttactagagccct

SEQ ID NO: 111523 - DNA, 15 bp, Homo sapiens
tatttactagagccc

SEQ ID NO: 111524 - DNA, 15 bp, Homo sapiens
ttatttactagagcc

SEQ ID NO: 111525 - DNA, 15 bp, Homo sapiens
gttatttactagagc

SEQ ID NO: 111526 - DNA, 15 bp, Homo sapiens
ggttatttactagag

SEQ ID NO: 111527 - DNA, 15 bp, Homo sapiens
tggttatttactaga

SEQ ID NO: 111528 - DNA, 15 bp, Homo sapiens
ctggttatttactag

SEQ ID NO: 111529 - DNA, 15 bp, Homo sapiens
actggttatttacta

SEQ ID NO: 111530 - DNA, 15 bp, Homo sapiens
cactggttatttact

SEQ ID NO: 111531 - DNA, 15 bp, Homo sapiens
ccactggttatttac

SEQ ID NO: 111532 - DNA, 15 bp, Homo sapiens
gccactggttattta

SEQ ID NO: 111533 - DNA, 15 bp, Homo sapiens
tgccactggttattt

SEQ ID NO: 111534 - DNA, 15 bp, Homo sapiens
ttgccactggttatt

SEQ ID NO: 111535 - DNA, 15 bp, Homo sapiens
cttgccactggttat

SEQ ID NO: 111536 - DNA, 15 bp, Homo sapiens
tcttgccactggtta

SEQ ID NO: 111537 - DNA, 15 bp, Homo sapiens
ttcttgccactggtt

SEQ ID NO: 111538 - DNA, 15 bp, Homo sapiens
cttcttgccactggt

SEQ ID NO: 111539 - DNA, 15 bp, Homo sapiens
acttcttgccactgg

SEQ ID NO: 111540 - DNA, 15 bp, Homo sapiens
aacttcttgccactg

SEQ ID NO: 111541 - DNA, 15 bp, Homo sapiens
gaacttcttgccact

SEQ ID NO: 111542 - DNA, 15 bp, Homo sapiens
tgaacttcttgccac

SEQ ID NO: 111543 - DNA, 15 bp, Homo sapiens
gtgaacttcttgcca

SEQ ID NO: 111544 - DNA, 15 bp, Homo sapiens
tgtgaacttcttgcc

SEQ ID NO: 111545 - DNA, 15 bp, Homo sapiens
atgtgaacttcttgc

SEQ ID NO: 111546 - DNA, 15 bp, Homo sapiens
aatgtgaacttcttg

SEQ ID NO: 111547 - DNA, 15 bp, Homo sapiens
taatgtgaacttctt

SEQ ID NO: 111548 - DNA, 15 bp, Homo sapiens
ttaatgtgaacttct

SEQ ID NO: 111549 - DNA, 15 bp, Homo sapiens
attaatgtgaacttc

SEQ ID NO: 111550 - DNA, 15 bp, Homo sapiens
gattaatgtgaactt

SEQ ID NO: 111551 - DNA, 15 bp, Homo sapiens
agattaatgtgaact

SEQ ID NO: 111552 - DNA, 15 bp, Homo sapiens
tagattaatgtgaac

SEQ ID NO: 111553 - DNA, 15 bp, Homo sapiens
gtagattaatgtgaa

SEQ ID NO: 111554 - DNA, 15 bp, Homo sapiens
ggtagattaatgtga

SEQ ID NO: 111555 - DNA, 15 bp, Homo sapiens
tggtagattaatgtg

SEQ ID NO: 111556 - DNA, 15 bp, Homo sapiens
ctggtagattaatgt

SEQ ID NO: 111557 - DNA, 15 bp, Homo sapiens
cctggtagattaatg

SEQ ID NO: 111558 - DNA, 15 bp, Homo sapiens
tcctggtagattaat

SEQ ID NO: 111559 - DNA, 15 bp, Homo sapiens
atcctggtagattaa

SEQ ID NO: 111560 - DNA, 15 bp, Homo sapiens
aatcctggtagatta

SEQ ID NO: 111561 - DNA, 15 bp, Homo sapiens
aaatcctggtagatt

SEQ ID NO: 111562 - DNA, 15 bp, Homo sapiens
caaatcctggtagat

SEQ ID NO: 111563 - DNA, 15 bp, Homo sapiens
tcaaatcctggtaga

SEQ ID NO: 111564 - DNA, 15 bp, Homo sapiens
ttcaaatcctggtag

SEQ ID NO: 111565 - DNA, 15 bp, Homo sapiens
tttcaaatcctggta

SEQ ID NO: 111566 - DNA, 15 bp, Homo sapiens
atttcaaatcctggt

SEQ ID NO: 111567 - DNA, 15 bp, Homo sapiens
gatttcaaatcctgg

SEQ ID NO: 111568 - DNA, 15 bp, Homo sapiens
ggatttcaaatcctg

SEQ ID NO: 111569 - DNA, 15 bp, Homo sapiens
aggatttcaaatcct

SEQ ID NO: 111570 - DNA, 15 bp, Homo sapiens
caggatttcaaatcc

SEQ ID NO: 111571 - DNA, 15 bp, Homo sapiens
ccaggatttcaaatc

SEQ ID NO: 111572 - DNA, 15 bp, Homo sapiens
gccaggatttcaaat

SEQ ID NO: 111573 - DNA, 15 bp, Homo sapiens
tgccaggatttcaaa

SEQ ID NO: 111574 - DNA, 15 bp, Homo sapiens
ttgccaggatttcaa

SEQ ID NO: 111575 - DNA, 15 bp, Homo sapiens
cttgccaggatttca

SEQ ID NO: 111576 - DNA, 15 bp, Homo sapiens
tcttgccaggatttc

SEQ ID NO: 111577 - DNA, 15 bp, Homo sapiens
ttcttgccaggattt

SEQ ID NO: 111578 - DNA, 15 bp, Homo sapiens
tttcttgccaggatt

SEQ ID NO: 111579 - DNA, 15 bp, Homo sapiens
atttcttgccaggat

SEQ ID NO: 111580 - DNA, 15 bp, Homo sapiens
tatttcttgccagga

SEQ ID NO: 111581 - DNA, 15 bp, Homo sapiens
atatttcttgccagg

SEQ ID NO: 111582 - DNA, 15 bp, Homo sapiens
gatatttcttgccag

SEQ ID NO: 111583 - DNA, 15 bp, Homo sapiens
agatatttcttgcca

SEQ ID NO: 111584 - DNA, 15 bp, Homo sapiens
gagatatttcttgcc

SEQ ID NO: 111585 - DNA, 15 bp, Homo sapiens
agagatatttcttgc

SEQ ID NO: 111586 - DNA, 15 bp, Homo sapiens
tagagatatttcttg

SEQ ID NO: 111587 - DNA, 15 bp, Homo sapiens
ttagagatatttctt

SEQ ID NO: 111588 - DNA, 15 bp, Homo sapiens
attagagatatttct

SEQ ID NO: 111589 - DNA, 15 bp, Homo sapiens
aattagagatatttc

SEQ ID NO: 111590 - DNA, 15 bp, Homo sapiens
aaattagagatattt

SEQ ID NO: 111591 - DNA, 15 bp, Homo sapiens
caaattagagatatt

SEQ ID NO: 111592 - DNA, 15 bp, Homo sapiens
ccaaattagagatat

SEQ ID NO: 111593 - DNA, 15 bp, Homo sapiens
cccaaattagagata

SEQ ID NO: 111594 - DNA, 15 bp, Homo sapiens
gcccaaattagagat

SEQ ID NO: 111595 - DNA, 15 bp, Homo sapiens
tgcccaaattagaga

SEQ ID NO: 111596 - DNA, 15 bp, Homo sapiens
atgcccaaattagag

SEQ ID NO: 111597 - DNA, 15 bp, Homo sapiens
aatgcccaaattaga

SEQ ID NO: 111598 - DNA, 15 bp, Homo sapiens
aaatgcccaaattag

SEQ ID NO: 111599 - DNA, 15 bp, Homo sapiens
aaaatgcccaaatta

SEQ ID NO: 111600 - DNA, 15 bp, Homo sapiens
taaaatgcccaaatt

SEQ ID NO: 111601 - DNA, 15 bp, Homo sapiens
ctaaaatgcccaaat

SEQ ID NO: 111602 - DNA, 15 bp, Homo sapiens
actaaaatgcccaaa

SEQ ID NO: 111603 - DNA, 15 bp, Homo sapiens
cactaaaatgcccaa

SEQ ID NO: 111604 - DNA, 15 bp, Homo sapiens
tcactaaaatgccca

SEQ ID NO: 111605 - DNA, 15 bp, Homo sapiens
ttcactaaaatgccc

SEQ ID NO: 111606 - DNA, 15 bp, Homo sapiens
attcactaaaatgcc

SEQ ID NO: 111607 - DNA, 15 bp, Homo sapiens
gattcactaaaatgc

SEQ ID NO: 111608 - DNA, 15 bp, Homo sapiens
ggattcactaaaatg

SEQ ID NO: 111609 - DNA, 15 bp, Homo sapiens
tggattcactaaaat

SEQ ID NO: 111610 - DNA, 15 bp, Homo sapiens
aacccaggggtcatc

SEQ ID NO: 111611 - DNA, 15 bp, Homo sapiens
aaacccaggggtcat

SEQ ID NO: 111612 - DNA, 15 bp, Homo sapiens
gaaacccaggggtca

SEQ ID NO: 111613 - DNA, 15 bp, Homo sapiens
agaaacccaggggtc

SEQ ID NO: 111614 - DNA, 15 bp, Homo sapiens
cagaaacccaggggt

SEQ ID NO: 111615 - DNA, 15 bp, Homo sapiens
ccagaaacccagggg

SEQ ID NO: 111616 - DNA, 15 bp, Homo sapiens
gccagaaacccaggg

SEQ ID NO: 111617 - DNA, 15 bp, Homo sapiens
agccagaaacccagg

SEQ ID NO: 111618 - DNA, 15 bp, Homo sapiens
aagccagaaacccag

SEQ ID NO: 111619 - DNA, 15 bp, Homo sapiens
caagccagaaaccca

SEQ ID NO: 111620 - DNA, 15 bp, Homo sapiens
tcaagccagaaaccc

SEQ ID NO: 111621 - DNA, 15 bp, Homo sapiens
atcaagccagaaacc

SEQ ID NO: 111622 - DNA, 15 bp, Homo sapiens
catcaagccagaaac

SEQ ID NO: 111623 - DNA, 15 bp, Homo sapiens
tcatcaagccagaaa

SEQ ID NO: 111624 - DNA, 15 bp, Homo sapiens
atcatcaagccagaa

SEQ ID NO: 111625 - DNA, 15 bp, Homo sapiens
catcatcaagccaga

SEQ ID NO: 111626 - DNA, 15 bp, Homo sapiens
acatcatcaagccag

SEQ ID NO: 111627 - DNA, 15 bp, Homo sapiens
cacatcatcaagcca

SEQ ID NO: 111628 - DNA, 15 bp, Homo sapiens
ccacatcatcaagcc

SEQ ID NO: 111629 - DNA, 15 bp, Homo sapiens
tccacatcatcaagc

SEQ ID NO: 111630 - DNA, 15 bp, Homo sapiens
atccacatcatcaag

SEQ ID NO: 111631 - DNA, 15 bp, Homo sapiens
catccacatcatcaa

SEQ ID NO: 111632 - DNA, 15 bp, Homo sapiens
ccatccacatcatca

SEQ ID NO: 111633 - DNA, 15 bp, Homo sapiens
accatccacatcatc

SEQ ID NO: 111634 - DNA, 15 bp, Homo sapiens
caccatccacatcat

SEQ ID NO: 111635 - DNA, 15 bp, Homo sapiens
acaccatccacatca

SEQ ID NO: 111636 - DNA, 15 bp, Homo sapiens
cacaccatccacatc

SEQ ID NO: 111637 - DNA, 15 bp, Homo sapiens
ccacaccatccacat

SEQ ID NO: 111638 - DNA, 15 bp, Homo sapiens
gccacaccatccaca

SEQ ID NO: 111639 - DNA, 15 bp, Homo sapiens
ggccacaccatccac

SEQ ID NO: 111640 - DNA, 15 bp, Homo sapiens
tggccacaccatcca

SEQ ID NO: 111641 - DNA, 15 bp, Homo sapiens
atggccacaccatcc

SEQ ID NO: 111642 - DNA, 15 bp, Homo sapiens
aatggccacaccatc

SEQ ID NO: 111643 - DNA, 15 bp, Homo sapiens
caatggccacaccat

SEQ ID NO: 111644 - DNA, 15 bp, Homo sapiens
tcaatggccacacca

SEQ ID NO: 111645 - DNA, 15 bp, Homo sapiens
ctcaatggccacacc

SEQ ID NO: 111646 - DNA, 15 bp, Homo sapiens
tctcaatggccacac

SEQ ID NO: 111647 - DNA, 15 bp, Homo sapiens
atctcaatggccaca

SEQ ID NO: 111648 - DNA, 15 bp, Homo sapiens
catctcaatggccac

SEQ ID NO: 111649 - DNA, 15 bp, Homo sapiens
ccatctcaatggcca

SEQ ID NO: 111650 - DNA, 15 bp, Homo sapiens
cccatctcaatggcc

SEQ ID NO: 111651 - DNA, 15 bp, Homo sapiens
acccatctcaatggc

SEQ ID NO: 111652 - DNA, 15 bp, Homo sapiens
cacccatctcaatgg

SEQ ID NO: 111653 - DNA, 15 bp, Homo sapiens
gcacccatctcaatg

SEQ ID NO: 111654 - DNA, 15 bp, Homo sapiens
agcacccatctcaat

SEQ ID NO: 111655 - DNA, 15 bp, Homo sapiens
cagcacccatctcaa

SEQ ID NO: 111656 - DNA, 15 bp, Homo sapiens
acagcacccatctca

SEQ ID NO: 111657 - DNA, 15 bp, Homo sapiens
tacagcacccatctc

SEQ ID NO: 111658 - DNA, 15 bp, Homo sapiens
ttacagcacccatct

SEQ ID NO: 111659 - DNA, 15 bp, Homo sapiens
cttacagcacccatc

SEQ ID NO: 111660 - DNA, 15 bp, Homo sapiens
tcttacagcacccat

SEQ ID NO: 111661 - DNA, 15 bp, Homo sapiens
ttcttacagcaccca

SEQ ID NO: 111662 - DNA, 15 bp, Homo sapiens
tttcttacagcaccc

SEQ ID NO: 111663 - DNA, 15 bp, Homo sapiens
ttttcttacagcacc

SEQ ID NO: 111664 - DNA, 15 bp, Homo sapiens
cttttcttacagcac

SEQ ID NO: 111665 - DNA, 15 bp, Homo sapiens
tcttttcttacagca

SEQ ID NO: 111666 - DNA, 15 bp, Homo sapiens
atcttttcttacagc

SEQ ID NO: 111667 - DNA, 15 bp, Homo sapiens
tatcttttcttacag

SEQ ID NO: 111668 - DNA, 15 bp, Homo sapiens
ctatcttttcttaca

SEQ ID NO: 111669 - DNA, 15 bp, Homo sapiens
tctatcttttcttac

SEQ ID NO: 111670 - DNA, 15 bp, Homo sapiens
ctctatcttttctta

SEQ ID NO: 111671 - DNA, 15 bp, Homo sapiens
cctctatcttttctt

SEQ ID NO: 111672 - DNA, 15 bp, Homo sapiens
tcctctatcttttct

SEQ ID NO: 111673 - DNA, 15 bp, Homo sapiens
gtcctctatcttttc

SEQ ID NO: 111674 - DNA, 15 bp, Homo sapiens
ggtcctctatctttt

SEQ ID NO: 111675 - DNA, 15 bp, Homo sapiens
cggtcctctatcttt

SEQ ID NO: 111676 - DNA, 15 bp, Homo sapiens
ccggtcctctatctt

SEQ ID NO: 111677 - DNA, 15 bp, Homo sapiens
cccggtcctctatct

SEQ ID NO: 111678 - DNA, 15 bp, Homo sapiens
acccggtcctctatc

SEQ ID NO: 111679 - DNA, 15 bp, Homo sapiens
cacccggtcctctat

SEQ ID NO: 111680 - DNA, 15 bp, Homo sapiens
gcacccggtcctcta

SEQ ID NO: 111681 - DNA, 15 bp, Homo sapiens
cgcacccggtcctct

SEQ ID NO: 111682 - DNA, 15 bp, Homo sapiens
ccgcacccggtcctc

SEQ ID NO: 111683 - DNA, 15 bp, Homo sapiens
accgcacccggtcct

SEQ ID NO: 111684 - DNA, 15 bp, Homo sapiens
gaccgcacccggtcc

SEQ ID NO: 111685 - DNA, 15 bp, Homo sapiens
cgaccgcacccggtc

SEQ ID NO: 111686 - DNA, 15 bp, Homo sapiens
gcgaccgcacccggt

SEQ ID NO: 111687 - DNA, 15 bp, Homo sapiens
agcgaccgcacccgg

SEQ ID NO: 111688 - DNA, 15 bp, Homo sapiens
aagcgaccgcacccg

SEQ ID NO: 111689 - DNA, 15 bp, Homo sapiens
taagcgaccgcaccc

SEQ ID NO: 111690 - DNA, 15 bp, Homo sapiens
ataagcgaccgcacc

SEQ ID NO: 111691 - DNA, 15 bp, Homo sapiens
cataagcgaccgcac

SEQ ID NO: 111692 - DNA, 15 bp, Homo sapiens
gcataagcgaccgca

SEQ ID NO: 111693 - DNA, 15 bp, Homo sapiens
ggcataagcgaccgc

SEQ ID NO: 111694 - DNA, 15 bp, Homo sapiens
aggcataagcgaccg

SEQ ID NO: 111695 - DNA, 15 bp, Homo sapiens
caggcataagcgacc

SEQ ID NO: 111696 - DNA, 15 bp, Homo sapiens
acaggcataagcgac

SEQ ID NO: 111697 - DNA, 15 bp, Homo sapiens
tacaggcataagcga

SEQ ID NO: 111698 - DNA, 15 bp, Homo sapiens
ttacaggcataagcg

SEQ ID NO: 111699 - DNA, 15 bp, Homo sapiens
attacaggcataagc

SEQ ID NO: 111700 - DNA, 15 bp, Homo sapiens
gattacaggcataag

SEQ ID NO: 111701 - DNA, 15 bp, Homo sapiens
agattacaggcataa

SEQ ID NO: 111702 - DNA, 15 bp, Homo sapiens
aagattacaggcata

SEQ ID NO: 111703 - DNA, 15 bp, Homo sapiens
aaagattacaggcat

SEQ ID NO: 111704 - DNA, 15 bp, Homo sapiens
caaagattacaggca

SEQ ID NO: 111705 - DNA, 15 bp, Homo sapiens
gcaaagattacaggc

SEQ ID NO: 111706 - DNA, 15 bp, Homo sapiens
tgcaaagattacagg

SEQ ID NO: 111707 - DNA, 15 bp, Homo sapiens
gtgcaaagattacag

SEQ ID NO: 111708 - DNA, 15 bp, Homo sapiens
cgtgcaaagattaca

SEQ ID NO: 111709 - DNA, 15 bp, Homo sapiens
acgtgcaaagattac

SEQ ID NO: 111710 - DNA, 15 bp, Homo sapiens
aacgtgcaaagatta

SEQ ID NO: 111711 - DNA, 15 bp, Homo sapiens
caacgtgcaaagatt

SEQ ID NO: 111712 - DNA, 15 bp, Homo sapiens
ccaacgtgcaaagat

SEQ ID NO: 111713 - DNA, 15 bp, Homo sapiens
cccaacgtgcaaaga

SEQ ID NO: 111714 - DNA, 15 bp, Homo sapiens
tcccaacgtgcaaag

SEQ ID NO: 111715 - DNA, 15 bp, Homo sapiens
ctcccaacgtgcaaa

SEQ ID NO: 111716 - DNA, 15 bp, Homo sapiens
cctcccaacgtgcaa

SEQ ID NO: 111717 - DNA, 15 bp, Homo sapiens
gcctcccaacgtgca

SEQ ID NO: 111718 - DNA, 15 bp, Homo sapiens
ggcctcccaacgtgc

SEQ ID NO: 111719 - DNA, 15 bp, Homo sapiens
tggcctcccaacgtg

SEQ ID NO: 111720 - DNA, 15 bp, Homo sapiens
ttggcctcccaacgt

SEQ ID NO: 111721 - DNA, 15 bp, Homo sapiens
cttggcctcccaacg

SEQ ID NO: 111722 - DNA, 15 bp, Homo sapiens
ccttggcctcccaac

SEQ ID NO: 111723 - DNA, 15 bp, Homo sapiens
accaccttggcctcc

SEQ ID NO: 111724 - DNA, 15 bp, Homo sapiens
caccaccttggcctc

SEQ ID NO: 111725 - DNA, 15 bp, Homo sapiens
ccaccaccttggcct

SEQ ID NO: 111726 - DNA, 15 bp, Homo sapiens
tccaccaccttggcc

SEQ ID NO: 111727 - DNA, 15 bp, Homo sapiens
atccaccaccttggc

SEQ ID NO: 111728 - DNA, 15 bp, Homo sapiens
gatccaccaccttgg

SEQ ID NO: 111729 - DNA, 15 bp, Homo sapiens
tgatccaccaccttg

SEQ ID NO: 111730 - DNA, 15 bp, Homo sapiens
gtgatccaccacctt

SEQ ID NO: 111731 - DNA, 15 bp, Homo sapiens
ggtgatccaccacct

SEQ ID NO: 111732 - DNA, 15 bp, Homo sapiens
aggtgatccaccacc

SEQ ID NO: 111733 - DNA, 15 bp, Homo sapiens
caggtgatccaccac

SEQ ID NO: 111734 - DNA, 15 bp, Homo sapiens
tcaggtgatccacca

SEQ ID NO: 111735 - DNA, 15 bp, Homo sapiens
ctcaggtgatccacc

SEQ ID NO: 111736 - DNA, 15 bp, Homo sapiens
cctcaggtgatccac

SEQ ID NO: 111737 - DNA, 15 bp, Homo sapiens
acctcaggtgatcca

SEQ ID NO: 111738 - DNA, 15 bp, Homo sapiens
accaggctggtctca

SEQ ID NO: 111739 - DNA, 15 bp, Homo sapiens
gaccaggctggtctc

SEQ ID NO: 111740 - DNA, 15 bp, Homo sapiens
tgaccaggctggtct

SEQ ID NO: 111741 - DNA, 15 bp, Homo sapiens
ttgaccaggctggtc

SEQ ID NO: 111742 - DNA, 15 bp, Homo sapiens
gttgaccaggctggt

SEQ ID NO: 111743 - DNA, 15 bp, Homo sapiens
tgttgaccaggctgg

SEQ ID NO: 111744 - DNA, 15 bp, Homo sapiens
atgttgaccaggctg

SEQ ID NO: 111745 - DNA, 15 bp, Homo sapiens
catgttgaccaggct

SEQ ID NO: 111746 - DNA, 15 bp, Homo sapiens
ccatgttgaccaggc

SEQ ID NO: 111747 - DNA, 15 bp, Homo sapiens
gccatgttgaccagg

SEQ ID NO: 111748 - DNA, 15 bp, Homo sapiens
tgccatgttgaccag

SEQ ID NO: 111749 - DNA, 15 bp, Homo sapiens
ttgccatgttgacca

SEQ ID NO: 111750 - DNA, 15 bp, Homo sapiens
tttgccatgttgacc

SEQ ID NO: 111751 - DNA, 15 bp, Homo sapiens
ttttgccatgttgac

SEQ ID NO: 111752 - DNA, 15 bp, Homo sapiens
tttttgccatgttga

SEQ ID NO: 111753 - DNA, 15 bp, Homo sapiens
gtttttgccatgttg

SEQ ID NO: 111754 - DNA, 15 bp, Homo sapiens
ggtttttgccatgtt

SEQ ID NO: 111755 - DNA, 15 bp, Homo sapiens
gggtttttgccatgt

SEQ ID NO: 111756 - DNA, 15 bp, Homo sapiens
cgggtttttgccatg

SEQ ID NO: 111757 - DNA, 15 bp, Homo sapiens
acgggtttttgccat

SEQ ID NO: 111758 - DNA, 15 bp, Homo sapiens
gacgggtttttgcca

SEQ ID NO: 111759 - DNA, 15 bp, Homo sapiens
agacgggtttttgcc

SEQ ID NO: 111760 - DNA, 15 bp, Homo sapiens
gagacgggtttttgc

SEQ ID NO: 111761 - DNA, 15 bp, Homo sapiens
agagacgggtttttg

SEQ ID NO: 111762 - DNA, 15 bp, Homo sapiens
tagagacgggttttt

SEQ ID NO: 111763 - DNA, 15 bp, Homo sapiens
gtagagacgggtttt

SEQ ID NO: 111764 - DNA, 15 bp, Homo sapiens
agtagagacgggttt

SEQ ID NO: 111765 - DNA, 15 bp, Homo sapiens
gagtagagacgggtt

SEQ ID NO: 111766 - DNA, 15 bp, Homo sapiens
tgagtagagacgggt

SEQ ID NO: 111767 - DNA, 15 bp, Homo sapiens
ttgagtagagacggg

SEQ ID NO: 111768 - DNA, 15 bp, Homo sapiens
tttgagtagagacgg

SEQ ID NO: 111769 - DNA, 15 bp, Homo sapiens
ttttgagtagagacg

SEQ ID NO: 111770 - DNA, 15 bp, Homo sapiens
tttttgagtagagac

SEQ ID NO: 111771 - DNA, 15 bp, Homo sapiens
ttttttgagtagaga

SEQ ID NO: 111772 - DNA, 15 bp, Homo sapiens
tttttttgagtagag

SEQ ID NO: 111773 - DNA, 15 bp, Homo sapiens
ttttttttgagtaga

SEQ ID NO: 111774 - DNA, 15 bp, Homo sapiens
tttttttttgagtag

SEQ ID NO: 111775 - DNA, 15 bp, Homo sapiens
ttttttttttgagta

SEQ ID NO: 111776 - DNA, 15 bp, Homo sapiens
tttttttttttgagt

SEQ ID NO: 111777 - DNA, 15 bp, Homo sapiens
agctaattttttttt

SEQ ID NO: 111778 - DNA, 15 bp, Homo sapiens
cagctaatttttttt

SEQ ID NO: 111779 - DNA, 15 bp, Homo sapiens
tcagctaattttttt

SEQ ID NO: 111780 - DNA, 15 bp, Homo sapiens
ctcagctaatttttt

SEQ ID NO: 111781 - DNA, 15 bp, Homo sapiens
actcagctaattttt

SEQ ID NO: 111782 - DNA, 15 bp, Homo sapiens
cactcagctaatttt

SEQ ID NO: 111783 - DNA, 15 bp, Homo sapiens
acactcagctaattt

SEQ ID NO: 111784 - DNA, 15 bp, Homo sapiens
cacactcagctaatt

SEQ ID NO: 111785 - DNA, 15 bp, Homo sapiens
ccacactcagctaat

SEQ ID NO: 111786 - DNA, 15 bp, Homo sapiens
accacactcagctaa

SEQ ID NO: 111787 - DNA, 15 bp, Homo sapiens
taccacactcagcta

SEQ ID NO: 111788 - DNA, 15 bp, Homo sapiens
ctaccacactcagct

SEQ ID NO: 111789 - DNA, 15 bp, Homo sapiens
actaccacactcagc

SEQ ID NO: 111790 - DNA, 15 bp, Homo sapiens
tactaccacactcag

SEQ ID NO: 111791 - DNA, 15 bp, Homo sapiens
atactaccacactca

SEQ ID NO: 111792 - DNA, 15 bp, Homo sapiens
catactaccacactc

SEQ ID NO: 111793 - DNA, 15 bp, Homo sapiens
acatactaccacact

SEQ ID NO: 111794 - DNA, 15 bp, Homo sapiens
cacatactaccacac

SEQ ID NO: 111795 - DNA, 15 bp, Homo sapiens
gcacatactaccaca

SEQ ID NO: 111796 - DNA, 15 bp, Homo sapiens
ggcacatactaccac

SEQ ID NO: 111797 - DNA, 15 bp, Homo sapiens
aggcacatactacca

SEQ ID NO: 111798 - DNA, 15 bp, Homo sapiens
caggcacatactacc

SEQ ID NO: 111799 - DNA, 15 bp, Homo sapiens
acaggcacatactac

SEQ ID NO: 111800 - DNA, 15 bp, Homo sapiens
tacaggcacatacta

SEQ ID NO: 111801 - DNA, 15 bp, Homo sapiens
ttacaggcacatact

SEQ ID NO: 111802 - DNA, 15 bp, Homo sapiens
attacaggcacatac

SEQ ID NO: 111803 - DNA, 15 bp, Homo sapiens
gattacaggcacata

SEQ ID NO: 111804 - DNA, 15 bp, Homo sapiens
agcctcccaggttca

SEQ ID NO: 111805 - DNA, 15 bp, Homo sapiens
cagcctcccaggttc

SEQ ID NO: 111806 - DNA, 15 bp, Homo sapiens
tcagcctcccaggtt

SEQ ID NO: 111807 - DNA, 15 bp, Homo sapiens
aacctcagcctccca

SEQ ID NO: 111808 - DNA, 15 bp, Homo sapiens
caacctcagcctccc

SEQ ID NO: 111809 - DNA, 15 bp, Homo sapiens
gcaacctcagcctcc

SEQ ID NO: 111810 - DNA, 15 bp, Homo sapiens
tgcaacctcagcctc

SEQ ID NO: 111811 - DNA, 15 bp, Homo sapiens
ctgcaacctcagcct

SEQ ID NO: 111812 - DNA, 15 bp, Homo sapiens
actgcaacctcagcc

SEQ ID NO: 111813 - DNA, 15 bp, Homo sapiens
cactgcaacctcagc

SEQ ID NO: 111814 - DNA, 15 bp, Homo sapiens
tcactgcaacctcag

SEQ ID NO: 111815 - DNA, 15 bp, Homo sapiens
actcactgcaacctc

SEQ ID NO: 111816 - DNA, 15 bp, Homo sapiens
acaatcttgactcac

SEQ ID NO: 111817 - DNA, 15 bp, Homo sapiens
cacaatcttgactca

SEQ ID NO: 111818 - DNA, 15 bp, Homo sapiens
gcacaatcttgactc

SEQ ID NO: 111819 - DNA, 15 bp, Homo sapiens
ggcacaatcttgact

SEQ ID NO: 111820 - DNA, 15 bp, Homo sapiens
tggcacaatcttgac

SEQ ID NO: 111821 - DNA, 15 bp, Homo sapiens
gtggcacaatcttga

SEQ ID NO: 111822 - DNA, 15 bp, Homo sapiens
actcttgttgcccag

SEQ ID NO: 111823 - DNA, 15 bp, Homo sapiens
cactcttgttgccca

SEQ ID NO: 111824 - DNA, 15 bp, Homo sapiens
tcactcttgttgccc

SEQ ID NO: 111825 - DNA, 15 bp, Homo sapiens
ttcactcttgttgcc

SEQ ID NO: 111826 - DNA, 15 bp, Homo sapiens
tttcactcttgttgc

SEQ ID NO: 111827 - DNA, 15 bp, Homo sapiens
ttttcactcttgttg

SEQ ID NO: 111828 - DNA, 15 bp, Homo sapiens
gttttcactcttgtt

SEQ ID NO: 111829 - DNA, 15 bp, Homo sapiens
agttttcactcttgt

SEQ ID NO: 111830 - DNA, 15 bp, Homo sapiens
gagttttcactcttg

SEQ ID NO: 111831 - DNA, 15 bp, Homo sapiens
agagttttcactctt

SEQ ID NO: 111832 - DNA, 15 bp, Homo sapiens
cagagttttcactct

SEQ ID NO: 111833 - DNA, 15 bp, Homo sapiens
acagagttttcactc

SEQ ID NO: 111834 - DNA, 15 bp, Homo sapiens
gacagagttttcact

SEQ ID NO: 111835 - DNA, 15 bp, Homo sapiens
agacagagttttcac

SEQ ID NO: 111836 - DNA, 15 bp, Homo sapiens
gagacagagttttca

SEQ ID NO: 111837 - DNA, 15 bp, Homo sapiens
tgagacagagttttc

SEQ ID NO: 111838 - DNA, 15 bp, Homo sapiens
ctttttttttttttg

SEQ ID NO: 111839 - DNA, 15 bp, Homo sapiens
tctaccttttttttt

SEQ ID NO: 111840 - DNA, 15 bp, Homo sapiens
ttctacctttttttt

SEQ ID NO: 111841 - DNA, 15 bp, Homo sapiens
cttctaccttttttt

SEQ ID NO: 111842 - DNA, 15 bp, Homo sapiens
gcttctacctttttt

SEQ ID NO: 111843 - DNA, 15 bp, Homo sapiens
tgcttctaccttttt

SEQ ID NO: 111844 - DNA, 15 bp, Homo sapiens
atgcttctacctttt

SEQ ID NO: 111845 - DNA, 15 bp, Homo sapiens
catgcttctaccttt

SEQ ID NO: 111846 - DNA, 15 bp, Homo sapiens
gcatgcttctacctt

SEQ ID NO: 111847 - DNA, 15 bp, Homo sapiens
tgcatgcttctacct

SEQ ID NO: 111848 - DNA, 15 bp, Homo sapiens
ctgcatgcttctacc

SEQ ID NO: 111849 - DNA, 15 bp, Homo sapiens
tctgcatgcttctac

SEQ ID NO: 111850 - DNA, 15 bp, Homo sapiens
ttctgcatgcttcta

SEQ ID NO: 111851 - DNA, 15 bp, Homo sapiens
tttctgcatgcttct

SEQ ID NO: 111852 - DNA, 15 bp, Homo sapiens
atttctgcatgcttc

SEQ ID NO: 111853 - DNA, 15 bp, Homo sapiens
gatttctgcatgctt

SEQ ID NO: 111854 - DNA, 15 bp, Homo sapiens
tgatttctgcatgct

SEQ ID NO: 111855 - DNA, 15 bp, Homo sapiens
gtgatttctgcatgc

SEQ ID NO: 111856 - DNA, 15 bp, Homo sapiens
tgtgatttctgcatg

SEQ ID NO: 111857 - DNA, 15 bp, Homo sapiens
ctgtgatttctgcat

SEQ ID NO: 111858 - DNA, 15 bp, Homo sapiens
cctgtgatttctgca

SEQ ID NO: 111859 - DNA, 15 bp, Homo sapiens
acctgtgatttctgc

SEQ ID NO: 111860 - DNA, 15 bp, Homo sapiens
tacctgtgatttctg

SEQ ID NO: 111861 - DNA, 15 bp, Homo sapiens
atacctgtgatttct

SEQ ID NO: 111862 - DNA, 15 bp, Homo sapiens
catacctgtgatttc

SEQ ID NO: 111863 - DNA, 15 bp, Homo sapiens
acatacctgtgattt

SEQ ID NO: 111864 - DNA, 15 bp, Homo sapiens
tacatacctgtgatt

SEQ ID NO: 111865 - DNA, 15 bp, Homo sapiens
atacatacctgtgat

SEQ ID NO: 111866 - DNA, 15 bp, Homo sapiens
aatacatacctgtga

SEQ ID NO: 111867 - DNA, 15 bp, Homo sapiens
caatacatacctgtg

SEQ ID NO: 111868 - DNA, 15 bp, Homo sapiens
ccaatacatacctgt

SEQ ID NO: 111869 - DNA, 15 bp, Homo sapiens
tccaatacatacctg

SEQ ID NO: 111870 - DNA, 15 bp, Homo sapiens
gtccaatacatacct

SEQ ID NO: 111871 - DNA, 15 bp, Homo sapiens
tgtccaatacatacc

SEQ ID NO: 111872 - DNA, 15 bp, Homo sapiens
atgtccaatacatac

SEQ ID NO: 111873 - DNA, 15 bp, Homo sapiens
catgtccaatacata

SEQ ID NO: 111874 - DNA, 15 bp, Homo sapiens
acatgtccaatacat

SEQ ID NO: 111875 - DNA, 15 bp, Homo sapiens
aacatgtccaataca

SEQ ID NO: 111876 - DNA, 15 bp, Homo sapiens
caacatgtccaatac

SEQ ID NO: 111877 - DNA, 15 bp, Homo sapiens
tcaacatgtccaata

SEQ ID NO: 111878 - DNA, 15 bp, Homo sapiens
gtcaacatgtccaat

SEQ ID NO: 111879 - DNA, 15 bp, Homo sapiens
tgtcaacatgtccaa

SEQ ID NO: 111880 - DNA, 15 bp, Homo sapiens
atgtcaacatgtcca

SEQ ID NO: 111881 - DNA, 15 bp, Homo sapiens
aatgtcaacatgtcc

SEQ ID NO: 111882 - DNA, 15 bp, Homo sapiens
aaatgtcaacatgtc

SEQ ID NO: 111883 - DNA, 15 bp, Homo sapiens
aaaatgtcaacatgt

SEQ ID NO: 111884 - DNA, 15 bp, Homo sapiens
taaaatgtcaacatg

SEQ ID NO: 111885 - DNA, 15 bp, Homo sapiens
ttaaaatgtcaacat

SEQ ID NO: 111886 - DNA, 15 bp, Homo sapiens
cttaaaatgtcaaca

SEQ ID NO: 111887 - DNA, 15 bp, Homo sapiens
acttaaaatgtcaac

SEQ ID NO: 111888 - DNA, 15 bp, Homo sapiens
tacttaaaatgtcaa

SEQ ID NO: 111889 - DNA, 15 bp, Homo sapiens
gtacttaaaatgtca

SEQ ID NO: 111890 - DNA, 15 bp, Homo sapiens
ggtacttaaaatgtc

SEQ ID NO: 111891 - DNA, 15 bp, Homo sapiens
aggtacttaaaatgt

SEQ ID NO: 111892 - DNA, 15 bp, Homo sapiens
aaggtacttaaaatg

SEQ ID NO: 111893 - DNA, 15 bp, Homo sapiens
aaaggtacttaaaat

SEQ ID NO: 111894 - DNA, 15 bp, Homo sapiens
caaaggtacttaaaa

SEQ ID NO: 111895 - DNA, 15 bp, Homo sapiens
tcaaaggtacttaaa

SEQ ID NO: 111896 - DNA, 15 bp, Homo sapiens
ctcaaaggtacttaa

SEQ ID NO: 111897 - DNA, 15 bp, Homo sapiens
tctcaaaggtactta

SEQ ID NO: 111898 - DNA, 15 bp, Homo sapiens
ttctcaaaggtactt

SEQ ID NO: 111899 - DNA, 15 bp, Homo sapiens
attctcaaaggtact

SEQ ID NO: 111900 - DNA, 15 bp, Homo sapiens
cattctcaaaggtac

SEQ ID NO: 111901 - DNA, 15 bp, Homo sapiens
acattctcaaaggta

SEQ ID NO: 111902 - DNA, 15 bp, Homo sapiens
aacattctcaaaggt

SEQ ID NO: 111903 - DNA, 15 bp, Homo sapiens
taacattctcaaagg

SEQ ID NO: 111904 - DNA, 15 bp, Homo sapiens
ttaacattctcaaag

SEQ ID NO: 111905 - DNA, 15 bp, Homo sapiens
attaacattctcaaa

SEQ ID NO: 111906 - DNA, 15 bp, Homo sapiens
aattaacattctcaa

SEQ ID NO: 111907 - DNA, 15 bp, Homo sapiens
caattaacattctca

SEQ ID NO: 111908 - DNA, 15 bp, Homo sapiens
ccaattaacattctc

SEQ ID NO: 111909 - DNA, 15 bp, Homo sapiens
tccaattaacattct

SEQ ID NO: 111910 - DNA, 15 bp, Homo sapiens
ttccaattaacattc

SEQ ID NO: 111911 - DNA, 15 bp, Homo sapiens
tttccaattaacatt

SEQ ID NO: 111912 - DNA, 15 bp, Homo sapiens
atttccaattaacat

SEQ ID NO: 111913 - DNA, 15 bp, Homo sapiens
catttccaattaaca

SEQ ID NO: 111914 - DNA, 15 bp, Homo sapiens
acatttccaattaac

SEQ ID NO: 111915 - DNA, 15 bp, Homo sapiens
gacatttccaattaa

SEQ ID NO: 111916 - DNA, 15 bp, Homo sapiens
cgacatttccaatta

SEQ ID NO: 111917 - DNA, 15 bp, Homo sapiens
ccgacatttccaatt

SEQ ID NO: 111918 - DNA, 15 bp, Homo sapiens
cccgacatttccaat

SEQ ID NO: 111919 - DNA, 15 bp, Homo sapiens
acccgacatttccaa

SEQ ID NO: 111920 - DNA, 15 bp, Homo sapiens
tacccgacatttcca

SEQ ID NO: 111921 - DNA, 15 bp, Homo sapiens
gtacccgacatttcc

SEQ ID NO: 111922 - DNA, 15 bp, Homo sapiens
agtacccgacatttc

SEQ ID NO: 111923 - DNA, 15 bp, Homo sapiens
gagtacccgacattt

SEQ ID NO: 111924 - DNA, 15 bp, Homo sapiens
tgagtacccgacatt

SEQ ID NO: 111925 - DNA, 15 bp, Homo sapiens
gtgagtacccgacat

SEQ ID NO: 111926 - DNA, 15 bp, Homo sapiens
tgtgagtacccgaca

SEQ ID NO: 111927 - DNA, 15 bp, Homo sapiens
atgtgagtacccgac

SEQ ID NO: 111928 - DNA, 15 bp, Homo sapiens
catgtgagtacccga

SEQ ID NO: 111929 - DNA, 15 bp, Homo sapiens
tcatgtgagtacccg

SEQ ID NO: 111930 - DNA, 15 bp, Homo sapiens
atcatgtgagtaccc

SEQ ID NO: 111931 - DNA, 15 bp, Homo sapiens
aatcatgtgagtacc

SEQ ID NO: 111932 - DNA, 15 bp, Homo sapiens
taatcatgtgagtac

SEQ ID NO: 111933 - DNA, 15 bp, Homo sapiens
ataatcatgtgagta

SEQ ID NO: 111934 - DNA, 15 bp, Homo sapiens
aataatcatgtgagt

SEQ ID NO: 111935 - DNA, 15 bp, Homo sapiens
gaataatcatgtgag

SEQ ID NO: 111936 - DNA, 15 bp, Homo sapiens
tgaataatcatgtga

SEQ ID NO: 111937 - DNA, 15 bp, Homo sapiens
ctgaataatcatgtg

SEQ ID NO: 111938 - DNA, 15 bp, Homo sapiens
cctgaataatcatgt

SEQ ID NO: 111939 - DNA, 15 bp, Homo sapiens
acctgaataatcatg

SEQ ID NO: 111940 - DNA, 15 bp, Homo sapiens
gacctgaataatcat

SEQ ID NO: 111941 - DNA, 15 bp, Homo sapiens
agacctgaataatca

SEQ ID NO: 111942 - DNA, 15 bp, Homo sapiens
cagacctgaataatc

SEQ ID NO: 111943 - DNA, 15 bp, Homo sapiens
ccagacctgaataat

SEQ ID NO: 111944 - DNA, 15 bp, Homo sapiens
tccagacctgaataa

SEQ ID NO: 111945 - DNA, 15 bp, Homo sapiens
ctccagacctgaata

SEQ ID NO: 111946 - DNA, 15 bp, Homo sapiens
tctccagacctgaat

SEQ ID NO: 111947 - DNA, 15 bp, Homo sapiens
ttctccagacctgaa

SEQ ID NO: 111948 - DNA, 15 bp, Homo sapiens
attctccagacctga

SEQ ID NO: 111949 - DNA, 15 bp, Homo sapiens
tattctccagacctg

SEQ ID NO: 111950 - DNA, 15 bp, Homo sapiens
atattctccagacct

SEQ ID NO: 111951 - DNA, 15 bp, Homo sapiens
tatattctccagacc

SEQ ID NO: 111952 - DNA, 15 bp, Homo sapiens
atatattctccagac

SEQ ID NO: 111953 - DNA, 15 bp, Homo sapiens
gatatattctccaga

SEQ ID NO: 111954 - DNA, 15 bp, Homo sapiens
agatatattctccag

SEQ ID NO: 111955 - DNA, 15 bp, Homo sapiens
cagatatattctcca

SEQ ID NO: 111956 - DNA, 15 bp, Homo sapiens
ccagatatattctcc

SEQ ID NO: 111957 - DNA, 15 bp, Homo sapiens
tccagatatattctc

SEQ ID NO: 111958 - DNA, 15 bp, Homo sapiens
gtccagatatattct

SEQ ID NO: 111959 - DNA, 15 bp, Homo sapiens
agtccagatatattc

SEQ ID NO: 111960 - DNA, 15 bp, Homo sapiens
cagtccagatatatt

SEQ ID NO: 111961 - DNA, 15 bp, Homo sapiens
tcagtccagatatat

SEQ ID NO: 111962 - DNA, 15 bp, Homo sapiens
ttcagtccagatata

SEQ ID NO: 111963 - DNA, 15 bp, Homo sapiens
cttcagtccagatat

SEQ ID NO: 111964 - DNA, 15 bp, Homo sapiens
tcttcagtccagata

SEQ ID NO: 111965 - DNA, 15 bp, Homo sapiens
ctcttcagtccagat

SEQ ID NO: 111966 - DNA, 15 bp, Homo sapiens
cctcttcagtccaga

SEQ ID NO: 111967 - DNA, 15 bp, Homo sapiens
acctcttcagtccag

SEQ ID NO: 111968 - DNA, 15 bp, Homo sapiens
cacctcttcagtcca

SEQ ID NO: 111969 - DNA, 15 bp, Homo sapiens
ccacctcttcagtcc

SEQ ID NO: 111970 - DNA, 15 bp, Homo sapiens
tccacctcttcagtc

SEQ ID NO: 111971 - DNA, 15 bp, Homo sapiens
atccacctcttcagt

SEQ ID NO: 111972 - DNA, 15 bp, Homo sapiens
aatccacctcttcag

SEQ ID NO: 111973 - DNA, 15 bp, Homo sapiens
aaatccacctcttca

SEQ ID NO: 111974 - DNA, 15 bp, Homo sapiens
aaaatccacctcttc

SEQ ID NO: 111975 - DNA, 15 bp, Homo sapiens
taaaatccacctctt

SEQ ID NO: 111976 - DNA, 15 bp, Homo sapiens
ataaaatccacctct

SEQ ID NO: 111977 - DNA, 15 bp, Homo sapiens
cataaaatccacctc

SEQ ID NO: 111978 - DNA, 15 bp, Homo sapiens
tcataaaatccacct

SEQ ID NO: 111979 - DNA, 15 bp, Homo sapiens
ctcataaaatccacc

SEQ ID NO: 111980 - DNA, 15 bp, Homo sapiens
actcataaaatccac

SEQ ID NO: 111981 - DNA, 15 bp, Homo sapiens
gactcataaaatcca

SEQ ID NO: 111982 - DNA, 15 bp, Homo sapiens
tgactcataaaatcc

SEQ ID NO: 111983 - DNA, 15 bp, Homo sapiens
atgactcataaaatc

SEQ ID NO: 111984 - DNA, 15 bp, Homo sapiens
gatgactcataaaat

SEQ ID NO: 111985 - DNA, 15 bp, Homo sapiens
agatgactcataaaa

SEQ ID NO: 111986 - DNA, 15 bp, Homo sapiens
cagatgactcataaa

SEQ ID NO: 111987 - DNA, 15 bp, Homo sapiens
gcagatgactcataa

SEQ ID NO: 111988 - DNA, 15 bp, Homo sapiens
tgcagatgactcata

SEQ ID NO: 111989 - DNA, 15 bp, Homo sapiens
atgcagatgactcat

SEQ ID NO: 111990 - DNA, 15 bp, Homo sapiens
tatgcagatgactca

SEQ ID NO: 111991 - DNA, 15 bp, Homo sapiens
ctatgcagatgactc

SEQ ID NO: 111992 - DNA, 15 bp, Homo sapiens
tctatgcagatgact

SEQ ID NO: 111993 - DNA, 15 bp, Homo sapiens
ctctatgcagatgac

SEQ ID NO: 111994 - DNA, 15 bp, Homo sapiens
cctctatgcagatga

SEQ ID NO: 111995 - DNA, 15 bp, Homo sapiens
acctctatgcagatg

SEQ ID NO: 111996 - DNA, 15 bp, Homo sapiens
gacctctatgcagat

SEQ ID NO: 111997 - DNA, 15 bp, Homo sapiens
tgacctctatgcaga

SEQ ID NO: 111998 - DNA, 15 bp, Homo sapiens
atgacctctatgcag

SEQ ID NO: 111999 - DNA, 15 bp, Homo sapiens
tatgacctctatgca

SEQ ID NO: 112000 - DNA, 15 bp, Homo sapiens
ttatgacctctatgc

SEQ ID NO: 112001 - DNA, 15 bp, Homo sapiens
attatgacctctatg

SEQ ID NO: 112002 - DNA, 15 bp, Homo sapiens
aattatgacctctat

SEQ ID NO: 112003 - DNA, 15 bp, Homo sapiens
taattatgacctcta

SEQ ID NO: 112004 - DNA, 15 bp, Homo sapiens
ttaattatgacctct

SEQ ID NO: 112005 - DNA, 15 bp, Homo sapiens
tttaattatgacctc

SEQ ID NO: 112006 - DNA, 15 bp, Homo sapiens
ctttaattatgacct

SEQ ID NO: 112007 - DNA, 15 bp, Homo sapiens
actttaattatgacc

SEQ ID NO: 112008 - DNA, 15 bp, Homo sapiens
tactttaattatgac

SEQ ID NO: 112009 - DNA, 15 bp, Homo sapiens
ttactttaattatga

SEQ ID NO: 112010 - DNA, 15 bp, Homo sapiens
attactttaattatg

SEQ ID NO: 112011 - DNA, 15 bp, Homo sapiens
gattactttaattat

SEQ ID NO: 112012 - DNA, 15 bp, Homo sapiens
tgattactttaatta

SEQ ID NO: 112013 - DNA, 15 bp, Homo sapiens
ctgattactttaatt

SEQ ID NO: 112014 - DNA, 15 bp, Homo sapiens
cctgattactttaat

SEQ ID NO: 112015 - DNA, 15 bp, Homo sapiens
ccctgattactttaa

SEQ ID NO: 112016 - DNA, 15 bp, Homo sapiens
tccctgattacttta

SEQ ID NO: 112017 - DNA, 15 bp, Homo sapiens
atccctgattacttt

SEQ ID NO: 112018 - DNA, 15 bp, Homo sapiens
catccctgattactt

SEQ ID NO: 112019 - DNA, 15 bp, Homo sapiens
tcatccctgattact

SEQ ID NO: 112020 - DNA, 15 bp, Homo sapiens
atcatccctgattac

SEQ ID NO: 112021 - DNA, 15 bp, Homo sapiens
tatcatccctgatta

SEQ ID NO: 112022 - DNA, 15 bp, Homo sapiens
ctatcatccctgatt

SEQ ID NO: 112023 - DNA, 15 bp, Homo sapiens
tctatcatccctgat

SEQ ID NO: 112024 - DNA, 15 bp, Homo sapiens
atctatcatccctga

SEQ ID NO: 112025 - DNA, 15 bp, Homo sapiens
aatctatcatccctg

SEQ ID NO: 112026 - DNA, 15 bp, Homo sapiens
caatctatcatccct

SEQ ID NO: 112027 - DNA, 15 bp, Homo sapiens
acaatctatcatccc

SEQ ID NO: 112028 - DNA, 15 bp, Homo sapiens
gacaatctatcatcc

SEQ ID NO: 112029 - DNA, 15 bp, Homo sapiens
agacaatctatcatc

SEQ ID NO: 112030 - DNA, 15 bp, Homo sapiens
tagacaatctatcat

SEQ ID NO: 112031 - DNA, 15 bp, Homo sapiens
ctagacaatctatca

SEQ ID NO: 112032 - DNA, 15 bp, Homo sapiens
cctagacaatctatc

SEQ ID NO: 112033 - DNA, 15 bp, Homo sapiens
tcctagacaatctat

SEQ ID NO: 112034 - DNA, 15 bp, Homo sapiens
ttcctagacaatcta

SEQ ID NO: 112035 - DNA, 15 bp, Homo sapiens
gttcctagacaatct

SEQ ID NO: 112036 - DNA, 15 bp, Homo sapiens
tgttcctagacaatc

SEQ ID NO: 112037 - DNA, 15 bp, Homo sapiens
ctgttcctagacaat

SEQ ID NO: 112038 - DNA, 15 bp, Homo sapiens
cctgttcctagacaa

SEQ ID NO: 112039 - DNA, 15 bp, Homo sapiens
tcctgttcctagaca

SEQ ID NO: 112040 - DNA, 15 bp, Homo sapiens
atcctgttcctagac

SEQ ID NO: 112041 - DNA, 15 bp, Homo sapiens
tatcctgttcctaga

SEQ ID NO: 112042 - DNA, 15 bp, Homo sapiens
atatcctgttcctag

SEQ ID NO: 112043 - DNA, 15 bp, Homo sapiens
tatatcctgttccta

SEQ ID NO: 112044 - DNA, 15 bp, Homo sapiens
ctatatcctgttcct

SEQ ID NO: 112045 - DNA, 15 bp, Homo sapiens
actatatcctgttcc

SEQ ID NO: 112046 - DNA, 15 bp, Homo sapiens
cactatatcctgttc

SEQ ID NO: 112047 - DNA, 15 bp, Homo sapiens
tcactatatcctgtt

SEQ ID NO: 112048 - DNA, 15 bp, Homo sapiens
ttcactatatcctgt

SEQ ID NO: 112049 - DNA, 15 bp, Homo sapiens
tttcactatatcctg

SEQ ID NO: 112050 - DNA, 15 bp, Homo sapiens
ctttcactatatcct

SEQ ID NO: 112051 - DNA, 15 bp, Homo sapiens
tctttcactatatcc

SEQ ID NO: 112052 - DNA, 15 bp, Homo sapiens
ttctttcactatatc

SEQ ID NO: 112053 - DNA, 15 bp, Homo sapiens
cttctttcactatat

SEQ ID NO: 112054 - DNA, 15 bp, Homo sapiens
tcttctttcactata

SEQ ID NO: 112055 - DNA, 15 bp, Homo sapiens
ctcttctttcactat

SEQ ID NO: 112056 - DNA, 15 bp, Homo sapiens
cctcttctttcacta

SEQ ID NO: 112057 - DNA, 15 bp, Homo sapiens
ccctcttctttcact

SEQ ID NO: 112058 - DNA, 15 bp, Homo sapiens
gccctcttctttcac

SEQ ID NO: 112059 - DNA, 15 bp, Homo sapiens
ggccctcttctttca

SEQ ID NO: 112060 - DNA, 15 bp, Homo sapiens
gggccctcttctttc

SEQ ID NO: 112061 - DNA, 15 bp, Homo sapiens
agggccctcttcttt

SEQ ID NO: 112062 - DNA, 15 bp, Homo sapiens
gagggccctcttctt

SEQ ID NO: 112063 - DNA, 15 bp, Homo sapiens
tgagggccctcttct

SEQ ID NO: 112064 - DNA, 15 bp, Homo sapiens
ttgagggccctcttc

SEQ ID NO: 112065 - DNA, 15 bp, Homo sapiens
gttgagggccctctt

SEQ ID NO: 112066 - DNA, 15 bp, Homo sapiens
ggttgagggccctct

SEQ ID NO: 112067 - DNA, 15 bp, Homo sapiens
tggttgagggccctc

SEQ ID NO: 112068 - DNA, 15 bp, Homo sapiens
ttggttgagggccct

SEQ ID NO: 112069 - DNA, 15 bp, Homo sapiens
cttggttgagggccc

SEQ ID NO: 112070 - DNA, 15 bp, Homo sapiens
acttggttgagggcc

SEQ ID NO: 112071 - DNA, 15 bp, Homo sapiens
gacttggttgagggc

SEQ ID NO: 112072 - DNA, 15 bp, Homo sapiens
agacttggttgaggg

SEQ ID NO: 112073 - DNA, 15 bp, Homo sapiens
aagacttggttgagg

SEQ ID NO: 112074 - DNA, 15 bp, Homo sapiens
taagacttggttgag

SEQ ID NO: 112075 - DNA, 15 bp, Homo sapiens
ttaagacttggttga

SEQ ID NO: 112076 - DNA, 15 bp, Homo sapiens
cttaagacttggttg

SEQ ID NO: 112077 - DNA, 15 bp, Homo sapiens
tcttaagacttggtt

SEQ ID NO: 112078 - DNA, 15 bp, Homo sapiens
ttcttaagacttggt

SEQ ID NO: 112079 - DNA, 15 bp, Homo sapiens
attcttaagacttgg

SEQ ID NO: 112080 - DNA, 15 bp, Homo sapiens
aattcttaagacttg

SEQ ID NO: 112081 - DNA, 15 bp, Homo sapiens
taattcttaagactt

SEQ ID NO: 112082 - DNA, 15 bp, Homo sapiens
gtaattcttaagact

SEQ ID NO: 112083 - DNA, 15 bp, Homo sapiens
tgtaattcttaagac

SEQ ID NO: 112084 - DNA, 15 bp, Homo sapiens
atgtaattcttaaga

SEQ ID NO: 112085 - DNA, 15 bp, Homo sapiens
gatgtaattcttaag

SEQ ID NO: 112086 - DNA, 15 bp, Homo sapiens
tgatgtaattcttaa

SEQ ID NO: 112087 - DNA, 15 bp, Homo sapiens
atgatgtaattctta

SEQ ID NO: 112088 - DNA, 15 bp, Homo sapiens
aatgatgtaattctt

SEQ ID NO: 112089 - DNA, 15 bp, Homo sapiens
aaatgatgtaattct

SEQ ID NO: 112090 - DNA, 15 bp, Homo sapiens
taaatgatgtaattc

SEQ ID NO: 112091 - DNA, 15 bp, Homo sapiens
ctaaatgatgtaatt

SEQ ID NO: 112092 - DNA, 15 bp, Homo sapiens
actaaatgatgtaat

SEQ ID NO: 112093 - DNA, 15 bp, Homo sapiens
tactaaatgatgtaa

SEQ ID NO: 112094 - DNA, 15 bp, Homo sapiens
ttactaaatgatgta

SEQ ID NO: 112095 - DNA, 15 bp, Homo sapiens
cttactaaatgatgt

SEQ ID NO: 112096 - DNA, 15 bp, Homo sapiens
tcttactaaatgatg

SEQ ID NO: 112097 - DNA, 15 bp, Homo sapiens
ttcttactaaatgat

SEQ ID NO: 112098 - DNA, 15 bp, Homo sapiens
tttcttactaaatga

SEQ ID NO: 112099 - DNA, 15 bp, Homo sapiens
atttcttactaaatg

SEQ ID NO: 112100 - DNA, 15 bp, Homo sapiens
gatttcttactaaat

SEQ ID NO: 112101 - DNA, 15 bp, Homo sapiens
agatttcttactaaa

SEQ ID NO: 112102 - DNA, 15 bp, Homo sapiens
gagatttcttactaa

SEQ ID NO: 112103 - DNA, 15 bp, Homo sapiens
tgagatttcttacta

SEQ ID NO: 112104 - DNA, 15 bp, Homo sapiens
ctgagatttcttact

SEQ ID NO: 112105 - DNA, 15 bp, Homo sapiens
cctgagatttcttac

SEQ ID NO: 112106 - DNA, 15 bp, Homo sapiens
tcctgagatttctta

SEQ ID NO: 112107 - DNA, 15 bp, Homo sapiens
ttcctgagatttctt

SEQ ID NO: 112108 - DNA, 15 bp, Homo sapiens
cttcctgagatttct

SEQ ID NO: 112109 - DNA, 15 bp, Homo sapiens
tcttcctgagatttc

SEQ ID NO: 112110 - DNA, 15 bp, Homo sapiens
atcttcctgagattt

SEQ ID NO: 112111 - DNA, 15 bp, Homo sapiens
catcttcctgagatt

SEQ ID NO: 112112 - DNA, 15 bp, Homo sapiens
tcatcttcctgagat

SEQ ID NO: 112113 - DNA, 15 bp, Homo sapiens
ctcatcttcctgaga

SEQ ID NO: 112114 - DNA, 15 bp, Homo sapiens
gctcatcttcctgag

SEQ ID NO: 112115 - DNA, 15 bp, Homo sapiens
agctcatcttcctga

SEQ ID NO: 112116 - DNA, 15 bp, Homo sapiens
aagctcatcttcctg

SEQ ID NO: 112117 - DNA, 15 bp, Homo sapiens
caagctcatcttcct

SEQ ID NO: 112118 - DNA, 15 bp, Homo sapiens
gcaagctcatcttcc

SEQ ID NO: 112119 - DNA, 15 bp, Homo sapiens
tgcaagctcatcttc

SEQ ID NO: 112120 - DNA, 15 bp, Homo sapiens
ttgcaagctcatctt

SEQ ID NO: 112121 - DNA, 15 bp, Homo sapiens
tttgcaagctcatct

SEQ ID NO: 112122 - DNA, 15 bp, Homo sapiens
ttttgcaagctcatc

SEQ ID NO: 112123 - DNA, 15 bp, Homo sapiens
cttttgcaagctcat

SEQ ID NO: 112124 - DNA, 15 bp, Homo sapiens
tcttttgcaagctca

SEQ ID NO: 112125 - DNA, 15 bp, Homo sapiens
ttcttttgcaagctc

SEQ ID NO: 112126 - DNA, 15 bp, Homo sapiens
tttcttttgcaagct

SEQ ID NO: 112127 - DNA, 15 bp, Homo sapiens
gtttcttttgcaagc

SEQ ID NO: 112128 - DNA, 15 bp, Homo sapiens
agtttcttttgcaag

SEQ ID NO: 112129 - DNA, 15 bp, Homo sapiens
ttagtttcttttgca

SEQ ID NO: 112130 - DNA, 15 bp, Homo sapiens
attagtttcttttgc

SEQ ID NO: 112131 - DNA, 15 bp, Homo sapiens
cattagtttcttttg

SEQ ID NO: 112132 - DNA, 15 bp, Homo sapiens
acattagtttctttt

SEQ ID NO: 112133 - DNA, 15 bp, Homo sapiens
tacattagtttcttt

SEQ ID NO: 112134 - DNA, 15 bp, Homo sapiens
ttacattagtttctt

SEQ ID NO: 112135 - DNA, 15 bp, Homo sapiens
cttacattagtttct

SEQ ID NO: 112136 - DNA, 15 bp, Homo sapiens
acttacattagtttc

SEQ ID NO: 112137 - DNA, 15 bp, Homo sapiens
tacttacattagttt

SEQ ID NO: 112138 - DNA, 15 bp, Homo sapiens
ctacttacattagtt

SEQ ID NO: 112139 - DNA, 15 bp, Homo sapiens
gctacttacattagt

SEQ ID NO: 112140 - DNA, 15 bp, Homo sapiens
tgctacttacattag

SEQ ID NO: 112141 - DNA, 15 bp, Homo sapiens
ttgctacttacatta

SEQ ID NO: 112142 - DNA, 15 bp, Homo sapiens
cttgctacttacatt

SEQ ID NO: 112143 - DNA, 15 bp, Homo sapiens
tcttgctacttacat

SEQ ID NO: 112144 - DNA, 15 bp, Homo sapiens
ttcttgctacttaca

SEQ ID NO: 112145 - DNA, 15 bp, Homo sapiens
cttcttgctacttac

SEQ ID NO: 112146 - DNA, 15 bp, Homo sapiens
acttcttgctactta

SEQ ID NO: 112147 - DNA, 15 bp, Homo sapiens
cacttcttgctactt

SEQ ID NO: 112148 - DNA, 15 bp, Homo sapiens
ccacttcttgctact

SEQ ID NO: 112149 - DNA, 15 bp, Homo sapiens
accacttcttgctac

SEQ ID NO: 112150 - DNA, 15 bp, Homo sapiens
taccacttcttgcta

SEQ ID NO: 112151 - DNA, 15 bp, Homo sapiens
ctaccacttcttgct

SEQ ID NO: 112152 - DNA, 15 bp, Homo sapiens
cctaccacttcttgc

SEQ ID NO: 112153 - DNA, 15 bp, Homo sapiens
ccctaccacttcttg

SEQ ID NO: 112154 - DNA, 15 bp, Homo sapiens
tccctaccacttctt

SEQ ID NO: 112155 - DNA, 15 bp, Homo sapiens
gtccctaccacttct

SEQ ID NO: 112156 - DNA, 15 bp, Homo sapiens
tgtccctaccacttc

SEQ ID NO: 112157 - DNA, 15 bp, Homo sapiens
gtgtccctaccactt

SEQ ID NO: 112158 - DNA, 15 bp, Homo sapiens
tgtgtccctaccact

SEQ ID NO: 112159 - DNA, 15 bp, Homo sapiens
ctgtgtccctaccac

SEQ ID NO: 112160 - DNA, 15 bp, Homo sapiens
actgtgtccctacca

SEQ ID NO: 112161 - DNA, 15 bp, Homo sapiens
aactgtgtccctacc

SEQ ID NO: 112162 - DNA, 15 bp, Homo sapiens
caactgtgtccctac

SEQ ID NO: 112163 - DNA, 15 bp, Homo sapiens
tcaactgtgtcccta

SEQ ID NO: 112164 - DNA, 15 bp, Homo sapiens
ctcaactgtgtccct

SEQ ID NO: 112165 - DNA, 15 bp, Homo sapiens
actcaactgtgtccc

SEQ ID NO: 112166 - DNA, 15 bp, Homo sapiens
tactcaactgtgtcc

SEQ ID NO: 112167 - DNA, 15 bp, Homo sapiens
gtactcaactgtgtc

SEQ ID NO: 112168 - DNA, 15 bp, Homo sapiens
agtactcaactgtgt

SEQ ID NO: 112169 - DNA, 15 bp, Homo sapiens
tagtactcaactgtg

SEQ ID NO: 112170 - DNA, 15 bp, Homo sapiens
ctagtactcaactgt

SEQ ID NO: 112171 - DNA, 15 bp, Homo sapiens
cctagtactcaactg

SEQ ID NO: 112172 - DNA, 15 bp, Homo sapiens
acctagtactcaact

SEQ ID NO: 112173 - DNA, 15 bp, Homo sapiens
gacctagtactcaac

SEQ ID NO: 112174 - DNA, 15 bp, Homo sapiens
agacctagtactcaa

SEQ ID NO: 112175 - DNA, 15 bp, Homo sapiens
cagacctagtactca

SEQ ID NO: 112176 - DNA, 15 bp, Homo sapiens
ccagacctagtactc

SEQ ID NO: 112177 - DNA, 15 bp, Homo sapiens
tccagacctagtact

SEQ ID NO: 112178 - DNA, 15 bp, Homo sapiens
ttccagacctagtac

SEQ ID NO: 112179 - DNA, 15 bp, Homo sapiens
tttccagacctagta

SEQ ID NO: 112180 - DNA, 15 bp, Homo sapiens
ctttccagacctagt

SEQ ID NO: 112181 - DNA, 15 bp, Homo sapiens
gctttccagacctag

SEQ ID NO: 112182 - DNA, 15 bp, Homo sapiens
agctttccagaccta

SEQ ID NO: 112183 - DNA, 15 bp, Homo sapiens
tagctttccagacct

SEQ ID NO: 112184 - DNA, 15 bp, Homo sapiens
ctagctttccagacc

SEQ ID NO: 112185 - DNA, 15 bp, Homo sapiens
cctagctttccagac

SEQ ID NO: 112186 - DNA, 15 bp, Homo sapiens
ccctagctttccaga

SEQ ID NO: 112187 - DNA, 15 bp, Homo sapiens
cccctagctttccag

SEQ ID NO: 112188 - DNA, 15 bp, Homo sapiens
tcccctagctttcca

SEQ ID NO: 112189 - DNA, 15 bp, Homo sapiens
ttcccctagctttcc

SEQ ID NO: 112190 - DNA, 15 bp, Homo sapiens
cttcccctagctttc

SEQ ID NO: 112191 - DNA, 15 bp, Homo sapiens
tcttcccctagcttt

SEQ ID NO: 112192 - DNA, 15 bp, Homo sapiens
atcttcccctagctt

SEQ ID NO: 112193 - DNA, 15 bp, Homo sapiens
catcttcccctagct

SEQ ID NO: 112194 - DNA, 15 bp, Homo sapiens
ccatcttcccctagc

SEQ ID NO: 112195 - DNA, 15 bp, Homo sapiens
accatcttcccctag

SEQ ID NO: 112196 - DNA, 15 bp, Homo sapiens
taccatcttccccta

SEQ ID NO: 112197 - DNA, 15 bp, Homo sapiens
ataccatcttcccct

SEQ ID NO: 112198 - DNA, 15 bp, Homo sapiens
aataccatcttcccc

SEQ ID NO: 112199 - DNA, 15 bp, Homo sapiens
aaataccatcttccc

SEQ ID NO: 112200 - DNA, 15 bp, Homo sapiens
aaaataccatcttcc

SEQ ID NO: 112201 - DNA, 15 bp, Homo sapiens
caaaataccatcttc

SEQ ID NO: 112202 - DNA, 15 bp, Homo sapiens
tcaaaataccatctt

SEQ ID NO: 112203 - DNA, 15 bp, Homo sapiens
gtcaaaataccatct

SEQ ID NO: 112204 - DNA, 15 bp, Homo sapiens
tgtcaaaataccatc

SEQ ID NO: 112205 - DNA, 15 bp, Homo sapiens
ctgtcaaaataccat

SEQ ID NO: 112206 - DNA, 15 bp, Homo sapiens
tctgtcaaaatacca

SEQ ID NO: 112207 - DNA, 15 bp, Homo sapiens
ctctgtcaaaatacc

SEQ ID NO: 112208 - DNA, 15 bp, Homo sapiens
actctgtcaaaatac

SEQ ID NO: 112209 - DNA, 15 bp, Homo sapiens
cactctgtcaaaata

SEQ ID NO: 112210 - DNA, 15 bp, Homo sapiens
gcactctgtcaaaat

SEQ ID NO: 112211 - DNA, 15 bp, Homo sapiens
tgcactctgtcaaaa

SEQ ID NO: 112212 - DNA, 15 bp, Homo sapiens
ctgcactctgtcaaa

SEQ ID NO: 112213 - DNA, 15 bp, Homo sapiens
actgcactctgtcaa

SEQ ID NO: 112214 - DNA, 15 bp, Homo sapiens
aactgcactctgtca

SEQ ID NO: 112215 - DNA, 15 bp, Homo sapiens
taactgcactctgtc

SEQ ID NO: 112216 - DNA, 15 bp, Homo sapiens
gtaactgcactctgt

SEQ ID NO: 112217 - DNA, 15 bp, Homo sapiens
ggtaactgcactctg

SEQ ID NO: 112218 - DNA, 15 bp, Homo sapiens
aggtaactgcactct

SEQ ID NO: 112219 - DNA, 15 bp, Homo sapiens
caggtaactgcactc

SEQ ID NO: 112220 - DNA, 15 bp, Homo sapiens
acaggtaactgcact

SEQ ID NO: 112221 - DNA, 15 bp, Homo sapiens
aacaggtaactgcac

SEQ ID NO: 112222 - DNA, 15 bp, Homo sapiens
aaacaggtaactgca

SEQ ID NO: 112223 - DNA, 15 bp, Homo sapiens
aaaacaggtaactgc

SEQ ID NO: 112224 - DNA, 15 bp, Homo sapiens
caaaacaggtaactg

SEQ ID NO: 112225 - DNA, 15 bp, Homo sapiens
ccaaaacaggtaact

SEQ ID NO: 112226 - DNA, 15 bp, Homo sapiens
tccaaaacaggtaac

SEQ ID NO: 112227 - DNA, 15 bp, Homo sapiens
atccaaaacaggtaa

SEQ ID NO: 112228 - DNA, 15 bp, Homo sapiens
tatccaaaacaggta

SEQ ID NO: 112229 - DNA, 15 bp, Homo sapiens
atatccaaaacaggt

SEQ ID NO: 112230 - DNA, 15 bp, Homo sapiens
aatatccaaaacagg

SEQ ID NO: 112231 - DNA, 15 bp, Homo sapiens
aaatatccaaaacag

SEQ ID NO: 112232 - DNA, 15 bp, Homo sapiens
aaaatatccaaaaca

SEQ ID NO: 112233 - DNA, 15 bp, Homo sapiens
caaaatatccaaaac

SEQ ID NO: 112234 - DNA, 15 bp, Homo sapiens
tcaaaatatccaaaa

SEQ ID NO: 112235 - DNA, 15 bp, Homo sapiens
ttcaaaatatccaaa

SEQ ID NO: 112236 - DNA, 15 bp, Homo sapiens
tttcaaaatatccaa

SEQ ID NO: 112237 - DNA, 15 bp, Homo sapiens
ctttcaaaatatcca

SEQ ID NO: 112238 - DNA, 15 bp, Homo sapiens
actttcaaaatatcc

SEQ ID NO: 112239 - DNA, 15 bp, Homo sapiens
aactttcaaaatatc

SEQ ID NO: 112240 - DNA, 15 bp, Homo sapiens
taactttcaaaatat

SEQ ID NO: 112241 - DNA, 15 bp, Homo sapiens
ttaactttcaaaata

SEQ ID NO: 112242 - DNA, 15 bp, Homo sapiens
tttaactttcaaaat

SEQ ID NO: 112243 - DNA, 15 bp, Homo sapiens
atttaactttcaaaa

SEQ ID NO: 112244 - DNA, 15 bp, Homo sapiens
tatttaactttcaaa

SEQ ID NO: 112245 - DNA, 15 bp, Homo sapiens
atatttaactttcaa

SEQ ID NO: 112246 - DNA, 15 bp, Homo sapiens
catatttaactttca

SEQ ID NO: 112247 - DNA, 15 bp, Homo sapiens
tcatatttaactttc

SEQ ID NO: 112248 - DNA, 15 bp, Homo sapiens
atcatatttaacttt

SEQ ID NO: 112249 - DNA, 15 bp, Homo sapiens
catcatatttaactt

SEQ ID NO: 112250 - DNA, 15 bp, Homo sapiens
acatcatatttaact

SEQ ID NO: 112251 - DNA, 15 bp, Homo sapiens
gacatcatatttaac

SEQ ID NO: 112252 - DNA, 15 bp, Homo sapiens
ggacatcatatttaa

SEQ ID NO: 112253 - DNA, 15 bp, Homo sapiens
tggacatcatattta

SEQ ID NO: 112254 - DNA, 15 bp, Homo sapiens
gtggacatcatattt

SEQ ID NO: 112255 - DNA, 15 bp, Homo sapiens
tgtggacatcatatt

SEQ ID NO: 112256 - DNA, 15 bp, Homo sapiens
atgtggacatcatat

SEQ ID NO: 112257 - DNA, 15 bp, Homo sapiens
tatgtggacatcata

SEQ ID NO: 112258 - DNA, 15 bp, Homo sapiens
ttatgtggacatcat

SEQ ID NO: 112259 - DNA, 15 bp, Homo sapiens
tttatgtggacatca

SEQ ID NO: 112260 - DNA, 15 bp, Homo sapiens
gtttatgtggacatc

SEQ ID NO: 112261 - DNA, 15 bp, Homo sapiens
tgtttatgtggacat

SEQ ID NO: 112262 - DNA, 15 bp, Homo sapiens
atgtttatgtggaca

SEQ ID NO: 112263 - DNA, 15 bp, Homo sapiens
tatgtttatgtggac

SEQ ID NO: 112264 - DNA, 15 bp, Homo sapiens
atatgtttatgtgga

SEQ ID NO: 112265 - DNA, 15 bp, Homo sapiens
aatatgtttatgtgg

SEQ ID NO: 112266 - DNA, 15 bp, Homo sapiens
taatatgtttatgtg

SEQ ID NO: 112267 - DNA, 15 bp, Homo sapiens
ttaatatgtttatgt

SEQ ID NO: 112268 - DNA, 15 bp, Homo sapiens
attaatatgtttatg

SEQ ID NO: 112269 - DNA, 15 bp, Homo sapiens
aattaatatgtttat

SEQ ID NO: 112270 - DNA, 15 bp, Homo sapiens
taattaatatgttta

SEQ ID NO: 112271 - DNA, 15 bp, Homo sapiens
ctaattaatatgttt

SEQ ID NO: 112272 - DNA, 15 bp, Homo sapiens
tctaattaatatgtt

SEQ ID NO: 112273 - DNA, 15 bp, Homo sapiens
atctaattaatatgt

SEQ ID NO: 112274 - DNA, 15 bp, Homo sapiens
gatctaattaatatg

SEQ ID NO: 112275 - DNA, 15 bp, Homo sapiens
tgatctaattaatat

SEQ ID NO: 112276 - DNA, 15 bp, Homo sapiens
ctgatctaattaata

SEQ ID NO: 112277 - DNA, 15 bp, Homo sapiens
actgatctaattaat

SEQ ID NO: 112278 - DNA, 15 bp, Homo sapiens
aactgatctaattaa

SEQ ID NO: 112279 - DNA, 15 bp, Homo sapiens
caactgatctaatta

SEQ ID NO: 112280 - DNA, 15 bp, Homo sapiens
gcaactgatctaatt

SEQ ID NO: 112281 - DNA, 15 bp, Homo sapiens
ggcaactgatctaat

SEQ ID NO: 112282 - DNA, 15 bp, Homo sapiens
tggcaactgatctaa

SEQ ID NO: 112283 - DNA, 15 bp, Homo sapiens
atggcaactgatcta

SEQ ID NO: 112284 - DNA, 15 bp, Homo sapiens
aatggcaactgatct

SEQ ID NO: 112285 - DNA, 15 bp, Homo sapiens
caatggcaactgatc

SEQ ID NO: 112286 - DNA, 15 bp, Homo sapiens
ccaatggcaactgat

SEQ ID NO: 112287 - DNA, 15 bp, Homo sapiens
cccaatggcaactga

SEQ ID NO: 112288 - DNA, 15 bp, Homo sapiens
ccccaatggcaactg

SEQ ID NO: 112289 - DNA, 15 bp, Homo sapiens
accccaatggcaact

SEQ ID NO: 112290 - DNA, 15 bp, Homo sapiens
gaccccaatggcaac

SEQ ID NO: 112291 - DNA, 15 bp, Homo sapiens
tgaccccaatggcaa

SEQ ID NO: 112292 - DNA, 15 bp, Homo sapiens
atgaccccaatggca

SEQ ID NO: 112293 - DNA, 15 bp, Homo sapiens
aatgaccccaatggc

SEQ ID NO: 112294 - DNA, 15 bp, Homo sapiens
taatgaccccaatgg

SEQ ID NO: 112295 - DNA, 15 bp, Homo sapiens
ataatgaccccaatg

SEQ ID NO: 112296 - DNA, 15 bp, Homo sapiens
aataatgaccccaat

SEQ ID NO: 112297 - DNA, 15 bp, Homo sapiens
caataatgaccccaa

SEQ ID NO: 112298 - DNA, 15 bp, Homo sapiens
tcaataatgacccca

SEQ ID NO: 112299 - DNA, 15 bp, Homo sapiens
ttcaataatgacccc

SEQ ID NO: 112300 - DNA, 15 bp, Homo sapiens
gttcaataatgaccc

SEQ ID NO: 112301 - DNA, 15 bp, Homo sapiens
agttcaataatgacc

SEQ ID NO: 112302 - DNA, 15 bp, Homo sapiens
aagttcaataatgac

SEQ ID NO: 112303 - DNA, 15 bp, Homo sapiens
taagttcaataatga

SEQ ID NO: 112304 - DNA, 15 bp, Homo sapiens
ctaagttcaataatg

SEQ ID NO: 112305 - DNA, 15 bp, Homo sapiens
gctaagttcaataat

SEQ ID NO: 112306 - DNA, 15 bp, Homo sapiens
tgctaagttcaataa

SEQ ID NO: 112307 - DNA, 15 bp, Homo sapiens
ttgctaagttcaata

SEQ ID NO: 112308 - DNA, 15 bp, Homo sapiens
cttgctaagttcaat

SEQ ID NO: 112309 - DNA, 15 bp, Homo sapiens
ccttgctaagttcaa

SEQ ID NO: 112310 - DNA, 15 bp, Homo sapiens
cccttgctaagttca

SEQ ID NO: 112311 - DNA, 15 bp, Homo sapiens
gcccttgctaagttc

SEQ ID NO: 112312 - DNA, 15 bp, Homo sapiens
tgcccttgctaagtt

SEQ ID NO: 112313 - DNA, 15 bp, Homo sapiens
ttgcccttgctaagt

SEQ ID NO: 112314 - DNA, 15 bp, Homo sapiens
attgcccttgctaag

SEQ ID NO: 112315 - DNA, 15 bp, Homo sapiens
cattgcccttgctaa

SEQ ID NO: 112316 - DNA, 15 bp, Homo sapiens
acattgcccttgcta

SEQ ID NO: 112317 - DNA, 15 bp, Homo sapiens
gacattgcccttgct

SEQ ID NO: 112318 - DNA, 15 bp, Homo sapiens
agacattgcccttgc

SEQ ID NO: 112319 - DNA, 15 bp, Homo sapiens
cagacattgcccttg

SEQ ID NO: 112320 - DNA, 15 bp, Homo sapiens
ccagacattgccctt

SEQ ID NO: 112321 - DNA, 15 bp, Homo sapiens
cccagacattgccct

SEQ ID NO: 112322 - DNA, 15 bp, Homo sapiens
tcccagacattgccc

SEQ ID NO: 112323 - DNA, 15 bp, Homo sapiens
ctcccagacattgcc

SEQ ID NO: 112324 - DNA, 15 bp, Homo sapiens
actcccagacattgc

SEQ ID NO: 112325 - DNA, 15 bp, Homo sapiens
cactcccagacattg

SEQ ID NO: 112326 - DNA, 15 bp, Homo sapiens
tcactcccagacatt

SEQ ID NO: 112327 - DNA, 15 bp, Homo sapiens
atcactcccagacat

SEQ ID NO: 112328 - DNA, 15 bp, Homo sapiens
catcactcccagaca

SEQ ID NO: 112329 - DNA, 15 bp, Homo sapiens
ccatcactcccagac

SEQ ID NO: 112330 - DNA, 15 bp, Homo sapiens
accatcactcccaga

SEQ ID NO: 112331 - DNA, 15 bp, Homo sapiens
caccatcactcccag

SEQ ID NO: 112332 - DNA, 15 bp, Homo sapiens
ccaccatcactccca

SEQ ID NO: 112333 - DNA, 15 bp, Homo sapiens
accaccatcactccc

SEQ ID NO: 112334 - DNA, 15 bp, Homo sapiens
taccaccatcactcc

SEQ ID NO: 112335 - DNA, 15 bp, Homo sapiens
ctaccaccatcactc

SEQ ID NO: 112336 - DNA, 15 bp, Homo sapiens
tctaccaccatcact

SEQ ID NO: 112337 - DNA, 15 bp, Homo sapiens
ttctaccaccatcac

SEQ ID NO: 112338 - DNA, 15 bp, Homo sapiens
cttctaccaccatca

SEQ ID NO: 112339 - DNA, 15 bp, Homo sapiens
gcttctaccaccatc

SEQ ID NO: 112340 - DNA, 15 bp, Homo sapiens
ggcttctaccaccat

SEQ ID NO: 112341 - DNA, 15 bp, Homo sapiens
tggcttctaccacca

SEQ ID NO: 112342 - DNA, 15 bp, Homo sapiens
ctggcttctaccacc

SEQ ID NO: 112343 - DNA, 15 bp, Homo sapiens
tctggcttctaccac

SEQ ID NO: 112344 - DNA, 15 bp, Homo sapiens
ttctggcttctacca

SEQ ID NO: 112345 - DNA, 15 bp, Homo sapiens
attctggcttctacc

SEQ ID NO: 112346 - DNA, 15 bp, Homo sapiens
cattctggcttctac

SEQ ID NO: 112347 - DNA, 15 bp, Homo sapiens
ccattctggcttcta

SEQ ID NO: 112348 - DNA, 15 bp, Homo sapiens
gccattctggcttct

SEQ ID NO: 112349 - DNA, 15 bp, Homo sapiens
tgccattctggcttc

SEQ ID NO: 112350 - DNA, 15 bp, Homo sapiens
atgccattctggctt

SEQ ID NO: 112351 - DNA, 15 bp, Homo sapiens
catgccattctggct

SEQ ID NO: 112352 - DNA, 15 bp, Homo sapiens
ccatgccattctggc

SEQ ID NO: 112353 - DNA, 15 bp, Homo sapiens
gccatgccattctgg

SEQ ID NO: 112354 - DNA, 15 bp, Homo sapiens
agccatgccattctg

SEQ ID NO: 112355 - DNA, 15 bp, Homo sapiens
gagccatgccattct

SEQ ID NO: 112356 - DNA, 15 bp, Homo sapiens
tgagccatgccattc

SEQ ID NO: 112357 - DNA, 15 bp, Homo sapiens
ttgagccatgccatt

SEQ ID NO: 112358 - DNA, 15 bp, Homo sapiens
attgagccatgccat

SEQ ID NO: 112359 - DNA, 15 bp, Homo sapiens
gattgagccatgcca

SEQ ID NO: 112360 - DNA, 15 bp, Homo sapiens
ggattgagccatgcc

SEQ ID NO: 112361 - DNA, 15 bp, Homo sapiens
tggattgagccatgc

SEQ ID NO: 112362 - DNA, 15 bp, Homo sapiens
ttggattgagccatg

SEQ ID NO: 112363 - DNA, 15 bp, Homo sapiens
tttggattgagccat

SEQ ID NO: 112364 - DNA, 15 bp, Homo sapiens
ctttggattgagcca

SEQ ID NO: 112365 - DNA, 15 bp, Homo sapiens
tctttggattgagcc

SEQ ID NO: 112366 - DNA, 15 bp, Homo sapiens
atctttggattgagc

SEQ ID NO: 112367 - DNA, 15 bp, Homo sapiens
aatctttggattgag

SEQ ID NO: 112368 - DNA, 15 bp, Homo sapiens
caatctttggattga

SEQ ID NO: 112369 - DNA, 15 bp, Homo sapiens
acaatctttggattg

SEQ ID NO: 112370 - DNA, 15 bp, Homo sapiens
tacaatctttggatt

SEQ ID NO: 112371 - DNA, 15 bp, Homo sapiens
gtacaatctttggat

SEQ ID NO: 112372 - DNA, 15 bp, Homo sapiens
ggtacaatctttgga

SEQ ID NO: 112373 - DNA, 15 bp, Homo sapiens
tggtacaatctttgg

SEQ ID NO: 112374 - DNA, 15 bp, Homo sapiens
gtggtacaatctttg

SEQ ID NO: 112375 - DNA, 15 bp, Homo sapiens
ggtggtacaatcttt

SEQ ID NO: 112376 - DNA, 15 bp, Homo sapiens
gggtggtacaatctt

SEQ ID NO: 112377 - DNA, 15 bp, Homo sapiens
agggtggtacaatct

SEQ ID NO: 112378 - DNA, 15 bp, Homo sapiens
cagggtggtacaatc

SEQ ID NO: 112379 - DNA, 15 bp, Homo sapiens
ccagggtggtacaat

SEQ ID NO: 112380 - DNA, 15 bp, Homo sapiens
gccagggtggtacaa

SEQ ID NO: 112381 - DNA, 15 bp, Homo sapiens
ggccagggtggtaca

SEQ ID NO: 112382 - DNA, 15 bp, Homo sapiens
aggccagggtggtac

SEQ ID NO: 112383 - DNA, 15 bp, Homo sapiens
aaggccagggtggta

SEQ ID NO: 112384 - DNA, 15 bp, Homo sapiens
caaggccagggtggt

SEQ ID NO: 112385 - DNA, 15 bp, Homo sapiens
ccaaggccagggtgg

SEQ ID NO: 112386 - DNA, 15 bp, Homo sapiens
gccaaggccagggtg

SEQ ID NO: 112387 - DNA, 15 bp, Homo sapiens
ggccaaggccagggt

SEQ ID NO: 112388 - DNA, 15 bp, Homo sapiens
aggccaaggccaggg

SEQ ID NO: 112389 - DNA, 15 bp, Homo sapiens
aaggccaaggccagg

SEQ ID NO: 112390 - DNA, 15 bp, Homo sapiens
taaggccaaggccag

SEQ ID NO: 112391 - DNA, 15 bp, Homo sapiens
ttaaggccaaggcca

SEQ ID NO: 112392 - DNA, 15 bp, Homo sapiens
gttaaggccaaggcc

SEQ ID NO: 112393 - DNA, 15 bp, Homo sapiens
ggttaaggccaaggc

SEQ ID NO: 112394 - DNA, 15 bp, Homo sapiens
aggttaaggccaagg

SEQ ID NO: 112395 - DNA, 15 bp, Homo sapiens
gaggttaaggccaag

SEQ ID NO: 112396 - DNA, 15 bp, Homo sapiens
agaggttaaggccaa

SEQ ID NO: 112397 - DNA, 15 bp, Homo sapiens
aagaggttaaggcca

SEQ ID NO: 112398 - DNA, 15 bp, Homo sapiens
aaagaggttaaggcc

SEQ ID NO: 112399 - DNA, 15 bp, Homo sapiens
taaagaggttaaggc

SEQ ID NO: 112400 - DNA, 15 bp, Homo sapiens
ttaaagaggttaagg

SEQ ID NO: 112401 - DNA, 15 bp, Homo sapiens
cttaaagaggttaag

SEQ ID NO: 112402 - DNA, 15 bp, Homo sapiens
acttaaagaggttaa

SEQ ID NO: 112403 - DNA, 15 bp, Homo sapiens
aacttaaagaggtta

SEQ ID NO: 112404 - DNA, 15 bp, Homo sapiens
aaacttaaagaggtt

SEQ ID NO: 112405 - DNA, 15 bp, Homo sapiens
gaaacttaaagaggt

SEQ ID NO: 112406 - DNA, 15 bp, Homo sapiens
tgaaacttaaagagg

SEQ ID NO: 112407 - DNA, 15 bp, Homo sapiens
atgaaacttaaagag

SEQ ID NO: 112408 - DNA, 15 bp, Homo sapiens
aatgaaacttaaaga

SEQ ID NO: 112409 - DNA, 15 bp, Homo sapiens
aaatgaaacttaaag

SEQ ID NO: 112410 - DNA, 15 bp, Homo sapiens
aaaatgaaacttaaa

SEQ ID NO: 112411 - DNA, 15 bp, Homo sapiens
gaaaatgaaacttaa

SEQ ID NO: 112412 - DNA, 15 bp, Homo sapiens
tgaaaatgaaactta

SEQ ID NO: 112413 - DNA, 15 bp, Homo sapiens
atgaaaatgaaactt

SEQ ID NO: 112414 - DNA, 15 bp, Homo sapiens
aatgaaaatgaaact

SEQ ID NO: 112415 - DNA, 15 bp, Homo sapiens
taatgaaaatgaaac

SEQ ID NO: 112416 - DNA, 15 bp, Homo sapiens
ataatgaaaatgaaa

SEQ ID NO: 112417 - DNA, 15 bp, Homo sapiens
gataatgaaaatgaa

SEQ ID NO: 112418 - DNA, 15 bp, Homo sapiens
ggataatgaaaatga

SEQ ID NO: 112419 - DNA, 15 bp, Homo sapiens
tggataatgaaaatg

SEQ ID NO: 112420 - DNA, 15 bp, Homo sapiens
atggataatgaaaat

SEQ ID NO: 112421 - DNA, 15 bp, Homo sapiens
tatggataatgaaaa

SEQ ID NO: 112422 - DNA, 15 bp, Homo sapiens
ttatggataatgaaa

SEQ ID NO: 112423 - DNA, 15 bp, Homo sapiens
tttatggataatgaa

SEQ ID NO: 112424 - DNA, 15 bp, Homo sapiens
ctttatggataatga

SEQ ID NO: 112425 - DNA, 15 bp, Homo sapiens
actttatggataatg

SEQ ID NO: 112426 - DNA, 15 bp, Homo sapiens
tactttatggataat

SEQ ID NO: 112427 - DNA, 15 bp, Homo sapiens
ctactttatggataa

SEQ ID NO: 112428 - DNA, 15 bp, Homo sapiens
tttctactttatgga

SEQ ID NO: 112429 - DNA, 15 bp, Homo sapiens
ctttctactttatgg

SEQ ID NO: 112430 - DNA, 15 bp, Homo sapiens
tctttctactttatg

SEQ ID NO: 112431 - DNA, 15 bp, Homo sapiens
ctctttctactttat

SEQ ID NO: 112432 - DNA, 15 bp, Homo sapiens
cctctttctacttta

SEQ ID NO: 112433 - DNA, 15 bp, Homo sapiens
gcctctttctacttt

SEQ ID NO: 112434 - DNA, 15 bp, Homo sapiens
agcctctttctactt

SEQ ID NO: 112435 - DNA, 15 bp, Homo sapiens
aagcctctttctact

SEQ ID NO: 112436 - DNA, 15 bp, Homo sapiens
aaagcctctttctac

SEQ ID NO: 112437 - DNA, 15 bp, Homo sapiens
caaagcctctttcta

SEQ ID NO: 112438 - DNA, 15 bp, Homo sapiens
acaaagcctctttct

SEQ ID NO: 112439 - DNA, 15 bp, Homo sapiens
cacaaagcctctttc

SEQ ID NO: 112440 - DNA, 15 bp, Homo sapiens
tcacaaagcctcttt

SEQ ID NO: 112441 - DNA, 15 bp, Homo sapiens
ttcacaaagcctctt

SEQ ID NO: 112442 - DNA, 15 bp, Homo sapiens
attcacaaagcctct

SEQ ID NO: 112443 - DNA, 15 bp, Homo sapiens
aattcacaaagcctc

SEQ ID NO: 112444 - DNA, 15 bp, Homo sapiens
aaattcacaaagcct

SEQ ID NO: 112445 - DNA, 15 bp, Homo sapiens
aaaattcacaaagcc

SEQ ID NO: 112446 - DNA, 15 bp, Homo sapiens
taaaattcacaaagc

SEQ ID NO: 112447 - DNA, 15 bp, Homo sapiens
ataaaattcacaaag

SEQ ID NO: 112448 - DNA, 15 bp, Homo sapiens
aataaaattcacaaa

SEQ ID NO: 112449 - DNA, 15 bp, Homo sapiens
caataaaattcacaa

SEQ ID NO: 112450 - DNA, 15 bp, Homo sapiens
gcaataaaattcaca

SEQ ID NO: 112451 - DNA, 15 bp, Homo sapiens
tgcaataaaattcac

SEQ ID NO: 112452 - DNA, 15 bp, Homo sapiens
atgcaataaaattca

SEQ ID NO: 112453 - DNA, 15 bp, Homo sapiens
tatgcaataaaattc

SEQ ID NO: 112454 - DNA, 15 bp, Homo sapiens
gtatgcaataaaatt

SEQ ID NO: 112455 - DNA, 15 bp, Homo sapiens
cgtatgcaataaaat

SEQ ID NO: 112456 - DNA, 15 bp, Homo sapiens
acgtatgcaataaaa

SEQ ID NO: 112457 - DNA, 15 bp, Homo sapiens
cacgtatgcaataaa

SEQ ID NO: 112458 - DNA, 15 bp, Homo sapiens
acacgtatgcaataa

SEQ ID NO: 112459 - DNA, 15 bp, Homo sapiens
cacacgtatgcaata

SEQ ID NO: 112460 - DNA, 15 bp, Homo sapiens
acacacgtatgcaat

SEQ ID NO: 112461 - DNA, 15 bp, Homo sapiens
tacacacgtatgcaa

SEQ ID NO: 112462 - DNA, 15 bp, Homo sapiens
ttacacacgtatgca

SEQ ID NO: 112463 - DNA, 15 bp, Homo sapiens
cttacacacgtatgc

SEQ ID NO: 112464 - DNA, 15 bp, Homo sapiens
tcttacacacgtatg

SEQ ID NO: 112465 - DNA, 15 bp, Homo sapiens
atcttacacacgtat

SEQ ID NO: 112466 - DNA, 15 bp, Homo sapiens
aatcttacacacgta

SEQ ID NO: 112467 - DNA, 15 bp, Homo sapiens
gaatcttacacacgt

SEQ ID NO: 112468 - DNA, 15 bp, Homo sapiens
ggaatcttacacacg

SEQ ID NO: 112469 - DNA, 15 bp, Homo sapiens
aggaatcttacacac

SEQ ID NO: 112470 - DNA, 15 bp, Homo sapiens
aaggaatcttacaca

SEQ ID NO: 112471 - DNA, 15 bp, Homo sapiens
taaggaatcttacac

SEQ ID NO: 112472 - DNA, 15 bp, Homo sapiens
ctaaggaatcttaca

SEQ ID NO: 112473 - DNA, 15 bp, Homo sapiens
gctaaggaatcttac

SEQ ID NO: 112474 - DNA, 15 bp, Homo sapiens
tgctaaggaatctta

SEQ ID NO: 112475 - DNA, 15 bp, Homo sapiens
gtgctaaggaatctt

SEQ ID NO: 112476 - DNA, 15 bp, Homo sapiens
tgtgctaaggaatct

SEQ ID NO: 112477 - DNA, 15 bp, Homo sapiens
ttgtgctaaggaatc

SEQ ID NO: 112478 - DNA, 15 bp, Homo sapiens
gttgtgctaaggaat

SEQ ID NO: 112479 - DNA, 15 bp, Homo sapiens
tgttgtgctaaggaa

SEQ ID NO: 112480 - DNA, 15 bp, Homo sapiens
gtgttgtgctaagga

SEQ ID NO: 112481 - DNA, 15 bp, Homo sapiens
cgtgttgtgctaagg

SEQ ID NO: 112482 - DNA, 15 bp, Homo sapiens
ccgtgttgtgctaag

SEQ ID NO: 112483 - DNA, 15 bp, Homo sapiens
tccgtgttgtgctaa

SEQ ID NO: 112484 - DNA, 15 bp, Homo sapiens
ttccgtgttgtgcta

SEQ ID NO: 112485 - DNA, 15 bp, Homo sapiens
cttccgtgttgtgct

SEQ ID NO: 112486 - DNA, 15 bp, Homo sapiens
gcttccgtgttgtgc

SEQ ID NO: 112487 - DNA, 15 bp, Homo sapiens
agcttccgtgttgtg

SEQ ID NO: 112488 - DNA, 15 bp, Homo sapiens
cagcttccgtgttgt

SEQ ID NO: 112489 - DNA, 15 bp, Homo sapiens
acagcttccgtgttg

SEQ ID NO: 112490 - DNA, 15 bp, Homo sapiens
tacagcttccgtgtt

SEQ ID NO: 112491 - DNA, 15 bp, Homo sapiens
atacagcttccgtgt

SEQ ID NO: 112492 - DNA, 15 bp, Homo sapiens
aatacagcttccgtg

SEQ ID NO: 112493 - DNA, 15 bp, Homo sapiens
taatacagcttccgt

SEQ ID NO: 112494 - DNA, 15 bp, Homo sapiens
ttaatacagcttccg

SEQ ID NO: 112495 - DNA, 15 bp, Homo sapiens
cttaatacagcttcc

SEQ ID NO: 112496 - DNA, 15 bp, Homo sapiens
tcttaatacagcttc

SEQ ID NO: 112497 - DNA, 15 bp, Homo sapiens
ctcttaatacagctt

SEQ ID NO: 112498 - DNA, 15 bp, Homo sapiens
gctcttaatacagct

SEQ ID NO: 112499 - DNA, 15 bp, Homo sapiens
agctcttaatacagc

SEQ ID NO: 112500 - DNA, 15 bp, Homo sapiens
aagctcttaatacag

SEQ ID NO: 112501 - DNA, 15 bp, Homo sapiens
caagctcttaataca

SEQ ID NO: 112502 - DNA, 15 bp, Homo sapiens
ccaagctcttaatac

SEQ ID NO: 112503 - DNA, 15 bp, Homo sapiens
accaagctcttaata

SEQ ID NO: 112504 - DNA, 15 bp, Homo sapiens
taccaagctcttaat

SEQ ID NO: 112505 - DNA, 15 bp, Homo sapiens
ttaccaagctcttaa

SEQ ID NO: 112506 - DNA, 15 bp, Homo sapiens
tttaccaagctctta

SEQ ID NO: 112507 - DNA, 15 bp, Homo sapiens
atttaccaagctctt

SEQ ID NO: 112508 - DNA, 15 bp, Homo sapiens
catttaccaagctct

SEQ ID NO: 112509 - DNA, 15 bp, Homo sapiens
acatttaccaagctc

SEQ ID NO: 112510 - DNA, 15 bp, Homo sapiens
aacatttaccaagct

SEQ ID NO: 112511 - DNA, 15 bp, Homo sapiens
taacatttaccaagc

SEQ ID NO: 112512 - DNA, 15 bp, Homo sapiens
ctaacatttaccaag

SEQ ID NO: 112513 - DNA, 15 bp, Homo sapiens
actaacatttaccaa

SEQ ID NO: 112514 - DNA, 15 bp, Homo sapiens
aactaacatttacca

SEQ ID NO: 112515 - DNA, 15 bp, Homo sapiens
taactaacatttacc

SEQ ID NO: 112516 - DNA, 15 bp, Homo sapiens
ttaactaacatttac

SEQ ID NO: 112517 - DNA, 15 bp, Homo sapiens
cttaactaacattta

SEQ ID NO: 112518 - DNA, 15 bp, Homo sapiens
acttaactaacattt

SEQ ID NO: 112519 - DNA, 15 bp, Homo sapiens
aacttaactaacatt

SEQ ID NO: 112520 - DNA, 15 bp, Homo sapiens
gaacttaactaacat

SEQ ID NO: 112521 - DNA, 15 bp, Homo sapiens
tgaacttaactaaca

SEQ ID NO: 112522 - DNA, 15 bp, Homo sapiens
atgaacttaactaac

SEQ ID NO: 112523 - DNA, 15 bp, Homo sapiens
aatgaacttaactaa

SEQ ID NO: 112524 - DNA, 15 bp, Homo sapiens
aaatgaacttaacta

SEQ ID NO: 112525 - DNA, 15 bp, Homo sapiens
caaatgaacttaact

SEQ ID NO: 112526 - DNA, 15 bp, Homo sapiens
acaaatgaacttaac

SEQ ID NO: 112527 - DNA, 15 bp, Homo sapiens
aacaaatgaacttaa

SEQ ID NO: 112528 - DNA, 15 bp, Homo sapiens
aaacaaatgaactta

SEQ ID NO: 112529 - DNA, 15 bp, Homo sapiens
aaaacaaatgaactt

SEQ ID NO: 112530 - DNA, 15 bp, Homo sapiens
gaaaacaaatgaact

SEQ ID NO: 112531 - DNA, 15 bp, Homo sapiens
agaaaacaaatgaac

SEQ ID NO: 112532 - DNA, 15 bp, Homo sapiens
cagaaaacaaatgaa

SEQ ID NO: 112533 - DNA, 15 bp, Homo sapiens
acagaaaacaaatga

SEQ ID NO: 112534 - DNA, 15 bp, Homo sapiens
gacagaaaacaaatg

SEQ ID NO: 112535 - DNA, 15 bp, Homo sapiens
tgacagaaaacaaat

SEQ ID NO: 112536 - DNA, 15 bp, Homo sapiens
ttgacagaaaacaaa

SEQ ID NO: 112537 - DNA, 15 bp, Homo sapiens
gttgacagaaaacaa

SEQ ID NO: 112538 - DNA, 15 bp, Homo sapiens
tgttgacagaaaaca

SEQ ID NO: 112539 - DNA, 15 bp, Homo sapiens
ttgttgacagaaaac

SEQ ID NO: 112540 - DNA, 15 bp, Homo sapiens
gttgttgacagaaaa

SEQ ID NO: 112541 - DNA, 15 bp, Homo sapiens
tgttgttgacagaaa

SEQ ID NO: 112542 - DNA, 15 bp, Homo sapiens
ttgttgttgacagaa

SEQ ID NO: 112543 - DNA, 15 bp, Homo sapiens
attgttgttgacaga

SEQ ID NO: 112544 - DNA, 15 bp, Homo sapiens
cattgttgttgacag

SEQ ID NO: 112545 - DNA, 15 bp, Homo sapiens
tcattgttgttgaca

SEQ ID NO: 112546 - DNA, 15 bp, Homo sapiens
ctcattgttgttgac

SEQ ID NO: 112547 - DNA, 15 bp, Homo sapiens
tctcattgttgttga

SEQ ID NO: 112548 - DNA, 15 bp, Homo sapiens
ctctcattgttgttg

SEQ ID NO: 112549 - DNA, 15 bp, Homo sapiens
gctctcattgttgtt

SEQ ID NO: 112550 - DNA, 15 bp, Homo sapiens
tgctctcattgttgt

SEQ ID NO: 112551 - DNA, 15 bp, Homo sapiens
ttgctctcattgttg

SEQ ID NO: 112552 - DNA, 15 bp, Homo sapiens
tttgctctcattgtt

SEQ ID NO: 112553 - DNA, 15 bp, Homo sapiens
ttttgctctcattgt

SEQ ID NO: 112554 - DNA, 15 bp, Homo sapiens
attttgctctcattg

SEQ ID NO: 112555 - DNA, 15 bp, Homo sapiens
tattttgctctcatt

SEQ ID NO: 112556 - DNA, 15 bp, Homo sapiens
ttattttgctctcat

SEQ ID NO: 112557 - DNA, 15 bp, Homo sapiens
attattttgctctca

SEQ ID NO: 112558 - DNA, 15 bp, Homo sapiens
tattattttgctctc

SEQ ID NO: 112559 - DNA, 15 bp, Homo sapiens
ttattattttgctct

SEQ ID NO: 112560 - DNA, 15 bp, Homo sapiens
attattattttgctc

SEQ ID NO: 112561 - DNA, 15 bp, Homo sapiens
tattattattttgct

SEQ ID NO: 112562 - DNA, 15 bp, Homo sapiens
ttattattattttgc

SEQ ID NO: 112563 - DNA, 15 bp, Homo sapiens
cttattattattttg

SEQ ID NO: 112564 - DNA, 15 bp, Homo sapiens
ccttattattatttt

SEQ ID NO: 112565 - DNA, 15 bp, Homo sapiens
accttattattattt

SEQ ID NO: 112566 - DNA, 15 bp, Homo sapiens
aaccttattattatt

SEQ ID NO: 112567 - DNA, 15 bp, Homo sapiens
aaaccttattattat

SEQ ID NO: 112568 - DNA, 15 bp, Homo sapiens
caaaccttattatta

SEQ ID NO: 112569 - DNA, 15 bp, Homo sapiens
ccaaaccttattatt

SEQ ID NO: 112570 - DNA, 15 bp, Homo sapiens
accaaaccttattat

SEQ ID NO: 112571 - DNA, 15 bp, Homo sapiens
aaccaaaccttatta

SEQ ID NO: 112572 - DNA, 15 bp, Homo sapiens
aaaccaaaccttatt

SEQ ID NO: 112573 - DNA, 15 bp, Homo sapiens
caaaccaaaccttat

SEQ ID NO: 112574 - DNA, 15 bp, Homo sapiens
acaaaccaaacctta

SEQ ID NO: 112575 - DNA, 15 bp, Homo sapiens
tacaaaccaaacctt

SEQ ID NO: 112576 - DNA, 15 bp, Homo sapiens
atacaaaccaaacct

SEQ ID NO: 112577 - DNA, 15 bp, Homo sapiens
tatacaaaccaaacc

SEQ ID NO: 112578 - DNA, 15 bp, Homo sapiens
ctatacaaaccaaac

SEQ ID NO: 112579 - DNA, 15 bp, Homo sapiens
actatacaaaccaaa

SEQ ID NO: 112580 - DNA, 15 bp, Homo sapiens
gactatacaaaccaa

SEQ ID NO: 112581 - DNA, 15 bp, Homo sapiens
cgactatacaaacca

SEQ ID NO: 112582 - DNA, 15 bp, Homo sapiens
acgactatacaaacc

SEQ ID NO: 112583 - DNA, 15 bp, Homo sapiens
cacgactatacaaac

SEQ ID NO: 112584 - DNA, 15 bp, Homo sapiens
acacgactatacaaa

SEQ ID NO: 112585 - DNA, 15 bp, Homo sapiens
tacacgactatacaa

SEQ ID NO: 112586 - DNA, 15 bp, Homo sapiens
gtacacgactataca

SEQ ID NO: 112587 - DNA, 15 bp, Homo sapiens
agtacacgactatac

SEQ ID NO: 112588 - DNA, 15 bp, Homo sapiens
cagtacacgactata

SEQ ID NO: 112589 - DNA, 15 bp, Homo sapiens
gcagtacacgactat

SEQ ID NO: 112590 - DNA, 15 bp, Homo sapiens
tgcagtacacgacta

SEQ ID NO: 112591 - DNA, 15 bp, Homo sapiens
atgcagtacacgact

SEQ ID NO: 112592 - DNA, 15 bp, Homo sapiens
aatgcagtacacgac

SEQ ID NO: 112593 - DNA, 15 bp, Homo sapiens
aaatgcagtacacga

SEQ ID NO: 112594 - DNA, 15 bp, Homo sapiens
aaaatgcagtacacg

SEQ ID NO: 112595 - DNA, 15 bp, Homo sapiens
taaaatgcagtacac

SEQ ID NO: 112596 - DNA, 15 bp, Homo sapiens
ttaaaatgcagtaca

SEQ ID NO: 112597 - DNA, 15 bp, Homo sapiens
cttaaaatgcagtac

SEQ ID NO: 112598 - DNA, 15 bp, Homo sapiens
acttaaaatgcagta

SEQ ID NO: 112599 - DNA, 15 bp, Homo sapiens
aacttaaaatgcagt

SEQ ID NO: 112600 - DNA, 15 bp, Homo sapiens
taacttaaaatgcag

SEQ ID NO: 112601 - DNA, 15 bp, Homo sapiens
ttaacttaaaatgca

SEQ ID NO: 112602 - DNA, 15 bp, Homo sapiens
tttaacttaaaatgc

SEQ ID NO: 112603 - DNA, 15 bp, Homo sapiens
ctttaacttaaaatg

SEQ ID NO: 112604 - DNA, 15 bp, Homo sapiens
actttaacttaaaat

SEQ ID NO: 112605 - DNA, 15 bp, Homo sapiens
cactttaacttaaaa

SEQ ID NO: 112606 - DNA, 15 bp, Homo sapiens
ccactttaacttaaa

SEQ ID NO: 112607 - DNA, 15 bp, Homo sapiens
accactttaacttaa

SEQ ID NO: 112608 - DNA, 15 bp, Homo sapiens
aaccactttaactta

SEQ ID NO: 112609 - DNA, 15 bp, Homo sapiens
taaccactttaactt

SEQ ID NO: 112610 - DNA, 15 bp, Homo sapiens
ttaaccactttaact

SEQ ID NO: 112611 - DNA, 15 bp, Homo sapiens
attaaccactttaac

SEQ ID NO: 112612 - DNA, 15 bp, Homo sapiens
aattaaccactttaa

SEQ ID NO: 112613 - DNA, 15 bp, Homo sapiens
taattaaccacttta

SEQ ID NO: 112614 - DNA, 15 bp, Homo sapiens
ataattaaccacttt

SEQ ID NO: 112615 - DNA, 15 bp, Homo sapiens
tataattaaccactt

SEQ ID NO: 112616 - DNA, 15 bp, Homo sapiens
ttataattaaccact

SEQ ID NO: 112617 - DNA, 15 bp, Homo sapiens
tttataattaaccac

SEQ ID NO: 112618 - DNA, 15 bp, Homo sapiens
ttttataattaacca

SEQ ID NO: 112619 - DNA, 15 bp, Homo sapiens
gttttataattaacc

SEQ ID NO: 112620 - DNA, 15 bp, Homo sapiens
tgttttataattaac

SEQ ID NO: 112621 - DNA, 15 bp, Homo sapiens
atgttttataattaa

SEQ ID NO: 112622 - DNA, 15 bp, Homo sapiens
tatgttttataatta

SEQ ID NO: 112623 - DNA, 15 bp, Homo sapiens
atatgttttataatt

SEQ ID NO: 112624 - DNA, 15 bp, Homo sapiens
tatatgttttataat

SEQ ID NO: 112625 - DNA, 15 bp, Homo sapiens
ttatatgttttataa

SEQ ID NO: 112626 - DNA, 15 bp, Homo sapiens
attatatgttttata

SEQ ID NO: 112627 - DNA, 15 bp, Homo sapiens
aattatatgttttat

SEQ ID NO: 112628 - DNA, 15 bp, Homo sapiens
caattatatgtttta

SEQ ID NO: 112629 - DNA, 15 bp, Homo sapiens
acaattatatgtttt

SEQ ID NO: 112630 - DNA, 15 bp, Homo sapiens
cacaattatatgttt

SEQ ID NO: 112631 - DNA, 15 bp, Homo sapiens
tcacaattatatgtt

SEQ ID NO: 112632 - DNA, 15 bp, Homo sapiens
ttcacaattatatgt

SEQ ID NO: 112633 - DNA, 15 bp, Homo sapiens
tttcacaattatatg

SEQ ID NO: 112634 - DNA, 15 bp, Homo sapiens
ttttcacaattatat

SEQ ID NO: 112635 - DNA, 15 bp, Homo sapiens
attttcacaattata

SEQ ID NO: 112636 - DNA, 15 bp, Homo sapiens
cattttcacaattat

SEQ ID NO: 112637 - DNA, 15 bp, Homo sapiens
ccattttcacaatta

SEQ ID NO: 112638 - DNA, 15 bp, Homo sapiens
accattttcacaatt

SEQ ID NO: 112639 - DNA, 15 bp, Homo sapiens
caccattttcacaat

SEQ ID NO: 112640 - DNA, 15 bp, Homo sapiens
gcaccattttcacaa

SEQ ID NO: 112641 - DNA, 15 bp, Homo sapiens
agcaccattttcaca

SEQ ID NO: 112642 - DNA, 15 bp, Homo sapiens
tagcaccattttcac

SEQ ID NO: 112643 - DNA, 15 bp, Homo sapiens
atagcaccattttca

SEQ ID NO: 112644 - DNA, 15 bp, Homo sapiens
aatagcaccattttc

SEQ ID NO: 112645 - DNA, 15 bp, Homo sapiens
aaatagcaccatttt

SEQ ID NO: 112646 - DNA, 15 bp, Homo sapiens
aaaatagcaccattt

SEQ ID NO: 112647 - DNA, 15 bp, Homo sapiens
gaaaatagcaccatt

SEQ ID NO: 112648 - DNA, 15 bp, Homo sapiens
ggaaaatagcaccat

SEQ ID NO: 112649 - DNA, 15 bp, Homo sapiens
gggaaaatagcacca

SEQ ID NO: 112650 - DNA, 15 bp, Homo sapiens
ggggaaaatagcacc

SEQ ID NO: 112651 - DNA, 15 bp, Homo sapiens
aggggaaaatagcac

SEQ ID NO: 112652 - DNA, 15 bp, Homo sapiens
gaggggaaaatagca

SEQ ID NO: 112653 - DNA, 15 bp, Homo sapiens
tgaggggaaaatagc

SEQ ID NO: 112654 - DNA, 15 bp, Homo sapiens
ttgaggggaaaatag

SEQ ID NO: 112655 - DNA, 15 bp, Homo sapiens
cttgaggggaaaata

SEQ ID NO: 112656 - DNA, 15 bp, Homo sapiens
acttgaggggaaaat

SEQ ID NO: 112657 - DNA, 15 bp, Homo sapiens
aacttgaggggaaaa

SEQ ID NO: 112658 - DNA, 15 bp, Homo sapiens
taacttgaggggaaa

SEQ ID NO: 112659 - DNA, 15 bp, Homo sapiens
gtaacttgaggggaa

SEQ ID NO: 112660 - DNA, 15 bp, Homo sapiens
agtaacttgagggga

SEQ ID NO: 112661 - DNA, 15 bp, Homo sapiens
tagtaacttgagggg

SEQ ID NO: 112662 - DNA, 15 bp, Homo sapiens
atagtaacttgaggg

SEQ ID NO: 112663 - DNA, 15 bp, Homo sapiens
tatagtaacttgagg

SEQ ID NO: 112664 - DNA, 15 bp, Homo sapiens
ttatagtaacttgag

SEQ ID NO: 112665 - DNA, 15 bp, Homo sapiens
attatagtaacttga

SEQ ID NO: 112666 - DNA, 15 bp, Homo sapiens
tattatagtaacttg

SEQ ID NO: 112667 - DNA, 15 bp, Homo sapiens
gtattatagtaactt

SEQ ID NO: 112668 - DNA, 15 bp, Homo sapiens
ggtattatagtaact

SEQ ID NO: 112669 - DNA, 15 bp, Homo sapiens
cggtattatagtaac

SEQ ID NO: 112670 - DNA, 15 bp, Homo sapiens
acggtattatagtaa

SEQ ID NO: 112671 - DNA, 15 bp, Homo sapiens
tacggtattatagta

SEQ ID NO: 112672 - DNA, 15 bp, Homo sapiens
atacggtattatagt

SEQ ID NO: 112673 - DNA, 15 bp, Homo sapiens
aatacggtattatag

SEQ ID NO: 112674 - DNA, 15 bp, Homo sapiens
aaatacggtattata

SEQ ID NO: 112675 - DNA, 15 bp, Homo sapiens
aaaatacggtattat

SEQ ID NO: 112676 - DNA, 15 bp, Homo sapiens
aaaaatacggtatta

SEQ ID NO: 112677 - DNA, 15 bp, Homo sapiens
gaaaaatacggtatt

SEQ ID NO: 112678 - DNA, 15 bp, Homo sapiens
ggaaaaatacggtat

SEQ ID NO: 112679 - DNA, 15 bp, Homo sapiens
aggaaaaatacggta

SEQ ID NO: 112680 - DNA, 15 bp, Homo sapiens
aaggaaaaatacggt

SEQ ID NO: 112681 - DNA, 15 bp, Homo sapiens
gaaggaaaaatacgg

SEQ ID NO: 112682 - DNA, 15 bp, Homo sapiens
tgaaggaaaaatacg

SEQ ID NO: 112683 - DNA, 15 bp, Homo sapiens
atgaaggaaaaatac

SEQ ID NO: 112684 - DNA, 15 bp, Homo sapiens
catgaaggaaaaata

SEQ ID NO: 112685 - DNA, 15 bp, Homo sapiens
ccatgaaggaaaaat

SEQ ID NO: 112686 - DNA, 15 bp, Homo sapiens
tccatgaaggaaaaa

SEQ ID NO: 112687 - DNA, 15 bp, Homo sapiens
ctccatgaaggaaaa

SEQ ID NO: 112688 - DNA, 15 bp, Homo sapiens
tctccatgaaggaaa

SEQ ID NO: 112689 - DNA, 15 bp, Homo sapiens
ctctccatgaaggaa

SEQ ID NO: 112690 - DNA, 15 bp, Homo sapiens
cctctccatgaagga

SEQ ID NO: 112691 - DNA, 15 bp, Homo sapiens
tcctctccatgaagg

SEQ ID NO: 112692 - DNA, 15 bp, Homo sapiens
atcctctccatgaag

SEQ ID NO: 112693 - DNA, 15 bp, Homo sapiens
aatcctctccatgaa

SEQ ID NO: 112694 - DNA, 15 bp, Homo sapiens
gaatcctctccatga

SEQ ID NO: 112695 - DNA, 15 bp, Homo sapiens
agaatcctctccatg

SEQ ID NO: 112696 - DNA, 15 bp, Homo sapiens
tagaatcctctccat

SEQ ID NO: 112697 - DNA, 15 bp, Homo sapiens
ttagaatcctctcca

SEQ ID NO: 112698 - DNA, 15 bp, Homo sapiens
cttagaatcctctcc

SEQ ID NO: 112699 - DNA, 15 bp, Homo sapiens
tcttagaatcctctc

SEQ ID NO: 112700 - DNA, 15 bp, Homo sapiens
atcttagaatcctct

SEQ ID NO: 112701 - DNA, 15 bp, Homo sapiens
tatcttagaatcctc

SEQ ID NO: 112702 - DNA, 15 bp, Homo sapiens
atatcttagaatcct

SEQ ID NO: 112703 - DNA, 15 bp, Homo sapiens
gatatcttagaatcc

SEQ ID NO: 112704 - DNA, 15 bp, Homo sapiens
agatatcttagaatc

SEQ ID NO: 112705 - DNA, 15 bp, Homo sapiens
aagatatcttagaat

SEQ ID NO: 112706 - DNA, 15 bp, Homo sapiens
taagatatcttagaa

SEQ ID NO: 112707 - DNA, 15 bp, Homo sapiens
ataagatatcttaga

SEQ ID NO: 112708 - DNA, 15 bp, Homo sapiens
cataagatatcttag

SEQ ID NO: 112709 - DNA, 15 bp, Homo sapiens
acataagatatctta

SEQ ID NO: 112710 - DNA, 15 bp, Homo sapiens
aacataagatatctt

SEQ ID NO: 112711 - DNA, 15 bp, Homo sapiens
gaacataagatatct

SEQ ID NO: 112712 - DNA, 15 bp, Homo sapiens
tgaacataagatatc

SEQ ID NO: 112713 - DNA, 15 bp, Homo sapiens
ttgaacataagatat

SEQ ID NO: 112714 - DNA, 15 bp, Homo sapiens
tttgaacataagata

SEQ ID NO: 112715 - DNA, 15 bp, Homo sapiens
ttttgaacataagat

SEQ ID NO: 112716 - DNA, 15 bp, Homo sapiens
attttgaacataaga

SEQ ID NO: 112717 - DNA, 15 bp, Homo sapiens
aattttgaacataag

SEQ ID NO: 112718 - DNA, 15 bp, Homo sapiens
taattttgaacataa

SEQ ID NO: 112719 - DNA, 15 bp, Homo sapiens
ataattttgaacata

SEQ ID NO: 112720 - DNA, 15 bp, Homo sapiens
tataattttgaacat

SEQ ID NO: 112721 - DNA, 15 bp, Homo sapiens
ttataattttgaaca

SEQ ID NO: 112722 - DNA, 15 bp, Homo sapiens
attataattttgaac

SEQ ID NO: 112723 - DNA, 15 bp, Homo sapiens
tattataattttgaa

SEQ ID NO: 112724 - DNA, 15 bp, Homo sapiens
tctattataattttg

SEQ ID NO: 112725 - DNA, 15 bp, Homo sapiens
atctattataatttt

SEQ ID NO: 112726 - DNA, 15 bp, Homo sapiens
tatctattataattt

SEQ ID NO: 112727 - DNA, 15 bp, Homo sapiens
gtatctattataatt

SEQ ID NO: 112728 - DNA, 15 bp, Homo sapiens
agtatctattataat

SEQ ID NO: 112729 - DNA, 15 bp, Homo sapiens
tagtatctattataa

SEQ ID NO: 112730 - DNA, 15 bp, Homo sapiens
ctagtatctattata

SEQ ID NO: 112731 - DNA, 15 bp, Homo sapiens
actagtatctattat

SEQ ID NO: 112732 - DNA, 15 bp, Homo sapiens
cactagtatctatta

SEQ ID NO: 112733 - DNA, 15 bp, Homo sapiens
tcactagtatctatt

SEQ ID NO: 112734 - DNA, 15 bp, Homo sapiens
atcactagtatctat

SEQ ID NO: 112735 - DNA, 15 bp, Homo sapiens
aatcactagtatcta

SEQ ID NO: 112736 - DNA, 15 bp, Homo sapiens
aaatcactagtatct

SEQ ID NO: 112737 - DNA, 15 bp, Homo sapiens
aaaatcactagtatc

SEQ ID NO: 112738 - DNA, 15 bp, Homo sapiens
aaaaatcactagtat

SEQ ID NO: 112739 - DNA, 15 bp, Homo sapiens
gaaaaatcactagta

SEQ ID NO: 112740 - DNA, 15 bp, Homo sapiens
tgaaaaatcactagt

SEQ ID NO: 112741 - DNA, 15 bp, Homo sapiens
ttgaaaaatcactag

SEQ ID NO: 112742 - DNA, 15 bp, Homo sapiens
gttgaaaaatcacta

SEQ ID NO: 112743 - DNA, 15 bp, Homo sapiens
agttgaaaaatcact

SEQ ID NO: 112744 - DNA, 15 bp, Homo sapiens
aagttgaaaaatcac

SEQ ID NO: 112745 - DNA, 15 bp, Homo sapiens
aaagttgaaaaatca

SEQ ID NO: 112746 - DNA, 15 bp, Homo sapiens
taaagttgaaaaatc

SEQ ID NO: 112747 - DNA, 15 bp, Homo sapiens
ataaagttgaaaaat

SEQ ID NO: 112748 - DNA, 15 bp, Homo sapiens
aataaagttgaaaaa

SEQ ID NO: 112749 - DNA, 15 bp, Homo sapiens
aaataaagttgaaaa

SEQ ID NO: 112750 - DNA, 15 bp, Homo sapiens
gaaataaagttgaaa

SEQ ID NO: 112751 - DNA, 15 bp, Homo sapiens
agaaataaagttgaa

SEQ ID NO: 112752 - DNA, 15 bp, Homo sapiens
cagaaataaagttga

SEQ ID NO: 112753 - DNA, 15 bp, Homo sapiens
gcagaaataaagttg

SEQ ID NO: 112754 - DNA, 15 bp, Homo sapiens
ggcagaaataaagtt

SEQ ID NO: 112755 - DNA, 15 bp, Homo sapiens
gggcagaaataaagt

SEQ ID NO: 112756 - DNA, 15 bp, Homo sapiens
agggcagaaataaag

SEQ ID NO: 112757 - DNA, 15 bp, Homo sapiens
aagggcagaaataaa

SEQ ID NO: 112758 - DNA, 15 bp, Homo sapiens
aaagggcagaaataa

SEQ ID NO: 112759 - DNA, 15 bp, Homo sapiens
aaaagggcagaaata

SEQ ID NO: 112760 - DNA, 15 bp, Homo sapiens
taaaagggcagaaat

SEQ ID NO: 112761 - DNA, 15 bp, Homo sapiens
ataaaagggcagaaa

SEQ ID NO: 112762 - DNA, 15 bp, Homo sapiens
cataaaagggcagaa

SEQ ID NO: 112763 - DNA, 15 bp, Homo sapiens
acataaaagggcaga

SEQ ID NO: 112764 - DNA, 15 bp, Homo sapiens
cacataaaagggcag

SEQ ID NO: 112765 - DNA, 15 bp, Homo sapiens
acacataaaagggca

SEQ ID NO: 112766 - DNA, 15 bp, Homo sapiens
cacacataaaagggc

SEQ ID NO: 112767 - DNA, 15 bp, Homo sapiens
acacacataaaaggg

SEQ ID NO: 112768 - DNA, 15 bp, Homo sapiens
aacacacataaaagg

SEQ ID NO: 112769 - DNA, 15 bp, Homo sapiens
aaacacacataaaag

SEQ ID NO: 112770 - DNA, 15 bp, Homo sapiens
aaaacacacataaaa

SEQ ID NO: 112771 - DNA, 15 bp, Homo sapiens
aaaaacacacataaa

SEQ ID NO: 112772 - DNA, 15 bp, Homo sapiens
gaaaaacacacataa

SEQ ID NO: 112773 - DNA, 15 bp, Homo sapiens
agaaaaacacacata

SEQ ID NO: 112774 - DNA, 15 bp, Homo sapiens
gagaaaaacacacat

SEQ ID NO: 112775 - DNA, 15 bp, Homo sapiens
cgagaaaaacacaca

SEQ ID NO: 112776 - DNA, 15 bp, Homo sapiens
gcgagaaaaacacac

SEQ ID NO: 112777 - DNA, 15 bp, Homo sapiens
agcgagaaaaacaca

SEQ ID NO: 112778 - DNA, 15 bp, Homo sapiens
aagcgagaaaaacac

SEQ ID NO: 112779 - DNA, 15 bp, Homo sapiens
taagcgagaaaaaca

SEQ ID NO: 112780 - DNA, 15 bp, Homo sapiens
ttaagcgagaaaaac

SEQ ID NO: 112781 - DNA, 15 bp, Homo sapiens
attaagcgagaaaaa

SEQ ID NO: 112782 - DNA, 15 bp, Homo sapiens
tattaagcgagaaaa

SEQ ID NO: 112783 - DNA, 15 bp, Homo sapiens
gtattaagcgagaaa

SEQ ID NO: 112784 - DNA, 15 bp, Homo sapiens
tgtattaagcgagaa

SEQ ID NO: 112785 - DNA, 15 bp, Homo sapiens
gtgtattaagcgaga

SEQ ID NO: 112786 - DNA, 15 bp, Homo sapiens
tgtgtattaagcgag

SEQ ID NO: 112787 - DNA, 15 bp, Homo sapiens
atgtgtattaagcga

SEQ ID NO: 112788 - DNA, 15 bp, Homo sapiens
tatgtgtattaagcg

SEQ ID NO: 112789 - DNA, 15 bp, Homo sapiens
ttatgtgtattaagc

SEQ ID NO: 112790 - DNA, 15 bp, Homo sapiens
gttatgtgtattaag

SEQ ID NO: 112791 - DNA, 15 bp, Homo sapiens
tgttatgtgtattaa

SEQ ID NO: 112792 - DNA, 15 bp, Homo sapiens
ttgttatgtgtatta

SEQ ID NO: 112793 - DNA, 15 bp, Homo sapiens
attgttatgtgtatt

SEQ ID NO: 112794 - DNA, 15 bp, Homo sapiens
gattgttatgtgtat

SEQ ID NO: 112795 - DNA, 15 bp, Homo sapiens
agattgttatgtgta

SEQ ID NO: 112796 - DNA, 15 bp, Homo sapiens
aagattgttatgtgt

SEQ ID NO: 112797 - DNA, 15 bp, Homo sapiens
aaagattgttatgtg

SEQ ID NO: 112798 - DNA, 15 bp, Homo sapiens
aaaagattgttatgt

SEQ ID NO: 112799 - DNA, 15 bp, Homo sapiens
aaaaagattgttatg

SEQ ID NO: 112800 - DNA, 15 bp, Homo sapiens
aaaaaagattgttat

SEQ ID NO: 112801 - DNA, 15 bp, Homo sapiens
aaaaaaagattgtta

SEQ ID NO: 112802 - DNA, 15 bp, Homo sapiens
aaaaaaaagattgtt

SEQ ID NO: 112803 - DNA, 15 bp, Homo sapiens
aaaaaaaaagattgt

SEQ ID NO: 112804 - DNA, 15 bp, Homo sapiens
aaaaaaaaaagattg

SEQ ID NO: 112805 - DNA, 15 bp, Homo sapiens
aaaaaaaaaaagatt

SEQ ID NO: 112806 - DNA, 15 bp, Homo sapiens
cccgtctcaaaaaaa

SEQ ID NO: 112807 - DNA, 15 bp, Homo sapiens
ccccgtctcaaaaaa

SEQ ID NO: 112808 - DNA, 15 bp, Homo sapiens
accccgtctcaaaaa

SEQ ID NO: 112809 - DNA, 15 bp, Homo sapiens
gaccccgtctcaaaa

SEQ ID NO: 112810 - DNA, 15 bp, Homo sapiens
agaccccgtctcaaa

SEQ ID NO: 112811 - DNA, 15 bp, Homo sapiens
aagaccccgtctcaa

SEQ ID NO: 112812 - DNA, 15 bp, Homo sapiens
caagaccccgtctca

SEQ ID NO: 112813 - DNA, 15 bp, Homo sapiens
gcaagaccccgtctc

SEQ ID NO: 112814 - DNA, 15 bp, Homo sapiens
agcaagaccccgtct

SEQ ID NO: 112815 - DNA, 15 bp, Homo sapiens
gagcaagaccccgtc

SEQ ID NO: 112816 - DNA, 15 bp, Homo sapiens
agagcaagaccccgt

SEQ ID NO: 112817 - DNA, 15 bp, Homo sapiens
cagagcaagaccccg

SEQ ID NO: 112818 - DNA, 15 bp, Homo sapiens
acagagcaagacccc

SEQ ID NO: 112819 - DNA, 15 bp, Homo sapiens
aacagagcaagaccc

SEQ ID NO: 112820 - DNA, 15 bp, Homo sapiens
caacagagcaagacc

SEQ ID NO: 112821 - DNA, 15 bp, Homo sapiens
cctgccactgcactc

SEQ ID NO: 112822 - DNA, 15 bp, Homo sapiens
tcctgccactgcact

SEQ ID NO: 112823 - DNA, 15 bp, Homo sapiens
atcctgccactgcac

SEQ ID NO: 112824 - DNA, 15 bp, Homo sapiens
gatcctgccactgca

SEQ ID NO: 112825 - DNA, 15 bp, Homo sapiens
tgatcctgccactgc

SEQ ID NO: 112826 - DNA, 15 bp, Homo sapiens
gtgatcctgccactg

SEQ ID NO: 112827 - DNA, 15 bp, Homo sapiens
cgtgatcctgccact

SEQ ID NO: 112828 - DNA, 15 bp, Homo sapiens
ccgtgatcctgccac

SEQ ID NO: 112829 - DNA, 15 bp, Homo sapiens
gccgtgatcctgcca

SEQ ID NO: 112830 - DNA, 15 bp, Homo sapiens
agccgtgatcctgcc

SEQ ID NO: 112831 - DNA, 15 bp, Homo sapiens
gagccgtgatcctgc

SEQ ID NO: 112832 - DNA, 15 bp, Homo sapiens
tgagccgtgatcctg

SEQ ID NO: 112833 - DNA, 15 bp, Homo sapiens
gtgagccgtgatcct

SEQ ID NO: 112834 - DNA, 15 bp, Homo sapiens
agtgagccgtgatcc

SEQ ID NO: 112835 - DNA, 15 bp, Homo sapiens
gggctgcagtgagcc

SEQ ID NO: 112836 - DNA, 15 bp, Homo sapiens
ggggctgcagtgagc

SEQ ID NO: 112837 - DNA, 15 bp, Homo sapiens
tggggctgcagtgag

SEQ ID NO: 112838 - DNA, 15 bp, Homo sapiens
ctggggctgcagtga

SEQ ID NO: 112839 - DNA, 15 bp, Homo sapiens
gctggggctgcagtg

SEQ ID NO: 112840 - DNA, 15 bp, Homo sapiens
ggctggggctgcagt

SEQ ID NO: 112841 - DNA, 15 bp, Homo sapiens
aggctggggctgcag

SEQ ID NO: 112842 - DNA, 15 bp, Homo sapiens
gaggctggggctgca

SEQ ID NO: 112843 - DNA, 15 bp, Homo sapiens
ggaggctggggctgc

SEQ ID NO: 112844 - DNA, 15 bp, Homo sapiens
tggaggctggggctg

SEQ ID NO: 112845 - DNA, 15 bp, Homo sapiens
ctggaggctggggct

SEQ ID NO: 112846 - DNA, 15 bp, Homo sapiens
cctggaggctggggc

SEQ ID NO: 112847 - DNA, 15 bp, Homo sapiens
ccctggaggctgggg

SEQ ID NO: 112848 - DNA, 15 bp, Homo sapiens
gccctggaggctggg

SEQ ID NO: 112849 - DNA, 15 bp, Homo sapiens
agccctggaggctgg

SEQ ID NO: 112850 - DNA, 15 bp, Homo sapiens
gagccctggaggctg

SEQ ID NO: 112851 - DNA, 15 bp, Homo sapiens
tgagccctggaggct

SEQ ID NO: 112852 - DNA, 15 bp, Homo sapiens
ttgagccctggaggc

SEQ ID NO: 112853 - DNA, 15 bp, Homo sapiens
cttgagccctggagg

SEQ ID NO: 112854 - DNA, 15 bp, Homo sapiens
gcttgagccctggag

SEQ ID NO: 112855 - DNA, 15 bp, Homo sapiens
cgcttgagccctgga

SEQ ID NO: 112856 - DNA, 15 bp, Homo sapiens
tcgcttgagccctgg

SEQ ID NO: 112857 - DNA, 15 bp, Homo sapiens
atcgcttgagccctg

SEQ ID NO: 112858 - DNA, 15 bp, Homo sapiens
aatcgcttgagccct

SEQ ID NO: 112859 - DNA, 15 bp, Homo sapiens
gaatcgcttgagccc

SEQ ID NO: 112860 - DNA, 15 bp, Homo sapiens
agaatcgcttgagcc

SEQ ID NO: 112861 - DNA, 15 bp, Homo sapiens
gagaatcgcttgagc

SEQ ID NO: 112862 - DNA, 15 bp, Homo sapiens
ggagaatcgcttgag

SEQ ID NO: 112863 - DNA, 15 bp, Homo sapiens
tgggagaatcgcttg

SEQ ID NO: 112864 - DNA, 15 bp, Homo sapiens
gtgggagaatcgctt

SEQ ID NO: 112865 - DNA, 15 bp, Homo sapiens
ggtgggagaatcgct

SEQ ID NO: 112866 - DNA, 15 bp, Homo sapiens
aggtgggagaatcgc

SEQ ID NO: 112867 - DNA, 15 bp, Homo sapiens
gaggtgggagaatcg

SEQ ID NO: 112868 - DNA, 15 bp, Homo sapiens
ggctgaggtgggaga

SEQ ID NO: 112869 - DNA, 15 bp, Homo sapiens
taggctgaggtggga

SEQ ID NO: 112870 - DNA, 15 bp, Homo sapiens
gtaggctgaggtggg

SEQ ID NO: 112871 - DNA, 15 bp, Homo sapiens
agtaggctgaggtgg

SEQ ID NO: 112872 - DNA, 15 bp, Homo sapiens
cagtaggctgaggtg

SEQ ID NO: 112873 - DNA, 15 bp, Homo sapiens
tcagtaggctgaggt

SEQ ID NO: 112874 - DNA, 15 bp, Homo sapiens
gtcagtaggctgagg

SEQ ID NO: 112875 - DNA, 15 bp, Homo sapiens
ggtcagtaggctgag

SEQ ID NO: 112876 - DNA, 15 bp, Homo sapiens
tggtcagtaggctga

SEQ ID NO: 112877 - DNA, 15 bp, Homo sapiens
ctggtcagtaggctg

SEQ ID NO: 112878 - DNA, 15 bp, Homo sapiens
gctggtcagtaggct

SEQ ID NO: 112879 - DNA, 15 bp, Homo sapiens
agctggtcagtaggc

SEQ ID NO: 112880 - DNA, 15 bp, Homo sapiens
cagctggtcagtagg

SEQ ID NO: 112881 - DNA, 15 bp, Homo sapiens
ccagctggtcagtag

SEQ ID NO: 112882 - DNA, 15 bp, Homo sapiens
tccagctggtcagta

SEQ ID NO: 112883 - DNA, 15 bp, Homo sapiens
ttccagctggtcagt

SEQ ID NO: 112884 - DNA, 15 bp, Homo sapiens
gttccagctggtcag

SEQ ID NO: 112885 - DNA, 15 bp, Homo sapiens
agttccagctggtca

SEQ ID NO: 112886 - DNA, 15 bp, Homo sapiens
tagttccagctggtc

SEQ ID NO: 112887 - DNA, 15 bp, Homo sapiens
gtagttccagctggt

SEQ ID NO: 112888 - DNA, 15 bp, Homo sapiens
cgtagttccagctgg

SEQ ID NO: 112889 - DNA, 15 bp, Homo sapiens
tcgtagttccagctg

SEQ ID NO: 112890 - DNA, 15 bp, Homo sapiens
ctcgtagttccagct

SEQ ID NO: 112891 - DNA, 15 bp, Homo sapiens
gctcgtagttccagc

SEQ ID NO: 112892 - DNA, 15 bp, Homo sapiens
tgctcgtagttccag

SEQ ID NO: 112893 - DNA, 15 bp, Homo sapiens
gtgctcgtagttcca

SEQ ID NO: 112894 - DNA, 15 bp, Homo sapiens
cgtgctcgtagttcc

SEQ ID NO: 112895 - DNA, 15 bp, Homo sapiens
gcgtgctcgtagttc

SEQ ID NO: 112896 - DNA, 15 bp, Homo sapiens
tgcgtgctcgtagtt

SEQ ID NO: 112897 - DNA, 15 bp, Homo sapiens
gtgcgtgctcgtagt

SEQ ID NO: 112898 - DNA, 15 bp, Homo sapiens
ggtgcgtgctcgtag

SEQ ID NO: 112899 - DNA, 15 bp, Homo sapiens
tggtgcgtgctcgta

SEQ ID NO: 112900 - DNA, 15 bp, Homo sapiens
gtggtgcgtgctcgt

SEQ ID NO: 112901 - DNA, 15 bp, Homo sapiens
ggtggtgcgtgctcg

SEQ ID NO: 112902 - DNA, 15 bp, Homo sapiens
tggtggtgcgtgctc

SEQ ID NO: 112903 - DNA, 15 bp, Homo sapiens
atggtggtgcgtgct

SEQ ID NO: 112904 - DNA, 15 bp, Homo sapiens
tatggtggtgcgtgc

SEQ ID NO: 112905 - DNA, 15 bp, Homo sapiens
gtatggtggtgcgtg

SEQ ID NO: 112906 - DNA, 15 bp, Homo sapiens
agtatggtggtgcgt

SEQ ID NO: 112907 - DNA, 15 bp, Homo sapiens
cagtatggtggtgcg

SEQ ID NO: 112908 - DNA, 15 bp, Homo sapiens
ccagtatggtggtgc

SEQ ID NO: 112909 - DNA, 15 bp, Homo sapiens
gccagtatggtggtg

SEQ ID NO: 112910 - DNA, 15 bp, Homo sapiens
agccagtatggtggt

SEQ ID NO: 112911 - DNA, 15 bp, Homo sapiens
tagccagtatggtgg

SEQ ID NO: 112912 - DNA, 15 bp, Homo sapiens
ttagccagtatggtg

SEQ ID NO: 112913 - DNA, 15 bp, Homo sapiens
attagccagtatggt

SEQ ID NO: 112914 - DNA, 15 bp, Homo sapiens
aattagccagtatgg

SEQ ID NO: 112915 - DNA, 15 bp, Homo sapiens
aaattagccagtatg

SEQ ID NO: 112916 - DNA, 15 bp, Homo sapiens
aaaattagccagtat

SEQ ID NO: 112917 - DNA, 15 bp, Homo sapiens
aaaaattagccagta

SEQ ID NO: 112918 - DNA, 15 bp, Homo sapiens
aaaaaattagccagt

SEQ ID NO: 112919 - DNA, 15 bp, Homo sapiens
gtaaaaaatacaaaa

SEQ ID NO: 112920 - DNA, 15 bp, Homo sapiens
tgtaaaaaatacaaa

SEQ ID NO: 112921 - DNA, 15 bp, Homo sapiens
ttgtaaaaaatacaa

SEQ ID NO: 112922 - DNA, 15 bp, Homo sapiens
tttgtaaaaaataca

SEQ ID NO: 112923 - DNA, 15 bp, Homo sapiens
ttttgtaaaaaatac

SEQ ID NO: 112924 - DNA, 15 bp, Homo sapiens
attttgtaaaaaata

SEQ ID NO: 112925 - DNA, 15 bp, Homo sapiens
cattttgtaaaaaat

SEQ ID NO: 112926 - DNA, 15 bp, Homo sapiens
tcattttgtaaaaaa

SEQ ID NO: 112927 - DNA, 15 bp, Homo sapiens
ctcattttgtaaaaa

SEQ ID NO: 112928 - DNA, 15 bp, Homo sapiens
cctcattttgtaaaa

SEQ ID NO: 112929 - DNA, 15 bp, Homo sapiens
acctcattttgtaaa

SEQ ID NO: 112930 - DNA, 15 bp, Homo sapiens
gacctcattttgtaa

SEQ ID NO: 112931 - DNA, 15 bp, Homo sapiens
agacctcattttgta

SEQ ID NO: 112932 - DNA, 15 bp, Homo sapiens
aagacctcattttgt

SEQ ID NO: 112933 - DNA, 15 bp, Homo sapiens
aaagacctcattttg

SEQ ID NO: 112934 - DNA, 15 bp, Homo sapiens
gaaagacctcatttt

SEQ ID NO: 112935 - DNA, 15 bp, Homo sapiens
tgaaagacctcattt

SEQ ID NO: 112936 - DNA, 15 bp, Homo sapiens
atgaaagacctcatt

SEQ ID NO: 112937 - DNA, 15 bp, Homo sapiens
aatgaaagacctcat

SEQ ID NO: 112938 - DNA, 15 bp, Homo sapiens
aaatgaaagacctca

SEQ ID NO: 112939 - DNA, 15 bp, Homo sapiens
aaaatgaaagacctc

SEQ ID NO: 112940 - DNA, 15 bp, Homo sapiens
caaaatgaaagacct

SEQ ID NO: 112941 - DNA, 15 bp, Homo sapiens
acaaaatgaaagacc

SEQ ID NO: 112942 - DNA, 15 bp, Homo sapiens
tacaaaatgaaagac

SEQ ID NO: 112943 - DNA, 15 bp, Homo sapiens
ctacaaaatgaaaga

SEQ ID NO: 112944 - DNA, 15 bp, Homo sapiens
tctacaaaatgaaag

SEQ ID NO: 112945 - DNA, 15 bp, Homo sapiens
ttctacaaaatgaaa

SEQ ID NO: 112946 - DNA, 15 bp, Homo sapiens
tttctacaaaatgaa

SEQ ID NO: 112947 - DNA, 15 bp, Homo sapiens
ttttctacaaaatga

SEQ ID NO: 112948 - DNA, 15 bp, Homo sapiens
attttctacaaaatg

SEQ ID NO: 112949 - DNA, 15 bp, Homo sapiens
cattttctacaaaat

SEQ ID NO: 112950 - DNA, 15 bp, Homo sapiens
tcattttctacaaaa

SEQ ID NO: 112951 - DNA, 15 bp, Homo sapiens
ctcattttctacaaa

SEQ ID NO: 112952 - DNA, 15 bp, Homo sapiens
cctcattttctacaa

SEQ ID NO: 112953 - DNA, 15 bp, Homo sapiens
acctcattttctaca

SEQ ID NO: 112954 - DNA, 15 bp, Homo sapiens
gacctcattttctac

SEQ ID NO: 112955 - DNA, 15 bp, Homo sapiens
tgacctcattttcta

SEQ ID NO: 112956 - DNA, 15 bp, Homo sapiens
atgacctcattttct

SEQ ID NO: 112957 - DNA, 15 bp, Homo sapiens
catgacctcattttc

SEQ ID NO: 112958 - DNA, 15 bp, Homo sapiens
acatgacctcatttt

SEQ ID NO: 112959 - DNA, 15 bp, Homo sapiens
aacatgacctcattt

SEQ ID NO: 112960 - DNA, 15 bp, Homo sapiens
aaacatgacctcatt

SEQ ID NO: 112961 - DNA, 15 bp, Homo sapiens
gaaacatgacctcat

SEQ ID NO: 112962 - DNA, 15 bp, Homo sapiens
ggaaacatgacctca

SEQ ID NO: 112963 - DNA, 15 bp, Homo sapiens
gggaaacatgacctc

SEQ ID NO: 112964 - DNA, 15 bp, Homo sapiens
tgggaaacatgacct

SEQ ID NO: 112965 - DNA, 15 bp, Homo sapiens
ctgggaaacatgacc

SEQ ID NO: 112966 - DNA, 15 bp, Homo sapiens
cctgggaaacatgac

SEQ ID NO: 112967 - DNA, 15 bp, Homo sapiens
gcctgggaaacatga

SEQ ID NO: 112968 - DNA, 15 bp, Homo sapiens
agcctgggaaacatg

SEQ ID NO: 112969 - DNA, 15 bp, Homo sapiens
cagcctgggaaacat

SEQ ID NO: 112970 - DNA, 15 bp, Homo sapiens
accagcctgggaaac

SEQ ID NO: 112971 - DNA, 15 bp, Homo sapiens
gaccagcctgggaaa

SEQ ID NO: 112972 - DNA, 15 bp, Homo sapiens
agaccagcctgggaa

SEQ ID NO: 112973 - DNA, 15 bp, Homo sapiens
aagaccagcctggga

SEQ ID NO: 112974 - DNA, 15 bp, Homo sapiens
taagaccagcctggg

SEQ ID NO: 112975 - DNA, 15 bp, Homo sapiens
ttaagaccagcctgg

SEQ ID NO: 112976 - DNA, 15 bp, Homo sapiens
tttaagaccagcctg

SEQ ID NO: 112977 - DNA, 15 bp, Homo sapiens
gtttaagaccagcct

SEQ ID NO: 112978 - DNA, 15 bp, Homo sapiens
agtttaagaccagcc

SEQ ID NO: 112979 - DNA, 15 bp, Homo sapiens
gagtttaagaccagc

SEQ ID NO: 112980 - DNA, 15 bp, Homo sapiens
agagtttaagaccag

SEQ ID NO: 112981 - DNA, 15 bp, Homo sapiens
aagagtttaagacca

SEQ ID NO: 112982 - DNA, 15 bp, Homo sapiens
caagagtttaagacc

SEQ ID NO: 112983 - DNA, 15 bp, Homo sapiens
ccaagagtttaagac

SEQ ID NO: 112984 - DNA, 15 bp, Homo sapiens
tccaagagtttaaga

SEQ ID NO: 112985 - DNA, 15 bp, Homo sapiens
gtccaagagtttaag

SEQ ID NO: 112986 - DNA, 15 bp, Homo sapiens
agtccaagagtttaa

SEQ ID NO: 112987 - DNA, 15 bp, Homo sapiens
gagtccaagagttta

SEQ ID NO: 112988 - DNA, 15 bp, Homo sapiens
tgagtccaagagttt

SEQ ID NO: 112989 - DNA, 15 bp, Homo sapiens
ttgagtccaagagtt

SEQ ID NO: 112990 - DNA, 15 bp, Homo sapiens
tttgagtccaagagt

SEQ ID NO: 112991 - DNA, 15 bp, Homo sapiens
ttttgagtccaagag

SEQ ID NO: 112992 - DNA, 15 bp, Homo sapiens
cttttgagtccaaga

SEQ ID NO: 112993 - DNA, 15 bp, Homo sapiens
tcttttgagtccaag

SEQ ID NO: 112994 - DNA, 15 bp, Homo sapiens
atcttttgagtccaa

SEQ ID NO: 112995 - DNA, 15 bp, Homo sapiens
aatcttttgagtcca

SEQ ID NO: 112996 - DNA, 15 bp, Homo sapiens
aaatcttttgagtcc

SEQ ID NO: 112997 - DNA, 15 bp, Homo sapiens
caaatcttttgagtc

SEQ ID NO: 112998 - DNA, 15 bp, Homo sapiens
gcaaatcttttgagt

SEQ ID NO: 112999 - DNA, 15 bp, Homo sapiens
ggcaaatcttttgag

SEQ ID NO: 113000 - DNA, 15 bp, Homo sapiens
aggcaaatcttttga

SEQ ID NO: 113001 - DNA, 15 bp, Homo sapiens
caggcaaatcttttg

SEQ ID NO: 113002 - DNA, 15 bp, Homo sapiens
gcaggcaaatctttt

SEQ ID NO: 113003 - DNA, 15 bp, Homo sapiens
ggcaggcaaatcttt

SEQ ID NO: 113004 - DNA, 15 bp, Homo sapiens
aggcaggcaaatctt

SEQ ID NO: 113005 - DNA, 15 bp, Homo sapiens
gaggcaggcaaatct

SEQ ID NO: 113006 - DNA, 15 bp, Homo sapiens
cgaggcaggcaaatc

SEQ ID NO: 113007 - DNA, 15 bp, Homo sapiens
ccgaggcaggcaaat

SEQ ID NO: 113008 - DNA, 15 bp, Homo sapiens
gccgaggcaggcaaa

SEQ ID NO: 113009 - DNA, 15 bp, Homo sapiens
ggccgaggcaggcaa

SEQ ID NO: 113010 - DNA, 15 bp, Homo sapiens
tctataatcccagca

SEQ ID NO: 113011 - DNA, 15 bp, Homo sapiens
gtctataatcccagc

SEQ ID NO: 113012 - DNA, 15 bp, Homo sapiens
tgtctataatcccag

SEQ ID NO: 113013 - DNA, 15 bp, Homo sapiens
atgtctataatccca

SEQ ID NO: 113014 - DNA, 15 bp, Homo sapiens
catgtctataatccc

SEQ ID NO: 113015 - DNA, 15 bp, Homo sapiens
tcatgtctataatcc

SEQ ID NO: 113016 - DNA, 15 bp, Homo sapiens
ctcatgtctataatc

SEQ ID NO: 113017 - DNA, 15 bp, Homo sapiens
gctcatgtctataat

SEQ ID NO: 113018 - DNA, 15 bp, Homo sapiens
ggctcatgtctataa

SEQ ID NO: 113019 - DNA, 15 bp, Homo sapiens
tggctcatgtctata

SEQ ID NO: 113020 - DNA, 15 bp, Homo sapiens
gtggctcatgtctat

SEQ ID NO: 113021 - DNA, 15 bp, Homo sapiens
agtggctcatgtcta

SEQ ID NO: 113022 - DNA, 15 bp, Homo sapiens
cagtggctcatgtct

SEQ ID NO: 113023 - DNA, 15 bp, Homo sapiens
acagtggctcatgtc

SEQ ID NO: 113024 - DNA, 15 bp, Homo sapiens
cacagtggctcatgt

SEQ ID NO: 113025 - DNA, 15 bp, Homo sapiens
gcacagtggctcatg

SEQ ID NO: 113026 - DNA, 15 bp, Homo sapiens
ggcacagtggctcat

SEQ ID NO: 113027 - DNA, 15 bp, Homo sapiens
gaggctgggcacagt

SEQ ID NO: 113028 - DNA, 15 bp, Homo sapiens
tgaggctgggcacag

SEQ ID NO: 113029 - DNA, 15 bp, Homo sapiens
atgaggctgggcaca

SEQ ID NO: 113030 - DNA, 15 bp, Homo sapiens
tatgaggctgggcac

SEQ ID NO: 113031 - DNA, 15 bp, Homo sapiens
gtatgaggctgggca

SEQ ID NO: 113032 - DNA, 15 bp, Homo sapiens
ggtatgaggctgggc

SEQ ID NO: 113033 - DNA, 15 bp, Homo sapiens
tggtatgaggctggg

SEQ ID NO: 113034 - DNA, 15 bp, Homo sapiens
ttggtatgaggctgg

SEQ ID NO: 113035 - DNA, 15 bp, Homo sapiens
attggtatgaggctg

SEQ ID NO: 113036 - DNA, 15 bp, Homo sapiens
gattggtatgaggct

SEQ ID NO: 113037 - DNA, 15 bp, Homo sapiens
agattggtatgaggc

SEQ ID NO: 113038 - DNA, 15 bp, Homo sapiens
aagattggtatgagg

SEQ ID NO: 113039 - DNA, 15 bp, Homo sapiens
aaagattggtatgag

SEQ ID NO: 113040 - DNA, 15 bp, Homo sapiens
aaaagattggtatga

SEQ ID NO: 113041 - DNA, 15 bp, Homo sapiens
caaaagattggtatg

SEQ ID NO: 113042 - DNA, 15 bp, Homo sapiens
tcaaaagattggtat

SEQ ID NO: 113043 - DNA, 15 bp, Homo sapiens
ctcaaaagattggta

SEQ ID NO: 113044 - DNA, 15 bp, Homo sapiens
cctcaaaagattggt

SEQ ID NO: 113045 - DNA, 15 bp, Homo sapiens
ccctcaaaagattgg

SEQ ID NO: 113046 - DNA, 15 bp, Homo sapiens
gccctcaaaagattg

SEQ ID NO: 113047 - DNA, 15 bp, Homo sapiens
agccctcaaaagatt

SEQ ID NO: 113048 - DNA, 15 bp, Homo sapiens
tagccctcaaaagat

SEQ ID NO: 113049 - DNA, 15 bp, Homo sapiens
atagccctcaaaaga

SEQ ID NO: 113050 - DNA, 15 bp, Homo sapiens
tatagccctcaaaag

SEQ ID NO: 113051 - DNA, 15 bp, Homo sapiens
gtatagccctcaaaa

SEQ ID NO: 113052 - DNA, 15 bp, Homo sapiens
ggtatagccctcaaa

SEQ ID NO: 113053 - DNA, 15 bp, Homo sapiens
aggtatagccctcaa

SEQ ID NO: 113054 - DNA, 15 bp, Homo sapiens
gaggtatagccctca

SEQ ID NO: 113055 - DNA, 15 bp, Homo sapiens
agaggtatagccctc

SEQ ID NO: 113056 - DNA, 15 bp, Homo sapiens
cagaggtatagccct

SEQ ID NO: 113057 - DNA, 15 bp, Homo sapiens
gcagaggtatagccc

SEQ ID NO: 113058 - DNA, 15 bp, Homo sapiens
ggcagaggtatagcc

SEQ ID NO: 113059 - DNA, 15 bp, Homo sapiens
tggcagaggtatagc

SEQ ID NO: 113060 - DNA, 15 bp, Homo sapiens
ctggcagaggtatag

SEQ ID NO: 113061 - DNA, 15 bp, Homo sapiens
actggcagaggtata

SEQ ID NO: 113062 - DNA, 15 bp, Homo sapiens
tactggcagaggtat

SEQ ID NO: 113063 - DNA, 15 bp, Homo sapiens
atactggcagaggta

SEQ ID NO: 113064 - DNA, 15 bp, Homo sapiens
gatactggcagaggt

SEQ ID NO: 113065 - DNA, 15 bp, Homo sapiens
tgatactggcagagg

SEQ ID NO: 113066 - DNA, 15 bp, Homo sapiens
gtgatactggcagag

SEQ ID NO: 113067 - DNA, 15 bp, Homo sapiens
agtgatactggcaga

SEQ ID NO: 113068 - DNA, 15 bp, Homo sapiens
aagtgatactggcag

SEQ ID NO: 113069 - DNA, 15 bp, Homo sapiens
taagtgatactggca

SEQ ID NO: 113070 - DNA, 15 bp, Homo sapiens
ctaagtgatactggc

SEQ ID NO: 113071 - DNA, 15 bp, Homo sapiens
cctaagtgatactgg

SEQ ID NO: 113072 - DNA, 15 bp, Homo sapiens
tcctaagtgatactg

SEQ ID NO: 113073 - DNA, 15 bp, Homo sapiens
ttcctaagtgatact

SEQ ID NO: 113074 - DNA, 15 bp, Homo sapiens
tttcctaagtgatac

SEQ ID NO: 113075 - DNA, 15 bp, Homo sapiens
atttcctaagtgata

SEQ ID NO: 113076 - DNA, 15 bp, Homo sapiens
aatttcctaagtgat

SEQ ID NO: 113077 - DNA, 15 bp, Homo sapiens
taatttcctaagtga

SEQ ID NO: 113078 - DNA, 15 bp, Homo sapiens
ttaatttcctaagtg

SEQ ID NO: 113079 - DNA, 15 bp, Homo sapiens
attaatttcctaagt

SEQ ID NO: 113080 - DNA, 15 bp, Homo sapiens
cattaatttcctaag

SEQ ID NO: 113081 - DNA, 15 bp, Homo sapiens
tcattaatttcctaa

SEQ ID NO: 113082 - DNA, 15 bp, Homo sapiens
atcattaatttccta

SEQ ID NO: 113083 - DNA, 15 bp, Homo sapiens
tatcattaatttcct

SEQ ID NO: 113084 - DNA, 15 bp, Homo sapiens
ctatcattaatttcc

SEQ ID NO: 113085 - DNA, 15 bp, Homo sapiens
tctatcattaatttc

SEQ ID NO: 113086 - DNA, 15 bp, Homo sapiens
ctctatcattaattt

SEQ ID NO: 113087 - DNA, 15 bp, Homo sapiens
gctctatcattaatt

SEQ ID NO: 113088 - DNA, 15 bp, Homo sapiens
agctctatcattaat

SEQ ID NO: 113089 - DNA, 15 bp, Homo sapiens
tagctctatcattaa

SEQ ID NO: 113090 - DNA, 15 bp, Homo sapiens
ttagctctatcatta

SEQ ID NO: 113091 - DNA, 15 bp, Homo sapiens
cttagctctatcatt

SEQ ID NO: 113092 - DNA, 15 bp, Homo sapiens
tcttagctctatcat

SEQ ID NO: 113093 - DNA, 15 bp, Homo sapiens
atcttagctctatca

SEQ ID NO: 113094 - DNA, 15 bp, Homo sapiens
catcttagctctatc

SEQ ID NO: 113095 - DNA, 15 bp, Homo sapiens
tcatcttagctctat

SEQ ID NO: 113096 - DNA, 15 bp, Homo sapiens
ttcatcttagctcta

SEQ ID NO: 113097 - DNA, 15 bp, Homo sapiens
tttcatcttagctct

SEQ ID NO: 113098 - DNA, 15 bp, Homo sapiens
ttttcatcttagctc

SEQ ID NO: 113099 - DNA, 15 bp, Homo sapiens
gttttcatcttagct

SEQ ID NO: 113100 - DNA, 15 bp, Homo sapiens
ggttttcatcttagc

SEQ ID NO: 113101 - DNA, 15 bp, Homo sapiens
gggttttcatcttag

SEQ ID NO: 113102 - DNA, 15 bp, Homo sapiens
tgggttttcatctta

SEQ ID NO: 113103 - DNA, 15 bp, Homo sapiens
ctgggttttcatctt

SEQ ID NO: 113104 - DNA, 15 bp, Homo sapiens
cctgggttttcatct

SEQ ID NO: 113105 - DNA, 15 bp, Homo sapiens
tcctgggttttcatc

SEQ ID NO: 113106 - DNA, 15 bp, Homo sapiens
atcctgggttttcat

SEQ ID NO: 113107 - DNA, 15 bp, Homo sapiens
aatcctgggttttca

SEQ ID NO: 113108 - DNA, 15 bp, Homo sapiens
caatcctgggttttc

SEQ ID NO: 113109 - DNA, 15 bp, Homo sapiens
gcaatcctgggtttt

SEQ ID NO: 113110 - DNA, 15 bp, Homo sapiens
ggcaatcctgggttt

SEQ ID NO: 113111 - DNA, 15 bp, Homo sapiens
aggcaatcctgggtt

SEQ ID NO: 113112 - DNA, 15 bp, Homo sapiens
caggcaatcctgggt

SEQ ID NO: 113113 - DNA, 15 bp, Homo sapiens
ccaggcaatcctggg

SEQ ID NO: 113114 - DNA, 15 bp, Homo sapiens
gccaggcaatcctgg

SEQ ID NO: 113115 - DNA, 15 bp, Homo sapiens
tgccaggcaatcctg

SEQ ID NO: 113116 - DNA, 15 bp, Homo sapiens
gtgccaggcaatcct

SEQ ID NO: 113117 - DNA, 15 bp, Homo sapiens
agtgccaggcaatcc

SEQ ID NO: 113118 - DNA, 15 bp, Homo sapiens
aagtgccaggcaatc

SEQ ID NO: 113119 - DNA, 15 bp, Homo sapiens
taagtgccaggcaat

SEQ ID NO: 113120 - DNA, 15 bp, Homo sapiens
ttaagtgccaggcaa

SEQ ID NO: 113121 - DNA, 15 bp, Homo sapiens
gttaagtgccaggca

SEQ ID NO: 113122 - DNA, 15 bp, Homo sapiens
ggttaagtgccaggc

SEQ ID NO: 113123 - DNA, 15 bp, Homo sapiens
tggttaagtgccagg

SEQ ID NO: 113124 - DNA, 15 bp, Homo sapiens
gtggttaagtgccag

SEQ ID NO: 113125 - DNA, 15 bp, Homo sapiens
agtggttaagtgcca

SEQ ID NO: 113126 - DNA, 15 bp, Homo sapiens
tagtggttaagtgcc

SEQ ID NO: 113127 - DNA, 15 bp, Homo sapiens
gtagtggttaagtgc

SEQ ID NO: 113128 - DNA, 15 bp, Homo sapiens
tgtagtggttaagtg

SEQ ID NO: 113129 - DNA, 15 bp, Homo sapiens
ctgtagtggttaagt

SEQ ID NO: 113130 - DNA, 15 bp, Homo sapiens
gctgtagtggttaag

SEQ ID NO: 113131 - DNA, 15 bp, Homo sapiens
tgctgtagtggttaa

SEQ ID NO: 113132 - DNA, 15 bp, Homo sapiens
atgctgtagtggtta

SEQ ID NO: 113133 - DNA, 15 bp, Homo sapiens
tatgctgtagtggtt

SEQ ID NO: 113134 - DNA, 15 bp, Homo sapiens
atatgctgtagtggt

SEQ ID NO: 113135 - DNA, 15 bp, Homo sapiens
aatatgctgtagtgg

SEQ ID NO: 113136 - DNA, 15 bp, Homo sapiens
caatatgctgtagtg

SEQ ID NO: 113137 - DNA, 15 bp, Homo sapiens
gcaatatgctgtagt

SEQ ID NO: 113138 - DNA, 15 bp, Homo sapiens
ggcaatatgctgtag

SEQ ID NO: 113139 - DNA, 15 bp, Homo sapiens
aggcaatatgctgta

SEQ ID NO: 113140 - DNA, 15 bp, Homo sapiens
gaggcaatatgctgt

SEQ ID NO: 113141 - DNA, 15 bp, Homo sapiens
ggaggcaatatgctg

SEQ ID NO: 113142 - DNA, 15 bp, Homo sapiens
aggaggcaatatgct

SEQ ID NO: 113143 - DNA, 15 bp, Homo sapiens
aaggaggcaatatgc

SEQ ID NO: 113144 - DNA, 15 bp, Homo sapiens
caaggaggcaatatg

SEQ ID NO: 113145 - DNA, 15 bp, Homo sapiens
gcaaggaggcaatat

SEQ ID NO: 113146 - DNA, 15 bp, Homo sapiens
tgcaaggaggcaata

SEQ ID NO: 113147 - DNA, 15 bp, Homo sapiens
ctgcaaggaggcaat

SEQ ID NO: 113148 - DNA, 15 bp, Homo sapiens
tctgcaaggaggcaa

SEQ ID NO: 113149 - DNA, 15 bp, Homo sapiens
ttctgcaaggaggca

SEQ ID NO: 113150 - DNA, 15 bp, Homo sapiens
tttctgcaaggaggc

SEQ ID NO: 113151 - DNA, 15 bp, Homo sapiens
atttctgcaaggagg

SEQ ID NO: 113152 - DNA, 15 bp, Homo sapiens
catttctgcaaggag

SEQ ID NO: 113153 - DNA, 15 bp, Homo sapiens
gcatttctgcaagga

SEQ ID NO: 113154 - DNA, 15 bp, Homo sapiens
tgcatttctgcaagg

SEQ ID NO: 113155 - DNA, 15 bp, Homo sapiens
ttgcatttctgcaag

SEQ ID NO: 113156 - DNA, 15 bp, Homo sapiens
cttgcatttctgcaa

SEQ ID NO: 113157 - DNA, 15 bp, Homo sapiens
gcttgcatttctgca

SEQ ID NO: 113158 - DNA, 15 bp, Homo sapiens
agcttgcatttctgc

SEQ ID NO: 113159 - DNA, 15 bp, Homo sapiens
aagcttgcatttctg

SEQ ID NO: 113160 - DNA, 15 bp, Homo sapiens
taagcttgcatttct

SEQ ID NO: 113161 - DNA, 15 bp, Homo sapiens
ctaagcttgcatttc

SEQ ID NO: 113162 - DNA, 15 bp, Homo sapiens
tctaagcttgcattt

SEQ ID NO: 113163 - DNA, 15 bp, Homo sapiens
ctctaagcttgcatt

SEQ ID NO: 113164 - DNA, 15 bp, Homo sapiens
cctctaagcttgcat

SEQ ID NO: 113165 - DNA, 15 bp, Homo sapiens
tcctctaagcttgca

SEQ ID NO: 113166 - DNA, 15 bp, Homo sapiens
atcctctaagcttgc

SEQ ID NO: 113167 - DNA, 15 bp, Homo sapiens
aatcctctaagcttg

SEQ ID NO: 113168 - DNA, 15 bp, Homo sapiens
gaatcctctaagctt

SEQ ID NO: 113169 - DNA, 15 bp, Homo sapiens
agaatcctctaagct

SEQ ID NO: 113170 - DNA, 15 bp, Homo sapiens
tagaatcctctaagc

SEQ ID NO: 113171 - DNA, 15 bp, Homo sapiens
ttagaatcctctaag

SEQ ID NO: 113172 - DNA, 15 bp, Homo sapiens
cttagaatcctctaa

SEQ ID NO: 113173 - DNA, 15 bp, Homo sapiens
ccttagaatcctcta

SEQ ID NO: 113174 - DNA, 15 bp, Homo sapiens
accttagaatcctct

SEQ ID NO: 113175 - DNA, 15 bp, Homo sapiens
caccttagaatcctc

SEQ ID NO: 113176 - DNA, 15 bp, Homo sapiens
gcaccttagaatcct

SEQ ID NO: 113177 - DNA, 15 bp, Homo sapiens
agcaccttagaatcc

SEQ ID NO: 113178 - DNA, 15 bp, Homo sapiens
tagcaccttagaatc

SEQ ID NO: 113179 - DNA, 15 bp, Homo sapiens
ttagcaccttagaat

SEQ ID NO: 113180 - DNA, 15 bp, Homo sapiens
cttagcaccttagaa

SEQ ID NO: 113181 - DNA, 15 bp, Homo sapiens
tcttagcaccttaga

SEQ ID NO: 113182 - DNA, 15 bp, Homo sapiens
gtcttagcaccttag

SEQ ID NO: 113183 - DNA, 15 bp, Homo sapiens
tgtcttagcacctta

SEQ ID NO: 113184 - DNA, 15 bp, Homo sapiens
ttgtcttagcacctt

SEQ ID NO: 113185 - DNA, 15 bp, Homo sapiens
tttgtcttagcacct

SEQ ID NO: 113186 - DNA, 15 bp, Homo sapiens
ctttgtcttagcacc

SEQ ID NO: 113187 - DNA, 15 bp, Homo sapiens
cctttgtcttagcac

SEQ ID NO: 113188 - DNA, 15 bp, Homo sapiens
acctttgtcttagca

SEQ ID NO: 113189 - DNA, 15 bp, Homo sapiens
aacctttgtcttagc

SEQ ID NO: 113190 - DNA, 15 bp, Homo sapiens
taacctttgtcttag

SEQ ID NO: 113191 - DNA, 15 bp, Homo sapiens
ataacctttgtctta

SEQ ID NO: 113192 - DNA, 15 bp, Homo sapiens
cataacctttgtctt

SEQ ID NO: 113193 - DNA, 15 bp, Homo sapiens
acataacctttgtct

SEQ ID NO: 113194 - DNA, 15 bp, Homo sapiens
tacataacctttgtc

SEQ ID NO: 113195 - DNA, 15 bp, Homo sapiens
atacataacctttgt

SEQ ID NO: 113196 - DNA, 15 bp, Homo sapiens
catacataacctttg

SEQ ID NO: 113197 - DNA, 15 bp, Homo sapiens
acatacataaccttt

SEQ ID NO: 113198 - DNA, 15 bp, Homo sapiens
gacatacataacctt

SEQ ID NO: 113199 - DNA, 15 bp, Homo sapiens
agacatacataacct

SEQ ID NO: 113200 - DNA, 15 bp, Homo sapiens
aagacatacataacc

SEQ ID NO: 113201 - DNA, 15 bp, Homo sapiens
caagacatacataac

SEQ ID NO: 113202 - DNA, 15 bp, Homo sapiens
ccaagacatacataa

SEQ ID NO: 113203 - DNA, 15 bp, Homo sapiens
cccaagacatacata

SEQ ID NO: 113204 - DNA, 15 bp, Homo sapiens
ccccaagacatacat

SEQ ID NO: 113205 - DNA, 15 bp, Homo sapiens
cccccaagacataca

SEQ ID NO: 113206 - DNA, 15 bp, Homo sapiens
acccccaagacatac

SEQ ID NO: 113207 - DNA, 15 bp, Homo sapiens
aacccccaagacata

SEQ ID NO: 113208 - DNA, 15 bp, Homo sapiens
taacccccaagacat

SEQ ID NO: 113209 - DNA, 15 bp, Homo sapiens
ataacccccaagaca

SEQ ID NO: 113210 - DNA, 15 bp, Homo sapiens
tataacccccaagac

SEQ ID NO: 113211 - DNA, 15 bp, Homo sapiens
atataacccccaaga

SEQ ID NO: 113212 - DNA, 15 bp, Homo sapiens
tatataacccccaag

SEQ ID NO: 113213 - DNA, 15 bp, Homo sapiens
atatataacccccaa

SEQ ID NO: 113214 - DNA, 15 bp, Homo sapiens
catatataaccccca

SEQ ID NO: 113215 - DNA, 15 bp, Homo sapiens
tcatatataaccccc

SEQ ID NO: 113216 - DNA, 15 bp, Homo sapiens
ttcatatataacccc

SEQ ID NO: 113217 - DNA, 15 bp, Homo sapiens
attcatatataaccc

SEQ ID NO: 113218 - DNA, 15 bp, Homo sapiens
gattcatatataacc

SEQ ID NO: 113219 - DNA, 15 bp, Homo sapiens
tgattcatatataac

SEQ ID NO: 113220 - DNA, 15 bp, Homo sapiens
ctgattcatatataa

SEQ ID NO: 113221 - DNA, 15 bp, Homo sapiens
actgattcatatata

SEQ ID NO: 113222 - DNA, 15 bp, Homo sapiens
aactgattcatatat

SEQ ID NO: 113223 - DNA, 15 bp, Homo sapiens
aaactgattcatata

SEQ ID NO: 113224 - DNA, 15 bp, Homo sapiens
caaactgattcatat

SEQ ID NO: 113225 - DNA, 15 bp, Homo sapiens
ccaaactgattcata

SEQ ID NO: 113226 - DNA, 15 bp, Homo sapiens
tccaaactgattcat

SEQ ID NO: 113227 - DNA, 15 bp, Homo sapiens
atccaaactgattca

SEQ ID NO: 113228 - DNA, 15 bp, Homo sapiens
gatccaaactgattc

SEQ ID NO: 113229 - DNA, 15 bp, Homo sapiens
agatccaaactgatt

SEQ ID NO: 113230 - DNA, 15 bp, Homo sapiens
aagatccaaactgat

SEQ ID NO: 113231 - DNA, 15 bp, Homo sapiens
aaagatccaaactga

SEQ ID NO: 113232 - DNA, 15 bp, Homo sapiens
taaagatccaaactg

SEQ ID NO: 113233 - DNA, 15 bp, Homo sapiens
ctaaagatccaaact

SEQ ID NO: 113234 - DNA, 15 bp, Homo sapiens
actaaagatccaaac

SEQ ID NO: 113235 - DNA, 15 bp, Homo sapiens
aactaaagatccaaa

SEQ ID NO: 113236 - DNA, 15 bp, Homo sapiens
taactaaagatccaa

SEQ ID NO: 113237 - DNA, 15 bp, Homo sapiens
ttaactaaagatcca

SEQ ID NO: 113238 - DNA, 15 bp, Homo sapiens
gttaactaaagatcc

SEQ ID NO: 113239 - DNA, 15 bp, Homo sapiens
tgttaactaaagatc

SEQ ID NO: 113240 - DNA, 15 bp, Homo sapiens
atgttaactaaagat

SEQ ID NO: 113241 - DNA, 15 bp, Homo sapiens
aatgttaactaaaga

SEQ ID NO: 113242 - DNA, 15 bp, Homo sapiens
gaatgttaactaaag

SEQ ID NO: 113243 - DNA, 15 bp, Homo sapiens
agaatgttaactaaa

SEQ ID NO: 113244 - DNA, 15 bp, Homo sapiens
cagaatgttaactaa

SEQ ID NO: 113245 - DNA, 15 bp, Homo sapiens
tcagaatgttaacta

SEQ ID NO: 113246 - DNA, 15 bp, Homo sapiens
atcagaatgttaact

SEQ ID NO: 113247 - DNA, 15 bp, Homo sapiens
aatcagaatgttaac

SEQ ID NO: 113248 - DNA, 15 bp, Homo sapiens
gaatcagaatgttaa

SEQ ID NO: 113249 - DNA, 15 bp, Homo sapiens
tgaatcagaatgtta

SEQ ID NO: 113250 - DNA, 15 bp, Homo sapiens
atgaatcagaatgtt

SEQ ID NO: 113251 - DNA, 15 bp, Homo sapiens
aatgaatcagaatgt

SEQ ID NO: 113252 - DNA, 15 bp, Homo sapiens
gaatgaatcagaatg

SEQ ID NO: 113253 - DNA, 15 bp, Homo sapiens
agaatgaatcagaat

SEQ ID NO: 113254 - DNA, 15 bp, Homo sapiens
gagaatgaatcagaa

SEQ ID NO: 113255 - DNA, 15 bp, Homo sapiens
tgagaatgaatcaga

SEQ ID NO: 113256 - DNA, 15 bp, Homo sapiens
atgagaatgaatcag

SEQ ID NO: 113257 - DNA, 15 bp, Homo sapiens
aatgagaatgaatca

SEQ ID NO: 113258 - DNA, 15 bp, Homo sapiens
aaatgagaatgaatc

SEQ ID NO: 113259 - DNA, 15 bp, Homo sapiens
taaatgagaatgaat

SEQ ID NO: 113260 - DNA, 15 bp, Homo sapiens
ataaatgagaatgaa

SEQ ID NO: 113261 - DNA, 15 bp, Homo sapiens
cataaatgagaatga

SEQ ID NO: 113262 - DNA, 15 bp, Homo sapiens
acataaatgagaatg

SEQ ID NO: 113263 - DNA, 15 bp, Homo sapiens
aacataaatgagaat

SEQ ID NO: 113264 - DNA, 15 bp, Homo sapiens
gaacataaatgagaa

SEQ ID NO: 113265 - DNA, 15 bp, Homo sapiens
tgaacataaatgaga

SEQ ID NO: 113266 - DNA, 15 bp, Homo sapiens
atgaacataaatgag

SEQ ID NO: 113267 - DNA, 15 bp, Homo sapiens
aatgaacataaatga

SEQ ID NO: 113268 - DNA, 15 bp, Homo sapiens
gaatgaacataaatg

SEQ ID NO: 113269 - DNA, 15 bp, Homo sapiens
ggaatgaacataaat

SEQ ID NO: 113270 - DNA, 15 bp, Homo sapiens
gggaatgaacataaa

SEQ ID NO: 113271 - DNA, 15 bp, Homo sapiens
tgggaatgaacataa

SEQ ID NO: 113272 - DNA, 15 bp, Homo sapiens
atgggaatgaacata

SEQ ID NO: 113273 - DNA, 15 bp, Homo sapiens
gatgggaatgaacat

SEQ ID NO: 113274 - DNA, 15 bp, Homo sapiens
agatgggaatgaaca

SEQ ID NO: 113275 - DNA, 15 bp, Homo sapiens
gagatgggaatgaac

SEQ ID NO: 113276 - DNA, 15 bp, Homo sapiens
tgagatgggaatgaa

SEQ ID NO: 113277 - DNA, 15 bp, Homo sapiens
ctgagatgggaatga

SEQ ID NO: 113278 - DNA, 15 bp, Homo sapiens
actgagatgggaatg

SEQ ID NO: 113279 - DNA, 15 bp, Homo sapiens
gactgagatgggaat

SEQ ID NO: 113280 - DNA, 15 bp, Homo sapiens
agactgagatgggaa

SEQ ID NO: 113281 - DNA, 15 bp, Homo sapiens
gagactgagatggga

SEQ ID NO: 113282 - DNA, 15 bp, Homo sapiens
tgagactgagatggg

SEQ ID NO: 113283 - DNA, 15 bp, Homo sapiens
ctgagactgagatgg

SEQ ID NO: 113284 - DNA, 15 bp, Homo sapiens
actgagactgagatg

SEQ ID NO: 113285 - DNA, 15 bp, Homo sapiens
gactgagactgagat

SEQ ID NO: 113286 - DNA, 15 bp, Homo sapiens
agactgagactgaga

SEQ ID NO: 113287 - DNA, 15 bp, Homo sapiens
gagactgagactgag

SEQ ID NO: 113288 - DNA, 15 bp, Homo sapiens
agagactgagactga

SEQ ID NO: 113289 - DNA, 15 bp, Homo sapiens
gagagactgagactg

SEQ ID NO: 113290 - DNA, 15 bp, Homo sapiens
ggagagactgagact

SEQ ID NO: 113291 - DNA, 15 bp, Homo sapiens
gggagagactgagac

SEQ ID NO: 113292 - DNA, 15 bp, Homo sapiens
agggagagactgaga

SEQ ID NO: 113293 - DNA, 15 bp, Homo sapiens
cagggagagactgag

SEQ ID NO: 113294 - DNA, 15 bp, Homo sapiens
gcagggagagactga

SEQ ID NO: 113295 - DNA, 15 bp, Homo sapiens
ggcagggagagactg

SEQ ID NO: 113296 - DNA, 15 bp, Homo sapiens
aggcagggagagact

SEQ ID NO: 113297 - DNA, 15 bp, Homo sapiens
gaggcagggagagac

SEQ ID NO: 113298 - DNA, 15 bp, Homo sapiens
agaggcagggagaga

SEQ ID NO: 113299 - DNA, 15 bp, Homo sapiens
gagaggcagggagag

SEQ ID NO: 113300 - DNA, 15 bp, Homo sapiens
agagaggcagggaga

SEQ ID NO: 113301 - DNA, 15 bp, Homo sapiens
gagagaggcagggag

SEQ ID NO: 113302 - DNA, 15 bp, Homo sapiens
ggagagaggcaggga

SEQ ID NO: 113303 - DNA, 15 bp, Homo sapiens
cggagagaggcaggg

SEQ ID NO: 113304 - DNA, 15 bp, Homo sapiens
acggagagaggcagg

SEQ ID NO: 113305 - DNA, 15 bp, Homo sapiens
gacggagagaggcag

SEQ ID NO: 113306 - DNA, 15 bp, Homo sapiens
agacggagagaggca

SEQ ID NO: 113307 - DNA, 15 bp, Homo sapiens
gagacggagagaggc

SEQ ID NO: 113308 - DNA, 15 bp, Homo sapiens
tgagacggagagagg

SEQ ID NO: 113309 - DNA, 15 bp, Homo sapiens
ctgagacggagagag

SEQ ID NO: 113310 - DNA, 15 bp, Homo sapiens
cctgagacggagaga

SEQ ID NO: 113311 - DNA, 15 bp, Homo sapiens
acctgagacggagag

SEQ ID NO: 113312 - DNA, 15 bp, Homo sapiens
cacctgagacggaga

SEQ ID NO: 113313 - DNA, 15 bp, Homo sapiens
tcacctgagacggag

SEQ ID NO: 113314 - DNA, 15 bp, Homo sapiens
gtcacctgagacgga

SEQ ID NO: 113315 - DNA, 15 bp, Homo sapiens
tgtcacctgagacgg

SEQ ID NO: 113316 - DNA, 15 bp, Homo sapiens
ctgtcacctgagacg

SEQ ID NO: 113317 - DNA, 15 bp, Homo sapiens
tctgtcacctgagac

SEQ ID NO: 113318 - DNA, 15 bp, Homo sapiens
ttctgtcacctgaga

SEQ ID NO: 113319 - DNA, 15 bp, Homo sapiens
cttctgtcacctgag

SEQ ID NO: 113320 - DNA, 15 bp, Homo sapiens
ccttctgtcacctga

SEQ ID NO: 113321 - DNA, 15 bp, Homo sapiens
tccttctgtcacctg

SEQ ID NO: 113322 - DNA, 15 bp, Homo sapiens
ttccttctgtcacct

SEQ ID NO: 113323 - DNA, 15 bp, Homo sapiens
tttccttctgtcacc

SEQ ID NO: 113324 - DNA, 15 bp, Homo sapiens
ttttccttctgtcac

SEQ ID NO: 113325 - DNA, 15 bp, Homo sapiens
gttttccttctgtca

SEQ ID NO: 113326 - DNA, 15 bp, Homo sapiens
tgttttccttctgtc

SEQ ID NO: 113327 - DNA, 15 bp, Homo sapiens
ctgttttccttctgt

SEQ ID NO: 113328 - DNA, 15 bp, Homo sapiens
cctgttttccttctg

SEQ ID NO: 113329 - DNA, 15 bp, Homo sapiens
tcctgttttccttct

SEQ ID NO: 113330 - DNA, 15 bp, Homo sapiens
atcctgttttccttc

SEQ ID NO: 113331 - DNA, 15 bp, Homo sapiens
gatcctgttttcctt

SEQ ID NO: 113332 - DNA, 15 bp, Homo sapiens
agatcctgttttcct

SEQ ID NO: 113333 - DNA, 15 bp, Homo sapiens
cagatcctgttttcc

SEQ ID NO: 113334 - DNA, 15 bp, Homo sapiens
ccagatcctgttttc

SEQ ID NO: 113335 - DNA, 15 bp, Homo sapiens
tccagatcctgtttt

SEQ ID NO: 113336 - DNA, 15 bp, Homo sapiens
ttccagatcctgttt

SEQ ID NO: 113337 - DNA, 15 bp, Homo sapiens
tttccagatcctgtt

SEQ ID NO: 113338 - DNA, 15 bp, Homo sapiens
ctttccagatcctgt

SEQ ID NO: 113339 - DNA, 15 bp, Homo sapiens
tctttccagatcctg

SEQ ID NO: 113340 - DNA, 15 bp, Homo sapiens
ctctttccagatcct

SEQ ID NO: 113341 - DNA, 15 bp, Homo sapiens
gctctttccagatcc

SEQ ID NO: 113342 - DNA, 15 bp, Homo sapiens
tgctctttccagatc

SEQ ID NO: 113343 - DNA, 15 bp, Homo sapiens
atgctctttccagat

SEQ ID NO: 113344 - DNA, 15 bp, Homo sapiens
gatgctctttccaga

SEQ ID NO: 113345 - DNA, 15 bp, Homo sapiens
tgatgctctttccag

SEQ ID NO: 113346 - DNA, 15 bp, Homo sapiens
gtgatgctctttcca

SEQ ID NO: 113347 - DNA, 15 bp, Homo sapiens
tgtgatgctctttcc

SEQ ID NO: 113348 - DNA, 15 bp, Homo sapiens
ctgtgatgctctttc

SEQ ID NO: 113349 - DNA, 15 bp, Homo sapiens
actgtgatgctcttt

SEQ ID NO: 113350 - DNA, 15 bp, Homo sapiens
aactgtgatgctctt

SEQ ID NO: 113351 - DNA, 15 bp, Homo sapiens
caactgtgatgctct

SEQ ID NO: 113352 - DNA, 15 bp, Homo sapiens
ccaactgtgatgctc

SEQ ID NO: 113353 - DNA, 15 bp, Homo sapiens
gccaactgtgatgct

SEQ ID NO: 113354 - DNA, 15 bp, Homo sapiens
ggccaactgtgatgc

SEQ ID NO: 113355 - DNA, 15 bp, Homo sapiens
gggccaactgtgatg

SEQ ID NO: 113356 - DNA, 15 bp, Homo sapiens
cgggccaactgtgat

SEQ ID NO: 113357 - DNA, 15 bp, Homo sapiens
ccgggccaactgtga

SEQ ID NO: 113358 - DNA, 15 bp, Homo sapiens
tccgggccaactgtg

SEQ ID NO: 113359 - DNA, 15 bp, Homo sapiens
ttccgggccaactgt

SEQ ID NO: 113360 - DNA, 15 bp, Homo sapiens
tttccgggccaactg

SEQ ID NO: 113361 - DNA, 15 bp, Homo sapiens
ttttccgggccaact

SEQ ID NO: 113362 - DNA, 15 bp, Homo sapiens
attttccgggccaac

SEQ ID NO: 113363 - DNA, 15 bp, Homo sapiens
cattttccgggccaa

SEQ ID NO: 113364 - DNA, 15 bp, Homo sapiens
tcattttccgggcca

SEQ ID NO: 113365 - DNA, 15 bp, Homo sapiens
ttcattttccgggcc

SEQ ID NO: 113366 - DNA, 15 bp, Homo sapiens
cttcattttccgggc

SEQ ID NO: 113367 - DNA, 15 bp, Homo sapiens
tcttcattttccggg

SEQ ID NO: 113368 - DNA, 15 bp, Homo sapiens
ttcttcattttccgg

SEQ ID NO: 113369 - DNA, 15 bp, Homo sapiens
tttcttcattttccg

SEQ ID NO: 113370 - DNA, 15 bp, Homo sapiens
ctttcttcattttcc

SEQ ID NO: 113371 - DNA, 15 bp, Homo sapiens
tctttcttcattttc

SEQ ID NO: 113372 - DNA, 15 bp, Homo sapiens
ctctttcttcatttt

SEQ ID NO: 113373 - DNA, 15 bp, Homo sapiens
cctctttcttcattt

SEQ ID NO: 113374 - DNA, 15 bp, Homo sapiens
gcctctttcttcatt

SEQ ID NO: 113375 - DNA, 15 bp, Homo sapiens
agcctctttcttcat

SEQ ID NO: 113376 - DNA, 15 bp, Homo sapiens
cagcctctttcttca

SEQ ID NO: 113377 - DNA, 15 bp, Homo sapiens
gcagcctctttcttc

SEQ ID NO: 113378 - DNA, 15 bp, Homo sapiens
agcagcctctttctt

SEQ ID NO: 113379 - DNA, 15 bp, Homo sapiens
aagcagcctctttct

SEQ ID NO: 113380 - DNA, 15 bp, Homo sapiens
gaagcagcctctttc

SEQ ID NO: 113381 - DNA, 15 bp, Homo sapiens
agaagcagcctcttt

SEQ ID NO: 113382 - DNA, 15 bp, Homo sapiens
gagaagcagcctctt

SEQ ID NO: 113383 - DNA, 15 bp, Homo sapiens
agagaagcagcctct

SEQ ID NO: 113384 - DNA, 15 bp, Homo sapiens
gagagaagcagcctc

SEQ ID NO: 113385 - DNA, 15 bp, Homo sapiens
agagagaagcagcct

SEQ ID NO: 113386 - DNA, 15 bp, Homo sapiens
gagagagaagcagcc

SEQ ID NO: 113387 - DNA, 15 bp, Homo sapiens
agagagagaagcagc

SEQ ID NO: 113388 - DNA, 15 bp, Homo sapiens
cagagagagaagcag

SEQ ID NO: 113389 - DNA, 15 bp, Homo sapiens
tcagagagagaagca

SEQ ID NO: 113390 - DNA, 15 bp, Homo sapiens
ttcagagagagaagc

SEQ ID NO: 113391 - DNA, 15 bp, Homo sapiens
attcagagagagaag

SEQ ID NO: 113392 - DNA, 15 bp, Homo sapiens
cattcagagagagaa

SEQ ID NO: 113393 - DNA, 15 bp, Homo sapiens
ccattcagagagaga

SEQ ID NO: 113394 - DNA, 15 bp, Homo sapiens
gccattcagagagag

SEQ ID NO: 113395 - DNA, 15 bp, Homo sapiens
agccattcagagaga

SEQ ID NO: 113396 - DNA, 15 bp, Homo sapiens
aagccattcagagag

SEQ ID NO: 113397 - DNA, 15 bp, Homo sapiens
aaagccattcagaga

SEQ ID NO: 113398 - DNA, 15 bp, Homo sapiens
gaaagccattcagag

SEQ ID NO: 113399 - DNA, 15 bp, Homo sapiens
agaaagccattcaga

SEQ ID NO: 113400 - DNA, 15 bp, Homo sapiens
cagaaagccattcag

SEQ ID NO: 113401 - DNA, 15 bp, Homo sapiens
gcagaaagccattca

SEQ ID NO: 113402 - DNA, 15 bp, Homo sapiens
agcagaaagccattc

SEQ ID NO: 113403 - DNA, 15 bp, Homo sapiens
tagcagaaagccatt

SEQ ID NO: 113404 - DNA, 15 bp, Homo sapiens
gtagcagaaagccat

SEQ ID NO: 113405 - DNA, 15 bp, Homo sapiens
agtagcagaaagcca

SEQ ID NO: 113406 - DNA, 15 bp, Homo sapiens
cagtagcagaaagcc

SEQ ID NO: 113407 - DNA, 15 bp, Homo sapiens
tcagtagcagaaagc

SEQ ID NO: 113408 - DNA, 15 bp, Homo sapiens
ttcagtagcagaaag

SEQ ID NO: 113409 - DNA, 15 bp, Homo sapiens
tttcagtagcagaaa

SEQ ID NO: 113410 - DNA, 15 bp, Homo sapiens
gtttcagtagcagaa

SEQ ID NO: 113411 - DNA, 15 bp, Homo sapiens
agtttcagtagcaga

SEQ ID NO: 113412 - DNA, 15 bp, Homo sapiens
cagtttcagtagcag

SEQ ID NO: 113413 - DNA, 15 bp, Homo sapiens
tcagtttcagtagca

SEQ ID NO: 113414 - DNA, 15 bp, Homo sapiens
ttcagtttcagtagc

SEQ ID NO: 113415 - DNA, 15 bp, Homo sapiens
attcagtttcagtag

SEQ ID NO: 113416 - DNA, 15 bp, Homo sapiens
aattcagtttcagta

SEQ ID NO: 113417 - DNA, 15 bp, Homo sapiens
caattcagtttcagt

SEQ ID NO: 113418 - DNA, 15 bp, Homo sapiens
ccaattcagtttcag

SEQ ID NO: 113419 - DNA, 15 bp, Homo sapiens
accaattcagtttca

SEQ ID NO: 113420 - DNA, 15 bp, Homo sapiens
taccaattcagtttc

SEQ ID NO: 113421 - DNA, 15 bp, Homo sapiens
gtaccaattcagttt

SEQ ID NO: 113422 - DNA, 15 bp, Homo sapiens
tgtaccaattcagtt

SEQ ID NO: 113423 - DNA, 15 bp, Homo sapiens
ctgtaccaattcagt

SEQ ID NO: 113424 - DNA, 15 bp, Homo sapiens
tctgtaccaattcag

SEQ ID NO: 113425 - DNA, 15 bp, Homo sapiens
ttctgtaccaattca

SEQ ID NO: 113426 - DNA, 15 bp, Homo sapiens
cttctgtaccaattc

SEQ ID NO: 113427 - DNA, 15 bp, Homo sapiens
acttctgtaccaatt

SEQ ID NO: 113428 - DNA, 15 bp, Homo sapiens
gacttctgtaccaat

SEQ ID NO: 113429 - DNA, 15 bp, Homo sapiens
ggacttctgtaccaa

SEQ ID NO: 113430 - DNA, 15 bp, Homo sapiens
tggacttctgtacca

SEQ ID NO: 113431 - DNA, 15 bp, Homo sapiens
gtggacttctgtacc

SEQ ID NO: 113432 - DNA, 15 bp, Homo sapiens
agtggacttctgtac

SEQ ID NO: 113433 - DNA, 15 bp, Homo sapiens
aagtggacttctgta

SEQ ID NO: 113434 - DNA, 15 bp, Homo sapiens
gaagtggacttctgt

SEQ ID NO: 113435 - DNA, 15 bp, Homo sapiens
tgaagtggacttctg

SEQ ID NO: 113436 - DNA, 15 bp, Homo sapiens
ctgaagtggacttct

SEQ ID NO: 113437 - DNA, 15 bp, Homo sapiens
tctgaagtggacttc

SEQ ID NO: 113438 - DNA, 15 bp, Homo sapiens
ttctgaagtggactt

SEQ ID NO: 113439 - DNA, 15 bp, Homo sapiens
cttctgaagtggact

SEQ ID NO: 113440 - DNA, 15 bp, Homo sapiens
ccttctgaagtggac

SEQ ID NO: 113441 - DNA, 15 bp, Homo sapiens
accttctgaagtgga

SEQ ID NO: 113442 - DNA, 15 bp, Homo sapiens
gaccttctgaagtgg

SEQ ID NO: 113443 - DNA, 15 bp, Homo sapiens
agaccttctgaagtg

SEQ ID NO: 113444 - DNA, 15 bp, Homo sapiens
cagaccttctgaagt

SEQ ID NO: 113445 - DNA, 15 bp, Homo sapiens
gcagaccttctgaag

SEQ ID NO: 113446 - DNA, 15 bp, Homo sapiens
agcagaccttctgaa

SEQ ID NO: 113447 - DNA, 15 bp, Homo sapiens
aagcagaccttctga

SEQ ID NO: 113448 - DNA, 15 bp, Homo sapiens
caagcagaccttctg

SEQ ID NO: 113449 - DNA, 15 bp, Homo sapiens
ccaagcagaccttct

SEQ ID NO: 113450 - DNA, 15 bp, Homo sapiens
accaagcagaccttc

SEQ ID NO: 113451 - DNA, 15 bp, Homo sapiens
caccaagcagacctt

SEQ ID NO: 113452 - DNA, 15 bp, Homo sapiens
tcaccaagcagacct

SEQ ID NO: 113453 - DNA, 15 bp, Homo sapiens
gtcaccaagcagacc

SEQ ID NO: 113454 - DNA, 15 bp, Homo sapiens
agtcaccaagcagac

SEQ ID NO: 113455 - DNA, 15 bp, Homo sapiens
aagtcaccaagcaga

SEQ ID NO: 113456 - DNA, 15 bp, Homo sapiens
caagtcaccaagcag

SEQ ID NO: 113457 - DNA, 15 bp, Homo sapiens
ccaagtcaccaagca

SEQ ID NO: 113458 - DNA, 15 bp, Homo sapiens
tccaagtcaccaagc

SEQ ID NO: 113459 - DNA, 15 bp, Homo sapiens
atccaagtcaccaag

SEQ ID NO: 113460 - DNA, 15 bp, Homo sapiens
tatccaagtcaccaa

SEQ ID NO: 113461 - DNA, 15 bp, Homo sapiens
gtatccaagtcacca

SEQ ID NO: 113462 - DNA, 15 bp, Homo sapiens
tgtatccaagtcacc

SEQ ID NO: 113463 - DNA, 15 bp, Homo sapiens
ctgtatccaagtcac

SEQ ID NO: 113464 - DNA, 15 bp, Homo sapiens
tctgtatccaagtca

SEQ ID NO: 113465 - DNA, 15 bp, Homo sapiens
ttctgtatccaagtc

SEQ ID NO: 113466 - DNA, 15 bp, Homo sapiens
tttctgtatccaagt

SEQ ID NO: 113467 - DNA, 15 bp, Homo sapiens
atttctgtatccaag

SEQ ID NO: 113468 - DNA, 15 bp, Homo sapiens
aatttctgtatccaa

SEQ ID NO: 113469 - DNA, 15 bp, Homo sapiens
aaatttctgtatcca

SEQ ID NO: 113470 - DNA, 15 bp, Homo sapiens
gaaatttctgtatcc

SEQ ID NO: 113471 - DNA, 15 bp, Homo sapiens
ggaaatttctgtatc

SEQ ID NO: 113472 - DNA, 15 bp, Homo sapiens
aggaaatttctgtat

SEQ ID NO: 113473 - DNA, 15 bp, Homo sapiens
caggaaatttctgta

SEQ ID NO: 113474 - DNA, 15 bp, Homo sapiens
ccaggaaatttctgt

SEQ ID NO: 113475 - DNA, 15 bp, Homo sapiens
cccaggaaatttctg

SEQ ID NO: 113476 - DNA, 15 bp, Homo sapiens
gcccaggaaatttct

SEQ ID NO: 113477 - DNA, 15 bp, Homo sapiens
agcccaggaaatttc

SEQ ID NO: 113478 - DNA, 15 bp, Homo sapiens
tagcccaggaaattt

SEQ ID NO: 113479 - DNA, 15 bp, Homo sapiens
ttagcccaggaaatt

SEQ ID NO: 113480 - DNA, 15 bp, Homo sapiens
tttagcccaggaaat

SEQ ID NO: 113481 - DNA, 15 bp, Homo sapiens
ctttagcccaggaaa

SEQ ID NO: 113482 - DNA, 15 bp, Homo sapiens
actttagcccaggaa

SEQ ID NO: 113483 - DNA, 15 bp, Homo sapiens
tactttagcccagga

SEQ ID NO: 113484 - DNA, 15 bp, Homo sapiens
ttactttagcccagg

SEQ ID NO: 113485 - DNA, 15 bp, Homo sapiens
cttactttagcccag

SEQ ID NO: 113486 - DNA, 15 bp, Homo sapiens
acttactttagccca

SEQ ID NO: 113487 - DNA, 15 bp, Homo sapiens
aacttactttagccc

SEQ ID NO: 113488 - DNA, 15 bp, Homo sapiens
caacttactttagcc

SEQ ID NO: 113489 - DNA, 15 bp, Homo sapiens
gcaacttactttagc

SEQ ID NO: 113490 - DNA, 15 bp, Homo sapiens
tgcaacttactttag

SEQ ID NO: 113491 - DNA, 15 bp, Homo sapiens
ctgcaacttacttta

SEQ ID NO: 113492 - DNA, 15 bp, Homo sapiens
actgcaacttacttt

SEQ ID NO: 113493 - DNA, 15 bp, Homo sapiens
aactgcaacttactt

SEQ ID NO: 113494 - DNA, 15 bp, Homo sapiens
gaactgcaacttact

SEQ ID NO: 113495 - DNA, 15 bp, Homo sapiens
tgaactgcaacttac

SEQ ID NO: 113496 - DNA, 15 bp, Homo sapiens
ctgaactgcaactta

SEQ ID NO: 113497 - DNA, 15 bp, Homo sapiens
tctgaactgcaactt

SEQ ID NO: 113498 - DNA, 15 bp, Homo sapiens
atctgaactgcaact

SEQ ID NO: 113499 - DNA, 15 bp, Homo sapiens
catctgaactgcaac

SEQ ID NO: 113500 - DNA, 15 bp, Homo sapiens
tcatctgaactgcaa

SEQ ID NO: 113501 - DNA, 15 bp, Homo sapiens
ttcatctgaactgca

SEQ ID NO: 113502 - DNA, 15 bp, Homo sapiens
tttcatctgaactgc

SEQ ID NO: 113503 - DNA, 15 bp, Homo sapiens
gtttcatctgaactg

SEQ ID NO: 113504 - DNA, 15 bp, Homo sapiens
tgtttcatctgaact

SEQ ID NO: 113505 - DNA, 15 bp, Homo sapiens
gtgtttcatctgaac

SEQ ID NO: 113506 - DNA, 15 bp, Homo sapiens
ggtgtttcatctgaa

SEQ ID NO: 113507 - DNA, 15 bp, Homo sapiens
tggtgtttcatctga

SEQ ID NO: 113508 - DNA, 15 bp, Homo sapiens
ctggtgtttcatctg

SEQ ID NO: 113509 - DNA, 15 bp, Homo sapiens
gctggtgtttcatct

SEQ ID NO: 113510 - DNA, 15 bp, Homo sapiens
tgctggtgtttcatc

SEQ ID NO: 113511 - DNA, 15 bp, Homo sapiens
atgctggtgtttcat

SEQ ID NO: 113512 - DNA, 15 bp, Homo sapiens
catgctggtgtttca

SEQ ID NO: 113513 - DNA, 15 bp, Homo sapiens
tcatgctggtgtttc

SEQ ID NO: 113514 - DNA, 15 bp, Homo sapiens
atcatgctggtgttt

SEQ ID NO: 113515 - DNA, 15 bp, Homo sapiens
catcatgctggtgtt

SEQ ID NO: 113516 - DNA, 15 bp, Homo sapiens
gcatcatgctggtgt

SEQ ID NO: 113517 - DNA, 15 bp, Homo sapiens
ggcatcatgctggtg

SEQ ID NO: 113518 - DNA, 15 bp, Homo sapiens
tggcatcatgctggt

SEQ ID NO: 113519 - DNA, 15 bp, Homo sapiens
ctggcatcatgctgg

SEQ ID NO: 113520 - DNA, 15 bp, Homo sapiens
gctggcatcatgctg

SEQ ID NO: 113521 - DNA, 15 bp, Homo sapiens
cgctggcatcatgct

SEQ ID NO: 113522 - DNA, 15 bp, Homo sapiens
acgctggcatcatgc

SEQ ID NO: 113523 - DNA, 15 bp, Homo sapiens
tacgctggcatcatg

SEQ ID NO: 113524 - DNA, 15 bp, Homo sapiens
ttacgctggcatcat

SEQ ID NO: 113525 - DNA, 15 bp, Homo sapiens
gttacgctggcatca

SEQ ID NO: 113526 - DNA, 15 bp, Homo sapiens
tgttacgctggcatc

SEQ ID NO: 113527 - DNA, 15 bp, Homo sapiens
atgttacgctggcat

SEQ ID NO: 113528 - DNA, 15 bp, Homo sapiens
catgttacgctggca

SEQ ID NO: 113529 - DNA, 15 bp, Homo sapiens
ccatgttacgctggc

SEQ ID NO: 113530 - DNA, 15 bp, Homo sapiens
gccatgttacgctgg

SEQ ID NO: 113531 - DNA, 15 bp, Homo sapiens
tgccatgttacgctg

SEQ ID NO: 113532 - DNA, 15 bp, Homo sapiens
atgccatgttacgct

SEQ ID NO: 113533 - DNA, 15 bp, Homo sapiens
aatgccatgttacgc

SEQ ID NO: 113534 - DNA, 15 bp, Homo sapiens
aaatgccatgttacg

SEQ ID NO: 113535 - DNA, 15 bp, Homo sapiens
caaatgccatgttac

SEQ ID NO: 113536 - DNA, 15 bp, Homo sapiens
acaaatgccatgtta

SEQ ID NO: 113537 - DNA, 15 bp, Homo sapiens
aacaaatgccatgtt

SEQ ID NO: 113538 - DNA, 15 bp, Homo sapiens
gaacaaatgccatgt

SEQ ID NO: 113539 - DNA, 15 bp, Homo sapiens
cgaacaaatgccatg

SEQ ID NO: 113540 - DNA, 15 bp, Homo sapiens
ccgaacaaatgccat

SEQ ID NO: 113541 - DNA, 15 bp, Homo sapiens
cccgaacaaatgcca

SEQ ID NO: 113542 - DNA, 15 bp, Homo sapiens
gcccgaacaaatgcc

SEQ ID NO: 113543 - DNA, 15 bp, Homo sapiens
cgcccgaacaaatgc

SEQ ID NO: 113544 - DNA, 15 bp, Homo sapiens
tcgcccgaacaaatg

SEQ ID NO: 113545 - DNA, 15 bp, Homo sapiens
gtcgcccgaacaaat

SEQ ID NO: 113546 - DNA, 15 bp, Homo sapiens
ggtcgcccgaacaaa

SEQ ID NO: 113547 - DNA, 15 bp, Homo sapiens
aggtcgcccgaacaa

SEQ ID NO: 113548 - DNA, 15 bp, Homo sapiens
caggtcgcccgaaca

SEQ ID NO: 113549 - DNA, 15 bp, Homo sapiens
ccaggtcgcccgaac

SEQ ID NO: 113550 - DNA, 15 bp, Homo sapiens
accaggtcgcccgaa

SEQ ID NO: 113551 - DNA, 15 bp, Homo sapiens
aaccaggtcgcccga

SEQ ID NO: 113552 - DNA, 15 bp, Homo sapiens
caaccaggtcgcccg

SEQ ID NO: 113553 - DNA, 15 bp, Homo sapiens
ccaaccaggtcgccc

SEQ ID NO: 113554 - DNA, 15 bp, Homo sapiens
tccaaccaggtcgcc

SEQ ID NO: 113555 - DNA, 15 bp, Homo sapiens
atccaaccaggtcgc

SEQ ID NO: 113556 - DNA, 15 bp, Homo sapiens
tatccaaccaggtcg

SEQ ID NO: 113557 - DNA, 15 bp, Homo sapiens
gtatccaaccaggtc

SEQ ID NO: 113558 - DNA, 15 bp, Homo sapiens
ggtatccaaccaggt

SEQ ID NO: 113559 - DNA, 15 bp, Homo sapiens
tggtatccaaccagg

SEQ ID NO: 113560 - DNA, 15 bp, Homo sapiens
atggtatccaaccag

SEQ ID NO: 113561 - DNA, 15 bp, Homo sapiens
catggtatccaacca

SEQ ID NO: 113562 - DNA, 15 bp, Homo sapiens
acatggtatccaacc

SEQ ID NO: 113563 - DNA, 15 bp, Homo sapiens
gacatggtatccaac

SEQ ID NO: 113564 - DNA, 15 bp, Homo sapiens
ggacatggtatccaa

SEQ ID NO: 113565 - DNA, 15 bp, Homo sapiens
gggacatggtatcca

SEQ ID NO: 113566 - DNA, 15 bp, Homo sapiens
agggacatggtatcc

SEQ ID NO: 113567 - DNA, 15 bp, Homo sapiens
gagggacatggtatc

SEQ ID NO: 113568 - DNA, 15 bp, Homo sapiens
ggagggacatggtat

SEQ ID NO: 113569 - DNA, 15 bp, Homo sapiens
tggagggacatggta

SEQ ID NO: 113570 - DNA, 15 bp, Homo sapiens
atggagggacatggt

SEQ ID NO: 113571 - DNA, 15 bp, Homo sapiens
aatggagggacatgg

SEQ ID NO: 113572 - DNA, 15 bp, Homo sapiens
aaatggagggacatg

SEQ ID NO: 113573 - DNA, 15 bp, Homo sapiens
aaaatggagggacat

SEQ ID NO: 113574 - DNA, 15 bp, Homo sapiens
taaaatggagggaca

SEQ ID NO: 113575 - DNA, 15 bp, Homo sapiens
ataaaatggagggac

SEQ ID NO: 113576 - DNA, 15 bp, Homo sapiens
atataaaatggaggg

SEQ ID NO: 113577 - DNA, 15 bp, Homo sapiens
aatataaaatggagg

SEQ ID NO: 113578 - DNA, 15 bp, Homo sapiens
taatataaaatggag

SEQ ID NO: 113579 - DNA, 15 bp, Homo sapiens
ttaatataaaatgga

SEQ ID NO: 113580 - DNA, 15 bp, Homo sapiens
tttaatataaaatgg

SEQ ID NO: 113581 - DNA, 15 bp, Homo sapiens
atttaatataaaatg

SEQ ID NO: 113582 - DNA, 15 bp, Homo sapiens
gatttaatataaaat

SEQ ID NO: 113583 - DNA, 15 bp, Homo sapiens
agatttaatataaaa

SEQ ID NO: 113584 - DNA, 15 bp, Homo sapiens
tagatttaatataaa

SEQ ID NO: 113585 - DNA, 15 bp, Homo sapiens
ctagatttaatataa

SEQ ID NO: 113586 - DNA, 15 bp, Homo sapiens
gctagatttaatata

SEQ ID NO: 113587 - DNA, 15 bp, Homo sapiens
ggctagatttaatat

SEQ ID NO: 113588 - DNA, 15 bp, Homo sapiens
aggctagatttaata

SEQ ID NO: 113589 - DNA, 15 bp, Homo sapiens
aaggctagatttaat

SEQ ID NO: 113590 - DNA, 15 bp, Homo sapiens
aaaggctagatttaa

SEQ ID NO: 113591 - DNA, 15 bp, Homo sapiens
aaaaggctagattta

SEQ ID NO: 113592 - DNA, 15 bp, Homo sapiens
gaaaaggctagattt

SEQ ID NO: 113593 - DNA, 15 bp, Homo sapiens
agaaaaggctagatt

SEQ ID NO: 113594 - DNA, 15 bp, Homo sapiens
aagaaaaggctagat

SEQ ID NO: 113595 - DNA, 15 bp, Homo sapiens
aaagaaaaggctaga

SEQ ID NO: 113596 - DNA, 15 bp, Homo sapiens
aaaagaaaaggctag

SEQ ID NO: 113597 - DNA, 15 bp, Homo sapiens
aaaaagaaaaggcta

SEQ ID NO: 113598 - DNA, 15 bp, Homo sapiens
aaaaaagaaaaggct

SEQ ID NO: 113599 - DNA, 15 bp, Homo sapiens
caaaaaagaaaaggc

SEQ ID NO: 113600 - DNA, 15 bp, Homo sapiens
gcaaaaaagaaaagg

SEQ ID NO: 113601 - DNA, 15 bp, Homo sapiens
tgcaaaaaagaaaag

SEQ ID NO: 113602 - DNA, 15 bp, Homo sapiens
atgcaaaaaagaaaa

SEQ ID NO: 113603 - DNA, 15 bp, Homo sapiens
aatgcaaaaaagaaa

SEQ ID NO: 113604 - DNA, 15 bp, Homo sapiens
caatgcaaaaaagaa

SEQ ID NO: 113605 - DNA, 15 bp, Homo sapiens
acaatgcaaaaaaga

SEQ ID NO: 113606 - DNA, 15 bp, Homo sapiens
aacaatgcaaaaaag

SEQ ID NO: 113607 - DNA, 15 bp, Homo sapiens
aaacaatgcaaaaaa

SEQ ID NO: 113608 - DNA, 15 bp, Homo sapiens
aaaacaatgcaaaaa

SEQ ID NO: 113609 - DNA, 15 bp, Homo sapiens
aaaaacaatgcaaaa

SEQ ID NO: 113610 - DNA, 15 bp, Homo sapiens
gaaaaacaatgcaaa

SEQ ID NO: 113611 - DNA, 15 bp, Homo sapiens
ggaaaaacaatgcaa

SEQ ID NO: 113612 - DNA, 15 bp, Homo sapiens
tggaaaaacaatgca

SEQ ID NO: 113613 - DNA, 15 bp, Homo sapiens
gtggaaaaacaatgc

SEQ ID NO: 113614 - DNA, 15 bp, Homo sapiens
agtggaaaaacaatg

SEQ ID NO: 113615 - DNA, 15 bp, Homo sapiens
aagtggaaaaacaat

SEQ ID NO: 113616 - DNA, 15 bp, Homo sapiens
gaagtggaaaaacaa

SEQ ID NO: 113617 - DNA, 15 bp, Homo sapiens
agaagtggaaaaaca

SEQ ID NO: 113618 - DNA, 15 bp, Homo sapiens
gagaagtggaaaaac

SEQ ID NO: 113619 - DNA, 15 bp, Homo sapiens
agagaagtggaaaaa

SEQ ID NO: 113620 - DNA, 15 bp, Homo sapiens
cagagaagtggaaaa

SEQ ID NO: 113621 - DNA, 15 bp, Homo sapiens
acagagaagtggaaa

SEQ ID NO: 113622 - DNA, 15 bp, Homo sapiens
gacagagaagtggaa

SEQ ID NO: 113623 - DNA, 15 bp, Homo sapiens
ggacagagaagtgga

SEQ ID NO: 113624 - DNA, 15 bp, Homo sapiens
aggacagagaagtgg

SEQ ID NO: 113625 - DNA, 15 bp, Homo sapiens
taggacagagaagtg

SEQ ID NO: 113626 - DNA, 15 bp, Homo sapiens
ttaggacagagaagt

SEQ ID NO: 113627 - DNA, 15 bp, Homo sapiens
cttaggacagagaag

SEQ ID NO: 113628 - DNA, 15 bp, Homo sapiens
tcttaggacagagaa

SEQ ID NO: 113629 - DNA, 15 bp, Homo sapiens
ttcttaggacagaga

SEQ ID NO: 113630 - DNA, 15 bp, Homo sapiens
tttcttaggacagag

SEQ ID NO: 113631 - DNA, 15 bp, Homo sapiens
ttttcttaggacaga

SEQ ID NO: 113632 - DNA, 15 bp, Homo sapiens
tttttcttaggacag

SEQ ID NO: 113633 - DNA, 15 bp, Homo sapiens
attttttcttaggac

SEQ ID NO: 113634 - DNA, 15 bp, Homo sapiens
tattttttcttagga

SEQ ID NO: 113635 - DNA, 15 bp, Homo sapiens
atattttttcttagg

SEQ ID NO: 113636 - DNA, 15 bp, Homo sapiens
aatattttttcttag

SEQ ID NO: 113637 - DNA, 15 bp, Homo sapiens
aaatattttttctta

SEQ ID NO: 113638 - DNA, 15 bp, Homo sapiens
aaaatattttttctt

SEQ ID NO: 113639 - DNA, 15 bp, Homo sapiens
taaaatattttttct

SEQ ID NO: 113640 - DNA, 15 bp, Homo sapiens
ttaaaatattttttc

SEQ ID NO: 113641 - DNA, 15 bp, Homo sapiens
tttaaaatatttttt

SEQ ID NO: 113642 - DNA, 15 bp, Homo sapiens
attatttttaaaata

SEQ ID NO: 113643 - DNA, 15 bp, Homo sapiens
tcattatttttaaaa

SEQ ID NO: 113644 - DNA, 15 bp, Homo sapiens
atcattatttttaaa

SEQ ID NO: 113645 - DNA, 15 bp, Homo sapiens
aatcattatttttaa

SEQ ID NO: 113646 - DNA, 15 bp, Homo sapiens
taatcattattttta

SEQ ID NO: 113647 - DNA, 15 bp, Homo sapiens
ataatcattattttt

SEQ ID NO: 113648 - DNA, 15 bp, Homo sapiens
tataatcattatttt

SEQ ID NO: 113649 - DNA, 15 bp, Homo sapiens
atataatcattattt

SEQ ID NO: 113650 - DNA, 15 bp, Homo sapiens
aatataatcattatt

SEQ ID NO: 113651 - DNA, 15 bp, Homo sapiens
aaatataatcattat

SEQ ID NO: 113652 - DNA, 15 bp, Homo sapiens
aaaatataatcatta

SEQ ID NO: 113653 - DNA, 15 bp, Homo sapiens
taaaatataatcatt

SEQ ID NO: 113654 - DNA, 15 bp, Homo sapiens
ataaaatataatcat

SEQ ID NO: 113655 - DNA, 15 bp, Homo sapiens
aataaaatataatca

SEQ ID NO: 113656 - DNA, 15 bp, Homo sapiens
aaataaaatataatc

SEQ ID NO: 113657 - DNA, 15 bp, Homo sapiens
aaaataaaatataat

SEQ ID NO: 113658 - DNA, 15 bp, Homo sapiens
gaaaataaaatataa

SEQ ID NO: 113659 - DNA, 15 bp, Homo sapiens
agaaaataaaatata

SEQ ID NO: 113660 - DNA, 15 bp, Homo sapiens
aagaaaataaaatat

SEQ ID NO: 113661 - DNA, 15 bp, Homo sapiens
aaagaaaataaaata

SEQ ID NO: 113662 - DNA, 15 bp, Homo sapiens
taaagaaaataaaat

SEQ ID NO: 113663 - DNA, 15 bp, Homo sapiens
ataaagaaaataaaa

SEQ ID NO: 113664 - DNA, 15 bp, Homo sapiens
tataaagaaaataaa

SEQ ID NO: 113665 - DNA, 15 bp, Homo sapiens
ttataaagaaaataa

SEQ ID NO: 113666 - DNA, 15 bp, Homo sapiens
attataaagaaaata

SEQ ID NO: 113667 - DNA, 15 bp, Homo sapiens
aattataaagaaaat

SEQ ID NO: 113668 - DNA, 15 bp, Homo sapiens
aaattataaagaaaa

SEQ ID NO: 113669 - DNA, 15 bp, Homo sapiens
gaaattataaagaaa

SEQ ID NO: 113670 - DNA, 15 bp, Homo sapiens
agaaattataaagaa

SEQ ID NO: 113671 - DNA, 15 bp, Homo sapiens
tagaaattataaaga

SEQ ID NO: 113672 - DNA, 15 bp, Homo sapiens
gtagaaattataaag

SEQ ID NO: 113673 - DNA, 15 bp, Homo sapiens
agtagaaattataaa

SEQ ID NO: 113674 - DNA, 15 bp, Homo sapiens
aagtagaaattataa

SEQ ID NO: 113675 - DNA, 15 bp, Homo sapiens
aaagtagaaattata

SEQ ID NO: 113676 - DNA, 15 bp, Homo sapiens
aaaagtagaaattat

SEQ ID NO: 113677 - DNA, 15 bp, Homo sapiens
taaaagtagaaatta

SEQ ID NO: 113678 - DNA, 15 bp, Homo sapiens
ctaaaagtagaaatt

SEQ ID NO: 113679 - DNA, 15 bp, Homo sapiens
tctaaaagtagaaat

SEQ ID NO: 113680 - DNA, 15 bp, Homo sapiens
atctaaaagtagaaa

SEQ ID NO: 113681 - DNA, 15 bp, Homo sapiens
aatctaaaagtagaa

SEQ ID NO: 113682 - DNA, 15 bp, Homo sapiens
taatctaaaagtaga

SEQ ID NO: 113683 - DNA, 15 bp, Homo sapiens
ttaatctaaaagtag

SEQ ID NO: 113684 - DNA, 15 bp, Homo sapiens
cttaatctaaaagta

SEQ ID NO: 113685 - DNA, 15 bp, Homo sapiens
ccttaatctaaaagt

SEQ ID NO: 113686 - DNA, 15 bp, Homo sapiens
cccttaatctaaaag

SEQ ID NO: 113687 - DNA, 15 bp, Homo sapiens
ccccttaatctaaaa

SEQ ID NO: 113688 - DNA, 15 bp, Homo sapiens
accccttaatctaaa

SEQ ID NO: 113689 - DNA, 15 bp, Homo sapiens
taccccttaatctaa

SEQ ID NO: 113690 - DNA, 15 bp, Homo sapiens
gtaccccttaatcta

SEQ ID NO: 113691 - DNA, 15 bp, Homo sapiens
tgtaccccttaatct

SEQ ID NO: 113692 - DNA, 15 bp, Homo sapiens
gtgtaccccttaatc

SEQ ID NO: 113693 - DNA, 15 bp, Homo sapiens
tgtgtaccccttaat

SEQ ID NO: 113694 - DNA, 15 bp, Homo sapiens
atgtgtaccccttaa

SEQ ID NO: 113695 - DNA, 15 bp, Homo sapiens
tatgtgtacccctta

SEQ ID NO: 113696 - DNA, 15 bp, Homo sapiens
atatgtgtacccctt

SEQ ID NO: 113697 - DNA, 15 bp, Homo sapiens
tatatgtgtacccct

SEQ ID NO: 113698 - DNA, 15 bp, Homo sapiens
ctatatgtgtacccc

SEQ ID NO: 113699 - DNA, 15 bp, Homo sapiens
cctatatgtgtaccc

SEQ ID NO: 113700 - DNA, 15 bp, Homo sapiens
acctatatgtgtacc

SEQ ID NO: 113701 - DNA, 15 bp, Homo sapiens
aacctatatgtgtac

SEQ ID NO: 113702 - DNA, 15 bp, Homo sapiens
aaacctatatgtgta

SEQ ID NO: 113703 - DNA, 15 bp, Homo sapiens
caaacctatatgtgt

SEQ ID NO: 113704 - DNA, 15 bp, Homo sapiens
acaaacctatatgtg

SEQ ID NO: 113705 - DNA, 15 bp, Homo sapiens
aacaaacctatatgt

SEQ ID NO: 113706 - DNA, 15 bp, Homo sapiens
taacaaacctatatg

SEQ ID NO: 113707 - DNA, 15 bp, Homo sapiens
gtaacaaacctatat

SEQ ID NO: 113708 - DNA, 15 bp, Homo sapiens
tgtaacaaacctata

SEQ ID NO: 113709 - DNA, 15 bp, Homo sapiens
atgtaacaaacctat

SEQ ID NO: 113710 - DNA, 15 bp, Homo sapiens
catgtaacaaaccta

SEQ ID NO: 113711 - DNA, 15 bp, Homo sapiens
ccatgtaacaaacct

SEQ ID NO: 113712 - DNA, 15 bp, Homo sapiens
tccatgtaacaaacc

SEQ ID NO: 113713 - DNA, 15 bp, Homo sapiens
atccatgtaacaaac

SEQ ID NO: 113714 - DNA, 15 bp, Homo sapiens
tatccatgtaacaaa

SEQ ID NO: 113715 - DNA, 15 bp, Homo sapiens
atatccatgtaacaa

SEQ ID NO: 113716 - DNA, 15 bp, Homo sapiens
tatatccatgtaaca

SEQ ID NO: 113717 - DNA, 15 bp, Homo sapiens
atatatccatgtaac

SEQ ID NO: 113718 - DNA, 15 bp, Homo sapiens
aatatatccatgtaa

SEQ ID NO: 113719 - DNA, 15 bp, Homo sapiens
cacaatatatccatg

SEQ ID NO: 113720 - DNA, 15 bp, Homo sapiens
acacaatatatccat

SEQ ID NO: 113721 - DNA, 15 bp, Homo sapiens
tacacaatatatcca

SEQ ID NO: 113722 - DNA, 15 bp, Homo sapiens
ttacacaatatatcc

SEQ ID NO: 113723 - DNA, 15 bp, Homo sapiens
attacacaatatatc

SEQ ID NO: 113724 - DNA, 15 bp, Homo sapiens
cattacacaatatat

SEQ ID NO: 113725 - DNA, 15 bp, Homo sapiens
gcattacacaatata

SEQ ID NO: 113726 - DNA, 15 bp, Homo sapiens
agcattacacaatat

SEQ ID NO: 113727 - DNA, 15 bp, Homo sapiens
cagcattacacaata

SEQ ID NO: 113728 - DNA, 15 bp, Homo sapiens
tcagcattacacaat

SEQ ID NO: 113729 - DNA, 15 bp, Homo sapiens
ctcagcattacacaa

SEQ ID NO: 113730 - DNA, 15 bp, Homo sapiens
cctcagcattacaca

SEQ ID NO: 113731 - DNA, 15 bp, Homo sapiens
acctcagcattacac

SEQ ID NO: 113732 - DNA, 15 bp, Homo sapiens
aacctcagcattaca

SEQ ID NO: 113733 - DNA, 15 bp, Homo sapiens
aaacctcagcattac

SEQ ID NO: 113734 - DNA, 15 bp, Homo sapiens
caaacctcagcatta

SEQ ID NO: 113735 - DNA, 15 bp, Homo sapiens
ccaaacctcagcatt

SEQ ID NO: 113736 - DNA, 15 bp, Homo sapiens
ccccaaacctcagca

SEQ ID NO: 113737 - DNA, 15 bp, Homo sapiens
accccaaacctcagc

SEQ ID NO: 113738 - DNA, 15 bp, Homo sapiens
taccccaaacctcag

SEQ ID NO: 113739 - DNA, 15 bp, Homo sapiens
ataccccaaacctca

SEQ ID NO: 113740 - DNA, 15 bp, Homo sapiens
cataccccaaacctc

SEQ ID NO: 113741 - DNA, 15 bp, Homo sapiens
tcataccccaaacct

SEQ ID NO: 113742 - DNA, 15 bp, Homo sapiens
ttcataccccaaacc

SEQ ID NO: 113743 - DNA, 15 bp, Homo sapiens
attcataccccaaac

SEQ ID NO: 113744 - DNA, 15 bp, Homo sapiens
cattcataccccaaa

SEQ ID NO: 113745 - DNA, 15 bp, Homo sapiens
tcattcataccccaa

SEQ ID NO: 113746 - DNA, 15 bp, Homo sapiens
atcattcatacccca

SEQ ID NO: 113747 - DNA, 15 bp, Homo sapiens
gatcattcatacccc

SEQ ID NO: 113748 - DNA, 15 bp, Homo sapiens
ggatcattcataccc

SEQ ID NO: 113749 - DNA, 15 bp, Homo sapiens
gggatcattcatacc

SEQ ID NO: 113750 - DNA, 15 bp, Homo sapiens
tgggatcattcatac

SEQ ID NO: 113751 - DNA, 15 bp, Homo sapiens
atgggatcattcata

SEQ ID NO: 113752 - DNA, 15 bp, Homo sapiens
gatgggatcattcat

SEQ ID NO: 113753 - DNA, 15 bp, Homo sapiens
tgatgggatcattca

SEQ ID NO: 113754 - DNA, 15 bp, Homo sapiens
gtgatgggatcattc

SEQ ID NO: 113755 - DNA, 15 bp, Homo sapiens
ggtgatgggatcatt

SEQ ID NO: 113756 - DNA, 15 bp, Homo sapiens
gggtgatgggatcat

SEQ ID NO: 113757 - DNA, 15 bp, Homo sapiens
tgggtgatgggatca

SEQ ID NO: 113758 - DNA, 15 bp, Homo sapiens
ctgggtgatgggatc

SEQ ID NO: 113759 - DNA, 15 bp, Homo sapiens
cctgggtgatgggat

SEQ ID NO: 113760 - DNA, 15 bp, Homo sapiens
acctgggtgatggga

SEQ ID NO: 113761 - DNA, 15 bp, Homo sapiens
tacctgggtgatggg

SEQ ID NO: 113762 - DNA, 15 bp, Homo sapiens
ctacctgggtgatgg

SEQ ID NO: 113763 - DNA, 15 bp, Homo sapiens
actacctgggtgatg

SEQ ID NO: 113764 - DNA, 15 bp, Homo sapiens
cactacctgggtgat

SEQ ID NO: 113765 - DNA, 15 bp, Homo sapiens
tcactacctgggtga

SEQ ID NO: 113766 - DNA, 15 bp, Homo sapiens
ctcactacctgggtg

SEQ ID NO: 113767 - DNA, 15 bp, Homo sapiens
gctcactacctgggt

SEQ ID NO: 113768 - DNA, 15 bp, Homo sapiens
tgctcactacctggg

SEQ ID NO: 113769 - DNA, 15 bp, Homo sapiens
atgctcactacctgg

SEQ ID NO: 113770 - DNA, 15 bp, Homo sapiens
tatgctcactacctg

SEQ ID NO: 113771 - DNA, 15 bp, Homo sapiens
ctatgctcactacct

SEQ ID NO: 113772 - DNA, 15 bp, Homo sapiens
actatgctcactacc

SEQ ID NO: 113773 - DNA, 15 bp, Homo sapiens
tactatgctcactac

SEQ ID NO: 113774 - DNA, 15 bp, Homo sapiens
gtactatgctcacta

SEQ ID NO: 113775 - DNA, 15 bp, Homo sapiens
ggtactatgctcact

SEQ ID NO: 113776 - DNA, 15 bp, Homo sapiens
gggtactatgctcac

SEQ ID NO: 113777 - DNA, 15 bp, Homo sapiens
tgggtactatgctca

SEQ ID NO: 113778 - DNA, 15 bp, Homo sapiens
gtgggtactatgctc

SEQ ID NO: 113779 - DNA, 15 bp, Homo sapiens
agtgggtactatgct

SEQ ID NO: 113780 - DNA, 15 bp, Homo sapiens
tagtgggtactatgc

SEQ ID NO: 113781 - DNA, 15 bp, Homo sapiens
ctagtgggtactatg

SEQ ID NO: 113782 - DNA, 15 bp, Homo sapiens
cctagtgggtactat

SEQ ID NO: 113783 - DNA, 15 bp, Homo sapiens
acctagtgggtacta

SEQ ID NO: 113784 - DNA, 15 bp, Homo sapiens
tacctagtgggtact

SEQ ID NO: 113785 - DNA, 15 bp, Homo sapiens
ctacctagtgggtac

SEQ ID NO: 113786 - DNA, 15 bp, Homo sapiens
actacctagtgggta

SEQ ID NO: 113787 - DNA, 15 bp, Homo sapiens
aactacctagtgggt

SEQ ID NO: 113788 - DNA, 15 bp, Homo sapiens
aaactacctagtggg

SEQ ID NO: 113789 - DNA, 15 bp, Homo sapiens
aaaactacctagtgg

SEQ ID NO: 113790 - DNA, 15 bp, Homo sapiens
aaaaactacctagtg

SEQ ID NO: 113791 - DNA, 15 bp, Homo sapiens
gaaaaactacctagt

SEQ ID NO: 113792 - DNA, 15 bp, Homo sapiens
tgaaaaactacctag

SEQ ID NO: 113793 - DNA, 15 bp, Homo sapiens
ctgaaaaactaccta

SEQ ID NO: 113794 - DNA, 15 bp, Homo sapiens
gctgaaaaactacct

SEQ ID NO: 113795 - DNA, 15 bp, Homo sapiens
tgagctgaaaaacta

SEQ ID NO: 113796 - DNA, 15 bp, Homo sapiens
atgagctgaaaaact

SEQ ID NO: 113797 - DNA, 15 bp, Homo sapiens
catgagctgaaaaac

SEQ ID NO: 113798 - DNA, 15 bp, Homo sapiens
gcatgagctgaaaaa

SEQ ID NO: 113799 - DNA, 15 bp, Homo sapiens
ggcatgagctgaaaa

SEQ ID NO: 113800 - DNA, 15 bp, Homo sapiens
aggcatgagctgaaa

SEQ ID NO: 113801 - DNA, 15 bp, Homo sapiens
gaggcatgagctgaa

SEQ ID NO: 113802 - DNA, 15 bp, Homo sapiens
ggaggcatgagctga

SEQ ID NO: 113803 - DNA, 15 bp, Homo sapiens
gggaggcatgagctg

SEQ ID NO: 113804 - DNA, 15 bp, Homo sapiens
agggaggcatgagct

SEQ ID NO: 113805 - DNA, 15 bp, Homo sapiens
gagggaggcatgagc

SEQ ID NO: 113806 - DNA, 15 bp, Homo sapiens
agagggaggcatgag

SEQ ID NO: 113807 - DNA, 15 bp, Homo sapiens
cagagggaggcatga

SEQ ID NO: 113808 - DNA, 15 bp, Homo sapiens
acagagggaggcatg

SEQ ID NO: 113809 - DNA, 15 bp, Homo sapiens
aacagagggaggcat

SEQ ID NO: 113810 - DNA, 15 bp, Homo sapiens
aaacagagggaggca

SEQ ID NO: 113811 - DNA, 15 bp, Homo sapiens
gaaacagagggaggc

SEQ ID NO: 113812 - DNA, 15 bp, Homo sapiens
agaaacagagggagg

SEQ ID NO: 113813 - DNA, 15 bp, Homo sapiens
gagaaacagagggag

SEQ ID NO: 113814 - DNA, 15 bp, Homo sapiens
cgagaaacagaggga

SEQ ID NO: 113815 - DNA, 15 bp, Homo sapiens
gcgagaaacagaggg

SEQ ID NO: 113816 - DNA, 15 bp, Homo sapiens
ggcgagaaacagagg

SEQ ID NO: 113817 - DNA, 15 bp, Homo sapiens
gggcgagaaacagag

SEQ ID NO: 113818 - DNA, 15 bp, Homo sapiens
ggggcgagaaacaga

SEQ ID NO: 113819 - DNA, 15 bp, Homo sapiens
aggggcgagaaacag

SEQ ID NO: 113820 - DNA, 15 bp, Homo sapiens
gaggggcgagaaaca

SEQ ID NO: 113821 - DNA, 15 bp, Homo sapiens
agaggggcgagaaac

SEQ ID NO: 113822 - DNA, 15 bp, Homo sapiens
tagaggggcgagaaa

SEQ ID NO: 113823 - DNA, 15 bp, Homo sapiens
gtagaggggcgagaa

SEQ ID NO: 113824 - DNA, 15 bp, Homo sapiens
agtagaggggcgaga

SEQ ID NO: 113825 - DNA, 15 bp, Homo sapiens
tagtagaggggcgag

SEQ ID NO: 113826 - DNA, 15 bp, Homo sapiens
ctagtagaggggcga

SEQ ID NO: 113827 - DNA, 15 bp, Homo sapiens
actagtagaggggcg

SEQ ID NO: 113828 - DNA, 15 bp, Homo sapiens
gactagtagaggggc

SEQ ID NO: 113829 - DNA, 15 bp, Homo sapiens
ggactagtagagggg

SEQ ID NO: 113830 - DNA, 15 bp, Homo sapiens
gggactagtagaggg

SEQ ID NO: 113831 - DNA, 15 bp, Homo sapiens
ggggactagtagagg

SEQ ID NO: 113832 - DNA, 15 bp, Homo sapiens
tggggactagtagag

SEQ ID NO: 113833 - DNA, 15 bp, Homo sapiens
ctggggactagtaga

SEQ ID NO: 113834 - DNA, 15 bp, Homo sapiens
actggggactagtag

SEQ ID NO: 113835 - DNA, 15 bp, Homo sapiens
cactggggactagta

SEQ ID NO: 113836 - DNA, 15 bp, Homo sapiens
acactggggactagt

SEQ ID NO: 113837 - DNA, 15 bp, Homo sapiens
aacactggggactag

SEQ ID NO: 113838 - DNA, 15 bp, Homo sapiens
aaacactggggacta

SEQ ID NO: 113839 - DNA, 15 bp, Homo sapiens
taaacactggggact

SEQ ID NO: 113840 - DNA, 15 bp, Homo sapiens
ataaacactggggac

SEQ ID NO: 113841 - DNA, 15 bp, Homo sapiens
gataaacactgggga

SEQ ID NO: 113842 - DNA, 15 bp, Homo sapiens
cgataaacactgggg

SEQ ID NO: 113843 - DNA, 15 bp, Homo sapiens
acgataaacactggg

SEQ ID NO: 113844 - DNA, 15 bp, Homo sapiens
aacgataaacactgg

SEQ ID NO: 113845 - DNA, 15 bp, Homo sapiens
gaacgataaacactg

SEQ ID NO: 113846 - DNA, 15 bp, Homo sapiens
ggaacgataaacact

SEQ ID NO: 113847 - DNA, 15 bp, Homo sapiens
gggaacgataaacac

SEQ ID NO: 113848 - DNA, 15 bp, Homo sapiens
agggaacgataaaca

SEQ ID NO: 113849 - DNA, 15 bp, Homo sapiens
aagggaacgataaac

SEQ ID NO: 113850 - DNA, 15 bp, Homo sapiens
gaagggaacgataaa

SEQ ID NO: 113851 - DNA, 15 bp, Homo sapiens
agaagggaacgataa

SEQ ID NO: 113852 - DNA, 15 bp, Homo sapiens
aagaagggaacgata

SEQ ID NO: 113853 - DNA, 15 bp, Homo sapiens
aaagaagggaacgat

SEQ ID NO: 113854 - DNA, 15 bp, Homo sapiens
taaagaagggaacga

SEQ ID NO: 113855 - DNA, 15 bp, Homo sapiens
ataaagaagggaacg

SEQ ID NO: 113856 - DNA, 15 bp, Homo sapiens
cataaagaagggaac

SEQ ID NO: 113857 - DNA, 15 bp, Homo sapiens
ccataaagaagggaa

SEQ ID NO: 113858 - DNA, 15 bp, Homo sapiens
gccataaagaaggga

SEQ ID NO: 113859 - DNA, 15 bp, Homo sapiens
ggccataaagaaggg

SEQ ID NO: 113860 - DNA, 15 bp, Homo sapiens
aggccataaagaagg

SEQ ID NO: 113861 - DNA, 15 bp, Homo sapiens
aaggccataaagaag

SEQ ID NO: 113862 - DNA, 15 bp, Homo sapiens
caaggccataaagaa

SEQ ID NO: 113863 - DNA, 15 bp, Homo sapiens
gcaaggccataaaga

SEQ ID NO: 113864 - DNA, 15 bp, Homo sapiens
cgcaaggccataaag

SEQ ID NO: 113865 - DNA, 15 bp, Homo sapiens
acgcaaggccataaa

SEQ ID NO: 113866 - DNA, 15 bp, Homo sapiens
tacgcaaggccataa

SEQ ID NO: 113867 - DNA, 15 bp, Homo sapiens
gtacgcaaggccata

SEQ ID NO: 113868 - DNA, 15 bp, Homo sapiens
ggtacgcaaggccat

SEQ ID NO: 113869 - DNA, 15 bp, Homo sapiens
gggtacgcaaggcca

SEQ ID NO: 113870 - DNA, 15 bp, Homo sapiens
tgggtacgcaaggcc

SEQ ID NO: 113871 - DNA, 15 bp, Homo sapiens
ttgggtacgcaaggc

SEQ ID NO: 113872 - DNA, 15 bp, Homo sapiens
attgggtacgcaagg

SEQ ID NO: 113873 - DNA, 15 bp, Homo sapiens
cattgggtacgcaag

SEQ ID NO: 113874 - DNA, 15 bp, Homo sapiens
acattgggtacgcaa

SEQ ID NO: 113875 - DNA, 15 bp, Homo sapiens
aacattgggtacgca

SEQ ID NO: 113876 - DNA, 15 bp, Homo sapiens
aaacattgggtacgc

SEQ ID NO: 113877 - DNA, 15 bp, Homo sapiens
taaacattgggtacg

SEQ ID NO: 113878 - DNA, 15 bp, Homo sapiens
ctaaacattgggtac

SEQ ID NO: 113879 - DNA, 15 bp, Homo sapiens
gctaaacattgggta

SEQ ID NO: 113880 - DNA, 15 bp, Homo sapiens
ggctaaacattgggt

SEQ ID NO: 113881 - DNA, 15 bp, Homo sapiens
gggctaaacattggg

SEQ ID NO: 113882 - DNA, 15 bp, Homo sapiens
ggggctaaacattgg

SEQ ID NO: 113883 - DNA, 15 bp, Homo sapiens
gggggctaaacattg

SEQ ID NO: 113884 - DNA, 15 bp, Homo sapiens
tgggggctaaacatt

SEQ ID NO: 113885 - DNA, 15 bp, Homo sapiens
gtgggggctaaacat

SEQ ID NO: 113886 - DNA, 15 bp, Homo sapiens
agtgggggctaaaca

SEQ ID NO: 113887 - DNA, 15 bp, Homo sapiens
aagtgggggctaaac

SEQ ID NO: 113888 - DNA, 15 bp, Homo sapiens
caagtgggggctaaa

SEQ ID NO: 113889 - DNA, 15 bp, Homo sapiens
acaagtgggggctaa

SEQ ID NO: 113890 - DNA, 15 bp, Homo sapiens
tacaagtgggggcta

SEQ ID NO: 113891 - DNA, 15 bp, Homo sapiens
ttacaagtgggggct

SEQ ID NO: 113892 - DNA, 15 bp, Homo sapiens
cttacaagtgggggc

SEQ ID NO: 113893 - DNA, 15 bp, Homo sapiens
gcttacaagtggggg

SEQ ID NO: 113894 - DNA, 15 bp, Homo sapiens
cgcttacaagtgggg

SEQ ID NO: 113895 - DNA, 15 bp, Homo sapiens
tcgcttacaagtggg

SEQ ID NO: 113896 - DNA, 15 bp, Homo sapiens
ctcgcttacaagtgg

SEQ ID NO: 113897 - DNA, 15 bp, Homo sapiens
tctcgcttacaagtg

SEQ ID NO: 113898 - DNA, 15 bp, Homo sapiens
ttctcgcttacaagt

SEQ ID NO: 113899 - DNA, 15 bp, Homo sapiens
gttctcgcttacaag

SEQ ID NO: 113900 - DNA, 15 bp, Homo sapiens
cgttctcgcttacaa

SEQ ID NO: 113901 - DNA, 15 bp, Homo sapiens
acgttctcgcttaca

SEQ ID NO: 113902 - DNA, 15 bp, Homo sapiens
cacgttctcgcttac

SEQ ID NO: 113903 - DNA, 15 bp, Homo sapiens
ccacgttctcgctta

SEQ ID NO: 113904 - DNA, 15 bp, Homo sapiens
accacgttctcgctt

SEQ ID NO: 113905 - DNA, 15 bp, Homo sapiens
taccacgttctcgct

SEQ ID NO: 113906 - DNA, 15 bp, Homo sapiens
ttaccacgttctcgc

SEQ ID NO: 113907 - DNA, 15 bp, Homo sapiens
attaccacgttctcg

SEQ ID NO: 113908 - DNA, 15 bp, Homo sapiens
aattaccacgttctc

SEQ ID NO: 113909 - DNA, 15 bp, Homo sapiens
caattaccacgttct

SEQ ID NO: 113910 - DNA, 15 bp, Homo sapiens
ccaattaccacgttc

SEQ ID NO: 113911 - DNA, 15 bp, Homo sapiens
accaattaccacgtt

SEQ ID NO: 113912 - DNA, 15 bp, Homo sapiens
aaccaattaccacgt

SEQ ID NO: 113913 - DNA, 15 bp, Homo sapiens
aaaccaattaccacg

SEQ ID NO: 113914 - DNA, 15 bp, Homo sapiens
gaaaccaattaccac

SEQ ID NO: 113915 - DNA, 15 bp, Homo sapiens
ggaaaccaattacca

SEQ ID NO: 113916 - DNA, 15 bp, Homo sapiens
gggaaaccaattacc

SEQ ID NO: 113917 - DNA, 15 bp, Homo sapiens
tgggaaaccaattac

SEQ ID NO: 113918 - DNA, 15 bp, Homo sapiens
atgggaaaccaatta

SEQ ID NO: 113919 - DNA, 15 bp, Homo sapiens
aatgggaaaccaatt

SEQ ID NO: 113920 - DNA, 15 bp, Homo sapiens
gaatgggaaaccaat

SEQ ID NO: 113921 - DNA, 15 bp, Homo sapiens
ggaatgggaaaccaa

SEQ ID NO: 113922 - DNA, 15 bp, Homo sapiens
aggaatgggaaacca

SEQ ID NO: 113923 - DNA, 15 bp, Homo sapiens
caggaatgggaaacc

SEQ ID NO: 113924 - DNA, 15 bp, Homo sapiens
gcaggaatgggaaac

SEQ ID NO: 113925 - DNA, 15 bp, Homo sapiens
tgcaggaatgggaaa

SEQ ID NO: 113926 - DNA, 15 bp, Homo sapiens
atgcaggaatgggaa

SEQ ID NO: 113927 - DNA, 15 bp, Homo sapiens
aatgcaggaatggga

SEQ ID NO: 113928 - DNA, 15 bp, Homo sapiens
taatgcaggaatggg

SEQ ID NO: 113929 - DNA, 15 bp, Homo sapiens
ttaatgcaggaatgg

SEQ ID NO: 113930 - DNA, 15 bp, Homo sapiens
attaatgcaggaatg

SEQ ID NO: 113931 - DNA, 15 bp, Homo sapiens
aattaatgcaggaat

SEQ ID NO: 113932 - DNA, 15 bp, Homo sapiens
gaattaatgcaggaa

SEQ ID NO: 113933 - DNA, 15 bp, Homo sapiens
tgaattaatgcagga

SEQ ID NO: 113934 - DNA, 15 bp, Homo sapiens
gtgaattaatgcagg

SEQ ID NO: 113935 - DNA, 15 bp, Homo sapiens
agtgaattaatgcag

SEQ ID NO: 113936 - DNA, 15 bp, Homo sapiens
aagtgaattaatgca

SEQ ID NO: 113937 - DNA, 15 bp, Homo sapiens
taagtgaattaatgc

SEQ ID NO: 113938 - DNA, 15 bp, Homo sapiens
ctaagtgaattaatg

SEQ ID NO: 113939 - DNA, 15 bp, Homo sapiens
cctaagtgaattaat

SEQ ID NO: 113940 - DNA, 15 bp, Homo sapiens
tcctaagtgaattaa

SEQ ID NO: 113941 - DNA, 15 bp, Homo sapiens
atcctaagtgaatta

SEQ ID NO: 113942 - DNA, 15 bp, Homo sapiens
tatcctaagtgaatt

SEQ ID NO: 113943 - DNA, 15 bp, Homo sapiens
ttatcctaagtgaat

SEQ ID NO: 113944 - DNA, 15 bp, Homo sapiens
attatcctaagtgaa

SEQ ID NO: 113945 - DNA, 15 bp, Homo sapiens
cattatcctaagtga

SEQ ID NO: 113946 - DNA, 15 bp, Homo sapiens
ccattatcctaagtg

SEQ ID NO: 113947 - DNA, 15 bp, Homo sapiens
gaggccattatccta

SEQ ID NO: 113948 - DNA, 15 bp, Homo sapiens
cagctggaggccatt

SEQ ID NO: 113949 - DNA, 15 bp, Homo sapiens
gcagctggaggccat

SEQ ID NO: 113950 - DNA, 15 bp, Homo sapiens
tgcagctggaggcca

SEQ ID NO: 113951 - DNA, 15 bp, Homo sapiens
ttgcagctggaggcc

SEQ ID NO: 113952 - DNA, 15 bp, Homo sapiens
gttgcagctggaggc

SEQ ID NO: 113953 - DNA, 15 bp, Homo sapiens
ggttgcagctggagg

SEQ ID NO: 113954 - DNA, 15 bp, Homo sapiens
tggttgcagctggag

SEQ ID NO: 113955 - DNA, 15 bp, Homo sapiens
atggttgcagctgga

SEQ ID NO: 113956 - DNA, 15 bp, Homo sapiens
catggttgcagctgg

SEQ ID NO: 113957 - DNA, 15 bp, Homo sapiens
acatggttgcagctg

SEQ ID NO: 113958 - DNA, 15 bp, Homo sapiens
aacatggttgcagct

SEQ ID NO: 113959 - DNA, 15 bp, Homo sapiens
caacatggttgcagc

SEQ ID NO: 113960 - DNA, 15 bp, Homo sapiens
gcaacatggttgcag

SEQ ID NO: 113961 - DNA, 15 bp, Homo sapiens
agcaacatggttgca

SEQ ID NO: 113962 - DNA, 15 bp, Homo sapiens
cagcaacatggttgc

SEQ ID NO: 113963 - DNA, 15 bp, Homo sapiens
gcagcaacatggttg

SEQ ID NO: 113964 - DNA, 15 bp, Homo sapiens
tgcagcaacatggtt

SEQ ID NO: 113965 - DNA, 15 bp, Homo sapiens
ttgcagcaacatggt

SEQ ID NO: 113966 - DNA, 15 bp, Homo sapiens
tttgcagcaacatgg

SEQ ID NO: 113967 - DNA, 15 bp, Homo sapiens
ctttgcagcaacatg

SEQ ID NO: 113968 - DNA, 15 bp, Homo sapiens
cctttgcagcaacat

SEQ ID NO: 113969 - DNA, 15 bp, Homo sapiens
tcctttgcagcaaca

SEQ ID NO: 113970 - DNA, 15 bp, Homo sapiens
gtcctttgcagcaac

SEQ ID NO: 113971 - DNA, 15 bp, Homo sapiens
tgtcctttgcagcaa

SEQ ID NO: 113972 - DNA, 15 bp, Homo sapiens
gaatgaaatcatgtc

SEQ ID NO: 113973 - DNA, 15 bp, Homo sapiens
agaatgaaatcatgt

SEQ ID NO: 113974 - DNA, 15 bp, Homo sapiens
aagaatgaaatcatg

SEQ ID NO: 113975 - DNA, 15 bp, Homo sapiens
aaagaatgaaatcat

SEQ ID NO: 113976 - DNA, 15 bp, Homo sapiens
aaaagaatgaaatca

SEQ ID NO: 113977 - DNA, 15 bp, Homo sapiens
aaaaagaatgaaatc

SEQ ID NO: 113978 - DNA, 15 bp, Homo sapiens
aaaaaagaatgaaat

SEQ ID NO: 113979 - DNA, 15 bp, Homo sapiens
taaaaaagaatgaaa

SEQ ID NO: 113980 - DNA, 15 bp, Homo sapiens
ataaaaaagaatgaa

SEQ ID NO: 113981 - DNA, 15 bp, Homo sapiens
cataaaaaagaatga

SEQ ID NO: 113982 - DNA, 15 bp, Homo sapiens
ccataaaaaagaatg

SEQ ID NO: 113983 - DNA, 15 bp, Homo sapiens
accataaaaaagaat

SEQ ID NO: 113984 - DNA, 15 bp, Homo sapiens
aaccataaaaaagaa

SEQ ID NO: 113985 - DNA, 15 bp, Homo sapiens
caaccataaaaaaga

SEQ ID NO: 113986 - DNA, 15 bp, Homo sapiens
acaaccataaaaaag

SEQ ID NO: 113987 - DNA, 15 bp, Homo sapiens
tacaaccataaaaaa

SEQ ID NO: 113988 - DNA, 15 bp, Homo sapiens
atacaaccataaaaa

SEQ ID NO: 113989 - DNA, 15 bp, Homo sapiens
catacaaccataaaa

SEQ ID NO: 113990 - DNA, 15 bp, Homo sapiens
ccatacaaccataaa

SEQ ID NO: 113991 - DNA, 15 bp, Homo sapiens
accatacaaccataa

SEQ ID NO: 113992 - DNA, 15 bp, Homo sapiens
taccatacaaccata

SEQ ID NO: 113993 - DNA, 15 bp, Homo sapiens
gtaccatacaaccat

SEQ ID NO: 113994 - DNA, 15 bp, Homo sapiens
agtaccatacaacca

SEQ ID NO: 113995 - DNA, 15 bp, Homo sapiens
gagtaccatacaacc

SEQ ID NO: 113996 - DNA, 15 bp, Homo sapiens
ggagtaccatacaac

SEQ ID NO: 113997 - DNA, 15 bp, Homo sapiens
tggagtaccatacaa

SEQ ID NO: 113998 - DNA, 15 bp, Homo sapiens
atggagtaccataca

SEQ ID NO: 113999 - DNA, 15 bp, Homo sapiens
catggagtaccatac

SEQ ID NO: 114000 - DNA, 15 bp, Homo sapiens
ccatggagtaccata

SEQ ID NO: 114001 - DNA, 15 bp, Homo sapiens
accatggagtaccat

SEQ ID NO: 114002 - DNA, 15 bp, Homo sapiens
caccatggagtacca

SEQ ID NO: 114003 - DNA, 15 bp, Homo sapiens
acaccatggagtacc

SEQ ID NO: 114004 - DNA, 15 bp, Homo sapiens
tacatatacaccatg

SEQ ID NO: 114005 - DNA, 15 bp, Homo sapiens
atacatatacaccat

SEQ ID NO: 114006 - DNA, 15 bp, Homo sapiens
gatacatatacacca

SEQ ID NO: 114007 - DNA, 15 bp, Homo sapiens
tgatacatatacacc

SEQ ID NO: 114008 - DNA, 15 bp, Homo sapiens
gtgatacatatacac

SEQ ID NO: 114009 - DNA, 15 bp, Homo sapiens
tgtgatacatataca

SEQ ID NO: 114010 - DNA, 15 bp, Homo sapiens
atgtgatacatatac

SEQ ID NO: 114011 - DNA, 15 bp, Homo sapiens
aatgtgatacatata

SEQ ID NO: 114012 - DNA, 15 bp, Homo sapiens
aaatgtgatacatat

SEQ ID NO: 114013 - DNA, 15 bp, Homo sapiens
aaaatgtgatacata

SEQ ID NO: 114014 - DNA, 15 bp, Homo sapiens
gaaaatgtgatacat

SEQ ID NO: 114015 - DNA, 15 bp, Homo sapiens
agaaaatgtgataca

SEQ ID NO: 114016 - DNA, 15 bp, Homo sapiens
aagaaaatgtgatac

SEQ ID NO: 114017 - DNA, 15 bp, Homo sapiens
aaagaaaatgtgata

SEQ ID NO: 114018 - DNA, 15 bp, Homo sapiens
taaagaaaatgtgat

SEQ ID NO: 114019 - DNA, 15 bp, Homo sapiens
ataaagaaaatgtga

SEQ ID NO: 114020 - DNA, 15 bp, Homo sapiens
atggtggattggata

SEQ ID NO: 114021 - DNA, 15 bp, Homo sapiens
aatggtggattggat

SEQ ID NO: 114022 - DNA, 15 bp, Homo sapiens
caatggtggattgga

SEQ ID NO: 114023 - DNA, 15 bp, Homo sapiens
tcaatggtggattgg

SEQ ID NO: 114024 - DNA, 15 bp, Homo sapiens
atcaatggtggattg

SEQ ID NO: 114025 - DNA, 15 bp, Homo sapiens
catcaatggtggatt

SEQ ID NO: 114026 - DNA, 15 bp, Homo sapiens
ccatcaatggtggat

SEQ ID NO: 114027 - DNA, 15 bp, Homo sapiens
cccatcaatggtgga

SEQ ID NO: 114028 - DNA, 15 bp, Homo sapiens
gcccatcaatggtgg

SEQ ID NO: 114029 - DNA, 15 bp, Homo sapiens
tgcccatcaatggtg

SEQ ID NO: 114030 - DNA, 15 bp, Homo sapiens
gtgcccatcaatggt

SEQ ID NO: 114031 - DNA, 15 bp, Homo sapiens
cctaggtgcccatca

SEQ ID NO: 114032 - DNA, 15 bp, Homo sapiens
acctaggtgcccatc

SEQ ID NO: 114033 - DNA, 15 bp, Homo sapiens
aacctaggtgcccat

SEQ ID NO: 114034 - DNA, 15 bp, Homo sapiens
caacctaggtgccca

SEQ ID NO: 114035 - DNA, 15 bp, Homo sapiens
tcaacctaggtgccc

SEQ ID NO: 114036 - DNA, 15 bp, Homo sapiens
atcaacctaggtgcc

SEQ ID NO: 114037 - DNA, 15 bp, Homo sapiens
catcaacctaggtgc

SEQ ID NO: 114038 - DNA, 15 bp, Homo sapiens
tcatcaacctaggtg

SEQ ID NO: 114039 - DNA, 15 bp, Homo sapiens
gtcatcaacctaggt

SEQ ID NO: 114040 - DNA, 15 bp, Homo sapiens
tgtcatcaacctagg

SEQ ID NO: 114041 - DNA, 15 bp, Homo sapiens
atgtcatcaacctag

SEQ ID NO: 114042 - DNA, 15 bp, Homo sapiens
catgtcatcaaccta

SEQ ID NO: 114043 - DNA, 15 bp, Homo sapiens
acatgtcatcaacct

SEQ ID NO: 114044 - DNA, 15 bp, Homo sapiens
gacatgtcatcaacc

SEQ ID NO: 114045 - DNA, 15 bp, Homo sapiens
ggacatgtcatcaac

SEQ ID NO: 114046 - DNA, 15 bp, Homo sapiens
aggacatgtcatcaa

SEQ ID NO: 114047 - DNA, 15 bp, Homo sapiens
aaggacatgtcatca

SEQ ID NO: 114048 - DNA, 15 bp, Homo sapiens
caaggacatgtcatc

SEQ ID NO: 114049 - DNA, 15 bp, Homo sapiens
gcaaggacatgtcat

SEQ ID NO: 114050 - DNA, 15 bp, Homo sapiens
agcaaggacatgtca

SEQ ID NO: 114051 - DNA, 15 bp, Homo sapiens
gagcaaggacatgtc

SEQ ID NO: 114052 - DNA, 15 bp, Homo sapiens
agagcaaggacatgt

SEQ ID NO: 114053 - DNA, 15 bp, Homo sapiens
aagagcaaggacatg

SEQ ID NO: 114054 - DNA, 15 bp, Homo sapiens
caagagcaaggacat

SEQ ID NO: 114055 - DNA, 15 bp, Homo sapiens
acaagagcaaggaca

SEQ ID NO: 114056 - DNA, 15 bp, Homo sapiens
cacaagagcaaggac

SEQ ID NO: 114057 - DNA, 15 bp, Homo sapiens
tcacaagagcaagga

SEQ ID NO: 114058 - DNA, 15 bp, Homo sapiens
ttcacaagagcaagg

SEQ ID NO: 114059 - DNA, 15 bp, Homo sapiens
attcacaagagcaag

SEQ ID NO: 114060 - DNA, 15 bp, Homo sapiens
tattcacaagagcaa

SEQ ID NO: 114061 - DNA, 15 bp, Homo sapiens
ctattcacaagagca

SEQ ID NO: 114062 - DNA, 15 bp, Homo sapiens
actattcacaagagc

SEQ ID NO: 114063 - DNA, 15 bp, Homo sapiens
cactattcacaagag

SEQ ID NO: 114064 - DNA, 15 bp, Homo sapiens
gcactattcacaaga

SEQ ID NO: 114065 - DNA, 15 bp, Homo sapiens
agcactattcacaag

SEQ ID NO: 114066 - DNA, 15 bp, Homo sapiens
tcagcactattcaca

SEQ ID NO: 114067 - DNA, 15 bp, Homo sapiens
atcagcactattcac

SEQ ID NO: 114068 - DNA, 15 bp, Homo sapiens
catcagcactattca

SEQ ID NO: 114069 - DNA, 15 bp, Homo sapiens
tcatcagcactattc

SEQ ID NO: 114070 - DNA, 15 bp, Homo sapiens
ttcatcagcactatt

SEQ ID NO: 114071 - DNA, 15 bp, Homo sapiens
gttcatcagcactat

SEQ ID NO: 114072 - DNA, 15 bp, Homo sapiens
tgttcatcagcacta

SEQ ID NO: 114073 - DNA, 15 bp, Homo sapiens
atgttcatcagcact

SEQ ID NO: 114074 - DNA, 15 bp, Homo sapiens
tatgttcatcagcac

SEQ ID NO: 114075 - DNA, 15 bp, Homo sapiens
atatgttcatcagca

SEQ ID NO: 114076 - DNA, 15 bp, Homo sapiens
catatgttcatcagc

SEQ ID NO: 114077 - DNA, 15 bp, Homo sapiens
tcatatgttcatcag

SEQ ID NO: 114078 - DNA, 15 bp, Homo sapiens
ctcatatgttcatca

SEQ ID NO: 114079 - DNA, 15 bp, Homo sapiens
actcatatgttcatc

SEQ ID NO: 114080 - DNA, 15 bp, Homo sapiens
cactcatatgttcat

SEQ ID NO: 114081 - DNA, 15 bp, Homo sapiens
gcactcatatgttca

SEQ ID NO: 114082 - DNA, 15 bp, Homo sapiens
tgcactcatatgttc

SEQ ID NO: 114083 - DNA, 15 bp, Homo sapiens
atgcactcatatgtt

SEQ ID NO: 114084 - DNA, 15 bp, Homo sapiens
catgcactcatatgt

SEQ ID NO: 114085 - DNA, 15 bp, Homo sapiens
acatgcactcatatg

SEQ ID NO: 114086 - DNA, 15 bp, Homo sapiens
cacatgcactcatat

SEQ ID NO: 114087 - DNA, 15 bp, Homo sapiens
acacatgcactcata

SEQ ID NO: 114088 - DNA, 15 bp, Homo sapiens
gacacatgcactcat

SEQ ID NO: 114089 - DNA, 15 bp, Homo sapiens
agacacatgcactca

SEQ ID NO: 114090 - DNA, 15 bp, Homo sapiens
aagacacatgcactc

SEQ ID NO: 114091 - DNA, 15 bp, Homo sapiens
aaagacacatgcact

SEQ ID NO: 114092 - DNA, 15 bp, Homo sapiens
aaaagacacatgcac

SEQ ID NO: 114093 - DNA, 15 bp, Homo sapiens
aaaaagacacatgca

SEQ ID NO: 114094 - DNA, 15 bp, Homo sapiens
caaaaagacacatgc

SEQ ID NO: 114095 - DNA, 15 bp, Homo sapiens
ccaaaaagacacatg

SEQ ID NO: 114096 - DNA, 15 bp, Homo sapiens
accaaaaagacacat

SEQ ID NO: 114097 - DNA, 15 bp, Homo sapiens
taccaaaaagacaca

SEQ ID NO: 114098 - DNA, 15 bp, Homo sapiens
ctaccaaaaagacac

SEQ ID NO: 114099 - DNA, 15 bp, Homo sapiens
tctaccaaaaagaca

SEQ ID NO: 114100 - DNA, 15 bp, Homo sapiens
ttctaccaaaaagac

SEQ ID NO: 114101 - DNA, 15 bp, Homo sapiens
gttctaccaaaaaga

SEQ ID NO: 114102 - DNA, 15 bp, Homo sapiens
tgttctaccaaaaag

SEQ ID NO: 114103 - DNA, 15 bp, Homo sapiens
ctgttctaccaaaaa

SEQ ID NO: 114104 - DNA, 15 bp, Homo sapiens
actgttctaccaaaa

SEQ ID NO: 114105 - DNA, 15 bp, Homo sapiens
aactgttctaccaaa

SEQ ID NO: 114106 - DNA, 15 bp, Homo sapiens
aaactgttctaccaa

SEQ ID NO: 114107 - DNA, 15 bp, Homo sapiens
taaactgttctacca

SEQ ID NO: 114108 - DNA, 15 bp, Homo sapiens
ataaactgttctacc

SEQ ID NO: 114109 - DNA, 15 bp, Homo sapiens
aataaactgttctac

SEQ ID NO: 114110 - DNA, 15 bp, Homo sapiens
aaataaactgttcta

SEQ ID NO: 114111 - DNA, 15 bp, Homo sapiens
aaaataaactgttct

SEQ ID NO: 114112 - DNA, 15 bp, Homo sapiens
gaaaataaactgttc

SEQ ID NO: 114113 - DNA, 15 bp, Homo sapiens
ggaaaataaactgtt

SEQ ID NO: 114114 - DNA, 15 bp, Homo sapiens
aggaaaataaactgt

SEQ ID NO: 114115 - DNA, 15 bp, Homo sapiens
aaggaaaataaactg

SEQ ID NO: 114116 - DNA, 15 bp, Homo sapiens
aaaggaaaataaact

SEQ ID NO: 114117 - DNA, 15 bp, Homo sapiens
caaaggaaaataaac

SEQ ID NO: 114118 - DNA, 15 bp, Homo sapiens
gcaaaggaaaataaa

SEQ ID NO: 114119 - DNA, 15 bp, Homo sapiens
ggcaaaggaaaataa

SEQ ID NO: 114120 - DNA, 15 bp, Homo sapiens
aggcaaaggaaaata

SEQ ID NO: 114121 - DNA, 15 bp, Homo sapiens
taggcaaaggaaaat

SEQ ID NO: 114122 - DNA, 15 bp, Homo sapiens
ataggcaaaggaaaa

SEQ ID NO: 114123 - DNA, 15 bp, Homo sapiens
tataggcaaaggaaa

SEQ ID NO: 114124 - DNA, 15 bp, Homo sapiens
atataggcaaaggaa

SEQ ID NO: 114125 - DNA, 15 bp, Homo sapiens
tatataggcaaagga

SEQ ID NO: 114126 - DNA, 15 bp, Homo sapiens
gtatataggcaaagg

SEQ ID NO: 114127 - DNA, 15 bp, Homo sapiens
ggtatataggcaaag

SEQ ID NO: 114128 - DNA, 15 bp, Homo sapiens
gggtatataggcaaa

SEQ ID NO: 114129 - DNA, 15 bp, Homo sapiens
tgggtatataggcaa

SEQ ID NO: 114130 - DNA, 15 bp, Homo sapiens
ctgggtatataggca

SEQ ID NO: 114131 - DNA, 15 bp, Homo sapiens
actgggtatataggc

SEQ ID NO: 114132 - DNA, 15 bp, Homo sapiens
tactgggtatatagg

SEQ ID NO: 114133 - DNA, 15 bp, Homo sapiens
ttactgggtatatag

SEQ ID NO: 114134 - DNA, 15 bp, Homo sapiens
gattactgggtatat

SEQ ID NO: 114135 - DNA, 15 bp, Homo sapiens
tgattactgggtata

SEQ ID NO: 114136 - DNA, 15 bp, Homo sapiens
ctgattactgggtat

SEQ ID NO: 114137 - DNA, 15 bp, Homo sapiens
tctgattactgggta

SEQ ID NO: 114138 - DNA, 15 bp, Homo sapiens
atctgattactgggt

SEQ ID NO: 114139 - DNA, 15 bp, Homo sapiens
aatctgattactggg

SEQ ID NO: 114140 - DNA, 15 bp, Homo sapiens
aaatctgattactgg

SEQ ID NO: 114141 - DNA, 15 bp, Homo sapiens
gaaatctgattactg

SEQ ID NO: 114142 - DNA, 15 bp, Homo sapiens
agaaatctgattact

SEQ ID NO: 114143 - DNA, 15 bp, Homo sapiens
cagaaatctgattac

SEQ ID NO: 114144 - DNA, 15 bp, Homo sapiens
ccagaaatctgatta

SEQ ID NO: 114145 - DNA, 15 bp, Homo sapiens
cccagaaatctgatt

SEQ ID NO: 114146 - DNA, 15 bp, Homo sapiens
acccagaaatctgat

SEQ ID NO: 114147 - DNA, 15 bp, Homo sapiens
gacccagaaatctga

SEQ ID NO: 114148 - DNA, 15 bp, Homo sapiens
tgacccagaaatctg

SEQ ID NO: 114149 - DNA, 15 bp, Homo sapiens
ctgacccagaaatct

SEQ ID NO: 114150 - DNA, 15 bp, Homo sapiens
actgacccagaaatc

SEQ ID NO: 114151 - DNA, 15 bp, Homo sapiens
tactgacccagaaat

SEQ ID NO: 114152 - DNA, 15 bp, Homo sapiens
ttactgacccagaaa

SEQ ID NO: 114153 - DNA, 15 bp, Homo sapiens
attactgacccagaa

SEQ ID NO: 114154 - DNA, 15 bp, Homo sapiens
gattactgacccaga

SEQ ID NO: 114155 - DNA, 15 bp, Homo sapiens
tgattactgacccag

SEQ ID NO: 114156 - DNA, 15 bp, Homo sapiens
ctgattactgaccca

SEQ ID NO: 114157 - DNA, 15 bp, Homo sapiens
tctgattactgaccc

SEQ ID NO: 114158 - DNA, 15 bp, Homo sapiens
ttctgattactgacc

SEQ ID NO: 114159 - DNA, 15 bp, Homo sapiens
attctgattactgac

SEQ ID NO: 114160 - DNA, 15 bp, Homo sapiens
aattctgattactga

SEQ ID NO: 114161 - DNA, 15 bp, Homo sapiens
gaattctgattactg

SEQ ID NO: 114162 - DNA, 15 bp, Homo sapiens
agaattctgattact

SEQ ID NO: 114163 - DNA, 15 bp, Homo sapiens
cagaattctgattac

SEQ ID NO: 114164 - DNA, 15 bp, Homo sapiens
acagaattctgatta

SEQ ID NO: 114165 - DNA, 15 bp, Homo sapiens
aacagaattctgatt

SEQ ID NO: 114166 - DNA, 15 bp, Homo sapiens
aaacagaattctgat

SEQ ID NO: 114167 - DNA, 15 bp, Homo sapiens
caaacagaattctga

SEQ ID NO: 114168 - DNA, 15 bp, Homo sapiens
tcaaacagaattctg

SEQ ID NO: 114169 - DNA, 15 bp, Homo sapiens
ttcaaacagaattct

SEQ ID NO: 114170 - DNA, 15 bp, Homo sapiens
cttcaaacagaattc

SEQ ID NO: 114171 - DNA, 15 bp, Homo sapiens
acttcaaacagaatt

SEQ ID NO: 114172 - DNA, 15 bp, Homo sapiens
aacttcaaacagaat

SEQ ID NO: 114173 - DNA, 15 bp, Homo sapiens
gaacttcaaacagaa

SEQ ID NO: 114174 - DNA, 15 bp, Homo sapiens
agaacttcaaacaga

SEQ ID NO: 114175 - DNA, 15 bp, Homo sapiens
aagaacttcaaacag

SEQ ID NO: 114176 - DNA, 15 bp, Homo sapiens
aaagaacttcaaaca

SEQ ID NO: 114177 - DNA, 15 bp, Homo sapiens
caaagaacttcaaac

SEQ ID NO: 114178 - DNA, 15 bp, Homo sapiens
tcaaagaacttcaaa

SEQ ID NO: 114179 - DNA, 15 bp, Homo sapiens
ctcaaagaacttcaa

SEQ ID NO: 114180 - DNA, 15 bp, Homo sapiens
tctcaaagaacttca

SEQ ID NO: 114181 - DNA, 15 bp, Homo sapiens
ttctcaaagaacttc

SEQ ID NO: 114182 - DNA, 15 bp, Homo sapiens
tttctcaaagaactt

SEQ ID NO: 114183 - DNA, 15 bp, Homo sapiens
atttctcaaagaact

SEQ ID NO: 114184 - DNA, 15 bp, Homo sapiens
aatttctcaaagaac

SEQ ID NO: 114185 - DNA, 15 bp, Homo sapiens
aaatttctcaaagaa

SEQ ID NO: 114186 - DNA, 15 bp, Homo sapiens
gaaatttctcaaaga

SEQ ID NO: 114187 - DNA, 15 bp, Homo sapiens
tagaaatttctcaaa

SEQ ID NO: 114188 - DNA, 15 bp, Homo sapiens
ttagaaatttctcaa

SEQ ID NO: 114189 - DNA, 15 bp, Homo sapiens
tttagaaatttctca

SEQ ID NO: 114190 - DNA, 15 bp, Homo sapiens
gtttagaaatttctc

SEQ ID NO: 114191 - DNA, 15 bp, Homo sapiens
agtttagaaatttct

SEQ ID NO: 114192 - DNA, 15 bp, Homo sapiens
cagtttagaaatttc

SEQ ID NO: 114193 - DNA, 15 bp, Homo sapiens
gcagtttagaaattt

SEQ ID NO: 114194 - DNA, 15 bp, Homo sapiens
agcagtttagaaatt

SEQ ID NO: 114195 - DNA, 15 bp, Homo sapiens
aagcagtttagaaat

SEQ ID NO: 114196 - DNA, 15 bp, Homo sapiens
aaagcagtttagaaa

SEQ ID NO: 114197 - DNA, 15 bp, Homo sapiens
gaaagcagtttagaa

SEQ ID NO: 114198 - DNA, 15 bp, Homo sapiens
ggaaagcagtttaga

SEQ ID NO: 114199 - DNA, 15 bp, Homo sapiens
tggaaagcagtttag

SEQ ID NO: 114200 - DNA, 15 bp, Homo sapiens
gtggaaagcagttta

SEQ ID NO: 114201 - DNA, 15 bp, Homo sapiens
tgtggaaagcagttt

SEQ ID NO: 114202 - DNA, 15 bp, Homo sapiens
ctgtggaaagcagtt

SEQ ID NO: 114203 - DNA, 15 bp, Homo sapiens
tctgtggaaagcagt

SEQ ID NO: 114204 - DNA, 15 bp, Homo sapiens
ctctgtggaaagcag

SEQ ID NO: 114205 - DNA, 15 bp, Homo sapiens
cctctgtggaaagca

SEQ ID NO: 114206 - DNA, 15 bp, Homo sapiens
gcctctgtggaaagc

SEQ ID NO: 114207 - DNA, 15 bp, Homo sapiens
agcctctgtggaaag

SEQ ID NO: 114208 - DNA, 15 bp, Homo sapiens
cagcctctgtggaaa

SEQ ID NO: 114209 - DNA, 15 bp, Homo sapiens
tcagcctctgtggaa

SEQ ID NO: 114210 - DNA, 15 bp, Homo sapiens
ttcagcctctgtgga

SEQ ID NO: 114211 - DNA, 15 bp, Homo sapiens
gttcagcctctgtgg

SEQ ID NO: 114212 - DNA, 15 bp, Homo sapiens
agttcagcctctgtg

SEQ ID NO: 114213 - DNA, 15 bp, Homo sapiens
tagttcagcctctgt

SEQ ID NO: 114214 - DNA, 15 bp, Homo sapiens
ttagttcagcctctg

SEQ ID NO: 114215 - DNA, 15 bp, Homo sapiens
attagttcagcctct

SEQ ID NO: 114216 - DNA, 15 bp, Homo sapiens
aattagttcagcctc

SEQ ID NO: 114217 - DNA, 15 bp, Homo sapiens
aaattagttcagcct

SEQ ID NO: 114218 - DNA, 15 bp, Homo sapiens
taaattagttcagcc

SEQ ID NO: 114219 - DNA, 15 bp, Homo sapiens
gtaaattagttcagc

SEQ ID NO: 114220 - DNA, 15 bp, Homo sapiens
tgtaaattagttcag

SEQ ID NO: 114221 - DNA, 15 bp, Homo sapiens
atgtaaattagttca

SEQ ID NO: 114222 - DNA, 15 bp, Homo sapiens
aatgtaaattagttc

SEQ ID NO: 114223 - DNA, 15 bp, Homo sapiens
gaatgtaaattagtt

SEQ ID NO: 114224 - DNA, 15 bp, Homo sapiens
ggaatgtaaattagt

SEQ ID NO: 114225 - DNA, 15 bp, Homo sapiens
gggaatgtaaattag

SEQ ID NO: 114226 - DNA, 15 bp, Homo sapiens
tgggaatgtaaatta

SEQ ID NO: 114227 - DNA, 15 bp, Homo sapiens
gtgggaatgtaaatt

SEQ ID NO: 114228 - DNA, 15 bp, Homo sapiens
ggtgggaatgtaaat

SEQ ID NO: 114229 - DNA, 15 bp, Homo sapiens
tggtgggaatgtaaa

SEQ ID NO: 114230 - DNA, 15 bp, Homo sapiens
ttggtgggaatgtaa

SEQ ID NO: 114231 - DNA, 15 bp, Homo sapiens
gttggtgggaatgta

SEQ ID NO: 114232 - DNA, 15 bp, Homo sapiens
tgttggtgggaatgt

SEQ ID NO: 114233 - DNA, 15 bp, Homo sapiens
ctgttggtgggaatg

SEQ ID NO: 114234 - DNA, 15 bp, Homo sapiens
actgttggtgggaat

SEQ ID NO: 114235 - DNA, 15 bp, Homo sapiens
tactgttggtgggaa

SEQ ID NO: 114236 - DNA, 15 bp, Homo sapiens
atactgttggtggga

SEQ ID NO: 114237 - DNA, 15 bp, Homo sapiens
tatactgttggtggg

SEQ ID NO: 114238 - DNA, 15 bp, Homo sapiens
ttatactgttggtgg

SEQ ID NO: 114239 - DNA, 15 bp, Homo sapiens
tttatactgttggtg

SEQ ID NO: 114240 - DNA, 15 bp, Homo sapiens
ttttatactgttggt

SEQ ID NO: 114241 - DNA, 15 bp, Homo sapiens
cttttatactgttgg

SEQ ID NO: 114242 - DNA, 15 bp, Homo sapiens
acttttatactgttg

SEQ ID NO: 114243 - DNA, 15 bp, Homo sapiens
cacttttatactgtt

SEQ ID NO: 114244 - DNA, 15 bp, Homo sapiens
acacttttatactgt

SEQ ID NO: 114245 - DNA, 15 bp, Homo sapiens
aacacttttatactg

SEQ ID NO: 114246 - DNA, 15 bp, Homo sapiens
gaacacttttatact

SEQ ID NO: 114247 - DNA, 15 bp, Homo sapiens
ggaacacttttatac

SEQ ID NO: 114248 - DNA, 15 bp, Homo sapiens
aggaacacttttata

SEQ ID NO: 114249 - DNA, 15 bp, Homo sapiens
aaggaacacttttat

SEQ ID NO: 114250 - DNA, 15 bp, Homo sapiens
aaaggaacactttta

SEQ ID NO: 114251 - DNA, 15 bp, Homo sapiens
aaaaggaacactttt

SEQ ID NO: 114252 - DNA, 15 bp, Homo sapiens
aaaaaggaacacttt

SEQ ID NO: 114253 - DNA, 15 bp, Homo sapiens
gaaaaaggaacactt

SEQ ID NO: 114254 - DNA, 15 bp, Homo sapiens
agaaaaaggaacact

SEQ ID NO: 114255 - DNA, 15 bp, Homo sapiens
gagaaaaaggaacac

SEQ ID NO: 114256 - DNA, 15 bp, Homo sapiens
agagaaaaaggaaca

SEQ ID NO: 114257 - DNA, 15 bp, Homo sapiens
cagagaaaaaggaac

SEQ ID NO: 114258 - DNA, 15 bp, Homo sapiens
gcagagaaaaaggaa

SEQ ID NO: 114259 - DNA, 15 bp, Homo sapiens
tgcagagaaaaagga

SEQ ID NO: 114260 - DNA, 15 bp, Homo sapiens
ttgcagagaaaaagg

SEQ ID NO: 114261 - DNA, 15 bp, Homo sapiens
gttgcagagaaaaag

SEQ ID NO: 114262 - DNA, 15 bp, Homo sapiens
ggttgcagagaaaaa

SEQ ID NO: 114263 - DNA, 15 bp, Homo sapiens
aggttgcagagaaaa

SEQ ID NO: 114264 - DNA, 15 bp, Homo sapiens
aaggttgcagagaaa

SEQ ID NO: 114265 - DNA, 15 bp, Homo sapiens
caaggttgcagagaa

SEQ ID NO: 114266 - DNA, 15 bp, Homo sapiens
acaaggttgcagaga

SEQ ID NO: 114267 - DNA, 15 bp, Homo sapiens
gacaaggttgcagag

SEQ ID NO: 114268 - DNA, 15 bp, Homo sapiens
tgacaaggttgcaga

SEQ ID NO: 114269 - DNA, 15 bp, Homo sapiens
ttgacaaggttgcag

SEQ ID NO: 114270 - DNA, 15 bp, Homo sapiens
gttgacaaggttgca

SEQ ID NO: 114271 - DNA, 15 bp, Homo sapiens
tgttgacaaggttgc

SEQ ID NO: 114272 - DNA, 15 bp, Homo sapiens
atgttgacaaggttg

SEQ ID NO: 114273 - DNA, 15 bp, Homo sapiens
gatgttgacaaggtt

SEQ ID NO: 114274 - DNA, 15 bp, Homo sapiens
agatgttgacaaggt

SEQ ID NO: 114275 - DNA, 15 bp, Homo sapiens
cagatgttgacaagg

SEQ ID NO: 114276 - DNA, 15 bp, Homo sapiens
acagatgttgacaag

SEQ ID NO: 114277 - DNA, 15 bp, Homo sapiens
aacagatgttgacaa

SEQ ID NO: 114278 - DNA, 15 bp, Homo sapiens
taacagatgttgaca

SEQ ID NO: 114279 - DNA, 15 bp, Homo sapiens
ataacagatgttgac

SEQ ID NO: 114280 - DNA, 15 bp, Homo sapiens
aataacagatgttga

SEQ ID NO: 114281 - DNA, 15 bp, Homo sapiens
aaataacagatgttg

SEQ ID NO: 114282 - DNA, 15 bp, Homo sapiens
aaaaataacagatgt

SEQ ID NO: 114283 - DNA, 15 bp, Homo sapiens
aaaaaataacagatg

SEQ ID NO: 114284 - DNA, 15 bp, Homo sapiens
caaaaaataacagat

SEQ ID NO: 114285 - DNA, 15 bp, Homo sapiens
tcaaaaaataacaga

SEQ ID NO: 114286 - DNA, 15 bp, Homo sapiens
gtcaaaaaataacag

SEQ ID NO: 114287 - DNA, 15 bp, Homo sapiens
agtcaaaaaataaca

SEQ ID NO: 114288 - DNA, 15 bp, Homo sapiens
aagtcaaaaaataac

SEQ ID NO: 114289 - DNA, 15 bp, Homo sapiens
tattattaaaaagtc

SEQ ID NO: 114290 - DNA, 15 bp, Homo sapiens
ctattattaaaaagt

SEQ ID NO: 114291 - DNA, 15 bp, Homo sapiens
agctattattaaaaa

SEQ ID NO: 114292 - DNA, 15 bp, Homo sapiens
tagctattattaaaa

SEQ ID NO: 114293 - DNA, 15 bp, Homo sapiens
atagctattattaaa

SEQ ID NO: 114294 - DNA, 15 bp, Homo sapiens
aatagctattattaa

SEQ ID NO: 114295 - DNA, 15 bp, Homo sapiens
gaatagctattatta

SEQ ID NO: 114296 - DNA, 15 bp, Homo sapiens
agaatagctattatt

SEQ ID NO: 114297 - DNA, 15 bp, Homo sapiens
tagaatagctattat

SEQ ID NO: 114298 - DNA, 15 bp, Homo sapiens
ttagaatagctatta

SEQ ID NO: 114299 - DNA, 15 bp, Homo sapiens
tttagaatagctatt

SEQ ID NO: 114300 - DNA, 15 bp, Homo sapiens
atttagaatagctat

SEQ ID NO: 114301 - DNA, 15 bp, Homo sapiens
catttagaatagcta

SEQ ID NO: 114302 - DNA, 15 bp, Homo sapiens
ccatttagaatagct

SEQ ID NO: 114303 - DNA, 15 bp, Homo sapiens
accatttagaatagc

SEQ ID NO: 114304 - DNA, 15 bp, Homo sapiens
caccatttagaatag

SEQ ID NO: 114305 - DNA, 15 bp, Homo sapiens
acaccatttagaata

SEQ ID NO: 114306 - DNA, 15 bp, Homo sapiens
cacaccatttagaat

SEQ ID NO: 114307 - DNA, 15 bp, Homo sapiens
tcacaccatttagaa

SEQ ID NO: 114308 - DNA, 15 bp, Homo sapiens
ctcacaccatttaga

SEQ ID NO: 114309 - DNA, 15 bp, Homo sapiens
tctcacaccatttag

SEQ ID NO: 114310 - DNA, 15 bp, Homo sapiens
atctcacaccattta

SEQ ID NO: 114311 - DNA, 15 bp, Homo sapiens
catctcacaccattt

SEQ ID NO: 114312 - DNA, 15 bp, Homo sapiens
ccatctcacaccatt

SEQ ID NO: 114313 - DNA, 15 bp, Homo sapiens
accatctcacaccat

SEQ ID NO: 114314 - DNA, 15 bp, Homo sapiens
taccatctcacacca

SEQ ID NO: 114315 - DNA, 15 bp, Homo sapiens
ataccatctcacacc

SEQ ID NO: 114316 - DNA, 15 bp, Homo sapiens
gataccatctcacac

SEQ ID NO: 114317 - DNA, 15 bp, Homo sapiens
tgagataccatctca

SEQ ID NO: 114318 - DNA, 15 bp, Homo sapiens
atgagataccatctc

SEQ ID NO: 114319 - DNA, 15 bp, Homo sapiens
aatgagataccatct

SEQ ID NO: 114320 - DNA, 15 bp, Homo sapiens
caatgagataccatc

SEQ ID NO: 114321 - DNA, 15 bp, Homo sapiens
acaatgagataccat

SEQ ID NO: 114322 - DNA, 15 bp, Homo sapiens
cacaatgagatacca

SEQ ID NO: 114323 - DNA, 15 bp, Homo sapiens
ccacaatgagatacc

SEQ ID NO: 114324 - DNA, 15 bp, Homo sapiens
accacaatgagatac

SEQ ID NO: 114325 - DNA, 15 bp, Homo sapiens
aaccacaatgagata

SEQ ID NO: 114326 - DNA, 15 bp, Homo sapiens
aaaccacaatgagat

SEQ ID NO: 114327 - DNA, 15 bp, Homo sapiens
gaaaccacaatgaga

SEQ ID NO: 114328 - DNA, 15 bp, Homo sapiens
tgaaaccacaatgag

SEQ ID NO: 114329 - DNA, 15 bp, Homo sapiens
ttgaaaccacaatga

SEQ ID NO: 114330 - DNA, 15 bp, Homo sapiens
attgaaaccacaatg

SEQ ID NO: 114331 - DNA, 15 bp, Homo sapiens
aattgaaaccacaat

SEQ ID NO: 114332 - DNA, 15 bp, Homo sapiens
aaattgaaaccacaa

SEQ ID NO: 114333 - DNA, 15 bp, Homo sapiens
caaattgaaaccaca

SEQ ID NO: 114334 - DNA, 15 bp, Homo sapiens
gcaaattgaaaccac

SEQ ID NO: 114335 - DNA, 15 bp, Homo sapiens
tgcaaattgaaacca

SEQ ID NO: 114336 - DNA, 15 bp, Homo sapiens
atgcaaattgaaacc

SEQ ID NO: 114337 - DNA, 15 bp, Homo sapiens
aatgcaaattgaaac

SEQ ID NO: 114338 - DNA, 15 bp, Homo sapiens
aaatgcaaattgaaa

SEQ ID NO: 114339 - DNA, 15 bp, Homo sapiens
gaaatgcaaattgaa

SEQ ID NO: 114340 - DNA, 15 bp, Homo sapiens
agaaatgcaaattga

SEQ ID NO: 114341 - DNA, 15 bp, Homo sapiens
gagaaatgcaaattg

SEQ ID NO: 114342 - DNA, 15 bp, Homo sapiens
agagaaatgcaaatt

SEQ ID NO: 114343 - DNA, 15 bp, Homo sapiens
tagagaaatgcaaat

SEQ ID NO: 114344 - DNA, 15 bp, Homo sapiens
ttagagaaatgcaaa

SEQ ID NO: 114345 - DNA, 15 bp, Homo sapiens
attagagaaatgcaa

SEQ ID NO: 114346 - DNA, 15 bp, Homo sapiens
cattagagaaatgca

SEQ ID NO: 114347 - DNA, 15 bp, Homo sapiens
acattagagaaatgc

SEQ ID NO: 114348 - DNA, 15 bp, Homo sapiens
aacattagagaaatg

SEQ ID NO: 114349 - DNA, 15 bp, Homo sapiens
taacattagagaaat

SEQ ID NO: 114350 - DNA, 15 bp, Homo sapiens
ctaacattagagaaa

SEQ ID NO: 114351 - DNA, 15 bp, Homo sapiens
actaacattagagaa

SEQ ID NO: 114352 - DNA, 15 bp, Homo sapiens
cactaacattagaga

SEQ ID NO: 114353 - DNA, 15 bp, Homo sapiens
tcactaacattagag

SEQ ID NO: 114354 - DNA, 15 bp, Homo sapiens
atcactaacattaga

SEQ ID NO: 114355 - DNA, 15 bp, Homo sapiens
catcactaacattag

SEQ ID NO: 114356 - DNA, 15 bp, Homo sapiens
acatcactaacatta

SEQ ID NO: 114357 - DNA, 15 bp, Homo sapiens
aacatcactaacatt

SEQ ID NO: 114358 - DNA, 15 bp, Homo sapiens
caacatcactaacat

SEQ ID NO: 114359 - DNA, 15 bp, Homo sapiens
tcaacatcactaaca

SEQ ID NO: 114360 - DNA, 15 bp, Homo sapiens
ctcaacatcactaac

SEQ ID NO: 114361 - DNA, 15 bp, Homo sapiens
gctcaacatcactaa

SEQ ID NO: 114362 - DNA, 15 bp, Homo sapiens
tgctcaacatcacta

SEQ ID NO: 114363 - DNA, 15 bp, Homo sapiens
atgctcaacatcact

SEQ ID NO: 114364 - DNA, 15 bp, Homo sapiens
aatgctcaacatcac

SEQ ID NO: 114365 - DNA, 15 bp, Homo sapiens
aaatgctcaacatca

SEQ ID NO: 114366 - DNA, 15 bp, Homo sapiens
aaaatgctcaacatc

SEQ ID NO: 114367 - DNA, 15 bp, Homo sapiens
cgaaaaaatgctcaa

SEQ ID NO: 114368 - DNA, 15 bp, Homo sapiens
acgaaaaaatgctca

SEQ ID NO: 114369 - DNA, 15 bp, Homo sapiens
cacgaaaaaatgctc

SEQ ID NO: 114370 - DNA, 15 bp, Homo sapiens
acacgaaaaaatgct

SEQ ID NO: 114371 - DNA, 15 bp, Homo sapiens
cacacgaaaaaatgc

SEQ ID NO: 114372 - DNA, 15 bp, Homo sapiens
acacacgaaaaaatg

SEQ ID NO: 114373 - DNA, 15 bp, Homo sapiens
aacacacgaaaaaat

SEQ ID NO: 114374 - DNA, 15 bp, Homo sapiens
caacacacgaaaaaa

SEQ ID NO: 114375 - DNA, 15 bp, Homo sapiens
acaacacacgaaaaa

SEQ ID NO: 114376 - DNA, 15 bp, Homo sapiens
aacaacacacgaaaa

SEQ ID NO: 114377 - DNA, 15 bp, Homo sapiens
caacaacacacgaaa

SEQ ID NO: 114378 - DNA, 15 bp, Homo sapiens
ccaacaacacacgaa

SEQ ID NO: 114379 - DNA, 15 bp, Homo sapiens
gccaacaacacacga

SEQ ID NO: 114380 - DNA, 15 bp, Homo sapiens
agccaacaacacacg

SEQ ID NO: 114381 - DNA, 15 bp, Homo sapiens
cagccaacaacacac

SEQ ID NO: 114382 - DNA, 15 bp, Homo sapiens
gcagccaacaacaca

SEQ ID NO: 114383 - DNA, 15 bp, Homo sapiens
agcagccaacaacac

SEQ ID NO: 114384 - DNA, 15 bp, Homo sapiens
tagcagccaacaaca

SEQ ID NO: 114385 - DNA, 15 bp, Homo sapiens
ctagcagccaacaac

SEQ ID NO: 114386 - DNA, 15 bp, Homo sapiens
actagcagccaacaa

SEQ ID NO: 114387 - DNA, 15 bp, Homo sapiens
tactagcagccaaca

SEQ ID NO: 114388 - DNA, 15 bp, Homo sapiens
atactagcagccaac

SEQ ID NO: 114389 - DNA, 15 bp, Homo sapiens
catactagcagccaa

SEQ ID NO: 114390 - DNA, 15 bp, Homo sapiens
acatactagcagcca

SEQ ID NO: 114391 - DNA, 15 bp, Homo sapiens
gacatactagcagcc

SEQ ID NO: 114392 - DNA, 15 bp, Homo sapiens
ggacatactagcagc

SEQ ID NO: 114393 - DNA, 15 bp, Homo sapiens
aggacatactagcag

SEQ ID NO: 114394 - DNA, 15 bp, Homo sapiens
aaggacatactagca

SEQ ID NO: 114395 - DNA, 15 bp, Homo sapiens
aaaggacatactagc

SEQ ID NO: 114396 - DNA, 15 bp, Homo sapiens
aaaaggacatactag

SEQ ID NO: 114397 - DNA, 15 bp, Homo sapiens
aaaaaggacatacta

SEQ ID NO: 114398 - DNA, 15 bp, Homo sapiens
caaaaaggacatact

SEQ ID NO: 114399 - DNA, 15 bp, Homo sapiens
tcaaaaaggacatac

SEQ ID NO: 114400 - DNA, 15 bp, Homo sapiens
ttcaaaaaggacata

SEQ ID NO: 114401 - DNA, 15 bp, Homo sapiens
cttcaaaaaggacat

SEQ ID NO: 114402 - DNA, 15 bp, Homo sapiens
acttcaaaaaggaca

SEQ ID NO: 114403 - DNA, 15 bp, Homo sapiens
cacttcaaaaaggac

SEQ ID NO: 114404 - DNA, 15 bp, Homo sapiens
acacttcaaaaagga

SEQ ID NO: 114405 - DNA, 15 bp, Homo sapiens
gacacttcaaaaagg

SEQ ID NO: 114406 - DNA, 15 bp, Homo sapiens
agacacttcaaaaag

SEQ ID NO: 114407 - DNA, 15 bp, Homo sapiens
cagacacttcaaaaa

SEQ ID NO: 114408 - DNA, 15 bp, Homo sapiens
acagacacttcaaaa

SEQ ID NO: 114409 - DNA, 15 bp, Homo sapiens
aacagacacttcaaa

SEQ ID NO: 114410 - DNA, 15 bp, Homo sapiens
gaacagacacttcaa

SEQ ID NO: 114411 - DNA, 15 bp, Homo sapiens
tgaacagacacttca

SEQ ID NO: 114412 - DNA, 15 bp, Homo sapiens
aatgaacagacactt

SEQ ID NO: 114413 - DNA, 15 bp, Homo sapiens
aaatgaacagacact

SEQ ID NO: 114414 - DNA, 15 bp, Homo sapiens
aaaatgaacagacac

SEQ ID NO: 114415 - DNA, 15 bp, Homo sapiens
taaaatgaacagaca

SEQ ID NO: 114416 - DNA, 15 bp, Homo sapiens
ataaaatgaacagac

SEQ ID NO: 114417 - DNA, 15 bp, Homo sapiens
aataaaatgaacaga

SEQ ID NO: 114418 - DNA, 15 bp, Homo sapiens
aaataaaatgaacag

SEQ ID NO: 114419 - DNA, 15 bp, Homo sapiens
caaataaaatgaaca

SEQ ID NO: 114420 - DNA, 15 bp, Homo sapiens
gcaaataaaatgaac

SEQ ID NO: 114421 - DNA, 15 bp, Homo sapiens
ggcaaataaaatgaa

SEQ ID NO: 114422 - DNA, 15 bp, Homo sapiens
gggcaaataaaatga

SEQ ID NO: 114423 - DNA, 15 bp, Homo sapiens
tgggcaaataaaatg

SEQ ID NO: 114424 - DNA, 15 bp, Homo sapiens
gtgggcaaataaaat

SEQ ID NO: 114425 - DNA, 15 bp, Homo sapiens
agtgggcaaataaaa

SEQ ID NO: 114426 - DNA, 15 bp, Homo sapiens
aagtgggcaaataaa

SEQ ID NO: 114427 - DNA, 15 bp, Homo sapiens
aaagtgggcaaataa

SEQ ID NO: 114428 - DNA, 15 bp, Homo sapiens
aaaagtgggcaaata

SEQ ID NO: 114429 - DNA, 15 bp, Homo sapiens
aaaaagtgggcaaat

SEQ ID NO: 114430 - DNA, 15 bp, Homo sapiens
taaaaagtgggcaaa

SEQ ID NO: 114431 - DNA, 15 bp, Homo sapiens
ttaaaaagtgggcaa

SEQ ID NO: 114432 - DNA, 15 bp, Homo sapiens
attaaaaagtgggca

SEQ ID NO: 114433 - DNA, 15 bp, Homo sapiens
cattaaaaagtgggc

SEQ ID NO: 114434 - DNA, 15 bp, Homo sapiens
ccattaaaaagtggg

SEQ ID NO: 114435 - DNA, 15 bp, Homo sapiens
cccattaaaaagtgg

SEQ ID NO: 114436 - DNA, 15 bp, Homo sapiens
ccccattaaaaagtg

SEQ ID NO: 114437 - DNA, 15 bp, Homo sapiens
accccattaaaaagt

SEQ ID NO: 114438 - DNA, 15 bp, Homo sapiens
aaccccattaaaaag

SEQ ID NO: 114439 - DNA, 15 bp, Homo sapiens
taaccccattaaaaa

SEQ ID NO: 114440 - DNA, 15 bp, Homo sapiens
ataaccccattaaaa

SEQ ID NO: 114441 - DNA, 15 bp, Homo sapiens
aataaccccattaaa

SEQ ID NO: 114442 - DNA, 15 bp, Homo sapiens
aaataaccccattaa

SEQ ID NO: 114443 - DNA, 15 bp, Homo sapiens
caaataaccccatta

SEQ ID NO: 114444 - DNA, 15 bp, Homo sapiens
acaaataaccccatt

SEQ ID NO: 114445 - DNA, 15 bp, Homo sapiens
tacaaataaccccat

SEQ ID NO: 114446 - DNA, 15 bp, Homo sapiens
ttacaaataacccca

SEQ ID NO: 114447 - DNA, 15 bp, Homo sapiens
tttacaaataacccc

SEQ ID NO: 114448 - DNA, 15 bp, Homo sapiens
ttttacaaataaccc

SEQ ID NO: 114449 - DNA, 15 bp, Homo sapiens
gttttacaaataacc

SEQ ID NO: 114450 - DNA, 15 bp, Homo sapiens
tgttttacaaataac

SEQ ID NO: 114451 - DNA, 15 bp, Homo sapiens
ctgttttacaaataa

SEQ ID NO: 114452 - DNA, 15 bp, Homo sapiens
gctgttttacaaata

SEQ ID NO: 114453 - DNA, 15 bp, Homo sapiens
agctgttttacaaat

SEQ ID NO: 114454 - DNA, 15 bp, Homo sapiens
gagctgttttacaaa

SEQ ID NO: 114455 - DNA, 15 bp, Homo sapiens
agagctgttttacaa

SEQ ID NO: 114456 - DNA, 15 bp, Homo sapiens
aagagctgttttaca

SEQ ID NO: 114457 - DNA, 15 bp, Homo sapiens
aaagagctgttttac

SEQ ID NO: 114458 - DNA, 15 bp, Homo sapiens
aaaagagctgtttta

SEQ ID NO: 114459 - DNA, 15 bp, Homo sapiens
taaaagagctgtttt

SEQ ID NO: 114460 - DNA, 15 bp, Homo sapiens
ttaaaagagctgttt

SEQ ID NO: 114461 - DNA, 15 bp, Homo sapiens
attaaaagagctgtt

SEQ ID NO: 114462 - DNA, 15 bp, Homo sapiens
tattaaaagagctgt

SEQ ID NO: 114463 - DNA, 15 bp, Homo sapiens
ttattaaaagagctg

SEQ ID NO: 114464 - DNA, 15 bp, Homo sapiens
cttattaaaagagct

SEQ ID NO: 114465 - DNA, 15 bp, Homo sapiens
tcttattaaaagagc

SEQ ID NO: 114466 - DNA, 15 bp, Homo sapiens
atcttattaaaagag

SEQ ID NO: 114467 - DNA, 15 bp, Homo sapiens
tatcttattaaaaga

SEQ ID NO: 114468 - DNA, 15 bp, Homo sapiens
atatcttattaaaag

SEQ ID NO: 114469 - DNA, 15 bp, Homo sapiens
aatatcttattaaaa

SEQ ID NO: 114470 - DNA, 15 bp, Homo sapiens
aaatatcttattaaa

SEQ ID NO: 114471 - DNA, 15 bp, Homo sapiens
aaaatatcttattaa

SEQ ID NO: 114472 - DNA, 15 bp, Homo sapiens
aaaaatatcttatta

SEQ ID NO: 114473 - DNA, 15 bp, Homo sapiens
taaaaatatcttatt

SEQ ID NO: 114474 - DNA, 15 bp, Homo sapiens
ataaaaatatcttat

SEQ ID NO: 114475 - DNA, 15 bp, Homo sapiens
gataaaaatatctta

SEQ ID NO: 114476 - DNA, 15 bp, Homo sapiens
ggataaaaatatctt

SEQ ID NO: 114477 - DNA, 15 bp, Homo sapiens
aggataaaaatatct

SEQ ID NO: 114478 - DNA, 15 bp, Homo sapiens
caggataaaaatatc

SEQ ID NO: 114479 - DNA, 15 bp, Homo sapiens
tcaggataaaaatat

SEQ ID NO: 114480 - DNA, 15 bp, Homo sapiens
atcaggataaaaata

SEQ ID NO: 114481 - DNA, 15 bp, Homo sapiens
aatcaggataaaaat

SEQ ID NO: 114482 - DNA, 15 bp, Homo sapiens
gaatcaggataaaaa

SEQ ID NO: 114483 - DNA, 15 bp, Homo sapiens
ggaatcaggataaaa

SEQ ID NO: 114484 - DNA, 15 bp, Homo sapiens
tggaatcaggataaa

SEQ ID NO: 114485 - DNA, 15 bp, Homo sapiens
ttggaatcaggataa

SEQ ID NO: 114486 - DNA, 15 bp, Homo sapiens
tttggaatcaggata

SEQ ID NO: 114487 - DNA, 15 bp, Homo sapiens
ttttggaatcaggat

SEQ ID NO: 114488 - DNA, 15 bp, Homo sapiens
cttttggaatcagga

SEQ ID NO: 114489 - DNA, 15 bp, Homo sapiens
gcttttggaatcagg

SEQ ID NO: 114490 - DNA, 15 bp, Homo sapiens
tgcttttggaatcag

SEQ ID NO: 114491 - DNA, 15 bp, Homo sapiens
atgcttttggaatca

SEQ ID NO: 114492 - DNA, 15 bp, Homo sapiens
aatgcttttggaatc

SEQ ID NO: 114493 - DNA, 15 bp, Homo sapiens
taatgcttttggaat

SEQ ID NO: 114494 - DNA, 15 bp, Homo sapiens
gtaatgcttttggaa

SEQ ID NO: 114495 - DNA, 15 bp, Homo sapiens
tgtaatgcttttgga

SEQ ID NO: 114496 - DNA, 15 bp, Homo sapiens
atgtaatgcttttgg

SEQ ID NO: 114497 - DNA, 15 bp, Homo sapiens
aatgtaatgcttttg

SEQ ID NO: 114498 - DNA, 15 bp, Homo sapiens
gaatgtaatgctttt

SEQ ID NO: 114499 - DNA, 15 bp, Homo sapiens
tgaatgtaatgcttt

SEQ ID NO: 114500 - DNA, 15 bp, Homo sapiens
atgaatgtaatgctt

SEQ ID NO: 114501 - DNA, 15 bp, Homo sapiens
catgaatgtaatgct

SEQ ID NO: 114502 - DNA, 15 bp, Homo sapiens
ccatgaatgtaatgc

SEQ ID NO: 114503 - DNA, 15 bp, Homo sapiens
tccatgaatgtaatg

SEQ ID NO: 114504 - DNA, 15 bp, Homo sapiens
atccatgaatgtaat

SEQ ID NO: 114505 - DNA, 15 bp, Homo sapiens
gatccatgaatgtaa

SEQ ID NO: 114506 - DNA, 15 bp, Homo sapiens
tgatccatgaatgta

SEQ ID NO: 114507 - DNA, 15 bp, Homo sapiens
atgatccatgaatgt

SEQ ID NO: 114508 - DNA, 15 bp, Homo sapiens
gatgatccatgaatg

SEQ ID NO: 114509 - DNA, 15 bp, Homo sapiens
tgatgatccatgaat

SEQ ID NO: 114510 - DNA, 15 bp, Homo sapiens
ttgatgatccatgaa

SEQ ID NO: 114511 - DNA, 15 bp, Homo sapiens
cttgatgatccatga

SEQ ID NO: 114512 - DNA, 15 bp, Homo sapiens
ccttgatgatccatg

SEQ ID NO: 114513 - DNA, 15 bp, Homo sapiens
gccttgatgatccat

SEQ ID NO: 114514 - DNA, 15 bp, Homo sapiens
ggccttgatgatcca

SEQ ID NO: 114515 - DNA, 15 bp, Homo sapiens
aggccttgatgatcc

SEQ ID NO: 114516 - DNA, 15 bp, Homo sapiens
aaggccttgatgatc

SEQ ID NO: 114517 - DNA, 15 bp, Homo sapiens
aaaggccttgatgat

SEQ ID NO: 114518 - DNA, 15 bp, Homo sapiens
taaaggccttgatga

SEQ ID NO: 114519 - DNA, 15 bp, Homo sapiens
ataaaggccttgatg

SEQ ID NO: 114520 - DNA, 15 bp, Homo sapiens
tataaaggccttgat

SEQ ID NO: 114521 - DNA, 15 bp, Homo sapiens
ctataaaggccttga

SEQ ID NO: 114522 - DNA, 15 bp, Homo sapiens
cctataaaggccttg

SEQ ID NO: 114523 - DNA, 15 bp, Homo sapiens
acctataaaggcctt

SEQ ID NO: 114524 - DNA, 15 bp, Homo sapiens
tacctataaaggcct

SEQ ID NO: 114525 - DNA, 15 bp, Homo sapiens
atacctataaaggcc

SEQ ID NO: 114526 - DNA, 15 bp, Homo sapiens
aatacctataaaggc

SEQ ID NO: 114527 - DNA, 15 bp, Homo sapiens
taatacctataaagg

SEQ ID NO: 114528 - DNA, 15 bp, Homo sapiens
ataatacctataaag

SEQ ID NO: 114529 - DNA, 15 bp, Homo sapiens
aataatacctataaa

SEQ ID NO: 114530 - DNA, 15 bp, Homo sapiens
aaataatacctataa

SEQ ID NO: 114531 - DNA, 15 bp, Homo sapiens
aaaataatacctata

SEQ ID NO: 114532 - DNA, 15 bp, Homo sapiens
aaaaataatacctat

SEQ ID NO: 114533 - DNA, 15 bp, Homo sapiens
taaaaataataccta

SEQ ID NO: 114534 - DNA, 15 bp, Homo sapiens
ataaaaataatacct

SEQ ID NO: 114535 - DNA, 15 bp, Homo sapiens
tataaaaataatacc

SEQ ID NO: 114536 - DNA, 15 bp, Homo sapiens
atataaaaataatac

SEQ ID NO: 114537 - DNA, 15 bp, Homo sapiens
tatataaaaataata

SEQ ID NO: 114538 - DNA, 15 bp, Homo sapiens
ctatataaaaataat

SEQ ID NO: 114539 - DNA, 15 bp, Homo sapiens
actatataaaaataa

SEQ ID NO: 114540 - DNA, 15 bp, Homo sapiens
tactatataaaaata

SEQ ID NO: 114541 - DNA, 15 bp, Homo sapiens
gtactatataaaaat

SEQ ID NO: 114542 - DNA, 15 bp, Homo sapiens
agtactatataaaaa

SEQ ID NO: 114543 - DNA, 15 bp, Homo sapiens
aagtactatataaaa

SEQ ID NO: 114544 - DNA, 15 bp, Homo sapiens
taagtactatataaa

SEQ ID NO: 114545 - DNA, 15 bp, Homo sapiens
ttaagtactatataa

SEQ ID NO: 114546 - DNA, 15 bp, Homo sapiens
tttaagtactatata

SEQ ID NO: 114547 - DNA, 15 bp, Homo sapiens
ttttaagtactatat

SEQ ID NO: 114548 - DNA, 15 bp, Homo sapiens
cttttaagtactata

SEQ ID NO: 114549 - DNA, 15 bp, Homo sapiens
gcttttaagtactat

SEQ ID NO: 114550 - DNA, 15 bp, Homo sapiens
ggcttttaagtacta

SEQ ID NO: 114551 - DNA, 15 bp, Homo sapiens
aggcttttaagtact

SEQ ID NO: 114552 - DNA, 15 bp, Homo sapiens
taggcttttaagtac

SEQ ID NO: 114553 - DNA, 15 bp, Homo sapiens
ttaggcttttaagta

SEQ ID NO: 114554 - DNA, 15 bp, Homo sapiens
attaggcttttaagt

SEQ ID NO: 114555 - DNA, 15 bp, Homo sapiens
aattaggcttttaag

SEQ ID NO: 114556 - DNA, 15 bp, Homo sapiens
gaattaggcttttaa

SEQ ID NO: 114557 - DNA, 15 bp, Homo sapiens
tgaattaggctttta

SEQ ID NO: 114558 - DNA, 15 bp, Homo sapiens
gtgaattaggctttt

SEQ ID NO: 114559 - DNA, 15 bp, Homo sapiens
ggtgaattaggcttt

SEQ ID NO: 114560 - DNA, 15 bp, Homo sapiens
tggtgaattaggctt

SEQ ID NO: 114561 - DNA, 15 bp, Homo sapiens
gtggtgaattaggct

SEQ ID NO: 114562 - DNA, 15 bp, Homo sapiens
ggtggtgaattaggc

SEQ ID NO: 114563 - DNA, 15 bp, Homo sapiens
aggtggtgaattagg

SEQ ID NO: 114564 - DNA, 15 bp, Homo sapiens
aaggtggtgaattag

SEQ ID NO: 114565 - DNA, 15 bp, Homo sapiens
aaaggtggtgaatta

SEQ ID NO: 114566 - DNA, 15 bp, Homo sapiens
taaaggtggtgaatt

SEQ ID NO: 114567 - DNA, 15 bp, Homo sapiens
ttaaaggtggtgaat

SEQ ID NO: 114568 - DNA, 15 bp, Homo sapiens
tttaaaggtggtgaa

SEQ ID NO: 114569 - DNA, 15 bp, Homo sapiens
ttttaaaggtggtga

SEQ ID NO: 114570 - DNA, 15 bp, Homo sapiens
attttaaaggtggtg

SEQ ID NO: 114571 - DNA, 15 bp, Homo sapiens
gattttaaaggtggt

SEQ ID NO: 114572 - DNA, 15 bp, Homo sapiens
tgattttaaaggtgg

SEQ ID NO: 114573 - DNA, 15 bp, Homo sapiens
ttgattttaaaggtg

SEQ ID NO: 114574 - DNA, 15 bp, Homo sapiens
attgattttaaaggt

SEQ ID NO: 114575 - DNA, 15 bp, Homo sapiens
cattgattttaaagg

SEQ ID NO: 114576 - DNA, 15 bp, Homo sapiens
tcattgattttaaag

SEQ ID NO: 114577 - DNA, 15 bp, Homo sapiens
gtcattgattttaaa

SEQ ID NO: 114578 - DNA, 15 bp, Homo sapiens
tgtcattgattttaa

SEQ ID NO: 114579 - DNA, 15 bp, Homo sapiens
gtgtcattgatttta

SEQ ID NO: 114580 - DNA, 15 bp, Homo sapiens
tgtgtcattgatttt

SEQ ID NO: 114581 - DNA, 15 bp, Homo sapiens
atgtgtcattgattt

SEQ ID NO: 114582 - DNA, 15 bp, Homo sapiens
tatgtgtcattgatt

SEQ ID NO: 114583 - DNA, 15 bp, Homo sapiens
atatgtgtcattgat

SEQ ID NO: 114584 - DNA, 15 bp, Homo sapiens
aatatgtgtcattga

SEQ ID NO: 114585 - DNA, 15 bp, Homo sapiens
aaatatgtgtcattg

SEQ ID NO: 114586 - DNA, 15 bp, Homo sapiens
taaatatgtgtcatt

SEQ ID NO: 114587 - DNA, 15 bp, Homo sapiens
gtaaatatgtgtcat

SEQ ID NO: 114588 - DNA, 15 bp, Homo sapiens
tgtaaatatgtgtca

SEQ ID NO: 114589 - DNA, 15 bp, Homo sapiens
ctgtaaatatgtgtc

SEQ ID NO: 114590 - DNA, 15 bp, Homo sapiens
tctgtaaatatgtgt

SEQ ID NO: 114591 - DNA, 15 bp, Homo sapiens
ctctgtaaatatgtg

SEQ ID NO: 114592 - DNA, 15 bp, Homo sapiens
actctgtaaatatgt

SEQ ID NO: 114593 - DNA, 15 bp, Homo sapiens
cactctgtaaatatg

SEQ ID NO: 114594 - DNA, 15 bp, Homo sapiens
acactctgtaaatat

SEQ ID NO: 114595 - DNA, 15 bp, Homo sapiens
aacactctgtaaata

SEQ ID NO: 114596 - DNA, 15 bp, Homo sapiens
aaacactctgtaaat

SEQ ID NO: 114597 - DNA, 15 bp, Homo sapiens
taaacactctgtaaa

SEQ ID NO: 114598 - DNA, 15 bp, Homo sapiens
gtaaacactctgtaa

SEQ ID NO: 114599 - DNA, 15 bp, Homo sapiens
tgtaaacactctgta

SEQ ID NO: 114600 - DNA, 15 bp, Homo sapiens
ttgtaaacactctgt

SEQ ID NO: 114601 - DNA, 15 bp, Homo sapiens
tttgtaaacactctg

SEQ ID NO: 114602 - DNA, 15 bp, Homo sapiens
ctttgtaaacactct

SEQ ID NO: 114603 - DNA, 15 bp, Homo sapiens
tctttgtaaacactc

SEQ ID NO: 114604 - DNA, 15 bp, Homo sapiens
ttctttgtaaacact

SEQ ID NO: 114605 - DNA, 15 bp, Homo sapiens
attctttgtaaacac

SEQ ID NO: 114606 - DNA, 15 bp, Homo sapiens
aattctttgtaaaca

SEQ ID NO: 114607 - DNA, 15 bp, Homo sapiens
caattctttgtaaac

SEQ ID NO: 114608 - DNA, 15 bp, Homo sapiens
acaattctttgtaaa

SEQ ID NO: 114609 - DNA, 15 bp, Homo sapiens
cacaattctttgtaa

SEQ ID NO: 114610 - DNA, 15 bp, Homo sapiens
gcacaattctttgta

SEQ ID NO: 114611 - DNA, 15 bp, Homo sapiens
agcacaattctttgt

SEQ ID NO: 114612 - DNA, 15 bp, Homo sapiens
cagcacaattctttg

SEQ ID NO: 114613 - DNA, 15 bp, Homo sapiens
tcagcacaattcttt

SEQ ID NO: 114614 - DNA, 15 bp, Homo sapiens
ctcagcacaattctt

SEQ ID NO: 114615 - DNA, 15 bp, Homo sapiens
actcagcacaattct

SEQ ID NO: 114616 - DNA, 15 bp, Homo sapiens
aactcagcacaattc

SEQ ID NO: 114617 - DNA, 15 bp, Homo sapiens
aaactcagcacaatt

SEQ ID NO: 114618 - DNA, 15 bp, Homo sapiens
taaactcagcacaat

SEQ ID NO: 114619 - DNA, 15 bp, Homo sapiens
ttaaactcagcacaa

SEQ ID NO: 114620 - DNA, 15 bp, Homo sapiens
attaaactcagcaca

SEQ ID NO: 114621 - DNA, 15 bp, Homo sapiens
aattaaactcagcac

SEQ ID NO: 114622 - DNA, 15 bp, Homo sapiens
gaattaaactcagca

SEQ ID NO: 114623 - DNA, 15 bp, Homo sapiens
agaattaaactcagc

SEQ ID NO: 114624 - DNA, 15 bp, Homo sapiens
aagaattaaactcag

SEQ ID NO: 114625 - DNA, 15 bp, Homo sapiens
gaagaattaaactca

SEQ ID NO: 114626 - DNA, 15 bp, Homo sapiens
agaagaattaaactc

SEQ ID NO: 114627 - DNA, 15 bp, Homo sapiens
aagaagaattaaact

SEQ ID NO: 114628 - DNA, 15 bp, Homo sapiens
aaagaagaattaaac

SEQ ID NO: 114629 - DNA, 15 bp, Homo sapiens
taaagaagaattaaa

SEQ ID NO: 114630 - DNA, 15 bp, Homo sapiens
ttaaagaagaattaa

SEQ ID NO: 114631 - DNA, 15 bp, Homo sapiens
attaaagaagaatta

SEQ ID NO: 114632 - DNA, 15 bp, Homo sapiens
tattaaagaagaatt

SEQ ID NO: 114633 - DNA, 15 bp, Homo sapiens
ttattaaagaagaat

SEQ ID NO: 114634 - DNA, 15 bp, Homo sapiens
gttattaaagaagaa

SEQ ID NO: 114635 - DNA, 15 bp, Homo sapiens
tgttattaaagaaga

SEQ ID NO: 114636 - DNA, 15 bp, Homo sapiens
atgttattaaagaag

SEQ ID NO: 114637 - DNA, 15 bp, Homo sapiens
aatgttattaaagaa

SEQ ID NO: 114638 - DNA, 15 bp, Homo sapiens
aaatgttattaaaga

SEQ ID NO: 114639 - DNA, 15 bp, Homo sapiens
aaaatgttattaaag

SEQ ID NO: 114640 - DNA, 15 bp, Homo sapiens
taaaatgttattaaa

SEQ ID NO: 114641 - DNA, 15 bp, Homo sapiens
ttaaaatgttattaa

SEQ ID NO: 114642 - DNA, 15 bp, Homo sapiens
tttaaaatgttatta

SEQ ID NO: 114643 - DNA, 15 bp, Homo sapiens
gttttaaaatgttat

SEQ ID NO: 114644 - DNA, 15 bp, Homo sapiens
ggttttaaaatgtta

SEQ ID NO: 114645 - DNA, 15 bp, Homo sapiens
tggttttaaaatgtt

SEQ ID NO: 114646 - DNA, 15 bp, Homo sapiens
ttggttttaaaatgt

SEQ ID NO: 114647 - DNA, 15 bp, Homo sapiens
attggttttaaaatg

SEQ ID NO: 114648 - DNA, 15 bp, Homo sapiens
tattggttttaaaat

SEQ ID NO: 114649 - DNA, 15 bp, Homo sapiens
ttattggttttaaaa

SEQ ID NO: 114650 - DNA, 15 bp, Homo sapiens
cttattggttttaaa

SEQ ID NO: 114651 - DNA, 15 bp, Homo sapiens
acttattggttttaa

SEQ ID NO: 114652 - DNA, 15 bp, Homo sapiens
tacttattggtttta

SEQ ID NO: 114653 - DNA, 15 bp, Homo sapiens
ttacttattggtttt

SEQ ID NO: 114654 - DNA, 15 bp, Homo sapiens
attacttattggttt

SEQ ID NO: 114655 - DNA, 15 bp, Homo sapiens
gattacttattggtt

SEQ ID NO: 114656 - DNA, 15 bp, Homo sapiens
agattacttattggt

SEQ ID NO: 114657 - DNA, 15 bp, Homo sapiens
aagattacttattgg

SEQ ID NO: 114658 - DNA, 15 bp, Homo sapiens
aaagattacttattg

SEQ ID NO: 114659 - DNA, 15 bp, Homo sapiens
gaaagattacttatt

SEQ ID NO: 114660 - DNA, 15 bp, Homo sapiens
agaaagattacttat

SEQ ID NO: 114661 - DNA, 15 bp, Homo sapiens
tagaaagattactta

SEQ ID NO: 114662 - DNA, 15 bp, Homo sapiens
atagaaagattactt

SEQ ID NO: 114663 - DNA, 15 bp, Homo sapiens
aatagaaagattact

SEQ ID NO: 114664 - DNA, 15 bp, Homo sapiens
caatagaaagattac

SEQ ID NO: 114665 - DNA, 15 bp, Homo sapiens
gcaatagaaagatta

SEQ ID NO: 114666 - DNA, 15 bp, Homo sapiens
tgcaatagaaagatt

SEQ ID NO: 114667 - DNA, 15 bp, Homo sapiens
ttgcaatagaaagat

SEQ ID NO: 114668 - DNA, 15 bp, Homo sapiens
tttgcaatagaaaga

SEQ ID NO: 114669 - DNA, 15 bp, Homo sapiens
gtttgcaatagaaag

SEQ ID NO: 114670 - DNA, 15 bp, Homo sapiens
agtttgcaatagaaa

SEQ ID NO: 114671 - DNA, 15 bp, Homo sapiens
aagtttgcaatagaa

SEQ ID NO: 114672 - DNA, 15 bp, Homo sapiens
aaagtttgcaataga

SEQ ID NO: 114673 - DNA, 15 bp, Homo sapiens
gaaagtttgcaatag

SEQ ID NO: 114674 - DNA, 15 bp, Homo sapiens
tgaaagtttgcaata

SEQ ID NO: 114675 - DNA, 15 bp, Homo sapiens
ctgaaagtttgcaat

SEQ ID NO: 114676 - DNA, 15 bp, Homo sapiens
tctgaaagtttgcaa

SEQ ID NO: 114677 - DNA, 15 bp, Homo sapiens
atctgaaagtttgca

SEQ ID NO: 114678 - DNA, 15 bp, Homo sapiens
catctgaaagtttgc

SEQ ID NO: 114679 - DNA, 15 bp, Homo sapiens
acatctgaaagtttg

SEQ ID NO: 114680 - DNA, 15 bp, Homo sapiens
tacatctgaaagttt

SEQ ID NO: 114681 - DNA, 15 bp, Homo sapiens
ttacatctgaaagtt

SEQ ID NO: 114682 - DNA, 15 bp, Homo sapiens
tttacatctgaaagt

SEQ ID NO: 114683 - DNA, 15 bp, Homo sapiens
ctttacatctgaaag

SEQ ID NO: 114684 - DNA, 15 bp, Homo sapiens
tctttacatctgaaa

SEQ ID NO: 114685 - DNA, 15 bp, Homo sapiens
ttctttacatctgaa

SEQ ID NO: 114686 - DNA, 15 bp, Homo sapiens
gttctttacatctga

SEQ ID NO: 114687 - DNA, 15 bp, Homo sapiens
agttctttacatctg

SEQ ID NO: 114688 - DNA, 15 bp, Homo sapiens
aagttctttacatct

SEQ ID NO: 114689 - DNA, 15 bp, Homo sapiens
taagttctttacatc

SEQ ID NO: 114690 - DNA, 15 bp, Homo sapiens
ctaagttctttacat

SEQ ID NO: 114691 - DNA, 15 bp, Homo sapiens
cctaagttctttaca

SEQ ID NO: 114692 - DNA, 15 bp, Homo sapiens
tcctaagttctttac

SEQ ID NO: 114693 - DNA, 15 bp, Homo sapiens
ttcctaagttcttta

SEQ ID NO: 114694 - DNA, 15 bp, Homo sapiens
attcctaagttcttt

SEQ ID NO: 114695 - DNA, 15 bp, Homo sapiens
tattcctaagttctt

SEQ ID NO: 114696 - DNA, 15 bp, Homo sapiens
ctattcctaagttct

SEQ ID NO: 114697 - DNA, 15 bp, Homo sapiens
tctattcctaagttc

SEQ ID NO: 114698 - DNA, 15 bp, Homo sapiens
ttctattcctaagtt

SEQ ID NO: 114699 - DNA, 15 bp, Homo sapiens
attctattcctaagt

SEQ ID NO: 114700 - DNA, 15 bp, Homo sapiens
aattctattcctaag

SEQ ID NO: 114701 - DNA, 15 bp, Homo sapiens
aaattctattcctaa

SEQ ID NO: 114702 - DNA, 15 bp, Homo sapiens
aaaattctattccta

SEQ ID NO: 114703 - DNA, 15 bp, Homo sapiens
taaaattctattcct

SEQ ID NO: 114704 - DNA, 15 bp, Homo sapiens
ttaaaattctattcc

SEQ ID NO: 114705 - DNA, 15 bp, Homo sapiens
tttaaaattctattc

SEQ ID NO: 114706 - DNA, 15 bp, Homo sapiens
ttttaaaattctatt

SEQ ID NO: 114707 - DNA, 15 bp, Homo sapiens
tttttaaaattctat

SEQ ID NO: 114708 - DNA, 15 bp, Homo sapiens
ttttttaaaattcta

SEQ ID NO: 114709 - DNA, 15 bp, Homo sapiens
attttttaaaattct

SEQ ID NO: 114710 - DNA, 15 bp, Homo sapiens
gattttttaaaattc

SEQ ID NO: 114711 - DNA, 15 bp, Homo sapiens
tgattttttaaaatt

SEQ ID NO: 114712 - DNA, 15 bp, Homo sapiens
ttgattttttaaaat

SEQ ID NO: 114713 - DNA, 15 bp, Homo sapiens
attgattttttaaaa

SEQ ID NO: 114714 - DNA, 15 bp, Homo sapiens
tattgattttttaaa

SEQ ID NO: 114715 - DNA, 15 bp, Homo sapiens
gtattgattttttaa

SEQ ID NO: 114716 - DNA, 15 bp, Homo sapiens
tgtattgatttttta
